United States Patent 11,640,849 (METHODS FOR HISTOLOGICAL DIAGNOSIS AND TREATMENT OF DISEASES) - sequence listing, part 50

SEQ ID NO: 1905037 - protein, 22 aa, Staphylococcus
SYLLCIFIFFVLAKIDLYKKAL

SEQ ID NO: 1905038 - protein, 18 aa, Staphylococcus
SYLLFFQGSSLKGTFLIV

SEQ ID NO: 1905039 - protein, 19 aa, Staphylococcus
SYLMLFIALEPIRAINNFI

SEQ ID NO: 1905040 - protein, 24 aa, Staphylococcus
SYLSGSLPMFLIYLKNANTITYTI

SEQ ID NO: 1905041 - protein, 27 aa, Staphylococcus
SYLTLFLNFIILIISIIFILFGMPIYL

SEQ ID NO: 1905042 - protein, 27 aa, Staphylococcus
SYLTLFLNFIILLISIVFILFGTPIYL

SEQ ID NO: 1905043 - protein, 28 aa, Staphylococcus
SYLTLFLNFVILFISIILIIFGVPIYLV

SEQ ID NO: 1905044 - protein, 20 aa, Staphylococcus
SYMIIFGVILSFIFGIPLGT

SEQ ID NO: 1905045 - protein, 31 aa, Staphylococcus
SYMPELDWHYSYFVFIAISLVVVVSLITLFK

SEQ ID NO: 1905046 - protein, 26 aa, Staphylococcus
SYNDEFLVHLTFVPLLFLGRYTHMPY

SEQ ID NO: 1905047 - protein, 17 aa, Staphylococcus
SYPLLIIVPACLITVTI

SEQ ID NO: 1905048 - protein, 31 aa, Staphylococcus
SYTEWVKFVWKPILIWIMICSVAMSIALVIG

SEQ ID NO: 1905049 - protein, 24 aa, Staphylococcus
SYTLLYSTLLLIVALILRIMGDFN

SEQ ID NO: 1905050 - protein, 25 aa, Staphylococcus
SYYEAVVLGFYFIYRLIAVHPQDIV

SEQ ID NO: 1905051 - protein, 23 aa, Staphylococcus
TAALLLIILQIVTGALSIFTHVN

SEQ ID NO: 1905052 - protein, 17 aa, Staphylococcus
TAALTLGLLFIGINKFT

SEQ ID NO: 1905053 - protein, 38 aa, Staphylococcus
TAAQPLIFGILLLVVTVVPFYIFTALKIAGPSSTFFIV

SEQ ID NO: 1905054 - protein, 24 aa, Staphylococcus
TADLKTRIRMDNKNYRGTTDYYIH

SEQ ID NO: 1905055 - protein, 17 aa, Staphylococcus
TADWLYPFFKQAAVTFY

SEQ ID NO: 1905056 - protein, 22 aa, Staphylococcus
TAFAFICWLVISIAIFAVRHIC

SEQ ID NO: 1905057 - protein, 23 aa, Staphylococcus
TAFSLLIKFLLPNILNSGRLYTI

SEQ ID NO: 1905058 - protein, 21 aa, Staphylococcus
TAFSLLIKFLLPNVLNNGKLY

SEQ ID NO: 1905059 - protein, 23 aa, Staphylococcus
TAFSLLIKFLLPNVLNTGKLYTI

SEQ ID NO: 1905060 - protein, 24 aa, Staphylococcus
TAGIITWLLTALGAAAVFVFKKVN

SEQ ID NO: 1905061 - protein, 25 aa, Staphylococcus
TAGILILMIIVFCINIFGTKLFEIV

SEQ ID NO: 1905062 - protein, 21 aa, Staphylococcus
TAGTPAPVTNNGATGTPGTTA

SEQ ID NO: 1905063 - protein, 27 aa, Staphylococcus
TAGTVLRASFIRLANPTGKAAKEIEKM

SEQ ID NO: 1905064 - protein, 23 aa, Staphylococcus
TAHPNFLWFDLTKPDILITIIAG

SEQ ID NO: 1905065 - protein, 17 aa, Staphylococcus
TAIATIGALLPLLFGQD

SEQ ID NO: 1905066 - protein, 18 aa, Staphylococcus
TAIFLAAIMNFIGALTFT

SEQ ID NO: 1905067 - protein, 31 aa, Staphylococcus
TAIIMMVTAPFIPMFYIIFGLKTRDESKDQM

SEQ ID NO: 1905068 - protein, 29 aa, Staphylococcus
TAINVLPIFIVPLVVERKKIKSHPDVQKA

SEQ ID NO: 1905069 - protein, 30 aa, Staphylococcus
TAINVLPIIIVPLVVERKKIKEHPDVKKAT

SEQ ID NO: 1905070 - protein, 28 aa, Staphylococcus
TAINVLPIIIVPLVVERKRIKSHPEVQK

SEQ ID NO: 1905071 - protein, 21 aa, Staphylococcus
TAIQEKLRQDAVEKLIAVAER

SEQ ID NO: 1905072 - protein, 30 aa, Staphylococcus
TAISVFGFLKPYIIGIWNGIKTASMIIWGL

SEQ ID NO: 1905073 - protein, 20 aa, Staphylococcus
TAKELLATTVQRLAADHTTE

SEQ ID NO: 1905074 - protein, 22 aa, Staphylococcus
TALFLLCFYFLPNLNRYNETRS

SEQ ID NO: 1905075 - protein, 31 aa, Staphylococcus
TALIMIVTAPFIPIFYIIFGLKTRDESKDKM

SEQ ID NO: 1905076 - protein, 32 aa, Staphylococcus
TALIMMVTAPFIPVFYILFGLKTRDESKDQMT

SEQ ID NO: 1905077 - protein, 17 aa, Staphylococcus
TALLLLIPIFISYKEGL

SEQ ID NO: 1905078 - protein, 18 aa, Staphylococcus
TALTGWLKGMQGANIVVL

SEQ ID NO: 1905079 - protein, 18 aa, Staphylococcus
TALVLLFKDKRQKQHSVL

SEQ ID NO: 1905080 - protein, 19 aa, Staphylococcus
TAMHGLRESIKDKAEIKNS

SEQ ID NO: 1905081 - protein, 20 aa, Staphylococcus
TAMIFMTLFYYRDSDRMMKQ

SEQ ID NO: 1905082 - protein, 38 aa, Staphylococcus
TAPFKARMILGFVMSFLNAIFIAMPIFLAANVFNRMLT

SEQ ID NO: 1905083 - protein, 27 aa, Staphylococcus
TAPVLAFLPVIVIGILFGLAMDYEVFL

SEQ ID NO: 1905084 - protein, 28 aa, Staphylococcus
TASDYIQGLPRAAELKAITYFNENVQSN

SEQ ID NO: 1905085 - protein, 37 aa, Staphylococcus
TASFKWYDFVYFIDTFIYLFILIFKNNWLDKRVFSKK

SEQ ID NO: 1905086 - protein, 37 aa, Staphylococcus
TASFKWYDFVYFIDTIIYLFVLIFKQKWLDKRVFSKK

SEQ ID NO: 1905087 - protein, 25 aa, Staphylococcus
TASKFLPYLLLITIILHIAASLVSF

SEQ ID NO: 1905088 - protein, 28 aa, Staphylococcus
TASKRLPWLLILTFLGMITATILGSFED

SEQ ID NO: 1905089 - protein, 25 aa, Staphylococcus
TASSFLFLVPLFSTLFSIIGLREPF

SEQ ID NO: 1905090 - protein, 30 aa, Staphylococcus
TATQALTKVFTLLFGKASLVRTVFGLLVGV

SEQ ID NO: 1905091 - protein, 27 aa, Staphylococcus
TATSNVYFMNFRLQEPSHLFSKADHKN

SEQ ID NO: 1905092 - protein, 19 aa, Staphylococcus
TAVFLCRFVPVLRVLITIP

SEQ ID NO: 1905093 - protein, 37 aa, Staphylococcus
TAVFLSRLLLSLLVYSNLFKKKYWLFGVKKADRHDIS

SEQ ID NO: 1905094 - protein, 27 aa, Staphylococcus
TAVPGVTLFLLLRAFSSGASSLTGIEA

SEQ ID NO: 1905095 - protein, 26 aa, Staphylococcus
TAWSPYLMVVILLLLTRTVPLIKDFT

SEQ ID NO: 1905096 - protein, 36 aa, Staphylococcus
TCLLLFVMMMIQWLMHQPLSLFFYAKSFAVIFIYEW

SEQ ID NO: 1905097 - protein, 26 aa, Staphylococcus
TCLWFLFCVFIFQYIKLLFSKPKFKV

SEQ ID NO: 1905098 - protein, 30 aa, Staphylococcus
TCSWKWTLIALFYPIVTAYLLTLAFYQISN

SEQ ID NO: 1905099 - protein, 17 aa, Staphylococcus
TCVFVPIIFKKMFPIPD

SEQ ID NO: 1905100 - protein, 23 aa, Staphylococcus
TCYALLLYMSWSSALGRISTHKQ

SEQ ID NO: 1905101 - protein, 27 aa, Staphylococcus
TDEQKAKLIDYLEKLRRDTLKEIDKSH

SEQ ID NO: 1905102 - protein, 31 aa, Staphylococcus
TDGGLSWSPDHKSIIYRYDATKGSSITLNQI

SEQ ID NO: 1905103 - protein, 25 aa, Staphylococcus
TDGNGHVIITPTTPIVEGNVIAKAY

SEQ ID NO: 1905104 - protein, 24 aa, Staphylococcus
TDHLPLFLILRFVQGLTGGGAIVI

SEQ ID NO: 1905105 - protein, 22 aa, Staphylococcus
TDIVQFFMYLSAAINLLLSKIN

SEQ ID NO: 1905106 - protein, 29 aa, Staphylococcus
TDIYSIGVVLYEMLIGKPPFSGETAVSIA

SEQ ID NO: 1905107 - protein, 36 aa, Staphylococcus
TDNLKEVPLILLITIIIDVFLALITSYLVSKRLTKP

SEQ ID NO: 1905108 - protein, 26 aa, Staphylococcus
TDNLPRFFVYLLLFMFSMIGIVIANN

SEQ ID NO: 1905109 - protein, 25 aa, Staphylococcus
TDPNTQVALIDKNGRIFGAGTTDSS

SEQ ID NO: 1905110 - protein, 20 aa, Staphylococcus
TDQQFPPRNAQRRQRRRNQS

SEQ ID NO: 1905111 - protein, 28 aa, Staphylococcus
TDQRPLIMGILVAVIFGLALTAPISSAA

SEQ ID NO: 1905112 - protein, 34 aa, Staphylococcus
TDQSVFKKALKRLPWLIILTFLGMITATILGGFE

SEQ ID NO: 1905113 - protein, 23 aa, Staphylococcus
TDQYFLIFLLLVVILYPIHKAIH

SEQ ID NO: 1905114 - protein, 18 aa, Staphylococcus
TDSWRALQDKLTEARNII

SEQ ID NO: 1905115 - protein, 22 aa, Staphylococcus
TDTITVLFIITTGLIGSMMGSM

SEQ ID NO: 1905116 - protein, 17 aa, Staphylococcus
TDVIFIPLLGIMLGGIV

SEQ ID NO: 1905117 - protein, 28 aa, Staphylococcus
TDWQTYIMIAIYFIILLIIGYYGYRQAT

SEQ ID NO: 1905118 - protein, 26 aa, Staphylococcus
TDYSYLYIDLFFILSQLLFIFSLFFL

SEQ ID NO: 1905119 - protein, 24 aa, Staphylococcus
TEAASGFLALIEAGPDKVNQYSDS

SEQ ID NO: 1905120 - protein, 20 aa, Staphylococcus
TEAINKLQPLANNEALKVAR

SEQ ID NO: 1905121 - protein, 23 aa, Staphylococcus
TEAMAQYRDVVTKRYALPETGET

SEQ ID NO: 1905122 - protein, 23 aa, Staphylococcus
TEDDVYFLLVQRNRDKSFYAAEI

SEQ ID NO: 1905123 - protein, 30 aa, Staphylococcus; identical to SEQ ID NO: 1589532

SEQ ID NO: 1905124 - protein, 25 aa, Staphylococcus
TEDNRFYEHGALDYKRLFGAVGKNL

SEQ ID NO: 1905125 - protein, 27 aa, Staphylococcus
TEFNNTFVPPTPPTPVFQPEKFDLSVE

SEQ ID NO: 1905126 - protein, 20 aa, Staphylococcus
TEFYYRMMRMGLKGSVSTDA

SEQ ID NO: 1905127 - protein, 18 aa, Staphylococcus
TEGKYYKYFVYKDDNKHK

SEQ ID NO: 1905128 - protein, 25 aa, Staphylococcus
TEGTIMLMIMTWMMGITFSHTLLLF

SEQ ID NO: 1905129 - protein, 34 aa, Staphylococcus
TEGWRSFNYVILPLILSLIIIAWFGFRQFKLDDP

SEQ ID NO: 1905130 - protein, 24 aa, Staphylococcus
TEIIQMLCILLFSDNTEHAWTLVK

SEQ ID NO: 1905131 - protein, 39 aa, Staphylococcus
TEILDLQKNMWKYLSLIGIIVLIAIYLAVRSINRTYIRP

SEQ ID NO: 1905132 - protein, 39 aa, Staphylococcus
TEILELQKSMWKYLSLIGIIVLLAIYLAVRSINRTYIRP

SEQ ID NO: 1905133 - protein, 26 aa, Staphylococcus
TEILIASLLLIVFMFIAIKGASVSGS

SEQ ID NO: 1905134 - protein, 22 aa, Staphylococcus
TEIVQFFMYLSAAINLLMLKVN

SEQ ID NO: 1905135 - protein, 39 aa, Staphylococcus
TEKMALLYARPLYYFGNVMKPLIWLMNGSARVILRVFGV

SEQ ID NO: 1905136 - protein, 20 aa, Staphylococcus
TEKQSLLENYYQTHTNATAS

SEQ ID NO: 1905137 - protein, 30 aa, Staphylococcus
TEKVLGWLSWVFLLILTIVTMFIALVSFSN

SEQ ID NO: 1905138 - protein, 25 aa, Staphylococcus
TELQPILMCMLISMVFSFIIISPLS

SEQ ID NO: 1905139 - protein, 33 aa, Staphylococcus
TEMDGHGIITPREPLPLGKIYARATDGAETPNS

SEQ ID NO: 1905140 - protein, 26 aa, Staphylococcus
TEMSPILLAWIVAAVLRIALGSSTVA

SEQ ID NO: 1905141 - protein, 51 aa, Staphylococcus
TEPHNLLFLIVITVLVALAVYLFRFLWVYVLYPYFYLAVSPFQKMISQDDD

SEQ ID NO: 1905142 - protein, 50 aa, Staphylococcus
TEPHNLLFLVVITALVALAVYLFRFIWVYVLYPLFYLSVSPFQKLMNEEG

SEQ ID NO: 1905143 - protein, 24 aa, Staphylococcus
TEPKIHTTLIHKANTKTPVKVTTD

SEQ ID NO: 1905144 - protein, 48 aa, Staphylococcus
TEPLEFSFLFVAPLLFFIHAVLDGLSFLILYLLDLHLGYTFSGGFIDF

SEQ ID NO: 1905145 - protein, 33 aa, Staphylococcus
TEPLEFSFLFVAPLLFFIHAVLDGLSFLTLYLL

SEQ ID NO: 1905146 - protein, 34 aa, Staphylococcus
TEPLEFSFLFVAPLLFFIHAVLDGLSFLTLYLLH

SEQ ID NO: 1905147 - protein, 27 aa, Staphylococcus
TEPLEFTFLFIAPYLFVIHALLAATMD

SEQ ID NO: 1905148 - protein, 24 aa, Staphylococcus
TEQIARIVFILIGSFLVLNVFHGS

SEQ ID NO: 1905149 - protein, 24 aa, Staphylococcus
TEQLARIIFILIGSYLVLNVFHGT

SEQ ID NO: 1905150 - protein, 32 aa, Staphylococcus
TEQQPLIMGILVSVLFGLALTAPISSAALALM

SEQ ID NO: 1905151 - protein, 29 aa, Staphylococcus
TESRKFKIFSLISMIAIAGLAIFRFIHRM

SEQ ID NO: 1905152 - protein, 31 aa, Staphylococcus
TETKQPRFYLWLIIGLIFGFAPPLQTTINSS

SEQ ID NO: 1905153 - protein, 24 aa, Staphylococcus
TETPLRYSIPFNEDNRYLVMPALS

SEQ ID NO: 1905154 - protein, 25 aa, Staphylococcus
TETPLRYVLPFNNENKYLVMPALSD

SEQ ID NO: 1905155 - protein, 30 aa, Staphylococcus
TEVQATPPRTFARFSSLSQPASTSSNASAQ

SEQ ID NO: 1905156 - protein, 21 aa, Staphylococcus
TFAIAFLLRPVGGIIFGIIGD

SEQ ID NO: 1905157 - protein, 27 aa, Staphylococcus
TFCIIMVFALLGFLIYNVNPAKVFMGD

SEQ ID NO: 1905158 - protein, 19 aa, Staphylococcus
TFCLCVIIAISLFWDLGSL

SEQ ID NO: 1905159 - protein, 26 aa, Staphylococcus
TFCSIVIYIIIYKLLNKIPINKKIKY

SEQ ID NO: 1905160 - protein, 17 aa, Staphylococcus
TFDFNKIILEEKIIPMG

SEQ ID NO: 1905161 - protein, 31 aa, Staphylococcus
TFDLKGPYWMYVIIFIIFTISYTALAIFTEV

SEQ ID NO: 1905162 - protein, 26 aa, Staphylococcus
TFDPIIFIILCAGIVVWLFGVHPFVV

SEQ ID NO: 1905163 - protein, 32 aa, Staphylococcus
TFDPIIFVLWCIGILLWIVGVHPYLAFFPIVG

SEQ ID NO: 1905164 - protein, 29 aa, Staphylococcus
TFEKNYKFIKHIMVGLLSIIVLGSILIVL

SEQ ID NO: 1905165 - protein, 18 aa, Staphylococcus
TFFGILIHIAFHEYILPK

SEQ ID NO: 1905166 - protein, 19 aa, Staphylococcus
TFFIFMFAAWFIVSSIIGL

SEQ ID NO: 1905167 - protein, 20 aa, Staphylococcus
TFHSYHDLEFLLVTREDEYK

SEQ ID NO: 1905168 - protein, 17 aa, Staphylococcus
TFIATIVSVPIGLGAAI

SEQ ID NO: 1905169 - protein, 26 aa, Staphylococcus
TFIFGLVFGLLFYWSNNIWLTGAAHS

SEQ ID NO: 1905170 - protein, 20 aa, Staphylococcus
TFIFIWIGIVLYSTSQYLKM

SEQ ID NO: 1905171 - protein, 21 aa, Staphylococcus
TFIIPIIIMLLMVVQAIISKN

SEQ ID NO: 1905172 - protein, 20 aa, Staphylococcus
TFIITFLLSQLLYLILRKYI

SEQ ID NO: 1905173 - protein, 25 aa, Staphylococcus
TFIIYLFAIWFIINAIFNIFTVTPA

SEQ ID NO: 1905174 - protein, 24 aa, Staphylococcus
TFIKFLIVMILSILPLALVKILQS

SEQ ID NO: 1905175 - protein, 51 aa, Staphylococcus
TFIMAFFMMISSYIMMFVLDVKLALIALIFLPIIMIILASYRKYSAFLFSK

SEQ ID NO: 1905176 - protein, 20 aa, Staphylococcus
TFIMALFYFVSVSVQLYQMK

SEQ ID NO: 1905177 - protein, 20 aa, Staphylococcus
TFIVLLALTAFFVATEFAIV

SEQ ID NO: 1905178 - protein, 35 aa, Staphylococcus
TFIVVSTLIFLFIGKPIKLLIIAGALNGLILPITL

SEQ ID NO: 1905179 - protein, 22 aa, Staphylococcus
TFKGNITILMTPARSIVKENFK

SEQ ID NO: 1905180 - protein, 25 aa, Staphylococcus
TFLFIYKFFKPFYKISYLLLIIIFL

SEQ ID NO: 1905181 - protein, 22 aa, Staphylococcus
TFLGIVSLFAWGLGYFGQPHII

SEQ ID NO: 1905182 - protein, 22 aa, Staphylococcus
TFLGMISLFAWGLGYFGQPHII

SEQ ID NO: 1905183 - protein, 19 aa, Staphylococcus
TFLKAVGIIILFFGILLMN

SEQ ID NO: 1905184 - protein, 27 aa, Staphylococcus
TFLLEQVPIIFILIYATLRGMINATET

SEQ ID NO: 1905185 - protein, 17 aa, Staphylococcus
TFLLTYLTDENPAVTIL

SEQ ID NO: 1905186 - protein, 25 aa, Staphylococcus
TFLTAFFCMSLHLNPIYATLSAIVT

SEQ ID NO: 1905187 - protein, 19 aa, Staphylococcus
TFLTMRTILTLKGYRYIAA

SEQ ID NO: 1905188 - protein, 23 aa, Staphylococcus
TFLTMRTILTLKGYRYVAAVVSF

SEQ ID NO: 1905189 - protein, 25 aa, Staphylococcus
TFLTSLFCLMLDLTPIFAILTAIVT

SEQ ID NO: 1905190 - protein, 26 aa, Staphylococcus
TFLTSLFCMLLHLTPIFAILTAIVTI

SEQ ID NO: 1905191 - protein, 25 aa, Staphylococcus
TFLTTLFCLLLNLTPIFAILTAIVS

SEQ ID NO: 1905192 - protein, 24 aa, Staphylococcus
TFMNYVKLIWFVSSLGLLAGAMGS

SEQ ID NO: 1905193 - protein, 19 aa, Staphylococcus
TFMTPLGQSPLALGADIVI

SEQ ID NO: 1905194 - protein, 19 aa, Staphylococcus
TFMTPLSQSPLALGADIVV

SEQ ID NO: 1905195 - protein, 30 aa, Staphylococcus
TFNIINMPMLILSLLFFAIGTYFVFQIQRK

SEQ ID NO: 1905196 - protein, 21 aa, Staphylococcus
TFPITLFIGLAIIFLFILVVF

SEQ ID NO: 1905197 - protein, 20 aa, Staphylococcus
TFSDGREINIPKGKDGKSVT

SEQ ID NO: 1905198 - protein, 32 aa, Staphylococcus
TFSEFRTFLAVLLICLLGISITLVIASTYSII

SEQ ID NO: 1905199 - protein, 23 aa, Staphylococcus
TFSFFIYLMHPLILDALYSYTST

SEQ ID NO: 1905200 - protein, 18 aa, Staphylococcus
TFSSLLNYGIDGLISFNN

SEQ ID NO: 1905201 - protein, 25 aa, Staphylococcus
TFTHSLLFIAIIVCLLYVIQTSSYY

SEQ ID NO: 1905202 - protein, 28 aa, Staphylococcus
TFTHSLLFLGMIGFLLILIQTPTYYLVT

SEQ ID NO: 1905203 - protein, 31 aa, Staphylococcus
TFTLAFINFFIPFLLVFILDGFKGIKETLPA

SEQ ID NO: 1905204 - protein, 24 aa, Staphylococcus
TFTNYLRLIWFVASLGLLAGAMGS

SEQ ID NO: 1905205 - protein, 21 aa, Staphylococcus
TFTTPHYLLLVVGIIVIVMMT

SEQ ID NO: 1905206 - protein, 24 aa, Staphylococcus
TFVFIWIGIIIYSISQYFKIKKDK

SEQ ID NO: 1905207 - protein, 27 aa, Staphylococcus
TFVGPFFIWLYAPLIQNVFWLGVALGA

SEQ ID NO: 1905208 - protein, 17 aa, Staphylococcus
TFVLGLIIALFTALMRI

SEQ ID NO: 1905209 - protein, 25 aa, Staphylococcus
TFVSLFFPIVILAVPFIDTLFAMIR

SEQ ID NO: 1905210 - protein, 25 aa, Staphylococcus
TFVYLYPQFFFGIIVFFLVGWLTIR

SEQ ID NO: 1905211 - protein, 30 aa, Staphylococcus
TFYKFKFILIMLIILLLSSMVLFISGLAQG

SEQ ID NO: 1905212 - protein, 18 aa, Staphylococcus
TFYLHGYAGTGNSMKLLV

SEQ ID NO: 1905213 - protein, 24 aa, Staphylococcus
TFYMAAFLAILLTVGHIKGYLTVT

SEQ ID NO: 1905214 - protein, 28 aa, Staphylococcus
TGALILFGIAFIIGLFRLIKGPTTADRV

SEQ ID NO: 1905215 - protein, 25 aa, Staphylococcus
TGALVVIIWIVWIKPLASINELFGM

SEQ ID NO: 1905216 - protein, 40 aa, Staphylococcus
TGEDETNRGGLVSIVLTMLAGLGLIRRSKKDKNKDRKNNE

SEQ ID NO: 1905217 - protein, 18 aa, Staphylococcus
TGEKIGETFIPDGQKGDK

SEQ ID NO: 1905218 - protein, 22 aa, Staphylococcus
TGFALICWLVISLGIFVVRHMN

SEQ ID NO: 1905219 - protein, 27 aa, Staphylococcus
TGFFSVRLLLSLIFINLTSPVGMHLVA

SEQ ID NO: 1905220 - protein, 19 aa, Staphylococcus
TGFLAFIVIGPIALILGTG

SEQ ID NO: 1905221 - protein, 27 aa, Staphylococcus
TGHTAWRYLIVVLYLVPYAFFGLFIYA

SEQ ID NO: 1905222 - protein, 33 aa, Staphylococcus; identical to SEQ ID NO: 1594022

SEQ ID NO: 1905223 - protein, 25 aa, Staphylococcus
TGIACGFIFYPLTMVITKRHKEVHP

SEQ ID NO: 1905224 - protein, 24 aa, Staphylococcus
TGIALLILFLLIKLVMEVHSVFTP

SEQ ID NO: 1905225 - protein, 21 aa, Staphylococcus
TGIALVILFVLIKLFMEVQSV

SEQ ID NO: 1905226 - protein, 20 aa, Staphylococcus
TGICFLLALFFSPLIEIVTS

SEQ ID NO: 1905227 - protein, 23 aa, Staphylococcus
TGIFIIMLFILIKLFMEVHEVFT

SEQ ID NO: 1905228 - protein, 23 aa, Staphylococcus
TGIFLIILFVLIKLFMEVHSVFT

SEQ ID NO: 1905229 - protein, 24 aa, Staphylococcus
TGIMLTFAILYFGVMIDAGLFEPV

SEQ ID NO: 1905230 - protein, 26 aa, Staphylococcus
TGIPSWILVIILTGVTLFLVIRTLHK

SEQ ID NO: 1905231 - protein, 29 aa, Staphylococcus
TGISLLITVILGFFIARTITKPITDMRNQ

SEQ ID NO: 1905232 - protein, 22 aa, Staphylococcus
TGKPMLMVSFELSGTTSTFELN

SEQ ID NO: 1905233 - protein, 17 aa, Staphylococcus
TGLKLRSWITIASTLLG

SEQ ID NO: 1905234 - protein, 18 aa, Staphylococcus
TGLLLLFPIIVSYKEKLH

SEQ ID NO: 1905235 - protein, 25 aa, Staphylococcus
TGLVLGIILLIIALIAVFLISKKPK

SEQ ID NO: 1905236 - protein, 20 aa, Staphylococcus
TGMAIILYYAFHISPAVTNF

SEQ ID NO: 1905237 - protein, 28 aa, Staphylococcus
TGNGAFFMFFAFYFKKLSTRQWMFIIGL

SEQ ID NO: 1905238 - protein, 27 aa, Staphylococcus
TGQTHALDLGGFTFGDGFDTRQGVPIP

SEQ ID NO: 1905239 - protein, 24 aa, Staphylococcus
TGSFMLFVLLLFGFDFLSAAGNAK

SEQ ID NO: 1905240 - protein, 31 aa, Staphylococcus
TGSIVLQFALLFAAQLYLVFTKGAAGDREPV

SEQ ID NO: 1905241 - protein, 34 aa, Staphylococcus
TGTDHLNFWDFLSQKWWFVLAIVVIVCGTLSQIF

SEQ ID NO: 1905242 - protein, 24 aa, Staphylococcus
TGTSIFYFLIILPISIFIYLRIDW

SEQ ID NO: 1905243 - protein, 24 aa, Staphylococcus
TGVALLILFLLIKLIMEVHSVFTP

SEQ ID NO: 1905244 - protein, 23 aa, Staphylococcus
TGVIGMFILFFTGGIVILPGVVA

SEQ ID NO: 1905245 - protein, 21 aa, Staphylococcus
TGVIVLIGFVLMYLVLFKMPK

SEQ ID NO: 1905246 - protein, 23 aa, Staphylococcus
TGVLFFTLLPKLFINFPRRYRNV

SEQ ID NO: 1905247 - protein, 24 aa, Staphylococcus
TGVLITLFSILLNIVLSGTLKRTY

SEQ ID NO: 1905248 - protein, 19 aa, Staphylococcus
TGVLLNFVLVFTTLKIFGY

SEQ ID NO: 1905249 - protein, 17 aa, Staphylococcus
TGVLNAYPWLTNKYIIS

SEQ ID NO: 1905250 - protein, 17 aa, Staphylococcus
THFPNFGGGLIGFYLFK

SEQ ID NO: 1905251 - protein, 17 aa, Staphylococcus
THINWLAVIALSVGGLI

SEQ ID NO: 1905252 - protein, 26 aa, Staphylococcus
THMSPILLAWIVAAVLRIALGSATVA

SEQ ID NO: 1905253 - protein, 33 aa, Staphylococcus
THNKLAMTALISLFLIFVISMLSPLIAPHDPNT

SEQ ID NO: 1905254 - protein, 25 aa, Staphylococcus
THQPRYIIGDKWRYSGVTVTENGIT

SEQ ID NO: 1905255 - protein, 19 aa, Staphylococcus
THRLIIIVTLIMIELFIFT

SEQ ID NO: 1905256 - protein, 23 aa, Staphylococcus
THSLLFIGIIGILLHIIDTPIYY

SEQ ID NO: 1905257 - protein, 24 aa, Staphylococcus
THSLLFIGIIVFLLNLIQTPTYYL

SEQ ID NO: 1905258 - protein, 17 aa, Staphylococcus
THVTFDIPIPLLAPMHM

SEQ ID NO: 1905259 - protein, 23 aa, Staphylococcus
THWVLFFLMVFFIFVVLNAPTYI

SEQ ID NO: 1905260 - protein, 18 aa, Staphylococcus
THYIIKVVSKYQLDSEGN

SEQ ID NO: 1905261 - protein, 19 aa, Staphylococcus
TIAISFIGIFATFGGAYLG

SEQ ID NO: 1905262 - protein, 23 aa, Staphylococcus
TIAIWFRHLFMFTPNADFMIYVP

SEQ ID NO: 1905263 - protein, 24 aa, Staphylococcus
TIALITLFNILIHLGFASATSLSS

SEQ ID NO: 1905264 - protein, 17 aa, Staphylococcus
TIALYLVIGPFFALPRL

SEQ ID NO: 1905265 - protein, 36 aa, Staphylococcus
TIASWRLLFVILGILGLVWVIIWAKVFTDYPEDNKK

SEQ ID NO: 1905266 - protein, 20 aa, Staphylococcus
TICSLFLIIIYAIYYKLSIS

SEQ ID NO: 1905267 - protein, 21 aa, Staphylococcus
TICTLLLCFLKADTSYIYLIV

SEQ ID NO: 1905268 - protein, 19 aa, Staphylococcus
TIDEKRSWHLQSRGTFLEG

SEQ ID NO: 1905269 - protein, 18 aa, Staphylococcus
TIEAADTIYPHKAEYVNL

SEQ ID NO: 1905270 - protein, 31 aa, Staphylococcus
TIENVLAIFPWFIIAIPLILILSYQLDILNL

SEQ ID NO: 1905271 - protein, 18 aa, Staphylococcus
TIFFILMKAPDLALTQLV

SEQ ID NO: 1905272 - protein, 17 aa, Staphylococcus
TIFGLLLATIYKIYEYL

SEQ ID NO: 1905273 - protein, 22 aa, Staphylococcus
TIFLLIMVPFFLIYMLKDHEKF

SEQ ID NO: 1905274 - protein, 23 aa, Staphylococcus
TIFLLVMVPFFLIYMLKDHEKFI

SEQ ID NO: 1905275 - protein, 22 aa, Staphylococcus
TIFVVCYLYWYCKKIKQEPKAS

SEQ ID NO: 1905276 - protein, 24 aa, Staphylococcus
TIGALIPLLFGQDSSILISKGLAA

SEQ ID NO: 1905277 - protein, 17 aa, Staphylococcus
TIGFIVFNIPIQVLLLI

SEQ ID NO: 1905278 - protein, 25 aa, Staphylococcus
TIGIFLIFIVPFIDPFLGLIPEWGE

SEQ ID NO: 1905279 - protein, 20 aa, Staphylococcus
TIGWQWIFIISIALSILSFF

SEQ ID NO: 1905280 - protein, 39 aa, Staphylococcus
TIHESFGLPYWLSSLLLVILILLTLLLKFDRLIAVLGGV

SEQ ID NO: 1905281 - protein, 34 aa, Staphylococcus
TIHESFKLPYWISSLLLVLLILATLFLKFERLIT

SEQ ID NO: 1905282 - protein, 20 aa, Staphylococcus
TIHFGFLSIPITVIWIVAIT

SEQ ID NO: 1905283 - protein, 29 aa, Staphylococcus
TIHNIKQNLFWAFGYNIAGIPIAACGLLA

SEQ ID NO: 1905284 - protein, 20 aa, Staphylococcus
TIHTLPNLEFKFISANSLKQ

SEQ ID NO: 1905285 - protein, 17 aa, Staphylococcus
TIIALFSFKLYRHYYFK

SEQ ID NO: 1905286 - protein, 21 aa, Staphylococcus
TIIFICFNFIPFIDQLFNGFS

SEQ ID NO: 1905287 - protein, 29 aa, Staphylococcus
TIIFITILVLLFISLFYKELFILSFDEEY

SEQ ID NO: 1905288 - protein, 22 aa, Staphylococcus
TIIFVIVGIFVLGFFLSTYEAT

SEQ ID NO: 1905289 - protein, 18 aa, Staphylococcus
TIIFYLLGGIFKKAQFLQ

SEQ ID NO: 1905290 - protein, 30 aa, Staphylococcus
TIIIALSIMFFLDIKLTLAAIIIFPFYVFT

SEQ ID NO: 1905291 - protein, 50 aa, Staphylococcus; identical to SEQ ID NO: 1753581

SEQ ID NO: 1905292 - protein, 51 aa, Staphylococcus
TIIIALSIMFFLDVKLTLAAILIFPFYILTVYFFFGKLRSLTRVRSQALAE

SEQ ID NO: 1905293 - protein, 27 aa, Staphylococcus
TIIIALSIMFFLDVKLTLAAMFIFPFY

SEQ ID NO: 1905294 - protein, 51 aa, Staphylococcus
TIIIALTIMFFLDVKLTFAAIFIFPFYILTVYFFFGRLRKLTRVRSQALAE

SEQ ID NO: 1905295 - protein, 19 aa, Staphylococcus
TIIIFTLLLQVFFFKDIKT

SEQ ID NO: 1905296 - protein, 22 aa, Staphylococcus
TIIIPVLFVMNSLFGLTGVVWS

SEQ ID NO: 1905297 - protein, 19 aa, Staphylococcus
TIILAIIFFIILIGISYFQ

SEQ ID NO: 1905298 - protein, 26 aa, Staphylococcus
TIILGIIFVVLFIWRQERLETPLLSF

SEQ ID NO: 1905299 - protein, 31 aa, Staphylococcus
TIILVLLVLMSIVLTYMVWNFSPDLSNADST

SEQ ID NO: 1905300 - protein, 30 aa, Staphylococcus
TIIMINNFYFAYYFLLIGAGYLLIRITFPH

SEQ ID NO: 1905301 - protein, 18 aa, Staphylococcus
TIIMVIAILIAVIITKHF

SEQ ID NO: 1905302 - protein, 34 aa, Staphylococcus
TIIQPIVFGLILLVVVAVPYYIFNALKVAGPSST

SEQ ID NO: 1905303 - protein, 19 aa, Staphylococcus
TIITLLLVTGLKLRSWITI

SEQ ID NO: 1905304 - protein, 25 aa, Staphylococcus
TIITVAPVFLVPLIVERKRIKDHPD

SEQ ID NO: 1905305 - protein, 19 aa, Staphylococcus
TIIVFILIGVLTIVGILGG

SEQ ID NO: 1905306 - protein, 20 aa, Staphylococcus
TIIVFIVFGILMIFGILGGH

SEQ ID NO: 1905307 - protein, 18 aa, Staphylococcus
TIIVIFMLAFILLNIIGL

SEQ ID NO: 1905308 - protein, 17 aa, Staphylococcus
TIKLWITDKLGWYYLIL

SEQ ID NO: 1905309 - protein, 23 aa, Staphylococcus
TIKQALPHFIIPQVPYTLETLQI

SEQ ID NO: 1905310 - protein, 25 aa, Staphylococcus
TIKQNFIVIILFFINIKDFHFADLK

SEQ ID NO: 1905311 - protein, 25 aa, Staphylococcus
TILFGILYLVLMVTAAYVLIRMYRN

SEQ ID NO: 1905312 - protein, 17 aa, Staphylococcus
TILFYFIIHVHYTYIDI

SEQ ID NO: 1905313 - protein, 19 aa, Staphylococcus
TILIALPRIIDVIVGIIIA

SEQ ID NO: 1905314 - protein, 21 aa, Staphylococcus
TILLALGFVINLVLAFIIIFL

SEQ ID NO: 1905315 - protein, 21 aa, Staphylococcus
TILLYVFWELTSIASFLLISY

SEQ ID NO: 1905316 - protein, 21 aa, Staphylococcus
TILMYIFWELTSVSSFLLISY

SEQ ID NO: 1905317 - protein, 18 aa, Staphylococcus
TILTCTLLLIWAAYSSLN

SEQ ID NO: 1905318 - protein, 24 aa, Staphylococcus
TILVSWIWFILLAILGKMIGSVDK

SEQ ID NO: 1905319 - protein, 27 aa, Staphylococcus
TIMKTLTLFTVFLTLPTLVFSFFGMNV

SEQ ID NO: 1905320 - protein, 19 aa, Staphylococcus
TIMLAILAVLFIIFVIRFI

SEQ ID NO: 1905321 - protein, 17 aa, Staphylococcus
TIMLISFIVFIGFDMIR

SEQ ID NO: 1905322 - protein, 33 aa, Staphylococcus
TIMTLIIAIIIYYIILYTLFLIAELVLLPADFL

SEQ ID NO: 1905323 - protein, 37 aa, Staphylococcus
TIMTLLIAIVIYYMILYLLFLIAELVLLPPGFLGQQV

SEQ ID NO: 1905324 - protein, 33 aa, Staphylococcus
TIMTLLTPYWYAFIIIHLLFIGFLLWQNIFFSN

SEQ ID NO: 1905325 - protein, 17 aa, Staphylococcus
TIMVISFIVFIGFDMIR

SEQ ID NO: 1905326 - protein, 29 aa, Staphylococcus
TIMVYAGLMLIFFIVFNYASQVAMEIATE

SEQ ID NO: 1905327 - protein, 26 aa, Staphylococcus
TINKMLFIFLFCFIGNIIGGFILFFL

SEQ ID NO: 1905328 - protein, 17 aa, Staphylococcus
TINMPFLITMIPTIVVA

SEQ ID NO: 1905329 - protein, 23 aa, Staphylococcus
TINWNIVLLFAGIFIANALLSGI

SEQ ID NO: 1905330 - protein, 47 aa, Staphylococcus
TIPMAIIIAMFWIHLNTALIMLVTAPFIPLFYIIFGLKTRDESKDQM

SEQ ID NO: 1905331 - protein, 26 aa, Staphylococcus
TIPSLALLGLMIPLFGIGKVPAVIAL

SEQ ID NO: 1905332 - protein, 19 aa, Staphylococcus
TIQAFIHSILFGFPTKKEK

SEQ ID NO: 1905333 - protein, 24 aa, Staphylococcus
TIQLFSFFIGYHFDKFDLGVQQLF

SEQ ID NO: 1905334 - protein, 17 aa, Staphylococcus
TIQLLPITGIPLPFISY

SEQ ID NO: 1905335 - protein, 23 aa, Staphylococcus
TIQLLPITGIPLPFISYGGSSLW

SEQ ID NO: 1905336 - protein, 26 aa, Staphylococcus
TIQSIPWLVIVLVAIVAMIVISQTAT

SEQ ID NO: 1905337 - protein, 31 aa, Staphylococcus
TIQWPQIIGVIPWFVLAFIGAIAIAKQLTIM

SEQ ID NO: 1905338 - protein, 23 aa, Staphylococcus
TIQYPIVLIIVFLGILTTLKLTV

SEQ ID NO: 1905339 - protein, 24 aa, Staphylococcus
TIQYPLILVMIFMTMLFGINHFIL

SEQ ID NO: 1905340 - protein, 28 aa, Staphylococcus
TIRNIKQNLFWAFGYNAAGIPIAAMGLL

SEQ ID NO: 1905341 - protein, 22 aa, Staphylococcus
TISFVISFIVVTYLHVVLGELA

SEQ ID NO: 1905342 - protein, 26 aa, Staphylococcus
TISHWITFLFPMINWFVPKRYAKLSE

SEQ ID NO: 1905343 - protein, 17 aa, Staphylococcus
TISIFKFNDNRKISHND

SEQ ID NO: 1905344 - protein, 24 aa, Staphylococcus
TISIIFIFVITFLLTIINPSIPLV

SEQ ID NO: 1905345 - protein, 20 aa, Staphylococcus
TISIWFRHLFTFSPDAMLMN

SEQ ID NO: 1905346 - protein, 25 aa, Staphylococcus
TISKVAVFIILTFGAYIFLAGHDNP

SEQ ID NO: 1905347 - protein, 24 aa, Staphylococcus
TISLHFYLFFFIGVIVTGFIKMFI

SEQ ID NO: 1905348 - protein, 34 aa, Staphylococcus
TISNNLDMIKSPHPSYPAGYGLSSRPTITRYFVQ

SEQ ID NO: 1905349 - protein, 25 aa, Staphylococcus
TISQYLHWQSIFVLSIILSVVALWI

SEQ ID NO: 1905350 - protein, 25 aa, Staphylococcus
TISSSFLFLVPLLSTIFSIIGLGEP

SEQ ID NO: 1905351 - protein, 20 aa, Staphylococcus
TISYIPKVGYYDKITHAHAY

SEQ ID NO: 1905352 - protein, 46 aa, Staphylococcus
TITFIVFMIFLITKFSHVWPILIFLPLIVIVFLRIKGHYKDIAKQL

SEQ ID NO: 1905353 - protein, 41 aa, Staphylococcus
TITFIVFMILLITKFTQVWPILFFLPFVVSVFMRINTHYKN

SEQ ID NO: 1905354 - protein, 40 aa, Staphylococcus
TITFVVFMIFLITKFNQVWPILIFLPIVVIGFLKIRMHYR

SEQ ID NO: 1905355 - protein, 42 aa, Staphylococcus
TITFVVFMIFLITKFSHVWPILLFLPFFVSVFVRIKIHYRNV

SEQ ID NO: 1905356 - protein, 18 aa, Staphylococcus
TITGIQPEVTKKAAARKA

SEQ ID NO: 1905357 - protein, 21 aa, Staphylococcus
TITVMILLIPTFRESPLLATF

SEQ ID NO: 1905358 - protein, 18 aa, Staphylococcus
TITYFVFKLGLIAKITIL

SEQ ID NO: 1905359 - protein, 20 aa, Staphylococcus
TIVAMMILILSGILTKHYTA

SEQ ID NO: 1905360 - protein, 24 aa, Staphylococcus
TIVFGFFALTFVTPILRSVFPQLG

SEQ ID NO: 1905361 - protein, 24 aa, Staphylococcus
TIVFGFFALTFVTPMLRHLFPDLG

SEQ ID NO: 1905362 - protein, 18 aa, Staphylococcus
TIVFNRTILKVINFIIIA

SEQ ID NO: 1905363 - protein, 21 aa, Staphylococcus
TIVGYILIIIFSMTYWKWLGL

SEQ ID NO: 1905364 - protein, 51 aa, Staphylococcus
TIVIALSIMFFLDVKLTFAAIFIFPFYILTVYFFFGRLRKLTRKRSQALAE

SEQ ID NO: 1905365 - protein, 19 aa, Staphylococcus
TIVLAIIFFLIMIGISYFG

SEQ ID NO: 1905366 - protein, 19 aa, Staphylococcus
TIVLFFAIGCFKYADAHVT

SEQ ID NO: 1905367 - protein, 23 aa, Staphylococcus
TIVTFILGLIIALFTALMRISSS

SEQ ID NO: 1905368 - protein, 23 aa, Staphylococcus
TIWFVVPILIVIALAVPTVKTLY

SEQ ID NO: 1905369 - protein, 21 aa, Staphylococcus
TIWMMIGFIIFGAISSLTAAI

SEQ ID NO: 1905370 - protein, 25 aa, Staphylococcus
TIYAVSAGYKWFFAYPDQKVETVNT

SEQ ID NO: 1905371 - protein, 27 aa, Staphylococcus
TIYCIGLVFLLYMAWSLWRTRPVTLQS

SEQ ID NO: 1905372 - protein, 18 aa, Staphylococcus
TIYILVAIMYWVVCFIIS

SEQ ID NO: 1905373 - protein, 24 aa, Staphylococcus
TIYILVAIMYWVVCFIISIIQGWY

SEQ ID NO: 1905374 - protein, 18 aa, Staphylococcus
TIYILVAVMYWVICFIIS

SEQ ID NO: 1905375 - protein, 18 aa, Staphylococcus
TIYVPRDLENLKVHSDDG

SEQ ID NO: 1905376 - protein, 27 aa, Staphylococcus
TKAFPIVWPILYLLMGVSYLITTKNKT

SEQ ID NO: 1905377 - protein, 24 aa, Staphylococcus
TKAGVFPMYVWLPGAYYAPPFAII

SEQ ID NO: 1905378 - protein, 24 aa, Staphylococcus
TKAGVFPMYVWLPGAYYAPPVAII

SEQ ID NO: 1905379 - protein, 44 aa, Staphylococcus
TKAIALITVFLFVVLLIFERSIIMPLYMIASILITYYASIGIAN

SEQ ID NO: 1905380 - protein, 27 aa, Staphylococcus
TKDGSFKQPIFVLDGHSHTVIDKGEHY

SEQ ID NO: 1905381 - protein, 25 aa, Staphylococcus
TKEIKTLYPFVFNVLYEIVQRMSDD

SEQ ID NO: 1905382 - protein, 25 aa, Staphylococcus
TKEYWVWKNKYYRYLFDFGKEDKEL

SEQ ID NO: 1905383 - protein, 20 aa, Staphylococcus
TKFLIFIVYITIFSSFSILF

SEQ ID NO: 1905384 - protein, 32 aa, Staphylococcus
TKGSSITLNQILPLLTARTSIPSLRNDISGDD

SEQ ID NO: 1905385 - protein, 39 aa, Staphylococcus
TKHDLKNMLTLVVVLLFILFIILLFMFMNHNDQDSNRLT

SEQ ID NO: 1905386 - protein, 41 aa, Staphylococcus
TKHGLMNRLTLIVVICFVLFLILLFMFLNYNDEDNGTITIT

SEQ ID NO: 1905387 - protein, 21 aa, Staphylococcus
TKKFPVFYLILTLLPYLKNVI

SEQ ID NO: 1905388 - protein, 23 aa, Staphylococcus
TKKKWLVILLAVAFICSFSTLKL

SEQ ID NO: 1905389 - protein, 38 aa, Staphylococcus
TKKRIKKLPIAILIVLILLVSLIVYITVSYQNGIKYAE

SEQ ID NO: 1905390 - protein, 24 aa, Staphylococcus
TKLIDWGVLLILGIFLGSYIAAKG

SEQ ID NO: 1905391 - protein, 29 aa, Staphylococcus
TKLNTGASLAFYDVTSRYIDGSGNLLISA

SEQ ID NO: 1905392 - protein, 22 aa, Staphylococcus
TKLPWIVLYGFTGLLIPASLAT

SEQ ID NO: 1905393 - protein, 17 aa, Staphylococcus
TKLYYKLINSFVEDIEF

SEQ ID NO: 1905394 - protein, 34 aa, Staphylococcus
TKLYYLSIILIVIAILIVALIFYNTRKNMNQSNL

SEQ ID NO: 1905395 - protein, 23 aa, Staphylococcus
TKNKVLKWVFFSCTLIGLLVLAT

SEQ ID NO: 1905396 - protein, 29 aa, Staphylococcus
TKNQFTYFNELSLFHDIRQWLKEETSNLE

SEQ ID NO: 1905397 - protein, 17 aa, Staphylococcus
TKPDIWITIIAGVLYFI

SEQ ID NO: 1905398 - protein, 23 aa, Staphylococcus
TKPLSYYIDWISNLSHEKLHQPT

SEQ ID NO: 1905399 - protein, 28 aa, Staphylococcus
TKQSLSFILILIIIVLMLRATLNFINQL

SEQ ID NO: 1905400 - protein, 25 aa, Staphylococcus
TKSLPFIILGVFILGFFLSTYEATM

SEQ ID NO: 1905401 - protein, 29 aa, Staphylococcus
TKSNIIRWILILLILIPFVLILAGLFDKY

SEQ ID NO: 1905402 - protein, 29 aa, Staphylococcus
TKVFDGITYFVAAVAGISLFIAGIGVMNV

SEQ ID NO: 1905403 - protein, 25 aa, Staphylococcus
TKVLSILYMIPGLYAIPFYFRFLHV

SEQ ID NO: 1905404 - protein, 18 aa, Staphylococcus
TKYDLLIRKNDITYKTSL

SEQ ID NO: 1905405 - protein, 17 aa, Staphylococcus
TKYMMVAILLIGILAFL

SEQ ID NO: 1905406 - protein, 20 aa, Staphylococcus
TKYVKSIKIGLDALGYNVNN

SEQ ID NO: 1905407 - protein, 35 aa, Staphylococcus
TLAAIIIFPFYVFTVYFFFGRLRKLTRKRSQALAE

SEQ ID NO: 1905408 - protein, 19 aa, Staphylococcus
TLAILALMIPIFGVGKTPA

SEQ ID NO: 1905409 - protein, 18 aa, Staphylococcus
TLAVLAIMIPIFGVGKTP

SEQ ID NO: 1905410 - protein, 25 aa, Staphylococcus
TLCVLFILWFIVTVLFYRNSHKPST

SEQ ID NO: 1905411 - protein, 25 aa, Staphylococcus
TLDAVFWMINKILKLAPLGVFAFIC

SEQ ID NO: 1905412 - protein, 43 aa, Staphylococcus
TLDTLKNSLKYNAPSKPIIEINYLIPNLTITPANKADKLDITY

SEQ ID NO: 1905413 - protein, 19 aa, Staphylococcus
TLEMYRFEYPITFATSIFA

SEQ ID NO: 1905414 - protein, 24 aa, Staphylococcus
TLEMYRFEYPITFVISIFASIFTS

SEQ ID NO: 1905415 - protein, 18 aa, Staphylococcus
TLEPFFNQYTYALNYAIN

SEQ ID NO: 1905416 - protein, 21 aa, Staphylococcus
TLFAFFILTVLTVTLKTYFSY

SEQ ID NO: 1905417 - protein, 17 aa, Staphylococcus
TLFAMFFGAGNLIFPTN

SEQ ID NO: 1905418 - protein, 20 aa, Staphylococcus
TLFFFSIVFFLVGYLTIRST

SEQ ID NO: 1905419 - protein, 39 aa, Staphylococcus
TLFFGLVFSFIAIGLYFLIHSLLVLMIVRLIHGLAFGMS

SEQ ID NO: 1905420 - protein, 19 aa, Staphylococcus
TLFFVTLVIAVLSGLIFLV

SEQ ID NO: 1905421 - protein, 23 aa, Staphylococcus
TLFLNFIVLVISILMIIFGVPIY

SEQ ID NO: 1905422 - protein, 28 aa, Staphylococcus
TLFSNFYFTYYQAIVLGIYFILRVVFQY

SEQ ID NO: 1905423 - protein, 21 aa, Staphylococcus
TLGFIFLMFLSGLEIDFKAFK

SEQ ID NO: 1905424 - protein, 21 aa, Staphylococcus
TLGIIFPILAIVGSIFTFVYS

SEQ ID NO: 1905425 - protein, 20 aa, Staphylococcus
TLGMIFPIMAIAGSIFTFVY

SEQ ID NO: 1905426 - protein, 33 aa, Staphylococcus
TLGNHEFDFGYDQLLKLKKQLNFPMITSNVYKN

SEQ ID NO: 1905427 - protein, 24 aa, Staphylococcus
TLGVLFLIILFIYNAFGYLSKVRK

SEQ ID NO: 1905428 - protein, 20 aa, Staphylococcus
TLHDETYPRLFRINARDTNL

SEQ ID NO: 1905429 - protein, 27 aa, Staphylococcus
TLHIPNWILVILITLITLILVTKTLKK

SEQ ID NO: 1905430 - protein, 17 aa, Staphylococcus
TLHLAGISLWLGALIYL

SEQ ID NO: 1905431 - protein, 24 aa, Staphylococcus
TLHLAGMTLWLGALVYLICYAKNG

SEQ ID NO: 1905432 - protein, 19 aa, Staphylococcus
TLHNESYPRIFRINSRDTN

SEQ ID NO: 1905433 - protein, 24 aa, Staphylococcus
TLIAMIFYVIQLSSPLINLSTLVT

SEQ ID NO: 1905434 - protein, 32 aa, Staphylococcus
TLIEMLLTLFITFTLCMLLPLFIHNANYYFHQ

SEQ ID NO: 1905435 - protein, 17 aa, Staphylococcus
TLIFAIILAVVKGIGIP

SEQ ID NO: 1905436 - protein, 19 aa, Staphylococcus
TLIFVIWQPKGLNIGITAV

SEQ ID NO: 1905437 - protein, 28 aa, Staphylococcus
TLIGSIVMLFIMDWQMTLLTFIAIPIFM

SEQ ID NO: 1905438 - protein, 22 aa, Staphylococcus
TLIIFGIVLILTSLVGSLFSVL

SEQ ID NO: 1905439 - protein, 18 aa, Staphylococcus
TLIIIAILLMVTFAKANE

SEQ ID NO: 1905440 - protein, 18 aa, Staphylococcus
TLIIILSMFLFVGIGVKK

SEQ ID NO: 1905441 - protein, 24 aa, Staphylococcus
TLILFSLLYFIISIVVGIILWAIF

SEQ ID NO: 1905442 - protein, 20 aa, Staphylococcus
TLILGLIILLLGFSPVQHLS

SEQ ID NO: 1905443 - protein, 24 aa, Staphylococcus
TLILGMFMFLLLLPLEKVFKLSSY

SEQ ID NO: 1905444 - protein, 25 aa, Staphylococcus
TLILGMFMFLLLLPLEKVFKLSSYY

SEQ ID NO: 1905445 - protein, 23 aa, Staphylococcus
TLILIMVILLFTLTNIKFQKYAG

SEQ ID NO: 1905446 - protein, 23 aa, Staphylococcus
TLILLLFIIIIFIATTLTYYLRN

SEQ ID NO: 1905447 - protein, 25 aa, Staphylococcus
TLIMFITWMFTMYKWKEAGRKLESK

SEQ ID NO: 1905448 - protein, 27 aa, Staphylococcus
TLINVLPIVIVPLVVERKRIKEHPDVR

SEQ ID NO: 1905449 - protein, 25 aa, Staphylococcus
TLINYINLIWFITSLGILAGAMGST

SEQ ID NO: 1905450 - protein, 30 aa, Staphylococcus; identical to SEQ ID NO: 1748430

SEQ ID NO: 1905451 - protein, 23 aa, Staphylococcus
TLIRSLFTLFYTGVWTLLGCLCM

SEQ ID NO: 1905452 - protein, 26 aa, Staphylococcus
TLISAYVLGILFFATSRFSKKSSIIW

SEQ ID NO: 1905453 - protein, 32 aa, Staphylococcus
TLISILIVAIAIIGFFVFVHFKYGDQSGQSHK

SEQ ID NO: 1905454 - protein, 29 aa, Staphylococcus
TLITVLPVILVPLIVERKRIKDHPDVQKV

SEQ ID NO: 1905455 - protein, 40 aa, Staphylococcus
TLIVLSFYNWQMSAILFLIMPIALLFIAISKFATAATNKK

SEQ ID NO: 1905456 - protein, 17 aa, Staphylococcus
TLKNPLWAIFYIICIIA

SEQ ID NO: 1905457 - protein, 22 aa, Staphylococcus
TLKYSIGLLIFVCIWTFILSLI

SEQ ID NO: 1905458 - protein, 19 aa, Staphylococcus
TLLACCFGLLFISLFFRNR

SEQ ID NO: 1905459 - protein, 18 aa, Staphylococcus
TLLDFYVSIKSPYKFRKL

SEQ ID NO: 1905460 - protein, 20 aa, Staphylococcus
TLLEKWGFPRWASILTIFIV

SEQ ID NO: 1905461 - protein, 20 aa, Staphylococcus
TLLEKWGFPRWASILTIFVV

SEQ ID NO: 1905462 - protein, 21 aa, Staphylococcus
TLLFLLIGMVLIYAFLLGLFL

SEQ ID NO: 1905463 - protein, 20 aa, Staphylococcus
TLLICLVIMSIISLFVGVSQ

SEQ ID NO: 1905464 - protein, 21 aa, Staphylococcus
TLLIILVILSILSLFIGVSQL

SEQ ID NO: 1905465 - protein, 21 aa, Staphylococcus
TLLIVIFLALGIFSQWFADKI

SEQ ID NO: 1905466 - protein, 18 aa, Staphylococcus
TLLIYLTLIQIIGVLLII

SEQ ID NO: 1905467 - protein, 26 aa, Staphylococcus
TLLLGVILAFLWPPNRLKKEPPLAVR

SEQ ID NO: 1905468 - protein, 34 aa, Staphylococcus
TLLLTIKKYRNITLIFWIISLLSLMLMIVISQPH

SEQ ID NO: 1905469 - protein, 19 aa, Staphylococcus
TLLLYVFVQWLHISSVIAP

SEQ ID NO: 1905470 - protein, 20 aa, Staphylococcus
TLLMIVIIGVPLGLIAGYKK

SEQ ID NO: 1905471 - protein, 22 aa, Staphylococcus
TLLNEFFKKLGFDTQLLAKPGT

SEQ ID NO: 1905472 - protein, 29 aa, Staphylococcus
TLLNIFHGWPWYAVWLVLLGFGGGMIIPA

SEQ ID NO: 1905473 - protein, 18 aa, Staphylococcus
TLLTFITIPIFIAIIMPL

SEQ ID NO: 1905474 - protein, 28 aa, Staphylococcus
TLLTSFWYIFIIIYALFDIYLLWQLKHN

SEQ ID NO: 1905475 - protein, 21 aa, Staphylococcus
TLLYLLFPIISIFNEKRGSQT

SEQ ID NO: 1905476 - protein, 26 aa, Staphylococcus
TLMGKYKYLFYLAILLSVVSSVISLG

SEQ ID NO: 1905477 - protein, 20 aa, Staphylococcus
TLMLFAYLLALIALKELLNM

SEQ ID NO: 1905478 - protein, 22 aa, Staphylococcus
TLMRKLKVPIFPIVARKAKGTN

SEQ ID NO: 1905479 - protein, 21 aa, Staphylococcus
TLMVTMFRLFGKQGLIAWVAM

SEQ ID NO: 1905480 - protein, 25 aa, Staphylococcus
TLNFGYLMELFFKHLLMSIYGVLFA

SEQ ID NO: 1905481 - protein, 20 aa, Staphylococcus
TLNFIVLLPALFATTYISKK

SEQ ID NO: 1905482 - protein, 26 aa, Staphylococcus
TLNRGDKIVYQVWLDTTHLTPENKIN

SEQ ID NO: 1905483 - protein, 18 aa, Staphylococcus
TLPAIIALVVYALLPILR

SEQ ID NO: 1905484 - protein, 17 aa, Staphylococcus
TLPIFAVLMAFGNLFGV

SEQ ID NO: 1905485 - protein, 21 aa, Staphylococcus
TLPILIQIPILLGLYACIKYP

SEQ ID NO: 1905486 - protein, 25 aa, Staphylococcus
TLPTLVFSFFGMNVPLPINDHSPVS

SEQ ID NO: 1905487 - protein, 27 aa, Staphylococcus
TLPWLPAAIGFLLGGLFIRLLDAIIPH

SEQ ID NO: 1905488 - protein, 45 aa, Staphylococcus
TLQFIRLHRRVGRFSILFLAINSILFLVFILVYINSYRHIHYTKQ

SEQ ID NO: 1905489 - protein, 24 aa, Staphylococcus
TLQLLIVPAVIAAILWFFVKPDQP

SEQ ID NO: 1905490 - protein, 33 aa, Staphylococcus
TLQMLNMRYSHWFRFVWPVVVFVLVFGGGMLVA

SEQ ID NO: 1905491 - protein, 26 aa, Staphylococcus
TLQVALLFISQLYYHFSKGVISEREP

SEQ ID NO: 1905492 - protein, 19 aa, Staphylococcus
TLSFIILSFYLVIDATKSL

SEQ ID NO: 1905493 - protein, 25 aa, Staphylococcus
TLSPILLAWIVAAVLRIALGSATVA

SEQ ID NO: 1905494 - protein, 19 aa, Staphylococcus
TLSQVALLAAFIPIISGMS

SEQ ID NO: 1905495 - protein, 21 aa, Staphylococcus
TLSQVALLAAFIPIISGMSGN

SEQ ID NO: 1905496 - protein, 23 aa, Staphylococcus
TLTFIQLLTPFAVYFIAELFHAS

SEQ ID NO: 1905497 - protein, 30 aa, Staphylococcus
TLTIVLIILVTLFIIFLMKVYKTNHKDTEY

SEQ ID NO: 1905498 - protein, 22 aa, Staphylococcus
TLTYFIVIIFQFYALHILFAKY

SEQ ID NO: 1905499 - protein, 26 aa, Staphylococcus
TLTYFIVIIFQFYLLHIVFAKHLVKL

SEQ ID NO: 1905500 - protein, 19 aa, Staphylococcus
TLVAFNFIHGVLTLPGLAA

SEQ ID NO: 1905501 - protein, 19 aa, Staphylococcus
TLVALGISVAYIYSLYAFY

SEQ ID NO: 1905502 - protein, 23 aa, Staphylococcus
TLVALILIYLVATLFHLGDQISA

SEQ ID NO: 1905503 - protein, 26 aa, Staphylococcus
TLVAMILFALLLFQVIFKHGNFSVYF

SEQ ID NO: 1905504 - protein, 22 aa, Staphylococcus
TLVFSFFGMNVPLPIDDHSYAS

SEQ ID NO: 1905505 - protein, 21 aa, Staphylococcus
TLVGMRLRRVSPRKVIAPLIK

SEQ ID NO: 1905506 - protein, 30 aa, Staphylococcus
TLVIINFFIPFLLIFIIDGFKGIKETLPSI

SEQ ID NO: 1905507 - protein, 22 aa, Staphylococcus
TLVIVIIVILPYLDVLLLGRAQ

SEQ ID NO: 1905508 - protein, 25 aa, Staphylococcus
TLVIVLIIMTLFLNFAPYGKQGLQA

SEQ ID NO: 1905509 - protein, 25 aa, Staphylococcus
TLVIVLVIMTLFLKFAPYGKEGLQA

SEQ ID NO: 1905510 - protein, 29 aa, Staphylococcus
TLVLINNFYFAYYFLIIASVYALIRIMFR

SEQ ID NO: 1905511 - protein, 31 aa, Staphylococcus
TLVLVIIVVCVLLFQFINHTGPFSGSKSENT

SEQ ID NO: 1905512 - protein, 26 aa, Staphylococcus
TLVLVLAVMTLFLKYAPYGKQGLQAL

SEQ ID NO: 1905513 - protein, 25 aa, Staphylococcus
TLVLVLIIMTLFLKFAPYGKQGLQA

SEQ ID NO: 1905514 - protein, 20 aa, Staphylococcus
TLVMIIVMQMSLHFTPSSID

SEQ ID NO: 1905515 - protein, 30 aa, Staphylococcus
TLVQNLISYVVWFIVLTSILSRFGISVSAI

SEQ ID NO: 1905516 - protein, 19 aa, Staphylococcus
TLVSLLGNPGKALAIILLV

SEQ ID NO: 1905517 - protein, 19 aa, Staphylococcus
TLVTVTCLLLSFALVFGSL

SEQ ID NO: 1905518 - protein, 24 aa, Staphylococcus
TLVVPFMFMWLTKSKRNKAIGRAS

SEQ ID NO: 1905519 - protein, 26 aa, Staphylococcus
TLVVTLLIAIPFFKLPGGIATGAVVE

SEQ ID NO: 1905520 - protein, 27 aa, Staphylococcus
TLVVTLLIAIPFFKLPLGIATGGVVEG

SEQ ID NO: 1905521 - protein, 26 aa, Staphylococcus
TLVVTLLIALPFFKLPGGIATGGVIE

SEQ ID NO: 1905522 - protein, 26 aa, Staphylococcus
TLYFSQYLFQYLAFKVIQQLRIDAFN

SEQ ID NO: 1905523 - protein, 21 aa, Staphylococcus
TMALFILTLLFHRNLRLERYH

SEQ ID NO: 1905524 - protein, 19 aa, Staphylococcus
TMFILPLILIGVGQGFIFT

SEQ ID NO: 1905525 - protein, 22 aa, Staphylococcus
TMGPFIVIVFFAAQMLAYFTWS

SEQ ID NO: 1905526 - protein, 20 aa, Staphylococcus
TMGVTTPIVAGLGAAVKISA

SEQ ID NO: 1905527 - protein, 19 aa, Staphylococcus
TMGWLYWGMWSLVTSVDII

SEQ ID NO: 1905528 - protein, 22 aa, Staphylococcus
TMGWLYYIMWALVSSVDVMVAA

SEQ ID NO: 1905529 - protein, 48 aa, Staphylococcus
TMIDSFFNYLFGNSRFLTYILILIGTIFITYYKALPKTRRTVGAFVLQ

SEQ ID NO: 1905530 - protein, 20 aa, Staphylococcus
TMILPLIPWGTSGIYYSHQL

SEQ ID NO: 1905531 - protein, 18 aa, Staphylococcus
TMLNEVIVDYLRGDGTLQ

SEQ ID NO: 1905532 - protein, 20 aa, Staphylococcus
TMLSPFVILFLTIVGAYLFF

SEQ ID NO: 1905533 - protein, 24 aa, Staphylococcus
TMLTKIASFIPLLSPFVLFLRAST

SEQ ID NO: 1905534 - protein, 20 aa, Staphylococcus
TMMLLLNLFLSVTGVLLMII

SEQ ID NO: 1905535 - protein, 20 aa, Staphylococcus
TMPIFALLMAFGNLFGVGGG

SEQ ID NO: 1905536 - protein, 33 aa, Staphylococcus
TMQNHFLITPWLLLIPLIVIALVVLKVPAIPAI

SEQ ID NO: 1905537 - protein, 24 aa, Staphylococcus
TMSICYCIILFPLTVLLHFRIEAK

SEQ ID NO: 1905538 - protein, 19 aa, Staphylococcus
TMSIWMGFSQIKPGGEDSF

SEQ ID NO: 1905539 - protein, 24 aa, Staphylococcus
TMSSFILIVFFAAQLLAFLKWSNL

SEQ ID NO: 1905540 - protein, 22 aa, Staphylococcus
TMSVLMMIPFLFVGFDVIPQIA

SEQ ID NO: 1905541 - protein, 19 aa, Staphylococcus
TMTFIIYGLIGLVALLLFP

SEQ ID NO: 1905542 - protein, 35 aa, Staphylococcus; identical to SEQ ID NO: 1749699

SEQ ID NO: 1905543 - protein, 22 aa, Staphylococcus
TMTNILLFSYLSGSLPMLLIYL

SEQ ID NO: 1905544 - protein, 23 aa, Staphylococcus
TMTPIYIVMIAYSIVYGIFAVMA

SEQ ID NO: 1905545 - protein, 21 aa, Staphylococcus
TMVAIIWILLGDLLATWIGIQ

SEQ ID NO: 1905546 - protein, 21 aa, Staphylococcus
TMVAIIWILLGDPLATWIGFP

SEQ ID NO: 1905547 - protein, 20 aa, Staphylococcus
TMVAIIWILLGDPLVHYIHF

SEQ ID NO: 1905548 - protein, 25 aa, Staphylococcus
TMVKAGIFLLFKFTPILGLSDSYIY

SEQ ID NO: 1905549 - protein, 19 aa, Staphylococcus
TMWMLIGFMIFGAVSSLLA

SEQ ID NO: 1905550 - protein, 23 aa, Staphylococcus
TNAIYNYWWMFTLSLLCFIIAMS

SEQ ID NO: 1905551 - protein, 35 aa, Staphylococcus
TNIIGAKWVFFCSFIILLFPIFFLGQAQSPGMLMA

SEQ ID NO: 1905552 - protein, 23 aa, Staphylococcus
TNIWVMIILRLIQGLTGGAGAVI

SEQ ID NO: 1905553 - protein, 25 aa, Staphylococcus
TNKEKYLLIIFMSNAIFGVLQDWVQ

SEQ ID NO: 1905554 - protein, 26 aa, Staphylococcus
TNKLNKWLFFTCIVIALLVLAALLIQ

SEQ ID NO: 1905555 - protein, 23 aa, Staphylococcus
TNNELIRTSTVWNPSLYETTPSN

SEQ ID NO: 1905556 - protein, 29 aa, Staphylococcus
TNNNTTIISGILPDTVKKAAARKAIDDAA

SEQ ID NO: 1905557 - protein, 22 aa, Staphylococcus
TNPLHVWMWAQLAVFLHVFVDI

SEQ ID NO: 1905558 - protein, 25 aa, Staphylococcus
TNQLPIFIVMALYTGIYAVFAIIGY

SEQ ID NO: 1905559 - protein, 18 aa, Staphylococcus
TNRFSPRPVLLYALLVFI

SEQ ID NO: 1905560 - protein, 19 aa, Staphylococcus
TNRSQLVHDLLAESYSETD

SEQ ID NO: 1905561 - protein, 38 aa, Staphylococcus
TNRVALFLTISILGFIGLILGVMVWLGMKAIPIFVILM

SEQ ID NO: 1905562 - protein, 20 aa, Staphylococcus
TNRYPARPVLLWTLVIFVVG

SEQ ID NO: 1905563 - protein, 47 aa, Staphylococcus
TNTAKYTFTNYVDIYNNVRGSFSLLSWPFKELVTTDKQSVPVGITVA

SEQ ID NO: 1905564 - protein, 17 aa, Staphylococcus
TNTIKLWITDKLGWYYL

SEQ ID NO: 1905565 - protein, 20 aa, Staphylococcus
TNTMLILAIVPLVGLIITTA

SEQ ID NO: 1905566 - protein, 25 aa, Staphylococcus
TNTQPIIMTILIAVIFSILIVSPIS

SEQ ID NO: 1905567 - protein, 19 aa, Staphylococcus
TNTVRGLPNGVTFDPRTNT

SEQ ID NO: 1905568 - protein, 37 aa, Staphylococcus
TNVIAIKMLFHPFNPYYIFKIRVPFTPGLIPKRRDEI

SEQ ID NO: 1905569 - protein, 37 aa, Staphylococcus
TNVIAIRMLFHPFKPYYIFKMRIPFTPGLIPKRREEI

SEQ ID NO: 1905570 - protein, 37 aa, Staphylococcus
TNVIAIRMLFHPFKPYYIFKMRIPFTPGLIPKRRGEI

SEQ ID NO: 1905571 - protein, 23 aa, Staphylococcus
TNVYLFIALRLIQGFSAGVITTL

SEQ ID NO: 1905572 - protein, 32 aa, Staphylococcus
TNWQTYIMIAIYFIILLIIGYYGYKQATGNLS

SEQ ID NO: 1905573 - protein, 29 aa, Staphylococcus
TNWQTYIMIAIYFIILLVIGYYGYKQATG

SEQ ID NO: 1905574 - protein, 18 aa, Staphylococcus
TPAFISTLIIWILGILLL

SEQ ID NO: 1905575 - protein, 18 aa, Staphylococcus
TPALIYLFAHEWLQVSFM

SEQ ID NO: 1905576 - protein, 25 aa, Staphylococcus
TPERRWVYIFAIMSAGLIALFIQHL

SEQ ID NO: 1905577 - protein, 20 aa, Staphylococcus
TPFIILFLTVVGAYLFFRSS

SEQ ID NO: 1905578 - protein, 24 aa, Staphylococcus
TPFLIVMVVLIAIYYLFAGSISIS

SEQ ID NO: 1905579 - protein, 23 aa, Staphylococcus
TPGTVVIPVTVTYPDGSKDKTTV

SEQ ID NO: 1905580 - protein, 28 aa, Staphylococcus
TPHTYAILMFIILVAWLMTYIIPAGEYV

SEQ ID NO: 1905581 - protein, 25 aa, Staphylococcus
TPIAGFLVMFGFNSPMKVIIYGVIM

SEQ ID NO: 1905582 - protein, 21 aa, Staphylococcus
TPIFIMLCFPFTPSALMNVVA

SEQ ID NO: 1905583 - protein, 29 aa, Staphylococcus
TPILDHDFVVLDFTYDMPLTTYLGQVLNN

SEQ ID NO: 1905584 - protein, 21 aa, Staphylococcus
TPIVLALGNGLFRWTEKYGNG

SEQ ID NO: 1905585 - protein, 24 aa, Staphylococcus
TPKDLWHHLPAIILILLMGTIGIL

SEQ ID NO: 1905586 - protein, 27 aa, Staphylococcus
TPKNSKYSYMLHELGYNATTVSDESSL

SEQ ID NO: 1905587 - protein, 25 aa, Staphylococcus
TPLIVQLFIVYYGLPAFILFLNEHL

SEQ ID NO: 1905588 - protein, 26 aa, Staphylococcus
TPLLLQLFLVYFALPQFLLIFQININ

SEQ ID NO: 1905589 - protein, 25 aa, Staphylococcus
TPLLLQLFLVYFALPQLLLFVHIDI

SEQ ID NO: 1905590 - protein, 17 aa, Staphylococcus
TPLLRTFIPQLDSFNSI

SEQ ID NO: 1905591 - protein, 30 aa, Staphylococcus
TPLLSIFVTAFITFLFVGPITRQLGYWLSD

SEQ ID NO: 1905592 - protein, 30 aa, Staphylococcus
TPMAGIPAWLWSCIFLVIIFSLNSLSVRIY

SEQ ID NO: 1905593 - protein, 23 aa, Staphylococcus
TPMIVQLFIIFYGIPELGRLITG

SEQ ID NO: 1905594 - protein, 24 aa, Staphylococcus
TPMIVQLFIIFYGIPELGRLITGN

SEQ ID NO: 1905595 - protein, 23 aa, Staphylococcus
TPMIVQLFIIFYGIPELGRLITN

SEQ ID NO: 1905596 - protein, 23 aa, Staphylococcus
TPMIVQLFIIFYGIPELGRLVTG

SEQ ID NO: 1905597 - protein, 23 aa, Staphylococcus
TPMIVQLFIIFYGLPELGRLVTN

SEQ ID NO: 1905598 - protein, 24 aa, Staphylococcus
TPMLVQVFIVFFGTTAALGLDVSA

SEQ ID NO: 1905599 - protein, 30 aa, Staphylococcus
TPMNTLFFFFSAFALPFMLKVGIKSKFFVL

SEQ ID NO: 1905600 - protein, 51 aa, Staphylococcus; identical to SEQ ID NO: 1591316

SEQ ID NO: 1905601 - protein, 26 aa, Staphylococcus
TPNFKLSHFIGYSLLQFLIGFIACYI

SEQ ID NO: 1905602 - protein, 25 aa, Staphylococcus
TPRGVKLLYPLPLSVKLPIQFKTGG

SEQ ID NO: 1905603 - protein, 47 aa, Staphylococcus
TPYDHWNFMKLAKPLFWFSGIIILAGVVILFIFKLNLGIDFTSGTRV

SEQ ID NO: 1905604 - protein, 21 aa, Staphylococcus
TPYFGILLSLIPFIIATFLFK

SEQ ID NO: 1905605 - protein, 24 aa, Staphylococcus
TQEKIYVYNWGEYIDPSLIKKFEK

SEQ ID NO: 1905606 - protein, 30 aa, Staphylococcus
TQFGSYFLFVIILIFIIYSNMLFVKRRFRE

SEQ ID NO: 1905607 - protein, 17 aa, Staphylococcus
TQFIDALYRIDSDAVAE

SEQ ID NO: 1905608 - protein, 20 aa, Staphylococcus
TQFIYMRVLKIYKKDIYNFL

SEQ ID NO: 1905609 - protein, 19 aa, Staphylococcus
TQGIYKYIFYFISFMIIMV

SEQ ID NO: 1905610 - protein, 17 aa, Staphylococcus
TQGLSLGHLGDDGLLSG

SEQ ID NO: 1905611 - protein, 17 aa, Staphylococcus
TQGWLQLSFMDHLWLKD

SEQ ID NO: 1905612 - protein, 28 aa, Staphylococcus
TQHSVLRNYPLLARIRYLSEKMGPELRQ

SEQ ID NO: 1905613 - protein, 17 aa, Staphylococcus
TQINWWLVVALSIGGMA

SEQ ID NO: 1905614 - protein, 20 aa, Staphylococcus
TQKRWWLMNLALGVVYFVIW

SEQ ID NO: 1905615 - protein, 41 aa, Staphylococcus
TQKSNKKMWMIIGIIALLFIALIIAFSILKSQFSPEKQASN

SEQ ID NO: 1905616 - protein, 28 aa, Staphylococcus
TQKTWRGDYLIDQLTKDGSFKQPIFVLD

SEQ ID NO: 1905617 - protein, 54 aa, Staphylococcus
TQLAFAMLVAIVIVYLVLVITFKGGLAPFTILFSLPFTIIGVVLALLITGETIS

SEQ ID NO: 1905618 - protein, 24 aa, Staphylococcus
TQNKLFIILLGLAFILSFSTLKLA

SEQ ID NO: 1905619 - protein, 27 aa, Staphylococcus
TQNYFNEKMQVVLDGNVDFNITRMLDK

SEQ ID NO: 1905620 - protein, 25 aa, Staphylococcus
TQPHIMMLIILWMVGCITSFSGLAL

SEQ ID NO: 1905621 - protein, 22 aa, Staphylococcus
TQPILIYCHILGLPTIIANIFS

SEQ ID NO: 1905622 - protein, 37 aa, Staphylococcus
TQPSKKRFKPKFPWFKTIIVALVAGIIGALIVLGVGR

SEQ ID NO: 1905623 - protein, 22 aa, Staphylococcus
TQSGDYNLNYNVAGNEVNIPIS

SEQ ID NO: 1905624 - protein, 23 aa, Staphylococcus
TQSIEDINNVKLNIVKKPEAINE

SEQ ID NO: 1905625 - protein, 17 aa, Staphylococcus
TQSIRKWNDSHVSNKSG

SEQ ID NO: 1905626 - protein, 26 aa, Staphylococcus
TQSNPLALILWLAIGFSFGFAPPIQT

SEQ ID NO: 1905627 - protein, 25 aa, Staphylococcus
TQSQFTYFNKMSFFHDVKQWLKNAE

SEQ ID NO: 1905628 - protein, 18 aa, Staphylococcus
TQSVFSGLIFFRISPMNL

SEQ ID NO: 1905629 - protein, 23 aa, Staphylococcus
TQSVWIGLILFIRGCAVGGVMLP

SEQ ID NO: 1905630 - protein, 19 aa, Staphylococcus
TRAQWFKRMATIGGIVVLI

SEQ ID NO: 1905631 - protein, 24 aa, Staphylococcus
TREETVRMIRLVNDLLQLSKMDNA

SEQ ID NO: 1905632 - protein, 36 aa, Staphylococcus
TRGATGAIFMGIFYALVMLAIFLPGYKAMPGNVDKL

SEQ ID NO: 1905633 - protein, 24 aa, Staphylococcus
TRGKQGTGLGLFICKMIIEEHGGT

SEQ ID NO: 1905634 - protein, 21 aa, Staphylococcus
TRGLYIFSMAAFLIGSLVAAL

SEQ ID NO: 1905635 - protein, 40 aa, Staphylococcus
TRHGLKNWLTLVVVIAFILFIILLFMFLNQGDEDTGQITI

SEQ ID NO: 1905636 - protein, 29 aa, Staphylococcus
TRIAVFLTPIWFIILGLMYMRYKQVSKSQ

SEQ ID NO: 1905637 - protein, 26 aa, Staphylococcus
TRIGVLFIPVWAIILWIMYQKYKKES

SEQ ID NO: 1905638 - protein, 20 aa, Staphylococcus
TRLFIFQYSKLILFTTYILI

SEQ ID NO: 1905639 - protein, 20 aa, Staphylococcus
TRLIIYPFDITAMSYMLVVL

SEQ ID NO: 1905640 - protein, 20 aa, Staphylococcus
TRLLLILVALLVSISTALVG

SEQ ID NO: 1905641 - protein, 17 aa, Staphylococcus
TRLSNLIKELLLLSELD

SEQ ID NO: 1905642 - protein, 32 aa, Staphylococcus
TRMGVVLSPLWFILLGLIYLRYTRKARKLEVN

SEQ ID NO: 1905643 - protein, 28 aa, Staphylococcus
TRMKDKFKVNFWIVLPGAILTIIVLFFL

SEQ ID NO: 1905644 - protein, 40 aa, Staphylococcus
TRNLMDKRINFFFGLVVIVFVIIVLRLGYLQIAQGSHYKQ

SEQ ID NO: 1905645 - protein, 19 aa, Staphylococcus
TRQVFLTGIIIFFLGTLLG

SEQ ID NO: 1905646 - protein, 19 aa, Staphylococcus
TRQVFLVGIAVFFIGTIIG

SEQ ID NO: 1905647 - protein, 23 aa, Staphylococcus
TRQVFLVGIFIFFLGTMLGGFSP

SEQ ID NO: 1905648 - protein, 29 aa, Staphylococcus
TRRAIYLTPLWFVILGLMYWRYKKASTAS

SEQ ID NO: 1905649 - protein, 24 aa, Staphylococcus
TRRRHYWFAILANCIILVIISLLF

SEQ ID NO: 1905650 - protein, 20 aa, Staphylococcus
TRTGLYIIDSKLLKGHVYNG

SEQ ID NO: 1905651 - protein, 18 aa, Staphylococcus
TRTLLLFGSLFGGAFYFS

SEQ ID NO: 1905652 - protein, 30 aa, Staphylococcus
TRVSMFFWLVCLLPLPFFFTNLGTTFIVLA

SEQ ID NO: 1905653 - protein, 23 aa, Staphylococcus
TSAAYFYSIYEMSKWLLDSNAQP

SEQ ID NO: 1905654 - protein, 17 aa, Staphylococcus
TSAAYFYSIYLAIIHYG

SEQ ID NO: 1905655 - protein, 22 aa, Staphylococcus
TSAGFKWFFAYPEQKIETVNHL

SEQ ID NO: 1905656 - protein, 21 aa, Staphylococcus
TSAGYKWFFSYPEEKIETVNH

SEQ ID NO: 1905657 - protein, 41 aa, Staphylococcus
TSATLAWNAIKMAVLHPIQSLKLVITAVWNAIKIGAVLAWT

SEQ ID NO: 1905658 - protein, 20 aa, Staphylococcus
TSCVILLHVFNAKVIDFHLF

SEQ ID NO: 1905659 - protein, 23 aa, Staphylococcus
TSESLSQSLSLSASESLSESESL

SEQ ID NO: 1905660 - protein, 29 aa, Staphylococcus
TSEWLRVWGLMYFITIFTNLFWGVVGDKI

SEQ ID NO: 1905661 - protein, 24 aa, Staphylococcus
TSFEKWNFVKLAKPLIALSILIVI

SEQ ID NO: 1905662 - protein, 22 aa, Staphylococcus
TSFVLAFPMAYVWPMIQSGLNA

SEQ ID NO: 1905663 - protein, 30 aa, Staphylococcus
TSGILIMFIMLFLNGWFQGMGWPPSGRVLV

SEQ ID NO: 1905664 - protein, 17 aa, Staphylococcus
TSHSQFDSISTSESMSG

SEQ ID NO: 1905665 - protein, 17 aa, Staphylococcus
TSHSRMYTFSKRKAINN

SEQ ID NO: 1905666 - protein, 21 aa, Staphylococcus
TSIAIDKIETLPTGATKVTFS

SEQ ID NO: 1905667 - protein, 25 aa, Staphylococcus
TSIATITFIYFLREKNKIQNPSNVL

SEQ ID NO: 1905668 - protein, 31 aa, Staphylococcus
TSIGLFCIIMIFALLGFLPFNLNPAKVFMGD

SEQ ID NO: 1905669 - protein, 29 aa, Staphylococcus
TSILDILIVWYVLYLLITVFKGTKAIQLL

SEQ ID NO: 1905670 - protein, 29 aa, Staphylococcus
TSIVFVLIFIYFIIDIYFWVNRGIFHGYV

SEQ ID NO: 1905671 - protein, 28 aa, Staphylococcus
TSIVVLGFLSPFLFLVSIAIKLESKGPI

SEQ ID NO: 1905672 - protein, 22 aa, Staphylococcus
TSKDQWIHDTQGPISNAAVNTK

SEQ ID NO: 1905673 - protein, 22 aa, Staphylococcus
TSKILLFMILGTIFLDAYDITI

SEQ ID NO: 1905674 - protein, 24 aa, Staphylococcus
TSKRFIDWLNLNNIVPGFYGVNSI

SEQ ID NO: 1905675 - protein, 22 aa, Staphylococcus
TSKRWLMISVSIFIIMMLVLNQ

SEQ ID NO: 1905676 - protein, 35 aa, Staphylococcus
TSKVLHAPVIQTVKFTRTPIVNVVNGRIVGYDEDG

SEQ ID NO: 1905677 - protein, 23 aa, Staphylococcus
TSLFFFFSSFILPYVLKVKMKSI

SEQ ID NO: 1905678 - protein, 37 aa, Staphylococcus
TSLGGFQFILSPIALSLLLLLYGLGGGFFLPSNTSAI

SEQ ID NO: 1905679 - protein, 22 aa, Staphylococcus
TSLGLLQYILNPVTISLLLLIY

SEQ ID NO: 1905680 - protein, 20 aa, Staphylococcus
TSLHHELPMTGERASTTTFV

SEQ ID NO: 1905681 - protein, 22 aa, Staphylococcus
TSLLVLFLDRVGLFLAMLVLVL

SEQ ID NO: 1905682 - protein, 25 aa, Staphylococcus
TSLSFILFLGITQINWWLVVALSIG

SEQ ID NO: 1905683 - protein, 18 aa, Staphylococcus
TSMDWDRKYPYKDTLRGI

SEQ ID NO: 1905684 - protein, 23 aa, Staphylococcus
TSNFMYFTVGLYYRVISPTRVLK

SEQ ID NO: 1905685 - protein, 26 aa, Staphylococcus
TSNFMYLTVGWYYKAIRLNKVIWIFI

SEQ ID NO: 1905686 - protein, 24 aa, Staphylococcus
TSNFSFYTILFLALLTIIFGCVGA

SEQ ID NO: 1905687 - protein, 27 aa, Staphylococcus
TSNYDSNRFMWQRPESIFNNQKGFERT

SEQ ID NO: 1905688 - protein, 17 aa, Staphylococcus
TSNYLKVMFLSAPFVIL

SEQ ID NO: 1905689 - protein, 17 aa, Staphylococcus
TSPFIILFLTVVGAYLF

SEQ ID NO: 1905690 - protein, 19 aa, Staphylococcus
TSPRKAILGGAKFIRTNYF

SEQ ID NO: 1905691 - protein, 19 aa, Staphylococcus
TSPRKAILGGAKFVRNQYF

SEQ ID NO: 1905692 - protein, 22 aa, Staphylococcus
TSPSLILVLYSIRMFGVALMMM

SEQ ID NO: 1905693 - protein, 22 aa, Staphylococcus
TSPVLTFLWFCAIAMHVTMMVI

SEQ ID NO: 1905694 - protein, 17 aa, Staphylococcus
TSQILMLITFLITIIHV

SEQ ID NO: 1905695 - protein, 24 aa, Staphylococcus
TSQLEKILNQYKSLDLSNKTEDSV

SEQ ID NO: 1905696 - protein, 18 aa, Staphylococcus
TSQWLQIWGFMYIVTIFT

SEQ ID NO: 1905697 - protein, 22 aa, Staphylococcus
TSRFFWLICSLAVLILAVFIFT

SEQ ID NO: 1905698 - protein, 20 aa, Staphylococcus
TSRIIFVVILVPLISYFFQD

SEQ ID NO: 1905699 - protein, 20 aa, Staphylococcus
TSRIIFVVILVPLISYFFQN

SEQ ID NO: 1905700 - protein, 42 aa, Staphylococcus
TSRKTVMRAYYKHEGNSKYLVYDVFFNNDGVNFISPGSQQRL

SEQ ID NO: 1905701 - protein, 20 aa, Staphylococcus
TSRLRKLILMILVGGAIAAS

SEQ ID NO: 1905702 - protein, 35 aa, Staphylococcus
TSSTWAWLFILFIAPVLGFFLYILFGRGVSKNKLY

SEQ ID NO: 1905703 - protein, 28 aa, Staphylococcus
TSTYVNWMIVPLFLIIVLTFVVWKKQWL

SEQ ID NO: 1905704 - protein, 29 aa, Staphylococcus
TSVAYILWFFLGGLGGHRFYLGKTGSAVG

SEQ ID NO: 1905705 - protein, 29 aa, Staphylococcus
TSVLDLLIVWYVLYLLITVFKGTKAIQLL

SEQ ID NO: 1905706 - protein, 29 aa, Staphylococcus
TSVLDLVIVWYVIYLLITVFKGTKAIQLL

SEQ ID NO: 1905707 - protein, 38 aa, Staphylococcus
TSVPEGTPVYMQWIDKDGVVSPIYRAHTNNSLSTSGGS

SEQ ID NO: 1905708 - protein, 25 aa, Staphylococcus
TSVSSFLLIVYWYSKGDSQFGAIQS

SEQ ID NO: 1905709 - protein, 19 aa, Staphylococcus
TSWIFILFIVLGGLSYTIG

SEQ ID NO: 1905710 - protein, 21 aa, Staphylococcus
TSWKWTLTALIYPIFTAYILT

SEQ ID NO: 1905711 - protein, 22 aa, Staphylococcus
TSWRVPFIIVVGIALVGYIFGA

SEQ ID NO: 1905712 - protein, 29 aa, Staphylococcus
TTAEVIFIIILGLPIYFFYEYKMNWKNTK

SEQ ID NO: 1905713 - protein, 28 aa, Staphylococcus
TTAKKRLPWLIILTFLGMITATILGSFE

SEQ ID NO: 1905714 - protein, 25 aa, Staphylococcus
TTCTYLFLFVFGVLAILALEHHHAF

SEQ ID NO: 1905715 - protein, 27 aa, Staphylococcus
TTDTPYWYVVIIYAIRMFAVALIIMPL

SEQ ID NO: 1905716 - protein, 27 aa, Staphylococcus
TTFSAVLVLFLVIWSLTYTGFSIGDLL

SEQ ID NO: 1905717 - protein, 24 aa, Staphylococcus
TTGFVIFNIPIQVLLLISSAYAAC

SEQ ID NO: 1905718 - protein, 24 aa, Staphylococcus
TTGIPMWIFVIVLTIITLYVVIKT

SEQ ID NO: 1905719 - protein, 25 aa, Staphylococcus
TTGISYDYTLNFKEGAFHEGDTFKI

SEQ ID NO: 1905720 - protein, 25 aa, Staphylococcus
TTGKYPFMMFGLPAAAFAIYRQAKP

SEQ ID NO: 1905721 - protein, 28 aa, Staphylococcus
TTGNSNHLVLGEPIIVVGNPLGVDFKES

SEQ ID NO: 1905722 - protein, 28 aa, Staphylococcus
TTGPLLAFLPVITIGLLFGLAMDYEVFL

SEQ ID NO: 1905723 - protein, 28 aa, Staphylococcus
TTGQQVSRFFVPDGLPGNDGRSITITNE

SEQ ID NO: 1905724 - protein, 21 aa, Staphylococcus
TTHVWLWAQLAVFLHVFVDIF

SEQ ID NO: 1905725 - protein, 25 aa, Staphylococcus
TTICAIILVYLLIKSLMPFVIERMD

SEQ ID NO: 1905726 - protein, 36 aa, Staphylococcus
TTIFTLFIITLLNYIILYLLLAISVSLFVPPSLFNQ

SEQ ID NO: 1905727 - protein, 32 aa, Staphylococcus
TTILIIAILVIFGILFLIFDTNLFKNDIKYTF

SEQ ID NO: 1905728 - protein, 23 aa, Staphylococcus
TTISFVISFIVVTYLHVVLGELA

SEQ ID NO: 1905729 - protein, 26 aa, Staphylococcus
TTIVGIIFILLSLVIRFILYKTTNQS

SEQ ID NO: 1905730 - protein, 28 aa, Staphylococcus
TTIVMMIILFVIITISIFKFNDNRKISH

SEQ ID NO: 1905731 - protein, 23 aa, Staphylococcus
TTLFAFLCYLIWSSVFGSRHFNQ

SEQ ID NO: 1905732 - protein, 23 aa, Staphylococcus
TTLIGIISLFSWGLGYFGQPHII

SEQ ID NO: 1905733 - protein, 30 aa, Staphylococcus
TTLLNFFHGWPWYAIWLVLLGFGGGMIVPA

SEQ ID NO: 1905734 - protein, 30 aa, Staphylococcus
TTLLNFFHGWPWYAVWLVALGFGGGMIVPA

SEQ ID NO: 1905735 - protein, 30 aa, Staphylococcus
TTLLNFFHGWPWYAVWLVLLGFGGGMIVPA

SEQ ID NO: 1905736 - protein, 29 aa, Staphylococcus
TTLLNFFHGWPWYAVWLVMLGFGGGIIIP

SEQ ID NO: 1905737 - protein, 31 aa, Staphylococcus
TTLLNLFHGWPWYAIWLVLLGFGGGMIVPAI

SEQ ID NO: 1905738 - protein, 26 aa, Staphylococcus
TTLLTLFWYIFVVIYLILIAFILWMK

SEQ ID NO: 1905739 - protein, 25 aa, Staphylococcus
TTLVGIVFIILSLIIRFIVYKTTNR

SEQ ID NO: 1905740 - protein, 23 aa, Staphylococcus
TTLWVLIIYGIIGCALLILSYIA

SEQ ID NO: 1905741 - protein, 23 aa, Staphylococcus
TTMDWDRRYPYGDTLRSIFGSVS

SEQ ID NO: 1905742 - protein, 24 aa, Staphylococcus
TTNIILLAFGYFIIPFVLGFLVHQ

SEQ ID NO: 1905743 - protein, 22 aa, Staphylococcus
TTQFLIIFTLFLFAYYTNFAPS

SEQ ID NO: 1905744 - protein, 28 aa, Staphylococcus
TTQFNWLGDLIIMLLIQIGGLGIVTITT

SEQ ID NO: 1905745 - protein, 17 aa, Staphylococcus
TTQPITVKQRRALMVKS

SEQ ID NO: 1905746 - protein, 28 aa, Staphylococcus
TTRDVSYTVSLPTSVPIKKDFNANLIYQ

SEQ ID NO: 1905747 - protein, 23 aa, Staphylococcus
TTRNAFFIGRTMDYNVSLEGALK

SEQ ID NO: 1905748 - protein, 26 aa, Staphylococcus
TTSFILAFPMAWIWPSIQTGLNAFSE

SEQ ID NO: 1905749 - protein, 28 aa, Staphylococcus
TTSLSLAYLMTLVGSILLLSAFRRKNVK

SEQ ID NO: 1905750 - protein, 25 aa, Staphylococcus
TTSTYLFLFVFGVLSILLLEHNHAF

SEQ ID NO: 1905751 - protein, 24 aa, Staphylococcus
TTTARLFDMVIQWGFLAIIVIFQP

SEQ ID NO: 1905752 - protein, 25 aa, Staphylococcus
TTTISFVIAFIIVTYLHVVLGELAP

SEQ ID NO: 1905753 - protein, 24 aa, Staphylococcus
TTTLGIISLFAWGLGYFGQPHIIV

SEQ ID NO: 1905754 - protein, 23 aa, Staphylococcus
TTTRFILNPLIISWIFLLLGMTR

SEQ ID NO: 1905755 - protein, 20 aa, Staphylococcus
TTTVYFWLVGSLSTLKWGDV

SEQ ID NO: 1905756 - protein, 26 aa, Staphylococcus
TTVATIFFIFIWTIILICYIKYRKQH

SEQ ID NO: 1905757 - protein, 19 aa, Staphylococcus
TTVFCMLLNLTPIFAILTA

SEQ ID NO: 1905758 - protein, 25 aa, Staphylococcus
TTVIGIISFFAWGLGYFGQPHIIVR

SEQ ID NO: 1905759 - protein, 34 aa, Staphylococcus
TTVIYFNFTWSYYGDLLIFLPLSLLGVERFYKEK

SEQ ID NO: 1905760 - protein, 24 aa, Staphylococcus
TTVLGIISLFAWGLGYFGQPHIIV

SEQ ID NO: 1905761 - protein, 23 aa, Staphylococcus
TTVLGIISLFSWGLGYFGQPHII

SEQ ID NO: 1905762 - protein, 27 aa, Staphylococcus
TTVLRYYFWITIALITLIVASIAWLFD

SEQ ID NO: 1905763 - protein, 34 aa, Staphylococcus
TTVMTLFVAIIIYYIILYTLFLIAELVLLPSDFL

SEQ ID NO: 1905764 - protein, 37 aa, Staphylococcus
TTVMTLLIAVIIYYIILYLMFLFAELVLLPADFLGQQ

SEQ ID NO: 1905765 - protein, 21 aa, Staphylococcus
TTVRFYLIFIAVFALIMFLCG

SEQ ID NO: 1905766 - protein, 23 aa, Staphylococcus
TTVSFVIAFIVVTYLHVVLGELA

SEQ ID NO: 1905767 - protein, 24 aa, Staphylococcus
TTVTYLVLFVFGVIIILLFEYNHA

SEQ ID NO: 1905768 - protein, 26 aa, Staphylococcus
TTWNQLMWAAPFILIALVIIISMSKQ

SEQ ID NO: 1905769 - protein, 19 aa, Staphylococcus
TTYHNIPLTSQRLISWLNS

SEQ ID NO: 1905770 - protein, 21 aa, Staphylococcus
TTYIYITLVAFNFIHGVLTLP

SEQ ID NO: 1905771 - protein, 34 aa, Staphylococcus
TVADITWIIRIISMVVIFIPLLATWRGVFQGYKS

SEQ ID NO: 1905772 - protein, 19 aa, Staphylococcus
TVAIFLGFLYQLYSPKINL

SEQ ID NO: 1905773 - protein, 24 aa, Staphylococcus
TVAQTIWTLIVTTITTIISTLVTI

SEQ ID NO: 1905774 - protein, 26 aa, Staphylococcus
TVCDVFLLLFIMKFGFRKIEAIVGTL

SEQ ID NO: 1905775 - protein, 34 aa, Staphylococcus
TVDDITWIIRIISIVVIFIPLLATWRGVFQGYKS

SEQ ID NO: 1905776 - protein, 25 aa, Staphylococcus
TVEEKQEFISKLKALVNRIHMQVND

SEQ ID NO: 1905777 - protein, 17 aa, Staphylococcus
TVFCMLLNLTPIFAILT

SEQ ID NO: 1905778 - protein, 18 aa, Staphylococcus
TVFFPLWLPVHAHGPIST

SEQ ID NO: 1905779 - protein, 20 aa, Staphylococcus
TVFKLPRVAGILRGYINTDM

SEQ ID NO: 1905780 - protein, 28 aa, Staphylococcus
TVFLTAYVLLFCLLLLGVILDAMHDTIS

SEQ ID NO: 1905781 - protein, 18 aa, Staphylococcus
TVFVILGSVFVKLILNIP

SEQ ID NO: 1905782 - protein, 38 aa, Staphylococcus
TVFYCTFLIAILLFAWPFIYSAIVAFGKWLIGFGPFGA

SEQ ID NO: 1905783 - protein, 18 aa, Staphylococcus
TVGFFFTISSKFVQLRML

SEQ ID NO: 1905784 - protein, 33 aa, Staphylococcus
TVGNHEFDFGYDQLLKLQKQLNFPIVSSNIYKN

SEQ ID NO: 1905785 - protein, 18 aa, Staphylococcus
TVGVQIFGDLLNAGGRFG

SEQ ID NO: 1905786 - protein, 18 aa, Staphylococcus
TVIALPKDSPILLEHLNH

SEQ ID NO: 1905787 - protein, 21 aa, Staphylococcus
TVIDMWFVILPVVMSIGTIAT

SEQ ID NO: 1905788 - protein, 20 aa, Staphylococcus
TVIDMWFVILPVVMSIGTLA

SEQ ID NO: 1905789 - protein, 18 aa, Staphylococcus
TVIFYFLGGVFKKAQFLQ

SEQ ID NO: 1905790 - protein, 22 aa, Staphylococcus
TVIGIISLFSWGLGYFGQPHII

SEQ ID NO: 1905791 - protein, 26 aa, Staphylococcus
TVIGLILLSLTFLPDAWYIAASVVGY

SEQ ID NO: 1905792 - protein, 30 aa, Staphylococcus
TVIGVGLFIHWIWPTLPIGAAFAVAAILCP

SEQ ID NO: 1905793 - protein, 19 aa, Staphylococcus
TVIIFIIIGILTILGIMGG

SEQ ID NO: 1905794 - protein, 20 aa, Staphylococcus
TVIIVGLISGALWAFGQGNQ

SEQ ID NO: 1905795 - protein, 21 aa, Staphylococcus
TVIKWLSFIPVSLFTALVIDS

SEQ ID NO: 1905796 - protein, 24 aa, Staphylococcus
TVILILSFVILVTSGVYLIAKYSG

SEQ ID NO: 1905797 - protein, 19 aa, Staphylococcus
TVIMRPYLDVLLLGRAQAI

SEQ ID NO: 1905798 - protein, 30 aa, Staphylococcus
TVITLFNFITLFLLLTISTLLFVPPELFSN

SEQ ID NO: 1905799 - protein, 24 aa, Staphylococcus
TVIVLIAMLFQFKLQHVATLATVT

SEQ ID NO: 1905800 - protein, 25 aa, Staphylococcus
TVIVSWLWFIFLAVVGKMIGNIDKT

SEQ ID NO: 1905801 - protein, 22 aa, Staphylococcus
TVKGNWIITVHKYPMEVLSDII

SEQ ID NO: 1905802 - protein, 26 aa, Staphylococcus
TVLDVFILLFIMKFGFRKIEAIVGAL

SEQ ID NO: 1905803 - protein, 26 aa, Staphylococcus
TVLDVFLLLFIMKFGFRKIEAIVGTL

SEQ ID NO: 1905804 - protein, 17 aa, Staphylococcus
TVLFIIATGLIGSILGS

SEQ ID NO: 1905805 - protein, 20 aa, Staphylococcus
TVLFIIVWALIIIAYINYHR

SEQ ID NO: 1905806 - protein, 19 aa, Staphylococcus
TVLFLVVWALIIIAYINYS

SEQ ID NO: 1905807 - protein, 26 aa, Staphylococcus
TVLFLVVWGLILWAYINYSRRNPELH

SEQ ID NO: 1905808 - protein, 37 aa, Staphylococcus
TVLIALAVYVFRFIWVYVLYPYFYLSVSPFQKMMSKE

SEQ ID NO: 1905809 - protein, 19 aa, Staphylococcus
TVLIFCYVIGTLIVVLRYY

SEQ ID NO: 1905810 - protein, 18 aa, Staphylococcus
TVLILILSLIMPVTMPFY

SEQ ID NO: 1905811 - protein, 23 aa, Staphylococcus
TVLIQCVFIYFLIKSIIPYVVDF

SEQ ID NO: 1905812 - protein, 22 aa, Staphylococcus
TVLIWVLILAVIIYYSIRLSTR

SEQ ID NO: 1905813 - protein, 17 aa, Staphylococcus
TVLLLKRKTPAINVDET

SEQ ID NO: 1905814 - protein, 27 aa, Staphylococcus
TVLSLCLFAGVLQWRAFRFYRFRHLRT

SEQ ID NO: 1905815 - protein, 22 aa, Staphylococcus
TVLVPFLTHLPISAALLASGIG

SEQ ID NO: 1905816 - protein, 18 aa, Staphylococcus
TVLWIFLFCYIIVASIDF

SEQ ID NO: 1905817 - protein, 19 aa, Staphylococcus
TVLWIFLFCYIIVASIDFG

SEQ ID NO: 1905818 - protein, 22 aa, Staphylococcus
TVLYLFVWTLIIISYIVYAFKN

SEQ ID NO: 1905819 - protein, 24 aa, Staphylococcus
TVMILSYFGLLSFSSSVTAGVVYA

SEQ ID NO: 1905820 - protein, 19 aa, Staphylococcus
TVMLIAYDQILRGYIAVAD

SEQ ID NO: 1905821 - protein, 18 aa, Staphylococcus
TVMTILILMALVSLSCVF

SEQ ID NO: 1905822 - protein, 24 aa, Staphylococcus
TVMTIVAGLFIAFGTIITFRKHFK

SEQ ID NO: 1905823 - protein, 25 aa, Staphylococcus
TVNIITTWLLLLPGSFLLGIHLGFG

SEQ ID NO: 1905824 - protein, 44 aa, Staphylococcus
TVNLLEGRAKPGYPKGYALESRPFLTDTAITNGGYGDVKFSVPV

SEQ ID NO: 1905825 - protein, 31 aa, Staphylococcus
TVNWKLTLIVMLPMPILVILTSYYGRLMSKG

SEQ ID NO: 1905826 - protein, 32 aa, Staphylococcus
TVPALIYYGLKFLNPHYFLVSAFLISAISSLA

SEQ ID NO: 1905827 - protein, 34 aa, Staphylococcus
TVPEITWIIRIISIVVVFIPLLATWRGVFQGYQS

SEQ ID NO: 1905828 - protein, 17 aa, Staphylococcus
TVQEGMWFVKHLQIPLF

SEQ ID NO: 1905829 - protein, 23 aa, Staphylococcus
TVQLLPITGIPLPFISYGGSSLW

SEQ ID NO: 1905830 - protein, 24 aa, Staphylococcus
TVQLLPITGIPLPFISYGGSSLWS

SEQ ID NO: 1905831 - protein, 40 aa, Staphylococcus
TVQLPSYLIIIVFLFVLINLIITFPILRKFKVATPIFKPL

SEQ ID NO: 1905832 - protein, 25 aa, Staphylococcus
TVRSYLIIIAIFAILMFFLGDAKEP

SEQ ID NO: 1905833 - protein, 24 aa, Staphylococcus
TVRSYLIIIAIFAVLMFIFGDNHE

SEQ ID NO: 1905834 - protein, 24 aa, Staphylococcus
TVRSYLIIISLFAVLMFLLGDNKE

SEQ ID NO: 1905835 - protein, 22 aa, Staphylococcus
TVSEMNQAGKITGWHVKDNDQT

SEQ ID NO: 1905836 - protein, 23 aa, Staphylococcus
TVSIFTYLFLIVTSLIIVFVISS

SEQ ID NO: 1905837 - protein, 31 aa, Staphylococcus
TVSWKLTLIAMIPLPFMVLLTSIYGSLLSKG

SEQ ID NO: 1905838 - protein, 24 aa, Staphylococcus
TVTLILFIFVGNMLGLPFAIVIDH

SEQ ID NO: 1905839 - protein, 28 aa, Staphylococcus
TVTTFLSLLLDRIGLFISMVLLILQLSA

SEQ ID NO: 1905840 - protein, 21 aa, Staphylococcus
TVVDPYLRGGSIPGTNSNVII

SEQ ID NO: 1905841 - protein, 26 aa, Staphylococcus
TVVIAMLFFIFIVLGIVSRVCGVRIT

SEQ ID NO: 1905842 - protein, 18 aa, Staphylococcus
TVVVVVIAILIFGASSLF

SEQ ID NO: 1905843 - protein, 17 aa, Staphylococcus
TVWLMITIIPISIILGV

SEQ ID NO: 1905844 - protein, 25 aa, Staphylococcus
TWGPVLWVMLPELFPMRARGAATGA

SEQ ID NO: 1905845 - protein, 19 aa, Staphylococcus
TWINLLLKTYAFIGIFSHD

SEQ ID NO: 1905846 - protein, 27 aa, Staphylococcus
TWRAKWQLTIMFVIFALLSNVTGVVIR

SEQ ID NO: 1905847 - protein, 17 aa, Staphylococcus
TWRILAPLFIVAFVFGG

SEQ ID NO: 1905848 - protein, 20 aa, Staphylococcus
TWSITLYTLLLTGTIIIFGR

SEQ ID NO: 1905849 - protein, 19 aa, Staphylococcus
TWSVTLYTLLLTGTIIIFG

SEQ ID NO: 1905850 - protein, 26 aa, Staphylococcus
TWVNIISWSLIIILSILNVYLIIQTF

SEQ ID NO: 1905851 - protein, 18 aa, Staphylococcus
TYALLYSAIILLALTFVH

SEQ ID NO: 1905852 - protein, 28 aa, Staphylococcus
TYASFLLLTWLIVIFVLLIIAYRRAKVL

SEQ ID NO: 1905853 - protein, 29 aa, Staphylococcus
TYFIVIIFQFYILHWLFSKYLIGLNPIGM

SEQ ID NO: 1905854 - protein, 23 aa, Staphylococcus
TYGFLRLEIIVAFLNGLALIVIS

SEQ ID NO: 1905855 - protein, 23 aa, Staphylococcus
TYGHLMLIYIIRSFGMSFIMMPI

SEQ ID NO: 1905856 - protein, 24 aa, Staphylococcus
TYGMIVYVVLIIAFTYFYAFVQVN

SEQ ID NO: 1905857 - protein, 20 aa, Staphylococcus
TYIGYAPIKNPQLAFSIVYT

SEQ ID NO: 1905858 - protein, 17 aa, Staphylococcus
TYIKNKVIALAKGLYNG

SEQ ID NO: 1905859 - protein, 23 aa, Staphylococcus
TYILPIIIIIIMLALAILGNQYS

SEQ ID NO: 1905860 - protein, 24 aa, Staphylococcus
TYIPLMFTLFYILCIDFYLGPSWH

SEQ ID NO: 1905861 - protein, 22 aa, Staphylococcus
TYIVGVCFLFISIYLNLAIGSS

SEQ ID NO: 1905862 - protein, 29 aa, Staphylococcus
TYKDNKLLFDPYTIVKKNGIRYGIVGVTT

SEQ ID NO: 1905863 - protein, 27 aa, Staphylococcus
TYLVQLAFFIILLMNPVILKKISLKAM

SEQ ID NO: 1905864 - protein, 45 aa, Staphylococcus
TYMMIIFGYTKWRNNWLFILFIIHYAILIYFVFCNTPMNTLFFFF

SEQ ID NO: 1905865 - protein, 25 aa, Staphylococcus
TYPLQLAFFIILLMSHSLINKISLK

SEQ ID NO: 1905866 - protein, 24 aa, Staphylococcus
TYPLQLFFFIILLMNKETLQSLEL

SEQ ID NO: 1905867 - protein, 18 aa, Staphylococcus
TYQGIFSFDVLGLQDIHR

SEQ ID NO: 1905868 - protein, 18 aa, Staphylococcus
TYQGIFSFNVLGLQDIHR

SEQ ID NO: 1905869 - protein, 23 aa, Staphylococcus
TYQSLIVLSLYLLGILVALIVST

SEQ ID NO: 1905870 - protein, 32 aa, Staphylococcus
TYRHQLLTFAWFLPVLFALSGLLILLGLILVF

SEQ ID NO: 1905871 - protein, 25 aa, Staphylococcus
TYSRIMYVIIIIAIIYFVIRYFMKR

SEQ ID NO: 1905872 - protein, 27 aa, Staphylococcus
TYSYVMYIILIIAILYLAYRLFFKKRK

SEQ ID NO: 1905873 - protein, 19 aa, Staphylococcus
TYVVMILYAGWLSTNNASL

SEQ ID NO: 1905874 - protein, 22 aa, Staphylococcus
TYYKIFLIFHINLATIGGVLGL

SEQ ID NO: 1905875 - protein, 22 aa, Staphylococcus
TYYKIFLIFHVNLATIGGVLGL

SEQ ID NO: 1905876 - protein, 20 aa, Staphylococcus
TYYVMMILSPIFITYASLHS

SEQ ID NO: 1905877 - protein, 23 aa, Staphylococcus
VAAATFIVFYFPTQRLTSRKYLR

SEQ ID NO: 1905878 - protein, 22 aa, Staphylococcus
VAAIPIILFLLCLTVFKMKGVY

SEQ ID NO: 1905879 - protein, 29 aa, Staphylococcus
VAAIVIAVIFLILFLTALSSKKKAQQQAE

SEQ ID NO: 1905880 - protein, 23 aa, Staphylococcus
VAAMFYWLLAMILEYIFNKMETS

SEQ ID NO: 1905881 - protein, 24 aa, Staphylococcus
VAAMILVLIFIFYSILIYRREHTV

SEQ ID NO: 1905882 - protein, 19 aa, Staphylococcus
VAAVAGISLFIAGIGVMNV

SEQ ID NO: 1905883 - protein, 27 aa, Staphylococcus
VACTIAFIIFFIWYPLTDKRHKQIVKE

SEQ ID NO: 1905884 - protein, 25 aa, Staphylococcus
VAEKGQLPVWFKYRNKYGFPLNAFL

SEQ ID NO: 1905885 - protein, 20 aa, Staphylococcus
VAFGKWLIGFGPFGAFLYGF

SEQ ID NO: 1905886 - protein, 23 aa, Staphylococcus
VAFYPILVPIFIAMGYDSIICVG

SEQ ID NO: 1905887 - protein, 23 aa, Staphylococcus
VAFYPILVPIFIAMGYDSIVCVG

SEQ ID NO: 1905888 - protein, 23 aa, Staphylococcus
VAFYPILVPIFLAMGYDSIVCVG

SEQ ID NO: 1905889 - protein, 52 aa, Staphylococcus
VAGEDYTQNVIFNYGNRTVPVISDINYLTKDFAEFTTYINQNRAFNTGSKVR

SEQ ID NO: 1905890 - protein, 22 aa, Staphylococcus
VAGIITWLLTALGAASVFIFKS

SEQ ID NO: 1905891 - protein, 28 aa, Staphylococcus
VAGIPIAAIGLLAPWVAGAAMALSSVSV

SEQ ID NO: 1905892 - protein, 28 aa, Staphylococcus
VAGIPIAALGLLAPWIAGAAMALSSVSV

SEQ ID NO: 1905893 - protein, 29 aa, Staphylococcus
VAGIPIAALGLLAPWIAGAAMALSSVSVV

SEQ ID NO: 1905894 - protein, 27 aa, Staphylococcus
VAGVVFLMLFRRFYWHILVYLMVFIMM

SEQ ID NO: 1905895 - protein, 26 aa, Staphylococcus
VAGWNLALYIIFRLISGIIVAGLLSY

SEQ ID NO: 1905896 - protein, 25 aa, Staphylococcus
VAGWNLFLFILFRSISGIVITGLVS

SEQ ID NO: 1905897 - protein, 24 aa, Staphylococcus
VAGWNLILFIVFRAISGIIIAGLL

SEQ ID NO: 1905898 - protein, 25 aa, Staphylococcus
VAGWNLLLFIIFRSISGIVIAGLLS

SEQ ID NO: 1905899 - protein, 18 aa, Staphylococcus
VAHVLLPFMFGPIIASII

SEQ ID NO: 1905900 - protein, 29 aa, Staphylococcus
VAICISPIWFIFLFLFYKKYKKNAEYLAE

SEQ ID NO: 1905901 - protein, 28 aa, Staphylococcus
VAIGIALFIFLIMRPPIEYLRQYLAQWT

SEQ ID NO: 1905902 - protein, 18 aa, Staphylococcus
VAIILFVAVALVLVGMFH

SEQ ID NO: 1905903 - protein, 25 aa, Staphylococcus
VAIIVMIFIFSFYKELFILSFDEEY

SEQ ID NO: 1905904 - protein, 29 aa, Staphylococcus
VAITSIILGWILAKLINKINFNKLSEKLP

SEQ ID NO: 1905905 - protein, 30 aa, Staphylococcus
VAKAKIEWEILIKSIKPIVKVKPEANEALT

SEQ ID NO: 1905906 - protein, 32 aa, Staphylococcus
VAKHKWSSLIAWVVILAAIMIPLSFNAPKFDN

SEQ ID NO: 1905907 - protein, 24 aa, Staphylococcus
VAKLIFTMLILSVTVQLTMWLLPT

SEQ ID NO: 1905908 - protein, 28 aa, Staphylococcus
VALFLAISILGFIGLILGIMVWLGMKAI

SEQ ID NO: 1905909 - protein, 30 aa, Staphylococcus
VALIILVVLVKMFGFIRALARYFERLFSHR

SEQ ID NO: 1905910 - protein, 18 aa, Staphylococcus
VALLLISFVLLTANSYVF

SEQ ID NO: 1905911 - protein, 20 aa, Staphylococcus
VALMMLLFFITVVFLVIDII

SEQ ID NO: 1905912 - protein, 23 aa, Staphylococcus
VALNLFLAWFFVYFEQGRKVVRG

SEQ ID NO: 1905913 - protein, 20 aa, Staphylococcus
VALVIYLIFNKRNLGDVGLA

SEQ ID NO: 1905914 - protein, 27 aa, Staphylococcus
VALYFSPFWLLLLYVAYKLGGFKNRVS

SEQ ID NO: 1905915 - protein, 22 aa, Staphylococcus
VAMISWMVSVFGFDLSFIIDAL

SEQ ID NO: 1905916 - protein, 23 aa, Staphylococcus
VAMNWYFIAASVFMLIPTLYFTT

SEQ ID NO: 1905917 - protein, 17 aa, Staphylococcus
VANHPLMLLVQGIVFFI

SEQ ID NO: 1905918 - protein, 30 aa, Staphylococcus
VANNGTLFGGILAALGSLLLVGSKRRSKKY

SEQ ID NO: 1905919 - protein, 17 aa, Staphylococcus
VANQPLMLLVQGIVFFI

SEQ ID NO: 1905920 - protein, 25 aa, Staphylococcus
VAPILLLILAAIFFLTLYLTKYVSL

SEQ ID NO: 1905921 - protein, 24 aa, Staphylococcus
VAPILYVIHALLTGLSLFIAATFH

SEQ ID NO: 1905922 - protein, 23 aa, Staphylococcus
VAPTLKLIFISAIILFPLGYIIG

SEQ ID NO: 1905923 - protein, 24 aa, Staphylococcus
VAPVLFVIHALLTGLSLFIAAIFH

SEQ ID NO: 1905924 - protein, 24 aa, Staphylococcus
VAPVLFVIHALLTGLSLFIAALFH

SEQ ID NO: 1905925 - protein, 18 aa, Staphylococcus
VAQALIAFVLLLAGGGDG

SEQ ID NO: 1905926 - protein, 22 aa, Staphylococcus
VAQEKVFGLNDLNNIVINVIQK

SEQ ID NO: 1905927 - protein, 19 aa, Staphylococcus
VAQSLIAFILLLAGGGDGA

SEQ ID NO: 1905928 - protein, 34 aa, Staphylococcus
VARISYTQWLKFAWKLIVVWIIICATAMSIALMI

SEQ ID NO: 1905929 - protein, 26 aa, Staphylococcus
VASALWLKVVFLPFQLLGIVLIIILI

SEQ ID NO: 1905930 - protein, 25 aa, Staphylococcus
VASATLMLVFFGTILFILGPDILSN

SEQ ID NO: 1905931 - protein, 28 aa, Staphylococcus
VASEFVYNTPLLSKKPLFIYISQSGETA

SEQ ID NO: 1905932 - protein, 20 aa, Staphylococcus
VASLDMFLNIILKESNRIES

SEQ ID NO: 1905933 - protein, 25 aa, Staphylococcus
VASLLIMAVLIWTIGIQSSAWIIVA

SEQ ID NO: 1905934 - protein, 28 aa, Staphylococcus
VASLVIMAILIWTLGIQSSAWIIIVCLS

SEQ ID NO: 1905935 - protein, 31 aa, Staphylococcus
VASSQKFLIIYSIIFMLVIVAVVLTMFAIFI

SEQ ID NO: 1905936 - protein, 32 aa, Staphylococcus
VASSQKFLIIYSIIFMLVIVAVVLTMFAVFIF

SEQ ID NO: 1905937 - protein, 24 aa, Staphylococcus
VASVIIIILIILISEVIPKSIAAT

SEQ ID NO: 1905938 - protein, 24 aa, Staphylococcus
VATLLLSIILLIMEAYTFGTVILI

SEQ ID NO: 1905939 - protein, 25 aa, Staphylococcus
VATVIFFMVFFWVLDVGIGNLIQLF

SEQ ID NO: 1905940 - protein, 24 aa, Staphylococcus
VATVLAMIGGILLLFKRRKNDEEK

SEQ ID NO: 1905941 - protein, 26 aa, Staphylococcus
VAVALFLVIFCWQPIHFYALAIKRKD

SEQ ID NO: 1905942 - protein, 29 aa, Staphylococcus
VAVALLIKRYYLMGLWLLATVGLGGILGI

SEQ ID NO: 1905943 - protein, 29 aa, Staphylococcus
VAVIAITLISVFIFLKHQLSPEQSVDQIS

SEQ ID NO: 1905944 - protein, 18 aa, Staphylococcus
VAVIFYWSLAIIIELIFH

SEQ ID NO: 1905945 - protein, 24 aa, Staphylococcus
VAVIIVFLVLLFHLVRLASKTDSI

SEQ ID NO: 1905946 - protein, 17 aa, Staphylococcus
VAVPLAAGILAFIGLIL

SEQ ID NO: 1905947 - protein, 19 aa, Staphylococcus
VAYIYPPNITYLDQLKESQ

SEQ ID NO: 1905948 - protein, 22 aa, Staphylococcus
VCALFVIIYFNLSVGSSHITFN

SEQ ID NO: 1905949 - protein, 35 aa, Staphylococcus
VCATVLFIIIVVIYRQPFLALIVGGSLTIAMTVGT

SEQ ID NO: 1905950 - protein, 26 aa, Staphylococcus
VCGLPLFFIIPNILGKYLISPALRDI

SEQ ID NO: 1905951 - protein, 17 aa, Staphylococcus
VCILVFKYKKEQLAGLK

SEQ ID NO: 1905952 - protein, 18 aa, Staphylococcus
VCLLFSPLILISYSIING

SEQ ID NO: 1905953 - protein, 23 aa, Staphylococcus
VCLMFIFLLMFNGTQFKITGAFI

SEQ ID NO: 1905954 - protein, 31 aa, Staphylococcus
VCSVVLFLIIVVIYRQPLLALIVGGSLTCAM

SEQ ID NO: 1905955 - protein, 25 aa, Staphylococcus
VCTATAIMILLYSGLKFGDSAPQGV

SEQ ID NO: 1905956 - protein, 25 aa, Staphylococcus
VCTATAIMILLYSGLKFGEKAPQGV

SEQ ID NO: 1905957 - protein, 20 aa, Staphylococcus
VCTATAIMILLYSGLKFGES

SEQ ID NO: 1905958 - protein, 24 aa, Staphylococcus
VDEPLHFQGGLTKRSYFNQNGKVT

SEQ ID NO: 1905959 - protein, 23 aa, Staphylococcus
VDEPLHFRGGLTKRSYFNKNNRI

SEQ ID NO: 1905960 - protein, 24 aa, Staphylococcus
VDFNLNIWLLLLVTIILSIFGQLG

SEQ ID NO: 1905961 - protein, 25 aa, Staphylococcus
VDGKVRTYVLLGYPTKIDANNPHGA

SEQ ID NO: 1905962 - protein, 17 aa, Staphylococcus
VDIIFYCAIFGFLVARI

SEQ ID NO: 1905963 - protein, 23 aa, Staphylococcus
VDIIKNRVLAAENNLLGAEKLAY

SEQ ID NO: 1905964 - protein, 22 aa, Staphylococcus
VDIKKILRGVSTFRTATATANP

SEQ ID NO: 1905965 - protein, 18 aa, Staphylococcus
VDIVVAHYFYKKALKNSN

SEQ ID NO: 1905966 - protein, 17 aa, Staphylococcus
VDKIKRANGLSSNDIHN

SEQ ID NO: 1905967 - protein, 29 aa, Staphylococcus
VDSPGYFTTIFAVLFLGSIQLISIGIIGE

SEQ ID NO: 1905968 - protein, 39 aa, Staphylococcus
VDSVWLSLLLIIVAFFVVPFLIAWILDLVLRKVIHLYRN

SEQ ID NO: 1905969 - protein, 34 aa, Staphylococcus
VDTSLLRYYFWVTILIVIILVGLIAWLFDYKFDR

SEQ ID NO: 1905970 - protein, 24 aa, Staphylococcus
VDTTHIWLWAQLAVFLHVFVDIFN

SEQ ID NO: 1905971 - protein, 17 aa, Staphylococcus
VDVLFLAIGAMLGWGWV

SEQ ID NO: 1905972 - protein, 22 aa, Staphylococcus
VDVMIIFLREGIEVLLIIMTLT

SEQ ID NO: 1905973 - protein, 21 aa, Staphylococcus
VDVMIIFLREGLEVLLVIMTL

SEQ ID NO: 1905974 - protein, 24 aa, Staphylococcus
VDYLLLTMLLYIPGLFVYYTVQKN

SEQ ID NO: 1905975 - protein, 21 aa, Staphylococcus
VEALQNIYLRVYYPPVVIGIT

SEQ ID NO: 1905976 - protein, 26 aa, Staphylococcus
VEALQNIYLRVYYPPVVIGITALITV

SEQ ID NO: 1905977 - protein, 17 aa, Staphylococcus
VEELLLLTKDKVNIQAL

SEQ ID NO: 1905978 - protein, 28 aa, Staphylococcus
VEEQQAAQLILDQALNTAIQNIDNADTN

SEQ ID NO: 1905979 - protein, 25 aa, Staphylococcus
VEFHVKPNPLYNRMTIRIKDNGIGI

SEQ ID NO: 1905980 - protein, 18 aa, Staphylococcus
VEFTDGNVITVLKGRDGK

SEQ ID NO: 1905981 - protein, 17 aa, Staphylococcus
VEILFATIGLMIGLLIS

SEQ ID NO: 1905982 - protein, 26 aa, Staphylococcus
VEKFTRLFKMIYLRFKARKNRKKEER

SEQ ID NO: 1905983 - protein, 25 aa, Staphylococcus
VEKRIPLFIVLLSGAFITILNQTLL

SEQ ID NO: 1905984 - protein, 21 aa, Staphylococcus
VEKYPHIRLRLVKGAYKENAS

SEQ ID NO: 1905985 - protein, 25 aa, Staphylococcus
VENHQIIWVILKYEYLENRPTISEE

SEQ ID NO: 1905986 - protein, 21 aa, Staphylococcus
VENIPFQIEYVVSKDLPVGQQ

SEQ ID NO: 1905987 - protein, 45 aa, Staphylococcus
VEPDNIKFLILISLLIALAIYVVRFIWVFLLYKDFYYPNHLQRYL

SEQ ID NO: 1905988 - protein, 27 aa, Staphylococcus
VEPVFGFMKAILVFTRMSVRGLNKVKR

SEQ ID NO: 1905989 - protein, 24 aa, Staphylococcus
VEQNLEADILFDGESTPIRKSTSY

SEQ ID NO: 1905990 - protein, 17 aa, Staphylococcus
VERKRIKEHPDVRKATD

SEQ ID NO: 1905991 - protein, 19 aa, Staphylococcus
VERLPAMVLPSWAYNMIAP

SEQ ID NO: 1905992 - protein, 19 aa, Staphylococcus
VESFILLPIVLPPTVMGFI

SEQ ID NO: 1905993 - protein, 26 aa, Staphylococcus
VESNNMFIFIQLLTPFVTYLIAEVFH

SEQ ID NO: 1905994 - protein, 27 aa, Staphylococcus
VESPTLFILVALCGAIVFNTIVYTCVS

SEQ ID NO: 1905995 - protein, 31 aa, Staphylococcus
VESPVLFVTIAVFSSLVFNSIIYTCVSMLGN

SEQ ID NO: 1905996 - protein, 34 aa, Staphylococcus
VETKFIINVIDEDKLEIQPIPNQIVKINTHIKDV

SEQ ID NO: 1905997 - protein, 24 aa, Staphylococcus
VEVVYFLLSLFISVDRKSGAFIIL

SEQ ID NO: 1905998 - protein, 18 aa, Staphylococcus
VEWGTVIVTVITFAILLA

SEQ ID NO: 1905999 - protein, 20 aa, Staphylococcus
VEWMNHFMSDRLDRNVISDP

SEQ ID NO: 1906000 - protein, 18 aa, Staphylococcus
VFALLITRETISVPSLIG

SEQ ID NO: 1906001 - protein, 17 aa, Staphylococcus
VFAMINVLILFVLCQFL

SEQ ID NO: 1906002 - protein, 29 aa, Staphylococcus
VFANAPFTLLPILIGFSAAKRFGGNAFLG

SEQ ID NO: 1906003 - protein, 29 aa, Staphylococcus
VFANAPFTLLPILIGFSAAKRFGGNPFLG

SEQ ID NO: 1906004 - protein, 19 aa, Staphylococcus
VFAVFLYALLPIIKNTYTG

SEQ ID NO: 1906005 - protein, 45 aa, Staphylococcus
VFDLALRYIQKLSYKKILITLGALLIIVVLVIVIPLFGGKGDKVT

SEQ ID NO: 1906006 - protein, 26 aa, Staphylococcus
VFEHAGWLGGFLYGLLYGPLVITGLH

SEQ ID NO: 1906007 - protein, 26 aa, Staphylococcus
VFEIFFGIMLLLKRPANWLKTGINLF

SEQ ID NO: 1906008 - protein, 31 aa, Staphylococcus
VFEYAPFAILNFLVPIISIIFAYTGFKIVKL

SEQ ID NO: 1906009 - protein, 17 aa, Staphylococcus
VFFIFVMPIFRYKNFRY

SEQ ID NO: 1906010 - protein, 17 aa, Staphylococcus
VFFLVIGILFFIITLIL

SEQ ID NO: 1906011 - protein, 17 aa, Staphylococcus
VFFSLIFPIIMMLVIIM

SEQ ID NO: 1906012 - protein, 32 aa, Staphylococcus
VFFSTILAVILLFIWPMVFSGIVAFGEWLVGF

SEQ ID NO: 1906013 - protein, 20 aa, Staphylococcus
VFFVFMFAFWFIFSSVIGLF

SEQ ID NO: 1906014 - protein, 18 aa, Staphylococcus
VFGAAIKDVEWGTIIVTL

SEQ ID NO: 1906015 - protein, 19 aa, Staphylococcus
VFGFIMLISIILAYAFKWL

SEQ ID NO: 1906016 - protein, 20 aa, Staphylococcus
VFHLILFIMWGEHQEYWYLY

SEQ ID NO: 1906017 - protein, 21 aa, Staphylococcus
VFHLILFVMWGEHQEYWYLYT

SEQ ID NO: 1906018 - protein, 18 aa, Staphylococcus
VFHLILLVMWGEHQEYWY

SEQ ID NO: 1906019 - protein, 18 aa, Staphylococcus
VFHLPVFNMLFTSGAFLL

SEQ ID NO: 1906020 - protein, 17 aa, Staphylococcus
VFIIGLVGFLWGMCLAG

SEQ ID NO: 1906021 - protein, 18 aa, Staphylococcus
VFIIVLIMFINYLGDIII

SEQ ID NO: 1906022 - protein, 17 aa, Staphylococcus
VFILLSLIVSRYLYSVA

SEQ ID NO: 1906023 - protein, 19 aa, Staphylococcus
VFITPIILTFVLAFGLSSF

SEQ ID NO: 1906024 - protein, 19 aa, Staphylococcus
VFITPIILTLVLAFGLSAF

SEQ ID NO: 1906025 - protein, 19 aa, Staphylococcus
VFITPVILTLVLAFGLSAF

SEQ ID NO: 1906026 - protein, 20 aa, Staphylococcus
VFIVLFLFFVGSILHMRYRD

SEQ ID NO: 1906027 - protein, 23 aa, Staphylococcus
VFIWLPLLLLAMEKSIQQRKSGL

SEQ ID NO: 1906028 - protein, 17 aa, Staphylococcus
VFIYKNHSSINIANKNQ

SEQ ID NO: 1906029 - protein, 17 aa, Staphylococcus
VFKGIIILALISSIFGL

SEQ ID NO: 1906030 - protein, 22 aa, Staphylococcus
VFKSMMIPLMIIVAMCFIHLNT

SEQ ID NO: 1906031 - protein, 22 aa, Staphylococcus
VFLLIMVPFFLIYMLKDHEKFI

SEQ ID NO: 1906032 - protein, 17 aa, Staphylococcus
VFLLMYLFGNEGIIAKL

SEQ ID NO: 1906033 - protein, 25 aa, Staphylococcus
VFLTRILLSLLVQSNYFKKSFWLFG

SEQ ID NO: 1906034 - protein, 19 aa, Staphylococcus
VFLVFFIYHKLRYKTKIIP

SEQ ID NO: 1906035 - protein, 33 aa, Staphylococcus
VFLVIITTWFHLPLWLLVISFFIMVCPVTGIGP

SEQ ID NO: 1906036 - protein, 24 aa, Staphylococcus
VFMILFSIFVLFRGLGKDYDAAVM

SEQ ID NO: 1906037 - protein, 18 aa, Staphylococcus
VFMLRVLSLLVISAVVIA

SEQ ID NO: 1906038 - protein, 18 aa, Staphylococcus
VFNRIGRLSGNKYSHIDL

SEQ ID NO: 1906039 - protein, 31 aa, Staphylococcus
VFNVSWVAGILWLIAAIMLLVRRPKNQYAYN

SEQ ID NO: 1906040 - protein, 23 aa, Staphylococcus
VFPEIVMALIFIKAVGPGSFSGV

SEQ ID NO: 1906041 - protein, 31 aa, Staphylococcus
VFRNTLIYAVIMAVAIFISLAFNIQKSYWIP

SEQ ID NO: 1906042 - protein, 22 aa, Staphylococcus
VFRPIMRPLFTLPGRSTVDNLA

SEQ ID NO: 1906043 - protein, 27 aa, Staphylococcus
VFRVILIPIFLLFALANFGFGKISFIG

SEQ ID NO: 1906044 - protein, 27 aa, Staphylococcus
VFRVILIPLFILFALVNFGFGNVSILG

SEQ ID NO: 1906045 - protein, 27 aa, Staphylococcus
VFRVILIPVFILFALVDFGFGKVSFLG

SEQ ID NO: 1906046 - protein, 27 aa, Staphylococcus
VFRVILIPVFILFALVDFGFGTVSVLG

SEQ ID NO: 1906047 - protein, 26 aa, Staphylococcus
VFRVILIPVFILFALVNFGFGNMTFI

SEQ ID NO: 1906048 - protein, 26 aa, Staphylococcus
VFRVILIPVFILFALVNFGFGNVSVL

SEQ ID NO: 1906049 - protein, 27 aa, Staphylococcus
VFRVVLIPVFILFALVNFGFGKVSFLG

SEQ ID NO: 1906050 - protein, 22 aa, Staphylococcus
VFSFIWIFILGLIIDGPPIFTM

SEQ ID NO: 1906051 - protein, 26 aa, Staphylococcus
VFSGFIIGAFFLPLVMLGLHHMFTPI

SEQ ID NO: 1906052 - protein, 25 aa, Staphylococcus
VFSIIFLIVIYLTIGPLFAIPRTAS

SEQ ID NO: 1906053 - protein, 33 aa, Staphylococcus
VFSKDFMNSNFWIYWKTMFAFEPWHSAMEMRRY

SEQ ID NO: 1906054 - protein, 24 aa, Staphylococcus
VFSLFIMYIWRKKIFKIPLVPYIF

SEQ ID NO: 1906055 - protein, 33 aa, Staphylococcus
VFSNDFLHSNFWIYWKTMFAFEPWHSAMEMRRY

SEQ ID NO: 1906056 - protein, 20 aa, Staphylococcus
VFSVIFLVAIYLTIGPLFAI

SEQ ID NO: 1906057 - protein, 17 aa, Staphylococcus
VFSYARALLKANVTIDS

SEQ ID NO: 1906058 - protein, 26 aa, Staphylococcus
VFTAIFYIIGILFKHMSFLQKLMSGT

SEQ ID NO: 1906059 - protein, 20 aa, Staphylococcus
VFTIFNVLKFHWIDNRTLII

SEQ ID NO: 1906060 - protein, 17 aa, Staphylococcus
VFTWVSLIVFLILSYIG

SEQ ID NO: 1906061 - protein, 25 aa, Staphylococcus
VFVFNTFFILTIVSLVITILTIIFN

SEQ ID NO: 1906062 - protein, 18 aa, Staphylococcus
VFVIIIMILVTWNDIQRY

SEQ ID NO: 1906063 - protein, 17 aa, Staphylococcus
VFVIWQPKGLDIGITAV

SEQ ID NO: 1906064 - protein, 19 aa, Staphylococcus
VFVTAVLFVIGFWTILPKD

SEQ ID NO: 1906065 - protein, 20 aa, Staphylococcus
VFWFALAICTIFVAFGAIFP

SEQ ID NO: 1906066 - protein, 19 aa, Staphylococcus
VFYVVFPIAIIIIIASIFL

SEQ ID NO: 1906067 - protein, 38 aa, Staphylococcus
VGAGLAVFSFVTQALIFAIIFGIAAIGFIIGAIMVKST

SEQ ID NO: 1906068 - protein, 22 aa, Staphylococcus
VGAIFVVIIMILVTWNDIQRYF

SEQ ID NO: 1906069 - protein, 23 aa, Staphylococcus
VGALLLAFYFYRDNPDLKHAFMQ

SEQ ID NO: 1906070 - protein, 39 aa, Staphylococcus; identical to SEQ ID NO: 1753814

SEQ ID NO: 1906071 - protein, 37 aa, Staphylococcus
VGASFKWYDFVYFIDTIVYLFILIFKGSWLDKRVFSK

SEQ ID NO: 1906072 - protein, 24 aa, Staphylococcus
VGETFSLYLIWYSIGRFFVEGLRT

SEQ ID NO: 1906073 - protein, 24 aa, Staphylococcus
VGETFTLYLIWYSIGRFFVEGLRT

SEQ ID NO: 1906074 - protein, 25 aa, Staphylococcus
VGEYMRYWFPTLPEWIPGVIVIVLL

SEQ ID NO: 1906075 - protein, 17 aa, Staphylococcus
VGFFFTISSKFVQLRML

SEQ ID NO: 1906076 - protein, 20 aa, Staphylococcus
VGFILLHQWIPYLAKIGAMM

SEQ ID NO: 1906077 - protein, 23 aa, Staphylococcus
VGFIMYSIIKIFFKNANLTKTNR

SEQ ID NO: 1906078 - protein, 25 aa, Staphylococcus
VGFTLFIFTLIMNLISYWISKRYRE

SEQ ID NO: 1906079 - protein, 24 aa, Staphylococcus
VGFTLFIFTLLMNLLSQWISKRFR

SEQ ID NO: 1906080 - protein, 25 aa, Staphylococcus
VGFTLFLFTLIMNLISHWITKRFRE

SEQ ID NO: 1906081 - protein, 19 aa, Staphylococcus
VGFTLFLFTLVMNLISQWI

SEQ ID NO: 1906082 - protein, 47 aa, Staphylococcus
VGGIVPEILITKLIIFGLFGLGFFLIGFIAKPFLDPIMTKIAKRVEE

SEQ ID NO: 1906083 - protein, 26 aa, Staphylococcus
VGGVLVWLMYLPHWKATDDQGAKLGV

SEQ ID NO: 1906084 - protein, 32 aa, Staphylococcus
VGHFSRWMLCLHPILFIFFSGVFLSSWIQSYC

SEQ ID NO: 1906085 - protein, 18 aa, Staphylococcus
VGHWKMLGIYLISGIFGN

SEQ ID NO: 1906086 - protein, 22 aa, Staphylococcus
VGHWRMFVIYLVAGLFGNFASL

SEQ ID NO: 1906087 - protein, 23 aa, Staphylococcus
VGIDFLSVMGFASAISVLFAVLA

SEQ ID NO: 1906088 - protein, 26 aa, Staphylococcus
VGIDYALFILFRYRQIVKTESNHIKA

SEQ ID NO: 1906089 - protein, 26 aa, Staphylococcus
VGIDYALFILFRYRQVMKTETDYIKG

SEQ ID NO: 1906090 - protein, 25 aa, Staphylococcus
VGIDYSLFILFRYKEIKKSGTATVE

SEQ ID NO: 1906091 - protein, 25 aa, Staphylococcus
VGIDYSLFILFRYKEIRKKGTPPVE

SEQ ID NO: 1906092 - protein, 26 aa, Staphylococcus
VGIIALLTFIFDIPNFTLTLAVMIGL

SEQ ID NO: 1906093 - protein, 25 aa, Staphylococcus
VGIIALLTYIFDIPNFTLTLAVMIG

SEQ ID NO: 1906094 - protein, 29 aa, Staphylococcus
VGILKFGIPMLIPLLIKYVIDDIINNGAI

SEQ ID NO: 1906095 - protein, 24 aa, Staphylococcus
VGILLLLQLLFFAVQPWILYHHRY

SEQ ID NO: 1906096 - protein, 24 aa, Staphylococcus
VGIPIGIFIARFKKLAWPVITIAN

SEQ ID NO: 1906097 - protein, 22 aa, Staphylococcus
VGISPLIALFPSGLYAIVQQFN

SEQ ID NO: 1906098 - protein, 17 aa, Staphylococcus
VGIVFFLAILVGATYLI

SEQ ID NO: 1906099 - protein, 27 aa, Staphylococcus
VGKRGTLYSIVKFNNQTIGRFVKETYN

SEQ ID NO: 1906100 - protein, 27 aa, Staphylococcus
VGKTSLFKVPLWSTWLVWGIVTIIIVG

SEQ ID NO: 1906101 - protein, 23 aa, Staphylococcus
VGKVSLRFWPLTDFKFNFNPDMS

SEQ ID NO: 1906102 - protein, 25 aa, Staphylococcus
VGLLGRFYIIFALFLSVLFLNETLC

SEQ ID NO: 1906103 - protein, 24 aa, Staphylococcus
VGLPILTAPFIFATWLVLFAGKMS

SEQ ID NO: 1906104 - protein, 25 aa, Staphylococcus
VGLPLFTALPILTALLEKYGIRDQI

SEQ ID NO: 1906105 - protein, 18 aa, Staphylococcus
VGLPLLTALPIVSGMLEK

SEQ ID NO: 1906106 - protein, 24 aa, Staphylococcus
VGLTFLFIKFLINKGFKEKLSDYR

SEQ ID NO: 1906107 - protein, 22 aa, Staphylococcus
VGLVIICCLIGFVRSFILLIIL

SEQ ID NO: 1906108 - protein, 23 aa, Staphylococcus
VGLVLLIPLVFTIAKKLKVSQVK

SEQ ID NO: 1906109 - protein, 31 aa, Staphylococcus
VGLVYAVIYYVIFRFLIKKLNFKTPGREDKM

SEQ ID NO: 1906110 - protein, 26 aa, Staphylococcus
VGLYFLISSLFLLMLVRLLHGIAFGL

SEQ ID NO: 1906111 - protein, 26 aa, Staphylococcus
VGMCLVLLLFYLMHQKTLIPLAIQRV

SEQ ID NO: 1906112 - protein, 25 aa, Staphylococcus
VGMIGLIIIILLALIGPLLSSHDYA

SEQ ID NO: 1906113 - protein, 27 aa, Staphylococcus
VGMIVFFLIFGLFINKVTRLLKEAEMW

SEQ ID NO: 1906114 - protein, 19 aa, Staphylococcus
VGMLLIALTFLPTVIYVIS

SEQ ID NO: 1906115 - protein, 27 aa, Staphylococcus
VGNFFMSVLGFIFILYANRFMMKRRQQ

SEQ ID NO: 1906116 - protein, 22 aa, Staphylococcus
VGNPLGADFKGSVSSGIISGLN

SEQ ID NO: 1906117 - protein, 23 aa, Staphylococcus
VGPALLIPLYVQNALGLSALLSG

SEQ ID NO: 1906118 - protein, 18 aa, Staphylococcus
VGPLFEAFMEKAVADRLA

SEQ ID NO: 1906119 - protein, 18 aa, Staphylococcus
VGPYKMLGIYLISGLFGN

SEQ ID NO: 1906120 - protein, 40 aa, Staphylococcus
VGQMIDSFFNYLFGMSRFLTYILVILGTVFITYSKKIPKT

SEQ ID NO: 1906121 - protein, 41 aa, Staphylococcus
VGRGYKKVLKWSLNHKWIVLILTTLILIGSIALGAAKIGTS

SEQ ID NO: 1906122 - protein, 44 aa, Staphylococcus
VGRMIDSFFNYLFGASRYLTYILVSLITIYIAMQRHFPKTRRTF

SEQ ID NO: 1906123 - protein, 25 aa, Staphylococcus
VGSAIIMFAIILIVLQFTGLLSLES

SEQ ID NO: 1906124 - protein, 31 aa, Staphylococcus
VGSFSIVFLIMNPLLFVVFVFVFINSYCQTH

SEQ ID NO: 1906125 - protein, 26 aa, Staphylococcus
VGSGFAFLGLLLLSLTFLPNVAYIIS

SEQ ID NO: 1906126 - protein, 24 aa, Staphylococcus
VGSIWLIVTIIPITIILGIGTAIY

SEQ ID NO: 1906127 - protein, 24 aa, Staphylococcus
VGSKILLMIILKLLGIHTSVSLIF

SEQ ID NO: 1906128 - protein, 27 aa, Staphylococcus
VGSVFLFIIIVIFLMYANHLFIKRRTQ

SEQ ID NO: 1906129 - protein, 27 aa, Staphylococcus
VGSVFLFIIIVIFLMYVNQLFIKQRVK

SEQ ID NO: 1906130 - protein, 22 aa, Staphylococcus
VGSWLFLLGIGLLYKTVGTLNF

SEQ ID NO: 1906131 - protein, 20 aa, Staphylococcus
VGSWRMLVIYFVSGLFGNFV

SEQ ID NO: 1906132 - protein, 29 aa, Staphylococcus
VGSYFIAIALFFFAFTTILAYYYIAETNI

SEQ ID NO: 1906133 - protein, 17 aa, Staphylococcus
VGSYFLFIIIVVFIMYT

SEQ ID NO: 1906134 - protein, 25 aa, Staphylococcus
VGTLFLLILNIIFNIQMFSSSFYAG

SEQ ID NO: 1906135 - protein, 17 aa, Staphylococcus
VGTLIFAIILAVVKGIG

SEQ ID NO: 1906136 - protein, 24 aa, Staphylococcus
VGTLWLMITIIPISIILGVGTAIY

SEQ ID NO: 1906137 - protein, 24 aa, Staphylococcus
VGTLWLMITIIPISIVLGVGTAIY

SEQ ID NO: 1906138 - protein, 25 aa, Staphylococcus
VGTLWLMLTIIPFSIILGVGTAIYL

SEQ ID NO: 1906139 - protein, 18 aa, Staphylococcus
VGVFIIVAIIGAILSFIK

SEQ ID NO: 1906140 - protein, 29 aa, Staphylococcus
VGVGFFIHWVWPNLPMPAGFALAAILCPT

SEQ ID NO: 1906141 - protein, 30 aa, Staphylococcus
VGVIFLITFLIYLFYSPRLKFDVLENPNKS

SEQ ID NO: 1906142 - protein, 18 aa, Staphylococcus
VGVILQIVYKLPIIVSVV

SEQ ID NO: 1906143 - protein, 18 aa, Staphylococcus
VGVMLFVARIWDAINDPI

SEQ ID NO: 1906144 - protein, 26 aa, Staphylococcus
VGVSTLIGIVFGWIPARAASKKELID

SEQ ID NO: 1906145 - protein, 35 aa, Staphylococcus
VGVYLAIILVVCSCYLAFILIGSLQGKDMSNSVLD

SEQ ID NO: 1906146 - protein, 22 aa, Staphylococcus
VGWAVLLRLIVIGMSYLMLFAT

SEQ ID NO: 1906147 - protein, 23 aa, Staphylococcus
VGYSVAIFFIFFGAPDLALTQFV

SEQ ID NO: 1906148 - protein, 20 aa, Staphylococcus
VHGEWYRLITSMFLHFNFEH

SEQ ID NO: 1906149 - protein, 20 aa, Staphylococcus
VHGEWYRLVTSMFLHFNFEH

SEQ ID NO: 1906150 - protein, 34 aa, Staphylococcus
VHHLNWHWVYFTLTVLYLCLIFVIYRYVPESPRR

SEQ ID NO: 1906151 - protein, 19 aa, Staphylococcus
VHIDSKLILQVLFNLVDNA

SEQ ID NO: 1906152 - protein, 27 aa, Staphylococcus
VHIMMYIVALFLPVFIIFTVKKPVQKN

SEQ ID NO: 1906153 - protein, 29 aa, Staphylococcus
VHISILTLFKPLFIFIPRSIWPNKPGALS

SEQ ID NO: 1906154 - protein, 31 aa, Staphylococcus
VHISVLFIICILLLIGPYFFFRSSVSLVLKL

SEQ ID NO: 1906155 - protein, 23 aa, Staphylococcus
VHITWMNWFLAALVPGLVSLIVV

SEQ ID NO: 1906156 - protein, 24 aa, Staphylococcus
VHKIYFCINLILPFILITIFLIFL

SEQ ID NO: 1906157 - protein, 17 aa, Staphylococcus
VHLILHVICICIAYWAL

SEQ ID NO: 1906158 - protein, 22 aa, Staphylococcus
VHLILHVLCICIAYWALNSLKL

SEQ ID NO: 1906159 - protein, 17 aa, Staphylococcus
VHTFIPKVPLAFIQITF

SEQ ID NO: 1906160 - protein, 21 aa, Staphylococcus
VIAALFYLFVGLDYEIFDYQF

SEQ ID NO: 1906161 - protein, 17 aa, Staphylococcus
VIAFLWVLFQDEDSFKL

SEQ ID NO: 1906162 - protein, 20 aa, Staphylococcus
VIAIIAFFAILLLVPKKARN

SEQ ID NO: 1906163 - protein, 27 aa, Staphylococcus
VIAIIVVFFIILFYKELFILSFDEEYS

SEQ ID NO: 1906164 - protein, 35 aa, Staphylococcus
VIALAVYVFRFVWVYVLYPYFYLPVSPFERAMNEG

SEQ ID NO: 1906165 - protein, 19 aa, Staphylococcus
VIALLPNALLGELLKLFKD

SEQ ID NO: 1906166 - protein, 18 aa, Staphylococcus
VIALPLFMEVFAFFFEAI

SEQ ID NO: 1906167 - protein, 18 aa, Staphylococcus
VIANFWFIQALGAAYLIF

SEQ ID NO: 1906168 - protein, 26 aa, Staphylococcus
VIAPSGNLRVYRLNPSTLSDEEVNKV

SEQ ID NO: 1906169 - protein, 23 aa, Staphylococcus
VIAQFIVLGLFFTLHKFYIASVV

SEQ ID NO: 1906170 - protein, 23 aa, Staphylococcus
VIATVLLLVFMFIAIRGASVSGT

SEQ ID NO: 1906171 - protein, 41 aa, Staphylococcus
VIDDFGKAVGFITLTGLLSGFWLVLAKRRKKEEEEEKLNGK

SEQ ID NO: 1906172 - protein, 22 aa, Staphylococcus
VIDFLIVAFALFLFVKLANTLM

SEQ ID NO: 1906173 - protein, 22 aa, Staphylococcus
VIEEKLLRFLPTLKNKYDIFVS

SEQ ID NO: 1906174 - protein, 19 aa, Staphylococcus
VIFAAFIGFAFLRVMRKQP

SEQ ID NO: 1906175 - protein, 19 aa, Staphylococcus
VIFATFIGFAYLRVARKQP

SEQ ID NO: 1906176 - protein, 20 aa, Staphylococcus
VIFAVWILAMIEKRLHKVIP

SEQ ID NO: 1906177 - protein, 23 aa, Staphylococcus
VIFAVWILSIIEKKLHKVTPNAI

SEQ ID NO: 1906178 - protein, 17 aa, Staphylococcus
VIFTILMGNAFAAFTVI

SEQ ID NO: 1906179 - protein, 18 aa, Staphylococcus
VIFYLLIVFGVATGLSPS

SEQ ID NO: 1906180 - protein, 19 aa, Staphylococcus
VIFYLSIVSIFISSVLTMI

SEQ ID NO: 1906181 - protein, 19 aa, Staphylococcus
VIGCYFYLKKFSKGPIEWL

SEQ ID NO: 1906182 - protein, 23 aa, Staphylococcus
VIGGYSLFKVGFQNLIRFDFDMK

SEQ ID NO: 1906183 - protein, 21 aa, Staphylococcus
VIGIFLYVITLQKTNLFGVLK

SEQ ID NO: 1906184 - protein, 26 aa, Staphylococcus
VIGILLLLSLIIFLKLNTFISLIVTS

SEQ ID NO: 1906185 - protein, 26 aa, Staphylococcus
VIGIPKWIQFLFIIIVAMVVSASMRV

SEQ ID NO: 1906186 - protein, 24 aa, Staphylococcus
VIGLLLVLIIYFLLTVLAQGVIEQ

SEQ ID NO: 1906187 - protein, 17 aa, Staphylococcus
VIGPFFALPRLATTSFE

SEQ ID NO: 1906188 - protein, 17 aa, Staphylococcus
VIGPFFALPRLATTSYE

SEQ ID NO: 1906189 - protein, 30 aa, Staphylococcus
VIGVGFFIHWIWPDLPMPAAFAIAAILCPT

SEQ ID NO: 1906190 - protein, 26 aa, Staphylococcus
VIGVGFFIHWIWPELPTGAAFAIAAI

SEQ ID NO: 1906191 - protein, 30 aa, Staphylococcus
VIGVGFFIHWIWPNLPMPAAFAIAGILCPT

SEQ ID NO: 1906192 - protein, 25 aa, Staphylococcus
VIGVGLFIHLVWPDLPIGAAFAIAA

SEQ ID NO: 1906193 - protein, 29 aa, Staphylococcus
VIGVGLFVHWIWPELPIGAAFAIAAILCP

SEQ ID NO: 1906194 - protein, 30 aa, Staphylococcus
VIGVGYFIAWIWPELPMPAAFAIAAILCPT

SEQ ID NO: 1906195 - protein, 30 aa, Staphylococcus; identical to SEQ ID NO: 1753853

SEQ ID NO: 1906196 - protein, 28 aa, Staphylococcus
VIGVILLAILAYLYFSVMKNNAQIEKGY

SEQ ID NO: 1906197 - protein, 18 aa, Staphylococcus
VIHILDMMVDKYFEFVYT

SEQ ID NO: 1906198 - protein, 18 aa, Staphylococcus
VIIAMFILQFLLNFFIPS

SEQ ID NO: 1906199 - protein, 23 aa, Staphylococcus
VIIAMFILQFMLNFFIPSGSGQA

SEQ ID NO: 1906200 - protein, 19 aa, Staphylococcus
VIIAPFWMGILGLMYLRYK

SEQ ID NO: 1906201 - protein, 25 aa, Staphylococcus
VIIASFWPFLVVLGVHWGLVPIMID

SEQ ID NO: 1906202 - protein, 17 aa, Staphylococcus
VIIEILSIMNIVFAVTT

SEQ ID NO: 1906203 - protein, 22 aa, Staphylococcus
VIIFMVPGIIPLVPGGLAFDAT

SEQ ID NO: 1906204 - protein, 22 aa, Staphylococcus
VIIFYMGMMGSIKTLDFVIGII

SEQ ID NO: 1906205 - protein, 21 aa, Staphylococcus
VIIGILLGLFLGVIAAIKQNT

SEQ ID NO: 1906206 - protein, 26 aa, Staphylococcus
VIIGLFIIFLFIWMIFKTVQLQCFNN

SEQ ID NO: 1906207 - protein, 28 aa, Staphylococcus
VIIIALVVVGIMFYLRSSKRQVVEQTEE

SEQ ID NO: 1906208 - protein, 25 aa, Staphylococcus
VIIIIAFIAALFIKGLPKPPVENND

SEQ ID NO: 1906209 - protein, 22 aa, Staphylococcus
VIIIILIIAIVLNQRYMKDRVE

SEQ ID NO: 1906210 - protein, 18 aa, Staphylococcus
VIILFCILVLISIGMHQP

SEQ ID NO: 1906211 - protein, 23 aa, Staphylococcus
VIILFICSIMIKWQPNYSMISPT

SEQ ID NO: 1906212 - protein, 26 aa, Staphylococcus
VIILLFTLLLQIFFYKDLNLTINDQV

SEQ ID NO: 1906213 - protein, 28 aa, Staphylococcus
VIIQSFLTLLFLLFLILSATGIIQPDLT

SEQ ID NO: 1906214 - protein, 17 aa, Staphylococcus
VIITFLLLMINLGLMTK

SEQ ID NO: 1906215 - protein, 18 aa, Staphylococcus
VIIVGLISGALWAFGQGN

SEQ ID NO: 1906216 - protein, 19 aa, Staphylococcus
VIIYFIVGAALGILIIPEV

SEQ ID NO: 1906217 - protein, 25 aa, Staphylococcus
VIKNNFIVIIIFLFNIKDFKYDDFY

SEQ ID NO: 1906218 - protein, 25 aa, Staphylococcus
VIKRGATLPTHLAGGSTTQIPVTIN

SEQ ID NO: 1906219 - protein, 25 aa, Staphylococcus
VILATVLGCLIIYTGFGIFKDSIFT

SEQ ID NO: 1906220 - protein, 24 aa, Staphylococcus
VILAVFLPLIYFTPNKITYDNTNE

SEQ ID NO: 1906221 - protein, 23 aa, Staphylococcus
VILAVWLLSIIEKKLHKIVPNAI

SEQ ID NO: 1906222 - protein, 17 aa, Staphylococcus
VILFILGIAFIVGSGVL

SEQ ID NO: 1906223 - protein, 17 aa, Staphylococcus
VILFLTIVGAYLFFRSS

SEQ ID NO: 1906224 - protein, 37 aa, Staphylococcus
VILGFILHFIFDLNSPWILILFVLVIIVNASWNTIGR

SEQ ID NO: 1906225 - protein, 17 aa, Staphylococcus
VILGVLMPLFGFSLIIV

SEQ ID NO: 1906226 - protein, 24 aa, Staphylococcus
VILIILIMITVYAIPYLDVLLLGR

SEQ ID NO: 1906227 - protein, 20 aa, Staphylococcus
VILKLLLNIPLIMAFHTVGA

SEQ ID NO: 1906228 - protein, 20 aa, Staphylococcus
VILLAILTMAFRIAPMPSAA

SEQ ID NO: 1906229 - protein, 20 aa, Staphylococcus
VILMIILCLLRLNVIISLFI

SEQ ID NO: 1906230 - protein, 18 aa, Staphylococcus
VILMLLMFIGRVGLISFI

SEQ ID NO: 1906231 - protein, 17 aa, Staphylococcus
VILSFIFGIPLGTGFGV

SEQ ID NO: 1906232 - protein, 27 aa, Staphylococcus
VILSIITIFILLWIAVRSYKNTILSFD

SEQ ID NO: 1906233 - protein, 26 aa, Staphylococcus
VILSTIVALLQLLTGDWRGAWQTMSK

SEQ ID NO: 1906234 - protein, 23 aa, Staphylococcus
VILVALFIWRQSKLETPLLNFSV

SEQ ID NO: 1906235 - protein, 32 aa, Staphylococcus
VILVVVNLFLAWFFVFFPWGNWFVSKMADGIS

SEQ ID NO: 1906236 - protein, 20 aa, Staphylococcus
VIMAILIWSMGVQSSAWVSI

SEQ ID NO: 1906237 - protein, 21 aa, Staphylococcus
VIMFICITLIGLFSQWARTTN

SEQ ID NO: 1906238 - protein, 28 aa, Staphylococcus
VIMIIFMAMPFIFGLWNAVVPLQIGARD

SEQ ID NO: 1906239 - protein, 25 aa, Staphylococcus
VIMIIFMAMPFIFGLWNVVVPLQIG

SEQ ID NO: 1906240 - protein, 20 aa, Staphylococcus
VIMTELDEVYFLGNERLIHQ

SEQ ID NO: 1906241 - protein, 24 aa, Staphylococcus
VIMVFALIGFLPYNLNPAKVFMGD

SEQ ID NO: 1906242 - protein, 31 aa, Staphylococcus
VINVLTILSSIFFPLTLLTGWFGMNFTNMPE

SEQ ID NO: 1906243 - protein, 18 aa, Staphylococcus
VIPILTAILLIFIGKRPL

SEQ ID NO: 1906244 - protein, 34 aa, Staphylococcus
VIPVGIAYALIYYFLFTFLIKKLNLKTPGREDKE

SEQ ID NO: 1906245 - protein, 33 aa, Staphylococcus
VIPVGIVYAIVYYFLFDFAIRKFKLKTPGREDK

SEQ ID NO: 1906246 - protein, 17 aa, Staphylococcus
VIPVLPVYLKDLGLKGS

SEQ ID NO: 1906247 - protein, 23 aa, Staphylococcus
VIQEAVSIFKYLTNGAYTMINYT

SEQ ID NO: 1906248 - protein, 17 aa, Staphylococcus
VIQFTLHDETYPRLFRI

SEQ ID NO: 1906249 - protein, 20 aa, Staphylococcus
VIQIIFGYLLSRFLINTKRK

SEQ ID NO: 1906250 - protein, 31 aa, Staphylococcus
VIQLIVGLFTAFIQLLTGDFSGAWLTLQTTI

SEQ ID NO: 1906251 - protein, 26 aa, Staphylococcus
VIQVAPWLVILLVSIVAIVVISQTAT

SEQ ID NO: 1906252 - protein, 26 aa, Staphylococcus
VIQWGFLAIIVIFQPEIRRALEQLGR

SEQ ID NO: 1906253 - protein, 20 aa, Staphylococcus
VIQWGVLALIVIFQPEIRRA

SEQ ID NO: 1906254 - protein, 20 aa, Staphylococcus
VIQYWTPMAGIPAWVWSCIF

SEQ ID NO: 1906255 - protein, 18 aa, Staphylococcus
VIQYYYPSIYALEEISFM

SEQ ID NO: 1906256 - protein, 25 aa, Staphylococcus
VIRFAIICSILVLIIFVAIRNRLLS

SEQ ID NO: 1906257 - protein, 22 aa, Staphylococcus
VISAILIAIGWWQIWHRHVNAH

SEQ ID NO: 1906258 - protein, 19 aa, Staphylococcus
VISCLTFFIVTYGISRWVI

SEQ ID NO: 1906259 - protein, 23 aa, Staphylococcus
VISCLTYFIVTFGISKWVILYGR

SEQ ID NO: 1906260 - protein, 26 aa, Staphylococcus
VISDRDIYNIFRKETFSGNQYLNSLQ

SEQ ID NO: 1906261 - protein, 24 aa, Staphylococcus
VISGVIMIIVFFINQKLAKRTNSS

SEQ ID NO: 1906262 - protein, 19 aa, Staphylococcus
VISGYLITSLLIIEYYRTG

SEQ ID NO: 1906263 - protein, 17 aa, Staphylococcus
VISIVVGLLVVIVVTKF

SEQ ID NO: 1906264 - protein, 23 aa, Staphylococcus
VISLIISFLIWYFTRNWRRSRRE

SEQ ID NO: 1906265 - protein, 20 aa, Staphylococcus
VISMLIFLMAIFLILKKAIK

SEQ ID NO: 1906266 - protein, 25 aa, Staphylococcus
VISPMKLLFIILLIIGIIGLKISTD

SEQ ID NO: 1906267 - protein, 44 aa, Staphylococcus
VISSFIMMFILDVRLAFMAMFFMPIIILVLALYRKYASIFFAEA

SEQ ID NO: 1906268 - protein, 34 aa, Staphylococcus
VITIIGVIGLMIFAFIFTIGYILSNIDPENKLEG

SEQ ID NO: 1906269 - protein, 19 aa, Staphylococcus
VITIILMIIAGFGLILFGI

SEQ ID NO: 1906270 - protein, 33 aa, Staphylococcus
VITIIVLVVIGVLAFWFWNNATSYVTTDNAKVD

SEQ ID NO: 1906271 - protein, 30 aa, Staphylococcus
VITIVVLAVIGIIGFHFYNNATSYVTTDNA

SEQ ID NO: 1906272 - protein, 25 aa, Staphylococcus
VITLKFYIIVLIGILYILIHHYRYH

SEQ ID NO: 1906273 - protein, 19 aa, Staphylococcus
VITSIAFLVVLLLLTIQFT

SEQ ID NO: 1906274 - protein, 23 aa, Staphylococcus
VITTWCLLIPLSYLTAFVLGWGY

SEQ ID NO: 1906275 - protein, 19 aa, Staphylococcus
VIVGIPVAMISWMVSVFGF

SEQ ID NO: 1906276 - protein, 25 aa, Staphylococcus
VIVGLFIIFLFIWMSFRTIQLQCFN

SEQ ID NO: 1906277 - protein, 18 aa, Staphylococcus
VIVGTAFPEGLQGMNTAR

SEQ ID NO: 1906278 - protein, 18 aa, Staphylococcus
VIVLIIRLVLMPLMFIQV

SEQ ID NO: 1906279 - protein, 18 aa, Staphylococcus
VIVMMFILSWLMPSYVAI

SEQ ID NO: 1906280 - protein, 17 aa, Staphylococcus
VIVPDYPSSKGTPTVTV

SEQ ID NO: 1906281 - protein, 19 aa, Staphylococcus
VIVTFAWMIIGFSISFDQG

SEQ ID NO: 1906282 - protein, 25 aa, Staphylococcus
VIVTLLIFVLWISILFSRMYFHAHF

SEQ ID NO: 1906283 - protein, 25 aa, Staphylococcus
VIVTVVFFLIFFYALDLGIGKLIEL

SEQ ID NO: 1906284 - protein, 20 aa, Staphylococcus
VIYITLFLAIVLLFKHYKLS

SEQ ID NO: 1906285 - protein, 27 aa, Staphylococcus
VIYLMFFGMLVFGFIKVGWIPIKGFEI

SEQ ID NO: 1906286 - protein, 19 aa, Staphylococcus
VIYSLIITTLFWAMRNFIP

SEQ ID NO: 1906287 - protein, 29 aa, Staphylococcus
VIYYNFTWSFYGNLLILLPLSLFAMERFF

SEQ ID NO: 1906288 - protein, 24 aa, Staphylococcus
VKAYPFLDITLLQNIFTLMSSAGN

SEQ ID NO: 1906289 - protein, 24 aa, Staphylococcus
VKDLWIIIIFITFSWSFYTIFDQQ

SEQ ID NO: 1906290 - protein, 26 aa, Staphylococcus
VKEGLAKVAYVYPPNTRYLETLESSQ

SEQ ID NO: 1906291 - protein, 19 aa, Staphylococcus
VKELWISVLTICFILAVSK

SEQ ID NO: 1906292 - protein, 23 aa, Staphylococcus
VKFKEMVHMLLYNNAAFLTTDNS

SEQ ID NO: 1906293 - protein, 21 aa, Staphylococcus
VKFNIPIQVLLLIASTYAAFI

SEQ ID NO: 1906294 - protein, 39 aa, Staphylococcus
VKFSVPVKNWNSDLSVNGFVMMYPNGNGYSNNLDPYSTQ

SEQ ID NO: 1906295 - protein, 28 aa, Staphylococcus
VKGLSFFYIFIGLFMFGLLSKSSIVLNI

SEQ ID NO: 1906296 - protein, 24 aa, Staphylococcus
VKGQIVQVKGLPYKDHSLAQNAMD

SEQ ID NO: 1906297 - protein, 27 aa, Staphylococcus
VKGSNFNFNNFNNFISNAPSGSQFSWV

SEQ ID NO: 1906298 - protein, 29 aa, Staphylococcus
VKIAISIYLAMVLLVCSSYLVLILVGSLQ

SEQ ID NO: 1906299 - protein, 18 aa, Staphylococcus
VKIAPWLTNHVFVMISSI

SEQ ID NO: 1906300 - protein, 38 aa, Staphylococcus
VKIAVGIYLALVLLACSSYLIFILIGSLQGNDMSHSVL

SEQ ID NO: 1906301 - protein, 22 aa, Staphylococcus
VKKIKMILLLLAVILAGASISI

SEQ ID NO: 1906302 - protein, 26 aa, Staphylococcus
VKKISRFFRMFYLRFKARKNLRKQEY

SEQ ID NO: 1906303 - protein, 25 aa, Staphylococcus
VKKMLYIFLFCFIGNIIGGFILFLL

SEQ ID NO: 1906304 - protein, 17 aa, Staphylococcus
VKLAKPLIGLSILILIV

SEQ ID NO: 1906305 - protein, 26 aa, Staphylococcus
VKMMMQYLHLLPFLQDLITDGIIAGV

SEQ ID NO: 1906306 - protein, 25 aa, Staphylococcus
VKNEQIAKIAAITPSKDYKNNAIAE

SEQ ID NO: 1906307 - protein, 23 aa, Staphylococcus
VKPYKWRIIATILVGILKFGIPM

SEQ ID NO: 1906308 - protein, 24 aa, Staphylococcus
VKPYKWRIVATIIIGIIKFGIPML

SEQ ID NO: 1906309 - protein, 24 aa, Staphylococcus
VKPYKYRIFATIIIGIIKFGIPML

SEQ ID NO: 1906310 - protein, 19 aa, Staphylococcus
VKPYKYRIIATIIIGIIKF

SEQ ID NO: 1906311 - protein, 26 aa, Staphylococcus
VKQSKPMPPIIIWDKEKGSISIKPNG

SEQ ID NO: 1906312 - protein, 25 aa, Staphylococcus
VKQVFWRILLFYVLSIFVISAIIPY

SEQ ID NO: 1906313 - protein, 24 aa, Staphylococcus
VKQVFWRILLFYVLSIVVIAAIIP

SEQ ID NO: 1906314 - protein, 25 aa, Staphylococcus
VKRDFLLILVYVLGNMYLPFILADA

SEQ ID NO: 1906315 - protein, 26 aa, Staphylococcus
VKRDFWLIPIYLLANNIMPLLLFAAI

SEQ ID NO: 1906316 - protein, 22 aa, Staphylococcus
VKRELGFVLMALNIRKVVAQRA

SEQ ID NO: 1906317 - protein, 25 aa, Staphylococcus
VKSNPIDIIHFLTLSKNTMRKMVQN

SEQ ID NO: 1906318 - protein, 19 aa, Staphylococcus
VKTLLFFIVGSLVYISGYR

SEQ ID NO: 1906319 - protein, 23 aa, Staphylococcus
VKTRPLYLASMGIFLFGTIVAAI

SEQ ID NO: 1906320 - protein, 25 aa, Staphylococcus
VKVTTDPYTLVELLDKHGHVIGKAT

SEQ ID NO: 1906321 - protein, 21 aa, Staphylococcus
VKWCRMMIRQILSNSLKYSQG

SEQ ID NO: 1906322 - protein, 34 aa, Staphylococcus
VKWKYVGILLVIQFIFAFLLLKTNVGITVIGGIA

SEQ ID NO: 1906323 - protein, 24 aa, Staphylococcus
VKYIRFHLALLLLPVIVGIVGLVT

SEQ ID NO: 1906324 - protein, 25 aa, Staphylococcus
VKYIRLHLTLLLLPVIVGVIGLITI

SEQ ID NO: 1906325 - protein, 50 aa, Staphylococcus
VLAAFIFVISPIYFRFTVYWPFFSDVFIWLPLLLWSIERFLKSGKIGFFI

SEQ ID NO: 1906326 - protein, 19 aa, Staphylococcus
VLAFIGLVLSPAIGAILMS

SEQ ID NO: 1906327 - protein, 25 aa, Staphylococcus
VLAFLICVLGILTFGIFPHLMPSFN

SEQ ID NO: 1906328 - protein, 37 aa, Staphylococcus
VLAFLVKYIDFPISVYIQPFLIALLFGIGTDYCILLL

SEQ ID NO: 1906329 - protein, 20 aa, Staphylococcus
VLAIILNVYGIFSYGWSFNE

SEQ ID NO: 1906330 - protein, 25 aa, Staphylococcus
VLAITLWIATWWITEAIPIAATSLL

SEQ ID NO: 1906331 - protein, 18 aa, Staphylococcus
VLALITGDIGSMPDLKKP

SEQ ID NO: 1906332 - protein, 33 aa, Staphylococcus
VLANSILLIILFLILICILILNWKFLHLTDNWS

SEQ ID NO: 1906333 - protein, 19 aa, Staphylococcus
VLATLLNFGWIFIGLTTFK

SEQ ID NO: 1906334 - protein, 19 aa, Staphylococcus
VLATLLNLGWLFIGLTTFK

SEQ ID NO: 1906335 - protein, 17 aa, Staphylococcus
VLAVMIPIFGVGKLPAI

SEQ ID NO: 1906336 - protein, 18 aa, Staphylococcus
VLAVRNINTIHFASRTIE

SEQ ID NO: 1906337 - protein, 20 aa, Staphylococcus
VLAVTLFVATWWITESIPIP

SEQ ID NO: 1906338 - protein, 20 aa, Staphylococcus
VLAYAFKWLGLVDDVLLMII

SEQ ID NO: 1906339 - protein, 25 aa, Staphylococcus
VLDAGGHPWQESQPGTFIVTSAQPN

SEQ ID NO: 1906340 - protein, 23 aa, Staphylococcus
VLDNAQMPFGRYYKLDIVGVIKD

SEQ ID NO: 1906341 - protein, 23 aa, Staphylococcus
VLETIYRLILKYLRWYIKTVKGS

SEQ ID NO: 1906342 - protein, 30 aa, Staphylococcus
VLETLLLILVAYILIIIQSYIFIRKRSIHE

SEQ ID NO: 1906343 - protein, 17 aa, Staphylococcus
VLFFFKERLMVTRRIAI

SEQ ID NO: 1906344 - protein, 18 aa, Staphylococcus
VLFFMLKDSHHFKEYSTK

SEQ ID NO: 1906345 - protein, 24 aa, Staphylococcus
VLFGIAFIIGLFRLIKGPTTADRV

SEQ ID NO: 1906346 - protein, 17 aa, Staphylococcus
VLFHPLVGGFLLAAILA

SEQ ID NO: 1906347 - protein, 17 aa, Staphylococcus
VLFLIVWALIIIAYINY

SEQ ID NO: 1906348 - protein, 19 aa, Staphylococcus
VLFLVVWGLIIYAYIRYQK

SEQ ID NO: 1906349 - protein, 19 aa, Staphylococcus
VLFTLCIILSIIGLLLSLF

SEQ ID NO: 1906350 - protein, 25 aa, Staphylococcus
VLFVPALVCFFFFAVFGASAIYLQN

SEQ ID NO: 1906351 - protein, 20 aa, Staphylococcus
VLFVPALVCFIFFAVFGASA

SEQ ID NO: 1906352 - protein, 20 aa, Staphylococcus
VLFVPALVCFLFFAVFGASA

SEQ ID NO: 1906353 - protein, 19 aa, Staphylococcus
VLGFLFGLLLVFLMRKILP

SEQ ID NO: 1906354 - protein, 25 aa, Staphylococcus
VLGIFAIILIILFKGKTENLIPLYA

SEQ ID NO: 1906355 - protein, 29 aa, Staphylococcus
VLGVAVIYLFMLGFYRLPGLVAIIALTTY

SEQ ID NO: 1906356 - protein, 29 aa, Staphylococcus
VLGVGLFVHWIWPELPIGAAFALAAILCP

SEQ ID NO: 1906357 - protein, 18 aa, Staphylococcus
VLGWTFFIACLNLAGIPP

SEQ ID NO: 1906358 - protein, 26 aa, Staphylococcus
VLHKRIIFTILILVIYILGSNISIIG

SEQ ID NO: 1906359 - protein, 25 aa, Staphylococcus
VLIATMVLCAIFILSAYNNANSEQT

SEQ ID NO: 1906360 - protein, 30 aa, Staphylococcus
VLIAVSMLMTLWLVPLLSSKRARRLKQLVK

SEQ ID NO: 1906361 - protein, 17 aa, Staphylococcus
VLIAWILYYFVKIRLTN

SEQ ID NO: 1906362 - protein, 19 aa, Staphylococcus
VLIAWILYYFVNIQLTNYN

SEQ ID NO: 1906363 - protein, 18 aa, Staphylococcus
VLIFIGWMLLAQIPIVLI

SEQ ID NO: 1906364 - protein, 25 aa, Staphylococcus
VLIGIILVFSIFKPTYRKPGLYKDY

SEQ ID NO: 1906365 - protein, 18 aa, Staphylococcus
VLIGILNYFKILPFIIKV

SEQ ID NO: 1906366 - protein, 19 aa, Staphylococcus
VLIGLFVANWKVGLSALLS

SEQ ID NO: 1906367 - protein, 37 aa, Staphylococcus
VLIGPMIHYFSWLGLFIILILYMIGLFASIRIDRLKY

SEQ ID NO: 1906368 - protein, 17 aa, Staphylococcus
VLIICVIVMMLGLSLFM

SEQ ID NO: 1906369 - protein, 17 aa, Staphylococcus
VLIIFTFIPLIDQIFNG

SEQ ID NO: 1906370 - protein, 19 aa, Staphylococcus
VLIIILLVLIFIEITEYRL

SEQ ID NO: 1906371 - protein, 18 aa, Staphylococcus
VLILCVIVMMLTLSFVMP

SEQ ID NO: 1906372 - protein, 19 aa, Staphylococcus
VLILFFITYFGVIMSAIVR

SEQ ID NO: 1906373 - protein, 19 aa, Staphylococcus
VLILIGIFLGSIKGGVYAL

SEQ ID NO: 1906374 - protein, 17 aa, Staphylococcus
VLILPYVHLITTAIGDM

SEQ ID NO: 1906375 - protein, 23 aa, Staphylococcus
VLILTLCVFIWNLFHWGTNPTVQ

SEQ ID NO: 1906376 - protein, 34 aa, Staphylococcus
VLIQLPNCFEFIFVLFALFKIGAIPVLALATHRK

SEQ ID NO: 1906377 - protein, 25 aa, Staphylococcus
VLISILLLTLISVGIYAVFRHQHLQ

SEQ ID NO: 1906378 - protein, 21 aa, Staphylococcus
VLITLAFLVVCNQPLSAATPN

SEQ ID NO: 1906379 - protein, 21 aa, Staphylococcus
VLIVIGFILALFIKENRNAKD

SEQ ID NO: 1906380 - protein, 25 aa, Staphylococcus
VLKDKLFMYLIIGSSILLMGELSTS

SEQ ID NO: 1906381 - protein, 18 aa, Staphylococcus
VLKFLFDLIYPLTPFEMV

SEQ ID NO: 1906382 - protein, 36 aa, Staphylococcus
VLKGRLTTRQIYLGKAGLFLLLGVVQALIVTLGDLL

SEQ ID NO: 1906383 - protein, 29 aa, Staphylococcus
VLKRPFRFRKLVLMLILSVIVLYLNHILI

SEQ ID NO: 1906384 - protein, 22 aa, Staphylococcus
VLLALIIFGGIKWIANAATAIV

SEQ ID NO: 1906385 - protein, 19 aa, Staphylococcus
VLLGLRTAGALGCGIFAIV

SEQ ID NO: 1906386 - protein, 18 aa, Staphylococcus
VLLGVLAPLVTWYDPNHI

SEQ ID NO: 1906387 - protein, 27 aa, Staphylococcus
VLLIDSLFGLLIVVLIYTTIISSFQQL

SEQ ID NO: 1906388 - protein, 20 aa, Staphylococcus
VLLIFLVVLTILSLFIGVSQ

SEQ ID NO: 1906389 - protein, 27 aa, Staphylococcus
VLLIIIIVPLTWLILNINDIKENMNET

SEQ ID NO: 1906390 - protein, 20 aa, Staphylococcus
VLLIPLVFTIAKRANVSALK

SEQ ID NO: 1906391 - protein, 19 aa, Staphylococcus
VLLLFLIIVLYVVFMGLFL

SEQ ID NO: 1906392 - protein, 27 aa, Staphylococcus
VLLNIGLTCIFLVFTFLREVKLYQHFY

SEQ ID NO: 1906393 - protein, 31 aa, Staphylococcus
VLLPFILSGFLFYVFLPLQKLLEKYRVPRWG

SEQ ID NO: 1906394 - protein, 25 aa, Staphylococcus
VLLQNVFSVQLRWFPVAGWEGLPTI

SEQ ID NO: 1906395 - protein, 24 aa, Staphylococcus
VLLSLIVMILLLWIAVRSYRDSVL

SEQ ID NO: 1906396 - protein, 18 aa, Staphylococcus
VLLTVFIHLGLNTLLEPF

SEQ ID NO: 1906397 - protein, 18 aa, Staphylococcus
VLLVFSYNGWVLLLAGVF

SEQ ID NO: 1906398 - protein, 17 aa, Staphylococcus
VLLVISVLLILIIPNIA

SEQ ID NO: 1906399 - protein, 21 aa, Staphylococcus
VLLVLLLPKIKLLQVGTLKAQ

SEQ ID NO: 1906400 - protein, 28 aa, Staphylococcus
VLMDVLSWQLVIFAIAMIVLVRPISVLL

SEQ ID NO: 1906401 - protein, 23 aa, Staphylococcus
VLMGQILFHPLVGGFLLAAILAA

SEQ ID NO: 1906402 - protein, 27 aa, Staphylococcus
VLMNVLSWKLVIFSLVMIVLVRPIAVL

SEQ ID NO: 1906403 - protein, 17 aa, Staphylococcus
VLMPLFGFSLIIVFIIE

SEQ ID NO: 1906404 - protein, 19 aa, Staphylococcus
VLMVMLPLAFIFTISIVFF

SEQ ID NO: 1906405 - protein, 41 aa, Staphylococcus
VLNAYPWLTNKYIISLIGIVLFFIIFGVFIPRVIKSLRKLE

SEQ ID NO: 1906406 - protein, 27 aa, Staphylococcus
VLNIGMTAIFLLFAFLKEIKLYQHFYE

SEQ ID NO: 1906407 - protein, 20 aa, Staphylococcus
VLNILIWTLIMIAYLNYVKR

SEQ ID NO: 1906408 - protein, 32 aa, Staphylococcus
VLNISKDGKKFLFFDNYSFNVPQKSVSIYPSS

SEQ ID NO: 1906409 - protein, 21 aa, Staphylococcus
VLNLGIPWQIGLTGVLFSGIV

SEQ ID NO: 1906410 - protein, 25 aa, Staphylococcus
VLNNKWVWAIAFANIFVYFVRYGVL

SEQ ID NO: 1906411 - protein, 19 aa, Staphylococcus
VLNQFYWFFGTTIGSLFGV

SEQ ID NO: 1906412 - protein, 34 aa, Staphylococcus
VLPIGIVWFCLYYIIFRFLIIKFNFKTPGREDKE

SEQ ID NO: 1906413 - protein, 22 aa, Staphylococcus
VLPIYIFIYMITNKKTNEVERK

SEQ ID NO: 1906414 - protein, 23 aa, Staphylococcus
VLPPIAAMIFIKLGYHPIAGLVM

SEQ ID NO: 1906415 - protein, 28 aa, Staphylococcus
VLQEPWFLVILAFFSLLTGLIIGMVNLV

SEQ ID NO: 1906416 - protein, 24 aa, Staphylococcus
VLRSEWLHNTGKIYERINENDRKH

SEQ ID NO: 1906417 - protein, 33 aa, Staphylococcus
VLRYLQIVAIFITALLFLLAHPMAWMMGDVHLE

SEQ ID NO: 1906418 - protein, 30 aa, Staphylococcus
VLSALIFNALIIVLLIPIAMKGVKFKGAST

SEQ ID NO: 1906419 - protein, 24 aa, Staphylococcus
VLSFLLCVLGILTFGIFPHLMPTF

SEQ ID NO: 1906420 - protein, 24 aa, Staphylococcus
VLSIILAFAFKWLGFVDDVLLMVI

SEQ ID NO: 1906421 - protein, 19 aa, Staphylococcus
VLSIMPWLIAAFIAALLMA

SEQ ID NO: 1906422 - protein, 26 aa, Staphylococcus
VLSLYISGFFLFFHYARLKELKCDRF

SEQ ID NO: 1906423 - protein, 27 aa, Staphylococcus
VLSSSIVNLLFLPPKFETKIYYNSANI

SEQ ID NO: 1906424 - protein, 20 aa, Staphylococcus
VLSTLFILIPTLIVGMILML

SEQ ID NO: 1906425 - protein, 29 aa, Staphylococcus
VLSWIGNILHLLYLGFIALMVSMMGNKDF

SEQ ID NO: 1906426 - protein, 26 aa, Staphylococcus
VLSYPVYLFIIGLIIMIVVGVWKVAT

SEQ ID NO: 1906427 - protein, 18 aa, Staphylococcus
VLTICSFIRFILQPINRY

SEQ ID NO: 1906428 - protein, 21 aa, Staphylococcus
VLTLDFQNLTSNGSQYIIVLD

SEQ ID NO: 1906429 - protein, 33 aa, Staphylococcus
VLTLGFLLAFASLFLVIWFPTSPFVLIASAILL

SEQ ID NO: 1906430 - protein, 18 aa, Staphylococcus
VLTLGFLLAFISLFLVIW

SEQ ID NO: 1906431 - protein, 21 aa, Staphylococcus
VLTLLIIIAISYIILFALLMI

SEQ ID NO: 1906432 - protein, 34 aa, Staphylococcus
VLTQKGWSSLWVWPLLLLSLLLIVNFVLSNKAAE

SEQ ID NO: 1906433 - protein, 18 aa, Staphylococcus
VLTVFLINWIIGIFKKYS

SEQ ID NO: 1906434 - protein, 29 aa, Staphylococcus
VLTWIGFILHTLYVIFLVLIQMMVSDSDF

SEQ ID NO: 1906435 - protein, 22 aa, Staphylococcus
VLVFINPMWFGIIFAIVGALLI

SEQ ID NO: 1906436 - protein, 18 aa, Staphylococcus
VLVGFAALFFVEFSLFRS

SEQ ID NO: 1906437 - protein, 18 aa, Staphylococcus
VLVLWVGFLIYQFGFHNG

SEQ ID NO: 1906438 - protein, 22 aa, Staphylococcus
VLVTLVIILTIVSLFVGVSKLA

SEQ ID NO: 1906439 - protein, 26 aa, Staphylococcus
VLVTTPFVLFFFLKDGHHFKETAIKV

SEQ ID NO: 1906440 - protein, 30 aa, Staphylococcus
VLVVSVKLFGFLRAIARYYERLYSHRTTFT

SEQ ID NO: 1906441 - protein, 18 aa, Staphylococcus
VLWGILPIYWELIHHIGA

SEQ ID NO: 1906442 - protein, 22 aa, Staphylococcus
VLWTFLFFYIIVASIDFGAGFL

SEQ ID NO: 1906443 - protein, 24 aa, Staphylococcus
VLYDYHMDKKWYPASMTKLMTMYL

SEQ ID NO: 1906444 - protein, 28 aa, Staphylococcus
VLYGVLLLIVTVIPFYVFNVLKIAGPSS

SEQ ID NO: 1906445 - protein, 18 aa, Staphylococcus
VLYLMHKHHRITDKEYAD

SEQ ID NO: 1906446 - protein, 18 aa, Staphylococcus
VLYLMHYHHRISDKQWKE

SEQ ID NO: 1906447 - protein, 24 aa, Staphylococcus
VLYSILLTWIIGRILQRISPIATT

SEQ ID NO: 1906448 - protein, 32 aa, Staphylococcus
VLYYNFTWSFYGDLLIILPLSLWGMERFFQRR

SEQ ID NO: 1906449 - protein, 26 aa, Staphylococcus
VMAGVILNFVLVFSSLKLLGYSEETI

SEQ ID NO: 1906450 - protein, 17 aa, Staphylococcus
VMALIFIKAVGPGSFSG

SEQ ID NO: 1906451 - protein, 33 aa, Staphylococcus
VMALITSPIMLLKLLIVWTLVQFFEGHFISPNV

SEQ ID NO: 1906452 - protein, 18 aa, Staphylococcus
VMALVMLIYLFTSVGARN

SEQ ID NO: 1906453 - protein, 17 aa, Staphylococcus
VMAPLSFVLASLAIYWA

SEQ ID NO: 1906454 - protein, 45 aa, Staphylococcus
VMDLKKIAKTPAVLVILGGLALLPSFYAWFNLEATWDPYGNTKNI

SEQ ID NO: 1906455 - protein, 17 aa, Staphylococcus
VMFAILVAAYRRAKVLK

SEQ ID NO: 1906456 - protein, 17 aa, Staphylococcus
VMFITIILILMSHNLAI

SEQ ID NO: 1906457 - protein, 18 aa, Staphylococcus
VMFLIMNTIAQFFLVIPN

SEQ ID NO: 1906458 - protein, 19 aa, Staphylococcus
VMFYFNFTWSFYGDVLIYF

SEQ ID NO: 1906459 - protein, 18 aa, Staphylococcus
VMGAIEFLGGVLAALSGP

SEQ ID NO: 1906460 - protein, 20 aa, Staphylococcus
VMGFILLIVFSPRSYIGAFF

SEQ ID NO: 1906461 - protein, 18 aa, Staphylococcus
VMGLIAMVLLVVGIALTS

SEQ ID NO: 1906462 - protein, 44 aa, Staphylococcus
VMGNTNWDFIMVWLPLHAKLALWSVMLTILCATITLVTMLFSKK

SEQ ID NO: 1906463 - protein, 26 aa, Staphylococcus
VMHLSMWLLFIGFVILVAPVTGVATL

SEQ ID NO: 1906464 - protein, 19 aa, Staphylococcus
VMIGLFIGAIYMIIADKYS

SEQ ID NO: 1906465 - protein, 19 aa, Staphylococcus
VMIGLFLGAIYMIIADKYS

SEQ ID NO: 1906466 - protein, 18 aa, Staphylococcus
VMIIFFVALLLVSPIIFY

SEQ ID NO: 1906467 - protein, 18 aa, Staphylococcus
VMIIPLNSDAHLIHPIWL

SEQ ID NO: 1906468 - protein, 19 aa, Staphylococcus
VMILLVRPISVIVSTFRTE

SEQ ID NO: 1906469 - protein, 18 aa, Staphylococcus
VMIVLRFVQGLTGGASAV

SEQ ID NO: 1906470 - protein, 18 aa, Staphylococcus
VMLLSIIIWLLIGMVFFA

SEQ ID NO: 1906471 - protein, 18 aa, Staphylococcus
VMLLTIAIILGFGALEIG

SEQ ID NO: 1906472 - protein, 27 aa, Staphylococcus
VMMMLTPFWYIFLGIYVLFIAFIIWQK

SEQ ID NO: 1906473 - protein, 31 aa, Staphylococcus
VMMVLLNIILPYAALLLIGIFVWNIMQWSTN

SEQ ID NO: 1906474 - protein, 22 aa, Staphylococcus
VMNNISFWLFAGAMLLFNLSFI

SEQ ID NO: 1906475 - protein, 17 aa, Staphylococcus
VMQDGFLGSLFGVENTG

SEQ ID NO: 1906476 - protein, 24 aa, Staphylococcus
VMQRIGKCFALLQLTGEILNDIDG

SEQ ID NO: 1906477 - protein, 24 aa, Staphylococcus
VMTFAFIIWMIFHVGFLVFGLEQQ

SEQ ID NO: 1906478 - protein, 19 aa, Staphylococcus
VMVGVILNFVLVFTSLNLL

SEQ ID NO: 1906479 - protein, 19 aa, Staphylococcus
VMVIFLREGLEVLLIVMAL

SEQ ID NO: 1906480 - protein, 23 aa, Staphylococcus
VMVLIIIFYRPLMVSTFDPVFSR

SEQ ID NO: 1906481 - protein, 21 aa, Staphylococcus
VMYIIIGILIKISGTGWLMHL

SEQ ID NO: 1906482 - protein, 25 aa, Staphylococcus
VMYQYRLLLTIYFALTFWISIIILW

SEQ ID NO: 1906483 - protein, 25 aa, Staphylococcus
VNAGNIYTYDPIRKDIYADTDVTDP

SEQ ID NO: 1906484 - protein, 20 aa, Staphylococcus
VNALQIRFILDWNSQAHRPQ

SEQ ID NO: 1906485 - protein, 23 aa, Staphylococcus
VNDKLFIMNWISFFMLGIVYAKF

SEQ ID NO: 1906486 - protein, 32 aa, Staphylococcus
VNEGDYFTVDMPDYANFNGIADYTAVDNKIYP

SEQ ID NO: 1906487 - protein, 21 aa, Staphylococcus
VNEVYLISHAILETGAVKSDL

SEQ ID NO: 1906488 - protein, 21 aa, Staphylococcus
VNEVYLISHALLETGASKSQL

SEQ ID NO: 1906489 - protein, 22 aa, Staphylococcus
VNEVYLISHALLETGSVKSELA

SEQ ID NO: 1906490 - protein, 21 aa, Staphylococcus
VNFLMYLIHYTLIVTVTIFTI

SEQ ID NO: 1906491 - protein, 25 aa, Staphylococcus
VNGYILITVLILSLAVVSWQVALVA

SEQ ID NO: 1906492 - protein, 17 aa, Staphylococcus
VNHLWLEWFAQETMKWI

SEQ ID NO: 1906493 - protein, 25 aa, Staphylococcus
VNICAWGLIIILSFLNIYLIIETFK

SEQ ID NO: 1906494 - protein, 22 aa, Staphylococcus
VNIFLVALRKITKVRTLFITGH

SEQ ID NO: 1906495 - protein, 26 aa, Staphylococcus
VNIGKLFVIFLIRTIITLPIITLIAH

SEQ ID NO: 1906496 - protein, 22 aa, Staphylococcus
VNIPLLYFQGFLLGFGASMTLV

SEQ ID NO: 1906497 - protein, 22 aa, Staphylococcus
VNKYYFCFDLITPVIIITVICA

SEQ ID NO: 1906498 - protein, 23 aa, Staphylococcus
VNLLSIVVIVLVVYFLVPPVLGI

SEQ ID NO: 1906499 - protein, 23 aa, Staphylococcus
VNPMHIWLWAQLGVFLHVFVDIF

SEQ ID NO: 1906500 - protein, 28 aa, Staphylococcus
VNQNLWILVLIIPTWINLLLKTYAFIGI

SEQ ID NO: 1906501 - protein, 30 aa, Staphylococcus
VNQPLIFGVLLLLVTVIPYYIFSSLNIPGP

SEQ ID NO: 1906502 - protein, 25 aa, Staphylococcus
VNRWQKFYILIIATLLSVLSSLFGL

SEQ ID NO: 1906503 - protein, 24 aa, Staphylococcus
VNSTYIGYAPIKDPKLAFSIVYTN

SEQ ID NO: 1906504 - protein, 22 aa, Staphylococcus
VNTFFIIMWLLGQMSIWNFLFL

SEQ ID NO: 1906505 - protein, 23 aa, Staphylococcus
VNTFFLVMWLLAQASIWNFLFLR

SEQ ID NO: 1906506 - protein, 20 aa, Staphylococcus
VNVALSRMKPFLAGVSKGME

SEQ ID NO: 1906507 - protein, 24 aa, Staphylococcus
VNVIYIIIALLALILMFIKVTPST

SEQ ID NO: 1906508 - protein, 21 aa, Staphylococcus
VNWMYIAIIIMIVIGLLLYRK

SEQ ID NO: 1906509 - protein, 23 aa, Staphylococcus
VNYCSWILIIVLSVLNVYLIIET

SEQ ID NO: 1906510 - protein, 30 aa, Staphylococcus
VPALIYYGLKFLNPSYFLISAFIISAICSL

SEQ ID NO: 1906511 - protein, 29 aa, Staphylococcus
VPALIYYGLKFLNPSYFLVSAFIISAITS

SEQ ID NO: 1906512 - protein, 18 aa, Staphylococcus
VPCYLCAILAIIYGFTGI

SEQ ID NO: 1906513 - protein, 45 aa, Staphylococcus
VPEHALTKYLFYTFFLLFITIILFVTFVHYAVLALLICFLFGFGT

SEQ ID NO: 1906514 - protein, 22 aa, Staphylococcus
VPEKWMLGLLGLIPIYLGIKVA

SEQ ID NO: 1906515 - protein, 26 aa, Staphylococcus
VPFGDDWFAYFMRRLAERPQNLSLAF

SEQ ID NO: 1906516 - protein, 20 aa, Staphylococcus
VPFYIIGFLAAFIVGLIAIK

SEQ ID NO: 1906517 - protein, 20 aa, Staphylococcus
VPFYLLGFLAAFIVGLIAIK

SEQ ID NO: 1906518 - protein, 18 aa, Staphylococcus
VPGILITNAIRDLLAGEL

SEQ ID NO: 1906519 - protein, 17 aa, Staphylococcus
VPGILITNAIRDLMAGE

SEQ ID NO: 1906520 - protein, 31 aa, Staphylococcus
VPILTAFFCTFLVLVLLVAWPVVYNAIVTFG

SEQ ID NO: 1906521 - protein, 21 aa, Staphylococcus
VPIQFNMITLLIFGVVLIIIS

SEQ ID NO: 1906522 - protein, 33 aa, Staphylococcus
VPIVIGIAVLVFIIWIIFVHPGQFEDALVAMIS

SEQ ID NO: 1906523 - protein, 33 aa, Staphylococcus
VPKAIKQVFWRILIFYILAIFVIGMLIPYDSSA

SEQ ID NO: 1906524 - protein, 34 aa, Staphylococcus
VPKAIKQVFWRILLFYILAIFIIGMLIPYDSKSL

SEQ ID NO: 1906525 - protein, 35 aa, Staphylococcus
VPKAIKQVFWRILLFYILAIFIIGMLIPYDSSALM

SEQ ID NO: 1906526 - protein, 33 aa, Staphylococcus
VPKAIKQVFWRILLFYILAIFVIGMLIPYNSNA

SEQ ID NO: 1906527 - protein, 27 aa, Staphylococcus
VPLTVILLAILYFLLTKWLFKIEDADQ

SEQ ID NO: 1906528 - protein, 25 aa, Staphylococcus
VPPIAIALAMIIFKRKFTKAQRGSI

SEQ ID NO: 1906529 - protein, 17 aa, Staphylococcus
VPPPWLNGGDLGRDIIN

SEQ ID NO: 1906530 - protein, 37 aa, Staphylococcus
VPQSRPGQNLIVNPMWYNLNFALVPQNDVKIDITNYN

SEQ ID NO: 1906531 - protein, 35 aa, Staphylococcus
VPRIHLGWFVLPVPIVLFIYFLTYIPITTSGNTIM

SEQ ID NO: 1906532 - protein, 24 aa, Staphylococcus
VPTLTILFKHLLPKVLPSILVLII

SEQ ID NO: 1906533 - protein, 18 aa, Staphylococcus
VPTMFFFTGLIIGIIPYL

SEQ ID NO: 1906534 - protein, 22 aa, Staphylococcus
VPVLMFAFFGIILGFATLFKNP

SEQ ID NO: 1906535 - protein, 21 aa, Staphylococcus
VPVLMFAFFGIVLGFATLFKN

SEQ ID NO: 1906536 - protein, 31 aa, Staphylococcus
VPVYTVAAIFYWALAIIIELIFHKLELHTTH

SEQ ID NO: 1906537 - protein, 26 aa, Staphylococcus
VPWSFKLHIFLGFSIFALWPFTRLVH

SEQ ID NO: 1906538 - protein, 25 aa, Staphylococcus
VPYFILTEMPPFVGGLLIAAIFAAA

SEQ ID NO: 1906539 - protein, 26 aa, Staphylococcus
VPYFILTEMPPFVGGLLIAAIFAAAQ

SEQ ID NO: 1906540 - protein, 26 aa, Staphylococcus
VPYGDDWFAYFMRRLAERPQNLSLAV

SEQ ID NO: 1906541 - protein, 26 aa, Staphylococcus
VPYGNDWFAYFMRRLAERPQNLSLAY

SEQ ID NO: 1906542 - protein, 17 aa, Staphylococcus
VQELLTQANGLNTAMKA

SEQ ID NO: 1906543 - protein, 18 aa, Staphylococcus
VQFFKKLLPVIPDVYRKF

SEQ ID NO: 1906544 - protein, 26 aa, Staphylococcus
VQFFNWFALMYLWTYSTGAIAKNVWN

SEQ ID NO: 1906545 - protein, 24 aa, Staphylococcus
VQFVMLLITFGLLALTLLIGKEIN

SEQ ID NO: 1906546 - protein, 24 aa, Staphylococcus
VQGFFKGFLSLIPVLCGIIVGYIV

SEQ ID NO: 1906547 - protein, 25 aa, Staphylococcus
VQGVCFFVLYYVIFRVVIQVFNLNT

SEQ ID NO: 1906548 - protein, 25 aa, Staphylococcus
VQHRDFIYRFFYWMNNIAMAIGMLI

SEQ ID NO: 1906549 - protein, 25 aa, Staphylococcus
VQLISFIIYIIWQVALIMFYYKSRQ

SEQ ID NO: 1906550 - protein, 25 aa, Staphylococcus
VQLLSFIIYVIWQVALIMFYYKSRQ

SEQ ID NO: 1906551 - protein, 18 aa, Staphylococcus
VQLMPRYDSQNQVLGPVR

SEQ ID NO: 1906552 - protein, 27 aa, Staphylococcus
VQLNIMEWLYFTYLLLGVFLAMYCMIL

SEQ ID NO: 1906553 - protein, 26 aa, Staphylococcus
VQLPSYIIIIVFLLVLINIIITFPIL

SEQ ID NO: 1906554 - protein, 18 aa, Staphylococcus
VQLRWIPEMFRAIGEKPE

SEQ ID NO: 1906555 - protein, 36 aa, Staphylococcus
VQLTRFEKVLYISLITVIALISIYVLSLKMDAYDTR

SEQ ID NO: 1906556 - protein, 37 aa, Staphylococcus; identical to SEQ ID NO: 1753952

SEQ ID NO: 1906557 - protein, 18 aa, Staphylococcus
VQNFYTLTWLIGLLIMIG

SEQ ID NO: 1906558 - protein, 31 aa, Staphylococcus
VQNKYSIRKFSVGITSILIGASVIFGANSEA

SEQ ID NO: 1906559 - protein, 22 aa, Staphylococcus
VQQAMLLHYISGKYVLDLKEDD

SEQ ID NO: 1906560 - protein, 25 aa, Staphylococcus
VQQGMMIIIFLLLLATLVIGKNING

SEQ ID NO: 1906561 - protein, 26 aa, Staphylococcus
VQSKKEEVYRRLLASNLTSVPERFII

SEQ ID NO: 1906562 - protein, 23 aa, Staphylococcus
VQSNYFKKSFWLFGVSKKDRHDI

SEQ ID NO: 1906563 - protein, 28 aa, Staphylococcus
VRCPLFLIKAIIFILLPIYTIYTGMAPS

SEQ ID NO: 1906564 - protein, 19 aa, Staphylococcus
VRFLDAEALVLFNPYQMTK

SEQ ID NO: 1906565 - protein, 27 aa, Staphylococcus
VRFVKWVLYVVALFLPIFIVYTVVKPV

SEQ ID NO: 1906566 - protein, 23 aa, Staphylococcus
VRGAIAWFYSMIWAILGFLWINH

SEQ ID NO: 1906567 - protein, 23 aa, Staphylococcus
VRGLVLLVKGLIIGLKNAIVAIW

SEQ ID NO: 1906568 - protein, 27 aa, Staphylococcus
VRIVLPLIIIIILFTVLYSVAPNVKTK

SEQ ID NO: 1906569 - protein, 17 aa, Staphylococcus
VRKFYFCINLILPFLII

SEQ ID NO: 1906570 - protein, 30 aa, Staphylococcus
VRKIIGALRSWIIAAWNYIKNKVVALAKAL

SEQ ID NO: 1906571 - protein, 34 aa, Staphylococcus
VRKKIILVLFVIPFPIMVWGVMSQGWWFPVMAAM

SEQ ID NO: 1906572 - protein, 19 aa, Staphylococcus
VRLFALIGIPFAAGIINFV

SEQ ID NO: 1906573 - protein, 23 aa, Staphylococcus
VRLYLIVMAVFAIVMFFLGDAKE

SEQ ID NO: 1906574 - protein, 25 aa, Staphylococcus
VRNKIFFTLAMLVIFKIGTYIPAPG

SEQ ID NO: 1906575 - protein, 35 aa, Staphylococcus
VRRRITVFGGILLAIILMLIIVLVLQKQSNSEDAA

SEQ ID NO: 1906576 - protein, 21 aa, Staphylococcus
VRSNEMMYTKKDKLLELPHTG

SEQ ID NO: 1906577 - protein, 23 aa, Staphylococcus
VRSYLIIIAIFAILMFIFGDKNE

SEQ ID NO: 1906578 - protein, 25 aa, Staphylococcus
VRYEASFFYYLFSKNAYIAHHEPKF

SEQ ID NO: 1906579 - protein, 18 aa, Staphylococcus
VRYYYPSIFALEEIIFML

SEQ ID NO: 1906580 - protein, 22 aa, Staphylococcus
VSAFIFLLLAIFYGIYFIKSKK

SEQ ID NO: 1906581 - protein, 27 aa, Staphylococcus
VSAFSFFIYLLHPIILDSLFAYTNIFE

SEQ ID NO: 1906582 - protein, 21 aa, Staphylococcus
VSAGYKWFFAYPEQKVETVNT

SEQ ID NO: 1906583 - protein, 39 aa, Staphylococcus
VSASFKWYDFVYFLDTIVYLFILIFKRSWLDKRVFSKKF

SEQ ID NO: 1906584 - protein, 60 aa, Staphylococcus; identical to SEQ ID NO: 1753965

SEQ ID NO: 1906585 - protein, 25 aa, Staphylococcus
VSCLLMLFFGSFIFNLLGQNAVVLG

SEQ ID NO: 1906586 - protein, 18 aa, Staphylococcus
VSDYPFIAIFKMLSYFIP

SEQ ID NO: 1906587 - protein, 25 aa, Staphylococcus
VSELLPPLLLLVVALILVLLQGDLG

SEQ ID NO: 1906588 - protein, 18 aa, Staphylococcus
VSFIWLPIFSVLFSIMTL

SEQ ID NO: 1906589 - protein, 24 aa, Staphylococcus
VSFSIYFYIHEIWIFIAMYAIFQG

SEQ ID NO: 1906590 - protein, 17 aa, Staphylococcus
VSFWFPHIPNWISALFC

SEQ ID NO: 1906591 - protein, 18 aa, Staphylococcus
VSFWFPQIPNWVSALFCV

SEQ ID NO: 1906592 - protein, 20 aa, Staphylococcus
VSGCFLFIFAYFNLAIGSSE

SEQ ID NO: 1906593 - protein, 23 aa, Staphylococcus
VSGLMAWLITWYYRKRGYERMKA

SEQ ID NO: 1906594 - protein, 25 aa, Staphylococcus
VSGTTWHQLWWSGPIIIVAIIVMLT

SEQ ID NO: 1906595 - protein, 29 aa, Staphylococcus
VSHDTYSGHRLLKGPNNFGGGVVADVSVN

SEQ ID NO: 1906596 - protein, 40 aa, Staphylococcus
VSHLFTPYPWIKWLMYVVALFLPVFVIFTILRPVQENQKL

SEQ ID NO: 1906597 - protein, 23 aa, Staphylococcus
VSHWFTFLFPMINWFIPKRYAKL

SEQ ID NO: 1906598 - protein, 18 aa, Staphylococcus
VSIEVPKIGYKGNYDIRI

SEQ ID NO: 1906599 - protein, 28 aa, Staphylococcus
VSIFGFDLSFIIDGFIGLGGFVVSYFPT

SEQ ID NO: 1906600 - protein, 21 aa, Staphylococcus
VSIFIIMMLVLNQLLAGTVIL

SEQ ID NO: 1906601 - protein, 26 aa, Staphylococcus
VSIGKLFVIFLLRTIIVLPIIALMAH

SEQ ID NO: 1906602 - protein, 28 aa, Staphylococcus
VSIICLTIFIIFFGISWGPVLWVMLPEL

SEQ ID NO: 1906603 - protein, 19 aa, Staphylococcus
VSIIIHFIVLVLTAISGYS

SEQ ID NO: 1906604 - protein, 18 aa, Staphylococcus
VSIILFIGTFLMMYYKNV

SEQ ID NO: 1906605 - protein, 35 aa, Staphylococcus
VSIYLAVVVIICCSYLIMILVGSFQGNDMRGSVLD

SEQ ID NO: 1906606 - protein, 18 aa, Staphylococcus
VSKLFPFVLIASSGGAYL

SEQ ID NO: 1906607 - protein, 24 aa, Staphylococcus
VSKNGRRYLIFNNMSFTPPTKEVT

SEQ ID NO: 1906608 - protein, 39 aa, Staphylococcus
VSKSYRKILNWSLNHKWIVLVISVVILVGSIALGGAKLG

SEQ ID NO: 1906609 - protein, 26 aa, Staphylococcus
VSLFLTTMMLTFFPQLIKLTHSYLYE

SEQ ID NO: 1906610 - protein, 26 aa, Staphylococcus
VSLILTCIIFLGFLYQLYSKRINFVG

SEQ ID NO: 1906611 - protein, 25 aa, Staphylococcus
VSLILTCIIFLGFLYQLYSKRTNFA

SEQ ID NO: 1906612 - protein, 25 aa, Staphylococcus
VSLILYFAHVLLPFMFGPIIAAIIV

SEQ ID NO: 1906613 - protein, 18 aa, Staphylococcus
VSLLFPILSDALSTEWVF

SEQ ID NO: 1906614 - protein, 32 aa, Staphylococcus
VSLLILNFISIIILLILAFASPIYDLIEILVL

SEQ ID NO: 1906615 - protein, 27 aa, Staphylococcus
VSLLLTILLLVMFDWKGQFSIKTDHGT

SEQ ID NO: 1906616 - protein, 17 aa, Staphylococcus
VSLPWMPIIDLDFAFRL

SEQ ID NO: 1906617 - protein, 30 aa, Staphylococcus
VSMCLKLSCSALLISGSMIGYGFASDMTAQ

SEQ ID NO: 1906618 - protein, 24 aa, Staphylococcus
VSNFFFSLVLFIVLGYGILALTAR

SEQ ID NO: 1906619 - protein, 40 aa, Staphylococcus
VSPIYRGVLAFFFVINVILAFVIVFLDRDRRDATATWAWL

SEQ ID NO: 1906620 - protein, 21 aa, Staphylococcus
VSPLLIVIVITMFVLFLTEVT

SEQ ID NO: 1906621 - protein, 19 aa, Staphylococcus
VSPRKVIGPLIKAHKAGLN

SEQ ID NO: 1906622 - protein, 24 aa, Staphylococcus
VSQLFIPYYFGIVSIILIIILIYI

SEQ ID NO: 1906623 - protein, 25 aa, Staphylococcus
VSQQSLLDLVTRLEQTRNSLANVIT

SEQ ID NO: 1906624 - protein, 19 aa, Staphylococcus
VSQSLIAFILLLAGGGNGA

SEQ ID NO: 1906625 - protein, 25 aa, Staphylococcus
VSRLVSCLLILFLGSAIFSILGQHA

SEQ ID NO: 1906626 - protein, 26 aa, Staphylococcus
VSSEFVYNTPLLSENPLFIYISQSGE

SEQ ID NO: 1906627 - protein, 24 aa, Staphylococcus
VSSNFFKKKYWLFGVKKKDRHDIN

SEQ ID NO: 1906628 - protein, 24 aa, Staphylococcus
VSSNYFKKKFWLFGVKKKQRHDIN

SEQ ID NO: 1906629 - protein, 24 aa, Staphylococcus
VSSNYFKKKFWLFGVSKKNRHDIN

SEQ ID NO: 1906630 - protein, 24 aa, Staphylococcus
VSSNYFKKKYWMFGVNKNNRHDIN

SEQ ID NO: 1906631 - protein, 23 aa, Staphylococcus
VSTLAFYYFPAWSGPNIFVTTLI

SEQ ID NO: 1906632 - protein, 24 aa, Staphylococcus
VSTPSYDVYPFMYGMSNEEYNKLT

SEQ ID NO: 1906633 - protein, 26 aa, Staphylococcus
VSTSYALLFFDLIVVAISITVIPMDK

SEQ ID NO: 1906634 - protein, 25 aa, Staphylococcus
VSTVIFFMVFFWVLDIGIGNLIELF

SEQ ID NO: 1906635 - protein, 24 aa, Staphylococcus
VSTVLFFMAFFYVLDIGIGNLIEL

SEQ ID NO: 1906636 - protein, 20 aa, Staphylococcus
VSVAFMFYGLALLLSHIVAF

SEQ ID NO: 1906637 - protein, 39 aa, Staphylococcus
VSVFGFDLSFIIDALVGIGMFFVSYFPTQRLTSRKYLTE

SEQ ID NO: 1906638 - protein, 18 aa, Staphylococcus
VSVIFSPLTFIAGIYGMN

SEQ ID NO: 1906639 - protein, 17 aa, Staphylococcus
VSVIVIAYTFFGGYLAV

SEQ ID NO: 1906640 - protein, 23 aa, Staphylococcus
VSVLYLFMYKMTSYLYLNYVNQL

SEQ ID NO: 1906641 - protein, 26 aa, Staphylococcus
VSVSTLIGIIFGWVPARAAAKKELID

SEQ ID NO: 1906642 - protein, 24 aa, Staphylococcus
VSVSWLWFIFLAIAGRLLGSVDKT

SEQ ID NO: 1906643 - protein, 30 aa, Staphylococcus
VSYQAKLAAKNLISQILNDSFKEIEDANDN

SEQ ID NO: 1906644 - protein, 18 aa, Staphylococcus
VTAFAGWVAKLFETHPAV

SEQ ID NO: 1906645 - protein, 24 aa, Staphylococcus
VTAFFLLLTIYVLGPVISLIPMVV

SEQ ID NO: 1906646 - protein, 23 aa, Staphylococcus
VTARLLISGLLLLTIFKILNPRQ

SEQ ID NO: 1906647 - protein, 26 aa, Staphylococcus
VTAVKYVFDEPLVLTNGQSFQTNMRV

SEQ ID NO: 1906648 - protein, 26 aa, Staphylococcus
VTCCWFLFCVFIFQYIKLLFSNPKIK

SEQ ID NO: 1906649 - protein, 23 aa, Staphylococcus
VTDSYYRIILIAAFISIILSAIP

SEQ ID NO: 1906650 - protein, 30 aa, Staphylococcus
VTEPILYGLILWYKRLIPIVLVSGAIGGAI

SEQ ID NO: 1906651 - protein, 30 aa, Staphylococcus
VTFHAVHNLIRPFRDLVKVKWSQTGFVSGK

SEQ ID NO: 1906652 - protein, 19 aa, Staphylococcus
VTFILGLIIALFTALMRIS

SEQ ID NO: 1906653 - protein, 19 aa, Staphylococcus
VTFILGLVIALFTALMRIS

SEQ ID NO: 1906654 - protein, 21 aa, Staphylococcus
VTFLTMRTILTLKGYRYMAAV

SEQ ID NO: 1906655 - protein, 23 aa, Staphylococcus
VTFVFIFMHLWQTTIQKYFFGKA

SEQ ID NO: 1906656 - protein, 19 aa, Staphylococcus
VTFVLGLIIALFTALMRIS

SEQ ID NO: 1906657 - protein, 19 aa, Staphylococcus
VTFVLGLILALFTALMRIS

SEQ ID NO: 1906658 - protein, 20 aa, Staphylococcus
VTGICFLLALFFSPLIEVVT

SEQ ID NO: 1906659 - protein, 24 aa, Staphylococcus
VTGVLLMIIFIWNIMQWSTNPAVQ

SEQ ID NO: 1906660 - protein, 18 aa, Staphylococcus
VTGWTYWLCWIITGMAEV

SEQ ID NO: 1906661 - protein, 27 aa, Staphylococcus
VTIKDHDDFTIDNGYFESTSDSESQSD

SEQ ID NO: 1906662 - protein, 24 aa, Staphylococcus
VTILGGDLLLIPKAIKASKATIRN

SEQ ID NO: 1906663 - protein, 25 aa, Staphylococcus
VTINGLRIMIIIAPLLFVCLTAFLY

SEQ ID NO: 1906664 - protein, 25 aa, Staphylococcus
VTISLLLLIYGIGGGFFLPSNTSAI

SEQ ID NO: 1906665 - protein, 24 aa, Staphylococcus
VTISSYFFIFYAIASLITRPVAGR

SEQ ID NO: 1906666 - protein, 29 aa, Staphylococcus
VTKIDAEYSKLITKTLPENKAKLNAKKKI

SEQ ID NO: 1906667 - protein, 24 aa, Staphylococcus
VTKTKFTIFVQDTTSPVVNAIQSQ

SEQ ID NO: 1906668 - protein, 26 aa, Staphylococcus
VTLGFIKFNIPIQVLLLISSAYAALI

SEQ ID NO: 1906669 - protein, 20 aa, Staphylococcus
VTLIFFIFVSNMLGLPFQLI

SEQ ID NO: 1906670 - protein, 19 aa, Staphylococcus
VTLIIILIVQRFTAGFLKS

SEQ ID NO: 1906671 - protein, 21 aa, Staphylococcus
VTLILFIFVANMLGLPFAIVT

SEQ ID NO: 1906672 - protein, 21 aa, Staphylococcus
VTLILFIFVANMLGLPFSIVT

SEQ ID NO: 1906673 - protein, 20 aa, Staphylococcus
VTLILYIFIANMLGLPFSIV

SEQ ID NO: 1906674 - protein, 25 aa, Staphylococcus
VTLIVFVILIFVLIYTAQRLADIKD

SEQ ID NO: 1906675 - protein, 20 aa, Staphylococcus
VTLLLLLFIIIVYIATTLTY

SEQ ID NO: 1906676 - protein, 18 aa, Staphylococcus
VTLPLGRPFFTACIGGGI

SEQ ID NO: 1906677 - protein, 25 aa, Staphylococcus
VTMIIVFVILLIILQKTTFGRHTYA

SEQ ID NO: 1906678 - protein, 30 aa, Staphylococcus
VTMNIILLAFGYFIIPFASAFIIHELCKKI

SEQ ID NO: 1906679 - protein, 17 aa, Staphylococcus
VTMPRKEVAPEAPDIVA

SEQ ID NO: 1906680 - protein, 17 aa, Staphylococcus
VTNLLSPLFRAANGYLG

SEQ ID NO: 1906681 - protein, 29 aa, Staphylococcus
VTNTLIQLPFIFVLAWVVTKIVPGEDLNE

SEQ ID NO: 1906682 - protein, 23 aa, Staphylococcus
VTPFLIVMVVLIAIVYLFKGTVP

SEQ ID NO: 1906683 - protein, 18 aa, Staphylococcus
VTPFTPMLILGRIIQGLS

SEQ ID NO: 1906684 - protein, 25 aa, Staphylococcus
VTPTITLLIMGLATIFLIMPVAGVV

SEQ ID NO: 1906685 - protein, 25 aa, Staphylococcus
VTREGLALGIYIILTGSRSSAIKSA

SEQ ID NO: 1906686 - protein, 19 aa, Staphylococcus
VTRYFAIILAFIQSIGMAF

SEQ ID NO: 1906687 - protein, 20 aa, Staphylococcus
VTRYFAIILAFIQSIGMAFQ

SEQ ID NO: 1906688 - protein, 24 aa, Staphylococcus
VTSDVKITFPEKGIYQINFNTEDD

SEQ ID NO: 1906689 - protein, 27 aa, Staphylococcus
VTSNNIGQFPLIGTNMQRTGIYMGVKP

SEQ ID NO: 1906690 - protein, 39 aa, Staphylococcus
VTSVFGFDLSFILDALIGIGMFFVSYFPTQRLTSKKYLN

SEQ ID NO: 1906691 - protein, 28 aa, Staphylococcus
VTTFLGWKYIFIFSIIVALTALFLIKGT

SEQ ID NO: 1906692 - protein, 17 aa, Staphylococcus
VTTLCFGIIYFYKYKML

SEQ ID NO: 1906693 - protein, 19 aa, Staphylococcus
VTTLTVLLLKRKTPAINVD

SEQ ID NO: 1906694 - protein, 18 aa, Staphylococcus
VTTRLIISGLFLLVMFKI

SEQ ID NO: 1906695 - protein, 28 aa, Staphylococcus
VTTVILLWFIFCVYIFQYIKLLFTNRKI

SEQ ID NO: 1906696 - protein, 18 aa, Staphylococcus
VTVDQINKLPNGDSEVVF

SEQ ID NO: 1906697 - protein, 26 aa, Staphylococcus
VTVGSLPDMITFSKDSKYLLVANEEE

SEQ ID NO: 1906698 - protein, 32 aa, Staphylococcus
VTVIVAFVKSIWGGLVAWWQQNHVLIQAAATV

SEQ ID NO: 1906699 - protein, 18 aa, Staphylococcus
VTVPNYPSDKPAPKVTVD

SEQ ID NO: 1906700 - protein, 24 aa, Staphylococcus
VTVSSYFFIFYAITSLVTRPVTGR

SEQ ID NO: 1906701 - protein, 26 aa, Staphylococcus
VTWLKPFGLPVFTLPFIVATWIMLLA

SEQ ID NO: 1906702 - protein, 30 aa, Staphylococcus
VTYALIILNVVIWLFMVLFLNRSSDLKLLD

SEQ ID NO: 1906703 - protein, 24 aa, Staphylococcus
VVAALFFIIYFVVKKDIISANIKE

SEQ ID NO: 1906704 - protein, 23 aa, Staphylococcus
VVAFSLTIFLWASAFPVIKLALK

SEQ ID NO: 1906705 - protein, 19 aa, Staphylococcus
VVALIFVIKFLPETRGRSL

SEQ ID NO: 1906706 - protein, 19 aa, Staphylococcus
VVALLPNALLGELLKLFKE

SEQ ID NO: 1906707 - protein, 26 aa, Staphylococcus
VVAYPAFIFLIITFLTLSITNNGWLL

SEQ ID NO: 1906708 - protein, 17 aa, Staphylococcus
VVDMWFVILPVVMSIGT

SEQ ID NO: 1906709 - protein, 20 aa, Staphylococcus
VVDMWFVILPVVMSIGTIAT

SEQ ID NO: 1906710 - protein, 17 aa, Staphylococcus
VVDVIIYYPFVKVYDEQ

SEQ ID NO: 1906711 - protein, 41 aa, Staphylococcus
VVDYYSYLANLFLFLYKNFSFPLLFLVIIFIFREEISSLLR

SEQ ID NO: 1906712 - protein, 23 aa, Staphylococcus
VVEPFFQWFVWIGGAGATLSLCI

SEQ ID NO: 1906713 - protein, 20 aa, Staphylococcus
VVFAVFLYALLPIIKNTYTG

SEQ ID NO: 1906714 - protein, 19 aa, Staphylococcus
VVFSDGKELNIPKGAKGDK

SEQ ID NO: 1906715 - protein, 19 aa, Staphylococcus
VVFSIVMILLVRPISVIVS

SEQ ID NO: 1906716 - protein, 17 aa, Staphylococcus
VVGAFLFRNTHPSIETL

SEQ ID NO: 1906717 - protein, 22 aa, Staphylococcus
VVGGLLIAIALTLGGKPTAQGL

SEQ ID NO: 1906718 - protein, 30 aa, Staphylococcus
VVGIALLTFIIWITVVHTGQFEPALMAAIS

SEQ ID NO: 1906719 - protein, 44 aa, Staphylococcus
VVGISLITFIIWIIFIHFGQFEPALLAAISVLVIACPCALGLAT

SEQ ID NO: 1906720 - protein, 22 aa, Staphylococcus
VVIALLPNALLGELLKFFKDGN

SEQ ID NO: 1906721 - protein, 23 aa, Staphylococcus
VVIALLPNALLGELLKFFKDGNE

SEQ ID NO: 1906722 - protein, 23 aa, Staphylococcus
VVIALLPNALLGELLKLFKDDYQ

SEQ ID NO: 1906723 - protein, 18 aa, Staphylococcus
VVIATKIGNQWALNEKPV

SEQ ID NO: 1906724 - protein, 34 aa, Staphylococcus
VVIGFIFVGIYFFLFRFLILKFDIPLPGRKKGTE

SEQ ID NO: 1906725 - protein, 28 aa, Staphylococcus
VVIGIIFLLFMTLFFFLKGYHKLSKDKL

SEQ ID NO: 1906726 - protein, 27 aa, Staphylococcus
VVIILLYIMLFIIVIPLLRYHYFSYYY

SEQ ID NO: 1906727 - protein, 27 aa, Staphylococcus
VVIISIVVIFVLQLLLNILEFSNIGQS

SEQ ID NO: 1906728 - protein, 23 aa, Staphylococcus
VVILLIVGIAWLFGRRFERPHQF

SEQ ID NO: 1906729 - protein, 20 aa, Staphylococcus
VVILMIGLSIFRFTPAHAES

SEQ ID NO: 1906730 - protein, 21 aa, Staphylococcus
VVISIFVIITALLWIFSVLIF

SEQ ID NO: 1906731 - protein, 25 aa, Staphylococcus
VVISLYFILRRLFAIKHGKYKVQRS

SEQ ID NO: 1906732 - protein, 17 aa, Staphylococcus
VVKILALTALLTAPQHR

SEQ ID NO: 1906733 - protein, 17 aa, Staphylococcus
VVKLLFNRETAEKDLYK

SEQ ID NO: 1906734 - protein, 23 aa, Staphylococcus
VVLILIILIRIVIYFIILMGIIY

SEQ ID NO: 1906735 - protein, 22 aa, Staphylococcus
VVLILLTLFLQFDRLIAVLGGV

SEQ ID NO: 1906736 - protein, 25 aa, Staphylococcus
VVLISCMVFLTFFLSVNQSAHSEQT

SEQ ID NO: 1906737 - protein, 18 aa, Staphylococcus
VVLIVLFILIMVTFSRAN

SEQ ID NO: 1906738 - protein, 17 aa, Staphylococcus
VVLLITFGSFIAAGMPI

SEQ ID NO: 1906739 - protein, 22 aa, Staphylococcus
VVLPSYVKWKFPLQIGLMTGLY

SEQ ID NO: 1906740 - protein, 18 aa, Staphylococcus
VVLRLLLTFIITVILLFF

SEQ ID NO: 1906741 - protein, 26 aa, Staphylococcus
VVLSTTFILIIFGAILFFLLEQSNTL

SEQ ID NO: 1906742 - protein, 28 aa, Staphylococcus
VVLTFCIIFVGLFIFTFFNAKFYDTPIG

SEQ ID NO: 1906743 - protein, 20 aa, Staphylococcus
VVMLLTIAIILGFGALEIAT

SEQ ID NO: 1906744 - protein, 19 aa, Staphylococcus
VVNLIFLPPKFETKIYHNS

SEQ ID NO: 1906745 - protein, 18 aa, Staphylococcus
VVPALASTFFKRGLKQQR

SEQ ID NO: 1906746 - protein, 17 aa, Staphylococcus
VVPALGSTLFRKGIQTK

SEQ ID NO: 1906747 - protein, 31 aa, Staphylococcus
VVPFMAIIYILMAVFIIILNIQAVPALFALI

SEQ ID NO: 1906748 - protein, 26 aa, Staphylococcus
VVPLPTLFFGMFFNNLFFWCANQMIV

SEQ ID NO: 1906749 - protein, 17 aa, Staphylococcus
VVPLVTAFILDIIFRKV

SEQ ID NO: 1906750 - protein, 30 aa, Staphylococcus
VVQLTKFEKVLYISLIAVIAMVSIYILSLK

SEQ ID NO: 1906751 - protein, 28 aa, Staphylococcus
VVQWLLGLFLFSYGTYAFLRKVYFKNKA

SEQ ID NO: 1906752 - protein, 23 aa, Staphylococcus
VVRDTIKPVVNPISNQKKEVNTP

SEQ ID NO: 1906753 - protein, 35 aa, Staphylococcus
VVRRRITVFGGILLAIILILLVLLVIQRHSNDQDA

SEQ ID NO: 1906754 - protein, 32 aa, Staphylococcus; identical to SEQ ID NO: 1593134

SEQ ID NO: 1906755 - protein, 18 aa, Staphylococcus
VVSFLEVLIYVVGLGLVM

SEQ ID NO: 1906756 - protein, 17 aa, Staphylococcus
VVSFLEVLVYVVGLGLV

SEQ ID NO: 1906757 - protein, 20 aa, Staphylococcus
VVSIPLSILIAIVALKLSNV

SEQ ID NO: 1906758 - protein, 25 aa, Staphylococcus
VVSTVIFFLVFFYALDLGITALKNL

SEQ ID NO: 1906759 - protein, 26 aa, Staphylococcus
VVSTVIFFLVFFYALDVGINALKQLL

SEQ ID NO: 1906760 - protein, 29 aa, Staphylococcus
VVSVILAYLFKWFGLIDDVLLMVIIISTI

SEQ ID NO: 1906761 - protein, 19 aa, Staphylococcus
VVSVKLFGFLRAMMRYVER

SEQ ID NO: 1906762 - protein, 23 aa, Staphylococcus
VVSYLLLRKMKIDALFFAIVMAV

SEQ ID NO: 1906763 - protein, 32 aa, Staphylococcus
VVSYLNWHWVYFILTILYLTLTFIIYKHVPES

SEQ ID NO: 1906764 - protein, 26 aa, Staphylococcus
VVSYVVWFIVLTTILSKFGISVGGII

SEQ ID NO: 1906765 - protein, 32 aa, Staphylococcus
VVTAPGFFQTISPYLPFTYAIDSLRETVGGIV

SEQ ID NO: 1906766 - protein, 29 aa, Staphylococcus
VVTFVISFYFFRYLKFKNYATLLAAMLYA

SEQ ID NO: 1906767 - protein, 18 aa, Staphylococcus
VVTSLICFFILYMANFTS

SEQ ID NO: 1906768 - protein, 19 aa, Staphylococcus
VVTYALLLGLFLTGLITSL

SEQ ID NO: 1906769 - protein, 22 aa, Staphylococcus
VVVGPNFYMGIGTPGGNKIPTI

SEQ ID NO: 1906770 - protein, 26 aa, Staphylococcus
VVVIFAIILLILQFIGKLSLSSFSVI

SEQ ID NO: 1906771 - protein, 18 aa, Staphylococcus
VVVILWIVFVKPLGEVND

SEQ ID NO: 1906772 - protein, 24 aa, Staphylococcus
VVVLFLISAFLFLATTFDSGSYIL

SEQ ID NO: 1906773 - protein, 19 aa, Staphylococcus
VVVLVLILTVIRIVPAHQV

SEQ ID NO: 1906774 - protein, 19 aa, Staphylococcus
VVVMIWSASFFKALFVPGG

SEQ ID NO: 1906775 - protein, 19 aa, Staphylococcus
VVVNPLFAKPNALASIFGV

SEQ ID NO: 1906776 - protein, 18 aa, Staphylococcus
VVVNVEQKAIAANALKEQ

SEQ ID NO: 1906777 - protein, 40 aa, Staphylococcus
VVVQLTRFEKYLYITLVTAIAVIAIYMLSLKMDAYDTNGK

SEQ ID NO: 1906778 - protein, 26 aa, Staphylococcus
VVVVLAMFAFFIFKYSYNKNDESGKM

SEQ ID NO: 1906779 - protein, 27 aa, Staphylococcus
VVVYPAFIFLIISFAMLMFSFDGWVLL

SEQ ID NO: 1906780 - protein, 19 aa, Staphylococcus
VVWAIGNLFLFFSQPKVGV

SEQ ID NO: 1906781 - protein, 22 aa, Staphylococcus
VVWGILPIYWKLIGGVSAFEIL

SEQ ID NO: 1906782 - protein, 27 aa, Staphylococcus
VVWSKPLVYGLLITGILFSLMMKFFQV

SEQ ID NO: 1906783 - protein, 18 aa, Staphylococcus
VVYATSAGYKWFFSYPEE

SEQ ID NO: 1906784 - protein, 25 aa, Staphylococcus
VVYAVSAGYKWFFAYPDQHIETVNT

SEQ ID NO: 1906785 - protein, 25 aa, Staphylococcus
VVYAVSAGYKWFFAYPDQKVETVNT

SEQ ID NO: 1906786 - protein, 19 aa, Staphylococcus
VVYEFGMALLLFKVNVLSH

SEQ ID NO: 1906787 - protein, 21 aa, Staphylococcus
VVYKAVDDTFFILTNTHIVGS

SEQ ID NO: 1906788 - protein, 17 aa, Staphylococcus
VVYLLINAAFLMTLPIS

SEQ ID NO: 1906789 - protein, 17 aa, Staphylococcus
VVYPAYVFLFATFVMLY

SEQ ID NO: 1906790 - protein, 19 aa, Staphylococcus
VVYVVFIVFWQVGFSNAVN

SEQ ID NO: 1906791 - protein, 32 aa, Staphylococcus
VWGVILPVVFISIIGWFWFSGSNFASSWNPHH

SEQ ID NO: 1906792 - protein, 26 aa, Staphylococcus
VWGVMTQGWWFPIMASMFLAFTIVIM

SEQ ID NO: 1906793 - protein, 26 aa, Staphylococcus
VWGVMTQGWWFPVMASMFLAVTIIIM

SEQ ID NO: 1906794 - protein, 18 aa, Staphylococcus
VWIIRPKLHYILYDSDRL

SEQ ID NO: 1906795 - protein, 18 aa, Staphylococcus
VWIISFLTIIIGFIVSFT

SEQ ID NO: 1906796 - protein, 24 aa, Staphylococcus
VWLALALAVFILLIGPGRFIIDTF

SEQ ID NO: 1906797 - protein, 24 aa, Staphylococcus
VWLSFLLLAFVFIVGPTIFIMETT

SEQ ID NO: 1906798 - protein, 24 aa, Staphylococcus
VWLSFLLLGFVFIVGPTIFIMETT

SEQ ID NO: 1906799 - protein, 20 aa, Staphylococcus
VWLSFLLLGFVFVVGPTVFI

SEQ ID NO: 1906800 - protein, 17 aa, Staphylococcus
VWLYHFLERVLIPTGLH

SEQ ID NO: 1906801 - protein, 25 aa, Staphylococcus
VWQGVLHLVFFWTTIPTIISIIHGI

SEQ ID NO: 1906802 - protein, 18 aa, Staphylococcus
VWRMVFIILTVFGILMVI

SEQ ID NO: 1906803 - protein, 20 aa, Staphylococcus
VWSIILRTLHLAGISLWLGA

SEQ ID NO: 1906804 - protein, 22 aa, Staphylococcus
VYFKWQILVTLLFVIPCHELYM

SEQ ID NO: 1906805 - protein, 17 aa, Staphylococcus
VYFVVLCVICILVTIGM

SEQ ID NO: 1906806 - protein, 20 aa, Staphylococcus
VYIQPFLVALLFGIGTDYCI

SEQ ID NO: 1906807 - protein, 24 aa, Staphylococcus
VYITLCVIGFLLFGLGLGLFATPS

SEQ ID NO: 1906808 - protein, 22 aa, Staphylococcus
VYKIVGDTFFVLTNTHIVGEAD

SEQ ID NO: 1906809 - protein, 22 aa, Staphylococcus
VYPIIRTLVIILKPITKLLNTI

SEQ ID NO: 1906810 - protein, 19 aa, Staphylococcus
VYSLNYLVLFFALVVIISL

SEQ ID NO: 1906811 - protein, 33 aa, Staphylococcus
VYSRPLYYFGNVMKPLIWLMNGSARVIIRIFGV

SEQ ID NO: 1906812 - protein, 20 aa, Staphylococcus
VYSYIPLYITSVAFWMIQEQ

SEQ ID NO: 1906813 - protein, 23 aa, Staphylococcus
VYSYLLIALTLTAGTAFLIWLGD

SEQ ID NO: 1906814 - protein, 19 aa, Staphylococcus
VYVTDGINMNRRNGSRDFG

SEQ ID NO: 1906815 - protein, 23 aa, Staphylococcus
VYVYLTLVAFNFISGVLTLPGLA

SEQ ID NO: 1906816 - protein, 17 aa, Staphylococcus
VYWLVFGLGIRSNNPID

SEQ ID NO: 1906817 - protein, 18 aa, Staphylococcus
VYYNDKYIVILASNLTVE

SEQ ID NO: 1906818 - protein, 20 aa, Staphylococcus
WAIIFIFPFVIHIGYIVYKD

SEQ ID NO: 1906819 - protein, 19 aa, Staphylococcus
WAIILTFMVLFFGITMVMM

SEQ ID NO: 1906820 - protein, 17 aa, Staphylococcus
WAITFLTILIIITPGST

SEQ ID NO: 1906821 - protein, 17 aa, Staphylococcus
WAIYPFTMIIIITLIYL

SEQ ID NO: 1906822 - protein, 18 aa, Staphylococcus
WAIYSRPFLLFALVCNIL

SEQ ID NO: 1906823 - protein, 26 aa, Staphylococcus
WAKLGILISLIFFPKGHILIKLLFSV

SEQ ID NO: 1906824 - protein, 25 aa, Staphylococcus
WAKLGILLSLIFFPKGHILIKLTFA

SEQ ID NO: 1906825 - protein, 17 aa, Staphylococcus
WALLYSAIVLFTLILAN

SEQ ID NO: 1906826 - protein, 24 aa, Staphylococcus
WALTIFVFFIVTMALTLILRDYQP

SEQ ID NO: 1906827 - protein, 21 aa, Staphylococcus
WALTIFVFFVVTMALSLILRD

SEQ ID NO: 1906828 - protein, 28 aa, Staphylococcus
WANMSFIVLLVLLIICAIPEHSFLRNAK

SEQ ID NO: 1906829 - protein, 17 aa, Staphylococcus
WAVLLRVLALAFSYLLH

SEQ ID NO: 1906830 - protein, 27 aa, Staphylococcus
WAYSQVWLYFMYYWLIFGIGCYFGQYL

SEQ ID NO: 1906831 - protein, 18 aa, Staphylococcus
WCRMMIRQILSNSLKYSK

SEQ ID NO: 1906832 - protein, 19 aa, Staphylococcus
WCYNKFYNITLPAFLGFFA

SEQ ID NO: 1906833 - protein, 34 aa, Staphylococcus
WDAFNFFSPLAWSLIFITLLLLLNIFSVKAFGET

SEQ ID NO: 1906834 - protein, 27 aa, Staphylococcus
WDFLSRNWWMIFPIGGFLSWLIPQLLG

SEQ ID NO: 1906835 - protein, 24 aa, Staphylococcus
WDKWTSNLWHWVNSVLIIVLFVVV

SEQ ID NO: 1906836 - protein, 24 aa, Staphylococcus
WDVLGFIILITLRKHLKIGETFFI

SEQ ID NO: 1906837 - protein, 26 aa, Staphylococcus
WEFLAGHWWLFFPIAGMIWWMLRYFI

SEQ ID NO: 1906838 - protein, 21 aa, Staphylococcus
WEKFYLLVIGAILALLSSILG

SEQ ID NO: 1906839 - protein, 25 aa, Staphylococcus
WEKWTSRLFQWIQSVTFLVTIIILT

SEQ ID NO: 1906840 - protein, 17 aa, Staphylococcus
WEPRFLVYRKDSSLWYS

SEQ ID NO: 1906841 - protein, 17 aa, Staphylococcus
WESIILDPIGPMLALGA

SEQ ID NO: 1906842 - protein, 26 aa, Staphylococcus
WFEKMSVLIYLYLAYCFLVVYLGQLL

SEQ ID NO: 1906843 - protein, 17 aa, Staphylococcus
WFFAYPDQHIETVNTLT

SEQ ID NO: 1906844 - protein, 24 aa, Staphylococcus
WFKTIYLIYFNIMLFCLCMINLFF

SEQ ID NO: 1906845 - protein, 17 aa, Staphylococcus
WFMQLWHLIFMCPAIIL

SEQ ID NO: 1906846 - protein, 18 aa, Staphylococcus
WFNLDATWDPYGNTKNIK

SEQ ID NO: 1906847 - protein, 17 aa, Staphylococcus
WFQLLLSPFAWSVVFLA

SEQ ID NO: 1906848 - protein, 27 aa, Staphylococcus
WFVLPVPILLFIYFLSMISITKSGNTV

SEQ ID NO: 1906849 - protein, 25 aa, Staphylococcus
WFVLPVPVVLFIYFLSFITTTSSGN

SEQ ID NO: 1906850 - protein, 26 aa, Staphylococcus
WFVLPVPVVLFIYFLSYISTTMSGDH

SEQ ID NO: 1906851 - protein, 21 aa, Staphylococcus
WGAGYNIVAVPLAAGILAFIG

SEQ ID NO: 1906852 - protein, 18 aa, Staphylococcus
WGATLLSLTLLIRVNRSW

SEQ ID NO: 1906853 - protein, 35 aa, Staphylococcus
WGDDWSFVIALLPWLIVIIPFLFTKANTLNILNTN

SEQ ID NO: 1906854 - protein, 31 aa, Staphylococcus
WGDDWTFVLAFIPWIMVIVPYLLFKSNELNI

SEQ ID NO: 1906855 - protein, 37 aa, Staphylococcus
WGDEWAFVIAFLPWIIVLIPFLLFKANVLNLLNTHQH

SEQ ID NO: 1906856 - protein, 33 aa, Staphylococcus
WGDEWAFVLAFLPWIVIILPYLLFKSNELNLIN

SEQ ID NO: 1906857 - protein, 24 aa, Staphylococcus
WGEKGVFDYRRSLLRTDVILNSGD

SEQ ID NO: 1906858 - protein, 21 aa, Staphylococcus
WGFPRWASILTIFIVLIAIIA

SEQ ID NO: 1906859 - protein, 19 aa, Staphylococcus
WGIKYGLFIQSIIDFIIIA

SEQ ID NO: 1906860 - protein, 23 aa, Staphylococcus
WGIKYGLFIQSIIDFIIVAIALF

SEQ ID NO: 1906861 - protein, 23 aa, Staphylococcus
WGLRSIIYIFILIAAITTVMLYA

SEQ ID NO: 1906862 - protein, 24 aa, Staphylococcus
WGPVLWVMLPELFPMRARGAATGI

SEQ ID NO: 1906863 - protein, 34 aa, Staphylococcus
WGTIIVTLATFAILLALLKKFAWGPLKEVMDKRE

SEQ ID NO: 1906864 - protein, 21 aa, Staphylococcus
WGTIQMFLLQALPIFIAICIV

SEQ ID NO: 1906865 - protein, 34 aa, Staphylococcus
WGTTIVTIITFIILLALLKKFAWGPLKEVMDKRE

SEQ ID NO: 1906866 - protein, 34 aa, Staphylococcus
WGTVIVQIVTFIILLALLKKFAWGPLKEVMDKRE

SEQ ID NO: 1906867 - protein, 25 aa, Staphylococcus
WGVMTQGWWFPIMASMFLAFTIVIM

SEQ ID NO: 1906868 - protein, 26 aa, Staphylococcus
WGVMTQGWWLPVMASAFLIFTIIIMF

SEQ ID NO: 1906869 - protein, 17 aa, Staphylococcus
WGVYFIIIGILLQRFNK

SEQ ID NO: 1906870 - protein, 26 aa, Staphylococcus
WHREGWMIFIGWLSYFFLGFYMGYYY

SEQ ID NO: 1906871 - protein, 19 aa, Staphylococcus
WHRTNALWVIPVGIVYAIV

SEQ ID NO: 1906872 - protein, 27 aa, Staphylococcus
WHSVYFTLTILYLILAVAIYKKVPESP

SEQ ID NO: 1906873 - protein, 20 aa, Staphylococcus
WHWKDTLLILLLIPIAVILF

SEQ ID NO: 1906874 - protein, 18 aa, Staphylococcus
WIAQRFYHQIAQRLELFI

SEQ ID NO: 1906875 - protein, 23 aa, Staphylococcus
WIDFPHIYLPFKDYVPSIHLGLI

SEQ ID NO: 1906876 - protein, 18 aa, Staphylococcus
WIFFSMISDQILFKHVKK

SEQ ID NO: 1906877 - protein, 27 aa, Staphylococcus
WIGITIIFGAFALFWFVGIHGPSIVEP

SEQ ID NO: 1906878 - protein, 17 aa, Staphylococcus
WIGTLVALILIATSIYK

SEQ ID NO: 1906879 - protein, 22 aa, Staphylococcus
WIGWVVTLFLWGTTLWGILYKS

SEQ ID NO: 1906880 - protein, 18 aa, Staphylococcus
WIHPFTIGGAFVIATFLH

SEQ ID NO: 1906881 - protein, 28 aa, Staphylococcus
WIHYPYDFIVIIIIALIFYKIGTSSYFE

SEQ ID NO: 1906882 - protein, 22 aa, Staphylococcus
WILFFLMIFFVFIVLSAPTYLP

SEQ ID NO: 1906883 - protein, 20 aa, Staphylococcus
WIMVLAIFIINVFYVTFLTM

SEQ ID NO: 1906884 - protein, 17 aa, Staphylococcus
WIRLLKAQPDNLKLNYW

SEQ ID NO: 1906885 - protein, 19 aa, Staphylococcus
WISIIMAFLFVMSPLYYRF

SEQ ID NO: 1906886 - protein, 38 aa, Staphylococcus
WITDKLGWYYLILTTIIVFFCIFLIFSPIGKLKLGKPN

SEQ ID NO: 1906887 - protein, 38 aa, Staphylococcus
WITDKLGWYYLILTTIIVFFCIFLILSPIGKLKLGKPN

SEQ ID NO: 1906888 - protein, 37 aa, Staphylococcus
WITDKLGWYYLILTTIIVFFCVFLIFSPIGKLKLGKP

SEQ ID NO: 1906889 - protein, 38 aa, Staphylococcus
WITEKLGWYYMILTTVIVFFCIFLIFSPIGKLKLGKPN

SEQ ID NO: 1906890 - protein, 24 aa, Staphylococcus
WITLFFLMIIIIIYILTTLTNFLK

SEQ ID NO: 1906891 - protein, 37 aa, Staphylococcus
WITNDLGWYYLILTTIIVFFCVFLIFSPIGKLKLGKP

SEQ ID NO: 1906892 - protein, 18 aa, Staphylococcus
WITREFLLKHWTFTSEVA

SEQ ID NO: 1906893 - protein, 24 aa, Staphylococcus
WKKQWLYQPYILIAIVLLFFVQQI

SEQ ID NO: 1906894 - protein, 22 aa, Staphylococcus
WKLLLYNVIVILIFFVLGSILH

SEQ ID NO: 1906895 - protein, 47 aa, Staphylococcus
WKQALLLIMVAAVINYFWAAWAFLIAGVIILIFIVRSYLVTKFSGMK

SEQ ID NO: 1906896 - protein, 22 aa, Staphylococcus
WKVFLTPVILTLVLAFGLSAFE

SEQ ID NO: 1906897 - protein, 22 aa, Staphylococcus
WLAIIFIYYFGVKWHLFPFVGS

SEQ ID NO: 1906898 - protein, 22 aa, Staphylococcus
WLAIIFIYYFGVKWHLLPFVGS

SEQ ID NO: 1906899 - protein, 19 aa, Staphylococcus
WLALLIAVILLYIGTGEWT

SEQ ID NO: 1906900 - protein, 18 aa, Staphylococcus
WLDMMIMIPFMVPPYIGA

SEQ ID NO: 1906901 - protein, 34 aa, Staphylococcus
WLGEPVFEKLLHPLFVLLPLPDALNATISLIVSF

SEQ ID NO: 1906902 - protein, 20 aa, Staphylococcus
WLGIPQPFRFSGFGFDLGAI

SEQ ID NO: 1906903 - protein, 19 aa, Staphylococcus
WLGITFAVLITVTFAFVFN

SEQ ID NO: 1906904 - protein, 21 aa, Staphylococcus
WLGIVFAILITVTFAFVFNTV

SEQ ID NO: 1906905 - protein, 20 aa, Staphylococcus
WLGIVFATLITITFAFVFNT

SEQ ID NO: 1906906 - protein, 23 aa, Staphylococcus
WLGWTVFILLWGTTVWGILYKSI

SEQ ID NO: 1906907 - protein, 19 aa, Staphylococcus
WLIAIVVVSIIIWAFSGVP

SEQ ID NO: 1906908 - protein, 20 aa, Staphylococcus
WLIGVLVIFTVIFYFLGGVF

SEQ ID NO: 1906909 - protein, 19 aa, Staphylococcus
WLLWAIIIVWATVSLFLEQ

SEQ ID NO: 1906910 - protein, 20 aa, Staphylococcus
WLMITIIPISIILGVGTAIY

SEQ ID NO: 1906911 - protein, 20 aa, Staphylococcus
WLMLLAIFVINVAYVTCLTV

SEQ ID NO: 1906912 - protein, 20 aa, Staphylococcus
WLMVFAIFIINVCYVTFLTM

SEQ ID NO: 1906913 - protein, 20 aa, Staphylococcus
WLMVFAIFVINVCYVTCLTM

SEQ ID NO: 1906914 - protein, 20 aa, Staphylococcus
WLMVLAIFIINVAYVTCLTM

SEQ ID NO: 1906915 - protein, 18 aa, Staphylococcus
WLMVLAIFVINVCYVTFL

SEQ ID NO: 1906916 - protein, 18 aa, Staphylococcus
WLNIIAIWILHKPAIQAL

SEQ ID NO: 1906917 - protein, 17 aa, Staphylococcus
WLPAAIGFLFGGIFIRV

SEQ ID NO: 1906918 - protein, 25 aa, Staphylococcus
WLPAAIGFLLGGLFIRGLDLVIPHI

SEQ ID NO: 1906919 - protein, 20 aa, Staphylococcus
WLPYVLIVISLHILGFGLLY

SEQ ID NO: 1906920 - protein, 23 aa, Staphylococcus
WLQIWGFMYIVTIFTNLFWGIVG

SEQ ID NO: 1906921 - protein, 23 aa, Staphylococcus
WLRKIDWILVALLTILAIISVTT

SEQ ID NO: 1906922 - protein, 21 aa, Staphylococcus
WLSFILLAFVFIIGPTVFIME

SEQ ID NO: 1906923 - protein, 21 aa, Staphylococcus
WLSFILLAFVFIVGPTVFIME

SEQ ID NO: 1906924 - protein, 20 aa, Staphylococcus
WLSFLLLGFVFIVGPTVFIM

SEQ ID NO: 1906925 - protein, 18 aa, Staphylococcus
WLSQMWISLIVGALFMYI

SEQ ID NO: 1906926 - protein, 19 aa, Staphylococcus
WLTALACVLLLMSFNLLST

SEQ ID NO: 1906927 - protein, 17 aa, Staphylococcus
WLVQWLPASLRFGVTQY

SEQ ID NO: 1906928 - protein, 18 aa, Staphylococcus
WMFTLSLLCFIIAMSLAL

SEQ ID NO: 1906929 - protein, 19 aa, Staphylococcus
WMGILGLMYLRYKKESRKA

SEQ ID NO: 1906930 - protein, 19 aa, Staphylococcus
WMIGKVLLLAPIAVFAFIT

SEQ ID NO: 1906931 - protein, 19 aa, Staphylococcus
WMMGFVLRMFLARDAYFKE

SEQ ID NO: 1906932 - protein, 17 aa, Staphylococcus
WMVSIFGFDLSFIIDGF

SEQ ID NO: 1906933 - protein, 31 aa, Staphylococcus
WNAGRNVIVYQRNYASLPDGRALGTGQQKNG

SEQ ID NO: 1906934 - protein, 30 aa, Staphylococcus
WNITKSIFGKLRSWLTKTWKNIKNSVVNYA

SEQ ID NO: 1906935 - protein, 18 aa, Staphylococcus
WNIVIFSIGMYLVVFGLK

SEQ ID NO: 1906936 - protein, 18 aa, Staphylococcus
WNIVIFSIGMYLVVYGLK

SEQ ID NO: 1906937 - protein, 19 aa, Staphylococcus
WNIVIFSLGMYLVVFGLKN

SEQ ID NO: 1906938 - protein, 26 aa, Staphylococcus
WNIVVLFASIFIINALLSGLGIYLLS

SEQ ID NO: 1906939 - protein, 23 aa, Staphylococcus
WNLFLYVFFRCISGIVLAGLFPY

SEQ ID NO: 1906940 - protein, 19 aa, Staphylococcus
WNLWRNLAKQSPEFGHPEK

SEQ ID NO: 1906941 - protein, 28 aa, Staphylococcus
WNRHPYLWWFMFAVYISNAFFTLVNLYM

SEQ ID NO: 1906942 - protein, 21 aa, Staphylococcus
WNWIAVIVYLVAMLLVGAYFT

SEQ ID NO: 1906943 - protein, 21 aa, Staphylococcus
WNWVAVILYLVVMLIVGAYFT

SEQ ID NO: 1906944 - protein, 25 aa, Staphylococcus
WNWVAVLLYLLIMLAVGAYFTKRAS

SEQ ID NO: 1906945 - protein, 30 aa, Staphylococcus
WPAFISIKSEFWWIYLPATLIATVVPAVLT

SEQ ID NO: 1906946 - protein, 21 aa, Staphylococcus
WPGFVLVIIGAVFWGVGGTVS

SEQ ID NO: 1906947 - protein, 24 aa, Staphylococcus
WPISILVIIVIVLSLIFAPNLSQL

SEQ ID NO: 1906948 - protein, 17 aa, Staphylococcus
WPYVLLPFGFGQIFHQI

SEQ ID NO: 1906949 - protein, 17 aa, Staphylococcus
WQISVVQFFNWFALMYL

SEQ ID NO: 1906950 - protein, 26 aa, Staphylococcus
WQMNRVLLWIYLIVLICVMFANQPSI

SEQ ID NO: 1906951 - protein, 26 aa, Staphylococcus
WQREGWMIFIGWLSYFLLGFYMGYHY

SEQ ID NO: 1906952 - protein, 28 aa, Staphylococcus
WRKKIILILFVIPFPLMVWGVMTQGWWF

SEQ ID NO: 1906953 - protein, 23 aa, Staphylococcus
WRKKWLYHPLVLLGIVVIFFVQQ

SEQ ID NO: 1906954 - protein, 26 aa, Staphylococcus
WRLIAISILLLFFWSTEKILHPIDSA

SEQ ID NO: 1906955 - protein, 30 aa, Staphylococcus
WRNIFVFPIIIVAIAFILSFFFMKDVIPNR

SEQ ID NO: 1906956 - protein, 17 aa, Staphylococcus
WRSLFHVVTPIAALTFL

SEQ ID NO: 1906957 - protein, 24 aa, Staphylococcus
WRYTFLFIVFVSVLVGILMYFYVP

SEQ ID NO: 1906958 - protein, 23 aa, Staphylococcus
WSAPSFKNLFLPKGKLSSLVLNF

SEQ ID NO: 1906959 - protein, 18 aa, Staphylococcus
WSILMSIALFFIMMKVMP

SEQ ID NO: 1906960 - protein, 24 aa, Staphylococcus
WSMVLGYIVCQMLGGIFGGVLVWL

SEQ ID NO: 1906961 - protein, 25 aa, Staphylococcus
WSNIWFDVLILFVFIIVFTTMNIIG

SEQ ID NO: 1906962 - protein, 23 aa, Staphylococcus
WSSPSFKGLFLPKGKLSSLVFNF

SEQ ID NO: 1906963 - protein, 24 aa, Staphylococcus
WSSPSFKGLFLPKGKLSSLVLNFS

SEQ ID NO: 1906964 - protein, 31 aa, Staphylococcus
WTDSITNFIILLFTVIGLLAIFFADWFIDFF

SEQ ID NO: 1906965 - protein, 30 aa, Staphylococcus
WTGMKIVPVFFLLLFFSMQLLMLPEQMLPE

SEQ ID NO: 1906966 - protein, 19 aa, Staphylococcus
WTHFIISLPVIIGGSFSAF

SEQ ID NO: 1906967 - protein, 31 aa, Staphylococcus
WTIIAGLIFALLFFYLIVLSPLLSFKNDVQT

SEQ ID NO: 1906968 - protein, 20 aa, Staphylococcus
WTILLSLIFLKENIKRYQII

SEQ ID NO: 1906969 - protein, 20 aa, Staphylococcus
WTITLVGLVTLFWASLNATK

SEQ ID NO: 1906970 - protein, 40 aa, Staphylococcus
WTKRHKKRNSIYTGIIFVVALILLVFAMTSQKIEPVKAIG

SEQ ID NO: 1906971 - protein, 29 aa, Staphylococcus
WTLFRTITFPLLRPGIISGWILIFCISMR

SEQ ID NO: 1906972 - protein, 19 aa, Staphylococcus
WTLPIMFVLTIVGGLLGAW

SEQ ID NO: 1906973 - protein, 23 aa, Staphylococcus
WTSKRWLIISITIFIVMMLVLNF

SEQ ID NO: 1906974 - protein, 18 aa, Staphylococcus
WTVLISHIAFCIPIVVII

SEQ ID NO: 1906975 - protein, 19 aa, Staphylococcus
WTVMILLVVIGWLTSVRSN

SEQ ID NO: 1906976 - protein, 25 aa, Staphylococcus
WTVPCYLCIVFAIFYGFSGIGIKKA

SEQ ID NO: 1906977 - protein, 17 aa, Staphylococcus
WTWCMLVTFVIAAVLIG

SEQ ID NO: 1906978 - protein, 17 aa, Staphylococcus
WVDSPDTWKNTIGESEK

SEQ ID NO: 1906979 - protein, 28 aa, Staphylococcus
WVFFSSFIILLFPIFLLSQAQSVNMLML

SEQ ID NO: 1906980 - protein, 17 aa, Staphylococcus
WVGVIVTLILIAASVYK

SEQ ID NO: 1906981 - protein, 27 aa, Staphylococcus
WVIAIVVALIVIWGFAGMPALELKSKS

SEQ ID NO: 1906982 - protein, 18 aa, Staphylococcus
WVIDLVIIFTLFGVGVVM

SEQ ID NO: 1906983 - protein, 17 aa, Staphylococcus
WVILLILCFMKMAKIQF

SEQ ID NO: 1906984 - protein, 18 aa, Staphylococcus
WVIMVIIGFLYICKEIFY

SEQ ID NO: 1906985 - protein, 18 aa, Staphylococcus
WVLLIILFFAAYFNFSEK

SEQ ID NO: 1906986 - protein, 19 aa, Staphylococcus
WVNIISWTLIVILSGLNVY

SEQ ID NO: 1906987 - protein, 26 aa, Staphylococcus
WVQNWTIFYWAWWVSWAPFVGIFIAR

SEQ ID NO: 1906988 - protein, 23 aa, Staphylococcus
WVSALFCVLLLMAFNLFSAKIFG

SEQ ID NO: 1906989 - protein, 19 aa, Staphylococcus
WVSIIIHLIILILTAITGY

SEQ ID NO: 1906990 - protein, 18 aa, Staphylococcus
WVSLIIQIIIFILVAITG

SEQ ID NO: 1906991 - protein, 20 aa, Staphylococcus
WVTSLYAFDISFIYDFGIGI

SEQ ID NO: 1906992 - protein, 17 aa, Staphylococcus
WVWTITLVGLVTLFWAS

SEQ ID NO: 1906993 - protein, 20 aa, Staphylococcus
WWFPVMAAMFLSFTIAIMFL

SEQ ID NO: 1906994 - protein, 25 aa, Staphylococcus
WWHFLIYIFIFLILIDIVYAAFGPW

SEQ ID NO: 1906995 - protein, 20 aa, Staphylococcus
WYAMLWNLIFMIPGIIGLFL

SEQ ID NO: 1906996 - protein, 19 aa, Staphylococcus
WYIISSVVGYLLFGTGLGM

SEQ ID NO: 1906997 - protein, 18 aa, Staphylococcus
WYLPKWLGAVLPNIDVEG

SEQ ID NO: 1906998 - protein, 27 aa, Staphylococcus
WYSMLEEFKVTIWYTAPTALRMLMSAG

SEQ ID NO: 1906999 - protein, 20 aa, Staphylococcus
WYSYLCPMLNWFIPIKYTEL

SEQ ID NO: 1907000 - protein, 27 aa, Staphylococcus
WYTNYWYHWLIYIAAIYLVLMFITLIA

SEQ ID NO: 1907001 - protein, 18 aa, Staphylococcus
WYVFTIIYVLFILFIIWQ

SEQ ID NO: 1907002 - protein, 20 aa, Staphylococcus
YAAGYFKPFWPLAIINVFEE

SEQ ID NO: 1907003 - protein, 23 aa, Staphylococcus
YAALAFFALINMIVLILTIIFIP

SEQ ID NO: 1907004 - protein, 34 aa, Staphylococcus
YAALITMFIIHLIIVGLLGLNPWRYLRKTAEVLI

SEQ ID NO: 1907005 - protein, 24 aa, Staphylococcus
YAALLTMYVIHLIILAIMGINPIR

SEQ ID NO: 1907006 - protein, 17 aa, Staphylococcus
YAAPILDDVYKAKNNEL

SEQ ID NO: 1907007 - protein, 25 aa, Staphylococcus
YAAVGIIIYVSLRFEWRMGLSSVLA

SEQ ID NO: 1907008 - protein, 17 aa, Staphylococcus
YAAYEKRSGRNSLLSES

SEQ ID NO: 1907009 - protein, 37 aa, Staphylococcus
YADDPLSYVKHISRSIFGFMRYNDAYDQVRIFGADEL

SEQ ID NO: 1907010 - protein, 29 aa, Staphylococcus
YADLLNKLIMILIYIIVAIIVIKVLNKSI

SEQ ID NO: 1907011 - protein, 24 aa, Staphylococcus
YAFDISFIYDFGIGIAAFFALYVP

SEQ ID NO: 1907012 - protein, 22 aa, Staphylococcus
YAFILVMVAFVLISVAMYLLPY

SEQ ID NO: 1907013 - protein, 18 aa, Staphylococcus
YAFYPEAPFTLLMIAGFL

SEQ ID NO: 1907014 - protein, 18 aa, Staphylococcus
YAGFFIVFVYFKSGKNLV

SEQ ID NO: 1907015 - protein, 18 aa, Staphylococcus
YAIILIIASYFGAKLGVK

SEQ ID NO: 1907016 - protein, 18 aa, Staphylococcus
YAIIPYMLTIIPSIMLGF

SEQ ID NO: 1907017 - protein, 19 aa, Staphylococcus
YAILNYTVPIISIIFGYIG

SEQ ID NO: 1907018 - protein, 25 aa, Staphylococcus
YAINSKYYVFIMSYIDRIQQDGRSG

SEQ ID NO: 1907019 - protein, 18 aa, Staphylococcus
YAIPFYFRFLHVRSFREN

SEQ ID NO: 1907020 - protein, 19 aa, Staphylococcus
YAIRMFAVALIIMPLNTIG

SEQ ID NO: 1907021 - protein, 25 aa, Staphylococcus
YAIRSILWEHIIQLKMPFFDKNESG

SEQ ID NO: 1907022 - protein, 25 aa, Staphylococcus
YAISFPLYSYFGLLFLIVGWLTIRN

SEQ ID NO: 1907023 - protein, 19 aa, Staphylococcus
YAIYFLMGIILYIAYDRRR

SEQ ID NO: 1907024 - protein, 20 aa, Staphylococcus
YALIRFFTLLFDQHPNITHP

SEQ ID NO: 1907025 - protein, 21 aa, Staphylococcus
YALMILVVSVKLFGFLRAMMR

SEQ ID NO: 1907026 - protein, 23 aa, Staphylococcus
YALRMIIPNLFSFLASIFVLWLY

SEQ ID NO: 1907027 - protein, 25 aa, Staphylococcus
YALTFIMILNIFIWAFSIYVLVMTC

SEQ ID NO: 1907028 - protein, 19 aa, Staphylococcus
YALTWLIGVFIVINGILGL

SEQ ID NO: 1907029 - protein, 17 aa, Staphylococcus
YAMKHLKTDFKKNALKN

SEQ ID NO: 1907030 - protein, 17 aa, Staphylococcus
YANDYWIDLHADPFKEL

SEQ ID NO: 1907031 - protein, 18 aa, Staphylococcus
YAQLLLSIARSCQNKIII

SEQ ID NO: 1907032 - protein, 31 aa, Staphylococcus
YASIMLLTWLIIIFILLILAYRRAKVFKRPF

SEQ ID NO: 1907033 - protein, 39 aa, Staphylococcus
YASTKKKMHLTIWQFILILLSVIIITTIIAVFATIGINH

SEQ ID NO: 1907034 - protein, 24 aa, Staphylococcus
YAVITFLLITWFIQKGLKQELRDY

SEQ ID NO: 1907035 - protein, 26 aa, Staphylococcus
YAVIYYVVFRFLIVKFNFKTPGREDK

SEQ ID NO: 1907036 - protein, 29 aa, Staphylococcus
YAVLDFTYDLPLNVYLGQVLDISAKIPKN

SEQ ID NO: 1907037 - protein, 17 aa, Staphylococcus
YAWVLLVLVFLEGLLAA

SEQ ID NO: 1907038 - protein, 30 aa, Staphylococcus
YAYIFPGIVTILFLFSFIAQVLKVYNTRYW

SEQ ID NO: 1907039 - protein, 18 aa, Staphylococcus
YCIVIFPITIILYTRIAR

SEQ ID NO: 1907040 - protein, 18 aa, Staphylococcus
YCLIIIFVLVVVLGVWLV

SEQ ID NO: 1907041 - protein, 19 aa, Staphylococcus
YDASYHEYRMIDTDKANTI

SEQ ID NO: 1907042 - protein, 30 aa, Staphylococcus
YDFQLVKVIPYLLVLILALVGVNVIIVLIG

SEQ ID NO: 1907043 - protein, 18 aa, Staphylococcus
YDHEYTTHIELESVIPTI

SEQ ID NO: 1907044 - protein, 18 aa, Staphylococcus
YDIAADSVWYIVVLNLGM

SEQ ID NO: 1907045 - protein, 24 aa, Staphylococcus
YDKTAVIILFTLLIVVIIDFISSK

SEQ ID NO: 1907046 - protein, 30 aa, Staphylococcus
YDLIKVVPYLFVLILALFGVNVIIVLIGGI

SEQ ID NO: 1907047 - protein, 19 aa, Staphylococcus
YDLKRQFNKAVKDAREALS

SEQ ID NO: 1907048 - protein, 26 aa, Staphylococcus
YDLLPTLVAVFLFAALFLPFLMEYGL

SEQ ID NO: 1907049 - protein, 21 aa, Staphylococcus
YDLTEIAFLVPISFVLTIASA

SEQ ID NO: 1907050 - protein, 18 aa, Staphylococcus
YDMASIFEIIPYLLIASG

SEQ ID NO: 1907051 - protein, 23 aa, Staphylococcus
YDQIGIWAPILLLIGRIIQGFST

SEQ ID NO: 1907052 - protein, 26 aa, Staphylococcus
YDQIGVWAPILLLLGRVLQGFSTGGE

SEQ ID NO: 1907053 - protein, 60 aa, Staphylococcus
YDSNNPTDLLYSGRPNTASKSFGVFTGVFNVPNNVSRLRFMFETFEKRSYESANGGRILK

SEQ ID NO: 1907054 - protein, 24 aa, Staphylococcus
YDSVMHSLVILSVLFGVIAIIVTS

SEQ ID NO: 1907055 - protein, 27 aa, Staphylococcus
YDTIGIWAPILLLLARILQGFSTGGEY

SEQ ID NO: 1907056 - protein, 26 aa, Staphylococcus
YDTIGIWAPILLLLARVLQGFSTGGE

SEQ ID NO: 1907057 - protein, 25 aa, Staphylococcus
YDYKVLIACLLVLVILILNLRGLTE

SEQ ID NO: 1907058 - protein, 25 aa, Staphylococcus
YDYNLIKVIPYLLVLILALVGVNVI

SEQ ID NO: 1907059 - protein, 24 aa, Staphylococcus
YDYNLIKVIPYVLVLVLALVGVNV

SEQ ID NO: 1907060 - protein, 50 aa, Staphylococcus
YEAHEKKKMSGISKIISTLIVLLLLGGLVFAVFAFVDNSNRVNERLNNQS

SEQ ID NO: 1907061 - protein, 19 aa, Staphylococcus
YEDKLAYGIALKGSSKLSG

SEQ ID NO: 1907062 - protein, 24 aa, Staphylococcus
YEDSKPIIATLFLDNYDEITQNMN

SEQ ID NO: 1907063 - protein, 40 aa, Staphylococcus
YEILGGGKKYNQVFMTMDGKLKIKIDYTVDDSVVEGDYFT

SEQ ID NO: 1907064 - protein, 25 aa, Staphylococcus
YEINTRYFVIITSYIEQIQPDGRSG

SEQ ID NO: 1907065 - protein, 19 aa, Staphylococcus
YEIPKKKRSKKKKFFFALI

SEQ ID NO: 1907066 - protein, 20 aa, Staphylococcus
YEKFLYRLMLIIGIIFSIAF

SEQ ID NO: 1907067 - protein, 21 aa, Staphylococcus
YEKIINIALFITAALTALVVV

SEQ ID NO: 1907068 - protein, 18 aa, Staphylococcus
YELFASRCYELLLGKFDS

SEQ ID NO: 1907069 - protein, 24 aa, Staphylococcus
YENIDLTFLFDYDELFYGNKLYFE

SEQ ID NO: 1907070 - protein, 19 aa, Staphylococcus
YENILLRHFPFGGDIIFVR

SEQ ID NO: 1907071 - protein, 30 aa, Staphylococcus
YENLAIKIALIIIYIIVALIVIAILNKVIE

SEQ ID NO: 1907072 - protein, 24 aa, Staphylococcus
YERWIVPIVFIGLGIYILFENGTF

SEQ ID NO: 1907073 - protein, 17 aa, Staphylococcus
YESLVLPMIAYLESHGV

SEQ ID NO: 1907074 - protein, 23 aa, Staphylococcus
YESLVLPMIAYLESHGVQFEYDV

SEQ ID NO: 1907075 - protein, 28 aa, Staphylococcus
YETLAIKIIMILIYIVAAIIVISILNKV

SEQ ID NO: 1907076 - protein, 24 aa, Staphylococcus
YETPAFWFGVFRYIAEGATIILVG

SEQ ID NO: 1907077 - protein, 33 aa, Staphylococcus
YEVAERKPSIWPFIIVGLVVIGIIVSCCFACYH

SEQ ID NO: 1907078 - protein, 30 aa, Staphylococcus
YEVFNFISWAPFTFLPIFIAITAAKHFKVN

SEQ ID NO: 1907079 - protein, 24 aa, Staphylococcus
YEVLYLVVPLLIIAFIFANHFTIA

SEQ ID NO: 1907080 - protein, 25 aa, Staphylococcus
YEYSLNIVSMIALFFTLYLGVVQVQ

SEQ ID NO: 1907081 - protein, 21 aa, Staphylococcus
YFAILLTIIFFGMAYFIPKFK

SEQ ID NO: 1907082 - protein, 20 aa, Staphylococcus
YFAILMILPLWAQHKVKSTY

SEQ ID NO: 1907083 - protein, 21 aa, Staphylococcus
YFCINLILPILLLTGIFVLLS

SEQ ID NO: 1907084 - protein, 19 aa, Staphylococcus
YFCVAMVITILLLFFGSFF

SEQ ID NO: 1907085 - protein, 18 aa, Staphylococcus
YFEMFWDSILYAALITMI

SEQ ID NO: 1907086 - protein, 25 aa, Staphylococcus
YFETSAVLITLILFGKYLEAKAKTQ

SEQ ID NO: 1907087 - protein, 26 aa, Staphylococcus
YFETSAVLITLILFGKYLEARAKSQT

SEQ ID NO: 1907088 - protein, 26 aa, Staphylococcus
YFETSAVLITLILFGKYLEARAKTQT

SEQ ID NO: 1907089 - protein, 24 aa, Staphylococcus
YFETSAVLITLILFGKYLETRAKT

SEQ ID NO: 1907090 - protein, 19 aa, Staphylococcus
YFETSAVLITLILLGKYFE

SEQ ID NO: 1907091 - protein, 27 aa, Staphylococcus
YFGGQLTLFFWFFKLHYSFGHIINSKI

SEQ ID NO: 1907092 - protein, 27 aa, Staphylococcus
YFGGQLTLFFWFFKLNYSFEHIINSKI

SEQ ID NO: 1907093 - protein, 27 aa, Staphylococcus
YFGGQLTLFFWFFKLNYSFGHIINAKI

SEQ ID NO: 1907094 - protein, 27 aa, Staphylococcus
YFGGQLTLFFWFFKLNYSFGHIINSKI

SEQ ID NO: 1907095 - protein, 27 aa, Staphylococcus
YFGGQLTLFFWFFQLHYSFGHIINSKI

SEQ ID NO: 1907096 - protein, 27 aa, Staphylococcus
YFGGQLTLFFWFFQLHYSFGHILNSKI

SEQ ID NO: 1907097 - protein, 29 aa, Staphylococcus
YFGILLSVIPFLIATYFFKKTNGFFLLAP

SEQ ID NO: 1907098 - protein, 17 aa, Staphylococcus
YFGSGDFMKEGFYMNNS

SEQ ID NO: 1907099 - protein, 23 aa, Staphylococcus
YFHLLYLFRISSIVSQPLFGIWT

SEQ ID NO: 1907100 - protein, 23 aa, Staphylococcus
YFHMIWHFFIIVASVFHFVAIMY

SEQ ID NO: 1907101 - protein, 22 aa, Staphylococcus
YFHMIWHIFIVIASLFHFIGIV

SEQ ID NO: 1907102 - protein, 22 aa, Staphylococcus
YFHMIWHLFIVLASLFHLIAIL

SEQ ID NO: 1907103 - protein, 19 aa, Staphylococcus
YFHPHTMIAVILMGAAAAM

SEQ ID NO: 1907104 - protein, 20 aa, Staphylococcus
YFIAFFLQIFYNIIALLMIG

SEQ ID NO: 1907105 - protein, 25 aa, Staphylococcus
YFIEHWRLLLYNIVIIIVFFVLGSI

SEQ ID NO: 1907106 - protein, 18 aa, Staphylococcus
YFILIISMAIVTFICTFV

SEQ ID NO: 1907107 - protein, 17 aa, Staphylococcus
YFIYPYKDEMEHKNIKF

SEQ ID NO: 1907108 - protein, 22 aa, Staphylococcus
YFKGYIQPFWPLAIINVFEEFT

SEQ ID NO: 1907109 - protein, 17 aa, Staphylococcus
YFLIIRPQQKRAKEHRE

SEQ ID NO: 1907110 - protein, 19 aa, Staphylococcus
YFLNFVVLYLKWDMAILKK

SEQ ID NO: 1907111 - protein, 19 aa, Staphylococcus
YFLPLAGLLLFFVATVPGI

SEQ ID NO: 1907112 - protein, 17 aa, Staphylococcus
YFLVLSTSGLIALYIHH

SEQ ID NO: 1907113 - protein, 18 aa, Staphylococcus
YFNGKWEWFKWNPLNMIM

SEQ ID NO: 1907114 - protein, 17 aa, Staphylococcus
YFNIFLIFVGIGLVIPV

SEQ ID NO: 1907115 - protein, 17 aa, Staphylococcus
YFNIFLVFLGIGLVVPV

SEQ ID NO: 1907116 - protein, 19 aa, Staphylococcus
YFNPHLIIAVIIMGIAAMV

SEQ ID NO: 1907117 - protein, 39 aa, Staphylococcus
YFNYSLNYKVWYLTVLAGLIPFIPIKFSFIKFNNVNNPS

SEQ ID NO: 1907118 - protein, 21 aa, Staphylococcus
YFSALIFLVLALFYGYYFINR

SEQ ID NO: 1907119 - protein, 21 aa, Staphylococcus
YFSALVFLFLAIFYGIYFVKV

SEQ ID NO: 1907120 - protein, 17 aa, Staphylococcus
YFTCMKDTAIPSKEMLI

SEQ ID NO: 1907121 - protein, 24 aa, Staphylococcus
YFTPVWFIILGLMYYRYKQMAKKT

SEQ ID NO: 1907122 - protein, 21 aa, Staphylococcus
YFTQFNWFEPTLIGLAALLII

SEQ ID NO: 1907123 - protein, 17 aa, Staphylococcus
YFVFIYKNHSSINIANK

SEQ ID NO: 1907124 - protein, 20 aa, Staphylococcus
YFVILMVLPLWAQHKVKSNY

SEQ ID NO: 1907125 - protein, 18 aa, Staphylococcus
YFVPIVVGIAIFTFIIWI

SEQ ID NO: 1907126 - protein, 17 aa, Staphylococcus
YFVPTVVGIALLTFIIW

SEQ ID NO: 1907127 - protein, 24 aa, Staphylococcus
YFVQTIVMFLIILGSIGFPVLLEI

SEQ ID NO: 1907128 - protein, 24 aa, Staphylococcus
YFVQTIVMFLITLGSIGFPVLLEV

SEQ ID NO: 1907129 - protein, 24 aa, Staphylococcus
YFVQTIVMFLIVLGSIGFPVLLEV

SEQ ID NO: 1907130 - protein, 26 aa, Staphylococcus
YFVVQFIITLFLIWLPTYLTEQYHVA

SEQ ID NO: 1907131 - protein, 25 aa, Staphylococcus
YFVVQFVIALFLIWLPTYLAEQYHV

SEQ ID NO: 1907132 - protein, 20 aa, Staphylococcus
YFVVQFVITLFLIWLPTYLT

SEQ ID NO: 1907133 - protein, 25 aa, Staphylococcus
YFYIHDIWLFIITYAIFQGLFAPAM

SEQ ID NO: 1907134 - protein, 26 aa, Staphylococcus
YFYIHHIWLFIIVYAIFQGLFAPAMP

SEQ ID NO: 1907135 - protein, 30 aa, Staphylococcus
YFYLLLFITTTLIGALLLYLPITGKHPIDF

SEQ ID NO: 1907136 - protein, 21 aa, Staphylococcus
YFYLMLFFSTTLVGAILLYLP

SEQ ID NO: 1907137 - protein, 29 aa, Staphylococcus
YGALALLPLLIFLILYIGVGITFTIMGKE

SEQ ID NO: 1907138 - protein, 24 aa, Staphylococcus
YGDDWFSYFMRRLAERPQNLNLMF

SEQ ID NO: 1907139 - protein, 23 aa, Staphylococcus
YGFFPLTLYTIVAGSLFMLLFLP

SEQ ID NO: 1907140 - protein, 17 aa, Staphylococcus
YGFFYAPLVITGLHHMF

SEQ ID NO: 1907141 - protein, 22 aa, Staphylococcus
YGFREFLRGFFWFKEQDDVLDD

SEQ ID NO: 1907142 - protein, 17 aa, Staphylococcus
YGFWCFSVFAIGTFLKY

SEQ ID NO: 1907143 - protein, 20 aa, Staphylococcus
YGHINFTFLNTLDSFKNTVS

SEQ ID NO: 1907144 - protein, 17 aa, Staphylococcus
YGKINFLILFVTTLIIG

SEQ ID NO: 1907145 - protein, 24 aa, Staphylococcus
YGLAIIFHIFWYTLTMHLAYMILR

SEQ ID NO: 1907146 - protein, 19 aa, Staphylococcus
YGLKLLNPNYFLVSAFIIS

SEQ ID NO: 1907147 - protein, 28 aa, Staphylococcus
YGLKPLVYTGFILLILATLPLCFLQYDS

SEQ ID NO: 1907148 - protein, 18 aa, Staphylococcus
YGLLYAPLVITGLHHMFL

SEQ ID NO: 1907149 - protein, 20 aa, Staphylococcus
YGLPVFTLPFIIATWIMLFA

SEQ ID NO: 1907150 - protein, 17 aa, Staphylococcus
YGLSRLLIFWHLGYFGY

SEQ ID NO: 1907151 - protein, 23 aa, Staphylococcus
YGMIVYVVLIIAFTYFYAFVQVN

SEQ ID NO: 1907152 - protein, 21 aa, Staphylococcus
YGMKAILIYYLYYSVAEGGFG

SEQ ID NO: 1907153 - protein, 21 aa, Staphylococcus
YGMKAILVYYLYYSVAKGGFG

SEQ ID NO: 1907154 - protein, 34 aa, Staphylococcus
YGMNFKYMPELNWHYSYFAFIGISLIVTITLILF

SEQ ID NO: 1907155 - protein, 22 aa, Staphylococcus
YGNKLYFERLMINLINNSLEHN

SEQ ID NO: 1907156 - protein, 17 aa, Staphylococcus
YGSLFLSGILVILIAPF

SEQ ID NO: 1907157 - protein, 19 aa, Staphylococcus
YGTLSVIVLLLLVATGLPL

SEQ ID NO: 1907158 - protein, 17 aa, Staphylococcus
YGVFAPWLNGVTNCIAG

SEQ ID NO: 1907159 - protein, 29 aa, Staphylococcus
YGVRPLIMIGFTLLIILTGVLAFLKVDTP

SEQ ID NO: 1907160 - protein, 26 aa, Staphylococcus
YGVTLLLVTVIPYYIFSALKIAGPSS

SEQ ID NO: 1907161 - protein, 21 aa, Staphylococcus
YGVWFMAAIVCYLIIPKPGIA

SEQ ID NO: 1907162 - protein, 21 aa, Staphylococcus
YGVWFMAAVVCYLIIPKPGIA

SEQ ID NO: 1907163 - protein, 22 aa, Staphylococcus
YGWKTILYFEIITTIAIGLGII

SEQ ID NO: 1907164 - protein, 23 aa, Staphylococcus
YGYLGLIIPLHGIDWFFGSPQGI

SEQ ID NO: 1907165 - protein, 17 aa, Staphylococcus
YGYLGYIIPLHSTDWFW

SEQ ID NO: 1907166 - protein, 24 aa, Staphylococcus
YHAAFWFAVIISIISLISVFMLKS

SEQ ID NO: 1907167 - protein, 27 aa, Staphylococcus
YHFEIHSLWYLGMIPWIGAVFTAYFGG

SEQ ID NO: 1907168 - protein, 31 aa, Staphylococcus
YHFSVPVRDWNGDLSFNGKVLMFDNNVTLVG

SEQ ID NO: 1907169 - protein, 32 aa, Staphylococcus
YHFVLAMFPMLIFLLTLLPFFNIEQSQITNML

SEQ ID NO: 1907170 - protein, 29 aa, Staphylococcus
YHFVLAMFPMLIFLLTLLPLFNLDQSQIT

SEQ ID NO: 1907171 - protein, 32 aa, Staphylococcus
YHHKHSLIGLFILILVILLARATFNMLNQRIG

SEQ ID NO: 1907172 - protein, 21 aa, Staphylococcus
YHHKVLIACLLVLFILIMNLR

SEQ ID NO: 1907173 - protein, 28 aa, Staphylococcus
YHIDKQYHHILIPPFIIQILVENAIKHA

SEQ ID NO: 1907174 - protein, 19 aa, Staphylococcus
YHIRDPYWKLIKGNKRKVK

SEQ ID NO: 1907175 - protein, 22 aa, Staphylococcus
YHLVKVIPYVLVLVLALIGVNV

SEQ ID NO: 1907176 - protein, 23 aa, Staphylococcus
YHNKFIWLLGITNTIGILLQYVS

SEQ ID NO: 1907177 - protein, 25 aa, Staphylococcus
YHQYVPWLVLVPIVSLIGLFTLIIK

SEQ ID NO: 1907178 - protein, 29 aa, Staphylococcus
YHSGFLFAVIITFISLLLTFLIKSKKKVK

SEQ ID NO: 1907179 - protein, 20 aa, Staphylococcus
YHVVMWLIVIYMIIGFIVLW

SEQ ID NO: 1907180 - protein, 26 aa, Staphylococcus
YHWNVMFYGMFFIGLVAIIVGMFWFK

SEQ ID NO: 1907181 - protein, 25 aa, Staphylococcus
YHWNVMFYGMFFIGLVAVLVGYIWF

SEQ ID NO: 1907182 - protein, 38 aa, Staphylococcus
YHWNVMFYGMFFLGIAAMIFGYFWFRLYQRTTNPRADY

SEQ ID NO: 1907183 - protein, 37 aa, Staphylococcus
YHWNVMFYGMFILGLIAIIIGFIWFRLYQRTTNPKAD

SEQ ID NO: 1907184 - protein, 27 aa, Staphylococcus
YIALAGWLILGLIFFIVRYPKLKRINK

SEQ ID NO: 1907185 - protein, 26 aa, Staphylococcus
YIAYIILIMFALPFLLSVTLILINYI

SEQ ID NO: 1907186 - protein, 32 aa, Staphylococcus
YIDGLIGIILFFIIFGFFLKKVTYAFKELEQI

SEQ ID NO: 1907187 - protein, 29 aa, Staphylococcus
YIDGLLGALIFFIIFGFFINQVTQLIRTM

SEQ ID NO: 1907188 - protein, 24 aa, Staphylococcus
YIDKSTYKGIYSFDVLGLQNINRN

SEQ ID NO: 1907189 - protein, 22 aa, Staphylococcus
YIEMLFVVCIISLLLYFQLFNI

SEQ ID NO: 1907190 - protein, 28 aa, Staphylococcus
YIFKIDQAWILMLAVLIIIINASWNTIN

SEQ ID NO: 1907191 - protein, 18 aa, Staphylococcus
YIFMFLIGTVAIAAIVGI

SEQ ID NO: 1907192 - protein, 26 aa, Staphylococcus
YIGLGIVLMFFIISLVSQILEVYSTR

SEQ ID NO: 1907193 - protein, 27 aa, Staphylococcus
YIGPSIFLFIFILTFIHRFLEIKVTRY

SEQ ID NO: 1907194 - protein, 18 aa, Staphylococcus
YIGYAPIKDPKLSFSIVY

SEQ ID NO: 1907195 - protein, 18 aa, Staphylococcus
YIGYAPINNPKLSFSIVY

SEQ ID NO: 1907196 - protein, 19 aa, Staphylococcus
YIIFFLLIIIGTSCVALVS

SEQ ID NO: 1907197 - protein, 19 aa, Staphylococcus
YIIGAIINFIKYFGYTLTQ

SEQ ID NO: 1907198 - protein, 23 aa, Staphylococcus
YIIGLVFLLYMAWTLWHEQSSDI

SEQ ID NO: 1907199 - protein, 17 aa, Staphylococcus
YIILLQTAQFYTQQAYG

SEQ ID NO: 1907200 - protein, 17 aa, Staphylococcus
YIIPIIIIILMLAQAVV

SEQ ID NO: 1907201 - protein, 18 aa, Staphylococcus
YIISIEIVFFHLSKNFMS

SEQ ID NO: 1907202 - protein, 29 aa, Staphylococcus
YIKIDFWVIMLIIGFLYMCKIVFYPDSEN

SEQ ID NO: 1907203 - protein, 17 aa, Staphylococcus
YIKIIEKRLLNARNFTS

SEQ ID NO: 1907204 - protein, 32 aa, Staphylococcus
YILFLATFLERFSYFLIIPFLSIYLAQNYHLS

SEQ ID NO: 1907205 - protein, 18 aa, Staphylococcus
YILHRFFGQAFYPKKIWI

SEQ ID NO: 1907206 - protein, 21 aa, Staphylococcus
YILIALILLGLINFFIVKSKK

SEQ ID NO: 1907207 - protein, 18 aa, Staphylococcus
YILIGIMLYFLMSSIGEL

SEQ ID NO: 1907208 - protein, 18 aa, Staphylococcus
YILIPYTILTFINAVYLV

SEQ ID NO: 1907209 - protein, 22 aa, Staphylococcus
YILNIFFIFFINVIVGLYVIKM

SEQ ID NO: 1907210 - protein, 24 aa, Staphylococcus
YILTSLYYVFLIIKILGACYLIYL

SEQ ID NO: 1907211 - protein, 25 aa, Staphylococcus
YILTSLYYVFLIIKILGACYLIYLG

SEQ ID NO: 1907212 - protein, 20 aa, Staphylococcus
YILWGILPIYWELISDIGAF

SEQ ID NO: 1907213 - protein, 22 aa, Staphylococcus
YIMMILFIIFISVTLGLLDIIY

SEQ ID NO: 1907214 - protein, 17 aa, Staphylococcus
YINAEPTKKQAYDLAVQ

SEQ ID NO: 1907215 - protein, 19 aa, Staphylococcus
YINQNRAFNTGSKVRLSGQ

SEQ ID NO: 1907216 - protein, 17 aa, Staphylococcus
YIPEWFGPNFWITCLVA

SEQ ID NO: 1907217 - protein, 25 aa, Staphylococcus
YIQYYLYLLILLGILYLFSPHPFLL

SEQ ID NO: 1907218 - protein, 25 aa, Staphylococcus
YIQYYLYLLIVLGILYLIIPRPFIL

SEQ ID NO: 1907219 - protein, 21 aa, Staphylococcus
YIRFPNRFFETLFNHFEQFNF

SEQ ID NO: 1907220 - protein, 17 aa, Staphylococcus
YISIILLIISFYFNTFN

SEQ ID NO: 1907221 - protein, 29 aa, Staphylococcus
YISIVILLHIIGFSFLWFAGKDHHILFGM

SEQ ID NO: 1907222 - protein, 19 aa, Staphylococcus
YISIVSLLIAIIIAVPLGI

SEQ ID NO: 1907223 - protein, 20 aa, Staphylococcus
YITIVFALHIIGFVFLWIAA

SEQ ID NO: 1907224 - protein, 24 aa, Staphylococcus
YITKVLYRLTFVGSIFLAVIAILP

SEQ ID NO: 1907225 - protein, 17 aa, Staphylococcus
YITLILIVISFYFNMRN

SEQ ID NO: 1907226 - protein, 18 aa, Staphylococcus
YITLLLLAISFFFNTNNP

SEQ ID NO: 1907227 - protein, 22 aa, Staphylococcus
YITRVLYRLTFVGSIFLAVIAI

SEQ ID NO: 1907228 - protein, 19 aa, Staphylococcus
YIVFVVIALILPYLVLCLR

SEQ ID NO: 1907229 - protein, 18 aa, Staphylococcus
YIVIALILIGLINVFLSK

SEQ ID NO: 1907230 - protein, 19 aa, Staphylococcus
YIVIIMAIPMWAQHNVKSN

SEQ ID NO: 1907231 - protein, 19 aa, Staphylococcus
YIVLIAFVIVMMFILSWLM

SEQ ID NO: 1907232 - protein, 17 aa, Staphylococcus
YIVLIISVIVMMFIFSW

SEQ ID NO: 1907233 - protein, 17 aa, Staphylococcus
YIVMTIYSTIYAIFAII

SEQ ID NO: 1907234 - protein, 23 aa, Staphylococcus
YIVSIFMGLVKFAPIAKAKWLAF

SEQ ID NO: 1907235 - protein, 23 aa, Staphylococcus
YIVSIFMGLVKFGPIAHAKWLDF

SEQ ID NO: 1907236 - protein, 20 aa, Staphylococcus
YIVTSLLIIIGLLIAYIIGV

SEQ ID NO: 1907237 - protein, 35 aa, Staphylococcus
YKANRNIFWLLLIVFLILFILLQVRIFTIKEDNIY

SEQ ID NO: 1907238 - protein, 24 aa, Staphylococcus
YKEPKRYILPWALLGFVVVMIYQM

SEQ ID NO: 1907239 - protein, 24 aa, Staphylococcus
YKFMRQWFMFWGPPMIIISLFVFL

SEQ ID NO: 1907240 - protein, 26 aa, Staphylococcus
YKGKTETYRFLLIDTPETKHPRVGKQ

SEQ ID NO: 1907241 - protein, 42 aa, Staphylococcus
YKHAQAPVYIVKFWTILISLVLGMVVMFALIFTNTGNIQLSN

SEQ ID NO: 1907242 - protein, 36 aa, Staphylococcus
YKHFYYRLFAILTLAFILLSFVPFIDQLFNGFSAPQ

SEQ ID NO: 1907243 - protein, 22 aa, Staphylococcus
YKHILSIIMLWIGSFILIGANM

SEQ ID NO: 1907244 - protein, 29 aa, Staphylococcus
YKHYYYKIFAIITWFLLIGSLSQYFDSAF

SEQ ID NO: 1907245 - protein, 17 aa, Staphylococcus
YKMLGIYLISGLFGNFA

SEQ ID NO: 1907246 - protein, 38 aa, Staphylococcus
YKQEWFIVLTLIFIFPLGLFVMWRYSKWPSIAKTIVTV

SEQ ID NO: 1907247 - protein, 27 aa, Staphylococcus
YKRILFTLMIIFIYILGSNIKIADMKS

SEQ ID NO: 1907248 - protein, 22 aa, Staphylococcus
YKRLYYQQKYFFTLSGLVVRMR

SEQ ID NO: 1907249 - protein, 23 aa, Staphylococcus
YKRPVIIFIVPGIIPLVPGGTAY

SEQ ID NO: 1907250 - protein, 22 aa, Staphylococcus
YKRPVIVFIVPGIIPLVPGGAA

SEQ ID NO: 1907251 - protein, 21 aa, Staphylococcus
YKTHTLNWFKQTWGYMNLGAS

SEQ ID NO: 1907252 - protein, 38 aa, Staphylococcus
YKWMIITTLIMFLTILLFCLVIIFFLKDTLKDGELDEA

SEQ ID NO: 1907253 - protein, 39 aa, Staphylococcus
YKWMIITTLITFTTILLFCLIIIFFLKDTLRNSELDEAE

SEQ ID NO: 1907254 - protein, 18 aa, Staphylococcus
YKYIFYFISFMIIMVVIP

SEQ ID NO: 1907255 - protein, 26 aa, Staphylococcus
YKYKRYPILMLLVCATLAVAVVVQNV

SEQ ID NO: 1907256 - protein, 24 aa, Staphylococcus
YKYMRQWFIFWGPPMIIISLFVFL

SEQ ID NO: 1907257 - protein, 25 aa, Staphylococcus
YLAGFIILFFRAIVPVLPLTLYVIL

SEQ ID NO: 1907258 - protein, 22 aa, Staphylococcus
YLAGFLLLYLRAMVPILPLFLY

SEQ ID NO: 1907259 - protein, 30 aa, Staphylococcus; identical to SEQ ID NO: 1754161

SEQ ID NO: 1907260 - protein, 21 aa, Staphylococcus
YLDKWWIVAFIFVAQLVLSLS

SEQ ID NO: 1907261 - protein, 26 aa, Staphylococcus
YLDNWWIVVFIFVCQLILSLSYHYTR

SEQ ID NO: 1907262 - protein, 17 aa, Staphylococcus
YLDRFLIIPILGAASMG

SEQ ID NO: 1907263 - protein, 28 aa, Staphylococcus
YLDVSTPYALLFFDLIVVVISLTVISLD

SEQ ID NO: 1907264 - protein, 38 aa, Staphylococcus
YLFDYYPFINFLFFLLFYSLWILFIVSVTILLSTFIKS

SEQ ID NO: 1907265 - protein, 20 aa, Staphylococcus
YLFFNNIIILSLIVIILMIL

SEQ ID NO: 1907266 - protein, 22 aa, Staphylococcus
YLFGMIAYFILLMLRTTRSLKN

SEQ ID NO: 1907267 - protein, 23 aa, Staphylococcus
YLFKKLSWPVGLIIIAVLISSLG

SEQ ID NO: 1907268 - protein, 19 aa, Staphylococcus
YLFNWFFIVYNIGVIITVG

SEQ ID NO: 1907269 - protein, 28 aa, Staphylococcus
YLGFAIIFGFMAFFWFIGVHGPSVVGPA

SEQ ID NO: 1907270 - protein, 32 aa, Staphylococcus
YLGHKHLLFVLFFIAMLISWYLFEKYYDVEQV

SEQ ID NO: 1907271 - protein, 25 aa, Staphylococcus
YLGLVNFCRLVPILLLSVWAGSIAD

SEQ ID NO: 1907272 - protein, 26 aa, Staphylococcus
YLGNMPWWNVILLYTIRILSGTILSG

SEQ ID NO: 1907273 - protein, 24 aa, Staphylococcus
YLGYILVALFLITWLISTLIWKFG

SEQ ID NO: 1907274 - protein, 22 aa, Staphylococcus
YLGYILVALFLVTWLISTLIWK

SEQ ID NO: 1907275 - protein, 18 aa, Staphylococcus
YLGYLIGAIIPMFITIKS

SEQ ID NO: 1907276 - protein, 19 aa, Staphylococcus
YLHELIRWLLIFGVLFQLP

SEQ ID NO: 1907277 - protein, 18 aa, Staphylococcus
YLHMLLWGKEKGYKAFNM

SEQ ID NO: 1907278 - protein, 30 aa, Staphylococcus
YLIDQLTQSKLFSHPIFVVDGHSHTVIEHG

SEQ ID NO: 1907279 - protein, 19 aa, Staphylococcus
YLIGLGTLLLIALIEIVPP

SEQ ID NO: 1907280 - protein, 18 aa, Staphylococcus
YLIGLLQSPYYYTPYQED

SEQ ID NO: 1907281 - protein, 19 aa, Staphylococcus
YLIIPFAILMLINAIYLVV

SEQ ID NO: 1907282 - protein, 21 aa, Staphylococcus
YLIKMFKYFEQLRWFIGELNH

SEQ ID NO: 1907283 - protein, 17 aa, Staphylococcus
YLILLKLLHVHYMVSHI

SEQ ID NO: 1907284 - protein, 18 aa, Staphylococcus
YLILNILSIILMGFTTNF

SEQ ID NO: 1907285 - protein, 21 aa, Staphylococcus
YLIVIAILIIVSLFSLSVGAV

SEQ ID NO: 1907286 - protein, 18 aa, Staphylococcus
YLKNLIIAIPLTLNGIIC

SEQ ID NO: 1907287 - protein, 34 aa, Staphylococcus
YLKRNKWKMFFWLAGLIILTLIIPPAFKNIYPDN

SEQ ID NO: 1907288 - protein, 30 aa, Staphylococcus
YLKVMFLSAPFVILFFILEQFARAVGAPII

SEQ ID NO: 1907289 - protein, 17 aa, Staphylococcus
YLLIGVMLYFLMASIGE

SEQ ID NO: 1907290 - protein, 17 aa, Staphylococcus
YLLIVFGVATGLSPSAL

SEQ ID NO: 1907291 - protein, 18 aa, Staphylococcus
YLLNLHLGYTFSGGFIDF

SEQ ID NO: 1907292 - protein, 19 aa, Staphylococcus
YLLRIFQLLLLYATPMFVF

SEQ ID NO: 1907293 - protein, 19 aa, Staphylococcus
YLLSFLIILIILSSLTSFL

SEQ ID NO: 1907294 - protein, 19 aa, Staphylococcus
YLLTALYLAIFITLYLIYG

SEQ ID NO: 1907295 - protein, 17 aa, Staphylococcus
YLLVLILALVGVNVIIV

SEQ ID NO: 1907296 - protein, 19 aa, Staphylococcus
YLNEDPEIQRIYDKAIQSG

SEQ ID NO: 1907297 - protein, 17 aa, Staphylococcus
YLNIVPFGRDYNGANIT

SEQ ID NO: 1907298 - protein, 20 aa, Staphylococcus
YLNRPLAIIFWIIAELAIIA

SEQ ID NO: 1907299 - protein, 32 aa, Staphylococcus
YLNSLQRGSNYFRFEYFNPTNSSKYYKNLDEQ

SEQ ID NO: 1907300 - protein, 17 aa, Staphylococcus
YLPFGYGAEDIELNKIS

SEQ ID NO: 1907301 - protein, 19 aa, Staphylococcus
YLQLFMGSILFFKFLTEFI

SEQ ID NO: 1907302 - protein, 20 aa, Staphylococcus
YLQLFMISILFFKLLTEFIN

SEQ ID NO: 1907303 - protein, 19 aa, Staphylococcus
YLQLFMISILFFKLLTEFV

SEQ ID NO: 1907304 - protein, 19 aa, Staphylococcus
YLRKIWVAVKFLVVYLYQL

SEQ ID NO: 1907305 - protein, 19 aa, Staphylococcus
YLRVYYPPVVIGITATITV

SEQ ID NO: 1907306 - protein, 19 aa, Staphylococcus
YLSKPVAIIFWIIAELAII

SEQ ID NO: 1907307 - protein, 17 aa, Staphylococcus
YLSVFFAPVLLPIVMWI

SEQ ID NO: 1907308 - protein, 23 aa, Staphylococcus
YLSVGLLIPIINIIIYCVFIPGH

SEQ ID NO: 1907309 - protein, 21 aa, Staphylococcus
YLTAIITVFLLLALNLMTVKA

SEQ ID NO: 1907310 - protein, 28 aa, Staphylococcus
YLTIYLLVALMYWVVCFIISIAQNFYES

SEQ ID NO: 1907311 - protein, 33 aa, Staphylococcus
YLTKFIAVSIACGFFLFMFGGVAQDFIYAIIAG

SEQ ID NO: 1907312 - protein, 33 aa, Staphylococcus
YLTKREEYLGKSGLFYLIGIVQALIVSIGDIVI

SEQ ID NO: 1907313 - protein, 24 aa, Staphylococcus
YLVEFFDWRSLFHVVAPIAAITFL

SEQ ID NO: 1907314 - protein, 21 aa, Staphylococcus
YLWVILVLVFLEGLLAADNAV

SEQ ID NO: 1907315 - protein, 21 aa, Staphylococcus
YLWVLLVLVFLEGLLAADNAV

SEQ ID NO: 1907316 - protein, 19 aa, Staphylococcus
YLYLYTFPITVIIGLFIIF

SEQ ID NO: 1907317 - protein, 20 aa, Staphylococcus
YLYTFPIIVIIGLFIIFLFI

SEQ ID NO: 1907318 - protein, 27 aa, Staphylococcus
YMAYIILAFFLFVFCLLFVNATTRNAI

SEQ ID NO: 1907319 - protein, 37 aa, Staphylococcus
YMEKLSYKKLLITVGAMILIILLVIVVPLFGKKGDTI

SEQ ID NO: 1907320 - protein, 26 aa, Staphylococcus
YMFLSLFIIITITFFLMKMMPGSPFN

SEQ ID NO: 1907321 - protein, 24 aa, Staphylococcus
YMGIPVFLAFFIYHKVRYKTKKIP

SEQ ID NO: 1907322 - protein, 23 aa, Staphylococcus
YMGIPVFLAFFIYHKVRYKTKMV

SEQ ID NO: 1907323 - protein, 25 aa, Staphylococcus
YMGIPVFLVFFIYHKLRYKTKKIPL

SEQ ID NO: 1907324 - protein, 27 aa, Staphylococcus
YMGYAILVFFIFVFGLLFVNVDTRRAI

SEQ ID NO: 1907325 - protein, 22 aa, Staphylococcus
YMGYVILLFFILVFGLLFVNET

SEQ ID NO: 1907326 - protein, 17 aa, Staphylococcus
YMHSPYFIPDKGYINAL

SEQ ID NO: 1907327 - protein, 18 aa, Staphylococcus
YMIEIEVPSKMLKHLTID

SEQ ID NO: 1907328 - protein, 34 aa, Staphylococcus
YMIIAIFILILINLLVTFPILRKFKIATPIFKPL

SEQ ID NO: 1907329 - protein, 26 aa, Staphylococcus
YMKIFAFIYLLYLAYKVLISSIGGPK

SEQ ID NO: 1907330 - protein, 17 aa, Staphylococcus
YMNYWFPNLPQWIPGVV

SEQ ID NO: 1907331 - protein, 20 aa, Staphylococcus
YMSRMIIPNLFSLIASIVVL

SEQ ID NO: 1907332 - protein, 18 aa, Staphylococcus
YNFNPTYSTDANGGEVLT

SEQ ID NO: 1907333 - protein, 28 aa, Staphylococcus
YNFTWSFYGDLLIFLPLSLWGMERFFQR

SEQ ID NO: 1907334 - protein, 44 aa, Staphylococcus
YNHAKPPVFLVRFWTLMVSFILGLALMGIFIFNNLGIVNVPENN

SEQ ID NO: 1907335 - protein, 20 aa, Staphylococcus
YNIFMFIVWIGIIAAFFFVN

SEQ ID NO: 1907336 - protein, 18 aa, Staphylococcus
YNIIVILFFFIVGSILHK

SEQ ID NO: 1907337 - protein, 20 aa, Staphylococcus
YNIVYHIYFIAFLVLIGVIN

SEQ ID NO: 1907338 - protein, 22 aa, Staphylococcus
YNKDKVWYPASMTKLMTMYLTL

SEQ ID NO: 1907339 - protein, 23 aa, Staphylococcus
YNKYQCTWWAYQRRVQLGKPVSN

SEQ ID NO: 1907340 - protein, 23 aa, Staphylococcus
YNNPFLNPALIASLGIIIVLVLF

SEQ ID NO: 1907341 - protein, 18 aa, Staphylococcus
YNNPFLNPALISSILIIA

SEQ ID NO: 1907342 - protein, 23 aa, Staphylococcus
YNNPLLNPALIGSLGIIIVLLLT

SEQ ID NO: 1907343 - protein, 27 aa, Staphylococcus
YNPDGQFILFWYAPVAILISLLSVTAS

SEQ ID NO: 1907344 - protein, 25 aa, Staphylococcus
YNRKLAYIYVDGEMLNNILVKEGLA

SEQ ID NO: 1907345 - protein, 24 aa, Staphylococcus
YNRTIILNWLFYFVLGFYIGKYYD

SEQ ID NO: 1907346 - protein, 17 aa, Staphylococcus
YNTYYQPVGAPPKKQKG

SEQ ID NO: 1907347 - protein, 33 aa, Staphylococcus
YNVPQKYFTIADKNGFGLAYYSSNLMGSNNPSM

SEQ ID NO: 1907348 - protein, 24 aa, Staphylococcus
YNWKLPFYLIAIITFLCLLGVLYF

SEQ ID NO: 1907349 - protein, 19 aa, Staphylococcus
YPALLLIVFLIMLIILNHT

SEQ ID NO: 1907350 - protein, 21 aa, Staphylococcus
YPFIAIFKMLSYFIPLLIIVI

SEQ ID NO: 1907351 - protein, 48 aa, Staphylococcus
YPIFPDQIAFIKRNHFYMICTYIPIVGLLLSFISPSVGIPLTIIACIY

SEQ ID NO: 1907352 - protein, 19 aa, Staphylococcus
YPIILIAIFITMLSILNYT

SEQ ID NO: 1907353 - protein, 27 aa, Staphylococcus
YPIPFHHQYLIRLTFVPLLFLGRYTNV

SEQ ID NO: 1907354 - protein, 21 aa, Staphylococcus
YPLFLYGFLVWVTYITNKARL

SEQ ID NO: 1907355 - protein, 20 aa, Staphylococcus
YPLKILIITGLMIGALFNAL

SEQ ID NO: 1907356 - protein, 20 aa, Staphylococcus
YPMFIYSFVVWITYSSPSYK

SEQ ID NO: 1907357 - protein, 17 aa, Staphylococcus
YPNNLGGVAGDKTVGPI

SEQ ID NO: 1907358 - protein, 17 aa, Staphylococcus
YPTIKDGEQVVANGVYD

SEQ ID NO: 1907359 - protein, 22 aa, Staphylococcus
YPVLGWTFFIAALSLAGIPPLS

SEQ ID NO: 1907360 - protein, 23 aa, Staphylococcus
YPYDFIVIIVVALIFYSIGATSY

SEQ ID NO: 1907361 - protein, 22 aa, Staphylococcus
YPYDFLVITIVALAFYKLGTTS

SEQ ID NO: 1907362 - protein, 22 aa, Staphylococcus
YPYWLDSTGWYELIRAKNKNDE

SEQ ID NO: 1907363 - protein, 17 aa, Staphylococcus
YQAPLYLFDDIYIKIHG

SEQ ID NO: 1907364 - protein, 28 aa, Staphylococcus
YQDIIRFIVRVLIPFSFIISLFLISQGT

SEQ ID NO: 1907365 - protein, 23 aa, Staphylococcus
YQGFTKIIIVLIVSPIIAFCVGF

SEQ ID NO: 1907366 - protein, 21 aa, Staphylococcus
YQLEQVLLIFLDNAIKYDIRD

SEQ ID NO: 1907367 - protein, 19 aa, Staphylococcus
YQQVYPFLSLATILSMNAI

SEQ ID NO: 1907368 - protein, 18 aa, Staphylococcus
YQYRPPLERILTNLLDNA

SEQ ID NO: 1907369 - protein, 25 aa, Staphylococcus
YRANLKTLFIPEFLGSAVIGAIAIF

SEQ ID NO: 1907370 - protein, 18 aa, Staphylococcus
YRFPSFITFIVPFISLSI

SEQ ID NO: 1907371 - protein, 17 aa, Staphylococcus
YRGIFKETLFKKTSFWL

SEQ ID NO: 1907372 - protein, 17 aa, Staphylococcus
YRGIFKETLFKRSSFWL

SEQ ID NO: 1907373 - protein, 25 aa, Staphylococcus
YRHFYYRVFAILTIIFICFNFIPFI

SEQ ID NO: 1907374 - protein, 19 aa, Staphylococcus
YRHNGILPKALLRAVGQDL

SEQ ID NO: 1907375 - protein, 28 aa, Staphylococcus
YRHYYYKIFAIITWFLLIGSLSQYFDSA

SEQ ID NO: 1907376 - protein, 21 aa, Staphylococcus
YRIVLVVIIAILYFGFGIGKG

SEQ ID NO: 1907377 - protein, 21 aa, Staphylococcus
YRKLFIIGLVLFTFGSLICAI

SEQ ID NO: 1907378 - protein, 19 aa, Staphylococcus
YRMVFSTMNVERMNSILFE

SEQ ID NO: 1907379 - protein, 25 aa, Staphylococcus
YRNVTLILWIISLVSLLAMVIISQP

SEQ ID NO: 1907380 - protein, 23 aa, Staphylococcus
YRTQLFHVLQGTKFVNGAIKAEL

SEQ ID NO: 1907381 - protein, 18 aa, Staphylococcus
YSAIILLALTFVHSYWSI

SEQ ID NO: 1907382 - protein, 24 aa, Staphylococcus
YSAVLLTSFILFSAFIISANQSEG

SEQ ID NO: 1907383 - protein, 22 aa, Staphylococcus
YSDPVNVTDLTPPILPNLETDL

SEQ ID NO: 1907384 - protein, 24 aa, Staphylococcus
YSGLGLIFIVLALKLVNLIYRLII

SEQ ID NO: 1907385 - protein, 28 aa, Staphylococcus
YSHKVLIACLLVLFILLLNLRGLTESAT

SEQ ID NO: 1907386 - protein, 18 aa, Staphylococcus
YSHLITLTNHYPFTLSSE

SEQ ID NO: 1907387 - protein, 18 aa, Staphylococcus
YSIKFIMYIFFGKHQPNA

SEQ ID NO: 1907388 - protein, 22 aa, Staphylococcus
YSIPFVIVSLNFPLFNIVDQLT

SEQ ID NO: 1907389 - protein, 31 aa, Staphylococcus
YSIPVLMFIYPLAITLILLTLISPLFNHSTT

SEQ ID NO: 1907390 - protein, 17 aa, Staphylococcus
YSKDEIFQVYLNKIYYS

SEQ ID NO: 1907391 - protein, 22 aa, Staphylococcus
YSKNQILSFYLNNIYYGNNQYD

SEQ ID NO: 1907392 - protein, 26 aa, Staphylococcus
YSLAIPLIIIVLIQVAFMVLFSIFVL

SEQ ID NO: 1907393 - protein, 25 aa, Staphylococcus
YSLALPLIAIVLVQVVFISLFAFFI

SEQ ID NO: 1907394 - protein, 26 aa, Staphylococcus
YSLALPLIIIVLVQVVFMILFSIFVL

SEQ ID NO: 1907395 - protein, 20 aa, Staphylococcus
YSLFRILFIMYFGDADGEQV

SEQ ID NO: 1907396 - protein, 50 aa, Staphylococcus
YSLIALVLSVFLFFKGKKAFWFIFVGGFLLTFLLYANVVYFRFFSDFLTF

SEQ ID NO: 1907397 - protein, 24 aa, Staphylococcus
YSLKYLWVLLLFGIIGLVIEIVGI

SEQ ID NO: 1907398 - protein, 21 aa, Staphylococcus
YSLLDFGFKSPASPGSFIVYM

SEQ ID NO: 1907399 - protein, 26 aa, Staphylococcus
YSMIETFKVTIWYTAPTALRMLMSAG

SEQ ID NO: 1907400 - protein, 18 aa, Staphylococcus
YSNFYISLLIFVCLLYFV

SEQ ID NO: 1907401 - protein, 26 aa, Staphylococcus
YSNTNPVYFTHTWTLNDGSIAPESIQ

SEQ ID NO: 1907402 - protein, 26 aa, Staphylococcus
YSQVLLMIVVFLIVGLIGALLSFIKV

SEQ ID NO: 1907403 - protein, 23 aa, Staphylococcus
YSRIMYVIIIIAVIYFVIRYFVK

SEQ ID NO: 1907404 - protein, 25 aa, Staphylococcus
YSTIIIFFLIMIFAFSLFLNGHYQP

SEQ ID NO: 1907405 - protein, 24 aa, Staphylococcus
YSTLGFGLMLYAFSSAGNLGFTNP

SEQ ID NO: 1907406 - protein, 30 aa, Staphylococcus
YSTPVLMFIYPLAITIILLTLVSPLFNHSK

SEQ ID NO: 1907407 - protein, 31 aa, Staphylococcus
YSTPVLMFTYPLAITLILLTLASPLFNHSKI

SEQ ID NO: 1907408 - protein, 17 aa, Staphylococcus
YSTRGLYIFSMAAFLIG

SEQ ID NO: 1907409 - protein, 24 aa, Staphylococcus
YSTTAPMYWLIKNEFMRMIPAKFG

SEQ ID NO: 1907410 - protein, 22 aa, Staphylococcus
YSVALFFLLMRAPDLALTQLVV

SEQ ID NO: 1907411 - protein, 18 aa, Staphylococcus
YSVMIFFVIIGFALHLFG

SEQ ID NO: 1907412 - protein, 26 aa, Staphylococcus
YSVMPYIIILIITTIFIVLLEISLKS

SEQ ID NO: 1907413 - protein, 25 aa, Staphylococcus
YSVNFGYLWDLFIKHLLMSVYGVLF

SEQ ID NO: 1907414 - protein, 22 aa, Staphylococcus
YSVPFVIVSLNFPLFNLVDQFT

SEQ ID NO: 1907415 - protein, 18 aa, Staphylococcus
YSVPLISEAEKRGLRILT

SEQ ID NO: 1907416 - protein, 17 aa, Staphylococcus
YSYRLLVTLICAGLLLS

SEQ ID NO: 1907417 - protein, 17 aa, Staphylococcus
YTAIFILILLENVLPVV

SEQ ID NO: 1907418 - protein, 19 aa, Staphylococcus
YTAKLFPFGPIFAGFLCII

SEQ ID NO: 1907419 - protein, 17 aa, Staphylococcus
YTFAITDLKDFNAAYQT

SEQ ID NO: 1907420 - protein, 17 aa, Staphylococcus
YTFIIAMLVFSITSLFV

SEQ ID NO: 1907421 - protein, 27 aa, Staphylococcus
YTFSVLFFVDLIIVLIFNKIKPSSEYD

SEQ ID NO: 1907422 - protein, 24 aa, Staphylococcus
YTGKVIWAFATYLLFNAAYSVVNI

SEQ ID NO: 1907423 - protein, 28 aa, Staphylococcus
YTIIILFIFLVIIIIRYLVFKFKPLKIA

SEQ ID NO: 1907424 - protein, 31 aa, Staphylococcus
YTIIILFVFLVIVIIRYLIFKFKPLKVIASE

SEQ ID NO: 1907425 - protein, 25 aa, Staphylococcus
YTIMPLTAFLIAKLFHLPPEVAIGV

SEQ ID NO: 1907426 - protein, 26 aa, Staphylococcus
YTISTWLLPALILCAFYFILTILISI

SEQ ID NO: 1907427 - protein, 17 aa, Staphylococcus
YTIVLSIVWTLFLIIWY

SEQ ID NO: 1907428 - protein, 26 aa, Staphylococcus
YTLNFGYLMELFFKHLLMSIYGVLFA

SEQ ID NO: 1907429 - protein, 25 aa, Staphylococcus
YTLTALVVAALLIWAFAGMPALEIK

SEQ ID NO: 1907430 - protein, 26 aa, Staphylococcus
YTLTPIFIVMIIYSLVYLIFAVISFI

SEQ ID NO: 1907431 - protein, 19 aa, Staphylococcus
YTMMVLSPLFIIYASLHSA

SEQ ID NO: 1907432 - protein, 17 aa, Staphylococcus
YTMVLIATMVLCAIFIL

SEQ ID NO: 1907433 - protein, 17 aa, Staphylococcus
YTQNNYFVIIPLTMIFG

SEQ ID NO: 1907434 - protein, 17 aa, Staphylococcus
YTSLIDILSIVFILLCI

SEQ ID NO: 1907435 - protein, 23 aa, Staphylococcus
YTTALLIIWLLLQLYVNYKVHPF

SEQ ID NO: 1907436 - protein, 41 aa, Staphylococcus
YTVIIGNIDLPIRAGFSLEAKIPLKTLKLPKNVLTKDNQVF

SEQ ID NO: 1907437 - protein, 27 aa, Staphylococcus
YTWSFYGDLLILLPLSLWGMERFFQKR

SEQ ID NO: 1907438 - protein, 35 aa, Staphylococcus
YTYASFILLSWLVVMLILLFIFYRRARVIKRPFRY

SEQ ID NO: 1907439 - protein, 29 aa, Staphylococcus
YTYASFLLLTWLVVMFILLVLAYRRAQVL

SEQ ID NO: 1907440 - protein, 19 aa, Staphylococcus
YTYLISSIIIGLTSGFIGH

SEQ ID NO: 1907441 - protein, 28 aa, Staphylococcus
YTYLLYGIFCILLLGLLILPETPITPVI

SEQ ID NO: 1907442 - protein, 26 aa, Staphylococcus
YTYTLYFIICILLIGLLVLPETPITP

SEQ ID NO: 1907443 - protein, 24 aa, Staphylococcus
YVFQPLTIIFNSSIMLLLCILSLV

SEQ ID NO: 1907444 - protein, 26 aa, Staphylococcus
YVGILTCCLVFLLVLVSNESELAKFQ

SEQ ID NO: 1907445 - protein, 22 aa, Staphylococcus
YVGNYFKPFWPLAIINVFEEFS

SEQ ID NO: 1907446 - protein, 24 aa, Staphylococcus
YVGNYFKPFWPLVIINVFEEFSST

SEQ ID NO: 1907447 - protein, 24 aa, Staphylococcus
YVGRFIFMMAMLSYWFILPQMMQH

SEQ ID NO: 1907448 - protein, 22 aa, Staphylococcus
YVGRYYLKARRYPPVLLGALIG

SEQ ID NO: 1907449 - protein, 23 aa, Staphylococcus
YVGYLIFMLIVIPVMYSFFFTVL

SEQ ID NO: 1907450 - protein, 17 aa, Staphylococcus
YVIGTLIVVLRYYNYTI

SEQ ID NO: 1907451 - protein, 19 aa, Staphylococcus
YVILINILLAIAALVMGIF

SEQ ID NO: 1907452 - protein, 20 aa, Staphylococcus
YVILPVNGKWYDHLGIERST

SEQ ID NO: 1907453 - protein, 17 aa, Staphylococcus
YVILSFAIVFVIAFLLN

SEQ ID NO: 1907454 - protein, 21 aa, Staphylococcus
YVISSVLGYLLFGLGLGMYAT

SEQ ID NO: 1907455 - protein, 20 aa, Staphylococcus
YVITDAVHIGWKGWVYIDEH

SEQ ID NO: 1907456 - protein, 17 aa, Staphylococcus
YVITLQKTNLFGVLKAQ

SEQ ID NO: 1907457 - protein, 25 aa, Staphylococcus
YVKDGYIMLNGLRLIHKDDIVLPGE

SEQ ID NO: 1907458 - protein, 24 aa, Staphylococcus
YVKKHWLFLVIVLLIVMGLESLYN

SEQ ID NO: 1907459 - protein, 19 aa, Staphylococcus
YVLFSRLHIGGKSKAFAVG

SEQ ID NO: 1907460 - protein, 26 aa, Staphylococcus
YVLGITVWIAIWWITEAIPIAATSFL

SEQ ID NO: 1907461 - protein, 18 aa, Staphylococcus
YVLLGVLPNKTAWWLVIP

SEQ ID NO: 1907462 - protein, 18 aa, Staphylococcus
YVLMILYTAWLGKSGSSL

SEQ ID NO: 1907463 - protein, 21 aa, Staphylococcus
YVLMILYTGWLSTSAKSVNGN

SEQ ID NO: 1907464 - protein, 25 aa, Staphylococcus
YVLVIYITFFIPGGSIFFLLALLSF

SEQ ID NO: 1907465 - protein, 19 aa, Staphylococcus
YVLWGILPIYWELIDHIGA

SEQ ID NO: 1907466 - protein, 20 aa, Staphylococcus
YVMMVLSPLFIIYASLQSAS

SEQ ID NO: 1907467 - protein, 21 aa, Staphylococcus
YVPDSLLCIQLIFLNIAVFFS

SEQ ID NO: 1907468 - protein, 42 aa, Staphylococcus
YVPEILTRKVITLSLFGIIFLLIGIIFKPITDPIMRKVAERA

SEQ ID NO: 1907469 - protein, 26 aa, Staphylococcus
YVPEKWILGLLGLIPIYLGLKVAIFD

SEQ ID NO: 1907470 - protein, 18 aa, Staphylococcus
YVPILIEQLFMMLMGQAD

SEQ ID NO: 1907471 - protein, 22 aa, Staphylococcus
YVPNIIFMMLFPISFITISIGN

SEQ ID NO: 1907472 - protein, 27 aa, Staphylococcus
YVSFNQSNGIIIFNANSIKPESQVTII

SEQ ID NO: 1907473 - protein, 20 aa, Staphylococcus
YVSIVLFLAGLWFNSSYFHA

SEQ ID NO: 1907474 - protein, 24 aa, Staphylococcus
YVTFLTMRTILTLKGYRYMAAAVS

SEQ ID NO: 1907475 - protein, 25 aa, Staphylococcus
YVTMIILLFFLILSYTKYVPKFFIF

SEQ ID NO: 1907476 - protein, 30 aa, Staphylococcus
YVVFIPIFIILFFYYVVRFIFRSAIKKQVL

SEQ ID NO: 1907477 - protein, 19 aa, Staphylococcus
YVVMLLYTGWLGTHSKSLN

SEQ ID NO: 1907478 - protein, 20 aa, Staphylococcus
YVVRPIIMFGWMIIFAIVIA

SEQ ID NO: 1907479 - protein, 25 aa, Staphylococcus
YVVSIIIYYIVILAILFGNFKIMKE

SEQ ID NO: 1907480 - protein, 17 aa, Staphylococcus
YVYFSWLLGLLVGMVVM

SEQ ID NO: 1907481 - protein, 19 aa, Staphylococcus
YWFGLINALFFSGTIIAGL

SEQ ID NO: 1907482 - protein, 27 aa, Staphylococcus
YWFPNLPQWIPGVVAVLLLLAANLTSV

SEQ ID NO: 1907483 - protein, 19 aa, Staphylococcus
YWGKFIVYILSFSVLSLIS

SEQ ID NO: 1907484 - protein, 28 aa, Staphylococcus
YWKLLLQSIMFIILLFIAESLDFLFLKS

SEQ ID NO: 1907485 - protein, 20 aa, Staphylococcus
YWLGDQLWYERLFDNIISNV

SEQ ID NO: 1907486 - protein, 19 aa, Staphylococcus
YWLYMYAYSMYLFFDFAGY

SEQ ID NO: 1907487 - protein, 18 aa, Staphylococcus
YWQVVWYIAIVTSSLVVI

SEQ ID NO: 1907488 - protein, 17 aa, Staphylococcus
YWQVVWYVAIVASALVV

SEQ ID NO: 1907489 - protein, 19 aa, Staphylococcus
YWQVVWYVAIVTSSLCVIA

SEQ ID NO: 1907490 - protein, 24 aa, Staphylococcus
YYDQLILMEFRFPRMLITILAGAA

SEQ ID NO: 1907491 - protein, 28 aa, Staphylococcus
YYFCLNLLLPFIIITGIFIRLIMSHPEF

SEQ ID NO: 1907492 - protein, 22 aa, Staphylococcus
YYFGFFSFGLLIATGTLAHIYV

SEQ ID NO: 1907493 - protein, 41 aa, Staphylococcus
YYFNQIQWIGFFSNLLFIPYYSLILFPLAIFTYLYIQLFTT

SEQ ID NO: 1907494 - protein, 20 aa, Staphylococcus
YYGLKFLNPQYFLVSAFIIS

SEQ ID NO: 1907495 - protein, 24 aa, Staphylococcus
YYGLNFLNPSYFLVSAFIISAITS

SEQ ID NO: 1907496 - protein, 30 aa, Staphylococcus
YYKAIRLNKVIWIFIFCFIGNVLGGIILFF

SEQ ID NO: 1907497 - protein, 21 aa, Staphylococcus
YYKTLLVITSIAFLVVLLLLT

SEQ ID NO: 1907498 - protein, 20 aa, Staphylococcus
YYLAAIVVAFLLLNLPYVHK

SEQ ID NO: 1907499 - protein, 29 aa, Staphylococcus
YYPLYPRTIILYWLFYFIVGFYVGKYYDL

SEQ ID NO: 1907500 - protein, 26 aa, Staphylococcus
YYPTIYTLQLFLYVPFALILTTAIAL

SEQ ID NO: 1907501 - protein, 25 aa, Staphylococcus
YYTDKYGHILYPNKLKHKNIKPIIL

SEQ ID NO: 1907502 - protein, 19 aa, Staphylococcus
YYVIEPIVNHIERGATTIT

SEQ ID NO: 1907503 - protein, 20 aa, Staphylococcus
YYVMMVLSPLFITYASLHSA

SEQ ID NO: 1907504 - protein, 18 aa, Staphylococcus
YYVVYLILLKLLGINYLI

SEQ ID NO: 1907505 - protein, 21 aa, Staphylococcus
YYVVYLLLLKLLNVNYLVSHI

SEQ ID NO: 1907506 - protein, 29 aa, Staphylococcus
YYYALVIGLIITIIALFSAIYFTRQNAVN

SEQ ID NO: 1907507 - protein, 17 aa, Staphylococcus
KRWLFISSTLIKQTVRS

SEQ ID NO: 1907508 - protein, 18 aa, Staphylococcus
PFTLLPILIGFSAAKRFG

SEQ ID NO: 1907509 - protein, 25 aa, Staphylococcus
HTKLVIVYVLLIIIGMQIIGLYFTN

SEQ ID NO: 1907510 - protein, 21 aa, Staphylococcus
KLILIFICIFTFLLMVIQSQF

SEQ ID NO: 1907511 - protein, 27 aa, Staphylococcus
LAAIIIVYLILVITFKGGLAPFTILFS

SEQ ID NO: 1907512 - protein, 23 aa, Staphylococcus
LIFNALIIVLLIPIAMKGVKFKG

SEQ ID NO: 1907513 - protein, 20 aa, Staphylococcus
LVIFFLLIALTTVFVGSEFA

SEQ ID NO: 1907514 - protein, 23 aa, Staphylococcus
MLNYKVWYLTLLAGLIPFIPIKF

SEQ ID NO: 1907515 - protein, 25 aa, Staphylococcus
PELYFAFLGILKIGAIVGPLFEAFM

SEQ ID NO: 1907516 - protein, 20 aa, Staphylococcus
PIAALGLLAPWIAGAAMALS

SEQ ID NO: 1907517 - protein, 22 aa, Staphylococcus
SLLILFFYLFSDGLRDAFDPKM

SEQ ID NO: 1907518 - protein, 18 aa, Staphylococcus
TGKYPFMMFGLPAAAFAI

SEQ ID NO: 1907519 - protein, 19 aa, Staphylococcus
YVFAVRLRWFPVAGWEGFS

SEQ ID NO: 1907520 - protein, 23 aa, Staphylococcus
AAIAFLILCIGIVVVLISVKKNL

SEQ ID NO: 1907521 - protein, 26 aa, Staphylococcus
AIVILIIFALLFRFIVKLIPIYYIFR

SEQ ID NO: 1907522 - protein, 24 aa, Staphylococcus
ATKRLPWLIILTFLGMITATILGS

SEQ ID NO: 1907523 - protein, 20 aa, Staphylococcus
DFYYLIIALIFLIVISVISM

SEQ ID NO: 1907524 - protein, 23 aa, Staphylococcus
DHEYTTQIAFAKPVPQPAKAQAS

SEQ ID NO: 1907525 - protein, 20 aa, Staphylococcus
FGSLLALGGSILLFGRKRKE

SEQ ID NO: 1907526 - protein, 19 aa, Staphylococcus
FILAFPMAWIWPFIQNGLN

SEQ ID NO: 1907527 - protein, 18 aa, Staphylococcus
FITVILGFFIARTITRPI

SEQ ID NO: 1907528 - protein, 18 aa, Staphylococcus
FMMFGLPAAAFAIYKNAR

SEQ ID NO: 1907529 - protein, 25 aa, Staphylococcus
FMNSNFWIYWKTMFAFEPWHSAMEM

SEQ ID NO: 1907530 - protein, 19 aa, Staphylococcus
FSSVLIIFIILLSGLTFLP

SEQ ID NO: 1907531 - protein, 18 aa, Staphylococcus
FVAPLLFFIHAVLDGLSF

SEQ ID NO: 1907532 - protein, 17 aa, Staphylococcus
FVFLILIFFLVFTAQKL

SEQ ID NO: 1907533 - protein, 17 aa, Staphylococcus
GIIAAIAFLILCIGIVV

SEQ ID NO: 1907534 - protein, 20 aa, Staphylococcus
GQIYLMMFFTDILGISAFYG

SEQ ID NO: 1907535 - protein, 27 aa, Staphylococcus
GSIWAWLLVLVFLPIIGFILYLLLGRQ

SEQ ID NO: 1907536 - protein, 22 aa, Staphylococcus
GSSLKPFLAYGPAIENMQWATN

SEQ ID NO: 1907537 - protein, 25 aa, Staphylococcus
GTIVAIIVILLFLRNIRTTAISIVS

SEQ ID NO: 1907538 - protein, 25 aa, Staphylococcus
GTPAYVYLIPVVAVVFLMLSVAILK

SEQ ID NO: 1907539 - protein, 25 aa, Staphylococcus
HATLWASLVAILGGIMFLIRPKKKH

SEQ ID NO: 1907540 - protein, 24 aa, Staphylococcus
HKYPRLFLMLIPVCLLIGVGYYYK

SEQ ID NO: 1907541 - protein, 26 aa, Staphylococcus
HTKDYIIFGILIFISVAGLIATYFIN

SEQ ID NO: 1907542 - protein, 18 aa, Staphylococcus
ILPSFYAWFNLWAMWDPY

SEQ ID NO: 1907543 - protein, 20 aa, Staphylococcus
IVTIIVFLPLAFVSGSVGEM

SEQ ID NO: 1907544 - protein, 23 aa, Staphylococcus
IWSQYLIGLLLTAGFFFTISSKF

SEQ ID NO: 1907545 - protein, 22 aa, Staphylococcus
LDLLIVWYVLYLLITVFKGTKA

SEQ ID NO: 1907546 - protein, 31 aa, Staphylococcus
LDVKLTFAAIFIFPFYILTVYFFFGRLRKLT

SEQ ID NO: 1907547 - protein, 20 aa, Staphylococcus
LFLCTLLVWLMTPGLSLFYG

SEQ ID NO: 1907548 - protein, 20 aa, Staphylococcus
LLILFFYLFSDGLRDAFDPK

SEQ ID NO: 1907549 - protein, 24 aa, Staphylococcus
MLLPCLLFFLIFNYIPMAGLVLAF

SEQ ID NO: 1907550 - protein, 20 aa, Staphylococcus
NDKRTVLFPYVEGKEIYNSI

SEQ ID NO: 1907551 - protein, 20 aa, Staphylococcus
NFFIPFLLIFIIDGFKGIKE

SEQ ID NO: 1907552 - protein, 34 aa, Staphylococcus
NGKTYFEVTLKNADWWKSFQFFTPQNKELTTTVV

SEQ ID NO: 1907553 - protein, 27 aa, Staphylococcus
NVSRTYLFSIFFILLLTLIFANFSEAL

SEQ ID NO: 1907554 - protein, 23 aa, Staphylococcus
PGAVFWMWIIAFIGAASAFIEAT

SEQ ID NO: 1907555 - protein, 23 aa, Staphylococcus
PGAVFWMWIIAFIGAASAFMEAT

SEQ ID NO: 1907556 - protein, 21 aa, Staphylococcus
PIILIIVFYFFLIRPQQKRAK

SEQ ID NO: 1907557 - protein, 20 aa, Staphylococcus
PLATFLHFNLSIAMLIALTV

SEQ ID NO: 1907558 - protein, 22 aa, Staphylococcus
PNQHFSIRKFSIGAASITLGTC

SEQ ID NO: 1907559 - protein, 20 aa, Staphylococcus
PPFFFSVLLPIVFISALIGI

SEQ ID NO: 1907560 - protein, 26 aa, Staphylococcus
QIFGIPVFLFLNLVIILLCIIVGSIL

SEQ ID NO: 1907561 - protein, 26 aa, Staphylococcus
SFCFIFLLLLFFRYILKRYFNYMLNY

SEQ ID NO: 1907562 - protein, 20 aa, Staphylococcus
SFIFLCIFSFGILSSSSAFA

SEQ ID NO: 1907563 - protein, 17 aa, Staphylococcus
SFIFLLLLLVPGSPASL

SEQ ID NO: 1907564 - protein, 20 aa, Staphylococcus
SIGIVLYEMLVGEPPFNGET

SEQ ID NO: 1907565 - protein, 32 aa, Staphylococcus
SMLTTLIPVLIIAFLFIFFLSQAQGGGGGGRM

SEQ ID NO: 1907566 - protein, 19 aa, Staphylococcus
STLWIFILAPLLGAVIAAL

SEQ ID NO: 1907567 - protein, 17 aa, Staphylococcus
TMRKMVQNLWWGAGYNI

SEQ ID NO: 1907568 - protein, 22 aa, Staphylococcus
VLLLFPGLYFYAPFLSFIGGVI

SEQ ID NO: 1907569 - protein, 17 aa, Staphylococcus
VVFILLTFGFYVFFAGH

SEQ ID NO: 1907570 - protein, 26 aa, Staphylococcus
VVIKLWLTIIFIVTTVLILLSAALIT

SEQ ID NO: 1907571 - protein, 20 aa, Staphylococcus
WDMTWIIPLILILILIAFSM

SEQ ID NO: 1907572 - protein, 19 aa, Staphylococcus
YFEAELNHAKWWKSFEFYD

SEQ ID NO: 1907573 - protein, 17 aa, Staphylococcus
YFVILMVIPMWAQHKVK

SEQ ID NO: 1907574 - protein, 18 aa, Staphylococcus
YILVFFLFGIAVTMIAGA

SEQ ID NO: 1907575 - protein, 24 aa, Staphylococcus
AAAGITVNLLDPTGIRLATTTTDI

SEQ ID NO: 1907576 - protein, 25 aa, Staphylococcus
AAGWTLLVYIIFAVLFFAAPIAFIS

SEQ ID NO: 1907577 - protein, 22 aa, Staphylococcus
AAIAFLVLCIGIVVVLISVKKN

SEQ ID NO: 1907578 - protein, 23 aa, Staphylococcus
AAIIIFPFYVFTVYFFFGRLRKL

SEQ ID NO: 1907579 - protein, 17 aa, Staphylococcus
AAKNLISQILNDSFKEI

SEQ ID NO: 1907580 - protein, 24 aa, Staphylococcus
AAKRLPWLIILTFLGMITATILGN

SEQ ID NO: 1907581 - protein, 18 aa, Staphylococcus
AEDLILKRKVAIKAISIP

SEQ ID NO: 1907582 - protein, 27 aa, Staphylococcus
AERKPSIWPFIIVGLVVIGIIVSCCFA

SEQ ID NO: 1907583 - protein, 17 aa, Staphylococcus
AFEYSMQLPEGIEYVPN

SEQ ID NO: 1907584 - protein, 20 aa, Staphylococcus
AFFFFVFILLFFSADTRAAI

SEQ ID NO: 1907585 - protein, 19 aa, Staphylococcus
AFFNNSNWRRDLPYGRSGW

SEQ ID NO: 1907586 - protein, 25 aa, Staphylococcus
AFIAAIIFVFILNVFIIQGAVVKQQ

SEQ ID NO: 1907587 - protein, 19 aa, Staphylococcus
AFIGSAVGFILNQVKKRKQ

SEQ ID NO: 1907588 - protein, 18 aa, Staphylococcus
AFILLIVLLFAGMGLTYK

SEQ ID NO: 1907589 - protein, 17 aa, Staphylococcus
AFILLVALLFTGMGLTY

SEQ ID NO: 1907590 - protein, 18 aa, Staphylococcus
AFILLVVLLFAGMGLTYK

SEQ ID NO: 1907591 - protein, 19 aa, Staphylococcus
AFLLLVILLFAGMGLTYKN

SEQ ID NO: 1907592 - protein, 18 aa, Staphylococcus
AFLLLVVLLFAGMAATYK

SEQ ID NO: 1907593 - protein, 20 aa, Staphylococcus
AFLVLIFIFDWKLSLICLIP

SEQ ID NO: 1907594 - protein, 19 aa, Staphylococcus
AFLVLVIGIVLVLVSVKKN

SEQ ID NO: 1907595 - protein, 23 aa, Staphylococcus
AFMAMFFMPIIILVLALYRKYAS

SEQ ID NO: 1907596 - protein, 21 aa, Staphylococcus
AFVLLVFVFRSILVPLKAVLG

SEQ ID NO: 1907597 - protein, 21 aa, Staphylococcus
AFYLFIPMSLMFWLSKFKIKY

SEQ ID NO: 1907598 - protein, 24 aa, Staphylococcus
AGLIFALLFFYLIVLSPLLSFKND

SEQ ID NO: 1907599 - protein, 28 aa, Staphylococcus
AGSIWAWLLVLVLIPILGFIIYLFIGRQ

SEQ ID NO: 1907600 - protein, 23 aa, Staphylococcus
AGVIILTLILLSSSIILLLKLRH

SEQ ID NO: 1907601 - protein, 22 aa, Staphylococcus
AIAFLILCIGIVVVLISVKKNL

SEQ ID NO: 1907602 - protein, 20 aa, Staphylococcus
AIAFLILCIGVVVVLMSVKK

SEQ ID NO: 1907603 - protein, 17 aa, Staphylococcus
AIAIIAVIIFFVGKTQM

SEQ ID NO: 1907604 - protein, 25 aa, Staphylococcus
AIAIVIVGFIFKPLMATFTAIALII

SEQ ID NO: 1907605 - protein, 24 aa, Staphylococcus
AIGIALFIFVIVRPPIEYIRQYLA

SEQ ID NO: 1907606 - protein, 24 aa, Staphylococcus
AIGITLFIFLIVRPPIEYLRQYLA

SEQ ID NO: 1907607 - protein, 17 aa, Staphylococcus
AIIGALLLFVKQITEIF

SEQ ID NO: 1907608 - protein, 24 aa, Staphylococcus
AIIGSTIGLLYKNKGFEKIDELKK

SEQ ID NO: 1907609 - protein, 24 aa, Staphylococcus
AIILFLIIVVVFKQPFLALIVAAS

SEQ ID NO: 1907610 - protein, 17 aa, Staphylococcus
AIILIVILISAIISTMN

SEQ ID NO: 1907611 - protein, 20 aa, Staphylococcus
AIIVVFFIILFYKELFILSF

SEQ ID NO: 1907612 - protein, 19 aa, Staphylococcus
AIIVYFIVCLLISFLALIS

SEQ ID NO: 1907613 - protein, 19 aa, Staphylococcus
AIIYNLWWFFYNITQVAGI

SEQ ID NO: 1907614 - protein, 19 aa, Staphylococcus
AIIYNLWWLFYNVAQVAGL

SEQ ID NO: 1907615 - protein, 19 aa, Staphylococcus
AIKTFLYLISKIKLIPFAI

SEQ ID NO: 1907616 - protein, 21 aa, Staphylococcus
AILPSFYAWFNLWAMWDPYGN

SEQ ID NO: 1907617 - protein, 26 aa, Staphylococcus
AILTFSIWLLWIHPGSFEDALVAAIS

SEQ ID NO: 1907618 - protein, 19 aa, Staphylococcus
AILVIFGILFLIFDTNLFK

SEQ ID NO: 1907619 - protein, 24 aa, Staphylococcus
AILYIPIFFLMFYSFNSAGNMIHF

SEQ ID NO: 1907620 - protein, 20 aa, Staphylococcus
AIMMILLPVIFFIPNLFGHN

SEQ ID NO: 1907621 - protein, 20 aa, Staphylococcus
AIPFIILILLLIPFTSIVLG

SEQ ID NO: 1907622 - protein, 22 aa, Staphylococcus
AIPFIILILLLIPFTSVILGTI

SEQ ID NO: 1907623 - protein, 23 aa, Staphylococcus
AIPFIILILLLIPFTSVILGTIS

SEQ ID NO: 1907624 - protein, 22 aa, Staphylococcus
AIPFIILILLLIPFTSVLLGTI

SEQ ID NO: 1907625 - protein, 23 aa, Staphylococcus
AIPFIILILLLIPFTSVVLGTIS

SEQ ID NO: 1907626 - protein, 20 aa, Staphylococcus
AIRMLFHPFKPYYIFKMRIP

SEQ ID NO: 1907627 - protein, 20 aa, Staphylococcus
AISLFITGLLGFFIARTITK

SEQ ID NO: 1907628 - protein, 22 aa, Staphylococcus
AITIIILITAIIFIAASTVFAF

SEQ ID NO: 1907629 - protein, 23 aa, Staphylococcus
AIVIAVIFLILFLTALSSKKKAQ

SEQ ID NO: 1907630 - protein, 25 aa, Staphylococcus
AIYTITVILFSAFISFVLTNIYYHF

SEQ ID NO: 1907631 - protein, 27 aa, Staphylococcus
AIYVFRFIWVFVWYKDFYFPKNIQYYM

SEQ ID NO: 1907632 - protein, 24 aa, Staphylococcus
AKAKQMIKLLFEKAKIEIEKAKTS

SEQ ID NO: 1907633 - protein, 20 aa, Staphylococcus
AKIKLWFLLKGLTPIFIFLI

SEQ ID NO: 1907634 - protein, 24 aa, Staphylococcus
AKKRLPWLIILTFLGMITATILGS

SEQ ID NO: 1907635 - protein, 26 aa, Staphylococcus
AKLYTLIWFIIGLLIYLLYGVKHSKK

SEQ ID NO: 1907636 - protein, 29 aa, Staphylococcus
AKPIIMFYKIFYPFIYILNGSARLILKMF

SEQ ID NO: 1907637 - protein, 23 aa, Staphylococcus
ALAFILLMIVFRSIIIPLKAVLG

SEQ ID NO: 1907638 - protein, 31 aa, Staphylococcus
ALAIYLFRFLWVFVLYPYFYLPVSPFQKMIS

SEQ ID NO: 1907639 - protein, 29 aa, Staphylococcus
ALAVYVFRFIWVYVLYPLFYLSVSPFQKL

SEQ ID NO: 1907640 - protein, 29 aa, Staphylococcus
ALAVYVFRFVWVYVLYPYFYLPVSPFERA

SEQ ID NO: 1907641 - protein, 37 aa, Staphylococcus
ALFVPYILMVLTAIALVILGFIFKPLVAGIAAAILFV

SEQ ID NO: 1907642 - protein, 32 aa, Staphylococcus
ALILPFVIMTLTAIALVVVWFVFNQLVAGIAT

SEQ ID NO: 1907643 - protein, 22 aa, Staphylococcus
ALILSVFLFFKGKKAYWFIFIG

SEQ ID NO: 1907644 - protein, 33 aa, Staphylococcus
ALLIPFIIMVLTAIALVIVWFIFNQIVAGIAAG

SEQ ID NO: 1907645 - protein, 37 aa, Staphylococcus
ALLIPFILMVLTAIALVIVWFIFNQIVAGIAAAILVV

SEQ ID NO: 1907646 - protein, 25 aa, Staphylococcus
ALLIPFILMVLTSIALVVVWFIFKP

SEQ ID NO: 1907647 - protein, 25 aa, Staphylococcus
ALLIPYILMVLTAIAIVIVGFIFKP

SEQ ID NO: 1907648 - protein, 17 aa, Staphylococcus
ALLPELLFDRARVYLKS

SEQ ID NO: 1907649 - protein, 25 aa, Staphylococcus
ALLTFLIWITLVHPGQFEDALVAAI

SEQ ID NO: 1907650 - protein, 17 aa, Staphylococcus
ALLVAITGITLLYSRKK

SEQ ID NO: 1907651 - protein, 28 aa, Staphylococcus
ALMIPFLLMVLTAIAIVVVWFVFNQLIA

SEQ ID NO: 1907652 - protein, 26 aa, Staphylococcus
ALMSNWISVILWIVAGIMLLVRKGKK

SEQ ID NO: 1907653 - protein, 22 aa, Staphylococcus
ALPWFIMFILILSAGAISDKIL

SEQ ID NO: 1907654 - protein, 19 aa, Staphylococcus
ALSIMFFLDVKLTIAAIFI

SEQ ID NO: 1907655 - protein, 22 aa, Staphylococcus
ALSIMFFLDVKLTLAAILIFPF

SEQ ID NO: 1907656 - protein, 18 aa, Staphylococcus
ALSIWVGGLLMVSLLSVD

SEQ ID NO: 1907657 - protein, 34 aa, Staphylococcus
ALVLSIFLFFKGKKAFWFIFIGGFILTFLLYANV

SEQ ID NO: 1907658 - protein, 19 aa, Staphylococcus
ALWIVSIFAIIISLVALFK

SEQ ID NO: 1907659 - protein, 24 aa, Staphylococcus
AMFIPLFFIFKYKQPMFGKLSSQP

SEQ ID NO: 1907660 - protein, 20 aa, Staphylococcus
AMFIPLFFIIKYKQPIFGKL

SEQ ID NO: 1907661 - protein, 17 aa, Staphylococcus
AMIYLGMTIFSLSIVYI

SEQ ID NO: 1907662 - protein, 19 aa, Staphylococcus
AMSFLYILFNFIYTVSYGV

SEQ ID NO: 1907663 - protein, 41 aa, Staphylococcus
ANIKARKIIPWGIAFFIIILLIIIFFLLKNFNSPEAQSELL

SEQ ID NO: 1907664 - protein, 28 aa, Staphylococcus
ANSIWAWLLVLVFLPLIGFILYLLLGRQ

SEQ ID NO: 1907665 - protein, 19 aa, Staphylococcus
APFIPLFYIIFGLKTRDES

SEQ ID NO: 1907666 - protein, 24 aa, Staphylococcus
APIMPIIIIPIISSLIVGLIFIFV

SEQ ID NO: 1907667 - protein, 24 aa, Staphylococcus
APIMPIIIIPIISSVIVGLIFIFL

SEQ ID NO: 1907668 - protein, 21 aa, Staphylococcus
APLLFVFVMIILIFNLGLSLI

SEQ ID NO: 1907669 - protein, 18 aa, Staphylococcus
APWLFFFPGVLLGGFALL

SEQ ID NO: 1907670 - protein, 32 aa, Staphylococcus
AQNNATLFGSLFAALGGLFLVGRRRKNKNNEE

SEQ ID NO: 1907671 - protein, 26 aa, Staphylococcus
ASAIVGSALGLFYKNKVYKKTDELRD

SEQ ID NO: 1907672 - protein, 19 aa, Staphylococcus
ASALTLALYLFAGNGSAQA

SEQ ID NO: 1907673 - protein, 24 aa, Staphylococcus
ASAYAFMLFILLYIPCLSTVAAIR

SEQ ID NO: 1907674 - protein, 19 aa, Staphylococcus
ASEFWILCLFSIIATLGEL

SEQ ID NO: 1907675 - protein, 34 aa, Staphylococcus
ASGQVLKTYWPVLAIGMILIGGGLLLLARTRKQH

SEQ ID NO: 1907676 - protein, 23 aa, Staphylococcus
ASKRLPWLIVLTFLGMITATILG

SEQ ID NO: 1907677 - protein, 24 aa, Staphylococcus
ASKRLPWLLILTFLGMITATILGS

SEQ ID NO: 1907678 - protein, 18 aa, Staphylococcus
ASLVVGLIFIFIIGAPIA

SEQ ID NO: 1907679 - protein, 29 aa, Staphylococcus
ASSTWAWIFVLFVLPVLGFILYLFFGRTV

SEQ ID NO: 1907680 - protein, 31 aa, Staphylococcus
ASSTWAWLFVLFVLPLIGFILYLFFGRTVSK

SEQ ID NO: 1907681 - protein, 33 aa, Staphylococcus
ASTKKKMHLTIWQFILILLSVIIITTIIAVFAT

SEQ ID NO: 1907682 - protein, 20 aa, Staphylococcus
ATDYPLTPLSAGNRILVVNP

SEQ ID NO: 1907683 - protein, 22 aa, Staphylococcus
ATHFPPRGSQRRRRRRRETATH

SEQ ID NO: 1907684 - protein, 17 aa, Staphylococcus
ATLLIILILQRFTRGFL

SEQ ID NO: 1907685 - protein, 40 aa, Staphylococcus
ATNLKLRRIVPLGIVFFILILIVVLFFLLKNFNSPDAQAK

SEQ ID NO: 1907686 - protein, 29 aa, Staphylococcus
ATSTWAWLFVLLVLPLIGFVLYLFFGRTV

SEQ ID NO: 1907687 - protein, 20 aa, Staphylococcus
ATWHWLFYINIPIALIAIVL

SEQ ID NO: 1907688 - protein, 28 aa, Staphylococcus
ATYSIVAAGFFFPCVSLNVLAAESKDVE

SEQ ID NO: 1907689 - protein, 25 aa, Staphylococcus
AVIILLWLIIYIALDNLPFGNIHDL

SEQ ID NO: 1907690 - protein, 19 aa, Staphylococcus
AVIMLFVWPFIFSAIVIFG

SEQ ID NO: 1907691 - protein, 20 aa, Staphylococcus
AVIYLFMLGFYRLPGLVAVI

SEQ ID NO: 1907692 - protein, 23 aa, Staphylococcus
AVKIYFGMWKTFITAVWNGIKYV

SEQ ID NO: 1907693 - protein, 18 aa, Staphylococcus
AVLFIFFLISFIGQILKV

SEQ ID NO: 1907694 - protein, 18 aa, Staphylococcus
AVLYIPILFLMVYSFNSA

SEQ ID NO: 1907695 - protein, 23 aa, Staphylococcus
AVMLIIQGWLTAVKIYFGMWKTF

SEQ ID NO: 1907696 - protein, 24 aa, Staphylococcus
AVVIAIIFFVLFLIALNSKKKIKQ

SEQ ID NO: 1907697 - protein, 26 aa, Staphylococcus
AVVLAMLIAIFAILKHQFSPESQADN

SEQ ID NO: 1907698 - protein, 31 aa, Staphylococcus
AVYTITVILFSAFISFILTNIYYHFNLKASN

SEQ ID NO: 1907699 - protein, 24 aa, Staphylococcus
AWALLPLLLFIALFLGVGTITGDF

SEQ ID NO: 1907700 - protein, 18 aa, Staphylococcus
AWFNLWAMWDPYGNTGHI

SEQ ID NO: 1907701 - protein, 20 aa, Staphylococcus
AWGWSILFLLIIFALNSLSV

SEQ ID NO: 1907702 - protein, 18 aa, Staphylococcus
AWILMLAVLIIIINASWN

SEQ ID NO: 1907703 - protein, 19 aa, Staphylococcus
AWLYPFLVLTIIGIIIDFM

SEQ ID NO: 1907704 - protein, 18 aa, Staphylococcus
AWMLFFFGWFIGYGPLMG

SEQ ID NO: 1907705 - protein, 18 aa, Staphylococcus
AWRYLIVTLYLAPYILFS

SEQ ID NO: 1907706 - protein, 21 aa, Staphylococcus
AYALLFFDLIVVAISLTVLPL

SEQ ID NO: 1907707 - protein, 17 aa, Staphylococcus
AYLSLIVYIILSVTKYL

SEQ ID NO: 1907708 - protein, 19 aa, Staphylococcus
AYVLLFCLLLLGVILDAMH

SEQ ID NO: 1907709 - protein, 17 aa, Staphylococcus
CCLVFLLVLVSNESELA

SEQ ID NO: 1907710 - protein, 17 aa, Staphylococcus
CDVFLLLFIMKFGFRKI

SEQ ID NO: 1907711 - protein, 22 aa, Staphylococcus
CGGCLVLLILIVIGISACTATF

SEQ ID NO: 1907712 - protein, 24 aa, Staphylococcus
CISPIWFIFLFLFYKKYKKNAEYL

SEQ ID NO: 1907713 - protein, 18 aa, Staphylococcus
CPNGQPVIIVGYYYDTVG

SEQ ID NO: 1907714 - protein, 17 aa, Staphylococcus
CTIAFIIFFIWYPLTDK

SEQ ID NO: 1907715 - protein, 17 aa, Staphylococcus
DAKKAFQAIMYAGIQYA

SEQ ID NO: 1907716 - protein, 37 aa, Staphylococcus
DATATWAWLFLLFVMPVLGFFIYIFFGRGIRKKRERG

SEQ ID NO: 1907717 - protein, 22 aa, Staphylococcus
DDFEFQMLFGFRTDLAYAIADD

SEQ ID NO: 1907718 - protein, 17 aa, Staphylococcus
DDFGKAVGFITLTGLLS

SEQ ID NO: 1907719 - protein, 24 aa, Staphylococcus
DDKNLLLSFIFGLKTKFFFEMLIE

SEQ ID NO: 1907720 - protein, 33 aa, Staphylococcus
DDPLSYVKHISRSIFGFMRYNDAYDQVRIFGAD

SEQ ID NO: 1907721 - protein, 29 aa, Staphylococcus
DENFLQTDYNWVLYVKEQIPKELMPYIDR

SEQ ID NO: 1907722 - protein, 24 aa, Staphylococcus
DFGYDQLLKLQKQLNFPIVSSNIY

SEQ ID NO: 1907723 - protein, 25 aa, Staphylococcus
DFLHSNFWIYWKTMFAFEPWHSAME

SEQ ID NO: 1907724 - protein, 23 aa, Staphylococcus
DFLLIPLFIFFQILTPIIIVFGV

SEQ ID NO: 1907725 - protein, 21 aa, Staphylococcus
DFLSQKWWFVLILVVIVCGTI

SEQ ID NO: 1907726 - protein, 18 aa, Staphylococcus
DFWTYIMLILLIGSLILL

SEQ ID NO: 1907727 - protein, 23 aa, Staphylococcus
DGKKFLFFDNYSFNVPQKSVSIY

SEQ ID NO: 1907728 - protein, 39 aa, Staphylococcus
DGKKKGGFMKIILPIIAAVLILGAIAIFAGMALNNHSNS

SEQ ID NO: 1907729 - protein, 17 aa, Staphylococcus
DGKYQVMIIIPENFSKL

SEQ ID NO: 1907730 - protein, 20 aa, Staphylococcus
DGQFILFWYAPVAILISLLS

SEQ ID NO: 1907731 - protein, 20 aa, Staphylococcus
DGRYTLRFPDGTLNDKYMYG

SEQ ID NO: 1907732 - protein, 19 aa, Staphylococcus
DIIPNILPYIVVKENARSM

SEQ ID NO: 1907733 - protein, 19 aa, Staphylococcus
DIITVLPFGNLISQIQVKG

SEQ ID NO: 1907734 - protein, 20 aa, Staphylococcus
DKGIVLKAPFILYGVNADGS

SEQ ID NO: 1907735 - protein, 24 aa, Staphylococcus
DKQAKIYFGHIDHPYIVKVTSKID

SEQ ID NO: 1907736 - protein, 23 aa, Staphylococcus
DLKKYLMEHIYNGKLYQLGGVNN

SEQ ID NO: 1907737 - protein, 21 aa, Staphylococcus
DLLIVWYVLYLLITVFKGTKA

SEQ ID NO: 1907738 - protein, 25 aa, Staphylococcus
DLLNKLIMILIYIIVAIIVIKVLNK

SEQ ID NO: 1907739 - protein, 19 aa, Staphylococcus
DLNNIVINVIQKPTARKAI

SEQ ID NO: 1907740 - protein, 18 aa, Staphylococcus
DLNSPWILILFVLVIIVN

SEQ ID NO: 1907741 - protein, 18 aa, Staphylococcus
DLRLFRISWIVLVVLMIG

SEQ ID NO: 1907742 - protein, 23 aa, Staphylococcus
DLRTYYLSFWYFITFGSFVAFGI

SEQ ID NO: 1907743 - protein, 25 aa, Staphylococcus
DLSVNGFVMMYPNGNGYSNNLDPYS

SEQ ID NO: 1907744 - protein, 21 aa, Staphylococcus
DLVIVWYVIYLLITVFKGTKA

SEQ ID NO: 1907745 - protein, 40 aa, Staphylococcus
DNKKKGGIMKILLPLIAAVLILGAIAIFGGMALNNHNNSK

SEQ ID NO: 1907746 - protein, 24 aa, Staphylococcus
DNTAPMLYGTIFAGLGTAMVFGMK

SEQ ID NO: 1907747 - protein, 17 aa, Staphylococcus
DNYFRYGGYNEYVKTES

SEQ ID NO: 1907748 - protein, 19 aa, Staphylococcus
DNYNFCIYVPFGDDWFGYF

SEQ ID NO: 1907749 - protein, 23 aa, Staphylococcus
DPFTPLIIAAIMYFILTFTLSRG

SEQ ID NO: 1907750 - protein, 21 aa, Staphylococcus
DPNNPSIVWPRYTDLASLTKS

SEQ ID NO: 1907751 - protein, 22 aa, Staphylococcus
DQRGIFSGWNYGIGIQVDPNHP

SEQ ID NO: 1907752 - protein, 23 aa, Staphylococcus
DRIKVIIEQIVKKSFKDIDLASR

SEQ ID NO: 1907753 - protein, 19 aa, Staphylococcus
DSKLPVIFWMHGGGFIAGD

SEQ ID NO: 1907754 - protein, 23 aa, Staphylococcus
DTALTLLKATFDEKVRDIESATN

SEQ ID NO: 1907755 - protein, 30 aa, Staphylococcus
DTNNAITIIILITAIIFIAVSTVFAFFLSN

SEQ ID NO: 1907756 - protein, 38 aa, Staphylococcus
DTPVEVPVKVWVYKFDFANSVYKIQIGQTFPGGTWVKK

SEQ ID NO: 1907757 - protein, 27 aa, Staphylococcus
DTVRKDFVSGFIAGAFIGSAVGFILNQ

SEQ ID NO: 1907758 - protein, 25 aa, Staphylococcus
DVLGSFFSFLTWGAVISLILAIIGG

SEQ ID NO: 1907759 - protein, 19 aa, Staphylococcus
DWHYSYFVFIAISLVVVVS

SEQ ID NO: 1907760 - protein, 18 aa, Staphylococcus
DWKMTLLTFITIPIFVLI

SEQ ID NO: 1907761 - protein, 23 aa, Staphylococcus
DWRRLFMSILIYALSQLIVILWQ

SEQ ID NO: 1907762 - protein, 41 aa, Staphylococcus
DYLDIIKSFFKEHWPKIAIIIGVILLIIILNAIFTNVNKND

SEQ ID NO: 1907763 - protein, 19 aa, Staphylococcus
EALQNIYLRVFYPPVVIGF

SEQ ID NO: 1907764 - protein, 19 aa, Staphylococcus
EAYSIRKYSIGAASILVGS

SEQ ID NO: 1907765 - protein, 37 aa, Staphylococcus
EDETNRGGLVSIVLTMLAGLGLIRRSKKDKNKDRKNN

SEQ ID NO: 1907766 - protein, 17 aa, Staphylococcus
EDKSNQQFPPRNAQRRK

SEQ ID NO: 1907767 - protein, 43 aa, Staphylococcus
EDNNKKKGGLLGKLLPIIAAILILAAIGIFGGMALTGNNDDKG

SEQ ID NO: 1907768 - protein, 23 aa, Staphylococcus
EDNRYLVMPALSDALKIVGLKTV

SEQ ID NO: 1907769 - protein, 24 aa, Staphylococcus
EDTDLRTYLYQHKKPREKVTLTII

SEQ ID NO: 1907770 - protein, 24 aa, Staphylococcus
EEAARTGNPIKLMIGFNARDRHHN

SEQ ID NO: 1907771 - protein, 24 aa, Staphylococcus
EESPIFIFILLFINALFDGFTNPI

SEQ ID NO: 1907772 - protein, 24 aa, Staphylococcus
EFRTFLAVLLICLLGISITLVIAS

SEQ ID NO: 1907773 - protein, 18 aa, Staphylococcus
EFSFLFVAPILYVIHVFL

SEQ ID NO: 1907774 - protein, 30 aa, Staphylococcus
EGDYFTVDFGKYIHPGTSRKPYRVNNIHDA

SEQ ID NO: 1907775 - protein, 23 aa, Staphylococcus
EGDYFTVDMPDYANFNGIADYTA

SEQ ID NO: 1907776 - protein, 17 aa, Staphylococcus
EGTPVYMQWIDKDGVVS

SEQ ID NO: 1907777 - protein, 34 aa, Staphylococcus
EHKSVKFRFWKFVVLQLVIILATIAITVCITLAI

SEQ ID NO: 1907778 - protein, 25 aa, Staphylococcus
EIKAIQPIGTLRQAALEEFTDVYND

SEQ ID NO: 1907779 - protein, 31 aa, Staphylococcus
EILITKLIIFGLFGLGFFLIGFIAKPFLDPI

SEQ ID NO: 1907780 - protein, 31 aa, Staphylococcus
EILITKMIILILFGLGFFILGILVKPVLDPI

SEQ ID NO: 1907781 - protein, 23 aa, Staphylococcus
EIYTPIVFILALLVMVIPPIFSL

SEQ ID NO: 1907782 - protein, 17 aa, Staphylococcus
ELKLIMLLGFLLGGIIG

SEQ ID NO: 1907783 - protein, 23 aa, Staphylococcus
ELLWFFLMFHLFFGLLLYLFSLI

SEQ ID NO: 1907784 - protein, 18 aa, Staphylococcus
ELLYISLRLSLIKVLKPY

SEQ ID NO: 1907785 - protein, 27 aa, Staphylococcus
ENRNLFWLFLILLLVLFVLLQIRIFSI

SEQ ID NO: 1907786 - protein, 35 aa, Staphylococcus
ENYKQYRYLIIILVLLVIILLIFIKPDESSTKIEE

SEQ ID NO: 1907787 - protein, 28 aa, Staphylococcus
EPHNSPIIPISLILLGAGTLYYNRKKDA

SEQ ID NO: 1907788 - protein, 24 aa, Staphylococcus
EQFYLFFPAILILLLLTIKKYRNV

SEQ ID NO: 1907789 - protein, 20 aa, Staphylococcus
EQFYLFFPFVLITLLLTIKK

SEQ ID NO: 1907790 - protein, 19 aa, Staphylococcus
ERYYTVILIIICIALILWL

SEQ ID NO: 1907791 - protein, 17 aa, Staphylococcus
ESPLRYIIAIIVVILVI

SEQ ID NO: 1907792 - protein, 17 aa, Staphylococcus
ESPLRYIIAIVIIILVV

SEQ ID NO: 1907793 - protein, 28 aa, Staphylococcus
ESSAIILLLFFIGIILLSIWTQSYLIGF

SEQ ID NO: 1907794 - protein, 25 aa, Staphylococcus
ESSAIILLMFFIGIIVLSIWTQSYL

SEQ ID NO: 1907795 - protein, 25 aa, Staphylococcus
ESSTAFLMTSLLSGIALLSRKFKKE

SEQ ID NO: 1907796 - protein, 17 aa, Staphylococcus
ETFGWYYMLLISIILIF

SEQ ID NO: 1907797 - protein, 25 aa, Staphylococcus
ETLVPVNLYVKPALKQKISYWHNNE

SEQ ID NO: 1907798 - protein, 18 aa, Staphylococcus
ETTINGQFVFRPDNADFA

SEQ ID NO: 1907799 - protein, 24 aa, Staphylococcus
EVLFALFITILIFSILPALIRTTG

SEQ ID NO: 1907800 - protein, 20 aa, Staphylococcus
EVPEYFTKGARNEFVYGFIV

SEQ ID NO: 1907801 - protein, 19 aa, Staphylococcus
EVPILYVTVWLDDQGNIIK

SEQ ID NO: 1907802 - protein, 17 aa, Staphylococcus
EVTNNVIDVYFVPSDNV

SEQ ID NO: 1907803 - protein, 24 aa, Staphylococcus
EYLGKGMFFILMGVLQTLIVTTGD

SEQ ID NO: 1907804 - protein, 17 aa, Staphylococcus
FALLLTIVIIAPNSYAS

SEQ ID NO: 1907805 - protein, 24 aa, Staphylococcus
FCFIFLLLLFFRYILKRYFNYMLN

SEQ ID NO: 1907806 - protein, 25 aa, Staphylococcus
FCIFLLFALIFYLFSLPFSAFGLAL

SEQ ID NO: 1907807 - protein, 19 aa, Staphylococcus
FCTFLAIVLLFVWPPVFNA

SEQ ID NO: 1907808 - protein, 24 aa, Staphylococcus
FEINWLWPVLFLDIVIITPVVEEL

SEQ ID NO: 1907809 - protein, 27 aa, Staphylococcus
FEKLLHPLFVLLPLPDALNATISLIVS

SEQ ID NO: 1907810 - protein, 19 aa, Staphylococcus
FEKVLYISLITVIALISIY

SEQ ID NO: 1907811 - protein, 17 aa, Staphylococcus
FEVDSLIFALFRITLDT

SEQ ID NO: 1907812 - protein, 18 aa, Staphylococcus
FFAFIFIVLLINSTTRFA

SEQ ID NO: 1907813 - protein, 17 aa, Staphylococcus
FFAFIFVILLINSSTRL

SEQ ID NO: 1907814 - protein, 18 aa, Staphylococcus
FFEAIFLSIYFYTWNRFK

SEQ ID NO: 1907815 - protein, 17 aa, Staphylococcus
FFFSAFAIPFMLKKGFK

SEQ ID NO: 1907816 - protein, 20 aa, Staphylococcus
FFHGWPWYAVWLVLLGFGGG

SEQ ID NO: 1907817 - protein, 25 aa, Staphylococcus
FFKGKKAFWFIFVGGFLLTFLLYAN

SEQ ID NO: 1907818 - protein, 26 aa, Staphylococcus
FFKGKKAYWFIFIAGFLLTFLLYANV

SEQ ID NO: 1907819 - protein, 26 aa, Staphylococcus
FFKGKKAYWFIFIGGFLLTFLLYANV

SEQ ID NO: 1907820 - protein, 18 aa, Staphylococcus
FFLVLLICAKWIAALMGD

SEQ ID NO: 1907821 - protein, 23 aa, Staphylococcus
FFQTISPYLPFTYAIDALRETVG

SEQ ID NO: 1907822 - protein, 17 aa, Staphylococcus
FFWFFQLHYSFGHILNS

SEQ ID NO: 1907823 - protein, 31 aa, Staphylococcus
FGEFRIFLLVLLIFLLLISISLVIASTYSII

SEQ ID NO: 1907824 - protein, 26 aa, Staphylococcus
FGFIVLIFAILVLRLGYLQIAQGSHY

SEQ ID NO: 1907825 - protein, 31 aa, Staphylococcus
FGGGLIGFYLFKLLIPLISIAGVIIITVLLI

SEQ ID NO: 1907826 - protein, 24 aa, Staphylococcus
FGIFWTLLLIVWYLLGIPVGPGGP

SEQ ID NO: 1907827 - protein, 17 aa, Staphylococcus
FGIIFAVLTVVFVIGIF

SEQ ID NO: 1907828 - protein, 17 aa, Staphylococcus
FGIRKFAIGIGSVALAT

SEQ ID NO: 1907829 - protein, 34 aa, Staphylococcus
FGKAVGFITLTGLLSGFWLVLAKRRKKEEEEEKL

SEQ ID NO: 1907830 - protein, 22 aa, Staphylococcus
FGLIAIMLIVCIVLVVAMMAGG

SEQ ID NO: 1907831 - protein, 18 aa, Staphylococcus
FGLIMKPLIWLMNGSARM

SEQ ID NO: 1907832 - protein, 19 aa, Staphylococcus
FGLLYLVLLFTSAYVLIRM

SEQ ID NO: 1907833 - protein, 17 aa, Staphylococcus
FGNIMKPLIWLMNGSAR

SEQ ID NO: 1907834 - protein, 19 aa, Staphylococcus
FGVASITLGSALIIGAHHE

SEQ ID NO: 1907835 - protein, 24 aa, Staphylococcus
FGVVMKPLIWLMNGSARMIIRMFG

SEQ ID NO: 1907836 - protein, 23 aa, Staphylococcus
FGYDQLLKLKKQLNFPMITSNVY

SEQ ID NO: 1907837 - protein, 17 aa, Staphylococcus
FGYLIIPFVAAFFVHEL

SEQ ID NO: 1907838 - protein, 18 aa, Staphylococcus
FHGWPWYAVWLVALGFGG

SEQ ID NO: 1907839 - protein, 18 aa, Staphylococcus
FHGWPWYAVWLVLLGFGG

SEQ ID NO: 1907840 - protein, 17 aa, Staphylococcus
FHHQYLIRLTFVPLLFL

SEQ ID NO: 1907841 - protein, 24 aa, Staphylococcus
FHIFRIFFILFLIAPAIKYFLNYT

SEQ ID NO: 1907842 - protein, 23 aa, Staphylococcus
FHIFRIFFILFLVAPIINYFLKR

SEQ ID NO: 1907843 - protein, 18 aa, Staphylococcus
FIAWIWPELPMPAAFAIA

SEQ ID NO: 1907844 - protein, 23 aa, Staphylococcus
FICLTIMLLISIALILFFKKKKW

SEQ ID NO: 1907845 - protein, 26 aa, Staphylococcus
FIDTIIYLFILIFKRQWLSTKAFSKK

SEQ ID NO: 1907846 - protein, 17 aa, Staphylococcus
FIFLFYLLISILTPLAV

SEQ ID NO: 1907847 - protein, 17 aa, Staphylococcus
FIFLIFTFVMHILFTKG

SEQ ID NO: 1907848 - protein, 23 aa, Staphylococcus
FIFPLLLLLIVLAICLMVYHTYF

SEQ ID NO: 1907849 - protein, 18 aa, Staphylococcus
FIFRCLVVVLVFFGAVIK

SEQ ID NO: 1907850 - protein, 18 aa, Staphylococcus
FIIIILFIFFFLGFIVPS

SEQ ID NO: 1907851 - protein, 18 aa, Staphylococcus
FIILTVIVLIWSSSFFKG

SEQ ID NO: 1907852 - protein, 18 aa, Staphylococcus
FILAIIILTIIVSITTAI

SEQ ID NO: 1907853 - protein, 19 aa, Staphylococcus
FILILIIIVLMLRATLNFI

SEQ ID NO: 1907854 - protein, 18 aa, Staphylococcus
FILLGILGLIWVVIWSMV

SEQ ID NO: 1907855 - protein, 17 aa, Staphylococcus
FILLLYKELFILSFDEE

SEQ ID NO: 1907856 - protein, 22 aa, Staphylococcus
FINFFIPFLLVFILDGFKGIKE

SEQ ID NO: 1907857 - protein, 19 aa, Staphylococcus
FINFLFFLLFYSLWILFIV

SEQ ID NO: 1907858 - protein, 17 aa, Staphylococcus
FIPIFIILFFYYVVRFI

SEQ ID NO: 1907859 - protein, 17 aa, Staphylococcus
FIPLFYIIFGLKTRDES

SEQ ID NO: 1907860 - protein, 24 aa, Staphylococcus
FISFFVPFLLIFMIDGFRGIKEIL

SEQ ID NO: 1907861 - protein, 18 aa, Staphylococcus
FISLYLKWWIVFGVAIVL

SEQ ID NO: 1907862 - protein, 24 aa, Staphylococcus
FISPFWFIFLYFYYKKYKNNAKDL

SEQ ID NO: 1907863 - protein, 23 aa, Staphylococcus
FISPIWFIFLFFYYKKYKSNAKA

SEQ ID NO: 1907864 - protein, 23 aa, Staphylococcus
FITIVLFCLVIIFFLKDALHDSE

SEQ ID NO: 1907865 - protein, 18 aa, Staphylococcus
FITLIIPIFFFITAIMMF

SEQ ID NO: 1907866 - protein, 17 aa, Staphylococcus
FITVILGFFIARTITRP

SEQ ID NO: 1907867 - protein, 25 aa, Staphylococcus
FIVFFIFLIRLIYLAIKGKPKKSAA

SEQ ID NO: 1907868 - protein, 30 aa, Staphylococcus
FIVNIIIMIFLLGALLLGIIWLIKDKRQTQ

SEQ ID NO: 1907869 - protein, 24 aa, Staphylococcus
FIVNIIIVFFLFSVLVMGAVLLFK

SEQ ID NO: 1907870 - protein, 17 aa, Staphylococcus
FIVVLVALILHFFLIYG

SEQ ID NO: 1907871 - protein, 25 aa, Staphylococcus
FKFMIPLFIVWLVVGSIVLFIFTAV

SEQ ID NO: 1907872 - protein, 17 aa, Staphylococcus
FKFSWIVLSILLIGYIV

SEQ ID NO: 1907873 - protein, 24 aa, Staphylococcus
FKGKKAFWFMFIGGFLLTFLLYAN

SEQ ID NO: 1907874 - protein, 24 aa, Staphylococcus
FKGKKAYWFIFIGGFLLSFLLYAN

SEQ ID NO: 1907875 - protein, 21 aa, Staphylococcus
FKPYYIFKMRIPFTPGLIPKR

SEQ ID NO: 1907876 - protein, 21 aa, Staphylococcus
FKTRWIWPILFLDIVIVTPIV

SEQ ID NO: 1907877 - protein, 21 aa, Staphylococcus
FKVYPIWMFIISTLLAITVVV

SEQ ID NO: 1907878 - protein, 19 aa, Staphylococcus
FLADYWWTIFPVGGFLVWA

SEQ ID NO: 1907879 - protein, 24 aa, Staphylococcus
FLDTIVYLFILIFKRSWLDKRVFS

SEQ ID NO: 1907880 - protein, 17 aa, Staphylococcus
FLFIIIIIFLMYTNHLF

SEQ ID NO: 1907881 - protein, 18 aa, Staphylococcus
FLFITIIIFLMYANHLFI

SEQ ID NO: 1907882 - protein, 17 aa, Staphylococcus
FLFKRLSWPYALIITAV

SEQ ID NO: 1907883 - protein, 17 aa, Staphylococcus
FLFKRLSWPYGLIIAAV

SEQ ID NO: 1907884 - protein, 18 aa, Staphylococcus
FLFKRLSWPYGLIIAAVI

SEQ ID NO: 1907885 - protein, 17 aa, Staphylococcus
FLFVFGVLSILLLEHNH

SEQ ID NO: 1907886 - protein, 19 aa, Staphylococcus
FLFVLPLTNVLFTIIMIFI

SEQ ID NO: 1907887 - protein, 18 aa, Staphylococcus
FLGIIWLIFQITFTWVGT

SEQ ID NO: 1907888 - protein, 21 aa, Staphylococcus
FLGWKYIFIFSIIVALTALFL

SEQ ID NO: 1907889 - protein, 25 aa, Staphylococcus
FLIGLMFMIIILLAAIIYFHQLTKD

SEQ ID NO: 1907890 - protein, 19 aa, Staphylococcus
FLIIIILFIIFLRFTNQPL

SEQ ID NO: 1907891 - protein, 19 aa, Staphylococcus
FLIILISVIVAIFAILMII

SEQ ID NO: 1907892 - protein, 19 aa, Staphylococcus
FLIITTVFAFFLSSRITKP

SEQ ID NO: 1907893 - protein, 20 aa, Staphylococcus
FLILVLIIFTLFTYKAPNGM

SEQ ID NO: 1907894 - protein, 24 aa, Staphylococcus
FLKYMTIFVLLNFTITCTLIIILF

SEQ ID NO: 1907895 - protein, 19 aa, Staphylococcus
FLLLFIMKFGFRKIEAIVG

SEQ ID NO: 1907896 - protein, 21 aa, Staphylococcus
FLLLFLIFTIFVGLPLLIMEF

SEQ ID NO: 1907897 - protein, 20 aa, Staphylococcus
FLMFMPVWISSIVASILLFF

SEQ ID NO: 1907898 - protein, 19 aa, Staphylococcus
FLRLYLLTLLFFSANAILN

SEQ ID NO: 1907899 - protein, 18 aa, Staphylococcus
FLSRWLLSLLISSNFFKK

SEQ ID NO: 1907900 - protein, 21 aa, Staphylococcus
FLSVLPWFIITIPIILMLSHQ

SEQ ID NO: 1907901 - protein, 19 aa, Staphylococcus
FLVLVLVIFTLFTYKAPSG

SEQ ID NO: 1907902 - protein, 17 aa, Staphylococcus
FMIFILLYVPCISTVAT

SEQ ID NO: 1907903 - protein, 18 aa, Staphylococcus
FMLDYVIFHIIQRSFFKY

SEQ ID NO: 1907904 - protein, 18 aa, Staphylococcus
FMMFGLPAAAFAIYRQAK

SEQ ID NO: 1907905 - protein, 18 aa, Staphylococcus
FNFILALVIFIGLAYYQG

SEQ ID NO: 1907906 - protein, 23 aa, Staphylococcus
FNFWLYLIIFWFVPLLTTFQIIR

SEQ ID NO: 1907907 - protein, 26 aa, Staphylococcus
FNTYLGMLVWPLLALGLFFNIVQRAK

SEQ ID NO: 1907908 - protein, 18 aa, Staphylococcus
FNYLFGMSRFLTYILVIL

SEQ ID NO: 1907909 - protein, 17 aa, Staphylococcus
FPIIILAVPFIDTLFAM

SEQ ID NO: 1907910 - protein, 18 aa, Staphylococcus
FPYVLMRPLLFIAVILGG

SEQ ID NO: 1907911 - protein, 18 aa, Staphylococcus
FRISWLVLAILLIGYLVS

SEQ ID NO: 1907912 - protein, 20 aa, Staphylococcus
FRSIPFIILLIAIVPFTKLI

SEQ ID NO: 1907913 - protein, 20 aa, Staphylococcus
FRVILIPLFILFALVNFGFG

SEQ ID NO: 1907914 - protein, 24 aa, Staphylococcus
FSAAPWLFFFPGLLLGGYALLFQM

SEQ ID NO: 1907915 - protein, 31 aa, Staphylococcus
FSEFRIFLAILITLLLLFSIILVISSTYAII

SEQ ID NO: 1907916 - protein, 31 aa, Staphylococcus
FSEFRIFLALLIILLLIISISLIIASTYAII

SEQ ID NO: 1907917 - protein, 31 aa, Staphylococcus
FSEFRLFLAVLLTLLLLISISLVIASTYAIV

SEQ ID NO: 1907918 - protein, 30 aa, Staphylococcus
FSEFRVFLAILIILLLMISMILIISSTYAL

SEQ ID NO: 1907919 - protein, 21 aa, Staphylococcus
FSIFCLLLSLIPPLFQTVNLL

SEQ ID NO: 1907920 - protein, 26 aa, Staphylococcus
FSIIFAILTVIFLVGLFFSKNKDIDY

SEQ ID NO: 1907921 - protein, 29 aa, Staphylococcus
FSIRKFKVGIFSTLIATVAFLSSPITHIA

SEQ ID NO: 1907922 - protein, 33 aa, Staphylococcus
FSIRKFNVGIFSALIATVAFLGVNPNSADAAEQ

SEQ ID NO: 1907923 - protein, 28 aa, Staphylococcus
FSIRKFSVGIFSTVIATLTFLSHPGHAA

SEQ ID NO: 1907924 - protein, 21 aa, Staphylococcus
FSIRKFTVGTFSTVIATLSFI

SEQ ID NO: 1907925 - protein, 28 aa, Staphylococcus
FSIRLLGRLLFIWFLRKMNAINENYGYF

SEQ ID NO: 1907926 - protein, 24 aa, Staphylococcus
FSISILYIVYLFINILISGINIPG

SEQ ID NO: 1907927 - protein, 18 aa, Staphylococcus
FSIVFFVLAWLFARKPSK

SEQ ID NO: 1907928 - protein, 33 aa, Staphylococcus
FSKLWEIIKRNLKWLIILPIVCLLLSVLVTAVA

SEQ ID NO: 1907929 - protein, 25 aa, Staphylococcus
FSMLFKLIFMLDYHLFHLIQNSFKT

SEQ ID NO: 1907930 - protein, 42 aa, Staphylococcus
FSSLPGWVRKGAIGMGLFAAALGPVVLGLGLVLRAVGSAAKG

SEQ ID NO: 1907931 - protein, 21 aa, Staphylococcus
FSSVLIIFIILLSGLTFLPDL

SEQ ID NO: 1907932 - protein, 24 aa, Staphylococcus
FSTILAVILLFIWPMVFSGIVAFG

SEQ ID NO: 1907933 - protein, 19 aa, Staphylococcus
FSVRLLLSLIFINLTSPVG

SEQ ID NO: 1907934 - protein, 28 aa, Staphylococcus
FTGHPPFFRLYLITWMMVLILIGGSRIS

SEQ ID NO: 1907935 - protein, 20 aa, Staphylococcus
FTIIGVLLILVGVFFVFKPQ

SEQ ID NO: 1907936 - protein, 19 aa, Staphylococcus
FTIILIAALIIWSFIYTGF

SEQ ID NO: 1907937 - protein, 26 aa, Staphylococcus
FTITCTLIIILFFKVLPNIYWDINEI

SEQ ID NO: 1907938 - protein, 30 aa, Staphylococcus
FTKGARNEFVYGFIVGAVIGSAVGLVSISK

SEQ ID NO: 1907939 - protein, 19 aa, Staphylococcus
FTLIYFIIVLYLCINPGKI

SEQ ID NO: 1907940 - protein, 38 aa, Staphylococcus
FTNYVDIYNNVRGSFSLLSWPFKELVTTDKQSVPVGIT

SEQ ID NO: 1907941 - protein, 22 aa, Staphylococcus
FTPIKLRRRVWRRLARDLKPNQ

SEQ ID NO: 1907942 - protein, 24 aa, Staphylococcus
FTPLLVAAILYFILTFVLSRVMYF

SEQ ID NO: 1907943 - protein, 22 aa, Staphylococcus
FTTIILFCLIIIFFLKDTLREG

SEQ ID NO: 1907944 - protein, 18 aa, Staphylococcus
FVAIIIYYIILYTLFLIA

SEQ ID NO: 1907945 - protein, 19 aa, Staphylococcus
FVAPLLFFIHAVLDGLSFL

SEQ ID NO: 1907946 - protein, 17 aa, Staphylococcus
FVFVFIIFIFFAHSFAT

SEQ ID NO: 1907947 - protein, 17 aa, Staphylococcus
FVHWIWPELPIGAAFAI

SEQ ID NO: 1907948 - protein, 17 aa, Staphylococcus
FVILFILIILWSITYRK

SEQ ID NO: 1907949 - protein, 17 aa, Staphylococcus
FVLLLLLPLILAYVIAI

SEQ ID NO: 1907950 - protein, 20 aa, Staphylococcus
FVLLVFVFRSILVPLKAVLG

SEQ ID NO: 1907951 - protein, 17 aa, Staphylococcus
FVPFLLMFIIDGLKGVK

SEQ ID NO: 1907952 - protein, 24 aa, Staphylococcus
FVPFYSFLIFPLSILFFVLSHFTI

SEQ ID NO: 1907953 - protein, 26 aa, Staphylococcus
FVPLYSFIYFPLTLFFFLISHIFINI

SEQ ID NO: 1907954 - protein, 17 aa, Staphylococcus
FVSLFLVIWFPASPFVI

SEQ ID NO: 1907955 - protein, 17 aa, Staphylococcus
FWAFALCLLPFSLMLVG

SEQ ID NO: 1907956 - protein, 19 aa, Staphylococcus
FWFIFAVIALILWIPQMLS

SEQ ID NO: 1907957 - protein, 17 aa, Staphylococcus
FWILIIGLIVLVAPVTG

SEQ ID NO: 1907958 - protein, 19 aa, Staphylococcus
FWVTILIVIILVGLIAWLF

SEQ ID NO: 1907959 - protein, 19 aa, Staphylococcus
FYFAYYFLLIGAGYLLIRI

SEQ ID NO: 1907960 - protein, 22 aa, Staphylococcus
FYKFKFILIMLIILLLSSMVLF

SEQ ID NO: 1907961 - protein, 22 aa, Staphylococcus
FYSLPILFLIAFNRFNFQWATV

SEQ ID NO: 1907962 - protein, 17 aa, Staphylococcus
FYVPLILSLIVIAIFIK

SEQ ID NO: 1907963 - protein, 18 aa, Staphylococcus
FYVWLIIGFIFGFAPPLQ

SEQ ID NO: 1907964 - protein, 19 aa, Staphylococcus
FYWVVMAFIIIFLGIFIFT

SEQ ID NO: 1907965 - protein, 24 aa, Staphylococcus
GAASILVGSLLFLGGGQASAAESN

SEQ ID NO: 1907966 - protein, 21 aa, Staphylococcus
GAFFMFFAFYFKKLSTRQWMF

SEQ ID NO: 1907967 - protein, 24 aa, Staphylococcus
GAFLFLFLIFTIFVGLPLLIMEFT

SEQ ID NO: 1907968 - protein, 18 aa, Staphylococcus
GAIILLFGIMYYRSIKTV

SEQ ID NO: 1907969 - protein, 23 aa, Staphylococcus
GALIFIFIGILLRSIIGLSWLYI

SEQ ID NO: 1907970 - protein, 17 aa, Staphylococcus
GALRSWIIAAWNYIKNK

SEQ ID NO: 1907971 - protein, 21 aa, Staphylococcus
GASMIIMGGGIVWYVKHRKRK

SEQ ID NO: 1907972 - protein, 23 aa, Staphylococcus
GAYLSLIVYIILSAAKFIVGYSY

SEQ ID NO: 1907973 - protein, 18 aa, Staphylococcus
GCFSIMFISFLLSWLVYW

SEQ ID NO: 1907974 - protein, 25 aa, Staphylococcus
GCGGCLVLLILLIIGLTSCTGAFVN

SEQ ID NO: 1907975 - protein, 21 aa, Staphylococcus
GCILIIYWIITFLNLKFDMAK

SEQ ID NO: 1907976 - protein, 17 aa, Staphylococcus
GDDWFAYFMRRLAERPQ

SEQ ID NO: 1907977 - protein, 18 aa, Staphylococcus
GDHPLRYILAIAIFVIIV

SEQ ID NO: 1907978 - protein, 24 aa, Staphylococcus
GDNAPALYPNYWGGTKFPVKKRLE

SEQ ID NO: 1907979 - protein, 31 aa, Staphylococcus
GDNKKTWIIIAVIAVLLIALIVAFSVLKNQF

SEQ ID NO: 1907980 - protein, 21 aa, Staphylococcus
GETFFLYLIWYSIGRFFVEGL

SEQ ID NO: 1907981 - protein, 22 aa, Staphylococcus
GFFVFFFVFLISGIALLRERTK

SEQ ID NO: 1907982 - protein, 26 aa, Staphylococcus
GFGFQLLFIFIFKMLIVALIGFGASF

SEQ ID NO: 1907983 - protein, 20 aa, Staphylococcus
GFKKDLKWELGLGATIVTAT

SEQ ID NO: 1907984 - protein, 27 aa, Staphylococcus
GFNSARLFVYDANNPSTLLYKGTPKTS

SEQ ID NO: 1907985 - protein, 20 aa, Staphylococcus
GFTSWMFYVPLILSLIVIAI

SEQ ID NO: 1907986 - protein, 41 aa, Staphylococcus
GFVDLLKNTLGFVGISSLLAGFWFILAKRRKKEEEDETVDL

SEQ ID NO: 1907987 - protein, 19 aa, Staphylococcus
GFVYFIIWIGLGSLWMKLI

SEQ ID NO: 1907988 - protein, 25 aa, Staphylococcus
GGFIIILLIIVFVLLKNFNSPDAQA

SEQ ID NO: 1907989 - protein, 19 aa, Staphylococcus
GGFKLPQYIDRKTATQSGD

SEQ ID NO: 1907990 - protein, 29 aa, Staphylococcus
GGGIIGFYLLKLFVPLISIAGIIIVTLIL

SEQ ID NO: 1907991 - protein, 29 aa, Staphylococcus
GGGLIGFYLLKIFIPLISIAGVIILTLIL

SEQ ID NO: 1907992 - protein, 24 aa, Staphylococcus
GGMIPFLLLFLLSVKFKFQPTRMI

SEQ ID NO: 1907993 - protein, 39 aa, Staphylococcus
GHFSFLSFLPLPHFMVQPWFQFILATPVQFILGWQFYKG

SEQ ID NO: 1907994 - protein, 27 aa, Staphylococcus
GHSNHENMIYWFGIPRDQTPVGQVTFS

SEQ ID NO: 1907995 - protein, 21 aa, Staphylococcus
GIALILALVIYLHHLTKEASS

SEQ ID NO: 1907996 - protein, 17 aa, Staphylococcus
GIAVFIFVIVRPPIEFL

SEQ ID NO: 1907997 - protein, 20 aa, Staphylococcus
GIDYSLFILFRYKEIRKKGT

SEQ ID NO: 1907998 - protein, 17 aa, Staphylococcus
GIIAAIAFLILCIGVVV

SEQ ID NO: 1907999 - protein, 17 aa, Staphylococcus
GIIAAIAFLVLCIGIVV

SEQ ID NO: 1908000 - protein, 26 aa, Staphylococcus
GIIAAVAFLILVIGIVVVLLSVKKNL

SEQ ID NO: 1908001 - protein, 21 aa, Staphylococcus
GIIGLYYWSAWALFIVCIMIL

SEQ ID NO: 1908002 - protein, 21 aa, Staphylococcus
GIIVIPFVLLGILVFSFHQMW

SEQ ID NO: 1908003 - protein, 22 aa, Staphylococcus
GIPIFLVIMWLIFQTTFTWIGT

SEQ ID NO: 1908004 - protein, 26 aa, Staphylococcus
GITLFLIACIVIIFGIIAIFKNKNYL

SEQ ID NO: 1908005 - protein, 17 aa, Staphylococcus
GIVLYYLFAIVVAFLLL

SEQ ID NO: 1908006 - protein, 23 aa, Staphylococcus
GKENLYRIAIQYYGSGSPANVEK

SEQ ID NO: 1908007 - protein, 17 aa, Staphylococcus
GKIWLPMIIITAAYYFV

SEQ ID NO: 1908008 - protein, 32 aa, Staphylococcus
GKKPTGLIILLSLIFIGFIAAMLYGAYYAYEH

SEQ ID NO: 1908009 - protein, 22 aa, Staphylococcus
GKKYLFFDKYNFNIPQHTVSIY

SEQ ID NO: 1908010 - protein, 17 aa, Staphylococcus
GLFGFMAMGMFGNKYLE

SEQ ID NO: 1908011 - protein, 19 aa, Staphylococcus
GLFTLWYYWKKRKPHIQKM

SEQ ID NO: 1908012 - protein, 17 aa, Staphylococcus
GLGFIIFGICMKPVMDP

SEQ ID NO: 1908013 - protein, 21 aa, Staphylococcus
GLIAFIVWVLITHNIDFALER

SEQ ID NO: 1908014 - protein, 26 aa, Staphylococcus
GLIGYYLLELFIPLISIIGVFIITVL

SEQ ID NO: 1908015 - protein, 18 aa, Staphylococcus
GLIIVLAYILMNFKYFKN

SEQ ID NO: 1908016 - protein, 18 aa, Staphylococcus
GLILLQFVLLIVSQLIYY

SEQ ID NO: 1908017 - protein, 24 aa, Staphylococcus
GLTPIFFFLIFTFVMHIFFTHGGT

SEQ ID NO: 1908018 - protein, 27 aa, Staphylococcus
GLVCALLLFIIIMVLYGQAILAIIVGG

SEQ ID NO: 1908019 - protein, 20 aa, Staphylococcus
GMLVWPLLALGFFFNIIQRG

SEQ ID NO: 1908020 - protein, 19 aa, Staphylococcus
GMSRFLTYILVILGTVFIT

SEQ ID NO: 1908021 - protein, 17 aa, Staphylococcus
GMTAFLLVLIYRTYRVT

SEQ ID NO: 1908022 - protein, 22 aa, Staphylococcus
GMTAIFLLFAFLKEIKLYQHFY

SEQ ID NO: 1908023 - protein, 18 aa, Staphylococcus
GNLYLRSTLYGYDSNFTR

SEQ ID NO: 1908024 - protein, 24 aa, Staphylococcus
GNRTVPVISDINYLTKDFAEFTTY

SEQ ID NO: 1908025 - protein, 25 aa, Staphylococcus
GNTNWDFIMVWLPLHAKLALWSVML

SEQ ID NO: 1908026 - protein, 22 aa, Staphylococcus
GPIFIIILLIIFFFLGFIVPSS

SEQ ID NO: 1908027 - protein, 21 aa, Staphylococcus
GPIFIVILLIIFFFLGFIIPS

SEQ ID NO: 1908028 - protein, 17 aa, Staphylococcus
GPIWLFVAPFLGALGSF

SEQ ID NO: 1908029 - protein, 22 aa, Staphylococcus
GPQDSYLLIRGIKTLGLRMEQV

SEQ ID NO: 1908030 - protein, 22 aa, Staphylococcus
GQLTLFFWFFKLNYSFGHIINA

SEQ ID NO: 1908031 - protein, 22 aa, Staphylococcus
GQLTLFFWFFKLNYSFGHIINS

SEQ ID NO: 1908032 - protein, 24 aa, Staphylococcus
GQTMLILIIFFSILFYAGIWVKQL

SEQ ID NO: 1908033 - protein, 17 aa, Staphylococcus
GQWFLYAAPWSVLMSIA

SEQ ID NO: 1908034 - protein, 17 aa, Staphylococcus
GRNVNHLVFANTSYEIL

SEQ ID NO: 1908035 - protein, 18 aa, Staphylococcus
GSFKYNPFVLNQVKQLGS

SEQ ID NO: 1908036 - protein, 25 aa, Staphylococcus
GSGAPLPKFWQTADGIKPSVANYFR

SEQ ID NO: 1908037 - protein, 27 aa, Staphylococcus
GSIWAWLFVLAFLPILGFIIYLLFGRQ

SEQ ID NO: 1908038 - protein, 23 aa, Staphylococcus
GSMCMIFVAVMVYWFINRQKEKE

SEQ ID NO: 1908039 - protein, 22 aa, Staphylococcus
GSNYFRFEYFNPTNSSKYYKNL

SEQ ID NO: 1908040 - protein, 27 aa, Staphylococcus
GSSITLNQILPLLTARTSIPSLRNDIS

SEQ ID NO: 1908041 - protein, 19 aa, Staphylococcus
GSSLKPFLAYGPAIENMHW

SEQ ID NO: 1908042 - protein, 21 aa, Staphylococcus
GSSLKPFLSYGPAIENMQWAT

SEQ ID NO: 1908043 - protein, 20 aa, Staphylococcus
GSVQIIVALIGLAGTLVGAA

SEQ ID NO: 1908044 - protein, 21 aa, Staphylococcus
GSWRWIFWMNIPFIVVGLVGC

SEQ ID NO: 1908045 - protein, 22 aa, Staphylococcus
GSYFLFVIIIVFLMYANQLFVK

SEQ ID NO: 1908046 - protein, 23 aa, Staphylococcus
GTASILLGSTLIFGINHDAEAAE

SEQ ID NO: 1908047 - protein, 25 aa, Staphylococcus
GTIVAIIVILLFLRNIKTTAISIVS

SEQ ID NO: 1908048 - protein, 25 aa, Staphylococcus
GTIVAIIVILLFLRNIRTTAISVVS

SEQ ID NO: 1908049 - protein, 25 aa, Staphylococcus
GTIVAIVVILLFLRNIRTTAISIVS

SEQ ID NO: 1908050 - protein, 25 aa, Staphylococcus
GTMVAIIVILLFLRNIRTTAISIVS

SEQ ID NO: 1908051 - protein, 24 aa, Staphylococcus
GTPHWLLLLFYIIGALPIITGMSL

SEQ ID NO: 1908052 - protein, 27 aa, Staphylococcus
GTVLLIIAIILILFAIVAVFKNKNYFK

SEQ ID NO: 1908053 - protein, 19 aa, Staphylococcus
GVEPIARFVGFKAVGVDPK

SEQ ID NO: 1908054 - protein, 22 aa, Staphylococcus
GVGFFIHWIWPELPTGAAFAIA

SEQ ID NO: 1908055 - protein, 22 aa, Staphylococcus
GVGLFVHWIWPELPIGAAFALA

SEQ ID NO: 1908056 - protein, 24 aa, Staphylococcus
GVGLTLLYTLLFLIGLTLGKGTLS

SEQ ID NO: 1908057 - protein, 21 aa, Staphylococcus
GVIFAILTVIFIVGTFLVKTK

SEQ ID NO: 1908058 - protein, 24 aa, Staphylococcus
GVIGLMIFAFIFTIGYILSNIDPE

SEQ ID NO: 1908059 - protein, 19 aa, Staphylococcus
GVIYKAQLVLTPYGAKQYI

SEQ ID NO: 1908060 - protein, 20 aa, Staphylococcus
GVLAFFFVINVILAFVIVFL

SEQ ID NO: 1908061 - protein, 19 aa, Staphylococcus
GVLLWVLGIHPYFAFFPIV

SEQ ID NO: 1908062 - protein, 24 aa, Staphylococcus
GVVWTLFVIAWYLLGIPLGPGGLV

SEQ ID NO: 1908063 - protein, 25 aa, Staphylococcus
GVWAIIVYFIICLLISFLALISMNI

SEQ ID NO: 1908064 - protein, 18 aa, Staphylococcus
GWLLFFGIVFFSGSLYIL

SEQ ID NO: 1908065 - protein, 25 aa, Staphylococcus
GWSSLWVWPLLLLSLLLIVNFVLSN

SEQ ID NO: 1908066 - protein, 19 aa, Staphylococcus
GYTPVLKLKKSALTPELLA

SEQ ID NO: 1908067 - protein, 31 aa, Staphylococcus
HAKPPVFLVRFWTLMVSFILGLALMGIFIFN

SEQ ID NO: 1908068 - protein, 25 aa, Staphylococcus
HAQAPVYIVKFWTILISLVLGMVVM

SEQ ID NO: 1908069 - protein, 27 aa, Staphylococcus
HASNKGAPYLLPSTPYNTLHASDVKGI

SEQ ID NO: 1908070 - protein, 17 aa, Staphylococcus
HAYITPTRPIPEGNVTA

SEQ ID NO: 1908071 - protein, 23 aa, Staphylococcus
HDVSWGEWFLFAAPWSILMSIAL

SEQ ID NO: 1908072 - protein, 26 aa, Staphylococcus
HFLITPWLLLIPLIVIALVVLKVPAI

SEQ ID NO: 1908073 - protein, 23 aa, Staphylococcus
HFSWYYLLLVLLILIVSVYLLFS

SEQ ID NO: 1908074 - protein, 32 aa, Staphylococcus
HGAAHGYPFYNTPTVHINSFWDFARGSNEYDR

SEQ ID NO: 1908075 - protein, 26 aa, Staphylococcus
HGIITPREPLPLGKIYARATDGAETP

SEQ ID NO: 1908076 - protein, 26 aa, Staphylococcus
HHNSLLETIWFIIPVIIVIALAIPTV

SEQ ID NO: 1908077 - protein, 23 aa, Staphylococcus
HIFRIFFILFIVAPIISYLLKLS

SEQ ID NO: 1908078 - protein, 23 aa, Staphylococcus
HIFRIFFILFLIAPLINYFLKYR

SEQ ID NO: 1908079 - protein, 20 aa, Staphylococcus
HIFYLPFWQTGLGGSLEVGG

SEQ ID NO: 1908080 - protein, 23 aa, Staphylococcus
HKEKYFLIIFMSNAIFGVLQDWV

SEQ ID NO: 1908081 - protein, 28 aa, Staphylococcus
HKMYFIMGALFIFLMIFYVMNSNQSEDK

SEQ ID NO: 1908082 - protein, 19 aa, Staphylococcus
HKRWLFISSTLIKQTVRSS

SEQ ID NO: 1908083 - protein, 20 aa, Staphylococcus
HKWLSIIIWLVVLGVVIAPL

SEQ ID NO: 1908084 - protein, 18 aa, Staphylococcus
HLIPIRYIFRVLSILIFV

SEQ ID NO: 1908085 - protein, 22 aa, Staphylococcus
HLNWHWVYFTLTVLYLCLIFVI

SEQ ID NO: 1908086 - protein, 17 aa, Staphylococcus
HLTPFLYIILKNALMTI

SEQ ID NO: 1908087 - protein, 31 aa, Staphylococcus
HMNLPHILMNPWFQFLLATPIQFMIGWQFYV

SEQ ID NO: 1908088 - protein, 46 aa, Staphylococcus
HNGKKKRGLAGILLPLIALLLILAALAIFIGMYLNNDKKDSNQADN

SEQ ID NO: 1908089 - protein, 18 aa, Staphylococcus
HNHIFLNNQILYHVIDNL

SEQ ID NO: 1908090 - protein, 22 aa, Staphylococcus
HPDTLDHLKLQKLINKIDDAQN

SEQ ID NO: 1908091 - protein, 20 aa, Staphylococcus
HPILTLLGTILIIVAIAIVI

SEQ ID NO: 1908092 - protein, 22 aa, Staphylococcus
HQPLSIWFYLKSIIILVVYEFG

SEQ ID NO: 1908093 - protein, 23 aa, Staphylococcus
HREGWMIFIGWLSYFFLGFYMGY

SEQ ID NO: 1908094 - protein, 18 aa, Staphylococcus
HSNLLINIFLISAFILNL

SEQ ID NO: 1908095 - protein, 31 aa, Staphylococcus
HSRPPKPKFPWFRIIIIALIAGIIGALIVLE

SEQ ID NO: 1908096 - protein, 17 aa, Staphylococcus
HSWAQGMNFEWGDNLGT

SEQ ID NO: 1908097 - protein, 17 aa, Staphylococcus
HSYISWIIVICISLIIV

SEQ ID NO: 1908098 - protein, 26 aa, Staphylococcus
HTKLVIVYVLLIIIGMQIIGLYFTNS

SEQ ID NO: 1908099 - protein, 24 aa, Staphylococcus
HYGYFICLFVMLIISIILIIFFKR

SEQ ID NO: 1908100 - protein, 19 aa, Staphylococcus
HYLFYKFIAAAVISVSFLY

SEQ ID NO: 1908101 - protein, 21 aa, Staphylococcus
IAFTLIWFLLGIPVGPGGPIK

SEQ ID NO: 1908102 - protein, 25 aa, Staphylococcus
IAFYYVILFCLFLLATLVVLPPGYL

SEQ ID NO: 1908103 - protein, 23 aa, Staphylococcus
IAIFIIFFISGTLSWFMHDKEKY

SEQ ID NO: 1908104 - protein, 19 aa, Staphylococcus
IAIFKNKNYLKMLAMAIII

SEQ ID NO: 1908105 - protein, 30 aa, Staphylococcus
IAIIILVAILILFSFVPVGLWISAIAAGVK

SEQ ID NO: 1908106 - protein, 22 aa, Staphylococcus
IAKALVEKLLNQALAQINQDKT

SEQ ID NO: 1908107 - protein, 32 aa, Staphylococcus
IAKNKWLSVIAWIILLLMIVVPLMLSAPKFDS

SEQ ID NO: 1908108 - protein, 29 aa, Staphylococcus
IALAIYVFRFVWVYLLFKDFYYPNNVQSY

SEQ ID NO: 1908109 - protein, 30 aa, Staphylococcus
IALAVYVFRFIWVYVLYPYFYLSVSPFQKM

SEQ ID NO: 1908110 - protein, 17 aa, Staphylococcus
IALFASWLLIPQKLSRY

SEQ ID NO: 1908111 - protein, 24 aa, Staphylococcus
IALLIFTIIYFLIVLYLCLNPNKM

SEQ ID NO: 1908112 - protein, 20 aa, Staphylococcus
IALWIISLVAIILSLVALFK

SEQ ID NO: 1908113 - protein, 22 aa, Staphylococcus
IATFFLMDIVSYLLLNDPHMNQ

SEQ ID NO: 1908114 - protein, 23 aa, Staphylococcus
IATNWISLILWLIAGIMLLVRKP

SEQ ID NO: 1908115 - protein, 22 aa, Staphylococcus
IATWHWLFFINIPIALIAIILV

SEQ ID NO: 1908116 - protein, 19 aa, Staphylococcus
IAVIAILIIIYIALKYAPF

SEQ ID NO: 1908117 - protein, 31 aa, Staphylococcus
IAVIIVIALLVLFSFVPVGLWISAIAAGVKV

SEQ ID NO: 1908118 - protein, 33 aa, Staphylococcus
IAVIIVVALLILFSFVPIGLWISAIAAGVHVGI

SEQ ID NO: 1908119 - protein, 21 aa, Staphylococcus
IAVILLWIGLIIFALYQNKKL

SEQ ID NO: 1908120 - protein, 23 aa, Staphylococcus
IAVSTVFAFFLSNRITKPLRQLR

SEQ ID NO: 1908121 - protein, 22 aa, Staphylococcus
IAVVIGVLLICGIGGAAAYYFT

SEQ ID NO: 1908122 - protein, 32 aa, Staphylococcus
IAVVIIVALLILFSFVPVGLWISALAAGVHVG

SEQ ID NO: 1908123 - protein, 18 aa, Staphylococcus
ICAFYYFRYLKLKQAPLM

SEQ ID NO: 1908124 - protein, 18 aa, Staphylococcus
ICAFYYFRYLKLSSTPLL

SEQ ID NO: 1908125 - protein, 27 aa, Staphylococcus
ICLITISLMLFLFKKKVAIASLSILIA

SEQ ID NO: 1908126 - protein, 17 aa, Staphylococcus
ICSLPFLSPLLGPGGVI

SEQ ID NO: 1908127 - protein, 22 aa, Staphylococcus
IDATWLLLLAVFIIIINASWNT

SEQ ID NO: 1908128 - protein, 17 aa, Staphylococcus
IDTFIYLFILIFKNNWL

SEQ ID NO: 1908129 - protein, 24 aa, Staphylococcus
IDTIIYLIILIFKRNWLDTRAFSK

SEQ ID NO: 1908130 - protein, 23 aa, Staphylococcus
IDYALFILFRYRQVMKTETDYIK

SEQ ID NO: 1908131 - protein, 18 aa, Staphylococcus
IEDKSNQQFPPRNAQRRK

SEQ ID NO: 1908132 - protein, 25 aa, Staphylococcus
IEFIIKWKIYLIIGLVVLAMVVLSL

SEQ ID NO: 1908133 - protein, 18 aa, Staphylococcus
IELFIFTFFNASFYQIPI

SEQ ID NO: 1908134 - protein, 22 aa, Staphylococcus
IELPMLIMMAIFSFVIFDSVEH

SEQ ID NO: 1908135 - protein, 21 aa, Staphylococcus
IENVNQFDVTFTKKPSALTHI

SEQ ID NO: 1908136 - protein, 24 aa, Staphylococcus
IEPGTIKNITYTVSLPTSEPIKKD

SEQ ID NO: 1908137 - protein, 19 aa, Staphylococcus
IETIWFVVPIIIVIALAIP

SEQ ID NO: 1908138 - protein, 18 aa, Staphylococcus
IETIWFVVPIIIVIALSI

SEQ ID NO: 1908139 - protein, 18 aa, Staphylococcus
IETIWFVVPILIVIALAI

SEQ ID NO: 1908140 - protein, 19 aa, Staphylococcus
IEYFTLLFLFCIVVIMISG

SEQ ID NO: 1908141 - protein, 18 aa, Staphylococcus
IEYLPLFKQFGIASIDVL

SEQ ID NO: 1908142 - protein, 18 aa, Staphylococcus
IFAFILLKTNIGITVIGG

SEQ ID NO: 1908143 - protein, 18 aa, Staphylococcus
IFAFLLLKTNVGITVIGG

SEQ ID NO: 1908144 - protein, 17 aa, Staphylococcus
IFALIIPFVYRFYKRIH

SEQ ID NO: 1908145 - protein, 19 aa, Staphylococcus
IFALIIPILYRFFKRIHIG

SEQ ID NO: 1908146 - protein, 19 aa, Staphylococcus
IFAVLFRFIVHLIPIRYIF

SEQ ID NO: 1908147 - protein, 27 aa, Staphylococcus
IFFIIVLVILIILMIIFGRKWSEYLQT

SEQ ID NO: 1908148 - protein, 26 aa, Staphylococcus
IFGIPVFLFLNIIVILLCIIVGSVLA

SEQ ID NO: 1908149 - protein, 27 aa, Staphylococcus
IFGIPVLLFLNLMVILLCIIVGSVLAY

SEQ ID NO: 1908150 - protein, 25 aa, Staphylococcus
IFGIVFAILTVIFIVGIFLAKTKDV

SEQ ID NO: 1908151 - protein, 19 aa, Staphylococcus
IFGLVFGLLFYWSNNIWLT

SEQ ID NO: 1908152 - protein, 27 aa, Staphylococcus
IFIILLIAIGIMFFLRSNKRTLISNAE

SEQ ID NO: 1908153 - protein, 17 aa, Staphylococcus
IFIILLSGLTFLPDLML

SEQ ID NO: 1908154 - protein, 18 aa, Staphylococcus
IFIVMIIYSLVYLIFAVI

SEQ ID NO: 1908155 - protein, 24 aa, Staphylococcus
IFLLQFVLLLIAQLNFHFTKGVLA

SEQ ID NO: 1908156 - protein, 32 aa, Staphylococcus
IFLRSRIYWILWLLFLHFIFLGIAYLDYDISV

SEQ ID NO: 1908157 - protein, 27 aa, Staphylococcus
IFMGIFYALVMLAIFLPGYKAMPGNVD

SEQ ID NO: 1908158 - protein, 18 aa, Staphylococcus
IFPILIGIIIWLLTPIRP

SEQ ID NO: 1908159 - protein, 18 aa, Staphylococcus
IFPVYILTVYFFFGRLRN

SEQ ID NO: 1908160 - protein, 17 aa, Staphylococcus
IFPWDFKILIGIGLLFC

SEQ ID NO: 1908161 - protein, 19 aa, Staphylococcus
IFSIFTIIAFIVVTCLTIY

SEQ ID NO: 1908162 - protein, 24 aa, Staphylococcus
IFTVVFAVLTLIFIVGIFLAKAKT

SEQ ID NO: 1908163 - protein, 17 aa, Staphylococcus
IFVFIFSFPFFPLPLTP

SEQ ID NO: 1908164 - protein, 27 aa, Staphylococcus
IFVGIYFFLFRFLILKFDIPLPGRKKG

SEQ ID NO: 1908165 - protein, 22 aa, Staphylococcus
IFVSWIWFIFLALVGKSVGTID

SEQ ID NO: 1908166 - protein, 26 aa, Staphylococcus
IFWLLLIVFLILFILLQVRIFTIKED

SEQ ID NO: 1908167 - protein, 18 aa, Staphylococcus
IFYWFFFVLIINYTAAYA

SEQ ID NO: 1908168 - protein, 23 aa, Staphylococcus
IGAGLAALGGLSIFGRRRKKNSE

SEQ ID NO: 1908169 - protein, 22 aa, Staphylococcus
IGFYLLAIFEPLVSIIGVILIT

SEQ ID NO: 1908170 - protein, 18 aa, Staphylococcus
IGGIIIITFILWVLAVLL

SEQ ID NO: 1908171 - protein, 18 aa, Staphylococcus
IGIALFIFAVVRPPIEYA

SEQ ID NO: 1908172 - protein, 24 aa, Staphylococcus
IGIALFIFLIMRPPIEYLRQYLAQ

SEQ ID NO: 1908173 - protein, 23 aa, Staphylococcus
IGIALFIFLIVRPPIEFIRQYLA

SEQ ID NO: 1908174 - protein, 23 aa, Staphylococcus
IGIALFIFLIVRPPIEYLRQYLA

SEQ ID NO: 1908175 - protein, 30 aa, Staphylococcus; identical to SEQ ID NO: 1599666

SEQ ID NO: 1908176 - protein, 17 aa, Staphylococcus
IGIVLYEMLVGEPPFNG

SEQ ID NO: 1908177 - protein, 18 aa, Staphylococcus
IGIVLYEMLVGEPPFNGE

SEQ ID NO: 1908178 - protein, 18 aa, Staphylococcus
IGIYLAIILIVTTLYLSF

SEQ ID NO: 1908179 - protein, 17 aa, Staphylococcus
IGKLFVIFLIRTIITLP

SEQ ID NO: 1908180 - protein, 17 aa, Staphylococcus
IGKLFVIFLLRTIIVLP

SEQ ID NO: 1908181 - protein, 25 aa, Staphylococcus
IGLAIIILIIFAFAFRFIVKLIPVR

SEQ ID NO: 1908182 - protein, 25 aa, Staphylococcus
IGLFGLLILLVIVGIIFFSMISDQI

SEQ ID NO: 1908183 - protein, 18 aa, Staphylococcus
IGMFFVSYFPTQRLTSRK

SEQ ID NO: 1908184 - protein, 26 aa, Staphylococcus
IGMPIFLWIMWLIFQITFTWIGTPLS

SEQ ID NO: 1908185 - protein, 23 aa, Staphylococcus
IGPMIHYFSWLGLFIILILYMIG

SEQ ID NO: 1908186 - protein, 24 aa, Staphylococcus
IGSYFLFIIIIVFILYANLLFLKR

SEQ ID NO: 1908187 - protein, 24 aa, Staphylococcus
IGTALFWTILAILFIAGPYIPNAL

SEQ ID NO: 1908188 - protein, 24 aa, Staphylococcus
IGVGLFIHWIWPTLPIGAAFAVAA

SEQ ID NO: 1908189 - protein, 29 aa, Staphylococcus
IGVLLLICFLIYLFYSPRLKFDVLENPNK

SEQ ID NO: 1908190 - protein, 29 aa, Staphylococcus
IGVLLLITFLIYLFYSPRLKFDVLENPNK

SEQ ID NO: 1908191 - protein, 19 aa, Staphylococcus
IHVQWKLLGYFLIIMAVFI

SEQ ID NO: 1908192 - protein, 23 aa, Staphylococcus
IIALSIMFFLDIKLTLAAIIIFP

SEQ ID NO: 1908193 - protein, 23 aa, Staphylococcus
IIALTIMFFLDVKLTFAAIFIFP

SEQ ID NO: 1908194 - protein, 20 aa, Staphylococcus
IIAWLLILGVIVTPLLISAP

SEQ ID NO: 1908195 - protein, 18 aa, Staphylococcus
IIFIFFIVYIFISYFYSP

SEQ ID NO: 1908196 - protein, 26 aa, Staphylococcus
IIFIILIIVGVLFYMRSNKSQMIEKA

SEQ ID NO: 1908197 - protein, 17 aa, Staphylococcus
IIFILLSLVIRFILYKT

SEQ ID NO: 1908198 - protein, 17 aa, Staphylococcus
IIFKPNLVFIITDMSLI

SEQ ID NO: 1908199 - protein, 18 aa, Staphylococcus
IIFTIVILLVTFWLHYIV

SEQ ID NO: 1908200 - protein, 20 aa, Staphylococcus
IIFVMFIQIFLLRSAIVHTN

SEQ ID NO: 1908201 - protein, 18 aa, Staphylococcus
IIGLIGLLIILVAAGFIF

SEQ ID NO: 1908202 - protein, 24 aa, Staphylococcus
IIGVAIILLLVIAAFIVKQTTGSG

SEQ ID NO: 1908203 - protein, 26 aa, Staphylococcus
IIHFASWRWIFFINIFIVIIAIPLMN

SEQ ID NO: 1908204 - protein, 27 aa, Staphylococcus
IIHFATWQWIFFINIFVTIIAVPIMIK

SEQ ID NO: 1908205 - protein, 18 aa, Staphylococcus
IIIAMFWIHLNTALIMLV

SEQ ID NO: 1908206 - protein, 20 aa, Staphylococcus
IIICIALILWLGIKEKNRHT

SEQ ID NO: 1908207 - protein, 19 aa, Staphylococcus
IIIFALWILFHRHSFRQSW

SEQ ID NO: 1908208 - protein, 23 aa, Staphylococcus
IIIFFLIFGWFIKKATLALKELE

SEQ ID NO: 1908209 - protein, 18 aa, Staphylococcus
IIIGMQIIGLYFTNSLEK

SEQ ID NO: 1908210 - protein, 21 aa, Staphylococcus
IIIIILIAVGIMFYLRSNKRK

SEQ ID NO: 1908211 - protein, 20 aa, Staphylococcus
IIIIIVLIIAFFLNQQYLKS

SEQ ID NO: 1908212 - protein, 24 aa, Staphylococcus
IIIILIISLILAIVFFFGLKSYQG

SEQ ID NO: 1908213 - protein, 23 aa, Staphylococcus
IIIIVLIIVGIMFYLRSNKRKIV

SEQ ID NO: 1908214 - protein, 26 aa, Staphylococcus
IIISGILFLAFVLMPASWFTGLVTNK

SEQ ID NO: 1908215 - protein, 17 aa, Staphylococcus
IIITLKNNQSLTSLGYS

SEQ ID NO: 1908216 - protein, 18 aa, Staphylococcus
IIIVILILAFILNQRYMQ

SEQ ID NO: 1908217 - protein, 23 aa, Staphylococcus
IIKMIAFILVFPGLLTLWLAVFS

SEQ ID NO: 1908218 - protein, 21 aa, Staphylococcus
IILFFIIFGFFLKKVTYAFKE

SEQ ID NO: 1908219 - protein, 17 aa, Staphylococcus
IILLCLIIYAGAAQFII

SEQ ID NO: 1908220 - protein, 17 aa, Staphylococcus
IILLCLLVYAGAAQFII

SEQ ID NO: 1908221 - protein, 20 aa, Staphylococcus
IILLFLIYLLILQLNNALTL

SEQ ID NO: 1908222 - protein, 27 aa, Staphylococcus
IILLLAFLILMIFSIYKLVKIKKMNEK

SEQ ID NO: 1908223 - protein, 18 aa, Staphylococcus
IILVVAGTGLIYIRTRKK

SEQ ID NO: 1908224 - protein, 25 aa, Staphylococcus
IIMLILLIFIAILLFIIRLSLSLLW

SEQ ID NO: 1908225 - protein, 19 aa, Staphylococcus
IIPILFFIVAIMMFARKDR

SEQ ID NO: 1908226 - protein, 24 aa, Staphylococcus
IISGLYMLILFFKKLRKFKVNKAM

SEQ ID NO: 1908227 - protein, 24 aa, Staphylococcus
IISKVHIVIPALKYDHEYTTHIEL

SEQ ID NO: 1908228 - protein, 18 aa, Staphylococcus
IISTLFLILGIVSSMVSL

SEQ ID NO: 1908229 - protein, 18 aa, Staphylococcus
IITFILVLLVFWGLSFDA

SEQ ID NO: 1908230 - protein, 25 aa, Staphylococcus
IITGWNRYWIFQRYDLKYLDDPKGS

SEQ ID NO: 1908231 - protein, 18 aa, Staphylococcus
IITIVVLVLIGIGGFYYY

SEQ ID NO: 1908232 - protein, 20 aa, Staphylococcus
IITTLITFTTILLFCLIIIF

SEQ ID NO: 1908233 - protein, 17 aa, Staphylococcus
IITVIVFIVVALVTALL

SEQ ID NO: 1908234 - protein, 17 aa, Staphylococcus
IITVLPFGNLISQIKVK

SEQ ID NO: 1908235 - protein, 27 aa, Staphylococcus
IIVAFFVVPFLIAWILDLVLRKVIHLY

SEQ ID NO: 1908236 - protein, 18 aa, Staphylococcus
IIVFIIEALLYWKDRRKA

SEQ ID NO: 1908237 - protein, 19 aa, Staphylococcus
IIVGIILATLYFLYVWKND

SEQ ID NO: 1908238 - protein, 21 aa, Staphylococcus
IIVIILIAVGIMFYLRSNKRQ

SEQ ID NO: 1908239 - protein, 29 aa, Staphylococcus
IIVTLVTFLILLALLKKFAWGPLKDVMDK

SEQ ID NO: 1908240 - protein, 25 aa, Staphylococcus
IIVVIIALIALFLILKSQFSPEKQA

SEQ ID NO: 1908241 - protein, 18 aa, Staphylococcus
IIYLFMLGFYRLPGLVAI

SEQ ID NO: 1908242 - protein, 18 aa, Staphylococcus
IIYNLWWFAYNVAQVAGV

SEQ ID NO: 1908243 - protein, 24 aa, Staphylococcus
IIYYIILYLMFLFAELVLLPADFL

SEQ ID NO: 1908244 - protein, 19 aa, Staphylococcus
IIYYIILYTLFLIAELVLL

SEQ ID NO: 1908245 - protein, 24 aa, Staphylococcus
IKLWLTIIFIVTTVLILLSAALIT

SEQ ID NO: 1908246 - protein, 24 aa, Staphylococcus
IKLWLTIILIVETVLILLSVSLIT

SEQ ID NO: 1908247 - protein, 28 aa, Staphylococcus
IKTLINVLPIFIVPLVTERKHIKNHSEV

SEQ ID NO: 1908248 - protein, 17 aa, Staphylococcus
IKWTLFSMIYPLATAYI

SEQ ID NO: 1908249 - protein, 17 aa, Staphylococcus
ILAIIFVMFIQIFLLRS

SEQ ID NO: 1908250 - protein, 18 aa, Staphylococcus
ILCYLGFQFGLKKRDEML

SEQ ID NO: 1908251 - protein, 17 aa, Staphylococcus
ILFIFRCLVVVLVFFGA

SEQ ID NO: 1908252 - protein, 24 aa, Staphylococcus
ILGWFSWIFLLLMTIITMFIALVS

SEQ ID NO: 1908253 - protein, 24 aa, Staphylococcus
ILHLPIWILFISFLALVGPVTGIA

SEQ ID NO: 1908254 - protein, 19 aa, Staphylococcus
ILIFLFLVFHLIRLASKIN

SEQ ID NO: 1908255 - protein, 17 aa, Staphylococcus
ILIFLPFVVLVLLKIRS

SEQ ID NO: 1908256 - protein, 18 aa, Staphylococcus
ILIFYFIFCGILAICQNL

SEQ ID NO: 1908257 - protein, 20 aa, Staphylococcus
ILIIIYIALKYAPFLRDQEW

SEQ ID NO: 1908258 - protein, 22 aa, Staphylococcus
ILILIFLAFIFHLVRLATKIEL

SEQ ID NO: 1908259 - protein, 19 aa, Staphylococcus
ILIMLICLGFINHPIQAAE

SEQ ID NO: 1908260 - protein, 27 aa, Staphylococcus
ILISGVIFIIFVLLPAQLFTGLITDKT

SEQ ID NO: 1908261 - protein, 27 aa, Staphylococcus
ILISGVIFIIFVLMPSSWFTGLVTNKT

SEQ ID NO: 1908262 - protein, 25 aa, Staphylococcus
ILISGVIFVIFVLLPASWFTGLVTD

SEQ ID NO: 1908263 - protein, 21 aa, Staphylococcus
ILITAIIFLGISTVFAFFLSN

SEQ ID NO: 1908264 - protein, 25 aa, Staphylococcus
ILITKVIILALFGLGFIIVGVILKP

SEQ ID NO: 1908265 - protein, 17 aa, Staphylococcus
ILIVILISAIISTMNQN

SEQ ID NO: 1908266 - protein, 18 aa, Staphylococcus
ILLGIILGVVVGYFLARN

SEQ ID NO: 1908267 - protein, 18 aa, Staphylococcus
ILLLFFLTTIAGSIYFYK

SEQ ID NO: 1908268 - protein, 17 aa, Staphylococcus
ILLPIFTNALITGLVGG

SEQ ID NO: 1908269 - protein, 17 aa, Staphylococcus
ILLVTTGAGLIYLRQRK

SEQ ID NO: 1908270 - protein, 19 aa, Staphylococcus
ILLYIMLFIIVIPLLRYHY

SEQ ID NO: 1908271 - protein, 19 aa, Staphylococcus
ILMFIILVAWLMTYIIPAG

SEQ ID NO: 1908272 - protein, 21 aa, Staphylococcus
ILNVFIFNYFFTVPRFTLEMY

SEQ ID NO: 1908273 - protein, 17 aa, Staphylococcus
ILTCTLIILLAITVFYF

SEQ ID NO: 1908274 - protein, 26 aa, Staphylococcus
ILTKKLVILSLFGIGFLLIGVIFKPI

SEQ ID NO: 1908275 - protein, 21 aa, Staphylococcus
ILTLFASFLIGLTLMGILLFN

SEQ ID NO: 1908276 - protein, 34 aa, Staphylococcus
ILTRKVITLSLFGIIFLLIGIIFKPITDPIMRKV

SEQ ID NO: 1908277 - protein, 25 aa, Staphylococcus
ILTVVYILLAFWILRAIPKSPYHIP

SEQ ID NO: 1908278 - protein, 18 aa, Staphylococcus
ILVGVFFVFKPQIDHFIT

SEQ ID NO: 1908279 - protein, 26 aa, Staphylococcus
ILVIILIAIGVMFYMRSNKRNSIEKA

SEQ ID NO: 1908280 - protein, 25 aa, Staphylococcus
ILVLISYLLFLLLGLANGLINMNTE

SEQ ID NO: 1908281 - protein, 17 aa, Staphylococcus
ILVLLIIFFFLGFIIPS

SEQ ID NO: 1908282 - protein, 19 aa, Staphylococcus
ILVLWLYFRKSIPGKFDAV

SEQ ID NO: 1908283 - protein, 20 aa, Staphylococcus
IMISYLLFLLSGLASGLMNM

SEQ ID NO: 1908284 - protein, 19 aa, Staphylococcus
IMLLLAFIMIFLQNRRFLK

SEQ ID NO: 1908285 - protein, 18 aa, Staphylococcus
IMMFVLDVKLALIALIFL

SEQ ID NO: 1908286 - protein, 27 aa, Staphylococcus
INFKRSHFIIILIVTILVTAMIAVFAT

SEQ ID NO: 1908287 - protein, 25 aa, Staphylococcus
INLFIPLIVIYMLTRFFYKKHLSRN

SEQ ID NO: 1908288 - protein, 23 aa, Staphylococcus
INLFLAWFLMYFPWGKTAVQSLA

SEQ ID NO: 1908289 - protein, 22 aa, Staphylococcus
INPLFILLFAPLISLMWMKMGK

SEQ ID NO: 1908290 - protein, 17 aa, Staphylococcus
INRLLLALILPLVIFII

SEQ ID NO: 1908291 - protein, 24 aa, Staphylococcus
INSGYKKLLYWSLNHKWIVIIISI

SEQ ID NO: 1908292 - protein, 24 aa, Staphylococcus
INSQIATLFLLDIVSYLLLNDTHM

SEQ ID NO: 1908293 - protein, 18 aa, Staphylococcus
INTQIATLFLIDIVSYLL

SEQ ID NO: 1908294 - protein, 22 aa, Staphylococcus
INVFFLYFWIFKVTKTQTRKSA

SEQ ID NO: 1908295 - protein, 18 aa, Staphylococcus
INVLIWLIMILYLNHFSD

SEQ ID NO: 1908296 - protein, 24 aa, Staphylococcus
IPFTILWPLFITLLIFTFFKNVDT

SEQ ID NO: 1908297 - protein, 19 aa, Staphylococcus
IPFTLLWPILITLLVFTFS

SEQ ID NO: 1908298 - protein, 18 aa, Staphylococcus
IPIFFFIIAIMMFARKNK

SEQ ID NO: 1908299 - protein, 18 aa, Staphylococcus
IPIFICIFTFLLMVIQSQ

SEQ ID NO: 1908300 - protein, 21 aa, Staphylococcus
IPIFLVIMWLIFQATFSWIGT

SEQ ID NO: 1908301 - protein, 17 aa, Staphylococcus
IPISVQYDNYRDGHVIA

SEQ ID NO: 1908302 - protein, 22 aa, Staphylococcus
IPLLIYFYVPFFKKLKVTSAYE

SEQ ID NO: 1908303 - protein, 24 aa, Staphylococcus
IPMFIIILILVVFAILFIVNETHL

SEQ ID NO: 1908304 - protein, 28 aa, Staphylococcus
IPVALNEIFIRIFWSIKEIFYHKRSVKD

SEQ ID NO: 1908305 - protein, 31 aa, Staphylococcus
IPVIIFETLIRCYWFYKQKFYYGKSFKESLS

SEQ ID NO: 1908306 - protein, 18 aa, Staphylococcus
IPVLFFIVAIMMFARKDR

SEQ ID NO: 1908307 - protein, 18 aa, Staphylococcus
IQGILPTGNITAKVSITE

SEQ ID NO: 1908308 - protein, 33 aa, Staphylococcus
IQLLTKWKTHIIILIAVVLLFIVILMLMKNNET

SEQ ID NO: 1908309 - protein, 34 aa, Staphylococcus
IQMKFERTLFALITAMLIIFVGVVIGYFVRRKND

SEQ ID NO: 1908310 - protein, 25 aa, Staphylococcus
IQNLTALIHYPGIDTPVEVPVKVWV

SEQ ID NO: 1908311 - protein, 27 aa, Staphylococcus
IQPSVSIPMIPLVPAQPSVPVQPSVPA

SEQ ID NO: 1908312 - protein, 39 aa, Staphylococcus
IRKIVPVAIIFFIIILLVILFFLLRNFNSPNAQTKILVN

SEQ ID NO: 1908313 - protein, 18 aa, Staphylococcus
ISAVVILLIVAGIGFGAY

SEQ ID NO: 1908314 - protein, 25 aa, Staphylococcus
ISFDPFTPLLLAAGLYFVLTFSLSR

SEQ ID NO: 1908315 - protein, 17 aa, Staphylococcus
ISFYFFRYLKFKNYATL

SEQ ID NO: 1908316 - protein, 23 aa, Staphylococcus
ISGIFMLILLIKKLRHLTTHKVV

SEQ ID NO: 1908317 - protein, 25 aa, Staphylococcus
ISIIAAILVLFIIALIVKNATGESD

SEQ ID NO: 1908318 - protein, 27 aa, Staphylococcus
ISIIIFILLIISVVIFKYILRDHKQQH

SEQ ID NO: 1908319 - protein, 17 aa, Staphylococcus
ISIYLGTVFIACTTYLA

SEQ ID NO: 1908320 - protein, 17 aa, Staphylococcus
ISLFYILAIINSKVFNF

SEQ ID NO: 1908321 - protein, 24 aa, Staphylococcus
ISLIFAIIIVLFIQTFIVVGAVIP

SEQ ID NO: 1908322 - protein, 23 aa, Staphylococcus
ISLIFAIIIVLFIQTFLIRGAIV

SEQ ID NO: 1908323 - protein, 23 aa, Staphylococcus
ISLLFVLIFFVFSLPKSALILGV

SEQ ID NO: 1908324 - protein, 25 aa, Staphylococcus
ISMLFYLWIIPWLSAKRVRILKQQV

SEQ ID NO: 1908325 - protein, 22 aa, Staphylococcus
ISPIWFIFLFIFYRKYKSNAED

SEQ ID NO: 1908326 - protein, 17 aa, Staphylococcus
ISPIWFIFLFLFYRRRL

SEQ ID NO: 1908327 - protein, 19 aa, Staphylococcus
ISPWLLLIPLAVIVLVVFK

SEQ ID NO: 1908328 - protein, 17 aa, Staphylococcus
ISRFFRMFYLRFKARKN

SEQ ID NO: 1908329 - protein, 22 aa, Staphylococcus
ISTLFLILAILLLIGLSFYKNI

SEQ ID NO: 1908330 - protein, 24 aa, Staphylococcus
ISTPYALLFFDLLVVLISLTQISL

SEQ ID NO: 1908331 - protein, 17 aa, Staphylococcus
ISYLLFLLSGLANGLIK

SEQ ID NO: 1908332 - protein, 18 aa, Staphylococcus
ISYVVWFIVLTSILSRFG

SEQ ID NO: 1908333 - protein, 29 aa, Staphylococcus
ITCILLFLLIFFLFNLPLSAFLLGAGIML

SEQ ID NO: 1908334 - protein, 27 aa, Staphylococcus
ITFTTILLFCLIIIFFLKDTLRNSELD

SEQ ID NO: 1908335 - protein, 22 aa, Staphylococcus
ITGLLMIYVFNPPASWINHLLL

SEQ ID NO: 1908336 - protein, 22 aa, Staphylococcus
ITGLLMIYVFNPPASWLNHLLL

SEQ ID NO: 1908337 - protein, 21 aa, Staphylococcus
ITGLLMIYVINPPASWLNNTL

SEQ ID NO: 1908338 - protein, 24 aa, Staphylococcus
ITIILIILLIVIIITIAYKLYHRS

SEQ ID NO: 1908339 - protein, 21 aa, Staphylococcus
ITIPIFVLIMIPLGRVMQKIS

SEQ ID NO: 1908340 - protein, 17 aa, Staphylococcus
ITIVVIAIIVIGGLFGL

SEQ ID NO: 1908341 - protein, 17 aa, Staphylococcus
ITLIVVMLIACVVLVVL

SEQ ID NO: 1908342 - protein, 18 aa, Staphylococcus
ITMFFVLNIITPFANAEN

SEQ ID NO: 1908343 - protein, 27 aa, Staphylococcus
ITVIILIIAIIFLAITTIFAFFLSSRI

SEQ ID NO: 1908344 - protein, 23 aa, Staphylococcus
IVAILGLLIIFVVGAIIFFSMVS

SEQ ID NO: 1908345 - protein, 23 aa, Staphylococcus
IVDYLLIFFLFGISVTMLAGAGS

SEQ ID NO: 1908346 - protein, 17 aa, Staphylococcus
IVFIIFGIILFGLTYFK

SEQ ID NO: 1908347 - protein, 18 aa, Staphylococcus
IVFLILIYVLVFTAQKLA

SEQ ID NO: 1908348 - protein, 20 aa, Staphylococcus
IVFMIFLITKFSQVWPILIF

SEQ ID NO: 1908349 - protein, 17 aa, Staphylococcus
IVFYFSFFSIVALIPFV

SEQ ID NO: 1908350 - protein, 31 aa, Staphylococcus
IVIAIIALLILFSFVPIGLWISAIAAGVKVN

SEQ ID NO: 1908351 - protein, 22 aa, Staphylococcus
IVIFVGFFLAATLVWFVHDKDE

SEQ ID NO: 1908352 - protein, 19 aa, Staphylococcus
IVITIIVVVLIFYNTRKSA

SEQ ID NO: 1908353 - protein, 23 aa, Staphylococcus
IVIYYMILYLLFLIAELVLLPPG

SEQ ID NO: 1908354 - protein, 19 aa, Staphylococcus
IVLGLIVLLFIPLTVMIGV

SEQ ID NO: 1908355 - protein, 22 aa, Staphylococcus
IVLIILVTLFIIFLMKVYKTNH

SEQ ID NO: 1908356 - protein, 17 aa, Staphylococcus
IVLLFPIYFLSLAQTPG

SEQ ID NO: 1908357 - protein, 17 aa, Staphylococcus
IVLLFVWPPVFNAIVTF

SEQ ID NO: 1908358 - protein, 18 aa, Staphylococcus
IVLPLIIIIILFTVLYSV

SEQ ID NO: 1908359 - protein, 19 aa, Staphylococcus
IVLVWYLIAGVLYLTQKRK

SEQ ID NO: 1908360 - protein, 17 aa, Staphylococcus
IVMIFLFLGEWISSLSK

SEQ ID NO: 1908361 - protein, 18 aa, Staphylococcus
IVMMIILFVIITISIFKF

SEQ ID NO: 1908362 - protein, 24 aa, Staphylococcus
IVNILIIMVLLSILMVGLFLLFKD

SEQ ID NO: 1908363 - protein, 29 aa, Staphylococcus
IVPAILIPKLIILGLFGLGFLTIGLCLKP

SEQ ID NO: 1908364 - protein, 17 aa, Staphylococcus
IVSLSIISVILWIIAVL

SEQ ID NO: 1908365 - protein, 23 aa, Staphylococcus
IVSWRWMFFINVLVVIIAILLQI

SEQ ID NO: 1908366 - protein, 23 aa, Staphylococcus
IVTAPFIPIFYIIFGLKTRDESK

SEQ ID NO: 1908367 - protein, 28 aa, Staphylococcus
IVTIITFIILLALLKKFAWGPLKEVMDK

SEQ ID NO: 1908368 - protein, 17 aa, Staphylococcus
IVTIVVLVIIGVVGFHF

SEQ ID NO: 1908369 - protein, 18 aa, Staphylococcus
IVVCVLLFQFINHTGPFS

SEQ ID NO: 1908370 - protein, 24 aa, Staphylococcus
IVVFYYLKWLKLKTAPLLIATILY

SEQ ID NO: 1908371 - protein, 27 aa, Staphylococcus
IVVGAFILFLILLFMLMNHSDQGSNRI

SEQ ID NO: 1908372 - protein, 23 aa, Staphylococcus
IVVIIMFYIFYRMLKSKIKKMFG

SEQ ID NO: 1908373 - protein, 18 aa, Staphylococcus
IVVLLFILLLYKELFILS

SEQ ID NO: 1908374 - protein, 17 aa, Staphylococcus
IVVLVIVIPLFGGKGDK

SEQ ID NO: 1908375 - protein, 17 aa, Staphylococcus
IVWYVLYLLITVFKGTK

SEQ ID NO: 1908376 - protein, 17 aa, Staphylococcus
IVYFIIWIGLGSLWMKL

SEQ ID NO: 1908377 - protein, 17 aa, Staphylococcus
IVYFIVCLLLSFLALIS

SEQ ID NO: 1908378 - protein, 22 aa, Staphylococcus
IVYPVIHLFVVILSPITKVLNA

SEQ ID NO: 1908379 - protein, 20 aa, Staphylococcus
IVYYFLFDFAIRKFKLKTPG

SEQ ID NO: 1908380 - protein, 26 aa, Staphylococcus
IWAWLLVLVFLPIVGFILYLLLGRQI

SEQ ID NO: 1908381 - protein, 18 aa, Staphylococcus
IWFYLIFFLFFGLFLLLL

SEQ ID NO: 1908382 - protein, 18 aa, Staphylococcus
IWFYLIFLLFFGLLLFLI

SEQ ID NO: 1908383 - protein, 18 aa, Staphylococcus
IWFYLIFLLFFGLLLFLV

SEQ ID NO: 1908384 - protein, 17 aa, Staphylococcus
IWFYVIFLLFYGLVLFL

SEQ ID NO: 1908385 - protein, 19 aa, Staphylococcus
IWIVLLIFNLINTFLVLVG

SEQ ID NO: 1908386 - protein, 18 aa, Staphylococcus
IYESSVFSEINSLSHSAS

SEQ ID NO: 1908387 - protein, 18 aa, Staphylococcus
IYRLIIKYLMWYIKTVKG

SEQ ID NO: 1908388 - protein, 26 aa, Staphylococcus
IYTPISFFVFIFKPITKILNALTDLI

SEQ ID NO: 1908389 - protein, 25 aa, Staphylococcus
IYVFRYIWVYIWFKDFYAPKNVQSY

SEQ ID NO: 1908390 - protein, 17 aa, Staphylococcus
IYVNPQSVNSYDTWLTI

SEQ ID NO: 1908391 - protein, 25 aa, Staphylococcus
IYVVRFIWVFLLYKDFYYPNHLQRY

SEQ ID NO: 1908392 - protein, 19 aa, Staphylococcus
KAFPLLKFEHYLKYIIFNV

SEQ ID NO: 1908393 - protein, 25 aa, Staphylococcus
KAKIEWEILIKSIKPIVKVKPEANE

SEQ ID NO: 1908394 - protein, 19 aa, Staphylococcus
KDDLQAQYNWGVVPSDYTY

SEQ ID NO: 1908395 - protein, 17 aa, Staphylococcus
KEKYLLIIFMSNAIFGV

SEQ ID NO: 1908396 - protein, 22 aa, Staphylococcus
KELKLIMFLGFLLGGIIGLFQG

SEQ ID NO: 1908397 - protein, 35 aa, Staphylococcus
KELLYIALRISLIKILRPYYPFPIIIDDAFVHFDK

SEQ ID NO: 1908398 - protein, 26 aa, Staphylococcus
KELLYVALRISLIKVLKPYYPFPIIV

SEQ ID NO: 1908399 - protein, 34 aa, Staphylococcus
KELTNNSLPYIVTLLGSFALLISRKRERKDNNRN

SEQ ID NO: 1908400 - protein, 19 aa, Staphylococcus
KENLYRIAIQYYGEGTQQN

SEQ ID NO: 1908401 - protein, 27 aa, Staphylococcus
KEQEFNPALLMLLAGLGLIGIFRNKIK

SEQ ID NO: 1908402 - protein, 42 aa, Staphylococcus
KESNKRGIKGLLLPLLALLLVLAALAIFLGMYLNKDHGDNQA

SEQ ID NO: 1908403 - protein, 21 aa, Staphylococcus
KFAIFLMVLLVIIGGIYSSAK

SEQ ID NO: 1908404 - protein, 19 aa, Staphylococcus
KFAIFLMVLLVILGGVYAS

SEQ ID NO: 1908405 - protein, 20 aa, Staphylococcus
KFAIFLMVLLVILGGVYASS

SEQ ID NO: 1908406 - protein, 24 aa, Staphylococcus
KFAIFLMVVLVILGGIYSSAKLKL

SEQ ID NO: 1908407 - protein, 23 aa, Staphylococcus
KFAIFLMVVLVILGGVYASAKLK

SEQ ID NO: 1908408 - protein, 21 aa, Staphylococcus
KFAIFLMVVLVILGGVYSSAK

SEQ ID NO: 1908409 - protein, 21 aa, Staphylococcus
KFAIFLMVVLVILGGVYSSMK

SEQ ID NO: 1908410 - protein, 20 aa, Staphylococcus
KFEKILYITLVSVIAMISIY

SEQ ID NO: 1908411 - protein, 20 aa, Staphylococcus
KFEKVLYISLIAVIAMVSIY

SEQ ID NO: 1908412 - protein, 23 aa, Staphylococcus
KFFQAISPYLPFTYAIDALRETV

SEQ ID NO: 1908413 - protein, 17 aa, Staphylococcus
KFGVSSILVGSIIGLTM

SEQ ID NO: 1908414 - protein, 20 aa, Staphylococcus
KFIISLILSLPLIYTMVGHF

SEQ ID NO: 1908415 - protein, 24 aa, Staphylococcus
KFIPYLIFVFLWVICVYSPVAHWV

SEQ ID NO: 1908416 - protein, 27 aa, Staphylococcus
KFIQILWFYLIFFLFFGLLLFLISLIA

SEQ ID NO: 1908417 - protein, 28 aa, Staphylococcus
KFKDDMHGLFEPLKYTPSLSNKFDGSLL

SEQ ID NO: 1908418 - protein, 22 aa, Staphylococcus
KFNSYLKVSCSVLLMSGTLVGY

SEQ ID NO: 1908419 - protein, 17 aa, Staphylococcus
KFRQPLNVPLKQGDVVT

SEQ ID NO: 1908420 - protein, 21 aa, Staphylococcus
KFRYVLIMLIIVLLSLMVLFI

SEQ ID NO: 1908421 - protein, 20 aa, Staphylococcus
KFSIRKYAIGTFSTVIATLV

SEQ ID NO: 1908422 - protein, 20 aa, Staphylococcus
KFSIRKYAIGTVSTLVATFV

SEQ ID NO: 1908423 - protein, 22 aa, Staphylococcus
KFSIRKYAVGTFSTLIATLVFL

SEQ ID NO: 1908424 - protein, 29 aa, Staphylococcus
KGIILKLLIPILIIIGIIIGVMYALSLRA

SEQ ID NO: 1908425 - protein, 17 aa, Staphylococcus
KGINVINTIQLEIIKKV

SEQ ID NO: 1908426 - protein, 29 aa, Staphylococcus
KGKGLFFKIVIGLIIIVAIFFGVMYAMSS

SEQ ID NO: 1908427 - protein, 38 aa, Staphylococcus
KGKYWLIGCGAGCGCLVILIILVLAACVIFMKVSDSIS

SEQ ID NO: 1908428 - protein, 41 aa, Staphylococcus
KGMSCIAKIISIIIVLLLLGGLTFAIFSFVDHSKKANERLN

SEQ ID NO: 1908429 - protein, 24 aa, Staphylococcus
KGSNYFRFEYFNPLNSKKYYKNLD

SEQ ID NO: 1908430 - protein, 31 aa, Staphylococcus
KHILITMFALLCLILLILFIASMFYFHRITS

SEQ ID NO: 1908431 - protein, 19 aa, Staphylococcus
KHLLFVLFFIAMLISWYLF

SEQ ID NO: 1908432 - protein, 20 aa, Staphylococcus
KIFMLAPLLPIIALIYTCFD

SEQ ID NO: 1908433 - protein, 26 aa, Staphylococcus
KIIFIVFILYFILLYFVQMNSILMVA

SEQ ID NO: 1908434 - protein, 18 aa, Staphylococcus
KIKWFYFIGGILGVVFVT

SEQ ID NO: 1908435 - protein, 20 aa, Staphylococcus
KILIALLLYRFAYYFVPVII

SEQ ID NO: 1908436 - protein, 23 aa, Staphylococcus
KITLFSFVLLLTSLWSYFILKIT

SEQ ID NO: 1908437 - protein, 25 aa, Staphylococcus
KKAFQAIMYAGIQYAKEQTSLYTTY

SEQ ID NO: 1908438 - protein, 21 aa, Staphylococcus
KKAFWFMFVGGFLLTFLLYAN

SEQ ID NO: 1908439 - protein, 26 aa, Staphylococcus
KKALKRLPWLIILTFLGMITATILGG

SEQ ID NO: 1908440 - protein, 31 aa, Staphylococcus
KKDDKYYFQITLDNASWWKSFRFFDENETEL

SEQ ID NO: 1908441 - protein, 24 aa, Staphylococcus
KKHSTLLFATLLIAFGYLSHFVNG

SEQ ID NO: 1908442 - protein, 33 aa, Staphylococcus
KKKKNKRIFLRLFIIFVFIYALFIGLMYYLSSR

SEQ ID NO: 1908443 - protein, 36 aa, Staphylococcus
KKKSKRLFLRLFIFLIIIIILFLGLMFFLSSRANVD

SEQ ID NO: 1908444 - protein, 34 aa, Staphylococcus
KKKSKRLFLRMLIIFIIIFALFTGLMYFLSSRAN

SEQ ID NO: 1908445 - protein, 31 aa, Staphylococcus
KKLRKLPFIILIILILLIAAIIYIVHGYRSG

SEQ ID NO: 1908446 - protein, 27 aa, Staphylococcus
KKLRKLPFVILIIVVLLIVMITYVVHG

SEQ ID NO: 1908447 - protein, 42 aa, Staphylococcus
KKMSGISKIISTLIVLLLLGGLVFAVFAFVDNSNRVNERLNN

SEQ ID NO: 1908448 - protein, 17 aa, Staphylococcus
KKPKIAGILLIIAGLIA

SEQ ID NO: 1908449 - protein, 28 aa, Staphylococcus
KKRFRKLPFIILIGIIILAIIIGYSVHG

SEQ ID NO: 1908450 - protein, 27 aa, Staphylococcus
KKSKKKVIFIVLIIAVVLAMLIAIFAI

SEQ ID NO: 1908451 - protein, 17 aa, Staphylococcus
KKVMLWAAFFALTFFII

SEQ ID NO: 1908452 - protein, 20 aa, Staphylococcus
KKWIVIISNFKEFINVAAPT

SEQ ID NO: 1908453 - protein, 24 aa, Staphylococcus
KLATPRAISRIASPVMLAATDNVA

SEQ ID NO: 1908454 - protein, 19 aa, Staphylococcus
KLDLKYTPMALLYFNPKNE

SEQ ID NO: 1908455 - protein, 22 aa, Staphylococcus
KLESYYIRLRPMKFLYQKTVNG

SEQ ID NO: 1908456 - protein, 17 aa, Staphylococcus
KLFMIFLIRTAITLPII

SEQ ID NO: 1908457 - protein, 21 aa, Staphylococcus
KLFMPWYYLVKFILPVIIVLI

SEQ ID NO: 1908458 - protein, 20 aa, Staphylococcus
KLFVIFLIRTIITLPIITLI

SEQ ID NO: 1908459 - protein, 20 aa, Staphylococcus
KLFVIFLLRTIIVLPIIALM

SEQ ID NO: 1908460 - protein, 25 aa, Staphylococcus
KLHNPFIQDVPKWINTYWLADQGVN

SEQ ID NO: 1908461 - protein, 20 aa, Staphylococcus
KLIFSIVLSVPLLMTMLVHL

SEQ ID NO: 1908462 - protein, 17 aa, Staphylococcus
KLIFYWVKYLNYQIVYR

SEQ ID NO: 1908463 - protein, 20 aa, Staphylococcus
KLIPVRFIFRVLSILIFVMT

SEQ ID NO: 1908464 - protein, 20 aa, Staphylococcus
KLKCKGFQDLKLKIAYDLNE

SEQ ID NO: 1908465 - protein, 18 aa, Staphylococcus
KLVFFLAIAQRDIELTKR

SEQ ID NO: 1908466 - protein, 17 aa, Staphylococcus
KLYLFMSIFLPLAFYLL

SEQ ID NO: 1908467 - protein, 21 aa, Staphylococcus
KLYTLIWFLVGIVIYVFYGIK

SEQ ID NO: 1908468 - protein, 21 aa, Staphylococcus
KLYYLSFWYFITFGAFVAFGL

SEQ ID NO: 1908469 - protein, 32 aa, Staphylococcus
KMGLPTKVFLWFIGILVLLALIAVIYLGYKIF

SEQ ID NO: 1908470 - protein, 17 aa, Staphylococcus
KMKVFEKADQAIAKEKE

SEQ ID NO: 1908471 - protein, 22 aa, Staphylococcus
KMLRMVFILLAIVGAALTVFAF

SEQ ID NO: 1908472 - protein, 18 aa, Staphylococcus
KMRFIPYLIFVGLWVVFI

SEQ ID NO: 1908473 - protein, 40 aa, Staphylococcus
KMSGFAKIVSGLIVLLLVGGLIFAIFAFVDHSNKANERLA

SEQ ID NO: 1908474 - protein, 41 aa, Staphylococcus
KMSGISKLISTIIVLLLLSGLAFAIFAFVDHSNRSSERLNN

SEQ ID NO: 1908475 - protein, 38 aa, Staphylococcus
KMSNLAKIVSAIIVVILLFTLAFATFSFVDHSKKGSER

SEQ ID NO: 1908476 - protein, 35 aa, Staphylococcus
KMVPWGIGTFIIILLIILFFLLKNFNSPEAQAKIF

SEQ ID NO: 1908477 - protein, 36 aa, Staphylococcus
KNKKSKKWLIAIIAILLIIVAVFATRAILNNNSSDN

SEQ ID NO: 1908478 - protein, 35 aa, Staphylococcus
KNKKSKRWLIAIIAILLLIIGIFATKSYIDHKNES

SEQ ID NO: 1908479 - protein, 36 aa, Staphylococcus
KNKNKKPIWIIILSIIFILLIGALLYGAYYYYNNVI

SEQ ID NO: 1908480 - protein, 23 aa, Staphylococcus
KNLYLTFLLLFITIILFVTVVHN

SEQ ID NO: 1908481 - protein, 25 aa, Staphylococcus
KNNLLMFCPLLPLIAFLSIFISPEI

SEQ ID NO: 1908482 - protein, 26 aa, Staphylococcus
KNWGIWLFIPIIFLLISLIITFLFMT

SEQ ID NO: 1908483 - protein, 24 aa, Staphylococcus
KPAALKQILAKLDAQKAFISENND

SEQ ID NO: 1908484 - protein, 17 aa, Staphylococcus
KPFLAYGPAIENMHWAT

SEQ ID NO: 1908485 - protein, 27 aa, Staphylococcus
KPLRAMIYLGLIVFFISLLYIGYISVG

SEQ ID NO: 1908486 - protein, 23 aa, Staphylococcus
KPNKPLIIISILVAVIAITLISV

SEQ ID NO: 1908487 - protein, 32 aa, Staphylococcus
KPTMIALISFILFLILLFLFLNHNDQKSDRIT

SEQ ID NO: 1908488 - protein, 22 aa, Staphylococcus
KPTPFLARVIGWSIALVLGFII

SEQ ID NO: 1908489 - protein, 42 aa, Staphylococcus
KPTQKNHYSIRKFTVGTASIIVGSFLFFGQAHAEEGTEGNTW

SEQ ID NO: 1908490 - protein, 25 aa, Staphylococcus
KQEGRKWLFFKDYKFDIPRYNIYVD

SEQ ID NO: 1908491 - protein, 23 aa, Staphylococcus
KQELIKTILLTKFDHIDTSKIVD

SEQ ID NO: 1908492 - protein, 34 aa, Staphylococcus
KQIQYSIFGVLLFIIILILIYMFTPLSKVNSVKI

SEQ ID NO: 1908493 - protein, 28 aa, Staphylococcus
KQKRNWWLRLSFIVLSIVGLGLTLFSFV

SEQ ID NO: 1908494 - protein, 17 aa, Staphylococcus
KQNFIVIILFFINIKDF

SEQ ID NO: 1908495 - protein, 21 aa, Staphylococcus
KQNKYSIRKFKLGAASVTVAS

SEQ ID NO: 1908496 - protein, 32 aa, Staphylococcus
KRIKFKTWQFILLLLGVVIITAGITVAATIGI

SEQ ID NO: 1908497 - protein, 29 aa, Staphylococcus
KRIKKLPIAILIVLILLVSLIVYITVSYQ

SEQ ID NO: 1908498 - protein, 36 aa, Staphylococcus
KRIQYIIITVLVLLIVIFLLYMFTPLSKISNVNIKG

SEQ ID NO: 1908499 - protein, 35 aa, Staphylococcus
KRIQYIIVTTLILLIILFLLYMFTPLSRISHVNIS

SEQ ID NO: 1908500 - protein, 30 aa, Staphylococcus
KRLRKLPFIILIILIILISIIVYITHQYNS

SEQ ID NO: 1908501 - protein, 25 aa, Staphylococcus
KRNKLIISAILAFPLLLTMLVHLFN

SEQ ID NO: 1908502 - protein, 27 aa, Staphylococcus
KRQQWLRFSFVLLAIVGIALAVFSFMT

SEQ ID NO: 1908503 - protein, 26 aa, Staphylococcus
KRRNFLYTLIVLVITLVLLVVAISSQ

SEQ ID NO: 1908504 - protein, 43 aa, Staphylococcus
KRTIIKIIGFMFIAFIILALLGILLFAYYAWKAPAFTESKLQD

SEQ ID NO: 1908505 - protein, 31 aa, Staphylococcus
KRVRKLPFIILFILIILIVIIAYIAHGYNSG

SEQ ID NO: 1908506 - protein, 21 aa, Staphylococcus
KSELRRAPVLGLLQPDGIDTY

SEQ ID NO: 1908507 - protein, 29 aa, Staphylococcus
KSGDYFTVQFPKYLNYFGNSTPQSTKIPD

SEQ ID NO: 1908508 - protein, 27 aa, Staphylococcus
KSIGMFIIIVILALYFIDMNRNNAILA

SEQ ID NO: 1908509 - protein, 36 aa, Staphylococcus
KSNKGKKWLAAIVVILLIVVAIFIVRNMMQPKNDDQ

SEQ ID NO: 1908510 - protein, 35 aa, Staphylococcus
KSNKKMWMIIGIIALLFIALIIAFSILKSQFSPEK

SEQ ID NO: 1908511 - protein, 20 aa, Staphylococcus
KSNQQFPPRNAQRRKRRRDI

SEQ ID NO: 1908512 - protein, 21 aa, Staphylococcus
KSNQQFPPRNAQRRKRRRDVA

SEQ ID NO: 1908513 - protein, 26 aa, Staphylococcus
KSYIKTLNMILIPTLILISSTVMIIY

SEQ ID NO: 1908514 - protein, 17 aa, Staphylococcus
KTKYYFIILLISKLISI

SEQ ID NO: 1908515 - protein, 27 aa, Staphylococcus
KTRKNWVLWFLFLNLMMLGISYIDYDI

SEQ ID NO: 1908516 - protein, 24 aa, Staphylococcus
KTVMRAYYKHEGNSKYLVYDVFFN

SEQ ID NO: 1908517 - protein, 23 aa, Staphylococcus
KVAGYLFYFTVSAGLIAFIVWVL

SEQ ID NO: 1908518 - protein, 17 aa, Staphylococcus
KVALLPELLFDRARVYL

SEQ ID NO: 1908519 - protein, 20 aa, Staphylococcus
KVFFNDGHTAILPKGDKGDK

SEQ ID NO: 1908520 - protein, 29 aa, Staphylococcus
KVIITILILLFVVLIGIVIYAFAKFHSLN

SEQ ID NO: 1908521 - protein, 32 aa, Staphylococcus
KVKDFLKLHWLKIVIVVAIILIVILISAIIST

SEQ ID NO: 1908522 - protein, 21 aa, Staphylococcus
KVLGWLNWIGLLLLTVATMFI

SEQ ID NO: 1908523 - protein, 42 aa, Staphylococcus
KVLPKTGENLAPVHPIYATLMFAIGGLMMFFRKRKNEDKDST

SEQ ID NO: 1908524 - protein, 36 aa, Staphylococcus
KVQKKIHLKLWHLIILIIGIILITVAITVAATLLIS

SEQ ID NO: 1908525 - protein, 20 aa, Staphylococcus
KVSFRFWPFSEFKFNFNPDN

SEQ ID NO: 1908526 - protein, 22 aa, Staphylococcus
KVWLYFMYFWIIFGIGTYFGQY

SEQ ID NO: 1908527 - protein, 18 aa, Staphylococcus
KWIVLVISVVILVGSIAL

SEQ ID NO: 1908528 - protein, 20 aa, Staphylococcus
KWKMFFWLAGLIILTLIIPP

SEQ ID NO: 1908529 - protein, 18 aa, Staphylococcus
KYIVWFIVITTILSKFGI

SEQ ID NO: 1908530 - protein, 17 aa, Staphylococcus
KYIYLLYKLNDEEIKIV

SEQ ID NO: 1908531 - protein, 17 aa, Staphylococcus
KYKFIISLILSLPLIYT

SEQ ID NO: 1908532 - protein, 28 aa, Staphylococcus
LAAIIIVYLVLVLTFKGALAPFTILFSL

SEQ ID NO: 1908533 - protein, 26 aa, Staphylococcus
LAAMFIFPFYILTVYYFFGRLRGLTR

SEQ ID NO: 1908534 - protein, 21 aa, Staphylococcus
LAFFLFVFVLLFFSADTRVAI

SEQ ID NO: 1908535 - protein, 17 aa, Staphylococcus
LAFLPWIVIILPYLLFK

SEQ ID NO: 1908536 - protein, 22 aa, Staphylococcus
LAFVLLMFVFRSIIIPLKAVLG

SEQ ID NO: 1908537 - protein, 18 aa, Staphylococcus
LAIIITALVLLFKDKRQK

SEQ ID NO: 1908538 - protein, 24 aa, Staphylococcus
LAIKIIMILIYIVAAIIVISILNK

SEQ ID NO: 1908539 - protein, 20 aa, Staphylococcus
LAPGFYWLIVSIIGLIVVVF

SEQ ID NO: 1908540 - protein, 22 aa, Staphylococcus
LASIFVLWLYFKKSLPKSTNIE

SEQ ID NO: 1908541 - protein, 17 aa, Staphylococcus
LAVLLGLLLVISISLVI

SEQ ID NO: 1908542 - protein, 20 aa, Staphylococcus
LAWLGIITQLFILLGLGIGT

SEQ ID NO: 1908543 - protein, 21 aa, Staphylococcus
LCLMIILFTLLPTLLLVLGNK

SEQ ID NO: 1908544 - protein, 30 aa, Staphylococcus
LDFLPNIYNKYSIRKFTVGTASILLGSTLI

SEQ ID NO: 1908545 - protein, 32 aa, Staphylococcus
LDFLPNKLNKYSIRRFTVGTASILVGATLIFG

SEQ ID NO: 1908546 - protein, 19 aa, Staphylococcus
LDFLPNRLNKYSIRKFTVG

SEQ ID NO: 1908547 - protein, 27 aa, Staphylococcus
LDKPLPMLDLPIIPIIVSRYWVQLISS

SEQ ID NO: 1908548 - protein, 23 aa, Staphylococcus
LDLIIVWYVLYLLITVFKGTKAI

SEQ ID NO: 1908549 - protein, 25 aa, Staphylococcus
LDPNKVYVFLLKNMGVERKVNSTTL

SEQ ID NO: 1908550 - protein, 17 aa, Staphylococcus
LDVFILLFIMKFGFRKI

SEQ ID NO: 1908551 - protein, 17 aa, Staphylococcus
LDVFLLLFIMKFGFRKI

SEQ ID NO: 1908552 - protein, 24 aa, Staphylococcus
LEFATWHWLFFINIPIAIIAIILV

SEQ ID NO: 1908553 - protein, 24 aa, Staphylococcus
LEFATWHWLFFINIPIAIIAIVLV

SEQ ID NO: 1908554 - protein, 24 aa, Staphylococcus
LEFATWHWLFFINIPIAIVAGILA

SEQ ID NO: 1908555 - protein, 23 aa, Staphylococcus
LEFATWHWLFFINIPIAVIAIIL

SEQ ID NO: 1908556 - protein, 23 aa, Staphylococcus
LEFATWHWLFFVNIPISIIAIIL

SEQ ID NO: 1908557 - protein, 25 aa, Staphylococcus
LEGRAKPGYPKGYALESRPFLTDTA

SEQ ID NO: 1908558 - protein, 17 aa, Staphylococcus
LERVGLIIIIAYLLMNT

SEQ ID NO: 1908559 - protein, 23 aa, Staphylococcus
LERVGLIILIAYILMNINHFKTM

SEQ ID NO: 1908560 - protein, 20 aa, Staphylococcus
LFAFFILFRVLGKDYDAAVM

SEQ ID NO: 1908561 - protein, 18 aa, Staphylococcus
LFCSITLLSWLYLTKSHT

SEQ ID NO: 1908562 - protein, 18 aa, Staphylococcus
LFDAFVVRLLLIPALTQL

SEQ ID NO: 1908563 - protein, 17 aa, Staphylococcus
LFFIFIVLSILSLFIGV

SEQ ID NO: 1908564 - protein, 19 aa, Staphylococcus
LFFLLFYSLWILFIVSVTI

SEQ ID NO: 1908565 - protein, 19 aa, Staphylococcus
LFFSLPVLVIIFILSFIFL

SEQ ID NO: 1908566 - protein, 23 aa, Staphylococcus
LFFVLAFFVLFHVSAFAAEIPAK

SEQ ID NO: 1908567 - protein, 23 aa, Staphylococcus
LFFVPFYTFILFPASLIYFASLH

SEQ ID NO: 1908568 - protein, 18 aa, Staphylococcus
LFFWFFKLHYSFGHIINS

SEQ ID NO: 1908569 - protein, 20 aa, Staphylococcus
LFGLLYFVLLFTSAYVLLRM

SEQ ID NO: 1908570 - protein, 18 aa, Staphylococcus
LFIFILTFIHRFLEIKVT

SEQ ID NO: 1908571 - protein, 22 aa, Staphylococcus
LFIFVFIIINISLAIMYVNKIN

SEQ ID NO: 1908572 - protein, 22 aa, Staphylococcus
LFIFVFILVNIFLVVIYIDKVN

SEQ ID NO: 1908573 - protein, 23 aa, Staphylococcus
LFIFVFILVNILLVLIYVNKVTK

SEQ ID NO: 1908574 - protein, 26 aa, Staphylococcus
LFIFVFILVNILLVMIYIDKVNKAQI

SEQ ID NO: 1908575 - protein, 22 aa, Staphylococcus
LFIFVFILVNISLIVIYINKVT

SEQ ID NO: 1908576 - protein, 22 aa, Staphylococcus
LFIFVFILVNISLVIIYIDKVN

SEQ ID NO: 1908577 - protein, 22 aa, Staphylococcus
LFIFVFVLVNIFLILIYINKVT

SEQ ID NO: 1908578 - protein, 18 aa, Staphylococcus
LFIGKPIKLLIIAGALNG

SEQ ID NO: 1908579 - protein, 17 aa, Staphylococcus
LFIKTRKNWVLWFLFLN

SEQ ID NO: 1908580 - protein, 18 aa, Staphylococcus
LFILFRYKEIRKKGTPPV

SEQ ID NO: 1908581 - protein, 18 aa, Staphylococcus
LFILILVILLARATFNML

SEQ ID NO: 1908582 - protein, 17 aa, Staphylococcus
LFILLFAAILIIAVLLA

SEQ ID NO: 1908583 - protein, 19 aa, Staphylococcus
LFILVITAILTYVLRYVWR

SEQ ID NO: 1908584 - protein, 20 aa, Staphylococcus
LFIMCIYWWISYLGFQKEER

SEQ ID NO: 1908585 - protein, 18 aa, Staphylococcus
LFIPVWAIILWIMYQKYK

SEQ ID NO: 1908586 - protein, 18 aa, Staphylococcus
LFIPVWVLVLFLMYQKYK

SEQ ID NO: 1908587 - protein, 18 aa, Staphylococcus
LFIPWYYLIKYVMPLVII

SEQ ID NO: 1908588 - protein, 19 aa, Staphylococcus
LFKISWIVLAILLVGYLIS

SEQ ID NO: 1908589 - protein, 28 aa, Staphylococcus
LFKYTLPYKWIIVLAFITLILSTIASMM

SEQ ID NO: 1908590 - protein, 18 aa, Staphylococcus
LFLAWFFIYFPWGRNGVK

SEQ ID NO: 1908591 - protein, 20 aa, Staphylococcus
LFLCILLVWLMTPGLSLFYG

SEQ ID NO: 1908592 - protein, 19 aa, Staphylococcus
LFLCTLLVWIMTPGLSLFY

SEQ ID NO: 1908593 - protein, 17 aa, Staphylococcus
LFLCTLLVWVMTPGLSL

SEQ ID NO: 1908594 - protein, 19 aa, Staphylococcus
LFLGMIGFLLILIQTPTYY

SEQ ID NO: 1908595 - protein, 21 aa, Staphylococcus
LFLIIVVIYRQPLLALIVGGS

SEQ ID NO: 1908596 - protein, 18 aa, Staphylococcus
LFLIMPIALLFIAISKFA

SEQ ID NO: 1908597 - protein, 17 aa, Staphylococcus
LFLKTRSNWIFWIIFLQ

SEQ ID NO: 1908598 - protein, 22 aa, Staphylococcus
LFLLCIIVIISFLALGAIITHA

SEQ ID NO: 1908599 - protein, 25 aa, Staphylococcus
LFLLFFIFLSFIGLFIYTYFQNTRV

SEQ ID NO: 1908600 - protein, 24 aa, Staphylococcus
LFLLLFLMIFFLFNLPFNAFFLGM

SEQ ID NO: 1908601 - protein, 20 aa, Staphylococcus
LFRISWIVLVVLMIGYFVSE

SEQ ID NO: 1908602 - protein, 19 aa, Staphylococcus
LFTLFTYRAPMGMRAMGAL

SEQ ID NO: 1908603 - protein, 18 aa, Staphylococcus
LFVCAMSFLYILFNFIYT

SEQ ID NO: 1908604 - protein, 19 aa, Staphylococcus
LFVPFFSIVIMVPLTLLII

SEQ ID NO: 1908605 - protein, 25 aa, Staphylococcus
LGIIFTFLLIIGFILNLILAFIIIF

SEQ ID NO: 1908606 - protein, 29 aa, Staphylococcus
LGIVFLITFLIYLFYSPRLKFDVLENPNN

SEQ ID NO: 1908607 - protein, 17 aa, Staphylococcus
LGKLFMIFLIRTAITLP

SEQ ID NO: 1908608 - protein, 17 aa, Staphylococcus
LGLLHLLPSLLLNGSDW

SEQ ID NO: 1908609 - protein, 23 aa, Staphylococcus
LGPLLFIIFYFIPAITGLADAPR

SEQ ID NO: 1908610 - protein, 26 aa, Staphylococcus
LGTIVAIIIILLFLRNIRTTAISVVS

SEQ ID NO: 1908611 - protein, 29 aa, Staphylococcus
LGVIFLVLFLIYLFYSPRLKFDVLENPNK

SEQ ID NO: 1908612 - protein, 29 aa, Staphylococcus
LGVVFLVSFLIYLFYSPRLKFDVLENPNK

SEQ ID NO: 1908613 - protein, 23 aa, Staphylococcus
LGWFSWVFLLILTIVTMFIALVS

SEQ ID NO: 1908614 - protein, 27 aa, Staphylococcus
LGWSLNHKWLVLIISIVILIASIGIGA

SEQ ID NO: 1908615 - protein, 18 aa, Staphylococcus
LHDGLAKLDLIQINAHKK

SEQ ID NO: 1908616 - protein, 38 aa, Staphylococcus
LHNSPKIFKIKRWKFIILLIAIILITVILTVLSTIAIS

SEQ ID NO: 1908617 - protein, 20 aa, Staphylococcus
LHPILFVFFIIIFINSWRHA

SEQ ID NO: 1908618 - protein, 27 aa, Staphylococcus
LHTKLVIVYVLLIIIGMQIIGLYFTNS

SEQ ID NO: 1908619 - protein, 29 aa, Staphylococcus
LIAFAIYIFRFIWVYVLFKDFYYPKNVEA

SEQ ID NO: 1908620 - protein, 20 aa, Staphylococcus
LIAIIILTICAWWLKPDIVY

SEQ ID NO: 1908621 - protein, 19 aa, Staphylococcus
LIAILLFAWPFIYSAIVAF

SEQ ID NO: 1908622 - protein, 17 aa, Staphylococcus
LIAISVLLLFFWSTEKI

SEQ ID NO: 1908623 - protein, 24 aa, Staphylococcus
LIALILSIFLFFKGKKAYWFIFIG

SEQ ID NO: 1908624 - protein, 39 aa, Staphylococcus
LIDKVKYFFKEHWAKVLIVLAVILLIVLINAIFNNVDHN

SEQ ID NO: 1908625 - protein, 23 aa, Staphylococcus
LIFALIIPILYRFFKKIHLGWFV

SEQ ID NO: 1908626 - protein, 19 aa, Staphylococcus
LIFGAFAFFWFVGIHGPSI

SEQ ID NO: 1908627 - protein, 24 aa, Staphylococcus
LIFLSLVLVVVPIIFAIILLKSSQ

SEQ ID NO: 1908628 - protein, 17 aa, Staphylococcus
LIGLFILILVILLARAT

SEQ ID NO: 1908629 - protein, 23 aa, Staphylococcus
LIGLSMFFVSYLPTQRLTSRKYL

SEQ ID NO: 1908630 - protein, 17 aa, Staphylococcus
LIHPLLILFFSALAFIV

SEQ ID NO: 1908631 - protein, 22 aa, Staphylococcus
LIIFAIFFISGTVTWFAFDKAK

SEQ ID NO: 1908632 - protein, 17 aa, Staphylococcus
LIIFIILLSGLTFLPDL

SEQ ID NO: 1908633 - protein, 18 aa, Staphylococcus
LIIFLFVGLIGASLSFIK

SEQ ID NO: 1908634 - protein, 17 aa, Staphylococcus
LIIISVLLLFFWSTEKI

SEQ ID NO: 1908635 - protein, 19 aa, Staphylococcus
LIILILQRFTRGFLKSIAI

SEQ ID NO: 1908636 - protein, 21 aa, Staphylococcus
LIIPIFFFIIAIMMFARKSKV

SEQ ID NO: 1908637 - protein, 17 aa, Staphylococcus
LIIVVLVIVIPLFGGKG

SEQ ID NO: 1908638 - protein, 20 aa, Staphylococcus
LIKVLKPYYPFPIIVDDAFV

SEQ ID NO: 1908639 - protein, 19 aa, Staphylococcus
LILILIGSLILATLFFFGL

SEQ ID NO: 1908640 - protein, 19 aa, Staphylococcus
LILISTITIISFIGLGAIV

SEQ ID NO: 1908641 - protein, 20 aa, Staphylococcus
LILIVVVVGFGIYFYASKDK

SEQ ID NO: 1908642 - protein, 21 aa, Staphylococcus
LILSVFLFFKGKKAYWFIFIA

SEQ ID NO: 1908643 - protein, 22 aa, Staphylococcus
LILVVIIYKYLLLKYDMTQLTK

SEQ ID NO: 1908644 - protein, 18 aa, Staphylococcus
LIMGILVAVIFGLALTAP

SEQ ID NO: 1908645 - protein, 19 aa, Staphylococcus
LIMLFIMDWQMTLLTFITI

SEQ ID NO: 1908646 - protein, 18 aa, Staphylococcus
LISAYVLGILFFATSRFS

SEQ ID NO: 1908647 - protein, 19 aa, Staphylococcus
LISIVLTYLVWNYTPDLNN

SEQ ID NO: 1908648 - protein, 17 aa, Staphylococcus
LISLISLYIAFAGKIPK

SEQ ID NO: 1908649 - protein, 22 aa, Staphylococcus
LITFLPLLFIPFLGDLGLATTT

SEQ ID NO: 1908650 - protein, 24 aa, Staphylococcus
LITKVVVLTLFGLGFIIFGICMKP

SEQ ID NO: 1908651 - protein, 21 aa, Staphylococcus
LITLFIVIIIAIVLGFLLKNH

SEQ ID NO: 1908652 - protein, 20 aa, Staphylococcus
LIVFFLLIALTTVFVGSEFA

SEQ ID NO: 1908653 - protein, 19 aa, Staphylococcus
LIVILIATIAVSFTFYLFQ

SEQ ID NO: 1908654 - protein, 25 aa, Staphylococcus
LIVILLLTIIISFIFFMITKKDNYD

SEQ ID NO: 1908655 - protein, 18 aa, Staphylococcus
LIVLFYLSLSETALTAAN

SEQ ID NO: 1908656 - protein, 28 aa, Staphylococcus
LIVVICFVLFLILLFMFLNYNDEDNGTI

SEQ ID NO: 1908657 - protein, 24 aa, Staphylococcus
LKEVPLILLITIIIDVFLALITSY

SEQ ID NO: 1908658 - protein, 18 aa, Staphylococcus
LKHIIVTIFLIGLMFMII

SEQ ID NO: 1908659 - protein, 25 aa, Staphylococcus
LKKNLKWLIILPLVFLVVGMILTFF

SEQ ID NO: 1908660 - protein, 17 aa, Staphylococcus
LKSIPIFIALIALIVLI

SEQ ID NO: 1908661 - protein, 18 aa, Staphylococcus
LLAKFKTDGFIKVNLDWQ

SEQ ID NO: 1908662 - protein, 18 aa, Staphylococcus
LLCYLGFQFGLKKRDEML

SEQ ID NO: 1908663 - protein, 24 aa, Staphylococcus
LLETIWFIVPFIILFALAIPTVKT

SEQ ID NO: 1908664 - protein, 17 aa, Staphylococcus
LLFDPYTIVKKNGIRYG

SEQ ID NO: 1908665 - protein, 17 aa, Staphylococcus
LLFPIYFLSLAQTPGML

SEQ ID NO: 1908666 - protein, 25 aa, Staphylococcus
LLFVVLLGLWLLFKDKHQKQHSVLR

SEQ ID NO: 1908667 - protein, 19 aa, Staphylococcus
LLHPLFNLLQLPDALTTTI

SEQ ID NO: 1908668 - protein, 31 aa, Staphylococcus
LLIALAIYVFRFIWVFILFKQFYYPNNIQSY

SEQ ID NO: 1908669 - protein, 17 aa, Staphylococcus
LLIFFASTIITPFSEAD

SEQ ID NO: 1908670 - protein, 23 aa, Staphylococcus
LLIFFIAFGLLSLTSYAAEVPDT

SEQ ID NO: 1908671 - protein, 21 aa, Staphylococcus
LLIFGIWITLLPPLPFKILGL

SEQ ID NO: 1908672 - protein, 25 aa, Staphylococcus
LLIIPFLILAFLISKLIPLFYIRKW

SEQ ID NO: 1908673 - protein, 21 aa, Staphylococcus
LLILFFYLFSDGLRDAFDPKM

SEQ ID NO: 1908674 - protein, 19 aa, Staphylococcus
LLILMFMFLAKIKLWFLIK

SEQ ID NO: 1908675 - protein, 18 aa, Staphylococcus
LLINIFLISAFILNLIFA

SEQ ID NO: 1908676 - protein, 25 aa, Staphylococcus
LLKKWYLFLYLFLMIIALITTLTIL

SEQ ID NO: 1908677 - protein, 17 aa, Staphylococcus
LLLIFPALLGYFLGNFA

SEQ ID NO: 1908678 - protein, 19 aa, Staphylococcus
LLLIIAFTLILFQSYIFLK

SEQ ID NO: 1908679 - protein, 17 aa, Staphylococcus
LLLIIFSLAFYPAYNPK

SEQ ID NO: 1908680 - protein, 19 aa, Staphylococcus
LLLISTITIISFIGLGAII

SEQ ID NO: 1908681 - protein, 20 aa, Staphylococcus
LLLLCTITIISFIGLGAILH

SEQ ID NO: 1908682 - protein, 18 aa, Staphylococcus
LLLLSTITIISFIGLGVI

SEQ ID NO: 1908683 - protein, 19 aa, Staphylococcus
LLLVLMWFFLIRPQQKRAK

SEQ ID NO: 1908684 - protein, 17 aa, Staphylococcus
LLMIVFRSIIIPLKAVL

SEQ ID NO: 1908685 - protein, 20 aa, Staphylococcus
LLMTMLVHLFHLPLPSMLMN

SEQ ID NO: 1908686 - protein, 18 aa, Staphylococcus
LLNGIRKIMEVGLEGSFD

SEQ ID NO: 1908687 - protein, 17 aa, Staphylococcus
LLPFIFALIIPIVYRFI

SEQ ID NO: 1908688 - protein, 18 aa, Staphylococcus
LLPLIFALIIPFVYRFYK

SEQ ID NO: 1908689 - protein, 17 aa, Staphylococcus
LLPLIFALIIPILYRFF

SEQ ID NO: 1908690 - protein, 26 aa, Staphylococcus
LLPLIFALIIPILYRFFKKIHLGWFV

SEQ ID NO: 1908691 - protein, 23 aa, Staphylococcus
LLPLLLFVLLFLGVGIISGDFTT

SEQ ID NO: 1908692 - protein, 17 aa, Staphylococcus
LLPYFIFFAFYSVYYFL

SEQ ID NO: 1908693 - protein, 17 aa, Staphylococcus
LLRLFIMFTLASLAFVI

SEQ ID NO: 1908694 - protein, 23 aa, Staphylococcus
LLSVINPEVQVKPFALDEIQQQA

SEQ ID NO: 1908695 - protein, 22 aa, Staphylococcus
LLSYIFFVIFTPLVAFMLMRIM

SEQ ID NO: 1908696 - protein, 18 aa, Staphylococcus
LLTFIIWITVVHTGQFEP

SEQ ID NO: 1908697 - protein, 17 aa, Staphylococcus
LLTILGLIYFYLPNREM

SEQ ID NO: 1908698 - protein, 17 aa, Staphylococcus
LLVIGWYGYKKATGNVS

SEQ ID NO: 1908699 - protein, 17 aa, Staphylococcus
LLVLMWFFLIRPQQKKA

SEQ ID NO: 1908700 - protein, 17 aa, Staphylococcus
LLVLPITVLVSGVFVYL

SEQ ID NO: 1908701 - protein, 18 aa, Staphylococcus
LLVMIFISAFALRNGFLR

SEQ ID NO: 1908702 - protein, 25 aa, Staphylococcus
LLVQGIIFFILYYAIFRFVIQVFNL

SEQ ID NO: 1908703 - protein, 17 aa, Staphylococcus
LLWGILPIYWRLIGNIS

SEQ ID NO: 1908704 - protein, 17 aa, Staphylococcus
LLYLFMSSFIIFLLVEK

SEQ ID NO: 1908705 - protein, 17 aa, Staphylococcus
LLYLLFCWTEIPGVIGM

SEQ ID NO: 1908706 - protein, 19 aa, Staphylococcus
LMAIGFICSLPFLSPLLGP

SEQ ID NO: 1908707 - protein, 18 aa, Staphylococcus
LMDKLNMLDIDKIENILS

SEQ ID NO: 1908708 - protein, 23 aa, Staphylococcus
LMEWIFFTYLLLGVFFALYCMTL

SEQ ID NO: 1908709 - protein, 23 aa, Staphylococcus
LMIFMLWILLGWKVAVVYFVVLA

SEQ ID NO: 1908710 - protein, 18 aa, Staphylococcus
LMILLTVILYYGSKRLQD

SEQ ID NO: 1908711 - protein, 18 aa, Staphylococcus
LMLFFELLILFIIVSFIV

SEQ ID NO: 1908712 - protein, 17 aa, Staphylococcus
LMLFFELLLLFIIVSFI

SEQ ID NO: 1908713 - protein, 18 aa, Staphylococcus
LMLFFELLVLFIVVSFIV

SEQ ID NO: 1908714 - protein, 24 aa, Staphylococcus
LMLPGFALILSTSFLSPSVFAAEN

SEQ ID NO: 1908715 - protein, 25 aa, Staphylococcus
LMNMLIPFLLIWIIDGFKGIKETLP

SEQ ID NO: 1908716 - protein, 24 aa, Staphylococcus
LNFFHGWPWYAIWLVLLGFGGGMI

SEQ ID NO: 1908717 - protein, 23 aa, Staphylococcus
LPFILLLIIIIVFIVLLIINHSE

SEQ ID NO: 1908718 - protein, 29 aa, Staphylococcus
LPIFISGAIFIIFVLLPSSWFTGLVNKKT

SEQ ID NO: 1908719 - protein, 22 aa, Staphylococcus
LPIFSILFFLVAWFFARKPSKI

SEQ ID NO: 1908720 - protein, 18 aa, Staphylococcus
LPILLFSVYFLISLSVVH

SEQ ID NO: 1908721 - protein, 17 aa, Staphylococcus
LPILLLVLMWFFLIRPQ

SEQ ID NO: 1908722 - protein, 30 aa, Staphylococcus
LPKFLTLFAGPLFNFILAIVLFIGLAYYHG

SEQ ID NO: 1908723 - protein, 35 aa, Staphylococcus
LPKFLTLFAGPLFNFILALILFIALAYFQGTPTTS

SEQ ID NO: 1908724 - protein, 20 aa, Staphylococcus
LPKFLTLFAGPLFNFILALV

SEQ ID NO: 1908725 - protein, 35 aa, Staphylococcus
LPKFLTLFAGPLFNFILALVLFIGLAYYQGTPTPT

SEQ ID NO: 1908726 - protein, 21 aa, Staphylococcus
LPLLLCLFIMIPRIKLLQVGD

SEQ ID NO: 1908727 - protein, 20 aa, Staphylococcus
LPLLLFVLLFLGVGIISGDF

SEQ ID NO: 1908728 - protein, 21 aa, Staphylococcus
LPLVLLFITLIIPIFFFITAI

SEQ ID NO: 1908729 - protein, 19 aa, Staphylococcus
LPLVLLFVTLIIPIFFFII

SEQ ID NO: 1908730 - protein, 31 aa, Staphylococcus
LPMLNLPIIPIWLSRFWVRLISQVPKEMVYP

SEQ ID NO: 1908731 - protein, 22 aa, Staphylococcus
LPRFFFYLLLFMFSMLGIVLSN

SEQ ID NO: 1908732 - protein, 22 aa, Staphylococcus
LPRFFIYLLLFMFAMLGIVVSN

SEQ ID NO: 1908733 - protein, 21 aa, Staphylococcus
LPRFFLYLLLFMFSMLGIVVS

SEQ ID NO: 1908734 - protein, 32 aa, Staphylococcus
LQIQMWKYIALIGLFVIIIIFLVVRSINRTYI

SEQ ID NO: 1908735 - protein, 27 aa, Staphylococcus
LQKDTNYFKFQYFNPLKSRDYYKNLDK

SEQ ID NO: 1908736 - protein, 31 aa, Staphylococcus
LQKNMWKYLSLIGIIVLIAIYLAVRSINRTY

SEQ ID NO: 1908737 - protein, 22 aa, Staphylococcus
LQKSMWKYLSLIGIIVLLAIYL

SEQ ID NO: 1908738 - protein, 23 aa, Staphylococcus
LRAMIYLGMFIFGLSIIYIIYLL

SEQ ID NO: 1908739 - protein, 28 aa, Staphylococcus
LRLSIILFMFILIILIVLLCINHKDILR

SEQ ID NO: 1908740 - protein, 21 aa, Staphylococcus
LRSIPFIILLIAIVPFTKLVA

SEQ ID NO: 1908741 - protein, 18 aa, Staphylococcus
LRSTLYGYDSNFTRVSMA

SEQ ID NO: 1908742 - protein, 21 aa, Staphylococcus
LRTMIYFGLFIFAISLIYIIY

SEQ ID NO: 1908743 - protein, 20 aa, Staphylococcus
LSAPFVILFFILEQFARAVG

SEQ ID NO: 1908744 - protein, 23 aa, Staphylococcus
LSAYAFMIFILLYIPCLSTVATI

SEQ ID NO: 1908745 - protein, 29 aa, Staphylococcus
LSCLGCFGIIFLILLLIGGCSAIFSDDNN

SEQ ID NO: 1908746 - protein, 17 aa, Staphylococcus
LSGLVCALLLFIIIMVL

SEQ ID NO: 1908747 - protein, 23 aa, Staphylococcus
LSLLILFFYLFSDGLRDAFDPKM

SEQ ID NO: 1908748 - protein, 17 aa, Staphylococcus
LSLLLLLYGLGGGFFLP

SEQ ID NO: 1908749 - protein, 17 aa, Staphylococcus
LSNALLLGLFLFGLLTS

SEQ ID NO: 1908750 - protein, 24 aa, Staphylococcus
LSPLWFILLGLIYLRYTRKARKLE

SEQ ID NO: 1908751 - protein, 26 aa, Staphylococcus
LSTIIIILLLIIFGILYIIFDTNLFN

SEQ ID NO: 1908752 - protein, 23 aa, Staphylococcus
LSTIVALLQLLTGDWRGAWQTMS

SEQ ID NO: 1908753 - protein, 20 aa, Staphylococcus
LSVFALFLVLTATSVCVTQA

SEQ ID NO: 1908754 - protein, 27 aa, Staphylococcus
LSVILVITILISFTFYFFNKEDKPDKD

SEQ ID NO: 1908755 - protein, 30 aa, Staphylococcus
LSVILVITILISFVFYYFNKEDRPDKDTLF

SEQ ID NO: 1908756 - protein, 29 aa, Staphylococcus
LSVILVITIVISFLFYFLTTEKKVDKDTL

SEQ ID NO: 1908757 - protein, 19 aa, Staphylococcus
LSWILLIFILLILAYRRSK

SEQ ID NO: 1908758 - protein, 22 aa, Staphylococcus
LTFAWFLPVLFALSGLLILLGL

SEQ ID NO: 1908759 - protein, 26 aa, Staphylococcus
LTIIFYIFFFLILITLVIIASRYVYK

SEQ ID NO: 1908760 - protein, 24 aa, Staphylococcus
LTILSSIFFPLTLLTGWFGMNFTN

SEQ ID NO: 1908761 - protein, 20 aa, Staphylococcus
LTKVFTLLFGKASLVRTVFG

SEQ ID NO: 1908762 - protein, 17 aa, Staphylococcus
LTLFIIFFGFTWGPVLW

SEQ ID NO: 1908763 - protein, 20 aa, Staphylococcus
LTLFLNFVILFISIILIIFG

SEQ ID NO: 1908764 - protein, 18 aa, Staphylococcus
LTLFLVIALVVWSFLYTG

SEQ ID NO: 1908765 - protein, 19 aa, Staphylococcus
LTLLILIIIIMISPSIYTK

SEQ ID NO: 1908766 - protein, 27 aa, Staphylococcus
LTMIVFVLLNTYLLRQLKSIGMFIIIV

SEQ ID NO: 1908767 - protein, 22 aa, Staphylococcus
LTPFWYIFLIIYILLGIYLAWQ

SEQ ID NO: 1908768 - protein, 22 aa, Staphylococcus
LTPIFFFLIFTFFMHIFFTNGG

SEQ ID NO: 1908769 - protein, 23 aa, Staphylococcus
LTPIWIFLIFTFLMHLFLTKGGS

SEQ ID NO: 1908770 - protein, 23 aa, Staphylococcus
LTRFEKFLYITLVTAIAVLAIYM

SEQ ID NO: 1908771 - protein, 20 aa, Staphylococcus
LTRPLSFYIDWIGNLSLGKL

SEQ ID NO: 1908772 - protein, 26 aa, Staphylococcus
LTVILIITIIISFVFYYFTSDEKVDK

SEQ ID NO: 1908773 - protein, 20 aa, Staphylococcus
LTWLIIIFILLILAYRRAKV

SEQ ID NO: 1908774 - protein, 17 aa, Staphylococcus
LVAIVIAFLLLNLPFVH

SEQ ID NO: 1908775 - protein, 20 aa, Staphylococcus
LVALILHFFLIYGGTIKFLA

SEQ ID NO: 1908776 - protein, 17 aa, Staphylococcus
LVFFFSLGLFKYADAHV

SEQ ID NO: 1908777 - protein, 25 aa, Staphylococcus
LVFNIILIALFILNLFFSFTIVFLE

SEQ ID NO: 1908778 - protein, 23 aa, Staphylococcus
LVIFVVFFLAATLVWFVHDKDIY

SEQ ID NO: 1908779 - protein, 19 aa, Staphylococcus
LVIGLIITIIALFSAIYFT

SEQ ID NO: 1908780 - protein, 17 aa, Staphylococcus
LVIIFILSFIFLGKPVF

SEQ ID NO: 1908781 - protein, 23 aa, Staphylococcus
LVIKIIMILIYIIVALIVIAILN

SEQ ID NO: 1908782 - protein, 18 aa, Staphylococcus
LVIQFIFAFLLLKTNVGI

SEQ ID NO: 1908783 - protein, 19 aa, Staphylococcus
LVIQLIFAFILLKTNIGIT

SEQ ID NO: 1908784 - protein, 19 aa, Staphylococcus
LVLCFIVFGITTGTSYAAE

SEQ ID NO: 1908785 - protein, 24 aa, Staphylococcus
LVLFIFTLIYFLVVLYLCINPGKI

SEQ ID NO: 1908786 - protein, 17 aa, Staphylococcus
LVLLWFNKRQRLPFSIE

SEQ ID NO: 1908787 - protein, 19 aa, Staphylococcus
LVLSVFLFFKGKKAFWFIF

SEQ ID NO: 1908788 - protein, 20 aa, Staphylococcus
LVLVLIIMTLFLKFAPYGKQ

SEQ ID NO: 1908789 - protein, 17 aa, Staphylococcus
LVMLIHVFPVHLLETIM

SEQ ID NO: 1908790 - protein, 19 aa, Staphylococcus
LVQWWHWIIQILHLDLGVS

SEQ ID NO: 1908791 - protein, 18 aa, Staphylococcus
LVTIVVFLPLVFVSGSVG

SEQ ID NO: 1908792 - protein, 24 aa, Staphylococcus
LVTTPFVLFFFLKDGHHFKETAIK

SEQ ID NO: 1908793 - protein, 22 aa, Staphylococcus
LVVVYVLLIIIGMQIIGLYFTN

SEQ ID NO: 1908794 - protein, 18 aa, Staphylococcus
LVYDVFFNNDGVNFISPG

SEQ ID NO: 1908795 - protein, 18 aa, Staphylococcus
LWAAFFALTFFIIYSTRT

SEQ ID NO: 1908796 - protein, 20 aa, Staphylococcus
LWIAPIAGILLLIIFSLAFY

SEQ ID NO: 1908797 - protein, 23 aa, Staphylococcus
LWIFIVLWIILFFVIIAFLLYRR

SEQ ID NO: 1908798 - protein, 19 aa, Staphylococcus
LYAIIFVGLIIFLSIIVFI

SEQ ID NO: 1908799 - protein, 31 aa, Staphylococcus
LYAIKQWKFQLSIIILVIISIALFLIYSKSD

SEQ ID NO: 1908800 - protein, 19 aa, Staphylococcus
LYHYLLILSFFFLALFQVH

SEQ ID NO: 1908801 - protein, 17 aa, Staphylococcus
LYILLIVGIITVVDSYM

SEQ ID NO: 1908802 - protein, 20 aa, Staphylococcus
LYIWLLIGFIFGFAPPLQTT

SEQ ID NO: 1908803 - protein, 17 aa, Staphylococcus
LYPLFMSMFWIVGTVIY

SEQ ID NO: 1908804 - protein, 18 aa, Staphylococcus
LYQYNINKTWYPASMTKL

SEQ ID NO: 1908805 - protein, 20 aa, Staphylococcus
LYTLIWFIIGIFIYLLYGMR

SEQ ID NO: 1908806 - protein, 23 aa, Staphylococcus
LYTLIWFIIGIVYYLFYLVKTNR

SEQ ID NO: 1908807 - protein, 17 aa, Staphylococcus
LYWKILLIFIYTLLNAN

SEQ ID NO: 1908808 - protein, 22 aa, Staphylococcus
LYYLIMLIIVGIILATLYFLYV

SEQ ID NO: 1908809 - protein, 18 aa, Staphylococcus
MAILIWTLGIQSSAWIII

SEQ ID NO: 1908810 - protein, 24 aa, Staphylococcus
MAPIMPIIIIPILASLVVGLIFIF

SEQ ID NO: 1908811 - protein, 25 aa, Staphylococcus
MAPIMPIIIIPILASLVVGLIFIFI

SEQ ID NO: 1908812 - protein, 31 aa, Staphylococcus
MDKRINFFFGLVVIVFVIIVLRLGYLQIAQG

SEQ ID NO: 1908813 - protein, 18 aa, Staphylococcus
MFILLFLNGWFQGMGWPP

SEQ ID NO: 1908814 - protein, 18 aa, Staphylococcus
MFIMLFLNGWFQGMGWPP

SEQ ID NO: 1908815 - protein, 17 aa, Staphylococcus
MFIPLFFIFKYKQPMFG

SEQ ID NO: 1908816 - protein, 17 aa, Staphylococcus
MFIPLFFIIKYRQPILG

SEQ ID NO: 1908817 - protein, 22 aa, Staphylococcus
MFITFIILYIILHKTIFGRQTY

SEQ ID NO: 1908818 - protein, 17 aa, Staphylococcus
MFLSMIVLLLIALVFLL

SEQ ID NO: 1908819 - protein, 18 aa, Staphylococcus
MFLTLIIILFILLFLYFY

SEQ ID NO: 1908820 - protein, 19 aa, Staphylococcus
MFYGMFFIGLVAIAVGFFW

SEQ ID NO: 1908821 - protein, 35 aa, Staphylococcus
MGTGAKVISIITVLLLLGGLVFAVFSFVDHSNRAN

SEQ ID NO: 1908822 - protein, 23 aa, Staphylococcus
MGTWYIIGFIVLLILAIIATLLI

SEQ ID NO: 1908823 - protein, 21 aa, Staphylococcus
MIATLLVIPWLSAKKARQIKK

SEQ ID NO: 1908824 - protein, 18 aa, Staphylococcus
MIIFLREGLEVLLIILTL

SEQ ID NO: 1908825 - protein, 27 aa, Staphylococcus
MKFFPFIIFIFLWVILIYSPVAHWVWG

SEQ ID NO: 1908826 - protein, 25 aa, Staphylococcus
MKIVPVFFLLLFFSMQLLMLPEQML

SEQ ID NO: 1908827 - protein, 18 aa, Staphylococcus
MKLFVIAFTLGISLNNDT

SEQ ID NO: 1908828 - protein, 17 aa, Staphylococcus
MLAIMMLFLFILNNIKI

SEQ ID NO: 1908829 - protein, 17 aa, Staphylococcus
MLFHPFNPYYIFKIRVP

SEQ ID NO: 1908830 - protein, 18 aa, Staphylococcus
MLPMFVFLAAPKYIKIPH

SEQ ID NO: 1908831 - protein, 23 aa, Staphylococcus
MLRITFVLLAIVGAGLAVFSFVT

SEQ ID NO: 1908832 - protein, 18 aa, Staphylococcus
MLSLFPMLLFLMSLLPLF

SEQ ID NO: 1908833 - protein, 19 aa, Staphylococcus
MMILQYLVLLWFNKRQRLP

SEQ ID NO: 1908834 - protein, 18 aa, Staphylococcus
MMIMMCLVLISPTVFAEQ

SEQ ID NO: 1908835 - protein, 22 aa, Staphylococcus
MMLLTLLLIVVPVIFIVNLYHH

SEQ ID NO: 1908836 - protein, 27 aa, Staphylococcus
MMLLTLVLIVVPVIFIINLYKTSESAM

SEQ ID NO: 1908837 - protein, 22 aa, Staphylococcus
MMLTPFWYIFLGIYVLFIAFII

SEQ ID NO: 1908838 - protein, 21 aa, Staphylococcus
MMPLLFIFLLIIVIKSLTLDG

SEQ ID NO: 1908839 - protein, 17 aa, Staphylococcus
MMPLLFVFLILIVIKSL

SEQ ID NO: 1908840 - protein, 19 aa, Staphylococcus
MNALFFFFSAFAIPFMLKK

SEQ ID NO: 1908841 - protein, 33 aa, Staphylococcus
MNHRINFIFGLIVFIFVIIVLRLGYLQIAQGSH

SEQ ID NO: 1908842 - protein, 29 aa, Staphylococcus
MNLPLKIFLWMFGILVLLAIIAVIYVAAK

SEQ ID NO: 1908843 - protein, 32 aa, Staphylococcus
MNRRINFIFGLVVFIFAIMVLRLGYLQIAQGS

SEQ ID NO: 1908844 - protein, 17 aa, Staphylococcus
MPEFLIVIYHGGLDQLN

SEQ ID NO: 1908845 - protein, 18 aa, Staphylococcus
MPMLILSLLFFAIGTYFV

SEQ ID NO: 1908846 - protein, 25 aa, Staphylococcus
MRFFPFMIFIFIWVLVIYSPVAHWV

SEQ ID NO: 1908847 - protein, 23 aa, Staphylococcus
MSKLSSYLKVSCSALILSSSLVG

SEQ ID NO: 1908848 - protein, 22 aa, Staphylococcus
MSPILLAWIVTAVLRIALGSAT

SEQ ID NO: 1908849 - protein, 27 aa, Staphylococcus
MSRTLCYYFWLPFGPVLYSYLDGSIFL

SEQ ID NO: 1908850 - protein, 23 aa, Staphylococcus
MSSWTLYYWGWWLSWSPFVGVFI

SEQ ID NO: 1908851 - protein, 24 aa, Staphylococcus
MSSWTLYYWGWWLSWSPFVGVFIA

SEQ ID NO: 1908852 - protein, 22 aa, Staphylococcus
MSTWTLYYWGWWLSWSPFVGVF

SEQ ID NO: 1908853 - protein, 17 aa, Staphylococcus
MSVVLTYMIWNFTPDLT

SEQ ID NO: 1908854 - protein, 18 aa, Staphylococcus
MVFMLWVLLGWKVAIVYF

SEQ ID NO: 1908855 - protein, 17 aa, Staphylococcus
MVLLVIIGGIYSSAKLK

SEQ ID NO: 1908856 - protein, 19 aa, Staphylococcus
MVRHPIILLPIFTNALITG

SEQ ID NO: 1908857 - protein, 23 aa, Staphylococcus
MVTAPFIPMFYIIFGLKTRDESK

SEQ ID NO: 1908858 - protein, 24 aa, Staphylococcus
MVTAPFIPVFYILFGLKTRDESKD

SEQ ID NO: 1908859 - protein, 18 aa, Staphylococcus
MYLIIIYAIRMFAVSLLM

SEQ ID NO: 1908860 - protein, 18 aa, Staphylococcus
NADDNYFRYGGYNEYVKT

SEQ ID NO: 1908861 - protein, 27 aa, Staphylococcus
NAWALFPLLLFMLLFLGVGIISGDFTT

SEQ ID NO: 1908862 - protein, 35 aa, Staphylococcus
NDADNWTLDSGFYKTPVKYSLGDYVWYDSNQDGIQ

SEQ ID NO: 1908863 - protein, 17 aa, Staphylococcus
NDKYLIRMLPIDDIKLT

SEQ ID NO: 1908864 - protein, 31 aa, Staphylococcus
NEDKHNGLIPLLTALGGIILLRRRRNNEIQD

SEQ ID NO: 1908865 - protein, 26 aa, Staphylococcus
NENPNIRQFFLFDLTSRLIGRDDNVN

SEQ ID NO: 1908866 - protein, 17 aa, Staphylococcus
NETGHVTIIPQQWIPKG

SEQ ID NO: 1908867 - protein, 45 aa, Staphylococcus
NFEYIKNAIIAFFKEHWPKLLIIIGIILLLLILNAIFTTVNKNDH

SEQ ID NO: 1908868 - protein, 20 aa, Staphylococcus
NFFHGWPWYAVWLVMLGFGG

SEQ ID NO: 1908869 - protein, 21 aa, Staphylococcus
NFFIPFLLIFIIDGLKGVKET

SEQ ID NO: 1908870 - protein, 18 aa, Staphylococcus
NFFVWIPLIVIIICLMFK

SEQ ID NO: 1908871 - protein, 23 aa, Staphylococcus
NFIEMLMVLFILSILLVCTISSK

SEQ ID NO: 1908872 - protein, 20 aa, Staphylococcus
NFWLLILIIPTWINLLLKTY

SEQ ID NO: 1908873 - protein, 29 aa, Staphylococcus
NGDDLPTNGFLFYWNPKTTGSNTSQWQSL

SEQ ID NO: 1908874 - protein, 22 aa, Staphylococcus
NGHKLTTFIKNNEGRWIVQNGE

SEQ ID NO: 1908875 - protein, 22 aa, Staphylococcus
NGHVNITPDHYLFEGNITAKAY

SEQ ID NO: 1908876 - protein, 24 aa, Staphylococcus
NGKVNFLPIKFNKVGTYIYQITEQ

SEQ ID NO: 1908877 - protein, 17 aa, Staphylococcus
NGLIRDEAWLKKKLNYI

SEQ ID NO: 1908878 - protein, 45 aa, Staphylococcus
NGNKKRGLMGILLPLIALLLILAALAIFIGMYLNNDHKEKNNNTA

SEQ ID NO: 1908879 - protein, 41 aa, Staphylococcus
NGQEPKKSGGLKKLLPLLLGLLIIAAIAIFGGMALTNQGDH

SEQ ID NO: 1908880 - protein, 25 aa, Staphylococcus
NGWGWVWFWWLVFPASIGSFGLWFS

SEQ ID NO: 1908881 - protein, 25 aa, Staphylococcus
NHAKPPVFLVRILTLFASFLIGLTL

SEQ ID NO: 1908882 - protein, 17 aa, Staphylococcus
NHLVFANTSYEILGGGK

SEQ ID NO: 1908883 - protein, 25 aa, Staphylococcus
NHWGWIWFFWLIIPASVGSFGLWFY

SEQ ID NO: 1908884 - protein, 22 aa, Staphylococcus
NIGLTCIFLVFTFLREVKLYQH

SEQ ID NO: 1908885 - protein, 24 aa, Staphylococcus
NIIRWILILLILIPFVLILAGLFD

SEQ ID NO: 1908886 - protein, 20 aa, Staphylococcus
NIKFLILISLLIALAIYVVR

SEQ ID NO: 1908887 - protein, 24 aa, Staphylococcus
NIKFLIMFTLLIALAIYVFRFIWV

SEQ ID NO: 1908888 - protein, 19 aa, Staphylococcus
NILHLLYLGFIALMVSMMG

SEQ ID NO: 1908889 - protein, 20 aa, Staphylococcus
NILNIPSWLELDPDAKGNRF

SEQ ID NO: 1908890 - protein, 20 aa, Staphylococcus
NIMILLIFRFLMGIAIGMDS

SEQ ID NO: 1908891 - protein, 22 aa, Staphylococcus
NINFFVWIPLIVIIICLLMKMS

SEQ ID NO: 1908892 - protein, 22 aa, Staphylococcus
NISPYLPFTYLIDCLREVVGGI

SEQ ID NO: 1908893 - protein, 39 aa, Staphylococcus
NKIVDFLKEHWIKILIAIALILILVLVKAIFTEPSQEQH

SEQ ID NO: 1908894 - protein, 24 aa, Staphylococcus
NKKTWIIASIIIVVIIALIALFLI

SEQ ID NO: 1908895 - protein, 25 aa, Staphylococcus
NKLVIIVGCALVLLLAICCYKFLNV

SEQ ID NO: 1908896 - protein, 35 aa, Staphylococcus
NKNKQVRFKLWQFLLILLGVILITAGITVAATILI

SEQ ID NO: 1908897 - protein, 23 aa, Staphylococcus
NKSAFMFIIPILAGYIARSIADK

SEQ ID NO: 1908898 - protein, 20 aa, Staphylococcus
NLDMIKSPHPSYPAGYGLSS

SEQ ID NO: 1908899 - protein, 23 aa, Staphylococcus
NLFHGWPWYAIWLVLLGFGGGMI

SEQ ID NO: 1908900 - protein, 20 aa, Staphylococcus
NLFLAWFFIYFPWGKSGIKA

SEQ ID NO: 1908901 - protein, 24 aa, Staphylococcus
NLFLAWFFVFFPWGNWFVSKMADG

SEQ ID NO: 1908902 - protein, 21 aa, Staphylococcus
NLFLFLYKNFSFPLLFLVIIF

SEQ ID NO: 1908903 - protein, 25 aa, Staphylococcus
NLGLTAMFLIFTFLKEVKLYQHLYN

SEQ ID NO: 1908904 - protein, 24 aa, Staphylococcus
NLIEWLYFTFLLLSVFFAIYCMAL

SEQ ID NO: 1908905 - protein, 36 aa, Staphylococcus
NLKFKKFIPWVIITFIIILIGIVFILLKNFNSPEAQ

SEQ ID NO: 1908906 - protein, 25 aa, Staphylococcus
NLKNKYSIRKFTVGTASILLGSLLF

SEQ ID NO: 1908907 - protein, 24 aa, Staphylococcus
NLLAKAHPIIYYYTAIDPVEVTLK

SEQ ID NO: 1908908 - protein, 24 aa, Staphylococcus
NLLMLTPFLPILSILIIVFNKNLG

SEQ ID NO: 1908909 - protein, 17 aa, Staphylococcus
NLLTIFYLSWYSTIYWL

SEQ ID NO: 1908910 - protein, 24 aa, Staphylococcus
NLMRISLIILAIIGIGLTVFSFVS

SEQ ID NO: 1908911 - protein, 23 aa, Staphylococcus
NLSLLYCFILLTLLTTFICYKNY

SEQ ID NO: 1908912 - protein, 26 aa, Staphylococcus
NLTNGNYLVEFVMPEGYIPTQANSTV

SEQ ID NO: 1908913 - protein, 18 aa, Staphylococcus
NLYNYWPNQNTPGDSSAQ

SEQ ID NO: 1908914 - protein, 18 aa, Staphylococcus
NLYRIAIQYYGNGSPENV

SEQ ID NO: 1908915 - protein, 31 aa, Staphylococcus
NMLTLVVVLLFILFIILLFMFMNHNDQDSNR

SEQ ID NO: 1908916 - protein, 24 aa, Staphylococcus
NNKKIFLFVMILITIICVCLAIFY

SEQ ID NO: 1908917 - protein, 25 aa, Staphylococcus
NNLFMICPFIPFIGLIICFISPSTG

SEQ ID NO: 1908918 - protein, 28 aa, Staphylococcus
NNLQENTGYFKYQYFNPLDAQQYYDNLD

SEQ ID NO: 1908919 - protein, 20 aa, Staphylococcus
NNPSTLLYKGTPKTSSQPFG

SEQ ID NO: 1908920 - protein, 26 aa, Staphylococcus
NNTKWRLFSKPIISTLFLILGIVSSM

SEQ ID NO: 1908921 - protein, 23 aa, Staphylococcus
NNTTIISGILPDTVKKAAARKAI

SEQ ID NO: 1908922 - protein, 20 aa, Staphylococcus
NPEYPMFYTPSAVDYSSFMS

SEQ ID NO: 1908923 - protein, 22 aa, Staphylococcus
NPLLFLLKKLKWPIGLIIVAVS

SEQ ID NO: 1908924 - protein, 25 aa, Staphylococcus
NPNEPYFVKYLYDPDNKDISPEGIT

SEQ ID NO: 1908925 - protein, 21 aa, Staphylococcus
NPSMYGYLVKGWLALHEVGHG

SEQ ID NO: 1908926 - protein, 25 aa, Staphylococcus
NPTKALVWIFLIQAIILLLVGATVH

SEQ ID NO: 1908927 - protein, 18 aa, Staphylococcus
NPYYIFKIRVPFTPGLIP

SEQ ID NO: 1908928 - protein, 27 aa, Staphylococcus
NQRQKLLRLAFIALAIIGAALTVFSFV

SEQ ID NO: 1908929 - protein, 17 aa, Staphylococcus
NQTYFVMTLLNREWWES

SEQ ID NO: 1908930 - protein, 23 aa, Staphylococcus
NSDWRFMMSWLPLQVKITLFSFV

SEQ ID NO: 1908931 - protein, 25 aa, Staphylococcus
NSFGWLFLLIIFILDIFLISLAISR

SEQ ID NO: 1908932 - protein, 25 aa, Staphylococcus
NSFGWLFLLIIFILDVFLISLAVSR

SEQ ID NO: 1908933 - protein, 25 aa, Staphylococcus
NSIPPWMLIIFWAASIVILLGTVMI

SEQ ID NO: 1908934 - protein, 24 aa, Staphylococcus
NSISPWIFVIFWVASIVILLGTIM

SEQ ID NO: 1908935 - protein, 28 aa, Staphylococcus
NSIWAWLLVLVFLPLLGFILYLLFGRQI

SEQ ID NO: 1908936 - protein, 22 aa, Staphylococcus
NSKLLGTPSLFDDLFNRNSILD

SEQ ID NO: 1908937 - protein, 22 aa, Staphylococcus
NSRFLTYILILIGTIFITYYKA

SEQ ID NO: 1908938 - protein, 19 aa, Staphylococcus
NSYDTWLTIQGYQNQVNDS

SEQ ID NO: 1908939 - protein, 25 aa, Staphylococcus
NTFGWLFLLIIFILDIFLISLATSR

SEQ ID NO: 1908940 - protein, 31 aa, Staphylococcus
NTGITNYQHPIVPIMFTFGISIFVSSLKRRK

SEQ ID NO: 1908941 - protein, 19 aa, Staphylococcus
NTKVNLYNYWPNQNTPGDS

SEQ ID NO: 1908942 - protein, 23 aa, Staphylococcus
NVFTQLGPLFLWVAQGLDSLGKK

SEQ ID NO: 1908943 - protein, 45 aa, Staphylococcus
NVKRTIIKIIGFLLIAFIVLVLLGILLFAYYAWKAPAFTESKLQD

SEQ ID NO: 1908944 - protein, 25 aa, Staphylococcus
NVLAIFPWFIIAIPLILILSYQLDI

SEQ ID NO: 1908945 - protein, 19 aa, Staphylococcus
NVLIKQIIPEIFAEPRYTV

SEQ ID NO: 1908946 - protein, 24 aa, Staphylococcus
NVMFYMMFILGLLAFLFGLAWFKI

SEQ ID NO: 1908947 - protein, 18 aa, Staphylococcus
NVSNIKIQLIPNNDIMGN

SEQ ID NO: 1908948 - protein, 23 aa, Staphylococcus
NVVRSLYFVAIAFGLLATFIMAG

SEQ ID NO: 1908949 - protein, 20 aa, Staphylococcus
NWRLLFILLGILGLIWVVIW

SEQ ID NO: 1908950 - protein, 29 aa, Staphylococcus
NYFKYFAMAITIILLSILALGIHKMIESN

SEQ ID NO: 1908951 - protein, 25 aa, Staphylococcus
NYKNKLSRQFKISSAILVITSSLIG

SEQ ID NO: 1908952 - protein, 30 aa, Staphylococcus
NYLKMLAMAIIIILLSMLALGIHKVIESNN

SEQ ID NO: 1908953 - protein, 17 aa, Staphylococcus
NYRTYYLSLWYFITFGA

SEQ ID NO: 1908954 - protein, 35 aa, Staphylococcus
PAAGKVLKLSVLPFAIIALVIGSTLIWVSRRKKHH

SEQ ID NO: 1908955 - protein, 22 aa, Staphylococcus
PCLLFFLIFNYIPMTSLILAFK

SEQ ID NO: 1908956 - protein, 26 aa, Staphylococcus
PDFVVRFWTILIASLICLAIVGALVV

SEQ ID NO: 1908957 - protein, 27 aa, Staphylococcus
PDILMNPWFQFILATPIQFIIGWQFYV

SEQ ID NO: 1908958 - protein, 21 aa, Staphylococcus
PEFFQIIHPFIPFSYAVDALR

SEQ ID NO: 1908959 - protein, 27 aa, Staphylococcus
PEIFMNPWFQFILATPIQFIIGWQFYV

SEQ ID NO: 1908960 - protein, 28 aa, Staphylococcus
PEYHKKRNAILKLYDIVDAQEAIINAVP

SEQ ID NO: 1908961 - protein, 18 aa, Staphylococcus
PFFFNVLLPIVFISALIG

SEQ ID NO: 1908962 - protein, 19 aa, Staphylococcus
PFFFNVLLPIVFISALIGI

SEQ ID NO: 1908963 - protein, 19 aa, Staphylococcus
PFFFSVLLPIVFISALIGI

SEQ ID NO: 1908964 - protein, 20 aa, Staphylococcus
PFNWLLFIGILLVGANLRAP

SEQ ID NO: 1908965 - protein, 19 aa, Staphylococcus
PFTLLPILIGFSAAKRFGG

SEQ ID NO: 1908966 - protein, 24 aa, Staphylococcus
PFTPLIVAAILYFILTFTLSRVMY

SEQ ID NO: 1908967 - protein, 23 aa, Staphylococcus
PFYTALAIWVGALLLVSLLTTDN

SEQ ID NO: 1908968 - protein, 22 aa, Staphylococcus
PGAVFWMWVIAFIGAASAFIEA

SEQ ID NO: 1908969 - protein, 22 aa, Staphylococcus
PGAVFWMWVIAFIGAASAFMEA

SEQ ID NO: 1908970 - protein, 24 aa, Staphylococcus
PGDMNFLRWTNIRDDYTISWSNDK

SEQ ID NO: 1908971 - protein, 22 aa, Staphylococcus
PGSEVQLYFIGTSMGNTNGING

SEQ ID NO: 1908972 - protein, 28 aa, Staphylococcus
PGSQQRLGMALLLPYKVMKLNSDGSFAS

SEQ ID NO: 1908973 - protein, 23 aa, Staphylococcus
PGYFTTIFAVLFLGSIQLISIGI

SEQ ID NO: 1908974 - protein, 20 aa, Staphylococcus
PIAAIGLLAPWVAGAAMALS

SEQ ID NO: 1908975 - protein, 18 aa, Staphylococcus
PIAAMGLLAPWIAGAAMA

SEQ ID NO: 1908976 - protein, 19 aa, Staphylococcus
PIAAMGLLAPWIAGAAMAL

SEQ ID NO: 1908977 - protein, 18 aa, Staphylococcus
PIFFLMFYSFNSGGNMIH

SEQ ID NO: 1908978 - protein, 21 aa, Staphylococcus
PIFIILFFYYVVRFIFRSAIK

SEQ ID NO: 1908979 - protein, 23 aa, Staphylococcus
PIFSIIFFLLAWFFARKPSKILD

SEQ ID NO: 1908980 - protein, 24 aa, Staphylococcus
PIFSILFFLIAWFFSRKPSKILDY

SEQ ID NO: 1908981 - protein, 25 aa, Staphylococcus
PIIFIILVIGIILWIIGIHPYAIFI

SEQ ID NO: 1908982 - protein, 20 aa, Staphylococcus
PILFFLIFTFLMHLFLTKGG

SEQ ID NO: 1908983 - protein, 21 aa, Staphylococcus
PILKAVFYSLPILFLIAFNRF

SEQ ID NO: 1908984 - protein, 17 aa, Staphylococcus
PIPTTVTIVGAPRSQPS

SEQ ID NO: 1908985 - protein, 24 aa, Staphylococcus
PIRDNTWSVYGYPNTLRLEESKGQ

SEQ ID NO: 1908986 - protein, 18 aa, Staphylococcus
PIVLVLLILFFFYSHYLF

SEQ ID NO: 1908987 - protein, 27 aa, Staphylococcus
PKKTKIILTIIILLVAILGSILGHMFS

SEQ ID NO: 1908988 - protein, 24 aa, Staphylococcus
PKRKDFVVSFITGAIIGSTIGLLY

SEQ ID NO: 1908989 - protein, 19 aa, Staphylococcus
PKWLVKLIIFIVLTFVSMA

SEQ ID NO: 1908990 - protein, 22 aa, Staphylococcus
PLAGAALLSGLALLSTRKNKKD

SEQ ID NO: 1908991 - protein, 21 aa, Staphylococcus
PLFIIVLLVIFFFLGFIVPSS

SEQ ID NO: 1908992 - protein, 17 aa, Staphylococcus
PLIGFVLYLFFGRTVSK

SEQ ID NO: 1908993 - protein, 25 aa, Staphylococcus
PLISALFFHYLFVKVLKIYNPNIFK

SEQ ID NO: 1908994 - protein, 21 aa, Staphylococcus
PLLSMFFFYSAFALPFIFDVG

SEQ ID NO: 1908995 - protein, 21 aa, Staphylococcus
PLRYIIAIIVVILVILGAFQL

SEQ ID NO: 1908996 - protein, 21 aa, Staphylococcus
PLRYIIAIVIIILVVLGAFQL

SEQ ID NO: 1908997 - protein, 20 aa, Staphylococcus
PLRYILAIAIFVIIVLGAFQ

SEQ ID NO: 1908998 - protein, 19 aa, Staphylococcus
PLVFLFLFAWKKVPAIPTL

SEQ ID NO: 1908999 - protein, 38 aa, Staphylococcus
PNRHNKYAIRRFTVGTASILVGATLIFGVNHEAKAAET

SEQ ID NO: 1909000 - protein, 25 aa, Staphylococcus
PNRLNKYSIRKFTVGTASILVGATL

SEQ ID NO: 1909001 - protein, 21 aa, Staphylococcus
PPFFFNVLLPIVFISALIGIL

SEQ ID NO: 1909002 - protein, 20 aa, Staphylococcus
PPFFFSVLLPIVFISAIIGI

SEQ ID NO: 1909003 - protein, 27 aa, Staphylococcus
PQPGKPKFPWFKTIIVALIAGVIGALL

SEQ ID NO: 1909004 - protein, 23 aa, Staphylococcus
PQVIVLNSLPGFNLINGGKVGVL

SEQ ID NO: 1909005 - protein, 30 aa, Staphylococcus
PRKPMSPLAWVIIALLIAIAIIAVIIFFVG

SEQ ID NO: 1909006 - protein, 22 aa, Staphylococcus
PRLLAIYLFILVITAILTYVLR

SEQ ID NO: 1909007 - protein, 20 aa, Staphylococcus
PSEWLIVLVWYLIAGVLYLT

SEQ ID NO: 1909008 - protein, 28 aa, Staphylococcus
PSIFMNPWFQFILATPVQFIIGWQFYVG

SEQ ID NO: 1909009 - protein, 28 aa, Staphylococcus
PSKPIIEINYLIPNLTITPANKADKLDI

SEQ ID NO: 1909010 - protein, 28 aa, Staphylococcus
PSMLMNPWFQFTLATPVQFIIGWQFYKG

SEQ ID NO: 1909011 - protein, 29 aa, Staphylococcus
PSRYNKPKFPWFKTILVALIAGIIGALLV

SEQ ID NO: 1909012 - protein, 20 aa, Staphylococcus
PSYLIIIVFLFVLINLIITF

SEQ ID NO: 1909013 - protein, 28 aa, Staphylococcus
PVALVRFWTLFIVFLLGMVIMALLMFND

SEQ ID NO: 1909014 - protein, 22 aa, Staphylococcus
PVFSMLFFIVAWFFARKPSKIL

SEQ ID NO: 1909015 - protein, 25 aa, Staphylococcus
PVKIITWFIGILVVLAIVASIFVVA

SEQ ID NO: 1909016 - protein, 20 aa, Staphylococcus
PVLFLLVFYFLIIRPQQKRA

SEQ ID NO: 1909017 - protein, 19 aa, Staphylococcus
PWILILFVLVIIVNASWNT

SEQ ID NO: 1909018 - protein, 23 aa, Staphylococcus
PYPWIKWLMYVVALFLPVFVIFT

SEQ ID NO: 1909019 - protein, 19 aa, Staphylococcus
PYVFISWMFLFMSFQFEYV

SEQ ID NO: 1909020 - protein, 17 aa, Staphylococcus
PYVLMRPMLFISVILGG

SEQ ID NO: 1909021 - protein, 21 aa, Staphylococcus
PYWMYVIIFIIFTISYTALAI

SEQ ID NO: 1909022 - protein, 24 aa, Staphylococcus
QAKNRLNYILDPIVNRPSLLDRIT

SEQ ID NO: 1909023 - protein, 17 aa, Staphylococcus
QALTKVFTLLFGKASLV

SEQ ID NO: 1909024 - protein, 17 aa, Staphylococcus
QATLPRKEDESPKFAVR

SEQ ID NO: 1909025 - protein, 30 aa, Staphylococcus
QAVKQHWMPIALVIAIIGGSMIWFSQRKKS

SEQ ID NO: 1909026 - protein, 23 aa, Staphylococcus
QDGYRYYDFIDNVGIRSGSHLYI

SEQ ID NO: 1909027 - protein, 20 aa, Staphylococcus
QDLYALFRKQNFSGNSYLNS

SEQ ID NO: 1909028 - protein, 24 aa, Staphylococcus
QEPWFLVILAFFSLLTGLIIGMVN

SEQ ID NO: 1909029 - protein, 29 aa, Staphylococcus
QFEAWKYIVIIGMFILAVVFLIVRNINRT

SEQ ID NO: 1909030 - protein, 25 aa, Staphylococcus
QFFEYVLNFWLYEGELLLLLLKDES

SEQ ID NO: 1909031 - protein, 17 aa, Staphylococcus
QFVFRPDNADFAGSYVQ

SEQ ID NO: 1909032 - protein, 18 aa, Staphylococcus
QFVLLIVSQLIYYFSKGE

SEQ ID NO: 1909033 - protein, 19 aa, Staphylococcus
QFYLFFPFILVILLLTIKK

SEQ ID NO: 1909034 - protein, 19 aa, Staphylococcus
QGSFKYNPFVVNQISRMSE

SEQ ID NO: 1909035 - protein, 28 aa, Staphylococcus
QHDFGHTTFYLSFGVRPGRSFNSDANEY

SEQ ID NO: 1909036 - protein, 28 aa, Staphylococcus
QHDNQLPLAGITFAAGAALVSRRMVQKK

SEQ ID NO: 1909037 - protein, 27 aa, Staphylococcus
QIFGIPVFLFLNILIILLCIIVGSVLA

SEQ ID NO: 1909038 - protein, 26 aa, Staphylococcus
QIFGIPVFLFLNLVIILLCIIVGSVL

SEQ ID NO: 1909039 - protein, 47 aa, Staphylococcus
QILESITKFFKKHWVKVVIVVALIILILLLSAIFRNVNNTGTNQSGL

SEQ ID NO: 1909040 - protein, 24 aa, Staphylococcus
QILLFVFFIVFLVLPVIVLLGRSI

SEQ ID NO: 1909041 - protein, 29 aa, Staphylococcus
QIPHIFMNPWFQFVLATPVQFVIGWQFYV

SEQ ID NO: 1909042 - protein, 18 aa, Staphylococcus
QIVLIAVILIFSYQLFKT

SEQ ID NO: 1909043 - protein, 25 aa, Staphylococcus
QIYMGKAGFFFLLGIIQALIVSIGD

SEQ ID NO: 1909044 - protein, 21 aa, Staphylococcus
QKEMWKYLSIVGVIVLITVYL

SEQ ID NO: 1909045 - protein, 30 aa, Staphylococcus
QKFLTLFAGPLFNFILALVLFLGLAMYSGA

SEQ ID NO: 1909046 - protein, 25 aa, Staphylococcus
QKKNFFPYILLSIGAFLTIGFMVFT

SEQ ID NO: 1909047 - protein, 28 aa, Staphylococcus
QKQYRWLKISFIILALISVGLTIFAFIT

SEQ ID NO: 1909048 - protein, 17 aa, Staphylococcus
QKWYQYVFLFTDMFLIL

SEQ ID NO: 1909049 - protein, 44 aa, Staphylococcus
QKYAKPKSKKPWIWVGVGCLVFFILIIIGIVALTFGMNGGFKHH

SEQ ID NO: 1909050 - protein, 23 aa, Staphylococcus
QLIMLIGFIVIVSLILWILAVLI

SEQ ID NO: 1909051 - protein, 24 aa, Staphylococcus
QLINFILYILWQVAIIMFYWKSRA

SEQ ID NO: 1909052 - protein, 29 aa, Staphylococcus
QLPNCFEFIFVLFALFKIGAIPVLALATH

SEQ ID NO: 1909053 - protein, 25 aa, Staphylococcus
QMILGWLMILLMFALPIGVAYHFSD

SEQ ID NO: 1909054 - protein, 20 aa, Staphylococcus
QNIYFSIIIKMIAFILVFPG

SEQ ID NO: 1909055 - protein, 21 aa, Staphylococcus
QNLWLMILIIPTWINLLLKTY

SEQ ID NO: 1909056 - protein, 24 aa, Staphylococcus
QPFTWVLLIFIALFIGSLLFTLNN

SEQ ID NO: 1909057 - protein, 19 aa, Staphylococcus
QPIIFLLLGLLIVSLYLII

SEQ ID NO: 1909058 - protein, 30 aa, Staphylococcus
QPSKKRFKPKFPWFKTIIVALVAGIIGALI

SEQ ID NO: 1909059 - protein, 23 aa, Staphylococcus
QPVIIVGYYYDTVGNIVLQCGDN

SEQ ID NO: 1909060 - protein, 18 aa, Staphylococcus
QRELSDRLTFSSWLETDY

SEQ ID NO: 1909061 - protein, 26 aa, Staphylococcus
QREMWKYLSIIGVIVLFTVYLASRSI

SEQ ID NO: 1909062 - protein, 23 aa, Staphylococcus
QSINPLFILLFAPVVSLIWQKLG

SEQ ID NO: 1909063 - protein, 24 aa, Staphylococcus
QSSNYFRFQYFNPLDSKKYYKNLD

SEQ ID NO: 1909064 - protein, 30 aa, Staphylococcus
QSTKEILYIALRLSLIKTLKPYYPFPIIID

SEQ ID NO: 1909065 - protein, 30 aa, Staphylococcus
QSTKELLYISLRLSLIKILRPYYSMPIIID

SEQ ID NO: 1909066 - protein, 35 aa, Staphylococcus
QSTKELLYVALRLSLIKVLKPYYPFPIIVDDAFVH

SEQ ID NO: 1909067 - protein, 23 aa, Staphylococcus
QTHALDLGGFTFGDGFDTRQGVP

SEQ ID NO: 1909068 - protein, 25 aa, Staphylococcus
QTHTVYGKENLYRIAIRYYGEGTQA

SEQ ID NO: 1909069 - protein, 17 aa, Staphylococcus
QVFWRILIFYILAIFVI

SEQ ID NO: 1909070 - protein, 23 aa, Staphylococcus
QVFWRILLFYILAIFIIGMLIPY

SEQ ID NO: 1909071 - protein, 24 aa, Staphylococcus
QVFWRILLFYILAIFIIGMLIPYD

SEQ ID NO: 1909072 - protein, 21 aa, Staphylococcus
QWSKPLLYILLIVGIITVVDS

SEQ ID NO: 1909073 - protein, 19 aa, Staphylococcus
QYHHILIPPFIIQILVENA

SEQ ID NO: 1909074 - protein, 22 aa, Staphylococcus
QYVNYFMLFNVIATLLTLYVIG

SEQ ID NO: 1909075 - protein, 31 aa, Staphylococcus
RAHASSIQFVRAELAGFGGFGGYVWFDKNND

SEQ ID NO: 1909076 - protein, 26 aa, Staphylococcus
RAIPFIILILLLIPFTSLILGTISGP

SEQ ID NO: 1909077 - protein, 25 aa, Staphylococcus
RAIPFIILILLLIPFTSLVLGTISG

SEQ ID NO: 1909078 - protein, 22 aa, Staphylococcus
RALEFRQLFNYNQLYVEPMKEY

SEQ ID NO: 1909079 - protein, 23 aa, Staphylococcus
RDTYYEVILPANSKLISSSGGTG

SEQ ID NO: 1909080 - protein, 21 aa, Staphylococcus
REIFMGKAGFFFLLGIVQALI

SEQ ID NO: 1909081 - protein, 26 aa, Staphylococcus
REVIGYWLGFAGIVLVPLISLVANIF

SEQ ID NO: 1909082 - protein, 23 aa, Staphylococcus
RFDFLPNRLNKYSIRKFTNGIAS

SEQ ID NO: 1909083 - protein, 21 aa, Staphylococcus
RFEKVLYITLITVIAMISIYM

SEQ ID NO: 1909084 - protein, 19 aa, Staphylococcus
RFEKYLYITLVTAIAVIAI

SEQ ID NO: 1909085 - protein, 20 aa, Staphylococcus
RFFYYMFLTLIIILFILLFL

SEQ ID NO: 1909086 - protein, 21 aa, Staphylococcus
RFIKWLTLLNIVPGYYGINSI

SEQ ID NO: 1909087 - protein, 27 aa, Staphylococcus
RFIVKLIPIYYIFRVLSIFIFLMAFKM

SEQ ID NO: 1909088 - protein, 26 aa, Staphylococcus
RFIVKLIPIYYIFRVLSILIFIMAFK

SEQ ID NO: 1909089 - protein, 20 aa, Staphylococcus
RFWIILITILVLFLAAQVRI

SEQ ID NO: 1909090 - protein, 20 aa, Staphylococcus
RFYLWLIIGLIFGFAPPLQT

SEQ ID NO: 1909091 - protein, 24 aa, Staphylococcus
RHNNYSIRKFTIGTASILVGTTLI

SEQ ID NO: 1909092 - protein, 27 aa, Staphylococcus
RICNFFSLFLMFIFKMPKMLKYNHILV

SEQ ID NO: 1909093 - protein, 26 aa, Staphylococcus
RIENRWIVFLIFLISSIIVLISLNVY

SEQ ID NO: 1909094 - protein, 18 aa, Staphylococcus
RILLFYILAIFVIGMLIP

SEQ ID NO: 1909095 - protein, 37 aa, Staphylococcus
RIQYTVITVLVLLIVIFLLYMFTPLSKISNVKIEGNH

SEQ ID NO: 1909096 - protein, 27 aa, Staphylococcus
RISFKTNGLPTERLYYAAGGRALEFRQ

SEQ ID NO: 1909097 - protein, 25 aa, Staphylococcus
RISMFIWLVFLLPLPFLLSSLGTTF

SEQ ID NO: 1909098 - protein, 23 aa, Staphylococcus
RKDFCKYFLKKIKPTVIKGNASE

SEQ ID NO: 1909099 - protein, 25 aa, Staphylococcus
RKFTNGIASVLIGSTILLGAVIDKE

SEQ ID NO: 1909100 - protein, 18 aa, Staphylococcus
RKHKFGVSSILVGSIIGL

SEQ ID NO: 1909101 - protein, 20 aa, Staphylococcus
RKMVQNLWWGAGYNIIAVPL

SEQ ID NO: 1909102 - protein, 21 aa, Staphylococcus
RKMVQNLWWGAGYNIVAVPLA

SEQ ID NO: 1909103 - protein, 40 aa, Staphylococcus
RKRQKTIQYIVITALILIIILFLLYMFTPISRIANVTIKG

SEQ ID NO: 1909104 - protein, 25 aa, Staphylococcus
RLEFYRLYLFMVHLLKFGGMYASSV

SEQ ID NO: 1909105 - protein, 20 aa, Staphylococcus
RLFIYVQFTALLIAISSSLV

SEQ ID NO: 1909106 - protein, 19 aa, Staphylococcus
RLFWAFALCLLPFSLMLVG

SEQ ID NO: 1909107 - protein, 20 aa, Staphylococcus
RLFWVIPVYVFLKVLMPIII

SEQ ID NO: 1909108 - protein, 20 aa, Staphylococcus
RLNKPFFWLFVIGFNVCFMP

SEQ ID NO: 1909109 - protein, 34 aa, Staphylococcus
RMSLPAKILVWCVGILFILALLAMIYVIAKIFIT

SEQ ID NO: 1909110 - protein, 25 aa, Staphylococcus
RNPKPRFPLFKTIVIAIVAGIIGAL

SEQ ID NO: 1909111 - protein, 26 aa, Staphylococcus
RNTYYLLGSVILLAILALIATYFVKR

SEQ ID NO: 1909112 - protein, 29 aa, Staphylococcus
RPSYNKKPKFPWFKTIIVALIAGIIGALL

SEQ ID NO: 1909113 - protein, 36 aa, Staphylococcus
RQKKSKKWLYIIIALLLIVVAVFVTLAFMGGDSNSD

SEQ ID NO: 1909114 - protein, 37 aa, Staphylococcus
RQKRIQYVIITFLVLLIILFLLYMFTPLSRISNIKIS

SEQ ID NO: 1909115 - protein, 25 aa, Staphylococcus
RQPFGTYIKLSCSALLISSVFVNYS

SEQ ID NO: 1909116 - protein, 23 aa, Staphylococcus
RQQLHSIRKFKVGTASILIGVTL

SEQ ID NO: 1909117 - protein, 17 aa, Staphylococcus
RSEWLHNTGKIYERINE

SEQ ID NO: 1909118 - protein, 33 aa, Staphylococcus
RSIIPPLVMIALTVVIFLVRPLGVYILMMIGMS

SEQ ID NO: 1909119 - protein, 17 aa, Staphylococcus
RSIPFIILLIAIVPFTK

SEQ ID NO: 1909120 - protein, 29 aa, Staphylococcus
RSKKKKFAIALILLLLVASLFGFIAMGMF

SEQ ID NO: 1909121 - protein, 36 aa, Staphylococcus
RSKKKKFAIIFILALLLLSLIGFIAWGMLSDKYTEM

SEQ ID NO: 1909122 - protein, 31 aa, Staphylococcus
RSKKKKFFFALIFLILLAGLITFLAFGMFGD

SEQ ID NO: 1909123 - protein, 23 aa, Staphylococcus
RSLLHISTIALSGLLFTNTPGVM

SEQ ID NO: 1909124 - protein, 26 aa, Staphylococcus
RSNWIFWIIFLQFVFLGMAYIDYDMA

SEQ ID NO: 1909125 - protein, 27 aa, Staphylococcus
RTHVVNGQNLYRIAIQYYGEGTPENVE

SEQ ID NO: 1909126 - protein, 42 aa, Staphylococcus
RTIIKIIGFMFIAFIVLLLLGILLFAYYAWKAPAFTESKLED

SEQ ID NO: 1909127 - protein, 18 aa, Staphylococcus
RTIMYFGMGIFGISILYL

SEQ ID NO: 1909128 - protein, 33 aa, Staphylococcus
RTKKKKFFYTLIIVLLLFGLFGFMAMGMFGNKY

SEQ ID NO: 1909129 - protein, 23 aa, Staphylococcus
RTNKMDFTVTWKVNPSASASGHD

SEQ ID NO: 1909130 - protein, 22 aa, Staphylococcus
RTYYLSLWYFITFGAFVAFGLF

SEQ ID NO: 1909131 - protein, 17 aa, Staphylococcus
RVILIPIFLLFALANFG

SEQ ID NO: 1909132 - protein, 17 aa, Staphylococcus
RVRISFLPISNTGRISV

SEQ ID NO: 1909133 - protein, 25 aa, Staphylococcus
RVSMFFWLVVLLPLPFLLSSLGVTF

SEQ ID NO: 1909134 - protein, 21 aa, Staphylococcus
RWMLCLHPILFIFFSGVFLSS

SEQ ID NO: 1909135 - protein, 17 aa, Staphylococcus
RYILIMLIIFLLGSMVL

SEQ ID NO: 1909136 - protein, 22 aa, Staphylococcus
SAIFFNYLFVKILKLYKPDVFI

SEQ ID NO: 1909137 - protein, 18 aa, Staphylococcus
SAKRWIRYIHEVEEPDFL

SEQ ID NO: 1909138 - protein, 22 aa, Staphylococcus
SALFPILLIVPLFDILMYFNVL

SEQ ID NO: 1909139 - protein, 25 aa, Staphylococcus
SALRYYFWLTILVIILVVGIIAWLF

SEQ ID NO: 1909140 - protein, 30 aa, Staphylococcus
SANIIFGIIFAILSVVFIVGIFFVKTKEVG

SEQ ID NO: 1909141 - protein, 18 aa, Staphylococcus
SAPFVILFFILEQFARAV

SEQ ID NO: 1909142 - protein, 21 aa, Staphylococcus
SAVLVLFLVIWSLTYTGFSIG

SEQ ID NO: 1909143 - protein, 25 aa, Staphylococcus
SCLALLICSLFLTPLVKRIKVFNRK

SEQ ID NO: 1909144 - protein, 18 aa, Staphylococcus
SCSALLISGSMIGYGFAS

SEQ ID NO: 1909145 - protein, 17 aa, Staphylococcus
SDATGKFRQPLNVPLKQ

SEQ ID NO: 1909146 - protein, 19 aa, Staphylococcus
SDEQFPPRNAQRRQRRRDT

SEQ ID NO: 1909147 - protein, 42 aa, Staphylococcus
SDFLRRNWAKIAVVIGAIILVLLLFAIFHNLQDRDGTSSGQV

SEQ ID NO: 1909148 - protein, 24 aa, Staphylococcus
SDVFIWLPLLLWSIERFLKSGKIG

SEQ ID NO: 1909149 - protein, 19 aa, Staphylococcus
SEFRIFLAVLLGLLLVISI

SEQ ID NO: 1909150 - protein, 20 aa, Staphylococcus
SEGKLYFMTKYDGKEYFISQ

SEQ ID NO: 1909151 - protein, 24 aa, Staphylococcus
SELKLMLIFIIINIMISFYPGIFN

SEQ ID NO: 1909152 - protein, 27 aa, Staphylococcus
SEVPFYSKSMLLNRLNSLATGSYKYNP

SEQ ID NO: 1909153 - protein, 21 aa, Staphylococcus
SEWVVLILGTILFFYGGKPFL

SEQ ID NO: 1909154 - protein, 24 aa, Staphylococcus
SFCFIFLLLVFFKYILKRYFNYSL

SEQ ID NO: 1909155 - protein, 28 aa, Staphylococcus
SFFNYLFGYSRYLTYILVILASGFLAYN

SEQ ID NO: 1909156 - protein, 23 aa, Staphylococcus
SFGWLFLVIIFVLDVFLIALAIS

SEQ ID NO: 1909157 - protein, 19 aa, Staphylococcus
SFILFFTLGFFKVADAHVT

SEQ ID NO: 1909158 - protein, 17 aa, Staphylococcus
SFILFIALGLFKVADAH

SEQ ID NO: 1909159 - protein, 19 aa, Staphylococcus
SFLFLVPLFSTLFSIIGLR

SEQ ID NO: 1909160 - protein, 21 aa, Staphylococcus
SFVLVLIIFLVNWGPNVSYAA

SEQ ID NO: 1909161 - protein, 17 aa, Staphylococcus
SFVTQALIFAIIFGIAA

SEQ ID NO: 1909162 - protein, 17 aa, Staphylococcus
SFYIDWIGNLSLGKLHQ

SEQ ID NO: 1909163 - protein, 17 aa, Staphylococcus
SGHAYITPTRPIPEGNV

SEQ ID NO: 1909164 - protein, 25 aa, Staphylococcus
SGIMLFIMVIYWFIALSEFKKQQRL

SEQ ID NO: 1909165 - protein, 26 aa, Staphylococcus
SGKFYLTVLMIYVLLSIVLIVIATFF

SEQ ID NO: 1909166 - protein, 24 aa, Staphylococcus
SGLISLLLLLIKQVTEMFGIDLSH

SEQ ID NO: 1909167 - protein, 34 aa, Staphylococcus
SGRTKKWLIAIIVILLIIVAIFVTRAIMNHNDDK

SEQ ID NO: 1909168 - protein, 38 aa, Staphylococcus
SHPSRKDFVISFITGALIGSAVGLFYKNKAEEKIDGAK

SEQ ID NO: 1909169 - protein, 25 aa, Staphylococcus
SHVWPILIFLPLIVIVFLRIKGHYK

SEQ ID NO: 1909170 - protein, 22 aa, Staphylococcus
SIAIYLLPLFILGNVSWTFVLS

SEQ ID NO: 1909171 - protein, 27 aa, Staphylococcus
SIALVVVWFIFKPLVATIAAAILVVMI

SEQ ID NO: 1909172 - protein, 24 aa, Staphylococcus
SICLPLFFYLLFTSILDLPKSERI

SEQ ID NO: 1909173 - protein, 20 aa, Staphylococcus
SIFGFFILTLITLSLKTYFA

SEQ ID NO: 1909174 - protein, 21 aa, Staphylococcus
SIGVVLYEMLIGKPPFSGETA

SEQ ID NO: 1909175 - protein, 20 aa, Staphylococcus
SIIFIAPMIVFLFVFGVGTA

SEQ ID NO: 1909176 - protein, 18 aa, Staphylococcus
SIIGLVLVLLFKDKGQNQ

SEQ ID NO: 1909177 - protein, 25 aa, Staphylococcus
SIILFLLVMMSVVLTFMVWNFSPDL

SEQ ID NO: 1909178 - protein, 20 aa, Staphylococcus
SIILGLLVLISIVLTYLVWN

SEQ ID NO: 1909179 - protein, 21 aa, Staphylococcus
SIILILLVLMSVVLTYMIWNF

SEQ ID NO: 1909180 - protein, 22 aa, Staphylococcus
SIILILLVLMSVVLTYMTWNFS

SEQ ID NO: 1909181 - protein, 23 aa, Staphylococcus
SIITLPLVLLFVTLIIPIFFFII

SEQ ID NO: 1909182 - protein, 19 aa, Staphylococcus
SILFLVFILVYINSYRHIH

SEQ ID NO: 1909183 - protein, 17 aa, Staphylococcus
SILIMFILLFLNGWFQG

SEQ ID NO: 1909184 - protein, 24 aa, Staphylococcus
SILLPLFFYLIFTSILDLPKAQQQ

SEQ ID NO: 1909185 - protein, 23 aa, Staphylococcus
SILNVFVFNYFFTVPRFTLEMYR

SEQ ID NO: 1909186 - protein, 31 aa, Staphylococcus
SILSTLIPVLIIALLFIFFLSQAQGGGGGGR

SEQ ID NO: 1909187 - protein, 31 aa, Staphylococcus
SILSTLIPVLVIALLFIFFLSQAQGGGGGGR

SEQ ID NO: 1909188 - protein, 31 aa, Staphylococcus
SILTTLIPVLIIALLFIFFLSQAQGGGGGGR

SEQ ID NO: 1909189 - protein, 19 aa, Staphylococcus
SILYYLAIALIVITIIVVV

SEQ ID NO: 1909190 - protein, 17 aa, Staphylococcus
SIMFFLDVKLTFAAIFI

SEQ ID NO: 1909191 - protein, 23 aa, Staphylococcus
SIQHQFWWPVYLPITIAALVIPA

SEQ ID NO: 1909192 - protein, 17 aa, Staphylococcus
SIVIIITLIIWVLAVLL

SEQ ID NO: 1909193 - protein, 25 aa, Staphylococcus
SIVWTLFLIIWYLLGIPVGPGGPIK

SEQ ID NO: 1909194 - protein, 19 aa, Staphylococcus
SIVYFALKYAPFLREQDWN

SEQ ID NO: 1909195 - protein, 25 aa, Staphylococcus
SIYTGIIFVVALILLVFAMTSQKIE

SEQ ID NO: 1909196 - protein, 24 aa, Staphylococcus
SKLYYIFISVIIITIIVIAFILYK

SEQ ID NO: 1909197 - protein, 30 aa, Staphylococcus
SKMKITVLSLIFALLLAGLVGFIGMGVFGS

SEQ ID NO: 1909198 - protein, 18 aa, Staphylococcus
SKTRLFIYVQFTALLIAI

SEQ ID NO: 1909199 - protein, 22 aa, Staphylococcus
SKWLIPIFVISVLIFTLLTVGV

SEQ ID NO: 1909200 - protein, 23 aa, Staphylococcus
SLFFLLILLIFIKKLKLPIILLI

SEQ ID NO: 1909201 - protein, 19 aa, Staphylococcus
SLFYIFIGLLMFSLLNKTG

SEQ ID NO: 1909202 - protein, 22 aa, Staphylococcus
SLGKLFMIFLIRTAITLPIIAL

SEQ ID NO: 1909203 - protein, 27 aa, Staphylococcus
SLITFIIWIIFIHFGQFEPALLAAISV

SEQ ID NO: 1909204 - protein, 23 aa, Staphylococcus
SLKWLIIYSIIFMLVIVGVVFVL

SEQ ID NO: 1909205 - protein, 22 aa, Staphylococcus
SLLKYYFWLTILVVVILVGIVA

SEQ ID NO: 1909206 - protein, 23 aa, Staphylococcus
SLLKYYFWLTVVVVILLIVGIAW

SEQ ID NO: 1909207 - protein, 23 aa, Staphylococcus
SLNHKWIVIIVSTIILIASIGLG

SEQ ID NO: 1909208 - protein, 22 aa, Staphylococcus
SLPWFIMFILILSAGAISDKIL

SEQ ID NO: 1909209 - protein, 23 aa, Staphylococcus
SLPWLIMFFLILSAGAISDKILS

SEQ ID NO: 1909210 - protein, 23 aa, Staphylococcus
SLPWLLMFFLILSGGAISDKILN

SEQ ID NO: 1909211 - protein, 26 aa, Staphylococcus
SLRLSLIKVLKPYYPFPIIIDDAFVH

SEQ ID NO: 1909212 - protein, 24 aa, Staphylococcus
SLVINWIAALFWIIAGIMLLVRKN

SEQ ID NO: 1909213 - protein, 22 aa, Staphylococcus
SLVMLFIMDWKMTLLTFITIPI

SEQ ID NO: 1909214 - protein, 21 aa, Staphylococcus
SMFCSLWLVPWLSAKRVGKLK

SEQ ID NO: 1909215 - protein, 24 aa, Staphylococcus
SMSPLLFAWIIAAIFRIALGSATV

SEQ ID NO: 1909216 - protein, 24 aa, Staphylococcus
SMTISLGILPWLSAKRARVLSERV

SEQ ID NO: 1909217 - protein, 29 aa, Staphylococcus
SNHKKPAWLFVVIGLVIALLISGIGYAAY

SEQ ID NO: 1909218 - protein, 37 aa, Staphylococcus
SNIRIRKFIPWAIVAFIIVLLIIVFVLVRNYNSPDAQ

SEQ ID NO: 1909219 - protein, 28 aa, Staphylococcus
SNKILLKILIIVIVLVAIFMGAMYVLSS

SEQ ID NO: 1909220 - protein, 25 aa, Staphylococcus
SNKTQYKVVLPEGVQFISAQNARAN

SEQ ID NO: 1909221 - protein, 22 aa, Staphylococcus
SNLIMIIVYVVAAWIILRFVNK

SEQ ID NO: 1909222 - protein, 19 aa, Staphylococcus
SNRLLTLNVDRIEPGTIKN

SEQ ID NO: 1909223 - protein, 28 aa, Staphylococcus
SNTPKRKDFVVSFIASAIVGSALGLFYK

SEQ ID NO: 1909224 - protein, 24 aa, Staphylococcus
SNYKLYYLSLWYFITFGAFVAFGL

SEQ ID NO: 1909225 - protein, 25 aa, Staphylococcus
SNYKLYYLSLWYFITFGAFVAFGLF

SEQ ID NO: 1909226 - protein, 20 aa, Staphylococcus
SPIFIFVLLFLNAIFDGFTN

SEQ ID NO: 1909227 - protein, 21 aa, Staphylococcus
SPLLFVLVALFGAIVFNTIVY

SEQ ID NO: 1909228 - protein, 19 aa, Staphylococcus
SQPFGIFKGVFNVPDNISR

SEQ ID NO: 1909229 - protein, 23 aa, Staphylococcus
SRLYVFSIFIILLLTLVFANFSE

SEQ ID NO: 1909230 - protein, 23 aa, Staphylococcus
SRNSQFIQALRQIGLMSPNIEIK

SEQ ID NO: 1909231 - protein, 31 aa, Staphylococcus
SRPGQNLIVNPMWYNLNFALVPQNDVKIDIT

SEQ ID NO: 1909232 - protein, 17 aa, Staphylococcus
SRYLTYILILLATGFIT

SEQ ID NO: 1909233 - protein, 30 aa, Staphylococcus
SSKGKKFLIALIIILLIASLAGFIAWGVFG

SEQ ID NO: 1909234 - protein, 33 aa, Staphylococcus
SSKKKKFLFAFIFALLLIGLIAFISMAVFGSKY

SEQ ID NO: 1909235 - protein, 24 aa, Staphylococcus
SSLPWLFMFFLILSAGAISDKILN

SEQ ID NO: 1909236 - protein, 18 aa, Staphylococcus
SSMILFFSLPVLVIIFIL

SEQ ID NO: 1909237 - protein, 25 aa, Staphylococcus
SSNHQGSLVDPSGFKPSHQNPGEQH

SEQ ID NO: 1909238 - protein, 22 aa, Staphylococcus
SSNINPSFYVNDSNYRNVTSNY

SEQ ID NO: 1909239 - protein, 24 aa, Staphylococcus
SSTLVTIIVFLPLAFVSGSVGEMF

SEQ ID NO: 1909240 - protein, 24 aa, Staphylococcus
SSTLVTIIVFLPLVFVAGSVGEMF

SEQ ID NO: 1909241 - protein, 25 aa, Staphylococcus
SSTWAWLFILFIAPVLGFFLYILFG

SEQ ID NO: 1909242 - protein, 24 aa, Staphylococcus
SSVVAIIFFFVWPFVYDAIVAFGK

SEQ ID NO: 1909243 - protein, 22 aa, Staphylococcus
SSWTLYYWGWWLSWSPFVGIFI

SEQ ID NO: 1909244 - protein, 21 aa, Staphylococcus
SSWTLYYWGWWLSWSPFVGVF

SEQ ID NO: 1909245 - protein, 17 aa, Staphylococcus
STIFAFFLSSRITKPLR

SEQ ID NO: 1909246 - protein, 22 aa, Staphylococcus
STIILFCLVIIFFLKDTLRDGE

SEQ ID NO: 1909247 - protein, 31 aa, Staphylococcus; identical to SEQ ID NO: 1893256

SEQ ID NO: 1909248 - protein, 25 aa, Staphylococcus
STKKMIFWIIIGIIGAALIIGIVYI

SEQ ID NO: 1909249 - protein, 24 aa, Staphylococcus
STVIATLVFIGFNTGQAQANESDQ

SEQ ID NO: 1909250 - protein, 19 aa, Staphylococcus
STWTLYYWGWWLSWSPFVG

SEQ ID NO: 1909251 - protein, 17 aa, Staphylococcus
SVFIILFFLLLSAITPL

SEQ ID NO: 1909252 - protein, 19 aa, Staphylococcus
SVFLVWYLNIFVLKTFSIT

SEQ ID NO: 1909253 - protein, 23 aa, Staphylococcus
SVGKLFMIFLIRTLITLPIISLM

SEQ ID NO: 1909254 - protein, 25 aa, Staphylococcus
SVGNWRWIFWINIPFIFIGLIGCLF

SEQ ID NO: 1909255 - protein, 31 aa, Staphylococcus
SVILFLLVMMSIVLTYMIWNFTPDLNNLDSA

SEQ ID NO: 1909256 - protein, 17 aa, Staphylococcus
SVLFGTFLIYANPANHA

SEQ ID NO: 1909257 - protein, 23 aa, Staphylococcus
SVLIYYLVLLLIYIIAALILLPP

SEQ ID NO: 1909258 - protein, 22 aa, Staphylococcus
SVRFIFAIIVIAISIFGLFQLG

SEQ ID NO: 1909259 - protein, 17 aa, Staphylococcus
SVRLILALVFINLTSPV

SEQ ID NO: 1909260 - protein, 18 aa, Staphylococcus
SVWYIVVLNLGMSVLFII

SEQ ID NO: 1909261 - protein, 22 aa, Staphylococcus
SVYLFLLMMMIWLAINVLTRHP

SEQ ID NO: 1909262 - protein, 19 aa, Staphylococcus
SWDEHPILTLLGTILIIVA

SEQ ID NO: 1909263 - protein, 18 aa, Staphylococcus
SWIIVICISLIIVSIVGA

SEQ ID NO: 1909264 - protein, 17 aa, Staphylococcus
SWIIVIVVSLILVTIVG

SEQ ID NO: 1909265 - protein, 23 aa, Staphylococcus
SWYYLLLVLIIFFICVYLLFSRY

SEQ ID NO: 1909266 - protein, 20 aa, Staphylococcus
SWYYLLLVLLIFFVCVYLLF

SEQ ID NO: 1909267 - protein, 18 aa, Staphylococcus
SWYYLLLVLLILIVCVYL

SEQ ID NO: 1909268 - protein, 18 aa, Staphylococcus
SYASSYVDLIDRVPPEKP

SEQ ID NO: 1909269 - protein, 23 aa, Staphylococcus
TAAFWTILAILFIGGPYIPDAIN

SEQ ID NO: 1909270 - protein, 25 aa, Staphylococcus
TAINVLPIFIVPLVVERKKIKSHPD

SEQ ID NO: 1909271 - protein, 25 aa, Staphylococcus
TAINVLPIIIVPLVVERKKIKEHPD

SEQ ID NO: 1909272 - protein, 25 aa, Staphylococcus
TAINVLPIIIVPLVVERKRIKSHPE

SEQ ID NO: 1909273 - protein, 22 aa, Staphylococcus
TAPLLFIFVIIILVFNLGLSLI

SEQ ID NO: 1909274 - protein, 20 aa, Staphylococcus
TASILVGATLIFGAGHDVAK

SEQ ID NO: 1909275 - protein, 19 aa, Staphylococcus
TAWRYLIVVLYLVPYAFFG

SEQ ID NO: 1909276 - protein, 22 aa, Staphylococcus
TDLYFFLFLRLIQGLTAGGSIV

SEQ ID NO: 1909277 - protein, 21 aa, Staphylococcus
TDPKIATIFVPKGSRYEIGRD

SEQ ID NO: 1909278 - protein, 23 aa, Staphylococcus
TEPNVPVTIYVGPTTYRTTSDAT

SEQ ID NO: 1909279 - protein, 27 aa, Staphylococcus
TETNTTLWSVLLGGLGLAFIRKRKASK

SEQ ID NO: 1909280 - protein, 21 aa, Staphylococcus
TFICTFYFFKYIKLKPLAIIV

SEQ ID NO: 1909281 - protein, 21 aa, Staphylococcus
TFLMDIVCYLLLNNDYMHKSY

SEQ ID NO: 1909282 - protein, 22 aa, Staphylococcus
TFLSWRWIFVFSIIVSLIAVLL

SEQ ID NO: 1909283 - protein, 18 aa, Staphylococcus
TFSDGHIITIPKGKDGKS

SEQ ID NO: 1909284 - protein, 23 aa, Staphylococcus
TFSFKWLIALAFLMLAISTAASV

SEQ ID NO: 1909285 - protein, 35 aa, Staphylococcus
TFSPTILVLLMYLVSLMTAYLFYSYERHKGQVNFV

SEQ ID NO: 1909286 - protein, 19 aa, Staphylococcus
TFSTLFLFVLNELMWFDMT

SEQ ID NO: 1909287 - protein, 17 aa, Staphylococcus
TFTVMYPNDTLPTGDQI

SEQ ID NO: 1909288 - protein, 22 aa, Staphylococcus
TFVGWRWIFIISIIVALLAMYL

SEQ ID NO: 1909289 - protein, 22 aa, Staphylococcus
TFVGWRWIYILSIIIALLAMYL

SEQ ID NO: 1909290 - protein, 19 aa, Staphylococcus
TFVLSWLPAHAKWLLTSVY

SEQ ID NO: 1909291 - protein, 17 aa, Staphylococcus
TFYLFMYLKFKPAPMFI

SEQ ID NO: 1909292 - protein, 28 aa, Staphylococcus
TGAIVGSALGLYYKMKVFEKADQAIAKE

SEQ ID NO: 1909293 - protein, 31 aa, Staphylococcus
TGEQDQVLFGMLAGTLFASAGTLFLVQARRK

SEQ ID NO: 1909294 - protein, 30 aa, Staphylococcus
TGEVVKKSWLPVTVLLVIAGGTLIGLGRRK

SEQ ID NO: 1909295 - protein, 23 aa, Staphylococcus
TGHTLLIYMLILGGAAIMTYILR

SEQ ID NO: 1909296 - protein, 22 aa, Staphylococcus
TGHVTIIPQQWIPKGDVSAKAT

SEQ ID NO: 1909297 - protein, 23 aa, Staphylococcus
TGKLFFLGWIALAIAVVWIGLIT

SEQ ID NO: 1909298 - protein, 21 aa, Staphylococcus
TGLLMVYVFNPPAAWLNKLLL

SEQ ID NO: 1909299 - protein, 29 aa, Staphylococcus
TGLVSAVAAMLAGLGLFGKSRKNKKDKKN

SEQ ID NO: 1909300 - protein, 23 aa, Staphylococcus
TGSSLKPFLAYGPAIENMQWATN

SEQ ID NO: 1909301 - protein, 32 aa, Staphylococcus
THEGPFLRLYFITWMMHILLIGGSRLSWRIFN

SEQ ID NO: 1909302 - protein, 26 aa, Staphylococcus
THNRNLFWIFLIILLVLFVALQVRIF

SEQ ID NO: 1909303 - protein, 27 aa, Staphylococcus
TIAAIFIFPFYILTVYFFFGRLRQLTR

SEQ ID NO: 1909304 - protein, 21 aa, Staphylococcus
TIAVSFTFYLFQKEDNPNKDA

SEQ ID NO: 1909305 - protein, 21 aa, Staphylococcus
TIDEKLFIKQKLDESYKKAEE

SEQ ID NO: 1909306 - protein, 19 aa, Staphylococcus
TIFIFIWVIMIYSPVAHWV

SEQ ID NO: 1909307 - protein, 17 aa, Staphylococcus
TIFVPKGSRYEIGRDLR

SEQ ID NO: 1909308 - protein, 20 aa, Staphylococcus
TIIILITAIVFFIVSTIFAF

SEQ ID NO: 1909309 - protein, 19 aa, Staphylococcus
TIIILVTAVIFLIITTVFA

SEQ ID NO: 1909310 - protein, 41 aa, Staphylococcus; identical to SEQ ID NO: 1755234

SEQ ID NO: 1909311 - protein, 20 aa, Staphylococcus
TIILVLLVLMSIVLTYMVWN

SEQ ID NO: 1909312 - protein, 20 aa, Staphylococcus
TILFYHLVLPSEFAPVLGLS

SEQ ID NO: 1909313 - protein, 21 aa, Staphylococcus
TILFYHLVLPSEFAPVLGLSS

SEQ ID NO: 1909314 - protein, 26 aa, Staphylococcus
TILILGLLIYNLFILPLFIPAVVSTL

SEQ ID NO: 1909315 - protein, 25 aa, Staphylococcus
TIMNPWIQLILATPVQFIIGWQFYV

SEQ ID NO: 1909316 - protein, 18 aa, Staphylococcus
TISGIPKEPGRYDIIVTV

SEQ ID NO: 1909317 - protein, 23 aa, Staphylococcus
TITGLLMIYAFNPPAAWLNNLLL

SEQ ID NO: 1909318 - protein, 23 aa, Staphylococcus
TITGLLMIYVFNPPAAWLNNLLL

SEQ ID NO: 1909319 - protein, 19 aa, Staphylococcus
TIVSMIFLPLTLIAGIYGM

SEQ ID NO: 1909320 - protein, 25 aa, Staphylococcus
TIVWTLFTLIWFLLGIPVGPGGPLH

SEQ ID NO: 1909321 - protein, 21 aa, Staphylococcus
TIWASLLAFLGSTLLINRKNR

SEQ ID NO: 1909322 - protein, 20 aa, Staphylococcus
TIWFVVPILIVIALAVPTVK

SEQ ID NO: 1909323 - protein, 25 aa, Staphylococcus
TKEILYISLRLSLIKVLKPYYHLPI

SEQ ID NO: 1909324 - protein, 18 aa, Staphylococcus
TKHKIFILLIGIAFICSF

SEQ ID NO: 1909325 - protein, 29 aa, Staphylococcus
TKLYYLSIILIVIAILIVALIFYNTRKNM

SEQ ID NO: 1909326 - protein, 28 aa, Staphylococcus
TKQNSDQLIALLLIELANQMDKDKVQAN

SEQ ID NO: 1909327 - protein, 18 aa, Staphylococcus
TKRQIYLGKGAFFIMMGI

SEQ ID NO: 1909328 - protein, 26 aa, Staphylococcus
TKYLFYTFFLLFITIILFVTFVHYAV

SEQ ID NO: 1909329 - protein, 24 aa, Staphylococcus
TKYLFYTFLLLFLTIVLFVTFVHN

SEQ ID NO: 1909330 - protein, 30 aa, Staphylococcus
TLAAILIFPFYILTVYFFFGKLRSLTRVRS

SEQ ID NO: 1909331 - protein, 20 aa, Staphylococcus
TLFAGPLFNFILALVIFIGL

SEQ ID NO: 1909332 - protein, 26 aa, Staphylococcus
TLFAGPLFNFILALVLFIGLAYYQGT

SEQ ID NO: 1909333 - protein, 27 aa, Staphylococcus
TLFAGPLFNFLLTLVLFIGLAYYQGTP

SEQ ID NO: 1909334 - protein, 20 aa, Staphylococcus
TLFILIIAYILIILQAIIFL

SEQ ID NO: 1909335 - protein, 18 aa, Staphylococcus
TLIGSMCMIFVAVMVYWF

SEQ ID NO: 1909336 - protein, 26 aa, Staphylococcus
TLIIILFILLFLYFYKHFELKQHQSL

SEQ ID NO: 1909337 - protein, 28 aa, Staphylococcus
TLILNNFFSIRKLKFGVASITLGSALII

SEQ ID NO: 1909338 - protein, 21 aa, Staphylococcus
TLIMFITWMFTMYKWKEAGRK

SEQ ID NO: 1909339 - protein, 22 aa, Staphylococcus
TLINVLPIVIVPLVVERKRIKE

SEQ ID NO: 1909340 - protein, 22 aa, Staphylococcus
TLIQLPFIFVLAWVVTKIVPGE

SEQ ID NO: 1909341 - protein, 20 aa, Staphylococcus
TLISILIVAIAIIGFFVFVH

SEQ ID NO: 1909342 - protein, 25 aa, Staphylococcus
TLITVLPVILVPLIVERKRIKDHPD

SEQ ID NO: 1909343 - protein, 20 aa, Staphylococcus
TLIVMLPMPILVILTSYYGR

SEQ ID NO: 1909344 - protein, 20 aa, Staphylococcus
TLKPYYPFPIIIDDAFVHFD

SEQ ID NO: 1909345 - protein, 33 aa, Staphylococcus
TLLFAKPIIFFYKIMYPFIWLLNGAARLILKIF

SEQ ID NO: 1909346 - protein, 33 aa, Staphylococcus
TLLFAKPIIFFYKLMYPFIWLLNGAARLILKMF

SEQ ID NO: 1909347 - protein, 20 aa, Staphylococcus
TLLLCYLGFQFGLKKRDEML

SEQ ID NO: 1909348 - protein, 17 aa, Staphylococcus
TLRLFLVLILFSGVWQV

SEQ ID NO: 1909349 - protein, 22 aa, Staphylococcus
TLSMILTLCIVPWLSAKKARTL

SEQ ID NO: 1909350 - protein, 18 aa, Staphylococcus
TLSVFLFFKGKKAFWFMF

SEQ ID NO: 1909351 - protein, 18 aa, Staphylococcus
TLTIIFLVVILTMYPLAK

SEQ ID NO: 1909352 - protein, 19 aa, Staphylococcus
TLTPIFIVMIIYSLVYLIF

SEQ ID NO: 1909353 - protein, 26 aa, Staphylococcus
TLVTFVILLALLKKFAWGPLKEVMDK

SEQ ID NO: 1909354 - protein, 24 aa, Staphylococcus
TMLNFFHGWPWYAVWLVMLGFGGG

SEQ ID NO: 1909355 - protein, 35 aa, Staphylococcus
TMNKRIRFIFGAIVLIFVLIVLRLGYLQIAQGAHY

SEQ ID NO: 1909356 - protein, 34 aa, Staphylococcus
TMNKRISFIFGIIVFIFAIIVLRLGYLQIAQGSH

SEQ ID NO: 1909357 - protein, 24 aa, Staphylococcus
TNIWFYLIFFLFFGLFLFLITLAV

SEQ ID NO: 1909358 - protein, 23 aa, Staphylococcus
TNKPKLVQPPLDKTRLQALYDAS

SEQ ID NO: 1909359 - protein, 34 aa, Staphylococcus
TNNAITIIILITAIIFLAVSTIFAFFLSSRITKP

SEQ ID NO: 1909360 - protein, 18 aa, Staphylococcus
TNRFAVRPVLLWTLVAFI

SEQ ID NO: 1909361 - protein, 26 aa, Staphylococcus
TNVLMGAVLSLLAGLGLMKRSRKNKE

SEQ ID NO: 1909362 - protein, 18 aa, Staphylococcus
TPLIVAAVLYFILTFALS

SEQ ID NO: 1909363 - protein, 17 aa, Staphylococcus
TPNSFAPLKVAAVEGQS

SEQ ID NO: 1909364 - protein, 29 aa, Staphylococcus
TPPPRKKFPWFRVVLIALLSGIIGALLVL

SEQ ID NO: 1909365 - protein, 20 aa, Staphylococcus
TPPRTFARFSSLSQPASTSS

SEQ ID NO: 1909366 - protein, 25 aa, Staphylococcus
TPQRKDFVVSFITGAIVGSALGLYY

SEQ ID NO: 1909367 - protein, 19 aa, Staphylococcus
TPVIIVNNYIDAYNTHVVC

SEQ ID NO: 1909368 - protein, 22 aa, Staphylococcus
TPVINTRLVYKAGTLTPIDVST

SEQ ID NO: 1909369 - protein, 27 aa, Staphylococcus
TPVYMQWIDKDGVVSPIYRAHTNNSLS

SEQ ID NO: 1909370 - protein, 17 aa, Staphylococcus
TPWLWPVLFLTTGILEP

SEQ ID NO: 1909371 - protein, 22 aa, Staphylococcus
TPYALLFFDLIVVAISLSVIPI

SEQ ID NO: 1909372 - protein, 23 aa, Staphylococcus
TQFLSWRWIFFINIFVVIIAVPL

SEQ ID NO: 1909373 - protein, 21 aa, Staphylococcus
TRFSIRKYQGFGAASVAIIGF

SEQ ID NO: 1909374 - protein, 26 aa, Staphylococcus
TRIGMFVWLILLLPLPFLLSDLGPVF

SEQ ID NO: 1909375 - protein, 26 aa, Staphylococcus
TRISMFIWLVFLLPLPFLLSGLGVTF

SEQ ID NO: 1909376 - protein, 26 aa, Staphylococcus
TRISMFIWLVLLLPIPFMLSNLGTTF

SEQ ID NO: 1909377 - protein, 26 aa, Staphylococcus
TRISMFIWLVLLLPLPFLLSSLGTTF

SEQ ID NO: 1909378 - protein, 34 aa, Staphylococcus
TRKSKKWLIAIIVILLIIVAIFVTRAVLNHNNNK

SEQ ID NO: 1909379 - protein, 24 aa, Staphylococcus
TSFTIFLVLALIIWSFLYTGFSFA

SEQ ID NO: 1909380 - protein, 25 aa, Staphylococcus
TSILRYYFWFTILLVAVIVGLIVWW

SEQ ID NO: 1909381 - protein, 27 aa, Staphylococcus
TSIQLEIELMTLLVGLGLVLKNRRKKQ

SEQ ID NO: 1909382 - protein, 26 aa, Staphylococcus
TSKQYLIYMLGFMPGFPYLGGLDSRI

SEQ ID NO: 1909383 - protein, 17 aa, Staphylococcus
TSLLLQILIVTLLSVVI

SEQ ID NO: 1909384 - protein, 18 aa, Staphylococcus
TSTYFFLFFFGIIAILAL

SEQ ID NO: 1909385 - protein, 21 aa, Staphylococcus
TTHWGMIFLYVCMAIAGLVLL

SEQ ID NO: 1909386 - protein, 22 aa, Staphylococcus
TTKQRQLFFKDLKLDKTTRNNS

SEQ ID NO: 1909387 - protein, 17 aa, Staphylococcus
TTNMIFGIVFAILTVIF

SEQ ID NO: 1909388 - protein, 26 aa, Staphylococcus
TTTITFLTIFLFSIIIIFFLSNSLRH

SEQ ID NO: 1909389 - protein, 17 aa, Staphylococcus
TVILFSALVSFLFANVY

SEQ ID NO: 1909390 - protein, 20 aa, Staphylococcus
TVILLIAILFKFNLAHVATL

SEQ ID NO: 1909391 - protein, 26 aa, Staphylococcus
TVITFAILLALLKKFAWGPLKEVMDK

SEQ ID NO: 1909392 - protein, 24 aa, Staphylococcus
TVLGWLIIFLMFALPIYLAYHFSD

SEQ ID NO: 1909393 - protein, 22 aa, Staphylococcus
TVTKIVVFILLTFGFYVFFAGH

SEQ ID NO: 1909394 - protein, 20 aa, Staphylococcus
TVTKVVVFILLTFGFYVFFA

SEQ ID NO: 1909395 - protein, 17 aa, Staphylococcus
TWLGVVLQALAAIMFLV

SEQ ID NO: 1909396 - protein, 20 aa, Staphylococcus
TWLLIIIFHIILPAVISFAL

SEQ ID NO: 1909397 - protein, 19 aa, Staphylococcus
TWVVFIPFLPWTIPLHYDN

SEQ ID NO: 1909398 - protein, 18 aa, Staphylococcus
TWYYLLLVLVILIVCVYL

SEQ ID NO: 1909399 - protein, 22 aa, Staphylococcus
TYALLLMIIIISSILTYLIPAG

SEQ ID NO: 1909400 - protein, 20 aa, Staphylococcus
TYFVMTLLNREWWESYKFYQ

SEQ ID NO: 1909401 - protein, 19 aa, Staphylococcus
TYILLFITFIMANVILVAL

SEQ ID NO: 1909402 - protein, 24 aa, Staphylococcus
TYIWYIFFCILLLGLLIIPETPIT

SEQ ID NO: 1909403 - protein, 17 aa, Staphylococcus
TYLIPIASLFVLITISV

SEQ ID NO: 1909404 - protein, 20 aa, Staphylococcus
TYLWWFLFAVYISQAFYTAV

SEQ ID NO: 1909405 - protein, 23 aa, Staphylococcus
VAAILIWLFDFTLADPIASIIVS

SEQ ID NO: 1909406 - protein, 25 aa, Staphylococcus
VAGYLFYFAVIVGVISFIVWMLIQN

SEQ ID NO: 1909407 - protein, 25 aa, Staphylococcus
VAIIIAIICFILFLVALKSKNNMKH

SEQ ID NO: 1909408 - protein, 26 aa, Staphylococcus
VAIIVAILFFILFLVANHSKKKIKNQ

SEQ ID NO: 1909409 - protein, 25 aa, Staphylococcus
VAIVVAIICLILFLVTLKSKNNIKQ

SEQ ID NO: 1909410 - protein, 25 aa, Staphylococcus
VAIVVAVICLILFIVALKSKKKAQE

SEQ ID NO: 1909411 - protein, 32 aa, Staphylococcus
VALAVYLFRFIWVYVLYPLFYLSVSPFQKLMN

SEQ ID NO: 1909412 - protein, 30 aa, Staphylococcus
VALAVYLFRFLWVYVLYPYFYLAVSPFQKM

SEQ ID NO: 1909413 - protein, 28 aa, Staphylococcus
VALAVYLFRFVWVYVLYPYFYLSVSPFQ

SEQ ID NO: 1909414 - protein, 24 aa, Staphylococcus
VALKYIFLLFIWNFSWILGILSFI

SEQ ID NO: 1909415 - protein, 24 aa, Staphylococcus
VALLIFTLIYFLIVLYLCINPNKM

SEQ ID NO: 1909416 - protein, 19 aa, Staphylococcus
VAMYLLPYFVLGNNSWSFV

SEQ ID NO: 1909417 - protein, 28 aa, Staphylococcus
VAVVIALICLILFFVALRNNKKIKRQTV

SEQ ID NO: 1909418 - protein, 23 aa, Staphylococcus
VCDVFLLLFIMKFGFRKIEAIVG

SEQ ID NO: 1909419 - protein, 35 aa, Staphylococcus
VDLGDIGTLGYIIRSKPNTLPDFSGIGVLKSEYTF

SEQ ID NO: 1909420 - protein, 24 aa, Staphylococcus
VDSFFNYLFGWSRYMTYILISLIS

SEQ ID NO: 1909421 - protein, 20 aa, Staphylococcus
VEHILTWLGVVLQALAAIMF

SEQ ID NO: 1909422 - protein, 20 aa, Staphylococcus
VEPFFRFMKAIWGFPRISVR

SEQ ID NO: 1909423 - protein, 29 aa, Staphylococcus
VEPTSTSLPEFDLPSYLASESISASTSMS

SEQ ID NO: 1909424 - protein, 19 aa, Staphylococcus
VESPILFVLIALFASLVFN

SEQ ID NO: 1909425 - protein, 23 aa, Staphylococcus
VFDVFLLLFIMKFGFRKIEAIVG

SEQ ID NO: 1909426 - protein, 23 aa, Staphylococcus
VFDVFLLLFIMRFGFRKIEAIVG

SEQ ID NO: 1909427 - protein, 24 aa, Staphylococcus
VFDVFLLLFIMRFGFRKIEAIVGT

SEQ ID NO: 1909428 - protein, 19 aa, Staphylococcus
VFFALYYFIFRFVIKIFNL

SEQ ID NO: 1909429 - protein, 20 aa, Staphylococcus
VFILLFIMKFGFRKIEAIVG

SEQ ID NO: 1909430 - protein, 20 aa, Staphylococcus
VFMIFLITKFNQVWPILIFL

SEQ ID NO: 1909431 - protein, 19 aa, Staphylococcus
VFNWLMYGLLAYVFSQLSS

SEQ ID NO: 1909432 - protein, 23 aa, Staphylococcus
VFNYWWMFVISFIFFLIAGVLTI

SEQ ID NO: 1909433 - protein, 17 aa, Staphylococcus
VFPLYVWLPGSYYAPPF

SEQ ID NO: 1909434 - protein, 27 aa, Staphylococcus
VFTAIYYFLFRFLILKFNIPLPGRKKD

SEQ ID NO: 1909435 - protein, 20 aa, Staphylococcus
VFVLIFIYFIIDIYFWVNRG

SEQ ID NO: 1909436 - protein, 22 aa, Staphylococcus
VFWRILLFYILAIFVIGMLIPY

SEQ ID NO: 1909437 - protein, 17 aa, Staphylococcus
VGATLIFGAGHDVAKAA

SEQ ID NO: 1909438 - protein, 22 aa, Staphylococcus
VGGFILFFLLKFSHVMTPEMTN

SEQ ID NO: 1909439 - protein, 25 aa, Staphylococcus
VGIAIFTFIIWISLVQPGQFEPALV

SEQ ID NO: 1909440 - protein, 17 aa, Staphylococcus
VGIYLALVLLACSSYLI

SEQ ID NO: 1909441 - protein, 21 aa, Staphylococcus
VGKVSFRFWPLNNFKFNFNPD

SEQ ID NO: 1909442 - protein, 17 aa, Staphylococcus
VGMFIFGVFIAALMILM

SEQ ID NO: 1909443 - protein, 24 aa, Staphylococcus
VGQTLLILIIFFSIMFYAGIGVHN

SEQ ID NO: 1909444 - protein, 23 aa, Staphylococcus
VGQTLLIMIIFVSILFYAGIGVQ

SEQ ID NO: 1909445 - protein, 25 aa, Staphylococcus
VGRFSILFLAINSILFLVFILVYIN

SEQ ID NO: 1909446 - protein, 24 aa, Staphylococcus
VGSYFLFIIIIVFLLYANFLFMKR

SEQ ID NO: 1909447 - protein, 26 aa, Staphylococcus
VGTASILIGVTLIFGVPKVAYAEEMQ

SEQ ID NO: 1909448 - protein, 26 aa, Staphylococcus
VGTASILLGSLLFLGQNDAQAAEETS

SEQ ID NO: 1909449 - protein, 25 aa, Staphylococcus
VGTFSTLIATLVFLGTHTDQAHASE

SEQ ID NO: 1909450 - protein, 29 aa, Staphylococcus
VGVIFLITFLIYLFYSPRLKFDVLENPNK

SEQ ID NO: 1909451 - protein, 20 aa, Staphylococcus
VGWLLFFGIVFFSGSLYILA

SEQ ID NO: 1909452 - protein, 25 aa, Staphylococcus
VHKHYFLFLLILISIFFILTILPKS

SEQ ID NO: 1909453 - protein, 20 aa, Staphylococcus
VHLKLFYFFHAINNSVWFVL

SEQ ID NO: 1909454 - protein, 25 aa, Staphylococcus
VIAALLIIFFRWGWADPLASVIVAI

SEQ ID NO: 1909455 - protein, 19 aa, Staphylococcus
VIAFLPWIIVLIPFLLFKA

SEQ ID NO: 1909456 - protein, 27 aa, Staphylococcus
VIAIICIIYFALKYAPFLRDQDWNPIN

SEQ ID NO: 1909457 - protein, 22 aa, Staphylococcus
VIALTIMFYLNVKLTLAALVIF

SEQ ID NO: 1909458 - protein, 19 aa, Staphylococcus
VIFYILLVVTIIDLLFALK

SEQ ID NO: 1909459 - protein, 29 aa, Staphylococcus
VIGIAVLVFIIWIIFVHPGQFEDALVAMI

SEQ ID NO: 1909460 - protein, 22 aa, Staphylococcus
VIIIALVVVGIMFYLRSSKRQV

SEQ ID NO: 1909461 - protein, 17 aa, Staphylococcus
VIIIILIIAIVLNQRYM

SEQ ID NO: 1909462 - protein, 23 aa, Staphylococcus
VIIMMIVYIALRYAPFLRDQEWN

SEQ ID NO: 1909463 - protein, 26 aa, Staphylococcus
VIITILIILLVLIVAAAIFVFTKLHS

SEQ ID NO: 1909464 - protein, 17 aa, Staphylococcus
VIIVVCVLLFQFINHTG

SEQ ID NO: 1909465 - protein, 25 aa, Staphylococcus
VIIVYLVLVLTFKGGLAPFTILFSL

SEQ ID NO: 1909466 - protein, 25 aa, Staphylococcus
VILFLIIVIIYRQPFLALIVGASLT

SEQ ID NO: 1909467 - protein, 19 aa, Staphylococcus
VILIIFALLFRFIVKLIPV

SEQ ID NO: 1909468 - protein, 24 aa, Staphylococcus
VILLFVFLLLIFHLIRLAIRVEAP

SEQ ID NO: 1909469 - protein, 17 aa, Staphylococcus
VINFQTPEGYTPTKSYQ

SEQ ID NO: 1909470 - protein, 18 aa, Staphylococcus
VINTIQLEIIKKVEAKHE

SEQ ID NO: 1909471 - protein, 18 aa, Staphylococcus
VINVIQKPTARKAINTKA

SEQ ID NO: 1909472 - protein, 17 aa, Staphylococcus
VIQLIFAFILLKTNIGI

SEQ ID NO: 1909473 - protein, 21 aa, Staphylococcus
VISLWIFYEAIMRMIFPKPIE

SEQ ID NO: 1909474 - protein, 23 aa, Staphylococcus
VITLPLVLLFVPLIIPILFLIVA

SEQ ID NO: 1909475 - protein, 18 aa, Staphylococcus
VIVLIIMTLFLNFAPYGK

SEQ ID NO: 1909476 - protein, 29 aa, Staphylococcus
VIVQIVTFIILLALLKKFAWGPLKEVMDK

SEQ ID NO: 1909477 - protein, 20 aa, Staphylococcus
VIVYLIVCLLISFLALISMN

SEQ ID NO: 1909478 - protein, 22 aa, Staphylococcus
VIVYLVLVITFKGGLAPFTILF

SEQ ID NO: 1909479 - protein, 23 aa, Staphylococcus
VIVYLVLVITFKGGLAPFTILFS

SEQ ID NO: 1909480 - protein, 21 aa, Staphylococcus
VIVYQRNYASLPDGRALGTGQ

SEQ ID NO: 1909481 - protein, 39 aa, Staphylococcus
VKDNDQTEIPLVWGPKALPPYNPYVFDKTNNKIAAVLSK

SEQ ID NO: 1909482 - protein, 22 aa, Staphylococcus
VKLFGFLRAIARYYERLYSHRT

SEQ ID NO: 1909483 - protein, 25 aa, Staphylococcus
VKRRIMLFAGILLAIILILSIMVFT

SEQ ID NO: 1909484 - protein, 43 aa, Staphylococcus
VKRTIIKIIGFLFIAFIVLLLLGILLFAYYAWKAPAFNESKLQ

SEQ ID NO: 1909485 - protein, 19 aa, Staphylococcus
VKSIWGGLVAWWQQNHVLI

SEQ ID NO: 1909486 - protein, 24 aa, Staphylococcus
VLAFFLLMFVFRSILVPLKAVLGF

SEQ ID NO: 1909487 - protein, 18 aa, Staphylococcus
VLDKYIYLLYKLNDEEIK

SEQ ID NO: 1909488 - protein, 23 aa, Staphylococcus
VLFIIIVVIYRQPFLALIVGGSL

SEQ ID NO: 1909489 - protein, 23 aa, Staphylococcus
VLFTIIMILYRTPLLGLIVAGSL

SEQ ID NO: 1909490 - protein, 19 aa, Staphylococcus
VLIFIFFLILLILNITVIP

SEQ ID NO: 1909491 - protein, 24 aa, Staphylococcus
VLIIALIVFIVWFSLITPLDFQSS

SEQ ID NO: 1909492 - protein, 17 aa, Staphylococcus
VLISILLLTLISVGIYA

SEQ ID NO: 1909493 - protein, 21 aa, Staphylococcus
VLLIFILIFGDLKFVLESYTL

SEQ ID NO: 1909494 - protein, 22 aa, Staphylococcus
VLLIIFIHWWVKYLGFKRNEDL

SEQ ID NO: 1909495 - protein, 23 aa, Staphylococcus
VLLIIIIVPLTWLILNINDIKEN

SEQ ID NO: 1909496 - protein, 17 aa, Staphylococcus
VLLIIWSVLFVSGIAFA

SEQ ID NO: 1909497 - protein, 18 aa, Staphylococcus
VLMILIPIIFFIPNLFGQ

SEQ ID NO: 1909498 - protein, 17 aa, Staphylococcus
VLMSVVLTYMTWNFSPD

SEQ ID NO: 1909499 - protein, 23 aa, Staphylococcus
VLRYYFWITIALITLIVASIAWL

SEQ ID NO: 1909500 - protein, 25 aa, Staphylococcus
VLSFLIIWLVPRWIKFIPAPLISIV

SEQ ID NO: 1909501 - protein, 23 aa, Staphylococcus
VLSILPWFIVTVPLILFLAQRLD

SEQ ID NO: 1909502 - protein, 18 aa, Staphylococcus
VLSVFLFFKGKKAFWFMF

SEQ ID NO: 1909503 - protein, 18 aa, Staphylococcus
VLVLIVMTLFLNFAPYGK

SEQ ID NO: 1909504 - protein, 29 aa, Staphylococcus
VLVTLITFLILLALLKKFAWGPLKQVMDK

SEQ ID NO: 1909505 - protein, 26 aa, Staphylococcus
VLVVIGVLAFWFWNNATSYVTTDNAK

SEQ ID NO: 1909506 - protein, 17 aa, Staphylococcus
VMDLKKIAKTPAVLVIL

SEQ ID NO: 1909507 - protein, 17 aa, Staphylococcus
VNIFLILIYINKVTKSQ

SEQ ID NO: 1909508 - protein, 33 aa, Staphylococcus
VNLQKELWKYIALIGVVVLIAIYLAVRSIKRTY

SEQ ID NO: 1909509 - protein, 24 aa, Staphylococcus
VNRNIFWILLITLLVLFVAMQIRI

SEQ ID NO: 1909510 - protein, 25 aa, Staphylococcus
VNRNLFWILLIVLLLIFVILQIRIF

SEQ ID NO: 1909511 - protein, 25 aa, Staphylococcus
VPDFIVKFWTLLVSTLIVLVLLGTL

SEQ ID NO: 1909512 - protein, 21 aa, Staphylococcus
VPFIFLVLLRMSALKGMIISA

SEQ ID NO: 1909513 - protein, 21 aa, Staphylococcus
VPIIFAIILLKSSQGAFESSF

SEQ ID NO: 1909514 - protein, 18 aa, Staphylococcus
VQATTLIPVMKPVINTDV

SEQ ID NO: 1909515 - protein, 17 aa, Staphylococcus
VRRDWEFNINSPEFNDL

SEQ ID NO: 1909516 - protein, 19 aa, Staphylococcus
VRWILYVVALFLPVFIIYT

SEQ ID NO: 1909517 - protein, 19 aa, Staphylococcus
VSIFTQLMPLFKWSSQGFQ

SEQ ID NO: 1909518 - protein, 25 aa, Staphylococcus
VSIGKLFMIFLIRTLITLPIIALLA

SEQ ID NO: 1909519 - protein, 33 aa, Staphylococcus
VSILTTLIPVLIIALLFIFFLSQAQGGGGGGGR

SEQ ID NO: 1909520 - protein, 33 aa, Staphylococcus
VSILTTLIPVLIIALLFIFFLSQAQGGGQGGRM

SEQ ID NO: 1909521 - protein, 24 aa, Staphylococcus
VSRLRFMFETFEKRSYESANGGRI

SEQ ID NO: 1909522 - protein, 19 aa, Staphylococcus
VSRRFFLKMLGIGGAGAVI

SEQ ID NO: 1909523 - protein, 23 aa, Staphylococcus
VSTPYALLFFDLIVVVISLTVIS

SEQ ID NO: 1909524 - protein, 17 aa, Staphylococcus
VSWLWFIFLAVVGKMIG

SEQ ID NO: 1909525 - protein, 22 aa, Staphylococcus
VTAPFIPLFYIIFGLKTRDESK

SEQ ID NO: 1909526 - protein, 24 aa, Staphylococcus
VTDITPPYLIKKDGKYYVFNQYLT

SEQ ID NO: 1909527 - protein, 18 aa, Staphylococcus
VTENDIITVLPFGNLISQ

SEQ ID NO: 1909528 - protein, 17 aa, Staphylococcus
VTKIVVFILLTFGFYIY

SEQ ID NO: 1909529 - protein, 19 aa, Staphylococcus
VTKIVVFILLTFGFYVFFA

SEQ ID NO: 1909530 - protein, 25 aa, Staphylococcus
VTLAFLLLMLVFRSIIIPLKAVGGF

SEQ ID NO: 1909531 - protein, 27 aa, Staphylococcus
VTLATFAILLALLKKFAWGPLKEVMDK

SEQ ID NO: 1909532 - protein, 18 aa, Staphylococcus
VTLIFWIISLISLLLMVW

SEQ ID NO: 1909533 - protein, 17 aa, Staphylococcus
VTLPKFFQNISPYLPFT

SEQ ID NO: 1909534 - protein, 23 aa, Staphylococcus
VTQALIFAIIFGIAAIGFIIGAI

SEQ ID NO: 1909535 - protein, 27 aa, Staphylococcus
VTSLRKFLIFITLLALFCSITLLSWLY

SEQ ID NO: 1909536 - protein, 28 aa, Staphylococcus
VTTSITFLIIFIFSLVIIYFLSITLRDN

SEQ ID NO: 1909537 - protein, 23 aa, Staphylococcus
VVCSCYLAFILIGSLQGKDMSNS

SEQ ID NO: 1909538 - protein, 17 aa, Staphylococcus
VVFAIIMWFFVKPDQPL

SEQ ID NO: 1909539 - protein, 17 aa, Staphylococcus
VVFILLTFGFYIYLAGH

SEQ ID NO: 1909540 - protein, 17 aa, Staphylococcus
VVFILLTFGFYVFLAGH

SEQ ID NO: 1909541 - protein, 26 aa, Staphylococcus
VVIAFILFIILLFMFLNQGDEDTGQI

SEQ ID NO: 1909542 - protein, 32 aa, Staphylococcus
VVKKSTIPLGILLFIIGGGLIWFIKRNKSKNC

SEQ ID NO: 1909543 - protein, 23 aa, Staphylococcus
VVLLLIFLALIFHLIRLATKVES

SEQ ID NO: 1909544 - protein, 29 aa, Staphylococcus
VVLNLGMSVLFIIFTFFKESRLSKHFYKN

SEQ ID NO: 1909545 - protein, 18 aa, Staphylococcus
VVLRFWPFGEWTTKFNPG

SEQ ID NO: 1909546 - protein, 18 aa, Staphylococcus
VVLSFLFVLPLTNVLFTI

SEQ ID NO: 1909547 - protein, 18 aa, Staphylococcus
VVMILFLIGLFIMAKKHV

SEQ ID NO: 1909548 - protein, 34 aa, Staphylococcus
VVNSQQTQIPLVWGPKVLPSYTYVTFDKTNNKIG

SEQ ID NO: 1909549 - protein, 24 aa, Staphylococcus
VVTFVALALLAIAFILMVRSIIHL

SEQ ID NO: 1909550 - protein, 18 aa, Staphylococcus
VVWRYWPFNEWKTNFNPG

SEQ ID NO: 1909551 - protein, 22 aa, Staphylococcus
VWPILLFLPFFVSVFVRIKIHY

SEQ ID NO: 1909552 - protein, 20 aa, Staphylococcus
VWVILPWFIIALPIILYYCH

SEQ ID NO: 1909553 - protein, 24 aa, Staphylococcus
VYAFIYYFVFRFLILKFKYKTPGR

SEQ ID NO: 1909554 - protein, 21 aa, Staphylococcus
WAIIVYFIVCLLISFLALISM

SEQ ID NO: 1909555 - protein, 23 aa, Staphylococcus
WDFLSQKWWFVLAIVVIVCGTLS

SEQ ID NO: 1909556 - protein, 17 aa, Staphylococcus
WFIITIPIILMLSHQLD

SEQ ID NO: 1909557 - protein, 18 aa, Staphylococcus
WFLFCVFIFQYIKLLFSN

SEQ ID NO: 1909558 - protein, 26 aa, Staphylococcus
WGDEWIFVMAFLPWIIIILPYLFYKS

SEQ ID NO: 1909559 - protein, 17 aa, Staphylococcus
WIGFFSNLLFIPYYSLI

SEQ ID NO: 1909560 - protein, 18 aa, Staphylococcus
WIGNILHLLYLGFIALMV

SEQ ID NO: 1909561 - protein, 17 aa, Staphylococcus
WIIAIFLAVLLALIIFG

SEQ ID NO: 1909562 - protein, 22 aa, Staphylococcus
WISILPVWLFVKAPRYIKMINI

SEQ ID NO: 1909563 - protein, 17 aa, Staphylococcus
WIVIVISIVILIGSIGL

SEQ ID NO: 1909564 - protein, 18 aa, Staphylococcus
WLAYLILILTIVLTLTAL

SEQ ID NO: 1909565 - protein, 18 aa, Staphylococcus
WLLIVFVLVIIINASWNT

SEQ ID NO: 1909566 - protein, 18 aa, Staphylococcus
WLLLFIFLQVTLSLYALS

SEQ ID NO: 1909567 - protein, 17 aa, Staphylococcus
WLVPWLSAKRVGKLKQQ

SEQ ID NO: 1909568 - protein, 19 aa, Staphylococcus
WLVVMLILLFIFYRRARVI

SEQ ID NO: 1909569 - protein, 17 aa, Staphylococcus
WLWPVLFLTTGILEPIA

SEQ ID NO: 1909570 - protein, 18 aa, Staphylococcus
WLYLMLFIRGCSVGGIML

SEQ ID NO: 1909571 - protein, 20 aa, Staphylococcus
WMIFIGWLSYFLLGFYIGTY

SEQ ID NO: 1909572 - protein, 25 aa, Staphylococcus
WMSTWTLYYWGWWLSWSPFVGVFIA

SEQ ID NO: 1909573 - protein, 17 aa, Staphylococcus
WPILFFLPFVVSVFMRI

SEQ ID NO: 1909574 - protein, 17 aa, Staphylococcus
WPILITLLVFTFSKGVN

SEQ ID NO: 1909575 - protein, 20 aa, Staphylococcus
WPIVIVLLILFFFYSHYLFA

SEQ ID NO: 1909576 - protein, 18 aa, Staphylococcus
WPIVLVLLILFYFYSHYL

SEQ ID NO: 1909577 - protein, 24 aa, Staphylococcus
WQTYIMIIIYFTILLFIGYYGYKQ

SEQ ID NO: 1909578 - protein, 19 aa, Staphylococcus
WSAWALFIVCIMILALIIE

SEQ ID NO: 1909579 - protein, 26 aa, Staphylococcus
WSLNHKWIVLILTTLILIGSIALGAA

SEQ ID NO: 1909580 - protein, 25 aa, Staphylococcus
WSLNHKWLVIIITTIILIASVVLGG

SEQ ID NO: 1909581 - protein, 20 aa, Staphylococcus
WTWMMLIWILLACVLIGPLL

SEQ ID NO: 1909582 - protein, 21 aa, Staphylococcus
WVRWILYIVALFLPIFIIYTI

SEQ ID NO: 1909583 - protein, 20 aa, Staphylococcus
WVRWILYVVALFLPIFIVYT

SEQ ID NO: 1909584 - protein, 20 aa, Staphylococcus
WVRWILYVVALFLPLFIAYT

SEQ ID NO: 1909585 - protein, 19 aa, Staphylococcus
WWSVVAWVIILAAIIIPLT

SEQ ID NO: 1909586 - protein, 17 aa, Staphylococcus
WWVLLINILIALAALAM

SEQ ID NO: 1909587 - protein, 18 aa, Staphylococcus
WYIFIIIYALFDIYLLWQ

SEQ ID NO: 1909588 - protein, 17 aa, Staphylococcus
WYQYVFLFTDMFLILCL

SEQ ID NO: 1909589 - protein, 17 aa, Staphylococcus
WYVFVIIYFLFIAYILW

SEQ ID NO: 1909590 - protein, 18 aa, Staphylococcus
WYVVIIYAIRMFAVALII

SEQ ID NO: 1909591 - protein, 22 aa, Staphylococcus
WYYLLLVLFILIVCVYLLFSRY

SEQ ID NO: 1909592 - protein, 22 aa, Staphylococcus
YALIYYFLFTFLIKKLNLKTPG

SEQ ID NO: 1909593 - protein, 17 aa, Staphylococcus
YCLFLSLMPLILQVLQR

SEQ ID NO: 1909594 - protein, 19 aa, Staphylococcus
YCTFLIAILLFAWPFIYSA

SEQ ID NO: 1909595 - protein, 23 aa, Staphylococcus
YEKNHLLFILILHSFANVHVSHS

SEQ ID NO: 1909596 - protein, 19 aa, Staphylococcus
YFLFVIILIFIIYSNMLFV

SEQ ID NO: 1909597 - protein, 20 aa, Staphylococcus
YFMLSLFPMLLFLLSIVPVV

SEQ ID NO: 1909598 - protein, 19 aa, Staphylococcus
YFPYVLMRPLLFIAVILGG

SEQ ID NO: 1909599 - protein, 20 aa, Staphylococcus
YFPYVLMRPLLFIAVILGGM

SEQ ID NO: 1909600 - protein, 19 aa, Staphylococcus
YFPYVLMRPLLFVSVILGG

SEQ ID NO: 1909601 - protein, 18 aa, Staphylococcus
YFVILMVLPLWAQHKVKS

SEQ ID NO: 1909602 - protein, 20 aa, Staphylococcus
YFYLLLFITTTLIGALLLYL

SEQ ID NO: 1909603 - protein, 17 aa, Staphylococcus
YFYSIYEMIRWLLNKVN

SEQ ID NO: 1909604 - protein, 18 aa, Staphylococcus
YGLIFIGIIIFFIALIII

SEQ ID NO: 1909605 - protein, 24 aa, Staphylococcus
YGSLWVWPILIIAILFIVNFVVFN

SEQ ID NO: 1909606 - protein, 24 aa, Staphylococcus
YGTALFWILLAITFIAGPYIPNVF

SEQ ID NO: 1909607 - protein, 19 aa, Staphylococcus
YIFFAIIIILSIVGLIRLC

SEQ ID NO: 1909608 - protein, 19 aa, Staphylococcus
YILVFFLFGISVTMIAGAG

SEQ ID NO: 1909609 - protein, 19 aa, Staphylococcus
YIPGYNIPFLIQPASAGEG

SEQ ID NO: 1909610 - protein, 26 aa, Staphylococcus
YISNQDFYRLFRKQSFNNEYLDYLQK

SEQ ID NO: 1909611 - protein, 17 aa, Staphylococcus
YITPTRPIPEGNVTAKA

SEQ ID NO: 1909612 - protein, 22 aa, Staphylococcus
YIVAWFYWLTWTVALGSEFTAV

SEQ ID NO: 1909613 - protein, 17 aa, Staphylococcus
YIVIIMAIPMWAQHNVK

SEQ ID NO: 1909614 - protein, 17 aa, Staphylococcus
YIVPRFFKAIPAPLIAI

SEQ ID NO: 1909615 - protein, 17 aa, Staphylococcus
YIVWFIVITTILSKFGI

SEQ ID NO: 1909616 - protein, 21 aa, Staphylococcus
YKFRYILITLIIILLASMVLF

SEQ ID NO: 1909617 - protein, 35 aa, Staphylococcus
YKQEWFIVLTLIFIFPLGLFVMWRYSKWPSIAKTI

SEQ ID NO: 1909618 - protein, 36 aa, Staphylococcus
YKWMIITTLIMFLTILLFCLVIIFFLKDTLKDGELD

SEQ ID NO: 1909619 - protein, 19 aa, Staphylococcus
YKWMIITTLITFTTILLFC

SEQ ID NO: 1909620 - protein, 21 aa, Staphylococcus
YLAPYILFSLLIYAILKAYER

SEQ ID NO: 1909621 - protein, 19 aa, Staphylococcus
YLFKKLSWPVGLIIIAVLI

SEQ ID NO: 1909622 - protein, 17 aa, Staphylococcus
YLLIIFMSNAIFGVLQD

SEQ ID NO: 1909623 - protein, 23 aa, Staphylococcus
YLLYFIFCILLIGLLILPETAIT

SEQ ID NO: 1909624 - protein, 17 aa, Staphylococcus
YLMLFFSTTLVGAILLY

SEQ ID NO: 1909625 - protein, 24 aa, Staphylococcus
YLNTSILLMFWLVVLFALLVYSFN

SEQ ID NO: 1909626 - protein, 24 aa, Staphylococcus
YLQEFNKIVLIDKVKLKAKSQIFD

SEQ ID NO: 1909627 - protein, 19 aa, Staphylococcus
YLRKFPYLVFPDNVAIALG

SEQ ID NO: 1909628 - protein, 24 aa, Staphylococcus
YLSLIGIIVLLAIYLAVRSINRTY

SEQ ID NO: 1909629 - protein, 23 aa, Staphylococcus
YLTIAPWLFFFPGILLGGYALLF

SEQ ID NO: 1909630 - protein, 21 aa, Staphylococcus
YLTKDFAEFTTYINQNRAFNT

SEQ ID NO: 1909631 - protein, 17 aa, Staphylococcus
YLVMLPLTFIFGADLLL

SEQ ID NO: 1909632 - protein, 20 aa, Staphylococcus
YLWPGFLLILFIASFIINAA

SEQ ID NO: 1909633 - protein, 18 aa, Staphylococcus
YLWWFMFAVYISNAFFTL

SEQ ID NO: 1909634 - protein, 19 aa, Staphylococcus
YMPELKWHYAYFICLGVML

SEQ ID NO: 1909635 - protein, 20 aa, Staphylococcus
YMTYILISLISLYIAFAGKI

SEQ ID NO: 1909636 - protein, 17 aa, Staphylococcus
YPFMMFGLPAAAFAIYR

SEQ ID NO: 1909637 - protein, 19 aa, Staphylococcus
YPIGTFLHASNKGAPYLLP

SEQ ID NO: 1909638 - protein, 22 aa, Staphylococcus
YQNLLVNLLIILAYILIGMIVI

SEQ ID NO: 1909639 - protein, 20 aa, Staphylococcus
YRPHYFLKIRIPFTPGLIPK

SEQ ID NO: 1909640 - protein, 21 aa, Staphylococcus
YSAPWLFFFPGILLGGFALTC

SEQ ID NO: 1909641 - protein, 20 aa, Staphylococcus
YSAPWLFIFPGVLLGGFALI

SEQ ID NO: 1909642 - protein, 18 aa, Staphylococcus
YSGHRLLKGPNNFGGGVV

SEQ ID NO: 1909643 - protein, 17 aa, Staphylococcus
YSIVKFNNQTIGRFVKE

SEQ ID NO: 1909644 - protein, 17 aa, Staphylococcus
YSIYEMIRWLLNKVNEP

SEQ ID NO: 1909645 - protein, 20 aa, Staphylococcus
YTFVLLFITIVLFVTAVHSA

SEQ ID NO: 1909646 - protein, 17 aa, Staphylococcus
YTLLPLIMVLLGEKIFW

SEQ ID NO: 1909647 - protein, 18 aa, Staphylococcus
YVFAVRLRWFPVAGWEGF

SEQ ID NO: 1909648 - protein, 18 aa, Staphylococcus
YVGILTCCLVFLLVLVSN

SEQ ID NO: 1909649 - protein, 19 aa, Staphylococcus
YVGWRWIFILSIIFAFIAI

SEQ ID NO: 1909650 - protein, 22 aa, Staphylococcus
YVQWLKFAWKLIALWAIICAIA

SEQ ID NO: 1909651 - protein, 20 aa, Staphylococcus
YWRFILLMFMSIFGMVGWLI

SEQ ID NO: 1909652 - protein, 19 aa, Staphylococcus
YYFGFFSFGLLIATGTLAH

SEQ ID NO: 1909653 - protein, 26 aa, Staphylococcus
YYKFRYILIMLIILLLGIMVLFISGL

SEQ ID NO: 1909654 - protein, 18 aa, Staphylococcus
YYTSLWYFITFGAFVAFG

SEQ ID NO: 1909655 - protein, 9 aa, Staphylococcus
LTNGPLEGI

SEQ ID NO: 1909656 - protein, 8 aa, Staphylococcus
NGKKTSTI

SEQ ID NO: 1909657 - protein, 12 aa, Staphylococcus
STTKKEIKQPKV

SEQ ID NO: 1909658 - protein, 11 aa, Staphylococcus
AQEYRSQKSIA

SEQ ID NO: 1909659 - protein, 6 aa, Staphylococcus
KKHKGR

SEQ ID NO: 1909660 - protein, 4 aa, Staphylococcus
SHFT

SEQ ID NO: 1909661 - protein, 11 aa, Staphylococcus
AASDVGQSSFD

SEQ ID NO: 1909662 - protein, 7 aa, Staphylococcus
RGATSYH

SEQ ID NO: 1909663 - protein, 5 aa, Staphylococcus
IPDNE

SEQ ID NO: 1909664 - protein, 9 aa, Staphylococcus
ENCSTKNEN

SEQ ID NO: 1909665 - protein, 9 aa, Staphylococcus
GPSGSGKST

SEQ ID NO: 1909666 - protein, 5 aa, Staphylococcus
KNRRS

SEQ ID NO: 1909667 - protein, 4 aa, Staphylococcus
KEIE

SEQ ID NO: 1909668 - protein, 8 aa, Staphylococcus
KTKKYKSD

SEQ ID NO: 1909669 - protein, 7 aa, Staphylococcus
TSNRPLY

SEQ ID NO: 1909670 - protein, 9 aa, Staphylococcus
AGYGSESNY

SEQ ID NO: 1909671 - protein, 10 aa, Staphylococcus
EDHDNELTKE

SEQ ID NO: 1909672 - protein, 6 aa, Staphylococcus
IEANAN

SEQ ID NO: 1909673 - protein, 13 aa, Staphylococcus
KDRNSYSKTDHDA

SEQ ID NO: 1909674 - protein, 9 aa, Staphylococcus
KIKKYKKQI

SEQ ID NO: 1909675 - protein, 8 aa, Staphylococcus
NQKPSYKT

SEQ ID NO: 1909676 - protein, 7 aa, Staphylococcus
QNPTDTR

SEQ ID NO: 1909677 - protein, 11 aa, Staphylococcus
HMKNGQLKPGY

SEQ ID NO: 1909678 - protein, 14 aa, Staphylococcus
IQNHESKMNEDSKA

SEQ ID NO: 1909679 - protein, 5 aa, Staphylococcus
KYGYK

SEQ ID NO: 1909680 - protein, 11 aa, Staphylococcus
NNEKCTKTRKQ

SEQ ID NO: 1909681 - protein, 4 aa, Staphylococcus
PTNH

SEQ ID NO: 1909682 - protein, 14 aa, Staphylococcus
TRYQSINTAKNTLK

SEQ ID NO: 1909683 - protein, 7 aa, Staphylococcus
QRDNHSA

SEQ ID NO: 1909684 - protein, 4 aa, Staphylococcus
ENRV

SEQ ID NO: 1909685 - protein, 5 aa, Staphylococcus
EVRRR

SEQ ID NO: 1909686 - protein, 16 aa, Staphylococcus
EYERTENRQSQRNGYY

SEQ ID NO: 1909687 - protein, 5 aa, Staphylococcus
HKKAY

SEQ ID NO: 1909688 - protein, 11 aa, Staphylococcus
IPKKNSKSFRE

SEQ ID NO: 1909689 - protein, 6 aa, Staphylococcus
KDDVSK

SEQ ID NO: 1909690 - protein, 7 aa, Staphylococcus
NQTSANR

SEQ ID NO: 1909691 - protein, 8 aa, Staphylococcus
PRTRDGHF

SEQ ID NO: 1909692 - protein, 10 aa, Staphylococcus
QGNSHNRLKS

SEQ ID NO: 1909693 - protein, 8 aa, Staphylococcus
QPKYSKAC

SEQ ID NO: 1909694 - protein, 5 aa, Staphylococcus
QRNEK

SEQ ID NO: 1909695 - protein, 5 aa, Staphylococcus
QRTEY

SEQ ID NO: 1909696 - protein, 5 aa, Staphylococcus
REAKN

SEQ ID NO: 1909697 - protein, 6 aa, Staphylococcus
RGLQGT

SEQ ID NO: 1909698 - protein, 8 aa, Staphylococcus
SGESEETW

SEQ ID NO: 1909699 - protein, 6 aa, Staphylococcus
SLDDGF

SEQ ID NO: 1909700 - protein, 5 aa, Staphylococcus
SVSKS

SEQ ID NO: 1909701 - protein, 7 aa, Staphylococcus
TKDGDRE

SEQ ID NO: 1909702 - protein, 6 aa, Staphylococcus
VSTRKV

SEQ ID NO: 1909703 - protein, 17 aa, Staphylococcus
FGKPQKVITDQAPSTKV

SEQ ID NO: 1909704 - protein, 9 aa, Staphylococcus
GPSGSGKTT

SEQ ID NO: 1909705 - protein, 4 aa, Staphylococcus
AEGH

SEQ ID NO: 1909706 - protein, 4 aa, Staphylococcus
AEEV

SEQ ID NO: 1909707 - protein, 6 aa, Staphylococcus
AGPGGY

SEQ ID NO: 1909708 - protein, 8 aa, Staphylococcus
NSKTNKKI

SEQ ID NO: 1909709 - protein, 4 aa, Staphylococcus
RKRP

SEQ ID NO: 1909710 - protein, 7 aa, Staphylococcus
SGAGKST

SEQ ID NO: 1909711 - protein, 4 aa, Staphylococcus
TEKG

SEQ ID NO: 1909712 - protein, 5 aa, Staphylococcus
YIGGH

SEQ ID NO: 1909713 - protein, 9 aa, Staphylococcus
GRSGSGKSS

SEQ ID NO: 1909714 - protein, 7 aa, Staphylococcus
GSGSTEH

SEQ ID NO: 1909715 - protein, 14 aa, Staphylococcus
KKLSEPETKNIYSQ

SEQ ID NO: 1909716 - protein, 8 aa, Staphylococcus
RPNVGKSS

SEQ ID NO: 1909717 - protein, 10 aa, Staphylococcus
VAGGIKPDTI

SEQ ID NO: 1909718 - protein, 4 aa, Staphylococcus
YEVS

SEQ ID NO: 1909719 - protein, 4 aa, Staphylococcus
AQLG

SEQ ID NO: 1909720 - protein, 7 aa, Staphylococcus
DEPTTAL

SEQ ID NO: 1909721 - protein, 13 aa, Staphylococcus
EGDRGPQAANVVK

SEQ ID NO: 1909722 - protein, 4 aa, Staphylococcus
ETSE

SEQ ID NO: 1909723 - protein, 4 aa, Staphylococcus
FDEK

SEQ ID NO: 1909724 - protein, 10 aa, Staphylococcus
FTNAQGEREA

SEQ ID NO: 1909725 - protein, 6 aa, Staphylococcus
GGVDSS

SEQ ID NO: 1909726 - protein, 4 aa, Staphylococcus
GHSE

SEQ ID NO: 1909727 - protein, 4 aa, Staphylococcus
IGGG

SEQ ID NO: 1909728 - protein, 4 aa, Staphylococcus
KAHP

SEQ ID NO: 1909729 - protein, 4 aa, Staphylococcus
MGGK

SEQ ID NO: 1909730 - protein, 10 aa, Staphylococcus
PFNQPGVEAY

SEQ ID NO: 1909731 - protein, 5 aa, Staphylococcus
SAGGV

SEQ ID NO: 1909732 - protein, 4 aa, Staphylococcus
TGGG

SEQ ID NO: 1909733 - protein, 5 aa, Staphylococcus
TGRTH

SEQ ID NO: 1909734 - protein, 9 aa, Staphylococcus
TGVGKTELA

SEQ ID NO: 1909735 - protein, 5 aa, Staphylococcus
TPSNP

SEQ ID NO: 1909736 - protein, 4 aa, Staphylococcus
TTYG

SEQ ID NO: 1909737 - protein, 4 aa, Staphylococcus
VNGK

SEQ ID NO: 1909738 - protein, 29 aa, Staphylococcus
AANNTGGAVKKREDTHKMAEANKAFAHYR

SEQ ID NO: 1909739 - protein, 9 aa, Staphylococcus
AASETELKE

SEQ ID NO: 1909740 - protein, 10 aa, Staphylococcus
AASGGGGKGI

SEQ ID NO: 1909741 - protein, 9 aa, Staphylococcus
AASNNGVDE

SEQ ID NO: 1909742 - protein, 7 aa, Staphylococcus
AAYPGQG

SEQ ID NO: 1909743 - protein, 5 aa, Staphylococcus
ACPTC

SEQ ID NO: 1909744 - protein, 8 aa, Staphylococcus
ADGPMPQT

SEQ ID NO: 1909745 - protein, 4 aa, Staphylococcus
ADLR

SEQ ID NO: 1909746 - protein, 7 aa, Staphylococcus
ADTDGAH

SEQ ID NO: 1909747 - protein, 7 aa, Staphylococcus
ADTGVDP

SEQ ID NO: 1909748 - protein, 9 aa, Staphylococcus
AEADTTYGK

SEQ ID NO: 1909749 - protein, 7 aa, Staphylococcus
AEAGDNI

SEQ ID NO: 1909750 - protein, 8 aa, Staphylococcus
AEHNYDMN

SEQ ID NO: 1909751 - protein, 13 aa, Staphylococcus
AGDGFQGAEISPY

SEQ ID NO: 1909752 - protein, 11 aa, Staphylococcus
AGDGGNGITAY

SEQ ID NO: 1909753 - protein, 7 aa, Staphylococcus
AGGAAHL

SEQ ID NO: 1909754 - protein, 5 aa, Staphylococcus
AGIEA

SEQ ID NO: 1909755 - protein, 7 aa, Staphylococcus
AGKGAVE

SEQ ID NO: 1909756 - protein, 5 aa, Staphylococcus
AGKST

SEQ ID NO: 1909757 - protein, 8 aa, Staphylococcus
AGKTTTTE

SEQ ID NO: 1909758 - protein, 5 aa, Staphylococcus
AGLPK

SEQ ID NO: 1909759 - protein, 9 aa, Staphylococcus
AGMARDGKT

SEQ ID NO: 1909760 - protein, 4 aa, Staphylococcus
AGNI

SEQ ID NO: 1909761 - protein, 4 aa, Staphylococcus
AGPN

SEQ ID NO: 1909762 - protein, 6 aa, Staphylococcus
AGQGKV

SEQ ID NO: 1909763 - protein, 9 aa, Staphylococcus
AHDAKTTRL

SEQ ID NO: 1909764 - protein, 6 aa, Staphylococcus
AIKPGQ

SEQ ID NO: 1909765 - protein, 7 aa, Staphylococcus
AKDRQQE

SEQ ID NO: 1909766 - protein, 11 aa, Staphylococcus
AKETKNKTSFP

SEQ ID NO: 1909767 - protein, 6 aa, Staphylococcus
AKPETL

SEQ ID NO: 1909768 - protein, 7 aa, Staphylococcus
AKPGEIS

SEQ ID NO: 1909769 - protein, 5 aa, Staphylococcus
ALNDA

SEQ ID NO: 1909770 - protein, 8 aa, Staphylococcus
ANGAGKST

SEQ ID NO: 1909771 - protein, 6 aa, Staphylococcus
ANKPPT

SEQ ID NO: 1909772 - protein, 9 aa, Staphylococcus
APEDEQTET

SEQ ID NO: 1909773 - protein, 5 aa, Staphylococcus
APEYG

SEQ ID NO: 1909774 - protein, 8 aa, Staphylococcus
APLGSGKS

SEQ ID NO: 1909775 - protein, 10 aa, Staphylococcus
APRPHNSGHY

SEQ ID NO: 1909776 - protein, 11 aa, Staphylococcus
AQGTSSRSTKL

SEQ ID NO: 1909777 - protein, 7 aa, Staphylococcus
AQNTTHA

SEQ ID NO: 1909778 - protein, 4 aa, Staphylococcus
AQTG

SEQ ID NO: 1909779 - protein, 7 aa, Staphylococcus
AREGGNN

SEQ ID NO: 1909780 - protein, 6 aa, Staphylococcus
ARGNSG

SEQ ID NO: 1909781 - protein, 5 aa, Staphylococcus
ARPAI

SEQ ID NO: 1909782 - protein, 14 aa, Staphylococcus
ARQDRKARSREPIT

SEQ ID NO: 1909783 - protein, 9 aa, Staphylococcus
ASAPEGTSE

SEQ ID NO: 1909784 - protein, 5 aa, Staphylococcus
ASLEA

SEQ ID NO: 1909785 - protein, 7 aa, Staphylococcus
ASLETES

SEQ ID NO: 1909786 - protein, 6 aa, Staphylococcus
ASPEKI

SEQ ID NO: 1909787 - protein, 4 aa, Staphylococcus
ATIR

SEQ ID NO: 1909788 - protein, 12 aa, Staphylococcus
ATSALDPQTTDE

SEQ ID NO: 1909789 - protein, 14 aa, Staphylococcus
ATSSEKSQIQNREK

SEQ ID NO: 1909790 - protein, 7 aa, Staphylococcus
AVEAGES

SEQ ID NO: 1909791 - protein, 14 aa, Staphylococcus
AVPGGSSGGSAAAV

SEQ ID NO: 1909792 - protein, 7 aa, Staphylococcus
CKQSGAR

SEQ ID NO: 1909793 - protein, 8 aa, Staphylococcus
CPLGPRPI

SEQ ID NO: 1909794 - protein, 9 aa, Staphylococcus
CTGKGNDQV

SEQ ID NO: 1909795 - protein, 8 aa, Staphylococcus
DADGVTST

SEQ ID NO: 1909796 - protein, 7 aa, Staphylococcus
DAGREGE

SEQ ID NO: 1909797 - protein, 15 aa, Staphylococcus
DAQTYGSQGQQRTTA

SEQ ID NO: 1909798 - protein, 8 aa, Staphylococcus
DDKETVNH

SEQ ID NO: 1909799 - protein, 8 aa, Staphylococcus
DDSTPIES

SEQ ID NO: 1909800 - protein, 4 aa, Staphylococcus
DEEI

SEQ ID NO: 1909801 - protein, 6 aa, Staphylococcus
DERAKA

SEQ ID NO: 1909802 - protein, 6 aa, Staphylococcus
DFPGDD

SEQ ID NO: 1909803 - protein, 8 aa, Staphylococcus
DGTMSSKI

SEQ ID NO: 1909804 - protein, 4 aa, Staphylococcus
DGVA

SEQ ID NO: 1909805 - protein, 8 aa, Staphylococcus
DGYGQTES

SEQ ID NO: 1909806 - protein, 9 aa, Staphylococcus
DKAQTTRNK

SEQ ID NO: 1909807 - protein, 5 aa, Staphylococcus
DKNDN

SEQ ID NO: 1909808 - protein, 10 aa, Staphylococcus
DKPDVDTIEG

SEQ ID NO: 1909809 - protein, 4 aa, Staphylococcus
DKPR

SEQ ID NO: 1909810 - protein, 7 aa, Staphylococcus
DLPPEKV

SEQ ID NO: 1909811 - protein, 9 aa, Staphylococcus
DLSGGEKAR

SEQ ID NO: 1909812 - protein, 5 aa, Staphylococcus
DMSGV

SEQ ID NO: 1909813 - protein, 18 aa, Staphylococcus
DNGRRGRPVTGPGNRPLK

SEQ ID NO: 1909814 - protein, 8 aa, Staphylococcus
DNGTPIKT

SEQ ID NO: 1909815 - protein, 7 aa, Staphylococcus
DNSGARE

SEQ ID NO: 1909816 - protein, 6 aa, Staphylococcus
DPGNYK

SEQ ID NO: 1909817 - protein, 10 aa, Staphylococcus
DPKTNEPTRV

SEQ ID NO: 1909818 - protein, 8 aa, Staphylococcus
DPTDQKSV

SEQ ID NO: 1909819 - protein, 7 aa, Staphylococcus
DSDQSIY

SEQ ID NO: 1909820 - protein, 5 aa, Staphylococcus
DSFGT

SEQ ID NO: 1909821 - protein, 7 aa, Staphylococcus
DSQELSD

SEQ ID NO: 1909822 - protein, 8 aa, Staphylococcus
DSRGNPTV

SEQ ID NO: 1909823 - protein, 15 aa, Staphylococcus
DSTEAEKPGYNTPEN

SEQ ID NO: 1909824 - protein, 6 aa, Staphylococcus
DTFRAG

SEQ ID NO: 1909825 - protein, 6 aa, Staphylococcus
DTGRTH

SEQ ID NO: 1909826 - protein, 7 aa, Staphylococcus
DTKRQGS

SEQ ID NO: 1909827 - protein, 14 aa, Staphylococcus
DTQDIADELKNRRA

SEQ ID NO: 1909828 - protein, 6 aa, Staphylococcus
DTVTES

SEQ ID NO: 1909829 - protein, 6 aa, Staphylococcus
DVGGRY

SEQ ID NO: 1909830 - protein, 5 aa, Staphylococcus
DVPNA

SEQ ID NO: 1909831 - protein, 4 aa, Staphylococcus
DYTD

SEQ ID NO: 1909832 - protein, 6 aa, Staphylococcus
EAIREA

SEQ ID NO: 1909833 - protein, 7 aa, Staphylococcus
EDCGTDR

SEQ ID NO: 1909834 - protein, 5 aa, Staphylococcus
EDPHN

SEQ ID NO: 1909835 - protein, 11 aa, Staphylococcus
EDQLPSVGPGQ

SEQ ID NO: 1909836 - protein, 5 aa, Staphylococcus
EDTRI

SEQ ID NO: 1909837 - protein, 5 aa, Staphylococcus
EERTV

SEQ ID NO: 1909838 - protein, 7 aa, Staphylococcus
EETDPTI

SEQ ID NO: 1909839 - protein, 5 aa, Staphylococcus
EGAAR

SEQ ID NO: 1909840 - protein, 6 aa, Staphylococcus
EGASVN

SEQ ID NO: 1909841 - protein, 5 aa, Staphylococcus
EGIHE

SEQ ID NO: 1909842 - protein, 10 aa, Staphylococcus
EGPKGGPGMP

SEQ ID NO: 1909843 - protein, 6 aa, Staphylococcus
EGQRRY

SEQ ID NO: 1909844 - protein, 6 aa, Staphylococcus
EGTMPQ

SEQ ID NO: 1909845 - protein, 9 aa, Staphylococcus
EGVSTRHNP

SEQ ID NO: 1909846 - protein, 11 aa, Staphylococcus
EIAQSEAHNHA

SEQ ID NO: 1909847 - protein, 12 aa, Staphylococcus
EIRGEQKEIGWG

SEQ ID NO: 1909848 - protein, 6 aa, Staphylococcus
EKAGAN

SEQ ID NO: 1909849 - protein, 6 aa, Staphylococcus
EKIAPT

SEQ ID NO: 1909850 - protein, 12 aa, Staphylococcus
EKQKAGKAKMKA

SEQ ID NO: 1909851 - protein, 6 aa, Staphylococcus
EKRGRN

SEQ ID NO: 1909852 - protein, 8 aa, Staphylococcus
EKSAQTYN

SEQ ID NO: 1909853 - protein, 11 aa, Staphylococcus
EKTPSFTVSED

SEQ ID NO: 1909854 - protein, 4 aa, Staphylococcus
ELEE

SEQ ID NO: 1909855 - protein, 8 aa, Staphylococcus
ENAQGKTN

SEQ ID NO: 1909856 - protein, 7 aa, Staphylococcus
ENQEGID

SEQ ID NO: 1909857 - protein, 12 aa, Staphylococcus
ENTRVGQSSDFD

SEQ ID NO: 1909858 - protein, 5 aa, Staphylococcus
EPEGI

SEQ ID NO: 1909859 - protein, 7 aa, Staphylococcus
EPGVGKT

SEQ ID NO: 1909860 - protein, 8 aa, Staphylococcus
EPHKIPPT

SEQ ID NO: 1909861 - protein, 12 aa, Staphylococcus
EPKSKADQDKMT

SEQ ID NO: 1909862 - protein, 7 aa, Staphylococcus
EPTNGLD

SEQ ID NO: 1909863 - protein, 14 aa, Staphylococcus
EQHIRRDKATSNIC

SEQ ID NO: 1909864 - protein, 5 aa, Staphylococcus
ESGAF

SEQ ID NO: 1909865 - protein, 12 aa, Staphylococcus
ESGTKTAQTIKS

SEQ ID NO: 1909866 - protein, 12 aa, Staphylococcus
ESNGSSSQASIC

SEQ ID NO: 1909867 - protein, 8 aa, Staphylococcus
ETPEGPNI

SEQ ID NO: 1909868 - protein, 8 aa, Staphylococcus
ETPPENRF

SEQ ID NO: 1909869 - protein, 8 aa, Staphylococcus
ETTSEKNA

SEQ ID NO: 1909870 - protein, 5 aa, Staphylococcus
EVEQS

SEQ ID NO: 1909871 - protein, 9 aa, Staphylococcus
EWRGDKQLR

SEQ ID NO: 1909872 - protein, 9 aa, Staphylococcus
FAAADGRVE

SEQ ID NO: 1909873 - protein, 6 aa, Staphylococcus
FARSGD

SEQ ID NO: 1909874 - protein, 12 aa, Staphylococcus
FDCPNRDGTVAH

SEQ ID NO: 1909875 - protein, 5 aa, Staphylococcus
FDYAG

SEQ ID NO: 1909876 - protein, 9 aa, Staphylococcus
FKPRTSPYD

SEQ ID NO: 1909877 - protein, 4 aa, Staphylococcus
FNTD

SEQ ID NO: 1909878 - protein, 4 aa, Staphylococcus
FPDD

SEQ ID NO: 1909879 - protein, 10 aa, Staphylococcus
GAGKTTTAGK

SEQ ID NO: 1909880 - protein, 11 aa, Staphylococcus
GAGTDPSEGAA

SEQ ID NO: 1909881 - protein, 9 aa, Staphylococcus
GAKQVRKKF

SEQ ID NO: 1909882 - protein, 7 aa, Staphylococcus
GAQELQD

SEQ ID NO: 1909883 - protein, 19 aa, Staphylococcus
GARKGLADTALKTADSGYL

SEQ ID NO: 1909884 - protein, 9 aa, Staphylococcus
GASPGASTA

SEQ ID NO: 1909885 - protein, 9 aa, Staphylococcus
GATGTGKTF

SEQ ID NO: 1909886 - protein, 4 aa, Staphylococcus
GDGP

SEQ ID NO: 1909887 - protein, 5 aa, Staphylococcus
GDGYT

SEQ ID NO: 1909888 - protein, 8 aa, Staphylococcus
GDPGIGKS

SEQ ID NO: 1909889 - protein, 8 aa, Staphylococcus
GDSAVEEG

SEQ ID NO: 1909890 - protein, 11 aa, Staphylococcus
GDSGIGKSETA

SEQ ID NO: 1909891 - protein, 8 aa, Staphylococcus
GDVGSGKT

SEQ ID NO: 1909892 - protein, 10 aa, Staphylococcus
GEAARRIGEG

SEQ ID NO: 1909893 - protein, 11 aa, Staphylococcus
GEAEKSTSLYT

SEQ ID NO: 1909894 - protein, 9 aa, Staphylococcus
GEEFGGRDH

SEQ ID NO: 1909895 - protein, 10 aa, Staphylococcus
GEGKKMSKSL

SEQ ID NO: 1909896 - protein, 10 aa, Staphylococcus
GEGPSGPNTE

SEQ ID NO: 1909897 - protein, 4 aa, Staphylococcus
GERL

SEQ ID NO: 1909898 - protein, 7 aa, Staphylococcus
GESAPKI

SEQ ID NO: 1909899 - protein, 9 aa, Staphylococcus
GETHEGASQ

SEQ ID NO: 1909900 - protein, 5 aa, Staphylococcus
GGDGT

SEQ ID NO: 1909901 - protein, 6 aa, Staphylococcus
GGERAL

SEQ ID NO: 1909902 - protein, 11 aa, Staphylococcus
GGGATKEKVTE

SEQ ID NO: 1909903 - protein, 11 aa, Staphylococcus
GGPQGDAGLTG

SEQ ID NO: 1909904 - protein, 7 aa, Staphylococcus
GGQDSTT

SEQ ID NO: 1909905 - protein, 10 aa, Staphylococcus
GGSGRKTANI

SEQ ID NO: 1909906 - protein, 5 aa, Staphylococcus
GGSIN

SEQ ID NO: 1909907 - protein, 6 aa, Staphylococcus
GGSTNT

SEQ ID NO: 1909908 - protein, 12 aa, Staphylococcus
GGVAGSDITQGL

SEQ ID NO: 1909909 - protein, 7 aa, Staphylococcus
GGVDSSV

SEQ ID NO: 1909910 - protein, 4 aa, Staphylococcus
GGVH

SEQ ID NO: 1909911 - protein, 6 aa, Staphylococcus
GIEPQT

SEQ ID NO: 1909912 - protein, 9 aa, Staphylococcus
GIHKPKHKL

SEQ ID NO: 1909913 - protein, 15 aa, Staphylococcus
GIPAKARRKGGHPAK

SEQ ID NO: 1909914 - protein, 7 aa, Staphylococcus
GISKEGE

SEQ ID NO: 1909915 - protein, 5 aa, Staphylococcus
GKDAE

SEQ ID NO: 1909916 - protein, 16 aa, Staphylococcus
GKFGQGGYKTSGGLHG

SEQ ID NO: 1909917 - protein, 6 aa, Staphylococcus
GKGPVV

SEQ ID NO: 1909918 - protein, 8 aa, Staphylococcus
GKGTQASE

SEQ ID NO: 1909919 - protein, 4 aa, Staphylococcus
GKIN

SEQ ID NO: 1909920 - protein, 8 aa, Staphylococcus
GKKGYGYN

SEQ ID NO: 1909921 - protein, 12 aa, Staphylococcus
GKMSKSKGNVVD

SEQ ID NO: 1909922 - protein, 7 aa, Staphylococcus
GKNRSPL

SEQ ID NO: 1909923 - protein, 5 aa, Staphylococcus
GKPKK

SEQ ID NO: 1909924 - protein, 9 aa, Staphylococcus
GKRGQNARL

SEQ ID NO: 1909925 - protein, 6 aa, Staphylococcus
GKSTLA

SEQ ID NO: 1909926 - protein, 4 aa, Staphylococcus
GKTT

SEQ ID NO: 1909927 - protein, 5 aa, Staphylococcus
GLDTS

SEQ ID NO: 1909928 - protein, 12 aa, Staphylococcus
GLMPNPKTGTVT

SEQ ID NO: 1909929 - protein, 4 aa, Staphylococcus
GMTE

SEQ ID NO: 1909930 - protein, 6 aa, Staphylococcus
GNAGNI

SEQ ID NO: 1909931 - protein, 6 aa, Staphylococcus
GNRFPH

SEQ ID NO: 1909932 - protein, 5 aa, Staphylococcus
GNYQI

SEQ ID NO: 1909933 - protein, 8 aa, Staphylococcus
GPAGTGKT

SEQ ID NO: 1909934 - protein, 8 aa, Staphylococcus
GPDFPTGG

SEQ ID NO: 1909935 - protein, 10 aa, Staphylococcus
GPESSGKTTV

SEQ ID NO: 1909936 - protein, 8 aa, Staphylococcus
GPGEGAGV

SEQ ID NO: 1909937 - protein, 9 aa, Staphylococcus
GPNGAGKST

SEQ ID NO: 1909938 - protein, 9 aa, Staphylococcus
GPNGEDGTI

SEQ ID NO: 1909939 - protein, 7 aa, Staphylococcus
GPPYANG

SEQ ID NO: 1909940 - protein, 10 aa, Staphylococcus
GPRGTGKTSI

SEQ ID NO: 1909941 - protein, 10 aa, Staphylococcus
GPSGCGKSTY

SEQ ID NO: 1909942 - protein, 9 aa, Staphylococcus
GPTGSGKST

SEQ ID NO: 1909943 - protein, 16 aa, Staphylococcus
GQINGTSGYEEAAGQG

SEQ ID NO: 1909944 - protein, 8 aa, Staphylococcus
GQLEETAR

SEQ ID NO: 1909945 - protein, 7 aa, Staphylococcus
GQNNERV

SEQ ID NO: 1909946 - protein, 8 aa, Staphylococcus
GRAPGTDM

SEQ ID NO: 1909947 - protein, 7 aa, Staphylococcus
GRARRGE

SEQ ID NO: 1909948 - protein, 9 aa, Staphylococcus
GRNGAGKST

SEQ ID NO: 1909949 - protein, 4 aa, Staphylococcus
GRQS

SEQ ID NO: 1909950 - protein, 8 aa, Staphylococcus
GRTMPGRR

SEQ ID NO: 1909951 - protein, 6 aa, Staphylococcus
GSDQYR

SEQ ID NO: 1909952 - protein, 8 aa, Staphylococcus
GSQGEPMA

SEQ ID NO: 1909953 - protein, 8 aa, Staphylococcus
GSVKGKKR

SEQ ID NO: 1909954 - protein, 7 aa, Staphylococcus
GSVPHSG

SEQ ID NO: 1909955 - protein, 8 aa, Staphylococcus
GTAVGTGI

SEQ ID NO: 1909956 - protein, 8 aa, Staphylococcus
GTEGPSVS

SEQ ID NO: 1909957 - protein, 9 aa, Staphylococcus
GTGIPTKDI

SEQ ID NO: 1909958 - protein, 10 aa, Staphylococcus
GTNGKTTTSN

SEQ ID NO: 1909959 - protein, 8 aa, Staphylococcus
GVATPQDA

SEQ ID NO: 1909960 - protein, 9 aa, Staphylococcus
GVGDSTDVV

SEQ ID NO: 1909961 - protein, 7 aa, Staphylococcus
GVHSGDS

SEQ ID NO: 1909962 - protein, 9 aa, Staphylococcus
GYAPSSPSF

SEQ ID NO: 1909963 - protein, 15 aa, Staphylococcus
GYDGGTGASPKTSIQ

SEQ ID NO: 1909964 - protein, 6 aa, Staphylococcus
GYGKTE

SEQ ID NO: 1909965 - protein, 13 aa, Staphylococcus
GYQETISDPSYTG

SEQ ID NO: 1909966 - protein, 7 aa, Staphylococcus
GYTQDTM

SEQ ID NO: 1909967 - protein, 12 aa, Staphylococcus
HAGGRGKAGGVK

SEQ ID NO: 1909968 - protein, 5 aa, Staphylococcus
HANIG

SEQ ID NO: 1909969 - protein, 9 aa, Staphylococcus
HARSTGPYS

SEQ ID NO: 1909970 - protein, 5 aa, Staphylococcus
HDGHT

SEQ ID NO: 1909971 - protein, 8 aa, Staphylococcus
HEVAPGQH

SEQ ID NO: 1909972 - protein, 6 aa, Staphylococcus
HGGMTS

SEQ ID NO: 1909973 - protein, 7 aa, Staphylococcus
HGKTTLT

SEQ ID NO: 1909974 - protein, 4 aa, Staphylococcus
HGSF

SEQ ID NO: 1909975 - protein, 7 aa, Staphylococcus
HKNDPGV

SEQ ID NO: 1909976 - protein, 4 aa, Staphylococcus
HNTY

SEQ ID NO: 1909977 - protein, 5 aa, Staphylococcus
HPEGY

SEQ ID NO: 1909978 - protein, 8 aa, Staphylococcus
HPEGYTAT

SEQ ID NO: 1909979 - protein, 4 aa, Staphylococcus
HSDA

SEQ ID NO: 1909980 - protein, 6 aa, Staphylococcus
HSTGRK

SEQ ID NO: 1909981 - protein, 5 aa, Staphylococcus
HTSDE

SEQ ID NO: 1909982 - protein, 8 aa, Staphylococcus
IAPSSSYS

SEQ ID NO: 1909983 - protein, 20 aa, Staphylococcus
IARKSENTSITRDVSGEGVQ

SEQ ID NO: 1909984 - protein, 10 aa, Staphylococcus
IDGATGQNAM

SEQ ID NO: 1909985 - protein, 11 aa, Staphylococcus
IDNKDSKIRYR

SEQ ID NO: 1909986 - protein, 15 aa, Staphylococcus
IDQKTTSKNPRSTVA

SEQ ID NO: 1909987 - protein, 4 aa, Staphylococcus
IEAE

SEQ ID NO: 1909988 - protein, 7 aa, Staphylococcus
IGGDKEL

SEQ ID NO: 1909989 - protein, 8 aa, Staphylococcus
IGGRTSHS

SEQ ID NO: 1909990 - protein, 5 aa, Staphylococcus
IGRHN

SEQ ID NO: 1909991 - protein, 6 aa, Staphylococcus
IGTSGA

SEQ ID NO: 1909992 - protein, 4 aa, Staphylococcus
IKPE

SEQ ID NO: 1909993 - protein, 19 aa, Staphylococcus
IPENEPGSSIMPGKVNPTQ

SEQ ID NO: 1909994 - protein, 7 aa, Staphylococcus
ISEEEAT

SEQ ID NO: 1909995 - protein, 8 aa, Staphylococcus
ISGGGRCN

SEQ ID NO: 1909996 - protein, 6 aa, Staphylococcus
ISKPGL

SEQ ID NO: 1909997 - protein, 5 aa, Staphylococcus
ISTRE

SEQ ID NO: 1909998 - protein, 6 aa, Staphylococcus
ITGSGP

SEQ ID NO: 1909999 - protein, 5 aa, Staphylococcus
ITRDT

SEQ ID NO: 1910000 - protein, 6 aa, Staphylococcus
KAATQS

SEQ ID NO: 1910001 - protein, 5 aa, Staphylococcus
KAGYT

SEQ ID NO: 1910002 - protein, 7 aa, Staphylococcus
KAKPKIG

SEQ ID NO: 1910003 - protein, 11 aa, Staphylococcus
KAQKDKNTSRI

SEQ ID NO: 1910004 - protein, 8 aa, Staphylococcus
KAREVRDT

SEQ ID NO: 1910005 - protein, 6 aa, Staphylococcus
KDDEFD

SEQ ID NO: 1910006 - protein, 8 aa, Staphylococcus
KDEGGRHT

SEQ ID NO: 1910007 - protein, 7 aa, Staphylococcus
KDGTREQ

SEQ ID NO: 1910008 - protein, 5 aa, Staphylococcus
KDQEA

SEQ ID NO: 1910009 - protein, 6 aa, Staphylococcus
KDSEID

SEQ ID NO: 1910010 - protein, 6 aa, Staphylococcus
KDSPII

SEQ ID NO: 1910011 - protein, 8 aa, Staphylococcus
KEEDQKEK

SEQ ID NO: 1910012 - protein, 6 aa, Staphylococcus
KEGFLR

SEQ ID NO: 1910013 - protein, 7 aa, Staphylococcus
KEKKIPR

SEQ ID NO: 1910014 - protein, 11 aa, Staphylococcus
KELQPDIPTKS

SEQ ID NO: 1910015 - protein, 19 aa, Staphylococcus
KGAYPGKAAEERGQSESIA

SEQ ID NO: 1910016 - protein, 14 aa, Staphylococcus
KGEEKTGGRTRPSL

SEQ ID NO: 1910017 - protein, 17 aa, Staphylococcus
KGEETNRVEGFESGADD

SEQ ID NO: 1910018 - protein, 9 aa, Staphylococcus
KGLSAGRVQ

SEQ ID NO: 1910019 - protein, 7 aa, Staphylococcus
KGQLSKS

SEQ ID NO: 1910020 - protein, 7 aa, Staphylococcus
KGSSNYP

SEQ ID NO: 1910021 - protein, 6 aa, Staphylococcus
KGTEQK

SEQ ID NO: 1910022 - protein, 5 aa, Staphylococcus
KGTGN

SEQ ID NO: 1910023 - protein, 7 aa, Staphylococcus
KGVTDVD

SEQ ID NO: 1910024 - protein, 5 aa, Staphylococcus
KHSKV

SEQ ID NO: 1910025 - protein, 10 aa, Staphylococcus
KIEDDPSHPE

SEQ ID NO: 1910026 - protein, 7 aa, Staphylococcus
KKGLGRK

SEQ ID NO: 1910027 - protein, 7 aa, Staphylococcus
KKGPFAP

SEQ ID NO: 1910028 - protein, 9 aa, Staphylococcus
KKGRTPNPD

SEQ ID NO: 1910029 - protein, 5 aa, Staphylococcus
KKYKG

SEQ ID NO: 1910030 - protein, 5 aa, Staphylococcus
KMGRP

SEQ ID NO: 1910031 - protein, 7 aa, Staphylococcus
KNGVGKT

SEQ ID NO: 1910032 - protein, 4 aa, Staphylococcus
KNNY

SEQ ID NO: 1910033 - protein, 5 aa, Staphylococcus
KNVTG

SEQ ID NO: 1910034 - protein, 5 aa, Staphylococcus
KPEQI

SEQ ID NO: 1910035 - protein, 7 aa, Staphylococcus
KPFSPRE

SEQ ID NO: 1910036 - protein, 10 aa, Staphylococcus
KQDRSSNIEK

SEQ ID NO: 1910037 - protein, 5 aa, Staphylococcus
KRIKV

SEQ ID NO: 1910038 - protein, 7 aa, Staphylococcus
KSAPTTL

SEQ ID NO: 1910039 - protein, 9 aa, Staphylococcus
KSDDTVGRV

SEQ ID NO: 1910040 - protein, 8 aa, Staphylococcus
KSEDPEKF

SEQ ID NO: 1910041 - protein, 14 aa, Staphylococcus
KTIKEVQKETGIKG

SEQ ID NO: 1910042 - protein, 9 aa, Staphylococcus
KTKTGYSTA

SEQ ID NO: 1910043 - protein, 7 aa, Staphylococcus
KTPPAPV

SEQ ID NO: 1910044 - protein, 4 aa, Staphylococcus
KVTG

SEQ ID NO: 1910045 - protein, 8 aa, Staphylococcus
KYRGGAPI

SEQ ID NO: 1910046 - protein, 8 aa, Staphylococcus
LASSSTVH

SEQ ID NO: 1910047 - protein, 4 aa, Staphylococcus
LDTP

SEQ ID NO: 1910048 - protein, 4 aa, Staphylococcus
LEQP

SEQ ID NO: 1910049 - protein, 6 aa, Staphylococcus
LEQRTN

SEQ ID NO: 1910050 - protein, 4 aa, Staphylococcus
LGFG

SEQ ID NO: 1910051 - protein, 11 aa, Staphylococcus
LGGAQGQATEI

SEQ ID NO: 1910052 - protein, 11 aa, Staphylococcus
LGGRATTGKNV

SEQ ID NO: 1910053 - protein, 4 aa, Staphylococcus
LGKE

SEQ ID NO: 1910054 - protein, 7 aa, Staphylococcus
LGPDPFP

SEQ ID NO: 1910055 - protein, 4 aa, Staphylococcus
LGSK

SEQ ID NO: 1910056 - protein, 11 aa, Staphylococcus
LGTVGGQEDDV

SEQ ID NO: 1910057 - protein, 7 aa, Staphylococcus
LKPEKDG

SEQ ID NO: 1910058 - protein, 5 aa, Staphylococcus
LKSGR

SEQ ID NO: 1910059 - protein, 14 aa, Staphylococcus
LNPKDGKPVVTPSQ

SEQ ID NO: 1910060 - protein, 8 aa, Staphylococcus
LPGNAQSI

SEQ ID NO: 1910061 - protein, 8 aa, Staphylococcus
LPKKPAAL

SEQ ID NO: 1910062 - protein, 26 aa, Staphylococcus
LPVRGQKTKNNARTRKGPVKTVANKK

SEQ ID NO: 1910063 - protein, 10 aa, Staphylococcus
LQPAAGAHGE

SEQ ID NO: 1910064 - protein, 10 aa, Staphylococcus
LRADRQPEFT

SEQ ID NO: 1910065 - protein, 11 aa, Staphylococcus
LRSNTQGRGTY

SEQ ID NO: 1910066 - protein, 9 aa, Staphylococcus
LSGSGKSSL

SEQ ID NO: 1910067 - protein, 5 aa, Staphylococcus
LSPSQ

SEQ ID NO: 1910068 - protein, 7 aa, Staphylococcus
LTDREEN

SEQ ID NO: 1910069 - protein, 6 aa, Staphylococcus
LTGGCP

SEQ ID NO: 1910070 - protein, 6 aa, Staphylococcus
MDPKHR

SEQ ID NO: 1910071 - protein, 7 aa, Staphylococcus
MEKDGNY

SEQ ID NO: 1910072 - protein, 12 aa, Staphylococcus
MGGGTGTGAAPV

SEQ ID NO: 1910073 - protein, 11 aa, Staphylococcus
MNPTPTDKGRR

SEQ ID NO: 1910074 - protein, 12 aa, Staphylococcus
MSGSKSKRPGLD

SEQ ID NO: 1910075 - protein, 6 aa, Staphylococcus
MSNQGS

SEQ ID NO: 1910076 - protein, 8 aa, Staphylococcus
MSTKNGRK

SEQ ID NO: 1910077 - protein, 9 aa, Staphylococcus
NAKQPKEVA

SEQ ID NO: 1910078 - protein, 6 aa, Staphylococcus
NCDPDE

SEQ ID NO: 1910079 - protein, 5 aa, Staphylococcus
NDDAI

SEQ ID NO: 1910080 - protein, 8 aa, Staphylococcus
NDDSNRAL

SEQ ID NO: 1910081 - protein, 5 aa, Staphylococcus
NDNGW

SEQ ID NO: 1910082 - protein, 10 aa, Staphylococcus
NDTGNKYSPT

SEQ ID NO: 1910083 - protein, 7 aa, Staphylococcus
NEPPGAR

SEQ ID NO: 1910084 - protein, 6 aa, Staphylococcus
NEPTAA

SEQ ID NO: 1910085 - protein, 10 aa, Staphylococcus
NGSGKSTLSN

SEQ ID NO: 1910086 - protein, 10 aa, Staphylococcus
NGTASRETEQ

SEQ ID NO: 1910087 - protein, 7 aa, Staphylococcus
NGTGKST

SEQ ID NO: 1910088 - protein, 7 aa, Staphylococcus
NIEAGGS

SEQ ID NO: 1910089 - protein, 8 aa, Staphylococcus
NIGSAGGQ

SEQ ID NO: 1910090 - protein, 4 aa, Staphylococcus
NIGT

SEQ ID NO: 1910091 - protein, 4 aa, Staphylococcus
NKPI

SEQ ID NO: 1910092 - protein, 6 aa, Staphylococcus
NKRPDY

SEQ ID NO: 1910093 - protein, 5 aa, Staphylococcus
NKTGY

SEQ ID NO: 1910094 - protein, 6 aa, Staphylococcus
NLEESN

SEQ ID NO: 1910095 - protein, 7 aa, Staphylococcus
NLEGEST

SEQ ID NO: 1910096 - protein, 5 aa, Staphylococcus
NLGPL

SEQ ID NO: 1910097 - protein, 14 aa, Staphylococcus
NMARTSQQPGKTQT

SEQ ID NO: 1910098 - protein, 4 aa, Staphylococcus
NNGD

SEQ ID NO: 1910099 - protein, 5 aa, Staphylococcus
NPATI

SEQ ID NO: 1910100 - protein, 5 aa, Staphylococcus
NPLAE

SEQ ID NO: 1910101 - protein, 7 aa, Staphylococcus
NPTPKTV

SEQ ID NO: 1910102 - protein, 12 aa, Staphylococcus
NPYFSTDTTAAL

SEQ ID NO: 1910103 - protein, 7 aa, Staphylococcus
NRGERAY

SEQ ID NO: 1910104 - protein, 4 aa, Staphylococcus
NTDG

SEQ ID NO: 1910105 - protein, 7 aa, Staphylococcus
NTTGDGL

SEQ ID NO: 1910106 - protein, 8 aa, Staphylococcus
PAAPGTGV

SEQ ID NO: 1910107 - protein, 8 aa, Staphylococcus
PADGNETR

SEQ ID NO: 1910108 - protein, 18 aa, Staphylococcus
PAGKANPAPPVGPALGQA

SEQ ID NO: 1910109 - protein, 8 aa, Staphylococcus
PASESEEM

SEQ ID NO: 1910110 - protein, 6 aa, Staphylococcus
PDCRNT

SEQ ID NO: 1910111 - protein, 9 aa, Staphylococcus
PDHGGVTRA

SEQ ID NO: 1910112 - protein, 8 aa, Staphylococcus
PEGGSNKV

SEQ ID NO: 1910113 - protein, 6 aa, Staphylococcus
PEGKSG

SEQ ID NO: 1910114 - protein, 4 aa, Staphylococcus
PEGY

SEQ ID NO: 1910115 - protein, 5 aa, Staphylococcus
PEMSA

SEQ ID NO: 1910116 - protein, 9 aa, Staphylococcus
PETSPEDIE

SEQ ID NO: 1910117 - protein, 7 aa, Staphylococcus
PGGAGSL

SEQ ID NO: 1910118 - protein, 8 aa, Staphylococcus
PGGESTTL

SEQ ID NO: 1910119 - protein, 7 aa, Staphylococcus
PGRSNAF

SEQ ID NO: 1910120 - protein, 4 aa, Staphylococcus
PIPR

SEQ ID NO: 1910121 - protein, 4 aa, Staphylococcus
PIRI

SEQ ID NO: 1910122 - protein, 9 aa, Staphylococcus
PKSHPARDM

SEQ ID NO: 1910123 - protein, 9 aa, Staphylococcus
PNKGEPLKS

SEQ ID NO: 1910124 - protein, 7 aa, Staphylococcus
PNPFPKS

SEQ ID NO: 1910125 - protein, 8 aa, Staphylococcus
PPGIGKTS

SEQ ID NO: 1910126 - protein, 4 aa, Staphylococcus
PRIP

SEQ ID NO: 1910127 - protein, 10 aa, Staphylococcus
PRKERNAIAE

SEQ ID NO: 1910128 - protein, 18 aa, Staphylococcus
PRVSRSSALASKATGYPI

SEQ ID NO: 1910129 - protein, 7 aa, Staphylococcus
PSGCGKT

SEQ ID NO: 1910130 - protein, 6 aa, Staphylococcus
PSGTEP

SEQ ID NO: 1910131 - protein, 6 aa, Staphylococcus
PSSETN

SEQ ID NO: 1910132 - protein, 9 aa, Staphylococcus
PSVGGPAKG

SEQ ID NO: 1910133 - protein, 11 aa, Staphylococcus
PTGTVSGAPKL

SEQ ID NO: 1910134 - protein, 11 aa, Staphylococcus
PTNGMDPDGSI

SEQ ID NO: 1910135 - protein, 8 aa, Staphylococcus
PTSALDPE

SEQ ID NO: 1910136 - protein, 7 aa, Staphylococcus
PTTAGEI

SEQ ID NO: 1910137 - protein, 5 aa, Staphylococcus
PTTGL

SEQ ID NO: 1910138 - protein, 11 aa, Staphylococcus
PVPDGDTGTNM

SEQ ID NO: 1910139 - protein, 10 aa, Staphylococcus
PYQPEISQGE

SEQ ID NO: 1910140 - protein, 7 aa, Staphylococcus
QATVSRD

SEQ ID NO: 1910141 - protein, 7 aa, Staphylococcus
QDAADED

SEQ ID NO: 1910142 - protein, 7 aa, Staphylococcus
QDDAAGT

SEQ ID NO: 1910143 - protein, 5 aa, Staphylococcus
QEEAL

SEQ ID NO: 1910144 - protein, 7 aa, Staphylococcus
QEEDPTF

SEQ ID NO: 1910145 - protein, 5 aa, Staphylococcus
QEESV

SEQ ID NO: 1910146 - protein, 4 aa, Staphylococcus
QEGI

SEQ ID NO: 1910147 - protein, 5 aa, Staphylococcus
QEHGG

SEQ ID NO: 1910148 - protein, 5 aa, Staphylococcus
QEQPG

SEQ ID NO: 1910149 - protein, 7 aa, Staphylococcus
QERGISV

SEQ ID NO: 1910150 - protein, 8 aa, Staphylococcus
QFSGGQRQ

SEQ ID NO: 1910151 - protein, 6 aa, Staphylococcus
QGIEAQ

SEQ ID NO: 1910152 - protein, 7 aa, Staphylococcus
QKEFGED

SEQ ID NO: 1910153 - protein, 6 aa, Staphylococcus
QKVSGD

SEQ ID NO: 1910154 - protein, 9 aa, Staphylococcus
QPDHGEQGL

SEQ ID NO: 1910155 - protein, 8 aa, Staphylococcus
QPDRPVGR

SEQ ID NO: 1910156 - protein, 5 aa, Staphylococcus
QPSRK

SEQ ID NO: 1910157 - protein, 7 aa, Staphylococcus
QQAAGEL

SEQ ID NO: 1910158 - protein, 4 aa, Staphylococcus
QQAR

SEQ ID NO: 1910159 - protein, 14 aa, Staphylococcus
QQPLGGKAQFGGQR

SEQ ID NO: 1910160 - protein, 10 aa, Staphylococcus
QRAENNQKIY

SEQ ID NO: 1910161 - protein, 8 aa, Staphylococcus
QRNGPTGT

SEQ ID NO: 1910162 - protein, 15 aa, Staphylococcus
QRNPRATRAEASDVA

SEQ ID NO: 1910163 - protein, 5 aa, Staphylococcus
QRPSV

SEQ ID NO: 1910164 - protein, 9 aa, Staphylococcus
QSGYTGEDG

SEQ ID NO: 1910165 - protein, 9 aa, Staphylococcus
QSIGEPGTQ

SEQ ID NO: 1910166 - protein, 16 aa, Staphylococcus
QSPIGRTPRSNPATYT

SEQ ID NO: 1910167 - protein, 16 aa, Staphylococcus
RASGAGGQHINKTESA

SEQ ID NO: 1910168 - protein, 6 aa, Staphylococcus
RDNPMD

SEQ ID NO: 1910169 - protein, 24 aa, Staphylococcus
RDPRMKERKKPGLKKARRSPQFSK

SEQ ID NO: 1910170 - protein, 8 aa, Staphylococcus
RDVDQKSA

SEQ ID NO: 1910171 - protein, 7 aa, Staphylococcus
RENAENK

SEQ ID NO: 1910172 - protein, 10 aa, Staphylococcus
RESGSIEQDA

SEQ ID NO: 1910173 - protein, 12 aa, Staphylococcus
REYGTTTGRPRR

SEQ ID NO: 1910174 - protein, 8 aa, Staphylococcus
RGAKGGYQ

SEQ ID NO: 1910175 - protein, 5 aa, Staphylococcus
RGAQV

SEQ ID NO: 1910176 - protein, 5 aa, Staphylococcus
RGFTN

SEQ ID NO: 1910177 - protein, 16 aa, Staphylococcus
RGKTGSDLGMDRGTAD

SEQ ID NO: 1910178 - protein, 9 aa, Staphylococcus
RGYGTTLGN

SEQ ID NO: 1910179 - protein, 13 aa, Staphylococcus
RHPSRSKRLKDFM

SEQ ID NO: 1910180 - protein, 8 aa, Staphylococcus
RKEGKLPR

SEQ ID NO: 1910181 - protein, 6 aa, Staphylococcus
RKGEGD

SEQ ID NO: 1910182 - protein, 8 aa, Staphylococcus
RKNKRRTH

SEQ ID NO: 1910183 - protein, 5 aa, Staphylococcus
RKNSV

SEQ ID NO: 1910184 - protein, 8 aa, Staphylococcus
RKQKGRYR

SEQ ID NO: 1910185 - protein, 5 aa, Staphylococcus
RKREW

SEQ ID NO: 1910186 - protein, 7 aa, Staphylococcus
RKRRNYA

SEQ ID NO: 1910187 - protein, 8 aa, Staphylococcus
RKTKNNPV

SEQ ID NO: 1910188 - protein, 4 aa, Staphylococcus
RMSE

SEQ ID NO: 1910189 - protein, 5 aa, Staphylococcus
RPGDM

SEQ ID NO: 1910190 - protein, 11 aa, Staphylococcus
RPGEPPTVENA

SEQ ID NO: 1910191 - protein, 10 aa, Staphylococcus
RPPGREAYPG

SEQ ID NO: 1910192 - protein, 16 aa, Staphylococcus
RPRAQGRASAINKRTS

SEQ ID NO: 1910193 - protein, 8 aa, Staphylococcus
RPSGTEPK

SEQ ID NO: 1910194 - protein, 8 aa, Staphylococcus
RQTGGRGV

SEQ ID NO: 1910195 - protein, 5 aa, Staphylococcus
RRTGD

SEQ ID NO: 1910196 - protein, 7 aa, Staphylococcus
RRTKNNP

SEQ ID NO: 1910197 - protein, 9 aa, Staphylococcus
RRVGGSNYQ

SEQ ID NO: 1910198 - protein, 10 aa, Staphylococcus
RRVTGTSAKY

SEQ ID NO: 1910199 - protein, 6 aa, Staphylococcus
RSGTLT

SEQ ID NO: 1910200 - protein, 4 aa, Staphylococcus
RSIG

SEQ ID NO: 1910201 - protein, 10 aa, Staphylococcus
RTKDGGTHEV

SEQ ID NO: 1910202 - protein, 7 aa, Staphylococcus
RTRRQAR

SEQ ID NO: 1910203 - protein, 8 aa, Staphylococcus
RTSKTPLS

SEQ ID NO: 1910204 - protein, 6 aa, Staphylococcus
RVGKEP

SEQ ID NO: 1910205 - protein, 16 aa, Staphylococcus
RVPETESGGRIHTSTA

SEQ ID NO: 1910206 - protein, 6 aa, Staphylococcus
RVPHGA

SEQ ID NO: 1910207 - protein, 8 aa, Staphylococcus
RYQPATPT

SEQ ID NO: 1910208 - protein, 7 aa, Staphylococcus
SAGKSSL

SEQ ID NO: 1910209 - protein, 6 aa, Staphylococcus
SAQYES

SEQ ID NO: 1910210 - protein, 8 aa, Staphylococcus
SCTNTSNP

SEQ ID NO: 1910211 - protein, 9 aa, Staphylococcus
SDPDREGEA

SEQ ID NO: 1910212 - protein, 10 aa, Staphylococcus
SDTSAGAGMQ

SEQ ID NO: 1910213 - protein, 6 aa, Staphylococcus
SEEERF

SEQ ID NO: 1910214 - protein, 9 aa, Staphylococcus
SEEGGTEIE

SEQ ID NO: 1910215 - protein, 13 aa, Staphylococcus
SEIEEQIKSSKEE

SEQ ID NO: 1910216 - protein, 6 aa, Staphylococcus
SEITGV

SEQ ID NO: 1910217 - protein, 6 aa, Staphylococcus
SGAKIS

SEQ ID NO: 1910218 - protein, 11 aa, Staphylococcus
SGARGNASNFT

SEQ ID NO: 1910219 - protein, 8 aa, Staphylococcus
SGCGKTTT

SEQ ID NO: 1910220 - protein, 7 aa, Staphylococcus
SGGARMQ

SEQ ID NO: 1910221 - protein, 4 aa, Staphylococcus
SGLP

SEQ ID NO: 1910222 - protein, 7 aa, Staphylococcus
SGNPSAC

SEQ ID NO: 1910223 - protein, 7 aa, Staphylococcus
SGPRAGL

SEQ ID NO: 1910224 - protein, 8 aa, Staphylococcus
SGSSHRGV

SEQ ID NO: 1910225 - protein, 11 aa, Staphylococcus
SGSTGEPKGVQ

SEQ ID NO: 1910226 - protein, 4 aa, Staphylococcus
SHPG

SEQ ID NO: 1910227 - protein, 11 aa, Staphylococcus
SIEADKDGSTV

SEQ ID NO: 1910228 - protein, 6 aa, Staphylococcus
SIGETA

SEQ ID NO: 1910229 - protein, 6 aa, Staphylococcus
SKFDSD

SEQ ID NO: 1910230 - protein, 8 aa, Staphylococcus
SKGREPYQ

SEQ ID NO: 1910231 - protein, 9 aa, Staphylococcus
SKHSYGPSR

SEQ ID NO: 1910232 - protein, 7 aa, Staphylococcus
SKHTAPH

SEQ ID NO: 1910233 - protein, 7 aa, Staphylococcus
SKPSDLI

SEQ ID NO: 1910234 - protein, 5 aa, Staphylococcus
SKRNP

SEQ ID NO: 1910235 - protein, 9 aa, Staphylococcus
SKRTPDGEF

SEQ ID NO: 1910236 - protein, 8 aa, Staphylococcus
SKSHSATG

SEQ ID NO: 1910237 - protein, 9 aa, Staphylococcus
SKTDRASKV

SEQ ID NO: 1910238 - protein, 8 aa, Staphylococcus
SLGSNTPI

SEQ ID NO: 1910239 - protein, 7 aa, Staphylococcus
SLTPGQQ

SEQ ID NO: 1910240 - protein, 8 aa, Staphylococcus
SPGGSVTA

SEQ ID NO: 1910241 - protein, 8 aa, Staphylococcus
SPKTETGI

SEQ ID NO: 1910242 - protein, 6 aa, Staphylococcus
SPPPHH

SEQ ID NO: 1910243 - protein, 4 aa, Staphylococcus
SPTG

SEQ ID NO: 1910244 - protein, 14 aa, Staphylococcus
SPTPAGEGKSTVTV

SEQ ID NO: 1910245 - protein, 4 aa, Staphylococcus
SPVN

SEQ ID NO: 1910246 - protein, 9 aa, Staphylococcus
SQKETGERI

SEQ ID NO: 1910247 - protein, 8 aa, Staphylococcus
SRGSVGSS

SEQ ID NO: 1910248 - protein, 9 aa, Staphylococcus
SRYDKGEAA

SEQ ID NO: 1910249 - protein, 6 aa, Staphylococcus
SSGGFG

SEQ ID NO: 1910250 - protein, 6 aa, Staphylococcus
SSGVGV

SEQ ID NO: 1910251 - protein, 14 aa, Staphylococcus
SSPIPGNTKSINRT

SEQ ID NO: 1910252 - protein, 4 aa, Staphylococcus
SSSL

SEQ ID NO: 1910253 - protein, 5 aa, Staphylococcus
STANL

SEQ ID NO: 1910254 - protein, 4 aa, Staphylococcus
STPM

SEQ ID NO: 1910255 - protein, 13 aa, Staphylococcus
STPSGSTAYNKAL

SEQ ID NO: 1910256 - protein, 7 aa, Staphylococcus
STRIPAV

SEQ ID NO: 1910257 - protein, 7 aa, Staphylococcus
SVGEPKP

SEQ ID NO: 1910258 - protein, 9 aa, Staphylococcus
SYGSRRGNH

SEQ ID NO: 1910259 - protein, 12 aa, Staphylococcus
TAGDNKLGGDDF

SEQ ID NO: 1910260 - protein, 10 aa, Staphylococcus
TARDSNRGGC

SEQ ID NO: 1910261 - protein, 6 aa, Staphylococcus
TDGGVP

SEQ ID NO: 1910262 - protein, 18 aa, Staphylococcus
TEDGTDEIISTRSKTYQK

SEQ ID NO: 1910263 - protein, 7 aa, Staphylococcus
TGEQQTV

SEQ ID NO: 1910264 - protein, 7 aa, Staphylococcus
TGFGTGG

SEQ ID NO: 1910265 - protein, 5 aa, Staphylococcus
TGGYN

SEQ ID NO: 1910266 - protein, 8 aa, Staphylococcus
TGKGPAVR

SEQ ID NO: 1910267 - protein, 5 aa, Staphylococcus
TGQPD

SEQ ID NO: 1910268 - protein, 7 aa, Staphylococcus
TGRDGIH

SEQ ID NO: 1910269 - protein, 8 aa, Staphylococcus
TGRPRTET

SEQ ID NO: 1910270 - protein, 7 aa, Staphylococcus
TGSGKTE

SEQ ID NO: 1910271 - protein, 10 aa, Staphylococcus
TGSGTQSNMN

SEQ ID NO: 1910272 - protein, 5 aa, Staphylococcus
TGTVS

SEQ ID NO: 1910273 - protein, 9 aa, Staphylococcus
TGVGKTEIA

SEQ ID NO: 1910274 - protein, 12 aa, Staphylococcus
TGVKRTTGQHPG

SEQ ID NO: 1910275 - protein, 9 aa, Staphylococcus
TGYSAAQSL

SEQ ID NO: 1910276 - protein, 6 aa, Staphylococcus
TIAENG

SEQ ID NO: 1910277 - protein, 8 aa, Staphylococcus
TIGPKGRN

SEQ ID NO: 1910278 - protein, 8 aa, Staphylococcus
TIQGEGRV

SEQ ID NO: 1910279 - protein, 8 aa, Staphylococcus
TKGTNEPY

SEQ ID NO: 1910280 - protein, 9 aa, Staphylococcus
TKLKNGRKF

SEQ ID NO: 1910281 - protein, 5 aa, Staphylococcus
TKNGQ

SEQ ID NO: 1910282 - protein, 6 aa, Staphylococcus
TKPFST

SEQ ID NO: 1910283 - protein, 10 aa, Staphylococcus
TKRGKGKAGF

SEQ ID NO: 1910284 - protein, 7 aa, Staphylococcus
TNIGTGM

SEQ ID NO: 1910285 - protein, 7 aa, Staphylococcus
TNPPIDA

SEQ ID NO: 1910286 - protein, 5 aa, Staphylococcus
TNTFP

SEQ ID NO: 1910287 - protein, 10 aa, Staphylococcus
TPGHADFGGE

SEQ ID NO: 1910288 - protein, 12 aa, Staphylococcus
TPGHEDFSEDTY

SEQ ID NO: 1910289 - protein, 6 aa, Staphylococcus
TPHPTA

SEQ ID NO: 1910290 - protein, 6 aa, Staphylococcus
TPNRAD

SEQ ID NO: 1910291 - protein, 6 aa, Staphylococcus
TPPDYE

SEQ ID NO: 1910292 - protein, 6 aa, Staphylococcus
TPRGGI

SEQ ID NO: 1910293 - protein, 10 aa, Staphylococcus
TQGVTAQGKD

SEQ ID NO: 1910294 - protein, 8 aa, Staphylococcus
TSAGSSKI

SEQ ID NO: 1910295 - protein, 5 aa, Staphylococcus
TSGKE

SEQ ID NO: 1910296 - protein, 9 aa, Staphylococcus
TSGSGKTTA

SEQ ID NO: 1910297 - protein, 6 aa, Staphylococcus
TSLPEH

SEQ ID NO: 1910298 - protein, 8 aa, Staphylococcus
TTGLSNQY

SEQ ID NO: 1910299 - protein, 6 aa, Staphylococcus
TTQHGY

SEQ ID NO: 1910300 - protein, 7 aa, Staphylococcus
TTRPETM

SEQ ID NO: 1910301 - protein, 7 aa, Staphylococcus
TTSNPYH

SEQ ID NO: 1910302 - protein, 5 aa, Staphylococcus
TVEDN

SEQ ID NO: 1910303 - protein, 10 aa, Staphylococcus
TYEKATRNTL

SEQ ID NO: 1910304 - protein, 17 aa, Staphylococcus
VANKTNEIAGDGTTTAT

SEQ ID NO: 1910305 - protein, 5 aa, Staphylococcus
VCSAG

SEQ ID NO: 1910306 - protein, 7 aa, Staphylococcus
VDGGAVK

SEQ ID NO: 1910307 - protein, 6 aa, Staphylococcus
VDYSGR

SEQ ID NO: 1910308 - protein, 9 aa, Staphylococcus
VGGGGNNAV

SEQ ID NO: 1910309 - protein, 4 aa, Staphylococcus
VGGL

SEQ ID NO: 1910310 - protein, 5 aa, Staphylococcus
VGKST

SEQ ID NO: 1910311 - protein, 5 aa, Staphylococcus
VHEGT

SEQ ID NO: 1910312 - protein, 9 aa, Staphylococcus
VKPGKGSAF

SEQ ID NO: 1910313 - protein, 6 aa, Staphylococcus
VKRPEV

SEQ ID NO: 1910314 - protein, 4 aa, Staphylococcus
VKTA

SEQ ID NO: 1910315 - protein, 16 aa, Staphylococcus
VNSPSRSYKAVGGGAP

SEQ ID NO: 1910316 - protein, 6 aa, Staphylococcus
VPPAGY

SEQ ID NO: 1910317 - protein, 10 aa, Staphylococcus
VPTGEKGTTN

SEQ ID NO: 1910318 - protein, 5 aa, Staphylococcus
VQDRT

SEQ ID NO: 1910319 - protein, 5 aa, Staphylococcus
VQTPT

SEQ ID NO: 1910320 - protein, 15 aa, Staphylococcus
VRRARAGLKDPKRPI

SEQ ID NO: 1910321 - protein, 5 aa, Staphylococcus
VRRNP

SEQ ID NO: 1910322 - protein, 6 aa, Staphylococcus
VSEDGG

SEQ ID NO: 1910323 - protein, 20 aa, Staphylococcus
VSSGENRAVEAAKKAISSPL

SEQ ID NO: 1910324 - protein, 9 aa, Staphylococcus
VSTSETRPV

SEQ ID NO: 1910325 - protein, 6 aa, Staphylococcus
VTEPGY

SEQ ID NO: 1910326 - protein, 12 aa, Staphylococcus
VTPKGVTELTAE

SEQ ID NO: 1910327 - protein, 12 aa, Staphylococcus
VVQGEKRGRTIG

SEQ ID NO: 1910328 - protein, 19 aa, Staphylococcus
WSSAGALGFKGSKKSTPFA

SEQ ID NO: 1910329 - protein, 8 aa, Staphylococcus
YANEGPTL

SEQ ID NO: 1910330 - protein, 5 aa, Staphylococcus
YDPYR

SEQ ID NO: 1910331 - protein, 16 aa, Staphylococcus
YESEARDTKLGPEEIT

SEQ ID NO: 1910332 - protein, 10 aa, Staphylococcus
YGLRSNADNF

SEQ ID NO: 1910333 - protein, 11 aa, Staphylococcus
YHGGTESTGEV

SEQ ID NO: 1910334 - protein, 4 aa, Staphylococcus
YKGT

SEQ ID NO: 1910335 - protein, 6 aa, Staphylococcus
YNHGAG

SEQ ID NO: 1910336 - protein, 9 aa, Staphylococcus
YPDNPKAYQ

SEQ ID NO: 1910337 - protein, 5 aa, Staphylococcus
YPSGA

SEQ ID NO: 1910338 - protein, 10 aa, Staphylococcus
YQNPGGSVKD

SEQ ID NO: 1910339 - protein, 8 aa, Staphylococcus
YSKGEKDI

SEQ ID NO: 1910340 - protein, 12 aa, Staphylococcus
YTGDGGSSQGDF

SEQ ID NO: 1910341 - protein, 7 aa, Staphylococcus
AAGGDEA

SEQ ID NO: 1910342 - protein, 15 aa, Staphylococcus
AAGSGDFAGNRADPI

SEQ ID NO: 1910343 - protein, 6 aa, Staphylococcus
AASSSM

SEQ ID NO: 1910344 - protein, 6 aa, Staphylococcus
AASYGA

SEQ ID NO: 1910345 - protein, 7 aa, Staphylococcus
AATPTQA

SEQ ID NO: 1910346 - protein, 10 aa, Staphylococcus
ACATGTNSIG

SEQ ID NO: 1910347 - protein, 9 aa, Staphylococcus
ADPEYRGSL

SEQ ID NO: 1910348 - protein, 7 aa, Staphylococcus
ADPTADS

SEQ ID NO: 1910349 - protein, 7 aa, Staphylococcus
ADTTDEA

SEQ ID NO: 1910350 - protein, 7 aa, Staphylococcus
AEAAQDY

SEQ ID NO: 1910351 - protein, 4 aa, Staphylococcus
AEDE

SEQ ID NO: 1910352 - protein, 7 aa, Staphylococcus
AENNSTV

SEQ ID NO: 1910353 - protein, 5 aa, Staphylococcus
AESER

SEQ ID NO: 1910354 - protein, 5 aa, Staphylococcus
AFNTP

SEQ ID NO: 1910355 - protein, 4 aa, Staphylococcus
AGGL

SEQ ID NO: 1910356 - protein, 5 aa, Staphylococcus
AGGPV

SEQ ID NO: 1910357 - protein, 8 aa, Staphylococcus
AGIRDTED

SEQ ID NO: 1910358 - protein, 5 aa, Staphylococcus
AGITR

SEQ ID NO: 1910359 - protein, 7 aa, Staphylococcus
AGPAGMT

SEQ ID NO: 1910360 - protein, 8 aa, Staphylococcus
AGVGRKTA

SEQ ID NO: 1910361 - protein, 6 aa, Staphylococcus
AGVTDY

SEQ ID NO: 1910362 - protein, 13 aa, Staphylococcus
AHHNKKVDAPSGT

SEQ ID NO: 1910363 - protein, 9 aa, Staphylococcus
AIKGKRDDL

SEQ ID NO: 1910364 - protein, 28 aa, Staphylococcus
AKGIKTQVSGRLGGADIARAEQYSEGTV

SEQ ID NO: 1910365 - protein, 5 aa, Staphylococcus
ALAVG

SEQ ID NO: 1910366 - protein, 10 aa, Staphylococcus
ANAGPNTNGS

SEQ ID NO: 1910367 - protein, 9 aa, Staphylococcus
ANDKNEATL

SEQ ID NO: 1910368 - protein, 6 aa, Staphylococcus
ANEVPK

SEQ ID NO: 1910369 - protein, 7 aa, Staphylococcus
ANLGSSV

SEQ ID NO: 1910370 - protein, 6 aa, Staphylococcus
ANPLDS

SEQ ID NO: 1910371 - protein, 6 aa, Staphylococcus
ANPTGD

SEQ ID NO: 1910372 - protein, 8 aa, Staphylococcus
ANTDEEAR

SEQ ID NO: 1910373 - protein, 7 aa, Staphylococcus
APPETFV

SEQ ID NO: 1910374 - protein, 5 aa, Staphylococcus
APSGK

SEQ ID NO: 1910375 - protein, 11 aa, Staphylococcus
AQECRSQKSIA

SEQ ID NO: 1910376 - protein, 6 aa, Staphylococcus
AQTSSA

SEQ ID NO: 1910377 - protein, 7 aa, Staphylococcus
ARRKKTI

SEQ ID NO: 1910378 - protein, 7 aa, Staphylococcus
ASEGGMR

SEQ ID NO: 1910379 - protein, 10 aa, Staphylococcus
ASGGDGDGYA

SEQ ID NO: 1910380 - protein, 5 aa, Staphylococcus
ASLNP

SEQ ID NO: 1910381 - protein, 5 aa, Staphylococcus
ASQAG

SEQ ID NO: 1910382 - protein, 7 aa, Staphylococcus
ASVIPGS

SEQ ID NO: 1910383 - protein, 13 aa, Staphylococcus
ATSLTEAGYVGDD

SEQ ID NO: 1910384 - protein, 8 aa, Staphylococcus
AVATNEVN

SEQ ID NO: 1910385 - protein, 5 aa, Staphylococcus
AVTGV

SEQ ID NO: 1910386 - protein, 5 aa, Staphylococcus
AYQGY

SEQ ID NO: 1910387 - protein, 7 aa, Staphylococcus
DAPFQTQ

SEQ ID NO: 1910388 - protein, 4 aa, Staphylococcus
DATN

SEQ ID NO: 1910389 - protein, 7 aa, Staphylococcus
DDDGNSF

SEQ ID NO: 1910390 - protein, 8 aa, Staphylococcus
DDLVSGKS

SEQ ID NO: 1910391 - protein, 8 aa, Staphylococcus
DDRNEKMG

SEQ ID NO: 1910392 - protein, 6 aa, Staphylococcus
DEAQNA

SEQ ID NO: 1910393 - protein, 5 aa, Staphylococcus
DEEIG

SEQ ID NO: 1910394 - protein, 11 aa, Staphylococcus
DEQSPDIAQGV

SEQ ID NO: 1910395 - protein, 7 aa, Staphylococcus
DETYYTE

SEQ ID NO: 1910396 - protein, 10 aa, Staphylococcus
DEVLNPGNTD

SEQ ID NO: 1910397 - protein, 8 aa, Staphylococcus
DFKDDKDR

SEQ ID NO: 1910398 - protein, 9 aa, Staphylococcus
DGAVDDSYG

SEQ ID NO: 1910399 - protein, 6 aa, Staphylococcus
DGDGDR

SEQ ID NO: 1910400 - protein, 7 aa, Staphylococcus
DGETKRI

SEQ ID NO: 1910401 - protein, 7 aa, Staphylococcus
DGLAAGK

SEQ ID NO: 1910402 - protein, 5 aa, Staphylococcus
DGTAN

SEQ ID NO: 1910403 - protein, 5 aa, Staphylococcus
DGTVN

SEQ ID NO: 1910404 - protein, 6 aa, Staphylococcus
DHDGTK

SEQ ID NO: 1910405 - protein, 4 aa, Staphylococcus
DIPG

SEQ ID NO: 1910406 - protein, 5 aa, Staphylococcus
DISTT

SEQ ID NO: 1910407 - protein, 5 aa, Staphylococcus
DKDTE

SEQ ID NO: 1910408 - protein, 6 aa, Staphylococcus
DKDTSG

SEQ ID NO: 1910409 - protein, 8 aa, Staphylococcus
DKGPRGTR

SEQ ID NO: 1910410 - protein, 5 aa, Staphylococcus
DKHNF

SEQ ID NO: 1910411 - protein, 5 aa, Staphylococcus
DKSYP

SEQ ID NO: 1910412 - protein, 7 aa, Staphylococcus
DLGPAES

SEQ ID NO: 1910413 - protein, 6 aa, Staphylococcus
DLNDPL

SEQ ID NO: 1910414 - protein, 7 aa, Staphylococcus
DLTPGLA

SEQ ID NO: 1910415 - protein, 10 aa, Staphylococcus
DNAADGRDTS

SEQ ID NO: 1910416 - protein, 8 aa, Staphylococcus
DNPAIRGQ

SEQ ID NO: 1910417 - protein, 10 aa, Staphylococcus
DNPSVPDSEY

SEQ ID NO: 1910418 - protein, 8 aa, Staphylococcus
DNTPTCTT

SEQ ID NO: 1910419 - protein, 9 aa, Staphylococcus
DPGPTGLEK

SEQ ID NO: 1910420 - protein, 15 aa, Staphylococcus
DPKNRRIAAGPEIQS

SEQ ID NO: 1910421 - protein, 12 aa, Staphylococcus
DQEAQSPSDHAA

SEQ ID NO: 1910422 - protein, 9 aa, Staphylococcus
DQETANQEA

SEQ ID NO: 1910423 - protein, 7 aa, Staphylococcus
DQQVGAN

SEQ ID NO: 1910424 - protein, 4 aa, Staphylococcus
DSHR

SEQ ID NO: 1910425 - protein, 5 aa, Staphylococcus
DSTGA

SEQ ID NO: 1910426 - protein, 6 aa, Staphylococcus
DTEKDG

SEQ ID NO: 1910427 - protein, 5 aa, Staphylococcus
DTGIV

SEQ ID NO: 1910428 - protein, 7 aa, Staphylococcus
DTKPTTF

SEQ ID NO: 1910429 - protein, 10 aa, Staphylococcus
DTRKNDQQIR

SEQ ID NO: 1910430 - protein, 19 aa, Staphylococcus
DTYRSSGAGGQHVNTTDSA

SEQ ID NO: 1910431 - protein, 15 aa, Staphylococcus
DVEAGHAASVGRVDP

SEQ ID NO: 1910432 - protein, 7 aa, Staphylococcus
DVQGSVE

SEQ ID NO: 1910433 - protein, 6 aa, Staphylococcus
EAEGHA

SEQ ID NO: 1910434 - protein, 8 aa, Staphylococcus
EAGRTNKP

SEQ ID NO: 1910435 - protein, 6 aa, Staphylococcus
EAKTGA

SEQ ID NO: 1910436 - protein, 6 aa, Staphylococcus
EASQLT

SEQ ID NO: 1910437 - protein, 7 aa, Staphylococcus
EASSKVR

SEQ ID NO: 1910438 - protein, 12 aa, Staphylococcus
EDAGKSTHKDGY

SEQ ID NO: 1910439 - protein, 4 aa, Staphylococcus
EDAK

SEQ ID NO: 1910440 - protein, 6 aa, Staphylococcus
EDGNEY

SEQ ID NO: 1910441 - protein, 6 aa, Staphylococcus
EDTRRE

SEQ ID NO: 1910442 - protein, 7 aa, Staphylococcus
EEFGNGR

SEQ ID NO: 1910443 - protein, 8 aa, Staphylococcus
EGAKGSTL

SEQ ID NO: 1910444 - protein, 11 aa, Staphylococcus
EGANPTGSFKD

SEQ ID NO: 1910445 - protein, 8 aa, Staphylococcus
EGLTQSDE

SEQ ID NO: 1910446 - protein, 4 aa, Staphylococcus
EGRD

SEQ ID NO: 1910447 - protein, 5 aa, Staphylococcus
EGTQH

SEQ ID NO: 1910448 - protein, 8 aa, Staphylococcus
ELDDSRQT

SEQ ID NO: 1910449 - protein, 5 aa, Staphylococcus
ELGGE

SEQ ID NO: 1910450 - protein, 7 aa, Staphylococcus
ELTKDPK

SEQ ID NO: 1910451 - protein, 16 aa, Staphylococcus
ENKGKRSGGYSSGAHL

SEQ ID NO: 1910452 - protein, 5 aa, Staphylococcus
EPDDP

SEQ ID NO: 1910453 - protein, 8 aa, Staphylococcus
EPTNGIDA

SEQ ID NO: 1910454 - protein, 5 aa, Staphylococcus
EQNQD

SEQ ID NO: 1910455 - protein, 6 aa, Staphylococcus
ERSAVS

SEQ ID NO: 1910456 - protein, 17 aa, Staphylococcus
ESQSIGKRYRRQDEIGT

SEQ ID NO: 1910457 - protein, 5 aa, Staphylococcus
ESSHA

SEQ ID NO: 1910458 - protein, 6 aa, Staphylococcus
ESYESS

SEQ ID NO: 1910459 - protein, 10 aa, Staphylococcus
ETGLTQPGKT

SEQ ID NO: 1910460 - protein, 12 aa, Staphylococcus
ETPIGEEDDSHL

SEQ ID NO: 1910461 - protein, 8 aa, Staphylococcus
ETSRSHGD

SEQ ID NO: 1910462 - protein, 7 aa, Staphylococcus
EVQGSDI

SEQ ID NO: 1910463 - protein, 5 aa, Staphylococcus
EVRDE

SEQ ID NO: 1910464 - protein, 11 aa, Staphylococcus
FAGISQRRVRG

SEQ ID NO: 1910465 - protein, 18 aa, Staphylococcus
FGQTGPKVGSFDAGYGSG

SEQ ID NO: 1910466 - protein, 7 aa, Staphylococcus
FKKHSSG

SEQ ID NO: 1910467 - protein, 7 aa, Staphylococcus
FNSDPAV

SEQ ID NO: 1910468 - protein, 6 aa, Staphylococcus
FPGPGL

SEQ ID NO: 1910469 - protein, 10 aa, Staphylococcus
FTGQKGSYVP

SEQ ID NO: 1910470 - protein, 7 aa, Staphylococcus
FTRGSRK

SEQ ID NO: 1910471 - protein, 21 aa, Staphylococcus
FYEKPSVKRKKKSEAARKRKF

SEQ ID NO: 1910472 - protein, 6 aa, Staphylococcus
GAGAAG

SEQ ID NO: 1910473 - protein, 7 aa, Staphylococcus
GANPVSC

SEQ ID NO: 1910474 - protein, 8 aa, Staphylococcus
GATGSGKS

SEQ ID NO: 1910475 - protein, 5 aa, Staphylococcus
GDPDL

SEQ ID NO: 1910476 - protein, 7 aa, Staphylococcus
GDTIEED

SEQ ID NO: 1910477 - protein, 5 aa, Staphylococcus
GEGSQ

SEQ ID NO: 1910478 - protein, 5 aa, Staphylococcus
GENTF

SEQ ID NO: 1910479 - protein, 20 aa, Staphylococcus
GEPKYDLEESKNRDATYAAP

SEQ ID NO: 1910480 - protein, 9 aa, Staphylococcus
GERTREGND

SEQ ID NO: 1910481 - protein, 21 aa, Staphylococcus
GESEGKDFKGIYPSSANYTTD

SEQ ID NO: 1910482 - protein, 13 aa, Staphylococcus
GESGSGKSVTTKA

SEQ ID NO: 1910483 - protein, 5 aa, Staphylococcus
GEVQA

SEQ ID NO: 1910484 - protein, 7 aa, Staphylococcus
GFGSDLG

SEQ ID NO: 1910485 - protein, 11 aa, Staphylococcus
GFSGGEKKRNE

SEQ ID NO: 1910486 - protein, 7 aa, Staphylococcus
GGAAARP

SEQ ID NO: 1910487 - protein, 8 aa, Staphylococcus
GGFTGQAQ

SEQ ID NO: 1910488 - protein, 5 aa, Staphylococcus
GGGAI

SEQ ID NO: 1910489 - protein, 4 aa, Staphylococcus
GGGG

SEQ ID NO: 1910490 - protein, 11 aa, Staphylococcus
GGGQAGTNAAK

SEQ ID NO: 1910491 - protein, 7 aa, Staphylococcus
GGGSNAI

SEQ ID NO: 1910492 - protein, 5 aa, Staphylococcus
GGNPA

SEQ ID NO: 1910493 - protein, 5 aa, Staphylococcus
GGPSE

SEQ ID NO: 1910494 - protein, 4 aa, Staphylococcus
GGPT

SEQ ID NO: 1910495 - protein, 11 aa, Staphylococcus
GGQTMNPSTED

SEQ ID NO: 1910496 - protein, 8 aa, Staphylococcus
GGSAGSVL

SEQ ID NO: 1910497 - protein, 7 aa, Staphylococcus
GGSARNV

SEQ ID NO: 1910498 - protein, 4 aa, Staphylococcus
GGSG

SEQ ID NO: 1910499 - protein, 6 aa, Staphylococcus
GGTAGY

SEQ ID NO: 1910500 - protein, 8 aa, Staphylococcus
GGYNGSVA

SEQ ID NO: 1910501 - protein, 9 aa, Staphylococcus
GHNGSGAEI

SEQ ID NO: 1910502 - protein, 7 aa, Staphylococcus
GIGPKSA

SEQ ID NO: 1910503 - protein, 8 aa, Staphylococcus
GIGPKTAQ

SEQ ID NO: 1910504 - protein, 5 aa, Staphylococcus
GIKPG

SEQ ID NO: 1910505 - protein, 4 aa, Staphylococcus
GIPT

SEQ ID NO: 1910506 - protein, 8 aa, Staphylococcus
GKAGRSRW

SEQ ID NO: 1910507 - protein, 4 aa, Staphylococcus
GKFD

SEQ ID NO: 1910508 - protein, 5 aa, Staphylococcus
GKHGI

SEQ ID NO: 1910509 - protein, 7 aa, Staphylococcus
GKKEKDV

SEQ ID NO: 1910510 - protein, 4 aa, Staphylococcus
GKPV

SEQ ID NO: 1910511 - protein, 14 aa, Staphylococcus
GKPWDEAVGDAAEG

SEQ ID NO: 1910512 - protein, 7 aa, Staphylococcus
GKQGRFR

SEQ ID NO: 1910513 - protein, 8 aa, Staphylococcus
GKTGSGKT

SEQ ID NO: 1910514 - protein, 7 aa, Staphylococcus
GKTTFRH

SEQ ID NO: 1910515 - protein, 12 aa, Staphylococcus
GKVERANEREYG

SEQ ID NO: 1910516 - protein, 5 aa, Staphylococcus
GLPNE

SEQ ID NO: 1910517 - protein, 14 aa, Staphylococcus
GMRKKGKVYESTEK

SEQ ID NO: 1910518 - protein, 13 aa, Staphylococcus
GMTGTAKTEEEEF

SEQ ID NO: 1910519 - protein, 7 aa, Staphylococcus
GNGIESL

SEQ ID NO: 1910520 - protein, 5 aa, Staphylococcus
GNPMD

SEQ ID NO: 1910521 - protein, 6 aa, Staphylococcus
GPHVTT

SEQ ID NO: 1910522 - protein, 12 aa, Staphylococcus
GPNGTGKSTLSS

SEQ ID NO: 1910523 - protein, 11 aa, Staphylococcus
GPSGVGKGTVR

SEQ ID NO: 1910524 - protein, 6 aa, Staphylococcus
GPVNNG

SEQ ID NO: 1910525 - protein, 5 aa, Staphylococcus
GQDKA

SEQ ID NO: 1910526 - protein, 11 aa, Staphylococcus
GQTAPPGKRMG

SEQ ID NO: 1910527 - protein, 6 aa, Staphylococcus
GRPYRA

SEQ ID NO: 1910528 - protein, 9 aa, Staphylococcus
GRSSTRKEE

SEQ ID NO: 1910529 - protein, 11 aa, Staphylococcus
GSDTGGSIRQP

SEQ ID NO: 1910530 - protein, 7 aa, Staphylococcus
GSGKTTV

SEQ ID NO: 1910531 - protein, 6 aa, Staphylococcus
GSGSVG

SEQ ID NO: 1910532 - protein, 6 aa, Staphylococcus
GSHEAE

SEQ ID NO: 1910533 - protein, 9 aa, Staphylococcus
GSITPQESV

SEQ ID NO: 1910534 - protein, 6 aa, Staphylococcus
GSSFEK

SEQ ID NO: 1910535 - protein, 10 aa, Staphylococcus
GSSSGAALQG

SEQ ID NO: 1910536 - protein, 4 aa, Staphylococcus
GSYA

SEQ ID NO: 1910537 - protein, 11 aa, Staphylococcus
GTEESPGATEV

SEQ ID NO: 1910538 - protein, 9 aa, Staphylococcus
GTGDHPTTS

SEQ ID NO: 1910539 - protein, 6 aa, Staphylococcus
GTSGRL

SEQ ID NO: 1910540 - protein, 6 aa, Staphylococcus
GVNGGG

SEQ ID NO: 1910541 - protein, 9 aa, Staphylococcus
GVSEPDVED

SEQ ID NO: 1910542 - protein, 10 aa, Staphylococcus
GVSGSGKSSL

SEQ ID NO: 1910543 - protein, 8 aa, Staphylococcus
GVTEDSTN

SEQ ID NO: 1910544 - protein, 25 aa, Staphylococcus
GYARHGGGCFSGKDPTKVDRSAAYA

SEQ ID NO: 1910545 - protein, 5 aa, Staphylococcus
GYTVD

SEQ ID NO: 1910546 - protein, 13 aa, Staphylococcus
HDSARKAGRIPSG

SEQ ID NO: 1910547 - protein, 7 aa, Staphylococcus
HDVDSSE

SEQ ID NO: 1910548 - protein, 6 aa, Staphylococcus
HEDGAE

SEQ ID NO: 1910549 - protein, 5 aa, Staphylococcus
HGKTT

SEQ ID NO: 1910550 - protein, 12 aa, Staphylococcus
HKGQIPGVKKSS

SEQ ID NO: 1910551 - protein, 6 aa, Staphylococcus
HNPTED

SEQ ID NO: 1910552 - protein, 6 aa, Staphylococcus
HPATYD

SEQ ID NO: 1910553 - protein, 8 aa, Staphylococcus
HPHGDSSV

SEQ ID NO: 1910554 - protein, 10 aa, Staphylococcus
HQTGPEGKEV

SEQ ID NO: 1910555 - protein, 8 aa, Staphylococcus
HRGQEGAG

SEQ ID NO: 1910556 - protein, 5 aa, Staphylococcus
HSIPD

SEQ ID NO: 1910557 - protein, 8 aa, Staphylococcus
HSLEGAKE

SEQ ID NO: 1910558 - protein, 10 aa, Staphylococcus
IAPGANINYE

SEQ ID NO: 1910559 - protein, 10 aa, Staphylococcus
IDKNGRENYD

SEQ ID NO: 1910560 - protein, 5 aa, Staphylococcus
IDNDE

SEQ ID NO: 1910561 - protein, 10 aa, Staphylococcus
IDSGKPGKTI

SEQ ID NO: 1910562 - protein, 4 aa, Staphylococcus
IEQD

SEQ ID NO: 1910563 - protein, 6 aa, Staphylococcus
IGASTG

SEQ ID NO: 1910564 - protein, 10 aa, Staphylococcus
IGGGNSGVEA

SEQ ID NO: 1910565 - protein, 4 aa, Staphylococcus
IGGP

SEQ ID NO: 1910566 - protein, 8 aa, Staphylococcus
IGNNEGMT

SEQ ID NO: 1910567 - protein, 4 aa, Staphylococcus
IGPD

SEQ ID NO: 1910568 - protein, 6 aa, Staphylococcus
IGPGSI

SEQ ID NO: 1910569 - protein, 6 aa, Staphylococcus
IGSGNA

SEQ ID NO: 1910570 - protein, 4 aa, Staphylococcus
IHAR

SEQ ID NO: 1910571 - protein, 12 aa, Staphylococcus
IHTSGHGSQGDQ

SEQ ID NO: 1910572 - protein, 4 aa, Staphylococcus
IKAN

SEQ ID NO: 1910573 - protein, 4 aa, Staphylococcus
INEE

SEQ ID NO: 1910574 - protein, 8 aa, Staphylococcus
INETESDR

SEQ ID NO: 1910575 - protein, 7 aa, Staphylococcus
INPTRSG

SEQ ID NO: 1910576 - protein, 5 aa, Staphylococcus
INRPE

SEQ ID NO: 1910577 - protein, 6 aa, Staphylococcus
IPEAEQ

SEQ ID NO: 1910578 - protein, 11 aa, Staphylococcus
IPTSTGAAKAL

SEQ ID NO: 1910579 - protein, 7 aa, Staphylococcus
IQTPNSY

SEQ ID NO: 1910580 - protein, 11 aa, Staphylococcus
IRREQGSDIDA

SEQ ID NO: 1910581 - protein, 8 aa, Staphylococcus
IRRGYKSM

SEQ ID NO: 1910582 - protein, 9 aa, Staphylococcus
ISTGGGASL

SEQ ID NO: 1910583 - protein, 11 aa, Staphylococcus
ITYDSGGYSIK

SEQ ID NO: 1910584 - protein, 6 aa, Staphylococcus
KAPGKY

SEQ ID NO: 1910585 - protein, 8 aa, Staphylococcus
KDDPNARV

SEQ ID NO: 1910586 - protein, 16 aa, Staphylococcus
KDETDLGKEAKSYMDR

SEQ ID NO: 1910587 - protein, 15 aa, Staphylococcus
KDQNLSLNPTKISGA

SEQ ID NO: 1910588 - protein, 7 aa, Staphylococcus
KDTIENR

SEQ ID NO: 1910589 - protein, 8 aa, Staphylococcus
KEATGLGL

SEQ ID NO: 1910590 - protein, 7 aa, Staphylococcus
KEETGAK

SEQ ID NO: 1910591 - protein, 7 aa, Staphylococcus
KEFKNTY

SEQ ID NO: 1910592 - protein, 5 aa, Staphylococcus
KEGAK

SEQ ID NO: 1910593 - protein, 10 aa, Staphylococcus
KEPGGGTTDY

SEQ ID NO: 1910594 - protein, 7 aa, Staphylococcus
KEQKGLG

SEQ ID NO: 1910595 - protein, 10 aa, Staphylococcus
KGASKGEGLG

SEQ ID NO: 1910596 - protein, 9 aa, Staphylococcus
KGGATGGGY

SEQ ID NO: 1910597 - protein, 8 aa, Staphylococcus
KGGSEIEK

SEQ ID NO: 1910598 - protein, 5 aa, Staphylococcus
KGKNI

SEQ ID NO: 1910599 - protein, 9 aa, Staphylococcus
KGLKTSKEV

SEQ ID NO: 1910600 - protein, 11 aa, Staphylococcus
KGQMKQADRLN

SEQ ID NO: 1910601 - protein, 15 aa, Staphylococcus
KGVKTHPNDLKESNT

SEQ ID NO: 1910602 - protein, 8 aa, Staphylococcus
KIASGGEL

SEQ ID NO: 1910603 - protein, 5 aa, Staphylococcus
KISSF

SEQ ID NO: 1910604 - protein, 6 aa, Staphylococcus
KITDAG

SEQ ID NO: 1910605 - protein, 4 aa, Staphylococcus
KKIP

SEQ ID NO: 1910606 - protein, 4 aa, Staphylococcus
KKRY

SEQ ID NO: 1910607 - protein, 9 aa, Staphylococcus
KKTEEVDGY

SEQ ID NO: 1910608 - protein, 8 aa, Staphylococcus
KKTNSSVV

SEQ ID NO: 1910609 - protein, 10 aa, Staphylococcus
KKTQGNYNNE

SEQ ID NO: 1910610 - protein, 6 aa, Staphylococcus
KKYPQS

SEQ ID NO: 1910611 - protein, 7 aa, Staphylococcus
KLATTGG

SEQ ID NO: 1910612 - protein, 6 aa, Staphylococcus
KLQDSV

SEQ ID NO: 1910613 - protein, 9 aa, Staphylococcus
KNGDTVAQS

SEQ ID NO: 1910614 - protein, 9 aa, Staphylococcus
KNPGGGLAK

SEQ ID NO: 1910615 - protein, 5 aa, Staphylococcus
KNTST

SEQ ID NO: 1910616 - protein, 4 aa, Staphylococcus
KNYQ

SEQ ID NO: 1910617 - protein, 6 aa, Staphylococcus
KPHSYR

SEQ ID NO: 1910618 - protein, 6 aa, Staphylococcus
KPIVKD

SEQ ID NO: 1910619 - protein, 19 aa, Staphylococcus
KPKKKRMGRYQGYTNKRRK

SEQ ID NO: 1910620 - protein, 12 aa, Staphylococcus
KPNRRKADIEAK

SEQ ID NO: 1910621 - protein, 8 aa, Staphylococcus
KPSEETPF

SEQ ID NO: 1910622 - protein, 6 aa, Staphylococcus
KQKGAD

SEQ ID NO: 1910623 - protein, 7 aa, Staphylococcus
KQSTSGI

SEQ ID NO: 1910624 - protein, 13 aa, Staphylococcus
KSISTNKDLSAFI

SEQ ID NO: 1910625 - protein, 7 aa, Staphylococcus
KSSPEAI

SEQ ID NO: 1910626 - protein, 9 aa, Staphylococcus
KSTKKMKQI

SEQ ID NO: 1910627 - protein, 6 aa, Staphylococcus
KTITPR

SEQ ID NO: 1910628 - protein, 11 aa, Staphylococcus
KVTAKAQNDYH

SEQ ID NO: 1910629 - protein, 8 aa, Staphylococcus
LAGSEAAY

SEQ ID NO: 1910630 - protein, 4 aa, Staphylococcus
LAPY

SEQ ID NO: 1910631 - protein, 14 aa, Staphylococcus
LAQTGRLSSVDPNL

SEQ ID NO: 1910632 - protein, 10 aa, Staphylococcus
LDGDTRGGAA

SEQ ID NO: 1910633 - protein, 8 aa, Staphylococcus
LEDPYENM

SEQ ID NO: 1910634 - protein, 13 aa, Staphylococcus
LEEEDPKEIEASK

SEQ ID NO: 1910635 - protein, 10 aa, Staphylococcus
LEENPKQPKL

SEQ ID NO: 1910636 - protein, 6 aa, Staphylococcus
LEEPPA

SEQ ID NO: 1910637 - protein, 4 aa, Staphylococcus
LGAD

SEQ ID NO: 1910638 - protein, 5 aa, Staphylococcus
LGEAE

SEQ ID NO: 1910639 - protein, 6 aa, Staphylococcus
LGEMNP

SEQ ID NO: 1910640 - protein, 5 aa, Staphylococcus
LGGTE

SEQ ID NO: 1910641 - protein, 16 aa, Staphylococcus
LGGTGKEKGKRHPDIG

SEQ ID NO: 1910642 - protein, 16 aa, Staphylococcus
LGPAYQAGTMAGNPLS

SEQ ID NO: 1910643 - protein, 7 aa, Staphylococcus
LGSGKTT

SEQ ID NO: 1910644 - protein, 6 aa, Staphylococcus
LITTTE

SEQ ID NO: 1910645 - protein, 5 aa, Staphylococcus
LKEKE

SEQ ID NO: 1910646 - protein, 6 aa, Staphylococcus
LKPEDT

SEQ ID NO: 1910647 - protein, 11 aa, Staphylococcus
LPEGQMGNSEV

SEQ ID NO: 1910648 - protein, 4 aa, Staphylococcus
LPGA

SEQ ID NO: 1910649 - protein, 5 aa, Staphylococcus
LPGED

SEQ ID NO: 1910650 - protein, 9 aa, Staphylococcus
LPMTKKDAR

SEQ ID NO: 1910651 - protein, 8 aa, Staphylococcus
LPPASPQI

SEQ ID NO: 1910652 - protein, 7 aa, Staphylococcus
LQPFNPE

SEQ ID NO: 1910653 - protein, 14 aa, Staphylococcus
LQQSSYKLTPQREA

SEQ ID NO: 1910654 - protein, 12 aa, Staphylococcus
LSGPAKERIENS

SEQ ID NO: 1910655 - protein, 7 aa, Staphylococcus
LSKVGGK

SEQ ID NO: 1910656 - protein, 4 aa, Staphylococcus
LSPN

SEQ ID NO: 1910657 - protein, 4 aa, Staphylococcus
LSPT

SEQ ID NO: 1910658 - protein, 4 aa, Staphylococcus
LTDD

SEQ ID NO: 1910659 - protein, 8 aa, Staphylococcus
MGGTGGGI

SEQ ID NO: 1910660 - protein, 7 aa, Staphylococcus
MPSPGKI

SEQ ID NO: 1910661 - protein, 4 aa, Staphylococcus
MREQ

SEQ ID NO: 1910662 - protein, 4 aa, Staphylococcus
NALN

SEQ ID NO: 1910663 - protein, 5 aa, Staphylococcus
NAQSR

SEQ ID NO: 1910664 - protein, 8 aa, Staphylococcus
NAVPPATG

SEQ ID NO: 1910665 - protein, 5 aa, Staphylococcus
NDGGG

SEQ ID NO: 1910666 - protein, 8 aa, Staphylococcus
NEGANMAA

SEQ ID NO: 1910667 - protein, 9 aa, Staphylococcus
NESTSDTIP

SEQ ID NO: 1910668 - protein, 7 aa, Staphylococcus
NESYEPR

SEQ ID NO: 1910669 - protein, 9 aa, Staphylococcus
NGAGKSTTI

SEQ ID NO: 1910670 - protein, 7 aa, Staphylococcus
NGGGCTG

SEQ ID NO: 1910671 - protein, 7 aa, Staphylococcus
NHGGRTY

SEQ ID NO: 1910672 - protein, 7 aa, Staphylococcus
NKRSSGK

SEQ ID NO: 1910673 - protein, 7 aa, Staphylococcus
NKTNQRG

SEQ ID NO: 1910674 - protein, 11 aa, Staphylococcus
NLQKSGRITGA

SEQ ID NO: 1910675 - protein, 5 aa, Staphylococcus
NPAYE

SEQ ID NO: 1910676 - protein, 10 aa, Staphylococcus
NPETTPGGRA

SEQ ID NO: 1910677 - protein, 13 aa, Staphylococcus
NQNERSQIKNREA

SEQ ID NO: 1910678 - protein, 7 aa, Staphylococcus
NQNTIEE

SEQ ID NO: 1910679 - protein, 13 aa, Staphylococcus
NREEGDDTLSPGV

SEQ ID NO: 1910680 - protein, 5 aa, Staphylococcus
NRGPV

SEQ ID NO: 1910681 - protein, 6 aa, Staphylococcus
NSFGRQ

SEQ ID NO: 1910682 - protein, 7 aa, Staphylococcus
NSNDDIS

SEQ ID NO: 1910683 - protein, 4 aa, Staphylococcus
NSNV

SEQ ID NO: 1910684 - protein, 6 aa, Staphylococcus
NSPEYI

SEQ ID NO: 1910685 - protein, 11 aa, Staphylococcus
NSTGGVLGPQD

SEQ ID NO: 1910686 - protein, 7 aa, Staphylococcus
NSTRTKC

SEQ ID NO: 1910687 - protein, 9 aa, Staphylococcus
NTNAQVGHS

SEQ ID NO: 1910688 - protein, 8 aa, Staphylococcus
NVPGPKKG

SEQ ID NO: 1910689 - protein, 7 aa, Staphylococcus
PALGPTF

SEQ ID NO: 1910690 - protein, 9 aa, Staphylococcus
PDDSPISNR

SEQ ID NO: 1910691 - protein, 5 aa, Staphylococcus
PDERS

SEQ ID NO: 1910692 - protein, 5 aa, Staphylococcus
PDPIH

SEQ ID NO: 1910693 - protein, 8 aa, Staphylococcus
PDSTIAGK

SEQ ID NO: 1910694 - protein, 8 aa, Staphylococcus
PEGRNTNE

SEQ ID NO: 1910695 - protein, 4 aa, Staphylococcus
PEGT

SEQ ID NO: 1910696 - protein, 5 aa, Staphylococcus
PERDM

SEQ ID NO: 1910697 - protein, 11 aa, Staphylococcus
PEYDDVEDATT

SEQ ID NO: 1910698 - protein, 5 aa, Staphylococcus
PEYEA

SEQ ID NO: 1910699 - protein, 11 aa, Staphylococcus
PGAGGTESQDW

SEQ ID NO: 1910700 - protein, 7 aa, Staphylococcus
PGSTGAV

SEQ ID NO: 1910701 - protein, 6 aa, Staphylococcus
PIGNQR

SEQ ID NO: 1910702 - protein, 6 aa, Staphylococcus
PKTFTR

SEQ ID NO: 1910703 - protein, 8 aa, Staphylococcus
PNGTGKSQ

SEQ ID NO: 1910704 - protein, 9 aa, Staphylococcus
PNMSGKSTY

SEQ ID NO: 1910705 - protein, 6 aa, Staphylococcus
PNVGKS

SEQ ID NO: 1910706 - protein, 6 aa, Staphylococcus
PNYDGA

SEQ ID NO: 1910707 - protein, 7 aa, Staphylococcus
PPGTGDV

SEQ ID NO: 1910708 - protein, 9 aa, Staphylococcus
PQDDNRDGV

SEQ ID NO: 1910709 - protein, 5 aa, Staphylococcus
PQSPQ

SEQ ID NO: 1910710 - protein, 11 aa, Staphylococcus
PSGASTGEHEA

SEQ ID NO: 1910711 - protein, 4 aa, Staphylococcus
PTKD

SEQ ID NO: 1910712 - protein, 6 aa, Staphylococcus
PTNPTG

SEQ ID NO: 1910713 - protein, 7 aa, Staphylococcus
PVTPPNN

SEQ ID NO: 1910714 - protein, 8 aa, Staphylococcus
PYGGGKGG

SEQ ID NO: 1910715 - protein, 5 aa, Staphylococcus
QAPAR

SEQ ID NO: 1910716 - protein, 7 aa, Staphylococcus
QAPATKG

SEQ ID NO: 1910717 - protein, 6 aa, Staphylococcus
QCGSGL

SEQ ID NO: 1910718 - protein, 10 aa, Staphylococcus
QENGTEPPFQ

SEQ ID NO: 1910719 - protein, 9 aa, Staphylococcus
QEQDRGITI

SEQ ID NO: 1910720 - protein, 5 aa, Staphylococcus
QGASE

SEQ ID NO: 1910721 - protein, 4 aa, Staphylococcus
QGED

SEQ ID NO: 1910722 - protein, 9 aa, Staphylococcus
QGKMTTSGE

SEQ ID NO: 1910723 - protein, 7 aa, Staphylococcus
QGRIEED

SEQ ID NO: 1910724 - protein, 9 aa, Staphylococcus
QKDSTVRAN

SEQ ID NO: 1910725 - protein, 4 aa, Staphylococcus
QLDA

SEQ ID NO: 1910726 - protein, 5 aa, Staphylococcus
QPIAT

SEQ ID NO: 1910727 - protein, 7 aa, Staphylococcus
QPPGKKL

SEQ ID NO: 1910728 - protein, 8 aa, Staphylococcus
QPSSSTPL

SEQ ID NO: 1910729 - protein, 6 aa, Staphylococcus
QQLETD

SEQ ID NO: 1910730 - protein, 5 aa, Staphylococcus
QRPGA

SEQ ID NO: 1910731 - protein, 10 aa, Staphylococcus
QSEAVRTTEG

SEQ ID NO: 1910732 - protein, 5 aa, Staphylococcus
QSGNN

SEQ ID NO: 1910733 - protein, 9 aa, Staphylococcus
QTGQEDSKF

SEQ ID NO: 1910734 - protein, 12 aa, Staphylococcus
QTNEAKIRGYQK

SEQ ID NO: 1910735 - protein, 8 aa, Staphylococcus
QTNTYGAN

SEQ ID NO: 1910736 - protein, 4 aa, Staphylococcus
QVKR

SEQ ID NO: 1910737 - protein, 7 aa, Staphylococcus
QVPNDGN

SEQ ID NO: 1910738 - protein, 11 aa, Staphylococcus
RAGIKDPNRPI

SEQ ID NO: 1910739 - protein, 6 aa, Staphylococcus
RASERT

SEQ ID NO: 1910740 - protein, 5 aa, Staphylococcus
RASQG

SEQ ID NO: 1910741 - protein, 17 aa, Staphylococcus
RAVESAQKRVEGNNFDA

SEQ ID NO: 1910742 - protein, 8 aa, Staphylococcus
RDETDRTG

SEQ ID NO: 1910743 - protein, 7 aa, Staphylococcus
REDVQRG

SEQ ID NO: 1910744 - protein, 6 aa, Staphylococcus
RELSRD

SEQ ID NO: 1910745 - protein, 8 aa, Staphylococcus
RERSEVDQ

SEQ ID NO: 1910746 - protein, 8 aa, Staphylococcus
RFSGATRG

SEQ ID NO: 1910747 - protein, 18 aa, Staphylococcus
RGDKVTGKVRKPKDNEKY

SEQ ID NO: 1910748 - protein, 5 aa, Staphylococcus
RGIGR

SEQ ID NO: 1910749 - protein, 8 aa, Staphylococcus
RGKKPIQR

SEQ ID NO: 1910750 - protein, 10 aa, Staphylococcus
RISEDDAKKG

SEQ ID NO: 1910751 - protein, 5 aa, Staphylococcus
RKEEI

SEQ ID NO: 1910752 - protein, 6 aa, Staphylococcus
RNTGND

SEQ ID NO: 1910753 - protein, 16 aa, Staphylococcus
RNYITTKNKRNNPERI

SEQ ID NO: 1910754 - protein, 7 aa, Staphylococcus
RPERRTT

SEQ ID NO: 1910755 - protein, 5 aa, Staphylococcus
RPGPM

SEQ ID NO: 1910756 - protein, 6 aa, Staphylococcus
RPNDNI

SEQ ID NO: 1910757 - protein, 4 aa, Staphylococcus
RPNT

SEQ ID NO: 1910758 - protein, 8 aa, Staphylococcus
RPNVGKST

SEQ ID NO: 1910759 - protein, 9 aa, Staphylococcus
RRGGGISET

SEQ ID NO: 1910760 - protein, 8 aa, Staphylococcus
RRTYGNAE

SEQ ID NO: 1910761 - protein, 10 aa, Staphylococcus
RTPSTTDYNG

SEQ ID NO: 1910762 - protein, 8 aa, Staphylococcus
RVGRSSRI

SEQ ID NO: 1910763 - protein, 4 aa, Staphylococcus
RWNP

SEQ ID NO: 1910764 - protein, 11 aa, Staphylococcus
SAKKRTKSIAY

SEQ ID NO: 1910765 - protein, 15 aa, Staphylococcus
SASEFQKGEHKNVEG

SEQ ID NO: 1910766 - protein, 4 aa, Staphylococcus
SATG

SEQ ID NO: 1910767 - protein, 4 aa, Staphylococcus
SDED

SEQ ID NO: 1910768 - protein, 6 aa, Staphylococcus
SDMKGG

SEQ ID NO: 1910769 - protein, 9 aa, Staphylococcus
SDRNPENLP

SEQ ID NO: 1910770 - protein, 4 aa, Staphylococcus
SDRT

SEQ ID NO: 1910771 - protein, 11 aa, Staphylococcus
SEASVGKDTMT

SEQ ID NO: 1910772 - protein, 8 aa, Staphylococcus
SEEDKTLE

SEQ ID NO: 1910773 - protein, 7 aa, Staphylococcus
SEGQGMS

SEQ ID NO: 1910774 - protein, 6 aa, Staphylococcus
SEITPL

SEQ ID NO: 1910775 - protein, 6 aa, Staphylococcus
SERQAQ

SEQ ID NO: 1910776 - protein, 6 aa, Staphylococcus
SETDPI

SEQ ID NO: 1910777 - protein, 7 aa, Staphylococcus
SFDGKGQ

SEQ ID NO: 1910778 - protein, 6 aa, Staphylococcus
SFGKES

SEQ ID NO: 1910779 - protein, 4 aa, Staphylococcus
SGAL

SEQ ID NO: 1910780 - protein, 4 aa, Staphylococcus
SGAV

SEQ ID NO: 1910781 - protein, 5 aa, Staphylococcus
SGGKR

SEQ ID NO: 1910782 - protein, 9 aa, Staphylococcus
SGGNNAGHT

SEQ ID NO: 1910783 - protein, 6 aa, Staphylococcus
SGGTDN

SEQ ID NO: 1910784 - protein, 4 aa, Staphylococcus
SGLQ

SEQ ID NO: 1910785 - protein, 6 aa, Staphylococcus
SGNDDN

SEQ ID NO: 1910786 - protein, 18 aa, Staphylococcus
SGNVDSNRLRTGTMTEED

SEQ ID NO: 1910787 - protein, 9 aa, Staphylococcus
SGTATAGIP

SEQ ID NO: 1910788 - protein, 11 aa, Staphylococcus
SGTDAKTGSPD

SEQ ID NO: 1910789 - protein, 6 aa, Staphylococcus
SGVPTA

SEQ ID NO: 1910790 - protein, 19 aa, Staphylococcus
SHNHPSAIEPYQGAATGVG

SEQ ID NO: 1910791 - protein, 9 aa, Staphylococcus
SHRTSNDKE

SEQ ID NO: 1910792 - protein, 8 aa, Staphylococcus
SIQQAEDR

SEQ ID NO: 1910793 - protein, 6 aa, Staphylococcus
SITEGT

SEQ ID NO: 1910794 - protein, 8 aa, Staphylococcus
SKEAQAEA

SEQ ID NO: 1910795 - protein, 20 aa, Staphylococcus
SKMFSPSPAHFGAEPNSNTN

SEQ ID NO: 1910796 - protein, 8 aa, Staphylococcus
SKYTRSKL

SEQ ID NO: 1910797 - protein, 8 aa, Staphylococcus
SLAPGSKV

SEQ ID NO: 1910798 - protein, 5 aa, Staphylococcus
SNGLH

SEQ ID NO: 1910799 - protein, 6 aa, Staphylococcus
SNRPLY

SEQ ID NO: 1910800 - protein, 4 aa, Staphylococcus
SPDA

SEQ ID NO: 1910801 - protein, 9 aa, Staphylococcus
SPGSRSTPL

SEQ ID NO: 1910802 - protein, 7 aa, Staphylococcus
SPGVAEP

SEQ ID NO: 1910803 - protein, 11 aa, Staphylococcus
SPMDGIGPEDI

SEQ ID NO: 1910804 - protein, 4 aa, Staphylococcus
SPSI

SEQ ID NO: 1910805 - protein, 5 aa, Staphylococcus
SRGQT

SEQ ID NO: 1910806 - protein, 10 aa, Staphylococcus
SRISGVNPAD

SEQ ID NO: 1910807 - protein, 6 aa, Staphylococcus
SSETES

SEQ ID NO: 1910808 - protein, 8 aa, Staphylococcus
SSGTEATL

SEQ ID NO: 1910809 - protein, 9 aa, Staphylococcus
SSPNTENLQ

SEQ ID NO: 1910810 - protein, 4 aa, Staphylococcus
STCN

SEQ ID NO: 1910811 - protein, 17 aa, Staphylococcus
STGNTSASAAAYAARAG

SEQ ID NO: 1910812 - protein, 4 aa, Staphylococcus
STPG

SEQ ID NO: 1910813 - protein, 15 aa, Staphylococcus
SVTEGHPDKIADQVS

SEQ ID NO: 1910814 - protein, 11 aa, Staphylococcus
TAGQKGTGKWT

SEQ ID NO: 1910815 - protein, 5 aa, Staphylococcus
TANNA

SEQ ID NO: 1910816 - protein, 25 aa, Staphylococcus
TDEAKEGRDAFKEKRDPDFDQFPKF

SEQ ID NO: 1910817 - protein, 21 aa, Staphylococcus
TEEGIGQTTAVGIGGDPVNGT

SEQ ID NO: 1910818 - protein, 12 aa, Staphylococcus
TEMGSNPTELDQ

SEQ ID NO: 1910819 - protein, 7 aa, Staphylococcus
TGGEPMF

SEQ ID NO: 1910820 - protein, 7 aa, Staphylococcus
TGGQHRS

SEQ ID NO: 1910821 - protein, 8 aa, Staphylococcus
TGISEPVP

SEQ ID NO: 1910822 - protein, 4 aa, Staphylococcus
TGKK

SEQ ID NO: 1910823 - protein, 7 aa, Staphylococcus
TGSKDHN

SEQ ID NO: 1910824 - protein, 4 aa, Staphylococcus
TGTV

SEQ ID NO: 1910825 - protein, 10 aa, Staphylococcus
THDVDNDKSL

SEQ ID NO: 1910826 - protein, 9 aa, Staphylococcus
THSDAQKGI

SEQ ID NO: 1910827 - protein, 11 aa, Staphylococcus
TIDEVNTKAFE

SEQ ID NO: 1910828 - protein, 5 aa, Staphylococcus
TKLLP

SEQ ID NO: 1910829 - protein, 7 aa, Staphylococcus
TKQAAAY

SEQ ID NO: 1910830 - protein, 8 aa, Staphylococcus
TKTTPEKS

SEQ ID NO: 1910831 - protein, 12 aa, Staphylococcus
TMTPKKPNSALR

SEQ ID NO: 1910832 - protein, 17 aa, Staphylococcus
TNAGQIKTGSLSRTDRI

SEQ ID NO: 1910833 - protein, 7 aa, Staphylococcus
TNAGQTC

SEQ ID NO: 1910834 - protein, 17 aa, Staphylococcus
TNEHGYEIESKRGGGGY

SEQ ID NO: 1910835 - protein, 6 aa, Staphylococcus
TNKAEK

SEQ ID NO: 1910836 - protein, 7 aa, Staphylococcus
TNVGKST

SEQ ID NO: 1910837 - protein, 5 aa, Staphylococcus
TPGSD

SEQ ID NO: 1910838 - protein, 11 aa, Staphylococcus
TPMGGSADSYI

SEQ ID NO: 1910839 - protein, 8 aa, Staphylococcus
TPNTNQYR

SEQ ID NO: 1910840 - protein, 8 aa, Staphylococcus
TPYTKKPL

SEQ ID NO: 1910841 - protein, 7 aa, Staphylococcus
TSGEQRI

SEQ ID NO: 1910842 - protein, 9 aa, Staphylococcus
TSGPGVSNL

SEQ ID NO: 1910843 - protein, 5 aa, Staphylococcus
TSTHN

SEQ ID NO: 1910844 - protein, 6 aa, Staphylococcus
TSTKSV

SEQ ID NO: 1910845 - protein, 5 aa, Staphylococcus
TSVDG

SEQ ID NO: 1910846 - protein, 7 aa, Staphylococcus
TTNGAYA

SEQ ID NO: 1910847 - protein, 12 aa, Staphylococcus
TTRAGSLTGPLR

SEQ ID NO: 1910848 - protein, 5 aa, Staphylococcus
TTSSR

SEQ ID NO: 1910849 - protein, 4 aa, Staphylococcus
TTVT

SEQ ID NO: 1910850 - protein, 7 aa, Staphylococcus
TVSKGGH

SEQ ID NO: 1910851 - protein, 11 aa, Staphylococcus
TYEGGTHEDGF

SEQ ID NO: 1910852 - protein, 14 aa, Staphylococcus
VAETGAGQHGVASA

SEQ ID NO: 1910853 - protein, 5 aa, Staphylococcus
VAPPF

SEQ ID NO: 1910854 - protein, 6 aa, Staphylococcus
VAPRRE

SEQ ID NO: 1910855 - protein, 13 aa, Staphylococcus
VATPGIGKDAFQE

SEQ ID NO: 1910856 - protein, 4 aa, Staphylococcus
VDGA

SEQ ID NO: 1910857 - protein, 10 aa, Staphylococcus
VEGDLRREQN

SEQ ID NO: 1910858 - protein, 4 aa, Staphylococcus
VEIP

SEQ ID NO: 1910859 - protein, 10 aa, Staphylococcus
VEQTTKGPQI

SEQ ID NO: 1910860 - protein, 16 aa, Staphylococcus
VGETGPVRAPGRREIG

SEQ ID NO: 1910861 - protein, 13 aa, Staphylococcus
VGPNGSGKSNITD

SEQ ID NO: 1910862 - protein, 6 aa, Staphylococcus
VGYNED

SEQ ID NO: 1910863 - protein, 12 aa, Staphylococcus
VHGPYKGEPKLG

SEQ ID NO: 1910864 - protein, 5 aa, Staphylococcus
VKDGD

SEQ ID NO: 1910865 - protein, 11 aa, Staphylococcus
VKGPGPGRESA

SEQ ID NO: 1910866 - protein, 4 aa, Staphylococcus
VKQP

SEQ ID NO: 1910867 - protein, 4 aa, Staphylococcus
VKQQ

SEQ ID NO: 1910868 - protein, 8 aa, Staphylococcus
VPEGEGQS

SEQ ID NO: 1910869 - protein, 6 aa, Staphylococcus
VPSNPK

SEQ ID NO: 1910870 - protein, 7 aa, Staphylococcus
VPSTSKI

SEQ ID NO: 1910871 - protein, 4 aa, Staphylococcus
VQRR

SEQ ID NO: 1910872 - protein, 5 aa, Staphylococcus
VQRSM

SEQ ID NO: 1910873 - protein, 6 aa, Staphylococcus
VSEGRG

SEQ ID NO: 1910874 - protein, 6 aa, Staphylococcus
VSRDDA

SEQ ID NO: 1910875 - protein, 7 aa, Staphylococcus
VTGRPRG

SEQ ID NO: 1910876 - protein, 10 aa, Staphylococcus
VTPAHDPNDF

SEQ ID NO: 1910877 - protein, 5 aa, Staphylococcus
YAGPR

SEQ ID NO: 1910878 - protein, 11 aa, Staphylococcus
YATSGNKGIEN

SEQ ID NO: 1910879 - protein, 19 aa, Staphylococcus
YDLGPGPRMPEKKRQTAYE

SEQ ID NO: 1910880 - protein, 7 aa, Staphylococcus
YGDGAAD

SEQ ID NO: 1910881 - protein, 5 aa, Staphylococcus
YGGTY

SEQ ID NO: 1910882 - protein, 9 aa, Staphylococcus
YGSPEKKEI

SEQ ID NO: 1910883 - protein, 4 aa, Staphylococcus
YHGH

SEQ ID NO: 1910884 - protein, 12 aa, Staphylococcus
YKDSREQFEQRT

SEQ ID NO: 1910885 - protein, 9 aa, Staphylococcus
YNASPTSMK

SEQ ID NO: 1910886 - protein, 6 aa, Staphylococcus
YNGKKV

SEQ ID NO: 1910887 - protein, 14 aa, Staphylococcus
YPALNTSFNEEAGE

SEQ ID NO: 1910888 - protein, 9 aa, Staphylococcus
YQDTNKAQY

SEQ ID NO: 1910889 - protein, 9 aa, Staphylococcus
YSKGQSHHE

SEQ ID NO: 1910890 - protein, 8 aa, Staphylococcus
YSNQEIAS

SEQ ID NO: 1910891 - protein, 5 aa, Staphylococcus
YTRES

SEQ ID NO: 1910892 - protein, 16 aa, Staphylococcus
YVGEPGNFTRTSNRHD

SEQ ID NO: 1910893 - protein, 8 aa, Staphylococcus
AAGSGKTA

SEQ ID NO: 1910894 - protein, 5 aa, Staphylococcus
AAGSP

SEQ ID NO: 1910895 - protein, 6 aa, Staphylococcus
AAKAGD

SEQ ID NO: 1910896 - protein, 8 aa, Staphylococcus
AAKTPEKI

SEQ ID NO: 1910897 - protein, 6 aa, Staphylococcus
AASKGG

SEQ ID NO: 1910898 - protein, 8 aa, Staphylococcus
AATHNKGV

SEQ ID NO: 1910899 - protein, 5 aa, Staphylococcus
ADDSG

SEQ ID NO: 1910900 - protein, 9 aa, Staphylococcus
ADEKSIKGI

SEQ ID NO: 1910901 - protein, 5 aa, Staphylococcus
ADIEE

SEQ ID NO: 1910902 - protein, 4 aa, Staphylococcus
ADNV

SEQ ID NO: 1910903 - protein, 4 aa, Staphylococcus
AEDG

SEQ ID NO: 1910904 - protein, 17 aa, Staphylococcus
AEDGRKMSKSLGNGVDP

SEQ ID NO: 1910905 - protein, 10 aa, Staphylococcus
AEETGGGANR

SEQ ID NO: 1910906 - protein, 9 aa, Staphylococcus
AEQNNTSDL

SEQ ID NO: 1910907 - protein, 8 aa, Staphylococcus
AEQPNRPK

SEQ ID NO: 1910908 - protein, 7 aa, Staphylococcus
AETGKER

SEQ ID NO: 1910909 - protein, 18 aa, Staphylococcus
AFSTGSSIMPQKKNPDMA

SEQ ID NO: 1910910 - protein, 6 aa, Staphylococcus
AFTPKT

SEQ ID NO: 1910911 - protein, 8 aa, Staphylococcus
AGGVGSIA

SEQ ID NO: 1910912 - protein, 5 aa, Staphylococcus
AGIHT

SEQ ID NO: 1910913 - protein, 13 aa, Staphylococcus
AGKSDEDPYENPH

SEQ ID NO: 1910914 - protein, 9 aa, Staphylococcus
AGPATDATI

SEQ ID NO: 1910915 - protein, 8 aa, Staphylococcus
AGSGKTRV

SEQ ID NO: 1910916 - protein, 5 aa, Staphylococcus
AHGIP

SEQ ID NO: 1910917 - protein, 14 aa, Staphylococcus
AHGSGVMGKGAGTV

SEQ ID NO: 1910918 - protein, 4 aa, Staphylococcus
AHPS

SEQ ID NO: 1910919 - protein, 17 aa, Staphylococcus
AINAGQSVSRVGGSAQI

SEQ ID NO: 1910920 - protein, 6 aa, Staphylococcus
AIPYGT

SEQ ID NO: 1910921 - protein, 6 aa, Staphylococcus
AISDGE

SEQ ID NO: 1910922 - protein, 7 aa, Staphylococcus
AISPRTT

SEQ ID NO: 1910923 - protein, 5 aa, Staphylococcus
AITPG

SEQ ID NO: 1910924 - protein, 8 aa, Staphylococcus
AKAGAERI

SEQ ID NO: 1910925 - protein, 4 aa, Staphylococcus
ALGE

SEQ ID NO: 1910926 - protein, 6 aa, Staphylococcus
ALPDSE

SEQ ID NO: 1910927 - protein, 5 aa, Staphylococcus
ALSTD

SEQ ID NO: 1910928 - protein, 10 aa, Staphylococcus
AMPRTTNGNI

SEQ ID NO: 1910929 - protein, 9 aa, Staphylococcus
ANADAKPEH

SEQ ID NO: 1910930 - protein, 18 aa, Staphylococcus
ANASKSKQATSRKKQLEK

SEQ ID NO: 1910931 - protein, 8 aa, Staphylococcus
ANDSEYGL

SEQ ID NO: 1910932 - protein, 7 aa, Staphylococcus
ANKAVTD

SEQ ID NO: 1910933 - protein, 6 aa, Staphylococcus
ANNPSH

SEQ ID NO: 1910934 - protein, 10 aa, Staphylococcus
ANSRLDENGR

SEQ ID NO: 1910935 - protein, 6 aa, Staphylococcus
ANTDKD

SEQ ID NO: 1910936 - protein, 14 aa, Staphylococcus
APAPEGEGGSRAMQ

SEQ ID NO: 1910937 - protein, 5 aa, Staphylococcus
APKGA

SEQ ID NO: 1910938 - protein, 8 aa, Staphylococcus
APNAQNTA

SEQ ID NO: 1910939 - protein, 7 aa, Staphylococcus
APPQGIE

SEQ ID NO: 1910940 - protein, 13 aa, Staphylococcus
APTAGQEASQLAS

SEQ ID NO: 1910941 - protein, 7 aa, Staphylococcus
APTDAED

SEQ ID NO: 1910942 - protein, 9 aa, Staphylococcus
AQDKMNTVD

SEQ ID NO: 1910943 - protein, 10 aa, Staphylococcus
AQKNDQEAYE

SEQ ID NO: 1910944 - protein, 14 aa, Staphylococcus
AQQNPLRDYQNEGH

SEQ ID NO: 1910945 - protein, 11 aa, Staphylococcus
AQSGVEPQTET

SEQ ID NO: 1910946 - protein, 12 aa, Staphylococcus
AREREIEQSKAN

SEQ ID NO: 1910947 - protein, 8 aa, Staphylococcus
ARLSSDGK

SEQ ID NO: 1910948 - protein, 8 aa, Staphylococcus
ARSPRDGR

SEQ ID NO: 1910949 - protein, 8 aa, Staphylococcus
ARVTESNL

SEQ ID NO: 1910950 - protein, 8 aa, Staphylococcus
ASARRGAK

SEQ ID NO: 1910951 - protein, 16 aa, Staphylococcus
ASEGSEVLEEKDWGKR

SEQ ID NO: 1910952 - protein, 8 aa, Staphylococcus
ASHKEGKW

SEQ ID NO: 1910953 - protein, 7 aa, Staphylococcus
ASINDEI

SEQ ID NO: 1910954 - protein, 11 aa, Staphylococcus
ASNEADKYDEE

SEQ ID NO: 1910955 - protein, 8 aa, Staphylococcus
ASQEENAP

SEQ ID NO: 1910956 - protein, 5 aa, Staphylococcus
ASQLG

SEQ ID NO: 1910957 - protein, 7 aa, Staphylococcus
ASTGAAI

SEQ ID NO: 1910958 - protein, 7 aa, Staphylococcus
ATAEKNP

SEQ ID NO: 1910959 - protein, 8 aa, Staphylococcus
ATAQKGFV

SEQ ID NO: 1910960 - protein, 4 aa, Staphylococcus
ATGG

SEQ ID NO: 1910961 - protein, 10 aa, Staphylococcus
ATKEEGPIGK

SEQ ID NO: 1910962 - protein, 5 aa, Staphylococcus
ATPDQ

SEQ ID NO: 1910963 - protein, 8 aa, Staphylococcus
ATSEGDPV

SEQ ID NO: 1910964 - protein, 7 aa, Staphylococcus
AVSNGRA

SEQ ID NO: 1910965 - protein, 13 aa, Staphylococcus
AYLANGKSPKEAV

SEQ ID NO: 1910966 - protein, 5 aa, Staphylococcus
AYTKR

SEQ ID NO: 1910967 - protein, 8 aa, Staphylococcus
AYVPSTDT

SEQ ID NO: 1910968 - protein, 9 aa, Staphylococcus
CGQSNGRPI

SEQ ID NO: 1910969 - protein, 8 aa, Staphylococcus
CSAPGGKA

SEQ ID NO: 1910970 - protein, 22 aa, Staphylococcus
DAEENAEADKKRREEVDLRNEA

SEQ ID NO: 1910971 - protein, 14 aa, Staphylococcus
DAERQATKDAGKIA

SEQ ID NO: 1910972 - protein, 8 aa, Staphylococcus
DAKKSTPL

SEQ ID NO: 1910973 - protein, 4 aa, Staphylococcus
DAPE

SEQ ID NO: 1910974 - protein, 14 aa, Staphylococcus
DARGERERVKQRAN

SEQ ID NO: 1910975 - protein, 5 aa, Staphylococcus
DDETI

SEQ ID NO: 1910976 - protein, 9 aa, Staphylococcus
DDGRTRTLE

SEQ ID NO: 1910977 - protein, 5 aa, Staphylococcus
DDRYH

SEQ ID NO: 1910978 - protein, 11 aa, Staphylococcus
DDYTDPAPATA

SEQ ID NO: 1910979 - protein, 7 aa, Staphylococcus
DEDWRNR

SEQ ID NO: 1910980 - protein, 4 aa, Staphylococcus
DELD

SEQ ID NO: 1910981 - protein, 9 aa, Staphylococcus
DENPSTAAK

SEQ ID NO: 1910982 - protein, 7 aa, Staphylococcus
DEPTVED

SEQ ID NO: 1910983 - protein, 11 aa, Staphylococcus
DEVRSSKRVTT

SEQ ID NO: 1910984 - protein, 5 aa, Staphylococcus
DEYEQ

SEQ ID NO: 1910985 - protein, 11 aa, Staphylococcus
DFIQPPSRKNE

SEQ ID NO: 1910986 - protein, 10 aa, Staphylococcus
DFTENSEDYG

SEQ ID NO: 1910987 - protein, 9 aa, Staphylococcus
DGAKPTDTV

SEQ ID NO: 1910988 - protein, 5 aa, Staphylococcus
DGNDA

SEQ ID NO: 1910989 - protein, 6 aa, Staphylococcus
DGPSME

SEQ ID NO: 1910990 - protein, 9 aa, Staphylococcus
DGQKAPVAH

SEQ ID NO: 1910991 - protein, 7 aa, Staphylococcus
DGTAKGG

SEQ ID NO: 1910992 - protein, 6 aa, Staphylococcus
DGVPTY

SEQ ID NO: 1910993 - protein, 5 aa, Staphylococcus
DGYTG

SEQ ID NO: 1910994 - protein, 14 aa, Staphylococcus
DHARGKVLGGSSSI

SEQ ID NO: 1910995 - protein, 9 aa, Staphylococcus
DIGGGSTEV

SEQ ID NO: 1910996 - protein, 4 aa, Staphylococcus
DIQR

SEQ ID NO: 1910997 - protein, 7 aa, Staphylococcus
DKAPEIG

SEQ ID NO: 1910998 - protein, 12 aa, Staphylococcus
DKHSTGGVGDTT

SEQ ID NO: 1910999 - protein, 8 aa, Staphylococcus
DKNGCPKC

SEQ ID NO: 1911000 - protein, 19 aa, Staphylococcus
DKNGRVGFGTGKAQEVPEA

SEQ ID NO: 1911001 - protein, 7 aa, Staphylococcus
DKVGNDG

SEQ ID NO: 1911002 - protein, 8 aa, Staphylococcus
DLSGGQRQ

SEQ ID NO: 1911003 - protein, 15 aa, Staphylococcus
DLTERRESKQPLEYP

SEQ ID NO: 1911004 - protein, 4 aa, Staphylococcus
DMSE

SEQ ID NO: 1911005 - protein, 7 aa, Staphylococcus
DNETVSL

SEQ ID NO: 1911006 - protein, 5 aa, Staphylococcus
DNNEI

SEQ ID NO: 1911007 - protein, 6 aa, Staphylococcus
DNPNAI

SEQ ID NO: 1911008 - protein, 8 aa, Staphylococcus
DNQGKAQP

SEQ ID NO: 1911009 - protein, 6 aa, Staphylococcus
DPFKKA

SEQ ID NO: 1911010 - protein, 7 aa, Staphylococcus
DPGWLGP

SEQ ID NO: 1911011 - protein, 7 aa, Staphylococcus
DPKTRQI

SEQ ID NO: 1911012 - protein, 13 aa, Staphylococcus
DPLDGHKGTNIGS

SEQ ID NO: 1911013 - protein, 9 aa, Staphylococcus
DPTKVTRSA

SEQ ID NO: 1911014 - protein, 9 aa, Staphylococcus
DPYHGPNQA

SEQ ID NO: 1911015 - protein, 7 aa, Staphylococcus
DQNLERQ

SEQ ID NO: 1911016 - protein, 9 aa, Staphylococcus
DQSASGQTL

SEQ ID NO: 1911017 - protein, 5 aa, Staphylococcus
DQYSE

SEQ ID NO: 1911018 - protein, 9 aa, Staphylococcus
DRKERAGVK

SEQ ID NO: 1911019 - protein, 7 aa, Staphylococcus
DRNGREF

SEQ ID NO: 1911020 - protein, 4 aa, Staphylococcus
DRVG

SEQ ID NO: 1911021 - protein, 7 aa, Staphylococcus
DRYDGNP

SEQ ID NO: 1911022 - protein, 14 aa, Staphylococcus
DSAHGTNPASASFA

SEQ ID NO: 1911023 - protein, 9 aa, Staphylococcus
DSDSSSPHT

SEQ ID NO: 1911024 - protein, 6 aa, Staphylococcus
DSPTNQ

SEQ ID NO: 1911025 - protein, 4 aa, Staphylococcus
DTDQ

SEQ ID NO: 1911026 - protein, 10 aa, Staphylococcus
DVSRQKRKKV

SEQ ID NO: 1911027 - protein, 9 aa, Staphylococcus
DWGATPSAL

SEQ ID NO: 1911028 - protein, 6 aa, Staphylococcus
DYAESL

SEQ ID NO: 1911029 - protein, 11 aa, Staphylococcus
DYDRPGSNRQP

SEQ ID NO: 1911030 - protein, 4 aa, Staphylococcus
DYDT

SEQ ID NO: 1911031 - protein, 6 aa, Staphylococcus
DYGESD

SEQ ID NO: 1911032 - protein, 5 aa, Staphylococcus
EAARP

SEQ ID NO: 1911033 - protein, 4 aa, Staphylococcus
EAGI

SEQ ID NO: 1911034 - protein, 11 aa, Staphylococcus
EASLSGPKRPQ

SEQ ID NO: 1911035 - protein, 9 aa, Staphylococcus
EATAGNTGI

SEQ ID NO: 1911036 - protein, 7 aa, Staphylococcus
EATDEAV

SEQ ID NO: 1911037 - protein, 5 aa, Staphylococcus
EATQD

SEQ ID NO: 1911038 - protein, 4 aa, Staphylococcus
EAVE

SEQ ID NO: 1911039 - protein, 6 aa, Staphylococcus
EDDGPE

SEQ ID NO: 1911040 - protein, 5 aa, Staphylococcus
EDERY

SEQ ID NO: 1911041 - protein, 10 aa, Staphylococcus
EDTPGVTRDR

SEQ ID NO: 1911042 - protein, 6 aa, Staphylococcus
EEGPAH

SEQ ID NO: 1911043 - protein, 9 aa, Staphylococcus
EEIEEAQAG

SEQ ID NO: 1911044 - protein, 9 aa, Staphylococcus
EFSTQSPQL

SEQ ID NO: 1911045 - protein, 7 aa, Staphylococcus
EGASPIV

SEQ ID NO: 1911046 - protein, 6 aa, Staphylococcus
EGGLGG

SEQ ID NO: 1911047 - protein, 18 aa, Staphylococcus
EGMEKREENFADEVKGQM

SEQ ID NO: 1911048 - protein, 11 aa, Staphylococcus
EGQGPEHSSAR

SEQ ID NO: 1911049 - protein, 5 aa, Staphylococcus
EGRGI

SEQ ID NO: 1911050 - protein, 5 aa, Staphylococcus
EGRKI

SEQ ID NO: 1911051 - protein, 7 aa, Staphylococcus
EGSDDYR

SEQ ID NO: 1911052 - protein, 14 aa, Staphylococcus
EHESTYKQEDYPRY

SEQ ID NO: 1911053 - protein, 5 aa, Staphylococcus
EIAKT

SEQ ID NO: 1911054 - protein, 6 aa, Staphylococcus
EKFSKQ

SEQ ID NO: 1911055 - protein, 6 aa, Staphylococcus
EKMSKS

SEQ ID NO: 1911056 - protein, 13 aa, Staphylococcus
EKQARRIGEARHE

SEQ ID NO: 1911057 - protein, 5 aa, Staphylococcus
EKQSL

SEQ ID NO: 1911058 - protein, 10 aa, Staphylococcus
EKRAKELDEM

SEQ ID NO: 1911059 - protein, 7 aa, Staphylococcus
ELGGKSP

SEQ ID NO: 1911060 - protein, 5 aa, Staphylococcus
ELQGR

SEQ ID NO: 1911061 - protein, 10 aa, Staphylococcus
EMPKPDKTKL

SEQ ID NO: 1911062 - protein, 6 aa, Staphylococcus
EMRGPG

SEQ ID NO: 1911063 - protein, 11 aa, Staphylococcus
ENAAHGKGLTE

SEQ ID NO: 1911064 - protein, 6 aa, Staphylococcus
ENFPGQ

SEQ ID NO: 1911065 - protein, 8 aa, Staphylococcus
ENGLDGSR

SEQ ID NO: 1911066 - protein, 6 aa, Staphylococcus
ENYPKN

SEQ ID NO: 1911067 - protein, 11 aa, Staphylococcus
EPGRKTPGVEE

SEQ ID NO: 1911068 - protein, 11 aa, Staphylococcus
EPGVGKTAIAE

SEQ ID NO: 1911069 - protein, 10 aa, Staphylococcus
EQAKIAEEAG

SEQ ID NO: 1911070 - protein, 16 aa, Staphylococcus
EQERNESKRRQAQGIQ

SEQ ID NO: 1911071 - protein, 4 aa, Staphylococcus
EQGA

SEQ ID NO: 1911072 - protein, 7 aa, Staphylococcus
EQSDVNN

SEQ ID NO: 1911073 - protein, 6 aa, Staphylococcus
EQSGIE

SEQ ID NO: 1911074 - protein, 5 aa, Staphylococcus
EQWGS

SEQ ID NO: 1911075 - protein, 8 aa, Staphylococcus
ERKSGSAV

SEQ ID NO: 1911076 - protein, 12 aa, Staphylococcus
ERPMASDNKTLG

SEQ ID NO: 1911077 - protein, 8 aa, Staphylococcus
ERSELPAE

SEQ ID NO: 1911078 - protein, 5 aa, Staphylococcus
ERTKY

SEQ ID NO: 1911079 - protein, 4 aa, Staphylococcus
ESEI

SEQ ID NO: 1911080 - protein, 8 aa, Staphylococcus
ESEPPAQK

SEQ ID NO: 1911081 - protein, 4 aa, Staphylococcus
ESGV

SEQ ID NO: 1911082 - protein, 6 aa, Staphylococcus
ESMTNA

SEQ ID NO: 1911083 - protein, 8 aa, Staphylococcus
ESSRPNEI

SEQ ID NO: 1911084 - protein, 5 aa, Staphylococcus
ETGAM

SEQ ID NO: 1911085 - protein, 5 aa, Staphylococcus
ETKVE

SEQ ID NO: 1911086 - protein, 8 aa, Staphylococcus
ETTGNQLD

SEQ ID NO: 1911087 - protein, 8 aa, Staphylococcus
EVGEKQAA

SEQ ID NO: 1911088 - protein, 9 aa, Staphylococcus
EVNTTDPEY

SEQ ID NO: 1911089 - protein, 7 aa, Staphylococcus
EVQNDKS

SEQ ID NO: 1911090 - protein, 6 aa, Staphylococcus
EVSGKT

SEQ ID NO: 1911091 - protein, 9 aa, Staphylococcus
EVTKRKDNG

SEQ ID NO: 1911092 - protein, 24 aa, Staphylococcus
FAKGQKGSSAMPHKRNPIGSENIT

SEQ ID NO: 1911093 - protein, 10 aa, Staphylococcus
FDTQKERGQM

SEQ ID NO: 1911094 - protein, 4 aa, Staphylococcus
FGGG

SEQ ID NO: 1911095 - protein, 10 aa, Staphylococcus
FGNTSAASIP

SEQ ID NO: 1911096 - protein, 8 aa, Staphylococcus
FGPSTNGV

SEQ ID NO: 1911097 - protein, 4 aa, Staphylococcus
FGTG

SEQ ID NO: 1911098 - protein, 4 aa, Staphylococcus
FPAS

SEQ ID NO: 1911099 - protein, 5 aa, Staphylococcus
FTDND

SEQ ID NO: 1911100 - protein, 7 aa, Staphylococcus
FVTEGKN

SEQ ID NO: 1911101 - protein, 5 aa, Staphylococcus
GAEGI

SEQ ID NO: 1911102 - protein, 6 aa, Staphylococcus
GAGFPS

SEQ ID NO: 1911103 - protein, 5 aa, Staphylococcus
GAGKT

SEQ ID NO: 1911104 - protein, 8 aa, Staphylococcus
GAKGKRFA

SEQ ID NO: 1911105 - protein, 23 aa, Staphylococcus
GAPPGYVGHDDGGQLTEKVRRKP

SEQ ID NO: 1911106 - protein, 6 aa, Staphylococcus
GAQKVG

SEQ ID NO: 1911107 - protein, 5 aa, Staphylococcus
GASAI

SEQ ID NO: 1911108 - protein, 8 aa, Staphylococcus
GASAPGDL

SEQ ID NO: 1911109 - protein, 9 aa, Staphylococcus
GDDLPTAGG

SEQ ID NO: 1911110 - protein, 18 aa, Staphylococcus
GDEPKVIQNPEGARTTPS

SEQ ID NO: 1911111 - protein, 18 aa, Staphylococcus
GDLSENSEYDAAKDEQGF

SEQ ID NO: 1911112 - protein, 14 aa, Staphylococcus
GDSAGGSAKLGRDR

SEQ ID NO: 1911113 - protein, 8 aa, Staphylococcus
GDSDNDRA

SEQ ID NO: 1911114 - protein, 4 aa, Staphylococcus
GDSR

SEQ ID NO: 1911115 - protein, 6 aa, Staphylococcus
GEEVGN

SEQ ID NO: 1911116 - protein, 11 aa, Staphylococcus
GENISRPSVPE

SEQ ID NO: 1911117 - protein, 7 aa, Staphylococcus
GERGSGK

SEQ ID NO: 1911118 - protein, 8 aa, Staphylococcus
GESASDEL

SEQ ID NO: 1911119 - protein, 7 aa, Staphylococcus
GEVIAPD

SEQ ID NO: 1911120 - protein, 6 aa, Staphylococcus
GEVTNE

SEQ ID NO: 1911121 - protein, 6 aa, Staphylococcus
GGEKQR

SEQ ID NO: 1911122 - protein, 4 aa, Staphylococcus
GGES

SEQ ID NO: 1911123 - protein, 8 aa, Staphylococcus
GGKGRRAN

SEQ ID NO: 1911124 - protein, 4 aa, Staphylococcus
GGNE

SEQ ID NO: 1911125 - protein, 7 aa, Staphylococcus
GGNNDIN

SEQ ID NO: 1911126 - protein, 10 aa, Staphylococcus
GGPASGSAAI

SEQ ID NO: 1911127 - protein, 9 aa, Staphylococcus
GGPGTGKTT

SEQ ID NO: 1911128 - protein, 10 aa, Staphylococcus
GGRCEACKGD

SEQ ID NO: 1911129 - protein, 9 aa, Staphylococcus
GGRISKTKG

SEQ ID NO: 1911130 - protein, 11 aa, Staphylococcus
GGRNEEFEGER

SEQ ID NO: 1911131 - protein, 4 aa, Staphylococcus
GGRY

SEQ ID NO: 1911132 - protein, 8 aa, Staphylococcus
GGSHSDAP

SEQ ID NO: 1911133 - protein, 11 aa, Staphylococcus
GGSQGRDRSTA

SEQ ID NO: 1911134 - protein, 5 aa, Staphylococcus
GGSRI

SEQ ID NO: 1911135 - protein, 9 aa, Staphylococcus
GGTAEEEAA

SEQ ID NO: 1911136 - protein, 4 aa, Staphylococcus
GHKD

SEQ ID NO: 1911137 - protein, 10 aa, Staphylococcus
GHNGSGKSTI

SEQ ID NO: 1911138 - protein, 8 aa, Staphylococcus
GHSNGKQL

SEQ ID NO: 1911139 - protein, 8 aa, Staphylococcus
GIAGSYAE

SEQ ID NO: 1911140 - protein, 5 aa, Staphylococcus
GIDDA

SEQ ID NO: 1911141 - protein, 5 aa, Staphylococcus
GIGPE

SEQ ID NO: 1911142 - protein, 8 aa, Staphylococcus
GIGSPKDA

SEQ ID NO: 1911143 - protein, 5 aa, Staphylococcus
GIGTS

SEQ ID NO: 1911144 - protein, 5 aa, Staphylococcus
GIPLT

SEQ ID NO: 1911145 - protein, 8 aa, Staphylococcus
GKDQDQVK

SEQ ID NO: 1911146 - protein, 18 aa, Staphylococcus
GKFGGGGYKVSGGLHGVG

SEQ ID NO: 1911147 - protein, 7 aa, Staphylococcus
GKGNKER

SEQ ID NO: 1911148 - protein, 5 aa, Staphylococcus
GKHAF

SEQ ID NO: 1911149 - protein, 17 aa, Staphylococcus
GKLDGGAQRVPVATGSL

SEQ ID NO: 1911150 - protein, 12 aa, Staphylococcus
GKPVLDREGEHN

SEQ ID NO: 1911151 - protein, 7 aa, Staphylococcus
GKTTDQL

SEQ ID NO: 1911152 - protein, 4 aa, Staphylococcus
GKVT

SEQ ID NO: 1911153 - protein, 5 aa, Staphylococcus
GLGEM

SEQ ID NO: 1911154 - protein, 5 aa, Staphylococcus
GLGPK

SEQ ID NO: 1911155 - protein, 4 aa, Staphylococcus
GLHP

SEQ ID NO: 1911156 - protein, 5 aa, Staphylococcus
GLSKA

SEQ ID NO: 1911157 - protein, 10 aa, Staphylococcus
GNGLKDPDTA

SEQ ID NO: 1911158 - protein, 8 aa, Staphylococcus
GNGQLNSQ

SEQ ID NO: 1911159 - protein, 8 aa, Staphylococcus
GNQFPEGV

SEQ ID NO: 1911160 - protein, 6 aa, Staphylococcus
GNRNFE

SEQ ID NO: 1911161 - protein, 4 aa, Staphylococcus
GNYA

SEQ ID NO: 1911162 - protein, 11 aa, Staphylococcus
GPGRGSSAGSL

SEQ ID NO: 1911163 - protein, 9 aa, Staphylococcus
GPNGAGKTT

SEQ ID NO: 1911164 - protein, 5 aa, Staphylococcus
GPTHE

SEQ ID NO: 1911165 - protein, 15 aa, Staphylococcus
GQGNFGSMDGDGAAA

SEQ ID NO: 1911166 - protein, 5 aa, Staphylococcus
GQSTV

SEQ ID NO: 1911167 - protein, 9 aa, Staphylococcus
GQSVERGEV

SEQ ID NO: 1911168 - protein, 4 aa, Staphylococcus
GQYV

SEQ ID NO: 1911169 - protein, 9 aa, Staphylococcus
GRGTSTYDG

SEQ ID NO: 1911170 - protein, 7 aa, Staphylococcus
GRHGNKG

SEQ ID NO: 1911171 - protein, 12 aa, Staphylococcus
GRLTDSKGRSVD

SEQ ID NO: 1911172 - protein, 11 aa, Staphylococcus
GRPSTYAPTID

SEQ ID NO: 1911173 - protein, 9 aa, Staphylococcus
GRSGSGKTT

SEQ ID NO: 1911174 - protein, 9 aa, Staphylococcus
GRSQPEYRK

SEQ ID NO: 1911175 - protein, 13 aa, Staphylococcus
GSAGAGSKPNPLL

SEQ ID NO: 1911176 - protein, 4 aa, Staphylococcus
GSFK

SEQ ID NO: 1911177 - protein, 14 aa, Staphylococcus
GSGGNYALSAGRAL

SEQ ID NO: 1911178 - protein, 6 aa, Staphylococcus
GSGIGD

SEQ ID NO: 1911179 - protein, 11 aa, Staphylococcus
GSGSGKTTVTN

SEQ ID NO: 1911180 - protein, 5 aa, Staphylococcus
GSNFE

SEQ ID NO: 1911181 - protein, 16 aa, Staphylococcus
GSQGHAHAQNLKDNGY

SEQ ID NO: 1911182 - protein, 10 aa, Staphylococcus
GSVNNPETSS

SEQ ID NO: 1911183 - protein, 6 aa, Staphylococcus
GTANWT

SEQ ID NO: 1911184 - protein, 8 aa, Staphylococcus
GTCPSSTI

SEQ ID NO: 1911185 - protein, 5 aa, Staphylococcus
GTGTS

SEQ ID NO: 1911186 - protein, 10 aa, Staphylococcus
GTIDDPLDET

SEQ ID NO: 1911187 - protein, 9 aa, Staphylococcus
GTKNTSVKV

SEQ ID NO: 1911188 - protein, 7 aa, Staphylococcus
GTPGYEE

SEQ ID NO: 1911189 - protein, 5 aa, Staphylococcus
GTQAE

SEQ ID NO: 1911190 - protein, 5 aa, Staphylococcus
GTQDR

SEQ ID NO: 1911191 - protein, 6 aa, Staphylococcus
GTQTNQ

SEQ ID NO: 1911192 - protein, 4 aa, Staphylococcus
GTVA

SEQ ID NO: 1911193 - protein, 4 aa, Staphylococcus
GTWY

SEQ ID NO: 1911194 - protein, 7 aa, Staphylococcus
GVGPYTQ

SEQ ID NO: 1911195 - protein, 11 aa, Staphylococcus
GVKGSTKQAVE

SEQ ID NO: 1911196 - protein, 10 aa, Staphylococcus
GWTGGKYGVG

SEQ ID NO: 1911197 - protein, 7 aa, Staphylococcus
GYDQPAL

SEQ ID NO: 1911198 - protein, 5 aa, Staphylococcus
GYRGA

SEQ ID NO: 1911199 - protein, 5 aa, Staphylococcus
GYVSD

SEQ ID NO: 1911200 - protein, 5 aa, Staphylococcus
HACGT

SEQ ID NO: 1911201 - protein, 9 aa, Staphylococcus
HARSQRRKH

SEQ ID NO: 1911202 - protein, 7 aa, Staphylococcus
HDTSGNG

SEQ ID NO: 1911203 - protein, 10 aa, Staphylococcus
HETDTGSPEV

SEQ ID NO: 1911204 - protein, 8 aa, Staphylococcus
HKAQSKDI

SEQ ID NO: 1911205 - protein, 9 aa, Staphylococcus
HKKDHHSRR

SEQ ID NO: 1911206 - protein, 4 aa, Staphylococcus
HKKK

SEQ ID NO: 1911207 - protein, 7 aa, Staphylococcus
HNRENDL

SEQ ID NO: 1911208 - protein, 5 aa, Staphylococcus
HSTLR

SEQ ID NO: 1911209 - protein, 8 aa, Staphylococcus
HTDEETGQ

SEQ ID NO: 1911210 - protein, 4 aa, Staphylococcus
HTNG

SEQ ID NO: 1911211 - protein, 8 aa, Staphylococcus
HTNGQGKA

SEQ ID NO: 1911212 - protein, 10 aa, Staphylococcus
HVTTDAGTGC

SEQ ID NO: 1911213 - protein, 6 aa, Staphylococcus
HYPDTT

SEQ ID NO: 1911214 - protein, 5 aa, Staphylococcus
IADEV

SEQ ID NO: 1911215 - protein, 17 aa, Staphylococcus
IANSGYTSRRKAETLIT

SEQ ID NO: 1911216 - protein, 8 aa, Staphylococcus
IDDEGKLN

SEQ ID NO: 1911217 - protein, 6 aa, Staphylococcus
IDKAEK

SEQ ID NO: 1911218 - protein, 5 aa, Staphylococcus
IDSPV

SEQ ID NO: 1911219 - protein, 5 aa, Staphylococcus
IEEPG

SEQ ID NO: 1911220 - protein, 5 aa, Staphylococcus
IEGTP

SEQ ID NO: 1911221 - protein, 10 aa, Staphylococcus
IEHGDANEGV

SEQ ID NO: 1911222 - protein, 9 aa, Staphylococcus
IEQKKKGIE

SEQ ID NO: 1911223 - protein, 5 aa, Staphylococcus
IESND

SEQ ID NO: 1911224 - protein, 12 aa, Staphylococcus
IETGQLAKQANG

SEQ ID NO: 1911225 - protein, 12 aa, Staphylococcus
IETTEARAKEVR

SEQ ID NO: 1911226 - protein, 6 aa, Staphylococcus
IGHETN

SEQ ID NO: 1911227 - protein, 11 aa, Staphylococcus
IGPNGAGKSTL

SEQ ID NO: 1911228 - protein, 9 aa, Staphylococcus
IGPTGSGKT

SEQ ID NO: 1911229 - protein, 7 aa, Staphylococcus
IGQPVNG

SEQ ID NO: 1911230 - protein, 6 aa, Staphylococcus
IGSETA

SEQ ID NO: 1911231 - protein, 7 aa, Staphylococcus
IIESGGQ

SEQ ID NO: 1911232 - protein, 9 aa, Staphylococcus
IMPGGSQEM

SEQ ID NO: 1911233 - protein, 10 aa, Staphylococcus
INAKDKAEIE

SEQ ID NO: 1911234 - protein, 7 aa, Staphylococcus
INQPEND

SEQ ID NO: 1911235 - protein, 8 aa, Staphylococcus
INTPKQLP

SEQ ID NO: 1911236 - protein, 9 aa, Staphylococcus
IPANTGNIA

SEQ ID NO: 1911237 - protein, 9 aa, Staphylococcus
IPPAPRGVP

SEQ ID NO: 1911238 - protein, 11 aa, Staphylococcus
IPTPERDSDKP

SEQ ID NO: 1911239 - protein, 18 aa, Staphylococcus
IPVSAGLAGGSADAAATM

SEQ ID NO: 1911240 - protein, 8 aa, Staphylococcus
IPYSSRNP

SEQ ID NO: 1911241 - protein, 5 aa, Staphylococcus
IRSDK

SEQ ID NO: 1911242 - protein, 6 aa, Staphylococcus
ITGGEP

SEQ ID NO: 1911243 - protein, 9 aa, Staphylococcus
ITPDGTELE

SEQ ID NO: 1911244 - protein, 9 aa, Staphylococcus
ITQKGNART

SEQ ID NO: 1911245 - protein, 5 aa, Staphylococcus
IYEKR

SEQ ID NO: 1911246 - protein, 7 aa, Staphylococcus
KAIRTND

SEQ ID NO: 1911247 - protein, 9 aa, Staphylococcus
KAKGARSNI

SEQ ID NO: 1911248 - protein, 6 aa, Staphylococcus
KCRPIE

SEQ ID NO: 1911249 - protein, 5 aa, Staphylococcus
KDEEV

SEQ ID NO: 1911250 - protein, 4 aa, Staphylococcus
KDEL

SEQ ID NO: 1911251 - protein, 7 aa, Staphylococcus
KDGPDRI

SEQ ID NO: 1911252 - protein, 5 aa, Staphylococcus
KDKTD

SEQ ID NO: 1911253 - protein, 7 aa, Staphylococcus
KDSALER

SEQ ID NO: 1911254 - protein, 8 aa, Staphylococcus
KEANKDGY

SEQ ID NO: 1911255 - protein, 6 aa, Staphylococcus
KEERFH

SEQ ID NO: 1911256 - protein, 8 aa, Staphylococcus
KEGQIAGP

SEQ ID NO: 1911257 - protein, 5 aa, Staphylococcus
KEGTE

SEQ ID NO: 1911258 - protein, 8 aa, Staphylococcus
KEKGVYKG

SEQ ID NO: 1911259 - protein, 4 aa, Staphylococcus
KEKT

SEQ ID NO: 1911260 - protein, 6 aa, Staphylococcus
KEKVDP

SEQ ID NO: 1911261 - protein, 5 aa, Staphylococcus
KELGD

SEQ ID NO: 1911262 - protein, 7 aa, Staphylococcus
KENGYAV

SEQ ID NO: 1911263 - protein, 6 aa, Staphylococcus
KESINK

SEQ ID NO: 1911264 - protein, 13 aa, Staphylococcus
KEVEGTIRVHTVE

SEQ ID NO: 1911265 - protein, 5 aa, Staphylococcus
KFKGA

SEQ ID NO: 1911266 - protein, 8 aa, Staphylococcus
KGDEARSI

SEQ ID NO: 1911267 - protein, 4 aa, Staphylococcus
KGGN

SEQ ID NO: 1911268 - protein, 8 aa, Staphylococcus
KGIGATRA

SEQ ID NO: 1911269 - protein, 8 aa, Staphylococcus
KGIGKGVG

SEQ ID NO: 1911270 - protein, 12 aa, Staphylococcus
KGKKGEVKDVPV

SEQ ID NO: 1911271 - protein, 6 aa, Staphylococcus
KGKQVK

SEQ ID NO: 1911272 - protein, 7 aa, Staphylococcus
KGKVPRP

SEQ ID NO: 1911273 - protein, 5 aa, Staphylococcus
KGLRT

SEQ ID NO: 1911274 - protein, 9 aa, Staphylococcus
KGPNGEQVK

SEQ ID NO: 1911275 - protein, 7 aa, Staphylococcus
KGSPQIR

SEQ ID NO: 1911276 - protein, 9 aa, Staphylococcus
KGTGPRYCP

SEQ ID NO: 1911277 - protein, 8 aa, Staphylococcus
KGTRMKSK

SEQ ID NO: 1911278 - protein, 5 aa, Staphylococcus
KGVPQ

SEQ ID NO: 1911279 - protein, 20 aa, Staphylococcus
KGYTSYAPQYEGHAAPPEEI

SEQ ID NO: 1911280 - protein, 5 aa, Staphylococcus
KKPNI

SEQ ID NO: 1911281 - protein, 7 aa, Staphylococcus
KKTKSRL

SEQ ID NO: 1911282 - protein, 7 aa, Staphylococcus
KMEEGSL

SEQ ID NO: 1911283 - protein, 10 aa, Staphylococcus
KNASDNATEL

SEQ ID NO: 1911284 - protein, 9 aa, Staphylococcus
KNEKNFQPM

SEQ ID NO: 1911285 - protein, 8 aa, Staphylococcus
KNPAGMNA

SEQ ID NO: 1911286 - protein, 4 aa, Staphylococcus
KNSV

SEQ ID NO: 1911287 - protein, 7 aa, Staphylococcus
KPEDSWD

SEQ ID NO: 1911288 - protein, 5 aa, Staphylococcus
KPIDR

SEQ ID NO: 1911289 - protein, 8 aa, Staphylococcus
KPNVGKSS

SEQ ID NO: 1911290 - protein, 6 aa, Staphylococcus
KPPSVS

SEQ ID NO: 1911291 - protein, 7 aa, Staphylococcus
KPRSGYY

SEQ ID NO: 1911292 - protein, 7 aa, Staphylococcus
KPRTDYK

SEQ ID NO: 1911293 - protein, 8 aa, Staphylococcus
KQESKDGT

SEQ ID NO: 1911294 - protein, 5 aa, Staphylococcus
KQPAS

SEQ ID NO: 1911295 - protein, 8 aa, Staphylococcus
KQPNKEHM

SEQ ID NO: 1911296 - protein, 6 aa, Staphylococcus
KQRDRS

SEQ ID NO: 1911297 - protein, 7 aa, Staphylococcus
KREGQGC

SEQ ID NO: 1911298 - protein, 7 aa, Staphylococcus
KRQNPSP

SEQ ID NO: 1911299 - protein, 7 aa, Staphylococcus
KRRGKVR

SEQ ID NO: 1911300 - protein, 16 aa, Staphylococcus
KRVKRTGSGQLKRSRA

SEQ ID NO: 1911301 - protein, 6 aa, Staphylococcus
KSAYES

SEQ ID NO: 1911302 - protein, 6 aa, Staphylococcus
KSGDIE

SEQ ID NO: 1911303 - protein, 6 aa, Staphylococcus
KSGYEA

SEQ ID NO: 1911304 - protein, 7 aa, Staphylococcus
KSKEEYE

SEQ ID NO: 1911305 - protein, 6 aa, Staphylococcus
KSKPEL

SEQ ID NO: 1911306 - protein, 5 aa, Staphylococcus
KSNAL

SEQ ID NO: 1911307 - protein, 5 aa, Staphylococcus
KSSYM

SEQ ID NO: 1911308 - protein, 5 aa, Staphylococcus
KTAEV

SEQ ID NO: 1911309 - protein, 7 aa, Staphylococcus
KTELQND

SEQ ID NO: 1911310 - protein, 4 aa, Staphylococcus
KTGE

SEQ ID NO: 1911311 - protein, 12 aa, Staphylococcus
KTGYDVNAKGRL

SEQ ID NO: 1911312 - protein, 5 aa, Staphylococcus
KTTSL

SEQ ID NO: 1911313 - protein, 5 aa, Staphylococcus
KTYSV

SEQ ID NO: 1911314 - protein, 6 aa, Staphylococcus
KVGDEA

SEQ ID NO: 1911315 - protein, 8 aa, Staphylococcus
KVKPGSTV

SEQ ID NO: 1911316 - protein, 8 aa, Staphylococcus
KVKQTNSY

SEQ ID NO: 1911317 - protein, 6 aa, Staphylococcus
KVTEDF

SEQ ID NO: 1911318 - protein, 8 aa, Staphylococcus
KYAAKDPT

SEQ ID NO: 1911319 - protein, 8 aa, Staphylococcus
KYAPSESK

SEQ ID NO: 1911320 - protein, 10 aa, Staphylococcus
KYPTTQIEAS

SEQ ID NO: 1911321 - protein, 7 aa, Staphylococcus
KYSSGMR

SEQ ID NO: 1911322 - protein, 9 aa, Staphylococcus
LASKTTDDI

SEQ ID NO: 1911323 - protein, 6 aa, Staphylococcus
LASRGI

SEQ ID NO: 1911324 - protein, 12 aa, Staphylococcus
LATDGYESARET

SEQ ID NO: 1911325 - protein, 5 aa, Staphylococcus
LDDKA

SEQ ID NO: 1911326 - protein, 8 aa, Staphylococcus
LDDPDRYQ

SEQ ID NO: 1911327 - protein, 4 aa, Staphylococcus
LDGE

SEQ ID NO: 1911328 - protein, 10 aa, Staphylococcus
LDKSRGPAAS

SEQ ID NO: 1911329 - protein, 22 aa, Staphylococcus
LDTSGVDGRRQGRSLYGTKKPK

SEQ ID NO: 1911330 - protein, 13 aa, Staphylococcus
LEDKEDEKQGEVS

SEQ ID NO: 1911331 - protein, 4 aa, Staphylococcus
LEKP

SEQ ID NO: 1911332 - protein, 6 aa, Staphylococcus
LETEDY

SEQ ID NO: 1911333 - protein, 9 aa, Staphylococcus
LETGKEKRD

SEQ ID NO: 1911334 - protein, 7 aa, Staphylococcus
LGAQPPF

SEQ ID NO: 1911335 - protein, 4 aa, Staphylococcus
LGEN

SEQ ID NO: 1911336 - protein, 6 aa, Staphylococcus
LGGKSA

SEQ ID NO: 1911337 - protein, 7 aa, Staphylococcus
LGGQPQL

SEQ ID NO: 1911338 - protein, 11 aa, Staphylococcus
LGNDAGITGAA

SEQ ID NO: 1911339 - protein, 4 aa, Staphylococcus
LGRN

SEQ ID NO: 1911340 - protein, 6 aa, Staphylococcus
LKEASV

SEQ ID NO: 1911341 - protein, 5 aa, Staphylococcus
LKGGQ

SEQ ID NO: 1911342 - protein, 9 aa, Staphylococcus
LKRTTVSRK

SEQ ID NO: 1911343 - protein, 8 aa, Staphylococcus
LNEPERVA

SEQ ID NO: 1911344 - protein, 7 aa, Staphylococcus
LNPDEGR

SEQ ID NO: 1911345 - protein, 6 aa, Staphylococcus
LNQNDK

SEQ ID NO: 1911346 - protein, 9 aa, Staphylococcus
LNSTRAAVE

SEQ ID NO: 1911347 - protein, 7 aa, Staphylococcus
LPASNIK

SEQ ID NO: 1911348 - protein, 10 aa, Staphylococcus
LPASPGAATG

SEQ ID NO: 1911349 - protein, 5 aa, Staphylococcus
LPDGR

SEQ ID NO: 1911350 - protein, 4 aa, Staphylococcus
LPDR

SEQ ID NO: 1911351 - protein, 9 aa, Staphylococcus
LPGDEAGVK

SEQ ID NO: 1911352 - protein, 10 aa, Staphylococcus
LPHPGFPTDM

SEQ ID NO: 1911353 - protein, 11 aa, Staphylococcus
LPRDSSPTRLT

SEQ ID NO: 1911354 - protein, 10 aa, Staphylococcus
LPTKERNTQA

SEQ ID NO: 1911355 - protein, 6 aa, Staphylococcus
LREAET

SEQ ID NO: 1911356 - protein, 5 aa, Staphylococcus
LREEP

SEQ ID NO: 1911357 - protein, 5 aa, Staphylococcus
LRPLP

SEQ ID NO: 1911358 - protein, 29 aa, Staphylococcus
LSGTGKELEKRPYAPGQHGPNQRKKLSEY

SEQ ID NO: 1911359 - protein, 9 aa, Staphylococcus
LSKEKEPQI

SEQ ID NO: 1911360 - protein, 8 aa, Staphylococcus
LSPSAKAT

SEQ ID NO: 1911361 - protein, 6 aa, Staphylococcus
LTGGVE

SEQ ID NO: 1911362 - protein, 10 aa, Staphylococcus
LTNTNARIEP

SEQ ID NO: 1911363 - protein, 10 aa, Staphylococcus
LVTESDGRTW

SEQ ID NO: 1911364 - protein, 9 aa, Staphylococcus
MDKSSSTGQ

SEQ ID NO: 1911365 - protein, 4 aa, Staphylococcus
MEET

SEQ ID NO: 1911366 - protein, 5 aa, Staphylococcus
MKEEP

SEQ ID NO: 1911367 - protein, 8 aa, Staphylococcus
MPPGESGL

SEQ ID NO: 1911368 - protein, 8 aa, Staphylococcus
NAAKEPEV

SEQ ID NO: 1911369 - protein, 10 aa, Staphylococcus
NAISKGKQSH

SEQ ID NO: 1911370 - protein, 9 aa, Staphylococcus
NAKREEGQE

SEQ ID NO: 1911371 - protein, 5 aa, Staphylococcus
NAMPG

SEQ ID NO: 1911372 - protein, 11 aa, Staphylococcus
NAPEEKERGIT

SEQ ID NO: 1911373 - protein, 23 aa, Staphylococcus
NASVAGATGGCQAEVGSASAMAA

SEQ ID NO: 1911374 - protein, 13 aa, Staphylococcus
NATPGGVVKKGDV

SEQ ID NO: 1911375 - protein, 11 aa, Staphylococcus
NAVGYKNYPDN

SEQ ID NO: 1911376 - protein, 5 aa, Staphylococcus
NDPHK

SEQ ID NO: 1911377 - protein, 9 aa, Staphylococcus
NDPIDQRER

SEQ ID NO: 1911378 - protein, 4 aa, Staphylococcus
NDVT

SEQ ID NO: 1911379 - protein, 18 aa, Staphylococcus
NDYGMGSSRDWAAKGTNL

SEQ ID NO: 1911380 - protein, 4 aa, Staphylococcus
NEEE

SEQ ID NO: 1911381 - protein, 5 aa, Staphylococcus
NEESI

SEQ ID NO: 1911382 - protein, 26 aa, Staphylococcus
NEYDDTDKIFSNPSDKQTEDYISGRF

SEQ ID NO: 1911383 - protein, 7 aa, Staphylococcus
NGDKKTS

SEQ ID NO: 1911384 - protein, 7 aa, Staphylococcus
NGKSKIK

SEQ ID NO: 1911385 - protein, 12 aa, Staphylococcus
NGRWAKKRKMPR

SEQ ID NO: 1911386 - protein, 7 aa, Staphylococcus
NGSSGEN

SEQ ID NO: 1911387 - protein, 7 aa, Staphylococcus
NGTATDY

SEQ ID NO: 1911388 - protein, 6 aa, Staphylococcus
NGYTLG

SEQ ID NO: 1911389 - protein, 7 aa, Staphylococcus
NHETGKE

SEQ ID NO: 1911390 - protein, 4 aa, Staphylococcus
NHRG

SEQ ID NO: 1911391 - protein, 6 aa, Staphylococcus
NIPGNG

SEQ ID NO: 1911392 - protein, 6 aa, Staphylococcus
NIPPHN

SEQ ID NO: 1911393 - protein, 13 aa, Staphylococcus
NITSKGGTTQAGL

SEQ ID NO: 1911394 - protein, 7 aa, Staphylococcus
NKASSPV

SEQ ID NO: 1911395 - protein, 7 aa, Staphylococcus
NKHQGRD

SEQ ID NO: 1911396 - protein, 4 aa, Staphylococcus
NKKP

SEQ ID NO: 1911397 - protein, 6 aa, Staphylococcus
NKNFGV

SEQ ID NO: 1911398 - protein, 6 aa, Staphylococcus
NKVTAK

SEQ ID NO: 1911399 - protein, 11 aa, Staphylococcus
NKVTYTPHVDT

SEQ ID NO: 1911400 - protein, 5 aa, Staphylococcus
NLSEP

SEQ ID NO: 1911401 - protein, 4 aa, Staphylococcus
NNAG

SEQ ID NO: 1911402 - protein, 8 aa, Staphylococcus
NNEPGEIT

SEQ ID NO: 1911403 - protein, 8 aa, Staphylococcus
NNERQVQS

SEQ ID NO: 1911404 - protein, 8 aa, Staphylococcus
NNNNGARF

SEQ ID NO: 1911405 - protein, 7 aa, Staphylococcus
NNPTCGD

SEQ ID NO: 1911406 - protein, 4 aa, Staphylococcus
NPGL

SEQ ID NO: 1911407 - protein, 6 aa, Staphylococcus
NPIPGD

SEQ ID NO: 1911408 - protein, 8 aa, Staphylococcus
NPRSSRTV

SEQ ID NO: 1911409 - protein, 4 aa, Staphylococcus
NPSL

SEQ ID NO: 1911410 - protein, 9 aa, Staphylococcus
NQGTAEVPE

SEQ ID NO: 1911411 - protein, 5 aa, Staphylococcus
NQPGI

SEQ ID NO: 1911412 - protein, 9 aa, Staphylococcus
NQTKYDGTP

SEQ ID NO: 1911413 - protein, 6 aa, Staphylococcus
NSDGAV

SEQ ID NO: 1911414 - protein, 4 aa, Staphylococcus
NSGG

SEQ ID NO: 1911415 - protein, 9 aa, Staphylococcus
NSNIQGVDP

SEQ ID NO: 1911416 - protein, 5 aa, Staphylococcus
NSPGF

SEQ ID NO: 1911417 - protein, 8 aa, Staphylococcus
NTNENYTG

SEQ ID NO: 1911418 - protein, 8 aa, Staphylococcus
NTNPKPWD

SEQ ID NO: 1911419 - protein, 7 aa, Staphylococcus
NTTKPEV

SEQ ID NO: 1911420 - protein, 7 aa, Staphylococcus
NVGEKGD

SEQ ID NO: 1911421 - protein, 7 aa, Staphylococcus
NVGGLPE

SEQ ID NO: 1911422 - protein, 5 aa, Staphylococcus
NVGKS

SEQ ID NO: 1911423 - protein, 6 aa, Staphylococcus
PAEQRQ

SEQ ID NO: 1911424 - protein, 5 aa, Staphylococcus
PAQQK

SEQ ID NO: 1911425 - protein, 4 aa, Staphylococcus
PDAE

SEQ ID NO: 1911426 - protein, 4 aa, Staphylococcus
PDFP

SEQ ID NO: 1911427 - protein, 5 aa, Staphylococcus
PDGKV

SEQ ID NO: 1911428 - protein, 6 aa, Staphylococcus
PDQVPE

SEQ ID NO: 1911429 - protein, 11 aa, Staphylococcus
PEARPGPSDSN

SEQ ID NO: 1911430 - protein, 11 aa, Staphylococcus
PFDSSGRRHTS

SEQ ID NO: 1911431 - protein, 15 aa, Staphylococcus
PFGGPAGGDGGKGAS

SEQ ID NO: 1911432 - protein, 4 aa, Staphylococcus
PGAK

SEQ ID NO: 1911433 - protein, 4 aa, Staphylococcus
PGAR

SEQ ID NO: 1911434 - protein, 9 aa, Staphylococcus
PGDEEESYQ

SEQ ID NO: 1911435 - protein, 5 aa, Staphylococcus
PGDSI

SEQ ID NO: 1911436 - protein, 7 aa, Staphylococcus
PKRSKAV

SEQ ID NO: 1911437 - protein, 10 aa, Staphylococcus
PLTTPIGGGI

SEQ ID NO: 1911438 - protein, 5 aa, Staphylococcus
PMGEG

SEQ ID NO: 1911439 - protein, 9 aa, Staphylococcus
PNAAPLPGK

SEQ ID NO: 1911440 - protein, 5 aa, Staphylococcus
PNCST

SEQ ID NO: 1911441 - protein, 10 aa, Staphylococcus
PNDEEGRTTT

SEQ ID NO: 1911442 - protein, 4 aa, Staphylococcus
PNEG

SEQ ID NO: 1911443 - protein, 5 aa, Staphylococcus
PNGVG

SEQ ID NO: 1911444 - protein, 17 aa, Staphylococcus
PNKLKGAPKSVRGDRRG

SEQ ID NO: 1911445 - protein, 8 aa, Staphylococcus
PNNPTGTY

SEQ ID NO: 1911446 - protein, 7 aa, Staphylococcus
PNVEAGQ

SEQ ID NO: 1911447 - protein, 8 aa, Staphylococcus
PPGLGKTT

SEQ ID NO: 1911448 - protein, 7 aa, Staphylococcus
PPIRAGK

SEQ ID NO: 1911449 - protein, 8 aa, Staphylococcus
PPRKGCDE

SEQ ID NO: 1911450 - protein, 4 aa, Staphylococcus
PQFN

SEQ ID NO: 1911451 - protein, 5 aa, Staphylococcus
PSKDE

SEQ ID NO: 1911452 - protein, 16 aa, Staphylococcus
PSNGERYLSTPLYSFD

SEQ ID NO: 1911453 - protein, 6 aa, Staphylococcus
PTKEPF

SEQ ID NO: 1911454 - protein, 9 aa, Staphylococcus
PTSALDPEV

SEQ ID NO: 1911455 - protein, 10 aa, Staphylococcus
PTTFNNPRRM

SEQ ID NO: 1911456 - protein, 5 aa, Staphylococcus
PTYGR

SEQ ID NO: 1911457 - protein, 5 aa, Staphylococcus
PTYQR

SEQ ID NO: 1911458 - protein, 11 aa, Staphylococcus
PVASLDPLTTK

SEQ ID NO: 1911459 - protein, 5 aa, Staphylococcus
PVPES

SEQ ID NO: 1911460 - protein, 5 aa, Staphylococcus
QAPEN

SEQ ID NO: 1911461 - protein, 6 aa, Staphylococcus
QDNNMK

SEQ ID NO: 1911462 - protein, 6 aa, Staphylococcus
QDPGNL

SEQ ID NO: 1911463 - protein, 16 aa, Staphylococcus
QDPTKKMSKSDDNQKN

SEQ ID NO: 1911464 - protein, 6 aa, Staphylococcus
QDSEKD

SEQ ID NO: 1911465 - protein, 6 aa, Staphylococcus
QGDGGL

SEQ ID NO: 1911466 - protein, 5 aa, Staphylococcus
QGKEI

SEQ ID NO: 1911467 - protein, 7 aa, Staphylococcus
QGPDFPT

SEQ ID NO: 1911468 - protein, 13 aa, Staphylococcus
QKMPGRMGGNTVT

SEQ ID NO: 1911469 - protein, 10 aa, Staphylococcus
QLAPGTEGGF

SEQ ID NO: 1911470 - protein, 8 aa, Staphylococcus
QMTERDLE

SEQ ID NO: 1911471 - protein, 8 aa, Staphylococcus
QNVRTNYE

SEQ ID NO: 1911472 - protein, 12 aa, Staphylococcus
QPGVGKTLSSRY

SEQ ID NO: 1911473 - protein, 6 aa, Staphylococcus
QPYEGG

SEQ ID NO: 1911474 - protein, 14 aa, Staphylococcus
QQATTLSGGEAQRV

SEQ ID NO: 1911475 - protein, 9 aa, Staphylococcus
QQDDNYDLT

SEQ ID NO: 1911476 - protein, 8 aa, Staphylococcus
QRVQEAAK

SEQ ID NO: 1911477 - protein, 5 aa, Staphylococcus
QTDGR

SEQ ID NO: 1911478 - protein, 5 aa, Staphylococcus
QTEAY

SEQ ID NO: 1911479 - protein, 7 aa, Staphylococcus
QTTTSEI

SEQ ID NO: 1911480 - protein, 8 aa, Staphylococcus
RAEERHDD

SEQ ID NO: 1911481 - protein, 5 aa, Staphylococcus
RAHNL

SEQ ID NO: 1911482 - protein, 7 aa, Staphylococcus
RARDDQN

SEQ ID NO: 1911483 - protein, 7 aa, Staphylococcus
RAYEDLE

SEQ ID NO: 1911484 - protein, 6 aa, Staphylococcus
RDDSLD

SEQ ID NO: 1911485 - protein, 4 aa, Staphylococcus
RDSM

SEQ ID NO: 1911486 - protein, 11 aa, Staphylococcus
RESGLGGADGI

SEQ ID NO: 1911487 - protein, 7 aa, Staphylococcus
RETDGTS

SEQ ID NO: 1911488 - protein, 6 aa, Staphylococcus
RFSDGE

SEQ ID NO: 1911489 - protein, 6 aa, Staphylococcus
RGGLGE

SEQ ID NO: 1911490 - protein, 4 aa, Staphylococcus
RGLT

SEQ ID NO: 1911491 - protein, 5 aa, Staphylococcus
RGLTS

SEQ ID NO: 1911492 - protein, 7 aa, Staphylococcus
RGYTGRN

SEQ ID NO: 1911493 - protein, 12 aa, Staphylococcus
RLGGNSRSTVGT

SEQ ID NO: 1911494 - protein, 5 aa, Staphylococcus
RNHTD

SEQ ID NO: 1911495 - protein, 5 aa, Staphylococcus
RNIKA

SEQ ID NO: 1911496 - protein, 5 aa, Staphylococcus
RNIPG

SEQ ID NO: 1911497 - protein, 10 aa, Staphylococcus
RPDPDAYGSQ

SEQ ID NO: 1911498 - protein, 5 aa, Staphylococcus
RPEDL

SEQ ID NO: 1911499 - protein, 7 aa, Staphylococcus
RPGKELE

SEQ ID NO: 1911500 - protein, 7 aa, Staphylococcus
RPSVGKT

SEQ ID NO: 1911501 - protein, 5 aa, Staphylococcus
RPTVR

SEQ ID NO: 1911502 - protein, 6 aa, Staphylococcus
RQNGST

SEQ ID NO: 1911503 - protein, 5 aa, Staphylococcus
RQVNR

SEQ ID NO: 1911504 - protein, 4 aa, Staphylococcus
RRPS

SEQ ID NO: 1911505 - protein, 6 aa, Staphylococcus
RSDEQL

SEQ ID NO: 1911506 - protein, 6 aa, Staphylococcus
RSEPHE

SEQ ID NO: 1911507 - protein, 8 aa, Staphylococcus
RSGESEYY

SEQ ID NO: 1911508 - protein, 11 aa, Staphylococcus
RSRDPEKVVEQ

SEQ ID NO: 1911509 - protein, 9 aa, Staphylococcus
RSTNVPGST

SEQ ID NO: 1911510 - protein, 6 aa, Staphylococcus
RTAGVT

SEQ ID NO: 1911511 - protein, 13 aa, Staphylococcus
RTAMNTPIQGSAA

SEQ ID NO: 1911512 - protein, 11 aa, Staphylococcus
RTATSGKNGAS

SEQ ID NO: 1911513 - protein, 4 aa, Staphylococcus
RTDF

SEQ ID NO: 1911514 - protein, 5 aa, Staphylococcus
RTDNM

SEQ ID NO: 1911515 - protein, 8 aa, Staphylococcus
SAADEEIG

SEQ ID NO: 1911516 - protein, 5 aa, Staphylococcus
SAHRT

SEQ ID NO: 1911517 - protein, 4 aa, Staphylococcus
SAQV

SEQ ID NO: 1911518 - protein, 9 aa, Staphylococcus
SCRSQMAEG

SEQ ID NO: 1911519 - protein, 8 aa, Staphylococcus
SDSQAMGR

SEQ ID NO: 1911520 - protein, 6 aa, Staphylococcus
SEDEQP

SEQ ID NO: 1911521 - protein, 6 aa, Staphylococcus
SEGPKR

SEQ ID NO: 1911522 - protein, 9 aa, Staphylococcus
SERTSAQAI

SEQ ID NO: 1911523 - protein, 4 aa, Staphylococcus
SETD

SEQ ID NO: 1911524 - protein, 7 aa, Staphylococcus
SETLGEE

SEQ ID NO: 1911525 - protein, 4 aa, Staphylococcus
SEWN

SEQ ID NO: 1911526 - protein, 6 aa, Staphylococcus
SFDGED

SEQ ID NO: 1911527 - protein, 13 aa, Staphylococcus
SFNDSNNDGIGDL

SEQ ID NO: 1911528 - protein, 8 aa, Staphylococcus
SGAGKSTL

SEQ ID NO: 1911529 - protein, 6 aa, Staphylococcus
SGAGPT

SEQ ID NO: 1911530 - protein, 10 aa, Staphylococcus
SGAISKSNTT

SEQ ID NO: 1911531 - protein, 7 aa, Staphylococcus
SGGKRVR

SEQ ID NO: 1911532 - protein, 7 aa, Staphylococcus
SGGNPAL

SEQ ID NO: 1911533 - protein, 10 aa, Staphylococcus
SGGPNSVYEE

SEQ ID NO: 1911534 - protein, 6 aa, Staphylococcus
SGNQYA

SEQ ID NO: 1911535 - protein, 18 aa, Staphylococcus
SGNTYDKNFRKSAKTVGD

SEQ ID NO: 1911536 - protein, 8 aa, Staphylococcus
SGRPTEGM

SEQ ID NO: 1911537 - protein, 4 aa, Staphylococcus
SGVI

SEQ ID NO: 1911538 - protein, 15 aa, Staphylococcus
SGYENKVKKNLEKRV

SEQ ID NO: 1911539 - protein, 8 aa, Staphylococcus
SHESGIHQ

SEQ ID NO: 1911540 - protein, 7 aa, Staphylococcus
SKAAHPN

SEQ ID NO: 1911541 - protein, 8 aa, Staphylococcus
SKAPTFEE

SEQ ID NO: 1911542 - protein, 10 aa, Staphylococcus
SKSGTTTEPA

SEQ ID NO: 1911543 - protein, 7 aa, Staphylococcus
SKSLKGL

SEQ ID NO: 1911544 - protein, 8 aa, Staphylococcus
SKTIDGEK

SEQ ID NO: 1911545 - protein, 10 aa, Staphylococcus
SLLGADDKAG

SEQ ID NO: 1911546 - protein, 42 aa, Staphylococcus; identical to SEQ ID NO: 1764254

SEQ ID NO: 1911547 - protein, 5 aa, Staphylococcus
SLTGA

SEQ ID NO: 1911548 - protein, 5 aa, Staphylococcus
SLTQN

SEQ ID NO: 1911549 - protein, 10 aa, Staphylococcus
SNNPKKFEGL

SEQ ID NO: 1911550 - protein, 9 aa, Staphylococcus
SPMNDNGYD

SEQ ID NO: 1911551 - protein, 13 aa, Staphylococcus
SQPGNPLNRSTLP

SEQ ID NO: 1911552 - protein, 6 aa, Staphylococcus
SQSNVS

SEQ ID NO: 1911553 - protein, 5 aa, Staphylococcus
SQVEA

SEQ ID NO: 1911554 - protein, 7 aa, Staphylococcus
SRNEENF

SEQ ID NO: 1911555 - protein, 7 aa, Staphylococcus
SSDDPVR

SEQ ID NO: 1911556 - protein, 8 aa, Staphylococcus
SSEASANL

SEQ ID NO: 1911557 - protein, 4 aa, Staphylococcus
SSGA

SEQ ID NO: 1911558 - protein, 6 aa, Staphylococcus
SSGHDS

SEQ ID NO: 1911559 - protein, 6 aa, Staphylococcus
SSPESF

SEQ ID NO: 1911560 - protein, 10 aa, Staphylococcus
SSPQLDVPER

SEQ ID NO: 1911561 - protein, 6 aa, Staphylococcus
SSSDTE

SEQ ID NO: 1911562 - protein, 7 aa, Staphylococcus
SSTHGKK

SEQ ID NO: 1911563 - protein, 12 aa, Staphylococcus
STAKQLSKIGGG

SEQ ID NO: 1911564 - protein, 4 aa, Staphylococcus
STDD

SEQ ID NO: 1911565 - protein, 12 aa, Staphylococcus
STDLQKSENEKH

SEQ ID NO: 1911566 - protein, 5 aa, Staphylococcus
STKSH

SEQ ID NO: 1911567 - protein, 8 aa, Staphylococcus
STPSESLT

SEQ ID NO: 1911568 - protein, 5 aa, Staphylococcus
SVGAT

SEQ ID NO: 1911569 - protein, 16 aa, Staphylococcus
SVRPPEPYKGKGIRYQ

SEQ ID NO: 1911570 - protein, 6 aa, Staphylococcus
SYNREG

SEQ ID NO: 1911571 - protein, 6 aa, Staphylococcus
SYSEKE

SEQ ID NO: 1911572 - protein, 19 aa, Staphylococcus
TAEELDQNSGQTPGIPTGY

SEQ ID NO: 1911573 - protein, 9 aa, Staphylococcus
TANGKRTSI

SEQ ID NO: 1911574 - protein, 17 aa, Staphylococcus
TARRGRVDGMEPRGNAQ

SEQ ID NO: 1911575 - protein, 9 aa, Staphylococcus
TASAAMGRT

SEQ ID NO: 1911576 - protein, 8 aa, Staphylococcus
TASAGPGL

SEQ ID NO: 1911577 - protein, 8 aa, Staphylococcus
TDEDHPTQ

SEQ ID NO: 1911578 - protein, 17 aa, Staphylococcus
TDGQALNLSKAESKIQI

SEQ ID NO: 1911579 - protein, 8 aa, Staphylococcus
TDHGSDFT

SEQ ID NO: 1911580 - protein, 7 aa, Staphylococcus
TDNVTED

SEQ ID NO: 1911581 - protein, 8 aa, Staphylococcus
TENATTAR

SEQ ID NO: 1911582 - protein, 5 aa, Staphylococcus
TGDLS

SEQ ID NO: 1911583 - protein, 6 aa, Staphylococcus
TGDMPF

SEQ ID NO: 1911584 - protein, 4 aa, Staphylococcus
TGEE

SEQ ID NO: 1911585 - protein, 7 aa, Staphylococcus
TGEVKEQ

SEQ ID NO: 1911586 - protein, 9 aa, Staphylococcus
TGGDSGIGR

SEQ ID NO: 1911587 - protein, 10 aa, Staphylococcus
TGGSEWTKQI

SEQ ID NO: 1911588 - protein, 10 aa, Staphylococcus
TGKGSESGDA

SEQ ID NO: 1911589 - protein, 5 aa, Staphylococcus
TGQDA

SEQ ID NO: 1911590 - protein, 4 aa, Staphylococcus
TGQK

SEQ ID NO: 1911591 - protein, 10 aa, Staphylococcus
TGSPASSPHL

SEQ ID NO: 1911592 - protein, 5 aa, Staphylococcus
TGSQR

SEQ ID NO: 1911593 - protein, 9 aa, Staphylococcus
TGSSPGHDL

SEQ ID NO: 1911594 - protein, 8 aa, Staphylococcus
TINTEYGK

SEQ ID NO: 1911595 - protein, 5 aa, Staphylococcus
TIPFD

SEQ ID NO: 1911596 - protein, 14 aa, Staphylococcus
TKDPEYRTTPSGVS

SEQ ID NO: 1911597 - protein, 8 aa, Staphylococcus
TKFEAGTP

SEQ ID NO: 1911598 - protein, 10 aa, Staphylococcus
TKGKEVERDG

SEQ ID NO: 1911599 - protein, 11 aa, Staphylococcus
TKGQTSPSSAV

SEQ ID NO: 1911600 - protein, 16 aa, Staphylococcus
TKIYPGENVGRGGDDT

SEQ ID NO: 1911601 - protein, 9 aa, Staphylococcus
TKPGVSKTS

SEQ ID NO: 1911602 - protein, 15 aa, Staphylococcus
TKSDGKKFGKSESGA

SEQ ID NO: 1911603 - protein, 12 aa, Staphylococcus
TKSGVRRNDGSY

SEQ ID NO: 1911604 - protein, 12 aa, Staphylococcus
TKSTPKGNIEKN

SEQ ID NO: 1911605 - protein, 6 aa, Staphylococcus
TKTLRK

SEQ ID NO: 1911606 - protein, 7 aa, Staphylococcus
TKTPMGA

SEQ ID NO: 1911607 - protein, 8 aa, Staphylococcus
TKYRGEFE

SEQ ID NO: 1911608 - protein, 9 aa, Staphylococcus
TLDRGTKTL

SEQ ID NO: 1911609 - protein, 6 aa, Staphylococcus
TLQDRR

SEQ ID NO: 1911610 - protein, 7 aa, Staphylococcus
TLQGNLD

SEQ ID NO: 1911611 - protein, 7 aa, Staphylococcus
TNAGKSS

SEQ ID NO: 1911612 - protein, 8 aa, Staphylococcus
TNQNQQMQ

SEQ ID NO: 1911613 - protein, 7 aa, Staphylococcus
TNRKRGE

SEQ ID NO: 1911614 - protein, 4 aa, Staphylococcus
TPED

SEQ ID NO: 1911615 - protein, 5 aa, Staphylococcus
TPGHA

SEQ ID NO: 1911616 - protein, 11 aa, Staphylococcus
TPGSEAMKGAI

SEQ ID NO: 1911617 - protein, 6 aa, Staphylococcus
TPGVTG

SEQ ID NO: 1911618 - protein, 4 aa, Staphylococcus
TPRP

SEQ ID NO: 1911619 - protein, 11 aa, Staphylococcus
TPTAGSSGTIP

SEQ ID NO: 1911620 - protein, 9 aa, Staphylococcus
TQERYPKKS

SEQ ID NO: 1911621 - protein, 6 aa, Staphylococcus
TQLQSG

SEQ ID NO: 1911622 - protein, 14 aa, Staphylococcus
TRGDGTTGEDITEN

SEQ ID NO: 1911623 - protein, 7 aa, Staphylococcus
TRGQTQA

SEQ ID NO: 1911624 - protein, 15 aa, Staphylococcus
TSANTGGIMQVPENL

SEQ ID NO: 1911625 - protein, 8 aa, Staphylococcus
TSNGQTPF

SEQ ID NO: 1911626 - protein, 11 aa, Staphylococcus
TSRVGDGPFPT

SEQ ID NO: 1911627 - protein, 5 aa, Staphylococcus
TSTEH

SEQ ID NO: 1911628 - protein, 5 aa, Staphylococcus
TSYPG

SEQ ID NO: 1911629 - protein, 4 aa, Staphylococcus
TTAE

SEQ ID NO: 1911630 - protein, 5 aa, Staphylococcus
TTGAE

SEQ ID NO: 1911631 - protein, 6 aa, Staphylococcus
TTGLPD

SEQ ID NO: 1911632 - protein, 5 aa, Staphylococcus
TTGPE

SEQ ID NO: 1911633 - protein, 12 aa, Staphylococcus
TTTHKTLRGPRG

SEQ ID NO: 1911634 - protein, 5 aa, Staphylococcus
TTTNR

SEQ ID NO: 1911635 - protein, 10 aa, Staphylococcus
TVGSGDSTVA

SEQ ID NO: 1911636 - protein, 4 aa, Staphylococcus
TVPQ

SEQ ID NO: 1911637 - protein, 9 aa, Staphylococcus
TYGDASSRF

SEQ ID NO: 1911638 - protein, 8 aa, Staphylococcus
TYGPTEAT

SEQ ID NO: 1911639 - protein, 6 aa, Staphylococcus
VAGGGT

SEQ ID NO: 1911640 - protein, 9 aa, Staphylococcus
VAKASTGAI

SEQ ID NO: 1911641 - protein, 8 aa, Staphylococcus
VAKRNDAK

SEQ ID NO: 1911642 - protein, 4 aa, Staphylococcus
VARD

SEQ ID NO: 1911643 - protein, 8 aa, Staphylococcus
VDNNKDQT

SEQ ID NO: 1911644 - protein, 7 aa, Staphylococcus
VDNPEMR

SEQ ID NO: 1911645 - protein, 7 aa, Staphylococcus
VEDDKQG

SEQ ID NO: 1911646 - protein, 5 aa, Staphylococcus
VEDET

SEQ ID NO: 1911647 - protein, 6 aa, Staphylococcus
VEEIKA

SEQ ID NO: 1911648 - protein, 8 aa, Staphylococcus
VEGTPEKF

SEQ ID NO: 1911649 - protein, 7 aa, Staphylococcus
VEKTGRA

SEQ ID NO: 1911650 - protein, 7 aa, Staphylococcus
VEQDPGA

SEQ ID NO: 1911651 - protein, 6 aa, Staphylococcus
VETERE

SEQ ID NO: 1911652 - protein, 7 aa, Staphylococcus
VGDQTFT

SEQ ID NO: 1911653 - protein, 10 aa, Staphylococcus
VGGSDQWGNI

SEQ ID NO: 1911654 - protein, 10 aa, Staphylococcus
VGPTQSKDSY

SEQ ID NO: 1911655 - protein, 7 aa, Staphylococcus
VISPEGA

SEQ ID NO: 1911656 - protein, 23 aa, Staphylococcus
VKKGTGKYFGPYPNAYSAQETKK

SEQ ID NO: 1911657 - protein, 8 aa, Staphylococcus
VKKNIENG

SEQ ID NO: 1911658 - protein, 8 aa, Staphylococcus
VKKPETIN

SEQ ID NO: 1911659 - protein, 5 aa, Staphylococcus
VKPNN

SEQ ID NO: 1911660 - protein, 14 aa, Staphylococcus
VKYRSKEEQQAENH

SEQ ID NO: 1911661 - protein, 11 aa, Staphylococcus
VLSQEDAEKYL

SEQ ID NO: 1911662 - protein, 10 aa, Staphylococcus
VLTPADEEYH

SEQ ID NO: 1911663 - protein, 7 aa, Staphylococcus
VNEGDSF

SEQ ID NO: 1911664 - protein, 5 aa, Staphylococcus
VNENT

SEQ ID NO: 1911665 - protein, 7 aa, Staphylococcus
VNESPYE

SEQ ID NO: 1911666 - protein, 7 aa, Staphylococcus
VNYENAG

SEQ ID NO: 1911667 - protein, 5 aa, Staphylococcus
VPGPV

SEQ ID NO: 1911668 - protein, 5 aa, Staphylococcus
VQEGQ

SEQ ID NO: 1911669 - protein, 10 aa, Staphylococcus
VQPHSGSQAN

SEQ ID NO: 1911670 - protein, 5 aa, Staphylococcus
VQSTL

SEQ ID NO: 1911671 - protein, 7 aa, Staphylococcus
VRGTTSK

SEQ ID NO: 1911672 - protein, 9 aa, Staphylococcus
VRSEDANSH

SEQ ID NO: 1911673 - protein, 7 aa, Staphylococcus
VSDQRRE

SEQ ID NO: 1911674 - protein, 6 aa, Staphylococcus
VSGNEP

SEQ ID NO: 1911675 - protein, 10 aa, Staphylococcus
VSLPNTKYGI

SEQ ID NO: 1911676 - protein, 6 aa, Staphylococcus
VTAGGI

SEQ ID NO: 1911677 - protein, 7 aa, Staphylococcus
VTNTKKD

SEQ ID NO: 1911678 - protein, 10 aa, Staphylococcus
VTPGKGGQVV

SEQ ID NO: 1911679 - protein, 8 aa, Staphylococcus
VTPSSKVV

SEQ ID NO: 1911680 - protein, 4 aa, Staphylococcus
VTQK

SEQ ID NO: 1911681 - protein, 7 aa, Staphylococcus
VWPPSGD

SEQ ID NO: 1911682 - protein, 10 aa, Staphylococcus
WQGPPRLQNG

SEQ ID NO: 1911683 - protein, 7 aa, Staphylococcus
YCGPGRR

SEQ ID NO: 1911684 - protein, 12 aa, Staphylococcus
YDDGKDPKGLPK

SEQ ID NO: 1911685 - protein, 6 aa, Staphylococcus
YEATTN

SEQ ID NO: 1911686 - protein, 5 aa, Staphylococcus
YEVTQ

SEQ ID NO: 1911687 - protein, 5 aa, Staphylococcus
YGNVN

SEQ ID NO: 1911688 - protein, 6 aa, Staphylococcus
YGQKGE

SEQ ID NO: 1911689 - protein, 5 aa, Staphylococcus
YGTPT

SEQ ID NO: 1911690 - protein, 9 aa, Staphylococcus
YHDPETNEK

SEQ ID NO: 1911691 - protein, 7 aa, Staphylococcus
YKTPEDY

SEQ ID NO: 1911692 - protein, 5 aa, Staphylococcus
YPDES

SEQ ID NO: 1911693 - protein, 8 aa, Staphylococcus
YQDTNRVQ

SEQ ID NO: 1911694 - protein, 6 aa, Staphylococcus
YQETDK

SEQ ID NO: 1911695 - protein, 7 aa, Staphylococcus
YQTDKRH

SEQ ID NO: 1911696 - protein, 7 aa, Staphylococcus
YQTHTNA

SEQ ID NO: 1911697 - protein, 4 aa, Staphylococcus
YRQD

SEQ ID NO: 1911698 - protein, 13 aa, Staphylococcus
YSDNIKTYESHGD

SEQ ID NO: 1911699 - protein, 5 aa, Staphylococcus
YSKEK

SEQ ID NO: 1911700 - protein, 19 aa, Staphylococcus
YSNSRGSLKIKSKDPFEKP

SEQ ID NO: 1911701 - protein, 10 aa, Staphylococcus
YSSGPNHQLP

SEQ ID NO: 1911702 - protein, 4 aa, Staphylococcus
YTGR

SEQ ID NO: 1911703 - protein, 4 aa, Staphylococcus
YYGQ

SEQ ID NO: 1911704 - protein, 8 aa, Staphylococcus
AAAPDIYD

SEQ ID NO: 1911705 - protein, 7 aa, Staphylococcus
AADIRDV

SEQ ID NO: 1911706 - protein, 8 aa, Staphylococcus
AAEDPNTI

SEQ ID NO: 1911707 - protein, 19 aa, Staphylococcus
AAGLTSSSSEMAAKGGSGL

SEQ ID NO: 1911708 - protein, 12 aa, Staphylococcus
AAIDGGESIDTS

SEQ ID NO: 1911709 - protein, 5 aa, Staphylococcus
AAKVN

SEQ ID NO: 1911710 - protein, 4 aa, Staphylococcus
AAPG

SEQ ID NO: 1911711 - protein, 22 aa, Staphylococcus
AAPVAAAGAAGGGDAAAEKTEF

SEQ ID NO: 1911712 - protein, 12 aa, Staphylococcus
AAPVSTQTLQRD

SEQ ID NO: 1911713 - protein, 14 aa, Staphylococcus
AAQIAKKAHKEGLT

SEQ ID NO: 1911714 - protein, 7 aa, Staphylococcus
AARVSDK

SEQ ID NO: 1911715 - protein, 7 aa, Staphylococcus
ADDGKIS

SEQ ID NO: 1911716 - protein, 7 aa, Staphylococcus
ADEEDSY

SEQ ID NO: 1911717 - protein, 5 aa, Staphylococcus
ADEYQ

SEQ ID NO: 1911718 - protein, 6 aa, Staphylococcus
ADFDGD

SEQ ID NO: 1911719 - protein, 18 aa, Staphylococcus
ADKVTEDASFKDDLGADS

SEQ ID NO: 1911720 - protein, 9 aa, Staphylococcus
ADPDYGKGV

SEQ ID NO: 1911721 - protein, 6 aa, Staphylococcus
ADTDRG

SEQ ID NO: 1911722 - protein, 5 aa, Staphylococcus
AEAAE

SEQ ID NO: 1911723 - protein, 9 aa, Staphylococcus
AEAAGGKGY

SEQ ID NO: 1911724 - protein, 15 aa, Staphylococcus
AEEGGENGSAKASYV

SEQ ID NO: 1911725 - protein, 6 aa, Staphylococcus
AEEKGH

SEQ ID NO: 1911726 - protein, 14 aa, Staphylococcus
AEEVKTVGSLPSHD

SEQ ID NO: 1911727 - protein, 12 aa, Staphylococcus
AENGGDAKQIME

SEQ ID NO: 1911728 - protein, 6 aa, Staphylococcus
AENPYK

SEQ ID NO: 1911729 - protein, 7 aa, Staphylococcus
AENVNNY

SEQ ID NO: 1911730 - protein, 8 aa, Staphylococcus
AEQGYPVT

SEQ ID NO: 1911731 - protein, 5 aa, Staphylococcus
AEQTY

SEQ ID NO: 1911732 - protein, 4 aa, Staphylococcus
AERH

SEQ ID NO: 1911733 - protein, 4 aa, Staphylococcus
AFKN

SEQ ID NO: 1911734 - protein, 4 aa, Staphylococcus
AGAL

SEQ ID NO: 1911735 - protein, 6 aa, Staphylococcus
AGDETA

SEQ ID NO: 1911736 - protein, 8 aa, Staphylococcus
AGDYDGKA

SEQ ID NO: 1911737 - protein, 7 aa, Staphylococcus
AGESGPL

SEQ ID NO: 1911738 - protein, 10 aa, Staphylococcus
AGGAEGAIDA

SEQ ID NO: 1911739 - protein, 4 aa, Staphylococcus
AGGG

SEQ ID NO: 1911740 - protein, 7 aa, Staphylococcus
AGHEPGY

SEQ ID NO: 1911741 - protein, 7 aa, Staphylococcus
AGKDGEH

SEQ ID NO: 1911742 - protein, 4 aa, Staphylococcus
AGLT

SEQ ID NO: 1911743 - protein, 6 aa, Staphylococcus
AGNDAN

SEQ ID NO: 1911744 - protein, 9 aa, Staphylococcus
AGPGNPNLL

SEQ ID NO: 1911745 - protein, 5 aa, Staphylococcus
AGSEV

SEQ ID NO: 1911746 - protein, 20 aa, Staphylococcus
AGSGPSQLGSPDSAGVPESV

SEQ ID NO: 1911747 - protein, 6 aa, Staphylococcus
AGTTRD

SEQ ID NO: 1911748 - protein, 6 aa, Staphylococcus
AGVDTA

SEQ ID NO: 1911749 - protein, 5 aa, Staphylococcus
AGVGD

SEQ ID NO: 1911750 - protein, 5 aa, Staphylococcus
AGYTA

SEQ ID NO: 1911751 - protein, 7 aa, Staphylococcus
AHPEFGD

SEQ ID NO: 1911752 - protein, 11 aa, Staphylococcus
AIETATENERG

SEQ ID NO: 1911753 - protein, 7 aa, Staphylococcus
AKAQSKK

SEQ ID NO: 1911754 - protein, 4 aa, Staphylococcus
AKEE

SEQ ID NO: 1911755 - protein, 4 aa, Staphylococcus
AKEG

SEQ ID NO: 1911756 - protein, 9 aa, Staphylococcus
AKELGKGKT

SEQ ID NO: 1911757 - protein, 9 aa, Staphylococcus
AKERERTGI

SEQ ID NO: 1911758 - protein, 6 aa, Staphylococcus
AKGGDY

SEQ ID NO: 1911759 - protein, 8 aa, Staphylococcus
AKGSGAFG

SEQ ID NO: 1911760 - protein, 7 aa, Staphylococcus
AKGVGGF

SEQ ID NO: 1911761 - protein, 20 aa, Staphylococcus
AKHQTNVRSATKDQTQTMNR

SEQ ID NO: 1911762 - protein, 8 aa, Staphylococcus
AKKGKGSG

SEQ ID NO: 1911763 - protein, 11 aa, Staphylococcus
AKKNPEDPRFT

SEQ ID NO: 1911764 - protein, 5 aa, Staphylococcus
AKNRK

SEQ ID NO: 1911765 - protein, 9 aa, Staphylococcus
AKREVSEQL

SEQ ID NO: 1911766 - protein, 7 aa, Staphylococcus
AKVSDKI

SEQ ID NO: 1911767 - protein, 13 aa, Staphylococcus
ALGPGGLTRERAQ

SEQ ID NO: 1911768 - protein, 9 aa, Staphylococcus
ALKDKGAKE

SEQ ID NO: 1911769 - protein, 9 aa, Staphylococcus
ALPANEGRG

SEQ ID NO: 1911770 - protein, 10 aa, Staphylococcus
ALTETDGDID

SEQ ID NO: 1911771 - protein, 15 aa, Staphylococcus
ALTPKAEIEGEMGDT

SEQ ID NO: 1911772 - protein, 11 aa, Staphylococcus
AMGKEETLSTA

SEQ ID NO: 1911773 - protein, 9 aa, Staphylococcus
AMKKNGAKA

SEQ ID NO: 1911774 - protein, 4 aa, Staphylococcus
ANAS

SEQ ID NO: 1911775 - protein, 7 aa, Staphylococcus
ANDTKYG

SEQ ID NO: 1911776 - protein, 6 aa, Staphylococcus
ANGTHK

SEQ ID NO: 1911777 - protein, 9 aa, Staphylococcus
ANKAEMAGI

SEQ ID NO: 1911778 - protein, 11 aa, Staphylococcus
ANKVHANSNIG

SEQ ID NO: 1911779 - protein, 7 aa, Staphylococcus
ANTNGQY

SEQ ID NO: 1911780 - protein, 10 aa, Staphylococcus
ANVKKEGNDI

SEQ ID NO: 1911781 - protein, 9 aa, Staphylococcus
ANVQPSDDY

SEQ ID NO: 1911782 - protein, 12 aa, Staphylococcus
APDGNTISATEH

SEQ ID NO: 1911783 - protein, 6 aa, Staphylococcus
APDYAE

SEQ ID NO: 1911784 - protein, 8 aa, Staphylococcus
APGFGDRR

SEQ ID NO: 1911785 - protein, 10 aa, Staphylococcus
APGSITPHTK

SEQ ID NO: 1911786 - protein, 6 aa, Staphylococcus
APIPGT

SEQ ID NO: 1911787 - protein, 5 aa, Staphylococcus
APRVQ

SEQ ID NO: 1911788 - protein, 8 aa, Staphylococcus
APSGEGAN

SEQ ID NO: 1911789 - protein, 16 aa, Staphylococcus
APTGRASKRLQESTGL

SEQ ID NO: 1911790 - protein, 5 aa, Staphylococcus
APTTY

SEQ ID NO: 1911791 - protein, 9 aa, Staphylococcus
APVGTTLDE

SEQ ID NO: 1911792 - protein, 4 aa, Staphylococcus
AQER

SEQ ID NO: 1911793 - protein, 8 aa, Staphylococcus
AQFNPTQG

SEQ ID NO: 1911794 - protein, 5 aa, Staphylococcus
AQGEL

SEQ ID NO: 1911795 - protein, 4 aa, Staphylococcus
AQMD

SEQ ID NO: 1911796 - protein, 6 aa, Staphylococcus
AQNSPV

SEQ ID NO: 1911797 - protein, 9 aa, Staphylococcus
AQRQAGVGA

SEQ ID NO: 1911798 - protein, 5 aa, Staphylococcus
AQRTA

SEQ ID NO: 1911799 - protein, 6 aa, Staphylococcus
ARATYD

SEQ ID NO: 1911800 - protein, 7 aa, Staphylococcus
AREGKKV

SEQ ID NO: 1911801 - protein, 8 aa, Staphylococcus
ARNPKGQA

SEQ ID NO: 1911802 - protein, 11 aa, Staphylococcus
ARRSVNPPKDT

SEQ ID NO: 1911803 - protein, 5 aa, Staphylococcus
ARSEA

SEQ ID NO: 1911804 - protein, 7 aa, Staphylococcus
ARTQEQA

SEQ ID NO: 1911805 - protein, 12 aa, Staphylococcus
ASETASKSAMEH

SEQ ID NO: 1911806 - protein, 7 aa, Staphylococcus
ASGAVGS

SEQ ID NO: 1911807 - protein, 8 aa, Staphylococcus
ASGAVSGL

SEQ ID NO: 1911808 - protein, 5 aa, Staphylococcus
ASPHE

SEQ ID NO: 1911809 - protein, 6 aa, Staphylococcus
ASRAGI

SEQ ID NO: 1911810 - protein, 8 aa, Staphylococcus
ASTGTDAV

SEQ ID NO: 1911811 - protein, 18 aa, Staphylococcus
ASTSNRNFEGRQGKGART

SEQ ID NO: 1911812 - protein, 9 aa, Staphylococcus
ASTVEAQEK

SEQ ID NO: 1911813 - protein, 6 aa, Staphylococcus
ATEKEL

SEQ ID NO: 1911814 - protein, 17 aa, Staphylococcus
ATEVSTSEFADELIKNL

SEQ ID NO: 1911815 - protein, 6 aa, Staphylococcus
ATGGTI

SEQ ID NO: 1911816 - protein, 8 aa, Staphylococcus
ATGSRPIE

SEQ ID NO: 1911817 - protein, 9 aa, Staphylococcus
ATKAPSSVN

SEQ ID NO: 1911818 - protein, 5 aa, Staphylococcus
ATNDF

SEQ ID NO: 1911819 - protein, 5 aa, Staphylococcus
ATPAI

SEQ ID NO: 1911820 - protein, 10 aa, Staphylococcus
ATSGGGGKGM

SEQ ID NO: 1911821 - protein, 8 aa, Staphylococcus
ATVQEEVG

SEQ ID NO: 1911822 - protein, 7 aa, Staphylococcus
AVEAAKK

SEQ ID NO: 1911823 - protein, 11 aa, Staphylococcus
AVGNPGQANYV

SEQ ID NO: 1911824 - protein, 4 aa, Staphylococcus
AVTQ

SEQ ID NO: 1911825 - protein, 6 aa, Staphylococcus
AYGGEV

SEQ ID NO: 1911826 - protein, 8 aa, Staphylococcus
AYTGEGKQ

SEQ ID NO: 1911827 - protein, 4 aa, Staphylococcus
CENC

SEQ ID NO: 1911828 - protein, 5 aa, Staphylococcus
CGRPH

SEQ ID NO: 1911829 - protein, 11 aa, Staphylococcus
DAAGKGGNIKR

SEQ ID NO: 1911830 - protein, 4 aa, Staphylococcus
DADS

SEQ ID NO: 1911831 - protein, 7 aa, Staphylococcus
DAGIEAK

SEQ ID NO: 1911832 - protein, 5 aa, Staphylococcus
DAKDN

SEQ ID NO: 1911833 - protein, 7 aa, Staphylococcus
DANNDKD

SEQ ID NO: 1911834 - protein, 7 aa, Staphylococcus
DANSKSE

SEQ ID NO: 1911835 - protein, 4 aa, Staphylococcus
DAPY

SEQ ID NO: 1911836 - protein, 8 aa, Staphylococcus
DASSDSPF

SEQ ID NO: 1911837 - protein, 9 aa, Staphylococcus
DAYDNNSEL

SEQ ID NO: 1911838 - protein, 6 aa, Staphylococcus
DDAPGI

SEQ ID NO: 1911839 - protein, 14 aa, Staphylococcus
DDEINEGDTFGSVE

SEQ ID NO: 1911840 - protein, 11 aa, Staphylococcus
DDETFSSAGTI

SEQ ID NO: 1911841 - protein, 7 aa, Staphylococcus
DDGKEAV

SEQ ID NO: 1911842 - protein, 7 aa, Staphylococcus
DDIEEEG

SEQ ID NO: 1911843 - protein, 4 aa, Staphylococcus
DDKA

SEQ ID NO: 1911844 - protein, 8 aa, Staphylococcus
DDPTTSYK

SEQ ID NO: 1911845 - protein, 4 aa, Staphylococcus
DDRV

SEQ ID NO: 1911846 - protein, 16 aa, Staphylococcus
DDTDENGVCTATEDYN

SEQ ID NO: 1911847 - protein, 6 aa, Staphylococcus
DDTPLG

SEQ ID NO: 1911848 - protein, 6 aa, Staphylococcus
DDYENS

SEQ ID NO: 1911849 - protein, 5 aa, Staphylococcus
DEDAA

SEQ ID NO: 1911850 - protein, 5 aa, Staphylococcus
DEEIR

SEQ ID NO: 1911851 - protein, 8 aa, Staphylococcus
DELPTPEN

SEQ ID NO: 1911852 - protein, 6 aa, Staphylococcus
DGEEAL

SEQ ID NO: 1911853 - protein, 4 aa, Staphylococcus
DGEF

SEQ ID NO: 1911854 - protein, 8 aa, Staphylococcus
DGEYGGKL

SEQ ID NO: 1911855 - protein, 6 aa, Staphylococcus
DGLSRD

SEQ ID NO: 1911856 - protein, 5 aa, Staphylococcus
DGQSY

SEQ ID NO: 1911857 - protein, 13 aa, Staphylococcus
DGRETPRKPRIVN

SEQ ID NO: 1911858 - protein, 6 aa, Staphylococcus
DGRPKL

SEQ ID NO: 1911859 - protein, 9 aa, Staphylococcus
DGRTGEPFD

SEQ ID NO: 1911860 - protein, 5 aa, Staphylococcus
DGSDR

SEQ ID NO: 1911861 - protein, 4 aa, Staphylococcus
DGTL

SEQ ID NO: 1911862 - protein, 4 aa, Staphylococcus
DGTM

SEQ ID NO: 1911863 - protein, 7 aa, Staphylococcus
DGTVKTF

SEQ ID NO: 1911864 - protein, 5 aa, Staphylococcus
DGVMP

SEQ ID NO: 1911865 - protein, 12 aa, Staphylococcus
DGVSERGGHPVY

SEQ ID NO: 1911866 - protein, 17 aa, Staphylococcus
DGYNQTQLAKKAGISRQ

SEQ ID NO: 1911867 - protein, 4 aa, Staphylococcus
DHIP

SEQ ID NO: 1911868 - protein, 4 aa, Staphylococcus
DHNP

SEQ ID NO: 1911869 - protein, 9 aa, Staphylococcus
DIQPSSRRY

SEQ ID NO: 1911870 - protein, 7 aa, Staphylococcus
DISLDGD

SEQ ID NO: 1911871 - protein, 11 aa, Staphylococcus
DISQNGRAAQG

SEQ ID NO: 1911872 - protein, 6 aa, Staphylococcus
DKGELT

SEQ ID NO: 1911873 - protein, 7 aa, Staphylococcus
DKKSRMA

SEQ ID NO: 1911874 - protein, 5 aa, Staphylococcus
DKRFQ

SEQ ID NO: 1911875 - protein, 7 aa, Staphylococcus
DKTEQDQ

SEQ ID NO: 1911876 - protein, 5 aa, Staphylococcus
DLEGK

SEQ ID NO: 1911877 - protein, 14 aa, Staphylococcus
DLPNEEKPAYGQKV

SEQ ID NO: 1911878 - protein, 6 aa, Staphylococcus
DLSSTD

SEQ ID NO: 1911879 - protein, 7 aa, Staphylococcus
DNDRARV

SEQ ID NO: 1911880 - protein, 9 aa, Staphylococcus
DNEVSDPKE

SEQ ID NO: 1911881 - protein, 5 aa, Staphylococcus
DNFET

SEQ ID NO: 1911882 - protein, 7 aa, Staphylococcus
DNGRGIP

SEQ ID NO: 1911883 - protein, 7 aa, Staphylococcus
DNLEGSV

SEQ ID NO: 1911884 - protein, 4 aa, Staphylococcus
DNQK

SEQ ID NO: 1911885 - protein, 7 aa, Staphylococcus
DPDCSPE

SEQ ID NO: 1911886 - protein, 4 aa, Staphylococcus
DPDF

SEQ ID NO: 1911887 - protein, 5 aa, Staphylococcus
DPETL

SEQ ID NO: 1911888 - protein, 7 aa, Staphylococcus
DPSAASF

SEQ ID NO: 1911889 - protein, 5 aa, Staphylococcus
DPTED

SEQ ID NO: 1911890 - protein, 5 aa, Staphylococcus
DQART

SEQ ID NO: 1911891 - protein, 5 aa, Staphylococcus
DQDPH

SEQ ID NO: 1911892 - protein, 11 aa, Staphylococcus
DQGIHKRGAEI

SEQ ID NO: 1911893 - protein, 6 aa, Staphylococcus
DQHGTA

SEQ ID NO: 1911894 - protein, 4 aa, Staphylococcus
DQLA

SEQ ID NO: 1911895 - protein, 5 aa, Staphylococcus
DRAAQ

SEQ ID NO: 1911896 - protein, 6 aa, Staphylococcus
DRAEGI

SEQ ID NO: 1911897 - protein, 6 aa, Staphylococcus
DREEET

SEQ ID NO: 1911898 - protein, 13 aa, Staphylococcus
DREKAKNKRGKIG

SEQ ID NO: 1911899 - protein, 6 aa, Staphylococcus
DRGNDF

SEQ ID NO: 1911900 - protein, 7 aa, Staphylococcus
DRPHELR

SEQ ID NO: 1911901 - protein, 10 aa, Staphylococcus
DSAKEKSNEG

SEQ ID NO: 1911902 - protein, 5 aa, Staphylococcus
DSIDE

SEQ ID NO: 1911903 - protein, 8 aa, Staphylococcus
DSIERTTR

SEQ ID NO: 1911904 - protein, 16 aa, Staphylococcus
DSPSTNYAAIEDKSRR

SEQ ID NO: 1911905 - protein, 9 aa, Staphylococcus
DSTDGVQRG

SEQ ID NO: 1911906 - protein, 4 aa, Staphylococcus
DSVH

SEQ ID NO: 1911907 - protein, 6 aa, Staphylococcus
DTGSRM

SEQ ID NO: 1911908 - protein, 10 aa, Staphylococcus
DTTSRKGAHE

SEQ ID NO: 1911909 - protein, 4 aa, Staphylococcus
DTYE

SEQ ID NO: 1911910 - protein, 6 aa, Staphylococcus
DVPESL

SEQ ID NO: 1911911 - protein, 6 aa, Staphylococcus
DVPKQA

SEQ ID NO: 1911912 - protein, 9 aa, Staphylococcus
DVSEENPDE

SEQ ID NO: 1911913 - protein, 8 aa, Staphylococcus
DVTDQKNK

SEQ ID NO: 1911914 - protein, 5 aa, Staphylococcus
DYGFS

SEQ ID NO: 1911915 - protein, 7 aa, Staphylococcus
DYQPNQF

SEQ ID NO: 1911916 - protein, 7 aa, Staphylococcus
EAAEQSY

SEQ ID NO: 1911917 - protein, 12 aa, Staphylococcus
EAGQSASTSSYL

SEQ ID NO: 1911918 - protein, 4 aa, Staphylococcus
EAGV

SEQ ID NO: 1911919 - protein, 4 aa, Staphylococcus
EAIP

SEQ ID NO: 1911920 - protein, 7 aa, Staphylococcus
EARQVDP

SEQ ID NO: 1911921 - protein, 16 aa, Staphylococcus
EASENHKKRVQSSTLN

SEQ ID NO: 1911922 - protein, 4 aa, Staphylococcus
EDAV

SEQ ID NO: 1911923 - protein, 7 aa, Staphylococcus
EDDEATV

SEQ ID NO: 1911924 - protein, 7 aa, Staphylococcus
EDIGRGD

SEQ ID NO: 1911925 - protein, 18 aa, Staphylococcus
EDTDSKRNLEDGESSQFD

SEQ ID NO: 1911926 - protein, 7 aa, Staphylococcus
EDTSATN

SEQ ID NO: 1911927 - protein, 6 aa, Staphylococcus
EDVGTR

SEQ ID NO: 1911928 - protein, 6 aa, Staphylococcus
EEEEPI

SEQ ID NO: 1911929 - protein, 5 aa, Staphylococcus
EEKLT

SEQ ID NO: 1911930 - protein, 10 aa, Staphylococcus
EERDTNIKSY

SEQ ID NO: 1911931 - protein, 7 aa, Staphylococcus
EETKGAF

SEQ ID NO: 1911932 - protein, 14 aa, Staphylococcus
EEVKKKASVLSGGE

SEQ ID NO: 1911933 - protein, 8 aa, Staphylococcus
EEVPEEEY

SEQ ID NO: 1911934 - protein, 10 aa, Staphylococcus
EFEPESSQAL

SEQ ID NO: 1911935 - protein, 6 aa, Staphylococcus
EFTGKE

SEQ ID NO: 1911936 - protein, 9 aa, Staphylococcus
EGARDGKTV

SEQ ID NO: 1911937 - protein, 9 aa, Staphylococcus
EGASDGVGL

SEQ ID NO: 1911938 - protein, 7 aa, Staphylococcus
EGCPTDS

SEQ ID NO: 1911939 - protein, 8 aa, Staphylococcus
EGDGVGGL

SEQ ID NO: 1911940 - protein, 4 aa, Staphylococcus
EGDI

SEQ ID NO: 1911941 - protein, 5 aa, Staphylococcus
EGDQI

SEQ ID NO: 1911942 - protein, 14 aa, Staphylococcus
EGEHGAKRSAAEQV

SEQ ID NO: 1911943 - protein, 4 aa, Staphylococcus
EGGF

SEQ ID NO: 1911944 - protein, 10 aa, Staphylococcus
EGLPRHTSTH

SEQ ID NO: 1911945 - protein, 12 aa, Staphylococcus
EGQTNPPTLNSE

SEQ ID NO: 1911946 - protein, 11 aa, Staphylococcus
EGSTDEEAAKD

SEQ ID NO: 1911947 - protein, 4 aa, Staphylococcus
EGTG

SEQ ID NO: 1911948 - protein, 8 aa, Staphylococcus
EGTIKSEA

SEQ ID NO: 1911949 - protein, 4 aa, Staphylococcus
EGTV

SEQ ID NO: 1911950 - protein, 8 aa, Staphylococcus
EGYDTPEN

SEQ ID NO: 1911951 - protein, 15 aa, Staphylococcus
EHPHAAQQPENYELR

SEQ ID NO: 1911952 - protein, 7 aa, Staphylococcus
EIPPESV

SEQ ID NO: 1911953 - protein, 10 aa, Staphylococcus
EIPSPVSGTI

SEQ ID NO: 1911954 - protein, 5 aa, Staphylococcus
EIQDT

SEQ ID NO: 1911955 - protein, 7 aa, Staphylococcus
EITASAT

SEQ ID NO: 1911956 - protein, 11 aa, Staphylococcus
EITKDAFGKTI

SEQ ID NO: 1911957 - protein, 5 aa, Staphylococcus
EKAHS

SEQ ID NO: 1911958 - protein, 13 aa, Staphylococcus
EKEQGNDEAHEMD

SEQ ID NO: 1911959 - protein, 4 aa, Staphylococcus
EKFN

SEQ ID NO: 1911960 - protein, 4 aa, Staphylococcus
EKGI

SEQ ID NO: 1911961 - protein, 4 aa, Staphylococcus
EKHP

SEQ ID NO: 1911962 - protein, 6 aa, Staphylococcus
EKINDN

SEQ ID NO: 1911963 - protein, 23 aa, Staphylococcus
EKLNDKAYITPGLGDAGDRLFGT

SEQ ID NO: 1911964 - protein, 8 aa, Staphylococcus
EKLPDDFQ

SEQ ID NO: 1911965 - protein, 4 aa, Staphylococcus
EKQR

SEQ ID NO: 1911966 - protein, 6 aa, Staphylococcus
EKRPVR

SEQ ID NO: 1911967 - protein, 11 aa, Staphylococcus
EKTNVKHESPQ

SEQ ID NO: 1911968 - protein, 4 aa, Staphylococcus
EKYP

SEQ ID NO: 1911969 - protein, 7 aa, Staphylococcus
ELDPENN

SEQ ID NO: 1911970 - protein, 5 aa, Staphylococcus
ELGGN

SEQ ID NO: 1911971 - protein, 7 aa, Staphylococcus
ELNPTDE

SEQ ID NO: 1911972 - protein, 8 aa, Staphylococcus
ELSGGQQQ

SEQ ID NO: 1911973 - protein, 13 aa, Staphylococcus
EMRTGEGKTLTAT

SEQ ID NO: 1911974 - protein, 5 aa, Staphylococcus
ENGAH

SEQ ID NO: 1911975 - protein, 9 aa, Staphylococcus
ENGITSPSA

SEQ ID NO: 1911976 - protein, 9 aa, Staphylococcus
ENWSRPESE

SEQ ID NO: 1911977 - protein, 7 aa, Staphylococcus
ENYESEM

SEQ ID NO: 1911978 - protein, 11 aa, Staphylococcus
EPDESGDGGKL

SEQ ID NO: 1911979 - protein, 4 aa, Staphylococcus
EPNF

SEQ ID NO: 1911980 - protein, 6 aa, Staphylococcus
EPPENT

SEQ ID NO: 1911981 - protein, 8 aa, Staphylococcus
EPPSASPV

SEQ ID NO: 1911982 - protein, 9 aa, Staphylococcus
EPTNDLDTE

SEQ ID NO: 1911983 - protein, 4 aa, Staphylococcus
EPVS

SEQ ID NO: 1911984 - protein, 10 aa, Staphylococcus
EPWEPTSSDF

SEQ ID NO: 1911985 - protein, 4 aa, Staphylococcus
EPYS

SEQ ID NO: 1911986 - protein, 14 aa, Staphylococcus
EQADLTKKEAGSAV

SEQ ID NO: 1911987 - protein, 8 aa, Staphylococcus
EQPKSDRL

SEQ ID NO: 1911988 - protein, 8 aa, Staphylococcus
EQRSGRDA

SEQ ID NO: 1911989 - protein, 11 aa, Staphylococcus
EQSTMNESKYC

SEQ ID NO: 1911990 - protein, 11 aa, Staphylococcus
EQTLESRSRLE

SEQ ID NO: 1911991 - protein, 36 aa, Staphylococcus; identical to SEQ ID NO: 1604305

SEQ ID NO: 1911992 - protein, 8 aa, Staphylococcus
ERDNQPHT

SEQ ID NO: 1911993 - protein, 11 aa, Staphylococcus
ERFGDERRTEI

SEQ ID NO: 1911994 - protein, 13 aa, Staphylococcus
ERITSTNKGSVTS

SEQ ID NO: 1911995 - protein, 11 aa, Staphylococcus
ERKKLSKRDGQ

SEQ ID NO: 1911996 - protein, 4 aa, Staphylococcus
ERLQ

SEQ ID NO: 1911997 - protein, 8 aa, Staphylococcus
ERPELGNE

SEQ ID NO: 1911998 - protein, 7 aa, Staphylococcus
ERSVESA

SEQ ID NO: 1911999 - protein, 7 aa, Staphylococcus
ESAASGL

SEQ ID NO: 1912000 - protein, 9 aa, Staphylococcus
ESGRWGAYG

SEQ ID NO: 1912001 - protein, 15 aa, Staphylococcus
ESKSGYGLDKENELK

SEQ ID NO: 1912002 - protein, 6 aa, Staphylococcus
ETDEIS

SEQ ID NO: 1912003 - protein, 4 aa, Staphylococcus
ETEE

SEQ ID NO: 1912004 - protein, 5 aa, Staphylococcus
ETEKY

SEQ ID NO: 1912005 - protein, 4 aa, Staphylococcus
ETGA

SEQ ID NO: 1912006 - protein, 5 aa, Staphylococcus
ETGEV

SEQ ID NO: 1912007 - protein, 6 aa, Staphylococcus
ETMEKE

SEQ ID NO: 1912008 - protein, 11 aa, Staphylococcus
ETRDDAVGEAY

SEQ ID NO: 1912009 - protein, 8 aa, Staphylococcus
ETRPLSAT

SEQ ID NO: 1912010 - protein, 8 aa, Staphylococcus
ETTARYGD

SEQ ID NO: 1912011 - protein, 5 aa, Staphylococcus
EVPEI

SEQ ID NO: 1912012 - protein, 7 aa, Staphylococcus
EVPETLK

SEQ ID NO: 1912013 - protein, 5 aa, Staphylococcus
EVRKK

SEQ ID NO: 1912014 - protein, 5 aa, Staphylococcus
EVTDT

SEQ ID NO: 1912015 - protein, 15 aa, Staphylococcus
EWATPNKIVEALEEL

SEQ ID NO: 1912016 - protein, 5 aa, Staphylococcus
EYPRE

SEQ ID NO: 1912017 - protein, 18 aa, Staphylococcus
FAPTRTFKGHAADDKKTR

SEQ ID NO: 1912018 - protein, 7 aa, Staphylococcus
FDEPPQH

SEQ ID NO: 1912019 - protein, 9 aa, Staphylococcus
FDGANDDDV

SEQ ID NO: 1912020 - protein, 5 aa, Staphylococcus
FDSNN

SEQ ID NO: 1912021 - protein, 9 aa, Staphylococcus
FEANPDELT

SEQ ID NO: 1912022 - protein, 10 aa, Staphylococcus
FGCGSSREHA

SEQ ID NO: 1912023 - protein, 6 aa, Staphylococcus
FGDPEA

SEQ ID NO: 1912024 - protein, 16 aa, Staphylococcus
FGTEIPDEEAEKINTV

SEQ ID NO: 1912025 - protein, 9 aa, Staphylococcus
FKEETETDL

SEQ ID NO: 1912026 - protein, 7 aa, Staphylococcus
FKGTEAA

SEQ ID NO: 1912027 - protein, 5 aa, Staphylococcus
FNEED

SEQ ID NO: 1912028 - protein, 5 aa, Staphylococcus
FNTAN

SEQ ID NO: 1912029 - protein, 8 aa, Staphylococcus
FPKDNSEF

SEQ ID NO: 1912030 - protein, 5 aa, Staphylococcus
FPTTG

SEQ ID NO: 1912031 - protein, 4 aa, Staphylococcus
FQMT

SEQ ID NO: 1912032 - protein, 8 aa, Staphylococcus
FRDEKRPR

SEQ ID NO: 1912033 - protein, 7 aa, Staphylococcus
FSASKTY

SEQ ID NO: 1912034 - protein, 10 aa, Staphylococcus
FSDEDGIRAA

SEQ ID NO: 1912035 - protein, 5 aa, Staphylococcus
FSGNL

SEQ ID NO: 1912036 - protein, 7 aa, Staphylococcus
FSGYPDC

SEQ ID NO: 1912037 - protein, 4 aa, Staphylococcus
FSTD

SEQ ID NO: 1912038 - protein, 4 aa, Staphylococcus
FTPA

SEQ ID NO: 1912039 - protein, 10 aa, Staphylococcus
GADAKDLDDA

SEQ ID NO: 1912040 - protein, 8 aa, Staphylococcus
GAFGGKKE

SEQ ID NO: 1912041 - protein, 5 aa, Staphylococcus
GAGAA

SEQ ID NO: 1912042 - protein, 11 aa, Staphylococcus
GAKGPNGSTVT

SEQ ID NO: 1912043 - protein, 17 aa, Staphylococcus
GAPPGYVGHDEGGQLTE

SEQ ID NO: 1912044 - protein, 7 aa, Staphylococcus
GAPPHGG

SEQ ID NO: 1912045 - protein, 10 aa, Staphylococcus
GAPQKPGETR

SEQ ID NO: 1912046 - protein, 8 aa, Staphylococcus
GASEALDT

SEQ ID NO: 1912047 - protein, 9 aa, Staphylococcus
GASGSGKST

SEQ ID NO: 1912048 - protein, 9 aa, Staphylococcus
GATRIGASA

SEQ ID NO: 1912049 - protein, 14 aa, Staphylococcus
GDAVDSIYDASVNK

SEQ ID NO: 1912050 - protein, 8 aa, Staphylococcus
GDEGKGKI

SEQ ID NO: 1912051 - protein, 4 aa, Staphylococcus
GDEI

SEQ ID NO: 1912052 - protein, 6 aa, Staphylococcus
GDGGTA

SEQ ID NO: 1912053 - protein, 7 aa, Staphylococcus
GDGRNNV

SEQ ID NO: 1912054 - protein, 4 aa, Staphylococcus
GDII

SEQ ID NO: 1912055 - protein, 5 aa, Staphylococcus
GDPSS

SEQ ID NO: 1912056 - protein, 7 aa, Staphylococcus
GDRYDVG

SEQ ID NO: 1912057 - protein, 23 aa, Staphylococcus
GDSVTTDHISPAGAIGKDTPAGK

SEQ ID NO: 1912058 - protein, 11 aa, Staphylococcus
GEEAYEPQFGA

SEQ ID NO: 1912059 - protein, 5 aa, Staphylococcus
GEGKD

SEQ ID NO: 1912060 - protein, 12 aa, Staphylococcus
GEKIPRKGGQGM

SEQ ID NO: 1912061 - protein, 4 aa, Staphylococcus
GENA

SEQ ID NO: 1912062 - protein, 6 aa, Staphylococcus
GEPGVY

SEQ ID NO: 1912063 - protein, 13 aa, Staphylococcus
GESGCGKSTTGKA

SEQ ID NO: 1912064 - protein, 7 aa, Staphylococcus
GETGASM

SEQ ID NO: 1912065 - protein, 4 aa, Staphylococcus
GETV

SEQ ID NO: 1912066 - protein, 13 aa, Staphylococcus
GEYKDLREQSAKE

SEQ ID NO: 1912067 - protein, 9 aa, Staphylococcus
GEYQPNAHN

SEQ ID NO: 1912068 - protein, 6 aa, Staphylococcus
GFGPSG

SEQ ID NO: 1912069 - protein, 5 aa, Staphylococcus
GFSEE

SEQ ID NO: 1912070 - protein, 13 aa, Staphylococcus
GFSPEDRKENIRR

SEQ ID NO: 1912071 - protein, 7 aa, Staphylococcus
GFTQPAQ

SEQ ID NO: 1912072 - protein, 7 aa, Staphylococcus
GGATGDF

SEQ ID NO: 1912073 - protein, 7 aa, Staphylococcus
GGDISRK

SEQ ID NO: 1912074 - protein, 8 aa, Staphylococcus
GGDSAIGR

SEQ ID NO: 1912075 - protein, 4 aa, Staphylococcus
GGGL

SEQ ID NO: 1912076 - protein, 8 aa, Staphylococcus
GGGVHTPE

SEQ ID NO: 1912077 - protein, 9 aa, Staphylococcus
GGHSADLNN

SEQ ID NO: 1912078 - protein, 6 aa, Staphylococcus
GGIETG

SEQ ID NO: 1912079 - protein, 10 aa, Staphylococcus
GGKRPEREDL

SEQ ID NO: 1912080 - protein, 6 aa, Staphylococcus
GGKSPV

SEQ ID NO: 1912081 - protein, 12 aa, Staphylococcus
GGNTNYQDTIRR

SEQ ID NO: 1912082 - protein, 4 aa, Staphylococcus
GGRH

SEQ ID NO: 1912083 - protein, 10 aa, Staphylococcus
GGTNGKGSTV

SEQ ID NO: 1912084 - protein, 6 aa, Staphylococcus
GGTPLS

SEQ ID NO: 1912085 - protein, 4 aa, Staphylococcus
GHSD

SEQ ID NO: 1912086 - protein, 14 aa, Staphylococcus
GIAKAAKKADRIAA

SEQ ID NO: 1912087 - protein, 13 aa, Staphylococcus
GIDPKTIPVDDKE

SEQ ID NO: 1912088 - protein, 8 aa, Staphylococcus
GIGGDGDP

SEQ ID NO: 1912089 - protein, 9 aa, Staphylococcus
GIKNDSTNV

SEQ ID NO: 1912090 - protein, 5 aa, Staphylococcus
GINRE

SEQ ID NO: 1912091 - protein, 12 aa, Staphylococcus
GINTDGDALKKH

SEQ ID NO: 1912092 - protein, 5 aa, Staphylococcus
GIQGH

SEQ ID NO: 1912093 - protein, 4 aa, Staphylococcus
GIQQ

SEQ ID NO: 1912094 - protein, 9 aa, Staphylococcus
GKALDQDKS

SEQ ID NO: 1912095 - protein, 7 aa, Staphylococcus
GKDKQVG

SEQ ID NO: 1912096 - protein, 16 aa, Staphylococcus
GKGGKKLKEVGKRARH

SEQ ID NO: 1912097 - protein, 9 aa, Staphylococcus
GKGQVQDAG

SEQ ID NO: 1912098 - protein, 20 aa, Staphylococcus
GKIPGGFKKREGRPGDEATL

SEQ ID NO: 1912099 - protein, 9 aa, Staphylococcus
GKNGAGKST

SEQ ID NO: 1912100 - protein, 10 aa, Staphylococcus
GKNGSGKSTL

SEQ ID NO: 1912101 - protein, 8 aa, Staphylococcus
GKNSAVDA

SEQ ID NO: 1912102 - protein, 9 aa, Staphylococcus
GKNYSDSPK

SEQ ID NO: 1912103 - protein, 4 aa, Staphylococcus
GKPG

SEQ ID NO: 1912104 - protein, 14 aa, Staphylococcus
GKPLFTSEEKFESD

SEQ ID NO: 1912105 - protein, 7 aa, Staphylococcus
GKPLPNR

SEQ ID NO: 1912106 - protein, 7 aa, Staphylococcus
GKRGTAQ

SEQ ID NO: 1912107 - protein, 8 aa, Staphylococcus
GKRYNRET

SEQ ID NO: 1912108 - protein, 9 aa, Staphylococcus
GKSDKKRVQ

SEQ ID NO: 1912109 - protein, 9 aa, Staphylococcus
GKTDGAMDA

SEQ ID NO: 1912110 - protein, 5 aa, Staphylococcus
GKTTL

SEQ ID NO: 1912111 - protein, 12 aa, Staphylococcus
GKWNRAKQEING

SEQ ID NO: 1912112 - protein, 7 aa, Staphylococcus
GLDPDQY

SEQ ID NO: 1912113 - protein, 11 aa, Staphylococcus
GLEDPKTGKRP

SEQ ID NO: 1912114 - protein, 12 aa, Staphylococcus
GLGPTKDDLTKH

SEQ ID NO: 1912115 - protein, 5 aa, Staphylococcus
GLKPV

SEQ ID NO: 1912116 - protein, 9 aa, Staphylococcus
GLSGTYQTA

SEQ ID NO: 1912117 - protein, 7 aa, Staphylococcus
GMDENDW

SEQ ID NO: 1912118 - protein, 15 aa, Staphylococcus
GMPGGQMANTEEVEN

SEQ ID NO: 1912119 - protein, 4 aa, Staphylococcus
GMST

SEQ ID NO: 1912120 - protein, 4 aa, Staphylococcus
GNEL

SEQ ID NO: 1912121 - protein, 8 aa, Staphylococcus
GNEPLAQE

SEQ ID NO: 1912122 - protein, 6 aa, Staphylococcus
GNPEEY

SEQ ID NO: 1912123 - protein, 4 aa, Staphylococcus
GNTA

SEQ ID NO: 1912124 - protein, 13 aa, Staphylococcus
GNVEEPEHDGTAE

SEQ ID NO: 1912125 - protein, 4 aa, Staphylococcus
GPCG

SEQ ID NO: 1912126 - protein, 7 aa, Staphylococcus
GPHDANN

SEQ ID NO: 1912127 - protein, 6 aa, Staphylococcus
GPIGDG

SEQ ID NO: 1912128 - protein, 14 aa, Staphylococcus
GPMKAGLSAQGKAL

SEQ ID NO: 1912129 - protein, 7 aa, Staphylococcus
GPNGAGH

SEQ ID NO: 1912130 - protein, 9 aa, Staphylococcus
GPNGCGKST

SEQ ID NO: 1912131 - protein, 9 aa, Staphylococcus
GPNTGGKTV

SEQ ID NO: 1912132 - protein, 6 aa, Staphylococcus
GPQDDI

SEQ ID NO: 1912133 - protein, 9 aa, Staphylococcus
GPTPRSYSY

SEQ ID NO: 1912134 - protein, 8 aa, Staphylococcus
GQGQEATQ

SEQ ID NO: 1912135 - protein, 5 aa, Staphylococcus
GQKLY

SEQ ID NO: 1912136 - protein, 6 aa, Staphylococcus
GQLNPG

SEQ ID NO: 1912137 - protein, 12 aa, Staphylococcus
GQQRGKDTKDNI

SEQ ID NO: 1912138 - protein, 10 aa, Staphylococcus
GQTGSGKSTL

SEQ ID NO: 1912139 - protein, 8 aa, Staphylococcus
GRDEGKML

SEQ ID NO: 1912140 - protein, 10 aa, Staphylococcus
GRDPAPEEIG

SEQ ID NO: 1912141 - protein, 6 aa, Staphylococcus
GREQTA

SEQ ID NO: 1912142 - protein, 7 aa, Staphylococcus
GRFATSD

SEQ ID NO: 1912143 - protein, 14 aa, Staphylococcus
GRGTVATGRVERGQ

SEQ ID NO: 1912144 - protein, 7 aa, Staphylococcus
GRKSLEE

SEQ ID NO: 1912145 - protein, 8 aa, Staphylococcus
GRLQNKSN

SEQ ID NO: 1912146 - protein, 10 aa, Staphylococcus
GRPETQRKTV

SEQ ID NO: 1912147 - protein, 6 aa, Staphylococcus
GRRNMT

SEQ ID NO: 1912148 - protein, 13 aa, Staphylococcus
GRYSKETIRHPET

SEQ ID NO: 1912149 - protein, 11 aa, Staphylococcus
GSDEAGSGDYF

SEQ ID NO: 1912150 - protein, 6 aa, Staphylococcus
GSDSEI

SEQ ID NO: 1912151 - protein, 5 aa, Staphylococcus
GSERI

SEQ ID NO: 1912152 - protein, 13 aa, Staphylococcus
GSGNKTTQSVTSG

SEQ ID NO: 1912153 - protein, 6 aa, Staphylococcus
GSGVAT

SEQ ID NO: 1912154 - protein, 4 aa, Staphylococcus
GSIP

SEQ ID NO: 1912155 - protein, 10 aa, Staphylococcus
GSKTPGHPEF

SEQ ID NO: 1912156 - protein, 7 aa, Staphylococcus
GSPETVA

SEQ ID NO: 1912157 - protein, 9 aa, Staphylococcus
GSRATGTRI

SEQ ID NO: 1912158 - protein, 5 aa, Staphylococcus
GSRER

SEQ ID NO: 1912159 - protein, 4 aa, Staphylococcus
GSSF

SEQ ID NO: 1912160 - protein, 6 aa, Staphylococcus
GSSIEN

SEQ ID NO: 1912161 - protein, 7 aa, Staphylococcus
GSSSVKT

SEQ ID NO: 1912162 - protein, 17 aa, Staphylococcus
GSTGISAGYATDIPPHN

SEQ ID NO: 1912163 - protein, 12 aa, Staphylococcus
GSTKTSSETMEW

SEQ ID NO: 1912164 - protein, 4 aa, Staphylococcus
GSTT

SEQ ID NO: 1912165 - protein, 8 aa, Staphylococcus
GTADPYQD

SEQ ID NO: 1912166 - protein, 6 aa, Staphylococcus
GTCMTS

SEQ ID NO: 1912167 - protein, 7 aa, Staphylococcus
GTDGVGT

SEQ ID NO: 1912168 - protein, 10 aa, Staphylococcus
GTDPTGGAGV

SEQ ID NO: 1912169 - protein, 6 aa, Staphylococcus
GTDSHT

SEQ ID NO: 1912170 - protein, 5 aa, Staphylococcus
GTEGK

SEQ ID NO: 1912171 - protein, 12 aa, Staphylococcus
GTGGDKSNSFNI

SEQ ID NO: 1912172 - protein, 11 aa, Staphylococcus
GTLDDKGPTIA

SEQ ID NO: 1912173 - protein, 9 aa, Staphylococcus
GTLSGNPLA

SEQ ID NO: 1912174 - protein, 19 aa, Staphylococcus
GTNRTNKYYNDSKATNTLA

SEQ ID NO: 1912175 - protein, 5 aa, Staphylococcus
GTTAS

SEQ ID NO: 1912176 - protein, 17 aa, Staphylococcus
GTTASVPPQGGRKHPNQ

SEQ ID NO: 1912177 - protein, 9 aa, Staphylococcus
GTTSTRTLE

SEQ ID NO: 1912178 - protein, 9 aa, Staphylococcus
GTTVSRASL

SEQ ID NO: 1912179 - protein, 9 aa, Staphylococcus
GVFTEEGGQ

SEQ ID NO: 1912180 - protein, 8 aa, Staphylococcus
GVGGYPKG

SEQ ID NO: 1912181 - protein, 5 aa, Staphylococcus
GVGND

SEQ ID NO: 1912182 - protein, 4 aa, Staphylococcus
GVGY

SEQ ID NO: 1912183 - protein, 6 aa, Staphylococcus
GVNDDQ

SEQ ID NO: 1912184 - protein, 9 aa, Staphylococcus
GVNPTSDGE

SEQ ID NO: 1912185 - protein, 10 aa, Staphylococcus
GVSDPEQKRK

SEQ ID NO: 1912186 - protein, 4 aa, Staphylococcus
GYDE

SEQ ID NO: 1912187 - protein, 7 aa, Staphylococcus
GYGNKEI

SEQ ID NO: 1912188 - protein, 6 aa, Staphylococcus
GYHGKS

SEQ ID NO: 1912189 - protein, 6 aa, Staphylococcus
GYQPTL

SEQ ID NO: 1912190 - protein, 15 aa, Staphylococcus
GYSRDEANKLLKDND

SEQ ID NO: 1912191 - protein, 12 aa, Staphylococcus
GYTKEEQKMIDE

SEQ ID NO: 1912192 - protein, 7 aa, Staphylococcus
HAEPTTF

SEQ ID NO: 1912193 - protein, 5 aa, Staphylococcus
HAKEE

SEQ ID NO: 1912194 - protein, 4 aa, Staphylococcus
HASP

SEQ ID NO: 1912195 - protein, 4 aa, Staphylococcus
HATA

SEQ ID NO: 1912196 - protein, 7 aa, Staphylococcus
HDSPYSI

SEQ ID NO: 1912197 - protein, 4 aa, Staphylococcus
HEEG

SEQ ID NO: 1912198 - protein, 4 aa, Staphylococcus
HEQY

SEQ ID NO: 1912199 - protein, 8 aa, Staphylococcus
HGGGHKRQ

SEQ ID NO: 1912200 - protein, 12 aa, Staphylococcus
HGGTKSIANQES

SEQ ID NO: 1912201 - protein, 10 aa, Staphylococcus
HGKGTENKTV

SEQ ID NO: 1912202 - protein, 10 aa, Staphylococcus
HGSHEEHKAR

SEQ ID NO: 1912203 - protein, 9 aa, Staphylococcus
HGTSTPVGD

SEQ ID NO: 1912204 - protein, 11 aa, Staphylococcus
HKPSGAKPGFV

SEQ ID NO: 1912205 - protein, 8 aa, Staphylococcus
HKRSTGRS

SEQ ID NO: 1912206 - protein, 7 aa, Staphylococcus
HKSQGSE

SEQ ID NO: 1912207 - protein, 5 aa, Staphylococcus
HNPPM

SEQ ID NO: 1912208 - protein, 4 aa, Staphylococcus
HPRE

SEQ ID NO: 1912209 - protein, 7 aa, Staphylococcus
HQITPDS

SEQ ID NO: 1912210 - protein, 4 aa, Staphylococcus
HQMK

SEQ ID NO: 1912211 - protein, 5 aa, Staphylococcus
HRENY

SEQ ID NO: 1912212 - protein, 11 aa, Staphylococcus
HRSGETEDTTI

SEQ ID NO: 1912213 - protein, 15 aa, Staphylococcus
HSNNQRHTNETEQIL

SEQ ID NO: 1912214 - protein, 5 aa, Staphylococcus
HTEYG

SEQ ID NO: 1912215 - protein, 5 aa, Staphylococcus
IAAGA

SEQ ID NO: 1912216 - protein, 5 aa, Staphylococcus
IARTG

SEQ ID NO: 1912217 - protein, 5 aa, Staphylococcus
IDASY

SEQ ID NO: 1912218 - protein, 5 aa, Staphylococcus
IDGMT

SEQ ID NO: 1912219 - protein, 9 aa, Staphylococcus
IDTTGAGDA

SEQ ID NO: 1912220 - protein, 5 aa, Staphylococcus
IEDGM

SEQ ID NO: 1912221 - protein, 6 aa, Staphylococcus
IEDSNY

SEQ ID NO: 1912222 - protein, 4 aa, Staphylococcus
IEGD

SEQ ID NO: 1912223 - protein, 8 aa, Staphylococcus
IENGDEAL

SEQ ID NO: 1912224 - protein, 4 aa, Staphylococcus
IEQE

SEQ ID NO: 1912225 - protein, 10 aa, Staphylococcus
IERGGAGGGI

SEQ ID NO: 1912226 - protein, 11 aa, Staphylococcus
IETKSNPNDLV

SEQ ID NO: 1912227 - protein, 4 aa, Staphylococcus
IETR

SEQ ID NO: 1912228 - protein, 5 aa, Staphylococcus
IEYGN

SEQ ID NO: 1912229 - protein, 7 aa, Staphylococcus
IGKKEGY

SEQ ID NO: 1912230 - protein, 9 aa, Staphylococcus
IGKKTAQNI

SEQ ID NO: 1912231 - protein, 4 aa, Staphylococcus
IGPC

SEQ ID NO: 1912232 - protein, 8 aa, Staphylococcus
IGPGGKKI

SEQ ID NO: 1912233 - protein, 6 aa, Staphylococcus
IGRTDL

SEQ ID NO: 1912234 - protein, 4 aa, Staphylococcus
IIQP

SEQ ID NO: 1912235 - protein, 10 aa, Staphylococcus
IKDEPAGEDC

SEQ ID NO: 1912236 - protein, 7 aa, Staphylococcus
IKEDDIK

SEQ ID NO: 1912237 - protein, 9 aa, Staphylococcus
IKKRGEDIE

SEQ ID NO: 1912238 - protein, 6 aa, Staphylococcus
IKSMGK

SEQ ID NO: 1912239 - protein, 12 aa, Staphylococcus
IPELPDERKAKY

SEQ ID NO: 1912240 - protein, 5 aa, Staphylococcus
IPPEI

SEQ ID NO: 1912241 - protein, 5 aa, Staphylococcus
IQKGD

SEQ ID NO: 1912242 - protein, 6 aa, Staphylococcus
IQNDGT

SEQ ID NO: 1912243 - protein, 9 aa, Staphylococcus
IQYDPNRSA

SEQ ID NO: 1912244 - protein, 10 aa, Staphylococcus
ISAGRANSNL

SEQ ID NO: 1912245 - protein, 6 aa, Staphylococcus
ISETGS

SEQ ID NO: 1912246 - protein, 11 aa, Staphylococcus
ISEYSAHNQRG

SEQ ID NO: 1912247 - protein, 12 aa, Staphylococcus
ISGGGAVYHDTG

SEQ ID NO: 1912248 - protein, 6 aa, Staphylococcus
ISHQDD

SEQ ID NO: 1912249 - protein, 6 aa, Staphylococcus
ISHSSA

SEQ ID NO: 1912250 - protein, 5 aa, Staphylococcus
ISPDT

SEQ ID NO: 1912251 - protein, 17 aa, Staphylococcus
ISSAPGSVSQVRESTQS

SEQ ID NO: 1912252 - protein, 4 aa, Staphylococcus
ITEE

SEQ ID NO: 1912253 - protein, 5 aa, Staphylococcus
ITESD

SEQ ID NO: 1912254 - protein, 4 aa, Staphylococcus
ITGA

SEQ ID NO: 1912255 - protein, 4 aa, Staphylococcus
ITGS

SEQ ID NO: 1912256 - protein, 4 aa, Staphylococcus
ITPA

SEQ ID NO: 1912257 - protein, 10 aa, Staphylococcus
ITPVPGGVGP

SEQ ID NO: 1912258 - protein, 5 aa, Staphylococcus
ITRTG

SEQ ID NO: 1912259 - protein, 8 aa, Staphylococcus
ITYSTNNE

SEQ ID NO: 1912260 - protein, 5 aa, Staphylococcus
IYDGT

SEQ ID NO: 1912261 - protein, 11 aa, Staphylococcus
KAAEKPGSEIQ

SEQ ID NO: 1912262 - protein, 24 aa, Staphylococcus
KAEKEGKIKPGDTIVEPTSGNTGI

SEQ ID NO: 1912263 - protein, 7 aa, Staphylococcus
KAFNPDG

SEQ ID NO: 1912264 - protein, 9 aa, Staphylococcus
KAGYKPGED

SEQ ID NO: 1912265 - protein, 7 aa, Staphylococcus
KAIEETA

SEQ ID NO: 1912266 - protein, 5 aa, Staphylococcus
KAKGF

SEQ ID NO: 1912267 - protein, 11 aa, Staphylococcus
KAKPASAKGTY

SEQ ID NO: 1912268 - protein, 17 aa, Staphylococcus
KAKYITGQTIHVNGGMY

SEQ ID NO: 1912269 - protein, 8 aa, Staphylococcus
KALGTGLG

SEQ ID NO: 1912270 - protein, 9 aa, Staphylococcus
KAPNTSSTI

SEQ ID NO: 1912271 - protein, 8 aa, Staphylococcus
KARDKKLG

SEQ ID NO: 1912272 - protein, 6 aa, Staphylococcus
KAREVI

SEQ ID NO: 1912273 - protein, 7 aa, Staphylococcus
KASYEAK

SEQ ID NO: 1912274 - protein, 17 aa, Staphylococcus
KDAAEKAKKDLSGVSQT

SEQ ID NO: 1912275 - protein, 7 aa, Staphylococcus
KDALQGK

SEQ ID NO: 1912276 - protein, 6 aa, Staphylococcus
KDANAS

SEQ ID NO: 1912277 - protein, 10 aa, Staphylococcus
KDGETALHPS

SEQ ID NO: 1912278 - protein, 9 aa, Staphylococcus
KDMQEDKEG

SEQ ID NO: 1912279 - protein, 6 aa, Staphylococcus
KDNGRL

SEQ ID NO: 1912280 - protein, 7 aa, Staphylococcus
KDPLTNK

SEQ ID NO: 1912281 - protein, 8 aa, Staphylococcus
KDPNDEKD

SEQ ID NO: 1912282 - protein, 6 aa, Staphylococcus
KDQIQG

SEQ ID NO: 1912283 - protein, 24 aa, Staphylococcus
KDSEDKLTSIKRQTESRRGGKGSR

SEQ ID NO: 1912284 - protein, 6 aa, Staphylococcus
KDVSPY

SEQ ID NO: 1912285 - protein, 6 aa, Staphylococcus
KEATGV

SEQ ID NO: 1912286 - protein, 12 aa, Staphylococcus
KEDLNKKAGLSQ

SEQ ID NO: 1912287 - protein, 8 aa, Staphylococcus
KEEAAELA

SEQ ID NO: 1912288 - protein, 6 aa, Staphylococcus
KEEHNA

SEQ ID NO: 1912289 - protein, 12 aa, Staphylococcus
KEFADKAAARFG

SEQ ID NO: 1912290 - protein, 6 aa, Staphylococcus
KEGQDI

SEQ ID NO: 1912291 - protein, 7 aa, Staphylococcus
KEGYFEQ

SEQ ID NO: 1912292 - protein, 5 aa, Staphylococcus
KELEE

SEQ ID NO: 1912293 - protein, 10 aa, Staphylococcus
KEQEQTTKSG

SEQ ID NO: 1912294 - protein, 7 aa, Staphylococcus
KEQPDAL

SEQ ID NO: 1912295 - protein, 7 aa, Staphylococcus
KESNVET

SEQ ID NO: 1912296 - protein, 10 aa, Staphylococcus
KETFEPIEPG

SEQ ID NO: 1912297 - protein, 4 aa, Staphylococcus
KEVK

SEQ ID NO: 1912298 - protein, 8 aa, Staphylococcus
KEVSDKTI

SEQ ID NO: 1912299 - protein, 9 aa, Staphylococcus
KFEDGTEVT

SEQ ID NO: 1912300 - protein, 10 aa, Staphylococcus
KGAAASNHFE

SEQ ID NO: 1912301 - protein, 9 aa, Staphylococcus
KGAFNEENP

SEQ ID NO: 1912302 - protein, 9 aa, Staphylococcus
KGDAKSVSI

SEQ ID NO: 1912303 - protein, 4 aa, Staphylococcus
KGET

SEQ ID NO: 1912304 - protein, 7 aa, Staphylococcus
KGGGGAL

SEQ ID NO: 1912305 - protein, 5 aa, Staphylococcus
KGIEP

SEQ ID NO: 1912306 - protein, 5 aa, Staphylococcus
KGIKG

SEQ ID NO: 1912307 - protein, 5 aa, Staphylococcus
KGNEA

SEQ ID NO: 1912308 - protein, 16 aa, Staphylococcus
KGPIGKGTAKATVDGQ

SEQ ID NO: 1912309 - protein, 9 aa, Staphylococcus
KGQSLGAVD

SEQ ID NO: 1912310 - protein, 4 aa, Staphylococcus
KGTE

SEQ ID NO: 1912311 - protein, 8 aa, Staphylococcus
KGTENKTY

SEQ ID NO: 1912312 - protein, 13 aa, Staphylococcus
KGYKAEGLHGDIT

SEQ ID NO: 1912313 - protein, 6 aa, Staphylococcus
KHERNR

SEQ ID NO: 1912314 - protein, 23 aa, Staphylococcus
KHIETPGSEITDTRGGSHNAPTR

SEQ ID NO: 1912315 - protein, 14 aa, Staphylococcus
KHNQVDDYPFGGGQ

SEQ ID NO: 1912316 - protein, 10 aa, Staphylococcus
KHSEHSGEDF

SEQ ID NO: 1912317 - protein, 11 aa, Staphylococcus
KIGYESEEAKD

SEQ ID NO: 1912318 - protein, 10 aa, Staphylococcus
KIRDTASSHA

SEQ ID NO: 1912319 - protein, 11 aa, Staphylococcus
KKAKELKEEHG

SEQ ID NO: 1912320 - protein, 8 aa, Staphylococcus
KKASYEQR

SEQ ID NO: 1912321 - protein, 8 aa, Staphylococcus
KKATSNPR

SEQ ID NO: 1912322 - protein, 5 aa, Staphylococcus
KKDGI

SEQ ID NO: 1912323 - protein, 9 aa, Staphylococcus
KKEKETEII

SEQ ID NO: 1912324 - protein, 10 aa, Staphylococcus
KKENGVDLSQ

SEQ ID NO: 1912325 - protein, 8 aa, Staphylococcus
KKIGEDAK

SEQ ID NO: 1912326 - protein, 7 aa, Staphylococcus
KKNEGRT

SEQ ID NO: 1912327 - protein, 6 aa, Staphylococcus
KKNPHR

SEQ ID NO: 1912328 - protein, 5 aa, Staphylococcus
KKNSQ

SEQ ID NO: 1912329 - protein, 4 aa, Staphylococcus
KKQF

SEQ ID NO: 1912330 - protein, 8 aa, Staphylococcus
KKQPPLKA

SEQ ID NO: 1912331 - protein, 8 aa, Staphylococcus
KKRGKKAV

SEQ ID NO: 1912332 - protein, 14 aa, Staphylococcus
KKRIAKGSGRSLQE

SEQ ID NO: 1912333 - protein, 6 aa, Staphylococcus
KKRLKE

SEQ ID NO: 1912334 - protein, 9 aa, Staphylococcus
KKRSEREAY

SEQ ID NO: 1912335 - protein, 7 aa, Staphylococcus
KKSQKVR

SEQ ID NO: 1912336 - protein, 6 aa, Staphylococcus
KKTPYL

SEQ ID NO: 1912337 - protein, 20 aa, Staphylococcus
KKYHPDINKEEGADEKFKEI

SEQ ID NO: 1912338 - protein, 6 aa, Staphylococcus
KKYSMG

SEQ ID NO: 1912339 - protein, 8 aa, Staphylococcus
KLDPTGYE

SEQ ID NO: 1912340 - protein, 8 aa, Staphylococcus
KLERGKRT

SEQ ID NO: 1912341 - protein, 6 aa, Staphylococcus
KLQQSD

SEQ ID NO: 1912342 - protein, 14 aa, Staphylococcus
KLTPAQSKNTEKNE

SEQ ID NO: 1912343 - protein, 15 aa, Staphylococcus
KLYQREDDNPETVSN

SEQ ID NO: 1912344 - protein, 4 aa, Staphylococcus
KMEE

SEQ ID NO: 1912345 - protein, 4 aa, Staphylococcus
KNDQ

SEQ ID NO: 1912346 - protein, 6 aa, Staphylococcus
KNGIER

SEQ ID NO: 1912347 - protein, 6 aa, Staphylococcus
KNGYYD

SEQ ID NO: 1912348 - protein, 7 aa, Staphylococcus
KNHEREA

SEQ ID NO: 1912349 - protein, 5 aa, Staphylococcus
KNKER

SEQ ID NO: 1912350 - protein, 13 aa, Staphylococcus
KNPRNKGVLDNGS

SEQ ID NO: 1912351 - protein, 9 aa, Staphylococcus
KNTGDRPIQ

SEQ ID NO: 1912352 - protein, 6 aa, Staphylococcus
KNVKKG

SEQ ID NO: 1912353 - protein, 7 aa, Staphylococcus
KPEFSSA

SEQ ID NO: 1912354 - protein, 9 aa, Staphylococcus
KPEHSRSNK

SEQ ID NO: 1912355 - protein, 6 aa, Staphylococcus
KPISDY

SEQ ID NO: 1912356 - protein, 6 aa, Staphylococcus
KPLSRQ

SEQ ID NO: 1912357 - protein, 7 aa, Staphylococcus
KPMDSEE

SEQ ID NO: 1912358 - protein, 5 aa, Staphylococcus
KPSAD

SEQ ID NO: 1912359 - protein, 4 aa, Staphylococcus
KQAR

SEQ ID NO: 1912360 - protein, 10 aa, Staphylococcus
KQLPKGRKPI

SEQ ID NO: 1912361 - protein, 7 aa, Staphylococcus
KQVDGED

SEQ ID NO: 1912362 - protein, 7 aa, Staphylococcus
KQVTPGD

SEQ ID NO: 1912363 - protein, 8 aa, Staphylococcus
KRGPATNP

SEQ ID NO: 1912364 - protein, 7 aa, Staphylococcus
KRGSNSV

SEQ ID NO: 1912365 - protein, 5 aa, Staphylococcus
KRLRN

SEQ ID NO: 1912366 - protein, 5 aa, Staphylococcus
KRQGT

SEQ ID NO: 1912367 - protein, 6 aa, Staphylococcus
KRRVDE

SEQ ID NO: 1912368 - protein, 10 aa, Staphylococcus
KRSNSGTCYN

SEQ ID NO: 1912369 - protein, 12 aa, Staphylococcus
KRVAGYAHEEGK

SEQ ID NO: 1912370 - protein, 11 aa, Staphylococcus
KSDDDHEMEEE

SEQ ID NO: 1912371 - protein, 8 aa, Staphylococcus
KSDTYDKV

SEQ ID NO: 1912372 - protein, 6 aa, Staphylococcus
KSFGKG

SEQ ID NO: 1912373 - protein, 4 aa, Staphylococcus
KSKF

SEQ ID NO: 1912374 - protein, 9 aa, Staphylococcus
KSNTKGYAS

SEQ ID NO: 1912375 - protein, 8 aa, Staphylococcus
KSPADVQK

SEQ ID NO: 1912376 - protein, 12 aa, Staphylococcus
KSPNDDNGYDIS

SEQ ID NO: 1912377 - protein, 10 aa, Staphylococcus
KSQANQKKLS

SEQ ID NO: 1912378 - protein, 7 aa, Staphylococcus
KSQLRTD

SEQ ID NO: 1912379 - protein, 9 aa, Staphylococcus
KTIPVRPGR

SEQ ID NO: 1912380 - protein, 11 aa, Staphylococcus
KTTDASAVTTP

SEQ ID NO: 1912381 - protein, 7 aa, Staphylococcus
KTVQEAK

SEQ ID NO: 1912382 - protein, 8 aa, Staphylococcus
KVEYRAEK

SEQ ID NO: 1912383 - protein, 13 aa, Staphylococcus
KVGGTVVQTEDEI

SEQ ID NO: 1912384 - protein, 7 aa, Staphylococcus
KVGRTTG

SEQ ID NO: 1912385 - protein, 12 aa, Staphylococcus
KVKPGTKLSNIG

SEQ ID NO: 1912386 - protein, 7 aa, Staphylococcus
KVNADED

SEQ ID NO: 1912387 - protein, 6 aa, Staphylococcus
KVNSGN

SEQ ID NO: 1912388 - protein, 7 aa, Staphylococcus
KVSKVSE

SEQ ID NO: 1912389 - protein, 5 aa, Staphylococcus
KYDKG

SEQ ID NO: 1912390 - protein, 6 aa, Staphylococcus
KYIDET

SEQ ID NO: 1912391 - protein, 13 aa, Staphylococcus
KYPEVNAEIDGDD

SEQ ID NO: 1912392 - protein, 18 aa, Staphylococcus
KYSKKYKTHDENNSAKLG

SEQ ID NO: 1912393 - protein, 12 aa, Staphylococcus
LAENRKARHDYN

SEQ ID NO: 1912394 - protein, 4 aa, Staphylococcus
LDKG

SEQ ID NO: 1912395 - protein, 18 aa, Staphylococcus
LDNNPQSVEDYKNGKGKA

SEQ ID NO: 1912396 - protein, 7 aa, Staphylococcus
LDTTTKN

SEQ ID NO: 1912397 - protein, 5 aa, Staphylococcus
LEAGE

SEQ ID NO: 1912398 - protein, 11 aa, Staphylococcus
LEKDGTENTEQ

SEQ ID NO: 1912399 - protein, 5 aa, Staphylococcus
LEPVE

SEQ ID NO: 1912400 - protein, 11 aa, Staphylococcus
LEQSLKEGYAQ

SEQ ID NO: 1912401 - protein, 5 aa, Staphylococcus
LETAV

SEQ ID NO: 1912402 - protein, 8 aa, Staphylococcus
LETQGSKF

SEQ ID NO: 1912403 - protein, 8 aa, Staphylococcus
LGAGKTTL

SEQ ID NO: 1912404 - protein, 9 aa, Staphylococcus
LGGMGGAQP

SEQ ID NO: 1912405 - protein, 9 aa, Staphylococcus
LGKKGSVSG

SEQ ID NO: 1912406 - protein, 5 aa, Staphylococcus
LGPEP

SEQ ID NO: 1912407 - protein, 6 aa, Staphylococcus
LGSTPY

SEQ ID NO: 1912408 - protein, 7 aa, Staphylococcus
LKDKGNT

SEQ ID NO: 1912409 - protein, 11 aa, Staphylococcus
LKGPLHGGANE

SEQ ID NO: 1912410 - protein, 7 aa, Staphylococcus
LKKGPQI

SEQ ID NO: 1912411 - protein, 5 aa, Staphylococcus
LLNDP

SEQ ID NO: 1912412 - protein, 8 aa, Staphylococcus
LNDVAPAR

SEQ ID NO: 1912413 - protein, 6 aa, Staphylococcus
LPDEPL

SEQ ID NO: 1912414 - protein, 18 aa, Staphylococcus
LPEGPKYYPDDQISDHPE

SEQ ID NO: 1912415 - protein, 13 aa, Staphylococcus
LPGKDVKLSTNEQ

SEQ ID NO: 1912416 - protein, 10 aa, Staphylococcus
LPKTNSGKIR

SEQ ID NO: 1912417 - protein, 8 aa, Staphylococcus
LPNAPQEK

SEQ ID NO: 1912418 - protein, 8 aa, Staphylococcus
LPTGSGKS

SEQ ID NO: 1912419 - protein, 12 aa, Staphylococcus
LQAEGQSPLDSL

SEQ ID NO: 1912420 - protein, 12 aa, Staphylococcus
LQAEGQSPLESL

SEQ ID NO: 1912421 - protein, 8 aa, Staphylococcus
LRADKKVD

SEQ ID NO: 1912422 - protein, 9 aa, Staphylococcus
LRDETSLRT

SEQ ID NO: 1912423 - protein, 5 aa, Staphylococcus
LREAG

SEQ ID NO: 1912424 - protein, 7 aa, Staphylococcus
LREHKDT

SEQ ID NO: 1912425 - protein, 5 aa, Staphylococcus
LRGVA

SEQ ID NO: 1912426 - protein, 5 aa, Staphylococcus
LRQAG

SEQ ID NO: 1912427 - protein, 8 aa, Staphylococcus
LRSETDER

SEQ ID NO: 1912428 - protein, 18 aa, Staphylococcus
LRTGAIQEKTFRAGEKVE

SEQ ID NO: 1912429 - protein, 7 aa, Staphylococcus
LSDVRKD

SEQ ID NO: 1912430 - protein, 15 aa, Staphylococcus
LSEQTEKLKELNNGE

SEQ ID NO: 1912431 - protein, 10 aa, Staphylococcus
LSEQTTHNGP

SEQ ID NO: 1912432 - protein, 7 aa, Staphylococcus
LSGAGKS

SEQ ID NO: 1912433 - protein, 6 aa, Staphylococcus
LSGDGI

SEQ ID NO: 1912434 - protein, 7 aa, Staphylococcus
LSGGEQK

SEQ ID NO: 1912435 - protein, 5 aa, Staphylococcus
LSGKN

SEQ ID NO: 1912436 - protein, 4 aa, Staphylococcus
LSHG

SEQ ID NO: 1912437 - protein, 7 aa, Staphylococcus
LSKDETH

SEQ ID NO: 1912438 - protein, 19 aa, Staphylococcus
LSNRGGKGIKTATITERNG

SEQ ID NO: 1912439 - protein, 12 aa, Staphylococcus
LSSEAEYQRGYG

SEQ ID NO: 1912440 - protein, 6 aa, Staphylococcus
LSTQSD

SEQ ID NO: 1912441 - protein, 8 aa, Staphylococcus
LSVGGDLE

SEQ ID NO: 1912442 - protein, 9 aa, Staphylococcus
LTEERRKEL

SEQ ID NO: 1912443 - protein, 11 aa, Staphylococcus
LTEQGADKAER

SEQ ID NO: 1912444 - protein, 7 aa, Staphylococcus
LTPGDKI

SEQ ID NO: 1912445 - protein, 10 aa, Staphylococcus
LTPSDTAQLN

SEQ ID NO: 1912446 - protein, 5 aa, Staphylococcus
LTSQE

SEQ ID NO: 1912447 - protein, 27 aa, Staphylococcus
LVSENKTLAHPASVDSIPSSANQEDHV

SEQ ID NO: 1912448 - protein, 4 aa, Staphylococcus
LYGD

SEQ ID NO: 1912449 - protein, 7 aa, Staphylococcus
MAEQDGQ

SEQ ID NO: 1912450 - protein, 12 aa, Staphylococcus
MENRDNSRTPMQ

SEQ ID NO: 1912451 - protein, 5 aa, Staphylococcus
MGGYG

SEQ ID NO: 1912452 - protein, 4 aa, Staphylococcus
MGPI

SEQ ID NO: 1912453 - protein, 6 aa, Staphylococcus
MNPETR

SEQ ID NO: 1912454 - protein, 4 aa, Staphylococcus
MNPN

SEQ ID NO: 1912455 - protein, 9 aa, Staphylococcus
MPDITKDKY

SEQ ID NO: 1912456 - protein, 6 aa, Staphylococcus
MPPPNV

SEQ ID NO: 1912457 - protein, 7 aa, Staphylococcus
MPPTGGL

SEQ ID NO: 1912458 - protein, 7 aa, Staphylococcus
MQGEPVE

SEQ ID NO: 1912459 - protein, 6 aa, Staphylococcus
MRKPTQ

SEQ ID NO: 1912460 - protein, 5 aa, Staphylococcus
MRQEI

SEQ ID NO: 1912461 - protein, 7 aa, Staphylococcus
NAAVGDS

SEQ ID NO: 1912462 - protein, 5 aa, Staphylococcus
NADGE

SEQ ID NO: 1912463 - protein, 6 aa, Staphylococcus
NADRKS

SEQ ID NO: 1912464 - protein, 8 aa, Staphylococcus
NADTDGLA

SEQ ID NO: 1912465 - protein, 6 aa, Staphylococcus
NANPQV

SEQ ID NO: 1912466 - protein, 6 aa, Staphylococcus
NAPDEQ

SEQ ID NO: 1912467 - protein, 7 aa, Staphylococcus
NAPNLVS

SEQ ID NO: 1912468 - protein, 7 aa, Staphylococcus
NARGDAN

SEQ ID NO: 1912469 - protein, 5 aa, Staphylococcus
NATES

SEQ ID NO: 1912470 - protein, 5 aa, Staphylococcus
NCDRD

SEQ ID NO: 1912471 - protein, 4 aa, Staphylococcus
NDEI

SEQ ID NO: 1912472 - protein, 5 aa, Staphylococcus
NDEQL

SEQ ID NO: 1912473 - protein, 4 aa, Staphylococcus
NDEV

SEQ ID NO: 1912474 - protein, 19 aa, Staphylococcus
NDGASQSYVNSKKKAAEKI

SEQ ID NO: 1912475 - protein, 7 aa, Staphylococcus
NDGYDAS

SEQ ID NO: 1912476 - protein, 6 aa, Staphylococcus
NDLKEG

SEQ ID NO: 1912477 - protein, 7 aa, Staphylococcus
NDRKYHP

SEQ ID NO: 1912478 - protein, 4 aa, Staphylococcus
NEEI

SEQ ID NO: 1912479 - protein, 4 aa, Staphylococcus
NEGV

SEQ ID NO: 1912480 - protein, 25 aa, Staphylococcus
NEKDSSDTDEKLNPNDLSAPPGVKI

SEQ ID NO: 1912481 - protein, 8 aa, Staphylococcus
NEMSDPQI

SEQ ID NO: 1912482 - protein, 9 aa, Staphylococcus
NENIDSKRF

SEQ ID NO: 1912483 - protein, 7 aa, Staphylococcus
NEPERDQ

SEQ ID NO: 1912484 - protein, 9 aa, Staphylococcus
NERRSNKDM

SEQ ID NO: 1912485 - protein, 9 aa, Staphylococcus
NFPSEAPGV

SEQ ID NO: 1912486 - protein, 9 aa, Staphylococcus
NFRTSSEAE

SEQ ID NO: 1912487 - protein, 6 aa, Staphylococcus
NGAEGI

SEQ ID NO: 1912488 - protein, 7 aa, Staphylococcus
NGDASLG

SEQ ID NO: 1912489 - protein, 15 aa, Staphylococcus
NGEEVKMSKRTGNAI

SEQ ID NO: 1912490 - protein, 6 aa, Staphylococcus
NGEFAD

SEQ ID NO: 1912491 - protein, 9 aa, Staphylococcus
NGETQVGEV

SEQ ID NO: 1912492 - protein, 4 aa, Staphylococcus
NGFP

SEQ ID NO: 1912493 - protein, 7 aa, Staphylococcus
NGIHSNG

SEQ ID NO: 1912494 - protein, 6 aa, Staphylococcus
NGITET

SEQ ID NO: 1912495 - protein, 5 aa, Staphylococcus
NGLKG

SEQ ID NO: 1912496 - protein, 8 aa, Staphylococcus
NGNKALSN

SEQ ID NO: 1912497 - protein, 8 aa, Staphylococcus
NGSGNVRA

SEQ ID NO: 1912498 - protein, 5 aa, Staphylococcus
NHDTP

SEQ ID NO: 1912499 - protein, 7 aa, Staphylococcus
NIHPKNE

SEQ ID NO: 1912500 - protein, 6 aa, Staphylococcus
NKAKNI

SEQ ID NO: 1912501 - protein, 6 aa, Staphylococcus
NKAQDV

SEQ ID NO: 1912502 - protein, 7 aa, Staphylococcus
NKEQTQE

SEQ ID NO: 1912503 - protein, 4 aa, Staphylococcus
NKGD

SEQ ID NO: 1912504 - protein, 8 aa, Staphylococcus
NKGRGYAL

SEQ ID NO: 1912505 - protein, 7 aa, Staphylococcus
NKINPEV

SEQ ID NO: 1912506 - protein, 6 aa, Staphylococcus
NKPAQG

SEQ ID NO: 1912507 - protein, 7 aa, Staphylococcus
NKSPYDG

SEQ ID NO: 1912508 - protein, 16 aa, Staphylococcus
NKSRHISSLSGGETFQ

SEQ ID NO: 1912509 - protein, 9 aa, Staphylococcus
NKVTEGSTV

SEQ ID NO: 1912510 - protein, 13 aa, Staphylococcus
NLATGEKVEVGEA

SEQ ID NO: 1912511 - protein, 7 aa, Staphylococcus
NLPNPLA

SEQ ID NO: 1912512 - protein, 8 aa, Staphylococcus
NLSQEDYF

SEQ ID NO: 1912513 - protein, 4 aa, Staphylococcus
NMGQ

SEQ ID NO: 1912514 - protein, 8 aa, Staphylococcus
NNAGTGHS

SEQ ID NO: 1912515 - protein, 14 aa, Staphylococcus
NNGSIDNDPPAAMR

SEQ ID NO: 1912516 - protein, 5 aa, Staphylococcus
NNIKG

SEQ ID NO: 1912517 - protein, 4 aa, Staphylococcus
NNIP

SEQ ID NO: 1912518 - protein, 4 aa, Staphylococcus
NNLK

SEQ ID NO: 1912519 - protein, 9 aa, Staphylococcus
NNPETVSTD

SEQ ID NO: 1912520 - protein, 9 aa, Staphylococcus
NPNDERYKD

SEQ ID NO: 1912521 - protein, 8 aa, Staphylococcus
NPQSKDYF

SEQ ID NO: 1912522 - protein, 9 aa, Staphylococcus
NPSTQQRDA

SEQ ID NO: 1912523 - protein, 5 aa, Staphylococcus
NPTEI

SEQ ID NO: 1912524 - protein, 5 aa, Staphylococcus
NPVPL

SEQ ID NO: 1912525 - protein, 8 aa, Staphylococcus
NQAGSLVE

SEQ ID NO: 1912526 - protein, 14 aa, Staphylococcus
NQDGYKSLEEGQSV

SEQ ID NO: 1912527 - protein, 9 aa, Staphylococcus
NQDTDNIGA

SEQ ID NO: 1912528 - protein, 11 aa, Staphylococcus
NQITEDNAHDI

SEQ ID NO: 1912529 - protein, 7 aa, Staphylococcus
NQPKGVG

SEQ ID NO: 1912530 - protein, 8 aa, Staphylococcus
NSEENKGK

SEQ ID NO: 1912531 - protein, 15 aa, Staphylococcus
NSPVNDLSRGCSTED

SEQ ID NO: 1912532 - protein, 5 aa, Staphylococcus
NSSMY

SEQ ID NO: 1912533 - protein, 7 aa, Staphylococcus
NTAEAHP

SEQ ID NO: 1912534 - protein, 7 aa, Staphylococcus
NTGRKGP

SEQ ID NO: 1912535 - protein, 6 aa, Staphylococcus
NTLQPS

SEQ ID NO: 1912536 - protein, 5 aa, Staphylococcus
NTLSE

SEQ ID NO: 1912537 - protein, 21 aa, Staphylococcus
NTTIPTSKSQVYSTAADNQPA

SEQ ID NO: 1912538 - protein, 10 aa, Staphylococcus
NVDDSRVGDT

SEQ ID NO: 1912539 - protein, 13 aa, Staphylococcus
NVNTENQIASAKA

SEQ ID NO: 1912540 - protein, 7 aa, Staphylococcus
NVSESTY

SEQ ID NO: 1912541 - protein, 11 aa, Staphylococcus
PAAEPERVKQE

SEQ ID NO: 1912542 - protein, 12 aa, Staphylococcus
PADVRAKEGITD

SEQ ID NO: 1912543 - protein, 6 aa, Staphylococcus
PAEDTV

SEQ ID NO: 1912544 - protein, 4 aa, Staphylococcus
PALR

SEQ ID NO: 1912545 - protein, 6 aa, Staphylococcus
PATEEV

SEQ ID NO: 1912546 - protein, 9 aa, Staphylococcus
PDAGKTTLT

SEQ ID NO: 1912547 - protein, 11 aa, Staphylococcus
PDNPANDDPKM

SEQ ID NO: 1912548 - protein, 8 aa, Staphylococcus
PDNSIKAA

SEQ ID NO: 1912549 - protein, 7 aa, Staphylococcus
PDPGYTD

SEQ ID NO: 1912550 - protein, 6 aa, Staphylococcus
PDTDAI

SEQ ID NO: 1912551 - protein, 4 aa, Staphylococcus
PDVR

SEQ ID NO: 1912552 - protein, 5 aa, Staphylococcus
PDVRD

SEQ ID NO: 1912553 - protein, 6 aa, Staphylococcus
PDYEPM

SEQ ID NO: 1912554 - protein, 7 aa, Staphylococcus
PEDGSLE

SEQ ID NO: 1912555 - protein, 8 aa, Staphylococcus
PEGEDERV

SEQ ID NO: 1912556 - protein, 6 aa, Staphylococcus
PEREIG

SEQ ID NO: 1912557 - protein, 10 aa, Staphylococcus
PGAVPRTSTI

SEQ ID NO: 1912558 - protein, 8 aa, Staphylococcus
PGDPKEIG

SEQ ID NO: 1912559 - protein, 6 aa, Staphylococcus
PGFGGQ

SEQ ID NO: 1912560 - protein, 9 aa, Staphylococcus
PGGVNSPVR

SEQ ID NO: 1912561 - protein, 6 aa, Staphylococcus
PGMGSL

SEQ ID NO: 1912562 - protein, 4 aa, Staphylococcus
PGSI

SEQ ID NO: 1912563 - protein, 11 aa, Staphylococcus
PGTGETVGTQL

SEQ ID NO: 1912564 - protein, 7 aa, Staphylococcus
PGTPPDL

SEQ ID NO: 1912565 - protein, 4 aa, Staphylococcus
PHRS

SEQ ID NO: 1912566 - protein, 7 aa, Staphylococcus
PIGASGA

SEQ ID NO: 1912567 - protein, 5 aa, Staphylococcus
PINES

SEQ ID NO: 1912568 - protein, 6 aa, Staphylococcus
PKDKPR

SEQ ID NO: 1912569 - protein, 6 aa, Staphylococcus
PKGPGH

SEQ ID NO: 1912570 - protein, 4 aa, Staphylococcus
PKKD

SEQ ID NO: 1912571 - protein, 5 aa, Staphylococcus
PKQVV

SEQ ID NO: 1912572 - protein, 7 aa, Staphylococcus
PKSIGVG

SEQ ID NO: 1912573 - protein, 5 aa, Staphylococcus
PKTAS

SEQ ID NO: 1912574 - protein, 5 aa, Staphylococcus
PKVAT

SEQ ID NO: 1912575 - protein, 7 aa, Staphylococcus
PKYEKKL

SEQ ID NO: 1912576 - protein, 8 aa, Staphylococcus
PLAESGIG

SEQ ID NO: 1912577 - protein, 6 aa, Staphylococcus
PLTRTP

SEQ ID NO: 1912578 - protein, 4 aa, Staphylococcus
PMGE

SEQ ID NO: 1912579 - protein, 6 aa, Staphylococcus
PNEAQD

SEQ ID NO: 1912580 - protein, 8 aa, Staphylococcus
PNGCARPA

SEQ ID NO: 1912581 - protein, 5 aa, Staphylococcus
PNPSM

SEQ ID NO: 1912582 - protein, 10 aa, Staphylococcus
PNSEEKGTVV

SEQ ID NO: 1912583 - protein, 5 aa, Staphylococcus
PNVVA

SEQ ID NO: 1912584 - protein, 12 aa, Staphylococcus
PPFTSEKAKEKV

SEQ ID NO: 1912585 - protein, 4 aa, Staphylococcus
PPGI

SEQ ID NO: 1912586 - protein, 9 aa, Staphylococcus
PPKAGKTSL

SEQ ID NO: 1912587 - protein, 6 aa, Staphylococcus
PPMPSE

SEQ ID NO: 1912588 - protein, 5 aa, Staphylococcus
PPNVT

SEQ ID NO: 1912589 - protein, 14 aa, Staphylococcus
PPQQADGNATNPEQ

SEQ ID NO: 1912590 - protein, 17 aa, Staphylococcus
PPSGRTLSGGLDPASLH

SEQ ID NO: 1912591 - protein, 4 aa, Staphylococcus
PPTA

SEQ ID NO: 1912592 - protein, 9 aa, Staphylococcus
PQDTESYTH

SEQ ID NO: 1912593 - protein, 10 aa, Staphylococcus
PQSPEVADGL

SEQ ID NO: 1912594 - protein, 18 aa, Staphylococcus
PSDIRAAGGVARSANPKI

SEQ ID NO: 1912595 - protein, 14 aa, Staphylococcus
PSFARNKKKTFSVQ

SEQ ID NO: 1912596 - protein, 4 aa, Staphylococcus
PSFE

SEQ ID NO: 1912597 - protein, 8 aa, Staphylococcus
PSPGHYTG

SEQ ID NO: 1912598 - protein, 6 aa, Staphylococcus
PSRNEG

SEQ ID NO: 1912599 - protein, 9 aa, Staphylococcus
PSSSHTAGA

SEQ ID NO: 1912600 - protein, 9 aa, Staphylococcus
PSYSPETIA

SEQ ID NO: 1912601 - protein, 17 aa, Staphylococcus
PTADLEDDKPQLPDEEA

SEQ ID NO: 1912602 - protein, 10 aa, Staphylococcus
PTETESKETL

SEQ ID NO: 1912603 - protein, 9 aa, Staphylococcus
PTFHDPSKA

SEQ ID NO: 1912604 - protein, 7 aa, Staphylococcus
PTGGGKS

SEQ ID NO: 1912605 - protein, 10 aa, Staphylococcus
PTGSMTKDER

SEQ ID NO: 1912606 - protein, 6 aa, Staphylococcus
PTNQTS

SEQ ID NO: 1912607 - protein, 4 aa, Staphylococcus
PTQS

SEQ ID NO: 1912608 - protein, 8 aa, Staphylococcus
PTSALDPI

SEQ ID NO: 1912609 - protein, 8 aa, Staphylococcus
PVGAGKTQ

SEQ ID NO: 1912610 - protein, 8 aa, Staphylococcus
PVGEPANI

SEQ ID NO: 1912611 - protein, 9 aa, Staphylococcus
QAEEKMERS

SEQ ID NO: 1912612 - protein, 5 aa, Staphylococcus
QAGDI

SEQ ID NO: 1912613 - protein, 9 aa, Staphylococcus
QAKSSISED

SEQ ID NO: 1912614 - protein, 8 aa, Staphylococcus
QATEAIPN

SEQ ID NO: 1912615 - protein, 17 aa, Staphylococcus
QDLGSREGIAKAKSEIT

SEQ ID NO: 1912616 - protein, 9 aa, Staphylococcus
QDTDSITPQ

SEQ ID NO: 1912617 - protein, 8 aa, Staphylococcus
QDTQPEDI

SEQ ID NO: 1912618 - protein, 6 aa, Staphylococcus
QDVPAG

SEQ ID NO: 1912619 - protein, 8 aa, Staphylococcus
QEEPKNQG

SEQ ID NO: 1912620 - protein, 8 aa, Staphylococcus
QEKAKKSL

SEQ ID NO: 1912621 - protein, 6 aa, Staphylococcus
QERPTT

SEQ ID NO: 1912622 - protein, 11 aa, Staphylococcus
QFNPGGSVKDR

SEQ ID NO: 1912623 - protein, 5 aa, Staphylococcus
QGATS

SEQ ID NO: 1912624 - protein, 5 aa, Staphylococcus
QGEMK

SEQ ID NO: 1912625 - protein, 4 aa, Staphylococcus
QGKQ

SEQ ID NO: 1912626 - protein, 7 aa, Staphylococcus
QGLTPEG

SEQ ID NO: 1912627 - protein, 14 aa, Staphylococcus
QGMTPDKPYKKSAR

SEQ ID NO: 1912628 - protein, 7 aa, Staphylococcus
QGNPSLQ

SEQ ID NO: 1912629 - protein, 6 aa, Staphylococcus
QGQFRK

SEQ ID NO: 1912630 - protein, 4 aa, Staphylococcus
QGRI

SEQ ID NO: 1912631 - protein, 7 aa, Staphylococcus
QIEGTEA

SEQ ID NO: 1912632 - protein, 19 aa, Staphylococcus
QIPAGAPFGGYKKSGIGRE

SEQ ID NO: 1912633 - protein, 12 aa, Staphylococcus
QKAAANVGLEPE

SEQ ID NO: 1912634 - protein, 10 aa, Staphylococcus
QKTETREVEE

SEQ ID NO: 1912635 - protein, 17 aa, Staphylococcus
QKTNANPVITSGHPDFT

SEQ ID NO: 1912636 - protein, 10 aa, Staphylococcus
QKVENKNEIA

SEQ ID NO: 1912637 - protein, 4 aa, Staphylococcus
QLEN

SEQ ID NO: 1912638 - protein, 6 aa, Staphylococcus
QLNENQ

SEQ ID NO: 1912639 - protein, 4 aa, Staphylococcus
QMQG

SEQ ID NO: 1912640 - protein, 6 aa, Staphylococcus
QNATSS

SEQ ID NO: 1912641 - protein, 5 aa, Staphylococcus
QNQDM

SEQ ID NO: 1912642 - protein, 5 aa, Staphylococcus
QPDFP

SEQ ID NO: 1912643 - protein, 14 aa, Staphylococcus
QPGGSIKDQDSIDM

SEQ ID NO: 1912644 - protein, 4 aa, Staphylococcus
QPQV

SEQ ID NO: 1912645 - protein, 5 aa, Staphylococcus
QPVDE

SEQ ID NO: 1912646 - protein, 12 aa, Staphylococcus
QQDIGSDTSTAI

SEQ ID NO: 1912647 - protein, 10 aa, Staphylococcus
QQGEGIESTG

SEQ ID NO: 1912648 - protein, 8 aa, Staphylococcus
QQGRTVQQ

SEQ ID NO: 1912649 - protein, 5 aa, Staphylococcus
QQNQT

SEQ ID NO: 1912650 - protein, 7 aa, Staphylococcus
QQQNQNY

SEQ ID NO: 1912651 - protein, 10 aa, Staphylococcus
QQRQESKNVS

SEQ ID NO: 1912652 - protein, 5 aa, Staphylococcus
QQSEW

SEQ ID NO: 1912653 - protein, 6 aa, Staphylococcus
QRDNDR

SEQ ID NO: 1912654 - protein, 4 aa, Staphylococcus
QREN

SEQ ID NO: 1912655 - protein, 11 aa, Staphylococcus
QRGGSPSGADR

SEQ ID NO: 1912656 - protein, 10 aa, Staphylococcus
QRGNEKARER

SEQ ID NO: 1912657 - protein, 7 aa, Staphylococcus
QRHDTEI

SEQ ID NO: 1912658 - protein, 27 aa, Staphylococcus
QSAEKIVETAKRSGADVSGPIPLPTEK

SEQ ID NO: 1912659 - protein, 10 aa, Staphylococcus
QSAKSLRGSK

SEQ ID NO: 1912660 - protein, 9 aa, Staphylococcus
QSISPGLRK

SEQ ID NO: 1912661 - protein, 7 aa, Staphylococcus
QSLHEAP

SEQ ID NO: 1912662 - protein, 10 aa, Staphylococcus
QSLTDKPVKG

SEQ ID NO: 1912663 - protein, 4 aa, Staphylococcus
QSPG

SEQ ID NO: 1912664 - protein, 4 aa, Staphylococcus
QSPK

SEQ ID NO: 1912665 - protein, 5 aa, Staphylococcus
QSPLA

SEQ ID NO: 1912666 - protein, 6 aa, Staphylococcus
QSPYNV

SEQ ID NO: 1912667 - protein, 4 aa, Staphylococcus
QSQV

SEQ ID NO: 1912668 - protein, 4 aa, Staphylococcus
QSTF

SEQ ID NO: 1912669 - protein, 6 aa, Staphylococcus
QTEEEE

SEQ ID NO: 1912670 - protein, 5 aa, Staphylococcus
QTISS

SEQ ID NO: 1912671 - protein, 5 aa, Staphylococcus
QYNVN

SEQ ID NO: 1912672 - protein, 9 aa, Staphylococcus
RAEKSKTRR

SEQ ID NO: 1912673 - protein, 8 aa, Staphylococcus
RALTTKYD

SEQ ID NO: 1912674 - protein, 6 aa, Staphylococcus
RANGQT

SEQ ID NO: 1912675 - protein, 15 aa, Staphylococcus
RAQHNDAVGPTKGGV

SEQ ID NO: 1912676 - protein, 7 aa, Staphylococcus
RARGEAI

SEQ ID NO: 1912677 - protein, 6 aa, Staphylococcus
RARQSC

SEQ ID NO: 1912678 - protein, 5 aa, Staphylococcus
RASAA

SEQ ID NO: 1912679 - protein, 5 aa, Staphylococcus
RDKEI

SEQ ID NO: 1912680 - protein, 8 aa, Staphylococcus
RDQSEVEK

SEQ ID NO: 1912681 - protein, 9 aa, Staphylococcus
RDRRQRKRD

SEQ ID NO: 1912682 - protein, 6 aa, Staphylococcus
RDSQKG

SEQ ID NO: 1912683 - protein, 8 aa, Staphylococcus
RDTRVSGE

SEQ ID NO: 1912684 - protein, 17 aa, Staphylococcus
REAGTVKGKKTGKFATS

SEQ ID NO: 1912685 - protein, 5 aa, Staphylococcus
REDSY

SEQ ID NO: 1912686 - protein, 5 aa, Staphylococcus
REESE

SEQ ID NO: 1912687 - protein, 6 aa, Staphylococcus
REIPDA

SEQ ID NO: 1912688 - protein, 12 aa, Staphylococcus
RELSGPVATTYT

SEQ ID NO: 1912689 - protein, 5 aa, Staphylococcus
REPIE

SEQ ID NO: 1912690 - protein, 4 aa, Staphylococcus
REQS

SEQ ID NO: 1912691 - protein, 4 aa, Staphylococcus
RERG

SEQ ID NO: 1912692 - protein, 12 aa, Staphylococcus
REVEGKYTGDYL

SEQ ID NO: 1912693 - protein, 6 aa, Staphylococcus
REVGQN

SEQ ID NO: 1912694 - protein, 6 aa, Staphylococcus
RFDEEN

SEQ ID NO: 1912695 - protein, 16 aa, Staphylococcus
RGDADAMITGGTEAPI

SEQ ID NO: 1912696 - protein, 9 aa, Staphylococcus
RGEKTMEDR

SEQ ID NO: 1912697 - protein, 5 aa, Staphylococcus
RGESY

SEQ ID NO: 1912698 - protein, 4 aa, Staphylococcus
RGGE

SEQ ID NO: 1912699 - protein, 7 aa, Staphylococcus
RGGEEAE

SEQ ID NO: 1912700 - protein, 6 aa, Staphylococcus
RGGGSI

SEQ ID NO: 1912701 - protein, 11 aa, Staphylococcus
RGKERSRRPED

SEQ ID NO: 1912702 - protein, 5 aa, Staphylococcus
RGMAE

SEQ ID NO: 1912703 - protein, 9 aa, Staphylococcus
RGPSGIGKT

SEQ ID NO: 1912704 - protein, 5 aa, Staphylococcus
RGRKQ

SEQ ID NO: 1912705 - protein, 4 aa, Staphylococcus
RGSL

SEQ ID NO: 1912706 - protein, 4 aa, Staphylococcus
RGVE

SEQ ID NO: 1912707 - protein, 12 aa, Staphylococcus
RGVEQRQDKRPM

SEQ ID NO: 1912708 - protein, 6 aa, Staphylococcus
RGYRRE

SEQ ID NO: 1912709 - protein, 4 aa, Staphylococcus
RHYG

SEQ ID NO: 1912710 - protein, 13 aa, Staphylococcus
RIAKKSGEEIKSN

SEQ ID NO: 1912711 - protein, 11 aa, Staphylococcus
RIEAGEQKEDA

SEQ ID NO: 1912712 - protein, 4 aa, Staphylococcus
RIEK

SEQ ID NO: 1912713 - protein, 12 aa, Staphylococcus
RKDGKYGLIETT

SEQ ID NO: 1912714 - protein, 6 aa, Staphylococcus
RKEMSK

SEQ ID NO: 1912715 - protein, 12 aa, Staphylococcus
RKIAGSAQTRQK

SEQ ID NO: 1912716 - protein, 8 aa, Staphylococcus
RKIGPKDR

SEQ ID NO: 1912717 - protein, 10 aa, Staphylococcus
RKNDKHQTSE

SEQ ID NO: 1912718 - protein, 5 aa, Staphylococcus
RKPIE

SEQ ID NO: 1912719 - protein, 5 aa, Staphylococcus
RLASE

SEQ ID NO: 1912720 - protein, 6 aa, Staphylococcus
RLDDDG

SEQ ID NO: 1912721 - protein, 6 aa, Staphylococcus
RLEDRP

SEQ ID NO: 1912722 - protein, 9 aa, Staphylococcus
RLNNDDSVS

SEQ ID NO: 1912723 - protein, 12 aa, Staphylococcus
RLQEGKDDSLEG

SEQ ID NO: 1912724 - protein, 10 aa, Staphylococcus
RLRNDEAVER

SEQ ID NO: 1912725 - protein, 5 aa, Staphylococcus
RLTEP

SEQ ID NO: 1912726 - protein, 8 aa, Staphylococcus
RLTGKPGV

SEQ ID NO: 1912727 - protein, 9 aa, Staphylococcus
RNGAGKTTT

SEQ ID NO: 1912728 - protein, 9 aa, Staphylococcus
RNGKRTARA

SEQ ID NO: 1912729 - protein, 5 aa, Staphylococcus
RNHTE

SEQ ID NO: 1912730 - protein, 7 aa, Staphylococcus
RNITSEM

SEQ ID NO: 1912731 - protein, 9 aa, Staphylococcus
RNKDGITAK

SEQ ID NO: 1912732 - protein, 4 aa, Staphylococcus
RPAE

SEQ ID NO: 1912733 - protein, 8 aa, Staphylococcus
RPANDPAL

SEQ ID NO: 1912734 - protein, 15 aa, Staphylococcus
RPDAGAKRAAEAENV

SEQ ID NO: 1912735 - protein, 5 aa, Staphylococcus
RPDCL

SEQ ID NO: 1912736 - protein, 16 aa, Staphylococcus
RPDEKRVTERAYENPR

SEQ ID NO: 1912737 - protein, 4 aa, Staphylococcus
RPET

SEQ ID NO: 1912738 - protein, 5 aa, Staphylococcus
RPETE

SEQ ID NO: 1912739 - protein, 6 aa, Staphylococcus
RPGSVT

SEQ ID NO: 1912740 - protein, 4 aa, Staphylococcus
RPGY

SEQ ID NO: 1912741 - protein, 5 aa, Staphylococcus
RPPGH

SEQ ID NO: 1912742 - protein, 7 aa, Staphylococcus
RQAGKEH

SEQ ID NO: 1912743 - protein, 9 aa, Staphylococcus
RQGGYGRGR

SEQ ID NO: 1912744 - protein, 5 aa, Staphylococcus
RQGTP

SEQ ID NO: 1912745 - protein, 12 aa, Staphylococcus
RQKGSAGGHNGM

SEQ ID NO: 1912746 - protein, 6 aa, Staphylococcus
RQQVRD

SEQ ID NO: 1912747 - protein, 6 aa, Staphylococcus
RRDQHN

SEQ ID NO: 1912748 - protein, 6 aa, Staphylococcus
RRGTTL

SEQ ID NO: 1912749 - protein, 24 aa, Staphylococcus
RRKDSKRKKGHRQPYTKLTIDKIN

SEQ ID NO: 1912750 - protein, 5 aa, Staphylococcus
RRNET

SEQ ID NO: 1912751 - protein, 7 aa, Staphylococcus
RRNSAIP

SEQ ID NO: 1912752 - protein, 7 aa, Staphylococcus
RRPKPNV

SEQ ID NO: 1912753 - protein, 9 aa, Staphylococcus
RRPNTDELG

SEQ ID NO: 1912754 - protein, 13 aa, Staphylococcus
RSEAGSAGRDTRG

SEQ ID NO: 1912755 - protein, 13 aa, Staphylococcus
RSGDYARNNKQLR

SEQ ID NO: 1912756 - protein, 5 aa, Staphylococcus
RSNDP

SEQ ID NO: 1912757 - protein, 7 aa, Staphylococcus
RTAYEKK

SEQ ID NO: 1912758 - protein, 7 aa, Staphylococcus
RTCAGTN

SEQ ID NO: 1912759 - protein, 8 aa, Staphylococcus
RVAPSVAR

SEQ ID NO: 1912760 - protein, 8 aa, Staphylococcus
RVGRSEHQ

SEQ ID NO: 1912761 - protein, 18 aa, Staphylococcus
SAEADAFKGKISNESPMA

SEQ ID NO: 1912762 - protein, 10 aa, Staphylococcus
SAGGASGEAY

SEQ ID NO: 1912763 - protein, 4 aa, Staphylococcus
SAGS

SEQ ID NO: 1912764 - protein, 4 aa, Staphylococcus
SAGV

SEQ ID NO: 1912765 - protein, 4 aa, Staphylococcus
SAQK

SEQ ID NO: 1912766 - protein, 5 aa, Staphylococcus
SDEQG

SEQ ID NO: 1912767 - protein, 4 aa, Staphylococcus
SDID

SEQ ID NO: 1912768 - protein, 6 aa, Staphylococcus
SDKLSI

SEQ ID NO: 1912769 - protein, 8 aa, Staphylococcus
SDQRLTKP

SEQ ID NO: 1912770 - protein, 4 aa, Staphylococcus
SDRL

SEQ ID NO: 1912771 - protein, 8 aa, Staphylococcus
SDRPPKEI

SEQ ID NO: 1912772 - protein, 8 aa, Staphylococcus
SDSHPFYT

SEQ ID NO: 1912773 - protein, 16 aa, Staphylococcus
SEELTEESESKRPSVQ

SEQ ID NO: 1912774 - protein, 11 aa, Staphylococcus
SEGDQVKPQQI

SEQ ID NO: 1912775 - protein, 7 aa, Staphylococcus
SEGRNRQ

SEQ ID NO: 1912776 - protein, 8 aa, Staphylococcus
SEGYGPNE

SEQ ID NO: 1912777 - protein, 5 aa, Staphylococcus
SEHLE

SEQ ID NO: 1912778 - protein, 6 aa, Staphylococcus
SETEQL

SEQ ID NO: 1912779 - protein, 6 aa, Staphylococcus
SEVETN

SEQ ID NO: 1912780 - protein, 6 aa, Staphylococcus
SFQETT

SEQ ID NO: 1912781 - protein, 11 aa, Staphylococcus
SFTGSTDVGYG

SEQ ID NO: 1912782 - protein, 9 aa, Staphylococcus
SGATESNNI

SEQ ID NO: 1912783 - protein, 9 aa, Staphylococcus
SGETGAGKS

SEQ ID NO: 1912784 - protein, 6 aa, Staphylococcus
SGGEKQ

SEQ ID NO: 1912785 - protein, 24 aa, Staphylococcus
SGGEVGALTGPSLMPGGQEAAYNK

SEQ ID NO: 1912786 - protein, 8 aa, Staphylococcus
SGGGNTAL

SEQ ID NO: 1912787 - protein, 5 aa, Staphylococcus
SGGLG

SEQ ID NO: 1912788 - protein, 7 aa, Staphylococcus
SGGNSSM

SEQ ID NO: 1912789 - protein, 5 aa, Staphylococcus
SGGTL

SEQ ID NO: 1912790 - protein, 9 aa, Staphylococcus
SGIAAPAYA

SEQ ID NO: 1912791 - protein, 8 aa, Staphylococcus
SGINGEIR

SEQ ID NO: 1912792 - protein, 10 aa, Staphylococcus
SGKGGVGKST

SEQ ID NO: 1912793 - protein, 6 aa, Staphylococcus
SGKSEE

SEQ ID NO: 1912794 - protein, 4 aa, Staphylococcus
SGQR

SEQ ID NO: 1912795 - protein, 10 aa, Staphylococcus
SGSGKSTVSV

SEQ ID NO: 1912796 - protein, 7 aa, Staphylococcus
SGSSRKI

SEQ ID NO: 1912797 - protein, 16 aa, Staphylococcus
SGTAAANYTPAIAESQ

SEQ ID NO: 1912798 - protein, 5 aa, Staphylococcus
SGTEA

SEQ ID NO: 1912799 - protein, 6 aa, Staphylococcus
SGTSVL

SEQ ID NO: 1912800 - protein, 13 aa, Staphylococcus
SGTTGPQKAVPQT

SEQ ID NO: 1912801 - protein, 5 aa, Staphylococcus
SHRMP

SEQ ID NO: 1912802 - protein, 7 aa, Staphylococcus
SHTATHG

SEQ ID NO: 1912803 - protein, 7 aa, Staphylococcus
SKAGITV

SEQ ID NO: 1912804 - protein, 10 aa, Staphylococcus
SKAGNSGQIP

SEQ ID NO: 1912805 - protein, 11 aa, Staphylococcus
SKAYQSTTGIA

SEQ ID NO: 1912806 - protein, 16 aa, Staphylococcus
SKDASKDEIKKAYRKL

SEQ ID NO: 1912807 - protein, 8 aa, Staphylococcus
SKDSTQRY

SEQ ID NO: 1912808 - protein, 9 aa, Staphylococcus
SKEPGTIEP

SEQ ID NO: 1912809 - protein, 5 aa, Staphylococcus
SKGLT

SEQ ID NO: 1912810 - protein, 9 aa, Staphylococcus
SKKNRAVLE

SEQ ID NO: 1912811 - protein, 17 aa, Staphylococcus
SKLAGTERGVTEPEPSF

SEQ ID NO: 1912812 - protein, 6 aa, Staphylococcus
SLNEGA

SEQ ID NO: 1912813 - protein, 5 aa, Staphylococcus
SLNRQ

SEQ ID NO: 1912814 - protein, 9 aa, Staphylococcus
SMAGRGTDI

SEQ ID NO: 1912815 - protein, 4 aa, Staphylococcus
SNPF

SEQ ID NO: 1912816 - protein, 10 aa, Staphylococcus
SPEPSYMPGY

SEQ ID NO: 1912817 - protein, 5 aa, Staphylococcus
SPEQI

SEQ ID NO: 1912818 - protein, 9 aa, Staphylococcus
SPFGEGRPG

SEQ ID NO: 1912819 - protein, 9 aa, Staphylococcus
SPGPGHPLD

SEQ ID NO: 1912820 - protein, 12 aa, Staphylococcus
SPIGTGRGINNP

SEQ ID NO: 1912821 - protein, 18 aa, Staphylococcus
SPKPKDAPGFPVRAFAIK

SEQ ID NO: 1912822 - protein, 5 aa, Staphylococcus
SPLSE

SEQ ID NO: 1912823 - protein, 4 aa, Staphylococcus
SPNE

SEQ ID NO: 1912824 - protein, 5 aa, Staphylococcus
SPQAF

SEQ ID NO: 1912825 - protein, 11 aa, Staphylococcus
SPVQGSEQGGV

SEQ ID NO: 1912826 - protein, 4 aa, Staphylococcus
SQGV

SEQ ID NO: 1912827 - protein, 6 aa, Staphylococcus
SQPREV

SEQ ID NO: 1912828 - protein, 10 aa, Staphylococcus
SQSEGSDPAA

SEQ ID NO: 1912829 - protein, 5 aa, Staphylococcus
SQSLK

SEQ ID NO: 1912830 - protein, 4 aa, Staphylococcus
SRAN

SEQ ID NO: 1912831 - protein, 10 aa, Staphylococcus
SREDANLSPV

SEQ ID NO: 1912832 - protein, 8 aa, Staphylococcus
SRTSKTPL

SEQ ID NO: 1912833 - protein, 18 aa, Staphylococcus
SSGVTGENIHVDSGFHAI

SEQ ID NO: 1912834 - protein, 7 aa, Staphylococcus
SSPYDAK

SEQ ID NO: 1912835 - protein, 8 aa, Staphylococcus
SSSAKGQE

SEQ ID NO: 1912836 - protein, 9 aa, Staphylococcus
SSSAKSKIK

SEQ ID NO: 1912837 - protein, 8 aa, Staphylococcus
SSSQYGGC

SEQ ID NO: 1912838 - protein, 6 aa, Staphylococcus
SSTARA

SEQ ID NO: 1912839 - protein, 4 aa, Staphylococcus
SSTI

SEQ ID NO: 1912840 - protein, 6 aa, Staphylococcus
STDKRG

SEQ ID NO: 1912841 - protein, 9 aa, Staphylococcus
STGGSSITA

SEQ ID NO: 1912842 - protein, 5 aa, Staphylococcus
STNAL

SEQ ID NO: 1912843 - protein, 5 aa, Staphylococcus
STNQV

SEQ ID NO: 1912844 - protein, 6 aa, Staphylococcus
STSERG

SEQ ID NO: 1912845 - protein, 7 aa, Staphylococcus
STTGRYT

SEQ ID NO: 1912846 - protein, 9 aa, Staphylococcus
SVDPAANPY

SEQ ID NO: 1912847 - protein, 5 aa, Staphylococcus
SVGKS

SEQ ID NO: 1912848 - protein, 7 aa, Staphylococcus
SVQSEEM

SEQ ID NO: 1912849 - protein, 5 aa, Staphylococcus
SVSDF

SEQ ID NO: 1912850 - protein, 11 aa, Staphylococcus
SVTEGTDAQAE

SEQ ID NO: 1912851 - protein, 6 aa, Staphylococcus
TAAGGS

SEQ ID NO: 1912852 - protein, 8 aa, Staphylococcus
TADASGVD

SEQ ID NO: 1912853 - protein, 8 aa, Staphylococcus
TADPFDEL

SEQ ID NO: 1912854 - protein, 5 aa, Staphylococcus
TAGAN

SEQ ID NO: 1912855 - protein, 9 aa, Staphylococcus
TAGASGGVT

SEQ ID NO: 1912856 - protein, 10 aa, Staphylococcus
TAHREHASNV

SEQ ID NO: 1912857 - protein, 6 aa, Staphylococcus
TALSSK

SEQ ID NO: 1912858 - protein, 9 aa, Staphylococcus
TAPGHGEDD

SEQ ID NO: 1912859 - protein, 7 aa, Staphylococcus
TAPPHLE

SEQ ID NO: 1912860 - protein, 13 aa, Staphylococcus
TAQASSPTEGLGF

SEQ ID NO: 1912861 - protein, 4 aa, Staphylococcus
TARK

SEQ ID NO: 1912862 - protein, 11 aa, Staphylococcus
TAVRNNGGGHL

SEQ ID NO: 1912863 - protein, 4 aa, Staphylococcus
TCTG

SEQ ID NO: 1912864 - protein, 4 aa, Staphylococcus
TDAK

SEQ ID NO: 1912865 - protein, 5 aa, Staphylococcus
TDCSG

SEQ ID NO: 1912866 - protein, 5 aa, Staphylococcus
TDDAR

SEQ ID NO: 1912867 - protein, 4 aa, Staphylococcus
TDGF

SEQ ID NO: 1912868 - protein, 7 aa, Staphylococcus
TDLGENC

SEQ ID NO: 1912869 - protein, 4 aa, Staphylococcus
TDSG

SEQ ID NO: 1912870 - protein, 8 aa, Staphylococcus
TEARKHGK

SEQ ID NO: 1912871 - protein, 5 aa, Staphylococcus
TEDAI

SEQ ID NO: 1912872 - protein, 4 aa, Staphylococcus
TEDI

SEQ ID NO: 1912873 - protein, 18 aa, Staphylococcus
TEGISTTKIKQELYGKDA

SEQ ID NO: 1912874 - protein, 9 aa, Staphylococcus
TEGSIEPKN

SEQ ID NO: 1912875 - protein, 6 aa, Staphylococcus
TEKFNG

SEQ ID NO: 1912876 - protein, 7 aa, Staphylococcus
TERDEAE

SEQ ID NO: 1912877 - protein, 6 aa, Staphylococcus
TETARD

SEQ ID NO: 1912878 - protein, 25 aa, Staphylococcus
TETEPGIKGDTATGATKSATVETGY

SEQ ID NO: 1912879 - protein, 7 aa, Staphylococcus
TEYAGEM

SEQ ID NO: 1912880 - protein, 7 aa, Staphylococcus
TFEERGE

SEQ ID NO: 1912881 - protein, 15 aa, Staphylococcus
TFPDGTKLITVHHPI

SEQ ID NO: 1912882 - protein, 8 aa, Staphylococcus
TFSTTSLK

SEQ ID NO: 1912883 - protein, 20 aa, Staphylococcus
TGAEYKKIGVPGEQELGGRG

SEQ ID NO: 1912884 - protein, 13 aa, Staphylococcus
TGELKNKKGVNLP

SEQ ID NO: 1912885 - protein, 9 aa, Staphylococcus
TGGTGIAQR

SEQ ID NO: 1912886 - protein, 6 aa, Staphylococcus
TGHGVG

SEQ ID NO: 1912887 - protein, 5 aa, Staphylococcus
TGIDT

SEQ ID NO: 1912888 - protein, 6 aa, Staphylococcus
TGIGGE

SEQ ID NO: 1912889 - protein, 8 aa, Staphylococcus
TGKGQAVN

SEQ ID NO: 1912890 - protein, 5 aa, Staphylococcus
TGNTK

SEQ ID NO: 1912891 - protein, 10 aa, Staphylococcus
TGQTYTSGIK

SEQ ID NO: 1912892 - protein, 10 aa, Staphylococcus
TGSGKTLTSF

SEQ ID NO: 1912893 - protein, 22 aa, Staphylococcus
TGTDEHGQKIQEKAQKAGKTEL

SEQ ID NO: 1912894 - protein, 5 aa, Staphylococcus
TGTTL

SEQ ID NO: 1912895 - protein, 11 aa, Staphylococcus
THGEGDPPDNA

SEQ ID NO: 1912896 - protein, 6 aa, Staphylococcus
THPTNH

SEQ ID NO: 1912897 - protein, 5 aa, Staphylococcus
TIDPT

SEQ ID NO: 1912898 - protein, 4 aa, Staphylococcus
TISK

SEQ ID NO: 1912899 - protein, 5 aa, Staphylococcus
TKAMP

SEQ ID NO: 1912900 - protein, 10 aa, Staphylococcus
TKGEPGTGNI

SEQ ID NO: 1912901 - protein, 9 aa, Staphylococcus
TKKGVDRKK

SEQ ID NO: 1912902 - protein, 9 aa, Staphylococcus
TKSKVRRER

SEQ ID NO: 1912903 - protein, 9 aa, Staphylococcus
TKSTPEGAR

SEQ ID NO: 1912904 - protein, 6 aa, Staphylococcus
TLAENS

SEQ ID NO: 1912905 - protein, 9 aa, Staphylococcus
TLDQETLET

SEQ ID NO: 1912906 - protein, 7 aa, Staphylococcus
TLGGQTG

SEQ ID NO: 1912907 - protein, 5 aa, Staphylococcus
TLKTN

SEQ ID NO: 1912908 - protein, 4 aa, Staphylococcus
TLNE

SEQ ID NO: 1912909 - protein, 21 aa, Staphylococcus
TNDQKNIDNPHKDLRRARSCN

SEQ ID NO: 1912910 - protein, 7 aa, Staphylococcus
TNSKFDR

SEQ ID NO: 1912911 - protein, 11 aa, Staphylococcus
TPEIGQGRGPV

SEQ ID NO: 1912912 - protein, 9 aa, Staphylococcus
TPGHSPGSL

SEQ ID NO: 1912913 - protein, 4 aa, Staphylococcus
TPGR

SEQ ID NO: 1912914 - protein, 4 aa, Staphylococcus
TPIP

SEQ ID NO: 1912915 - protein, 5 aa, Staphylococcus
TPKHL

SEQ ID NO: 1912916 - protein, 5 aa, Staphylococcus
TPKLK

SEQ ID NO: 1912917 - protein, 7 aa, Staphylococcus
TPPGSFG

SEQ ID NO: 1912918 - protein, 4 aa, Staphylococcus
TPTG

SEQ ID NO: 1912919 - protein, 5 aa, Staphylococcus
TPTIE

SEQ ID NO: 1912920 - protein, 15 aa, Staphylococcus
TPVKEIDGEDPIKAD

SEQ ID NO: 1912921 - protein, 15 aa, Staphylococcus
TPVPHNGCRPPKRRR

SEQ ID NO: 1912922 - protein, 11 aa, Staphylococcus
TPYKESDIEPY

SEQ ID NO: 1912923 - protein, 6 aa, Staphylococcus
TQAMTA

SEQ ID NO: 1912924 - protein, 5 aa, Staphylococcus
TQNKD

SEQ ID NO: 1912925 - protein, 5 aa, Staphylococcus
TQPKN

SEQ ID NO: 1912926 - protein, 28 aa, Staphylococcus
TRGLGAGANPEIGKKAAEESREQIEDAI

SEQ ID NO: 1912927 - protein, 8 aa, Staphylococcus
TRGSTPGI

SEQ ID NO: 1912928 - protein, 7 aa, Staphylococcus
TRGTEKE

SEQ ID NO: 1912929 - protein, 6 aa, Staphylococcus
TRRSTI

SEQ ID NO: 1912930 - protein, 4 aa, Staphylococcus
TRVT

SEQ ID NO: 1912931 - protein, 5 aa, Staphylococcus
TSNPK

SEQ ID NO: 1912932 - protein, 14 aa, Staphylococcus
TSRPKKIGGERAKY

SEQ ID NO: 1912933 - protein, 4 aa, Staphylococcus
TSSI

SEQ ID NO: 1912934 - protein, 5 aa, Staphylococcus
TSSPS

SEQ ID NO: 1912935 - protein, 14 aa, Staphylococcus
TSTEKKLGKPVGSD

SEQ ID NO: 1912936 - protein, 10 aa, Staphylococcus
TSTGCDGVHP

SEQ ID NO: 1912937 - protein, 4 aa, Staphylococcus
TSTV

SEQ ID NO: 1912938 - protein, 11 aa, Staphylococcus
TSVSLKRHSDA

SEQ ID NO: 1912939 - protein, 6 aa, Staphylococcus
TTIGQS

SEQ ID NO: 1912940 - protein, 6 aa, Staphylococcus
TTNLER

SEQ ID NO: 1912941 - protein, 9 aa, Staphylococcus
TTSASDIAE

SEQ ID NO: 1912942 - protein, 16 aa, Staphylococcus
TTTMGPGVKVDTSSFK

SEQ ID NO: 1912943 - protein, 11 aa, Staphylococcus
TVKSNERGEVD

SEQ ID NO: 1912944 - protein, 4 aa, Staphylococcus
TYGT

SEQ ID NO: 1912945 - protein, 12 aa, Staphylococcus
VAKRATIPVLIV

SEQ ID NO: 1912946 - protein, 7 aa, Staphylococcus
VANGDEV

SEQ ID NO: 1912947 - protein, 4 aa, Staphylococcus
VAYT

SEQ ID NO: 1912948 - protein, 6 aa, Staphylococcus
VDEEEV

SEQ ID NO: 1912949 - protein, 15 aa, Staphylococcus
VDERAMDSNDLERER

SEQ ID NO: 1912950 - protein, 6 aa, Staphylococcus
VDEYNQ

SEQ ID NO: 1912951 - protein, 9 aa, Staphylococcus
VDGEQTAFP

SEQ ID NO: 1912952 - protein, 4 aa, Staphylococcus
VDNK

SEQ ID NO: 1912953 - protein, 14 aa, Staphylococcus
VDSRTILDSGGAER

SEQ ID NO: 1912954 - protein, 5 aa, Staphylococcus
VEGDA

SEQ ID NO: 1912955 - protein, 6 aa, Staphylococcus
VEGEEA

SEQ ID NO: 1912956 - protein, 4 aa, Staphylococcus
VEPE

SEQ ID NO: 1912957 - protein, 10 aa, Staphylococcus
VERSRKALSE

SEQ ID NO: 1912958 - protein, 9 aa, Staphylococcus
VGAKEGGVV

SEQ ID NO: 1912959 - protein, 9 aa, Staphylococcus
VGANSEQLS

SEQ ID NO: 1912960 - protein, 7 aa, Staphylococcus
VGAPQAI

SEQ ID NO: 1912961 - protein, 11 aa, Staphylococcus
VGEDGPTHEPI

SEQ ID NO: 1912962 - protein, 8 aa, Staphylococcus
VGKTTTIG

SEQ ID NO: 1912963 - protein, 8 aa, Staphylococcus
VGPNGDPL

SEQ ID NO: 1912964 - protein, 9 aa, Staphylococcus
VGRGPLAGP

SEQ ID NO: 1912965 - protein, 10 aa, Staphylococcus
VGTGDQKINL

SEQ ID NO: 1912966 - protein, 10 aa, Staphylococcus
VGTGGTLSGV

SEQ ID NO: 1912967 - protein, 7 aa, Staphylococcus
VHPGSAK

SEQ ID NO: 1912968 - protein, 9 aa, Staphylococcus
VKASGGVRN

SEQ ID NO: 1912969 - protein, 8 aa, Staphylococcus
VKASPEHP

SEQ ID NO: 1912970 - protein, 5 aa, Staphylococcus
VKGGR

SEQ ID NO: 1912971 - protein, 6 aa, Staphylococcus
VKKVEE

SEQ ID NO: 1912972 - protein, 5 aa, Staphylococcus
VKTGY

SEQ ID NO: 1912973 - protein, 7 aa, Staphylococcus
VNQGHRH

SEQ ID NO: 1912974 - protein, 7 aa, Staphylococcus
VNTASKS

SEQ ID NO: 1912975 - protein, 6 aa, Staphylococcus
VPDAPH

SEQ ID NO: 1912976 - protein, 9 aa, Staphylococcus
VPGKAEEKQ

SEQ ID NO: 1912977 - protein, 4 aa, Staphylococcus
VPRT

SEQ ID NO: 1912978 - protein, 7 aa, Staphylococcus
VPSSPSY

SEQ ID NO: 1912979 - protein, 10 aa, Staphylococcus
VPTREPGISP

SEQ ID NO: 1912980 - protein, 5 aa, Staphylococcus
VQDPL

SEQ ID NO: 1912981 - protein, 5 aa, Staphylococcus
VQGEN

SEQ ID NO: 1912982 - protein, 7 aa, Staphylococcus
VQKNGGV

SEQ ID NO: 1912983 - protein, 6 aa, Staphylococcus
VQSYQG

SEQ ID NO: 1912984 - protein, 8 aa, Staphylococcus
VSAGEPLN

SEQ ID NO: 1912985 - protein, 5 aa, Staphylococcus
VSDED

SEQ ID NO: 1912986 - protein, 8 aa, Staphylococcus
VSDKDGDM

SEQ ID NO: 1912987 - protein, 8 aa, Staphylococcus
VSGRGGTN

SEQ ID NO: 1912988 - protein, 7 aa, Staphylococcus
VSHNGNA

SEQ ID NO: 1912989 - protein, 7 aa, Staphylococcus
VSKGNAI

SEQ ID NO: 1912990 - protein, 7 aa, Staphylococcus
VSPATIR

SEQ ID NO: 1912991 - protein, 7 aa, Staphylococcus
VSRSPVR

SEQ ID NO: 1912992 - protein, 7 aa, Staphylococcus
VTASTDS

SEQ ID NO: 1912993 - protein, 10 aa, Staphylococcus
VTGTNGKTSI

SEQ ID NO: 1912994 - protein, 12 aa, Staphylococcus
VTNTGDKKSRQI

SEQ ID NO: 1912995 - protein, 8 aa, Staphylococcus
VTPGSDEA

SEQ ID NO: 1912996 - protein, 9 aa, Staphylococcus
VYRNDTGSL

SEQ ID NO: 1912997 - protein, 13 aa, Staphylococcus
VYWSPSSESSLAE

SEQ ID NO: 1912998 - protein, 7 aa, Staphylococcus
WAEPEGM

SEQ ID NO: 1912999 - protein, 6 aa, Staphylococcus
WGTPRE

SEQ ID NO: 1913000 - protein, 8 aa, Staphylococcus
WNGNQSPQ

SEQ ID NO: 1913001 - protein, 11 aa, Staphylococcus
YADGTDNPEGH

SEQ ID NO: 1913002 - protein, 10 aa, Staphylococcus
YAEGYPGRRY

SEQ ID NO: 1913003 - protein, 7 aa, Staphylococcus
YAKEGAD

SEQ ID NO: 1913004 - protein, 18 aa, Staphylococcus
YDGEGVTEAIRTKNNMDG

SEQ ID NO: 1913005 - protein, 5 aa, Staphylococcus
YDKEE

SEQ ID NO: 1913006 - protein, 12 aa, Staphylococcus
YDLSRGRITYRY

SEQ ID NO: 1913007 - protein, 9 aa, Staphylococcus
YDQLNKDAD

SEQ ID NO: 1913008 - protein, 4 aa, Staphylococcus
YEDN

SEQ ID NO: 1913009 - protein, 7 aa, Staphylococcus
YEEGNRF

SEQ ID NO: 1913010 - protein, 6 aa, Staphylococcus
YEVGQE

SEQ ID NO: 1913011 - protein, 4 aa, Staphylococcus
YGAD

SEQ ID NO: 1913012 - protein, 8 aa, Staphylococcus
YGAPTPVQ

SEQ ID NO: 1913013 - protein, 10 aa, Staphylococcus
YGSRAVKPPV

SEQ ID NO: 1913014 - protein, 5 aa, Staphylococcus
YGTVN

SEQ ID NO: 1913015 - protein, 4 aa, Staphylococcus
YGTY

SEQ ID NO: 1913016 - protein, 13 aa, Staphylococcus
YKDSNKKAEISKR

SEQ ID NO: 1913017 - protein, 8 aa, Staphylococcus
YKEISSCS

SEQ ID NO: 1913018 - protein, 5 aa, Staphylococcus
YKHDG

SEQ ID NO: 1913019 - protein, 8 aa, Staphylococcus
YKKEGKSQ

SEQ ID NO: 1913020 - protein, 7 aa, Staphylococcus
YKSIEES

SEQ ID NO: 1913021 - protein, 10 aa, Staphylococcus
YPITPKNHGT

SEQ ID NO: 1913022 - protein, 9 aa, Staphylococcus
YPRTDSNYL

SEQ ID NO: 1913023 - protein, 5 aa, Staphylococcus
YPTAP

SEQ ID NO: 1913024 - protein, 7 aa, Staphylococcus
YQERQTV

SEQ ID NO: 1913025 - protein, 6 aa, Staphylococcus
YQTRRN

SEQ ID NO: 1913026 - protein, 5 aa, Staphylococcus
YQYES

SEQ ID NO: 1913027 - protein, 6 aa, Staphylococcus
YRPNAV

SEQ ID NO: 1913028 - protein, 5 aa, Staphylococcus
YRQKD

SEQ ID NO: 1913029 - protein, 9 aa, Staphylococcus
YRQQDGSSI

SEQ ID NO: 1913030 - protein, 8 aa, Staphylococcus
YSPSPGSV

SEQ ID NO: 1913031 - protein, 4 aa, Staphylococcus
YTET

SEQ ID NO: 1913032 - protein, 6 aa, Staphylococcus
YTKEDE

SEQ ID NO: 1913033 - protein, 8 aa, Staphylococcus
YVKTPKDD

SEQ ID NO: 1913034 - protein, 5 aa, Staphylococcus
YVSQR

SEQ ID NO: 1913035 - protein, 14 aa, Staphylococcus
AAADDYKAQSIEPY

SEQ ID NO: 1913036 - protein, 7 aa, Staphylococcus
AADGVEA

SEQ ID NO: 1913037 - protein, 4 aa, Staphylococcus
AADI

SEQ ID NO: 1913038 - protein, 13 aa, Staphylococcus
AAFGKNGGNMGVS

SEQ ID NO: 1913039 - protein, 4 aa, Staphylococcus
AAKL

SEQ ID NO: 1913040 - protein, 9 aa, Staphylococcus
AAKSGLERI

SEQ ID NO: 1913041 - protein, 6 aa, Staphylococcus
AAKVSG

SEQ ID NO: 1913042 - protein, 5 aa, Staphylococcus
AAPGW

SEQ ID NO: 1913043 - protein, 5 aa, Staphylococcus
AAQER

SEQ ID NO: 1913044 - protein, 5 aa, Staphylococcus
AARGL

SEQ ID NO: 1913045 - protein, 6 aa, Staphylococcus
AASATA

SEQ ID NO: 1913046 - protein, 12 aa, Staphylococcus
AASDVGQSSFGA

SEQ ID NO: 1913047 - protein, 8 aa, Staphylococcus
AASTNSNY

SEQ ID NO: 1913048 - protein, 17 aa, Staphylococcus
AATMAEGAQKIVKLVKE

SEQ ID NO: 1913049 - protein, 10 aa, Staphylococcus
ACGGASSGFN

SEQ ID NO: 1913050 - protein, 5 aa, Staphylococcus
ADESY

SEQ ID NO: 1913051 - protein, 7 aa, Staphylococcus
ADGGWPE

SEQ ID NO: 1913052 - protein, 8 aa, Staphylococcus
ADPDCSPE

SEQ ID NO: 1913053 - protein, 6 aa, Staphylococcus
ADQART

SEQ ID NO: 1913054 - protein, 10 aa, Staphylococcus
ADSGAIGGNH

SEQ ID NO: 1913055 - protein, 4 aa, Staphylococcus
ADTV

SEQ ID NO: 1913056 - protein, 9 aa, Staphylococcus
ADVKREGDD

SEQ ID NO: 1913057 - protein, 8 aa, Staphylococcus
AEAPAEAY

SEQ ID NO: 1913058 - protein, 4 aa, Staphylococcus
AEDI

SEQ ID NO: 1913059 - protein, 4 aa, Staphylococcus
AEEA

SEQ ID NO: 1913060 - protein, 6 aa, Staphylococcus
AEEFNE

SEQ ID NO: 1913061 - protein, 4 aa, Staphylococcus
AEEK

SEQ ID NO: 1913062 - protein, 4 aa, Staphylococcus
AEGD

SEQ ID NO: 1913063 - protein, 5 aa, Staphylococcus
AEIDE

SEQ ID NO: 1913064 - protein, 11 aa, Staphylococcus
AEIEERGGGRQ

SEQ ID NO: 1913065 - protein, 8 aa, Staphylococcus
AEIGERTN

SEQ ID NO: 1913066 - protein, 6 aa, Staphylococcus
AEKGTY

SEQ ID NO: 1913067 - protein, 9 aa, Staphylococcus
AELKDGAKV

SEQ ID NO: 1913068 - protein, 9 aa, Staphylococcus
AELNPTPKW

SEQ ID NO: 1913069 - protein, 10 aa, Staphylococcus
AEMTGRNDIQ

SEQ ID NO: 1913070 - protein, 5 aa, Staphylococcus
AENAQ

SEQ ID NO: 1913071 - protein, 6 aa, Staphylococcus
AENGKK

SEQ ID NO: 1913072 - protein, 5 aa, Staphylococcus
AENPY

SEQ ID NO: 1913073 - protein, 4 aa, Staphylococcus
AENR

SEQ ID NO: 1913074 - protein, 6 aa, Staphylococcus
AEPASD

SEQ ID NO: 1913075 - protein, 4 aa, Staphylococcus
AERC

SEQ ID NO: 1913076 - protein, 6 aa, Staphylococcus
AESEQL

SEQ ID NO: 1913077 - protein, 7 aa, Staphylococcus
AETHTGD

SEQ ID NO: 1913078 - protein, 12 aa, Staphylococcus
AFAQRRKTINNN

SEQ ID NO: 1913079 - protein, 6 aa, Staphylococcus
AFQETN

SEQ ID NO: 1913080 - protein, 5 aa, Staphylococcus
AGALA

SEQ ID NO: 1913081 - protein, 7 aa, Staphylococcus
AGDARSK

SEQ ID NO: 1913082 - protein, 8 aa, Staphylococcus
AGDTGADC

SEQ ID NO: 1913083 - protein, 10 aa, Staphylococcus
AGGGDNACGA

SEQ ID NO: 1913084 - protein, 8 aa, Staphylococcus
AGGGTSEH

SEQ ID NO: 1913085 - protein, 6 aa, Staphylococcus
AGGSDL

SEQ ID NO: 1913086 - protein, 6 aa, Staphylococcus
AGGSLA

SEQ ID NO: 1913087 - protein, 6 aa, Staphylococcus
AGGTEM

SEQ ID NO: 1913088 - protein, 6 aa, Staphylococcus
AGHEPG

SEQ ID NO: 1913089 - protein, 4 aa, Staphylococcus
AGHN

SEQ ID NO: 1913090 - protein, 21 aa, Staphylococcus
AGKDKGKEGKVIATEPKKDRV

SEQ ID NO: 1913091 - protein, 10 aa, Staphylococcus
AGKGSEVGRT

SEQ ID NO: 1913092 - protein, 4 aa, Staphylococcus
AGLE

SEQ ID NO: 1913093 - protein, 12 aa, Staphylococcus
AGLEKSRQNFQE

SEQ ID NO: 1913094 - protein, 7 aa, Staphylococcus
AGLGRSG

SEQ ID NO: 1913095 - protein, 6 aa, Staphylococcus
AGNQIT

SEQ ID NO: 1913096 - protein, 6 aa, Staphylococcus
AGPIRT

SEQ ID NO: 1913097 - protein, 5 aa, Staphylococcus
AGSIT

SEQ ID NO: 1913098 - protein, 8 aa, Staphylococcus
AGTKEGIT

SEQ ID NO: 1913099 - protein, 7 aa, Staphylococcus
AGTPAKV

SEQ ID NO: 1913100 - protein, 4 aa, Staphylococcus
AGVG

SEQ ID NO: 1913101 - protein, 7 aa, Staphylococcus
AGVGSDH

SEQ ID NO: 1913102 - protein, 4 aa, Staphylococcus
AGYQ

SEQ ID NO: 1913103 - protein, 9 aa, Staphylococcus
AHASQTGPF

SEQ ID NO: 1913104 - protein, 8 aa, Staphylococcus
AHGHSKGV

SEQ ID NO: 1913105 - protein, 7 aa, Staphylococcus
AHPGLPD

SEQ ID NO: 1913106 - protein, 12 aa, Staphylococcus
AHRADEDATTTA

SEQ ID NO: 1913107 - protein, 8 aa, Staphylococcus
AIGDGDHG

SEQ ID NO: 1913108 - protein, 12 aa, Staphylococcus
AIGTSKDTEIRA

SEQ ID NO: 1913109 - protein, 6 aa, Staphylococcus
AISDGD

SEQ ID NO: 1913110 - protein, 17 aa, Staphylococcus
AISTPRSKQTAATTLAQ

SEQ ID NO: 1913111 - protein, 7 aa, Staphylococcus
AITKDGE

SEQ ID NO: 1913112 - protein, 6 aa, Staphylococcus
AIYDGT

SEQ ID NO: 1913113 - protein, 7 aa, Staphylococcus
AKAKTIE

SEQ ID NO: 1913114 - protein, 8 aa, Staphylococcus
AKAKTIEK

SEQ ID NO: 1913115 - protein, 12 aa, Staphylococcus
AKARTTKQQARI

SEQ ID NO: 1913116 - protein, 6 aa, Staphylococcus
AKDEIR

SEQ ID NO: 1913117 - protein, 6 aa, Staphylococcus
AKEASR

SEQ ID NO: 1913118 - protein, 5 aa, Staphylococcus
AKEGN

SEQ ID NO: 1913119 - protein, 5 aa, Staphylococcus
AKENN

SEQ ID NO: 1913120 - protein, 13 aa, Staphylococcus
AKESGSAAAPTAG

SEQ ID NO: 1913121 - protein, 9 aa, Staphylococcus
AKGRPSDNP

SEQ ID NO: 1913122 - protein, 6 aa, Staphylococcus
AKIPTH

SEQ ID NO: 1913123 - protein, 8 aa, Staphylococcus
AKKENGEV

SEQ ID NO: 1913124 - protein, 9 aa, Staphylococcus
AKLRGERSE

SEQ ID NO: 1913125 - protein, 10 aa, Staphylococcus
AKMGPASDPM

SEQ ID NO: 1913126 - protein, 7 aa, Staphylococcus
AKRAQRG

SEQ ID NO: 1913127 - protein, 8 aa, Staphylococcus
AKREVTEQ

SEQ ID NO: 1913128 - protein, 8 aa, Staphylococcus
AKRNPREI

SEQ ID NO: 1913129 - protein, 6 aa, Staphylococcus
AKSNIG

SEQ ID NO: 1913130 - protein, 7 aa, Staphylococcus
AKSNIGI

SEQ ID NO: 1913131 - protein, 4 aa, Staphylococcus
AKTM

SEQ ID NO: 1913132 - protein, 6 aa, Staphylococcus
AKVSDK

SEQ ID NO: 1913133 - protein, 5 aa, Staphylococcus
ALAAG

SEQ ID NO: 1913134 - protein, 9 aa, Staphylococcus
ALEEGNPVR

SEQ ID NO: 1913135 - protein, 15 aa, Staphylococcus
ALESLEGRNTRPTMD

SEQ ID NO: 1913136 - protein, 5 aa, Staphylococcus
ALETG

SEQ ID NO: 1913137 - protein, 6 aa, Staphylococcus
ALGEDK

SEQ ID NO: 1913138 - protein, 7 aa, Staphylococcus
ALHDPNG

SEQ ID NO: 1913139 - protein, 10 aa, Staphylococcus
ALKDKGAKDV

SEQ ID NO: 1913140 - protein, 10 aa, Staphylococcus
ALMSGSGPTV

SEQ ID NO: 1913141 - protein, 4 aa, Staphylococcus
ALPG

SEQ ID NO: 1913142 - protein, 14 aa, Staphylococcus
ALTPKAEIEGEMGD

SEQ ID NO: 1913143 - protein, 5 aa, Staphylococcus
ANAAP

SEQ ID NO: 1913144 - protein, 14 aa, Staphylococcus
ANAGDGSGQHPTQS

SEQ ID NO: 1913145 - protein, 10 aa, Staphylococcus
ANAGQKGAVT

SEQ ID NO: 1913146 - protein, 6 aa, Staphylococcus
ANDEQL

SEQ ID NO: 1913147 - protein, 4 aa, Staphylococcus
ANDK

SEQ ID NO: 1913148 - protein, 8 aa, Staphylococcus
ANDTDYGL

SEQ ID NO: 1913149 - protein, 8 aa, Staphylococcus
ANGAGKTT

SEQ ID NO: 1913150 - protein, 12 aa, Staphylococcus
ANGGRKKTIERS

SEQ ID NO: 1913151 - protein, 5 aa, Staphylococcus
ANGQT

SEQ ID NO: 1913152 - protein, 5 aa, Staphylococcus
ANGTH

SEQ ID NO: 1913153 - protein, 8 aa, Staphylococcus
ANINSPGQ

SEQ ID NO: 1913154 - protein, 11 aa, Staphylococcus
ANKVHANSDIG

SEQ ID NO: 1913155 - protein, 8 aa, Staphylococcus
ANLNKTVS

SEQ ID NO: 1913156 - protein, 7 aa, Staphylococcus
ANLSPGT

SEQ ID NO: 1913157 - protein, 6 aa, Staphylococcus
ANPKRL

SEQ ID NO: 1913158 - protein, 7 aa, Staphylococcus
ANPKRLD

SEQ ID NO: 1913159 - protein, 10 aa, Staphylococcus
ANRPASGTQI

SEQ ID NO: 1913160 - protein, 10 aa, Staphylococcus
APAEKQTRLS

SEQ ID NO: 1913161 - protein, 10 aa, Staphylococcus
APDRNNVNGY

SEQ ID NO: 1913162 - protein, 6 aa, Staphylococcus
APGGYG

SEQ ID NO: 1913163 - protein, 5 aa, Staphylococcus
APGPI

SEQ ID NO: 1913164 - protein, 7 aa, Staphylococcus
APGQELE

SEQ ID NO: 1913165 - protein, 4 aa, Staphylococcus
APGW

SEQ ID NO: 1913166 - protein, 7 aa, Staphylococcus
APIPGTS

SEQ ID NO: 1913167 - protein, 4 aa, Staphylococcus
APKP

SEQ ID NO: 1913168 - protein, 4 aa, Staphylococcus
APKT

SEQ ID NO: 1913169 - protein, 10 aa, Staphylococcus
APNPGTDAAV

SEQ ID NO: 1913170 - protein, 10 aa, Staphylococcus
APPKAGKTSL

SEQ ID NO: 1913171 - protein, 11 aa, Staphylococcus
APQNTRRKSIE

SEQ ID NO: 1913172 - protein, 8 aa, Staphylococcus
APSQTLSD

SEQ ID NO: 1913173 - protein, 5 aa, Staphylococcus
APVYG

SEQ ID NO: 1913174 - protein, 5 aa, Staphylococcus
AQDKE

SEQ ID NO: 1913175 - protein, 4 aa, Staphylococcus
AQEL

SEQ ID NO: 1913176 - protein, 5 aa, Staphylococcus
AQETR

SEQ ID NO: 1913177 - protein, 8 aa, Staphylococcus
AQKPQGSR

SEQ ID NO: 1913178 - protein, 8 aa, Staphylococcus
AQMPGSVT

SEQ ID NO: 1913179 - protein, 7 aa, Staphylococcus
AQNTKGV

SEQ ID NO: 1913180 - protein, 4 aa, Staphylococcus
AQPI

SEQ ID NO: 1913181 - protein, 9 aa, Staphylococcus
ARAKWGERS

SEQ ID NO: 1913182 - protein, 5 aa, Staphylococcus
AREGY

SEQ ID NO: 1913183 - protein, 5 aa, Staphylococcus
ARGFS

SEQ ID NO: 1913184 - protein, 6 aa, Staphylococcus
ARIPEW

SEQ ID NO: 1913185 - protein, 9 aa, Staphylococcus
ARNPKGQAV

SEQ ID NO: 1913186 - protein, 10 aa, Staphylococcus
ARQKDKTAEM

SEQ ID NO: 1913187 - protein, 8 aa, Staphylococcus
ARRRKARG

SEQ ID NO: 1913188 - protein, 12 aa, Staphylococcus
ARRRRKGRKVLS

SEQ ID NO: 1913189 - protein, 4 aa, Staphylococcus
ARSE

SEQ ID NO: 1913190 - protein, 17 aa, Staphylococcus
ARVAAKKAREVTRRKSA

SEQ ID NO: 1913191 - protein, 4 aa, Staphylococcus
ASAE

SEQ ID NO: 1913192 - protein, 8 aa, Staphylococcus
ASGRTPYV

SEQ ID NO: 1913193 - protein, 5 aa, Staphylococcus
ASLSR

SEQ ID NO: 1913194 - protein, 4 aa, Staphylococcus
ASNQ

SEQ ID NO: 1913195 - protein, 5 aa, Staphylococcus
ASNTN

SEQ ID NO: 1913196 - protein, 5 aa, Staphylococcus
ASPEI

SEQ ID NO: 1913197 - protein, 5 aa, Staphylococcus
ASPQY

SEQ ID NO: 1913198 - protein, 7 aa, Staphylococcus
ASSNDYR

SEQ ID NO: 1913199 - protein, 19 aa, Staphylococcus
ASTSNRNFEGRQGKGARTH

SEQ ID NO: 1913200 - protein, 6 aa, Staphylococcus
ASVHGD

SEQ ID NO: 1913201 - protein, 7 aa, Staphylococcus
ASYPPET

SEQ ID NO: 1913202 - protein, 5 aa, Staphylococcus
ATDHK

SEQ ID NO: 1913203 - protein, 4 aa, Staphylococcus
ATES

SEQ ID NO: 1913204 - protein, 5 aa, Staphylococcus
ATGGR

SEQ ID NO: 1913205 - protein, 12 aa, Staphylococcus
ATGGTPESSLRA

SEQ ID NO: 1913206 - protein, 8 aa, Staphylococcus
ATGKSTVS

SEQ ID NO: 1913207 - protein, 14 aa, Staphylococcus
ATIETARKKYPNKD

SEQ ID NO: 1913208 - protein, 8 aa, Staphylococcus
ATPGPYEI

SEQ ID NO: 1913209 - protein, 9 aa, Staphylococcus
ATRSALNSV

SEQ ID NO: 1913210 - protein, 12 aa, Staphylococcus
ATSALDPATTSS

SEQ ID NO: 1913211 - protein, 11 aa, Staphylococcus
ATVEQKPKMEG

SEQ ID NO: 1913212 - protein, 12 aa, Staphylococcus
ATYTKEDAFNQE

SEQ ID NO: 1913213 - protein, 7 aa, Staphylococcus
AVDTEGV

SEQ ID NO: 1913214 - protein, 12 aa, Staphylococcus
AVGEDGPTHEPI

SEQ ID NO: 1913215 - protein, 4 aa, Staphylococcus
AWYS

SEQ ID NO: 1913216 - protein, 5 aa, Staphylococcus
AYDRN

SEQ ID NO: 1913217 - protein, 16 aa, Staphylococcus
AYKNKQVDGFTTNPSL

SEQ ID NO: 1913218 - protein, 5 aa, Staphylococcus
CDEGE

SEQ ID NO: 1913219 - protein, 17 aa, Staphylococcus
CDQQTRKFNEEASQEDG

SEQ ID NO: 1913220 - protein, 9 aa, Staphylococcus
CGPEPDETL

SEQ ID NO: 1913221 - protein, 6 aa, Staphylococcus
CGRPHS

SEQ ID NO: 1913222 - protein, 5 aa, Staphylococcus
CPKVK

SEQ ID NO: 1913223 - protein, 7 aa, Staphylococcus
CRSPMAE

SEQ ID NO: 1913224 - protein, 14 aa, Staphylococcus
CSVQRKNQKLIEES

SEQ ID NO: 1913225 - protein, 20 aa, Staphylococcus
DAADSAPSFGDRKTYQMDPA

SEQ ID NO: 1913226 - protein, 8 aa, Staphylococcus
DAAESGVP

SEQ ID NO: 1913227 - protein, 4 aa, Staphylococcus
DAAS

SEQ ID NO: 1913228 - protein, 6 aa, Staphylococcus
DADDNC

SEQ ID NO: 1913229 - protein, 7 aa, Staphylococcus
DAKLDDG

SEQ ID NO: 1913230 - protein, 17 aa, Staphylococcus
DANREAFKERKRPATAK

SEQ ID NO: 1913231 - protein, 8 aa, Staphylococcus
DAPKKNPK

SEQ ID NO: 1913232 - protein, 7 aa, Staphylococcus
DAVQNSK

SEQ ID NO: 1913233 - protein, 8 aa, Staphylococcus
DAVQNSKV

SEQ ID NO: 1913234 - protein, 6 aa, Staphylococcus
DAVSDR

SEQ ID NO: 1913235 - protein, 5 aa, Staphylococcus
DDDFS

SEQ ID NO: 1913236 - protein, 7 aa, Staphylococcus
DDDTMRA

SEQ ID NO: 1913237 - protein, 4 aa, Staphylococcus
DDEG

SEQ ID NO: 1913238 - protein, 8 aa, Staphylococcus
DDERSGDF

SEQ ID NO: 1913239 - protein, 4 aa, Staphylococcus
DDET

SEQ ID NO: 1913240 - protein, 6 aa, Staphylococcus
DDFNEN

SEQ ID NO: 1913241 - protein, 12 aa, Staphylococcus
DDLRDAGSNVYA

SEQ ID NO: 1913242 - protein, 13 aa, Staphylococcus
DDLRDAGSNVYAE

SEQ ID NO: 1913243 - protein, 5 aa, Staphylococcus
DDMNR

SEQ ID NO: 1913244 - protein, 7 aa, Staphylococcus
DDNNEVG

SEQ ID NO: 1913245 - protein, 6 aa, Staphylococcus
DDQSMR

SEQ ID NO: 1913246 - protein, 13 aa, Staphylococcus
DDRRDKSRKMNDK

SEQ ID NO: 1913247 - protein, 4 aa, Staphylococcus
DDTL

SEQ ID NO: 1913248 - protein, 5 aa, Staphylococcus
DDTTL

SEQ ID NO: 1913249 - protein, 18 aa, Staphylococcus
DDVDPRVTTGKYYSPSEF

SEQ ID NO: 1913250 - protein, 7 aa, Staphylococcus
DDVPGDN

SEQ ID NO: 1913251 - protein, 6 aa, Staphylococcus
DEDNDI

SEQ ID NO: 1913252 - protein, 6 aa, Staphylococcus
DEDNDL

SEQ ID NO: 1913253 - protein, 9 aa, Staphylococcus
DEDRENEGD

SEQ ID NO: 1913254 - protein, 15 aa, Staphylococcus
DEEGKLGETENTQPA

SEQ ID NO: 1913255 - protein, 11 aa, Staphylococcus
DEEGNSLDAAR

SEQ ID NO: 1913256 - protein, 7 aa, Staphylococcus
DEENERI

SEQ ID NO: 1913257 - protein, 7 aa, Staphylococcus
DEESDWK

SEQ ID NO: 1913258 - protein, 4 aa, Staphylococcus
DEET

SEQ ID NO: 1913259 - protein, 4 aa, Staphylococcus
DEFT

SEQ ID NO: 1913260 - protein, 4 aa, Staphylococcus
DEGE

SEQ ID NO: 1913261 - protein, 6 aa, Staphylococcus
DEIDDP

SEQ ID NO: 1913262 - protein, 4 aa, Staphylococcus
DEKA

SEQ ID NO: 1913263 - protein, 14 aa, Staphylococcus
DELTTAQSKTLNDN

SEQ ID NO: 1913264 - protein, 7 aa, Staphylococcus
DENGEME

SEQ ID NO: 1913265 - protein, 7 aa, Staphylococcus
DENNEPL

SEQ ID NO: 1913266 - protein, 9 aa, Staphylococcus
DENRENEGD

SEQ ID NO: 1913267 - protein, 6 aa, Staphylococcus
DENVTH

SEQ ID NO: 1913268 - protein, 8 aa, Staphylococcus
DEQSIEQS

SEQ ID NO: 1913269 - protein, 4 aa, Staphylococcus
DERF

SEQ ID NO: 1913270 - protein, 5 aa, Staphylococcus
DERFK

SEQ ID NO: 1913271 - protein, 4 aa, Staphylococcus
DESE

SEQ ID NO: 1913272 - protein, 5 aa, Staphylococcus
DETIT

SEQ ID NO: 1913273 - protein, 8 aa, Staphylococcus
DETTAARK

SEQ ID NO: 1913274 - protein, 6 aa, Staphylococcus
DEVPEE

SEQ ID NO: 1913275 - protein, 24 aa, Staphylococcus
DEYEERRRGDNKIGTTKKGIGPAY

SEQ ID NO: 1913276 - protein, 8 aa, Staphylococcus
DFSGYPDC

SEQ ID NO: 1913277 - protein, 11 aa, Staphylococcus
DGADAKDLDDA

SEQ ID NO: 1913278 - protein, 10 aa, Staphylococcus
DGANGSTSSL

SEQ ID NO: 1913279 - protein, 6 aa, Staphylococcus
DGAQLE

SEQ ID NO: 1913280 - protein, 6 aa, Staphylococcus
DGEPVD

SEQ ID NO: 1913281 - protein, 8 aa, Staphylococcus
DGKITNDN

SEQ ID NO: 1913282 - protein, 8 aa, Staphylococcus
DGKKTSTI

SEQ ID NO: 1913283 - protein, 6 aa, Staphylococcus
DGLSGP

SEQ ID NO: 1913284 - protein, 5 aa, Staphylococcus
DGNVV

SEQ ID NO: 1913285 - protein, 9 aa, Staphylococcus
DGPKESGGL

SEQ ID NO: 1913286 - protein, 6 aa, Staphylococcus
DGREGV

SEQ ID NO: 1913287 - protein, 5 aa, Staphylococcus
DGRIA

SEQ ID NO: 1913288 - protein, 6 aa, Staphylococcus
DGSDRY

SEQ ID NO: 1913289 - protein, 9 aa, Staphylococcus
DGSERADRR

SEQ ID NO: 1913290 - protein, 7 aa, Staphylococcus
DGSLDYD

SEQ ID NO: 1913291 - protein, 7 aa, Staphylococcus
DGSVGSS

SEQ ID NO: 1913292 - protein, 12 aa, Staphylococcus
DGTPNKGKLGAN

SEQ ID NO: 1913293 - protein, 4 aa, Staphylococcus
DGTR

SEQ ID NO: 1913294 - protein, 7 aa, Staphylococcus
DGTTQVT

SEQ ID NO: 1913295 - protein, 6 aa, Staphylococcus
DGTVEG

SEQ ID NO: 1913296 - protein, 6 aa, Staphylococcus
DGVMPQ

SEQ ID NO: 1913297 - protein, 5 aa, Staphylococcus
DHDFD

SEQ ID NO: 1913298 - protein, 24 aa, Staphylococcus
DHGNSDQVLTDDDQPMTTHTTNPV

SEQ ID NO: 1913299 - protein, 7 aa, Staphylococcus
DHSAENI

SEQ ID NO: 1913300 - protein, 6 aa, Staphylococcus
DIDTEK

SEQ ID NO: 1913301 - protein, 8 aa, Staphylococcus
DIQPSSRR

SEQ ID NO: 1913302 - protein, 7 aa, Staphylococcus
DITGKKA

SEQ ID NO: 1913303 - protein, 10 aa, Staphylococcus
DKARVPAGGA

SEQ ID NO: 1913304 - protein, 4 aa, Staphylococcus
DKAV

SEQ ID NO: 1913305 - protein, 7 aa, Staphylococcus
DKEGGVD

SEQ ID NO: 1913306 - protein, 6 aa, Staphylococcus
DKGAII

SEQ ID NO: 1913307 - protein, 6 aa, Staphylococcus
DKGNPL

SEQ ID NO: 1913308 - protein, 9 aa, Staphylococcus
DKKLSNENF

SEQ ID NO: 1913309 - protein, 5 aa, Staphylococcus
DKMDK

SEQ ID NO: 1913310 - protein, 10 aa, Staphylococcus
DKPSARPEGV

SEQ ID NO: 1913311 - protein, 12 aa, Staphylococcus
DKPYKKLTDRQK

SEQ ID NO: 1913312 - protein, 5 aa, Staphylococcus
DKSLS

SEQ ID NO: 1913313 - protein, 7 aa, Staphylococcus
DKTSPYE

SEQ ID NO: 1913314 - protein, 10 aa, Staphylococcus
DLDRTPKKNK

SEQ ID NO: 1913315 - protein, 8 aa, Staphylococcus
DLGISSPD

SEQ ID NO: 1913316 - protein, 6 aa, Staphylococcus
DLGTEI

SEQ ID NO: 1913317 - protein, 8 aa, Staphylococcus
DLNHTGAH

SEQ ID NO: 1913318 - protein, 11 aa, Staphylococcus
DLNRAEDRKEF

SEQ ID NO: 1913319 - protein, 5 aa, Staphylococcus
DLPED

SEQ ID NO: 1913320 - protein, 7 aa, Staphylococcus
DLPGRSL

SEQ ID NO: 1913321 - protein, 13 aa, Staphylococcus
DLRASQSQEEFDK

SEQ ID NO: 1913322 - protein, 6 aa, Staphylococcus
DLSKTF

SEQ ID NO: 1913323 - protein, 11 aa, Staphylococcus
DLTPSDTAQLN

SEQ ID NO: 1913324 - protein, 5 aa, Staphylococcus
DMTPG

SEQ ID NO: 1913325 - protein, 4 aa, Staphylococcus
DNDE

SEQ ID NO: 1913326 - protein, 5 aa, Staphylococcus
DNDEV

SEQ ID NO: 1913327 - protein, 6 aa, Staphylococcus
DNDRAR

SEQ ID NO: 1913328 - protein, 6 aa, Staphylococcus
DNGYET

SEQ ID NO: 1913329 - protein, 5 aa, Staphylococcus
DNKTG

SEQ ID NO: 1913330 - protein, 10 aa, Staphylococcus
DNKVTEGSTV

SEQ ID NO: 1913331 - protein, 5 aa, Staphylococcus
DNPRQ

SEQ ID NO: 1913332 - protein, 4 aa, Staphylococcus
DNSL

SEQ ID NO: 1913333 - protein, 5 aa, Staphylococcus
DNSLN

SEQ ID NO: 1913334 - protein, 6 aa, Staphylococcus
DNVRHG

SEQ ID NO: 1913335 - protein, 7 aa, Staphylococcus
DPAARTT

SEQ ID NO: 1913336 - protein, 6 aa, Staphylococcus
DPEGNK

SEQ ID NO: 1913337 - protein, 7 aa, Staphylococcus
DPETNEV

SEQ ID NO: 1913338 - protein, 5 aa, Staphylococcus
DPEYE

SEQ ID NO: 1913339 - protein, 20 aa, Staphylococcus
DPIEGTKPTTKNEMTDLQST

SEQ ID NO: 1913340 - protein, 8 aa, Staphylococcus
DPISREKL

SEQ ID NO: 1913341 - protein, 8 aa, Staphylococcus
DPKDKTLL

SEQ ID NO: 1913342 - protein, 8 aa, Staphylococcus
DPKSIGVG

SEQ ID NO: 1913343 - protein, 8 aa, Staphylococcus
DPQGNATQ

SEQ ID NO: 1913344 - protein, 7 aa, Staphylococcus
DPSQTIT

SEQ ID NO: 1913345 - protein, 7 aa, Staphylococcus
DPTCGSG

SEQ ID NO: 1913346 - protein, 11 aa, Staphylococcus
DPWPKKRHAKR

SEQ ID NO: 1913347 - protein, 4 aa, Staphylococcus
DQGG

SEQ ID NO: 1913348 - protein, 7 aa, Staphylococcus
DQGQATA

SEQ ID NO: 1913349 - protein, 11 aa, Staphylococcus
DQLGQRPGAGA

SEQ ID NO: 1913350 - protein, 13 aa, Staphylococcus
DQNAEEVKKRPHF

SEQ ID NO: 1913351 - protein, 6 aa, Staphylococcus
DQTPLG

SEQ ID NO: 1913352 - protein, 4 aa, Staphylococcus
DQYY

SEQ ID NO: 1913353 - protein, 4 aa, Staphylococcus
DRAR

SEQ ID NO: 1913354 - protein, 4 aa, Staphylococcus
DRFE

SEQ ID NO: 1913355 - protein, 6 aa, Staphylococcus
DRLNTH

SEQ ID NO: 1913356 - protein, 5 aa, Staphylococcus
DRNTT

SEQ ID NO: 1913357 - protein, 9 aa, Staphylococcus
DRNYRDDPA

SEQ ID NO: 1913358 - protein, 7 aa, Staphylococcus
DRPNMRT

SEQ ID NO: 1913359 - protein, 9 aa, Staphylococcus
DRQTGKTTI

SEQ ID NO: 1913360 - protein, 4 aa, Staphylococcus
DRRP

SEQ ID NO: 1913361 - protein, 5 aa, Staphylococcus
DRYSA

SEQ ID NO: 1913362 - protein, 18 aa, Staphylococcus
DSAGGASGEAYMAEQDGQ

SEQ ID NO: 1913363 - protein, 8 aa, Staphylococcus
DSALRENE

SEQ ID NO: 1913364 - protein, 9 aa, Staphylococcus
DSDDEGEKI

SEQ ID NO: 1913365 - protein, 4 aa, Staphylococcus
DSGA

SEQ ID NO: 1913366 - protein, 14 aa, Staphylococcus
DSGVSGQAAQKMAE

SEQ ID NO: 1913367 - protein, 4 aa, Staphylococcus
DSLK

SEQ ID NO: 1913368 - protein, 6 aa, Staphylococcus
DSNEYS

SEQ ID NO: 1913369 - protein, 6 aa, Staphylococcus
DSPYSI

SEQ ID NO: 1913370 - protein, 10 aa, Staphylococcus
DSTATSQTPV

SEQ ID NO: 1913371 - protein, 6 aa, Staphylococcus
DSTDFT

SEQ ID NO: 1913372 - protein, 6 aa, Staphylococcus
DSTRTR

SEQ ID NO: 1913373 - protein, 10 aa, Staphylococcus
DSYANPDALE

SEQ ID NO: 1913374 - protein, 5 aa, Staphylococcus
DTATE

SEQ ID NO: 1913375 - protein, 4 aa, Staphylococcus
DTCP

SEQ ID NO: 1913376 - protein, 4 aa, Staphylococcus
DTEA

SEQ ID NO: 1913377 - protein, 8 aa, Staphylococcus
DTHQADDG

SEQ ID NO: 1913378 - protein, 5 aa, Staphylococcus
DTIPQ

SEQ ID NO: 1913379 - protein, 9 aa, Staphylococcus
DTLSGGEIQ

SEQ ID NO: 1913380 - protein, 16 aa, Staphylococcus
DTMQEATKPGITTKEL

SEQ ID NO: 1913381 - protein, 6 aa, Staphylococcus
DTPEGK

SEQ ID NO: 1913382 - protein, 6 aa, Staphylococcus
DTPLGS

SEQ ID NO: 1913383 - protein, 8 aa, Staphylococcus
DTQGQALN

SEQ ID NO: 1913384 - protein, 6 aa, Staphylococcus
DTQPFG

SEQ ID NO: 1913385 - protein, 7 aa, Staphylococcus
DTQPFGI

SEQ ID NO: 1913386 - protein, 7 aa, Staphylococcus
DTRVSGE

SEQ ID NO: 1913387 - protein, 5 aa, Staphylococcus
DTRVT

SEQ ID NO: 1913388 - protein, 8 aa, Staphylococcus
DTTDTEEI

SEQ ID NO: 1913389 - protein, 4 aa, Staphylococcus
DTTL

SEQ ID NO: 1913390 - protein, 5 aa, Staphylococcus
DVEAT

SEQ ID NO: 1913391 - protein, 5 aa, Staphylococcus
DVEPQ

SEQ ID NO: 1913392 - protein, 8 aa, Staphylococcus
DVGKKGGV

SEQ ID NO: 1913393 - protein, 7 aa, Staphylococcus
DVGTGSG

SEQ ID NO: 1913394 - protein, 15 aa, Staphylococcus
DVPGKHASYKAGGML

SEQ ID NO: 1913395 - protein, 7 aa, Staphylococcus
DVPQAGD

SEQ ID NO: 1913396 - protein, 7 aa, Staphylococcus
DVRDKGL

SEQ ID NO: 1913397 - protein, 9 aa, Staphylococcus
DVRPTKNQI

SEQ ID NO: 1913398 - protein, 5 aa, Staphylococcus
DVTDY

SEQ ID NO: 1913399 - protein, 9 aa, Staphylococcus
DVTETKGNY

SEQ ID NO: 1913400 - protein, 8 aa, Staphylococcus
DWPKPGVS

SEQ ID NO: 1913401 - protein, 7 aa, Staphylococcus
DYEEDAE

SEQ ID NO: 1913402 - protein, 12 aa, Staphylococcus
DYGNRENRKNAR

SEQ ID NO: 1913403 - protein, 4 aa, Staphylococcus
DYPD

SEQ ID NO: 1913404 - protein, 9 aa, Staphylococcus
DYPGIGPEH

SEQ ID NO: 1913405 - protein, 7 aa, Staphylococcus
DYVRHGE

SEQ ID NO: 1913406 - protein, 6 aa, Staphylococcus
EAAEQS

SEQ ID NO: 1913407 - protein, 14 aa, Staphylococcus
EAAGEEFNINSPKQ

SEQ ID NO: 1913408 - protein, 5 aa, Staphylococcus
EAGGV

SEQ ID NO: 1913409 - protein, 4 aa, Staphylococcus
EAGY

SEQ ID NO: 1913410 - protein, 10 aa, Staphylococcus
EAKGRPSDNP

SEQ ID NO: 1913411 - protein, 8 aa, Staphylococcus
EAKQYSLN

SEQ ID NO: 1913412 - protein, 5 aa, Staphylococcus
EANAS

SEQ ID NO: 1913413 - protein, 4 aa, Staphylococcus
EAQA

SEQ ID NO: 1913414 - protein, 9 aa, Staphylococcus
EAREEGPFL

SEQ ID NO: 1913415 - protein, 9 aa, Staphylococcus
EASDGKEAY

SEQ ID NO: 1913416 - protein, 9 aa, Staphylococcus
EASGAVSGL

SEQ ID NO: 1913417 - protein, 6 aa, Staphylococcus
EASQYV

SEQ ID NO: 1913418 - protein, 4 aa, Staphylococcus
EAVG

SEQ ID NO: 1913419 - protein, 4 aa, Staphylococcus
EDAE

SEQ ID NO: 1913420 - protein, 5 aa, Staphylococcus
EDAKR

SEQ ID NO: 1913421 - protein, 4 aa, Staphylococcus
EDEE

SEQ ID NO: 1913422 - protein, 4 aa, Staphylococcus
EDEI

SEQ ID NO: 1913423 - protein, 6 aa, Staphylococcus
EDEREA

SEQ ID NO: 1913424 - protein, 8 aa, Staphylococcus
EDETTQTA

SEQ ID NO: 1913425 - protein, 12 aa, Staphylococcus
EDEYNENIRLNY

SEQ ID NO: 1913426 - protein, 4 aa, Staphylococcus
EDID

SEQ ID NO: 1913427 - protein, 16 aa, Staphylococcus
EDLDGKKESKNDPELG

SEQ ID NO: 1913428 - protein, 11 aa, Staphylococcus
EDLNKKAGLSQ

SEQ ID NO: 1913429 - protein, 8 aa, Staphylococcus
EDMKRQSK

SEQ ID NO: 1913430 - protein, 8 aa, Staphylococcus
EDNKGSVV

SEQ ID NO: 1913431 - protein, 14 aa, Staphylococcus
EDNQVTVRDRDSME

SEQ ID NO: 1913432 - protein, 5 aa, Staphylococcus
EDNSD

SEQ ID NO: 1913433 - protein, 8 aa, Staphylococcus
EDPRTGKP

SEQ ID NO: 1913434 - protein, 4 aa, Staphylococcus
EDQQ

SEQ ID NO: 1913435 - protein, 7 aa, Staphylococcus
EDSKENR

SEQ ID NO: 1913436 - protein, 5 aa, Staphylococcus
EDTDD

SEQ ID NO: 1913437 - protein, 4 aa, Staphylococcus
EDTV

SEQ ID NO: 1913438 - protein, 18 aa, Staphylococcus
EDVTPKDFGRVGAQAAKQ

SEQ ID NO: 1913439 - protein, 8 aa, Staphylococcus
EDYDSGHI

SEQ ID NO: 1913440 - protein, 4 aa, Staphylococcus
EDYE

SEQ ID NO: 1913441 - protein, 6 aa, Staphylococcus
EDYPDT

SEQ ID NO: 1913442 - protein, 6 aa, Staphylococcus
EDYPEA

SEQ ID NO: 1913443 - protein, 4 aa, Staphylococcus
EEDL

SEQ ID NO: 1913444 - protein, 4 aa, Staphylococcus
EEEI

SEQ ID NO: 1913445 - protein, 4 aa, Staphylococcus
EEEQ

SEQ ID NO: 1913446 - protein, 4 aa, Staphylococcus
EEGG

SEQ ID NO: 1913447 - protein, 4 aa, Staphylococcus
EEGY

SEQ ID NO: 1913448 - protein, 15 aa, Staphylococcus
EEKGYIRRDPTKPRA

SEQ ID NO: 1913449 - protein, 24 aa, Staphylococcus
EEKNYGYSPQETTKNVKKLKRYRN

SEQ ID NO: 1913450 - protein, 13 aa, Staphylococcus
EELAGKEATFKTK

SEQ ID NO: 1913451 - protein, 10 aa, Staphylococcus
EEPPISVKDG

SEQ ID NO: 1913452 - protein, 8 aa, Staphylococcus
EEQALEKY

SEQ ID NO: 1913453 - protein, 8 aa, Staphylococcus
EEQEASPK

SEQ ID NO: 1913454 - protein, 7 aa, Staphylococcus
EEQRGDD

SEQ ID NO: 1913455 - protein, 18 aa, Staphylococcus
EESEDSFEDIAEDLIDFD

SEQ ID NO: 1913456 - protein, 5 aa, Staphylococcus
EESGL

SEQ ID NO: 1913457 - protein, 6 aa, Staphylococcus
EETEAK

SEQ ID NO: 1913458 - protein, 8 aa, Staphylococcus
EETKGAFP

SEQ ID NO: 1913459 - protein, 5 aa, Staphylococcus
EETNP

SEQ ID NO: 1913460 - protein, 15 aa, Staphylococcus
EEVKKKASVLSGGEK

SEQ ID NO: 1913461 - protein, 12 aa, Staphylococcus
EEVTATDVEGGN

SEQ ID NO: 1913462 - protein, 12 aa, Staphylococcus
EFEPQGDQPQAI

SEQ ID NO: 1913463 - protein, 9 aa, Staphylococcus
EFESSTPYY

SEQ ID NO: 1913464 - protein, 8 aa, Staphylococcus
EFESTTPY

SEQ ID NO: 1913465 - protein, 10 aa, Staphylococcus
EFKYSDNAQY

SEQ ID NO: 1913466 - protein, 10 aa, Staphylococcus
EGAGGGHAPD

SEQ ID NO: 1913467 - protein, 11 aa, Staphylococcus
EGAGGGHAPDL

SEQ ID NO: 1913468 - protein, 8 aa, Staphylococcus
EGDISSPY

SEQ ID NO: 1913469 - protein, 4 aa, Staphylococcus
EGDV

SEQ ID NO: 1913470 - protein, 5 aa, Staphylococcus
EGDVI

SEQ ID NO: 1913471 - protein, 7 aa, Staphylococcus
EGEDERV

SEQ ID NO: 1913472 - protein, 9 aa, Staphylococcus
EGGSGGALG

SEQ ID NO: 1913473 - protein, 4 aa, Staphylococcus
EGHS

SEQ ID NO: 1913474 - protein, 17 aa, Staphylococcus
EGINGTLSGTKEDTDKY

SEQ ID NO: 1913475 - protein, 4 aa, Staphylococcus
EGKE

SEQ ID NO: 1913476 - protein, 4 aa, Staphylococcus
EGMP

SEQ ID NO: 1913477 - protein, 17 aa, Staphylococcus
EGNEKMSKSKGNVINPD

SEQ ID NO: 1913478 - protein, 17 aa, Staphylococcus
EGNEKMSKSKGNVVNPD

SEQ ID NO: 1913479 - protein, 9 aa, Staphylococcus
EGNNNYGKE

SEQ ID NO: 1913480 - protein, 5 aa, Staphylococcus
EGNRT

SEQ ID NO: 1913481 - protein, 8 aa, Staphylococcus
EGPGSYTG

SEQ ID NO: 1913482 - protein, 5 aa, Staphylococcus
EGQDI

SEQ ID NO: 1913483 - protein, 7 aa, Staphylococcus
EGQKTGA

SEQ ID NO: 1913484 - protein, 20 aa, Staphylococcus
EGQTKSKLGTSEARSAVDSV

SEQ ID NO: 1913485 - protein, 9 aa, Staphylococcus
EGQTLGRLS

SEQ ID NO: 1913486 - protein, 5 aa, Staphylococcus
EGSIP

SEQ ID NO: 1913487 - protein, 6 aa, Staphylococcus
EGTLHP

SEQ ID NO: 1913488 - protein, 15 aa, Staphylococcus
EGTTPHTITGRYGSG

SEQ ID NO: 1913489 - protein, 7 aa, Staphylococcus
EGTTQVT

SEQ ID NO: 1913490 - protein, 7 aa, Staphylococcus
EHQPARS

SEQ ID NO: 1913491 - protein, 22 aa, Staphylococcus
EHTSQRERRAIEAERDTDELKK

SEQ ID NO: 1913492 - protein, 5 aa, Staphylococcus
EIESN

SEQ ID NO: 1913493 - protein, 10 aa, Staphylococcus
EIPSPVSGTV

SEQ ID NO: 1913494 - protein, 12 aa, Staphylococcus
EISEYSAHNQRG

SEQ ID NO: 1913495 - protein, 6 aa, Staphylococcus
EISPDT

SEQ ID NO: 1913496 - protein, 6 aa, Staphylococcus
EISTTT

SEQ ID NO: 1913497 - protein, 7 aa, Staphylococcus
EITQESS

SEQ ID NO: 1913498 - protein, 7 aa, Staphylococcus
EIYETPG

SEQ ID NO: 1913499 - protein, 5 aa, Staphylococcus
EKALQ

SEQ ID NO: 1913500 - protein, 11 aa, Staphylococcus
EKANSGHPGLP

SEQ ID NO: 1913501 - protein, 4 aa, Staphylococcus
EKAT

SEQ ID NO: 1913502 - protein, 9 aa, Staphylococcus
EKAYNGEKR

SEQ ID NO: 1913503 - protein, 8 aa, Staphylococcus
EKDKVGEA

SEQ ID NO: 1913504 - protein, 13 aa, Staphylococcus
EKEHSDHFNVENA

SEQ ID NO: 1913505 - protein, 5 aa, Staphylococcus
EKEQV

SEQ ID NO: 1913506 - protein, 6 aa, Staphylococcus
EKFTGQ

SEQ ID NO: 1913507 - protein, 15 aa, Staphylococcus
EKGEPTLELNDDGGY

SEQ ID NO: 1913508 - protein, 15 aa, Staphylococcus
EKGERELGTQMKATG

SEQ ID NO: 1913509 - protein, 5 aa, Staphylococcus
EKGEV

SEQ ID NO: 1913510 - protein, 10 aa, Staphylococcus
EKGGKGGVDL

SEQ ID NO: 1913511 - protein, 5 aa, Staphylococcus
EKGIT

SEQ ID NO: 1913512 - protein, 8 aa, Staphylococcus
EKGNYSAI

SEQ ID NO: 1913513 - protein, 8 aa, Staphylococcus
EKGPEVPR

SEQ ID NO: 1913514 - protein, 4 aa, Staphylococcus
EKGV

SEQ ID NO: 1913515 - protein, 7 aa, Staphylococcus
EKLEECG

SEQ ID NO: 1913516 - protein, 16 aa, Staphylococcus
EKLLTEAQDALSTPSN

SEQ ID NO: 1913517 - protein, 8 aa, Staphylococcus
EKLPEDFQ

SEQ ID NO: 1913518 - protein, 7 aa, Staphylococcus
EKLSDRA

SEQ ID NO: 1913519 - protein, 7 aa, Staphylococcus
EKMRKAE

SEQ ID NO: 1913520 - protein, 8 aa, Staphylococcus
EKPGVQGK

SEQ ID NO: 1913521 - protein, 11 aa, Staphylococcus
EKPKQGTAPSN

SEQ ID NO: 1913522 - protein, 4 aa, Staphylococcus
EKQI

SEQ ID NO: 1913523 - protein, 5 aa, Staphylococcus
EKRLP

SEQ ID NO: 1913524 - protein, 7 aa, Staphylococcus
EKSFGKG

SEQ ID NO: 1913525 - protein, 6 aa, Staphylococcus
EKSQNL

SEQ ID NO: 1913526 - protein, 16 aa, Staphylococcus
EKTGMKGRRETNTMPQ

SEQ ID NO: 1913527 - protein, 5 aa, Staphylococcus
EKYPN

SEQ ID NO: 1913528 - protein, 4 aa, Staphylococcus
EKYR

SEQ ID NO: 1913529 - protein, 10 aa, Staphylococcus
ELADKSEADM

SEQ ID NO: 1913530 - protein, 5 aa, Staphylococcus
ELEEK

SEQ ID NO: 1913531 - protein, 5 aa, Staphylococcus
ELEER

SEQ ID NO: 1913532 - protein, 4 aa, Staphylococcus
ELER

SEQ ID NO: 1913533 - protein, 6 aa, Staphylococcus
ELGGGS

SEQ ID NO: 1913534 - protein, 4 aa, Staphylococcus
ELGK

SEQ ID NO: 1913535 - protein, 6 aa, Staphylococcus
ELGSVG

SEQ ID NO: 1913536 - protein, 5 aa, Staphylococcus
ELGTA

SEQ ID NO: 1913537 - protein, 7 aa, Staphylococcus
ELPENAR

SEQ ID NO: 1913538 - protein, 16 aa, Staphylococcus
ELQQKTSAFGQSTTVT

SEQ ID NO: 1913539 - protein, 8 aa, Staphylococcus
ELRESRSD

SEQ ID NO: 1913540 - protein, 7 aa, Staphylococcus
ELSPTSD

SEQ ID NO: 1913541 - protein, 5 aa, Staphylococcus
EMAER

SEQ ID NO: 1913542 - protein, 10 aa, Staphylococcus
EMEDEPVRAI

SEQ ID NO: 1913543 - protein, 8 aa, Staphylococcus
EMEPDEGT

SEQ ID NO: 1913544 - protein, 4 aa, Staphylococcus
EMPP

SEQ ID NO: 1913545 - protein, 11 aa, Staphylococcus
EMQTGEGKTLT

SEQ ID NO: 1913546 - protein, 4 aa, Staphylococcus
ENAA

SEQ ID NO: 1913547 - protein, 6 aa, Staphylococcus
ENAGLE

SEQ ID NO: 1913548 - protein, 7 aa, Staphylococcus
ENAGLEG

SEQ ID NO: 1913549 - protein, 4 aa, Staphylococcus
ENEA

SEQ ID NO: 1913550 - protein, 5 aa, Staphylococcus
ENEGV

SEQ ID NO: 1913551 - protein, 5 aa, Staphylococcus
ENEHR

SEQ ID NO: 1913552 - protein, 17 aa, Staphylococcus
ENEKNYPDAIETGKEGL

SEQ ID NO: 1913553 - protein, 8 aa, Staphylococcus
ENGAGKST

SEQ ID NO: 1913554 - protein, 4 aa, Staphylococcus
ENGD

SEQ ID NO: 1913555 - protein, 6 aa, Staphylococcus
ENGDYP

SEQ ID NO: 1913556 - protein, 4 aa, Staphylococcus
ENIS

SEQ ID NO: 1913557 - protein, 8 aa, Staphylococcus
ENKDATGY

SEQ ID NO: 1913558 - protein, 6 aa, Staphylococcus
ENKGAW

SEQ ID NO: 1913559 - protein, 5 aa, Staphylococcus
ENMGQ

SEQ ID NO: 1913560 - protein, 10 aa, Staphylococcus
ENRKARHDYN

SEQ ID NO: 1913561 - protein, 4 aa, Staphylococcus
ENTP

SEQ ID NO: 1913562 - protein, 5 aa, Staphylococcus
ENVDG

SEQ ID NO: 1913563 - protein, 4 aa, Staphylococcus
ENVP

SEQ ID NO: 1913564 - protein, 4 aa, Staphylococcus
EPEK

SEQ ID NO: 1913565 - protein, 5 aa, Staphylococcus
EPLNP

SEQ ID NO: 1913566 - protein, 8 aa, Staphylococcus
EPQPPSED

SEQ ID NO: 1913567 - protein, 8 aa, Staphylococcus
EPRGCPRG

SEQ ID NO: 1913568 - protein, 13 aa, Staphylococcus
EPTGALDSKSAQD

SEQ ID NO: 1913569 - protein, 14 aa, Staphylococcus
EPTGALDSKSAQDL

SEQ ID NO: 1913570 - protein, 10 aa, Staphylococcus
EPTNDLDTET

SEQ ID NO: 1913571 - protein, 6 aa, Staphylococcus
EPTRDE

SEQ ID NO: 1913572 - protein, 9 aa, Staphylococcus
EPTSALDPI

SEQ ID NO: 1913573 - protein, 7 aa, Staphylococcus
EPTSGLD

SEQ ID NO: 1913574 - protein, 8 aa, Staphylococcus
EPVSLQPS

SEQ ID NO: 1913575 - protein, 6 aa, Staphylococcus
EQAKAQ

SEQ ID NO: 1913576 - protein, 6 aa, Staphylococcus
EQARQG

SEQ ID NO: 1913577 - protein, 5 aa, Staphylococcus
EQHPN

SEQ ID NO: 1913578 - protein, 7 aa, Staphylococcus
EQIETQD

SEQ ID NO: 1913579 - protein, 5 aa, Staphylococcus
EQKKQ

SEQ ID NO: 1913580 - protein, 13 aa, Staphylococcus
EQLKQGQEIVGNR

SEQ ID NO: 1913581 - protein, 4 aa, Staphylococcus
EQNL

SEQ ID NO: 1913582 - protein, 8 aa, Staphylococcus
EQNNDENG

SEQ ID NO: 1913583 - protein, 6 aa, Staphylococcus
EQSGIS

SEQ ID NO: 1913584 - protein, 12 aa, Staphylococcus
EQVRNNGERVEI

SEQ ID NO: 1913585 - protein, 7 aa, Staphylococcus
EQYDEDL

SEQ ID NO: 1913586 - protein, 6 aa, Staphylococcus
EQYTNG

SEQ ID NO: 1913587 - protein, 4 aa, Staphylococcus
ERAP

SEQ ID NO: 1913588 - protein, 7 aa, Staphylococcus
ERDSQKG

SEQ ID NO: 1913589 - protein, 5 aa, Staphylococcus
ERERG

SEQ ID NO: 1913590 - protein, 7 aa, Staphylococcus
EREVGQN

SEQ ID NO: 1913591 - protein, 4 aa, Staphylococcus
ERGR

SEQ ID NO: 1913592 - protein, 4 aa, Staphylococcus
ERIE

SEQ ID NO: 1913593 - protein, 9 aa, Staphylococcus
ERKDEDEPL

SEQ ID NO: 1913594 - protein, 11 aa, Staphylococcus
ERKERDHRKIG

SEQ ID NO: 1913595 - protein, 16 aa, Staphylococcus
ERKGRDKKQVSVYAVA

SEQ ID NO: 1913596 - protein, 12 aa, Staphylococcus
ERLAKAKEVGAT

SEQ ID NO: 1913597 - protein, 4 aa, Staphylococcus
ERPE

SEQ ID NO: 1913598 - protein, 8 aa, Staphylococcus
ERPQDDER

SEQ ID NO: 1913599 - protein, 4 aa, Staphylococcus
ERRG

SEQ ID NO: 1913600 - protein, 7 aa, Staphylococcus
ERRNRSK

SEQ ID NO: 1913601 - protein, 11 aa, Staphylococcus
ERSSARETAAR

SEQ ID NO: 1913602 - protein, 7 aa, Staphylococcus
ERTQAIG

SEQ ID NO: 1913603 - protein, 6 aa, Staphylococcus
ERTREI

SEQ ID NO: 1913604 - protein, 6 aa, Staphylococcus
ESAASG

SEQ ID NO: 1913605 - protein, 5 aa, Staphylococcus
ESAEV

SEQ ID NO: 1913606 - protein, 6 aa, Staphylococcus
ESAGVI

SEQ ID NO: 1913607 - protein, 8 aa, Staphylococcus
ESEQTPTS

SEQ ID NO: 1913608 - protein, 4 aa, Staphylococcus
ESFK

SEQ ID NO: 1913609 - protein, 8 aa, Staphylococcus
ESGSGKST

SEQ ID NO: 1913610 - protein, 9 aa, Staphylococcus
ESKETGNKE

SEQ ID NO: 1913611 - protein, 4 aa, Staphylococcus
ESLE

SEQ ID NO: 1913612 - protein, 5 aa, Staphylococcus
ESLED

SEQ ID NO: 1913613 - protein, 9 aa, Staphylococcus
ESPGASTSV

SEQ ID NO: 1913614 - protein, 5 aa, Staphylococcus
ESQTV

SEQ ID NO: 1913615 - protein, 4 aa, Staphylococcus
ETAD

SEQ ID NO: 1913616 - protein, 5 aa, Staphylococcus
ETCPI

SEQ ID NO: 1913617 - protein, 4 aa, Staphylococcus
ETDE

SEQ ID NO: 1913618 - protein, 9 aa, Staphylococcus
ETEARTGFV

SEQ ID NO: 1913619 - protein, 4 aa, Staphylococcus
ETGK

SEQ ID NO: 1913620 - protein, 11 aa, Staphylococcus
ETHGVNPKAIE

SEQ ID NO: 1913621 - protein, 4 aa, Staphylococcus
ETLN

SEQ ID NO: 1913622 - protein, 4 aa, Staphylococcus
ETLT

SEQ ID NO: 1913623 - protein, 4 aa, Staphylococcus
ETNY

SEQ ID NO: 1913624 - protein, 9 aa, Staphylococcus
ETPNGNGGV

SEQ ID NO: 1913625 - protein, 12 aa, Staphylococcus
ETRDDAVGEAYD

SEQ ID NO: 1913626 - protein, 8 aa, Staphylococcus
ETTARYGE

SEQ ID NO: 1913627 - protein, 7 aa, Staphylococcus
ETTVQGD

SEQ ID NO: 1913628 - protein, 7 aa, Staphylococcus
ETTVQGE

SEQ ID NO: 1913629 - protein, 4 aa, Staphylococcus
ETVR

SEQ ID NO: 1913630 - protein, 9 aa, Staphylococcus
ETVTPHDHQ

SEQ ID NO: 1913631 - protein, 4 aa, Staphylococcus
ETYQ

SEQ ID NO: 1913632 - protein, 13 aa, Staphylococcus
EVPELSRQSKGIP

SEQ ID NO: 1913633 - protein, 4 aa, Staphylococcus
EVRG

SEQ ID NO: 1913634 - protein, 5 aa, Staphylococcus
EVSTK

SEQ ID NO: 1913635 - protein, 5 aa, Staphylococcus
EVTNT

SEQ ID NO: 1913636 - protein, 6 aa, Staphylococcus
EYAGEM

SEQ ID NO: 1913637 - protein, 10 aa, Staphylococcus
EYGQSTLDDG

SEQ ID NO: 1913638 - protein, 20 aa, Staphylococcus
EYRNDISEEEIEATGAGDQG

SEQ ID NO: 1913639 - protein, 4 aa, Staphylococcus
FAEK

SEQ ID NO: 1913640 - protein, 5 aa, Staphylococcus
FDEEN

SEQ ID NO: 1913641 - protein, 11 aa, Staphylococcus
FDTKHTHGTGC

SEQ ID NO: 1913642 - protein, 16 aa, Staphylococcus
FEQQKKEKEMKKKQKV

SEQ ID NO: 1913643 - protein, 8 aa, Staphylococcus
FGAPHETA

SEQ ID NO: 1913644 - protein, 5 aa, Staphylococcus
FGDPE

SEQ ID NO: 1913645 - protein, 6 aa, Staphylococcus
FGEATR

SEQ ID NO: 1913646 - protein, 8 aa, Staphylococcus
FGGYDGKG

SEQ ID NO: 1913647 - protein, 27 aa, Staphylococcus
FGTEIPDEEAEKINTVGDAVKYINSLE

SEQ ID NO: 1913648 - protein, 11 aa, Staphylococcus
FGYGSTDTGNV

SEQ ID NO: 1913649 - protein, 4 aa, Staphylococcus
FIPG

SEQ ID NO: 1913650 - protein, 6 aa, Staphylococcus
FKEGLS

SEQ ID NO: 1913651 - protein, 5 aa, Staphylococcus
FKGER

SEQ ID NO: 1913652 - protein, 22 aa, Staphylococcus
FKQSAQVQGKFSRQSGGRGQYG

SEQ ID NO: 1913653 - protein, 5 aa, Staphylococcus
FNEEE

SEQ ID NO: 1913654 - protein, 10 aa, Staphylococcus
FNEGKRNEVR

SEQ ID NO: 1913655 - protein, 4 aa, Staphylococcus
FPAG

SEQ ID NO: 1913656 - protein, 7 aa, Staphylococcus
FPKTASA

SEQ ID NO: 1913657 - protein, 5 aa, Staphylococcus
FPTGA

SEQ ID NO: 1913658 - protein, 14 aa, Staphylococcus
FQPKENLAEVLDKH

SEQ ID NO: 1913659 - protein, 10 aa, Staphylococcus
FRAEKSKTRR

SEQ ID NO: 1913660 - protein, 10 aa, Staphylococcus
FRDRRQRKRD

SEQ ID NO: 1913661 - protein, 6 aa, Staphylococcus
FRNAGQ

SEQ ID NO: 1913662 - protein, 6 aa, Staphylococcus
FRPGQK

SEQ ID NO: 1913663 - protein, 11 aa, Staphylococcus
FSDAGNAANLA

SEQ ID NO: 1913664 - protein, 9 aa, Staphylococcus
FSGQKCSAC

SEQ ID NO: 1913665 - protein, 5 aa, Staphylococcus
FSTDD

SEQ ID NO: 1913666 - protein, 17 aa, Staphylococcus
FTGPHGGGGPGSGPVGV

SEQ ID NO: 1913667 - protein, 5 aa, Staphylococcus
FTGTS

SEQ ID NO: 1913668 - protein, 6 aa, Staphylococcus
FTGTSG

SEQ ID NO: 1913669 - protein, 8 aa, Staphylococcus
GAANEGNF

SEQ ID NO: 1913670 - protein, 8 aa, Staphylococcus
GADGPSFD

SEQ ID NO: 1913671 - protein, 4 aa, Staphylococcus
GADL

SEQ ID NO: 1913672 - protein, 4 aa, Staphylococcus
GAEA

SEQ ID NO: 1913673 - protein, 13 aa, Staphylococcus
GAGAGAAAQHSQS

SEQ ID NO: 1913674 - protein, 6 aa, Staphylococcus
GAGKTT

SEQ ID NO: 1913675 - protein, 8 aa, Staphylococcus
GAKAPNLV

SEQ ID NO: 1913676 - protein, 4 aa, Staphylococcus
GAKD

SEQ ID NO: 1913677 - protein, 7 aa, Staphylococcus
GAKGARV

SEQ ID NO: 1913678 - protein, 7 aa, Staphylococcus
GAKTFEQ

SEQ ID NO: 1913679 - protein, 10 aa, Staphylococcus
GALPANEGRG

SEQ ID NO: 1913680 - protein, 7 aa, Staphylococcus
GAMAKHT

SEQ ID NO: 1913681 - protein, 14 aa, Staphylococcus
GANAALNAFDYIIR

SEQ ID NO: 1913682 - protein, 16 aa, Staphylococcus
GANETRSYLASGTSRL

SEQ ID NO: 1913683 - protein, 9 aa, Staphylococcus
GANSNITYG

SEQ ID NO: 1913684 - protein, 18 aa, Staphylococcus
GAPPGYVGHDEGGQLTEA

SEQ ID NO: 1913685 - protein, 7 aa, Staphylococcus
GAPTPVQ

SEQ ID NO: 1913686 - protein, 7 aa, Staphylococcus
GAQAAPH

SEQ ID NO: 1913687 - protein, 14 aa, Staphylococcus
GAQTERSKRNFPVG

SEQ ID NO: 1913688 - protein, 8 aa, Staphylococcus
GASEITES

SEQ ID NO: 1913689 - protein, 9 aa, Staphylococcus
GASGSGKTT

SEQ ID NO: 1913690 - protein, 4 aa, Staphylococcus
GASL

SEQ ID NO: 1913691 - protein, 5 aa, Staphylococcus
GASLP

SEQ ID NO: 1913692 - protein, 10 aa, Staphylococcus
GASPIVSGEL

SEQ ID NO: 1913693 - protein, 6 aa, Staphylococcus
GATGGR

SEQ ID NO: 1913694 - protein, 4 aa, Staphylococcus
GATK

SEQ ID NO: 1913695 - protein, 4 aa, Staphylococcus
GCGE

SEQ ID NO: 1913696 - protein, 7 aa, Staphylococcus
GDARRGQ

SEQ ID NO: 1913697 - protein, 10 aa, Staphylococcus
GDDHVSNTPK

SEQ ID NO: 1913698 - protein, 9 aa, Staphylococcus
GDEGKGKIT

SEQ ID NO: 1913699 - protein, 4 aa, Staphylococcus
GDER

SEQ ID NO: 1913700 - protein, 14 aa, Staphylococcus
GDGEGVGNPLSEHP

SEQ ID NO: 1913701 - protein, 16 aa, Staphylococcus
GDGSYRGAQRISEECP

SEQ ID NO: 1913702 - protein, 6 aa, Staphylococcus
GDGTLN

SEQ ID NO: 1913703 - protein, 7 aa, Staphylococcus
GDKVPDI

SEQ ID NO: 1913704 - protein, 4 aa, Staphylococcus
GDPL

SEQ ID NO: 1913705 - protein, 5 aa, Staphylococcus
GDPTW

SEQ ID NO: 1913706 - protein, 13 aa, Staphylococcus
GDRMGQGKENVKT

SEQ ID NO: 1913707 - protein, 7 aa, Staphylococcus
GDRSFSE

SEQ ID NO: 1913708 - protein, 8 aa, Staphylococcus
GDTDDGSR

SEQ ID NO: 1913709 - protein, 7 aa, Staphylococcus
GDTGADC

SEQ ID NO: 1913710 - protein, 10 aa, Staphylococcus
GEALAGDKGF

SEQ ID NO: 1913711 - protein, 10 aa, Staphylococcus
GEALAGEKGF

SEQ ID NO: 1913712 - protein, 7 aa, Staphylococcus
GEAYGYA

SEQ ID NO: 1913713 - protein, 7 aa, Staphylococcus
GEDTDIA

SEQ ID NO: 1913714 - protein, 4 aa, Staphylococcus
GEEI

SEQ ID NO: 1913715 - protein, 27 aa, Staphylococcus
GEGDKAFCSGGDQKKRGHGGYVGEDQI

SEQ ID NO: 1913716 - protein, 8 aa, Staphylococcus
GEGELPDE

SEQ ID NO: 1913717 - protein, 8 aa, Staphylococcus
GEGGNGGQ

SEQ ID NO: 1913718 - protein, 7 aa, Staphylococcus
GEHGDSE

SEQ ID NO: 1913719 - protein, 8 aa, Staphylococcus
GEINGRPK

SEQ ID NO: 1913720 - protein, 4 aa, Staphylococcus
GELR

SEQ ID NO: 1913721 - protein, 12 aa, Staphylococcus
GERDLTKTPEMG

SEQ ID NO: 1913722 - protein, 8 aa, Staphylococcus
GERTPHGD

SEQ ID NO: 1913723 - protein, 7 aa, Staphylococcus
GESKVET

SEQ ID NO: 1913724 - protein, 12 aa, Staphylococcus
GETAAGLYPEEA

SEQ ID NO: 1913725 - protein, 4 aa, Staphylococcus
GETG

SEQ ID NO: 1913726 - protein, 11 aa, Staphylococcus
GETKADDIPAD

SEQ ID NO: 1913727 - protein, 4 aa, Staphylococcus
GEYA

SEQ ID NO: 1913728 - protein, 9 aa, Staphylococcus
GFGNTTTNI

SEQ ID NO: 1913729 - protein, 9 aa, Staphylococcus
GFLPGNGAI

SEQ ID NO: 1913730 - protein, 4 aa, Staphylococcus
GFPK

SEQ ID NO: 1913731 - protein, 4 aa, Staphylococcus
GGAI

SEQ ID NO: 1913732 - protein, 7 aa, Staphylococcus
GGASGPL

SEQ ID NO: 1913733 - protein, 7 aa, Staphylococcus
GGDGTLN

SEQ ID NO: 1913734 - protein, 10 aa, Staphylococcus
GGDNLAATFS

SEQ ID NO: 1913735 - protein, 6 aa, Staphylococcus
GGDPAI

SEQ ID NO: 1913736 - protein, 6 aa, Staphylococcus
GGDPSS

SEQ ID NO: 1913737 - protein, 15 aa, Staphylococcus
GGDPTATGMGGESIY

SEQ ID NO: 1913738 - protein, 7 aa, Staphylococcus
GGETAEM

SEQ ID NO: 1913739 - protein, 9 aa, Staphylococcus
GGGDSAAAA

SEQ ID NO: 1913740 - protein, 4 aa, Staphylococcus
GGGI

SEQ ID NO: 1913741 - protein, 8 aa, Staphylococcus
GGGTPTAL

SEQ ID NO: 1913742 - protein, 7 aa, Staphylococcus
GGHGTSI

SEQ ID NO: 1913743 - protein, 9 aa, Staphylococcus
GGIEPATTE

SEQ ID NO: 1913744 - protein, 7 aa, Staphylococcus
GGKNPNI

SEQ ID NO: 1913745 - protein, 10 aa, Staphylococcus
GGKNYSDSPK

SEQ ID NO: 1913746 - protein, 5 aa, Staphylococcus
GGKSP

SEQ ID NO: 1913747 - protein, 15 aa, Staphylococcus
GGQEPGSGAEANQNC

SEQ ID NO: 1913748 - protein, 6 aa, Staphylococcus
GGQGHL

SEQ ID NO: 1913749 - protein, 5 aa, Staphylococcus
GGQLT

SEQ ID NO: 1913750 - protein, 4 aa, Staphylococcus
GGQM

SEQ ID NO: 1913751 - protein, 9 aa, Staphylococcus
GGQSKGEAI

SEQ ID NO: 1913752 - protein, 6 aa, Staphylococcus
GGSERI

SEQ ID NO: 1913753 - protein, 8 aa, Staphylococcus
GGSTETSY

SEQ ID NO: 1913754 - protein, 6 aa, Staphylococcus
GGTFGK

SEQ ID NO: 1913755 - protein, 7 aa, Staphylococcus
GGTSNKY

SEQ ID NO: 1913756 - protein, 7 aa, Staphylococcus
GHDHSKH

SEQ ID NO: 1913757 - protein, 7 aa, Staphylococcus
GHEGPDS

SEQ ID NO: 1913758 - protein, 12 aa, Staphylococcus
GHGGDSGSIEDL

SEQ ID NO: 1913759 - protein, 23 aa, Staphylococcus
GHGKSLSRLGGGIGTRGPGETKL

SEQ ID NO: 1913760 - protein, 8 aa, Staphylococcus
GHSERSGA

SEQ ID NO: 1913761 - protein, 10 aa, Staphylococcus
GHSQLPSDGL

SEQ ID NO: 1913762 - protein, 7 aa, Staphylococcus
GIDPDKS

SEQ ID NO: 1913763 - protein, 7 aa, Staphylococcus
GIDPKSQ

SEQ ID NO: 1913764 - protein, 13 aa, Staphylococcus
GIEGRTAYKGPLQ

SEQ ID NO: 1913765 - protein, 5 aa, Staphylococcus
GIGGE

SEQ ID NO: 1913766 - protein, 9 aa, Staphylococcus
GIGKKTARQ

SEQ ID NO: 1913767 - protein, 4 aa, Staphylococcus
GIIE

SEQ ID NO: 1913768 - protein, 7 aa, Staphylococcus
GIIGDGN

SEQ ID NO: 1913769 - protein, 5 aa, Staphylococcus
GIKTG

SEQ ID NO: 1913770 - protein, 7 aa, Staphylococcus
GINGEIR

SEQ ID NO: 1913771 - protein, 5 aa, Staphylococcus
GINSV

SEQ ID NO: 1913772 - protein, 6 aa, Staphylococcus
GIPGIS

SEQ ID NO: 1913773 - protein, 13 aa, Staphylococcus
GIRRAYETGRGSI

SEQ ID NO: 1913774 - protein, 7 aa, Staphylococcus
GIRTHGD

SEQ ID NO: 1913775 - protein, 8 aa, Staphylococcus
GISAPTDV

SEQ ID NO: 1913776 - protein, 4 aa, Staphylococcus
GISN

SEQ ID NO: 1913777 - protein, 12 aa, Staphylococcus
GISNAANKVPGV

SEQ ID NO: 1913778 - protein, 14 aa, Staphylococcus
GITPKPQDGNPKPR

SEQ ID NO: 1913779 - protein, 5 aa, Staphylococcus
GITRK

SEQ ID NO: 1913780 - protein, 6 aa, Staphylococcus
GKAARN

SEQ ID NO: 1913781 - protein, 10 aa, Staphylococcus
GKALDQDKSY

SEQ ID NO: 1913782 - protein, 7 aa, Staphylococcus
GKAREVI

SEQ ID NO: 1913783 - protein, 6 aa, Staphylococcus
GKEGLS

SEQ ID NO: 1913784 - protein, 7 aa, Staphylococcus
GKFNHGD

SEQ ID NO: 1913785 - protein, 6 aa, Staphylococcus
GKGHMS

SEQ ID NO: 1913786 - protein, 4 aa, Staphylococcus
GKGN

SEQ ID NO: 1913787 - protein, 8 aa, Staphylococcus
GKGQVGRV

SEQ ID NO: 1913788 - protein, 10 aa, Staphylococcus
GKGQVQDAGA

SEQ ID NO: 1913789 - protein, 5 aa, Staphylococcus
GKGTY

SEQ ID NO: 1913790 - protein, 13 aa, Staphylococcus
GKIGTKTSYQTIQ

SEQ ID NO: 1913791 - protein, 10 aa, Staphylococcus
GKKISGKELR

SEQ ID NO: 1913792 - protein, 9 aa, Staphylococcus
GKKRIDVPE

SEQ ID NO: 1913793 - protein, 5 aa, Staphylococcus
GKLTG

SEQ ID NO: 1913794 - protein, 7 aa, Staphylococcus
GKNAGEA

SEQ ID NO: 1913795 - protein, 14 aa, Staphylococcus
GKNPKYNFEREEKF

SEQ ID NO: 1913796 - protein, 7 aa, Staphylococcus
GKQTYSD

SEQ ID NO: 1913797 - protein, 8 aa, Staphylococcus
GKRGTAQR

SEQ ID NO: 1913798 - protein, 8 aa, Staphylococcus
GLAEQQNG

SEQ ID NO: 1913799 - protein, 8 aa, Staphylococcus
GLAQEQDV

SEQ ID NO: 1913800 - protein, 5 aa, Staphylococcus
GLDYG

SEQ ID NO: 1913801 - protein, 8 aa, Staphylococcus
GLGSSASA

SEQ ID NO: 1913802 - protein, 5 aa, Staphylococcus
GLKSF

SEQ ID NO: 1913803 - protein, 6 aa, Staphylococcus
GLNKPN

SEQ ID NO: 1913804 - protein, 12 aa, Staphylococcus
GLPIGGYGGRQD

SEQ ID NO: 1913805 - protein, 9 aa, Staphylococcus
GLPRHTSTH

SEQ ID NO: 1913806 - protein, 4 aa, Staphylococcus
GLTS

SEQ ID NO: 1913807 - protein, 5 aa, Staphylococcus
GNADV

SEQ ID NO: 1913808 - protein, 14 aa, Staphylococcus
GNAGYMTDTEPGSL

SEQ ID NO: 1913809 - protein, 11 aa, Staphylococcus
GNDKCDLDEQT

SEQ ID NO: 1913810 - protein, 8 aa, Staphylococcus
GNGPQVGS

SEQ ID NO: 1913811 - protein, 8 aa, Staphylococcus
GNGSLDKK

SEQ ID NO: 1913812 - protein, 5 aa, Staphylococcus
GNINR

SEQ ID NO: 1913813 - protein, 7 aa, Staphylococcus
GNKALSN

SEQ ID NO: 1913814 - protein, 6 aa, Staphylococcus
GNKEHV

SEQ ID NO: 1913815 - protein, 6 aa, Staphylococcus
GNKKPI

SEQ ID NO: 1913816 - protein, 7 aa, Staphylococcus
GNPGRSA

SEQ ID NO: 1913817 - protein, 13 aa, Staphylococcus
GNQRDDRTHTGTI

SEQ ID NO: 1913818 - protein, 5 aa, Staphylococcus
GNRNG

SEQ ID NO: 1913819 - protein, 8 aa, Staphylococcus
GNSGPLLP

SEQ ID NO: 1913820 - protein, 4 aa, Staphylococcus
GPDL

SEQ ID NO: 1913821 - protein, 5 aa, Staphylococcus
GPDLS

SEQ ID NO: 1913822 - protein, 13 aa, Staphylococcus
GPDREQTNLLEKL

SEQ ID NO: 1913823 - protein, 11 aa, Staphylococcus
GPEMKSTGEVM

SEQ ID NO: 1913824 - protein, 4 aa, Staphylococcus
GPEP

SEQ ID NO: 1913825 - protein, 8 aa, Staphylococcus
GPERSEEL

SEQ ID NO: 1913826 - protein, 8 aa, Staphylococcus
GPLTTENL

SEQ ID NO: 1913827 - protein, 6 aa, Staphylococcus
GPNGAG

SEQ ID NO: 1913828 - protein, 10 aa, Staphylococcus
GPNGAGKSSL

SEQ ID NO: 1913829 - protein, 10 aa, Staphylococcus
GPNTGGKTVT

SEQ ID NO: 1913830 - protein, 15 aa, Staphylococcus
GPRRGDGAESVIIEL

SEQ ID NO: 1913831 - protein, 10 aa, Staphylococcus
GPSGSGKSTL

SEQ ID NO: 1913832 - protein, 8 aa, Staphylococcus
GPSPAALS

SEQ ID NO: 1913833 - protein, 8 aa, Staphylococcus
GPTAPTTA

SEQ ID NO: 1913834 - protein, 17 aa, Staphylococcus
GPTGSQMGKKETAADTA

SEQ ID NO: 1913835 - protein, 11 aa, Staphylococcus
GPTKDIPAPDV

SEQ ID NO: 1913836 - protein, 6 aa, Staphylococcus
GPYDAN

SEQ ID NO: 1913837 - protein, 13 aa, Staphylococcus
GQAQTGTGKTGAF

SEQ ID NO: 1913838 - protein, 12 aa, Staphylococcus
GQDKEATQQARD

SEQ ID NO: 1913839 - protein, 10 aa, Staphylococcus
GQDKEATQTM

SEQ ID NO: 1913840 - protein, 10 aa, Staphylococcus
GQEERDKEAQ

SEQ ID NO: 1913841 - protein, 7 aa, Staphylococcus
GQEPPYT

SEQ ID NO: 1913842 - protein, 5 aa, Staphylococcus
GQGTL

SEQ ID NO: 1913843 - protein, 10 aa, Staphylococcus
GQKAYDETGE

SEQ ID NO: 1913844 - protein, 7 aa, Staphylococcus
GQPIGSK

SEQ ID NO: 1913845 - protein, 6 aa, Staphylococcus
GQQTEI

SEQ ID NO: 1913846 - protein, 8 aa, Staphylococcus
GQSGVGKS

SEQ ID NO: 1913847 - protein, 10 aa, Staphylococcus
GQSQTGTGKS

SEQ ID NO: 1913848 - protein, 11 aa, Staphylococcus
GRDPAPEEIGE

SEQ ID NO: 1913849 - protein, 7 aa, Staphylococcus
GRETPLT

SEQ ID NO: 1913850 - protein, 8 aa, Staphylococcus
GRFATSDL

SEQ ID NO: 1913851 - protein, 4 aa, Staphylococcus
GRGL

SEQ ID NO: 1913852 - protein, 6 aa, Staphylococcus
GRGPIV

SEQ ID NO: 1913853 - protein, 6 aa, Staphylococcus
GRGSLS

SEQ ID NO: 1913854 - protein, 8 aa, Staphylococcus
GRKSLEEV

SEQ ID NO: 1913855 - protein, 6 aa, Staphylococcus
GRLPGG

SEQ ID NO: 1913856 - protein, 11 aa, Staphylococcus
GRLSAEDKKEI

SEQ ID NO: 1913857 - protein, 9 aa, Staphylococcus
GRLSPSSLG

SEQ ID NO: 1913858 - protein, 11 aa, Staphylococcus
GRPETQRKTVE

SEQ ID NO: 1913859 - protein, 8 aa, Staphylococcus
GRPTNGMS

SEQ ID NO: 1913860 - protein, 5 aa, Staphylococcus
GRQHK

SEQ ID NO: 1913861 - protein, 5 aa, Staphylococcus
GRRNM

SEQ ID NO: 1913862 - protein, 6 aa, Staphylococcus
GRSDYP

SEQ ID NO: 1913863 - protein, 5 aa, Staphylococcus
GRSYS

SEQ ID NO: 1913864 - protein, 11 aa, Staphylococcus
GRTGRAGKEGI

SEQ ID NO: 1913865 - protein, 4 aa, Staphylococcus
GRTH

SEQ ID NO: 1913866 - protein, 6 aa, Staphylococcus
GRYKAN

SEQ ID NO: 1913867 - protein, 7 aa, Staphylococcus
GSDGGFA

SEQ ID NO: 1913868 - protein, 9 aa, Staphylococcus
GSDGSGGKY

SEQ ID NO: 1913869 - protein, 13 aa, Staphylococcus
GSDREQALATKEL

SEQ ID NO: 1913870 - protein, 4 aa, Staphylococcus
GSEV

SEQ ID NO: 1913871 - protein, 10 aa, Staphylococcus
GSGGSTGADK

SEQ ID NO: 1913872 - protein, 10 aa, Staphylococcus
GSGPAGLTAA

SEQ ID NO: 1913873 - protein, 5 aa, Staphylococcus
GSGTA

SEQ ID NO: 1913874 - protein, 7 aa, Staphylococcus
GSHASRY

SEQ ID NO: 1913875 - protein, 5 aa, Staphylococcus
GSITV

SEQ ID NO: 1913876 - protein, 5 aa, Staphylococcus
GSLKD

SEQ ID NO: 1913877 - protein, 5 aa, Staphylococcus
GSPYD

SEQ ID NO: 1913878 - protein, 9 aa, Staphylococcus
GSQNARDLP

SEQ ID NO: 1913879 - protein, 9 aa, Staphylococcus
GSRAVKPPV

SEQ ID NO: 1913880 - protein, 5 aa, Staphylococcus
GTASI

SEQ ID NO: 1913881 - protein, 10 aa, Staphylococcus
GTDPSGGAGV

SEQ ID NO: 1913882 - protein, 7 aa, Staphylococcus
GTDSHTT

SEQ ID NO: 1913883 - protein, 8 aa, Staphylococcus
GTEHEQNA

SEQ ID NO: 1913884 - protein, 5 aa, Staphylococcus
GTGSL

SEQ ID NO: 1913885 - protein, 6 aa, Staphylococcus
GTGVAP

SEQ ID NO: 1913886 - protein, 4 aa, Staphylococcus
GTIA

SEQ ID NO: 1913887 - protein, 4 aa, Staphylococcus
GTIT

SEQ ID NO: 1913888 - protein, 7 aa, Staphylococcus
GTKLQSG

SEQ ID NO: 1913889 - protein, 8 aa, Staphylococcus
GTLSQNKK

SEQ ID NO: 1913890 - protein, 9 aa, Staphylococcus
GTLSQNKKG

SEQ ID NO: 1913891 - protein, 4 aa, Staphylococcus
GTME

SEQ ID NO: 1913892 - protein, 6 aa, Staphylococcus
GTNPEM

SEQ ID NO: 1913893 - protein, 5 aa, Staphylococcus
GTPGR

SEQ ID NO: 1913894 - protein, 6 aa, Staphylococcus
GTRAEE

SEQ ID NO: 1913895 - protein, 8 aa, Staphylococcus
GTRGFKAG

SEQ ID NO: 1913896 - protein, 29 aa, Staphylococcus
GTSTAKKIVEEANVSADTRVKDLTDDELG

SEQ ID NO: 1913897 - protein, 18 aa, Staphylococcus
GTTASVPPQGGRKHPNQE

SEQ ID NO: 1913898 - protein, 5 aa, Staphylococcus
GTTPE

SEQ ID NO: 1913899 - protein, 5 aa, Staphylococcus
GTTSG

SEQ ID NO: 1913900 - protein, 7 aa, Staphylococcus
GTVDGPG

SEQ ID NO: 1913901 - protein, 7 aa, Staphylococcus
GTVRNYT

SEQ ID NO: 1913902 - protein, 8 aa, Staphylococcus
GTYKGKEI

SEQ ID NO: 1913903 - protein, 5 aa, Staphylococcus
GTYSE

SEQ ID NO: 1913904 - protein, 10 aa, Staphylococcus
GVANKELTPE

SEQ ID NO: 1913905 - protein, 5 aa, Staphylococcus
GVDPS

SEQ ID NO: 1913906 - protein, 9 aa, Staphylococcus
GVEATTQIK

SEQ ID NO: 1913907 - protein, 12 aa, Staphylococcus
GVFSEPASNASI

SEQ ID NO: 1913908 - protein, 10 aa, Staphylococcus
GVGKSTLTQA

SEQ ID NO: 1913909 - protein, 9 aa, Staphylococcus
GVGKTTTIG

SEQ ID NO: 1913910 - protein, 5 aa, Staphylococcus
GVGYQ

SEQ ID NO: 1913911 - protein, 12 aa, Staphylococcus
GVKNGVPTPGFS

SEQ ID NO: 1913912 - protein, 4 aa, Staphylococcus
GVNG

SEQ ID NO: 1913913 - protein, 5 aa, Staphylococcus
GVNGI

SEQ ID NO: 1913914 - protein, 5 aa, Staphylococcus
GVPLE

SEQ ID NO: 1913915 - protein, 11 aa, Staphylococcus
GVTGTNGKTSI

SEQ ID NO: 1913916 - protein, 5 aa, Staphylococcus
GYDER

SEQ ID NO: 1913917 - protein, 16 aa, Staphylococcus
GYDKPENKAQMTPQEQ

SEQ ID NO: 1913918 - protein, 4 aa, Staphylococcus
GYEI

SEQ ID NO: 1913919 - protein, 11 aa, Staphylococcus
GYGPTENTTFT

SEQ ID NO: 1913920 - protein, 12 aa, Staphylococcus
GYITPENATTEI

SEQ ID NO: 1913921 - protein, 6 aa, Staphylococcus
GYTSYT

SEQ ID NO: 1913922 - protein, 7 aa, Staphylococcus
HAGGSDL

SEQ ID NO: 1913923 - protein, 7 aa, Staphylococcus
HANSGKY

SEQ ID NO: 1913924 - protein, 10 aa, Staphylococcus
HDEDDEDNIL

SEQ ID NO: 1913925 - protein, 4 aa, Staphylococcus
HDFD

SEQ ID NO: 1913926 - protein, 13 aa, Staphylococcus
HDQPRRVSTWGDD

SEQ ID NO: 1913927 - protein, 5 aa, Staphylococcus
HEEAP

SEQ ID NO: 1913928 - protein, 5 aa, Staphylococcus
HEEEN

SEQ ID NO: 1913929 - protein, 11 aa, Staphylococcus
HEESPGETVEL

SEQ ID NO: 1913930 - protein, 11 aa, Staphylococcus
HEFSGGQRQRI

SEQ ID NO: 1913931 - protein, 6 aa, Staphylococcus
HEGPDS

SEQ ID NO: 1913932 - protein, 6 aa, Staphylococcus
HFKPGQ

SEQ ID NO: 1913933 - protein, 5 aa, Staphylococcus
HGETG

SEQ ID NO: 1913934 - protein, 8 aa, Staphylococcus
HGGSATNI

SEQ ID NO: 1913935 - protein, 6 aa, Staphylococcus
HGKTTL

SEQ ID NO: 1913936 - protein, 14 aa, Staphylococcus
HGPGGRIAEFIEGI

SEQ ID NO: 1913937 - protein, 5 aa, Staphylococcus
HGSTF

SEQ ID NO: 1913938 - protein, 4 aa, Staphylococcus
HGTS

SEQ ID NO: 1913939 - protein, 8 aa, Staphylococcus
HGTSTPVG

SEQ ID NO: 1913940 - protein, 9 aa, Staphylococcus
HHGGGHKRQ

SEQ ID NO: 1913941 - protein, 5 aa, Staphylococcus
HHPRE

SEQ ID NO: 1913942 - protein, 5 aa, Staphylococcus
HKETY

SEQ ID NO: 1913943 - protein, 7 aa, Staphylococcus
HKGNLTK

SEQ ID NO: 1913944 - protein, 5 aa, Staphylococcus
HKRAI

SEQ ID NO: 1913945 - protein, 9 aa, Staphylococcus
HLTHGSPVN

SEQ ID NO: 1913946 - protein, 12 aa, Staphylococcus
HNEMDEPSITNP

SEQ ID NO: 1913947 - protein, 9 aa, Staphylococcus
HNNEAEQSV

SEQ ID NO: 1913948 - protein, 6 aa, Staphylococcus
HNPVAD

SEQ ID NO: 1913949 - protein, 7 aa, Staphylococcus
HNPVADN

SEQ ID NO: 1913950 - protein, 8 aa, Staphylococcus
HNTDPTFQ

SEQ ID NO: 1913951 - protein, 10 aa, Staphylococcus
HNVPGAEEYT

SEQ ID NO: 1913952 - protein, 10 aa, Staphylococcus
HPDAGKTTLT

SEQ ID NO: 1913953 - protein, 6 aa, Staphylococcus
HPEEYP

SEQ ID NO: 1913954 - protein, 6 aa, Staphylococcus
HPYEGK

SEQ ID NO: 1913955 - protein, 4 aa, Staphylococcus
HQFP

SEQ ID NO: 1913956 - protein, 11 aa, Staphylococcus
HQGKRSEELGI

SEQ ID NO: 1913957 - protein, 8 aa, Staphylococcus
HQKENASL

SEQ ID NO: 1913958 - protein, 5 aa, Staphylococcus
HQMKT

SEQ ID NO: 1913959 - protein, 4 aa, Staphylococcus
HREL

SEQ ID NO: 1913960 - protein, 4 aa, Staphylococcus
HREN

SEQ ID NO: 1913961 - protein, 8 aa, Staphylococcus
HRKGSHEK

SEQ ID NO: 1913962 - protein, 10 aa, Staphylococcus
HRRDKEGYAQ

SEQ ID NO: 1913963 - protein, 12 aa, Staphylococcus
HRSGETEDTTIS

SEQ ID NO: 1913964 - protein, 4 aa, Staphylococcus
HSEN

SEQ ID NO: 1913965 - protein, 9 aa, Staphylococcus
HSKEAQSLE

SEQ ID NO: 1913966 - protein, 6 aa, Staphylococcus
HSPFEE

SEQ ID NO: 1913967 - protein, 4 aa, Staphylococcus
HSRF

SEQ ID NO: 1913968 - protein, 6 aa, Staphylococcus
HTENGV

SEQ ID NO: 1913969 - protein, 6 aa, Staphylococcus
HTKNKD

SEQ ID NO: 1913970 - protein, 4 aa, Staphylococcus
HTPS

SEQ ID NO: 1913971 - protein, 8 aa, Staphylococcus
HTPTKKEF

SEQ ID NO: 1913972 - protein, 4 aa, Staphylococcus
HTVR

SEQ ID NO: 1913973 - protein, 6 aa, Staphylococcus
HTYGQR

SEQ ID NO: 1913974 - protein, 6 aa, Staphylococcus
HYDGGR

SEQ ID NO: 1913975 - protein, 4 aa, Staphylococcus
HYNN

SEQ ID NO: 1913976 - protein, 8 aa, Staphylococcus
IAAEQGTK

SEQ ID NO: 1913977 - protein, 6 aa, Staphylococcus
IAAGAD

SEQ ID NO: 1913978 - protein, 5 aa, Staphylococcus
IAGSG

SEQ ID NO: 1913979 - protein, 20 aa, Staphylococcus
IANADDPVEAAKQCRDAIEG

SEQ ID NO: 1913980 - protein, 4 aa, Staphylococcus
IAPG

SEQ ID NO: 1913981 - protein, 4 aa, Staphylococcus
IDAD

SEQ ID NO: 1913982 - protein, 6 aa, Staphylococcus
IDGATA

SEQ ID NO: 1913983 - protein, 7 aa, Staphylococcus
IDGGMSD

SEQ ID NO: 1913984 - protein, 4 aa, Staphylococcus
IDGM

SEQ ID NO: 1913985 - protein, 10 aa, Staphylococcus
IDKPTANPDR

SEQ ID NO: 1913986 - protein, 5 aa, Staphylococcus
IDTDL

SEQ ID NO: 1913987 - protein, 7 aa, Staphylococcus
IEEAESY

SEQ ID NO: 1913988 - protein, 13 aa, Staphylococcus
IEEEPFDGDALKF

SEQ ID NO: 1913989 - protein, 18 aa, Staphylococcus
IEEQADEVQKVKRSENGV

SEQ ID NO: 1913990 - protein, 11 aa, Staphylococcus
IEGDDESFKSL

SEQ ID NO: 1913991 - protein, 4 aa, Staphylococcus
IEGE

SEQ ID NO: 1913992 - protein, 11 aa, Staphylococcus
IEGHPDNVAPT

SEQ ID NO: 1913993 - protein, 5 aa, Staphylococcus
IEGKE

SEQ ID NO: 1913994 - protein, 13 aa, Staphylococcus
IELSADGPIRPPY

SEQ ID NO: 1913995 - protein, 4 aa, Staphylococcus
IENA

SEQ ID NO: 1913996 - protein, 8 aa, Staphylococcus
IEPGRSIV

SEQ ID NO: 1913997 - protein, 14 aa, Staphylococcus
IEQESGASTATISR

SEQ ID NO: 1913998 - protein, 14 aa, Staphylococcus
IEQGDEIAKSRLAE

SEQ ID NO: 1913999 - protein, 6 aa, Staphylococcus
IETGEV

SEQ ID NO: 1914000 - protein, 12 aa, Staphylococcus
IETKVGKGYMAH

SEQ ID NO: 1914001 - protein, 8 aa, Staphylococcus
IGGETAEM

SEQ ID NO: 1914002 - protein, 8 aa, Staphylococcus
IGKAQRVA

SEQ ID NO: 1914003 - protein, 6 aa, Staphylococcus
IGPDAI

SEQ ID NO: 1914004 - protein, 10 aa, Staphylococcus
IGPNGCGKST

SEQ ID NO: 1914005 - protein, 5 aa, Staphylococcus
IGRDC

SEQ ID NO: 1914006 - protein, 9 aa, Staphylococcus
IGSNAGGIK

SEQ ID NO: 1914007 - protein, 29 aa, Staphylococcus
IKAQQAREAARKAREDARSGKKNKRKDTL

SEQ ID NO: 1914008 - protein, 16 aa, Staphylococcus
IKEGDKVTGEVQQVED

SEQ ID NO: 1914009 - protein, 8 aa, Staphylococcus
IKETEKYG

SEQ ID NO: 1914010 - protein, 5 aa, Staphylococcus
IKITE

SEQ ID NO: 1914011 - protein, 12 aa, Staphylococcus
IKNNTERKPKGL

SEQ ID NO: 1914012 - protein, 7 aa, Staphylococcus
IKVEEGQ

SEQ ID NO: 1914013 - protein, 8 aa, Staphylococcus
IKVEEGQE

SEQ ID NO: 1914014 - protein, 6 aa, Staphylococcus
INASGP

SEQ ID NO: 1914015 - protein, 16 aa, Staphylococcus
INASTGKYTGRSPKDK

SEQ ID NO: 1914016 - protein, 13 aa, Staphylococcus
INESDVTLANASN

SEQ ID NO: 1914017 - protein, 4 aa, Staphylococcus
INKP

SEQ ID NO: 1914018 - protein, 4 aa, Staphylococcus
INKR

SEQ ID NO: 1914019 - protein, 9 aa, Staphylococcus
INNNDTPSN

SEQ ID NO: 1914020 - protein, 14 aa, Staphylococcus
INPEKDVDGFHPSN

SEQ ID NO: 1914021 - protein, 9 aa, Staphylococcus
INPTEGEVV

SEQ ID NO: 1914022 - protein, 7 aa, Staphylococcus
INTKEDF

SEQ ID NO: 1914023 - protein, 4 aa, Staphylococcus
IPDP

SEQ ID NO: 1914024 - protein, 6 aa, Staphylococcus
IPEDES

SEQ ID NO: 1914025 - protein, 10 aa, Staphylococcus
IPENQKYGAF

SEQ ID NO: 1914026 - protein, 4 aa, Staphylococcus
IPEQ

SEQ ID NO: 1914027 - protein, 6 aa, Staphylococcus
IPGEDR

SEQ ID NO: 1914028 - protein, 11 aa, Staphylococcus
IPGTDGPIENF

SEQ ID NO: 1914029 - protein, 7 aa, Staphylococcus
IPKNKNK

SEQ ID NO: 1914030 - protein, 4 aa, Staphylococcus
IPTT

SEQ ID NO: 1914031 - protein, 5 aa, Staphylococcus
IQGGP

SEQ ID NO: 1914032 - protein, 5 aa, Staphylococcus
IQGSQ

SEQ ID NO: 1914033 - protein, 4 aa, Staphylococcus
IQKD

SEQ ID NO: 1914034 - protein, 6 aa, Staphylococcus
IQPDGY

SEQ ID NO: 1914035 - protein, 5 aa, Staphylococcus
IQQFG

SEQ ID NO: 1914036 - protein, 12 aa, Staphylococcus
IQQFGTPTDIYD

SEQ ID NO: 1914037 - protein, 9 aa, Staphylococcus
IQSETMDSI

SEQ ID NO: 1914038 - protein, 4 aa, Staphylococcus
IRDG

SEQ ID NO: 1914039 - protein, 7 aa, Staphylococcus
IRQATTD

SEQ ID NO: 1914040 - protein, 4 aa, Staphylococcus
ISDE

SEQ ID NO: 1914041 - protein, 4 aa, Staphylococcus
ISEE

SEQ ID NO: 1914042 - protein, 7 aa, Staphylococcus
ISHSSAE

SEQ ID NO: 1914043 - protein, 11 aa, Staphylococcus
ISSGPMPSQSA

SEQ ID NO: 1914044 - protein, 4 aa, Staphylococcus
ISTI

SEQ ID NO: 1914045 - protein, 10 aa, Staphylococcus
ITEDNRSDLG

SEQ ID NO: 1914046 - protein, 12 aa, Staphylococcus
ITEKSSEAMAED

SEQ ID NO: 1914047 - protein, 4 aa, Staphylococcus
ITNE

SEQ ID NO: 1914048 - protein, 5 aa, Staphylococcus
ITPAS

SEQ ID NO: 1914049 - protein, 9 aa, Staphylococcus
ITPVPGGVG

SEQ ID NO: 1914050 - protein, 19 aa, Staphylococcus
ITRASTSGMAKSRRKTLEK

SEQ ID NO: 1914051 - protein, 5 aa, Staphylococcus
ITTDK

SEQ ID NO: 1914052 - protein, 12 aa, Staphylococcus
IVGGKSPDSGHE

SEQ ID NO: 1914053 - protein, 6 aa, Staphylococcus
KAAGAS

SEQ ID NO: 1914054 - protein, 4 aa, Staphylococcus
KAEQ

SEQ ID NO: 1914055 - protein, 8 aa, Staphylococcus
KAGNPDIM

SEQ ID NO: 1914056 - protein, 7 aa, Staphylococcus
KAHNEPS

SEQ ID NO: 1914057 - protein, 4 aa, Staphylococcus
KAHS

SEQ ID NO: 1914058 - protein, 7 aa, Staphylococcus
KAIEGIP

SEQ ID NO: 1914059 - protein, 8 aa, Staphylococcus
KAKEQGKK

SEQ ID NO: 1914060 - protein, 6 aa, Staphylococcus
KAKTGA

SEQ ID NO: 1914061 - protein, 6 aa, Staphylococcus
KALAEN

SEQ ID NO: 1914062 - protein, 7 aa, Staphylococcus
KALAESG

SEQ ID NO: 1914063 - protein, 11 aa, Staphylococcus
KALEGDAQYEE

SEQ ID NO: 1914064 - protein, 4 aa, Staphylococcus
KANP

SEQ ID NO: 1914065 - protein, 5 aa, Staphylococcus
KAPVT

SEQ ID NO: 1914066 - protein, 4 aa, Staphylococcus
KARA

SEQ ID NO: 1914067 - protein, 16 aa, Staphylococcus
KARDGKLTSDEMKGAT

SEQ ID NO: 1914068 - protein, 10 aa, Staphylococcus
KAREDDIKEK

SEQ ID NO: 1914069 - protein, 7 aa, Staphylococcus
KARTTAI

SEQ ID NO: 1914070 - protein, 8 aa, Staphylococcus
KASEHAAR

SEQ ID NO: 1914071 - protein, 4 aa, Staphylococcus
KASI

SEQ ID NO: 1914072 - protein, 13 aa, Staphylococcus
KATIERSDSCAVP

SEQ ID NO: 1914073 - protein, 7 aa, Staphylococcus
KAVEKGL

SEQ ID NO: 1914074 - protein, 8 aa, Staphylococcus
KAYETGKG

SEQ ID NO: 1914075 - protein, 18 aa, Staphylococcus
KDAAEKAKKDLSGVSQTQ

SEQ ID NO: 1914076 - protein, 5 aa, Staphylococcus
KDAGQ

SEQ ID NO: 1914077 - protein, 5 aa, Staphylococcus
KDAMG

SEQ ID NO: 1914078 - protein, 6 aa, Staphylococcus
KDANAN

SEQ ID NO: 1914079 - protein, 12 aa, Staphylococcus
KDAVKDSFKHPR

SEQ ID NO: 1914080 - protein, 4 aa, Staphylococcus
KDCL

SEQ ID NO: 1914081 - protein, 10 aa, Staphylococcus
KDDAKEVAQG

SEQ ID NO: 1914082 - protein, 4 aa, Staphylococcus
KDDP

SEQ ID NO: 1914083 - protein, 8 aa, Staphylococcus
KDEDIEST

SEQ ID NO: 1914084 - protein, 5 aa, Staphylococcus
KDGEI

SEQ ID NO: 1914085 - protein, 6 aa, Staphylococcus
KDHAKD

SEQ ID NO: 1914086 - protein, 6 aa, Staphylococcus
KDHLSA

SEQ ID NO: 1914087 - protein, 24 aa, Staphylococcus
KDLGTNKEQNITIQSSSALSDEEI

SEQ ID NO: 1914088 - protein, 7 aa, Staphylococcus
KDNENGF

SEQ ID NO: 1914089 - protein, 5 aa, Staphylococcus
KDNNY

SEQ ID NO: 1914090 - protein, 10 aa, Staphylococcus
KDNTLAQKAN

SEQ ID NO: 1914091 - protein, 7 aa, Staphylococcus
KDPDQTV

SEQ ID NO: 1914092 - protein, 5 aa, Staphylococcus
KDPDV

SEQ ID NO: 1914093 - protein, 13 aa, Staphylococcus
KDQKENGSKRRTV

SEQ ID NO: 1914094 - protein, 15 aa, Staphylococcus
KDQRPHALSGGQQQR

SEQ ID NO: 1914095 - protein, 10 aa, Staphylococcus
KEAAEKGKQV

SEQ ID NO: 1914096 - protein, 8 aa, Staphylococcus
KEAEEKVR

SEQ ID NO: 1914097 - protein, 8 aa, Staphylococcus
KEATGGLD

SEQ ID NO: 1914098 - protein, 7 aa, Staphylococcus
KEDGQRD

SEQ ID NO: 1914099 - protein, 7 aa, Staphylococcus
KEDPEYT

SEQ ID NO: 1914100 - protein, 4 aa, Staphylococcus
KEEL

SEQ ID NO: 1914101 - protein, 4 aa, Staphylococcus
KEFG

SEQ ID NO: 1914102 - protein, 6 aa, Staphylococcus
KEGGVD

SEQ ID NO: 1914103 - protein, 8 aa, Staphylococcus
KEGSISKE

SEQ ID NO: 1914104 - protein, 5 aa, Staphylococcus
KEGTV

SEQ ID NO: 1914105 - protein, 4 aa, Staphylococcus
KEGY

SEQ ID NO: 1914106 - protein, 8 aa, Staphylococcus
KEGYETEG

SEQ ID NO: 1914107 - protein, 8 aa, Staphylococcus
KEHANRYP

SEQ ID NO: 1914108 - protein, 6 aa, Staphylococcus
KEISIR

SEQ ID NO: 1914109 - protein, 7 aa, Staphylococcus
KEISKPD

SEQ ID NO: 1914110 - protein, 4 aa, Staphylococcus
KENH

SEQ ID NO: 1914111 - protein, 7 aa, Staphylococcus
KENSGTG

SEQ ID NO: 1914112 - protein, 9 aa, Staphylococcus
KEPTPIQKD

SEQ ID NO: 1914113 - protein, 7 aa, Staphylococcus
KEPYPNY

SEQ ID NO: 1914114 - protein, 7 aa, Staphylococcus
KEQADKV

SEQ ID NO: 1914115 - protein, 7 aa, Staphylococcus
KEQAQEQ

SEQ ID NO: 1914116 - protein, 5 aa, Staphylococcus
KEQFG

SEQ ID NO: 1914117 - protein, 5 aa, Staphylococcus
KEQGF

SEQ ID NO: 1914118 - protein, 8 aa, Staphylococcus
KEQLSGSC

SEQ ID NO: 1914119 - protein, 6 aa, Staphylococcus
KEQPDA

SEQ ID NO: 1914120 - protein, 8 aa, Staphylococcus
KESIKNTV

SEQ ID NO: 1914121 - protein, 4 aa, Staphylococcus
KETP

SEQ ID NO: 1914122 - protein, 8 aa, Staphylococcus
KEVENNEV

SEQ ID NO: 1914123 - protein, 5 aa, Staphylococcus
KEVKQ

SEQ ID NO: 1914124 - protein, 4 aa, Staphylococcus
KEVY

SEQ ID NO: 1914125 - protein, 4 aa, Staphylococcus
KFEE

SEQ ID NO: 1914126 - protein, 7 aa, Staphylococcus
KFEGEGC

SEQ ID NO: 1914127 - protein, 7 aa, Staphylococcus
KFGGPKG

SEQ ID NO: 1914128 - protein, 12 aa, Staphylococcus
KFNTRDKNRFER

SEQ ID NO: 1914129 - protein, 8 aa, Staphylococcus
KFRSGDYT

SEQ ID NO: 1914130 - protein, 6 aa, Staphylococcus
KGASQL

SEQ ID NO: 1914131 - protein, 11 aa, Staphylococcus
KGGVGKTTVAT

SEQ ID NO: 1914132 - protein, 6 aa, Staphylococcus
KGIEEG

SEQ ID NO: 1914133 - protein, 4 aa, Staphylococcus
KGIP

SEQ ID NO: 1914134 - protein, 9 aa, Staphylococcus
KGKTNKEIA

SEQ ID NO: 1914135 - protein, 7 aa, Staphylococcus
KGNEVDY

SEQ ID NO: 1914136 - protein, 4 aa, Staphylococcus
KGNL

SEQ ID NO: 1914137 - protein, 14 aa, Staphylococcus
KGNVEEPEHDGTAE

SEQ ID NO: 1914138 - protein, 5 aa, Staphylococcus
KGPGH

SEQ ID NO: 1914139 - protein, 15 aa, Staphylococcus
KGPTGSGKTKLAETL

SEQ ID NO: 1914140 - protein, 4 aa, Staphylococcus
KGQA

SEQ ID NO: 1914141 - protein, 6 aa, Staphylococcus
KGRSGF

SEQ ID NO: 1914142 - protein, 6 aa, Staphylococcus
KGSTYY

SEQ ID NO: 1914143 - protein, 7 aa, Staphylococcus
KGTGALQ

SEQ ID NO: 1914144 - protein, 9 aa, Staphylococcus
KGVKGSTVR

SEQ ID NO: 1914145 - protein, 4 aa, Staphylococcus
KGWG

SEQ ID NO: 1914146 - protein, 4 aa, Staphylococcus
KGYT

SEQ ID NO: 1914147 - protein, 9 aa, Staphylococcus
KHEEGPSMG

SEQ ID NO: 1914148 - protein, 14 aa, Staphylococcus
KHNEVEKEARDKAA

SEQ ID NO: 1914149 - protein, 4 aa, Staphylococcus
KHPK

SEQ ID NO: 1914150 - protein, 4 aa, Staphylococcus
KIAA

SEQ ID NO: 1914151 - protein, 17 aa, Staphylococcus
KIGALTDRNGLRPGRYT

SEQ ID NO: 1914152 - protein, 18 aa, Staphylococcus
KIGALTDRNGLRPGRYTI

SEQ ID NO: 1914153 - protein, 6 aa, Staphylococcus
KIHASS

SEQ ID NO: 1914154 - protein, 4 aa, Staphylococcus
KIKT

SEQ ID NO: 1914155 - protein, 5 aa, Staphylococcus
KIPTH

SEQ ID NO: 1914156 - protein, 15 aa, Staphylococcus
KIRPDGRKPDEIRPL

SEQ ID NO: 1914157 - protein, 8 aa, Staphylococcus
KISESFPE

SEQ ID NO: 1914158 - protein, 8 aa, Staphylococcus
KKAEPGYG

SEQ ID NO: 1914159 - protein, 6 aa, Staphylococcus
KKEGKG

SEQ ID NO: 1914160 - protein, 4 aa, Staphylococcus
KKEI

SEQ ID NO: 1914161 - protein, 4 aa, Staphylococcus
KKEQ

SEQ ID NO: 1914162 - protein, 15 aa, Staphylococcus
KKGDLASRRNAAKTL

SEQ ID NO: 1914163 - protein, 7 aa, Staphylococcus
KKLNSNV

SEQ ID NO: 1914164 - protein, 6 aa, Staphylococcus
KKLRNR

SEQ ID NO: 1914165 - protein, 6 aa, Staphylococcus
KKNFAE

SEQ ID NO: 1914166 - protein, 4 aa, Staphylococcus
KKNK

SEQ ID NO: 1914167 - protein, 6 aa, Staphylococcus
KKPANG

SEQ ID NO: 1914168 - protein, 17 aa, Staphylococcus
KKQAQESVKAEAERAGQ

SEQ ID NO: 1914169 - protein, 10 aa, Staphylococcus
KKQKEEGIES

SEQ ID NO: 1914170 - protein, 7 aa, Staphylococcus
KKQKYAV

SEQ ID NO: 1914171 - protein, 5 aa, Staphylococcus
KKQRN

SEQ ID NO: 1914172 - protein, 9 aa, Staphylococcus
KKTDKGQFT

SEQ ID NO: 1914173 - protein, 10 aa, Staphylococcus
KKTGKAEGDY

SEQ ID NO: 1914174 - protein, 5 aa, Staphylococcus
KKTYE

SEQ ID NO: 1914175 - protein, 8 aa, Staphylococcus
KKVNADED

SEQ ID NO: 1914176 - protein, 7 aa, Staphylococcus
KKYKLDK

SEQ ID NO: 1914177 - protein, 7 aa, Staphylococcus
KKYQNRD

SEQ ID NO: 1914178 - protein, 6 aa, Staphylococcus
KLAAKR

SEQ ID NO: 1914179 - protein, 7 aa, Staphylococcus
KLALTQS

SEQ ID NO: 1914180 - protein, 5 aa, Staphylococcus
KLGEE

SEQ ID NO: 1914181 - protein, 8 aa, Staphylococcus
KLKEEDHG

SEQ ID NO: 1914182 - protein, 8 aa, Staphylococcus
KLMGQKSE

SEQ ID NO: 1914183 - protein, 8 aa, Staphylococcus
KLRGERSE

SEQ ID NO: 1914184 - protein, 8 aa, Staphylococcus
KLRNQDDT

SEQ ID NO: 1914185 - protein, 6 aa, Staphylococcus
KLSEEA

SEQ ID NO: 1914186 - protein, 7 aa, Staphylococcus
KLSTGNT

SEQ ID NO: 1914187 - protein, 4 aa, Staphylococcus
KLTG

SEQ ID NO: 1914188 - protein, 5 aa, Staphylococcus
KMDLP

SEQ ID NO: 1914189 - protein, 7 aa, Staphylococcus
KMSEDLT

SEQ ID NO: 1914190 - protein, 5 aa, Staphylococcus
KMSRP

SEQ ID NO: 1914191 - protein, 6 aa, Staphylococcus
KNDTNW

SEQ ID NO: 1914192 - protein, 6 aa, Staphylococcus
KNENEK

SEQ ID NO: 1914193 - protein, 9 aa, Staphylococcus
KNFGQGMSG

SEQ ID NO: 1914194 - protein, 8 aa, Staphylococcus
KNGKKRIS

SEQ ID NO: 1914195 - protein, 8 aa, Staphylococcus
KNGYYADT

SEQ ID NO: 1914196 - protein, 16 aa, Staphylococcus
KNIAQTGNKPGVTKQQ

SEQ ID NO: 1914197 - protein, 8 aa, Staphylococcus
KNISQDQD

SEQ ID NO: 1914198 - protein, 14 aa, Staphylococcus
KNLATGEKVEVGEA

SEQ ID NO: 1914199 - protein, 6 aa, Staphylococcus
KNMNNS

SEQ ID NO: 1914200 - protein, 6 aa, Staphylococcus
KNNTNI

SEQ ID NO: 1914201 - protein, 6 aa, Staphylococcus
KNPETI

SEQ ID NO: 1914202 - protein, 7 aa, Staphylococcus
KNPETVA

SEQ ID NO: 1914203 - protein, 9 aa, Staphylococcus
KNPVTEPDF

SEQ ID NO: 1914204 - protein, 8 aa, Staphylococcus
KNTLGNTD

SEQ ID NO: 1914205 - protein, 13 aa, Staphylococcus
KNVTSGANPVGLR

SEQ ID NO: 1914206 - protein, 8 aa, Staphylococcus
KNYDSARN

SEQ ID NO: 1914207 - protein, 6 aa, Staphylococcus
KPEFTS

SEQ ID NO: 1914208 - protein, 5 aa, Staphylococcus
KPFVT

SEQ ID NO: 1914209 - protein, 23 aa, Staphylococcus
KPGKGGQLARSAGASSQVLGKEG

SEQ ID NO: 1914210 - protein, 9 aa, Staphylococcus
KPGQKAEDI

SEQ ID NO: 1914211 - protein, 5 aa, Staphylococcus
KPIGV

SEQ ID NO: 1914212 - protein, 5 aa, Staphylococcus
KPPSA

SEQ ID NO: 1914213 - protein, 5 aa, Staphylococcus
KPQAT

SEQ ID NO: 1914214 - protein, 6 aa, Staphylococcus
KPRKVN

SEQ ID NO: 1914215 - protein, 7 aa, Staphylococcus
KPSDRLR

SEQ ID NO: 1914216 - protein, 7 aa, Staphylococcus
KPSEETT

SEQ ID NO: 1914217 - protein, 5 aa, Staphylococcus
KPTPI

SEQ ID NO: 1914218 - protein, 5 aa, Staphylococcus
KPTPV

SEQ ID NO: 1914219 - protein, 5 aa, Staphylococcus
KQAGY

SEQ ID NO: 1914220 - protein, 7 aa, Staphylococcus
KQEPPYT

SEQ ID NO: 1914221 - protein, 11 aa, Staphylococcus
KQGMPSAKKKM

SEQ ID NO: 1914222 - protein, 7 aa, Staphylococcus
KQGRINI

SEQ ID NO: 1914223 - protein, 13 aa, Staphylococcus
KQNDSADTEGVEP

SEQ ID NO: 1914224 - protein, 5 aa, Staphylococcus
KQNQR

SEQ ID NO: 1914225 - protein, 7 aa, Staphylococcus
KQPDLNW

SEQ ID NO: 1914226 - protein, 5 aa, Staphylococcus
KQPQV

SEQ ID NO: 1914227 - protein, 6 aa, Staphylococcus
KQRKKI

SEQ ID NO: 1914228 - protein, 6 aa, Staphylococcus
KQSKPI

SEQ ID NO: 1914229 - protein, 7 aa, Staphylococcus
KQSRTSI

SEQ ID NO: 1914230 - protein, 7 aa, Staphylococcus
KQTLSNA

SEQ ID NO: 1914231 - protein, 8 aa, Staphylococcus
KQTPAHHT

SEQ ID NO: 1914232 - protein, 9 aa, Staphylococcus
KQTPAHHTD

SEQ ID NO: 1914233 - protein, 7 aa, Staphylococcus
KQTVGGY

SEQ ID NO: 1914234 - protein, 5 aa, Staphylococcus
KQVEE

SEQ ID NO: 1914235 - protein, 6 aa, Staphylococcus
KQVEEL

SEQ ID NO: 1914236 - protein, 8 aa, Staphylococcus
KRAAAKQT

SEQ ID NO: 1914237 - protein, 4 aa, Staphylococcus
KRED

SEQ ID NO: 1914238 - protein, 14 aa, Staphylococcus
KRFNGNSRSTVGTV

SEQ ID NO: 1914239 - protein, 10 aa, Staphylococcus
KRGIGPSSVE

SEQ ID NO: 1914240 - protein, 5 aa, Staphylococcus
KRKEE

SEQ ID NO: 1914241 - protein, 8 aa, Staphylococcus
KRKKDSSM

SEQ ID NO: 1914242 - protein, 7 aa, Staphylococcus
KRKKEQF

SEQ ID NO: 1914243 - protein, 9 aa, Staphylococcus
KRKPESKQE

SEQ ID NO: 1914244 - protein, 4 aa, Staphylococcus
KRLE

SEQ ID NO: 1914245 - protein, 4 aa, Staphylococcus
KRLQ

SEQ ID NO: 1914246 - protein, 7 aa, Staphylococcus
KRMKSKT

SEQ ID NO: 1914247 - protein, 6 aa, Staphylococcus
KRQGRQ

SEQ ID NO: 1914248 - protein, 7 aa, Staphylococcus
KRRVDEL

SEQ ID NO: 1914249 - protein, 9 aa, Staphylococcus
KRSNTGTCY

SEQ ID NO: 1914250 - protein, 7 aa, Staphylococcus
KRSVHDE

SEQ ID NO: 1914251 - protein, 11 aa, Staphylococcus
KRWDREEKAYN

SEQ ID NO: 1914252 - protein, 6 aa, Staphylococcus
KSAEHD

SEQ ID NO: 1914253 - protein, 10 aa, Staphylococcus
KSESDAREAG

SEQ ID NO: 1914254 - protein, 9 aa, Staphylococcus
KSETPPFSI

SEQ ID NO: 1914255 - protein, 4 aa, Staphylococcus
KSGC

SEQ ID NO: 1914256 - protein, 8 aa, Staphylococcus
KSGEKIPK

SEQ ID NO: 1914257 - protein, 8 aa, Staphylococcus
KSGPFANQ

SEQ ID NO: 1914258 - protein, 9 aa, Staphylococcus
KSGTTTEPA

SEQ ID NO: 1914259 - protein, 9 aa, Staphylococcus
KSHTTPNNL

SEQ ID NO: 1914260 - protein, 6 aa, Staphylococcus
KSIPQG

SEQ ID NO: 1914261 - protein, 8 aa, Staphylococcus
KSIRGSDV

SEQ ID NO: 1914262 - protein, 9 aa, Staphylococcus
KSISKNGGK

SEQ ID NO: 1914263 - protein, 7 aa, Staphylococcus
KSISNKG

SEQ ID NO: 1914264 - protein, 7 aa, Staphylococcus
KSKGGKL

SEQ ID NO: 1914265 - protein, 5 aa, Staphylococcus
KSKKG

SEQ ID NO: 1914266 - protein, 6 aa, Staphylococcus
KSLDDG

SEQ ID NO: 1914267 - protein, 8 aa, Staphylococcus
KSMEIQND

SEQ ID NO: 1914268 - protein, 5 aa, Staphylococcus
KSMGK

SEQ ID NO: 1914269 - protein, 8 aa, Staphylococcus
KSNTKGYA

SEQ ID NO: 1914270 - protein, 6 aa, Staphylococcus
KSQKVR

SEQ ID NO: 1914271 - protein, 8 aa, Staphylococcus
KSSQNTGT

SEQ ID NO: 1914272 - protein, 17 aa, Staphylococcus
KSSTKYSAEVQDPESLS

SEQ ID NO: 1914273 - protein, 10 aa, Staphylococcus
KSVDEPLQTG

SEQ ID NO: 1914274 - protein, 6 aa, Staphylococcus
KSVSAN

SEQ ID NO: 1914275 - protein, 7 aa, Staphylococcus
KTDEGLD

SEQ ID NO: 1914276 - protein, 7 aa, Staphylococcus
KTEVESK

SEQ ID NO: 1914277 - protein, 12 aa, Staphylococcus
KTFKTSDNLGQK

SEQ ID NO: 1914278 - protein, 6 aa, Staphylococcus
KTGEFG

SEQ ID NO: 1914279 - protein, 6 aa, Staphylococcus
KTGERI

SEQ ID NO: 1914280 - protein, 6 aa, Staphylococcus
KTGNGA

SEQ ID NO: 1914281 - protein, 6 aa, Staphylococcus
KTGSGA

SEQ ID NO: 1914282 - protein, 6 aa, Staphylococcus
KTHNQG

SEQ ID NO: 1914283 - protein, 5 aa, Staphylococcus
KTLEQ

SEQ ID NO: 1914284 - protein, 4 aa, Staphylococcus
KTMA

SEQ ID NO: 1914285 - protein, 8 aa, Staphylococcus
KTNPNSRR

SEQ ID NO: 1914286 - protein, 9 aa, Staphylococcus
KTPVKYASR

SEQ ID NO: 1914287 - protein, 6 aa, Staphylococcus
KTPYLE

SEQ ID NO: 1914288 - protein, 6 aa, Staphylococcus
KVKDPR

SEQ ID NO: 1914289 - protein, 10 aa, Staphylococcus
KVKNEKDAAV

SEQ ID NO: 1914290 - protein, 9 aa, Staphylococcus
KVRDAEPEV

SEQ ID NO: 1914291 - protein, 5 aa, Staphylococcus
KVSIE

SEQ ID NO: 1914292 - protein, 11 aa, Staphylococcus
KVTAGEAGGIT

SEQ ID NO: 1914293 - protein, 6 aa, Staphylococcus
KYADTA

SEQ ID NO: 1914294 - protein, 7 aa, Staphylococcus
KYAKKAK

SEQ ID NO: 1914295 - protein, 6 aa, Staphylococcus
KYDKGL

SEQ ID NO: 1914296 - protein, 5 aa, Staphylococcus
KYEGY

SEQ ID NO: 1914297 - protein, 7 aa, Staphylococcus
KYRGEFE

SEQ ID NO: 1914298 - protein, 5 aa, Staphylococcus
KYSMG

SEQ ID NO: 1914299 - protein, 13 aa, Staphylococcus
LAENGGDAKQIME

SEQ ID NO: 1914300 - protein, 10 aa, Staphylococcus
LAKEYASKFE

SEQ ID NO: 1914301 - protein, 5 aa, Staphylococcus
LANDP

SEQ ID NO: 1914302 - protein, 11 aa, Staphylococcus
LAPGDTKAITE

SEQ ID NO: 1914303 - protein, 5 aa, Staphylococcus
LARPA

SEQ ID NO: 1914304 - protein, 10 aa, Staphylococcus
LASPSAGQRT

SEQ ID NO: 1914305 - protein, 4 aa, Staphylococcus
LDDE

SEQ ID NO: 1914306 - protein, 6 aa, Staphylococcus
LDTCPE

SEQ ID NO: 1914307 - protein, 9 aa, Staphylococcus
LDTHQADDG

SEQ ID NO: 1914308 - protein, 8 aa, Staphylococcus
LDTSTKNH

SEQ ID NO: 1914309 - protein, 4 aa, Staphylococcus
LDYG

SEQ ID NO: 1914310 - protein, 5 aa, Staphylococcus
LEEEG

SEQ ID NO: 1914311 - protein, 6 aa, Staphylococcus
LEEQGL

SEQ ID NO: 1914312 - protein, 7 aa, Staphylococcus
LEERGYN

SEQ ID NO: 1914313 - protein, 5 aa, Staphylococcus
LEPHI

SEQ ID NO: 1914314 - protein, 4 aa, Staphylococcus
LEQG

SEQ ID NO: 1914315 - protein, 5 aa, Staphylococcus
LEQQK

SEQ ID NO: 1914316 - protein, 7 aa, Staphylococcus
LGARKGE

SEQ ID NO: 1914317 - protein, 7 aa, Staphylococcus
LGEDGEY

SEQ ID NO: 1914318 - protein, 10 aa, Staphylococcus
LGEVGKNTYA

SEQ ID NO: 1914319 - protein, 11 aa, Staphylococcus
LGEVGKNTYAV

SEQ ID NO: 1914320 - protein, 4 aa, Staphylococcus
LGGE

SEQ ID NO: 1914321 - protein, 10 aa, Staphylococcus
LGGKGANLSE

SEQ ID NO: 1914322 - protein, 13 aa, Staphylococcus
LGGPTNGVPREDG

SEQ ID NO: 1914323 - protein, 9 aa, Staphylococcus
LGIGGDGDP

SEQ ID NO: 1914324 - protein, 5 aa, Staphylococcus
LGPAL

SEQ ID NO: 1914325 - protein, 8 aa, Staphylococcus
LGPAPEPN

SEQ ID NO: 1914326 - protein, 4 aa, Staphylococcus
LGPT

SEQ ID NO: 1914327 - protein, 9 aa, Staphylococcus
LGQDVTPDK

SEQ ID NO: 1914328 - protein, 11 aa, Staphylococcus
LGRGGSDTTAV

SEQ ID NO: 1914329 - protein, 9 aa, Staphylococcus
LHKRSTGRS

SEQ ID NO: 1914330 - protein, 6 aa, Staphylococcus
LHPGAK

SEQ ID NO: 1914331 - protein, 12 aa, Staphylococcus
LIEKGKKEGHLS

SEQ ID NO: 1914332 - protein, 9 aa, Staphylococcus
LKAKGDYEA

SEQ ID NO: 1914333 - protein, 12 aa, Staphylococcus
LKAKIVKKNQIE

SEQ ID NO: 1914334 - protein, 11 aa, Staphylococcus
LKANPDKQAVG

SEQ ID NO: 1914335 - protein, 9 aa, Staphylococcus
LKEAAKKCD

SEQ ID NO: 1914336 - protein, 13 aa, Staphylococcus
LKETGTGDTLCGE

SEQ ID NO: 1914337 - protein, 9 aa, Staphylococcus
LKEVSGQPY

SEQ ID NO: 1914338 - protein, 4 aa, Staphylococcus
LKGL

SEQ ID NO: 1914339 - protein, 4 aa, Staphylococcus
LKKG

SEQ ID NO: 1914340 - protein, 8 aa, Staphylococcus
LKKRGAKN

SEQ ID NO: 1914341 - protein, 9 aa, Staphylococcus
LKLPNEDLG

SEQ ID NO: 1914342 - protein, 8 aa, Staphylococcus
LKNGNTEL

SEQ ID NO: 1914343 - protein, 7 aa, Staphylococcus
LKNPETY

SEQ ID NO: 1914344 - protein, 8 aa, Staphylococcus
LKNRGAKN

SEQ ID NO: 1914345 - protein, 6 aa, Staphylococcus
LKRGPQ

SEQ ID NO: 1914346 - protein, 6 aa, Staphylococcus
LKSKKG

SEQ ID NO: 1914347 - protein, 11 aa, Staphylococcus
LKTRKEDEVKD

SEQ ID NO: 1914348 - protein, 4 aa, Staphylococcus
LLSE

SEQ ID NO: 1914349 - protein, 8 aa, Staphylococcus
LNAGEGRV

SEQ ID NO: 1914350 - protein, 10 aa, Staphylococcus
LNDDLGGGSI

SEQ ID NO: 1914351 - protein, 7 aa, Staphylococcus
LNHTGAH

SEQ ID NO: 1914352 - protein, 6 aa, Staphylococcus
LNNLTD

SEQ ID NO: 1914353 - protein, 6 aa, Staphylococcus
LNPERS

SEQ ID NO: 1914354 - protein, 11 aa, Staphylococcus
LNPTKSPSVNA

SEQ ID NO: 1914355 - protein, 10 aa, Staphylococcus
LNPTPGRDNH

SEQ ID NO: 1914356 - protein, 14 aa, Staphylococcus
LPAYQGPKHELDED

SEQ ID NO: 1914357 - protein, 4 aa, Staphylococcus
LPED

SEQ ID NO: 1914358 - protein, 8 aa, Staphylococcus
LPEDAGER

SEQ ID NO: 1914359 - protein, 9 aa, Staphylococcus
LPHAPSAQL

SEQ ID NO: 1914360 - protein, 8 aa, Staphylococcus
LPKDKADF

SEQ ID NO: 1914361 - protein, 13 aa, Staphylococcus
LPKRAGRNNQGKL

SEQ ID NO: 1914362 - protein, 9 aa, Staphylococcus
LPKTNSGKI

SEQ ID NO: 1914363 - protein, 6 aa, Staphylococcus
LPNNKR

SEQ ID NO: 1914364 - protein, 6 aa, Staphylococcus
LPRSQM

SEQ ID NO: 1914365 - protein, 4 aa, Staphylococcus
LPSD

SEQ ID NO: 1914366 - protein, 4 aa, Staphylococcus
LPSL

SEQ ID NO: 1914367 - protein, 8 aa, Staphylococcus
LPTGGGKS

SEQ ID NO: 1914368 - protein, 8 aa, Staphylococcus
LQATTTSW

SEQ ID NO: 1914369 - protein, 11 aa, Staphylococcus
LQEGKDDSLEG

SEQ ID NO: 1914370 - protein, 4 aa, Staphylococcus
LQQP

SEQ ID NO: 1914371 - protein, 4 aa, Staphylococcus
LQQV

SEQ ID NO: 1914372 - protein, 10 aa, Staphylococcus
LRDGEQTPGV

SEQ ID NO: 1914373 - protein, 5 aa, Staphylococcus
LRGPG

SEQ ID NO: 1914374 - protein, 6 aa, Staphylococcus
LRKKGV

SEQ ID NO: 1914375 - protein, 13 aa, Staphylococcus
LRKRNTKKVQKNG

SEQ ID NO: 1914376 - protein, 14 aa, Staphylococcus
LRKRNTKKVQKNGV

SEQ ID NO: 1914377 - protein, 12 aa, Staphylococcus
LRPLGRTAAGVK

SEQ ID NO: 1914378 - protein, 7 aa, Staphylococcus
LRPPHRK

SEQ ID NO: 1914379 - protein, 7 aa, Staphylococcus
LRRDQHN

SEQ ID NO: 1914380 - protein, 11 aa, Staphylococcus
LRSEASSRFEK

SEQ ID NO: 1914381 - protein, 12 aa, Staphylococcus
LRTEPKLSLPTA

SEQ ID NO: 1914382 - protein, 7 aa, Staphylococcus
LRTTGGR

SEQ ID NO: 1914383 - protein, 6 aa, Staphylococcus
LSEKQV

SEQ ID NO: 1914384 - protein, 5 aa, Staphylococcus
LSEQY

SEQ ID NO: 1914385 - protein, 6 aa, Staphylococcus
LSEVET

SEQ ID NO: 1914386 - protein, 7 aa, Staphylococcus
LSEVETY

SEQ ID NO: 1914387 - protein, 5 aa, Staphylococcus
LSGLG

SEQ ID NO: 1914388 - protein, 5 aa, Staphylococcus
LSGPD

SEQ ID NO: 1914389 - protein, 20 aa, Staphylococcus
LSITPDRGKEFSKHPEITSE

SEQ ID NO: 1914390 - protein, 5 aa, Staphylococcus
LSKDA

SEQ ID NO: 1914391 - protein, 11 aa, Staphylococcus
LSKITDLTDRS

SEQ ID NO: 1914392 - protein, 15 aa, Staphylococcus
LSNNAEKVTTPGKKN

SEQ ID NO: 1914393 - protein, 9 aa, Staphylococcus
LSPKKNAQL

SEQ ID NO: 1914394 - protein, 5 aa, Staphylococcus
LSQLS

SEQ ID NO: 1914395 - protein, 6 aa, Staphylococcus
LSSQEF

SEQ ID NO: 1914396 - protein, 6 aa, Staphylococcus
LSSSSN

SEQ ID NO: 1914397 - protein, 7 aa, Staphylococcus
LSVGGDL

SEQ ID NO: 1914398 - protein, 9 aa, Staphylococcus
LTDSATAGF

SEQ ID NO: 1914399 - protein, 7 aa, Staphylococcus
LTGGNAG

SEQ ID NO: 1914400 - protein, 10 aa, Staphylococcus
LTPRERKQQM

SEQ ID NO: 1914401 - protein, 11 aa, Staphylococcus
LTPRERKQQMK

SEQ ID NO: 1914402 - protein, 12 aa, Staphylococcus
LTSPKEALENAG

SEQ ID NO: 1914403 - protein, 6 aa, Staphylococcus
LTYATE

SEQ ID NO: 1914404 - protein, 17 aa, Staphylococcus
MAGRGTDIKLGEGVEEI

SEQ ID NO: 1914405 - protein, 7 aa, Staphylococcus
MEGEPIE

SEQ ID NO: 1914406 - protein, 4 aa, Staphylococcus
MEGT

SEQ ID NO: 1914407 - protein, 5 aa, Staphylococcus
MESPQ

SEQ ID NO: 1914408 - protein, 4 aa, Staphylococcus
MGGR

SEQ ID NO: 1914409 - protein, 7 aa, Staphylococcus
MHGPELP

SEQ ID NO: 1914410 - protein, 4 aa, Staphylococcus
MHRQ

SEQ ID NO: 1914411 - protein, 13 aa, Staphylococcus
MLEGSAEEAHKFG

SEQ ID NO: 1914412 - protein, 5 aa, Staphylococcus
MNPEH

SEQ ID NO: 1914413 - protein, 52 aa, Staphylococcus; identical to SEQ ID NO: 1605593

SEQ ID NO: 1914414 - protein, 52 aa, Staphylococcus; identical to SEQ ID NO: 1784611

SEQ ID NO: 1914415 - protein, 6 aa, Staphylococcus
MPGSVT

SEQ ID NO: 1914416 - protein, 4 aa, Staphylococcus
MPRT

SEQ ID NO: 1914417 - protein, 7 aa, Staphylococcus
MQGNSSD

SEQ ID NO: 1914418 - protein, 4 aa, Staphylococcus
MRQE

SEQ ID NO: 1914419 - protein, 4 aa, Staphylococcus
MSGK

SEQ ID NO: 1914420 - protein, 15 aa, Staphylococcus
MSGRGLGHTGGTIDK

SEQ ID NO: 1914421 - protein, 6 aa, Staphylococcus
MSQERR

SEQ ID NO: 1914422 - protein, 5 aa, Staphylococcus
MSSTT

SEQ ID NO: 1914423 - protein, 6 aa, Staphylococcus
MSSTTI

SEQ ID NO: 1914424 - protein, 7 aa, Staphylococcus
NAAVGDT

SEQ ID NO: 1914425 - protein, 8 aa, Staphylococcus
NAEADAAS

SEQ ID NO: 1914426 - protein, 16 aa, Staphylococcus
NAENPEKKFQPTPGKV

SEQ ID NO: 1914427 - protein, 7 aa, Staphylococcus
NATYEAR

SEQ ID NO: 1914428 - protein, 6 aa, Staphylococcus
NAVGGH

SEQ ID NO: 1914429 - protein, 6 aa, Staphylococcus
NAVKES

SEQ ID NO: 1914430 - protein, 16 aa, Staphylococcus
NAVSAQRAVTDTTNDL

SEQ ID NO: 1914431 - protein, 8 aa, Staphylococcus
NDGYDASR

SEQ ID NO: 1914432 - protein, 8 aa, Staphylococcus
NDPEGNGI

SEQ ID NO: 1914433 - protein, 8 aa, Staphylococcus
NDPNINPE

SEQ ID NO: 1914434 - protein, 6 aa, Staphylococcus
NDPRPM

SEQ ID NO: 1914435 - protein, 4 aa, Staphylococcus
NDQS

SEQ ID NO: 1914436 - protein, 16 aa, Staphylococcus
NDSKNEQGAHKDRHEN

SEQ ID NO: 1914437 - protein, 6 aa, Staphylococcus
NDTQSK

SEQ ID NO: 1914438 - protein, 14 aa, Staphylococcus
NDTTVGIASSQGNF

SEQ ID NO: 1914439 - protein, 7 aa, Staphylococcus
NDVGGDI

SEQ ID NO: 1914440 - protein, 4 aa, Staphylococcus
NDVP

SEQ ID NO: 1914441 - protein, 10 aa, Staphylococcus
NDYPETTWPG

SEQ ID NO: 1914442 - protein, 11 aa, Staphylococcus
NDYPETTWPGE

SEQ ID NO: 1914443 - protein, 5 aa, Staphylococcus
NEDGY

SEQ ID NO: 1914444 - protein, 4 aa, Staphylococcus
NEEA

SEQ ID NO: 1914445 - protein, 14 aa, Staphylococcus
NEGIQSNKTKVGDR

SEQ ID NO: 1914446 - protein, 10 aa, Staphylococcus
NEIEPNLEAG

SEQ ID NO: 1914447 - protein, 8 aa, Staphylococcus
NEKGELNG

SEQ ID NO: 1914448 - protein, 18 aa, Staphylococcus
NELKEKDKNLDGNDIREG

SEQ ID NO: 1914449 - protein, 11 aa, Staphylococcus
NENRVGLSPSG

SEQ ID NO: 1914450 - protein, 8 aa, Staphylococcus
NESNVSSI

SEQ ID NO: 1914451 - protein, 7 aa, Staphylococcus
NETEGVT

SEQ ID NO: 1914452 - protein, 7 aa, Staphylococcus
NETTNNS

SEQ ID NO: 1914453 - protein, 6 aa, Staphylococcus
NETVEA

SEQ ID NO: 1914454 - protein, 5 aa, Staphylococcus
NFHGQ

SEQ ID NO: 1914455 - protein, 5 aa, Staphylococcus
NFRSR

SEQ ID NO: 1914456 - protein, 6 aa, Staphylococcus
NGDASL

SEQ ID NO: 1914457 - protein, 8 aa, Staphylococcus
NGDRARKQ

SEQ ID NO: 1914458 - protein, 14 aa, Staphylococcus
NGEAAMAGDGQVTL

SEQ ID NO: 1914459 - protein, 6 aa, Staphylococcus
NGEDKT

SEQ ID NO: 1914460 - protein, 4 aa, Staphylococcus
NGGF

SEQ ID NO: 1914461 - protein, 6 aa, Staphylococcus
NGGPVG

SEQ ID NO: 1914462 - protein, 4 aa, Staphylococcus
NGQV

SEQ ID NO: 1914463 - protein, 8 aa, Staphylococcus
NGSGDKEI

SEQ ID NO: 1914464 - protein, 5 aa, Staphylococcus
NGSGL

SEQ ID NO: 1914465 - protein, 6 aa, Staphylococcus
NGSTID

SEQ ID NO: 1914466 - protein, 8 aa, Staphylococcus
NGTGIEQD

SEQ ID NO: 1914467 - protein, 5 aa, Staphylococcus
NGYEK

SEQ ID NO: 1914468 - protein, 6 aa, Staphylococcus
NGYGLG

SEQ ID NO: 1914469 - protein, 6 aa, Staphylococcus
NHDPLR

SEQ ID NO: 1914470 - protein, 4 aa, Staphylococcus
NHEE

SEQ ID NO: 1914471 - protein, 11 aa, Staphylococcus
NIASPSTTDLI

SEQ ID NO: 1914472 - protein, 9 aa, Staphylococcus
NIGTPNDLP

SEQ ID NO: 1914473 - protein, 12 aa, Staphylococcus
NIKNAKSKIERM

SEQ ID NO: 1914474 - protein, 6 aa, Staphylococcus
NIQSST

SEQ ID NO: 1914475 - protein, 7 aa, Staphylococcus
NIQSSTL

SEQ ID NO: 1914476 - protein, 6 aa, Staphylococcus
NITEEQ

SEQ ID NO: 1914477 - protein, 18 aa, Staphylococcus
NKDHTYTPLPNKNIDTGM

SEQ ID NO: 1914478 - protein, 10 aa, Staphylococcus
NKDNAQRAVD

SEQ ID NO: 1914479 - protein, 8 aa, Staphylococcus
NKDYNDLR

SEQ ID NO: 1914480 - protein, 5 aa, Staphylococcus
NKEQG

SEQ ID NO: 1914481 - protein, 8 aa, Staphylococcus
NKEQTQEE

SEQ ID NO: 1914482 - protein, 4 aa, Staphylococcus
NKGK

SEQ ID NO: 1914483 - protein, 5 aa, Staphylococcus
NKGTE

SEQ ID NO: 1914484 - protein, 5 aa, Staphylococcus
NKHPK

SEQ ID NO: 1914485 - protein, 5 aa, Staphylococcus
NKNGK

SEQ ID NO: 1914486 - protein, 8 aa, Staphylococcus
NKSIEDGD

SEQ ID NO: 1914487 - protein, 10 aa, Staphylococcus
NKYGKEEAKK

SEQ ID NO: 1914488 - protein, 10 aa, Staphylococcus
NLDEEQGKDV

SEQ ID NO: 1914489 - protein, 4 aa, Staphylococcus
NLLG

SEQ ID NO: 1914490 - protein, 13 aa, Staphylococcus
NLPPSRGLGSSAA

SEQ ID NO: 1914491 - protein, 11 aa, Staphylococcus
NLTTIDKAKAS

SEQ ID NO: 1914492 - protein, 4 aa, Staphylococcus
NMRD

SEQ ID NO: 1914493 - protein, 10 aa, Staphylococcus
NNKQKRDPNV

SEQ ID NO: 1914494 - protein, 7 aa, Staphylococcus
NNNKERT

SEQ ID NO: 1914495 - protein, 4 aa, Staphylococcus
NNNP

SEQ ID NO: 1914496 - protein, 7 aa, Staphylococcus
NNNPTTI

SEQ ID NO: 1914497 - protein, 4 aa, Staphylococcus
NNPD

SEQ ID NO: 1914498 - protein, 5 aa, Staphylococcus
NNPDH

SEQ ID NO: 1914499 - protein, 10 aa, Staphylococcus
NNPETVSTDF

SEQ ID NO: 1914500 - protein, 4 aa, Staphylococcus
NNPN

SEQ ID NO: 1914501 - protein, 7 aa, Staphylococcus
NNSFNKD

SEQ ID NO: 1914502 - protein, 9 aa, Staphylococcus
NNTGTFGSV

SEQ ID NO: 1914503 - protein, 6 aa, Staphylococcus
NNVGRN

SEQ ID NO: 1914504 - protein, 10 aa, Staphylococcus
NNVNRTASDV

SEQ ID NO: 1914505 - protein, 8 aa, Staphylococcus
NNVPTTRN

SEQ ID NO: 1914506 - protein, 9 aa, Staphylococcus
NPDGTRGKL

SEQ ID NO: 1914507 - protein, 6 aa, Staphylococcus
NPGTPV

SEQ ID NO: 1914508 - protein, 6 aa, Staphylococcus
NPKINE

SEQ ID NO: 1914509 - protein, 7 aa, Staphylococcus
NPKINEK

SEQ ID NO: 1914510 - protein, 6 aa, Staphylococcus
NQGSLD

SEQ ID NO: 1914511 - protein, 10 aa, Staphylococcus
NQKEHSTIHT

SEQ ID NO: 1914512 - protein, 13 aa, Staphylococcus
NQTNQQKGFQSTA

SEQ ID NO: 1914513 - protein, 9 aa, Staphylococcus
NRESEHGNA

SEQ ID NO: 1914514 - protein, 8 aa, Staphylococcus
NRFGSTNE

SEQ ID NO: 1914515 - protein, 4 aa, Staphylococcus
NRGN

SEQ ID NO: 1914516 - protein, 5 aa, Staphylococcus
NRKNH

SEQ ID NO: 1914517 - protein, 6 aa, Staphylococcus
NRQGTP

SEQ ID NO: 1914518 - protein, 6 aa, Staphylococcus
NSADSF

SEQ ID NO: 1914519 - protein, 9 aa, Staphylococcus
NSEPVAASE

SEQ ID NO: 1914520 - protein, 14 aa, Staphylococcus
NSGGHAAQNAKTYQ

SEQ ID NO: 1914521 - protein, 7 aa, Staphylococcus
NSGPLLP

SEQ ID NO: 1914522 - protein, 7 aa, Staphylococcus
NSGRKGP

SEQ ID NO: 1914523 - protein, 6 aa, Staphylococcus
NSGTEA

SEQ ID NO: 1914524 - protein, 7 aa, Staphylococcus
NSGYPLD

SEQ ID NO: 1914525 - protein, 15 aa, Staphylococcus
NSKGACPNCGGKGYI

SEQ ID NO: 1914526 - protein, 12 aa, Staphylococcus
NSKNKKDAKDNL

SEQ ID NO: 1914527 - protein, 8 aa, Staphylococcus
NSRQEIDT

SEQ ID NO: 1914528 - protein, 8 aa, Staphylococcus
NSTSNVRA

SEQ ID NO: 1914529 - protein, 5 aa, Staphylococcus
NSTSV

SEQ ID NO: 1914530 - protein, 8 aa, Staphylococcus
NSYKKGEV

SEQ ID NO: 1914531 - protein, 6 aa, Staphylococcus
NTAEAH

SEQ ID NO: 1914532 - protein, 5 aa, Staphylococcus
NTEKA

SEQ ID NO: 1914533 - protein, 6 aa, Staphylococcus
NTEKAR

SEQ ID NO: 1914534 - protein, 7 aa, Staphylococcus
NTGELSV

SEQ ID NO: 1914535 - protein, 10 aa, Staphylococcus
NTKSVETREM

SEQ ID NO: 1914536 - protein, 10 aa, Staphylococcus
NTKVGPQDKP

SEQ ID NO: 1914537 - protein, 10 aa, Staphylococcus
NTNKKGNVLN

SEQ ID NO: 1914538 - protein, 7 aa, Staphylococcus
NTRPRKR

SEQ ID NO: 1914539 - protein, 8 aa, Staphylococcus
NTRPVPDS

SEQ ID NO: 1914540 - protein, 9 aa, Staphylococcus
NTTSNDASC

SEQ ID NO: 1914541 - protein, 5 aa, Staphylococcus
NVEKA

SEQ ID NO: 1914542 - protein, 9 aa, Staphylococcus
NWSSSKGKG

SEQ ID NO: 1914543 - protein, 5 aa, Staphylococcus
NYGSN

SEQ ID NO: 1914544 - protein, 4 aa, Staphylococcus
NYND

SEQ ID NO: 1914545 - protein, 5 aa, Staphylococcus
NYNPT

SEQ ID NO: 1914546 - protein, 8 aa, Staphylococcus
NYPQSRVT

SEQ ID NO: 1914547 - protein, 5 aa, Staphylococcus
NYQGQ

SEQ ID NO: 1914548 - protein, 7 aa, Staphylococcus
PAADNKF

SEQ ID NO: 1914549 - protein, 4 aa, Staphylococcus
PADK

SEQ ID NO: 1914550 - protein, 4 aa, Staphylococcus
PADQ

SEQ ID NO: 1914551 - protein, 4 aa, Staphylococcus
PAET

SEQ ID NO: 1914552 - protein, 6 aa, Staphylococcus
PALAAG

SEQ ID NO: 1914553 - protein, 13 aa, Staphylococcus
PAMDNDDYRRGKL

SEQ ID NO: 1914554 - protein, 9 aa, Staphylococcus
PASGKTRLS

SEQ ID NO: 1914555 - protein, 5 aa, Staphylococcus
PAVTQ

SEQ ID NO: 1914556 - protein, 7 aa, Staphylococcus
PDAYGRG

SEQ ID NO: 1914557 - protein, 9 aa, Staphylococcus
PDDGNGKSY

SEQ ID NO: 1914558 - protein, 4 aa, Staphylococcus
PDDI

SEQ ID NO: 1914559 - protein, 10 aa, Staphylococcus
PDEEIGRGPH

SEQ ID NO: 1914560 - protein, 7 aa, Staphylococcus
PDFPGDK

SEQ ID NO: 1914561 - protein, 5 aa, Staphylococcus
PDFPN

SEQ ID NO: 1914562 - protein, 4 aa, Staphylococcus
PDFS

SEQ ID NO: 1914563 - protein, 8 aa, Staphylococcus
PDHEATAE

SEQ ID NO: 1914564 - protein, 4 aa, Staphylococcus
PDIP

SEQ ID NO: 1914565 - protein, 10 aa, Staphylococcus
PDIRSPKEAY

SEQ ID NO: 1914566 - protein, 9 aa, Staphylococcus
PDIRSPQEA

SEQ ID NO: 1914567 - protein, 4 aa, Staphylococcus
PDSH

SEQ ID NO: 1914568 - protein, 7 aa, Staphylococcus
PDTDAIS

SEQ ID NO: 1914569 - protein, 9 aa, Staphylococcus
PDVRDGLKP

SEQ ID NO: 1914570 - protein, 10 aa, Staphylococcus
PDVRDGLKPV

SEQ ID NO: 1914571 - protein, 7 aa, Staphylococcus
PEKAHGL

SEQ ID NO: 1914572 - protein, 10 aa, Staphylococcus
PEKEPITPFS

SEQ ID NO: 1914573 - protein, 4 aa, Staphylococcus
PEMY

SEQ ID NO: 1914574 - protein, 5 aa, Staphylococcus
PEREI

SEQ ID NO: 1914575 - protein, 7 aa, Staphylococcus
PEVAEHP

SEQ ID NO: 1914576 - protein, 7 aa, Staphylococcus
PFPQEPL

SEQ ID NO: 1914577 - protein, 10 aa, Staphylococcus
PGETEEEFQE

SEQ ID NO: 1914578 - protein, 4 aa, Staphylococcus
PGEV

SEQ ID NO: 1914579 - protein, 5 aa, Staphylococcus
PGFGG

SEQ ID NO: 1914580 - protein, 6 aa, Staphylococcus
PGGITI

SEQ ID NO: 1914581 - protein, 7 aa, Staphylococcus
PGGITIS

SEQ ID NO: 1914582 - protein, 9 aa, Staphylococcus
PGGKATPEQ

SEQ ID NO: 1914583 - protein, 4 aa, Staphylococcus
PGIP

SEQ ID NO: 1914584 - protein, 12 aa, Staphylococcus
PGSHGSTFGGNP

SEQ ID NO: 1914585 - protein, 14 aa, Staphylococcus
PGSNKNGRRYSPFT

SEQ ID NO: 1914586 - protein, 6 aa, Staphylococcus
PHEGET

SEQ ID NO: 1914587 - protein, 12 aa, Staphylococcus
PHNGCRPPKRRR

SEQ ID NO: 1914588 - protein, 15 aa, Staphylococcus
PHSPWQRGTNENTNG

SEQ ID NO: 1914589 - protein, 12 aa, Staphylococcus
PIQASTKKDELK

SEQ ID NO: 1914590 - protein, 7 aa, Staphylococcus
PISREKL

SEQ ID NO: 1914591 - protein, 16 aa, Staphylococcus
PKDDDSVTQLILPIRT

SEQ ID NO: 1914592 - protein, 4 aa, Staphylococcus
PKLG

SEQ ID NO: 1914593 - protein, 4 aa, Staphylococcus
PKPV

SEQ ID NO: 1914594 - protein, 7 aa, Staphylococcus
PKQVSEQ

SEQ ID NO: 1914595 - protein, 6 aa, Staphylococcus
PKQVVS

SEQ ID NO: 1914596 - protein, 13 aa, Staphylococcus
PLAGTTDRQAEAL

SEQ ID NO: 1914597 - protein, 13 aa, Staphylococcus
PLASTSRALEPSI

SEQ ID NO: 1914598 - protein, 8 aa, Staphylococcus
PLGKPNPF

SEQ ID NO: 1914599 - protein, 7 aa, Staphylococcus
PLHPGAK

SEQ ID NO: 1914600 - protein, 4 aa, Staphylococcus
PLKT

SEQ ID NO: 1914601 - protein, 8 aa, Staphylococcus
PLRSGEEQ

SEQ ID NO: 1914602 - protein, 9 aa, Staphylococcus
PNAKFPPSL

SEQ ID NO: 1914603 - protein, 7 aa, Staphylococcus
PNAKPPV

SEQ ID NO: 1914604 - protein, 8 aa, Staphylococcus
PNAKPPVA

SEQ ID NO: 1914605 - protein, 22 aa, Staphylococcus
PNDGGLAQIGPTSRVTGRMDGM

SEQ ID NO: 1914606 - protein, 9 aa, Staphylococcus
PNETEEQFE

SEQ ID NO: 1914607 - protein, 7 aa, Staphylococcus
PNGCARP

SEQ ID NO: 1914608 - protein, 6 aa, Staphylococcus
PNGESF

SEQ ID NO: 1914609 - protein, 7 aa, Staphylococcus
PNGVGKT

SEQ ID NO: 1914610 - protein, 8 aa, Staphylococcus
PNGVSNDD

SEQ ID NO: 1914611 - protein, 9 aa, Staphylococcus
PNIPEAEEI

SEQ ID NO: 1914612 - protein, 5 aa, Staphylococcus
PNKDE

SEQ ID NO: 1914613 - protein, 7 aa, Staphylococcus
PNKEGQF

SEQ ID NO: 1914614 - protein, 5 aa, Staphylococcus
PNKRG

SEQ ID NO: 1914615 - protein, 8 aa, Staphylococcus
PNPDNEDT

SEQ ID NO: 1914616 - protein, 12 aa, Staphylococcus
PNTAGAKTAEEA

SEQ ID NO: 1914617 - protein, 17 aa, Staphylococcus
PNVAAKKIKSAVTDSDG

SEQ ID NO: 1914618 - protein, 4 aa, Staphylococcus
PNYG

SEQ ID NO: 1914619 - protein, 12 aa, Staphylococcus
PPFTSEKAKDKV

SEQ ID NO: 1914620 - protein, 4 aa, Staphylococcus
PPGT

SEQ ID NO: 1914621 - protein, 5 aa, Staphylococcus
PPGTI

SEQ ID NO: 1914622 - protein, 11 aa, Staphylococcus
PPLRSKEDRDA

SEQ ID NO: 1914623 - protein, 5 aa, Staphylococcus
PPMKG

SEQ ID NO: 1914624 - protein, 4 aa, Staphylococcus
PPMP

SEQ ID NO: 1914625 - protein, 6 aa, Staphylococcus
PPNVTG

SEQ ID NO: 1914626 - protein, 4 aa, Staphylococcus
PPYK

SEQ ID NO: 1914627 - protein, 10 aa, Staphylococcus
PQDTESYTHR

SEQ ID NO: 1914628 - protein, 5 aa, Staphylococcus
PQEQS

SEQ ID NO: 1914629 - protein, 4 aa, Staphylococcus
PQFS

SEQ ID NO: 1914630 - protein, 4 aa, Staphylococcus
PQQA

SEQ ID NO: 1914631 - protein, 4 aa, Staphylococcus
PQSI

SEQ ID NO: 1914632 - protein, 8 aa, Staphylococcus
PRGGSDIT

SEQ ID NO: 1914633 - protein, 6 aa, Staphylococcus
PRPETE

SEQ ID NO: 1914634 - protein, 8 aa, Staphylococcus
PSNPYDAK

SEQ ID NO: 1914635 - protein, 9 aa, Staphylococcus
PSPVKRPQD

SEQ ID NO: 1914636 - protein, 7 aa, Staphylococcus
PSQTLSD

SEQ ID NO: 1914637 - protein, 7 aa, Staphylococcus
PSRTIDD

SEQ ID NO: 1914638 - protein, 11 aa, Staphylococcus
PSSPVPTTSNT

SEQ ID NO: 1914639 - protein, 9 aa, Staphylococcus
PSSRGLSTR

SEQ ID NO: 1914640 - protein, 10 aa, Staphylococcus
PSSRLGEKQG

SEQ ID NO: 1914641 - protein, 6 aa, Staphylococcus
PSYPPI

SEQ ID NO: 1914642 - protein, 8 aa, Staphylococcus
PSYSPSSI

SEQ ID NO: 1914643 - protein, 10 aa, Staphylococcus
PTASGKTELS

SEQ ID NO: 1914644 - protein, 6 aa, Staphylococcus
PTDKTE

SEQ ID NO: 1914645 - protein, 8 aa, Staphylococcus
PTDLGENC

SEQ ID NO: 1914646 - protein, 9 aa, Staphylococcus
PTETESKET

SEQ ID NO: 1914647 - protein, 7 aa, Staphylococcus
PTGSGKS

SEQ ID NO: 1914648 - protein, 7 aa, Staphylococcus
PTINSDF

SEQ ID NO: 1914649 - protein, 4 aa, Staphylococcus
PTKA

SEQ ID NO: 1914650 - protein, 4 aa, Staphylococcus
PTKK

SEQ ID NO: 1914651 - protein, 10 aa, Staphylococcus
PTLPDEKEVE

SEQ ID NO: 1914652 - protein, 6 aa, Staphylococcus
PTMNEK

SEQ ID NO: 1914653 - protein, 7 aa, Staphylococcus
PTNQTSL

SEQ ID NO: 1914654 - protein, 4 aa, Staphylococcus
PTPN

SEQ ID NO: 1914655 - protein, 9 aa, Staphylococcus
PTQELREQG

SEQ ID NO: 1914656 - protein, 6 aa, Staphylococcus
PTTGLH

SEQ ID NO: 1914657 - protein, 7 aa, Staphylococcus
PTTGLHE

SEQ ID NO: 1914658 - protein, 10 aa, Staphylococcus
PVGEDQKQHM

SEQ ID NO: 1914659 - protein, 11 aa, Staphylococcus
PVGSGDSTVAG

SEQ ID NO: 1914660 - protein, 4 aa, Staphylococcus
PVYG

SEQ ID NO: 1914661 - protein, 7 aa, Staphylococcus
PVYTTSS

SEQ ID NO: 1914662 - protein, 15 aa, Staphylococcus
PVYWSPSSESSLAEA

SEQ ID NO: 1914663 - protein, 4 aa, Staphylococcus
PYLD

SEQ ID NO: 1914664 - protein, 5 aa, Staphylococcus
PYNKG

SEQ ID NO: 1914665 - protein, 8 aa, Staphylococcus
PYPGGPQI

SEQ ID NO: 1914666 - protein, 4 aa, Staphylococcus
PYQA

SEQ ID NO: 1914667 - protein, 8 aa, Staphylococcus
QAARVSDK

SEQ ID NO: 1914668 - protein, 7 aa, Staphylococcus
QAGSEVS

SEQ ID NO: 1914669 - protein, 8 aa, Staphylococcus
QAQSTSDF

SEQ ID NO: 1914670 - protein, 6 aa, Staphylococcus
QATTTS

SEQ ID NO: 1914671 - protein, 7 aa, Staphylococcus
QDATPIR

SEQ ID NO: 1914672 - protein, 7 aa, Staphylococcus
QDDAKRK

SEQ ID NO: 1914673 - protein, 4 aa, Staphylococcus
QDGL

SEQ ID NO: 1914674 - protein, 4 aa, Staphylococcus
QDID

SEQ ID NO: 1914675 - protein, 4 aa, Staphylococcus
QDPH

SEQ ID NO: 1914676 - protein, 4 aa, Staphylococcus
QDPL

SEQ ID NO: 1914677 - protein, 10 aa, Staphylococcus
QDQNKPLPVE

SEQ ID NO: 1914678 - protein, 10 aa, Staphylococcus
QDVERAEEEM

SEQ ID NO: 1914679 - protein, 5 aa, Staphylococcus
QDVPA

SEQ ID NO: 1914680 - protein, 4 aa, Staphylococcus
QEAL

SEQ ID NO: 1914681 - protein, 6 aa, Staphylococcus
QEENTI

SEQ ID NO: 1914682 - protein, 26 aa, Staphylococcus
QEEQQKYAAQRKSAVGTGDRSERVRT

SEQ ID NO: 1914683 - protein, 9 aa, Staphylococcus
QEGKRIGKT

SEQ ID NO: 1914684 - protein, 11 aa, Staphylococcus
QELADKSEADM

SEQ ID NO: 1914685 - protein, 4 aa, Staphylococcus
QERP

SEQ ID NO: 1914686 - protein, 5 aa, Staphylococcus
QESGV

SEQ ID NO: 1914687 - protein, 6 aa, Staphylococcus
QESGVS

SEQ ID NO: 1914688 - protein, 6 aa, Staphylococcus
QFPTGA

SEQ ID NO: 1914689 - protein, 15 aa, Staphylococcus
QGAKPGEGGQLPGSK

SEQ ID NO: 1914690 - protein, 6 aa, Staphylococcus
QGDTTG

SEQ ID NO: 1914691 - protein, 8 aa, Staphylococcus
QGEKYYQN

SEQ ID NO: 1914692 - protein, 4 aa, Staphylococcus
QGGP

SEQ ID NO: 1914693 - protein, 6 aa, Staphylococcus
QGKPFE

SEQ ID NO: 1914694 - protein, 6 aa, Staphylococcus
QGREVN

SEQ ID NO: 1914695 - protein, 10 aa, Staphylococcus
QGSEAGGHRG

SEQ ID NO: 1914696 - protein, 12 aa, Staphylococcus
QGSLGASGDLAP

SEQ ID NO: 1914697 - protein, 6 aa, Staphylococcus
QHETQS

SEQ ID NO: 1914698 - protein, 6 aa, Staphylococcus
QHETQT

SEQ ID NO: 1914699 - protein, 5 aa, Staphylococcus
QHNNP

SEQ ID NO: 1914700 - protein, 15 aa, Staphylococcus
QHRPKTTGRSKGGNY

SEQ ID NO: 1914701 - protein, 6 aa, Staphylococcus
QIDGKN

SEQ ID NO: 1914702 - protein, 4 aa, Staphylococcus
QIES

SEQ ID NO: 1914703 - protein, 8 aa, Staphylococcus
QIGGRRNG

SEQ ID NO: 1914704 - protein, 6 aa, Staphylococcus
QIPEGA

SEQ ID NO: 1914705 - protein, 4 aa, Staphylococcus
QKEK

SEQ ID NO: 1914706 - protein, 10 aa, Staphylococcus
QKGTAKGVGN

SEQ ID NO: 1914707 - protein, 10 aa, Staphylococcus
QKIMSSDNTI

SEQ ID NO: 1914708 - protein, 10 aa, Staphylococcus
QKQAEFKSNK

SEQ ID NO: 1914709 - protein, 7 aa, Staphylococcus
QKRNPEP

SEQ ID NO: 1914710 - protein, 4 aa, Staphylococcus
QLDE

SEQ ID NO: 1914711 - protein, 8 aa, Staphylococcus
QLENRASF

SEQ ID NO: 1914712 - protein, 9 aa, Staphylococcus
QLETEKSYE

SEQ ID NO: 1914713 - protein, 10 aa, Staphylococcus
QLGQRPGAGA

SEQ ID NO: 1914714 - protein, 6 aa, Staphylococcus
QLSGLG

SEQ ID NO: 1914715 - protein, 8 aa, Staphylococcus
QMHGPELP

SEQ ID NO: 1914716 - protein, 10 aa, Staphylococcus
QMKSEQDKNI

SEQ ID NO: 1914717 - protein, 7 aa, Staphylococcus
QNATSSV

SEQ ID NO: 1914718 - protein, 4 aa, Staphylococcus
QNEQ

SEQ ID NO: 1914719 - protein, 5 aa, Staphylococcus
QNGNF

SEQ ID NO: 1914720 - protein, 4 aa, Staphylococcus
QNIA

SEQ ID NO: 1914721 - protein, 7 aa, Staphylococcus
QNIQTSI

SEQ ID NO: 1914722 - protein, 10 aa, Staphylococcus
QNKGKETGAY

SEQ ID NO: 1914723 - protein, 8 aa, Staphylococcus
QNLSNNAD

SEQ ID NO: 1914724 - protein, 5 aa, Staphylococcus
QNMRD

SEQ ID NO: 1914725 - protein, 7 aa, Staphylococcus
QPDYEPM

SEQ ID NO: 1914726 - protein, 5 aa, Staphylococcus
QPEHR

SEQ ID NO: 1914727 - protein, 5 aa, Staphylococcus
QPERN

SEQ ID NO: 1914728 - protein, 9 aa, Staphylococcus
QPGLSPRAL

SEQ ID NO: 1914729 - protein, 9 aa, Staphylococcus
QPKKTIPTT

SEQ ID NO: 1914730 - protein, 6 aa, Staphylococcus
QPLTRS

SEQ ID NO: 1914731 - protein, 11 aa, Staphylococcus
QPSHDSPANKI

SEQ ID NO: 1914732 - protein, 14 aa, Staphylococcus
QPSHVNVNEVTVRP

SEQ ID NO: 1914733 - protein, 12 aa, Staphylococcus
QQDIGSDSSTAI

SEQ ID NO: 1914734 - protein, 4 aa, Staphylococcus
QQEV

SEQ ID NO: 1914735 - protein, 11 aa, Staphylococcus
QQGEGIESTGE

SEQ ID NO: 1914736 - protein, 5 aa, Staphylococcus
QQKFR

SEQ ID NO: 1914737 - protein, 11 aa, Staphylococcus
QQPLTERPGEY

SEQ ID NO: 1914738 - protein, 11 aa, Staphylococcus
QQRGKDTKDNI

SEQ ID NO: 1914739 - protein, 8 aa, Staphylococcus
QQSAYESS

SEQ ID NO: 1914740 - protein, 4 aa, Staphylococcus
QQSG

SEQ ID NO: 1914741 - protein, 8 aa, Staphylococcus
QQSSDTTY

SEQ ID NO: 1914742 - protein, 9 aa, Staphylococcus
QQVNLTPKE

SEQ ID NO: 1914743 - protein, 5 aa, Staphylococcus
QREMP

SEQ ID NO: 1914744 - protein, 4 aa, Staphylococcus
QRKA

SEQ ID NO: 1914745 - protein, 6 aa, Staphylococcus
QRPPGH

SEQ ID NO: 1914746 - protein, 16 aa, Staphylococcus
QRPTFNPETGKDFGKK

SEQ ID NO: 1914747 - protein, 13 aa, Staphylococcus
QRTSKKQKITRST

SEQ ID NO: 1914748 - protein, 4 aa, Staphylococcus
QRYR

SEQ ID NO: 1914749 - protein, 6 aa, Staphylococcus
QSAGSM

SEQ ID NO: 1914750 - protein, 6 aa, Staphylococcus
QSDEDV

SEQ ID NO: 1914751 - protein, 5 aa, Staphylococcus
QSEKL

SEQ ID NO: 1914752 - protein, 6 aa, Staphylococcus
QSFGTP

SEQ ID NO: 1914753 - protein, 7 aa, Staphylococcus
QSGSDSV

SEQ ID NO: 1914754 - protein, 7 aa, Staphylococcus
QSGSDTV

SEQ ID NO: 1914755 - protein, 4 aa, Staphylococcus
QSQA

SEQ ID NO: 1914756 - protein, 7 aa, Staphylococcus
QTEETLD

SEQ ID NO: 1914757 - protein, 7 aa, Staphylococcus
QTETTID

SEQ ID NO: 1914758 - protein, 6 aa, Staphylococcus
QTNHTD

SEQ ID NO: 1914759 - protein, 7 aa, Staphylococcus
QTPLQTS

SEQ ID NO: 1914760 - protein, 7 aa, Staphylococcus
QTQPLGR

SEQ ID NO: 1914761 - protein, 9 aa, Staphylococcus
QTRQKTGLQ

SEQ ID NO: 1914762 - protein, 5 aa, Staphylococcus
QTSDV

SEQ ID NO: 1914763 - protein, 6 aa, Staphylococcus
QTVGGY

SEQ ID NO: 1914764 - protein, 4 aa, Staphylococcus
QVMK

SEQ ID NO: 1914765 - protein, 5 aa, Staphylococcus
QVMKS

SEQ ID NO: 1914766 - protein, 4 aa, Staphylococcus
QYEQ

SEQ ID NO: 1914767 - protein, 5 aa, Staphylococcus
QYGTL

SEQ ID NO: 1914768 - protein, 10 aa, Staphylococcus
RAAPAEGDGE

SEQ ID NO: 1914769 - protein, 13 aa, Staphylococcus
RAGASYDDIEDSK

SEQ ID NO: 1914770 - protein, 13 aa, Staphylococcus
RAKSEAEKSFGNS

SEQ ID NO: 1914771 - protein, 5 aa, Staphylococcus
RALDG

SEQ ID NO: 1914772 - protein, 16 aa, Staphylococcus
RAPGSVGMASDASRVF

SEQ ID NO: 1914773 - protein, 4 aa, Staphylococcus
RAQA

SEQ ID NO: 1914774 - protein, 7 aa, Staphylococcus
RATTRKE

SEQ ID NO: 1914775 - protein, 7 aa, Staphylococcus
RAVAERA

SEQ ID NO: 1914776 - protein, 8 aa, Staphylococcus
RAVAERAG

SEQ ID NO: 1914777 - protein, 5 aa, Staphylococcus
RDDGY

SEQ ID NO: 1914778 - protein, 6 aa, Staphylococcus
RDEEIR

SEQ ID NO: 1914779 - protein, 6 aa, Staphylococcus
RDEQGQ

SEQ ID NO: 1914780 - protein, 5 aa, Staphylococcus
RDGEI

SEQ ID NO: 1914781 - protein, 9 aa, Staphylococcus
RDGEQTPGV

SEQ ID NO: 1914782 - protein, 7 aa, Staphylococcus
RDGFSTH

SEQ ID NO: 1914783 - protein, 4 aa, Staphylococcus
RDKE

SEQ ID NO: 1914784 - protein, 8 aa, Staphylococcus
RDKIESEY

SEQ ID NO: 1914785 - protein, 8 aa, Staphylococcus
RDNKPGIS

SEQ ID NO: 1914786 - protein, 8 aa, Staphylococcus
RDYGTGQM

SEQ ID NO: 1914787 - protein, 5 aa, Staphylococcus
RDYSS

SEQ ID NO: 1914788 - protein, 5 aa, Staphylococcus
REAEV

SEQ ID NO: 1914789 - protein, 4 aa, Staphylococcus
REAG

SEQ ID NO: 1914790 - protein, 6 aa, Staphylococcus
REDGSD

SEQ ID NO: 1914791 - protein, 7 aa, Staphylococcus
REEREAV

SEQ ID NO: 1914792 - protein, 5 aa, Staphylococcus
REGSK

SEQ ID NO: 1914793 - protein, 7 aa, Staphylococcus
REITSQK

SEQ ID NO: 1914794 - protein, 8 aa, Staphylococcus
REKTGAGM

SEQ ID NO: 1914795 - protein, 7 aa, Staphylococcus
RENTGEL

SEQ ID NO: 1914796 - protein, 4 aa, Staphylococcus
REPE

SEQ ID NO: 1914797 - protein, 23 aa, Staphylococcus
REPGGEHKETIETGTKAAARGGF

SEQ ID NO: 1914798 - protein, 8 aa, Staphylococcus
RERGCSNG

SEQ ID NO: 1914799 - protein, 7 aa, Staphylococcus
RERTGAG

SEQ ID NO: 1914800 - protein, 14 aa, Staphylococcus
RETAPFPRLLNRLY

SEQ ID NO: 1914801 - protein, 7 aa, Staphylococcus
RFGSTNE

SEQ ID NO: 1914802 - protein, 6 aa, Staphylococcus
RFYPNG

SEQ ID NO: 1914803 - protein, 5 aa, Staphylococcus
RGAAL

SEQ ID NO: 1914804 - protein, 11 aa, Staphylococcus
RGDDHVSNTPK

SEQ ID NO: 1914805 - protein, 4 aa, Staphylococcus
RGFT

SEQ ID NO: 1914806 - protein, 7 aa, Staphylococcus
RGGGSIE

SEQ ID NO: 1914807 - protein, 6 aa, Staphylococcus
RGGGYR

SEQ ID NO: 1914808 - protein, 5 aa, Staphylococcus
RGGNG

SEQ ID NO: 1914809 - protein, 15 aa, Staphylococcus
RGGNHVTSQNPEVNY

SEQ ID NO: 1914810 - protein, 7 aa, Staphylococcus
RGGSDIT

SEQ ID NO: 1914811 - protein, 4 aa, Staphylococcus
RGKG

SEQ ID NO: 1914812 - protein, 5 aa, Staphylococcus
RGLAG

SEQ ID NO: 1914813 - protein, 10 aa, Staphylococcus
RGLASKRTTT

SEQ ID NO: 1914814 - protein, 4 aa, Staphylococcus
RGLG

SEQ ID NO: 1914815 - protein, 9 aa, Staphylococcus
RGLGSSASA

SEQ ID NO: 1914816 - protein, 6 aa, Staphylococcus
RGMAEM

SEQ ID NO: 1914817 - protein, 6 aa, Staphylococcus
RGRGLY

SEQ ID NO: 1914818 - protein, 12 aa, Staphylococcus
RGTLDDKGPTIA

SEQ ID NO: 1914819 - protein, 4 aa, Staphylococcus
RGVR

SEQ ID NO: 1914820 - protein, 4 aa, Staphylococcus
RGVS

SEQ ID NO: 1914821 - protein, 6 aa, Staphylococcus
RGYQSP

SEQ ID NO: 1914822 - protein, 10 aa, Staphylococcus
RHGQARGPMA

SEQ ID NO: 1914823 - protein, 4 aa, Staphylococcus
RHSA

SEQ ID NO: 1914824 - protein, 5 aa, Staphylococcus
RHSAT

SEQ ID NO: 1914825 - protein, 4 aa, Staphylococcus
RIKT

SEQ ID NO: 1914826 - protein, 15 aa, Staphylococcus
RKGRDKKQVSVYAVA

SEQ ID NO: 1914827 - protein, 6 aa, Staphylococcus
RKKEQF

SEQ ID NO: 1914828 - protein, 5 aa, Staphylococcus
RKNPD

SEQ ID NO: 1914829 - protein, 5 aa, Staphylococcus
RKRPG

SEQ ID NO: 1914830 - protein, 9 aa, Staphylococcus
RKTEGKTQA

SEQ ID NO: 1914831 - protein, 7 aa, Staphylococcus
RKVEHGP

SEQ ID NO: 1914832 - protein, 8 aa, Staphylococcus
RLSPSSLG

SEQ ID NO: 1914833 - protein, 10 aa, Staphylococcus
RMAEPGEYTK

SEQ ID NO: 1914834 - protein, 8 aa, Staphylococcus
RMKEEKGL

SEQ ID NO: 1914835 - protein, 5 aa, Staphylococcus
RNEIT

SEQ ID NO: 1914836 - protein, 6 aa, Staphylococcus
RNEITP

SEQ ID NO: 1914837 - protein, 7 aa, Staphylococcus
RNFRDDP

SEQ ID NO: 1914838 - protein, 4 aa, Staphylococcus
RNVK

SEQ ID NO: 1914839 - protein, 4 aa, Staphylococcus
RPAL

SEQ ID NO: 1914840 - protein, 6 aa, Staphylococcus
RPDSWR

SEQ ID NO: 1914841 - protein, 8 aa, Staphylococcus
RPEEVTDI

SEQ ID NO: 1914842 - protein, 8 aa, Staphylococcus
RPLEEDGS

SEQ ID NO: 1914843 - protein, 6 aa, Staphylococcus
RPPHRK

SEQ ID NO: 1914844 - protein, 8 aa, Staphylococcus
RPSNDPAL

SEQ ID NO: 1914845 - protein, 7 aa, Staphylococcus
RPSSLDD

SEQ ID NO: 1914846 - protein, 15 aa, Staphylococcus
RPYGQEEFGTKAELK

SEQ ID NO: 1914847 - protein, 21 aa, Staphylococcus
RPYKQKKKTRATEAKRKGLEP

SEQ ID NO: 1914848 - protein, 11 aa, Staphylococcus
RQAITNPNTVQ

SEQ ID NO: 1914849 - protein, 10 aa, Staphylococcus
RQGGYGRGRR

SEQ ID NO: 1914850 - protein, 10 aa, Staphylococcus
RQPQIGETIN

SEQ ID NO: 1914851 - protein, 7 aa, Staphylococcus
RRERERK

SEQ ID NO: 1914852 - protein, 6 aa, Staphylococcus
RRNRSK

SEQ ID NO: 1914853 - protein, 8 aa, Staphylococcus
RRPKPNVA

SEQ ID NO: 1914854 - protein, 22 aa, Staphylococcus
RRQTSKKYPRKPGTPNKSPLLE

SEQ ID NO: 1914855 - protein, 6 aa, Staphylococcus
RRRKRA

SEQ ID NO: 1914856 - protein, 8 aa, Staphylococcus
RSEGFGAE

SEQ ID NO: 1914857 - protein, 11 aa, Staphylococcus
RSFQGGENKPL

SEQ ID NO: 1914858 - protein, 6 aa, Staphylococcus
RSKDVG

SEQ ID NO: 1914859 - protein, 15 aa, Staphylococcus
RSKEEREKLKQPRSS

SEQ ID NO: 1914860 - protein, 9 aa, Staphylococcus
RSSARETAA

SEQ ID NO: 1914861 - protein, 13 aa, Staphylococcus
RSSGTLSGGEAQR

SEQ ID NO: 1914862 - protein, 10 aa, Staphylococcus
RSSNEIGSDG

SEQ ID NO: 1914863 - protein, 6 aa, Staphylococcus
RTIDQA

SEQ ID NO: 1914864 - protein, 6 aa, Staphylococcus
RTIEQA

SEQ ID NO: 1914865 - protein, 6 aa, Staphylococcus
RTKEEI

SEQ ID NO: 1914866 - protein, 8 aa, Staphylococcus
RTRKGGAE

SEQ ID NO: 1914867 - protein, 7 aa, Staphylococcus
RTSKTPL

SEQ ID NO: 1914868 - protein, 9 aa, Staphylococcus
RTTEERHKQ

SEQ ID NO: 1914869 - protein, 4 aa, Staphylococcus
RTYE

SEQ ID NO: 1914870 - protein, 6 aa, Staphylococcus
RTYSSY

SEQ ID NO: 1914871 - protein, 4 aa, Staphylococcus
RVNP

SEQ ID NO: 1914872 - protein, 7 aa, Staphylococcus
RVSGTSG

SEQ ID NO: 1914873 - protein, 7 aa, Staphylococcus
RYRSNND

SEQ ID NO: 1914874 - protein, 7 aa, Staphylococcus
SAAEPAP

SEQ ID NO: 1914875 - protein, 8 aa, Staphylococcus
SAFNSQST

SEQ ID NO: 1914876 - protein, 4 aa, Staphylococcus
SAIK

SEQ ID NO: 1914877 - protein, 10 aa, Staphylococcus
SAKTGEGGKL

SEQ ID NO: 1914878 - protein, 14 aa, Staphylococcus
SALGPGGLTRERAQ

SEQ ID NO: 1914879 - protein, 15 aa, Staphylococcus
SALKNESDNASKHRL

SEQ ID NO: 1914880 - protein, 7 aa, Staphylococcus
SANTTEE

SEQ ID NO: 1914881 - protein, 5 aa, Staphylococcus
SAQEL

SEQ ID NO: 1914882 - protein, 14 aa, Staphylococcus
SASAYGKKTRSVKS

SEQ ID NO: 1914883 - protein, 23 aa, Staphylococcus
SASRALSTNDDKETACRPFQEGR

SEQ ID NO: 1914884 - protein, 4 aa, Staphylococcus
SATI

SEQ ID NO: 1914885 - protein, 13 aa, Staphylococcus
SAVEGTDLESKSI

SEQ ID NO: 1914886 - protein, 6 aa, Staphylococcus
SCDETS

SEQ ID NO: 1914887 - protein, 7 aa, Staphylococcus
SCDETSV

SEQ ID NO: 1914888 - protein, 7 aa, Staphylococcus
SCPSGAM

SEQ ID NO: 1914889 - protein, 13 aa, Staphylococcus
SCPSGAMYKRDED

SEQ ID NO: 1914890 - protein, 4 aa, Staphylococcus
SDDD

SEQ ID NO: 1914891 - protein, 4 aa, Staphylococcus
SDEN

SEQ ID NO: 1914892 - protein, 4 aa, Staphylococcus
SDGA

SEQ ID NO: 1914893 - protein, 10 aa, Staphylococcus
SDIKSPNTEI

SEQ ID NO: 1914894 - protein, 8 aa, Staphylococcus
SDKDKDEI

SEQ ID NO: 1914895 - protein, 5 aa, Staphylococcus
SDLSH

SEQ ID NO: 1914896 - protein, 8 aa, Staphylococcus
SDMGGDYE

SEQ ID NO: 1914897 - protein, 4 aa, Staphylococcus
SDPG

SEQ ID NO: 1914898 - protein, 7 aa, Staphylococcus
SDRALGS

SEQ ID NO: 1914899 - protein, 6 aa, Staphylococcus
SDTNFD

SEQ ID NO: 1914900 - protein, 7 aa, Staphylococcus
SDTPPKV

SEQ ID NO: 1914901 - protein, 12 aa, Staphylococcus
SEAKRKKATQKY

SEQ ID NO: 1914902 - protein, 6 aa, Staphylococcus
SECGFT

SEQ ID NO: 1914903 - protein, 6 aa, Staphylococcus
SEEENV

SEQ ID NO: 1914904 - protein, 5 aa, Staphylococcus
SEEVA

SEQ ID NO: 1914905 - protein, 10 aa, Staphylococcus
SEGDKDALHT

SEQ ID NO: 1914906 - protein, 11 aa, Staphylococcus
SEGDKDALHTQ

SEQ ID NO: 1914907 - protein, 23 aa, Staphylococcus
SEGVITDKEARKRNVGGEIIAYV

SEQ ID NO: 1914908 - protein, 6 aa, Staphylococcus
SEHLED

SEQ ID NO: 1914909 - protein, 8 aa, Staphylococcus
SEKDGRQA

SEQ ID NO: 1914910 - protein, 15 aa, Staphylococcus
SEKISEAMDENDPIP

SEQ ID NO: 1914911 - protein, 4 aa, Staphylococcus
SEKQ

SEQ ID NO: 1914912 - protein, 4 aa, Staphylococcus
SELT

SEQ ID NO: 1914913 - protein, 6 aa, Staphylococcus
SENDID

SEQ ID NO: 1914914 - protein, 6 aa, Staphylococcus
SENEGD

SEQ ID NO: 1914915 - protein, 6 aa, Staphylococcus
SERYPA

SEQ ID NO: 1914916 - protein, 4 aa, Staphylococcus
SESD

SEQ ID NO: 1914917 - protein, 9 aa, Staphylococcus
SESGTGAGV

SEQ ID NO: 1914918 - protein, 8 aa, Staphylococcus
SETGNAQG

SEQ ID NO: 1914919 - protein, 8 aa, Staphylococcus
SEVETAKR

SEQ ID NO: 1914920 - protein, 6 aa, Staphylococcus
SEVTEA

SEQ ID NO: 1914921 - protein, 8 aa, Staphylococcus
SFATSSGM

SEQ ID NO: 1914922 - protein, 5 aa, Staphylococcus
SFESE

SEQ ID NO: 1914923 - protein, 21 aa, Staphylococcus
SFGPDKERGKAYRDSGLFDND

SEQ ID NO: 1914924 - protein, 7 aa, Staphylococcus
SFQETTR

SEQ ID NO: 1914925 - protein, 7 aa, Staphylococcus
SGAGHLS

SEQ ID NO: 1914926 - protein, 8 aa, Staphylococcus
SGAGHLSA

SEQ ID NO: 1914927 - protein, 11 aa, Staphylococcus
SGATESNNTAI

SEQ ID NO: 1914928 - protein, 6 aa, Staphylococcus
SGCGKT

SEQ ID NO: 1914929 - protein, 7 aa, Staphylococcus
SGDTSDY

SEQ ID NO: 1914930 - protein, 9 aa, Staphylococcus
SGEESKHGI

SEQ ID NO: 1914931 - protein, 9 aa, Staphylococcus
SGETGSGKS

SEQ ID NO: 1914932 - protein, 12 aa, Staphylococcus
SGGGSGHEPAHA

SEQ ID NO: 1914933 - protein, 5 aa, Staphylococcus
SGGMK

SEQ ID NO: 1914934 - protein, 4 aa, Staphylococcus
SGGQ

SEQ ID NO: 1914935 - protein, 11 aa, Staphylococcus
SGGQDSTLTGK

SEQ ID NO: 1914936 - protein, 5 aa, Staphylococcus
SGICP

SEQ ID NO: 1914937 - protein, 4 aa, Staphylococcus
SGIE

SEQ ID NO: 1914938 - protein, 6 aa, Staphylococcus
SGIGKV

SEQ ID NO: 1914939 - protein, 6 aa, Staphylococcus
SGIGPV

SEQ ID NO: 1914940 - protein, 11 aa, Staphylococcus
SGKGGVGKSTV

SEQ ID NO: 1914941 - protein, 4 aa, Staphylococcus
SGLG

SEQ ID NO: 1914942 - protein, 11 aa, Staphylococcus
SGLTSQPSANS

SEQ ID NO: 1914943 - protein, 7 aa, Staphylococcus
SGMDTGE

SEQ ID NO: 1914944 - protein, 8 aa, Staphylococcus
SGMDTGEI

SEQ ID NO: 1914945 - protein, 5 aa, Staphylococcus
SGMNA

SEQ ID NO: 1914946 - protein, 9 aa, Staphylococcus
SGMNKPNGM

SEQ ID NO: 1914947 - protein, 5 aa, Staphylococcus
SGMSS

SEQ ID NO: 1914948 - protein, 5 aa, Staphylococcus
SGNGF

SEQ ID NO: 1914949 - protein, 4 aa, Staphylococcus
SGNL

SEQ ID NO: 1914950 - protein, 5 aa, Staphylococcus
SGPAA

SEQ ID NO: 1914951 - protein, 4 aa, Staphylococcus
SGPD

SEQ ID NO: 1914952 - protein, 10 aa, Staphylococcus
SGRGDKDMET

SEQ ID NO: 1914953 - protein, 14 aa, Staphylococcus
SGRGLGHTGGTIDK

SEQ ID NO: 1914954 - protein, 9 aa, Staphylococcus
SGSGKSTIS

SEQ ID NO: 1914955 - protein, 9 aa, Staphylococcus
SGSNPKYNA

SEQ ID NO: 1914956 - protein, 6 aa, Staphylococcus
SGSPEI

SEQ ID NO: 1914957 - protein, 9 aa, Staphylococcus
SGTTGLPKA

SEQ ID NO: 1914958 - protein, 9 aa, Staphylococcus
SHKSDDEWR

SEQ ID NO: 1914959 - protein, 6 aa, Staphylococcus
SHPNGD

SEQ ID NO: 1914960 - protein, 5 aa, Staphylococcus
SHQSI

SEQ ID NO: 1914961 - protein, 5 aa, Staphylococcus
SHQSL

SEQ ID NO: 1914962 - protein, 8 aa, Staphylococcus
SHTATHGA

SEQ ID NO: 1914963 - protein, 6 aa, Staphylococcus
SIEAGT

SEQ ID NO: 1914964 - protein, 7 aa, Staphylococcus
SIGETAQ

SEQ ID NO: 1914965 - protein, 7 aa, Staphylococcus
SIGPGGK

SEQ ID NO: 1914966 - protein, 4 aa, Staphylococcus
SIPE

SEQ ID NO: 1914967 - protein, 7 aa, Staphylococcus
SIRGSDV

SEQ ID NO: 1914968 - protein, 6 aa, Staphylococcus
SISQQQ

SEQ ID NO: 1914969 - protein, 8 aa, Staphylococcus
SKADNTPF

SEQ ID NO: 1914970 - protein, 7 aa, Staphylococcus
SKDDTNK

SEQ ID NO: 1914971 - protein, 6 aa, Staphylococcus
SKDNPV

SEQ ID NO: 1914972 - protein, 5 aa, Staphylococcus
SKEEQ

SEQ ID NO: 1914973 - protein, 20 aa, Staphylococcus
SKEHANRYPHEFSGGQRQRI

SEQ ID NO: 1914974 - protein, 6 aa, Staphylococcus
SKGDKC

SEQ ID NO: 1914975 - protein, 23 aa, Staphylococcus
SKGSLAGVDGRIQSRSYENQEGR

SEQ ID NO: 1914976 - protein, 11 aa, Staphylococcus
SKISSTNQRIR

SEQ ID NO: 1914977 - protein, 7 aa, Staphylococcus
SKPNRLH

SEQ ID NO: 1914978 - protein, 7 aa, Staphylococcus
SKPRRNQ

SEQ ID NO: 1914979 - protein, 8 aa, Staphylococcus
SKPSMSAG

SEQ ID NO: 1914980 - protein, 9 aa, Staphylococcus
SKQGSHATL

SEQ ID NO: 1914981 - protein, 8 aa, Staphylococcus
SKSGSVEL

SEQ ID NO: 1914982 - protein, 6 aa, Staphylococcus
SKSREW

SEQ ID NO: 1914983 - protein, 5 aa, Staphylococcus
SKTVG

SEQ ID NO: 1914984 - protein, 7 aa, Staphylococcus
SKTVSPG

SEQ ID NO: 1914985 - protein, 7 aa, Staphylococcus
SLGSKKL

SEQ ID NO: 1914986 - protein, 5 aa, Staphylococcus
SLLSS

SEQ ID NO: 1914987 - protein, 5 aa, Staphylococcus
SLNPT

SEQ ID NO: 1914988 - protein, 15 aa, Staphylococcus
SLPGLPDKAQLSIFD

SEQ ID NO: 1914989 - protein, 7 aa, Staphylococcus
SLRGNAL

SEQ ID NO: 1914990 - protein, 4 aa, Staphylococcus
SLRQ

SEQ ID NO: 1914991 - protein, 12 aa, Staphylococcus
SLSSISKSKGIA

SEQ ID NO: 1914992 - protein, 11 aa, Staphylococcus
SNESDYAANIE

SEQ ID NO: 1914993 - protein, 6 aa, Staphylococcus
SNPECN

SEQ ID NO: 1914994 - protein, 7 aa, Staphylococcus
SNPQCNV

SEQ ID NO: 1914995 - protein, 12 aa, Staphylococcus
SNSDNDPEKEKE

SEQ ID NO: 1914996 - protein, 8 aa, Staphylococcus
SNTAEFGD

SEQ ID NO: 1914997 - protein, 6 aa, Staphylococcus
SNTEFD

SEQ ID NO: 1914998 - protein, 4 aa, Staphylococcus
SNYL

SEQ ID NO: 1914999 - protein, 5 aa, Staphylococcus
SPCTE

SEQ ID NO: 1915000 - protein, 6 aa, Staphylococcus
SPDEEH

SEQ ID NO: 1915001 - protein, 9 aa, Staphylococcus
SPEDATRTE

SEQ ID NO: 1915002 - protein, 11 aa, Staphylococcus
SPEEAESPGIS

SEQ ID NO: 1915003 - protein, 8 aa, Staphylococcus
SPEGEEEI

SEQ ID NO: 1915004 - protein, 8 aa, Staphylococcus
SPEPGLQS

SEQ ID NO: 1915005 - protein, 4 aa, Staphylococcus
SPEQ

SEQ ID NO: 1915006 - protein, 11 aa, Staphylococcus
SPGPGKPSDYP

SEQ ID NO: 1915007 - protein, 5 aa, Staphylococcus
SPIEG

SEQ ID NO: 1915008 - protein, 11 aa, Staphylococcus
SPIGTGRGINN

SEQ ID NO: 1915009 - protein, 5 aa, Staphylococcus
SPKAI

SEQ ID NO: 1915010 - protein, 6 aa, Staphylococcus
SPKAII

SEQ ID NO: 1915011 - protein, 7 aa, Staphylococcus
SPKVATY

SEQ ID NO: 1915012 - protein, 4 aa, Staphylococcus
SPVS

SEQ ID NO: 1915013 - protein, 4 aa, Staphylococcus
SQHA

SEQ ID NO: 1915014 - protein, 6 aa, Staphylococcus
SQIIDN

SEQ ID NO: 1915015 - protein, 6 aa, Staphylococcus
SQKQEY

SEQ ID NO: 1915016 - protein, 5 aa, Staphylococcus
SQPTL

SEQ ID NO: 1915017 - protein, 4 aa, Staphylococcus
SQRE

SEQ ID NO: 1915018 - protein, 14 aa, Staphylococcus
SQSAEAKSTKYNAT

SEQ ID NO: 1915019 - protein, 7 aa, Staphylococcus
SQSNMPS

SEQ ID NO: 1915020 - protein, 4 aa, Staphylococcus
SQWR

SEQ ID NO: 1915021 - protein, 7 aa, Staphylococcus
SRAGSNA

SEQ ID NO: 1915022 - protein, 6 aa, Staphylococcus
SRDDAG

SEQ ID NO: 1915023 - protein, 5 aa, Staphylococcus
SRGGS

SEQ ID NO: 1915024 - protein, 13 aa, Staphylococcus
SRGVEQRQDKRPM

SEQ ID NO: 1915025 - protein, 4 aa, Staphylococcus
SRGY

SEQ ID NO: 1915026 - protein, 9 aa, Staphylococcus
SRIRKETIA

SEQ ID NO: 1915027 - protein, 7 aa, Staphylococcus
SRKVHSD

SEQ ID NO: 1915028 - protein, 10 aa, Staphylococcus
SRRKKTAAKK

SEQ ID NO: 1915029 - protein, 4 aa, Staphylococcus
SRRL

SEQ ID NO: 1915030 - protein, 5 aa, Staphylococcus
SRTNM

SEQ ID NO: 1915031 - protein, 7 aa, Staphylococcus
SRTYSSY

SEQ ID NO: 1915032 - protein, 4 aa, Staphylococcus
SRYP

SEQ ID NO: 1915033 - protein, 4 aa, Staphylococcus
SSDQ

SEQ ID NO: 1915034 - protein, 9 aa, Staphylococcus
SSDSHPFYT

SEQ ID NO: 1915035 - protein, 7 aa, Staphylococcus
SSEKFTN

SEQ ID NO: 1915036 - protein, 9 aa, Staphylococcus
SSKATNEES

SEQ ID NO: 1915037 - protein, 10 aa, Staphylococcus
SSKGEEELEE

SEQ ID NO: 1915038 - protein, 9 aa, Staphylococcus
SSKGTNEES

SEQ ID NO: 1915039 - protein, 7 aa, Staphylococcus
SSNATAL

SEQ ID NO: 1915040 - protein, 9 aa, Staphylococcus
SSNPVAGNV

SEQ ID NO: 1915041 - protein, 7 aa, Staphylococcus
SSPSNYL

SEQ ID NO: 1915042 - protein, 10 aa, Staphylococcus
SSTDSAHLAA

SEQ ID NO: 1915043 - protein, 4 aa, Staphylococcus
SSTE

SEQ ID NO: 1915044 - protein, 11 aa, Staphylococcus
SSTRESDGFKD

SEQ ID NO: 1915045 - protein, 4 aa, Staphylococcus
STAF

SEQ ID NO: 1915046 - protein, 8 aa, Staphylococcus
STAKELGT

SEQ ID NO: 1915047 - protein, 5 aa, Staphylococcus
STAQG

SEQ ID NO: 1915048 - protein, 5 aa, Staphylococcus
STGNE

SEQ ID NO: 1915049 - protein, 7 aa, Staphylococcus
STKGMAE

SEQ ID NO: 1915050 - protein, 14 aa, Staphylococcus
STKGSAKSDDVEKV

SEQ ID NO: 1915051 - protein, 9 aa, Staphylococcus
STTGKTGVE

SEQ ID NO: 1915052 - protein, 4 aa, Staphylococcus
SVAD

SEQ ID NO: 1915053 - protein, 8 aa, Staphylococcus
SVASGIPD

SEQ ID NO: 1915054 - protein, 4 aa, Staphylococcus
SVFN

SEQ ID NO: 1915055 - protein, 10 aa, Staphylococcus
SVGDTIQRGG

SEQ ID NO: 1915056 - protein, 4 aa, Staphylococcus
SVGK

SEQ ID NO: 1915057 - protein, 6 aa, Staphylococcus
SVKPEY

SEQ ID NO: 1915058 - protein, 5 aa, Staphylococcus
SVLEP

SEQ ID NO: 1915059 - protein, 7 aa, Staphylococcus
SVPENIQ

SEQ ID NO: 1915060 - protein, 18 aa, Staphylococcus
SVPSDIQTAVRNNGGGHL

SEQ ID NO: 1915061 - protein, 5 aa, Staphylococcus
SVTDK

SEQ ID NO: 1915062 - protein, 8 aa, Staphylococcus
SYETPSKL

SEQ ID NO: 1915063 - protein, 7 aa, Staphylococcus
SYKEQGL

SEQ ID NO: 1915064 - protein, 12 aa, Staphylococcus
SYSNAKKLYGED

SEQ ID NO: 1915065 - protein, 8 aa, Staphylococcus
TADEEDSY

SEQ ID NO: 1915066 - protein, 4 aa, Staphylococcus
TADG

SEQ ID NO: 1915067 - protein, 5 aa, Staphylococcus
TADGM

SEQ ID NO: 1915068 - protein, 7 aa, Staphylococcus
TADPFDE

SEQ ID NO: 1915069 - protein, 5 aa, Staphylococcus
TAETN

SEQ ID NO: 1915070 - protein, 4 aa, Staphylococcus
TAGI

SEQ ID NO: 1915071 - protein, 10 aa, Staphylococcus
TAGMDVSGRE

SEQ ID NO: 1915072 - protein, 5 aa, Staphylococcus
TAGYQ

SEQ ID NO: 1915073 - protein, 4 aa, Staphylococcus
TAHE

SEQ ID NO: 1915074 - protein, 12 aa, Staphylococcus
TAIGKSGAKNAG

SEQ ID NO: 1915075 - protein, 6 aa, Staphylococcus
TAPTGH

SEQ ID NO: 1915076 - protein, 4 aa, Staphylococcus
TARR

SEQ ID NO: 1915077 - protein, 5 aa, Staphylococcus
TASAL

SEQ ID NO: 1915078 - protein, 8 aa, Staphylococcus
TASYEARK

SEQ ID NO: 1915079 - protein, 8 aa, Staphylococcus
TATAEVQQ

SEQ ID NO: 1915080 - protein, 12 aa, Staphylococcus
TATASKEPRDGD

SEQ ID NO: 1915081 - protein, 12 aa, Staphylococcus
TATGDGSIAAQS

SEQ ID NO: 1915082 - protein, 10 aa, Staphylococcus
TAVATRGQAP

SEQ ID NO: 1915083 - protein, 9 aa, Staphylococcus
TAVDTEGVA

SEQ ID NO: 1915084 - protein, 8 aa, Staphylococcus
TAVDYKGT

SEQ ID NO: 1915085 - protein, 7 aa, Staphylococcus
TCGNREQ

SEQ ID NO: 1915086 - protein, 6 aa, Staphylococcus
TDDPYE

SEQ ID NO: 1915087 - protein, 9 aa, Staphylococcus
TDEDVNKKA

SEQ ID NO: 1915088 - protein, 4 aa, Staphylococcus
TDEE

SEQ ID NO: 1915089 - protein, 8 aa, Staphylococcus
TDEESDWK

SEQ ID NO: 1915090 - protein, 15 aa, Staphylococcus
TDEIKPSGTGESPLA

SEQ ID NO: 1915091 - protein, 7 aa, Staphylococcus
TDENRSI

SEQ ID NO: 1915092 - protein, 5 aa, Staphylococcus
TDGEF

SEQ ID NO: 1915093 - protein, 8 aa, Staphylococcus
TDHSAENI

SEQ ID NO: 1915094 - protein, 10 aa, Staphylococcus
TDKTSSYSRA

SEQ ID NO: 1915095 - protein, 8 aa, Staphylococcus
TDNGRGIP

SEQ ID NO: 1915096 - protein, 10 aa, Staphylococcus
TDNNRATDEF

SEQ ID NO: 1915097 - protein, 7 aa, Staphylococcus
TDPDADR

SEQ ID NO: 1915098 - protein, 10 aa, Staphylococcus
TDPRQRQNRE

SEQ ID NO: 1915099 - protein, 9 aa, Staphylococcus
TDSALRENE

SEQ ID NO: 1915100 - protein, 5 aa, Staphylococcus
TDSGG

SEQ ID NO: 1915101 - protein, 4 aa, Staphylococcus
TDVV

SEQ ID NO: 1915102 - protein, 8 aa, Staphylococcus
TEEEPHMG

SEQ ID NO: 1915103 - protein, 8 aa, Staphylococcus
TEGSIEPK

SEQ ID NO: 1915104 - protein, 8 aa, Staphylococcus
TEGSLSEG

SEQ ID NO: 1915105 - protein, 13 aa, Staphylococcus
TEKQSGKSVENRP

SEQ ID NO: 1915106 - protein, 5 aa, Staphylococcus
TELGA

SEQ ID NO: 1915107 - protein, 4 aa, Staphylococcus
TENQ

SEQ ID NO: 1915108 - protein, 27 aa, Staphylococcus
TERHESRRIDDQLRGRSGRQGDRGDSR

SEQ ID NO: 1915109 - protein, 5 aa, Staphylococcus
TERHW

SEQ ID NO: 1915110 - protein, 12 aa, Staphylococcus
TESAAKKVEEVL

SEQ ID NO: 1915111 - protein, 4 aa, Staphylococcus
TEVP

SEQ ID NO: 1915112 - protein, 5 aa, Staphylococcus
TFDMN

SEQ ID NO: 1915113 - protein, 4 aa, Staphylococcus
TFGD

SEQ ID NO: 1915114 - protein, 9 aa, Staphylococcus
TGAMTKDER

SEQ ID NO: 1915115 - protein, 6 aa, Staphylococcus
TGDITS

SEQ ID NO: 1915116 - protein, 14 aa, Staphylococcus
TGDPSKVGHLPGAT

SEQ ID NO: 1915117 - protein, 19 aa, Staphylococcus
TGDQTQIDLPKGVKSGLKE

SEQ ID NO: 1915118 - protein, 8 aa, Staphylococcus
TGDTSDYH

SEQ ID NO: 1915119 - protein, 5 aa, Staphylococcus
TGDYP

SEQ ID NO: 1915120 - protein, 7 aa, Staphylococcus
TGDYPAG

SEQ ID NO: 1915121 - protein, 8 aa, Staphylococcus
TGEDGEEA

SEQ ID NO: 1915122 - protein, 5 aa, Staphylococcus
TGEMK

SEQ ID NO: 1915123 - protein, 7 aa, Staphylococcus
TGERDGF

SEQ ID NO: 1915124 - protein, 4 aa, Staphylococcus
TGEV

SEQ ID NO: 1915125 - protein, 5 aa, Staphylococcus
TGEYE

SEQ ID NO: 1915126 - protein, 6 aa, Staphylococcus
TGGCPH

SEQ ID NO: 1915127 - protein, 7 aa, Staphylococcus
TGGCPHT

SEQ ID NO: 1915128 - protein, 4 aa, Staphylococcus
TGGL

SEQ ID NO: 1915129 - protein, 7 aa, Staphylococcus
TGGSSNL

SEQ ID NO: 1915130 - protein, 17 aa, Staphylococcus
TGGTSVPQTGSTGDGYK

SEQ ID NO: 1915131 - protein, 17 aa, Staphylococcus
TGGTSVPQTGSTGDGYR

SEQ ID NO: 1915132 - protein, 8 aa, Staphylococcus
TGGYGQDL

SEQ ID NO: 1915133 - protein, 9 aa, Staphylococcus
TGGYGQDLK

SEQ ID NO: 1915134 - protein, 6 aa, Staphylococcus
TGKPGM

SEQ ID NO: 1915135 - protein, 7 aa, Staphylococcus
TGLGGGI

SEQ ID NO: 1915136 - protein, 8 aa, Staphylococcus
TGNSSDVR

SEQ ID NO: 1915137 - protein, 9 aa, Staphylococcus
TGNSSDVRQ

SEQ ID NO: 1915138 - protein, 11 aa, Staphylococcus
TGNYNDKTAKL

SEQ ID NO: 1915139 - protein, 16 aa, Staphylococcus
TGRGTVATGRVERGQI

SEQ ID NO: 1915140 - protein, 4 aa, Staphylococcus
TGRY

SEQ ID NO: 1915141 - protein, 7 aa, Staphylococcus
TGSDSEI

SEQ ID NO: 1915142 - protein, 7 aa, Staphylococcus
TGSRPIE

SEQ ID NO: 1915143 - protein, 4 aa, Staphylococcus
TGST

SEQ ID NO: 1915144 - protein, 4 aa, Staphylococcus
TGTL

SEQ ID NO: 1915145 - protein, 9 aa, Staphylococcus
TGTPPRVNA

SEQ ID NO: 1915146 - protein, 6 aa, Staphylococcus
TGTSEF

SEQ ID NO: 1915147 - protein, 6 aa, Staphylococcus
TGTTLK

SEQ ID NO: 1915148 - protein, 10 aa, Staphylococcus
TGVGKTELAK

SEQ ID NO: 1915149 - protein, 10 aa, Staphylococcus
THGTAPKYAG

SEQ ID NO: 1915150 - protein, 8 aa, Staphylococcus
THPHYKPS

SEQ ID NO: 1915151 - protein, 11 aa, Staphylococcus
TIEEDSDDLDG

SEQ ID NO: 1915152 - protein, 9 aa, Staphylococcus
TIPGPNAGL

SEQ ID NO: 1915153 - protein, 6 aa, Staphylococcus
TITTTK

SEQ ID NO: 1915154 - protein, 6 aa, Staphylococcus
TKDAMG

SEQ ID NO: 1915155 - protein, 5 aa, Staphylococcus
TKEAF

SEQ ID NO: 1915156 - protein, 10 aa, Staphylococcus
TKEKETADSY

SEQ ID NO: 1915157 - protein, 10 aa, Staphylococcus
TKEKHPDADK

SEQ ID NO: 1915158 - protein, 10 aa, Staphylococcus
TKEKHPNADK

SEQ ID NO: 1915159 - protein, 10 aa, Staphylococcus
TKENPPIPGH

SEQ ID NO: 1915160 - protein, 16 aa, Staphylococcus
TKESVRAIRDAKAAGI

SEQ ID NO: 1915161 - protein, 8 aa, Staphylococcus
TKNKTSTV

SEQ ID NO: 1915162 - protein, 10 aa, Staphylococcus
TKSTPEGARD

SEQ ID NO: 1915163 - protein, 7 aa, Staphylococcus
TKYQPIP

SEQ ID NO: 1915164 - protein, 5 aa, Staphylococcus
TLAGQ

SEQ ID NO: 1915165 - protein, 15 aa, Staphylococcus
TLDEYRKNIEKDAAL

SEQ ID NO: 1915166 - protein, 12 aa, Staphylococcus
TLGRGGSDTTAV

SEQ ID NO: 1915167 - protein, 4 aa, Staphylococcus
TLPQ

SEQ ID NO: 1915168 - protein, 6 aa, Staphylococcus
TLSTKP

SEQ ID NO: 1915169 - protein, 9 aa, Staphylococcus
TMKTENGST

SEQ ID NO: 1915170 - protein, 8 aa, Staphylococcus
TMTTVPEE

SEQ ID NO: 1915171 - protein, 6 aa, Staphylococcus
TNANSE

SEQ ID NO: 1915172 - protein, 7 aa, Staphylococcus
TNETDTY

SEQ ID NO: 1915173 - protein, 7 aa, Staphylococcus
TNETETY

SEQ ID NO: 1915174 - protein, 7 aa, Staphylococcus
TNGKSRS

SEQ ID NO: 1915175 - protein, 4 aa, Staphylococcus
TNHL

SEQ ID NO: 1915176 - protein, 5 aa, Staphylococcus
TNHPA

SEQ ID NO: 1915177 - protein, 9 aa, Staphylococcus
TNIEKTDSA

SEQ ID NO: 1915178 - protein, 13 aa, Staphylococcus
TNIKNAKSKIERM

SEQ ID NO: 1915179 - protein, 10 aa, Staphylococcus
TNKEREAAQN

SEQ ID NO: 1915180 - protein, 4 aa, Staphylococcus
TNLR

SEQ ID NO: 1915181 - protein, 6 aa, Staphylococcus
TNNVDN

SEQ ID NO: 1915182 - protein, 5 aa, Staphylococcus
TNPFT

SEQ ID NO: 1915183 - protein, 6 aa, Staphylococcus
TNQRET

SEQ ID NO: 1915184 - protein, 7 aa, Staphylococcus
TNQRETT

SEQ ID NO: 1915185 - protein, 6 aa, Staphylococcus
TNTEFD

SEQ ID NO: 1915186 - protein, 9 aa, Staphylococcus
TPAQKDTEI

SEQ ID NO: 1915187 - protein, 5 aa, Staphylococcus
TPARL

SEQ ID NO: 1915188 - protein, 6 aa, Staphylococcus
TPARLS

SEQ ID NO: 1915189 - protein, 11 aa, Staphylococcus
TPDEEIGRGPH

SEQ ID NO: 1915190 - protein, 6 aa, Staphylococcus
TPDHTE

SEQ ID NO: 1915191 - protein, 4 aa, Staphylococcus
TPEQ

SEQ ID NO: 1915192 - protein, 5 aa, Staphylococcus
TPIPR

SEQ ID NO: 1915193 - protein, 4 aa, Staphylococcus
TPIY

SEQ ID NO: 1915194 - protein, 6 aa, Staphylococcus
TPLAES

SEQ ID NO: 1915195 - protein, 9 aa, Staphylococcus
TPLAESGIG

SEQ ID NO: 1915196 - protein, 9 aa, Staphylococcus
TPNETGAGF

SEQ ID NO: 1915197 - protein, 5 aa, Staphylococcus
TPNKV

SEQ ID NO: 1915198 - protein, 4 aa, Staphylococcus
TPQS

SEQ ID NO: 1915199 - protein, 6 aa, Staphylococcus
TPQSVA

SEQ ID NO: 1915200 - protein, 4 aa, Staphylococcus
TPRA

SEQ ID NO: 1915201 - protein, 5 aa, Staphylococcus
TQASV

SEQ ID NO: 1915202 - protein, 4 aa, Staphylococcus
TQET

SEQ ID NO: 1915203 - protein, 5 aa, Staphylococcus
TQGKQ

SEQ ID NO: 1915204 - protein, 6 aa, Staphylococcus
TQGPGL

SEQ ID NO: 1915205 - protein, 9 aa, Staphylococcus
TQIDPKRDV

SEQ ID NO: 1915206 - protein, 6 aa, Staphylococcus
TQPKNA

SEQ ID NO: 1915207 - protein, 9 aa, Staphylococcus
TQPPPRYTE

SEQ ID NO: 1915208 - protein, 7 aa, Staphylococcus
TQQSLSN

SEQ ID NO: 1915209 - protein, 18 aa, Staphylococcus
TQRGGPSTGLPTKQEQSD

SEQ ID NO: 1915210 - protein, 9 aa, Staphylococcus
TQSQGDVRS

SEQ ID NO: 1915211 - protein, 5 aa, Staphylococcus
TQSTF

SEQ ID NO: 1915212 - protein, 9 aa, Staphylococcus
TRALTTKYD

SEQ ID NO: 1915213 - protein, 8 aa, Staphylococcus
TRANKTQV

SEQ ID NO: 1915214 - protein, 9 aa, Staphylococcus
TRDDFGGSQ

SEQ ID NO: 1915215 - protein, 4 aa, Staphylococcus
TRDN

SEQ ID NO: 1915216 - protein, 4 aa, Staphylococcus
TREL

SEQ ID NO: 1915217 - protein, 12 aa, Staphylococcus
TREPGGVPTGEE

SEQ ID NO: 1915218 - protein, 29 aa, Staphylococcus
TRGLGAGANPEIGKKAAEESREQIEDAIQ

SEQ ID NO: 1915219 - protein, 18 aa, Staphylococcus
TRKSSLRDTYFNINQRGD

SEQ ID NO: 1915220 - protein, 9 aa, Staphylococcus
TRNDFGGSQ

SEQ ID NO: 1915221 - protein, 4 aa, Staphylococcus
TRNP

SEQ ID NO: 1915222 - protein, 5 aa, Staphylococcus
TRNPV

SEQ ID NO: 1915223 - protein, 5 aa, Staphylococcus
TRPDT

SEQ ID NO: 1915224 - protein, 6 aa, Staphylococcus
TRPELS

SEQ ID NO: 1915225 - protein, 6 aa, Staphylococcus
TRPTPN

SEQ ID NO: 1915226 - protein, 5 aa, Staphylococcus
TRYRP

SEQ ID NO: 1915227 - protein, 11 aa, Staphylococcus
TSACSSKRGKL

SEQ ID NO: 1915228 - protein, 4 aa, Staphylococcus
TSFQ

SEQ ID NO: 1915229 - protein, 5 aa, Staphylococcus
TSGLG

SEQ ID NO: 1915230 - protein, 14 aa, Staphylococcus
TSGTTGNPKAVTHS

SEQ ID NO: 1915231 - protein, 7 aa, Staphylococcus
TSKEVDE

SEQ ID NO: 1915232 - protein, 8 aa, Staphylococcus
TSKLDADD

SEQ ID NO: 1915233 - protein, 8 aa, Staphylococcus
TSKTTVTG

SEQ ID NO: 1915234 - protein, 11 aa, Staphylococcus
TSLNKDEKGIN

SEQ ID NO: 1915235 - protein, 4 aa, Staphylococcus
TSPI

SEQ ID NO: 1915236 - protein, 6 aa, Staphylococcus
TSPQAF

SEQ ID NO: 1915237 - protein, 7 aa, Staphylococcus
TSRPSYI

SEQ ID NO: 1915238 - protein, 12 aa, Staphylococcus
TTAKEGKHSPVA

SEQ ID NO: 1915239 - protein, 7 aa, Staphylococcus
TTDGFEL

SEQ ID NO: 1915240 - protein, 6 aa, Staphylococcus
TTDPGM

SEQ ID NO: 1915241 - protein, 4 aa, Staphylococcus
TTDT

SEQ ID NO: 1915242 - protein, 9 aa, Staphylococcus
TTERAPYPY

SEQ ID NO: 1915243 - protein, 4 aa, Staphylococcus
TTHY

SEQ ID NO: 1915244 - protein, 4 aa, Staphylococcus
TTNL

SEQ ID NO: 1915245 - protein, 13 aa, Staphylococcus
TTPGGKGANQAVA

SEQ ID NO: 1915246 - protein, 5 aa, Staphylococcus
TTRAA

SEQ ID NO: 1915247 - protein, 9 aa, Staphylococcus
TTSATPDEI

SEQ ID NO: 1915248 - protein, 4 aa, Staphylococcus
TTSG

SEQ ID NO: 1915249 - protein, 10 aa, Staphylococcus
TVEGPDDYKS

SEQ ID NO: 1915250 - protein, 6 aa, Staphylococcus
TVQGEN

SEQ ID NO: 1915251 - protein, 11 aa, Staphylococcus
TVSTTGKTGVE

SEQ ID NO: 1915252 - protein, 7 aa, Staphylococcus
TWEASGH

SEQ ID NO: 1915253 - protein, 4 aa, Staphylococcus
TYEE

SEQ ID NO: 1915254 - protein, 8 aa, Staphylococcus
VAEPAGAL

SEQ ID NO: 1915255 - protein, 7 aa, Staphylococcus
VAEPGDT

SEQ ID NO: 1915256 - protein, 5 aa, Staphylococcus
VAGDG

SEQ ID NO: 1915257 - protein, 4 aa, Staphylococcus
VAGS

SEQ ID NO: 1915258 - protein, 10 aa, Staphylococcus
VAGSGKSSLI

SEQ ID NO: 1915259 - protein, 31 aa, Staphylococcus
VASEDKSPKLNKLGGSEWKKTKAKVQQSVED

SEQ ID NO: 1915260 - protein, 10 aa, Staphylococcus
VASKEPRDGD

SEQ ID NO: 1915261 - protein, 7 aa, Staphylococcus
VATAEAT

SEQ ID NO: 1915262 - protein, 18 aa, Staphylococcus
VATNNQNSGQDVSRQGVQ

SEQ ID NO: 1915263 - protein, 4 aa, Staphylococcus
VDIT

SEQ ID NO: 1915264 - protein, 6 aa, Staphylococcus
VDPNAI

SEQ ID NO: 1915265 - protein, 4 aa, Staphylococcus
VDTI

SEQ ID NO: 1915266 - protein, 6 aa, Staphylococcus
VEGDAL

SEQ ID NO: 1915267 - protein, 7 aa, Staphylococcus
VEGETGY

SEQ ID NO: 1915268 - protein, 15 aa, Staphylococcus
VEGTNKAIASTIDGE

SEQ ID NO: 1915269 - protein, 6 aa, Staphylococcus
VENKNS

SEQ ID NO: 1915270 - protein, 4 aa, Staphylococcus
VEPS

SEQ ID NO: 1915271 - protein, 8 aa, Staphylococcus
VESQEQVD

SEQ ID NO: 1915272 - protein, 9 aa, Staphylococcus
VESQEQVDA

SEQ ID NO: 1915273 - protein, 9 aa, Staphylococcus
VESTSRAPW

SEQ ID NO: 1915274 - protein, 4 aa, Staphylococcus
VETS

SEQ ID NO: 1915275 - protein, 6 aa, Staphylococcus
VETTCA

SEQ ID NO: 1915276 - protein, 8 aa, Staphylococcus
VGDTIQRG

SEQ ID NO: 1915277 - protein, 7 aa, Staphylococcus
VGGYPKG

SEQ ID NO: 1915278 - protein, 5 aa, Staphylococcus
VGMDS

SEQ ID NO: 1915279 - protein, 10 aa, Staphylococcus
VGPNGAGKTT

SEQ ID NO: 1915280 - protein, 12 aa, Staphylococcus
VGQTQDDEGNRG

SEQ ID NO: 1915281 - protein, 8 aa, Staphylococcus
VGRGPLAG

SEQ ID NO: 1915282 - protein, 4 aa, Staphylococcus
VGSK

SEQ ID NO: 1915283 - protein, 7 aa, Staphylococcus
VGSKGTV

SEQ ID NO: 1915284 - protein, 11 aa, Staphylococcus
VGSTEQIKANH

SEQ ID NO: 1915285 - protein, 7 aa, Staphylococcus
VGTGASD

SEQ ID NO: 1915286 - protein, 6 aa, Staphylococcus
VGTGSG

SEQ ID NO: 1915287 - protein, 5 aa, Staphylococcus
VGTIA

SEQ ID NO: 1915288 - protein, 8 aa, Staphylococcus
VHAEPTTF

SEQ ID NO: 1915289 - protein, 11 aa, Staphylococcus
VHNGRRVSASR

SEQ ID NO: 1915290 - protein, 5 aa, Staphylococcus
VISNS

SEQ ID NO: 1915291 - protein, 8 aa, Staphylococcus
VKAGQDHD

SEQ ID NO: 1915292 - protein, 12 aa, Staphylococcus
VKDDKEKTKELS

SEQ ID NO: 1915293 - protein, 5 aa, Staphylococcus
VKDLP

SEQ ID NO: 1915294 - protein, 6 aa, Staphylococcus
VKGGRR

SEQ ID NO: 1915295 - protein, 9 aa, Staphylococcus
VKKSERKKM

SEQ ID NO: 1915296 - protein, 5 aa, Staphylococcus
VKKTG

SEQ ID NO: 1915297 - protein, 7 aa, Staphylococcus
VKQSKPI

SEQ ID NO: 1915298 - protein, 4 aa, Staphylococcus
VKQV

SEQ ID NO: 1915299 - protein, 9 aa, Staphylococcus
VKSGGPELA

SEQ ID NO: 1915300 - protein, 12 aa, Staphylococcus
VKTADTPSEIGT

SEQ ID NO: 1915301 - protein, 9 aa, Staphylococcus
VNDDTPQDD

SEQ ID NO: 1915302 - protein, 8 aa, Staphylococcus
VNEKNGSV

SEQ ID NO: 1915303 - protein, 12 aa, Staphylococcus
VNGDQSEEGLES

SEQ ID NO: 1915304 - protein, 5 aa, Staphylococcus
VNGVA

SEQ ID NO: 1915305 - protein, 4 aa, Staphylococcus
VNKE

SEQ ID NO: 1915306 - protein, 6 aa, Staphylococcus
VNPDEV

SEQ ID NO: 1915307 - protein, 4 aa, Staphylococcus
VNPF

SEQ ID NO: 1915308 - protein, 10 aa, Staphylococcus
VNQDTDNIGA

SEQ ID NO: 1915309 - protein, 8 aa, Staphylococcus
VPDQPSFK

SEQ ID NO: 1915310 - protein, 4 aa, Staphylococcus
VPED

SEQ ID NO: 1915311 - protein, 11 aa, Staphylococcus
VPELDKNKNHT

SEQ ID NO: 1915312 - protein, 4 aa, Staphylococcus
VPES

SEQ ID NO: 1915313 - protein, 5 aa, Staphylococcus
VPHPR

SEQ ID NO: 1915314 - protein, 9 aa, Staphylococcus
VPKKKSEFV

SEQ ID NO: 1915315 - protein, 10 aa, Staphylococcus
VPKSIPSDAY

SEQ ID NO: 1915316 - protein, 7 aa, Staphylococcus
VPPSNDI

SEQ ID NO: 1915317 - protein, 7 aa, Staphylococcus
VPRGRGK

SEQ ID NO: 1915318 - protein, 8 aa, Staphylococcus
VPSENAGA

SEQ ID NO: 1915319 - protein, 5 aa, Staphylococcus
VPTGT

SEQ ID NO: 1915320 - protein, 4 aa, Staphylococcus
VQEI

SEQ ID NO: 1915321 - protein, 6 aa, Staphylococcus
VQNQDM

SEQ ID NO: 1915322 - protein, 8 aa, Staphylococcus
VQQESGGI

SEQ ID NO: 1915323 - protein, 7 aa, Staphylococcus
VQTVGKG

SEQ ID NO: 1915324 - protein, 7 aa, Staphylococcus
VRERNPF

SEQ ID NO: 1915325 - protein, 7 aa, Staphylococcus
VRITPQR

SEQ ID NO: 1915326 - protein, 5 aa, Staphylococcus
VRQVE

SEQ ID NO: 1915327 - protein, 7 aa, Staphylococcus
VRRGAPN

SEQ ID NO: 1915328 - protein, 9 aa, Staphylococcus
VSEGTAYRA

SEQ ID NO: 1915329 - protein, 10 aa, Staphylococcus
VSGAKDPVKM

SEQ ID NO: 1915330 - protein, 11 aa, Staphylococcus
VSGPSLERPGD

SEQ ID NO: 1915331 - protein, 8 aa, Staphylococcus
VSGSSRKI

SEQ ID NO: 1915332 - protein, 8 aa, Staphylococcus
VSNEDAGL

SEQ ID NO: 1915333 - protein, 7 aa, Staphylococcus
VSREEAK

SEQ ID NO: 1915334 - protein, 5 aa, Staphylococcus
VSSQI

SEQ ID NO: 1915335 - protein, 7 aa, Staphylococcus
VTAYRGS

SEQ ID NO: 1915336 - protein, 13 aa, Staphylococcus
VTGAHGKTSTTGL

SEQ ID NO: 1915337 - protein, 12 aa, Staphylococcus
VTGSNGKTTTKD

SEQ ID NO: 1915338 - protein, 13 aa, Staphylococcus
VTGSNGKTTTKDM

SEQ ID NO: 1915339 - protein, 10 aa, Staphylococcus
VTKAPNGQNL

SEQ ID NO: 1915340 - protein, 10 aa, Staphylococcus
VTKSKVRRER

SEQ ID NO: 1915341 - protein, 9 aa, Staphylococcus
VVGPNGDPL

SEQ ID NO: 1915342 - protein, 7 aa, Staphylococcus
VVPGSEG

SEQ ID NO: 1915343 - protein, 5 aa, Staphylococcus
VYPNG

SEQ ID NO: 1915344 - protein, 5 aa, Staphylococcus
WEASG

SEQ ID NO: 1915345 - protein, 17 aa, Staphylococcus
WEEGSESLQPGLDLVGK

SEQ ID NO: 1915346 - protein, 17 aa, Staphylococcus
WEEGSETLQPGLDLVGK

SEQ ID NO: 1915347 - protein, 8 aa, Staphylococcus
WGTNPEMG

SEQ ID NO: 1915348 - protein, 13 aa, Staphylococcus
WPEDEEEEKRKAL

SEQ ID NO: 1915349 - protein, 12 aa, Staphylococcus
WQSEGNTGTPWL

SEQ ID NO: 1915350 - protein, 8 aa, Staphylococcus
WRGDSNNK

SEQ ID NO: 1915351 - protein, 4 aa, Staphylococcus
WRGT

SEQ ID NO: 1915352 - protein, 5 aa, Staphylococcus
YAEYG

SEQ ID NO: 1915353 - protein, 11 aa, Staphylococcus
YAGNKEKAEAV

SEQ ID NO: 1915354 - protein, 7 aa, Staphylococcus
YATDPRI

SEQ ID NO: 1915355 - protein, 6 aa, Staphylococcus
YDDTTL

SEQ ID NO: 1915356 - protein, 10 aa, Staphylococcus
YDGNEREPSV

SEQ ID NO: 1915357 - protein, 11 aa, Staphylococcus
YDGRTGEPFDN

SEQ ID NO: 1915358 - protein, 16 aa, Staphylococcus
YDQRSDELSGGQQQRI

SEQ ID NO: 1915359 - protein, 5 aa, Staphylococcus
YEEGK

SEQ ID NO: 1915360 - protein, 8 aa, Staphylococcus
YEFEPDKE

SEQ ID NO: 1915361 - protein, 9 aa, Staphylococcus
YEKNDLTQE

SEQ ID NO: 1915362 - protein, 9 aa, Staphylococcus
YENGAIDNT

SEQ ID NO: 1915363 - protein, 6 aa, Staphylococcus
YERRGN

SEQ ID NO: 1915364 - protein, 8 aa, Staphylococcus
YGAPPHGG

SEQ ID NO: 1915365 - protein, 4 aa, Staphylococcus
YGGL

SEQ ID NO: 1915366 - protein, 11 aa, Staphylococcus
YGHSQLPSDGL

SEQ ID NO: 1915367 - protein, 7 aa, Staphylococcus
YGKESEE

SEQ ID NO: 1915368 - protein, 5 aa, Staphylococcus
YGKRP

SEQ ID NO: 1915369 - protein, 6 aa, Staphylococcus
YGKRPV

SEQ ID NO: 1915370 - protein, 9 aa, Staphylococcus
YGLSGGQQQ

SEQ ID NO: 1915371 - protein, 4 aa, Staphylococcus
YGQE

SEQ ID NO: 1915372 - protein, 8 aa, Staphylococcus
YGSTGDAY

SEQ ID NO: 1915373 - protein, 7 aa, Staphylococcus
YHDKRSA

SEQ ID NO: 1915374 - protein, 8 aa, Staphylococcus
YHPHGDSS

SEQ ID NO: 1915375 - protein, 9 aa, Staphylococcus
YHPHGDSSI

SEQ ID NO: 1915376 - protein, 5 aa, Staphylococcus
YHQDY

SEQ ID NO: 1915377 - protein, 8 aa, Staphylococcus
YKEDGTGL

SEQ ID NO: 1915378 - protein, 6 aa, Staphylococcus
YKHDGN

SEQ ID NO: 1915379 - protein, 4 aa, Staphylococcus
YKHN

SEQ ID NO: 1915380 - protein, 6 aa, Staphylococcus
YKRDED

SEQ ID NO: 1915381 - protein, 11 aa, Staphylococcus
YKTKKSKERTI

SEQ ID NO: 1915382 - protein, 8 aa, Staphylococcus
YLNPQEYP

SEQ ID NO: 1915383 - protein, 9 aa, Staphylococcus
YNETRGTSI

SEQ ID NO: 1915384 - protein, 5 aa, Staphylococcus
YNQMQ

SEQ ID NO: 1915385 - protein, 6 aa, Staphylococcus
YNQMQK

SEQ ID NO: 1915386 - protein, 4 aa, Staphylococcus
YPDV

SEQ ID NO: 1915387 - protein, 4 aa, Staphylococcus
YPMP

SEQ ID NO: 1915388 - protein, 4 aa, Staphylococcus
YPNG

SEQ ID NO: 1915389 - protein, 5 aa, Staphylococcus
YPYYA

SEQ ID NO: 1915390 - protein, 10 aa, Staphylococcus
YQNADGSITI

SEQ ID NO: 1915391 - protein, 4 aa, Staphylococcus
YQRT

SEQ ID NO: 1915392 - protein, 7 aa, Staphylococcus
YQTRRNI

SEQ ID NO: 1915393 - protein, 12 aa, Staphylococcus
YRDPEDKEKYFD

SEQ ID NO: 1915394 - protein, 13 aa, Staphylococcus
YRDPEDKEKYMDD

SEQ ID NO: 1915395 - protein, 5 aa, Staphylococcus
YRGNS

SEQ ID NO: 1915396 - protein, 12 aa, Staphylococcus
YRRDSDDATHSH

SEQ ID NO: 1915397 - protein, 13 aa, Staphylococcus
YRRDSDDATHSHQ

SEQ ID NO: 1915398 - protein, 7 aa, Staphylococcus
YRSENLP

SEQ ID NO: 1915399 - protein, 5 aa, Staphylococcus
YRSEV

SEQ ID NO: 1915400 - protein, 6 aa, Staphylococcus
YRSTKT

SEQ ID NO: 1915401 - protein, 5 aa, Staphylococcus
YSDGA

SEQ ID NO: 1915402 - protein, 7 aa, Staphylococcus
YSFGGDK

SEQ ID NO: 1915403 - protein, 6 aa, Staphylococcus
YSKLNK

SEQ ID NO: 1915404 - protein, 8 aa, Staphylococcus
YSKRELSK

SEQ ID NO: 1915405 - protein, 7 aa, Staphylococcus
YSLKPGQ

SEQ ID NO: 1915406 - protein, 7 aa, Staphylococcus
YSRETME

SEQ ID NO: 1915407 - protein, 6 aa, Staphylococcus
YSTEKV

SEQ ID NO: 1915408 - protein, 5 aa, Staphylococcus
YTPRA

SEQ ID NO: 1915409 - protein, 6 aa, Staphylococcus
YTRPRE

SEQ ID NO: 1915410 - protein, 5 aa, Staphylococcus
YTTSE

SEQ ID NO: 1915411 - protein, 11 aa, Staphylococcus
YVTEGKITRNA

SEQ ID NO: 1915412 - protein, 9 aa, Staphylococcus
YWRGDSNNK

SEQ ID NO: 1915413 - protein, 9 aa, Staphylococcus
AAAGSGKTA

SEQ ID NO: 1915414 - protein, 16 aa, Staphylococcus
AAALSGTTHPIDRHET

SEQ ID NO: 1915415 - protein, 17 aa, Staphylococcus
AAALSGTTHPIDRHETQ

SEQ ID NO: 1915416 - protein, 8 aa, Staphylococcus
AADDPNTI

SEQ ID NO: 1915417 - protein, 12 aa, Staphylococcus
AADGIKDKDMHD

SEQ ID NO: 1915418 - protein, 8 aa, Staphylococcus
AADKITDA

SEQ ID NO: 1915419 - protein, 11 aa, Staphylococcus
AADKITDSIEA

SEQ ID NO: 1915420 - protein, 11 aa, Staphylococcus
AADPGSTNTDL

SEQ ID NO: 1915421 - protein, 6 aa, Staphylococcus
AAEGTI

SEQ ID NO: 1915422 - protein, 7 aa, Staphylococcus
AAEKGAE

SEQ ID NO: 1915423 - protein, 6 aa, Staphylococcus
AAELQH

SEQ ID NO: 1915424 - protein, 7 aa, Staphylococcus
AAENDLK

SEQ ID NO: 1915425 - protein, 10 aa, Staphylococcus
AAESDHGGYK

SEQ ID NO: 1915426 - protein, 13 aa, Staphylococcus
AAGESFNINSPKQ

SEQ ID NO: 1915427 - protein, 10 aa, Staphylococcus
AAGKGGNIKR

SEQ ID NO: 1915428 - protein, 18 aa, Staphylococcus
AAGLTSSSSEMAAKGGSG

SEQ ID NO: 1915429 - protein, 18 aa, Staphylococcus
AAGLVSGAAHSTGDTVRP

SEQ ID NO: 1915430 - protein, 15 aa, Staphylococcus
AAHGFGGKQTPKVTS

SEQ ID NO: 1915431 - protein, 5 aa, Staphylococcus
AAIQT

SEQ ID NO: 1915432 - protein, 7 aa, Staphylococcus
AAKEDSE

SEQ ID NO: 1915433 - protein, 5 aa, Staphylococcus
AAKLT

SEQ ID NO: 1915434 - protein, 6 aa, Staphylococcus
AAKNKG

SEQ ID NO: 1915435 - protein, 12 aa, Staphylococcus
AAKRRGKEIKGS

SEQ ID NO: 1915436 - protein, 6 aa, Staphylococcus
AAMESG

SEQ ID NO: 1915437 - protein, 7 aa, Staphylococcus
AAMESGV

SEQ ID NO: 1915438 - protein, 6 aa, Staphylococcus
AANDNP

SEQ ID NO: 1915439 - protein, 18 aa, Staphylococcus
AANEGDFDKAEQLTEEAN

SEQ ID NO: 1915440 - protein, 6 aa, Staphylococcus
AANGKT

SEQ ID NO: 1915441 - protein, 16 aa, Staphylococcus
AAPSANLSGRPSPTTF

SEQ ID NO: 1915442 - protein, 4 aa, Staphylococcus
AAQM

SEQ ID NO: 1915443 - protein, 4 aa, Staphylococcus
AARD

SEQ ID NO: 1915444 - protein, 7 aa, Staphylococcus
AARQHDM

SEQ ID NO: 1915445 - protein, 11 aa, Staphylococcus
AASDIGQSSFD

SEQ ID NO: 1915446 - protein, 10 aa, Staphylococcus
AASDVGQSSF

SEQ ID NO: 1915447 - protein, 7 aa, Staphylococcus
AASGAVG

SEQ ID NO: 1915448 - protein, 11 aa, Staphylococcus
AASGNRNWGQN

SEQ ID NO: 1915449 - protein, 9 aa, Staphylococcus
AASTNSNYV

SEQ ID NO: 1915450 - protein, 17 aa, Staphylococcus
AAYQAEGATQTDGKGRV

SEQ ID NO: 1915451 - protein, 10 aa, Staphylococcus
ACGGAASGFN

SEQ ID NO: 1915452 - protein, 4 aa, Staphylococcus
ADAA

SEQ ID NO: 1915453 - protein, 6 aa, Staphylococcus
ADAGVG

SEQ ID NO: 1915454 - protein, 8 aa, Staphylococcus
ADAKGNVR

SEQ ID NO: 1915455 - protein, 6 aa, Staphylococcus
ADALSR

SEQ ID NO: 1915456 - protein, 7 aa, Staphylococcus
ADDELGE

SEQ ID NO: 1915457 - protein, 8 aa, Staphylococcus
ADDGKISL

SEQ ID NO: 1915458 - protein, 7 aa, Staphylococcus
ADDSLND

SEQ ID NO: 1915459 - protein, 7 aa, Staphylococcus
ADEAKEY

SEQ ID NO: 1915460 - protein, 6 aa, Staphylococcus
ADEIKA

SEQ ID NO: 1915461 - protein, 4 aa, Staphylococcus
ADEV

SEQ ID NO: 1915462 - protein, 4 aa, Staphylococcus
ADGH

SEQ ID NO: 1915463 - protein, 7 aa, Staphylococcus
ADGPSFD

SEQ ID NO: 1915464 - protein, 7 aa, Staphylococcus
ADGPSME

SEQ ID NO: 1915465 - protein, 6 aa, Staphylococcus
ADIGSD

SEQ ID NO: 1915466 - protein, 6 aa, Staphylococcus
ADIRDV

SEQ ID NO: 1915467 - protein, 8 aa, Staphylococcus
ADKDGGEI

SEQ ID NO: 1915468 - protein, 9 aa, Staphylococcus
ADKDGGEII

SEQ ID NO: 1915469 - protein, 4 aa, Staphylococcus
ADKK

SEQ ID NO: 1915470 - protein, 5 aa, Staphylococcus
ADKLE

SEQ ID NO: 1915471 - protein, 7 aa, Staphylococcus
ADLSPGT

SEQ ID NO: 1915472 - protein, 7 aa, Staphylococcus
ADNPLKQ

SEQ ID NO: 1915473 - protein, 4 aa, Staphylococcus
ADNR

SEQ ID NO: 1915474 - protein, 9 aa, Staphylococcus
ADRDKPEHL

SEQ ID NO: 1915475 - protein, 4 aa, Staphylococcus
ADRF

SEQ ID NO: 1915476 - protein, 4 aa, Staphylococcus
ADRI

SEQ ID NO: 1915477 - protein, 10 aa, Staphylococcus
ADRLEEDSSQ

SEQ ID NO: 1915478 - protein, 4 aa, Staphylococcus
ADSF

SEQ ID NO: 1915479 - protein, 4 aa, Staphylococcus
ADSI

SEQ ID NO: 1915480 - protein, 12 aa, Staphylococcus
ADSIANDGYNDE

SEQ ID NO: 1915481 - protein, 4 aa, Staphylococcus
ADSL

SEQ ID NO: 1915482 - protein, 4 aa, Staphylococcus
ADTE

SEQ ID NO: 1915483 - protein, 5 aa, Staphylococcus
ADTER

SEQ ID NO: 1915484 - protein, 4 aa, Staphylococcus
ADTG

SEQ ID NO: 1915485 - protein, 7 aa, Staphylococcus
ADTPGFS

SEQ ID NO: 1915486 - protein, 9 aa, Staphylococcus
ADVKREGKD

SEQ ID NO: 1915487 - protein, 7 aa, Staphylococcus
AEAGVAP

SEQ ID NO: 1915488 - protein, 10 aa, Staphylococcus
AEAIDGQAAE

SEQ ID NO: 1915489 - protein, 11 aa, Staphylococcus
AEAISGQASEV

SEQ ID NO: 1915490 - protein, 8 aa, Staphylococcus
AEAPAKAY

SEQ ID NO: 1915491 - protein, 8 aa, Staphylococcus
AEAPAQAY

SEQ ID NO: 1915492 - protein, 7 aa, Staphylococcus
AEATKQA

SEQ ID NO: 1915493 - protein, 13 aa, Staphylococcus
AEDDYKYDEKTKA

SEQ ID NO: 1915494 - protein, 16 aa, Staphylococcus
AEDGRKMSKSLGNGVD

SEQ ID NO: 1915495 - protein, 5 aa, Staphylococcus
AEDIN

SEQ ID NO: 1915496 - protein, 9 aa, Staphylococcus
AEDVGTSEH

SEQ ID NO: 1915497 - protein, 6 aa, Staphylococcus
AEEFNQ

SEQ ID NO: 1915498 - protein, 7 aa, Staphylococcus
AEEFSER

SEQ ID NO: 1915499 - protein, 13 aa, Staphylococcus
AEEGYKSLEEGQK

SEQ ID NO: 1915500 - protein, 4 aa, Staphylococcus
AEEI

SEQ ID NO: 1915501 - protein, 6 aa, Staphylococcus
AEEKNH

SEQ ID NO: 1915502 - protein, 4 aa, Staphylococcus
AEEL

SEQ ID NO: 1915503 - protein, 14 aa, Staphylococcus
AEELAGKEATFKTK

SEQ ID NO: 1915504 - protein, 6 aa, Staphylococcus
AEENNL

SEQ ID NO: 1915505 - protein, 9 aa, Staphylococcus
AEERTIKGS

SEQ ID NO: 1915506 - protein, 6 aa, Staphylococcus
AEGQTV

SEQ ID NO: 1915507 - protein, 7 aa, Staphylococcus
AEHGEYG

SEQ ID NO: 1915508 - protein, 16 aa, Staphylococcus
AEHPHAAQQPENYELR

SEQ ID NO: 1915509 - protein, 12 aa, Staphylococcus
AEIDESSDTSMK

SEQ ID NO: 1915510 - protein, 13 aa, Staphylococcus
AEIDESSDTSMKI

SEQ ID NO: 1915511 - protein, 7 aa, Staphylococcus
AEIERDP

SEQ ID NO: 1915512 - protein, 4 aa, Staphylococcus
AEKI

SEQ ID NO: 1915513 - protein, 14 aa, Staphylococcus
AEKIESGIKRGKKH

SEQ ID NO: 1915514 - protein, 11 aa, Staphylococcus
AEKRAEEKSGL

SEQ ID NO: 1915515 - protein, 6 aa, Staphylococcus
AELQGR

SEQ ID NO: 1915516 - protein, 12 aa, Staphylococcus
AENDVVKENPDV

SEQ ID NO: 1915517 - protein, 8 aa, Staphylococcus
AENGYPVT

SEQ ID NO: 1915518 - protein, 5 aa, Staphylococcus
AENNY

SEQ ID NO: 1915519 - protein, 6 aa, Staphylococcus
AENRAH

SEQ ID NO: 1915520 - protein, 6 aa, Staphylococcus
AEPAGA

SEQ ID NO: 1915521 - protein, 7 aa, Staphylococcus
AEPASDF

SEQ ID NO: 1915522 - protein, 6 aa, Staphylococcus
AEPGDT

SEQ ID NO: 1915523 - protein, 7 aa, Staphylococcus
AEQAGIE

SEQ ID NO: 1915524 - protein, 7 aa, Staphylococcus
AESNNSD

SEQ ID NO: 1915525 - protein, 7 aa, Staphylococcus
AESQNFK

SEQ ID NO: 1915526 - protein, 8 aa, Staphylococcus
AETAQQVE

SEQ ID NO: 1915527 - protein, 13 aa, Staphylococcus
AETDHTSSDAQEF

SEQ ID NO: 1915528 - protein, 5 aa, Staphylococcus
AETDY

SEQ ID NO: 1915529 - protein, 13 aa, Staphylococcus
AETFGKGVNRETY

SEQ ID NO: 1915530 - protein, 7 aa, Staphylococcus
AETGRER

SEQ ID NO: 1915531 - protein, 6 aa, Staphylococcus
AETNDE

SEQ ID NO: 1915532 - protein, 6 aa, Staphylococcus
AETSDE

SEQ ID NO: 1915533 - protein, 9 aa, Staphylococcus
AETSRKQKQ

SEQ ID NO: 1915534 - protein, 9 aa, Staphylococcus
AEVGERTNI

SEQ ID NO: 1915535 - protein, 4 aa, Staphylococcus
AFAP

SEQ ID NO: 1915536 - protein, 6 aa, Staphylococcus
AFAPTN

SEQ ID NO: 1915537 - protein, 12 aa, Staphylococcus
AFDSDDRKQPNI

SEQ ID NO: 1915538 - protein, 4 aa, Staphylococcus
AFGA

SEQ ID NO: 1915539 - protein, 6 aa, Staphylococcus
AFPDTH

SEQ ID NO: 1915540 - protein, 7 aa, Staphylococcus
AFPDTHE

SEQ ID NO: 1915541 - protein, 13 aa, Staphylococcus
AFSENSDQMLTEG

SEQ ID NO: 1915542 - protein, 12 aa, Staphylococcus
AFSSGNNVTTGV

SEQ ID NO: 1915543 - protein, 4 aa, Staphylococcus
AFTG

SEQ ID NO: 1915544 - protein, 8 aa, Staphylococcus
AGADQSIV

SEQ ID NO: 1915545 - protein, 7 aa, Staphylococcus
AGAGFPS

SEQ ID NO: 1915546 - protein, 4 aa, Staphylococcus
AGAR

SEQ ID NO: 1915547 - protein, 10 aa, Staphylococcus
AGASTTDKSA

SEQ ID NO: 1915548 - protein, 13 aa, Staphylococcus
AGASTTDKSAEEL

SEQ ID NO: 1915549 - protein, 8 aa, Staphylococcus
AGDARRGQ

SEQ ID NO: 1915550 - protein, 4 aa, Staphylococcus
AGDI

SEQ ID NO: 1915551 - protein, 8 aa, Staphylococcus
AGDYEGKA

SEQ ID NO: 1915552 - protein, 7 aa, Staphylococcus
AGEEFDN

SEQ ID NO: 1915553 - protein, 13 aa, Staphylococcus
AGEGYKTLEEGQK

SEQ ID NO: 1915554 - protein, 4 aa, Staphylococcus
AGEL

SEQ ID NO: 1915555 - protein, 7 aa, Staphylococcus
AGENGPL

SEQ ID NO: 1915556 - protein, 7 aa, Staphylococcus
AGESTGI

SEQ ID NO: 1915557 - protein, 5 aa, Staphylococcus
AGFIP

SEQ ID NO: 1915558 - protein, 4 aa, Staphylococcus
AGGC

SEQ ID NO: 1915559 - protein, 6 aa, Staphylococcus
AGGKRI

SEQ ID NO: 1915560 - protein, 9 aa, Staphylococcus
AGGQGKLKG

SEQ ID NO: 1915561 - protein, 5 aa, Staphylococcus
AGGRE

SEQ ID NO: 1915562 - protein, 7 aa, Staphylococcus
AGGSLAT

SEQ ID NO: 1915563 - protein, 4 aa, Staphylococcus
AGGV

SEQ ID NO: 1915564 - protein, 10 aa, Staphylococcus
AGHGKEGAQH

SEQ ID NO: 1915565 - protein, 10 aa, Staphylococcus
AGHGKKGAQH

SEQ ID NO: 1915566 - protein, 5 aa, Staphylococcus
AGIND

SEQ ID NO: 1915567 - protein, 6 aa, Staphylococcus
AGIPED

SEQ ID NO: 1915568 - protein, 4 aa, Staphylococcus
AGIS

SEQ ID NO: 1915569 - protein, 19 aa, Staphylococcus
AGKDKALPMNTGAEAVETA

SEQ ID NO: 1915570 - protein, 8 aa, Staphylococcus
AGKDTDGQ

SEQ ID NO: 1915571 - protein, 8 aa, Staphylococcus
AGKETDGQ

SEQ ID NO: 1915572 - protein, 5 aa, Staphylococcus
AGKKA

SEQ ID NO: 1915573 - protein, 9 aa, Staphylococcus
AGLAESHPH

SEQ ID NO: 1915574 - protein, 10 aa, Staphylococcus
AGLAESHPHN

SEQ ID NO: 1915575 - protein, 11 aa, Staphylococcus
AGLASSASAYA

SEQ ID NO: 1915576 - protein, 11 aa, Staphylococcus
AGLDKSDDANI

SEQ ID NO: 1915577 - protein, 12 aa, Staphylococcus
AGLEKSRENFQE

SEQ ID NO: 1915578 - protein, 4 aa, Staphylococcus
AGMS

SEQ ID NO: 1915579 - protein, 5 aa, Staphylococcus
AGMSS

SEQ ID NO: 1915580 - protein, 7 aa, Staphylococcus
AGNQITN

SEQ ID NO: 1915581 - protein, 7 aa, Staphylococcus
AGPGGYV

SEQ ID NO: 1915582 - protein, 6 aa, Staphylococcus
AGPKGY

SEQ ID NO: 1915583 - protein, 4 aa, Staphylococcus
AGPV

SEQ ID NO: 1915584 - protein, 6 aa, Staphylococcus
AGQAAV

SEQ ID NO: 1915585 - protein, 10 aa, Staphylococcus
AGQGQNPARI

SEQ ID NO: 1915586 - protein, 7 aa, Staphylococcus
AGQNAEE

SEQ ID NO: 1915587 - protein, 4 aa, Staphylococcus
AGQR

SEQ ID NO: 1915588 - protein, 11 aa, Staphylococcus
AGRAGRHEKEG

SEQ ID NO: 1915589 - protein, 8 aa, Staphylococcus
AGSGIGKS

SEQ ID NO: 1915590 - protein, 7 aa, Staphylococcus
AGSGKTR

SEQ ID NO: 1915591 - protein, 9 aa, Staphylococcus
AGSSDSVIP

SEQ ID NO: 1915592 - protein, 10 aa, Staphylococcus
AGSSDSVIPD

SEQ ID NO: 1915593 - protein, 22 aa, Staphylococcus
AGSVGIANNQTGLYPSDSPGGW

SEQ ID NO: 1915594 - protein, 6 aa, Staphylococcus
AGTGMR

SEQ ID NO: 1915595 - protein, 7 aa, Staphylococcus
AGTGMRR

SEQ ID NO: 1915596 - protein, 8 aa, Staphylococcus
AGTKDGIT

SEQ ID NO: 1915597 - protein, 9 aa, Staphylococcus
AGTKSDKDV

SEQ ID NO: 1915598 - protein, 10 aa, Staphylococcus
AGTKSDSDVR

SEQ ID NO: 1915599 - protein, 4 aa, Staphylococcus
AGTL

SEQ ID NO: 1915600 - protein, 11 aa, Staphylococcus
AGTLSGNPLAM

SEQ ID NO: 1915601 - protein, 29 aa, Staphylococcus
AGTPAKVIKQTSEVEDSKREIVSALRKLN

SEQ ID NO: 1915602 - protein, 17 aa, Staphylococcus
AGTTRDAVDTEYSYDGQ

SEQ ID NO: 1915603 - protein, 18 aa, Staphylococcus
AGVDGRIQSRSYENQEGR

SEQ ID NO: 1915604 - protein, 27 aa, Staphylococcus
AGVEKGSGEPNKTKVATVTKDQVREIA

SEQ ID NO: 1915605 - protein, 6 aa, Staphylococcus
AGVGKT

SEQ ID NO: 1915606 - protein, 4 aa, Staphylococcus
AGYA

SEQ ID NO: 1915607 - protein, 13 aa, Staphylococcus
AGYHKTPDVNGFR

SEQ ID NO: 1915608 - protein, 7 aa, Staphylococcus
AGYTDKN

SEQ ID NO: 1915609 - protein, 13 aa, Staphylococcus
AHGIPGKRKIREG

SEQ ID NO: 1915610 - protein, 13 aa, Staphylococcus
AHGKPSGIDTQTI

SEQ ID NO: 1915611 - protein, 9 aa, Staphylococcus
AHGSSNAKA

SEQ ID NO: 1915612 - protein, 7 aa, Staphylococcus
AHHGDGT

SEQ ID NO: 1915613 - protein, 8 aa, Staphylococcus
AHHGDGTQ

SEQ ID NO: 1915614 - protein, 9 aa, Staphylococcus
AHNDNQANP

SEQ ID NO: 1915615 - protein, 7 aa, Staphylococcus
AHNNESV

SEQ ID NO: 1915616 - protein, 6 aa, Staphylococcus
AHPNGK

SEQ ID NO: 1915617 - protein, 18 aa, Staphylococcus
AHQSVKRGTIQVKRDGTP

SEQ ID NO: 1915618 - protein, 11 aa, Staphylococcus
AHRADEDATTT

SEQ ID NO: 1915619 - protein, 6 aa, Staphylococcus
AIAKTS

SEQ ID NO: 1915620 - protein, 21 aa, Staphylococcus
AIEPAATMAEGAQKIVKLVKE

SEQ ID NO: 1915621 - protein, 5 aa, Staphylococcus
AIEPK

SEQ ID NO: 1915622 - protein, 15 aa, Staphylococcus
AIKDTIKKASIASGV

SEQ ID NO: 1915623 - protein, 5 aa, Staphylococcus
AIKSY

SEQ ID NO: 1915624 - protein, 4 aa, Staphylococcus
AISE

SEQ ID NO: 1915625 - protein, 6 aa, Staphylococcus
AISKTG

SEQ ID NO: 1915626 - protein, 7 aa, Staphylococcus
AISQTSQ

SEQ ID NO: 1915627 - protein, 17 aa, Staphylococcus
AISTPRSKQTAATSLAQ

SEQ ID NO: 1915628 - protein, 6 aa, Staphylococcus
AITPGQ

SEQ ID NO: 1915629 - protein, 9 aa, Staphylococcus
AKAGRTISE

SEQ ID NO: 1915630 - protein, 9 aa, Staphylococcus
AKAISGSTQ

SEQ ID NO: 1915631 - protein, 9 aa, Staphylococcus
AKAKDGASC

SEQ ID NO: 1915632 - protein, 8 aa, Staphylococcus
AKAQDGAS

SEQ ID NO: 1915633 - protein, 10 aa, Staphylococcus
AKASNYRSAG

SEQ ID NO: 1915634 - protein, 7 aa, Staphylococcus
AKDEHGR

SEQ ID NO: 1915635 - protein, 11 aa, Staphylococcus
AKDLDKQGKGV

SEQ ID NO: 1915636 - protein, 7 aa, Staphylococcus
AKEANVP

SEQ ID NO: 1915637 - protein, 7 aa, Staphylococcus
AKEAYDA

SEQ ID NO: 1915638 - protein, 11 aa, Staphylococcus
AKEFSNDAEIT

SEQ ID NO: 1915639 - protein, 6 aa, Staphylococcus
AKEIGT

SEQ ID NO: 1915640 - protein, 10 aa, Staphylococcus
AKEKTKNNTG

SEQ ID NO: 1915641 - protein, 13 aa, Staphylococcus
AKENGSAAAPTAG

SEQ ID NO: 1915642 - protein, 11 aa, Staphylococcus
AKENKNDKQLR

SEQ ID NO: 1915643 - protein, 8 aa, Staphylococcus
AKETSIAN

SEQ ID NO: 1915644 - protein, 8 aa, Staphylococcus
AKETSVAN

SEQ ID NO: 1915645 - protein, 25 aa, Staphylococcus
AKEVSDQGRVQVNGNTAKAGTDVKV

SEQ ID NO: 1915646 - protein, 7 aa, Staphylococcus
AKGADSI

SEQ ID NO: 1915647 - protein, 10 aa, Staphylococcus
AKGAGEKKVN

SEQ ID NO: 1915648 - protein, 8 aa, Staphylococcus
AKGATHDN

SEQ ID NO: 1915649 - protein, 8 aa, Staphylococcus
AKGDEKSL

SEQ ID NO: 1915650 - protein, 33 aa, Staphylococcus
AKGGRGGRGNSRFATPRNPAPDFSENGEPGEEI

SEQ ID NO: 1915651 - protein, 5 aa, Staphylococcus
AKGML

SEQ ID NO: 1915652 - protein, 14 aa, Staphylococcus
AKGNPQWKTIQDNS

SEQ ID NO: 1915653 - protein, 14 aa, Staphylococcus
AKHNEGKGAKYTKI

SEQ ID NO: 1915654 - protein, 6 aa, Staphylococcus
AKIEGE

SEQ ID NO: 1915655 - protein, 4 aa, Staphylococcus
AKIG

SEQ ID NO: 1915656 - protein, 5 aa, Staphylococcus
AKISG

SEQ ID NO: 1915657 - protein, 7 aa, Staphylococcus
AKISGNA

SEQ ID NO: 1915658 - protein, 18 aa, Staphylococcus
AKKGENGQSSNMHGKNAE

SEQ ID NO: 1915659 - protein, 10 aa, Staphylococcus
AKKSKTGLQA

SEQ ID NO: 1915660 - protein, 10 aa, Staphylococcus
AKLEEQKKGY

SEQ ID NO: 1915661 - protein, 9 aa, Staphylococcus
AKLGNSQGK

SEQ ID NO: 1915662 - protein, 14 aa, Staphylococcus
AKNPSILASEHGKD

SEQ ID NO: 1915663 - protein, 5 aa, Staphylococcus
AKPNL

SEQ ID NO: 1915664 - protein, 5 aa, Staphylococcus
AKPTG

SEQ ID NO: 1915665 - protein, 12 aa, Staphylococcus
AKQAIASMSQTQ

SEQ ID NO: 1915666 - protein, 9 aa, Staphylococcus
AKQLGKGKT

SEQ ID NO: 1915667 - protein, 5 aa, Staphylococcus
AKQNG

SEQ ID NO: 1915668 - protein, 8 aa, Staphylococcus
AKQSEMNQ

SEQ ID NO: 1915669 - protein, 10 aa, Staphylococcus
AKRSRGTPRV

SEQ ID NO: 1915670 - protein, 9 aa, Staphylococcus
AKRTAAKQT

SEQ ID NO: 1915671 - protein, 13 aa, Staphylococcus
AKSGEPDPESNQA

SEQ ID NO: 1915672 - protein, 8 aa, Staphylococcus
AKTCPHDA

SEQ ID NO: 1915673 - protein, 10 aa, Staphylococcus
AKTRDEENEV

SEQ ID NO: 1915674 - protein, 7 aa, Staphylococcus
AKTYSLG

SEQ ID NO: 1915675 - protein, 11 aa, Staphylococcus
AKVTNSVTKNT

SEQ ID NO: 1915676 - protein, 6 aa, Staphylococcus
ALATGG

SEQ ID NO: 1915677 - protein, 7 aa, Staphylococcus
ALDDPQK

SEQ ID NO: 1915678 - protein, 13 aa, Staphylococcus
ALDTGNDPREFTK

SEQ ID NO: 1915679 - protein, 16 aa, Staphylococcus
ALESLEGRNTRPTMDK

SEQ ID NO: 1915680 - protein, 12 aa, Staphylococcus
ALGAKKDSYPID

SEQ ID NO: 1915681 - protein, 4 aa, Staphylococcus
ALGP

SEQ ID NO: 1915682 - protein, 5 aa, Staphylococcus
ALGPY

SEQ ID NO: 1915683 - protein, 11 aa, Staphylococcus
ALMSGSGPTVY

SEQ ID NO: 1915684 - protein, 10 aa, Staphylococcus
ALNEGKPENI

SEQ ID NO: 1915685 - protein, 4 aa, Staphylococcus
ALPD

SEQ ID NO: 1915686 - protein, 4 aa, Staphylococcus
ALPE

SEQ ID NO: 1915687 - protein, 10 aa, Staphylococcus
ALPQGATATD

SEQ ID NO: 1915688 - protein, 5 aa, Staphylococcus
ALSRG

SEQ ID NO: 1915689 - protein, 12 aa, Staphylococcus
ALTDDTRDTIEK

SEQ ID NO: 1915690 - protein, 21 aa, Staphylococcus
AMERGSNDRYFQEDKTPKKFV

SEQ ID NO: 1915691 - protein, 7 aa, Staphylococcus
AMKPDDV

SEQ ID NO: 1915692 - protein, 4 aa, Staphylococcus
AMPG

SEQ ID NO: 1915693 - protein, 23 aa, Staphylococcus
AMPKEDAEKLKEQLEEVGATVEL

SEQ ID NO: 1915694 - protein, 8 aa, Staphylococcus
ANADAKAE

SEQ ID NO: 1915695 - protein, 15 aa, Staphylococcus
ANAGKKAGEFYTPQQ

SEQ ID NO: 1915696 - protein, 9 aa, Staphylococcus
ANAKDPQKR

SEQ ID NO: 1915697 - protein, 18 aa, Staphylococcus
ANAKSPEQVESFLSETFN

SEQ ID NO: 1915698 - protein, 6 aa, Staphylococcus
ANANSE

SEQ ID NO: 1915699 - protein, 5 aa, Staphylococcus
ANDEV

SEQ ID NO: 1915700 - protein, 4 aa, Staphylococcus
ANDV

SEQ ID NO: 1915701 - protein, 6 aa, Staphylococcus
ANEDGY

SEQ ID NO: 1915702 - protein, 4 aa, Staphylococcus
ANEK

SEQ ID NO: 1915703 - protein, 9 aa, Staphylococcus
ANEPQSTKA

SEQ ID NO: 1915704 - protein, 4 aa, Staphylococcus
ANET

SEQ ID NO: 1915705 - protein, 8 aa, Staphylococcus
ANGAGKTS

SEQ ID NO: 1915706 - protein, 10 aa, Staphylococcus
ANGGRKKTIE

SEQ ID NO: 1915707 - protein, 11 aa, Staphylococcus
ANGGRKKTIER

SEQ ID NO: 1915708 - protein, 10 aa, Staphylococcus
ANGPTTPEAT

SEQ ID NO: 1915709 - protein, 11 aa, Staphylococcus
ANGPTTPEATR

SEQ ID NO: 1915710 - protein, 7 aa, Staphylococcus
ANHGEYG

SEQ ID NO: 1915711 - protein, 4 aa, Staphylococcus
ANHS

SEQ ID NO: 1915712 - protein, 10 aa, Staphylococcus
ANKAEMAGIP

SEQ ID NO: 1915713 - protein, 20 aa, Staphylococcus
ANKEKVESLSVEEKQEQHQL

SEQ ID NO: 1915714 - protein, 10 aa, Staphylococcus
ANKPASGTAI

SEQ ID NO: 1915715 - protein, 7 aa, Staphylococcus
ANKPNFD

SEQ ID NO: 1915716 - protein, 7 aa, Staphylococcus
ANKRGIP

SEQ ID NO: 1915717 - protein, 7 aa, Staphylococcus
ANKSNQV

SEQ ID NO: 1915718 - protein, 4 aa, Staphylococcus
ANKV

SEQ ID NO: 1915719 - protein, 9 aa, Staphylococcus
ANLNKTVSA

SEQ ID NO: 1915720 - protein, 10 aa, Staphylococcus
ANLNKTVSAA

SEQ ID NO: 1915721 - protein, 9 aa, Staphylococcus
ANNGEELPM

SEQ ID NO: 1915722 - protein, 8 aa, Staphylococcus
ANNVQSSV

SEQ ID NO: 1915723 - protein, 7 aa, Staphylococcus
ANNVQST

SEQ ID NO: 1915724 - protein, 7 aa, Staphylococcus
ANPPYSA

SEQ ID NO: 1915725 - protein, 8 aa, Staphylococcus
ANRDTAPA

SEQ ID NO: 1915726 - protein, 10 aa, Staphylococcus
ANRGANGIDG

SEQ ID NO: 1915727 - protein, 7 aa, Staphylococcus
ANRGYAK

SEQ ID NO: 1915728 - protein, 4 aa, Staphylococcus
ANRQ

SEQ ID NO: 1915729 - protein, 7 aa, Staphylococcus
ANSEQYG

SEQ ID NO: 1915730 - protein, 6 aa, Staphylococcus
ANSGKY

SEQ ID NO: 1915731 - protein, 6 aa, Staphylococcus
ANTIHK

SEQ ID NO: 1915732 - protein, 7 aa, Staphylococcus
ANTLEEA

SEQ ID NO: 1915733 - protein, 8 aa, Staphylococcus
ANTPVAET

SEQ ID NO: 1915734 - protein, 6 aa, Staphylococcus
ANVESE

SEQ ID NO: 1915735 - protein, 7 aa, Staphylococcus
ANVSKAT

SEQ ID NO: 1915736 - protein, 8 aa, Staphylococcus
APADPGAV

SEQ ID NO: 1915737 - protein, 10 aa, Staphylococcus
APAEKQTKLR

SEQ ID NO: 1915738 - protein, 7 aa, Staphylococcus
APATGDL

SEQ ID NO: 1915739 - protein, 7 aa, Staphylococcus
APDAEEM

SEQ ID NO: 1915740 - protein, 11 aa, Staphylococcus
APDGNTISATE

SEQ ID NO: 1915741 - protein, 5 aa, Staphylococcus
APEKV

SEQ ID NO: 1915742 - protein, 4 aa, Staphylococcus
APEL

SEQ ID NO: 1915743 - protein, 4 aa, Staphylococcus
APEN

SEQ ID NO: 1915744 - protein, 7 aa, Staphylococcus
APGFGDR

SEQ ID NO: 1915745 - protein, 8 aa, Staphylococcus
APGHGEDD

SEQ ID NO: 1915746 - protein, 14 aa, Staphylococcus
APGIGKEAGASLNS

SEQ ID NO: 1915747 - protein, 6 aa, Staphylococcus
APGQEL

SEQ ID NO: 1915748 - protein, 9 aa, Staphylococcus
APGSITPHT

SEQ ID NO: 1915749 - protein, 10 aa, Staphylococcus
APIDNSDEPL

SEQ ID NO: 1915750 - protein, 6 aa, Staphylococcus
APITER

SEQ ID NO: 1915751 - protein, 5 aa, Staphylococcus
APKTV

SEQ ID NO: 1915752 - protein, 5 aa, Staphylococcus
APLKD

SEQ ID NO: 1915753 - protein, 14 aa, Staphylococcus
APLQSEDKNAPGYV

SEQ ID NO: 1915754 - protein, 5 aa, Staphylococcus
APNMP

SEQ ID NO: 1915755 - protein, 12 aa, Staphylococcus
APNRDPRDEFET

SEQ ID NO: 1915756 - protein, 4 aa, Staphylococcus
APQI

SEQ ID NO: 1915757 - protein, 5 aa, Staphylococcus
APQIN

SEQ ID NO: 1915758 - protein, 5 aa, Staphylococcus
APSMP

SEQ ID NO: 1915759 - protein, 13 aa, Staphylococcus
APSYERGKNPFPK

SEQ ID NO: 1915760 - protein, 16 aa, Staphylococcus
APTAGQEASQLASQYA

SEQ ID NO: 1915761 - protein, 5 aa, Staphylococcus
APTGH

SEQ ID NO: 1915762 - protein, 6 aa, Staphylococcus
APTQSI

SEQ ID NO: 1915763 - protein, 5 aa, Staphylococcus
APVRQ

SEQ ID NO: 1915764 - protein, 5 aa, Staphylococcus
APVTL

SEQ ID NO: 1915765 - protein, 9 aa, Staphylococcus
APVYSTSSL

SEQ ID NO: 1915766 - protein, 5 aa, Staphylococcus
AQELE

SEQ ID NO: 1915767 - protein, 4 aa, Staphylococcus
AQGG

SEQ ID NO: 1915768 - protein, 5 aa, Staphylococcus
AQGVF

SEQ ID NO: 1915769 - protein, 5 aa, Staphylococcus
AQIGD

SEQ ID NO: 1915770 - protein, 7 aa, Staphylococcus
AQIGDEI

SEQ ID NO: 1915771 - protein, 9 aa, Staphylococcus
AQKARDLPL

SEQ ID NO: 1915772 - protein, 7 aa, Staphylococcus
AQKDDDN

SEQ ID NO: 1915773 - protein, 17 aa, Staphylococcus
AQKMAQEQNKKKEEKIK

SEQ ID NO: 1915774 - protein, 8 aa, Staphylococcus
AQLAAPDK

SEQ ID NO: 1915775 - protein, 8 aa, Staphylococcus
AQLASPDK

SEQ ID NO: 1915776 - protein, 5 aa, Staphylococcus
AQMQG

SEQ ID NO: 1915777 - protein, 4 aa, Staphylococcus
AQNE

SEQ ID NO: 1915778 - protein, 20 aa, Staphylococcus
AQNTYFEDNGAYTGETSPVA

SEQ ID NO: 1915779 - protein, 4 aa, Staphylococcus
AQPD

SEQ ID NO: 1915780 - protein, 22 aa, Staphylococcus
AQQDVDQEKAKDLEKKMRDSSF

SEQ ID NO: 1915781 - protein, 6 aa, Staphylococcus
AQQELQ

SEQ ID NO: 1915782 - protein, 4 aa, Staphylococcus
AQQG

SEQ ID NO: 1915783 - protein, 6 aa, Staphylococcus
AQQLTN

SEQ ID NO: 1915784 - protein, 13 aa, Staphylococcus
AQRALDNQKTDDR

SEQ ID NO: 1915785 - protein, 10 aa, Staphylococcus
AQRQAGVGAT

SEQ ID NO: 1915786 - protein, 8 aa, Staphylococcus
AQRSAGFD

SEQ ID NO: 1915787 - protein, 6 aa, Staphylococcus
AQRTAG

SEQ ID NO: 1915788 - protein, 4 aa, Staphylococcus
AQRY

SEQ ID NO: 1915789 - protein, 7 aa, Staphylococcus
AQSFGTP

SEQ ID NO: 1915790 - protein, 5 aa, Staphylococcus
AQSPG

SEQ ID NO: 1915791 - protein, 7 aa, Staphylococcus
AQTEEQV

SEQ ID NO: 1915792 - protein, 12 aa, Staphylococcus
AQTERSKRNFPV

SEQ ID NO: 1915793 - protein, 9 aa, Staphylococcus
AQTNANNLG

SEQ ID NO: 1915794 - protein, 4 aa, Staphylococcus
AQVE

SEQ ID NO: 1915795 - protein, 4 aa, Staphylococcus
ARAG

SEQ ID NO: 1915796 - protein, 12 aa, Staphylococcus
ARDNKQTLHRET

SEQ ID NO: 1915797 - protein, 4 aa, Staphylococcus
ARDT

SEQ ID NO: 1915798 - protein, 20 aa, Staphylococcus
AREAGDRSKISVYSDNPDID

SEQ ID NO: 1915799 - protein, 33 aa, Staphylococcus; identical to SEQ ID NO: 1755696

SEQ ID NO: 1915800 - protein, 4 aa, Staphylococcus
ARGS

SEQ ID NO: 1915801 - protein, 5 aa, Staphylococcus
ARIPE

SEQ ID NO: 1915802 - protein, 7 aa, Staphylococcus
ARKNSDV

SEQ ID NO: 1915803 - protein, 6 aa, Staphylococcus
ARKPII

SEQ ID NO: 1915804 - protein, 4 aa, Staphylococcus
ARPA

SEQ ID NO: 1915805 - protein, 5 aa, Staphylococcus
ARQGY

SEQ ID NO: 1915806 - protein, 5 aa, Staphylococcus
ARQHD

SEQ ID NO: 1915807 - protein, 5 aa, Staphylococcus
ARYGG

SEQ ID NO: 1915808 - protein, 6 aa, Staphylococcus
ASADYA

SEQ ID NO: 1915809 - protein, 4 aa, Staphylococcus
ASAV

SEQ ID NO: 1915810 - protein, 6 aa, Staphylococcus
ASDGVL

SEQ ID NO: 1915811 - protein, 4 aa, Staphylococcus
ASDT

SEQ ID NO: 1915812 - protein, 7 aa, Staphylococcus
ASEGQSK

SEQ ID NO: 1915813 - protein, 4 aa, Staphylococcus
ASEK

SEQ ID NO: 1915814 - protein, 8 aa, Staphylococcus
ASEKHTEK

SEQ ID NO: 1915815 - protein, 8 aa, Staphylococcus
ASEKMAGQ

SEQ ID NO: 1915816 - protein, 11 aa, Staphylococcus
ASETASKTAME

SEQ ID NO: 1915817 - protein, 7 aa, Staphylococcus
ASFNPAG

SEQ ID NO: 1915818 - protein, 7 aa, Staphylococcus
ASGKPTV

SEQ ID NO: 1915819 - protein, 6 aa, Staphylococcus
ASGRFG

SEQ ID NO: 1915820 - protein, 4 aa, Staphylococcus
ASIN

SEQ ID NO: 1915821 - protein, 7 aa, Staphylococcus
ASKEPVR

SEQ ID NO: 1915822 - protein, 21 aa, Staphylococcus
ASKGQANPQKVNQLLKQELDK

SEQ ID NO: 1915823 - protein, 4 aa, Staphylococcus
ASKK

SEQ ID NO: 1915824 - protein, 8 aa, Staphylococcus
ASKYGSNV

SEQ ID NO: 1915825 - protein, 6 aa, Staphylococcus
ASNQSG

SEQ ID NO: 1915826 - protein, 7 aa, Staphylococcus
ASNVNDI

SEQ ID NO: 1915827 - protein, 7 aa, Staphylococcus
ASNVNDL

SEQ ID NO: 1915828 - protein, 7 aa, Staphylococcus
ASNVTDL

SEQ ID NO: 1915829 - protein, 4 aa, Staphylococcus
ASPD

SEQ ID NO: 1915830 - protein, 5 aa, Staphylococcus
ASPDE

SEQ ID NO: 1915831 - protein, 5 aa, Staphylococcus
ASPEM

SEQ ID NO: 1915832 - protein, 11 aa, Staphylococcus
ASPEVGGETQS

SEQ ID NO: 1915833 - protein, 5 aa, Staphylococcus
ASPNY

SEQ ID NO: 1915834 - protein, 8 aa, Staphylococcus
ASPQASGG

SEQ ID NO: 1915835 - protein, 18 aa, Staphylococcus
ASPSLEKDGTFTNTERRI

SEQ ID NO: 1915836 - protein, 6 aa, Staphylococcus
ASQGNK

SEQ ID NO: 1915837 - protein, 6 aa, Staphylococcus
ASQGNR

SEQ ID NO: 1915838 - protein, 6 aa, Staphylococcus
ASQIEK

SEQ ID NO: 1915839 - protein, 6 aa, Staphylococcus
ASQLGK

SEQ ID NO: 1915840 - protein, 4 aa, Staphylococcus
ASQY

SEQ ID NO: 1915841 - protein, 22 aa, Staphylococcus
ASRALSTNDDKETACRPFQEGR

SEQ ID NO: 1915842 - protein, 5 aa, Staphylococcus
ASSAP

SEQ ID NO: 1915843 - protein, 4 aa, Staphylococcus
ASSF

SEQ ID NO: 1915844 - protein, 5 aa, Staphylococcus
ASSFV

SEQ ID NO: 1915845 - protein, 6 aa, Staphylococcus
ASSKGL

SEQ ID NO: 1915846 - protein, 24 aa, Staphylococcus
ASSLTGDESTIPNHKDITDQLDYE

SEQ ID NO: 1915847 - protein, 10 aa, Staphylococcus
ASTDEDAQRF

SEQ ID NO: 1915848 - protein, 4 aa, Staphylococcus
ASTF

SEQ ID NO: 1915849 - protein, 20 aa, Staphylococcus
ASTGNNRSHALNANKRRWNA

SEQ ID NO: 1915850 - protein, 7 aa, Staphylococcus
ASTLSDQ

SEQ ID NO: 1915851 - protein, 5 aa, Staphylococcus
ASTRV

SEQ ID NO: 1915852 - protein, 6 aa, Staphylococcus
ASTRVV

SEQ ID NO: 1915853 - protein, 4 aa, Staphylococcus
ATAF

SEQ ID NO: 1915854 - protein, 11 aa, Staphylococcus
ATDAHPTGSSL

SEQ ID NO: 1915855 - protein, 4 aa, Staphylococcus
ATDH

SEQ ID NO: 1915856 - protein, 17 aa, Staphylococcus
ATESGSTARTISKYRPH

SEQ ID NO: 1915857 - protein, 5 aa, Staphylococcus
ATESH

SEQ ID NO: 1915858 - protein, 8 aa, Staphylococcus
ATETSNNG

SEQ ID NO: 1915859 - protein, 6 aa, Staphylococcus
ATGATG

SEQ ID NO: 1915860 - protein, 7 aa, Staphylococcus
ATGGTIE

SEQ ID NO: 1915861 - protein, 6 aa, Staphylococcus
ATGSIT

SEQ ID NO: 1915862 - protein, 6 aa, Staphylococcus
ATHGKK

SEQ ID NO: 1915863 - protein, 7 aa, Staphylococcus
ATHSDPS

SEQ ID NO: 1915864 - protein, 7 aa, Staphylococcus
ATINDKT

SEQ ID NO: 1915865 - protein, 7 aa, Staphylococcus
ATINDNT

SEQ ID NO: 1915866 - protein, 14 aa, Staphylococcus
ATITDAENVKKSDK

SEQ ID NO: 1915867 - protein, 17 aa, Staphylococcus
ATKEARDRAINGEGPTL

SEQ ID NO: 1915868 - protein, 5 aa, Staphylococcus
ATKGA

SEQ ID NO: 1915869 - protein, 6 aa, Staphylococcus
ATLQKK

SEQ ID NO: 1915870 - protein, 12 aa, Staphylococcus
ATPEETRGSDLG

SEQ ID NO: 1915871 - protein, 8 aa, Staphylococcus
ATPENIPE

SEQ ID NO: 1915872 - protein, 9 aa, Staphylococcus
ATPENIPES

SEQ ID NO: 1915873 - protein, 8 aa, Staphylococcus
ATPERTDD

SEQ ID NO: 1915874 - protein, 8 aa, Staphylococcus
ATPGPYEL

SEQ ID NO: 1915875 - protein, 6 aa, Staphylococcus
ATPQML

SEQ ID NO: 1915876 - protein, 10 aa, Staphylococcus
ATPTAGSAGV

SEQ ID NO: 1915877 - protein, 6 aa, Staphylococcus
ATQNKD

SEQ ID NO: 1915878 - protein, 4 aa, Staphylococcus
ATQQ

SEQ ID NO: 1915879 - protein, 7 aa, Staphylococcus
ATQYPDK

SEQ ID NO: 1915880 - protein, 7 aa, Staphylococcus
ATSAVRT

SEQ ID NO: 1915881 - protein, 5 aa, Staphylococcus
ATSED

SEQ ID NO: 1915882 - protein, 5 aa, Staphylococcus
ATSEN

SEQ ID NO: 1915883 - protein, 6 aa, Staphylococcus
ATSNPK

SEQ ID NO: 1915884 - protein, 5 aa, Staphylococcus
ATTEY

SEQ ID NO: 1915885 - protein, 13 aa, Staphylococcus
ATTGQNALSQARS

SEQ ID NO: 1915886 - protein, 5 aa, Staphylococcus
ATTNL

SEQ ID NO: 1915887 - protein, 9 aa, Staphylococcus
ATTQDEYRN

SEQ ID NO: 1915888 - protein, 12 aa, Staphylococcus
ATVKTMSPEELR

SEQ ID NO: 1915889 - protein, 14 aa, Staphylococcus
ATYGKDPETKGQYW

SEQ ID NO: 1915890 - protein, 11 aa, Staphylococcus
AVAGGIKPDTI

SEQ ID NO: 1915891 - protein, 7 aa, Staphylococcus
AVAGKFN

SEQ ID NO: 1915892 - protein, 10 aa, Staphylococcus
AVASGTATAF

SEQ ID NO: 1915893 - protein, 6 aa, Staphylococcus
AVDQDG

SEQ ID NO: 1915894 - protein, 6 aa, Staphylococcus
AVEAAK

SEQ ID NO: 1915895 - protein, 12 aa, Staphylococcus
AVEQAENDVKKA

SEQ ID NO: 1915896 - protein, 12 aa, Staphylococcus
AVEQAENEVKKA

SEQ ID NO: 1915897 - protein, 8 aa, Staphylococcus
AVGDESEV

SEQ ID NO: 1915898 - protein, 10 aa, Staphylococcus
AVGDETETKE

SEQ ID NO: 1915899 - protein, 10 aa, Staphylococcus
AVGENGEIKG

SEQ ID NO: 1915900 - protein, 6 aa, Staphylococcus
AVGGGD

SEQ ID NO: 1915901 - protein, 10 aa, Staphylococcus
AVGPNGEVTG

SEQ ID NO: 1915902 - protein, 19 aa, Staphylococcus
AVKSGEADGCVSAGNTGAL

SEQ ID NO: 1915903 - protein, 10 aa, Staphylococcus
AVNAKESAKI

SEQ ID NO: 1915904 - protein, 8 aa, Staphylococcus
AVNQGHRH

SEQ ID NO: 1915905 - protein, 4 aa, Staphylococcus
AVPD

SEQ ID NO: 1915906 - protein, 8 aa, Staphylococcus
AVRRGADD

SEQ ID NO: 1915907 - protein, 27 aa, Staphylococcus
AVSGSGIKGKRDLAEGANGKAPEAYPH

SEQ ID NO: 1915908 - protein, 5 aa, Staphylococcus
AWDNR

SEQ ID NO: 1915909 - protein, 4 aa, Staphylococcus
AWSS

SEQ ID NO: 1915910 - protein, 4 aa, Staphylococcus
AYAH

SEQ ID NO: 1915911 - protein, 9 aa, Staphylococcus
AYDADNQSI

SEQ ID NO: 1915912 - protein, 6 aa, Staphylococcus
AYEGGA

SEQ ID NO: 1915913 - protein, 8 aa, Staphylococcus
AYEPQFGA

SEQ ID NO: 1915914 - protein, 4 aa, Staphylococcus
AYGT

SEQ ID NO: 1915915 - protein, 16 aa, Staphylococcus
AYKNKEVDGFTTNPSL

SEQ ID NO: 1915916 - protein, 4 aa, Staphylococcus
AYMP

SEQ ID NO: 1915917 - protein, 13 aa, Staphylococcus
AYNNEKDDIGPRI

SEQ ID NO: 1915918 - protein, 9 aa, Staphylococcus
AYNNKPNSR

SEQ ID NO: 1915919 - protein, 5 aa, Staphylococcus
AYPNR

SEQ ID NO: 1915920 - protein, 6 aa, Staphylococcus
AYQGGA

SEQ ID NO: 1915921 - protein, 9 aa, Staphylococcus
AYVPSTDTF

SEQ ID NO: 1915922 - protein, 8 aa, Staphylococcus
CANRDTAP

SEQ ID NO: 1915923 - protein, 6 aa, Staphylococcus
CAPGTS

SEQ ID NO: 1915924 - protein, 4 aa, Staphylococcus
CDEG

SEQ ID NO: 1915925 - protein, 15 aa, Staphylococcus
CDSGGNGACKDGTYI

SEQ ID NO: 1915926 - protein, 6 aa, Staphylococcus
CGPGRR

SEQ ID NO: 1915927 - protein, 8 aa, Staphylococcus
CKMEEGSL

SEQ ID NO: 1915928 - protein, 26 aa, Staphylococcus
CRSPSTVSRELARNASSGSYNPTYAH

SEQ ID NO: 1915929 - protein, 4 aa, Staphylococcus
CSAG

SEQ ID NO: 1915930 - protein, 13 aa, Staphylococcus
CSRDNKHTLHRET

SEQ ID NO: 1915931 - protein, 4 aa, Staphylococcus
CTSD

SEQ ID NO: 1915932 - protein, 6 aa, Staphylococcus
CTSNKT

SEQ ID NO: 1915933 - protein, 22 aa, Staphylococcus
DAADSAPSFGDRKTYQMDPANR

SEQ ID NO: 1915934 - protein, 7 aa, Staphylococcus
DAAESGI

SEQ ID NO: 1915935 - protein, 5 aa, Staphylococcus
DADMN

SEQ ID NO: 1915936 - protein, 7 aa, Staphylococcus
DADTVTV

SEQ ID NO: 1915937 - protein, 25 aa, Staphylococcus
DAEDGNLINTSDEDKTTDEEEKAHS

SEQ ID NO: 1915938 - protein, 7 aa, Staphylococcus
DAEIEPL

SEQ ID NO: 1915939 - protein, 5 aa, Staphylococcus
DAELE

SEQ ID NO: 1915940 - protein, 5 aa, Staphylococcus
DAENS

SEQ ID NO: 1915941 - protein, 4 aa, Staphylococcus
DAFS

SEQ ID NO: 1915942 - protein, 4 aa, Staphylococcus
DAGQ

SEQ ID NO: 1915943 - protein, 7 aa, Staphylococcus
DAGYNIK

SEQ ID NO: 1915944 - protein, 10 aa, Staphylococcus
DAHSAAEKNG

SEQ ID NO: 1915945 - protein, 8 aa, Staphylococcus
DAKANGYV

SEQ ID NO: 1915946 - protein, 7 aa, Staphylococcus
DAKATEI

SEQ ID NO: 1915947 - protein, 8 aa, Staphylococcus
DAKPEDYD

SEQ ID NO: 1915948 - protein, 7 aa, Staphylococcus
DAKPENY

SEQ ID NO: 1915949 - protein, 7 aa, Staphylococcus
DAKSTEI

SEQ ID NO: 1915950 - protein, 4 aa, Staphylococcus
DALP

SEQ ID NO: 1915951 - protein, 8 aa, Staphylococcus
DALSDDLK

SEQ ID NO: 1915952 - protein, 8 aa, Staphylococcus
DALSDKER

SEQ ID NO: 1915953 - protein, 18 aa, Staphylococcus
DALSDKERAFVSGTDDYV

SEQ ID NO: 1915954 - protein, 4 aa, Staphylococcus
DAMT

SEQ ID NO: 1915955 - protein, 9 aa, Staphylococcus
DANDTNAGL

SEQ ID NO: 1915956 - protein, 5 aa, Staphylococcus
DANND

SEQ ID NO: 1915957 - protein, 8 aa, Staphylococcus
DAPDAEEM

SEQ ID NO: 1915958 - protein, 19 aa, Staphylococcus
DAPGEVSDKQLEELSLRIR

SEQ ID NO: 1915959 - protein, 15 aa, Staphylococcus
DAPIGRNKKDRQSMD

SEQ ID NO: 1915960 - protein, 8 aa, Staphylococcus
DAPKTKEF

SEQ ID NO: 1915961 - protein, 19 aa, Staphylococcus
DAPYLSPHPYRGKRNEPER

SEQ ID NO: 1915962 - protein, 8 aa, Staphylococcus
DAQKTSVN

SEQ ID NO: 1915963 - protein, 5 aa, Staphylococcus
DAQRY

SEQ ID NO: 1915964 - protein, 7 aa, Staphylococcus
DASNRGM

SEQ ID NO: 1915965 - protein, 7 aa, Staphylococcus
DASQRGM

SEQ ID NO: 1915966 - protein, 8 aa, Staphylococcus
DASSFAQG

SEQ ID NO: 1915967 - protein, 13 aa, Staphylococcus
DATGKKQGRGAYV

SEQ ID NO: 1915968 - protein, 6 aa, Staphylococcus
DATTSL

SEQ ID NO: 1915969 - protein, 5 aa, Staphylococcus
DAVSD

SEQ ID NO: 1915970 - protein, 9 aa, Staphylococcus
DAYDNNPEL

SEQ ID NO: 1915971 - protein, 7 aa, Staphylococcus
DAYPNNS

SEQ ID NO: 1915972 - protein, 8 aa, Staphylococcus
DDAGIEAK

SEQ ID NO: 1915973 - protein, 4 aa, Staphylococcus
DDAL

SEQ ID NO: 1915974 - protein, 13 aa, Staphylococcus
DDALEGKVGTVIK

SEQ ID NO: 1915975 - protein, 5 aa, Staphylococcus
DDAPG

SEQ ID NO: 1915976 - protein, 9 aa, Staphylococcus
DDDDEEDKN

SEQ ID NO: 1915977 - protein, 11 aa, Staphylococcus
DDDEDNDKPDL

SEQ ID NO: 1915978 - protein, 4 aa, Staphylococcus
DDDG

SEQ ID NO: 1915979 - protein, 6 aa, Staphylococcus
DDDMNR

SEQ ID NO: 1915980 - protein, 6 aa, Staphylococcus
DDDNQV

SEQ ID NO: 1915981 - protein, 9 aa, Staphylococcus
DDEDEEDKN

SEQ ID NO: 1915982 - protein, 10 aa, Staphylococcus
DDEDHDKPEL

SEQ ID NO: 1915983 - protein, 8 aa, Staphylococcus
DDEHGWNK

SEQ ID NO: 1915984 - protein, 5 aa, Staphylococcus
DDEID

SEQ ID NO: 1915985 - protein, 4 aa, Staphylococcus
DDEL

SEQ ID NO: 1915986 - protein, 6 aa, Staphylococcus
DDEMRR

SEQ ID NO: 1915987 - protein, 10 aa, Staphylococcus
DDEPVKGSDF

SEQ ID NO: 1915988 - protein, 9 aa, Staphylococcus
DDETLDESI

SEQ ID NO: 1915989 - protein, 5 aa, Staphylococcus
DDFNE

SEQ ID NO: 1915990 - protein, 7 aa, Staphylococcus
DDGPDAV

SEQ ID NO: 1915991 - protein, 10 aa, Staphylococcus
DDGPKTKEDA

SEQ ID NO: 1915992 - protein, 4 aa, Staphylococcus
DDGY

SEQ ID NO: 1915993 - protein, 9 aa, Staphylococcus
DDLEDEDLI

SEQ ID NO: 1915994 - protein, 7 aa, Staphylococcus
DDLNGRT

SEQ ID NO: 1915995 - protein, 8 aa, Staphylococcus
DDLNGRTI

SEQ ID NO: 1915996 - protein, 5 aa, Staphylococcus
DDNAS

SEQ ID NO: 1915997 - protein, 5 aa, Staphylococcus
DDNPR

SEQ ID NO: 1915998 - protein, 6 aa, Staphylococcus
DDNVAN

SEQ ID NO: 1915999 - protein, 7 aa, Staphylococcus
DDNVANS

SEQ ID NO: 1916000 - protein, 7 aa, Staphylococcus
DDNVTHV

SEQ ID NO: 1916001 - protein, 9 aa, Staphylococcus
DDPAGKEWP

SEQ ID NO: 1916002 - protein, 9 aa, Staphylococcus
DDPEITSHP

SEQ ID NO: 1916003 - protein, 4 aa, Staphylococcus
DDPI

SEQ ID NO: 1916004 - protein, 6 aa, Staphylococcus
DDRNFG

SEQ ID NO: 1916005 - protein, 14 aa, Staphylococcus
DDRRDKSRKMNDKL

SEQ ID NO: 1916006 - protein, 7 aa, Staphylococcus
DDRSKEM

SEQ ID NO: 1916007 - protein, 27 aa, Staphylococcus
DDRYSDERTEQTVKNRQRKKINMNYIG

SEQ ID NO: 1916008 - protein, 6 aa, Staphylococcus
DDSPEH

SEQ ID NO: 1916009 - protein, 7 aa, Staphylococcus
DDSQTNA

SEQ ID NO: 1916010 - protein, 16 aa, Staphylococcus
DDSYAYENENGQYGKS

SEQ ID NO: 1916011 - protein, 15 aa, Staphylococcus
DDTDENGVCTATEDY

SEQ ID NO: 1916012 - protein, 6 aa, Staphylococcus
DDTMRA

SEQ ID NO: 1916013 - protein, 4 aa, Staphylococcus
DDTV

SEQ ID NO: 1916014 - protein, 7 aa, Staphylococcus
DDTVEGL

SEQ ID NO: 1916015 - protein, 6 aa, Staphylococcus
DDVEAT

SEQ ID NO: 1916016 - protein, 7 aa, Staphylococcus
DDYTTAN

SEQ ID NO: 1916017 - protein, 8 aa, Staphylococcus
DEADPENE

SEQ ID NO: 1916018 - protein, 9 aa, Staphylococcus
DEANAKAEL

SEQ ID NO: 1916019 - protein, 19 aa, Staphylococcus
DEANIQNAPGVRKANSELH

SEQ ID NO: 1916020 - protein, 8 aa, Staphylococcus
DEANKEDI

SEQ ID NO: 1916021 - protein, 9 aa, Staphylococcus
DEASLDETY

SEQ ID NO: 1916022 - protein, 12 aa, Staphylococcus
DEATTAEERQNS

SEQ ID NO: 1916023 - protein, 5 aa, Staphylococcus
DEAYT

SEQ ID NO: 1916024 - protein, 4 aa, Staphylococcus
DEDE

SEQ ID NO: 1916025 - protein, 4 aa, Staphylococcus
DEDF

SEQ ID NO: 1916026 - protein, 5 aa, Staphylococcus
DEDGE

SEQ ID NO: 1916027 - protein, 5 aa, Staphylococcus
DEEEV

SEQ ID NO: 1916028 - protein, 4 aa, Staphylococcus
DEEF

SEQ ID NO: 1916029 - protein, 6 aa, Staphylococcus
DEEFDG

SEQ ID NO: 1916030 - protein, 7 aa, Staphylococcus
DEEIQVN

SEQ ID NO: 1916031 - protein, 4 aa, Staphylococcus
DEEK

SEQ ID NO: 1916032 - protein, 7 aa, Staphylococcus
DEELQND

SEQ ID NO: 1916033 - protein, 4 aa, Staphylococcus
DEEM

SEQ ID NO: 1916034 - protein, 8 aa, Staphylococcus
DEENGDTF

SEQ ID NO: 1916035 - protein, 7 aa, Staphylococcus
DEERHGR

SEQ ID NO: 1916036 - protein, 5 aa, Staphylococcus
DEETA

SEQ ID NO: 1916037 - protein, 10 aa, Staphylococcus
DEETKQEIAP

SEQ ID NO: 1916038 - protein, 6 aa, Staphylococcus
DEFNRI

SEQ ID NO: 1916039 - protein, 6 aa, Staphylococcus
DEFPEW

SEQ ID NO: 1916040 - protein, 4 aa, Staphylococcus
DEGY

SEQ ID NO: 1916041 - protein, 6 aa, Staphylococcus
DEIGTK

SEQ ID NO: 1916042 - protein, 4 aa, Staphylococcus
DEIV

SEQ ID NO: 1916043 - protein, 7 aa, Staphylococcus
DEIWEGK

SEQ ID NO: 1916044 - protein, 4 aa, Staphylococcus
DEKE

SEQ ID NO: 1916045 - protein, 8 aa, Staphylococcus
DEKESNVR

SEQ ID NO: 1916046 - protein, 12 aa, Staphylococcus
DEKQTDYIMMMH

SEQ ID NO: 1916047 - protein, 15 aa, Staphylococcus
DELEPGKIRNSNGPM

SEQ ID NO: 1916048 - protein, 8 aa, Staphylococcus
DELPTPED

SEQ ID NO: 1916049 - protein, 15 aa, Staphylococcus
DELQPGKIRNSNGPM

SEQ ID NO: 1916050 - protein, 14 aa, Staphylococcus
DELTTAQSKTLNGN

SEQ ID NO: 1916051 - protein, 4 aa, Staphylococcus
DENA

SEQ ID NO: 1916052 - protein, 6 aa, Staphylococcus
DENDQA

SEQ ID NO: 1916053 - protein, 6 aa, Staphylococcus
DENDYA

SEQ ID NO: 1916054 - protein, 4 aa, Staphylococcus
DENG

SEQ ID NO: 1916055 - protein, 6 aa, Staphylococcus
DENGEM

SEQ ID NO: 1916056 - protein, 7 aa, Staphylococcus
DENGYKA

SEQ ID NO: 1916057 - protein, 6 aa, Staphylococcus
DENIQS

SEQ ID NO: 1916058 - protein, 4 aa, Staphylococcus
DENV

SEQ ID NO: 1916059 - protein, 5 aa, Staphylococcus
DENVM

SEQ ID NO: 1916060 - protein, 4 aa, Staphylococcus
DEPF

SEQ ID NO: 1916061 - protein, 6 aa, Staphylococcus
DEPKGF

SEQ ID NO: 1916062 - protein, 12 aa, Staphylococcus
DEPTASLDAKRA

SEQ ID NO: 1916063 - protein, 14 aa, Staphylococcus
DEPTGALDSKTSKQ

SEQ ID NO: 1916064 - protein, 8 aa, Staphylococcus
DEPYETLG

SEQ ID NO: 1916065 - protein, 4 aa, Staphylococcus
DEQA

SEQ ID NO: 1916066 - protein, 4 aa, Staphylococcus
DEQG

SEQ ID NO: 1916067 - protein, 11 aa, Staphylococcus
DEQTKGRGRFN

SEQ ID NO: 1916068 - protein, 4 aa, Staphylococcus
DERV

SEQ ID NO: 1916069 - protein, 6 aa, Staphylococcus
DESRTI

SEQ ID NO: 1916070 - protein, 4 aa, Staphylococcus
DESS

SEQ ID NO: 1916071 - protein, 6 aa, Staphylococcus
DESVYE

SEQ ID NO: 1916072 - protein, 11 aa, Staphylococcus
DETEDPDAIER

SEQ ID NO: 1916073 - protein, 4 aa, Staphylococcus
DETG

SEQ ID NO: 1916074 - protein, 7 aa, Staphylococcus
DETGKSV

SEQ ID NO: 1916075 - protein, 4 aa, Staphylococcus
DETI

SEQ ID NO: 1916076 - protein, 8 aa, Staphylococcus
DETLDRAN

SEQ ID NO: 1916077 - protein, 8 aa, Staphylococcus
DETLTAEE

SEQ ID NO: 1916078 - protein, 5 aa, Staphylococcus
DETNP

SEQ ID NO: 1916079 - protein, 4 aa, Staphylococcus
DETT

SEQ ID NO: 1916080 - protein, 12 aa, Staphylococcus
DETTMQNNHANL

SEQ ID NO: 1916081 - protein, 4 aa, Staphylococcus
DETY

SEQ ID NO: 1916082 - protein, 7 aa, Staphylococcus
DEVDQAK

SEQ ID NO: 1916083 - protein, 4 aa, Staphylococcus
DEVQ

SEQ ID NO: 1916084 - protein, 16 aa, Staphylococcus
DEWATPNKIVEALEEL

SEQ ID NO: 1916085 - protein, 5 aa, Staphylococcus
DEYEE

SEQ ID NO: 1916086 - protein, 7 aa, Staphylococcus
DFKNPNQ

SEQ ID NO: 1916087 - protein, 5 aa, Staphylococcus
DFKPP

SEQ ID NO: 1916088 - protein, 11 aa, Staphylococcus
DFSEDAEDYGV

SEQ ID NO: 1916089 - protein, 4 aa, Staphylococcus
DFTP

SEQ ID NO: 1916090 - protein, 8 aa, Staphylococcus
DGAQSAPH

SEQ ID NO: 1916091 - protein, 5 aa, Staphylococcus
DGATA

SEQ ID NO: 1916092 - protein, 10 aa, Staphylococcus
DGAVENGDTV

SEQ ID NO: 1916093 - protein, 10 aa, Staphylococcus
DGDGKEISRQ

SEQ ID NO: 1916094 - protein, 7 aa, Staphylococcus
DGDYPAE

SEQ ID NO: 1916095 - protein, 8 aa, Staphylococcus
DGDYPDEI

SEQ ID NO: 1916096 - protein, 4 aa, Staphylococcus
DGEG

SEQ ID NO: 1916097 - protein, 8 aa, Staphylococcus
DGEITNDN

SEQ ID NO: 1916098 - protein, 7 aa, Staphylococcus
DGEKWSN

SEQ ID NO: 1916099 - protein, 13 aa, Staphylococcus
DGEPSAYNYSQDG

SEQ ID NO: 1916100 - protein, 5 aa, Staphylococcus
DGESY

SEQ ID NO: 1916101 - protein, 4 aa, Staphylococcus
DGEV

SEQ ID NO: 1916102 - protein, 4 aa, Staphylococcus
DGFP

SEQ ID NO: 1916103 - protein, 6 aa, Staphylococcus
DGGALQ

SEQ ID NO: 1916104 - protein, 9 aa, Staphylococcus
DGGEGTTEA

SEQ ID NO: 1916105 - protein, 6 aa, Staphylococcus
DGGLGG

SEQ ID NO: 1916106 - protein, 13 aa, Staphylococcus
DGIKDPKDNELEK

SEQ ID NO: 1916107 - protein, 14 aa, Staphylococcus
DGIKNKTKVPEPVN

SEQ ID NO: 1916108 - protein, 5 aa, Staphylococcus
DGIPT

SEQ ID NO: 1916109 - protein, 10 aa, Staphylococcus
DGKAKGLKIG

SEQ ID NO: 1916110 - protein, 11 aa, Staphylococcus
DGKDPSEISRK

SEQ ID NO: 1916111 - protein, 8 aa, Staphylococcus
DGKSLSKE

SEQ ID NO: 1916112 - protein, 4 aa, Staphylococcus
DGNH

SEQ ID NO: 1916113 - protein, 4 aa, Staphylococcus
DGNY

SEQ ID NO: 1916114 - protein, 7 aa, Staphylococcus
DGPDAVD

SEQ ID NO: 1916115 - protein, 8 aa, Staphylococcus
DGPNQTGI

SEQ ID NO: 1916116 - protein, 4 aa, Staphylococcus
DGQS

SEQ ID NO: 1916117 - protein, 13 aa, Staphylococcus
DGRETPKKPRIVN

SEQ ID NO: 1916118 - protein, 7 aa, Staphylococcus
DGRFEDV

SEQ ID NO: 1916119 - protein, 4 aa, Staphylococcus
DGRI

SEQ ID NO: 1916120 - protein, 5 aa, Staphylococcus
DGRPK

SEQ ID NO: 1916121 - protein, 8 aa, Staphylococcus
DGRTRTLE

SEQ ID NO: 1916122 - protein, 4 aa, Staphylococcus
DGRV

SEQ ID NO: 1916123 - protein, 9 aa, Staphylococcus
DGSDEADAI

SEQ ID NO: 1916124 - protein, 7 aa, Staphylococcus
DGSQYGE

SEQ ID NO: 1916125 - protein, 7 aa, Staphylococcus
DGTDYSS

SEQ ID NO: 1916126 - protein, 12 aa, Staphylococcus
DGTENKGKLGAN

SEQ ID NO: 1916127 - protein, 7 aa, Staphylococcus
DGTGGAL

SEQ ID NO: 1916128 - protein, 5 aa, Staphylococcus
DGTGV

SEQ ID NO: 1916129 - protein, 7 aa, Staphylococcus
DGTVQTF

SEQ ID NO: 1916130 - protein, 7 aa, Staphylococcus
DGVGVQE

SEQ ID NO: 1916131 - protein, 7 aa, Staphylococcus
DGYKEGD

SEQ ID NO: 1916132 - protein, 17 aa, Staphylococcus
DHDEDELSHYSNATTDI

SEQ ID NO: 1916133 - protein, 17 aa, Staphylococcus
DHDEEELSHYSNATTDI

SEQ ID NO: 1916134 - protein, 5 aa, Staphylococcus
DHEPV

SEQ ID NO: 1916135 - protein, 24 aa, Staphylococcus
DHGNSDQVLTDDDEPMTTHTTNPV

SEQ ID NO: 1916136 - protein, 7 aa, Staphylococcus
DHGSSHL

SEQ ID NO: 1916137 - protein, 5 aa, Staphylococcus
DHIPE

SEQ ID NO: 1916138 - protein, 8 aa, Staphylococcus
DHKKTSRI

SEQ ID NO: 1916139 - protein, 8 aa, Staphylococcus
DHKKTSRL

SEQ ID NO: 1916140 - protein, 6 aa, Staphylococcus
DHRRPS

SEQ ID NO: 1916141 - protein, 4 aa, Staphylococcus
DHYQ

SEQ ID NO: 1916142 - protein, 4 aa, Staphylococcus
DIDG

SEQ ID NO: 1916143 - protein, 4 aa, Staphylococcus
DIKE

SEQ ID NO: 1916144 - protein, 12 aa, Staphylococcus
DIKEGDEVKRTG

SEQ ID NO: 1916145 - protein, 9 aa, Staphylococcus
DIKSPNTEI

SEQ ID NO: 1916146 - protein, 21 aa, Staphylococcus
DINTKEDFKATIERSDSCAVP

SEQ ID NO: 1916147 - protein, 12 aa, Staphylococcus
DIPGAGAAGGLG

SEQ ID NO: 1916148 - protein, 5 aa, Staphylococcus
DIQRQ

SEQ ID NO: 1916149 - protein, 4 aa, Staphylococcus
DIYE

SEQ ID NO: 1916150 - protein, 8 aa, Staphylococcus
DKAAQSNL

SEQ ID NO: 1916151 - protein, 7 aa, Staphylococcus
DKAIEKD

SEQ ID NO: 1916152 - protein, 12 aa, Staphylococcus
DKAKGAGDENYD

SEQ ID NO: 1916153 - protein, 7 aa, Staphylococcus
DKDIDQR

SEQ ID NO: 1916154 - protein, 7 aa, Staphylococcus
DKDTSIK

SEQ ID NO: 1916155 - protein, 7 aa, Staphylococcus
DKDYPGI

SEQ ID NO: 1916156 - protein, 4 aa, Staphylococcus
DKEI

SEQ ID NO: 1916157 - protein, 17 aa, Staphylococcus
DKFHPNKRRISNTGQRA

SEQ ID NO: 1916158 - protein, 9 aa, Staphylococcus
DKGADGYEM

SEQ ID NO: 1916159 - protein, 4 aa, Staphylococcus
DKGE

SEQ ID NO: 1916160 - protein, 10 aa, Staphylococcus
DKGIKTPKDL

SEQ ID NO: 1916161 - protein, 8 aa, Staphylococcus
DKGKALAE

SEQ ID NO: 1916162 - protein, 9 aa, Staphylococcus
DKGLAGAYS

SEQ ID NO: 1916163 - protein, 7 aa, Staphylococcus
DKGTAEG

SEQ ID NO: 1916164 - protein, 7 aa, Staphylococcus
DKGTGIK

SEQ ID NO: 1916165 - protein, 4 aa, Staphylococcus
DKGV

SEQ ID NO: 1916166 - protein, 6 aa, Staphylococcus
DKIEQS

SEQ ID NO: 1916167 - protein, 19 aa, Staphylococcus
DKITEAEEAGADYVGESDY

SEQ ID NO: 1916168 - protein, 8 aa, Staphylococcus
DKKEARRM

SEQ ID NO: 1916169 - protein, 6 aa, Staphylococcus
DKKEML

SEQ ID NO: 1916170 - protein, 19 aa, Staphylococcus
DKKGRVGFGTGKAQEVPEA

SEQ ID NO: 1916171 - protein, 11 aa, Staphylococcus
DKKLKDYTKEE

SEQ ID NO: 1916172 - protein, 7 aa, Staphylococcus
DKKQELN

SEQ ID NO: 1916173 - protein, 10 aa, Staphylococcus
DKKRNEHDER

SEQ ID NO: 1916174 - protein, 7 aa, Staphylococcus
DKKTSKI

SEQ ID NO: 1916175 - protein, 9 aa, Staphylococcus
DKKVKGGQD

SEQ ID NO: 1916176 - protein, 22 aa, Staphylococcus
DKKVRGRRLGEDYNKGGIEDGF

SEQ ID NO: 1916177 - protein, 4 aa, Staphylococcus
DKLE

SEQ ID NO: 1916178 - protein, 5 aa, Staphylococcus
DKNSV

SEQ ID NO: 1916179 - protein, 5 aa, Staphylococcus
DKPDA

SEQ ID NO: 1916180 - protein, 7 aa, Staphylococcus
DKPEEQF

SEQ ID NO: 1916181 - protein, 7 aa, Staphylococcus
DKPEQFR

SEQ ID NO: 1916182 - protein, 10 aa, Staphylococcus
DKPSARPEAV

SEQ ID NO: 1916183 - protein, 6 aa, Staphylococcus
DKPSRL

SEQ ID NO: 1916184 - protein, 5 aa, Staphylococcus
DKQPI

SEQ ID NO: 1916185 - protein, 7 aa, Staphylococcus
DKQPTVR

SEQ ID NO: 1916186 - protein, 15 aa, Staphylococcus
DKQSGRTDKRNGYQQ

SEQ ID NO: 1916187 - protein, 8 aa, Staphylococcus
DKQSRTSI

SEQ ID NO: 1916188 - protein, 7 aa, Staphylococcus
DKSDEEI

SEQ ID NO: 1916189 - protein, 10 aa, Staphylococcus
DKSDKRRGRL

SEQ ID NO: 1916190 - protein, 6 aa, Staphylococcus
DKSLSQ

SEQ ID NO: 1916191 - protein, 12 aa, Staphylococcus
DKSPAVRRTAGD

SEQ ID NO: 1916192 - protein, 5 aa, Staphylococcus
DKVPD

SEQ ID NO: 1916193 - protein, 6 aa, Staphylococcus
DKVPDI

SEQ ID NO: 1916194 - protein, 7 aa, Staphylococcus
DKVSNDT

SEQ ID NO: 1916195 - protein, 7 aa, Staphylococcus
DKVTNDS

SEQ ID NO: 1916196 - protein, 6 aa, Staphylococcus
DKYEFG

SEQ ID NO: 1916197 - protein, 17 aa, Staphylococcus
DKYPSEISGGQQQRTAA

SEQ ID NO: 1916198 - protein, 6 aa, Staphylococcus
DKYYEK

SEQ ID NO: 1916199 - protein, 8 aa, Staphylococcus
DLANGEAD

SEQ ID NO: 1916200 - protein, 7 aa, Staphylococcus
DLDSQTL

SEQ ID NO: 1916201 - protein, 4 aa, Staphylococcus
DLEQ

SEQ ID NO: 1916202 - protein, 6 aa, Staphylococcus
DLETAV

SEQ ID NO: 1916203 - protein, 11 aa, Staphylococcus
DLFSNKKEDES

SEQ ID NO: 1916204 - protein, 4 aa, Staphylococcus
DLGN

SEQ ID NO: 1916205 - protein, 6 aa, Staphylococcus
DLNGRT

SEQ ID NO: 1916206 - protein, 10 aa, Staphylococcus
DLNRAEDRKE

SEQ ID NO: 1916207 - protein, 6 aa, Staphylococcus
DLPEEN

SEQ ID NO: 1916208 - protein, 6 aa, Staphylococcus
DLPGPI

SEQ ID NO: 1916209 - protein, 4 aa, Staphylococcus
DLPT

SEQ ID NO: 1916210 - protein, 7 aa, Staphylococcus
DLPTTTI

SEQ ID NO: 1916211 - protein, 9 aa, Staphylococcus
DLQAKGEKF

SEQ ID NO: 1916212 - protein, 19 aa, Staphylococcus
DLRQGYEYSRTANPTRASL

SEQ ID NO: 1916213 - protein, 7 aa, Staphylococcus
DLSNAGA

SEQ ID NO: 1916214 - protein, 9 aa, Staphylococcus
DLSNAGANV

SEQ ID NO: 1916215 - protein, 9 aa, Staphylococcus
DLSNAGAQV

SEQ ID NO: 1916216 - protein, 6 aa, Staphylococcus
DLSQSF

SEQ ID NO: 1916217 - protein, 4 aa, Staphylococcus
DLTD

SEQ ID NO: 1916218 - protein, 7 aa, Staphylococcus
DMPDDET

SEQ ID NO: 1916219 - protein, 6 aa, Staphylococcus
DMSNLN

SEQ ID NO: 1916220 - protein, 5 aa, Staphylococcus
DMTNL

SEQ ID NO: 1916221 - protein, 6 aa, Staphylococcus
DMTQNA

SEQ ID NO: 1916222 - protein, 5 aa, Staphylococcus
DNDET

SEQ ID NO: 1916223 - protein, 5 aa, Staphylococcus
DNDGE

SEQ ID NO: 1916224 - protein, 9 aa, Staphylococcus
DNDKHDTIG

SEQ ID NO: 1916225 - protein, 4 aa, Staphylococcus
DNDY

SEQ ID NO: 1916226 - protein, 5 aa, Staphylococcus
DNEET

SEQ ID NO: 1916227 - protein, 5 aa, Staphylococcus
DNENY

SEQ ID NO: 1916228 - protein, 7 aa, Staphylococcus
DNEQRQI

SEQ ID NO: 1916229 - protein, 4 aa, Staphylococcus
DNFK

SEQ ID NO: 1916230 - protein, 7 aa, Staphylococcus
DNGDNNV

SEQ ID NO: 1916231 - protein, 6 aa, Staphylococcus
DNHKGV

SEQ ID NO: 1916232 - protein, 5 aa, Staphylococcus
DNKKV

SEQ ID NO: 1916233 - protein, 8 aa, Staphylococcus
DNKRSHDI

SEQ ID NO: 1916234 - protein, 4 aa, Staphylococcus
DNLS

SEQ ID NO: 1916235 - protein, 9 aa, Staphylococcus
DNNEGELTE

SEQ ID NO: 1916236 - protein, 4 aa, Staphylococcus
DNNI

SEQ ID NO: 1916237 - protein, 7 aa, Staphylococcus
DNNKDQT

SEQ ID NO: 1916238 - protein, 7 aa, Staphylococcus
DNNRKSV

SEQ ID NO: 1916239 - protein, 4 aa, Staphylococcus
DNNV

SEQ ID NO: 1916240 - protein, 5 aa, Staphylococcus
DNPNA

SEQ ID NO: 1916241 - protein, 8 aa, Staphylococcus
DNQGKAKP

SEQ ID NO: 1916242 - protein, 11 aa, Staphylococcus
DNQMDLKPGET

SEQ ID NO: 1916243 - protein, 6 aa, Staphylococcus
DNREDI

SEQ ID NO: 1916244 - protein, 7 aa, Staphylococcus
DNSHKLA

SEQ ID NO: 1916245 - protein, 4 aa, Staphylococcus
DNVD

SEQ ID NO: 1916246 - protein, 4 aa, Staphylococcus
DNVR

SEQ ID NO: 1916247 - protein, 6 aa, Staphylococcus
DNYNTD

SEQ ID NO: 1916248 - protein, 7 aa, Staphylococcus
DNYNTDA

SEQ ID NO: 1916249 - protein, 6 aa, Staphylococcus
DPAELK

SEQ ID NO: 1916250 - protein, 15 aa, Staphylococcus
DPAYIPRQNDARNQI

SEQ ID NO: 1916251 - protein, 14 aa, Staphylococcus
DPAYIPRQNEARNQ

SEQ ID NO: 1916252 - protein, 9 aa, Staphylococcus
DPDLRKNHP

SEQ ID NO: 1916253 - protein, 6 aa, Staphylococcus
DPEGNA

SEQ ID NO: 1916254 - protein, 4 aa, Staphylococcus
DPEV

SEQ ID NO: 1916255 - protein, 6 aa, Staphylococcus
DPGYTD

SEQ ID NO: 1916256 - protein, 4 aa, Staphylococcus
DPIS

SEQ ID NO: 1916257 - protein, 7 aa, Staphylococcus
DPITEDI

SEQ ID NO: 1916258 - protein, 7 aa, Staphylococcus
DPKDKTL

SEQ ID NO: 1916259 - protein, 6 aa, Staphylococcus
DPKECQ

SEQ ID NO: 1916260 - protein, 7 aa, Staphylococcus
DPKECQE

SEQ ID NO: 1916261 - protein, 13 aa, Staphylococcus
DPKYGPRKTLDIG

SEQ ID NO: 1916262 - protein, 12 aa, Staphylococcus
DPLDGHKGTNIG

SEQ ID NO: 1916263 - protein, 7 aa, Staphylococcus
DPNNNVA

SEQ ID NO: 1916264 - protein, 8 aa, Staphylococcus
DPNSTYIQ

SEQ ID NO: 1916265 - protein, 9 aa, Staphylococcus
DPRQRQNRE

SEQ ID NO: 1916266 - protein, 4 aa, Staphylococcus
DPTE

SEQ ID NO: 1916267 - protein, 7 aa, Staphylococcus
DPVADGP

SEQ ID NO: 1916268 - protein, 12 aa, Staphylococcus
DPWPKKRHAKRR

SEQ ID NO: 1916269 - protein, 10 aa, Staphylococcus
DPYPISGSHG

SEQ ID NO: 1916270 - protein, 11 aa, Staphylococcus
DPYPISGSHGL

SEQ ID NO: 1916271 - protein, 16 aa, Staphylococcus
DPYTNYGRPNSKYEKM

SEQ ID NO: 1916272 - protein, 8 aa, Staphylococcus
DQAPSTKV

SEQ ID NO: 1916273 - protein, 11 aa, Staphylococcus
DQGIHKRGAEV

SEQ ID NO: 1916274 - protein, 7 aa, Staphylococcus
DQIGPIT

SEQ ID NO: 1916275 - protein, 5 aa, Staphylococcus
DQIIP

SEQ ID NO: 1916276 - protein, 4 aa, Staphylococcus
DQIK

SEQ ID NO: 1916277 - protein, 4 aa, Staphylococcus
DQIP

SEQ ID NO: 1916278 - protein, 4 aa, Staphylococcus
DQKL

SEQ ID NO: 1916279 - protein, 14 aa, Staphylococcus
DQMAEDTKTFRGNR

SEQ ID NO: 1916280 - protein, 4 aa, Staphylococcus
DQNR

SEQ ID NO: 1916281 - protein, 4 aa, Staphylococcus
DQPY

SEQ ID NO: 1916282 - protein, 4 aa, Staphylococcus
DQQQ

SEQ ID NO: 1916283 - protein, 26 aa, Staphylococcus
DQSGGSTPKALKEYGVNEDEYSNDDE

SEQ ID NO: 1916284 - protein, 11 aa, Staphylococcus
DQSRGDQIDNA

SEQ ID NO: 1916285 - protein, 6 aa, Staphylococcus
DQTEAM

SEQ ID NO: 1916286 - protein, 11 aa, Staphylococcus
DQTSAHDPLNG

SEQ ID NO: 1916287 - protein, 7 aa, Staphylococcus
DQVGEEQ

SEQ ID NO: 1916288 - protein, 4 aa, Staphylococcus
DRDD

SEQ ID NO: 1916289 - protein, 7 aa, Staphylococcus
DRDEVDL

SEQ ID NO: 1916290 - protein, 8 aa, Staphylococcus
DRDLTQLA

SEQ ID NO: 1916291 - protein, 5 aa, Staphylococcus
DREHV

SEQ ID NO: 1916292 - protein, 7 aa, Staphylococcus
DRGEHAE

SEQ ID NO: 1916293 - protein, 9 aa, Staphylococcus
DRGPEPDKI

SEQ ID NO: 1916294 - protein, 9 aa, Staphylococcus
DRGPKPDKI

SEQ ID NO: 1916295 - protein, 9 aa, Staphylococcus
DRGPQPDKI

SEQ ID NO: 1916296 - protein, 5 aa, Staphylococcus
DRIDR

SEQ ID NO: 1916297 - protein, 9 aa, Staphylococcus
DRKKSRDKF

SEQ ID NO: 1916298 - protein, 6 aa, Staphylococcus
DRLNTY

SEQ ID NO: 1916299 - protein, 18 aa, Staphylococcus
DRPGIESSNERNNAGTGH

SEQ ID NO: 1916300 - protein, 6 aa, Staphylococcus
DRPHEL

SEQ ID NO: 1916301 - protein, 8 aa, Staphylococcus
DRQTGKTT

SEQ ID NO: 1916302 - protein, 9 aa, Staphylococcus
DRQTGKTTV

SEQ ID NO: 1916303 - protein, 6 aa, Staphylococcus
DRREDV

SEQ ID NO: 1916304 - protein, 9 aa, Staphylococcus
DRTKSRDKF

SEQ ID NO: 1916305 - protein, 7 aa, Staphylococcus
DRTRASL

SEQ ID NO: 1916306 - protein, 5 aa, Staphylococcus
DRVKG

SEQ ID NO: 1916307 - protein, 26 aa, Staphylococcus
DRYSDERTEQTVANRKRKKINMNYIG

SEQ ID NO: 1916308 - protein, 13 aa, Staphylococcus
DSAHGTNPASAAF

SEQ ID NO: 1916309 - protein, 6 aa, Staphylococcus
DSALER

SEQ ID NO: 1916310 - protein, 8 aa, Staphylococcus
DSDLQGHR

SEQ ID NO: 1916311 - protein, 4 aa, Staphylococcus
DSDQ

SEQ ID NO: 1916312 - protein, 16 aa, Staphylococcus
DSEAEMRKERIKKTKT

SEQ ID NO: 1916313 - protein, 15 aa, Staphylococcus
DSEAEMRKERINKTK

SEQ ID NO: 1916314 - protein, 7 aa, Staphylococcus
DSEEINI

SEQ ID NO: 1916315 - protein, 8 aa, Staphylococcus
DSEPPAQK

SEQ ID NO: 1916316 - protein, 8 aa, Staphylococcus
DSFSPSEV

SEQ ID NO: 1916317 - protein, 7 aa, Staphylococcus
DSGRGYR

SEQ ID NO: 1916318 - protein, 15 aa, Staphylococcus
DSGVSGQAAQKMAEK

SEQ ID NO: 1916319 - protein, 4 aa, Staphylococcus
DSHQ

SEQ ID NO: 1916320 - protein, 4 aa, Staphylococcus
DSHS

SEQ ID NO: 1916321 - protein, 8 aa, Staphylococcus
DSIQSRLE

SEQ ID NO: 1916322 - protein, 15 aa, Staphylococcus
DSKNEIGAHKDRHEN

SEQ ID NO: 1916323 - protein, 10 aa, Staphylococcus
DSKTPGHPEF

SEQ ID NO: 1916324 - protein, 12 aa, Staphylococcus
DSMSGGEKAKYK

SEQ ID NO: 1916325 - protein, 8 aa, Staphylococcus
DSNLQGHR

SEQ ID NO: 1916326 - protein, 6 aa, Staphylococcus
DSPGMN

SEQ ID NO: 1916327 - protein, 7 aa, Staphylococcus
DSPGMNA

SEQ ID NO: 1916328 - protein, 16 aa, Staphylococcus
DSPSTNYAAIEDKKRR

SEQ ID NO: 1916329 - protein, 16 aa, Staphylococcus
DSRREAFDASGDLKPY

SEQ ID NO: 1916330 - protein, 6 aa, Staphylococcus
DSTASS

SEQ ID NO: 1916331 - protein, 5 aa, Staphylococcus
DSTDF

SEQ ID NO: 1916332 - protein, 5 aa, Staphylococcus
DSTEF

SEQ ID NO: 1916333 - protein, 6 aa, Staphylococcus
DSTPLF

SEQ ID NO: 1916334 - protein, 7 aa, Staphylococcus
DSTRTRC

SEQ ID NO: 1916335 - protein, 8 aa, Staphylococcus
DSTSNVRA

SEQ ID NO: 1916336 - protein, 22 aa, Staphylococcus
DSVTTDHISPAGAIGKDTPAGK

SEQ ID NO: 1916337 - protein, 10 aa, Staphylococcus
DSYANPDALQ

SEQ ID NO: 1916338 - protein, 8 aa, Staphylococcus
DSYASPTV

SEQ ID NO: 1916339 - protein, 6 aa, Staphylococcus
DTAKRM

SEQ ID NO: 1916340 - protein, 37 aa, Staphylococcus; identical to SEQ ID NO: 1770999

SEQ ID NO: 1916341 - protein, 8 aa, Staphylococcus
DTEENIRK

SEQ ID NO: 1916342 - protein, 5 aa, Staphylococcus
DTEGH

SEQ ID NO: 1916343 - protein, 6 aa, Staphylococcus
DTENRL

SEQ ID NO: 1916344 - protein, 4 aa, Staphylococcus
DTEQ

SEQ ID NO: 1916345 - protein, 7 aa, Staphylococcus
DTEYTGG

SEQ ID NO: 1916346 - protein, 5 aa, Staphylococcus
DTFET

SEQ ID NO: 1916347 - protein, 6 aa, Staphylococcus
DTFPQE

SEQ ID NO: 1916348 - protein, 7 aa, Staphylococcus
DTGAGHN

SEQ ID NO: 1916349 - protein, 5 aa, Staphylococcus
DTGAI

SEQ ID NO: 1916350 - protein, 7 aa, Staphylococcus
DTGDNNV

SEQ ID NO: 1916351 - protein, 7 aa, Staphylococcus
DTHNASL

SEQ ID NO: 1916352 - protein, 5 aa, Staphylococcus
DTHQA

SEQ ID NO: 1916353 - protein, 9 aa, Staphylococcus
DTKERGRSM

SEQ ID NO: 1916354 - protein, 10 aa, Staphylococcus
DTKERGRSME

SEQ ID NO: 1916355 - protein, 8 aa, Staphylococcus
DTKKQYNL

SEQ ID NO: 1916356 - protein, 4 aa, Staphylococcus
DTLN

SEQ ID NO: 1916357 - protein, 6 aa, Staphylococcus
DTNAIT

SEQ ID NO: 1916358 - protein, 7 aa, Staphylococcus
DTNNEQA

SEQ ID NO: 1916359 - protein, 7 aa, Staphylococcus
DTNSITD

SEQ ID NO: 1916360 - protein, 7 aa, Staphylococcus
DTPEGKI

SEQ ID NO: 1916361 - protein, 6 aa, Staphylococcus
DTPGFS

SEQ ID NO: 1916362 - protein, 4 aa, Staphylococcus
DTPL

SEQ ID NO: 1916363 - protein, 7 aa, Staphylococcus
DTQGQAL

SEQ ID NO: 1916364 - protein, 4 aa, Staphylococcus
DTQT

SEQ ID NO: 1916365 - protein, 9 aa, Staphylococcus
DTRANKTQV

SEQ ID NO: 1916366 - protein, 14 aa, Staphylococcus
DTRDEGESTSGTSF

SEQ ID NO: 1916367 - protein, 9 aa, Staphylococcus
DTSYPSKET

SEQ ID NO: 1916368 - protein, 13 aa, Staphylococcus
DTTPGGGTDAGSI

SEQ ID NO: 1916369 - protein, 7 aa, Staphylococcus
DTTTTFS

SEQ ID NO: 1916370 - protein, 7 aa, Staphylococcus
DTVGDEL

SEQ ID NO: 1916371 - protein, 13 aa, Staphylococcus
DTVISGGGSDGSI

SEQ ID NO: 1916372 - protein, 7 aa, Staphylococcus
DTYENEA

SEQ ID NO: 1916373 - protein, 5 aa, Staphylococcus
DTYET

SEQ ID NO: 1916374 - protein, 13 aa, Staphylococcus
DTYGKDNKPKITN

SEQ ID NO: 1916375 - protein, 14 aa, Staphylococcus
DTYGKDNKPKITNM

SEQ ID NO: 1916376 - protein, 5 aa, Staphylococcus
DTYTN

SEQ ID NO: 1916377 - protein, 10 aa, Staphylococcus
DVEKMNPLSG

SEQ ID NO: 1916378 - protein, 4 aa, Staphylococcus
DVET

SEQ ID NO: 1916379 - protein, 6 aa, Staphylococcus
DVHGST

SEQ ID NO: 1916380 - protein, 6 aa, Staphylococcus
DVHQSV

SEQ ID NO: 1916381 - protein, 4 aa, Staphylococcus
DVIE

SEQ ID NO: 1916382 - protein, 4 aa, Staphylococcus
DVKE

SEQ ID NO: 1916383 - protein, 8 aa, Staphylococcus
DVKGDNQH

SEQ ID NO: 1916384 - protein, 5 aa, Staphylococcus
DVKGG

SEQ ID NO: 1916385 - protein, 5 aa, Staphylococcus
DVKRS

SEQ ID NO: 1916386 - protein, 8 aa, Staphylococcus
DVNDTPFT

SEQ ID NO: 1916387 - protein, 7 aa, Staphylococcus
DVNRNTM

SEQ ID NO: 1916388 - protein, 5 aa, Staphylococcus
DVPES

SEQ ID NO: 1916389 - protein, 6 aa, Staphylococcus
DVPQAG

SEQ ID NO: 1916390 - protein, 4 aa, Staphylococcus
DVPV

SEQ ID NO: 1916391 - protein, 5 aa, Staphylococcus
DVQFE

SEQ ID NO: 1916392 - protein, 4 aa, Staphylococcus
DVQR

SEQ ID NO: 1916393 - protein, 9 aa, Staphylococcus
DVRPTENQI

SEQ ID NO: 1916394 - protein, 5 aa, Staphylococcus
DVSGQ

SEQ ID NO: 1916395 - protein, 4 aa, Staphylococcus
DVSQ

SEQ ID NO: 1916396 - protein, 5 aa, Staphylococcus
DVTPF

SEQ ID NO: 1916397 - protein, 10 aa, Staphylococcus
DVTTEHEGEV

SEQ ID NO: 1916398 - protein, 5 aa, Staphylococcus
DVTTS

SEQ ID NO: 1916399 - protein, 5 aa, Staphylococcus
DVYGS

SEQ ID NO: 1916400 - protein, 6 aa, Staphylococcus
DWQPGQ

SEQ ID NO: 1916401 - protein, 12 aa, Staphylococcus
DYARSGNPNRQL

SEQ ID NO: 1916402 - protein, 11 aa, Staphylococcus
DYDRPGSNRKP

SEQ ID NO: 1916403 - protein, 10 aa, Staphylococcus
DYEENTPLEE

SEQ ID NO: 1916404 - protein, 5 aa, Staphylococcus
DYEGS

SEQ ID NO: 1916405 - protein, 17 aa, Staphylococcus
DYGMGSSRDWAAKGTNL

SEQ ID NO: 1916406 - protein, 5 aa, Staphylococcus
DYGSF

SEQ ID NO: 1916407 - protein, 9 aa, Staphylococcus
DYGTEDEIK

SEQ ID NO: 1916408 - protein, 9 aa, Staphylococcus
DYKKDDFAE

SEQ ID NO: 1916409 - protein, 7 aa, Staphylococcus
DYNNGRL

SEQ ID NO: 1916410 - protein, 10 aa, Staphylococcus
DYPGIGPEHS

SEQ ID NO: 1916411 - protein, 4 aa, Staphylococcus
DYQG

SEQ ID NO: 1916412 - protein, 6 aa, Staphylococcus
DYSEYG

SEQ ID NO: 1916413 - protein, 11 aa, Staphylococcus
DYSKKAQEDVL

SEQ ID NO: 1916414 - protein, 5 aa, Staphylococcus
DYTDD

SEQ ID NO: 1916415 - protein, 6 aa, Staphylococcus
EADLRG

SEQ ID NO: 1916416 - protein, 4 aa, Staphylococcus
EAEA

SEQ ID NO: 1916417 - protein, 13 aa, Staphylococcus
EAERSPNEKYIPN

SEQ ID NO: 1916418 - protein, 13 aa, Staphylococcus
EAERSPNESYIPN

SEQ ID NO: 1916419 - protein, 4 aa, Staphylococcus
EAFE

SEQ ID NO: 1916420 - protein, 4 aa, Staphylococcus
EAGA

SEQ ID NO: 1916421 - protein, 6 aa, Staphylococcus
EAGFEP

SEQ ID NO: 1916422 - protein, 7 aa, Staphylococcus
EAGFEPS

SEQ ID NO: 1916423 - protein, 7 aa, Staphylococcus
EAGLAQR

SEQ ID NO: 1916424 - protein, 8 aa, Staphylococcus
EAGSDLDS

SEQ ID NO: 1916425 - protein, 8 aa, Staphylococcus
EAGSDLNS

SEQ ID NO: 1916426 - protein, 6 aa, Staphylococcus
EAGTFN

SEQ ID NO: 1916427 - protein, 15 aa, Staphylococcus
EAGTNGLPGGYTSTE

SEQ ID NO: 1916428 - protein, 5 aa, Staphylococcus
EAGYG

SEQ ID NO: 1916429 - protein, 4 aa, Staphylococcus
EAHE

SEQ ID NO: 1916430 - protein, 11 aa, Staphylococcus
EAHGVNPKAIE

SEQ ID NO: 1916431 - protein, 12 aa, Staphylococcus
EAHKKLNQNVNP

SEQ ID NO: 1916432 - protein, 7 aa, Staphylococcus
EAHNTSI

SEQ ID NO: 1916433 - protein, 11 aa, Staphylococcus
EAHRENGATWD

SEQ ID NO: 1916434 - protein, 16 aa, Staphylococcus
EAIDETGINPVAQPEV

SEQ ID NO: 1916435 - protein, 4 aa, Staphylococcus
EAIN

SEQ ID NO: 1916436 - protein, 7 aa, Staphylococcus
EAINENT

SEQ ID NO: 1916437 - protein, 8 aa, Staphylococcus
EAINTVPS

SEQ ID NO: 1916438 - protein, 12 aa, Staphylococcus
EAINTVPSNGYL

SEQ ID NO: 1916439 - protein, 8 aa, Staphylococcus
EAKDGETY

SEQ ID NO: 1916440 - protein, 16 aa, Staphylococcus
EAKEGVKIQNESKTMA

SEQ ID NO: 1916441 - protein, 16 aa, Staphylococcus
EAKEGVQIQNESKTMA

SEQ ID NO: 1916442 - protein, 4 aa, Staphylococcus
EAKQ

SEQ ID NO: 1916443 - protein, 7 aa, Staphylococcus
EALEAAA

SEQ ID NO: 1916444 - protein, 7 aa, Staphylococcus
EALEDED

SEQ ID NO: 1916445 - protein, 4 aa, Staphylococcus
EALK

SEQ ID NO: 1916446 - protein, 4 aa, Staphylococcus
EAPK

SEQ ID NO: 1916447 - protein, 5 aa, Staphylococcus
EAPKS

SEQ ID NO: 1916448 - protein, 8 aa, Staphylococcus
EAPKTKEF

SEQ ID NO: 1916449 - protein, 10 aa, Staphylococcus
EAQDGSEKKQ

SEQ ID NO: 1916450 - protein, 11 aa, Staphylococcus
EAQDGSEKKQV

SEQ ID NO: 1916451 - protein, 4 aa, Staphylococcus
EAQE

SEQ ID NO: 1916452 - protein, 9 aa, Staphylococcus
EAQNERELQ

SEQ ID NO: 1916453 - protein, 9 aa, Staphylococcus
EAREDGPFL

SEQ ID NO: 1916454 - protein, 9 aa, Staphylococcus
EASAGNTGI

SEQ ID NO: 1916455 - protein, 11 aa, Staphylococcus
EASESDHGGYK

SEQ ID NO: 1916456 - protein, 6 aa, Staphylococcus
EASKLK

SEQ ID NO: 1916457 - protein, 9 aa, Staphylococcus
EASKNGKDW

SEQ ID NO: 1916458 - protein, 9 aa, Staphylococcus
EASNWNKEL

SEQ ID NO: 1916459 - protein, 11 aa, Staphylococcus
EASYPKEAQGL

SEQ ID NO: 1916460 - protein, 6 aa, Staphylococcus
EATDEA

SEQ ID NO: 1916461 - protein, 7 aa, Staphylococcus
EATGATG

SEQ ID NO: 1916462 - protein, 4 aa, Staphylococcus
EATL

SEQ ID NO: 1916463 - protein, 4 aa, Staphylococcus
EATR

SEQ ID NO: 1916464 - protein, 14 aa, Staphylococcus
EAVDEGQGTLSDAV

SEQ ID NO: 1916465 - protein, 6 aa, Staphylococcus
EAVPDG

SEQ ID NO: 1916466 - protein, 4 aa, Staphylococcus
EAYG

SEQ ID NO: 1916467 - protein, 5 aa, Staphylococcus
EAYSH

SEQ ID NO: 1916468 - protein, 4 aa, Staphylococcus
ECGF

SEQ ID NO: 1916469 - protein, 4 aa, Staphylococcus
EDAS

SEQ ID NO: 1916470 - protein, 5 aa, Staphylococcus
EDASI

SEQ ID NO: 1916471 - protein, 6 aa, Staphylococcus
EDASIK

SEQ ID NO: 1916472 - protein, 8 aa, Staphylococcus
EDASIKAA

SEQ ID NO: 1916473 - protein, 17 aa, Staphylococcus
EDASIKAAVDEAHKHGK

SEQ ID NO: 1916474 - protein, 15 aa, Staphylococcus
EDDDYITSTHRGHGH

SEQ ID NO: 1916475 - protein, 12 aa, Staphylococcus
EDDIQDKMNTSR

SEQ ID NO: 1916476 - protein, 6 aa, Staphylococcus
EDDKQG

SEQ ID NO: 1916477 - protein, 8 aa, Staphylococcus
EDDKSKKL

SEQ ID NO: 1916478 - protein, 12 aa, Staphylococcus
EDDPNAESPKLS

SEQ ID NO: 1916479 - protein, 4 aa, Staphylococcus
EDED

SEQ ID NO: 1916480 - protein, 8 aa, Staphylococcus
EDEERAKH

SEQ ID NO: 1916481 - protein, 6 aa, Staphylococcus
EDELNP

SEQ ID NO: 1916482 - protein, 4 aa, Staphylococcus
EDEM

SEQ ID NO: 1916483 - protein, 7 aa, Staphylococcus
EDENGKL

SEQ ID NO: 1916484 - protein, 8 aa, Staphylococcus
EDENSTHR

SEQ ID NO: 1916485 - protein, 6 aa, Staphylococcus
EDEPEI

SEQ ID NO: 1916486 - protein, 7 aa, Staphylococcus
EDEPEIT

SEQ ID NO: 1916487 - protein, 16 aa, Staphylococcus
EDEREQQAIINAIELN

SEQ ID NO: 1916488 - protein, 16 aa, Staphylococcus
EDEREQQAIKNAIELN

SEQ ID NO: 1916489 - protein, 6 aa, Staphylococcus
EDERQR

SEQ ID NO: 1916490 - protein, 4 aa, Staphylococcus
EDEW

SEQ ID NO: 1916491 - protein, 7 aa, Staphylococcus
EDGDTLN

SEQ ID NO: 1916492 - protein, 5 aa, Staphylococcus
EDGQR

SEQ ID NO: 1916493 - protein, 6 aa, Staphylococcus
EDGQRA

SEQ ID NO: 1916494 - protein, 5 aa, Staphylococcus
EDGTL

SEQ ID NO: 1916495 - protein, 5 aa, Staphylococcus
EDHGA

SEQ ID NO: 1916496 - protein, 10 aa, Staphylococcus
EDKIAKGKVQ

SEQ ID NO: 1916497 - protein, 5 aa, Staphylococcus
EDLAK

SEQ ID NO: 1916498 - protein, 4 aa, Staphylococcus
EDLE

SEQ ID NO: 1916499 - protein, 6 aa, Staphylococcus
EDLSKE

SEQ ID NO: 1916500 - protein, 6 aa, Staphylococcus
EDNAQV

SEQ ID NO: 1916501 - protein, 6 aa, Staphylococcus
EDNKEI

SEQ ID NO: 1916502 - protein, 7 aa, Staphylococcus
EDNKKQL

SEQ ID NO: 1916503 - protein, 6 aa, Staphylococcus
EDNQST

SEQ ID NO: 1916504 - protein, 5 aa, Staphylococcus
EDNTD

SEQ ID NO: 1916505 - protein, 7 aa, Staphylococcus
EDNYEPK

SEQ ID NO: 1916506 - protein, 4 aa, Staphylococcus
EDQD

SEQ ID NO: 1916507 - protein, 6 aa, Staphylococcus
EDQYGY

SEQ ID NO: 1916508 - protein, 14 aa, Staphylococcus
EDSALDKEAYDRAT

SEQ ID NO: 1916509 - protein, 8 aa, Staphylococcus
EDSDEDLG

SEQ ID NO: 1916510 - protein, 5 aa, Staphylococcus
EDSNY

SEQ ID NO: 1916511 - protein, 4 aa, Staphylococcus
EDTE

SEQ ID NO: 1916512 - protein, 5 aa, Staphylococcus
EDTED

SEQ ID NO: 1916513 - protein, 11 aa, Staphylococcus
EDTPGVTRDRI

SEQ ID NO: 1916514 - protein, 8 aa, Staphylococcus
EDTSEEDV

SEQ ID NO: 1916515 - protein, 6 aa, Staphylococcus
EDYPDA

SEQ ID NO: 1916516 - protein, 5 aa, Staphylococcus
EEADR

SEQ ID NO: 1916517 - protein, 5 aa, Staphylococcus
EEAEA

SEQ ID NO: 1916518 - protein, 4 aa, Staphylococcus
EEAG

SEQ ID NO: 1916519 - protein, 16 aa, Staphylococcus
EEAGEPLTANRMNEEY

SEQ ID NO: 1916520 - protein, 9 aa, Staphylococcus
EEAHKNDKQ

SEQ ID NO: 1916521 - protein, 11 aa, Staphylococcus
EEAKNDPDKVL

SEQ ID NO: 1916522 - protein, 11 aa, Staphylococcus
EEANSGHPGLP

SEQ ID NO: 1916523 - protein, 13 aa, Staphylococcus
EEAVEKAKELDSD

SEQ ID NO: 1916524 - protein, 12 aa, Staphylococcus
EEAVEKAKELDT

SEQ ID NO: 1916525 - protein, 9 aa, Staphylococcus
EEDAKKDIQ

SEQ ID NO: 1916526 - protein, 12 aa, Staphylococcus
EEDIKDNMNTSR

SEQ ID NO: 1916527 - protein, 5 aa, Staphylococcus
EEDTS

SEQ ID NO: 1916528 - protein, 15 aa, Staphylococcus
EEEETQVKDGKAKKL

SEQ ID NO: 1916529 - protein, 12 aa, Staphylococcus
EEEGVEGSKDAR

SEQ ID NO: 1916530 - protein, 7 aa, Staphylococcus
EEEIDEP

SEQ ID NO: 1916531 - protein, 7 aa, Staphylococcus
EEEPHMG

SEQ ID NO: 1916532 - protein, 12 aa, Staphylococcus
EEEYNENIRLNY

SEQ ID NO: 1916533 - protein, 4 aa, Staphylococcus
EEGF

SEQ ID NO: 1916534 - protein, 7 aa, Staphylococcus
EEGIPTD

SEQ ID NO: 1916535 - protein, 5 aa, Staphylococcus
EEGVS

SEQ ID NO: 1916536 - protein, 4 aa, Staphylococcus
EEIE

SEQ ID NO: 1916537 - protein, 7 aa, Staphylococcus
EEIGRGD

SEQ ID NO: 1916538 - protein, 13 aa, Staphylococcus
EEIISKDNNYSAM

SEQ ID NO: 1916539 - protein, 5 aa, Staphylococcus
EEITA

SEQ ID NO: 1916540 - protein, 15 aa, Staphylococcus
EEKGYIKRDPTKPRA

SEQ ID NO: 1916541 - protein, 7 aa, Staphylococcus
EEKNGQL

SEQ ID NO: 1916542 - protein, 9 aa, Staphylococcus
EELEDSPEF

SEQ ID NO: 1916543 - protein, 5 aa, Staphylococcus
EELGY

SEQ ID NO: 1916544 - protein, 10 aa, Staphylococcus
EELNDSYDKV

SEQ ID NO: 1916545 - protein, 11 aa, Staphylococcus
EEMPPGGAKGM

SEQ ID NO: 1916546 - protein, 11 aa, Staphylococcus
EEMPPGGAQGM

SEQ ID NO: 1916547 - protein, 5 aa, Staphylococcus
EEMTG

SEQ ID NO: 1916548 - protein, 9 aa, Staphylococcus
EENAQANAF

SEQ ID NO: 1916549 - protein, 4 aa, Staphylococcus
EENE

SEQ ID NO: 1916550 - protein, 4 aa, Staphylococcus
EENI

SEQ ID NO: 1916551 - protein, 5 aa, Staphylococcus
EENPN

SEQ ID NO: 1916552 - protein, 6 aa, Staphylococcus
EENQST

SEQ ID NO: 1916553 - protein, 7 aa, Staphylococcus
EEPTSGD

SEQ ID NO: 1916554 - protein, 13 aa, Staphylococcus
EEQARNHKDNPFD

SEQ ID NO: 1916555 - protein, 8 aa, Staphylococcus
EEQEGSPK

SEQ ID NO: 1916556 - protein, 16 aa, Staphylococcus
EERAERRQKENELRGI

SEQ ID NO: 1916557 - protein, 7 aa, Staphylococcus
EERAPLR

SEQ ID NO: 1916558 - protein, 8 aa, Staphylococcus
EERDNKYP

SEQ ID NO: 1916559 - protein, 7 aa, Staphylococcus
EEREIRG

SEQ ID NO: 1916560 - protein, 8 aa, Staphylococcus
EERQPING

SEQ ID NO: 1916561 - protein, 5 aa, Staphylococcus
EERVE

SEQ ID NO: 1916562 - protein, 6 aa, Staphylococcus
EESAEV

SEQ ID NO: 1916563 - protein, 15 aa, Staphylococcus
EESEVAKEKDGTSIS

SEQ ID NO: 1916564 - protein, 15 aa, Staphylococcus
EESEVAKEKDGTSVS

SEQ ID NO: 1916565 - protein, 9 aa, Staphylococcus
EESINQTKL

SEQ ID NO: 1916566 - protein, 10 aa, Staphylococcus
EESLNQTKLR

SEQ ID NO: 1916567 - protein, 6 aa, Staphylococcus
EESNED

SEQ ID NO: 1916568 - protein, 9 aa, Staphylococcus
EESNGLDTE

SEQ ID NO: 1916569 - protein, 6 aa, Staphylococcus
EESRHG

SEQ ID NO: 1916570 - protein, 8 aa, Staphylococcus
EESSGFNT

SEQ ID NO: 1916571 - protein, 19 aa, Staphylococcus
EESSYTTGQVFGVTGGIQI

SEQ ID NO: 1916572 - protein, 7 aa, Staphylococcus
EETEAKF

SEQ ID NO: 1916573 - protein, 4 aa, Staphylococcus
EETI

SEQ ID NO: 1916574 - protein, 4 aa, Staphylococcus
EETK

SEQ ID NO: 1916575 - protein, 4 aa, Staphylococcus
EETL

SEQ ID NO: 1916576 - protein, 5 aa, Staphylococcus
EETNT

SEQ ID NO: 1916577 - protein, 5 aa, Staphylococcus
EETPE

SEQ ID NO: 1916578 - protein, 5 aa, Staphylococcus
EETQT

SEQ ID NO: 1916579 - protein, 5 aa, Staphylococcus
EEVDS

SEQ ID NO: 1916580 - protein, 8 aa, Staphylococcus
EEVEGRPE

SEQ ID NO: 1916581 - protein, 9 aa, Staphylococcus
EEVGEAGTK

SEQ ID NO: 1916582 - protein, 7 aa, Staphylococcus
EEVGELS

SEQ ID NO: 1916583 - protein, 4 aa, Staphylococcus
EEVK

SEQ ID NO: 1916584 - protein, 7 aa, Staphylococcus
EEVPEEE

SEQ ID NO: 1916585 - protein, 4 aa, Staphylococcus
EFEE

SEQ ID NO: 1916586 - protein, 4 aa, Staphylococcus
EFEP

SEQ ID NO: 1916587 - protein, 7 aa, Staphylococcus
EFEPDKE

SEQ ID NO: 1916588 - protein, 14 aa, Staphylococcus
EFEPKMEDEQRTKL

SEQ ID NO: 1916589 - protein, 5 aa, Staphylococcus
EFEPQ

SEQ ID NO: 1916590 - protein, 10 aa, Staphylococcus
EFGSPKLPHL

SEQ ID NO: 1916591 - protein, 10 aa, Staphylococcus
EFGTRGLYGS

SEQ ID NO: 1916592 - protein, 4 aa, Staphylococcus
EFKE

SEQ ID NO: 1916593 - protein, 7 aa, Staphylococcus
EFNKKRY

SEQ ID NO: 1916594 - protein, 8 aa, Staphylococcus
EFNKKRYA

SEQ ID NO: 1916595 - protein, 12 aa, Staphylococcus
EFQQSADSIADA

SEQ ID NO: 1916596 - protein, 7 aa, Staphylococcus
EFSRGQN

SEQ ID NO: 1916597 - protein, 5 aa, Staphylococcus
EFYNS

SEQ ID NO: 1916598 - protein, 10 aa, Staphylococcus
EFYQPKPGTD

SEQ ID NO: 1916599 - protein, 9 aa, Staphylococcus
EGAQSDDDD

SEQ ID NO: 1916600 - protein, 11 aa, Staphylococcus
EGAREKADNGD

SEQ ID NO: 1916601 - protein, 19 aa, Staphylococcus
EGDEPKVIQNPEGARTTPS

SEQ ID NO: 1916602 - protein, 9 aa, Staphylococcus
EGDISSPYY

SEQ ID NO: 1916603 - protein, 13 aa, Staphylococcus
EGDRGEQAANVVK

SEQ ID NO: 1916604 - protein, 4 aa, Staphylococcus
EGEN

SEQ ID NO: 1916605 - protein, 6 aa, Staphylococcus
EGFGPF

SEQ ID NO: 1916606 - protein, 4 aa, Staphylococcus
EGFP

SEQ ID NO: 1916607 - protein, 9 aa, Staphylococcus
EGGPSKNYN

SEQ ID NO: 1916608 - protein, 9 aa, Staphylococcus
EGGPSKNYT

SEQ ID NO: 1916609 - protein, 8 aa, Staphylococcus
EGGSGGAL

SEQ ID NO: 1916610 - protein, 6 aa, Staphylococcus
EGIIEQ

SEQ ID NO: 1916611 - protein, 5 aa, Staphylococcus
EGIPT

SEQ ID NO: 1916612 - protein, 27 aa, Staphylococcus
EGKAYVGTTDTFYDNEKATPLTTQEDR

SEQ ID NO: 1916613 - protein, 18 aa, Staphylococcus
EGKDPSEISRKDEVWEGE

SEQ ID NO: 1916614 - protein, 6 aa, Staphylococcus
EGKEVN

SEQ ID NO: 1916615 - protein, 8 aa, Staphylococcus
EGKSLGAK

SEQ ID NO: 1916616 - protein, 13 aa, Staphylococcus
EGKTVNEKTQDFQ

SEQ ID NO: 1916617 - protein, 6 aa, Staphylococcus
EGLSGP

SEQ ID NO: 1916618 - protein, 6 aa, Staphylococcus
EGNREF

SEQ ID NO: 1916619 - protein, 7 aa, Staphylococcus
EGNSDHT

SEQ ID NO: 1916620 - protein, 7 aa, Staphylococcus
EGNTAQL

SEQ ID NO: 1916621 - protein, 9 aa, Staphylococcus
EGPGLTKKI

SEQ ID NO: 1916622 - protein, 7 aa, Staphylococcus
EGQAAQI

SEQ ID NO: 1916623 - protein, 10 aa, Staphylococcus
EGQTLGRLSS

SEQ ID NO: 1916624 - protein, 5 aa, Staphylococcus
EGRFD

SEQ ID NO: 1916625 - protein, 5 aa, Staphylococcus
EGRRI

SEQ ID NO: 1916626 - protein, 6 aa, Staphylococcus
EGRYTS

SEQ ID NO: 1916627 - protein, 5 aa, Staphylococcus
EGSED

SEQ ID NO: 1916628 - protein, 5 aa, Staphylococcus
EGSKI

SEQ ID NO: 1916629 - protein, 8 aa, Staphylococcus
EGTAKSIG

SEQ ID NO: 1916630 - protein, 5 aa, Staphylococcus
EGTFD

SEQ ID NO: 1916631 - protein, 10 aa, Staphylococcus
EGTIKSEAYR

SEQ ID NO: 1916632 - protein, 4 aa, Staphylococcus
EGTK

SEQ ID NO: 1916633 - protein, 16 aa, Staphylococcus
EGTTPHTITGRYGSGS

SEQ ID NO: 1916634 - protein, 7 aa, Staphylococcus
EGYDTPE

SEQ ID NO: 1916635 - protein, 4 aa, Staphylococcus
EGYG

SEQ ID NO: 1916636 - protein, 4 aa, Staphylococcus
EGYQ

SEQ ID NO: 1916637 - protein, 8 aa, Staphylococcus
EGYRPGDF

SEQ ID NO: 1916638 - protein, 6 aa, Staphylococcus
EGYSNE

SEQ ID NO: 1916639 - protein, 6 aa, Staphylococcus
EHDNEI

SEQ ID NO: 1916640 - protein, 6 aa, Staphylococcus
EHGDSE

SEQ ID NO: 1916641 - protein, 19 aa, Staphylococcus
EHGGEQGAKEAGKQRLEGK

SEQ ID NO: 1916642 - protein, 10 aa, Staphylococcus
EHLEEGKKSV

SEQ ID NO: 1916643 - protein, 4 aa, Staphylococcus
EHLS

SEQ ID NO: 1916644 - protein, 9 aa, Staphylococcus
EHRKAQNYA

SEQ ID NO: 1916645 - protein, 11 aa, Staphylococcus
EIDPKRRGETL

SEQ ID NO: 1916646 - protein, 16 aa, Staphylococcus
EIDSQTGHVSLGKDER

SEQ ID NO: 1916647 - protein, 6 aa, Staphylococcus
EIEDNP

SEQ ID NO: 1916648 - protein, 10 aa, Staphylococcus
EIEERGGGRQ

SEQ ID NO: 1916649 - protein, 4 aa, Staphylococcus
EIEN

SEQ ID NO: 1916650 - protein, 4 aa, Staphylococcus
EIGE

SEQ ID NO: 1916651 - protein, 6 aa, Staphylococcus
EIGPRI

SEQ ID NO: 1916652 - protein, 5 aa, Staphylococcus
EIHPE

SEQ ID NO: 1916653 - protein, 7 aa, Staphylococcus
EINKRAD

SEQ ID NO: 1916654 - protein, 6 aa, Staphylococcus
EIPDGK

SEQ ID NO: 1916655 - protein, 6 aa, Staphylococcus
EIPEPY

SEQ ID NO: 1916656 - protein, 7 aa, Staphylococcus
EIPKEDV

SEQ ID NO: 1916657 - protein, 4 aa, Staphylococcus
EIQE

SEQ ID NO: 1916658 - protein, 6 aa, Staphylococcus
EISEEN

SEQ ID NO: 1916659 - protein, 6 aa, Staphylococcus
EISEGE

SEQ ID NO: 1916660 - protein, 5 aa, Staphylococcus
EISES

SEQ ID NO: 1916661 - protein, 7 aa, Staphylococcus
EISTSTY

SEQ ID NO: 1916662 - protein, 8 aa, Staphylococcus
EITASATE

SEQ ID NO: 1916663 - protein, 8 aa, Staphylococcus
EIYETPGA

SEQ ID NO: 1916664 - protein, 5 aa, Staphylococcus
EKAGR

SEQ ID NO: 1916665 - protein, 6 aa, Staphylococcus
EKAKNY

SEQ ID NO: 1916666 - protein, 13 aa, Staphylococcus
EKAQGNDEAHEMD

SEQ ID NO: 1916667 - protein, 8 aa, Staphylococcus
EKASDEAI

SEQ ID NO: 1916668 - protein, 4 aa, Staphylococcus
EKDG

SEQ ID NO: 1916669 - protein, 5 aa, Staphylococcus
EKEEE

SEQ ID NO: 1916670 - protein, 7 aa, Staphylococcus
EKEGKSL

SEQ ID NO: 1916671 - protein, 12 aa, Staphylococcus
EKEMKKAAKDLD

SEQ ID NO: 1916672 - protein, 14 aa, Staphylococcus
EKFKNSDNEQVNKV

SEQ ID NO: 1916673 - protein, 4 aa, Staphylococcus
EKGA

SEQ ID NO: 1916674 - protein, 6 aa, Staphylococcus
EKGCPW

SEQ ID NO: 1916675 - protein, 11 aa, Staphylococcus
EKGELATTGST

SEQ ID NO: 1916676 - protein, 15 aa, Staphylococcus
EKGEPTLELNDNGGY

SEQ ID NO: 1916677 - protein, 16 aa, Staphylococcus
EKGERELGTQMKATGE

SEQ ID NO: 1916678 - protein, 6 aa, Staphylococcus
EKGERV

SEQ ID NO: 1916679 - protein, 10 aa, Staphylococcus
EKGGKGGVEL

SEQ ID NO: 1916680 - protein, 5 aa, Staphylococcus
EKGIS

SEQ ID NO: 1916681 - protein, 4 aa, Staphylococcus
EKGL

SEQ ID NO: 1916682 - protein, 9 aa, Staphylococcus
EKGPDVPRG

SEQ ID NO: 1916683 - protein, 12 aa, Staphylococcus
EKIEQGIKRGKK

SEQ ID NO: 1916684 - protein, 19 aa, Staphylococcus
EKITSEAATELPLTQRYFL

SEQ ID NO: 1916685 - protein, 19 aa, Staphylococcus
EKITSEPATELPLTQRYFL

SEQ ID NO: 1916686 - protein, 12 aa, Staphylococcus
EKKAPGAKIQGD

SEQ ID NO: 1916687 - protein, 9 aa, Staphylococcus
EKKDSRIPM

SEQ ID NO: 1916688 - protein, 6 aa, Staphylococcus
EKKGYV

SEQ ID NO: 1916689 - protein, 7 aa, Staphylococcus
EKKQELN

SEQ ID NO: 1916690 - protein, 4 aa, Staphylococcus
EKLN

SEQ ID NO: 1916691 - protein, 12 aa, Staphylococcus
EKLTKEGIDIQS

SEQ ID NO: 1916692 - protein, 12 aa, Staphylococcus
EKMNQNAAGVDV

SEQ ID NO: 1916693 - protein, 23 aa, Staphylococcus
EKNCGYSPQETTKNVKKLKRYRN

SEQ ID NO: 1916694 - protein, 7 aa, Staphylococcus
EKNMAKD

SEQ ID NO: 1916695 - protein, 6 aa, Staphylococcus
EKNTTL

SEQ ID NO: 1916696 - protein, 8 aa, Staphylococcus
EKPGIEGK

SEQ ID NO: 1916697 - protein, 13 aa, Staphylococcus
EKPPIPGRTNSTA

SEQ ID NO: 1916698 - protein, 7 aa, Staphylococcus
EKPTEIQ

SEQ ID NO: 1916699 - protein, 17 aa, Staphylococcus
EKQLEKAKNGEIKDDYI

SEQ ID NO: 1916700 - protein, 11 aa, Staphylococcus
EKRAKDLDDLG

SEQ ID NO: 1916701 - protein, 19 aa, Staphylococcus
EKRLSTKKEVFDEARRKKA

SEQ ID NO: 1916702 - protein, 7 aa, Staphylococcus
EKRPVRY

SEQ ID NO: 1916703 - protein, 4 aa, Staphylococcus
EKSG

SEQ ID NO: 1916704 - protein, 4 aa, Staphylococcus
EKSI

SEQ ID NO: 1916705 - protein, 8 aa, Staphylococcus
EKSSDEAI

SEQ ID NO: 1916706 - protein, 7 aa, Staphylococcus
EKTGNPR

SEQ ID NO: 1916707 - protein, 5 aa, Staphylococcus
EKTQR

SEQ ID NO: 1916708 - protein, 5 aa, Staphylococcus
EKVDP

SEQ ID NO: 1916709 - protein, 11 aa, Staphylococcus
EKVSSDDFEKI

SEQ ID NO: 1916710 - protein, 5 aa, Staphylococcus
ELEDY

SEQ ID NO: 1916711 - protein, 4 aa, Staphylococcus
ELEG

SEQ ID NO: 1916712 - protein, 5 aa, Staphylococcus
ELEKE

SEQ ID NO: 1916713 - protein, 4 aa, Staphylococcus
ELEN

SEQ ID NO: 1916714 - protein, 11 aa, Staphylococcus
ELENGRIKDDD

SEQ ID NO: 1916715 - protein, 4 aa, Staphylococcus
ELGE

SEQ ID NO: 1916716 - protein, 9 aa, Staphylococcus
ELGGDAKSI

SEQ ID NO: 1916717 - protein, 10 aa, Staphylococcus
ELGGDAKSIR

SEQ ID NO: 1916718 - protein, 7 aa, Staphylococcus
ELGGKSA

SEQ ID NO: 1916719 - protein, 8 aa, Staphylococcus
ELGGKSPY

SEQ ID NO: 1916720 - protein, 4 aa, Staphylococcus
ELKD

SEQ ID NO: 1916721 - protein, 9 aa, Staphylococcus
ELKDEGKIK

SEQ ID NO: 1916722 - protein, 11 aa, Staphylococcus
ELMKEAEDKVR

SEQ ID NO: 1916723 - protein, 4 aa, Staphylococcus
ELNN

SEQ ID NO: 1916724 - protein, 6 aa, Staphylococcus
ELQTVT

SEQ ID NO: 1916725 - protein, 6 aa, Staphylococcus
ELRDEN

SEQ ID NO: 1916726 - protein, 20 aa, Staphylococcus
ELRDGDKSRYSGKGVTKAVE

SEQ ID NO: 1916727 - protein, 4 aa, Staphylococcus
ELRQ

SEQ ID NO: 1916728 - protein, 7 aa, Staphylococcus
ELRQTDG

SEQ ID NO: 1916729 - protein, 6 aa, Staphylococcus
ELSTDT

SEQ ID NO: 1916730 - protein, 4 aa, Staphylococcus
ELTP

SEQ ID NO: 1916731 - protein, 8 aa, Staphylococcus
EMPEDTKR

SEQ ID NO: 1916732 - protein, 9 aa, Staphylococcus
EMSGGQKQR

SEQ ID NO: 1916733 - protein, 6 aa, Staphylococcus
EMTTNA

SEQ ID NO: 1916734 - protein, 4 aa, Staphylococcus
EMVE

SEQ ID NO: 1916735 - protein, 6 aa, Staphylococcus
ENAAYP

SEQ ID NO: 1916736 - protein, 7 aa, Staphylococcus
ENDESIS

SEQ ID NO: 1916737 - protein, 5 aa, Staphylococcus
ENDVF

SEQ ID NO: 1916738 - protein, 6 aa, Staphylococcus
ENEHRN

SEQ ID NO: 1916739 - protein, 4 aa, Staphylococcus
ENEL

SEQ ID NO: 1916740 - protein, 7 aa, Staphylococcus
ENENDAY

SEQ ID NO: 1916741 - protein, 6 aa, Staphylococcus
ENEVRD

SEQ ID NO: 1916742 - protein, 8 aa, Staphylococcus
ENFGKAKS

SEQ ID NO: 1916743 - protein, 5 aa, Staphylococcus
ENGEI

SEQ ID NO: 1916744 - protein, 6 aa, Staphylococcus
ENGGKL

SEQ ID NO: 1916745 - protein, 5 aa, Staphylococcus
ENGKH

SEQ ID NO: 1916746 - protein, 8 aa, Staphylococcus
ENGQYGKS

SEQ ID NO: 1916747 - protein, 11 aa, Staphylococcus
ENGTEHEGELD

SEQ ID NO: 1916748 - protein, 8 aa, Staphylococcus
ENGTPSLK

SEQ ID NO: 1916749 - protein, 6 aa, Staphylococcus
ENIDGL

SEQ ID NO: 1916750 - protein, 6 aa, Staphylococcus
ENIEET

SEQ ID NO: 1916751 - protein, 4 aa, Staphylococcus
ENIN

SEQ ID NO: 1916752 - protein, 8 aa, Staphylococcus
ENIPKDSK

SEQ ID NO: 1916753 - protein, 5 aa, Staphylococcus
ENISN

SEQ ID NO: 1916754 - protein, 8 aa, Staphylococcus
ENKDETGY

SEQ ID NO: 1916755 - protein, 4 aa, Staphylococcus
ENKI

SEQ ID NO: 1916756 - protein, 10 aa, Staphylococcus
ENKKRKANEI

SEQ ID NO: 1916757 - protein, 8 aa, Staphylococcus
ENKPTTKQ

SEQ ID NO: 1916758 - protein, 6 aa, Staphylococcus
ENMALG

SEQ ID NO: 1916759 - protein, 4 aa, Staphylococcus
ENMG

SEQ ID NO: 1916760 - protein, 9 aa, Staphylococcus
ENNEGELTE

SEQ ID NO: 1916761 - protein, 5 aa, Staphylococcus
ENNEL

SEQ ID NO: 1916762 - protein, 4 aa, Staphylococcus
ENPF

SEQ ID NO: 1916763 - protein, 4 aa, Staphylococcus
ENPQ

SEQ ID NO: 1916764 - protein, 5 aa, Staphylococcus
ENQDD

SEQ ID NO: 1916765 - protein, 4 aa, Staphylococcus
ENQF

SEQ ID NO: 1916766 - protein, 8 aa, Staphylococcus
ENQNGELI

SEQ ID NO: 1916767 - protein, 4 aa, Staphylococcus
ENRL

SEQ ID NO: 1916768 - protein, 4 aa, Staphylococcus
ENTA

SEQ ID NO: 1916769 - protein, 5 aa, Staphylococcus
ENTPV

SEQ ID NO: 1916770 - protein, 13 aa, Staphylococcus
ENTVEAKRLRNNP

SEQ ID NO: 1916771 - protein, 9 aa, Staphylococcus
ENVQEGRKD

SEQ ID NO: 1916772 - protein, 4 aa, Staphylococcus
ENVT

SEQ ID NO: 1916773 - protein, 5 aa, Staphylococcus
ENYEK

SEQ ID NO: 1916774 - protein, 4 aa, Staphylococcus
ENYP

SEQ ID NO: 1916775 - protein, 18 aa, Staphylococcus
ENYQNAKKQIYKNQTEDD

SEQ ID NO: 1916776 - protein, 5 aa, Staphylococcus
EPASG

SEQ ID NO: 1916777 - protein, 6 aa, Staphylococcus
EPEDGI

SEQ ID NO: 1916778 - protein, 4 aa, Staphylococcus
EPEE

SEQ ID NO: 1916779 - protein, 9 aa, Staphylococcus
EPEEHQSNF

SEQ ID NO: 1916780 - protein, 19 aa, Staphylococcus
EPEGSPVLSGGEPGPHKLQ

SEQ ID NO: 1916781 - protein, 7 aa, Staphylococcus
EPEPHEV

SEQ ID NO: 1916782 - protein, 4 aa, Staphylococcus
EPEQ

SEQ ID NO: 1916783 - protein, 20 aa, Staphylococcus
EPEQLEKSLKEAKSEGQKYF

SEQ ID NO: 1916784 - protein, 4 aa, Staphylococcus
EPET

SEQ ID NO: 1916785 - protein, 5 aa, Staphylococcus
EPFQD

SEQ ID NO: 1916786 - protein, 22 aa, Staphylococcus
EPGGEHKETIETGTKAAARGGF

SEQ ID NO: 1916787 - protein, 6 aa, Staphylococcus
EPGSRT

SEQ ID NO: 1916788 - protein, 12 aa, Staphylococcus
EPGVGKTAIAEG

SEQ ID NO: 1916789 - protein, 15 aa, Staphylococcus
EPIAEEYQANRQKKH

SEQ ID NO: 1916790 - protein, 6 aa, Staphylococcus
EPIGEN

SEQ ID NO: 1916791 - protein, 7 aa, Staphylococcus
EPITEDI

SEQ ID NO: 1916792 - protein, 12 aa, Staphylococcus
EPKTTSKSEQQF

SEQ ID NO: 1916793 - protein, 4 aa, Staphylococcus
EPLD

SEQ ID NO: 1916794 - protein, 6 aa, Staphylococcus
EPLEEE

SEQ ID NO: 1916795 - protein, 4 aa, Staphylococcus
EPLL

SEQ ID NO: 1916796 - protein, 11 aa, Staphylococcus
EPSSGLDGANM

SEQ ID NO: 1916797 - protein, 10 aa, Staphylococcus
EPSSNLDHET

SEQ ID NO: 1916798 - protein, 6 aa, Staphylococcus
EPSYRD

SEQ ID NO: 1916799 - protein, 8 aa, Staphylococcus
EPSYRDNV

SEQ ID NO: 1916800 - protein, 14 aa, Staphylococcus
EPTGALDSKSTQDL

SEQ ID NO: 1916801 - protein, 5 aa, Staphylococcus
EPTKK

SEQ ID NO: 1916802 - protein, 5 aa, Staphylococcus
EPTQY

SEQ ID NO: 1916803 - protein, 11 aa, Staphylococcus
EPTSALDPESI

SEQ ID NO: 1916804 - protein, 11 aa, Staphylococcus
EPTSGLDPVAR

SEQ ID NO: 1916805 - protein, 4 aa, Staphylococcus
EPVE

SEQ ID NO: 1916806 - protein, 4 aa, Staphylococcus
EPVK

SEQ ID NO: 1916807 - protein, 5 aa, Staphylococcus
EPVSL

SEQ ID NO: 1916808 - protein, 5 aa, Staphylococcus
EPYPG

SEQ ID NO: 1916809 - protein, 7 aa, Staphylococcus
EPYTEDA

SEQ ID NO: 1916810 - protein, 9 aa, Staphylococcus
EQAEKDGIS

SEQ ID NO: 1916811 - protein, 6 aa, Staphylococcus
EQAEQG

SEQ ID NO: 1916812 - protein, 4 aa, Staphylococcus
EQAP

SEQ ID NO: 1916813 - protein, 10 aa, Staphylococcus
EQARIAEEAG

SEQ ID NO: 1916814 - protein, 7 aa, Staphylococcus
EQEQPAY

SEQ ID NO: 1916815 - protein, 5 aa, Staphylococcus
EQERE

SEQ ID NO: 1916816 - protein, 19 aa, Staphylococcus
EQGATHAAEGYARVSGKPG

SEQ ID NO: 1916817 - protein, 18 aa, Staphylococcus
EQGATHAAEGYARVSGKT

SEQ ID NO: 1916818 - protein, 8 aa, Staphylococcus
EQGEQAAR

SEQ ID NO: 1916819 - protein, 4 aa, Staphylococcus
EQGI

SEQ ID NO: 1916820 - protein, 6 aa, Staphylococcus
EQGKLD

SEQ ID NO: 1916821 - protein, 15 aa, Staphylococcus
EQGMTPDKPYKKSAR

SEQ ID NO: 1916822 - protein, 15 aa, Staphylococcus
EQGPTIGKEEAESYK

SEQ ID NO: 1916823 - protein, 8 aa, Staphylococcus
EQIETQDE

SEQ ID NO: 1916824 - protein, 10 aa, Staphylococcus
EQKNQKKQDI

SEQ ID NO: 1916825 - protein, 9 aa, Staphylococcus
EQLAKSAKK

SEQ ID NO: 1916826 - protein, 4 aa, Staphylococcus
EQLD

SEQ ID NO: 1916827 - protein, 14 aa, Staphylococcus
EQLDDASWTITIQK

SEQ ID NO: 1916828 - protein, 6 aa, Staphylococcus
EQLGTA

SEQ ID NO: 1916829 - protein, 13 aa, Staphylococcus
EQLKQGQDIVGNR

SEQ ID NO: 1916830 - protein, 9 aa, Staphylococcus
EQLSNEKYR

SEQ ID NO: 1916831 - protein, 8 aa, Staphylococcus
EQLSNQDG

SEQ ID NO: 1916832 - protein, 6 aa, Staphylococcus
EQMSEE

SEQ ID NO: 1916833 - protein, 8 aa, Staphylococcus
EQNNDDNG

SEQ ID NO: 1916834 - protein, 8 aa, Staphylococcus
EQPKSERL

SEQ ID NO: 1916835 - protein, 4 aa, Staphylococcus
EQPL

SEQ ID NO: 1916836 - protein, 11 aa, Staphylococcus
EQSAKSLRGSK

SEQ ID NO: 1916837 - protein, 8 aa, Staphylococcus
EQSDYANG

SEQ ID NO: 1916838 - protein, 7 aa, Staphylococcus
EQSEVNN

SEQ ID NO: 1916839 - protein, 11 aa, Staphylococcus
EQSGEESSNVW

SEQ ID NO: 1916840 - protein, 16 aa, Staphylococcus
EQSYEYKTKPYEKDYG

SEQ ID NO: 1916841 - protein, 11 aa, Staphylococcus
EQTDVPESSDW

SEQ ID NO: 1916842 - protein, 11 aa, Staphylococcus
EQTIESRSRLE

SEQ ID NO: 1916843 - protein, 5 aa, Staphylococcus
EQTQV

SEQ ID NO: 1916844 - protein, 6 aa, Staphylococcus
EQTSNR

SEQ ID NO: 1916845 - protein, 9 aa, Staphylococcus
EQVNLTPKE

SEQ ID NO: 1916846 - protein, 36 aa, Staphylococcus
ERAARKGRNPQTGKEIEIPASKVPAFKAGKALKDAV

SEQ ID NO: 1916847 - protein, 8 aa, Staphylococcus
ERAKKTGK

SEQ ID NO: 1916848 - protein, 6 aa, Staphylococcus
ERALGS

SEQ ID NO: 1916849 - protein, 7 aa, Staphylococcus
ERDDETK

SEQ ID NO: 1916850 - protein, 4 aa, Staphylococcus
ERFQ

SEQ ID NO: 1916851 - protein, 4 aa, Staphylococcus
ERGE

SEQ ID NO: 1916852 - protein, 7 aa, Staphylococcus
ERGEGER

SEQ ID NO: 1916853 - protein, 9 aa, Staphylococcus
ERGENGPYY

SEQ ID NO: 1916854 - protein, 6 aa, Staphylococcus
ERGLTE

SEQ ID NO: 1916855 - protein, 7 aa, Staphylococcus
ERGPRRV

SEQ ID NO: 1916856 - protein, 6 aa, Staphylococcus
ERIDRD

SEQ ID NO: 1916857 - protein, 5 aa, Staphylococcus
ERIGD

SEQ ID NO: 1916858 - protein, 8 aa, Staphylococcus
ERKNKMTE

SEQ ID NO: 1916859 - protein, 10 aa, Staphylococcus
ERKRDEKLAK

SEQ ID NO: 1916860 - protein, 15 aa, Staphylococcus
ERKRNQSETNARFEE

SEQ ID NO: 1916861 - protein, 5 aa, Staphylococcus
ERLGI

SEQ ID NO: 1916862 - protein, 8 aa, Staphylococcus
ERMGDNAA

SEQ ID NO: 1916863 - protein, 15 aa, Staphylococcus
ERNEARKNKDFARAD

SEQ ID NO: 1916864 - protein, 9 aa, Staphylococcus
ERPEEVTDI

SEQ ID NO: 1916865 - protein, 6 aa, Staphylococcus
ERPLET

SEQ ID NO: 1916866 - protein, 9 aa, Staphylococcus
ERQDEDEPL

SEQ ID NO: 1916867 - protein, 5 aa, Staphylococcus
ERQQI

SEQ ID NO: 1916868 - protein, 5 aa, Staphylococcus
ERQVR

SEQ ID NO: 1916869 - protein, 9 aa, Staphylococcus
ERSEQGPYY

SEQ ID NO: 1916870 - protein, 5 aa, Staphylococcus
ERSYY

SEQ ID NO: 1916871 - protein, 18 aa, Staphylococcus
ERTGQSIEKIQQDTDRDN

SEQ ID NO: 1916872 - protein, 10 aa, Staphylococcus
ERTPRGRKAT

SEQ ID NO: 1916873 - protein, 12 aa, Staphylococcus
ERTPRGRKATPL

SEQ ID NO: 1916874 - protein, 7 aa, Staphylococcus
ERTQALG

SEQ ID NO: 1916875 - protein, 5 aa, Staphylococcus
ERVAE

SEQ ID NO: 1916876 - protein, 4 aa, Staphylococcus
ERVG

SEQ ID NO: 1916877 - protein, 5 aa, Staphylococcus
ERVGD

SEQ ID NO: 1916878 - protein, 6 aa, Staphylococcus
ERVGPF

SEQ ID NO: 1916879 - protein, 5 aa, Staphylococcus
ERVTE

SEQ ID NO: 1916880 - protein, 4 aa, Staphylococcus
ERYP

SEQ ID NO: 1916881 - protein, 11 aa, Staphylococcus
ERYRNKREQNQ

SEQ ID NO: 1916882 - protein, 7 aa, Staphylococcus
ESAKAGV

SEQ ID NO: 1916883 - protein, 12 aa, Staphylococcus
ESAKSAKSFGMD

SEQ ID NO: 1916884 - protein, 11 aa, Staphylococcus
ESAKSAQSFGM

SEQ ID NO: 1916885 - protein, 6 aa, Staphylococcus
ESANAG

SEQ ID NO: 1916886 - protein, 8 aa, Staphylococcus
ESDLKEGA

SEQ ID NO: 1916887 - protein, 7 aa, Staphylococcus
ESEGPFE

SEQ ID NO: 1916888 - protein, 4 aa, Staphylococcus
ESER

SEQ ID NO: 1916889 - protein, 5 aa, Staphylococcus
ESERY

SEQ ID NO: 1916890 - protein, 6 aa, Staphylococcus
ESFGAK

SEQ ID NO: 1916891 - protein, 7 aa, Staphylococcus
ESFNDSS

SEQ ID NO: 1916892 - protein, 12 aa, Staphylococcus
ESGCGKSTTGKA

SEQ ID NO: 1916893 - protein, 18 aa, Staphylococcus
ESGESAYETMALKELGMK

SEQ ID NO: 1916894 - protein, 4 aa, Staphylococcus
ESGI

SEQ ID NO: 1916895 - protein, 8 aa, Staphylococcus
ESGSGKSL

SEQ ID NO: 1916896 - protein, 9 aa, Staphylococcus
ESGSGKSLL

SEQ ID NO: 1916897 - protein, 6 aa, Staphylococcus
ESIDSK

SEQ ID NO: 1916898 - protein, 4 aa, Staphylococcus
ESIE

SEQ ID NO: 1916899 - protein, 23 aa, Staphylococcus
ESIEQAVERAGTKAGNKGAEAAV

SEQ ID NO: 1916900 - protein, 23 aa, Staphylococcus
ESIEQAVERAGTKAGNKGSEAAV

SEQ ID NO: 1916901 - protein, 9 aa, Staphylococcus
ESKDEIGDT

SEQ ID NO: 1916902 - protein, 5 aa, Staphylococcus
ESLRQ

SEQ ID NO: 1916903 - protein, 6 aa, Staphylococcus
ESLTPT

SEQ ID NO: 1916904 - protein, 6 aa, Staphylococcus
ESMSQS

SEQ ID NO: 1916905 - protein, 8 aa, Staphylococcus
ESNDMPDG

SEQ ID NO: 1916906 - protein, 7 aa, Staphylococcus
ESNGFNT

SEQ ID NO: 1916907 - protein, 7 aa, Staphylococcus
ESPTSGD

SEQ ID NO: 1916908 - protein, 9 aa, Staphylococcus
ESQHASPSM

SEQ ID NO: 1916909 - protein, 15 aa, Staphylococcus
ESRDGKIKVTSKGKQ

SEQ ID NO: 1916910 - protein, 10 aa, Staphylococcus
ESSNKNTRDI

SEQ ID NO: 1916911 - protein, 7 aa, Staphylococcus
ESSYNQS

SEQ ID NO: 1916912 - protein, 5 aa, Staphylococcus
ESTGG

SEQ ID NO: 1916913 - protein, 8 aa, Staphylococcus
ESTTPSIK

SEQ ID NO: 1916914 - protein, 9 aa, Staphylococcus
ESTTPSIQK

SEQ ID NO: 1916915 - protein, 19 aa, Staphylococcus
ESVDKDKGYGPYRQSERAD

SEQ ID NO: 1916916 - protein, 6 aa, Staphylococcus
ESVDTL

SEQ ID NO: 1916917 - protein, 5 aa, Staphylococcus
ESVYE

SEQ ID NO: 1916918 - protein, 5 aa, Staphylococcus
ESYGV

SEQ ID NO: 1916919 - protein, 6 aa, Staphylococcus
ESYMKE

SEQ ID NO: 1916920 - protein, 6 aa, Staphylococcus
ETAIPE

SEQ ID NO: 1916921 - protein, 6 aa, Staphylococcus
ETAKRM

SEQ ID NO: 1916922 - protein, 4 aa, Staphylococcus
ETAQ

SEQ ID NO: 1916923 - protein, 4 aa, Staphylococcus
ETAR

SEQ ID NO: 1916924 - protein, 4 aa, Staphylococcus
ETCP

SEQ ID NO: 1916925 - protein, 5 aa, Staphylococcus
ETCTG

SEQ ID NO: 1916926 - protein, 5 aa, Staphylococcus
ETDAK

SEQ ID NO: 1916927 - protein, 7 aa, Staphylococcus
ETDEETM

SEQ ID NO: 1916928 - protein, 9 aa, Staphylococcus
ETDEQAKRE

SEQ ID NO: 1916929 - protein, 9 aa, Staphylococcus
ETDSSESFS

SEQ ID NO: 1916930 - protein, 4 aa, Staphylococcus
ETDY

SEQ ID NO: 1916931 - protein, 12 aa, Staphylococcus
ETEERTGFVSKT

SEQ ID NO: 1916932 - protein, 4 aa, Staphylococcus
ETEK

SEQ ID NO: 1916933 - protein, 6 aa, Staphylococcus
ETEKYP

SEQ ID NO: 1916934 - protein, 7 aa, Staphylococcus
ETEMNGE

SEQ ID NO: 1916935 - protein, 5 aa, Staphylococcus
ETESD

SEQ ID NO: 1916936 - protein, 6 aa, Staphylococcus
ETETFE

SEQ ID NO: 1916937 - protein, 6 aa, Staphylococcus
ETETPK

SEQ ID NO: 1916938 - protein, 5 aa, Staphylococcus
ETFER

SEQ ID NO: 1916939 - protein, 6 aa, Staphylococcus
ETFPQE

SEQ ID NO: 1916940 - protein, 8 aa, Staphylococcus
ETGAQGKI

SEQ ID NO: 1916941 - protein, 4 aa, Staphylococcus
ETGD

SEQ ID NO: 1916942 - protein, 4 aa, Staphylococcus
ETGH

SEQ ID NO: 1916943 - protein, 13 aa, Staphylococcus
ETGKKFNNNKQAL

SEQ ID NO: 1916944 - protein, 9 aa, Staphylococcus
ETGKPGYGL

SEQ ID NO: 1916945 - protein, 9 aa, Staphylococcus
ETGSPSLRK

SEQ ID NO: 1916946 - protein, 5 aa, Staphylococcus
ETGSR

SEQ ID NO: 1916947 - protein, 8 aa, Staphylococcus
ETGTQGKI

SEQ ID NO: 1916948 - protein, 7 aa, Staphylococcus
ETGTTGT

SEQ ID NO: 1916949 - protein, 5 aa, Staphylococcus
ETHER

SEQ ID NO: 1916950 - protein, 11 aa, Staphylococcus
ETKPGVGYPKR

SEQ ID NO: 1916951 - protein, 5 aa, Staphylococcus
ETKSI

SEQ ID NO: 1916952 - protein, 5 aa, Staphylococcus
ETKYR

SEQ ID NO: 1916953 - protein, 4 aa, Staphylococcus
ETLD

SEQ ID NO: 1916954 - protein, 15 aa, Staphylococcus
ETLDTGKTLEESYAD

SEQ ID NO: 1916955 - protein, 5 aa, Staphylococcus
ETLEK

SEQ ID NO: 1916956 - protein, 4 aa, Staphylococcus
ETLK

SEQ ID NO: 1916957 - protein, 4 aa, Staphylococcus
ETLR

SEQ ID NO: 1916958 - protein, 4 aa, Staphylococcus
ETLS

SEQ ID NO: 1916959 - protein, 4 aa, Staphylococcus
ETMD

SEQ ID NO: 1916960 - protein, 15 aa, Staphylococcus
ETMGPDRDFEPTRQK

SEQ ID NO: 1916961 - protein, 5 aa, Staphylococcus
ETNED

SEQ ID NO: 1916962 - protein, 4 aa, Staphylococcus
ETNG

SEQ ID NO: 1916963 - protein, 6 aa, Staphylococcus
ETNVSS

SEQ ID NO: 1916964 - protein, 4 aa, Staphylococcus
ETPE

SEQ ID NO: 1916965 - protein, 9 aa, Staphylococcus
ETPNGNGGI

SEQ ID NO: 1916966 - protein, 14 aa, Staphylococcus
ETPNTIKATGGFAK

SEQ ID NO: 1916967 - protein, 14 aa, Staphylococcus
ETPSTIKATGGFAK

SEQ ID NO: 1916968 - protein, 10 aa, Staphylococcus
ETREPHAGEV

SEQ ID NO: 1916969 - protein, 10 aa, Staphylococcus
ETRGEKLESA

SEQ ID NO: 1916970 - protein, 9 aa, Staphylococcus
ETRPLSASK

SEQ ID NO: 1916971 - protein, 7 aa, Staphylococcus
ETSANEK

SEQ ID NO: 1916972 - protein, 5 aa, Staphylococcus
ETSAS

SEQ ID NO: 1916973 - protein, 10 aa, Staphylococcus
ETSEVRGKKV

SEQ ID NO: 1916974 - protein, 6 aa, Staphylococcus
ETSLEG

SEQ ID NO: 1916975 - protein, 4 aa, Staphylococcus
ETSN

SEQ ID NO: 1916976 - protein, 5 aa, Staphylococcus
ETSNP

SEQ ID NO: 1916977 - protein, 14 aa, Staphylococcus
ETSTSSVQKGESLY

SEQ ID NO: 1916978 - protein, 4 aa, Staphylococcus
ETTN

SEQ ID NO: 1916979 - protein, 9 aa, Staphylococcus
ETVDKEKGI

SEQ ID NO: 1916980 - protein, 11 aa, Staphylococcus
ETVTPTDNQEA

SEQ ID NO: 1916981 - protein, 4 aa, Staphylococcus
ETYN

SEQ ID NO: 1916982 - protein, 5 aa, Staphylococcus
ETYTD

SEQ ID NO: 1916983 - protein, 9 aa, Staphylococcus
EVAAEQGTK

SEQ ID NO: 1916984 - protein, 4 aa, Staphylococcus
EVEE

SEQ ID NO: 1916985 - protein, 6 aa, Staphylococcus
EVEGAK

SEQ ID NO: 1916986 - protein, 4 aa, Staphylococcus
EVET

SEQ ID NO: 1916987 - protein, 7 aa, Staphylococcus
EVETAKR

SEQ ID NO: 1916988 - protein, 5 aa, Staphylococcus
EVGQE

SEQ ID NO: 1916989 - protein, 5 aa, Staphylococcus
EVGRE

SEQ ID NO: 1916990 - protein, 7 aa, Staphylococcus
EVKDSDG

SEQ ID NO: 1916991 - protein, 14 aa, Staphylococcus
EVKGVRTNIGTEYR

SEQ ID NO: 1916992 - protein, 9 aa, Staphylococcus
EVKKPETIN

SEQ ID NO: 1916993 - protein, 19 aa, Staphylococcus
EVKYTENYRPISKSTTMRV

SEQ ID NO: 1916994 - protein, 15 aa, Staphylococcus
EVLTGSTRLKSGTAQ

SEQ ID NO: 1916995 - protein, 6 aa, Staphylococcus
EVNEKL

SEQ ID NO: 1916996 - protein, 7 aa, Staphylococcus
EVNENGM

SEQ ID NO: 1916997 - protein, 4 aa, Staphylococcus
EVPA

SEQ ID NO: 1916998 - protein, 5 aa, Staphylococcus
EVPDI

SEQ ID NO: 1916999 - protein, 12 aa, Staphylococcus
EVPELSRQSKGI

SEQ ID NO: 1917000 - protein, 8 aa, Staphylococcus
EVPETLKG

SEQ ID NO: 1917001 - protein, 5 aa, Staphylococcus
EVPKE

SEQ ID NO: 1917002 - protein, 6 aa, Staphylococcus
EVPQPV

SEQ ID NO: 1917003 - protein, 6 aa, Staphylococcus
EVRKKL

SEQ ID NO: 1917004 - protein, 8 aa, Staphylococcus
EVYDTTTA

SEQ ID NO: 1917005 - protein, 5 aa, Staphylococcus
EYAEP

SEQ ID NO: 1917006 - protein, 6 aa, Staphylococcus
EYDSTE

SEQ ID NO: 1917007 - protein, 11 aa, Staphylococcus
EYEEKRQEEEL

SEQ ID NO: 1917008 - protein, 4 aa, Staphylococcus
EYGS

SEQ ID NO: 1917009 - protein, 5 aa, Staphylococcus
EYIDK

SEQ ID NO: 1917010 - protein, 9 aa, Staphylococcus
EYKNRKDDI

SEQ ID NO: 1917011 - protein, 10 aa, Staphylococcus
EYKPTEENKK

SEQ ID NO: 1917012 - protein, 4 aa, Staphylococcus
EYQT

SEQ ID NO: 1917013 - protein, 5 aa, Staphylococcus
EYRQD

SEQ ID NO: 1917014 - protein, 13 aa, Staphylococcus
FADPDGHKYNFLV

SEQ ID NO: 1917015 - protein, 6 aa, Staphylococcus
FAEEEN

SEQ ID NO: 1917016 - protein, 25 aa, Staphylococcus
FAKGQKGSSAMPHKRNPIGSENITG

SEQ ID NO: 1917017 - protein, 11 aa, Staphylococcus
FAPEGQDPSMI

SEQ ID NO: 1917018 - protein, 7 aa, Staphylococcus
FAPGVSA

SEQ ID NO: 1917019 - protein, 4 aa, Staphylococcus
FAPT

SEQ ID NO: 1917020 - protein, 7 aa, Staphylococcus
FAPTRTF

SEQ ID NO: 1917021 - protein, 4 aa, Staphylococcus
FASE

SEQ ID NO: 1917022 - protein, 10 aa, Staphylococcus
FDEENDSGAY

SEQ ID NO: 1917023 - protein, 7 aa, Staphylococcus
FDEPPEH

SEQ ID NO: 1917024 - protein, 4 aa, Staphylococcus
FDEQ

SEQ ID NO: 1917025 - protein, 9 aa, Staphylococcus
FDGANDEDV

SEQ ID NO: 1917026 - protein, 5 aa, Staphylococcus
FDGTP

SEQ ID NO: 1917027 - protein, 10 aa, Staphylococcus
FDKETRQSIA

SEQ ID NO: 1917028 - protein, 8 aa, Staphylococcus
FDKPSYKQ

SEQ ID NO: 1917029 - protein, 5 aa, Staphylococcus
FDPNV

SEQ ID NO: 1917030 - protein, 7 aa, Staphylococcus
FDSAEKL

SEQ ID NO: 1917031 - protein, 10 aa, Staphylococcus
FDVTETKGNY

SEQ ID NO: 1917032 - protein, 4 aa, Staphylococcus
FEAG

SEQ ID NO: 1917033 - protein, 6 aa, Staphylococcus
FEGEGC

SEQ ID NO: 1917034 - protein, 8 aa, Staphylococcus
FEKPIPTH

SEQ ID NO: 1917035 - protein, 7 aa, Staphylococcus
FENGKGD

SEQ ID NO: 1917036 - protein, 9 aa, Staphylococcus
FENPANPEV

SEQ ID NO: 1917037 - protein, 5 aa, Staphylococcus
FENSS

SEQ ID NO: 1917038 - protein, 9 aa, Staphylococcus
FEPGDEKEV

SEQ ID NO: 1917039 - protein, 8 aa, Staphylococcus
FEPGDEKK

SEQ ID NO: 1917040 - protein, 6 aa, Staphylococcus
FESKGY

SEQ ID NO: 1917041 - protein, 15 aa, Staphylococcus
FETSTSSVQKGESLY

SEQ ID NO: 1917042 - protein, 19 aa, Staphylococcus
FGDLSENSEYDAAKDEQGF

SEQ ID NO: 1917043 - protein, 4 aa, Staphylococcus
FGGP

SEQ ID NO: 1917044 - protein, 6 aa, Staphylococcus
FGGPKG

SEQ ID NO: 1917045 - protein, 9 aa, Staphylococcus
FGGYDGKGQ

SEQ ID NO: 1917046 - protein, 8 aa, Staphylococcus
FGKTRSTL

SEQ ID NO: 1917047 - protein, 9 aa, Staphylococcus
FGPGNKQAY

SEQ ID NO: 1917048 - protein, 9 aa, Staphylococcus
FGSPKLPHL

SEQ ID NO: 1917049 - protein, 9 aa, Staphylococcus
FGSTDTGNV

SEQ ID NO: 1917050 - protein, 4 aa, Staphylococcus
FGTP

SEQ ID NO: 1917051 - protein, 7 aa, Staphylococcus
FHPTETL

SEQ ID NO: 1917052 - protein, 11 aa, Staphylococcus
FKDDAKEVAQG

SEQ ID NO: 1917053 - protein, 10 aa, Staphylococcus
FKEETETDLF

SEQ ID NO: 1917054 - protein, 6 aa, Staphylococcus
FKNPQQ

SEQ ID NO: 1917055 - protein, 4 aa, Staphylococcus
FKPN

SEQ ID NO: 1917056 - protein, 5 aa, Staphylococcus
FKPSQ

SEQ ID NO: 1917057 - protein, 12 aa, Staphylococcus
FKVEPGNSLSKF

SEQ ID NO: 1917058 - protein, 4 aa, Staphylococcus
FNND

SEQ ID NO: 1917059 - protein, 5 aa, Staphylococcus
FNNNP

SEQ ID NO: 1917060 - protein, 8 aa, Staphylococcus
FNNNPTTI

SEQ ID NO: 1917061 - protein, 5 aa, Staphylococcus
FNPSR

SEQ ID NO: 1917062 - protein, 7 aa, Staphylococcus
FNQSEEE

SEQ ID NO: 1917063 - protein, 9 aa, Staphylococcus
FNSEQQGLR

SEQ ID NO: 1917064 - protein, 6 aa, Staphylococcus
FNTANA

SEQ ID NO: 1917065 - protein, 10 aa, Staphylococcus
FNTGESETPI

SEQ ID NO: 1917066 - protein, 11 aa, Staphylococcus
FNTPHTHGTGC

SEQ ID NO: 1917067 - protein, 12 aa, Staphylococcus
FPASSSGSFKSV

SEQ ID NO: 1917068 - protein, 12 aa, Staphylococcus
FPASSTGSFKSV

SEQ ID NO: 1917069 - protein, 5 aa, Staphylococcus
FPDET

SEQ ID NO: 1917070 - protein, 4 aa, Staphylococcus
FPER

SEQ ID NO: 1917071 - protein, 20 aa, Staphylococcus
FPETSGIGIKPVSKEGTERL

SEQ ID NO: 1917072 - protein, 4 aa, Staphylococcus
FPGV

SEQ ID NO: 1917073 - protein, 11 aa, Staphylococcus
FPGVGKASKKV

SEQ ID NO: 1917074 - protein, 4 aa, Staphylococcus
FPGY

SEQ ID NO: 1917075 - protein, 4 aa, Staphylococcus
FPKG

SEQ ID NO: 1917076 - protein, 10 aa, Staphylococcus
FPTEKKGPSV

SEQ ID NO: 1917077 - protein, 10 aa, Staphylococcus
FQEEDGQDYQ

SEQ ID NO: 1917078 - protein, 11 aa, Staphylococcus
FQKGNEKARER

SEQ ID NO: 1917079 - protein, 8 aa, Staphylococcus
FQKRKDKK

SEQ ID NO: 1917080 - protein, 7 aa, Staphylococcus
FRNNTEY

SEQ ID NO: 1917081 - protein, 7 aa, Staphylococcus
FRPGQKE

SEQ ID NO: 1917082 - protein, 5 aa, Staphylococcus
FRPSY

SEQ ID NO: 1917083 - protein, 7 aa, Staphylococcus
FRTNNDY

SEQ ID NO: 1917084 - protein, 18 aa, Staphylococcus
FSASAAEAIDAKGGAHEV

SEQ ID NO: 1917085 - protein, 11 aa, Staphylococcus
FSDEDGIRAAE

SEQ ID NO: 1917086 - protein, 15 aa, Staphylococcus
FSEDEQAYKDHGGPH

SEQ ID NO: 1917087 - protein, 5 aa, Staphylococcus
FSEKQ

SEQ ID NO: 1917088 - protein, 9 aa, Staphylococcus
FSESVGKDL

SEQ ID NO: 1917089 - protein, 6 aa, Staphylococcus
FSETQG

SEQ ID NO: 1917090 - protein, 7 aa, Staphylococcus
FSGKSEE

SEQ ID NO: 1917091 - protein, 6 aa, Staphylococcus
FSNATE

SEQ ID NO: 1917092 - protein, 9 aa, Staphylococcus
FSNPHEKLS

SEQ ID NO: 1917093 - protein, 11 aa, Staphylococcus
FSPEPSYMPGY

SEQ ID NO: 1917094 - protein, 17 aa, Staphylococcus
FSPQKKPAQIEKDIEKL

SEQ ID NO: 1917095 - protein, 9 aa, Staphylococcus
FSPQSGTIS

SEQ ID NO: 1917096 - protein, 4 aa, Staphylococcus
FSPV

SEQ ID NO: 1917097 - protein, 5 aa, Staphylococcus
FTDIG

SEQ ID NO: 1917098 - protein, 10 aa, Staphylococcus
FTEDAEDAGV

SEQ ID NO: 1917099 - protein, 4 aa, Staphylococcus
FTEN

SEQ ID NO: 1917100 - protein, 16 aa, Staphylococcus
FTGPHGGGGPGSGPVG

SEQ ID NO: 1917101 - protein, 18 aa, Staphylococcus
FTGPHGGGGPGSGPVGVK

SEQ ID NO: 1917102 - protein, 15 aa, Staphylococcus
FTHPGSPNGEFTKET

SEQ ID NO: 1917103 - protein, 9 aa, Staphylococcus
FTKNKTSTV

SEQ ID NO: 1917104 - protein, 10 aa, Staphylococcus
FTQPPPRYTE

SEQ ID NO: 1917105 - protein, 21 aa, Staphylococcus
FTTEPTDGRSTTYSTDVAKGY

SEQ ID NO: 1917106 - protein, 6 aa, Staphylococcus
FVRHGE

SEQ ID NO: 1917107 - protein, 5 aa, Staphylococcus
FYPNG

SEQ ID NO: 1917108 - protein, 9 aa, Staphylococcus
FYQPKPGTD

SEQ ID NO: 1917109 - protein, 12 aa, Staphylococcus
GAAHSTGDTVRP

SEQ ID NO: 1917110 - protein, 7 aa, Staphylococcus
GAANGKT

SEQ ID NO: 1917111 - protein, 11 aa, Staphylococcus
GAANKTDPTRF

SEQ ID NO: 1917112 - protein, 8 aa, Staphylococcus
GADEVDPQ

SEQ ID NO: 1917113 - protein, 7 aa, Staphylococcus
GADGAWS

SEQ ID NO: 1917114 - protein, 8 aa, Staphylococcus
GAENPSID

SEQ ID NO: 1917115 - protein, 5 aa, Staphylococcus
GAESF

SEQ ID NO: 1917116 - protein, 4 aa, Staphylococcus
GAEV

SEQ ID NO: 1917117 - protein, 5 aa, Staphylococcus
GAEYQ

SEQ ID NO: 1917118 - protein, 7 aa, Staphylococcus
GAFGGKK

SEQ ID NO: 1917119 - protein, 12 aa, Staphylococcus
GAGGAEGAIDAS

SEQ ID NO: 1917120 - protein, 9 aa, Staphylococcus
GAGGSIGSE

SEQ ID NO: 1917121 - protein, 6 aa, Staphylococcus
GAGKTE

SEQ ID NO: 1917122 - protein, 9 aa, Staphylococcus
GAGSGGTFT

SEQ ID NO: 1917123 - protein, 4 aa, Staphylococcus
GAIS

SEQ ID NO: 1917124 - protein, 5 aa, Staphylococcus
GAISG

SEQ ID NO: 1917125 - protein, 6 aa, Staphylococcus
GAISGV

SEQ ID NO: 1917126 - protein, 8 aa, Staphylococcus
GAKAPSLV

SEQ ID NO: 1917127 - protein, 9 aa, Staphylococcus
GAKDETVTK

SEQ ID NO: 1917128 - protein, 5 aa, Staphylococcus
GAKDT

SEQ ID NO: 1917129 - protein, 6 aa, Staphylococcus
GAKPSE

SEQ ID NO: 1917130 - protein, 8 aa, Staphylococcus
GAKRAEQV

SEQ ID NO: 1917131 - protein, 5 aa, Staphylococcus
GALGE

SEQ ID NO: 1917132 - protein, 6 aa, Staphylococcus
GAMAKH

SEQ ID NO: 1917133 - protein, 8 aa, Staphylococcus
GAMAKHTE

SEQ ID NO: 1917134 - protein, 7 aa, Staphylococcus
GANGTGD

SEQ ID NO: 1917135 - protein, 6 aa, Staphylococcus
GAPHET

SEQ ID NO: 1917136 - protein, 5 aa, Staphylococcus
GAPTQ

SEQ ID NO: 1917137 - protein, 12 aa, Staphylococcus
GAPTRAVESAGK

SEQ ID NO: 1917138 - protein, 4 aa, Staphylococcus
GAPY

SEQ ID NO: 1917139 - protein, 7 aa, Staphylococcus
GAQRPGH

SEQ ID NO: 1917140 - protein, 6 aa, Staphylococcus
GARKGE

SEQ ID NO: 1917141 - protein, 8 aa, Staphylococcus
GASAPGGL

SEQ ID NO: 1917142 - protein, 8 aa, Staphylococcus
GASEITEK

SEQ ID NO: 1917143 - protein, 8 aa, Staphylococcus
GASEITEQ

SEQ ID NO: 1917144 - protein, 7 aa, Staphylococcus
GASGGVG

SEQ ID NO: 1917145 - protein, 8 aa, Staphylococcus
GASGGVGS

SEQ ID NO: 1917146 - protein, 6 aa, Staphylococcus
GASQYR

SEQ ID NO: 1917147 - protein, 5 aa, Staphylococcus
GASSI

SEQ ID NO: 1917148 - protein, 9 aa, Staphylococcus
GASVYSASE

SEQ ID NO: 1917149 - protein, 15 aa, Staphylococcus
GASVYSASEVARNEF

SEQ ID NO: 1917150 - protein, 5 aa, Staphylococcus
GATSQ

SEQ ID NO: 1917151 - protein, 8 aa, Staphylococcus
GATTTATK

SEQ ID NO: 1917152 - protein, 6 aa, Staphylococcus
GAVGSS

SEQ ID NO: 1917153 - protein, 7 aa, Staphylococcus
GAYGGEI

SEQ ID NO: 1917154 - protein, 4 aa, Staphylococcus
GAYN

SEQ ID NO: 1917155 - protein, 5 aa, Staphylococcus
GAYSN

SEQ ID NO: 1917156 - protein, 8 aa, Staphylococcus
GCGSSREH

SEQ ID NO: 1917157 - protein, 18 aa, Staphylococcus
GDASDNIPGVAGVGEKTA

SEQ ID NO: 1917158 - protein, 7 aa, Staphylococcus
GDDAQSM

SEQ ID NO: 1917159 - protein, 8 aa, Staphylococcus
GDDEHGWN

SEQ ID NO: 1917160 - protein, 17 aa, Staphylococcus
GDEIKENDAKLNEVDNK

SEQ ID NO: 1917161 - protein, 11 aa, Staphylococcus
GDELSRTKGFD

SEQ ID NO: 1917162 - protein, 10 aa, Staphylococcus
GDEQSIEQSL

SEQ ID NO: 1917163 - protein, 4 aa, Staphylococcus
GDEV

SEQ ID NO: 1917164 - protein, 4 aa, Staphylococcus
GDFH

SEQ ID NO: 1917165 - protein, 5 aa, Staphylococcus
GDGAF

SEQ ID NO: 1917166 - protein, 6 aa, Staphylococcus
GDGKEN

SEQ ID NO: 1917167 - protein, 8 aa, Staphylococcus
GDGQLNSQ

SEQ ID NO: 1917168 - protein, 15 aa, Staphylococcus
GDGSYRGAQRISEEC

SEQ ID NO: 1917169 - protein, 4 aa, Staphylococcus
GDHF

SEQ ID NO: 1917170 - protein, 11 aa, Staphylococcus
GDLPATQQAPL

SEQ ID NO: 1917171 - protein, 18 aa, Staphylococcus
GDNKGRRVSSVSSGSVTL

SEQ ID NO: 1917172 - protein, 7 aa, Staphylococcus
GDNPERL

SEQ ID NO: 1917173 - protein, 5 aa, Staphylococcus
GDPEL

SEQ ID NO: 1917174 - protein, 6 aa, Staphylococcus
GDPFDE

SEQ ID NO: 1917175 - protein, 7 aa, Staphylococcus
GDPITER

SEQ ID NO: 1917176 - protein, 19 aa, Staphylococcus
GDPQFEGQTKTKLGNSEVR

SEQ ID NO: 1917177 - protein, 15 aa, Staphylococcus
GDSAGGSAKLGRDRK

SEQ ID NO: 1917178 - protein, 4 aa, Staphylococcus
GDSE

SEQ ID NO: 1917179 - protein, 8 aa, Staphylococcus
GDSVDKGE

SEQ ID NO: 1917180 - protein, 8 aa, Staphylococcus
GDSVEKGE

SEQ ID NO: 1917181 - protein, 4 aa, Staphylococcus
GDTE

SEQ ID NO: 1917182 - protein, 5 aa, Staphylococcus
GDTLD

SEQ ID NO: 1917183 - protein, 5 aa, Staphylococcus
GDTTH

SEQ ID NO: 1917184 - protein, 4 aa, Staphylococcus
GDVI

SEQ ID NO: 1917185 - protein, 10 aa, Staphylococcus
GDVKNTYGTG

SEQ ID NO: 1917186 - protein, 8 aa, Staphylococcus
GDVRDKGL

SEQ ID NO: 1917187 - protein, 4 aa, Staphylococcus
GDYE

SEQ ID NO: 1917188 - protein, 12 aa, Staphylococcus
GDYSKKAQDDVL

SEQ ID NO: 1917189 - protein, 8 aa, Staphylococcus
GDYSTTAI

SEQ ID NO: 1917190 - protein, 4 aa, Staphylococcus
GEAE

SEQ ID NO: 1917191 - protein, 8 aa, Staphylococcus
GEAYGYAT

SEQ ID NO: 1917192 - protein, 15 aa, Staphylococcus
GEDEIGDEDNDKVKA

SEQ ID NO: 1917193 - protein, 7 aa, Staphylococcus
GEDGELY

SEQ ID NO: 1917194 - protein, 7 aa, Staphylococcus
GEDSPEH

SEQ ID NO: 1917195 - protein, 4 aa, Staphylococcus
GEEL

SEQ ID NO: 1917196 - protein, 7 aa, Staphylococcus
GEEYEPG

SEQ ID NO: 1917197 - protein, 11 aa, Staphylococcus
GEFQRNPDTDR

SEQ ID NO: 1917198 - protein, 4 aa, Staphylococcus
GEGC

SEQ ID NO: 1917199 - protein, 19 aa, Staphylococcus
GEGMEKREENFADEVKGQM

SEQ ID NO: 1917200 - protein, 7 aa, Staphylococcus
GEIPDYP

SEQ ID NO: 1917201 - protein, 8 aa, Staphylococcus
GEISGRPK

SEQ ID NO: 1917202 - protein, 10 aa, Staphylococcus
GEKVASGEAD

SEQ ID NO: 1917203 - protein, 5 aa, Staphylococcus
GELGK

SEQ ID NO: 1917204 - protein, 18 aa, Staphylococcus
GELHEGDTISVDGSKGDI

SEQ ID NO: 1917205 - protein, 4 aa, Staphylococcus
GELN

SEQ ID NO: 1917206 - protein, 4 aa, Staphylococcus
GENF

SEQ ID NO: 1917207 - protein, 9 aa, Staphylococcus
GENGAGKST

SEQ ID NO: 1917208 - protein, 12 aa, Staphylococcus
GENLGQVASQTL

SEQ ID NO: 1917209 - protein, 4 aa, Staphylococcus
GENS

SEQ ID NO: 1917210 - protein, 6 aa, Staphylococcus
GEPDDV

SEQ ID NO: 1917211 - protein, 6 aa, Staphylococcus
GEPDEV

SEQ ID NO: 1917212 - protein, 6 aa, Staphylococcus
GEPFEP

SEQ ID NO: 1917213 - protein, 4 aa, Staphylococcus
GEPK

SEQ ID NO: 1917214 - protein, 8 aa, Staphylococcus
GEPQAPGQ

SEQ ID NO: 1917215 - protein, 14 aa, Staphylococcus
GEQFEGGQADGYDL

SEQ ID NO: 1917216 - protein, 6 aa, Staphylococcus
GERDGF

SEQ ID NO: 1917217 - protein, 12 aa, Staphylococcus
GERDMTKTPEMG

SEQ ID NO: 1917218 - protein, 13 aa, Staphylococcus
GERMGQGKENVKT

SEQ ID NO: 1917219 - protein, 5 aa, Staphylococcus
GERPT

SEQ ID NO: 1917220 - protein, 8 aa, Staphylococcus
GERQQDVN

SEQ ID NO: 1917221 - protein, 9 aa, Staphylococcus
GERTPHGDA

SEQ ID NO: 1917222 - protein, 12 aa, Staphylococcus
GERTPHGDASIR

SEQ ID NO: 1917223 - protein, 7 aa, Staphylococcus
GESASDE

SEQ ID NO: 1917224 - protein, 9 aa, Staphylococcus
GESGSGKST

SEQ ID NO: 1917225 - protein, 13 aa, Staphylococcus
GETAAGQYPEEAV

SEQ ID NO: 1917226 - protein, 8 aa, Staphylococcus
GETGASME

SEQ ID NO: 1917227 - protein, 6 aa, Staphylococcus
GETNED

SEQ ID NO: 1917228 - protein, 4 aa, Staphylococcus
GETR

SEQ ID NO: 1917229 - protein, 6 aa, Staphylococcus
GETSDY

SEQ ID NO: 1917230 - protein, 8 aa, Staphylococcus
GETTLEDI

SEQ ID NO: 1917231 - protein, 5 aa, Staphylococcus
GETYG

SEQ ID NO: 1917232 - protein, 10 aa, Staphylococcus
GEVVERPSSV

SEQ ID NO: 1917233 - protein, 8 aa, Staphylococcus
GEYSDCKD

SEQ ID NO: 1917234 - protein, 5 aa, Staphylococcus
GEYSM

SEQ ID NO: 1917235 - protein, 8 aa, Staphylococcus
GFAGGELK

SEQ ID NO: 1917236 - protein, 13 aa, Staphylococcus
GFGGASEGQDYET

SEQ ID NO: 1917237 - protein, 6 aa, Staphylococcus
GFGGGY

SEQ ID NO: 1917238 - protein, 5 aa, Staphylococcus
GFGPF

SEQ ID NO: 1917239 - protein, 4 aa, Staphylococcus
GFGR

SEQ ID NO: 1917240 - protein, 7 aa, Staphylococcus
GFRGEAS

SEQ ID NO: 1917241 - protein, 10 aa, Staphylococcus
GGARSNSAFQ

SEQ ID NO: 1917242 - protein, 9 aa, Staphylococcus
GGASKGIAN

SEQ ID NO: 1917243 - protein, 8 aa, Staphylococcus
GGDISRKR

SEQ ID NO: 1917244 - protein, 8 aa, Staphylococcus
GGDNLAAT

SEQ ID NO: 1917245 - protein, 4 aa, Staphylococcus
GGDP

SEQ ID NO: 1917246 - protein, 14 aa, Staphylococcus
GGEAHITDYSNASR

SEQ ID NO: 1917247 - protein, 18 aa, Staphylococcus
GGEIGQETRRFDESTGKT

SEQ ID NO: 1917248 - protein, 8 aa, Staphylococcus
GGENSTIK

SEQ ID NO: 1917249 - protein, 8 aa, Staphylococcus
GGENTSIK

SEQ ID NO: 1917250 - protein, 9 aa, Staphylococcus
GGEPEASGH

SEQ ID NO: 1917251 - protein, 8 aa, Staphylococcus
GGGATGDF

SEQ ID NO: 1917252 - protein, 4 aa, Staphylococcus
GGGK

SEQ ID NO: 1917253 - protein, 6 aa, Staphylococcus
GGGPGG

SEQ ID NO: 1917254 - protein, 11 aa, Staphylococcus
GGGQEYGLRSG

SEQ ID NO: 1917255 - protein, 5 aa, Staphylococcus
GGGRY

SEQ ID NO: 1917256 - protein, 4 aa, Staphylococcus
GGGT

SEQ ID NO: 1917257 - protein, 5 aa, Staphylococcus
GGGVH

SEQ ID NO: 1917258 - protein, 9 aa, Staphylococcus
GGHKAGEVA

SEQ ID NO: 1917259 - protein, 4 aa, Staphylococcus
GGHP

SEQ ID NO: 1917260 - protein, 14 aa, Staphylococcus
GGHVTGPEDPNIQR

SEQ ID NO: 1917261 - protein, 6 aa, Staphylococcus
GGIKTG

SEQ ID NO: 1917262 - protein, 5 aa, Staphylococcus
GGINP

SEQ ID NO: 1917263 - protein, 4 aa, Staphylococcus
GGKE

SEQ ID NO: 1917264 - protein, 9 aa, Staphylococcus
GGKGANLSE

SEQ ID NO: 1917265 - protein, 9 aa, Staphylococcus
GGKGQVGRV

SEQ ID NO: 1917266 - protein, 6 aa, Staphylococcus
GGKNPN

SEQ ID NO: 1917267 - protein, 5 aa, Staphylococcus
GGKTT

SEQ ID NO: 1917268 - protein, 5 aa, Staphylococcus
GGLGE

SEQ ID NO: 1917269 - protein, 4 aa, Staphylococcus
GGMT

SEQ ID NO: 1917270 - protein, 8 aa, Staphylococcus
GGMTNASK

SEQ ID NO: 1917271 - protein, 9 aa, Staphylococcus
GGNGTGKTT

SEQ ID NO: 1917272 - protein, 20 aa, Staphylococcus
GGNTNYQDTIRRNKALAESG

SEQ ID NO: 1917273 - protein, 8 aa, Staphylococcus
GGNTPIDP

SEQ ID NO: 1917274 - protein, 4 aa, Staphylococcus
GGPE

SEQ ID NO: 1917275 - protein, 10 aa, Staphylococcus
GGPGTGKTTV

SEQ ID NO: 1917276 - protein, 15 aa, Staphylococcus
GGPKWTDPNNRPEQG

SEQ ID NO: 1917277 - protein, 12 aa, Staphylococcus
GGPTQGVPREDG

SEQ ID NO: 1917278 - protein, 6 aa, Staphylococcus
GGQAAN

SEQ ID NO: 1917279 - protein, 14 aa, Staphylococcus
GGQEPGSGEEAAQN

SEQ ID NO: 1917280 - protein, 4 aa, Staphylococcus
GGQF

SEQ ID NO: 1917281 - protein, 10 aa, Staphylococcus
GGQMAKTIDK

SEQ ID NO: 1917282 - protein, 4 aa, Staphylococcus
GGQQ

SEQ ID NO: 1917283 - protein, 11 aa, Staphylococcus
GGRCEACKGDG

SEQ ID NO: 1917284 - protein, 4 aa, Staphylococcus
GGRE

SEQ ID NO: 1917285 - protein, 5 aa, Staphylococcus
GGSAN

SEQ ID NO: 1917286 - protein, 9 aa, Staphylococcus
GGSHSDAPI

SEQ ID NO: 1917287 - protein, 9 aa, Staphylococcus
GGSPEASGH

SEQ ID NO: 1917288 - protein, 10 aa, Staphylococcus
GGSTETSYYK

SEQ ID NO: 1917289 - protein, 10 aa, Staphylococcus
GGTAEEEAAE

SEQ ID NO: 1917290 - protein, 7 aa, Staphylococcus
GGTFGKF

SEQ ID NO: 1917291 - protein, 18 aa, Staphylococcus
GGTIGQETRRFDESTGKT

SEQ ID NO: 1917292 - protein, 11 aa, Staphylococcus
GGTNGKGSTVA

SEQ ID NO: 1917293 - protein, 5 aa, Staphylococcus
GGVDS

SEQ ID NO: 1917294 - protein, 7 aa, Staphylococcus
GGVRTPL

SEQ ID NO: 1917295 - protein, 6 aa, Staphylococcus
GGVTDA

SEQ ID NO: 1917296 - protein, 7 aa, Staphylococcus
GGVTDAD

SEQ ID NO: 1917297 - protein, 7 aa, Staphylococcus
GGYLDGD

SEQ ID NO: 1917298 - protein, 6 aa, Staphylococcus
GHDTVT

SEQ ID NO: 1917299 - protein, 5 aa, Staphylococcus
GHEER

SEQ ID NO: 1917300 - protein, 7 aa, Staphylococcus
GHEHSKH

SEQ ID NO: 1917301 - protein, 23 aa, Staphylococcus
GHGRSLSRLGGGIGTRGPGETKL

SEQ ID NO: 1917302 - protein, 4 aa, Staphylococcus
GHLT

SEQ ID NO: 1917303 - protein, 12 aa, Staphylococcus
GHLTDTKGRRVD

SEQ ID NO: 1917304 - protein, 4 aa, Staphylococcus
GHSL

SEQ ID NO: 1917305 - protein, 5 aa, Staphylococcus
GHSLG

SEQ ID NO: 1917306 - protein, 7 aa, Staphylococcus
GHSNGKQ

SEQ ID NO: 1917307 - protein, 6 aa, Staphylococcus
GHVSVE

SEQ ID NO: 1917308 - protein, 12 aa, Staphylococcus
GHYTERGEDIGY

SEQ ID NO: 1917309 - protein, 4 aa, Staphylococcus
GIAE

SEQ ID NO: 1917310 - protein, 8 aa, Staphylococcus
GIAGDQQA

SEQ ID NO: 1917311 - protein, 7 aa, Staphylococcus
GIDPEKS

SEQ ID NO: 1917312 - protein, 6 aa, Staphylococcus
GIDPKD

SEQ ID NO: 1917313 - protein, 6 aa, Staphylococcus
GIDPKT

SEQ ID NO: 1917314 - protein, 5 aa, Staphylococcus
GIEET

SEQ ID NO: 1917315 - protein, 5 aa, Staphylococcus
GIENN

SEQ ID NO: 1917316 - protein, 5 aa, Staphylococcus
GIETR

SEQ ID NO: 1917317 - protein, 4 aa, Staphylococcus
GIGG

SEQ ID NO: 1917318 - protein, 5 aa, Staphylococcus
GIGSE

SEQ ID NO: 1917319 - protein, 4 aa, Staphylococcus
GIKR

SEQ ID NO: 1917320 - protein, 4 aa, Staphylococcus
GIND

SEQ ID NO: 1917321 - protein, 9 aa, Staphylococcus
GINEPAPEL

SEQ ID NO: 1917322 - protein, 5 aa, Staphylococcus
GIPDT

SEQ ID NO: 1917323 - protein, 7 aa, Staphylococcus
GIPGVSE

SEQ ID NO: 1917324 - protein, 4 aa, Staphylococcus
GIPL

SEQ ID NO: 1917325 - protein, 5 aa, Staphylococcus
GIPTL

SEQ ID NO: 1917326 - protein, 4 aa, Staphylococcus
GIQK

SEQ ID NO: 1917327 - protein, 14 aa, Staphylococcus
GIRRAYETGRGSIQ

SEQ ID NO: 1917328 - protein, 15 aa, Staphylococcus
GISGSYQSATQAGEM

SEQ ID NO: 1917329 - protein, 6 aa, Staphylococcus
GITGAG

SEQ ID NO: 1917330 - protein, 5 aa, Staphylococcus
GITQP

SEQ ID NO: 1917331 - protein, 6 aa, Staphylococcus
GKAANI

SEQ ID NO: 1917332 - protein, 11 aa, Staphylococcus
GKAEVGAPPMS

SEQ ID NO: 1917333 - protein, 8 aa, Staphylococcus
GKASHRGV

SEQ ID NO: 1917334 - protein, 8 aa, Staphylococcus
GKAYGYAT

SEQ ID NO: 1917335 - protein, 7 aa, Staphylococcus
GKDQDQV

SEQ ID NO: 1917336 - protein, 18 aa, Staphylococcus
GKEEGKLEQGGGTDDSTG

SEQ ID NO: 1917337 - protein, 7 aa, Staphylococcus
GKEGLSI

SEQ ID NO: 1917338 - protein, 4 aa, Staphylococcus
GKEI

SEQ ID NO: 1917339 - protein, 9 aa, Staphylococcus
GKEITEYPA

SEQ ID NO: 1917340 - protein, 12 aa, Staphylococcus
GKELPGIKAIND

SEQ ID NO: 1917341 - protein, 12 aa, Staphylococcus
GKELPGIKAINN

SEQ ID NO: 1917342 - protein, 5 aa, Staphylococcus
GKESF

SEQ ID NO: 1917343 - protein, 5 aa, Staphylococcus
GKEVN

SEQ ID NO: 1917344 - protein, 19 aa, Staphylococcus
GKFGGGGYKVSGGLHGVGS

SEQ ID NO: 1917345 - protein, 4 aa, Staphylococcus
GKFR

SEQ ID NO: 1917346 - protein, 4 aa, Staphylococcus
GKGF

SEQ ID NO: 1917347 - protein, 12 aa, Staphylococcus
GKGGGTKLADEL

SEQ ID NO: 1917348 - protein, 12 aa, Staphylococcus
GKGGHGSSPHMA

SEQ ID NO: 1917349 - protein, 8 aa, Staphylococcus
GKGNKERI

SEQ ID NO: 1917350 - protein, 9 aa, Staphylococcus
GKGSAYLGT

SEQ ID NO: 1917351 - protein, 4 aa, Staphylococcus
GKGT

SEQ ID NO: 1917352 - protein, 14 aa, Staphylococcus
GKGTFVKEQDSSIL

SEQ ID NO: 1917353 - protein, 5 aa, Staphylococcus
GKGTV

SEQ ID NO: 1917354 - protein, 7 aa, Staphylococcus
GKHQGDT

SEQ ID NO: 1917355 - protein, 10 aa, Staphylococcus
GKIDEGETQL

SEQ ID NO: 1917356 - protein, 4 aa, Staphylococcus
GKIE

SEQ ID NO: 1917357 - protein, 7 aa, Staphylococcus
GKITERH

SEQ ID NO: 1917358 - protein, 11 aa, Staphylococcus
GKITGAGTDTI

SEQ ID NO: 1917359 - protein, 7 aa, Staphylococcus
GKKDAQQ

SEQ ID NO: 1917360 - protein, 4 aa, Staphylococcus
GKKG

SEQ ID NO: 1917361 - protein, 16 aa, Staphylococcus
GKKGDLASRRNAAKTL

SEQ ID NO: 1917362 - protein, 4 aa, Staphylococcus
GKKT

SEQ ID NO: 1917363 - protein, 10 aa, Staphylococcus
GKLAPKSKAD

SEQ ID NO: 1917364 - protein, 18 aa, Staphylococcus
GKLDGGAQRVPVATGSLT

SEQ ID NO: 1917365 - protein, 10 aa, Staphylococcus
GKLTGGGRGG

SEQ ID NO: 1917366 - protein, 7 aa, Staphylococcus
GKNAAEA

SEQ ID NO: 1917367 - protein, 4 aa, Staphylococcus
GKNE

SEQ ID NO: 1917368 - protein, 9 aa, Staphylococcus
GKNGAGKTT

SEQ ID NO: 1917369 - protein, 10 aa, Staphylococcus
GKPDKKGYRK

SEQ ID NO: 1917370 - protein, 5 aa, Staphylococcus
GKPEE

SEQ ID NO: 1917371 - protein, 14 aa, Staphylococcus
GKPGLVTKEDVKEG

SEQ ID NO: 1917372 - protein, 5 aa, Staphylococcus
GKPIN

SEQ ID NO: 1917373 - protein, 14 aa, Staphylococcus
GKPLFTSEEKFESN

SEQ ID NO: 1917374 - protein, 7 aa, Staphylococcus
GKPLSEL

SEQ ID NO: 1917375 - protein, 5 aa, Staphylococcus
GKQGI

SEQ ID NO: 1917376 - protein, 5 aa, Staphylococcus
GKQGV

SEQ ID NO: 1917377 - protein, 5 aa, Staphylococcus
GKRPF

SEQ ID NO: 1917378 - protein, 7 aa, Staphylococcus
GKSAEHD

SEQ ID NO: 1917379 - protein, 8 aa, Staphylococcus
GKSLSELA

SEQ ID NO: 1917380 - protein, 6 aa, Staphylococcus
GKSVAN

SEQ ID NO: 1917381 - protein, 10 aa, Staphylococcus
GKTDGAMDAG

SEQ ID NO: 1917382 - protein, 8 aa, Staphylococcus
GKTPIGVA

SEQ ID NO: 1917383 - protein, 15 aa, Staphylococcus
GKTRHTKSHQENRGR

SEQ ID NO: 1917384 - protein, 8 aa, Staphylococcus
GKVKTGES

SEQ ID NO: 1917385 - protein, 6 aa, Staphylococcus
GKYVSR

SEQ ID NO: 1917386 - protein, 8 aa, Staphylococcus
GLAEEQNG

SEQ ID NO: 1917387 - protein, 7 aa, Staphylococcus
GLEAPQY

SEQ ID NO: 1917388 - protein, 12 aa, Staphylococcus
GLEDPKTGERPY

SEQ ID NO: 1917389 - protein, 5 aa, Staphylococcus
GLGKD

SEQ ID NO: 1917390 - protein, 6 aa, Staphylococcus
GLGPMT

SEQ ID NO: 1917391 - protein, 7 aa, Staphylococcus
GLGSKKI

SEQ ID NO: 1917392 - protein, 5 aa, Staphylococcus
GLKGV

SEQ ID NO: 1917393 - protein, 9 aa, Staphylococcus
GLKYTKKRE

SEQ ID NO: 1917394 - protein, 9 aa, Staphylococcus
GLNAGEGRV

SEQ ID NO: 1917395 - protein, 12 aa, Staphylococcus
GLNENRVKYNSA

SEQ ID NO: 1917396 - protein, 13 aa, Staphylococcus
GLNERGVSTSNLR

SEQ ID NO: 1917397 - protein, 8 aa, Staphylococcus
GLNGPKAR

SEQ ID NO: 1917398 - protein, 6 aa, Staphylococcus
GLNVPN

SEQ ID NO: 1917399 - protein, 8 aa, Staphylococcus
GLPANRNT

SEQ ID NO: 1917400 - protein, 5 aa, Staphylococcus
GLPQI

SEQ ID NO: 1917401 - protein, 6 aa, Staphylococcus
GLPTPN

SEQ ID NO: 1917402 - protein, 6 aa, Staphylococcus
GLSGEE

SEQ ID NO: 1917403 - protein, 10 aa, Staphylococcus
GLSSNTIGAY

SEQ ID NO: 1917404 - protein, 13 aa, Staphylococcus
GLTDGKNYSGLRR

SEQ ID NO: 1917405 - protein, 12 aa, Staphylococcus
GLTDGKNYTGLR

SEQ ID NO: 1917406 - protein, 7 aa, Staphylococcus
GLTGEEL

SEQ ID NO: 1917407 - protein, 8 aa, Staphylococcus
GMDENDWD

SEQ ID NO: 1917408 - protein, 4 aa, Staphylococcus
GMDS

SEQ ID NO: 1917409 - protein, 9 aa, Staphylococcus
GMKTGEEKD

SEQ ID NO: 1917410 - protein, 9 aa, Staphylococcus
GMPIPNDER

SEQ ID NO: 1917411 - protein, 8 aa, Staphylococcus
GMPPTGGL

SEQ ID NO: 1917412 - protein, 11 aa, Staphylococcus
GMTGTGKLGEK

SEQ ID NO: 1917413 - protein, 4 aa, Staphylococcus
GNAG

SEQ ID NO: 1917414 - protein, 6 aa, Staphylococcus
GNAGIK

SEQ ID NO: 1917415 - protein, 6 aa, Staphylococcus
GNDLDA

SEQ ID NO: 1917416 - protein, 7 aa, Staphylococcus
GNDLEEI

SEQ ID NO: 1917417 - protein, 7 aa, Staphylococcus
GNDPIQN

SEQ ID NO: 1917418 - protein, 4 aa, Staphylococcus
GNEE

SEQ ID NO: 1917419 - protein, 7 aa, Staphylococcus
GNEPLAQ

SEQ ID NO: 1917420 - protein, 7 aa, Staphylococcus
GNETYKT

SEQ ID NO: 1917421 - protein, 8 aa, Staphylococcus
GNETYPTI

SEQ ID NO: 1917422 - protein, 7 aa, Staphylococcus
GNETYRT

SEQ ID NO: 1917423 - protein, 4 aa, Staphylococcus
GNGF

SEQ ID NO: 1917424 - protein, 8 aa, Staphylococcus
GNGGNIAR

SEQ ID NO: 1917425 - protein, 8 aa, Staphylococcus
GNGGTDVT

SEQ ID NO: 1917426 - protein, 10 aa, Staphylococcus
GNGGTEVTKG

SEQ ID NO: 1917427 - protein, 6 aa, Staphylococcus
GNGPQI

SEQ ID NO: 1917428 - protein, 8 aa, Staphylococcus
GNGSLEKK

SEQ ID NO: 1917429 - protein, 5 aa, Staphylococcus
GNIDE

SEQ ID NO: 1917430 - protein, 7 aa, Staphylococcus
GNKEHVA

SEQ ID NO: 1917431 - protein, 16 aa, Staphylococcus
GNKKGIFTRDRKPKAI

SEQ ID NO: 1917432 - protein, 14 aa, Staphylococcus
GNKSITSNSGSTDL

SEQ ID NO: 1917433 - protein, 9 aa, Staphylococcus
GNLTDGQGN

SEQ ID NO: 1917434 - protein, 15 aa, Staphylococcus
GNNGSIDNDPPAAMR

SEQ ID NO: 1917435 - protein, 9 aa, Staphylococcus
GNNKTKREI

SEQ ID NO: 1917436 - protein, 7 aa, Staphylococcus
GNPEEYK

SEQ ID NO: 1917437 - protein, 6 aa, Staphylococcus
GNPKEE

SEQ ID NO: 1917438 - protein, 6 aa, Staphylococcus
GNPKRF

SEQ ID NO: 1917439 - protein, 6 aa, Staphylococcus
GNPRRF

SEQ ID NO: 1917440 - protein, 6 aa, Staphylococcus
GNPYVS

SEQ ID NO: 1917441 - protein, 10 aa, Staphylococcus
GNSGDEKEIS

SEQ ID NO: 1917442 - protein, 12 aa, Staphylococcus
GNSGGIVSSEPL

SEQ ID NO: 1917443 - protein, 8 aa, Staphylococcus
GNSGTTTR

SEQ ID NO: 1917444 - protein, 15 aa, Staphylococcus
GNTPDENGKLKGDVE

SEQ ID NO: 1917445 - protein, 4 aa, Staphylococcus
GNTV

SEQ ID NO: 1917446 - protein, 4 aa, Staphylococcus
GNYE

SEQ ID NO: 1917447 - protein, 11 aa, Staphylococcus
GNYNLGGEQSG

SEQ ID NO: 1917448 - protein, 15 aa, Staphylococcus
GNYRKPGSGAYPLRG

SEQ ID NO: 1917449 - protein, 8 aa, Staphylococcus
GPATDATI

SEQ ID NO: 1917450 - protein, 9 aa, Staphylococcus
GPDAVKTGM

SEQ ID NO: 1917451 - protein, 4 aa, Staphylococcus
GPDN

SEQ ID NO: 1917452 - protein, 10 aa, Staphylococcus
GPGAGNHGGE

SEQ ID NO: 1917453 - protein, 7 aa, Staphylococcus
GPGMGSL

SEQ ID NO: 1917454 - protein, 10 aa, Staphylococcus
GPGPGLDGGK

SEQ ID NO: 1917455 - protein, 13 aa, Staphylococcus
GPHQKKEKEREIG

SEQ ID NO: 1917456 - protein, 7 aa, Staphylococcus
GPKENSI

SEQ ID NO: 1917457 - protein, 8 aa, Staphylococcus
GPKRSEEL

SEQ ID NO: 1917458 - protein, 13 aa, Staphylococcus
GPMKAGLSAHGKA

SEQ ID NO: 1917459 - protein, 9 aa, Staphylococcus
GPNGAGKSS

SEQ ID NO: 1917460 - protein, 9 aa, Staphylococcus
GPNGSGKST

SEQ ID NO: 1917461 - protein, 8 aa, Staphylococcus
GPNGVGKT

SEQ ID NO: 1917462 - protein, 8 aa, Staphylococcus
GPNIGGSR

SEQ ID NO: 1917463 - protein, 9 aa, Staphylococcus
GPNIGGSRI

SEQ ID NO: 1917464 - protein, 6 aa, Staphylococcus
GPQAVE

SEQ ID NO: 1917465 - protein, 10 aa, Staphylococcus
GPQKGATEKM

SEQ ID NO: 1917466 - protein, 16 aa, Staphylococcus
GPRRGDGAESVIIELV

SEQ ID NO: 1917467 - protein, 5 aa, Staphylococcus
GPRVI

SEQ ID NO: 1917468 - protein, 6 aa, Staphylococcus
GPRVIT

SEQ ID NO: 1917469 - protein, 10 aa, Staphylococcus
GPSGSGKTTT

SEQ ID NO: 1917470 - protein, 7 aa, Staphylococcus
GPSPAAI

SEQ ID NO: 1917471 - protein, 13 aa, Staphylococcus
GPTAIATSTEDVV

SEQ ID NO: 1917472 - protein, 9 aa, Staphylococcus
GPTAPTTAF

SEQ ID NO: 1917473 - protein, 8 aa, Staphylococcus
GPTPRSYA

SEQ ID NO: 1917474 - protein, 6 aa, Staphylococcus
GQAISK

SEQ ID NO: 1917475 - protein, 10 aa, Staphylococcus
GQDKEATATM

SEQ ID NO: 1917476 - protein, 11 aa, Staphylococcus
GQDKEATQQAR

SEQ ID NO: 1917477 - protein, 16 aa, Staphylococcus
GQGNFGSMDGDGAAAM

SEQ ID NO: 1917478 - protein, 16 aa, Staphylococcus
GQGTRLGYKGPKGSFE

SEQ ID NO: 1917479 - protein, 4 aa, Staphylococcus
GQKA

SEQ ID NO: 1917480 - protein, 7 aa, Staphylococcus
GQMNRVG

SEQ ID NO: 1917481 - protein, 6 aa, Staphylococcus
GQPIGS

SEQ ID NO: 1917482 - protein, 7 aa, Staphylococcus
GQPITER

SEQ ID NO: 1917483 - protein, 5 aa, Staphylococcus
GQPVD

SEQ ID NO: 1917484 - protein, 6 aa, Staphylococcus
GQQKFR

SEQ ID NO: 1917485 - protein, 9 aa, Staphylococcus
GQRTDITND

SEQ ID NO: 1917486 - protein, 11 aa, Staphylococcus
GQSGNLTPADK

SEQ ID NO: 1917487 - protein, 8 aa, Staphylococcus
GQSGVGKT

SEQ ID NO: 1917488 - protein, 8 aa, Staphylococcus
GQTETTID

SEQ ID NO: 1917489 - protein, 9 aa, Staphylococcus
GQTGSGKST

SEQ ID NO: 1917490 - protein, 21 aa, Staphylococcus
GQVAQDDLEISSNSAQRGNIS

SEQ ID NO: 1917491 - protein, 4 aa, Staphylococcus
GRAQ

SEQ ID NO: 1917492 - protein, 9 aa, Staphylococcus
GRFSETSRE

SEQ ID NO: 1917493 - protein, 6 aa, Staphylococcus
GRGLTD

SEQ ID NO: 1917494 - protein, 8 aa, Staphylococcus
GRGPTNRE

SEQ ID NO: 1917495 - protein, 4 aa, Staphylococcus
GRGQ

SEQ ID NO: 1917496 - protein, 20 aa, Staphylococcus
GRGTESDEKIQSRVNEARKE

SEQ ID NO: 1917497 - protein, 8 aa, Staphylococcus
GRHGNKGV

SEQ ID NO: 1917498 - protein, 8 aa, Staphylococcus
GRIGAATG

SEQ ID NO: 1917499 - protein, 13 aa, Staphylococcus
GRKRQTQAAAGVE

SEQ ID NO: 1917500 - protein, 15 aa, Staphylococcus
GRKRQTQAAAGVESM

SEQ ID NO: 1917501 - protein, 6 aa, Staphylococcus
GRLQNK

SEQ ID NO: 1917502 - protein, 9 aa, Staphylococcus
GRNGEGKTT

SEQ ID NO: 1917503 - protein, 5 aa, Staphylococcus
GRPLV

SEQ ID NO: 1917504 - protein, 9 aa, Staphylococcus
GRPTNGMSV

SEQ ID NO: 1917505 - protein, 5 aa, Staphylococcus
GRRMS

SEQ ID NO: 1917506 - protein, 7 aa, Staphylococcus
GRSEEQI

SEQ ID NO: 1917507 - protein, 8 aa, Staphylococcus
GRSEGARV

SEQ ID NO: 1917508 - protein, 4 aa, Staphylococcus
GRTE

SEQ ID NO: 1917509 - protein, 10 aa, Staphylococcus
GRTGRGNYKG

SEQ ID NO: 1917510 - protein, 9 aa, Staphylococcus
GRTGRGNYR

SEQ ID NO: 1917511 - protein, 12 aa, Staphylococcus
GRVQSGEKMKYT

SEQ ID NO: 1917512 - protein, 7 aa, Staphylococcus
GRYGGRI

SEQ ID NO: 1917513 - protein, 7 aa, Staphylococcus
GRYKANK

SEQ ID NO: 1917514 - protein, 14 aa, Staphylococcus
GSAGAGSKPNPLLP

SEQ ID NO: 1917515 - protein, 9 aa, Staphylococcus
GSATNDGGV

SEQ ID NO: 1917516 - protein, 8 aa, Staphylococcus
GSAYYAPA

SEQ ID NO: 1917517 - protein, 8 aa, Staphylococcus
GSDGENHR

SEQ ID NO: 1917518 - protein, 8 aa, Staphylococcus
GSDGSGGK

SEQ ID NO: 1917519 - protein, 5 aa, Staphylococcus
GSDLP

SEQ ID NO: 1917520 - protein, 13 aa, Staphylococcus
GSDREQSIATKEL

SEQ ID NO: 1917521 - protein, 10 aa, Staphylococcus
GSDSVESAER

SEQ ID NO: 1917522 - protein, 5 aa, Staphylococcus
GSEFG

SEQ ID NO: 1917523 - protein, 4 aa, Staphylococcus
GSEL

SEQ ID NO: 1917524 - protein, 14 aa, Staphylococcus
GSEPLDNTSIHPES

SEQ ID NO: 1917525 - protein, 5 aa, Staphylococcus
GSERP

SEQ ID NO: 1917526 - protein, 6 aa, Staphylococcus
GSEVGD

SEQ ID NO: 1917527 - protein, 5 aa, Staphylococcus
GSEVS

SEQ ID NO: 1917528 - protein, 9 aa, Staphylococcus
GSFPQTREV

SEQ ID NO: 1917529 - protein, 4 aa, Staphylococcus
GSGF

SEQ ID NO: 1917530 - protein, 12 aa, Staphylococcus
GSGGLPVGTGGK

SEQ ID NO: 1917531 - protein, 11 aa, Staphylococcus
GSGGSTGDDQT

SEQ ID NO: 1917532 - protein, 7 aa, Staphylococcus
GSGGTFT

SEQ ID NO: 1917533 - protein, 7 aa, Staphylococcus
GSGIGDI

SEQ ID NO: 1917534 - protein, 7 aa, Staphylococcus
GSGKSTL

SEQ ID NO: 1917535 - protein, 5 aa, Staphylococcus
GSGKT

SEQ ID NO: 1917536 - protein, 6 aa, Staphylococcus
GSGKTT

SEQ ID NO: 1917537 - protein, 5 aa, Staphylococcus
GSGLA

SEQ ID NO: 1917538 - protein, 9 aa, Staphylococcus
GSGPTGSKI

SEQ ID NO: 1917539 - protein, 7 aa, Staphylococcus
GSGSERA

SEQ ID NO: 1917540 - protein, 11 aa, Staphylococcus
GSGSGKTSVTN

SEQ ID NO: 1917541 - protein, 18 aa, Staphylococcus
GSGSRFSDNRQQEVSEIS

SEQ ID NO: 1917542 - protein, 19 aa, Staphylococcus
GSGSRFSDNRQQEVSEISR

SEQ ID NO: 1917543 - protein, 26 aa, Staphylococcus
GSGVATLGLPDSPGVPEGTAKNTITV

SEQ ID NO: 1917544 - protein, 5 aa, Staphylococcus
GSHAS

SEQ ID NO: 1917545 - protein, 7 aa, Staphylococcus
GSIESGK

SEQ ID NO: 1917546 - protein, 11 aa, Staphylococcus
GSISAEAHETL

SEQ ID NO: 1917547 - protein, 10 aa, Staphylococcus
GSKQKEHGVR

SEQ ID NO: 1917548 - protein, 4 aa, Staphylococcus
GSMD

SEQ ID NO: 1917549 - protein, 7 aa, Staphylococcus
GSMGAGK

SEQ ID NO: 1917550 - protein, 8 aa, Staphylococcus
GSMTDSTG

SEQ ID NO: 1917551 - protein, 4 aa, Staphylococcus
GSNF

SEQ ID NO: 1917552 - protein, 9 aa, Staphylococcus
GSNGAGKTT

SEQ ID NO: 1917553 - protein, 8 aa, Staphylococcus
GSPGFSNE

SEQ ID NO: 1917554 - protein, 5 aa, Staphylococcus
GSQLG

SEQ ID NO: 1917555 - protein, 9 aa, Staphylococcus
GSQQARDLP

SEQ ID NO: 1917556 - protein, 4 aa, Staphylococcus
GSRG

SEQ ID NO: 1917557 - protein, 5 aa, Staphylococcus
GSRPI

SEQ ID NO: 1917558 - protein, 6 aa, Staphylococcus
GSRPIE

SEQ ID NO: 1917559 - protein, 17 aa, Staphylococcus
GSRQRDPNAPRKGDDLQ

SEQ ID NO: 1917560 - protein, 7 aa, Staphylococcus
GSSFTDI

SEQ ID NO: 1917561 - protein, 8 aa, Staphylococcus
GSSGQHSS

SEQ ID NO: 1917562 - protein, 10 aa, Staphylococcus
GSSGRGNVTP

SEQ ID NO: 1917563 - protein, 10 aa, Staphylococcus
GSSSSRTQRL

SEQ ID NO: 1917564 - protein, 8 aa, Staphylococcus
GSSSVKTI

SEQ ID NO: 1917565 - protein, 7 aa, Staphylococcus
GSTDKRG

SEQ ID NO: 1917566 - protein, 16 aa, Staphylococcus
GSTGISSGYATDIPPH

SEQ ID NO: 1917567 - protein, 4 aa, Staphylococcus
GSTP

SEQ ID NO: 1917568 - protein, 6 aa, Staphylococcus
GSTPPC

SEQ ID NO: 1917569 - protein, 7 aa, Staphylococcus
GSTSEGF

SEQ ID NO: 1917570 - protein, 7 aa, Staphylococcus
GSTSERG

SEQ ID NO: 1917571 - protein, 18 aa, Staphylococcus
GSVDGEEFEGGQAEGYDL

SEQ ID NO: 1917572 - protein, 14 aa, Staphylococcus
GSYNKRAKEEADKY

SEQ ID NO: 1917573 - protein, 8 aa, Staphylococcus
GTADAYQD

SEQ ID NO: 1917574 - protein, 6 aa, Staphylococcus
GTAISK

SEQ ID NO: 1917575 - protein, 4 aa, Staphylococcus
GTAT

SEQ ID NO: 1917576 - protein, 5 aa, Staphylococcus
GTATI

SEQ ID NO: 1917577 - protein, 8 aa, Staphylococcus
GTDGVGTK

SEQ ID NO: 1917578 - protein, 5 aa, Staphylococcus
GTDSG

SEQ ID NO: 1917579 - protein, 10 aa, Staphylococcus
GTDSKGSFPQ

SEQ ID NO: 1917580 - protein, 10 aa, Staphylococcus
GTEVKRGDET

SEQ ID NO: 1917581 - protein, 5 aa, Staphylococcus
GTGDA

SEQ ID NO: 1917582 - protein, 5 aa, Staphylococcus
GTGIA

SEQ ID NO: 1917583 - protein, 16 aa, Staphylococcus
GTGKTTLSAAPDRKLI

SEQ ID NO: 1917584 - protein, 15 aa, Staphylococcus
GTGKTTLSADPERKL

SEQ ID NO: 1917585 - protein, 7 aa, Staphylococcus
GTGLGIP

SEQ ID NO: 1917586 - protein, 8 aa, Staphylococcus
GTGMGLPG

SEQ ID NO: 1917587 - protein, 8 aa, Staphylococcus
GTGPRYCP

SEQ ID NO: 1917588 - protein, 11 aa, Staphylococcus
GTGQTYTSGIK

SEQ ID NO: 1917589 - protein, 7 aa, Staphylococcus
GTGSFGN

SEQ ID NO: 1917590 - protein, 5 aa, Staphylococcus
GTGST

SEQ ID NO: 1917591 - protein, 15 aa, Staphylococcus
GTGTNNTAKSIQASL

SEQ ID NO: 1917592 - protein, 5 aa, Staphylococcus
GTGVA

SEQ ID NO: 1917593 - protein, 5 aa, Staphylococcus
GTKFG

SEQ ID NO: 1917594 - protein, 4 aa, Staphylococcus
GTKI

SEQ ID NO: 1917595 - protein, 9 aa, Staphylococcus
GTKYRGEFE

SEQ ID NO: 1917596 - protein, 4 aa, Staphylococcus
GTLP

SEQ ID NO: 1917597 - protein, 4 aa, Staphylococcus
GTLS

SEQ ID NO: 1917598 - protein, 12 aa, Staphylococcus
GTMGQRWEEGKQ

SEQ ID NO: 1917599 - protein, 8 aa, Staphylococcus
GTNRSVGN

SEQ ID NO: 1917600 - protein, 10 aa, Staphylococcus
GTNVERGKEI

SEQ ID NO: 1917601 - protein, 12 aa, Staphylococcus
GTNVERGKEILN

SEQ ID NO: 1917602 - protein, 13 aa, Staphylococcus
GTPAMATGGMGDT

SEQ ID NO: 1917603 - protein, 8 aa, Staphylococcus
GTPYPEDL

SEQ ID NO: 1917604 - protein, 7 aa, Staphylococcus
GTRPDCL

SEQ ID NO: 1917605 - protein, 6 aa, Staphylococcus
GTRQDL

SEQ ID NO: 1917606 - protein, 4 aa, Staphylococcus
GTSG

SEQ ID NO: 1917607 - protein, 6 aa, Staphylococcus
GTSGLN

SEQ ID NO: 1917608 - protein, 7 aa, Staphylococcus
GTSGVDP

SEQ ID NO: 1917609 - protein, 17 aa, Staphylococcus
GTSIRLTGQDSERGTFS

SEQ ID NO: 1917610 - protein, 5 aa, Staphylococcus
GTSLK

SEQ ID NO: 1917611 - protein, 7 aa, Staphylococcus
GTSPSDF

SEQ ID NO: 1917612 - protein, 9 aa, Staphylococcus
GTSTQTQSI

SEQ ID NO: 1917613 - protein, 6 aa, Staphylococcus
GTTPEH

SEQ ID NO: 1917614 - protein, 5 aa, Staphylococcus
GTTPQ

SEQ ID NO: 1917615 - protein, 10 aa, Staphylococcus
GTTSTRTLET

SEQ ID NO: 1917616 - protein, 5 aa, Staphylococcus
GTVTV

SEQ ID NO: 1917617 - protein, 14 aa, Staphylococcus
GVAKDDLKEENVEA

SEQ ID NO: 1917618 - protein, 7 aa, Staphylococcus
GVAPGPI

SEQ ID NO: 1917619 - protein, 15 aa, Staphylococcus
GVDYDSANPPLYDSS

SEQ ID NO: 1917620 - protein, 9 aa, Staphylococcus
GVEATTEIK

SEQ ID NO: 1917621 - protein, 7 aa, Staphylococcus
GVETTCA

SEQ ID NO: 1917622 - protein, 11 aa, Staphylococcus
GVEVTTGPLGQ

SEQ ID NO: 1917623 - protein, 8 aa, Staphylococcus
GVGKTTVS

SEQ ID NO: 1917624 - protein, 7 aa, Staphylococcus
GVGPYTK

SEQ ID NO: 1917625 - protein, 5 aa, Staphylococcus
GVGVQ

SEQ ID NO: 1917626 - protein, 9 aa, Staphylococcus
GVKEGKRHQ

SEQ ID NO: 1917627 - protein, 4 aa, Staphylococcus
GVKR

SEQ ID NO: 1917628 - protein, 7 aa, Staphylococcus
GVKSGDT

SEQ ID NO: 1917629 - protein, 8 aa, Staphylococcus
GVPRGRGK

SEQ ID NO: 1917630 - protein, 12 aa, Staphylococcus
GVQNGVPTPGFS

SEQ ID NO: 1917631 - protein, 12 aa, Staphylococcus
GVRNGVPTPGFS

SEQ ID NO: 1917632 - protein, 11 aa, Staphylococcus
GVSDPEQKRKI

SEQ ID NO: 1917633 - protein, 11 aa, Staphylococcus
GVSKGKGFQGA

SEQ ID NO: 1917634 - protein, 7 aa, Staphylococcus
GVSKSTV

SEQ ID NO: 1917635 - protein, 9 aa, Staphylococcus
GVSKSTVSR

SEQ ID NO: 1917636 - protein, 4 aa, Staphylococcus
GVSR

SEQ ID NO: 1917637 - protein, 9 aa, Staphylococcus
GVTDTQKRR

SEQ ID NO: 1917638 - protein, 5 aa, Staphylococcus
GVTER

SEQ ID NO: 1917639 - protein, 11 aa, Staphylococcus
GVTPGKGGQVV

SEQ ID NO: 1917640 - protein, 4 aa, Staphylococcus
GVVT

SEQ ID NO: 1917641 - protein, 5 aa, Staphylococcus
GVYSG

SEQ ID NO: 1917642 - protein, 10 aa, Staphylococcus
GWANKKPSLR

SEQ ID NO: 1917643 - protein, 6 aa, Staphylococcus
GWPEPI

SEQ ID NO: 1917644 - protein, 13 aa, Staphylococcus
GWQSEGNTGTPWL

SEQ ID NO: 1917645 - protein, 11 aa, Staphylococcus
GWTGGKYGVGR

SEQ ID NO: 1917646 - protein, 4 aa, Staphylococcus
GWTK

SEQ ID NO: 1917647 - protein, 8 aa, Staphylococcus
GYAYESDG

SEQ ID NO: 1917648 - protein, 4 aa, Staphylococcus
GYDI

SEQ ID NO: 1917649 - protein, 6 aa, Staphylococcus
GYDTVT

SEQ ID NO: 1917650 - protein, 4 aa, Staphylococcus
GYDV

SEQ ID NO: 1917651 - protein, 4 aa, Staphylococcus
GYGD

SEQ ID NO: 1917652 - protein, 12 aa, Staphylococcus
GYGEDAMDASYD

SEQ ID NO: 1917653 - protein, 7 aa, Staphylococcus
GYGNKDI

SEQ ID NO: 1917654 - protein, 6 aa, Staphylococcus
GYKNID

SEQ ID NO: 1917655 - protein, 6 aa, Staphylococcus
GYLDGD

SEQ ID NO: 1917656 - protein, 4 aa, Staphylococcus
GYPI

SEQ ID NO: 1917657 - protein, 6 aa, Staphylococcus
GYPISN

SEQ ID NO: 1917658 - protein, 4 aa, Staphylococcus
GYQP

SEQ ID NO: 1917659 - protein, 17 aa, Staphylococcus
GYRAQHNDAVGPTKGGV

SEQ ID NO: 1917660 - protein, 6 aa, Staphylococcus
GYRTGS

SEQ ID NO: 1917661 - protein, 6 aa, Staphylococcus
GYSRQS

SEQ ID NO: 1917662 - protein, 8 aa, Staphylococcus
GYSYPSEY

SEQ ID NO: 1917663 - protein, 14 aa, Staphylococcus
GYTEAQAKEEGLSI

SEQ ID NO: 1917664 - protein, 6 aa, Staphylococcus
GYTEKN

SEQ ID NO: 1917665 - protein, 11 aa, Staphylococcus
GYTKEEQKMID

SEQ ID NO: 1917666 - protein, 4 aa, Staphylococcus
GYTV

SEQ ID NO: 1917667 - protein, 10 aa, Staphylococcus
HAALRNPKMA

SEQ ID NO: 1917668 - protein, 12 aa, Staphylococcus
HAAMAGDGQVTL

SEQ ID NO: 1917669 - protein, 7 aa, Staphylococcus
HAEGEKC

SEQ ID NO: 1917670 - protein, 5 aa, Staphylococcus
HAHPS

SEQ ID NO: 1917671 - protein, 8 aa, Staphylococcus
HAKEADVP

SEQ ID NO: 1917672 - protein, 9 aa, Staphylococcus
HAKGSGAFG

SEQ ID NO: 1917673 - protein, 16 aa, Staphylococcus
HAPHAKEEKAQPMTKA

SEQ ID NO: 1917674 - protein, 12 aa, Staphylococcus
HAQGSQGYGGEY

SEQ ID NO: 1917675 - protein, 7 aa, Staphylococcus
HARPEDQ

SEQ ID NO: 1917676 - protein, 8 aa, Staphylococcus
HASGKPTV

SEQ ID NO: 1917677 - protein, 8 aa, Staphylococcus
HASYTQHP

SEQ ID NO: 1917678 - protein, 9 aa, Staphylococcus
HATARKNDL

SEQ ID NO: 1917679 - protein, 8 aa, Staphylococcus
HATARQND

SEQ ID NO: 1917680 - protein, 16 aa, Staphylococcus
HDADELSHYSNATTDI

SEQ ID NO: 1917681 - protein, 11 aa, Staphylococcus
HDAGYNVKEDF

SEQ ID NO: 1917682 - protein, 4 aa, Staphylococcus
HDDP

SEQ ID NO: 1917683 - protein, 6 aa, Staphylococcus
HDEERF

SEQ ID NO: 1917684 - protein, 5 aa, Staphylococcus
HDGGK

SEQ ID NO: 1917685 - protein, 15 aa, Staphylococcus
HDKKMKEQDEKMNKF

SEQ ID NO: 1917686 - protein, 6 aa, Staphylococcus
HDSKDN

SEQ ID NO: 1917687 - protein, 8 aa, Staphylococcus
HDTSGNGL

SEQ ID NO: 1917688 - protein, 4 aa, Staphylococcus
HDYG

SEQ ID NO: 1917689 - protein, 4 aa, Staphylococcus
HEDG

SEQ ID NO: 1917690 - protein, 6 aa, Staphylococcus
HEDGDA

SEQ ID NO: 1917691 - protein, 6 aa, Staphylococcus
HEDPRT

SEQ ID NO: 1917692 - protein, 9 aa, Staphylococcus
HEEADETVT

SEQ ID NO: 1917693 - protein, 5 aa, Staphylococcus
HEGET

SEQ ID NO: 1917694 - protein, 9 aa, Staphylococcus
HEGTGAGSD

SEQ ID NO: 1917695 - protein, 4 aa, Staphylococcus
HEIR

SEQ ID NO: 1917696 - protein, 9 aa, Staphylococcus
HENPDSLDP

SEQ ID NO: 1917697 - protein, 9 aa, Staphylococcus
HEPPTDSPL

SEQ ID NO: 1917698 - protein, 8 aa, Staphylococcus
HEQEQPAY

SEQ ID NO: 1917699 - protein, 7 aa, Staphylococcus
HFDGTPC

SEQ ID NO: 1917700 - protein, 20 aa, Staphylococcus
HGDPQFEGQTKTKLGNSEVR

SEQ ID NO: 1917701 - protein, 14 aa, Staphylococcus
HGDSGLATLTGSNG

SEQ ID NO: 1917702 - protein, 7 aa, Staphylococcus
HGHSKGV

SEQ ID NO: 1917703 - protein, 10 aa, Staphylococcus
HGKPSGIDTK

SEQ ID NO: 1917704 - protein, 11 aa, Staphylococcus
HGKRPTEEELQ

SEQ ID NO: 1917705 - protein, 16 aa, Staphylococcus
HGLPHDPFKSSTVPRP

SEQ ID NO: 1917706 - protein, 8 aa, Staphylococcus
HGMDPSLG

SEQ ID NO: 1917707 - protein, 15 aa, Staphylococcus
HGNDPIADGTDHTRE

SEQ ID NO: 1917708 - protein, 17 aa, Staphylococcus
HGPYTTVDDEQLNPFLN

SEQ ID NO: 1917709 - protein, 7 aa, Staphylococcus
HGQTGVD

SEQ ID NO: 1917710 - protein, 4 aa, Staphylococcus
HGST

SEQ ID NO: 1917711 - protein, 14 aa, Staphylococcus
HGYGNNDTDRKEGI

SEQ ID NO: 1917712 - protein, 9 aa, Staphylococcus
HGYSDKPRH

SEQ ID NO: 1917713 - protein, 8 aa, Staphylococcus
HHGSTPPC

SEQ ID NO: 1917714 - protein, 7 aa, Staphylococcus
HHRPDYA

SEQ ID NO: 1917715 - protein, 14 aa, Staphylococcus
HIGSPSEKLEPGQQ

SEQ ID NO: 1917716 - protein, 6 aa, Staphylococcus
HKAQTN

SEQ ID NO: 1917717 - protein, 7 aa, Staphylococcus
HKAQTSL

SEQ ID NO: 1917718 - protein, 13 aa, Staphylococcus
HKEGPLSEGTVSG

SEQ ID NO: 1917719 - protein, 5 aa, Staphylococcus
HKGHQ

SEQ ID NO: 1917720 - protein, 8 aa, Staphylococcus
HKKTRNQM

SEQ ID NO: 1917721 - protein, 6 aa, Staphylococcus
HKRAIE

SEQ ID NO: 1917722 - protein, 16 aa, Staphylococcus
HKRAYDNDEGPNTGGM

SEQ ID NO: 1917723 - protein, 14 aa, Staphylococcus
HKRELAYTRYTWPK

SEQ ID NO: 1917724 - protein, 8 aa, Staphylococcus
HKSQGSEF

SEQ ID NO: 1917725 - protein, 6 aa, Staphylococcus
HKSTDQ

SEQ ID NO: 1917726 - protein, 6 aa, Staphylococcus
HKTSID

SEQ ID NO: 1917727 - protein, 9 aa, Staphylococcus
HKTYRDSEH

SEQ ID NO: 1917728 - protein, 10 aa, Staphylococcus
HLERKKGSIA

SEQ ID NO: 1917729 - protein, 11 aa, Staphylococcus
HLTDTKGRQVD

SEQ ID NO: 1917730 - protein, 13 aa, Staphylococcus
HNEMDEPSITNPV

SEQ ID NO: 1917731 - protein, 9 aa, Staphylococcus
HNGAGKSTF

SEQ ID NO: 1917732 - protein, 4 aa, Staphylococcus
HNGD

SEQ ID NO: 1917733 - protein, 19 aa, Staphylococcus
HNKDNTYTPLPNKNIDTGM

SEQ ID NO: 1917734 - protein, 6 aa, Staphylococcus
HNNESI

SEQ ID NO: 1917735 - protein, 6 aa, Staphylococcus
HNNESV

SEQ ID NO: 1917736 - protein, 17 aa, Staphylococcus
HNNVQGASDMGSMPDQF

SEQ ID NO: 1917737 - protein, 5 aa, Staphylococcus
HNYEN

SEQ ID NO: 1917738 - protein, 8 aa, Staphylococcus
HPATDQYG

SEQ ID NO: 1917739 - protein, 6 aa, Staphylococcus
HPDGDA

SEQ ID NO: 1917740 - protein, 15 aa, Staphylococcus
HPDPSVALSDAGQQM

SEQ ID NO: 1917741 - protein, 16 aa, Staphylococcus
HPDPSVALSDSGQQMD

SEQ ID NO: 1917742 - protein, 4 aa, Staphylococcus
HPDY

SEQ ID NO: 1917743 - protein, 5 aa, Staphylococcus
HPEFG

SEQ ID NO: 1917744 - protein, 5 aa, Staphylococcus
HPGEV

SEQ ID NO: 1917745 - protein, 10 aa, Staphylococcus
HPKEAESRKD

SEQ ID NO: 1917746 - protein, 6 aa, Staphylococcus
HPLTRT

SEQ ID NO: 1917747 - protein, 5 aa, Staphylococcus
HPNPV

SEQ ID NO: 1917748 - protein, 10 aa, Staphylococcus
HPRVAETTTA

SEQ ID NO: 1917749 - protein, 6 aa, Staphylococcus
HPSPLS

SEQ ID NO: 1917750 - protein, 10 aa, Staphylococcus
HPSSRTDRGV

SEQ ID NO: 1917751 - protein, 7 aa, Staphylococcus
HPTHPLT

SEQ ID NO: 1917752 - protein, 13 aa, Staphylococcus
HPTTGGVSASFAS

SEQ ID NO: 1917753 - protein, 4 aa, Staphylococcus
HQDA

SEQ ID NO: 1917754 - protein, 5 aa, Staphylococcus
HQDYY

SEQ ID NO: 1917755 - protein, 6 aa, Staphylococcus
HQETSD

SEQ ID NO: 1917756 - protein, 9 aa, Staphylococcus
HQGEKYYQN

SEQ ID NO: 1917757 - protein, 7 aa, Staphylococcus
HQHPADY

SEQ ID NO: 1917758 - protein, 8 aa, Staphylococcus
HQHPADYN

SEQ ID NO: 1917759 - protein, 4 aa, Staphylococcus
HQIT

SEQ ID NO: 1917760 - protein, 7 aa, Staphylococcus
HQKENAA

SEQ ID NO: 1917761 - protein, 14 aa, Staphylococcus
HQKPTQLNPEGGIL

SEQ ID NO: 1917762 - protein, 7 aa, Staphylococcus
HQLPEAV

SEQ ID NO: 1917763 - protein, 9 aa, Staphylococcus
HQQSDEDLL

SEQ ID NO: 1917764 - protein, 7 aa, Staphylococcus
HQRDNDR

SEQ ID NO: 1917765 - protein, 10 aa, Staphylococcus
HQTEPPTVEQ

SEQ ID NO: 1917766 - protein, 7 aa, Staphylococcus
HQTTQET

SEQ ID NO: 1917767 - protein, 7 aa, Staphylococcus
HQTTRSI

SEQ ID NO: 1917768 - protein, 6 aa, Staphylococcus
HQTTSD

SEQ ID NO: 1917769 - protein, 7 aa, Staphylococcus
HRDYSSS

SEQ ID NO: 1917770 - protein, 4 aa, Staphylococcus
HRHG

SEQ ID NO: 1917771 - protein, 6 aa, Staphylococcus
HRHPQY

SEQ ID NO: 1917772 - protein, 10 aa, Staphylococcus
HRKDYAVSDP

SEQ ID NO: 1917773 - protein, 4 aa, Staphylococcus
HRRE

SEQ ID NO: 1917774 - protein, 11 aa, Staphylococcus
HRTKTEKANEL

SEQ ID NO: 1917775 - protein, 10 aa, Staphylococcus
HRTNEETGKV

SEQ ID NO: 1917776 - protein, 11 aa, Staphylococcus
HRTNEETGKVD

SEQ ID NO: 1917777 - protein, 5 aa, Staphylococcus
HSENA

SEQ ID NO: 1917778 - protein, 8 aa, Staphylococcus
HSHPTADE

SEQ ID NO: 1917779 - protein, 4 aa, Staphylococcus
HSKE

SEQ ID NO: 1917780 - protein, 9 aa, Staphylococcus
HSKEAQTLE

SEQ ID NO: 1917781 - protein, 9 aa, Staphylococcus
HSNEAEQSV

SEQ ID NO: 1917782 - protein, 5 aa, Staphylococcus
HSPFE

SEQ ID NO: 1917783 - protein, 6 aa, Staphylococcus
HSPQIS

SEQ ID NO: 1917784 - protein, 4 aa, Staphylococcus
HSPT

SEQ ID NO: 1917785 - protein, 5 aa, Staphylococcus
HSPTA

SEQ ID NO: 1917786 - protein, 9 aa, Staphylococcus
HSRGTGKWN

SEQ ID NO: 1917787 - protein, 8 aa, Staphylococcus
HSSQPEEI

SEQ ID NO: 1917788 - protein, 7 aa, Staphylococcus
HSYTSAE

SEQ ID NO: 1917789 - protein, 6 aa, Staphylococcus
HTAETN

SEQ ID NO: 1917790 - protein, 8 aa, Staphylococcus
HTDDETGQ

SEQ ID NO: 1917791 - protein, 6 aa, Staphylococcus
HTGGHS

SEQ ID NO: 1917792 - protein, 7 aa, Staphylococcus
HTHPTAD

SEQ ID NO: 1917793 - protein, 25 aa, Staphylococcus
HTMAGDDPTRYRTSDEDAEWEKKDP

SEQ ID NO: 1917794 - protein, 6 aa, Staphylococcus
HTNYSG

SEQ ID NO: 1917795 - protein, 8 aa, Staphylococcus
HTPTKNEF

SEQ ID NO: 1917796 - protein, 9 aa, Staphylococcus
HTTDDFTGA

SEQ ID NO: 1917797 - protein, 15 aa, Staphylococcus
HTTDDYTGAVTTPIY

SEQ ID NO: 1917798 - protein, 6 aa, Staphylococcus
HTYEDR

SEQ ID NO: 1917799 - protein, 12 aa, Staphylococcus
HVADKEQGHSCG

SEQ ID NO: 1917800 - protein, 13 aa, Staphylococcus
HVADKEQGHSCGE

SEQ ID NO: 1917801 - protein, 8 aa, Staphylococcus
HVDSPEDV

SEQ ID NO: 1917802 - protein, 5 aa, Staphylococcus
HVKEE

SEQ ID NO: 1917803 - protein, 41 aa, Staphylococcus
HVPGPTDKASWGGAPTERISTRNSTSKASWGRPPTERKEQA

SEQ ID NO: 1917804 - protein, 4 aa, Staphylococcus
HVPR

SEQ ID NO: 1917805 - protein, 17 aa, Staphylococcus
HYDGGRHQIRVDMLNKM

SEQ ID NO: 1917806 - protein, 8 aa, Staphylococcus
HYGNPSSI

SEQ ID NO: 1917807 - protein, 8 aa, Staphylococcus
HYGSTPPC

SEQ ID NO: 1917808 - protein, 4 aa, Staphylococcus
HYPK

SEQ ID NO: 1917809 - protein, 5 aa, Staphylococcus
HYSPA

SEQ ID NO: 1917810 - protein, 8 aa, Staphylococcus
HYSPDTPV

SEQ ID NO: 1917811 - protein, 6 aa, Staphylococcus
IADEQG

SEQ ID NO: 1917812 - protein, 7 aa, Staphylococcus
IAGDQQA

SEQ ID NO: 1917813 - protein, 10 aa, Staphylococcus
IAGGGSDGSI

SEQ ID NO: 1917814 - protein, 11 aa, Staphylococcus
IAGGKQKTTYL

SEQ ID NO: 1917815 - protein, 4 aa, Staphylococcus
IAGP

SEQ ID NO: 1917816 - protein, 4 aa, Staphylococcus
IAGT

SEQ ID NO: 1917817 - protein, 5 aa, Staphylococcus
IAGTC

SEQ ID NO: 1917818 - protein, 5 aa, Staphylococcus
IAGTG

SEQ ID NO: 1917819 - protein, 4 aa, Staphylococcus
IAKE

SEQ ID NO: 1917820 - protein, 10 aa, Staphylococcus
IAKPDDSAEF

SEQ ID NO: 1917821 - protein, 6 aa, Staphylococcus
IAKTSM

SEQ ID NO: 1917822 - protein, 12 aa, Staphylococcus
IANADDPVEAAK

SEQ ID NO: 1917823 - protein, 20 aa, Staphylococcus
IANADDPVEAAKACRDAVKG

SEQ ID NO: 1917824 - protein, 15 aa, Staphylococcus
IANKQITTLQKNAKD

SEQ ID NO: 1917825 - protein, 6 aa, Staphylococcus
IARPAA

SEQ ID NO: 1917826 - protein, 7 aa, Staphylococcus
IARPAAS

SEQ ID NO: 1917827 - protein, 5 aa, Staphylococcus
IASHG

SEQ ID NO: 1917828 - protein, 21 aa, Staphylococcus
IATQAKVEAKLNEQGISRHDI

SEQ ID NO: 1917829 - protein, 5 aa, Staphylococcus
IDADQ

SEQ ID NO: 1917830 - protein, 4 aa, Staphylococcus
IDDA

SEQ ID NO: 1917831 - protein, 7 aa, Staphylococcus
IDDNVAN

SEQ ID NO: 1917832 - protein, 4 aa, Staphylococcus
IDEA

SEQ ID NO: 1917833 - protein, 4 aa, Staphylococcus
IDEN

SEQ ID NO: 1917834 - protein, 13 aa, Staphylococcus
IDGFTKDTKGYNY

SEQ ID NO: 1917835 - protein, 7 aa, Staphylococcus
IDKAEKG

SEQ ID NO: 1917836 - protein, 9 aa, Staphylococcus
IDKGVKGSD

SEQ ID NO: 1917837 - protein, 4 aa, Staphylococcus
IDKN

SEQ ID NO: 1917838 - protein, 9 aa, Staphylococcus
IDNPEKVPY

SEQ ID NO: 1917839 - protein, 4 aa, Staphylococcus
IDPL

SEQ ID NO: 1917840 - protein, 4 aa, Staphylococcus
IDPT

SEQ ID NO: 1917841 - protein, 4 aa, Staphylococcus
IDPV

SEQ ID NO: 1917842 - protein, 6 aa, Staphylococcus
IDVTTS

SEQ ID NO: 1917843 - protein, 4 aa, Staphylococcus
IEAG

SEQ ID NO: 1917844 - protein, 8 aa, Staphylococcus
IEAGKGDD

SEQ ID NO: 1917845 - protein, 8 aa, Staphylococcus
IEAGQGED

SEQ ID NO: 1917846 - protein, 11 aa, Staphylococcus
IEAGQNQDWTK

SEQ ID NO: 1917847 - protein, 13 aa, Staphylococcus
IEDEPFDGDALKF

SEQ ID NO: 1917848 - protein, 18 aa, Staphylococcus
IEDQADEVQKVKRSENGV

SEQ ID NO: 1917849 - protein, 8 aa, Staphylococcus
IEEAESYQ

SEQ ID NO: 1917850 - protein, 8 aa, Staphylococcus
IEEDAKKA

SEQ ID NO: 1917851 - protein, 11 aa, Staphylococcus
IEGANGPEIKI

SEQ ID NO: 1917852 - protein, 11 aa, Staphylococcus
IEGANGPEITI

SEQ ID NO: 1917853 - protein, 11 aa, Staphylococcus
IEGKSYTPQEI

SEQ ID NO: 1917854 - protein, 9 aa, Staphylococcus
IEGTAKSIG

SEQ ID NO: 1917855 - protein, 6 aa, Staphylococcus
IEGTPA

SEQ ID NO: 1917856 - protein, 10 aa, Staphylococcus
IEHPKENGYR

SEQ ID NO: 1917857 - protein, 6 aa, Staphylococcus
IEKAPN

SEQ ID NO: 1917858 - protein, 11 aa, Staphylococcus
IELRGDDPKVV

SEQ ID NO: 1917859 - protein, 4 aa, Staphylococcus
IEND

SEQ ID NO: 1917860 - protein, 7 aa, Staphylococcus
IENDGKK

SEQ ID NO: 1917861 - protein, 7 aa, Staphylococcus
IENGSAL

SEQ ID NO: 1917862 - protein, 7 aa, Staphylococcus
IENNGKK

SEQ ID NO: 1917863 - protein, 4 aa, Staphylococcus
IEPE

SEQ ID NO: 1917864 - protein, 4 aa, Staphylococcus
IEPG

SEQ ID NO: 1917865 - protein, 7 aa, Staphylococcus
IEPGRSI

SEQ ID NO: 1917866 - protein, 16 aa, Staphylococcus
IEPNTEPIRGGTDGSQ

SEQ ID NO: 1917867 - protein, 9 aa, Staphylococcus
IEPPSASPV

SEQ ID NO: 1917868 - protein, 6 aa, Staphylococcus
IEQGIG

SEQ ID NO: 1917869 - protein, 5 aa, Staphylococcus
IEQIT

SEQ ID NO: 1917870 - protein, 4 aa, Staphylococcus
IEQS

SEQ ID NO: 1917871 - protein, 10 aa, Staphylococcus
IEREEDDKSY

SEQ ID NO: 1917872 - protein, 4 aa, Staphylococcus
IETI

SEQ ID NO: 1917873 - protein, 4 aa, Staphylococcus
IFET

SEQ ID NO: 1917874 - protein, 4 aa, Staphylococcus
IGAA

SEQ ID NO: 1917875 - protein, 9 aa, Staphylococcus
IGDRSTSEL

SEQ ID NO: 1917876 - protein, 18 aa, Staphylococcus
IGEGPDAAAFNDEGSHTL

SEQ ID NO: 1917877 - protein, 7 aa, Staphylococcus
IGGGAKS

SEQ ID NO: 1917878 - protein, 8 aa, Staphylococcus
IGGGSTEV

SEQ ID NO: 1917879 - protein, 10 aa, Staphylococcus
IGGQVNDTAG

SEQ ID NO: 1917880 - protein, 11 aa, Staphylococcus
IGGQVNDTAGI

SEQ ID NO: 1917881 - protein, 5 aa, Staphylococcus
IGGSG

SEQ ID NO: 1917882 - protein, 9 aa, Staphylococcus
IGKGKPGVL

SEQ ID NO: 1917883 - protein, 5 aa, Staphylococcus
IGNDR

SEQ ID NO: 1917884 - protein, 6 aa, Staphylococcus
IGNDRR

SEQ ID NO: 1917885 - protein, 7 aa, Staphylococcus
IGNNDEH

SEQ ID NO: 1917886 - protein, 6 aa, Staphylococcus
IGPGAK

SEQ ID NO: 1917887 - protein, 9 aa, Staphylococcus
IGPGGKKIN

SEQ ID NO: 1917888 - protein, 5 aa, Staphylococcus
IGPRI

SEQ ID NO: 1917889 - protein, 10 aa, Staphylococcus
IGPTGSGKTL

SEQ ID NO: 1917890 - protein, 5 aa, Staphylococcus
IGRTD

SEQ ID NO: 1917891 - protein, 12 aa, Staphylococcus
IGRTGRAGKEGI

SEQ ID NO: 1917892 - protein, 12 aa, Staphylococcus
IGSDEAGSGDYF

SEQ ID NO: 1917893 - protein, 9 aa, Staphylococcus
IGSEETVKA

SEQ ID NO: 1917894 - protein, 6 aa, Staphylococcus
IGTVAE

SEQ ID NO: 1917895 - protein, 11 aa, Staphylococcus
IGVGKSSLTHK

SEQ ID NO: 1917896 - protein, 8 aa, Staphylococcus
IGYAPDSS

SEQ ID NO: 1917897 - protein, 4 aa, Staphylococcus
IHTA

SEQ ID NO: 1917898 - protein, 11 aa, Staphylococcus
IHTPRRSEPRV

SEQ ID NO: 1917899 - protein, 12 aa, Staphylococcus
IIPNSTGAAKAI

SEQ ID NO: 1917900 - protein, 7 aa, Staphylococcus
IKASEQI

SEQ ID NO: 1917901 - protein, 4 aa, Staphylococcus
IKDE

SEQ ID NO: 1917902 - protein, 6 aa, Staphylococcus
IKEDGR

SEQ ID NO: 1917903 - protein, 7 aa, Staphylococcus
IKEDGRL

SEQ ID NO: 1917904 - protein, 4 aa, Staphylococcus
IKEG

SEQ ID NO: 1917905 - protein, 9 aa, Staphylococcus
IKGAGTTTI

SEQ ID NO: 1917906 - protein, 10 aa, Staphylococcus
IKGDAKSVSI

SEQ ID NO: 1917907 - protein, 6 aa, Staphylococcus
IKGKGV

SEQ ID NO: 1917908 - protein, 8 aa, Staphylococcus
IKGNDASK

SEQ ID NO: 1917909 - protein, 9 aa, Staphylococcus
IKKRGDDIE

SEQ ID NO: 1917910 - protein, 14 aa, Staphylococcus
IKKTPKQDKAEEKR

SEQ ID NO: 1917911 - protein, 8 aa, Staphylococcus
IKNDSTNV

SEQ ID NO: 1917912 - protein, 19 aa, Staphylococcus
IKNSEQKYKHDNLTTTECP

SEQ ID NO: 1917913 - protein, 6 aa, Staphylococcus
IKNSIG

SEQ ID NO: 1917914 - protein, 8 aa, Staphylococcus
IKNTRNGT

SEQ ID NO: 1917915 - protein, 9 aa, Staphylococcus
IKPKDNKGK

SEQ ID NO: 1917916 - protein, 22 aa, Staphylococcus
IKQTSEVEDSKREIVSALRKLN

SEQ ID NO: 1917917 - protein, 4 aa, Staphylococcus
IKQY

SEQ ID NO: 1917918 - protein, 4 aa, Staphylococcus
IKRQ

SEQ ID NO: 1917919 - protein, 9 aa, Staphylococcus
IKTGAEAEY

SEQ ID NO: 1917920 - protein, 9 aa, Staphylococcus
IKTKENKGK

SEQ ID NO: 1917921 - protein, 10 aa, Staphylococcus
IKTKENKGKL

SEQ ID NO: 1917922 - protein, 4 aa, Staphylococcus
IKTP

SEQ ID NO: 1917923 - protein, 7 aa, Staphylococcus
IKTPENL

SEQ ID NO: 1917924 - protein, 6 aa, Staphylococcus
IKTQDI

SEQ ID NO: 1917925 - protein, 4 aa, Staphylococcus
INEA

SEQ ID NO: 1917926 - protein, 10 aa, Staphylococcus
INEGDGAFYG

SEQ ID NO: 1917927 - protein, 7 aa, Staphylococcus
INEMRGE

SEQ ID NO: 1917928 - protein, 9 aa, Staphylococcus
INEPSREVT

SEQ ID NO: 1917929 - protein, 5 aa, Staphylococcus
INESD

SEQ ID NO: 1917930 - protein, 4 aa, Staphylococcus
INET

SEQ ID NO: 1917931 - protein, 17 aa, Staphylococcus
INETKTKGANTTPETVS

SEQ ID NO: 1917932 - protein, 6 aa, Staphylococcus
INGRPK

SEQ ID NO: 1917933 - protein, 4 aa, Staphylococcus
INGS

SEQ ID NO: 1917934 - protein, 12 aa, Staphylococcus
INKAKSQQGPTI

SEQ ID NO: 1917935 - protein, 6 aa, Staphylococcus
INKNGK

SEQ ID NO: 1917936 - protein, 8 aa, Staphylococcus
INKTLTPH

SEQ ID NO: 1917937 - protein, 4 aa, Staphylococcus
INNE

SEQ ID NO: 1917938 - protein, 6 aa, Staphylococcus
INPATN

SEQ ID NO: 1917939 - protein, 8 aa, Staphylococcus
INPDNPRQ

SEQ ID NO: 1917940 - protein, 7 aa, Staphylococcus
INQMRGE

SEQ ID NO: 1917941 - protein, 4 aa, Staphylococcus
INRE

SEQ ID NO: 1917942 - protein, 5 aa, Staphylococcus
INRGN

SEQ ID NO: 1917943 - protein, 8 aa, Staphylococcus
INSTGKDE

SEQ ID NO: 1917944 - protein, 6 aa, Staphylococcus
INTDPE

SEQ ID NO: 1917945 - protein, 4 aa, Staphylococcus
IPDA

SEQ ID NO: 1917946 - protein, 9 aa, Staphylococcus
IPDGETPKG

SEQ ID NO: 1917947 - protein, 10 aa, Staphylococcus
IPDGETPKGI

SEQ ID NO: 1917948 - protein, 5 aa, Staphylococcus
IPDGK

SEQ ID NO: 1917949 - protein, 5 aa, Staphylococcus
IPDYA

SEQ ID NO: 1917950 - protein, 6 aa, Staphylococcus
IPDYAS

SEQ ID NO: 1917951 - protein, 6 aa, Staphylococcus
IPEDEN

SEQ ID NO: 1917952 - protein, 4 aa, Staphylococcus
IPEK

SEQ ID NO: 1917953 - protein, 13 aa, Staphylococcus
IPENPSEEDKEWG

SEQ ID NO: 1917954 - protein, 5 aa, Staphylococcus
IPGND

SEQ ID NO: 1917955 - protein, 7 aa, Staphylococcus
IPGPNHV

SEQ ID NO: 1917956 - protein, 13 aa, Staphylococcus
IPGTIDNDINGTD

SEQ ID NO: 1917957 - protein, 12 aa, Staphylococcus
IPKDTKNGDYST

SEQ ID NO: 1917958 - protein, 5 aa, Staphylococcus
IPNTV

SEQ ID NO: 1917959 - protein, 4 aa, Staphylococcus
IPQG

SEQ ID NO: 1917960 - protein, 9 aa, Staphylococcus
IPSEDAGKC

SEQ ID NO: 1917961 - protein, 5 aa, Staphylococcus
IPSEY

SEQ ID NO: 1917962 - protein, 13 aa, Staphylococcus
IPSGKANHEMEGL

SEQ ID NO: 1917963 - protein, 16 aa, Staphylococcus
IPSSLGGNGTGTNPDE

SEQ ID NO: 1917964 - protein, 4 aa, Staphylococcus
IPST

SEQ ID NO: 1917965 - protein, 8 aa, Staphylococcus
IPTGDPVS

SEQ ID NO: 1917966 - protein, 6 aa, Staphylococcus
IPTPTN

SEQ ID NO: 1917967 - protein, 4 aa, Staphylococcus
IPYG

SEQ ID NO: 1917968 - protein, 8 aa, Staphylococcus
IQDQAAKG

SEQ ID NO: 1917969 - protein, 6 aa, Staphylococcus
IQEEGA

SEQ ID NO: 1917970 - protein, 6 aa, Staphylococcus
IQEQAA

SEQ ID NO: 1917971 - protein, 4 aa, Staphylococcus
IQGN

SEQ ID NO: 1917972 - protein, 4 aa, Staphylococcus
IQGY

SEQ ID NO: 1917973 - protein, 10 aa, Staphylococcus
IQKRDDLEKQ

SEQ ID NO: 1917974 - protein, 13 aa, Staphylococcus
IQLGKKESVEDTA

SEQ ID NO: 1917975 - protein, 4 aa, Staphylococcus
IQNE

SEQ ID NO: 1917976 - protein, 4 aa, Staphylococcus
IQNG

SEQ ID NO: 1917977 - protein, 4 aa, Staphylococcus
IQNN

SEQ ID NO: 1917978 - protein, 5 aa, Staphylococcus
IQPDG

SEQ ID NO: 1917979 - protein, 8 aa, Staphylococcus
IQPNEASQ

SEQ ID NO: 1917980 - protein, 4 aa, Staphylococcus
IQQQ

SEQ ID NO: 1917981 - protein, 5 aa, Staphylococcus
IQQQG

SEQ ID NO: 1917982 - protein, 4 aa, Staphylococcus
IQRV

SEQ ID NO: 1917983 - protein, 5 aa, Staphylococcus
IQSGD

SEQ ID NO: 1917984 - protein, 5 aa, Staphylococcus
IQSTQ

SEQ ID NO: 1917985 - protein, 6 aa, Staphylococcus
IQTETL

SEQ ID NO: 1917986 - protein, 4 aa, Staphylococcus
IQTL

SEQ ID NO: 1917987 - protein, 10 aa, Staphylococcus
IQYDPNRSAN

SEQ ID NO: 1917988 - protein, 7 aa, Staphylococcus
IRDGANV

SEQ ID NO: 1917989 - protein, 8 aa, Staphylococcus
IRGKSTIT

SEQ ID NO: 1917990 - protein, 8 aa, Staphylococcus
IRKGTTDL

SEQ ID NO: 1917991 - protein, 6 aa, Staphylococcus
IRPETH

SEQ ID NO: 1917992 - protein, 8 aa, Staphylococcus
IRTKNGQN

SEQ ID NO: 1917993 - protein, 8 aa, Staphylococcus
IRTPKDIS

SEQ ID NO: 1917994 - protein, 7 aa, Staphylococcus
ISAPTDV

SEQ ID NO: 1917995 - protein, 10 aa, Staphylococcus
ISENTGVSKA

SEQ ID NO: 1917996 - protein, 4 aa, Staphylococcus
ISET

SEQ ID NO: 1917997 - protein, 11 aa, Staphylococcus
ISGDSKKKHQN

SEQ ID NO: 1917998 - protein, 7 aa, Staphylococcus
ISKARGI

SEQ ID NO: 1917999 - protein, 9 aa, Staphylococcus
ISKERASEK

SEQ ID NO: 1918000 - protein, 6 aa, Staphylococcus
ISKNAS

SEQ ID NO: 1918001 - protein, 10 aa, Staphylococcus
ISKQGSHATL

SEQ ID NO: 1918002 - protein, 5 aa, Staphylococcus
ISNDY

SEQ ID NO: 1918003 - protein, 5 aa, Staphylococcus
ISNEE

SEQ ID NO: 1918004 - protein, 12 aa, Staphylococcus
ISPKPPSSNMKP

SEQ ID NO: 1918005 - protein, 7 aa, Staphylococcus
ISQKEAE

SEQ ID NO: 1918006 - protein, 4 aa, Staphylococcus
ISRE

SEQ ID NO: 1918007 - protein, 7 aa, Staphylococcus
ISRETTG

SEQ ID NO: 1918008 - protein, 5 aa, Staphylococcus
ISSEE

SEQ ID NO: 1918009 - protein, 11 aa, Staphylococcus
ISSGPLPSQSA

SEQ ID NO: 1918010 - protein, 9 aa, Staphylococcus
ISSKDNPYR

SEQ ID NO: 1918011 - protein, 9 aa, Staphylococcus
ISSSAKGQE

SEQ ID NO: 1918012 - protein, 17 aa, Staphylococcus
ISTEVVETARDSLVIGI

SEQ ID NO: 1918013 - protein, 5 aa, Staphylococcus
ISTGA

SEQ ID NO: 1918014 - protein, 5 aa, Staphylococcus
ISTIG

SEQ ID NO: 1918015 - protein, 4 aa, Staphylococcus
ITDA

SEQ ID NO: 1918016 - protein, 4 aa, Staphylococcus
ITED

SEQ ID NO: 1918017 - protein, 5 aa, Staphylococcus
ITEDT

SEQ ID NO: 1918018 - protein, 10 aa, Staphylococcus
ITEEEAFTHP

SEQ ID NO: 1918019 - protein, 14 aa, Staphylococcus
ITEKQGVNKAAVSR

SEQ ID NO: 1918020 - protein, 5 aa, Staphylococcus
ITGAG

SEQ ID NO: 1918021 - protein, 8 aa, Staphylococcus
ITGAPKLN

SEQ ID NO: 1918022 - protein, 5 aa, Staphylococcus
ITGQK

SEQ ID NO: 1918023 - protein, 5 aa, Staphylococcus
ITGTS

SEQ ID NO: 1918024 - protein, 5 aa, Staphylococcus
ITHPN

SEQ ID NO: 1918025 - protein, 8 aa, Staphylococcus
ITNQRETT

SEQ ID NO: 1918026 - protein, 8 aa, Staphylococcus
ITQGTNSD

SEQ ID NO: 1918027 - protein, 4 aa, Staphylococcus
ITQP

SEQ ID NO: 1918028 - protein, 5 aa, Staphylococcus
ITQYT

SEQ ID NO: 1918029 - protein, 15 aa, Staphylococcus
ITRASTSGMAKSRRK

SEQ ID NO: 1918030 - protein, 10 aa, Staphylococcus
ITRDDDGAYV

SEQ ID NO: 1918031 - protein, 7 aa, Staphylococcus
ITRPKQI

SEQ ID NO: 1918032 - protein, 6 aa, Staphylococcus
ITSKPP

SEQ ID NO: 1918033 - protein, 4 aa, Staphylococcus
ITTA

SEQ ID NO: 1918034 - protein, 4 aa, Staphylococcus
ITTQ

SEQ ID NO: 1918035 - protein, 7 aa, Staphylococcus
IVKENPD

SEQ ID NO: 1918036 - protein, 4 aa, Staphylococcus
IYKQ

SEQ ID NO: 1918037 - protein, 6 aa, Staphylococcus
IYPPGA

SEQ ID NO: 1918038 - protein, 8 aa, Staphylococcus
IYQPTTTK

SEQ ID NO: 1918039 - protein, 11 aa, Staphylococcus
KAAANVGLEPE

SEQ ID NO: 1918040 - protein, 12 aa, Staphylococcus
KAAEELEKEGYS

SEQ ID NO: 1918041 - protein, 7 aa, Staphylococcus
KAAGASK

SEQ ID NO: 1918042 - protein, 13 aa, Staphylococcus
KAAHITDYTNASR

SEQ ID NO: 1918043 - protein, 7 aa, Staphylococcus
KAAKDFK

SEQ ID NO: 1918044 - protein, 9 aa, Staphylococcus
KAAKEMKER

SEQ ID NO: 1918045 - protein, 6 aa, Staphylococcus
KAAYPI

SEQ ID NO: 1918046 - protein, 4 aa, Staphylococcus
KADE

SEQ ID NO: 1918047 - protein, 7 aa, Staphylococcus
KADGIDA

SEQ ID NO: 1918048 - protein, 19 aa, Staphylococcus
KADGLVSGAAHSTGDTVRP

SEQ ID NO: 1918049 - protein, 5 aa, Staphylococcus
KADNG

SEQ ID NO: 1918050 - protein, 6 aa, Staphylococcus
KADPDL

SEQ ID NO: 1918051 - protein, 5 aa, Staphylococcus
KADRA

SEQ ID NO: 1918052 - protein, 9 aa, Staphylococcus
KAEKDDTDL

SEQ ID NO: 1918053 - protein, 5 aa, Staphylococcus
KAENG

SEQ ID NO: 1918054 - protein, 14 aa, Staphylococcus
KAETFEKELPQTKD

SEQ ID NO: 1918055 - protein, 17 aa, Staphylococcus
KAFPGQPSVAHDSDIEG

SEQ ID NO: 1918056 - protein, 7 aa, Staphylococcus
KAFSEDV

SEQ ID NO: 1918057 - protein, 4 aa, Staphylococcus
KAGD

SEQ ID NO: 1918058 - protein, 6 aa, Staphylococcus
KAGKTL

SEQ ID NO: 1918059 - protein, 7 aa, Staphylococcus
KAGKTLA

SEQ ID NO: 1918060 - protein, 7 aa, Staphylococcus
KAGNPDI

SEQ ID NO: 1918061 - protein, 4 aa, Staphylococcus
KAGY

SEQ ID NO: 1918062 - protein, 10 aa, Staphylococcus
KAHGGSNARA

SEQ ID NO: 1918063 - protein, 13 aa, Staphylococcus
KAHNETDIADNAV

SEQ ID NO: 1918064 - protein, 7 aa, Staphylococcus
KAHPGDL

SEQ ID NO: 1918065 - protein, 8 aa, Staphylococcus
KAIEETAN

SEQ ID NO: 1918066 - protein, 8 aa, Staphylococcus
KAIGKDKN

SEQ ID NO: 1918067 - protein, 8 aa, Staphylococcus
KAIGTGPF

SEQ ID NO: 1918068 - protein, 6 aa, Staphylococcus
KAIQEG

SEQ ID NO: 1918069 - protein, 8 aa, Staphylococcus
KAISPRTT

SEQ ID NO: 1918070 - protein, 7 aa, Staphylococcus
KAKAGDQ

SEQ ID NO: 1918071 - protein, 8 aa, Staphylococcus
KAKEINEQ

SEQ ID NO: 1918072 - protein, 17 aa, Staphylococcus
KAKEKIAEEGYDPEYGA

SEQ ID NO: 1918073 - protein, 7 aa, Staphylococcus
KAKEQGK

SEQ ID NO: 1918074 - protein, 4 aa, Staphylococcus
KAKG

SEQ ID NO: 1918075 - protein, 7 aa, Staphylococcus
KAKGEDA

SEQ ID NO: 1918076 - protein, 9 aa, Staphylococcus
KAKGGTGDK

SEQ ID NO: 1918077 - protein, 6 aa, Staphylococcus
KAKNIQ

SEQ ID NO: 1918078 - protein, 11 aa, Staphylococcus
KAKPSSAKGTY

SEQ ID NO: 1918079 - protein, 8 aa, Staphylococcus
KAKPSTLK

SEQ ID NO: 1918080 - protein, 9 aa, Staphylococcus
KAKPSTLKD

SEQ ID NO: 1918081 - protein, 4 aa, Staphylococcus
KAKQ

SEQ ID NO: 1918082 - protein, 7 aa, Staphylococcus
KAKSVEA

SEQ ID NO: 1918083 - protein, 5 aa, Staphylococcus
KAKYQ

SEQ ID NO: 1918084 - protein, 6 aa, Staphylococcus
KALTTT

SEQ ID NO: 1918085 - protein, 7 aa, Staphylococcus
KAMTGYQ

SEQ ID NO: 1918086 - protein, 14 aa, Staphylococcus
KANDDGEPSGTAGV

SEQ ID NO: 1918087 - protein, 8 aa, Staphylococcus
KANKRGIP

SEQ ID NO: 1918088 - protein, 5 aa, Staphylococcus
KANPF

SEQ ID NO: 1918089 - protein, 5 aa, Staphylococcus
KANPQ

SEQ ID NO: 1918090 - protein, 7 aa, Staphylococcus
KAPKLEG

SEQ ID NO: 1918091 - protein, 10 aa, Staphylococcus
KAPNTSSTIV

SEQ ID NO: 1918092 - protein, 13 aa, Staphylococcus
KAQDVIDKNNALK

SEQ ID NO: 1918093 - protein, 6 aa, Staphylococcus
KAQEII

SEQ ID NO: 1918094 - protein, 6 aa, Staphylococcus
KAQQSK

SEQ ID NO: 1918095 - protein, 14 aa, Staphylococcus
KARKELSSDKLEEN

SEQ ID NO: 1918096 - protein, 9 aa, Staphylococcus
KARVPAGGA

SEQ ID NO: 1918097 - protein, 7 aa, Staphylococcus
KASEDHE

SEQ ID NO: 1918098 - protein, 8 aa, Staphylococcus
KASEHASR

SEQ ID NO: 1918099 - protein, 8 aa, Staphylococcus
KASEVPSA

SEQ ID NO: 1918100 - protein, 11 aa, Staphylococcus
KASHKEPKNPY

SEQ ID NO: 1918101 - protein, 7 aa, Staphylococcus
KASPEHP

SEQ ID NO: 1918102 - protein, 8 aa, Staphylococcus
KASRETVR

SEQ ID NO: 1918103 - protein, 7 aa, Staphylococcus
KASRIRQ

SEQ ID NO: 1918104 - protein, 8 aa, Staphylococcus
KASYEGKV

SEQ ID NO: 1918105 - protein, 11 aa, Staphylococcus
KATDAPNHGMR

SEQ ID NO: 1918106 - protein, 8 aa, Staphylococcus
KATPEAKN

SEQ ID NO: 1918107 - protein, 6 aa, Staphylococcus
KAVEKG

SEQ ID NO: 1918108 - protein, 9 aa, Staphylococcus
KAVNPPNVM

SEQ ID NO: 1918109 - protein, 6 aa, Staphylococcus
KAVPNG

SEQ ID NO: 1918110 - protein, 6 aa, Staphylococcus
KAVSEM

SEQ ID NO: 1918111 - protein, 9 aa, Staphylococcus
KAYETGKGK

SEQ ID NO: 1918112 - protein, 4 aa, Staphylococcus
KAYP

SEQ ID NO: 1918113 - protein, 12 aa, Staphylococcus
KCEGSGQEFEEP

SEQ ID NO: 1918114 - protein, 12 aa, Staphylococcus
KCNNEEELKSGI

SEQ ID NO: 1918115 - protein, 6 aa, Staphylococcus
KDADAA

SEQ ID NO: 1918116 - protein, 5 aa, Staphylococcus
KDAME

SEQ ID NO: 1918117 - protein, 13 aa, Staphylococcus
KDAQTETYNDNDL

SEQ ID NO: 1918118 - protein, 9 aa, Staphylococcus
KDARRKREI

SEQ ID NO: 1918119 - protein, 9 aa, Staphylococcus
KDASGPYHK

SEQ ID NO: 1918120 - protein, 7 aa, Staphylococcus
KDATTSL

SEQ ID NO: 1918121 - protein, 12 aa, Staphylococcus
KDAVKESFKHPR

SEQ ID NO: 1918122 - protein, 7 aa, Staphylococcus
KDAVNTG

SEQ ID NO: 1918123 - protein, 7 aa, Staphylococcus
KDAVTSI

SEQ ID NO: 1918124 - protein, 7 aa, Staphylococcus
KDDDTFG

SEQ ID NO: 1918125 - protein, 9 aa, Staphylococcus
KDDEKRNNI

SEQ ID NO: 1918126 - protein, 4 aa, Staphylococcus
KDDI

SEQ ID NO: 1918127 - protein, 5 aa, Staphylococcus
KDDIE

SEQ ID NO: 1918128 - protein, 8 aa, Staphylococcus
KDDSQKDM

SEQ ID NO: 1918129 - protein, 5 aa, Staphylococcus
KDEDW

SEQ ID NO: 1918130 - protein, 15 aa, Staphylococcus
KDEGEVTASDITHDS

SEQ ID NO: 1918131 - protein, 21 aa, Staphylococcus
KDEIQEAQKYYTQKRAKKHEN

SEQ ID NO: 1918132 - protein, 11 aa, Staphylococcus
KDENGNDYPEW

SEQ ID NO: 1918133 - protein, 9 aa, Staphylococcus
KDEPAGEDC

SEQ ID NO: 1918134 - protein, 7 aa, Staphylococcus
KDESNKV

SEQ ID NO: 1918135 - protein, 8 aa, Staphylococcus
KDESQKDM

SEQ ID NO: 1918136 - protein, 8 aa, Staphylococcus
KDGDPRAK

SEQ ID NO: 1918137 - protein, 4 aa, Staphylococcus
KDGI

SEQ ID NO: 1918138 - protein, 4 aa, Staphylococcus
KDGL

SEQ ID NO: 1918139 - protein, 9 aa, Staphylococcus
KDGSGPYHK

SEQ ID NO: 1918140 - protein, 13 aa, Staphylococcus
KDGSLTGYGGTID

SEQ ID NO: 1918141 - protein, 8 aa, Staphylococcus
KDGTLDPV

SEQ ID NO: 1918142 - protein, 9 aa, Staphylococcus
KDGTLDPVV

SEQ ID NO: 1918143 - protein, 5 aa, Staphylococcus
KDGTM

SEQ ID NO: 1918144 - protein, 4 aa, Staphylococcus
KDGV

SEQ ID NO: 1918145 - protein, 7 aa, Staphylococcus
KDHLSAE

SEQ ID NO: 1918146 - protein, 7 aa, Staphylococcus
KDHTGAI

SEQ ID NO: 1918147 - protein, 4 aa, Staphylococcus
KDIE

SEQ ID NO: 1918148 - protein, 5 aa, Staphylococcus
KDIEG

SEQ ID NO: 1918149 - protein, 4 aa, Staphylococcus
KDIN

SEQ ID NO: 1918150 - protein, 6 aa, Staphylococcus
KDITSY

SEQ ID NO: 1918151 - protein, 4 aa, Staphylococcus
KDKD

SEQ ID NO: 1918152 - protein, 8 aa, Staphylococcus
KDKETLQK

SEQ ID NO: 1918153 - protein, 4 aa, Staphylococcus
KDKF

SEQ ID NO: 1918154 - protein, 16 aa, Staphylococcus
KDKGDRSITLRPEGTA

SEQ ID NO: 1918155 - protein, 17 aa, Staphylococcus
KDKGDRSITLRPEGTAA

SEQ ID NO: 1918156 - protein, 5 aa, Staphylococcus
KDKHG

SEQ ID NO: 1918157 - protein, 6 aa, Staphylococcus
KDKKIK

SEQ ID NO: 1918158 - protein, 4 aa, Staphylococcus
KDKL

SEQ ID NO: 1918159 - protein, 8 aa, Staphylococcus
KDKSEQQL

SEQ ID NO: 1918160 - protein, 8 aa, Staphylococcus
KDKTAKDV

SEQ ID NO: 1918161 - protein, 6 aa, Staphylococcus
KDKTYT

SEQ ID NO: 1918162 - protein, 6 aa, Staphylococcus
KDLGRK

SEQ ID NO: 1918163 - protein, 10 aa, Staphylococcus
KDLQEDKEGL

SEQ ID NO: 1918164 - protein, 5 aa, Staphylococcus
KDNGY

SEQ ID NO: 1918165 - protein, 4 aa, Staphylococcus
KDNK

SEQ ID NO: 1918166 - protein, 4 aa, Staphylococcus
KDNP

SEQ ID NO: 1918167 - protein, 4 aa, Staphylococcus
KDNR

SEQ ID NO: 1918168 - protein, 5 aa, Staphylococcus
KDPDF

SEQ ID NO: 1918169 - protein, 8 aa, Staphylococcus
KDPNDDKD

SEQ ID NO: 1918170 - protein, 14 aa, Staphylococcus
KDPNKHSLPQEETN

SEQ ID NO: 1918171 - protein, 5 aa, Staphylococcus
KDQGF

SEQ ID NO: 1918172 - protein, 4 aa, Staphylococcus
KDQR

SEQ ID NO: 1918173 - protein, 8 aa, Staphylococcus
KDQSQVER

SEQ ID NO: 1918174 - protein, 4 aa, Staphylococcus
KDRG

SEQ ID NO: 1918175 - protein, 6 aa, Staphylococcus
KDRINK

SEQ ID NO: 1918176 - protein, 4 aa, Staphylococcus
KDRN

SEQ ID NO: 1918177 - protein, 8 aa, Staphylococcus
KDRSRKEL

SEQ ID NO: 1918178 - protein, 7 aa, Staphylococcus
KDSIEDL

SEQ ID NO: 1918179 - protein, 8 aa, Staphylococcus
KDSIQKGD

SEQ ID NO: 1918180 - protein, 7 aa, Staphylococcus
KDTDIRA

SEQ ID NO: 1918181 - protein, 4 aa, Staphylococcus
KDTE

SEQ ID NO: 1918182 - protein, 7 aa, Staphylococcus
KDTEAAK

SEQ ID NO: 1918183 - protein, 8 aa, Staphylococcus
KDTEAAKQ

SEQ ID NO: 1918184 - protein, 11 aa, Staphylococcus
KDTEDSKGNLQ

SEQ ID NO: 1918185 - protein, 7 aa, Staphylococcus
KDTNVST

SEQ ID NO: 1918186 - protein, 6 aa, Staphylococcus
KDVRNM

SEQ ID NO: 1918187 - protein, 13 aa, Staphylococcus
KDVVTTSRFPGTT

SEQ ID NO: 1918188 - protein, 12 aa, Staphylococcus
KDYEENTPLEEQ

SEQ ID NO: 1918189 - protein, 4 aa, Staphylococcus
KDYK

SEQ ID NO: 1918190 - protein, 8 aa, Staphylococcus
KEAAKKCD

SEQ ID NO: 1918191 - protein, 4 aa, Staphylococcus
KEAG

SEQ ID NO: 1918192 - protein, 6 aa, Staphylococcus
KEASEQ

SEQ ID NO: 1918193 - protein, 5 aa, Staphylococcus
KEASR

SEQ ID NO: 1918194 - protein, 5 aa, Staphylococcus
KEATG

SEQ ID NO: 1918195 - protein, 6 aa, Staphylococcus
KEATVQ

SEQ ID NO: 1918196 - protein, 8 aa, Staphylococcus
KEDEDRVR

SEQ ID NO: 1918197 - protein, 8 aa, Staphylococcus
KEDGTVDF

SEQ ID NO: 1918198 - protein, 4 aa, Staphylococcus
KEDK

SEQ ID NO: 1918199 - protein, 5 aa, Staphylococcus
KEDKI

SEQ ID NO: 1918200 - protein, 6 aa, Staphylococcus
KEDKIK

SEQ ID NO: 1918201 - protein, 5 aa, Staphylococcus
KEDVD

SEQ ID NO: 1918202 - protein, 9 aa, Staphylococcus
KEEAAELAN

SEQ ID NO: 1918203 - protein, 12 aa, Staphylococcus
KEEAAKLAKKVE

SEQ ID NO: 1918204 - protein, 4 aa, Staphylococcus
KEEG

SEQ ID NO: 1918205 - protein, 5 aa, Staphylococcus
KEEGL

SEQ ID NO: 1918206 - protein, 9 aa, Staphylococcus
KEEGLKAAN

SEQ ID NO: 1918207 - protein, 7 aa, Staphylococcus
KEELERA

SEQ ID NO: 1918208 - protein, 4 aa, Staphylococcus
KEEN

SEQ ID NO: 1918209 - protein, 6 aa, Staphylococcus
KEEQPN

SEQ ID NO: 1918210 - protein, 4 aa, Staphylococcus
KEFE

SEQ ID NO: 1918211 - protein, 6 aa, Staphylococcus
KEFSDD

SEQ ID NO: 1918212 - protein, 6 aa, Staphylococcus
KEFSED

SEQ ID NO: 1918213 - protein, 11 aa, Staphylococcus
KEFSNDAKITE

SEQ ID NO: 1918214 - protein, 8 aa, Staphylococcus
KEGDPRAK

SEQ ID NO: 1918215 - protein, 4 aa, Staphylococcus
KEGK

SEQ ID NO: 1918216 - protein, 5 aa, Staphylococcus
KEGKD

SEQ ID NO: 1918217 - protein, 7 aa, Staphylococcus
KEGQIAG

SEQ ID NO: 1918218 - protein, 8 aa, Staphylococcus
KEGSDDYR

SEQ ID NO: 1918219 - protein, 7 aa, Staphylococcus
KEGSGTG

SEQ ID NO: 1918220 - protein, 7 aa, Staphylococcus
KEGTEEV

SEQ ID NO: 1918221 - protein, 7 aa, Staphylococcus
KEGTPEV

SEQ ID NO: 1918222 - protein, 4 aa, Staphylococcus
KEHG

SEQ ID NO: 1918223 - protein, 8 aa, Staphylococcus
KEIEERDH

SEQ ID NO: 1918224 - protein, 8 aa, Staphylococcus
KEIKPSEV

SEQ ID NO: 1918225 - protein, 6 aa, Staphylococcus
KEIPDA

SEQ ID NO: 1918226 - protein, 4 aa, Staphylococcus
KEIS

SEQ ID NO: 1918227 - protein, 6 aa, Staphylococcus
KEKEQV

SEQ ID NO: 1918228 - protein, 8 aa, Staphylococcus
KEKGYTPK

SEQ ID NO: 1918229 - protein, 5 aa, Staphylococcus
KEKLN

SEQ ID NO: 1918230 - protein, 6 aa, Staphylococcus
KEKQRL

SEQ ID NO: 1918231 - protein, 5 aa, Staphylococcus
KEKTD

SEQ ID NO: 1918232 - protein, 7 aa, Staphylococcus
KELKRSL

SEQ ID NO: 1918233 - protein, 5 aa, Staphylococcus
KELNT

SEQ ID NO: 1918234 - protein, 4 aa, Staphylococcus
KELS

SEQ ID NO: 1918235 - protein, 9 aa, Staphylococcus
KELVDGAPK

SEQ ID NO: 1918236 - protein, 10 aa, Staphylococcus
KELVDGAPKV

SEQ ID NO: 1918237 - protein, 11 aa, Staphylococcus
KEMKKAAKDLD

SEQ ID NO: 1918238 - protein, 6 aa, Staphylococcus
KEMRAA

SEQ ID NO: 1918239 - protein, 14 aa, Staphylococcus
KENAFYDPNGEMQL

SEQ ID NO: 1918240 - protein, 8 aa, Staphylococcus
KENDLAHG

SEQ ID NO: 1918241 - protein, 6 aa, Staphylococcus
KENDVP

SEQ ID NO: 1918242 - protein, 8 aa, Staphylococcus
KENGANTV

SEQ ID NO: 1918243 - protein, 4 aa, Staphylococcus
KENL

SEQ ID NO: 1918244 - protein, 5 aa, Staphylococcus
KENND

SEQ ID NO: 1918245 - protein, 6 aa, Staphylococcus
KENQDL

SEQ ID NO: 1918246 - protein, 6 aa, Staphylococcus
KENQTY

SEQ ID NO: 1918247 - protein, 5 aa, Staphylococcus
KENQV

SEQ ID NO: 1918248 - protein, 5 aa, Staphylococcus
KEPAA

SEQ ID NO: 1918249 - protein, 9 aa, Staphylococcus
KEPREHTSE

SEQ ID NO: 1918250 - protein, 4 aa, Staphylococcus
KEQA

SEQ ID NO: 1918251 - protein, 26 aa, Staphylococcus
KEQGIDESIHPNDDVNKSQSSNDTFP

SEQ ID NO: 1918252 - protein, 4 aa, Staphylococcus
KEQM

SEQ ID NO: 1918253 - protein, 13 aa, Staphylococcus
KEQNGAAMSLGRT

SEQ ID NO: 1918254 - protein, 4 aa, Staphylococcus
KEQR

SEQ ID NO: 1918255 - protein, 9 aa, Staphylococcus
KEQSQDNPI

SEQ ID NO: 1918256 - protein, 13 aa, Staphylococcus
KEQVPNNDERVEI

SEQ ID NO: 1918257 - protein, 4 aa, Staphylococcus
KEQY

SEQ ID NO: 1918258 - protein, 14 aa, Staphylococcus
KERHEDKKKNKYKI

SEQ ID NO: 1918259 - protein, 6 aa, Staphylococcus
KERINK

SEQ ID NO: 1918260 - protein, 4 aa, Staphylococcus
KERR

SEQ ID NO: 1918261 - protein, 8 aa, Staphylococcus
KERSRKEL

SEQ ID NO: 1918262 - protein, 4 aa, Staphylococcus
KESE

SEQ ID NO: 1918263 - protein, 4 aa, Staphylococcus
KESF

SEQ ID NO: 1918264 - protein, 5 aa, Staphylococcus
KESNL

SEQ ID NO: 1918265 - protein, 5 aa, Staphylococcus
KETDG

SEQ ID NO: 1918266 - protein, 5 aa, Staphylococcus
KETFE

SEQ ID NO: 1918267 - protein, 10 aa, Staphylococcus
KETGKLKMNG

SEQ ID NO: 1918268 - protein, 6 aa, Staphylococcus
KETGLN

SEQ ID NO: 1918269 - protein, 8 aa, Staphylococcus
KETLKKPY

SEQ ID NO: 1918270 - protein, 8 aa, Staphylococcus
KETSRTSR

SEQ ID NO: 1918271 - protein, 10 aa, Staphylococcus
KETVEEGVRK

SEQ ID NO: 1918272 - protein, 4 aa, Staphylococcus
KETY

SEQ ID NO: 1918273 - protein, 8 aa, Staphylococcus
KEVENNQV

SEQ ID NO: 1918274 - protein, 5 aa, Staphylococcus
KEVPE

SEQ ID NO: 1918275 - protein, 4 aa, Staphylococcus
KEYD

SEQ ID NO: 1918276 - protein, 5 aa, Staphylococcus
KEYTK

SEQ ID NO: 1918277 - protein, 7 aa, Staphylococcus
KFDGEGC

SEQ ID NO: 1918278 - protein, 4 aa, Staphylococcus
KFDP

SEQ ID NO: 1918279 - protein, 17 aa, Staphylococcus
KFEQQKKEKEMKKKQKV

SEQ ID NO: 1918280 - protein, 10 aa, Staphylococcus
KFGTTDGTIT

SEQ ID NO: 1918281 - protein, 17 aa, Staphylococcus
KFPYAANGRALSLDDTN

SEQ ID NO: 1918282 - protein, 18 aa, Staphylococcus
KFPYAANGRALSLDDTTG

SEQ ID NO: 1918283 - protein, 12 aa, Staphylococcus
KGAAASNHFEGG

SEQ ID NO: 1918284 - protein, 14 aa, Staphylococcus
KGAHAAKPEQGNDP

SEQ ID NO: 1918285 - protein, 4 aa, Staphylococcus
KGAT

SEQ ID NO: 1918286 - protein, 7 aa, Staphylococcus
KGDKERI

SEQ ID NO: 1918287 - protein, 5 aa, Staphylococcus
KGDLG

SEQ ID NO: 1918288 - protein, 5 aa, Staphylococcus
KGDRI

SEQ ID NO: 1918289 - protein, 8 aa, Staphylococcus
KGEEARSI

SEQ ID NO: 1918290 - protein, 8 aa, Staphylococcus
KGEIPNDD

SEQ ID NO: 1918291 - protein, 6 aa, Staphylococcus
KGELNN

SEQ ID NO: 1918292 - protein, 8 aa, Staphylococcus
KGETHEET

SEQ ID NO: 1918293 - protein, 7 aa, Staphylococcus
KGGDPAI

SEQ ID NO: 1918294 - protein, 6 aa, Staphylococcus
KGGGGA

SEQ ID NO: 1918295 - protein, 9 aa, Staphylococcus
KGGHQSFEE

SEQ ID NO: 1918296 - protein, 7 aa, Staphylococcus
KGGPVGL

SEQ ID NO: 1918297 - protein, 8 aa, Staphylococcus
KGGRLADH

SEQ ID NO: 1918298 - protein, 9 aa, Staphylococcus
KGGVGKTTI

SEQ ID NO: 1918299 - protein, 4 aa, Staphylococcus
KGHE

SEQ ID NO: 1918300 - protein, 6 aa, Staphylococcus
KGHEAM

SEQ ID NO: 1918301 - protein, 6 aa, Staphylococcus
KGHGYR

SEQ ID NO: 1918302 - protein, 13 aa, Staphylococcus
KGHTVTRLKGGDP

SEQ ID NO: 1918303 - protein, 6 aa, Staphylococcus
KGIGFE

SEQ ID NO: 1918304 - protein, 5 aa, Staphylococcus
KGIKN

SEQ ID NO: 1918305 - protein, 6 aa, Staphylococcus
KGIKNV

SEQ ID NO: 1918306 - protein, 9 aa, Staphylococcus
KGKEVSDYE

SEQ ID NO: 1918307 - protein, 14 aa, Staphylococcus
KGKGGHGAKPHETI

SEQ ID NO: 1918308 - protein, 5 aa, Staphylococcus
KGKID

SEQ ID NO: 1918309 - protein, 8 aa, Staphylococcus
KGLDALND

SEQ ID NO: 1918310 - protein, 13 aa, Staphylococcus
KGLTGSGVEVKDH

SEQ ID NO: 1918311 - protein, 6 aa, Staphylococcus
KGNIID

SEQ ID NO: 1918312 - protein, 6 aa, Staphylococcus
KGNIVD

SEQ ID NO: 1918313 - protein, 6 aa, Staphylococcus
KGNKEA

SEQ ID NO: 1918314 - protein, 7 aa, Staphylococcus
KGNKERI

SEQ ID NO: 1918315 - protein, 5 aa, Staphylococcus
KGNPL

SEQ ID NO: 1918316 - protein, 12 aa, Staphylococcus
KGNYNLGGEQSG

SEQ ID NO: 1918317 - protein, 7 aa, Staphylococcus
KGPEIRT

SEQ ID NO: 1918318 - protein, 8 aa, Staphylococcus
KGPGSYTG

SEQ ID NO: 1918319 - protein, 8 aa, Staphylococcus
KGPQPIQR

SEQ ID NO: 1918320 - protein, 7 aa, Staphylococcus
KGPREAI

SEQ ID NO: 1918321 - protein, 9 aa, Staphylococcus
KGRKTTDDL

SEQ ID NO: 1918322 - protein, 7 aa, Staphylococcus
KGSAGIK

SEQ ID NO: 1918323 - protein, 5 aa, Staphylococcus
KGSFK

SEQ ID NO: 1918324 - protein, 8 aa, Staphylococcus
KGSIPRED

SEQ ID NO: 1918325 - protein, 10 aa, Staphylococcus
KGTAKGEGNS

SEQ ID NO: 1918326 - protein, 7 aa, Staphylococcus
KGTATDY

SEQ ID NO: 1918327 - protein, 6 aa, Staphylococcus
KGTMEY

SEQ ID NO: 1918328 - protein, 6 aa, Staphylococcus
KGVSPY

SEQ ID NO: 1918329 - protein, 5 aa, Staphylococcus
KGYDD

SEQ ID NO: 1918330 - protein, 5 aa, Staphylococcus
KGYNA

SEQ ID NO: 1918331 - protein, 8 aa, Staphylococcus
KGYRTINQ

SEQ ID NO: 1918332 - protein, 12 aa, Staphylococcus
KGYVTKKGNPFS

SEQ ID NO: 1918333 - protein, 6 aa, Staphylococcus
KHDTIG

SEQ ID NO: 1918334 - protein, 5 aa, Staphylococcus
KHKGN

SEQ ID NO: 1918335 - protein, 7 aa, Staphylococcus
KHKKANY

SEQ ID NO: 1918336 - protein, 8 aa, Staphylococcus
KHKKGQPI

SEQ ID NO: 1918337 - protein, 8 aa, Staphylococcus
KHKKGQPV

SEQ ID NO: 1918338 - protein, 8 aa, Staphylococcus
KHKQGQPV

SEQ ID NO: 1918339 - protein, 7 aa, Staphylococcus
KHNDDEL

SEQ ID NO: 1918340 - protein, 7 aa, Staphylococcus
KHNEDEI

SEQ ID NO: 1918341 - protein, 15 aa, Staphylococcus
KHQKPTQLNPEGGIL

SEQ ID NO: 1918342 - protein, 10 aa, Staphylococcus
KHRGGPHNGN

SEQ ID NO: 1918343 - protein, 4 aa, Staphylococcus
KHVS

SEQ ID NO: 1918344 - protein, 7 aa, Staphylococcus
KIADSGY

SEQ ID NO: 1918345 - protein, 6 aa, Staphylococcus
KIAGDE

SEQ ID NO: 1918346 - protein, 11 aa, Staphylococcus
KIAGSAQTRQK

SEQ ID NO: 1918347 - protein, 13 aa, Staphylococcus
KIDEGTDVNYGEL

SEQ ID NO: 1918348 - protein, 15 aa, Staphylococcus
KIEQGDEVAKSRLAE

SEQ ID NO: 1918349 - protein, 7 aa, Staphylococcus
KIGGEDD

SEQ ID NO: 1918350 - protein, 7 aa, Staphylococcus
KIGNSAR

SEQ ID NO: 1918351 - protein, 6 aa, Staphylococcus
KIKELE

SEQ ID NO: 1918352 - protein, 4 aa, Staphylococcus
KIPE

SEQ ID NO: 1918353 - protein, 6 aa, Staphylococcus
KISEEG

SEQ ID NO: 1918354 - protein, 8 aa, Staphylococcus
KISYQGLP

SEQ ID NO: 1918355 - protein, 6 aa, Staphylococcus
KITEEG

SEQ ID NO: 1918356 - protein, 9 aa, Staphylococcus
KITENRDEL

SEQ ID NO: 1918357 - protein, 6 aa, Staphylococcus
KITERH

SEQ ID NO: 1918358 - protein, 11 aa, Staphylococcus
KITSETGRSEL

SEQ ID NO: 1918359 - protein, 8 aa, Staphylococcus
KKAANEDT

SEQ ID NO: 1918360 - protein, 8 aa, Staphylococcus
KKAEPGDG

SEQ ID NO: 1918361 - protein, 11 aa, Staphylococcus
KKAFDGRGNYT

SEQ ID NO: 1918362 - protein, 6 aa, Staphylococcus
KKAGAS

SEQ ID NO: 1918363 - protein, 5 aa, Staphylococcus
KKAGI

SEQ ID NO: 1918364 - protein, 8 aa, Staphylococcus
KKAPYEQR

SEQ ID NO: 1918365 - protein, 14 aa, Staphylococcus
KKASENSKKPRHVV

SEQ ID NO: 1918366 - protein, 9 aa, Staphylococcus
KKATSNPRV

SEQ ID NO: 1918367 - protein, 4 aa, Staphylococcus
KKDT

SEQ ID NO: 1918368 - protein, 5 aa, Staphylococcus
KKEAD

SEQ ID NO: 1918369 - protein, 7 aa, Staphylococcus
KKEGQGC

SEQ ID NO: 1918370 - protein, 16 aa, Staphylococcus
KKEIGKDPHKGVNPDE

SEQ ID NO: 1918371 - protein, 17 aa, Staphylococcus
KKEIGKEPHKGVNPDEV

SEQ ID NO: 1918372 - protein, 6 aa, Staphylococcus
KKEIKR

SEQ ID NO: 1918373 - protein, 7 aa, Staphylococcus
KKEKPDL

SEQ ID NO: 1918374 - protein, 5 aa, Staphylococcus
KKEQY

SEQ ID NO: 1918375 - protein, 6 aa, Staphylococcus
KKERPD

SEQ ID NO: 1918376 - protein, 6 aa, Staphylococcus
KKETNI

SEQ ID NO: 1918377 - protein, 10 aa, Staphylococcus
KKEYDQRIQD

SEQ ID NO: 1918378 - protein, 6 aa, Staphylococcus
KKFGEE

SEQ ID NO: 1918379 - protein, 7 aa, Staphylococcus
KKGASRA

SEQ ID NO: 1918380 - protein, 9 aa, Staphylococcus
KKGDKHAEV

SEQ ID NO: 1918381 - protein, 6 aa, Staphylococcus
KKGDKV

SEQ ID NO: 1918382 - protein, 6 aa, Staphylococcus
KKGEKV

SEQ ID NO: 1918383 - protein, 6 aa, Staphylococcus
KKGKIE

SEQ ID NO: 1918384 - protein, 8 aa, Staphylococcus
KKGMKEKG

SEQ ID NO: 1918385 - protein, 7 aa, Staphylococcus
KKGRSSQ

SEQ ID NO: 1918386 - protein, 29 aa, Staphylococcus
KKGVSSTKNGRDSESKRLGAKRADGQFVT

SEQ ID NO: 1918387 - protein, 30 aa, Staphylococcus
KKGVSSTKNGRDSESKRLGAKRADGQYVTG

SEQ ID NO: 1918388 - protein, 8 aa, Staphylococcus
KKKKDARE

SEQ ID NO: 1918389 - protein, 11 aa, Staphylococcus
KKLEKLDPDAE

SEQ ID NO: 1918390 - protein, 10 aa, Staphylococcus
KKLGNAVTRN

SEQ ID NO: 1918391 - protein, 7 aa, Staphylococcus
KKLNSDV

SEQ ID NO: 1918392 - protein, 9 aa, Staphylococcus
KKLSDSAKV

SEQ ID NO: 1918393 - protein, 7 aa, Staphylococcus
KKLTDRQ

SEQ ID NO: 1918394 - protein, 7 aa, Staphylococcus
KKLTKEG

SEQ ID NO: 1918395 - protein, 6 aa, Staphylococcus
KKMRED

SEQ ID NO: 1918396 - protein, 8 aa, Staphylococcus
KKMSEDLT

SEQ ID NO: 1918397 - protein, 7 aa, Staphylococcus
KKNFAEI

SEQ ID NO: 1918398 - protein, 9 aa, Staphylococcus
KKNYDSARN

SEQ ID NO: 1918399 - protein, 7 aa, Staphylococcus
KKPFSPR

SEQ ID NO: 1918400 - protein, 7 aa, Staphylococcus
KKPLEPQ

SEQ ID NO: 1918401 - protein, 9 aa, Staphylococcus
KKPLPSKDN

SEQ ID NO: 1918402 - protein, 6 aa, Staphylococcus
KKPNDT

SEQ ID NO: 1918403 - protein, 21 aa, Staphylococcus
KKPNIATATVGEGSSNQGDFH

SEQ ID NO: 1918404 - protein, 6 aa, Staphylococcus
KKPTPV

SEQ ID NO: 1918405 - protein, 17 aa, Staphylococcus
KKQAQDSVKAEAERAGQ

SEQ ID NO: 1918406 - protein, 9 aa, Staphylococcus
KKQDKTTLQ

SEQ ID NO: 1918407 - protein, 5 aa, Staphylococcus
KKQFD

SEQ ID NO: 1918408 - protein, 6 aa, Staphylococcus
KKQGTV

SEQ ID NO: 1918409 - protein, 5 aa, Staphylococcus
KKQKF

SEQ ID NO: 1918410 - protein, 7 aa, Staphylococcus
KKQKPDL

SEQ ID NO: 1918411 - protein, 8 aa, Staphylococcus
KKRSEREA

SEQ ID NO: 1918412 - protein, 6 aa, Staphylococcus
KKSDID

SEQ ID NO: 1918413 - protein, 9 aa, Staphylococcus
KKSFNNTHD

SEQ ID NO: 1918414 - protein, 9 aa, Staphylococcus
KKTEKGQFT

SEQ ID NO: 1918415 - protein, 10 aa, Staphylococcus
KKTIPVRPGR

SEQ ID NO: 1918416 - protein, 6 aa, Staphylococcus
KKTKSR

SEQ ID NO: 1918417 - protein, 5 aa, Staphylococcus
KKTME

SEQ ID NO: 1918418 - protein, 4 aa, Staphylococcus
KKTS

SEQ ID NO: 1918419 - protein, 6 aa, Staphylococcus
KKVASG

SEQ ID NO: 1918420 - protein, 9 aa, Staphylococcus
KKVEREVPV

SEQ ID NO: 1918421 - protein, 9 aa, Staphylococcus
KKYDNPFDP

SEQ ID NO: 1918422 - protein, 5 aa, Staphylococcus
KKYDR

SEQ ID NO: 1918423 - protein, 13 aa, Staphylococcus
KKYEGKDQATIDK

SEQ ID NO: 1918424 - protein, 13 aa, Staphylococcus
KKYEGKDQATIDQ

SEQ ID NO: 1918425 - protein, 16 aa, Staphylococcus
KKYLTVQDSKQNDVPA

SEQ ID NO: 1918426 - protein, 7 aa, Staphylococcus
KKYRLDK

SEQ ID NO: 1918427 - protein, 7 aa, Staphylococcus
KLAGPDT

SEQ ID NO: 1918428 - protein, 8 aa, Staphylococcus
KLALTQSK

SEQ ID NO: 1918429 - protein, 4 aa, Staphylococcus
KLEP

SEQ ID NO: 1918430 - protein, 4 aa, Staphylococcus
KLET

SEQ ID NO: 1918431 - protein, 4 aa, Staphylococcus
KLGG

SEQ ID NO: 1918432 - protein, 7 aa, Staphylococcus
KLGSGRQ

SEQ ID NO: 1918433 - protein, 9 aa, Staphylococcus
KLINKSKKP

SEQ ID NO: 1918434 - protein, 8 aa, Staphylococcus
KLKAYTKE

SEQ ID NO: 1918435 - protein, 5 aa, Staphylococcus
KLKED

SEQ ID NO: 1918436 - protein, 8 aa, Staphylococcus
KLKPKEQA

SEQ ID NO: 1918437 - protein, 8 aa, Staphylococcus
KLMGRKSE

SEQ ID NO: 1918438 - protein, 10 aa, Staphylococcus
KLNDKTPTTL

SEQ ID NO: 1918439 - protein, 5 aa, Staphylococcus
KLPDI

SEQ ID NO: 1918440 - protein, 6 aa, Staphylococcus
KLPEKR

SEQ ID NO: 1918441 - protein, 9 aa, Staphylococcus
KLPKTRSGK

SEQ ID NO: 1918442 - protein, 12 aa, Staphylococcus
KLPRDSSPTRLT

SEQ ID NO: 1918443 - protein, 10 aa, Staphylococcus
KLQKSGKTVT

SEQ ID NO: 1918444 - protein, 8 aa, Staphylococcus
KLRNTGKV

SEQ ID NO: 1918445 - protein, 9 aa, Staphylococcus
KLSDAKKDA

SEQ ID NO: 1918446 - protein, 8 aa, Staphylococcus
KLSGGEQK

SEQ ID NO: 1918447 - protein, 8 aa, Staphylococcus
KLSGGQQR

SEQ ID NO: 1918448 - protein, 4 aa, Staphylococcus
KLSN

SEQ ID NO: 1918449 - protein, 6 aa, Staphylococcus
KLSNQD

SEQ ID NO: 1918450 - protein, 8 aa, Staphylococcus
KLSNQTLK

SEQ ID NO: 1918451 - protein, 6 aa, Staphylococcus
KLSSEA

SEQ ID NO: 1918452 - protein, 12 aa, Staphylococcus
KLSSGKTVDERM

SEQ ID NO: 1918453 - protein, 6 aa, Staphylococcus
KLTEPA

SEQ ID NO: 1918454 - protein, 13 aa, Staphylococcus
KLTGKPAATIDPE

SEQ ID NO: 1918455 - protein, 14 aa, Staphylococcus
KLYQREDDNPETVA

SEQ ID NO: 1918456 - protein, 11 aa, Staphylococcus
KMDQQAHPGHN

SEQ ID NO: 1918457 - protein, 5 aa, Staphylococcus
KMEED

SEQ ID NO: 1918458 - protein, 11 aa, Staphylococcus
KMEVPNKGRDI

SEQ ID NO: 1918459 - protein, 12 aa, Staphylococcus
KMRGKGKVTEAD

SEQ ID NO: 1918460 - protein, 12 aa, Staphylococcus
KMSRRKKTAAKK

SEQ ID NO: 1918461 - protein, 13 aa, Staphylococcus
KNAAAGLDLGGGK

SEQ ID NO: 1918462 - protein, 8 aa, Staphylococcus
KNAADSIK

SEQ ID NO: 1918463 - protein, 18 aa, Staphylococcus
KNAEDVAKLRGKSVEELY

SEQ ID NO: 1918464 - protein, 11 aa, Staphylococcus
KNAEETENGVK

SEQ ID NO: 1918465 - protein, 5 aa, Staphylococcus
KNAFN

SEQ ID NO: 1918466 - protein, 7 aa, Staphylococcus
KNASEGI

SEQ ID NO: 1918467 - protein, 17 aa, Staphylococcus
KNDEDNVQKLKAYTEVI

SEQ ID NO: 1918468 - protein, 4 aa, Staphylococcus
KNEG

SEQ ID NO: 1918469 - protein, 8 aa, Staphylococcus
KNEGKTLH

SEQ ID NO: 1918470 - protein, 7 aa, Staphylococcus
KNEKARK

SEQ ID NO: 1918471 - protein, 7 aa, Staphylococcus
KNENARK

SEQ ID NO: 1918472 - protein, 4 aa, Staphylococcus
KNGE

SEQ ID NO: 1918473 - protein, 8 aa, Staphylococcus
KNHEREAD

SEQ ID NO: 1918474 - protein, 11 aa, Staphylococcus
KNIQGIDTEPV

SEQ ID NO: 1918475 - protein, 9 aa, Staphylococcus
KNKTGGTNR

SEQ ID NO: 1918476 - protein, 5 aa, Staphylococcus
KNLTV

SEQ ID NO: 1918477 - protein, 7 aa, Staphylococcus
KNPAGMN

SEQ ID NO: 1918478 - protein, 7 aa, Staphylococcus
KNPDETV

SEQ ID NO: 1918479 - protein, 9 aa, Staphylococcus
KNPPEEWRK

SEQ ID NO: 1918480 - protein, 8 aa, Staphylococcus
KNPVTEPD

SEQ ID NO: 1918481 - protein, 6 aa, Staphylococcus
KNRSQA

SEQ ID NO: 1918482 - protein, 7 aa, Staphylococcus
KNSAVDA

SEQ ID NO: 1918483 - protein, 8 aa, Staphylococcus
KNSAYLGT

SEQ ID NO: 1918484 - protein, 5 aa, Staphylococcus
KNSEL

SEQ ID NO: 1918485 - protein, 4 aa, Staphylococcus
KNSQ

SEQ ID NO: 1918486 - protein, 5 aa, Staphylococcus
KNSQP

SEQ ID NO: 1918487 - protein, 11 aa, Staphylococcus
KNTAESYLGDK

SEQ ID NO: 1918488 - protein, 6 aa, Staphylococcus
KNTGRP

SEQ ID NO: 1918489 - protein, 17 aa, Staphylococcus
KNTTVKVSGVSKEQVGA

SEQ ID NO: 1918490 - protein, 10 aa, Staphylococcus
KNVQGIETEP

SEQ ID NO: 1918491 - protein, 9 aa, Staphylococcus
KNVTEGPSV

SEQ ID NO: 1918492 - protein, 8 aa, Staphylococcus
KPDEHQSN

SEQ ID NO: 1918493 - protein, 4 aa, Staphylococcus
KPDI

SEQ ID NO: 1918494 - protein, 6 aa, Staphylococcus
KPELTP

SEQ ID NO: 1918495 - protein, 9 aa, Staphylococcus
KPERTEGNK

SEQ ID NO: 1918496 - protein, 8 aa, Staphylococcus
KPESTRQQ

SEQ ID NO: 1918497 - protein, 4 aa, Staphylococcus
KPFV

SEQ ID NO: 1918498 - protein, 6 aa, Staphylococcus
KPGASY

SEQ ID NO: 1918499 - protein, 10 aa, Staphylococcus
KPGEVTPEQC

SEQ ID NO: 1918500 - protein, 23 aa, Staphylococcus
KPGKGGQIARSAGASSQVLGKEG

SEQ ID NO: 1918501 - protein, 8 aa, Staphylococcus
KPGTGKTH

SEQ ID NO: 1918502 - protein, 8 aa, Staphylococcus
KPKAANEL

SEQ ID NO: 1918503 - protein, 4 aa, Staphylococcus
KPLD

SEQ ID NO: 1918504 - protein, 13 aa, Staphylococcus
KPLITKAKKSVAT

SEQ ID NO: 1918505 - protein, 13 aa, Staphylococcus
KPLVTKAKKSVAT

SEQ ID NO: 1918506 - protein, 8 aa, Staphylococcus
KPMDSEEA

SEQ ID NO: 1918507 - protein, 6 aa, Staphylococcus
KPMGKA

SEQ ID NO: 1918508 - protein, 4 aa, Staphylococcus
KPNA

SEQ ID NO: 1918509 - protein, 8 aa, Staphylococcus
KPNEHTQS

SEQ ID NO: 1918510 - protein, 6 aa, Staphylococcus
KPNIKA

SEQ ID NO: 1918511 - protein, 4 aa, Staphylococcus
KPNN

SEQ ID NO: 1918512 - protein, 4 aa, Staphylococcus
KPNW

SEQ ID NO: 1918513 - protein, 12 aa, Staphylococcus
KPPIPGRTNSTA

SEQ ID NO: 1918514 - protein, 5 aa, Staphylococcus
KPQST

SEQ ID NO: 1918515 - protein, 6 aa, Staphylococcus
KPRLTK

SEQ ID NO: 1918516 - protein, 8 aa, Staphylococcus
KPSELTPN

SEQ ID NO: 1918517 - protein, 6 aa, Staphylococcus
KPTYGR

SEQ ID NO: 1918518 - protein, 10 aa, Staphylococcus
KPVSKEGTER

SEQ ID NO: 1918519 - protein, 4 aa, Staphylococcus
KPYC

SEQ ID NO: 1918520 - protein, 9 aa, Staphylococcus
KQAEFKSNK

SEQ ID NO: 1918521 - protein, 4 aa, Staphylococcus
KQAG

SEQ ID NO: 1918522 - protein, 10 aa, Staphylococcus
KQAKSSISED

SEQ ID NO: 1918523 - protein, 5 aa, Staphylococcus
KQDGT

SEQ ID NO: 1918524 - protein, 8 aa, Staphylococcus
KQESRDGT

SEQ ID NO: 1918525 - protein, 5 aa, Staphylococcus
KQEYG

SEQ ID NO: 1918526 - protein, 6 aa, Staphylococcus
KQGEMK

SEQ ID NO: 1918527 - protein, 5 aa, Staphylococcus
KQGSN

SEQ ID NO: 1918528 - protein, 6 aa, Staphylococcus
KQHGVH

SEQ ID NO: 1918529 - protein, 6 aa, Staphylococcus
KQKGLD

SEQ ID NO: 1918530 - protein, 11 aa, Staphylococcus
KQLEQRNKEIT

SEQ ID NO: 1918531 - protein, 5 aa, Staphylococcus
KQLHG

SEQ ID NO: 1918532 - protein, 6 aa, Staphylococcus
KQLHGK

SEQ ID NO: 1918533 - protein, 4 aa, Staphylococcus
KQLT

SEQ ID NO: 1918534 - protein, 7 aa, Staphylococcus
KQLTQTQ

SEQ ID NO: 1918535 - protein, 30 aa, Staphylococcus; identical to SEQ ID NO: 1762115

SEQ ID NO: 1918536 - protein, 18 aa, Staphylococcus
KQNISEDWSKVKKGYKRK

SEQ ID NO: 1918537 - protein, 4 aa, Staphylococcus
KQNY

SEQ ID NO: 1918538 - protein, 6 aa, Staphylococcus
KQQESY

SEQ ID NO: 1918539 - protein, 7 aa, Staphylococcus
KQQIEST

SEQ ID NO: 1918540 - protein, 9 aa, Staphylococcus
KQQRDENLD

SEQ ID NO: 1918541 - protein, 6 aa, Staphylococcus
KQQRDI

SEQ ID NO: 1918542 - protein, 7 aa, Staphylococcus
KQQRTQD

SEQ ID NO: 1918543 - protein, 8 aa, Staphylococcus
KQRGRDME

SEQ ID NO: 1918544 - protein, 9 aa, Staphylococcus
KQRNPQYSV

SEQ ID NO: 1918545 - protein, 9 aa, Staphylococcus
KQSKRGTLR

SEQ ID NO: 1918546 - protein, 6 aa, Staphylococcus
KQSLSE

SEQ ID NO: 1918547 - protein, 7 aa, Staphylococcus
KQSNDNV

SEQ ID NO: 1918548 - protein, 8 aa, Staphylococcus
KQTQSNID

SEQ ID NO: 1918549 - protein, 7 aa, Staphylococcus
KQTRSDL

SEQ ID NO: 1918550 - protein, 6 aa, Staphylococcus
KQTSDV

SEQ ID NO: 1918551 - protein, 6 aa, Staphylococcus
KQVDGE

SEQ ID NO: 1918552 - protein, 10 aa, Staphylococcus
KQYKPSPASY

SEQ ID NO: 1918553 - protein, 4 aa, Staphylococcus
KQYN

SEQ ID NO: 1918554 - protein, 7 aa, Staphylococcus
KRAEEGI

SEQ ID NO: 1918555 - protein, 15 aa, Staphylococcus
KRAFDNDEGPNTGGM

SEQ ID NO: 1918556 - protein, 10 aa, Staphylococcus
KRDAKKENPI

SEQ ID NO: 1918557 - protein, 6 aa, Staphylococcus
KREEAA

SEQ ID NO: 1918558 - protein, 5 aa, Staphylococcus
KREEL

SEQ ID NO: 1918559 - protein, 4 aa, Staphylococcus
KREL

SEQ ID NO: 1918560 - protein, 7 aa, Staphylococcus
KRGAKRA

SEQ ID NO: 1918561 - protein, 4 aa, Staphylococcus
KRGI

SEQ ID NO: 1918562 - protein, 10 aa, Staphylococcus
KRGIGPSSVD

SEQ ID NO: 1918563 - protein, 6 aa, Staphylococcus
KRGKNA

SEQ ID NO: 1918564 - protein, 11 aa, Staphylococcus
KRGKSPLNPTN

SEQ ID NO: 1918565 - protein, 7 aa, Staphylococcus
KRGSNSI

SEQ ID NO: 1918566 - protein, 16 aa, Staphylococcus
KRIKDKKERYEAQANR

SEQ ID NO: 1918567 - protein, 8 aa, Staphylococcus
KRIQNSEK

SEQ ID NO: 1918568 - protein, 6 aa, Staphylococcus
KRKEEV

SEQ ID NO: 1918569 - protein, 7 aa, Staphylococcus
KRKGMPY

SEQ ID NO: 1918570 - protein, 6 aa, Staphylococcus
KRKNAS

SEQ ID NO: 1918571 - protein, 5 aa, Staphylococcus
KRLAG

SEQ ID NO: 1918572 - protein, 6 aa, Staphylococcus
KRLSQE

SEQ ID NO: 1918573 - protein, 13 aa, Staphylococcus
KRMEEKKIPEDLD

SEQ ID NO: 1918574 - protein, 6 aa, Staphylococcus
KRMRKT

SEQ ID NO: 1918575 - protein, 7 aa, Staphylococcus
KRNPREI

SEQ ID NO: 1918576 - protein, 13 aa, Staphylococcus
KRQAITNPNTVQS

SEQ ID NO: 1918577 - protein, 6 aa, Staphylococcus
KRQGKQ

SEQ ID NO: 1918578 - protein, 6 aa, Staphylococcus
KRQGKS

SEQ ID NO: 1918579 - protein, 7 aa, Staphylococcus
KRRNETY

SEQ ID NO: 1918580 - protein, 8 aa, Staphylococcus
KRSKNNKD

SEQ ID NO: 1918581 - protein, 5 aa, Staphylococcus
KRSMT

SEQ ID NO: 1918582 - protein, 9 aa, Staphylococcus
KRSRGTPRV

SEQ ID NO: 1918583 - protein, 5 aa, Staphylococcus
KRSVL

SEQ ID NO: 1918584 - protein, 8 aa, Staphylococcus
KRTKPDID

SEQ ID NO: 1918585 - protein, 4 aa, Staphylococcus
KRTL

SEQ ID NO: 1918586 - protein, 5 aa, Staphylococcus
KRTPY

SEQ ID NO: 1918587 - protein, 5 aa, Staphylococcus
KRVGD

SEQ ID NO: 1918588 - protein, 11 aa, Staphylococcus
KRWDREQKAYN

SEQ ID NO: 1918589 - protein, 6 aa, Staphylococcus
KRYKGP

SEQ ID NO: 1918590 - protein, 7 aa, Staphylococcus
KRYRTVD

SEQ ID NO: 1918591 - protein, 11 aa, Staphylococcus
KSAARELASRG

SEQ ID NO: 1918592 - protein, 8 aa, Staphylococcus
KSAEHDVS

SEQ ID NO: 1918593 - protein, 4 aa, Staphylococcus
KSAF

SEQ ID NO: 1918594 - protein, 14 aa, Staphylococcus
KSAHASENADEALN

SEQ ID NO: 1918595 - protein, 7 aa, Staphylococcus
KSDDIYT

SEQ ID NO: 1918596 - protein, 6 aa, Staphylococcus
KSEDGY

SEQ ID NO: 1918597 - protein, 8 aa, Staphylococcus
KSEDIRAE

SEQ ID NO: 1918598 - protein, 6 aa, Staphylococcus
KSEPEL

SEQ ID NO: 1918599 - protein, 5 aa, Staphylococcus
KSEPK

SEQ ID NO: 1918600 - protein, 6 aa, Staphylococcus
KSEQPV

SEQ ID NO: 1918601 - protein, 11 aa, Staphylococcus
KSERPLKGNEN

SEQ ID NO: 1918602 - protein, 8 aa, Staphylococcus
KSETPPFA

SEQ ID NO: 1918603 - protein, 4 aa, Staphylococcus
KSEV

SEQ ID NO: 1918604 - protein, 10 aa, Staphylococcus
KSEVEGEEAK

SEQ ID NO: 1918605 - protein, 9 aa, Staphylococcus
KSGEKIPKG

SEQ ID NO: 1918606 - protein, 11 aa, Staphylococcus
KSGEPNPESNQ

SEQ ID NO: 1918607 - protein, 5 aa, Staphylococcus
KSGLR

SEQ ID NO: 1918608 - protein, 6 aa, Staphylococcus
KSIENE

SEQ ID NO: 1918609 - protein, 18 aa, Staphylococcus
KSIRRGSANLKDSYAQVK

SEQ ID NO: 1918610 - protein, 10 aa, Staphylococcus
KSISKDGGKV

SEQ ID NO: 1918611 - protein, 10 aa, Staphylococcus
KSISKNGGKV

SEQ ID NO: 1918612 - protein, 6 aa, Staphylococcus
KSKGGK

SEQ ID NO: 1918613 - protein, 15 aa, Staphylococcus
KSKGIDRVNSKAISE

SEQ ID NO: 1918614 - protein, 18 aa, Staphylococcus
KSKKVSSRSGMSLTRDTS

SEQ ID NO: 1918615 - protein, 8 aa, Staphylococcus
KSKNTITK

SEQ ID NO: 1918616 - protein, 11 aa, Staphylococcus
KSLNRGKHTTR

SEQ ID NO: 1918617 - protein, 4 aa, Staphylococcus
KSMN

SEQ ID NO: 1918618 - protein, 5 aa, Staphylococcus
KSPHS

SEQ ID NO: 1918619 - protein, 10 aa, Staphylococcus
KSPSPEEDAY

SEQ ID NO: 1918620 - protein, 10 aa, Staphylococcus
KSPSPEEEAY

SEQ ID NO: 1918621 - protein, 10 aa, Staphylococcus
KSPSPEEGAY

SEQ ID NO: 1918622 - protein, 4 aa, Staphylococcus
KSQR

SEQ ID NO: 1918623 - protein, 10 aa, Staphylococcus
KSQSNQKKLS

SEQ ID NO: 1918624 - protein, 7 aa, Staphylococcus
KSRFQDS

SEQ ID NO: 1918625 - protein, 7 aa, Staphylococcus
KSRIPEW

SEQ ID NO: 1918626 - protein, 6 aa, Staphylococcus
KSRSIA

SEQ ID NO: 1918627 - protein, 9 aa, Staphylococcus
KSSKDNPKR

SEQ ID NO: 1918628 - protein, 9 aa, Staphylococcus
KSSRDDLTN

SEQ ID NO: 1918629 - protein, 4 aa, Staphylococcus
KSSY

SEQ ID NO: 1918630 - protein, 4 aa, Staphylococcus
KSTF

SEQ ID NO: 1918631 - protein, 5 aa, Staphylococcus
KSTQM

SEQ ID NO: 1918632 - protein, 9 aa, Staphylococcus
KSVDEPLQT

SEQ ID NO: 1918633 - protein, 11 aa, Staphylococcus
KSVEKDSERIS

SEQ ID NO: 1918634 - protein, 10 aa, Staphylococcus
KSVEKDTERI

SEQ ID NO: 1918635 - protein, 8 aa, Staphylococcus
KSVTPHRI

SEQ ID NO: 1918636 - protein, 9 aa, Staphylococcus
KSYKAQDNG

SEQ ID NO: 1918637 - protein, 9 aa, Staphylococcus
KTDRDGARV

SEQ ID NO: 1918638 - protein, 4 aa, Staphylococcus
KTEF

SEQ ID NO: 1918639 - protein, 12 aa, Staphylococcus
KTEVESKERTLY

SEQ ID NO: 1918640 - protein, 4 aa, Staphylococcus
KTFP

SEQ ID NO: 1918641 - protein, 5 aa, Staphylococcus
KTFST

SEQ ID NO: 1918642 - protein, 5 aa, Staphylococcus
KTGSN

SEQ ID NO: 1918643 - protein, 9 aa, Staphylococcus
KTGVGTIAS

SEQ ID NO: 1918644 - protein, 9 aa, Staphylococcus
KTHQGHGTD

SEQ ID NO: 1918645 - protein, 12 aa, Staphylococcus
KTIEETSQNAVN

SEQ ID NO: 1918646 - protein, 4 aa, Staphylococcus
KTIG

SEQ ID NO: 1918647 - protein, 9 aa, Staphylococcus
KTKNKDFDE

SEQ ID NO: 1918648 - protein, 12 aa, Staphylococcus
KTKPESGTVETV

SEQ ID NO: 1918649 - protein, 5 aa, Staphylococcus
KTLTG

SEQ ID NO: 1918650 - protein, 10 aa, Staphylococcus
KTMARGYRRE

SEQ ID NO: 1918651 - protein, 4 aa, Staphylococcus
KTME

SEQ ID NO: 1918652 - protein, 8 aa, Staphylococcus
KTNEQGQQ

SEQ ID NO: 1918653 - protein, 6 aa, Staphylococcus
KTPFNQ

SEQ ID NO: 1918654 - protein, 4 aa, Staphylococcus
KTPY

SEQ ID NO: 1918655 - protein, 14 aa, Staphylococcus
KTQSLNKAKSDSHW

SEQ ID NO: 1918656 - protein, 6 aa, Staphylococcus
KTREHE

SEQ ID NO: 1918657 - protein, 15 aa, Staphylococcus
KTRVNRKHRDRGDQE

SEQ ID NO: 1918658 - protein, 15 aa, Staphylococcus
KTRYQSVNTAKNTLK

SEQ ID NO: 1918659 - protein, 7 aa, Staphylococcus
KTSFNNA

SEQ ID NO: 1918660 - protein, 8 aa, Staphylococcus
KTSKQFKT

SEQ ID NO: 1918661 - protein, 8 aa, Staphylococcus
KTSQNTGT

SEQ ID NO: 1918662 - protein, 9 aa, Staphylococcus
KTSSIQYEN

SEQ ID NO: 1918663 - protein, 12 aa, Staphylococcus
KTSVSLKRHSDA

SEQ ID NO: 1918664 - protein, 7 aa, Staphylococcus
KTTDSAF

SEQ ID NO: 1918665 - protein, 6 aa, Staphylococcus
KTTGGI

SEQ ID NO: 1918666 - protein, 7 aa, Staphylococcus
KTTGTDA

SEQ ID NO: 1918667 - protein, 4 aa, Staphylococcus
KTTM

SEQ ID NO: 1918668 - protein, 6 aa, Staphylococcus
KTVQTL

SEQ ID NO: 1918669 - protein, 6 aa, Staphylococcus
KTYDEV

SEQ ID NO: 1918670 - protein, 6 aa, Staphylococcus
KTYHGE

SEQ ID NO: 1918671 - protein, 5 aa, Staphylococcus
KVDFG

SEQ ID NO: 1918672 - protein, 10 aa, Staphylococcus
KVDNGESLTA

SEQ ID NO: 1918673 - protein, 8 aa, Staphylococcus
KVEREVPV

SEQ ID NO: 1918674 - protein, 8 aa, Staphylococcus
KVLGTGEK

SEQ ID NO: 1918675 - protein, 6 aa, Staphylococcus
KVNEAE

SEQ ID NO: 1918676 - protein, 8 aa, Staphylococcus
KVNPSSEL

SEQ ID NO: 1918677 - protein, 6 aa, Staphylococcus
KVQREK

SEQ ID NO: 1918678 - protein, 6 aa, Staphylococcus
KVREGN

SEQ ID NO: 1918679 - protein, 8 aa, Staphylococcus
KVREGSTK

SEQ ID NO: 1918680 - protein, 9 aa, Staphylococcus
KVRGAEPEV

SEQ ID NO: 1918681 - protein, 10 aa, Staphylococcus
KVTAPDTPVP

SEQ ID NO: 1918682 - protein, 8 aa, Staphylococcus
KVTNKSNR

SEQ ID NO: 1918683 - protein, 4 aa, Staphylococcus
KVTQ

SEQ ID NO: 1918684 - protein, 12 aa, Staphylococcus
KWELTGQSIHDI

SEQ ID NO: 1918685 - protein, 10 aa, Staphylococcus
KYADDLGPLD

SEQ ID NO: 1918686 - protein, 8 aa, Staphylococcus
KYAREKGV

SEQ ID NO: 1918687 - protein, 6 aa, Staphylococcus
KYDDVR

SEQ ID NO: 1918688 - protein, 8 aa, Staphylococcus
KYDEKSDE

SEQ ID NO: 1918689 - protein, 4 aa, Staphylococcus
KYEE

SEQ ID NO: 1918690 - protein, 10 aa, Staphylococcus
KYERSSGVDF

SEQ ID NO: 1918691 - protein, 7 aa, Staphylococcus
KYETDYR

SEQ ID NO: 1918692 - protein, 20 aa, Staphylococcus
KYGGTSISDYRHADGKTGEM

SEQ ID NO: 1918693 - protein, 6 aa, Staphylococcus
KYGTVN

SEQ ID NO: 1918694 - protein, 6 aa, Staphylococcus
KYIGGH

SEQ ID NO: 1918695 - protein, 13 aa, Staphylococcus
KYPEVNAEIDGED

SEQ ID NO: 1918696 - protein, 4 aa, Staphylococcus
KYPF

SEQ ID NO: 1918697 - protein, 5 aa, Staphylococcus
KYPGQ

SEQ ID NO: 1918698 - protein, 4 aa, Staphylococcus
KYPN

SEQ ID NO: 1918699 - protein, 4 aa, Staphylococcus
KYPP

SEQ ID NO: 1918700 - protein, 9 aa, Staphylococcus
KYRDEKRPR

SEQ ID NO: 1918701 - protein, 5 aa, Staphylococcus
KYREL

SEQ ID NO: 1918702 - protein, 13 aa, Staphylococcus
KYRSKEEQQAENH

SEQ ID NO: 1918703 - protein, 18 aa, Staphylococcus
KYSEYKGGRQKTPPELSE

SEQ ID NO: 1918704 - protein, 11 aa, Staphylococcus
KYTAEGPQGLL

SEQ ID NO: 1918705 - protein, 4 aa, Staphylococcus
LADE

SEQ ID NO: 1918706 - protein, 7 aa, Staphylococcus
LADIGSD

SEQ ID NO: 1918707 - protein, 5 aa, Staphylococcus
LADPE

SEQ ID NO: 1918708 - protein, 8 aa, Staphylococcus
LAEENGGE

SEQ ID NO: 1918709 - protein, 7 aa, Staphylococcus
LAEKGTK

SEQ ID NO: 1918710 - protein, 9 aa, Staphylococcus
LAKGATHDN

SEQ ID NO: 1918711 - protein, 12 aa, Staphylococcus
LAKKNPEDPRFT

SEQ ID NO: 1918712 - protein, 9 aa, Staphylococcus
LAKKYSRDR

SEQ ID NO: 1918713 - protein, 4 aa, Staphylococcus
LAKM

SEQ ID NO: 1918714 - protein, 4 aa, Staphylococcus
LAND

SEQ ID NO: 1918715 - protein, 8 aa, Staphylococcus
LANDNEEK

SEQ ID NO: 1918716 - protein, 5 aa, Staphylococcus
LANEP

SEQ ID NO: 1918717 - protein, 8 aa, Staphylococcus
LANKSEKE

SEQ ID NO: 1918718 - protein, 12 aa, Staphylococcus
LANRSRGLTEEN

SEQ ID NO: 1918719 - protein, 12 aa, Staphylococcus
LAPGDTKAITEA

SEQ ID NO: 1918720 - protein, 5 aa, Staphylococcus
LAQAG

SEQ ID NO: 1918721 - protein, 8 aa, Staphylococcus
LAQGRPKD

SEQ ID NO: 1918722 - protein, 18 aa, Staphylococcus
LAQKMAQEQNKKKEEKIK

SEQ ID NO: 1918723 - protein, 4 aa, Staphylococcus
LAQT

SEQ ID NO: 1918724 - protein, 6 aa, Staphylococcus
LARPAA

SEQ ID NO: 1918725 - protein, 9 aa, Staphylococcus
LASARRGAK

SEQ ID NO: 1918726 - protein, 14 aa, Staphylococcus
LASKSFKPGRPIGG

SEQ ID NO: 1918727 - protein, 10 aa, Staphylococcus
LASPGAGQRT

SEQ ID NO: 1918728 - protein, 10 aa, Staphylococcus
LASPNAGQRT

SEQ ID NO: 1918729 - protein, 7 aa, Staphylococcus
LASRGID

SEQ ID NO: 1918730 - protein, 12 aa, Staphylococcus
LATDGYEGARET

SEQ ID NO: 1918731 - protein, 7 aa, Staphylococcus
LATNEGY

SEQ ID NO: 1918732 - protein, 7 aa, Staphylococcus
LATQEGL

SEQ ID NO: 1918733 - protein, 7 aa, Staphylococcus
LDAVSDR

SEQ ID NO: 1918734 - protein, 4 aa, Staphylococcus
LDDD

SEQ ID NO: 1918735 - protein, 4 aa, Staphylococcus
LDDG

SEQ ID NO: 1918736 - protein, 5 aa, Staphylococcus
LDDTT

SEQ ID NO: 1918737 - protein, 8 aa, Staphylococcus
LDETEERV

SEQ ID NO: 1918738 - protein, 8 aa, Staphylococcus
LDGTAKGG

SEQ ID NO: 1918739 - protein, 9 aa, Staphylococcus
LDHTEDNLT

SEQ ID NO: 1918740 - protein, 9 aa, Staphylococcus
LDKQGRINI

SEQ ID NO: 1918741 - protein, 10 aa, Staphylococcus
LDKSRGPSAS

SEQ ID NO: 1918742 - protein, 6 aa, Staphylococcus
LDNHSA

SEQ ID NO: 1918743 - protein, 5 aa, Staphylococcus
LDNRP

SEQ ID NO: 1918744 - protein, 6 aa, Staphylococcus
LDPDQY

SEQ ID NO: 1918745 - protein, 9 aa, Staphylococcus
LDPEKRFNV

SEQ ID NO: 1918746 - protein, 5 aa, Staphylococcus
LDPLT

SEQ ID NO: 1918747 - protein, 5 aa, Staphylococcus
LDPMK

SEQ ID NO: 1918748 - protein, 5 aa, Staphylococcus
LDSIN

SEQ ID NO: 1918749 - protein, 9 aa, Staphylococcus
LDTQGQALN

SEQ ID NO: 1918750 - protein, 10 aa, Staphylococcus
LDTSKANVKQ

SEQ ID NO: 1918751 - protein, 4 aa, Staphylococcus
LEAA

SEQ ID NO: 1918752 - protein, 4 aa, Staphylococcus
LEAD

SEQ ID NO: 1918753 - protein, 4 aa, Staphylococcus
LEAG

SEQ ID NO: 1918754 - protein, 4 aa, Staphylococcus
LEDA

SEQ ID NO: 1918755 - protein, 9 aa, Staphylococcus
LEDDSENKN

SEQ ID NO: 1918756 - protein, 10 aa, Staphylococcus
LEDTPDTPDE

SEQ ID NO: 1918757 - protein, 9 aa, Staphylococcus
LEDTSENKN

SEQ ID NO: 1918758 - protein, 4 aa, Staphylococcus
LEEA

SEQ ID NO: 1918759 - protein, 9 aa, Staphylococcus
LEENNGNRI

SEQ ID NO: 1918760 - protein, 7 aa, Staphylococcus
LEEQGLT

SEQ ID NO: 1918761 - protein, 4 aa, Staphylococcus
LEER

SEQ ID NO: 1918762 - protein, 8 aa, Staphylococcus
LEGCPTDS

SEQ ID NO: 1918763 - protein, 5 aa, Staphylococcus
LEGGF

SEQ ID NO: 1918764 - protein, 4 aa, Staphylococcus
LEGK

SEQ ID NO: 1918765 - protein, 11 aa, Staphylococcus
LEKDSTENTEQ

SEQ ID NO: 1918766 - protein, 12 aa, Staphylococcus
LEKNSKRVDEQR

SEQ ID NO: 1918767 - protein, 4 aa, Staphylococcus
LEMD

SEQ ID NO: 1918768 - protein, 4 aa, Staphylococcus
LEME

SEQ ID NO: 1918769 - protein, 5 aa, Staphylococcus
LENEI

SEQ ID NO: 1918770 - protein, 12 aa, Staphylococcus
LENGNPEVHPGP

SEQ ID NO: 1918771 - protein, 5 aa, Staphylococcus
LENQG

SEQ ID NO: 1918772 - protein, 5 aa, Staphylococcus
LEPND

SEQ ID NO: 1918773 - protein, 6 aa, Staphylococcus
LEPPQE

SEQ ID NO: 1918774 - protein, 4 aa, Staphylococcus
LEPQ

SEQ ID NO: 1918775 - protein, 4 aa, Staphylococcus
LEQE

SEQ ID NO: 1918776 - protein, 5 aa, Staphylococcus
LEQGG

SEQ ID NO: 1918777 - protein, 5 aa, Staphylococcus
LEQQG

SEQ ID NO: 1918778 - protein, 6 aa, Staphylococcus
LERAGY

SEQ ID NO: 1918779 - protein, 10 aa, Staphylococcus
LERDKIEAEY

SEQ ID NO: 1918780 - protein, 4 aa, Staphylococcus
LERE

SEQ ID NO: 1918781 - protein, 8 aa, Staphylococcus
LERETKKV

SEQ ID NO: 1918782 - protein, 9 aa, Staphylococcus
LERKKGSIA

SEQ ID NO: 1918783 - protein, 4 aa, Staphylococcus
LERQ

SEQ ID NO: 1918784 - protein, 10 aa, Staphylococcus
LESATGQRLT

SEQ ID NO: 1918785 - protein, 5 aa, Staphylococcus
LESEE

SEQ ID NO: 1918786 - protein, 4 aa, Staphylococcus
LESI

SEQ ID NO: 1918787 - protein, 6 aa, Staphylococcus
LESNGD

SEQ ID NO: 1918788 - protein, 4 aa, Staphylococcus
LETH

SEQ ID NO: 1918789 - protein, 12 aa, Staphylococcus
LEYEEKRQEEEL

SEQ ID NO: 1918790 - protein, 9 aa, Staphylococcus
LGAGKTTLS

SEQ ID NO: 1918791 - protein, 5 aa, Staphylococcus
LGAPY

SEQ ID NO: 1918792 - protein, 10 aa, Staphylococcus
LGDGQTSDEY

SEQ ID NO: 1918793 - protein, 6 aa, Staphylococcus
LGDKQG

SEQ ID NO: 1918794 - protein, 5 aa, Staphylococcus
LGDMN

SEQ ID NO: 1918795 - protein, 9 aa, Staphylococcus
LGEDVTPDK

SEQ ID NO: 1918796 - protein, 14 aa, Staphylococcus
LGEEEQEVINGEQV

SEQ ID NO: 1918797 - protein, 4 aa, Staphylococcus
LGEG

SEQ ID NO: 1918798 - protein, 4 aa, Staphylococcus
LGEM

SEQ ID NO: 1918799 - protein, 5 aa, Staphylococcus
LGENV

SEQ ID NO: 1918800 - protein, 11 aa, Staphylococcus
LGEPPHEGTQK

SEQ ID NO: 1918801 - protein, 4 aa, Staphylococcus
LGER

SEQ ID NO: 1918802 - protein, 14 aa, Staphylococcus
LGESTTTEDQTGEV

SEQ ID NO: 1918803 - protein, 5 aa, Staphylococcus
LGGGS

SEQ ID NO: 1918804 - protein, 6 aa, Staphylococcus
LGGQTG

SEQ ID NO: 1918805 - protein, 4 aa, Staphylococcus
LGGT

SEQ ID NO: 1918806 - protein, 4 aa, Staphylococcus
LGGY

SEQ ID NO: 1918807 - protein, 13 aa, Staphylococcus
LGLPDSPGVPEGI

SEQ ID NO: 1918808 - protein, 5 aa, Staphylococcus
LGNPI

SEQ ID NO: 1918809 - protein, 12 aa, Staphylococcus
LGPEMKSTGEVM

SEQ ID NO: 1918810 - protein, 7 aa, Staphylococcus
LGPEQEK

SEQ ID NO: 1918811 - protein, 6 aa, Staphylococcus
LGPGRL

SEQ ID NO: 1918812 - protein, 5 aa, Staphylococcus
LGPIQ

SEQ ID NO: 1918813 - protein, 4 aa, Staphylococcus
LGQD

SEQ ID NO: 1918814 - protein, 28 aa, Staphylococcus
LGQPIDGQGPINATKTRPVEKKATGVMD

SEQ ID NO: 1918815 - protein, 7 aa, Staphylococcus
LGQRKGE

SEQ ID NO: 1918816 - protein, 9 aa, Staphylococcus
LGQTAGQKV

SEQ ID NO: 1918817 - protein, 11 aa, Staphylococcus
LGSDDKSKELK

SEQ ID NO: 1918818 - protein, 4 aa, Staphylococcus
LGSG

SEQ ID NO: 1918819 - protein, 9 aa, Staphylococcus
LGSGGGKVP

SEQ ID NO: 1918820 - protein, 6 aa, Staphylococcus
LGSGGL

SEQ ID NO: 1918821 - protein, 5 aa, Staphylococcus
LGSKK

SEQ ID NO: 1918822 - protein, 6 aa, Staphylococcus
LGSKKI

SEQ ID NO: 1918823 - protein, 4 aa, Staphylococcus
LGTD

SEQ ID NO: 1918824 - protein, 6 aa, Staphylococcus
LGTDSG

SEQ ID NO: 1918825 - protein, 11 aa, Staphylococcus
LGTPAATTRGF

SEQ ID NO: 1918826 - protein, 7 aa, Staphylococcus
LHEDGDA

SEQ ID NO: 1918827 - protein, 11 aa, Staphylococcus
LHSPNIKTRKR

SEQ ID NO: 1918828 - protein, 12 aa, Staphylococcus
LIDKGKKEGHLS

SEQ ID NO: 1918829 - protein, 7 aa, Staphylococcus
LIGKPPK

SEQ ID NO: 1918830 - protein, 12 aa, Staphylococcus
LIGPNGAGKSTL

SEQ ID NO: 1918831 - protein, 5 aa, Staphylococcus
LIPQS

SEQ ID NO: 1918832 - protein, 13 aa, Staphylococcus
LITEENGITSPSA

SEQ ID NO: 1918833 - protein, 12 aa, Staphylococcus
LITSRKDGNKNL

SEQ ID NO: 1918834 - protein, 6 aa, Staphylococcus
LKADNG

SEQ ID NO: 1918835 - protein, 6 aa, Staphylococcus
LKDEGV

SEQ ID NO: 1918836 - protein, 14 aa, Staphylococcus
LKDTGTGDTLCGEK

SEQ ID NO: 1918837 - protein, 5 aa, Staphylococcus
LKDTL

SEQ ID NO: 1918838 - protein, 7 aa, Staphylococcus
LKEDQVD

SEQ ID NO: 1918839 - protein, 7 aa, Staphylococcus
LKEEDHG

SEQ ID NO: 1918840 - protein, 6 aa, Staphylococcus
LKEEGY

SEQ ID NO: 1918841 - protein, 9 aa, Staphylococcus
LKENGANTV

SEQ ID NO: 1918842 - protein, 5 aa, Staphylococcus
LKGAE

SEQ ID NO: 1918843 - protein, 5 aa, Staphylococcus
LKGAN

SEQ ID NO: 1918844 - protein, 6 aa, Staphylococcus
LKGGQK

SEQ ID NO: 1918845 - protein, 10 aa, Staphylococcus
LKHEEGPSMG

SEQ ID NO: 1918846 - protein, 6 aa, Staphylococcus
LKKDQV

SEQ ID NO: 1918847 - protein, 7 aa, Staphylococcus
LKKETNI

SEQ ID NO: 1918848 - protein, 5 aa, Staphylococcus
LKKGE

SEQ ID NO: 1918849 - protein, 19 aa, Staphylococcus
LKNAEDVAKLRGKSVEELY

SEQ ID NO: 1918850 - protein, 19 aa, Staphylococcus
LKNAEDVAKLRGKTVEELY

SEQ ID NO: 1918851 - protein, 9 aa, Staphylococcus
LKNKRNSIA

SEQ ID NO: 1918852 - protein, 4 aa, Staphylococcus
LKNQ

SEQ ID NO: 1918853 - protein, 8 aa, Staphylococcus
LKNQRNQD

SEQ ID NO: 1918854 - protein, 5 aa, Staphylococcus
LKNSV

SEQ ID NO: 1918855 - protein, 5 aa, Staphylococcus
LKPGQ

SEQ ID NO: 1918856 - protein, 7 aa, Staphylococcus
LKPKSGQ

SEQ ID NO: 1918857 - protein, 10 aa, Staphylococcus
LKQGEKHAEV

SEQ ID NO: 1918858 - protein, 16 aa, Staphylococcus
LKRAKYAGIEQPTMKG

SEQ ID NO: 1918859 - protein, 8 aa, Staphylococcus
LKRDDESE

SEQ ID NO: 1918860 - protein, 14 aa, Staphylococcus
LKSRIDSLATQEED

SEQ ID NO: 1918861 - protein, 11 aa, Staphylococcus
LKTNDKSQYLE

SEQ ID NO: 1918862 - protein, 11 aa, Staphylococcus
LKTRKEDEVKE

SEQ ID NO: 1918863 - protein, 4 aa, Staphylococcus
LKTT

SEQ ID NO: 1918864 - protein, 8 aa, Staphylococcus
LLAPAGNL

SEQ ID NO: 1918865 - protein, 6 aa, Staphylococcus
LMPEGG

SEQ ID NO: 1918866 - protein, 8 aa, Staphylococcus
LNAADEEA

SEQ ID NO: 1918867 - protein, 4 aa, Staphylococcus
LNDD

SEQ ID NO: 1918868 - protein, 7 aa, Staphylococcus
LNDPRPM

SEQ ID NO: 1918869 - protein, 6 aa, Staphylococcus
LNEEDV

SEQ ID NO: 1918870 - protein, 12 aa, Staphylococcus
LNEHASKENAKG

SEQ ID NO: 1918871 - protein, 5 aa, Staphylococcus
LNEPN

SEQ ID NO: 1918872 - protein, 9 aa, Staphylococcus
LNETAEERL

SEQ ID NO: 1918873 - protein, 7 aa, Staphylococcus
LNGNYTR

SEQ ID NO: 1918874 - protein, 5 aa, Staphylococcus
LNGQK

SEQ ID NO: 1918875 - protein, 12 aa, Staphylococcus
LNIPEESPSGNI

SEQ ID NO: 1918876 - protein, 12 aa, Staphylococcus
LNKQLNKGDVID

SEQ ID NO: 1918877 - protein, 8 aa, Staphylococcus
LNNDDSVS

SEQ ID NO: 1918878 - protein, 4 aa, Staphylococcus
LNNE

SEQ ID NO: 1918879 - protein, 4 aa, Staphylococcus
LNNQ

SEQ ID NO: 1918880 - protein, 5 aa, Staphylococcus
LNNRG

SEQ ID NO: 1918881 - protein, 4 aa, Staphylococcus
LNPN

SEQ ID NO: 1918882 - protein, 7 aa, Staphylococcus
LNPSDNQ

SEQ ID NO: 1918883 - protein, 5 aa, Staphylococcus
LNPVE

SEQ ID NO: 1918884 - protein, 6 aa, Staphylococcus
LNQNKD

SEQ ID NO: 1918885 - protein, 4 aa, Staphylococcus
LNRD

SEQ ID NO: 1918886 - protein, 4 aa, Staphylococcus
LNRQ

SEQ ID NO: 1918887 - protein, 7 aa, Staphylococcus
LNSADSF

SEQ ID NO: 1918888 - protein, 11 aa, Staphylococcus
LNSPNIKTRKR

SEQ ID NO: 1918889 - protein, 8 aa, Staphylococcus
LNTSERYH

SEQ ID NO: 1918890 - protein, 12 aa, Staphylococcus
LPAAEPERVKQE

SEQ ID NO: 1918891 - protein, 6 aa, Staphylococcus
LPAENE

SEQ ID NO: 1918892 - protein, 6 aa, Staphylococcus
LPDGTP

SEQ ID NO: 1918893 - protein, 5 aa, Staphylococcus
LPEGT

SEQ ID NO: 1918894 - protein, 4 aa, Staphylococcus
LPEK

SEQ ID NO: 1918895 - protein, 4 aa, Staphylococcus
LPET

SEQ ID NO: 1918896 - protein, 6 aa, Staphylococcus
LPGALS

SEQ ID NO: 1918897 - protein, 5 aa, Staphylococcus
LPGRA

SEQ ID NO: 1918898 - protein, 4 aa, Staphylococcus
LPGT

SEQ ID NO: 1918899 - protein, 6 aa, Staphylococcus
LPHGVA

SEQ ID NO: 1918900 - protein, 4 aa, Staphylococcus
LPKD

SEQ ID NO: 1918901 - protein, 4 aa, Staphylococcus
LPKF

SEQ ID NO: 1918902 - protein, 4 aa, Staphylococcus
LPKG

SEQ ID NO: 1918903 - protein, 6 aa, Staphylococcus
LPKKGD

SEQ ID NO: 1918904 - protein, 9 aa, Staphylococcus
LPNAPKEKG

SEQ ID NO: 1918905 - protein, 6 aa, Staphylococcus
LPNETG

SEQ ID NO: 1918906 - protein, 5 aa, Staphylococcus
LPNGT

SEQ ID NO: 1918907 - protein, 7 aa, Staphylococcus
LPPSNDI

SEQ ID NO: 1918908 - protein, 5 aa, Staphylococcus
LPSEE

SEQ ID NO: 1918909 - protein, 11 aa, Staphylococcus
LPSSTNPTLPY

SEQ ID NO: 1918910 - protein, 4 aa, Staphylococcus
LPTD

SEQ ID NO: 1918911 - protein, 5 aa, Staphylococcus
LPTEG

SEQ ID NO: 1918912 - protein, 6 aa, Staphylococcus
LPTGEG

SEQ ID NO: 1918913 - protein, 4 aa, Staphylococcus
LPTR

SEQ ID NO: 1918914 - protein, 15 aa, Staphylococcus
LPTTTIGSFPQTREV

SEQ ID NO: 1918915 - protein, 6 aa, Staphylococcus
LQDEKK

SEQ ID NO: 1918916 - protein, 10 aa, Staphylococcus
LQDELKSQGV

SEQ ID NO: 1918917 - protein, 9 aa, Staphylococcus
LQGKPITTE

SEQ ID NO: 1918918 - protein, 5 aa, Staphylococcus
LQGRK

SEQ ID NO: 1918919 - protein, 4 aa, Staphylococcus
LQGS

SEQ ID NO: 1918920 - protein, 12 aa, Staphylococcus
LQNGKPYRETST

SEQ ID NO: 1918921 - protein, 5 aa, Staphylococcus
LQNQY

SEQ ID NO: 1918922 - protein, 7 aa, Staphylococcus
LQPGDEV

SEQ ID NO: 1918923 - protein, 4 aa, Staphylococcus
LQQQ

SEQ ID NO: 1918924 - protein, 4 aa, Staphylococcus
LQQS

SEQ ID NO: 1918925 - protein, 8 aa, Staphylococcus
LQSGNYSD

SEQ ID NO: 1918926 - protein, 8 aa, Staphylococcus
LQTPTSGE

SEQ ID NO: 1918927 - protein, 4 aa, Staphylococcus
LQWG

SEQ ID NO: 1918928 - protein, 11 aa, Staphylococcus
LRDQKGADVKE

SEQ ID NO: 1918929 - protein, 12 aa, Staphylococcus
LRDQKGADVKEH

SEQ ID NO: 1918930 - protein, 4 aa, Staphylococcus
LRER

SEQ ID NO: 1918931 - protein, 10 aa, Staphylococcus
LRGEKTMEER

SEQ ID NO: 1918932 - protein, 8 aa, Staphylococcus
LRGNMDAN

SEQ ID NO: 1918933 - protein, 6 aa, Staphylococcus
LRKDSV

SEQ ID NO: 1918934 - protein, 5 aa, Staphylococcus
LRKKG

SEQ ID NO: 1918935 - protein, 4 aa, Staphylococcus
LRNG

SEQ ID NO: 1918936 - protein, 13 aa, Staphylococcus
LRQKGSAGGHNGM

SEQ ID NO: 1918937 - protein, 6 aa, Staphylococcus
LRQSGA

SEQ ID NO: 1918938 - protein, 12 aa, Staphylococcus
LRSEASSRFEKG

SEQ ID NO: 1918939 - protein, 9 aa, Staphylococcus
LRSGKEREE

SEQ ID NO: 1918940 - protein, 4 aa, Staphylococcus
LSAY

SEQ ID NO: 1918941 - protein, 6 aa, Staphylococcus
LSDDDS

SEQ ID NO: 1918942 - protein, 12 aa, Staphylococcus
LSDGSGKAQFAE

SEQ ID NO: 1918943 - protein, 4 aa, Staphylococcus
LSEE

SEQ ID NO: 1918944 - protein, 11 aa, Staphylococcus
LSEEDKLTVER

SEQ ID NO: 1918945 - protein, 12 aa, Staphylococcus
LSEEDKQTVERA

SEQ ID NO: 1918946 - protein, 12 aa, Staphylococcus
LSEENNKLKKEL

SEQ ID NO: 1918947 - protein, 4 aa, Staphylococcus
LSEG

SEQ ID NO: 1918948 - protein, 7 aa, Staphylococcus
LSEGTTS

SEQ ID NO: 1918949 - protein, 8 aa, Staphylococcus
LSEQDRAI

SEQ ID NO: 1918950 - protein, 4 aa, Staphylococcus
LSFG

SEQ ID NO: 1918951 - protein, 5 aa, Staphylococcus
LSFGE

SEQ ID NO: 1918952 - protein, 6 aa, Staphylococcus
LSGEGI

SEQ ID NO: 1918953 - protein, 9 aa, Staphylococcus
LSGGERQRI

SEQ ID NO: 1918954 - protein, 7 aa, Staphylococcus
LSGGQQQ

SEQ ID NO: 1918955 - protein, 9 aa, Staphylococcus
LSGGQQQRL

SEQ ID NO: 1918956 - protein, 20 aa, Staphylococcus
LSGKDKALPMNTGAEAVETA

SEQ ID NO: 1918957 - protein, 11 aa, Staphylococcus
LSGRSNVGKST

SEQ ID NO: 1918958 - protein, 9 aa, Staphylococcus
LSGSDANDG

SEQ ID NO: 1918959 - protein, 8 aa, Staphylococcus
LSGTVTPQ

SEQ ID NO: 1918960 - protein, 8 aa, Staphylococcus
LSKPEDVA

SEQ ID NO: 1918961 - protein, 8 aa, Staphylococcus
LSNGERYD

SEQ ID NO: 1918962 - protein, 9 aa, Staphylococcus
LSNGERYDE

SEQ ID NO: 1918963 - protein, 15 aa, Staphylococcus
LSNNAEKVTTPGKKK

SEQ ID NO: 1918964 - protein, 5 aa, Staphylococcus
LSNPF

SEQ ID NO: 1918965 - protein, 19 aa, Staphylococcus
LSNRGGKGIKTAKITERNG

SEQ ID NO: 1918966 - protein, 4 aa, Staphylococcus
LSNT

SEQ ID NO: 1918967 - protein, 6 aa, Staphylococcus
LSPEKE

SEQ ID NO: 1918968 - protein, 6 aa, Staphylococcus
LSPEKG

SEQ ID NO: 1918969 - protein, 10 aa, Staphylococcus
LSPKVKGQLK

SEQ ID NO: 1918970 - protein, 5 aa, Staphylococcus
LSPLN

SEQ ID NO: 1918971 - protein, 6 aa, Staphylococcus
LSPLNS

SEQ ID NO: 1918972 - protein, 5 aa, Staphylococcus
LSPND

SEQ ID NO: 1918973 - protein, 6 aa, Staphylococcus
LSPTNT

SEQ ID NO: 1918974 - protein, 4 aa, Staphylococcus
LSQD

SEQ ID NO: 1918975 - protein, 14 aa, Staphylococcus
LSQEDSSQGQGQMS

SEQ ID NO: 1918976 - protein, 5 aa, Staphylococcus
LSQSK

SEQ ID NO: 1918977 - protein, 13 aa, Staphylococcus
LSQTRSEKEKENI

SEQ ID NO: 1918978 - protein, 6 aa, Staphylococcus
LSREGM

SEQ ID NO: 1918979 - protein, 4 aa, Staphylococcus
LSRG

SEQ ID NO: 1918980 - protein, 4 aa, Staphylococcus
LSRS

SEQ ID NO: 1918981 - protein, 4 aa, Staphylococcus
LSSN

SEQ ID NO: 1918982 - protein, 13 aa, Staphylococcus
LSTTGKYTHVSNQ

SEQ ID NO: 1918983 - protein, 4 aa, Staphylococcus
LSYA

SEQ ID NO: 1918984 - protein, 8 aa, Staphylococcus
LTDEAASE

SEQ ID NO: 1918985 - protein, 5 aa, Staphylococcus
LTDED

SEQ ID NO: 1918986 - protein, 8 aa, Staphylococcus
LTDSATAG

SEQ ID NO: 1918987 - protein, 8 aa, Staphylococcus
LTEERRKE

SEQ ID NO: 1918988 - protein, 4 aa, Staphylococcus
LTEK

SEQ ID NO: 1918989 - protein, 13 aa, Staphylococcus
LTEKQTLESAGTK

SEQ ID NO: 1918990 - protein, 10 aa, Staphylococcus
LTESGSAAKV

SEQ ID NO: 1918991 - protein, 21 aa, Staphylococcus
LTFPSNHTNHSNHDNSNFNNE

SEQ ID NO: 1918992 - protein, 7 aa, Staphylococcus
LTGAKPA

SEQ ID NO: 1918993 - protein, 4 aa, Staphylococcus
LTGE

SEQ ID NO: 1918994 - protein, 5 aa, Staphylococcus
LTKDQ

SEQ ID NO: 1918995 - protein, 5 aa, Staphylococcus
LTKEE

SEQ ID NO: 1918996 - protein, 5 aa, Staphylococcus
LTPEQ

SEQ ID NO: 1918997 - protein, 14 aa, Staphylococcus
LTPGDKIVTSEATF

SEQ ID NO: 1918998 - protein, 7 aa, Staphylococcus
LTPNALT

SEQ ID NO: 1918999 - protein, 4 aa, Staphylococcus
LTPT

SEQ ID NO: 1919000 - protein, 5 aa, Staphylococcus
LTQES

SEQ ID NO: 1919001 - protein, 17 aa, Staphylococcus
LTSNGKLDRKKIAEVVN

SEQ ID NO: 1919002 - protein, 12 aa, Staphylococcus
LTSPKEAIEEAG

SEQ ID NO: 1919003 - protein, 8 aa, Staphylococcus
LTSTTEEM

SEQ ID NO: 1919004 - protein, 12 aa, Staphylococcus
LTTESVQEAQTR

SEQ ID NO: 1919005 - protein, 6 aa, Staphylococcus
LTTGPE

SEQ ID NO: 1919006 - protein, 5 aa, Staphylococcus
LTYAT

SEQ ID NO: 1919007 - protein, 6 aa, Staphylococcus
LYDEND

SEQ ID NO: 1919008 - protein, 6 aa, Staphylococcus
LYGDST

SEQ ID NO: 1919009 - protein, 5 aa, Staphylococcus
LYGKQ

SEQ ID NO: 1919010 - protein, 10 aa, Staphylococcus
LYSKGDSEIA

SEQ ID NO: 1919011 - protein, 4 aa, Staphylococcus
MAER

SEQ ID NO: 1919012 - protein, 17 aa, Staphylococcus
MAGRGTDIKLGEGVEEL

SEQ ID NO: 1919013 - protein, 9 aa, Staphylococcus
MAGSTTPEL

SEQ ID NO: 1919014 - protein, 11 aa, Staphylococcus
MARQKDKTAEM

SEQ ID NO: 1919015 - protein, 4 aa, Staphylococcus
MDLP

SEQ ID NO: 1919016 - protein, 4 aa, Staphylococcus
MDNR

SEQ ID NO: 1919017 - protein, 5 aa, Staphylococcus
MDPND

SEQ ID NO: 1919018 - protein, 8 aa, Staphylococcus
MEASQKNQ

SEQ ID NO: 1919019 - protein, 10 aa, Staphylococcus
MEDPKQTKGM

SEQ ID NO: 1919020 - protein, 11 aa, Staphylococcus
MEDPKQTKGMV

SEQ ID NO: 1919021 - protein, 12 aa, Staphylococcus
MEESDVPDPYYT

SEQ ID NO: 1919022 - protein, 8 aa, Staphylococcus
MEGANEEI

SEQ ID NO: 1919023 - protein, 12 aa, Staphylococcus
MENRDNARTPMQ

SEQ ID NO: 1919024 - protein, 18 aa, Staphylococcus
MEPTRQALKDAGLSTSEI

SEQ ID NO: 1919025 - protein, 4 aa, Staphylococcus
MEVQ

SEQ ID NO: 1919026 - protein, 10 aa, Staphylococcus
MGNPGQANYV

SEQ ID NO: 1919027 - protein, 8 aa, Staphylococcus
MGTGTQRV

SEQ ID NO: 1919028 - protein, 10 aa, Staphylococcus
MGTRSGDIDP

SEQ ID NO: 1919029 - protein, 4 aa, Staphylococcus
MKET

SEQ ID NO: 1919030 - protein, 7 aa, Staphylococcus
MKLSGTV

SEQ ID NO: 1919031 - protein, 6 aa, Staphylococcus
MKNDGA

SEQ ID NO: 1919032 - protein, 5 aa, Staphylococcus
MKRAG

SEQ ID NO: 1919033 - protein, 4 aa, Staphylococcus
MKRS

SEQ ID NO: 1919034 - protein, 8 aa, Staphylococcus
MKTKDTDT

SEQ ID NO: 1919035 - protein, 9 aa, Staphylococcus
MKTKDTETV

SEQ ID NO: 1919036 - protein, 5 aa, Staphylococcus
MNAES

SEQ ID NO: 1919037 - protein, 6 aa, Staphylococcus
MNDDES

SEQ ID NO: 1919038 - protein, 8 aa, Staphylococcus
MNDTKSYV

SEQ ID NO: 1919039 - protein, 8 aa, Staphylococcus
MNNNPNEF

SEQ ID NO: 1919040 - protein, 14 aa, Staphylococcus
MPGGQMANTEEVEN

SEQ ID NO: 1919041 - protein, 19 aa, Staphylococcus
MPGGQYSNLSQQAKSLGLG

SEQ ID NO: 1919042 - protein, 5 aa, Staphylococcus
MPKSG

SEQ ID NO: 1919043 - protein, 5 aa, Staphylococcus
MPREK

SEQ ID NO: 1919044 - protein, 4 aa, Staphylococcus
MPTD

SEQ ID NO: 1919045 - protein, 4 aa, Staphylococcus
MQKS

SEQ ID NO: 1919046 - protein, 11 aa, Staphylococcus
MQPVQPPTDDL

SEQ ID NO: 1919047 - protein, 4 aa, Staphylococcus
MQSE

SEQ ID NO: 1919048 - protein, 6 aa, Staphylococcus
MREAET

SEQ ID NO: 1919049 - protein, 5 aa, Staphylococcus
MRKAE

SEQ ID NO: 1919050 - protein, 8 aa, Staphylococcus
MRYRSNND

SEQ ID NO: 1919051 - protein, 5 aa, Staphylococcus
MSDKQ

SEQ ID NO: 1919052 - protein, 4 aa, Staphylococcus
MSEF

SEQ ID NO: 1919053 - protein, 7 aa, Staphylococcus
MSGAGKS

SEQ ID NO: 1919054 - protein, 5 aa, Staphylococcus
MSGGQ

SEQ ID NO: 1919055 - protein, 7 aa, Staphylococcus
MSGNGRF

SEQ ID NO: 1919056 - protein, 13 aa, Staphylococcus
MSRYGSDKPDTRF

SEQ ID NO: 1919057 - protein, 10 aa, Staphylococcus
MSTTVTDGGW

SEQ ID NO: 1919058 - protein, 5 aa, Staphylococcus
MTAPQ

SEQ ID NO: 1919059 - protein, 6 aa, Staphylococcus
MTGQTA

SEQ ID NO: 1919060 - protein, 12 aa, Staphylococcus
MTINEKAEDVSY

SEQ ID NO: 1919061 - protein, 6 aa, Staphylococcus
MTPPPV

SEQ ID NO: 1919062 - protein, 13 aa, Staphylococcus
MTQQEAETAFGNG

SEQ ID NO: 1919063 - protein, 9 aa, Staphylococcus
MTRGHNNSK

SEQ ID NO: 1919064 - protein, 18 aa, Staphylococcus
MTSAATQAIANTNEPAYG

SEQ ID NO: 1919065 - protein, 4 aa, Staphylococcus
NAAG

SEQ ID NO: 1919066 - protein, 7 aa, Staphylococcus
NAAPEVK

SEQ ID NO: 1919067 - protein, 7 aa, Staphylococcus
NADAGVG

SEQ ID NO: 1919068 - protein, 10 aa, Staphylococcus
NADEKSIKGI

SEQ ID NO: 1919069 - protein, 7 aa, Staphylococcus
NADFDGD

SEQ ID NO: 1919070 - protein, 10 aa, Staphylococcus
NADGIGRDAS

SEQ ID NO: 1919071 - protein, 11 aa, Staphylococcus
NADGIGRDAST

SEQ ID NO: 1919072 - protein, 9 aa, Staphylococcus
NADTDGLAG

SEQ ID NO: 1919073 - protein, 8 aa, Staphylococcus
NAEADAAN

SEQ ID NO: 1919074 - protein, 7 aa, Staphylococcus
NAEPKLN

SEQ ID NO: 1919075 - protein, 5 aa, Staphylococcus
NAGEL

SEQ ID NO: 1919076 - protein, 7 aa, Staphylococcus
NAGITAP

SEQ ID NO: 1919077 - protein, 7 aa, Staphylococcus
NAIETEK

SEQ ID NO: 1919078 - protein, 11 aa, Staphylococcus
NAKARSGEAIT

SEQ ID NO: 1919079 - protein, 9 aa, Staphylococcus
NAKETENGQ

SEQ ID NO: 1919080 - protein, 5 aa, Staphylococcus
NALTD

SEQ ID NO: 1919081 - protein, 4 aa, Staphylococcus
NANI

SEQ ID NO: 1919082 - protein, 7 aa, Staphylococcus
NANKEAD

SEQ ID NO: 1919083 - protein, 5 aa, Staphylococcus
NANLG

SEQ ID NO: 1919084 - protein, 9 aa, Staphylococcus
NAPNLVSSA

SEQ ID NO: 1919085 - protein, 8 aa, Staphylococcus
NAPTSKDT

SEQ ID NO: 1919086 - protein, 9 aa, Staphylococcus
NAPTSKNTY

SEQ ID NO: 1919087 - protein, 4 aa, Staphylococcus
NAQE

SEQ ID NO: 1919088 - protein, 5 aa, Staphylococcus
NAQEA

SEQ ID NO: 1919089 - protein, 6 aa, Staphylococcus
NAQETR

SEQ ID NO: 1919090 - protein, 4 aa, Staphylococcus
NAQN

SEQ ID NO: 1919091 - protein, 9 aa, Staphylococcus
NAQPEHYDK

SEQ ID NO: 1919092 - protein, 7 aa, Staphylococcus
NARPEIQ

SEQ ID NO: 1919093 - protein, 8 aa, Staphylococcus
NARTQEQA

SEQ ID NO: 1919094 - protein, 4 aa, Staphylococcus
NATE

SEQ ID NO: 1919095 - protein, 7 aa, Staphylococcus
NATKELK

SEQ ID NO: 1919096 - protein, 13 aa, Staphylococcus
NATSQAGVEGNAG

SEQ ID NO: 1919097 - protein, 5 aa, Staphylococcus
NAVGG

SEQ ID NO: 1919098 - protein, 5 aa, Staphylococcus
NAYDE

SEQ ID NO: 1919099 - protein, 4 aa, Staphylococcus
NAYY

SEQ ID NO: 1919100 - protein, 8 aa, Staphylococcus
NDAPEILG

SEQ ID NO: 1919101 - protein, 4 aa, Staphylococcus
NDAQ

SEQ ID NO: 1919102 - protein, 8 aa, Staphylococcus
NDATNKKN

SEQ ID NO: 1919103 - protein, 5 aa, Staphylococcus
NDDDL

SEQ ID NO: 1919104 - protein, 4 aa, Staphylococcus
NDDG

SEQ ID NO: 1919105 - protein, 5 aa, Staphylococcus
NDEAL

SEQ ID NO: 1919106 - protein, 5 aa, Staphylococcus
NDEEL

SEQ ID NO: 1919107 - protein, 4 aa, Staphylococcus
NDEG

SEQ ID NO: 1919108 - protein, 5 aa, Staphylococcus
NDERA

SEQ ID NO: 1919109 - protein, 11 aa, Staphylococcus
NDFSGGQKTRL

SEQ ID NO: 1919110 - protein, 7 aa, Staphylococcus
NDGKPYA

SEQ ID NO: 1919111 - protein, 4 aa, Staphylococcus
NDGP

SEQ ID NO: 1919112 - protein, 7 aa, Staphylococcus
NDGSDQY

SEQ ID NO: 1919113 - protein, 7 aa, Staphylococcus
NDGSEQY

SEQ ID NO: 1919114 - protein, 8 aa, Staphylococcus
NDIKPRDI

SEQ ID NO: 1919115 - protein, 11 aa, Staphylococcus
NDIRQDGNTGQ

SEQ ID NO: 1919116 - protein, 4 aa, Staphylococcus
NDIS

SEQ ID NO: 1919117 - protein, 7 aa, Staphylococcus
NDKADAA

SEQ ID NO: 1919118 - protein, 6 aa, Staphylococcus
NDKGER

SEQ ID NO: 1919119 - protein, 4 aa, Staphylococcus
NDKN

SEQ ID NO: 1919120 - protein, 7 aa, Staphylococcus
NDKTHQV

SEQ ID NO: 1919121 - protein, 6 aa, Staphylococcus
NDLDTT

SEQ ID NO: 1919122 - protein, 7 aa, Staphylococcus
NDLGTEI

SEQ ID NO: 1919123 - protein, 8 aa, Staphylococcus
NDLKPRDI

SEQ ID NO: 1919124 - protein, 4 aa, Staphylococcus
NDLN

SEQ ID NO: 1919125 - protein, 9 aa, Staphylococcus
NDLSGGQRQ

SEQ ID NO: 1919126 - protein, 6 aa, Staphylococcus
NDNAQV

SEQ ID NO: 1919127 - protein, 4 aa, Staphylococcus
NDNI

SEQ ID NO: 1919128 - protein, 5 aa, Staphylococcus
NDNKE

SEQ ID NO: 1919129 - protein, 4 aa, Staphylococcus
NDNY

SEQ ID NO: 1919130 - protein, 4 aa, Staphylococcus
NDPF

SEQ ID NO: 1919131 - protein, 5 aa, Staphylococcus
NDPTI

SEQ ID NO: 1919132 - protein, 6 aa, Staphylococcus
NDQYSE

SEQ ID NO: 1919133 - protein, 6 aa, Staphylococcus
NDRTHK

SEQ ID NO: 1919134 - protein, 4 aa, Staphylococcus
NDSE

SEQ ID NO: 1919135 - protein, 16 aa, Staphylococcus
NDSERQATKDAGKIAG

SEQ ID NO: 1919136 - protein, 7 aa, Staphylococcus
NDTDYGL

SEQ ID NO: 1919137 - protein, 6 aa, Staphylococcus
NDTKYG

SEQ ID NO: 1919138 - protein, 8 aa, Staphylococcus
NDTNAGLS

SEQ ID NO: 1919139 - protein, 4 aa, Staphylococcus
NDTV

SEQ ID NO: 1919140 - protein, 5 aa, Staphylococcus
NDTVR

SEQ ID NO: 1919141 - protein, 4 aa, Staphylococcus
NDVG

SEQ ID NO: 1919142 - protein, 5 aa, Staphylococcus
NDVGR

SEQ ID NO: 1919143 - protein, 4 aa, Staphylococcus
NDVK

SEQ ID NO: 1919144 - protein, 4 aa, Staphylococcus
NDVY

SEQ ID NO: 1919145 - protein, 7 aa, Staphylococcus
NDYSQEG

SEQ ID NO: 1919146 - protein, 4 aa, Staphylococcus
NEAI

SEQ ID NO: 1919147 - protein, 5 aa, Staphylococcus
NEDES

SEQ ID NO: 1919148 - protein, 9 aa, Staphylococcus
NEEDNKVYE

SEQ ID NO: 1919149 - protein, 6 aa, Staphylococcus
NEEERA

SEQ ID NO: 1919150 - protein, 5 aa, Staphylococcus
NEEIK

SEQ ID NO: 1919151 - protein, 10 aa, Staphylococcus
NEELNNKEIE

SEQ ID NO: 1919152 - protein, 10 aa, Staphylococcus
NEENQNVDEN

SEQ ID NO: 1919153 - protein, 5 aa, Staphylococcus
NEERV

SEQ ID NO: 1919154 - protein, 6 aa, Staphylococcus
NEESIH

SEQ ID NO: 1919155 - protein, 8 aa, Staphylococcus
NEFGTRGL

SEQ ID NO: 1919156 - protein, 11 aa, Staphylococcus
NEFNNKKSYYE

SEQ ID NO: 1919157 - protein, 4 aa, Staphylococcus
NEGK

SEQ ID NO: 1919158 - protein, 9 aa, Staphylococcus
NEGLSTEEA

SEQ ID NO: 1919159 - protein, 5 aa, Staphylococcus
NEIRN

SEQ ID NO: 1919160 - protein, 5 aa, Staphylococcus
NEITV

SEQ ID NO: 1919161 - protein, 8 aa, Staphylococcus
NEKDGRQA

SEQ ID NO: 1919162 - protein, 5 aa, Staphylococcus
NEKEI

SEQ ID NO: 1919163 - protein, 4 aa, Staphylococcus
NEKV

SEQ ID NO: 1919164 - protein, 5 aa, Staphylococcus
NELGG

SEQ ID NO: 1919165 - protein, 18 aa, Staphylococcus
NELKDKDKNLDGNDIREG

SEQ ID NO: 1919166 - protein, 4 aa, Staphylococcus
NELN

SEQ ID NO: 1919167 - protein, 9 aa, Staphylococcus
NEMSDPQID

SEQ ID NO: 1919168 - protein, 12 aa, Staphylococcus
NENEAKKSRLDS

SEQ ID NO: 1919169 - protein, 5 aa, Staphylococcus
NENGD

SEQ ID NO: 1919170 - protein, 4 aa, Staphylococcus
NENI

SEQ ID NO: 1919171 - protein, 10 aa, Staphylococcus
NENIDSKKFE

SEQ ID NO: 1919172 - protein, 11 aa, Staphylococcus
NENRVSLSPSG

SEQ ID NO: 1919173 - protein, 13 aa, Staphylococcus
NEPIGKGKDGEDV

SEQ ID NO: 1919174 - protein, 10 aa, Staphylococcus
NEQDAQASIK

SEQ ID NO: 1919175 - protein, 4 aa, Staphylococcus
NERG

SEQ ID NO: 1919176 - protein, 9 aa, Staphylococcus
NERGISTDN

SEQ ID NO: 1919177 - protein, 4 aa, Staphylococcus
NESL

SEQ ID NO: 1919178 - protein, 4 aa, Staphylococcus
NESS

SEQ ID NO: 1919179 - protein, 7 aa, Staphylococcus
NETDEIS

SEQ ID NO: 1919180 - protein, 4 aa, Staphylococcus
NETE

SEQ ID NO: 1919181 - protein, 6 aa, Staphylococcus
NETEAE

SEQ ID NO: 1919182 - protein, 4 aa, Staphylococcus
NETF

SEQ ID NO: 1919183 - protein, 4 aa, Staphylococcus
NETQ

SEQ ID NO: 1919184 - protein, 6 aa, Staphylococcus
NETQSK

SEQ ID NO: 1919185 - protein, 4 aa, Staphylococcus
NEYI

SEQ ID NO: 1919186 - protein, 9 aa, Staphylococcus
NEYNRQNNN

SEQ ID NO: 1919187 - protein, 6 aa, Staphylococcus
NFPDKE

SEQ ID NO: 1919188 - protein, 9 aa, Staphylococcus
NFPEEAPGV

SEQ ID NO: 1919189 - protein, 4 aa, Staphylococcus
NFSD

SEQ ID NO: 1919190 - protein, 11 aa, Staphylococcus
NGAFTGETSPV

SEQ ID NO: 1919191 - protein, 4 aa, Staphylococcus
NGAS

SEQ ID NO: 1919192 - protein, 9 aa, Staphylococcus
NGASEALDT

SEQ ID NO: 1919193 - protein, 4 aa, Staphylococcus
NGCQ

SEQ ID NO: 1919194 - protein, 11 aa, Staphylococcus
NGDQSEEGLES

SEQ ID NO: 1919195 - protein, 7 aa, Staphylococcus
NGDQSEL

SEQ ID NO: 1919196 - protein, 7 aa, Staphylococcus
NGDRARK

SEQ ID NO: 1919197 - protein, 5 aa, Staphylococcus
NGEDK

SEQ ID NO: 1919198 - protein, 12 aa, Staphylococcus
NGENLGQVASQT

SEQ ID NO: 1919199 - protein, 13 aa, Staphylococcus
NGENLGQVASQTL

SEQ ID NO: 1919200 - protein, 5 aa, Staphylococcus
NGENV

SEQ ID NO: 1919201 - protein, 6 aa, Staphylococcus
NGETHK

SEQ ID NO: 1919202 - protein, 10 aa, Staphylococcus
NGETQVGEVA

SEQ ID NO: 1919203 - protein, 9 aa, Staphylococcus
NGHGSAELY

SEQ ID NO: 1919204 - protein, 9 aa, Staphylococcus
NGIAGSYAE

SEQ ID NO: 1919205 - protein, 4 aa, Staphylococcus
NGIN

SEQ ID NO: 1919206 - protein, 6 aa, Staphylococcus
NGITTI

SEQ ID NO: 1919207 - protein, 8 aa, Staphylococcus
NGKKAYAA

SEQ ID NO: 1919208 - protein, 4 aa, Staphylococcus
NGKT

SEQ ID NO: 1919209 - protein, 9 aa, Staphylococcus
NGLDPKAVR

SEQ ID NO: 1919210 - protein, 8 aa, Staphylococcus
NGLEPAEV

SEQ ID NO: 1919211 - protein, 5 aa, Staphylococcus
NGLGY

SEQ ID NO: 1919212 - protein, 4 aa, Staphylococcus
NGLK

SEQ ID NO: 1919213 - protein, 11 aa, Staphylococcus
NGMDEATLSGD

SEQ ID NO: 1919214 - protein, 4 aa, Staphylococcus
NGNE

SEQ ID NO: 1919215 - protein, 15 aa, Staphylococcus
NGNQNVKPETRNKVN

SEQ ID NO: 1919216 - protein, 6 aa, Staphylococcus
NGQIVD

SEQ ID NO: 1919217 - protein, 6 aa, Staphylococcus
NGRVDK

SEQ ID NO: 1919218 - protein, 6 aa, Staphylococcus
NGRYEG

SEQ ID NO: 1919219 - protein, 6 aa, Staphylococcus
NGSGLA

SEQ ID NO: 1919220 - protein, 9 aa, Staphylococcus
NGSGNVRSK

SEQ ID NO: 1919221 - protein, 4 aa, Staphylococcus
NGSN

SEQ ID NO: 1919222 - protein, 8 aa, Staphylococcus
NGSRPRPM

SEQ ID NO: 1919223 - protein, 8 aa, Staphylococcus
NGSVYEKD

SEQ ID NO: 1919224 - protein, 13 aa, Staphylococcus
NGTGTALSAQDSW

SEQ ID NO: 1919225 - protein, 6 aa, Staphylococcus
NGVGKT

SEQ ID NO: 1919226 - protein, 13 aa, Staphylococcus
NGVLERNGHTEAA

SEQ ID NO: 1919227 - protein, 6 aa, Staphylococcus
NGYEKR

SEQ ID NO: 1919228 - protein, 7 aa, Staphylococcus
NGYYADT

SEQ ID NO: 1919229 - protein, 4 aa, Staphylococcus
NHNQ

SEQ ID NO: 1919230 - protein, 6 aa, Staphylococcus
NHTSDL

SEQ ID NO: 1919231 - protein, 5 aa, Staphylococcus
NHTSN

SEQ ID NO: 1919232 - protein, 11 aa, Staphylococcus
NIASPSTTELI

SEQ ID NO: 1919233 - protein, 10 aa, Staphylococcus
NIEEDAKKAV

SEQ ID NO: 1919234 - protein, 4 aa, Staphylococcus
NIGA

SEQ ID NO: 1919235 - protein, 5 aa, Staphylococcus
NIGNS

SEQ ID NO: 1919236 - protein, 7 aa, Staphylococcus
NIGTPDD

SEQ ID NO: 1919237 - protein, 11 aa, Staphylococcus
NIHTQSTKEIA

SEQ ID NO: 1919238 - protein, 6 aa, Staphylococcus
NINSPT

SEQ ID NO: 1919239 - protein, 7 aa, Staphylococcus
NIPDNKK

SEQ ID NO: 1919240 - protein, 5 aa, Staphylococcus
NIPPH

SEQ ID NO: 1919241 - protein, 7 aa, Staphylococcus
NIQNDGT

SEQ ID NO: 1919242 - protein, 5 aa, Staphylococcus
NIQTL

SEQ ID NO: 1919243 - protein, 5 aa, Staphylococcus
NISEP

SEQ ID NO: 1919244 - protein, 5 aa, Staphylococcus
NISPC

SEQ ID NO: 1919245 - protein, 4 aa, Staphylococcus
NITE

SEQ ID NO: 1919246 - protein, 8 aa, Staphylococcus
NKASSPVV

SEQ ID NO: 1919247 - protein, 5 aa, Staphylococcus
NKDEL

SEQ ID NO: 1919248 - protein, 6 aa, Staphylococcus
NKDNEV

SEQ ID NO: 1919249 - protein, 8 aa, Staphylococcus
NKDQLDGK

SEQ ID NO: 1919250 - protein, 4 aa, Staphylococcus
NKED

SEQ ID NO: 1919251 - protein, 7 aa, Staphylococcus
NKEENIN

SEQ ID NO: 1919252 - protein, 4 aa, Staphylococcus
NKEI

SEQ ID NO: 1919253 - protein, 5 aa, Staphylococcus
NKELN

SEQ ID NO: 1919254 - protein, 5 aa, Staphylococcus
NKENA

SEQ ID NO: 1919255 - protein, 6 aa, Staphylococcus
NKEQSK

SEQ ID NO: 1919256 - protein, 6 aa, Staphylococcus
NKESDL

SEQ ID NO: 1919257 - protein, 6 aa, Staphylococcus
NKESNL

SEQ ID NO: 1919258 - protein, 9 aa, Staphylococcus
NKGADGYEM

SEQ ID NO: 1919259 - protein, 5 aa, Staphylococcus
NKGDY

SEQ ID NO: 1919260 - protein, 7 aa, Staphylococcus
NKGRGYA

SEQ ID NO: 1919261 - protein, 5 aa, Staphylococcus
NKGTD

SEQ ID NO: 1919262 - protein, 15 aa, Staphylococcus
NKHNQVDDYPFGGGQ

SEQ ID NO: 1919263 - protein, 16 aa, Staphylococcus
NKKIQKLESQLEEERQ

SEQ ID NO: 1919264 - protein, 5 aa, Staphylococcus
NKKPI

SEQ ID NO: 1919265 - protein, 9 aa, Staphylococcus
NKKSYYDYE

SEQ ID NO: 1919266 - protein, 8 aa, Staphylococcus
NKLTKEEV

SEQ ID NO: 1919267 - protein, 5 aa, Staphylococcus
NKNFG

SEQ ID NO: 1919268 - protein, 6 aa, Staphylococcus
NKNSKL

SEQ ID NO: 1919269 - protein, 12 aa, Staphylococcus
NKNTKQKRKLRK

SEQ ID NO: 1919270 - protein, 7 aa, Staphylococcus
NKPGMTK

SEQ ID NO: 1919271 - protein, 14 aa, Staphylococcus
NKPQEQASYNASKA

SEQ ID NO: 1919272 - protein, 4 aa, Staphylococcus
NKPR

SEQ ID NO: 1919273 - protein, 21 aa, Staphylococcus
NKRMEENEKNNVLTHGEGRHI

SEQ ID NO: 1919274 - protein, 4 aa, Staphylococcus
NKSK

SEQ ID NO: 1919275 - protein, 9 aa, Staphylococcus
NKVNPSSEL

SEQ ID NO: 1919276 - protein, 12 aa, Staphylococcus
NKYGNTSAASIP

SEQ ID NO: 1919277 - protein, 8 aa, Staphylococcus
NKYIDETT

SEQ ID NO: 1919278 - protein, 13 aa, Staphylococcus
NLENGNPEVHPGP

SEQ ID NO: 1919279 - protein, 14 aa, Staphylococcus
NLENGNPEVHPGPT

SEQ ID NO: 1919280 - protein, 5 aa, Staphylococcus
NLGDT

SEQ ID NO: 1919281 - protein, 6 aa, Staphylococcus
NLGPDA

SEQ ID NO: 1919282 - protein, 4 aa, Staphylococcus
NLNE

SEQ ID NO: 1919283 - protein, 5 aa, Staphylococcus
NLPSH

SEQ ID NO: 1919284 - protein, 18 aa, Staphylococcus
NLSQEDYFDKKRNEHDER

SEQ ID NO: 1919285 - protein, 8 aa, Staphylococcus
NLTPGRQR

SEQ ID NO: 1919286 - protein, 6 aa, Staphylococcus
NLYGGS

SEQ ID NO: 1919287 - protein, 9 aa, Staphylococcus
NNAEVQLGA

SEQ ID NO: 1919288 - protein, 10 aa, Staphylococcus
NNARKAGINS

SEQ ID NO: 1919289 - protein, 4 aa, Staphylococcus
NNDE

SEQ ID NO: 1919290 - protein, 5 aa, Staphylococcus
NNDNE

SEQ ID NO: 1919291 - protein, 8 aa, Staphylococcus
NNEGELTE

SEQ ID NO: 1919292 - protein, 4 aa, Staphylococcus
NNEN

SEQ ID NO: 1919293 - protein, 7 aa, Staphylococcus
NNEQRDV

SEQ ID NO: 1919294 - protein, 9 aa, Staphylococcus
NNETNHANF

SEQ ID NO: 1919295 - protein, 8 aa, Staphylococcus
NNGAQEEA

SEQ ID NO: 1919296 - protein, 8 aa, Staphylococcus
NNGEYADQ

SEQ ID NO: 1919297 - protein, 8 aa, Staphylococcus
NNGPDSFG

SEQ ID NO: 1919298 - protein, 4 aa, Staphylococcus
NNGV

SEQ ID NO: 1919299 - protein, 6 aa, Staphylococcus
NNHSNA

SEQ ID NO: 1919300 - protein, 4 aa, Staphylococcus
NNIS

SEQ ID NO: 1919301 - protein, 7 aa, Staphylococcus
NNKTKHE

SEQ ID NO: 1919302 - protein, 7 aa, Staphylococcus
NNLDPND

SEQ ID NO: 1919303 - protein, 9 aa, Staphylococcus
NNNDTPSDL

SEQ ID NO: 1919304 - protein, 5 aa, Staphylococcus
NNNKE

SEQ ID NO: 1919305 - protein, 5 aa, Staphylococcus
NNNTK

SEQ ID NO: 1919306 - protein, 5 aa, Staphylococcus
NNPNQ

SEQ ID NO: 1919307 - protein, 4 aa, Staphylococcus
NNPS

SEQ ID NO: 1919308 - protein, 6 aa, Staphylococcus
NNPTCG

SEQ ID NO: 1919309 - protein, 4 aa, Staphylococcus
NNQF

SEQ ID NO: 1919310 - protein, 5 aa, Staphylococcus
NNQVA

SEQ ID NO: 1919311 - protein, 11 aa, Staphylococcus
NNQWDDKYPVT

SEQ ID NO: 1919312 - protein, 8 aa, Staphylococcus
NNSFNKDR

SEQ ID NO: 1919313 - protein, 5 aa, Staphylococcus
NNTNW

SEQ ID NO: 1919314 - protein, 8 aa, Staphylococcus
NPATGEKI

SEQ ID NO: 1919315 - protein, 5 aa, Staphylococcus
NPCPE

SEQ ID NO: 1919316 - protein, 4 aa, Staphylococcus
NPDI

SEQ ID NO: 1919317 - protein, 4 aa, Staphylococcus
NPEC

SEQ ID NO: 1919318 - protein, 5 aa, Staphylococcus
NPECN

SEQ ID NO: 1919319 - protein, 6 aa, Staphylococcus
NPEKYD

SEQ ID NO: 1919320 - protein, 8 aa, Staphylococcus
NPENNEYP

SEQ ID NO: 1919321 - protein, 12 aa, Staphylococcus
NPERKRTDYLTP

SEQ ID NO: 1919322 - protein, 4 aa, Staphylococcus
NPEY

SEQ ID NO: 1919323 - protein, 5 aa, Staphylococcus
NPIPG

SEQ ID NO: 1919324 - protein, 10 aa, Staphylococcus
NPKEKDTREI

SEQ ID NO: 1919325 - protein, 5 aa, Staphylococcus
NPLSG

SEQ ID NO: 1919326 - protein, 6 aa, Staphylococcus
NPLSGE

SEQ ID NO: 1919327 - protein, 6 aa, Staphylococcus
NPLTQK

SEQ ID NO: 1919328 - protein, 8 aa, Staphylococcus
NPLTTHDD

SEQ ID NO: 1919329 - protein, 4 aa, Staphylococcus
NPNE

SEQ ID NO: 1919330 - protein, 14 aa, Staphylococcus
NPNIDKKKKDAREM

SEQ ID NO: 1919331 - protein, 4 aa, Staphylococcus
NPPH

SEQ ID NO: 1919332 - protein, 5 aa, Staphylococcus
NPSPF

SEQ ID NO: 1919333 - protein, 10 aa, Staphylococcus
NPSTQQRDAQ

SEQ ID NO: 1919334 - protein, 8 aa, Staphylococcus
NPTLESSD

SEQ ID NO: 1919335 - protein, 9 aa, Staphylococcus
NPTTGGVSA

SEQ ID NO: 1919336 - protein, 12 aa, Staphylococcus
NPVNSKGEKTTP

SEQ ID NO: 1919337 - protein, 4 aa, Staphylococcus
NPYD

SEQ ID NO: 1919338 - protein, 8 aa, Staphylococcus
NQDSTQTF

SEQ ID NO: 1919339 - protein, 8 aa, Staphylococcus
NQDSTRTF

SEQ ID NO: 1919340 - protein, 14 aa, Staphylococcus
NQEGYKSLEEGQSV

SEQ ID NO: 1919341 - protein, 7 aa, Staphylococcus
NQEPNWN

SEQ ID NO: 1919342 - protein, 4 aa, Staphylococcus
NQER

SEQ ID NO: 1919343 - protein, 14 aa, Staphylococcus
NQFEGGYDQGGKGL

SEQ ID NO: 1919344 - protein, 4 aa, Staphylococcus
NQFS

SEQ ID NO: 1919345 - protein, 7 aa, Staphylococcus
NQIEGKE

SEQ ID NO: 1919346 - protein, 4 aa, Staphylococcus
NQIN

SEQ ID NO: 1919347 - protein, 6 aa, Staphylococcus
NQKEHS

SEQ ID NO: 1919348 - protein, 7 aa, Staphylococcus
NQNNTYN

SEQ ID NO: 1919349 - protein, 5 aa, Staphylococcus
NQPEF

SEQ ID NO: 1919350 - protein, 6 aa, Staphylococcus
NQPIDE

SEQ ID NO: 1919351 - protein, 6 aa, Staphylococcus
NQPIEE

SEQ ID NO: 1919352 - protein, 12 aa, Staphylococcus
NQQSHQDDSFSD

SEQ ID NO: 1919353 - protein, 14 aa, Staphylococcus
NQQTDYPSCGPDMP

SEQ ID NO: 1919354 - protein, 7 aa, Staphylococcus
NQSNSIY

SEQ ID NO: 1919355 - protein, 4 aa, Staphylococcus
NQSY

SEQ ID NO: 1919356 - protein, 18 aa, Staphylococcus
NQYGESTKNNYKQAIQEL

SEQ ID NO: 1919357 - protein, 11 aa, Staphylococcus
NQYNRTNKNKF

SEQ ID NO: 1919358 - protein, 9 aa, Staphylococcus
NQYSQKALA

SEQ ID NO: 1919359 - protein, 10 aa, Staphylococcus
NRARQAEITQ

SEQ ID NO: 1919360 - protein, 8 aa, Staphylococcus
NREEREAV

SEQ ID NO: 1919361 - protein, 5 aa, Staphylococcus
NREGR

SEQ ID NO: 1919362 - protein, 6 aa, Staphylococcus
NREGRR

SEQ ID NO: 1919363 - protein, 6 aa, Staphylococcus
NRENVD

SEQ ID NO: 1919364 - protein, 19 aa, Staphylococcus
NRESEHGNAVKQAHKPNFD

SEQ ID NO: 1919365 - protein, 8 aa, Staphylococcus
NRETYETN

SEQ ID NO: 1919366 - protein, 7 aa, Staphylococcus
NRGEKEK

SEQ ID NO: 1919367 - protein, 8 aa, Staphylococcus
NRGEKEKV

SEQ ID NO: 1919368 - protein, 7 aa, Staphylococcus
NRGPRRV

SEQ ID NO: 1919369 - protein, 7 aa, Staphylococcus
NRNPNNY

SEQ ID NO: 1919370 - protein, 12 aa, Staphylococcus
NRNYTKESKERL

SEQ ID NO: 1919371 - protein, 4 aa, Staphylococcus
NRPE

SEQ ID NO: 1919372 - protein, 6 aa, Staphylococcus
NRPELS

SEQ ID NO: 1919373 - protein, 4 aa, Staphylococcus
NRSH

SEQ ID NO: 1919374 - protein, 6 aa, Staphylococcus
NRVSED

SEQ ID NO: 1919375 - protein, 13 aa, Staphylococcus
NRYRLQPENSTMD

SEQ ID NO: 1919376 - protein, 6 aa, Staphylococcus
NRYSTE

SEQ ID NO: 1919377 - protein, 9 aa, Staphylococcus
NSASYYREG

SEQ ID NO: 1919378 - protein, 7 aa, Staphylococcus
NSDAEGR

SEQ ID NO: 1919379 - protein, 4 aa, Staphylococcus
NSDL

SEQ ID NO: 1919380 - protein, 8 aa, Staphylococcus
NSDQTESI

SEQ ID NO: 1919381 - protein, 17 aa, Staphylococcus
NSDVDKDTDTPSYKRTS

SEQ ID NO: 1919382 - protein, 4 aa, Staphylococcus
NSEA

SEQ ID NO: 1919383 - protein, 8 aa, Staphylococcus
NSEDIRAE

SEQ ID NO: 1919384 - protein, 4 aa, Staphylococcus
NSEV

SEQ ID NO: 1919385 - protein, 5 aa, Staphylococcus
NSGYA

SEQ ID NO: 1919386 - protein, 6 aa, Staphylococcus
NSGYAT

SEQ ID NO: 1919387 - protein, 7 aa, Staphylococcus
NSHGADT

SEQ ID NO: 1919388 - protein, 6 aa, Staphylococcus
NSHQLA

SEQ ID NO: 1919389 - protein, 4 aa, Staphylococcus
NSIA

SEQ ID NO: 1919390 - protein, 6 aa, Staphylococcus
NSIPEG

SEQ ID NO: 1919391 - protein, 6 aa, Staphylococcus
NSKGLT

SEQ ID NO: 1919392 - protein, 5 aa, Staphylococcus
NSKID

SEQ ID NO: 1919393 - protein, 11 aa, Staphylococcus
NSLPQGSTATD

SEQ ID NO: 1919394 - protein, 8 aa, Staphylococcus
NSMSKNNQ

SEQ ID NO: 1919395 - protein, 10 aa, Staphylococcus
NSPFAGREGD

SEQ ID NO: 1919396 - protein, 6 aa, Staphylococcus
NSPLSE

SEQ ID NO: 1919397 - protein, 10 aa, Staphylococcus
NSPVNDLSRG

SEQ ID NO: 1919398 - protein, 8 aa, Staphylococcus
NSSQTEKL

SEQ ID NO: 1919399 - protein, 4 aa, Staphylococcus
NSTS

SEQ ID NO: 1919400 - protein, 6 aa, Staphylococcus
NSYGLG

SEQ ID NO: 1919401 - protein, 7 aa, Staphylococcus
NSYRKGE

SEQ ID NO: 1919402 - protein, 4 aa, Staphylococcus
NTAI

SEQ ID NO: 1919403 - protein, 10 aa, Staphylococcus
NTDEGSKRLG

SEQ ID NO: 1919404 - protein, 5 aa, Staphylococcus
NTDKS

SEQ ID NO: 1919405 - protein, 9 aa, Staphylococcus
NTDTKIGKE

SEQ ID NO: 1919406 - protein, 16 aa, Staphylococcus
NTESPPGRNTDPLQDD

SEQ ID NO: 1919407 - protein, 6 aa, Staphylococcus
NTFGDA

SEQ ID NO: 1919408 - protein, 6 aa, Staphylococcus
NTGRPI

SEQ ID NO: 1919409 - protein, 5 aa, Staphylococcus
NTKEA

SEQ ID NO: 1919410 - protein, 8 aa, Staphylococcus
NTKGESTI

SEQ ID NO: 1919411 - protein, 10 aa, Staphylococcus
NTKSVETRDM

SEQ ID NO: 1919412 - protein, 11 aa, Staphylococcus
NTKVGAQDKPV

SEQ ID NO: 1919413 - protein, 5 aa, Staphylococcus
NTLNE

SEQ ID NO: 1919414 - protein, 4 aa, Staphylococcus
NTLS

SEQ ID NO: 1919415 - protein, 6 aa, Staphylococcus
NTNPHS

SEQ ID NO: 1919416 - protein, 8 aa, Staphylococcus
NTNPNSAV

SEQ ID NO: 1919417 - protein, 4 aa, Staphylococcus
NTPI

SEQ ID NO: 1919418 - protein, 8 aa, Staphylococcus
NTPYPEDL

SEQ ID NO: 1919419 - protein, 7 aa, Staphylococcus
NTRTTKG

SEQ ID NO: 1919420 - protein, 4 aa, Staphylococcus
NTSE

SEQ ID NO: 1919421 - protein, 8 aa, Staphylococcus
NTSNKYIT

SEQ ID NO: 1919422 - protein, 15 aa, Staphylococcus
NTVNGDDVTPVPSKD

SEQ ID NO: 1919423 - protein, 4 aa, Staphylococcus
NTYE

SEQ ID NO: 1919424 - protein, 9 aa, Staphylococcus
NTYEPGSTF

SEQ ID NO: 1919425 - protein, 11 aa, Staphylococcus
NTYEPGSTFKS

SEQ ID NO: 1919426 - protein, 5 aa, Staphylococcus
NVEAT

SEQ ID NO: 1919427 - protein, 26 aa, Staphylococcus
NVEGRSAKIEGKSQLQGAQVKATDLR

SEQ ID NO: 1919428 - protein, 6 aa, Staphylococcus
NVESSG

SEQ ID NO: 1919429 - protein, 8 aa, Staphylococcus
NVGGLPED

SEQ ID NO: 1919430 - protein, 4 aa, Staphylococcus
NVGI

SEQ ID NO: 1919431 - protein, 4 aa, Staphylococcus
NVGK

SEQ ID NO: 1919432 - protein, 25 aa, Staphylococcus
NVGTPEGVRELENAGADATKVGIGP

SEQ ID NO: 1919433 - protein, 26 aa, Staphylococcus
NVGTPEGVRELENAGADATKVGIGPG

SEQ ID NO: 1919434 - protein, 7 aa, Staphylococcus
NVKEKSD

SEQ ID NO: 1919435 - protein, 10 aa, Staphylococcus
NVKKGVKDNK

SEQ ID NO: 1919436 - protein, 12 aa, Staphylococcus
NVNTENQIASAK

SEQ ID NO: 1919437 - protein, 11 aa, Staphylococcus
NVQNPSITRED

SEQ ID NO: 1919438 - protein, 6 aa, Staphylococcus
NVSERR

SEQ ID NO: 1919439 - protein, 7 aa, Staphylococcus
NVSETTY

SEQ ID NO: 1919440 - protein, 5 aa, Staphylococcus
NVSSA

SEQ ID NO: 1919441 - protein, 11 aa, Staphylococcus
NVTSGANPVGL

SEQ ID NO: 1919442 - protein, 12 aa, Staphylococcus
NVTSGANPVGLR

SEQ ID NO: 1919443 - protein, 6 aa, Staphylococcus
NWNKEL

SEQ ID NO: 1919444 - protein, 13 aa, Staphylococcus
NYAASKEKDDKDL

SEQ ID NO: 1919445 - protein, 12 aa, Staphylococcus
NYERKKEKQSVL

SEQ ID NO: 1919446 - protein, 5 aa, Staphylococcus
NYGDD

SEQ ID NO: 1919447 - protein, 6 aa, Staphylococcus
NYHGSY

SEQ ID NO: 1919448 - protein, 5 aa, Staphylococcus
NYPSI

SEQ ID NO: 1919449 - protein, 7 aa, Staphylococcus
PAAGRKI

SEQ ID NO: 1919450 - protein, 8 aa, Staphylococcus
PADSSLAN

SEQ ID NO: 1919451 - protein, 6 aa, Staphylococcus
PAEAEA

SEQ ID NO: 1919452 - protein, 8 aa, Staphylococcus
PAEDTPLT

SEQ ID NO: 1919453 - protein, 11 aa, Staphylococcus
PAEKVDKALDQ

SEQ ID NO: 1919454 - protein, 11 aa, Staphylococcus
PAELSGGQQQR

SEQ ID NO: 1919455 - protein, 14 aa, Staphylococcus
PAGDGWDSDPFNPV

SEQ ID NO: 1919456 - protein, 11 aa, Staphylococcus
PAGEERPLPTT

SEQ ID NO: 1919457 - protein, 10 aa, Staphylococcus
PAGTQTGKQF

SEQ ID NO: 1919458 - protein, 5 aa, Staphylococcus
PALYN

SEQ ID NO: 1919459 - protein, 13 aa, Staphylococcus
PAMDDDDYRRGKL

SEQ ID NO: 1919460 - protein, 11 aa, Staphylococcus
PAPDGDPDAPL

SEQ ID NO: 1919461 - protein, 6 aa, Staphylococcus
PAPSGQ

SEQ ID NO: 1919462 - protein, 6 aa, Staphylococcus
PAQSGD

SEQ ID NO: 1919463 - protein, 11 aa, Staphylococcus
PAQSGEMRTLN

SEQ ID NO: 1919464 - protein, 4 aa, Staphylococcus
PAQT

SEQ ID NO: 1919465 - protein, 7 aa, Staphylococcus
PDAKLDD

SEQ ID NO: 1919466 - protein, 9 aa, Staphylococcus
PDDGEGKSY

SEQ ID NO: 1919467 - protein, 6 aa, Staphylococcus
PDDPPW

SEQ ID NO: 1919468 - protein, 5 aa, Staphylococcus
PDDSY

SEQ ID NO: 1919469 - protein, 24 aa, Staphylococcus
PDEKAPENMSDKEIEQVKEKEGQR

SEQ ID NO: 1919470 - protein, 4 aa, Staphylococcus
PDHM

SEQ ID NO: 1919471 - protein, 4 aa, Staphylococcus
PDLA

SEQ ID NO: 1919472 - protein, 8 aa, Staphylococcus
PDLPEGNL

SEQ ID NO: 1919473 - protein, 4 aa, Staphylococcus
PDPI

SEQ ID NO: 1919474 - protein, 11 aa, Staphylococcus
PDPNKTLNEGA

SEQ ID NO: 1919475 - protein, 4 aa, Staphylococcus
PDRD

SEQ ID NO: 1919476 - protein, 20 aa, Staphylococcus
PDSFSDGGQYNSIDNAVTRA

SEQ ID NO: 1919477 - protein, 5 aa, Staphylococcus
PDVPS

SEQ ID NO: 1919478 - protein, 7 aa, Staphylococcus
PDVPSMP

SEQ ID NO: 1919479 - protein, 5 aa, Staphylococcus
PDYAE

SEQ ID NO: 1919480 - protein, 7 aa, Staphylococcus
PEARDED

SEQ ID NO: 1919481 - protein, 7 aa, Staphylococcus
PEARTAL

SEQ ID NO: 1919482 - protein, 4 aa, Staphylococcus
PEAY

SEQ ID NO: 1919483 - protein, 4 aa, Staphylococcus
PEDY

SEQ ID NO: 1919484 - protein, 5 aa, Staphylococcus
PEFKE

SEQ ID NO: 1919485 - protein, 13 aa, Staphylococcus
PEGVEKMKEAHDD

SEQ ID NO: 1919486 - protein, 5 aa, Staphylococcus
PEIES

SEQ ID NO: 1919487 - protein, 9 aa, Staphylococcus
PEKLRQDEN

SEQ ID NO: 1919488 - protein, 8 aa, Staphylococcus
PEKQPIFG

SEQ ID NO: 1919489 - protein, 7 aa, Staphylococcus
PELDAQG

SEQ ID NO: 1919490 - protein, 8 aa, Staphylococcus
PELPEGNL

SEQ ID NO: 1919491 - protein, 4 aa, Staphylococcus
PEMS

SEQ ID NO: 1919492 - protein, 4 aa, Staphylococcus
PENQ

SEQ ID NO: 1919493 - protein, 6 aa, Staphylococcus
PEQLPD

SEQ ID NO: 1919494 - protein, 4 aa, Staphylococcus
PEQY

SEQ ID NO: 1919495 - protein, 10 aa, Staphylococcus
PERKRTTYLT

SEQ ID NO: 1919496 - protein, 4 aa, Staphylococcus
PEYE

SEQ ID NO: 1919497 - protein, 7 aa, Staphylococcus
PFAPPSK

SEQ ID NO: 1919498 - protein, 10 aa, Staphylococcus
PFEEAEESID

SEQ ID NO: 1919499 - protein, 5 aa, Staphylococcus
PFGGG

SEQ ID NO: 1919500 - protein, 15 aa, Staphylococcus
PFGSDLKSAESLNNQ

SEQ ID NO: 1919501 - protein, 6 aa, Staphylococcus
PFNIEG

SEQ ID NO: 1919502 - protein, 4 aa, Staphylococcus
PGAQ

SEQ ID NO: 1919503 - protein, 18 aa, Staphylococcus
PGASITTTSSVQGYNPSP

SEQ ID NO: 1919504 - protein, 10 aa, Staphylococcus
PGAVPRTSTL

SEQ ID NO: 1919505 - protein, 10 aa, Staphylococcus
PGDGTEERDQ

SEQ ID NO: 1919506 - protein, 9 aa, Staphylococcus
PGETEEEFQ

SEQ ID NO: 1919507 - protein, 13 aa, Staphylococcus
PGFEDMKKDLEAR

SEQ ID NO: 1919508 - protein, 8 aa, Staphylococcus
PGGPGTLE

SEQ ID NO: 1919509 - protein, 9 aa, Staphylococcus
PGGTATPEQ

SEQ ID NO: 1919510 - protein, 4 aa, Staphylococcus
PGHA

SEQ ID NO: 1919511 - protein, 4 aa, Staphylococcus
PGHG

SEQ ID NO: 1919512 - protein, 10 aa, Staphylococcus
PGIGKKTARQ

SEQ ID NO: 1919513 - protein, 11 aa, Staphylococcus
PGITDKDADDI

SEQ ID NO: 1919514 - protein, 14 aa, Staphylococcus
PGKSHQRHIDSENR

SEQ ID NO: 1919515 - protein, 5 aa, Staphylococcus
PGLQS

SEQ ID NO: 1919516 - protein, 6 aa, Staphylococcus
PGPASR

SEQ ID NO: 1919517 - protein, 10 aa, Staphylococcus
PGPPKEMQPM

SEQ ID NO: 1919518 - protein, 5 aa, Staphylococcus
PGQTA

SEQ ID NO: 1919519 - protein, 5 aa, Staphylococcus
PGQYN

SEQ ID NO: 1919520 - protein, 14 aa, Staphylococcus
PGSISQSRSNIEET

SEQ ID NO: 1919521 - protein, 5 aa, Staphylococcus
PGSVG

SEQ ID NO: 1919522 - protein, 4 aa, Staphylococcus
PGTE

SEQ ID NO: 1919523 - protein, 12 aa, Staphylococcus
PGTIDNDINGTD

SEQ ID NO: 1919524 - protein, 9 aa, Staphylococcus
PGTTTANYK

SEQ ID NO: 1919525 - protein, 6 aa, Staphylococcus
PGVPKG

SEQ ID NO: 1919526 - protein, 7 aa, Staphylococcus
PGVPKGK

SEQ ID NO: 1919527 - protein, 6 aa, Staphylococcus
PGWVTG

SEQ ID NO: 1919528 - protein, 4 aa, Staphylococcus
PHDF

SEQ ID NO: 1919529 - protein, 5 aa, Staphylococcus
PHDFE

SEQ ID NO: 1919530 - protein, 5 aa, Staphylococcus
PHDYG

SEQ ID NO: 1919531 - protein, 5 aa, Staphylococcus
PHEIR

SEQ ID NO: 1919532 - protein, 8 aa, Staphylococcus
PHGNPEKV

SEQ ID NO: 1919533 - protein, 5 aa, Staphylococcus
PHGVA

SEQ ID NO: 1919534 - protein, 9 aa, Staphylococcus
PHPGFPTDM

SEQ ID NO: 1919535 - protein, 9 aa, Staphylococcus
PHPGTDAAV

SEQ ID NO: 1919536 - protein, 6 aa, Staphylococcus
PHVKEE

SEQ ID NO: 1919537 - protein, 4 aa, Staphylococcus
PIEK

SEQ ID NO: 1919538 - protein, 6 aa, Staphylococcus
PIGASG

SEQ ID NO: 1919539 - protein, 10 aa, Staphylococcus
PIGGYGGRQD

SEQ ID NO: 1919540 - protein, 12 aa, Staphylococcus
PIGKLPPNKRKV

SEQ ID NO: 1919541 - protein, 18 aa, Staphylococcus
PIKQAKELSSDKKSNEKL

SEQ ID NO: 1919542 - protein, 5 aa, Staphylococcus
PIPER

SEQ ID NO: 1919543 - protein, 16 aa, Staphylococcus
PKADDSVTQLILPIRT

SEQ ID NO: 1919544 - protein, 4 aa, Staphylococcus
PKAY

SEQ ID NO: 1919545 - protein, 4 aa, Staphylococcus
PKDI

SEQ ID NO: 1919546 - protein, 4 aa, Staphylococcus
PKDT

SEQ ID NO: 1919547 - protein, 5 aa, Staphylococcus
PKECQ

SEQ ID NO: 1919548 - protein, 11 aa, Staphylococcus
PKEDGSEPNNW

SEQ ID NO: 1919549 - protein, 4 aa, Staphylococcus
PKEI

SEQ ID NO: 1919550 - protein, 4 aa, Staphylococcus
PKEM

SEQ ID NO: 1919551 - protein, 11 aa, Staphylococcus
PKEYGGEGATI

SEQ ID NO: 1919552 - protein, 6 aa, Staphylococcus
PKGTEH

SEQ ID NO: 1919553 - protein, 5 aa, Staphylococcus
PKHDE

SEQ ID NO: 1919554 - protein, 6 aa, Staphylococcus
PKHDEF

SEQ ID NO: 1919555 - protein, 9 aa, Staphylococcus
PKIPQGRGN

SEQ ID NO: 1919556 - protein, 8 aa, Staphylococcus
PKLSHGNR

SEQ ID NO: 1919557 - protein, 10 aa, Staphylococcus
PKLTPTATFE

SEQ ID NO: 1919558 - protein, 6 aa, Staphylococcus
PKNDKS

SEQ ID NO: 1919559 - protein, 11 aa, Staphylococcus
PKPDGSEPNNW

SEQ ID NO: 1919560 - protein, 7 aa, Staphylococcus
PKQISDN

SEQ ID NO: 1919561 - protein, 4 aa, Staphylococcus
PKQQ

SEQ ID NO: 1919562 - protein, 5 aa, Staphylococcus
PKRLQ

SEQ ID NO: 1919563 - protein, 8 aa, Staphylococcus
PKSKKITI

SEQ ID NO: 1919564 - protein, 15 aa, Staphylococcus
PKSKLDNLANAPHQG

SEQ ID NO: 1919565 - protein, 9 aa, Staphylococcus
PKSNSGITA

SEQ ID NO: 1919566 - protein, 8 aa, Staphylococcus
PKYDPDER

SEQ ID NO: 1919567 - protein, 8 aa, Staphylococcus
PKYNPDER

SEQ ID NO: 1919568 - protein, 4 aa, Staphylococcus
PLAD

SEQ ID NO: 1919569 - protein, 5 aa, Staphylococcus
PLAES

SEQ ID NO: 1919570 - protein, 12 aa, Staphylococcus
PLASTSRALEPS

SEQ ID NO: 1919571 - protein, 4 aa, Staphylococcus
PLPD

SEQ ID NO: 1919572 - protein, 4 aa, Staphylococcus
PLPE

SEQ ID NO: 1919573 - protein, 14 aa, Staphylococcus
PLPKRAGRNNQGKL

SEQ ID NO: 1919574 - protein, 15 aa, Staphylococcus
PLPNGGEINVKIVNI

SEQ ID NO: 1919575 - protein, 15 aa, Staphylococcus
PLPNGGEMNVKIVDI

SEQ ID NO: 1919576 - protein, 7 aa, Staphylococcus
PLSPTLT

SEQ ID NO: 1919577 - protein, 11 aa, Staphylococcus
PLSTLSGGEIQ

SEQ ID NO: 1919578 - protein, 4 aa, Staphylococcus
PLTR

SEQ ID NO: 1919579 - protein, 7 aa, Staphylococcus
PLTRTPD

SEQ ID NO: 1919580 - protein, 5 aa, Staphylococcus
PLTSE

SEQ ID NO: 1919581 - protein, 7 aa, Staphylococcus
PLYGDSK

SEQ ID NO: 1919582 - protein, 5 aa, Staphylococcus
PMEEK

SEQ ID NO: 1919583 - protein, 4 aa, Staphylococcus
PMKG

SEQ ID NO: 1919584 - protein, 15 aa, Staphylococcus
PMNGEDEAQKQTTRS

SEQ ID NO: 1919585 - protein, 9 aa, Staphylococcus
PMVPTTGQY

SEQ ID NO: 1919586 - protein, 6 aa, Staphylococcus
PNAEKR

SEQ ID NO: 1919587 - protein, 7 aa, Staphylococcus
PNAEKRF

SEQ ID NO: 1919588 - protein, 5 aa, Staphylococcus
PNAQK

SEQ ID NO: 1919589 - protein, 4 aa, Staphylococcus
PNDM

SEQ ID NO: 1919590 - protein, 9 aa, Staphylococcus
PNDRKYHPL

SEQ ID NO: 1919591 - protein, 6 aa, Staphylococcus
PNGDRK

SEQ ID NO: 1919592 - protein, 6 aa, Staphylococcus
PNGERK

SEQ ID NO: 1919593 - protein, 7 aa, Staphylococcus
PNGIGKS

SEQ ID NO: 1919594 - protein, 4 aa, Staphylococcus
PNGV

SEQ ID NO: 1919595 - protein, 5 aa, Staphylococcus
PNHPR

SEQ ID NO: 1919596 - protein, 8 aa, Staphylococcus
PNHSTTSD

SEQ ID NO: 1919597 - protein, 7 aa, Staphylococcus
PNKDELE

SEQ ID NO: 1919598 - protein, 14 aa, Staphylococcus
PNKNSAKLTQATAR

SEQ ID NO: 1919599 - protein, 4 aa, Staphylococcus
PNKV

SEQ ID NO: 1919600 - protein, 8 aa, Staphylococcus
PNLPEGNL

SEQ ID NO: 1919601 - protein, 12 aa, Staphylococcus
PNNPTGSTATKA

SEQ ID NO: 1919602 - protein, 8 aa, Staphylococcus
PNPENEET

SEQ ID NO: 1919603 - protein, 5 aa, Staphylococcus
PNPSI

SEQ ID NO: 1919604 - protein, 4 aa, Staphylococcus
PNQA

SEQ ID NO: 1919605 - protein, 10 aa, Staphylococcus
PNSEEKGEVV

SEQ ID NO: 1919606 - protein, 10 aa, Staphylococcus
PNSPHQAGLQ

SEQ ID NO: 1919607 - protein, 13 aa, Staphylococcus
PNSSLSAASGYAE

SEQ ID NO: 1919608 - protein, 7 aa, Staphylococcus
PNSTYIQ

SEQ ID NO: 1919609 - protein, 6 aa, Staphylococcus
PNVDAG

SEQ ID NO: 1919610 - protein, 7 aa, Staphylococcus
PNVKEKA

SEQ ID NO: 1919611 - protein, 4 aa, Staphylococcus
PNVT

SEQ ID NO: 1919612 - protein, 7 aa, Staphylococcus
PNYHGSY

SEQ ID NO: 1919613 - protein, 4 aa, Staphylococcus
PPAD

SEQ ID NO: 1919614 - protein, 4 aa, Staphylococcus
PPEN

SEQ ID NO: 1919615 - protein, 9 aa, Staphylococcus
PPGLGKTTL

SEQ ID NO: 1919616 - protein, 6 aa, Staphylococcus
PPIRAG

SEQ ID NO: 1919617 - protein, 4 aa, Staphylococcus
PPKL

SEQ ID NO: 1919618 - protein, 11 aa, Staphylococcus
PPLRSKEDREA

SEQ ID NO: 1919619 - protein, 4 aa, Staphylococcus
PPLT

SEQ ID NO: 1919620 - protein, 4 aa, Staphylococcus
PPNV

SEQ ID NO: 1919621 - protein, 5 aa, Staphylococcus
PPPNV

SEQ ID NO: 1919622 - protein, 17 aa, Staphylococcus
PPREYSISSSYKATPDE

SEQ ID NO: 1919623 - protein, 12 aa, Staphylococcus
PPSEVPERTEGY

SEQ ID NO: 1919624 - protein, 18 aa, Staphylococcus
PPSGRTLSGGLDPASLHK

SEQ ID NO: 1919625 - protein, 7 aa, Staphylococcus
PPVNTVT

SEQ ID NO: 1919626 - protein, 7 aa, Staphylococcus
PQARTAL

SEQ ID NO: 1919627 - protein, 4 aa, Staphylococcus
PQDS

SEQ ID NO: 1919628 - protein, 6 aa, Staphylococcus
PQELTS

SEQ ID NO: 1919629 - protein, 4 aa, Staphylococcus
PQLE

SEQ ID NO: 1919630 - protein, 9 aa, Staphylococcus
PQPAPADHP

SEQ ID NO: 1919631 - protein, 4 aa, Staphylococcus
PQPG

SEQ ID NO: 1919632 - protein, 7 aa, Staphylococcus
PQSIPQD

SEQ ID NO: 1919633 - protein, 6 aa, Staphylococcus
PRASKY

SEQ ID NO: 1919634 - protein, 7 aa, Staphylococcus
PRASRTV

SEQ ID NO: 1919635 - protein, 4 aa, Staphylococcus
PRER

SEQ ID NO: 1919636 - protein, 16 aa, Staphylococcus
PRSQMGVDTEDNYEPK

SEQ ID NO: 1919637 - protein, 9 aa, Staphylococcus
PRTEITSSG

SEQ ID NO: 1919638 - protein, 20 aa, Staphylococcus
PSCKTKKNVQRKTNARCPNC

SEQ ID NO: 1919639 - protein, 13 aa, Staphylococcus
PSDFKKNKGYERS

SEQ ID NO: 1919640 - protein, 11 aa, Staphylococcus
PSDIRAAGGVA

SEQ ID NO: 1919641 - protein, 10 aa, Staphylococcus
PSEEQDAQEV

SEQ ID NO: 1919642 - protein, 6 aa, Staphylococcus
PSEETT

SEQ ID NO: 1919643 - protein, 9 aa, Staphylococcus
PSEHTERSW

SEQ ID NO: 1919644 - protein, 15 aa, Staphylococcus
PSEHTERSWDEVPEE

SEQ ID NO: 1919645 - protein, 4 aa, Staphylococcus
PSEI

SEQ ID NO: 1919646 - protein, 8 aa, Staphylococcus
PSFRPGDT

SEQ ID NO: 1919647 - protein, 9 aa, Staphylococcus
PSGCGKSTT

SEQ ID NO: 1919648 - protein, 8 aa, Staphylococcus
PSGFNKSG

SEQ ID NO: 1919649 - protein, 8 aa, Staphylococcus
PSGPYDAK

SEQ ID NO: 1919650 - protein, 7 aa, Staphylococcus
PSGRAVT

SEQ ID NO: 1919651 - protein, 10 aa, Staphylococcus
PSGTQTGKQF

SEQ ID NO: 1919652 - protein, 7 aa, Staphylococcus
PSISQQQ

SEQ ID NO: 1919653 - protein, 4 aa, Staphylococcus
PSKD

SEQ ID NO: 1919654 - protein, 5 aa, Staphylococcus
PSLST

SEQ ID NO: 1919655 - protein, 5 aa, Staphylococcus
PSLTA

SEQ ID NO: 1919656 - protein, 8 aa, Staphylococcus
PSPGHYSG

SEQ ID NO: 1919657 - protein, 5 aa, Staphylococcus
PSPQP

SEQ ID NO: 1919658 - protein, 10 aa, Staphylococcus
PSPVKRPEDT

SEQ ID NO: 1919659 - protein, 6 aa, Staphylococcus
PSSEDV

SEQ ID NO: 1919660 - protein, 12 aa, Staphylococcus
PSSPVPTTSNTA

SEQ ID NO: 1919661 - protein, 8 aa, Staphylococcus
PSSRGLST

SEQ ID NO: 1919662 - protein, 11 aa, Staphylococcus
PSSRLGEKQGK

SEQ ID NO: 1919663 - protein, 9 aa, Staphylococcus
PSSRTDRGV

SEQ ID NO: 1919664 - protein, 6 aa, Staphylococcus
PSVGKT

SEQ ID NO: 1919665 - protein, 5 aa, Staphylococcus
PSVVA

SEQ ID NO: 1919666 - protein, 4 aa, Staphylococcus
PSYP

SEQ ID NO: 1919667 - protein, 8 aa, Staphylococcus
PSYSPETI

SEQ ID NO: 1919668 - protein, 6 aa, Staphylococcus
PTAGLD

SEQ ID NO: 1919669 - protein, 9 aa, Staphylococcus
PTDKSYQLS

SEQ ID NO: 1919670 - protein, 4 aa, Staphylococcus
PTDL

SEQ ID NO: 1919671 - protein, 5 aa, Staphylococcus
PTEGN

SEQ ID NO: 1919672 - protein, 7 aa, Staphylococcus
PTEKGKS

SEQ ID NO: 1919673 - protein, 7 aa, Staphylococcus
PTFHDPA

SEQ ID NO: 1919674 - protein, 7 aa, Staphylococcus
PTFRTGD

SEQ ID NO: 1919675 - protein, 20 aa, Staphylococcus
PTGNGDVIDGAREQWNDGSN

SEQ ID NO: 1919676 - protein, 4 aa, Staphylococcus
PTHE

SEQ ID NO: 1919677 - protein, 5 aa, Staphylococcus
PTHSS

SEQ ID NO: 1919678 - protein, 5 aa, Staphylococcus
PTKEP

SEQ ID NO: 1919679 - protein, 14 aa, Staphylococcus
PTKLKNPPSNWPRT

SEQ ID NO: 1919680 - protein, 4 aa, Staphylococcus
PTKN

SEQ ID NO: 1919681 - protein, 14 aa, Staphylococcus
PTKNSAKLTQATAR

SEQ ID NO: 1919682 - protein, 7 aa, Staphylococcus
PTLSKDS

SEQ ID NO: 1919683 - protein, 5 aa, Staphylococcus
PTNHL

SEQ ID NO: 1919684 - protein, 12 aa, Staphylococcus
PTPEEKSNYLPS

SEQ ID NO: 1919685 - protein, 5 aa, Staphylococcus
PTPTL

SEQ ID NO: 1919686 - protein, 7 aa, Staphylococcus
PTRGIDV

SEQ ID NO: 1919687 - protein, 7 aa, Staphylococcus
PTSALDP

SEQ ID NO: 1919688 - protein, 6 aa, Staphylococcus
PTSGNH

SEQ ID NO: 1919689 - protein, 6 aa, Staphylococcus
PTSNPV

SEQ ID NO: 1919690 - protein, 9 aa, Staphylococcus
PTSRGLSTR

SEQ ID NO: 1919691 - protein, 10 aa, Staphylococcus
PTSSIVGRGL

SEQ ID NO: 1919692 - protein, 4 aa, Staphylococcus
PTTY

SEQ ID NO: 1919693 - protein, 10 aa, Staphylococcus
PVGDDQKQHM

SEQ ID NO: 1919694 - protein, 8 aa, Staphylococcus
PVHASNRS

SEQ ID NO: 1919695 - protein, 4 aa, Staphylococcus
PVKP

SEQ ID NO: 1919696 - protein, 5 aa, Staphylococcus
PVPVG

SEQ ID NO: 1919697 - protein, 4 aa, Staphylococcus
PVRQ

SEQ ID NO: 1919698 - protein, 7 aa, Staphylococcus
PVTGTSY

SEQ ID NO: 1919699 - protein, 20 aa, Staphylococcus
PWGGYKQSGIGRELGKEGLE

SEQ ID NO: 1919700 - protein, 21 aa, Staphylococcus
PWGGYKQSGIGRELGKEGLEE

SEQ ID NO: 1919701 - protein, 9 aa, Staphylococcus
PYAAPPEDA

SEQ ID NO: 1919702 - protein, 12 aa, Staphylococcus
PYAAPPKDAYDL

SEQ ID NO: 1919703 - protein, 10 aa, Staphylococcus
PYAGDKGGQL

SEQ ID NO: 1919704 - protein, 4 aa, Staphylococcus
PYDF

SEQ ID NO: 1919705 - protein, 4 aa, Staphylococcus
PYDN

SEQ ID NO: 1919706 - protein, 5 aa, Staphylococcus
PYKKG

SEQ ID NO: 1919707 - protein, 5 aa, Staphylococcus
PYTEH

SEQ ID NO: 1919708 - protein, 15 aa, Staphylococcus
PYTNYGRPNSKYEKM

SEQ ID NO: 1919709 - protein, 5 aa, Staphylococcus
PYVEP

SEQ ID NO: 1919710 - protein, 13 aa, Staphylococcus
QADDDYKDKMGEK

SEQ ID NO: 1919711 - protein, 13 aa, Staphylococcus
QADEDYKDKMGEK

SEQ ID NO: 1919712 - protein, 4 aa, Staphylococcus
QADK

SEQ ID NO: 1919713 - protein, 5 aa, Staphylococcus
QADQL

SEQ ID NO: 1919714 - protein, 5 aa, Staphylococcus
QAEEA

SEQ ID NO: 1919715 - protein, 10 aa, Staphylococcus
QAEGKSPLED

SEQ ID NO: 1919716 - protein, 6 aa, Staphylococcus
QAENVN

SEQ ID NO: 1919717 - protein, 8 aa, Staphylococcus
QAGLGRSG

SEQ ID NO: 1919718 - protein, 8 aa, Staphylococcus
QAGSSCNI

SEQ ID NO: 1919719 - protein, 7 aa, Staphylococcus
QAHRPQF

SEQ ID NO: 1919720 - protein, 9 aa, Staphylococcus
QAIDDDTAA

SEQ ID NO: 1919721 - protein, 4 aa, Staphylococcus
QAIN

SEQ ID NO: 1919722 - protein, 7 aa, Staphylococcus
QAKATTV

SEQ ID NO: 1919723 - protein, 7 aa, Staphylococcus
QAKDQME

SEQ ID NO: 1919724 - protein, 4 aa, Staphylococcus
QALG

SEQ ID NO: 1919725 - protein, 11 aa, Staphylococcus
QALNEGKPENI

SEQ ID NO: 1919726 - protein, 7 aa, Staphylococcus
QANAQPI

SEQ ID NO: 1919727 - protein, 9 aa, Staphylococcus
QAPKSKKIT

SEQ ID NO: 1919728 - protein, 12 aa, Staphylococcus
QAQTGTGKTGAF

SEQ ID NO: 1919729 - protein, 8 aa, Staphylococcus
QATEALPN

SEQ ID NO: 1919730 - protein, 7 aa, Staphylococcus
QATNQAT

SEQ ID NO: 1919731 - protein, 6 aa, Staphylococcus
QDAEKD

SEQ ID NO: 1919732 - protein, 9 aa, Staphylococcus
QDALSTPSN

SEQ ID NO: 1919733 - protein, 8 aa, Staphylococcus
QDATGHAR

SEQ ID NO: 1919734 - protein, 8 aa, Staphylococcus
QDATPIKL

SEQ ID NO: 1919735 - protein, 8 aa, Staphylococcus
QDDAKRKV

SEQ ID NO: 1919736 - protein, 8 aa, Staphylococcus
QDDDIAKK

SEQ ID NO: 1919737 - protein, 8 aa, Staphylococcus
QDDEIAKK

SEQ ID NO: 1919738 - protein, 6 aa, Staphylococcus
QDDNAD

SEQ ID NO: 1919739 - protein, 5 aa, Staphylococcus
QDDQI

SEQ ID NO: 1919740 - protein, 17 aa, Staphylococcus
QDDRDLRDERRKQKLEP

SEQ ID NO: 1919741 - protein, 4 aa, Staphylococcus
QDEE

SEQ ID NO: 1919742 - protein, 7 aa, Staphylococcus
QDEQYDR

SEQ ID NO: 1919743 - protein, 5 aa, Staphylococcus
QDESM

SEQ ID NO: 1919744 - protein, 5 aa, Staphylococcus
QDIDE

SEQ ID NO: 1919745 - protein, 5 aa, Staphylococcus
QDIEE

SEQ ID NO: 1919746 - protein, 4 aa, Staphylococcus
QDLG

SEQ ID NO: 1919747 - protein, 8 aa, Staphylococcus
QDNDEFEE

SEQ ID NO: 1919748 - protein, 4 aa, Staphylococcus
QDNE

SEQ ID NO: 1919749 - protein, 11 aa, Staphylococcus
QDNPDLPRPVG

SEQ ID NO: 1919750 - protein, 5 aa, Staphylococcus
QDPDC

SEQ ID NO: 1919751 - protein, 9 aa, Staphylococcus
QDPSSVPDD

SEQ ID NO: 1919752 - protein, 9 aa, Staphylococcus
QDPSSVPED

SEQ ID NO: 1919753 - protein, 15 aa, Staphylococcus
QDQDTSNDKYTGFES

SEQ ID NO: 1919754 - protein, 4 aa, Staphylococcus
QDRP

SEQ ID NO: 1919755 - protein, 9 aa, Staphylococcus
QDRPNMKTV

SEQ ID NO: 1919756 - protein, 4 aa, Staphylococcus
QDTV

SEQ ID NO: 1919757 - protein, 5 aa, Staphylococcus
QEAHP

SEQ ID NO: 1919758 - protein, 6 aa, Staphylococcus
QEEHDK

SEQ ID NO: 1919759 - protein, 4 aa, Staphylococcus
QEEN

SEQ ID NO: 1919760 - protein, 25 aa, Staphylococcus
QEEQQKYASQRKSAVGTGDRSERIR

SEQ ID NO: 1919761 - protein, 5 aa, Staphylococcus
QEEVA

SEQ ID NO: 1919762 - protein, 5 aa, Staphylococcus
QEEVG

SEQ ID NO: 1919763 - protein, 4 aa, Staphylococcus
QEGL

SEQ ID NO: 1919764 - protein, 6 aa, Staphylococcus
QEGRGI

SEQ ID NO: 1919765 - protein, 5 aa, Staphylococcus
QEGTH

SEQ ID NO: 1919766 - protein, 6 aa, Staphylococcus
QEIAVK

SEQ ID NO: 1919767 - protein, 7 aa, Staphylococcus
QEKTNRR

SEQ ID NO: 1919768 - protein, 9 aa, Staphylococcus
QEKVESEGL

SEQ ID NO: 1919769 - protein, 5 aa, Staphylococcus
QELSE

SEQ ID NO: 1919770 - protein, 4 aa, Staphylococcus
QERR

SEQ ID NO: 1919771 - protein, 16 aa, Staphylococcus
QESEKAAEELEKEGYS

SEQ ID NO: 1919772 - protein, 8 aa, Staphylococcus
QETQPEDI

SEQ ID NO: 1919773 - protein, 10 aa, Staphylococcus
QEYEKQQEEI

SEQ ID NO: 1919774 - protein, 4 aa, Staphylococcus
QEYG

SEQ ID NO: 1919775 - protein, 5 aa, Staphylococcus
QFDTV

SEQ ID NO: 1919776 - protein, 9 aa, Staphylococcus
QFEDGTEVT

SEQ ID NO: 1919777 - protein, 26 aa, Staphylococcus
QFGEGTTHDYASASETIAERASAYNM

SEQ ID NO: 1919778 - protein, 8 aa, Staphylococcus
QFRSGDYT

SEQ ID NO: 1919779 - protein, 6 aa, Staphylococcus
QFSDDD

SEQ ID NO: 1919780 - protein, 10 aa, Staphylococcus
QFSTESAALK

SEQ ID NO: 1919781 - protein, 6 aa, Staphylococcus
QFTPGE

SEQ ID NO: 1919782 - protein, 14 aa, Staphylococcus
QGAKPGEGGQLPGT

SEQ ID NO: 1919783 - protein, 15 aa, Staphylococcus
QGAKPGEGGQLPGTK

SEQ ID NO: 1919784 - protein, 12 aa, Staphylococcus
QGEAGINVPPEG

SEQ ID NO: 1919785 - protein, 13 aa, Staphylococcus
QGEAGINVPPEGY

SEQ ID NO: 1919786 - protein, 6 aa, Staphylococcus
QGEEIA

SEQ ID NO: 1919787 - protein, 13 aa, Staphylococcus
QGEKIPRKGGQGM

SEQ ID NO: 1919788 - protein, 4 aa, Staphylococcus
QGEQ

SEQ ID NO: 1919789 - protein, 4 aa, Staphylococcus
QGFE

SEQ ID NO: 1919790 - protein, 4 aa, Staphylococcus
QGGH

SEQ ID NO: 1919791 - protein, 4 aa, Staphylococcus
QGGL

SEQ ID NO: 1919792 - protein, 9 aa, Staphylococcus
QGGMTNASK

SEQ ID NO: 1919793 - protein, 5 aa, Staphylococcus
QGIKP

SEQ ID NO: 1919794 - protein, 6 aa, Staphylococcus
QGKKEE

SEQ ID NO: 1919795 - protein, 5 aa, Staphylococcus
QGKPF

SEQ ID NO: 1919796 - protein, 4 aa, Staphylococcus
QGKY

SEQ ID NO: 1919797 - protein, 7 aa, Staphylococcus
QGLPNQP

SEQ ID NO: 1919798 - protein, 4 aa, Staphylococcus
QGNE

SEQ ID NO: 1919799 - protein, 7 aa, Staphylococcus
QGNISTD

SEQ ID NO: 1919800 - protein, 6 aa, Staphylococcus
QGNPSL

SEQ ID NO: 1919801 - protein, 9 aa, Staphylococcus
QGPSGIGKT

SEQ ID NO: 1919802 - protein, 6 aa, Staphylococcus
QGQSEF

SEQ ID NO: 1919803 - protein, 4 aa, Staphylococcus
QGQV

SEQ ID NO: 1919804 - protein, 4 aa, Staphylococcus
QGRF

SEQ ID NO: 1919805 - protein, 4 aa, Staphylococcus
QGSV

SEQ ID NO: 1919806 - protein, 6 aa, Staphylococcus
QGTNKD

SEQ ID NO: 1919807 - protein, 4 aa, Staphylococcus
QGTS

SEQ ID NO: 1919808 - protein, 8 aa, Staphylococcus
QGVSTEGA

SEQ ID NO: 1919809 - protein, 6 aa, Staphylococcus
QHAKDE

SEQ ID NO: 1919810 - protein, 5 aa, Staphylococcus
QHGTA

SEQ ID NO: 1919811 - protein, 11 aa, Staphylococcus
QHRDKNEDAGG

SEQ ID NO: 1919812 - protein, 11 aa, Staphylococcus
QHREKNEDAGG

SEQ ID NO: 1919813 - protein, 15 aa, Staphylococcus
QHRPKTTGRSKGGNF

SEQ ID NO: 1919814 - protein, 16 aa, Staphylococcus
QHRPKTTGRSKGGNYV

SEQ ID NO: 1919815 - protein, 5 aa, Staphylococcus
QHSEN

SEQ ID NO: 1919816 - protein, 7 aa, Staphylococcus
QIDDSKG

SEQ ID NO: 1919817 - protein, 15 aa, Staphylococcus
QIEETDSDFDREKLQ

SEQ ID NO: 1919818 - protein, 8 aa, Staphylococcus
QIEKGKDF

SEQ ID NO: 1919819 - protein, 5 aa, Staphylococcus
QIGPI

SEQ ID NO: 1919820 - protein, 4 aa, Staphylococcus
QIPD

SEQ ID NO: 1919821 - protein, 7 aa, Staphylococcus
QIRPGSN

SEQ ID NO: 1919822 - protein, 10 aa, Staphylococcus
QISRLGGPNF

SEQ ID NO: 1919823 - protein, 4 aa, Staphylococcus
QIVT

SEQ ID NO: 1919824 - protein, 5 aa, Staphylococcus
QKANA

SEQ ID NO: 1919825 - protein, 6 aa, Staphylococcus
QKATAF

SEQ ID NO: 1919826 - protein, 6 aa, Staphylococcus
QKDEDV

SEQ ID NO: 1919827 - protein, 9 aa, Staphylococcus
QKEKGDENF

SEQ ID NO: 1919828 - protein, 4 aa, Staphylococcus
QKES

SEQ ID NO: 1919829 - protein, 9 aa, Staphylococcus
QKESQAKKI

SEQ ID NO: 1919830 - protein, 9 aa, Staphylococcus
QKGYSGQQI

SEQ ID NO: 1919831 - protein, 9 aa, Staphylococcus
QKIMSTDNT

SEQ ID NO: 1919832 - protein, 4 aa, Staphylococcus
QKIN

SEQ ID NO: 1919833 - protein, 4 aa, Staphylococcus
QKKL

SEQ ID NO: 1919834 - protein, 5 aa, Staphylococcus
QKKQF

SEQ ID NO: 1919835 - protein, 9 aa, Staphylococcus
QKKSEGYLE

SEQ ID NO: 1919836 - protein, 8 aa, Staphylococcus
QKNDDNLG

SEQ ID NO: 1919837 - protein, 10 aa, Staphylococcus
QKNDKHQTSE

SEQ ID NO: 1919838 - protein, 9 aa, Staphylococcus
QKNGEGHRD

SEQ ID NO: 1919839 - protein, 6 aa, Staphylococcus
QKRDLS

SEQ ID NO: 1919840 - protein, 6 aa, Staphylococcus
QKRKDE

SEQ ID NO: 1919841 - protein, 6 aa, Staphylococcus
QKRNPE

SEQ ID NO: 1919842 - protein, 4 aa, Staphylococcus
QKRR

SEQ ID NO: 1919843 - protein, 5 aa, Staphylococcus
QKRYK

SEQ ID NO: 1919844 - protein, 9 aa, Staphylococcus
QKSKVPEDF

SEQ ID NO: 1919845 - protein, 5 aa, Staphylococcus
QKSMK

SEQ ID NO: 1919846 - protein, 4 aa, Staphylococcus
QKSN

SEQ ID NO: 1919847 - protein, 11 aa, Staphylococcus
QKSRDNSRTPM

SEQ ID NO: 1919848 - protein, 8 aa, Staphylococcus
QKTEVESK

SEQ ID NO: 1919849 - protein, 4 aa, Staphylococcus
QKTT

SEQ ID NO: 1919850 - protein, 4 aa, Staphylococcus
QKVA

SEQ ID NO: 1919851 - protein, 6 aa, Staphylococcus
QLDGKN

SEQ ID NO: 1919852 - protein, 11 aa, Staphylococcus
QLDQQNSNVNT

SEQ ID NO: 1919853 - protein, 4 aa, Staphylococcus
QLEP

SEQ ID NO: 1919854 - protein, 7 aa, Staphylococcus
QLETEKS

SEQ ID NO: 1919855 - protein, 13 aa, Staphylococcus
QLGPNEDDVELQK

SEQ ID NO: 1919856 - protein, 4 aa, Staphylococcus
QLNG

SEQ ID NO: 1919857 - protein, 4 aa, Staphylococcus
QLNN

SEQ ID NO: 1919858 - protein, 5 aa, Staphylococcus
QLPTR

SEQ ID NO: 1919859 - protein, 6 aa, Staphylococcus
QLPTRG

SEQ ID NO: 1919860 - protein, 5 aa, Staphylococcus
QLQSG

SEQ ID NO: 1919861 - protein, 7 aa, Staphylococcus
QLRKGSV

SEQ ID NO: 1919862 - protein, 5 aa, Staphylococcus
QLRRP

SEQ ID NO: 1919863 - protein, 7 aa, Staphylococcus
QLSPTNT

SEQ ID NO: 1919864 - protein, 4 aa, Staphylococcus
QLSS

SEQ ID NO: 1919865 - protein, 8 aa, Staphylococcus
QLTNGKEI

SEQ ID NO: 1919866 - protein, 6 aa, Staphylococcus
QLTPES

SEQ ID NO: 1919867 - protein, 4 aa, Staphylococcus
QMAE

SEQ ID NO: 1919868 - protein, 8 aa, Staphylococcus
QMEETSVN

SEQ ID NO: 1919869 - protein, 6 aa, Staphylococcus
QMNRVG

SEQ ID NO: 1919870 - protein, 10 aa, Staphylococcus
QMPTEDEQFE

SEQ ID NO: 1919871 - protein, 9 aa, Staphylococcus
QMPTEEEQF

SEQ ID NO: 1919872 - protein, 14 aa, Staphylococcus
QMTQPVKKGMKEKG

SEQ ID NO: 1919873 - protein, 9 aa, Staphylococcus
QNDAVTSIS

SEQ ID NO: 1919874 - protein, 5 aa, Staphylococcus
QNDPA

SEQ ID NO: 1919875 - protein, 10 aa, Staphylococcus
QNDYGASSIS

SEQ ID NO: 1919876 - protein, 7 aa, Staphylococcus
QNEAAEI

SEQ ID NO: 1919877 - protein, 9 aa, Staphylococcus
QNEGVNDGD

SEQ ID NO: 1919878 - protein, 9 aa, Staphylococcus
QNEKGDENF

SEQ ID NO: 1919879 - protein, 14 aa, Staphylococcus
QNEPLGKGKDGEDV

SEQ ID NO: 1919880 - protein, 5 aa, Staphylococcus
QNEQA

SEQ ID NO: 1919881 - protein, 15 aa, Staphylococcus
QNGDQIGVKSKREAL

SEQ ID NO: 1919882 - protein, 4 aa, Staphylococcus
QNGK

SEQ ID NO: 1919883 - protein, 7 aa, Staphylococcus
QNINNSH

SEQ ID NO: 1919884 - protein, 5 aa, Staphylococcus
QNKDY

SEQ ID NO: 1919885 - protein, 10 aa, Staphylococcus
QNKGKDTGAY

SEQ ID NO: 1919886 - protein, 4 aa, Staphylococcus
QNKI

SEQ ID NO: 1919887 - protein, 8 aa, Staphylococcus
QNKKSPYD

SEQ ID NO: 1919888 - protein, 6 aa, Staphylococcus
QNTKGV

SEQ ID NO: 1919889 - protein, 10 aa, Staphylococcus
QNVTEGPSVT

SEQ ID NO: 1919890 - protein, 6 aa, Staphylococcus
QPEHRP

SEQ ID NO: 1919891 - protein, 5 aa, Staphylococcus
QPETL

SEQ ID NO: 1919892 - protein, 6 aa, Staphylococcus
QPGDEV

SEQ ID NO: 1919893 - protein, 9 aa, Staphylococcus
QPGQKAEDI

SEQ ID NO: 1919894 - protein, 7 aa, Staphylococcus
QPIGENG

SEQ ID NO: 1919895 - protein, 4 aa, Staphylococcus
QPIY

SEQ ID NO: 1919896 - protein, 13 aa, Staphylococcus
QPKENLAEVLDKH

SEQ ID NO: 1919897 - protein, 6 aa, Staphylococcus
QPLEDK

SEQ ID NO: 1919898 - protein, 7 aa, Staphylococcus
QPLSDEA

SEQ ID NO: 1919899 - protein, 6 aa, Staphylococcus
QPLSRS

SEQ ID NO: 1919900 - protein, 7 aa, Staphylococcus
QPQTSIS

SEQ ID NO: 1919901 - protein, 5 aa, Staphylococcus
QPREV

SEQ ID NO: 1919902 - protein, 6 aa, Staphylococcus
QPTLSR

SEQ ID NO: 1919903 - protein, 5 aa, Staphylococcus
QPTND

SEQ ID NO: 1919904 - protein, 8 aa, Staphylococcus
QPVSLQPS

SEQ ID NO: 1919905 - protein, 4 aa, Staphylococcus
QQDA

SEQ ID NO: 1919906 - protein, 13 aa, Staphylococcus
QQDDVSKAHGTAL

SEQ ID NO: 1919907 - protein, 4 aa, Staphylococcus
QQDG

SEQ ID NO: 1919908 - protein, 4 aa, Staphylococcus
QQEA

SEQ ID NO: 1919909 - protein, 8 aa, Staphylococcus
QQESGGIS

SEQ ID NO: 1919910 - protein, 11 aa, Staphylococcus
QQGLGRTGTWS

SEQ ID NO: 1919911 - protein, 6 aa, Staphylococcus
QQHGHE

SEQ ID NO: 1919912 - protein, 6 aa, Staphylococcus
QQIDGT

SEQ ID NO: 1919913 - protein, 4 aa, Staphylococcus
QQKF

SEQ ID NO: 1919914 - protein, 6 aa, Staphylococcus
QQKKGY

SEQ ID NO: 1919915 - protein, 4 aa, Staphylococcus
QQKV

SEQ ID NO: 1919916 - protein, 4 aa, Staphylococcus
QQLS

SEQ ID NO: 1919917 - protein, 6 aa, Staphylococcus
QQNQNY

SEQ ID NO: 1919918 - protein, 5 aa, Staphylococcus
QQPEE

SEQ ID NO: 1919919 - protein, 4 aa, Staphylococcus
QQQG

SEQ ID NO: 1919920 - protein, 4 aa, Staphylococcus
QQQL

SEQ ID NO: 1919921 - protein, 4 aa, Staphylococcus
QQQP

SEQ ID NO: 1919922 - protein, 6 aa, Staphylococcus
QQQQEL

SEQ ID NO: 1919923 - protein, 6 aa, Staphylococcus
QQREPE

SEQ ID NO: 1919924 - protein, 10 aa, Staphylococcus
QQRQESKNVT

SEQ ID NO: 1919925 - protein, 8 aa, Staphylococcus
QQVGSPEE

SEQ ID NO: 1919926 - protein, 6 aa, Staphylococcus
QQYVEG

SEQ ID NO: 1919927 - protein, 12 aa, Staphylococcus
QRADGEKDSRTE

SEQ ID NO: 1919928 - protein, 25 aa, Staphylococcus
QRDGTPAAKMKDNVPTEVKKERLQR

SEQ ID NO: 1919929 - protein, 6 aa, Staphylococcus
QRELEE

SEQ ID NO: 1919930 - protein, 7 aa, Staphylococcus
QRELEEE

SEQ ID NO: 1919931 - protein, 17 aa, Staphylococcus
QRGGPSTGLPTKQEQSD

SEQ ID NO: 1919932 - protein, 7 aa, Staphylococcus
QRHNTEI

SEQ ID NO: 1919933 - protein, 13 aa, Staphylococcus
QRIKSAGPSTPVE

SEQ ID NO: 1919934 - protein, 13 aa, Staphylococcus
QRIKTAGPSTPVE

SEQ ID NO: 1919935 - protein, 11 aa, Staphylococcus
QRKKLSKRDGQ

SEQ ID NO: 1919936 - protein, 6 aa, Staphylococcus
QRLSEQ

SEQ ID NO: 1919937 - protein, 8 aa, Staphylococcus
QRMTQGQS

SEQ ID NO: 1919938 - protein, 10 aa, Staphylococcus
QRNNFKPGQE

SEQ ID NO: 1919939 - protein, 9 aa, Staphylococcus
QRQLSRNEA

SEQ ID NO: 1919940 - protein, 11 aa, Staphylococcus
QRRSGKSDKND

SEQ ID NO: 1919941 - protein, 12 aa, Staphylococcus
QRTDLREAKETL

SEQ ID NO: 1919942 - protein, 4 aa, Staphylococcus
QRTV

SEQ ID NO: 1919943 - protein, 27 aa, Staphylococcus
QSAEKIVETAKRSGAEVSGPIPLPTEK

SEQ ID NO: 1919944 - protein, 6 aa, Staphylococcus
QSAETL

SEQ ID NO: 1919945 - protein, 5 aa, Staphylococcus
QSAGS

SEQ ID NO: 1919946 - protein, 8 aa, Staphylococcus
QSDTHPLA

SEQ ID NO: 1919947 - protein, 4 aa, Staphylococcus
QSEE

SEQ ID NO: 1919948 - protein, 9 aa, Staphylococcus
QSEGSDPAA

SEQ ID NO: 1919949 - protein, 8 aa, Staphylococcus
QSEHSYPI

SEQ ID NO: 1919950 - protein, 5 aa, Staphylococcus
QSEQP

SEQ ID NO: 1919951 - protein, 5 aa, Staphylococcus
QSERF

SEQ ID NO: 1919952 - protein, 6 aa, Staphylococcus
QSERFD

SEQ ID NO: 1919953 - protein, 17 aa, Staphylococcus
QSFEKGKNQNHLTDDDV

SEQ ID NO: 1919954 - protein, 16 aa, Staphylococcus
QSFEKGKNQNHLTDED

SEQ ID NO: 1919955 - protein, 4 aa, Staphylococcus
QSGI

SEQ ID NO: 1919956 - protein, 5 aa, Staphylococcus
QSGIE

SEQ ID NO: 1919957 - protein, 10 aa, Staphylococcus
QSGNLTPADK

SEQ ID NO: 1919958 - protein, 5 aa, Staphylococcus
QSGPT

SEQ ID NO: 1919959 - protein, 10 aa, Staphylococcus
QSGVEPQTET

SEQ ID NO: 1919960 - protein, 6 aa, Staphylococcus
QSILDN

SEQ ID NO: 1919961 - protein, 4 aa, Staphylococcus
QSIP

SEQ ID NO: 1919962 - protein, 5 aa, Staphylococcus
QSIPV

SEQ ID NO: 1919963 - protein, 9 aa, Staphylococcus
QSKDEIGDT

SEQ ID NO: 1919964 - protein, 4 aa, Staphylococcus
QSKS

SEQ ID NO: 1919965 - protein, 6 aa, Staphylococcus
QSLDEE

SEQ ID NO: 1919966 - protein, 5 aa, Staphylococcus
QSLPN

SEQ ID NO: 1919967 - protein, 4 aa, Staphylococcus
QSPY

SEQ ID NO: 1919968 - protein, 4 aa, Staphylococcus
QSRK

SEQ ID NO: 1919969 - protein, 7 aa, Staphylococcus
QSSTARA

SEQ ID NO: 1919970 - protein, 5 aa, Staphylococcus
QSTYV

SEQ ID NO: 1919971 - protein, 18 aa, Staphylococcus
QSVGEKDVVTTSRFPGTT

SEQ ID NO: 1919972 - protein, 6 aa, Staphylococcus
QSYRPT

SEQ ID NO: 1919973 - protein, 8 aa, Staphylococcus
QTDEQGIE

SEQ ID NO: 1919974 - protein, 10 aa, Staphylococcus
QTDVPESSDW

SEQ ID NO: 1919975 - protein, 4 aa, Staphylococcus
QTEA

SEQ ID NO: 1919976 - protein, 7 aa, Staphylococcus
QTEETLN

SEQ ID NO: 1919977 - protein, 5 aa, Staphylococcus
QTEPY

SEQ ID NO: 1919978 - protein, 4 aa, Staphylococcus
QTEQ

SEQ ID NO: 1919979 - protein, 7 aa, Staphylococcus
QTGAQNK

SEQ ID NO: 1919980 - protein, 5 aa, Staphylococcus
QTGGL

SEQ ID NO: 1919981 - protein, 6 aa, Staphylococcus
QTGGLH

SEQ ID NO: 1919982 - protein, 10 aa, Staphylococcus
QTGNLTPADK

SEQ ID NO: 1919983 - protein, 9 aa, Staphylococcus
QTKDPDPLP

SEQ ID NO: 1919984 - protein, 6 aa, Staphylococcus
QTLRDE

SEQ ID NO: 1919985 - protein, 13 aa, Staphylococcus
QTLSPKEVNPSDY

SEQ ID NO: 1919986 - protein, 6 aa, Staphylococcus
QTNHTE

SEQ ID NO: 1919987 - protein, 5 aa, Staphylococcus
QTPEQ

SEQ ID NO: 1919988 - protein, 10 aa, Staphylococcus
QTPLKNRDQS

SEQ ID NO: 1919989 - protein, 6 aa, Staphylococcus
QTQPLG

SEQ ID NO: 1919990 - protein, 6 aa, Staphylococcus
QTQSLS

SEQ ID NO: 1919991 - protein, 5 aa, Staphylococcus
QTQVT

SEQ ID NO: 1919992 - protein, 6 aa, Staphylococcus
QTQVTE

SEQ ID NO: 1919993 - protein, 9 aa, Staphylococcus
QTRQKTGLK

SEQ ID NO: 1919994 - protein, 5 aa, Staphylococcus
QTTRS

SEQ ID NO: 1919995 - protein, 14 aa, Staphylococcus
QTVANNFETIIMKN

SEQ ID NO: 1919996 - protein, 8 aa, Staphylococcus
QVASGRFG

SEQ ID NO: 1919997 - protein, 8 aa, Staphylococcus
QVDGNDPI

SEQ ID NO: 1919998 - protein, 14 aa, Staphylococcus
QVELQDTKLTPENL

SEQ ID NO: 1919999 - protein, 9 aa, Staphylococcus
QVENSDGEA

SEQ ID NO: 1920000 - protein, 15 aa, Staphylococcus
QVGQTVESGAEADIK

SEQ ID NO: 1920001 - protein, 9 aa, Staphylococcus
QVGTGTQRV

SEQ ID NO: 1920002 - protein, 5 aa, Staphylococcus
QVINP

SEQ ID NO: 1920003 - protein, 6 aa, Staphylococcus
QVNEDD

SEQ ID NO: 1920004 - protein, 6 aa, Staphylococcus
QVNEDE

SEQ ID NO: 1920005 - protein, 4 aa, Staphylococcus
QVNR

SEQ ID NO: 1920006 - protein, 8 aa, Staphylococcus
QVPSSPSY

SEQ ID NO: 1920007 - protein, 8 aa, Staphylococcus
QVQPKDRG

SEQ ID NO: 1920008 - protein, 7 aa, Staphylococcus
QVSGNEP

SEQ ID NO: 1920009 - protein, 4 aa, Staphylococcus
QVST

SEQ ID NO: 1920010 - protein, 12 aa, Staphylococcus
QVTDKPEKPSMS

SEQ ID NO: 1920011 - protein, 7 aa, Staphylococcus
QVTPGDT

SEQ ID NO: 1920012 - protein, 19 aa, Staphylococcus
QVTRTQKQVKRKPSENQLK

SEQ ID NO: 1920013 - protein, 4 aa, Staphylococcus
QWRM

SEQ ID NO: 1920014 - protein, 4 aa, Staphylococcus
QWTD

SEQ ID NO: 1920015 - protein, 8 aa, Staphylococcus
QYEKPDVD

SEQ ID NO: 1920016 - protein, 9 aa, Staphylococcus
QYGKETNGY

SEQ ID NO: 1920017 - protein, 4 aa, Staphylococcus
QYGN

SEQ ID NO: 1920018 - protein, 15 aa, Staphylococcus
QYKDKAQKRTDGIPA

SEQ ID NO: 1920019 - protein, 4 aa, Staphylococcus
QYNQ

SEQ ID NO: 1920020 - protein, 10 aa, Staphylococcus
QYPGAPGLGG

SEQ ID NO: 1920021 - protein, 5 aa, Staphylococcus
QYTNG

SEQ ID NO: 1920022 - protein, 4 aa, Staphylococcus
RAAE

SEQ ID NO: 1920023 - protein, 9 aa, Staphylococcus
RAARNDKGE

SEQ ID NO: 1920024 - protein, 9 aa, Staphylococcus
RAARNDRGE

SEQ ID NO: 1920025 - protein, 9 aa, Staphylococcus
RAEERNDDL

SEQ ID NO: 1920026 - protein, 5 aa, Staphylococcus
RAEGI

SEQ ID NO: 1920027 - protein, 11 aa, Staphylococcus
RAGASYDDIED

SEQ ID NO: 1920028 - protein, 8 aa, Staphylococcus
RAGKSSVI

SEQ ID NO: 1920029 - protein, 4 aa, Staphylococcus
RAHN

SEQ ID NO: 1920030 - protein, 12 aa, Staphylococcus
RAHSETDIADNA

SEQ ID NO: 1920031 - protein, 5 aa, Staphylococcus
RAKDV

SEQ ID NO: 1920032 - protein, 9 aa, Staphylococcus
RAKNDEKYI

SEQ ID NO: 1920033 - protein, 5 aa, Staphylococcus
RAKTM

SEQ ID NO: 1920034 - protein, 11 aa, Staphylococcus
RALEAARNEKV

SEQ ID NO: 1920035 - protein, 17 aa, Staphylococcus
RAPGSVGMASDASRVFK

SEQ ID NO: 1920036 - protein, 6 aa, Staphylococcus
RAQDKN

SEQ ID NO: 1920037 - protein, 5 aa, Staphylococcus
RAQSF

SEQ ID NO: 1920038 - protein, 9 aa, Staphylococcus
RAQSPTRAH

SEQ ID NO: 1920039 - protein, 13 aa, Staphylococcus
RARGEAIKGIKGV

SEQ ID NO: 1920040 - protein, 4 aa, Staphylococcus
RARL

SEQ ID NO: 1920041 - protein, 6 aa, Staphylococcus
RASAAN

SEQ ID NO: 1920042 - protein, 13 aa, Staphylococcus
RASGSLSGGEAQR

SEQ ID NO: 1920043 - protein, 13 aa, Staphylococcus
RASGTLSGGEAQR

SEQ ID NO: 1920044 - protein, 9 aa, Staphylococcus
RATETNNNG

SEQ ID NO: 1920045 - protein, 10 aa, Staphylococcus
RATRSALNSV

SEQ ID NO: 1920046 - protein, 7 aa, Staphylococcus
RATSRKE

SEQ ID NO: 1920047 - protein, 5 aa, Staphylococcus
RATYD

SEQ ID NO: 1920048 - protein, 5 aa, Staphylococcus
RDDSY

SEQ ID NO: 1920049 - protein, 7 aa, Staphylococcus
RDEAAEL

SEQ ID NO: 1920050 - protein, 8 aa, Staphylococcus
RDEAGELI

SEQ ID NO: 1920051 - protein, 4 aa, Staphylococcus
RDEI

SEQ ID NO: 1920052 - protein, 12 aa, Staphylococcus
RDGLGHGKGGSM

SEQ ID NO: 1920053 - protein, 9 aa, Staphylococcus
RDGLTDEQI

SEQ ID NO: 1920054 - protein, 12 aa, Staphylococcus
RDGRARVSVGAR

SEQ ID NO: 1920055 - protein, 13 aa, Staphylococcus
RDGRARVSVGARS

SEQ ID NO: 1920056 - protein, 6 aa, Staphylococcus
RDHEDI

SEQ ID NO: 1920057 - protein, 6 aa, Staphylococcus
RDIEPG

SEQ ID NO: 1920058 - protein, 16 aa, Staphylococcus
RDIPNVSENALKNLDD

SEQ ID NO: 1920059 - protein, 5 aa, Staphylococcus
RDKDI

SEQ ID NO: 1920060 - protein, 7 aa, Staphylococcus
RDKDKVT

SEQ ID NO: 1920061 - protein, 8 aa, Staphylococcus
RDKDKVTD

SEQ ID NO: 1920062 - protein, 10 aa, Staphylococcus
RDKQVKGGQD

SEQ ID NO: 1920063 - protein, 6 aa, Staphylococcus
RDLTQL

SEQ ID NO: 1920064 - protein, 10 aa, Staphylococcus
RDPQASVGRG

SEQ ID NO: 1920065 - protein, 8 aa, Staphylococcus
RDTASSHA

SEQ ID NO: 1920066 - protein, 5 aa, Staphylococcus
RDTLD

SEQ ID NO: 1920067 - protein, 8 aa, Staphylococcus
RDYGTGNM

SEQ ID NO: 1920068 - protein, 9 aa, Staphylococcus
REAEDPFTC

SEQ ID NO: 1920069 - protein, 7 aa, Staphylococcus
REAEVGQ

SEQ ID NO: 1920070 - protein, 8 aa, Staphylococcus
REAGFEPS

SEQ ID NO: 1920071 - protein, 17 aa, Staphylococcus
REAGTVKGKKSGKFATS

SEQ ID NO: 1920072 - protein, 6 aa, Staphylococcus
REATQD

SEQ ID NO: 1920073 - protein, 10 aa, Staphylococcus
REDGSEFDKD

SEQ ID NO: 1920074 - protein, 4 aa, Staphylococcus
REDR

SEQ ID NO: 1920075 - protein, 22 aa, Staphylococcus
REEAYDKVQPKAMESWETKTPF

SEQ ID NO: 1920076 - protein, 5 aa, Staphylococcus
REEEI

SEQ ID NO: 1920077 - protein, 4 aa, Staphylococcus
REGY

SEQ ID NO: 1920078 - protein, 4 aa, Staphylococcus
REKD

SEQ ID NO: 1920079 - protein, 9 aa, Staphylococcus
REKEDERNL

SEQ ID NO: 1920080 - protein, 12 aa, Staphylococcus
REKYSDLNVSYI

SEQ ID NO: 1920081 - protein, 6 aa, Staphylococcus
RENASS

SEQ ID NO: 1920082 - protein, 5 aa, Staphylococcus
RENIG

SEQ ID NO: 1920083 - protein, 4 aa, Staphylococcus
RENN

SEQ ID NO: 1920084 - protein, 7 aa, Staphylococcus
RENPTIK

SEQ ID NO: 1920085 - protein, 7 aa, Staphylococcus
RENTGDL

SEQ ID NO: 1920086 - protein, 5 aa, Staphylococcus
REPNF

SEQ ID NO: 1920087 - protein, 4 aa, Staphylococcus
REQV

SEQ ID NO: 1920088 - protein, 6 aa, Staphylococcus
REQVGD

SEQ ID NO: 1920089 - protein, 5 aa, Staphylococcus
RERIE

SEQ ID NO: 1920090 - protein, 8 aa, Staphylococcus
RESETDKV

SEQ ID NO: 1920091 - protein, 8 aa, Staphylococcus
RESYGDDY

SEQ ID NO: 1920092 - protein, 14 aa, Staphylococcus
RETSPFPRLLNRLY

SEQ ID NO: 1920093 - protein, 13 aa, Staphylococcus
RETTSLSGGESQR

SEQ ID NO: 1920094 - protein, 5 aa, Staphylococcus
REVDT

SEQ ID NO: 1920095 - protein, 4 aa, Staphylococcus
RFES

SEQ ID NO: 1920096 - protein, 5 aa, Staphylococcus
RFESA

SEQ ID NO: 1920097 - protein, 7 aa, Staphylococcus
RFKDSGE

SEQ ID NO: 1920098 - protein, 8 aa, Staphylococcus
RFNETKVS

SEQ ID NO: 1920099 - protein, 13 aa, Staphylococcus
RFRSGGSKTAPVT

SEQ ID NO: 1920100 - protein, 5 aa, Staphylococcus
RFSDG

SEQ ID NO: 1920101 - protein, 5 aa, Staphylococcus
RGASE

SEQ ID NO: 1920102 - protein, 6 aa, Staphylococcus
RGDTTG

SEQ ID NO: 1920103 - protein, 11 aa, Staphylococcus
RGDVKNTYGTG

SEQ ID NO: 1920104 - protein, 4 aa, Staphylococcus
RGEF

SEQ ID NO: 1920105 - protein, 5 aa, Staphylococcus
RGEHI

SEQ ID NO: 1920106 - protein, 6 aa, Staphylococcus
RGEKEK

SEQ ID NO: 1920107 - protein, 6 aa, Staphylococcus
RGESYE

SEQ ID NO: 1920108 - protein, 16 aa, Staphylococcus
RGGNHVTSQNPEANYE

SEQ ID NO: 1920109 - protein, 15 aa, Staphylococcus
RGGVGADGITGDGAG

SEQ ID NO: 1920110 - protein, 4 aa, Staphylococcus
RGHD

SEQ ID NO: 1920111 - protein, 5 aa, Staphylococcus
RGHDS

SEQ ID NO: 1920112 - protein, 5 aa, Staphylococcus
RGIPK

SEQ ID NO: 1920113 - protein, 15 aa, Staphylococcus
RGKDFGEENIVGPND

SEQ ID NO: 1920114 - protein, 11 aa, Staphylococcus
RGKERSRRPQD

SEQ ID NO: 1920115 - protein, 5 aa, Staphylococcus
RGKGL

SEQ ID NO: 1920116 - protein, 7 aa, Staphylococcus
RGKSVAN

SEQ ID NO: 1920117 - protein, 7 aa, Staphylococcus
RGNMDAN

SEQ ID NO: 1920118 - protein, 5 aa, Staphylococcus
RGPIV

SEQ ID NO: 1920119 - protein, 6 aa, Staphylococcus
RGRKQM

SEQ ID NO: 1920120 - protein, 25 aa, Staphylococcus
RGRNAKSYTKAKNTDVQTYRKSSAL

SEQ ID NO: 1920121 - protein, 4 aa, Staphylococcus
RGSK

SEQ ID NO: 1920122 - protein, 7 aa, Staphylococcus
RGSTPGI

SEQ ID NO: 1920123 - protein, 6 aa, Staphylococcus
RGTEKE

SEQ ID NO: 1920124 - protein, 6 aa, Staphylococcus
RGTTAS

SEQ ID NO: 1920125 - protein, 9 aa, Staphylococcus
RGTTEADAS

SEQ ID NO: 1920126 - protein, 15 aa, Staphylococcus
RGVAPRNHSFPTPEV

SEQ ID NO: 1920127 - protein, 21 aa, Staphylococcus
RGYQLSKTEYRGREATDFKEE

SEQ ID NO: 1920128 - protein, 7 aa, Staphylococcus
RGYTSYT

SEQ ID NO: 1920129 - protein, 5 aa, Staphylococcus
RHANR

SEQ ID NO: 1920130 - protein, 12 aa, Staphylococcus
RHQSQDSSSPIL

SEQ ID NO: 1920131 - protein, 21 aa, Staphylococcus
RIANKQYDNSEAYSKLKTGLK

SEQ ID NO: 1920132 - protein, 6 aa, Staphylococcus
RIGAAT

SEQ ID NO: 1920133 - protein, 12 aa, Staphylococcus
RIKETEETLTTE

SEQ ID NO: 1920134 - protein, 4 aa, Staphylococcus
RINN

SEQ ID NO: 1920135 - protein, 5 aa, Staphylococcus
RINNE

SEQ ID NO: 1920136 - protein, 7 aa, Staphylococcus
RIQPGDT

SEQ ID NO: 1920137 - protein, 7 aa, Staphylococcus
RITGGEP

SEQ ID NO: 1920138 - protein, 6 aa, Staphylococcus
RITPQR

SEQ ID NO: 1920139 - protein, 8 aa, Staphylococcus
RKAPKLEG

SEQ ID NO: 1920140 - protein, 6 aa, Staphylococcus
RKAQVG

SEQ ID NO: 1920141 - protein, 10 aa, Staphylococcus
RKDETHKGDY

SEQ ID NO: 1920142 - protein, 6 aa, Staphylococcus
RKETIA

SEQ ID NO: 1920143 - protein, 20 aa, Staphylococcus
RKGIPFEPKELDNTEEEAAK

SEQ ID NO: 1920144 - protein, 11 aa, Staphylococcus
RKGKSPLNPTN

SEQ ID NO: 1920145 - protein, 6 aa, Staphylococcus
RKHSEQ

SEQ ID NO: 1920146 - protein, 8 aa, Staphylococcus
RKKESDLP

SEQ ID NO: 1920147 - protein, 15 aa, Staphylococcus
RKKRIAKGSGRSLQE

SEQ ID NO: 1920148 - protein, 15 aa, Staphylococcus
RKLDDGQRRLKAQKE

SEQ ID NO: 1920149 - protein, 10 aa, Staphylococcus
RKLENGDEVE

SEQ ID NO: 1920150 - protein, 8 aa, Staphylococcus
RKNKDDLD

SEQ ID NO: 1920151 - protein, 7 aa, Staphylococcus
RKPAEKP

SEQ ID NO: 1920152 - protein, 6 aa, Staphylococcus
RKPDHS

SEQ ID NO: 1920153 - protein, 14 aa, Staphylococcus
RKPKALSGGQRQRV

SEQ ID NO: 1920154 - protein, 12 aa, Staphylococcus
RKPQGANIGEQR

SEQ ID NO: 1920155 - protein, 4 aa, Staphylococcus
RKPS

SEQ ID NO: 1920156 - protein, 5 aa, Staphylococcus
RKYDP

SEQ ID NO: 1920157 - protein, 6 aa, Staphylococcus
RKYGKD

SEQ ID NO: 1920158 - protein, 7 aa, Staphylococcus
RKYGKDI

SEQ ID NO: 1920159 - protein, 7 aa, Staphylococcus
RKYGKDV

SEQ ID NO: 1920160 - protein, 13 aa, Staphylococcus
RKYGSQDQETLEK

SEQ ID NO: 1920161 - protein, 6 aa, Staphylococcus
RKYPEY

SEQ ID NO: 1920162 - protein, 4 aa, Staphylococcus
RLAG

SEQ ID NO: 1920163 - protein, 7 aa, Staphylococcus
RLARNTS

SEQ ID NO: 1920164 - protein, 6 aa, Staphylococcus
RLEEEG

SEQ ID NO: 1920165 - protein, 5 aa, Staphylococcus
RLKDK

SEQ ID NO: 1920166 - protein, 8 aa, Staphylococcus
RLKEQGAN

SEQ ID NO: 1920167 - protein, 8 aa, Staphylococcus
RLKSDPSF

SEQ ID NO: 1920168 - protein, 5 aa, Staphylococcus
RLKSE

SEQ ID NO: 1920169 - protein, 4 aa, Staphylococcus
RLQR

SEQ ID NO: 1920170 - protein, 9 aa, Staphylococcus
RLSEDKDKN

SEQ ID NO: 1920171 - protein, 11 aa, Staphylococcus
RLSPKVKGQLK

SEQ ID NO: 1920172 - protein, 11 aa, Staphylococcus
RLTCGKPGQDI

SEQ ID NO: 1920173 - protein, 10 aa, Staphylococcus
RLTDNGRDKG

SEQ ID NO: 1920174 - protein, 7 aa, Staphylococcus
RLTGRLS

SEQ ID NO: 1920175 - protein, 12 aa, Staphylococcus
RMEEKKIPEDLD

SEQ ID NO: 1920176 - protein, 10 aa, Staphylococcus
RNAAGASNAI

SEQ ID NO: 1920177 - protein, 5 aa, Staphylococcus
RNAIQ

SEQ ID NO: 1920178 - protein, 4 aa, Staphylococcus
RNEQ

SEQ ID NO: 1920179 - protein, 8 aa, Staphylococcus
RNGAGKST

SEQ ID NO: 1920180 - protein, 9 aa, Staphylococcus
RNGKRDLDN

SEQ ID NO: 1920181 - protein, 10 aa, Staphylococcus
RNGKRTAKAA

SEQ ID NO: 1920182 - protein, 9 aa, Staphylococcus
RNKDGINAK

SEQ ID NO: 1920183 - protein, 12 aa, Staphylococcus
RNNAEKQLGADK

SEQ ID NO: 1920184 - protein, 5 aa, Staphylococcus
RNPAN

SEQ ID NO: 1920185 - protein, 8 aa, Staphylococcus
RNPVTGEN

SEQ ID NO: 1920186 - protein, 8 aa, Staphylococcus
RNQGPFND

SEQ ID NO: 1920187 - protein, 4 aa, Staphylococcus
RPAR

SEQ ID NO: 1920188 - protein, 15 aa, Staphylococcus
RPDEKRVTERAYENP

SEQ ID NO: 1920189 - protein, 6 aa, Staphylococcus
RPDGKV

SEQ ID NO: 1920190 - protein, 11 aa, Staphylococcus
RPDPDAYGSQL

SEQ ID NO: 1920191 - protein, 5 aa, Staphylococcus
RPDTP

SEQ ID NO: 1920192 - protein, 5 aa, Staphylococcus
RPELT

SEQ ID NO: 1920193 - protein, 8 aa, Staphylococcus
RPEMPNTN

SEQ ID NO: 1920194 - protein, 6 aa, Staphylococcus
RPGKEL

SEQ ID NO: 1920195 - protein, 6 aa, Staphylococcus
RPGSIT

SEQ ID NO: 1920196 - protein, 5 aa, Staphylococcus
RPGSV

SEQ ID NO: 1920197 - protein, 6 aa, Staphylococcus
RPIPTK

SEQ ID NO: 1920198 - protein, 11 aa, Staphylococcus
RPLGRTAAGVK

SEQ ID NO: 1920199 - protein, 5 aa, Staphylococcus
RPLKT

SEQ ID NO: 1920200 - protein, 4 aa, Staphylococcus
RPNV

SEQ ID NO: 1920201 - protein, 7 aa, Staphylococcus
RPQSVYD

SEQ ID NO: 1920202 - protein, 15 aa, Staphylococcus
RPTFNPETGKDFGKK

SEQ ID NO: 1920203 - protein, 15 aa, Staphylococcus
RPYGQEEFGTKTELK

SEQ ID NO: 1920204 - protein, 6 aa, Staphylococcus
RQEQST

SEQ ID NO: 1920205 - protein, 14 aa, Staphylococcus
RQINGLSKNEMSEL

SEQ ID NO: 1920206 - protein, 14 aa, Staphylococcus
RQINGLSKNEMTEL

SEQ ID NO: 1920207 - protein, 8 aa, Staphylococcus
RQNDTEYI

SEQ ID NO: 1920208 - protein, 8 aa, Staphylococcus
RQNKGDVT

SEQ ID NO: 1920209 - protein, 5 aa, Staphylococcus
RQNLE

SEQ ID NO: 1920210 - protein, 6 aa, Staphylococcus
RQPQKD

SEQ ID NO: 1920211 - protein, 6 aa, Staphylococcus
RQPQKN

SEQ ID NO: 1920212 - protein, 11 aa, Staphylococcus
RQPQVGETIND

SEQ ID NO: 1920213 - protein, 4 aa, Staphylococcus
RQSM

SEQ ID NO: 1920214 - protein, 4 aa, Staphylococcus
RQSR

SEQ ID NO: 1920215 - protein, 5 aa, Staphylococcus
RQSRV

SEQ ID NO: 1920216 - protein, 9 aa, Staphylococcus
RQTGESEEV

SEQ ID NO: 1920217 - protein, 6 aa, Staphylococcus
RQTQGI

SEQ ID NO: 1920218 - protein, 13 aa, Staphylococcus
RQTTENAERLFKL

SEQ ID NO: 1920219 - protein, 13 aa, Staphylococcus
RQTTENAERLFNL

SEQ ID NO: 1920220 - protein, 6 aa, Staphylococcus
RRAQEL

SEQ ID NO: 1920221 - protein, 4 aa, Staphylococcus
RRGE

SEQ ID NO: 1920222 - protein, 5 aa, Staphylococcus
RRGTT

SEQ ID NO: 1920223 - protein, 13 aa, Staphylococcus
RRKSYGSTGQDAV

SEQ ID NO: 1920224 - protein, 16 aa, Staphylococcus
RRPDVYKRTKPEKQTV

SEQ ID NO: 1920225 - protein, 5 aa, Staphylococcus
RRTEY

SEQ ID NO: 1920226 - protein, 14 aa, Staphylococcus
RRTEYNLKKAKDRA

SEQ ID NO: 1920227 - protein, 15 aa, Staphylococcus
RSASAYGKKTRSVKS

SEQ ID NO: 1920228 - protein, 4 aa, Staphylococcus
RSDK

SEQ ID NO: 1920229 - protein, 5 aa, Staphylococcus
RSDSQ

SEQ ID NO: 1920230 - protein, 8 aa, Staphylococcus
RSEGFGDE

SEQ ID NO: 1920231 - protein, 5 aa, Staphylococcus
RSFND

SEQ ID NO: 1920232 - protein, 11 aa, Staphylococcus
RSFQGGEDKPL

SEQ ID NO: 1920233 - protein, 10 aa, Staphylococcus
RSGASGSPML

SEQ ID NO: 1920234 - protein, 4 aa, Staphylococcus
RSGE

SEQ ID NO: 1920235 - protein, 8 aa, Staphylococcus
RSGSGKTT

SEQ ID NO: 1920236 - protein, 10 aa, Staphylococcus
RSGSSACHSN

SEQ ID NO: 1920237 - protein, 14 aa, Staphylococcus
RSKEEREKLKQPRS

SEQ ID NO: 1920238 - protein, 26 aa, Staphylococcus
RSSAGRIAARARGRYGGRPEKLNQKD

SEQ ID NO: 1920239 - protein, 11 aa, Staphylococcus
RSVSKSGTIQE

SEQ ID NO: 1920240 - protein, 12 aa, Staphylococcus
RSVSKSGTIQEV

SEQ ID NO: 1920241 - protein, 8 aa, Staphylococcus
RTDHFGDD

SEQ ID NO: 1920242 - protein, 6 aa, Staphylococcus
RTEEQT

SEQ ID NO: 1920243 - protein, 5 aa, Staphylococcus
RTEYN

SEQ ID NO: 1920244 - protein, 11 aa, Staphylococcus
RTGCSASTIRR

SEQ ID NO: 1920245 - protein, 7 aa, Staphylococcus
RTINSPT

SEQ ID NO: 1920246 - protein, 6 aa, Staphylococcus
RTKDEI

SEQ ID NO: 1920247 - protein, 9 aa, Staphylococcus
RTKSDNDAF

SEQ ID NO: 1920248 - protein, 6 aa, Staphylococcus
RTLKTN

SEQ ID NO: 1920249 - protein, 15 aa, Staphylococcus
RTMSKQGQISEEAAS

SEQ ID NO: 1920250 - protein, 5 aa, Staphylococcus
RTPDY

SEQ ID NO: 1920251 - protein, 5 aa, Staphylococcus
RTRAS

SEQ ID NO: 1920252 - protein, 6 aa, Staphylococcus
RTRASL

SEQ ID NO: 1920253 - protein, 13 aa, Staphylococcus
RTRSELVESGQDD

SEQ ID NO: 1920254 - protein, 4 aa, Staphylococcus
RTSI

SEQ ID NO: 1920255 - protein, 5 aa, Staphylococcus
RTSPH

SEQ ID NO: 1920256 - protein, 10 aa, Staphylococcus
RTTASRAIKN

SEQ ID NO: 1920257 - protein, 4 aa, Staphylococcus
RTTD

SEQ ID NO: 1920258 - protein, 13 aa, Staphylococcus
RTVETLAKESGVP

SEQ ID NO: 1920259 - protein, 4 aa, Staphylococcus
RTVQ

SEQ ID NO: 1920260 - protein, 6 aa, Staphylococcus
RVDDGE

SEQ ID NO: 1920261 - protein, 10 aa, Staphylococcus
RVDKGDHKLE

SEQ ID NO: 1920262 - protein, 8 aa, Staphylococcus
RVEKINDN

SEQ ID NO: 1920263 - protein, 6 aa, Staphylococcus
RVEKSI

SEQ ID NO: 1920264 - protein, 6 aa, Staphylococcus
RVEQGE

SEQ ID NO: 1920265 - protein, 9 aa, Staphylococcus
RVKDTEDYK

SEQ ID NO: 1920266 - protein, 9 aa, Staphylococcus
RVKDTEDYQ

SEQ ID NO: 1920267 - protein, 15 aa, Staphylococcus
RVKKTSKTAGGKGLN

SEQ ID NO: 1920268 - protein, 4 aa, Staphylococcus
RVSS

SEQ ID NO: 1920269 - protein, 4 aa, Staphylococcus
RVTE

SEQ ID NO: 1920270 - protein, 9 aa, Staphylococcus
RVTNQEELE

SEQ ID NO: 1920271 - protein, 4 aa, Staphylococcus
RYEV

SEQ ID NO: 1920272 - protein, 5 aa, Staphylococcus
RYKPE

SEQ ID NO: 1920273 - protein, 9 aa, Staphylococcus
RYLNPQEYP

SEQ ID NO: 1920274 - protein, 4 aa, Staphylococcus
RYNE

SEQ ID NO: 1920275 - protein, 4 aa, Staphylococcus
RYNK

SEQ ID NO: 1920276 - protein, 5 aa, Staphylococcus
RYQPR

SEQ ID NO: 1920277 - protein, 7 aa, Staphylococcus
RYSTEKV

SEQ ID NO: 1920278 - protein, 10 aa, Staphylococcus
RYTERQGGYT

SEQ ID NO: 1920279 - protein, 7 aa, Staphylococcus
SAADPAP

SEQ ID NO: 1920280 - protein, 5 aa, Staphylococcus
SAASL

SEQ ID NO: 1920281 - protein, 5 aa, Staphylococcus
SADTG

SEQ ID NO: 1920282 - protein, 7 aa, Staphylococcus
SADYGKI

SEQ ID NO: 1920283 - protein, 10 aa, Staphylococcus
SAERAQLSNN

SEQ ID NO: 1920284 - protein, 4 aa, Staphylococcus
SAFS

SEQ ID NO: 1920285 - protein, 7 aa, Staphylococcus
SAGPIRT

SEQ ID NO: 1920286 - protein, 5 aa, Staphylococcus
SAGRF

SEQ ID NO: 1920287 - protein, 6 aa, Staphylococcus
SAGTIN

SEQ ID NO: 1920288 - protein, 6 aa, Staphylococcus
SAGTIS

SEQ ID NO: 1920289 - protein, 11 aa, Staphylococcus
SAIDGNQKLNT

SEQ ID NO: 1920290 - protein, 10 aa, Staphylococcus
SAIDNAKAAA

SEQ ID NO: 1920291 - protein, 5 aa, Staphylococcus
SAIGE

SEQ ID NO: 1920292 - protein, 8 aa, Staphylococcus
SAKVGAPR

SEQ ID NO: 1920293 - protein, 17 aa, Staphylococcus
SALKNESDNASKQRLEE

SEQ ID NO: 1920294 - protein, 19 aa, Staphylococcus
SANASKSKQATSRKKQLEK

SEQ ID NO: 1920295 - protein, 5 aa, Staphylococcus
SANLG

SEQ ID NO: 1920296 - protein, 9 aa, Staphylococcus
SAPAKGDVK

SEQ ID NO: 1920297 - protein, 4 aa, Staphylococcus
SASA

SEQ ID NO: 1920298 - protein, 9 aa, Staphylococcus
SASKSPEEI

SEQ ID NO: 1920299 - protein, 8 aa, Staphylococcus
SASQSEGF

SEQ ID NO: 1920300 - protein, 9 aa, Staphylococcus
SASSSLPGV

SEQ ID NO: 1920301 - protein, 5 aa, Staphylococcus
SATEI

SEQ ID NO: 1920302 - protein, 15 aa, Staphylococcus
SATPSLESYARAEKN

SEQ ID NO: 1920303 - protein, 9 aa, Staphylococcus
SAVAKRAKA

SEQ ID NO: 1920304 - protein, 9 aa, Staphylococcus
SAVNKGYDM

SEQ ID NO: 1920305 - protein, 6 aa, Staphylococcus
SAVSPY

SEQ ID NO: 1920306 - protein, 6 aa, Staphylococcus
SAYSRT

SEQ ID NO: 1920307 - protein, 6 aa, Staphylococcus
SDAEGR

SEQ ID NO: 1920308 - protein, 8 aa, Staphylococcus
SDAPYTTD

SEQ ID NO: 1920309 - protein, 8 aa, Staphylococcus
SDDAKERI

SEQ ID NO: 1920310 - protein, 4 aa, Staphylococcus
SDDE

SEQ ID NO: 1920311 - protein, 9 aa, Staphylococcus
SDDSDYITG

SEQ ID NO: 1920312 - protein, 5 aa, Staphylococcus
SDDTL

SEQ ID NO: 1920313 - protein, 4 aa, Staphylococcus
SDDY

SEQ ID NO: 1920314 - protein, 8 aa, Staphylococcus
SDEAKAKL

SEQ ID NO: 1920315 - protein, 8 aa, Staphylococcus
SDEKELSE

SEQ ID NO: 1920316 - protein, 4 aa, Staphylococcus
SDFH

SEQ ID NO: 1920317 - protein, 12 aa, Staphylococcus
SDFKKNKGYERS

SEQ ID NO: 1920318 - protein, 4 aa, Staphylococcus
SDIE

SEQ ID NO: 1920319 - protein, 8 aa, Staphylococcus
SDKDKEEI

SEQ ID NO: 1920320 - protein, 8 aa, Staphylococcus
SDKLSDAA

SEQ ID NO: 1920321 - protein, 5 aa, Staphylococcus
SDLKE

SEQ ID NO: 1920322 - protein, 8 aa, Staphylococcus
SDMGGDYD

SEQ ID NO: 1920323 - protein, 12 aa, Staphylococcus
SDNQKGRYQDQY

SEQ ID NO: 1920324 - protein, 6 aa, Staphylococcus
SDNTAT

SEQ ID NO: 1920325 - protein, 5 aa, Staphylococcus
SDPSR

SEQ ID NO: 1920326 - protein, 9 aa, Staphylococcus
SDRPPKEIA

SEQ ID NO: 1920327 - protein, 6 aa, Staphylococcus
SDSDED

SEQ ID NO: 1920328 - protein, 8 aa, Staphylococcus
SDYQEDDY

SEQ ID NO: 1920329 - protein, 14 aa, Staphylococcus
SEAERSPNESYIPN

SEQ ID NO: 1920330 - protein, 12 aa, Staphylococcus
SEAGSAGRDTRG

SEQ ID NO: 1920331 - protein, 12 aa, Staphylococcus
SEAKRKEATQKY

SEQ ID NO: 1920332 - protein, 5 aa, Staphylococcus
SEDEW

SEQ ID NO: 1920333 - protein, 5 aa, Staphylococcus
SEDNR

SEQ ID NO: 1920334 - protein, 9 aa, Staphylococcus
SEDYHGPDM

SEQ ID NO: 1920335 - protein, 6 aa, Staphylococcus
SEEEGV

SEQ ID NO: 1920336 - protein, 7 aa, Staphylococcus
SEEENVD

SEQ ID NO: 1920337 - protein, 8 aa, Staphylococcus
SEENEEKY

SEQ ID NO: 1920338 - protein, 12 aa, Staphylococcus
SEENNKLKKEVE

SEQ ID NO: 1920339 - protein, 4 aa, Staphylococcus
SEFY

SEQ ID NO: 1920340 - protein, 4 aa, Staphylococcus
SEGQ

SEQ ID NO: 1920341 - protein, 8 aa, Staphylococcus
SEGRNRQV

SEQ ID NO: 1920342 - protein, 7 aa, Staphylococcus
SEGTDFP

SEQ ID NO: 1920343 - protein, 7 aa, Staphylococcus
SEGTNFP

SEQ ID NO: 1920344 - protein, 4 aa, Staphylococcus
SEGV

SEQ ID NO: 1920345 - protein, 4 aa, Staphylococcus
SEGY

SEQ ID NO: 1920346 - protein, 7 aa, Staphylococcus
SEHSYPI

SEQ ID NO: 1920347 - protein, 4 aa, Staphylococcus
SEIE

SEQ ID NO: 1920348 - protein, 12 aa, Staphylococcus
SEIEAEGDVETG

SEQ ID NO: 1920349 - protein, 4 aa, Staphylococcus
SEIP

SEQ ID NO: 1920350 - protein, 4 aa, Staphylococcus
SEKL

SEQ ID NO: 1920351 - protein, 7 aa, Staphylococcus
SEKMPYR

SEQ ID NO: 1920352 - protein, 10 aa, Staphylococcus
SEKPAAGKSI

SEQ ID NO: 1920353 - protein, 5 aa, Staphylococcus
SELEE

SEQ ID NO: 1920354 - protein, 6 aa, Staphylococcus
SELGTA

SEQ ID NO: 1920355 - protein, 8 aa, Staphylococcus
SELKKGRQ

SEQ ID NO: 1920356 - protein, 6 aa, Staphylococcus
SELPES

SEQ ID NO: 1920357 - protein, 4 aa, Staphylococcus
SELQ

SEQ ID NO: 1920358 - protein, 8 aa, Staphylococcus
SELSGGQL

SEQ ID NO: 1920359 - protein, 5 aa, Staphylococcus
SENQI

SEQ ID NO: 1920360 - protein, 8 aa, Staphylococcus
SENQTDEA

SEQ ID NO: 1920361 - protein, 9 aa, Staphylococcus
SENQTDEAL

SEQ ID NO: 1920362 - protein, 4 aa, Staphylococcus
SENV

SEQ ID NO: 1920363 - protein, 5 aa, Staphylococcus
SENYN

SEQ ID NO: 1920364 - protein, 8 aa, Staphylococcus
SEQTPSSV

SEQ ID NO: 1920365 - protein, 8 aa, Staphylococcus
SEQVPSSV

SEQ ID NO: 1920366 - protein, 7 aa, Staphylococcus
SERALGS

SEQ ID NO: 1920367 - protein, 26 aa, Staphylococcus
SERGLETAVGDEGGFAPKFEGTEDAV

SEQ ID NO: 1920368 - protein, 10 aa, Staphylococcus
SERKAEPRLG

SEQ ID NO: 1920369 - protein, 10 aa, Staphylococcus
SESGTGAGVR

SEQ ID NO: 1920370 - protein, 11 aa, Staphylococcus
SESNEISSKEI

SEQ ID NO: 1920371 - protein, 5 aa, Staphylococcus
SETDT

SEQ ID NO: 1920372 - protein, 7 aa, Staphylococcus
SETLGDE

SEQ ID NO: 1920373 - protein, 5 aa, Staphylococcus
SETQG

SEQ ID NO: 1920374 - protein, 10 aa, Staphylococcus
SETSNKQPSI

SEQ ID NO: 1920375 - protein, 7 aa, Staphylococcus
SEVDEET

SEQ ID NO: 1920376 - protein, 4 aa, Staphylococcus
SEVI

SEQ ID NO: 1920377 - protein, 6 aa, Staphylococcus
SFDGGA

SEQ ID NO: 1920378 - protein, 10 aa, Staphylococcus
SFDKKTKEGH

SEQ ID NO: 1920379 - protein, 6 aa, Staphylococcus
SFDSNN

SEQ ID NO: 1920380 - protein, 13 aa, Staphylococcus
SFNNPTFTEEQNK

SEQ ID NO: 1920381 - protein, 13 aa, Staphylococcus
SFQDGRQRLEEAG

SEQ ID NO: 1920382 - protein, 6 aa, Staphylococcus
SFQEEV

SEQ ID NO: 1920383 - protein, 4 aa, Staphylococcus
SFSD

SEQ ID NO: 1920384 - protein, 9 aa, Staphylococcus
SFTGSTDVG

SEQ ID NO: 1920385 - protein, 7 aa, Staphylococcus
SGADIAS

SEQ ID NO: 1920386 - protein, 20 aa, Staphylococcus
SGANGSKPRDVFITEADLKK

SEQ ID NO: 1920387 - protein, 14 aa, Staphylococcus
SGAYYGGDTLKSTK

SEQ ID NO: 1920388 - protein, 13 aa, Staphylococcus
SGAYYGGDTLKTT

SEQ ID NO: 1920389 - protein, 10 aa, Staphylococcus
SGDESIGKRP

SEQ ID NO: 1920390 - protein, 6 aa, Staphylococcus
SGDKEI

SEQ ID NO: 1920391 - protein, 13 aa, Staphylococcus
SGDPKDIERADEE

SEQ ID NO: 1920392 - protein, 8 aa, Staphylococcus
SGDTVKVG

SEQ ID NO: 1920393 - protein, 8 aa, Staphylococcus
SGDTVQVG

SEQ ID NO: 1920394 - protein, 4 aa, Staphylococcus
SGDY

SEQ ID NO: 1920395 - protein, 13 aa, Staphylococcus
SGEEVGDTLSGHK

SEQ ID NO: 1920396 - protein, 7 aa, Staphylococcus
SGEINGD

SEQ ID NO: 1920397 - protein, 8 aa, Staphylococcus
SGETADSR

SEQ ID NO: 1920398 - protein, 6 aa, Staphylococcus
SGETRE

SEQ ID NO: 1920399 - protein, 4 aa, Staphylococcus
SGGE

SEQ ID NO: 1920400 - protein, 7 aa, Staphylococcus
SGGEAQR

SEQ ID NO: 1920401 - protein, 7 aa, Staphylococcus
SGGEFPR

SEQ ID NO: 1920402 - protein, 7 aa, Staphylococcus
SGGERTK

SEQ ID NO: 1920403 - protein, 17 aa, Staphylococcus
SGGGEERLHGQSSIGVG

SEQ ID NO: 1920404 - protein, 8 aa, Staphylococcus
SGGIPKKS

SEQ ID NO: 1920405 - protein, 11 aa, Staphylococcus
SGGIQEEAPSL

SEQ ID NO: 1920406 - protein, 12 aa, Staphylococcus
SGGKGTADEKIK

SEQ ID NO: 1920407 - protein, 6 aa, Staphylococcus
SGGNPA

SEQ ID NO: 1920408 - protein, 8 aa, Staphylococcus
SGGPKGIM

SEQ ID NO: 1920409 - protein, 6 aa, Staphylococcus
SGGQRG

SEQ ID NO: 1920410 - protein, 4 aa, Staphylococcus
SGGR

SEQ ID NO: 1920411 - protein, 9 aa, Staphylococcus
SGGSSEKFN

SEQ ID NO: 1920412 - protein, 11 aa, Staphylococcus
SGGSSEKYNNY

SEQ ID NO: 1920413 - protein, 13 aa, Staphylococcus
SGGVQEEAPSLGK

SEQ ID NO: 1920414 - protein, 6 aa, Staphylococcus
SGGVSL

SEQ ID NO: 1920415 - protein, 5 aa, Staphylococcus
SGICS

SEQ ID NO: 1920416 - protein, 15 aa, Staphylococcus
SGIDPKTIPVDDKET

SEQ ID NO: 1920417 - protein, 7 aa, Staphylococcus
SGIHSNG

SEQ ID NO: 1920418 - protein, 16 aa, Staphylococcus
SGISGSYQSATQAGEM

SEQ ID NO: 1920419 - protein, 6 aa, Staphylococcus
SGKHAF

SEQ ID NO: 1920420 - protein, 4 aa, Staphylococcus
SGKN

SEQ ID NO: 1920421 - protein, 9 aa, Staphylococcus
SGKTAERLN

SEQ ID NO: 1920422 - protein, 5 aa, Staphylococcus
SGLAP

SEQ ID NO: 1920423 - protein, 9 aa, Staphylococcus
SGLNAQISS

SEQ ID NO: 1920424 - protein, 9 aa, Staphylococcus
SGMNKPNGL

SEQ ID NO: 1920425 - protein, 9 aa, Staphylococcus
SGNKKAVDN

SEQ ID NO: 1920426 - protein, 7 aa, Staphylococcus
SGNRNFE

SEQ ID NO: 1920427 - protein, 7 aa, Staphylococcus
SGPFANQ

SEQ ID NO: 1920428 - protein, 12 aa, Staphylococcus
SGPGATNAITGI

SEQ ID NO: 1920429 - protein, 19 aa, Staphylococcus
SGPGATNAITGITDAHSDS

SEQ ID NO: 1920430 - protein, 11 aa, Staphylococcus
SGPIPPNPSEL

SEQ ID NO: 1920431 - protein, 7 aa, Staphylococcus
SGPYDAK

SEQ ID NO: 1920432 - protein, 22 aa, Staphylococcus
SGQDESQLREQMKDDAEERVKT

SEQ ID NO: 1920433 - protein, 22 aa, Staphylococcus
SGQDESQLREQMKDDAEQRVKT

SEQ ID NO: 1920434 - protein, 10 aa, Staphylococcus
SGQSGVGKST

SEQ ID NO: 1920435 - protein, 11 aa, Staphylococcus
SGRAGRHEKEG

SEQ ID NO: 1920436 - protein, 9 aa, Staphylococcus
SGRSDIDKN

SEQ ID NO: 1920437 - protein, 10 aa, Staphylococcus
SGRSNVGKSS

SEQ ID NO: 1920438 - protein, 20 aa, Staphylococcus
SGRTYNNQEPKYLNSPETPI

SEQ ID NO: 1920439 - protein, 14 aa, Staphylococcus
SGSACTAGSTTPSH

SEQ ID NO: 1920440 - protein, 7 aa, Staphylococcus
SGSFSDR

SEQ ID NO: 1920441 - protein, 11 aa, Staphylococcus
SGSSPIVSGEL

SEQ ID NO: 1920442 - protein, 9 aa, Staphylococcus
SGSTGQPKG

SEQ ID NO: 1920443 - protein, 8 aa, Staphylococcus
SGTLSEES

SEQ ID NO: 1920444 - protein, 11 aa, Staphylococcus
SGTNGKDDNIA

SEQ ID NO: 1920445 - protein, 4 aa, Staphylococcus
SGTP

SEQ ID NO: 1920446 - protein, 8 aa, Staphylococcus
SGTTGLPK

SEQ ID NO: 1920447 - protein, 4 aa, Staphylococcus
SGTV

SEQ ID NO: 1920448 - protein, 6 aa, Staphylococcus
SGVEYA

SEQ ID NO: 1920449 - protein, 10 aa, Staphylococcus
SGVGQNPARQ

SEQ ID NO: 1920450 - protein, 14 aa, Staphylococcus
SGYENKVKKNLEKR

SEQ ID NO: 1920451 - protein, 14 aa, Staphylococcus
SGYSGGHVENPTYE

SEQ ID NO: 1920452 - protein, 5 aa, Staphylococcus
SHDPY

SEQ ID NO: 1920453 - protein, 18 aa, Staphylococcus
SHEDRKVNKAFRHIGHSH

SEQ ID NO: 1920454 - protein, 7 aa, Staphylococcus
SHGGRTQ

SEQ ID NO: 1920455 - protein, 4 aa, Staphylococcus
SHGS

SEQ ID NO: 1920456 - protein, 5 aa, Staphylococcus
SHKDR

SEQ ID NO: 1920457 - protein, 9 aa, Staphylococcus
SHNPKDYNG

SEQ ID NO: 1920458 - protein, 4 aa, Staphylococcus
SHPA

SEQ ID NO: 1920459 - protein, 11 aa, Staphylococcus
SHPEYRSQYDT

SEQ ID NO: 1920460 - protein, 13 aa, Staphylococcus
SHPLQDESQVQGS

SEQ ID NO: 1920461 - protein, 13 aa, Staphylococcus
SHVADKEQGHSCG

SEQ ID NO: 1920462 - protein, 9 aa, Staphylococcus
SHVGAGADV

SEQ ID NO: 1920463 - protein, 6 aa, Staphylococcus
SIDTTH

SEQ ID NO: 1920464 - protein, 4 aa, Staphylococcus
SIED

SEQ ID NO: 1920465 - protein, 4 aa, Staphylococcus
SIEG

SEQ ID NO: 1920466 - protein, 7 aa, Staphylococcus
SIERTTR

SEQ ID NO: 1920467 - protein, 12 aa, Staphylococcus
SIETKSNPNDLV

SEQ ID NO: 1920468 - protein, 8 aa, Staphylococcus
SIGGGAKS

SEQ ID NO: 1920469 - protein, 6 aa, Staphylococcus
SIGGGT

SEQ ID NO: 1920470 - protein, 12 aa, Staphylococcus
SIGNDEMDDSEQ

SEQ ID NO: 1920471 - protein, 11 aa, Staphylococcus
SINEKDGKVGS

SEQ ID NO: 1920472 - protein, 5 aa, Staphylococcus
SINIS

SEQ ID NO: 1920473 - protein, 6 aa, Staphylococcus
SIPKGA

SEQ ID NO: 1920474 - protein, 6 aa, Staphylococcus
SIPYTL

SEQ ID NO: 1920475 - protein, 5 aa, Staphylococcus
SIQTR

SEQ ID NO: 1920476 - protein, 14 aa, Staphylococcus
SISENIDTSNASGE

SEQ ID NO: 1920477 - protein, 9 aa, Staphylococcus
SKADNTPFI

SEQ ID NO: 1920478 - protein, 6 aa, Staphylococcus
SKAGIT

SEQ ID NO: 1920479 - protein, 8 aa, Staphylococcus
SKAGSVEL

SEQ ID NO: 1920480 - protein, 7 aa, Staphylococcus
SKARETF

SEQ ID NO: 1920481 - protein, 7 aa, Staphylococcus
SKAVESY

SEQ ID NO: 1920482 - protein, 11 aa, Staphylococcus
SKAYQKTTGIA

SEQ ID NO: 1920483 - protein, 13 aa, Staphylococcus
SKCNNEDELKSGI

SEQ ID NO: 1920484 - protein, 4 aa, Staphylococcus
SKDA

SEQ ID NO: 1920485 - protein, 9 aa, Staphylococcus
SKDEEGKFT

SEQ ID NO: 1920486 - protein, 8 aa, Staphylococcus
SKDEIGDT

SEQ ID NO: 1920487 - protein, 11 aa, Staphylococcus
SKDGKLEGPNF

SEQ ID NO: 1920488 - protein, 6 aa, Staphylococcus
SKDPDF

SEQ ID NO: 1920489 - protein, 9 aa, Staphylococcus
SKDSTQRYQ

SEQ ID NO: 1920490 - protein, 4 aa, Staphylococcus
SKEE

SEQ ID NO: 1920491 - protein, 9 aa, Staphylococcus
SKEEAMKRA

SEQ ID NO: 1920492 - protein, 5 aa, Staphylococcus
SKEEL

SEQ ID NO: 1920493 - protein, 9 aa, Staphylococcus
SKEERERGG

SEQ ID NO: 1920494 - protein, 8 aa, Staphylococcus
SKEGRYAY

SEQ ID NO: 1920495 - protein, 8 aa, Staphylococcus
SKEGYSPE

SEQ ID NO: 1920496 - protein, 10 aa, Staphylococcus
SKEKHPDADK

SEQ ID NO: 1920497 - protein, 11 aa, Staphylococcus
SKEKKDAKAKE

SEQ ID NO: 1920498 - protein, 5 aa, Staphylococcus
SKEMN

SEQ ID NO: 1920499 - protein, 4 aa, Staphylococcus
SKFN

SEQ ID NO: 1920500 - protein, 4 aa, Staphylococcus
SKGL

SEQ ID NO: 1920501 - protein, 8 aa, Staphylococcus
SKHPLTRT

SEQ ID NO: 1920502 - protein, 8 aa, Staphylococcus
SKIGKEDF

SEQ ID NO: 1920503 - protein, 4 aa, Staphylococcus
SKIQ

SEQ ID NO: 1920504 - protein, 11 aa, Staphylococcus
SKISSTTQRIR

SEQ ID NO: 1920505 - protein, 7 aa, Staphylococcus
SKITELA

SEQ ID NO: 1920506 - protein, 7 aa, Staphylococcus
SKIVNDK

SEQ ID NO: 1920507 - protein, 11 aa, Staphylococcus
SKKETLAKEPL

SEQ ID NO: 1920508 - protein, 4 aa, Staphylococcus
SKKG

SEQ ID NO: 1920509 - protein, 9 aa, Staphylococcus
SKKGRYAYS

SEQ ID NO: 1920510 - protein, 9 aa, Staphylococcus
SKKSIQRDI

SEQ ID NO: 1920511 - protein, 7 aa, Staphylococcus
SKLAAKR

SEQ ID NO: 1920512 - protein, 14 aa, Staphylococcus
SKLRRAEKNTKQFE

SEQ ID NO: 1920513 - protein, 5 aa, Staphylococcus
SKNDY

SEQ ID NO: 1920514 - protein, 7 aa, Staphylococcus
SKNPDIT

SEQ ID NO: 1920515 - protein, 16 aa, Staphylococcus
SKNTIHDGARSQTIHA

SEQ ID NO: 1920516 - protein, 6 aa, Staphylococcus
SKPGIV

SEQ ID NO: 1920517 - protein, 7 aa, Staphylococcus
SKPHRNQ

SEQ ID NO: 1920518 - protein, 12 aa, Staphylococcus
SKPKLKEEKFER

SEQ ID NO: 1920519 - protein, 9 aa, Staphylococcus
SKPSMSAGV

SEQ ID NO: 1920520 - protein, 4 aa, Staphylococcus
SKQT

SEQ ID NO: 1920521 - protein, 11 aa, Staphylococcus
SKQTGSVFQNP

SEQ ID NO: 1920522 - protein, 6 aa, Staphylococcus
SKQTMQ

SEQ ID NO: 1920523 - protein, 8 aa, Staphylococcus
SKRIKSNS

SEQ ID NO: 1920524 - protein, 16 aa, Staphylococcus
SKSASKDEIKKAYRKL

SEQ ID NO: 1920525 - protein, 4 aa, Staphylococcus
SKSF

SEQ ID NO: 1920526 - protein, 14 aa, Staphylococcus
SKSFGSAGNPSPMT

SEQ ID NO: 1920527 - protein, 6 aa, Staphylococcus
SKSKPL

SEQ ID NO: 1920528 - protein, 21 aa, Staphylococcus
SKSKSHGKQNQIEGAKSEGKK

SEQ ID NO: 1920529 - protein, 7 aa, Staphylococcus
SKSLKGM

SEQ ID NO: 1920530 - protein, 4 aa, Staphylococcus
SKSY

SEQ ID NO: 1920531 - protein, 12 aa, Staphylococcus
SKTAFDGRGNYT

SEQ ID NO: 1920532 - protein, 6 aa, Staphylococcus
SKTGFG

SEQ ID NO: 1920533 - protein, 4 aa, Staphylococcus
SKTV

SEQ ID NO: 1920534 - protein, 7 aa, Staphylococcus
SKVAERS

SEQ ID NO: 1920535 - protein, 4 aa, Staphylococcus
SKYG

SEQ ID NO: 1920536 - protein, 7 aa, Staphylococcus
SKYKDGK

SEQ ID NO: 1920537 - protein, 8 aa, Staphylococcus
SKYKDGKI

SEQ ID NO: 1920538 - protein, 7 aa, Staphylococcus
SKYKLDK

SEQ ID NO: 1920539 - protein, 7 aa, Staphylococcus
SLAKGEK

SEQ ID NO: 1920540 - protein, 6 aa, Staphylococcus
SLDTKG

SEQ ID NO: 1920541 - protein, 5 aa, Staphylococcus
SLEEK

SEQ ID NO: 1920542 - protein, 7 aa, Staphylococcus
SLEGGFS

SEQ ID NO: 1920543 - protein, 14 aa, Staphylococcus
SLEKQKAKVKTQQE

SEQ ID NO: 1920544 - protein, 5 aa, Staphylococcus
SLGAD

SEQ ID NO: 1920545 - protein, 8 aa, Staphylococcus
SLGADRRN

SEQ ID NO: 1920546 - protein, 13 aa, Staphylococcus
SLKAQGAKVDSWG

SEQ ID NO: 1920547 - protein, 7 aa, Staphylococcus
SLKDRAE

SEQ ID NO: 1920548 - protein, 12 aa, Staphylococcus
SLKGPLHGGANE

SEQ ID NO: 1920549 - protein, 6 aa, Staphylococcus
SLNEDA

SEQ ID NO: 1920550 - protein, 15 aa, Staphylococcus
SLPDLPDKAQLSIFD

SEQ ID NO: 1920551 - protein, 6 aa, Staphylococcus
SLPGRA

SEQ ID NO: 1920552 - protein, 13 aa, Staphylococcus
SLPGWDSSYTKED

SEQ ID NO: 1920553 - protein, 4 aa, Staphylococcus
SLPI

SEQ ID NO: 1920554 - protein, 15 aa, Staphylococcus
SLPNLPDKAQLSIFD

SEQ ID NO: 1920555 - protein, 6 aa, Staphylococcus
SLQPVE

SEQ ID NO: 1920556 - protein, 10 aa, Staphylococcus
SLRGNALTNG

SEQ ID NO: 1920557 - protein, 42 aa, Staphylococcus; identical to SEQ ID NO: 1789869

SEQ ID NO: 1920558 - protein, 11 aa, Staphylococcus
SLSSISKNKDI

SEQ ID NO: 1920559 - protein, 8 aa, Staphylococcus
SLYGPTVG

SEQ ID NO: 1920560 - protein, 14 aa, Staphylococcus
SLYGPTVGDSVRLG

SEQ ID NO: 1920561 - protein, 11 aa, Staphylococcus
SMYGTGQLPKF

SEQ ID NO: 1920562 - protein, 6 aa, Staphylococcus
SNAKQI

SEQ ID NO: 1920563 - protein, 5 aa, Staphylococcus
SNATE

SEQ ID NO: 1920564 - protein, 6 aa, Staphylococcus
SNATQI

SEQ ID NO: 1920565 - protein, 8 aa, Staphylococcus
SNDLDEQT

SEQ ID NO: 1920566 - protein, 10 aa, Staphylococcus
SNFTNQDANE

SEQ ID NO: 1920567 - protein, 14 aa, Staphylococcus
SNGGRDGRVFSPDN

SEQ ID NO: 1920568 - protein, 9 aa, Staphylococcus
SNGPGDPDV

SEQ ID NO: 1920569 - protein, 5 aa, Staphylococcus
SNGSN

SEQ ID NO: 1920570 - protein, 7 aa, Staphylococcus
SNHTSDL

SEQ ID NO: 1920571 - protein, 6 aa, Staphylococcus
SNIPST

SEQ ID NO: 1920572 - protein, 4 aa, Staphylococcus
SNIQ

SEQ ID NO: 1920573 - protein, 6 aa, Staphylococcus
SNISSQ

SEQ ID NO: 1920574 - protein, 17 aa, Staphylococcus
SNKKIQKLENQLEEERQ

SEQ ID NO: 1920575 - protein, 6 aa, Staphylococcus
SNKREV

SEQ ID NO: 1920576 - protein, 8 aa, Staphylococcus
SNLLRDKD

SEQ ID NO: 1920577 - protein, 7 aa, Staphylococcus
SNLTSNA

SEQ ID NO: 1920578 - protein, 7 aa, Staphylococcus
SNMREEV

SEQ ID NO: 1920579 - protein, 14 aa, Staphylococcus
SNNAEKVTTPGKKK

SEQ ID NO: 1920580 - protein, 4 aa, Staphylococcus
SNNY

SEQ ID NO: 1920581 - protein, 7 aa, Staphylococcus
SNPLTHK

SEQ ID NO: 1920582 - protein, 7 aa, Staphylococcus
SNPYDAK

SEQ ID NO: 1920583 - protein, 4 aa, Staphylococcus
SNQL

SEQ ID NO: 1920584 - protein, 8 aa, Staphylococcus
SNRTARND

SEQ ID NO: 1920585 - protein, 12 aa, Staphylococcus
SNSDNDSEKEKE

SEQ ID NO: 1920586 - protein, 6 aa, Staphylococcus
SNSEYD

SEQ ID NO: 1920587 - protein, 8 aa, Staphylococcus
SNSSRFNA

SEQ ID NO: 1920588 - protein, 7 aa, Staphylococcus
SNSVPHY

SEQ ID NO: 1920589 - protein, 10 aa, Staphylococcus
SNTAEYGDYV

SEQ ID NO: 1920590 - protein, 4 aa, Staphylococcus
SNTS

SEQ ID NO: 1920591 - protein, 5 aa, Staphylococcus
SNTTI

SEQ ID NO: 1920592 - protein, 5 aa, Staphylococcus
SNVDN

SEQ ID NO: 1920593 - protein, 6 aa, Staphylococcus
SNVDNI

SEQ ID NO: 1920594 - protein, 12 aa, Staphylococcus
SNYSPSHTKYGS

SEQ ID NO: 1920595 - protein, 7 aa, Staphylococcus
SPAAQGL

SEQ ID NO: 1920596 - protein, 5 aa, Staphylococcus
SPALF

SEQ ID NO: 1920597 - protein, 6 aa, Staphylococcus
SPATIR

SEQ ID NO: 1920598 - protein, 4 aa, Staphylococcus
SPDE

SEQ ID NO: 1920599 - protein, 15 aa, Staphylococcus
SPDHLRGDEEGRYGT

SEQ ID NO: 1920600 - protein, 6 aa, Staphylococcus
SPDPNM

SEQ ID NO: 1920601 - protein, 10 aa, Staphylococcus
SPEAASGGPI

SEQ ID NO: 1920602 - protein, 9 aa, Staphylococcus
SPEDATRTD

SEQ ID NO: 1920603 - protein, 8 aa, Staphylococcus
SPEGEDEI

SEQ ID NO: 1920604 - protein, 9 aa, Staphylococcus
SPESLGVTE

SEQ ID NO: 1920605 - protein, 6 aa, Staphylococcus
SPETVA

SEQ ID NO: 1920606 - protein, 9 aa, Staphylococcus
SPFGKGRPG

SEQ ID NO: 1920607 - protein, 11 aa, Staphylococcus
SPFKSKSHLSP

SEQ ID NO: 1920608 - protein, 5 aa, Staphylococcus
SPGFA

SEQ ID NO: 1920609 - protein, 7 aa, Staphylococcus
SPGFSNE

SEQ ID NO: 1920610 - protein, 11 aa, Staphylococcus
SPGGTDGGEIH

SEQ ID NO: 1920611 - protein, 12 aa, Staphylococcus
SPGMPPGANTIN

SEQ ID NO: 1920612 - protein, 8 aa, Staphylococcus
SPHPSPLS

SEQ ID NO: 1920613 - protein, 12 aa, Staphylococcus
SPKNNDKDQQTY

SEQ ID NO: 1920614 - protein, 10 aa, Staphylococcus
SPNAKDPQKR

SEQ ID NO: 1920615 - protein, 7 aa, Staphylococcus
SPNGGYV

SEQ ID NO: 1920616 - protein, 16 aa, Staphylococcus
SPNKPYETKIVEYDQC

SEQ ID NO: 1920617 - protein, 4 aa, Staphylococcus
SPPI

SEQ ID NO: 1920618 - protein, 8 aa, Staphylococcus
SPQIERQE

SEQ ID NO: 1920619 - protein, 9 aa, Staphylococcus
SPQIERQEK

SEQ ID NO: 1920620 - protein, 8 aa, Staphylococcus
SPQSGTIS

SEQ ID NO: 1920621 - protein, 7 aa, Staphylococcus
SPSPIPI

SEQ ID NO: 1920622 - protein, 8 aa, Staphylococcus
SPTKNEEV

SEQ ID NO: 1920623 - protein, 12 aa, Staphylococcus
SPVQGSEQGGVR

SEQ ID NO: 1920624 - protein, 6 aa, Staphylococcus
SPVQSD

SEQ ID NO: 1920625 - protein, 4 aa, Staphylococcus
SPYD

SEQ ID NO: 1920626 - protein, 5 aa, Staphylococcus
SPYNV

SEQ ID NO: 1920627 - protein, 6 aa, Staphylococcus
SQGDGI

SEQ ID NO: 1920628 - protein, 5 aa, Staphylococcus
SQGFE

SEQ ID NO: 1920629 - protein, 8 aa, Staphylococcus
SQGGNTQG

SEQ ID NO: 1920630 - protein, 6 aa, Staphylococcus
SQGPKR

SEQ ID NO: 1920631 - protein, 5 aa, Staphylococcus
SQIEN

SEQ ID NO: 1920632 - protein, 5 aa, Staphylococcus
SQIID

SEQ ID NO: 1920633 - protein, 6 aa, Staphylococcus
SQKEIT

SEQ ID NO: 1920634 - protein, 5 aa, Staphylococcus
SQKQI

SEQ ID NO: 1920635 - protein, 6 aa, Staphylococcus
SQPLGR

SEQ ID NO: 1920636 - protein, 5 aa, Staphylococcus
SQPTM

SEQ ID NO: 1920637 - protein, 14 aa, Staphylococcus
SQSADAKSTKYNAT

SEQ ID NO: 1920638 - protein, 4 aa, Staphylococcus
SQSG

SEQ ID NO: 1920639 - protein, 6 aa, Staphylococcus
SQVEAG

SEQ ID NO: 1920640 - protein, 6 aa, Staphylococcus
SRAGAN

SEQ ID NO: 1920641 - protein, 4 aa, Staphylococcus
SRAI

SEQ ID NO: 1920642 - protein, 7 aa, Staphylococcus
SRDTDQK

SEQ ID NO: 1920643 - protein, 7 aa, Staphylococcus
SREGRYA

SEQ ID NO: 1920644 - protein, 5 aa, Staphylococcus
SREHE

SEQ ID NO: 1920645 - protein, 4 aa, Staphylococcus
SRFE

SEQ ID NO: 1920646 - protein, 9 aa, Staphylococcus
SRGEHTKHP

SEQ ID NO: 1920647 - protein, 7 aa, Staphylococcus
SRGTGRW

SEQ ID NO: 1920648 - protein, 14 aa, Staphylococcus
SRHADDANAIRRRR

SEQ ID NO: 1920649 - protein, 4 aa, Staphylococcus
SRIP

SEQ ID NO: 1920650 - protein, 6 aa, Staphylococcus
SRKIHS

SEQ ID NO: 1920651 - protein, 4 aa, Staphylococcus
SRKV

SEQ ID NO: 1920652 - protein, 6 aa, Staphylococcus
SRLNNG

SEQ ID NO: 1920653 - protein, 8 aa, Staphylococcus
SRLTGRLS

SEQ ID NO: 1920654 - protein, 6 aa, Staphylococcus
SRPDEL

SEQ ID NO: 1920655 - protein, 7 aa, Staphylococcus
SRPSYVS

SEQ ID NO: 1920656 - protein, 10 aa, Staphylococcus
SRQNQPSNLS

SEQ ID NO: 1920657 - protein, 7 aa, Staphylococcus
SRQQVRD

SEQ ID NO: 1920658 - protein, 8 aa, Staphylococcus
SRSECDTS

SEQ ID NO: 1920659 - protein, 8 aa, Staphylococcus
SRSECDTT

SEQ ID NO: 1920660 - protein, 4 aa, Staphylococcus
SRTI

SEQ ID NO: 1920661 - protein, 14 aa, Staphylococcus
SRTNRVEKETKPFG

SEQ ID NO: 1920662 - protein, 8 aa, Staphylococcus
SRVPDDLD

SEQ ID NO: 1920663 - protein, 5 aa, Staphylococcus
SRYPQ

SEQ ID NO: 1920664 - protein, 25 aa, Staphylococcus
SSAGRIAARARGRYGGRPEKLNKQD

SEQ ID NO: 1920665 - protein, 22 aa, Staphylococcus
SSATNGKLSQKSYEDLENQTGM

SEQ ID NO: 1920666 - protein, 10 aa, Staphylococcus
SSAVNKGYDM

SEQ ID NO: 1920667 - protein, 7 aa, Staphylococcus
SSDATSY

SEQ ID NO: 1920668 - protein, 4 aa, Staphylococcus
SSDD

SEQ ID NO: 1920669 - protein, 7 aa, Staphylococcus
SSDETSY

SEQ ID NO: 1920670 - protein, 5 aa, Staphylococcus
SSDIK

SEQ ID NO: 1920671 - protein, 7 aa, Staphylococcus
SSDKLSI

SEQ ID NO: 1920672 - protein, 7 aa, Staphylococcus
SSDTPTL

SEQ ID NO: 1920673 - protein, 10 aa, Staphylococcus
SSEASSNLSR

SEQ ID NO: 1920674 - protein, 8 aa, Staphylococcus
SSEGLAKE

SEQ ID NO: 1920675 - protein, 6 aa, Staphylococcus
SSEKFT

SEQ ID NO: 1920676 - protein, 5 aa, Staphylococcus
SSEPL

SEQ ID NO: 1920677 - protein, 9 aa, Staphylococcus
SSFKDKAVD

SEQ ID NO: 1920678 - protein, 6 aa, Staphylococcus
SSFTDM

SEQ ID NO: 1920679 - protein, 4 aa, Staphylococcus
SSHH

SEQ ID NO: 1920680 - protein, 14 aa, Staphylococcus
SSISYAGGKDLKSL

SEQ ID NO: 1920681 - protein, 8 aa, Staphylococcus
SSKGIGAS

SEQ ID NO: 1920682 - protein, 4 aa, Staphylococcus
SSKP

SEQ ID NO: 1920683 - protein, 5 aa, Staphylococcus
SSKSA

SEQ ID NO: 1920684 - protein, 4 aa, Staphylococcus
SSLE

SEQ ID NO: 1920685 - protein, 8 aa, Staphylococcus
SSLSKGEK

SEQ ID NO: 1920686 - protein, 8 aa, Staphylococcus
SSLTNEDG

SEQ ID NO: 1920687 - protein, 5 aa, Staphylococcus
SSNDF

SEQ ID NO: 1920688 - protein, 18 aa, Staphylococcus
SSNPVAGNVTVGTGVGPT

SEQ ID NO: 1920689 - protein, 13 aa, Staphylococcus
SSPHRKDAYRANE

SEQ ID NO: 1920690 - protein, 5 aa, Staphylococcus
SSPTQ

SEQ ID NO: 1920691 - protein, 10 aa, Staphylococcus
SSQKQDLDGD

SEQ ID NO: 1920692 - protein, 4 aa, Staphylococcus
SSST

SEQ ID NO: 1920693 - protein, 6 aa, Staphylococcus
SSSYTQ

SEQ ID NO: 1920694 - protein, 5 aa, Staphylococcus
SSTEQ

SEQ ID NO: 1920695 - protein, 10 aa, Staphylococcus
SSTSPEIGTV

SEQ ID NO: 1920696 - protein, 8 aa, Staphylococcus
SSTSSPDY

SEQ ID NO: 1920697 - protein, 6 aa, Staphylococcus
SSTTYE

SEQ ID NO: 1920698 - protein, 5 aa, Staphylococcus
SSTYT

SEQ ID NO: 1920699 - protein, 6 aa, Staphylococcus
SSVGPL

SEQ ID NO: 1920700 - protein, 4 aa, Staphylococcus
STDE

SEQ ID NO: 1920701 - protein, 4 aa, Staphylococcus
STDQ

SEQ ID NO: 1920702 - protein, 6 aa, Staphylococcus
STELGA

SEQ ID NO: 1920703 - protein, 7 aa, Staphylococcus
STGDFPF

SEQ ID NO: 1920704 - protein, 6 aa, Staphylococcus
STGNDV

SEQ ID NO: 1920705 - protein, 8 aa, Staphylococcus
STGQKRRL

SEQ ID NO: 1920706 - protein, 4 aa, Staphylococcus
STGR

SEQ ID NO: 1920707 - protein, 4 aa, Staphylococcus
STIK

SEQ ID NO: 1920708 - protein, 4 aa, Staphylococcus
STIP

SEQ ID NO: 1920709 - protein, 5 aa, Staphylococcus
STISS

SEQ ID NO: 1920710 - protein, 5 aa, Staphylococcus
STITG

SEQ ID NO: 1920711 - protein, 7 aa, Staphylococcus
STKAYTA

SEQ ID NO: 1920712 - protein, 15 aa, Staphylococcus
STKEVKETKEGLKSG

SEQ ID NO: 1920713 - protein, 7 aa, Staphylococcus
STKGMSE

SEQ ID NO: 1920714 - protein, 15 aa, Staphylococcus
STKGSAKSDDVTKVQ

SEQ ID NO: 1920715 - protein, 6 aa, Staphylococcus
STKNTK

SEQ ID NO: 1920716 - protein, 9 aa, Staphylococcus
STLEEAKNA

SEQ ID NO: 1920717 - protein, 7 aa, Staphylococcus
STLSGGQ

SEQ ID NO: 1920718 - protein, 11 aa, Staphylococcus
STNPDVSIPKE

SEQ ID NO: 1920719 - protein, 6 aa, Staphylococcus
STPYDA

SEQ ID NO: 1920720 - protein, 5 aa, Staphylococcus
STVTG

SEQ ID NO: 1920721 - protein, 16 aa, Staphylococcus
STYRSQNRGGRGVQGM

SEQ ID NO: 1920722 - protein, 4 aa, Staphylococcus
STYV

SEQ ID NO: 1920723 - protein, 15 aa, Staphylococcus
SVAEKKAPGAKIQGD

SEQ ID NO: 1920724 - protein, 8 aa, Staphylococcus
SVASGVPD

SEQ ID NO: 1920725 - protein, 8 aa, Staphylococcus
SVDEPLQT

SEQ ID NO: 1920726 - protein, 16 aa, Staphylococcus
SVDSRTIIDSGGAERL

SEQ ID NO: 1920727 - protein, 6 aa, Staphylococcus
SVEEAI

SEQ ID NO: 1920728 - protein, 5 aa, Staphylococcus
SVEGT

SEQ ID NO: 1920729 - protein, 5 aa, Staphylococcus
SVENG

SEQ ID NO: 1920730 - protein, 4 aa, Staphylococcus
SVGS

SEQ ID NO: 1920731 - protein, 26 aa, Staphylococcus
SVKVGAPTVEGATVTATVNKQGRGKK

SEQ ID NO: 1920732 - protein, 6 aa, Staphylococcus
SVNETS

SEQ ID NO: 1920733 - protein, 32 aa, Staphylococcus; identical to SEQ ID NO: 1790503

SEQ ID NO: 1920734 - protein, 9 aa, Staphylococcus
SVQTGAQNK

SEQ ID NO: 1920735 - protein, 10 aa, Staphylococcus
SVSDDRGRTV

SEQ ID NO: 1920736 - protein, 10 aa, Staphylococcus
SVSKSGTIQE

SEQ ID NO: 1920737 - protein, 7 aa, Staphylococcus
SYEGETI

SEQ ID NO: 1920738 - protein, 5 aa, Staphylococcus
SYELQ

SEQ ID NO: 1920739 - protein, 12 aa, Staphylococcus
SYGDANVEEGDE

SEQ ID NO: 1920740 - protein, 5 aa, Staphylococcus
SYGTG

SEQ ID NO: 1920741 - protein, 25 aa, Staphylococcus
SYGTQSKIIKDDKERLSGEDTREGL

SEQ ID NO: 1920742 - protein, 5 aa, Staphylococcus
SYNRE

SEQ ID NO: 1920743 - protein, 4 aa, Staphylococcus
SYPD

SEQ ID NO: 1920744 - protein, 9 aa, Staphylococcus
SYPGGPQVD

SEQ ID NO: 1920745 - protein, 21 aa, Staphylococcus
SYQQDDRDLRDERRKQKLEPA

SEQ ID NO: 1920746 - protein, 5 aa, Staphylococcus
SYTES

SEQ ID NO: 1920747 - protein, 10 aa, Staphylococcus
SYTSHTNTAI

SEQ ID NO: 1920748 - protein, 5 aa, Staphylococcus
SYYEG

SEQ ID NO: 1920749 - protein, 15 aa, Staphylococcus
SYYQEAGRAGRDGLK

SEQ ID NO: 1920750 - protein, 8 aa, Staphylococcus
TAADGVEA

SEQ ID NO: 1920751 - protein, 18 aa, Staphylococcus
TAAYQAEGATQTDGKGRV

SEQ ID NO: 1920752 - protein, 13 aa, Staphylococcus
TADSIANDGYNDE

SEQ ID NO: 1920753 - protein, 5 aa, Staphylococcus
TAEKN

SEQ ID NO: 1920754 - protein, 5 aa, Staphylococcus
TAENE

SEQ ID NO: 1920755 - protein, 8 aa, Staphylococcus
TAERPGDI

SEQ ID NO: 1920756 - protein, 11 aa, Staphylococcus
TAEVPSTVSGT

SEQ ID NO: 1920757 - protein, 5 aa, Staphylococcus
TAGEM

SEQ ID NO: 1920758 - protein, 21 aa, Staphylococcus
TAGGGGKGIRVARDEKELETG

SEQ ID NO: 1920759 - protein, 13 aa, Staphylococcus
TAGGVNRDRTGPH

SEQ ID NO: 1920760 - protein, 9 aa, Staphylococcus
TAGKGRSGF

SEQ ID NO: 1920761 - protein, 10 aa, Staphylococcus
TAGKGRSGYV

SEQ ID NO: 1920762 - protein, 7 aa, Staphylococcus
TAGNPIA

SEQ ID NO: 1920763 - protein, 4 aa, Staphylococcus
TAGY

SEQ ID NO: 1920764 - protein, 7 aa, Staphylococcus
TAIDYKG

SEQ ID NO: 1920765 - protein, 12 aa, Staphylococcus
TAIGKAGAKNAG

SEQ ID NO: 1920766 - protein, 9 aa, Staphylococcus
TAKESRIQR

SEQ ID NO: 1920767 - protein, 11 aa, Staphylococcus
TAKQLSKIGGG

SEQ ID NO: 1920768 - protein, 12 aa, Staphylococcus
TAMGKEETLSTA

SEQ ID NO: 1920769 - protein, 4 aa, Staphylococcus
TANA

SEQ ID NO: 1920770 - protein, 4 aa, Staphylococcus
TANH

SEQ ID NO: 1920771 - protein, 7 aa, Staphylococcus
TANNGKD

SEQ ID NO: 1920772 - protein, 9 aa, Staphylococcus
TANTGGDKI

SEQ ID NO: 1920773 - protein, 4 aa, Staphylococcus
TAPQ

SEQ ID NO: 1920774 - protein, 12 aa, Staphylococcus
TAPVSTQTLQRD

SEQ ID NO: 1920775 - protein, 8 aa, Staphylococcus
TARKYGLD

SEQ ID NO: 1920776 - protein, 24 aa, Staphylococcus
TARNVTKTHTSNTNTFQSPNHGPL

SEQ ID NO: 1920777 - protein, 9 aa, Staphylococcus
TASAALGRT

SEQ ID NO: 1920778 - protein, 8 aa, Staphylococcus
TASEGGAW

SEQ ID NO: 1920779 - protein, 4 aa, Staphylococcus
TATP

SEQ ID NO: 1920780 - protein, 6 aa, Staphylococcus
TAVDAG

SEQ ID NO: 1920781 - protein, 10 aa, Staphylococcus
TAVETERVQN

SEQ ID NO: 1920782 - protein, 7 aa, Staphylococcus
TAVKNED

SEQ ID NO: 1920783 - protein, 6 aa, Staphylococcus
TAYENG

SEQ ID NO: 1920784 - protein, 8 aa, Staphylococcus
TCGNGNDT

SEQ ID NO: 1920785 - protein, 6 aa, Staphylococcus
TCGNRE

SEQ ID NO: 1920786 - protein, 11 aa, Staphylococcus
TCTDNENGHEI

SEQ ID NO: 1920787 - protein, 6 aa, Staphylococcus
TDAEGR

SEQ ID NO: 1920788 - protein, 4 aa, Staphylococcus
TDDA

SEQ ID NO: 1920789 - protein, 7 aa, Staphylococcus
TDDAERN

SEQ ID NO: 1920790 - protein, 4 aa, Staphylococcus
TDDI

SEQ ID NO: 1920791 - protein, 10 aa, Staphylococcus
TDDPEITSHP

SEQ ID NO: 1920792 - protein, 4 aa, Staphylococcus
TDDS

SEQ ID NO: 1920793 - protein, 5 aa, Staphylococcus
TDEET

SEQ ID NO: 1920794 - protein, 4 aa, Staphylococcus
TDEL

SEQ ID NO: 1920795 - protein, 6 aa, Staphylococcus
TDENRA

SEQ ID NO: 1920796 - protein, 5 aa, Staphylococcus
TDETI

SEQ ID NO: 1920797 - protein, 6 aa, Staphylococcus
TDETIT

SEQ ID NO: 1920798 - protein, 14 aa, Staphylococcus
TDGEPFAGDPRNNL

SEQ ID NO: 1920799 - protein, 14 aa, Staphylococcus
TDGTPFEGDPRANL

SEQ ID NO: 1920800 - protein, 8 aa, Staphylococcus
TDKGTGIK

SEQ ID NO: 1920801 - protein, 9 aa, Staphylococcus
TDKNEYEAD

SEQ ID NO: 1920802 - protein, 9 aa, Staphylococcus
TDKPDPFLG

SEQ ID NO: 1920803 - protein, 9 aa, Staphylococcus
TDKPDPLLG

SEQ ID NO: 1920804 - protein, 7 aa, Staphylococcus
TDKRVSP

SEQ ID NO: 1920805 - protein, 7 aa, Staphylococcus
TDKSYQL

SEQ ID NO: 1920806 - protein, 4 aa, Staphylococcus
TDLT

SEQ ID NO: 1920807 - protein, 8 aa, Staphylococcus
TDNPTDDL

SEQ ID NO: 1920808 - protein, 5 aa, Staphylococcus
TDQQL

SEQ ID NO: 1920809 - protein, 4 aa, Staphylococcus
TDRI

SEQ ID NO: 1920810 - protein, 5 aa, Staphylococcus
TDRIG

SEQ ID NO: 1920811 - protein, 4 aa, Staphylococcus
TDSM

SEQ ID NO: 1920812 - protein, 6 aa, Staphylococcus
TDTLEE

SEQ ID NO: 1920813 - protein, 4 aa, Staphylococcus
TDYS

SEQ ID NO: 1920814 - protein, 12 aa, Staphylococcus
TEAAKGNSLTKK

SEQ ID NO: 1920815 - protein, 8 aa, Staphylococcus
TEASSTSE

SEQ ID NO: 1920816 - protein, 9 aa, Staphylococcus
TEAVTEGVP

SEQ ID NO: 1920817 - protein, 9 aa, Staphylococcus
TEDMKRQSK

SEQ ID NO: 1920818 - protein, 9 aa, Staphylococcus
TEDNRSDLG

SEQ ID NO: 1920819 - protein, 4 aa, Staphylococcus
TEDV

SEQ ID NO: 1920820 - protein, 4 aa, Staphylococcus
TEEG

SEQ ID NO: 1920821 - protein, 16 aa, Staphylococcus
TEGGHAEHTPETEEYG

SEQ ID NO: 1920822 - protein, 5 aa, Staphylococcus
TEHPG

SEQ ID NO: 1920823 - protein, 15 aa, Staphylococcus
TEIEEGTLSATGSGL

SEQ ID NO: 1920824 - protein, 6 aa, Staphylococcus
TEIENG

SEQ ID NO: 1920825 - protein, 5 aa, Staphylococcus
TEIGE

SEQ ID NO: 1920826 - protein, 5 aa, Staphylococcus
TEIND

SEQ ID NO: 1920827 - protein, 13 aa, Staphylococcus
TEKQGVNKAAVSR

SEQ ID NO: 1920828 - protein, 6 aa, Staphylococcus
TEKQRI

SEQ ID NO: 1920829 - protein, 13 aa, Staphylococcus
TEKQSGKSIENRP

SEQ ID NO: 1920830 - protein, 5 aa, Staphylococcus
TELDG

SEQ ID NO: 1920831 - protein, 5 aa, Staphylococcus
TELNG

SEQ ID NO: 1920832 - protein, 6 aa, Staphylococcus
TELSPR

SEQ ID NO: 1920833 - protein, 4 aa, Staphylococcus
TEQG

SEQ ID NO: 1920834 - protein, 27 aa, Staphylococcus
TERHESRRIDDQLRGRSGRQGDKGDSR

SEQ ID NO: 1920835 - protein, 4 aa, Staphylococcus
TERI

SEQ ID NO: 1920836 - protein, 5 aa, Staphylococcus
TERLQ

SEQ ID NO: 1920837 - protein, 17 aa, Staphylococcus
TERQRIQDKQKALNEAQ

SEQ ID NO: 1920838 - protein, 7 aa, Staphylococcus
TERQTKD

SEQ ID NO: 1920839 - protein, 9 aa, Staphylococcus
TESITPYEG

SEQ ID NO: 1920840 - protein, 7 aa, Staphylococcus
TESKFDR

SEQ ID NO: 1920841 - protein, 4 aa, Staphylococcus
TESY

SEQ ID NO: 1920842 - protein, 5 aa, Staphylococcus
TESYC

SEQ ID NO: 1920843 - protein, 7 aa, Staphylococcus
TETGDIQ

SEQ ID NO: 1920844 - protein, 15 aa, Staphylococcus
TEVVETARDSLVIGI

SEQ ID NO: 1920845 - protein, 11 aa, Staphylococcus
TFDQTELSGDY

SEQ ID NO: 1920846 - protein, 15 aa, Staphylococcus
TFPDGTKLITIHHPI

SEQ ID NO: 1920847 - protein, 4 aa, Staphylococcus
TGAE

SEQ ID NO: 1920848 - protein, 11 aa, Staphylococcus
TGAHGKTSTTG

SEQ ID NO: 1920849 - protein, 6 aa, Staphylococcus
TGASAI

SEQ ID NO: 1920850 - protein, 16 aa, Staphylococcus
TGDANDYVGKGLSGGT

SEQ ID NO: 1920851 - protein, 18 aa, Staphylococcus
TGDLVTPQQQAMNSETVS

SEQ ID NO: 1920852 - protein, 37 aa, Staphylococcus
TGDQMTQDGPHRKGDKRRARAAAQNIVPNSTGAAKAI

SEQ ID NO: 1920853 - protein, 23 aa, Staphylococcus
TGDQNTQDAPHRKGDKRRARAAA

SEQ ID NO: 1920854 - protein, 7 aa, Staphylococcus
TGDSQFD

SEQ ID NO: 1920855 - protein, 5 aa, Staphylococcus
TGDTV

SEQ ID NO: 1920856 - protein, 9 aa, Staphylococcus
TGEDGEEAV

SEQ ID NO: 1920857 - protein, 9 aa, Staphylococcus
TGEDIHPST

SEQ ID NO: 1920858 - protein, 7 aa, Staphylococcus
TGELSPK

SEQ ID NO: 1920859 - protein, 15 aa, Staphylococcus
TGFTNSEEQANGTTE

SEQ ID NO: 1920860 - protein, 8 aa, Staphylococcus
TGGDETDL

SEQ ID NO: 1920861 - protein, 5 aa, Staphylococcus
TGGES

SEQ ID NO: 1920862 - protein, 8 aa, Staphylococcus
TGGQPNEL

SEQ ID NO: 1920863 - protein, 4 aa, Staphylococcus
TGGR

SEQ ID NO: 1920864 - protein, 8 aa, Staphylococcus
TGIKESKH

SEQ ID NO: 1920865 - protein, 8 aa, Staphylococcus
TGIPESKH

SEQ ID NO: 1920866 - protein, 8 aa, Staphylococcus
TGKEGEPQ

SEQ ID NO: 1920867 - protein, 15 aa, Staphylococcus
TGKETEGYKGSTTFT

SEQ ID NO: 1920868 - protein, 12 aa, Staphylococcus
TGKSSTSEDANE

SEQ ID NO: 1920869 - protein, 4 aa, Staphylococcus
TGLS

SEQ ID NO: 1920870 - protein, 16 aa, Staphylococcus
TGMIGDPSGKSEERVL

SEQ ID NO: 1920871 - protein, 13 aa, Staphylococcus
TGNATYVESDKGS

SEQ ID NO: 1920872 - protein, 13 aa, Staphylococcus
TGNATYVESEKGS

SEQ ID NO: 1920873 - protein, 23 aa, Staphylococcus
TGNDTRGAEASAHAYASRDGQYR

SEQ ID NO: 1920874 - protein, 8 aa, Staphylococcus
TGNEGEPQ

SEQ ID NO: 1920875 - protein, 13 aa, Staphylococcus
TGNGVSPRPIPGV

SEQ ID NO: 1920876 - protein, 5 aa, Staphylococcus
TGNIN

SEQ ID NO: 1920877 - protein, 9 aa, Staphylococcus
TGNSGTTTR

SEQ ID NO: 1920878 - protein, 12 aa, Staphylococcus
TGNYNDKTAKLY

SEQ ID NO: 1920879 - protein, 10 aa, Staphylococcus
TGPISKSGMN

SEQ ID NO: 1920880 - protein, 6 aa, Staphylococcus
TGPTEV

SEQ ID NO: 1920881 - protein, 6 aa, Staphylococcus
TGQDAV

SEQ ID NO: 1920882 - protein, 21 aa, Staphylococcus
TGQNPQSGHAVAENALKILAN

SEQ ID NO: 1920883 - protein, 12 aa, Staphylococcus
TGRAQKNVAEEA

SEQ ID NO: 1920884 - protein, 10 aa, Staphylococcus
TGTHRDQTRD

SEQ ID NO: 1920885 - protein, 11 aa, Staphylococcus
TGTNGKTTTTS

SEQ ID NO: 1920886 - protein, 27 aa, Staphylococcus
TGTPPRVNAKTIDYSKTEIQPGDDVGR

SEQ ID NO: 1920887 - protein, 10 aa, Staphylococcus
TGTQSKLSGL

SEQ ID NO: 1920888 - protein, 4 aa, Staphylococcus
TGVE

SEQ ID NO: 1920889 - protein, 8 aa, Staphylococcus
TGVGKTEL

SEQ ID NO: 1920890 - protein, 11 aa, Staphylococcus
TGVGKTELAKS

SEQ ID NO: 1920891 - protein, 4 aa, Staphylococcus
TGYG

SEQ ID NO: 1920892 - protein, 6 aa, Staphylococcus
TGYPFV

SEQ ID NO: 1920893 - protein, 4 aa, Staphylococcus
THDE

SEQ ID NO: 1920894 - protein, 10 aa, Staphylococcus
THGTAPKYAD

SEQ ID NO: 1920895 - protein, 5 aa, Staphylococcus
THHSV

SEQ ID NO: 1920896 - protein, 4 aa, Staphylococcus
THKD

SEQ ID NO: 1920897 - protein, 14 aa, Staphylococcus
THPGSPNGEFTKET

SEQ ID NO: 1920898 - protein, 4 aa, Staphylococcus
THPN

SEQ ID NO: 1920899 - protein, 4 aa, Staphylococcus
THQT

SEQ ID NO: 1920900 - protein, 14 aa, Staphylococcus
THTGQGAIGLVVLR

SEQ ID NO: 1920901 - protein, 4 aa, Staphylococcus
TIEG

SEQ ID NO: 1920902 - protein, 4 aa, Staphylococcus
TIET

SEQ ID NO: 1920903 - protein, 6 aa, Staphylococcus
TIPFDQ

SEQ ID NO: 1920904 - protein, 19 aa, Staphylococcus
TISDLGREKVSKMSPATDF

SEQ ID NO: 1920905 - protein, 5 aa, Staphylococcus
TISKA

SEQ ID NO: 1920906 - protein, 5 aa, Staphylococcus
TISSS

SEQ ID NO: 1920907 - protein, 11 aa, Staphylococcus
TITKPRPGHAD

SEQ ID NO: 1920908 - protein, 8 aa, Staphylococcus
TKAGGLPV

SEQ ID NO: 1920909 - protein, 4 aa, Staphylococcus
TKDI

SEQ ID NO: 1920910 - protein, 7 aa, Staphylococcus
TKEDERE

SEQ ID NO: 1920911 - protein, 4 aa, Staphylococcus
TKEE

SEQ ID NO: 1920912 - protein, 9 aa, Staphylococcus
TKEEGPIGK

SEQ ID NO: 1920913 - protein, 7 aa, Staphylococcus
TKEGERD

SEQ ID NO: 1920914 - protein, 6 aa, Staphylococcus
TKEGKD

SEQ ID NO: 1920915 - protein, 11 aa, Staphylococcus
TKEGKDGSVDI

SEQ ID NO: 1920916 - protein, 6 aa, Staphylococcus
TKEGPK

SEQ ID NO: 1920917 - protein, 14 aa, Staphylococcus
TKEGTLSEAGGPQY

SEQ ID NO: 1920918 - protein, 4 aa, Staphylococcus
TKES

SEQ ID NO: 1920919 - protein, 6 aa, Staphylococcus
TKGDKC

SEQ ID NO: 1920920 - protein, 6 aa, Staphylococcus
TKGDRI

SEQ ID NO: 1920921 - protein, 9 aa, Staphylococcus
TKGEPGTGN

SEQ ID NO: 1920922 - protein, 6 aa, Staphylococcus
TKGIGA

SEQ ID NO: 1920923 - protein, 8 aa, Staphylococcus
TKGPEIRT

SEQ ID NO: 1920924 - protein, 9 aa, Staphylococcus
TKGPEIRTH

SEQ ID NO: 1920925 - protein, 4 aa, Staphylococcus
TKGT

SEQ ID NO: 1920926 - protein, 9 aa, Staphylococcus
TKGTAKVEK

SEQ ID NO: 1920927 - protein, 9 aa, Staphylococcus
TKGTEKVDK

SEQ ID NO: 1920928 - protein, 9 aa, Staphylococcus
TKGYPPSVR

SEQ ID NO: 1920929 - protein, 7 aa, Staphylococcus
TKIDGVE

SEQ ID NO: 1920930 - protein, 4 aa, Staphylococcus
TKIE

SEQ ID NO: 1920931 - protein, 9 aa, Staphylococcus
TKKAEVGSE

SEQ ID NO: 1920932 - protein, 12 aa, Staphylococcus
TKLSGTAEKPRL

SEQ ID NO: 1920933 - protein, 7 aa, Staphylococcus
TKNEKKI

SEQ ID NO: 1920934 - protein, 7 aa, Staphylococcus
TKNVQAA

SEQ ID NO: 1920935 - protein, 6 aa, Staphylococcus
TKPCDN

SEQ ID NO: 1920936 - protein, 10 aa, Staphylococcus
TKPDSKIGEI

SEQ ID NO: 1920937 - protein, 9 aa, Staphylococcus
TKPGVSRTS

SEQ ID NO: 1920938 - protein, 6 aa, Staphylococcus
TKPKNL

SEQ ID NO: 1920939 - protein, 5 aa, Staphylococcus
TKRYT

SEQ ID NO: 1920940 - protein, 4 aa, Staphylococcus
TKSI

SEQ ID NO: 1920941 - protein, 10 aa, Staphylococcus
TKTGKAEGDY

SEQ ID NO: 1920942 - protein, 4 aa, Staphylococcus
TKVD

SEQ ID NO: 1920943 - protein, 4 aa, Staphylococcus
TKYL

SEQ ID NO: 1920944 - protein, 6 aa, Staphylococcus
TKYSEA

SEQ ID NO: 1920945 - protein, 7 aa, Staphylococcus
TKYSEAM

SEQ ID NO: 1920946 - protein, 7 aa, Staphylococcus
TKYSESM

SEQ ID NO: 1920947 - protein, 7 aa, Staphylococcus
TLANASN

SEQ ID NO: 1920948 - protein, 7 aa, Staphylococcus
TLDDEDK

SEQ ID NO: 1920949 - protein, 8 aa, Staphylococcus
TLDDEDKE

SEQ ID NO: 1920950 - protein, 14 aa, Staphylococcus
TLDEYRKNIEKDAA

SEQ ID NO: 1920951 - protein, 8 aa, Staphylococcus
TLDKDGVG

SEQ ID NO: 1920952 - protein, 9 aa, Staphylococcus
TLEDPTNLE

SEQ ID NO: 1920953 - protein, 9 aa, Staphylococcus
TLGKTEEDI

SEQ ID NO: 1920954 - protein, 4 aa, Staphylococcus
TLNV

SEQ ID NO: 1920955 - protein, 6 aa, Staphylococcus
TLPEAY

SEQ ID NO: 1920956 - protein, 5 aa, Staphylococcus
TLPQD

SEQ ID NO: 1920957 - protein, 7 aa, Staphylococcus
TLPTPFE

SEQ ID NO: 1920958 - protein, 4 aa, Staphylococcus
TLQE

SEQ ID NO: 1920959 - protein, 5 aa, Staphylococcus
TLSDG

SEQ ID NO: 1920960 - protein, 10 aa, Staphylococcus
TLSPKKNAQL

SEQ ID NO: 1920961 - protein, 4 aa, Staphylococcus
TLTG

SEQ ID NO: 1920962 - protein, 10 aa, Staphylococcus
TMDKSSSTGQ

SEQ ID NO: 1920963 - protein, 5 aa, Staphylococcus
TMDQG

SEQ ID NO: 1920964 - protein, 10 aa, Staphylococcus
TMIGTDEQEI

SEQ ID NO: 1920965 - protein, 11 aa, Staphylococcus
TMIGTDEQEIN

SEQ ID NO: 1920966 - protein, 7 aa, Staphylococcus
TMNPDTR

SEQ ID NO: 1920967 - protein, 5 aa, Staphylococcus
TMNPE

SEQ ID NO: 1920968 - protein, 7 aa, Staphylococcus
TMSSERR

SEQ ID NO: 1920969 - protein, 13 aa, Staphylococcus
TMTKQGQISEEAA

SEQ ID NO: 1920970 - protein, 8 aa, Staphylococcus
TNARTAEV

SEQ ID NO: 1920971 - protein, 5 aa, Staphylococcus
TNDGD

SEQ ID NO: 1920972 - protein, 5 aa, Staphylococcus
TNDLS

SEQ ID NO: 1920973 - protein, 21 aa, Staphylococcus
TNDQNNIDNPHKDLRRARSCN

SEQ ID NO: 1920974 - protein, 27 aa, Staphylococcus
TNEAMNKADELTQERLGKHTQGLNIPG

SEQ ID NO: 1920975 - protein, 8 aa, Staphylococcus
TNEHETQQ

SEQ ID NO: 1920976 - protein, 6 aa, Staphylococcus
TNELAD

SEQ ID NO: 1920977 - protein, 15 aa, Staphylococcus
TNELNASYAADGYAR

SEQ ID NO: 1920978 - protein, 5 aa, Staphylococcus
TNETG

SEQ ID NO: 1920979 - protein, 9 aa, Staphylococcus
TNEYGTAPV

SEQ ID NO: 1920980 - protein, 5 aa, Staphylococcus
TNGDA

SEQ ID NO: 1920981 - protein, 11 aa, Staphylococcus
TNGDIPDYQAS

SEQ ID NO: 1920982 - protein, 5 aa, Staphylococcus
TNGEA

SEQ ID NO: 1920983 - protein, 7 aa, Staphylococcus
TNGTARS

SEQ ID NO: 1920984 - protein, 4 aa, Staphylococcus
TNIE

SEQ ID NO: 1920985 - protein, 10 aa, Staphylococcus
TNKEREEAQN

SEQ ID NO: 1920986 - protein, 6 aa, Staphylococcus
TNKNEK

SEQ ID NO: 1920987 - protein, 6 aa, Staphylococcus
TNKRGY

SEQ ID NO: 1920988 - protein, 8 aa, Staphylococcus
TNQNDTSS

SEQ ID NO: 1920989 - protein, 6 aa, Staphylococcus
TNQTGH

SEQ ID NO: 1920990 - protein, 8 aa, Staphylococcus
TNQTGHRE

SEQ ID NO: 1920991 - protein, 8 aa, Staphylococcus
TNTGELSV

SEQ ID NO: 1920992 - protein, 5 aa, Staphylococcus
TNTIG

SEQ ID NO: 1920993 - protein, 12 aa, Staphylococcus
TNTNPEPVNFFS

SEQ ID NO: 1920994 - protein, 8 aa, Staphylococcus
TNVPTTRN

SEQ ID NO: 1920995 - protein, 13 aa, Staphylococcus
TPDLSKNNGYRDR

SEQ ID NO: 1920996 - protein, 6 aa, Staphylococcus
TPDPEC

SEQ ID NO: 1920997 - protein, 4 aa, Staphylococcus
TPEN

SEQ ID NO: 1920998 - protein, 6 aa, Staphylococcus
TPEREK

SEQ ID NO: 1920999 - protein, 8 aa, Staphylococcus
TPFTNNEV

SEQ ID NO: 1921000 - protein, 4 aa, Staphylococcus
TPGI

SEQ ID NO: 1921001 - protein, 5 aa, Staphylococcus
TPGIR

SEQ ID NO: 1921002 - protein, 5 aa, Staphylococcus
TPGVT

SEQ ID NO: 1921003 - protein, 6 aa, Staphylococcus
TPIGRY

SEQ ID NO: 1921004 - protein, 5 aa, Staphylococcus
TPINR

SEQ ID NO: 1921005 - protein, 17 aa, Staphylococcus
TPKEMGGQGGNDTNPEQ

SEQ ID NO: 1921006 - protein, 6 aa, Staphylococcus
TPKHLD

SEQ ID NO: 1921007 - protein, 4 aa, Staphylococcus
TPKL

SEQ ID NO: 1921008 - protein, 5 aa, Staphylococcus
TPKSI

SEQ ID NO: 1921009 - protein, 6 aa, Staphylococcus
TPLEDG

SEQ ID NO: 1921010 - protein, 6 aa, Staphylococcus
TPLEEG

SEQ ID NO: 1921011 - protein, 14 aa, Staphylococcus
TPLGHDSKQELGSE

SEQ ID NO: 1921012 - protein, 9 aa, Staphylococcus
TPLKNRDQS

SEQ ID NO: 1921013 - protein, 6 aa, Staphylococcus
TPMGEG

SEQ ID NO: 1921014 - protein, 5 aa, Staphylococcus
TPNAL

SEQ ID NO: 1921015 - protein, 6 aa, Staphylococcus
TPNALT

SEQ ID NO: 1921016 - protein, 9 aa, Staphylococcus
TPNETGGGF

SEQ ID NO: 1921017 - protein, 10 aa, Staphylococcus
TPNIPEAEEI

SEQ ID NO: 1921018 - protein, 6 aa, Staphylococcus
TPNKVF

SEQ ID NO: 1921019 - protein, 4 aa, Staphylococcus
TPNR

SEQ ID NO: 1921020 - protein, 4 aa, Staphylococcus
TPQG

SEQ ID NO: 1921021 - protein, 8 aa, Staphylococcus
TPSEHTAR

SEQ ID NO: 1921022 - protein, 6 aa, Staphylococcus
TPSNPL

SEQ ID NO: 1921023 - protein, 4 aa, Staphylococcus
TPSQ

SEQ ID NO: 1921024 - protein, 5 aa, Staphylococcus
TPTRI

SEQ ID NO: 1921025 - protein, 5 aa, Staphylococcus
TPVTT

SEQ ID NO: 1921026 - protein, 9 aa, Staphylococcus
TPYKESDIE

SEQ ID NO: 1921027 - protein, 6 aa, Staphylococcus
TPYPPG

SEQ ID NO: 1921028 - protein, 4 aa, Staphylococcus
TPYT

SEQ ID NO: 1921029 - protein, 5 aa, Staphylococcus
TPYTF

SEQ ID NO: 1921030 - protein, 6 aa, Staphylococcus
TQAGDI

SEQ ID NO: 1921031 - protein, 11 aa, Staphylococcus
TQEEGAGNEIQ

SEQ ID NO: 1921032 - protein, 4 aa, Staphylococcus
TQEH

SEQ ID NO: 1921033 - protein, 5 aa, Staphylococcus
TQEKF

SEQ ID NO: 1921034 - protein, 8 aa, Staphylococcus
TQELREQG

SEQ ID NO: 1921035 - protein, 12 aa, Staphylococcus
TQGEGDPPDNAA

SEQ ID NO: 1921036 - protein, 10 aa, Staphylococcus
TQGLHNRGTF

SEQ ID NO: 1921037 - protein, 5 aa, Staphylococcus
TQIEK

SEQ ID NO: 1921038 - protein, 11 aa, Staphylococcus
TQKEGAGNEIQ

SEQ ID NO: 1921039 - protein, 6 aa, Staphylococcus
TQLQAT

SEQ ID NO: 1921040 - protein, 5 aa, Staphylococcus
TQNNL

SEQ ID NO: 1921041 - protein, 6 aa, Staphylococcus
TQQAGL

SEQ ID NO: 1921042 - protein, 8 aa, Staphylococcus
TQQSLSNY

SEQ ID NO: 1921043 - protein, 6 aa, Staphylococcus
TQRKKI

SEQ ID NO: 1921044 - protein, 5 aa, Staphylococcus
TQVGQ

SEQ ID NO: 1921045 - protein, 6 aa, Staphylococcus
TQVNGV

SEQ ID NO: 1921046 - protein, 10 aa, Staphylococcus
TRADKGTRKI

SEQ ID NO: 1921047 - protein, 5 aa, Staphylococcus
TRAEE

SEQ ID NO: 1921048 - protein, 9 aa, Staphylococcus
TRDRKPVTV

SEQ ID NO: 1921049 - protein, 6 aa, Staphylococcus
TRGQTQ

SEQ ID NO: 1921050 - protein, 8 aa, Staphylococcus
TRNEDKGF

SEQ ID NO: 1921051 - protein, 6 aa, Staphylococcus
TRPDTI

SEQ ID NO: 1921052 - protein, 7 aa, Staphylococcus
TRPDTIY

SEQ ID NO: 1921053 - protein, 4 aa, Staphylococcus
TRQD

SEQ ID NO: 1921054 - protein, 4 aa, Staphylococcus
TRTG

SEQ ID NO: 1921055 - protein, 6 aa, Staphylococcus
TRVPEN

SEQ ID NO: 1921056 - protein, 11 aa, Staphylococcus
TSACSSKREKL

SEQ ID NO: 1921057 - protein, 4 aa, Staphylococcus
TSAE

SEQ ID NO: 1921058 - protein, 5 aa, Staphylococcus
TSAQQ

SEQ ID NO: 1921059 - protein, 7 aa, Staphylococcus
TSAYSRQ

SEQ ID NO: 1921060 - protein, 4 aa, Staphylococcus
TSDA

SEQ ID NO: 1921061 - protein, 8 aa, Staphylococcus
TSDIGKDI

SEQ ID NO: 1921062 - protein, 6 aa, Staphylococcus
TSEAFK

SEQ ID NO: 1921063 - protein, 4 aa, Staphylococcus
TSED

SEQ ID NO: 1921064 - protein, 6 aa, Staphylococcus
TSEGPK

SEQ ID NO: 1921065 - protein, 24 aa, Staphylococcus
TSEGVITDKEARKRNVGGEIIAYV

SEQ ID NO: 1921066 - protein, 8 aa, Staphylococcus
TSEIGKDI

SEQ ID NO: 1921067 - protein, 9 aa, Staphylococcus
TSELKKGRQ

SEQ ID NO: 1921068 - protein, 11 aa, Staphylococcus
TSENQALGQGG

SEQ ID NO: 1921069 - protein, 9 aa, Staphylococcus
TSEQTPSSV

SEQ ID NO: 1921070 - protein, 7 aa, Staphylococcus
TSETVGF

SEQ ID NO: 1921071 - protein, 12 aa, Staphylococcus
TSETVGYRKPHP

SEQ ID NO: 1921072 - protein, 9 aa, Staphylococcus
TSGGGGKGM

SEQ ID NO: 1921073 - protein, 21 aa, Staphylococcus
TSGREEVENNLSQNIGELGKT

SEQ ID NO: 1921074 - protein, 8 aa, Staphylococcus
TSGSFSDR

SEQ ID NO: 1921075 - protein, 10 aa, Staphylococcus
TSGTTGNPKA

SEQ ID NO: 1921076 - protein, 14 aa, Staphylococcus
TSGTTGNPKAVTHT

SEQ ID NO: 1921077 - protein, 6 aa, Staphylococcus
TSGWTG

SEQ ID NO: 1921078 - protein, 6 aa, Staphylococcus
TSGYET

SEQ ID NO: 1921079 - protein, 4 aa, Staphylococcus
TSHA

SEQ ID NO: 1921080 - protein, 5 aa, Staphylococcus
TSHAK

SEQ ID NO: 1921081 - protein, 9 aa, Staphylococcus
TSIEGELPE

SEQ ID NO: 1921082 - protein, 4 aa, Staphylococcus
TSIY

SEQ ID NO: 1921083 - protein, 5 aa, Staphylococcus
TSNKT

SEQ ID NO: 1921084 - protein, 4 aa, Staphylococcus
TSNP

SEQ ID NO: 1921085 - protein, 9 aa, Staphylococcus
TSPSFSPDK

SEQ ID NO: 1921086 - protein, 9 aa, Staphylococcus
TSPSFTSDK

SEQ ID NO: 1921087 - protein, 7 aa, Staphylococcus
TSPTPDK

SEQ ID NO: 1921088 - protein, 8 aa, Staphylococcus
TSPTPDKI

SEQ ID NO: 1921089 - protein, 7 aa, Staphylococcus
TSQTGET

SEQ ID NO: 1921090 - protein, 6 aa, Staphylococcus
TSRAIN

SEQ ID NO: 1921091 - protein, 9 aa, Staphylococcus
TSRTPDDLD

SEQ ID NO: 1921092 - protein, 8 aa, Staphylococcus
TSSEKFTN

SEQ ID NO: 1921093 - protein, 4 aa, Staphylococcus
TSSM

SEQ ID NO: 1921094 - protein, 9 aa, Staphylococcus
TSSVQDETQ

SEQ ID NO: 1921095 - protein, 9 aa, Staphylococcus
TSTERPEVL

SEQ ID NO: 1921096 - protein, 4 aa, Staphylococcus
TSTP

SEQ ID NO: 1921097 - protein, 6 aa, Staphylococcus
TSVPEE

SEQ ID NO: 1921098 - protein, 4 aa, Staphylococcus
TSYD

SEQ ID NO: 1921099 - protein, 4 aa, Staphylococcus
TSYG

SEQ ID NO: 1921100 - protein, 5 aa, Staphylococcus
TSYGV

SEQ ID NO: 1921101 - protein, 4 aa, Staphylococcus
TSYH

SEQ ID NO: 1921102 - protein, 5 aa, Staphylococcus
TTAGE

SEQ ID NO: 1921103 - protein, 5 aa, Staphylococcus
TTAQG

SEQ ID NO: 1921104 - protein, 18 aa, Staphylococcus
TTDPTKEINVETTSNLNT

SEQ ID NO: 1921105 - protein, 6 aa, Staphylococcus
TTEDFK

SEQ ID NO: 1921106 - protein, 5 aa, Staphylococcus
TTELP

SEQ ID NO: 1921107 - protein, 7 aa, Staphylococcus
TTELQPE

SEQ ID NO: 1921108 - protein, 11 aa, Staphylococcus
TTESVQEAQTR

SEQ ID NO: 1921109 - protein, 6 aa, Staphylococcus
TTFDPH

SEQ ID NO: 1921110 - protein, 16 aa, Staphylococcus
TTFGNHDTENHLSRSD

SEQ ID NO: 1921111 - protein, 8 aa, Staphylococcus
TTGEKEKL

SEQ ID NO: 1921112 - protein, 6 aa, Staphylococcus
TTGLHE

SEQ ID NO: 1921113 - protein, 5 aa, Staphylococcus
TTGLP

SEQ ID NO: 1921114 - protein, 10 aa, Staphylococcus
TTGRQQMTKT

SEQ ID NO: 1921115 - protein, 4 aa, Staphylococcus
TTHE

SEQ ID NO: 1921116 - protein, 13 aa, Staphylococcus
TTIIGGGDSAAAA

SEQ ID NO: 1921117 - protein, 4 aa, Staphylococcus
TTIN

SEQ ID NO: 1921118 - protein, 20 aa, Staphylococcus
TTIPTSKSQVYSTAADNQPA

SEQ ID NO: 1921119 - protein, 4 aa, Staphylococcus
TTKN

SEQ ID NO: 1921120 - protein, 5 aa, Staphylococcus
TTKVD

SEQ ID NO: 1921121 - protein, 10 aa, Staphylococcus
TTLSGGEAQR

SEQ ID NO: 1921122 - protein, 6 aa, Staphylococcus
TTPDGY

SEQ ID NO: 1921123 - protein, 15 aa, Staphylococcus
TTPNQDNPLTEGKTP

SEQ ID NO: 1921124 - protein, 16 aa, Staphylococcus
TTPNQDNPLTEGKTPI

SEQ ID NO: 1921125 - protein, 6 aa, Staphylococcus
TTPQAE

SEQ ID NO: 1921126 - protein, 6 aa, Staphylococcus
TTQGYR

SEQ ID NO: 1921127 - protein, 9 aa, Staphylococcus
TTSASDIAD

SEQ ID NO: 1921128 - protein, 4 aa, Staphylococcus
TTSL

SEQ ID NO: 1921129 - protein, 6 aa, Staphylococcus
TTTSEI

SEQ ID NO: 1921130 - protein, 6 aa, Staphylococcus
TTVENG

SEQ ID NO: 1921131 - protein, 12 aa, Staphylococcus
TVEKDSKTMKKF

SEQ ID NO: 1921132 - protein, 5 aa, Staphylococcus
TVENG

SEQ ID NO: 1921133 - protein, 7 aa, Staphylococcus
TVGGGTK

SEQ ID NO: 1921134 - protein, 6 aa, Staphylococcus
TVGGND

SEQ ID NO: 1921135 - protein, 5 aa, Staphylococcus
TVGID

SEQ ID NO: 1921136 - protein, 10 aa, Staphylococcus
TVGNGGNIAR

SEQ ID NO: 1921137 - protein, 6 aa, Staphylococcus
TVGNTV

SEQ ID NO: 1921138 - protein, 7 aa, Staphylococcus
TVHDEES

SEQ ID NO: 1921139 - protein, 6 aa, Staphylococcus
TVNQDD

SEQ ID NO: 1921140 - protein, 7 aa, Staphylococcus
TVNQDDI

SEQ ID NO: 1921141 - protein, 6 aa, Staphylococcus
TVPGDI

SEQ ID NO: 1921142 - protein, 9 aa, Staphylococcus
TVPGPNAGL

SEQ ID NO: 1921143 - protein, 5 aa, Staphylococcus
TVPQD

SEQ ID NO: 1921144 - protein, 8 aa, Staphylococcus
TWTNRPGA

SEQ ID NO: 1921145 - protein, 6 aa, Staphylococcus
TYAGKK

SEQ ID NO: 1921146 - protein, 4 aa, Staphylococcus
TYER

SEQ ID NO: 1921147 - protein, 12 aa, Staphylococcus
TYESIGKPLPNR

SEQ ID NO: 1921148 - protein, 12 aa, Staphylococcus
TYETENESIVTD

SEQ ID NO: 1921149 - protein, 13 aa, Staphylococcus
TYETENESVVTDK

SEQ ID NO: 1921150 - protein, 14 aa, Staphylococcus
TYEYKEKPYEKDYG

SEQ ID NO: 1921151 - protein, 11 aa, Staphylococcus
TYGPKTHGIKD

SEQ ID NO: 1921152 - protein, 11 aa, Staphylococcus
TYGPKTHGIKN

SEQ ID NO: 1921153 - protein, 9 aa, Staphylococcus
TYGPTEATV

SEQ ID NO: 1921154 - protein, 4 aa, Staphylococcus
TYGQ

SEQ ID NO: 1921155 - protein, 5 aa, Staphylococcus
TYGQR

SEQ ID NO: 1921156 - protein, 8 aa, Staphylococcus
TYGTDEHP

SEQ ID NO: 1921157 - protein, 13 aa, Staphylococcus
TYNPAHVNAPEVK

SEQ ID NO: 1921158 - protein, 13 aa, Staphylococcus
TYNPASVNAPEVK

SEQ ID NO: 1921159 - protein, 4 aa, Staphylococcus
TYPE

SEQ ID NO: 1921160 - protein, 6 aa, Staphylococcus
TYQDNE

SEQ ID NO: 1921161 - protein, 9 aa, Staphylococcus
TYQNSATKI

SEQ ID NO: 1921162 - protein, 15 aa, Staphylococcus
TYRAQNRGGRGVQGM

SEQ ID NO: 1921163 - protein, 8 aa, Staphylococcus
TYRTTPDL

SEQ ID NO: 1921164 - protein, 4 aa, Staphylococcus
TYSD

SEQ ID NO: 1921165 - protein, 4 aa, Staphylococcus
TYSE

SEQ ID NO: 1921166 - protein, 12 aa, Staphylococcus
TYSKSSVKDRYT

SEQ ID NO: 1921167 - protein, 4 aa, Staphylococcus
TYSS

SEQ ID NO: 1921168 - protein, 6 aa, Staphylococcus
VAASYS

SEQ ID NO: 1921169 - protein, 11 aa, Staphylococcus
VADELGGQGLG

SEQ ID NO: 1921170 - protein, 13 aa, Staphylococcus
VADGGGLSRTDEK

SEQ ID NO: 1921171 - protein, 12 aa, Staphylococcus
VADQNDKKPTHK

SEQ ID NO: 1921172 - protein, 5 aa, Staphylococcus
VADTV

SEQ ID NO: 1921173 - protein, 15 aa, Staphylococcus
VAGERGAADAERDIR

SEQ ID NO: 1921174 - protein, 7 aa, Staphylococcus
VAGGGTA

SEQ ID NO: 1921175 - protein, 9 aa, Staphylococcus
VAGNGASDI

SEQ ID NO: 1921176 - protein, 15 aa, Staphylococcus
VAGSGKNGRITKEDI

SEQ ID NO: 1921177 - protein, 9 aa, Staphylococcus
VAGSGKSSL

SEQ ID NO: 1921178 - protein, 10 aa, Staphylococcus
VAGSGKSSLV

SEQ ID NO: 1921179 - protein, 9 aa, Staphylococcus
VAGSGKSTL

SEQ ID NO: 1921180 - protein, 7 aa, Staphylococcus
VAGTTRD

SEQ ID NO: 1921181 - protein, 10 aa, Staphylococcus
VAKAGTDVKV

SEQ ID NO: 1921182 - protein, 6 aa, Staphylococcus
VAPGPF

SEQ ID NO: 1921183 - protein, 6 aa, Staphylococcus
VAPSPI

SEQ ID NO: 1921184 - protein, 31 aa, Staphylococcus; identical to SEQ ID NO: 1758872

SEQ ID NO: 1921185 - protein, 6 aa, Staphylococcus
VATSFQ

SEQ ID NO: 1921186 - protein, 12 aa, Staphylococcus
VDDEDATERKVD

SEQ ID NO: 1921187 - protein, 5 aa, Staphylococcus
VDEDN

SEQ ID NO: 1921188 - protein, 10 aa, Staphylococcus
VDESNAKAEL

SEQ ID NO: 1921189 - protein, 7 aa, Staphylococcus
VDEYNQE

SEQ ID NO: 1921190 - protein, 4 aa, Staphylococcus
VDGK

SEQ ID NO: 1921191 - protein, 8 aa, Staphylococcus
VDGKGPIG

SEQ ID NO: 1921192 - protein, 8 aa, Staphylococcus
VDGQGPIG

SEQ ID NO: 1921193 - protein, 5 aa, Staphylococcus
VDITN

SEQ ID NO: 1921194 - protein, 7 aa, Staphylococcus
VDKATED

SEQ ID NO: 1921195 - protein, 8 aa, Staphylococcus
VDKATENY

SEQ ID NO: 1921196 - protein, 5 aa, Staphylococcus
VDKGT

SEQ ID NO: 1921197 - protein, 13 aa, Staphylococcus
VDKPRNLAKSVTV

SEQ ID NO: 1921198 - protein, 10 aa, Staphylococcus
VDKPTANPDR

SEQ ID NO: 1921199 - protein, 5 aa, Staphylococcus
VDKSG

SEQ ID NO: 1921200 - protein, 10 aa, Staphylococcus
VDMTSPEPIE

SEQ ID NO: 1921201 - protein, 10 aa, Staphylococcus
VDMTTPEPIE

SEQ ID NO: 1921202 - protein, 7 aa, Staphylococcus
VDPAANP

SEQ ID NO: 1921203 - protein, 5 aa, Staphylococcus
VDSDE

SEQ ID NO: 1921204 - protein, 6 aa, Staphylococcus
VDSGGK

SEQ ID NO: 1921205 - protein, 7 aa, Staphylococcus
VDSGGKG

SEQ ID NO: 1921206 - protein, 8 aa, Staphylococcus
VDSGGKGL

SEQ ID NO: 1921207 - protein, 12 aa, Staphylococcus
VDSLASEAREKL

SEQ ID NO: 1921208 - protein, 7 aa, Staphylococcus
VDSTGEI

SEQ ID NO: 1921209 - protein, 5 aa, Staphylococcus
VDTGD

SEQ ID NO: 1921210 - protein, 7 aa, Staphylococcus
VDYETTD

SEQ ID NO: 1921211 - protein, 5 aa, Staphylococcus
VDYRP

SEQ ID NO: 1921212 - protein, 9 aa, Staphylococcus
VDYRSQTDN

SEQ ID NO: 1921213 - protein, 6 aa, Staphylococcus
VEAGRY

SEQ ID NO: 1921214 - protein, 7 aa, Staphylococcus
VEAGRYE

SEQ ID NO: 1921215 - protein, 6 aa, Staphylococcus
VEAPKS

SEQ ID NO: 1921216 - protein, 10 aa, Staphylococcus
VEEAHKNDKQ

SEQ ID NO: 1921217 - protein, 7 aa, Staphylococcus
VEEESTF

SEQ ID NO: 1921218 - protein, 12 aa, Staphylococcus
VEEGQGTLSDAV

SEQ ID NO: 1921219 - protein, 5 aa, Staphylococcus
VEEND

SEQ ID NO: 1921220 - protein, 4 aa, Staphylococcus
VEEY

SEQ ID NO: 1921221 - protein, 5 aa, Staphylococcus
VEGAE

SEQ ID NO: 1921222 - protein, 9 aa, Staphylococcus
VEGDSPDDL

SEQ ID NO: 1921223 - protein, 5 aa, Staphylococcus
VEGPP

SEQ ID NO: 1921224 - protein, 7 aa, Staphylococcus
VEKPQSY

SEQ ID NO: 1921225 - protein, 4 aa, Staphylococcus
VENG

SEQ ID NO: 1921226 - protein, 4 aa, Staphylococcus
VEPG

SEQ ID NO: 1921227 - protein, 5 aa, Staphylococcus
VEPKV

SEQ ID NO: 1921228 - protein, 7 aa, Staphylococcus
VEQDPAA

SEQ ID NO: 1921229 - protein, 6 aa, Staphylococcus
VEQPGA

SEQ ID NO: 1921230 - protein, 10 aa, Staphylococcus
VERSRKALSQ

SEQ ID NO: 1921231 - protein, 8 aa, Staphylococcus
VESETPAI

SEQ ID NO: 1921232 - protein, 7 aa, Staphylococcus
VESGRYD

SEQ ID NO: 1921233 - protein, 4 aa, Staphylococcus
VESY

SEQ ID NO: 1921234 - protein, 10 aa, Staphylococcus
VETDEDISKE

SEQ ID NO: 1921235 - protein, 5 aa, Staphylococcus
VETED

SEQ ID NO: 1921236 - protein, 6 aa, Staphylococcus
VETESD

SEQ ID NO: 1921237 - protein, 5 aa, Staphylococcus
VETGD

SEQ ID NO: 1921238 - protein, 5 aa, Staphylococcus
VETPK

SEQ ID NO: 1921239 - protein, 4 aa, Staphylococcus
VETV

SEQ ID NO: 1921240 - protein, 10 aa, Staphylococcus
VEVTTGPLGQ

SEQ ID NO: 1921241 - protein, 11 aa, Staphylococcus
VFSEPASNASI

SEQ ID NO: 1921242 - protein, 20 aa, Staphylococcus
VGANSEQLSAMNHDSLIKEY

SEQ ID NO: 1921243 - protein, 7 aa, Staphylococcus
VGAPANI

SEQ ID NO: 1921244 - protein, 4 aa, Staphylococcus
VGAS

SEQ ID NO: 1921245 - protein, 4 aa, Staphylococcus
VGDA

SEQ ID NO: 1921246 - protein, 4 aa, Staphylococcus
VGDE

SEQ ID NO: 1921247 - protein, 13 aa, Staphylococcus
VGDPREEGTQVGP

SEQ ID NO: 1921248 - protein, 5 aa, Staphylococcus
VGDSK

SEQ ID NO: 1921249 - protein, 4 aa, Staphylococcus
VGEE

SEQ ID NO: 1921250 - protein, 7 aa, Staphylococcus
VGEEESN

SEQ ID NO: 1921251 - protein, 5 aa, Staphylococcus
VGENF

SEQ ID NO: 1921252 - protein, 9 aa, Staphylococcus
VGENGEIKG

SEQ ID NO: 1921253 - protein, 7 aa, Staphylococcus
VGENSDV

SEQ ID NO: 1921254 - protein, 7 aa, Staphylococcus
VGEQLEG

SEQ ID NO: 1921255 - protein, 9 aa, Staphylococcus
VGGKQKYSF

SEQ ID NO: 1921256 - protein, 5 aa, Staphylococcus
VGGNQ

SEQ ID NO: 1921257 - protein, 14 aa, Staphylococcus
VGGRKGHVHTDDNA

SEQ ID NO: 1921258 - protein, 6 aa, Staphylococcus
VGIDPS

SEQ ID NO: 1921259 - protein, 10 aa, Staphylococcus
VGIEKTTANA

SEQ ID NO: 1921260 - protein, 13 aa, Staphylococcus
VGKDVTKYKKGDR

SEQ ID NO: 1921261 - protein, 4 aa, Staphylococcus
VGKP

SEQ ID NO: 1921262 - protein, 6 aa, Staphylococcus
VGKQTE

SEQ ID NO: 1921263 - protein, 4 aa, Staphylococcus
VGNE

SEQ ID NO: 1921264 - protein, 4 aa, Staphylococcus
VGNG

SEQ ID NO: 1921265 - protein, 11 aa, Staphylococcus
VGPSSSHTAGA

SEQ ID NO: 1921266 - protein, 5 aa, Staphylococcus
VGRDC

SEQ ID NO: 1921267 - protein, 5 aa, Staphylococcus
VGREA

SEQ ID NO: 1921268 - protein, 5 aa, Staphylococcus
VGRGL

SEQ ID NO: 1921269 - protein, 7 aa, Staphylococcus
VGRKGGV

SEQ ID NO: 1921270 - protein, 10 aa, Staphylococcus
VGRKQEAPTG

SEQ ID NO: 1921271 - protein, 4 aa, Staphylococcus
VGRN

SEQ ID NO: 1921272 - protein, 7 aa, Staphylococcus
VGSHTNA

SEQ ID NO: 1921273 - protein, 7 aa, Staphylococcus
VGSNVNN

SEQ ID NO: 1921274 - protein, 4 aa, Staphylococcus
VGSQ

SEQ ID NO: 1921275 - protein, 8 aa, Staphylococcus
VGTGTQRV

SEQ ID NO: 1921276 - protein, 5 aa, Staphylococcus
VGTTV

SEQ ID NO: 1921277 - protein, 6 aa, Staphylococcus
VGYPKR

SEQ ID NO: 1921278 - protein, 8 aa, Staphylococcus
VGYQPTLA

SEQ ID NO: 1921279 - protein, 7 aa, Staphylococcus
VGYTEQP

SEQ ID NO: 1921280 - protein, 7 aa, Staphylococcus
VHGGRTK

SEQ ID NO: 1921281 - protein, 9 aa, Staphylococcus
VHPGSAKNA

SEQ ID NO: 1921282 - protein, 6 aa, Staphylococcus
VIEQGK

SEQ ID NO: 1921283 - protein, 10 aa, Staphylococcus
VIGKPDPVRG

SEQ ID NO: 1921284 - protein, 8 aa, Staphylococcus
VKARTTAI

SEQ ID NO: 1921285 - protein, 7 aa, Staphylococcus
VKDDETT

SEQ ID NO: 1921286 - protein, 14 aa, Staphylococcus
VKDIPGAGAAGGMG

SEQ ID NO: 1921287 - protein, 7 aa, Staphylococcus
VKDNNSA

SEQ ID NO: 1921288 - protein, 5 aa, Staphylococcus
VKEKA

SEQ ID NO: 1921289 - protein, 7 aa, Staphylococcus
VKEKGYG

SEQ ID NO: 1921290 - protein, 9 aa, Staphylococcus
VKENEESKK

SEQ ID NO: 1921291 - protein, 4 aa, Staphylococcus
VKEP

SEQ ID NO: 1921292 - protein, 6 aa, Staphylococcus
VKESDG

SEQ ID NO: 1921293 - protein, 6 aa, Staphylococcus
VKGEHQ

SEQ ID NO: 1921294 - protein, 5 aa, Staphylococcus
VKGKK

SEQ ID NO: 1921295 - protein, 7 aa, Staphylococcus
VKKVEEA

SEQ ID NO: 1921296 - protein, 10 aa, Staphylococcus
VKNDNAQGEY

SEQ ID NO: 1921297 - protein, 8 aa, Staphylococcus
VKNEKSGI

SEQ ID NO: 1921298 - protein, 9 aa, Staphylococcus
VKNEKSGIK

SEQ ID NO: 1921299 - protein, 18 aa, Staphylococcus
VKNGEADGCVSAGNTGAL

SEQ ID NO: 1921300 - protein, 5 aa, Staphylococcus
VKQGQ

SEQ ID NO: 1921301 - protein, 14 aa, Staphylococcus
VKRDPRTNMRSAQN

SEQ ID NO: 1921302 - protein, 15 aa, Staphylococcus
VKRDPRTNMRSPQNN

SEQ ID NO: 1921303 - protein, 5 aa, Staphylococcus
VKRKY

SEQ ID NO: 1921304 - protein, 14 aa, Staphylococcus
VKRRGDMEEDPSYK

SEQ ID NO: 1921305 - protein, 7 aa, Staphylococcus
VKSGQAP

SEQ ID NO: 1921306 - protein, 10 aa, Staphylococcus
VKSNERGEVD

SEQ ID NO: 1921307 - protein, 17 aa, Staphylococcus
VKSNQISIDEAKAQLSH

SEQ ID NO: 1921308 - protein, 4 aa, Staphylococcus
VKTE

SEQ ID NO: 1921309 - protein, 9 aa, Staphylococcus
VKTTSSYGI

SEQ ID NO: 1921310 - protein, 8 aa, Staphylococcus
VKVEGAKN

SEQ ID NO: 1921311 - protein, 6 aa, Staphylococcus
VLESNP

SEQ ID NO: 1921312 - protein, 7 aa, Staphylococcus
VLTPADE

SEQ ID NO: 1921313 - protein, 7 aa, Staphylococcus
VMGKTGK

SEQ ID NO: 1921314 - protein, 7 aa, Staphylococcus
VMGSGSL

SEQ ID NO: 1921315 - protein, 5 aa, Staphylococcus
VNDNE

SEQ ID NO: 1921316 - protein, 4 aa, Staphylococcus
VNEG

SEQ ID NO: 1921317 - protein, 5 aa, Staphylococcus
VNEKG

SEQ ID NO: 1921318 - protein, 4 aa, Staphylococcus
VNET

SEQ ID NO: 1921319 - protein, 5 aa, Staphylococcus
VNGGM

SEQ ID NO: 1921320 - protein, 5 aa, Staphylococcus
VNGKK

SEQ ID NO: 1921321 - protein, 5 aa, Staphylococcus
VNGKR

SEQ ID NO: 1921322 - protein, 4 aa, Staphylococcus
VNGR

SEQ ID NO: 1921323 - protein, 10 aa, Staphylococcus
VNGRKSPYTL

SEQ ID NO: 1921324 - protein, 10 aa, Staphylococcus
VNGRQSPYTL

SEQ ID NO: 1921325 - protein, 8 aa, Staphylococcus
VNHPESEP

SEQ ID NO: 1921326 - protein, 5 aa, Staphylococcus
VNIGA

SEQ ID NO: 1921327 - protein, 5 aa, Staphylococcus
VNKGT

SEQ ID NO: 1921328 - protein, 5 aa, Staphylococcus
VNNNK

SEQ ID NO: 1921329 - protein, 9 aa, Staphylococcus
VNNNLGRDI

SEQ ID NO: 1921330 - protein, 10 aa, Staphylococcus
VNNTGSFGSV

SEQ ID NO: 1921331 - protein, 16 aa, Staphylococcus
VNPAKIKSKGVKSVRK

SEQ ID NO: 1921332 - protein, 17 aa, Staphylococcus
VNPKKIQSKGVKSVRKR

SEQ ID NO: 1921333 - protein, 8 aa, Staphylococcus
VNPVDTKQ

SEQ ID NO: 1921334 - protein, 4 aa, Staphylococcus
VNQG

SEQ ID NO: 1921335 - protein, 7 aa, Staphylococcus
VNQKELE

SEQ ID NO: 1921336 - protein, 6 aa, Staphylococcus
VNSEDH

SEQ ID NO: 1921337 - protein, 7 aa, Staphylococcus
VNSTAGS

SEQ ID NO: 1921338 - protein, 7 aa, Staphylococcus
VNSYGKD

SEQ ID NO: 1921339 - protein, 8 aa, Staphylococcus
VNSYGKDI

SEQ ID NO: 1921340 - protein, 7 aa, Staphylococcus
VNTASRS

SEQ ID NO: 1921341 - protein, 7 aa, Staphylococcus
VPAEAEA

SEQ ID NO: 1921342 - protein, 8 aa, Staphylococcus
VPAPTRAE

SEQ ID NO: 1921343 - protein, 10 aa, Staphylococcus
VPASGKTRLS

SEQ ID NO: 1921344 - protein, 8 aa, Staphylococcus
VPDDGRSV

SEQ ID NO: 1921345 - protein, 8 aa, Staphylococcus
VPDEGRSV

SEQ ID NO: 1921346 - protein, 8 aa, Staphylococcus
VPDNGRSV

SEQ ID NO: 1921347 - protein, 10 aa, Staphylococcus
VPEEAESNEA

SEQ ID NO: 1921348 - protein, 5 aa, Staphylococcus
VPEEI

SEQ ID NO: 1921349 - protein, 11 aa, Staphylococcus
VPEGVDNDQQI

SEQ ID NO: 1921350 - protein, 9 aa, Staphylococcus
VPFTTDNGN

SEQ ID NO: 1921351 - protein, 4 aa, Staphylococcus
VPGV

SEQ ID NO: 1921352 - protein, 19 aa, Staphylococcus
VPKGTGRVRNMPTAAHTKE

SEQ ID NO: 1921353 - protein, 15 aa, Staphylococcus
VPKSISEEIIKKNKG

SEQ ID NO: 1921354 - protein, 5 aa, Staphylococcus
VPNDH

SEQ ID NO: 1921355 - protein, 21 aa, Staphylococcus
VPQPKGKTATSPKEALENARE

SEQ ID NO: 1921356 - protein, 19 aa, Staphylococcus
VPRGTGRVRNMPTAAHTKE

SEQ ID NO: 1921357 - protein, 4 aa, Staphylococcus
VPSF

SEQ ID NO: 1921358 - protein, 7 aa, Staphylococcus
VPSRNEG

SEQ ID NO: 1921359 - protein, 8 aa, Staphylococcus
VPSRRKDI

SEQ ID NO: 1921360 - protein, 4 aa, Staphylococcus
VPTH

SEQ ID NO: 1921361 - protein, 6 aa, Staphylococcus
VPVPES

SEQ ID NO: 1921362 - protein, 9 aa, Staphylococcus
VPYKSKNDG

SEQ ID NO: 1921363 - protein, 6 aa, Staphylococcus
VQAGLD

SEQ ID NO: 1921364 - protein, 12 aa, Staphylococcus
VQAGQNQDWAKL

SEQ ID NO: 1921365 - protein, 6 aa, Staphylococcus
VQDSHS

SEQ ID NO: 1921366 - protein, 5 aa, Staphylococcus
VQEIE

SEQ ID NO: 1921367 - protein, 12 aa, Staphylococcus
VQGSKGSPDTVR

SEQ ID NO: 1921368 - protein, 10 aa, Staphylococcus
VQPARGAKKE

SEQ ID NO: 1921369 - protein, 10 aa, Staphylococcus
VQPSRGAKKE

SEQ ID NO: 1921370 - protein, 7 aa, Staphylococcus
VQSYQGA

SEQ ID NO: 1921371 - protein, 4 aa, Staphylococcus
VQTG

SEQ ID NO: 1921372 - protein, 4 aa, Staphylococcus
VQTL

SEQ ID NO: 1921373 - protein, 8 aa, Staphylococcus
VQYDTPDN

SEQ ID NO: 1921374 - protein, 8 aa, Staphylococcus
VRERNPYT

SEQ ID NO: 1921375 - protein, 15 aa, Staphylococcus
VRETSPFPRLLNRLY

SEQ ID NO: 1921376 - protein, 18 aa, Staphylococcus
VRGRGGPRCMSQPLFRED

SEQ ID NO: 1921377 - protein, 18 aa, Staphylococcus
VRGRGGPRCMSQPLYRED

SEQ ID NO: 1921378 - protein, 5 aa, Staphylococcus
VRGTT

SEQ ID NO: 1921379 - protein, 8 aa, Staphylococcus
VRKEEQVE

SEQ ID NO: 1921380 - protein, 15 aa, Staphylococcus
VRPPEPYKGKGIRYQ

SEQ ID NO: 1921381 - protein, 8 aa, Staphylococcus
VRQGKMDP

SEQ ID NO: 1921382 - protein, 9 aa, Staphylococcus
VRQGKMDPV

SEQ ID NO: 1921383 - protein, 8 aa, Staphylococcus
VRQHPGEV

SEQ ID NO: 1921384 - protein, 6 aa, Staphylococcus
VRSEKV

SEQ ID NO: 1921385 - protein, 8 aa, Staphylococcus
VRSETDER

SEQ ID NO: 1921386 - protein, 6 aa, Staphylococcus
VSAGNT

SEQ ID NO: 1921387 - protein, 4 aa, Staphylococcus
VSDD

SEQ ID NO: 1921388 - protein, 9 aa, Staphylococcus
VSDDRGRKV

SEQ ID NO: 1921389 - protein, 9 aa, Staphylococcus
VSDDRGRTV

SEQ ID NO: 1921390 - protein, 8 aa, Staphylococcus
VSDERSAY

SEQ ID NO: 1921391 - protein, 11 aa, Staphylococcus
VSDGCEETNTA

SEQ ID NO: 1921392 - protein, 4 aa, Staphylococcus
VSDP

SEQ ID NO: 1921393 - protein, 15 aa, Staphylococcus
VSDRENSMTAGPRGP

SEQ ID NO: 1921394 - protein, 7 aa, Staphylococcus
VSEQRRE

SEQ ID NO: 1921395 - protein, 6 aa, Staphylococcus
VSETGD

SEQ ID NO: 1921396 - protein, 13 aa, Staphylococcus
VSGGGSGHEPAHA

SEQ ID NO: 1921397 - protein, 4 aa, Staphylococcus
VSGI

SEQ ID NO: 1921398 - protein, 8 aa, Staphylococcus
VSGNTTEE

SEQ ID NO: 1921399 - protein, 8 aa, Staphylococcus
VSGSGAYS

SEQ ID NO: 1921400 - protein, 9 aa, Staphylococcus
VSGSGKSTL

SEQ ID NO: 1921401 - protein, 8 aa, Staphylococcus
VSHDGNEL

SEQ ID NO: 1921402 - protein, 16 aa, Staphylococcus
VSKSDMKRVKQLLAYK

SEQ ID NO: 1921403 - protein, 9 aa, Staphylococcus
VSKSQREKF

SEQ ID NO: 1921404 - protein, 6 aa, Staphylococcus
VSKVSE

SEQ ID NO: 1921405 - protein, 9 aa, Staphylococcus
VSNEDAGHA

SEQ ID NO: 1921406 - protein, 5 aa, Staphylococcus
VSPSL

SEQ ID NO: 1921407 - protein, 8 aa, Staphylococcus
VSQFNPKQ

SEQ ID NO: 1921408 - protein, 8 aa, Staphylococcus
VSRAGSNA

SEQ ID NO: 1921409 - protein, 19 aa, Staphylococcus
VSSLPGKLADCSSKNPEES

SEQ ID NO: 1921410 - protein, 5 aa, Staphylococcus
VSSTA

SEQ ID NO: 1921411 - protein, 9 aa, Staphylococcus
VSTDPASNL

SEQ ID NO: 1921412 - protein, 7 aa, Staphylococcus
VSTPDNR

SEQ ID NO: 1921413 - protein, 10 aa, Staphylococcus
VSTRPGHTEV

SEQ ID NO: 1921414 - protein, 5 aa, Staphylococcus
VSTSP

SEQ ID NO: 1921415 - protein, 4 aa, Staphylococcus
VTDE

SEQ ID NO: 1921416 - protein, 16 aa, Staphylococcus
VTDRTQAAIYAMENKL

SEQ ID NO: 1921417 - protein, 6 aa, Staphylococcus
VTEGKE

SEQ ID NO: 1921418 - protein, 13 aa, Staphylococcus
VTFSSKAQKQLKQ

SEQ ID NO: 1921419 - protein, 5 aa, Staphylococcus
VTGEE

SEQ ID NO: 1921420 - protein, 7 aa, Staphylococcus
VTGGSTM

SEQ ID NO: 1921421 - protein, 9 aa, Staphylococcus
VTGGSTMAN

SEQ ID NO: 1921422 - protein, 11 aa, Staphylococcus
VTGTNGKTTVT

SEQ ID NO: 1921423 - protein, 12 aa, Staphylococcus
VTGTSKGKGFQG

SEQ ID NO: 1921424 - protein, 6 aa, Staphylococcus
VTIGDG

SEQ ID NO: 1921425 - protein, 11 aa, Staphylococcus
VTKAPNGQNLH

SEQ ID NO: 1921426 - protein, 6 aa, Staphylococcus
VTKAVE

SEQ ID NO: 1921427 - protein, 4 aa, Staphylococcus
VTKE

SEQ ID NO: 1921428 - protein, 10 aa, Staphylococcus
VTLRETGRLG

SEQ ID NO: 1921429 - protein, 12 aa, Staphylococcus
VTLRETGRLGDL

SEQ ID NO: 1921430 - protein, 6 aa, Staphylococcus
VTNKEE

SEQ ID NO: 1921431 - protein, 12 aa, Staphylococcus
VTNTGDKKSRQV

SEQ ID NO: 1921432 - protein, 4 aa, Staphylococcus
VTPA

SEQ ID NO: 1921433 - protein, 5 aa, Staphylococcus
VTPAL

SEQ ID NO: 1921434 - protein, 4 aa, Staphylococcus
VTPE

SEQ ID NO: 1921435 - protein, 4 aa, Staphylococcus
VTPN

SEQ ID NO: 1921436 - protein, 5 aa, Staphylococcus
VTPPD

SEQ ID NO: 1921437 - protein, 7 aa, Staphylococcus
VTPSSKV

SEQ ID NO: 1921438 - protein, 9 aa, Staphylococcus
VTPTDSPDT

SEQ ID NO: 1921439 - protein, 7 aa, Staphylococcus
VTQGPGL

SEQ ID NO: 1921440 - protein, 10 aa, Staphylococcus
VTQSNDERLS

SEQ ID NO: 1921441 - protein, 8 aa, Staphylococcus
VTSASAAV

SEQ ID NO: 1921442 - protein, 7 aa, Staphylococcus
VTSDVSG

SEQ ID NO: 1921443 - protein, 6 aa, Staphylococcus
VTSEAT

SEQ ID NO: 1921444 - protein, 6 aa, Staphylococcus
VTSGYM

SEQ ID NO: 1921445 - protein, 10 aa, Staphylococcus
VTSRTPDDLD

SEQ ID NO: 1921446 - protein, 9 aa, Staphylococcus
VTTDHGNEI

SEQ ID NO: 1921447 - protein, 5 aa, Staphylococcus
VTTDV

SEQ ID NO: 1921448 - protein, 7 aa, Staphylococcus
VTTGDGD

SEQ ID NO: 1921449 - protein, 7 aa, Staphylococcus
VTTGEGE

SEQ ID NO: 1921450 - protein, 6 aa, Staphylococcus
VTTKYG

SEQ ID NO: 1921451 - protein, 5 aa, Staphylococcus
VTTNY

SEQ ID NO: 1921452 - protein, 7 aa, Staphylococcus
VTVGPSV

SEQ ID NO: 1921453 - protein, 7 aa, Staphylococcus
VVERPSS

SEQ ID NO: 1921454 - protein, 7 aa, Staphylococcus
VVPGSDG

SEQ ID NO: 1921455 - protein, 6 aa, Staphylococcus
VVPGSE

SEQ ID NO: 1921456 - protein, 14 aa, Staphylococcus
WATTEENVEQLLKL

SEQ ID NO: 1921457 - protein, 8 aa, Staphylococcus
WDEKKPAC

SEQ ID NO: 1921458 - protein, 8 aa, Staphylococcus
WEDQEHYK

SEQ ID NO: 1921459 - protein, 7 aa, Staphylococcus
WNETSAS

SEQ ID NO: 1921460 - protein, 5 aa, Staphylococcus
WNGEE

SEQ ID NO: 1921461 - protein, 8 aa, Staphylococcus
WNGNQTPQ

SEQ ID NO: 1921462 - protein, 7 aa, Staphylococcus
WNKTGWG

SEQ ID NO: 1921463 - protein, 6 aa, Staphylococcus
WPPSGD

SEQ ID NO: 1921464 - protein, 4 aa, Staphylococcus
WPTV

SEQ ID NO: 1921465 - protein, 4 aa, Staphylococcus
WPTY

SEQ ID NO: 1921466 - protein, 5 aa, Staphylococcus
WRGTY

SEQ ID NO: 1921467 - protein, 7 aa, Staphylococcus
WSPEQIA

SEQ ID NO: 1921468 - protein, 7 aa, Staphylococcus
YAAKDPT

SEQ ID NO: 1921469 - protein, 6 aa, Staphylococcus
YADGDG

SEQ ID NO: 1921470 - protein, 6 aa, Staphylococcus
YADGEG

SEQ ID NO: 1921471 - protein, 6 aa, Staphylococcus
YADGNG

SEQ ID NO: 1921472 - protein, 4 aa, Staphylococcus
YAES

SEQ ID NO: 1921473 - protein, 10 aa, Staphylococcus
YAGSDKDSRL

SEQ ID NO: 1921474 - protein, 10 aa, Staphylococcus
YAGSDKDTQL

SEQ ID NO: 1921475 - protein, 11 aa, Staphylococcus
YANRGANGIDG

SEQ ID NO: 1921476 - protein, 5 aa, Staphylococcus
YAPAI

SEQ ID NO: 1921477 - protein, 7 aa, Staphylococcus
YARENGV

SEQ ID NO: 1921478 - protein, 4 aa, Staphylococcus
YATD

SEQ ID NO: 1921479 - protein, 6 aa, Staphylococcus
YDDGKH

SEQ ID NO: 1921480 - protein, 12 aa, Staphylococcus
YDDGKHFSDIGE

SEQ ID NO: 1921481 - protein, 11 aa, Staphylococcus
YDDGKHFTDIG

SEQ ID NO: 1921482 - protein, 6 aa, Staphylococcus
YDDPTI

SEQ ID NO: 1921483 - protein, 5 aa, Staphylococcus
YDERV

SEQ ID NO: 1921484 - protein, 6 aa, Staphylococcus
YDESNE

SEQ ID NO: 1921485 - protein, 10 aa, Staphylococcus
YDGDKDKAEL

SEQ ID NO: 1921486 - protein, 29 aa, Staphylococcus
YDGESEITHNATGDKGGSKYQLKGVGQRE

SEQ ID NO: 1921487 - protein, 9 aa, Staphylococcus
YDGTEREPA

SEQ ID NO: 1921488 - protein, 9 aa, Staphylococcus
YDKSSVADI

SEQ ID NO: 1921489 - protein, 4 aa, Staphylococcus
YDQL

SEQ ID NO: 1921490 - protein, 4 aa, Staphylococcus
YDRK

SEQ ID NO: 1921491 - protein, 4 aa, Staphylococcus
YDSN

SEQ ID NO: 1921492 - protein, 17 aa, Staphylococcus
YDSRREAFDASGDLKPY

SEQ ID NO: 1921493 - protein, 4 aa, Staphylococcus
YDST

SEQ ID NO: 1921494 - protein, 5 aa, Staphylococcus
YDTVT

SEQ ID NO: 1921495 - protein, 7 aa, Staphylococcus
YEADGAT

SEQ ID NO: 1921496 - protein, 4 aa, Staphylococcus
YEAS

SEQ ID NO: 1921497 - protein, 7 aa, Staphylococcus
YEATTNS

SEQ ID NO: 1921498 - protein, 5 aa, Staphylococcus
YEDNT

SEQ ID NO: 1921499 - protein, 9 aa, Staphylococcus
YEEEDVPTW

SEQ ID NO: 1921500 - protein, 6 aa, Staphylococcus
YEEGKR

SEQ ID NO: 1921501 - protein, 13 aa, Staphylococcus
YEEGNRFNHDPLR

SEQ ID NO: 1921502 - protein, 4 aa, Staphylococcus
YEEN

SEQ ID NO: 1921503 - protein, 4 aa, Staphylococcus
YEFG

SEQ ID NO: 1921504 - protein, 9 aa, Staphylococcus
YEGEGYGKF

SEQ ID NO: 1921505 - protein, 29 aa, Staphylococcus
YEGESEITHNATGDKGGSKYQLKGVGQRE

SEQ ID NO: 1921506 - protein, 7 aa, Staphylococcus
YEHANPT

SEQ ID NO: 1921507 - protein, 4 aa, Staphylococcus
YEKG

SEQ ID NO: 1921508 - protein, 10 aa, Staphylococcus
YEKGPDVPRG

SEQ ID NO: 1921509 - protein, 6 aa, Staphylococcus
YEKYEG

SEQ ID NO: 1921510 - protein, 6 aa, Staphylococcus
YEQETV

SEQ ID NO: 1921511 - protein, 15 aa, Staphylococcus
YEQLDDASWTITVQK

SEQ ID NO: 1921512 - protein, 16 aa, Staphylococcus
YERKDREGVFHTQWVE

SEQ ID NO: 1921513 - protein, 11 aa, Staphylococcus
YERKKEKQSVL

SEQ ID NO: 1921514 - protein, 12 aa, Staphylococcus
YERLSETNNFPE

SEQ ID NO: 1921515 - protein, 6 aa, Staphylococcus
YETGET

SEQ ID NO: 1921516 - protein, 19 aa, Staphylococcus
YETYTDSGISGKNIEGRPA

SEQ ID NO: 1921517 - protein, 4 aa, Staphylococcus
YEVE

SEQ ID NO: 1921518 - protein, 4 aa, Staphylococcus
YFGG

SEQ ID NO: 1921519 - protein, 4 aa, Staphylococcus
YGDE

SEQ ID NO: 1921520 - protein, 5 aa, Staphylococcus
YGDRN

SEQ ID NO: 1921521 - protein, 10 aa, Staphylococcus
YGEDTAEQSA

SEQ ID NO: 1921522 - protein, 10 aa, Staphylococcus
YGEKGGTPWL

SEQ ID NO: 1921523 - protein, 9 aa, Staphylococcus
YGEVNPKGV

SEQ ID NO: 1921524 - protein, 8 aa, Staphylococcus
YGGEGATI

SEQ ID NO: 1921525 - protein, 4 aa, Staphylococcus
YGHF

SEQ ID NO: 1921526 - protein, 12 aa, Staphylococcus
YGLPASDARNKE

SEQ ID NO: 1921527 - protein, 6 aa, Staphylococcus
YGLRSG

SEQ ID NO: 1921528 - protein, 4 aa, Staphylococcus
YGPN

SEQ ID NO: 1921529 - protein, 9 aa, Staphylococcus
YGPPKDRRA

SEQ ID NO: 1921530 - protein, 10 aa, Staphylococcus
YGPPKDRRAG

SEQ ID NO: 1921531 - protein, 9 aa, Staphylococcus
YGPPKERRA

SEQ ID NO: 1921532 - protein, 4 aa, Staphylococcus
YGPS

SEQ ID NO: 1921533 - protein, 6 aa, Staphylococcus
YGPSPM

SEQ ID NO: 1921534 - protein, 5 aa, Staphylococcus
YGQKG

SEQ ID NO: 1921535 - protein, 15 aa, Staphylococcus
YGQQNPLRDYQNEGH

SEQ ID NO: 1921536 - protein, 8 aa, Staphylococcus
YGQTDSGM

SEQ ID NO: 1921537 - protein, 16 aa, Staphylococcus
YGSHNNTLGATLAGEV

SEQ ID NO: 1921538 - protein, 12 aa, Staphylococcus
YGSISEEAHQTL

SEQ ID NO: 1921539 - protein, 6 aa, Staphylococcus
YGTHYE

SEQ ID NO: 1921540 - protein, 5 aa, Staphylococcus
YGTSV

SEQ ID NO: 1921541 - protein, 7 aa, Staphylococcus
YGTTGDA

SEQ ID NO: 1921542 - protein, 6 aa, Staphylococcus
YGTYYK

SEQ ID NO: 1921543 - protein, 4 aa, Staphylococcus
YGVH

SEQ ID NO: 1921544 - protein, 11 aa, Staphylococcus
YGYDTNPIGGF

SEQ ID NO: 1921545 - protein, 5 aa, Staphylococcus
YHANE

SEQ ID NO: 1921546 - protein, 8 aa, Staphylococcus
YHDKRSAS

SEQ ID NO: 1921547 - protein, 10 aa, Staphylococcus
YHEKKGSQLP

SEQ ID NO: 1921548 - protein, 10 aa, Staphylococcus
YHESPSEYTR

SEQ ID NO: 1921549 - protein, 5 aa, Staphylococcus
YIPNA

SEQ ID NO: 1921550 - protein, 12 aa, Staphylococcus
YIPTPERDSDKP

SEQ ID NO: 1921551 - protein, 10 aa, Staphylococcus
YKCNKKKCGR

SEQ ID NO: 1921552 - protein, 13 aa, Staphylococcus
YKDTNKKAEISKR

SEQ ID NO: 1921553 - protein, 7 aa, Staphylococcus
YKEDGTG

SEQ ID NO: 1921554 - protein, 9 aa, Staphylococcus
YKEISSCSN

SEQ ID NO: 1921555 - protein, 7 aa, Staphylococcus
YKENGTG

SEQ ID NO: 1921556 - protein, 8 aa, Staphylococcus
YKESYTKE

SEQ ID NO: 1921557 - protein, 4 aa, Staphylococcus
YKGP

SEQ ID NO: 1921558 - protein, 9 aa, Staphylococcus
YKPTEENKK

SEQ ID NO: 1921559 - protein, 8 aa, Staphylococcus
YKQDDFAQ

SEQ ID NO: 1921560 - protein, 8 aa, Staphylococcus
YKQDRDNV

SEQ ID NO: 1921561 - protein, 13 aa, Staphylococcus
YKQKKKEYHDSTA

SEQ ID NO: 1921562 - protein, 9 aa, Staphylococcus
YKRSAGVEF

SEQ ID NO: 1921563 - protein, 7 aa, Staphylococcus
YKRTRTY

SEQ ID NO: 1921564 - protein, 8 aa, Staphylococcus
YKRTRTYN

SEQ ID NO: 1921565 - protein, 4 aa, Staphylococcus
YKTV

SEQ ID NO: 1921566 - protein, 26 aa, Staphylococcus
YLGPAREAIKETVKGKIREFGTSNRA

SEQ ID NO: 1921567 - protein, 7 aa, Staphylococcus
YLPKGQG

SEQ ID NO: 1921568 - protein, 6 aa, Staphylococcus
YLPTGE

SEQ ID NO: 1921569 - protein, 7 aa, Staphylococcus
YLPTGEG

SEQ ID NO: 1921570 - protein, 13 aa, Staphylococcus
YNENGKSNFEPAD

SEQ ID NO: 1921571 - protein, 4 aa, Staphylococcus
YNEQ

SEQ ID NO: 1921572 - protein, 5 aa, Staphylococcus
YNEQH

SEQ ID NO: 1921573 - protein, 10 aa, Staphylococcus
YNETRGTSIF

SEQ ID NO: 1921574 - protein, 6 aa, Staphylococcus
YNIPQG

SEQ ID NO: 1921575 - protein, 28 aa, Staphylococcus
YNIPTKQAPELKLKGDGDLKGSSIGSKD

SEQ ID NO: 1921576 - protein, 5 aa, Staphylococcus
YNKKP

SEQ ID NO: 1921577 - protein, 10 aa, Staphylococcus
YNKKRDDYNP

SEQ ID NO: 1921578 - protein, 7 aa, Staphylococcus
YNQGSLD

SEQ ID NO: 1921579 - protein, 10 aa, Staphylococcus
YNRARQAAIT

SEQ ID NO: 1921580 - protein, 4 aa, Staphylococcus
YNTE

SEQ ID NO: 1921581 - protein, 9 aa, Staphylococcus
YNYPQSRVT

SEQ ID NO: 1921582 - protein, 5 aa, Staphylococcus
YPALY

SEQ ID NO: 1921583 - protein, 5 aa, Staphylococcus
YPASV

SEQ ID NO: 1921584 - protein, 11 aa, Staphylococcus
YPITPKNHGTE

SEQ ID NO: 1921585 - protein, 9 aa, Staphylococcus
YPNHSTTSD

SEQ ID NO: 1921586 - protein, 12 aa, Staphylococcus
YPSELSGGQQQR

SEQ ID NO: 1921587 - protein, 4 aa, Staphylococcus
YPTE

SEQ ID NO: 1921588 - protein, 9 aa, Staphylococcus
YQDHASELN

SEQ ID NO: 1921589 - protein, 4 aa, Staphylococcus
YQGQ

SEQ ID NO: 1921590 - protein, 6 aa, Staphylococcus
YQGYDN

SEQ ID NO: 1921591 - protein, 8 aa, Staphylococcus
YQHTTAAT

SEQ ID NO: 1921592 - protein, 4 aa, Staphylococcus
YQNQ

SEQ ID NO: 1921593 - protein, 4 aa, Staphylococcus
YQPK

SEQ ID NO: 1921594 - protein, 15 aa, Staphylococcus
YQPTHSENCSTKNEN

SEQ ID NO: 1921595 - protein, 8 aa, Staphylococcus
YQRGSGRK

SEQ ID NO: 1921596 - protein, 10 aa, Staphylococcus
YQRQLSRNEA

SEQ ID NO: 1921597 - protein, 9 aa, Staphylococcus
YRDGEIEGT

SEQ ID NO: 1921598 - protein, 16 aa, Staphylococcus
YRKAAQSLEIDERPLD

SEQ ID NO: 1921599 - protein, 4 aa, Staphylococcus
YRKI

SEQ ID NO: 1921600 - protein, 5 aa, Staphylococcus
YRNEP

SEQ ID NO: 1921601 - protein, 23 aa, Staphylococcus
YRNQTGDMTEPYTIGGGTYARNL

SEQ ID NO: 1921602 - protein, 6 aa, Staphylococcus
YRSTKN

SEQ ID NO: 1921603 - protein, 5 aa, Staphylococcus
YRVSS

SEQ ID NO: 1921604 - protein, 5 aa, Staphylococcus
YSEED

SEQ ID NO: 1921605 - protein, 12 aa, Staphylococcus
YSEGDQVKPQQI

SEQ ID NO: 1921606 - protein, 17 aa, Staphylococcus
YSEYKGGRQKTPPELSE

SEQ ID NO: 1921607 - protein, 7 aa, Staphylococcus
YSFGGDN

SEQ ID NO: 1921608 - protein, 15 aa, Staphylococcus
YSFSDDATALGAPTD

SEQ ID NO: 1921609 - protein, 10 aa, Staphylococcus
YSGNKKAVDN

SEQ ID NO: 1921610 - protein, 7 aa, Staphylococcus
YSKEELN

SEQ ID NO: 1921611 - protein, 4 aa, Staphylococcus
YSLR

SEQ ID NO: 1921612 - protein, 8 aa, Staphylococcus
YSQRETID

SEQ ID NO: 1921613 - protein, 9 aa, Staphylococcus
YSSGPNHQL

SEQ ID NO: 1921614 - protein, 5 aa, Staphylococcus
YSYDD

SEQ ID NO: 1921615 - protein, 6 aa, Staphylococcus
YTDGPR

SEQ ID NO: 1921616 - protein, 6 aa, Staphylococcus
YTESDI

SEQ ID NO: 1921617 - protein, 10 aa, Staphylococcus
YTGNSGTTTR

SEQ ID NO: 1921618 - protein, 10 aa, Staphylococcus
YTKAHDELKE

SEQ ID NO: 1921619 - protein, 6 aa, Staphylococcus
YTKEDQ

SEQ ID NO: 1921620 - protein, 6 aa, Staphylococcus
YTPTTF

SEQ ID NO: 1921621 - protein, 21 aa, Staphylococcus
YTQYQNQYEQEQLEQQRQYEQ

SEQ ID NO: 1921622 - protein, 12 aa, Staphylococcus
YTSRVGDGPFPT

SEQ ID NO: 1921623 - protein, 4 aa, Staphylococcus
YTTP

SEQ ID NO: 1921624 - protein, 9 aa, Staphylococcus
YTYEADGAT

SEQ ID NO: 1921625 - protein, 14 aa, Staphylococcus
YVGEDKKNKKPPYK

SEQ ID NO: 1921626 - protein, 6 aa, Staphylococcus
YVQDGQ

SEQ ID NO: 1921627 - protein, 7 aa, Staphylococcus
YVQSGDY

SEQ ID NO: 1921628 - protein, 10 aa, Staphylococcus
YVSAKSQAQT

SEQ ID NO: 1921629 - protein, 7 aa, Staphylococcus
YWDSEAR

SEQ ID NO: 1921630 - protein, 5 aa, Staphylococcus
YYEQQ

SEQ ID NO: 1921631 - protein, 14 aa, Staphylococcus
YYQEAGRAGRDGLE

SEQ ID NO: 1921632 - protein, 6 aa, Staphylococcus
AAADFG

SEQ ID NO: 1921633 - protein, 11 aa, Staphylococcus
AAAEDQVKQGT

SEQ ID NO: 1921634 - protein, 18 aa, Staphylococcus
AAAEKKKRGGKKGETEYR

SEQ ID NO: 1921635 - protein, 8 aa, Staphylococcus
AAAGKSTI

SEQ ID NO: 1921636 - protein, 11 aa, Staphylococcus
AAAGKSTIAKQ

SEQ ID NO: 1921637 - protein, 12 aa, Staphylococcus
AAAGKSTIAKQV

SEQ ID NO: 1921638 - protein, 12 aa, Staphylococcus
AAAGKSTIAKRV

SEQ ID NO: 1921639 - protein, 11 aa, Staphylococcus
AAAGKSTIARQ

SEQ ID NO: 1921640 - protein, 12 aa, Staphylococcus
AAAGKSTIARQV

SEQ ID NO: 1921641 - protein, 11 aa, Staphylococcus
AAAGKSTIARR

SEQ ID NO: 1921642 - protein, 10 aa, Staphylococcus
AAAISAPQIG

SEQ ID NO: 1921643 - protein, 8 aa, Staphylococcus
AAAKGAGV

SEQ ID NO: 1921644 - protein, 7 aa, Staphylococcus
AAAPDIY

SEQ ID NO: 1921645 - protein, 10 aa, Staphylococcus
AAAPDIYDYD

SEQ ID NO: 1921646 - protein, 5 aa, Staphylococcus
AAAPT

SEQ ID NO: 1921647 - protein, 18 aa, Staphylococcus
AAASHPADTLEALRQKGG

SEQ ID NO: 1921648 - protein, 8 aa, Staphylococcus
AAASNDVV

SEQ ID NO: 1921649 - protein, 10 aa, Staphylococcus
AAASTHGGQA

SEQ ID NO: 1921650 - protein, 11 aa, Staphylococcus
AAASYTKLTGK

SEQ ID NO: 1921651 - protein, 11 aa, Staphylococcus
AAASYTKMTGK

SEQ ID NO: 1921652 - protein, 7 aa, Staphylococcus
AAATTSH

SEQ ID NO: 1921653 - protein, 4 aa, Staphylococcus
AADA

SEQ ID NO: 1921654 - protein, 6 aa, Staphylococcus
AADAGV

SEQ ID NO: 1921655 - protein, 8 aa, Staphylococcus
AADDKANH

SEQ ID NO: 1921656 - protein, 8 aa, Staphylococcus
AADDPDTI

SEQ ID NO: 1921657 - protein, 8 aa, Staphylococcus
AADELQDQ

SEQ ID NO: 1921658 - protein, 17 aa, Staphylococcus
AADGLPEDVKEYFTARF

SEQ ID NO: 1921659 - protein, 13 aa, Staphylococcus
AADKITASIEKTI

SEQ ID NO: 1921660 - protein, 13 aa, Staphylococcus
AADKITDAIESTI

SEQ ID NO: 1921661 - protein, 11 aa, Staphylococcus
AADLDDEAKRY

SEQ ID NO: 1921662 - protein, 20 aa, Staphylococcus
AADLSKGLPGATERDDAISK

SEQ ID NO: 1921663 - protein, 7 aa, Staphylococcus
AADNLSA

SEQ ID NO: 1921664 - protein, 9 aa, Staphylococcus
AADPADDGL

SEQ ID NO: 1921665 - protein, 10 aa, Staphylococcus
AADPGPTNTD

SEQ ID NO: 1921666 - protein, 10 aa, Staphylococcus
AADPGSTNTD

SEQ ID NO: 1921667 - protein, 6 aa, Staphylococcus
AADQVK

SEQ ID NO: 1921668 - protein, 7 aa, Staphylococcus
AADYAKD

SEQ ID NO: 1921669 - protein, 8 aa, Staphylococcus
AAEAEAQG

SEQ ID NO: 1921670 - protein, 5 aa, Staphylococcus
AAEAG

SEQ ID NO: 1921671 - protein, 9 aa, Staphylococcus
AAEAVEPEV

SEQ ID NO: 1921672 - protein, 6 aa, Staphylococcus
AAEAVG

SEQ ID NO: 1921673 - protein, 10 aa, Staphylococcus
AAEDSGKADE

SEQ ID NO: 1921674 - protein, 12 aa, Staphylococcus
AAEDSGKAEDYK

SEQ ID NO: 1921675 - protein, 12 aa, Staphylococcus
AAEDSGKGEDYK

SEQ ID NO: 1921676 - protein, 11 aa, Staphylococcus
AAEDSGRAEDY

SEQ ID NO: 1921677 - protein, 10 aa, Staphylococcus
AAEDSGRETE

SEQ ID NO: 1921678 - protein, 8 aa, Staphylococcus
AAEEKEMS

SEQ ID NO: 1921679 - protein, 6 aa, Staphylococcus
AAEEVT

SEQ ID NO: 1921680 - protein, 9 aa, Staphylococcus
AAEFSNDAA

SEQ ID NO: 1921681 - protein, 17 aa, Staphylococcus
AAEGLPEDVKEYFTARF

SEQ ID NO: 1921682 - protein, 17 aa, Staphylococcus
AAEGLPEDVRHYFTARF

SEQ ID NO: 1921683 - protein, 17 aa, Staphylococcus
AAEGLPEDVRHYFTDRF

SEQ ID NO: 1921684 - protein, 17 aa, Staphylococcus
AAEGLPEDVRQYFTERF

SEQ ID NO: 1921685 - protein, 6 aa, Staphylococcus
AAEGNI

SEQ ID NO: 1921686 - protein, 8 aa, Staphylococcus
AAEHRAPH

SEQ ID NO: 1921687 - protein, 4 aa, Staphylococcus
AAEI

SEQ ID NO: 1921688 - protein, 6 aa, Staphylococcus
AAEIER

SEQ ID NO: 1921689 - protein, 16 aa, Staphylococcus
AAEKAGAQHTWIEKLG

SEQ ID NO: 1921690 - protein, 7 aa, Staphylococcus
AAEKGAD

SEQ ID NO: 1921691 - protein, 8 aa, Staphylococcus
AAEKGAEV

SEQ ID NO: 1921692 - protein, 8 aa, Staphylococcus
AAEKGEID

SEQ ID NO: 1921693 - protein, 6 aa, Staphylococcus
AAEKND

SEQ ID NO: 1921694 - protein, 5 aa, Staphylococcus
AAELA

SEQ ID NO: 1921695 - protein, 11 aa, Staphylococcus
AAEMEQNYNEV

SEQ ID NO: 1921696 - protein, 7 aa, Staphylococcus
AAENDLN

SEQ ID NO: 1921697 - protein, 7 aa, Staphylococcus
AAENGGE

SEQ ID NO: 1921698 - protein, 10 aa, Staphylococcus
AAENGQGPAF

SEQ ID NO: 1921699 - protein, 8 aa, Staphylococcus
AAENGSTF

SEQ ID NO: 1921700 - protein, 10 aa, Staphylococcus
AAENKKAEDI

SEQ ID NO: 1921701 - protein, 6 aa, Staphylococcus
AAENSL

SEQ ID NO: 1921702 - protein, 6 aa, Staphylococcus
AAEPGG

SEQ ID NO: 1921703 - protein, 9 aa, Staphylococcus
AAEQAGIEG

SEQ ID NO: 1921704 - protein, 5 aa, Staphylococcus
AAEQS

SEQ ID NO: 1921705 - protein, 15 aa, Staphylococcus
AAERGITPSKDADYT

SEQ ID NO: 1921706 - protein, 8 aa, Staphylococcus
AAESGVAP

SEQ ID NO: 1921707 - protein, 4 aa, Staphylococcus
AAET

SEQ ID NO: 1921708 - protein, 7 aa, Staphylococcus
AAEVDPP

SEQ ID NO: 1921709 - protein, 13 aa, Staphylococcus
AAEVHGESGMDGY

SEQ ID NO: 1921710 - protein, 14 aa, Staphylococcus
AAFGKNGGNMGVSG

SEQ ID NO: 1921711 - protein, 4 aa, Staphylococcus
AAGD

SEQ ID NO: 1921712 - protein, 8 aa, Staphylococcus
AAGDETDV

SEQ ID NO: 1921713 - protein, 11 aa, Staphylococcus
AAGDGEDTDKH

SEQ ID NO: 1921714 - protein, 10 aa, Staphylococcus
AAGDGIDSDK

SEQ ID NO: 1921715 - protein, 13 aa, Staphylococcus
AAGEDFNINSPKQ

SEQ ID NO: 1921716 - protein, 13 aa, Staphylococcus
AAGEEFNINSPKQ

SEQ ID NO: 1921717 - protein, 11 aa, Staphylococcus
AAGEGANTNKH

SEQ ID NO: 1921718 - protein, 7 aa, Staphylococcus
AAGENLA

SEQ ID NO: 1921719 - protein, 8 aa, Staphylococcus
AAGENLAY

SEQ ID NO: 1921720 - protein, 4 aa, Staphylococcus
AAGF

SEQ ID NO: 1921721 - protein, 8 aa, Staphylococcus
AAGGDEAA

SEQ ID NO: 1921722 - protein, 8 aa, Staphylococcus
AAGGPVTV

SEQ ID NO: 1921723 - protein, 9 aa, Staphylococcus
AAGGPVTVT

SEQ ID NO: 1921724 - protein, 17 aa, Staphylococcus
AAGGRLHTGRSRNDQVA

SEQ ID NO: 1921725 - protein, 4 aa, Staphylococcus
AAGI

SEQ ID NO: 1921726 - protein, 10 aa, Staphylococcus
AAGKGVNSNK

SEQ ID NO: 1921727 - protein, 18 aa, Staphylococcus
AAGLPKRVAENLQYALKE

SEQ ID NO: 1921728 - protein, 19 aa, Staphylococcus
AAGLTSSSSEMAAKGGSGM

SEQ ID NO: 1921729 - protein, 7 aa, Staphylococcus
AAGPDTE

SEQ ID NO: 1921730 - protein, 8 aa, Staphylococcus
AAGQGIDT

SEQ ID NO: 1921731 - protein, 6 aa, Staphylococcus
AAGQGQ

SEQ ID NO: 1921732 - protein, 11 aa, Staphylococcus
AAGRGKDTNQH

SEQ ID NO: 1921733 - protein, 4 aa, Staphylococcus
AAGS

SEQ ID NO: 1921734 - protein, 13 aa, Staphylococcus
AAGSGDFAGNRVD

SEQ ID NO: 1921735 - protein, 10 aa, Staphylococcus
AAGSYTKMTG

SEQ ID NO: 1921736 - protein, 8 aa, Staphylococcus
AAGYSQTS

SEQ ID NO: 1921737 - protein, 8 aa, Staphylococcus
AAHAAPRE

SEQ ID NO: 1921738 - protein, 14 aa, Staphylococcus
AAHADAKTNIKERT

SEQ ID NO: 1921739 - protein, 9 aa, Staphylococcus
AAHDDKDAI

SEQ ID NO: 1921740 - protein, 4 aa, Staphylococcus
AAHE

SEQ ID NO: 1921741 - protein, 9 aa, Staphylococcus
AAHGEDSYD

SEQ ID NO: 1921742 - protein, 6 aa, Staphylococcus
AAHNTN

SEQ ID NO: 1921743 - protein, 7 aa, Staphylococcus
AAHPDAD

SEQ ID NO: 1921744 - protein, 9 aa, Staphylococcus
AAHSDKSYV

SEQ ID NO: 1921745 - protein, 10 aa, Staphylococcus
AAHYGASKAA

SEQ ID NO: 1921746 - protein, 11 aa, Staphylococcus
AAHYGASKAAF

SEQ ID NO: 1921747 - protein, 11 aa, Staphylococcus
AAHYGASKAAL

SEQ ID NO: 1921748 - protein, 11 aa, Staphylococcus
AAIADDGSKEN

SEQ ID NO: 1921749 - protein, 12 aa, Staphylococcus
AAIAENADNKQE

SEQ ID NO: 1921750 - protein, 7 aa, Staphylococcus
AAIASGR

SEQ ID NO: 1921751 - protein, 9 aa, Staphylococcus
AAIDDNTAA

SEQ ID NO: 1921752 - protein, 12 aa, Staphylococcus
AAIDGGESVDTS

SEQ ID NO: 1921753 - protein, 22 aa, Staphylococcus
AAIEATKDKFAKEQAKGLKPRA

SEQ ID NO: 1921754 - protein, 21 aa, Staphylococcus
AAIEATKEKFERDKAKGLKPR

SEQ ID NO: 1921755 - protein, 6 aa, Staphylococcus
AAIEKA

SEQ ID NO: 1921756 - protein, 26 aa, Staphylococcus
AAIENGAKRIEGTVNGIGERAGNTAL

SEQ ID NO: 1921757 - protein, 12 aa, Staphylococcus
AAIESKKTGKPI

SEQ ID NO: 1921758 - protein, 4 aa, Staphylococcus
AAIP

SEQ ID NO: 1921759 - protein, 5 aa, Staphylococcus
AAIPE

SEQ ID NO: 1921760 - protein, 6 aa, Staphylococcus
AAIQTG

SEQ ID NO: 1921761 - protein, 8 aa, Staphylococcus
AAISADGL

SEQ ID NO: 1921762 - protein, 8 aa, Staphylococcus
AAISDGDT

SEQ ID NO: 1921763 - protein, 8 aa, Staphylococcus
AAISDGNT

SEQ ID NO: 1921764 - protein, 7 aa, Staphylococcus
AAITDNT

SEQ ID NO: 1921765 - protein, 16 aa, Staphylococcus
AAKAREELASDNLSDN

SEQ ID NO: 1921766 - protein, 7 aa, Staphylococcus
AAKDLKT

SEQ ID NO: 1921767 - protein, 16 aa, Staphylococcus
AAKEAVERAKNGEGPT

SEQ ID NO: 1921768 - protein, 6 aa, Staphylococcus
AAKEGD

SEQ ID NO: 1921769 - protein, 7 aa, Staphylococcus
AAKEITT

SEQ ID NO: 1921770 - protein, 13 aa, Staphylococcus
AAKEKEGKKPRVK

SEQ ID NO: 1921771 - protein, 7 aa, Staphylococcus
AAKEPEV

SEQ ID NO: 1921772 - protein, 11 aa, Staphylococcus
AAKESLDNTPN

SEQ ID NO: 1921773 - protein, 5 aa, Staphylococcus
AAKEV

SEQ ID NO: 1921774 - protein, 17 aa, Staphylococcus
AAKGEELTSEESKKVTR

SEQ ID NO: 1921775 - protein, 5 aa, Staphylococcus
AAKHK

SEQ ID NO: 1921776 - protein, 14 aa, Staphylococcus
AAKKAREVTRRKSA

SEQ ID NO: 1921777 - protein, 9 aa, Staphylococcus
AAKKSGAGT

SEQ ID NO: 1921778 - protein, 11 aa, Staphylococcus
AAKNAEKHRKI

SEQ ID NO: 1921779 - protein, 8 aa, Staphylococcus
AAKNGGEI

SEQ ID NO: 1921780 - protein, 6 aa, Staphylococcus
AAKNKQ

SEQ ID NO: 1921781 - protein, 10 aa, Staphylococcus
AAKNYKAEDL

SEQ ID NO: 1921782 - protein, 6 aa, Staphylococcus
AAKPTG

SEQ ID NO: 1921783 - protein, 21 aa, Staphylococcus
AAKQAGAVAGKLTGSGRGGSV

SEQ ID NO: 1921784 - protein, 7 aa, Staphylococcus
AAKQSGV

SEQ ID NO: 1921785 - protein, 9 aa, Staphylococcus
AAKRKGMDL

SEQ ID NO: 1921786 - protein, 8 aa, Staphylococcus
AAKRRGMN

SEQ ID NO: 1921787 - protein, 11 aa, Staphylococcus
AAKRRGRQIEG

SEQ ID NO: 1921788 - protein, 8 aa, Staphylococcus
AAKRYKNV

SEQ ID NO: 1921789 - protein, 6 aa, Staphylococcus
AAKSKG

SEQ ID NO: 1921790 - protein, 8 aa, Staphylococcus
AAKSPEKI

SEQ ID NO: 1921791 - protein, 18 aa, Staphylococcus
AAKSTTEGSGSSAGDGTI

SEQ ID NO: 1921792 - protein, 16 aa, Staphylococcus
AAKTGTGTYGEQTYQQ

SEQ ID NO: 1921793 - protein, 16 aa, Staphylococcus
AAKTGTGTYGSETYQQ

SEQ ID NO: 1921794 - protein, 12 aa, Staphylococcus
AAKTTNNKTNHS

SEQ ID NO: 1921795 - protein, 5 aa, Staphylococcus
AAKVA

SEQ ID NO: 1921796 - protein, 4 aa, Staphylococcus
AALA

SEQ ID NO: 1921797 - protein, 5 aa, Staphylococcus
AALAS

SEQ ID NO: 1921798 - protein, 7 aa, Staphylococcus
AALEDDD

SEQ ID NO: 1921799 - protein, 7 aa, Staphylococcus
AALEQPD

SEQ ID NO: 1921800 - protein, 8 aa, Staphylococcus
AALGDDKA

SEQ ID NO: 1921801 - protein, 9 aa, Staphylococcus
AALHSGQSF

SEQ ID NO: 1921802 - protein, 6 aa, Staphylococcus
AALPED

SEQ ID NO: 1921803 - protein, 20 aa, Staphylococcus
AALQESPNSKKQKTKQTQLN

SEQ ID NO: 1921804 - protein, 13 aa, Staphylococcus
AALRPDASVPREM

SEQ ID NO: 1921805 - protein, 17 aa, Staphylococcus
AALSGTTHPIDRAKTQE

SEQ ID NO: 1921806 - protein, 4 aa, Staphylococcus
AAMD

SEQ ID NO: 1921807 - protein, 15 aa, Staphylococcus
AAMNDKDKHAYEQKG

SEQ ID NO: 1921808 - protein, 6 aa, Staphylococcus
AAMSKD

SEQ ID NO: 1921809 - protein, 5 aa, Staphylococcus
AANAM

SEQ ID NO: 1921810 - protein, 9 aa, Staphylococcus
AANDEKALQ

SEQ ID NO: 1921811 - protein, 4 aa, Staphylococcus
AANE

SEQ ID NO: 1921812 - protein, 6 aa, Staphylococcus
AANEYE

SEQ ID NO: 1921813 - protein, 9 aa, Staphylococcus
AANGIAGRE

SEQ ID NO: 1921814 - protein, 5 aa, Staphylococcus
AANGK

SEQ ID NO: 1921815 - protein, 7 aa, Staphylococcus
AANGSDE

SEQ ID NO: 1921816 - protein, 5 aa, Staphylococcus
AANHQ

SEQ ID NO: 1921817 - protein, 16 aa, Staphylococcus
AANKDLNNVFDAFYTQ

SEQ ID NO: 1921818 - protein, 9 aa, Staphylococcus
AANKIDPTR

SEQ ID NO: 1921819 - protein, 8 aa, Staphylococcus
AANKIKPD

SEQ ID NO: 1921820 - protein, 8 aa, Staphylococcus
AANKINPD

SEQ ID NO: 1921821 - protein, 4 aa, Staphylococcus
AANL

SEQ ID NO: 1921822 - protein, 9 aa, Staphylococcus
AANLGTQSM

SEQ ID NO: 1921823 - protein, 5 aa, Staphylococcus
AANNL

SEQ ID NO: 1921824 - protein, 19 aa, Staphylococcus
AANNRENERFTSSSNIQPR

SEQ ID NO: 1921825 - protein, 7 aa, Staphylococcus
AANNTPC

SEQ ID NO: 1921826 - protein, 7 aa, Staphylococcus
AANQESE

SEQ ID NO: 1921827 - protein, 6 aa, Staphylococcus
AANQGI

SEQ ID NO: 1921828 - protein, 7 aa, Staphylococcus
AANQGQR

SEQ ID NO: 1921829 - protein, 5 aa, Staphylococcus
AANRE

SEQ ID NO: 1921830 - protein, 5 aa, Staphylococcus
AANSS

SEQ ID NO: 1921831 - protein, 7 aa, Staphylococcus
AAPAARA

SEQ ID NO: 1921832 - protein, 6 aa, Staphylococcus
AAPDVY

SEQ ID NO: 1921833 - protein, 4 aa, Staphylococcus
AAPE

SEQ ID NO: 1921834 - protein, 13 aa, Staphylococcus
AAPEDAKRAIEAA

SEQ ID NO: 1921835 - protein, 8 aa, Staphylococcus
AAPEDGNI

SEQ ID NO: 1921836 - protein, 10 aa, Staphylococcus
AAPESQVGGP

SEQ ID NO: 1921837 - protein, 5 aa, Staphylococcus
AAPGE

SEQ ID NO: 1921838 - protein, 4 aa, Staphylococcus
AAPH

SEQ ID NO: 1921839 - protein, 7 aa, Staphylococcus
AAPLPTV

SEQ ID NO: 1921840 - protein, 5 aa, Staphylococcus
AAPLS

SEQ ID NO: 1921841 - protein, 8 aa, Staphylococcus
AAPPHNES

SEQ ID NO: 1921842 - protein, 16 aa, Staphylococcus
AAPSANISGRTSPTTF

SEQ ID NO: 1921843 - protein, 16 aa, Staphylococcus
AAPSANTSGKPSPTTF

SEQ ID NO: 1921844 - protein, 15 aa, Staphylococcus
AAPSANVSGRPSPTT

SEQ ID NO: 1921845 - protein, 17 aa, Staphylococcus
AAPTGRAAKRLQESTGL

SEQ ID NO: 1921846 - protein, 22 aa, Staphylococcus
AAPVAAAGAAAGGDAEAEKTDF

SEQ ID NO: 1921847 - protein, 22 aa, Staphylococcus
AAPVAAAGAAGGGEAAAEKTEF

SEQ ID NO: 1921848 - protein, 21 aa, Staphylococcus
AAPVAAAGAAGGGEAAEKTEF

SEQ ID NO: 1921849 - protein, 19 aa, Staphylococcus
AAPYGGSPVKIKAGSYKAC

SEQ ID NO: 1921850 - protein, 9 aa, Staphylococcus
AAQADQNRP

SEQ ID NO: 1921851 - protein, 9 aa, Staphylococcus
AAQAPSSVN

SEQ ID NO: 1921852 - protein, 12 aa, Staphylococcus
AAQAQDPAKLGT

SEQ ID NO: 1921853 - protein, 6 aa, Staphylococcus
AAQDQG

SEQ ID NO: 1921854 - protein, 16 aa, Staphylococcus
AAQEGEYDKAESLIEE

SEQ ID NO: 1921855 - protein, 13 aa, Staphylococcus
AAQENERKRISRE

SEQ ID NO: 1921856 - protein, 5 aa, Staphylococcus
AAQGI

SEQ ID NO: 1921857 - protein, 16 aa, Staphylococcus
AAQGMTTDKSAQKAFQ

SEQ ID NO: 1921858 - protein, 10 aa, Staphylococcus
AAQGSQGYTF

SEQ ID NO: 1921859 - protein, 9 aa, Staphylococcus
AAQHVKDHD

SEQ ID NO: 1921860 - protein, 14 aa, Staphylococcus
AAQIAKKAHNEGLT

SEQ ID NO: 1921861 - protein, 6 aa, Staphylococcus
AAQKAQ

SEQ ID NO: 1921862 - protein, 7 aa, Staphylococcus
AAQKTGV

SEQ ID NO: 1921863 - protein, 5 aa, Staphylococcus
AAQMD

SEQ ID NO: 1921864 - protein, 4 aa, Staphylococcus
AAQN

SEQ ID NO: 1921865 - protein, 5 aa, Staphylococcus
AAQNG

SEQ ID NO: 1921866 - protein, 10 aa, Staphylococcus
AAQNKDFDKA

SEQ ID NO: 1921867 - protein, 9 aa, Staphylococcus
AAQQNDDLT

SEQ ID NO: 1921868 - protein, 6 aa, Staphylococcus
AAQRNN

SEQ ID NO: 1921869 - protein, 8 aa, Staphylococcus
AAQRRGLN

SEQ ID NO: 1921870 - protein, 5 aa, Staphylococcus
AAQSE

SEQ ID NO: 1921871 - protein, 7 aa, Staphylococcus
AAQSGYN

SEQ ID NO: 1921872 - protein, 7 aa, Staphylococcus
AAQSTEP

SEQ ID NO: 1921873 - protein, 7 aa, Staphylococcus
AAQTIKP

SEQ ID NO: 1921874 - protein, 7 aa, Staphylococcus
AAQTIQP

SEQ ID NO: 1921875 - protein, 9 aa, Staphylococcus
AARDSGAAI

SEQ ID NO: 1921876 - protein, 18 aa, Staphylococcus
AARDSGAAITAKHRGRVE

SEQ ID NO: 1921877 - protein, 19 aa, Staphylococcus
AARDSGAAITAKHRGRVEH

SEQ ID NO: 1921878 - protein, 13 aa, Staphylococcus
AARDSGAAITAKY

SEQ ID NO: 1921879 - protein, 14 aa, Staphylococcus
AARDSGAAITAKYR

SEQ ID NO: 1921880 - protein, 17 aa, Staphylococcus
AARDSGAAITANHRGRV

SEQ ID NO: 1921881 - protein, 15 aa, Staphylococcus
AAREAVKKGSAGLEQ

SEQ ID NO: 1921882 - protein, 6 aa, Staphylococcus
AAREVT

SEQ ID NO: 1921883 - protein, 4 aa, Staphylococcus
AARK

SEQ ID NO: 1921884 - protein, 9 aa, Staphylococcus
AARKPGMSR

SEQ ID NO: 1921885 - protein, 7 aa, Staphylococcus
AARKPII

SEQ ID NO: 1921886 - protein, 7 aa, Staphylococcus
AARKPLI

SEQ ID NO: 1921887 - protein, 4 aa, Staphylococcus
AARL

SEQ ID NO: 1921888 - protein, 8 aa, Staphylococcus
AARPGGDA

SEQ ID NO: 1921889 - protein, 7 aa, Staphylococcus
AARQHDI

SEQ ID NO: 1921890 - protein, 6 aa, Staphylococcus
AARTSH

SEQ ID NO: 1921891 - protein, 5 aa, Staphylococcus
AARVK

SEQ ID NO: 1921892 - protein, 5 aa, Staphylococcus
AARYG

SEQ ID NO: 1921893 - protein, 5 aa, Staphylococcus
AASAA

SEQ ID NO: 1921894 - protein, 15 aa, Staphylococcus
AASAGKKAGEFYTPQ

SEQ ID NO: 1921895 - protein, 16 aa, Staphylococcus
AASAGKKAGEFYTPQQ

SEQ ID NO: 1921896 - protein, 6 aa, Staphylococcus
AASDSD

SEQ ID NO: 1921897 - protein, 8 aa, Staphylococcus
AASDSRHN

SEQ ID NO: 1921898 - protein, 6 aa, Staphylococcus
AASEHN

SEQ ID NO: 1921899 - protein, 7 aa, Staphylococcus
AASENSS

SEQ ID NO: 1921900 - protein, 11 aa, Staphylococcus
AASETPVTSEL

SEQ ID NO: 1921901 - protein, 6 aa, Staphylococcus
AASEVE

SEQ ID NO: 1921902 - protein, 9 aa, Staphylococcus
AASFAGHNQ

SEQ ID NO: 1921903 - protein, 8 aa, Staphylococcus
AASGAVGS

SEQ ID NO: 1921904 - protein, 7 aa, Staphylococcus
AASGAVP

SEQ ID NO: 1921905 - protein, 9 aa, Staphylococcus
AASGNHNWG

SEQ ID NO: 1921906 - protein, 10 aa, Staphylococcus
AASGNRNWGQ

SEQ ID NO: 1921907 - protein, 13 aa, Staphylococcus
AASIAKKAHREGL

SEQ ID NO: 1921908 - protein, 14 aa, Staphylococcus
AASKKDINYNKSKL

SEQ ID NO: 1921909 - protein, 7 aa, Staphylococcus
AASKRIA

SEQ ID NO: 1921910 - protein, 8 aa, Staphylococcus
AASKRINK

SEQ ID NO: 1921911 - protein, 9 aa, Staphylococcus
AASLAGHNQ

SEQ ID NO: 1921912 - protein, 8 aa, Staphylococcus
AASLDSQE

SEQ ID NO: 1921913 - protein, 8 aa, Staphylococcus
AASLDTDA

SEQ ID NO: 1921914 - protein, 8 aa, Staphylococcus
AASLDTQE

SEQ ID NO: 1921915 - protein, 8 aa, Staphylococcus
AASLGTQA

SEQ ID NO: 1921916 - protein, 5 aa, Staphylococcus
AASLN

SEQ ID NO: 1921917 - protein, 8 aa, Staphylococcus
AASLQGDQ

SEQ ID NO: 1921918 - protein, 7 aa, Staphylococcus
AASNKGV

SEQ ID NO: 1921919 - protein, 16 aa, Staphylococcus
AASPHGTPGDRELQDN

SEQ ID NO: 1921920 - protein, 15 aa, Staphylococcus
AASPHGTPGDRQLKK

SEQ ID NO: 1921921 - protein, 13 aa, Staphylococcus
AASPHGTPGDRTL

SEQ ID NO: 1921922 - protein, 12 aa, Staphylococcus
AASPHGTPGERK

SEQ ID NO: 1921923 - protein, 15 aa, Staphylococcus
AASPHGTPGNRKLQQ

SEQ ID NO: 1921924 - protein, 15 aa, Staphylococcus
AASPHGVPGDRALQK

SEQ ID NO: 1921925 - protein, 15 aa, Staphylococcus
AASPHGVPGNRQLQN

SEQ ID NO: 1921926 - protein, 7 aa, Staphylococcus
AASQGKR

SEQ ID NO: 1921927 - protein, 7 aa, Staphylococcus
AASQSGQ

SEQ ID NO: 1921928 - protein, 7 aa, Staphylococcus
AASRTEH

SEQ ID NO: 1921929 - protein, 7 aa, Staphylococcus
AASSALQ

SEQ ID NO: 1921930 - protein, 16 aa, Staphylococcus
AASSGKKAGEFYTPQQ

SEQ ID NO: 1921931 - protein, 6 aa, Staphylococcus
AASSHH

SEQ ID NO: 1921932 - protein, 7 aa, Staphylococcus
AASSNSN

SEQ ID NO: 1921933 - protein, 6 aa, Staphylococcus
AASSTM

SEQ ID NO: 1921934 - protein, 8 aa, Staphylococcus
AASTDYPV

SEQ ID NO: 1921935 - protein, 6 aa, Staphylococcus
AASVTE

SEQ ID NO: 1921936 - protein, 7 aa, Staphylococcus
AASYGAK

SEQ ID NO: 1921937 - protein, 21 aa, Staphylococcus
AASYTEAGTKHGRLGLMAGHK

SEQ ID NO: 1921938 - protein, 9 aa, Staphylococcus
AASYTKMTG

SEQ ID NO: 1921939 - protein, 7 aa, Staphylococcus
AATAEDM

SEQ ID NO: 1921940 - protein, 8 aa, Staphylococcus
AATAKTSL

SEQ ID NO: 1921941 - protein, 16 aa, Staphylococcus
AATAQEKGAPKTEEDL

SEQ ID NO: 1921942 - protein, 12 aa, Staphylococcus
AATDSSNSEDYK

SEQ ID NO: 1921943 - protein, 8 aa, Staphylococcus
AATEGYVS

SEQ ID NO: 1921944 - protein, 9 aa, Staphylococcus
AATEKGNYV

SEQ ID NO: 1921945 - protein, 10 aa, Staphylococcus
AATESGSTAI

SEQ ID NO: 1921946 - protein, 11 aa, Staphylococcus
AATESGSTAVT

SEQ ID NO: 1921947 - protein, 14 aa, Staphylococcus
AATKGGRMIGNGAE

SEQ ID NO: 1921948 - protein, 4 aa, Staphylococcus
AATN

SEQ ID NO: 1921949 - protein, 13 aa, Staphylococcus
AATNIKNGKYDSQ

SEQ ID NO: 1921950 - protein, 9 aa, Staphylococcus
AATQSYSYS

SEQ ID NO: 1921951 - protein, 7 aa, Staphylococcus
AATRTQH

SEQ ID NO: 1921952 - protein, 16 aa, Staphylococcus
AATSDIPRFNKSPYDG

SEQ ID NO: 1921953 - protein, 6 aa, Staphylococcus
AATSTH

SEQ ID NO: 1921954 - protein, 6 aa, Staphylococcus
AATTIS

SEQ ID NO: 1921955 - protein, 10 aa, Staphylococcus
AATTKPKQDV

SEQ ID NO: 1921956 - protein, 14 aa, Staphylococcus
AATTTESVQEAQTR

SEQ ID NO: 1921957 - protein, 6 aa, Staphylococcus
AATVKE

SEQ ID NO: 1921958 - protein, 8 aa, Staphylococcus
AATVSEKN

SEQ ID NO: 1921959 - protein, 5 aa, Staphylococcus
AATYA

SEQ ID NO: 1921960 - protein, 6 aa, Staphylococcus
AAVGSD

SEQ ID NO: 1921961 - protein, 13 aa, Staphylococcus
AAVQEAGKISEGT

SEQ ID NO: 1921962 - protein, 12 aa, Staphylococcus
AAVQTFEKLKNI

SEQ ID NO: 1921963 - protein, 15 aa, Staphylococcus
AAVSSSEMVELLVKK

SEQ ID NO: 1921964 - protein, 7 aa, Staphylococcus
AAYDQGA

SEQ ID NO: 1921965 - protein, 23 aa, Staphylococcus
AAYEDTRPKIEKSVRNDLKETYE

SEQ ID NO: 1921966 - protein, 23 aa, Staphylococcus
AAYEDTRPKIETSVRNDLKETYE

SEQ ID NO: 1921967 - protein, 7 aa, Staphylococcus
AAYEKGE

SEQ ID NO: 1921968 - protein, 11 aa, Staphylococcus
AAYETVKQAAN

SEQ ID NO: 1921969 - protein, 12 aa, Staphylococcus
AAYTGSKKAKAI

SEQ ID NO: 1921970 - protein, 19 aa, Staphylococcus
AAYYQENNKLKKDNSSRKL

SEQ ID NO: 1921971 - protein, 6 aa, Staphylococcus
ACAQSG

SEQ ID NO: 1921972 - protein, 6 aa, Staphylococcus
ACDEGE

SEQ ID NO: 1921973 - protein, 13 aa, Staphylococcus
ACDSTLKDAEKKV

SEQ ID NO: 1921974 - protein, 13 aa, Staphylococcus
ACDTTLKDAEKKV

SEQ ID NO: 1921975 - protein, 10 aa, Staphylococcus
ACEERDPKQL

SEQ ID NO: 1921976 - protein, 4 aa, Staphylococcus
ACKA

SEQ ID NO: 1921977 - protein, 15 aa, Staphylococcus
ACKTTKPEYKQVNPN

SEQ ID NO: 1921978 - protein, 10 aa, Staphylococcus
ACNEEEADEA

SEQ ID NO: 1921979 - protein, 12 aa, Staphylococcus
ACQLTQKSKRAI

SEQ ID NO: 1921980 - protein, 4 aa, Staphylococcus
ACQN

SEQ ID NO: 1921981 - protein, 6 aa, Staphylococcus
ACSQDN

SEQ ID NO: 1921982 - protein, 14 aa, Staphylococcus
ACTPENAEKLVKAG

SEQ ID NO: 1921983 - protein, 5 aa, Staphylococcus
ADAAG

SEQ ID NO: 1921984 - protein, 6 aa, Staphylococcus
ADAAGV

SEQ ID NO: 1921985 - protein, 5 aa, Staphylococcus
ADAAP

SEQ ID NO: 1921986 - protein, 8 aa, Staphylococcus
ADADTLEP

SEQ ID NO: 1921987 - protein, 8 aa, Staphylococcus
ADAEGNVR

SEQ ID NO: 1921988 - protein, 15 aa, Staphylococcus
ADAGSKLAKAEKFGT

SEQ ID NO: 1921989 - protein, 14 aa, Staphylococcus
ADAGSKLTKAEKFG

SEQ ID NO: 1921990 - protein, 8 aa, Staphylococcus
ADAKPEDF

SEQ ID NO: 1921991 - protein, 6 aa, Staphylococcus
ADAKSV

SEQ ID NO: 1921992 - protein, 8 aa, Staphylococcus
ADANPEDY

SEQ ID NO: 1921993 - protein, 8 aa, Staphylococcus
ADAPPSQI

SEQ ID NO: 1921994 - protein, 7 aa, Staphylococcus
ADAQGNV

SEQ ID NO: 1921995 - protein, 9 aa, Staphylococcus
ADARDKEDI

SEQ ID NO: 1921996 - protein, 8 aa, Staphylococcus
ADARNEAA

SEQ ID NO: 1921997 - protein, 7 aa, Staphylococcus
ADARNQY

SEQ ID NO: 1921998 - protein, 9 aa, Staphylococcus
ADASAGNVT

SEQ ID NO: 1921999 - protein, 8 aa, Staphylococcus
ADASNLSR

SEQ ID NO: 1922000 - protein, 5 aa, Staphylococcus
ADASV

SEQ ID NO: 1922001 - protein, 7 aa, Staphylococcus
ADATGVD

SEQ ID NO: 1922002 - protein, 10 aa, Staphylococcus
ADATSRAIQA

SEQ ID NO: 1922003 - protein, 9 aa, Staphylococcus
ADAVDSAVT

SEQ ID NO: 1922004 - protein, 5 aa, Staphylococcus
ADCKK

SEQ ID NO: 1922005 - protein, 12 aa, Staphylococcus
ADDALDAVESTG

SEQ ID NO: 1922006 - protein, 8 aa, Staphylococcus
ADDANGRH

SEQ ID NO: 1922007 - protein, 6 aa, Staphylococcus
ADDAPD

SEQ ID NO: 1922008 - protein, 13 aa, Staphylococcus
ADDASDLEGKDLS

SEQ ID NO: 1922009 - protein, 8 aa, Staphylococcus
ADDDLNRQ

SEQ ID NO: 1922010 - protein, 12 aa, Staphylococcus
ADDDNDQTDAQS

SEQ ID NO: 1922011 - protein, 6 aa, Staphylococcus
ADDEAI

SEQ ID NO: 1922012 - protein, 8 aa, Staphylococcus
ADDEPVKG

SEQ ID NO: 1922013 - protein, 11 aa, Staphylococcus
ADDEPVKGSDF

SEQ ID NO: 1922014 - protein, 5 aa, Staphylococcus
ADDER

SEQ ID NO: 1922015 - protein, 6 aa, Staphylococcus
ADDGIT

SEQ ID NO: 1922016 - protein, 12 aa, Staphylococcus
ADDIEKKLNQKK

SEQ ID NO: 1922017 - protein, 18 aa, Staphylococcus
ADDITTEDTTVIGKVNLD

SEQ ID NO: 1922018 - protein, 8 aa, Staphylococcus
ADDKKEAW

SEQ ID NO: 1922019 - protein, 4 aa, Staphylococcus
ADDL

SEQ ID NO: 1922020 - protein, 5 aa, Staphylococcus
ADDRL

SEQ ID NO: 1922021 - protein, 7 aa, Staphylococcus
ADDSGLE

SEQ ID NO: 1922022 - protein, 11 aa, Staphylococcus
ADDSHPTKKGY

SEQ ID NO: 1922023 - protein, 8 aa, Staphylococcus
ADDSNGAV

SEQ ID NO: 1922024 - protein, 6 aa, Staphylococcus
ADDTPE

SEQ ID NO: 1922025 - protein, 7 aa, Staphylococcus
ADDTPQH

SEQ ID NO: 1922026 - protein, 17 aa, Staphylococcus
ADDTRRKNLGLTASGRK

SEQ ID NO: 1922027 - protein, 4 aa, Staphylococcus
ADDY

SEQ ID NO: 1922028 - protein, 4 aa, Staphylococcus
ADEA

SEQ ID NO: 1922029 - protein, 17 aa, Staphylococcus
ADEAKEYGLIDEVMQPE

SEQ ID NO: 1922030 - protein, 9 aa, Staphylococcus
ADEAQTEAE

SEQ ID NO: 1922031 - protein, 10 aa, Staphylococcus
ADEASLDATY

SEQ ID NO: 1922032 - protein, 10 aa, Staphylococcus
ADEASLDQTY

SEQ ID NO: 1922033 - protein, 10 aa, Staphylococcus
ADEATNEQQF

SEQ ID NO: 1922034 - protein, 9 aa, Staphylococcus
ADEDIESSW

SEQ ID NO: 1922035 - protein, 8 aa, Staphylococcus
ADEDKQKQ

SEQ ID NO: 1922036 - protein, 5 aa, Staphylococcus
ADEDN

SEQ ID NO: 1922037 - protein, 10 aa, Staphylococcus
ADEDNGERHV

SEQ ID NO: 1922038 - protein, 11 aa, Staphylococcus
ADEDSPHTKEQ

SEQ ID NO: 1922039 - protein, 7 aa, Staphylococcus
ADEDTKD

SEQ ID NO: 1922040 - protein, 13 aa, Staphylococcus
ADEDYKYDEKTKA

SEQ ID NO: 1922041 - protein, 7 aa, Staphylococcus
ADEDYRP

SEQ ID NO: 1922042 - protein, 10 aa, Staphylococcus
ADEENGRPEV

SEQ ID NO: 1922043 - protein, 20 aa, Staphylococcus
ADEENIEVTDEDIDKELEKM

SEQ ID NO: 1922044 - protein, 10 aa, Staphylococcus
ADEESLDATY

SEQ ID NO: 1922045 - protein, 4 aa, Staphylococcus
ADEG

SEQ ID NO: 1922046 - protein, 18 aa, Staphylococcus
ADEGTATIKPSRLEGTEV

SEQ ID NO: 1922047 - protein, 6 aa, Staphylococcus
ADEHPY

SEQ ID NO: 1922048 - protein, 4 aa, Staphylococcus
ADEI

SEQ ID NO: 1922049 - protein, 6 aa, Staphylococcus
ADEITA

SEQ ID NO: 1922050 - protein, 4 aa, Staphylococcus
ADEL

SEQ ID NO: 1922051 - protein, 5 aa, Staphylococcus
ADELG

SEQ ID NO: 1922052 - protein, 5 aa, Staphylococcus
ADELK

SEQ ID NO: 1922053 - protein, 8 aa, Staphylococcus
ADELSTKR

SEQ ID NO: 1922054 - protein, 7 aa, Staphylococcus
ADENRAK

SEQ ID NO: 1922055 - protein, 12 aa, Staphylococcus
ADEPFDGDALKF

SEQ ID NO: 1922056 - protein, 6 aa, Staphylococcus
ADEQGD

SEQ ID NO: 1922057 - protein, 17 aa, Staphylococcus
ADESELPDEDSLYKDVF

SEQ ID NO: 1922058 - protein, 10 aa, Staphylococcus
ADESQNEQQF

SEQ ID NO: 1922059 - protein, 7 aa, Staphylococcus
ADESYPS

SEQ ID NO: 1922060 - protein, 7 aa, Staphylococcus
ADETFND

SEQ ID NO: 1922061 - protein, 7 aa, Staphylococcus
ADETFNE

SEQ ID NO: 1922062 - protein, 14 aa, Staphylococcus
ADETTFSNNDDGIG

SEQ ID NO: 1922063 - protein, 6 aa, Staphylococcus
ADEVPK

SEQ ID NO: 1922064 - protein, 5 aa, Staphylococcus
ADEYE

SEQ ID NO: 1922065 - protein, 8 aa, Staphylococcus
ADEYETET

SEQ ID NO: 1922066 - protein, 5 aa, Staphylococcus
ADFEN

SEQ ID NO: 1922067 - protein, 6 aa, Staphylococcus
ADFGDV

SEQ ID NO: 1922068 - protein, 14 aa, Staphylococcus
ADFNNYDPTSQQLA

SEQ ID NO: 1922069 - protein, 13 aa, Staphylococcus
ADFQRGGFTEEES

SEQ ID NO: 1922070 - protein, 4 aa, Staphylococcus
ADFR

SEQ ID NO: 1922071 - protein, 10 aa, Staphylococcus
ADFSTITNEK

SEQ ID NO: 1922072 - protein, 9 aa, Staphylococcus
ADGAQYTDG

SEQ ID NO: 1922073 - protein, 9 aa, Staphylococcus
ADGATYQEG

SEQ ID NO: 1922074 - protein, 5 aa, Staphylococcus
ADGAW

SEQ ID NO: 1922075 - protein, 6 aa, Staphylococcus
ADGCDI

SEQ ID NO: 1922076 - protein, 4 aa, Staphylococcus
ADGD

SEQ ID NO: 1922077 - protein, 8 aa, Staphylococcus
ADGDASEV

SEQ ID NO: 1922078 - protein, 6 aa, Staphylococcus
ADGDKI

SEQ ID NO: 1922079 - protein, 15 aa, Staphylococcus
ADGEGHLTYGQEAQP

SEQ ID NO: 1922080 - protein, 6 aa, Staphylococcus
ADGEIG

SEQ ID NO: 1922081 - protein, 6 aa, Staphylococcus
ADGEKC

SEQ ID NO: 1922082 - protein, 6 aa, Staphylococcus
ADGEMM

SEQ ID NO: 1922083 - protein, 13 aa, Staphylococcus
ADGFKESDAQYAV

SEQ ID NO: 1922084 - protein, 9 aa, Staphylococcus
ADGGEGTMQ

SEQ ID NO: 1922085 - protein, 11 aa, Staphylococcus
ADGGEGTTEAL

SEQ ID NO: 1922086 - protein, 20 aa, Staphylococcus
ADGHDFNAAGENLAYGQASS

SEQ ID NO: 1922087 - protein, 11 aa, Staphylococcus
ADGHDNPEGQV

SEQ ID NO: 1922088 - protein, 8 aa, Staphylococcus
ADGKSPME

SEQ ID NO: 1922089 - protein, 9 aa, Staphylococcus
ADGKSPMSV

SEQ ID NO: 1922090 - protein, 7 aa, Staphylococcus
ADGLTQN

SEQ ID NO: 1922091 - protein, 6 aa, Staphylococcus
ADGNSA

SEQ ID NO: 1922092 - protein, 10 aa, Staphylococcus
ADGPNTKEIA

SEQ ID NO: 1922093 - protein, 6 aa, Staphylococcus
ADGQRD

SEQ ID NO: 1922094 - protein, 5 aa, Staphylococcus
ADGQT

SEQ ID NO: 1922095 - protein, 12 aa, Staphylococcus
ADGSDEADAIQS

SEQ ID NO: 1922096 - protein, 11 aa, Staphylococcus
ADGSDEKDAIE

SEQ ID NO: 1922097 - protein, 6 aa, Staphylococcus
ADGSEQ

SEQ ID NO: 1922098 - protein, 15 aa, Staphylococcus
ADGSMKRYEALKRIE

SEQ ID NO: 1922099 - protein, 7 aa, Staphylococcus
ADGSQEM

SEQ ID NO: 1922100 - protein, 9 aa, Staphylococcus
ADGSVEKFP

SEQ ID NO: 1922101 - protein, 7 aa, Staphylococcus
ADGTDYE

SEQ ID NO: 1922102 - protein, 7 aa, Staphylococcus
ADGTPDY

SEQ ID NO: 1922103 - protein, 15 aa, Staphylococcus
ADGTTTYTQYEGDTI

SEQ ID NO: 1922104 - protein, 19 aa, Staphylococcus
ADGVDDKGNEYQKYRNDDN

SEQ ID NO: 1922105 - protein, 5 aa, Staphylococcus
ADGWE

SEQ ID NO: 1922106 - protein, 4 aa, Staphylococcus
ADHD

SEQ ID NO: 1922107 - protein, 7 aa, Staphylococcus
ADHGNSD

SEQ ID NO: 1922108 - protein, 5 aa, Staphylococcus
ADHKR

SEQ ID NO: 1922109 - protein, 10 aa, Staphylococcus
ADHRYEEAEE

SEQ ID NO: 1922110 - protein, 7 aa, Staphylococcus
ADHSGYA

SEQ ID NO: 1922111 - protein, 7 aa, Staphylococcus
ADHSGYS

SEQ ID NO: 1922112 - protein, 9 aa, Staphylococcus
ADHTTESTV

SEQ ID NO: 1922113 - protein, 4 aa, Staphylococcus
ADID

SEQ ID NO: 1922114 - protein, 4 aa, Staphylococcus
ADIE

SEQ ID NO: 1922115 - protein, 15 aa, Staphylococcus
ADIEEAKAAIKDKDF

SEQ ID NO: 1922116 - protein, 9 aa, Staphylococcus
ADIELQPSA

SEQ ID NO: 1922117 - protein, 5 aa, Staphylococcus
ADIEQ

SEQ ID NO: 1922118 - protein, 7 aa, Staphylococcus
ADIESTW

SEQ ID NO: 1922119 - protein, 7 aa, Staphylococcus
ADIGQSR

SEQ ID NO: 1922120 - protein, 8 aa, Staphylococcus
ADIGTGSG

SEQ ID NO: 1922121 - protein, 9 aa, Staphylococcus
ADIGTGSGA

SEQ ID NO: 1922122 - protein, 9 aa, Staphylococcus
ADIKDGAKV

SEQ ID NO: 1922123 - protein, 12 aa, Staphylococcus
ADIKGAGTSTLK

SEQ ID NO: 1922124 - protein, 8 aa, Staphylococcus
ADIKPGST

SEQ ID NO: 1922125 - protein, 19 aa, Staphylococcus
ADIKQEKNALSTADQSEDN

SEQ ID NO: 1922126 - protein, 4 aa, Staphylococcus
ADIN

SEQ ID NO: 1922127 - protein, 10 aa, Staphylococcus
ADINHKQQAF

SEQ ID NO: 1922128 - protein, 12 aa, Staphylococcus
ADIPAVDKIVEE

SEQ ID NO: 1922129 - protein, 10 aa, Staphylococcus
ADIPEEERQN

SEQ ID NO: 1922130 - protein, 4 aa, Staphylococcus
ADIQ

SEQ ID NO: 1922131 - protein, 7 aa, Staphylococcus
ADIQPEN

SEQ ID NO: 1922132 - protein, 6 aa, Staphylococcus
ADIRAE

SEQ ID NO: 1922133 - protein, 12 aa, Staphylococcus
ADISKKLNDNVT

SEQ ID NO: 1922134 - protein, 13 aa, Staphylococcus
ADISQAADEKALQ

SEQ ID NO: 1922135 - protein, 6 aa, Staphylococcus
ADISTE

SEQ ID NO: 1922136 - protein, 86 aa, Staphylococcus
ADISTKTADDNNTRSNSDNRESSTIKQGHAYRNHESHNDIDSKQSAQHSTTKLQQKKSATNKEHNHDTTYAVKAQNKNNIKLGSKP

SEQ ID NO: 1922137 - protein, 6 aa, Staphylococcus
ADITAP

SEQ ID NO: 1922138 - protein, 9 aa, Staphylococcus
ADITLQNDQ

SEQ ID NO: 1922139 - protein, 4 aa, Staphylococcus
ADIY

SEQ ID NO: 1922140 - protein, 7 aa, Staphylococcus
ADKDESV

SEQ ID NO: 1922141 - protein, 9 aa, Staphylococcus
ADKDGGELI

SEQ ID NO: 1922142 - protein, 9 aa, Staphylococcus
ADKDGGEMI

SEQ ID NO: 1922143 - protein, 9 aa, Staphylococcus
ADKDGGEVI

SEQ ID NO: 1922144 - protein, 10 aa, Staphylococcus
ADKDGNIDQK

SEQ ID NO: 1922145 - protein, 11 aa, Staphylococcus
ADKDKDNLEKR

SEQ ID NO: 1922146 - protein, 5 aa, Staphylococcus
ADKEI

SEQ ID NO: 1922147 - protein, 16 aa, Staphylococcus
ADKETSELTGSEQEAN

SEQ ID NO: 1922148 - protein, 7 aa, Staphylococcus
ADKGEDM

SEQ ID NO: 1922149 - protein, 7 aa, Staphylococcus
ADKGEDV

SEQ ID NO: 1922150 - protein, 14 aa, Staphylococcus
ADKGIPSHYQGKDG

SEQ ID NO: 1922151 - protein, 8 aa, Staphylococcus
ADKGNALR

SEQ ID NO: 1922152 - protein, 14 aa, Staphylococcus
ADKGSRIYRMEAKF

SEQ ID NO: 1922153 - protein, 5 aa, Staphylococcus
ADKGW

SEQ ID NO: 1922154 - protein, 4 aa, Staphylococcus
ADKH

SEQ ID NO: 1922155 - protein, 16 aa, Staphylococcus
ADKHPEIKDYSDDERL

SEQ ID NO: 1922156 - protein, 16 aa, Staphylococcus
ADKHPEMKDYSDEERL

SEQ ID NO: 1922157 - protein, 10 aa, Staphylococcus
ADKKKSVTDR

SEQ ID NO: 1922158 - protein, 10 aa, Staphylococcus
ADKKKTVSDR

SEQ ID NO: 1922159 - protein, 7 aa, Staphylococcus
ADKKQGD

SEQ ID NO: 1922160 - protein, 6 aa, Staphylococcus
ADKLTG

SEQ ID NO: 1922161 - protein, 6 aa, Staphylococcus
ADKNYV

SEQ ID NO: 1922162 - protein, 13 aa, Staphylococcus
ADKQMKVNSAGNL

SEQ ID NO: 1922163 - protein, 11 aa, Staphylococcus
ADKQNKLGGEI

SEQ ID NO: 1922164 - protein, 18 aa, Staphylococcus
ADKQTSEALINTFLESRN

SEQ ID NO: 1922165 - protein, 9 aa, Staphylococcus
ADKQTSESL

SEQ ID NO: 1922166 - protein, 4 aa, Staphylococcus
ADKR

SEQ ID NO: 1922167 - protein, 6 aa, Staphylococcus
ADKRVP

SEQ ID NO: 1922168 - protein, 12 aa, Staphylococcus
ADKSEDNENNFK

SEQ ID NO: 1922169 - protein, 9 aa, Staphylococcus
ADKTVTSDI

SEQ ID NO: 1922170 - protein, 10 aa, Staphylococcus
ADKVKSASGR

SEQ ID NO: 1922171 - protein, 17 aa, Staphylococcus
ADKVSLNSSALKNPSFI

SEQ ID NO: 1922172 - protein, 16 aa, Staphylococcus
ADKVSLNSSALRNPSL

SEQ ID NO: 1922173 - protein, 6 aa, Staphylococcus
ADKVTE

SEQ ID NO: 1922174 - protein, 19 aa, Staphylococcus
ADKVTEDASFKDDLGADSL

SEQ ID NO: 1922175 - protein, 8 aa, Staphylococcus
ADKYYPNH

SEQ ID NO: 1922176 - protein, 26 aa, Staphylococcus
ADLAGSNKSNVKDAKDYDKDNRDGKN

SEQ ID NO: 1922177 - protein, 25 aa, Staphylococcus
ADLAGSNKSNVKDAPDFDKETPEGK

SEQ ID NO: 1922178 - protein, 25 aa, Staphylococcus
ADLAGSNKSNVKEAKDYDKDTPEGK

SEQ ID NO: 1922179 - protein, 25 aa, Staphylococcus
ADLAGSNKSNVKEAKDYDKETPEGK

SEQ ID NO: 1922180 - protein, 25 aa, Staphylococcus
ADLAGSNKSNVKEATDYDRNTPEGK

SEQ ID NO: 1922181 - protein, 25 aa, Staphylococcus
ADLAGSNKSNVKEATDYNPNTPEGK

SEQ ID NO: 1922182 - protein, 25 aa, Staphylococcus
ADLAGSNKSNVKEAVDYDRNTPEGK

SEQ ID NO: 1922183 - protein, 13 aa, Staphylococcus
ADLASAKKALDKE

SEQ ID NO: 1922184 - protein, 11 aa, Staphylococcus
ADLASTKAVEA

SEQ ID NO: 1922185 - protein, 4 aa, Staphylococcus
ADLD

SEQ ID NO: 1922186 - protein, 5 aa, Staphylococcus
ADLDD

SEQ ID NO: 1922187 - protein, 12 aa, Staphylococcus
ADLDGEDAKAFR

SEQ ID NO: 1922188 - protein, 13 aa, Staphylococcus
ADLDSVKKEIETR

SEQ ID NO: 1922189 - protein, 5 aa, Staphylococcus
ADLDV

SEQ ID NO: 1922190 - protein, 11 aa, Staphylococcus
ADLEEEANAFK

SEQ ID NO: 1922191 - protein, 10 aa, Staphylococcus
ADLEKAIEAT

SEQ ID NO: 1922192 - protein, 13 aa, Staphylococcus
ADLEQTAATQTKQ

SEQ ID NO: 1922193 - protein, 10 aa, Staphylococcus
ADLKATTDND

SEQ ID NO: 1922194 - protein, 9 aa, Staphylococcus
ADLKDGAKV

SEQ ID NO: 1922195 - protein, 4 aa, Staphylococcus
ADLP

SEQ ID NO: 1922196 - protein, 12 aa, Staphylococcus
ADLPTKFEAGTP

SEQ ID NO: 1922197 - protein, 16 aa, Staphylococcus
ADLQDKTMSELENNQK

SEQ ID NO: 1922198 - protein, 5 aa, Staphylococcus
ADLQN

SEQ ID NO: 1922199 - protein, 5 aa, Staphylococcus
ADLRG

SEQ ID NO: 1922200 - protein, 25 aa, Staphylococcus
ADLSSQDVADATRIQYGGSVKPNNI

SEQ ID NO: 1922201 - protein, 25 aa, Staphylococcus
ADLSSQDVAEATRIQYGGSVKPNNI

SEQ ID NO: 1922202 - protein, 5 aa, Staphylococcus
ADLST

SEQ ID NO: 1922203 - protein, 5 aa, Staphylococcus
ADLTE

SEQ ID NO: 1922204 - protein, 8 aa, Staphylococcus
ADMDDSET

SEQ ID NO: 1922205 - protein, 7 aa, Staphylococcus
ADMERKV

SEQ ID NO: 1922206 - protein, 19 aa, Staphylococcus
ADMETGTATIKPSSLNGAE

SEQ ID NO: 1922207 - protein, 7 aa, Staphylococcus
ADMNGEG

SEQ ID NO: 1922208 - protein, 20 aa, Staphylococcus
ADMSGRNDIQVGSAKISGNA

SEQ ID NO: 1922209 - protein, 5 aa, Staphylococcus
ADNDN

SEQ ID NO: 1922210 - protein, 8 aa, Staphylococcus
ADNDPETI

SEQ ID NO: 1922211 - protein, 9 aa, Staphylococcus
ADNDSSDKG

SEQ ID NO: 1922212 - protein, 10 aa, Staphylococcus
ADNGEDLPMN

SEQ ID NO: 1922213 - protein, 10 aa, Staphylococcus
ADNGEELPMN

SEQ ID NO: 1922214 - protein, 16 aa, Staphylococcus
ADNGEKAVEVLYNAFD

SEQ ID NO: 1922215 - protein, 9 aa, Staphylococcus
ADNGPIEQG

SEQ ID NO: 1922216 - protein, 7 aa, Staphylococcus
ADNGTTI

SEQ ID NO: 1922217 - protein, 5 aa, Staphylococcus
ADNIE

SEQ ID NO: 1922218 - protein, 11 aa, Staphylococcus
ADNIPDNDKKE

SEQ ID NO: 1922219 - protein, 4 aa, Staphylococcus
ADNK

SEQ ID NO: 1922220 - protein, 11 aa, Staphylococcus
ADNKDFRTNQP

SEQ ID NO: 1922221 - protein, 9 aa, Staphylococcus
ADNKGNQPI

SEQ ID NO: 1922222 - protein, 9 aa, Staphylococcus
ADNKNARLQ

SEQ ID NO: 1922223 - protein, 18 aa, Staphylococcus
ADNPDEEVIAPADDDADF

SEQ ID NO: 1922224 - protein, 7 aa, Staphylococcus
ADNPMKQ

SEQ ID NO: 1922225 - protein, 5 aa, Staphylococcus
ADNPN

SEQ ID NO: 1922226 - protein, 27 aa, Staphylococcus
ADNPYEQARQHKENKAKEISARRIFSF

SEQ ID NO: 1922227 - protein, 6 aa, Staphylococcus
ADNSDT

SEQ ID NO: 1922228 - protein, 6 aa, Staphylococcus
ADNTPE

SEQ ID NO: 1922229 - protein, 5 aa, Staphylococcus
ADNTR

SEQ ID NO: 1922230 - protein, 9 aa, Staphylococcus
ADNTSVKKV

SEQ ID NO: 1922231 - protein, 6 aa, Staphylococcus
ADNVPQ

SEQ ID NO: 1922232 - protein, 5 aa, Staphylococcus
ADNVT

SEQ ID NO: 1922233 - protein, 6 aa, Staphylococcus
ADNYSN

SEQ ID NO: 1922234 - protein, 12 aa, Staphylococcus
ADPDGHKYNFLV

SEQ ID NO: 1922235 - protein, 7 aa, Staphylococcus
ADPDTLP

SEQ ID NO: 1922236 - protein, 4 aa, Staphylococcus
ADPE

SEQ ID NO: 1922237 - protein, 9 aa, Staphylococcus
ADPEYGKGV

SEQ ID NO: 1922238 - protein, 9 aa, Staphylococcus
ADPEYRSSL

SEQ ID NO: 1922239 - protein, 8 aa, Staphylococcus
ADPGWLGP

SEQ ID NO: 1922240 - protein, 9 aa, Staphylococcus
ADPIGTKPL

SEQ ID NO: 1922241 - protein, 12 aa, Staphylococcus
ADPISEEDQDNM

SEQ ID NO: 1922242 - protein, 4 aa, Staphylococcus
ADPR

SEQ ID NO: 1922243 - protein, 6 aa, Staphylococcus
ADPSFL

SEQ ID NO: 1922244 - protein, 6 aa, Staphylococcus
ADPSKI

SEQ ID NO: 1922245 - protein, 6 aa, Staphylococcus
ADPTEA

SEQ ID NO: 1922246 - protein, 7 aa, Staphylococcus
ADPYEDI

SEQ ID NO: 1922247 - protein, 5 aa, Staphylococcus
ADQAE

SEQ ID NO: 1922248 - protein, 6 aa, Staphylococcus
ADQDLE

SEQ ID NO: 1922249 - protein, 5 aa, Staphylococcus
ADQDV

SEQ ID NO: 1922250 - protein, 6 aa, Staphylococcus
ADQEGV

SEQ ID NO: 1922251 - protein, 6 aa, Staphylococcus
ADQEKT

SEQ ID NO: 1922252 - protein, 6 aa, Staphylococcus
ADQFET

SEQ ID NO: 1922253 - protein, 14 aa, Staphylococcus
ADQGITANTVAPGM

SEQ ID NO: 1922254 - protein, 6 aa, Staphylococcus
ADQHDK

SEQ ID NO: 1922255 - protein, 5 aa, Staphylococcus
ADQLA

SEQ ID NO: 1922256 - protein, 9 aa, Staphylococcus
ADQLAESNV

SEQ ID NO: 1922257 - protein, 6 aa, Staphylococcus
ADQNIK

SEQ ID NO: 1922258 - protein, 8 aa, Staphylococcus
ADQPSYRT

SEQ ID NO: 1922259 - protein, 7 aa, Staphylococcus
ADQPYVD

SEQ ID NO: 1922260 - protein, 9 aa, Staphylococcus
ADQQEDANS

SEQ ID NO: 1922261 - protein, 12 aa, Staphylococcus
ADQQRGEAAEVG

SEQ ID NO: 1922262 - protein, 7 aa, Staphylococcus
ADQSGYT

SEQ ID NO: 1922263 - protein, 5 aa, Staphylococcus
ADQSI

SEQ ID NO: 1922264 - protein, 4 aa, Staphylococcus
ADQV

SEQ ID NO: 1922265 - protein, 6 aa, Staphylococcus
ADQVTE

SEQ ID NO: 1922266 - protein, 4 aa, Staphylococcus
ADRD

SEQ ID NO: 1922267 - protein, 15 aa, Staphylococcus
ADRDQEVGDGDERTI

SEQ ID NO: 1922268 - protein, 14 aa, Staphylococcus
ADRGISGKSMNRPA

SEQ ID NO: 1922269 - protein, 5 aa, Staphylococcus
ADRIG

SEQ ID NO: 1922270 - protein, 10 aa, Staphylococcus
ADRKGRTQVE

SEQ ID NO: 1922271 - protein, 5 aa, Staphylococcus
ADRKL

SEQ ID NO: 1922272 - protein, 10 aa, Staphylococcus
ADRLDEDSSN

SEQ ID NO: 1922273 - protein, 11 aa, Staphylococcus
ADRLEEDSSNL

SEQ ID NO: 1922274 - protein, 13 aa, Staphylococcus
ADRNVNRSRGGSL

SEQ ID NO: 1922275 - protein, 4 aa, Staphylococcus
ADRR

SEQ ID NO: 1922276 - protein, 5 aa, Staphylococcus
ADRTN

SEQ ID NO: 1922277 - protein, 11 aa, Staphylococcus
ADRTSTSPSSV

SEQ ID NO: 1922278 - protein, 7 aa, Staphylococcus
ADRVEGT

SEQ ID NO: 1922279 - protein, 6 aa, Staphylococcus
ADSADT

SEQ ID NO: 1922280 - protein, 9 aa, Staphylococcus
ADSAGRGYR

SEQ ID NO: 1922281 - protein, 8 aa, Staphylococcus
ADSAIGRA

SEQ ID NO: 1922282 - protein, 11 aa, Staphylococcus
ADSASDLEGVD

SEQ ID NO: 1922283 - protein, 6 aa, Staphylococcus
ADSDIV

SEQ ID NO: 1922284 - protein, 4 aa, Staphylococcus
ADSE

SEQ ID NO: 1922285 - protein, 8 aa, Staphylococcus
ADSEERLK

SEQ ID NO: 1922286 - protein, 8 aa, Staphylococcus
ADSEKLDP

SEQ ID NO: 1922287 - protein, 16 aa, Staphylococcus
ADSEPQSLSGGQKQRV

SEQ ID NO: 1922288 - protein, 10 aa, Staphylococcus
ADSEYGKGVA

SEQ ID NO: 1922289 - protein, 6 aa, Staphylococcus
ADSFPE

SEQ ID NO: 1922290 - protein, 4 aa, Staphylococcus
ADSG

SEQ ID NO: 1922291 - protein, 8 aa, Staphylococcus
ADSGDRHI

SEQ ID NO: 1922292 - protein, 16 aa, Staphylococcus
ADSGNTEWTDMPKNAK

SEQ ID NO: 1922293 - protein, 14 aa, Staphylococcus
ADSKFNDDERFSNY

SEQ ID NO: 1922294 - protein, 23 aa, Staphylococcus
ADSKTKNTPISGGDVGGSKNFEN

SEQ ID NO: 1922295 - protein, 5 aa, Staphylococcus
ADSLS

SEQ ID NO: 1922296 - protein, 15 aa, Staphylococcus
ADSLSDSLRLSDPEF

SEQ ID NO: 1922297 - protein, 8 aa, Staphylococcus
ADSLTEKL

SEQ ID NO: 1922298 - protein, 7 aa, Staphylococcus
ADSNGDI

SEQ ID NO: 1922299 - protein, 7 aa, Staphylococcus
ADSPQGL

SEQ ID NO: 1922300 - protein, 8 aa, Staphylococcus
ADSPYQET

SEQ ID NO: 1922301 - protein, 7 aa, Staphylococcus
ADSRDLN

SEQ ID NO: 1922302 - protein, 8 aa, Staphylococcus
ADSRDLNY

SEQ ID NO: 1922303 - protein, 7 aa, Staphylococcus
ADSSLAN

SEQ ID NO: 1922304 - protein, 7 aa, Staphylococcus
ADSSLNE

SEQ ID NO: 1922305 - protein, 6 aa, Staphylococcus
ADSSYI

SEQ ID NO: 1922306 - protein, 9 aa, Staphylococcus
ADSTKGMAE

SEQ ID NO: 1922307 - protein, 21 aa, Staphylococcus
ADSTNETVSFQPNTYYRNGHP

SEQ ID NO: 1922308 - protein, 13 aa, Staphylococcus
ADSVEEVKQALKN

SEQ ID NO: 1922309 - protein, 10 aa, Staphylococcus
ADSVSEDTTY

SEQ ID NO: 1922310 - protein, 7 aa, Staphylococcus
ADSWPNS

SEQ ID NO: 1922311 - protein, 4 aa, Staphylococcus
ADSY

SEQ ID NO: 1922312 - protein, 17 aa, Staphylococcus
ADTAAREAVAKGTPGIA

SEQ ID NO: 1922313 - protein, 7 aa, Staphylococcus
ADTDDTP

SEQ ID NO: 1922314 - protein, 8 aa, Staphylococcus
ADTDEHTS

SEQ ID NO: 1922315 - protein, 14 aa, Staphylococcus
ADTDEQAEYLSTTQ

SEQ ID NO: 1922316 - protein, 6 aa, Staphylococcus
ADTDKG

SEQ ID NO: 1922317 - protein, 6 aa, Staphylococcus
ADTEKI

SEQ ID NO: 1922318 - protein, 6 aa, Staphylococcus
ADTEKL

SEQ ID NO: 1922319 - protein, 8 aa, Staphylococcus
ADTEKTAI

SEQ ID NO: 1922320 - protein, 6 aa, Staphylococcus
ADTENY

SEQ ID NO: 1922321 - protein, 16 aa, Staphylococcus
ADTETIGCNPDGYNIN

SEQ ID NO: 1922322 - protein, 25 aa, Staphylococcus
ADTETIGCSPDGYNINDNCGSTHPE

SEQ ID NO: 1922323 - protein, 27 aa, Staphylococcus
ADTETIGCSPDGYNINENCGSTHPENL

SEQ ID NO: 1922324 - protein, 27 aa, Staphylococcus
ADTETVGCSPDGYNINEECGSTHPQAL

SEQ ID NO: 1922325 - protein, 7 aa, Staphylococcus
ADTGAAI

SEQ ID NO: 1922326 - protein, 22 aa, Staphylococcus
ADTGATYSLGRSSITSKKLKDE

SEQ ID NO: 1922327 - protein, 6 aa, Staphylococcus
ADTGEI

SEQ ID NO: 1922328 - protein, 7 aa, Staphylococcus
ADTHYTA

SEQ ID NO: 1922329 - protein, 4 aa, Staphylococcus
ADTI

SEQ ID NO: 1922330 - protein, 5 aa, Staphylococcus
ADTIA

SEQ ID NO: 1922331 - protein, 5 aa, Staphylococcus
ADTID

SEQ ID NO: 1922332 - protein, 8 aa, Staphylococcus
ADTIEQSD

SEQ ID NO: 1922333 - protein, 7 aa, Staphylococcus
ADTKEEA

SEQ ID NO: 1922334 - protein, 8 aa, Staphylococcus
ADTKESKF

SEQ ID NO: 1922335 - protein, 8 aa, Staphylococcus
ADTKKLTG

SEQ ID NO: 1922336 - protein, 8 aa, Staphylococcus
ADTKSIGA

SEQ ID NO: 1922337 - protein, 9 aa, Staphylococcus
ADTKSIGAL

SEQ ID NO: 1922338 - protein, 9 aa, Staphylococcus
ADTKSVGAL

SEQ ID NO: 1922339 - protein, 4 aa, Staphylococcus
ADTL

SEQ ID NO: 1922340 - protein, 6 aa, Staphylococcus
ADTLAR

SEQ ID NO: 1922341 - protein, 9 aa, Staphylococcus
ADTNATSAE

SEQ ID NO: 1922342 - protein, 6 aa, Staphylococcus
ADTNQL

SEQ ID NO: 1922343 - protein, 7 aa, Staphylococcus
ADTNQLD

SEQ ID NO: 1922344 - protein, 8 aa, Staphylococcus
ADTPEAVD

SEQ ID NO: 1922345 - protein, 23 aa, Staphylococcus
ADTQPKTERKIDEKEEHSDETMP

SEQ ID NO: 1922346 - protein, 5 aa, Staphylococcus
ADTRE

SEQ ID NO: 1922347 - protein, 40 aa, Staphylococcus
ADTRPKSDNNQNVKSRYNKTYQTSSSNKTGIKNTASHTVH

SEQ ID NO: 1922348 - protein, 4 aa, Staphylococcus
ADTS

SEQ ID NO: 1922349 - protein, 5 aa, Staphylococcus
ADTSL

SEQ ID NO: 1922350 - protein, 5 aa, Staphylococcus
ADTTD

SEQ ID NO: 1922351 - protein, 7 aa, Staphylococcus
ADTTDAT

SEQ ID NO: 1922352 - protein, 6 aa, Staphylococcus
ADTTIT

SEQ ID NO: 1922353 - protein, 11 aa, Staphylococcus
ADTTSRKGAHE

SEQ ID NO: 1922354 - protein, 7 aa, Staphylococcus
ADTTVNE

SEQ ID NO: 1922355 - protein, 8 aa, Staphylococcus
ADVASGEA

SEQ ID NO: 1922356 - protein, 9 aa, Staphylococcus
ADVASNNKI

SEQ ID NO: 1922357 - protein, 4 aa, Staphylococcus
ADVE

SEQ ID NO: 1922358 - protein, 16 aa, Staphylococcus
ADVESDLKEKGLPTSF

SEQ ID NO: 1922359 - protein, 10 aa, Staphylococcus
ADVKKSITVE

SEQ ID NO: 1922360 - protein, 14 aa, Staphylococcus
ADVKQQQTQDKGEL

SEQ ID NO: 1922361 - protein, 9 aa, Staphylococcus
ADVKREGQD

SEQ ID NO: 1922362 - protein, 9 aa, Staphylococcus
ADVKRQGDD

SEQ ID NO: 1922363 - protein, 11 aa, Staphylococcus
ADVKTSQPPIG

SEQ ID NO: 1922364 - protein, 10 aa, Staphylococcus
ADVPADLAKQ

SEQ ID NO: 1922365 - protein, 5 aa, Staphylococcus
ADVPV

SEQ ID NO: 1922366 - protein, 6 aa, Staphylococcus
ADVPVD

SEQ ID NO: 1922367 - protein, 8 aa, Staphylococcus
ADVPVDKA

SEQ ID NO: 1922368 - protein, 7 aa, Staphylococcus
ADVQHET

SEQ ID NO: 1922369 - protein, 5 aa, Staphylococcus
ADVSP

SEQ ID NO: 1922370 - protein, 7 aa, Staphylococcus
ADYAGST

SEQ ID NO: 1922371 - protein, 15 aa, Staphylococcus
ADYEPHSLSGGQKQR

SEQ ID NO: 1922372 - protein, 16 aa, Staphylococcus
ADYEPQSLSGGQKQRV

SEQ ID NO: 1922373 - protein, 7 aa, Staphylococcus
ADYGDYG

SEQ ID NO: 1922374 - protein, 12 aa, Staphylococcus
ADYISEKSPGAS

SEQ ID NO: 1922375 - protein, 10 aa, Staphylococcus
ADYKQNKESF

SEQ ID NO: 1922376 - protein, 6 aa, Staphylococcus
ADYNAR

SEQ ID NO: 1922377 - protein, 31 aa, Staphylococcus
ADYNNGASNEPQEPQTSTSTIEDNDGGKEQF

SEQ ID NO: 1922378 - protein, 7 aa, Staphylococcus
ADYPINK

SEQ ID NO: 1922379 - protein, 16 aa, Staphylococcus
ADYPKFKRPETGQYEL

SEQ ID NO: 1922380 - protein, 6 aa, Staphylococcus
ADYPLN

SEQ ID NO: 1922381 - protein, 12 aa, Staphylococcus
ADYPSDITPEGY

SEQ ID NO: 1922382 - protein, 6 aa, Staphylococcus
ADYRKK

SEQ ID NO: 1922383 - protein, 5 aa, Staphylococcus
ADYRV

SEQ ID NO: 1922384 - protein, 7 aa, Staphylococcus
ADYSLKD

SEQ ID NO: 1922385 - protein, 7 aa, Staphylococcus
ADYTDDD

SEQ ID NO: 1922386 - protein, 6 aa, Staphylococcus
AEAAEY

SEQ ID NO: 1922387 - protein, 11 aa, Staphylococcus
AEAAGGKGYTV

SEQ ID NO: 1922388 - protein, 8 aa, Staphylococcus
AEAAGQLG

SEQ ID NO: 1922389 - protein, 17 aa, Staphylococcus
AEADAFNGKISNESPIA

SEQ ID NO: 1922390 - protein, 12 aa, Staphylococcus
AEADKTANDAQE

SEQ ID NO: 1922391 - protein, 11 aa, Staphylococcus
AEADNATDYRD

SEQ ID NO: 1922392 - protein, 11 aa, Staphylococcus
AEADNATDYRN

SEQ ID NO: 1922393 - protein, 9 aa, Staphylococcus
AEADTAETY

SEQ ID NO: 1922394 - protein, 4 aa, Staphylococcus
AEAE

SEQ ID NO: 1922395 - protein, 7 aa, Staphylococcus
AEAEGLN

SEQ ID NO: 1922396 - protein, 8 aa, Staphylococcus
AEAETDAE

SEQ ID NO: 1922397 - protein, 4 aa, Staphylococcus
AEAF

SEQ ID NO: 1922398 - protein, 4 aa, Staphylococcus
AEAG

SEQ ID NO: 1922399 - protein, 9 aa, Staphylococcus
AEAGEKEEV

SEQ ID NO: 1922400 - protein, 5 aa, Staphylococcus
AEAGI

SEQ ID NO: 1922401 - protein, 9 aa, Staphylococcus
AEAGQDEGM

SEQ ID NO: 1922402 - protein, 7 aa, Staphylococcus
AEAHQTS

SEQ ID NO: 1922403 - protein, 8 aa, Staphylococcus
AEAHTDQR

SEQ ID NO: 1922404 - protein, 20 aa, Staphylococcus
AEAIPETIEPSEIEGRRDLR

SEQ ID NO: 1922405 - protein, 10 aa, Staphylococcus
AEAISGEKSA

SEQ ID NO: 1922406 - protein, 10 aa, Staphylococcus
AEAKEETGAN

SEQ ID NO: 1922407 - protein, 11 aa, Staphylococcus
AEAKKETGANV

SEQ ID NO: 1922408 - protein, 9 aa, Staphylococcus
AEAKKHNQP

SEQ ID NO: 1922409 - protein, 10 aa, Staphylococcus
AEAKQETGAN

SEQ ID NO: 1922410 - protein, 4 aa, Staphylococcus
AEAL

SEQ ID NO: 1922411 - protein, 6 aa, Staphylococcus
AEALKD

SEQ ID NO: 1922412 - protein, 9 aa, Staphylococcus
AEALSEKLG

SEQ ID NO: 1922413 - protein, 4 aa, Staphylococcus
AEAN

SEQ ID NO: 1922414 - protein, 7 aa, Staphylococcus
AEANGFR

SEQ ID NO: 1922415 - protein, 7 aa, Staphylococcus
AEANGRH

SEQ ID NO: 1922416 - protein, 9 aa, Staphylococcus
AEANTLTYG

SEQ ID NO: 1922417 - protein, 5 aa, Staphylococcus
AEAQD

SEQ ID NO: 1922418 - protein, 8 aa, Staphylococcus
AEAQGTPY

SEQ ID NO: 1922419 - protein, 9 aa, Staphylococcus
AEARGKSKG

SEQ ID NO: 1922420 - protein, 11 aa, Staphylococcus
AEARLDSGALA

SEQ ID NO: 1922421 - protein, 4 aa, Staphylococcus
AEAT

SEQ ID NO: 1922422 - protein, 6 aa, Staphylococcus
AEATIT

SEQ ID NO: 1922423 - protein, 14 aa, Staphylococcus
AEAVGAKAEVDGGF

SEQ ID NO: 1922424 - protein, 20 aa, Staphylococcus
AEAVPDHIEPSQIEGRRDLR

SEQ ID NO: 1922425 - protein, 20 aa, Staphylococcus
AEAVPEEIKPDEIKGRTDLR

SEQ ID NO: 1922426 - protein, 7 aa, Staphylococcus
AEAVQEA

SEQ ID NO: 1922427 - protein, 4 aa, Staphylococcus
AEAY

SEQ ID NO: 1922428 - protein, 6 aa, Staphylococcus
AEAYGL

SEQ ID NO: 1922429 - protein, 6 aa, Staphylococcus
AEAYTE

SEQ ID NO: 1922430 - protein, 12 aa, Staphylococcus
AEDAKTQAEQGE

SEQ ID NO: 1922431 - protein, 8 aa, Staphylococcus
AEDAMNND

SEQ ID NO: 1922432 - protein, 8 aa, Staphylococcus
AEDAPEKL

SEQ ID NO: 1922433 - protein, 11 aa, Staphylococcus
AEDARQKGEAL

SEQ ID NO: 1922434 - protein, 10 aa, Staphylococcus
AEDATSGNVT

SEQ ID NO: 1922435 - protein, 5 aa, Staphylococcus
AEDCD

SEQ ID NO: 1922436 - protein, 4 aa, Staphylococcus
AEDD

SEQ ID NO: 1922437 - protein, 10 aa, Staphylococcus
AEDDDKANIL

SEQ ID NO: 1922438 - protein, 9 aa, Staphylococcus
AEDDPNATI

SEQ ID NO: 1922439 - protein, 9 aa, Staphylococcus
AEDEAEHKE

SEQ ID NO: 1922440 - protein, 8 aa, Staphylococcus
AEDEITDD

SEQ ID NO: 1922441 - protein, 9 aa, Staphylococcus
AEDEKESYL

SEQ ID NO: 1922442 - protein, 15 aa, Staphylococcus
AEDEQEYKGHGGPNK

SEQ ID NO: 1922443 - protein, 8 aa, Staphylococcus
AEDERESY

SEQ ID NO: 1922444 - protein, 7 aa, Staphylococcus
AEDFNRP

SEQ ID NO: 1922445 - protein, 5 aa, Staphylococcus
AEDGE

SEQ ID NO: 1922446 - protein, 5 aa, Staphylococcus
AEDGH

SEQ ID NO: 1922447 - protein, 7 aa, Staphylococcus
AEDGKIS

SEQ ID NO: 1922448 - protein, 9 aa, Staphylococcus
AEDGNFDQF

SEQ ID NO: 1922449 - protein, 8 aa, Staphylococcus
AEDGTDEP

SEQ ID NO: 1922450 - protein, 18 aa, Staphylococcus
AEDIEVSDDDIDKELEKM

SEQ ID NO: 1922451 - protein, 17 aa, Staphylococcus
AEDINLGKHGKKPKDLG

SEQ ID NO: 1922452 - protein, 8 aa, Staphylococcus
AEDKDYRQ

SEQ ID NO: 1922453 - protein, 10 aa, Staphylococcus
AEDKGIPFNE

SEQ ID NO: 1922454 - protein, 8 aa, Staphylococcus
AEDKIDDL

SEQ ID NO: 1922455 - protein, 13 aa, Staphylococcus
AEDKYLSTKEKYK

SEQ ID NO: 1922456 - protein, 4 aa, Staphylococcus
AEDN

SEQ ID NO: 1922457 - protein, 5 aa, Staphylococcus
AEDNV

SEQ ID NO: 1922458 - protein, 5 aa, Staphylococcus
AEDPI

SEQ ID NO: 1922459 - protein, 20 aa, Staphylococcus
AEDPKRAKTRQSQEDVVEWI

SEQ ID NO: 1922460 - protein, 27 aa, Staphylococcus
AEDPREKAKLEKESKAQEISARRIFSF

SEQ ID NO: 1922461 - protein, 25 aa, Staphylococcus
AEDPYKAVKERKKEKELSVRHIFSF

SEQ ID NO: 1922462 - protein, 27 aa, Staphylococcus
AEDPYQQVKERKAHQESELAVRRIFSF

SEQ ID NO: 1922463 - protein, 4 aa, Staphylococcus
AEDQ

SEQ ID NO: 1922464 - protein, 6 aa, Staphylococcus
AEDQKL

SEQ ID NO: 1922465 - protein, 7 aa, Staphylococcus
AEDQSTV

SEQ ID NO: 1922466 - protein, 9 aa, Staphylococcus
AEDQSTVTV

SEQ ID NO: 1922467 - protein, 11 aa, Staphylococcus
AEDSDIDTEKL

SEQ ID NO: 1922468 - protein, 4 aa, Staphylococcus
AEDV

SEQ ID NO: 1922469 - protein, 9 aa, Staphylococcus
AEDVDEPDY

SEQ ID NO: 1922470 - protein, 7 aa, Staphylococcus
AEEADIP

SEQ ID NO: 1922471 - protein, 6 aa, Staphylococcus
AEEAKA

SEQ ID NO: 1922472 - protein, 7 aa, Staphylococcus
AEEAKAY

SEQ ID NO: 1922473 - protein, 7 aa, Staphylococcus
AEEAKEY

SEQ ID NO: 1922474 - protein, 15 aa, Staphylococcus
AEEATGIKTSTESGQ

SEQ ID NO: 1922475 - protein, 5 aa, Staphylococcus
AEEAV

SEQ ID NO: 1922476 - protein, 14 aa, Staphylococcus
AEEAVEKAKELNSD

SEQ ID NO: 1922477 - protein, 10 aa, Staphylococcus
AEEDDKANIL

SEQ ID NO: 1922478 - protein, 10 aa, Staphylococcus
AEEDSNANIL

SEQ ID NO: 1922479 - protein, 10 aa, Staphylococcus
AEEDSSATIL

SEQ ID NO: 1922480 - protein, 7 aa, Staphylococcus
AEEDTHR

SEQ ID NO: 1922481 - protein, 6 aa, Staphylococcus
AEEDYE

SEQ ID NO: 1922482 - protein, 13 aa, Staphylococcus
AEEEYTDHRRPSE

SEQ ID NO: 1922483 - protein, 8 aa, Staphylococcus
AEEFEDGI

SEQ ID NO: 1922484 - protein, 4 aa, Staphylococcus
AEEG

SEQ ID NO: 1922485 - protein, 6 aa, Staphylococcus
AEEGAS

SEQ ID NO: 1922486 - protein, 16 aa, Staphylococcus
AEEGGENGSAKASYVK

SEQ ID NO: 1922487 - protein, 15 aa, Staphylococcus
AEEGGENGSAKATYV

SEQ ID NO: 1922488 - protein, 6 aa, Staphylococcus
AEEGKR

SEQ ID NO: 1922489 - protein, 4 aa, Staphylococcus
AEEH

SEQ ID NO: 1922490 - protein, 7 aa, Staphylococcus
AEEHRKY

SEQ ID NO: 1922491 - protein, 7 aa, Staphylococcus
AEEIADS

SEQ ID NO: 1922492 - protein, 12 aa, Staphylococcus
AEEKNNDTISAH

SEQ ID NO: 1922493 - protein, 7 aa, Staphylococcus
AEEKRTL

SEQ ID NO: 1922494 - protein, 14 aa, Staphylococcus
AEELAGKKATFKTK

SEQ ID NO: 1922495 - protein, 9 aa, Staphylococcus
AEELGGETL

SEQ ID NO: 1922496 - protein, 15 aa, Staphylococcus
AEELKVKETNRIDTT

SEQ ID NO: 1922497 - protein, 12 aa, Staphylococcus
AEELPSGRTLDE

SEQ ID NO: 1922498 - protein, 5 aa, Staphylococcus
AEELR

SEQ ID NO: 1922499 - protein, 29 aa, Staphylococcus
AEEMKAERNKVSGEIAQKKRNKEDADDAI

SEQ ID NO: 1922500 - protein, 28 aa, Staphylococcus
AEEMKAERNRVSNEIAEKKRNKEDADDV

SEQ ID NO: 1922501 - protein, 9 aa, Staphylococcus
AEEMPPGGA

SEQ ID NO: 1922502 - protein, 12 aa, Staphylococcus
AEEMPPGGAKGM

SEQ ID NO: 1922503 - protein, 12 aa, Staphylococcus
AEEMPPGGAQGM

SEQ ID NO: 1922504 - protein, 4 aa, Staphylococcus
AEEN

SEQ ID NO: 1922505 - protein, 8 aa, Staphylococcus
AEENSQAS

SEQ ID NO: 1922506 - protein, 4 aa, Staphylococcus
AEEP

SEQ ID NO: 1922507 - protein, 19 aa, Staphylococcus
AEEPAHGKVRQNKDDVISW

SEQ ID NO: 1922508 - protein, 5 aa, Staphylococcus
AEEPG

SEQ ID NO: 1922509 - protein, 9 aa, Staphylococcus
AEEQADSFG

SEQ ID NO: 1922510 - protein, 16 aa, Staphylococcus
AEEQDLATAKKKDSTG

SEQ ID NO: 1922511 - protein, 8 aa, Staphylococcus
AEEQENQA

SEQ ID NO: 1922512 - protein, 6 aa, Staphylococcus
AEEQFE

SEQ ID NO: 1922513 - protein, 7 aa, Staphylococcus
AEEQGHE

SEQ ID NO: 1922514 - protein, 5 aa, Staphylococcus
AEEQN

SEQ ID NO: 1922515 - protein, 8 aa, Staphylococcus
AEERKKAV

SEQ ID NO: 1922516 - protein, 9 aa, Staphylococcus
AEERNHRRL

SEQ ID NO: 1922517 - protein, 10 aa, Staphylococcus
AEERTVKGSY

SEQ ID NO: 1922518 - protein, 13 aa, Staphylococcus
AEETADKLEEDNV

SEQ ID NO: 1922519 - protein, 13 aa, Staphylococcus
AEETADRLEEDNV

SEQ ID NO: 1922520 - protein, 13 aa, Staphylococcus
AEETADRLKDDNI

SEQ ID NO: 1922521 - protein, 7 aa, Staphylococcus
AEETAQA

SEQ ID NO: 1922522 - protein, 9 aa, Staphylococcus
AEETGGGAH

SEQ ID NO: 1922523 - protein, 9 aa, Staphylococcus
AEETGGGAN

SEQ ID NO: 1922524 - protein, 12 aa, Staphylococcus
AEETGVKHESPQ

SEQ ID NO: 1922525 - protein, 15 aa, Staphylococcus
AEETGYGAKAIAETD

SEQ ID NO: 1922526 - protein, 14 aa, Staphylococcus
AEEVNTVGTLPSHD

SEQ ID NO: 1922527 - protein, 11 aa, Staphylococcus
AEEVPPGGAQA

SEQ ID NO: 1922528 - protein, 17 aa, Staphylococcus
AEEVSTSEFADELIKNL

SEQ ID NO: 1922529 - protein, 5 aa, Staphylococcus
AEEVT

SEQ ID NO: 1922530 - protein, 18 aa, Staphylococcus
AEFDPEGVRTGHYQSGKD

SEQ ID NO: 1922531 - protein, 11 aa, Staphylococcus
AEFDTDSYNEF

SEQ ID NO: 1922532 - protein, 5 aa, Staphylococcus
AEFEF

SEQ ID NO: 1922533 - protein, 5 aa, Staphylococcus
AEGAA

SEQ ID NO: 1922534 - protein, 15 aa, Staphylococcus
AEGAADNYTRKDMDG

SEQ ID NO: 1922535 - protein, 10 aa, Staphylococcus
AEGADSEAHI

SEQ ID NO: 1922536 - protein, 8 aa, Staphylococcus
AEGASPIV

SEQ ID NO: 1922537 - protein, 5 aa, Staphylococcus
AEGDI

SEQ ID NO: 1922538 - protein, 7 aa, Staphylococcus
AEGDLNE

SEQ ID NO: 1922539 - protein, 7 aa, Staphylococcus
AEGDTNW

SEQ ID NO: 1922540 - protein, 12 aa, Staphylococcus
AEGEYEDHRRPS

SEQ ID NO: 1922541 - protein, 4 aa, Staphylococcus
AEGI

SEQ ID NO: 1922542 - protein, 7 aa, Staphylococcus
AEGIDPN

SEQ ID NO: 1922543 - protein, 5 aa, Staphylococcus
AEGIE

SEQ ID NO: 1922544 - protein, 13 aa, Staphylococcus
AEGIKSNKTKVGD

SEQ ID NO: 1922545 - protein, 5 aa, Staphylococcus
AEGKT

SEQ ID NO: 1922546 - protein, 9 aa, Staphylococcus
AEGKTQGAI

SEQ ID NO: 1922547 - protein, 6 aa, Staphylococcus
AEGKTV

SEQ ID NO: 1922548 - protein, 10 aa, Staphylococcus
AEGLKEVSEA

SEQ ID NO: 1922549 - protein, 8 aa, Staphylococcus
AEGNLASR

SEQ ID NO: 1922550 - protein, 11 aa, Staphylococcus
AEGQTGVNPAV

SEQ ID NO: 1922551 - protein, 7 aa, Staphylococcus
AEGQTVI

SEQ ID NO: 1922552 - protein, 7 aa, Staphylococcus
AEGQVER

SEQ ID NO: 1922553 - protein, 7 aa, Staphylococcus
AEGREDD

SEQ ID NO: 1922554 - protein, 10 aa, Staphylococcus
AEGREKGLRK

SEQ ID NO: 1922555 - protein, 6 aa, Staphylococcus
AEGSAV

SEQ ID NO: 1922556 - protein, 6 aa, Staphylococcus
AEGSNT

SEQ ID NO: 1922557 - protein, 6 aa, Staphylococcus
AEGTDS

SEQ ID NO: 1922558 - protein, 7 aa, Staphylococcus
AEGTEFR

SEQ ID NO: 1922559 - protein, 6 aa, Staphylococcus
AEGTES

SEQ ID NO: 1922560 - protein, 6 aa, Staphylococcus
AEGTET

SEQ ID NO: 1922561 - protein, 6 aa, Staphylococcus
AEGTSA

SEQ ID NO: 1922562 - protein, 12 aa, Staphylococcus
AEGYARVSGKPG

SEQ ID NO: 1922563 - protein, 5 aa, Staphylococcus
AEGYR

SEQ ID NO: 1922564 - protein, 7 aa, Staphylococcus
AEHDENA

SEQ ID NO: 1922565 - protein, 10 aa, Staphylococcus
AEHEQGPPFP

SEQ ID NO: 1922566 - protein, 7 aa, Staphylococcus
AEHERNR

SEQ ID NO: 1922567 - protein, 4 aa, Staphylococcus
AEHH

SEQ ID NO: 1922568 - protein, 5 aa, Staphylococcus
AEHND

SEQ ID NO: 1922569 - protein, 5 aa, Staphylococcus
AEHNG

SEQ ID NO: 1922570 - protein, 6 aa, Staphylococcus
AEHNQS

SEQ ID NO: 1922571 - protein, 16 aa, Staphylococcus
AEHPHTAQQPENYELR

SEQ ID NO: 1922572 - protein, 8 aa, Staphylococcus
AEHPKRPK

SEQ ID NO: 1922573 - protein, 6 aa, Staphylococcus
AEHPQS

SEQ ID NO: 1922574 - protein, 10 aa, Staphylococcus
AEHPSSPCGT

SEQ ID NO: 1922575 - protein, 18 aa, Staphylococcus
AEHQEEPSWENNQEDMEG

SEQ ID NO: 1922576 - protein, 4 aa, Staphylococcus
AEHR

SEQ ID NO: 1922577 - protein, 7 aa, Staphylococcus
AEHRAPH

SEQ ID NO: 1922578 - protein, 9 aa, Staphylococcus
AEHRKAQNF

SEQ ID NO: 1922579 - protein, 10 aa, Staphylococcus
AEHRKAQNYA

SEQ ID NO: 1922580 - protein, 7 aa, Staphylococcus
AEHTQSY

SEQ ID NO: 1922581 - protein, 5 aa, Staphylococcus
AEIAE

SEQ ID NO: 1922582 - protein, 54 aa, Staphylococcus
AEIAQQEMRKSHTNDTELNDTDISNTDSSDTNDMNDVREENVEATKPNHPNHTN

SEQ ID NO: 1922583 - protein, 5 aa, Staphylococcus
AEIAT

SEQ ID NO: 1922584 - protein, 4 aa, Staphylococcus
AEID

SEQ ID NO: 1922585 - protein, 12 aa, Staphylococcus
AEIDESNDTSMK

SEQ ID NO: 1922586 - protein, 9 aa, Staphylococcus
AEIDPSTFE

SEQ ID NO: 1922587 - protein, 6 aa, Staphylococcus
AEIETS

SEQ ID NO: 1922588 - protein, 4 aa, Staphylococcus
AEIG

SEQ ID NO: 1922589 - protein, 10 aa, Staphylococcus
AEIGERTNVG

SEQ ID NO: 1922590 - protein, 10 aa, Staphylococcus
AEIGTKAYGS

SEQ ID NO: 1922591 - protein, 7 aa, Staphylococcus
AEIKSRD

SEQ ID NO: 1922592 - protein, 5 aa, Staphylococcus
AEINR

SEQ ID NO: 1922593 - protein, 8 aa, Staphylococcus
AEINSDTF

SEQ ID NO: 1922594 - protein, 7 aa, Staphylococcus
AEIQGDQ

SEQ ID NO: 1922595 - protein, 6 aa, Staphylococcus
AEIQGG

SEQ ID NO: 1922596 - protein, 9 aa, Staphylococcus
AEIRGGEDR

SEQ ID NO: 1922597 - protein, 5 aa, Staphylococcus
AEKAE

SEQ ID NO: 1922598 - protein, 8 aa, Staphylococcus
AEKAEDID

SEQ ID NO: 1922599 - protein, 19 aa, Staphylococcus
AEKAENYPNQLSGGQKQRV

SEQ ID NO: 1922600 - protein, 8 aa, Staphylococcus
AEKAGIEG

SEQ ID NO: 1922601 - protein, 8 aa, Staphylococcus
AEKAGYRS

SEQ ID NO: 1922602 - protein, 9 aa, Staphylococcus
AEKAKSEGV

SEQ ID NO: 1922603 - protein, 6 aa, Staphylococcus
AEKANV

SEQ ID NO: 1922604 - protein, 8 aa, Staphylococcus
AEKAQELD

SEQ ID NO: 1922605 - protein, 7 aa, Staphylococcus
AEKAYKG

SEQ ID NO: 1922606 - protein, 9 aa, Staphylococcus
AEKDDNDDV

SEQ ID NO: 1922607 - protein, 11 aa, Staphylococcus
AEKDENRDSEI

SEQ ID NO: 1922608 - protein, 6 aa, Staphylococcus
AEKDYK

SEQ ID NO: 1922609 - protein, 24 aa, Staphylococcus
AEKEENGEQPFANPRNAAAGSLRQ

SEQ ID NO: 1922610 - protein, 12 aa, Staphylococcus
AEKEGAKNHAGY

SEQ ID NO: 1922611 - protein, 5 aa, Staphylococcus
AEKEL

SEQ ID NO: 1922612 - protein, 10 aa, Staphylococcus
AEKENGISDD

SEQ ID NO: 1922613 - protein, 14 aa, Staphylococcus
AEKFDGDKLEGKTV

SEQ ID NO: 1922614 - protein, 6 aa, Staphylococcus
AEKGEA

SEQ ID NO: 1922615 - protein, 7 aa, Staphylococcus
AEKGEDV

SEQ ID NO: 1922616 - protein, 7 aa, Staphylococcus
AEKGEEV

SEQ ID NO: 1922617 - protein, 5 aa, Staphylococcus
AEKGH

SEQ ID NO: 1922618 - protein, 10 aa, Staphylococcus
AEKGHASTHN

SEQ ID NO: 1922619 - protein, 9 aa, Staphylococcus
AEKHGDLGN

SEQ ID NO: 1922620 - protein, 7 aa, Staphylococcus
AEKIDAD

SEQ ID NO: 1922621 - protein, 7 aa, Staphylococcus
AEKIPEI

SEQ ID NO: 1922622 - protein, 7 aa, Staphylococcus
AEKKNLK

SEQ ID NO: 1922623 - protein, 9 aa, Staphylococcus
AEKKRSRNV

SEQ ID NO: 1922624 - protein, 11 aa, Staphylococcus
AEKLEEERKKR

SEQ ID NO: 1922625 - protein, 9 aa, Staphylococcus
AEKLGLSGN

SEQ ID NO: 1922626 - protein, 11 aa, Staphylococcus
AEKLKASQFNY

SEQ ID NO: 1922627 - protein, 9 aa, Staphylococcus
AEKLSDRAI

SEQ ID NO: 1922628 - protein, 13 aa, Staphylococcus
AEKLYQYGKAHLN

SEQ ID NO: 1922629 - protein, 13 aa, Staphylococcus
AEKLYQYGKAHLS

SEQ ID NO: 1922630 - protein, 4 aa, Staphylococcus
AEKN

SEQ ID NO: 1922631 - protein, 9 aa, Staphylococcus
AEKNDNEDI

SEQ ID NO: 1922632 - protein, 10 aa, Staphylococcus
AEKNSKHNQI

SEQ ID NO: 1922633 - protein, 9 aa, Staphylococcus
AEKPNRPSL

SEQ ID NO: 1922634 - protein, 10 aa, Staphylococcus
AEKQDAPAYE

SEQ ID NO: 1922635 - protein, 10 aa, Staphylococcus
AEKQEQQALR

SEQ ID NO: 1922636 - protein, 4 aa, Staphylococcus
AEKR

SEQ ID NO: 1922637 - protein, 6 aa, Staphylococcus
AEKSEV

SEQ ID NO: 1922638 - protein, 9 aa, Staphylococcus
AEKSFNKEP

SEQ ID NO: 1922639 - protein, 7 aa, Staphylococcus
AEKTDAV

SEQ ID NO: 1922640 - protein, 24 aa, Staphylococcus
AEKTEKDKHSKDNQADPKTTSDTI

SEQ ID NO: 1922641 - protein, 6 aa, Staphylococcus
AEKTET

SEQ ID NO: 1922642 - protein, 7 aa, Staphylococcus
AEKTETH

SEQ ID NO: 1922643 - protein, 7 aa, Staphylococcus
AEKTNSI

SEQ ID NO: 1922644 - protein, 8 aa, Staphylococcus
AEKTNSVG

SEQ ID NO: 1922645 - protein, 6 aa, Staphylococcus
AEKTNV

SEQ ID NO: 1922646 - protein, 8 aa, Staphylococcus
AEKVNKTV

SEQ ID NO: 1922647 - protein, 10 aa, Staphylococcus
AEKVNTKGGA

SEQ ID NO: 1922648 - protein, 8 aa, Staphylococcus
AEKVTQEN

SEQ ID NO: 1922649 - protein, 6 aa, Staphylococcus
AEKYAD

SEQ ID NO: 1922650 - protein, 14 aa, Staphylococcus
AELAEEKNNTEQKL

SEQ ID NO: 1922651 - protein, 4 aa, Staphylococcus
AELD

SEQ ID NO: 1922652 - protein, 7 aa, Staphylococcus
AELENGN

SEQ ID NO: 1922653 - protein, 7 aa, Staphylococcus
AELENNQ

SEQ ID NO: 1922654 - protein, 6 aa, Staphylococcus
AELEPL

SEQ ID NO: 1922655 - protein, 9 aa, Staphylococcus
AELEPTPKW

SEQ ID NO: 1922656 - protein, 7 aa, Staphylococcus
AELEQEG

SEQ ID NO: 1922657 - protein, 5 aa, Staphylococcus
AELES

SEQ ID NO: 1922658 - protein, 5 aa, Staphylococcus
AELGA

SEQ ID NO: 1922659 - protein, 12 aa, Staphylococcus
AELGQALGKAER

SEQ ID NO: 1922660 - protein, 13 aa, Staphylococcus
AELGQSLGKSERV

SEQ ID NO: 1922661 - protein, 13 aa, Staphylococcus
AELKSKEEKLQKT

SEQ ID NO: 1922662 - protein, 10 aa, Staphylococcus
AELNGEPVPH

SEQ ID NO: 1922663 - protein, 7 aa, Staphylococcus
AELNPGT

SEQ ID NO: 1922664 - protein, 7 aa, Staphylococcus
AELNSGT

SEQ ID NO: 1922665 - protein, 6 aa, Staphylococcus
AELPKE

SEQ ID NO: 1922666 - protein, 6 aa, Staphylococcus
AELPQE

SEQ ID NO: 1922667 - protein, 23 aa, Staphylococcus
AELPRDEVQTVSTKTPYVSTGSD

SEQ ID NO: 1922668 - protein, 4 aa, Staphylococcus
AELQ

SEQ ID NO: 1922669 - protein, 7 aa, Staphylococcus
AELQGDQ

SEQ ID NO: 1922670 - protein, 7 aa, Staphylococcus
AELQGEQ

SEQ ID NO: 1922671 - protein, 9 aa, Staphylococcus
AELQGRSRA

SEQ ID NO: 1922672 - protein, 17 aa, Staphylococcus
AELQRIQQKQQDDKEFE

SEQ ID NO: 1922673 - protein, 4 aa, Staphylococcus
AELS

SEQ ID NO: 1922674 - protein, 9 aa, Staphylococcus
AELSGGQQQ

SEQ ID NO: 1922675 - protein, 9 aa, Staphylococcus
AELSQNDKL

SEQ ID NO: 1922676 - protein, 18 aa, Staphylococcus
AELTENGFESLETSDAVS

SEQ ID NO: 1922677 - protein, 7 aa, Staphylococcus
AELTRQT

SEQ ID NO: 1922678 - protein, 7 aa, Staphylococcus
AELTRRT

SEQ ID NO: 1922679 - protein, 4 aa, Staphylococcus
AEME

SEQ ID NO: 1922680 - protein, 13 aa, Staphylococcus
AEMKKAQDTPIEK

SEQ ID NO: 1922681 - protein, 7 aa, Staphylococcus
AEMNGEG

SEQ ID NO: 1922682 - protein, 9 aa, Staphylococcus
AEMTGRNDI

SEQ ID NO: 1922683 - protein, 20 aa, Staphylococcus
AEMTGRNDIQVGEAKISGNA

SEQ ID NO: 1922684 - protein, 20 aa, Staphylococcus
AEMTGRNDIQVGSAKISGNA

SEQ ID NO: 1922685 - protein, 4 aa, Staphylococcus
AENA

SEQ ID NO: 1922686 - protein, 5 aa, Staphylococcus
AENAE

SEQ ID NO: 1922687 - protein, 11 aa, Staphylococcus
AENAEDVSARG

SEQ ID NO: 1922688 - protein, 8 aa, Staphylococcus
AENAGLEG

SEQ ID NO: 1922689 - protein, 11 aa, Staphylococcus
AENAKALRQTM

SEQ ID NO: 1922690 - protein, 7 aa, Staphylococcus
AENAQRL

SEQ ID NO: 1922691 - protein, 5 aa, Staphylococcus
AENAS

SEQ ID NO: 1922692 - protein, 7 aa, Staphylococcus
AENATIA

SEQ ID NO: 1922693 - protein, 7 aa, Staphylococcus
AENDEEI

SEQ ID NO: 1922694 - protein, 6 aa, Staphylococcus
AENDNY

SEQ ID NO: 1922695 - protein, 4 aa, Staphylococcus
AENE

SEQ ID NO: 1922696 - protein, 8 aa, Staphylococcus
AENEDDLN

SEQ ID NO: 1922697 - protein, 10 aa, Staphylococcus
AENEVNSDVP

SEQ ID NO: 1922698 - protein, 9 aa, Staphylococcus
AENFGKSKA

SEQ ID NO: 1922699 - protein, 16 aa, Staphylococcus
AENFGNVRGDNRESYD

SEQ ID NO: 1922700 - protein, 4 aa, Staphylococcus
AENG

SEQ ID NO: 1922701 - protein, 16 aa, Staphylococcus
AENGEKAVEELYGAFD

SEQ ID NO: 1922702 - protein, 16 aa, Staphylococcus
AENGERAVQTLYQAFD

SEQ ID NO: 1922703 - protein, 5 aa, Staphylococcus
AENGH

SEQ ID NO: 1922704 - protein, 6 aa, Staphylococcus
AENGKY

SEQ ID NO: 1922705 - protein, 16 aa, Staphylococcus
AENGNKAVEVLYDAFD

SEQ ID NO: 1922706 - protein, 16 aa, Staphylococcus
AENGQRAVEELYNAFD

SEQ ID NO: 1922707 - protein, 9 aa, Staphylococcus
AENGRIEEG

SEQ ID NO: 1922708 - protein, 7 aa, Staphylococcus
AENGSHA

SEQ ID NO: 1922709 - protein, 4 aa, Staphylococcus
AENI

SEQ ID NO: 1922710 - protein, 5 aa, Staphylococcus
AENIA

SEQ ID NO: 1922711 - protein, 18 aa, Staphylococcus
AENIEVSDEDIDKELEKM

SEQ ID NO: 1922712 - protein, 19 aa, Staphylococcus
AENIEVSEKDIDKELEKMS

SEQ ID NO: 1922713 - protein, 6 aa, Staphylococcus
AENKDS

SEQ ID NO: 1922714 - protein, 18 aa, Staphylococcus
AENKHNQVDDYPYGGGQG

SEQ ID NO: 1922715 - protein, 6 aa, Staphylococcus
AENNEI

SEQ ID NO: 1922716 - protein, 4 aa, Staphylococcus
AENP

SEQ ID NO: 1922717 - protein, 7 aa, Staphylococcus
AENPPKI

SEQ ID NO: 1922718 - protein, 9 aa, Staphylococcus
AENQDKTNQ

SEQ ID NO: 1922719 - protein, 6 aa, Staphylococcus
AENQPT

SEQ ID NO: 1922720 - protein, 5 aa, Staphylococcus
AENQY

SEQ ID NO: 1922721 - protein, 6 aa, Staphylococcus
AENSEQ

SEQ ID NO: 1922722 - protein, 9 aa, Staphylococcus
AENTGVSKA

SEQ ID NO: 1922723 - protein, 8 aa, Staphylococcus
AENTQISK

SEQ ID NO: 1922724 - protein, 9 aa, Staphylococcus
AENTSVSKA

SEQ ID NO: 1922725 - protein, 4 aa, Staphylococcus
AENV

SEQ ID NO: 1922726 - protein, 5 aa, Staphylococcus
AENVE

SEQ ID NO: 1922727 - protein, 18 aa, Staphylococcus
AENVEVSDEDIDKELEKM

SEQ ID NO: 1922728 - protein, 9 aa, Staphylococcus
AENVKKSDK

SEQ ID NO: 1922729 - protein, 9 aa, Staphylococcus
AENVPKSDK

SEQ ID NO: 1922730 - protein, 11 aa, Staphylococcus
AENVQNGAKDI

SEQ ID NO: 1922731 - protein, 11 aa, Staphylococcus
AENVQNGNKDI

SEQ ID NO: 1922732 - protein, 15 aa, Staphylococcus
AENVSLRNDPDGRSR

SEQ ID NO: 1922733 - protein, 7 aa, Staphylococcus
AEPANEI

SEQ ID NO: 1922734 - protein, 4 aa, Staphylococcus
AEPD

SEQ ID NO: 1922735 - protein, 9 aa, Staphylococcus
AEPDDNKTS

SEQ ID NO: 1922736 - protein, 8 aa, Staphylococcus
AEPEEGDV

SEQ ID NO: 1922737 - protein, 15 aa, Staphylococcus
AEPENEVSNALESYS

SEQ ID NO: 1922738 - protein, 5 aa, Staphylococcus
AEPFG

SEQ ID NO: 1922739 - protein, 8 aa, Staphylococcus
AEPHDKAT

SEQ ID NO: 1922740 - protein, 8 aa, Staphylococcus
AEPHDNAT

SEQ ID NO: 1922741 - protein, 5 aa, Staphylococcus
AEPHE

SEQ ID NO: 1922742 - protein, 7 aa, Staphylococcus
AEPHNNA

SEQ ID NO: 1922743 - protein, 9 aa, Staphylococcus
AEPKKQNIR

SEQ ID NO: 1922744 - protein, 9 aa, Staphylococcus
AEPLESATT

SEQ ID NO: 1922745 - protein, 11 aa, Staphylococcus
AEPLNKKSSIT

SEQ ID NO: 1922746 - protein, 4 aa, Staphylococcus
AEPP

SEQ ID NO: 1922747 - protein, 8 aa, Staphylococcus
AEPPIETN

SEQ ID NO: 1922748 - protein, 7 aa, Staphylococcus
AEPQKEI

SEQ ID NO: 1922749 - protein, 6 aa, Staphylococcus
AEPSKD

SEQ ID NO: 1922750 - protein, 7 aa, Staphylococcus
AEPTGQA

SEQ ID NO: 1922751 - protein, 8 aa, Staphylococcus
AEPYENSN

SEQ ID NO: 1922752 - protein, 7 aa, Staphylococcus
AEQAGLE

SEQ ID NO: 1922753 - protein, 8 aa, Staphylococcus
AEQAKQLS

SEQ ID NO: 1922754 - protein, 8 aa, Staphylococcus
AEQALEAG

SEQ ID NO: 1922755 - protein, 14 aa, Staphylococcus
AEQALNNQKTDDRI

SEQ ID NO: 1922756 - protein, 5 aa, Staphylococcus
AEQCQ

SEQ ID NO: 1922757 - protein, 8 aa, Staphylococcus
AEQDDRHD

SEQ ID NO: 1922758 - protein, 19 aa, Staphylococcus
AEQDGEVSDPIGGNYSDYQ

SEQ ID NO: 1922759 - protein, 14 aa, Staphylococcus
AEQDKTSENANKGR

SEQ ID NO: 1922760 - protein, 9 aa, Staphylococcus
AEQELNTTH

SEQ ID NO: 1922761 - protein, 7 aa, Staphylococcus
AEQEQSQ

SEQ ID NO: 1922762 - protein, 6 aa, Staphylococcus
AEQERL

SEQ ID NO: 1922763 - protein, 7 aa, Staphylococcus
AEQERLN

SEQ ID NO: 1922764 - protein, 17 aa, Staphylococcus
AEQERTKYGNLFMSISE

SEQ ID NO: 1922765 - protein, 7 aa, Staphylococcus
AEQGEDV

SEQ ID NO: 1922766 - protein, 5 aa, Staphylococcus
AEQGT

SEQ ID NO: 1922767 - protein, 19 aa, Staphylococcus
AEQGVNETPNNNDPDDNRK

SEQ ID NO: 1922768 - protein, 7 aa, Staphylococcus
AEQHGEN

SEQ ID NO: 1922769 - protein, 12 aa, Staphylococcus
AEQHNKKDISHL

SEQ ID NO: 1922770 - protein, 7 aa, Staphylococcus
AEQITRE

SEQ ID NO: 1922771 - protein, 7 aa, Staphylococcus
AEQLKGS

SEQ ID NO: 1922772 - protein, 7 aa, Staphylococcus
AEQLKGT

SEQ ID NO: 1922773 - protein, 14 aa, Staphylococcus
AEQLKQGQEIVGNR

SEQ ID NO: 1922774 - protein, 6 aa, Staphylococcus
AEQLRD

SEQ ID NO: 1922775 - protein, 11 aa, Staphylococcus
AEQNEAKPTNK

SEQ ID NO: 1922776 - protein, 11 aa, Staphylococcus
AEQNEVKPTNK

SEQ ID NO: 1922777 - protein, 7 aa, Staphylococcus
AEQPITE

SEQ ID NO: 1922778 - protein, 9 aa, Staphylococcus
AEQQDNPNS

SEQ ID NO: 1922779 - protein, 5 aa, Staphylococcus
AEQQG

SEQ ID NO: 1922780 - protein, 6 aa, Staphylococcus
AEQSAI

SEQ ID NO: 1922781 - protein, 9 aa, Staphylococcus
AEQSVRKED

SEQ ID NO: 1922782 - protein, 14 aa, Staphylococcus
AEQTDKLKELNNGE

SEQ ID NO: 1922783 - protein, 6 aa, Staphylococcus
AEQTEV

SEQ ID NO: 1922784 - protein, 7 aa, Staphylococcus
AEQTKSI

SEQ ID NO: 1922785 - protein, 7 aa, Staphylococcus
AEQTNSV

SEQ ID NO: 1922786 - protein, 7 aa, Staphylococcus
AEQTQSI

SEQ ID NO: 1922787 - protein, 14 aa, Staphylococcus
AEQVEAVTNTGDIP

SEQ ID NO: 1922788 - protein, 8 aa, Staphylococcus
AEQVTQEN

SEQ ID NO: 1922789 - protein, 12 aa, Staphylococcus
AEQYENYKEKES

SEQ ID NO: 1922790 - protein, 13 aa, Staphylococcus
AEQYVEEGQFPAG

SEQ ID NO: 1922791 - protein, 5 aa, Staphylococcus
AERCI

SEQ ID NO: 1922792 - protein, 6 aa, Staphylococcus
AERDAA

SEQ ID NO: 1922793 - protein, 8 aa, Staphylococcus
AERDQEGN

SEQ ID NO: 1922794 - protein, 8 aa, Staphylococcus
AERDQYDM

SEQ ID NO: 1922795 - protein, 4 aa, Staphylococcus
AERE

SEQ ID NO: 1922796 - protein, 23 aa, Staphylococcus
AEREGKIKPGDTIVEPTSGNTGI

SEQ ID NO: 1922797 - protein, 5 aa, Staphylococcus
AEREV

SEQ ID NO: 1922798 - protein, 5 aa, Staphylococcus
AERHY

SEQ ID NO: 1922799 - protein, 4 aa, Staphylococcus
AERK

SEQ ID NO: 1922800 - protein, 9 aa, Staphylococcus
AERKQHGLN

SEQ ID NO: 1922801 - protein, 10 aa, Staphylococcus
AERKQRQLST

SEQ ID NO: 1922802 - protein, 7 aa, Staphylococcus
AERLAND

SEQ ID NO: 1922803 - protein, 11 aa, Staphylococcus
AERLEEDSSQL

SEQ ID NO: 1922804 - protein, 6 aa, Staphylococcus
AERLGL

SEQ ID NO: 1922805 - protein, 7 aa, Staphylococcus
AERNNPD

SEQ ID NO: 1922806 - protein, 5 aa, Staphylococcus
AERNV

SEQ ID NO: 1922807 - protein, 8 aa, Staphylococcus
AERPGDIE

SEQ ID NO: 1922808 - protein, 8 aa, Staphylococcus
AERPGDIS

SEQ ID NO: 1922809 - protein, 12 aa, Staphylococcus
AERRAGSAGLQV

SEQ ID NO: 1922810 - protein, 7 aa, Staphylococcus
AERSDEL

SEQ ID NO: 1922811 - protein, 23 aa, Staphylococcus
AERVNASKSLNGPQASFDGNKEE

SEQ ID NO: 1922812 - protein, 5 aa, Staphylococcus
AERYG

SEQ ID NO: 1922813 - protein, 16 aa, Staphylococcus
AESAEDARRKYEEGNN

SEQ ID NO: 1922814 - protein, 20 aa, Staphylococcus
AESDDESEQQLADVIKDHRQ

SEQ ID NO: 1922815 - protein, 9 aa, Staphylococcus
AESDEDLNA

SEQ ID NO: 1922816 - protein, 5 aa, Staphylococcus
AESDI

SEQ ID NO: 1922817 - protein, 6 aa, Staphylococcus
AESDID

SEQ ID NO: 1922818 - protein, 12 aa, Staphylococcus
AESDKEVRSRGI

SEQ ID NO: 1922819 - protein, 7 aa, Staphylococcus
AESDPSE

SEQ ID NO: 1922820 - protein, 9 aa, Staphylococcus
AESDQTTLF

SEQ ID NO: 1922821 - protein, 6 aa, Staphylococcus
AESEAI

SEQ ID NO: 1922822 - protein, 10 aa, Staphylococcus
AESEISKSTF

SEQ ID NO: 1922823 - protein, 9 aa, Staphylococcus
AESEISKTT

SEQ ID NO: 1922824 - protein, 5 aa, Staphylococcus
AESEL

SEQ ID NO: 1922825 - protein, 24 aa, Staphylococcus
AESEYKKSLAKKERKLSARHILGF

SEQ ID NO: 1922826 - protein, 6 aa, Staphylococcus
AESFDQ

SEQ ID NO: 1922827 - protein, 6 aa, Staphylococcus
AESFTQ

SEQ ID NO: 1922828 - protein, 4 aa, Staphylococcus
AESH

SEQ ID NO: 1922829 - protein, 5 aa, Staphylococcus
AESIA

SEQ ID NO: 1922830 - protein, 20 aa, Staphylococcus
AESIDETKNNNGLVNPTSNE

SEQ ID NO: 1922831 - protein, 9 aa, Staphylococcus
AESIEDSDI

SEQ ID NO: 1922832 - protein, 5 aa, Staphylococcus
AESIQ

SEQ ID NO: 1922833 - protein, 5 aa, Staphylococcus
AESIT

SEQ ID NO: 1922834 - protein, 14 aa, Staphylococcus
AESKAKQKDYHKAA

SEQ ID NO: 1922835 - protein, 8 aa, Staphylococcus
AESKEQAL

SEQ ID NO: 1922836 - protein, 14 aa, Staphylococcus
AESKEQAMKIYEEG

SEQ ID NO: 1922837 - protein, 10 aa, Staphylococcus
AESKNDIDSV

SEQ ID NO: 1922838 - protein, 6 aa, Staphylococcus
AESKQF

SEQ ID NO: 1922839 - protein, 4 aa, Staphylococcus
AESL

SEQ ID NO: 1922840 - protein, 8 aa, Staphylococcus
AESLKSQG

SEQ ID NO: 1922841 - protein, 9 aa, Staphylococcus
AESNAASRR

SEQ ID NO: 1922842 - protein, 7 aa, Staphylococcus
AESNDEL

SEQ ID NO: 1922843 - protein, 9 aa, Staphylococcus
AESNNIYQS

SEQ ID NO: 1922844 - protein, 7 aa, Staphylococcus
AESNNTD

SEQ ID NO: 1922845 - protein, 9 aa, Staphylococcus
AESNQTDWG

SEQ ID NO: 1922846 - protein, 4 aa, Staphylococcus
AESP

SEQ ID NO: 1922847 - protein, 8 aa, Staphylococcus
AESPTRLS

SEQ ID NO: 1922848 - protein, 5 aa, Staphylococcus
AESQG

SEQ ID NO: 1922849 - protein, 9 aa, Staphylococcus
AESQSDLEA

SEQ ID NO: 1922850 - protein, 9 aa, Staphylococcus
AESQSEALD

SEQ ID NO: 1922851 - protein, 58 aa, Staphylococcus
AESQTEETTENNSEETSNSVENTESNNSQDVETNEEAANKDASNEEDENVDPKDQEIE

SEQ ID NO: 1922852 - protein, 9 aa, Staphylococcus
AESRQTDWG

SEQ ID NO: 1922853 - protein, 9 aa, Staphylococcus
AESRQVDPN

SEQ ID NO: 1922854 - protein, 9 aa, Staphylococcus
AESRSGTFP

SEQ ID NO: 1922855 - protein, 10 aa, Staphylococcus
AESSEAKPIE

SEQ ID NO: 1922856 - protein, 6 aa, Staphylococcus
AESSEE

SEQ ID NO: 1922857 - protein, 9 aa, Staphylococcus
AESSITPRK

SEQ ID NO: 1922858 - protein, 6 aa, Staphylococcus
AESTET

SEQ ID NO: 1922859 - protein, 5 aa, Staphylococcus
AESVP

SEQ ID NO: 1922860 - protein, 4 aa, Staphylococcus
AESW

SEQ ID NO: 1922861 - protein, 6 aa, Staphylococcus
AESYGH

SEQ ID NO: 1922862 - protein, 11 aa, Staphylococcus
AESYGHDPSQL

SEQ ID NO: 1922863 - protein, 11 aa, Staphylococcus
AESYGHNPDEL

SEQ ID NO: 1922864 - protein, 14 aa, Staphylococcus
AESYQGKVPDSPEL

SEQ ID NO: 1922865 - protein, 8 aa, Staphylococcus
AETAEEID

SEQ ID NO: 1922866 - protein, 6 aa, Staphylococcus
AETAKK

SEQ ID NO: 1922867 - protein, 17 aa, Staphylococcus
AETAKYAKESLDRMLSI

SEQ ID NO: 1922868 - protein, 5 aa, Staphylococcus
AETAL

SEQ ID NO: 1922869 - protein, 10 aa, Staphylococcus
AETAQDIQAG

SEQ ID NO: 1922870 - protein, 8 aa, Staphylococcus
AETASEID

SEQ ID NO: 1922871 - protein, 9 aa, Staphylococcus
AETASEIDV

SEQ ID NO: 1922872 - protein, 8 aa, Staphylococcus
AETATEID

SEQ ID NO: 1922873 - protein, 4 aa, Staphylococcus
AETD

SEQ ID NO: 1922874 - protein, 6 aa, Staphylococcus
AETDDE

SEQ ID NO: 1922875 - protein, 5 aa, Staphylococcus
AETDI

SEQ ID NO: 1922876 - protein, 6 aa, Staphylococcus
AETDYK

SEQ ID NO: 1922877 - protein, 7 aa, Staphylococcus
AETEDKF

SEQ ID NO: 1922878 - protein, 8 aa, Staphylococcus
AETENKLS

SEQ ID NO: 1922879 - protein, 7 aa, Staphylococcus
AETFGKG

SEQ ID NO: 1922880 - protein, 13 aa, Staphylococcus
AETFGKGDYRESY

SEQ ID NO: 1922881 - protein, 13 aa, Staphylococcus
AETGAGQHGVASA

SEQ ID NO: 1922882 - protein, 5 aa, Staphylococcus
AETGI

SEQ ID NO: 1922883 - protein, 16 aa, Staphylococcus
AETGRERIENNDRNMN

SEQ ID NO: 1922884 - protein, 7 aa, Staphylococcus
AETIDSA

SEQ ID NO: 1922885 - protein, 5 aa, Staphylococcus
AETIP

SEQ ID NO: 1922886 - protein, 14 aa, Staphylococcus
AETKIGKQIKEKYG

SEQ ID NO: 1922887 - protein, 5 aa, Staphylococcus
AETLN

SEQ ID NO: 1922888 - protein, 6 aa, Staphylococcus
AETNED

SEQ ID NO: 1922889 - protein, 8 aa, Staphylococcus
AETNLPSR

SEQ ID NO: 1922890 - protein, 8 aa, Staphylococcus
AETNLSSR

SEQ ID NO: 1922891 - protein, 9 aa, Staphylococcus
AETNNTSDL

SEQ ID NO: 1922892 - protein, 12 aa, Staphylococcus
AETNNTTSDAEE

SEQ ID NO: 1922893 - protein, 25 aa, Staphylococcus
AETNPKYDVDNRTAKLSANFLYHFI

SEQ ID NO: 1922894 - protein, 8 aa, Staphylococcus
AETPADIQ

SEQ ID NO: 1922895 - protein, 8 aa, Staphylococcus
AETPDPEC

SEQ ID NO: 1922896 - protein, 7 aa, Staphylococcus
AETPEEM

SEQ ID NO: 1922897 - protein, 16 aa, Staphylococcus
AETPIQMNDSDSMRSL

SEQ ID NO: 1922898 - protein, 5 aa, Staphylococcus
AETPN

SEQ ID NO: 1922899 - protein, 10 aa, Staphylococcus
AETPQDIKAG

SEQ ID NO: 1922900 - protein, 16 aa, Staphylococcus
AETPQDIKAGYDFGSK

SEQ ID NO: 1922901 - protein, 8 aa, Staphylococcus
AETPQDIQ

SEQ ID NO: 1922902 - protein, 12 aa, Staphylococcus
AETQLKQHHAQD

SEQ ID NO: 1922903 - protein, 19 aa, Staphylococcus
AETSESSDETESDADTNTV

SEQ ID NO: 1922904 - protein, 12 aa, Staphylococcus
AETSNKQPSIEA

SEQ ID NO: 1922905 - protein, 8 aa, Staphylococcus
AETTEPGG

SEQ ID NO: 1922906 - protein, 6 aa, Staphylococcus
AETTHT

SEQ ID NO: 1922907 - protein, 11 aa, Staphylococcus
AETTKRAKHFQ

SEQ ID NO: 1922908 - protein, 15 aa, Staphylococcus
AETTSEDKRDHSSQL

SEQ ID NO: 1922909 - protein, 5 aa, Staphylococcus
AETTT

SEQ ID NO: 1922910 - protein, 19 aa, Staphylococcus
AETVEQYTGKKEEQPKTIE

SEQ ID NO: 1922911 - protein, 12 aa, Staphylococcus
AETYGKGDYRAS

SEQ ID NO: 1922912 - protein, 6 aa, Staphylococcus
AEVDEE

SEQ ID NO: 1922913 - protein, 4 aa, Staphylococcus
AEVE

SEQ ID NO: 1922914 - protein, 8 aa, Staphylococcus
AEVEGRPE

SEQ ID NO: 1922915 - protein, 8 aa, Staphylococcus
AEVERDPF

SEQ ID NO: 1922916 - protein, 6 aa, Staphylococcus
AEVNRS

SEQ ID NO: 1922917 - protein, 10 aa, Staphylococcus
AEVPSSPCGE

SEQ ID NO: 1922918 - protein, 10 aa, Staphylococcus
AEVPSSPKVF

SEQ ID NO: 1922919 - protein, 4 aa, Staphylococcus
AEVS

SEQ ID NO: 1922920 - protein, 8 aa, Staphylococcus
AEVSHPNA

SEQ ID NO: 1922921 - protein, 26 aa, Staphylococcus
AEVSSQDVADATRIQYGGSVKPNNVK

SEQ ID NO: 1922922 - protein, 9 aa, Staphylococcus
AEVTHSKEG

SEQ ID NO: 1922923 - protein, 18 aa, Staphylococcus
AEWQGHQRGDHSQATKGG

SEQ ID NO: 1922924 - protein, 10 aa, Staphylococcus
AEYEKERGLY

SEQ ID NO: 1922925 - protein, 4 aa, Staphylococcus
AEYF

SEQ ID NO: 1922926 - protein, 4 aa, Staphylococcus
AEYG

SEQ ID NO: 1922927 - protein, 8 aa, Staphylococcus
AEYGTPTE

SEQ ID NO: 1922928 - protein, 11 aa, Staphylococcus
AEYNDTNHITD

SEQ ID NO: 1922929 - protein, 8 aa, Staphylococcus
AEYNKNGK

SEQ ID NO: 1922930 - protein, 4 aa, Staphylococcus
AEYQ

SEQ ID NO: 1922931 - protein, 8 aa, Staphylococcus
AEYSEGSY

SEQ ID NO: 1922932 - protein, 8 aa, Staphylococcus
AEYSPGND

SEQ ID NO: 1922933 - protein, 5 aa, Staphylococcus
AFAPS

SEQ ID NO: 1922934 - protein, 13 aa, Staphylococcus
AFAQRRKTINNNY

SEQ ID NO: 1922935 - protein, 7 aa, Staphylococcus
AFASGSP

SEQ ID NO: 1922936 - protein, 12 aa, Staphylococcus
AFDADDANQPNI

SEQ ID NO: 1922937 - protein, 20 aa, Staphylococcus
AFDEGEYANETSEVKGQKVR

SEQ ID NO: 1922938 - protein, 13 aa, Staphylococcus
AFDKNKDNKITEG

SEQ ID NO: 1922939 - protein, 7 aa, Staphylococcus
AFDKSGI

SEQ ID NO: 1922940 - protein, 4 aa, Staphylococcus
AFDP

SEQ ID NO: 1922941 - protein, 12 aa, Staphylococcus
AFDSDDTKQPNI

SEQ ID NO: 1922942 - protein, 11 aa, Staphylococcus
AFDSDETRQPN

SEQ ID NO: 1922943 - protein, 6 aa, Staphylococcus
AFEDGE

SEQ ID NO: 1922944 - protein, 8 aa, Staphylococcus
AFEKQKDK

SEQ ID NO: 1922945 - protein, 6 aa, Staphylococcus
AFEQGG

SEQ ID NO: 1922946 - protein, 5 aa, Staphylococcus
AFESN

SEQ ID NO: 1922947 - protein, 7 aa, Staphylococcus
AFESQSE

SEQ ID NO: 1922948 - protein, 10 aa, Staphylococcus
AFETSDKSYV

SEQ ID NO: 1922949 - protein, 21 aa, Staphylococcus
AFGASTPKKNTPQNTIQQPTT

SEQ ID NO: 1922950 - protein, 14 aa, Staphylococcus
AFGASTPKVNTPQV

SEQ ID NO: 1922951 - protein, 15 aa, Staphylococcus
AFGPTTPKDKTPALT

SEQ ID NO: 1922952 - protein, 4 aa, Staphylococcus
AFGQ

SEQ ID NO: 1922953 - protein, 6 aa, Staphylococcus
AFGQSA

SEQ ID NO: 1922954 - protein, 8 aa, Staphylococcus
AFGSNYDR

SEQ ID NO: 1922955 - protein, 7 aa, Staphylococcus
AFGTEKE

SEQ ID NO: 1922956 - protein, 4 aa, Staphylococcus
AFKE

SEQ ID NO: 1922957 - protein, 18 aa, Staphylococcus
AFKEAHKNTGKSEDSPVI

SEQ ID NO: 1922958 - protein, 6 aa, Staphylococcus
AFKGKY

SEQ ID NO: 1922959 - protein, 5 aa, Staphylococcus
AFKND

SEQ ID NO: 1922960 - protein, 8 aa, Staphylococcus
AFKNPTDQ

SEQ ID NO: 1922961 - protein, 9 aa, Staphylococcus
AFKPSSEDS

SEQ ID NO: 1922962 - protein, 9 aa, Staphylococcus
AFKPTDKDS

SEQ ID NO: 1922963 - protein, 8 aa, Staphylococcus
AFKPTSDD

SEQ ID NO: 1922964 - protein, 9 aa, Staphylococcus
AFKPTSNDS

SEQ ID NO: 1922965 - protein, 9 aa, Staphylococcus
AFKPTSTDS

SEQ ID NO: 1922966 - protein, 9 aa, Staphylococcus
AFKSSDDNN

SEQ ID NO: 1922967 - protein, 28 aa, Staphylococcus
AFKSSQYNNIGNPGQPNYDELAKSKPDV

SEQ ID NO: 1922968 - protein, 5 aa, Staphylococcus
AFNPD

SEQ ID NO: 1922969 - protein, 7 aa, Staphylococcus
AFPDKKA

SEQ ID NO: 1922970 - protein, 5 aa, Staphylococcus
AFPDS

SEQ ID NO: 1922971 - protein, 15 aa, Staphylococcus
AFPDSADKQQDHYQT

SEQ ID NO: 1922972 - protein, 6 aa, Staphylococcus
AFPDSE

SEQ ID NO: 1922973 - protein, 7 aa, Staphylococcus
AFPDSHE

SEQ ID NO: 1922974 - protein, 6 aa, Staphylococcus
AFPQQQ

SEQ ID NO: 1922975 - protein, 4 aa, Staphylococcus
AFPT

SEQ ID NO: 1922976 - protein, 12 aa, Staphylococcus
AFQDEQSEDNDR

SEQ ID NO: 1922977 - protein, 5 aa, Staphylococcus
AFQET

SEQ ID NO: 1922978 - protein, 7 aa, Staphylococcus
AFQETNI

SEQ ID NO: 1922979 - protein, 6 aa, Staphylococcus
AFRKGD

SEQ ID NO: 1922980 - protein, 10 aa, Staphylococcus
AFRPAKDQFD

SEQ ID NO: 1922981 - protein, 8 aa, Staphylococcus
AFRPPKEQ

SEQ ID NO: 1922982 - protein, 5 aa, Staphylococcus
AFRQS

SEQ ID NO: 1922983 - protein, 12 aa, Staphylococcus
AFRSGDSITGST

SEQ ID NO: 1922984 - protein, 10 aa, Staphylococcus
AFRSSKEQYD

SEQ ID NO: 1922985 - protein, 12 aa, Staphylococcus
AFRSSNKLQEKI

SEQ ID NO: 1922986 - protein, 7 aa, Staphylococcus
AFSDEDK

SEQ ID NO: 1922987 - protein, 6 aa, Staphylococcus
AFSDES

SEQ ID NO: 1922988 - protein, 7 aa, Staphylococcus
AFSDNHE

SEQ ID NO: 1922989 - protein, 11 aa, Staphylococcus
AFSEGKTETPL

SEQ ID NO: 1922990 - protein, 6 aa, Staphylococcus
AFSEKQ

SEQ ID NO: 1922991 - protein, 14 aa, Staphylococcus
AFSENSDQMLTEGN

SEQ ID NO: 1922992 - protein, 12 aa, Staphylococcus
AFSQRRKTIANN

SEQ ID NO: 1922993 - protein, 12 aa, Staphylococcus
AFSQRRKTINNN

SEQ ID NO: 1922994 - protein, 6 aa, Staphylococcus
AFSSEQ

SEQ ID NO: 1922995 - protein, 12 aa, Staphylococcus
AFSSKAQKQLKQ

SEQ ID NO: 1922996 - protein, 11 aa, Staphylococcus
AFSYKSTHPEI

SEQ ID NO: 1922997 - protein, 11 aa, Staphylococcus
AFTEQDREYYE

SEQ ID NO: 1922998 - protein, 10 aa, Staphylococcus
AFTGNDTEEL

SEQ ID NO: 1922999 - protein, 5 aa, Staphylococcus
AFTGS

SEQ ID NO: 1923000 - protein, 7 aa, Staphylococcus
AFTGSRE

SEQ ID NO: 1923001 - protein, 15 aa, Staphylococcus
AFTKEGNTSQTPGKL

SEQ ID NO: 1923002 - protein, 6 aa, Staphylococcus
AFTKQY

SEQ ID NO: 1923003 - protein, 7 aa, Staphylococcus
AFTPKTV

SEQ ID NO: 1923004 - protein, 7 aa, Staphylococcus
AFTPNTV

SEQ ID NO: 1923005 - protein, 6 aa, Staphylococcus
AFTPSE

SEQ ID NO: 1923006 - protein, 8 aa, Staphylococcus
AFTSTNEG

SEQ ID NO: 1923007 - protein, 12 aa, Staphylococcus
AFYGSSKAALNG

SEQ ID NO: 1923008 - protein, 7 aa, Staphylococcus
AGAAADF

SEQ ID NO: 1923009 - protein, 5 aa, Staphylococcus
AGADF

SEQ ID NO: 1923010 - protein, 7 aa, Staphylococcus
AGADQSI

SEQ ID NO: 1923011 - protein, 9 aa, Staphylococcus
AGADQSIVQ

SEQ ID NO: 1923012 - protein, 26 aa, Staphylococcus
AGADQSIVQGKSYQQSVTRKENQSLE

SEQ ID NO: 1923013 - protein, 26 aa, Staphylococcus
AGADQSIVQGSAYQQTVTRRNQPSLE

SEQ ID NO: 1923014 - protein, 6 aa, Staphylococcus
AGAETV

SEQ ID NO: 1923015 - protein, 12 aa, Staphylococcus
AGAGAQAGFSSD

SEQ ID NO: 1923016 - protein, 9 aa, Staphylococcus
AGAGQRGAV

SEQ ID NO: 1923017 - protein, 5 aa, Staphylococcus
AGAKE

SEQ ID NO: 1923018 - protein, 4 aa, Staphylococcus
AGAN

SEQ ID NO: 1923019 - protein, 15 aa, Staphylococcus
AGANAALNAFDYIIR

SEQ ID NO: 1923020 - protein, 5 aa, Staphylococcus
AGANK

SEQ ID NO: 1923021 - protein, 11 aa, Staphylococcus
AGANSNSSHPM

SEQ ID NO: 1923022 - protein, 10 aa, Staphylococcus
AGANSSSNHP

SEQ ID NO: 1923023 - protein, 5 aa, Staphylococcus
AGAQH

SEQ ID NO: 1923024 - protein, 6 aa, Staphylococcus
AGAQNK

SEQ ID NO: 1923025 - protein, 10 aa, Staphylococcus
AGASGYTNGV

SEQ ID NO: 1923026 - protein, 7 aa, Staphylococcus
AGASGYV

SEQ ID NO: 1923027 - protein, 16 aa, Staphylococcus
AGASGYVDGERYSNVN

SEQ ID NO: 1923028 - protein, 14 aa, Staphylococcus
AGASGYVEGERYTN

SEQ ID NO: 1923029 - protein, 16 aa, Staphylococcus
AGASGYVNGERYSNLN

SEQ ID NO: 1923030 - protein, 16 aa, Staphylococcus
AGASGYVNGKRYTNVN

SEQ ID NO: 1923031 - protein, 11 aa, Staphylococcus
AGASKNSSHPM

SEQ ID NO: 1923032 - protein, 12 aa, Staphylococcus
AGASTKDKSVSD

SEQ ID NO: 1923033 - protein, 13 aa, Staphylococcus
AGASTTDKSAETL

SEQ ID NO: 1923034 - protein, 7 aa, Staphylococcus
AGASYGG

SEQ ID NO: 1923035 - protein, 5 aa, Staphylococcus
AGATM

SEQ ID NO: 1923036 - protein, 10 aa, Staphylococcus
AGATRIGASA

SEQ ID NO: 1923037 - protein, 4 aa, Staphylococcus
AGCT

SEQ ID NO: 1923038 - protein, 9 aa, Staphylococcus
AGCVNDTPA

SEQ ID NO: 1923039 - protein, 6 aa, Staphylococcus
AGDARS

SEQ ID NO: 1923040 - protein, 6 aa, Staphylococcus
AGDATA

SEQ ID NO: 1923041 - protein, 9 aa, Staphylococcus
AGDAYVESG

SEQ ID NO: 1923042 - protein, 4 aa, Staphylococcus
AGDD

SEQ ID NO: 1923043 - protein, 4 aa, Staphylococcus
AGDE

SEQ ID NO: 1923044 - protein, 5 aa, Staphylococcus
AGDEA

SEQ ID NO: 1923045 - protein, 9 aa, Staphylococcus
AGDEAQGAT

SEQ ID NO: 1923046 - protein, 9 aa, Staphylococcus
AGDEGIDTK

SEQ ID NO: 1923047 - protein, 9 aa, Staphylococcus
AGDEGLDEK

SEQ ID NO: 1923048 - protein, 9 aa, Staphylococcus
AGDEGLDQQ

SEQ ID NO: 1923049 - protein, 10 aa, Staphylococcus
AGDEGLEADQ

SEQ ID NO: 1923050 - protein, 5 aa, Staphylococcus
AGDER

SEQ ID NO: 1923051 - protein, 9 aa, Staphylococcus
AGDFDKSKT

SEQ ID NO: 1923052 - protein, 7 aa, Staphylococcus
AGDFEET

SEQ ID NO: 1923053 - protein, 12 aa, Staphylococcus
AGDGSGQHPTQS

SEQ ID NO: 1923054 - protein, 7 aa, Staphylococcus
AGDHNEW

SEQ ID NO: 1923055 - protein, 6 aa, Staphylococcus
AGDPSI

SEQ ID NO: 1923056 - protein, 9 aa, Staphylococcus
AGDQARGGT

SEQ ID NO: 1923057 - protein, 6 aa, Staphylococcus
AGDQQA

SEQ ID NO: 1923058 - protein, 6 aa, Staphylococcus
AGDQTA

SEQ ID NO: 1923059 - protein, 4 aa, Staphylococcus
AGDR

SEQ ID NO: 1923060 - protein, 8 aa, Staphylococcus
AGDRKDAN

SEQ ID NO: 1923061 - protein, 5 aa, Staphylococcus
AGDRQ

SEQ ID NO: 1923062 - protein, 5 aa, Staphylococcus
AGDSL

SEQ ID NO: 1923063 - protein, 10 aa, Staphylococcus
AGDTKPVKEA

SEQ ID NO: 1923064 - protein, 7 aa, Staphylococcus
AGDTVEV

SEQ ID NO: 1923065 - protein, 5 aa, Staphylococcus
AGDVI

SEQ ID NO: 1923066 - protein, 7 aa, Staphylococcus
AGDVPRV

SEQ ID NO: 1923067 - protein, 9 aa, Staphylococcus
AGEAEDDVS

SEQ ID NO: 1923068 - protein, 10 aa, Staphylococcus
AGEAGDDVSE

SEQ ID NO: 1923069 - protein, 7 aa, Staphylococcus
AGEASEV

SEQ ID NO: 1923070 - protein, 12 aa, Staphylococcus
AGEASGFGGGGL

SEQ ID NO: 1923071 - protein, 9 aa, Staphylococcus
AGECSDSHN

SEQ ID NO: 1923072 - protein, 9 aa, Staphylococcus
AGEDAKDAT

SEQ ID NO: 1923073 - protein, 6 aa, Staphylococcus
AGEDKI

SEQ ID NO: 1923074 - protein, 7 aa, Staphylococcus
AGEDNQL

SEQ ID NO: 1923075 - protein, 13 aa, Staphylococcus
AGEDVSEWTRQTS

SEQ ID NO: 1923076 - protein, 6 aa, Staphylococcus
AGEEFD

SEQ ID NO: 1923077 - protein, 10 aa, Staphylococcus
AGEEIEGHGA

SEQ ID NO: 1923078 - protein, 14 aa, Staphylococcus
AGEEMEQAGSEQLY

SEQ ID NO: 1923079 - protein, 8 aa, Staphylococcus
AGEEMQQL

SEQ ID NO: 1923080 - protein, 7 aa, Staphylococcus
AGEEPNS

SEQ ID NO: 1923081 - protein, 10 aa, Staphylococcus
AGEERPLPTT

SEQ ID NO: 1923082 - protein, 7 aa, Staphylococcus
AGEETEV

SEQ ID NO: 1923083 - protein, 27 aa, Staphylococcus
AGEEVVGKHGTKAKVGVGIGSAEPSEY

SEQ ID NO: 1923084 - protein, 4 aa, Staphylococcus
AGEG

SEQ ID NO: 1923085 - protein, 5 aa, Staphylococcus
AGEGA

SEQ ID NO: 1923086 - protein, 14 aa, Staphylococcus
AGEGAPGENGGPHG

SEQ ID NO: 1923087 - protein, 15 aa, Staphylococcus
AGEGAPGENGGPQGD

SEQ ID NO: 1923088 - protein, 15 aa, Staphylococcus
AGEGAPGHNGGPQGD

SEQ ID NO: 1923089 - protein, 26 aa, Staphylococcus
AGEGLATEETPLDYNSTGDRKVTVDG

SEQ ID NO: 1923090 - protein, 14 aa, Staphylococcus
AGEGSPGVNGGPHG

SEQ ID NO: 1923091 - protein, 15 aa, Staphylococcus
AGEGSPGVNGGPSGD

SEQ ID NO: 1923092 - protein, 14 aa, Staphylococcus
AGEGTPGENGGPHG

SEQ ID NO: 1923093 - protein, 15 aa, Staphylococcus
AGEGWDTPPFEPTVT

SEQ ID NO: 1923094 - protein, 5 aa, Staphylococcus
AGEGY

SEQ ID NO: 1923095 - protein, 15 aa, Staphylococcus
AGEHGKAREITQEVE

SEQ ID NO: 1923096 - protein, 7 aa, Staphylococcus
AGEHPPL

SEQ ID NO: 1923097 - protein, 10 aa, Staphylococcus
AGEHQQAEEL

SEQ ID NO: 1923098 - protein, 4 aa, Staphylococcus
AGEI

SEQ ID NO: 1923099 - protein, 7 aa, Staphylococcus
AGEIEKA

SEQ ID NO: 1923100 - protein, 8 aa, Staphylococcus
AGEIEKSE

SEQ ID NO: 1923101 - protein, 11 aa, Staphylococcus
AGEISGLHPGR

SEQ ID NO: 1923102 - protein, 7 aa, Staphylococcus
AGEKERP

SEQ ID NO: 1923103 - protein, 8 aa, Staphylococcus
AGEKFNNG

SEQ ID NO: 1923104 - protein, 8 aa, Staphylococcus
AGEKIPKG

SEQ ID NO: 1923105 - protein, 20 aa, Staphylococcus
AGELSKDNVDKLWEKPEIVN

SEQ ID NO: 1923106 - protein, 7 aa, Staphylococcus
AGENFDN

SEQ ID NO: 1923107 - protein, 6 aa, Staphylococcus
AGENGE

SEQ ID NO: 1923108 - protein, 7 aa, Staphylococcus
AGEPGSI

SEQ ID NO: 1923109 - protein, 11 aa, Staphylococcus
AGEPLTVTDPN

SEQ ID NO: 1923110 - protein, 6 aa, Staphylococcus
AGEPYD

SEQ ID NO: 1923111 - protein, 6 aa, Staphylococcus
AGEQAN

SEQ ID NO: 1923112 - protein, 7 aa, Staphylococcus
AGEQFDD

SEQ ID NO: 1923113 - protein, 10 aa, Staphylococcus
AGEQTKTFAQ

SEQ ID NO: 1923114 - protein, 5 aa, Staphylococcus
AGEQY

SEQ ID NO: 1923115 - protein, 7 aa, Staphylococcus
AGEQYEE

SEQ ID NO: 1923116 - protein, 7 aa, Staphylococcus
AGERDTL

SEQ ID NO: 1923117 - protein, 4 aa, Staphylococcus
AGET

SEQ ID NO: 1923118 - protein, 7 aa, Staphylococcus
AGETERD

SEQ ID NO: 1923119 - protein, 7 aa, Staphylococcus
AGETFDN

SEQ ID NO: 1923120 - protein, 7 aa, Staphylococcus
AGETHYT

SEQ ID NO: 1923121 - protein, 4 aa, Staphylococcus
AGEV

SEQ ID NO: 1923122 - protein, 7 aa, Staphylococcus
AGEVEKA

SEQ ID NO: 1923123 - protein, 4 aa, Staphylococcus
AGEY

SEQ ID NO: 1923124 - protein, 6 aa, Staphylococcus
AGFDPK

SEQ ID NO: 1923125 - protein, 27 aa, Staphylococcus
AGFETSAYATEKVGDATTEAARSLEQN

SEQ ID NO: 1923126 - protein, 26 aa, Staphylococcus
AGFETSAYATQKAGDATIESKRALQE

SEQ ID NO: 1923127 - protein, 14 aa, Staphylococcus
AGFGDESEKEREDL

SEQ ID NO: 1923128 - protein, 5 aa, Staphylococcus
AGFGP

SEQ ID NO: 1923129 - protein, 5 aa, Staphylococcus
AGFLP

SEQ ID NO: 1923130 - protein, 6 aa, Staphylococcus
AGFNKS

SEQ ID NO: 1923131 - protein, 6 aa, Staphylococcus
AGFPAS

SEQ ID NO: 1923132 - protein, 6 aa, Staphylococcus
AGFPKD

SEQ ID NO: 1923133 - protein, 5 aa, Staphylococcus
AGFPN

SEQ ID NO: 1923134 - protein, 4 aa, Staphylococcus
AGFS

SEQ ID NO: 1923135 - protein, 6 aa, Staphylococcus
AGFSTK

SEQ ID NO: 1923136 - protein, 11 aa, Staphylococcus
AGGAEGAIDAS

SEQ ID NO: 1923137 - protein, 8 aa, Staphylococcus
AGGDGTLN

SEQ ID NO: 1923138 - protein, 9 aa, Staphylococcus
AGGDKKVNY

SEQ ID NO: 1923139 - protein, 9 aa, Staphylococcus
AGGDQTGKY

SEQ ID NO: 1923140 - protein, 9 aa, Staphylococcus
AGGEPISEP

SEQ ID NO: 1923141 - protein, 8 aa, Staphylococcus
AGGETSKE

SEQ ID NO: 1923142 - protein, 18 aa, Staphylococcus
AGGGGAAYTSAKHGIAGY

SEQ ID NO: 1923143 - protein, 7 aa, Staphylococcus
AGGGGIP

SEQ ID NO: 1923144 - protein, 7 aa, Staphylococcus
AGGGMGK

SEQ ID NO: 1923145 - protein, 8 aa, Staphylococcus
AGGGTSAQ

SEQ ID NO: 1923146 - protein, 9 aa, Staphylococcus
AGGGTSKQF

SEQ ID NO: 1923147 - protein, 10 aa, Staphylococcus
AGGKEKTNYL

SEQ ID NO: 1923148 - protein, 6 aa, Staphylococcus
AGGKTM

SEQ ID NO: 1923149 - protein, 10 aa, Staphylococcus
AGGNAGYLTA

SEQ ID NO: 1923150 - protein, 9 aa, Staphylococcus
AGGNPVATL

SEQ ID NO: 1923151 - protein, 8 aa, Staphylococcus
AGGPDKVN

SEQ ID NO: 1923152 - protein, 8 aa, Staphylococcus
AGGPPGKI

SEQ ID NO: 1923153 - protein, 8 aa, Staphylococcus
AGGQGKLK

SEQ ID NO: 1923154 - protein, 8 aa, Staphylococcus
AGGSIGSE

SEQ ID NO: 1923155 - protein, 8 aa, Staphylococcus
AGGSLSTY

SEQ ID NO: 1923156 - protein, 7 aa, Staphylococcus
AGGSMST

SEQ ID NO: 1923157 - protein, 9 aa, Staphylococcus
AGGSTSEHY

SEQ ID NO: 1923158 - protein, 14 aa, Staphylococcus
AGGSVAQGRVSQGE

SEQ ID NO: 1923159 - protein, 4 aa, Staphylococcus
AGGT

SEQ ID NO: 1923160 - protein, 5 aa, Staphylococcus
AGGTD

SEQ ID NO: 1923161 - protein, 6 aa, Staphylococcus
AGGTDM

SEQ ID NO: 1923162 - protein, 7 aa, Staphylococcus
AGGTKKV

SEQ ID NO: 1923163 - protein, 7 aa, Staphylococcus
AGGVGSI

SEQ ID NO: 1923164 - protein, 9 aa, Staphylococcus
AGGVGSITT

SEQ ID NO: 1923165 - protein, 13 aa, Staphylococcus
AGGVNRDRKGPHF

SEQ ID NO: 1923166 - protein, 12 aa, Staphylococcus
AGGVNRDRTGPH

SEQ ID NO: 1923167 - protein, 12 aa, Staphylococcus
AGGVNRNRTGPH

SEQ ID NO: 1923168 - protein, 7 aa, Staphylococcus
AGHDKRE

SEQ ID NO: 1923169 - protein, 5 aa, Staphylococcus
AGHPT

SEQ ID NO: 1923170 - protein, 14 aa, Staphylococcus
AGHSGASRADSGEV

SEQ ID NO: 1923171 - protein, 13 aa, Staphylococcus
AGIDITTDAPLRE

SEQ ID NO: 1923172 - protein, 15 aa, Staphylococcus
AGIDPTKQAWSKATQ

SEQ ID NO: 1923173 - protein, 18 aa, Staphylococcus
AGIEGLTKSSARELASRG

SEQ ID NO: 1923174 - protein, 7 aa, Staphylococcus
AGIGRGQ

SEQ ID NO: 1923175 - protein, 4 aa, Staphylococcus
AGIH

SEQ ID NO: 1923176 - protein, 4 aa, Staphylococcus
AGIK

SEQ ID NO: 1923177 - protein, 10 aa, Staphylococcus
AGIKDPNRPI

SEQ ID NO: 1923178 - protein, 14 aa, Staphylococcus
AGIKRKEAKDKAQR

SEQ ID NO: 1923179 - protein, 6 aa, Staphylococcus
AGINRS

SEQ ID NO: 1923180 - protein, 4 aa, Staphylococcus
AGIP

SEQ ID NO: 1923181 - protein, 12 aa, Staphylococcus
AGIPAALSNTAG

SEQ ID NO: 1923182 - protein, 11 aa, Staphylococcus
AGIQKRIDNGT

SEQ ID NO: 1923183 - protein, 4 aa, Staphylococcus
AGIR

SEQ ID NO: 1923184 - protein, 12 aa, Staphylococcus
AGISGNMNASPL

SEQ ID NO: 1923185 - protein, 14 aa, Staphylococcus
AGISGQFAKPADIT

SEQ ID NO: 1923186 - protein, 4 aa, Staphylococcus
AGIT

SEQ ID NO: 1923187 - protein, 6 aa, Staphylococcus
AGITAD

SEQ ID NO: 1923188 - protein, 5 aa, Staphylococcus
AGITK

SEQ ID NO: 1923189 - protein, 9 aa, Staphylococcus
AGKAGRSRW

SEQ ID NO: 1923190 - protein, 18 aa, Staphylococcus
AGKAIKSFDERKEINNVQ

SEQ ID NO: 1923191 - protein, 4 aa, Staphylococcus
AGKD

SEQ ID NO: 1923192 - protein, 7 aa, Staphylococcus
AGKDGDH

SEQ ID NO: 1923193 - protein, 21 aa, Staphylococcus
AGKDKGKEGKVVATEPKKDRV

SEQ ID NO: 1923194 - protein, 20 aa, Staphylococcus
AGKDKGKEGKVVATEPKRDR

SEQ ID NO: 1923195 - protein, 21 aa, Staphylococcus
AGKDKGKEGKVVSTEPKKDRV

SEQ ID NO: 1923196 - protein, 8 aa, Staphylococcus
AGKEAKGG

SEQ ID NO: 1923197 - protein, 17 aa, Staphylococcus
AGKETVTAAKGASYFDN

SEQ ID NO: 1923198 - protein, 9 aa, Staphylococcus
AGKETVTVA

SEQ ID NO: 1923199 - protein, 8 aa, Staphylococcus
AGKFEETP

SEQ ID NO: 1923200 - protein, 16 aa, Staphylococcus
AGKGQFKPVGEANPYL

SEQ ID NO: 1923201 - protein, 10 aa, Staphylococcus
AGKGSEVGRS

SEQ ID NO: 1923202 - protein, 10 aa, Staphylococcus
AGKGTEIGRS

SEQ ID NO: 1923203 - protein, 6 aa, Staphylococcus
AGKHGG

SEQ ID NO: 1923204 - protein, 7 aa, Staphylococcus
AGKHGVG

SEQ ID NO: 1923205 - protein, 9 aa, Staphylococcus
AGKLSKGKK

SEQ ID NO: 1923206 - protein, 9 aa, Staphylococcus
AGKNEQKLT

SEQ ID NO: 1923207 - protein, 7 aa, Staphylococcus
AGKPDIT

SEQ ID NO: 1923208 - protein, 9 aa, Staphylococcus
AGKQSGVHG

SEQ ID NO: 1923209 - protein, 13 aa, Staphylococcus
AGKSDEDPYENSH

SEQ ID NO: 1923210 - protein, 12 aa, Staphylococcus
AGKSDEDPYQNP

SEQ ID NO: 1923211 - protein, 9 aa, Staphylococcus
AGKTAKDVL

SEQ ID NO: 1923212 - protein, 8 aa, Staphylococcus
AGKTATQI

SEQ ID NO: 1923213 - protein, 10 aa, Staphylococcus
AGLASSASAF

SEQ ID NO: 1923214 - protein, 12 aa, Staphylococcus
AGLASSASAYAA

SEQ ID NO: 1923215 - protein, 5 aa, Staphylococcus
AGLDA

SEQ ID NO: 1923216 - protein, 12 aa, Staphylococcus
AGLDKNDDDNID

SEQ ID NO: 1923217 - protein, 11 aa, Staphylococcus
AGLDKNDQDNI

SEQ ID NO: 1923218 - protein, 12 aa, Staphylococcus
AGLEKNDESNID

SEQ ID NO: 1923219 - protein, 12 aa, Staphylococcus
AGLEKSRENFQA

SEQ ID NO: 1923220 - protein, 7 aa, Staphylococcus
AGLESDD

SEQ ID NO: 1923221 - protein, 4 aa, Staphylococcus
AGLG

SEQ ID NO: 1923222 - protein, 8 aa, Staphylococcus
AGLGARDT

SEQ ID NO: 1923223 - protein, 10 aa, Staphylococcus
AGLGPQTPLD

SEQ ID NO: 1923224 - protein, 9 aa, Staphylococcus
AGLGPTTPI

SEQ ID NO: 1923225 - protein, 9 aa, Staphylococcus
AGLKDSMEN

SEQ ID NO: 1923226 - protein, 7 aa, Staphylococcus
AGLKEEE

SEQ ID NO: 1923227 - protein, 18 aa, Staphylococcus
AGLKGGGSYVEYRTDDAR

SEQ ID NO: 1923228 - protein, 5 aa, Staphylococcus
AGLLG

SEQ ID NO: 1923229 - protein, 12 aa, Staphylococcus
AGLNPKPVNPNE

SEQ ID NO: 1923230 - protein, 4 aa, Staphylococcus
AGLP

SEQ ID NO: 1923231 - protein, 6 aa, Staphylococcus
AGLPAD

SEQ ID NO: 1923232 - protein, 6 aa, Staphylococcus
AGLQSD

SEQ ID NO: 1923233 - protein, 4 aa, Staphylococcus
AGLR

SEQ ID NO: 1923234 - protein, 16 aa, Staphylococcus
AGLSEKSQKAAEKGIS

SEQ ID NO: 1923235 - protein, 6 aa, Staphylococcus
AGLTSD

SEQ ID NO: 1923236 - protein, 7 aa, Staphylococcus
AGLTSDD

SEQ ID NO: 1923237 - protein, 8 aa, Staphylococcus
AGLTSNSQ

SEQ ID NO: 1923238 - protein, 11 aa, Staphylococcus
AGLTVKEDENV

SEQ ID NO: 1923239 - protein, 16 aa, Staphylococcus
AGMSPKSEAAAQKGLP

SEQ ID NO: 1923240 - protein, 17 aa, Staphylococcus
AGMSPKSIEAAEKGLPN

SEQ ID NO: 1923241 - protein, 17 aa, Staphylococcus
AGMSPKSVAAARNGLPN

SEQ ID NO: 1923242 - protein, 7 aa, Staphylococcus
AGMTEKE

SEQ ID NO: 1923243 - protein, 7 aa, Staphylococcus
AGMTEQQ

SEQ ID NO: 1923244 - protein, 11 aa, Staphylococcus
AGMTGEEADAI

SEQ ID NO: 1923245 - protein, 12 aa, Staphylococcus
AGMTLDESASIE

SEQ ID NO: 1923246 - protein, 10 aa, Staphylococcus
AGNAGDDVSE

SEQ ID NO: 1923247 - protein, 6 aa, Staphylococcus
AGNDNN

SEQ ID NO: 1923248 - protein, 7 aa, Staphylococcus
AGNDNNS

SEQ ID NO: 1923249 - protein, 7 aa, Staphylococcus
AGNDYAA

SEQ ID NO: 1923250 - protein, 18 aa, Staphylococcus
AGNDYAKLGEQFTIERPS

SEQ ID NO: 1923251 - protein, 5 aa, Staphylococcus
AGNEI

SEQ ID NO: 1923252 - protein, 5 aa, Staphylococcus
AGNFE

SEQ ID NO: 1923253 - protein, 9 aa, Staphylococcus
AGNGQNPAR

SEQ ID NO: 1923254 - protein, 10 aa, Staphylococcus
AGNGQNPARQ

SEQ ID NO: 1923255 - protein, 8 aa, Staphylococcus
AGNKKFKS

SEQ ID NO: 1923256 - protein, 18 aa, Staphylococcus
AGNNYSKLGDTFTIERPE

SEQ ID NO: 1923257 - protein, 7 aa, Staphylococcus
AGNPNSK

SEQ ID NO: 1923258 - protein, 7 aa, Staphylococcus
AGNQISN

SEQ ID NO: 1923259 - protein, 8 aa, Staphylococcus
AGNQTSNR

SEQ ID NO: 1923260 - protein, 9 aa, Staphylococcus
AGNRLGGNA

SEQ ID NO: 1923261 - protein, 12 aa, Staphylococcus
AGNSVVTASTDS

SEQ ID NO: 1923262 - protein, 5 aa, Staphylococcus
AGNTA

SEQ ID NO: 1923263 - protein, 7 aa, Staphylococcus
AGNTEKD

SEQ ID NO: 1923264 - protein, 7 aa, Staphylococcus
AGNTGAT

SEQ ID NO: 1923265 - protein, 7 aa, Staphylococcus
AGNTGST

SEQ ID NO: 1923266 - protein, 5 aa, Staphylococcus
AGNTM

SEQ ID NO: 1923267 - protein, 5 aa, Staphylococcus
AGNYA

SEQ ID NO: 1923268 - protein, 9 aa, Staphylococcus
AGPDSDYMT

SEQ ID NO: 1923269 - protein, 6 aa, Staphylococcus
AGPEIT

SEQ ID NO: 1923270 - protein, 7 aa, Staphylococcus
AGPGFTI

SEQ ID NO: 1923271 - protein, 9 aa, Staphylococcus
AGPGNPSLL

SEQ ID NO: 1923272 - protein, 24 aa, Staphylococcus
AGPHSDEYEGKETIDATGKVVSPT

SEQ ID NO: 1923273 - protein, 5 aa, Staphylococcus
AGPIA

SEQ ID NO: 1923274 - protein, 7 aa, Staphylococcus
AGPKANP

SEQ ID NO: 1923275 - protein, 5 aa, Staphylococcus
AGPKV

SEQ ID NO: 1923276 - protein, 12 aa, Staphylococcus
AGPNAQVANTNL

SEQ ID NO: 1923277 - protein, 7 aa, Staphylococcus
AGPNVSS

SEQ ID NO: 1923278 - protein, 7 aa, Staphylococcus
AGPNVTS

SEQ ID NO: 1923279 - protein, 16 aa, Staphylococcus
AGPRRGDGAESAIIEL

SEQ ID NO: 1923280 - protein, 12 aa, Staphylococcus
AGPTPPNPSELI

SEQ ID NO: 1923281 - protein, 7 aa, Staphylococcus
AGPTVTS

SEQ ID NO: 1923282 - protein, 5 aa, Staphylococcus
AGPVG

SEQ ID NO: 1923283 - protein, 9 aa, Staphylococcus
AGPYHDDSY

SEQ ID NO: 1923284 - protein, 8 aa, Staphylococcus
AGPYHEEE

SEQ ID NO: 1923285 - protein, 7 aa, Staphylococcus
AGQDAQE

SEQ ID NO: 1923286 - protein, 5 aa, Staphylococcus
AGQDI

SEQ ID NO: 1923287 - protein, 11 aa, Staphylococcus
AGQDKKATQTM

SEQ ID NO: 1923288 - protein, 46 aa, Staphylococcus
AGQDRRDRHVPRGPPGQPAAGRRARPGPGTPADQDHRHDLPTRRAH

SEQ ID NO: 1923289 - protein, 13 aa, Staphylococcus
AGQEATLKTGQSL

SEQ ID NO: 1923290 - protein, 6 aa, Staphylococcus
AGQGNL

SEQ ID NO: 1923291 - protein, 5 aa, Staphylococcus
AGQGT

SEQ ID NO: 1923292 - protein, 6 aa, Staphylococcus
AGQGTI

SEQ ID NO: 1923293 - protein, 8 aa, Staphylococcus
AGQKSIDE

SEQ ID NO: 1923294 - protein, 5 aa, Staphylococcus
AGQLI

SEQ ID NO: 1923295 - protein, 8 aa, Staphylococcus
AGQLPKGK

SEQ ID NO: 1923296 - protein, 9 aa, Staphylococcus
AGQLPKNQT

SEQ ID NO: 1923297 - protein, 12 aa, Staphylococcus
AGQMKSSKITDY

SEQ ID NO: 1923298 - protein, 14 aa, Staphylococcus
AGQMKSSKITEGQV

SEQ ID NO: 1923299 - protein, 11 aa, Staphylococcus
AGQNASTSSYL

SEQ ID NO: 1923300 - protein, 5 aa, Staphylococcus
AGQPE

SEQ ID NO: 1923301 - protein, 8 aa, Staphylococcus
AGQPRGQR

SEQ ID NO: 1923302 - protein, 10 aa, Staphylococcus
AGQQTLKQYT

SEQ ID NO: 1923303 - protein, 12 aa, Staphylococcus
AGQVSNLGNEYN

SEQ ID NO: 1923304 - protein, 12 aa, Staphylococcus
AGRAGRHDKPGR

SEQ ID NO: 1923305 - protein, 12 aa, Staphylococcus
AGRAGRHEKEGQ

SEQ ID NO: 1923306 - protein, 14 aa, Staphylococcus
AGRATAKVSIPSPN

SEQ ID NO: 1923307 - protein, 9 aa, Staphylococcus
AGRDITDDI

SEQ ID NO: 1923308 - protein, 10 aa, Staphylococcus
AGRDITDDIA

SEQ ID NO: 1923309 - protein, 8 aa, Staphylococcus
AGRDITSD

SEQ ID NO: 1923310 - protein, 13 aa, Staphylococcus
AGREATLKTGQTL

SEQ ID NO: 1923311 - protein, 8 aa, Staphylococcus
AGREKSVD

SEQ ID NO: 1923312 - protein, 6 aa, Staphylococcus
AGRGGS

SEQ ID NO: 1923313 - protein, 9 aa, Staphylococcus
AGRGPRGFG

SEQ ID NO: 1923314 - protein, 5 aa, Staphylococcus
AGRIE

SEQ ID NO: 1923315 - protein, 5 aa, Staphylococcus
AGRIG

SEQ ID NO: 1923316 - protein, 7 aa, Staphylococcus
AGRLSDE

SEQ ID NO: 1923317 - protein, 9 aa, Staphylococcus
AGRNDEKLQ

SEQ ID NO: 1923318 - protein, 10 aa, Staphylococcus
AGRNEEKLQT

SEQ ID NO: 1923319 - protein, 11 aa, Staphylococcus
AGRQTKDDDID

SEQ ID NO: 1923320 - protein, 11 aa, Staphylococcus
AGRQTKEDTID

SEQ ID NO: 1923321 - protein, 4 aa, Staphylococcus
AGRS

SEQ ID NO: 1923322 - protein, 4 aa, Staphylococcus
AGRT

SEQ ID NO: 1923323 - protein, 5 aa, Staphylococcus
AGRTE

SEQ ID NO: 1923324 - protein, 9 aa, Staphylococcus
AGSADNIIP

SEQ ID NO: 1923325 - protein, 13 aa, Staphylococcus
AGSALKQTIDSIG

SEQ ID NO: 1923326 - protein, 5 aa, Staphylococcus
AGSAS

SEQ ID NO: 1923327 - protein, 10 aa, Staphylococcus
AGSEEYETAI

SEQ ID NO: 1923328 - protein, 11 aa, Staphylococcus
AGSEIKRGEES

SEQ ID NO: 1923329 - protein, 7 aa, Staphylococcus
AGSETAL

SEQ ID NO: 1923330 - protein, 11 aa, Staphylococcus
AGSEVKRGDKT

SEQ ID NO: 1923331 - protein, 11 aa, Staphylococcus
AGSGGSTGADK

SEQ ID NO: 1923332 - protein, 7 aa, Staphylococcus
AGSGGVG

SEQ ID NO: 1923333 - protein, 8 aa, Staphylococcus
AGSGGVGS

SEQ ID NO: 1923334 - protein, 21 aa, Staphylococcus
AGSGPSQLGSPDSAGVPKSVA

SEQ ID NO: 1923335 - protein, 18 aa, Staphylococcus
AGSGPSQLGSPDSAGVPL

SEQ ID NO: 1923336 - protein, 20 aa, Staphylococcus
AGSGPSQLGSPDSAGVPQSV

SEQ ID NO: 1923337 - protein, 12 aa, Staphylococcus
AGSIEATAEAYR

SEQ ID NO: 1923338 - protein, 7 aa, Staphylococcus
AGSITKR

SEQ ID NO: 1923339 - protein, 27 aa, Staphylococcus
AGSLNNGGEVSAKATDKAGNESPKTIR

SEQ ID NO: 1923340 - protein, 8 aa, Staphylococcus
AGSNGASI

SEQ ID NO: 1923341 - protein, 11 aa, Staphylococcus
AGSPRKPGMSR

SEQ ID NO: 1923342 - protein, 11 aa, Staphylococcus
AGSSSGAALQG

SEQ ID NO: 1923343 - protein, 9 aa, Staphylococcus
AGSTDSVIP

SEQ ID NO: 1923344 - protein, 13 aa, Staphylococcus
AGSTITDDIPKES

SEQ ID NO: 1923345 - protein, 13 aa, Staphylococcus
AGSTITDDIPNDS

SEQ ID NO: 1923346 - protein, 6 aa, Staphylococcus
AGSTSM

SEQ ID NO: 1923347 - protein, 13 aa, Staphylococcus
AGSVGIANNQTGL

SEQ ID NO: 1923348 - protein, 5 aa, Staphylococcus
AGSVK

SEQ ID NO: 1923349 - protein, 11 aa, Staphylococcus
AGSVSDKTVGA

SEQ ID NO: 1923350 - protein, 13 aa, Staphylococcus
AGSVSDKTVGPNQ

SEQ ID NO: 1923351 - protein, 7 aa, Staphylococcus
AGSVSEK

SEQ ID NO: 1923352 - protein, 12 aa, Staphylococcus
AGSVSQKEVGQH

SEQ ID NO: 1923353 - protein, 13 aa, Staphylococcus
AGSVSTKTLGKNQ

SEQ ID NO: 1923354 - protein, 6 aa, Staphylococcus
AGSYET

SEQ ID NO: 1923355 - protein, 7 aa, Staphylococcus
AGTAEGI

SEQ ID NO: 1923356 - protein, 5 aa, Staphylococcus
AGTDL

SEQ ID NO: 1923357 - protein, 15 aa, Staphylococcus
AGTDLGLEKDQVEES

SEQ ID NO: 1923358 - protein, 7 aa, Staphylococcus
AGTEKGI

SEQ ID NO: 1923359 - protein, 6 aa, Staphylococcus
AGTELG

SEQ ID NO: 1923360 - protein, 4 aa, Staphylococcus
AGTF

SEQ ID NO: 1923361 - protein, 6 aa, Staphylococcus
AGTGAA

SEQ ID NO: 1923362 - protein, 7 aa, Staphylococcus
AGTGATT

SEQ ID NO: 1923363 - protein, 16 aa, Staphylococcus
AGTGMRRYSDAKYEKH

SEQ ID NO: 1923364 - protein, 7 aa, Staphylococcus
AGTHGRE

SEQ ID NO: 1923365 - protein, 21 aa, Staphylococcus
AGTIKRGKTIKEDKQNAEQLL

SEQ ID NO: 1923366 - protein, 10 aa, Staphylococcus
AGTINEGDKA

SEQ ID NO: 1923367 - protein, 10 aa, Staphylococcus
AGTINQGDKA

SEQ ID NO: 1923368 - protein, 4 aa, Staphylococcus
AGTK

SEQ ID NO: 1923369 - protein, 15 aa, Staphylococcus
AGTKFDAEGSEQPLG

SEQ ID NO: 1923370 - protein, 16 aa, Staphylococcus
AGTKHDIEGSKQPLGS

SEQ ID NO: 1923371 - protein, 15 aa, Staphylococcus
AGTKHEAEGSEQPLG

SEQ ID NO: 1923372 - protein, 9 aa, Staphylococcus
AGTKSDKDI

SEQ ID NO: 1923373 - protein, 10 aa, Staphylococcus
AGTKSDKDVR

SEQ ID NO: 1923374 - protein, 9 aa, Staphylococcus
AGTKSDTDV

SEQ ID NO: 1923375 - protein, 7 aa, Staphylococcus
AGTLNQG

SEQ ID NO: 1923376 - protein, 12 aa, Staphylococcus
AGTNASLFQIDD

SEQ ID NO: 1923377 - protein, 6 aa, Staphylococcus
AGTNLG

SEQ ID NO: 1923378 - protein, 4 aa, Staphylococcus
AGTP

SEQ ID NO: 1923379 - protein, 29 aa, Staphylococcus
AGTPAKVIKQTSEVEDSKHEIVSALRKLN

SEQ ID NO: 1923380 - protein, 29 aa, Staphylococcus
AGTPAKVIKQTSEVQDSKREIVAALRKLN

SEQ ID NO: 1923381 - protein, 5 aa, Staphylococcus
AGTPI

SEQ ID NO: 1923382 - protein, 5 aa, Staphylococcus
AGTPV

SEQ ID NO: 1923383 - protein, 4 aa, Staphylococcus
AGTQ

SEQ ID NO: 1923384 - protein, 6 aa, Staphylococcus
AGTQLG

SEQ ID NO: 1923385 - protein, 9 aa, Staphylococcus
AGTQTEKQF

SEQ ID NO: 1923386 - protein, 4 aa, Staphylococcus
AGTS

SEQ ID NO: 1923387 - protein, 8 aa, Staphylococcus
AGTSLGLE

SEQ ID NO: 1923388 - protein, 6 aa, Staphylococcus
AGTSSM

SEQ ID NO: 1923389 - protein, 11 aa, Staphylococcus
AGTTNTGSVDD

SEQ ID NO: 1923390 - protein, 12 aa, Staphylococcus
AGTTNTGSVDDF

SEQ ID NO: 1923391 - protein, 16 aa, Staphylococcus
AGTTRDAIDTEYSYED

SEQ ID NO: 1923392 - protein, 15 aa, Staphylococcus
AGTTRDAVDTEYSFD

SEQ ID NO: 1923393 - protein, 17 aa, Staphylococcus
AGTTRDAVDTEYSYDDQ

SEQ ID NO: 1923394 - protein, 17 aa, Staphylococcus
AGTTRDAVDTEYSYEGQ

SEQ ID NO: 1923395 - protein, 10 aa, Staphylococcus
AGTTVSRASL

SEQ ID NO: 1923396 - protein, 11 aa, Staphylococcus
AGTTVSRASLH

SEQ ID NO: 1923397 - protein, 4 aa, Staphylococcus
AGTV

SEQ ID NO: 1923398 - protein, 7 aa, Staphylococcus
AGTVEAT

SEQ ID NO: 1923399 - protein, 5 aa, Staphylococcus
AGTVG

SEQ ID NO: 1923400 - protein, 5 aa, Staphylococcus
AGTVK

SEQ ID NO: 1923401 - protein, 13 aa, Staphylococcus
AGTVSHKTVGENE

SEQ ID NO: 1923402 - protein, 18 aa, Staphylococcus
AGVDGRLQSRSYENQEGR

SEQ ID NO: 1923403 - protein, 12 aa, Staphylococcus
AGVDITTEAPLK

SEQ ID NO: 1923404 - protein, 13 aa, Staphylococcus
AGVDITTEAPLKD

SEQ ID NO: 1923405 - protein, 41 aa, Staphylococcus
AGVEKGSGEPNKNKVASVTKDQVREIANSKMQDLNAADEEA

SEQ ID NO: 1923406 - protein, 26 aa, Staphylococcus
AGVEKGSGEPNKNKVATVTKDQVREI

SEQ ID NO: 1923407 - protein, 26 aa, Staphylococcus
AGVEKGSGEPNKTKVASVTKDQVREI

SEQ ID NO: 1923408 - protein, 26 aa, Staphylococcus
AGVEKGSGEPNKTKVATVTKDQVREI

SEQ ID NO: 1923409 - protein, 41 aa, Staphylococcus
AGVEKGSGEPNKTKVATVTKEQVREIANSKMQDLNAADEEA

SEQ ID NO: 1923410 - protein, 5 aa, Staphylococcus
AGVET

SEQ ID NO: 1923411 - protein, 7 aa, Staphylococcus
AGVGSGF

SEQ ID NO: 1923412 - protein, 12 aa, Staphylococcus
AGVITDDTEKAV

SEQ ID NO: 1923413 - protein, 4 aa, Staphylococcus
AGVN

SEQ ID NO: 1923414 - protein, 4 aa, Staphylococcus
AGVP

SEQ ID NO: 1923415 - protein, 16 aa, Staphylococcus
AGVPAKDLAERITRTG

SEQ ID NO: 1923416 - protein, 12 aa, Staphylococcus
AGVPARLSNTAG

SEQ ID NO: 1923417 - protein, 12 aa, Staphylococcus
AGVPASLSNTAG

SEQ ID NO: 1923418 - protein, 6 aa, Staphylococcus
AGVPDA

SEQ ID NO: 1923419 - protein, 7 aa, Staphylococcus
AGVPKDN

SEQ ID NO: 1923420 - protein, 7 aa, Staphylococcus
AGVPKGA

SEQ ID NO: 1923421 - protein, 15 aa, Staphylococcus
AGVPQINRRETDYVD

SEQ ID NO: 1923422 - protein, 7 aa, Staphylococcus
AGVQEED

SEQ ID NO: 1923423 - protein, 7 aa, Staphylococcus
AGVQEEE

SEQ ID NO: 1923424 - protein, 5 aa, Staphylococcus
AGVTD

SEQ ID NO: 1923425 - protein, 6 aa, Staphylococcus
AGWDTH

SEQ ID NO: 1923426 - protein, 4 aa, Staphylococcus
AGWT

SEQ ID NO: 1923427 - protein, 8 aa, Staphylococcus
AGYAHEEG

SEQ ID NO: 1923428 - protein, 9 aa, Staphylococcus
AGYAHEEGK

SEQ ID NO: 1923429 - protein, 6 aa, Staphylococcus
AGYAPV

SEQ ID NO: 1923430 - protein, 10 aa, Staphylococcus
AGYDKSCEVP

SEQ ID NO: 1923431 - protein, 5 aa, Staphylococcus
AGYDR

SEQ ID NO: 1923432 - protein, 5 aa, Staphylococcus
AGYDS

SEQ ID NO: 1923433 - protein, 8 aa, Staphylococcus
AGYEASTE

SEQ ID NO: 1923434 - protein, 6 aa, Staphylococcus
AGYERN

SEQ ID NO: 1923435 - protein, 25 aa, Staphylococcus
AGYETSAYATEREGDATLEAERALK

SEQ ID NO: 1923436 - protein, 4 aa, Staphylococcus
AGYG

SEQ ID NO: 1923437 - protein, 8 aa, Staphylococcus
AGYGSEPN

SEQ ID NO: 1923438 - protein, 8 aa, Staphylococcus
AGYGSESN

SEQ ID NO: 1923439 - protein, 6 aa, Staphylococcus
AGYGSF

SEQ ID NO: 1923440 - protein, 14 aa, Staphylococcus
AGYGSYGAIEDITI

SEQ ID NO: 1923441 - protein, 14 aa, Staphylococcus
AGYHKTEDVNGFRQ

SEQ ID NO: 1923442 - protein, 20 aa, Staphylococcus
AGYHKTKDVNGYRQEGFGPF

SEQ ID NO: 1923443 - protein, 8 aa, Staphylococcus
AGYHSGTE

SEQ ID NO: 1923444 - protein, 14 aa, Staphylococcus
AGYISATEDEEQST

SEQ ID NO: 1923445 - protein, 8 aa, Staphylococcus
AGYKPGEE

SEQ ID NO: 1923446 - protein, 10 aa, Staphylococcus
AGYNDQINEE

SEQ ID NO: 1923447 - protein, 6 aa, Staphylococcus
AGYPLN

SEQ ID NO: 1923448 - protein, 5 aa, Staphylococcus
AGYQE

SEQ ID NO: 1923449 - protein, 8 aa, Staphylococcus
AGYQPGDF

SEQ ID NO: 1923450 - protein, 8 aa, Staphylococcus
AGYQSGTE

SEQ ID NO: 1923451 - protein, 13 aa, Staphylococcus
AGYSGAKRDRPEL

SEQ ID NO: 1923452 - protein, 5 aa, Staphylococcus
AGYSY

SEQ ID NO: 1923453 - protein, 6 aa, Staphylococcus
AGYTAG

SEQ ID NO: 1923454 - protein, 7 aa, Staphylococcus
AGYTGKN

SEQ ID NO: 1923455 - protein, 6 aa, Staphylococcus
AGYVET

SEQ ID NO: 1923456 - protein, 8 aa, Staphylococcus
AHADDSAY

SEQ ID NO: 1923457 - protein, 17 aa, Staphylococcus
AHAERYGHERYGKTYEG

SEQ ID NO: 1923458 - protein, 7 aa, Staphylococcus
AHAPSVK

SEQ ID NO: 1923459 - protein, 7 aa, Staphylococcus
AHAQQDD

SEQ ID NO: 1923460 - protein, 5 aa, Staphylococcus
AHARS

SEQ ID NO: 1923461 - protein, 9 aa, Staphylococcus
AHASQSGPF

SEQ ID NO: 1923462 - protein, 8 aa, Staphylococcus
AHASQTGP

SEQ ID NO: 1923463 - protein, 12 aa, Staphylococcus
AHASSGRSPSIK

SEQ ID NO: 1923464 - protein, 4 aa, Staphylococcus
AHAT

SEQ ID NO: 1923465 - protein, 6 aa, Staphylococcus
AHAVGE

SEQ ID NO: 1923466 - protein, 8 aa, Staphylococcus
AHDEHRAL

SEQ ID NO: 1923467 - protein, 6 aa, Staphylococcus
AHDEKK

SEQ ID NO: 1923468 - protein, 7 aa, Staphylococcus
AHDKASV

SEQ ID NO: 1923469 - protein, 4 aa, Staphylococcus
AHDR

SEQ ID NO: 1923470 - protein, 9 aa, Staphylococcus
AHDRDRSGV

SEQ ID NO: 1923471 - protein, 8 aa, Staphylococcus
AHDSERHP

SEQ ID NO: 1923472 - protein, 4 aa, Staphylococcus
AHEA

SEQ ID NO: 1923473 - protein, 5 aa, Staphylococcus
AHEEG

SEQ ID NO: 1923474 - protein, 7 aa, Staphylococcus
AHEEGRV

SEQ ID NO: 1923475 - protein, 6 aa, Staphylococcus
AHEEIR

SEQ ID NO: 1923476 - protein, 6 aa, Staphylococcus
AHEENE

SEQ ID NO: 1923477 - protein, 7 aa, Staphylococcus
AHENASN

SEQ ID NO: 1923478 - protein, 8 aa, Staphylococcus
AHENDDAY

SEQ ID NO: 1923479 - protein, 11 aa, Staphylococcus
AHENGEKSMEA

SEQ ID NO: 1923480 - protein, 5 aa, Staphylococcus
AHEPG

SEQ ID NO: 1923481 - protein, 6 aa, Staphylococcus
AHEPGG

SEQ ID NO: 1923482 - protein, 4 aa, Staphylococcus
AHEQ

SEQ ID NO: 1923483 - protein, 8 aa, Staphylococcus
AHERTRKG

SEQ ID NO: 1923484 - protein, 6 aa, Staphylococcus
AHEVGE

SEQ ID NO: 1923485 - protein, 6 aa, Staphylococcus
AHGEDD

SEQ ID NO: 1923486 - protein, 8 aa, Staphylococcus
AHGEMADP

SEQ ID NO: 1923487 - protein, 16 aa, Staphylococcus
AHGETPIDWCGEEAQR

SEQ ID NO: 1923488 - protein, 14 aa, Staphylococcus
AHGFGGKQTPKVTS

SEQ ID NO: 1923489 - protein, 16 aa, Staphylococcus
AHGGAAKTSGAGGGDC

SEQ ID NO: 1923490 - protein, 8 aa, Staphylococcus
AHGGSNAR

SEQ ID NO: 1923491 - protein, 9 aa, Staphylococcus
AHGGSQLKD

SEQ ID NO: 1923492 - protein, 8 aa, Staphylococcus
AHGGSRLK

SEQ ID NO: 1923493 - protein, 12 aa, Staphylococcus
AHGKPSGIDTQT

SEQ ID NO: 1923494 - protein, 26 aa, Staphylococcus
AHGQGKTKKESEQKAAERAYHIMRQH

SEQ ID NO: 1923495 - protein, 5 aa, Staphylococcus
AHGQH

SEQ ID NO: 1923496 - protein, 16 aa, Staphylococcus
AHGSEPLNYPTDSTAQ

SEQ ID NO: 1923497 - protein, 10 aa, Staphylococcus
AHGSSSAKAF

SEQ ID NO: 1923498 - protein, 8 aa, Staphylococcus
AHGTSEIK

SEQ ID NO: 1923499 - protein, 13 aa, Staphylococcus
AHGTYGQYQRPQT

SEQ ID NO: 1923500 - protein, 9 aa, Staphylococcus
AHHAETNGI

SEQ ID NO: 1923501 - protein, 8 aa, Staphylococcus
AHHDNEIS

SEQ ID NO: 1923502 - protein, 7 aa, Staphylococcus
AHHESQR

SEQ ID NO: 1923503 - protein, 6 aa, Staphylococcus
AHHGDG

SEQ ID NO: 1923504 - protein, 13 aa, Staphylococcus
AHHNKAPKTESEL

SEQ ID NO: 1923505 - protein, 9 aa, Staphylococcus
AHHSESRPF

SEQ ID NO: 1923506 - protein, 6 aa, Staphylococcus
AHISHT

SEQ ID NO: 1923507 - protein, 18 aa, Staphylococcus
AHKAQKEKEVSIRHIFSF

SEQ ID NO: 1923508 - protein, 6 aa, Staphylococcus
AHKDED

SEQ ID NO: 1923509 - protein, 6 aa, Staphylococcus
AHKDGK

SEQ ID NO: 1923510 - protein, 8 aa, Staphylococcus
AHKDKDYA

SEQ ID NO: 1923511 - protein, 6 aa, Staphylococcus
AHKDQA

SEQ ID NO: 1923512 - protein, 8 aa, Staphylococcus
AHKEGVKD

SEQ ID NO: 1923513 - protein, 12 aa, Staphylococcus
AHKGRKGNGQVE

SEQ ID NO: 1923514 - protein, 4 aa, Staphylococcus
AHKR

SEQ ID NO: 1923515 - protein, 5 aa, Staphylococcus
AHKRE

SEQ ID NO: 1923516 - protein, 9 aa, Staphylococcus
AHKSQTGPF

SEQ ID NO: 1923517 - protein, 4 aa, Staphylococcus
AHLE

SEQ ID NO: 1923518 - protein, 10 aa, Staphylococcus
AHNDNQSDPH

SEQ ID NO: 1923519 - protein, 10 aa, Staphylococcus
AHNEGVKTTA

SEQ ID NO: 1923520 - protein, 9 aa, Staphylococcus
AHNKKPTKR

SEQ ID NO: 1923521 - protein, 10 aa, Staphylococcus
AHNNKSAIKD

SEQ ID NO: 1923522 - protein, 10 aa, Staphylococcus
AHNSSISESY

SEQ ID NO: 1923523 - protein, 18 aa, Staphylococcus
AHNTRRKRVRKDDHLTNE

SEQ ID NO: 1923524 - protein, 23 aa, Staphylococcus
AHPEFKSPDSPTVRVGGEVQSSF

SEQ ID NO: 1923525 - protein, 24 aa, Staphylococcus
AHPELKTDDSPTVRVGGEAQSSFE

SEQ ID NO: 1923526 - protein, 7 aa, Staphylococcus
AHPERVE

SEQ ID NO: 1923527 - protein, 23 aa, Staphylococcus
AHPEYKTEDSPTVRVGGEAQATF

SEQ ID NO: 1923528 - protein, 7 aa, Staphylococcus
AHPGFPD

SEQ ID NO: 1923529 - protein, 8 aa, Staphylococcus
AHPGSLGP

SEQ ID NO: 1923530 - protein, 6 aa, Staphylococcus
AHPKDI

SEQ ID NO: 1923531 - protein, 12 aa, Staphylococcus
AHPLQDENQIQG

SEQ ID NO: 1923532 - protein, 7 aa, Staphylococcus
AHPNFSS

SEQ ID NO: 1923533 - protein, 6 aa, Staphylococcus
AHPNGD

SEQ ID NO: 1923534 - protein, 8 aa, Staphylococcus
AHPNGKNI

SEQ ID NO: 1923535 - protein, 8 aa, Staphylococcus
AHPNGKNM

SEQ ID NO: 1923536 - protein, 18 aa, Staphylococcus
AHPNGKSEILNGPYAGQT

SEQ ID NO: 1923537 - protein, 8 aa, Staphylococcus
AHPNGPNI

SEQ ID NO: 1923538 - protein, 19 aa, Staphylococcus
AHPNGPNTIENGKYKGKTL

SEQ ID NO: 1923539 - protein, 7 aa, Staphylococcus
AHPQFGD

SEQ ID NO: 1923540 - protein, 6 aa, Staphylococcus
AHPQGD

SEQ ID NO: 1923541 - protein, 6 aa, Staphylococcus
AHQDED

SEQ ID NO: 1923542 - protein, 5 aa, Staphylococcus
AHQGD

SEQ ID NO: 1923543 - protein, 9 aa, Staphylococcus
AHQGQAQTL

SEQ ID NO: 1923544 - protein, 5 aa, Staphylococcus
AHQKY

SEQ ID NO: 1923545 - protein, 12 aa, Staphylococcus
AHQLTEEEKEAF

SEQ ID NO: 1923546 - protein, 17 aa, Staphylococcus
AHQNETMTTLDDQERTL

SEQ ID NO: 1923547 - protein, 19 aa, Staphylococcus
AHQNGPNVIENGKHQGKTL

SEQ ID NO: 1923548 - protein, 8 aa, Staphylococcus
AHQRPEDQ

SEQ ID NO: 1923549 - protein, 8 aa, Staphylococcus
AHQSKPSL

SEQ ID NO: 1923550 - protein, 11 aa, Staphylococcus
AHQSVKRGTIQ

SEQ ID NO: 1923551 - protein, 12 aa, Staphylococcus
AHRADEDAATTA

SEQ ID NO: 1923552 - protein, 16 aa, Staphylococcus
AHRDSYQGKYFESTVK

SEQ ID NO: 1923553 - protein, 4 aa, Staphylococcus
AHRN

SEQ ID NO: 1923554 - protein, 4 aa, Staphylococcus
AHRR

SEQ ID NO: 1923555 - protein, 6 aa, Staphylococcus
AHRTQY

SEQ ID NO: 1923556 - protein, 7 aa, Staphylococcus
AHSAGMN

SEQ ID NO: 1923557 - protein, 14 aa, Staphylococcus
AHSALESNADNKAD

SEQ ID NO: 1923558 - protein, 5 aa, Staphylococcus
AHSDE

SEQ ID NO: 1923559 - protein, 15 aa, Staphylococcus
AHSFGAKKNGLPSGR

SEQ ID NO: 1923560 - protein, 10 aa, Staphylococcus
AHSKEDIEKT

SEQ ID NO: 1923561 - protein, 8 aa, Staphylococcus
AHSKKLDE

SEQ ID NO: 1923562 - protein, 6 aa, Staphylococcus
AHSNGA

SEQ ID NO: 1923563 - protein, 6 aa, Staphylococcus
AHSNKE

SEQ ID NO: 1923564 - protein, 5 aa, Staphylococcus
AHSQS

SEQ ID NO: 1923565 - protein, 8 aa, Staphylococcus
AHSRPEDQ

SEQ ID NO: 1923566 - protein, 25 aa, Staphylococcus
AHSSDDDDKYRSAEIREGLKSQDCN

SEQ ID NO: 1923567 - protein, 20 aa, Staphylococcus
AHSSDDDDKYRTQEERDGLK

SEQ ID NO: 1923568 - protein, 6 aa, Staphylococcus
AHSSIT

SEQ ID NO: 1923569 - protein, 9 aa, Staphylococcus
AHSSQTGPF

SEQ ID NO: 1923570 - protein, 8 aa, Staphylococcus
AHSTGYER

SEQ ID NO: 1923571 - protein, 5 aa, Staphylococcus
AHSVG

SEQ ID NO: 1923572 - protein, 6 aa, Staphylococcus
AHTAQP

SEQ ID NO: 1923573 - protein, 4 aa, Staphylococcus
AHTE

SEQ ID NO: 1923574 - protein, 8 aa, Staphylococcus
AHTESYDK

SEQ ID NO: 1923575 - protein, 13 aa, Staphylococcus
AHTGKKVAYADTE

SEQ ID NO: 1923576 - protein, 7 aa, Staphylococcus
AHTGTKE

SEQ ID NO: 1923577 - protein, 8 aa, Staphylococcus
AHTGTKEF

SEQ ID NO: 1923578 - protein, 21 aa, Staphylococcus
AHTKDDIKTTIQAFDTALSRI

SEQ ID NO: 1923579 - protein, 9 aa, Staphylococcus
AHTKEDIEK

SEQ ID NO: 1923580 - protein, 9 aa, Staphylococcus
AHTKEDIER

SEQ ID NO: 1923581 - protein, 8 aa, Staphylococcus
AHTQEDIE

SEQ ID NO: 1923582 - protein, 6 aa, Staphylococcus
AHTTHK

SEQ ID NO: 1923583 - protein, 13 aa, Staphylococcus
AHVTGPEDPNIQR

SEQ ID NO: 1923584 - protein, 6 aa, Staphylococcus
AHYAPD

SEQ ID NO: 1923585 - protein, 6 aa, Staphylococcus
AHYDDT

SEQ ID NO: 1923586 - protein, 7 aa, Staphylococcus
AHYDGTN

SEQ ID NO: 1923587 - protein, 9 aa, Staphylococcus
AHYEETDDI

SEQ ID NO: 1923588 - protein, 10 aa, Staphylococcus
AHYGASKAAF

SEQ ID NO: 1923589 - protein, 13 aa, Staphylococcus
AHYSASKAALNAS

SEQ ID NO: 1923590 - protein, 5 aa, Staphylococcus
AHYSN

SEQ ID NO: 1923591 - protein, 8 aa, Staphylococcus
AIAAGTKD

SEQ ID NO: 1923592 - protein, 21 aa, Staphylococcus
AIAATKEKFEREKAKGLKPRA

SEQ ID NO: 1923593 - protein, 12 aa, Staphylococcus
AIADRKSVLEQD

SEQ ID NO: 1923594 - protein, 6 aa, Staphylococcus
AIAENK

SEQ ID NO: 1923595 - protein, 10 aa, Staphylococcus
AIAESKENND

SEQ ID NO: 1923596 - protein, 8 aa, Staphylococcus
AIAGSTQY

SEQ ID NO: 1923597 - protein, 7 aa, Staphylococcus
AIAKAND

SEQ ID NO: 1923598 - protein, 8 aa, Staphylococcus
AIANGTKD

SEQ ID NO: 1923599 - protein, 12 aa, Staphylococcus
AIAQRGKVELNE

SEQ ID NO: 1923600 - protein, 6 aa, Staphylococcus
AIASQR

SEQ ID NO: 1923601 - protein, 4 aa, Staphylococcus
AIDA

SEQ ID NO: 1923602 - protein, 5 aa, Staphylococcus
AIDDD

SEQ ID NO: 1923603 - protein, 15 aa, Staphylococcus
AIDEAQSGNNQPAVK

SEQ ID NO: 1923604 - protein, 15 aa, Staphylococcus
AIDEAQTGNDQPAVK

SEQ ID NO: 1923605 - protein, 6 aa, Staphylococcus
AIDEDN

SEQ ID NO: 1923606 - protein, 10 aa, Staphylococcus
AIDENGEMDR

SEQ ID NO: 1923607 - protein, 11 aa, Staphylococcus
AIDGGESVDTS

SEQ ID NO: 1923608 - protein, 12 aa, Staphylococcus
AIDGRPNIENGE

SEQ ID NO: 1923609 - protein, 17 aa, Staphylococcus
AIDKDEKFGSTAEQNGK

SEQ ID NO: 1923610 - protein, 13 aa, Staphylococcus
AIDKDGKAHPLTQ

SEQ ID NO: 1923611 - protein, 10 aa, Staphylococcus
AIDQNGEMDR

SEQ ID NO: 1923612 - protein, 10 aa, Staphylococcus
AIDSNPKLTL

SEQ ID NO: 1923613 - protein, 7 aa, Staphylococcus
AIDTGGR

SEQ ID NO: 1923614 - protein, 7 aa, Staphylococcus
AIDTKGR

SEQ ID NO: 1923615 - protein, 10 aa, Staphylococcus
AIDTTGAGDA

SEQ ID NO: 1923616 - protein, 4 aa, Staphylococcus
AIEA

SEQ ID NO: 1923617 - protein, 10 aa, Staphylococcus
AIEAAKDTGF

SEQ ID NO: 1923618 - protein, 5 aa, Staphylococcus
AIEAD

SEQ ID NO: 1923619 - protein, 6 aa, Staphylococcus
AIEADK

SEQ ID NO: 1923620 - protein, 11 aa, Staphylococcus
AIEDAKEHGEI

SEQ ID NO: 1923621 - protein, 13 aa, Staphylococcus
AIEEAKKQKGPTM

SEQ ID NO: 1923622 - protein, 11 aa, Staphylococcus
AIEEAKSQDVP

SEQ ID NO: 1923623 - protein, 5 aa, Staphylococcus
AIEEE

SEQ ID NO: 1923624 - protein, 7 aa, Staphylococcus
AIEEPEV

SEQ ID NO: 1923625 - protein, 6 aa, Staphylococcus
AIEERE

SEQ ID NO: 1923626 - protein, 13 aa, Staphylococcus
AIEGGARRIEGTV

SEQ ID NO: 1923627 - protein, 25 aa, Staphylococcus
AIEGGARRIEGTVNGIGERAGNAAL

SEQ ID NO: 1923628 - protein, 26 aa, Staphylococcus
AIEGGARRIEGTVNGIGERAGNTALE

SEQ ID NO: 1923629 - protein, 10 aa, Staphylococcus
AIEGKSADDV

SEQ ID NO: 1923630 - protein, 9 aa, Staphylococcus
AIEHTKEKI

SEQ ID NO: 1923631 - protein, 6 aa, Staphylococcus
AIEKGG

SEQ ID NO: 1923632 - protein, 11 aa, Staphylococcus
AIEKKDSKIPM

SEQ ID NO: 1923633 - protein, 15 aa, Staphylococcus
AIEKNEVKSNNPHGD

SEQ ID NO: 1923634 - protein, 28 aa, Staphylococcus
AIEKPSKQSVSELKRQHETEQSDTNYDR

SEQ ID NO: 1923635 - protein, 5 aa, Staphylococcus
AIENA

SEQ ID NO: 1923636 - protein, 13 aa, Staphylococcus
AIENGAKRIEGTL

SEQ ID NO: 1923637 - protein, 25 aa, Staphylococcus
AIENGAKRIEGTVNGIGERAGNTAI

SEQ ID NO: 1923638 - protein, 21 aa, Staphylococcus
AIEPASTMAEGAQKIVKLVKE

SEQ ID NO: 1923639 - protein, 4 aa, Staphylococcus
AIEQ

SEQ ID NO: 1923640 - protein, 6 aa, Staphylococcus
AIEQGE

SEQ ID NO: 1923641 - protein, 4 aa, Staphylococcus
AIER

SEQ ID NO: 1923642 - protein, 11 aa, Staphylococcus
AIERKTGARGL

SEQ ID NO: 1923643 - protein, 6 aa, Staphylococcus
AIERSA

SEQ ID NO: 1923644 - protein, 59 aa, Staphylococcus
AIETDTEYASEQVEHNNDSVHDSSSNTEGEKLEDDDKQIVENEDVSSSIKSSIIPGSKP

SEQ ID NO: 1923645 - protein, 7 aa, Staphylococcus
AIETEGL

SEQ ID NO: 1923646 - protein, 7 aa, Staphylococcus
AIETGGR

SEQ ID NO: 1923647 - protein, 9 aa, Staphylococcus
AIETGRVQN

SEQ ID NO: 1923648 - protein, 6 aa, Staphylococcus
AIGAAT

SEQ ID NO: 1923649 - protein, 10 aa, Staphylococcus
AIGDGTTDNY

SEQ ID NO: 1923650 - protein, 12 aa, Staphylococcus
AIGESPTELGKE

SEQ ID NO: 1923651 - protein, 5 aa, Staphylococcus
AIGGG

SEQ ID NO: 1923652 - protein, 21 aa, Staphylococcus
AIGGNTIRTGGQVNAPEPQWQ

SEQ ID NO: 1923653 - protein, 11 aa, Staphylococcus
AIGKAGAKNAG

SEQ ID NO: 1923654 - protein, 9 aa, Staphylococcus
AIGPYSHAT

SEQ ID NO: 1923655 - protein, 7 aa, Staphylococcus
AIGQEGK

SEQ ID NO: 1923656 - protein, 12 aa, Staphylococcus
AIGSEKKTAQMI

SEQ ID NO: 1923657 - protein, 12 aa, Staphylococcus
AIIGSSTSGIMP

SEQ ID NO: 1923658 - protein, 8 aa, Staphylococcus
AIIGTSAG

SEQ ID NO: 1923659 - protein, 8 aa, Staphylococcus
AIISGSGA

SEQ ID NO: 1923660 - protein, 4 aa, Staphylococcus
AIKA

SEQ ID NO: 1923661 - protein, 5 aa, Staphylococcus
AIKAN

SEQ ID NO: 1923662 - protein, 8 aa, Staphylococcus
AIKDAGGF

SEQ ID NO: 1923663 - protein, 12 aa, Staphylococcus
AIKDAKQNATIN

SEQ ID NO: 1923664 - protein, 13 aa, Staphylococcus
AIKDNQLNKDSIT

SEQ ID NO: 1923665 - protein, 13 aa, Staphylococcus
AIKDPKLNKDSIT

SEQ ID NO: 1923666 - protein, 15 aa, Staphylococcus
AIKDTLKKASIASGV

SEQ ID NO: 1923667 - protein, 7 aa, Staphylococcus
AIKEAND

SEQ ID NO: 1923668 - protein, 6 aa, Staphylococcus
AIKEED

SEQ ID NO: 1923669 - protein, 8 aa, Staphylococcus
AIKEGGRV

SEQ ID NO: 1923670 - protein, 8 aa, Staphylococcus
AIKESDAD

SEQ ID NO: 1923671 - protein, 9 aa, Staphylococcus
AIKGKRDNL

SEQ ID NO: 1923672 - protein, 7 aa, Staphylococcus
AIKNGEQ

SEQ ID NO: 1923673 - protein, 6 aa, Staphylococcus
AIKNGQ

SEQ ID NO: 1923674 - protein, 5 aa, Staphylococcus
AIKNR

SEQ ID NO: 1923675 - protein, 7 aa, Staphylococcus
AIKPNGT

SEQ ID NO: 1923676 - protein, 10 aa, Staphylococcus
AIKPNPDPYL

SEQ ID NO: 1923677 - protein, 17 aa, Staphylococcus
AIKQGAADYEQLKSFLN

SEQ ID NO: 1923678 - protein, 11 aa, Staphylococcus
AIKSESEKLNY

SEQ ID NO: 1923679 - protein, 9 aa, Staphylococcus
AIKSKGSKA

SEQ ID NO: 1923680 - protein, 5 aa, Staphylococcus
AIKTE

SEQ ID NO: 1923681 - protein, 8 aa, Staphylococcus
AIKTGHKA

SEQ ID NO: 1923682 - protein, 13 aa, Staphylococcus
AILGEKESGDGTV

SEQ ID NO: 1923683 - protein, 18 aa, Staphylococcus
AINAGQSVSRVGGSAQIK

SEQ ID NO: 1923684 - protein, 8 aa, Staphylococcus
AINDDNEK

SEQ ID NO: 1923685 - protein, 9 aa, Staphylococcus
AINDEDRIP

SEQ ID NO: 1923686 - protein, 5 aa, Staphylococcus
AINDQ

SEQ ID NO: 1923687 - protein, 6 aa, Staphylococcus
AINENT

SEQ ID NO: 1923688 - protein, 13 aa, Staphylococcus
AINESKQFNKQFQ

SEQ ID NO: 1923689 - protein, 10 aa, Staphylococcus
AINGELPKDY

SEQ ID NO: 1923690 - protein, 18 aa, Staphylococcus
AINKGDKFGCAEESKNTN

SEQ ID NO: 1923691 - protein, 8 aa, Staphylococcus
AINKSGLD

SEQ ID NO: 1923692 - protein, 9 aa, Staphylococcus
AINNGSRDD

SEQ ID NO: 1923693 - protein, 5 aa, Staphylococcus
AINNK

SEQ ID NO: 1923694 - protein, 15 aa, Staphylococcus
AINNSKVKPGDYDKI

SEQ ID NO: 1923695 - protein, 12 aa, Staphylococcus
AINPNNKDISKS

SEQ ID NO: 1923696 - protein, 9 aa, Staphylococcus
AINQDGGQL

SEQ ID NO: 1923697 - protein, 6 aa, Staphylococcus
AINQHE

SEQ ID NO: 1923698 - protein, 5 aa, Staphylococcus
AINQQ

SEQ ID NO: 1923699 - protein, 7 aa, Staphylococcus
AINQSDK

SEQ ID NO: 1923700 - protein, 12 aa, Staphylococcus
AINSAKPSDELK

SEQ ID NO: 1923701 - protein, 12 aa, Staphylococcus
AINSAKPSDQLK

SEQ ID NO: 1923702 - protein, 10 aa, Staphylococcus
AINSGQLSDE

SEQ ID NO: 1923703 - protein, 13 aa, Staphylococcus
AINTDDLSSDKKL

SEQ ID NO: 1923704 - protein, 11 aa, Staphylococcus
AINTVPSNGYL

SEQ ID NO: 1923705 - protein, 6 aa, Staphylococcus
AIPGDD

SEQ ID NO: 1923706 - protein, 6 aa, Staphylococcus
AIPNDT

SEQ ID NO: 1923707 - protein, 7 aa, Staphylococcus
AIPPEDA

SEQ ID NO: 1923708 - protein, 17 aa, Staphylococcus
AIPPVERNQNGYRDYRT

SEQ ID NO: 1923709 - protein, 8 aa, Staphylococcus
AIQDAKQN

SEQ ID NO: 1923710 - protein, 10 aa, Staphylococcus
AIQDEESYQV

SEQ ID NO: 1923711 - protein, 7 aa, Staphylococcus
AIQDNTK

SEQ ID NO: 1923712 - protein, 13 aa, Staphylococcus
AIQGLGAAKNQPV

SEQ ID NO: 1923713 - protein, 10 aa, Staphylococcus
AIQGPKARDL

SEQ ID NO: 1923714 - protein, 9 aa, Staphylococcus
AIQGSDRSN

SEQ ID NO: 1923715 - protein, 9 aa, Staphylococcus
AIQGSNRSN

SEQ ID NO: 1923716 - protein, 7 aa, Staphylococcus
AIQGSSM

SEQ ID NO: 1923717 - protein, 9 aa, Staphylococcus
AIQGSSRSN

SEQ ID NO: 1923718 - protein, 17 aa, Staphylococcus
AIQHRGDTVTEGASSNV

SEQ ID NO: 1923719 - protein, 17 aa, Staphylococcus
AIQKGDKFGYAEEPKNK

SEQ ID NO: 1923720 - protein, 7 aa, Staphylococcus
AIQKPEE

SEQ ID NO: 1923721 - protein, 4 aa, Staphylococcus
AIQS

SEQ ID NO: 1923722 - protein, 10 aa, Staphylococcus
AIQSDSAFSQ

SEQ ID NO: 1923723 - protein, 5 aa, Staphylococcus
AIQST

SEQ ID NO: 1923724 - protein, 4 aa, Staphylococcus
AIQT

SEQ ID NO: 1923725 - protein, 22 aa, Staphylococcus
AIQTSQEDLANAQKAQTAYTRN

SEQ ID NO: 1923726 - protein, 138 aa, Staphylococcus
AIQTTQDAIQSTQQSHTKKLDEQQAIASESSASHQSSQSHQPKQSTSPSSSESNSVASTSTSTSHHSNSLSNVDEATKSESTSLSTSEQSTSLSETKSHTTSESQVTNTNNHTESQSSPLGHPEPKEEKKGFFARLFN

SEQ ID NO: 1923727 - protein, 4 aa, Staphylococcus
AIRN

SEQ ID NO: 1923728 - protein, 7 aa, Staphylococcus
AISADGL

SEQ ID NO: 1923729 - protein, 7 aa, Staphylococcus
AISDEGT

SEQ ID NO: 1923730 - protein, 10 aa, Staphylococcus
AISDENSFKE

SEQ ID NO: 1923731 - protein, 7 aa, Staphylococcus
AISDGDE

SEQ ID NO: 1923732 - protein, 6 aa, Staphylococcus
AISDGN

SEQ ID NO: 1923733 - protein, 6 aa, Staphylococcus
AISDYK

SEQ ID NO: 1923734 - protein, 16 aa, Staphylococcus
AISEDNQDIKEALGEI

SEQ ID NO: 1923735 - protein, 16 aa, Staphylococcus
AISEKAIERKTGARGL

SEQ ID NO: 1923736 - protein, 6 aa, Staphylococcus
AISEKT

SEQ ID NO: 1923737 - protein, 11 aa, Staphylococcus
AISENERTKLA

SEQ ID NO: 1923738 - protein, 4 aa, Staphylococcus
AISG

SEQ ID NO: 1923739 - protein, 5 aa, Staphylococcus
AISGD

SEQ ID NO: 1923740 - protein, 5 aa, Staphylococcus
AISGE

SEQ ID NO: 1923741 - protein, 7 aa, Staphylococcus
AISGSED

SEQ ID NO: 1923742 - protein, 18 aa, Staphylococcus
AISKDESGLTREKLSQFG

SEQ ID NO: 1923743 - protein, 9 aa, Staphylococcus
AISKNKPDA

SEQ ID NO: 1923744 - protein, 7 aa, Staphylococcus
AISKPDE

SEQ ID NO: 1923745 - protein, 12 aa, Staphylococcus
AISQQIQTREQT

SEQ ID NO: 1923746 - protein, 5 aa, Staphylococcus
AISQT

SEQ ID NO: 1923747 - protein, 6 aa, Staphylococcus
AISQTS

SEQ ID NO: 1923748 - protein, 7 aa, Staphylococcus
AISQTSN

SEQ ID NO: 1923749 - protein, 7 aa, Staphylococcus
AISQTTN

SEQ ID NO: 1923750 - protein, 5 aa, Staphylococcus
AISRQ

SEQ ID NO: 1923751 - protein, 15 aa, Staphylococcus
AISSDALERVKKSRA

SEQ ID NO: 1923752 - protein, 14 aa, Staphylococcus
AISSSETVELLVKS

SEQ ID NO: 1923753 - protein, 6 aa, Staphylococcus
AISTIG

SEQ ID NO: 1923754 - protein, 7 aa, Staphylococcus
AISTKAT

SEQ ID NO: 1923755 - protein, 9 aa, Staphylococcus
AISTNKPDA

SEQ ID NO: 1923756 - protein, 16 aa, Staphylococcus
AISTPRSKQTAAQTLA

SEQ ID NO: 1923757 - protein, 16 aa, Staphylococcus
AISTPRSKQTAATTLA

SEQ ID NO: 1923758 - protein, 6 aa, Staphylococcus
AITAEG

SEQ ID NO: 1923759 - protein, 9 aa, Staphylococcus
AITAGSDIK

SEQ ID NO: 1923760 - protein, 5 aa, Staphylococcus
AITDK

SEQ ID NO: 1923761 - protein, 19 aa, Staphylococcus
AITERQSLENEDSSCKVSQ

SEQ ID NO: 1923762 - protein, 14 aa, Staphylococcus
AITGENSDIKGTNL

SEQ ID NO: 1923763 - protein, 18 aa, Staphylococcus
AITGQKPLITKAKKSVAT

SEQ ID NO: 1923764 - protein, 4 aa, Staphylococcus
AITK

SEQ ID NO: 1923765 - protein, 13 aa, Staphylococcus
AITKAKSQNGPTM

SEQ ID NO: 1923766 - protein, 10 aa, Staphylococcus
AITSNHARAT

SEQ ID NO: 1923767 - protein, 8 aa, Staphylococcus
AITSQNNW

SEQ ID NO: 1923768 - protein, 13 aa, Staphylococcus
AITTAKSQQGPTL

SEQ ID NO: 1923769 - protein, 7 aa, Staphylococcus
AITTGHP

SEQ ID NO: 1923770 - protein, 14 aa, Staphylococcus
AIVNTTSVTAYRGS

SEQ ID NO: 1923771 - protein, 14 aa, Staphylococcus
AIYEGRPYGMNPTK

SEQ ID NO: 1923772 - protein, 13 aa, Staphylococcus
AIYKEHNDTSSQL

SEQ ID NO: 1923773 - protein, 4 aa, Staphylococcus
AKAA

SEQ ID NO: 1923774 - protein, 10 aa, Staphylococcus
AKAAERAGAA

SEQ ID NO: 1923775 - protein, 7 aa, Staphylococcus
AKAATSL

SEQ ID NO: 1923776 - protein, 9 aa, Staphylococcus
AKADDDAEF

SEQ ID NO: 1923777 - protein, 8 aa, Staphylococcus
AKADDGAP

SEQ ID NO: 1923778 - protein, 21 aa, Staphylococcus
AKADDGSGKTGTINITVTTDA

SEQ ID NO: 1923779 - protein, 11 aa, Staphylococcus
AKADSPQTPAM

SEQ ID NO: 1923780 - protein, 4 aa, Staphylococcus
AKAE

SEQ ID NO: 1923781 - protein, 11 aa, Staphylococcus
AKAEEGKQERV

SEQ ID NO: 1923782 - protein, 9 aa, Staphylococcus
AKAEHDETL

SEQ ID NO: 1923783 - protein, 6 aa, Staphylococcus
AKAERE

SEQ ID NO: 1923784 - protein, 6 aa, Staphylococcus
AKAGAL

SEQ ID NO: 1923785 - protein, 19 aa, Staphylococcus
AKAGDKDVDKAVKAAQTAF

SEQ ID NO: 1923786 - protein, 8 aa, Staphylococcus
AKAGGIPV

SEQ ID NO: 1923787 - protein, 8 aa, Staphylococcus
AKAGGLPV

SEQ ID NO: 1923788 - protein, 10 aa, Staphylococcus
AKAGQKGAVT

SEQ ID NO: 1923789 - protein, 10 aa, Staphylococcus
AKAGQTISEQ

SEQ ID NO: 1923790 - protein, 10 aa, Staphylococcus
AKAGRSISED

SEQ ID NO: 1923791 - protein, 10 aa, Staphylococcus
AKAGRSISEK

SEQ ID NO: 1923792 - protein, 10 aa, Staphylococcus
AKAGRTISED

SEQ ID NO: 1923793 - protein, 4 aa, Staphylococcus
AKAH

SEQ ID NO: 1923794 - protein, 17 aa, Staphylococcus
AKAIDADAGTINQGDQA

SEQ ID NO: 1923795 - protein, 16 aa, Staphylococcus
AKAIDADAGTLETGDD

SEQ ID NO: 1923796 - protein, 10 aa, Staphylococcus
AKAISGSTDY

SEQ ID NO: 1923797 - protein, 8 aa, Staphylococcus
AKAKDGAA

SEQ ID NO: 1923798 - protein, 8 aa, Staphylococcus
AKAKDGAS

SEQ ID NO: 1923799 - protein, 12 aa, Staphylococcus
AKAKEDTKDNTG

SEQ ID NO: 1923800 - protein, 9 aa, Staphylococcus
AKAKEGKVQ

SEQ ID NO: 1923801 - protein, 7 aa, Staphylococcus
AKAKNYR

SEQ ID NO: 1923802 - protein, 6 aa, Staphylococcus
AKAKPE

SEQ ID NO: 1923803 - protein, 12 aa, Staphylococcus
AKAKPSKPDDCR

SEQ ID NO: 1923804 - protein, 12 aa, Staphylococcus
AKAKPSKPEDCK

SEQ ID NO: 1923805 - protein, 12 aa, Staphylococcus
AKAKPTKPEQCR

SEQ ID NO: 1923806 - protein, 9 aa, Staphylococcus
AKAKSQNLK

SEQ ID NO: 1923807 - protein, 9 aa, Staphylococcus
AKAKTIEKY

SEQ ID NO: 1923808 - protein, 4 aa, Staphylococcus
AKAL

SEQ ID NO: 1923809 - protein, 8 aa, Staphylococcus
AKALYGDD

SEQ ID NO: 1923810 - protein, 7 aa, Staphylococcus
AKANAKM

SEQ ID NO: 1923811 - protein, 10 aa, Staphylococcus
AKANISDNHY

SEQ ID NO: 1923812 - protein, 20 aa, Staphylococcus
AKANQADVDKAVKAAQDAFD

SEQ ID NO: 1923813 - protein, 5 aa, Staphylococcus
AKANV

SEQ ID NO: 1923814 - protein, 8 aa, Staphylococcus
AKAQETKQ

SEQ ID NO: 1923815 - protein, 16 aa, Staphylococcus
AKAQMSQTFSSKQRFV

SEQ ID NO: 1923816 - protein, 6 aa, Staphylococcus
AKAQPG

SEQ ID NO: 1923817 - protein, 7 aa, Staphylococcus
AKAQSQK

SEQ ID NO: 1923818 - protein, 11 aa, Staphylococcus
AKARSTKQQAR

SEQ ID NO: 1923819 - protein, 12 aa, Staphylococcus
AKARSTKQQARI

SEQ ID NO: 1923820 - protein, 9 aa, Staphylococcus
AKASDFNRP

SEQ ID NO: 1923821 - protein, 7 aa, Staphylococcus
AKASDPL

SEQ ID NO: 1923822 - protein, 9 aa, Staphylococcus
AKASDTISK

SEQ ID NO: 1923823 - protein, 13 aa, Staphylococcus
AKASGSAAAPTAG

SEQ ID NO: 1923824 - protein, 8 aa, Staphylococcus
AKASGYDD

SEQ ID NO: 1923825 - protein, 10 aa, Staphylococcus
AKASQYRSAG

SEQ ID NO: 1923826 - protein, 7 aa, Staphylococcus
AKASVPE

SEQ ID NO: 1923827 - protein, 5 aa, Staphylococcus
AKATD

SEQ ID NO: 1923828 - protein, 8 aa, Staphylococcus
AKATESFK

SEQ ID NO: 1923829 - protein, 6 aa, Staphylococcus
AKATGF

SEQ ID NO: 1923830 - protein, 4 aa, Staphylococcus
AKAY

SEQ ID NO: 1923831 - protein, 54 aa, Staphylococcus
AKDADGSQSEEQATSSDKNDSTDNQKQDKKDTSKSKESKEDSKDQQDNAAKDSE

SEQ ID NO: 1923832 - protein, 8 aa, Staphylococcus
AKDAGLDV

SEQ ID NO: 1923833 - protein, 7 aa, Staphylococcus
AKDAHGR

SEQ ID NO: 1923834 - protein, 9 aa, Staphylococcus
AKDANDADD

SEQ ID NO: 1923835 - protein, 8 aa, Staphylococcus
AKDANGRL

SEQ ID NO: 1923836 - protein, 9 aa, Staphylococcus
AKDDGATIA

SEQ ID NO: 1923837 - protein, 29 aa, Staphylococcus
AKDDKDNDKENKLPKLNQGDKVTATQIEP

SEQ ID NO: 1923838 - protein, 29 aa, Staphylococcus
AKDDKDNEKENKLPNLSKGDEVTATQIEP

SEQ ID NO: 1923839 - protein, 29 aa, Staphylococcus
AKDDKENDKENKLPNLKEGDKVTATQIEP

SEQ ID NO: 1923840 - protein, 7 aa, Staphylococcus
AKDDVRS

SEQ ID NO: 1923841 - protein, 5 aa, Staphylococcus
AKDED

SEQ ID NO: 1923842 - protein, 8 aa, Staphylococcus
AKDEDGQI

SEQ ID NO: 1923843 - protein, 6 aa, Staphylococcus
AKDEDW

SEQ ID NO: 1923844 - protein, 17 aa, Staphylococcus
AKDEETMTTLDNNERKL

SEQ ID NO: 1923845 - protein, 5 aa, Staphylococcus
AKDEG

SEQ ID NO: 1923846 - protein, 6 aa, Staphylococcus
AKDENI

SEQ ID NO: 1923847 - protein, 7 aa, Staphylococcus
AKDETNK

SEQ ID NO: 1923848 - protein, 9 aa, Staphylococcus
AKDETPKIM

SEQ ID NO: 1923849 - protein, 7 aa, Staphylococcus
AKDEYGR

SEQ ID NO: 1923850 - protein, 6 aa, Staphylococcus
AKDFDQ

SEQ ID NO: 1923851 - protein, 9 aa, Staphylococcus
AKDGEAAAR

SEQ ID NO: 1923852 - protein, 9 aa, Staphylococcus
AKDGEGATK

SEQ ID NO: 1923853 - protein, 6 aa, Staphylococcus
AKDGEI

SEQ ID NO: 1923854 - protein, 6 aa, Staphylococcus
AKDHDT

SEQ ID NO: 1923855 - protein, 12 aa, Staphylococcus
AKDIAQSTGYER

SEQ ID NO: 1923856 - protein, 8 aa, Staphylococcus
AKDIDGKD

SEQ ID NO: 1923857 - protein, 8 aa, Staphylococcus
AKDIDGND

SEQ ID NO: 1923858 - protein, 6 aa, Staphylococcus
AKDIES

SEQ ID NO: 1923859 - protein, 6 aa, Staphylococcus
AKDIHS

SEQ ID NO: 1923860 - protein, 7 aa, Staphylococcus
AKDIKAD

SEQ ID NO: 1923861 - protein, 13 aa, Staphylococcus
AKDIQDKLQQTSK

SEQ ID NO: 1923862 - protein, 8 aa, Staphylococcus
AKDKAERV

SEQ ID NO: 1923863 - protein, 9 aa, Staphylococcus
AKDKALDGI

SEQ ID NO: 1923864 - protein, 8 aa, Staphylococcus
AKDKAQQV

SEQ ID NO: 1923865 - protein, 15 aa, Staphylococcus
AKDKASAESEQIDPR

SEQ ID NO: 1923866 - protein, 8 aa, Staphylococcus
AKDKDTLG

SEQ ID NO: 1923867 - protein, 7 aa, Staphylococcus
AKDKDVT

SEQ ID NO: 1923868 - protein, 9 aa, Staphylococcus
AKDKELPGI

SEQ ID NO: 1923869 - protein, 6 aa, Staphylococcus
AKDKGI

SEQ ID NO: 1923870 - protein, 8 aa, Staphylococcus
AKDKIPEL

SEQ ID NO: 1923871 - protein, 6 aa, Staphylococcus
AKDKMG

SEQ ID NO: 1923872 - protein, 7 aa, Staphylococcus
AKDKNIA

SEQ ID NO: 1923873 - protein, 9 aa, Staphylococcus
AKDKTIASA

SEQ ID NO: 1923874 - protein, 11 aa, Staphylococcus
AKDLDAQGKGV

SEQ ID NO: 1923875 - protein, 11 aa, Staphylococcus
AKDLEKQGKGV

SEQ ID NO: 1923876 - protein, 9 aa, Staphylococcus
AKDNAKGGT

SEQ ID NO: 1923877 - protein, 9 aa, Staphylococcus
AKDNENQNI

SEQ ID NO: 1923878 - protein, 8 aa, Staphylococcus
AKDNGIGI

SEQ ID NO: 1923879 - protein, 10 aa, Staphylococcus
AKDPKGGCAG

SEQ ID NO: 1923880 - protein, 7 aa, Staphylococcus
AKDQLNI

SEQ ID NO: 1923881 - protein, 5 aa, Staphylococcus
AKDQQ

SEQ ID NO: 1923882 - protein, 7 aa, Staphylococcus
AKDQTYP

SEQ ID NO: 1923883 - protein, 14 aa, Staphylococcus
AKDSRSKNIGLTTS

SEQ ID NO: 1923884 - protein, 10 aa, Staphylococcus
AKDTKKGLRD

SEQ ID NO: 1923885 - protein, 9 aa, Staphylococcus
AKDTPPDKV

SEQ ID NO: 1923886 - protein, 7 aa, Staphylococcus
AKDTTIS

SEQ ID NO: 1923887 - protein, 9 aa, Staphylococcus
AKDVGIDKE

SEQ ID NO: 1923888 - protein, 9 aa, Staphylococcus
AKDYRQGLK

SEQ ID NO: 1923889 - protein, 14 aa, Staphylococcus
AKDYRQGLKDQVEA

SEQ ID NO: 1923890 - protein, 23 aa, Staphylococcus
AKDYRQGLKDQVEQLKEQGYTPK

SEQ ID NO: 1923891 - protein, 11 aa, Staphylococcus
AKDYRQGLQDQ

SEQ ID NO: 1923892 - protein, 7 aa, Staphylococcus
AKEADVP

SEQ ID NO: 1923893 - protein, 7 aa, Staphylococcus
AKEAEVP

SEQ ID NO: 1923894 - protein, 5 aa, Staphylococcus
AKEAG

SEQ ID NO: 1923895 - protein, 6 aa, Staphylococcus
AKEAGF

SEQ ID NO: 1923896 - protein, 13 aa, Staphylococcus
AKEAGIYEQLLTV

SEQ ID NO: 1923897 - protein, 9 aa, Staphylococcus
AKEAQGDDI

SEQ ID NO: 1923898 - protein, 9 aa, Staphylococcus
AKEAQGEDI

SEQ ID NO: 1923899 - protein, 7 aa, Staphylococcus
AKEARIQ

SEQ ID NO: 1923900 - protein, 6 aa, Staphylococcus
AKEAYD

SEQ ID NO: 1923901 - protein, 7 aa, Staphylococcus
AKEAYEA

SEQ ID NO: 1923902 - protein, 7 aa, Staphylococcus
AKEAYQA

SEQ ID NO: 1923903 - protein, 9 aa, Staphylococcus
AKEDARKHQ

SEQ ID NO: 1923904 - protein, 5 aa, Staphylococcus
AKEDQ

SEQ ID NO: 1923905 - protein, 12 aa, Staphylococcus
AKEEADSRSHQL

SEQ ID NO: 1923906 - protein, 5 aa, Staphylococcus
AKEEG

SEQ ID NO: 1923907 - protein, 9 aa, Staphylococcus
AKEEGGYYT

SEQ ID NO: 1923908 - protein, 6 aa, Staphylococcus
AKEEGI

SEQ ID NO: 1923909 - protein, 7 aa, Staphylococcus
AKEEMKR

SEQ ID NO: 1923910 - protein, 5 aa, Staphylococcus
AKEEN

SEQ ID NO: 1923911 - protein, 8 aa, Staphylococcus
AKEETIDK

SEQ ID NO: 1923912 - protein, 8 aa, Staphylococcus
AKEETISK

SEQ ID NO: 1923913 - protein, 8 aa, Staphylococcus
AKEETITK

SEQ ID NO: 1923914 - protein, 8 aa, Staphylococcus
AKEGRGQE

SEQ ID NO: 1923915 - protein, 7 aa, Staphylococcus
AKEGTRL

SEQ ID NO: 1923916 - protein, 8 aa, Staphylococcus
AKEGVELS

SEQ ID NO: 1923917 - protein, 10 aa, Staphylococcus
AKEGVPPTNW

SEQ ID NO: 1923918 - protein, 14 aa, Staphylococcus
AKEGVQIQNESKTM

SEQ ID NO: 1923919 - protein, 14 aa, Staphylococcus
AKEGVTIQNESKTM

SEQ ID NO: 1923920 - protein, 4 aa, Staphylococcus
AKEH

SEQ ID NO: 1923921 - protein, 5 aa, Staphylococcus
AKEHH

SEQ ID NO: 1923922 - protein, 13 aa, Staphylococcus
AKEIEDKLNNKKA

SEQ ID NO: 1923923 - protein, 5 aa, Staphylococcus
AKEIG

SEQ ID NO: 1923924 - protein, 6 aa, Staphylococcus
AKEIKS

SEQ ID NO: 1923925 - protein, 10 aa, Staphylococcus
AKEISDQGRI

SEQ ID NO: 1923926 - protein, 25 aa, Staphylococcus
AKEISDQGRITVNGNDAKAGTDVKV

SEQ ID NO: 1923927 - protein, 25 aa, Staphylococcus
AKEISDQGRITVNGSVAKAGTDVKV

SEQ ID NO: 1923928 - protein, 12 aa, Staphylococcus
AKEISDQGRVTI

SEQ ID NO: 1923929 - protein, 14 aa, Staphylococcus
AKEISKQLFEINNL

SEQ ID NO: 1923930 - protein, 15 aa, Staphylococcus
AKEITDTNEHSGVGK

SEQ ID NO: 1923931 - protein, 5 aa, Staphylococcus
AKEKG

SEQ ID NO: 1923932 - protein, 8 aa, Staphylococcus
AKEKGFTK

SEQ ID NO: 1923933 - protein, 9 aa, Staphylococcus
AKEKGIEID

SEQ ID NO: 1923934 - protein, 10 aa, Staphylococcus
AKEKGYEQTR

SEQ ID NO: 1923935 - protein, 9 aa, Staphylococcus
AKEKNLKKA

SEQ ID NO: 1923936 - protein, 4 aa, Staphylococcus
AKEL

SEQ ID NO: 1923937 - protein, 6 aa, Staphylococcus
AKELGA

SEQ ID NO: 1923938 - protein, 6 aa, Staphylococcus
AKELGE

SEQ ID NO: 1923939 - protein, 6 aa, Staphylococcus
AKELKG

SEQ ID NO: 1923940 - protein, 6 aa, Staphylococcus
AKELNK

SEQ ID NO: 1923941 - protein, 7 aa, Staphylococcus
AKELYQD

SEQ ID NO: 1923942 - protein, 8 aa, Staphylococcus
AKENETPL

SEQ ID NO: 1923943 - protein, 6 aa, Staphylococcus
AKENGV

SEQ ID NO: 1923944 - protein, 31 aa, Staphylococcus
AKENKAVSSSKQQAPKQKVKKASTKKALPKI

SEQ ID NO: 1923945 - protein, 7 aa, Staphylococcus
AKENKPK

SEQ ID NO: 1923946 - protein, 16 aa, Staphylococcus
AKENKSDKQLKKISEL

SEQ ID NO: 1923947 - protein, 7 aa, Staphylococcus
AKENSDI

SEQ ID NO: 1923948 - protein, 10 aa, Staphylococcus
AKENSEKNHI

SEQ ID NO: 1923949 - protein, 8 aa, Staphylococcus
AKENTLSG

SEQ ID NO: 1923950 - protein, 8 aa, Staphylococcus
AKENYESI

SEQ ID NO: 1923951 - protein, 6 aa, Staphylococcus
AKEPEI

SEQ ID NO: 1923952 - protein, 19 aa, Staphylococcus
AKEQDEKVSEYGIEQNNGE

SEQ ID NO: 1923953 - protein, 8 aa, Staphylococcus
AKEQGIDI

SEQ ID NO: 1923954 - protein, 12 aa, Staphylococcus
AKEQGVDITTNA

SEQ ID NO: 1923955 - protein, 12 aa, Staphylococcus
AKEQGVEVTADA

SEQ ID NO: 1923956 - protein, 5 aa, Staphylococcus
AKEQN

SEQ ID NO: 1923957 - protein, 6 aa, Staphylococcus
AKEQPD

SEQ ID NO: 1923958 - protein, 8 aa, Staphylococcus
AKEQPDKI

SEQ ID NO: 1923959 - protein, 10 aa, Staphylococcus
AKEQSQDNPI

SEQ ID NO: 1923960 - protein, 18 aa, Staphylococcus
AKERDEKVSEYGIEQADG

SEQ ID NO: 1923961 - protein, 19 aa, Staphylococcus
AKERGEAYQDFDKSDYASG

SEQ ID NO: 1923962 - protein, 8 aa, Staphylococcus
AKERGEKY

SEQ ID NO: 1923963 - protein, 19 aa, Staphylococcus
AKERGESYQDFDQSDYANG

SEQ ID NO: 1923964 - protein, 18 aa, Staphylococcus
AKERNEKVSEYGIEQADG

SEQ ID NO: 1923965 - protein, 6 aa, Staphylococcus
AKERPD

SEQ ID NO: 1923966 - protein, 5 aa, Staphylococcus
AKESA

SEQ ID NO: 1923967 - protein, 9 aa, Staphylococcus
AKESGAEIL

SEQ ID NO: 1923968 - protein, 8 aa, Staphylococcus
AKESINKE

SEQ ID NO: 1923969 - protein, 6 aa, Staphylococcus
AKETFG

SEQ ID NO: 1923970 - protein, 7 aa, Staphylococcus
AKETNIA

SEQ ID NO: 1923971 - protein, 7 aa, Staphylococcus
AKETPVN

SEQ ID NO: 1923972 - protein, 5 aa, Staphylococcus
AKEVD

SEQ ID NO: 1923973 - protein, 14 aa, Staphylococcus
AKEVRETKEGLKSG

SEQ ID NO: 1923974 - protein, 14 aa, Staphylococcus
AKEVRKTKEGLKSG

SEQ ID NO: 1923975 - protein, 16 aa, Staphylococcus
AKEVSTSDFADELIKN

SEQ ID NO: 1923976 - protein, 4 aa, Staphylococcus
AKEY

SEQ ID NO: 1923977 - protein, 9 aa, Staphylococcus
AKEYASKFE

SEQ ID NO: 1923978 - protein, 8 aa, Staphylococcus
AKEYASQG

SEQ ID NO: 1923979 - protein, 5 aa, Staphylococcus
AKEYQ

SEQ ID NO: 1923980 - protein, 14 aa, Staphylococcus
AKEYRQGLQEQVES

SEQ ID NO: 1923981 - protein, 4 aa, Staphylococcus
AKFD

SEQ ID NO: 1923982 - protein, 10 aa, Staphylococcus
AKFDNANESY

SEQ ID NO: 1923983 - protein, 4 aa, Staphylococcus
AKFG

SEQ ID NO: 1923984 - protein, 11 aa, Staphylococcus
AKFGKEPRAYG

SEQ ID NO: 1923985 - protein, 7 aa, Staphylococcus
AKGADSM

SEQ ID NO: 1923986 - protein, 16 aa, Staphylococcus
AKGAISKAGSQVADEK

SEQ ID NO: 1923987 - protein, 7 aa, Staphylococcus
AKGANKR

SEQ ID NO: 1923988 - protein, 6 aa, Staphylococcus
AKGATH

SEQ ID NO: 1923989 - protein, 8 aa, Staphylococcus
AKGATHNN

SEQ ID NO: 1923990 - protein, 8 aa, Staphylococcus
AKGATHSN

SEQ ID NO: 1923991 - protein, 9 aa, Staphylococcus
AKGDDERHP

SEQ ID NO: 1923992 - protein, 8 aa, Staphylococcus
AKGDEASL

SEQ ID NO: 1923993 - protein, 8 aa, Staphylococcus
AKGDEDSL

SEQ ID NO: 1923994 - protein, 8 aa, Staphylococcus
AKGDEQSL

SEQ ID NO: 1923995 - protein, 11 aa, Staphylococcus
AKGDMQAAQDN

SEQ ID NO: 1923996 - protein, 10 aa, Staphylococcus
AKGDPIPSTI

SEQ ID NO: 1923997 - protein, 14 aa, Staphylococcus
AKGDTSADITTSES

SEQ ID NO: 1923998 - protein, 9 aa, Staphylococcus
AKGEAETSL

SEQ ID NO: 1923999 - protein, 14 aa, Staphylococcus
AKGFDDAETQYTPA

SEQ ID NO: 1924000 - protein, 7 aa, Staphylococcus
AKGFDKD

SEQ ID NO: 1924001 - protein, 7 aa, Staphylococcus
AKGFNQQ

SEQ ID NO: 1924002 - protein, 4 aa, Staphylococcus
AKGG

SEQ ID NO: 1924003 - protein, 7 aa, Staphylococcus
AKGGEIR

SEQ ID NO: 1924004 - protein, 8 aa, Staphylococcus
AKGGINTH

SEQ ID NO: 1924005 - protein, 33 aa, Staphylococcus
AKGGRGGRGNSRFASPRNPAPDFSENGEPGEEI

SEQ ID NO: 1924006 - protein, 8 aa, Staphylococcus
AKGIEPIE

SEQ ID NO: 1924007 - protein, 5 aa, Staphylococcus
AKGIY

SEQ ID NO: 1924008 - protein, 13 aa, Staphylococcus
AKGKALDKIFRQH

SEQ ID NO: 1924009 - protein, 8 aa, Staphylococcus
AKGKKYKI

SEQ ID NO: 1924010 - protein, 11 aa, Staphylococcus
AKGKPRGIFGN

SEQ ID NO: 1924011 - protein, 12 aa, Staphylococcus
AKGKPTGSLTDE

SEQ ID NO: 1924012 - protein, 6 aa, Staphylococcus
AKGKSI

SEQ ID NO: 1924013 - protein, 9 aa, Staphylococcus
AKGKSIYEA

SEQ ID NO: 1924014 - protein, 7 aa, Staphylococcus
AKGKTIY

SEQ ID NO: 1924015 - protein, 9 aa, Staphylococcus
AKGKTNKEI

SEQ ID NO: 1924016 - protein, 10 aa, Staphylococcus
AKGKTNKEIA

SEQ ID NO: 1924017 - protein, 6 aa, Staphylococcus
AKGKTV

SEQ ID NO: 1924018 - protein, 16 aa, Staphylococcus
AKGLPGAAERDDAISK

SEQ ID NO: 1924019 - protein, 12 aa, Staphylococcus
AKGLTSDDITEQ

SEQ ID NO: 1924020 - protein, 13 aa, Staphylococcus
AKGMEDGEYDLGG

SEQ ID NO: 1924021 - protein, 13 aa, Staphylococcus
AKGMKDGEYDLGG

SEQ ID NO: 1924022 - protein, 13 aa, Staphylococcus
AKGMPDGEYDLGG

SEQ ID NO: 1924023 - protein, 14 aa, Staphylococcus
AKGMPDGEYDLGGQ

SEQ ID NO: 1924024 - protein, 13 aa, Staphylococcus
AKGMPEGEYDLGG

SEQ ID NO: 1924025 - protein, 14 aa, Staphylococcus
AKGMPESEYDLGGQ

SEQ ID NO: 1924026 - protein, 13 aa, Staphylococcus
AKGMSDGEYDLGG

SEQ ID NO: 1924027 - protein, 16 aa, Staphylococcus
AKGNKEDVDKAVDAAN

SEQ ID NO: 1924028 - protein, 16 aa, Staphylococcus
AKGNLNKSSKVADSQT

SEQ ID NO: 1924029 - protein, 16 aa, Staphylococcus
AKGNNEDVNKAVQAAD

SEQ ID NO: 1924030 - protein, 8 aa, Staphylococcus
AKGNPIHN

SEQ ID NO: 1924031 - protein, 13 aa, Staphylococcus
AKGNQQWRTLNNN

SEQ ID NO: 1924032 - protein, 9 aa, Staphylococcus
AKGNRNNSL

SEQ ID NO: 1924033 - protein, 56 aa, Staphylococcus
AKGNVKETVGNATDNKDLEKEGKADKTSGKMNEKIDEVADKAKGFTDKLKDKFNKD

SEQ ID NO: 1924034 - protein, 9 aa, Staphylococcus
AKGPGSYTG

SEQ ID NO: 1924035 - protein, 10 aa, Staphylococcus
AKGPSQGRTF

SEQ ID NO: 1924036 - protein, 7 aa, Staphylococcus
AKGQDTL

SEQ ID NO: 1924037 - protein, 5 aa, Staphylococcus
AKGQN

SEQ ID NO: 1924038 - protein, 13 aa, Staphylococcus
AKGQPSGKFTDEK

SEQ ID NO: 1924039 - protein, 15 aa, Staphylococcus
AKGQPTGSLKDEKSS

SEQ ID NO: 1924040 - protein, 16 aa, Staphylococcus
AKGQTTIENAAKEPEV

SEQ ID NO: 1924041 - protein, 7 aa, Staphylococcus
AKGRGAK

SEQ ID NO: 1924042 - protein, 6 aa, Staphylococcus
AKGRSI

SEQ ID NO: 1924043 - protein, 7 aa, Staphylococcus
AKGRSIY

SEQ ID NO: 1924044 - protein, 6 aa, Staphylococcus
AKGSGM

SEQ ID NO: 1924045 - protein, 13 aa, Staphylococcus
AKGSPSNEYQDEK

SEQ ID NO: 1924046 - protein, 4 aa, Staphylococcus
AKGV

SEQ ID NO: 1924047 - protein, 5 aa, Staphylococcus
AKGVD

SEQ ID NO: 1924048 - protein, 6 aa, Staphylococcus
AKGVGG

SEQ ID NO: 1924049 - protein, 7 aa, Staphylococcus
AKGVGGL

SEQ ID NO: 1924050 - protein, 13 aa, Staphylococcus
AKGVSKANDITNT

SEQ ID NO: 1924051 - protein, 12 aa, Staphylococcus
AKGVSKANDVSD

SEQ ID NO: 1924052 - protein, 13 aa, Staphylococcus
AKGVSKANDVTDT

SEQ ID NO: 1924053 - protein, 13 aa, Staphylococcus
AKGVSKANESTDV

SEQ ID NO: 1924054 - protein, 12 aa, Staphylococcus
AKGVSKANEVSE

SEQ ID NO: 1924055 - protein, 9 aa, Staphylococcus
AKGVSPLES

SEQ ID NO: 1924056 - protein, 10 aa, Staphylococcus
AKGYPPSVRE

SEQ ID NO: 1924057 - protein, 6 aa, Staphylococcus
AKHAEQ

SEQ ID NO: 1924058 - protein, 8 aa, Staphylococcus
AKHAGPEV

SEQ ID NO: 1924059 - protein, 10 aa, Staphylococcus
AKHARAKVKN

SEQ ID NO: 1924060 - protein, 8 aa, Staphylococcus
AKHENNRY

SEQ ID NO: 1924061 - protein, 6 aa, Staphylococcus
AKHENV

SEQ ID NO: 1924062 - protein, 10 aa, Staphylococcus
AKHGKGLKQV

SEQ ID NO: 1924063 - protein, 33 aa, Staphylococcus
AKHGKGLKQVEQTAIKATKEKFEKEKQKGLTPR

SEQ ID NO: 1924064 - protein, 33 aa, Staphylococcus
AKHGKNLKDVEKAAIQATKEKFEREKAKGLRPR

SEQ ID NO: 1924065 - protein, 11 aa, Staphylococcus
AKHGKNLKGVE

SEQ ID NO: 1924066 - protein, 34 aa, Staphylococcus
AKHGKNLKGVENAAIEATKEKFEKEKAKGLKPRA

SEQ ID NO: 1924067 - protein, 12 aa, Staphylococcus
AKHGKNLKGVET

SEQ ID NO: 1924068 - protein, 34 aa, Staphylococcus
AKHGKNLKNVEAEAIKATKEKFEREKEKGLKPRA

SEQ ID NO: 1924069 - protein, 33 aa, Staphylococcus
AKHGMESTKDIVSNKGRSKRLGYRSQGHVDPGA

SEQ ID NO: 1924070 - protein, 8 aa, Staphylococcus
AKHIQSNS

SEQ ID NO: 1924071 - protein, 9 aa, Staphylococcus
AKHNDSSEY

SEQ ID NO: 1924072 - protein, 6 aa, Staphylococcus
AKHPDY

SEQ ID NO: 1924073 - protein, 13 aa, Staphylococcus
AKHPSNNLSQSYI

SEQ ID NO: 1924074 - protein, 8 aa, Staphylococcus
AKHQREVT

SEQ ID NO: 1924075 - protein, 6 aa, Staphylococcus
AKHRQY

SEQ ID NO: 1924076 - protein, 10 aa, Staphylococcus
AKHSDAQQDD

SEQ ID NO: 1924077 - protein, 13 aa, Staphylococcus
AKHTDQSQESIST

SEQ ID NO: 1924078 - protein, 7 aa, Staphylococcus
AKHTIAG

SEQ ID NO: 1924079 - protein, 6 aa, Staphylococcus
AKHTKS

SEQ ID NO: 1924080 - protein, 12 aa, Staphylococcus
AKIDESSPTSMK

SEQ ID NO: 1924081 - protein, 13 aa, Staphylococcus
AKIDESSSTSMKI

SEQ ID NO: 1924082 - protein, 7 aa, Staphylococcus
AKIDSED

SEQ ID NO: 1924083 - protein, 4 aa, Staphylococcus
AKIE

SEQ ID NO: 1924084 - protein, 6 aa, Staphylococcus
AKIEGD

SEQ ID NO: 1924085 - protein, 7 aa, Staphylococcus
AKIEGEL

SEQ ID NO: 1924086 - protein, 18 aa, Staphylococcus
AKIEKAKRIKSKLEDLKK

SEQ ID NO: 1924087 - protein, 14 aa, Staphylococcus
AKIESLETTNASYI

SEQ ID NO: 1924088 - protein, 5 aa, Staphylococcus
AKIGT

SEQ ID NO: 1924089 - protein, 7 aa, Staphylococcus
AKIKESN

SEQ ID NO: 1924090 - protein, 10 aa, Staphylococcus
AKINKTTEKI

SEQ ID NO: 1924091 - protein, 4 aa, Staphylococcus
AKIS

SEQ ID NO: 1924092 - protein, 8 aa, Staphylococcus
AKITPDGS

SEQ ID NO: 1924093 - protein, 8 aa, Staphylococcus
AKITPNTS

SEQ ID NO: 1924094 - protein, 11 aa, Staphylococcus
AKITSNDKGVN

SEQ ID NO: 1924095 - protein, 13 aa, Staphylococcus
AKKAADEIGATSH

SEQ ID NO: 1924096 - protein, 5 aa, Staphylococcus
AKKAE

SEQ ID NO: 1924097 - protein, 8 aa, Staphylococcus
AKKAGAET

SEQ ID NO: 1924098 - protein, 9 aa, Staphylococcus
AKKAGIPEH

SEQ ID NO: 1924099 - protein, 10 aa, Staphylococcus
AKKAKSGFQA

SEQ ID NO: 1924100 - protein, 12 aa, Staphylococcus
AKKAPDAKIKGD

SEQ ID NO: 1924101 - protein, 11 aa, Staphylococcus
AKKAYKLSPEV

SEQ ID NO: 1924102 - protein, 7 aa, Staphylococcus
AKKDGQW

SEQ ID NO: 1924103 - protein, 7 aa, Staphylococcus
AKKDGYT

SEQ ID NO: 1924104 - protein, 8 aa, Staphylococcus
AKKDYASD

SEQ ID NO: 1924105 - protein, 10 aa, Staphylococcus
AKKEAANRRD

SEQ ID NO: 1924106 - protein, 8 aa, Staphylococcus
AKKEALPD

SEQ ID NO: 1924107 - protein, 10 aa, Staphylococcus
AKKEEEEEYY

SEQ ID NO: 1924108 - protein, 9 aa, Staphylococcus
AKKEEEFND

SEQ ID NO: 1924109 - protein, 7 aa, Staphylococcus
AKKEELV

SEQ ID NO: 1924110 - protein, 7 aa, Staphylococcus
AKKEIPK

SEQ ID NO: 1924111 - protein, 8 aa, Staphylococcus
AKKESGEV

SEQ ID NO: 1924112 - protein, 5 aa, Staphylococcus
AKKFT

SEQ ID NO: 1924113 - protein, 18 aa, Staphylococcus
AKKGENGQSSNMHGRGAD

SEQ ID NO: 1924114 - protein, 17 aa, Staphylococcus
AKKGENGQSSNMHGRNA

SEQ ID NO: 1924115 - protein, 18 aa, Staphylococcus
AKKGENGQSSNMHGRNTE

SEQ ID NO: 1924116 - protein, 7 aa, Staphylococcus
AKKGLRD

SEQ ID NO: 1924117 - protein, 16 aa, Staphylococcus
AKKHPEMKDYSDEERL

SEQ ID NO: 1924118 - protein, 12 aa, Staphylococcus
AKKKEEAQTERL

SEQ ID NO: 1924119 - protein, 10 aa, Staphylococcus
AKKKLKNGDL

SEQ ID NO: 1924120 - protein, 7 aa, Staphylococcus
AKKKVPK

SEQ ID NO: 1924121 - protein, 18 aa, Staphylococcus
AKKLSARLDGPIEENLPD

SEQ ID NO: 1924122 - protein, 10 aa, Staphylococcus
AKKMSGKELR

SEQ ID NO: 1924123 - protein, 9 aa, Staphylococcus
AKKNDKKSL

SEQ ID NO: 1924124 - protein, 6 aa, Staphylococcus
AKKNFS

SEQ ID NO: 1924125 - protein, 11 aa, Staphylococcus
AKKNKKKNHIE

SEQ ID NO: 1924126 - protein, 8 aa, Staphylococcus
AKKNNATV

SEQ ID NO: 1924127 - protein, 7 aa, Staphylococcus
AKKNSVC

SEQ ID NO: 1924128 - protein, 7 aa, Staphylococcus
AKKNVKA

SEQ ID NO: 1924129 - protein, 7 aa, Staphylococcus
AKKPVVE

SEQ ID NO: 1924130 - protein, 7 aa, Staphylococcus
AKKQGIT

SEQ ID NO: 1924131 - protein, 6 aa, Staphylococcus
AKKQVT

SEQ ID NO: 1924132 - protein, 7 aa, Staphylococcus
AKKRKEL

SEQ ID NO: 1924133 - protein, 10 aa, Staphylococcus
AKKRTKSIAY

SEQ ID NO: 1924134 - protein, 11 aa, Staphylococcus
AKKSKSGLQAN

SEQ ID NO: 1924135 - protein, 11 aa, Staphylococcus
AKKSKTGLQAN

SEQ ID NO: 1924136 - protein, 7 aa, Staphylococcus
AKKSTPL

SEQ ID NO: 1924137 - protein, 12 aa, Staphylococcus
AKKTFEAIKNEE

SEQ ID NO: 1924138 - protein, 9 aa, Staphylococcus
AKKTPTKSG

SEQ ID NO: 1924139 - protein, 7 aa, Staphylococcus
AKKTPYL

SEQ ID NO: 1924140 - protein, 10 aa, Staphylococcus
AKKVKSGLQA

SEQ ID NO: 1924141 - protein, 7 aa, Staphylococcus
AKKVNPK

SEQ ID NO: 1924142 - protein, 7 aa, Staphylococcus
AKKYGLE

SEQ ID NO: 1924143 - protein, 8 aa, Staphylococcus
AKLASPDK

SEQ ID NO: 1924144 - protein, 5 aa, Staphylococcus
AKLDR

SEQ ID NO: 1924145 - protein, 15 aa, Staphylococcus
AKLEESGIVDGTEEI

SEQ ID NO: 1924146 - protein, 35 aa, Staphylococcus
AKLEESPNSKKTKSKLNQLKQQEASNNRKINETKD

SEQ ID NO: 1924147 - protein, 18 aa, Staphylococcus
AKLEGTKQILDTKGPKAV

SEQ ID NO: 1924148 - protein, 6 aa, Staphylococcus
AKLEPH

SEQ ID NO: 1924149 - protein, 6 aa, Staphylococcus
AKLESS

SEQ ID NO: 1924150 - protein, 10 aa, Staphylococcus
AKLGNSQGKY

SEQ ID NO: 1924151 - protein, 10 aa, Staphylococcus
AKLINKSKKP

SEQ ID NO: 1924152 - protein, 9 aa, Staphylococcus
AKLKSNADI

SEQ ID NO: 1924153 - protein, 9 aa, Staphylococcus
AKLRGEHSE

SEQ ID NO: 1924154 - protein, 8 aa, Staphylococcus
AKLTQASF

SEQ ID NO: 1924155 - protein, 10 aa, Staphylococcus
AKMGPSSDPM

SEQ ID NO: 1924156 - protein, 13 aa, Staphylococcus
AKMKGTDSDDNLN

SEQ ID NO: 1924157 - protein, 19 aa, Staphylococcus
AKMNKDQKAEYEREKMEKE

SEQ ID NO: 1924158 - protein, 8 aa, Staphylococcus
AKNASTEL

SEQ ID NO: 1924159 - protein, 4 aa, Staphylococcus
AKND

SEQ ID NO: 1924160 - protein, 5 aa, Staphylococcus
AKNDE

SEQ ID NO: 1924161 - protein, 10 aa, Staphylococcus
AKNDKNFQPM

SEQ ID NO: 1924162 - protein, 8 aa, Staphylococcus
AKNDNLQG

SEQ ID NO: 1924163 - protein, 6 aa, Staphylococcus
AKNEGQ

SEQ ID NO: 1924164 - protein, 8 aa, Staphylococcus
AKNEGVTE

SEQ ID NO: 1924165 - protein, 6 aa, Staphylococcus
AKNGDI

SEQ ID NO: 1924166 - protein, 10 aa, Staphylococcus
AKNGDSVAQS

SEQ ID NO: 1924167 - protein, 6 aa, Staphylococcus
AKNGEI

SEQ ID NO: 1924168 - protein, 16 aa, Staphylococcus
AKNGERAVEKLYQIFD

SEQ ID NO: 1924169 - protein, 9 aa, Staphylococcus
AKNGRIEEG

SEQ ID NO: 1924170 - protein, 6 aa, Staphylococcus
AKNGSI

SEQ ID NO: 1924171 - protein, 15 aa, Staphylococcus
AKNHGMTELPNHDER

SEQ ID NO: 1924172 - protein, 7 aa, Staphylococcus
AKNHNQK

SEQ ID NO: 1924173 - protein, 18 aa, Staphylococcus
AKNISKNYAKPASTPFND

SEQ ID NO: 1924174 - protein, 10 aa, Staphylococcus
AKNITKRTAV

SEQ ID NO: 1924175 - protein, 8 aa, Staphylococcus
AKNITQES

SEQ ID NO: 1924176 - protein, 4 aa, Staphylococcus
AKNK

SEQ ID NO: 1924177 - protein, 8 aa, Staphylococcus
AKNKANQM

SEQ ID NO: 1924178 - protein, 8 aa, Staphylococcus
AKNKDIAK

SEQ ID NO: 1924179 - protein, 8 aa, Staphylococcus
AKNKEIAQ

SEQ ID NO: 1924180 - protein, 8 aa, Staphylococcus
AKNKRAGA

SEQ ID NO: 1924181 - protein, 8 aa, Staphylococcus
AKNLSDRA

SEQ ID NO: 1924182 - protein, 10 aa, Staphylococcus
AKNNAYRKAT

SEQ ID NO: 1924183 - protein, 19 aa, Staphylococcus
AKNNDEDGVIQTLNLLLGF

SEQ ID NO: 1924184 - protein, 8 aa, Staphylococcus
AKNNDKKS

SEQ ID NO: 1924185 - protein, 8 aa, Staphylococcus
AKNNDRKS

SEQ ID NO: 1924186 - protein, 9 aa, Staphylococcus
AKNNDYPLP

SEQ ID NO: 1924187 - protein, 7 aa, Staphylococcus
AKNNEDL

SEQ ID NO: 1924188 - protein, 7 aa, Staphylococcus
AKNNNPY

SEQ ID NO: 1924189 - protein, 11 aa, Staphylococcus
AKNNQDQSQFL

SEQ ID NO: 1924190 - protein, 7 aa, Staphylococcus
AKNPDES

SEQ ID NO: 1924191 - protein, 10 aa, Staphylococcus
AKNPEFQGEK

SEQ ID NO: 1924192 - protein, 6 aa, Staphylococcus
AKNPSI

SEQ ID NO: 1924193 - protein, 15 aa, Staphylococcus
AKNPSILASKDAKEV

SEQ ID NO: 1924194 - protein, 6 aa, Staphylococcus
AKNPVV

SEQ ID NO: 1924195 - protein, 7 aa, Staphylococcus
AKNQELN

SEQ ID NO: 1924196 - protein, 12 aa, Staphylococcus
AKNQTQVNEKIR

SEQ ID NO: 1924197 - protein, 14 aa, Staphylococcus
AKNRDNVPFTAPAE

SEQ ID NO: 1924198 - protein, 7 aa, Staphylococcus
AKNTNDD

SEQ ID NO: 1924199 - protein, 4 aa, Staphylococcus
AKNV

SEQ ID NO: 1924200 - protein, 15 aa, Staphylococcus
AKNVTMRNDPDGRSR

SEQ ID NO: 1924201 - protein, 15 aa, Staphylococcus
AKNVTTRNDPDGRSR

SEQ ID NO: 1924202 - protein, 8 aa, Staphylococcus
AKPADRRQ

SEQ ID NO: 1924203 - protein, 15 aa, Staphylococcus
AKPDHVEFDNNHWLQ

SEQ ID NO: 1924204 - protein, 12 aa, Staphylococcus
AKPEDNLSTKDF

SEQ ID NO: 1924205 - protein, 6 aa, Staphylococcus
AKPEEI

SEQ ID NO: 1924206 - protein, 7 aa, Staphylococcus
AKPEEVI

SEQ ID NO: 1924207 - protein, 8 aa, Staphylococcus
AKPEFEDV

SEQ ID NO: 1924208 - protein, 8 aa, Staphylococcus
AKPEGMDS

SEQ ID NO: 1924209 - protein, 8 aa, Staphylococcus
AKPETSSF

SEQ ID NO: 1924210 - protein, 9 aa, Staphylococcus
AKPETVQNV

SEQ ID NO: 1924211 - protein, 4 aa, Staphylococcus
AKPF

SEQ ID NO: 1924212 - protein, 4 aa, Staphylococcus
AKPG

SEQ ID NO: 1924213 - protein, 5 aa, Staphylococcus
AKPGF

SEQ ID NO: 1924214 - protein, 11 aa, Staphylococcus
AKPGSIGPIQE

SEQ ID NO: 1924215 - protein, 9 aa, Staphylococcus
AKPGSLGPV

SEQ ID NO: 1924216 - protein, 5 aa, Staphylococcus
AKPGT

SEQ ID NO: 1924217 - protein, 13 aa, Staphylococcus
AKPKEEIAAEAET

SEQ ID NO: 1924218 - protein, 7 aa, Staphylococcus
AKPKVTQ

SEQ ID NO: 1924219 - protein, 4 aa, Staphylococcus
AKPN

SEQ ID NO: 1924220 - protein, 9 aa, Staphylococcus
AKPNRLHQE

SEQ ID NO: 1924221 - protein, 5 aa, Staphylococcus
AKPNT

SEQ ID NO: 1924222 - protein, 16 aa, Staphylococcus
AKPQDMEHFNHKSWLQ

SEQ ID NO: 1924223 - protein, 6 aa, Staphylococcus
AKPSGI

SEQ ID NO: 1924224 - protein, 10 aa, Staphylococcus
AKPSKAAHPN

SEQ ID NO: 1924225 - protein, 14 aa, Staphylococcus
AKPSKLEEGSKEIE

SEQ ID NO: 1924226 - protein, 10 aa, Staphylococcus
AKPSNLAKNG

SEQ ID NO: 1924227 - protein, 4 aa, Staphylococcus
AKPT

SEQ ID NO: 1924228 - protein, 9 aa, Staphylococcus
AKQAGISRQ

SEQ ID NO: 1924229 - protein, 6 aa, Staphylococcus
AKQAIA

SEQ ID NO: 1924230 - protein, 8 aa, Staphylococcus
AKQAIASM

SEQ ID NO: 1924231 - protein, 12 aa, Staphylococcus
AKQAIASMSQAQ

SEQ ID NO: 1924232 - protein, 6 aa, Staphylococcus
AKQANG

SEQ ID NO: 1924233 - protein, 9 aa, Staphylococcus
AKQDGDTLA

SEQ ID NO: 1924234 - protein, 16 aa, Staphylococcus
AKQDNNIEDTKEPATE

SEQ ID NO: 1924235 - protein, 4 aa, Staphylococcus
AKQE

SEQ ID NO: 1924236 - protein, 12 aa, Staphylococcus
AKQEASGGESFK

SEQ ID NO: 1924237 - protein, 8 aa, Staphylococcus
AKQEGHEE

SEQ ID NO: 1924238 - protein, 6 aa, Staphylococcus
AKQELN

SEQ ID NO: 1924239 - protein, 7 aa, Staphylococcus
AKQFPDQ

SEQ ID NO: 1924240 - protein, 6 aa, Staphylococcus
AKQGTT

SEQ ID NO: 1924241 - protein, 51 aa, Staphylococcus
AKQIGVGPQQNGFPKERQRTKQVGVGPQQNGFPKERQRTKQVGVGPQQREF

SEQ ID NO: 1924242 - protein, 7 aa, Staphylococcus
AKQIKPE

SEQ ID NO: 1924243 - protein, 5 aa, Staphylococcus
AKQKA

SEQ ID NO: 1924244 - protein, 10 aa, Staphylococcus
AKQKADELGA

SEQ ID NO: 1924245 - protein, 8 aa, Staphylococcus
AKQNGYDE

SEQ ID NO: 1924246 - protein, 10 aa, Staphylococcus
AKQNGYNEQI

SEQ ID NO: 1924247 - protein, 7 aa, Staphylococcus
AKQNKNI

SEQ ID NO: 1924248 - protein, 9 aa, Staphylococcus
AKQQAEQGN

SEQ ID NO: 1924249 - protein, 6 aa, Staphylococcus
AKQQAV

SEQ ID NO: 1924250 - protein, 7 aa, Staphylococcus
AKQQNTI

SEQ ID NO: 1924251 - protein, 8 aa, Staphylococcus
AKQQPTTL

SEQ ID NO: 1924252 - protein, 7 aa, Staphylococcus
AKQQQTI

SEQ ID NO: 1924253 - protein, 14 aa, Staphylococcus
AKQRGENITKSFEP

SEQ ID NO: 1924254 - protein, 10 aa, Staphylococcus
AKQRGGHHNG

SEQ ID NO: 1924255 - protein, 9 aa, Staphylococcus
AKQRKPEAL

SEQ ID NO: 1924256 - protein, 13 aa, Staphylococcus
AKQSGQDISNDFE

SEQ ID NO: 1924257 - protein, 8 aa, Staphylococcus
AKQSIEDG

SEQ ID NO: 1924258 - protein, 14 aa, Staphylococcus
AKQSIENGETFKGQ

SEQ ID NO: 1924259 - protein, 8 aa, Staphylococcus
AKQSQMNG

SEQ ID NO: 1924260 - protein, 15 aa, Staphylococcus
AKQSTSNYKAKQKRL

SEQ ID NO: 1924261 - protein, 12 aa, Staphylococcus
AKQTFKSLKNEE

SEQ ID NO: 1924262 - protein, 8 aa, Staphylococcus
AKQTVGIG

SEQ ID NO: 1924263 - protein, 14 aa, Staphylococcus
AKQVPAKELIFEKF

SEQ ID NO: 1924264 - protein, 4 aa, Staphylococcus
AKQW

SEQ ID NO: 1924265 - protein, 13 aa, Staphylococcus
AKQYGEKGLPEDT

SEQ ID NO: 1924266 - protein, 12 aa, Staphylococcus
AKQYNVSRSPVR

SEQ ID NO: 1924267 - protein, 8 aa, Staphylococcus
AKRAATKN

SEQ ID NO: 1924268 - protein, 11 aa, Staphylococcus
AKRAATRENRV

SEQ ID NO: 1924269 - protein, 11 aa, Staphylococcus
AKRADTRQKRV

SEQ ID NO: 1924270 - protein, 7 aa, Staphylococcus
AKRAGQS

SEQ ID NO: 1924271 - protein, 8 aa, Staphylococcus
AKRAQRGI

SEQ ID NO: 1924272 - protein, 12 aa, Staphylococcus
AKRASTRQNRVD

SEQ ID NO: 1924273 - protein, 8 aa, Staphylococcus
AKRAYPNR

SEQ ID NO: 1924274 - protein, 10 aa, Staphylococcus
AKREELEASL

SEQ ID NO: 1924275 - protein, 8 aa, Staphylococcus
AKREEMGA

SEQ ID NO: 1924276 - protein, 8 aa, Staphylococcus
AKRESEFN

SEQ ID NO: 1924277 - protein, 7 aa, Staphylococcus
AKRESLA

SEQ ID NO: 1924278 - protein, 17 aa, Staphylococcus
AKRGDGGQSSNMHGKNA

SEQ ID NO: 1924279 - protein, 7 aa, Staphylococcus
AKRGIHR

SEQ ID NO: 1924280 - protein, 11 aa, Staphylococcus
AKRGKVELNEK

SEQ ID NO: 1924281 - protein, 6 aa, Staphylococcus
AKRGTN

SEQ ID NO: 1924282 - protein, 5 aa, Staphylococcus
AKRHD

SEQ ID NO: 1924283 - protein, 7 aa, Staphylococcus
AKRHGYE

SEQ ID NO: 1924284 - protein, 6 aa, Staphylococcus
AKRISE

SEQ ID NO: 1924285 - protein, 20 aa, Staphylococcus
AKRKESAEVFKDSKDESKIE

SEQ ID NO: 1924286 - protein, 20 aa, Staphylococcus
AKRKGTKDSNSEEDNSSKKI

SEQ ID NO: 1924287 - protein, 4 aa, Staphylococcus
AKRM

SEQ ID NO: 1924288 - protein, 6 aa, Staphylococcus
AKRNFS

SEQ ID NO: 1924289 - protein, 8 aa, Staphylococcus
AKRNPRDI

SEQ ID NO: 1924290 - protein, 6 aa, Staphylococcus
AKRNRN

SEQ ID NO: 1924291 - protein, 7 aa, Staphylococcus
AKRNRSF

SEQ ID NO: 1924292 - protein, 8 aa, Staphylococcus
AKRNRSFE

SEQ ID NO: 1924293 - protein, 7 aa, Staphylococcus
AKRPIKI

SEQ ID NO: 1924294 - protein, 6 aa, Staphylococcus
AKRQGF

SEQ ID NO: 1924295 - protein, 12 aa, Staphylococcus
AKRRANSAGLQV

SEQ ID NO: 1924296 - protein, 11 aa, Staphylococcus
AKRRGGQHNGN

SEQ ID NO: 1924297 - protein, 20 aa, Staphylococcus
AKRRKDEENSNVQVRDDNKI

SEQ ID NO: 1924298 - protein, 13 aa, Staphylococcus
AKRSQDPLTSEER

SEQ ID NO: 1924299 - protein, 11 aa, Staphylococcus
AKRSQTRHNRV

SEQ ID NO: 1924300 - protein, 8 aa, Staphylococcus
AKRSQTRI

SEQ ID NO: 1924301 - protein, 11 aa, Staphylococcus
AKRSQTRQSRV

SEQ ID NO: 1924302 - protein, 10 aa, Staphylococcus
AKRSRGTPRI

SEQ ID NO: 1924303 - protein, 7 aa, Staphylococcus
AKRVNSN

SEQ ID NO: 1924304 - protein, 6 aa, Staphylococcus
AKRVYG

SEQ ID NO: 1924305 - protein, 7 aa, Staphylococcus
AKRYRER

SEQ ID NO: 1924306 - protein, 8 aa, Staphylococcus
AKRYRERL

SEQ ID NO: 1924307 - protein, 15 aa, Staphylococcus
AKSADEIKQVFEEAD

SEQ ID NO: 1924308 - protein, 15 aa, Staphylococcus
AKSAEEIKQVFEEAD

SEQ ID NO: 1924309 - protein, 11 aa, Staphylococcus
AKSAEETADGV

SEQ ID NO: 1924310 - protein, 11 aa, Staphylococcus
AKSAEETDNGV

SEQ ID NO: 1924311 - protein, 12 aa, Staphylococcus
AKSAEETDNGVK

SEQ ID NO: 1924312 - protein, 11 aa, Staphylococcus
AKSAEETENGV

SEQ ID NO: 1924313 - protein, 7 aa, Staphylococcus
AKSDIGT

SEQ ID NO: 1924314 - protein, 7 aa, Staphylococcus
AKSEAPI

SEQ ID NO: 1924315 - protein, 8 aa, Staphylococcus
AKSEIKTA

SEQ ID NO: 1924316 - protein, 8 aa, Staphylococcus
AKSEQDVE

SEQ ID NO: 1924317 - protein, 8 aa, Staphylococcus
AKSEYASD

SEQ ID NO: 1924318 - protein, 5 aa, Staphylococcus
AKSFD

SEQ ID NO: 1924319 - protein, 6 aa, Staphylococcus
AKSFNM

SEQ ID NO: 1924320 - protein, 13 aa, Staphylococcus
AKSGEPDPNSNQA

SEQ ID NO: 1924321 - protein, 8 aa, Staphylococcus
AKSGETRE

SEQ ID NO: 1924322 - protein, 6 aa, Staphylococcus
AKSGFN

SEQ ID NO: 1924323 - protein, 8 aa, Staphylococcus
AKSGLERI

SEQ ID NO: 1924324 - protein, 9 aa, Staphylococcus
AKSGLERVR

SEQ ID NO: 1924325 - protein, 8 aa, Staphylococcus
AKSGQIPE

SEQ ID NO: 1924326 - protein, 9 aa, Staphylococcus
AKSGQLATF

SEQ ID NO: 1924327 - protein, 7 aa, Staphylococcus
AKSGYLD

SEQ ID NO: 1924328 - protein, 4 aa, Staphylococcus
AKSI

SEQ ID NO: 1924329 - protein, 7 aa, Staphylococcus
AKSINAD

SEQ ID NO: 1924330 - protein, 7 aa, Staphylococcus
AKSISTS

SEQ ID NO: 1924331 - protein, 16 aa, Staphylococcus
AKSITGTVQKVNGGWY

SEQ ID NO: 1924332 - protein, 9 aa, Staphylococcus
AKSKEGKLQ

SEQ ID NO: 1924333 - protein, 6 aa, Staphylococcus
AKSKPL

SEQ ID NO: 1924334 - protein, 8 aa, Staphylococcus
AKSLGTEA

SEQ ID NO: 1924335 - protein, 8 aa, Staphylococcus
AKSLNTEA

SEQ ID NO: 1924336 - protein, 8 aa, Staphylococcus
AKSMTESI

SEQ ID NO: 1924337 - protein, 8 aa, Staphylococcus
AKSNDKKS

SEQ ID NO: 1924338 - protein, 9 aa, Staphylococcus
AKSNDKKSL

SEQ ID NO: 1924339 - protein, 7 aa, Staphylococcus
AKSNDMK

SEQ ID NO: 1924340 - protein, 26 aa, Staphylococcus
AKSNENLETPNEQIQQNEKTFSQEEV

SEQ ID NO: 1924341 - protein, 8 aa, Staphylococcus
AKSNKKIT

SEQ ID NO: 1924342 - protein, 8 aa, Staphylococcus
AKSNRNMQ

SEQ ID NO: 1924343 - protein, 8 aa, Staphylococcus
AKSNSTFV

SEQ ID NO: 1924344 - protein, 8 aa, Staphylococcus
AKSQAQTL

SEQ ID NO: 1924345 - protein, 8 aa, Staphylococcus
AKSRAEER

SEQ ID NO: 1924346 - protein, 8 aa, Staphylococcus
AKSREGKL

SEQ ID NO: 1924347 - protein, 10 aa, Staphylococcus
AKSRKEENEV

SEQ ID NO: 1924348 - protein, 8 aa, Staphylococcus
AKSRKTYH

SEQ ID NO: 1924349 - protein, 10 aa, Staphylococcus
AKSRSEEKEV

SEQ ID NO: 1924350 - protein, 20 aa, Staphylococcus
AKSSFKASRELYGKTDGNQG

SEQ ID NO: 1924351 - protein, 9 aa, Staphylococcus
AKSSLSDKS

SEQ ID NO: 1924352 - protein, 7 aa, Staphylococcus
AKSTHGT

SEQ ID NO: 1924353 - protein, 10 aa, Staphylococcus
AKSTKERKKR

SEQ ID NO: 1924354 - protein, 4 aa, Staphylococcus
AKSV

SEQ ID NO: 1924355 - protein, 21 aa, Staphylococcus
AKSVIPPINGVESSKNLYDST

SEQ ID NO: 1924356 - protein, 6 aa, Staphylococcus
AKSVLE

SEQ ID NO: 1924357 - protein, 4 aa, Staphylococcus
AKSY

SEQ ID NO: 1924358 - protein, 15 aa, Staphylococcus
AKSYEDSESKYTPAW

SEQ ID NO: 1924359 - protein, 5 aa, Staphylococcus
AKSYN

SEQ ID NO: 1924360 - protein, 9 aa, Staphylococcus
AKTAKTKLV

SEQ ID NO: 1924361 - protein, 8 aa, Staphylococcus
AKTCPHDK

SEQ ID NO: 1924362 - protein, 17 aa, Staphylococcus
AKTDDQLTSEIVKEYNV

SEQ ID NO: 1924363 - protein, 15 aa, Staphylococcus
AKTGAIHGAAEGKAV

SEQ ID NO: 1924364 - protein, 6 aa, Staphylococcus
AKTGKE

SEQ ID NO: 1924365 - protein, 8 aa, Staphylococcus
AKTGKEAD

SEQ ID NO: 1924366 - protein, 6 aa, Staphylococcus
AKTIKD

SEQ ID NO: 1924367 - protein, 5 aa, Staphylococcus
AKTMG

SEQ ID NO: 1924368 - protein, 8 aa, Staphylococcus
AKTPIASS

SEQ ID NO: 1924369 - protein, 6 aa, Staphylococcus
AKTQSL

SEQ ID NO: 1924370 - protein, 6 aa, Staphylococcus
AKTREE

SEQ ID NO: 1924371 - protein, 10 aa, Staphylococcus
AKTREEEKEV

SEQ ID NO: 1924372 - protein, 10 aa, Staphylococcus
AKTRYRSNND

SEQ ID NO: 1924373 - protein, 7 aa, Staphylococcus
AKTSFGG

SEQ ID NO: 1924374 - protein, 10 aa, Staphylococcus
AKTSKIALGT

SEQ ID NO: 1924375 - protein, 7 aa, Staphylococcus
AKTSPYE

SEQ ID NO: 1924376 - protein, 13 aa, Staphylococcus
AKTTQKTHVYIKQ

SEQ ID NO: 1924377 - protein, 7 aa, Staphylococcus
AKTTRYA

SEQ ID NO: 1924378 - protein, 6 aa, Staphylococcus
AKTYSV

SEQ ID NO: 1924379 - protein, 6 aa, Staphylococcus
AKVDEM

SEQ ID NO: 1924380 - protein, 12 aa, Staphylococcus
AKVDKSTSQALE

SEQ ID NO: 1924381 - protein, 4 aa, Staphylococcus
AKVE

SEQ ID NO: 1924382 - protein, 6 aa, Staphylococcus
AKVEDN

SEQ ID NO: 1924383 - protein, 5 aa, Staphylococcus
AKVEK

SEQ ID NO: 1924384 - protein, 16 aa, Staphylococcus
AKVGETVAKRASEKGV

SEQ ID NO: 1924385 - protein, 7 aa, Staphylococcus
AKVKSGY

SEQ ID NO: 1924386 - protein, 14 aa, Staphylococcus
AKVNALAQDKGLDL

SEQ ID NO: 1924387 - protein, 4 aa, Staphylococcus
AKVR

SEQ ID NO: 1924388 - protein, 5 aa, Staphylococcus
AKVSG

SEQ ID NO: 1924389 - protein, 8 aa, Staphylococcus
AKVTEDGQ

SEQ ID NO: 1924390 - protein, 8 aa, Staphylococcus
AKVTENGE

SEQ ID NO: 1924391 - protein, 7 aa, Staphylococcus
AKVTGHS

SEQ ID NO: 1924392 - protein, 5 aa, Staphylococcus
AKVTS

SEQ ID NO: 1924393 - protein, 11 aa, Staphylococcus
AKVTSSVTKKT

SEQ ID NO: 1924394 - protein, 11 aa, Staphylococcus
AKVTSSVTKST

SEQ ID NO: 1924395 - protein, 4 aa, Staphylococcus
AKWG

SEQ ID NO: 1924396 - protein, 7 aa, Staphylococcus
AKWGERS

SEQ ID NO: 1924397 - protein, 11 aa, Staphylococcus
AKWSNGDPVTA

SEQ ID NO: 1924398 - protein, 20 aa, Staphylococcus
AKYAYDGLTYDDEPRKGPEV

SEQ ID NO: 1924399 - protein, 12 aa, Staphylococcus
AKYDDKGEGIKY

SEQ ID NO: 1924400 - protein, 11 aa, Staphylococcus
AKYDGEGYGKF

SEQ ID NO: 1924401 - protein, 9 aa, Staphylococcus
AKYEEEQPL

SEQ ID NO: 1924402 - protein, 8 aa, Staphylococcus
AKYEEEYN

SEQ ID NO: 1924403 - protein, 5 aa, Staphylococcus
AKYGS

SEQ ID NO: 1924404 - protein, 6 aa, Staphylococcus
AKYGYD

SEQ ID NO: 1924405 - protein, 8 aa, Staphylococcus
AKYGYDSQ

SEQ ID NO: 1924406 - protein, 5 aa, Staphylococcus
AKYIT

SEQ ID NO: 1924407 - protein, 4 aa, Staphylococcus
AKYK

SEQ ID NO: 1924408 - protein, 7 aa, Staphylococcus
AKYKDGK

SEQ ID NO: 1924409 - protein, 8 aa, Staphylococcus
AKYNPKKD

SEQ ID NO: 1924410 - protein, 5 aa, Staphylococcus
AKYPA

SEQ ID NO: 1924411 - protein, 10 aa, Staphylococcus
AKYPDNTPQR

SEQ ID NO: 1924412 - protein, 8 aa, Staphylococcus
AKYRGEFE

SEQ ID NO: 1924413 - protein, 14 aa, Staphylococcus
AKYVDSAKDDKKED

SEQ ID NO: 1924414 - protein, 4 aa, Staphylococcus
ALAA

SEQ ID NO: 1924415 - protein, 6 aa, Staphylococcus
ALADEC

SEQ ID NO: 1924416 - protein, 7 aa, Staphylococcus
ALADNNF

SEQ ID NO: 1924417 - protein, 9 aa, Staphylococcus
ALAEASDIP

SEQ ID NO: 1924418 - protein, 8 aa, Staphylococcus
ALAEATTI

SEQ ID NO: 1924419 - protein, 5 aa, Staphylococcus
ALAKD

SEQ ID NO: 1924420 - protein, 6 aa, Staphylococcus
ALAKGG

SEQ ID NO: 1924421 - protein, 13 aa, Staphylococcus
ALANKKAKEEYRH

SEQ ID NO: 1924422 - protein, 7 aa, Staphylococcus
ALAQQEK

SEQ ID NO: 1924423 - protein, 8 aa, Staphylococcus
ALAQSGAK

SEQ ID NO: 1924424 - protein, 10 aa, Staphylococcus
ALATQDNNGV

SEQ ID NO: 1924425 - protein, 8 aa, Staphylococcus
ALATQDRN

SEQ ID NO: 1924426 - protein, 10 aa, Staphylococcus
ALATSSGQAA

SEQ ID NO: 1924427 - protein, 9 aa, Staphylococcus
ALATTDNNQ

SEQ ID NO: 1924428 - protein, 6 aa, Staphylococcus
ALDDDE

SEQ ID NO: 1924429 - protein, 5 aa, Staphylococcus
ALDDP

SEQ ID NO: 1924430 - protein, 6 aa, Staphylococcus
ALDDPQ

SEQ ID NO: 1924431 - protein, 5 aa, Staphylococcus
ALDDS

SEQ ID NO: 1924432 - protein, 5 aa, Staphylococcus
ALDEE

SEQ ID NO: 1924433 - protein, 9 aa, Staphylococcus
ALDEPRDAF

SEQ ID NO: 1924434 - protein, 5 aa, Staphylococcus
ALDEQ

SEQ ID NO: 1924435 - protein, 8 aa, Staphylococcus
ALDESNGL

SEQ ID NO: 1924436 - protein, 6 aa, Staphylococcus
ALDGDE

SEQ ID NO: 1924437 - protein, 9 aa, Staphylococcus
ALDKDGKQI

SEQ ID NO: 1924438 - protein, 6 aa, Staphylococcus
ALDNDA

SEQ ID NO: 1924439 - protein, 7 aa, Staphylococcus
ALDNGSK

SEQ ID NO: 1924440 - protein, 20 aa, Staphylococcus
ALDPYNGGEISPGPEVQTDE

SEQ ID NO: 1924441 - protein, 4 aa, Staphylococcus
ALDS

SEQ ID NO: 1924442 - protein, 7 aa, Staphylococcus
ALDTEGV

SEQ ID NO: 1924443 - protein, 13 aa, Staphylococcus
ALDTGNDPRAFTK

SEQ ID NO: 1924444 - protein, 14 aa, Staphylococcus
ALDTGNDPREFTKE

SEQ ID NO: 1924445 - protein, 19 aa, Staphylococcus
ALDTGNDPREFTKKNVQTF

SEQ ID NO: 1924446 - protein, 13 aa, Staphylococcus
ALDTGNDPREFTQ

SEQ ID NO: 1924447 - protein, 4 aa, Staphylococcus
ALEA

SEQ ID NO: 1924448 - protein, 10 aa, Staphylococcus
ALEADKKLDE

SEQ ID NO: 1924449 - protein, 8 aa, Staphylococcus
ALEARTGH

SEQ ID NO: 1924450 - protein, 10 aa, Staphylococcus
ALEATDGDIE

SEQ ID NO: 1924451 - protein, 10 aa, Staphylococcus
ALEDGKPVRS

SEQ ID NO: 1924452 - protein, 11 aa, Staphylococcus
ALEDPNNTHLK

SEQ ID NO: 1924453 - protein, 4 aa, Staphylococcus
ALEE

SEQ ID NO: 1924454 - protein, 7 aa, Staphylococcus
ALEESNG

SEQ ID NO: 1924455 - protein, 10 aa, Staphylococcus
ALEGDAEYEQ

SEQ ID NO: 1924456 - protein, 17 aa, Staphylococcus
ALEKDKDFGRNEDPKHQ

SEQ ID NO: 1924457 - protein, 8 aa, Staphylococcus
ALEKTSIQ

SEQ ID NO: 1924458 - protein, 9 aa, Staphylococcus
ALENENVKS

SEQ ID NO: 1924459 - protein, 7 aa, Staphylococcus
ALENGDM

SEQ ID NO: 1924460 - protein, 9 aa, Staphylococcus
ALENGDPVR

SEQ ID NO: 1924461 - protein, 7 aa, Staphylococcus
ALENGNM

SEQ ID NO: 1924462 - protein, 14 aa, Staphylococcus
ALEPGKIRNSNGPM

SEQ ID NO: 1924463 - protein, 4 aa, Staphylococcus
ALEQ

SEQ ID NO: 1924464 - protein, 7 aa, Staphylococcus
ALEQPDS

SEQ ID NO: 1924465 - protein, 5 aa, Staphylococcus
ALEQY

SEQ ID NO: 1924466 - protein, 15 aa, Staphylococcus
ALEQYSDEMTQNGKN

SEQ ID NO: 1924467 - protein, 7 aa, Staphylococcus
ALESDGV

SEQ ID NO: 1924468 - protein, 5 aa, Staphylococcus
ALESG

SEQ ID NO: 1924469 - protein, 7 aa, Staphylococcus
ALESTLN

SEQ ID NO: 1924470 - protein, 9 aa, Staphylococcus
ALETAEDGI

SEQ ID NO: 1924471 - protein, 11 aa, Staphylococcus
ALETATENERG

SEQ ID NO: 1924472 - protein, 19 aa, Staphylococcus
ALEYSEKGHVKGKVVVKVE

SEQ ID NO: 1924473 - protein, 10 aa, Staphylococcus
ALGAKKDHYP

SEQ ID NO: 1924474 - protein, 12 aa, Staphylococcus
ALGAKKEKYPID

SEQ ID NO: 1924475 - protein, 11 aa, Staphylococcus
ALGAKKERYPI

SEQ ID NO: 1924476 - protein, 19 aa, Staphylococcus
ALGAQGGMPTINDIAQDLD

SEQ ID NO: 1924477 - protein, 7 aa, Staphylococcus
ALGEDKA

SEQ ID NO: 1924478 - protein, 6 aa, Staphylococcus
ALGEPG

SEQ ID NO: 1924479 - protein, 5 aa, Staphylococcus
ALGER

SEQ ID NO: 1924480 - protein, 8 aa, Staphylococcus
ALGETDAQ

SEQ ID NO: 1924481 - protein, 12 aa, Staphylococcus
ALGETYGSDKML

SEQ ID NO: 1924482 - protein, 6 aa, Staphylococcus
ALGGES

SEQ ID NO: 1924483 - protein, 7 aa, Staphylococcus
ALGGNTA

SEQ ID NO: 1924484 - protein, 18 aa, Staphylococcus
ALGGQRQRDVAAQGGDPV

SEQ ID NO: 1924485 - protein, 7 aa, Staphylococcus
ALGGWKG

SEQ ID NO: 1924486 - protein, 4 aa, Staphylococcus
ALGK

SEQ ID NO: 1924487 - protein, 10 aa, Staphylococcus
ALGKSPEEQL

SEQ ID NO: 1924488 - protein, 9 aa, Staphylococcus
ALGNSPEEQ

SEQ ID NO: 1924489 - protein, 6 aa, Staphylococcus
ALGPYS

SEQ ID NO: 1924490 - protein, 10 aa, Staphylococcus
ALGPYSHATE

SEQ ID NO: 1924491 - protein, 7 aa, Staphylococcus
ALGRDTA

SEQ ID NO: 1924492 - protein, 6 aa, Staphylococcus
ALGSHS

SEQ ID NO: 1924493 - protein, 7 aa, Staphylococcus
ALHDPEG

SEQ ID NO: 1924494 - protein, 8 aa, Staphylococcus
ALHDPNGL

SEQ ID NO: 1924495 - protein, 6 aa, Staphylococcus
ALHPED

SEQ ID NO: 1924496 - protein, 5 aa, Staphylococcus
ALHPP

SEQ ID NO: 1924497 - protein, 4 aa, Staphylococcus
ALIP

SEQ ID NO: 1924498 - protein, 13 aa, Staphylococcus
ALKESQEKNDVDL

SEQ ID NO: 1924499 - protein, 9 aa, Staphylococcus
ALKETAKRM

SEQ ID NO: 1924500 - protein, 5 aa, Staphylococcus
ALKGA

SEQ ID NO: 1924501 - protein, 7 aa, Staphylococcus
ALKKDQV

SEQ ID NO: 1924502 - protein, 6 aa, Staphylococcus
ALKNKG

SEQ ID NO: 1924503 - protein, 8 aa, Staphylococcus
ALKNNPEL

SEQ ID NO: 1924504 - protein, 8 aa, Staphylococcus
ALKNNSEL

SEQ ID NO: 1924505 - protein, 9 aa, Staphylococcus
ALKNPTDMN

SEQ ID NO: 1924506 - protein, 8 aa, Staphylococcus
ALKQATEI

SEQ ID NO: 1924507 - protein, 23 aa, Staphylococcus
ALKQEDKANSAKAKAILEQIRQD

SEQ ID NO: 1924508 - protein, 5 aa, Staphylococcus
ALKRG

SEQ ID NO: 1924509 - protein, 21 aa, Staphylococcus
ALKTADTANMAKAKEIIADLR

SEQ ID NO: 1924510 - protein, 5 aa, Staphylococcus
ALNDD

SEQ ID NO: 1924511 - protein, 6 aa, Staphylococcus
ALNDDE

SEQ ID NO: 1924512 - protein, 8 aa, Staphylococcus
ALNDENRV

SEQ ID NO: 1924513 - protein, 6 aa, Staphylococcus
ALNDPQ

SEQ ID NO: 1924514 - protein, 19 aa, Staphylococcus
ALNDSERGLASYNPKVDED

SEQ ID NO: 1924515 - protein, 10 aa, Staphylococcus
ALNDVAPARA

SEQ ID NO: 1924516 - protein, 7 aa, Staphylococcus
ALNEDLK

SEQ ID NO: 1924517 - protein, 16 aa, Staphylococcus
ALNEEKEELEATYDTD

SEQ ID NO: 1924518 - protein, 16 aa, Staphylococcus
ALNEEQKQLNEQYETD

SEQ ID NO: 1924519 - protein, 10 aa, Staphylococcus
ALNEGKPEKI

SEQ ID NO: 1924520 - protein, 6 aa, Staphylococcus
ALNEKY

SEQ ID NO: 1924521 - protein, 11 aa, Staphylococcus
ALNENKERKLD

SEQ ID NO: 1924522 - protein, 8 aa, Staphylococcus
ALNGEDNL

SEQ ID NO: 1924523 - protein, 8 aa, Staphylococcus
ALNGTNRL

SEQ ID NO: 1924524 - protein, 4 aa, Staphylococcus
ALNK

SEQ ID NO: 1924525 - protein, 7 aa, Staphylococcus
ALNKDQV

SEQ ID NO: 1924526 - protein, 18 aa, Staphylococcus
ALNNEGKELEITQRSDLN

SEQ ID NO: 1924527 - protein, 5 aa, Staphylococcus
ALNNN

SEQ ID NO: 1924528 - protein, 7 aa, Staphylococcus
ALNPNEV

SEQ ID NO: 1924529 - protein, 12 aa, Staphylococcus
ALNPTAGKPVAV

SEQ ID NO: 1924530 - protein, 6 aa, Staphylococcus
ALNQGK

SEQ ID NO: 1924531 - protein, 7 aa, Staphylococcus
ALNQSDT

SEQ ID NO: 1924532 - protein, 5 aa, Staphylococcus
ALNSD

SEQ ID NO: 1924533 - protein, 7 aa, Staphylococcus
ALNSNDY

SEQ ID NO: 1924534 - protein, 4 aa, Staphylococcus
ALNT

SEQ ID NO: 1924535 - protein, 9 aa, Staphylococcus
ALPADTKIG

SEQ ID NO: 1924536 - protein, 7 aa, Staphylococcus
ALPAPKV

SEQ ID NO: 1924537 - protein, 9 aa, Staphylococcus
ALPDAFPVP

SEQ ID NO: 1924538 - protein, 5 aa, Staphylococcus
ALPDE

SEQ ID NO: 1924539 - protein, 12 aa, Staphylococcus
ALPDKHRWEPKS

SEQ ID NO: 1924540 - protein, 7 aa, Staphylococcus
ALPDNAR

SEQ ID NO: 1924541 - protein, 7 aa, Staphylococcus
ALPDTPD

SEQ ID NO: 1924542 - protein, 5 aa, Staphylococcus
ALPEE

SEQ ID NO: 1924543 - protein, 7 aa, Staphylococcus
ALPEGAD

SEQ ID NO: 1924544 - protein, 8 aa, Staphylococcus
ALPEGVTA

SEQ ID NO: 1924545 - protein, 5 aa, Staphylococcus
ALPEM

SEQ ID NO: 1924546 - protein, 5 aa, Staphylococcus
ALPEN

SEQ ID NO: 1924547 - protein, 6 aa, Staphylococcus
ALPENA

SEQ ID NO: 1924548 - protein, 23 aa, Staphylococcus
ALPKEEAEKLKEALEEVGATVEL

SEQ ID NO: 1924549 - protein, 16 aa, Staphylococcus
ALPKGLSARIDTTSFP

SEQ ID NO: 1924550 - protein, 10 aa, Staphylococcus
ALPTSTSNWT

SEQ ID NO: 1924551 - protein, 7 aa, Staphylococcus
ALQDESE

SEQ ID NO: 1924552 - protein, 6 aa, Staphylococcus
ALQDHS

SEQ ID NO: 1924553 - protein, 18 aa, Staphylococcus
ALQDKRQQKQHQDDDIQK

SEQ ID NO: 1924554 - protein, 10 aa, Staphylococcus
ALQDKYKGEA

SEQ ID NO: 1924555 - protein, 7 aa, Staphylococcus
ALQEAQK

SEQ ID NO: 1924556 - protein, 19 aa, Staphylococcus
ALQEKRQQNQESNEDSIQK

SEQ ID NO: 1924557 - protein, 9 aa, Staphylococcus
ALQKPTDMN

SEQ ID NO: 1924558 - protein, 10 aa, Staphylococcus
ALQNNHKPTV

SEQ ID NO: 1924559 - protein, 9 aa, Staphylococcus
ALQNPTDMN

SEQ ID NO: 1924560 - protein, 7 aa, Staphylococcus
ALQPEEI

SEQ ID NO: 1924561 - protein, 19 aa, Staphylococcus
ALQQKRHDNQDKQEDSIQK

SEQ ID NO: 1924562 - protein, 10 aa, Staphylococcus
ALQRTNQSIE

SEQ ID NO: 1924563 - protein, 14 aa, Staphylococcus
ALQSELKSPQTTFN

SEQ ID NO: 1924564 - protein, 10 aa, Staphylococcus
ALRDSEEYKA

SEQ ID NO: 1924565 - protein, 6 aa, Staphylococcus
ALREGK

SEQ ID NO: 1924566 - protein, 7 aa, Staphylococcus
ALRGENN

SEQ ID NO: 1924567 - protein, 21 aa, Staphylococcus
ALRGKEKMSAQAVGGAVGSNP

SEQ ID NO: 1924568 - protein, 5 aa, Staphylococcus
ALRGS

SEQ ID NO: 1924569 - protein, 13 aa, Staphylococcus
ALRKEAANKGNAQ

SEQ ID NO: 1924570 - protein, 16 aa, Staphylococcus
ALRNSEEYKAIKDAYD

SEQ ID NO: 1924571 - protein, 20 aa, Staphylococcus
ALRNTSYCGQSKSRHRFGEG

SEQ ID NO: 1924572 - protein, 4 aa, Staphylococcus
ALRQ

SEQ ID NO: 1924573 - protein, 5 aa, Staphylococcus
ALRQG

SEQ ID NO: 1924574 - protein, 11 aa, Staphylococcus
ALRSNARKFNG

SEQ ID NO: 1924575 - protein, 4 aa, Staphylococcus
ALSA

SEQ ID NO: 1924576 - protein, 15 aa, Staphylococcus
ALSAARPGARKETLE

SEQ ID NO: 1924577 - protein, 6 aa, Staphylococcus
ALSDDE

SEQ ID NO: 1924578 - protein, 8 aa, Staphylococcus
ALSDEKYR

SEQ ID NO: 1924579 - protein, 7 aa, Staphylococcus
ALSDELK

SEQ ID NO: 1924580 - protein, 6 aa, Staphylococcus
ALSEGK

SEQ ID NO: 1924581 - protein, 8 aa, Staphylococcus
ALSEKVEQ

SEQ ID NO: 1924582 - protein, 7 aa, Staphylococcus
ALSERKT

SEQ ID NO: 1924583 - protein, 7 aa, Staphylococcus
ALSESAL

SEQ ID NO: 1924584 - protein, 8 aa, Staphylococcus
ALSETSQY

SEQ ID NO: 1924585 - protein, 13 aa, Staphylococcus
ALSGFGKKTEENI

SEQ ID NO: 1924586 - protein, 9 aa, Staphylococcus
ALSGGQRQR

SEQ ID NO: 1924587 - protein, 5 aa, Staphylococcus
ALSGI

SEQ ID NO: 1924588 - protein, 9 aa, Staphylococcus
ALSKANKGD

SEQ ID NO: 1924589 - protein, 9 aa, Staphylococcus
ALSKDTKAD

SEQ ID NO: 1924590 - protein, 9 aa, Staphylococcus
ALSKGNQQK

SEQ ID NO: 1924591 - protein, 6 aa, Staphylococcus
ALSKQD

SEQ ID NO: 1924592 - protein, 8 aa, Staphylococcus
ALSKTTVE

SEQ ID NO: 1924593 - protein, 8 aa, Staphylococcus
ALSNEKYR

SEQ ID NO: 1924594 - protein, 7 aa, Staphylococcus
ALSNKGH

SEQ ID NO: 1924595 - protein, 9 aa, Staphylococcus
ALSNPGKYR

SEQ ID NO: 1924596 - protein, 11 aa, Staphylococcus
ALSPKVKGQLK

SEQ ID NO: 1924597 - protein, 12 aa, Staphylococcus
ALSPKVKGQLKQ

SEQ ID NO: 1924598 - protein, 11 aa, Staphylococcus
ALSPRVKARSK

SEQ ID NO: 1924599 - protein, 6 aa, Staphylococcus
ALSQGF

SEQ ID NO: 1924600 - protein, 10 aa, Staphylococcus
ALSQTAEPQR

SEQ ID NO: 1924601 - protein, 7 aa, Staphylococcus
ALSQYDK

SEQ ID NO: 1924602 - protein, 10 aa, Staphylococcus
ALSSDELREG

SEQ ID NO: 1924603 - protein, 7 aa, Staphylococcus
ALSSIKK

SEQ ID NO: 1924604 - protein, 5 aa, Staphylococcus
ALSSN

SEQ ID NO: 1924605 - protein, 5 aa, Staphylococcus
ALSSR

SEQ ID NO: 1924606 - protein, 7 aa, Staphylococcus
ALSTDEK

SEQ ID NO: 1924607 - protein, 10 aa, Staphylococcus
ALSTGDSTFA

SEQ ID NO: 1924608 - protein, 11 aa, Staphylococcus
ALTDDTKHTIK

SEQ ID NO: 1924609 - protein, 15 aa, Staphylococcus
ALTDEDASIKAKNIE

SEQ ID NO: 1924610 - protein, 7 aa, Staphylococcus
ALTDENR

SEQ ID NO: 1924611 - protein, 12 aa, Staphylococcus
ALTDQTRDTIQQ

SEQ ID NO: 1924612 - protein, 4 aa, Staphylococcus
ALTE

SEQ ID NO: 1924613 - protein, 9 aa, Staphylococcus
ALTEEKGLK

SEQ ID NO: 1924614 - protein, 11 aa, Staphylococcus
ALTETDGDIDK

SEQ ID NO: 1924615 - protein, 10 aa, Staphylococcus
ALTETDGDMD

SEQ ID NO: 1924616 - protein, 6 aa, Staphylococcus
ALTGEI

SEQ ID NO: 1924617 - protein, 10 aa, Staphylococcus
ALTNDPEVIR

SEQ ID NO: 1924618 - protein, 5 aa, Staphylococcus
ALTQA

SEQ ID NO: 1924619 - protein, 12 aa, Staphylococcus
ALTQNYETKHSK

SEQ ID NO: 1924620 - protein, 5 aa, Staphylococcus
ALTRY

SEQ ID NO: 1924621 - protein, 7 aa, Staphylococcus
ALTSGTS

SEQ ID NO: 1924622 - protein, 8 aa, Staphylococcus
ALTSTEKQ

SEQ ID NO: 1924623 - protein, 4 aa, Staphylococcus
ALTT

SEQ ID NO: 1924624 - protein, 7 aa, Staphylococcus
ALYGSTI

SEQ ID NO: 1924625 - protein, 7 aa, Staphylococcus
AMAETGD

SEQ ID NO: 1924626 - protein, 9 aa, Staphylococcus
AMDEDKRDY

SEQ ID NO: 1924627 - protein, 10 aa, Staphylococcus
AMDGVTEDVK

SEQ ID NO: 1924628 - protein, 4 aa, Staphylococcus
AMDR

SEQ ID NO: 1924629 - protein, 8 aa, Staphylococcus
AMEENNEP

SEQ ID NO: 1924630 - protein, 16 aa, Staphylococcus
AMEETGDLKVPQEEGI

SEQ ID NO: 1924631 - protein, 20 aa, Staphylococcus
AMEKGSNDRYFQEDKAPRKF

SEQ ID NO: 1924632 - protein, 21 aa, Staphylococcus
AMEKGSNDRYFQEDKSPRKFV

SEQ ID NO: 1924633 - protein, 20 aa, Staphylococcus
AMEKGSNDRYFQEDKTPRKF

SEQ ID NO: 1924634 - protein, 7 aa, Staphylococcus
AMEQANQ

SEQ ID NO: 1924635 - protein, 19 aa, Staphylococcus
AMEQRRDETNEKSEKYDEL

SEQ ID NO: 1924636 - protein, 12 aa, Staphylococcus
AMESGSNDRYFQ

SEQ ID NO: 1924637 - protein, 24 aa, Staphylococcus
AMESGSNDRYFQEDKAPKKFVPEG

SEQ ID NO: 1924638 - protein, 4 aa, Staphylococcus
AMET

SEQ ID NO: 1924639 - protein, 5 aa, Staphylococcus
AMETG

SEQ ID NO: 1924640 - protein, 10 aa, Staphylococcus
AMGKEETLST

SEQ ID NO: 1924641 - protein, 7 aa, Staphylococcus
AMGKGDK

SEQ ID NO: 1924642 - protein, 8 aa, Staphylococcus
AMGSDEQP

SEQ ID NO: 1924643 - protein, 7 aa, Staphylococcus
AMKDSES

SEQ ID NO: 1924644 - protein, 13 aa, Staphylococcus
AMKGQSAKAIARK

SEQ ID NO: 1924645 - protein, 17 aa, Staphylococcus
AMKNASNESFGYTEDEI

SEQ ID NO: 1924646 - protein, 14 aa, Staphylococcus
AMKQASDESFGYTE

SEQ ID NO: 1924647 - protein, 8 aa, Staphylococcus
AMKQEGNK

SEQ ID NO: 1924648 - protein, 9 aa, Staphylococcus
AMNARYDNG

SEQ ID NO: 1924649 - protein, 8 aa, Staphylococcus
AMNQYEGK

SEQ ID NO: 1924650 - protein, 12 aa, Staphylococcus
AMPNDTTPKSRL

SEQ ID NO: 1924651 - protein, 6 aa, Staphylococcus
AMPQTS

SEQ ID NO: 1924652 - protein, 7 aa, Staphylococcus
AMPRDKQ

SEQ ID NO: 1924653 - protein, 7 aa, Staphylococcus
AMPREKQ

SEQ ID NO: 1924654 - protein, 8 aa, Staphylococcus
AMPSQGRF

SEQ ID NO: 1924655 - protein, 12 aa, Staphylococcus
AMQAGASKQGIA

SEQ ID NO: 1924656 - protein, 7 aa, Staphylococcus
AMQPENL

SEQ ID NO: 1924657 - protein, 6 aa, Staphylococcus
AMQPQN

SEQ ID NO: 1924658 - protein, 4 aa, Staphylococcus
AMRA

SEQ ID NO: 1924659 - protein, 14 aa, Staphylococcus
AMRRKADDALEKAS

SEQ ID NO: 1924660 - protein, 15 aa, Staphylococcus
AMSAQRAVTDTTNDL

SEQ ID NO: 1924661 - protein, 14 aa, Staphylococcus
AMSATGQGKIKAGF

SEQ ID NO: 1924662 - protein, 7 aa, Staphylococcus
AMSDGAQ

SEQ ID NO: 1924663 - protein, 8 aa, Staphylococcus
AMSGQGRF

SEQ ID NO: 1924664 - protein, 8 aa, Staphylococcus
AMSGSGRF

SEQ ID NO: 1924665 - protein, 8 aa, Staphylococcus
AMSQDKPT

SEQ ID NO: 1924666 - protein, 15 aa, Staphylococcus
AMSYGSISAEAHETL

SEQ ID NO: 1924667 - protein, 11 aa, Staphylococcus
AMTDKAPENVE

SEQ ID NO: 1924668 - protein, 6 aa, Staphylococcus
AMTEQD

SEQ ID NO: 1924669 - protein, 8 aa, Staphylococcus
AMTPASDY

SEQ ID NO: 1924670 - protein, 5 aa, Staphylococcus
AMTPD

SEQ ID NO: 1924671 - protein, 8 aa, Staphylococcus
AMTPDTAT

SEQ ID NO: 1924672 - protein, 8 aa, Staphylococcus
AMTSEIEE

SEQ ID NO: 1924673 - protein, 9 aa, Staphylococcus
AMTSTGLSR

SEQ ID NO: 1924674 - protein, 11 aa, Staphylococcus
AMYHNGTEKVQ

SEQ ID NO: 1924675 - protein, 15 aa, Staphylococcus
ANAAQPILSEQDKKD

SEQ ID NO: 1924676 - protein, 12 aa, Staphylococcus
ANACTGQKGMED

SEQ ID NO: 1924677 - protein, 9 aa, Staphylococcus
ANADTKEDC

SEQ ID NO: 1924678 - protein, 7 aa, Staphylococcus
ANAFPTP

SEQ ID NO: 1924679 - protein, 10 aa, Staphylococcus
ANAGQKGSVT

SEQ ID NO: 1924680 - protein, 5 aa, Staphylococcus
ANAHS

SEQ ID NO: 1924681 - protein, 12 aa, Staphylococcus
ANAIAPGAVDTG

SEQ ID NO: 1924682 - protein, 10 aa, Staphylococcus
ANAKNGLKGT

SEQ ID NO: 1924683 - protein, 17 aa, Staphylococcus
ANAKSPDQVESFLEETF

SEQ ID NO: 1924684 - protein, 18 aa, Staphylococcus
ANAKSPEQVESFLDENLN

SEQ ID NO: 1924685 - protein, 18 aa, Staphylococcus
ANAKSPEQVESFLDETFN

SEQ ID NO: 1924686 - protein, 18 aa, Staphylococcus
ANAKSPEQVETFLAETFQ

SEQ ID NO: 1924687 - protein, 13 aa, Staphylococcus
ANAMANRSQYPNR

SEQ ID NO: 1924688 - protein, 10 aa, Staphylococcus
ANAMDGVTED

SEQ ID NO: 1924689 - protein, 7 aa, Staphylococcus
ANAPEGN

SEQ ID NO: 1924690 - protein, 7 aa, Staphylococcus
ANAPRID

SEQ ID NO: 1924691 - protein, 8 aa, Staphylococcus
ANAPRIDD

SEQ ID NO: 1924692 - protein, 15 aa, Staphylococcus
ANAPRIDDQRFDNGQ

SEQ ID NO: 1924693 - protein, 15 aa, Staphylococcus
ANAPRIDDQRFNQGK

SEQ ID NO: 1924694 - protein, 8 aa, Staphylococcus
ANAPRVDD

SEQ ID NO: 1924695 - protein, 5 aa, Staphylococcus
ANAQP

SEQ ID NO: 1924696 - protein, 7 aa, Staphylococcus
ANAQREL

SEQ ID NO: 1924697 - protein, 6 aa, Staphylococcus
ANAQSL

SEQ ID NO: 1924698 - protein, 7 aa, Staphylococcus
ANARNEH

SEQ ID NO: 1924699 - protein, 7 aa, Staphylococcus
ANASHQS

SEQ ID NO: 1924700 - protein, 5 aa, Staphylococcus
ANATD

SEQ ID NO: 1924701 - protein, 8 aa, Staphylococcus
ANATGVSK

SEQ ID NO: 1924702 - protein, 14 aa, Staphylococcus
ANATTYSNNEDGIG

SEQ ID NO: 1924703 - protein, 11 aa, Staphylococcus
ANATVDSQTDH

SEQ ID NO: 1924704 - protein, 13 aa, Staphylococcus
ANDDGEPSGTAGV

SEQ ID NO: 1924705 - protein, 6 aa, Staphylococcus
ANDDRI

SEQ ID NO: 1924706 - protein, 9 aa, Staphylococcus
ANDEDFKNE

SEQ ID NO: 1924707 - protein, 9 aa, Staphylococcus
ANDEDFRTN

SEQ ID NO: 1924708 - protein, 7 aa, Staphylococcus
ANDEGVT

SEQ ID NO: 1924709 - protein, 6 aa, Staphylococcus
ANDEIR

SEQ ID NO: 1924710 - protein, 10 aa, Staphylococcus
ANDESGTKQI

SEQ ID NO: 1924711 - protein, 7 aa, Staphylococcus
ANDESIS

SEQ ID NO: 1924712 - protein, 25 aa, Staphylococcus
ANDEVDKAPNDYANESDQYDINGVR

SEQ ID NO: 1924713 - protein, 11 aa, Staphylococcus
ANDGLKPQFEA

SEQ ID NO: 1924714 - protein, 14 aa, Staphylococcus
ANDIGTDQLKSTLS

SEQ ID NO: 1924715 - protein, 23 aa, Staphylococcus
ANDIKTDSTFKQEVENLEKEIRN

SEQ ID NO: 1924716 - protein, 7 aa, Staphylococcus
ANDIPTE

SEQ ID NO: 1924717 - protein, 6 aa, Staphylococcus
ANDKNV

SEQ ID NO: 1924718 - protein, 8 aa, Staphylococcus
ANDKSYIQ

SEQ ID NO: 1924719 - protein, 4 aa, Staphylococcus
ANDL

SEQ ID NO: 1924720 - protein, 7 aa, Staphylococcus
ANDNEEK

SEQ ID NO: 1924721 - protein, 18 aa, Staphylococcus
ANDNGAYKMSNKDFGQKM

SEQ ID NO: 1924722 - protein, 4 aa, Staphylococcus
ANDP

SEQ ID NO: 1924723 - protein, 8 aa, Staphylococcus
ANDPEEEV

SEQ ID NO: 1924724 - protein, 9 aa, Staphylococcus
ANDQTRSMG

SEQ ID NO: 1924725 - protein, 9 aa, Staphylococcus
ANDSETSIR

SEQ ID NO: 1924726 - protein, 6 aa, Staphylococcus
ANDTEF

SEQ ID NO: 1924727 - protein, 8 aa, Staphylococcus
ANDTEYGL

SEQ ID NO: 1924728 - protein, 5 aa, Staphylococcus
ANDTL

SEQ ID NO: 1924729 - protein, 6 aa, Staphylococcus
ANDTLA

SEQ ID NO: 1924730 - protein, 8 aa, Staphylococcus
ANDTTEEN

SEQ ID NO: 1924731 - protein, 10 aa, Staphylococcus
ANEAESEADF

SEQ ID NO: 1924732 - protein, 8 aa, Staphylococcus
ANEAGVAP

SEQ ID NO: 1924733 - protein, 12 aa, Staphylococcus
ANEAVKKGEQVD

SEQ ID NO: 1924734 - protein, 8 aa, Staphylococcus
ANEDGSHY

SEQ ID NO: 1924735 - protein, 12 aa, Staphylococcus
ANEDQDTSDLAY

SEQ ID NO: 1924736 - protein, 10 aa, Staphylococcus
ANEDTQEQID

SEQ ID NO: 1924737 - protein, 17 aa, Staphylococcus
ANEDTRKGVQKAIESRK

SEQ ID NO: 1924738 - protein, 17 aa, Staphylococcus
ANEDYRSQDDNQENAEN

SEQ ID NO: 1924739 - protein, 17 aa, Staphylococcus
ANEEKQQLNSENKRVIA

SEQ ID NO: 1924740 - protein, 10 aa, Staphylococcus
ANEEPPTNWE

SEQ ID NO: 1924741 - protein, 19 aa, Staphylococcus
ANEERNEGEVDEAHSRGKL

SEQ ID NO: 1924742 - protein, 11 aa, Staphylococcus
ANEEYSDQSEH

SEQ ID NO: 1924743 - protein, 4 aa, Staphylococcus
ANEG

SEQ ID NO: 1924744 - protein, 5 aa, Staphylococcus
ANEGA

SEQ ID NO: 1924745 - protein, 10 aa, Staphylococcus
ANEGDTSFVS

SEQ ID NO: 1924746 - protein, 7 aa, Staphylococcus
ANEGGDI

SEQ ID NO: 1924747 - protein, 4 aa, Staphylococcus
ANEH

SEQ ID NO: 1924748 - protein, 7 aa, Staphylococcus
ANEHEDA

SEQ ID NO: 1924749 - protein, 9 aa, Staphylococcus
ANEHEDEWK

SEQ ID NO: 1924750 - protein, 8 aa, Staphylococcus
ANEHEENW

SEQ ID NO: 1924751 - protein, 15 aa, Staphylococcus
ANEIEKNKSAQLKAD

SEQ ID NO: 1924752 - protein, 12 aa, Staphylococcus
ANEKFPSKRQLS

SEQ ID NO: 1924753 - protein, 10 aa, Staphylococcus
ANEKHEDLQP

SEQ ID NO: 1924754 - protein, 11 aa, Staphylococcus
ANEKSNPGNIN

SEQ ID NO: 1924755 - protein, 4 aa, Staphylococcus
ANEL

SEQ ID NO: 1924756 - protein, 7 aa, Staphylococcus
ANELAEQ

SEQ ID NO: 1924757 - protein, 17 aa, Staphylococcus
ANELDAEANSVDEYKEN

SEQ ID NO: 1924758 - protein, 17 aa, Staphylococcus
ANELDSDADNVEEYKEN

SEQ ID NO: 1924759 - protein, 18 aa, Staphylococcus
ANELDSDANSVDEYKENL

SEQ ID NO: 1924760 - protein, 17 aa, Staphylococcus
ANELDSEANTVDEYKEN

SEQ ID NO: 1924761 - protein, 18 aa, Staphylococcus
ANELDSNAETVDEYKENL

SEQ ID NO: 1924762 - protein, 14 aa, Staphylococcus
ANELMNKSETYMNE

SEQ ID NO: 1924763 - protein, 6 aa, Staphylococcus
ANELMT

SEQ ID NO: 1924764 - protein, 11 aa, Staphylococcus
ANEMEGTTDEV

SEQ ID NO: 1924765 - protein, 5 aa, Staphylococcus
ANEND

SEQ ID NO: 1924766 - protein, 7 aa, Staphylococcus
ANENEEK

SEQ ID NO: 1924767 - protein, 17 aa, Staphylococcus
ANENETMTTLDNTERTL

SEQ ID NO: 1924768 - protein, 4 aa, Staphylococcus
ANEP

SEQ ID NO: 1924769 - protein, 10 aa, Staphylococcus
ANEPKSTKAI

SEQ ID NO: 1924770 - protein, 5 aa, Staphylococcus
ANEPP

SEQ ID NO: 1924771 - protein, 6 aa, Staphylococcus
ANEPSV

SEQ ID NO: 1924772 - protein, 6 aa, Staphylococcus
ANEQEL

SEQ ID NO: 1924773 - protein, 5 aa, Staphylococcus
ANEQL

SEQ ID NO: 1924774 - protein, 6 aa, Staphylococcus
ANEQSQ

SEQ ID NO: 1924775 - protein, 10 aa, Staphylococcus
ANEQSYKDQG

SEQ ID NO: 1924776 - protein, 5 aa, Staphylococcus
ANERN

SEQ ID NO: 1924777 - protein, 6 aa, Staphylococcus
ANESLD

SEQ ID NO: 1924778 - protein, 6 aa, Staphylococcus
ANESLN

SEQ ID NO: 1924779 - protein, 6 aa, Staphylococcus
ANESYI

SEQ ID NO: 1924780 - protein, 5 aa, Staphylococcus
ANETH

SEQ ID NO: 1924781 - protein, 8 aa, Staphylococcus
ANETKNLD

SEQ ID NO: 1924782 - protein, 5 aa, Staphylococcus
ANETL

SEQ ID NO: 1924783 - protein, 8 aa, Staphylococcus
ANEVDKAE

SEQ ID NO: 1924784 - protein, 8 aa, Staphylococcus
ANEYDTEA

SEQ ID NO: 1924785 - protein, 8 aa, Staphylococcus
ANEYEKSI

SEQ ID NO: 1924786 - protein, 5 aa, Staphylococcus
ANEYK

SEQ ID NO: 1924787 - protein, 5 aa, Staphylococcus
ANEYN

SEQ ID NO: 1924788 - protein, 5 aa, Staphylococcus
ANEYQ

SEQ ID NO: 1924789 - protein, 5 aa, Staphylococcus
ANEYS

SEQ ID NO: 1924790 - protein, 7 aa, Staphylococcus
ANFGNSN

SEQ ID NO: 1924791 - protein, 11 aa, Staphylococcus
ANFKQNKAKIS

SEQ ID NO: 1924792 - protein, 5 aa, Staphylococcus
ANFTK

SEQ ID NO: 1924793 - protein, 14 aa, Staphylococcus
ANGGDGSGQHPTQS

SEQ ID NO: 1924794 - protein, 10 aa, Staphylococcus
ANGGEYNNAH

SEQ ID NO: 1924795 - protein, 9 aa, Staphylococcus
ANGGEYNQA

SEQ ID NO: 1924796 - protein, 5 aa, Staphylococcus
ANGHT

SEQ ID NO: 1924797 - protein, 9 aa, Staphylococcus
ANGIPTPGF

SEQ ID NO: 1924798 - protein, 23 aa, Staphylococcus
ANGKRYDKLKEEVERELLAAGYI

SEQ ID NO: 1924799 - protein, 16 aa, Staphylococcus
ANGKSVIENAAKEPEI

SEQ ID NO: 1924800 - protein, 12 aa, Staphylococcus
ANGKVFEGYANV

SEQ ID NO: 1924801 - protein, 14 aa, Staphylococcus
ANGKYKVGDKLPSL

SEQ ID NO: 1924802 - protein, 6 aa, Staphylococcus
ANGPFE

SEQ ID NO: 1924803 - protein, 7 aa, Staphylococcus
ANGPNAH

SEQ ID NO: 1924804 - protein, 8 aa, Staphylococcus
ANGPTTLE

SEQ ID NO: 1924805 - protein, 10 aa, Staphylococcus
ANGPTTPAAT

SEQ ID NO: 1924806 - protein, 11 aa, Staphylococcus
ANGPTTSEATR

SEQ ID NO: 1924807 - protein, 6 aa, Staphylococcus
ANGPVN

SEQ ID NO: 1924808 - protein, 6 aa, Staphylococcus
ANGQVK

SEQ ID NO: 1924809 - protein, 8 aa, Staphylococcus
ANGREPLM

SEQ ID NO: 1924810 - protein, 9 aa, Staphylococcus
ANGSGKSVT

SEQ ID NO: 1924811 - protein, 8 aa, Staphylococcus
ANGVGKTT

SEQ ID NO: 1924812 - protein, 12 aa, Staphylococcus
ANGVSPRPIPGV

SEQ ID NO: 1924813 - protein, 5 aa, Staphylococcus
ANGVT

SEQ ID NO: 1924814 - protein, 19 aa, Staphylococcus
ANGVTPDDADEWVGEKNGK

SEQ ID NO: 1924815 - protein, 15 aa, Staphylococcus
ANGYAISHVKMRKDL

SEQ ID NO: 1924816 - protein, 7 aa, Staphylococcus
ANHGDYG

SEQ ID NO: 1924817 - protein, 18 aa, Staphylococcus
ANHINESKKLNNASYQPK

SEQ ID NO: 1924818 - protein, 22 aa, Staphylococcus
ANHPLSQGLNTYKGHVTNKGVA

SEQ ID NO: 1924819 - protein, 18 aa, Staphylococcus
ANHSQAKAAKATQDGKFN

SEQ ID NO: 1924820 - protein, 5 aa, Staphylococcus
ANHTE

SEQ ID NO: 1924821 - protein, 12 aa, Staphylococcus
ANHTRSDETIAF

SEQ ID NO: 1924822 - protein, 4 aa, Staphylococcus
ANIA

SEQ ID NO: 1924823 - protein, 5 aa, Staphylococcus
ANIAE

SEQ ID NO: 1924824 - protein, 6 aa, Staphylococcus
ANIDAN

SEQ ID NO: 1924825 - protein, 7 aa, Staphylococcus
ANIDKND

SEQ ID NO: 1924826 - protein, 5 aa, Staphylococcus
ANIDQ

SEQ ID NO: 1924827 - protein, 6 aa, Staphylococcus
ANIDTK

SEQ ID NO: 1924828 - protein, 5 aa, Staphylococcus
ANIEP

SEQ ID NO: 1924829 - protein, 8 aa, Staphylococcus
ANIEPSDD

SEQ ID NO: 1924830 - protein, 8 aa, Staphylococcus
ANIGTPDD

SEQ ID NO: 1924831 - protein, 9 aa, Staphylococcus
ANIGTPNDL

SEQ ID NO: 1924832 - protein, 12 aa, Staphylococcus
ANIKGAGTSTLK

SEQ ID NO: 1924833 - protein, 14 aa, Staphylococcus
ANIKNAAKNVGIEK

SEQ ID NO: 1924834 - protein, 5 aa, Staphylococcus
ANIPD

SEQ ID NO: 1924835 - protein, 8 aa, Staphylococcus
ANIPTAKS

SEQ ID NO: 1924836 - protein, 7 aa, Staphylococcus
ANIQPGS

SEQ ID NO: 1924837 - protein, 7 aa, Staphylococcus
ANISEGD

SEQ ID NO: 1924838 - protein, 6 aa, Staphylococcus
ANISLD

SEQ ID NO: 1924839 - protein, 26 aa, Staphylococcus
ANKAASLTVQKPGAQASIPLASEVDN

SEQ ID NO: 1924840 - protein, 8 aa, Staphylococcus
ANKADISS

SEQ ID NO: 1924841 - protein, 26 aa, Staphylococcus
ANKAEITKDNTTVVDGDGDQNSIDAR

SEQ ID NO: 1924842 - protein, 19 aa, Staphylococcus
ANKAKKQGYTVNENPTKGS

SEQ ID NO: 1924843 - protein, 20 aa, Staphylococcus
ANKARTKKLTQADMEGGTFT

SEQ ID NO: 1924844 - protein, 6 aa, Staphylococcus
ANKAVT

SEQ ID NO: 1924845 - protein, 8 aa, Staphylococcus
ANKDEWQR

SEQ ID NO: 1924846 - protein, 5 aa, Staphylococcus
ANKDV

SEQ ID NO: 1924847 - protein, 11 aa, Staphylococcus
ANKEEAEAAGV

SEQ ID NO: 1924848 - protein, 6 aa, Staphylococcus
ANKEIT

SEQ ID NO: 1924849 - protein, 8 aa, Staphylococcus
ANKEKIQT

SEQ ID NO: 1924850 - protein, 6 aa, Staphylococcus
ANKESY

SEQ ID NO: 1924851 - protein, 5 aa, Staphylococcus
ANKGD

SEQ ID NO: 1924852 - protein, 9 aa, Staphylococcus
ANKGTSLDD

SEQ ID NO: 1924853 - protein, 8 aa, Staphylococcus
ANKGYREA

SEQ ID NO: 1924854 - protein, 16 aa, Staphylococcus
ANKHPEIKDYSDEERL

SEQ ID NO: 1924855 - protein, 7 aa, Staphylococcus
ANKHQSN

SEQ ID NO: 1924856 - protein, 4 aa, Staphylococcus
ANKK

SEQ ID NO: 1924857 - protein, 9 aa, Staphylococcus
ANKKNKPDI

SEQ ID NO: 1924858 - protein, 9 aa, Staphylococcus
ANKKRASYM

SEQ ID NO: 1924859 - protein, 5 aa, Staphylococcus
ANKLF

SEQ ID NO: 1924860 - protein, 10 aa, Staphylococcus
ANKLKNKATV

SEQ ID NO: 1924861 - protein, 10 aa, Staphylococcus
ANKLSGGQKR

SEQ ID NO: 1924862 - protein, 11 aa, Staphylococcus
ANKNAQATYDL

SEQ ID NO: 1924863 - protein, 12 aa, Staphylococcus
ANKNITKETHTS

SEQ ID NO: 1924864 - protein, 9 aa, Staphylococcus
ANKNKANDI

SEQ ID NO: 1924865 - protein, 11 aa, Staphylococcus
ANKNVTKETHA

SEQ ID NO: 1924866 - protein, 9 aa, Staphylococcus
ANKPASGTA

SEQ ID NO: 1924867 - protein, 6 aa, Staphylococcus
ANKPKW

SEQ ID NO: 1924868 - protein, 8 aa, Staphylococcus
ANKPNFDR

SEQ ID NO: 1924869 - protein, 12 aa, Staphylococcus
ANKQEKLGGSVT

SEQ ID NO: 1924870 - protein, 8 aa, Staphylococcus
ANKQGTPI

SEQ ID NO: 1924871 - protein, 23 aa, Staphylococcus
ANKQRTYKTAASKRVKKLESKGY

SEQ ID NO: 1924872 - protein, 6 aa, Staphylococcus
ANKREV

SEQ ID NO: 1924873 - protein, 5 aa, Staphylococcus
ANKRT

SEQ ID NO: 1924874 - protein, 7 aa, Staphylococcus
ANKSAQT

SEQ ID NO: 1924875 - protein, 10 aa, Staphylococcus
ANKSGISESY

SEQ ID NO: 1924876 - protein, 28 aa, Staphylococcus
ANKSSNNSENKAELKEATKKYEKYTDKQ

SEQ ID NO: 1924877 - protein, 7 aa, Staphylococcus
ANKTETH

SEQ ID NO: 1924878 - protein, 9 aa, Staphylococcus
ANKTPSTVS

SEQ ID NO: 1924879 - protein, 11 aa, Staphylococcus
ANKVDRTKHYS

SEQ ID NO: 1924880 - protein, 10 aa, Staphylococcus
ANKVDRTKYY

SEQ ID NO: 1924881 - protein, 9 aa, Staphylococcus
ANKVDRTQY

SEQ ID NO: 1924882 - protein, 5 aa, Staphylococcus
ANKVG

SEQ ID NO: 1924883 - protein, 7 aa, Staphylococcus
ANLKADN

SEQ ID NO: 1924884 - protein, 18 aa, Staphylococcus
ANLNSIEKEVYDSGFRVR

SEQ ID NO: 1924885 - protein, 5 aa, Staphylococcus
ANLRG

SEQ ID NO: 1924886 - protein, 9 aa, Staphylococcus
ANLTPNGDV

SEQ ID NO: 1924887 - protein, 5 aa, Staphylococcus
ANMKL

SEQ ID NO: 1924888 - protein, 6 aa, Staphylococcus
ANNANV

SEQ ID NO: 1924889 - protein, 19 aa, Staphylococcus
ANNASWANAHDSTKFGKQF

SEQ ID NO: 1924890 - protein, 4 aa, Staphylococcus
ANNE

SEQ ID NO: 1924891 - protein, 10 aa, Staphylococcus
ANNEEYSGET

SEQ ID NO: 1924892 - protein, 6 aa, Staphylococcus
ANNEKV

SEQ ID NO: 1924893 - protein, 20 aa, Staphylococcus
ANNESKTASSKSQGQDFTNT

SEQ ID NO: 1924894 - protein, 10 aa, Staphylococcus
ANNEVTSSYV

SEQ ID NO: 1924895 - protein, 17 aa, Staphylococcus
ANNHYQKALEKNEGNQS

SEQ ID NO: 1924896 - protein, 11 aa, Staphylococcus
ANNISKEVDGS

SEQ ID NO: 1924897 - protein, 16 aa, Staphylococcus
ANNIYTPKQQTEDNPL

SEQ ID NO: 1924898 - protein, 12 aa, Staphylococcus
ANNKKLKEIEQS

SEQ ID NO: 1924899 - protein, 12 aa, Staphylococcus
ANNPAEQPLKGY

SEQ ID NO: 1924900 - protein, 8 aa, Staphylococcus
ANNSDYGL

SEQ ID NO: 1924901 - protein, 5 aa, Staphylococcus
ANNVT

SEQ ID NO: 1924902 - protein, 14 aa, Staphylococcus
ANPAKSDEPEDIAK

SEQ ID NO: 1924903 - protein, 13 aa, Staphylococcus
ANPAKSEDAEDIA

SEQ ID NO: 1924904 - protein, 4 aa, Staphylococcus
ANPE

SEQ ID NO: 1924905 - protein, 7 aa, Staphylococcus
ANPEATR

SEQ ID NO: 1924906 - protein, 5 aa, Staphylococcus
ANPED

SEQ ID NO: 1924907 - protein, 8 aa, Staphylococcus
ANPEDEAA

SEQ ID NO: 1924908 - protein, 8 aa, Staphylococcus
ANPEEEQA

SEQ ID NO: 1924909 - protein, 7 aa, Staphylococcus
ANPENPQ

SEQ ID NO: 1924910 - protein, 7 aa, Staphylococcus
ANPERDF

SEQ ID NO: 1924911 - protein, 9 aa, Staphylococcus
ANPGSLGPI

SEQ ID NO: 1924912 - protein, 10 aa, Staphylococcus
ANPGSLGPIH

SEQ ID NO: 1924913 - protein, 10 aa, Staphylococcus
ANPGSLGPVH

SEQ ID NO: 1924914 - protein, 9 aa, Staphylococcus
ANPHKIESE

SEQ ID NO: 1924915 - protein, 10 aa, Staphylococcus
ANPKAIRETM

SEQ ID NO: 1924916 - protein, 7 aa, Staphylococcus
ANPLESY

SEQ ID NO: 1924917 - protein, 7 aa, Staphylococcus
ANPLTHK

SEQ ID NO: 1924918 - protein, 5 aa, Staphylococcus
ANPNY

SEQ ID NO: 1924919 - protein, 10 aa, Staphylococcus
ANPPGPSKTI

SEQ ID NO: 1924920 - protein, 24 aa, Staphylococcus
ANPPYSAKWSADSKFNDDERFSNY

SEQ ID NO: 1924921 - protein, 15 aa, Staphylococcus
ANPPYSAKWSSDPQF

SEQ ID NO: 1924922 - protein, 7 aa, Staphylococcus
ANPQRLD

SEQ ID NO: 1924923 - protein, 13 aa, Staphylococcus
ANPRQIERVTRGA

SEQ ID NO: 1924924 - protein, 15 aa, Staphylococcus
ANPSKSEDAEDIAKE

SEQ ID NO: 1924925 - protein, 15 aa, Staphylococcus
ANPSKSEDAEDMAKE

SEQ ID NO: 1924926 - protein, 15 aa, Staphylococcus
ANPSKSEDVEDIAKD

SEQ ID NO: 1924927 - protein, 8 aa, Staphylococcus
ANPTHSYT

SEQ ID NO: 1924928 - protein, 10 aa, Staphylococcus
ANQAGEKKVN

SEQ ID NO: 1924929 - protein, 9 aa, Staphylococcus
ANQESQKDD

SEQ ID NO: 1924930 - protein, 8 aa, Staphylococcus
ANQGGDSH

SEQ ID NO: 1924931 - protein, 13 aa, Staphylococcus
ANQGRIFEGYANV

SEQ ID NO: 1924932 - protein, 6 aa, Staphylococcus
ANQHKG

SEQ ID NO: 1924933 - protein, 4 aa, Staphylococcus
ANQI

SEQ ID NO: 1924934 - protein, 9 aa, Staphylococcus
ANQIEPNQP

SEQ ID NO: 1924935 - protein, 5 aa, Staphylococcus
ANQLP

SEQ ID NO: 1924936 - protein, 5 aa, Staphylococcus
ANQND

SEQ ID NO: 1924937 - protein, 4 aa, Staphylococcus
ANQQ

SEQ ID NO: 1924938 - protein, 10 aa, Staphylococcus
ANQQKQLESN

SEQ ID NO: 1924939 - protein, 5 aa, Staphylococcus
ANQRK

SEQ ID NO: 1924940 - protein, 8 aa, Staphylococcus
ANQTNQTA

SEQ ID NO: 1924941 - protein, 14 aa, Staphylococcus
ANQTTYSNNEDGIG

SEQ ID NO: 1924942 - protein, 23 aa, Staphylococcus
ANQVEGAARIDGKGLSTADALSQ

SEQ ID NO: 1924943 - protein, 9 aa, Staphylococcus
ANRAEEAGI

SEQ ID NO: 1924944 - protein, 17 aa, Staphylococcus
ANRDAFKQRKRPATAKP

SEQ ID NO: 1924945 - protein, 6 aa, Staphylococcus
ANRDEL

SEQ ID NO: 1924946 - protein, 11 aa, Staphylococcus
ANRDPKAYTNP

SEQ ID NO: 1924947 - protein, 7 aa, Staphylococcus
ANRDTAP

SEQ ID NO: 1924948 - protein, 7 aa, Staphylococcus
ANRDTAS

SEQ ID NO: 1924949 - protein, 9 aa, Staphylococcus
ANRDTASSF

SEQ ID NO: 1924950 - protein, 4 aa, Staphylococcus
ANRF

SEQ ID NO: 1924951 - protein, 6 aa, Staphylococcus
ANRHEP

SEQ ID NO: 1924952 - protein, 9 aa, Staphylococcus
ANRMSQNPV

SEQ ID NO: 1924953 - protein, 4 aa, Staphylococcus
ANRN

SEQ ID NO: 1924954 - protein, 13 aa, Staphylococcus
ANRPADKPLKGYK

SEQ ID NO: 1924955 - protein, 9 aa, Staphylococcus
ANRPASGTQ

SEQ ID NO: 1924956 - protein, 11 aa, Staphylococcus
ANRPEDVESLE

SEQ ID NO: 1924957 - protein, 6 aa, Staphylococcus
ANRPEE

SEQ ID NO: 1924958 - protein, 10 aa, Staphylococcus
ANRQSDGFKD

SEQ ID NO: 1924959 - protein, 8 aa, Staphylococcus
ANRRTTSK

SEQ ID NO: 1924960 - protein, 4 aa, Staphylococcus
ANRS

SEQ ID NO: 1924961 - protein, 11 aa, Staphylococcus
ANRSRTLTEEN

SEQ ID NO: 1924962 - protein, 7 aa, Staphylococcus
ANRTAKR

SEQ ID NO: 1924963 - protein, 10 aa, Staphylococcus
ANRTDYLETD

SEQ ID NO: 1924964 - protein, 5 aa, Staphylococcus
ANRVA

SEQ ID NO: 1924965 - protein, 11 aa, Staphylococcus
ANSASDLEGVD

SEQ ID NO: 1924966 - protein, 7 aa, Staphylococcus
ANSDDDR

SEQ ID NO: 1924967 - protein, 9 aa, Staphylococcus
ANSDTPPKV

SEQ ID NO: 1924968 - protein, 13 aa, Staphylococcus
ANSEDQAKTSFEE

SEQ ID NO: 1924969 - protein, 7 aa, Staphylococcus
ANSEKQA

SEQ ID NO: 1924970 - protein, 8 aa, Staphylococcus
ANSESGRH

SEQ ID NO: 1924971 - protein, 4 aa, Staphylococcus
ANSG

SEQ ID NO: 1924972 - protein, 6 aa, Staphylococcus
ANSGDY

SEQ ID NO: 1924973 - protein, 9 aa, Staphylococcus
ANSGQELPM

SEQ ID NO: 1924974 - protein, 5 aa, Staphylococcus
ANSGV

SEQ ID NO: 1924975 - protein, 16 aa, Staphylococcus
ANSKAIDSNKPKPRYL

SEQ ID NO: 1924976 - protein, 9 aa, Staphylococcus
ANSKPEMEA

SEQ ID NO: 1924977 - protein, 6 aa, Staphylococcus
ANSKRL

SEQ ID NO: 1924978 - protein, 16 aa, Staphylococcus
ANSLGKQSKKVMKGDD

SEQ ID NO: 1924979 - protein, 6 aa, Staphylococcus
ANSNEA

SEQ ID NO: 1924980 - protein, 9 aa, Staphylococcus
ANSNRPISR

SEQ ID NO: 1924981 - protein, 14 aa, Staphylococcus
ANSPRIDDQRYQNG

SEQ ID NO: 1924982 - protein, 13 aa, Staphylococcus
ANSPRISDERFNQ

SEQ ID NO: 1924983 - protein, 4 aa, Staphylococcus
ANSQ

SEQ ID NO: 1924984 - protein, 10 aa, Staphylococcus
ANSQDDEADA

SEQ ID NO: 1924985 - protein, 11 aa, Staphylococcus
ANSQDDEADKL

SEQ ID NO: 1924986 - protein, 7 aa, Staphylococcus
ANSQKSI

SEQ ID NO: 1924987 - protein, 6 aa, Staphylococcus
ANSQYN

SEQ ID NO: 1924988 - protein, 9 aa, Staphylococcus
ANSRLDDEG

SEQ ID NO: 1924989 - protein, 10 aa, Staphylococcus
ANSTLDENGR

SEQ ID NO: 1924990 - protein, 6 aa, Staphylococcus
ANSTTN

SEQ ID NO: 1924991 - protein, 7 aa, Staphylococcus
ANTAYNQ

SEQ ID NO: 1924992 - protein, 6 aa, Staphylococcus
ANTAYR

SEQ ID NO: 1924993 - protein, 8 aa, Staphylococcus
ANTDEEGR

SEQ ID NO: 1924994 - protein, 7 aa, Staphylococcus
ANTDIKD

SEQ ID NO: 1924995 - protein, 4 aa, Staphylococcus
ANTE

SEQ ID NO: 1924996 - protein, 7 aa, Staphylococcus
ANTEKDY

SEQ ID NO: 1924997 - protein, 6 aa, Staphylococcus
ANTFDN

SEQ ID NO: 1924998 - protein, 4 aa, Staphylococcus
ANTG

SEQ ID NO: 1924999 - protein, 9 aa, Staphylococcus
ANTGAIDGA

SEQ ID NO: 1925000 - protein, 14 aa, Staphylococcus
ANTGNLLKDETKKY

SEQ ID NO: 1925001 - protein, 13 aa, Staphylococcus
ANTGRVYDGYANV

SEQ ID NO: 1925002 - protein, 12 aa, Staphylococcus
ANTISDKATSTL

SEQ ID NO: 1925003 - protein, 10 aa, Staphylococcus
ANTKEIIGNQ

SEQ ID NO: 1925004 - protein, 9 aa, Staphylococcus
ANTKSIGTL

SEQ ID NO: 1925005 - protein, 6 aa, Staphylococcus
ANTPAK

SEQ ID NO: 1925006 - protein, 7 aa, Staphylococcus
ANTPDEA

SEQ ID NO: 1925007 - protein, 11 aa, Staphylococcus
ANTPLTNASYD

SEQ ID NO: 1925008 - protein, 9 aa, Staphylococcus
ANTPTSSQV

SEQ ID NO: 1925009 - protein, 9 aa, Staphylococcus
ANTPVAETD

SEQ ID NO: 1925010 - protein, 17 aa, Staphylococcus
ANTPVFAGGADNACGAL

SEQ ID NO: 1925011 - protein, 14 aa, Staphylococcus
ANTTPILVNTEHDI

SEQ ID NO: 1925012 - protein, 19 aa, Staphylococcus
ANVAALGEKHKGAGEGSDD

SEQ ID NO: 1925013 - protein, 19 aa, Staphylococcus
ANVAALGEKHKGAGKGADD

SEQ ID NO: 1925014 - protein, 20 aa, Staphylococcus
ANVAALGEKHKGAGKGADDV

SEQ ID NO: 1925015 - protein, 18 aa, Staphylococcus
ANVAALGEKHKGAGNGVD

SEQ ID NO: 1925016 - protein, 19 aa, Staphylococcus
ANVAALGEKHKGAGQGADD

SEQ ID NO: 1925017 - protein, 4 aa, Staphylococcus
ANVE

SEQ ID NO: 1925018 - protein, 7 aa, Staphylococcus
ANVESEI

SEQ ID NO: 1925019 - protein, 5 aa, Staphylococcus
ANVGK

SEQ ID NO: 1925020 - protein, 9 aa, Staphylococcus
ANVKQEGND

SEQ ID NO: 1925021 - protein, 11 aa, Staphylococcus
ANVNNNNGARF

SEQ ID NO: 1925022 - protein, 8 aa, Staphylococcus
ANVQEEVG

SEQ ID NO: 1925023 - protein, 9 aa, Staphylococcus
ANVQPSGDY

SEQ ID NO: 1925024 - protein, 21 aa, Staphylococcus
ANVQTETSPFRPVGRKSKVRA

SEQ ID NO: 1925025 - protein, 6 aa, Staphylococcus
ANVRRS

SEQ ID NO: 1925026 - protein, 8 aa, Staphylococcus
ANVSESHP

SEQ ID NO: 1925027 - protein, 19 aa, Staphylococcus
ANVSPDTRVKDLTDDELGR

SEQ ID NO: 1925028 - protein, 12 aa, Staphylococcus
ANVTPYKPQYKR

SEQ ID NO: 1925029 - protein, 9 aa, Staphylococcus
ANVTREGDD

SEQ ID NO: 1925030 - protein, 14 aa, Staphylococcus
ANVTTPKSIQTASA

SEQ ID NO: 1925031 - protein, 13 aa, Staphylococcus
ANYASSKEKDPKD

SEQ ID NO: 1925032 - protein, 13 aa, Staphylococcus
ANYASSKQKDDKD

SEQ ID NO: 1925033 - protein, 7 aa, Staphylococcus
ANYDQSI

SEQ ID NO: 1925034 - protein, 13 aa, Staphylococcus
ANYDSQLIIPIIP

SEQ ID NO: 1925035 - protein, 30 aa, Staphylococcus
ANYGDEATFGGGKSVRDGMAQNPNVTRDDR

SEQ ID NO: 1925036 - protein, 19 aa, Staphylococcus
ANYGNDSFTDYKSLNTEHA

SEQ ID NO: 1925037 - protein, 6 aa, Staphylococcus
ANYKAE

SEQ ID NO: 1925038 - protein, 5 aa, Staphylococcus
ANYND

SEQ ID NO: 1925039 - protein, 10 aa, Staphylococcus
ANYNDPIDEE

SEQ ID NO: 1925040 - protein, 9 aa, Staphylococcus
ANYNNNNEI

SEQ ID NO: 1925041 - protein, 5 aa, Staphylococcus
ANYPK

SEQ ID NO: 1925042 - protein, 6 aa, Staphylococcus
ANYPRA

SEQ ID NO: 1925043 - protein, 6 aa, Staphylococcus
ANYQRT

SEQ ID NO: 1925044 - protein, 16 aa, Staphylococcus
ANYTSRNKKRFEPDFT

SEQ ID NO: 1925045 - protein, 22 aa, Staphylococcus
APAATKEELAGLEGRNFDNKTE

SEQ ID NO: 1925046 - protein, 6 aa, Staphylococcus
APAFNS

SEQ ID NO: 1925047 - protein, 4 aa, Staphylococcus
APAH

SEQ ID NO: 1925048 - protein, 5 aa, Staphylococcus
APAIT

SEQ ID NO: 1925049 - protein, 6 aa, Staphylococcus
APAIVP

SEQ ID NO: 1925050 - protein, 11 aa, Staphylococcus
APALKEKETPV

SEQ ID NO: 1925051 - protein, 4 aa, Staphylococcus
APAN

SEQ ID NO: 1925052 - protein, 15 aa, Staphylococcus
APAPEGEGGSRAMQA

SEQ ID NO: 1925053 - protein, 8 aa, Staphylococcus
APAPTDTK

SEQ ID NO: 1925054 - protein, 28 aa, Staphylococcus
APARVKRRKERRQESKETLEFLTRTRHI

SEQ ID NO: 1925055 - protein, 8 aa, Staphylococcus
APASRTQR

SEQ ID NO: 1925056 - protein, 6 aa, Staphylococcus
APASVN

SEQ ID NO: 1925057 - protein, 7 aa, Staphylococcus
APATGDV

SEQ ID NO: 1925058 - protein, 16 aa, Staphylococcus
APDAPISKQSKAAALQ

SEQ ID NO: 1925059 - protein, 5 aa, Staphylococcus
APDDN

SEQ ID NO: 1925060 - protein, 7 aa, Staphylococcus
APDGQSY

SEQ ID NO: 1925061 - protein, 6 aa, Staphylococcus
APDHTE

SEQ ID NO: 1925062 - protein, 11 aa, Staphylococcus
APDKEPITPFS

SEQ ID NO: 1925063 - protein, 6 aa, Staphylococcus
APDLKT

SEQ ID NO: 1925064 - protein, 8 aa, Staphylococcus
APDRNHVD

SEQ ID NO: 1925065 - protein, 10 aa, Staphylococcus
APDRNRVNGH

SEQ ID NO: 1925066 - protein, 11 aa, Staphylococcus
APDSEAQRKEL

SEQ ID NO: 1925067 - protein, 9 aa, Staphylococcus
APDTIAEHD

SEQ ID NO: 1925068 - protein, 4 aa, Staphylococcus
APDY

SEQ ID NO: 1925069 - protein, 14 aa, Staphylococcus
APDYHIEDSEKAVR

SEQ ID NO: 1925070 - protein, 15 aa, Staphylococcus
APEAKALKEYTQQIE

SEQ ID NO: 1925071 - protein, 15 aa, Staphylococcus
APEALGDYNAGPSHV

SEQ ID NO: 1925072 - protein, 11 aa, Staphylococcus
APEAQPDKEID

SEQ ID NO: 1925073 - protein, 8 aa, Staphylococcus
APEDNSAK

SEQ ID NO: 1925074 - protein, 5 aa, Staphylococcus
APEER

SEQ ID NO: 1925075 - protein, 9 aa, Staphylococcus
APEERNKAM

SEQ ID NO: 1925076 - protein, 5 aa, Staphylococcus
APEHH

SEQ ID NO: 1925077 - protein, 5 aa, Staphylococcus
APEKE

SEQ ID NO: 1925078 - protein, 14 aa, Staphylococcus
APENVSDEQAASLP

SEQ ID NO: 1925079 - protein, 8 aa, Staphylococcus
APEPFDES

SEQ ID NO: 1925080 - protein, 8 aa, Staphylococcus
APEQIKET

SEQ ID NO: 1925081 - protein, 4 aa, Staphylococcus
APER

SEQ ID NO: 1925082 - protein, 5 aa, Staphylococcus
APERI

SEQ ID NO: 1925083 - protein, 7 aa, Staphylococcus
APESLPD

SEQ ID NO: 1925084 - protein, 6 aa, Staphylococcus
APESVN

SEQ ID NO: 1925085 - protein, 16 aa, Staphylococcus
APETGLKTKRSEYNSY

SEQ ID NO: 1925086 - protein, 4 aa, Staphylococcus
APEV

SEQ ID NO: 1925087 - protein, 14 aa, Staphylococcus
APEYKGAASDQFSD

SEQ ID NO: 1925088 - protein, 6 aa, Staphylococcus
APFAGT

SEQ ID NO: 1925089 - protein, 6 aa, Staphylococcus
APFNGT

SEQ ID NO: 1925090 - protein, 6 aa, Staphylococcus
APFPEE

SEQ ID NO: 1925091 - protein, 29 aa, Staphylococcus
APFPELGEVGQNSFRATADAIAARAKEHQ

SEQ ID NO: 1925092 - protein, 6 aa, Staphylococcus
APFQTQ

SEQ ID NO: 1925093 - protein, 6 aa, Staphylococcus
APGASI

SEQ ID NO: 1925094 - protein, 7 aa, Staphylococcus
APGDYEK

SEQ ID NO: 1925095 - protein, 24 aa, Staphylococcus
APGEDYDAYPRDIEKDTKAAESAG

SEQ ID NO: 1925096 - protein, 5 aa, Staphylococcus
APGEH

SEQ ID NO: 1925097 - protein, 6 aa, Staphylococcus
APGEHL

SEQ ID NO: 1925098 - protein, 18 aa, Staphylococcus
APGEVSEKQLEELSLRIR

SEQ ID NO: 1925099 - protein, 17 aa, Staphylococcus
APGEYKYETVETPTIEH

SEQ ID NO: 1925100 - protein, 6 aa, Staphylococcus
APGFEN

SEQ ID NO: 1925101 - protein, 9 aa, Staphylococcus
APGFGDRRK

SEQ ID NO: 1925102 - protein, 5 aa, Staphylococcus
APGFT

SEQ ID NO: 1925103 - protein, 9 aa, Staphylococcus
APGGASTAE

SEQ ID NO: 1925104 - protein, 12 aa, Staphylococcus
APGIGKEAGASL

SEQ ID NO: 1925105 - protein, 13 aa, Staphylococcus
APGIGKEAGASLN

SEQ ID NO: 1925106 - protein, 14 aa, Staphylococcus
APGIGKEAGASLSS

SEQ ID NO: 1925107 - protein, 11 aa, Staphylococcus
APGIGREAGAS

SEQ ID NO: 1925108 - protein, 15 aa, Staphylococcus
APGIGREAGASLDEL

SEQ ID NO: 1925109 - protein, 13 aa, Staphylococcus
APGKRHKDDVKTT

SEQ ID NO: 1925110 - protein, 13 aa, Staphylococcus
APGKRHKNDVKTT

SEQ ID NO: 1925111 - protein, 12 aa, Staphylococcus
APGKRHPEDIKT

SEQ ID NO: 1925112 - protein, 13 aa, Staphylococcus
APGKRHSEDVKTT

SEQ ID NO: 1925113 - protein, 13 aa, Staphylococcus
APGKRSNDDTKTT

SEQ ID NO: 1925114 - protein, 12 aa, Staphylococcus
APGKRSSDDIKT

SEQ ID NO: 1925115 - protein, 12 aa, Staphylococcus
APGKRYKNDIKT

SEQ ID NO: 1925116 - protein, 4 aa, Staphylococcus
APGM

SEQ ID NO: 1925117 - protein, 5 aa, Staphylococcus
APGNF

SEQ ID NO: 1925118 - protein, 27 aa, Staphylococcus
APGPIDNTGGSGKLSLSEEAKQQTLDS

SEQ ID NO: 1925119 - protein, 8 aa, Staphylococcus
APGQELEN

SEQ ID NO: 1925120 - protein, 7 aa, Staphylococcus
APGQLDD

SEQ ID NO: 1925121 - protein, 5 aa, Staphylococcus
APGRV

SEQ ID NO: 1925122 - protein, 12 aa, Staphylococcus
APGSKPADWPQI

SEQ ID NO: 1925123 - protein, 8 aa, Staphylococcus
APGTGKSF

SEQ ID NO: 1925124 - protein, 9 aa, Staphylococcus
APGTITPHT

SEQ ID NO: 1925125 - protein, 5 aa, Staphylococcus
APGTS

SEQ ID NO: 1925126 - protein, 4 aa, Staphylococcus
APGY

SEQ ID NO: 1925127 - protein, 22 aa, Staphylococcus
APHASKEELAGLEGRNFDNKND

SEQ ID NO: 1925128 - protein, 6 aa, Staphylococcus
APHIEE

SEQ ID NO: 1925129 - protein, 11 aa, Staphylococcus
APHKKGESGIA

SEQ ID NO: 1925130 - protein, 8 aa, Staphylococcus
APHPDADY

SEQ ID NO: 1925131 - protein, 5 aa, Staphylococcus
APHQG

SEQ ID NO: 1925132 - protein, 9 aa, Staphylococcus
APHQKAETG

SEQ ID NO: 1925133 - protein, 12 aa, Staphylococcus
APHRDPRDEFET

SEQ ID NO: 1925134 - protein, 8 aa, Staphylococcus
APHVEPPE

SEQ ID NO: 1925135 - protein, 5 aa, Staphylococcus
APIAT

SEQ ID NO: 1925136 - protein, 7 aa, Staphylococcus
APIEPSK

SEQ ID NO: 1925137 - protein, 13 aa, Staphylococcus
APIGRNEKDRQSM

SEQ ID NO: 1925138 - protein, 13 aa, Staphylococcus
APIGTTRAEWSER

SEQ ID NO: 1925139 - protein, 4 aa, Staphylococcus
APIL

SEQ ID NO: 1925140 - protein, 6 aa, Staphylococcus
APIPED

SEQ ID NO: 1925141 - protein, 13 aa, Staphylococcus
APISDEERENMKR

SEQ ID NO: 1925142 - protein, 6 aa, Staphylococcus
APISQD

SEQ ID NO: 1925143 - protein, 6 aa, Staphylococcus
APITKE

SEQ ID NO: 1925144 - protein, 11 aa, Staphylococcus
APITQATLGKK

SEQ ID NO: 1925145 - protein, 5 aa, Staphylococcus
APIYG

SEQ ID NO: 1925146 - protein, 17 aa, Staphylococcus
APKAITGEDTTIKGTEL

SEQ ID NO: 1925147 - protein, 9 aa, Staphylococcus
APKAQQQPL

SEQ ID NO: 1925148 - protein, 9 aa, Staphylococcus
APKAQRNRL

SEQ ID NO: 1925149 - protein, 9 aa, Staphylococcus
APKDQRDRL

SEQ ID NO: 1925150 - protein, 7 aa, Staphylococcus
APKGAHI

SEQ ID NO: 1925151 - protein, 8 aa, Staphylococcus
APKGKEEL

SEQ ID NO: 1925152 - protein, 9 aa, Staphylococcus
APKHARENE

SEQ ID NO: 1925153 - protein, 5 aa, Staphylococcus
APKIT

SEQ ID NO: 1925154 - protein, 21 aa, Staphylococcus
APKLDNAASEQFREDLNNSAA

SEQ ID NO: 1925155 - protein, 5 aa, Staphylococcus
APKMD

SEQ ID NO: 1925156 - protein, 6 aa, Staphylococcus
APKMNK

SEQ ID NO: 1925157 - protein, 6 aa, Staphylococcus
APKMRK

SEQ ID NO: 1925158 - protein, 10 aa, Staphylococcus
APKNQRNKLK

SEQ ID NO: 1925159 - protein, 9 aa, Staphylococcus
APKPEREKD

SEQ ID NO: 1925160 - protein, 18 aa, Staphylococcus
APKRVQRRKDRREESKNT

SEQ ID NO: 1925161 - protein, 18 aa, Staphylococcus
APKRVQRRKERREDSKRT

SEQ ID NO: 1925162 - protein, 13 aa, Staphylococcus
APKSTLSSDTEIQ

SEQ ID NO: 1925163 - protein, 8 aa, Staphylococcus
APKVETQE

SEQ ID NO: 1925164 - protein, 4 aa, Staphylococcus
APLA

SEQ ID NO: 1925165 - protein, 5 aa, Staphylococcus
APLAA

SEQ ID NO: 1925166 - protein, 11 aa, Staphylococcus
APLGDSEGHIN

SEQ ID NO: 1925167 - protein, 6 aa, Staphylococcus
APLGEE

SEQ ID NO: 1925168 - protein, 12 aa, Staphylococcus
APLGSGEAYGYT

SEQ ID NO: 1925169 - protein, 11 aa, Staphylococcus
APLGSGETYGY

SEQ ID NO: 1925170 - protein, 6 aa, Staphylococcus
APLGTH

SEQ ID NO: 1925171 - protein, 5 aa, Staphylococcus
APLKT

SEQ ID NO: 1925172 - protein, 19 aa, Staphylococcus
APLQSEDLDAPGYVPESSL

SEQ ID NO: 1925173 - protein, 15 aa, Staphylococcus
APLQSENKNAPGYVP

SEQ ID NO: 1925174 - protein, 5 aa, Staphylococcus
APLRE

SEQ ID NO: 1925175 - protein, 5 aa, Staphylococcus
APLRS

SEQ ID NO: 1925176 - protein, 10 aa, Staphylococcus
APLSPDEIQE

SEQ ID NO: 1925177 - protein, 5 aa, Staphylococcus
APLSQ

SEQ ID NO: 1925178 - protein, 12 aa, Staphylococcus
APLTETKHPSLT

SEQ ID NO: 1925179 - protein, 4 aa, Staphylococcus
APLV

SEQ ID NO: 1925180 - protein, 14 aa, Staphylococcus
APMPNARQTNEDIE

SEQ ID NO: 1925181 - protein, 19 aa, Staphylococcus
APMPNARQTNEEVEVSPFD

SEQ ID NO: 1925182 - protein, 20 aa, Staphylococcus
APMPNGRITKEAEEVSPFTP

SEQ ID NO: 1925183 - protein, 4 aa, Staphylococcus
APNE

SEQ ID NO: 1925184 - protein, 7 aa, Staphylococcus
APNEASQ

SEQ ID NO: 1925185 - protein, 7 aa, Staphylococcus
APNEDTL

SEQ ID NO: 1925186 - protein, 9 aa, Staphylococcus
APNEEREEN

SEQ ID NO: 1925187 - protein, 9 aa, Staphylococcus
APNEEREQE

SEQ ID NO: 1925188 - protein, 6 aa, Staphylococcus
APNEPT

SEQ ID NO: 1925189 - protein, 12 aa, Staphylococcus
APNETTQTFKGT

SEQ ID NO: 1925190 - protein, 17 aa, Staphylococcus
APNKGVNEDPVCGSGNG

SEQ ID NO: 1925191 - protein, 9 aa, Staphylococcus
APNKQRERE

SEQ ID NO: 1925192 - protein, 11 aa, Staphylococcus
APNQHGSNQEY

SEQ ID NO: 1925193 - protein, 9 aa, Staphylococcus
APNQQRENE

SEQ ID NO: 1925194 - protein, 11 aa, Staphylococcus
APNRDPRDEFE

SEQ ID NO: 1925195 - protein, 5 aa, Staphylococcus
APNSW

SEQ ID NO: 1925196 - protein, 5 aa, Staphylococcus
APNTV

SEQ ID NO: 1925197 - protein, 14 aa, Staphylococcus
APNYEKKLEITNLG

SEQ ID NO: 1925198 - protein, 6 aa, Staphylococcus
APPETF

SEQ ID NO: 1925199 - protein, 10 aa, Staphylococcus
APPPQGQLPS

SEQ ID NO: 1925200 - protein, 4 aa, Staphylococcus
APQG

SEQ ID NO: 1925201 - protein, 10 aa, Staphylococcus
APQGTSYTVT

SEQ ID NO: 1925202 - protein, 6 aa, Staphylococcus
APQGVP

SEQ ID NO: 1925203 - protein, 5 aa, Staphylococcus
APQID

SEQ ID NO: 1925204 - protein, 6 aa, Staphylococcus
APQMDK

SEQ ID NO: 1925205 - protein, 6 aa, Staphylococcus
APQMKQ

SEQ ID NO: 1925206 - protein, 9 aa, Staphylococcus
APQNTRRKA

SEQ ID NO: 1925207 - protein, 11 aa, Staphylococcus
APQNTRRKKIE

SEQ ID NO: 1925208 - protein, 11 aa, Staphylococcus
APQNTRRKPIE

SEQ ID NO: 1925209 - protein, 11 aa, Staphylococcus
APQNTRRKSIN

SEQ ID NO: 1925210 - protein, 8 aa, Staphylococcus
APQQLQSK

SEQ ID NO: 1925211 - protein, 5 aa, Staphylococcus
APQSG

SEQ ID NO: 1925212 - protein, 8 aa, Staphylococcus
APQSLPDE

SEQ ID NO: 1925213 - protein, 6 aa, Staphylococcus
APRDIT

SEQ ID NO: 1925214 - protein, 4 aa, Staphylococcus
APRE

SEQ ID NO: 1925215 - protein, 5 aa, Staphylococcus
APREL

SEQ ID NO: 1925216 - protein, 5 aa, Staphylococcus
APRLQ

SEQ ID NO: 1925217 - protein, 7 aa, Staphylococcus
APRNEGE

SEQ ID NO: 1925218 - protein, 4 aa, Staphylococcus
APRV

SEQ ID NO: 1925219 - protein, 11 aa, Staphylococcus
APSDERLKSDE

SEQ ID NO: 1925220 - protein, 7 aa, Staphylococcus
APSEELD

SEQ ID NO: 1925221 - protein, 9 aa, Staphylococcus
APSEKTEAG

SEQ ID NO: 1925222 - protein, 5 aa, Staphylococcus
APSGE

SEQ ID NO: 1925223 - protein, 7 aa, Staphylococcus
APSHPAY

SEQ ID NO: 1925224 - protein, 11 aa, Staphylococcus
APSIYQPTDKL

SEQ ID NO: 1925225 - protein, 7 aa, Staphylococcus
APSKEDY

SEQ ID NO: 1925226 - protein, 8 aa, Staphylococcus
APSKREEF

SEQ ID NO: 1925227 - protein, 5 aa, Staphylococcus
APSMK

SEQ ID NO: 1925228 - protein, 8 aa, Staphylococcus
APSNDEQG

SEQ ID NO: 1925229 - protein, 4 aa, Staphylococcus
APSP

SEQ ID NO: 1925230 - protein, 5 aa, Staphylococcus
APSQE

SEQ ID NO: 1925231 - protein, 7 aa, Staphylococcus
APSQTLT

SEQ ID NO: 1925232 - protein, 7 aa, Staphylococcus
APSQYPE

SEQ ID NO: 1925233 - protein, 13 aa, Staphylococcus
APSYERGANPFPK

SEQ ID NO: 1925234 - protein, 13 aa, Staphylococcus
APSYERGVNPFPK

SEQ ID NO: 1925235 - protein, 6 aa, Staphylococcus
APTDTK

SEQ ID NO: 1925236 - protein, 5 aa, Staphylococcus
APTEE

SEQ ID NO: 1925237 - protein, 6 aa, Staphylococcus
APTGDI

SEQ ID NO: 1925238 - protein, 6 aa, Staphylococcus
APTGHT

SEQ ID NO: 1925239 - protein, 16 aa, Staphylococcus
APTGRASKRLAESTGL

SEQ ID NO: 1925240 - protein, 16 aa, Staphylococcus
APTGRASKRLQEATGL

SEQ ID NO: 1925241 - protein, 11 aa, Staphylococcus
APTGSVDATDI

SEQ ID NO: 1925242 - protein, 6 aa, Staphylococcus
APTMDK

SEQ ID NO: 1925243 - protein, 5 aa, Staphylococcus
APTMK

SEQ ID NO: 1925244 - protein, 6 aa, Staphylococcus
APTMRN

SEQ ID NO: 1925245 - protein, 7 aa, Staphylococcus
APTNNAA

SEQ ID NO: 1925246 - protein, 6 aa, Staphylococcus
APTNST

SEQ ID NO: 1925247 - protein, 13 aa, Staphylococcus
APTQIEPRSKTRI

SEQ ID NO: 1925248 - protein, 8 aa, Staphylococcus
APTSNAKK

SEQ ID NO: 1925249 - protein, 18 aa, Staphylococcus
APTSPPTMPTNLGTTERR

SEQ ID NO: 1925250 - protein, 5 aa, Staphylococcus
APTSV

SEQ ID NO: 1925251 - protein, 19 aa, Staphylococcus
APTTATNKSVTYTSDSTDI

SEQ ID NO: 1925252 - protein, 5 aa, Staphylococcus
APTTE

SEQ ID NO: 1925253 - protein, 6 aa, Staphylococcus
APTTRQ

SEQ ID NO: 1925254 - protein, 6 aa, Staphylococcus
APTTTK

SEQ ID NO: 1925255 - protein, 10 aa, Staphylococcus
APVDNRDEPL

SEQ ID NO: 1925256 - protein, 10 aa, Staphylococcus
APVDNSDEPL

SEQ ID NO: 1925257 - protein, 6 aa, Staphylococcus
APVESQ

SEQ ID NO: 1925258 - protein, 5 aa, Staphylococcus
APVGP

SEQ ID NO: 1925259 - protein, 21 aa, Staphylococcus
APVGRNGIKATFKGNEEGPTI

SEQ ID NO: 1925260 - protein, 10 aa, Staphylococcus
APVGTTLDEA

SEQ ID NO: 1925261 - protein, 5 aa, Staphylococcus
APVLN

SEQ ID NO: 1925262 - protein, 6 aa, Staphylococcus
APVQGT

SEQ ID NO: 1925263 - protein, 10 aa, Staphylococcus
APVSGGDVNE

SEQ ID NO: 1925264 - protein, 12 aa, Staphylococcus
APVTEATHGQKN

SEQ ID NO: 1925265 - protein, 15 aa, Staphylococcus
APVYQKGEAHLTNPQ

SEQ ID NO: 1925266 - protein, 8 aa, Staphylococcus
APVYSNKD

SEQ ID NO: 1925267 - protein, 8 aa, Staphylococcus
APVYTTSS

SEQ ID NO: 1925268 - protein, 8 aa, Staphylococcus
APYDKEGG

SEQ ID NO: 1925269 - protein, 6 aa, Staphylococcus
APYDKR

SEQ ID NO: 1925270 - protein, 10 aa, Staphylococcus
APYDQTDKPV

SEQ ID NO: 1925271 - protein, 5 aa, Staphylococcus
APYEG

SEQ ID NO: 1925272 - protein, 6 aa, Staphylococcus
APYEKK

SEQ ID NO: 1925273 - protein, 7 aa, Staphylococcus
APYENRA

SEQ ID NO: 1925274 - protein, 9 aa, Staphylococcus
APYEPPENP

SEQ ID NO: 1925275 - protein, 6 aa, Staphylococcus
APYKEN

SEQ ID NO: 1925276 - protein, 5 aa, Staphylococcus
APYKF

SEQ ID NO: 1925277 - protein, 5 aa, Staphylococcus
APYKY

SEQ ID NO: 1925278 - protein, 18 aa, Staphylococcus
APYLSPHPYRGKRNEPER

SEQ ID NO: 1925279 - protein, 5 aa, Staphylococcus
APYNY

SEQ ID NO: 1925280 - protein, 16 aa, Staphylococcus
APYPNISEKSEDLSDE

SEQ ID NO: 1925281 - protein, 5 aa, Staphylococcus
APYRD

SEQ ID NO: 1925282 - protein, 6 aa, Staphylococcus
APYREL

SEQ ID NO: 1925283 - protein, 5 aa, Staphylococcus
APYSE

SEQ ID NO: 1925284 - protein, 6 aa, Staphylococcus
APYSNQ

SEQ ID NO: 1925285 - protein, 9 aa, Staphylococcus
APYTSGKID

SEQ ID NO: 1925286 - protein, 18 aa, Staphylococcus
AQAASQETKAAAAKEAEA

SEQ ID NO: 1925287 - protein, 9 aa, Staphylococcus
AQADDADAI

SEQ ID NO: 1925288 - protein, 7 aa, Staphylococcus
AQADGHT

SEQ ID NO: 1925289 - protein, 5 aa, Staphylococcus
AQAED

SEQ ID NO: 1925290 - protein, 13 aa, Staphylococcus
AQAEEKAKKTFGS

SEQ ID NO: 1925291 - protein, 6 aa, Staphylococcus
AQAEHD

SEQ ID NO: 1925292 - protein, 9 aa, Staphylococcus
AQAEKDGIN

SEQ ID NO: 1925293 - protein, 5 aa, Staphylococcus
AQAGA

SEQ ID NO: 1925294 - protein, 8 aa, Staphylococcus
AQAHKNGD

SEQ ID NO: 1925295 - protein, 6 aa, Staphylococcus
AQAIAE

SEQ ID NO: 1925296 - protein, 6 aa, Staphylococcus
AQAKKC

SEQ ID NO: 1925297 - protein, 14 aa, Staphylococcus
AQAKTPTLIHKIIT

SEQ ID NO: 1925298 - protein, 4 aa, Staphylococcus
AQAM

SEQ ID NO: 1925299 - protein, 8 aa, Staphylococcus
AQARSQTL

SEQ ID NO: 1925300 - protein, 6 aa, Staphylococcus
AQASAV

SEQ ID NO: 1925301 - protein, 12 aa, Staphylococcus
AQASSPTEGLGF

SEQ ID NO: 1925302 - protein, 4 aa, Staphylococcus
AQAT

SEQ ID NO: 1925303 - protein, 5 aa, Staphylococcus
AQATR

SEQ ID NO: 1925304 - protein, 14 aa, Staphylococcus
AQATTPTLIHKIIT

SEQ ID NO: 1925305 - protein, 9 aa, Staphylococcus
AQATVKESQ

SEQ ID NO: 1925306 - protein, 6 aa, Staphylococcus
AQAVGE

SEQ ID NO: 1925307 - protein, 4 aa, Staphylococcus
AQCE

SEQ ID NO: 1925308 - protein, 7 aa, Staphylococcus
AQDDFNQ

SEQ ID NO: 1925309 - protein, 5 aa, Staphylococcus
AQDED

SEQ ID NO: 1925310 - protein, 7 aa, Staphylococcus
AQDETTR

SEQ ID NO: 1925311 - protein, 10 aa, Staphylococcus
AQDKAKGGTI

SEQ ID NO: 1925312 - protein, 10 aa, Staphylococcus
AQDKGVKVPQ

SEQ ID NO: 1925313 - protein, 7 aa, Staphylococcus
AQDKKYK

SEQ ID NO: 1925314 - protein, 7 aa, Staphylococcus
AQDNFKQ

SEQ ID NO: 1925315 - protein, 7 aa, Staphylococcus
AQDNNPY

SEQ ID NO: 1925316 - protein, 7 aa, Staphylococcus
AQDQNEA

SEQ ID NO: 1925317 - protein, 14 aa, Staphylococcus
AQDQNKKKEEKIKE

SEQ ID NO: 1925318 - protein, 11 aa, Staphylococcus
AQDRDSSQRDL

SEQ ID NO: 1925319 - protein, 10 aa, Staphylococcus
AQDSAQANAF

SEQ ID NO: 1925320 - protein, 8 aa, Staphylococcus
AQDTHDAL

SEQ ID NO: 1925321 - protein, 20 aa, Staphylococcus
AQDTNDLERRRQAAESARLA

SEQ ID NO: 1925322 - protein, 11 aa, Staphylococcus
AQDYRSQKSIA

SEQ ID NO: 1925323 - protein, 4 aa, Staphylococcus
AQEA

SEQ ID NO: 1925324 - protein, 8 aa, Staphylococcus
AQEADNPL

SEQ ID NO: 1925325 - protein, 8 aa, Staphylococcus
AQEAGIGG

SEQ ID NO: 1925326 - protein, 7 aa, Staphylococcus
AQEAIQH

SEQ ID NO: 1925327 - protein, 11 aa, Staphylococcus
AQEAKDKGEAL

SEQ ID NO: 1925328 - protein, 8 aa, Staphylococcus
AQEATLPG

SEQ ID NO: 1925329 - protein, 15 aa, Staphylococcus
AQEAVERAKNGEGPT

SEQ ID NO: 1925330 - protein, 5 aa, Staphylococcus
AQEDY

SEQ ID NO: 1925331 - protein, 4 aa, Staphylococcus
AQEE

SEQ ID NO: 1925332 - protein, 10 aa, Staphylococcus
AQEEKQTGVA

SEQ ID NO: 1925333 - protein, 7 aa, Staphylococcus
AQEEMDN

SEQ ID NO: 1925334 - protein, 5 aa, Staphylococcus
AQEEN

SEQ ID NO: 1925335 - protein, 6 aa, Staphylococcus
AQEENK

SEQ ID NO: 1925336 - protein, 4 aa, Staphylococcus
AQEG

SEQ ID NO: 1925337 - protein, 10 aa, Staphylococcus
AQEGFSKSHP

SEQ ID NO: 1925338 - protein, 7 aa, Staphylococcus
AQEGGDI

SEQ ID NO: 1925339 - protein, 5 aa, Staphylococcus
AQEGV

SEQ ID NO: 1925340 - protein, 13 aa, Staphylococcus
AQEGYKSLEEGQA

SEQ ID NO: 1925341 - protein, 11 aa, Staphylococcus
AQEIQKPKKKQ

SEQ ID NO: 1925342 - protein, 7 aa, Staphylococcus
AQEKKQA

SEQ ID NO: 1925343 - protein, 12 aa, Staphylococcus
AQENERKRISRE

SEQ ID NO: 1925344 - protein, 8 aa, Staphylococcus
AQENPNYY

SEQ ID NO: 1925345 - protein, 4 aa, Staphylococcus
AQEP

SEQ ID NO: 1925346 - protein, 5 aa, Staphylococcus
AQEPD

SEQ ID NO: 1925347 - protein, 11 aa, Staphylococcus
AQEQADSYGHS

SEQ ID NO: 1925348 - protein, 11 aa, Staphylococcus
AQEQSESYGHS

SEQ ID NO: 1925349 - protein, 7 aa, Staphylococcus
AQESGLD

SEQ ID NO: 1925350 - protein, 8 aa, Staphylococcus
AQESRNAK

SEQ ID NO: 1925351 - protein, 18 aa, Staphylococcus
AQETAKAIADNEGVKTTA

SEQ ID NO: 1925352 - protein, 5 aa, Staphylococcus
AQEVH

SEQ ID NO: 1925353 - protein, 6 aa, Staphylococcus
AQEVTA

SEQ ID NO: 1925354 - protein, 5 aa, Staphylococcus
AQEYE

SEQ ID NO: 1925355 - protein, 9 aa, Staphylococcus
AQFNPSQGF

SEQ ID NO: 1925356 - protein, 10 aa, Staphylococcus
AQFNPSQGFR

SEQ ID NO: 1925357 - protein, 6 aa, Staphylococcus
AQFPAG

SEQ ID NO: 1925358 - protein, 6 aa, Staphylococcus
AQGADV

SEQ ID NO: 1925359 - protein, 15 aa, Staphylococcus
AQGAENNGSIINWTD

SEQ ID NO: 1925360 - protein, 14 aa, Staphylococcus
AQGAKTTSSVTKNT

SEQ ID NO: 1925361 - protein, 10 aa, Staphylococcus
AQGAKVDSWG

SEQ ID NO: 1925362 - protein, 20 aa, Staphylococcus
AQGDNPWTHQEQSSYHHQDD

SEQ ID NO: 1925363 - protein, 11 aa, Staphylococcus
AQGEDKEKSPF

SEQ ID NO: 1925364 - protein, 6 aa, Staphylococcus
AQGEDV

SEQ ID NO: 1925365 - protein, 8 aa, Staphylococcus
AQGEEVEE

SEQ ID NO: 1925366 - protein, 22 aa, Staphylococcus
AQGEHPWNQQEHAASHSEFQDD

SEQ ID NO: 1925367 - protein, 6 aa, Staphylococcus
AQGEKF

SEQ ID NO: 1925368 - protein, 7 aa, Staphylococcus
AQGGDVN

SEQ ID NO: 1925369 - protein, 12 aa, Staphylococcus
AQGGGLSRTDEK

SEQ ID NO: 1925370 - protein, 9 aa, Staphylococcus
AQGGGRGKQ

SEQ ID NO: 1925371 - protein, 9 aa, Staphylococcus
AQGGSRLKD

SEQ ID NO: 1925372 - protein, 4 aa, Staphylococcus
AQGH

SEQ ID NO: 1925373 - protein, 29 aa, Staphylococcus
AQGIAQASSKQQSSQSNTRGKRQNKGTFS

SEQ ID NO: 1925374 - protein, 13 aa, Staphylococcus
AQGIPSRLSNTAG

SEQ ID NO: 1925375 - protein, 5 aa, Staphylococcus
AQGIQ

SEQ ID NO: 1925376 - protein, 6 aa, Staphylococcus
AQGKTV

SEQ ID NO: 1925377 - protein, 4 aa, Staphylococcus
AQGL

SEQ ID NO: 1925378 - protein, 11 aa, Staphylococcus
AQGLDEESINE

SEQ ID NO: 1925379 - protein, 4 aa, Staphylococcus
AQGQ

SEQ ID NO: 1925380 - protein, 11 aa, Staphylococcus
AQGQFENSGRC

SEQ ID NO: 1925381 - protein, 6 aa, Staphylococcus
AQGQSV

SEQ ID NO: 1925382 - protein, 28 aa, Staphylococcus
AQGRTVGYSGRTYKNQEPKYLNSPETPI

SEQ ID NO: 1925383 - protein, 28 aa, Staphylococcus
AQGRTVGYSGRTYTNQEPKYLNSPETPI

SEQ ID NO: 1925384 - protein, 4 aa, Staphylococcus
AQGS

SEQ ID NO: 1925385 - protein, 5 aa, Staphylococcus
AQGSV

SEQ ID NO: 1925386 - protein, 6 aa, Staphylococcus
AQGSVL

SEQ ID NO: 1925387 - protein, 6 aa, Staphylococcus
AQGSVM

SEQ ID NO: 1925388 - protein, 4 aa, Staphylococcus
AQGT

SEQ ID NO: 1925389 - protein, 9 aa, Staphylococcus
AQGTPKQVM

SEQ ID NO: 1925390 - protein, 7 aa, Staphylococcus
AQGTQGI

SEQ ID NO: 1925391 - protein, 4 aa, Staphylococcus
AQGY

SEQ ID NO: 1925392 - protein, 14 aa, Staphylococcus
AQGYITPENAQTEI

SEQ ID NO: 1925393 - protein, 4 aa, Staphylococcus
AQHD

SEQ ID NO: 1925394 - protein, 7 aa, Staphylococcus
AQHEQSY

SEQ ID NO: 1925395 - protein, 10 aa, Staphylococcus
AQHKDATHNC

SEQ ID NO: 1925396 - protein, 7 aa, Staphylococcus
AQHNNDL

SEQ ID NO: 1925397 - protein, 6 aa, Staphylococcus
AQHPDV

SEQ ID NO: 1925398 - protein, 8 aa, Staphylococcus
AQHSDGTF

SEQ ID NO: 1925399 - protein, 6 aa, Staphylococcus
AQHSDN

SEQ ID NO: 1925400 - protein, 6 aa, Staphylococcus
AQIEAG

SEQ ID NO: 1925401 - protein, 18 aa, Staphylococcus
AQIEETDSDFDKEKLQER

SEQ ID NO: 1925402 - protein, 17 aa, Staphylococcus
AQIEETDSDFDREKLQE

SEQ ID NO: 1925403 - protein, 18 aa, Staphylococcus
AQIEETDSEFDKEKLQER

SEQ ID NO: 1925404 - protein, 6 aa, Staphylococcus
AQIGDE

SEQ ID NO: 1925405 - protein, 9 aa, Staphylococcus
AQIGGRRNG

SEQ ID NO: 1925406 - protein, 11 aa, Staphylococcus
AQIGKENLTDS

SEQ ID NO: 1925407 - protein, 14 aa, Staphylococcus
AQKAAKAYAEEHGA

SEQ ID NO: 1925408 - protein, 8 aa, Staphylococcus
AQKAESLG

SEQ ID NO: 1925409 - protein, 30 aa, Staphylococcus
AQKAGEETKLAANKDAEATIAKAQAQADQI

SEQ ID NO: 1925410 - protein, 6 aa, Staphylococcus
AQKAKV

SEQ ID NO: 1925411 - protein, 20 aa, Staphylococcus
AQKARNKKLRSEDMQGGTFT

SEQ ID NO: 1925412 - protein, 19 aa, Staphylococcus
AQKARNNQLTQEDMQGGTF

SEQ ID NO: 1925413 - protein, 19 aa, Staphylococcus
AQKARNQQLTQEDMTGGTF

SEQ ID NO: 1925414 - protein, 20 aa, Staphylococcus
AQKARTNKLTQADLSGGTFT

SEQ ID NO: 1925415 - protein, 4 aa, Staphylococcus
AQKD

SEQ ID NO: 1925416 - protein, 7 aa, Staphylococcus
AQKDGDN

SEQ ID NO: 1925417 - protein, 6 aa, Staphylococcus
AQKEEK

SEQ ID NO: 1925418 - protein, 7 aa, Staphylococcus
AQKENDN

SEQ ID NO: 1925419 - protein, 8 aa, Staphylococcus
AQKGKGSG

SEQ ID NO: 1925420 - protein, 7 aa, Staphylococcus
AQKGNII

SEQ ID NO: 1925421 - protein, 12 aa, Staphylococcus
AQKGSNALTGRL

SEQ ID NO: 1925422 - protein, 15 aa, Staphylococcus
AQKHPEIKDYSDHDR

SEQ ID NO: 1925423 - protein, 6 aa, Staphylococcus
AQKHSV

SEQ ID NO: 1925424 - protein, 16 aa, Staphylococcus
AQKILTDKEVEAYFDN

SEQ ID NO: 1925425 - protein, 5 aa, Staphylococcus
AQKKH

SEQ ID NO: 1925426 - protein, 7 aa, Staphylococcus
AQKKKGF

SEQ ID NO: 1925427 - protein, 11 aa, Staphylococcus
AQKKLKQDDEA

SEQ ID NO: 1925428 - protein, 9 aa, Staphylococcus
AQKLNQEGY

SEQ ID NO: 1925429 - protein, 4 aa, Staphylococcus
AQKM

SEQ ID NO: 1925430 - protein, 8 aa, Staphylococcus
AQKNDDLE

SEQ ID NO: 1925431 - protein, 10 aa, Staphylococcus
AQKNDEEAYE

SEQ ID NO: 1925432 - protein, 12 aa, Staphylococcus
AQKNKQEAYEMG

SEQ ID NO: 1925433 - protein, 8 aa, Staphylococcus
AQKPQGAR

SEQ ID NO: 1925434 - protein, 8 aa, Staphylococcus
AQKPQGSK

SEQ ID NO: 1925435 - protein, 8 aa, Staphylococcus
AQKPTGSK

SEQ ID NO: 1925436 - protein, 7 aa, Staphylococcus
AQKQDAF

SEQ ID NO: 1925437 - protein, 8 aa, Staphylococcus
AQKQLDTA

SEQ ID NO: 1925438 - protein, 7 aa, Staphylococcus
AQKSDTF

SEQ ID NO: 1925439 - protein, 6 aa, Staphylococcus
AQKVGY

SEQ ID NO: 1925440 - protein, 8 aa, Staphylococcus
AQLAEPDK

SEQ ID NO: 1925441 - protein, 4 aa, Staphylococcus
AQLD

SEQ ID NO: 1925442 - protein, 7 aa, Staphylococcus
AQLDGTL

SEQ ID NO: 1925443 - protein, 16 aa, Staphylococcus
AQLDKSSSSYYYYGEE

SEQ ID NO: 1925444 - protein, 6 aa, Staphylococcus
AQLESE

SEQ ID NO: 1925445 - protein, 6 aa, Staphylococcus
AQLPDL

SEQ ID NO: 1925446 - protein, 10 aa, Staphylococcus
AQLPTNTEIQ

SEQ ID NO: 1925447 - protein, 12 aa, Staphylococcus
AQLQQGKQYSSI

SEQ ID NO: 1925448 - protein, 15 aa, Staphylococcus
AQLSDSEKAKISHRG

SEQ ID NO: 1925449 - protein, 5 aa, Staphylococcus
AQLTE

SEQ ID NO: 1925450 - protein, 13 aa, Staphylococcus
AQLTEENVDTVKG

SEQ ID NO: 1925451 - protein, 6 aa, Staphylococcus
AQLTSR

SEQ ID NO: 1925452 - protein, 9 aa, Staphylococcus
AQLTSRKDI

SEQ ID NO: 1925453 - protein, 16 aa, Staphylococcus
AQLTSSSLQGIQGKKI

SEQ ID NO: 1925454 - protein, 5 aa, Staphylococcus
AQNAE

SEQ ID NO: 1925455 - protein, 8 aa, Staphylococcus
AQNAKDEL

SEQ ID NO: 1925456 - protein, 7 aa, Staphylococcus
AQNAPTT

SEQ ID NO: 1925457 - protein, 8 aa, Staphylococcus
AQNAREEL

SEQ ID NO: 1925458 - protein, 7 aa, Staphylococcus
AQNDDDI

SEQ ID NO: 1925459 - protein, 7 aa, Staphylococcus
AQNDNEF

SEQ ID NO: 1925460 - protein, 5 aa, Staphylococcus
AQNEK

SEQ ID NO: 1925461 - protein, 8 aa, Staphylococcus
AQNENAVA

SEQ ID NO: 1925462 - protein, 5 aa, Staphylococcus
AQNFT

SEQ ID NO: 1925463 - protein, 16 aa, Staphylococcus
AQNGDRAVQTLYDAFE

SEQ ID NO: 1925464 - protein, 9 aa, Staphylococcus
AQNGDTSAL

SEQ ID NO: 1925465 - protein, 7 aa, Staphylococcus
AQNGNIA

SEQ ID NO: 1925466 - protein, 6 aa, Staphylococcus
AQNGQI

SEQ ID NO: 1925467 - protein, 5 aa, Staphylococcus
AQNGT

SEQ ID NO: 1925468 - protein, 18 aa, Staphylococcus
AQNKEANHHAQQALYQQL

SEQ ID NO: 1925469 - protein, 9 aa, Staphylococcus
AQNLSNNAE

SEQ ID NO: 1925470 - protein, 10 aa, Staphylococcus
AQNPENTDAL

SEQ ID NO: 1925471 - protein, 8 aa, Staphylococcus
AQNPERLK

SEQ ID NO: 1925472 - protein, 14 aa, Staphylococcus
AQNPYGDGKASERI

SEQ ID NO: 1925473 - protein, 6 aa, Staphylococcus
AQNQGM

SEQ ID NO: 1925474 - protein, 6 aa, Staphylococcus
AQNSAG

SEQ ID NO: 1925475 - protein, 7 aa, Staphylococcus
AQNSAGA

SEQ ID NO: 1925476 - protein, 6 aa, Staphylococcus
AQNSPL

SEQ ID NO: 1925477 - protein, 7 aa, Staphylococcus
AQNTYFE

SEQ ID NO: 1925478 - protein, 14 aa, Staphylococcus
AQPAQESEGTTNEI

SEQ ID NO: 1925479 - protein, 6 aa, Staphylococcus
AQPDID

SEQ ID NO: 1925480 - protein, 6 aa, Staphylococcus
AQPEDV

SEQ ID NO: 1925481 - protein, 5 aa, Staphylococcus
AQPEE

SEQ ID NO: 1925482 - protein, 22 aa, Staphylococcus
AQPESETKQINTTKGTGNDLSA

SEQ ID NO: 1925483 - protein, 19 aa, Staphylococcus
AQPGEESSNVWNNAGTGHS

SEQ ID NO: 1925484 - protein, 13 aa, Staphylococcus
AQPGNPLNRSTLP

SEQ ID NO: 1925485 - protein, 5 aa, Staphylococcus
AQPKA

SEQ ID NO: 1925486 - protein, 14 aa, Staphylococcus
AQPLSLDEGPNKIG

SEQ ID NO: 1925487 - protein, 4 aa, Staphylococcus
AQPM

SEQ ID NO: 1925488 - protein, 8 aa, Staphylococcus
AQPQTVQN

SEQ ID NO: 1925489 - protein, 10 aa, Staphylococcus
AQPTWDPKDF

SEQ ID NO: 1925490 - protein, 7 aa, Staphylococcus
AQQADGT

SEQ ID NO: 1925491 - protein, 6 aa, Staphylococcus
AQQAER

SEQ ID NO: 1925492 - protein, 19 aa, Staphylococcus
AQQAGEETKLAANKEAEAV

SEQ ID NO: 1925493 - protein, 30 aa, Staphylococcus
AQQAGEQTKAAAEKQAEATLAQAQAKADQI

SEQ ID NO: 1925494 - protein, 19 aa, Staphylococcus
AQQAGEQTKIAATKESEAI

SEQ ID NO: 1925495 - protein, 8 aa, Staphylococcus
AQQAGIDG

SEQ ID NO: 1925496 - protein, 14 aa, Staphylococcus
AQQALDNQKTDNRI

SEQ ID NO: 1925497 - protein, 22 aa, Staphylococcus
AQQDVDEDKAKDLEKKMRTSSF

SEQ ID NO: 1925498 - protein, 22 aa, Staphylococcus
AQQDVDESKAKDLEKKMRTSSL

SEQ ID NO: 1925499 - protein, 22 aa, Staphylococcus
AQQDVDQDKAKDLEKKMRDSSF

SEQ ID NO: 1925500 - protein, 22 aa, Staphylococcus
AQQDVDQEKAKDLEKKMRESSF

SEQ ID NO: 1925501 - protein, 21 aa, Staphylococcus
AQQDVDQEKAKDLEQKMRNST

SEQ ID NO: 1925502 - protein, 4 aa, Staphylococcus
AQQE

SEQ ID NO: 1925503 - protein, 9 aa, Staphylococcus
AQQEGRINA

SEQ ID NO: 1925504 - protein, 6 aa, Staphylococcus
AQQEGV

SEQ ID NO: 1925505 - protein, 5 aa, Staphylococcus
AQQEL

SEQ ID NO: 1925506 - protein, 12 aa, Staphylococcus
AQQEQNNRIEET

SEQ ID NO: 1925507 - protein, 16 aa, Staphylococcus
AQQGAVAQTTEAPQQV

SEQ ID NO: 1925508 - protein, 18 aa, Staphylococcus
AQQKENSSLLPAQDNDQW

SEQ ID NO: 1925509 - protein, 8 aa, Staphylococcus
AQQKESIE

SEQ ID NO: 1925510 - protein, 6 aa, Staphylococcus
AQQLKT

SEQ ID NO: 1925511 - protein, 7 aa, Staphylococcus
AQQNERL

SEQ ID NO: 1925512 - protein, 12 aa, Staphylococcus
AQQNFGAIMKLQ

SEQ ID NO: 1925513 - protein, 18 aa, Staphylococcus
AQQNGAVAGKLTGGGRGG

SEQ ID NO: 1925514 - protein, 11 aa, Staphylococcus
AQQNVKQNTIQ

SEQ ID NO: 1925515 - protein, 12 aa, Staphylococcus
AQQQFGAIMKLE

SEQ ID NO: 1925516 - protein, 8 aa, Staphylococcus
AQQQNKYK

SEQ ID NO: 1925517 - protein, 10 aa, Staphylococcus
AQQRSAESLQ

SEQ ID NO: 1925518 - protein, 10 aa, Staphylococcus
AQQSEDSDSV

SEQ ID NO: 1925519 - protein, 10 aa, Staphylococcus
AQQSQSTSHL

SEQ ID NO: 1925520 - protein, 19 aa, Staphylococcus
AQQSTHSLAKQKADIADTR

SEQ ID NO: 1925521 - protein, 8 aa, Staphylococcus
AQQTYASE

SEQ ID NO: 1925522 - protein, 8 aa, Staphylococcus
AQQVTEEN

SEQ ID NO: 1925523 - protein, 52 aa, Staphylococcus
AQQYVGDSSLDIDDQEELKDSTENINSDVDKNVSNDATELDIDNQEKSEHHY

SEQ ID NO: 1925524 - protein, 10 aa, Staphylococcus
AQRADAEEAL

SEQ ID NO: 1925525 - protein, 13 aa, Staphylococcus
AQRALDNQKTTDR

SEQ ID NO: 1925526 - protein, 11 aa, Staphylococcus
AQRGKVQRDEK

SEQ ID NO: 1925527 - protein, 26 aa, Staphylococcus
AQRISEEEGMKARETANEFEKSISTQ

SEQ ID NO: 1925528 - protein, 10 aa, Staphylococcus
AQRNGYEEQI

SEQ ID NO: 1925529 - protein, 5 aa, Staphylococcus
AQRNR

SEQ ID NO: 1925530 - protein, 8 aa, Staphylococcus
AQRPGSVT

SEQ ID NO: 1925531 - protein, 6 aa, Staphylococcus
AQRPNE

SEQ ID NO: 1925532 - protein, 9 aa, Staphylococcus
AQRQRSFES

SEQ ID NO: 1925533 - protein, 10 aa, Staphylococcus
AQRQSGVGAN

SEQ ID NO: 1925534 - protein, 5 aa, Staphylococcus
AQRSA

SEQ ID NO: 1925535 - protein, 6 aa, Staphylococcus
AQRSAG

SEQ ID NO: 1925536 - protein, 9 aa, Staphylococcus
AQRSAGFDT

SEQ ID NO: 1925537 - protein, 9 aa, Staphylococcus
AQRSAGYDG

SEQ ID NO: 1925538 - protein, 12 aa, Staphylococcus
AQRSKEGWQGWP

SEQ ID NO: 1925539 - protein, 16 aa, Staphylococcus
AQRTEEGWNGWPADGK

SEQ ID NO: 1925540 - protein, 8 aa, Staphylococcus
AQRTPNKK

SEQ ID NO: 1925541 - protein, 8 aa, Staphylococcus
AQRVSEET

SEQ ID NO: 1925542 - protein, 9 aa, Staphylococcus
AQRVSEETS

SEQ ID NO: 1925543 - protein, 7 aa, Staphylococcus
AQRVTEF

SEQ ID NO: 1925544 - protein, 6 aa, Staphylococcus
AQSDID

SEQ ID NO: 1925545 - protein, 6 aa, Staphylococcus
AQSDNL

SEQ ID NO: 1925546 - protein, 9 aa, Staphylococcus
AQSEANGAT

SEQ ID NO: 1925547 - protein, 4 aa, Staphylococcus
AQSG

SEQ ID NO: 1925548 - protein, 5 aa, Staphylococcus
AQSGA

SEQ ID NO: 1925549 - protein, 9 aa, Staphylococcus
AQSGASLSQ

SEQ ID NO: 1925550 - protein, 11 aa, Staphylococcus
AQSGWTMPNRD

SEQ ID NO: 1925551 - protein, 5 aa, Staphylococcus
AQSKG

SEQ ID NO: 1925552 - protein, 14 aa, Staphylococcus
AQSKLDEDKKLSSQ

SEQ ID NO: 1925553 - protein, 10 aa, Staphylococcus
AQSKLDQDRK

SEQ ID NO: 1925554 - protein, 13 aa, Staphylococcus
AQSKLDSNHEQLT

SEQ ID NO: 1925555 - protein, 7 aa, Staphylococcus
AQSLEEA

SEQ ID NO: 1925556 - protein, 20 aa, Staphylococcus
AQSLRNELSENEKQKADKEM

SEQ ID NO: 1925557 - protein, 19 aa, Staphylococcus
AQSLRNELSENEKQQADKE

SEQ ID NO: 1925558 - protein, 10 aa, Staphylococcus
AQSNANKLGY

SEQ ID NO: 1925559 - protein, 10 aa, Staphylococcus
AQSNASAQGY

SEQ ID NO: 1925560 - protein, 10 aa, Staphylococcus
AQSNNNDSRF

SEQ ID NO: 1925561 - protein, 5 aa, Staphylococcus
AQSPY

SEQ ID NO: 1925562 - protein, 10 aa, Staphylococcus
AQSQAVSDKY

SEQ ID NO: 1925563 - protein, 5 aa, Staphylococcus
AQSQD

SEQ ID NO: 1925564 - protein, 15 aa, Staphylococcus
AQSQLNEDKHITSQS

SEQ ID NO: 1925565 - protein, 9 aa, Staphylococcus
AQSQPLEEG

SEQ ID NO: 1925566 - protein, 11 aa, Staphylococcus
AQSQRGKGYAK

SEQ ID NO: 1925567 - protein, 14 aa, Staphylococcus
AQSQVESERLVGAN

SEQ ID NO: 1925568 - protein, 7 aa, Staphylococcus
AQSSEIV

SEQ ID NO: 1925569 - protein, 5 aa, Staphylococcus
AQSSY

SEQ ID NO: 1925570 - protein, 5 aa, Staphylococcus
AQSVD

SEQ ID NO: 1925571 - protein, 15 aa, Staphylococcus
AQSYDDVKSKYTPAW

SEQ ID NO: 1925572 - protein, 7 aa, Staphylococcus
AQTAERG

SEQ ID NO: 1925573 - protein, 10 aa, Staphylococcus
AQTANTLRKN

SEQ ID NO: 1925574 - protein, 7 aa, Staphylococcus
AQTDEDF

SEQ ID NO: 1925575 - protein, 5 aa, Staphylococcus
AQTDV

SEQ ID NO: 1925576 - protein, 7 aa, Staphylococcus
AQTENMS

SEQ ID NO: 1925577 - protein, 9 aa, Staphylococcus
AQTEQDEYD

SEQ ID NO: 1925578 - protein, 7 aa, Staphylococcus
AQTESKR

SEQ ID NO: 1925579 - protein, 5 aa, Staphylococcus
AQTFP

SEQ ID NO: 1925580 - protein, 5 aa, Staphylococcus
AQTGD

SEQ ID NO: 1925581 - protein, 6 aa, Staphylococcus
AQTGSP

SEQ ID NO: 1925582 - protein, 6 aa, Staphylococcus
AQTHAS

SEQ ID NO: 1925583 - protein, 12 aa, Staphylococcus
AQTISNKSSQLY

SEQ ID NO: 1925584 - protein, 7 aa, Staphylococcus
AQTKEEL

SEQ ID NO: 1925585 - protein, 4 aa, Staphylococcus
AQTL

SEQ ID NO: 1925586 - protein, 4 aa, Staphylococcus
AQTM

SEQ ID NO: 1925587 - protein, 10 aa, Staphylococcus
AQTNAKKLGY

SEQ ID NO: 1925588 - protein, 9 aa, Staphylococcus
AQTNANKLG

SEQ ID NO: 1925589 - protein, 5 aa, Staphylococcus
AQTND

SEQ ID NO: 1925590 - protein, 6 aa, Staphylococcus
AQTNEE

SEQ ID NO: 1925591 - protein, 6 aa, Staphylococcus
AQTPGK

SEQ ID NO: 1925592 - protein, 8 aa, Staphylococcus
AQTPPFSI

SEQ ID NO: 1925593 - protein, 25 aa, Staphylococcus
AQTQKVQSKNNLDFGDPFGGGFGFF

SEQ ID NO: 1925594 - protein, 8 aa, Staphylococcus
AQTSALDN

SEQ ID NO: 1925595 - protein, 8 aa, Staphylococcus
AQTSEKNK

SEQ ID NO: 1925596 - protein, 10 aa, Staphylococcus
AQTSKIALGT

SEQ ID NO: 1925597 - protein, 8 aa, Staphylococcus
AQTTKHTN

SEQ ID NO: 1925598 - protein, 10 aa, Staphylococcus
AQTVSEETSI

SEQ ID NO: 1925599 - protein, 10 aa, Staphylococcus
AQVEEGVRKG

SEQ ID NO: 1925600 - protein, 6 aa, Staphylococcus
AQVEES

SEQ ID NO: 1925601 - protein, 17 aa, Staphylococcus
AQVEKQLGQPQRVTANE

SEQ ID NO: 1925602 - protein, 5 aa, Staphylococcus
AQVEM

SEQ ID NO: 1925603 - protein, 12 aa, Staphylococcus
AQVENEAVSDLG

SEQ ID NO: 1925604 - protein, 10 aa, Staphylococcus
AQVGTKAYGS

SEQ ID NO: 1925605 - protein, 4 aa, Staphylococcus
AQVK

SEQ ID NO: 1925606 - protein, 4 aa, Staphylococcus
AQVP

SEQ ID NO: 1925607 - protein, 5 aa, Staphylococcus
AQVPD

SEQ ID NO: 1925608 - protein, 5 aa, Staphylococcus
AQYEA

SEQ ID NO: 1925609 - protein, 7 aa, Staphylococcus
AQYEEER

SEQ ID NO: 1925610 - protein, 8 aa, Staphylococcus
AQYGKDTY

SEQ ID NO: 1925611 - protein, 6 aa, Staphylococcus
AQYHTS

SEQ ID NO: 1925612 - protein, 8 aa, Staphylococcus
AQYKEEMT

SEQ ID NO: 1925613 - protein, 9 aa, Staphylococcus
ARAAAQQGI

SEQ ID NO: 1925614 - protein, 9 aa, Staphylococcus
ARAAAQQGV

SEQ ID NO: 1925615 - protein, 7 aa, Staphylococcus
ARAAGRE

SEQ ID NO: 1925616 - protein, 9 aa, Staphylococcus
ARAAKKQGV

SEQ ID NO: 1925617 - protein, 6 aa, Staphylococcus
ARAEKG

SEQ ID NO: 1925618 - protein, 12 aa, Staphylococcus
ARAENRLRVANL

SEQ ID NO: 1925619 - protein, 11 aa, Staphylococcus
ARAERYSEGTV

SEQ ID NO: 1925620 - protein, 4 aa, Staphylococcus
ARAF

SEQ ID NO: 1925621 - protein, 4 aa, Staphylococcus
ARAK

SEQ ID NO: 1925622 - protein, 6 aa, Staphylococcus
ARANDS

SEQ ID NO: 1925623 - protein, 8 aa, Staphylococcus
ARAPRDGR

SEQ ID NO: 1925624 - protein, 11 aa, Staphylococcus
ARAQEIEQETR

SEQ ID NO: 1925625 - protein, 11 aa, Staphylococcus
ARAQGIDITTD

SEQ ID NO: 1925626 - protein, 15 aa, Staphylococcus
ARASKQGISEAGASP

SEQ ID NO: 1925627 - protein, 11 aa, Staphylococcus
ARASKYRSAGT

SEQ ID NO: 1925628 - protein, 10 aa, Staphylococcus
ARASNYRSAG

SEQ ID NO: 1925629 - protein, 20 aa, Staphylococcus
ARASTTGMAKSRRKKLDKID

SEQ ID NO: 1925630 - protein, 13 aa, Staphylococcus
ARATENDKQSRFP

SEQ ID NO: 1925631 - protein, 13 aa, Staphylococcus
ARCPYGPREGDEV

SEQ ID NO: 1925632 - protein, 7 aa, Staphylococcus
ARDADDM

SEQ ID NO: 1925633 - protein, 9 aa, Staphylococcus
ARDDQYKGL

SEQ ID NO: 1925634 - protein, 5 aa, Staphylococcus
ARDED

SEQ ID NO: 1925635 - protein, 5 aa, Staphylococcus
ARDEF

SEQ ID NO: 1925636 - protein, 8 aa, Staphylococcus
ARDEGPFL

SEQ ID NO: 1925637 - protein, 6 aa, Staphylococcus
ARDKDI

SEQ ID NO: 1925638 - protein, 14 aa, Staphylococcus
ARDMNNSESGPPNT

SEQ ID NO: 1925639 - protein, 4 aa, Staphylococcus
ARDN

SEQ ID NO: 1925640 - protein, 5 aa, Staphylococcus
ARDND

SEQ ID NO: 1925641 - protein, 7 aa, Staphylococcus
ARDNNLK

SEQ ID NO: 1925642 - protein, 8 aa, Staphylococcus
ARDVESNE

SEQ ID NO: 1925643 - protein, 4 aa, Staphylococcus
ARDY

SEQ ID NO: 1925644 - protein, 11 aa, Staphylococcus
AREAGDRSKIS

SEQ ID NO: 1925645 - protein, 20 aa, Staphylococcus
AREAGDRSKISVHSDNPDID

SEQ ID NO: 1925646 - protein, 20 aa, Staphylococcus
AREAGDRSKISVYSDNADID

SEQ ID NO: 1925647 - protein, 20 aa, Staphylococcus
AREAGDRSKISVYSDNPEID

SEQ ID NO: 1925648 - protein, 20 aa, Staphylococcus
AREAGDRSKISVYSENPDID

SEQ ID NO: 1925649 - protein, 6 aa, Staphylococcus
AREAGV

SEQ ID NO: 1925650 - protein, 5 aa, Staphylococcus
AREAR

SEQ ID NO: 1925651 - protein, 5 aa, Staphylococcus
AREDA

SEQ ID NO: 1925652 - protein, 10 aa, Staphylococcus
AREDNPDKQW

SEQ ID NO: 1925653 - protein, 8 aa, Staphylococcus
AREEEGNT

SEQ ID NO: 1925654 - protein, 6 aa, Staphylococcus
AREENI

SEQ ID NO: 1925655 - protein, 6 aa, Staphylococcus
AREETL

SEQ ID NO: 1925656 - protein, 7 aa, Staphylococcus
AREEWGP

SEQ ID NO: 1925657 - protein, 7 aa, Staphylococcus
AREFSNE

SEQ ID NO: 1925658 - protein, 5 aa, Staphylococcus
AREGA

SEQ ID NO: 1925659 - protein, 6 aa, Staphylococcus
AREGKR

SEQ ID NO: 1925660 - protein, 5 aa, Staphylococcus
AREIG

SEQ ID NO: 1925661 - protein, 6 aa, Staphylococcus
AREKGI

SEQ ID NO: 1925662 - protein, 21 aa, Staphylococcus
AREKGIDVTNTPKASTNATAD

SEQ ID NO: 1925663 - protein, 8 aa, Staphylococcus
AREKGTKH

SEQ ID NO: 1925664 - protein, 20 aa, Staphylococcus
AREKKVDGITDLRDETSLRT

SEQ ID NO: 1925665 - protein, 8 aa, Staphylococcus
AREKRIEG

SEQ ID NO: 1925666 - protein, 5 aa, Staphylococcus
ARELG

SEQ ID NO: 1925667 - protein, 5 aa, Staphylococcus
ARELN

SEQ ID NO: 1925668 - protein, 4 aa, Staphylococcus
AREN

SEQ ID NO: 1925669 - protein, 5 aa, Staphylococcus
ARENA

SEQ ID NO: 1925670 - protein, 9 aa, Staphylococcus
ARENDIKEK

SEQ ID NO: 1925671 - protein, 5 aa, Staphylococcus
AREPE

SEQ ID NO: 1925672 - protein, 4 aa, Staphylococcus
AREQ

SEQ ID NO: 1925673 - protein, 5 aa, Staphylococcus
AREQA

SEQ ID NO: 1925674 - protein, 12 aa, Staphylococcus
AREREIEESKAN

SEQ ID NO: 1925675 - protein, 12 aa, Staphylococcus
AREREIEQGKAN

SEQ ID NO: 1925676 - protein, 10 aa, Staphylococcus
AREREKTGIK

SEQ ID NO: 1925677 - protein, 14 aa, Staphylococcus
ARERRKSDERIKDV

SEQ ID NO: 1925678 - protein, 10 aa, Staphylococcus
ARERRKSDEV

SEQ ID NO: 1925679 - protein, 4 aa, Staphylococcus
ARES

SEQ ID NO: 1925680 - protein, 6 aa, Staphylococcus
ARESRT

SEQ ID NO: 1925681 - protein, 12 aa, Staphylococcus
ARESYNPPTLNI

SEQ ID NO: 1925682 - protein, 9 aa, Staphylococcus
ARETYQSDV

SEQ ID NO: 1925683 - protein, 5 aa, Staphylococcus
AREYL

SEQ ID NO: 1925684 - protein, 6 aa, Staphylococcus
AREYNK

SEQ ID NO: 1925685 - protein, 5 aa, Staphylococcus
ARFPN

SEQ ID NO: 1925686 - protein, 10 aa, Staphylococcus
ARFTNGNQPI

SEQ ID NO: 1925687 - protein, 7 aa, Staphylococcus
ARGCANG

SEQ ID NO: 1925688 - protein, 7 aa, Staphylococcus
ARGCRNG

SEQ ID NO: 1925689 - protein, 7 aa, Staphylococcus
ARGCSNG

SEQ ID NO: 1925690 - protein, 11 aa, Staphylococcus
ARGDLQAAQDN

SEQ ID NO: 1925691 - protein, 4 aa, Staphylococcus
ARGE

SEQ ID NO: 1925692 - protein, 13 aa, Staphylococcus
ARGERERVKQRAN

SEQ ID NO: 1925693 - protein, 12 aa, Staphylococcus
ARGERQHSSKLT

SEQ ID NO: 1925694 - protein, 4 aa, Staphylococcus
ARGF

SEQ ID NO: 1925695 - protein, 5 aa, Staphylococcus
ARGFN

SEQ ID NO: 1925696 - protein, 9 aa, Staphylococcus
ARGGEDYSK

SEQ ID NO: 1925697 - protein, 6 aa, Staphylococcus
ARGGQY

SEQ ID NO: 1925698 - protein, 33 aa, Staphylococcus; identical to SEQ ID NO: 1774112

SEQ ID NO: 1925699 - protein, 12 aa, Staphylococcus
ARGLASKRTTTV

SEQ ID NO: 1925700 - protein, 7 aa, Staphylococcus
ARGRDME

SEQ ID NO: 1925701 - protein, 13 aa, Staphylococcus
ARGRKDDKGKLAE

SEQ ID NO: 1925702 - protein, 13 aa, Staphylococcus
ARGRKDEKGELAE

SEQ ID NO: 1925703 - protein, 5 aa, Staphylococcus
ARGSY

SEQ ID NO: 1925704 - protein, 4 aa, Staphylococcus
ARGT

SEQ ID NO: 1925705 - protein, 8 aa, Staphylococcus
ARGVGNGN

SEQ ID NO: 1925706 - protein, 5 aa, Staphylococcus
ARHDE

SEQ ID NO: 1925707 - protein, 11 aa, Staphylococcus
ARHGLPDTPHD

SEQ ID NO: 1925708 - protein, 14 aa, Staphylococcus
ARHISSLSGGETFQ

SEQ ID NO: 1925709 - protein, 8 aa, Staphylococcus
ARHPERKT

SEQ ID NO: 1925710 - protein, 9 aa, Staphylococcus
ARHSDGTLN

SEQ ID NO: 1925711 - protein, 13 aa, Staphylococcus
ARIADNEGNQPID

SEQ ID NO: 1925712 - protein, 6 aa, Staphylococcus
ARIEEG

SEQ ID NO: 1925713 - protein, 5 aa, Staphylococcus
ARIEG

SEQ ID NO: 1925714 - protein, 5 aa, Staphylococcus
ARIEP

SEQ ID NO: 1925715 - protein, 12 aa, Staphylococcus
ARIEQGEQKEDA

SEQ ID NO: 1925716 - protein, 12 aa, Staphylococcus
ARIESGEQKEDA

SEQ ID NO: 1925717 - protein, 8 aa, Staphylococcus
ARIKGNAV

SEQ ID NO: 1925718 - protein, 13 aa, Staphylococcus
ARIPDNENNQPID

SEQ ID NO: 1925719 - protein, 12 aa, Staphylococcus
ARIPDNKGNQPI

SEQ ID NO: 1925720 - protein, 13 aa, Staphylococcus
ARIPDNKGNQPID

SEQ ID NO: 1925721 - protein, 4 aa, Staphylococcus
ARIQ

SEQ ID NO: 1925722 - protein, 8 aa, Staphylococcus
ARITPNQS

SEQ ID NO: 1925723 - protein, 8 aa, Staphylococcus
ARITPNTS

SEQ ID NO: 1925724 - protein, 15 aa, Staphylococcus
ARKAERVALTSDSQV

SEQ ID NO: 1925725 - protein, 8 aa, Staphylococcus
ARKANIES

SEQ ID NO: 1925726 - protein, 19 aa, Staphylococcus
ARKASRAVGKKGTDLPGQI

SEQ ID NO: 1925727 - protein, 19 aa, Staphylococcus
ARKASRAVGKNGTDLPGQI

SEQ ID NO: 1925728 - protein, 20 aa, Staphylococcus
ARKASRAVGKRGTDLPGQVA

SEQ ID NO: 1925729 - protein, 6 aa, Staphylococcus
ARKDAL

SEQ ID NO: 1925730 - protein, 5 aa, Staphylococcus
ARKEM

SEQ ID NO: 1925731 - protein, 7 aa, Staphylococcus
ARKGEVR

SEQ ID NO: 1925732 - protein, 6 aa, Staphylococcus
ARKHDI

SEQ ID NO: 1925733 - protein, 12 aa, Staphylococcus
ARKKALKNKRKK

SEQ ID NO: 1925734 - protein, 9 aa, Staphylococcus
ARKKERGKA

SEQ ID NO: 1925735 - protein, 19 aa, Staphylococcus
ARKKKEQGLTEAEAKEQAK

SEQ ID NO: 1925736 - protein, 10 aa, Staphylococcus
ARKKLKNGDL

SEQ ID NO: 1925737 - protein, 6 aa, Staphylococcus
ARKNGY

SEQ ID NO: 1925738 - protein, 4 aa, Staphylococcus
ARKP

SEQ ID NO: 1925739 - protein, 12 aa, Staphylococcus
ARKPDNLTNNEA

SEQ ID NO: 1925740 - protein, 10 aa, Staphylococcus
ARKRLKNGEL

SEQ ID NO: 1925741 - protein, 10 aa, Staphylococcus
ARKSDKLKTY

SEQ ID NO: 1925742 - protein, 8 aa, Staphylococcus
ARKSIRKN

SEQ ID NO: 1925743 - protein, 9 aa, Staphylococcus
ARKSIRKND

SEQ ID NO: 1925744 - protein, 8 aa, Staphylococcus
ARKSIRQN

SEQ ID NO: 1925745 - protein, 13 aa, Staphylococcus
ARKTKEEYQHDNN

SEQ ID NO: 1925746 - protein, 10 aa, Staphylococcus
ARKVSVGREL

SEQ ID NO: 1925747 - protein, 8 aa, Staphylococcus
ARKYFTSE

SEQ ID NO: 1925748 - protein, 7 aa, Staphylococcus
ARKYGLE

SEQ ID NO: 1925749 - protein, 5 aa, Staphylococcus
ARLGG

SEQ ID NO: 1925750 - protein, 4 aa, Staphylococcus
ARLN

SEQ ID NO: 1925751 - protein, 12 aa, Staphylococcus
ARMKSNNPDMPI

SEQ ID NO: 1925752 - protein, 7 aa, Staphylococcus
ARMPKAK

SEQ ID NO: 1925753 - protein, 6 aa, Staphylococcus
ARMTED

SEQ ID NO: 1925754 - protein, 4 aa, Staphylococcus
ARNA

SEQ ID NO: 1925755 - protein, 11 aa, Staphylococcus
ARNANEADIQE

SEQ ID NO: 1925756 - protein, 5 aa, Staphylococcus
ARNEA

SEQ ID NO: 1925757 - protein, 9 aa, Staphylococcus
ARNELNTNN

SEQ ID NO: 1925758 - protein, 4 aa, Staphylococcus
ARNF

SEQ ID NO: 1925759 - protein, 8 aa, Staphylococcus
ARNGKDAA

SEQ ID NO: 1925760 - protein, 10 aa, Staphylococcus
ARNGKQNVIQ

SEQ ID NO: 1925761 - protein, 35 aa, Staphylococcus
ARNGMESTEDIISNKGRSKRLGHRSKGFKDPGAVS

SEQ ID NO: 1925762 - protein, 6 aa, Staphylococcus
ARNHGM

SEQ ID NO: 1925763 - protein, 5 aa, Staphylococcus
ARNIS

SEQ ID NO: 1925764 - protein, 17 aa, Staphylococcus
ARNKQLSQEDMSGGTFT

SEQ ID NO: 1925765 - protein, 6 aa, Staphylococcus
ARNKSR

SEQ ID NO: 1925766 - protein, 9 aa, Staphylococcus
ARNNEEVER

SEQ ID NO: 1925767 - protein, 11 aa, Staphylococcus
ARNNETVERPK

SEQ ID NO: 1925768 - protein, 5 aa, Staphylococcus
ARNNN

SEQ ID NO: 1925769 - protein, 31 aa, Staphylococcus
ARNNSKSYFENQGFTDVKTKNPEGHDVLIWQ

SEQ ID NO: 1925770 - protein, 6 aa, Staphylococcus
ARNNVA

SEQ ID NO: 1925771 - protein, 5 aa, Staphylococcus
ARNPF

SEQ ID NO: 1925772 - protein, 7 aa, Staphylococcus
ARNQGDN

SEQ ID NO: 1925773 - protein, 8 aa, Staphylococcus
ARNSYLDS

SEQ ID NO: 1925774 - protein, 7 aa, Staphylococcus
ARNTIQD

SEQ ID NO: 1925775 - protein, 8 aa, Staphylococcus
ARNVTPGY

SEQ ID NO: 1925776 - protein, 55 aa, Staphylococcus
ARNYIGESSLDEDGNAMNMSKSKTSTSRQSAENQQQTESTNSEDIEEDSNTPFNY

SEQ ID NO: 1925777 - protein, 4 aa, Staphylococcus
ARPD

SEQ ID NO: 1925778 - protein, 6 aa, Staphylococcus
ARPEAG

SEQ ID NO: 1925779 - protein, 13 aa, Staphylococcus
ARPGTTLSITDED

SEQ ID NO: 1925780 - protein, 6 aa, Staphylococcus
ARPKPV

SEQ ID NO: 1925781 - protein, 9 aa, Staphylococcus
ARPNGDVNE

SEQ ID NO: 1925782 - protein, 14 aa, Staphylococcus
ARPNTTLSTTDEGE

SEQ ID NO: 1925783 - protein, 11 aa, Staphylococcus
ARPSGQNGPTI

SEQ ID NO: 1925784 - protein, 13 aa, Staphylococcus
ARPSGQNGTTSMT

SEQ ID NO: 1925785 - protein, 5 aa, Staphylococcus
ARPSR

SEQ ID NO: 1925786 - protein, 10 aa, Staphylococcus
ARQKDKDAVN

SEQ ID NO: 1925787 - protein, 5 aa, Staphylococcus
ARQLG

SEQ ID NO: 1925788 - protein, 4 aa, Staphylococcus
ARQN

SEQ ID NO: 1925789 - protein, 7 aa, Staphylococcus
ARQNNLK

SEQ ID NO: 1925790 - protein, 6 aa, Staphylococcus
ARQNSK

SEQ ID NO: 1925791 - protein, 21 aa, Staphylococcus
ARQQNIDVTNTPKASTNSTAE

SEQ ID NO: 1925792 - protein, 8 aa, Staphylococcus
ARQSIQDA

SEQ ID NO: 1925793 - protein, 7 aa, Staphylococcus
ARQTIQD

SEQ ID NO: 1925794 - protein, 5 aa, Staphylococcus
ARQTN

SEQ ID NO: 1925795 - protein, 8 aa, Staphylococcus
ARQTNPEG

SEQ ID NO: 1925796 - protein, 7 aa, Staphylococcus
ARQVDPN

SEQ ID NO: 1925797 - protein, 14 aa, Staphylococcus
ARQVNKDGYLSNKN

SEQ ID NO: 1925798 - protein, 4 aa, Staphylococcus
ARQY

SEQ ID NO: 1925799 - protein, 12 aa, Staphylococcus
ARQYGEEGLPED

SEQ ID NO: 1925800 - protein, 6 aa, Staphylococcus
ARRGAA

SEQ ID NO: 1925801 - protein, 4 aa, Staphylococcus
ARRM

SEQ ID NO: 1925802 - protein, 5 aa, Staphylococcus
ARRNG

SEQ ID NO: 1925803 - protein, 13 aa, Staphylococcus
ARRQPEETRENIK

SEQ ID NO: 1925804 - protein, 12 aa, Staphylococcus
ARRQPEQTETYV

SEQ ID NO: 1925805 - protein, 9 aa, Staphylococcus
ARRRKSRGL

SEQ ID NO: 1925806 - protein, 8 aa, Staphylococcus
ARRRQQRG

SEQ ID NO: 1925807 - protein, 8 aa, Staphylococcus
ARRRQSRG

SEQ ID NO: 1925808 - protein, 6 aa, Staphylococcus
ARRRRE

SEQ ID NO: 1925809 - protein, 5 aa, Staphylococcus
ARRSQ

SEQ ID NO: 1925810 - protein, 9 aa, Staphylococcus
ARRSVNPPI

SEQ ID NO: 1925811 - protein, 9 aa, Staphylococcus
ARRSVNPPV

SEQ ID NO: 1925812 - protein, 7 aa, Staphylococcus
ARRTDRM

SEQ ID NO: 1925813 - protein, 11 aa, Staphylococcus
ARRTVNPPKDT

SEQ ID NO: 1925814 - protein, 4 aa, Staphylococcus
ARSA

SEQ ID NO: 1925815 - protein, 9 aa, Staphylococcus
ARSAGEQIE

SEQ ID NO: 1925816 - protein, 11 aa, Staphylococcus
ARSAGKEIEFQ

SEQ ID NO: 1925817 - protein, 14 aa, Staphylococcus
ARSAGKEVEFQGQT

SEQ ID NO: 1925818 - protein, 11 aa, Staphylococcus
ARSAGKEVQFQ

SEQ ID NO: 1925819 - protein, 8 aa, Staphylococcus
ARSAGQTI

SEQ ID NO: 1925820 - protein, 9 aa, Staphylococcus
ARSARAYGS

SEQ ID NO: 1925821 - protein, 8 aa, Staphylococcus
ARSCRAYG

SEQ ID NO: 1925822 - protein, 7 aa, Staphylococcus
ARSDIDK

SEQ ID NO: 1925823 - protein, 13 aa, Staphylococcus
ARSEFSSETPIDA

SEQ ID NO: 1925824 - protein, 8 aa, Staphylococcus
ARSEGPFL

SEQ ID NO: 1925825 - protein, 7 aa, Staphylococcus
ARSGLER

SEQ ID NO: 1925826 - protein, 14 aa, Staphylococcus
ARSGQIRVTSKGRQ

SEQ ID NO: 1925827 - protein, 9 aa, Staphylococcus
ARSKEGKLQ

SEQ ID NO: 1925828 - protein, 10 aa, Staphylococcus
ARSKNHSIPD

SEQ ID NO: 1925829 - protein, 18 aa, Staphylococcus
ARSQGKRKDTSLNIEETG

SEQ ID NO: 1925830 - protein, 5 aa, Staphylococcus
ARSQR

SEQ ID NO: 1925831 - protein, 10 aa, Staphylococcus
ARSREDVEQH

SEQ ID NO: 1925832 - protein, 8 aa, Staphylococcus
ARSREGKL

SEQ ID NO: 1925833 - protein, 7 aa, Staphylococcus
ARSRGDN

SEQ ID NO: 1925834 - protein, 9 aa, Staphylococcus
ARSSTLSHA

SEQ ID NO: 1925835 - protein, 9 aa, Staphylococcus
ARSSTRKEE

SEQ ID NO: 1925836 - protein, 8 aa, Staphylococcus
ARSSVEKG

SEQ ID NO: 1925837 - protein, 7 aa, Staphylococcus
ARSTGAA

SEQ ID NO: 1925838 - protein, 7 aa, Staphylococcus
ARTAEQG

SEQ ID NO: 1925839 - protein, 6 aa, Staphylococcus
ARTAGP

SEQ ID NO: 1925840 - protein, 19 aa, Staphylococcus
ARTASRSIGKKGTDLPGQI

SEQ ID NO: 1925841 - protein, 8 aa, Staphylococcus
ARTEDVRA

SEQ ID NO: 1925842 - protein, 21 aa, Staphylococcus
ARTGTPAARMDDQIDESIKNE

SEQ ID NO: 1925843 - protein, 5 aa, Staphylococcus
ARTHN

SEQ ID NO: 1925844 - protein, 5 aa, Staphylococcus
ARTHP

SEQ ID NO: 1925845 - protein, 8 aa, Staphylococcus
ARTHRDTE

SEQ ID NO: 1925846 - protein, 6 aa, Staphylococcus
ARTLSE

SEQ ID NO: 1925847 - protein, 8 aa, Staphylococcus
ARTQKSSI

SEQ ID NO: 1925848 - protein, 8 aa, Staphylococcus
ARTQNSSI

SEQ ID NO: 1925849 - protein, 8 aa, Staphylococcus
ARTQNTSI

SEQ ID NO: 1925850 - protein, 5 aa, Staphylococcus
ARTQS

SEQ ID NO: 1925851 - protein, 6 aa, Staphylococcus
ARTRNY

SEQ ID NO: 1925852 - protein, 4 aa, Staphylococcus
ARTY

SEQ ID NO: 1925853 - protein, 16 aa, Staphylococcus
ARVAAKKAREVTRRKS

SEQ ID NO: 1925854 - protein, 8 aa, Staphylococcus
ARVEEENQ

SEQ ID NO: 1925855 - protein, 7 aa, Staphylococcus
ARVNEYS

SEQ ID NO: 1925856 - protein, 7 aa, Staphylococcus
ARVPELK

SEQ ID NO: 1925857 - protein, 9 aa, Staphylococcus
ARVQAESQK

SEQ ID NO: 1925858 - protein, 10 aa, Staphylococcus
ARVQAESQKL

SEQ ID NO: 1925859 - protein, 7 aa, Staphylococcus
ARVQGKD

SEQ ID NO: 1925860 - protein, 9 aa, Staphylococcus
ARVQTESQK

SEQ ID NO: 1925861 - protein, 4 aa, Staphylococcus
ARVS

SEQ ID NO: 1925862 - protein, 6 aa, Staphylococcus
ARVSPK

SEQ ID NO: 1925863 - protein, 9 aa, Staphylococcus
ARVSTPTDV

SEQ ID NO: 1925864 - protein, 15 aa, Staphylococcus
ARYARSIKGTKPTFY

SEQ ID NO: 1925865 - protein, 15 aa, Staphylococcus
ARYASAIKGTKPTFY

SEQ ID NO: 1925866 - protein, 17 aa, Staphylococcus
ARYASSIKGTKPQFTKD

SEQ ID NO: 1925867 - protein, 10 aa, Staphylococcus
ARYATEDRIK

SEQ ID NO: 1925868 - protein, 6 aa, Staphylococcus
ARYEDA

SEQ ID NO: 1925869 - protein, 11 aa, Staphylococcus
ARYENGELTEY

SEQ ID NO: 1925870 - protein, 11 aa, Staphylococcus
ARYENGQLTEY

SEQ ID NO: 1925871 - protein, 11 aa, Staphylococcus
ARYENGTLTEY

SEQ ID NO: 1925872 - protein, 15 aa, Staphylococcus
ARYESQTNYIPTPKA

SEQ ID NO: 1925873 - protein, 4 aa, Staphylococcus
ARYG

SEQ ID NO: 1925874 - protein, 17 aa, Staphylococcus
ARYGQSIKGTKPEFTEE

SEQ ID NO: 1925875 - protein, 5 aa, Staphylococcus
ARYPE

SEQ ID NO: 1925876 - protein, 11 aa, Staphylococcus
ARYQGGNKHQV

SEQ ID NO: 1925877 - protein, 11 aa, Staphylococcus
ARYQGGNKQQV

SEQ ID NO: 1925878 - protein, 8 aa, Staphylococcus
ARYRGQGL

SEQ ID NO: 1925879 - protein, 7 aa, Staphylococcus
ASADRDI

SEQ ID NO: 1925880 - protein, 10 aa, Staphylococcus
ASAEGCKRSL

SEQ ID NO: 1925881 - protein, 6 aa, Staphylococcus
ASAEIA

SEQ ID NO: 1925882 - protein, 13 aa, Staphylococcus
ASAENNSTPFTPN

SEQ ID NO: 1925883 - protein, 8 aa, Staphylococcus
ASAEQQET

SEQ ID NO: 1925884 - protein, 13 aa, Staphylococcus
ASAGNHAQGVAYT

SEQ ID NO: 1925885 - protein, 7 aa, Staphylococcus
ASAKAGV

SEQ ID NO: 1925886 - protein, 7 aa, Staphylococcus
ASANEKY

SEQ ID NO: 1925887 - protein, 7 aa, Staphylococcus
ASANEVV

SEQ ID NO: 1925888 - protein, 16 aa, Staphylococcus
ASAPGSVSQVRESTQS

SEQ ID NO: 1925889 - protein, 9 aa, Staphylococcus
ASAREMKQR

SEQ ID NO: 1925890 - protein, 8 aa, Staphylococcus
ASASEPSP

SEQ ID NO: 1925891 - protein, 6 aa, Staphylococcus
ASASQI

SEQ ID NO: 1925892 - protein, 4 aa, Staphylococcus
ASAT

SEQ ID NO: 1925893 - protein, 5 aa, Staphylococcus
ASATG

SEQ ID NO: 1925894 - protein, 6 aa, Staphylococcus
ASAVEG

SEQ ID NO: 1925895 - protein, 15 aa, Staphylococcus
ASCDETLKNAEKKVN

SEQ ID NO: 1925896 - protein, 14 aa, Staphylococcus
ASCSVGEAKGIASN

SEQ ID NO: 1925897 - protein, 8 aa, Staphylococcus
ASCTTNSL

SEQ ID NO: 1925898 - protein, 4 aa, Staphylococcus
ASDA

SEQ ID NO: 1925899 - protein, 8 aa, Staphylococcus
ASDALSEA

SEQ ID NO: 1925900 - protein, 7 aa, Staphylococcus
ASDATDN

SEQ ID NO: 1925901 - protein, 9 aa, Staphylococcus
ASDDDISGQ

SEQ ID NO: 1925902 - protein, 7 aa, Staphylococcus
ASDDRIQ

SEQ ID NO: 1925903 - protein, 8 aa, Staphylococcus
ASDDYTKI

SEQ ID NO: 1925904 - protein, 7 aa, Staphylococcus
ASDEAKM

SEQ ID NO: 1925905 - protein, 7 aa, Staphylococcus
ASDEEAM

SEQ ID NO: 1925906 - protein, 10 aa, Staphylococcus
ASDEIGESRI

SEQ ID NO: 1925907 - protein, 7 aa, Staphylococcus
ASDERHN

SEQ ID NO: 1925908 - protein, 8 aa, Staphylococcus
ASDERTLE

SEQ ID NO: 1925909 - protein, 13 aa, Staphylococcus
ASDETKDKSHLGQ

SEQ ID NO: 1925910 - protein, 5 aa, Staphylococcus
ASDID

SEQ ID NO: 1925911 - protein, 10 aa, Staphylococcus
ASDIRKELEA

SEQ ID NO: 1925912 - protein, 11 aa, Staphylococcus
ASDKQNPRLNQ

SEQ ID NO: 1925913 - protein, 6 aa, Staphylococcus
ASDKYE

SEQ ID NO: 1925914 - protein, 6 aa, Staphylococcus
ASDNAH

SEQ ID NO: 1925915 - protein, 7 aa, Staphylococcus
ASDPMKQ

SEQ ID NO: 1925916 - protein, 11 aa, Staphylococcus
ASDQNDAIEKA

SEQ ID NO: 1925917 - protein, 5 aa, Staphylococcus
ASDSS

SEQ ID NO: 1925918 - protein, 5 aa, Staphylococcus
ASDSV

SEQ ID NO: 1925919 - protein, 9 aa, Staphylococcus
ASDTPPDKV

SEQ ID NO: 1925920 - protein, 5 aa, Staphylococcus
ASDVA

SEQ ID NO: 1925921 - protein, 5 aa, Staphylococcus
ASDYV

SEQ ID NO: 1925922 - protein, 6 aa, Staphylococcus
ASEAGI

SEQ ID NO: 1925923 - protein, 20 aa, Staphylococcus
ASEAIQHRGETVTEGASSNV

SEQ ID NO: 1925924 - protein, 10 aa, Staphylococcus
ASEALQHDEK

SEQ ID NO: 1925925 - protein, 10 aa, Staphylococcus
ASEASYKEQG

SEQ ID NO: 1925926 - protein, 5 aa, Staphylococcus
ASEDS

SEQ ID NO: 1925927 - protein, 8 aa, Staphylococcus
ASEEGSRY

SEQ ID NO: 1925928 - protein, 11 aa, Staphylococcus
ASEEKENTSRS

SEQ ID NO: 1925929 - protein, 17 aa, Staphylococcus
ASEELSEDSESKRPSVQ

SEQ ID NO: 1925930 - protein, 17 aa, Staphylococcus
ASEELSEESESKRPSVQ

SEQ ID NO: 1925931 - protein, 17 aa, Staphylococcus
ASEELTEESESKRPSVQ

SEQ ID NO: 1925932 - protein, 7 aa, Staphylococcus
ASEENEE

SEQ ID NO: 1925933 - protein, 13 aa, Staphylococcus
ASEGKSKLTNVPD

SEQ ID NO: 1925934 - protein, 5 aa, Staphylococcus
ASEGV

SEQ ID NO: 1925935 - protein, 5 aa, Staphylococcus
ASEIE

SEQ ID NO: 1925936 - protein, 12 aa, Staphylococcus
ASEIEKADVDDE

SEQ ID NO: 1925937 - protein, 7 aa, Staphylococcus
ASEISDA

SEQ ID NO: 1925938 - protein, 16 aa, Staphylococcus
ASEKISEAMDQNDPIP

SEQ ID NO: 1925939 - protein, 8 aa, Staphylococcus
ASEKMTGQ

SEQ ID NO: 1925940 - protein, 10 aa, Staphylococcus
ASELEGKDLS

SEQ ID NO: 1925941 - protein, 11 aa, Staphylococcus
ASELQTSDNQV

SEQ ID NO: 1925942 - protein, 4 aa, Staphylococcus
ASEM

SEQ ID NO: 1925943 - protein, 6 aa, Staphylococcus
ASEMTE

SEQ ID NO: 1925944 - protein, 16 aa, Staphylococcus
ASENDLVGSTGYGYDD

SEQ ID NO: 1925945 - protein, 7 aa, Staphylococcus
ASENGTG

SEQ ID NO: 1925946 - protein, 14 aa, Staphylococcus
ASENHKKRVQSSTL

SEQ ID NO: 1925947 - protein, 15 aa, Staphylococcus
ASENHKKRVQSSTLN

SEQ ID NO: 1925948 - protein, 8 aa, Staphylococcus
ASENHPGQ

SEQ ID NO: 1925949 - protein, 6 aa, Staphylococcus
ASEPYN

SEQ ID NO: 1925950 - protein, 16 aa, Staphylococcus
ASEQLRYGENPQQSAR

SEQ ID NO: 1925951 - protein, 8 aa, Staphylococcus
ASEQSNMP

SEQ ID NO: 1925952 - protein, 6 aa, Staphylococcus
ASEQSQ

SEQ ID NO: 1925953 - protein, 4 aa, Staphylococcus
ASER

SEQ ID NO: 1925954 - protein, 5 aa, Staphylococcus
ASESG

SEQ ID NO: 1925955 - protein, 7 aa, Staphylococcus
ASESIEK

SEQ ID NO: 1925956 - protein, 23 aa, Staphylococcus
ASESKFEENMPPKDLLQQIAELN

SEQ ID NO: 1925957 - protein, 5 aa, Staphylococcus
ASESN

SEQ ID NO: 1925958 - protein, 24 aa, Staphylococcus
ASESSNKQPSIESLQQGTTFGSRE

SEQ ID NO: 1925959 - protein, 4 aa, Staphylococcus
ASET

SEQ ID NO: 1925960 - protein, 12 aa, Staphylococcus
ASETASKTAMEH

SEQ ID NO: 1925961 - protein, 5 aa, Staphylococcus
ASEVS

SEQ ID NO: 1925962 - protein, 9 aa, Staphylococcus
ASFATSSGM

SEQ ID NO: 1925963 - protein, 8 aa, Staphylococcus
ASFNEEGH

SEQ ID NO: 1925964 - protein, 5 aa, Staphylococcus
ASFNQ

SEQ ID NO: 1925965 - protein, 13 aa, Staphylococcus
ASFRNNQQNTIAN

SEQ ID NO: 1925966 - protein, 10 aa, Staphylococcus
ASFSKNEKKL

SEQ ID NO: 1925967 - protein, 6 aa, Staphylococcus
ASGAVG

SEQ ID NO: 1925968 - protein, 9 aa, Staphylococcus
ASGAVGSIA

SEQ ID NO: 1925969 - protein, 8 aa, Staphylococcus
ASGCGKTT

SEQ ID NO: 1925970 - protein, 6 aa, Staphylococcus
ASGDHT

SEQ ID NO: 1925971 - protein, 12 aa, Staphylococcus
ASGDVGRIIVKM

SEQ ID NO: 1925972 - protein, 12 aa, Staphylococcus
ASGDVGRLIIKM

SEQ ID NO: 1925973 - protein, 10 aa, Staphylococcus
ASGDVKEPSP

SEQ ID NO: 1925974 - protein, 7 aa, Staphylococcus
ASGFPKE

SEQ ID NO: 1925975 - protein, 7 aa, Staphylococcus
ASGFPKG

SEQ ID NO: 1925976 - protein, 13 aa, Staphylococcus
ASGGGVTVSGGEP

SEQ ID NO: 1925977 - protein, 11 aa, Staphylococcus
ASGHPYGASGA

SEQ ID NO: 1925978 - protein, 9 aa, Staphylococcus
ASGHPYSAS

SEQ ID NO: 1925979 - protein, 6 aa, Staphylococcus
ASGHTG

SEQ ID NO: 1925980 - protein, 8 aa, Staphylococcus
ASGISPDD

SEQ ID NO: 1925981 - protein, 8 aa, Staphylococcus
ASGISPNE

SEQ ID NO: 1925982 - protein, 8 aa, Staphylococcus
ASGKEPMS

SEQ ID NO: 1925983 - protein, 16 aa, Staphylococcus
ASGKSIIENAAKEPEI

SEQ ID NO: 1925984 - protein, 8 aa, Staphylococcus
ASGKSTVS

SEQ ID NO: 1925985 - protein, 9 aa, Staphylococcus
ASGKSTVSE

SEQ ID NO: 1925986 - protein, 7 aa, Staphylococcus
ASGKTAI

SEQ ID NO: 1925987 - protein, 16 aa, Staphylococcus
ASGKTVLENAAKEPEI

SEQ ID NO: 1925988 - protein, 9 aa, Staphylococcus
ASGLTETKG

SEQ ID NO: 1925989 - protein, 6 aa, Staphylococcus
ASGMEV

SEQ ID NO: 1925990 - protein, 8 aa, Staphylococcus
ASGMNKPN

SEQ ID NO: 1925991 - protein, 4 aa, Staphylococcus
ASGN

SEQ ID NO: 1925992 - protein, 8 aa, Staphylococcus
ASGNDSEW

SEQ ID NO: 1925993 - protein, 9 aa, Staphylococcus
ASGNRNWGQ

SEQ ID NO: 1925994 - protein, 10 aa, Staphylococcus
ASGNRNWGQN

SEQ ID NO: 1925995 - protein, 7 aa, Staphylococcus
ASGQHSS

SEQ ID NO: 1925996 - protein, 8 aa, Staphylococcus
ASGQLKNG

SEQ ID NO: 1925997 - protein, 7 aa, Staphylococcus
ASGRTPY

SEQ ID NO: 1925998 - protein, 8 aa, Staphylococcus
ASGSGKTT

SEQ ID NO: 1925999 - protein, 7 aa, Staphylococcus
ASGSTPY

SEQ ID NO: 1926000 - protein, 9 aa, Staphylococcus
ASGTATAFN

SEQ ID NO: 1926001 - protein, 8 aa, Staphylococcus
ASGVEVKD

SEQ ID NO: 1926002 - protein, 14 aa, Staphylococcus
ASGVNDSYMDTAEE

SEQ ID NO: 1926003 - protein, 17 aa, Staphylococcus
ASGYGDDQFSKQAAEQI

SEQ ID NO: 1926004 - protein, 6 aa, Staphylococcus
ASGYSF

SEQ ID NO: 1926005 - protein, 8 aa, Staphylococcus
ASHAEGKW

SEQ ID NO: 1926006 - protein, 5 aa, Staphylococcus
ASHDD

SEQ ID NO: 1926007 - protein, 11 aa, Staphylococcus
ASHDDRTTTQV

SEQ ID NO: 1926008 - protein, 7 aa, Staphylococcus
ASHGADT

SEQ ID NO: 1926009 - protein, 5 aa, Staphylococcus
ASHIN

SEQ ID NO: 1926010 - protein, 4 aa, Staphylococcus
ASHM

SEQ ID NO: 1926011 - protein, 6 aa, Staphylococcus
ASHPAY

SEQ ID NO: 1926012 - protein, 8 aa, Staphylococcus
ASHPDADK

SEQ ID NO: 1926013 - protein, 15 aa, Staphylococcus
ASHSDINVSSLAQAE

SEQ ID NO: 1926014 - protein, 9 aa, Staphylococcus
ASHTRSERT

SEQ ID NO: 1926015 - protein, 13 aa, Staphylococcus
ASIAKNAHKKGIT

SEQ ID NO: 1926016 - protein, 4 aa, Staphylococcus
ASID

SEQ ID NO: 1926017 - protein, 10 aa, Staphylococcus
ASIDKKIAED

SEQ ID NO: 1926018 - protein, 4 aa, Staphylococcus
ASIE

SEQ ID NO: 1926019 - protein, 5 aa, Staphylococcus
ASIEN

SEQ ID NO: 1926020 - protein, 7 aa, Staphylococcus
ASIENGD

SEQ ID NO: 1926021 - protein, 5 aa, Staphylococcus
ASIEP

SEQ ID NO: 1926022 - protein, 8 aa, Staphylococcus
ASIGLSEA

SEQ ID NO: 1926023 - protein, 4 aa, Staphylococcus
ASIK

SEQ ID NO: 1926024 - protein, 18 aa, Staphylococcus
ASIKKQPKELGHLIGIKR

SEQ ID NO: 1926025 - protein, 8 aa, Staphylococcus
ASINEHKN

SEQ ID NO: 1926026 - protein, 7 aa, Staphylococcus
ASIPRDD

SEQ ID NO: 1926027 - protein, 4 aa, Staphylococcus
ASIQ

SEQ ID NO: 1926028 - protein, 6 aa, Staphylococcus
ASIQNG

SEQ ID NO: 1926029 - protein, 6 aa, Staphylococcus
ASIQRG

SEQ ID NO: 1926030 - protein, 20 aa, Staphylococcus
ASISGAAGGCQAEVGSAAAM

SEQ ID NO: 1926031 - protein, 24 aa, Staphylococcus
ASISGAAGGCQAEVGSAAAMAAGA

SEQ ID NO: 1926032 - protein, 6 aa, Staphylococcus
ASKAHV

SEQ ID NO: 1926033 - protein, 20 aa, Staphylococcus
ASKAQGAIAGKLTGGGRGGS

SEQ ID NO: 1926034 - protein, 8 aa, Staphylococcus
ASKAQVGN

SEQ ID NO: 1926035 - protein, 14 aa, Staphylococcus
ASKDDEHVSYKETE

SEQ ID NO: 1926036 - protein, 6 aa, Staphylococcus
ASKDIG

SEQ ID NO: 1926037 - protein, 7 aa, Staphylococcus
ASKENDY

SEQ ID NO: 1926038 - protein, 9 aa, Staphylococcus
ASKEPRDGD

SEQ ID NO: 1926039 - protein, 8 aa, Staphylococcus
ASKEPVRS

SEQ ID NO: 1926040 - protein, 8 aa, Staphylococcus
ASKEQLDP

SEQ ID NO: 1926041 - protein, 8 aa, Staphylococcus
ASKEQLEP

SEQ ID NO: 1926042 - protein, 8 aa, Staphylococcus
ASKETLEP

SEQ ID NO: 1926043 - protein, 8 aa, Staphylococcus
ASKEVGTT

SEQ ID NO: 1926044 - protein, 6 aa, Staphylococcus
ASKGDY

SEQ ID NO: 1926045 - protein, 9 aa, Staphylococcus
ASKGKDPVY

SEQ ID NO: 1926046 - protein, 5 aa, Staphylococcus
ASKGL

SEQ ID NO: 1926047 - protein, 9 aa, Staphylococcus
ASKGNVATW

SEQ ID NO: 1926048 - protein, 10 aa, Staphylococcus
ASKGQANPQI

SEQ ID NO: 1926049 - protein, 21 aa, Staphylococcus
ASKGQANPQKVNGLLKQELDK

SEQ ID NO: 1926050 - protein, 21 aa, Staphylococcus
ASKGQANPQKVNQILKQELDK

SEQ ID NO: 1926051 - protein, 10 aa, Staphylococcus
ASKGQANPQL

SEQ ID NO: 1926052 - protein, 10 aa, Staphylococcus
ASKGQANPQM

SEQ ID NO: 1926053 - protein, 8 aa, Staphylococcus
ASKGTSKL

SEQ ID NO: 1926054 - protein, 7 aa, Staphylococcus
ASKGVST

SEQ ID NO: 1926055 - protein, 5 aa, Staphylococcus
ASKHY

SEQ ID NO: 1926056 - protein, 5 aa, Staphylococcus
ASKID

SEQ ID NO: 1926057 - protein, 13 aa, Staphylococcus
ASKIDFEPKEGDE

SEQ ID NO: 1926058 - protein, 10 aa, Staphylococcus
ASKIDRTQHY

SEQ ID NO: 1926059 - protein, 14 aa, Staphylococcus
ASKKAIKDAGITPA

SEQ ID NO: 1926060 - protein, 7 aa, Staphylococcus
ASKKGTA

SEQ ID NO: 1926061 - protein, 13 aa, Staphylococcus
ASKLGFEPKEGDE

SEQ ID NO: 1926062 - protein, 13 aa, Staphylococcus
ASKLNFEPKEGDE

SEQ ID NO: 1926063 - protein, 13 aa, Staphylococcus
ASKLTFDPKEGDE

SEQ ID NO: 1926064 - protein, 12 aa, Staphylococcus
ASKNKKDAKDNL

SEQ ID NO: 1926065 - protein, 6 aa, Staphylococcus
ASKNLR

SEQ ID NO: 1926066 - protein, 12 aa, Staphylococcus
ASKPNQQPRSMS

SEQ ID NO: 1926067 - protein, 7 aa, Staphylococcus
ASKPTGI

SEQ ID NO: 1926068 - protein, 4 aa, Staphylococcus
ASKQ

SEQ ID NO: 1926069 - protein, 7 aa, Staphylococcus
ASKQKGV

SEQ ID NO: 1926070 - protein, 7 aa, Staphylococcus
ASKQLTP

SEQ ID NO: 1926071 - protein, 12 aa, Staphylococcus
ASKQRGKNPFPK

SEQ ID NO: 1926072 - protein, 8 aa, Staphylococcus
ASKQVTEK

SEQ ID NO: 1926073 - protein, 8 aa, Staphylococcus
ASKREDIT

SEQ ID NO: 1926074 - protein, 15 aa, Staphylococcus
ASKRVVEKAGLKSED

SEQ ID NO: 1926075 - protein, 8 aa, Staphylococcus
ASKSAVPI

SEQ ID NO: 1926076 - protein, 5 aa, Staphylococcus
ASKTI

SEQ ID NO: 1926077 - protein, 13 aa, Staphylococcus
ASKTIPTTSQPAI

SEQ ID NO: 1926078 - protein, 8 aa, Staphylococcus
ASKTNSVG

SEQ ID NO: 1926079 - protein, 11 aa, Staphylococcus
ASKVDRNEHYS

SEQ ID NO: 1926080 - protein, 12 aa, Staphylococcus
ASKVDRTQQYSV

SEQ ID NO: 1926081 - protein, 13 aa, Staphylococcus
ASLAEPENEHLKN

SEQ ID NO: 1926082 - protein, 17 aa, Staphylococcus
ASLDGKQATDDGESKWI

SEQ ID NO: 1926083 - protein, 12 aa, Staphylococcus
ASLEDNKNTMTE

SEQ ID NO: 1926084 - protein, 14 aa, Staphylococcus
ASLEGTGVGTNPDE

SEQ ID NO: 1926085 - protein, 13 aa, Staphylococcus
ASLKKGTPVIYVE

SEQ ID NO: 1926086 - protein, 8 aa, Staphylococcus
ASLKNTDL

SEQ ID NO: 1926087 - protein, 7 aa, Staphylococcus
ASLKQSN

SEQ ID NO: 1926088 - protein, 7 aa, Staphylococcus
ASLNDSD

SEQ ID NO: 1926089 - protein, 10 aa, Staphylococcus
ASLNNKEKNL

SEQ ID NO: 1926090 - protein, 22 aa, Staphylococcus
ASLPEEKEAVEIQNDENEADNE

SEQ ID NO: 1926091 - protein, 14 aa, Staphylococcus
ASLPNADKQLTAQQ

SEQ ID NO: 1926092 - protein, 18 aa, Staphylococcus
ASLPSKRLENKNGTHSSK

SEQ ID NO: 1926093 - protein, 15 aa, Staphylococcus
ASLQDKKMSELENNQ

SEQ ID NO: 1926094 - protein, 6 aa, Staphylococcus
ASLQYK

SEQ ID NO: 1926095 - protein, 6 aa, Staphylococcus
ASLRDM

SEQ ID NO: 1926096 - protein, 4 aa, Staphylococcus
ASLS

SEQ ID NO: 1926097 - protein, 5 aa, Staphylococcus
ASLTQ

SEQ ID NO: 1926098 - protein, 7 aa, Staphylococcus
ASLTRQT

SEQ ID NO: 1926099 - protein, 4 aa, Staphylococcus
ASLV

SEQ ID NO: 1926100 - protein, 4 aa, Staphylococcus
ASME

SEQ ID NO: 1926101 - protein, 5 aa, Staphylococcus
ASMEE

SEQ ID NO: 1926102 - protein, 4 aa, Staphylococcus
ASMH

SEQ ID NO: 1926103 - protein, 6 aa, Staphylococcus
ASMHDK

SEQ ID NO: 1926104 - protein, 11 aa, Staphylococcus
ASMQDKMEETI

SEQ ID NO: 1926105 - protein, 20 aa, Staphylococcus
ASMSASTTVNTLKDGTKKRI

SEQ ID NO: 1926106 - protein, 9 aa, Staphylococcus
ASNADDDVT

SEQ ID NO: 1926107 - protein, 6 aa, Staphylococcus
ASNATD

SEQ ID NO: 1926108 - protein, 7 aa, Staphylococcus
ASNATKL

SEQ ID NO: 1926109 - protein, 7 aa, Staphylococcus
ASNATPC

SEQ ID NO: 1926110 - protein, 4 aa, Staphylococcus
ASND

SEQ ID NO: 1926111 - protein, 21 aa, Staphylococcus
ASNDDRTTTQVKELENDDKID

SEQ ID NO: 1926112 - protein, 8 aa, Staphylococcus
ASNDEWDE

SEQ ID NO: 1926113 - protein, 11 aa, Staphylococcus
ASNDLDEETIT

SEQ ID NO: 1926114 - protein, 9 aa, Staphylococcus
ASNDLDEQT

SEQ ID NO: 1926115 - protein, 11 aa, Staphylococcus
ASNDLDEQTIT

SEQ ID NO: 1926116 - protein, 23 aa, Staphylococcus
ASNDLDEQTITSLKSQGARVDSW

SEQ ID NO: 1926117 - protein, 7 aa, Staphylococcus
ASNDTDA

SEQ ID NO: 1926118 - protein, 9 aa, Staphylococcus
ASNEDYRTQ

SEQ ID NO: 1926119 - protein, 5 aa, Staphylococcus
ASNGD

SEQ ID NO: 1926120 - protein, 6 aa, Staphylococcus
ASNGIE

SEQ ID NO: 1926121 - protein, 7 aa, Staphylococcus
ASNGYEV

SEQ ID NO: 1926122 - protein, 6 aa, Staphylococcus
ASNHTP

SEQ ID NO: 1926123 - protein, 12 aa, Staphylococcus
ASNIAKKGKLLV

SEQ ID NO: 1926124 - protein, 12 aa, Staphylococcus
ASNIAKKGQLLN

SEQ ID NO: 1926125 - protein, 11 aa, Staphylococcus
ASNIDDELDSD

SEQ ID NO: 1926126 - protein, 5 aa, Staphylococcus
ASNIE

SEQ ID NO: 1926127 - protein, 10 aa, Staphylococcus
ASNKKDRKRR

SEQ ID NO: 1926128 - protein, 5 aa, Staphylococcus
ASNKL

SEQ ID NO: 1926129 - protein, 8 aa, Staphylococcus
ASNLSSDY

SEQ ID NO: 1926130 - protein, 6 aa, Staphylococcus
ASNNIR

SEQ ID NO: 1926131 - protein, 9 aa, Staphylococcus
ASNQFSSLE

SEQ ID NO: 1926132 - protein, 6 aa, Staphylococcus
ASNRSG

SEQ ID NO: 1926133 - protein, 8 aa, Staphylococcus
ASNSMAAG

SEQ ID NO: 1926134 - protein, 4 aa, Staphylococcus
ASNV

SEQ ID NO: 1926135 - protein, 6 aa, Staphylococcus
ASNVGS

SEQ ID NO: 1926136 - protein, 7 aa, Staphylococcus
ASNVNDV

SEQ ID NO: 1926137 - protein, 9 aa, Staphylococcus
ASNYDLEEE

SEQ ID NO: 1926138 - protein, 7 aa, Staphylococcus
ASPATIN

SEQ ID NO: 1926139 - protein, 6 aa, Staphylococcus
ASPEEI

SEQ ID NO: 1926140 - protein, 5 aa, Staphylococcus
ASPEF

SEQ ID NO: 1926141 - protein, 7 aa, Staphylococcus
ASPEIAD

SEQ ID NO: 1926142 - protein, 5 aa, Staphylococcus
ASPEQ

SEQ ID NO: 1926143 - protein, 6 aa, Staphylococcus
ASPFQS

SEQ ID NO: 1926144 - protein, 18 aa, Staphylococcus
ASPGAERPIKKDKDFQNA

SEQ ID NO: 1926145 - protein, 18 aa, Staphylococcus
ASPGAERPIKKEKDFQNA

SEQ ID NO: 1926146 - protein, 18 aa, Staphylococcus
ASPGAERPIKKEKDYHNA

SEQ ID NO: 1926147 - protein, 18 aa, Staphylococcus
ASPGAERPIKKEQDYQKA

SEQ ID NO: 1926148 - protein, 18 aa, Staphylococcus
ASPGAERPIKNEKALKDA

SEQ ID NO: 1926149 - protein, 14 aa, Staphylococcus
ASPGAERPIKTDKA

SEQ ID NO: 1926150 - protein, 19 aa, Staphylococcus
ASPGAERPLKKEKDYQNAI

SEQ ID NO: 1926151 - protein, 16 aa, Staphylococcus
ASPGIQDNASRSERIQ

SEQ ID NO: 1926152 - protein, 4 aa, Staphylococcus
ASPI

SEQ ID NO: 1926153 - protein, 8 aa, Staphylococcus
ASPKHTEG

SEQ ID NO: 1926154 - protein, 5 aa, Staphylococcus
ASPKK

SEQ ID NO: 1926155 - protein, 13 aa, Staphylococcus
ASPKTADAIKNNE

SEQ ID NO: 1926156 - protein, 12 aa, Staphylococcus
ASPNKKHYSEQD

SEQ ID NO: 1926157 - protein, 6 aa, Staphylococcus
ASPPKL

SEQ ID NO: 1926158 - protein, 10 aa, Staphylococcus
ASPQTHKDTK

SEQ ID NO: 1926159 - protein, 7 aa, Staphylococcus
ASPQVDG

SEQ ID NO: 1926160 - protein, 4 aa, Staphylococcus
ASPS

SEQ ID NO: 1926161 - protein, 16 aa, Staphylococcus
ASPSLEKDGTFTNTER

SEQ ID NO: 1926162 - protein, 17 aa, Staphylococcus
ASPSLEKDGTFTNTERR

SEQ ID NO: 1926163 - protein, 17 aa, Staphylococcus
ASPSLEKEGTFANTERR

SEQ ID NO: 1926164 - protein, 5 aa, Staphylococcus
ASPYK

SEQ ID NO: 1926165 - protein, 10 aa, Staphylococcus
ASQAKPPNAA

SEQ ID NO: 1926166 - protein, 5 aa, Staphylococcus
ASQAQ

SEQ ID NO: 1926167 - protein, 8 aa, Staphylococcus
ASQAVGTT

SEQ ID NO: 1926168 - protein, 9 aa, Staphylococcus
ASQDTLSQV

SEQ ID NO: 1926169 - protein, 8 aa, Staphylococcus
ASQEEKAP

SEQ ID NO: 1926170 - protein, 5 aa, Staphylococcus
ASQEF

SEQ ID NO: 1926171 - protein, 12 aa, Staphylococcus
ASQEQLEARVEN

SEQ ID NO: 1926172 - protein, 8 aa, Staphylococcus
ASQEQNAP

SEQ ID NO: 1926173 - protein, 12 aa, Staphylococcus
ASQFKSGEVNVP

SEQ ID NO: 1926174 - protein, 7 aa, Staphylococcus
ASQGEHN

SEQ ID NO: 1926175 - protein, 6 aa, Staphylococcus
ASQGNE

SEQ ID NO: 1926176 - protein, 6 aa, Staphylococcus
ASQGNF

SEQ ID NO: 1926177 - protein, 6 aa, Staphylococcus
ASQGNS

SEQ ID NO: 1926178 - protein, 5 aa, Staphylococcus
ASQGQ

SEQ ID NO: 1926179 - protein, 28 aa, Staphylococcus
ASQIHGDSGLDGPKLPEVPALKPTQKQA

SEQ ID NO: 1926180 - protein, 14 aa, Staphylococcus
ASQKKLKSQEARPI

SEQ ID NO: 1926181 - protein, 8 aa, Staphylococcus
ASQNPTFE

SEQ ID NO: 1926182 - protein, 10 aa, Staphylococcus
ASQPQSTSTL

SEQ ID NO: 1926183 - protein, 10 aa, Staphylococcus
ASQPSVQTPM

SEQ ID NO: 1926184 - protein, 8 aa, Staphylococcus
ASQPVGTT

SEQ ID NO: 1926185 - protein, 13 aa, Staphylococcus
ASQPYKESKPLKI

SEQ ID NO: 1926186 - protein, 4 aa, Staphylococcus
ASQQ

SEQ ID NO: 1926187 - protein, 26 aa, Staphylococcus
ASQQAETNESVTSNQIAQQDQQTETM

SEQ ID NO: 1926188 - protein, 9 aa, Staphylococcus
ASQQKLKGR

SEQ ID NO: 1926189 - protein, 4 aa, Staphylococcus
ASQR

SEQ ID NO: 1926190 - protein, 6 aa, Staphylococcus
ASQRED

SEQ ID NO: 1926191 - protein, 12 aa, Staphylococcus
ASQRYESMDRPK

SEQ ID NO: 1926192 - protein, 4 aa, Staphylococcus
ASQS

SEQ ID NO: 1926193 - protein, 15 aa, Staphylococcus
ASQSDTANYMSDTND

SEQ ID NO: 1926194 - protein, 6 aa, Staphylococcus
ASQSSK

SEQ ID NO: 1926195 - protein, 5 aa, Staphylococcus
ASQTF

SEQ ID NO: 1926196 - protein, 6 aa, Staphylococcus
ASQVAP

SEQ ID NO: 1926197 - protein, 12 aa, Staphylococcus
ASQVHGESGMDG

SEQ ID NO: 1926198 - protein, 17 aa, Staphylococcus
ASQYKAGHYPDKAHQQQ

SEQ ID NO: 1926199 - protein, 13 aa, Staphylococcus
ASQYKSGERALPQ

SEQ ID NO: 1926200 - protein, 4 aa, Staphylococcus
ASRA

SEQ ID NO: 1926201 - protein, 5 aa, Staphylococcus
ASRAD

SEQ ID NO: 1926202 - protein, 8 aa, Staphylococcus
ASRAEYKK

SEQ ID NO: 1926203 - protein, 9 aa, Staphylococcus
ASRAGQYRG

SEQ ID NO: 1926204 - protein, 22 aa, Staphylococcus
ASRALSTNNDKETACRPFQEGR

SEQ ID NO: 1926205 - protein, 22 aa, Staphylococcus
ASRALSTNNDRETACRPFQEGR

SEQ ID NO: 1926206 - protein, 5 aa, Staphylococcus
ASRAN

SEQ ID NO: 1926207 - protein, 8 aa, Staphylococcus
ASRDAAKN

SEQ ID NO: 1926208 - protein, 19 aa, Staphylococcus
ASREQGLADSNKVKEFLKN

SEQ ID NO: 1926209 - protein, 7 aa, Staphylococcus
ASRETVR

SEQ ID NO: 1926210 - protein, 4 aa, Staphylococcus
ASRG

SEQ ID NO: 1926211 - protein, 8 aa, Staphylococcus
ASRGIGSA

SEQ ID NO: 1926212 - protein, 10 aa, Staphylococcus
ASRIDKANGF

SEQ ID NO: 1926213 - protein, 6 aa, Staphylococcus
ASRLTR

SEQ ID NO: 1926214 - protein, 7 aa, Staphylococcus
ASRNGTG

SEQ ID NO: 1926215 - protein, 6 aa, Staphylococcus
ASRNVV

SEQ ID NO: 1926216 - protein, 15 aa, Staphylococcus
ASSAEEIKQVFEEAE

SEQ ID NO: 1926217 - protein, 15 aa, Staphylococcus
ASSAEGKAKLKNSDT

SEQ ID NO: 1926218 - protein, 9 aa, Staphylococcus
ASSAFQGAY

SEQ ID NO: 1926219 - protein, 7 aa, Staphylococcus
ASSANRR

SEQ ID NO: 1926220 - protein, 8 aa, Staphylococcus
ASSDEEVR

SEQ ID NO: 1926221 - protein, 13 aa, Staphylococcus
ASSDLNGSEQEAE

SEQ ID NO: 1926222 - protein, 7 aa, Staphylococcus
ASSDYAK

SEQ ID NO: 1926223 - protein, 14 aa, Staphylococcus
ASSEEDKKALHDSN

SEQ ID NO: 1926224 - protein, 15 aa, Staphylococcus
ASSEEGKAKLKNSDT

SEQ ID NO: 1926225 - protein, 23 aa, Staphylococcus
ASSEEGQLDEKNTIPHTFLHLVR

SEQ ID NO: 1926226 - protein, 14 aa, Staphylococcus
ASSEEGVLDEKNTI

SEQ ID NO: 1926227 - protein, 8 aa, Staphylococcus
ASSEKSLR

SEQ ID NO: 1926228 - protein, 7 aa, Staphylococcus
ASSETPF

SEQ ID NO: 1926229 - protein, 10 aa, Staphylococcus
ASSFKDEAVD

SEQ ID NO: 1926230 - protein, 10 aa, Staphylococcus
ASSFKDKAVD

SEQ ID NO: 1926231 - protein, 8 aa, Staphylococcus
ASSFKPTN

SEQ ID NO: 1926232 - protein, 9 aa, Staphylococcus
ASSFNDHTK

SEQ ID NO: 1926233 - protein, 9 aa, Staphylococcus
ASSGIGEET

SEQ ID NO: 1926234 - protein, 7 aa, Staphylococcus
ASSGKAF

SEQ ID NO: 1926235 - protein, 14 aa, Staphylococcus
ASSGKAYINGSAGE

SEQ ID NO: 1926236 - protein, 9 aa, Staphylococcus
ASSGPDDTW

SEQ ID NO: 1926237 - protein, 11 aa, Staphylococcus
ASSGQGDGKGG

SEQ ID NO: 1926238 - protein, 8 aa, Staphylococcus
ASSGSLPG

SEQ ID NO: 1926239 - protein, 5 aa, Staphylococcus
ASSGT

SEQ ID NO: 1926240 - protein, 8 aa, Staphylococcus
ASSKDDVN

SEQ ID NO: 1926241 - protein, 8 aa, Staphylococcus
ASSKEGKL

SEQ ID NO: 1926242 - protein, 5 aa, Staphylococcus
ASSKG

SEQ ID NO: 1926243 - protein, 7 aa, Staphylococcus
ASSKGGL

SEQ ID NO: 1926244 - protein, 10 aa, Staphylococcus
ASSKKDRKRR

SEQ ID NO: 1926245 - protein, 14 aa, Staphylococcus
ASSKTIPTTSQPAI

SEQ ID NO: 1926246 - protein, 5 aa, Staphylococcus
ASSKW

SEQ ID NO: 1926247 - protein, 5 aa, Staphylococcus
ASSLP

SEQ ID NO: 1926248 - protein, 25 aa, Staphylococcus
ASSLTGDESTIPNHKDITDTLDYEG

SEQ ID NO: 1926249 - protein, 25 aa, Staphylococcus
ASSLTGDNATIPNHKDITDQLDYEG

SEQ ID NO: 1926250 - protein, 25 aa, Staphylococcus
ASSLTGDNSTIPNHKDITDQLDYEG

SEQ ID NO: 1926251 - protein, 24 aa, Staphylococcus
ASSLTGDSATIPNHKDITDQLDYE

SEQ ID NO: 1926252 - protein, 11 aa, Staphylococcus
ASSMAQQAGGY

SEQ ID NO: 1926253 - protein, 13 aa, Staphylococcus
ASSNEAIETARKA

SEQ ID NO: 1926254 - protein, 7 aa, Staphylococcus
ASSNEYR

SEQ ID NO: 1926255 - protein, 7 aa, Staphylococcus
ASSNQVL

SEQ ID NO: 1926256 - protein, 9 aa, Staphylococcus
ASSPIEPTG

SEQ ID NO: 1926257 - protein, 17 aa, Staphylococcus
ASSPNEVKRAIENENDA

SEQ ID NO: 1926258 - protein, 17 aa, Staphylococcus
ASSPQQLEENVNNYNKK

SEQ ID NO: 1926259 - protein, 8 aa, Staphylococcus
ASSPVGTT

SEQ ID NO: 1926260 - protein, 11 aa, Staphylococcus
ASSQEEVRERG

SEQ ID NO: 1926261 - protein, 8 aa, Staphylococcus
ASSQSEEM

SEQ ID NO: 1926262 - protein, 8 aa, Staphylococcus
ASSREGKL

SEQ ID NO: 1926263 - protein, 5 aa, Staphylococcus
ASSRG

SEQ ID NO: 1926264 - protein, 15 aa, Staphylococcus
ASSRPKKIGGERAKY

SEQ ID NO: 1926265 - protein, 8 aa, Staphylococcus
ASSSAADN

SEQ ID NO: 1926266 - protein, 15 aa, Staphylococcus
ASSSEAENKQEDLEQ

SEQ ID NO: 1926267 - protein, 7 aa, Staphylococcus
ASSSIGA

SEQ ID NO: 1926268 - protein, 12 aa, Staphylococcus
ASSSINTDPFQY

SEQ ID NO: 1926269 - protein, 8 aa, Staphylococcus
ASSSPNDV

SEQ ID NO: 1926270 - protein, 9 aa, Staphylococcus
ASSSRTQRL

SEQ ID NO: 1926271 - protein, 15 aa, Staphylococcus
ASSTEGKEKLKNSDT

SEQ ID NO: 1926272 - protein, 10 aa, Staphylococcus
ASSTKDVERL

SEQ ID NO: 1926273 - protein, 8 aa, Staphylococcus
ASSTKSEV

SEQ ID NO: 1926274 - protein, 10 aa, Staphylococcus
ASSVEQLEEN

SEQ ID NO: 1926275 - protein, 7 aa, Staphylococcus
ASTAEGR

SEQ ID NO: 1926276 - protein, 8 aa, Staphylococcus
ASTAGNGC

SEQ ID NO: 1926277 - protein, 12 aa, Staphylococcus
ASTDDNANRYAE

SEQ ID NO: 1926278 - protein, 13 aa, Staphylococcus
ASTEEGNNLTEEA

SEQ ID NO: 1926279 - protein, 15 aa, Staphylococcus
ASTEEGNQLTEEEQW

SEQ ID NO: 1926280 - protein, 5 aa, Staphylococcus
ASTEN

SEQ ID NO: 1926281 - protein, 20 aa, Staphylococcus
ASTGNHRSHALNANKRRWNA

SEQ ID NO: 1926282 - protein, 15 aa, Staphylococcus
ASTGNKHAGDKLEAL

SEQ ID NO: 1926283 - protein, 17 aa, Staphylococcus
ASTGNKKATNKLKELGA

SEQ ID NO: 1926284 - protein, 20 aa, Staphylococcus
ASTGNNRSHALNANKRRFNA

SEQ ID NO: 1926285 - protein, 20 aa, Staphylococcus
ASTGNNRSHALNSSKRRWNA

SEQ ID NO: 1926286 - protein, 19 aa, Staphylococcus
ASTGNRRSHALNSTKRRWN

SEQ ID NO: 1926287 - protein, 17 aa, Staphylococcus
ASTGRKDATDKLKTLGA

SEQ ID NO: 1926288 - protein, 8 aa, Staphylococcus
ASTHASNA

SEQ ID NO: 1926289 - protein, 8 aa, Staphylococcus
ASTHPGAG

SEQ ID NO: 1926290 - protein, 5 aa, Staphylococcus
ASTIE

SEQ ID NO: 1926291 - protein, 11 aa, Staphylococcus
ASTITSHDAGY

SEQ ID NO: 1926292 - protein, 12 aa, Staphylococcus
ASTITSHDAGYL

SEQ ID NO: 1926293 - protein, 4 aa, Staphylococcus
ASTK

SEQ ID NO: 1926294 - protein, 14 aa, Staphylococcus
ASTKIEPHSKQTIG

SEQ ID NO: 1926295 - protein, 4 aa, Staphylococcus
ASTL

SEQ ID NO: 1926296 - protein, 6 aa, Staphylococcus
ASTLES

SEQ ID NO: 1926297 - protein, 6 aa, Staphylococcus
ASTLGG

SEQ ID NO: 1926298 - protein, 7 aa, Staphylococcus
ASTLSSQ

SEQ ID NO: 1926299 - protein, 7 aa, Staphylococcus
ASTNLTP

SEQ ID NO: 1926300 - protein, 7 aa, Staphylococcus
ASTPIAE

SEQ ID NO: 1926301 - protein, 8 aa, Staphylococcus
ASTPMAET

SEQ ID NO: 1926302 - protein, 7 aa, Staphylococcus
ASTPNEV

SEQ ID NO: 1926303 - protein, 35 aa, Staphylococcus
ASTQDKDFENETGSKVELSSKVGEAIAKKAADKGI

SEQ ID NO: 1926304 - protein, 12 aa, Staphylococcus
ASTQELNSKLAQ

SEQ ID NO: 1926305 - protein, 9 aa, Staphylococcus
ASTQQPHGY

SEQ ID NO: 1926306 - protein, 4 aa, Staphylococcus
ASTS

SEQ ID NO: 1926307 - protein, 7 aa, Staphylococcus
ASTSEGF

SEQ ID NO: 1926308 - protein, 7 aa, Staphylococcus
ASTSPTT

SEQ ID NO: 1926309 - protein, 22 aa, Staphylococcus
ASTTHAQLTPEEQLSAGITPET

SEQ ID NO: 1926310 - protein, 18 aa, Staphylococcus
ASTTHQQLTEAEQRQSGV

SEQ ID NO: 1926311 - protein, 7 aa, Staphylococcus
ASTTNEA

SEQ ID NO: 1926312 - protein, 7 aa, Staphylococcus
ASTYERP

SEQ ID NO: 1926313 - protein, 5 aa, Staphylococcus
ASVAR

SEQ ID NO: 1926314 - protein, 7 aa, Staphylococcus
ASVATRD

SEQ ID NO: 1926315 - protein, 6 aa, Staphylococcus
ASVGSA

SEQ ID NO: 1926316 - protein, 8 aa, Staphylococcus
ASVHGDQA

SEQ ID NO: 1926317 - protein, 7 aa, Staphylococcus
ASVKTRN

SEQ ID NO: 1926318 - protein, 11 aa, Staphylococcus
ASVNNRQNGQR

SEQ ID NO: 1926319 - protein, 12 aa, Staphylococcus
ASVNNRQNGQRN

SEQ ID NO: 1926320 - protein, 4 aa, Staphylococcus
ASVP

SEQ ID NO: 1926321 - protein, 9 aa, Staphylococcus
ASVPAKTEE

SEQ ID NO: 1926322 - protein, 12 aa, Staphylococcus
ASVPEDVRNERG

SEQ ID NO: 1926323 - protein, 8 aa, Staphylococcus
ASVRPERI

SEQ ID NO: 1926324 - protein, 9 aa, Staphylococcus
ASVRQKGIE

SEQ ID NO: 1926325 - protein, 4 aa, Staphylococcus
ASVS

SEQ ID NO: 1926326 - protein, 8 aa, Staphylococcus
ASVSAGQY

SEQ ID NO: 1926327 - protein, 8 aa, Staphylococcus
ASVSSYTD

SEQ ID NO: 1926328 - protein, 10 aa, Staphylococcus
ASYARSRDNR

SEQ ID NO: 1926329 - protein, 10 aa, Staphylococcus
ASYEAPHQPE

SEQ ID NO: 1926330 - protein, 10 aa, Staphylococcus
ASYKDTITEE

SEQ ID NO: 1926331 - protein, 5 aa, Staphylococcus
ASYPD

SEQ ID NO: 1926332 - protein, 18 aa, Staphylococcus
ASYPNILPSSTNPTLPYT

SEQ ID NO: 1926333 - protein, 23 aa, Staphylococcus
ASYPNILPSSTNPTLPYTQNTVD

SEQ ID NO: 1926334 - protein, 17 aa, Staphylococcus
ASYPNVLPSSTNPTLPY

SEQ ID NO: 1926335 - protein, 7 aa, Staphylococcus
ASYPSET

SEQ ID NO: 1926336 - protein, 17 aa, Staphylococcus
ASYSNILPSSTNPTLPY

SEQ ID NO: 1926337 - protein, 4 aa, Staphylococcus
ATAE

SEQ ID NO: 1926338 - protein, 5 aa, Staphylococcus
ATAEK

SEQ ID NO: 1926339 - protein, 7 aa, Staphylococcus
ATAEKKP

SEQ ID NO: 1926340 - protein, 9 aa, Staphylococcus
ATAEKNPLQ

SEQ ID NO: 1926341 - protein, 8 aa, Staphylococcus
ATAENPFG

SEQ ID NO: 1926342 - protein, 4 aa, Staphylococcus
ATAG

SEQ ID NO: 1926343 - protein, 5 aa, Staphylococcus
ATAGY

SEQ ID NO: 1926344 - protein, 5 aa, Staphylococcus
ATAHK

SEQ ID NO: 1926345 - protein, 8 aa, Staphylococcus
ATAKELGT

SEQ ID NO: 1926346 - protein, 5 aa, Staphylococcus
ATAKT

SEQ ID NO: 1926347 - protein, 24 aa, Staphylococcus
ATANKGAAASFVTTGKSVKGSTGL

SEQ ID NO: 1926348 - protein, 8 aa, Staphylococcus
ATAPKHLK

SEQ ID NO: 1926349 - protein, 6 aa, Staphylococcus
ATAPSY

SEQ ID NO: 1926350 - protein, 7 aa, Staphylococcus
ATAQAPD

SEQ ID NO: 1926351 - protein, 21 aa, Staphylococcus
ATAQGRNSQEARELSSAITQQ

SEQ ID NO: 1926352 - protein, 7 aa, Staphylococcus
ATAQKGF

SEQ ID NO: 1926353 - protein, 8 aa, Staphylococcus
ATAREASK

SEQ ID NO: 1926354 - protein, 7 aa, Staphylococcus
ATARQND

SEQ ID NO: 1926355 - protein, 8 aa, Staphylococcus
ATATAEVQ

SEQ ID NO: 1926356 - protein, 7 aa, Staphylococcus
ATATAIE

SEQ ID NO: 1926357 - protein, 20 aa, Staphylococcus
ATATRSLEYSENKVNAEQVQ

SEQ ID NO: 1926358 - protein, 11 aa, Staphylococcus
ATAVETGRVTN

SEQ ID NO: 1926359 - protein, 4 aa, Staphylococcus
ATDA

SEQ ID NO: 1926360 - protein, 7 aa, Staphylococcus
ATDASEL

SEQ ID NO: 1926361 - protein, 5 aa, Staphylococcus
ATDDD

SEQ ID NO: 1926362 - protein, 6 aa, Staphylococcus
ATDDDW

SEQ ID NO: 1926363 - protein, 6 aa, Staphylococcus
ATDDTI

SEQ ID NO: 1926364 - protein, 5 aa, Staphylococcus
ATDDV

SEQ ID NO: 1926365 - protein, 11 aa, Staphylococcus
ATDEDAQRYAN

SEQ ID NO: 1926366 - protein, 23 aa, Staphylococcus
ATDEDLEENNRARSAKLRVAEIL

SEQ ID NO: 1926367 - protein, 11 aa, Staphylococcus
ATDEEKQSAQK

SEQ ID NO: 1926368 - protein, 11 aa, Staphylococcus
ATDEKAQSYAQ

SEQ ID NO: 1926369 - protein, 9 aa, Staphylococcus
ATDENDKWT

SEQ ID NO: 1926370 - protein, 13 aa, Staphylococcus
ATDGYKTLEEGQK

SEQ ID NO: 1926371 - protein, 8 aa, Staphylococcus
ATDIDGKE

SEQ ID NO: 1926372 - protein, 10 aa, Staphylococcus
ATDIDNQEEY

SEQ ID NO: 1926373 - protein, 7 aa, Staphylococcus
ATDKQDF

SEQ ID NO: 1926374 - protein, 20 aa, Staphylococcus
ATDKSGQDIYNERFYGGIFR

SEQ ID NO: 1926375 - protein, 15 aa, Staphylococcus
ATDLETNVKNGQDTR

SEQ ID NO: 1926376 - protein, 10 aa, Staphylococcus
ATDLETQTDY

SEQ ID NO: 1926377 - protein, 8 aa, Staphylococcus
ATDNEKHK

SEQ ID NO: 1926378 - protein, 9 aa, Staphylococcus
ATDPGEGAY

SEQ ID NO: 1926379 - protein, 9 aa, Staphylococcus
ATDPNREPV

SEQ ID NO: 1926380 - protein, 10 aa, Staphylococcus
ATDPSEGAYE

SEQ ID NO: 1926381 - protein, 11 aa, Staphylococcus
ATDRDSSQRDL

SEQ ID NO: 1926382 - protein, 4 aa, Staphylococcus
ATDS

SEQ ID NO: 1926383 - protein, 12 aa, Staphylococcus
ATDSDSLIESDA

SEQ ID NO: 1926384 - protein, 5 aa, Staphylococcus
ATDTE

SEQ ID NO: 1926385 - protein, 5 aa, Staphylococcus
ATDVD

SEQ ID NO: 1926386 - protein, 9 aa, Staphylococcus
ATDVNDDDE

SEQ ID NO: 1926387 - protein, 9 aa, Staphylococcus
ATEAIENSD

SEQ ID NO: 1926388 - protein, 4 aa, Staphylococcus
ATED

SEQ ID NO: 1926389 - protein, 5 aa, Staphylococcus
ATEDE

SEQ ID NO: 1926390 - protein, 5 aa, Staphylococcus
ATEDL

SEQ ID NO: 1926391 - protein, 5 aa, Staphylococcus
ATEDN

SEQ ID NO: 1926392 - protein, 6 aa, Staphylococcus
ATEDNR

SEQ ID NO: 1926393 - protein, 8 aa, Staphylococcus
ATEDSEDE

SEQ ID NO: 1926394 - protein, 8 aa, Staphylococcus
ATEDTKAD

SEQ ID NO: 1926395 - protein, 4 aa, Staphylococcus
ATEE

SEQ ID NO: 1926396 - protein, 9 aa, Staphylococcus
ATEEDGQRH

SEQ ID NO: 1926397 - protein, 4 aa, Staphylococcus
ATEG

SEQ ID NO: 1926398 - protein, 9 aa, Staphylococcus
ATEGIGSEK

SEQ ID NO: 1926399 - protein, 16 aa, Staphylococcus
ATEGQIAINGKDVRKM

SEQ ID NO: 1926400 - protein, 7 aa, Staphylococcus
ATEGTSK

SEQ ID NO: 1926401 - protein, 13 aa, Staphylococcus
ATEIRSQKSIAES

SEQ ID NO: 1926402 - protein, 7 aa, Staphylococcus
ATEISSI

SEQ ID NO: 1926403 - protein, 5 aa, Staphylococcus
ATEIT

SEQ ID NO: 1926404 - protein, 6 aa, Staphylococcus
ATEITT

SEQ ID NO: 1926405 - protein, 5 aa, Staphylococcus
ATEKE

SEQ ID NO: 1926406 - protein, 6 aa, Staphylococcus
ATEKGL

SEQ ID NO: 1926407 - protein, 4 aa, Staphylococcus
ATEL

SEQ ID NO: 1926408 - protein, 10 aa, Staphylococcus
ATELAQQESK

SEQ ID NO: 1926409 - protein, 15 aa, Staphylococcus
ATELKVKETNRIDTT

SEQ ID NO: 1926410 - protein, 5 aa, Staphylococcus
ATEMN

SEQ ID NO: 1926411 - protein, 10 aa, Staphylococcus
ATENKKAEDI

SEQ ID NO: 1926412 - protein, 10 aa, Staphylococcus
ATENKKAEDV

SEQ ID NO: 1926413 - protein, 7 aa, Staphylococcus
ATEPEDY

SEQ ID NO: 1926414 - protein, 18 aa, Staphylococcus
ATEPTSAFGKLSGTHKDI

SEQ ID NO: 1926415 - protein, 7 aa, Staphylococcus
ATEQAEE

SEQ ID NO: 1926416 - protein, 10 aa, Staphylococcus
ATEQTDDDKS

SEQ ID NO: 1926417 - protein, 8 aa, Staphylococcus
ATEQVTNR

SEQ ID NO: 1926418 - protein, 14 aa, Staphylococcus
ATERATKNGKEETQ

SEQ ID NO: 1926419 - protein, 6 aa, Staphylococcus
ATEREI

SEQ ID NO: 1926420 - protein, 11 aa, Staphylococcus
ATERPEGVNAG

SEQ ID NO: 1926421 - protein, 17 aa, Staphylococcus
ATESDLLGTTGYGYDDI

SEQ ID NO: 1926422 - protein, 16 aa, Staphylococcus
ATESDLQGSTGYGYDD

SEQ ID NO: 1926423 - protein, 14 aa, Staphylococcus
ATESGSTAKTISKF

SEQ ID NO: 1926424 - protein, 18 aa, Staphylococcus
ATESGSTARTISKYRPQS

SEQ ID NO: 1926425 - protein, 10 aa, Staphylococcus
ATESGSTAVT

SEQ ID NO: 1926426 - protein, 5 aa, Staphylococcus
ATETF

SEQ ID NO: 1926427 - protein, 16 aa, Staphylococcus
ATEVKTSEFADELIKN

SEQ ID NO: 1926428 - protein, 6 aa, Staphylococcus
ATEVPA

SEQ ID NO: 1926429 - protein, 6 aa, Staphylococcus
ATEYGE

SEQ ID NO: 1926430 - protein, 6 aa, Staphylococcus
ATFESR

SEQ ID NO: 1926431 - protein, 19 aa, Staphylococcus
ATFSQSGATVVPSGFNKSG

SEQ ID NO: 1926432 - protein, 9 aa, Staphylococcus
ATFTPNTPI

SEQ ID NO: 1926433 - protein, 9 aa, Staphylococcus
ATGAGDSFT

SEQ ID NO: 1926434 - protein, 6 aa, Staphylococcus
ATGASV

SEQ ID NO: 1926435 - protein, 14 aa, Staphylococcus
ATGDGSIAAQNAQA

SEQ ID NO: 1926436 - protein, 11 aa, Staphylococcus
ATGDGSIAAQS

SEQ ID NO: 1926437 - protein, 24 aa, Staphylococcus
ATGDGSIAAQSAADYIEAIKDKLE

SEQ ID NO: 1926438 - protein, 24 aa, Staphylococcus
ATGDGSIAAQSAADYITELKDKLE

SEQ ID NO: 1926439 - protein, 6 aa, Staphylococcus
ATGEPI

SEQ ID NO: 1926440 - protein, 6 aa, Staphylococcus
ATGEQV

SEQ ID NO: 1926441 - protein, 5 aa, Staphylococcus
ATGEV

SEQ ID NO: 1926442 - protein, 4 aa, Staphylococcus
ATGF

SEQ ID NO: 1926443 - protein, 5 aa, Staphylococcus
ATGGT

SEQ ID NO: 1926444 - protein, 12 aa, Staphylococcus
ATGHPKSVEQGL

SEQ ID NO: 1926445 - protein, 11 aa, Staphylococcus
ATGHPYSASGA

SEQ ID NO: 1926446 - protein, 5 aa, Staphylococcus
ATGHT

SEQ ID NO: 1926447 - protein, 9 aa, Staphylococcus
ATGKPATIE

SEQ ID NO: 1926448 - protein, 7 aa, Staphylococcus
ATGKSTI

SEQ ID NO: 1926449 - protein, 9 aa, Staphylococcus
ATGKSTVSE

SEQ ID NO: 1926450 - protein, 4 aa, Staphylococcus
ATGL

SEQ ID NO: 1926451 - protein, 12 aa, Staphylococcus
ATGLPTDVSSTN

SEQ ID NO: 1926452 - protein, 10 aa, Staphylococcus
ATGLSNPMKS

SEQ ID NO: 1926453 - protein, 6 aa, Staphylococcus
ATGNTM

SEQ ID NO: 1926454 - protein, 5 aa, Staphylococcus
ATGNV

SEQ ID NO: 1926455 - protein, 14 aa, Staphylococcus
ATGPKTQLKDLDDD

SEQ ID NO: 1926456 - protein, 6 aa, Staphylococcus
ATGPLK

SEQ ID NO: 1926457 - protein, 6 aa, Staphylococcus
ATGQST

SEQ ID NO: 1926458 - protein, 6 aa, Staphylococcus
ATGQTQ

SEQ ID NO: 1926459 - protein, 6 aa, Staphylococcus
ATGQTT

SEQ ID NO: 1926460 - protein, 6 aa, Staphylococcus
ATGQTV

SEQ ID NO: 1926461 - protein, 10 aa, Staphylococcus
ATGRNPNVEG

SEQ ID NO: 1926462 - protein, 9 aa, Staphylococcus
ATGRRPNVN

SEQ ID NO: 1926463 - protein, 8 aa, Staphylococcus
ATGSDDAI

SEQ ID NO: 1926464 - protein, 15 aa, Staphylococcus
ATGSKTQLSDLDSDD

SEQ ID NO: 1926465 - protein, 4 aa, Staphylococcus
ATGT

SEQ ID NO: 1926466 - protein, 8 aa, Staphylococcus
ATGTGKTI

SEQ ID NO: 1926467 - protein, 15 aa, Staphylococcus
ATGTIGDPSGRTSER

SEQ ID NO: 1926468 - protein, 17 aa, Staphylococcus
ATGTPAGVGAGLQPPKF

SEQ ID NO: 1926469 - protein, 17 aa, Staphylococcus
ATGTPAGVGAGLQPPQF

SEQ ID NO: 1926470 - protein, 15 aa, Staphylococcus
ATGTPAGVGAGMEPP

SEQ ID NO: 1926471 - protein, 24 aa, Staphylococcus
ATGTPAGVGAGMEPPQYLQPGDEV

SEQ ID NO: 1926472 - protein, 17 aa, Staphylococcus
ATGTPAGVGAGMNPPQF

SEQ ID NO: 1926473 - protein, 24 aa, Staphylococcus
ATGTPAGVGAGMNPPQYLQPGDEV

SEQ ID NO: 1926474 - protein, 16 aa, Staphylococcus
ATGTPAGVGAGMQPPQ

SEQ ID NO: 1926475 - protein, 8 aa, Staphylococcus
ATGTQGKI

SEQ ID NO: 1926476 - protein, 5 aa, Staphylococcus
ATGTR

SEQ ID NO: 1926477 - protein, 7 aa, Staphylococcus
ATGTSFR

SEQ ID NO: 1926478 - protein, 14 aa, Staphylococcus
ATGTYDDATKRATY

SEQ ID NO: 1926479 - protein, 13 aa, Staphylococcus
ATHDSDYAKLDDG

SEQ ID NO: 1926480 - protein, 13 aa, Staphylococcus
ATHDSDYGKLDDG

SEQ ID NO: 1926481 - protein, 14 aa, Staphylococcus
ATHDSDYSKLDDGT

SEQ ID NO: 1926482 - protein, 7 aa, Staphylococcus
ATHDTDF

SEQ ID NO: 1926483 - protein, 7 aa, Staphylococcus
ATHDTRC

SEQ ID NO: 1926484 - protein, 4 aa, Staphylococcus
ATHE

SEQ ID NO: 1926485 - protein, 7 aa, Staphylococcus
ATHEGNY

SEQ ID NO: 1926486 - protein, 9 aa, Staphylococcus
ATHKPDQLK

SEQ ID NO: 1926487 - protein, 7 aa, Staphylococcus
ATHNKGV

SEQ ID NO: 1926488 - protein, 6 aa, Staphylococcus
ATHPAL

SEQ ID NO: 1926489 - protein, 5 aa, Staphylococcus
ATHPL

SEQ ID NO: 1926490 - protein, 9 aa, Staphylococcus
ATHRKSGYG

SEQ ID NO: 1926491 - protein, 11 aa, Staphylococcus
ATHSDNDLQPL

SEQ ID NO: 1926492 - protein, 10 aa, Staphylococcus
ATHSKATPAV

SEQ ID NO: 1926493 - protein, 17 aa, Staphylococcus
ATHSNYLEKSWKNMFLI

SEQ ID NO: 1926494 - protein, 12 aa, Staphylococcus
ATHSQSVSTETN

SEQ ID NO: 1926495 - protein, 8 aa, Staphylococcus
ATIDDNGR

SEQ ID NO: 1926496 - protein, 9 aa, Staphylococcus
ATIDGDKQI

SEQ ID NO: 1926497 - protein, 8 aa, Staphylococcus
ATIDTNDK

SEQ ID NO: 1926498 - protein, 14 aa, Staphylococcus
ATIESARKKYPQKE

SEQ ID NO: 1926499 - protein, 14 aa, Staphylococcus
ATIETARKKYPNKE

SEQ ID NO: 1926500 - protein, 13 aa, Staphylococcus
ATIETSETTKQGL

SEQ ID NO: 1926501 - protein, 14 aa, Staphylococcus
ATIETSSFASGSAI

SEQ ID NO: 1926502 - protein, 12 aa, Staphylococcus
ATIGSQMADTTR

SEQ ID NO: 1926503 - protein, 6 aa, Staphylococcus
ATIKPI

SEQ ID NO: 1926504 - protein, 6 aa, Staphylococcus
ATINDE

SEQ ID NO: 1926505 - protein, 10 aa, Staphylococcus
ATINDEPISH

SEQ ID NO: 1926506 - protein, 14 aa, Staphylococcus
ATITDAENVPKSDK

SEQ ID NO: 1926507 - protein, 7 aa, Staphylococcus
ATITDKT

SEQ ID NO: 1926508 - protein, 7 aa, Staphylococcus
ATITSKA

SEQ ID NO: 1926509 - protein, 9 aa, Staphylococcus
ATKAGGLPV

SEQ ID NO: 1926510 - protein, 11 aa, Staphylococcus
ATKAKTTTSVD

SEQ ID NO: 1926511 - protein, 19 aa, Staphylococcus
ATKARNGQLTQADMEGGTF

SEQ ID NO: 1926512 - protein, 11 aa, Staphylococcus
ATKASSFKPTN

SEQ ID NO: 1926513 - protein, 13 aa, Staphylococcus
ATKDLDKKLSRSK

SEQ ID NO: 1926514 - protein, 8 aa, Staphylococcus
ATKDSTEL

SEQ ID NO: 1926515 - protein, 17 aa, Staphylococcus
ATKEARDRAVAGEGPTL

SEQ ID NO: 1926516 - protein, 17 aa, Staphylococcus
ATKEARDRAVNGDGPTL

SEQ ID NO: 1926517 - protein, 17 aa, Staphylococcus
ATKEARDRAVNGEGPTL

SEQ ID NO: 1926518 - protein, 17 aa, Staphylococcus
ATKEARERAVAGEGPTL

SEQ ID NO: 1926519 - protein, 10 aa, Staphylococcus
ATKEDMQNLK

SEQ ID NO: 1926520 - protein, 10 aa, Staphylococcus
ATKEDMQTLK

SEQ ID NO: 1926521 - protein, 9 aa, Staphylococcus
ATKEGGLPV

SEQ ID NO: 1926522 - protein, 6 aa, Staphylococcus
ATKEIK

SEQ ID NO: 1926523 - protein, 8 aa, Staphylococcus
ATKENHHA

SEQ ID NO: 1926524 - protein, 7 aa, Staphylococcus
ATKGSHV

SEQ ID NO: 1926525 - protein, 8 aa, Staphylococcus
ATKGSHVI

SEQ ID NO: 1926526 - protein, 7 aa, Staphylococcus
ATKHAAK

SEQ ID NO: 1926527 - protein, 12 aa, Staphylococcus
ATKKETDLAKEG

SEQ ID NO: 1926528 - protein, 5 aa, Staphylococcus
ATKKN

SEQ ID NO: 1926529 - protein, 13 aa, Staphylococcus
ATKLTSMIDEYCK

SEQ ID NO: 1926530 - protein, 8 aa, Staphylococcus
ATKNNTKL

SEQ ID NO: 1926531 - protein, 7 aa, Staphylococcus
ATKNQTQ

SEQ ID NO: 1926532 - protein, 9 aa, Staphylococcus
ATKNRDQNN

SEQ ID NO: 1926533 - protein, 10 aa, Staphylococcus
ATKNTSQYRA

SEQ ID NO: 1926534 - protein, 12 aa, Staphylococcus
ATKQKRPKESLE

SEQ ID NO: 1926535 - protein, 11 aa, Staphylococcus
ATKQKRPKETL

SEQ ID NO: 1926536 - protein, 12 aa, Staphylococcus
ATKQTRPKESLS

SEQ ID NO: 1926537 - protein, 12 aa, Staphylococcus
ATKQTRPKETLS

SEQ ID NO: 1926538 - protein, 4 aa, Staphylococcus
ATKV

SEQ ID NO: 1926539 - protein, 7 aa, Staphylococcus
ATLAGEV

SEQ ID NO: 1926540 - protein, 13 aa, Staphylococcus
ATLEKTNPKQDGV

SEQ ID NO: 1926541 - protein, 5 aa, Staphylococcus
ATLEN

SEQ ID NO: 1926542 - protein, 6 aa, Staphylococcus
ATLGDE

SEQ ID NO: 1926543 - protein, 12 aa, Staphylococcus
ATLGSQLANPHR

SEQ ID NO: 1926544 - protein, 6 aa, Staphylococcus
ATLGTE

SEQ ID NO: 1926545 - protein, 12 aa, Staphylococcus
ATLGTQIADPQR

SEQ ID NO: 1926546 - protein, 13 aa, Staphylococcus
ATLGTQMADTSRR

SEQ ID NO: 1926547 - protein, 13 aa, Staphylococcus
ATLGTQMANSNRR

SEQ ID NO: 1926548 - protein, 4 aa, Staphylococcus
ATLK

SEQ ID NO: 1926549 - protein, 7 aa, Staphylococcus
ATLNGKE

SEQ ID NO: 1926550 - protein, 6 aa, Staphylococcus
ATLNGM

SEQ ID NO: 1926551 - protein, 43 aa, Staphylococcus
ATLPKEDVIESDESTTQSYLENDNDEDNPTLGDVFGDKFKDLK

SEQ ID NO: 1926552 - protein, 43 aa, Staphylococcus
ATLPKEDVVESDDATTQSYLSNDSIEDNPTLGDVFGDKFKDLK

SEQ ID NO: 1926553 - protein, 32 aa, Staphylococcus
ATLPNEDVIESDEATTQSYIDNDSDDDNPTLG

SEQ ID NO: 1926554 - protein, 43 aa, Staphylococcus
ATLPNEDVIESDEATTQSYLSNETDEDNPTLGDVFGDKFKNLK

SEQ ID NO: 1926555 - protein, 43 aa, Staphylococcus
ATLPNEDVVESDASTTQSYLNNDADEDNPTLGDVFGDKFKDLK

SEQ ID NO: 1926556 - protein, 44 aa, Staphylococcus
ATLPNENVIESDSETTQSYLDNGSDDEDNPTLGDVFGDKLKDFK

SEQ ID NO: 1926557 - protein, 6 aa, Staphylococcus
ATLPTS

SEQ ID NO: 1926558 - protein, 19 aa, Staphylococcus
ATLSANGATVVPSGFNKSG

SEQ ID NO: 1926559 - protein, 5 aa, Staphylococcus
ATLSD

SEQ ID NO: 1926560 - protein, 20 aa, Staphylococcus
ATLSDESESIDTPAPDEHFG

SEQ ID NO: 1926561 - protein, 6 aa, Staphylococcus
ATLSPL

SEQ ID NO: 1926562 - protein, 9 aa, Staphylococcus
ATLTDKGQQ

SEQ ID NO: 1926563 - protein, 19 aa, Staphylococcus
ATLTPSGTTVVPSGFNKSG

SEQ ID NO: 1926564 - protein, 6 aa, Staphylococcus
ATLTTT

SEQ ID NO: 1926565 - protein, 5 aa, Staphylococcus
ATMGT

SEQ ID NO: 1926566 - protein, 10 aa, Staphylococcus
ATMKTDNGST

SEQ ID NO: 1926567 - protein, 10 aa, Staphylococcus
ATMKTENGST

SEQ ID NO: 1926568 - protein, 4 aa, Staphylococcus
ATMS

SEQ ID NO: 1926569 - protein, 4 aa, Staphylococcus
ATNA

SEQ ID NO: 1926570 - protein, 18 aa, Staphylococcus
ATNAGQIKTGSLSRTDRI

SEQ ID NO: 1926571 - protein, 6 aa, Staphylococcus
ATNDFD

SEQ ID NO: 1926572 - protein, 23 aa, Staphylococcus
ATNEDAERYAQTIANKVKEKMGL

SEQ ID NO: 1926573 - protein, 9 aa, Staphylococcus
ATNEDAQRF

SEQ ID NO: 1926574 - protein, 8 aa, Staphylococcus
ATNEITDA

SEQ ID NO: 1926575 - protein, 11 aa, Staphylococcus
ATNETYKITNN

SEQ ID NO: 1926576 - protein, 4 aa, Staphylococcus
ATNG

SEQ ID NO: 1926577 - protein, 10 aa, Staphylococcus
ATNGGKIKPT

SEQ ID NO: 1926578 - protein, 7 aa, Staphylococcus
ATNGTFT

SEQ ID NO: 1926579 - protein, 7 aa, Staphylococcus
ATNHPDQ

SEQ ID NO: 1926580 - protein, 10 aa, Staphylococcus
ATNKPLPNLE

SEQ ID NO: 1926581 - protein, 4 aa, Staphylococcus
ATNL

SEQ ID NO: 1926582 - protein, 5 aa, Staphylococcus
ATNLG

SEQ ID NO: 1926583 - protein, 6 aa, Staphylococcus
ATNQKL

SEQ ID NO: 1926584 - protein, 8 aa, Staphylococcus
ATNSNHPV

SEQ ID NO: 1926585 - protein, 9 aa, Staphylococcus
ATNSNKPVY

SEQ ID NO: 1926586 - protein, 13 aa, Staphylococcus
ATNTTVSNNEEDL

SEQ ID NO: 1926587 - protein, 7 aa, Staphylococcus
ATNVPSH

SEQ ID NO: 1926588 - protein, 12 aa, Staphylococcus
ATNYCKDNNKGL

SEQ ID NO: 1926589 - protein, 6 aa, Staphylococcus
ATPADN

SEQ ID NO: 1926590 - protein, 7 aa, Staphylococcus
ATPDNIP

SEQ ID NO: 1926591 - protein, 9 aa, Staphylococcus
ATPDNIPES

SEQ ID NO: 1926592 - protein, 6 aa, Staphylococcus
ATPDQV

SEQ ID NO: 1926593 - protein, 6 aa, Staphylococcus
ATPDQY

SEQ ID NO: 1926594 - protein, 10 aa, Staphylococcus
ATPEDNMNTQ

SEQ ID NO: 1926595 - protein, 6 aa, Staphylococcus
ATPEEI

SEQ ID NO: 1926596 - protein, 7 aa, Staphylococcus
ATPENIP

SEQ ID NO: 1926597 - protein, 10 aa, Staphylococcus
ATPEVSGEAQ

SEQ ID NO: 1926598 - protein, 7 aa, Staphylococcus
ATPGPFE

SEQ ID NO: 1926599 - protein, 7 aa, Staphylococcus
ATPGPYE

SEQ ID NO: 1926600 - protein, 4 aa, Staphylococcus
ATPH

SEQ ID NO: 1926601 - protein, 5 aa, Staphylococcus
ATPIN

SEQ ID NO: 1926602 - protein, 8 aa, Staphylococcus
ATPKHTEG

SEQ ID NO: 1926603 - protein, 7 aa, Staphylococcus
ATPNIAT

SEQ ID NO: 1926604 - protein, 11 aa, Staphylococcus
ATPNKSHYSQE

SEQ ID NO: 1926605 - protein, 9 aa, Staphylococcus
ATPNLPEAE

SEQ ID NO: 1926606 - protein, 12 aa, Staphylococcus
ATPNLPEAEEIT

SEQ ID NO: 1926607 - protein, 6 aa, Staphylococcus
ATPPLK

SEQ ID NO: 1926608 - protein, 6 aa, Staphylococcus
ATPPQK

SEQ ID NO: 1926609 - protein, 6 aa, Staphylococcus
ATPQEI

SEQ ID NO: 1926610 - protein, 7 aa, Staphylococcus
ATPQELD

SEQ ID NO: 1926611 - protein, 6 aa, Staphylococcus
ATPQNV

SEQ ID NO: 1926612 - protein, 8 aa, Staphylococcus
ATPSEDET

SEQ ID NO: 1926613 - protein, 14 aa, Staphylococcus
ATPSKDDASEPVGP

SEQ ID NO: 1926614 - protein, 13 aa, Staphylococcus
ATPSLETYARAEK

SEQ ID NO: 1926615 - protein, 12 aa, Staphylococcus
ATPSLNQKLAQS

SEQ ID NO: 1926616 - protein, 12 aa, Staphylococcus
ATPSRKLRSQFK

SEQ ID NO: 1926617 - protein, 8 aa, Staphylococcus
ATPTLEEG

SEQ ID NO: 1926618 - protein, 6 aa, Staphylococcus
ATPTQS

SEQ ID NO: 1926619 - protein, 9 aa, Staphylococcus
ATPTVGVTD

SEQ ID NO: 1926620 - protein, 13 aa, Staphylococcus
ATPYELVGENYRD

SEQ ID NO: 1926621 - protein, 7 aa, Staphylococcus
ATQANAL

SEQ ID NO: 1926622 - protein, 10 aa, Staphylococcus
ATQDRGTKTL

SEQ ID NO: 1926623 - protein, 16 aa, Staphylococcus
ATQEAVDRAKKGEGPT

SEQ ID NO: 1926624 - protein, 5 aa, Staphylococcus
ATQEE

SEQ ID NO: 1926625 - protein, 14 aa, Staphylococcus
ATQEEVKDLVNNIS

SEQ ID NO: 1926626 - protein, 7 aa, Staphylococcus
ATQFQPQ

SEQ ID NO: 1926627 - protein, 9 aa, Staphylococcus
ATQGASPKL

SEQ ID NO: 1926628 - protein, 4 aa, Staphylococcus
ATQL

SEQ ID NO: 1926629 - protein, 6 aa, Staphylococcus
ATQNED

SEQ ID NO: 1926630 - protein, 6 aa, Staphylococcus
ATQNEQ

SEQ ID NO: 1926631 - protein, 7 aa, Staphylococcus
ATQPEGI

SEQ ID NO: 1926632 - protein, 8 aa, Staphylococcus
ATQQPDEL

SEQ ID NO: 1926633 - protein, 6 aa, Staphylococcus
ATQSIE

SEQ ID NO: 1926634 - protein, 9 aa, Staphylococcus
ATQSIGKSI

SEQ ID NO: 1926635 - protein, 8 aa, Staphylococcus
ATQTETEL

SEQ ID NO: 1926636 - protein, 8 aa, Staphylococcus
ATQTMTDL

SEQ ID NO: 1926637 - protein, 6 aa, Staphylococcus
ATQTRQ

SEQ ID NO: 1926638 - protein, 8 aa, Staphylococcus
ATRDISEE

SEQ ID NO: 1926639 - protein, 7 aa, Staphylococcus
ATREELT

SEQ ID NO: 1926640 - protein, 10 aa, Staphylococcus
ATRGLQDKYG

SEQ ID NO: 1926641 - protein, 8 aa, Staphylococcus
ATRIGASA

SEQ ID NO: 1926642 - protein, 5 aa, Staphylococcus
ATRIQ

SEQ ID NO: 1926643 - protein, 4 aa, Staphylococcus
ATRK

SEQ ID NO: 1926644 - protein, 7 aa, Staphylococcus
ATRKAEV

SEQ ID NO: 1926645 - protein, 5 aa, Staphylococcus
ATRMN

SEQ ID NO: 1926646 - protein, 4 aa, Staphylococcus
ATRP

SEQ ID NO: 1926647 - protein, 6 aa, Staphylococcus
ATRPVT

SEQ ID NO: 1926648 - protein, 5 aa, Staphylococcus
ATRQK

SEQ ID NO: 1926649 - protein, 6 aa, Staphylococcus
ATRSAL

SEQ ID NO: 1926650 - protein, 28 aa, Staphylococcus
ATRSCSSISEPGKDESTTVSGNKNAHTA

SEQ ID NO: 1926651 - protein, 15 aa, Staphylococcus
ATSADEIKQVFEEAD

SEQ ID NO: 1926652 - protein, 8 aa, Staphylococcus
ATSADTLD

SEQ ID NO: 1926653 - protein, 12 aa, Staphylococcus
ATSAEEVRERGI

SEQ ID NO: 1926654 - protein, 9 aa, Staphylococcus
ATSAKEDVS

SEQ ID NO: 1926655 - protein, 6 aa, Staphylococcus
ATSALD

SEQ ID NO: 1926656 - protein, 15 aa, Staphylococcus
ATSALDADNTEKAED

SEQ ID NO: 1926657 - protein, 12 aa, Staphylococcus
ATSALDPATTDS

SEQ ID NO: 1926658 - protein, 11 aa, Staphylococcus
ATSANEVRQRG

SEQ ID NO: 1926659 - protein, 10 aa, Staphylococcus
ATSARLAKSE

SEQ ID NO: 1926660 - protein, 5 aa, Staphylococcus
ATSDE

SEQ ID NO: 1926661 - protein, 9 aa, Staphylococcus
ATSDESSDM

SEQ ID NO: 1926662 - protein, 12 aa, Staphylococcus
ATSEDNATASRA

SEQ ID NO: 1926663 - protein, 5 aa, Staphylococcus
ATSEI

SEQ ID NO: 1926664 - protein, 10 aa, Staphylococcus
ATSENKFENK

SEQ ID NO: 1926665 - protein, 8 aa, Staphylococcus
ATSEVDGI

SEQ ID NO: 1926666 - protein, 8 aa, Staphylococcus
ATSEVKGI

SEQ ID NO: 1926667 - protein, 9 aa, Staphylococcus
ATSGGGGKG

SEQ ID NO: 1926668 - protein, 6 aa, Staphylococcus
ATSGTT

SEQ ID NO: 1926669 - protein, 9 aa, Staphylococcus
ATSKELQKE

SEQ ID NO: 1926670 - protein, 5 aa, Staphylococcus
ATSKV

SEQ ID NO: 1926671 - protein, 13 aa, Staphylococcus
ATSLTEAGYVGED

SEQ ID NO: 1926672 - protein, 9 aa, Staphylococcus
ATSNDELGE

SEQ ID NO: 1926673 - protein, 6 aa, Staphylococcus
ATSNLD

SEQ ID NO: 1926674 - protein, 7 aa, Staphylococcus
ATSPQTM

SEQ ID NO: 1926675 - protein, 15 aa, Staphylococcus
ATSRPKKIGGERAKY

SEQ ID NO: 1926676 - protein, 7 aa, Staphylococcus
ATSRPLT

SEQ ID NO: 1926677 - protein, 7 aa, Staphylococcus
ATSSKIH

SEQ ID NO: 1926678 - protein, 18 aa, Staphylococcus
ATSSSDEKLEKAKELGAS

SEQ ID NO: 1926679 - protein, 12 aa, Staphylococcus
ATSSSRSNIQPT

SEQ ID NO: 1926680 - protein, 8 aa, Staphylococcus
ATSTKTTL

SEQ ID NO: 1926681 - protein, 14 aa, Staphylococcus
ATSVEEAVENENAG

SEQ ID NO: 1926682 - protein, 15 aa, Staphylococcus
ATSYDDQQSKYTPAW

SEQ ID NO: 1926683 - protein, 7 aa, Staphylococcus
ATSYDRQ

SEQ ID NO: 1926684 - protein, 9 aa, Staphylococcus
ATSYTSEGQ

SEQ ID NO: 1926685 - protein, 10 aa, Staphylococcus
ATTDKGEQFE

SEQ ID NO: 1926686 - protein, 12 aa, Staphylococcus
ATTDKQKGALKQ

SEQ ID NO: 1926687 - protein, 19 aa, Staphylococcus
ATTDKQKGALKQLATNEGY

SEQ ID NO: 1926688 - protein, 20 aa, Staphylococcus
ATTDKSKGALKQLADNEGYE

SEQ ID NO: 1926689 - protein, 16 aa, Staphylococcus
ATTEESLDLGGFEPCQ

SEQ ID NO: 1926690 - protein, 9 aa, Staphylococcus
ATTERDEAE

SEQ ID NO: 1926691 - protein, 6 aa, Staphylococcus
ATTFAT

SEQ ID NO: 1926692 - protein, 13 aa, Staphylococcus
ATTFDKDGHPPKL

SEQ ID NO: 1926693 - protein, 8 aa, Staphylococcus
ATTGASEI

SEQ ID NO: 1926694 - protein, 11 aa, Staphylococcus
ATTGENGQFHP

SEQ ID NO: 1926695 - protein, 12 aa, Staphylococcus
ATTGENGQFHPE

SEQ ID NO: 1926696 - protein, 20 aa, Staphylococcus
ATTGNNRSHALNANKRRFNA

SEQ ID NO: 1926697 - protein, 18 aa, Staphylococcus
ATTGQNALSQAKSFKEVT

SEQ ID NO: 1926698 - protein, 14 aa, Staphylococcus
ATTGQNALSQARSF

SEQ ID NO: 1926699 - protein, 13 aa, Staphylococcus
ATTGQNALSQART

SEQ ID NO: 1926700 - protein, 13 aa, Staphylococcus
ATTGQSALSQARS

SEQ ID NO: 1926701 - protein, 7 aa, Staphylococcus
ATTHQTN

SEQ ID NO: 1926702 - protein, 7 aa, Staphylococcus
ATTHQYG

SEQ ID NO: 1926703 - protein, 7 aa, Staphylococcus
ATTKESV

SEQ ID NO: 1926704 - protein, 5 aa, Staphylococcus
ATTLD

SEQ ID NO: 1926705 - protein, 9 aa, Staphylococcus
ATTLEQAGC

SEQ ID NO: 1926706 - protein, 11 aa, Staphylococcus
ATTLSKNNGFA

SEQ ID NO: 1926707 - protein, 8 aa, Staphylococcus
ATTLSNKG

SEQ ID NO: 1926708 - protein, 7 aa, Staphylococcus
ATTNLER

SEQ ID NO: 1926709 - protein, 7 aa, Staphylococcus
ATTPSEW

SEQ ID NO: 1926710 - protein, 11 aa, Staphylococcus
ATTQTRPKESL

SEQ ID NO: 1926711 - protein, 6 aa, Staphylococcus
ATTSYG

SEQ ID NO: 1926712 - protein, 10 aa, Staphylococcus
ATTTSNKNRT

SEQ ID NO: 1926713 - protein, 7 aa, Staphylococcus
ATTVDEA

SEQ ID NO: 1926714 - protein, 17 aa, Staphylococcus
ATVANAARYRNKADLEK

SEQ ID NO: 1926715 - protein, 8 aa, Staphylococcus
ATVEKEKG

SEQ ID NO: 1926716 - protein, 6 aa, Staphylococcus
ATVENS

SEQ ID NO: 1926717 - protein, 11 aa, Staphylococcus
ATVEQKPKMDG

SEQ ID NO: 1926718 - protein, 25 aa, Staphylococcus
ATVGAEVDASVNKEDRRAIQKNHSA

SEQ ID NO: 1926719 - protein, 4 aa, Staphylococcus
ATVI

SEQ ID NO: 1926720 - protein, 4 aa, Staphylococcus
ATVK

SEQ ID NO: 1926721 - protein, 8 aa, Staphylococcus
ATVKDSGV

SEQ ID NO: 1926722 - protein, 8 aa, Staphylococcus
ATVKNDKQ

SEQ ID NO: 1926723 - protein, 10 aa, Staphylococcus
ATVKTMSPEE

SEQ ID NO: 1926724 - protein, 12 aa, Staphylococcus
ATVKTMSPEELK

SEQ ID NO: 1926725 - protein, 12 aa, Staphylococcus
ATVNESKVTETM

SEQ ID NO: 1926726 - protein, 6 aa, Staphylococcus
ATVSGL

SEQ ID NO: 1926727 - protein, 19 aa, Staphylococcus
ATVTQVAKASATALGLKPN

SEQ ID NO: 1926728 - protein, 7 aa, Staphylococcus
ATVTTPN

SEQ ID NO: 1926729 - protein, 11 aa, Staphylococcus
ATVVPEGEKIP

SEQ ID NO: 1926730 - protein, 19 aa, Staphylococcus
ATWNASHSDINVSSLAQAE

SEQ ID NO: 1926731 - protein, 4 aa, Staphylococcus
ATWS

SEQ ID NO: 1926732 - protein, 9 aa, Staphylococcus
ATWSGEGGG

SEQ ID NO: 1926733 - protein, 15 aa, Staphylococcus
ATYDEANEAVDNGAK

SEQ ID NO: 1926734 - protein, 5 aa, Staphylococcus
ATYDK

SEQ ID NO: 1926735 - protein, 6 aa, Staphylococcus
ATYDSQ

SEQ ID NO: 1926736 - protein, 13 aa, Staphylococcus
ATYFDSNAQPKAL

SEQ ID NO: 1926737 - protein, 13 aa, Staphylococcus
ATYGKDPETKGAY

SEQ ID NO: 1926738 - protein, 14 aa, Staphylococcus
ATYGKDPETKGEYW

SEQ ID NO: 1926739 - protein, 4 aa, Staphylococcus
ATYP

SEQ ID NO: 1926740 - protein, 5 aa, Staphylococcus
ATYPE

SEQ ID NO: 1926741 - protein, 6 aa, Staphylococcus
ATYQAQ

SEQ ID NO: 1926742 - protein, 13 aa, Staphylococcus
ATYTKEDAFDQSA

SEQ ID NO: 1926743 - protein, 13 aa, Staphylococcus
ATYTKEDAFNQES

SEQ ID NO: 1926744 - protein, 12 aa, Staphylococcus
ATYTKEDAFNQS

SEQ ID NO: 1926745 - protein, 14 aa, Staphylococcus
ATYTTDSNEESGVG

SEQ ID NO: 1926746 - protein, 10 aa, Staphylococcus
ATYVESDKGS

SEQ ID NO: 1926747 - protein, 10 aa, Staphylococcus
ATYVESEKGS

SEQ ID NO: 1926748 - protein, 8 aa, Staphylococcus
AVAAGESV

SEQ ID NO: 1926749 - protein, 6 aa, Staphylococcus
AVAEEP

SEQ ID NO: 1926750 - protein, 30 aa, Staphylococcus
AVAEGKGKTKKESEQKAAEQAYKSMKKNES

SEQ ID NO: 1926751 - protein, 29 aa, Staphylococcus
AVAEGKGKTKKESEQKAAERAYKILKNKN

SEQ ID NO: 1926752 - protein, 11 aa, Staphylococcus
AVAGGIKPETI

SEQ ID NO: 1926753 - protein, 6 aa, Staphylococcus
AVAGKF

SEQ ID NO: 1926754 - protein, 12 aa, Staphylococcus
AVAGSDKNSRHP

SEQ ID NO: 1926755 - protein, 13 aa, Staphylococcus
AVAGSNKSSSHPM

SEQ ID NO: 1926756 - protein, 18 aa, Staphylococcus
AVAGTIKRSQNEQEDEAN

SEQ ID NO: 1926757 - protein, 19 aa, Staphylococcus
AVAGTIKRTHEEAEDKANV

SEQ ID NO: 1926758 - protein, 9 aa, Staphylococcus
AVAKTSMSN

SEQ ID NO: 1926759 - protein, 9 aa, Staphylococcus
AVANNQTQL

SEQ ID NO: 1926760 - protein, 5 aa, Staphylococcus
AVAQI

SEQ ID NO: 1926761 - protein, 12 aa, Staphylococcus
AVAQRGKVELNE

SEQ ID NO: 1926762 - protein, 6 aa, Staphylococcus
AVASGA

SEQ ID NO: 1926763 - protein, 11 aa, Staphylococcus
AVASGTATAFT

SEQ ID NO: 1926764 - protein, 9 aa, Staphylococcus
AVATDEQSL

SEQ ID NO: 1926765 - protein, 9 aa, Staphylococcus
AVATEPDND

SEQ ID NO: 1926766 - protein, 9 aa, Staphylococcus
AVATNEVNA

SEQ ID NO: 1926767 - protein, 11 aa, Staphylococcus
AVATSTEDVVA

SEQ ID NO: 1926768 - protein, 5 aa, Staphylococcus
AVDAG

SEQ ID NO: 1926769 - protein, 27 aa, Staphylococcus
AVDAGASPLSEKHDNSRYEDSEGSSSV

SEQ ID NO: 1926770 - protein, 5 aa, Staphylococcus
AVDDF

SEQ ID NO: 1926771 - protein, 6 aa, Staphylococcus
AVDDRT

SEQ ID NO: 1926772 - protein, 7 aa, Staphylococcus
AVDEETF

SEQ ID NO: 1926773 - protein, 6 aa, Staphylococcus
AVDETV

SEQ ID NO: 1926774 - protein, 5 aa, Staphylococcus
AVDGL

SEQ ID NO: 1926775 - protein, 5 aa, Staphylococcus
AVDID

SEQ ID NO: 1926776 - protein, 13 aa, Staphylococcus
AVDKDGEKHPLTQ

SEQ ID NO: 1926777 - protein, 13 aa, Staphylococcus
AVDKDGNKHPLTQ

SEQ ID NO: 1926778 - protein, 13 aa, Staphylococcus
AVDKDGNTHSLTQ

SEQ ID NO: 1926779 - protein, 13 aa, Staphylococcus
AVDKGHDDDFGKN

SEQ ID NO: 1926780 - protein, 17 aa, Staphylococcus
AVDKGTSFGASTLEENK

SEQ ID NO: 1926781 - protein, 17 aa, Staphylococcus
AVDKGTSFGASTLKENQ

SEQ ID NO: 1926782 - protein, 7 aa, Staphylococcus
AVDNGDG

SEQ ID NO: 1926783 - protein, 16 aa, Staphylococcus
AVDNGTSFGASTLQEN

SEQ ID NO: 1926784 - protein, 12 aa, Staphylococcus
AVDQSVQSLKEA

SEQ ID NO: 1926785 - protein, 10 aa, Staphylococcus
AVDTTGAGDA

SEQ ID NO: 1926786 - protein, 9 aa, Staphylococcus
AVEAGAESM

SEQ ID NO: 1926787 - protein, 5 aa, Staphylococcus
AVEAI

SEQ ID NO: 1926788 - protein, 36 aa, Staphylococcus
AVEATPGNLKQLEQQNKRAAADRQQEIDEAKALKAK

SEQ ID NO: 1926789 - protein, 36 aa, Staphylococcus
AVEATPGNLKQLEQQNRRAEADRQQEIDDAKALKAK

SEQ ID NO: 1926790 - protein, 12 aa, Staphylococcus
AVEATQVFKLED

SEQ ID NO: 1926791 - protein, 4 aa, Staphylococcus
AVED

SEQ ID NO: 1926792 - protein, 7 aa, Staphylococcus
AVEDEQS

SEQ ID NO: 1926793 - protein, 5 aa, Staphylococcus
AVEED

SEQ ID NO: 1926794 - protein, 7 aa, Staphylococcus
AVEEQRI

SEQ ID NO: 1926795 - protein, 6 aa, Staphylococcus
AVEGLP

SEQ ID NO: 1926796 - protein, 12 aa, Staphylococcus
AVEGTDLEAKSI

SEQ ID NO: 1926797 - protein, 12 aa, Staphylococcus
AVEGTDLESKSI

SEQ ID NO: 1926798 - protein, 12 aa, Staphylococcus
AVEGTKNTAISD

SEQ ID NO: 1926799 - protein, 5 aa, Staphylococcus
AVEHP

SEQ ID NO: 1926800 - protein, 10 aa, Staphylococcus
AVEKDTNTMK

SEQ ID NO: 1926801 - protein, 11 aa, Staphylococcus
AVEKTTGANRE

SEQ ID NO: 1926802 - protein, 12 aa, Staphylococcus
AVENSWNDINKL

SEQ ID NO: 1926803 - protein, 4 aa, Staphylococcus
AVEP

SEQ ID NO: 1926804 - protein, 13 aa, Staphylococcus
AVEQAENDVKKAS

SEQ ID NO: 1926805 - protein, 14 aa, Staphylococcus
AVEQERNEAKKAEL

SEQ ID NO: 1926806 - protein, 7 aa, Staphylococcus
AVEQQDA

SEQ ID NO: 1926807 - protein, 5 aa, Staphylococcus
AVERS

SEQ ID NO: 1926808 - protein, 4 aa, Staphylococcus
AVES

SEQ ID NO: 1926809 - protein, 16 aa, Staphylococcus
AVESAQKRVEGNNFDA

SEQ ID NO: 1926810 - protein, 12 aa, Staphylococcus
AVESAVGNIEGV

SEQ ID NO: 1926811 - protein, 6 aa, Staphylococcus
AVETSR

SEQ ID NO: 1926812 - protein, 10 aa, Staphylococcus
AVGAKEGGVV

SEQ ID NO: 1926813 - protein, 9 aa, Staphylococcus
AVGDESEVR

SEQ ID NO: 1926814 - protein, 10 aa, Staphylococcus
AVGEDGEIKG

SEQ ID NO: 1926815 - protein, 9 aa, Staphylococcus
AVGENGEIK

SEQ ID NO: 1926816 - protein, 6 aa, Staphylococcus
AVGGGN

SEQ ID NO: 1926817 - protein, 8 aa, Staphylococcus
AVGGGNYN

SEQ ID NO: 1926818 - protein, 8 aa, Staphylococcus
AVGGGNYP

SEQ ID NO: 1926819 - protein, 7 aa, Staphylococcus
AVGHTGE

SEQ ID NO: 1926820 - protein, 5 aa, Staphylococcus
AVGND

SEQ ID NO: 1926821 - protein, 9 aa, Staphylococcus
AVGNKGHVT

SEQ ID NO: 1926822 - protein, 12 aa, Staphylococcus
AVGNPGQANYVA

SEQ ID NO: 1926823 - protein, 9 aa, Staphylococcus
AVGPQGEVT

SEQ ID NO: 1926824 - protein, 7 aa, Staphylococcus
AVGPSGE

SEQ ID NO: 1926825 - protein, 4 aa, Staphylococcus
AVGR

SEQ ID NO: 1926826 - protein, 8 aa, Staphylococcus
AVGSKGTV

SEQ ID NO: 1926827 - protein, 8 aa, Staphylococcus
AVGTDGSI

SEQ ID NO: 1926828 - protein, 8 aa, Staphylococcus
AVGTDGTL

SEQ ID NO: 1926829 - protein, 7 aa, Staphylococcus
AVGTEGA

SEQ ID NO: 1926830 - protein, 8 aa, Staphylococcus
AVGTEGSI

SEQ ID NO: 1926831 - protein, 13 aa, Staphylococcus
AVGTGSQKSNVTS

SEQ ID NO: 1926832 - protein, 10 aa, Staphylococcus
AVGTKEGGVV

SEQ ID NO: 1926833 - protein, 8 aa, Staphylococcus
AVGTNGSI

SEQ ID NO: 1926834 - protein, 5 aa, Staphylococcus
AVGTT

SEQ ID NO: 1926835 - protein, 8 aa, Staphylococcus
AVHGEDAN

SEQ ID NO: 1926836 - protein, 11 aa, Staphylococcus
AVHGESGMEGY

SEQ ID NO: 1926837 - protein, 5 aa, Staphylococcus
AVHGM

SEQ ID NO: 1926838 - protein, 30 aa, Staphylococcus
AVKAQQAREAARKAREDARTGKKNKRKDTL

SEQ ID NO: 1926839 - protein, 14 aa, Staphylococcus
AVKDNKNNKNNKNN

SEQ ID NO: 1926840 - protein, 17 aa, Staphylococcus
AVKDQRPNALSGGQQQR

SEQ ID NO: 1926841 - protein, 15 aa, Staphylococcus
AVKDTIKKASIASGV

SEQ ID NO: 1926842 - protein, 6 aa, Staphylococcus
AVKEGM

SEQ ID NO: 1926843 - protein, 12 aa, Staphylococcus
AVKGELDDKNTI

SEQ ID NO: 1926844 - protein, 14 aa, Staphylococcus
AVKGSGKNGRITKA

SEQ ID NO: 1926845 - protein, 5 aa, Staphylococcus
AVKGT

SEQ ID NO: 1926846 - protein, 11 aa, Staphylococcus
AVKIGKDINPE

SEQ ID NO: 1926847 - protein, 11 aa, Staphylococcus
AVKIGKEINPD

SEQ ID NO: 1926848 - protein, 8 aa, Staphylococcus
AVKKGYDM

SEQ ID NO: 1926849 - protein, 8 aa, Staphylococcus
AVKNGADE

SEQ ID NO: 1926850 - protein, 8 aa, Staphylococcus
AVKNGNVY

SEQ ID NO: 1926851 - protein, 9 aa, Staphylococcus
AVKNKETQF

SEQ ID NO: 1926852 - protein, 16 aa, Staphylococcus
AVKNVENSTRGHDSED

SEQ ID NO: 1926853 - protein, 6 aa, Staphylococcus
AVKQDK

SEQ ID NO: 1926854 - protein, 13 aa, Staphylococcus
AVKSDNEASVEDN

SEQ ID NO: 1926855 - protein, 9 aa, Staphylococcus
AVKSGEAHG

SEQ ID NO: 1926856 - protein, 15 aa, Staphylococcus
AVKTNTDALKRARTN

SEQ ID NO: 1926857 - protein, 4 aa, Staphylococcus
AVND

SEQ ID NO: 1926858 - protein, 8 aa, Staphylococcus
AVNDETIE

SEQ ID NO: 1926859 - protein, 8 aa, Staphylococcus
AVNDGLKN

SEQ ID NO: 1926860 - protein, 9 aa, Staphylococcus
AVNDGLKSF

SEQ ID NO: 1926861 - protein, 13 aa, Staphylococcus
AVNESDVTLANAS

SEQ ID NO: 1926862 - protein, 19 aa, Staphylococcus
AVNGDANGSIPTSEPQKYR

SEQ ID NO: 1926863 - protein, 18 aa, Staphylococcus
AVNGTASLDPEKQDENMQ

SEQ ID NO: 1926864 - protein, 15 aa, Staphylococcus
AVNHTQDLNSRLSEF

SEQ ID NO: 1926865 - protein, 16 aa, Staphylococcus
AVNKEERKDIQKNHSA

SEQ ID NO: 1926866 - protein, 8 aa, Staphylococcus
AVNNDGQV

SEQ ID NO: 1926867 - protein, 15 aa, Staphylococcus
AVNPDDLSPEKQSKL

SEQ ID NO: 1926868 - protein, 14 aa, Staphylococcus
AVNPDELNPEKQSK

SEQ ID NO: 1926869 - protein, 4 aa, Staphylococcus
AVNQ

SEQ ID NO: 1926870 - protein, 7 aa, Staphylococcus
AVNREDN

SEQ ID NO: 1926871 - protein, 17 aa, Staphylococcus
AVNRGTSFGASTLEENK

SEQ ID NO: 1926872 - protein, 4 aa, Staphylococcus
AVNS

SEQ ID NO: 1926873 - protein, 5 aa, Staphylococcus
AVNTE

SEQ ID NO: 1926874 - protein, 9 aa, Staphylococcus
AVNVSSKYQ

SEQ ID NO: 1926875 - protein, 8 aa, Staphylococcus
AVNYENAG

SEQ ID NO: 1926876 - protein, 7 aa, Staphylococcus
AVPADKV

SEQ ID NO: 1926877 - protein, 7 aa, Staphylococcus
AVPAPAS

SEQ ID NO: 1926878 - protein, 5 aa, Staphylococcus
AVPDG

SEQ ID NO: 1926879 - protein, 13 aa, Staphylococcus
AVPEKNGKEISRI

SEQ ID NO: 1926880 - protein, 19 aa, Staphylococcus
AVPETGKEVSRIGSTFGKT

SEQ ID NO: 1926881 - protein, 4 aa, Staphylococcus
AVPG

SEQ ID NO: 1926882 - protein, 7 aa, Staphylococcus
AVPGAPH

SEQ ID NO: 1926883 - protein, 11 aa, Staphylococcus
AVPKDAESNQD

SEQ ID NO: 1926884 - protein, 15 aa, Staphylococcus
AVPQPDPESERTRER

SEQ ID NO: 1926885 - protein, 5 aa, Staphylococcus
AVPQT

SEQ ID NO: 1926886 - protein, 6 aa, Staphylococcus
AVPTEK

SEQ ID NO: 1926887 - protein, 8 aa, Staphylococcus
AVQGQGVT

SEQ ID NO: 1926888 - protein, 9 aa, Staphylococcus
AVQGSNRSN

SEQ ID NO: 1926889 - protein, 7 aa, Staphylococcus
AVQPRGY

SEQ ID NO: 1926890 - protein, 8 aa, Staphylococcus
AVQQGDSE

SEQ ID NO: 1926891 - protein, 7 aa, Staphylococcus
AVQQGYS

SEQ ID NO: 1926892 - protein, 15 aa, Staphylococcus
AVQSSPDQKLFSAKS

SEQ ID NO: 1926893 - protein, 5 aa, Staphylococcus
AVRGA

SEQ ID NO: 1926894 - protein, 12 aa, Staphylococcus
AVRLETGKEKKD

SEQ ID NO: 1926895 - protein, 8 aa, Staphylococcus
AVRRGASD

SEQ ID NO: 1926896 - protein, 17 aa, Staphylococcus
AVRTSTPAGGTTDGAAQ

SEQ ID NO: 1926897 - protein, 11 aa, Staphylococcus
AVSAGTATAFN

SEQ ID NO: 1926898 - protein, 12 aa, Staphylococcus
AVSDEEKRRGVA

SEQ ID NO: 1926899 - protein, 10 aa, Staphylococcus
AVSDEGSFQE

SEQ ID NO: 1926900 - protein, 12 aa, Staphylococcus
AVSEEEKTPLRR

SEQ ID NO: 1926901 - protein, 10 aa, Staphylococcus
AVSEGTAYRA

SEQ ID NO: 1926902 - protein, 5 aa, Staphylococcus
AVSGD

SEQ ID NO: 1926903 - protein, 28 aa, Staphylococcus
AVSGNGDSRAGRWTNSTKTECGLHTTNK

SEQ ID NO: 1926904 - protein, 27 aa, Staphylococcus
AVSGSGIKGKRDLAEGANGKEPEAYPH

SEQ ID NO: 1926905 - protein, 27 aa, Staphylococcus
AVSGSGIKGKRDLSEGPNGKAPEAYPH

SEQ ID NO: 1926906 - protein, 16 aa, Staphylococcus
AVSGSGKNGRITKEDI

SEQ ID NO: 1926907 - protein, 17 aa, Staphylococcus
AVSGSGKNGRTTKEDVD

SEQ ID NO: 1926908 - protein, 12 aa, Staphylococcus
AVSGSGVAGRED

SEQ ID NO: 1926909 - protein, 27 aa, Staphylococcus
AVSGSGVKGKQDLAEGANGKAPEAYPH

SEQ ID NO: 1926910 - protein, 27 aa, Staphylococcus
AVSGSGVKGKRDLSEGANGKAPEAYPH

SEQ ID NO: 1926911 - protein, 4 aa, Staphylococcus
AVSH

SEQ ID NO: 1926912 - protein, 28 aa, Staphylococcus
AVSKEDEGKARLEEHNKKVDEESKNISI

SEQ ID NO: 1926913 - protein, 8 aa, Staphylococcus
AVSKEQLA

SEQ ID NO: 1926914 - protein, 7 aa, Staphylococcus
AVSNGRS

SEQ ID NO: 1926915 - protein, 6 aa, Staphylococcus
AVSNIG

SEQ ID NO: 1926916 - protein, 6 aa, Staphylococcus
AVSPEQ

SEQ ID NO: 1926917 - protein, 7 aa, Staphylococcus
AVSPQQL

SEQ ID NO: 1926918 - protein, 14 aa, Staphylococcus
AVSSSKTVERLIKQ

SEQ ID NO: 1926919 - protein, 11 aa, Staphylococcus
AVSSSSRGNLE

SEQ ID NO: 1926920 - protein, 8 aa, Staphylococcus
AVSTVKSG

SEQ ID NO: 1926921 - protein, 15 aa, Staphylococcus
AVTAGELKRNNPERL

SEQ ID NO: 1926922 - protein, 4 aa, Staphylococcus
AVTE

SEQ ID NO: 1926923 - protein, 11 aa, Staphylococcus
AVTGMGAQGGM

SEQ ID NO: 1926924 - protein, 15 aa, Staphylococcus
AVTGSGKNGRITKED

SEQ ID NO: 1926925 - protein, 10 aa, Staphylococcus
AVTNDVKTHM

SEQ ID NO: 1926926 - protein, 10 aa, Staphylococcus
AVTNKSIHNE

SEQ ID NO: 1926927 - protein, 8 aa, Staphylococcus
AVTNTKKD

SEQ ID NO: 1926928 - protein, 16 aa, Staphylococcus
AVTPHKPEAKNVMGQS

SEQ ID NO: 1926929 - protein, 4 aa, Staphylococcus
AVTS

SEQ ID NO: 1926930 - protein, 7 aa, Staphylococcus
AVTTQQT

SEQ ID NO: 1926931 - protein, 17 aa, Staphylococcus
AVTVDATATLNEEAPYE

SEQ ID NO: 1926932 - protein, 13 aa, Staphylococcus
AVYESTKAAAKPR

SEQ ID NO: 1926933 - protein, 26 aa, Staphylococcus
AVYGEPDTVPITEADSKTPTSPYGES

SEQ ID NO: 1926934 - protein, 8 aa, Staphylococcus
AVYTDDED

SEQ ID NO: 1926935 - protein, 8 aa, Staphylococcus
AWNNEDRP

SEQ ID NO: 1926936 - protein, 8 aa, Staphylococcus
AWNNKDRP

SEQ ID NO: 1926937 - protein, 7 aa, Staphylococcus
AYAAQND

SEQ ID NO: 1926938 - protein, 10 aa, Staphylococcus
AYADGDARNV

SEQ ID NO: 1926939 - protein, 12 aa, Staphylococcus
AYADGQKYELSQ

SEQ ID NO: 1926940 - protein, 11 aa, Staphylococcus
AYADKGGTPWL

SEQ ID NO: 1926941 - protein, 8 aa, Staphylococcus
AYANKGYT

SEQ ID NO: 1926942 - protein, 7 aa, Staphylococcus
AYASPTV

SEQ ID NO: 1926943 - protein, 4 aa, Staphylococcus
AYDD

SEQ ID NO: 1926944 - protein, 5 aa, Staphylococcus
AYDDI

SEQ ID NO: 1926945 - protein, 8 aa, Staphylococcus
AYDDNNPL

SEQ ID NO: 1926946 - protein, 5 aa, Staphylococcus
AYDEG

SEQ ID NO: 1926947 - protein, 20 aa, Staphylococcus
AYDEKLKNYPSVQGDNVQYG

SEQ ID NO: 1926948 - protein, 7 aa, Staphylococcus
AYDKNNP

SEQ ID NO: 1926949 - protein, 8 aa, Staphylococcus
AYDKNNPL

SEQ ID NO: 1926950 - protein, 8 aa, Staphylococcus
AYDNNNPL

SEQ ID NO: 1926951 - protein, 20 aa, Staphylococcus
AYDPKKDEFKEVSQEDLKGS

SEQ ID NO: 1926952 - protein, 19 aa, Staphylococcus
AYDPKNDEFKEISQEDFKG

SEQ ID NO: 1926953 - protein, 20 aa, Staphylococcus
AYDPKNDEFKEVSQDDLKGS

SEQ ID NO: 1926954 - protein, 8 aa, Staphylococcus
AYDPQKDE

SEQ ID NO: 1926955 - protein, 7 aa, Staphylococcus
AYDQEAT

SEQ ID NO: 1926956 - protein, 6 aa, Staphylococcus
AYDQGA

SEQ ID NO: 1926957 - protein, 6 aa, Staphylococcus
AYDRNG

SEQ ID NO: 1926958 - protein, 19 aa, Staphylococcus
AYDRVQPKAMESWETKTPF

SEQ ID NO: 1926959 - protein, 21 aa, Staphylococcus
AYDSKTEVDTGDSTTGESAAE

SEQ ID NO: 1926960 - protein, 19 aa, Staphylococcus
AYDSPQSAETLAQKQDTIS

SEQ ID NO: 1926961 - protein, 6 aa, Staphylococcus
AYDSVA

SEQ ID NO: 1926962 - protein, 8 aa, Staphylococcus
AYDTPRTD

SEQ ID NO: 1926963 - protein, 8 aa, Staphylococcus
AYEAAGAT

SEQ ID NO: 1926964 - protein, 6 aa, Staphylococcus
AYEDEQ

SEQ ID NO: 1926965 - protein, 12 aa, Staphylococcus
AYEEAKDDPAFQ

SEQ ID NO: 1926966 - protein, 5 aa, Staphylococcus
AYEKK

SEQ ID NO: 1926967 - protein, 12 aa, Staphylococcus
AYEKVGKALGTI

SEQ ID NO: 1926968 - protein, 12 aa, Staphylococcus
AYEKVGKELGTI

SEQ ID NO: 1926969 - protein, 6 aa, Staphylococcus
AYENEY

SEQ ID NO: 1926970 - protein, 7 aa, Staphylococcus
AYENGIS

SEQ ID NO: 1926971 - protein, 5 aa, Staphylococcus
AYENN

SEQ ID NO: 1926972 - protein, 14 aa, Staphylococcus
AYERLKETNNFPEF

SEQ ID NO: 1926973 - protein, 14 aa, Staphylococcus
AYERLSETNNFPDF

SEQ ID NO: 1926974 - protein, 14 aa, Staphylococcus
AYERLSETNNFPEF

SEQ ID NO: 1926975 - protein, 9 aa, Staphylococcus
AYESQQAEI

SEQ ID NO: 1926976 - protein, 21 aa, Staphylococcus
AYETDMYQTSEQSARESQANL

SEQ ID NO: 1926977 - protein, 5 aa, Staphylococcus
AYGDI

SEQ ID NO: 1926978 - protein, 7 aa, Staphylococcus
AYGESAP

SEQ ID NO: 1926979 - protein, 13 aa, Staphylococcus
AYGFSSSASYSKK

SEQ ID NO: 1926980 - protein, 9 aa, Staphylococcus
AYGGFTTGK

SEQ ID NO: 1926981 - protein, 6 aa, Staphylococcus
AYGGPV

SEQ ID NO: 1926982 - protein, 5 aa, Staphylococcus
AYGGY

SEQ ID NO: 1926983 - protein, 11 aa, Staphylococcus
AYGKAKDNKVA

SEQ ID NO: 1926984 - protein, 10 aa, Staphylococcus
AYGPSESTVV

SEQ ID NO: 1926985 - protein, 12 aa, Staphylococcus
AYGQPADNNASR

SEQ ID NO: 1926986 - protein, 7 aa, Staphylococcus
AYGQTPK

SEQ ID NO: 1926987 - protein, 6 aa, Staphylococcus
AYGSHN

SEQ ID NO: 1926988 - protein, 10 aa, Staphylococcus
AYGTPLTDET

SEQ ID NO: 1926989 - protein, 6 aa, Staphylococcus
AYHANE

SEQ ID NO: 1926990 - protein, 8 aa, Staphylococcus
AYKDDYNQ

SEQ ID NO: 1926991 - protein, 10 aa, Staphylococcus
AYKDHGGPDK

SEQ ID NO: 1926992 - protein, 10 aa, Staphylococcus
AYKDYQPESL

SEQ ID NO: 1926993 - protein, 11 aa, Staphylococcus
AYKENGGTPWL

SEQ ID NO: 1926994 - protein, 8 aa, Staphylococcus
AYKGEDVD

SEQ ID NO: 1926995 - protein, 7 aa, Staphylococcus
AYKGNKG

SEQ ID NO: 1926996 - protein, 13 aa, Staphylococcus
AYKKAKNDPTFQD

SEQ ID NO: 1926997 - protein, 10 aa, Staphylococcus
AYKKAQDKQL

SEQ ID NO: 1926998 - protein, 41 aa, Staphylococcus
AYKKEQDQKIEQQAKQQSKNKTNNEKKKKKGLSYKEQKEYE

SEQ ID NO: 1926999 - protein, 36 aa, Staphylococcus
AYKKEQDRQTSLAKQSAQQSKQQAQTRKKSGLSYKE

SEQ ID NO: 1927000 - protein, 9 aa, Staphylococcus
AYKNDETNG

SEQ ID NO: 1927001 - protein, 10 aa, Staphylococcus
AYKNEQENGR

SEQ ID NO: 1927002 - protein, 16 aa, Staphylococcus
AYKNNEVDGFTTNPSL

SEQ ID NO: 1927003 - protein, 9 aa, Staphylococcus
AYKQNTETG

SEQ ID NO: 1927004 - protein, 6 aa, Staphylococcus
AYKQYP

SEQ ID NO: 1927005 - protein, 9 aa, Staphylococcus
AYKRSEAEI

SEQ ID NO: 1927006 - protein, 7 aa, Staphylococcus
AYKTEAN

SEQ ID NO: 1927007 - protein, 6 aa, Staphylococcus
AYKTND

SEQ ID NO: 1927008 - protein, 13 aa, Staphylococcus
AYLANGKSPREAV

SEQ ID NO: 1927009 - protein, 5 aa, Staphylococcus
AYMTT

SEQ ID NO: 1927010 - protein, 19 aa, Staphylococcus
AYNDITEDQEEDVKQRLKS

SEQ ID NO: 1927011 - protein, 5 aa, Staphylococcus
AYNGK

SEQ ID NO: 1927012 - protein, 13 aa, Staphylococcus
AYNKAKQDQSFQD

SEQ ID NO: 1927013 - protein, 5 aa, Staphylococcus
AYNKG

SEQ ID NO: 1927014 - protein, 8 aa, Staphylococcus
AYNNQPNS

SEQ ID NO: 1927015 - protein, 33 aa, Staphylococcus
AYNNQTGVNEKEREEQQKQAEQYREQNEQQQFE

SEQ ID NO: 1927016 - protein, 14 aa, Staphylococcus
AYNNTLGSTLAGEV

SEQ ID NO: 1927017 - protein, 8 aa, Staphylococcus
AYNPKEDE

SEQ ID NO: 1927018 - protein, 6 aa, Staphylococcus
AYNQKS

SEQ ID NO: 1927019 - protein, 8 aa, Staphylococcus
AYNRKPYA

SEQ ID NO: 1927020 - protein, 11 aa, Staphylococcus
AYNTDKGTGIK

SEQ ID NO: 1927021 - protein, 6 aa, Staphylococcus
AYPDSS

SEQ ID NO: 1927022 - protein, 7 aa, Staphylococcus
AYPELKA

SEQ ID NO: 1927023 - protein, 8 aa, Staphylococcus
AYPELKEK

SEQ ID NO: 1927024 - protein, 7 aa, Staphylococcus
AYPHPDK

SEQ ID NO: 1927025 - protein, 9 aa, Staphylococcus
AYPHPDKPI

SEQ ID NO: 1927026 - protein, 5 aa, Staphylococcus
AYPKR

SEQ ID NO: 1927027 - protein, 5 aa, Staphylococcus
AYPNH

SEQ ID NO: 1927028 - protein, 6 aa, Staphylococcus
AYPQTN

SEQ ID NO: 1927029 - protein, 5 aa, Staphylococcus
AYPSL

SEQ ID NO: 1927030 - protein, 6 aa, Staphylococcus
AYPSLS

SEQ ID NO: 1927031 - protein, 13 aa, Staphylococcus
AYPTLNDQSTTYD

SEQ ID NO: 1927032 - protein, 10 aa, Staphylococcus
AYQDEGHGSP

SEQ ID NO: 1927033 - protein, 18 aa, Staphylococcus
AYQEDESKNSERKLQEIR

SEQ ID NO: 1927034 - protein, 6 aa, Staphylococcus
AYQEED

SEQ ID NO: 1927035 - protein, 11 aa, Staphylococcus
AYQEGLKEEGI

SEQ ID NO: 1927036 - protein, 7 aa, Staphylococcus
AYQGGAV

SEQ ID NO: 1927037 - protein, 6 aa, Staphylococcus
AYQNDE

SEQ ID NO: 1927038 - protein, 5 aa, Staphylococcus
AYQNE

SEQ ID NO: 1927039 - protein, 6 aa, Staphylococcus
AYQNES

SEQ ID NO: 1927040 - protein, 13 aa, Staphylococcus
AYQQAKQDESFQE

SEQ ID NO: 1927041 - protein, 11 aa, Staphylococcus
AYQRSKRDLPY

SEQ ID NO: 1927042 - protein, 4 aa, Staphylococcus
AYQS

SEQ ID NO: 1927043 - protein, 4 aa, Staphylococcus
AYQT

SEQ ID NO: 1927044 - protein, 25 aa, Staphylococcus
AYQTEASKKSDLERTDLAKGKTGVF

SEQ ID NO: 1927045 - protein, 12 aa, Staphylococcus
AYQTGDPSSEVA

SEQ ID NO: 1927046 - protein, 5 aa, Staphylococcus
AYQTN

SEQ ID NO: 1927047 - protein, 6 aa, Staphylococcus
AYRANE

SEQ ID NO: 1927048 - protein, 8 aa, Staphylococcus
AYRIPKSI

SEQ ID NO: 1927049 - protein, 6 aa, Staphylococcus
AYRIPQ

SEQ ID NO: 1927050 - protein, 11 aa, Staphylococcus
AYRKGTVDSPY

SEQ ID NO: 1927051 - protein, 9 aa, Staphylococcus
AYRKRYDTH

SEQ ID NO: 1927052 - protein, 18 aa, Staphylococcus
AYRTKDVQEQRNATEKAM

SEQ ID NO: 1927053 - protein, 6 aa, Staphylococcus
AYSDNK

SEQ ID NO: 1927054 - protein, 5 aa, Staphylococcus
AYSDS

SEQ ID NO: 1927055 - protein, 4 aa, Staphylococcus
AYSN

SEQ ID NO: 1927056 - protein, 11 aa, Staphylococcus
AYSQDGTRHHT

SEQ ID NO: 1927057 - protein, 6 aa, Staphylococcus
AYSQEP

SEQ ID NO: 1927058 - protein, 10 aa, Staphylococcus
AYSQQQDDAH

SEQ ID NO: 1927059 - protein, 11 aa, Staphylococcus
AYSSSSERACD

SEQ ID NO: 1927060 - protein, 5 aa, Staphylococcus
AYSYK

SEQ ID NO: 1927061 - protein, 10 aa, Staphylococcus
AYTEATDQIQ

SEQ ID NO: 1927062 - protein, 7 aa, Staphylococcus
AYTERLQ

SEQ ID NO: 1927063 - protein, 6 aa, Staphylococcus
AYTGEG

SEQ ID NO: 1927064 - protein, 23 aa, Staphylococcus
AYTGEGEHVNSGELNGLENEAAI

SEQ ID NO: 1927065 - protein, 8 aa, Staphylococcus
AYTGPQNH

SEQ ID NO: 1927066 - protein, 5 aa, Staphylococcus
AYTGR

SEQ ID NO: 1927067 - protein, 5 aa, Staphylococcus
AYTKL

SEQ ID NO: 1927068 - protein, 8 aa, Staphylococcus
AYTKNNTS

SEQ ID NO: 1927069 - protein, 6 aa, Staphylococcus
AYTKRN

SEQ ID NO: 1927070 - protein, 15 aa, Staphylococcus
AYTNPNLELGSEDES

SEQ ID NO: 1927071 - protein, 5 aa, Staphylococcus
AYTNR

SEQ ID NO: 1927072 - protein, 6 aa, Staphylococcus
AYTPKL

SEQ ID NO: 1927073 - protein, 8 aa, Staphylococcus
AYTPKLKR

SEQ ID NO: 1927074 - protein, 11 aa, Staphylococcus
AYTQSASDQDV

SEQ ID NO: 1927075 - protein, 6 aa, Staphylococcus
AYTSED

SEQ ID NO: 1927076 - protein, 11 aa, Staphylococcus
AYYATSDESTF

SEQ ID NO: 1927077 - protein, 5 aa, Staphylococcus
AYYDK

SEQ ID NO: 1927078 - protein, 6 aa, Staphylococcus
CAETDY

SEQ ID NO: 1927079 - protein, 9 aa, Staphylococcus
CAGPKERIQ

SEQ ID NO: 1927080 - protein, 5 aa, Staphylococcus
CAKAE

SEQ ID NO: 1927081 - protein, 11 aa, Staphylococcus
CAPEGDAATGM

SEQ ID NO: 1927082 - protein, 7 aa, Staphylococcus
CAQDSKP

SEQ ID NO: 1927083 - protein, 21 aa, Staphylococcus
CAQGGNPWTQNQQIQAQDDIE

SEQ ID NO: 1927084 - protein, 13 aa, Staphylococcus
CARDNKHTMHRET

SEQ ID NO: 1927085 - protein, 9 aa, Staphylococcus
CATGTNSIG

SEQ ID NO: 1927086 - protein, 10 aa, Staphylococcus
CATPSSQEVL

SEQ ID NO: 1927087 - protein, 15 aa, Staphylococcus
CATQDEVKELVHHIS

SEQ ID NO: 1927088 - protein, 5 aa, Staphylococcus
CATSE

SEQ ID NO: 1927089 - protein, 15 aa, Staphylococcus
CATSEEVQDLVNQYA

SEQ ID NO: 1927090 - protein, 14 aa, Staphylococcus
CDGEGAKPGTKKKT

SEQ ID NO: 1927091 - protein, 18 aa, Staphylococcus
CDGEGAKPGTSKKTCSYC

SEQ ID NO: 1927092 - protein, 4 aa, Staphylococcus
CDGK

SEQ ID NO: 1927093 - protein, 11 aa, Staphylococcus
CDKEQEARKEV

SEQ ID NO: 1927094 - protein, 9 aa, Staphylococcus
CDKERDKVI

SEQ ID NO: 1927095 - protein, 7 aa, Staphylococcus
CDNAPKR

SEQ ID NO: 1927096 - protein, 7 aa, Staphylococcus
CDNGKNI

SEQ ID NO: 1927097 - protein, 6 aa, Staphylococcus
CDNQPE

SEQ ID NO: 1927098 - protein, 17 aa, Staphylococcus
CDQQTRKFNEEAAKEDG

SEQ ID NO: 1927099 - protein, 17 aa, Staphylococcus
CDQQTRKFNEEAAQEDG

SEQ ID NO: 1927100 - protein, 17 aa, Staphylococcus
CDQQTRKFNEEASQENG

SEQ ID NO: 1927101 - protein, 5 aa, Staphylococcus
CDTHD

SEQ ID NO: 1927102 - protein, 12 aa, Staphylococcus
CDVQTNVGPNGV

SEQ ID NO: 1927103 - protein, 10 aa, Staphylococcus
CEAQPPSEDF

SEQ ID NO: 1927104 - protein, 7 aa, Staphylococcus
CEAYDKG

SEQ ID NO: 1927105 - protein, 5 aa, Staphylococcus
CEETH

SEQ ID NO: 1927106 - protein, 6 aa, Staphylococcus
CEGNES

SEQ ID NO: 1927107 - protein, 6 aa, Staphylococcus
CEGRGE

SEQ ID NO: 1927108 - protein, 4 aa, Staphylococcus
CEKK

SEQ ID NO: 1927109 - protein, 8 aa, Staphylococcus
CEKPDPKA

SEQ ID NO: 1927110 - protein, 8 aa, Staphylococcus
CENEQDLY

SEQ ID NO: 1927111 - protein, 5 aa, Staphylococcus
CEPMT

SEQ ID NO: 1927112 - protein, 10 aa, Staphylococcus
CEPQPPSEDF

SEQ ID NO: 1927113 - protein, 19 aa, Staphylococcus
CEQRDPKGLYKKARSGEIK

SEQ ID NO: 1927114 - protein, 13 aa, Staphylococcus
CERFTKCSKNLII

SEQ ID NO: 1927115 - protein, 10 aa, Staphylococcus
CERKGIPFEP

SEQ ID NO: 1927116 - protein, 10 aa, Staphylococcus
CESGEGKTYR

SEQ ID NO: 1927117 - protein, 7 aa, Staphylococcus
CESQSAH

SEQ ID NO: 1927118 - protein, 5 aa, Staphylococcus
CETNE

SEQ ID NO: 1927119 - protein, 11 aa, Staphylococcus
CEYTDNADCPK

SEQ ID NO: 1927120 - protein, 11 aa, Staphylococcus
CGAYSKGNRQK

SEQ ID NO: 1927121 - protein, 18 aa, Staphylococcus
CGDRNYISTKNKRNHPER

SEQ ID NO: 1927122 - protein, 4 aa, Staphylococcus
CGEQ

SEQ ID NO: 1927123 - protein, 15 aa, Staphylococcus
CGGAGYTLTDPSDID

SEQ ID NO: 1927124 - protein, 9 aa, Staphylococcus
CGGASSGFN

SEQ ID NO: 1927125 - protein, 4 aa, Staphylococcus
CGNG

SEQ ID NO: 1927126 - protein, 6 aa, Staphylococcus
CGNGND

SEQ ID NO: 1927127 - protein, 5 aa, Staphylococcus
CGNGV

SEQ ID NO: 1927128 - protein, 5 aa, Staphylococcus
CGNRD

SEQ ID NO: 1927129 - protein, 4 aa, Staphylococcus
CGNT

SEQ ID NO: 1927130 - protein, 6 aa, Staphylococcus
CGPGEV

SEQ ID NO: 1927131 - protein, 7 aa, Staphylococcus
CGQGRPN

SEQ ID NO: 1927132 - protein, 11 aa, Staphylococcus
CGQSRDMKRKD

SEQ ID NO: 1927133 - protein, 10 aa, Staphylococcus
CGQSREMKHK

SEQ ID NO: 1927134 - protein, 9 aa, Staphylococcus
CGQTNDRPI

SEQ ID NO: 1927135 - protein, 18 aa, Staphylococcus
CGSANNQLKDEDKHSKML

SEQ ID NO: 1927136 - protein, 17 aa, Staphylococcus
CGSANNQLKDEETHSKM

SEQ ID NO: 1927137 - protein, 8 aa, Staphylococcus
CGSKYGGS

SEQ ID NO: 1927138 - protein, 5 aa, Staphylococcus
CGSSF

SEQ ID NO: 1927139 - protein, 16 aa, Staphylococcus
CGSSFKTAKVSGNPEQ

SEQ ID NO: 1927140 - protein, 16 aa, Staphylococcus
CGSSFKTAKVSGTPEE

SEQ ID NO: 1927141 - protein, 8 aa, Staphylococcus
CGTGDPFS

SEQ ID NO: 1927142 - protein, 19 aa, Staphylococcus
CGTPSKVMKDKKSLTGQYL

SEQ ID NO: 1927143 - protein, 12 aa, Staphylococcus
CGTSVEKDITQR

SEQ ID NO: 1927144 - protein, 4 aa, Staphylococcus
CGVD

SEQ ID NO: 1927145 - protein, 5 aa, Staphylococcus
CGVDP

SEQ ID NO: 1927146 - protein, 5 aa, Staphylococcus
CGVPE

SEQ ID NO: 1927147 - protein, 7 aa, Staphylococcus
CHDTEMR

SEQ ID NO: 1927148 - protein, 7 aa, Staphylococcus
CHPPKSL

SEQ ID NO: 1927149 - protein, 11 aa, Staphylococcus
CIAGGGSDGNI

SEQ ID NO: 1927150 - protein, 15 aa, Staphylococcus
CKDGDVVERKSKKNR

SEQ ID NO: 1927151 - protein, 6 aa, Staphylococcus
CKEGDN

SEQ ID NO: 1927152 - protein, 7 aa, Staphylococcus
CKESPEE

SEQ ID NO: 1927153 - protein, 7 aa, Staphylococcus
CKESPEV

SEQ ID NO: 1927154 - protein, 7 aa, Staphylococcus
CKGEDSV

SEQ ID NO: 1927155 - protein, 4 aa, Staphylococcus
CKGK

SEQ ID NO: 1927156 - protein, 7 aa, Staphylococcus
CKGRGEK

SEQ ID NO: 1927157 - protein, 8 aa, Staphylococcus
CKGRNRDT

SEQ ID NO: 1927158 - protein, 7 aa, Staphylococcus
CKKRGKT

SEQ ID NO: 1927159 - protein, 7 aa, Staphylococcus
CKKYDGQ

SEQ ID NO: 1927160 - protein, 5 aa, Staphylococcus
CKMNS

SEQ ID NO: 1927161 - protein, 21 aa, Staphylococcus
CKPDPNFSSVASANPEDHKAF

SEQ ID NO: 1927162 - protein, 10 aa, Staphylococcus
CKPPLKEREI

SEQ ID NO: 1927163 - protein, 4 aa, Staphylococcus
CKQR

SEQ ID NO: 1927164 - protein, 6 aa, Staphylococcus
CKSMNE

SEQ ID NO: 1927165 - protein, 13 aa, Staphylococcus
CKSTEVKQNAVNQ

SEQ ID NO: 1927166 - protein, 5 aa, Staphylococcus
CLEEA

SEQ ID NO: 1927167 - protein, 5 aa, Staphylococcus
CNDEE

SEQ ID NO: 1927168 - protein, 10 aa, Staphylococcus
CNEEDNKVYE

SEQ ID NO: 1927169 - protein, 15 aa, Staphylococcus
CNEGEVVERKSKKNR

SEQ ID NO: 1927170 - protein, 5 aa, Staphylococcus
CNEKE

SEQ ID NO: 1927171 - protein, 27 aa, Staphylococcus
CNENKAKKPFAYKEDEDGVFSKPQRTI

SEQ ID NO: 1927172 - protein, 18 aa, Staphylococcus
CNGDGAKPGTSKKTCSYC

SEQ ID NO: 1927173 - protein, 28 aa, Staphylococcus
CNGEGAKPGTNKKTCSYCNGAGSVSVEQ

SEQ ID NO: 1927174 - protein, 5 aa, Staphylococcus
CNHPK

SEQ ID NO: 1927175 - protein, 4 aa, Staphylococcus
CNKQ

SEQ ID NO: 1927176 - protein, 19 aa, Staphylococcus
CNPDGYNINDECGSTHPEH

SEQ ID NO: 1927177 - protein, 20 aa, Staphylococcus
CNPNGYNINQEVGSTHPESL

SEQ ID NO: 1927178 - protein, 7 aa, Staphylococcus
CNPNPYQ

SEQ ID NO: 1927179 - protein, 10 aa, Staphylococcus
CNPNPYQSNI

SEQ ID NO: 1927180 - protein, 9 aa, Staphylococcus
CNPNPYQSR

SEQ ID NO: 1927181 - protein, 9 aa, Staphylococcus
CNPPMSSRE

SEQ ID NO: 1927182 - protein, 6 aa, Staphylococcus
CNQPKT

SEQ ID NO: 1927183 - protein, 13 aa, Staphylococcus
CNQPPGTWSDDSS

SEQ ID NO: 1927184 - protein, 5 aa, Staphylococcus
CNQQA

SEQ ID NO: 1927185 - protein, 12 aa, Staphylococcus
CNQTENAKREVE

SEQ ID NO: 1927186 - protein, 7 aa, Staphylococcus
CNRPKTE

SEQ ID NO: 1927187 - protein, 8 aa, Staphylococcus
CNTNSEIS

SEQ ID NO: 1927188 - protein, 10 aa, Staphylococcus
CNTNSEMSKL

SEQ ID NO: 1927189 - protein, 4 aa, Staphylococcus
CPED

SEQ ID NO: 1927190 - protein, 8 aa, Staphylococcus
CPESSAHF

SEQ ID NO: 1927191 - protein, 6 aa, Staphylococcus
CPGAGA

SEQ ID NO: 1927192 - protein, 4 aa, Staphylococcus
CPKI

SEQ ID NO: 1927193 - protein, 12 aa, Staphylococcus
CPKVKAKPGITQ

SEQ ID NO: 1927194 - protein, 11 aa, Staphylococcus
CPNSVDGEPCN

SEQ ID NO: 1927195 - protein, 10 aa, Staphylococcus
CPSCQGKRLN

SEQ ID NO: 1927196 - protein, 19 aa, Staphylococcus
CPTCGQNPTYPHLNETKRQ

SEQ ID NO: 1927197 - protein, 7 aa, Staphylococcus
CPTLNEK

SEQ ID NO: 1927198 - protein, 11 aa, Staphylococcus
CPYGPRPGDEV

SEQ ID NO: 1927199 - protein, 12 aa, Staphylococcus
CPYGPRPGDEVK

SEQ ID NO: 1927200 - protein, 12 aa, Staphylococcus
CPYGPRPGEEVK

SEQ ID NO: 1927201 - protein, 12 aa, Staphylococcus
CPYGPRSGEEVK

SEQ ID NO: 1927202 - protein, 12 aa, Staphylococcus
CPYGSREGSEVR

SEQ ID NO: 1927203 - protein, 20 aa, Staphylococcus
CQESPKEVANSLLSNTIKLQ

SEQ ID NO: 1927204 - protein, 16 aa, Staphylococcus
CQKKANEALSLEGTCG

SEQ ID NO: 1927205 - protein, 16 aa, Staphylococcus
CQPTSKLGLATGGTMT

SEQ ID NO: 1927206 - protein, 7 aa, Staphylococcus
CQSNKDL

SEQ ID NO: 1927207 - protein, 5 aa, Staphylococcus
CQTEC

SEQ ID NO: 1927208 - protein, 18 aa, Staphylococcus
CREGQKRMKAMKKEVGTN

SEQ ID NO: 1927209 - protein, 14 aa, Staphylococcus
CREGQKRMKGQLKE

SEQ ID NO: 1927210 - protein, 14 aa, Staphylococcus
CREGQKRYKASLKE

SEQ ID NO: 1927211 - protein, 7 aa, Staphylococcus
CRSDDEE

SEQ ID NO: 1927212 - protein, 7 aa, Staphylococcus
CRSDDET

SEQ ID NO: 1927213 - protein, 7 aa, Staphylococcus
CRSDDKE

SEQ ID NO: 1927214 - protein, 7 aa, Staphylococcus
CRSPIAE

SEQ ID NO: 1927215 - protein, 8 aa, Staphylococcus
CRSPLAES

SEQ ID NO: 1927216 - protein, 9 aa, Staphylococcus
CRSQMAEGY

SEQ ID NO: 1927217 - protein, 7 aa, Staphylococcus
CRTDERQ

SEQ ID NO: 1927218 - protein, 12 aa, Staphylococcus
CSAPGGKACQTA

SEQ ID NO: 1927219 - protein, 7 aa, Staphylococcus
CSEHDGK

SEQ ID NO: 1927220 - protein, 14 aa, Staphylococcus
CSGDDLMNSNGNYK

SEQ ID NO: 1927221 - protein, 6 aa, Staphylococcus
CSGKDE

SEQ ID NO: 1927222 - protein, 8 aa, Staphylococcus
CSKGTQQK

SEQ ID NO: 1927223 - protein, 8 aa, Staphylococcus
CSKGTRQK

SEQ ID NO: 1927224 - protein, 8 aa, Staphylococcus
CSKSARNR

SEQ ID NO: 1927225 - protein, 10 aa, Staphylococcus
CSLQSGNYSD

SEQ ID NO: 1927226 - protein, 52 aa, Staphylococcus
CSNWSSPSRPAAGTESTTPPRRTSSRPSARSSWTSTAPERTDSSRTRPPPGV

SEQ ID NO: 1927227 - protein, 20 aa, Staphylococcus
CSPDGYNINEGVGSTHPEAL

SEQ ID NO: 1927228 - protein, 4 aa, Staphylococcus
CSPI

SEQ ID NO: 1927229 - protein, 12 aa, Staphylococcus
CSPPIREKSRMP

SEQ ID NO: 1927230 - protein, 13 aa, Staphylococcus
CSRDNKQTLHRET

SEQ ID NO: 1927231 - protein, 7 aa, Staphylococcus
CSSDNTL

SEQ ID NO: 1927232 - protein, 9 aa, Staphylococcus
CSTDDSVAK

SEQ ID NO: 1927233 - protein, 5 aa, Staphylococcus
CSTDE

SEQ ID NO: 1927234 - protein, 6 aa, Staphylococcus
CSTDES

SEQ ID NO: 1927235 - protein, 7 aa, Staphylococcus
CSTDNTL

SEQ ID NO: 1927236 - protein, 7 aa, Staphylococcus
CSTDQTV

SEQ ID NO: 1927237 - protein, 12 aa, Staphylococcus
CSTGGTCQCKIH

SEQ ID NO: 1927238 - protein, 8 aa, Staphylococcus
CSVQRKNQ

SEQ ID NO: 1927239 - protein, 11 aa, Staphylococcus
CSVQRKNQKLI

SEQ ID NO: 1927240 - protein, 15 aa, Staphylococcus
CSVQRKNQKLIEESP

SEQ ID NO: 1927241 - protein, 6 aa, Staphylococcus
CTAGTR

SEQ ID NO: 1927242 - protein, 12 aa, Staphylococcus
CTEAQEAPVAKS

SEQ ID NO: 1927243 - protein, 10 aa, Staphylococcus
CTEKSAHFSD

SEQ ID NO: 1927244 - protein, 4 aa, Staphylococcus
CTGH

SEQ ID NO: 1927245 - protein, 4 aa, Staphylococcus
CTGR

SEQ ID NO: 1927246 - protein, 5 aa, Staphylococcus
CTHYT

SEQ ID NO: 1927247 - protein, 24 aa, Staphylococcus
CTKGKSAKSVRKQPYSDIPAKQRA

SEQ ID NO: 1927248 - protein, 11 aa, Staphylococcus
CTNSTDGEPCN

SEQ ID NO: 1927249 - protein, 4 aa, Staphylococcus
CTPK

SEQ ID NO: 1927250 - protein, 9 aa, Staphylococcus
CTPPMNDRE

SEQ ID NO: 1927251 - protein, 8 aa, Staphylococcus
CTSKINSK

SEQ ID NO: 1927252 - protein, 8 aa, Staphylococcus
CTSNKSEF

SEQ ID NO: 1927253 - protein, 15 aa, Staphylococcus
CYRSEAGSAGRDTRG

SEQ ID NO: 1927254 - protein, 15 aa, Staphylococcus
DAAAASVDKAQDTED

SEQ ID NO: 1927255 - protein, 4 aa, Staphylococcus
DAAD

SEQ ID NO: 1927256 - protein, 15 aa, Staphylococcus
DAADAAIQKAEETDD

SEQ ID NO: 1927257 - protein, 10 aa, Staphylococcus
DAADQYTRKD

SEQ ID NO: 1927258 - protein, 13 aa, Staphylococcus
DAAEAAAQSLEKG

SEQ ID NO: 1927259 - protein, 7 aa, Staphylococcus
DAAEAGI

SEQ ID NO: 1927260 - protein, 7 aa, Staphylococcus
DAAEAGV

SEQ ID NO: 1927261 - protein, 5 aa, Staphylococcus
DAAEN

SEQ ID NO: 1927262 - protein, 19 aa, Staphylococcus
DAAESLGADYKGHKSGTFG

SEQ ID NO: 1927263 - protein, 26 aa, Staphylococcus
DAAESTPQFGDRKTYQMDPANRREAL

SEQ ID NO: 1927264 - protein, 24 aa, Staphylococcus
DAAESTPSFGDRKTYQMDPSNRRE

SEQ ID NO: 1927265 - protein, 11 aa, Staphylococcus
DAAGKTAQTRF

SEQ ID NO: 1927266 - protein, 17 aa, Staphylococcus
DAAGTPWTLQISVLGKY

SEQ ID NO: 1927267 - protein, 8 aa, Staphylococcus
DAAKAKGI

SEQ ID NO: 1927268 - protein, 14 aa, Staphylococcus
DAAKDIDQVFDAFY

SEQ ID NO: 1927269 - protein, 10 aa, Staphylococcus
DAAKEGEISQ

SEQ ID NO: 1927270 - protein, 8 aa, Staphylococcus
DAAKNAGL

SEQ ID NO: 1927271 - protein, 10 aa, Staphylococcus
DAAKSGEVSQ

SEQ ID NO: 1927272 - protein, 6 aa, Staphylococcus
DAAPVL

SEQ ID NO: 1927273 - protein, 4 aa, Staphylococcus
DAAQ

SEQ ID NO: 1927274 - protein, 16 aa, Staphylococcus
DAAQAAIDKAESSKDC

SEQ ID NO: 1927275 - protein, 6 aa, Staphylococcus
DAAQKF

SEQ ID NO: 1927276 - protein, 12 aa, Staphylococcus
DAAQTEAKGPAY

SEQ ID NO: 1927277 - protein, 10 aa, Staphylococcus
DAARVPAGGA

SEQ ID NO: 1927278 - protein, 14 aa, Staphylococcus
DAASEKIKTRIFNL

SEQ ID NO: 1927279 - protein, 7 aa, Staphylococcus
DAASELE

SEQ ID NO: 1927280 - protein, 8 aa, Staphylococcus
DAASKNDV

SEQ ID NO: 1927281 - protein, 9 aa, Staphylococcus
DACEETNTA

SEQ ID NO: 1927282 - protein, 19 aa, Staphylococcus
DADAAENNNGYNPNDPYSY

SEQ ID NO: 1927283 - protein, 6 aa, Staphylococcus
DADAEN

SEQ ID NO: 1927284 - protein, 6 aa, Staphylococcus
DADAKF

SEQ ID NO: 1927285 - protein, 10 aa, Staphylococcus
DADAKGDIRG

SEQ ID NO: 1927286 - protein, 10 aa, Staphylococcus
DADAKGNVRG

SEQ ID NO: 1927287 - protein, 8 aa, Staphylococcus
DADARGNI

SEQ ID NO: 1927288 - protein, 7 aa, Staphylococcus
DADATEI

SEQ ID NO: 1927289 - protein, 7 aa, Staphylococcus
DADDNRI

SEQ ID NO: 1927290 - protein, 10 aa, Staphylococcus
DADDQTKGAY

SEQ ID NO: 1927291 - protein, 58 aa, Staphylococcus
DADEATDNSSSSTESTNETADTSEHDQHETSTETAKDDAQSYSTEKSTADVEKSPQHT

SEQ ID NO: 1927292 - protein, 6 aa, Staphylococcus
DADENC

SEQ ID NO: 1927293 - protein, 10 aa, Staphylococcus
DADEPSSPCG

SEQ ID NO: 1927294 - protein, 14 aa, Staphylococcus
DADETTQERLRAGY

SEQ ID NO: 1927295 - protein, 15 aa, Staphylococcus
DADETTQERLTSGYE

SEQ ID NO: 1927296 - protein, 6 aa, Staphylococcus
DADGKL

SEQ ID NO: 1927297 - protein, 7 aa, Staphylococcus
DADGVEI

SEQ ID NO: 1927298 - protein, 9 aa, Staphylococcus
DADHDEELE

SEQ ID NO: 1927299 - protein, 9 aa, Staphylococcus
DADHIQENV

SEQ ID NO: 1927300 - protein, 4 aa, Staphylococcus
DADI

SEQ ID NO: 1927301 - protein, 5 aa, Staphylococcus
DADIE

SEQ ID NO: 1927302 - protein, 6 aa, Staphylococcus
DADKAV

SEQ ID NO: 1927303 - protein, 20 aa, Staphylococcus
DADKAVKSTYEYCYNGICLK

SEQ ID NO: 1927304 - protein, 6 aa, Staphylococcus
DADKGW

SEQ ID NO: 1927305 - protein, 13 aa, Staphylococcus
DADKLSEHLGGEI

SEQ ID NO: 1927306 - protein, 20 aa, Staphylococcus
DADKVTEDASFKDDLGADSL

SEQ ID NO: 1927307 - protein, 4 aa, Staphylococcus
DADM

SEQ ID NO: 1927308 - protein, 9 aa, Staphylococcus
DADNAVRAT

SEQ ID NO: 1927309 - protein, 5 aa, Staphylococcus
DADNK

SEQ ID NO: 1927310 - protein, 9 aa, Staphylococcus
DADNKENNI

SEQ ID NO: 1927311 - protein, 6 aa, Staphylococcus
DADNNC

SEQ ID NO: 1927312 - protein, 11 aa, Staphylococcus
DADNPSSPCGS

SEQ ID NO: 1927313 - protein, 18 aa, Staphylococcus
DADNQYQKALAKNKGNQT

SEQ ID NO: 1927314 - protein, 18 aa, Staphylococcus
DADNQYQKALEKNKGNAS

SEQ ID NO: 1927315 - protein, 11 aa, Staphylococcus
DADPFASQNAE

SEQ ID NO: 1927316 - protein, 6 aa, Staphylococcus
DADQNC

SEQ ID NO: 1927317 - protein, 5 aa, Staphylococcus
DADSI

SEQ ID NO: 1927318 - protein, 10 aa, Staphylococcus
DADSTSTAQY

SEQ ID NO: 1927319 - protein, 4 aa, Staphylococcus
DADT

SEQ ID NO: 1927320 - protein, 9 aa, Staphylococcus
DADTAKQYL

SEQ ID NO: 1927321 - protein, 10 aa, Staphylococcus
DADTSDLEEH

SEQ ID NO: 1927322 - protein, 12 aa, Staphylococcus
DADTSDLKDNDE

SEQ ID NO: 1927323 - protein, 5 aa, Staphylococcus
DADTY

SEQ ID NO: 1927324 - protein, 11 aa, Staphylococcus
DADVKTSQPAI

SEQ ID NO: 1927325 - protein, 5 aa, Staphylococcus
DADYE

SEQ ID NO: 1927326 - protein, 9 aa, Staphylococcus
DADYSGGFV

SEQ ID NO: 1927327 - protein, 4 aa, Staphylococcus
DAEA

SEQ ID NO: 1927328 - protein, 15 aa, Staphylococcus
DAEATEITEYLNEVI

SEQ ID NO: 1927329 - protein, 18 aa, Staphylococcus
DAEDQYKKALEKNKGNQS

SEQ ID NO: 1927330 - protein, 4 aa, Staphylococcus
DAEE

SEQ ID NO: 1927331 - protein, 6 aa, Staphylococcus
DAEEDL

SEQ ID NO: 1927332 - protein, 6 aa, Staphylococcus
DAEEIA

SEQ ID NO: 1927333 - protein, 6 aa, Staphylococcus
DAEEIN

SEQ ID NO: 1927334 - protein, 23 aa, Staphylococcus
DAEENAEADKKRREESDLRNEAD

SEQ ID NO: 1927335 - protein, 7 aa, Staphylococcus
DAEENVR

SEQ ID NO: 1927336 - protein, 7 aa, Staphylococcus
DAEEPDA

SEQ ID NO: 1927337 - protein, 6 aa, Staphylococcus
DAEGAD

SEQ ID NO: 1927338 - protein, 13 aa, Staphylococcus
DAEGEGGRPEIDR

SEQ ID NO: 1927339 - protein, 21 aa, Staphylococcus
DAEGEQMTSDEGVRPNSSVEK

SEQ ID NO: 1927340 - protein, 22 aa, Staphylococcus
DAEGNEMTSDEGIRSNSSVEKL

SEQ ID NO: 1927341 - protein, 6 aa, Staphylococcus
DAEGQT

SEQ ID NO: 1927342 - protein, 4 aa, Staphylococcus
DAEH

SEQ ID NO: 1927343 - protein, 9 aa, Staphylococcus
DAEIDRDPF

SEQ ID NO: 1927344 - protein, 6 aa, Staphylococcus
DAEKAV

SEQ ID NO: 1927345 - protein, 8 aa, Staphylococcus
DAEKAVRA

SEQ ID NO: 1927346 - protein, 20 aa, Staphylococcus
DAEKVTEDASFKDDLGADSL

SEQ ID NO: 1927347 - protein, 5 aa, Staphylococcus
DAEKY

SEQ ID NO: 1927348 - protein, 6 aa, Staphylococcus
DAELED

SEQ ID NO: 1927349 - protein, 7 aa, Staphylococcus
DAEMQDK

SEQ ID NO: 1927350 - protein, 9 aa, Staphylococcus
DAENENKRL

SEQ ID NO: 1927351 - protein, 11 aa, Staphylococcus
DAENLSDHDQQ

SEQ ID NO: 1927352 - protein, 7 aa, Staphylococcus
DAENYTA

SEQ ID NO: 1927353 - protein, 6 aa, Staphylococcus
DAEPEG

SEQ ID NO: 1927354 - protein, 4 aa, Staphylococcus
DAEQ

SEQ ID NO: 1927355 - protein, 22 aa, Staphylococcus
DAEQNAEEDKKRREESDLRNEA

SEQ ID NO: 1927356 - protein, 13 aa, Staphylococcus
DAEREKYNKENGF

SEQ ID NO: 1927357 - protein, 12 aa, Staphylococcus
DAERQKYNQQFK

SEQ ID NO: 1927358 - protein, 6 aa, Staphylococcus
DAERYQ

SEQ ID NO: 1927359 - protein, 4 aa, Staphylococcus
DAES

SEQ ID NO: 1927360 - protein, 18 aa, Staphylococcus
DAESDYPEYQPLGKPNPF

SEQ ID NO: 1927361 - protein, 6 aa, Staphylococcus
DAESFT

SEQ ID NO: 1927362 - protein, 9 aa, Staphylococcus
DAETALHPS

SEQ ID NO: 1927363 - protein, 7 aa, Staphylococcus
DAETEEV

SEQ ID NO: 1927364 - protein, 7 aa, Staphylococcus
DAETKIP

SEQ ID NO: 1927365 - protein, 5 aa, Staphylococcus
DAETM

SEQ ID NO: 1927366 - protein, 7 aa, Staphylococcus
DAETSIK

SEQ ID NO: 1927367 - protein, 9 aa, Staphylococcus
DAEVNRDPF

SEQ ID NO: 1927368 - protein, 7 aa, Staphylococcus
DAFDPDK

SEQ ID NO: 1927369 - protein, 4 aa, Staphylococcus
DAFK

SEQ ID NO: 1927370 - protein, 13 aa, Staphylococcus
DAFNKRRGMTDEE

SEQ ID NO: 1927371 - protein, 18 aa, Staphylococcus
DAFNRRKEMTDDEIGQQL

SEQ ID NO: 1927372 - protein, 18 aa, Staphylococcus
DAFNRRKGMTDEEIGEQL

SEQ ID NO: 1927373 - protein, 18 aa, Staphylococcus
DAFNRRRGLTDEEIGQQL

SEQ ID NO: 1927374 - protein, 12 aa, Staphylococcus
DAFNRRRGMTDQ

SEQ ID NO: 1927375 - protein, 18 aa, Staphylococcus
DAFNRRRNMSDEEIGAQL

SEQ ID NO: 1927376 - protein, 8 aa, Staphylococcus
DAFPKQKT

SEQ ID NO: 1927377 - protein, 6 aa, Staphylococcus
DAGANF

SEQ ID NO: 1927378 - protein, 5 aa, Staphylococcus
DAGAQ

SEQ ID NO: 1927379 - protein, 4 aa, Staphylococcus
DAGE

SEQ ID NO: 1927380 - protein, 8 aa, Staphylococcus
DAGEETKV

SEQ ID NO: 1927381 - protein, 13 aa, Staphylococcus
DAGEISESTEKAV

SEQ ID NO: 1927382 - protein, 7 aa, Staphylococcus
DAGEQAT

SEQ ID NO: 1927383 - protein, 7 aa, Staphylococcus
DAGETHY

SEQ ID NO: 1927384 - protein, 10 aa, Staphylococcus
DAGGETKEIT

SEQ ID NO: 1927385 - protein, 6 aa, Staphylococcus
DAGGMN

SEQ ID NO: 1927386 - protein, 5 aa, Staphylococcus
DAGGT

SEQ ID NO: 1927387 - protein, 7 aa, Staphylococcus
DAGHIKK

SEQ ID NO: 1927388 - protein, 4 aa, Staphylococcus
DAGI

SEQ ID NO: 1927389 - protein, 7 aa, Staphylococcus
DAGINQD

SEQ ID NO: 1927390 - protein, 9 aa, Staphylococcus
DAGIQPSDV

SEQ ID NO: 1927391 - protein, 5 aa, Staphylococcus
DAGKE

SEQ ID NO: 1927392 - protein, 16 aa, Staphylococcus
DAGKRVKSAGPSTPVE

SEQ ID NO: 1927393 - protein, 4 aa, Staphylococcus
DAGL

SEQ ID NO: 1927394 - protein, 5 aa, Staphylococcus
DAGLG

SEQ ID NO: 1927395 - protein, 5 aa, Staphylococcus
DAGLN

SEQ ID NO: 1927396 - protein, 7 aa, Staphylococcus
DAGNQIT

SEQ ID NO: 1927397 - protein, 6 aa, Staphylococcus
DAGQNC

SEQ ID NO: 1927398 - protein, 7 aa, Staphylococcus
DAGRGYR

SEQ ID NO: 1927399 - protein, 11 aa, Staphylococcus
DAGSANSQNYY

SEQ ID NO: 1927400 - protein, 6 aa, Staphylococcus
DAGSDV

SEQ ID NO: 1927401 - protein, 8 aa, Staphylococcus
DAGSQAEL

SEQ ID NO: 1927402 - protein, 9 aa, Staphylococcus
DAGTMNSKQ

SEQ ID NO: 1927403 - protein, 5 aa, Staphylococcus
DAGVE

SEQ ID NO: 1927404 - protein, 6 aa, Staphylococcus
DAGVPE

SEQ ID NO: 1927405 - protein, 7 aa, Staphylococcus
DAGYESA

SEQ ID NO: 1927406 - protein, 6 aa, Staphylococcus
DAGYGD

SEQ ID NO: 1927407 - protein, 5 aa, Staphylococcus
DAGYT

SEQ ID NO: 1927408 - protein, 9 aa, Staphylococcus
DAHAAAEKH

SEQ ID NO: 1927409 - protein, 7 aa, Staphylococcus
DAHERAD

SEQ ID NO: 1927410 - protein, 8 aa, Staphylococcus
DAHERSAK

SEQ ID NO: 1927411 - protein, 10 aa, Staphylococcus
DAHGAAEKNG

SEQ ID NO: 1927412 - protein, 14 aa, Staphylococcus
DAHGSGVMGNGAGT

SEQ ID NO: 1927413 - protein, 8 aa, Staphylococcus
DAHHGDGT

SEQ ID NO: 1927414 - protein, 9 aa, Staphylococcus
DAHNAAEKH

SEQ ID NO: 1927415 - protein, 5 aa, Staphylococcus
DAHQS

SEQ ID NO: 1927416 - protein, 7 aa, Staphylococcus
DAHRDEN

SEQ ID NO: 1927417 - protein, 9 aa, Staphylococcus
DAHSTEQRP

SEQ ID NO: 1927418 - protein, 7 aa, Staphylococcus
DAHTRSQ

SEQ ID NO: 1927419 - protein, 8 aa, Staphylococcus
DAHVEAGD

SEQ ID NO: 1927420 - protein, 8 aa, Staphylococcus
DAHVEEGD

SEQ ID NO: 1927421 - protein, 4 aa, Staphylococcus
DAIA

SEQ ID NO: 1927422 - protein, 10 aa, Staphylococcus
DAIADNKDSI

SEQ ID NO: 1927423 - protein, 9 aa, Staphylococcus
DAIAENKDS

SEQ ID NO: 1927424 - protein, 5 aa, Staphylococcus
DAIAR

SEQ ID NO: 1927425 - protein, 11 aa, Staphylococcus
DAIATSASLDP

SEQ ID NO: 1927426 - protein, 9 aa, Staphylococcus
DAIDDETAA

SEQ ID NO: 1927427 - protein, 10 aa, Staphylococcus
DAIEDKADGY

SEQ ID NO: 1927428 - protein, 7 aa, Staphylococcus
DAIESTG

SEQ ID NO: 1927429 - protein, 7 aa, Staphylococcus
DAIGLNN

SEQ ID NO: 1927430 - protein, 26 aa, Staphylococcus
DAIGQNDPTNTRDYTEITTETTNNNI

SEQ ID NO: 1927431 - protein, 12 aa, Staphylococcus
DAIKESFKTPRG

SEQ ID NO: 1927432 - protein, 4 aa, Staphylococcus
DAIN

SEQ ID NO: 1927433 - protein, 6 aa, Staphylococcus
DAINAA

SEQ ID NO: 1927434 - protein, 13 aa, Staphylococcus
DAINDKEARRDQM

SEQ ID NO: 1927435 - protein, 7 aa, Staphylococcus
DAINENT

SEQ ID NO: 1927436 - protein, 13 aa, Staphylococcus
DAINGGTGADELP

SEQ ID NO: 1927437 - protein, 16 aa, Staphylococcus
DAINGGTGGDNLPRHQ

SEQ ID NO: 1927438 - protein, 13 aa, Staphylococcus
DAINGGVGADNLP

SEQ ID NO: 1927439 - protein, 4 aa, Staphylococcus
DAIP

SEQ ID NO: 1927440 - protein, 5 aa, Staphylococcus
DAIPE

SEQ ID NO: 1927441 - protein, 7 aa, Staphylococcus
DAIPNNA

SEQ ID NO: 1927442 - protein, 5 aa, Staphylococcus
DAIPS

SEQ ID NO: 1927443 - protein, 9 aa, Staphylococcus
DAIQEKAKK

SEQ ID NO: 1927444 - protein, 17 aa, Staphylococcus
DAIQEKAKKYVDTQYER

SEQ ID NO: 1927445 - protein, 12 aa, Staphylococcus
DAIQEKNTTYVD

SEQ ID NO: 1927446 - protein, 7 aa, Staphylococcus
DAISNKD

SEQ ID NO: 1927447 - protein, 6 aa, Staphylococcus
DAITTG

SEQ ID NO: 1927448 - protein, 7 aa, Staphylococcus
DAKADGY

SEQ ID NO: 1927449 - protein, 7 aa, Staphylococcus
DAKAEGY

SEQ ID NO: 1927450 - protein, 12 aa, Staphylococcus
DAKAGGNVINGK

SEQ ID NO: 1927451 - protein, 11 aa, Staphylococcus
DAKAKEGKIPR

SEQ ID NO: 1927452 - protein, 8 aa, Staphylococcus
DAKAKGYV

SEQ ID NO: 1927453 - protein, 8 aa, Staphylococcus
DAKALTSS

SEQ ID NO: 1927454 - protein, 6 aa, Staphylococcus
DAKAQD

SEQ ID NO: 1927455 - protein, 9 aa, Staphylococcus
DAKASYDKY

SEQ ID NO: 1927456 - protein, 8 aa, Staphylococcus
DAKDGQTY

SEQ ID NO: 1927457 - protein, 6 aa, Staphylococcus
DAKEAD

SEQ ID NO: 1927458 - protein, 5 aa, Staphylococcus
DAKED

SEQ ID NO: 1927459 - protein, 7 aa, Staphylococcus
DAKEDGI

SEQ ID NO: 1927460 - protein, 6 aa, Staphylococcus
DAKEGH

SEQ ID NO: 1927461 - protein, 16 aa, Staphylococcus
DAKEIKVDRTNATSIP

SEQ ID NO: 1927462 - protein, 5 aa, Staphylococcus
DAKEN

SEQ ID NO: 1927463 - protein, 8 aa, Staphylococcus
DAKEVTAR

SEQ ID NO: 1927464 - protein, 31 aa, Staphylococcus
DAKGETLVQASSQDKDIASDSTSKVDLSTKV

SEQ ID NO: 1927465 - protein, 8 aa, Staphylococcus
DAKIYNNE

SEQ ID NO: 1927466 - protein, 7 aa, Staphylococcus
DAKKDIK

SEQ ID NO: 1927467 - protein, 12 aa, Staphylococcus
DAKKEAEIEKDK

SEQ ID NO: 1927468 - protein, 11 aa, Staphylococcus
DAKKNNDSNEV

SEQ ID NO: 1927469 - protein, 9 aa, Staphylococcus
DAKKSTPLK

SEQ ID NO: 1927470 - protein, 9 aa, Staphylococcus
DAKKTYAEA

SEQ ID NO: 1927471 - protein, 8 aa, Staphylococcus
DAKKVAKK

SEQ ID NO: 1927472 - protein, 6 aa, Staphylococcus
DAKLDD

SEQ ID NO: 1927473 - protein, 7 aa, Staphylococcus
DAKNGKL

SEQ ID NO: 1927474 - protein, 8 aa, Staphylococcus
DAKNVEDL

SEQ ID NO: 1927475 - protein, 7 aa, Staphylococcus
DAKPEDY

SEQ ID NO: 1927476 - protein, 8 aa, Staphylococcus
DAKPEEVV

SEQ ID NO: 1927477 - protein, 7 aa, Staphylococcus
DAKPEGA

SEQ ID NO: 1927478 - protein, 7 aa, Staphylococcus
DAKPETY

SEQ ID NO: 1927479 - protein, 6 aa, Staphylococcus
DAKQAY

SEQ ID NO: 1927480 - protein, 8 aa, Staphylococcus
DAKQIAKE

SEQ ID NO: 1927481 - protein, 12 aa, Staphylococcus
DAKQNDENIQSQ

SEQ ID NO: 1927482 - protein, 14 aa, Staphylococcus
DAKQNGKEIEKDFE

SEQ ID NO: 1927483 - protein, 8 aa, Staphylococcus
DAKQRGTL

SEQ ID NO: 1927484 - protein, 13 aa, Staphylococcus
DAKQSGENISSQF

SEQ ID NO: 1927485 - protein, 9 aa, Staphylococcus
DAKQSIEAG

SEQ ID NO: 1927486 - protein, 9 aa, Staphylococcus
DAKRAQRGI

SEQ ID NO: 1927487 - protein, 6 aa, Staphylococcus
DAKREK

SEQ ID NO: 1927488 - protein, 5 aa, Staphylococcus
DAKRI

SEQ ID NO: 1927489 - protein, 5 aa, Staphylococcus
DAKRQ

SEQ ID NO: 1927490 - protein, 7 aa, Staphylococcus
DAKSTNI

SEQ ID NO: 1927491 - protein, 6 aa, Staphylococcus
DAKSTQ

SEQ ID NO: 1927492 - protein, 6 aa, Staphylococcus
DAKTTW

SEQ ID NO: 1927493 - protein, 10 aa, Staphylococcus
DAKVQADSGK

SEQ ID NO: 1927494 - protein, 14 aa, Staphylococcus
DAKVSSVRAREKAI

SEQ ID NO: 1927495 - protein, 11 aa, Staphylococcus
DAKYSKEKLRT

SEQ ID NO: 1927496 - protein, 20 aa, Staphylococcus
DALANSGYLDTRKHTSNNLE

SEQ ID NO: 1927497 - protein, 5 aa, Staphylococcus
DALAS

SEQ ID NO: 1927498 - protein, 9 aa, Staphylococcus
DALDAKTNG

SEQ ID NO: 1927499 - protein, 11 aa, Staphylococcus
DALDDDTNAIR

SEQ ID NO: 1927500 - protein, 14 aa, Staphylococcus
DALEGKAGTKIVLD

SEQ ID NO: 1927501 - protein, 9 aa, Staphylococcus
DALKENSKL

SEQ ID NO: 1927502 - protein, 13 aa, Staphylococcus
DALKEQKESINED

SEQ ID NO: 1927503 - protein, 9 aa, Staphylococcus
DALKNDSTL

SEQ ID NO: 1927504 - protein, 9 aa, Staphylococcus
DALKNNPEL

SEQ ID NO: 1927505 - protein, 5 aa, Staphylococcus
DALKP

SEQ ID NO: 1927506 - protein, 8 aa, Staphylococcus
DALNDDLK

SEQ ID NO: 1927507 - protein, 12 aa, Staphylococcus
DALNDKENRRDQ

SEQ ID NO: 1927508 - protein, 6 aa, Staphylococcus
DALPEG

SEQ ID NO: 1927509 - protein, 6 aa, Staphylococcus
DALQYS

SEQ ID NO: 1927510 - protein, 14 aa, Staphylococcus
DALSDELKDQMKSQ

SEQ ID NO: 1927511 - protein, 17 aa, Staphylococcus
DALSDKEEAYLTGTDDY

SEQ ID NO: 1927512 - protein, 18 aa, Staphylococcus
DALSDKEQAYLTGTDDYV

SEQ ID NO: 1927513 - protein, 6 aa, Staphylococcus
DALSEE

SEQ ID NO: 1927514 - protein, 9 aa, Staphylococcus
DALSEKLGK

SEQ ID NO: 1927515 - protein, 20 aa, Staphylococcus
DALSPNNGKRVPFGTGTSVS

SEQ ID NO: 1927516 - protein, 7 aa, Staphylococcus
DALTDKE

SEQ ID NO: 1927517 - protein, 9 aa, Staphylococcus
DAMSNGDIG

SEQ ID NO: 1927518 - protein, 9 aa, Staphylococcus
DAMSNGDLG

SEQ ID NO: 1927519 - protein, 19 aa, Staphylococcus
DANAAALGEKHKGAGHNAD

SEQ ID NO: 1927520 - protein, 7 aa, Staphylococcus
DANAAPI

SEQ ID NO: 1927521 - protein, 7 aa, Staphylococcus
DANAFAE

SEQ ID NO: 1927522 - protein, 13 aa, Staphylococcus
DANDEVKTSTKRR

SEQ ID NO: 1927523 - protein, 7 aa, Staphylococcus
DANDQRR

SEQ ID NO: 1927524 - protein, 6 aa, Staphylococcus
DANEGA

SEQ ID NO: 1927525 - protein, 5 aa, Staphylococcus
DANEI

SEQ ID NO: 1927526 - protein, 7 aa, Staphylococcus
DANERYP

SEQ ID NO: 1927527 - protein, 10 aa, Staphylococcus
DANESLSKVD

SEQ ID NO: 1927528 - protein, 17 aa, Staphylococcus
DANGPTGTFINGDGKMP

SEQ ID NO: 1927529 - protein, 10 aa, Staphylococcus
DANHGGSEFD

SEQ ID NO: 1927530 - protein, 14 aa, Staphylococcus
DANNADSGSEEYAK

SEQ ID NO: 1927531 - protein, 8 aa, Staphylococcus
DANNDKDM

SEQ ID NO: 1927532 - protein, 11 aa, Staphylococcus
DANNKNKGPLA

SEQ ID NO: 1927533 - protein, 6 aa, Staphylococcus
DANNLS

SEQ ID NO: 1927534 - protein, 9 aa, Staphylococcus
DANNLTDTK

SEQ ID NO: 1927535 - protein, 6 aa, Staphylococcus
DANPEH

SEQ ID NO: 1927536 - protein, 6 aa, Staphylococcus
DANPKV

SEQ ID NO: 1927537 - protein, 13 aa, Staphylococcus
DANPLAPHPDAVE

SEQ ID NO: 1927538 - protein, 9 aa, Staphylococcus
DANQQTTDQ

SEQ ID NO: 1927539 - protein, 17 aa, Staphylococcus
DANRDAFKERKRPATAK

SEQ ID NO: 1927540 - protein, 7 aa, Staphylococcus
DANREAF

SEQ ID NO: 1927541 - protein, 18 aa, Staphylococcus
DANREAFKERKRPATAKP

SEQ ID NO: 1927542 - protein, 48 aa, Staphylococcus
DANSKVVGSYSDTDGMSTATNSESPKVDVDSPLYRTPKSDKPDEDLGN

SEQ ID NO: 1927543 - protein, 7 aa, Staphylococcus
DANSNSE

SEQ ID NO: 1927544 - protein, 4 aa, Staphylococcus
DANT

SEQ ID NO: 1927545 - protein, 9 aa, Staphylococcus
DANTGTKEF

SEQ ID NO: 1927546 - protein, 6 aa, Staphylococcus
DANTKI

SEQ ID NO: 1927547 - protein, 20 aa, Staphylococcus
DANVAALGEKHKGAGQGAND

SEQ ID NO: 1927548 - protein, 6 aa, Staphylococcus
DANVAD

SEQ ID NO: 1927549 - protein, 18 aa, Staphylococcus
DANVNKDERRDIQKNHSA

SEQ ID NO: 1927550 - protein, 13 aa, Staphylococcus
DAPADENNGRPEV

SEQ ID NO: 1927551 - protein, 8 aa, Staphylococcus
DAPDAEDM

SEQ ID NO: 1927552 - protein, 57 aa, Staphylococcus
DAPDAEDMQFKGSESDEASSESTEAPVEESTKEEASAPAQSSNDEEVDESKRVKAMP

SEQ ID NO: 1927553 - protein, 9 aa, Staphylococcus
DAPDAEEMS

SEQ ID NO: 1927554 - protein, 7 aa, Staphylococcus
DAPEHVT

SEQ ID NO: 1927555 - protein, 5 aa, Staphylococcus
DAPEI

SEQ ID NO: 1927556 - protein, 8 aa, Staphylococcus
DAPEPSDI

SEQ ID NO: 1927557 - protein, 15 aa, Staphylococcus
DAPETGFITIVLGDK

SEQ ID NO: 1927558 - protein, 5 aa, Staphylococcus
DAPEV

SEQ ID NO: 1927559 - protein, 6 aa, Staphylococcus
DAPEVS

SEQ ID NO: 1927560 - protein, 21 aa, Staphylococcus
DAPEYASAEEGIEANYENGVT

SEQ ID NO: 1927561 - protein, 6 aa, Staphylococcus
DAPGMN

SEQ ID NO: 1927562 - protein, 5 aa, Staphylococcus
DAPHK

SEQ ID NO: 1927563 - protein, 14 aa, Staphylococcus
DAPIGRDKKDRQSM

SEQ ID NO: 1927564 - protein, 13 aa, Staphylococcus
DAPIGRNKKDRQA

SEQ ID NO: 1927565 - protein, 13 aa, Staphylococcus
DAPIGRNKNDRQA

SEQ ID NO: 1927566 - protein, 14 aa, Staphylococcus
DAPIGRNKNDRQSM

SEQ ID NO: 1927567 - protein, 4 aa, Staphylococcus
DAPK

SEQ ID NO: 1927568 - protein, 8 aa, Staphylococcus
DAPKDDPE

SEQ ID NO: 1927569 - protein, 7 aa, Staphylococcus
DAPKKHP

SEQ ID NO: 1927570 - protein, 8 aa, Staphylococcus
DAPKKNPR

SEQ ID NO: 1927571 - protein, 7 aa, Staphylococcus
DAPKVRN

SEQ ID NO: 1927572 - protein, 7 aa, Staphylococcus
DAPMKQA

SEQ ID NO: 1927573 - protein, 6 aa, Staphylococcus
DAPNIE

SEQ ID NO: 1927574 - protein, 17 aa, Staphylococcus
DAPQTLRDISKAFANQN

SEQ ID NO: 1927575 - protein, 5 aa, Staphylococcus
DAPRE

SEQ ID NO: 1927576 - protein, 19 aa, Staphylococcus
DAPSDVSDKQLQELSLRIR

SEQ ID NO: 1927577 - protein, 9 aa, Staphylococcus
DAPSEETIK

SEQ ID NO: 1927578 - protein, 9 aa, Staphylococcus
DAPSETTIK

SEQ ID NO: 1927579 - protein, 19 aa, Staphylococcus
DAPSEVSDKQLEELSLRIR

SEQ ID NO: 1927580 - protein, 19 aa, Staphylococcus
DAPSEVSENQLEELSLRIR

SEQ ID NO: 1927581 - protein, 10 aa, Staphylococcus
DAPSGNSSKE

SEQ ID NO: 1927582 - protein, 10 aa, Staphylococcus
DAPYEAPEDP

SEQ ID NO: 1927583 - protein, 20 aa, Staphylococcus
DAPYLSPHPYRGKRNEPERV

SEQ ID NO: 1927584 - protein, 18 aa, Staphylococcus
DAPYLSPHPYRGKRNEPM

SEQ ID NO: 1927585 - protein, 19 aa, Staphylococcus
DAPYLSPHPYRGKRNEPQR

SEQ ID NO: 1927586 - protein, 6 aa, Staphylococcus
DAQALT

SEQ ID NO: 1927587 - protein, 6 aa, Staphylococcus
DAQATE

SEQ ID NO: 1927588 - protein, 7 aa, Staphylococcus
DAQDSRR

SEQ ID NO: 1927589 - protein, 13 aa, Staphylococcus
DAQEKGGQLSRSI

SEQ ID NO: 1927590 - protein, 6 aa, Staphylococcus
DAQEKN

SEQ ID NO: 1927591 - protein, 6 aa, Staphylococcus
DAQETY

SEQ ID NO: 1927592 - protein, 5 aa, Staphylococcus
DAQEY

SEQ ID NO: 1927593 - protein, 6 aa, Staphylococcus
DAQGQH

SEQ ID NO: 1927594 - protein, 6 aa, Staphylococcus
DAQIED

SEQ ID NO: 1927595 - protein, 8 aa, Staphylococcus
DAQIYEKE

SEQ ID NO: 1927596 - protein, 12 aa, Staphylococcus
DAQIYEKEDSKV

SEQ ID NO: 1927597 - protein, 13 aa, Staphylococcus
DAQIYEKEEGSKV

SEQ ID NO: 1927598 - protein, 4 aa, Staphylococcus
DAQK

SEQ ID NO: 1927599 - protein, 7 aa, Staphylococcus
DAQKHSV

SEQ ID NO: 1927600 - protein, 8 aa, Staphylococcus
DAQKKSVN

SEQ ID NO: 1927601 - protein, 15 aa, Staphylococcus
DAQKNKVSLTMINPN

SEQ ID NO: 1927602 - protein, 8 aa, Staphylococcus
DAQKNNDL

SEQ ID NO: 1927603 - protein, 8 aa, Staphylococcus
DAQKQSVN

SEQ ID NO: 1927604 - protein, 8 aa, Staphylococcus
DAQKSSVN

SEQ ID NO: 1927605 - protein, 4 aa, Staphylococcus
DAQL

SEQ ID NO: 1927606 - protein, 7 aa, Staphylococcus
DAQLNDG

SEQ ID NO: 1927607 - protein, 6 aa, Staphylococcus
DAQNGI

SEQ ID NO: 1927608 - protein, 6 aa, Staphylococcus
DAQPEG

SEQ ID NO: 1927609 - protein, 8 aa, Staphylococcus
DAQPQEID

SEQ ID NO: 1927610 - protein, 5 aa, Staphylococcus
DAQRE

SEQ ID NO: 1927611 - protein, 7 aa, Staphylococcus
DAQSKSE

SEQ ID NO: 1927612 - protein, 21 aa, Staphylococcus
DAQSMSKPAQAEDDAESKKRF

SEQ ID NO: 1927613 - protein, 7 aa, Staphylococcus
DAQSTEI

SEQ ID NO: 1927614 - protein, 4 aa, Staphylococcus
DAQT

SEQ ID NO: 1927615 - protein, 5 aa, Staphylococcus
DAQTK

SEQ ID NO: 1927616 - protein, 7 aa, Staphylococcus
DAQTLAR

SEQ ID NO: 1927617 - protein, 16 aa, Staphylococcus
DAQVESYRKLKHVIES

SEQ ID NO: 1927618 - protein, 8 aa, Staphylococcus
DAQVSADK

SEQ ID NO: 1927619 - protein, 12 aa, Staphylococcus
DARAPRDGRNIE

SEQ ID NO: 1927620 - protein, 4 aa, Staphylococcus
DARD

SEQ ID NO: 1927621 - protein, 6 aa, Staphylococcus
DARDQD

SEQ ID NO: 1927622 - protein, 6 aa, Staphylococcus
DAREGA

SEQ ID NO: 1927623 - protein, 13 aa, Staphylococcus
DARERALNGEGST

SEQ ID NO: 1927624 - protein, 11 aa, Staphylococcus
DARETFEDVQD

SEQ ID NO: 1927625 - protein, 4 aa, Staphylococcus
DARF

SEQ ID NO: 1927626 - protein, 36 aa, Staphylococcus
DARGQNVTTNTRDYTEITTETTNNNILSPSSTAYPY

SEQ ID NO: 1927627 - protein, 8 aa, Staphylococcus
DARHIQSE

SEQ ID NO: 1927628 - protein, 10 aa, Staphylococcus
DARHKREKLG

SEQ ID NO: 1927629 - protein, 9 aa, Staphylococcus
DARHVENEE

SEQ ID NO: 1927630 - protein, 18 aa, Staphylococcus
DARKGVQKAIASRRKQLE

SEQ ID NO: 1927631 - protein, 4 aa, Staphylococcus
DARL

SEQ ID NO: 1927632 - protein, 11 aa, Staphylococcus
DARNALPDTFS

SEQ ID NO: 1927633 - protein, 6 aa, Staphylococcus
DARNNV

SEQ ID NO: 1927634 - protein, 8 aa, Staphylococcus
DARPGGKN

SEQ ID NO: 1927635 - protein, 16 aa, Staphylococcus
DARREAFDPSGDLKPY

SEQ ID NO: 1927636 - protein, 7 aa, Staphylococcus
DARRRRE

SEQ ID NO: 1927637 - protein, 11 aa, Staphylococcus
DARSARAYGSA

SEQ ID NO: 1927638 - protein, 11 aa, Staphylococcus
DARSKNQSIPD

SEQ ID NO: 1927639 - protein, 17 aa, Staphylococcus
DASARTEKEISQKCESY

SEQ ID NO: 1927640 - protein, 9 aa, Staphylococcus
DASDAEKGV

SEQ ID NO: 1927641 - protein, 7 aa, Staphylococcus
DASDNTI

SEQ ID NO: 1927642 - protein, 7 aa, Staphylococcus
DASDNTL

SEQ ID NO: 1927643 - protein, 17 aa, Staphylococcus
DASDNTTKTIKNKCRSY

SEQ ID NO: 1927644 - protein, 10 aa, Staphylococcus
DASENTVKNI

SEQ ID NO: 1927645 - protein, 7 aa, Staphylococcus
DASERGM

SEQ ID NO: 1927646 - protein, 28 aa, Staphylococcus
DASEWNKDERKGVQQAIASRRKQLEKES

SEQ ID NO: 1927647 - protein, 14 aa, Staphylococcus
DASGGGVTVSGGEP

SEQ ID NO: 1927648 - protein, 9 aa, Staphylococcus
DASGISSDE

SEQ ID NO: 1927649 - protein, 5 aa, Staphylococcus
DASGR

SEQ ID NO: 1927650 - protein, 7 aa, Staphylococcus
DASGRTV

SEQ ID NO: 1927651 - protein, 8 aa, Staphylococcus
DASIGKRP

SEQ ID NO: 1927652 - protein, 18 aa, Staphylococcus
DASIKNGFETYTSDNGRM

SEQ ID NO: 1927653 - protein, 8 aa, Staphylococcus
DASINDEI

SEQ ID NO: 1927654 - protein, 19 aa, Staphylococcus
DASKDQNKQKIKDKSLNKK

SEQ ID NO: 1927655 - protein, 5 aa, Staphylococcus
DASKM

SEQ ID NO: 1927656 - protein, 8 aa, Staphylococcus
DASNDSSI

SEQ ID NO: 1927657 - protein, 5 aa, Staphylococcus
DASNE

SEQ ID NO: 1927658 - protein, 8 aa, Staphylococcus
DASNTGSI

SEQ ID NO: 1927659 - protein, 7 aa, Staphylococcus
DASPNTM

SEQ ID NO: 1927660 - protein, 8 aa, Staphylococcus
DASQASAI

SEQ ID NO: 1927661 - protein, 8 aa, Staphylococcus
DASQNGKS

SEQ ID NO: 1927662 - protein, 8 aa, Staphylococcus
DASQQQAV

SEQ ID NO: 1927663 - protein, 6 aa, Staphylococcus
DASQRG

SEQ ID NO: 1927664 - protein, 9 aa, Staphylococcus
DASRSEALE

SEQ ID NO: 1927665 - protein, 7 aa, Staphylococcus
DASSENI

SEQ ID NO: 1927666 - protein, 8 aa, Staphylococcus
DASSESPF

SEQ ID NO: 1927667 - protein, 13 aa, Staphylococcus
DASSIKKEKPYHG

SEQ ID NO: 1927668 - protein, 7 aa, Staphylococcus
DASSKGL

SEQ ID NO: 1927669 - protein, 8 aa, Staphylococcus
DASTFAQG

SEQ ID NO: 1927670 - protein, 15 aa, Staphylococcus
DASTIQKENHSATID

SEQ ID NO: 1927671 - protein, 42 aa, Staphylococcus
DASTKGLDELTSAKTKSLNEIKTSKDSTLKEITNTGSDYTNQ

SEQ ID NO: 1927672 - protein, 10 aa, Staphylococcus
DASTSKDMSD

SEQ ID NO: 1927673 - protein, 6 aa, Staphylococcus
DASYEG

SEQ ID NO: 1927674 - protein, 10 aa, Staphylococcus
DASYTDFSNT

SEQ ID NO: 1927675 - protein, 5 aa, Staphylococcus
DASYW

SEQ ID NO: 1927676 - protein, 7 aa, Staphylococcus
DATDERV

SEQ ID NO: 1927677 - protein, 7 aa, Staphylococcus
DATDNGF

SEQ ID NO: 1927678 - protein, 7 aa, Staphylococcus
DATDVDI

SEQ ID NO: 1927679 - protein, 8 aa, Staphylococcus
DATEPYDG

SEQ ID NO: 1927680 - protein, 12 aa, Staphylococcus
DATGKKPGRGAY

SEQ ID NO: 1927681 - protein, 14 aa, Staphylococcus
DATGKQQGRGAYVS

SEQ ID NO: 1927682 - protein, 11 aa, Staphylococcus
DATGNFENNGR

SEQ ID NO: 1927683 - protein, 8 aa, Staphylococcus
DATGRTAE

SEQ ID NO: 1927684 - protein, 7 aa, Staphylococcus
DATGRTV

SEQ ID NO: 1927685 - protein, 12 aa, Staphylococcus
DATLKDAEKKVN

SEQ ID NO: 1927686 - protein, 6 aa, Staphylococcus
DATNDF

SEQ ID NO: 1927687 - protein, 6 aa, Staphylococcus
DATNDL

SEQ ID NO: 1927688 - protein, 17 aa, Staphylococcus
DATNGKVYNAGTGNQTD

SEQ ID NO: 1927689 - protein, 5 aa, Staphylococcus
DATNT

SEQ ID NO: 1927690 - protein, 7 aa, Staphylococcus
DATPIEL

SEQ ID NO: 1927691 - protein, 6 aa, Staphylococcus
DATPIR

SEQ ID NO: 1927692 - protein, 7 aa, Staphylococcus
DATPYDH

SEQ ID NO: 1927693 - protein, 8 aa, Staphylococcus
DATPYDRD

SEQ ID NO: 1927694 - protein, 8 aa, Staphylococcus
DATPYDRK

SEQ ID NO: 1927695 - protein, 8 aa, Staphylococcus
DATQPYTE

SEQ ID NO: 1927696 - protein, 9 aa, Staphylococcus
DATQQEPGN

SEQ ID NO: 1927697 - protein, 6 aa, Staphylococcus
DATQRG

SEQ ID NO: 1927698 - protein, 6 aa, Staphylococcus
DATRVS

SEQ ID NO: 1927699 - protein, 8 aa, Staphylococcus
DATSPNDI

SEQ ID NO: 1927700 - protein, 8 aa, Staphylococcus
DATSTDLE

SEQ ID NO: 1927701 - protein, 10 aa, Staphylococcus
DATTQSGALD

SEQ ID NO: 1927702 - protein, 12 aa, Staphylococcus
DATVGDDTTVGP

SEQ ID NO: 1927703 - protein, 10 aa, Staphylococcus
DAVANERDIP

SEQ ID NO: 1927704 - protein, 8 aa, Staphylococcus
DAVDENDI

SEQ ID NO: 1927705 - protein, 14 aa, Staphylococcus
DAVDKDGKKHPLTQ

SEQ ID NO: 1927706 - protein, 7 aa, Staphylococcus
DAVEADQ

SEQ ID NO: 1927707 - protein, 5 aa, Staphylococcus
DAVET

SEQ ID NO: 1927708 - protein, 11 aa, Staphylococcus
DAVKESFKHPR

SEQ ID NO: 1927709 - protein, 6 aa, Staphylococcus
DAVKNA

SEQ ID NO: 1927710 - protein, 71 aa, Staphylococcus
DAVNHDSDIENDSAQGRDEYALTDSTVEDGKVNQEFESNTQNFDSGYRDFETNDNTSKSLNNVDDADYREI

SEQ ID NO: 1927711 - protein, 10 aa, Staphylococcus
DAVNSGDTMT

SEQ ID NO: 1927712 - protein, 8 aa, Staphylococcus
DAVQNTKV

SEQ ID NO: 1927713 - protein, 8 aa, Staphylococcus
DAVRGGGL

SEQ ID NO: 1927714 - protein, 7 aa, Staphylococcus
DAVRNND

SEQ ID NO: 1927715 - protein, 13 aa, Staphylococcus
DAVSKGGKLSRSL

SEQ ID NO: 1927716 - protein, 7 aa, Staphylococcus
DAVTHGA

SEQ ID NO: 1927717 - protein, 8 aa, Staphylococcus
DAVTSATY

SEQ ID NO: 1927718 - protein, 14 aa, Staphylococcus
DAYAKVKDNEESKK

SEQ ID NO: 1927719 - protein, 9 aa, Staphylococcus
DAYDNNSGL

SEQ ID NO: 1927720 - protein, 7 aa, Staphylococcus
DAYPNES

SEQ ID NO: 1927721 - protein, 7 aa, Staphylococcus
DAYPRQI

SEQ ID NO: 1927722 - protein, 11 aa, Staphylococcus
DAYPSSQGQKG

SEQ ID NO: 1927723 - protein, 6 aa, Staphylococcus
DAYSDS

SEQ ID NO: 1927724 - protein, 5 aa, Staphylococcus
DAYSG

SEQ ID NO: 1927725 - protein, 10 aa, Staphylococcus
DAYTKDDKSY

SEQ ID NO: 1927726 - protein, 13 aa, Staphylococcus
DCDVETNVGPNGV

SEQ ID NO: 1927727 - protein, 6 aa, Staphylococcus
DCGNQH

SEQ ID NO: 1927728 - protein, 5 aa, Staphylococcus
DCKDT

SEQ ID NO: 1927729 - protein, 11 aa, Staphylococcus
DCKVETNIGQH

SEQ ID NO: 1927730 - protein, 12 aa, Staphylococcus
DCKVETNIGQNG

SEQ ID NO: 1927731 - protein, 9 aa, Staphylococcus
DCNNGLSDQ

SEQ ID NO: 1927732 - protein, 4 aa, Staphylococcus
DCPD

SEQ ID NO: 1927733 - protein, 9 aa, Staphylococcus
DCPKVKAKP

SEQ ID NO: 1927734 - protein, 11 aa, Staphylococcus
DCPNIKNETDR

SEQ ID NO: 1927735 - protein, 11 aa, Staphylococcus
DCPNIKSETER

SEQ ID NO: 1927736 - protein, 8 aa, Staphylococcus
DCPTTTTY

SEQ ID NO: 1927737 - protein, 7 aa, Staphylococcus
DCQTKDE

SEQ ID NO: 1927738 - protein, 9 aa, Staphylococcus
DCSKGTKQK

SEQ ID NO: 1927739 - protein, 16 aa, Staphylococcus
DCSVQRKNQKLIEESP

SEQ ID NO: 1927740 - protein, 17 aa, Staphylococcus
DCTHSDGRVSNSSSKSL

SEQ ID NO: 1927741 - protein, 8 aa, Staphylococcus
DCTRTQAN

SEQ ID NO: 1927742 - protein, 8 aa, Staphylococcus
DCTRTQAS

SEQ ID NO: 1927743 - protein, 4 aa, Staphylococcus
DDAA

SEQ ID NO: 1927744 - protein, 5 aa, Staphylococcus
DDAAF

SEQ ID NO: 1927745 - protein, 11 aa, Staphylococcus
DDAASVDIETN

SEQ ID NO: 1927746 - protein, 4 aa, Staphylococcus
DDAE

SEQ ID NO: 1927747 - protein, 26 aa, Staphylococcus
DDAEDGNLINTSDEDKTTDEEEKAHS

SEQ ID NO: 1927748 - protein, 6 aa, Staphylococcus
DDAEEQ

SEQ ID NO: 1927749 - protein, 7 aa, Staphylococcus
DDAESLI

SEQ ID NO: 1927750 - protein, 4 aa, Staphylococcus
DDAF

SEQ ID NO: 1927751 - protein, 5 aa, Staphylococcus
DDAFE

SEQ ID NO: 1927752 - protein, 8 aa, Staphylococcus
DDAGIENG

SEQ ID NO: 1927753 - protein, 6 aa, Staphylococcus
DDAGKL

SEQ ID NO: 1927754 - protein, 7 aa, Staphylococcus
DDAIRSA

SEQ ID NO: 1927755 - protein, 5 aa, Staphylococcus
DDAKF

SEQ ID NO: 1927756 - protein, 9 aa, Staphylococcus
DDAKKVAKK

SEQ ID NO: 1927757 - protein, 6 aa, Staphylococcus
DDAKQI

SEQ ID NO: 1927758 - protein, 8 aa, Staphylococcus
DDALRNYN

SEQ ID NO: 1927759 - protein, 10 aa, Staphylococcus
DDAMPENSTM

SEQ ID NO: 1927760 - protein, 18 aa, Staphylococcus
DDAPAKLRDISKAFAAQN

SEQ ID NO: 1927761 - protein, 7 aa, Staphylococcus
DDAPEVS

SEQ ID NO: 1927762 - protein, 7 aa, Staphylococcus
DDAPQLD

SEQ ID NO: 1927763 - protein, 7 aa, Staphylococcus
DDAPQYI

SEQ ID NO: 1927764 - protein, 7 aa, Staphylococcus
DDAQSMQ

SEQ ID NO: 1927765 - protein, 11 aa, Staphylococcus
DDAQTEPHGPD

SEQ ID NO: 1927766 - protein, 6 aa, Staphylococcus
DDAQTM

SEQ ID NO: 1927767 - protein, 12 aa, Staphylococcus
DDARSARAYGSA

SEQ ID NO: 1927768 - protein, 4 aa, Staphylococcus
DDAS

SEQ ID NO: 1927769 - protein, 7 aa, Staphylococcus
DDAVAQI

SEQ ID NO: 1927770 - protein, 7 aa, Staphylococcus
DDAVTEI

SEQ ID NO: 1927771 - protein, 8 aa, Staphylococcus
DDAVTGIK

SEQ ID NO: 1927772 - protein, 16 aa, Staphylococcus
DDAYAYENENGQYGKS

SEQ ID NO: 1927773 - protein, 7 aa, Staphylococcus
DDDAESL

SEQ ID NO: 1927774 - protein, 7 aa, Staphylococcus
DDDASEV

SEQ ID NO: 1927775 - protein, 4 aa, Staphylococcus
DDDD

SEQ ID NO: 1927776 - protein, 10 aa, Staphylococcus
DDDDEEDENL

SEQ ID NO: 1927777 - protein, 7 aa, Staphylococcus
DDDEAIK

SEQ ID NO: 1927778 - protein, 11 aa, Staphylococcus
DDDEDNDKPEL

SEQ ID NO: 1927779 - protein, 11 aa, Staphylococcus
DDDEDNDKPNL

SEQ ID NO: 1927780 - protein, 10 aa, Staphylococcus
DDDEDNDKPY

SEQ ID NO: 1927781 - protein, 8 aa, Staphylococcus
DDDEEDQN

SEQ ID NO: 1927782 - protein, 15 aa, Staphylococcus
DDDEFEEDENWEEEY

SEQ ID NO: 1927783 - protein, 10 aa, Staphylococcus
DDDEKRSNLE

SEQ ID NO: 1927784 - protein, 45 aa, Staphylococcus
DDDENEGISNKTTDENNDEKIDDANYREINESESLMQDKANDLKF

SEQ ID NO: 1927785 - protein, 6 aa, Staphylococcus
DDDERI

SEQ ID NO: 1927786 - protein, 32 aa, Staphylococcus
DDDESRDYIENNDDDDNPTLGEVFGDKLKNLK

SEQ ID NO: 1927787 - protein, 13 aa, Staphylococcus
DDDFTGDITHPNQ

SEQ ID NO: 1927788 - protein, 12 aa, Staphylococcus
DDDGNEVEPNVK

SEQ ID NO: 1927789 - protein, 6 aa, Staphylococcus
DDDKEA

SEQ ID NO: 1927790 - protein, 6 aa, Staphylococcus
DDDKPA

SEQ ID NO: 1927791 - protein, 8 aa, Staphylococcus
DDDKSHAD

SEQ ID NO: 1927792 - protein, 6 aa, Staphylococcus
DDDNEA

SEQ ID NO: 1927793 - protein, 12 aa, Staphylococcus
DDDNNNRPYQDA

SEQ ID NO: 1927794 - protein, 6 aa, Staphylococcus
DDDPEH

SEQ ID NO: 1927795 - protein, 9 aa, Staphylococcus
DDDPNKQNI

SEQ ID NO: 1927796 - protein, 6 aa, Staphylococcus
DDDQPK

SEQ ID NO: 1927797 - protein, 14 aa, Staphylococcus
DDDQPMTTHTTNPV

SEQ ID NO: 1927798 - protein, 5 aa, Staphylococcus
DDDTI

SEQ ID NO: 1927799 - protein, 8 aa, Staphylococcus
DDDTPIGR

SEQ ID NO: 1927800 - protein, 12 aa, Staphylococcus
DDDYTADITHPN

SEQ ID NO: 1927801 - protein, 15 aa, Staphylococcus
DDEAEDLKSHTQEAS

SEQ ID NO: 1927802 - protein, 7 aa, Staphylococcus
DDEAINV

SEQ ID NO: 1927803 - protein, 14 aa, Staphylococcus
DDEAQPLDATKGAQ

SEQ ID NO: 1927804 - protein, 7 aa, Staphylococcus
DDEASNA

SEQ ID NO: 1927805 - protein, 14 aa, Staphylococcus
DDEATTANEEEGIA

SEQ ID NO: 1927806 - protein, 6 aa, Staphylococcus
DDEDDL

SEQ ID NO: 1927807 - protein, 12 aa, Staphylococcus
DDEEDDPDAIER

SEQ ID NO: 1927808 - protein, 13 aa, Staphylococcus
DDEEDETERSIHE

SEQ ID NO: 1927809 - protein, 6 aa, Staphylococcus
DDEETA

SEQ ID NO: 1927810 - protein, 7 aa, Staphylococcus
DDEEVYQ

SEQ ID NO: 1927811 - protein, 5 aa, Staphylococcus
DDEFT

SEQ ID NO: 1927812 - protein, 7 aa, Staphylococcus
DDEGEKI

SEQ ID NO: 1927813 - protein, 11 aa, Staphylococcus
DDEGNELPANR

SEQ ID NO: 1927814 - protein, 8 aa, Staphylococcus
DDEGNETL

SEQ ID NO: 1927815 - protein, 13 aa, Staphylococcus
DDEGNKVDTNVKG

SEQ ID NO: 1927816 - protein, 15 aa, Staphylococcus
DDEGNLHRLMSADID

SEQ ID NO: 1927817 - protein, 25 aa, Staphylococcus
DDEGNRKKVQKGGYRTKQEAKRIAE

SEQ ID NO: 1927818 - protein, 7 aa, Staphylococcus
DDEGNRY

SEQ ID NO: 1927819 - protein, 12 aa, Staphylococcus
DDEGQPVETNVK

SEQ ID NO: 1927820 - protein, 9 aa, Staphylococcus
DDEGSPGTD

SEQ ID NO: 1927821 - protein, 8 aa, Staphylococcus
DDEHGWNN

SEQ ID NO: 1927822 - protein, 6 aa, Staphylococcus
DDEHSE

SEQ ID NO: 1927823 - protein, 4 aa, Staphylococcus
DDEI

SEQ ID NO: 1927824 - protein, 12 aa, Staphylococcus
DDEIGNGESIFD

SEQ ID NO: 1927825 - protein, 5 aa, Staphylococcus
DDEIK

SEQ ID NO: 1927826 - protein, 7 aa, Staphylococcus
DDEIQQQ

SEQ ID NO: 1927827 - protein, 4 aa, Staphylococcus
DDEK

SEQ ID NO: 1927828 - protein, 8 aa, Staphylococcus
DDEKEGRM

SEQ ID NO: 1927829 - protein, 10 aa, Staphylococcus
DDEKEKHSVN

SEQ ID NO: 1927830 - protein, 17 aa, Staphylococcus
DDEKMGSYQYEITYKEQ

SEQ ID NO: 1927831 - protein, 8 aa, Staphylococcus
DDEKQNEL

SEQ ID NO: 1927832 - protein, 6 aa, Staphylococcus
DDEKVK

SEQ ID NO: 1927833 - protein, 13 aa, Staphylococcus
DDELDSVKEEVKK

SEQ ID NO: 1927834 - protein, 6 aa, Staphylococcus
DDELGE

SEQ ID NO: 1927835 - protein, 10 aa, Staphylococcus
DDELKEDRLQ

SEQ ID NO: 1927836 - protein, 4 aa, Staphylococcus
DDEM

SEQ ID NO: 1927837 - protein, 35 aa, Staphylococcus
DDEMDDDDDIPAQTDDQETLDDPEDEQVEDEISES

SEQ ID NO: 1927838 - protein, 33 aa, Staphylococcus
DDEMDDDDDIPAQTDDQETLDDSDDNEEDIDGS

SEQ ID NO: 1927839 - protein, 7 aa, Staphylococcus
DDEMETA

SEQ ID NO: 1927840 - protein, 6 aa, Staphylococcus
DDENEL

SEQ ID NO: 1927841 - protein, 6 aa, Staphylococcus
DDENEM

SEQ ID NO: 1927842 - protein, 6 aa, Staphylococcus
DDEPEL

SEQ ID NO: 1927843 - protein, 7 aa, Staphylococcus
DDEPSHV

SEQ ID NO: 1927844 - protein, 8 aa, Staphylococcus
DDEPVTGS

SEQ ID NO: 1927845 - protein, 12 aa, Staphylococcus
DDEQARGKSKGL

SEQ ID NO: 1927846 - protein, 5 aa, Staphylococcus
DDEQH

SEQ ID NO: 1927847 - protein, 5 aa, Staphylococcus
DDEQI

SEQ ID NO: 1927848 - protein, 7 aa, Staphylococcus
DDEQLND

SEQ ID NO: 1927849 - protein, 6 aa, Staphylococcus
DDEQQA

SEQ ID NO: 1927850 - protein, 8 aa, Staphylococcus
DDEQQHHT

SEQ ID NO: 1927851 - protein, 8 aa, Staphylococcus
DDEQTEEM

SEQ ID NO: 1927852 - protein, 8 aa, Staphylococcus
DDERQEAV

SEQ ID NO: 1927853 - protein, 7 aa, Staphylococcus
DDERQGR

SEQ ID NO: 1927854 - protein, 8 aa, Staphylococcus
DDERQGRM

SEQ ID NO: 1927855 - protein, 7 aa, Staphylococcus
DDESEVI

SEQ ID NO: 1927856 - protein, 7 aa, Staphylococcus
DDESKRY

SEQ ID NO: 1927857 - protein, 6 aa, Staphylococcus
DDESMI

SEQ ID NO: 1927858 - protein, 14 aa, Staphylococcus
DDESPSSHQSLSGS

SEQ ID NO: 1927859 - protein, 7 aa, Staphylococcus
DDESQLD

SEQ ID NO: 1927860 - protein, 10 aa, Staphylococcus
DDETFSSAGT

SEQ ID NO: 1927861 - protein, 9 aa, Staphylococcus
DDETLDTSI

SEQ ID NO: 1927862 - protein, 11 aa, Staphylococcus
DDETLDTSIEE

SEQ ID NO: 1927863 - protein, 9 aa, Staphylococcus
DDETLEASV

SEQ ID NO: 1927864 - protein, 9 aa, Staphylococcus
DDETLLPDP

SEQ ID NO: 1927865 - protein, 15 aa, Staphylococcus
DDETVSKEVEQKTQL

SEQ ID NO: 1927866 - protein, 4 aa, Staphylococcus
DDEV

SEQ ID NO: 1927867 - protein, 7 aa, Staphylococcus
DDEVDDK

SEQ ID NO: 1927868 - protein, 11 aa, Staphylococcus
DDEVDVEPLPE

SEQ ID NO: 1927869 - protein, 13 aa, Staphylococcus
DDEVKKYLKKIKN

SEQ ID NO: 1927870 - protein, 6 aa, Staphylococcus
DDFDQE

SEQ ID NO: 1927871 - protein, 8 aa, Staphylococcus
DDFEPGKN

SEQ ID NO: 1927872 - protein, 11 aa, Staphylococcus
DDFKGEAKPGP

SEQ ID NO: 1927873 - protein, 8 aa, Staphylococcus
DDFKPNGT

SEQ ID NO: 1927874 - protein, 6 aa, Staphylococcus
DDFPQQ

SEQ ID NO: 1927875 - protein, 5 aa, Staphylococcus
DDFTD

SEQ ID NO: 1927876 - protein, 7 aa, Staphylococcus
DDFTKKE

SEQ ID NO: 1927877 - protein, 5 aa, Staphylococcus
DDFYG

SEQ ID NO: 1927878 - protein, 7 aa, Staphylococcus
DDGANGY

SEQ ID NO: 1927879 - protein, 6 aa, Staphylococcus
DDGEEL

SEQ ID NO: 1927880 - protein, 6 aa, Staphylococcus
DDGEPT

SEQ ID NO: 1927881 - protein, 8 aa, Staphylococcus
DDGEPTYP

SEQ ID NO: 1927882 - protein, 16 aa, Staphylococcus
DDGETFTEHPDLSKES

SEQ ID NO: 1927883 - protein, 5 aa, Staphylococcus
DDGFE

SEQ ID NO: 1927884 - protein, 7 aa, Staphylococcus
DDGGALQ

SEQ ID NO: 1927885 - protein, 6 aa, Staphylococcus
DDGGQI

SEQ ID NO: 1927886 - protein, 7 aa, Staphylococcus
DDGGVHK

SEQ ID NO: 1927887 - protein, 5 aa, Staphylococcus
DDGIE

SEQ ID NO: 1927888 - protein, 9 aa, Staphylococcus
DDGIIDSRE

SEQ ID NO: 1927889 - protein, 6 aa, Staphylococcus
DDGITA

SEQ ID NO: 1927890 - protein, 8 aa, Staphylococcus
DDGKASQY

SEQ ID NO: 1927891 - protein, 7 aa, Staphylococcus
DDGKDAV

SEQ ID NO: 1927892 - protein, 9 aa, Staphylococcus
DDGKGFDVD

SEQ ID NO: 1927893 - protein, 9 aa, Staphylococcus
DDGKIQGVN

SEQ ID NO: 1927894 - protein, 10 aa, Staphylococcus
DDGKKHYDDY

SEQ ID NO: 1927895 - protein, 11 aa, Staphylococcus
DDGKVYDGMED

SEQ ID NO: 1927896 - protein, 5 aa, Staphylococcus
DDGLQ

SEQ ID NO: 1927897 - protein, 13 aa, Staphylococcus
DDGNEVPPQTKGN

SEQ ID NO: 1927898 - protein, 5 aa, Staphylococcus
DDGNP

SEQ ID NO: 1927899 - protein, 6 aa, Staphylococcus
DDGPDM

SEQ ID NO: 1927900 - protein, 8 aa, Staphylococcus
DDGPESVD

SEQ ID NO: 1927901 - protein, 8 aa, Staphylococcus
DDGPKTKQ

SEQ ID NO: 1927902 - protein, 5 aa, Staphylococcus
DDGPM

SEQ ID NO: 1927903 - protein, 9 aa, Staphylococcus
DDGPQSVEE

SEQ ID NO: 1927904 - protein, 5 aa, Staphylococcus
DDGQI

SEQ ID NO: 1927905 - protein, 6 aa, Staphylococcus
DDGQIY

SEQ ID NO: 1927906 - protein, 9 aa, Staphylococcus
DDGQTLATP

SEQ ID NO: 1927907 - protein, 18 aa, Staphylococcus
DDGSDNPDFNPNKPEYKD

SEQ ID NO: 1927908 - protein, 12 aa, Staphylococcus
DDGSMAKGEQLE

SEQ ID NO: 1927909 - protein, 19 aa, Staphylococcus
DDGSVGSGFDLPDKKCESC

SEQ ID NO: 1927910 - protein, 20 aa, Staphylococcus
DDGSVGSGFDLPDKTCETCG

SEQ ID NO: 1927911 - protein, 14 aa, Staphylococcus
DDGTAMKQYLRMVE

SEQ ID NO: 1927912 - protein, 6 aa, Staphylococcus
DDGVAY

SEQ ID NO: 1927913 - protein, 5 aa, Staphylococcus
DDGYR

SEQ ID NO: 1927914 - protein, 5 aa, Staphylococcus
DDHAK

SEQ ID NO: 1927915 - protein, 9 aa, Staphylococcus
DDHISNTPK

SEQ ID NO: 1927916 - protein, 7 aa, Staphylococcus
DDHTGHD

SEQ ID NO: 1927917 - protein, 4 aa, Staphylococcus
DDHV

SEQ ID NO: 1927918 - protein, 5 aa, Staphylococcus
DDIAN

SEQ ID NO: 1927919 - protein, 6 aa, Staphylococcus
DDIAPN

SEQ ID NO: 1927920 - protein, 6 aa, Staphylococcus
DDIDDM

SEQ ID NO: 1927921 - protein, 6 aa, Staphylococcus
DDIDQD

SEQ ID NO: 1927922 - protein, 8 aa, Staphylococcus
DDIEDEDL

SEQ ID NO: 1927923 - protein, 10 aa, Staphylococcus
DDIEDEDLIP

SEQ ID NO: 1927924 - protein, 31 aa, Staphylococcus
DDIERDKAKEYQGQHVSAEDGKEKVKPQPVV

SEQ ID NO: 1927925 - protein, 14 aa, Staphylococcus
DDIEREKTTDFGEA

SEQ ID NO: 1927926 - protein, 8 aa, Staphylococcus
DDIERKLE

SEQ ID NO: 1927927 - protein, 21 aa, Staphylococcus
DDIESQLESDLSSEEESQNTF

SEQ ID NO: 1927928 - protein, 6 aa, Staphylococcus
DDIETL

SEQ ID NO: 1927929 - protein, 5 aa, Staphylococcus
DDIGT

SEQ ID NO: 1927930 - protein, 13 aa, Staphylococcus
DDIKEYDTQLNEI

SEQ ID NO: 1927931 - protein, 9 aa, Staphylococcus
DDIKQQMER

SEQ ID NO: 1927932 - protein, 15 aa, Staphylococcus
DDIKTTNSPAITGDG

SEQ ID NO: 1927933 - protein, 5 aa, Staphylococcus
DDINP

SEQ ID NO: 1927934 - protein, 11 aa, Staphylococcus
DDINSGNDDIK

SEQ ID NO: 1927935 - protein, 4 aa, Staphylococcus
DDIP

SEQ ID NO: 1927936 - protein, 7 aa, Staphylococcus
DDIPGDN

SEQ ID NO: 1927937 - protein, 15 aa, Staphylococcus
DDIQNDESKIREKLR

SEQ ID NO: 1927938 - protein, 21 aa, Staphylococcus
DDIQSKGITCASAGNHAQGVA

SEQ ID NO: 1927939 - protein, 17 aa, Staphylococcus
DDISEEEIEATGAGDQG

SEQ ID NO: 1927940 - protein, 8 aa, Staphylococcus
DDISRDEG

SEQ ID NO: 1927941 - protein, 17 aa, Staphylococcus
DDISYEEAMNNDTYKPI

SEQ ID NO: 1927942 - protein, 8 aa, Staphylococcus
DDITGRRG

SEQ ID NO: 1927943 - protein, 18 aa, Staphylococcus
DDITSIRNQRPRIDTARK

SEQ ID NO: 1927944 - protein, 16 aa, Staphylococcus
DDIVGYTEEERNNNVE

SEQ ID NO: 1927945 - protein, 16 aa, Staphylococcus
DDKAFGELVSKAKDAL

SEQ ID NO: 1927946 - protein, 5 aa, Staphylococcus
DDKAS

SEQ ID NO: 1927947 - protein, 6 aa, Staphylococcus
DDKATM

SEQ ID NO: 1927948 - protein, 12 aa, Staphylococcus
DDKDTETVEKNK

SEQ ID NO: 1927949 - protein, 4 aa, Staphylococcus
DDKE

SEQ ID NO: 1927950 - protein, 9 aa, Staphylococcus
DDKEDIQSQ

SEQ ID NO: 1927951 - protein, 9 aa, Staphylococcus
DDKEITSQR

SEQ ID NO: 1927952 - protein, 12 aa, Staphylococcus
DDKGEPTTDPYK

SEQ ID NO: 1927953 - protein, 7 aa, Staphylococcus
DDKGQLH

SEQ ID NO: 1927954 - protein, 7 aa, Staphylococcus
DDKGSIR

SEQ ID NO: 1927955 - protein, 8 aa, Staphylococcus
DDKGVVDS

SEQ ID NO: 1927956 - protein, 14 aa, Staphylococcus
DDKGYKDKWNSGKA

SEQ ID NO: 1927957 - protein, 7 aa, Staphylococcus
DDKKAIV

SEQ ID NO: 1927958 - protein, 9 aa, Staphylococcus
DDKKDKNTY

SEQ ID NO: 1927959 - protein, 8 aa, Staphylococcus
DDKLAEEL

SEQ ID NO: 1927960 - protein, 4 aa, Staphylococcus
DDKN

SEQ ID NO: 1927961 - protein, 6 aa, Staphylococcus
DDKNAI

SEQ ID NO: 1927962 - protein, 7 aa, Staphylococcus
DDKNGAV

SEQ ID NO: 1927963 - protein, 15 aa, Staphylococcus
DDKNPSILASEHGKD

SEQ ID NO: 1927964 - protein, 8 aa, Staphylococcus
DDKPLHEK

SEQ ID NO: 1927965 - protein, 4 aa, Staphylococcus
DDKQ

SEQ ID NO: 1927966 - protein, 9 aa, Staphylococcus
DDKQDQSLV

SEQ ID NO: 1927967 - protein, 9 aa, Staphylococcus
DDKQDVTDT

SEQ ID NO: 1927968 - protein, 9 aa, Staphylococcus
DDKQTKINK

SEQ ID NO: 1927969 - protein, 10 aa, Staphylococcus
DDKSENVTHH

SEQ ID NO: 1927970 - protein, 6 aa, Staphylococcus
DDKSQK

SEQ ID NO: 1927971 - protein, 9 aa, Staphylococcus
DDKSSSTIY

SEQ ID NO: 1927972 - protein, 9 aa, Staphylococcus
DDKSTDQSL

SEQ ID NO: 1927973 - protein, 9 aa, Staphylococcus
DDKSVTGNL

SEQ ID NO: 1927974 - protein, 12 aa, Staphylococcus
DDKTKADILSDL

SEQ ID NO: 1927975 - protein, 7 aa, Staphylococcus
DDKTVRA

SEQ ID NO: 1927976 - protein, 5 aa, Staphylococcus
DDKVD

SEQ ID NO: 1927977 - protein, 16 aa, Staphylococcus
DDKVVTSTHDITENDT

SEQ ID NO: 1927978 - protein, 7 aa, Staphylococcus
DDLAEDG

SEQ ID NO: 1927979 - protein, 4 aa, Staphylococcus
DDLD

SEQ ID NO: 1927980 - protein, 6 aa, Staphylococcus
DDLDTT

SEQ ID NO: 1927981 - protein, 5 aa, Staphylococcus
DDLED

SEQ ID NO: 1927982 - protein, 7 aa, Staphylococcus
DDLEEDG

SEQ ID NO: 1927983 - protein, 7 aa, Staphylococcus
DDLEEEG

SEQ ID NO: 1927984 - protein, 16 aa, Staphylococcus
DDLERALESGQITRKQ

SEQ ID NO: 1927985 - protein, 8 aa, Staphylococcus
DDLKGRTI

SEQ ID NO: 1927986 - protein, 6 aa, Staphylococcus
DDLKQP

SEQ ID NO: 1927987 - protein, 7 aa, Staphylococcus
DDLNKRI

SEQ ID NO: 1927988 - protein, 18 aa, Staphylococcus
DDLNQNKRIGPDPSEFNG

SEQ ID NO: 1927989 - protein, 8 aa, Staphylococcus
DDLNQTGE

SEQ ID NO: 1927990 - protein, 7 aa, Staphylococcus
DDLPEGD

SEQ ID NO: 1927991 - protein, 7 aa, Staphylococcus
DDLPTAE

SEQ ID NO: 1927992 - protein, 7 aa, Staphylococcus
DDLQQMT

SEQ ID NO: 1927993 - protein, 12 aa, Staphylococcus
DDLRDQGSNVYA

SEQ ID NO: 1927994 - protein, 7 aa, Staphylococcus
DDLTDSQ

SEQ ID NO: 1927995 - protein, 7 aa, Staphylococcus
DDLTNSS

SEQ ID NO: 1927996 - protein, 17 aa, Staphylococcus
DDLTSYAEQIDAKDWEK

SEQ ID NO: 1927997 - protein, 6 aa, Staphylococcus
DDLTYR

SEQ ID NO: 1927998 - protein, 5 aa, Staphylococcus
DDLYQ

SEQ ID NO: 1927999 - protein, 7 aa, Staphylococcus
DDLYRDN

SEQ ID NO: 1928000 - protein, 7 aa, Staphylococcus
DDMDDRT

SEQ ID NO: 1928001 - protein, 9 aa, Staphylococcus
DDMEHEGEH

SEQ ID NO: 1928002 - protein, 12 aa, Staphylococcus
DDMGDPAERDVT

SEQ ID NO: 1928003 - protein, 7 aa, Staphylococcus
DDMHGSF

SEQ ID NO: 1928004 - protein, 6 aa, Staphylococcus
DDMNNP

SEQ ID NO: 1928005 - protein, 7 aa, Staphylococcus
DDMSTAV

SEQ ID NO: 1928006 - protein, 6 aa, Staphylococcus
DDNAIT

SEQ ID NO: 1928007 - protein, 7 aa, Staphylococcus
DDNATNV

SEQ ID NO: 1928008 - protein, 5 aa, Staphylococcus
DDNDI

SEQ ID NO: 1928009 - protein, 18 aa, Staphylococcus
DDNDKDLNKLQNSNQWDD

SEQ ID NO: 1928010 - protein, 7 aa, Staphylococcus
DDNDKRM

SEQ ID NO: 1928011 - protein, 8 aa, Staphylococcus
DDNDYSQM

SEQ ID NO: 1928012 - protein, 26 aa, Staphylococcus
DDNEEEQPQQEEEKVYTGTDLRMLFG

SEQ ID NO: 1928013 - protein, 13 aa, Staphylococcus
DDNEIKTKLKEAL

SEQ ID NO: 1928014 - protein, 7 aa, Staphylococcus
DDNGEME

SEQ ID NO: 1928015 - protein, 7 aa, Staphylococcus
DDNGLKA

SEQ ID NO: 1928016 - protein, 6 aa, Staphylococcus
DDNGLN

SEQ ID NO: 1928017 - protein, 5 aa, Staphylococcus
DDNGQ

SEQ ID NO: 1928018 - protein, 8 aa, Staphylococcus
DDNGYKAG

SEQ ID NO: 1928019 - protein, 7 aa, Staphylococcus
DDNHQTY

SEQ ID NO: 1928020 - protein, 7 aa, Staphylococcus
DDNHYAK

SEQ ID NO: 1928021 - protein, 7 aa, Staphylococcus
DDNIQSG

SEQ ID NO: 1928022 - protein, 5 aa, Staphylococcus
DDNIR

SEQ ID NO: 1928023 - protein, 11 aa, Staphylococcus
DDNLEEDPRED

SEQ ID NO: 1928024 - protein, 5 aa, Staphylococcus
DDNLS

SEQ ID NO: 1928025 - protein, 12 aa, Staphylococcus
DDNNNDNQYQNK

SEQ ID NO: 1928026 - protein, 5 aa, Staphylococcus
DDNNQ

SEQ ID NO: 1928027 - protein, 12 aa, Staphylococcus
DDNNSRNKGPLA

SEQ ID NO: 1928028 - protein, 4 aa, Staphylococcus
DDNP

SEQ ID NO: 1928029 - protein, 6 aa, Staphylococcus
DDNPDL

SEQ ID NO: 1928030 - protein, 9 aa, Staphylococcus
DDNPENITK

SEQ ID NO: 1928031 - protein, 6 aa, Staphylococcus
DDNPKQ

SEQ ID NO: 1928032 - protein, 9 aa, Staphylococcus
DDNQANITQ

SEQ ID NO: 1928033 - protein, 7 aa, Staphylococcus
DDNRIDK

SEQ ID NO: 1928034 - protein, 6 aa, Staphylococcus
DDNSLN

SEQ ID NO: 1928035 - protein, 10 aa, Staphylococcus
DDNTPKDKAV

SEQ ID NO: 1928036 - protein, 5 aa, Staphylococcus
DDNTV

SEQ ID NO: 1928037 - protein, 14 aa, Staphylococcus
DDNVETLASKTGDV

SEQ ID NO: 1928038 - protein, 6 aa, Staphylococcus
DDNVQP

SEQ ID NO: 1928039 - protein, 5 aa, Staphylococcus
DDNVT

SEQ ID NO: 1928040 - protein, 9 aa, Staphylococcus
DDPAGKDWS

SEQ ID NO: 1928041 - protein, 9 aa, Staphylococcus
DDPAGKPWS

SEQ ID NO: 1928042 - protein, 10 aa, Staphylococcus
DDPAGKPWSE

SEQ ID NO: 1928043 - protein, 9 aa, Staphylococcus
DDPAGKSWS

SEQ ID NO: 1928044 - protein, 8 aa, Staphylococcus
DDPATSYK

SEQ ID NO: 1928045 - protein, 8 aa, Staphylococcus
DDPDELKS

SEQ ID NO: 1928046 - protein, 7 aa, Staphylococcus
DDPDFEE

SEQ ID NO: 1928047 - protein, 6 aa, Staphylococcus
DDPDTI

SEQ ID NO: 1928048 - protein, 8 aa, Staphylococcus
DDPEIKKQ

SEQ ID NO: 1928049 - protein, 9 aa, Staphylococcus
DDPEITGHP

SEQ ID NO: 1928050 - protein, 6 aa, Staphylococcus
DDPETF

SEQ ID NO: 1928051 - protein, 7 aa, Staphylococcus
DDPETFA

SEQ ID NO: 1928052 - protein, 4 aa, Staphylococcus
DDPF

SEQ ID NO: 1928053 - protein, 7 aa, Staphylococcus
DDPITMA

SEQ ID NO: 1928054 - protein, 12 aa, Staphylococcus
DDPLNDVAPARA

SEQ ID NO: 1928055 - protein, 5 aa, Staphylococcus
DDPQK

SEQ ID NO: 1928056 - protein, 9 aa, Staphylococcus
DDPQKKKLT

SEQ ID NO: 1928057 - protein, 9 aa, Staphylococcus
DDPQNMGQG

SEQ ID NO: 1928058 - protein, 8 aa, Staphylococcus
DDPRAEDN

SEQ ID NO: 1928059 - protein, 9 aa, Staphylococcus
DDPSEETIK

SEQ ID NO: 1928060 - protein, 7 aa, Staphylococcus
DDPSELK

SEQ ID NO: 1928061 - protein, 7 aa, Staphylococcus
DDPSEMK

SEQ ID NO: 1928062 - protein, 5 aa, Staphylococcus
DDPTI

SEQ ID NO: 1928063 - protein, 9 aa, Staphylococcus
DDPYDKQGG

SEQ ID NO: 1928064 - protein, 5 aa, Staphylococcus
DDQAQ

SEQ ID NO: 1928065 - protein, 12 aa, Staphylococcus
DDQASVDIETDK

SEQ ID NO: 1928066 - protein, 6 aa, Staphylococcus
DDQEAI

SEQ ID NO: 1928067 - protein, 7 aa, Staphylococcus
DDQEGLE

SEQ ID NO: 1928068 - protein, 7 aa, Staphylococcus
DDQFTWT

SEQ ID NO: 1928069 - protein, 11 aa, Staphylococcus
DDQGNELPANR

SEQ ID NO: 1928070 - protein, 12 aa, Staphylococcus
DDQGNELPPNRM

SEQ ID NO: 1928071 - protein, 6 aa, Staphylococcus
DDQHEK

SEQ ID NO: 1928072 - protein, 11 aa, Staphylococcus
DDQKGSIAVGK

SEQ ID NO: 1928073 - protein, 5 aa, Staphylococcus
DDQKR

SEQ ID NO: 1928074 - protein, 5 aa, Staphylococcus
DDQLS

SEQ ID NO: 1928075 - protein, 5 aa, Staphylococcus
DDQMK

SEQ ID NO: 1928076 - protein, 7 aa, Staphylococcus
DDQPYDE

SEQ ID NO: 1928077 - protein, 7 aa, Staphylococcus
DDQQTYT

SEQ ID NO: 1928078 - protein, 5 aa, Staphylococcus
DDQSF

SEQ ID NO: 1928079 - protein, 5 aa, Staphylococcus
DDQSM

SEQ ID NO: 1928080 - protein, 8 aa, Staphylococcus
DDQSRTSI

SEQ ID NO: 1928081 - protein, 54 aa, Staphylococcus
DDQTLETATENETESETQDNTSNEDIEKDHQDSELTNQSANAQSSEAKNNGRYS

SEQ ID NO: 1928082 - protein, 10 aa, Staphylococcus
DDQTLKGERG

SEQ ID NO: 1928083 - protein, 15 aa, Staphylococcus
DDRAKEDIAKQIQSQ

SEQ ID NO: 1928084 - protein, 5 aa, Staphylococcus
DDRAP

SEQ ID NO: 1928085 - protein, 6 aa, Staphylococcus
DDRDFG

SEQ ID NO: 1928086 - protein, 5 aa, Staphylococcus
DDRDI

SEQ ID NO: 1928087 - protein, 7 aa, Staphylococcus
DDREEWD

SEQ ID NO: 1928088 - protein, 9 aa, Staphylococcus
DDRETSYYD

SEQ ID NO: 1928089 - protein, 5 aa, Staphylococcus
DDRHG

SEQ ID NO: 1928090 - protein, 4 aa, Staphylococcus
DDRI

SEQ ID NO: 1928091 - protein, 4 aa, Staphylococcus
DDRL

SEQ ID NO: 1928092 - protein, 4 aa, Staphylococcus
DDRM

SEQ ID NO: 1928093 - protein, 15 aa, Staphylococcus
DDRNFGGHVLDFEIE

SEQ ID NO: 1928094 - protein, 6 aa, Staphylococcus
DDRNLG

SEQ ID NO: 1928095 - protein, 8 aa, Staphylococcus
DDRQENIT

SEQ ID NO: 1928096 - protein, 14 aa, Staphylococcus
DDRRDKKRKMNDKL

SEQ ID NO: 1928097 - protein, 27 aa, Staphylococcus
DDRRDKSRKMNDKLTSVQNQLNKMSGE

SEQ ID NO: 1928098 - protein, 5 aa, Staphylococcus
DDRSH

SEQ ID NO: 1928099 - protein, 7 aa, Staphylococcus
DDRTGPH

SEQ ID NO: 1928100 - protein, 5 aa, Staphylococcus
DDRVD

SEQ ID NO: 1928101 - protein, 4 aa, Staphylococcus
DDRY

SEQ ID NO: 1928102 - protein, 8 aa, Staphylococcus
DDSEEKPQ

SEQ ID NO: 1928103 - protein, 7 aa, Staphylococcus
DDSEKKM

SEQ ID NO: 1928104 - protein, 11 aa, Staphylococcus
DDSESYEDITK

SEQ ID NO: 1928105 - protein, 7 aa, Staphylococcus
DDSFREE

SEQ ID NO: 1928106 - protein, 10 aa, Staphylococcus
DDSGESEGIA

SEQ ID NO: 1928107 - protein, 5 aa, Staphylococcus
DDSGL

SEQ ID NO: 1928108 - protein, 7 aa, Staphylococcus
DDSKENR

SEQ ID NO: 1928109 - protein, 6 aa, Staphylococcus
DDSKGF

SEQ ID NO: 1928110 - protein, 4 aa, Staphylococcus
DDSL

SEQ ID NO: 1928111 - protein, 6 aa, Staphylococcus
DDSLND

SEQ ID NO: 1928112 - protein, 7 aa, Staphylococcus
DDSLSQK

SEQ ID NO: 1928113 - protein, 11 aa, Staphylococcus
DDSNKQKMSIA

SEQ ID NO: 1928114 - protein, 7 aa, Staphylococcus
DDSNYLR

SEQ ID NO: 1928115 - protein, 8 aa, Staphylococcus
DDSPNKTI

SEQ ID NO: 1928116 - protein, 7 aa, Staphylococcus
DDSQKEM

SEQ ID NO: 1928117 - protein, 10 aa, Staphylococcus
DDSQQNITKH

SEQ ID NO: 1928118 - protein, 6 aa, Staphylococcus
DDSQTN

SEQ ID NO: 1928119 - protein, 7 aa, Staphylococcus
DDSQTNS

SEQ ID NO: 1928120 - protein, 6 aa, Staphylococcus
DDSQYP

SEQ ID NO: 1928121 - protein, 5 aa, Staphylococcus
DDSVF

SEQ ID NO: 1928122 - protein, 5 aa, Staphylococcus
DDSYE

SEQ ID NO: 1928123 - protein, 8 aa, Staphylococcus
DDSYLRSE

SEQ ID NO: 1928124 - protein, 7 aa, Staphylococcus
DDTANYE

SEQ ID NO: 1928125 - protein, 4 aa, Staphylococcus
DDTD

SEQ ID NO: 1928126 - protein, 10 aa, Staphylococcus
DDTDSNHRYK

SEQ ID NO: 1928127 - protein, 7 aa, Staphylococcus
DDTGAVD

SEQ ID NO: 1928128 - protein, 8 aa, Staphylococcus
DDTGKVDL

SEQ ID NO: 1928129 - protein, 7 aa, Staphylococcus
DDTGKVR

SEQ ID NO: 1928130 - protein, 7 aa, Staphylococcus
DDTGQVD

SEQ ID NO: 1928131 - protein, 7 aa, Staphylococcus
DDTGRSV

SEQ ID NO: 1928132 - protein, 4 aa, Staphylococcus
DDTH

SEQ ID NO: 1928133 - protein, 7 aa, Staphylococcus
DDTHERI

SEQ ID NO: 1928134 - protein, 14 aa, Staphylococcus
DDTHRTLSTELTTD

SEQ ID NO: 1928135 - protein, 5 aa, Staphylococcus
DDTIT

SEQ ID NO: 1928136 - protein, 7 aa, Staphylococcus
DDTKEIT

SEQ ID NO: 1928137 - protein, 6 aa, Staphylococcus
DDTKNH

SEQ ID NO: 1928138 - protein, 6 aa, Staphylococcus
DDTKQP

SEQ ID NO: 1928139 - protein, 8 aa, Staphylococcus
DDTKRKAF

SEQ ID NO: 1928140 - protein, 7 aa, Staphylococcus
DDTLAEQ

SEQ ID NO: 1928141 - protein, 5 aa, Staphylococcus
DDTLL

SEQ ID NO: 1928142 - protein, 5 aa, Staphylococcus
DDTMR

SEQ ID NO: 1928143 - protein, 6 aa, Staphylococcus
DDTMRE

SEQ ID NO: 1928144 - protein, 16 aa, Staphylococcus
DDTNDQETVEKNEYID

SEQ ID NO: 1928145 - protein, 7 aa, Staphylococcus
DDTNDVG

SEQ ID NO: 1928146 - protein, 7 aa, Staphylococcus
DDTNEVG

SEQ ID NO: 1928147 - protein, 8 aa, Staphylococcus
DDTNEVGE

SEQ ID NO: 1928148 - protein, 7 aa, Staphylococcus
DDTNNYE

SEQ ID NO: 1928149 - protein, 6 aa, Staphylococcus
DDTPNH

SEQ ID NO: 1928150 - protein, 4 aa, Staphylococcus
DDTR

SEQ ID NO: 1928151 - protein, 13 aa, Staphylococcus
DDTRGKETARELN

SEQ ID NO: 1928152 - protein, 8 aa, Staphylococcus
DDTRPHAD

SEQ ID NO: 1928153 - protein, 7 aa, Staphylococcus
DDTSQLA

SEQ ID NO: 1928154 - protein, 7 aa, Staphylococcus
DDTSYER

SEQ ID NO: 1928155 - protein, 7 aa, Staphylococcus
DDTTVTV

SEQ ID NO: 1928156 - protein, 16 aa, Staphylococcus
DDTVNESENDSYEDTM

SEQ ID NO: 1928157 - protein, 6 aa, Staphylococcus
DDTWGS

SEQ ID NO: 1928158 - protein, 4 aa, Staphylococcus
DDTY

SEQ ID NO: 1928159 - protein, 5 aa, Staphylococcus
DDVDG

SEQ ID NO: 1928160 - protein, 18 aa, Staphylococcus
DDVDPRVTTGKYYSPKEF

SEQ ID NO: 1928161 - protein, 4 aa, Staphylococcus
DDVE

SEQ ID NO: 1928162 - protein, 6 aa, Staphylococcus
DDVEPY

SEQ ID NO: 1928163 - protein, 7 aa, Staphylococcus
DDVGGDI

SEQ ID NO: 1928164 - protein, 6 aa, Staphylococcus
DDVGTM

SEQ ID NO: 1928165 - protein, 10 aa, Staphylococcus
DDVKDQTKQV

SEQ ID NO: 1928166 - protein, 7 aa, Staphylococcus
DDVKEGD

SEQ ID NO: 1928167 - protein, 9 aa, Staphylococcus
DDVKEGDSV

SEQ ID NO: 1928168 - protein, 10 aa, Staphylococcus
DDVKEQTKQV

SEQ ID NO: 1928169 - protein, 9 aa, Staphylococcus
DDVKEVAQG

SEQ ID NO: 1928170 - protein, 9 aa, Staphylococcus
DDVKTEIKS

SEQ ID NO: 1928171 - protein, 12 aa, Staphylococcus
DDVNPRELTGNY

SEQ ID NO: 1928172 - protein, 8 aa, Staphylococcus
DDVPGDDA

SEQ ID NO: 1928173 - protein, 13 aa, Staphylococcus
DDVPQGASDEENI

SEQ ID NO: 1928174 - protein, 13 aa, Staphylococcus
DDVPQGDSDEENV

SEQ ID NO: 1928175 - protein, 9 aa, Staphylococcus
DDVQEQTKQ

SEQ ID NO: 1928176 - protein, 7 aa, Staphylococcus
DDVRPNG

SEQ ID NO: 1928177 - protein, 12 aa, Staphylococcus
DDVSPALTDNPI

SEQ ID NO: 1928178 - protein, 9 aa, Staphylococcus
DDVSSVNEV

SEQ ID NO: 1928179 - protein, 4 aa, Staphylococcus
DDVT

SEQ ID NO: 1928180 - protein, 23 aa, Staphylococcus
DDVTDDTNEDNGAARYLKARFLQ

SEQ ID NO: 1928181 - protein, 9 aa, Staphylococcus
DDVTEEEAR

SEQ ID NO: 1928182 - protein, 4 aa, Staphylococcus
DDVV

SEQ ID NO: 1928183 - protein, 5 aa, Staphylococcus
DDVYE

SEQ ID NO: 1928184 - protein, 7 aa, Staphylococcus
DDYAESL

SEQ ID NO: 1928185 - protein, 5 aa, Staphylococcus
DDYAQ

SEQ ID NO: 1928186 - protein, 10 aa, Staphylococcus
DDYDNSDKQL

SEQ ID NO: 1928187 - protein, 8 aa, Staphylococcus
DDYDPRAH

SEQ ID NO: 1928188 - protein, 6 aa, Staphylococcus
DDYDRS

SEQ ID NO: 1928189 - protein, 6 aa, Staphylococcus
DDYGKP

SEQ ID NO: 1928190 - protein, 15 aa, Staphylococcus
DDYGQGTKKRIKKDS

SEQ ID NO: 1928191 - protein, 7 aa, Staphylococcus
DDYKGNP

SEQ ID NO: 1928192 - protein, 15 aa, Staphylococcus
DDYKNLNYKNSTFRN

SEQ ID NO: 1928193 - protein, 6 aa, Staphylococcus
DDYKTP

SEQ ID NO: 1928194 - protein, 24 aa, Staphylococcus
DDYKYDEKTKSVNLTEQGADKAER

SEQ ID NO: 1928195 - protein, 4 aa, Staphylococcus
DDYL

SEQ ID NO: 1928196 - protein, 8 aa, Staphylococcus
DDYNEDDY

SEQ ID NO: 1928197 - protein, 9 aa, Staphylococcus
DDYNEDDYP

SEQ ID NO: 1928198 - protein, 5 aa, Staphylococcus
DDYNG

SEQ ID NO: 1928199 - protein, 6 aa, Staphylococcus
DDYNVQ

SEQ ID NO: 1928200 - protein, 6 aa, Staphylococcus
DDYPDT

SEQ ID NO: 1928201 - protein, 6 aa, Staphylococcus
DDYQAG

SEQ ID NO: 1928202 - protein, 8 aa, Staphylococcus
DDYQEDDY

SEQ ID NO: 1928203 - protein, 8 aa, Staphylococcus
DDYQNDDY

SEQ ID NO: 1928204 - protein, 6 aa, Staphylococcus
DDYSKN

SEQ ID NO: 1928205 - protein, 12 aa, Staphylococcus
DDYSNQSDIQEV

SEQ ID NO: 1928206 - protein, 7 aa, Staphylococcus
DDYSPSA

SEQ ID NO: 1928207 - protein, 8 aa, Staphylococcus
DDYSQEGL

SEQ ID NO: 1928208 - protein, 9 aa, Staphylococcus
DDYTDPAPA

SEQ ID NO: 1928209 - protein, 11 aa, Staphylococcus
DDYTDPAPATT

SEQ ID NO: 1928210 - protein, 13 aa, Staphylococcus
DDYTGSEISGNKV

SEQ ID NO: 1928211 - protein, 7 aa, Staphylococcus
DDYTYSS

SEQ ID NO: 1928212 - protein, 5 aa, Staphylococcus
DEAAA

SEQ ID NO: 1928213 - protein, 6 aa, Staphylococcus
DEAAEL

SEQ ID NO: 1928214 - protein, 7 aa, Staphylococcus
DEAAKQA

SEQ ID NO: 1928215 - protein, 12 aa, Staphylococcus
DEAAYNKNKKNE

SEQ ID NO: 1928216 - protein, 8 aa, Staphylococcus
DEADAPNW

SEQ ID NO: 1928217 - protein, 18 aa, Staphylococcus
DEADIQNAPGVRKANREL

SEQ ID NO: 1928218 - protein, 5 aa, Staphylococcus
DEADL

SEQ ID NO: 1928219 - protein, 9 aa, Staphylococcus
DEADNETKE

SEQ ID NO: 1928220 - protein, 5 aa, Staphylococcus
DEADQ

SEQ ID NO: 1928221 - protein, 9 aa, Staphylococcus
DEADQAMEN

SEQ ID NO: 1928222 - protein, 16 aa, Staphylococcus
DEADQTLDEKEPSNIT

SEQ ID NO: 1928223 - protein, 6 aa, Staphylococcus
DEADQV

SEQ ID NO: 1928224 - protein, 9 aa, Staphylococcus
DEADTESGV

SEQ ID NO: 1928225 - protein, 9 aa, Staphylococcus
DEADTQSGV

SEQ ID NO: 1928226 - protein, 4 aa, Staphylococcus
DEAE

SEQ ID NO: 1928227 - protein, 13 aa, Staphylococcus
DEAEDEENGKEVN

SEQ ID NO: 1928228 - protein, 23 aa, Staphylococcus
DEAEIQEAISSGAKYVTTSYQKL

SEQ ID NO: 1928229 - protein, 7 aa, Staphylococcus
DEAEPFS

SEQ ID NO: 1928230 - protein, 10 aa, Staphylococcus
DEAESDINDE

SEQ ID NO: 1928231 - protein, 7 aa, Staphylococcus
DEAEYKD

SEQ ID NO: 1928232 - protein, 5 aa, Staphylococcus
DEAFE

SEQ ID NO: 1928233 - protein, 8 aa, Staphylococcus
DEAIEGIP

SEQ ID NO: 1928234 - protein, 11 aa, Staphylococcus
DEAKDDIKITH

SEQ ID NO: 1928235 - protein, 21 aa, Staphylococcus
DEAKDKANQRIKSATKEADDI

SEQ ID NO: 1928236 - protein, 19 aa, Staphylococcus
DEAKDNHYSKPSTEDETNE

SEQ ID NO: 1928237 - protein, 21 aa, Staphylococcus
DEAKEKANQRVKSATKEADSI

SEQ ID NO: 1928238 - protein, 22 aa, Staphylococcus
DEAKEKMKEFNNNQWDDKYPVT

SEQ ID NO: 1928239 - protein, 7 aa, Staphylococcus
DEAKGYV

SEQ ID NO: 1928240 - protein, 11 aa, Staphylococcus
DEAKHGEKSRF

SEQ ID NO: 1928241 - protein, 20 aa, Staphylococcus
DEAKLGKAVGSDIENDKSTY

SEQ ID NO: 1928242 - protein, 6 aa, Staphylococcus
DEAKNA

SEQ ID NO: 1928243 - protein, 8 aa, Staphylococcus
DEAKRGEV

SEQ ID NO: 1928244 - protein, 14 aa, Staphylococcus
DEALESAAKLSNRY

SEQ ID NO: 1928245 - protein, 16 aa, Staphylococcus
DEALKSHTDALIKTLT

SEQ ID NO: 1928246 - protein, 4 aa, Staphylococcus
DEAN

SEQ ID NO: 1928247 - protein, 8 aa, Staphylococcus
DEANDKCA

SEQ ID NO: 1928248 - protein, 11 aa, Staphylococcus
DEANEAVDHGA

SEQ ID NO: 1928249 - protein, 19 aa, Staphylococcus
DEANIQNAPGVKKANNELH

SEQ ID NO: 1928250 - protein, 19 aa, Staphylococcus
DEANIQNAPGVKKANSELH

SEQ ID NO: 1928251 - protein, 9 aa, Staphylococcus
DEANSQNKL

SEQ ID NO: 1928252 - protein, 6 aa, Staphylococcus
DEAPNE

SEQ ID NO: 1928253 - protein, 19 aa, Staphylococcus
DEAPNPEESEEANGTIYDE

SEQ ID NO: 1928254 - protein, 9 aa, Staphylococcus
DEAQASSIS

SEQ ID NO: 1928255 - protein, 9 aa, Staphylococcus
DEAQQRGHE

SEQ ID NO: 1928256 - protein, 12 aa, Staphylococcus
DEAQSATVKDVE

SEQ ID NO: 1928257 - protein, 7 aa, Staphylococcus
DEAQVKT

SEQ ID NO: 1928258 - protein, 6 aa, Staphylococcus
DEAREG

SEQ ID NO: 1928259 - protein, 11 aa, Staphylococcus
DEAREKGEPLS

SEQ ID NO: 1928260 - protein, 5 aa, Staphylococcus
DEARF

SEQ ID NO: 1928261 - protein, 9 aa, Staphylococcus
DEARVNEYS

SEQ ID NO: 1928262 - protein, 8 aa, Staphylococcus
DEASDDIK

SEQ ID NO: 1928263 - protein, 14 aa, Staphylococcus
DEASEEIKTRIFNL

SEQ ID NO: 1928264 - protein, 11 aa, Staphylococcus
DEASRGKSKGL

SEQ ID NO: 1928265 - protein, 12 aa, Staphylococcus
DEASRKLNKMNQ

SEQ ID NO: 1928266 - protein, 9 aa, Staphylococcus
DEASSEDKN

SEQ ID NO: 1928267 - protein, 8 aa, Staphylococcus
DEASSKVR

SEQ ID NO: 1928268 - protein, 23 aa, Staphylococcus
DEASTIPGSLGLSPSASFSLEGP

SEQ ID NO: 1928269 - protein, 4 aa, Staphylococcus
DEAT

SEQ ID NO: 1928270 - protein, 12 aa, Staphylococcus
DEATSAEERQTS

SEQ ID NO: 1928271 - protein, 8 aa, Staphylococcus
DEATSQNK

SEQ ID NO: 1928272 - protein, 12 aa, Staphylococcus
DEATTAEERQDS

SEQ ID NO: 1928273 - protein, 12 aa, Staphylococcus
DEATTAEERQTS

SEQ ID NO: 1928274 - protein, 5 aa, Staphylococcus
DEAYE

SEQ ID NO: 1928275 - protein, 5 aa, Staphylococcus
DEAYP

SEQ ID NO: 1928276 - protein, 4 aa, Staphylococcus
DEDA

SEQ ID NO: 1928277 - protein, 7 aa, Staphylococcus
DEDANKS

SEQ ID NO: 1928278 - protein, 4 aa, Staphylococcus
DEDD

SEQ ID NO: 1928279 - protein, 5 aa, Staphylococcus
DEDDE

SEQ ID NO: 1928280 - protein, 9 aa, Staphylococcus
DEDDEVKRE

SEQ ID NO: 1928281 - protein, 6 aa, Staphylococcus
DEDDKA

SEQ ID NO: 1928282 - protein, 8 aa, Staphylococcus
DEDDKEIE

SEQ ID NO: 1928283 - protein, 6 aa, Staphylococcus
DEDDLD

SEQ ID NO: 1928284 - protein, 10 aa, Staphylococcus
DEDDNPDYGP

SEQ ID NO: 1928285 - protein, 19 aa, Staphylococcus
DEDDRTVNEKRADILREHI

SEQ ID NO: 1928286 - protein, 19 aa, Staphylococcus
DEDDSFESNAVTQELQTGY

SEQ ID NO: 1928287 - protein, 8 aa, Staphylococcus
DEDDVNEH

SEQ ID NO: 1928288 - protein, 7 aa, Staphylococcus
DEDEATV

SEQ ID NO: 1928289 - protein, 22 aa, Staphylococcus
DEDEDDEKSVNEKRADILRAQT

SEQ ID NO: 1928290 - protein, 7 aa, Staphylococcus
DEDEKRY

SEQ ID NO: 1928291 - protein, 20 aa, Staphylococcus
DEDENVSVNEKRANILRKHT

SEQ ID NO: 1928292 - protein, 20 aa, Staphylococcus
DEDETISVNEKRANILREYT

SEQ ID NO: 1928293 - protein, 19 aa, Staphylococcus
DEDEYMSQKSSKSDKEFGY

SEQ ID NO: 1928294 - protein, 7 aa, Staphylococcus
DEDGNEV

SEQ ID NO: 1928295 - protein, 11 aa, Staphylococcus
DEDGPGEPGTV

SEQ ID NO: 1928296 - protein, 11 aa, Staphylococcus
DEDGPGTPGSV

SEQ ID NO: 1928297 - protein, 11 aa, Staphylococcus
DEDGPGTPGTV

SEQ ID NO: 1928298 - protein, 9 aa, Staphylococcus
DEDGSDSAI

SEQ ID NO: 1928299 - protein, 10 aa, Staphylococcus
DEDGSDSAIV

SEQ ID NO: 1928300 - protein, 10 aa, Staphylococcus
DEDGSDSSIV

SEQ ID NO: 1928301 - protein, 7 aa, Staphylococcus
DEDGTPL

SEQ ID NO: 1928302 - protein, 7 aa, Staphylococcus
DEDIDQL

SEQ ID NO: 1928303 - protein, 6 aa, Staphylococcus
DEDIEE

SEQ ID NO: 1928304 - protein, 17 aa, Staphylococcus
DEDKAQIATLDSNDSQF

SEQ ID NO: 1928305 - protein, 7 aa, Staphylococcus
DEDKGQR

SEQ ID NO: 1928306 - protein, 9 aa, Staphylococcus
DEDKKQRVQ

SEQ ID NO: 1928307 - protein, 6 aa, Staphylococcus
DEDKTI

SEQ ID NO: 1928308 - protein, 4 aa, Staphylococcus
DEDL

SEQ ID NO: 1928309 - protein, 5 aa, Staphylococcus
DEDME

SEQ ID NO: 1928310 - protein, 16 aa, Staphylococcus
DEDMKDDLKAFIKQLD

SEQ ID NO: 1928311 - protein, 16 aa, Staphylococcus
DEDMKDDVKKYIRELN

SEQ ID NO: 1928312 - protein, 9 aa, Staphylococcus
DEDMKQELE

SEQ ID NO: 1928313 - protein, 8 aa, Staphylococcus
DEDNDTEM

SEQ ID NO: 1928314 - protein, 8 aa, Staphylococcus
DEDNERIS

SEQ ID NO: 1928315 - protein, 9 aa, Staphylococcus
DEDNGDTYT

SEQ ID NO: 1928316 - protein, 9 aa, Staphylococcus
DEDNGNTYT

SEQ ID NO: 1928317 - protein, 6 aa, Staphylococcus
DEDNPN

SEQ ID NO: 1928318 - protein, 15 aa, Staphylococcus
DEDNQTRRLISADID

SEQ ID NO: 1928319 - protein, 23 aa, Staphylococcus
DEDNVEEINKTAASINPKDNELD

SEQ ID NO: 1928320 - protein, 7 aa, Staphylococcus
DEDQFAK

SEQ ID NO: 1928321 - protein, 26 aa, Staphylococcus
DEDQNKYKRKGFGVGEPNTHYDKPSF

SEQ ID NO: 1928322 - protein, 7 aa, Staphylococcus
DEDQRDM

SEQ ID NO: 1928323 - protein, 4 aa, Staphylococcus
DEDR

SEQ ID NO: 1928324 - protein, 15 aa, Staphylococcus
DEDRVASDSNTPTFV

SEQ ID NO: 1928325 - protein, 11 aa, Staphylococcus
DEDSQLPTDQN

SEQ ID NO: 1928326 - protein, 6 aa, Staphylococcus
DEDTDL

SEQ ID NO: 1928327 - protein, 10 aa, Staphylococcus
DEDTLKGERG

SEQ ID NO: 1928328 - protein, 6 aa, Staphylococcus
DEDTNL

SEQ ID NO: 1928329 - protein, 9 aa, Staphylococcus
DEDTSEEDV

SEQ ID NO: 1928330 - protein, 7 aa, Staphylococcus
DEEAAYQ

SEQ ID NO: 1928331 - protein, 5 aa, Staphylococcus
DEEAD

SEQ ID NO: 1928332 - protein, 8 aa, Staphylococcus
DEEAKAVR

SEQ ID NO: 1928333 - protein, 10 aa, Staphylococcus
DEEAKQEIAP

SEQ ID NO: 1928334 - protein, 10 aa, Staphylococcus
DEEANNDVVN

SEQ ID NO: 1928335 - protein, 6 aa, Staphylococcus
DEEAPS

SEQ ID NO: 1928336 - protein, 9 aa, Staphylococcus
DEEAYRSAY

SEQ ID NO: 1928337 - protein, 8 aa, Staphylococcus
DEEDADNE

SEQ ID NO: 1928338 - protein, 5 aa, Staphylococcus
DEEDF

SEQ ID NO: 1928339 - protein, 5 aa, Staphylococcus
DEEDL

SEQ ID NO: 1928340 - protein, 9 aa, Staphylococcus
DEEDPDNEA

SEQ ID NO: 1928341 - protein, 5 aa, Staphylococcus
DEEDR

SEQ ID NO: 1928342 - protein, 4 aa, Staphylococcus
DEEE

SEQ ID NO: 1928343 - protein, 7 aa, Staphylococcus
DEEEAQK

SEQ ID NO: 1928344 - protein, 15 aa, Staphylococcus
DEEEDKWKVIDTFKL

SEQ ID NO: 1928345 - protein, 11 aa, Staphylococcus
DEEEDPDAIER

SEQ ID NO: 1928346 - protein, 7 aa, Staphylococcus
DEEEFKQ

SEQ ID NO: 1928347 - protein, 9 aa, Staphylococcus
DEEENKIQR

SEQ ID NO: 1928348 - protein, 4 aa, Staphylococcus
DEEG

SEQ ID NO: 1928349 - protein, 20 aa, Staphylococcus
DEEGDVDFDDNQYTENTRAA

SEQ ID NO: 1928350 - protein, 5 aa, Staphylococcus
DEEGE

SEQ ID NO: 1928351 - protein, 18 aa, Staphylococcus
DEEGGTPARYQRYKDNNN

SEQ ID NO: 1928352 - protein, 5 aa, Staphylococcus
DEEGK

SEQ ID NO: 1928353 - protein, 9 aa, Staphylococcus
DEEGKLPHN

SEQ ID NO: 1928354 - protein, 5 aa, Staphylococcus
DEEGL

SEQ ID NO: 1928355 - protein, 10 aa, Staphylococcus
DEEGNELDAA

SEQ ID NO: 1928356 - protein, 7 aa, Staphylococcus
DEEGNEV

SEQ ID NO: 1928357 - protein, 7 aa, Staphylococcus
DEEGNLP

SEQ ID NO: 1928358 - protein, 10 aa, Staphylococcus
DEEGNQLDAA

SEQ ID NO: 1928359 - protein, 12 aa, Staphylococcus
DEEGVEGSKDAR

SEQ ID NO: 1928360 - protein, 13 aa, Staphylococcus
DEEGVEGSKDSRT

SEQ ID NO: 1928361 - protein, 22 aa, Staphylococcus
DEEGYTRASNHLGGLEGGMSNG

SEQ ID NO: 1928362 - protein, 10 aa, Staphylococcus
DEEIENHKQD

SEQ ID NO: 1928363 - protein, 6 aa, Staphylococcus
DEEIEQ

SEQ ID NO: 1928364 - protein, 6 aa, Staphylococcus
DEEIKT

SEQ ID NO: 1928365 - protein, 8 aa, Staphylococcus
DEEIQHSA

SEQ ID NO: 1928366 - protein, 5 aa, Staphylococcus
DEEIS

SEQ ID NO: 1928367 - protein, 15 aa, Staphylococcus
DEEITKNKQTHHDAK

SEQ ID NO: 1928368 - protein, 6 aa, Staphylococcus
DEEITV

SEQ ID NO: 1928369 - protein, 20 aa, Staphylococcus
DEEKAKGIITASAGNHAQGL

SEQ ID NO: 1928370 - protein, 20 aa, Staphylococcus
DEEKELTKQLEQKNKEVTSL

SEQ ID NO: 1928371 - protein, 18 aa, Staphylococcus
DEEKRKASEISKEAGADF

SEQ ID NO: 1928372 - protein, 6 aa, Staphylococcus
DEEKTL

SEQ ID NO: 1928373 - protein, 18 aa, Staphylococcus
DEEKVKASELAKAAGADF

SEQ ID NO: 1928374 - protein, 14 aa, Staphylococcus
DEEKVKASELSKVA

SEQ ID NO: 1928375 - protein, 4 aa, Staphylococcus
DEEL

SEQ ID NO: 1928376 - protein, 5 aa, Staphylococcus
DEELD

SEQ ID NO: 1928377 - protein, 24 aa, Staphylococcus
DEELERRNKQWQAPPLKANRGTLA

SEQ ID NO: 1928378 - protein, 8 aa, Staphylococcus
DEENERVS

SEQ ID NO: 1928379 - protein, 6 aa, Staphylococcus
DEENHE

SEQ ID NO: 1928380 - protein, 5 aa, Staphylococcus
DEEQG

SEQ ID NO: 1928381 - protein, 6 aa, Staphylococcus
DEEQIN

SEQ ID NO: 1928382 - protein, 8 aa, Staphylococcus
DEEQQLEA

SEQ ID NO: 1928383 - protein, 4 aa, Staphylococcus
DEER

SEQ ID NO: 1928384 - protein, 7 aa, Staphylococcus
DEERAKH

SEQ ID NO: 1928385 - protein, 7 aa, Staphylococcus
DEERLSS

SEQ ID NO: 1928386 - protein, 5 aa, Staphylococcus
DEERN

SEQ ID NO: 1928387 - protein, 6 aa, Staphylococcus
DEERQT

SEQ ID NO: 1928388 - protein, 7 aa, Staphylococcus
DEERRGR

SEQ ID NO: 1928389 - protein, 5 aa, Staphylococcus
DEERY

SEQ ID NO: 1928390 - protein, 4 aa, Staphylococcus
DEES

SEQ ID NO: 1928391 - protein, 6 aa, Staphylococcus
DEESCT

SEQ ID NO: 1928392 - protein, 9 aa, Staphylococcus
DEESEKRTY

SEQ ID NO: 1928393 - protein, 7 aa, Staphylococcus
DEESERI

SEQ ID NO: 1928394 - protein, 9 aa, Staphylococcus
DEESGLAQR

SEQ ID NO: 1928395 - protein, 10 aa, Staphylococcus
DEESKQEIAP

SEQ ID NO: 1928396 - protein, 6 aa, Staphylococcus
DEESQH

SEQ ID NO: 1928397 - protein, 5 aa, Staphylococcus
DEESS

SEQ ID NO: 1928398 - protein, 13 aa, Staphylococcus
DEESVRSIATKTT

SEQ ID NO: 1928399 - protein, 5 aa, Staphylococcus
DEESY

SEQ ID NO: 1928400 - protein, 7 aa, Staphylococcus
DEETAEL

SEQ ID NO: 1928401 - protein, 8 aa, Staphylococcus
DEETAQSV

SEQ ID NO: 1928402 - protein, 12 aa, Staphylococcus
DEETEDSYDEDT

SEQ ID NO: 1928403 - protein, 9 aa, Staphylococcus
DEETGDTYT

SEQ ID NO: 1928404 - protein, 17 aa, Staphylococcus
DEETGKITEVKTGYELE

SEQ ID NO: 1928405 - protein, 7 aa, Staphylococcus
DEETIQK

SEQ ID NO: 1928406 - protein, 12 aa, Staphylococcus
DEETMQNNHANL

SEQ ID NO: 1928407 - protein, 12 aa, Staphylococcus
DEETMQQNHANL

SEQ ID NO: 1928408 - protein, 11 aa, Staphylococcus
DEETPKDKAVA

SEQ ID NO: 1928409 - protein, 8 aa, Staphylococcus
DEETPSKV

SEQ ID NO: 1928410 - protein, 6 aa, Staphylococcus
DEETQE

SEQ ID NO: 1928411 - protein, 6 aa, Staphylococcus
DEETQI

SEQ ID NO: 1928412 - protein, 6 aa, Staphylococcus
DEEVGK

SEQ ID NO: 1928413 - protein, 7 aa, Staphylococcus
DEEVGKK

SEQ ID NO: 1928414 - protein, 11 aa, Staphylococcus
DEEVNSSGMRK

SEQ ID NO: 1928415 - protein, 6 aa, Staphylococcus
DEEYER

SEQ ID NO: 1928416 - protein, 13 aa, Staphylococcus
DEFAKKAAGQFGS

SEQ ID NO: 1928417 - protein, 11 aa, Staphylococcus
DEFDDKGKIHD

SEQ ID NO: 1928418 - protein, 7 aa, Staphylococcus
DEFDKEI

SEQ ID NO: 1928419 - protein, 6 aa, Staphylococcus
DEFDPS

SEQ ID NO: 1928420 - protein, 5 aa, Staphylococcus
DEFGE

SEQ ID NO: 1928421 - protein, 10 aa, Staphylococcus
DEFKNSEAIG

SEQ ID NO: 1928422 - protein, 16 aa, Staphylococcus
DEFNKIKNKKSYYSYE

SEQ ID NO: 1928423 - protein, 5 aa, Staphylococcus
DEFNQ

SEQ ID NO: 1928424 - protein, 6 aa, Staphylococcus
DEFNQI

SEQ ID NO: 1928425 - protein, 7 aa, Staphylococcus
DEFNQIK

SEQ ID NO: 1928426 - protein, 15 aa, Staphylococcus
DEFNQIKNKKSYYDF

SEQ ID NO: 1928427 - protein, 16 aa, Staphylococcus
DEFNQVKNKKSYYDYN

SEQ ID NO: 1928428 - protein, 11 aa, Staphylococcus
DEFPTKHDESL

SEQ ID NO: 1928429 - protein, 4 aa, Staphylococcus
DEFS

SEQ ID NO: 1928430 - protein, 6 aa, Staphylococcus
DEFSSE

SEQ ID NO: 1928431 - protein, 5 aa, Staphylococcus
DEFTQ

SEQ ID NO: 1928432 - protein, 4 aa, Staphylococcus
DEFY

SEQ ID NO: 1928433 - protein, 5 aa, Staphylococcus
DEFYN

SEQ ID NO: 1928434 - protein, 8 aa, Staphylococcus
DEFYPSNP

SEQ ID NO: 1928435 - protein, 4 aa, Staphylococcus
DEGA

SEQ ID NO: 1928436 - protein, 14 aa, Staphylococcus
DEGAASAIVNNSNK

SEQ ID NO: 1928437 - protein, 5 aa, Staphylococcus
DEGAN

SEQ ID NO: 1928438 - protein, 5 aa, Staphylococcus
DEGAT

SEQ ID NO: 1928439 - protein, 6 aa, Staphylococcus
DEGEEH

SEQ ID NO: 1928440 - protein, 7 aa, Staphylococcus
DEGEEIE

SEQ ID NO: 1928441 - protein, 7 aa, Staphylococcus
DEGEKDE

SEQ ID NO: 1928442 - protein, 10 aa, Staphylococcus
DEGELAEVGE

SEQ ID NO: 1928443 - protein, 7 aa, Staphylococcus
DEGENYF

SEQ ID NO: 1928444 - protein, 10 aa, Staphylococcus
DEGESIGQHP

SEQ ID NO: 1928445 - protein, 60 aa, Staphylococcus
DEGESTESSSTTESENEEQNNSHSENEEQQTSDTTSVNEDDSNHDEDTNKSNNVEPQNGK

SEQ ID NO: 1928446 - protein, 15 aa, Staphylococcus
DEGEVTASDITHDSD

SEQ ID NO: 1928447 - protein, 7 aa, Staphylococcus
DEGFKSF

SEQ ID NO: 1928448 - protein, 5 aa, Staphylococcus
DEGGI

SEQ ID NO: 1928449 - protein, 9 aa, Staphylococcus
DEGGLGADG

SEQ ID NO: 1928450 - protein, 5 aa, Staphylococcus
DEGGY

SEQ ID NO: 1928451 - protein, 5 aa, Staphylococcus
DEGHA

SEQ ID NO: 1928452 - protein, 13 aa, Staphylococcus
DEGHTEISSRDIG

SEQ ID NO: 1928453 - protein, 4 aa, Staphylococcus
DEGI

SEQ ID NO: 1928454 - protein, 38 aa, Staphylococcus
DEGIRQGTTADKLGKLRPAFKKDGSVTAGNASGINDGA

SEQ ID NO: 1928455 - protein, 9 aa, Staphylococcus
DEGKDKLAH

SEQ ID NO: 1928456 - protein, 7 aa, Staphylococcus
DEGKIER

SEQ ID NO: 1928457 - protein, 7 aa, Staphylococcus
DEGKLER

SEQ ID NO: 1928458 - protein, 9 aa, Staphylococcus
DEGKLPEEV

SEQ ID NO: 1928459 - protein, 23 aa, Staphylococcus
DEGKSAEAKDEVAAPKKTYKSQL

SEQ ID NO: 1928460 - protein, 17 aa, Staphylococcus
DEGLAGVTSTTGLTGGD

SEQ ID NO: 1928461 - protein, 7 aa, Staphylococcus
DEGLEAR

SEQ ID NO: 1928462 - protein, 7 aa, Staphylococcus
DEGLTGP

SEQ ID NO: 1928463 - protein, 8 aa, Staphylococcus
DEGNAGTD

SEQ ID NO: 1928464 - protein, 8 aa, Staphylococcus
DEGNEDEY

SEQ ID NO: 1928465 - protein, 5 aa, Staphylococcus
DEGNL

SEQ ID NO: 1928466 - protein, 12 aa, Staphylococcus
DEGQAEVSSREI

SEQ ID NO: 1928467 - protein, 7 aa, Staphylococcus
DEGQFAK

SEQ ID NO: 1928468 - protein, 14 aa, Staphylococcus
DEGQLRRLISADIE

SEQ ID NO: 1928469 - protein, 9 aa, Staphylococcus
DEGQPVEPG

SEQ ID NO: 1928470 - protein, 13 aa, Staphylococcus
DEGQTEISSRDIG

SEQ ID NO: 1928471 - protein, 16 aa, Staphylococcus
DEGRIGYQKDGFSGAG

SEQ ID NO: 1928472 - protein, 9 aa, Staphylococcus
DEGSGYDIG

SEQ ID NO: 1928473 - protein, 6 aa, Staphylococcus
DEGSSD

SEQ ID NO: 1928474 - protein, 14 aa, Staphylococcus
DEGSSLEDNKAHME

SEQ ID NO: 1928475 - protein, 5 aa, Staphylococcus
DEGSV

SEQ ID NO: 1928476 - protein, 5 aa, Staphylococcus
DEGSY

SEQ ID NO: 1928477 - protein, 9 aa, Staphylococcus
DEGSYQPSR

SEQ ID NO: 1928478 - protein, 4 aa, Staphylococcus
DEGT

SEQ ID NO: 1928479 - protein, 8 aa, Staphylococcus
DEGTAGTD

SEQ ID NO: 1928480 - protein, 22 aa, Staphylococcus
DEGTQTDSNTSNYDDDDEQYQY

SEQ ID NO: 1928481 - protein, 28 aa, Staphylococcus
DEGVIQGQKVPKYRGEDRVAENSTTPTF

SEQ ID NO: 1928482 - protein, 8 aa, Staphylococcus
DEGVKGSD

SEQ ID NO: 1928483 - protein, 6 aa, Staphylococcus
DEGYET

SEQ ID NO: 1928484 - protein, 8 aa, Staphylococcus
DEHAEDTS

SEQ ID NO: 1928485 - protein, 4 aa, Staphylococcus
DEHE

SEQ ID NO: 1928486 - protein, 12 aa, Staphylococcus
DEHERAQNIKQL

SEQ ID NO: 1928487 - protein, 5 aa, Staphylococcus
DEHGE

SEQ ID NO: 1928488 - protein, 7 aa, Staphylococcus
DEHGEQF

SEQ ID NO: 1928489 - protein, 7 aa, Staphylococcus
DEHHSNE

SEQ ID NO: 1928490 - protein, 9 aa, Staphylococcus
DEHLKNSGL

SEQ ID NO: 1928491 - protein, 6 aa, Staphylococcus
DEHQKP

SEQ ID NO: 1928492 - protein, 4 aa, Staphylococcus
DEIA

SEQ ID NO: 1928493 - protein, 5 aa, Staphylococcus
DEIAE

SEQ ID NO: 1928494 - protein, 5 aa, Staphylococcus
DEIAN

SEQ ID NO: 1928495 - protein, 5 aa, Staphylococcus
DEIAP

SEQ ID NO: 1928496 - protein, 4 aa, Staphylococcus
DEID

SEQ ID NO: 1928497 - protein, 5 aa, Staphylococcus
DEIDD

SEQ ID NO: 1928498 - protein, 6 aa, Staphylococcus
DEIDGA

SEQ ID NO: 1928499 - protein, 8 aa, Staphylococcus
DEIDQVER

SEQ ID NO: 1928500 - protein, 4 aa, Staphylococcus
DEIE

SEQ ID NO: 1928501 - protein, 7 aa, Staphylococcus
DEIEDDL

SEQ ID NO: 1928502 - protein, 5 aa, Staphylococcus
DEIEH

SEQ ID NO: 1928503 - protein, 10 aa, Staphylococcus
DEIEKQKGQY

SEQ ID NO: 1928504 - protein, 6 aa, Staphylococcus
DEIENS

SEQ ID NO: 1928505 - protein, 9 aa, Staphylococcus
DEIEQRKGQ

SEQ ID NO: 1928506 - protein, 12 aa, Staphylococcus
DEIGQKIKQFYD

SEQ ID NO: 1928507 - protein, 6 aa, Staphylococcus
DEIGTQ

SEQ ID NO: 1928508 - protein, 7 aa, Staphylococcus
DEIHPEQ

SEQ ID NO: 1928509 - protein, 16 aa, Staphylococcus
DEIKENDAKLNEVDNK

SEQ ID NO: 1928510 - protein, 26 aa, Staphylococcus
DEILEQKESKLEERQQQVDAKESSVQ

SEQ ID NO: 1928511 - protein, 4 aa, Staphylococcus
DEIN

SEQ ID NO: 1928512 - protein, 6 aa, Staphylococcus
DEIPES

SEQ ID NO: 1928513 - protein, 5 aa, Staphylococcus
DEIPT

SEQ ID NO: 1928514 - protein, 5 aa, Staphylococcus
DEIQE

SEQ ID NO: 1928515 - protein, 10 aa, Staphylococcus
DEIQSRQGQY

SEQ ID NO: 1928516 - protein, 5 aa, Staphylococcus
DEIRN

SEQ ID NO: 1928517 - protein, 6 aa, Staphylococcus
DEIRNQ

SEQ ID NO: 1928518 - protein, 9 aa, Staphylococcus
DEIRRKTDG

SEQ ID NO: 1928519 - protein, 9 aa, Staphylococcus
DEISANEGA

SEQ ID NO: 1928520 - protein, 6 aa, Staphylococcus
DEISET

SEQ ID NO: 1928521 - protein, 6 aa, Staphylococcus
DEISKK

SEQ ID NO: 1928522 - protein, 10 aa, Staphylococcus
DEISSDFETQ

SEQ ID NO: 1928523 - protein, 5 aa, Staphylococcus
DEITA

SEQ ID NO: 1928524 - protein, 5 aa, Staphylococcus
DEKAA

SEQ ID NO: 1928525 - protein, 8 aa, Staphylococcus
DEKAKLDQ

SEQ ID NO: 1928526 - protein, 15 aa, Staphylococcus
DEKAKSLNKENGQSF

SEQ ID NO: 1928527 - protein, 5 aa, Staphylococcus
DEKAL

SEQ ID NO: 1928528 - protein, 19 aa, Staphylococcus
DEKANESNELESAETTRDD

SEQ ID NO: 1928529 - protein, 23 aa, Staphylococcus
DEKAPENMSDKEIEQVKEKEGQR

SEQ ID NO: 1928530 - protein, 23 aa, Staphylococcus
DEKAPENMSDKEVEQVKEKEGQR

SEQ ID NO: 1928531 - protein, 19 aa, Staphylococcus
DEKASQSDALDIEKTSRDD

SEQ ID NO: 1928532 - protein, 5 aa, Staphylococcus
DEKAT

SEQ ID NO: 1928533 - protein, 11 aa, Staphylococcus
DEKATQEDYKA

SEQ ID NO: 1928534 - protein, 10 aa, Staphylococcus
DEKATSKSLI

SEQ ID NO: 1928535 - protein, 8 aa, Staphylococcus
DEKDGRQA

SEQ ID NO: 1928536 - protein, 9 aa, Staphylococcus
DEKDIRQAN

SEQ ID NO: 1928537 - protein, 9 aa, Staphylococcus
DEKDKPEIQ

SEQ ID NO: 1928538 - protein, 8 aa, Staphylococcus
DEKDLNQA

SEQ ID NO: 1928539 - protein, 10 aa, Staphylococcus
DEKDTQAFSK

SEQ ID NO: 1928540 - protein, 10 aa, Staphylococcus
DEKDTQEFSK

SEQ ID NO: 1928541 - protein, 7 aa, Staphylococcus
DEKEISE

SEQ ID NO: 1928542 - protein, 8 aa, Staphylococcus
DEKEKALF

SEQ ID NO: 1928543 - protein, 7 aa, Staphylococcus
DEKEKGM

SEQ ID NO: 1928544 - protein, 7 aa, Staphylococcus
DEKELGK

SEQ ID NO: 1928545 - protein, 7 aa, Staphylococcus
DEKEQGV

SEQ ID NO: 1928546 - protein, 9 aa, Staphylococcus
DEKETQAFS

SEQ ID NO: 1928547 - protein, 10 aa, Staphylococcus
DEKETQEFSK

SEQ ID NO: 1928548 - protein, 11 aa, Staphylococcus
DEKETQEFSKR

SEQ ID NO: 1928549 - protein, 4 aa, Staphylococcus
DEKG

SEQ ID NO: 1928550 - protein, 6 aa, Staphylococcus
DEKGCP

SEQ ID NO: 1928551 - protein, 15 aa, Staphylococcus
DEKGCPWDKEQTHDS

SEQ ID NO: 1928552 - protein, 10 aa, Staphylococcus
DEKGESYLSN

SEQ ID NO: 1928553 - protein, 17 aa, Staphylococcus
DEKGKDEANKIQDQAVA

SEQ ID NO: 1928554 - protein, 4 aa, Staphylococcus
DEKI

SEQ ID NO: 1928555 - protein, 8 aa, Staphylococcus
DEKINTNY

SEQ ID NO: 1928556 - protein, 6 aa, Staphylococcus
DEKKDF

SEQ ID NO: 1928557 - protein, 13 aa, Staphylococcus
DEKKDYTKFWRDH

SEQ ID NO: 1928558 - protein, 18 aa, Staphylococcus
DEKKEMVKDEATQKANDK

SEQ ID NO: 1928559 - protein, 20 aa, Staphylococcus
DEKKIGKAVGSDESNNKSTY

SEQ ID NO: 1928560 - protein, 11 aa, Staphylococcus
DEKKTQEFSKR

SEQ ID NO: 1928561 - protein, 4 aa, Staphylococcus
DEKL

SEQ ID NO: 1928562 - protein, 15 aa, Staphylococcus
DEKLNSSKKLSELNS

SEQ ID NO: 1928563 - protein, 14 aa, Staphylococcus
DEKLYSDDDKKDKD

SEQ ID NO: 1928564 - protein, 5 aa, Staphylococcus
DEKMG

SEQ ID NO: 1928565 - protein, 8 aa, Staphylococcus
DEKNARAE

SEQ ID NO: 1928566 - protein, 7 aa, Staphylococcus
DEKNKRG

SEQ ID NO: 1928567 - protein, 19 aa, Staphylococcus
DEKNLGKPVGSDEKNHKNT

SEQ ID NO: 1928568 - protein, 8 aa, Staphylococcus
DEKNTESL

SEQ ID NO: 1928569 - protein, 5 aa, Staphylococcus
DEKPD

SEQ ID NO: 1928570 - protein, 7 aa, Staphylococcus
DEKPLYL

SEQ ID NO: 1928571 - protein, 4 aa, Staphylococcus
DEKQ

SEQ ID NO: 1928572 - protein, 16 aa, Staphylococcus
DEKQARRIGEARHEES

SEQ ID NO: 1928573 - protein, 8 aa, Staphylococcus
DEKQNQVI

SEQ ID NO: 1928574 - protein, 7 aa, Staphylococcus
DEKQQEL

SEQ ID NO: 1928575 - protein, 8 aa, Staphylococcus
DEKQQRDV

SEQ ID NO: 1928576 - protein, 6 aa, Staphylococcus
DEKQRL

SEQ ID NO: 1928577 - protein, 7 aa, Staphylococcus
DEKTITE

SEQ ID NO: 1928578 - protein, 5 aa, Staphylococcus
DEKTQ

SEQ ID NO: 1928579 - protein, 6 aa, Staphylococcus
DEKTRE

SEQ ID NO: 1928580 - protein, 14 aa, Staphylococcus
DEKTTSKQETEGLG

SEQ ID NO: 1928581 - protein, 19 aa, Staphylococcus
DEKTTVSDQLNTVETSRDD

SEQ ID NO: 1928582 - protein, 17 aa, Staphylococcus
DEKVKASELAKAAGADF

SEQ ID NO: 1928583 - protein, 16 aa, Staphylococcus
DEKVKEVRDIKDHEEA

SEQ ID NO: 1928584 - protein, 7 aa, Staphylococcus
DEKVQDG

SEQ ID NO: 1928585 - protein, 17 aa, Staphylococcus
DEKVRPDGRKPDEIRPL

SEQ ID NO: 1928586 - protein, 11 aa, Staphylococcus
DEKYSKEKLRT

SEQ ID NO: 1928587 - protein, 4 aa, Staphylococcus
DELA

SEQ ID NO: 1928588 - protein, 21 aa, Staphylococcus
DELARRESYQGKFYTSNTKVN

SEQ ID NO: 1928589 - protein, 19 aa, Staphylococcus
DELARRNSYQGKFHKERVQ

SEQ ID NO: 1928590 - protein, 21 aa, Staphylococcus
DELARRNSYQGKHYSSEVKVK

SEQ ID NO: 1928591 - protein, 6 aa, Staphylococcus
DELDDP

SEQ ID NO: 1928592 - protein, 7 aa, Staphylococcus
DELDGTI

SEQ ID NO: 1928593 - protein, 14 aa, Staphylococcus
DELDRYKKQSNKRL

SEQ ID NO: 1928594 - protein, 15 aa, Staphylococcus
DELDVEGKHQQAEEI

SEQ ID NO: 1928595 - protein, 9 aa, Staphylococcus
DELEDSPEF

SEQ ID NO: 1928596 - protein, 11 aa, Staphylococcus
DELEDVAADND

SEQ ID NO: 1928597 - protein, 21 aa, Staphylococcus
DELEEERQQQIERGEMPRYGG

SEQ ID NO: 1928598 - protein, 10 aa, Staphylococcus
DELEEVTQEN

SEQ ID NO: 1928599 - protein, 19 aa, Staphylococcus
DELEKKVEQLKKDIGSTQS

SEQ ID NO: 1928600 - protein, 10 aa, Staphylococcus
DELEKLQKQL

SEQ ID NO: 1928601 - protein, 12 aa, Staphylococcus
DELENEIKRYNN

SEQ ID NO: 1928602 - protein, 12 aa, Staphylococcus
DELESATGQRLT

SEQ ID NO: 1928603 - protein, 4 aa, Staphylococcus
DELG

SEQ ID NO: 1928604 - protein, 7 aa, Staphylococcus
DELGETI

SEQ ID NO: 1928605 - protein, 13 aa, Staphylococcus
DELGNQVNRLTIL

SEQ ID NO: 1928606 - protein, 7 aa, Staphylococcus
DELGSKL

SEQ ID NO: 1928607 - protein, 12 aa, Staphylococcus
DELGSNSMAAGK

SEQ ID NO: 1928608 - protein, 9 aa, Staphylococcus
DELGSPITV

SEQ ID NO: 1928609 - protein, 7 aa, Staphylococcus
DELGSQL

SEQ ID NO: 1928610 - protein, 6 aa, Staphylococcus
DELGTK

SEQ ID NO: 1928611 - protein, 9 aa, Staphylococcus
DELIGKPPK

SEQ ID NO: 1928612 - protein, 12 aa, Staphylococcus
DELINEAKQQTP

SEQ ID NO: 1928613 - protein, 10 aa, Staphylococcus
DELKDREGTT

SEQ ID NO: 1928614 - protein, 12 aa, Staphylococcus
DELKNNKEQHDE

SEQ ID NO: 1928615 - protein, 16 aa, Staphylococcus
DELKNRGAHYEKGDNW

SEQ ID NO: 1928616 - protein, 16 aa, Staphylococcus
DELKNRGANYEQGDNW

SEQ ID NO: 1928617 - protein, 8 aa, Staphylococcus
DELKRSDL

SEQ ID NO: 1928618 - protein, 11 aa, Staphylococcus
DELKTLQEGPV

SEQ ID NO: 1928619 - protein, 4 aa, Staphylococcus
DELL

SEQ ID NO: 1928620 - protein, 16 aa, Staphylococcus
DELPHRERHFNEIIEK

SEQ ID NO: 1928621 - protein, 7 aa, Staphylococcus
DELQDNL

SEQ ID NO: 1928622 - protein, 8 aa, Staphylococcus
DELQPGEA

SEQ ID NO: 1928623 - protein, 11 aa, Staphylococcus
DELRSSKRVTT

SEQ ID NO: 1928624 - protein, 19 aa, Staphylococcus
DELRTGTDDVQKITDESIK

SEQ ID NO: 1928625 - protein, 4 aa, Staphylococcus
DELS

SEQ ID NO: 1928626 - protein, 5 aa, Staphylococcus
DELSD

SEQ ID NO: 1928627 - protein, 7 aa, Staphylococcus
DELSDLQ

SEQ ID NO: 1928628 - protein, 11 aa, Staphylococcus
DELSGGQKQRV

SEQ ID NO: 1928629 - protein, 12 aa, Staphylococcus
DELSNKYGVDRD

SEQ ID NO: 1928630 - protein, 26 aa, Staphylococcus
DELSQNSQPKTKEAKQVKKPLPSKDN

SEQ ID NO: 1928631 - protein, 6 aa, Staphylococcus
DELTKE

SEQ ID NO: 1928632 - protein, 7 aa, Staphylococcus
DELTPYA

SEQ ID NO: 1928633 - protein, 14 aa, Staphylococcus
DELTTAQSKSLNDA

SEQ ID NO: 1928634 - protein, 11 aa, Staphylococcus
DEMDEKGNIHD

SEQ ID NO: 1928635 - protein, 7 aa, Staphylococcus
DEMDKEN

SEQ ID NO: 1928636 - protein, 6 aa, Staphylococcus
DEMENR

SEQ ID NO: 1928637 - protein, 7 aa, Staphylococcus
DEMETKL

SEQ ID NO: 1928638 - protein, 4 aa, Staphylococcus
DEMF

SEQ ID NO: 1928639 - protein, 5 aa, Staphylococcus
DEMKD

SEQ ID NO: 1928640 - protein, 5 aa, Staphylococcus
DEMNR

SEQ ID NO: 1928641 - protein, 11 aa, Staphylococcus
DEMNSGPSEKY

SEQ ID NO: 1928642 - protein, 12 aa, Staphylococcus
DEMPTEDEQFEA

SEQ ID NO: 1928643 - protein, 4 aa, Staphylococcus
DEMR

SEQ ID NO: 1928644 - protein, 5 aa, Staphylococcus
DEMRR

SEQ ID NO: 1928645 - protein, 11 aa, Staphylococcus
DEMRSSKRVTT

SEQ ID NO: 1928646 - protein, 6 aa, Staphylococcus
DEMTPY

SEQ ID NO: 1928647 - protein, 13 aa, Staphylococcus
DENAEEVKKRPHF

SEQ ID NO: 1928648 - protein, 6 aa, Staphylococcus
DENAEV

SEQ ID NO: 1928649 - protein, 7 aa, Staphylococcus
DENAEVV

SEQ ID NO: 1928650 - protein, 5 aa, Staphylococcus
DENAI

SEQ ID NO: 1928651 - protein, 11 aa, Staphylococcus
DENAIKASYEN

SEQ ID NO: 1928652 - protein, 6 aa, Staphylococcus
DENAIT

SEQ ID NO: 1928653 - protein, 6 aa, Staphylococcus
DENAKN

SEQ ID NO: 1928654 - protein, 11 aa, Staphylococcus
DENATQDDYTA

SEQ ID NO: 1928655 - protein, 6 aa, Staphylococcus
DENCTD

SEQ ID NO: 1928656 - protein, 4 aa, Staphylococcus
DEND

SEQ ID NO: 1928657 - protein, 5 aa, Staphylococcus
DENDA

SEQ ID NO: 1928658 - protein, 5 aa, Staphylococcus
DENDH

SEQ ID NO: 1928659 - protein, 5 aa, Staphylococcus
DENDQ

SEQ ID NO: 1928660 - protein, 6 aa, Staphylococcus
DENDQK

SEQ ID NO: 1928661 - protein, 4 aa, Staphylococcus
DENE

SEQ ID NO: 1928662 - protein, 30 aa, Staphylococcus
DENEDFQENVTNQKEQDIKGKVSSTPSRRV

SEQ ID NO: 1928663 - protein, 7 aa, Staphylococcus
DENEDIN

SEQ ID NO: 1928664 - protein, 8 aa, Staphylococcus
DENEETIY

SEQ ID NO: 1928665 - protein, 11 aa, Staphylococcus
DENEKDAYKLK

SEQ ID NO: 1928666 - protein, 7 aa, Staphylococcus
DENFPGQ

SEQ ID NO: 1928667 - protein, 5 aa, Staphylococcus
DENGA

SEQ ID NO: 1928668 - protein, 12 aa, Staphylococcus
DENGEPTTDSNA

SEQ ID NO: 1928669 - protein, 5 aa, Staphylococcus
DENGN

SEQ ID NO: 1928670 - protein, 10 aa, Staphylococcus
DENGTPSTIA

SEQ ID NO: 1928671 - protein, 6 aa, Staphylococcus
DENIKE

SEQ ID NO: 1928672 - protein, 23 aa, Staphylococcus
DENIKTNTNLKPKADKSNPSHIG

SEQ ID NO: 1928673 - protein, 6 aa, Staphylococcus
DENIQD

SEQ ID NO: 1928674 - protein, 4 aa, Staphylococcus
DENK

SEQ ID NO: 1928675 - protein, 6 aa, Staphylococcus
DENKDF

SEQ ID NO: 1928676 - protein, 5 aa, Staphylococcus
DENKK

SEQ ID NO: 1928677 - protein, 8 aa, Staphylococcus
DENKLYKK

SEQ ID NO: 1928678 - protein, 6 aa, Staphylococcus
DENKPT

SEQ ID NO: 1928679 - protein, 8 aa, Staphylococcus
DENKTGFS

SEQ ID NO: 1928680 - protein, 5 aa, Staphylococcus
DENMR

SEQ ID NO: 1928681 - protein, 4 aa, Staphylococcus
DENN

SEQ ID NO: 1928682 - protein, 13 aa, Staphylococcus
DENNESYIVKGYR

SEQ ID NO: 1928683 - protein, 6 aa, Staphylococcus
DENNKV

SEQ ID NO: 1928684 - protein, 8 aa, Staphylococcus
DENNNELG

SEQ ID NO: 1928685 - protein, 9 aa, Staphylococcus
DENNQTHMK

SEQ ID NO: 1928686 - protein, 14 aa, Staphylococcus
DENNTNVPFTEDDL

SEQ ID NO: 1928687 - protein, 4 aa, Staphylococcus
DENP

SEQ ID NO: 1928688 - protein, 8 aa, Staphylococcus
DENPNTAA

SEQ ID NO: 1928689 - protein, 7 aa, Staphylococcus
DENPQLD

SEQ ID NO: 1928690 - protein, 7 aa, Staphylococcus
DENPSID

SEQ ID NO: 1928691 - protein, 8 aa, Staphylococcus
DENPSTAA

SEQ ID NO: 1928692 - protein, 9 aa, Staphylococcus
DENQDEEEF

SEQ ID NO: 1928693 - protein, 4 aa, Staphylococcus
DENR

SEQ ID NO: 1928694 - protein, 13 aa, Staphylococcus
DENSGTPAKPRNL

SEQ ID NO: 1928695 - protein, 12 aa, Staphylococcus
DENSIKKDDDSV

SEQ ID NO: 1928696 - protein, 11 aa, Staphylococcus
DENSNKAAIEN

SEQ ID NO: 1928697 - protein, 7 aa, Staphylococcus
DENSSFL

SEQ ID NO: 1928698 - protein, 6 aa, Staphylococcus
DENTDL

SEQ ID NO: 1928699 - protein, 10 aa, Staphylococcus
DENTPKDKAV

SEQ ID NO: 1928700 - protein, 10 aa, Staphylococcus
DENTPKNEAV

SEQ ID NO: 1928701 - protein, 6 aa, Staphylococcus
DENTSF

SEQ ID NO: 1928702 - protein, 10 aa, Staphylococcus
DENVANTFDN

SEQ ID NO: 1928703 - protein, 22 aa, Staphylococcus
DENVKTDATIKPKADKSNPNHI

SEQ ID NO: 1928704 - protein, 6 aa, Staphylococcus
DENVLN

SEQ ID NO: 1928705 - protein, 11 aa, Staphylococcus
DENYSKEKLRT

SEQ ID NO: 1928706 - protein, 4 aa, Staphylococcus
DEPD

SEQ ID NO: 1928707 - protein, 12 aa, Staphylococcus
DEPDEINQKKQA

SEQ ID NO: 1928708 - protein, 8 aa, Staphylococcus
DEPDPLLG

SEQ ID NO: 1928709 - protein, 13 aa, Staphylococcus
DEPEVPKELTNLK

SEQ ID NO: 1928710 - protein, 12 aa, Staphylococcus
DEPFRDNQSAYT

SEQ ID NO: 1928711 - protein, 9 aa, Staphylococcus
DEPGDDEHL

SEQ ID NO: 1928712 - protein, 10 aa, Staphylococcus
DEPGDDMATQ

SEQ ID NO: 1928713 - protein, 11 aa, Staphylococcus
DEPGDSAQQQY

SEQ ID NO: 1928714 - protein, 11 aa, Staphylococcus
DEPGDSMNRQQ

SEQ ID NO: 1928715 - protein, 4 aa, Staphylococcus
DEPI

SEQ ID NO: 1928716 - protein, 7 aa, Staphylococcus
DEPIDEP

SEQ ID NO: 1928717 - protein, 8 aa, Staphylococcus
DEPKSVNQ

SEQ ID NO: 1928718 - protein, 4 aa, Staphylococcus
DEPP

SEQ ID NO: 1928719 - protein, 5 aa, Staphylococcus
DEPPI

SEQ ID NO: 1928720 - protein, 7 aa, Staphylococcus
DEPSVED

SEQ ID NO: 1928721 - protein, 9 aa, Staphylococcus
DEPSYVKDA

SEQ ID NO: 1928722 - protein, 8 aa, Staphylococcus
DEPTASLD

SEQ ID NO: 1928723 - protein, 14 aa, Staphylococcus
DEPTASLDADRATS

SEQ ID NO: 1928724 - protein, 12 aa, Staphylococcus
DEPTASLDAERA

SEQ ID NO: 1928725 - protein, 13 aa, Staphylococcus
DEPTASLDAERAT

SEQ ID NO: 1928726 - protein, 14 aa, Staphylococcus
DEPTASLDASRATK

SEQ ID NO: 1928727 - protein, 12 aa, Staphylococcus
DEPTASLDTDNA

SEQ ID NO: 1928728 - protein, 11 aa, Staphylococcus
DEPTASLDTEN

SEQ ID NO: 1928729 - protein, 12 aa, Staphylococcus
DEPTASLDTQNA

SEQ ID NO: 1928730 - protein, 13 aa, Staphylococcus
DEPTGALDSKNTR

SEQ ID NO: 1928731 - protein, 14 aa, Staphylococcus
DEPTGALDSKNTRD

SEQ ID NO: 1928732 - protein, 15 aa, Staphylococcus
DEPTGALDSKSAQDL

SEQ ID NO: 1928733 - protein, 14 aa, Staphylococcus
DEPTGALDSKSSKQ

SEQ ID NO: 1928734 - protein, 15 aa, Staphylococcus
DEPTGALDSKSSQDL

SEQ ID NO: 1928735 - protein, 14 aa, Staphylococcus
DEPTGALDSKTSKD

SEQ ID NO: 1928736 - protein, 14 aa, Staphylococcus
DEPTGALDSKTSKN

SEQ ID NO: 1928737 - protein, 14 aa, Staphylococcus
DEPTGALDSKTSKT

SEQ ID NO: 1928738 - protein, 12 aa, Staphylococcus
DEPTSALDQHNR

SEQ ID NO: 1928739 - protein, 11 aa, Staphylococcus
DEPTSALDYDN

SEQ ID NO: 1928740 - protein, 8 aa, Staphylococcus
DEPTTALD

SEQ ID NO: 1928741 - protein, 9 aa, Staphylococcus
DEPTTNLDN

SEQ ID NO: 1928742 - protein, 7 aa, Staphylococcus
DEPTVKE

SEQ ID NO: 1928743 - protein, 16 aa, Staphylococcus
DEQAAQTLYEEAGNHI

SEQ ID NO: 1928744 - protein, 7 aa, Staphylococcus
DEQAKAQ

SEQ ID NO: 1928745 - protein, 10 aa, Staphylococcus
DEQAKAVGAV

SEQ ID NO: 1928746 - protein, 13 aa, Staphylococcus
DEQATGSDFNKPG

SEQ ID NO: 1928747 - protein, 14 aa, Staphylococcus
DEQATQLKEAGVDR

SEQ ID NO: 1928748 - protein, 5 aa, Staphylococcus
DEQCE

SEQ ID NO: 1928749 - protein, 11 aa, Staphylococcus
DEQDANVPYND

SEQ ID NO: 1928750 - protein, 15 aa, Staphylococcus
DEQDHLTDDEQETRK

SEQ ID NO: 1928751 - protein, 5 aa, Staphylococcus
DEQDN

SEQ ID NO: 1928752 - protein, 7 aa, Staphylococcus
DEQDNEI

SEQ ID NO: 1928753 - protein, 8 aa, Staphylococcus
DEQDNEIE

SEQ ID NO: 1928754 - protein, 6 aa, Staphylococcus
DEQDQP

SEQ ID NO: 1928755 - protein, 11 aa, Staphylococcus
DEQEDPDAIER

SEQ ID NO: 1928756 - protein, 9 aa, Staphylococcus
DEQEGSPKY

SEQ ID NO: 1928757 - protein, 12 aa, Staphylococcus
DEQEGTKEKELQ

SEQ ID NO: 1928758 - protein, 7 aa, Staphylococcus
DEQEREM

SEQ ID NO: 1928759 - protein, 15 aa, Staphylococcus
DEQGEKHRLMSADID

SEQ ID NO: 1928760 - protein, 5 aa, Staphylococcus
DEQGQ

SEQ ID NO: 1928761 - protein, 13 aa, Staphylococcus
DEQGQVKEEGLKQ

SEQ ID NO: 1928762 - protein, 8 aa, Staphylococcus
DEQGVNLD

SEQ ID NO: 1928763 - protein, 11 aa, Staphylococcus
DEQHDEKLEEI

SEQ ID NO: 1928764 - protein, 12 aa, Staphylococcus
DEQHDEKLESIK

SEQ ID NO: 1928765 - protein, 12 aa, Staphylococcus
DEQHDEKLETIK

SEQ ID NO: 1928766 - protein, 8 aa, Staphylococcus
DEQHIQKV

SEQ ID NO: 1928767 - protein, 14 aa, Staphylococcus
DEQHYAKGSARSIE

SEQ ID NO: 1928768 - protein, 10 aa, Staphylococcus
DEQKDELSEL

SEQ ID NO: 1928769 - protein, 20 aa, Staphylococcus
DEQKLGKKVGSDLENDKSTY

SEQ ID NO: 1928770 - protein, 9 aa, Staphylococcus
DEQKSTSIS

SEQ ID NO: 1928771 - protein, 11 aa, Staphylococcus
DEQLANKLNNA

SEQ ID NO: 1928772 - protein, 19 aa, Staphylococcus
DEQLDEAAKRLKSLSPMYK

SEQ ID NO: 1928773 - protein, 9 aa, Staphylococcus
DEQLDSSEQ

SEQ ID NO: 1928774 - protein, 6 aa, Staphylococcus
DEQLKR

SEQ ID NO: 1928775 - protein, 6 aa, Staphylococcus
DEQLQE

SEQ ID NO: 1928776 - protein, 7 aa, Staphylococcus
DEQLTND

SEQ ID NO: 1928777 - protein, 4 aa, Staphylococcus
DEQM

SEQ ID NO: 1928778 - protein, 9 aa, Staphylococcus
DEQNKPMES

SEQ ID NO: 1928779 - protein, 7 aa, Staphylococcus
DEQNNEI

SEQ ID NO: 1928780 - protein, 6 aa, Staphylococcus
DEQNNP

SEQ ID NO: 1928781 - protein, 11 aa, Staphylococcus
DEQQDKVENDQ

SEQ ID NO: 1928782 - protein, 7 aa, Staphylococcus
DEQQPIG

SEQ ID NO: 1928783 - protein, 4 aa, Staphylococcus
DEQR

SEQ ID NO: 1928784 - protein, 7 aa, Staphylococcus
DEQRDKI

SEQ ID NO: 1928785 - protein, 7 aa, Staphylococcus
DEQRKAA

SEQ ID NO: 1928786 - protein, 5 aa, Staphylococcus
DEQRR

SEQ ID NO: 1928787 - protein, 9 aa, Staphylococcus
DEQSIEQSL

SEQ ID NO: 1928788 - protein, 10 aa, Staphylococcus
DEQSLKQTSV

SEQ ID NO: 1928789 - protein, 9 aa, Staphylococcus
DEQSPDIAQ

SEQ ID NO: 1928790 - protein, 21 aa, Staphylococcus
DEQTKGKGRFNRPWASAKGKG

SEQ ID NO: 1928791 - protein, 10 aa, Staphylococcus
DEQTKGRGRF

SEQ ID NO: 1928792 - protein, 6 aa, Staphylococcus
DEQTKI

SEQ ID NO: 1928793 - protein, 8 aa, Staphylococcus
DEQTLSDR

SEQ ID NO: 1928794 - protein, 6 aa, Staphylococcus
DEQTQL

SEQ ID NO: 1928795 - protein, 6 aa, Staphylococcus
DEQTQV

SEQ ID NO: 1928796 - protein, 4 aa, Staphylococcus
DEQV

SEQ ID NO: 1928797 - protein, 16 aa, Staphylococcus
DEQVGSQPIYPYLFSV

SEQ ID NO: 1928798 - protein, 4 aa, Staphylococcus
DEQY

SEQ ID NO: 1928799 - protein, 7 aa, Staphylococcus
DEQYDED

SEQ ID NO: 1928800 - protein, 12 aa, Staphylococcus
DEQYEEAMAQLG

SEQ ID NO: 1928801 - protein, 7 aa, Staphylococcus
DEQYFAK

SEQ ID NO: 1928802 - protein, 21 aa, Staphylococcus
DERAERRQKENELRGIPSTLN

SEQ ID NO: 1928803 - protein, 10 aa, Staphylococcus
DERAKQMSKD

SEQ ID NO: 1928804 - protein, 7 aa, Staphylococcus
DERAQYE

SEQ ID NO: 1928805 - protein, 9 aa, Staphylococcus
DERDASRNP

SEQ ID NO: 1928806 - protein, 7 aa, Staphylococcus
DEREDSD

SEQ ID NO: 1928807 - protein, 16 aa, Staphylococcus
DEREDVEQREDTYHYE

SEQ ID NO: 1928808 - protein, 16 aa, Staphylococcus
DEREEEGREDSYHYEG

SEQ ID NO: 1928809 - protein, 24 aa, Staphylococcus
DEREKNEEQPFANPRNAAAGSLRQ

SEQ ID NO: 1928810 - protein, 4 aa, Staphylococcus
DERG

SEQ ID NO: 1928811 - protein, 14 aa, Staphylococcus
DERGCASGGSCKCS

SEQ ID NO: 1928812 - protein, 5 aa, Staphylococcus
DERGD

SEQ ID NO: 1928813 - protein, 13 aa, Staphylococcus
DERHNLTKGRLQR

SEQ ID NO: 1928814 - protein, 6 aa, Staphylococcus
DERHNS

SEQ ID NO: 1928815 - protein, 4 aa, Staphylococcus
DERI

SEQ ID NO: 1928816 - protein, 20 aa, Staphylococcus
DERKGPNFISTSAENKQELI

SEQ ID NO: 1928817 - protein, 12 aa, Staphylococcus
DERLEKAKEVGA

SEQ ID NO: 1928818 - protein, 7 aa, Staphylococcus
DERQDTL

SEQ ID NO: 1928819 - protein, 7 aa, Staphylococcus
DERQTEY

SEQ ID NO: 1928820 - protein, 7 aa, Staphylococcus
DERSKEM

SEQ ID NO: 1928821 - protein, 6 aa, Staphylococcus
DERVDE

SEQ ID NO: 1928822 - protein, 9 aa, Staphylococcus
DERYQNGKY

SEQ ID NO: 1928823 - protein, 8 aa, Staphylococcus
DESAASDL

SEQ ID NO: 1928824 - protein, 8 aa, Staphylococcus
DESAESIE

SEQ ID NO: 1928825 - protein, 5 aa, Staphylococcus
DESDL

SEQ ID NO: 1928826 - protein, 8 aa, Staphylococcus
DESDQSEA

SEQ ID NO: 1928827 - protein, 7 aa, Staphylococcus
DESDTRL

SEQ ID NO: 1928828 - protein, 5 aa, Staphylococcus
DESDY

SEQ ID NO: 1928829 - protein, 8 aa, Staphylococcus
DESEAYEA

SEQ ID NO: 1928830 - protein, 18 aa, Staphylococcus
DESEESFEDIAEDLIDFD

SEQ ID NO: 1928831 - protein, 7 aa, Staphylococcus
DESEGPV

SEQ ID NO: 1928832 - protein, 6 aa, Staphylococcus
DESELT

SEQ ID NO: 1928833 - protein, 6 aa, Staphylococcus
DESEME

SEQ ID NO: 1928834 - protein, 12 aa, Staphylococcus
DESENYENITKE

SEQ ID NO: 1928835 - protein, 8 aa, Staphylococcus
DESEQYNL

SEQ ID NO: 1928836 - protein, 6 aa, Staphylococcus
DESETY

SEQ ID NO: 1928837 - protein, 13 aa, Staphylococcus
DESEVNDPYGGDK

SEQ ID NO: 1928838 - protein, 5 aa, Staphylococcus
DESFD

SEQ ID NO: 1928839 - protein, 10 aa, Staphylococcus
DESGGDGAGG

SEQ ID NO: 1928840 - protein, 7 aa, Staphylococcus
DESGKLD

SEQ ID NO: 1928841 - protein, 7 aa, Staphylococcus
DESGNLD

SEQ ID NO: 1928842 - protein, 6 aa, Staphylococcus
DESHDA

SEQ ID NO: 1928843 - protein, 16 aa, Staphylococcus
DESHRDALDTLIKKYD

SEQ ID NO: 1928844 - protein, 100 aa, Staphylococcus
DESIPSSNHVTSEPMSSSQELSESQQKPNEQQWQQRSGHNAVTQSVDHETEYAKKRKRQSDIKSETSSEPDSASENQSDSTENNDETSNDNTSMSSTKPM

SEQ ID NO: 1928845 - protein, 15 aa, Staphylococcus
DESIQTNYEEPKGKL

SEQ ID NO: 1928846 - protein, 13 aa, Staphylococcus
DESISEQSSELVQ

SEQ ID NO: 1928847 - protein, 6 aa, Staphylococcus
DESITN

SEQ ID NO: 1928848 - protein, 8 aa, Staphylococcus
DESKAQTF

SEQ ID NO: 1928849 - protein, 6 aa, Staphylococcus
DESKDA

SEQ ID NO: 1928850 - protein, 6 aa, Staphylococcus
DESKEA

SEQ ID NO: 1928851 - protein, 10 aa, Staphylococcus
DESKKATLNF

SEQ ID NO: 1928852 - protein, 25 aa, Staphylococcus
DESKLKKSSTGDFTKKSIDNAIPKG

SEQ ID NO: 1928853 - protein, 17 aa, Staphylococcus
DESKNYENITKEAYEEL

SEQ ID NO: 1928854 - protein, 10 aa, Staphylococcus
DESKTTTRVN

SEQ ID NO: 1928855 - protein, 5 aa, Staphylococcus
DESLA

SEQ ID NO: 1928856 - protein, 10 aa, Staphylococcus
DESLDAERMK

SEQ ID NO: 1928857 - protein, 5 aa, Staphylococcus
DESLQ

SEQ ID NO: 1928858 - protein, 6 aa, Staphylococcus
DESLSQ

SEQ ID NO: 1928859 - protein, 14 aa, Staphylococcus
DESNHHNKYARNDI

SEQ ID NO: 1928860 - protein, 9 aa, Staphylococcus
DESNWTNGA

SEQ ID NO: 1928861 - protein, 6 aa, Staphylococcus
DESNYK

SEQ ID NO: 1928862 - protein, 7 aa, Staphylococcus
DESNYLR

SEQ ID NO: 1928863 - protein, 11 aa, Staphylococcus
DESPKQNITAE

SEQ ID NO: 1928864 - protein, 7 aa, Staphylococcus
DESQEVT

SEQ ID NO: 1928865 - protein, 18 aa, Staphylococcus
DESQSIGKRYRRQDEIGT

SEQ ID NO: 1928866 - protein, 7 aa, Staphylococcus
DESRRTV

SEQ ID NO: 1928867 - protein, 7 aa, Staphylococcus
DESRTVK

SEQ ID NO: 1928868 - protein, 6 aa, Staphylococcus
DESSIE

SEQ ID NO: 1928869 - protein, 10 aa, Staphylococcus
DESSIKKEQV

SEQ ID NO: 1928870 - protein, 9 aa, Staphylococcus
DESSLKEAT

SEQ ID NO: 1928871 - protein, 15 aa, Staphylococcus
DESSNETEEGTQDGP

SEQ ID NO: 1928872 - protein, 9 aa, Staphylococcus
DESTASQFD

SEQ ID NO: 1928873 - protein, 6 aa, Staphylococcus
DESTLE

SEQ ID NO: 1928874 - protein, 10 aa, Staphylococcus
DESTPKDQAV

SEQ ID NO: 1928875 - protein, 9 aa, Staphylococcus
DESTSEADV

SEQ ID NO: 1928876 - protein, 9 aa, Staphylococcus
DESTSEEDV

SEQ ID NO: 1928877 - protein, 6 aa, Staphylococcus
DESTTF

SEQ ID NO: 1928878 - protein, 7 aa, Staphylococcus
DESVKRT

SEQ ID NO: 1928879 - protein, 5 aa, Staphylococcus
DESYE

SEQ ID NO: 1928880 - protein, 7 aa, Staphylococcus
DESYEPR

SEQ ID NO: 1928881 - protein, 8 aa, Staphylococcus
DESYKQKG

SEQ ID NO: 1928882 - protein, 7 aa, Staphylococcus
DETAISE

SEQ ID NO: 1928883 - protein, 7 aa, Staphylococcus
DETDFGE

SEQ ID NO: 1928884 - protein, 8 aa, Staphylococcus
DETDGTIV

SEQ ID NO: 1928885 - protein, 10 aa, Staphylococcus
DETDLKNANH

SEQ ID NO: 1928886 - protein, 7 aa, Staphylococcus
DETDNGF

SEQ ID NO: 1928887 - protein, 7 aa, Staphylococcus
DETDRTG

SEQ ID NO: 1928888 - protein, 6 aa, Staphylococcus
DETDTY

SEQ ID NO: 1928889 - protein, 4 aa, Staphylococcus
DETE

SEQ ID NO: 1928890 - protein, 11 aa, Staphylococcus
DETEDENAIER

SEQ ID NO: 1928891 - protein, 23 aa, Staphylococcus
DETERRRKIQNEYNEEHGITPQT

SEQ ID NO: 1928892 - protein, 24 aa, Staphylococcus
DETERRRTIQEAYNEKHNITPTTI

SEQ ID NO: 1928893 - protein, 6 aa, Staphylococcus
DETFEF

SEQ ID NO: 1928894 - protein, 6 aa, Staphylococcus
DETGCP

SEQ ID NO: 1928895 - protein, 7 aa, Staphylococcus
DETGTDV

SEQ ID NO: 1928896 - protein, 6 aa, Staphylococcus
DETIAK

SEQ ID NO: 1928897 - protein, 7 aa, Staphylococcus
DETIEQQ

SEQ ID NO: 1928898 - protein, 15 aa, Staphylococcus
DETISEAHSESVETQ

SEQ ID NO: 1928899 - protein, 9 aa, Staphylococcus
DETISEEQM

SEQ ID NO: 1928900 - protein, 4 aa, Staphylococcus
DETK

SEQ ID NO: 1928901 - protein, 8 aa, Staphylococcus
DETKAARH

SEQ ID NO: 1928902 - protein, 9 aa, Staphylococcus
DETKAARQP

SEQ ID NO: 1928903 - protein, 17 aa, Staphylococcus
DETKAKVSKLSGGNKRK

SEQ ID NO: 1928904 - protein, 7 aa, Staphylococcus
DETKAQA

SEQ ID NO: 1928905 - protein, 7 aa, Staphylococcus
DETKAQD

SEQ ID NO: 1928906 - protein, 11 aa, Staphylococcus
DETKNKHFDED

SEQ ID NO: 1928907 - protein, 10 aa, Staphylococcus
DETKQYSLNG

SEQ ID NO: 1928908 - protein, 8 aa, Staphylococcus
DETKTLRK

SEQ ID NO: 1928909 - protein, 7 aa, Staphylococcus
DETKTQD

SEQ ID NO: 1928910 - protein, 7 aa, Staphylococcus
DETLAAT

SEQ ID NO: 1928911 - protein, 9 aa, Staphylococcus
DETLEQSIE

SEQ ID NO: 1928912 - protein, 9 aa, Staphylococcus
DETLTQQAI

SEQ ID NO: 1928913 - protein, 16 aa, Staphylococcus
DETLYEEDKKDNSNKK

SEQ ID NO: 1928914 - protein, 12 aa, Staphylococcus
DETMQATAKENL

SEQ ID NO: 1928915 - protein, 9 aa, Staphylococcus
DETNDQSLA

SEQ ID NO: 1928916 - protein, 7 aa, Staphylococcus
DETPSSY

SEQ ID NO: 1928917 - protein, 9 aa, Staphylococcus
DETQAARKP

SEQ ID NO: 1928918 - protein, 6 aa, Staphylococcus
DETQEH

SEQ ID NO: 1928919 - protein, 5 aa, Staphylococcus
DETQL

SEQ ID NO: 1928920 - protein, 7 aa, Staphylococcus
DETQNYD

SEQ ID NO: 1928921 - protein, 8 aa, Staphylococcus
DETQRRRD

SEQ ID NO: 1928922 - protein, 24 aa, Staphylococcus
DETQRRRDIQTAHNEKYGITPKTI

SEQ ID NO: 1928923 - protein, 24 aa, Staphylococcus
DETQRRRDIQTAHNKEHGITPKTI

SEQ ID NO: 1928924 - protein, 8 aa, Staphylococcus
DETQRRRE

SEQ ID NO: 1928925 - protein, 23 aa, Staphylococcus
DETQRRREIQTAHNEKYGITPQT

SEQ ID NO: 1928926 - protein, 10 aa, Staphylococcus
DETQSPKSYK

SEQ ID NO: 1928927 - protein, 7 aa, Staphylococcus
DETQTQI

SEQ ID NO: 1928928 - protein, 7 aa, Staphylococcus
DETRIDK

SEQ ID NO: 1928929 - protein, 10 aa, Staphylococcus
DETRKANYTF

SEQ ID NO: 1928930 - protein, 9 aa, Staphylococcus
DETTAARKP

SEQ ID NO: 1928931 - protein, 11 aa, Staphylococcus
DETTKNPPHGG

SEQ ID NO: 1928932 - protein, 8 aa, Staphylococcus
DETTKQMQ

SEQ ID NO: 1928933 - protein, 5 aa, Staphylococcus
DETTN

SEQ ID NO: 1928934 - protein, 10 aa, Staphylococcus
DETTNLPPEI

SEQ ID NO: 1928935 - protein, 7 aa, Staphylococcus
DETTNYE

SEQ ID NO: 1928936 - protein, 6 aa, Staphylococcus
DETTQI

SEQ ID NO: 1928937 - protein, 12 aa, Staphylococcus
DETTSKQQLGTI

SEQ ID NO: 1928938 - protein, 14 aa, Staphylococcus
DETVDEDGEKEELR

SEQ ID NO: 1928939 - protein, 5 aa, Staphylococcus
DETVE

SEQ ID NO: 1928940 - protein, 11 aa, Staphylococcus
DETVKTSDNNG

SEQ ID NO: 1928941 - protein, 18 aa, Staphylococcus
DETVSEQKMKEVKSKLNE

SEQ ID NO: 1928942 - protein, 15 aa, Staphylococcus
DETYQTSDKSSEEVL

SEQ ID NO: 1928943 - protein, 32 aa, Staphylococcus
DETYYTESQLEEPVYDDNGKIIGGKSPDSGHE

SEQ ID NO: 1928944 - protein, 4 aa, Staphylococcus
DEVA

SEQ ID NO: 1928945 - protein, 5 aa, Staphylococcus
DEVAE

SEQ ID NO: 1928946 - protein, 16 aa, Staphylococcus
DEVAKGEAIKTSIRNG

SEQ ID NO: 1928947 - protein, 26 aa, Staphylococcus
DEVAKGEAVKSAIRSGAASHVQTVGK

SEQ ID NO: 1928948 - protein, 7 aa, Staphylococcus
DEVASPT

SEQ ID NO: 1928949 - protein, 4 aa, Staphylococcus
DEVD

SEQ ID NO: 1928950 - protein, 4 aa, Staphylococcus
DEVE

SEQ ID NO: 1928951 - protein, 12 aa, Staphylococcus
DEVEKGESIKQA

SEQ ID NO: 1928952 - protein, 10 aa, Staphylococcus
DEVEKQIESL

SEQ ID NO: 1928953 - protein, 6 aa, Staphylococcus
DEVENE

SEQ ID NO: 1928954 - protein, 5 aa, Staphylococcus
DEVES

SEQ ID NO: 1928955 - protein, 6 aa, Staphylococcus
DEVIQP

SEQ ID NO: 1928956 - protein, 5 aa, Staphylococcus
DEVKE

SEQ ID NO: 1928957 - protein, 14 aa, Staphylococcus
DEVKGVRTNIGTEY

SEQ ID NO: 1928958 - protein, 10 aa, Staphylococcus
DEVKKGDPKI

SEQ ID NO: 1928959 - protein, 15 aa, Staphylococcus
DEVLEQRKAEVKPFK

SEQ ID NO: 1928960 - protein, 4 aa, Staphylococcus
DEVN

SEQ ID NO: 1928961 - protein, 7 aa, Staphylococcus
DEVNEKL

SEQ ID NO: 1928962 - protein, 16 aa, Staphylococcus
DEVNKGEAVKNTIRSG

SEQ ID NO: 1928963 - protein, 20 aa, Staphylococcus
DEVNNSENQQNSSENNINNA

SEQ ID NO: 1928964 - protein, 5 aa, Staphylococcus
DEVNY

SEQ ID NO: 1928965 - protein, 8 aa, Staphylococcus
DEVPEEEY

SEQ ID NO: 1928966 - protein, 12 aa, Staphylococcus
DEVPGGGAQQRD

SEQ ID NO: 1928967 - protein, 15 aa, Staphylococcus
DEVPTVSTKTPYVST

SEQ ID NO: 1928968 - protein, 6 aa, Staphylococcus
DEVQTR

SEQ ID NO: 1928969 - protein, 4 aa, Staphylococcus
DEVR

SEQ ID NO: 1928970 - protein, 4 aa, Staphylococcus
DEVS

SEQ ID NO: 1928971 - protein, 6 aa, Staphylococcus
DEVSEY

SEQ ID NO: 1928972 - protein, 6 aa, Staphylococcus
DEVSPE

SEQ ID NO: 1928973 - protein, 23 aa, Staphylococcus
DEVTAGNGAKKDAMSGKGKLNNR

SEQ ID NO: 1928974 - protein, 24 aa, Staphylococcus
DEVTAGNGAKKDFIEGKGRLNNQI

SEQ ID NO: 1928975 - protein, 23 aa, Staphylococcus
DEVTAGNGAKKDHIDGKGRLNNQ

SEQ ID NO: 1928976 - protein, 23 aa, Staphylococcus
DEVTAGNGAKKDKMEGKGRLNNQ

SEQ ID NO: 1928977 - protein, 23 aa, Staphylococcus
DEVTAGNGAKKDKMQGKGRLNNR

SEQ ID NO: 1928978 - protein, 23 aa, Staphylococcus
DEVTAGNGAKKDTMAGKGKLNNQ

SEQ ID NO: 1928979 - protein, 23 aa, Staphylococcus
DEVTAGNGAKKDTMKGKGRLNNQ

SEQ ID NO: 1928980 - protein, 15 aa, Staphylococcus
DEVTDTSVENNSQSL

SEQ ID NO: 1928981 - protein, 12 aa, Staphylococcus
DEVVQNNDPDYL

SEQ ID NO: 1928982 - protein, 4 aa, Staphylococcus
DEWL

SEQ ID NO: 1928983 - protein, 9 aa, Staphylococcus
DEWSESERA

SEQ ID NO: 1928984 - protein, 4 aa, Staphylococcus
DEYA

SEQ ID NO: 1928985 - protein, 4 aa, Staphylococcus
DEYE

SEQ ID NO: 1928986 - protein, 24 aa, Staphylococcus
DEYEERLRGDNKIGTTKKGIGPAY

SEQ ID NO: 1928987 - protein, 6 aa, Staphylococcus
DEYEQH

SEQ ID NO: 1928988 - protein, 26 aa, Staphylococcus
DEYEYKEEHGEPVERAEDGEASSHEQ

SEQ ID NO: 1928989 - protein, 6 aa, Staphylococcus
DEYGDA

SEQ ID NO: 1928990 - protein, 12 aa, Staphylococcus
DEYGITQEQSHT

SEQ ID NO: 1928991 - protein, 7 aa, Staphylococcus
DEYGPDL

SEQ ID NO: 1928992 - protein, 6 aa, Staphylococcus
DEYKET

SEQ ID NO: 1928993 - protein, 6 aa, Staphylococcus
DEYKTD

SEQ ID NO: 1928994 - protein, 7 aa, Staphylococcus
DEYKTSN

SEQ ID NO: 1928995 - protein, 10 aa, Staphylococcus
DEYNAQQSAL

SEQ ID NO: 1928996 - protein, 7 aa, Staphylococcus
DEYNKPE

SEQ ID NO: 1928997 - protein, 5 aa, Staphylococcus
DEYNQ

SEQ ID NO: 1928998 - protein, 7 aa, Staphylococcus
DEYPGYE

SEQ ID NO: 1928999 - protein, 5 aa, Staphylococcus
DEYQQ

SEQ ID NO: 1929000 - protein, 9 aa, Staphylococcus
DEYQQSDLS

SEQ ID NO: 1929001 - protein, 9 aa, Staphylococcus
DEYQQTSGA

SEQ ID NO: 1929002 - protein, 28 aa, Staphylococcus
DEYQRQLNDQGAYAQNIDDNIGQENVDT

SEQ ID NO: 1929003 - protein, 8 aa, Staphylococcus
DEYQSSRG

SEQ ID NO: 1929004 - protein, 7 aa, Staphylococcus
DEYRTAS

SEQ ID NO: 1929005 - protein, 5 aa, Staphylococcus
DEYSE

SEQ ID NO: 1929006 - protein, 5 aa, Staphylococcus
DEYSI

SEQ ID NO: 1929007 - protein, 8 aa, Staphylococcus
DFANASKE

SEQ ID NO: 1929008 - protein, 7 aa, Staphylococcus
DFDGDEL

SEQ ID NO: 1929009 - protein, 10 aa, Staphylococcus
DFDGDRSFSE

SEQ ID NO: 1929010 - protein, 6 aa, Staphylococcus
DFDGEE

SEQ ID NO: 1929011 - protein, 9 aa, Staphylococcus
DFDSRKEYN

SEQ ID NO: 1929012 - protein, 10 aa, Staphylococcus
DFEANKDTIE

SEQ ID NO: 1929013 - protein, 4 aa, Staphylococcus
DFED

SEQ ID NO: 1929014 - protein, 44 aa, Staphylococcus
DFEESEEAAVEELEDEETASEIEEAAEEEAIEETFEKDSKKDVE

SEQ ID NO: 1929015 - protein, 12 aa, Staphylococcus
DFEGKRTGTYTL

SEQ ID NO: 1929016 - protein, 5 aa, Staphylococcus
DFEGP

SEQ ID NO: 1929017 - protein, 8 aa, Staphylococcus
DFEGTTED

SEQ ID NO: 1929018 - protein, 7 aa, Staphylococcus
DFEKGEK

SEQ ID NO: 1929019 - protein, 17 aa, Staphylococcus
DFEKNQNLTLKEKLVIH

SEQ ID NO: 1929020 - protein, 6 aa, Staphylococcus
DFENKQ

SEQ ID NO: 1929021 - protein, 10 aa, Staphylococcus
DFENTTGYKR

SEQ ID NO: 1929022 - protein, 10 aa, Staphylococcus
DFEPESSQAL

SEQ ID NO: 1929023 - protein, 12 aa, Staphylococcus
DFEQKQQNISNK

SEQ ID NO: 1929024 - protein, 11 aa, Staphylococcus
DFERDKQRCNV

SEQ ID NO: 1929025 - protein, 6 aa, Staphylococcus
DFERKR

SEQ ID NO: 1929026 - protein, 16 aa, Staphylococcus
DFESGKLDNYDTAGQG

SEQ ID NO: 1929027 - protein, 6 aa, Staphylococcus
DFETAI

SEQ ID NO: 1929028 - protein, 6 aa, Staphylococcus
DFETQY

SEQ ID NO: 1929029 - protein, 10 aa, Staphylococcus
DFETSEPLSH

SEQ ID NO: 1929030 - protein, 4 aa, Staphylococcus
DFGD

SEQ ID NO: 1929031 - protein, 7 aa, Staphylococcus
DFGEATR

SEQ ID NO: 1929032 - protein, 11 aa, Staphylococcus
DFGEDAEDYGV

SEQ ID NO: 1929033 - protein, 13 aa, Staphylococcus
DFGGGGHPNASGV

SEQ ID NO: 1929034 - protein, 5 aa, Staphylococcus
DFGMT

SEQ ID NO: 1929035 - protein, 7 aa, Staphylococcus
DFGNEAK

SEQ ID NO: 1929036 - protein, 6 aa, Staphylococcus
DFGPDL

SEQ ID NO: 1929037 - protein, 4 aa, Staphylococcus
DFGS

SEQ ID NO: 1929038 - protein, 11 aa, Staphylococcus
DFGSDKLKQTL

SEQ ID NO: 1929039 - protein, 8 aa, Staphylococcus
DFGSGKGD

SEQ ID NO: 1929040 - protein, 6 aa, Staphylococcus
DFGSGQ

SEQ ID NO: 1929041 - protein, 7 aa, Staphylococcus
DFGTKEE

SEQ ID NO: 1929042 - protein, 8 aa, Staphylococcus
DFKEESKL

SEQ ID NO: 1929043 - protein, 30 aa, Staphylococcus
DFKKTRLTANEDVKRVDPSNLPHNLLIGLV

SEQ ID NO: 1929044 - protein, 10 aa, Staphylococcus
DFKPATKAHP

SEQ ID NO: 1929045 - protein, 8 aa, Staphylococcus
DFKPGETF

SEQ ID NO: 1929046 - protein, 9 aa, Staphylococcus
DFKPKDLKK

SEQ ID NO: 1929047 - protein, 9 aa, Staphylococcus
DFKPKNLKN

SEQ ID NO: 1929048 - protein, 7 aa, Staphylococcus
DFKPNKK

SEQ ID NO: 1929049 - protein, 7 aa, Staphylococcus
DFKPNRH

SEQ ID NO: 1929050 - protein, 9 aa, Staphylococcus
DFKSKKQDT

SEQ ID NO: 1929051 - protein, 7 aa, Staphylococcus
DFKSPDN

SEQ ID NO: 1929052 - protein, 7 aa, Staphylococcus
DFKSPQQ

SEQ ID NO: 1929053 - protein, 10 aa, Staphylococcus
DFKSTPQGYQ

SEQ ID NO: 1929054 - protein, 13 aa, Staphylococcus
DFNATTQSDALDE

SEQ ID NO: 1929055 - protein, 7 aa, Staphylococcus
DFNDDKD

SEQ ID NO: 1929056 - protein, 9 aa, Staphylococcus
DFNNEGAES

SEQ ID NO: 1929057 - protein, 8 aa, Staphylococcus
DFNNGVSQ

SEQ ID NO: 1929058 - protein, 9 aa, Staphylococcus
DFNPDTDAV

SEQ ID NO: 1929059 - protein, 9 aa, Staphylococcus
DFNPDTDVI

SEQ ID NO: 1929060 - protein, 13 aa, Staphylococcus
DFNPETDAVPESD

SEQ ID NO: 1929061 - protein, 10 aa, Staphylococcus
DFNPETDSIA

SEQ ID NO: 1929062 - protein, 12 aa, Staphylococcus
DFNPETDSVPEH

SEQ ID NO: 1929063 - protein, 10 aa, Staphylococcus
DFNPGSNVTN

SEQ ID NO: 1929064 - protein, 5 aa, Staphylococcus
DFNQR

SEQ ID NO: 1929065 - protein, 8 aa, Staphylococcus
DFNSKREL

SEQ ID NO: 1929066 - protein, 13 aa, Staphylococcus
DFNSNSSKPITRK

SEQ ID NO: 1929067 - protein, 6 aa, Staphylococcus
DFNTAN

SEQ ID NO: 1929068 - protein, 5 aa, Staphylococcus
DFPAG

SEQ ID NO: 1929069 - protein, 6 aa, Staphylococcus
DFPDKD

SEQ ID NO: 1929070 - protein, 5 aa, Staphylococcus
DFPDT

SEQ ID NO: 1929071 - protein, 4 aa, Staphylococcus
DFPE

SEQ ID NO: 1929072 - protein, 6 aa, Staphylococcus
DFPGKE

SEQ ID NO: 1929073 - protein, 5 aa, Staphylococcus
DFPGM

SEQ ID NO: 1929074 - protein, 13 aa, Staphylococcus
DFPKYGNNDSRVD

SEQ ID NO: 1929075 - protein, 5 aa, Staphylococcus
DFPNT

SEQ ID NO: 1929076 - protein, 5 aa, Staphylococcus
DFPTE

SEQ ID NO: 1929077 - protein, 4 aa, Staphylococcus
DFQT

SEQ ID NO: 1929078 - protein, 12 aa, Staphylococcus
DFSDEDGIRAAE

SEQ ID NO: 1929079 - protein, 11 aa, Staphylococcus
DFSDEKTLEKA

SEQ ID NO: 1929080 - protein, 11 aa, Staphylococcus
DFSDNAEDYGV

SEQ ID NO: 1929081 - protein, 6 aa, Staphylococcus
DFSEDA

SEQ ID NO: 1929082 - protein, 10 aa, Staphylococcus
DFSEDAEDAG

SEQ ID NO: 1929083 - protein, 12 aa, Staphylococcus
DFSEDAEDAGVQ

SEQ ID NO: 1929084 - protein, 11 aa, Staphylococcus
DFSENAEDYGV

SEQ ID NO: 1929085 - protein, 10 aa, Staphylococcus
DFSGGQKTRL

SEQ ID NO: 1929086 - protein, 9 aa, Staphylococcus
DFSGYTKDY

SEQ ID NO: 1929087 - protein, 11 aa, Staphylococcus
DFSKDADDYGV

SEQ ID NO: 1929088 - protein, 7 aa, Staphylococcus
DFSKEEV

SEQ ID NO: 1929089 - protein, 11 aa, Staphylococcus
DFSKTADDLGV

SEQ ID NO: 1929090 - protein, 5 aa, Staphylococcus
DFSNG

SEQ ID NO: 1929091 - protein, 6 aa, Staphylococcus
DFSRRV

SEQ ID NO: 1929092 - protein, 8 aa, Staphylococcus
DFSSEDLD

SEQ ID NO: 1929093 - protein, 11 aa, Staphylococcus
DFSSQAEDYGV

SEQ ID NO: 1929094 - protein, 4 aa, Staphylococcus
DFTD

SEQ ID NO: 1929095 - protein, 12 aa, Staphylococcus
DFTDSKNVESFK

SEQ ID NO: 1929096 - protein, 4 aa, Staphylococcus
DFTE

SEQ ID NO: 1929097 - protein, 10 aa, Staphylococcus
DFTEDSEDYG

SEQ ID NO: 1929098 - protein, 5 aa, Staphylococcus
DFTEE

SEQ ID NO: 1929099 - protein, 7 aa, Staphylococcus
DFTEETK

SEQ ID NO: 1929100 - protein, 13 aa, Staphylococcus
DFTEGAEGEVPFK

SEQ ID NO: 1929101 - protein, 9 aa, Staphylococcus
DFTKTNQGL

SEQ ID NO: 1929102 - protein, 5 aa, Staphylococcus
DFTNI

SEQ ID NO: 1929103 - protein, 19 aa, Staphylococcus
DFTSNDTQITGESEPNSTV

SEQ ID NO: 1929104 - protein, 9 aa, Staphylococcus
DFTSYDEAA

SEQ ID NO: 1929105 - protein, 5 aa, Staphylococcus
DGAEI

SEQ ID NO: 1929106 - protein, 9 aa, Staphylococcus
DGAEITDES

SEQ ID NO: 1929107 - protein, 4 aa, Staphylococcus
DGAF

SEQ ID NO: 1929108 - protein, 5 aa, Staphylococcus
DGAFS

SEQ ID NO: 1929109 - protein, 7 aa, Staphylococcus
DGAFSKV

SEQ ID NO: 1929110 - protein, 12 aa, Staphylococcus
DGAFTFKSIHHP

SEQ ID NO: 1929111 - protein, 6 aa, Staphylococcus
DGAGAA

SEQ ID NO: 1929112 - protein, 8 aa, Staphylococcus
DGAGAGRL

SEQ ID NO: 1929113 - protein, 6 aa, Staphylococcus
DGAGVG

SEQ ID NO: 1929114 - protein, 10 aa, Staphylococcus
DGAIENGDTV

SEQ ID NO: 1929115 - protein, 17 aa, Staphylococcus
DGAIGSTYNVNGKRSRQ

SEQ ID NO: 1929116 - protein, 11 aa, Staphylococcus
DGAKLETRNGY

SEQ ID NO: 1929117 - protein, 4 aa, Staphylococcus
DGAL

SEQ ID NO: 1929118 - protein, 7 aa, Staphylococcus
DGALDVE

SEQ ID NO: 1929119 - protein, 7 aa, Staphylococcus
DGANEEI

SEQ ID NO: 1929120 - protein, 10 aa, Staphylococcus
DGANGSTSAL

SEQ ID NO: 1929121 - protein, 10 aa, Staphylococcus
DGANGSTSQL

SEQ ID NO: 1929122 - protein, 5 aa, Staphylococcus
DGANV

SEQ ID NO: 1929123 - protein, 8 aa, Staphylococcus
DGAQAAPH

SEQ ID NO: 1929124 - protein, 9 aa, Staphylococcus
DGAQDIEES

SEQ ID NO: 1929125 - protein, 9 aa, Staphylococcus
DGAQNSKEA

SEQ ID NO: 1929126 - protein, 9 aa, Staphylococcus
DGAQSAPHM

SEQ ID NO: 1929127 - protein, 10 aa, Staphylococcus
DGAREKAENG

SEQ ID NO: 1929128 - protein, 11 aa, Staphylococcus
DGAREKAENGD

SEQ ID NO: 1929129 - protein, 18 aa, Staphylococcus
DGASAITGETISVSGGSN

SEQ ID NO: 1929130 - protein, 4 aa, Staphylococcus
DGAT

SEQ ID NO: 1929131 - protein, 9 aa, Staphylococcus
DGAVENGNT

SEQ ID NO: 1929132 - protein, 10 aa, Staphylococcus
DGAWKKKENI

SEQ ID NO: 1929133 - protein, 7 aa, Staphylococcus
DGDASEV

SEQ ID NO: 1929134 - protein, 17 aa, Staphylococcus
DGDDIKITKSDSLKETL

SEQ ID NO: 1929135 - protein, 7 aa, Staphylococcus
DGDDRTV

SEQ ID NO: 1929136 - protein, 8 aa, Staphylococcus
DGDDTAKD

SEQ ID NO: 1929137 - protein, 6 aa, Staphylococcus
DGDEAF

SEQ ID NO: 1929138 - protein, 5 aa, Staphylococcus
DGDEF

SEQ ID NO: 1929139 - protein, 5 aa, Staphylococcus
DGDES

SEQ ID NO: 1929140 - protein, 11 aa, Staphylococcus
DGDFKGSSVGY

SEQ ID NO: 1929141 - protein, 5 aa, Staphylococcus
DGDGD

SEQ ID NO: 1929142 - protein, 8 aa, Staphylococcus
DGDGKEIS

SEQ ID NO: 1929143 - protein, 6 aa, Staphylococcus
DGDGRE

SEQ ID NO: 1929144 - protein, 21 aa, Staphylococcus
DGDGVKEVTDARVGQDGTQHG

SEQ ID NO: 1929145 - protein, 7 aa, Staphylococcus
DGDKDNV

SEQ ID NO: 1929146 - protein, 8 aa, Staphylococcus
DGDKEISV

SEQ ID NO: 1929147 - protein, 9 aa, Staphylococcus
DGDKEQARQ

SEQ ID NO: 1929148 - protein, 5 aa, Staphylococcus
DGDKR

SEQ ID NO: 1929149 - protein, 5 aa, Staphylococcus
DGDKV

SEQ ID NO: 1929150 - protein, 9 aa, Staphylococcus
DGDLKETAD

SEQ ID NO: 1929151 - protein, 4 aa, Staphylococcus
DGDP

SEQ ID NO: 1929152 - protein, 11 aa, Staphylococcus
DGDRYKKIEQN

SEQ ID NO: 1929153 - protein, 8 aa, Staphylococcus
DGDSSTND

SEQ ID NO: 1929154 - protein, 5 aa, Staphylococcus
DGDSV

SEQ ID NO: 1929155 - protein, 8 aa, Staphylococcus
DGDTSTND

SEQ ID NO: 1929156 - protein, 5 aa, Staphylococcus
DGDTV

SEQ ID NO: 1929157 - protein, 9 aa, Staphylococcus
DGDWDGEKV

SEQ ID NO: 1929158 - protein, 8 aa, Staphylococcus
DGDYPPEI

SEQ ID NO: 1929159 - protein, 9 aa, Staphylococcus
DGDYPPEIQ

SEQ ID NO: 1929160 - protein, 6 aa, Staphylococcus
DGDYTG

SEQ ID NO: 1929161 - protein, 6 aa, Staphylococcus
DGEAPE

SEQ ID NO: 1929162 - protein, 5 aa, Staphylococcus
DGEAQ

SEQ ID NO: 1929163 - protein, 7 aa, Staphylococcus
DGEAVYP

SEQ ID NO: 1929164 - protein, 6 aa, Staphylococcus
DGEDDS

SEQ ID NO: 1929165 - protein, 7 aa, Staphylococcus
DGEDGDV

SEQ ID NO: 1929166 - protein, 7 aa, Staphylococcus
DGEDPVE

SEQ ID NO: 1929167 - protein, 8 aa, Staphylococcus
DGEDTAKD

SEQ ID NO: 1929168 - protein, 12 aa, Staphylococcus
DGEDTAKDMYTK

SEQ ID NO: 1929169 - protein, 8 aa, Staphylococcus
DGEDTARD

SEQ ID NO: 1929170 - protein, 7 aa, Staphylococcus
DGEEALE

SEQ ID NO: 1929171 - protein, 15 aa, Staphylococcus
DGEEALEKVNATNPE

SEQ ID NO: 1929172 - protein, 7 aa, Staphylococcus
DGEEALK

SEQ ID NO: 1929173 - protein, 5 aa, Staphylococcus
DGEEE

SEQ ID NO: 1929174 - protein, 10 aa, Staphylococcus
DGEEITEYPA

SEQ ID NO: 1929175 - protein, 11 aa, Staphylococcus
DGEEITEYPAN

SEQ ID NO: 1929176 - protein, 7 aa, Staphylococcus
DGEEKTG

SEQ ID NO: 1929177 - protein, 10 aa, Staphylococcus
DGEEKTGNTS

SEQ ID NO: 1929178 - protein, 14 aa, Staphylococcus
DGEELQKIEDPAGP

SEQ ID NO: 1929179 - protein, 22 aa, Staphylococcus
DGEELSEQPSNFRDKAKRFFKG

SEQ ID NO: 1929180 - protein, 15 aa, Staphylococcus
DGEEVKMSKRTGNAI

SEQ ID NO: 1929181 - protein, 18 aa, Staphylococcus
DGEGVTEAIRTKSNMDGM

SEQ ID NO: 1929182 - protein, 4 aa, Staphylococcus
DGEI

SEQ ID NO: 1929183 - protein, 7 aa, Staphylococcus
DGEIAGA

SEQ ID NO: 1929184 - protein, 7 aa, Staphylococcus
DGEIDKQ

SEQ ID NO: 1929185 - protein, 10 aa, Staphylococcus
DGEIKGISQR

SEQ ID NO: 1929186 - protein, 9 aa, Staphylococcus
DGEIKGVAQ

SEQ ID NO: 1929187 - protein, 10 aa, Staphylococcus
DGEIKGVSQR

SEQ ID NO: 1929188 - protein, 10 aa, Staphylococcus
DGEIPQTHQE

SEQ ID NO: 1929189 - protein, 8 aa, Staphylococcus
DGEITDDN

SEQ ID NO: 1929190 - protein, 15 aa, Staphylococcus
DGEITHEKEGDNGFG

SEQ ID NO: 1929191 - protein, 4 aa, Staphylococcus
DGEK

SEQ ID NO: 1929192 - protein, 26 aa, Staphylococcus
DGEKGRDGKSVTAETTRGDKDGQTGA

SEQ ID NO: 1929193 - protein, 7 aa, Staphylococcus
DGEKTKR

SEQ ID NO: 1929194 - protein, 9 aa, Staphylococcus
DGEKTTGNT

SEQ ID NO: 1929195 - protein, 5 aa, Staphylococcus
DGELQ

SEQ ID NO: 1929196 - protein, 6 aa, Staphylococcus
DGELRI

SEQ ID NO: 1929197 - protein, 17 aa, Staphylococcus
DGENGAKEAGKQRLEGK

SEQ ID NO: 1929198 - protein, 7 aa, Staphylococcus
DGENQFS

SEQ ID NO: 1929199 - protein, 5 aa, Staphylococcus
DGEPR

SEQ ID NO: 1929200 - protein, 10 aa, Staphylococcus
DGEPSAYNYA

SEQ ID NO: 1929201 - protein, 12 aa, Staphylococcus
DGEPSAYNYSQD

SEQ ID NO: 1929202 - protein, 7 aa, Staphylococcus
DGEQPVA

SEQ ID NO: 1929203 - protein, 15 aa, Staphylococcus
DGEQVGDGKVGPVTR

SEQ ID NO: 1929204 - protein, 4 aa, Staphylococcus
DGES

SEQ ID NO: 1929205 - protein, 5 aa, Staphylococcus
DGESI

SEQ ID NO: 1929206 - protein, 8 aa, Staphylococcus
DGESLSAE

SEQ ID NO: 1929207 - protein, 9 aa, Staphylococcus
DGESTNPAL

SEQ ID NO: 1929208 - protein, 12 aa, Staphylococcus
DGESWGEKDLSK

SEQ ID NO: 1929209 - protein, 9 aa, Staphylococcus
DGETALHPS

SEQ ID NO: 1929210 - protein, 7 aa, Staphylococcus
DGETETG

SEQ ID NO: 1929211 - protein, 10 aa, Staphylococcus
DGETFTENDN

SEQ ID NO: 1929212 - protein, 11 aa, Staphylococcus
DGETITEYPAN

SEQ ID NO: 1929213 - protein, 21 aa, Staphylococcus
DGETPASLKKQFDSQRKRNIN

SEQ ID NO: 1929214 - protein, 22 aa, Staphylococcus
DGETYSKSLDNKEIEKQGKAMA

SEQ ID NO: 1929215 - protein, 7 aa, Staphylococcus
DGEVAAT

SEQ ID NO: 1929216 - protein, 9 aa, Staphylococcus
DGEVTLSDG

SEQ ID NO: 1929217 - protein, 18 aa, Staphylococcus
DGEWKKKENITDEIKSTD

SEQ ID NO: 1929218 - protein, 19 aa, Staphylococcus
DGEWKKQDNITSEIESTED

SEQ ID NO: 1929219 - protein, 9 aa, Staphylococcus
DGEYGGKLP

SEQ ID NO: 1929220 - protein, 10 aa, Staphylococcus
DGEYGGKLPG

SEQ ID NO: 1929221 - protein, 8 aa, Staphylococcus
DGEYGGQL

SEQ ID NO: 1929222 - protein, 14 aa, Staphylococcus
DGEYTLEMRAIYYG

SEQ ID NO: 1929223 - protein, 4 aa, Staphylococcus
DGFA

SEQ ID NO: 1929224 - protein, 5 aa, Staphylococcus
DGFAT

SEQ ID NO: 1929225 - protein, 8 aa, Staphylococcus
DGFNQTQL

SEQ ID NO: 1929226 - protein, 6 aa, Staphylococcus
DGFPDH

SEQ ID NO: 1929227 - protein, 7 aa, Staphylococcus
DGFPDHG

SEQ ID NO: 1929228 - protein, 6 aa, Staphylococcus
DGFSEE

SEQ ID NO: 1929229 - protein, 5 aa, Staphylococcus
DGFSG

SEQ ID NO: 1929230 - protein, 9 aa, Staphylococcus
DGGEGTTAA

SEQ ID NO: 1929231 - protein, 19 aa, Staphylococcus
DGGEGTTDALKEAHNAKTY

SEQ ID NO: 1929232 - protein, 4 aa, Staphylococcus
DGGF

SEQ ID NO: 1929233 - protein, 5 aa, Staphylococcus
DGGFQ

SEQ ID NO: 1929234 - protein, 11 aa, Staphylococcus
DGGGTKTAGVI

SEQ ID NO: 1929235 - protein, 5 aa, Staphylococcus
DGGHP

SEQ ID NO: 1929236 - protein, 8 aa, Staphylococcus
DGGINDKT

SEQ ID NO: 1929237 - protein, 9 aa, Staphylococcus
DGGKAEVYH

SEQ ID NO: 1929238 - protein, 6 aa, Staphylococcus
DGGKAV

SEQ ID NO: 1929239 - protein, 4 aa, Staphylococcus
DGGL

SEQ ID NO: 1929240 - protein, 5 aa, Staphylococcus
DGGMS

SEQ ID NO: 1929241 - protein, 6 aa, Staphylococcus
DGGPVG

SEQ ID NO: 1929242 - protein, 13 aa, Staphylococcus
DGGQPIYNYLLSV

SEQ ID NO: 1929243 - protein, 7 aa, Staphylococcus
DGGRVDI

SEQ ID NO: 1929244 - protein, 6 aa, Staphylococcus
DGGSEY

SEQ ID NO: 1929245 - protein, 6 aa, Staphylococcus
DGGSQN

SEQ ID NO: 1929246 - protein, 31 aa, Staphylococcus
DGGSSKKDANKIKQLETENQRLKAENKDFRK

SEQ ID NO: 1929247 - protein, 10 aa, Staphylococcus
DGGSYSMENP

SEQ ID NO: 1929248 - protein, 15 aa, Staphylococcus
DGGSYSVENPDVVED

SEQ ID NO: 1929249 - protein, 8 aa, Staphylococcus
DGGTTIDD

SEQ ID NO: 1929250 - protein, 5 aa, Staphylococcus
DGGVQ

SEQ ID NO: 1929251 - protein, 7 aa, Staphylococcus
DGGYNGE

SEQ ID NO: 1929252 - protein, 7 aa, Staphylococcus
DGHAEEA

SEQ ID NO: 1929253 - protein, 7 aa, Staphylococcus
DGHALTE

SEQ ID NO: 1929254 - protein, 5 aa, Staphylococcus
DGHED

SEQ ID NO: 1929255 - protein, 6 aa, Staphylococcus
DGHENV

SEQ ID NO: 1929256 - protein, 4 aa, Staphylococcus
DGHF

SEQ ID NO: 1929257 - protein, 6 aa, Staphylococcus
DGHLYQ

SEQ ID NO: 1929258 - protein, 7 aa, Staphylococcus
DGHMPTR

SEQ ID NO: 1929259 - protein, 7 aa, Staphylococcus
DGHSAKS

SEQ ID NO: 1929260 - protein, 14 aa, Staphylococcus
DGHYAGAKELGRSI

SEQ ID NO: 1929261 - protein, 13 aa, Staphylococcus
DGHYQGARDLGRS

SEQ ID NO: 1929262 - protein, 14 aa, Staphylococcus
DGHYSGAKDLGRSI

SEQ ID NO: 1929263 - protein, 13 aa, Staphylococcus
DGHYSGAKKLGRA

SEQ ID NO: 1929264 - protein, 13 aa, Staphylococcus
DGHYTGAKKLGRA

SEQ ID NO: 1929265 - protein, 8 aa, Staphylococcus
DGHYTTNS

SEQ ID NO: 1929266 - protein, 7 aa, Staphylococcus
DGIAKPL

SEQ ID NO: 1929267 - protein, 17 aa, Staphylococcus
DGIDYQTAGENLAYGQQ

SEQ ID NO: 1929268 - protein, 7 aa, Staphylococcus
DGIENRD

SEQ ID NO: 1929269 - protein, 10 aa, Staphylococcus
DGIGAKRKTK

SEQ ID NO: 1929270 - protein, 5 aa, Staphylococcus
DGIGD

SEQ ID NO: 1929271 - protein, 10 aa, Staphylococcus
DGIGSKRKTK

SEQ ID NO: 1929272 - protein, 10 aa, Staphylococcus
DGIGSKRKTS

SEQ ID NO: 1929273 - protein, 10 aa, Staphylococcus
DGIGSKRKTT

SEQ ID NO: 1929274 - protein, 11 aa, Staphylococcus
DGIKLKGDKVD

SEQ ID NO: 1929275 - protein, 15 aa, Staphylococcus
DGIKNKTEVPKPVNQ

SEQ ID NO: 1929276 - protein, 8 aa, Staphylococcus
DGINEQGL

SEQ ID NO: 1929277 - protein, 6 aa, Staphylococcus
DGINTN

SEQ ID NO: 1929278 - protein, 6 aa, Staphylococcus
DGIPTY

SEQ ID NO: 1929279 - protein, 5 aa, Staphylococcus
DGIQP

SEQ ID NO: 1929280 - protein, 14 aa, Staphylococcus
DGIQVSAEGDLKPV

SEQ ID NO: 1929281 - protein, 4 aa, Staphylococcus
DGIR

SEQ ID NO: 1929282 - protein, 5 aa, Staphylococcus
DGIRN

SEQ ID NO: 1929283 - protein, 22 aa, Staphylococcus
DGISQQDLSKAFNRKGATVSAT

SEQ ID NO: 1929284 - protein, 10 aa, Staphylococcus
DGKAKGLQIG

SEQ ID NO: 1929285 - protein, 4 aa, Staphylococcus
DGKD

SEQ ID NO: 1929286 - protein, 10 aa, Staphylococcus
DGKDLSQDAH

SEQ ID NO: 1929287 - protein, 8 aa, Staphylococcus
DGKDPGYH

SEQ ID NO: 1929288 - protein, 4 aa, Staphylococcus
DGKE

SEQ ID NO: 1929289 - protein, 8 aa, Staphylococcus
DGKEADEI

SEQ ID NO: 1929290 - protein, 12 aa, Staphylococcus
DGKEEQGDYKQS

SEQ ID NO: 1929291 - protein, 10 aa, Staphylococcus
DGKEIATGLS

SEQ ID NO: 1929292 - protein, 8 aa, Staphylococcus
DGKELTTD

SEQ ID NO: 1929293 - protein, 7 aa, Staphylococcus
DGKEQHQ

SEQ ID NO: 1929294 - protein, 7 aa, Staphylococcus
DGKGFNV

SEQ ID NO: 1929295 - protein, 6 aa, Staphylococcus
DGKGHI

SEQ ID NO: 1929296 - protein, 7 aa, Staphylococcus
DGKGINP

SEQ ID NO: 1929297 - protein, 4 aa, Staphylococcus
DGKH

SEQ ID NO: 1929298 - protein, 9 aa, Staphylococcus
DGKHESISH

SEQ ID NO: 1929299 - protein, 6 aa, Staphylococcus
DGKHYD

SEQ ID NO: 1929300 - protein, 12 aa, Staphylococcus
DGKIADGDILKI

SEQ ID NO: 1929301 - protein, 21 aa, Staphylococcus
DGKIAYDSQRKDEKPRGGKDV

SEQ ID NO: 1929302 - protein, 7 aa, Staphylococcus
DGKIPEI

SEQ ID NO: 1929303 - protein, 7 aa, Staphylococcus
DGKKHKA

SEQ ID NO: 1929304 - protein, 8 aa, Staphylococcus
DGKKHKES

SEQ ID NO: 1929305 - protein, 9 aa, Staphylococcus
DGKKPTSKV

SEQ ID NO: 1929306 - protein, 10 aa, Staphylococcus
DGKKRENDIQ

SEQ ID NO: 1929307 - protein, 8 aa, Staphylococcus
DGKKSEYA

SEQ ID NO: 1929308 - protein, 5 aa, Staphylococcus
DGKKY

SEQ ID NO: 1929309 - protein, 8 aa, Staphylococcus
DGKKYKSK

SEQ ID NO: 1929310 - protein, 13 aa, Staphylococcus
DGKLQHGEPLPSN

SEQ ID NO: 1929311 - protein, 8 aa, Staphylococcus
DGKNAADM

SEQ ID NO: 1929312 - protein, 21 aa, Staphylococcus
DGKNAADPQTGQVMGTQAGEN

SEQ ID NO: 1929313 - protein, 12 aa, Staphylococcus
DGKNAADPVTGK

SEQ ID NO: 1929314 - protein, 21 aa, Staphylococcus
DGKNAADPYTGKDMGTQAGSN

SEQ ID NO: 1929315 - protein, 24 aa, Staphylococcus
DGKNAADVSTGQVQKTQAGDNLTV

SEQ ID NO: 1929316 - protein, 20 aa, Staphylococcus
DGKNAKDMKGNERGTQAGNN

SEQ ID NO: 1929317 - protein, 12 aa, Staphylococcus
DGKPDKKGYRKY

SEQ ID NO: 1929318 - protein, 11 aa, Staphylococcus
DGKPDKRGYRK

SEQ ID NO: 1929319 - protein, 15 aa, Staphylococcus
DGKPIQLGDTDRELN

SEQ ID NO: 1929320 - protein, 13 aa, Staphylococcus
DGKPVLDREGEHN

SEQ ID NO: 1929321 - protein, 14 aa, Staphylococcus
DGKPVNSRPGEYNQ

SEQ ID NO: 1929322 - protein, 6 aa, Staphylococcus
DGKPYA

SEQ ID NO: 1929323 - protein, 4 aa, Staphylococcus
DGKQ

SEQ ID NO: 1929324 - protein, 9 aa, Staphylococcus
DGKQADVTF

SEQ ID NO: 1929325 - protein, 8 aa, Staphylococcus
DGKQSGYH

SEQ ID NO: 1929326 - protein, 6 aa, Staphylococcus
DGKQSL

SEQ ID NO: 1929327 - protein, 7 aa, Staphylococcus
DGKQTRD

SEQ ID NO: 1929328 - protein, 6 aa, Staphylococcus
DGKRAA

SEQ ID NO: 1929329 - protein, 10 aa, Staphylococcus
DGKRLYDDNS

SEQ ID NO: 1929330 - protein, 8 aa, Staphylococcus
DGKRLYED

SEQ ID NO: 1929331 - protein, 9 aa, Staphylococcus
DGKSGKPII

SEQ ID NO: 1929332 - protein, 10 aa, Staphylococcus
DGKSITDSPY

SEQ ID NO: 1929333 - protein, 9 aa, Staphylococcus
DGKSMTDSP

SEQ ID NO: 1929334 - protein, 8 aa, Staphylococcus
DGKTEDTI

SEQ ID NO: 1929335 - protein, 7 aa, Staphylococcus
DGKTKRI

SEQ ID NO: 1929336 - protein, 16 aa, Staphylococcus
DGKTLLKTNGSGKTNE

SEQ ID NO: 1929337 - protein, 8 aa, Staphylococcus
DGKTSGYN

SEQ ID NO: 1929338 - protein, 24 aa, Staphylococcus
DGKTTKDLNGHYTTSDIFNELKKN

SEQ ID NO: 1929339 - protein, 9 aa, Staphylococcus
DGKTVPEPF

SEQ ID NO: 1929340 - protein, 19 aa, Staphylococcus
DGKVAYDSQTQNDSPREGE

SEQ ID NO: 1929341 - protein, 17 aa, Staphylococcus
DGKYELRESKVTAGNNY

SEQ ID NO: 1929342 - protein, 6 aa, Staphylococcus
DGLEPK

SEQ ID NO: 1929343 - protein, 7 aa, Staphylococcus
DGLGQKL

SEQ ID NO: 1929344 - protein, 7 aa, Staphylococcus
DGLNPNQ

SEQ ID NO: 1929345 - protein, 5 aa, Staphylococcus
DGLPE

SEQ ID NO: 1929346 - protein, 18 aa, Staphylococcus
DGLRPGSIYDANDESQFA

SEQ ID NO: 1929347 - protein, 18 aa, Staphylococcus
DGLRPGSIYDANDESQIA

SEQ ID NO: 1929348 - protein, 19 aa, Staphylococcus
DGLRPGSIYDANDESQISE

SEQ ID NO: 1929349 - protein, 4 aa, Staphylococcus
DGLS

SEQ ID NO: 1929350 - protein, 6 aa, Staphylococcus
DGLSDY

SEQ ID NO: 1929351 - protein, 7 aa, Staphylococcus
DGLSRDR

SEQ ID NO: 1929352 - protein, 5 aa, Staphylococcus
DGLTE

SEQ ID NO: 1929353 - protein, 8 aa, Staphylococcus
DGLTQPAT

SEQ ID NO: 1929354 - protein, 4 aa, Staphylococcus
DGLV

SEQ ID NO: 1929355 - protein, 5 aa, Staphylococcus
DGLVS

SEQ ID NO: 1929356 - protein, 4 aa, Staphylococcus
DGMF

SEQ ID NO: 1929357 - protein, 9 aa, Staphylococcus
DGNAGPESI

SEQ ID NO: 1929358 - protein, 8 aa, Staphylococcus
DGNDAQDI

SEQ ID NO: 1929359 - protein, 8 aa, Staphylococcus
DGNDLAKA

SEQ ID NO: 1929360 - protein, 8 aa, Staphylococcus
DGNDPVEN

SEQ ID NO: 1929361 - protein, 4 aa, Staphylococcus
DGNE

SEQ ID NO: 1929362 - protein, 5 aa, Staphylococcus
DGNEF

SEQ ID NO: 1929363 - protein, 10 aa, Staphylococcus
DGNESDASGT

SEQ ID NO: 1929364 - protein, 4 aa, Staphylococcus
DGNG

SEQ ID NO: 1929365 - protein, 26 aa, Staphylococcus
DGNGKEISRQDIHNGQDGKTPTIEQV

SEQ ID NO: 1929366 - protein, 34 aa, Staphylococcus
DGNGKEISRQDIYNGRDGQDGKDGKTPSIEQQPI

SEQ ID NO: 1929367 - protein, 17 aa, Staphylococcus
DGNGKEVSRQNIYNTSN

SEQ ID NO: 1929368 - protein, 5 aa, Staphylococcus
DGNGR

SEQ ID NO: 1929369 - protein, 8 aa, Staphylococcus
DGNGRTSR

SEQ ID NO: 1929370 - protein, 6 aa, Staphylococcus
DGNGRV

SEQ ID NO: 1929371 - protein, 11 aa, Staphylococcus
DGNHLPTDQNV

SEQ ID NO: 1929372 - protein, 4 aa, Staphylococcus
DGNI

SEQ ID NO: 1929373 - protein, 6 aa, Staphylococcus
DGNIPL

SEQ ID NO: 1929374 - protein, 6 aa, Staphylococcus
DGNKDN

SEQ ID NO: 1929375 - protein, 9 aa, Staphylococcus
DGNKEGKLK

SEQ ID NO: 1929376 - protein, 7 aa, Staphylococcus
DGNKEKV

SEQ ID NO: 1929377 - protein, 8 aa, Staphylococcus
DGNKEQAK

SEQ ID NO: 1929378 - protein, 8 aa, Staphylococcus
DGNKQQAK

SEQ ID NO: 1929379 - protein, 9 aa, Staphylococcus
DGNKVPEPF

SEQ ID NO: 1929380 - protein, 11 aa, Staphylococcus
DGNNAKGSYQT

SEQ ID NO: 1929381 - protein, 10 aa, Staphylococcus
DGNNDTHHHG

SEQ ID NO: 1929382 - protein, 9 aa, Staphylococcus
DGNNGKGTF

SEQ ID NO: 1929383 - protein, 7 aa, Staphylococcus
DGNNKNH

SEQ ID NO: 1929384 - protein, 9 aa, Staphylococcus
DGNPAKIDD

SEQ ID NO: 1929385 - protein, 10 aa, Staphylococcus
DGNPKNNNVS

SEQ ID NO: 1929386 - protein, 28 aa, Staphylococcus
DGNQGGKTHYYPNSTGAMESQPEYKRAP

SEQ ID NO: 1929387 - protein, 7 aa, Staphylococcus
DGNQITE

SEQ ID NO: 1929388 - protein, 6 aa, Staphylococcus
DGNRIS

SEQ ID NO: 1929389 - protein, 6 aa, Staphylococcus
DGNSAA

SEQ ID NO: 1929390 - protein, 9 aa, Staphylococcus
DGNSAGFQD

SEQ ID NO: 1929391 - protein, 14 aa, Staphylococcus
DGNSYTDQVDISSK

SEQ ID NO: 1929392 - protein, 8 aa, Staphylococcus
DGNTEKEY

SEQ ID NO: 1929393 - protein, 17 aa, Staphylococcus
DGNTGPDSIIKSGKNGY

SEQ ID NO: 1929394 - protein, 11 aa, Staphylococcus
DGNTLKGERGV

SEQ ID NO: 1929395 - protein, 14 aa, Staphylococcus
DGNTYQDSSIGTGS

SEQ ID NO: 1929396 - protein, 4 aa, Staphylococcus
DGNV

SEQ ID NO: 1929397 - protein, 15 aa, Staphylococcus
DGNVDAIVKKVRCEH

SEQ ID NO: 1929398 - protein, 15 aa, Staphylococcus
DGNVDATVKKVRCND

SEQ ID NO: 1929399 - protein, 9 aa, Staphylococcus
DGNVQDRDT

SEQ ID NO: 1929400 - protein, 16 aa, Staphylococcus
DGNVVGSDKRGTGKTH

SEQ ID NO: 1929401 - protein, 6 aa, Staphylococcus
DGNYTY

SEQ ID NO: 1929402 - protein, 7 aa, Staphylococcus
DGNYTYF

SEQ ID NO: 1929403 - protein, 8 aa, Staphylococcus
DGPADKAQ

SEQ ID NO: 1929404 - protein, 22 aa, Staphylococcus
DGPAEREKYVATASSKRSLKDA

SEQ ID NO: 1929405 - protein, 8 aa, Staphylococcus
DGPAETGG

SEQ ID NO: 1929406 - protein, 10 aa, Staphylococcus
DGPASEADDD

SEQ ID NO: 1929407 - protein, 10 aa, Staphylococcus
DGPASEANED

SEQ ID NO: 1929408 - protein, 20 aa, Staphylococcus
DGPDAEKIEARAKEKLNADE

SEQ ID NO: 1929409 - protein, 6 aa, Staphylococcus
DGPDAV

SEQ ID NO: 1929410 - protein, 7 aa, Staphylococcus
DGPEHDN

SEQ ID NO: 1929411 - protein, 6 aa, Staphylococcus
DGPERF

SEQ ID NO: 1929412 - protein, 8 aa, Staphylococcus
DGPGEHDY

SEQ ID NO: 1929413 - protein, 7 aa, Staphylococcus
DGPKEMG

SEQ ID NO: 1929414 - protein, 9 aa, Staphylococcus
DGPKETGGL

SEQ ID NO: 1929415 - protein, 12 aa, Staphylococcus
DGPKHSHEKSYK

SEQ ID NO: 1929416 - protein, 8 aa, Staphylococcus
DGPKQTGI

SEQ ID NO: 1929417 - protein, 4 aa, Staphylococcus
DGPL

SEQ ID NO: 1929418 - protein, 9 aa, Staphylococcus
DGPLYDAPD

SEQ ID NO: 1929419 - protein, 6 aa, Staphylococcus
DGPNHD

SEQ ID NO: 1929420 - protein, 6 aa, Staphylococcus
DGPSDL

SEQ ID NO: 1929421 - protein, 8 aa, Staphylococcus
DGPSETGI

SEQ ID NO: 1929422 - protein, 21 aa, Staphylococcus
DGPSGIRKQTEGGDALGLTGS

SEQ ID NO: 1929423 - protein, 8 aa, Staphylococcus
DGPSQTGI

SEQ ID NO: 1929424 - protein, 20 aa, Staphylococcus
DGPSTRGDYVETVSSKSSLQ

SEQ ID NO: 1929425 - protein, 12 aa, Staphylococcus
DGPTCHTGNTSC

SEQ ID NO: 1929426 - protein, 8 aa, Staphylococcus
DGPTDNAT

SEQ ID NO: 1929427 - protein, 9 aa, Staphylococcus
DGPVKPAQL

SEQ ID NO: 1929428 - protein, 5 aa, Staphylococcus
DGQAL

SEQ ID NO: 1929429 - protein, 8 aa, Staphylococcus
DGQALTKQ

SEQ ID NO: 1929430 - protein, 11 aa, Staphylococcus
DGQEIKNETYV

SEQ ID NO: 1929431 - protein, 9 aa, Staphylococcus
DGQERSINE

SEQ ID NO: 1929432 - protein, 15 aa, Staphylococcus
DGQEVKMSKRTGNAI

SEQ ID NO: 1929433 - protein, 4 aa, Staphylococcus
DGQF

SEQ ID NO: 1929434 - protein, 8 aa, Staphylococcus
DGQHYTGL

SEQ ID NO: 1929435 - protein, 5 aa, Staphylococcus
DGQIL

SEQ ID NO: 1929436 - protein, 6 aa, Staphylococcus
DGQISM

SEQ ID NO: 1929437 - protein, 13 aa, Staphylococcus
DGQITNEEVLSHN

SEQ ID NO: 1929438 - protein, 10 aa, Staphylococcus
DGQKADTEHG

SEQ ID NO: 1929439 - protein, 35 aa, Staphylococcus
DGQKGADGKNGVDGKDGKTPTIEQQPIRDKDGKQI

SEQ ID NO: 1929440 - protein, 17 aa, Staphylococcus
DGQKGKNGQDGKTPTIE

SEQ ID NO: 1929441 - protein, 10 aa, Staphylococcus
DGQPAKADDP

SEQ ID NO: 1929442 - protein, 9 aa, Staphylococcus
DGQPAKVDD

SEQ ID NO: 1929443 - protein, 13 aa, Staphylococcus
DGQPIKLGQTSRV

SEQ ID NO: 1929444 - protein, 10 aa, Staphylococcus
DGQPLDLTKT

SEQ ID NO: 1929445 - protein, 6 aa, Staphylococcus
DGQQFR

SEQ ID NO: 1929446 - protein, 8 aa, Staphylococcus
DGQSFAEQ

SEQ ID NO: 1929447 - protein, 5 aa, Staphylococcus
DGQSH

SEQ ID NO: 1929448 - protein, 7 aa, Staphylococcus
DGQSPMK

SEQ ID NO: 1929449 - protein, 17 aa, Staphylococcus
DGQTATVKGPKGELTRT

SEQ ID NO: 1929450 - protein, 11 aa, Staphylococcus
DGQTGINPPVG

SEQ ID NO: 1929451 - protein, 11 aa, Staphylococcus
DGQTGVNPPVG

SEQ ID NO: 1929452 - protein, 9 aa, Staphylococcus
DGQTHTIAQ

SEQ ID NO: 1929453 - protein, 6 aa, Staphylococcus
DGQTLD

SEQ ID NO: 1929454 - protein, 15 aa, Staphylococcus
DGQVEATIKKVRCDN

SEQ ID NO: 1929455 - protein, 13 aa, Staphylococcus
DGQVGNNDDPSDI

SEQ ID NO: 1929456 - protein, 16 aa, Staphylococcus
DGQVVTKHDESEGAMS

SEQ ID NO: 1929457 - protein, 14 aa, Staphylococcus
DGQWKKKENITKNI

SEQ ID NO: 1929458 - protein, 4 aa, Staphylococcus
DGQY

SEQ ID NO: 1929459 - protein, 7 aa, Staphylococcus
DGQYSGE

SEQ ID NO: 1929460 - protein, 10 aa, Staphylococcus
DGRAHELSES

SEQ ID NO: 1929461 - protein, 8 aa, Staphylococcus
DGREDKPQ

SEQ ID NO: 1929462 - protein, 9 aa, Staphylococcus
DGREETGNT

SEQ ID NO: 1929463 - protein, 5 aa, Staphylococcus
DGREG

SEQ ID NO: 1929464 - protein, 13 aa, Staphylococcus
DGREIPKKPRIVN

SEQ ID NO: 1929465 - protein, 6 aa, Staphylococcus
DGRGPI

SEQ ID NO: 1929466 - protein, 8 aa, Staphylococcus
DGRHYSGL

SEQ ID NO: 1929467 - protein, 6 aa, Staphylococcus
DGRNNV

SEQ ID NO: 1929468 - protein, 8 aa, Staphylococcus
DGRPELPK

SEQ ID NO: 1929469 - protein, 7 aa, Staphylococcus
DGRQATH

SEQ ID NO: 1929470 - protein, 10 aa, Staphylococcus
DGRQPAASEA

SEQ ID NO: 1929471 - protein, 20 aa, Staphylococcus
DGRRATGVTYKKNGKERTIN

SEQ ID NO: 1929472 - protein, 8 aa, Staphylococcus
DGRRPGFR

SEQ ID NO: 1929473 - protein, 7 aa, Staphylococcus
DGRSKEM

SEQ ID NO: 1929474 - protein, 10 aa, Staphylococcus
DGRTANSDDI

SEQ ID NO: 1929475 - protein, 9 aa, Staphylococcus
DGRTAQREN

SEQ ID NO: 1929476 - protein, 7 aa, Staphylococcus
DGRTAVR

SEQ ID NO: 1929477 - protein, 9 aa, Staphylococcus
DGRTENPDD

SEQ ID NO: 1929478 - protein, 8 aa, Staphylococcus
DGSAKDQI

SEQ ID NO: 1929479 - protein, 8 aa, Staphylococcus
DGSAKEDI

SEQ ID NO: 1929480 - protein, 10 aa, Staphylococcus
DGSASEVKQQ

SEQ ID NO: 1929481 - protein, 11 aa, Staphylococcus
DGSDEADAIES

SEQ ID NO: 1929482 - protein, 8 aa, Staphylococcus
DGSDEAEW

SEQ ID NO: 1929483 - protein, 9 aa, Staphylococcus
DGSDEQDAI

SEQ ID NO: 1929484 - protein, 10 aa, Staphylococcus
DGSDETDAIE

SEQ ID NO: 1929485 - protein, 9 aa, Staphylococcus
DGSDRAKER

SEQ ID NO: 1929486 - protein, 8 aa, Staphylococcus
DGSDSSIV

SEQ ID NO: 1929487 - protein, 8 aa, Staphylococcus
DGSEFDRD

SEQ ID NO: 1929488 - protein, 7 aa, Staphylococcus
DGSETDK

SEQ ID NO: 1929489 - protein, 8 aa, Staphylococcus
DGSEYGEL

SEQ ID NO: 1929490 - protein, 16 aa, Staphylococcus
DGSFSRLEGTSTTSLD

SEQ ID NO: 1929491 - protein, 7 aa, Staphylococcus
DGSGGAL

SEQ ID NO: 1929492 - protein, 7 aa, Staphylococcus
DGSGGGL

SEQ ID NO: 1929493 - protein, 8 aa, Staphylococcus
DGSHAGKM

SEQ ID NO: 1929494 - protein, 7 aa, Staphylococcus
DGSISNK

SEQ ID NO: 1929495 - protein, 11 aa, Staphylococcus
DGSKDNSKNLL

SEQ ID NO: 1929496 - protein, 14 aa, Staphylococcus
DGSKELVFENGNWA

SEQ ID NO: 1929497 - protein, 13 aa, Staphylococcus
DGSKELVFKNGNW

SEQ ID NO: 1929498 - protein, 7 aa, Staphylococcus
DGSKGVR

SEQ ID NO: 1929499 - protein, 6 aa, Staphylococcus
DGSKIY

SEQ ID NO: 1929500 - protein, 8 aa, Staphylococcus
DGSLASNN

SEQ ID NO: 1929501 - protein, 12 aa, Staphylococcus
DGSLDYDDEVSA

SEQ ID NO: 1929502 - protein, 10 aa, Staphylococcus
DGSLHAPQGR

SEQ ID NO: 1929503 - protein, 7 aa, Staphylococcus
DGSLNNK

SEQ ID NO: 1929504 - protein, 24 aa, Staphylococcus
DGSLPQPVSSSSLITDEEKKYFEQ

SEQ ID NO: 1929505 - protein, 24 aa, Staphylococcus
DGSLSDKIVDSNNKSLDKTYNQTV

SEQ ID NO: 1929506 - protein, 8 aa, Staphylococcus
DGSLSNKI

SEQ ID NO: 1929507 - protein, 19 aa, Staphylococcus
DGSLSNKIVENNDNSLDKV

SEQ ID NO: 1929508 - protein, 19 aa, Staphylococcus
DGSLTSKVVDTDDKSLQKV

SEQ ID NO: 1929509 - protein, 8 aa, Staphylococcus
DGSLYTGY

SEQ ID NO: 1929510 - protein, 12 aa, Staphylococcus
DGSMAKGEDLQA

SEQ ID NO: 1929511 - protein, 19 aa, Staphylococcus
DGSMPQPISSSSLISDDEK

SEQ ID NO: 1929512 - protein, 7 aa, Staphylococcus
DGSNFDA

SEQ ID NO: 1929513 - protein, 9 aa, Staphylococcus
DGSNKAYQA

SEQ ID NO: 1929514 - protein, 10 aa, Staphylococcus
DGSQKAYEQG

SEQ ID NO: 1929515 - protein, 9 aa, Staphylococcus
DGSRTDEKP

SEQ ID NO: 1929516 - protein, 16 aa, Staphylococcus
DGSRTYHTGDKAKEDG

SEQ ID NO: 1929517 - protein, 5 aa, Staphylococcus
DGSSY

SEQ ID NO: 1929518 - protein, 8 aa, Staphylococcus
DGSTDATH

SEQ ID NO: 1929519 - protein, 10 aa, Staphylococcus
DGSTDDSKIE

SEQ ID NO: 1929520 - protein, 10 aa, Staphylococcus
DGSTDHSRHE

SEQ ID NO: 1929521 - protein, 9 aa, Staphylococcus
DGSTDHSTQ

SEQ ID NO: 1929522 - protein, 11 aa, Staphylococcus
DGSTDHTKHEL

SEQ ID NO: 1929523 - protein, 8 aa, Staphylococcus
DGSTDHTL

SEQ ID NO: 1929524 - protein, 10 aa, Staphylococcus
DGSTDNSEEI

SEQ ID NO: 1929525 - protein, 10 aa, Staphylococcus
DGSTDNSEQL

SEQ ID NO: 1929526 - protein, 9 aa, Staphylococcus
DGSTDNTKR

SEQ ID NO: 1929527 - protein, 12 aa, Staphylococcus
DGSTDQSKPLAT

SEQ ID NO: 1929528 - protein, 9 aa, Staphylococcus
DGSTDQTEA

SEQ ID NO: 1929529 - protein, 10 aa, Staphylococcus
DGSTDRSTEI

SEQ ID NO: 1929530 - protein, 9 aa, Staphylococcus
DGSTDRTKQ

SEQ ID NO: 1929531 - protein, 9 aa, Staphylococcus
DGSTDSTAQ

SEQ ID NO: 1929532 - protein, 11 aa, Staphylococcus
DGSTEAEQSGT

SEQ ID NO: 1929533 - protein, 4 aa, Staphylococcus
DGSV

SEQ ID NO: 1929534 - protein, 10 aa, Staphylococcus
DGSVEEGDTV

SEQ ID NO: 1929535 - protein, 8 aa, Staphylococcus
DGSVENSD

SEQ ID NO: 1929536 - protein, 11 aa, Staphylococcus
DGSVGSGFDLP

SEQ ID NO: 1929537 - protein, 19 aa, Staphylococcus
DGSVGSGFDLPDKKCPECG

SEQ ID NO: 1929538 - protein, 19 aa, Staphylococcus
DGSVGSGFDLPDKKCPTCG

SEQ ID NO: 1929539 - protein, 18 aa, Staphylococcus
DGSVGSGFDLPDKQCSTC

SEQ ID NO: 1929540 - protein, 18 aa, Staphylococcus
DGSVKNDLQQLTTKFKRS

SEQ ID NO: 1929541 - protein, 7 aa, Staphylococcus
DGSYLSS

SEQ ID NO: 1929542 - protein, 5 aa, Staphylococcus
DGSYT

SEQ ID NO: 1929543 - protein, 9 aa, Staphylococcus
DGSYTARSE

SEQ ID NO: 1929544 - protein, 9 aa, Staphylococcus
DGSYTERSR

SEQ ID NO: 1929545 - protein, 8 aa, Staphylococcus
DGSYTGKA

SEQ ID NO: 1929546 - protein, 4 aa, Staphylococcus
DGTD

SEQ ID NO: 1929547 - protein, 4 aa, Staphylococcus
DGTF

SEQ ID NO: 1929548 - protein, 4 aa, Staphylococcus
DGTG

SEQ ID NO: 1929549 - protein, 6 aa, Staphylococcus
DGTGAA

SEQ ID NO: 1929550 - protein, 6 aa, Staphylococcus
DGTGGA

SEQ ID NO: 1929551 - protein, 8 aa, Staphylococcus
DGTGIVKA

SEQ ID NO: 1929552 - protein, 8 aa, Staphylococcus
DGTGTSLA

SEQ ID NO: 1929553 - protein, 8 aa, Staphylococcus
DGTGVVKA

SEQ ID NO: 1929554 - protein, 7 aa, Staphylococcus
DGTHDTI

SEQ ID NO: 1929555 - protein, 11 aa, Staphylococcus
DGTHQTPRYTK

SEQ ID NO: 1929556 - protein, 7 aa, Staphylococcus
DGTINLD

SEQ ID NO: 1929557 - protein, 7 aa, Staphylococcus
DGTISET

SEQ ID NO: 1929558 - protein, 10 aa, Staphylococcus
DGTKAPAAHG

SEQ ID NO: 1929559 - protein, 5 aa, Staphylococcus
DGTKE

SEQ ID NO: 1929560 - protein, 14 aa, Staphylococcus
DGTKELVFENGNWA

SEQ ID NO: 1929561 - protein, 11 aa, Staphylococcus
DGTKFGKTAGG

SEQ ID NO: 1929562 - protein, 6 aa, Staphylococcus
DGTKTL

SEQ ID NO: 1929563 - protein, 8 aa, Staphylococcus
DGTLDPVV

SEQ ID NO: 1929564 - protein, 6 aa, Staphylococcus
DGTLHP

SEQ ID NO: 1929565 - protein, 12 aa, Staphylococcus
DGTLQPGDPVPS

SEQ ID NO: 1929566 - protein, 5 aa, Staphylococcus
DGTLY

SEQ ID NO: 1929567 - protein, 11 aa, Staphylococcus
DGTMAKGASLE

SEQ ID NO: 1929568 - protein, 10 aa, Staphylococcus
DGTMAKGEQL

SEQ ID NO: 1929569 - protein, 13 aa, Staphylococcus
DGTMAKGEQLQSF

SEQ ID NO: 1929570 - protein, 12 aa, Staphylococcus
DGTMAKGNELQQ

SEQ ID NO: 1929571 - protein, 11 aa, Staphylococcus
DGTMARGEDLQ

SEQ ID NO: 1929572 - protein, 10 aa, Staphylococcus
DGTMPQAISN

SEQ ID NO: 1929573 - protein, 9 aa, Staphylococcus
DGTNENKQR

SEQ ID NO: 1929574 - protein, 5 aa, Staphylococcus
DGTNI

SEQ ID NO: 1929575 - protein, 5 aa, Staphylococcus
DGTQI

SEQ ID NO: 1929576 - protein, 10 aa, Staphylococcus
DGTRAEEEIA

SEQ ID NO: 1929577 - protein, 10 aa, Staphylococcus
DGTRPGSGNH

SEQ ID NO: 1929578 - protein, 8 aa, Staphylococcus
DGTRPVNF

SEQ ID NO: 1929579 - protein, 9 aa, Staphylococcus
DGTRVTKKG

SEQ ID NO: 1929580 - protein, 18 aa, Staphylococcus
DGTSIRLTGQDSERGTFS

SEQ ID NO: 1929581 - protein, 15 aa, Staphylococcus
DGTSMSREELSSEGL

SEQ ID NO: 1929582 - protein, 12 aa, Staphylococcus
DGTSNKGKLGAN

SEQ ID NO: 1929583 - protein, 6 aa, Staphylococcus
DGTTLE

SEQ ID NO: 1929584 - protein, 5 aa, Staphylococcus
DGTTN

SEQ ID NO: 1929585 - protein, 6 aa, Staphylococcus
DGTTNL

SEQ ID NO: 1929586 - protein, 6 aa, Staphylococcus
DGTTTV

SEQ ID NO: 1929587 - protein, 4 aa, Staphylococcus
DGTV

SEQ ID NO: 1929588 - protein, 7 aa, Staphylococcus
DGTVEGL

SEQ ID NO: 1929589 - protein, 6 aa, Staphylococcus
DGTVNE

SEQ ID NO: 1929590 - protein, 11 aa, Staphylococcus
DGTVQTETGNP

SEQ ID NO: 1929591 - protein, 7 aa, Staphylococcus
DGTVRNY

SEQ ID NO: 1929592 - protein, 6 aa, Staphylococcus
DGTVTD

SEQ ID NO: 1929593 - protein, 6 aa, Staphylococcus
DGTVTE

SEQ ID NO: 1929594 - protein, 9 aa, Staphylococcus
DGTWRTEEV

SEQ ID NO: 1929595 - protein, 5 aa, Staphylococcus
DGTYF

SEQ ID NO: 1929596 - protein, 6 aa, Staphylococcus
DGTYLE

SEQ ID NO: 1929597 - protein, 17 aa, Staphylococcus
DGTYRNPSTAKGINTKE

SEQ ID NO: 1929598 - protein, 5 aa, Staphylococcus
DGTYS

SEQ ID NO: 1929599 - protein, 13 aa, Staphylococcus
DGTYSDEMKGIYY

SEQ ID NO: 1929600 - protein, 13 aa, Staphylococcus
DGTYSKEMKGIYY

SEQ ID NO: 1929601 - protein, 13 aa, Staphylococcus
DGTYTEEMREIYY

SEQ ID NO: 1929602 - protein, 6 aa, Staphylococcus
DGTYTY

SEQ ID NO: 1929603 - protein, 12 aa, Staphylococcus
DGVCSDEDTIRK

SEQ ID NO: 1929604 - protein, 4 aa, Staphylococcus
DGVD

SEQ ID NO: 1929605 - protein, 5 aa, Staphylococcus
DGVEE

SEQ ID NO: 1929606 - protein, 6 aa, Staphylococcus
DGVGVQ

SEQ ID NO: 1929607 - protein, 4 aa, Staphylococcus
DGVL

SEQ ID NO: 1929608 - protein, 9 aa, Staphylococcus
DGVLPQTVT

SEQ ID NO: 1929609 - protein, 4 aa, Staphylococcus
DGVR

SEQ ID NO: 1929610 - protein, 11 aa, Staphylococcus
DGVSERGGHPV

SEQ ID NO: 1929611 - protein, 10 aa, Staphylococcus
DGVSERGGYP

SEQ ID NO: 1929612 - protein, 13 aa, Staphylococcus
DGVSTADVSLEAG

SEQ ID NO: 1929613 - protein, 11 aa, Staphylococcus
DGVVATQTTYP

SEQ ID NO: 1929614 - protein, 5 aa, Staphylococcus
DGYDE

SEQ ID NO: 1929615 - protein, 10 aa, Staphylococcus
DGYDEGNISK

SEQ ID NO: 1929616 - protein, 8 aa, Staphylococcus
DGYEEGRA

SEQ ID NO: 1929617 - protein, 7 aa, Staphylococcus
DGYEESN

SEQ ID NO: 1929618 - protein, 5 aa, Staphylococcus
DGYGK

SEQ ID NO: 1929619 - protein, 21 aa, Staphylococcus
DGYGNLSSVNDDANKLNKNSN

SEQ ID NO: 1929620 - protein, 30 aa, Staphylococcus
DGYKEGDAIPIATKQAEEWYKDASKEELEE

SEQ ID NO: 1929621 - protein, 7 aa, Staphylococcus
DGYKESD

SEQ ID NO: 1929622 - protein, 11 aa, Staphylococcus
DGYKSLEEGQN

SEQ ID NO: 1929623 - protein, 5 aa, Staphylococcus
DGYNA

SEQ ID NO: 1929624 - protein, 12 aa, Staphylococcus
DGYNINNQGRKR

SEQ ID NO: 1929625 - protein, 4 aa, Staphylococcus
DGYP

SEQ ID NO: 1929626 - protein, 6 aa, Staphylococcus
DGYPYG

SEQ ID NO: 1929627 - protein, 8 aa, Staphylococcus
DGYRPGDF

SEQ ID NO: 1929628 - protein, 13 aa, Staphylococcus
DGYRVETRNGAYY

SEQ ID NO: 1929629 - protein, 9 aa, Staphylococcus
DGYSADDAF

SEQ ID NO: 1929630 - protein, 7 aa, Staphylococcus
DGYSTGG

SEQ ID NO: 1929631 - protein, 8 aa, Staphylococcus
DGYSTGGS

SEQ ID NO: 1929632 - protein, 4 aa, Staphylococcus
DGYT

SEQ ID NO: 1929633 - protein, 5 aa, Staphylococcus
DGYTF

SEQ ID NO: 1929634 - protein, 12 aa, Staphylococcus
DGYTKEEQKMID

SEQ ID NO: 1929635 - protein, 14 aa, Staphylococcus
DGYTYKGNPNECEN

SEQ ID NO: 1929636 - protein, 9 aa, Staphylococcus
DHAAKPELA

SEQ ID NO: 1929637 - protein, 5 aa, Staphylococcus
DHAGL

SEQ ID NO: 1929638 - protein, 5 aa, Staphylococcus
DHAKD

SEQ ID NO: 1929639 - protein, 9 aa, Staphylococcus
DHAKEETEK

SEQ ID NO: 1929640 - protein, 14 aa, Staphylococcus
DHDDINVSQLAQAE

SEQ ID NO: 1929641 - protein, 12 aa, Staphylococcus
DHDGNITANAGN

SEQ ID NO: 1929642 - protein, 12 aa, Staphylococcus
DHDNNNRPFTYQ

SEQ ID NO: 1929643 - protein, 4 aa, Staphylococcus
DHDS

SEQ ID NO: 1929644 - protein, 5 aa, Staphylococcus
DHDSI

SEQ ID NO: 1929645 - protein, 9 aa, Staphylococcus
DHDTQAIAK

SEQ ID NO: 1929646 - protein, 13 aa, Staphylococcus
DHDYGTAADGTYY

SEQ ID NO: 1929647 - protein, 7 aa, Staphylococcus
DHEATAE

SEQ ID NO: 1929648 - protein, 15 aa, Staphylococcus
DHEDTLRTHHKKRFG

SEQ ID NO: 1929649 - protein, 5 aa, Staphylococcus
DHEDV

SEQ ID NO: 1929650 - protein, 26 aa, Staphylococcus
DHEKQQNEETLNELKDKQKHLNKEVQ

SEQ ID NO: 1929651 - protein, 5 aa, Staphylococcus
DHEPI

SEQ ID NO: 1929652 - protein, 4 aa, Staphylococcus
DHEQ

SEQ ID NO: 1929653 - protein, 8 aa, Staphylococcus
DHEQGPSF

SEQ ID NO: 1929654 - protein, 10 aa, Staphylococcus
DHEQNKSDKK

SEQ ID NO: 1929655 - protein, 9 aa, Staphylococcus
DHEQNNQPH

SEQ ID NO: 1929656 - protein, 5 aa, Staphylococcus
DHEQS

SEQ ID NO: 1929657 - protein, 9 aa, Staphylococcus
DHERYQDEQ

SEQ ID NO: 1929658 - protein, 4 aa, Staphylococcus
DHES

SEQ ID NO: 1929659 - protein, 12 aa, Staphylococcus
DHESAPEGVCVL

SEQ ID NO: 1929660 - protein, 7 aa, Staphylococcus
DHEVEGS

SEQ ID NO: 1929661 - protein, 7 aa, Staphylococcus
DHEYRDI

SEQ ID NO: 1929662 - protein, 8 aa, Staphylococcus
DHFAEGDA

SEQ ID NO: 1929663 - protein, 4 aa, Staphylococcus
DHFG

SEQ ID NO: 1929664 - protein, 11 aa, Staphylococcus
DHFGDNEKPTG

SEQ ID NO: 1929665 - protein, 4 aa, Staphylococcus
DHGA

SEQ ID NO: 1929666 - protein, 6 aa, Staphylococcus
DHGAEA

SEQ ID NO: 1929667 - protein, 17 aa, Staphylococcus
DHGANRRVEQIDVQVTE

SEQ ID NO: 1929668 - protein, 22 aa, Staphylococcus
DHGATTYDFGGTDNNPDKESDH

SEQ ID NO: 1929669 - protein, 7 aa, Staphylococcus
DHGESLT

SEQ ID NO: 1929670 - protein, 5 aa, Staphylococcus
DHGGK

SEQ ID NO: 1929671 - protein, 6 aa, Staphylococcus
DHGGKA

SEQ ID NO: 1929672 - protein, 8 aa, Staphylococcus
DHGGRTKS

SEQ ID NO: 1929673 - protein, 6 aa, Staphylococcus
DHGGSA

SEQ ID NO: 1929674 - protein, 6 aa, Staphylococcus
DHGGTA

SEQ ID NO: 1929675 - protein, 12 aa, Staphylococcus
DHGKSIKKPLSE

SEQ ID NO: 1929676 - protein, 24 aa, Staphylococcus
DHGNSDEVLTDDDQPMTTHTTNPV

SEQ ID NO: 1929677 - protein, 4 aa, Staphylococcus
DHGR

SEQ ID NO: 1929678 - protein, 11 aa, Staphylococcus
DHGRGISKKDL

SEQ ID NO: 1929679 - protein, 4 aa, Staphylococcus
DHGS

SEQ ID NO: 1929680 - protein, 6 aa, Staphylococcus
DHGSNG

SEQ ID NO: 1929681 - protein, 4 aa, Staphylococcus
DHHR

SEQ ID NO: 1929682 - protein, 5 aa, Staphylococcus
DHKET

SEQ ID NO: 1929683 - protein, 13 aa, Staphylococcus
DHKGASRADSGEI

SEQ ID NO: 1929684 - protein, 10 aa, Staphylococcus
DHKGSLAIGK

SEQ ID NO: 1929685 - protein, 5 aa, Staphylococcus
DHKMA

SEQ ID NO: 1929686 - protein, 4 aa, Staphylococcus
DHLD

SEQ ID NO: 1929687 - protein, 5 aa, Staphylococcus
DHLKE

SEQ ID NO: 1929688 - protein, 12 aa, Staphylococcus
DHLRGDAEGRYG

SEQ ID NO: 1929689 - protein, 12 aa, Staphylococcus
DHLSTDEQETRK

SEQ ID NO: 1929690 - protein, 4 aa, Staphylococcus
DHNE

SEQ ID NO: 1929691 - protein, 11 aa, Staphylococcus
DHNEVETGEIG

SEQ ID NO: 1929692 - protein, 4 aa, Staphylococcus
DHPD

SEQ ID NO: 1929693 - protein, 7 aa, Staphylococcus
DHPDRAQ

SEQ ID NO: 1929694 - protein, 11 aa, Staphylococcus
DHPEKREDHYN

SEQ ID NO: 1929695 - protein, 24 aa, Staphylococcus
DHPEYKTTDSPTVRVGGEAQSSFE

SEQ ID NO: 1929696 - protein, 5 aa, Staphylococcus
DHPIT

SEQ ID NO: 1929697 - protein, 9 aa, Staphylococcus
DHPKNQIDE

SEQ ID NO: 1929698 - protein, 8 aa, Staphylococcus
DHPLNQST

SEQ ID NO: 1929699 - protein, 12 aa, Staphylococcus
DHPLTPLPDSVE

SEQ ID NO: 1929700 - protein, 5 aa, Staphylococcus
DHPNN

SEQ ID NO: 1929701 - protein, 7 aa, Staphylococcus
DHPPLGM

SEQ ID NO: 1929702 - protein, 7 aa, Staphylococcus
DHPTSVQ

SEQ ID NO: 1929703 - protein, 6 aa, Staphylococcus
DHPYNL

SEQ ID NO: 1929704 - protein, 13 aa, Staphylococcus
DHQDEKESRFANE

SEQ ID NO: 1929705 - protein, 8 aa, Staphylococcus
DHQGYDST

SEQ ID NO: 1929706 - protein, 9 aa, Staphylococcus
DHQGYEQTK

SEQ ID NO: 1929707 - protein, 7 aa, Staphylococcus
DHQSKDN

SEQ ID NO: 1929708 - protein, 9 aa, Staphylococcus
DHQSSSVGA

SEQ ID NO: 1929709 - protein, 15 aa, Staphylococcus
DHRAPRRDFQPETFK

SEQ ID NO: 1929710 - protein, 5 aa, Staphylococcus
DHRDH

SEQ ID NO: 1929711 - protein, 8 aa, Staphylococcus
DHRLPSDE

SEQ ID NO: 1929712 - protein, 9 aa, Staphylococcus
DHRPSTVGG

SEQ ID NO: 1929713 - protein, 7 aa, Staphylococcus
DHRRPSE

SEQ ID NO: 1929714 - protein, 11 aa, Staphylococcus
DHRTNEETAKV

SEQ ID NO: 1929715 - protein, 12 aa, Staphylococcus
DHRTNEETGKVD

SEQ ID NO: 1929716 - protein, 6 aa, Staphylococcus
DHSAYA

SEQ ID NO: 1929717 - protein, 4 aa, Staphylococcus
DHSE

SEQ ID NO: 1929718 - protein, 6 aa, Staphylococcus
DHSEGI

SEQ ID NO: 1929719 - protein, 7 aa, Staphylococcus
DHSGYAN

SEQ ID NO: 1929720 - protein, 10 aa, Staphylococcus
DHSHQDENLA

SEQ ID NO: 1929721 - protein, 16 aa, Staphylococcus
DHSPCTPELKDTDDAF

SEQ ID NO: 1929722 - protein, 6 aa, Staphylococcus
DHTGAI

SEQ ID NO: 1929723 - protein, 6 aa, Staphylococcus
DHTKLG

SEQ ID NO: 1929724 - protein, 12 aa, Staphylococcus
DHTKNGQLKPGY

SEQ ID NO: 1929725 - protein, 8 aa, Staphylococcus
DHTNNPSR

SEQ ID NO: 1929726 - protein, 7 aa, Staphylococcus
DHTQTGQ

SEQ ID NO: 1929727 - protein, 4 aa, Staphylococcus
DHTT

SEQ ID NO: 1929728 - protein, 6 aa, Staphylococcus
DHTYSN

SEQ ID NO: 1929729 - protein, 10 aa, Staphylococcus
DHVEKTDNNQ

SEQ ID NO: 1929730 - protein, 12 aa, Staphylococcus
DHVNTDTNWKDG

SEQ ID NO: 1929731 - protein, 5 aa, Staphylococcus
DIAEE

SEQ ID NO: 1929732 - protein, 49 aa, Staphylococcus
DIAEEKKNDSTDEGELTKEDKFVEETKSDPDDNREVEPPKKGFWSRFFG

SEQ ID NO: 1929733 - protein, 49 aa, Staphylococcus
DIAEEKKNDSTDEGELTKEDKFVEETKSGPDDNREVEPPKKGFWSRFFG

SEQ ID NO: 1929734 - protein, 7 aa, Staphylococcus
DIAESDH

SEQ ID NO: 1929735 - protein, 8 aa, Staphylococcus
DIAESDHQ

SEQ ID NO: 1929736 - protein, 7 aa, Staphylococcus
DIAGKKA

SEQ ID NO: 1929737 - protein, 5 aa, Staphylococcus
DIAKE

SEQ ID NO: 1929738 - protein, 9 aa, Staphylococcus
DIANDSEIK

SEQ ID NO: 1929739 - protein, 7 aa, Staphylococcus
DIANGTK

SEQ ID NO: 1929740 - protein, 11 aa, Staphylococcus
DIASDQQDNVD

SEQ ID NO: 1929741 - protein, 7 aa, Staphylococcus
DIASETQ

SEQ ID NO: 1929742 - protein, 19 aa, Staphylococcus
DIDAETKERLTSGYDAATY

SEQ ID NO: 1929743 - protein, 4 aa, Staphylococcus
DIDD

SEQ ID NO: 1929744 - protein, 6 aa, Staphylococcus
DIDEAY

SEQ ID NO: 1929745 - protein, 5 aa, Staphylococcus
DIDEE

SEQ ID NO: 1929746 - protein, 18 aa, Staphylococcus
DIDETSENNEEADSEEKD

SEQ ID NO: 1929747 - protein, 10 aa, Staphylococcus
DIDGAAEAAV

SEQ ID NO: 1929748 - protein, 11 aa, Staphylococcus
DIDGAASAAAN

SEQ ID NO: 1929749 - protein, 6 aa, Staphylococcus
DIDGNE

SEQ ID NO: 1929750 - protein, 7 aa, Staphylococcus
DIDGTGH

SEQ ID NO: 1929751 - protein, 4 aa, Staphylococcus
DIDH

SEQ ID NO: 1929752 - protein, 4 aa, Staphylococcus
DIDK

SEQ ID NO: 1929753 - protein, 6 aa, Staphylococcus
DIDNAY

SEQ ID NO: 1929754 - protein, 6 aa, Staphylococcus
DIDNKE

SEQ ID NO: 1929755 - protein, 11 aa, Staphylococcus
DIDPKRRGETL

SEQ ID NO: 1929756 - protein, 11 aa, Staphylococcus
DIDPNRIRDTG

SEQ ID NO: 1929757 - protein, 6 aa, Staphylococcus
DIDPNS

SEQ ID NO: 1929758 - protein, 16 aa, Staphylococcus
DIDPRETTGKYLSPSE

SEQ ID NO: 1929759 - protein, 9 aa, Staphylococcus
DIDSDEEKK

SEQ ID NO: 1929760 - protein, 9 aa, Staphylococcus
DIDSRHEYN

SEQ ID NO: 1929761 - protein, 6 aa, Staphylococcus
DIDSTD

SEQ ID NO: 1929762 - protein, 4 aa, Staphylococcus
DIDT

SEQ ID NO: 1929763 - protein, 6 aa, Staphylococcus
DIDTDK

SEQ ID NO: 1929764 - protein, 5 aa, Staphylococcus
DIDTE

SEQ ID NO: 1929765 - protein, 18 aa, Staphylococcus
DIDTEEPTEDLTGENEAS

SEQ ID NO: 1929766 - protein, 6 aa, Staphylococcus
DIDTEL

SEQ ID NO: 1929767 - protein, 5 aa, Staphylococcus
DIDTQ

SEQ ID NO: 1929768 - protein, 6 aa, Staphylococcus
DIDVPY

SEQ ID NO: 1929769 - protein, 5 aa, Staphylococcus
DIDYG

SEQ ID NO: 1929770 - protein, 4 aa, Staphylococcus
DIEA

SEQ ID NO: 1929771 - protein, 11 aa, Staphylococcus
DIEAAVDGTIA

SEQ ID NO: 1929772 - protein, 6 aa, Staphylococcus
DIEANG

SEQ ID NO: 1929773 - protein, 11 aa, Staphylococcus
DIEDDDNVGSM

SEQ ID NO: 1929774 - protein, 6 aa, Staphylococcus
DIEDIP

SEQ ID NO: 1929775 - protein, 6 aa, Staphylococcus
DIEEGN

SEQ ID NO: 1929776 - protein, 5 aa, Staphylococcus
DIEEI

SEQ ID NO: 1929777 - protein, 23 aa, Staphylococcus
DIEEKDEKQAEAEKNENTNLFDE

SEQ ID NO: 1929778 - protein, 5 aa, Staphylococcus
DIEGF

SEQ ID NO: 1929779 - protein, 5 aa, Staphylococcus
DIEGK

SEQ ID NO: 1929780 - protein, 25 aa, Staphylococcus
DIEGKTGTAQVADEKSGGYVKGENP

SEQ ID NO: 1929781 - protein, 25 aa, Staphylococcus
DIEGKTGTAQVADEKSGGYVKGPNP

SEQ ID NO: 1929782 - protein, 25 aa, Staphylococcus
DIEGKTGTAQVADSEGGGYVKGENP

SEQ ID NO: 1929783 - protein, 25 aa, Staphylococcus
DIEGKTGTAQVADSNGGGYVKGENP

SEQ ID NO: 1929784 - protein, 5 aa, Staphylococcus
DIEGT

SEQ ID NO: 1929785 - protein, 7 aa, Staphylococcus
DIEGTGH

SEQ ID NO: 1929786 - protein, 5 aa, Staphylococcus
DIEHP

SEQ ID NO: 1929787 - protein, 5 aa, Staphylococcus
DIEHS

SEQ ID NO: 1929788 - protein, 6 aa, Staphylococcus
DIEHSS

SEQ ID NO: 1929789 - protein, 11 aa, Staphylococcus
DIEINQGHPET

SEQ ID NO: 1929790 - protein, 6 aa, Staphylococcus
DIEKDS

SEQ ID NO: 1929791 - protein, 5 aa, Staphylococcus
DIEKE

SEQ ID NO: 1929792 - protein, 13 aa, Staphylococcus
DIEKPSKQSVSEL

SEQ ID NO: 1929793 - protein, 44 aa, Staphylococcus
DIEKRPDNKKAYNKKDNLQQQLDANQQKIDEAKNLQQEHGNELP

SEQ ID NO: 1929794 - protein, 44 aa, Staphylococcus
DIEKRPENKKSHNKKANLEQQLAANQQKIDEAQQLQAEHGNELP

SEQ ID NO: 1929795 - protein, 6 aa, Staphylococcus
DIEKVK

SEQ ID NO: 1929796 - protein, 4 aa, Staphylococcus
DIEN

SEQ ID NO: 1929797 - protein, 5 aa, Staphylococcus
DIENP

SEQ ID NO: 1929798 - protein, 12 aa, Staphylococcus
DIENSKKPITKD

SEQ ID NO: 1929799 - protein, 6 aa, Staphylococcus
DIEPND

SEQ ID NO: 1929800 - protein, 16 aa, Staphylococcus
DIEPPAETEAQREEYL

SEQ ID NO: 1929801 - protein, 8 aa, Staphylococcus
DIEPQNQA

SEQ ID NO: 1929802 - protein, 4 aa, Staphylococcus
DIEQ

SEQ ID NO: 1929803 - protein, 8 aa, Staphylococcus
DIEQDESS

SEQ ID NO: 1929804 - protein, 5 aa, Staphylococcus
DIEQL

SEQ ID NO: 1929805 - protein, 23 aa, Staphylococcus
DIEQNNSNGNNENLKENEINQNS

SEQ ID NO: 1929806 - protein, 5 aa, Staphylococcus
DIEQP

SEQ ID NO: 1929807 - protein, 8 aa, Staphylococcus
DIEQSLKN

SEQ ID NO: 1929808 - protein, 11 aa, Staphylococcus
DIERDEDDKSY

SEQ ID NO: 1929809 - protein, 11 aa, Staphylococcus
DIEREEDDKGY

SEQ ID NO: 1929810 - protein, 11 aa, Staphylococcus
DIEREEDDKQY

SEQ ID NO: 1929811 - protein, 56 aa, Staphylococcus
DIEREKTKDLGEGKHLTAEDGKEKVKSQPIVKGDQVGRNDPCPCGSGKKYKNCHGQ

SEQ ID NO: 1929812 - protein, 5 aa, Staphylococcus
DIERN

SEQ ID NO: 1929813 - protein, 4 aa, Staphylococcus
DIES

SEQ ID NO: 1929814 - protein, 6 aa, Staphylococcus
DIESDD

SEQ ID NO: 1929815 - protein, 5 aa, Staphylococcus
DIESE

SEQ ID NO: 1929816 - protein, 6 aa, Staphylococcus
DIESGA

SEQ ID NO: 1929817 - protein, 4 aa, Staphylococcus
DIET

SEQ ID NO: 1929818 - protein, 6 aa, Staphylococcus
DIETDK

SEQ ID NO: 1929819 - protein, 5 aa, Staphylococcus
DIETE

SEQ ID NO: 1929820 - protein, 8 aa, Staphylococcus
DIETNRED

SEQ ID NO: 1929821 - protein, 9 aa, Staphylococcus
DIETPDKAM

SEQ ID NO: 1929822 - protein, 9 aa, Staphylococcus
DIETREKQE

SEQ ID NO: 1929823 - protein, 4 aa, Staphylococcus
DIFT

SEQ ID NO: 1929824 - protein, 7 aa, Staphylococcus
DIGETYK

SEQ ID NO: 1929825 - protein, 9 aa, Staphylococcus
DIGKAQRVA

SEQ ID NO: 1929826 - protein, 11 aa, Staphylococcus
DIGPKAKGLDT

SEQ ID NO: 1929827 - protein, 5 aa, Staphylococcus
DIGQA

SEQ ID NO: 1929828 - protein, 6 aa, Staphylococcus
DIGTGS

SEQ ID NO: 1929829 - protein, 5 aa, Staphylococcus
DIGTP

SEQ ID NO: 1929830 - protein, 15 aa, Staphylococcus
DIGTPLPLKEAEDNE

SEQ ID NO: 1929831 - protein, 5 aa, Staphylococcus
DIIEN

SEQ ID NO: 1929832 - protein, 13 aa, Staphylococcus
DIIPNSKKIHASS

SEQ ID NO: 1929833 - protein, 19 aa, Staphylococcus
DIIQTNDDPSYKNNIGRAS

SEQ ID NO: 1929834 - protein, 4 aa, Staphylococcus
DIIS

SEQ ID NO: 1929835 - protein, 5 aa, Staphylococcus
DIISA

SEQ ID NO: 1929836 - protein, 7 aa, Staphylococcus
DIISGEG

SEQ ID NO: 1929837 - protein, 10 aa, Staphylococcus
DIKDARAKVE

SEQ ID NO: 1929838 - protein, 8 aa, Staphylococcus
DIKDGKQL

SEQ ID NO: 1929839 - protein, 7 aa, Staphylococcus
DIKDNDY

SEQ ID NO: 1929840 - protein, 23 aa, Staphylococcus
DIKEAAKATTGKVVNNTGQVCTA

SEQ ID NO: 1929841 - protein, 8 aa, Staphylococcus
DIKEDAKK

SEQ ID NO: 1929842 - protein, 8 aa, Staphylococcus
DIKEKQGV

SEQ ID NO: 1929843 - protein, 7 aa, Staphylococcus
DIKEPQS

SEQ ID NO: 1929844 - protein, 8 aa, Staphylococcus
DIKESGPI

SEQ ID NO: 1929845 - protein, 11 aa, Staphylococcus
DIKGAGTSTIK

SEQ ID NO: 1929846 - protein, 5 aa, Staphylococcus
DIKGY

SEQ ID NO: 1929847 - protein, 6 aa, Staphylococcus
DIKKEA

SEQ ID NO: 1929848 - protein, 4 aa, Staphylococcus
DIKN

SEQ ID NO: 1929849 - protein, 8 aa, Staphylococcus
DIKNKYSQ

SEQ ID NO: 1929850 - protein, 4 aa, Staphylococcus
DIKP

SEQ ID NO: 1929851 - protein, 7 aa, Staphylococcus
DIKPELT

SEQ ID NO: 1929852 - protein, 5 aa, Staphylococcus
DIKPG

SEQ ID NO: 1929853 - protein, 9 aa, Staphylococcus
DIKPKDIKK

SEQ ID NO: 1929854 - protein, 19 aa, Staphylococcus
DIKQNQDKQITQQQVEDTV

SEQ ID NO: 1929855 - protein, 5 aa, Staphylococcus
DIKRQ

SEQ ID NO: 1929856 - protein, 5 aa, Staphylococcus
DIKSE

SEQ ID NO: 1929857 - protein, 6 aa, Staphylococcus
DIKTKK

SEQ ID NO: 1929858 - protein, 5 aa, Staphylococcus
DILDE

SEQ ID NO: 1929859 - protein, 21 aa, Staphylococcus
DILPKNEEEIAQRREKAKAVV

SEQ ID NO: 1929860 - protein, 11 aa, Staphylococcus
DIMPREDEDIV

SEQ ID NO: 1929861 - protein, 4 aa, Staphylococcus
DINA

SEQ ID NO: 1929862 - protein, 6 aa, Staphylococcus
DINDLK

SEQ ID NO: 1929863 - protein, 8 aa, Staphylococcus
DINDNDDL

SEQ ID NO: 1929864 - protein, 9 aa, Staphylococcus
DINDQTANR

SEQ ID NO: 1929865 - protein, 8 aa, Staphylococcus
DINEEHEQ

SEQ ID NO: 1929866 - protein, 6 aa, Staphylococcus
DINENT

SEQ ID NO: 1929867 - protein, 6 aa, Staphylococcus
DINETA

SEQ ID NO: 1929868 - protein, 15 aa, Staphylococcus
DINETEQKLLKQFEG

SEQ ID NO: 1929869 - protein, 4 aa, Staphylococcus
DINF

SEQ ID NO: 1929870 - protein, 27 aa, Staphylococcus
DINKAVKDIEKRPENKKAYNKKENLEQ

SEQ ID NO: 1929871 - protein, 8 aa, Staphylococcus
DINKTENV

SEQ ID NO: 1929872 - protein, 12 aa, Staphylococcus
DINNKKDLKNSE

SEQ ID NO: 1929873 - protein, 8 aa, Staphylococcus
DINNSKIS

SEQ ID NO: 1929874 - protein, 14 aa, Staphylococcus
DINPDDTKETLEER

SEQ ID NO: 1929875 - protein, 7 aa, Staphylococcus
DINPETK

SEQ ID NO: 1929876 - protein, 10 aa, Staphylococcus
DINPLTEKND

SEQ ID NO: 1929877 - protein, 5 aa, Staphylococcus
DINPQ

SEQ ID NO: 1929878 - protein, 7 aa, Staphylococcus
DINQAEP

SEQ ID NO: 1929879 - protein, 15 aa, Staphylococcus
DINQDEVKKWSAEDA

SEQ ID NO: 1929880 - protein, 12 aa, Staphylococcus
DINSLKRKWHSH

SEQ ID NO: 1929881 - protein, 4 aa, Staphylococcus
DINT

SEQ ID NO: 1929882 - protein, 21 aa, Staphylococcus
DINTKESFKASIERSDSCAVP

SEQ ID NO: 1929883 - protein, 7 aa, Staphylococcus
DINTKNE

SEQ ID NO: 1929884 - protein, 17 aa, Staphylococcus
DINTQGYDELEPAGHLN

SEQ ID NO: 1929885 - protein, 8 aa, Staphylococcus
DINTSRIS

SEQ ID NO: 1929886 - protein, 14 aa, Staphylococcus
DIPADQEAMDIGPK

SEQ ID NO: 1929887 - protein, 15 aa, Staphylococcus
DIPADQEAMDIGPKS

SEQ ID NO: 1929888 - protein, 5 aa, Staphylococcus
DIPAG

SEQ ID NO: 1929889 - protein, 8 aa, Staphylococcus
DIPDAKDN

SEQ ID NO: 1929890 - protein, 9 aa, Staphylococcus
DIPDRQKGL

SEQ ID NO: 1929891 - protein, 9 aa, Staphylococcus
DIPDRQTGL

SEQ ID NO: 1929892 - protein, 4 aa, Staphylococcus
DIPE

SEQ ID NO: 1929893 - protein, 7 aa, Staphylococcus
DIPEAKD

SEQ ID NO: 1929894 - protein, 7 aa, Staphylococcus
DIPEDSD

SEQ ID NO: 1929895 - protein, 7 aa, Staphylococcus
DIPEEDV

SEQ ID NO: 1929896 - protein, 7 aa, Staphylococcus
DIPEGRT

SEQ ID NO: 1929897 - protein, 6 aa, Staphylococcus
DIPEHQ

SEQ ID NO: 1929898 - protein, 6 aa, Staphylococcus
DIPEKA

SEQ ID NO: 1929899 - protein, 7 aa, Staphylococcus
DIPENKR

SEQ ID NO: 1929900 - protein, 7 aa, Staphylococcus
DIPENRT

SEQ ID NO: 1929901 - protein, 6 aa, Staphylococcus
DIPEQA

SEQ ID NO: 1929902 - protein, 5 aa, Staphylococcus
DIPFS

SEQ ID NO: 1929903 - protein, 15 aa, Staphylococcus
DIPGKHASYKAGGML

SEQ ID NO: 1929904 - protein, 5 aa, Staphylococcus
DIPGS

SEQ ID NO: 1929905 - protein, 5 aa, Staphylococcus
DIPGV

SEQ ID NO: 1929906 - protein, 12 aa, Staphylococcus
DIPKDLKRNEKI

SEQ ID NO: 1929907 - protein, 15 aa, Staphylococcus
DIPKDQEAMDVGPKT

SEQ ID NO: 1929908 - protein, 12 aa, Staphylococcus
DIPKVQNEYQDK

SEQ ID NO: 1929909 - protein, 4 aa, Staphylococcus
DIPL

SEQ ID NO: 1929910 - protein, 5 aa, Staphylococcus
DIPLD

SEQ ID NO: 1929911 - protein, 4 aa, Staphylococcus
DIPN

SEQ ID NO: 1929912 - protein, 7 aa, Staphylococcus
DIPNDAY

SEQ ID NO: 1929913 - protein, 14 aa, Staphylococcus
DIPNEEKPAYGQKV

SEQ ID NO: 1929914 - protein, 6 aa, Staphylococcus
DIPPRS

SEQ ID NO: 1929915 - protein, 6 aa, Staphylococcus
DIPPSN

SEQ ID NO: 1929916 - protein, 9 aa, Staphylococcus
DIPQDEHDK

SEQ ID NO: 1929917 - protein, 5 aa, Staphylococcus
DIPQE

SEQ ID NO: 1929918 - protein, 6 aa, Staphylococcus
DIPQSD

SEQ ID NO: 1929919 - protein, 6 aa, Staphylococcus
DIPSEY

SEQ ID NO: 1929920 - protein, 6 aa, Staphylococcus
DIPTEL

SEQ ID NO: 1929921 - protein, 8 aa, Staphylococcus
DIPTNQAP

SEQ ID NO: 1929922 - protein, 4 aa, Staphylococcus
DIQD

SEQ ID NO: 1929923 - protein, 5 aa, Staphylococcus
DIQDE

SEQ ID NO: 1929924 - protein, 8 aa, Staphylococcus
DIQDSQDP

SEQ ID NO: 1929925 - protein, 6 aa, Staphylococcus
DIQDTS

SEQ ID NO: 1929926 - protein, 5 aa, Staphylococcus
DIQGA

SEQ ID NO: 1929927 - protein, 7 aa, Staphylococcus
DIQGKKA

SEQ ID NO: 1929928 - protein, 4 aa, Staphylococcus
DIQP

SEQ ID NO: 1929929 - protein, 6 aa, Staphylococcus
DIQPED

SEQ ID NO: 1929930 - protein, 6 aa, Staphylococcus
DIQPEL

SEQ ID NO: 1929931 - protein, 6 aa, Staphylococcus
DIQPEN

SEQ ID NO: 1929932 - protein, 7 aa, Staphylococcus
DIQPGTH

SEQ ID NO: 1929933 - protein, 15 aa, Staphylococcus
DIQPPAESEEQRNEY

SEQ ID NO: 1929934 - protein, 10 aa, Staphylococcus
DIQPSPVQKQ

SEQ ID NO: 1929935 - protein, 9 aa, Staphylococcus
DIQPSQITS

SEQ ID NO: 1929936 - protein, 9 aa, Staphylococcus
DIQQKTAEY

SEQ ID NO: 1929937 - protein, 5 aa, Staphylococcus
DIQSP

SEQ ID NO: 1929938 - protein, 28 aa, Staphylococcus
DIRDSYKEQLAGMKEKAKEFQAAGNKIY

SEQ ID NO: 1929939 - protein, 5 aa, Staphylococcus
DIRDV

SEQ ID NO: 1929940 - protein, 15 aa, Staphylococcus
DIREPEADSPVKDGP

SEQ ID NO: 1929941 - protein, 13 aa, Staphylococcus
DIRKGNAGQVPDH

SEQ ID NO: 1929942 - protein, 6 aa, Staphylococcus
DIRSHE

SEQ ID NO: 1929943 - protein, 8 aa, Staphylococcus
DISAETLK

SEQ ID NO: 1929944 - protein, 12 aa, Staphylococcus
DISDETTSHHLS

SEQ ID NO: 1929945 - protein, 9 aa, Staphylococcus
DISEENPDE

SEQ ID NO: 1929946 - protein, 12 aa, Staphylococcus
DISEGDEVKRTG

SEQ ID NO: 1929947 - protein, 14 aa, Staphylococcus
DISENDDIKDYTAK

SEQ ID NO: 1929948 - protein, 5 aa, Staphylococcus
DISIG

SEQ ID NO: 1929949 - protein, 6 aa, Staphylococcus
DISIGN

SEQ ID NO: 1929950 - protein, 7 aa, Staphylococcus
DISIPNE

SEQ ID NO: 1929951 - protein, 8 aa, Staphylococcus
DISKNDQS

SEQ ID NO: 1929952 - protein, 7 aa, Staphylococcus
DISLDGE

SEQ ID NO: 1929953 - protein, 17 aa, Staphylococcus
DISLDGELNKSFSEDVK

SEQ ID NO: 1929954 - protein, 13 aa, Staphylococcus
DISNMSKKELREI

SEQ ID NO: 1929955 - protein, 10 aa, Staphylococcus
DISNQADINR

SEQ ID NO: 1929956 - protein, 7 aa, Staphylococcus
DISNQTV

SEQ ID NO: 1929957 - protein, 7 aa, Staphylococcus
DISNSEI

SEQ ID NO: 1929958 - protein, 9 aa, Staphylococcus
DISNSGLSK

SEQ ID NO: 1929959 - protein, 7 aa, Staphylococcus
DISPDDQ

SEQ ID NO: 1929960 - protein, 14 aa, Staphylococcus
DISPKELLEFLEKE

SEQ ID NO: 1929961 - protein, 93 aa, Staphylococcus
DISPRDGADFKKPSSVDGSSKEDLSVAGHPDNDTTNRKVNSNGTVNGGSSSSNSGSNNSSGQSNQQGNNSQGNNNQQGNNSQGNNNQQSGNAL

SEQ ID NO: 1929962 - protein, 11 aa, Staphylococcus
DISPTDNHSAE

SEQ ID NO: 1929963 - protein, 7 aa, Staphylococcus
DISPYQS

SEQ ID NO: 1929964 - protein, 11 aa, Staphylococcus
DISQNGRATQG

SEQ ID NO: 1929965 - protein, 7 aa, Staphylococcus
DISRPGL

SEQ ID NO: 1929966 - protein, 11 aa, Staphylococcus
DISRTPKAEGM

SEQ ID NO: 1929967 - protein, 9 aa, Staphylococcus
DISSDDDVI

SEQ ID NO: 1929968 - protein, 13 aa, Staphylococcus
DISSLEKKYKGEA

SEQ ID NO: 1929969 - protein, 6 aa, Staphylococcus
DISSTD

SEQ ID NO: 1929970 - protein, 15 aa, Staphylococcus
DISTETVVSESEIRT

SEQ ID NO: 1929971 - protein, 7 aa, Staphylococcus
DISTPNY

SEQ ID NO: 1929972 - protein, 6 aa, Staphylococcus
DISTTQ

SEQ ID NO: 1929973 - protein, 7 aa, Staphylococcus
DITANPD

SEQ ID NO: 1929974 - protein, 12 aa, Staphylococcus
DITEDKSLQQDT

SEQ ID NO: 1929975 - protein, 11 aa, Staphylococcus
DITEDRTAKKA

SEQ ID NO: 1929976 - protein, 12 aa, Staphylococcus
DITEGDEVKRTG

SEQ ID NO: 1929977 - protein, 7 aa, Staphylococcus
DITEGLK

SEQ ID NO: 1929978 - protein, 7 aa, Staphylococcus
DITGGSL

SEQ ID NO: 1929979 - protein, 22 aa, Staphylococcus
DITGGSLGQMTPQQVKESHRNK

SEQ ID NO: 1929980 - protein, 6 aa, Staphylococcus
DITHDS

SEQ ID NO: 1929981 - protein, 4 aa, Staphylococcus
DITM

SEQ ID NO: 1929982 - protein, 5 aa, Staphylococcus
DITNL

SEQ ID NO: 1929983 - protein, 7 aa, Staphylococcus
DITPDQV

SEQ ID NO: 1929984 - protein, 6 aa, Staphylococcus
DITPEN

SEQ ID NO: 1929985 - protein, 7 aa, Staphylococcus
DITPGLA

SEQ ID NO: 1929986 - protein, 6 aa, Staphylococcus
DITQES

SEQ ID NO: 1929987 - protein, 7 aa, Staphylococcus
DITQESS

SEQ ID NO: 1929988 - protein, 6 aa, Staphylococcus
DITQRE

SEQ ID NO: 1929989 - protein, 7 aa, Staphylococcus
DITRSEY

SEQ ID NO: 1929990 - protein, 10 aa, Staphylococcus
DITSNPKRDT

SEQ ID NO: 1929991 - protein, 5 aa, Staphylococcus
DITTA

SEQ ID NO: 1929992 - protein, 8 aa, Staphylococcus
DITTDEIA

SEQ ID NO: 1929993 - protein, 13 aa, Staphylococcus
DITTDSRTAKSGS

SEQ ID NO: 1929994 - protein, 13 aa, Staphylococcus
DITTDSRTASEGS

SEQ ID NO: 1929995 - protein, 10 aa, Staphylococcus
DITTNAPLKS

SEQ ID NO: 1929996 - protein, 7 aa, Staphylococcus
DITTQTE

SEQ ID NO: 1929997 - protein, 4 aa, Staphylococcus
DIVK

SEQ ID NO: 1929998 - protein, 5 aa, Staphylococcus
DIVKK

SEQ ID NO: 1929999 - protein, 5 aa, Staphylococcus
DIVSQ

SEQ ID NO: 1930000 - protein, 10 aa, Staphylococcus
DIVSSGETHE

SEQ ID NO: 1930001 - protein, 5 aa, Staphylococcus
DIYEK

SEQ ID NO: 1930002 - protein, 6 aa, Staphylococcus
DKAAHS

SEQ ID NO: 1930003 - protein, 9 aa, Staphylococcus
DKADDDQLR

SEQ ID NO: 1930004 - protein, 7 aa, Staphylococcus
DKADINR

SEQ ID NO: 1930005 - protein, 11 aa, Staphylococcus
DKADQETVEKN

SEQ ID NO: 1930006 - protein, 6 aa, Staphylococcus
DKAEEV

SEQ ID NO: 1930007 - protein, 8 aa, Staphylococcus
DKAENVSE

SEQ ID NO: 1930008 - protein, 9 aa, Staphylococcus
DKAFSEDVK

SEQ ID NO: 1930009 - protein, 9 aa, Staphylococcus
DKAGISADA

SEQ ID NO: 1930010 - protein, 4 aa, Staphylococcus
DKAI

SEQ ID NO: 1930011 - protein, 8 aa, Staphylococcus
DKAIEGIP

SEQ ID NO: 1930012 - protein, 12 aa, Staphylococcus
DKAIKASARTLE

SEQ ID NO: 1930013 - protein, 9 aa, Staphylococcus
DKAINDQKE

SEQ ID NO: 1930014 - protein, 11 aa, Staphylococcus
DKAKGAGEENF

SEQ ID NO: 1930015 - protein, 11 aa, Staphylococcus
DKAKGAGEENY

SEQ ID NO: 1930016 - protein, 12 aa, Staphylococcus
DKAKGGGDENYD

SEQ ID NO: 1930017 - protein, 13 aa, Staphylococcus
DKAKGSDDENYDN

SEQ ID NO: 1930018 - protein, 6 aa, Staphylococcus
DKAKNK

SEQ ID NO: 1930019 - protein, 5 aa, Staphylococcus
DKAKQ

SEQ ID NO: 1930020 - protein, 14 aa, Staphylococcus
DKAKSLNEENGQSF

SEQ ID NO: 1930021 - protein, 8 aa, Staphylococcus
DKAKSNSL

SEQ ID NO: 1930022 - protein, 4 aa, Staphylococcus
DKAN

SEQ ID NO: 1930023 - protein, 7 aa, Staphylococcus
DKANHPN

SEQ ID NO: 1930024 - protein, 8 aa, Staphylococcus
DKANKDDI

SEQ ID NO: 1930025 - protein, 10 aa, Staphylococcus
DKANKDDIKQ

SEQ ID NO: 1930026 - protein, 8 aa, Staphylococcus
DKANKEDI

SEQ ID NO: 1930027 - protein, 7 aa, Staphylococcus
DKANKER

SEQ ID NO: 1930028 - protein, 14 aa, Staphylococcus
DKANNKSASLKLKV

SEQ ID NO: 1930029 - protein, 7 aa, Staphylococcus
DKANSNL

SEQ ID NO: 1930030 - protein, 4 aa, Staphylococcus
DKAP

SEQ ID NO: 1930031 - protein, 4 aa, Staphylococcus
DKAQ

SEQ ID NO: 1930032 - protein, 7 aa, Staphylococcus
DKAQQVE

SEQ ID NO: 1930033 - protein, 10 aa, Staphylococcus
DKAQSTDSGI

SEQ ID NO: 1930034 - protein, 7 aa, Staphylococcus
DKARGRL

SEQ ID NO: 1930035 - protein, 5 aa, Staphylococcus
DKARK

SEQ ID NO: 1930036 - protein, 5 aa, Staphylococcus
DKARM

SEQ ID NO: 1930037 - protein, 12 aa, Staphylococcus
DKASAREQQAGD

SEQ ID NO: 1930038 - protein, 6 aa, Staphylococcus
DKASIQ

SEQ ID NO: 1930039 - protein, 8 aa, Staphylococcus
DKASNQNV

SEQ ID NO: 1930040 - protein, 5 aa, Staphylococcus
DKASQ

SEQ ID NO: 1930041 - protein, 12 aa, Staphylococcus
DKASQKIFEVER

SEQ ID NO: 1930042 - protein, 9 aa, Staphylococcus
DKATAESYL

SEQ ID NO: 1930043 - protein, 9 aa, Staphylococcus
DKATEGTIT

SEQ ID NO: 1930044 - protein, 7 aa, Staphylococcus
DKATENY

SEQ ID NO: 1930045 - protein, 17 aa, Staphylococcus
DKATKDAENAQYPDVEE

SEQ ID NO: 1930046 - protein, 6 aa, Staphylococcus
DKATLS

SEQ ID NO: 1930047 - protein, 8 aa, Staphylococcus
DKATNQNV

SEQ ID NO: 1930048 - protein, 8 aa, Staphylococcus
DKAVSYPR

SEQ ID NO: 1930049 - protein, 7 aa, Staphylococcus
DKAVTEA

SEQ ID NO: 1930050 - protein, 5 aa, Staphylococcus
DKAYD

SEQ ID NO: 1930051 - protein, 5 aa, Staphylococcus
DKAYP

SEQ ID NO: 1930052 - protein, 4 aa, Staphylococcus
DKCD

SEQ ID NO: 1930053 - protein, 7 aa, Staphylococcus
DKDAKEY

SEQ ID NO: 1930054 - protein, 8 aa, Staphylococcus
DKDAQSDL

SEQ ID NO: 1930055 - protein, 8 aa, Staphylococcus
DKDDKGKV

SEQ ID NO: 1930056 - protein, 16 aa, Staphylococcus
DKDDPRFDRPTKPIGP

SEQ ID NO: 1930057 - protein, 7 aa, Staphylococcus
DKDDQPI

SEQ ID NO: 1930058 - protein, 7 aa, Staphylococcus
DKDDVYA

SEQ ID NO: 1930059 - protein, 5 aa, Staphylococcus
DKDEF

SEQ ID NO: 1930060 - protein, 8 aa, Staphylococcus
DKDEQIVD

SEQ ID NO: 1930061 - protein, 7 aa, Staphylococcus
DKDEVEA

SEQ ID NO: 1930062 - protein, 7 aa, Staphylococcus
DKDEVFE

SEQ ID NO: 1930063 - protein, 7 aa, Staphylococcus
DKDEYNQ

SEQ ID NO: 1930064 - protein, 14 aa, Staphylococcus
DKDFPKQEQPWPGL

SEQ ID NO: 1930065 - protein, 4 aa, Staphylococcus
DKDG

SEQ ID NO: 1930066 - protein, 7 aa, Staphylococcus
DKDGFDN

SEQ ID NO: 1930067 - protein, 12 aa, Staphylococcus
DKDGHYENNGRC

SEQ ID NO: 1930068 - protein, 9 aa, Staphylococcus
DKDGKTKQI

SEQ ID NO: 1930069 - protein, 7 aa, Staphylococcus
DKDGLTD

SEQ ID NO: 1930070 - protein, 7 aa, Staphylococcus
DKDGNWT

SEQ ID NO: 1930071 - protein, 5 aa, Staphylococcus
DKDGQ

SEQ ID NO: 1930072 - protein, 13 aa, Staphylococcus
DKDGRGSITSSNL

SEQ ID NO: 1930073 - protein, 6 aa, Staphylococcus
DKDGVG

SEQ ID NO: 1930074 - protein, 5 aa, Staphylococcus
DKDGY

SEQ ID NO: 1930075 - protein, 7 aa, Staphylococcus
DKDHAYK

SEQ ID NO: 1930076 - protein, 11 aa, Staphylococcus
DKDHNDKGAIK

SEQ ID NO: 1930077 - protein, 12 aa, Staphylococcus
DKDHNDKPAIKS

SEQ ID NO: 1930078 - protein, 12 aa, Staphylococcus
DKDHNDKSAIKS

SEQ ID NO: 1930079 - protein, 9 aa, Staphylococcus
DKDIEEGYK

SEQ ID NO: 1930080 - protein, 8 aa, Staphylococcus
DKDIESSW

SEQ ID NO: 1930081 - protein, 6 aa, Staphylococcus
DKDIHR

SEQ ID NO: 1930082 - protein, 19 aa, Staphylococcus
DKDITSKSIQPKKGESVGR

SEQ ID NO: 1930083 - protein, 13 aa, Staphylococcus
DKDKEAVKTAPRI

SEQ ID NO: 1930084 - protein, 7 aa, Staphylococcus
DKDKEEI

SEQ ID NO: 1930085 - protein, 7 aa, Staphylococcus
DKDKIAK

SEQ ID NO: 1930086 - protein, 10 aa, Staphylococcus
DKDKSLNEGA

SEQ ID NO: 1930087 - protein, 8 aa, Staphylococcus
DKDKSSAL

SEQ ID NO: 1930088 - protein, 9 aa, Staphylococcus
DKDKSSALL

SEQ ID NO: 1930089 - protein, 7 aa, Staphylococcus
DKDKTSA

SEQ ID NO: 1930090 - protein, 6 aa, Staphylococcus
DKDLKE

SEQ ID NO: 1930091 - protein, 7 aa, Staphylococcus
DKDLQSI

SEQ ID NO: 1930092 - protein, 19 aa, Staphylococcus
DKDLSRLARRGSGSASRSI

SEQ ID NO: 1930093 - protein, 20 aa, Staphylococcus
DKDLSRLARRGSGSASRSIY

SEQ ID NO: 1930094 - protein, 11 aa, Staphylococcus
DKDNDEITKED

SEQ ID NO: 1930095 - protein, 10 aa, Staphylococcus
DKDNDLSNSA

SEQ ID NO: 1930096 - protein, 11 aa, Staphylococcus
DKDNKDVTRED

SEQ ID NO: 1930097 - protein, 9 aa, Staphylococcus
DKDNKPGIS

SEQ ID NO: 1930098 - protein, 6 aa, Staphylococcus
DKDNYF

SEQ ID NO: 1930099 - protein, 8 aa, Staphylococcus
DKDPLNDA

SEQ ID NO: 1930100 - protein, 10 aa, Staphylococcus
DKDQKADDMF

SEQ ID NO: 1930101 - protein, 8 aa, Staphylococcus
DKDRAKDF

SEQ ID NO: 1930102 - protein, 7 aa, Staphylococcus
DKDSETI

SEQ ID NO: 1930103 - protein, 8 aa, Staphylococcus
DKDSSKVK

SEQ ID NO: 1930104 - protein, 6 aa, Staphylococcus
DKDTEL

SEQ ID NO: 1930105 - protein, 16 aa, Staphylococcus
DKDTEQLKSLTEASAG

SEQ ID NO: 1930106 - protein, 6 aa, Staphylococcus
DKDTER

SEQ ID NO: 1930107 - protein, 10 aa, Staphylococcus
DKDTKTISRD

SEQ ID NO: 1930108 - protein, 5 aa, Staphylococcus
DKDTN

SEQ ID NO: 1930109 - protein, 32 aa, Staphylococcus
DKDVHVSDASSDNATEETSVDKAHNDNVEDAQ

SEQ ID NO: 1930110 - protein, 7 aa, Staphylococcus
DKDVNMT

SEQ ID NO: 1930111 - protein, 9 aa, Staphylococcus
DKDVYDPRK

SEQ ID NO: 1930112 - protein, 7 aa, Staphylococcus
DKEANVK

SEQ ID NO: 1930113 - protein, 12 aa, Staphylococcus
DKEARKIFEVER

SEQ ID NO: 1930114 - protein, 10 aa, Staphylococcus
DKEASEVAGG

SEQ ID NO: 1930115 - protein, 8 aa, Staphylococcus
DKEDDANW

SEQ ID NO: 1930116 - protein, 8 aa, Staphylococcus
DKEDEADW

SEQ ID NO: 1930117 - protein, 13 aa, Staphylococcus
DKEDEAFANPTKP

SEQ ID NO: 1930118 - protein, 7 aa, Staphylococcus
DKEDGKD

SEQ ID NO: 1930119 - protein, 7 aa, Staphylococcus
DKEDGKN

SEQ ID NO: 1930120 - protein, 7 aa, Staphylococcus
DKEDGKQ

SEQ ID NO: 1930121 - protein, 7 aa, Staphylococcus
DKEDGRW

SEQ ID NO: 1930122 - protein, 8 aa, Staphylococcus
DKEDNADW

SEQ ID NO: 1930123 - protein, 11 aa, Staphylococcus
DKEDNKLINPS

SEQ ID NO: 1930124 - protein, 8 aa, Staphylococcus
DKEDPQYT

SEQ ID NO: 1930125 - protein, 9 aa, Staphylococcus
DKEEERELK

SEQ ID NO: 1930126 - protein, 9 aa, Staphylococcus
DKEEIDKPE

SEQ ID NO: 1930127 - protein, 8 aa, Staphylococcus
DKEEKLRK

SEQ ID NO: 1930128 - protein, 25 aa, Staphylococcus
DKEEKSKAVENGKKLPKKQPLRSKD

SEQ ID NO: 1930129 - protein, 5 aa, Staphylococcus
DKEEM

SEQ ID NO: 1930130 - protein, 6 aa, Staphylococcus
DKEENR

SEQ ID NO: 1930131 - protein, 9 aa, Staphylococcus
DKEENVNQG

SEQ ID NO: 1930132 - protein, 9 aa, Staphylococcus
DKEESSKNF

SEQ ID NO: 1930133 - protein, 6 aa, Staphylococcus
DKEFKK

SEQ ID NO: 1930134 - protein, 4 aa, Staphylococcus
DKEG

SEQ ID NO: 1930135 - protein, 7 aa, Staphylococcus
DKEGNRI

SEQ ID NO: 1930136 - protein, 6 aa, Staphylococcus
DKEHKL

SEQ ID NO: 1930137 - protein, 15 aa, Staphylococcus
DKEHSELNGSEQEAE

SEQ ID NO: 1930138 - protein, 10 aa, Staphylococcus
DKEIADVESK

SEQ ID NO: 1930139 - protein, 7 aa, Staphylococcus
DKEIEGA

SEQ ID NO: 1930140 - protein, 8 aa, Staphylococcus
DKEIQETA

SEQ ID NO: 1930141 - protein, 7 aa, Staphylococcus
DKEITAQ

SEQ ID NO: 1930142 - protein, 4 aa, Staphylococcus
DKEK

SEQ ID NO: 1930143 - protein, 13 aa, Staphylococcus
DKEKAEAHINAGA

SEQ ID NO: 1930144 - protein, 13 aa, Staphylococcus
DKEKAKNKRGKIG

SEQ ID NO: 1930145 - protein, 14 aa, Staphylococcus
DKEKENARINERNR

SEQ ID NO: 1930146 - protein, 8 aa, Staphylococcus
DKEKGGKF

SEQ ID NO: 1930147 - protein, 7 aa, Staphylococcus
DKEKGKS

SEQ ID NO: 1930148 - protein, 5 aa, Staphylococcus
DKEKI

SEQ ID NO: 1930149 - protein, 16 aa, Staphylococcus
DKEKLKKVAKTEEGRV

SEQ ID NO: 1930150 - protein, 16 aa, Staphylococcus
DKEKLNKESKTEEGRV

SEQ ID NO: 1930151 - protein, 12 aa, Staphylococcus
DKEKPAVTESTD

SEQ ID NO: 1930152 - protein, 5 aa, Staphylococcus
DKELE

SEQ ID NO: 1930153 - protein, 6 aa, Staphylococcus
DKELEN

SEQ ID NO: 1930154 - protein, 8 aa, Staphylococcus
DKELNGNT

SEQ ID NO: 1930155 - protein, 7 aa, Staphylococcus
DKELNQN

SEQ ID NO: 1930156 - protein, 8 aa, Staphylococcus
DKELTEAL

SEQ ID NO: 1930157 - protein, 8 aa, Staphylococcus
DKENAAEV

SEQ ID NO: 1930158 - protein, 8 aa, Staphylococcus
DKENDKDW

SEQ ID NO: 1930159 - protein, 19 aa, Staphylococcus
DKENIEANDEDIDKELEKM

SEQ ID NO: 1930160 - protein, 9 aa, Staphylococcus
DKENQKPNI

SEQ ID NO: 1930161 - protein, 8 aa, Staphylococcus
DKENTEIQ

SEQ ID NO: 1930162 - protein, 6 aa, Staphylococcus
DKENVY

SEQ ID NO: 1930163 - protein, 11 aa, Staphylococcus
DKEPEVTPETR

SEQ ID NO: 1930164 - protein, 8 aa, Staphylococcus
DKEPLSNP

SEQ ID NO: 1930165 - protein, 5 aa, Staphylococcus
DKEPV

SEQ ID NO: 1930166 - protein, 7 aa, Staphylococcus
DKEQSIQ

SEQ ID NO: 1930167 - protein, 4 aa, Staphylococcus
DKER

SEQ ID NO: 1930168 - protein, 7 aa, Staphylococcus
DKERGKL

SEQ ID NO: 1930169 - protein, 5 aa, Staphylococcus
DKERI

SEQ ID NO: 1930170 - protein, 14 aa, Staphylococcus
DKERLRNQLDALQF

SEQ ID NO: 1930171 - protein, 15 aa, Staphylococcus
DKESELTGTEQEAEY

SEQ ID NO: 1930172 - protein, 13 aa, Staphylococcus
DKESIAKGFKDST

SEQ ID NO: 1930173 - protein, 5 aa, Staphylococcus
DKESL

SEQ ID NO: 1930174 - protein, 8 aa, Staphylococcus
DKESSNNF

SEQ ID NO: 1930175 - protein, 5 aa, Staphylococcus
DKESV

SEQ ID NO: 1930176 - protein, 7 aa, Staphylococcus
DKESYEG

SEQ ID NO: 1930177 - protein, 6 aa, Staphylococcus
DKETAM

SEQ ID NO: 1930178 - protein, 20 aa, Staphylococcus
DKETDAPYNITTRGAEYHFV

SEQ ID NO: 1930179 - protein, 5 aa, Staphylococcus
DKETE

SEQ ID NO: 1930180 - protein, 8 aa, Staphylococcus
DKETERID

SEQ ID NO: 1930181 - protein, 8 aa, Staphylococcus
DKETERIN

SEQ ID NO: 1930182 - protein, 8 aa, Staphylococcus
DKETGAFG

SEQ ID NO: 1930183 - protein, 13 aa, Staphylococcus
DKETLKKGVKDAS

SEQ ID NO: 1930184 - protein, 15 aa, Staphylococcus
DKETLRYGENPQQSA

SEQ ID NO: 1930185 - protein, 11 aa, Staphylococcus
DKETPSYESQI

SEQ ID NO: 1930186 - protein, 5 aa, Staphylococcus
DKEVD

SEQ ID NO: 1930187 - protein, 14 aa, Staphylococcus
DKEVDGTIRVHVVE

SEQ ID NO: 1930188 - protein, 5 aa, Staphylococcus
DKEVK

SEQ ID NO: 1930189 - protein, 9 aa, Staphylococcus
DKEVRTTHG

SEQ ID NO: 1930190 - protein, 8 aa, Staphylococcus
DKEVYDPR

SEQ ID NO: 1930191 - protein, 9 aa, Staphylococcus
DKEVYDPRK

SEQ ID NO: 1930192 - protein, 8 aa, Staphylococcus
DKEYKGNT

SEQ ID NO: 1930193 - protein, 12 aa, Staphylococcus
DKFEDADEEKVK

SEQ ID NO: 1930194 - protein, 9 aa, Staphylococcus
DKFGAAPSG

SEQ ID NO: 1930195 - protein, 17 aa, Staphylococcus
DKFHSNKRRVSSTGQSA

SEQ ID NO: 1930196 - protein, 10 aa, Staphylococcus
DKFKNGDEAF

SEQ ID NO: 1930197 - protein, 32 aa, Staphylococcus
DKFKNSDNEQVDKAKDKINEYTEKNNDDKKDD

SEQ ID NO: 1930198 - protein, 8 aa, Staphylococcus
DKFNSPGF

SEQ ID NO: 1930199 - protein, 13 aa, Staphylococcus
DKFNTRDKNRFER

SEQ ID NO: 1930200 - protein, 13 aa, Staphylococcus
DKFPGLTEPDPSY

SEQ ID NO: 1930201 - protein, 6 aa, Staphylococcus
DKFPGN

SEQ ID NO: 1930202 - protein, 7 aa, Staphylococcus
DKFSKQE

SEQ ID NO: 1930203 - protein, 10 aa, Staphylococcus
DKGAGEKKVN

SEQ ID NO: 1930204 - protein, 6 aa, Staphylococcus
DKGATM

SEQ ID NO: 1930205 - protein, 6 aa, Staphylococcus
DKGCAY

SEQ ID NO: 1930206 - protein, 6 aa, Staphylococcus
DKGDAL

SEQ ID NO: 1930207 - protein, 6 aa, Staphylococcus
DKGDEL

SEQ ID NO: 1930208 - protein, 5 aa, Staphylococcus
DKGDT

SEQ ID NO: 1930209 - protein, 5 aa, Staphylococcus
DKGED

SEQ ID NO: 1930210 - protein, 10 aa, Staphylococcus
DKGEKAGVKN

SEQ ID NO: 1930211 - protein, 6 aa, Staphylococcus
DKGELP

SEQ ID NO: 1930212 - protein, 15 aa, Staphylococcus
DKGEPTLELNDDGGY

SEQ ID NO: 1930213 - protein, 7 aa, Staphylococcus
DKGEREY

SEQ ID NO: 1930214 - protein, 4 aa, Staphylococcus
DKGF

SEQ ID NO: 1930215 - protein, 20 aa, Staphylococcus
DKGFKESAVSQFNDADGPRH

SEQ ID NO: 1930216 - protein, 5 aa, Staphylococcus
DKGGI

SEQ ID NO: 1930217 - protein, 4 aa, Staphylococcus
DKGI

SEQ ID NO: 1930218 - protein, 7 aa, Staphylococcus
DKGIAED

SEQ ID NO: 1930219 - protein, 7 aa, Staphylococcus
DKGIDKD

SEQ ID NO: 1930220 - protein, 16 aa, Staphylococcus
DKGILSQSSPVATQIP

SEQ ID NO: 1930221 - protein, 7 aa, Staphylococcus
DKGISQK

SEQ ID NO: 1930222 - protein, 4 aa, Staphylococcus
DKGK

SEQ ID NO: 1930223 - protein, 17 aa, Staphylococcus
DKGKELGKVKPSTSGWS

SEQ ID NO: 1930224 - protein, 6 aa, Staphylococcus
DKGKQI

SEQ ID NO: 1930225 - protein, 7 aa, Staphylococcus
DKGKQIE

SEQ ID NO: 1930226 - protein, 8 aa, Staphylococcus
DKGKTVEI

SEQ ID NO: 1930227 - protein, 4 aa, Staphylococcus
DKGL

SEQ ID NO: 1930228 - protein, 9 aa, Staphylococcus
DKGLAGAYN

SEQ ID NO: 1930229 - protein, 10 aa, Staphylococcus
DKGLAGAYSS

SEQ ID NO: 1930230 - protein, 11 aa, Staphylococcus
DKGLAGAYSSN

SEQ ID NO: 1930231 - protein, 8 aa, Staphylococcus
DKGLDGSR

SEQ ID NO: 1930232 - protein, 6 aa, Staphylococcus
DKGLDV

SEQ ID NO: 1930233 - protein, 13 aa, Staphylococcus
DKGLEVAKELKEL

SEQ ID NO: 1930234 - protein, 17 aa, Staphylococcus
DKGLNGVTSATGLTGGD

SEQ ID NO: 1930235 - protein, 5 aa, Staphylococcus
DKGMT

SEQ ID NO: 1930236 - protein, 11 aa, Staphylococcus
DKGNSIQNEAR

SEQ ID NO: 1930237 - protein, 7 aa, Staphylococcus
DKGQALA

SEQ ID NO: 1930238 - protein, 6 aa, Staphylococcus
DKGQHQ

SEQ ID NO: 1930239 - protein, 6 aa, Staphylococcus
DKGQPL

SEQ ID NO: 1930240 - protein, 12 aa, Staphylococcus
DKGRDKAHKASF

SEQ ID NO: 1930241 - protein, 12 aa, Staphylococcus
DKGREKAHQASF

SEQ ID NO: 1930242 - protein, 6 aa, Staphylococcus
DKGRFG

SEQ ID NO: 1930243 - protein, 10 aa, Staphylococcus
DKGSIKTASN

SEQ ID NO: 1930244 - protein, 7 aa, Staphylococcus
DKGTAQD

SEQ ID NO: 1930245 - protein, 7 aa, Staphylococcus
DKGTASQ

SEQ ID NO: 1930246 - protein, 12 aa, Staphylococcus
DKGVKAKEIKQK

SEQ ID NO: 1930247 - protein, 8 aa, Staphylococcus
DKGVKDSD

SEQ ID NO: 1930248 - protein, 10 aa, Staphylococcus
DKGVKNVHGY

SEQ ID NO: 1930249 - protein, 7 aa, Staphylococcus
DKGVSLR

SEQ ID NO: 1930250 - protein, 4 aa, Staphylococcus
DKGY

SEQ ID NO: 1930251 - protein, 6 aa, Staphylococcus
DKGYYQ

SEQ ID NO: 1930252 - protein, 5 aa, Staphylococcus
DKHDR

SEQ ID NO: 1930253 - protein, 7 aa, Staphylococcus
DKHEHDE

SEQ ID NO: 1930254 - protein, 5 aa, Staphylococcus
DKHLD

SEQ ID NO: 1930255 - protein, 6 aa, Staphylococcus
DKHPED

SEQ ID NO: 1930256 - protein, 6 aa, Staphylococcus
DKHPEK

SEQ ID NO: 1930257 - protein, 6 aa, Staphylococcus
DKHVTP

SEQ ID NO: 1930258 - protein, 12 aa, Staphylococcus
DKIADNKSAEFA

SEQ ID NO: 1930259 - protein, 14 aa, Staphylococcus
DKIDAAKKDGDSIG

SEQ ID NO: 1930260 - protein, 14 aa, Staphylococcus
DKIDEAKKEGDSIG

SEQ ID NO: 1930261 - protein, 14 aa, Staphylococcus
DKIDEAKREGDSIG

SEQ ID NO: 1930262 - protein, 8 aa, Staphylococcus
DKIDESKD

SEQ ID NO: 1930263 - protein, 9 aa, Staphylococcus
DKIEDTPGE

SEQ ID NO: 1930264 - protein, 7 aa, Staphylococcus
DKIEEGK

SEQ ID NO: 1930265 - protein, 7 aa, Staphylococcus
DKIEKPK

SEQ ID NO: 1930266 - protein, 14 aa, Staphylococcus
DKIKAGAQVATENH

SEQ ID NO: 1930267 - protein, 5 aa, Staphylococcus
DKIKR

SEQ ID NO: 1930268 - protein, 9 aa, Staphylococcus
DKIKTKTSV

SEQ ID NO: 1930269 - protein, 12 aa, Staphylococcus
DKINEIKPKKVF

SEQ ID NO: 1930270 - protein, 20 aa, Staphylococcus
DKINEYTGGEKNNNDDKKDD

SEQ ID NO: 1930271 - protein, 20 aa, Staphylococcus
DKINEYTGGNNDSKDDKKDN

SEQ ID NO: 1930272 - protein, 12 aa, Staphylococcus
DKINSRKPAHYD

SEQ ID NO: 1930273 - protein, 14 aa, Staphylococcus
DKIPPRCDINLNNK

SEQ ID NO: 1930274 - protein, 7 aa, Staphylococcus
DKIPQKG

SEQ ID NO: 1930275 - protein, 7 aa, Staphylococcus
DKIQEGD

SEQ ID NO: 1930276 - protein, 7 aa, Staphylococcus
DKIQQTI

SEQ ID NO: 1930277 - protein, 7 aa, Staphylococcus
DKIQTNR

SEQ ID NO: 1930278 - protein, 5 aa, Staphylococcus
DKISN

SEQ ID NO: 1930279 - protein, 17 aa, Staphylococcus
DKISNEKVNAPQALNEV

SEQ ID NO: 1930280 - protein, 7 aa, Staphylococcus
DKISQNV

SEQ ID NO: 1930281 - protein, 7 aa, Staphylococcus
DKITDQL

SEQ ID NO: 1930282 - protein, 23 aa, Staphylococcus
DKITEAEEAGADYVGEAEYAQKI

SEQ ID NO: 1930283 - protein, 19 aa, Staphylococcus
DKITEAEEAGADYVGESEY

SEQ ID NO: 1930284 - protein, 23 aa, Staphylococcus
DKITEAEEAGADYVGESEYAQKI

SEQ ID NO: 1930285 - protein, 8 aa, Staphylococcus
DKITKKNK

SEQ ID NO: 1930286 - protein, 11 aa, Staphylococcus
DKITTHDDPTY

SEQ ID NO: 1930287 - protein, 13 aa, Staphylococcus
DKITTHDDPTYTK

SEQ ID NO: 1930288 - protein, 5 aa, Staphylococcus
DKIVE

SEQ ID NO: 1930289 - protein, 7 aa, Staphylococcus
DKIVSSD

SEQ ID NO: 1930290 - protein, 8 aa, Staphylococcus
DKKAEGYL

SEQ ID NO: 1930291 - protein, 5 aa, Staphylococcus
DKKAG

SEQ ID NO: 1930292 - protein, 7 aa, Staphylococcus
DKKARGI

SEQ ID NO: 1930293 - protein, 32 aa, Staphylococcus
DKKAYKKDAKSNKYANKPAEGHAKKAGAAPKR

SEQ ID NO: 1930294 - protein, 32 aa, Staphylococcus
DKKAYKKGSKTNKYANKPAEGHAKKADTAPKR

SEQ ID NO: 1930295 - protein, 9 aa, Staphylococcus
DKKCETCGS

SEQ ID NO: 1930296 - protein, 13 aa, Staphylococcus
DKKDKTIKETIKR

SEQ ID NO: 1930297 - protein, 11 aa, Staphylococcus
DKKEFKEDEFR

SEQ ID NO: 1930298 - protein, 10 aa, Staphylococcus
DKKEFNEQTF

SEQ ID NO: 1930299 - protein, 7 aa, Staphylococcus
DKKEKPY

SEQ ID NO: 1930300 - protein, 5 aa, Staphylococcus
DKKEM

SEQ ID NO: 1930301 - protein, 8 aa, Staphylococcus
DKKEMNER

SEQ ID NO: 1930302 - protein, 9 aa, Staphylococcus
DKKEQHKWE

SEQ ID NO: 1930303 - protein, 24 aa, Staphylococcus
DKKEVRKIAEEQDLATAKKKDSTG

SEQ ID NO: 1930304 - protein, 18 aa, Staphylococcus
DKKFEETRLKKGKYYGAT

SEQ ID NO: 1930305 - protein, 14 aa, Staphylococcus
DKKGKVSLTMIDPN

SEQ ID NO: 1930306 - protein, 18 aa, Staphylococcus
DKKHDKTLKDTGGIGTVA

SEQ ID NO: 1930307 - protein, 7 aa, Staphylococcus
DKKIQDA

SEQ ID NO: 1930308 - protein, 15 aa, Staphylococcus
DKKKNKGFKFPKQSQ

SEQ ID NO: 1930309 - protein, 9 aa, Staphylococcus
DKKKTAKKL

SEQ ID NO: 1930310 - protein, 8 aa, Staphylococcus
DKKLANDN

SEQ ID NO: 1930311 - protein, 6 aa, Staphylococcus
DKKLDS

SEQ ID NO: 1930312 - protein, 12 aa, Staphylococcus
DKKLKDYTKEEM

SEQ ID NO: 1930313 - protein, 14 aa, Staphylococcus
DKKLREKRQTKKAV

SEQ ID NO: 1930314 - protein, 10 aa, Staphylococcus
DKKMKPNSSG

SEQ ID NO: 1930315 - protein, 9 aa, Staphylococcus
DKKNNGEGI

SEQ ID NO: 1930316 - protein, 9 aa, Staphylococcus
DKKNNGKGI

SEQ ID NO: 1930317 - protein, 17 aa, Staphylococcus
DKKNQFPDELSGGQKQR

SEQ ID NO: 1930318 - protein, 9 aa, Staphylococcus
DKKNREEIE

SEQ ID NO: 1930319 - protein, 4 aa, Staphylococcus
DKKP

SEQ ID NO: 1930320 - protein, 10 aa, Staphylococcus
DKKPFDEKEF

SEQ ID NO: 1930321 - protein, 11 aa, Staphylococcus
DKKPFDEQEFR

SEQ ID NO: 1930322 - protein, 6 aa, Staphylococcus
DKKPNR

SEQ ID NO: 1930323 - protein, 7 aa, Staphylococcus
DKKQRCS

SEQ ID NO: 1930324 - protein, 9 aa, Staphylococcus
DKKRGYRDG

SEQ ID NO: 1930325 - protein, 7 aa, Staphylococcus
DKKRLKE

SEQ ID NO: 1930326 - protein, 10 aa, Staphylococcus
DKKRNEQDER

SEQ ID NO: 1930327 - protein, 10 aa, Staphylococcus
DKKSLTGQYL

SEQ ID NO: 1930328 - protein, 8 aa, Staphylococcus
DKKSREQI

SEQ ID NO: 1930329 - protein, 6 aa, Staphylococcus
DKKSRM

SEQ ID NO: 1930330 - protein, 10 aa, Staphylococcus
DKKTTEKPKK

SEQ ID NO: 1930331 - protein, 4 aa, Staphylococcus
DKKV

SEQ ID NO: 1930332 - protein, 10 aa, Staphylococcus
DKKVAPNIET

SEQ ID NO: 1930333 - protein, 10 aa, Staphylococcus
DKKYDNPFNP

SEQ ID NO: 1930334 - protein, 4 aa, Staphylococcus
DKLD

SEQ ID NO: 1930335 - protein, 22 aa, Staphylococcus
DKLDGSVRRDPIHRQSPNFDEL

SEQ ID NO: 1930336 - protein, 8 aa, Staphylococcus
DKLDTIKD

SEQ ID NO: 1930337 - protein, 33 aa, Staphylococcus
DKLEKGDDEGNEGEGQGGGTNPPPKENKFSRFA

SEQ ID NO: 1930338 - protein, 5 aa, Staphylococcus
DKLEP

SEQ ID NO: 1930339 - protein, 8 aa, Staphylococcus
DKLERELD

SEQ ID NO: 1930340 - protein, 8 aa, Staphylococcus
DKLERKKA

SEQ ID NO: 1930341 - protein, 9 aa, Staphylococcus
DKLFPNENI

SEQ ID NO: 1930342 - protein, 6 aa, Staphylococcus
DKLGDF

SEQ ID NO: 1930343 - protein, 5 aa, Staphylococcus
DKLGG

SEQ ID NO: 1930344 - protein, 6 aa, Staphylococcus
DKLGGK

SEQ ID NO: 1930345 - protein, 9 aa, Staphylococcus
DKLHSEEEK

SEQ ID NO: 1930346 - protein, 5 aa, Staphylococcus
DKLKQ

SEQ ID NO: 1930347 - protein, 14 aa, Staphylococcus
DKLKQQDASELEQS

SEQ ID NO: 1930348 - protein, 7 aa, Staphylococcus
DKLKSEK

SEQ ID NO: 1930349 - protein, 6 aa, Staphylococcus
DKLNDN

SEQ ID NO: 1930350 - protein, 6 aa, Staphylococcus
DKLNDS

SEQ ID NO: 1930351 - protein, 12 aa, Staphylococcus
DKLNEKPLTDRE

SEQ ID NO: 1930352 - protein, 6 aa, Staphylococcus
DKLNTD

SEQ ID NO: 1930353 - protein, 16 aa, Staphylococcus
DKLPDKDHPQYDDKVK

SEQ ID NO: 1930354 - protein, 7 aa, Staphylococcus
DKLPSIQ

SEQ ID NO: 1930355 - protein, 6 aa, Staphylococcus
DKLPYS

SEQ ID NO: 1930356 - protein, 7 aa, Staphylococcus
DKLQKEP

SEQ ID NO: 1930357 - protein, 9 aa, Staphylococcus
DKLQQSLGK

SEQ ID NO: 1930358 - protein, 7 aa, Staphylococcus
DKLQRLK

SEQ ID NO: 1930359 - protein, 9 aa, Staphylococcus
DKLQSELDR

SEQ ID NO: 1930360 - protein, 6 aa, Staphylococcus
DKLQTE

SEQ ID NO: 1930361 - protein, 6 aa, Staphylococcus
DKLRQA

SEQ ID NO: 1930362 - protein, 6 aa, Staphylococcus
DKLRQT

SEQ ID NO: 1930363 - protein, 5 aa, Staphylococcus
DKLSI

SEQ ID NO: 1930364 - protein, 14 aa, Staphylococcus
DKLSPKTREKYEEY

SEQ ID NO: 1930365 - protein, 9 aa, Staphylococcus
DKLSRTQGF

SEQ ID NO: 1930366 - protein, 13 aa, Staphylococcus
DKLSSSIDEQPFS

SEQ ID NO: 1930367 - protein, 6 aa, Staphylococcus
DKLTED

SEQ ID NO: 1930368 - protein, 10 aa, Staphylococcus
DKLTGRTEAN

SEQ ID NO: 1930369 - protein, 13 aa, Staphylococcus
DKLTSEGQEVADD

SEQ ID NO: 1930370 - protein, 4 aa, Staphylococcus
DKMD

SEQ ID NO: 1930371 - protein, 5 aa, Staphylococcus
DKMGA

SEQ ID NO: 1930372 - protein, 8 aa, Staphylococcus
DKMKAEKG

SEQ ID NO: 1930373 - protein, 6 aa, Staphylococcus
DKMKEV

SEQ ID NO: 1930374 - protein, 5 aa, Staphylococcus
DKMNE

SEQ ID NO: 1930375 - protein, 7 aa, Staphylococcus
DKMPSTE

SEQ ID NO: 1930376 - protein, 5 aa, Staphylococcus
DKMSV

SEQ ID NO: 1930377 - protein, 6 aa, Staphylococcus
DKMTHT

SEQ ID NO: 1930378 - protein, 6 aa, Staphylococcus
DKNCSV

SEQ ID NO: 1930379 - protein, 8 aa, Staphylococcus
DKNDGGVK

SEQ ID NO: 1930380 - protein, 7 aa, Staphylococcus
DKNDKTV

SEQ ID NO: 1930381 - protein, 6 aa, Staphylococcus
DKNDLQ

SEQ ID NO: 1930382 - protein, 4 aa, Staphylococcus
DKNE

SEQ ID NO: 1930383 - protein, 8 aa, Staphylococcus
DKNEGNPS

SEQ ID NO: 1930384 - protein, 8 aa, Staphylococcus
DKNENIYE

SEQ ID NO: 1930385 - protein, 6 aa, Staphylococcus
DKNETD

SEQ ID NO: 1930386 - protein, 9 aa, Staphylococcus
DKNFSTDTF

SEQ ID NO: 1930387 - protein, 4 aa, Staphylococcus
DKNG

SEQ ID NO: 1930388 - protein, 6 aa, Staphylococcus
DKNGDL

SEQ ID NO: 1930389 - protein, 6 aa, Staphylococcus
DKNGEI

SEQ ID NO: 1930390 - protein, 7 aa, Staphylococcus
DKNGGMI

SEQ ID NO: 1930391 - protein, 16 aa, Staphylococcus
DKNGKTYQDSSIGTGS

SEQ ID NO: 1930392 - protein, 7 aa, Staphylococcus
DKNGRTK

SEQ ID NO: 1930393 - protein, 7 aa, Staphylococcus
DKNHAQQ

SEQ ID NO: 1930394 - protein, 8 aa, Staphylococcus
DKNHQLTG

SEQ ID NO: 1930395 - protein, 22 aa, Staphylococcus
DKNIIPGNAKKVEKDSKEYYEA

SEQ ID NO: 1930396 - protein, 9 aa, Staphylococcus
DKNIPKGRG

SEQ ID NO: 1930397 - protein, 12 aa, Staphylococcus
DKNIRESEDSGA

SEQ ID NO: 1930398 - protein, 9 aa, Staphylococcus
DKNKGYYRA

SEQ ID NO: 1930399 - protein, 8 aa, Staphylococcus
DKNKITER

SEQ ID NO: 1930400 - protein, 11 aa, Staphylococcus
DKNKNGYIGSE

SEQ ID NO: 1930401 - protein, 8 aa, Staphylococcus
DKNKSTNF

SEQ ID NO: 1930402 - protein, 10 aa, Staphylococcus
DKNKTLNEGA

SEQ ID NO: 1930403 - protein, 6 aa, Staphylococcus
DKNLNE

SEQ ID NO: 1930404 - protein, 4 aa, Staphylococcus
DKNM

SEQ ID NO: 1930405 - protein, 5 aa, Staphylococcus
DKNMQ

SEQ ID NO: 1930406 - protein, 5 aa, Staphylococcus
DKNNA

SEQ ID NO: 1930407 - protein, 6 aa, Staphylococcus
DKNNGA

SEQ ID NO: 1930408 - protein, 8 aa, Staphylococcus
DKNNGLSD

SEQ ID NO: 1930409 - protein, 9 aa, Staphylococcus
DKNNNYPYP

SEQ ID NO: 1930410 - protein, 7 aa, Staphylococcus
DKNPDID

SEQ ID NO: 1930411 - protein, 5 aa, Staphylococcus
DKNPE

SEQ ID NO: 1930412 - protein, 7 aa, Staphylococcus
DKNPTLR

SEQ ID NO: 1930413 - protein, 11 aa, Staphylococcus
DKNQRGKGYAK

SEQ ID NO: 1930414 - protein, 6 aa, Staphylococcus
DKNRLK

SEQ ID NO: 1930415 - protein, 7 aa, Staphylococcus
DKNRLKE

SEQ ID NO: 1930416 - protein, 8 aa, Staphylococcus
DKNRSGLK

SEQ ID NO: 1930417 - protein, 10 aa, Staphylococcus
DKNSEGYLDE

SEQ ID NO: 1930418 - protein, 6 aa, Staphylococcus
DKNSSF

SEQ ID NO: 1930419 - protein, 12 aa, Staphylococcus
DKNSSIKSSQEI

SEQ ID NO: 1930420 - protein, 14 aa, Staphylococcus
DKNTDSLGKLWGTI

SEQ ID NO: 1930421 - protein, 7 aa, Staphylococcus
DKNTKTE

SEQ ID NO: 1930422 - protein, 14 aa, Staphylococcus
DKNTTKTVYDAKKT

SEQ ID NO: 1930423 - protein, 10 aa, Staphylococcus
DKNVDEKAQE

SEQ ID NO: 1930424 - protein, 6 aa, Staphylococcus
DKNVNM

SEQ ID NO: 1930425 - protein, 4 aa, Staphylococcus
DKNY

SEQ ID NO: 1930426 - protein, 7 aa, Staphylococcus
DKNYPGI

SEQ ID NO: 1930427 - protein, 10 aa, Staphylococcus
DKPAARPEGV

SEQ ID NO: 1930428 - protein, 7 aa, Staphylococcus
DKPATVK

SEQ ID NO: 1930429 - protein, 12 aa, Staphylococcus
DKPDELKPKKVF

SEQ ID NO: 1930430 - protein, 9 aa, Staphylococcus
DKPDKPSMA

SEQ ID NO: 1930431 - protein, 8 aa, Staphylococcus
DKPDYGEA

SEQ ID NO: 1930432 - protein, 10 aa, Staphylococcus
DKPEARPEGV

SEQ ID NO: 1930433 - protein, 7 aa, Staphylococcus
DKPEEQL

SEQ ID NO: 1930434 - protein, 6 aa, Staphylococcus
DKPEET

SEQ ID NO: 1930435 - protein, 6 aa, Staphylococcus
DKPEQF

SEQ ID NO: 1930436 - protein, 7 aa, Staphylococcus
DKPEQFK

SEQ ID NO: 1930437 - protein, 5 aa, Staphylococcus
DKPES

SEQ ID NO: 1930438 - protein, 7 aa, Staphylococcus
DKPESAV

SEQ ID NO: 1930439 - protein, 10 aa, Staphylococcus
DKPESKENLA

SEQ ID NO: 1930440 - protein, 7 aa, Staphylococcus
DKPGAFG

SEQ ID NO: 1930441 - protein, 9 aa, Staphylococcus
DKPGIVGQT

SEQ ID NO: 1930442 - protein, 6 aa, Staphylococcus
DKPHEL

SEQ ID NO: 1930443 - protein, 4 aa, Staphylococcus
DKPI

SEQ ID NO: 1930444 - protein, 4 aa, Staphylococcus
DKPL

SEQ ID NO: 1930445 - protein, 8 aa, Staphylococcus
DKPLKGFN

SEQ ID NO: 1930446 - protein, 9 aa, Staphylococcus
DKPNTPSLS

SEQ ID NO: 1930447 - protein, 6 aa, Staphylococcus
DKPPSA

SEQ ID NO: 1930448 - protein, 14 aa, Staphylococcus
DKPQETNRTFDTAV

SEQ ID NO: 1930449 - protein, 8 aa, Staphylococcus
DKPQSEKE

SEQ ID NO: 1930450 - protein, 7 aa, Staphylococcus
DKPQTHF

SEQ ID NO: 1930451 - protein, 9 aa, Staphylococcus
DKPQTTGYK

SEQ ID NO: 1930452 - protein, 9 aa, Staphylococcus
DKPRTDDKG

SEQ ID NO: 1930453 - protein, 7 aa, Staphylococcus
DKPTEIQ

SEQ ID NO: 1930454 - protein, 9 aa, Staphylococcus
DKPVDDDTI

SEQ ID NO: 1930455 - protein, 9 aa, Staphylococcus
DKPVLDGTT

SEQ ID NO: 1930456 - protein, 11 aa, Staphylococcus
DKPYKKLTDRQ

SEQ ID NO: 1930457 - protein, 7 aa, Staphylococcus
DKQAITE

SEQ ID NO: 1930458 - protein, 32 aa, Staphylococcus
DKQAYKKDAKSNKYANKPAEGHAKKAGAAPKR

SEQ ID NO: 1930459 - protein, 32 aa, Staphylococcus
DKQAYKKDAKSNKYATKPAEGHAKKAGTAPKR

SEQ ID NO: 1930460 - protein, 32 aa, Staphylococcus
DKQAYKKDSKSNKYANKPAEGHAKKAGTAPKR

SEQ ID NO: 1930461 - protein, 32 aa, Staphylococcus
DKQAYKKGSKSNKYANKPAEGHAKKADTTPKR

SEQ ID NO: 1930462 - protein, 7 aa, Staphylococcus
DKQDGRL

SEQ ID NO: 1930463 - protein, 5 aa, Staphylococcus
DKQDM

SEQ ID NO: 1930464 - protein, 10 aa, Staphylococcus
DKQEETKEFP

SEQ ID NO: 1930465 - protein, 5 aa, Staphylococcus
DKQEM

SEQ ID NO: 1930466 - protein, 6 aa, Staphylococcus
DKQEML

SEQ ID NO: 1930467 - protein, 5 aa, Staphylococcus
DKQGN

SEQ ID NO: 1930468 - protein, 6 aa, Staphylococcus
DKQGNI

SEQ ID NO: 1930469 - protein, 8 aa, Staphylococcus
DKQGYKAG

SEQ ID NO: 1930470 - protein, 4 aa, Staphylococcus
DKQH

SEQ ID NO: 1930471 - protein, 5 aa, Staphylococcus
DKQHV

SEQ ID NO: 1930472 - protein, 7 aa, Staphylococcus
DKQIEAG

SEQ ID NO: 1930473 - protein, 7 aa, Staphylococcus
DKQIEGA

SEQ ID NO: 1930474 - protein, 13 aa, Staphylococcus
DKQIKDNLINLIK

SEQ ID NO: 1930475 - protein, 11 aa, Staphylococcus
DKQKGSLSIGK

SEQ ID NO: 1930476 - protein, 17 aa, Staphylococcus
DKQKMQQIAKQASREAW

SEQ ID NO: 1930477 - protein, 20 aa, Staphylococcus
DKQLDESINGAYKEKYGNSA

SEQ ID NO: 1930478 - protein, 19 aa, Staphylococcus
DKQLEEATERLTDLANMYN

SEQ ID NO: 1930479 - protein, 15 aa, Staphylococcus
DKQLEKSLKAGDKVE

SEQ ID NO: 1930480 - protein, 15 aa, Staphylococcus
DKQLESYQRLQKVIQ

SEQ ID NO: 1930481 - protein, 11 aa, Staphylococcus
DKQMSELENNQ

SEQ ID NO: 1930482 - protein, 4 aa, Staphylococcus
DKQN

SEQ ID NO: 1930483 - protein, 8 aa, Staphylococcus
DKQNANNI

SEQ ID NO: 1930484 - protein, 9 aa, Staphylococcus
DKQNIDTEL

SEQ ID NO: 1930485 - protein, 7 aa, Staphylococcus
DKQPIFG

SEQ ID NO: 1930486 - protein, 6 aa, Staphylococcus
DKQPNV

SEQ ID NO: 1930487 - protein, 7 aa, Staphylococcus
DKQPPLK

SEQ ID NO: 1930488 - protein, 8 aa, Staphylococcus
DKQQPNQK

SEQ ID NO: 1930489 - protein, 6 aa, Staphylococcus
DKQQVY

SEQ ID NO: 1930490 - protein, 4 aa, Staphylococcus
DKQR

SEQ ID NO: 1930491 - protein, 16 aa, Staphylococcus
DKQRLKQQLQTEKSFK

SEQ ID NO: 1930492 - protein, 6 aa, Staphylococcus
DKQRTQ

SEQ ID NO: 1930493 - protein, 7 aa, Staphylococcus
DKQSFTR

SEQ ID NO: 1930494 - protein, 12 aa, Staphylococcus
DKQSKERAAEEA

SEQ ID NO: 1930495 - protein, 8 aa, Staphylococcus
DKQSRTSV

SEQ ID NO: 1930496 - protein, 8 aa, Staphylococcus
DKQSYTSR

SEQ ID NO: 1930497 - protein, 6 aa, Staphylococcus
DKQTIQ

SEQ ID NO: 1930498 - protein, 17 aa, Staphylococcus
DKQTRKFNEEASSEEGG

SEQ ID NO: 1930499 - protein, 8 aa, Staphylococcus
DKQTRKVQ

SEQ ID NO: 1930500 - protein, 6 aa, Staphylococcus
DKQTTM

SEQ ID NO: 1930501 - protein, 12 aa, Staphylococcus
DKQWTYEHYHNA

SEQ ID NO: 1930502 - protein, 7 aa, Staphylococcus
DKQYGPP

SEQ ID NO: 1930503 - protein, 7 aa, Staphylococcus
DKRAEVD

SEQ ID NO: 1930504 - protein, 9 aa, Staphylococcus
DKRAFDEQT

SEQ ID NO: 1930505 - protein, 7 aa, Staphylococcus
DKRALPD

SEQ ID NO: 1930506 - protein, 7 aa, Staphylococcus
DKRFNDV

SEQ ID NO: 1930507 - protein, 5 aa, Staphylococcus
DKRGM

SEQ ID NO: 1930508 - protein, 4 aa, Staphylococcus
DKRI

SEQ ID NO: 1930509 - protein, 7 aa, Staphylococcus
DKRIEGS

SEQ ID NO: 1930510 - protein, 5 aa, Staphylococcus
DKRLP

SEQ ID NO: 1930511 - protein, 6 aa, Staphylococcus
DKRLPK

SEQ ID NO: 1930512 - protein, 10 aa, Staphylococcus
DKRNGKANVI

SEQ ID NO: 1930513 - protein, 13 aa, Staphylococcus
DKRNQWNDVFGEG

SEQ ID NO: 1930514 - protein, 7 aa, Staphylococcus
DKRNRSK

SEQ ID NO: 1930515 - protein, 5 aa, Staphylococcus
DKRRG

SEQ ID NO: 1930516 - protein, 10 aa, Staphylococcus
DKRRNEHDER

SEQ ID NO: 1930517 - protein, 6 aa, Staphylococcus
DKRTIA

SEQ ID NO: 1930518 - protein, 9 aa, Staphylococcus
DKRTSEINT

SEQ ID NO: 1930519 - protein, 7 aa, Staphylococcus
DKRVTPK

SEQ ID NO: 1930520 - protein, 12 aa, Staphylococcus
DKRWDREQKAYN

SEQ ID NO: 1930521 - protein, 7 aa, Staphylococcus
DKRYEEL

SEQ ID NO: 1930522 - protein, 6 aa, Staphylococcus
DKRYQE

SEQ ID NO: 1930523 - protein, 7 aa, Staphylococcus
DKRYSDD

SEQ ID NO: 1930524 - protein, 5 aa, Staphylococcus
DKSAI

SEQ ID NO: 1930525 - protein, 8 aa, Staphylococcus
DKSAQSNL

SEQ ID NO: 1930526 - protein, 9 aa, Staphylococcus
DKSCEVPKA

SEQ ID NO: 1930527 - protein, 7 aa, Staphylococcus
DKSDDEL

SEQ ID NO: 1930528 - protein, 7 aa, Staphylococcus
DKSDEEL

SEQ ID NO: 1930529 - protein, 10 aa, Staphylococcus
DKSDIDSKLK

SEQ ID NO: 1930530 - protein, 10 aa, Staphylococcus
DKSDKGTPRL

SEQ ID NO: 1930531 - protein, 11 aa, Staphylococcus
DKSDKRRGKLT

SEQ ID NO: 1930532 - protein, 20 aa, Staphylococcus
DKSDKRRGRPTISKKWDQTT

SEQ ID NO: 1930533 - protein, 11 aa, Staphylococcus
DKSDKRRGSLT

SEQ ID NO: 1930534 - protein, 13 aa, Staphylococcus
DKSDSITSSIPPH

SEQ ID NO: 1930535 - protein, 9 aa, Staphylococcus
DKSDYASGK

SEQ ID NO: 1930536 - protein, 12 aa, Staphylococcus
DKSEGGKSRTDS

SEQ ID NO: 1930537 - protein, 8 aa, Staphylococcus
DKSENGEL

SEQ ID NO: 1930538 - protein, 17 aa, Staphylococcus
DKSESSNSETVHPHQTK

SEQ ID NO: 1930539 - protein, 8 aa, Staphylococcus
DKSFQNTK

SEQ ID NO: 1930540 - protein, 6 aa, Staphylococcus
DKSGAD

SEQ ID NO: 1930541 - protein, 7 aa, Staphylococcus
DKSGDIE

SEQ ID NO: 1930542 - protein, 12 aa, Staphylococcus
DKSGINKLDSIS

SEQ ID NO: 1930543 - protein, 7 aa, Staphylococcus
DKSHTNE

SEQ ID NO: 1930544 - protein, 4 aa, Staphylococcus
DKSI

SEQ ID NO: 1930545 - protein, 7 aa, Staphylococcus
DKSIQQK

SEQ ID NO: 1930546 - protein, 5 aa, Staphylococcus
DKSIT

SEQ ID NO: 1930547 - protein, 13 aa, Staphylococcus
DKSITEALASYRQ

SEQ ID NO: 1930548 - protein, 6 aa, Staphylococcus
DKSKAL

SEQ ID NO: 1930549 - protein, 20 aa, Staphylococcus
DKSKARAFDKDSRSKVEGQK

SEQ ID NO: 1930550 - protein, 7 aa, Staphylococcus
DKSMPDI

SEQ ID NO: 1930551 - protein, 4 aa, Staphylococcus
DKSN

SEQ ID NO: 1930552 - protein, 7 aa, Staphylococcus
DKSNPNV

SEQ ID NO: 1930553 - protein, 10 aa, Staphylococcus
DKSNRGKGIA

SEQ ID NO: 1930554 - protein, 7 aa, Staphylococcus
DKSPEIG

SEQ ID NO: 1930555 - protein, 6 aa, Staphylococcus
DKSPHA

SEQ ID NO: 1930556 - protein, 8 aa, Staphylococcus
DKSPRGTR

SEQ ID NO: 1930557 - protein, 8 aa, Staphylococcus
DKSPYDGF

SEQ ID NO: 1930558 - protein, 11 aa, Staphylococcus
DKSQIKASYED

SEQ ID NO: 1930559 - protein, 8 aa, Staphylococcus
DKSRDNAW

SEQ ID NO: 1930560 - protein, 6 aa, Staphylococcus
DKSREW

SEQ ID NO: 1930561 - protein, 9 aa, Staphylococcus
DKSRGVRLS

SEQ ID NO: 1930562 - protein, 26 aa, Staphylococcus
DKSRPIKPGKYSSYSTSQALNETLRN

SEQ ID NO: 1930563 - protein, 5 aa, Staphylococcus
DKSSD

SEQ ID NO: 1930564 - protein, 17 aa, Staphylococcus
DKSSDNDLEKSEQEARY

SEQ ID NO: 1930565 - protein, 8 aa, Staphylococcus
DKSTDDTF

SEQ ID NO: 1930566 - protein, 14 aa, Staphylococcus
DKSTDSKGILWGTI

SEQ ID NO: 1930567 - protein, 10 aa, Staphylococcus
DKSTEGLKEA

SEQ ID NO: 1930568 - protein, 5 aa, Staphylococcus
DKSVF

SEQ ID NO: 1930569 - protein, 5 aa, Staphylococcus
DKSVT

SEQ ID NO: 1930570 - protein, 4 aa, Staphylococcus
DKSY

SEQ ID NO: 1930571 - protein, 6 aa, Staphylococcus
DKSYPG

SEQ ID NO: 1930572 - protein, 5 aa, Staphylococcus
DKSYQ

SEQ ID NO: 1930573 - protein, 7 aa, Staphylococcus
DKTDDEI

SEQ ID NO: 1930574 - protein, 7 aa, Staphylococcus
DKTDQDQ

SEQ ID NO: 1930575 - protein, 9 aa, Staphylococcus
DKTDSKIDD

SEQ ID NO: 1930576 - protein, 54 aa, Staphylococcus
DKTEDEAATEAAQQTEHASAQTTESANEQVIDDTTPGNALHTESDEDDERTEVR

SEQ ID NO: 1930577 - protein, 62 aa, Staphylococcus
DKTEDEDATEAAQTENGESNAESTESSSEEVIDDDTPGNALHTEADEETTVSSDEDATDERI

SEQ ID NO: 1930578 - protein, 7 aa, Staphylococcus
DKTEGSL

SEQ ID NO: 1930579 - protein, 7 aa, Staphylococcus
DKTEQDC

SEQ ID NO: 1930580 - protein, 7 aa, Staphylococcus
DKTEQDE

SEQ ID NO: 1930581 - protein, 7 aa, Staphylococcus
DKTGATG

SEQ ID NO: 1930582 - protein, 6 aa, Staphylococcus
DKTGDM

SEQ ID NO: 1930583 - protein, 8 aa, Staphylococcus
DKTGKDST

SEQ ID NO: 1930584 - protein, 8 aa, Staphylococcus
DKTGTDVN

SEQ ID NO: 1930585 - protein, 4 aa, Staphylococcus
DKTI

SEQ ID NO: 1930586 - protein, 18 aa, Staphylococcus
DKTIDSLQKGKVNIEEPG

SEQ ID NO: 1930587 - protein, 4 aa, Staphylococcus
DKTN

SEQ ID NO: 1930588 - protein, 7 aa, Staphylococcus
DKTNEPH

SEQ ID NO: 1930589 - protein, 7 aa, Staphylococcus
DKTNGGS

SEQ ID NO: 1930590 - protein, 5 aa, Staphylococcus
DKTPF

SEQ ID NO: 1930591 - protein, 7 aa, Staphylococcus
DKTPLGE

SEQ ID NO: 1930592 - protein, 7 aa, Staphylococcus
DKTPNPV

SEQ ID NO: 1930593 - protein, 38 aa, Staphylococcus
DKTPTQNINSSDSVGQQSQQQDHYQTENETRTHKGKRM

SEQ ID NO: 1930594 - protein, 11 aa, Staphylococcus
DKTQVKHESPQ

SEQ ID NO: 1930595 - protein, 5 aa, Staphylococcus
DKTRA

SEQ ID NO: 1930596 - protein, 7 aa, Staphylococcus
DKTSIDM

SEQ ID NO: 1930597 - protein, 7 aa, Staphylococcus
DKTSTGI

SEQ ID NO: 1930598 - protein, 11 aa, Staphylococcus
DKTSYHNNGLE

SEQ ID NO: 1930599 - protein, 5 aa, Staphylococcus
DKTTF

SEQ ID NO: 1930600 - protein, 9 aa, Staphylococcus
DKTTQEVES

SEQ ID NO: 1930601 - protein, 7 aa, Staphylococcus
DKTYHHK

SEQ ID NO: 1930602 - protein, 13 aa, Staphylococcus
DKVAETKKRIENE

SEQ ID NO: 1930603 - protein, 12 aa, Staphylococcus
DKVDGDFKNLDN

SEQ ID NO: 1930604 - protein, 7 aa, Staphylococcus
DKVEADV

SEQ ID NO: 1930605 - protein, 7 aa, Staphylococcus
DKVEEYD

SEQ ID NO: 1930606 - protein, 12 aa, Staphylococcus
DKVENYKPSPDG

SEQ ID NO: 1930607 - protein, 14 aa, Staphylococcus
DKVETSPKKQINPE

SEQ ID NO: 1930608 - protein, 4 aa, Staphylococcus
DKVG

SEQ ID NO: 1930609 - protein, 14 aa, Staphylococcus
DKVITSTKDLAEND

SEQ ID NO: 1930610 - protein, 9 aa, Staphylococcus
DKVKKDEYK

SEQ ID NO: 1930611 - protein, 9 aa, Staphylococcus
DKVKKTNSY

SEQ ID NO: 1930612 - protein, 9 aa, Staphylococcus
DKVKQTNSY

SEQ ID NO: 1930613 - protein, 17 aa, Staphylococcus
DKVKSKIELRGDDPKVV

SEQ ID NO: 1930614 - protein, 17 aa, Staphylococcus
DKVKSKIELRGDDSKVV

SEQ ID NO: 1930615 - protein, 8 aa, Staphylococcus
DKVNADVQ

SEQ ID NO: 1930616 - protein, 21 aa, Staphylococcus
DKVNADVQDLNHGTAHCPSPV

SEQ ID NO: 1930617 - protein, 10 aa, Staphylococcus
DKVNGEFSQL

SEQ ID NO: 1930618 - protein, 8 aa, Staphylococcus
DKVNPSSE

SEQ ID NO: 1930619 - protein, 5 aa, Staphylococcus
DKVNR

SEQ ID NO: 1930620 - protein, 7 aa, Staphylococcus
DKVNYSG

SEQ ID NO: 1930621 - protein, 4 aa, Staphylococcus
DKVP

SEQ ID NO: 1930622 - protein, 7 aa, Staphylococcus
DKVPESY

SEQ ID NO: 1930623 - protein, 8 aa, Staphylococcus
DKVQGDID

SEQ ID NO: 1930624 - protein, 9 aa, Staphylococcus
DKVREEGKA

SEQ ID NO: 1930625 - protein, 8 aa, Staphylococcus
DKVRPEGK

SEQ ID NO: 1930626 - protein, 7 aa, Staphylococcus
DKVRQPD

SEQ ID NO: 1930627 - protein, 8 aa, Staphylococcus
DKVSEEEI

SEQ ID NO: 1930628 - protein, 13 aa, Staphylococcus
DKVSGKKLKEKLE

SEQ ID NO: 1930629 - protein, 7 aa, Staphylococcus
DKVSKGD

SEQ ID NO: 1930630 - protein, 16 aa, Staphylococcus
DKVTGKVRKPKDNEKY

SEQ ID NO: 1930631 - protein, 6 aa, Staphylococcus
DKVTGN

SEQ ID NO: 1930632 - protein, 7 aa, Staphylococcus
DKVTNES

SEQ ID NO: 1930633 - protein, 15 aa, Staphylococcus
DKYAYDSSPRVIPNR

SEQ ID NO: 1930634 - protein, 4 aa, Staphylococcus
DKYG

SEQ ID NO: 1930635 - protein, 12 aa, Staphylococcus
DKYGATPSQDHS

SEQ ID NO: 1930636 - protein, 10 aa, Staphylococcus
DKYGKAAAPK

SEQ ID NO: 1930637 - protein, 10 aa, Staphylococcus
DKYGKAEAKK

SEQ ID NO: 1930638 - protein, 10 aa, Staphylococcus
DKYGKDEAKK

SEQ ID NO: 1930639 - protein, 10 aa, Staphylococcus
DKYGKEEAKE

SEQ ID NO: 1930640 - protein, 8 aa, Staphylococcus
DKYGNHYD

SEQ ID NO: 1930641 - protein, 5 aa, Staphylococcus
DKYGY

SEQ ID NO: 1930642 - protein, 6 aa, Staphylococcus
DKYINT

SEQ ID NO: 1930643 - protein, 5 aa, Staphylococcus
DKYLD

SEQ ID NO: 1930644 - protein, 13 aa, Staphylococcus
DKYNEQQRKGWSQ

SEQ ID NO: 1930645 - protein, 20 aa, Staphylococcus
DKYNGCTDETVPENKKRPLK

SEQ ID NO: 1930646 - protein, 6 aa, Staphylococcus
DKYNPS

SEQ ID NO: 1930647 - protein, 6 aa, Staphylococcus
DKYPNV

SEQ ID NO: 1930648 - protein, 18 aa, Staphylococcus
DKYPSEISGGQKQRASAA

SEQ ID NO: 1930649 - protein, 18 aa, Staphylococcus
DKYPSEISGGQRQRTSAA

SEQ ID NO: 1930650 - protein, 15 aa, Staphylococcus
DKYSHEKAVQNSAIS

SEQ ID NO: 1930651 - protein, 9 aa, Staphylococcus
DKYSLADEK

SEQ ID NO: 1930652 - protein, 9 aa, Staphylococcus
DKYSPFPEE

SEQ ID NO: 1930653 - protein, 10 aa, Staphylococcus
DKYTRDRQYS

SEQ ID NO: 1930654 - protein, 23 aa, Staphylococcus
DKYYDSESQHTRDNSTNTKQDEW

SEQ ID NO: 1930655 - protein, 7 aa, Staphylococcus
DKYYESR

SEQ ID NO: 1930656 - protein, 5 aa, Staphylococcus
DLAAK

SEQ ID NO: 1930657 - protein, 13 aa, Staphylococcus
DLADAKAAIKTKD

SEQ ID NO: 1930658 - protein, 9 aa, Staphylococcus
DLADGDAGI

SEQ ID NO: 1930659 - protein, 5 aa, Staphylococcus
DLAEE

SEQ ID NO: 1930660 - protein, 14 aa, Staphylococcus
DLAESEINGKDSED

SEQ ID NO: 1930661 - protein, 9 aa, Staphylococcus
DLAETEEDL

SEQ ID NO: 1930662 - protein, 12 aa, Staphylococcus
DLAETKEAIKNK

SEQ ID NO: 1930663 - protein, 9 aa, Staphylococcus
DLAGEDDAD

SEQ ID NO: 1930664 - protein, 8 aa, Staphylococcus
DLAKATQR

SEQ ID NO: 1930665 - protein, 7 aa, Staphylococcus
DLAKGAK

SEQ ID NO: 1930666 - protein, 9 aa, Staphylococcus
DLANAGAQV

SEQ ID NO: 1930667 - protein, 9 aa, Staphylococcus
DLANEKNEV

SEQ ID NO: 1930668 - protein, 8 aa, Staphylococcus
DLANGEAN

SEQ ID NO: 1930669 - protein, 9 aa, Staphylococcus
DLANGKADI

SEQ ID NO: 1930670 - protein, 9 aa, Staphylococcus
DLANGKAEM

SEQ ID NO: 1930671 - protein, 8 aa, Staphylococcus
DLANGNAD

SEQ ID NO: 1930672 - protein, 5 aa, Staphylococcus
DLANN

SEQ ID NO: 1930673 - protein, 10 aa, Staphylococcus
DLANSQQIKD

SEQ ID NO: 1930674 - protein, 11 aa, Staphylococcus
DLAQKGDRDTI

SEQ ID NO: 1930675 - protein, 5 aa, Staphylococcus
DLAQS

SEQ ID NO: 1930676 - protein, 9 aa, Staphylococcus
DLASENEIE

SEQ ID NO: 1930677 - protein, 7 aa, Staphylococcus
DLASTHA

SEQ ID NO: 1930678 - protein, 7 aa, Staphylococcus
DLATETE

SEQ ID NO: 1930679 - protein, 6 aa, Staphylococcus
DLDAQA

SEQ ID NO: 1930680 - protein, 8 aa, Staphylococcus
DLDDDFED

SEQ ID NO: 1930681 - protein, 8 aa, Staphylococcus
DLDDETIQ

SEQ ID NO: 1930682 - protein, 8 aa, Staphylococcus
DLDDTLDR

SEQ ID NO: 1930683 - protein, 6 aa, Staphylococcus
DLDESL

SEQ ID NO: 1930684 - protein, 8 aa, Staphylococcus
DLDGQTLG

SEQ ID NO: 1930685 - protein, 8 aa, Staphylococcus
DLDKAADA

SEQ ID NO: 1930686 - protein, 12 aa, Staphylococcus
DLDKKESLNQNV

SEQ ID NO: 1930687 - protein, 6 aa, Staphylococcus
DLDKKS

SEQ ID NO: 1930688 - protein, 9 aa, Staphylococcus
DLDKPVEDY

SEQ ID NO: 1930689 - protein, 37 aa, Staphylococcus
DLDNLSKEKEKLQQKKQDKKTLNKINDAENKIKKTHE

SEQ ID NO: 1930690 - protein, 4 aa, Staphylococcus
DLDP

SEQ ID NO: 1930691 - protein, 7 aa, Staphylococcus
DLDPKID

SEQ ID NO: 1930692 - protein, 7 aa, Staphylococcus
DLDPVSA

SEQ ID NO: 1930693 - protein, 8 aa, Staphylococcus
DLDRIKDR

SEQ ID NO: 1930694 - protein, 10 aa, Staphylococcus
DLDSQTEEEF

SEQ ID NO: 1930695 - protein, 11 aa, Staphylococcus
DLDSQTEEEFN

SEQ ID NO: 1930696 - protein, 7 aa, Staphylococcus
DLDTDGE

SEQ ID NO: 1930697 - protein, 29 aa, Staphylococcus
DLDTKIEKQSSENSAIESEIKKNSSYERI

SEQ ID NO: 1930698 - protein, 14 aa, Staphylococcus
DLDTTNRYSEFKTI

SEQ ID NO: 1930699 - protein, 14 aa, Staphylococcus
DLEAQHVSVEVVKH

SEQ ID NO: 1930700 - protein, 6 aa, Staphylococcus
DLEDQG

SEQ ID NO: 1930701 - protein, 11 aa, Staphylococcus
DLEDRKPSKGL

SEQ ID NO: 1930702 - protein, 6 aa, Staphylococcus
DLEEQG

SEQ ID NO: 1930703 - protein, 16 aa, Staphylococcus
DLEETNRDGHDVLVWT

SEQ ID NO: 1930704 - protein, 5 aa, Staphylococcus
DLEGH

SEQ ID NO: 1930705 - protein, 6 aa, Staphylococcus
DLEGNT

SEQ ID NO: 1930706 - protein, 5 aa, Staphylococcus
DLEGQ

SEQ ID NO: 1930707 - protein, 12 aa, Staphylococcus
DLEGTNDETYEN

SEQ ID NO: 1930708 - protein, 4 aa, Staphylococcus
DLEK

SEQ ID NO: 1930709 - protein, 12 aa, Staphylococcus
DLEKKESLNQNV

SEQ ID NO: 1930710 - protein, 12 aa, Staphylococcus
DLEKKESLNQQI

SEQ ID NO: 1930711 - protein, 13 aa, Staphylococcus
DLEKRESVNQQVD

SEQ ID NO: 1930712 - protein, 15 aa, Staphylococcus
DLEKTKKKQEKPTKM

SEQ ID NO: 1930713 - protein, 9 aa, Staphylococcus
DLENELGSP

SEQ ID NO: 1930714 - protein, 13 aa, Staphylococcus
DLENGTSSEPKTL

SEQ ID NO: 1930715 - protein, 6 aa, Staphylococcus
DLENIS

SEQ ID NO: 1930716 - protein, 5 aa, Staphylococcus
DLENK

SEQ ID NO: 1930717 - protein, 6 aa, Staphylococcus
DLENQT

SEQ ID NO: 1930718 - protein, 7 aa, Staphylococcus
DLEPGGK

SEQ ID NO: 1930719 - protein, 5 aa, Staphylococcus
DLEPR

SEQ ID NO: 1930720 - protein, 5 aa, Staphylococcus
DLEQN

SEQ ID NO: 1930721 - protein, 11 aa, Staphylococcus
DLEQNGYNAYE

SEQ ID NO: 1930722 - protein, 4 aa, Staphylococcus
DLER

SEQ ID NO: 1930723 - protein, 11 aa, Staphylococcus
DLEREARRYEN

SEQ ID NO: 1930724 - protein, 12 aa, Staphylococcus
DLERNKGESNYL

SEQ ID NO: 1930725 - protein, 4 aa, Staphylococcus
DLES

SEQ ID NO: 1930726 - protein, 18 aa, Staphylococcus
DLESGAPTEALTGENEGY

SEQ ID NO: 1930727 - protein, 4 aa, Staphylococcus
DLET

SEQ ID NO: 1930728 - protein, 18 aa, Staphylococcus
DLETDEPTEALTGENEAS

SEQ ID NO: 1930729 - protein, 5 aa, Staphylococcus
DLETH

SEQ ID NO: 1930730 - protein, 4 aa, Staphylococcus
DLGE

SEQ ID NO: 1930731 - protein, 9 aa, Staphylococcus
DLGEQTDNV

SEQ ID NO: 1930732 - protein, 18 aa, Staphylococcus
DLGGTTSTSQFFEYLYKS

SEQ ID NO: 1930733 - protein, 11 aa, Staphylococcus
DLGHKSRDTHQ

SEQ ID NO: 1930734 - protein, 6 aa, Staphylococcus
DLGIST

SEQ ID NO: 1930735 - protein, 4 aa, Staphylococcus
DLGK

SEQ ID NO: 1930736 - protein, 7 aa, Staphylococcus
DLGLKEG

SEQ ID NO: 1930737 - protein, 7 aa, Staphylococcus
DLGPADS

SEQ ID NO: 1930738 - protein, 4 aa, Staphylococcus
DLGQ

SEQ ID NO: 1930739 - protein, 11 aa, Staphylococcus
DLGQDTTNGEW

SEQ ID NO: 1930740 - protein, 4 aa, Staphylococcus
DLGR

SEQ ID NO: 1930741 - protein, 5 aa, Staphylococcus
DLGRR

SEQ ID NO: 1930742 - protein, 5 aa, Staphylococcus
DLGSD

SEQ ID NO: 1930743 - protein, 9 aa, Staphylococcus
DLGSREGIA

SEQ ID NO: 1930744 - protein, 5 aa, Staphylococcus
DLGYQ

SEQ ID NO: 1930745 - protein, 12 aa, Staphylococcus
DLGYQPGLQPYT

SEQ ID NO: 1930746 - protein, 18 aa, Staphylococcus
DLKDSNLEEEINLLRGLR

SEQ ID NO: 1930747 - protein, 4 aa, Staphylococcus
DLKE

SEQ ID NO: 1930748 - protein, 6 aa, Staphylococcus
DLKEAN

SEQ ID NO: 1930749 - protein, 8 aa, Staphylococcus
DLKEASDQ

SEQ ID NO: 1930750 - protein, 14 aa, Staphylococcus
DLKEEEINGKDSED

SEQ ID NO: 1930751 - protein, 12 aa, Staphylococcus
DLKEKLKPYSWG

SEQ ID NO: 1930752 - protein, 8 aa, Staphylococcus
DLKEQQEY

SEQ ID NO: 1930753 - protein, 12 aa, Staphylococcus
DLKGDHEKAEEI

SEQ ID NO: 1930754 - protein, 16 aa, Staphylococcus
DLKGKQANKEAEQSQI

SEQ ID NO: 1930755 - protein, 10 aa, Staphylococcus
DLKGPVTEFN

SEQ ID NO: 1930756 - protein, 6 aa, Staphylococcus
DLKGRT

SEQ ID NO: 1930757 - protein, 7 aa, Staphylococcus
DLKGRTV

SEQ ID NO: 1930758 - protein, 5 aa, Staphylococcus
DLKGY

SEQ ID NO: 1930759 - protein, 12 aa, Staphylococcus
DLKNGQSVEVPT

SEQ ID NO: 1930760 - protein, 8 aa, Staphylococcus
DLKPDNLH

SEQ ID NO: 1930761 - protein, 7 aa, Staphylococcus
DLKPEQL

SEQ ID NO: 1930762 - protein, 7 aa, Staphylococcus
DLKPKQL

SEQ ID NO: 1930763 - protein, 5 aa, Staphylococcus
DLKPP

SEQ ID NO: 1930764 - protein, 11 aa, Staphylococcus
DLKQKPDPKNL

SEQ ID NO: 1930765 - protein, 12 aa, Staphylococcus
DLKQQISQQGIE

SEQ ID NO: 1930766 - protein, 5 aa, Staphylococcus
DLKQT

SEQ ID NO: 1930767 - protein, 18 aa, Staphylococcus
DLKRAKYAGIEKQTLKGK

SEQ ID NO: 1930768 - protein, 18 aa, Staphylococcus
DLKRAKYAGIEQQKLKGK

SEQ ID NO: 1930769 - protein, 17 aa, Staphylococcus
DLKRAKYSGIEQQRLKG

SEQ ID NO: 1930770 - protein, 6 aa, Staphylococcus
DLKRNN

SEQ ID NO: 1930771 - protein, 19 aa, Staphylococcus
DLKRTPSFSVDKPNETSGI

SEQ ID NO: 1930772 - protein, 8 aa, Staphylococcus
DLKSDKLH

SEQ ID NO: 1930773 - protein, 6 aa, Staphylococcus
DLKSKI

SEQ ID NO: 1930774 - protein, 7 aa, Staphylococcus
DLKSKIS

SEQ ID NO: 1930775 - protein, 8 aa, Staphylococcus
DLKSNKLH

SEQ ID NO: 1930776 - protein, 16 aa, Staphylococcus
DLKSQQADKEAKQAQI

SEQ ID NO: 1930777 - protein, 15 aa, Staphylococcus
DLKTGKEYRKDEVVE

SEQ ID NO: 1930778 - protein, 5 aa, Staphylococcus
DLKTQ

SEQ ID NO: 1930779 - protein, 9 aa, Staphylococcus
DLKTRTRHK

SEQ ID NO: 1930780 - protein, 5 aa, Staphylococcus
DLLKQ

SEQ ID NO: 1930781 - protein, 9 aa, Staphylococcus
DLNAADEEA

SEQ ID NO: 1930782 - protein, 7 aa, Staphylococcus
DLNDDEI

SEQ ID NO: 1930783 - protein, 10 aa, Staphylococcus
DLNDDFDESI

SEQ ID NO: 1930784 - protein, 10 aa, Staphylococcus
DLNDKKIQEI

SEQ ID NO: 1930785 - protein, 17 aa, Staphylococcus
DLNDSQELTFDVQKPLA

SEQ ID NO: 1930786 - protein, 5 aa, Staphylococcus
DLNEE

SEQ ID NO: 1930787 - protein, 16 aa, Staphylococcus
DLNGENNMDIEEATIE

SEQ ID NO: 1930788 - protein, 10 aa, Staphylococcus
DLNGKSPFDR

SEQ ID NO: 1930789 - protein, 7 aa, Staphylococcus
DLNGRTL

SEQ ID NO: 1930790 - protein, 6 aa, Staphylococcus
DLNGTS

SEQ ID NO: 1930791 - protein, 11 aa, Staphylococcus
DLNGTSELDGD

SEQ ID NO: 1930792 - protein, 9 aa, Staphylococcus
DLNHTGAHK

SEQ ID NO: 1930793 - protein, 16 aa, Staphylococcus
DLNKDQRIGPDPDTFE

SEQ ID NO: 1930794 - protein, 4 aa, Staphylococcus
DLNN

SEQ ID NO: 1930795 - protein, 5 aa, Staphylococcus
DLNNE

SEQ ID NO: 1930796 - protein, 18 aa, Staphylococcus
DLNNKGSAFPESLSGGMK

SEQ ID NO: 1930797 - protein, 11 aa, Staphylococcus
DLNPSAAKTQH

SEQ ID NO: 1930798 - protein, 4 aa, Staphylococcus
DLNQ

SEQ ID NO: 1930799 - protein, 8 aa, Staphylococcus
DLNSGEMK

SEQ ID NO: 1930800 - protein, 9 aa, Staphylococcus
DLNSGETQV

SEQ ID NO: 1930801 - protein, 11 aa, Staphylococcus
DLNSGQSHTYE

SEQ ID NO: 1930802 - protein, 6 aa, Staphylococcus
DLNSKD

SEQ ID NO: 1930803 - protein, 14 aa, Staphylococcus
DLNTGKVQEPDTGC

SEQ ID NO: 1930804 - protein, 8 aa, Staphylococcus
DLNTTGDF

SEQ ID NO: 1930805 - protein, 6 aa, Staphylococcus
DLPASK

SEQ ID NO: 1930806 - protein, 6 aa, Staphylococcus
DLPASQ

SEQ ID NO: 1930807 - protein, 6 aa, Staphylococcus
DLPASR

SEQ ID NO: 1930808 - protein, 7 aa, Staphylococcus
DLPASTM

SEQ ID NO: 1930809 - protein, 4 aa, Staphylococcus
DLPD

SEQ ID NO: 1930810 - protein, 5 aa, Staphylococcus
DLPDE

SEQ ID NO: 1930811 - protein, 6 aa, Staphylococcus
DLPDNN

SEQ ID NO: 1930812 - protein, 11 aa, Staphylococcus
DLPEDADTQTI

SEQ ID NO: 1930813 - protein, 5 aa, Staphylococcus
DLPEG

SEQ ID NO: 1930814 - protein, 6 aa, Staphylococcus
DLPEKA

SEQ ID NO: 1930815 - protein, 7 aa, Staphylococcus
DLPENAD

SEQ ID NO: 1930816 - protein, 6 aa, Staphylococcus
DLPENN

SEQ ID NO: 1930817 - protein, 6 aa, Staphylococcus
DLPETE

SEQ ID NO: 1930818 - protein, 4 aa, Staphylococcus
DLPG

SEQ ID NO: 1930819 - protein, 7 aa, Staphylococcus
DLPGALQ

SEQ ID NO: 1930820 - protein, 9 aa, Staphylococcus
DLPGPIHQD

SEQ ID NO: 1930821 - protein, 7 aa, Staphylococcus
DLPGPIY

SEQ ID NO: 1930822 - protein, 8 aa, Staphylococcus
DLPGRSHE

SEQ ID NO: 1930823 - protein, 9 aa, Staphylococcus
DLPKDADNL

SEQ ID NO: 1930824 - protein, 16 aa, Staphylococcus
DLPKSVETSNINPLSP

SEQ ID NO: 1930825 - protein, 13 aa, Staphylococcus
DLPNANPKTNVIP

SEQ ID NO: 1930826 - protein, 5 aa, Staphylococcus
DLPNE

SEQ ID NO: 1930827 - protein, 14 aa, Staphylococcus
DLPNEEKPAYGQQV

SEQ ID NO: 1930828 - protein, 5 aa, Staphylococcus
DLPNI

SEQ ID NO: 1930829 - protein, 7 aa, Staphylococcus
DLPNPLA

SEQ ID NO: 1930830 - protein, 4 aa, Staphylococcus
DLPP

SEQ ID NO: 1930831 - protein, 4 aa, Staphylococcus
DLPQ

SEQ ID NO: 1930832 - protein, 6 aa, Staphylococcus
DLPQNA

SEQ ID NO: 1930833 - protein, 6 aa, Staphylococcus
DLPQQA

SEQ ID NO: 1930834 - protein, 5 aa, Staphylococcus
DLPSR

SEQ ID NO: 1930835 - protein, 7 aa, Staphylococcus
DLPTGSK

SEQ ID NO: 1930836 - protein, 10 aa, Staphylococcus
DLPTSNAIKS

SEQ ID NO: 1930837 - protein, 12 aa, Staphylococcus
DLPTTEEDDEEM

SEQ ID NO: 1930838 - protein, 12 aa, Staphylococcus
DLPTTEEDEEEM

SEQ ID NO: 1930839 - protein, 12 aa, Staphylococcus
DLPTTQEDEEEM

SEQ ID NO: 1930840 - protein, 20 aa, Staphylococcus
DLPTTTIGSFPQSQEVRKYR

SEQ ID NO: 1930841 - protein, 6 aa, Staphylococcus
DLPYDA

SEQ ID NO: 1930842 - protein, 31 aa, Staphylococcus
DLQAHTDRNDKPIATIESNHKENKIPDSEKK

SEQ ID NO: 1930843 - protein, 8 aa, Staphylococcus
DLQARGEK

SEQ ID NO: 1930844 - protein, 12 aa, Staphylococcus
DLQEEISAEVNN

SEQ ID NO: 1930845 - protein, 8 aa, Staphylococcus
DLQGQYDK

SEQ ID NO: 1930846 - protein, 14 aa, Staphylococcus
DLQPGKIRNSNGPM

SEQ ID NO: 1930847 - protein, 8 aa, Staphylococcus
DLQPKDRN

SEQ ID NO: 1930848 - protein, 4 aa, Staphylococcus
DLQS

SEQ ID NO: 1930849 - protein, 10 aa, Staphylococcus
DLQTSKLTES

SEQ ID NO: 1930850 - protein, 14 aa, Staphylococcus
DLRAGQSKEEFDKA

SEQ ID NO: 1930851 - protein, 13 aa, Staphylococcus
DLRNGKQVEVPTY

SEQ ID NO: 1930852 - protein, 6 aa, Staphylococcus
DLRPDQ

SEQ ID NO: 1930853 - protein, 20 aa, Staphylococcus
DLRPKQSKLSKIERAEASNP

SEQ ID NO: 1930854 - protein, 14 aa, Staphylococcus
DLRPKTKKRKINEY

SEQ ID NO: 1930855 - protein, 19 aa, Staphylococcus
DLRQGYEYSRTANPTRGAI

SEQ ID NO: 1930856 - protein, 19 aa, Staphylococcus
DLRQGYEYSRTANPTRTSI

SEQ ID NO: 1930857 - protein, 16 aa, Staphylococcus
DLRQNDEKSVSDITDD

SEQ ID NO: 1930858 - protein, 14 aa, Staphylococcus
DLRSGEVQEPDTGC

SEQ ID NO: 1930859 - protein, 4 aa, Staphylococcus
DLSA

SEQ ID NO: 1930860 - protein, 16 aa, Staphylococcus
DLSADTCCEPRPGCGH

SEQ ID NO: 1930861 - protein, 5 aa, Staphylococcus
DLSAS

SEQ ID NO: 1930862 - protein, 4 aa, Staphylococcus
DLSD

SEQ ID NO: 1930863 - protein, 15 aa, Staphylococcus
DLSDQQSLEQAMQGQ

SEQ ID NO: 1930864 - protein, 4 aa, Staphylococcus
DLSE

SEQ ID NO: 1930865 - protein, 9 aa, Staphylococcus
DLSEDENLD

SEQ ID NO: 1930866 - protein, 11 aa, Staphylococcus
DLSEDITPYEG

SEQ ID NO: 1930867 - protein, 7 aa, Staphylococcus
DLSEPKK

SEQ ID NO: 1930868 - protein, 5 aa, Staphylococcus
DLSFG

SEQ ID NO: 1930869 - protein, 10 aa, Staphylococcus
DLSGGERTKV

SEQ ID NO: 1930870 - protein, 4 aa, Staphylococcus
DLSK

SEQ ID NO: 1930871 - protein, 8 aa, Staphylococcus
DLSKDENV

SEQ ID NO: 1930872 - protein, 10 aa, Staphylococcus
DLSKKTIRHE

SEQ ID NO: 1930873 - protein, 11 aa, Staphylococcus
DLSKNNQYELN

SEQ ID NO: 1930874 - protein, 6 aa, Staphylococcus
DLSKSF

SEQ ID NO: 1930875 - protein, 12 aa, Staphylococcus
DLSNAGAHVKDE

SEQ ID NO: 1930876 - protein, 10 aa, Staphylococcus
DLSNAGANVV

SEQ ID NO: 1930877 - protein, 6 aa, Staphylococcus
DLSNAN

SEQ ID NO: 1930878 - protein, 8 aa, Staphylococcus
DLSNEEEI

SEQ ID NO: 1930879 - protein, 13 aa, Staphylococcus
DLSNEEKPKFGQA

SEQ ID NO: 1930880 - protein, 5 aa, Staphylococcus
DLSNL

SEQ ID NO: 1930881 - protein, 8 aa, Staphylococcus
DLSPQDGK

SEQ ID NO: 1930882 - protein, 9 aa, Staphylococcus
DLSPQDGKL

SEQ ID NO: 1930883 - protein, 9 aa, Staphylococcus
DLSPQDGKV

SEQ ID NO: 1930884 - protein, 8 aa, Staphylococcus
DLSPQDGQ

SEQ ID NO: 1930885 - protein, 11 aa, Staphylococcus
DLSQEDAKARV

SEQ ID NO: 1930886 - protein, 10 aa, Staphylococcus
DLSQEEAKAR

SEQ ID NO: 1930887 - protein, 6 aa, Staphylococcus
DLSRSF

SEQ ID NO: 1930888 - protein, 5 aa, Staphylococcus
DLSSE

SEQ ID NO: 1930889 - protein, 8 aa, Staphylococcus
DLSSNTLT

SEQ ID NO: 1930890 - protein, 8 aa, Staphylococcus
DLSSRTGE

SEQ ID NO: 1930891 - protein, 7 aa, Staphylococcus
DLSSTDM

SEQ ID NO: 1930892 - protein, 7 aa, Staphylococcus
DLSSTHA

SEQ ID NO: 1930893 - protein, 5 aa, Staphylococcus
DLSTQ

SEQ ID NO: 1930894 - protein, 6 aa, Staphylococcus
DLSTSQ

SEQ ID NO: 1930895 - protein, 5 aa, Staphylococcus
DLTDD

SEQ ID NO: 1930896 - protein, 13 aa, Staphylococcus
DLTDVSSKSIQRD

SEQ ID NO: 1930897 - protein, 32 aa, Staphylococcus
DLTEAEKQQAQQAEQAQAQQTAAENEENNKEN

SEQ ID NO: 1930898 - protein, 5 aa, Staphylococcus
DLTEE

SEQ ID NO: 1930899 - protein, 6 aa, Staphylococcus
DLTEGE

SEQ ID NO: 1930900 - protein, 9 aa, Staphylococcus
DLTEKAEQH

SEQ ID NO: 1930901 - protein, 16 aa, Staphylococcus
DLTERRESKQPLEYPS

SEQ ID NO: 1930902 - protein, 11 aa, Staphylococcus
DLTESITPYEG

SEQ ID NO: 1930903 - protein, 5 aa, Staphylococcus
DLTGA

SEQ ID NO: 1930904 - protein, 6 aa, Staphylococcus
DLTKKG

SEQ ID NO: 1930905 - protein, 14 aa, Staphylococcus
DLTKSKKQQSEYED

SEQ ID NO: 1930906 - protein, 6 aa, Staphylococcus
DLTNDD

SEQ ID NO: 1930907 - protein, 8 aa, Staphylococcus
DLTPQTSK

SEQ ID NO: 1930908 - protein, 10 aa, Staphylococcus
DLTQEEAKAR

SEQ ID NO: 1930909 - protein, 15 aa, Staphylococcus
DLTQEELAERTDLSK

SEQ ID NO: 1930910 - protein, 11 aa, Staphylococcus
DLTQQSKERII

SEQ ID NO: 1930911 - protein, 17 aa, Staphylococcus
DLTRENAKEMISQNQRQ

SEQ ID NO: 1930912 - protein, 15 aa, Staphylococcus
DLTRNSEVIDETNHD

SEQ ID NO: 1930913 - protein, 6 aa, Staphylococcus
DLTSKA

SEQ ID NO: 1930914 - protein, 10 aa, Staphylococcus
DLTSLEKQHD

SEQ ID NO: 1930915 - protein, 7 aa, Staphylococcus
DLTTDFG

SEQ ID NO: 1930916 - protein, 9 aa, Staphylococcus
DLTTKTSEF

SEQ ID NO: 1930917 - protein, 10 aa, Staphylococcus
DLTTQDNQEY

SEQ ID NO: 1930918 - protein, 10 aa, Staphylococcus
DLVKDAENIT

SEQ ID NO: 1930919 - protein, 10 aa, Staphylococcus
DLVNPPEDKF

SEQ ID NO: 1930920 - protein, 9 aa, Staphylococcus
DLYSEGTTI

SEQ ID NO: 1930921 - protein, 9 aa, Staphylococcus
DLYTQEHGH

SEQ ID NO: 1930922 - protein, 18 aa, Staphylococcus
DMDDLRAKAKEAVESGKY

SEQ ID NO: 1930923 - protein, 18 aa, Staphylococcus
DMDDLRAKAKEAVESGQY

SEQ ID NO: 1930924 - protein, 7 aa, Staphylococcus
DMDEEGL

SEQ ID NO: 1930925 - protein, 6 aa, Staphylococcus
DMDNSV

SEQ ID NO: 1930926 - protein, 5 aa, Staphylococcus
DMDPV

SEQ ID NO: 1930927 - protein, 18 aa, Staphylococcus
DMEDLRAKAKEAVESGQY

SEQ ID NO: 1930928 - protein, 6 aa, Staphylococcus
DMEDSG

SEQ ID NO: 1930929 - protein, 7 aa, Staphylococcus
DMEKDGK

SEQ ID NO: 1930930 - protein, 8 aa, Staphylococcus
DMEKERPM

SEQ ID NO: 1930931 - protein, 5 aa, Staphylococcus
DMELD

SEQ ID NO: 1930932 - protein, 11 aa, Staphylococcus
DMESENKQIPL

SEQ ID NO: 1930933 - protein, 7 aa, Staphylococcus
DMGGDYD

SEQ ID NO: 1930934 - protein, 12 aa, Staphylococcus
DMGTFEQDNQYD

SEQ ID NO: 1930935 - protein, 5 aa, Staphylococcus
DMHEE

SEQ ID NO: 1930936 - protein, 4 aa, Staphylococcus
DMIE

SEQ ID NO: 1930937 - protein, 13 aa, Staphylococcus
DMKDSIEDQGYDV

SEQ ID NO: 1930938 - protein, 13 aa, Staphylococcus
DMKEEKKEKEWSG

SEQ ID NO: 1930939 - protein, 11 aa, Staphylococcus
DMKQEQGDNAV

SEQ ID NO: 1930940 - protein, 8 aa, Staphylococcus
DMNDKETI

SEQ ID NO: 1930941 - protein, 5 aa, Staphylococcus
DMNEV

SEQ ID NO: 1930942 - protein, 8 aa, Staphylococcus
DMNKPVTI

SEQ ID NO: 1930943 - protein, 12 aa, Staphylococcus
DMNNTSAPIRPE

SEQ ID NO: 1930944 - protein, 8 aa, Staphylococcus
DMNTGEEQ

SEQ ID NO: 1930945 - protein, 5 aa, Staphylococcus
DMPAS

SEQ ID NO: 1930946 - protein, 8 aa, Staphylococcus
DMPDAEDN

SEQ ID NO: 1930947 - protein, 7 aa, Staphylococcus
DMPDAQD

SEQ ID NO: 1930948 - protein, 13 aa, Staphylococcus
DMPDDEKDKRGID

SEQ ID NO: 1930949 - protein, 13 aa, Staphylococcus
DMPDEEKDKRGID

SEQ ID NO: 1930950 - protein, 7 aa, Staphylococcus
DMPNAED

SEQ ID NO: 1930951 - protein, 6 aa, Staphylococcus
DMPSAL

SEQ ID NO: 1930952 - protein, 8 aa, Staphylococcus
DMQDSSKD

SEQ ID NO: 1930953 - protein, 4 aa, Staphylococcus
DMQQ

SEQ ID NO: 1930954 - protein, 6 aa, Staphylococcus
DMQRAA

SEQ ID NO: 1930955 - protein, 10 aa, Staphylococcus
DMQSETQAVD

SEQ ID NO: 1930956 - protein, 12 aa, Staphylococcus
DMRNESSPIRPE

SEQ ID NO: 1930957 - protein, 15 aa, Staphylococcus
DMSANTKVRIDGSKN

SEQ ID NO: 1930958 - protein, 7 aa, Staphylococcus
DMSDDET

SEQ ID NO: 1930959 - protein, 9 aa, Staphylococcus
DMSKGEQTL

SEQ ID NO: 1930960 - protein, 5 aa, Staphylococcus
DMSPE

SEQ ID NO: 1930961 - protein, 6 aa, Staphylococcus
DMSPES

SEQ ID NO: 1930962 - protein, 10 aa, Staphylococcus
DMSTGETETI

SEQ ID NO: 1930963 - protein, 8 aa, Staphylococcus
DMSTNEIK

SEQ ID NO: 1930964 - protein, 6 aa, Staphylococcus
DMSTNV

SEQ ID NO: 1930965 - protein, 7 aa, Staphylococcus
DMSTNVP

SEQ ID NO: 1930966 - protein, 6 aa, Staphylococcus
DMTANT

SEQ ID NO: 1930967 - protein, 6 aa, Staphylococcus
DMTEGY

SEQ ID NO: 1930968 - protein, 11 aa, Staphylococcus
DMTEKDIKDEI

SEQ ID NO: 1930969 - protein, 8 aa, Staphylococcus
DMTESGSY

SEQ ID NO: 1930970 - protein, 8 aa, Staphylococcus
DMTKNAES

SEQ ID NO: 1930971 - protein, 12 aa, Staphylococcus
DMTLSEKVTSGN

SEQ ID NO: 1930972 - protein, 6 aa, Staphylococcus
DMTPET

SEQ ID NO: 1930973 - protein, 8 aa, Staphylococcus
DMTSSHPK

SEQ ID NO: 1930974 - protein, 17 aa, Staphylococcus
DMTSYTRSEYKKIEKPN

SEQ ID NO: 1930975 - protein, 8 aa, Staphylococcus
DMTTQEDI

SEQ ID NO: 1930976 - protein, 6 aa, Staphylococcus
DMTTSV

SEQ ID NO: 1930977 - protein, 12 aa, Staphylococcus
DNADQETVEKNN

SEQ ID NO: 1930978 - protein, 17 aa, Staphylococcus
DNAEKYETLLDDIEAYV

SEQ ID NO: 1930979 - protein, 5 aa, Staphylococcus
DNAEM

SEQ ID NO: 1930980 - protein, 9 aa, Staphylococcus
DNAEQELTN

SEQ ID NO: 1930981 - protein, 7 aa, Staphylococcus
DNAGTSF

SEQ ID NO: 1930982 - protein, 6 aa, Staphylococcus
DNAKEH

SEQ ID NO: 1930983 - protein, 10 aa, Staphylococcus
DNAKQVKANQ

SEQ ID NO: 1930984 - protein, 8 aa, Staphylococcus
DNANKEDI

SEQ ID NO: 1930985 - protein, 5 aa, Staphylococcus
DNAPD

SEQ ID NO: 1930986 - protein, 12 aa, Staphylococcus
DNAPEEKERGIT

SEQ ID NO: 1930987 - protein, 6 aa, Staphylococcus
DNAPVL

SEQ ID NO: 1930988 - protein, 5 aa, Staphylococcus
DNAQQ

SEQ ID NO: 1930989 - protein, 5 aa, Staphylococcus
DNASF

SEQ ID NO: 1930990 - protein, 7 aa, Staphylococcus
DNATNVP

SEQ ID NO: 1930991 - protein, 44 aa, Staphylococcus
DNAVQEQVKEATRQSTPSNQSSNFGNQQTSGKSFEELANKYRII

SEQ ID NO: 1930992 - protein, 8 aa, Staphylococcus
DNAYKTET

SEQ ID NO: 1930993 - protein, 6 aa, Staphylococcus
DNAYSN

SEQ ID NO: 1930994 - protein, 8 aa, Staphylococcus
DNCTDPFE

SEQ ID NO: 1930995 - protein, 15 aa, Staphylococcus
DNDAEKWKEIDTFSF

SEQ ID NO: 1930996 - protein, 7 aa, Staphylococcus
DNDEEAE

SEQ ID NO: 1930997 - protein, 8 aa, Staphylococcus
DNDEEAEF

SEQ ID NO: 1930998 - protein, 7 aa, Staphylococcus
DNDEEIG

SEQ ID NO: 1930999 - protein, 5 aa, Staphylococcus
DNDEI

SEQ ID NO: 1931000 - protein, 6 aa, Staphylococcus
DNDETI

SEQ ID NO: 1931001 - protein, 4 aa, Staphylococcus
DNDH

SEQ ID NO: 1931002 - protein, 9 aa, Staphylococcus
DNDIPGTDY

SEQ ID NO: 1931003 - protein, 8 aa, Staphylococcus
DNDIRSKA

SEQ ID NO: 1931004 - protein, 5 aa, Staphylococcus
DNDIY

SEQ ID NO: 1931005 - protein, 9 aa, Staphylococcus
DNDKHKATL

SEQ ID NO: 1931006 - protein, 7 aa, Staphylococcus
DNDKIGD

SEQ ID NO: 1931007 - protein, 6 aa, Staphylococcus
DNDKKL

SEQ ID NO: 1931008 - protein, 6 aa, Staphylococcus
DNDKQS

SEQ ID NO: 1931009 - protein, 6 aa, Staphylococcus
DNDKYT

SEQ ID NO: 1931010 - protein, 4 aa, Staphylococcus
DNDN

SEQ ID NO: 1931011 - protein, 8 aa, Staphylococcus
DNDNQPIG

SEQ ID NO: 1931012 - protein, 25 aa, Staphylococcus
DNDPNTQDKRMKRAGLGQPDAPGFE

SEQ ID NO: 1931013 - protein, 5 aa, Staphylococcus
DNDPV

SEQ ID NO: 1931014 - protein, 4 aa, Staphylococcus
DNDQ

SEQ ID NO: 1931015 - protein, 6 aa, Staphylococcus
DNDQDE

SEQ ID NO: 1931016 - protein, 5 aa, Staphylococcus
DNDQS

SEQ ID NO: 1931017 - protein, 7 aa, Staphylococcus
DNDRKSV

SEQ ID NO: 1931018 - protein, 7 aa, Staphylococcus
DNDSDRN

SEQ ID NO: 1931019 - protein, 7 aa, Staphylococcus
DNDSRTH

SEQ ID NO: 1931020 - protein, 7 aa, Staphylococcus
DNDTQTV

SEQ ID NO: 1931021 - protein, 5 aa, Staphylococcus
DNDTV

SEQ ID NO: 1931022 - protein, 7 aa, Staphylococcus
DNDYPGI

SEQ ID NO: 1931023 - protein, 13 aa, Staphylococcus
DNEAEESTEEKSE

SEQ ID NO: 1931024 - protein, 7 aa, Staphylococcus
DNEAHKK

SEQ ID NO: 1931025 - protein, 16 aa, Staphylococcus
DNEAIDDTMDEQTRRD

SEQ ID NO: 1931026 - protein, 18 aa, Staphylococcus
DNEAQQKTSAFGQSTTVT

SEQ ID NO: 1931027 - protein, 6 aa, Staphylococcus
DNEAVS

SEQ ID NO: 1931028 - protein, 4 aa, Staphylococcus
DNED

SEQ ID NO: 1931029 - protein, 7 aa, Staphylococcus
DNEDLQK

SEQ ID NO: 1931030 - protein, 6 aa, Staphylococcus
DNEEFE

SEQ ID NO: 1931031 - protein, 7 aa, Staphylococcus
DNEETGQ

SEQ ID NO: 1931032 - protein, 5 aa, Staphylococcus
DNEGA

SEQ ID NO: 1931033 - protein, 10 aa, Staphylococcus
DNEGTAEVPK

SEQ ID NO: 1931034 - protein, 4 aa, Staphylococcus
DNEI

SEQ ID NO: 1931035 - protein, 15 aa, Staphylococcus
DNEITAKDIAKHSEL

SEQ ID NO: 1931036 - protein, 8 aa, Staphylococcus
DNEKCTKI

SEQ ID NO: 1931037 - protein, 6 aa, Staphylococcus
DNEKDI

SEQ ID NO: 1931038 - protein, 7 aa, Staphylococcus
DNEKESS

SEQ ID NO: 1931039 - protein, 15 aa, Staphylococcus
DNEKLDQIKSYIEVV

SEQ ID NO: 1931040 - protein, 10 aa, Staphylococcus
DNEKLPSDQN

SEQ ID NO: 1931041 - protein, 4 aa, Staphylococcus
DNEL

SEQ ID NO: 1931042 - protein, 7 aa, Staphylococcus
DNELTND

SEQ ID NO: 1931043 - protein, 8 aa, Staphylococcus
DNENAGRF

SEQ ID NO: 1931044 - protein, 6 aa, Staphylococcus
DNENGF

SEQ ID NO: 1931045 - protein, 14 aa, Staphylococcus
DNENKLGETEHTQP

SEQ ID NO: 1931046 - protein, 6 aa, Staphylococcus
DNENPE

SEQ ID NO: 1931047 - protein, 17 aa, Staphylococcus
DNENQEVVGKHGEKATV

SEQ ID NO: 1931048 - protein, 7 aa, Staphylococcus
DNENQKF

SEQ ID NO: 1931049 - protein, 9 aa, Staphylococcus
DNENQLSKK

SEQ ID NO: 1931050 - protein, 7 aa, Staphylococcus
DNENRTL

SEQ ID NO: 1931051 - protein, 9 aa, Staphylococcus
DNENTDSLK

SEQ ID NO: 1931052 - protein, 8 aa, Staphylococcus
DNENVSLE

SEQ ID NO: 1931053 - protein, 7 aa, Staphylococcus
DNEPNNW

SEQ ID NO: 1931054 - protein, 19 aa, Staphylococcus
DNEQSAATQHAKSDGQFEQ

SEQ ID NO: 1931055 - protein, 5 aa, Staphylococcus
DNERT

SEQ ID NO: 1931056 - protein, 7 aa, Staphylococcus
DNESGNI

SEQ ID NO: 1931057 - protein, 14 aa, Staphylococcus
DNESPLNQDATANA

SEQ ID NO: 1931058 - protein, 12 aa, Staphylococcus
DNESVTDTDAEV

SEQ ID NO: 1931059 - protein, 4 aa, Staphylococcus
DNET

SEQ ID NO: 1931060 - protein, 7 aa, Staphylococcus
DNETAEL

SEQ ID NO: 1931061 - protein, 7 aa, Staphylococcus
DNETTQI

SEQ ID NO: 1931062 - protein, 5 aa, Staphylococcus
DNETV

SEQ ID NO: 1931063 - protein, 6 aa, Staphylococcus
DNEVEA

SEQ ID NO: 1931064 - protein, 5 aa, Staphylococcus
DNEVP

SEQ ID NO: 1931065 - protein, 98 aa, Staphylococcus
DNEVQDDISSTDNVNERNNNRRRQTYQSDFTTGQAHTHRRRHRNYTGSGQRATSSHDDRHKEQSHADSQSRLKKQASAYATQQTSPHSHYSSTKPRFK

SEQ ID NO: 1931066 - protein, 5 aa, Staphylococcus
DNEYA

SEQ ID NO: 1931067 - protein, 8 aa, Staphylococcus
DNEYTNTQ

SEQ ID NO: 1931068 - protein, 8 aa, Staphylococcus
DNFASGSA

SEQ ID NO: 1931069 - protein, 4 aa, Staphylococcus
DNFD

SEQ ID NO: 1931070 - protein, 5 aa, Staphylococcus
DNFDN

SEQ ID NO: 1931071 - protein, 9 aa, Staphylococcus
DNFDSNTNT

SEQ ID NO: 1931072 - protein, 5 aa, Staphylococcus
DNFDT

SEQ ID NO: 1931073 - protein, 24 aa, Staphylococcus
DNFEHEGQVYNSDDFKGPAKPGPI

SEQ ID NO: 1931074 - protein, 5 aa, Staphylococcus
DNFEP

SEQ ID NO: 1931075 - protein, 6 aa, Staphylococcus
DNFEVA

SEQ ID NO: 1931076 - protein, 7 aa, Staphylococcus
DNFEVSR

SEQ ID NO: 1931077 - protein, 9 aa, Staphylococcus
DNFGQGMSG

SEQ ID NO: 1931078 - protein, 8 aa, Staphylococcus
DNFNPQDF

SEQ ID NO: 1931079 - protein, 6 aa, Staphylococcus
DNFNSL

SEQ ID NO: 1931080 - protein, 8 aa, Staphylococcus
DNGAIENT

SEQ ID NO: 1931081 - protein, 9 aa, Staphylococcus
DNGASAKSL

SEQ ID NO: 1931082 - protein, 11 aa, Staphylococcus
DNGATNDLSYS

SEQ ID NO: 1931083 - protein, 5 aa, Staphylococcus
DNGDI

SEQ ID NO: 1931084 - protein, 8 aa, Staphylococcus
DNGEGHRD

SEQ ID NO: 1931085 - protein, 11 aa, Staphylococcus
DNGERVKPGRG

SEQ ID NO: 1931086 - protein, 15 aa, Staphylococcus
DNGERVTPEVKEGDT

SEQ ID NO: 1931087 - protein, 16 aa, Staphylococcus
DNGEWTTDATQQEVTP

SEQ ID NO: 1931088 - protein, 11 aa, Staphylococcus
DNGFSKEGHKN

SEQ ID NO: 1931089 - protein, 7 aa, Staphylococcus
DNGGSTK

SEQ ID NO: 1931090 - protein, 8 aa, Staphylococcus
DNGIGKST

SEQ ID NO: 1931091 - protein, 8 aa, Staphylococcus
DNGISSAR

SEQ ID NO: 1931092 - protein, 6 aa, Staphylococcus
DNGITY

SEQ ID NO: 1931093 - protein, 9 aa, Staphylococcus
DNGKAEVYH

SEQ ID NO: 1931094 - protein, 15 aa, Staphylococcus
DNGKAIRETSTTDIP

SEQ ID NO: 1931095 - protein, 8 aa, Staphylococcus
DNGKASQY

SEQ ID NO: 1931096 - protein, 7 aa, Staphylococcus
DNGKEAV

SEQ ID NO: 1931097 - protein, 8 aa, Staphylococcus
DNGKPIKV

SEQ ID NO: 1931098 - protein, 15 aa, Staphylococcus
DNGKPKQVPGVYPEN

SEQ ID NO: 1931099 - protein, 8 aa, Staphylococcus
DNGKPVQV

SEQ ID NO: 1931100 - protein, 17 aa, Staphylococcus
DNGLEEIEAEGQEFDPN

SEQ ID NO: 1931101 - protein, 16 aa, Staphylococcus
DNGLEEIESEGQAFDP

SEQ ID NO: 1931102 - protein, 17 aa, Staphylococcus
DNGLEEIESEGQAFDPN

SEQ ID NO: 1931103 - protein, 16 aa, Staphylococcus
DNGLEEIESEGQEFDP

SEQ ID NO: 1931104 - protein, 7 aa, Staphylococcus
DNGLTVE

SEQ ID NO: 1931105 - protein, 5 aa, Staphylococcus
DNGPM

SEQ ID NO: 1931106 - protein, 7 aa, Staphylococcus
DNGPTLL

SEQ ID NO: 1931107 - protein, 8 aa, Staphylococcus
DNGQEERI

SEQ ID NO: 1931108 - protein, 22 aa, Staphylococcus
DNGQTTWDPSKKHIKEGVKQSL

SEQ ID NO: 1931109 - protein, 11 aa, Staphylococcus
DNGRDKAQQVS

SEQ ID NO: 1931110 - protein, 7 aa, Staphylococcus
DNGRKSV

SEQ ID NO: 1931111 - protein, 9 aa, Staphylococcus
DNGSGIEAD

SEQ ID NO: 1931112 - protein, 9 aa, Staphylococcus
DNGSGKSTF

SEQ ID NO: 1931113 - protein, 14 aa, Staphylococcus
DNGSRVAPEVSEGD

SEQ ID NO: 1931114 - protein, 9 aa, Staphylococcus
DNGSSTGRV

SEQ ID NO: 1931115 - protein, 9 aa, Staphylococcus
DNGSTDIQN

SEQ ID NO: 1931116 - protein, 12 aa, Staphylococcus
DNGSTPDITTEK

SEQ ID NO: 1931117 - protein, 7 aa, Staphylococcus
DNGSTQK

SEQ ID NO: 1931118 - protein, 7 aa, Staphylococcus
DNGSVTQ

SEQ ID NO: 1931119 - protein, 4 aa, Staphylococcus
DNGT

SEQ ID NO: 1931120 - protein, 8 aa, Staphylococcus
DNGTDQQG

SEQ ID NO: 1931121 - protein, 8 aa, Staphylococcus
DNGTGKST

SEQ ID NO: 1931122 - protein, 4 aa, Staphylococcus
DNGV

SEQ ID NO: 1931123 - protein, 14 aa, Staphylococcus
DNGVGIGAHPGLPD

SEQ ID NO: 1931124 - protein, 7 aa, Staphylococcus
DNGVSYQ

SEQ ID NO: 1931125 - protein, 6 aa, Staphylococcus
DNGVTQ

SEQ ID NO: 1931126 - protein, 7 aa, Staphylococcus
DNGYETR

SEQ ID NO: 1931127 - protein, 7 aa, Staphylococcus
DNGYNGE

SEQ ID NO: 1931128 - protein, 7 aa, Staphylococcus
DNGYSGE

SEQ ID NO: 1931129 - protein, 8 aa, Staphylococcus
DNGYSGEV

SEQ ID NO: 1931130 - protein, 4 aa, Staphylococcus
DNHF

SEQ ID NO: 1931131 - protein, 8 aa, Staphylococcus
DNHKPELK

SEQ ID NO: 1931132 - protein, 8 aa, Staphylococcus
DNHKSKAS

SEQ ID NO: 1931133 - protein, 48 aa, Staphylococcus
DNHLNGGGAQAASASNESAAASTSEETSAPQTQSVPEGDFPETTEKIP

SEQ ID NO: 1931134 - protein, 48 aa, Staphylococcus
DNHLNGGGAQAATASNESAAASTSEDTSAVQTQSVPEGDFPETTEKIP

SEQ ID NO: 1931135 - protein, 7 aa, Staphylococcus
DNHNHNG

SEQ ID NO: 1931136 - protein, 8 aa, Staphylococcus
DNHSGDEV

SEQ ID NO: 1931137 - protein, 6 aa, Staphylococcus
DNHSGI

SEQ ID NO: 1931138 - protein, 7 aa, Staphylococcus
DNHSKKL

SEQ ID NO: 1931139 - protein, 11 aa, Staphylococcus
DNHSKKLQIDS

SEQ ID NO: 1931140 - protein, 18 aa, Staphylococcus
DNHVPTAAGLASSASAYA

SEQ ID NO: 1931141 - protein, 7 aa, Staphylococcus
DNHYTTD

SEQ ID NO: 1931142 - protein, 9 aa, Staphylococcus
DNIADNGSV

SEQ ID NO: 1931143 - protein, 13 aa, Staphylococcus
DNIANLKQQAKSL

SEQ ID NO: 1931144 - protein, 11 aa, Staphylococcus
DNIANNDNRNN

SEQ ID NO: 1931145 - protein, 7 aa, Staphylococcus
DNIDDKD

SEQ ID NO: 1931146 - protein, 6 aa, Staphylococcus
DNIDEE

SEQ ID NO: 1931147 - protein, 4 aa, Staphylococcus
DNIE

SEQ ID NO: 1931148 - protein, 6 aa, Staphylococcus
DNIEDA

SEQ ID NO: 1931149 - protein, 10 aa, Staphylococcus
DNIEDEDLIP

SEQ ID NO: 1931150 - protein, 7 aa, Staphylococcus
DNIKSGD

SEQ ID NO: 1931151 - protein, 14 aa, Staphylococcus
DNILRSEDKDVQAS

SEQ ID NO: 1931152 - protein, 4 aa, Staphylococcus
DNIN

SEQ ID NO: 1931153 - protein, 8 aa, Staphylococcus
DNINPKYK

SEQ ID NO: 1931154 - protein, 13 aa, Staphylococcus
DNIPDNKSAEFAK

SEQ ID NO: 1931155 - protein, 20 aa, Staphylococcus
DNIPDNKSAEFAKVKPRKVN

SEQ ID NO: 1931156 - protein, 9 aa, Staphylococcus
DNIPDNSSL

SEQ ID NO: 1931157 - protein, 6 aa, Staphylococcus
DNIQSQ

SEQ ID NO: 1931158 - protein, 5 aa, Staphylococcus
DNIRH

SEQ ID NO: 1931159 - protein, 6 aa, Staphylococcus
DNITNF

SEQ ID NO: 1931160 - protein, 14 aa, Staphylococcus
DNKAQKLDNKIEQL

SEQ ID NO: 1931161 - protein, 11 aa, Staphylococcus
DNKARKLQVDS

SEQ ID NO: 1931162 - protein, 13 aa, Staphylococcus
DNKASEFEQEQKQ

SEQ ID NO: 1931163 - protein, 9 aa, Staphylococcus
DNKASIKTK

SEQ ID NO: 1931164 - protein, 9 aa, Staphylococcus
DNKATVKTK

SEQ ID NO: 1931165 - protein, 17 aa, Staphylococcus
DNKDKISKGDKVVTSGL

SEQ ID NO: 1931166 - protein, 8 aa, Staphylococcus
DNKDLDDE

SEQ ID NO: 1931167 - protein, 8 aa, Staphylococcus
DNKEAGRY

SEQ ID NO: 1931168 - protein, 7 aa, Staphylococcus
DNKEDRN

SEQ ID NO: 1931169 - protein, 6 aa, Staphylococcus
DNKEEL

SEQ ID NO: 1931170 - protein, 9 aa, Staphylococcus
DNKEISDYT

SEQ ID NO: 1931171 - protein, 9 aa, Staphylococcus
DNKEISNYT

SEQ ID NO: 1931172 - protein, 9 aa, Staphylococcus
DNKEISSYT

SEQ ID NO: 1931173 - protein, 8 aa, Staphylococcus
DNKEKTDA

SEQ ID NO: 1931174 - protein, 16 aa, Staphylococcus
DNKESLRYGENPQQSA

SEQ ID NO: 1931175 - protein, 11 aa, Staphylococcus
DNKHPKTAEIV

SEQ ID NO: 1931176 - protein, 8 aa, Staphylococcus
DNKHQGRD

SEQ ID NO: 1931177 - protein, 7 aa, Staphylococcus
DNKIEGS

SEQ ID NO: 1931178 - protein, 9 aa, Staphylococcus
DNKIQPYTA

SEQ ID NO: 1931179 - protein, 6 aa, Staphylococcus
DNKKEL

SEQ ID NO: 1931180 - protein, 11 aa, Staphylococcus
DNKKGSIQVGK

SEQ ID NO: 1931181 - protein, 8 aa, Staphylococcus
DNKKKAMR

SEQ ID NO: 1931182 - protein, 9 aa, Staphylococcus
DNKNAKGIE

SEQ ID NO: 1931183 - protein, 7 aa, Staphylococcus
DNKNGFK

SEQ ID NO: 1931184 - protein, 6 aa, Staphylococcus
DNKNIN

SEQ ID NO: 1931185 - protein, 7 aa, Staphylococcus
DNKPQME

SEQ ID NO: 1931186 - protein, 8 aa, Staphylococcus
DNKQGGRF

SEQ ID NO: 1931187 - protein, 10 aa, Staphylococcus
DNKQSYDNIS

SEQ ID NO: 1931188 - protein, 9 aa, Staphylococcus
DNKRNKEEK

SEQ ID NO: 1931189 - protein, 5 aa, Staphylococcus
DNKRR

SEQ ID NO: 1931190 - protein, 7 aa, Staphylococcus
DNKRSHD

SEQ ID NO: 1931191 - protein, 8 aa, Staphylococcus
DNKSDQAV

SEQ ID NO: 1931192 - protein, 5 aa, Staphylococcus
DNKSG

SEQ ID NO: 1931193 - protein, 6 aa, Staphylococcus
DNKSGL

SEQ ID NO: 1931194 - protein, 11 aa, Staphylococcus
DNKSHDESVDN

SEQ ID NO: 1931195 - protein, 9 aa, Staphylococcus
DNKSLKDQS

SEQ ID NO: 1931196 - protein, 8 aa, Staphylococcus
DNKSLTEQ

SEQ ID NO: 1931197 - protein, 7 aa, Staphylococcus
DNKSYYE

SEQ ID NO: 1931198 - protein, 4 aa, Staphylococcus
DNKT

SEQ ID NO: 1931199 - protein, 16 aa, Staphylococcus
DNKTDYEKLKESEAWS

SEQ ID NO: 1931200 - protein, 6 aa, Staphylococcus
DNKTGL

SEQ ID NO: 1931201 - protein, 7 aa, Staphylococcus
DNKTGLN

SEQ ID NO: 1931202 - protein, 7 aa, Staphylococcus
DNKTVRE

SEQ ID NO: 1931203 - protein, 13 aa, Staphylococcus
DNKTYTKDSNKVR

SEQ ID NO: 1931204 - protein, 8 aa, Staphylococcus
DNLAKADA

SEQ ID NO: 1931205 - protein, 22 aa, Staphylococcus
DNLAPAKTTIRHAKRSQKPTIR

SEQ ID NO: 1931206 - protein, 10 aa, Staphylococcus
DNLDESLRPT

SEQ ID NO: 1931207 - protein, 5 aa, Staphylococcus
DNLDG

SEQ ID NO: 1931208 - protein, 7 aa, Staphylococcus
DNLDNDR

SEQ ID NO: 1931209 - protein, 5 aa, Staphylococcus
DNLDT

SEQ ID NO: 1931210 - protein, 4 aa, Staphylococcus
DNLE

SEQ ID NO: 1931211 - protein, 7 aa, Staphylococcus
DNLEGQP

SEQ ID NO: 1931212 - protein, 7 aa, Staphylococcus
DNLEKTK

SEQ ID NO: 1931213 - protein, 8 aa, Staphylococcus
DNLERPTG

SEQ ID NO: 1931214 - protein, 9 aa, Staphylococcus
DNLERPTGA

SEQ ID NO: 1931215 - protein, 10 aa, Staphylococcus
DNLGKSEYQI

SEQ ID NO: 1931216 - protein, 4 aa, Staphylococcus
DNLK

SEQ ID NO: 1931217 - protein, 6 aa, Staphylococcus
DNLKED

SEQ ID NO: 1931218 - protein, 5 aa, Staphylococcus
DNLKG

SEQ ID NO: 1931219 - protein, 8 aa, Staphylococcus
DNLKPGGT

SEQ ID NO: 1931220 - protein, 8 aa, Staphylococcus
DNLKPNGT

SEQ ID NO: 1931221 - protein, 6 aa, Staphylococcus
DNLNKR

SEQ ID NO: 1931222 - protein, 5 aa, Staphylococcus
DNLPD

SEQ ID NO: 1931223 - protein, 4 aa, Staphylococcus
DNLV

SEQ ID NO: 1931224 - protein, 7 aa, Staphylococcus
DNMALGQ

SEQ ID NO: 1931225 - protein, 5 aa, Staphylococcus
DNMDG

SEQ ID NO: 1931226 - protein, 12 aa, Staphylococcus
DNMKQNAAGVDV

SEQ ID NO: 1931227 - protein, 14 aa, Staphylococcus
DNMPDYEGEPYARN

SEQ ID NO: 1931228 - protein, 7 aa, Staphylococcus
DNMSTKV

SEQ ID NO: 1931229 - protein, 11 aa, Staphylococcus
DNNATLSARRH

SEQ ID NO: 1931230 - protein, 5 aa, Staphylococcus
DNNDI

SEQ ID NO: 1931231 - protein, 11 aa, Staphylococcus
DNNDKDQSDVI

SEQ ID NO: 1931232 - protein, 10 aa, Staphylococcus
DNNEGKLTEL

SEQ ID NO: 1931233 - protein, 7 aa, Staphylococcus
DNNEITV

SEQ ID NO: 1931234 - protein, 6 aa, Staphylococcus
DNNETS

SEQ ID NO: 1931235 - protein, 10 aa, Staphylococcus
DNNFESKTNN

SEQ ID NO: 1931236 - protein, 26 aa, Staphylococcus
DNNGIKNPFETVQKSEVTEYQNDDSL

SEQ ID NO: 1931237 - protein, 6 aa, Staphylococcus
DNNNDI

SEQ ID NO: 1931238 - protein, 7 aa, Staphylococcus
DNNPDAK

SEQ ID NO: 1931239 - protein, 7 aa, Staphylococcus
DNNPNAN

SEQ ID NO: 1931240 - protein, 6 aa, Staphylococcus
DNNPSI

SEQ ID NO: 1931241 - protein, 8 aa, Staphylococcus
DNNQDGAV

SEQ ID NO: 1931242 - protein, 15 aa, Staphylococcus
DNNQRVYTGDRNSHC

SEQ ID NO: 1931243 - protein, 8 aa, Staphylococcus
DNNQTIEA

SEQ ID NO: 1931244 - protein, 6 aa, Staphylococcus
DNNRKA

SEQ ID NO: 1931245 - protein, 6 aa, Staphylococcus
DNNRKS

SEQ ID NO: 1931246 - protein, 6 aa, Staphylococcus
DNNRKT

SEQ ID NO: 1931247 - protein, 5 aa, Staphylococcus
DNNSV

SEQ ID NO: 1931248 - protein, 4 aa, Staphylococcus
DNNT

SEQ ID NO: 1931249 - protein, 8 aa, Staphylococcus
DNNTMNGA

SEQ ID NO: 1931250 - protein, 6 aa, Staphylococcus
DNPDIS

SEQ ID NO: 1931251 - protein, 10 aa, Staphylococcus
DNPEKIKSIK

SEQ ID NO: 1931252 - protein, 11 aa, Staphylococcus
DNPEKIKSIKG

SEQ ID NO: 1931253 - protein, 10 aa, Staphylococcus
DNPETIRTRQ

SEQ ID NO: 1931254 - protein, 6 aa, Staphylococcus
DNPEYY

SEQ ID NO: 1931255 - protein, 4 aa, Staphylococcus
DNPI

SEQ ID NO: 1931256 - protein, 33 aa, Staphylococcus
DNPISKKNFYKGEKTYAGKPITKDTASKVETEL

SEQ ID NO: 1931257 - protein, 33 aa, Staphylococcus
DNPISKKTFYKGEKNIVGKPITSETADKVETEL

SEQ ID NO: 1931258 - protein, 33 aa, Staphylococcus
DNPISKKTFYKGEKSYAGKPITEETANKVETEL

SEQ ID NO: 1931259 - protein, 4 aa, Staphylococcus
DNPK

SEQ ID NO: 1931260 - protein, 17 aa, Staphylococcus
DNPKNMGQGVPFQNDSD

SEQ ID NO: 1931261 - protein, 7 aa, Staphylococcus
DNPKYEK

SEQ ID NO: 1931262 - protein, 7 aa, Staphylococcus
DNPKYRN

SEQ ID NO: 1931263 - protein, 4 aa, Staphylococcus
DNPL

SEQ ID NO: 1931264 - protein, 5 aa, Staphylococcus
DNPNI

SEQ ID NO: 1931265 - protein, 6 aa, Staphylococcus
DNPNIS

SEQ ID NO: 1931266 - protein, 7 aa, Staphylococcus
DNPNLGD

SEQ ID NO: 1931267 - protein, 7 aa, Staphylococcus
DNPNVRS

SEQ ID NO: 1931268 - protein, 7 aa, Staphylococcus
DNPPNEY

SEQ ID NO: 1931269 - protein, 8 aa, Staphylococcus
DNPRQLER

SEQ ID NO: 1931270 - protein, 11 aa, Staphylococcus
DNPSKMPERDQ

SEQ ID NO: 1931271 - protein, 9 aa, Staphylococcus
DNPSMPESI

SEQ ID NO: 1931272 - protein, 11 aa, Staphylococcus
DNPSVPDSEYD

SEQ ID NO: 1931273 - protein, 8 aa, Staphylococcus
DNPTQITK

SEQ ID NO: 1931274 - protein, 8 aa, Staphylococcus
DNPTQPQQ

SEQ ID NO: 1931275 - protein, 31 aa, Staphylococcus
DNPVNDKTLYKGKREIAGKPITEKTAEKVNK

SEQ ID NO: 1931276 - protein, 33 aa, Staphylococcus
DNPVTKKNFYSGKKEYAGKPISKDTADKVEKEL

SEQ ID NO: 1931277 - protein, 9 aa, Staphylococcus
DNPYDKEGG

SEQ ID NO: 1931278 - protein, 5 aa, Staphylococcus
DNQAG

SEQ ID NO: 1931279 - protein, 5 aa, Staphylococcus
DNQAS

SEQ ID NO: 1931280 - protein, 7 aa, Staphylococcus
DNQAVST

SEQ ID NO: 1931281 - protein, 8 aa, Staphylococcus
DNQDGGKF

SEQ ID NO: 1931282 - protein, 8 aa, Staphylococcus
DNQEPGSM

SEQ ID NO: 1931283 - protein, 5 aa, Staphylococcus
DNQFV

SEQ ID NO: 1931284 - protein, 10 aa, Staphylococcus
DNQGAAASRN

SEQ ID NO: 1931285 - protein, 12 aa, Staphylococcus
DNQGAAKSRNMG

SEQ ID NO: 1931286 - protein, 7 aa, Staphylococcus
DNQGFEN

SEQ ID NO: 1931287 - protein, 50 aa, Staphylococcus
DNQGGGPHYYPNNQGVYASQHEYKKPPFPTDGDGYEYNYREDDDNYFEQP

SEQ ID NO: 1931288 - protein, 50 aa, Staphylococcus
DNQGGGPHYYPNNQGVYDSQPEFKKPPFPADGDGYEYNQRQDDDNYFEQP

SEQ ID NO: 1931289 - protein, 10 aa, Staphylococcus
DNQGTAEVPE

SEQ ID NO: 1931290 - protein, 12 aa, Staphylococcus
DNQIETGHSSEV

SEQ ID NO: 1931291 - protein, 11 aa, Staphylococcus
DNQINANRYTK

SEQ ID NO: 1931292 - protein, 9 aa, Staphylococcus
DNQKDFNNF

SEQ ID NO: 1931293 - protein, 17 aa, Staphylococcus
DNQKKAAELKKQQIDEQ

SEQ ID NO: 1931294 - protein, 9 aa, Staphylococcus
DNQKKASDP

SEQ ID NO: 1931295 - protein, 7 aa, Staphylococcus
DNQLADQ

SEQ ID NO: 1931296 - protein, 7 aa, Staphylococcus
DNQLAEQ

SEQ ID NO: 1931297 - protein, 29 aa, Staphylococcus
DNQNETLEQEENQNENDIKGTVSASTRRR

SEQ ID NO: 1931298 - protein, 7 aa, Staphylococcus
DNQNNEG

SEQ ID NO: 1931299 - protein, 7 aa, Staphylococcus
DNQNNFE

SEQ ID NO: 1931300 - protein, 8 aa, Staphylococcus
DNQNSDKK

SEQ ID NO: 1931301 - protein, 9 aa, Staphylococcus
DNQNTEGVE

SEQ ID NO: 1931302 - protein, 7 aa, Staphylococcus
DNQNTQR

SEQ ID NO: 1931303 - protein, 5 aa, Staphylococcus
DNQPL

SEQ ID NO: 1931304 - protein, 5 aa, Staphylococcus
DNQQC

SEQ ID NO: 1931305 - protein, 7 aa, Staphylococcus
DNQQLHD

SEQ ID NO: 1931306 - protein, 9 aa, Staphylococcus
DNQSQNKKN

SEQ ID NO: 1931307 - protein, 5 aa, Staphylococcus
DNQTK

SEQ ID NO: 1931308 - protein, 8 aa, Staphylococcus
DNQTSEVF

SEQ ID NO: 1931309 - protein, 10 aa, Staphylococcus
DNQTSTQYPD

SEQ ID NO: 1931310 - protein, 7 aa, Staphylococcus
DNQTTGT

SEQ ID NO: 1931311 - protein, 9 aa, Staphylococcus
DNQTVDGNT

SEQ ID NO: 1931312 - protein, 23 aa, Staphylococcus
DNQTYQLEQNDPPSHLHGGSNGI

SEQ ID NO: 1931313 - protein, 12 aa, Staphylococcus
DNQYPERNYKQD

SEQ ID NO: 1931314 - protein, 6 aa, Staphylococcus
DNQYSI

SEQ ID NO: 1931315 - protein, 18 aa, Staphylococcus
DNQYTAPEGVFVDFLNSS

SEQ ID NO: 1931316 - protein, 6 aa, Staphylococcus
DNRAAH

SEQ ID NO: 1931317 - protein, 9 aa, Staphylococcus
DNRASEYTK

SEQ ID NO: 1931318 - protein, 9 aa, Staphylococcus
DNRASHYAE

SEQ ID NO: 1931319 - protein, 8 aa, Staphylococcus
DNRASKYA

SEQ ID NO: 1931320 - protein, 15 aa, Staphylococcus
DNRASKYADQINQQH

SEQ ID NO: 1931321 - protein, 7 aa, Staphylococcus
DNRASRY

SEQ ID NO: 1931322 - protein, 10 aa, Staphylococcus
DNRASRYAEA

SEQ ID NO: 1931323 - protein, 7 aa, Staphylococcus
DNREEEF

SEQ ID NO: 1931324 - protein, 6 aa, Staphylococcus
DNRGSF

SEQ ID NO: 1931325 - protein, 5 aa, Staphylococcus
DNRHD

SEQ ID NO: 1931326 - protein, 7 aa, Staphylococcus
DNRIEGS

SEQ ID NO: 1931327 - protein, 7 aa, Staphylococcus
DNRLEAA

SEQ ID NO: 1931328 - protein, 4 aa, Staphylococcus
DNRN

SEQ ID NO: 1931329 - protein, 7 aa, Staphylococcus
DNRNHNG

SEQ ID NO: 1931330 - protein, 6 aa, Staphylococcus
DNRRYK

SEQ ID NO: 1931331 - protein, 7 aa, Staphylococcus
DNRSSRY

SEQ ID NO: 1931332 - protein, 5 aa, Staphylococcus
DNRSY

SEQ ID NO: 1931333 - protein, 6 aa, Staphylococcus
DNRSYY

SEQ ID NO: 1931334 - protein, 4 aa, Staphylococcus
DNRT

SEQ ID NO: 1931335 - protein, 7 aa, Staphylococcus
DNRTASI

SEQ ID NO: 1931336 - protein, 5 aa, Staphylococcus
DNRTL

SEQ ID NO: 1931337 - protein, 12 aa, Staphylococcus
DNRTVTQTSLNE

SEQ ID NO: 1931338 - protein, 11 aa, Staphylococcus
DNRVKTSTKRR

SEQ ID NO: 1931339 - protein, 5 aa, Staphylococcus
DNRYH

SEQ ID NO: 1931340 - protein, 5 aa, Staphylococcus
DNSAV

SEQ ID NO: 1931341 - protein, 9 aa, Staphylococcus
DNSDAFGTA

SEQ ID NO: 1931342 - protein, 6 aa, Staphylococcus
DNSEKI

SEQ ID NO: 1931343 - protein, 7 aa, Staphylococcus
DNSEQEL

SEQ ID NO: 1931344 - protein, 4 aa, Staphylococcus
DNSG

SEQ ID NO: 1931345 - protein, 8 aa, Staphylococcus
DNSGKTAF

SEQ ID NO: 1931346 - protein, 4 aa, Staphylococcus
DNSI

SEQ ID NO: 1931347 - protein, 6 aa, Staphylococcus
DNSKAK

SEQ ID NO: 1931348 - protein, 9 aa, Staphylococcus
DNSKGKNYR

SEQ ID NO: 1931349 - protein, 6 aa, Staphylococcus
DNSKIQ

SEQ ID NO: 1931350 - protein, 6 aa, Staphylococcus
DNSLNI

SEQ ID NO: 1931351 - protein, 10 aa, Staphylococcus
DNSNNNDSHF

SEQ ID NO: 1931352 - protein, 13 aa, Staphylococcus
DNSPSKKVSKNIY

SEQ ID NO: 1931353 - protein, 9 aa, Staphylococcus
DNSQPNDHA

SEQ ID NO: 1931354 - protein, 5 aa, Staphylococcus
DNSRV

SEQ ID NO: 1931355 - protein, 8 aa, Staphylococcus
DNSSTNAD

SEQ ID NO: 1931356 - protein, 4 aa, Staphylococcus
DNST

SEQ ID NO: 1931357 - protein, 9 aa, Staphylococcus
DNSTRGLQI

SEQ ID NO: 1931358 - protein, 6 aa, Staphylococcus
DNSVKE

SEQ ID NO: 1931359 - protein, 6 aa, Staphylococcus
DNSYEG

SEQ ID NO: 1931360 - protein, 15 aa, Staphylococcus
DNSYEMPEDGYNGKD

SEQ ID NO: 1931361 - protein, 11 aa, Staphylococcus
DNSYTENTRAA

SEQ ID NO: 1931362 - protein, 10 aa, Staphylococcus
DNTDALRDGI

SEQ ID NO: 1931363 - protein, 16 aa, Staphylococcus
DNTDENGYCTATEDYN

SEQ ID NO: 1931364 - protein, 12 aa, Staphylococcus
DNTFPKDVKSQN

SEQ ID NO: 1931365 - protein, 5 aa, Staphylococcus
DNTGH

SEQ ID NO: 1931366 - protein, 4 aa, Staphylococcus
DNTI

SEQ ID NO: 1931367 - protein, 4 aa, Staphylococcus
DNTL

SEQ ID NO: 1931368 - protein, 6 aa, Staphylococcus
DNTMRD

SEQ ID NO: 1931369 - protein, 12 aa, Staphylococcus
DNTNGIATEAEL

SEQ ID NO: 1931370 - protein, 6 aa, Staphylococcus
DNTPDY

SEQ ID NO: 1931371 - protein, 8 aa, Staphylococcus
DNTPGCTT

SEQ ID NO: 1931372 - protein, 7 aa, Staphylococcus
DNTPYDS

SEQ ID NO: 1931373 - protein, 11 aa, Staphylococcus
DNTRQKRKRNY

SEQ ID NO: 1931374 - protein, 5 aa, Staphylococcus
DNTTA

SEQ ID NO: 1931375 - protein, 6 aa, Staphylococcus
DNTTYT

SEQ ID NO: 1931376 - protein, 7 aa, Staphylococcus
DNTYEGV

SEQ ID NO: 1931377 - protein, 9 aa, Staphylococcus
DNVDVTTSK

SEQ ID NO: 1931378 - protein, 11 aa, Staphylococcus
DNVIDKPAEDL

SEQ ID NO: 1931379 - protein, 4 aa, Staphylococcus
DNVK

SEQ ID NO: 1931380 - protein, 6 aa, Staphylococcus
DNVKQV

SEQ ID NO: 1931381 - protein, 7 aa, Staphylococcus
DNVKQVE

SEQ ID NO: 1931382 - protein, 10 aa, Staphylococcus
DNVKSEIKSL

SEQ ID NO: 1931383 - protein, 10 aa, Staphylococcus
DNVKSEITSL

SEQ ID NO: 1931384 - protein, 6 aa, Staphylococcus
DNVNPV

SEQ ID NO: 1931385 - protein, 25 aa, Staphylococcus
DNVNRTASDVRSAFGKNGGNMGVSG

SEQ ID NO: 1931386 - protein, 7 aa, Staphylococcus
DNVRHGL

SEQ ID NO: 1931387 - protein, 7 aa, Staphylococcus
DNVRSEI

SEQ ID NO: 1931388 - protein, 10 aa, Staphylococcus
DNVSAREGAL

SEQ ID NO: 1931389 - protein, 9 aa, Staphylococcus
DNVTQQSDI

SEQ ID NO: 1931390 - protein, 8 aa, Staphylococcus
DNWNKTND

SEQ ID NO: 1931391 - protein, 5 aa, Staphylococcus
DNWPN

SEQ ID NO: 1931392 - protein, 8 aa, Staphylococcus
DNWSNEQV

SEQ ID NO: 1931393 - protein, 7 aa, Staphylococcus
DNYAGEQ

SEQ ID NO: 1931394 - protein, 10 aa, Staphylococcus
DNYAKNKGKF

SEQ ID NO: 1931395 - protein, 4 aa, Staphylococcus
DNYD

SEQ ID NO: 1931396 - protein, 5 aa, Staphylococcus
DNYEA

SEQ ID NO: 1931397 - protein, 5 aa, Staphylococcus
DNYEG

SEQ ID NO: 1931398 - protein, 11 aa, Staphylococcus
DNYGTPLTEET

SEQ ID NO: 1931399 - protein, 4 aa, Staphylococcus
DNYK

SEQ ID NO: 1931400 - protein, 6 aa, Staphylococcus
DNYKGV

SEQ ID NO: 1931401 - protein, 11 aa, Staphylococcus
DNYKKASDNRL

SEQ ID NO: 1931402 - protein, 6 aa, Staphylococcus
DNYPKN

SEQ ID NO: 1931403 - protein, 18 aa, Staphylococcus
DNYQNAKKQIYKNQTEND

SEQ ID NO: 1931404 - protein, 6 aa, Staphylococcus
DNYQTD

SEQ ID NO: 1931405 - protein, 7 aa, Staphylococcus
DNYREPI

SEQ ID NO: 1931406 - protein, 4 aa, Staphylococcus
DNYS

SEQ ID NO: 1931407 - protein, 6 aa, Staphylococcus
DNYSAS

SEQ ID NO: 1931408 - protein, 10 aa, Staphylococcus
DNYSSAGSFR

SEQ ID NO: 1931409 - protein, 14 aa, Staphylococcus
DNYTPAGQQITQAV

SEQ ID NO: 1931410 - protein, 5 aa, Staphylococcus
DNYTS

SEQ ID NO: 1931411 - protein, 7 aa, Staphylococcus
DPAAQGL

SEQ ID NO: 1931412 - protein, 7 aa, Staphylococcus
DPAARST

SEQ ID NO: 1931413 - protein, 8 aa, Staphylococcus
DPAARTSF

SEQ ID NO: 1931414 - protein, 20 aa, Staphylococcus
DPADLEKSLKEAQSEGQKYF

SEQ ID NO: 1931415 - protein, 6 aa, Staphylococcus
DPAETR

SEQ ID NO: 1931416 - protein, 4 aa, Staphylococcus
DPAF

SEQ ID NO: 1931417 - protein, 8 aa, Staphylococcus
DPAGKDWS

SEQ ID NO: 1931418 - protein, 4 aa, Staphylococcus
DPAL

SEQ ID NO: 1931419 - protein, 8 aa, Staphylococcus
DPALTKEA

SEQ ID NO: 1931420 - protein, 6 aa, Staphylococcus
DPAQYN

SEQ ID NO: 1931421 - protein, 15 aa, Staphylococcus
DPAYIPRHNEARNQI

SEQ ID NO: 1931422 - protein, 16 aa, Staphylococcus
DPAYIPRNNEARNQIR

SEQ ID NO: 1931423 - protein, 15 aa, Staphylococcus
DPAYIPRQNEARNQI

SEQ ID NO: 1931424 - protein, 10 aa, Staphylococcus
DPCGGPGTPY

SEQ ID NO: 1931425 - protein, 8 aa, Staphylococcus
DPDADRLG

SEQ ID NO: 1931426 - protein, 9 aa, Staphylococcus
DPDAQKSFK

SEQ ID NO: 1931427 - protein, 7 aa, Staphylococcus
DPDGLAK

SEQ ID NO: 1931428 - protein, 6 aa, Staphylococcus
DPDGVD

SEQ ID NO: 1931429 - protein, 6 aa, Staphylococcus
DPDGVN

SEQ ID NO: 1931430 - protein, 4 aa, Staphylococcus
DPDH

SEQ ID NO: 1931431 - protein, 13 aa, Staphylococcus
DPDKFKEANHDEI

SEQ ID NO: 1931432 - protein, 11 aa, Staphylococcus
DPDKNGSAKFK

SEQ ID NO: 1931433 - protein, 6 aa, Staphylococcus
DPDKNN

SEQ ID NO: 1931434 - protein, 4 aa, Staphylococcus
DPDL

SEQ ID NO: 1931435 - protein, 13 aa, Staphylococcus
DPDLDTPATLDLS

SEQ ID NO: 1931436 - protein, 8 aa, Staphylococcus
DPDRAREF

SEQ ID NO: 1931437 - protein, 8 aa, Staphylococcus
DPDTGAQY

SEQ ID NO: 1931438 - protein, 8 aa, Staphylococcus
DPDTLESK

SEQ ID NO: 1931439 - protein, 6 aa, Staphylococcus
DPDTLT

SEQ ID NO: 1931440 - protein, 20 aa, Staphylococcus
DPDTYRDRKPDELSGGQRQR

SEQ ID NO: 1931441 - protein, 5 aa, Staphylococcus
DPDVD

SEQ ID NO: 1931442 - protein, 23 aa, Staphylococcus
DPDVVNNADKLRKYSKEQAELQK

SEQ ID NO: 1931443 - protein, 23 aa, Staphylococcus
DPDVVSDSNKLREYSKEQSDLQK

SEQ ID NO: 1931444 - protein, 4 aa, Staphylococcus
DPDY

SEQ ID NO: 1931445 - protein, 8 aa, Staphylococcus
DPDYPEDR

SEQ ID NO: 1931446 - protein, 8 aa, Staphylococcus
DPDYPQER

SEQ ID NO: 1931447 - protein, 9 aa, Staphylococcus
DPDYQGQGY

SEQ ID NO: 1931448 - protein, 4 aa, Staphylococcus
DPEA

SEQ ID NO: 1931449 - protein, 19 aa, Staphylococcus
DPEAYRHQANDLKQRFEEK

SEQ ID NO: 1931450 - protein, 14 aa, Staphylococcus
DPEDPAKLLPEEQE

SEQ ID NO: 1931451 - protein, 6 aa, Staphylococcus
DPEEAL

SEQ ID NO: 1931452 - protein, 17 aa, Staphylococcus
DPEEQIPVSEDGDTLTL

SEQ ID NO: 1931453 - protein, 4 aa, Staphylococcus
DPEF

SEQ ID NO: 1931454 - protein, 5 aa, Staphylococcus
DPEFT

SEQ ID NO: 1931455 - protein, 5 aa, Staphylococcus
DPEGN

SEQ ID NO: 1931456 - protein, 6 aa, Staphylococcus
DPEGNG

SEQ ID NO: 1931457 - protein, 7 aa, Staphylococcus
DPEGNGI

SEQ ID NO: 1931458 - protein, 8 aa, Staphylococcus
DPEGNGIE

SEQ ID NO: 1931459 - protein, 7 aa, Staphylococcus
DPEGNGL

SEQ ID NO: 1931460 - protein, 7 aa, Staphylococcus
DPEGNQY

SEQ ID NO: 1931461 - protein, 8 aa, Staphylococcus
DPEHSPLI

SEQ ID NO: 1931462 - protein, 7 aa, Staphylococcus
DPEIKED

SEQ ID NO: 1931463 - protein, 16 aa, Staphylococcus
DPEIKEELKEVSGQPY

SEQ ID NO: 1931464 - protein, 7 aa, Staphylococcus
DPEIKEN

SEQ ID NO: 1931465 - protein, 13 aa, Staphylococcus
DPEKNGASKFKQY

SEQ ID NO: 1931466 - protein, 12 aa, Staphylococcus
DPEKNGSSKFKQ

SEQ ID NO: 1931467 - protein, 13 aa, Staphylococcus
DPEKNGTSKFKQY

SEQ ID NO: 1931468 - protein, 7 aa, Staphylococcus
DPEKQHR

SEQ ID NO: 1931469 - protein, 15 aa, Staphylococcus
DPEKRTVAAEKYPNV

SEQ ID NO: 1931470 - protein, 11 aa, Staphylococcus
DPELRGQKNNV

SEQ ID NO: 1931471 - protein, 9 aa, Staphylococcus
DPENAEQET

SEQ ID NO: 1931472 - protein, 25 aa, Staphylococcus
DPENEKALAEGKERVNTLTSKHPLY

SEQ ID NO: 1931473 - protein, 7 aa, Staphylococcus
DPERQDA

SEQ ID NO: 1931474 - protein, 6 aa, Staphylococcus
DPERQK

SEQ ID NO: 1931475 - protein, 7 aa, Staphylococcus
DPERQKA

SEQ ID NO: 1931476 - protein, 6 aa, Staphylococcus
DPERQQ

SEQ ID NO: 1931477 - protein, 5 aa, Staphylococcus
DPESM

SEQ ID NO: 1931478 - protein, 7 aa, Staphylococcus
DPESNEV

SEQ ID NO: 1931479 - protein, 8 aa, Staphylococcus
DPESTYIQ

SEQ ID NO: 1931480 - protein, 5 aa, Staphylococcus
DPETF

SEQ ID NO: 1931481 - protein, 12 aa, Staphylococcus
DPETGEPDKALT

SEQ ID NO: 1931482 - protein, 17 aa, Staphylococcus
DPETGMKGRRETNTMPQ

SEQ ID NO: 1931483 - protein, 8 aa, Staphylococcus
DPETSELK

SEQ ID NO: 1931484 - protein, 8 aa, Staphylococcus
DPETSETV

SEQ ID NO: 1931485 - protein, 9 aa, Staphylococcus
DPEVAERPE

SEQ ID NO: 1931486 - protein, 8 aa, Staphylococcus
DPEYGDRQ

SEQ ID NO: 1931487 - protein, 11 aa, Staphylococcus
DPFDGKTLSEQ

SEQ ID NO: 1931488 - protein, 4 aa, Staphylococcus
DPFE

SEQ ID NO: 1931489 - protein, 17 aa, Staphylococcus
DPFKKADELVKEAQNVT

SEQ ID NO: 1931490 - protein, 11 aa, Staphylococcus
DPFNGNTLSDQ

SEQ ID NO: 1931491 - protein, 11 aa, Staphylococcus
DPFNSNTLSDQ

SEQ ID NO: 1931492 - protein, 6 aa, Staphylococcus
DPFPNE

SEQ ID NO: 1931493 - protein, 6 aa, Staphylococcus
DPFPNT

SEQ ID NO: 1931494 - protein, 8 aa, Staphylococcus
DPFPREGL

SEQ ID NO: 1931495 - protein, 11 aa, Staphylococcus
DPFRKEDVEKE

SEQ ID NO: 1931496 - protein, 6 aa, Staphylococcus
DPGESF

SEQ ID NO: 1931497 - protein, 5 aa, Staphylococcus
DPGNL

SEQ ID NO: 1931498 - protein, 6 aa, Staphylococcus
DPGWLG

SEQ ID NO: 1931499 - protein, 9 aa, Staphylococcus
DPHKPHAQK

SEQ ID NO: 1931500 - protein, 11 aa, Staphylococcus
DPHKSKRAGVL

SEQ ID NO: 1931501 - protein, 12 aa, Staphylococcus
DPHREDKHELTP

SEQ ID NO: 1931502 - protein, 14 aa, Staphylococcus
DPHRPNAKDKSLEQ

SEQ ID NO: 1931503 - protein, 14 aa, Staphylococcus
DPHRPNANNKSLEQ

SEQ ID NO: 1931504 - protein, 28 aa, Staphylococcus
DPIDNAGPIPESVPREPIHRQPPPFDEL

SEQ ID NO: 1931505 - protein, 13 aa, Staphylococcus
DPIEGTKPTIKEE

SEQ ID NO: 1931506 - protein, 14 aa, Staphylococcus
DPIEGTKPTVKEEM

SEQ ID NO: 1931507 - protein, 5 aa, Staphylococcus
DPIGA

SEQ ID NO: 1931508 - protein, 7 aa, Staphylococcus
DPIGGEG

SEQ ID NO: 1931509 - protein, 12 aa, Staphylococcus
DPIGGNGTPYVT

SEQ ID NO: 1931510 - protein, 16 aa, Staphylococcus
DPIIGDSNGQYIEIGD

SEQ ID NO: 1931511 - protein, 20 aa, Staphylococcus
DPIKGTKPTTKNEMTDLQST

SEQ ID NO: 1931512 - protein, 10 aa, Staphylococcus
DPINQKDSEL

SEQ ID NO: 1931513 - protein, 12 aa, Staphylococcus
DPIQKTRDPEAA

SEQ ID NO: 1931514 - protein, 8 aa, Staphylococcus
DPIRSETD

SEQ ID NO: 1931515 - protein, 7 aa, Staphylococcus
DPITEEI

SEQ ID NO: 1931516 - protein, 11 aa, Staphylococcus
DPIVTSKDSQN

SEQ ID NO: 1931517 - protein, 4 aa, Staphylococcus
DPKD

SEQ ID NO: 1931518 - protein, 10 aa, Staphylococcus
DPKDHSKASK

SEQ ID NO: 1931519 - protein, 8 aa, Staphylococcus
DPKENEIQ

SEQ ID NO: 1931520 - protein, 9 aa, Staphylococcus
DPKEVDDET

SEQ ID NO: 1931521 - protein, 9 aa, Staphylococcus
DPKEVDDPT

SEQ ID NO: 1931522 - protein, 8 aa, Staphylococcus
DPKFGESI

SEQ ID NO: 1931523 - protein, 4 aa, Staphylococcus
DPKL

SEQ ID NO: 1931524 - protein, 8 aa, Staphylococcus
DPKLAAKR

SEQ ID NO: 1931525 - protein, 5 aa, Staphylococcus
DPKMK

SEQ ID NO: 1931526 - protein, 7 aa, Staphylococcus
DPKNGMS

SEQ ID NO: 1931527 - protein, 8 aa, Staphylococcus
DPKQGPSI

SEQ ID NO: 1931528 - protein, 8 aa, Staphylococcus
DPKRARSE

SEQ ID NO: 1931529 - protein, 8 aa, Staphylococcus
DPKTGGFR

SEQ ID NO: 1931530 - protein, 7 aa, Staphylococcus
DPKTGSE

SEQ ID NO: 1931531 - protein, 5 aa, Staphylococcus
DPKTL

SEQ ID NO: 1931532 - protein, 7 aa, Staphylococcus
DPKTRKI

SEQ ID NO: 1931533 - protein, 8 aa, Staphylococcus
DPKTRQIQ

SEQ ID NO: 1931534 - protein, 8 aa, Staphylococcus
DPKTYNHQ

SEQ ID NO: 1931535 - protein, 13 aa, Staphylococcus
DPKYGPKKTLDIG

SEQ ID NO: 1931536 - protein, 5 aa, Staphylococcus
DPLNS

SEQ ID NO: 1931537 - protein, 7 aa, Staphylococcus
DPMEPEY

SEQ ID NO: 1931538 - protein, 10 aa, Staphylococcus
DPNAAPLPGQ

SEQ ID NO: 1931539 - protein, 5 aa, Staphylococcus
DPNAD

SEQ ID NO: 1931540 - protein, 8 aa, Staphylococcus
DPNAQKAF

SEQ ID NO: 1931541 - protein, 14 aa, Staphylococcus
DPNDKNASAETTVE

SEQ ID NO: 1931542 - protein, 18 aa, Staphylococcus
DPNEIENAPLPNNKVESL

SEQ ID NO: 1931543 - protein, 7 aa, Staphylococcus
DPNHTAK

SEQ ID NO: 1931544 - protein, 6 aa, Staphylococcus
DPNLKG

SEQ ID NO: 1931545 - protein, 16 aa, Staphylococcus
DPNNEEWQQEAERLQL

SEQ ID NO: 1931546 - protein, 7 aa, Staphylococcus
DPNNQAI

SEQ ID NO: 1931547 - protein, 10 aa, Staphylococcus
DPNPDSPCKS

SEQ ID NO: 1931548 - protein, 6 aa, Staphylococcus
DPNQLK

SEQ ID NO: 1931549 - protein, 8 aa, Staphylococcus
DPNQQKNF

SEQ ID NO: 1931550 - protein, 12 aa, Staphylococcus
DPNREDKHALPP

SEQ ID NO: 1931551 - protein, 6 aa, Staphylococcus
DPNRID

SEQ ID NO: 1931552 - protein, 8 aa, Staphylococcus
DPNRTAQS

SEQ ID NO: 1931553 - protein, 5 aa, Staphylococcus
DPNTL

SEQ ID NO: 1931554 - protein, 4 aa, Staphylococcus
DPNV

SEQ ID NO: 1931555 - protein, 5 aa, Staphylococcus
DPNVK

SEQ ID NO: 1931556 - protein, 6 aa, Staphylococcus
DPPDYL

SEQ ID NO: 1931557 - protein, 6 aa, Staphylococcus
DPPENT

SEQ ID NO: 1931558 - protein, 4 aa, Staphylococcus
DPPI

SEQ ID NO: 1931559 - protein, 10 aa, Staphylococcus
DPPNVPEENP

SEQ ID NO: 1931560 - protein, 9 aa, Staphylococcus
DPQASIGNG

SEQ ID NO: 1931561 - protein, 9 aa, Staphylococcus
DPQASIGRG

SEQ ID NO: 1931562 - protein, 4 aa, Staphylococcus
DPQI

SEQ ID NO: 1931563 - protein, 12 aa, Staphylococcus
DPQMRGQGLGPK

SEQ ID NO: 1931564 - protein, 7 aa, Staphylococcus
DPQREKE

SEQ ID NO: 1931565 - protein, 5 aa, Staphylococcus
DPQTL

SEQ ID NO: 1931566 - protein, 8 aa, Staphylococcus
DPRAYDKG

SEQ ID NO: 1931567 - protein, 5 aa, Staphylococcus
DPRMD

SEQ ID NO: 1931568 - protein, 5 aa, Staphylococcus
DPRMK

SEQ ID NO: 1931569 - protein, 8 aa, Staphylococcus
DPRNEHDA

SEQ ID NO: 1931570 - protein, 4 aa, Staphylococcus
DPRY

SEQ ID NO: 1931571 - protein, 17 aa, Staphylococcus
DPSDEGGQFQDRGAQYK

SEQ ID NO: 1931572 - protein, 8 aa, Staphylococcus
DPSDPNNF

SEQ ID NO: 1931573 - protein, 6 aa, Staphylococcus
DPSDYD

SEQ ID NO: 1931574 - protein, 4 aa, Staphylococcus
DPSE

SEQ ID NO: 1931575 - protein, 8 aa, Staphylococcus
DPSEDINT

SEQ ID NO: 1931576 - protein, 5 aa, Staphylococcus
DPSEI

SEQ ID NO: 1931577 - protein, 9 aa, Staphylococcus
DPSESTIEE

SEQ ID NO: 1931578 - protein, 6 aa, Staphylococcus
DPSETR

SEQ ID NO: 1931579 - protein, 9 aa, Staphylococcus
DPSGKAAWE

SEQ ID NO: 1931580 - protein, 5 aa, Staphylococcus
DPSGN

SEQ ID NO: 1931581 - protein, 6 aa, Staphylococcus
DPSKED

SEQ ID NO: 1931582 - protein, 5 aa, Staphylococcus
DPSKL

SEQ ID NO: 1931583 - protein, 12 aa, Staphylococcus
DPSKNGSAKFKQ

SEQ ID NO: 1931584 - protein, 10 aa, Staphylococcus
DPSKSDLKPE

SEQ ID NO: 1931585 - protein, 8 aa, Staphylococcus
DPSKSGKL

SEQ ID NO: 1931586 - protein, 4 aa, Staphylococcus
DPSL

SEQ ID NO: 1931587 - protein, 7 aa, Staphylococcus
DPSLTQT

SEQ ID NO: 1931588 - protein, 4 aa, Staphylococcus
DPSN

SEQ ID NO: 1931589 - protein, 15 aa, Staphylococcus
DPSNETWHDEAMRLQ

SEQ ID NO: 1931590 - protein, 15 aa, Staphylococcus
DPSNETWQEEANRLD

SEQ ID NO: 1931591 - protein, 8 aa, Staphylococcus
DPSNIESN

SEQ ID NO: 1931592 - protein, 7 aa, Staphylococcus
DPSNSVA

SEQ ID NO: 1931593 - protein, 8 aa, Staphylococcus
DPSNTSYE

SEQ ID NO: 1931594 - protein, 6 aa, Staphylococcus
DPSQLQ

SEQ ID NO: 1931595 - protein, 8 aa, Staphylococcus
DPSQTITR

SEQ ID NO: 1931596 - protein, 4 aa, Staphylococcus
DPSR

SEQ ID NO: 1931597 - protein, 6 aa, Staphylococcus
DPSRID

SEQ ID NO: 1931598 - protein, 6 aa, Staphylococcus
DPSRVT

SEQ ID NO: 1931599 - protein, 9 aa, Staphylococcus
DPSSDGNKI

SEQ ID NO: 1931600 - protein, 9 aa, Staphylococcus
DPSSETDKI

SEQ ID NO: 1931601 - protein, 10 aa, Staphylococcus
DPSSSDLKPE

SEQ ID NO: 1931602 - protein, 12 aa, Staphylococcus
DPSSSLEDNHSH

SEQ ID NO: 1931603 - protein, 7 aa, Staphylococcus
DPSSTYI

SEQ ID NO: 1931604 - protein, 9 aa, Staphylococcus
DPSTSELKS

SEQ ID NO: 1931605 - protein, 9 aa, Staphylococcus
DPSVFEKNG

SEQ ID NO: 1931606 - protein, 6 aa, Staphylococcus
DPTADS

SEQ ID NO: 1931607 - protein, 8 aa, Staphylococcus
DPTAELER

SEQ ID NO: 1931608 - protein, 9 aa, Staphylococcus
DPTAQKAFP

SEQ ID NO: 1931609 - protein, 9 aa, Staphylococcus
DPTDDGGQF

SEQ ID NO: 1931610 - protein, 9 aa, Staphylococcus
DPTDGGGQF

SEQ ID NO: 1931611 - protein, 10 aa, Staphylococcus
DPTDNKGQFF

SEQ ID NO: 1931612 - protein, 7 aa, Staphylococcus
DPTDTLK

SEQ ID NO: 1931613 - protein, 12 aa, Staphylococcus
DPTDYKRTGEEL

SEQ ID NO: 1931614 - protein, 4 aa, Staphylococcus
DPTF

SEQ ID NO: 1931615 - protein, 7 aa, Staphylococcus
DPTGGSM

SEQ ID NO: 1931616 - protein, 5 aa, Staphylococcus
DPTHH

SEQ ID NO: 1931617 - protein, 7 aa, Staphylococcus
DPTHPVT

SEQ ID NO: 1931618 - protein, 4 aa, Staphylococcus
DPTI

SEQ ID NO: 1931619 - protein, 18 aa, Staphylococcus
DPTIVNENANKDSNTFST

SEQ ID NO: 1931620 - protein, 14 aa, Staphylococcus
DPTKVTRSALQNAA

SEQ ID NO: 1931621 - protein, 13 aa, Staphylococcus
DPTKVTRSSLQHA

SEQ ID NO: 1931622 - protein, 4 aa, Staphylococcus
DPTL

SEQ ID NO: 1931623 - protein, 7 aa, Staphylococcus
DPTNNVA

SEQ ID NO: 1931624 - protein, 7 aa, Staphylococcus
DPTNSVA

SEQ ID NO: 1931625 - protein, 8 aa, Staphylococcus
DPTNWESE

SEQ ID NO: 1931626 - protein, 6 aa, Staphylococcus
DPTRIE

SEQ ID NO: 1931627 - protein, 5 aa, Staphylococcus
DPTYK

SEQ ID NO: 1931628 - protein, 6 aa, Staphylococcus
DPVADG

SEQ ID NO: 1931629 - protein, 10 aa, Staphylococcus
DPVADGPTIM

SEQ ID NO: 1931630 - protein, 10 aa, Staphylococcus
DPVADGSTIM

SEQ ID NO: 1931631 - protein, 4 aa, Staphylococcus
DPVE

SEQ ID NO: 1931632 - protein, 14 aa, Staphylococcus
DPVEKVDRQSKKII

SEQ ID NO: 1931633 - protein, 12 aa, Staphylococcus
DPVETPGTGTRV

SEQ ID NO: 1931634 - protein, 8 aa, Staphylococcus
DPVGGESL

SEQ ID NO: 1931635 - protein, 5 aa, Staphylococcus
DPVPN

SEQ ID NO: 1931636 - protein, 9 aa, Staphylococcus
DPVYTTGDN

SEQ ID NO: 1931637 - protein, 13 aa, Staphylococcus
DPWPKKRHTKRRL

SEQ ID NO: 1931638 - protein, 13 aa, Staphylococcus
DPWPKNRHAKRRL

SEQ ID NO: 1931639 - protein, 9 aa, Staphylococcus
DPWSNERDG

SEQ ID NO: 1931640 - protein, 12 aa, Staphylococcus
DPYENDEKQQDY

SEQ ID NO: 1931641 - protein, 10 aa, Staphylococcus
DPYHGPKQAH

SEQ ID NO: 1931642 - protein, 10 aa, Staphylococcus
DPYHGPNQAH

SEQ ID NO: 1931643 - protein, 6 aa, Staphylococcus
DPYHPE

SEQ ID NO: 1931644 - protein, 4 aa, Staphylococcus
DPYI

SEQ ID NO: 1931645 - protein, 6 aa, Staphylococcus
DPYLRS

SEQ ID NO: 1931646 - protein, 13 aa, Staphylococcus
DPYRHSLPQEETN

SEQ ID NO: 1931647 - protein, 4 aa, Staphylococcus
DPYS

SEQ ID NO: 1931648 - protein, 16 aa, Staphylococcus
DPYTNYGRPDSKYEKM

SEQ ID NO: 1931649 - protein, 14 aa, Staphylococcus
DPYTNYGRPDTKYA

SEQ ID NO: 1931650 - protein, 11 aa, Staphylococcus
DPYTPQVPASL

SEQ ID NO: 1931651 - protein, 10 aa, Staphylococcus
DQAADGNYQS

SEQ ID NO: 1931652 - protein, 8 aa, Staphylococcus
DQAAQQYA

SEQ ID NO: 1931653 - protein, 10 aa, Staphylococcus
DQADEKNKIA

SEQ ID NO: 1931654 - protein, 12 aa, Staphylococcus
DQADQKIFKVEK

SEQ ID NO: 1931655 - protein, 6 aa, Staphylococcus
DQADVE

SEQ ID NO: 1931656 - protein, 5 aa, Staphylococcus
DQAEN

SEQ ID NO: 1931657 - protein, 7 aa, Staphylococcus
DQAESHL

SEQ ID NO: 1931658 - protein, 12 aa, Staphylococcus
DQAETHDIDNNI

SEQ ID NO: 1931659 - protein, 6 aa, Staphylococcus
DQAGVK

SEQ ID NO: 1931660 - protein, 5 aa, Staphylococcus
DQAHL

SEQ ID NO: 1931661 - protein, 10 aa, Staphylococcus
DQAKVPAGGA

SEQ ID NO: 1931662 - protein, 14 aa, Staphylococcus
DQALDAAAKLSDRY

SEQ ID NO: 1931663 - protein, 16 aa, Staphylococcus
DQAMGKETELPADGYY

SEQ ID NO: 1931664 - protein, 15 aa, Staphylococcus
DQANSEVVGKHGTKV

SEQ ID NO: 1931665 - protein, 12 aa, Staphylococcus
DQAPKHMSGAHD

SEQ ID NO: 1931666 - protein, 7 aa, Staphylococcus
DQAPSIL

SEQ ID NO: 1931667 - protein, 14 aa, Staphylococcus
DQAQNLYKEDDNHD

SEQ ID NO: 1931668 - protein, 4 aa, Staphylococcus
DQAR

SEQ ID NO: 1931669 - protein, 7 aa, Staphylococcus
DQAREGR

SEQ ID NO: 1931670 - protein, 11 aa, Staphylococcus
DQASQHDGLGA

SEQ ID NO: 1931671 - protein, 8 aa, Staphylococcus
DQASSTSE

SEQ ID NO: 1931672 - protein, 9 aa, Staphylococcus
DQASTSGQA

SEQ ID NO: 1931673 - protein, 7 aa, Staphylococcus
DQATAER

SEQ ID NO: 1931674 - protein, 18 aa, Staphylococcus
DQATDAEKQNDKQPPQQK

SEQ ID NO: 1931675 - protein, 16 aa, Staphylococcus
DQATRELKKEGKLQQL

SEQ ID NO: 1931676 - protein, 4 aa, Staphylococcus
DQCE

SEQ ID NO: 1931677 - protein, 5 aa, Staphylococcus
DQDCE

SEQ ID NO: 1931678 - protein, 5 aa, Staphylococcus
DQDDV

SEQ ID NO: 1931679 - protein, 4 aa, Staphylococcus
DQDE

SEQ ID NO: 1931680 - protein, 4 aa, Staphylococcus
DQDF

SEQ ID NO: 1931681 - protein, 7 aa, Staphylococcus
DQDFPKH

SEQ ID NO: 1931682 - protein, 9 aa, Staphylococcus
DQDGATTEF

SEQ ID NO: 1931683 - protein, 5 aa, Staphylococcus
DQDGD

SEQ ID NO: 1931684 - protein, 8 aa, Staphylococcus
DQDGNVKN

SEQ ID NO: 1931685 - protein, 11 aa, Staphylococcus
DQDIDDKSAAY

SEQ ID NO: 1931686 - protein, 9 aa, Staphylococcus
DQDIKTANH

SEQ ID NO: 1931687 - protein, 9 aa, Staphylococcus
DQDKAQQFY

SEQ ID NO: 1931688 - protein, 9 aa, Staphylococcus
DQDKHKEHY

SEQ ID NO: 1931689 - protein, 8 aa, Staphylococcus
DQDKTLEE

SEQ ID NO: 1931690 - protein, 39 aa, Staphylococcus
DQDLTAEERQLKAEQQQPDHTSQSAEDETTQDNTDQSSP

SEQ ID NO: 1931691 - protein, 6 aa, Staphylococcus
DQDNEL

SEQ ID NO: 1931692 - protein, 6 aa, Staphylococcus
DQDPGV

SEQ ID NO: 1931693 - protein, 6 aa, Staphylococcus
DQDRLN

SEQ ID NO: 1931694 - protein, 6 aa, Staphylococcus
DQDTGK

SEQ ID NO: 1931695 - protein, 8 aa, Staphylococcus
DQDVYDPR

SEQ ID NO: 1931696 - protein, 35 aa, Staphylococcus
DQDVYDPRKYLGPAREAIKETVKGKIREFGTSNRA

SEQ ID NO: 1931697 - protein, 5 aa, Staphylococcus
DQEAH

SEQ ID NO: 1931698 - protein, 5 aa, Staphylococcus
DQEGL

SEQ ID NO: 1931699 - protein, 16 aa, Staphylococcus
DQEGNASPIAKEYRSQ

SEQ ID NO: 1931700 - protein, 5 aa, Staphylococcus
DQEGR

SEQ ID NO: 1931701 - protein, 12 aa, Staphylococcus
DQEGVEGSKDAR

SEQ ID NO: 1931702 - protein, 4 aa, Staphylococcus
DQEI

SEQ ID NO: 1931703 - protein, 17 aa, Staphylococcus
DQEIETGHSSDVLGNPI

SEQ ID NO: 1931704 - protein, 14 aa, Staphylococcus
DQEKEAARLNERNR

SEQ ID NO: 1931705 - protein, 15 aa, Staphylococcus
DQEKEAARTSERNRL

SEQ ID NO: 1931706 - protein, 8 aa, Staphylococcus
DQEKITKE

SEQ ID NO: 1931707 - protein, 6 aa, Staphylococcus
DQEKLQ

SEQ ID NO: 1931708 - protein, 5 aa, Staphylococcus
DQELE

SEQ ID NO: 1931709 - protein, 16 aa, Staphylococcus
DQEMKEELTQFIKDLN

SEQ ID NO: 1931710 - protein, 5 aa, Staphylococcus
DQENS

SEQ ID NO: 1931711 - protein, 14 aa, Staphylococcus
DQEQKLSQTEYTQP

SEQ ID NO: 1931712 - protein, 6 aa, Staphylococcus
DQEQQK

SEQ ID NO: 1931713 - protein, 9 aa, Staphylococcus
DQEQQLEAG

SEQ ID NO: 1931714 - protein, 11 aa, Staphylococcus
DQEQQLEAGTS

SEQ ID NO: 1931715 - protein, 6 aa, Staphylococcus
DQERIT

SEQ ID NO: 1931716 - protein, 5 aa, Staphylococcus
DQERQ

SEQ ID NO: 1931717 - protein, 24 aa, Staphylococcus
DQESEVEAAISSGAEYVTTSNKSL

SEQ ID NO: 1931718 - protein, 12 aa, Staphylococcus
DQESLQQGSTLT

SEQ ID NO: 1931719 - protein, 4 aa, Staphylococcus
DQET

SEQ ID NO: 1931720 - protein, 7 aa, Staphylococcus
DQEVKDR

SEQ ID NO: 1931721 - protein, 11 aa, Staphylococcus
DQFDEDKANDL

SEQ ID NO: 1931722 - protein, 4 aa, Staphylococcus
DQFG

SEQ ID NO: 1931723 - protein, 4 aa, Staphylococcus
DQGA

SEQ ID NO: 1931724 - protein, 9 aa, Staphylococcus
DQGASAKSI

SEQ ID NO: 1931725 - protein, 23 aa, Staphylococcus
DQGDSFDYEETKAKLGPYKENEN

SEQ ID NO: 1931726 - protein, 7 aa, Staphylococcus
DQGDVVE

SEQ ID NO: 1931727 - protein, 6 aa, Staphylococcus
DQGEID

SEQ ID NO: 1931728 - protein, 7 aa, Staphylococcus
DQGESFD

SEQ ID NO: 1931729 - protein, 23 aa, Staphylococcus
DQGESFDYEATKAKLGPYNNNEN

SEQ ID NO: 1931730 - protein, 22 aa, Staphylococcus
DQGESFDYESTKSKLGPYQENE

SEQ ID NO: 1931731 - protein, 23 aa, Staphylococcus
DQGESFDYETTKSKLGPYDDNEN

SEQ ID NO: 1931732 - protein, 23 aa, Staphylococcus
DQGESFDYETTKSQLGPYDENEN

SEQ ID NO: 1931733 - protein, 7 aa, Staphylococcus
DQGESLT

SEQ ID NO: 1931734 - protein, 11 aa, Staphylococcus
DQGGVDEKQNN

SEQ ID NO: 1931735 - protein, 7 aa, Staphylococcus
DQGKASA

SEQ ID NO: 1931736 - protein, 8 aa, Staphylococcus
DQGKASSY

SEQ ID NO: 1931737 - protein, 8 aa, Staphylococcus
DQGKDALP

SEQ ID NO: 1931738 - protein, 6 aa, Staphylococcus
DQGKLD

SEQ ID NO: 1931739 - protein, 10 aa, Staphylococcus
DQGKTEGRDT

SEQ ID NO: 1931740 - protein, 6 aa, Staphylococcus
DQGLEQ

SEQ ID NO: 1931741 - protein, 10 aa, Staphylococcus
DQGLKQGMED

SEQ ID NO: 1931742 - protein, 5 aa, Staphylococcus
DQGLP

SEQ ID NO: 1931743 - protein, 7 aa, Staphylococcus
DQGQATS

SEQ ID NO: 1931744 - protein, 22 aa, Staphylococcus
DQGQSFDYEEKKKELGPYQEDE

SEQ ID NO: 1931745 - protein, 8 aa, Staphylococcus
DQGSASTY

SEQ ID NO: 1931746 - protein, 7 aa, Staphylococcus
DQGSVYT

SEQ ID NO: 1931747 - protein, 12 aa, Staphylococcus
DQGSVYTSYAYY

SEQ ID NO: 1931748 - protein, 4 aa, Staphylococcus
DQGV

SEQ ID NO: 1931749 - protein, 9 aa, Staphylococcus
DQGYSAGTE

SEQ ID NO: 1931750 - protein, 6 aa, Staphylococcus
DQHAET

SEQ ID NO: 1931751 - protein, 5 aa, Staphylococcus
DQHDI

SEQ ID NO: 1931752 - protein, 7 aa, Staphylococcus
DQHGPNH

SEQ ID NO: 1931753 - protein, 5 aa, Staphylococcus
DQHNS

SEQ ID NO: 1931754 - protein, 4 aa, Staphylococcus
DQIA

SEQ ID NO: 1931755 - protein, 10 aa, Staphylococcus
DQIGDEKGDA

SEQ ID NO: 1931756 - protein, 7 aa, Staphylococcus
DQIGEEQ

SEQ ID NO: 1931757 - protein, 11 aa, Staphylococcus
DQIGPLTRTVK

SEQ ID NO: 1931758 - protein, 15 aa, Staphylococcus
DQIKAGAQVATDNQI

SEQ ID NO: 1931759 - protein, 25 aa, Staphylococcus
DQIKENKQTDLHRPKSADRVNHKNE

SEQ ID NO: 1931760 - protein, 5 aa, Staphylococcus
DQIKT

SEQ ID NO: 1931761 - protein, 5 aa, Staphylococcus
DQIPD

SEQ ID NO: 1931762 - protein, 8 aa, Staphylococcus
DQIPSEIA

SEQ ID NO: 1931763 - protein, 5 aa, Staphylococcus
DQIPT

SEQ ID NO: 1931764 - protein, 11 aa, Staphylococcus
DQISNETYPIK

SEQ ID NO: 1931765 - protein, 10 aa, Staphylococcus
DQKAAEKQFQ

SEQ ID NO: 1931766 - protein, 12 aa, Staphylococcus
DQKDANKYKPYL

SEQ ID NO: 1931767 - protein, 4 aa, Staphylococcus
DQKE

SEQ ID NO: 1931768 - protein, 8 aa, Staphylococcus
DQKESVQT

SEQ ID NO: 1931769 - protein, 14 aa, Staphylococcus
DQKFHQQEYKKAAS

SEQ ID NO: 1931770 - protein, 9 aa, Staphylococcus
DQKGPLEVS

SEQ ID NO: 1931771 - protein, 18 aa, Staphylococcus
DQKKALVQDEAQDKANEK

SEQ ID NO: 1931772 - protein, 17 aa, Staphylococcus
DQKKGLVKDEAVNKANE

SEQ ID NO: 1931773 - protein, 11 aa, Staphylococcus
DQKQAEFKSNK

SEQ ID NO: 1931774 - protein, 9 aa, Staphylococcus
DQKQQQEYY

SEQ ID NO: 1931775 - protein, 8 aa, Staphylococcus
DQKRPMHS

SEQ ID NO: 1931776 - protein, 13 aa, Staphylococcus
DQKSIARKAQEAY

SEQ ID NO: 1931777 - protein, 13 aa, Staphylococcus
DQKSIGRKAQEAY

SEQ ID NO: 1931778 - protein, 16 aa, Staphylococcus
DQKYKQRNYRKAAEYY

SEQ ID NO: 1931779 - protein, 5 aa, Staphylococcus
DQLAQ

SEQ ID NO: 1931780 - protein, 5 aa, Staphylococcus
DQLAS

SEQ ID NO: 1931781 - protein, 25 aa, Staphylococcus
DQLEQNEQADEGSKKVDPRLQNYTI

SEQ ID NO: 1931782 - protein, 6 aa, Staphylococcus
DQLGSE

SEQ ID NO: 1931783 - protein, 5 aa, Staphylococcus
DQLHG

SEQ ID NO: 1931784 - protein, 8 aa, Staphylococcus
DQLKPQEA

SEQ ID NO: 1931785 - protein, 6 aa, Staphylococcus
DQLNDL

SEQ ID NO: 1931786 - protein, 4 aa, Staphylococcus
DQLP

SEQ ID NO: 1931787 - protein, 8 aa, Staphylococcus
DQLPGKFT

SEQ ID NO: 1931788 - protein, 10 aa, Staphylococcus
DQLSGSNSGI

SEQ ID NO: 1931789 - protein, 6 aa, Staphylococcus
DQLSQK

SEQ ID NO: 1931790 - protein, 7 aa, Staphylococcus
DQLTATQ

SEQ ID NO: 1931791 - protein, 9 aa, Staphylococcus
DQLTPGRQR

SEQ ID NO: 1931792 - protein, 6 aa, Staphylococcus
DQLTSK

SEQ ID NO: 1931793 - protein, 4 aa, Staphylococcus
DQLY

SEQ ID NO: 1931794 - protein, 5 aa, Staphylococcus
DQMNT

SEQ ID NO: 1931795 - protein, 4 aa, Staphylococcus
DQNE

SEQ ID NO: 1931796 - protein, 12 aa, Staphylococcus
DQNEAKVSYEDR

SEQ ID NO: 1931797 - protein, 11 aa, Staphylococcus
DQNEATSKDIN

SEQ ID NO: 1931798 - protein, 12 aa, Staphylococcus
DQNETINIPNHF

SEQ ID NO: 1931799 - protein, 16 aa, Staphylococcus
DQNGNKIKEKKITIRE

SEQ ID NO: 1931800 - protein, 9 aa, Staphylococcus
DQNKIDRPI

SEQ ID NO: 1931801 - protein, 7 aa, Staphylococcus
DQNKPED

SEQ ID NO: 1931802 - protein, 4 aa, Staphylococcus
DQNL

SEQ ID NO: 1931803 - protein, 10 aa, Staphylococcus
DQNLNRDSVT

SEQ ID NO: 1931804 - protein, 10 aa, Staphylococcus
DQNNDMTREE

SEQ ID NO: 1931805 - protein, 7 aa, Staphylococcus
DQNNQSF

SEQ ID NO: 1931806 - protein, 4 aa, Staphylococcus
DQNP

SEQ ID NO: 1931807 - protein, 5 aa, Staphylococcus
DQNPY

SEQ ID NO: 1931808 - protein, 4 aa, Staphylococcus
DQNQ

SEQ ID NO: 1931809 - protein, 14 aa, Staphylococcus
DQNSGQTPGIPTGY

SEQ ID NO: 1931810 - protein, 5 aa, Staphylococcus
DQNSV

SEQ ID NO: 1931811 - protein, 7 aa, Staphylococcus
DQNTTAD

SEQ ID NO: 1931812 - protein, 6 aa, Staphylococcus
DQNTTI

SEQ ID NO: 1931813 - protein, 5 aa, Staphylococcus
DQPED

SEQ ID NO: 1931814 - protein, 13 aa, Staphylococcus
DQPEDMTGESLIN

SEQ ID NO: 1931815 - protein, 6 aa, Staphylococcus
DQPEQF

SEQ ID NO: 1931816 - protein, 5 aa, Staphylococcus
DQPES

SEQ ID NO: 1931817 - protein, 10 aa, Staphylococcus
DQPGEESSNV

SEQ ID NO: 1931818 - protein, 8 aa, Staphylococcus
DQPIPKNN

SEQ ID NO: 1931819 - protein, 12 aa, Staphylococcus
DQPRKELSAYAP

SEQ ID NO: 1931820 - protein, 12 aa, Staphylococcus
DQPRNELSAYAP

SEQ ID NO: 1931821 - protein, 14 aa, Staphylococcus
DQPRPELSAYAPKV

SEQ ID NO: 1931822 - protein, 12 aa, Staphylococcus
DQPRSELSAYAP

SEQ ID NO: 1931823 - protein, 6 aa, Staphylococcus
DQPRVQ

SEQ ID NO: 1931824 - protein, 5 aa, Staphylococcus
DQPTN

SEQ ID NO: 1931825 - protein, 5 aa, Staphylococcus
DQPVQ

SEQ ID NO: 1931826 - protein, 7 aa, Staphylococcus
DQPVTSP

SEQ ID NO: 1931827 - protein, 7 aa, Staphylococcus
DQPYPDN

SEQ ID NO: 1931828 - protein, 38 aa, Staphylococcus
DQQAKRQEKQVNVPELTPQTSQTLDKNNVAKNHESNHN

SEQ ID NO: 1931829 - protein, 6 aa, Staphylococcus
DQQAPA

SEQ ID NO: 1931830 - protein, 9 aa, Staphylococcus
DQQAQSRGL

SEQ ID NO: 1931831 - protein, 14 aa, Staphylococcus
DQQELTFDVQRPTD

SEQ ID NO: 1931832 - protein, 4 aa, Staphylococcus
DQQF

SEQ ID NO: 1931833 - protein, 4 aa, Staphylococcus
DQQH

SEQ ID NO: 1931834 - protein, 10 aa, Staphylococcus
DQQKHYDGHD

SEQ ID NO: 1931835 - protein, 17 aa, Staphylococcus
DQQPDEYKESVLPSSIT

SEQ ID NO: 1931836 - protein, 7 aa, Staphylococcus
DQQQFSS

SEQ ID NO: 1931837 - protein, 12 aa, Staphylococcus
DQQQLPADQGVT

SEQ ID NO: 1931838 - protein, 16 aa, Staphylococcus
DQQQSFDDLRYKNRFL

SEQ ID NO: 1931839 - protein, 5 aa, Staphylococcus
DQQSI

SEQ ID NO: 1931840 - protein, 8 aa, Staphylococcus
DQQSYASQ

SEQ ID NO: 1931841 - protein, 6 aa, Staphylococcus
DQQSYE

SEQ ID NO: 1931842 - protein, 8 aa, Staphylococcus
DQQSYEQT

SEQ ID NO: 1931843 - protein, 4 aa, Staphylococcus
DQQV

SEQ ID NO: 1931844 - protein, 6 aa, Staphylococcus
DQREGV

SEQ ID NO: 1931845 - protein, 6 aa, Staphylococcus
DQREPD

SEQ ID NO: 1931846 - protein, 4 aa, Staphylococcus
DQRG

SEQ ID NO: 1931847 - protein, 5 aa, Staphylococcus
DQRGA

SEQ ID NO: 1931848 - protein, 16 aa, Staphylococcus
DQRGEINGNRRKLNAA

SEQ ID NO: 1931849 - protein, 14 aa, Staphylococcus
DQRPHALSGGQQQR

SEQ ID NO: 1931850 - protein, 25 aa, Staphylococcus
DQRRRTGSQDPVPRRELGPADPHRP

SEQ ID NO: 1931851 - protein, 15 aa, Staphylococcus
DQRSDELSGGQQQRI

SEQ ID NO: 1931852 - protein, 15 aa, Staphylococcus
DQRTEEASGADYAYT

SEQ ID NO: 1931853 - protein, 10 aa, Staphylococcus
DQRYDEVQKD

SEQ ID NO: 1931854 - protein, 8 aa, Staphylococcus
DQSASGQT

SEQ ID NO: 1931855 - protein, 6 aa, Staphylococcus
DQSDMT

SEQ ID NO: 1931856 - protein, 8 aa, Staphylococcus
DQSEHDES

SEQ ID NO: 1931857 - protein, 5 aa, Staphylococcus
DQSEI

SEQ ID NO: 1931858 - protein, 8 aa, Staphylococcus
DQSEPIMS

SEQ ID NO: 1931859 - protein, 26 aa, Staphylococcus
DQSGGSTPKALKDYGVEENEYSNDEE

SEQ ID NO: 1931860 - protein, 25 aa, Staphylococcus
DQSGGSTPKALKEYGINEDQYSNED

SEQ ID NO: 1931861 - protein, 25 aa, Staphylococcus
DQSGGSTPKALKEYGVGEDQYNNED

SEQ ID NO: 1931862 - protein, 26 aa, Staphylococcus
DQSGGSTPKALKEYGVNEDQYSNDDE

SEQ ID NO: 1931863 - protein, 26 aa, Staphylococcus
DQSGGSTPKALRDYGVTEDQYDSEDE

SEQ ID NO: 1931864 - protein, 17 aa, Staphylococcus
DQSISNGTKLKKSDKIE

SEQ ID NO: 1931865 - protein, 4 aa, Staphylococcus
DQSK

SEQ ID NO: 1931866 - protein, 16 aa, Staphylococcus
DQSKIREKYKTTNPSI

SEQ ID NO: 1931867 - protein, 10 aa, Staphylococcus
DQSLESRSRL

SEQ ID NO: 1931868 - protein, 6 aa, Staphylococcus
DQSLSN

SEQ ID NO: 1931869 - protein, 7 aa, Staphylococcus
DQSMEQD

SEQ ID NO: 1931870 - protein, 6 aa, Staphylococcus
DQSMSN

SEQ ID NO: 1931871 - protein, 5 aa, Staphylococcus
DQSQT

SEQ ID NO: 1931872 - protein, 28 aa, Staphylococcus
DQSRGDQIDNAENFESKGYGRTIPEDQL

SEQ ID NO: 1931873 - protein, 19 aa, Staphylococcus
DQSRGDQIDNAKHFESKGF

SEQ ID NO: 1931874 - protein, 28 aa, Staphylococcus
DQSRGDQIDNAKNFESKGYGKAIPEEEL

SEQ ID NO: 1931875 - protein, 32 aa, Staphylococcus
DQSRGDQIDNAKNFQNKGYAETLPEDQANTTN

SEQ ID NO: 1931876 - protein, 22 aa, Staphylococcus
DQSRGDQIDNAKNFSSKGYGRY

SEQ ID NO: 1931877 - protein, 5 aa, Staphylococcus
DQSRP

SEQ ID NO: 1931878 - protein, 12 aa, Staphylococcus
DQSSDYSSQESS

SEQ ID NO: 1931879 - protein, 8 aa, Staphylococcus
DQSSKTAT

SEQ ID NO: 1931880 - protein, 11 aa, Staphylococcus
DQSSRGKSKGL

SEQ ID NO: 1931881 - protein, 9 aa, Staphylococcus
DQSSSGQTL

SEQ ID NO: 1931882 - protein, 7 aa, Staphylococcus
DQSSTGL

SEQ ID NO: 1931883 - protein, 9 aa, Staphylococcus
DQSTVASPL

SEQ ID NO: 1931884 - protein, 12 aa, Staphylococcus
DQSVSDEDERTI

SEQ ID NO: 1931885 - protein, 4 aa, Staphylococcus
DQSY

SEQ ID NO: 1931886 - protein, 17 aa, Staphylococcus
DQTALSSHEVAQGYKNV

SEQ ID NO: 1931887 - protein, 6 aa, Staphylococcus
DQTDEE

SEQ ID NO: 1931888 - protein, 5 aa, Staphylococcus
DQTDT

SEQ ID NO: 1931889 - protein, 18 aa, Staphylococcus
DQTEINGKNGDAKEKERL

SEQ ID NO: 1931890 - protein, 6 aa, Staphylococcus
DQTETR

SEQ ID NO: 1931891 - protein, 6 aa, Staphylococcus
DQTGNR

SEQ ID NO: 1931892 - protein, 6 aa, Staphylococcus
DQTGQS

SEQ ID NO: 1931893 - protein, 7 aa, Staphylococcus
DQTGSYV

SEQ ID NO: 1931894 - protein, 8 aa, Staphylococcus
DQTGTPGT

SEQ ID NO: 1931895 - protein, 4 aa, Staphylococcus
DQTI

SEQ ID NO: 1931896 - protein, 6 aa, Staphylococcus
DQTKAQ

SEQ ID NO: 1931897 - protein, 9 aa, Staphylococcus
DQTKVERPV

SEQ ID NO: 1931898 - protein, 10 aa, Staphylococcus
DQTNATRAAM

SEQ ID NO: 1931899 - protein, 7 aa, Staphylococcus
DQTNEMT

SEQ ID NO: 1931900 - protein, 8 aa, Staphylococcus
DQTNKNID

SEQ ID NO: 1931901 - protein, 4 aa, Staphylococcus
DQTP

SEQ ID NO: 1931902 - protein, 8 aa, Staphylococcus
DQTPASIK

SEQ ID NO: 1931903 - protein, 6 aa, Staphylococcus
DQTPLF

SEQ ID NO: 1931904 - protein, 10 aa, Staphylococcus
DQTSAHDPLN

SEQ ID NO: 1931905 - protein, 20 aa, Staphylococcus
DQTSAHDPLNGYVPQGYSLE

SEQ ID NO: 1931906 - protein, 5 aa, Staphylococcus
DQTTV

SEQ ID NO: 1931907 - protein, 4 aa, Staphylococcus
DQTV

SEQ ID NO: 1931908 - protein, 6 aa, Staphylococcus
DQTVEG

SEQ ID NO: 1931909 - protein, 6 aa, Staphylococcus
DQTVGK

SEQ ID NO: 1931910 - protein, 7 aa, Staphylococcus
DQTVNDI

SEQ ID NO: 1931911 - protein, 6 aa, Staphylococcus
DQTVRE

SEQ ID NO: 1931912 - protein, 15 aa, Staphylococcus
DQTYQTSNKDSETVL

SEQ ID NO: 1931913 - protein, 7 aa, Staphylococcus
DQVAEYS

SEQ ID NO: 1931914 - protein, 6 aa, Staphylococcus
DQVETE

SEQ ID NO: 1931915 - protein, 6 aa, Staphylococcus
DQVGED

SEQ ID NO: 1931916 - protein, 6 aa, Staphylococcus
DQVGEE

SEQ ID NO: 1931917 - protein, 25 aa, Staphylococcus
DQVLEKEEKASDENSNERNTKKVNI

SEQ ID NO: 1931918 - protein, 4 aa, Staphylococcus
DQVS

SEQ ID NO: 1931919 - protein, 8 aa, Staphylococcus
DQVSESLK

SEQ ID NO: 1931920 - protein, 10 aa, Staphylococcus
DQVSNEYKSN

SEQ ID NO: 1931921 - protein, 7 aa, Staphylococcus
DQVTRKE

SEQ ID NO: 1931922 - protein, 18 aa, Staphylococcus
DQYASAGSFRRYKEQSKD

SEQ ID NO: 1931923 - protein, 7 aa, Staphylococcus
DQYDEDL

SEQ ID NO: 1931924 - protein, 5 aa, Staphylococcus
DQYDQ

SEQ ID NO: 1931925 - protein, 5 aa, Staphylococcus
DQYGE

SEQ ID NO: 1931926 - protein, 10 aa, Staphylococcus
DQYKTKDLKK

SEQ ID NO: 1931927 - protein, 7 aa, Staphylococcus
DQYLSGS

SEQ ID NO: 1931928 - protein, 4 aa, Staphylococcus
DQYN

SEQ ID NO: 1931929 - protein, 13 aa, Staphylococcus
DQYPDQLSGGMQQ

SEQ ID NO: 1931930 - protein, 4 aa, Staphylococcus
DQYQ

SEQ ID NO: 1931931 - protein, 13 aa, Staphylococcus
DQYSEDNRQLDQK

SEQ ID NO: 1931932 - protein, 10 aa, Staphylococcus
DRAADGYDYD

SEQ ID NO: 1931933 - protein, 7 aa, Staphylococcus
DRADINR

SEQ ID NO: 1931934 - protein, 17 aa, Staphylococcus
DRAESSIDNTRHDETNI

SEQ ID NO: 1931935 - protein, 4 aa, Staphylococcus
DRAG

SEQ ID NO: 1931936 - protein, 6 aa, Staphylococcus
DRAGQL

SEQ ID NO: 1931937 - protein, 6 aa, Staphylococcus
DRAKAR

SEQ ID NO: 1931938 - protein, 10 aa, Staphylococcus
DRAKDRFAEV

SEQ ID NO: 1931939 - protein, 5 aa, Staphylococcus
DRAKM

SEQ ID NO: 1931940 - protein, 8 aa, Staphylococcus
DRAKVDED

SEQ ID NO: 1931941 - protein, 8 aa, Staphylococcus
DRANAKDV

SEQ ID NO: 1931942 - protein, 6 aa, Staphylococcus
DRAPEI

SEQ ID NO: 1931943 - protein, 5 aa, Staphylococcus
DRAQH

SEQ ID NO: 1931944 - protein, 5 aa, Staphylococcus
DRAQV

SEQ ID NO: 1931945 - protein, 5 aa, Staphylococcus
DRARL

SEQ ID NO: 1931946 - protein, 13 aa, Staphylococcus
DRATEWNQAFSNK

SEQ ID NO: 1931947 - protein, 15 aa, Staphylococcus
DRDEKLGKKIRESQM

SEQ ID NO: 1931948 - protein, 13 aa, Staphylococcus
DRDESIGDADERT

SEQ ID NO: 1931949 - protein, 7 aa, Staphylococcus
DRDGARV

SEQ ID NO: 1931950 - protein, 5 aa, Staphylococcus
DRDIS

SEQ ID NO: 1931951 - protein, 13 aa, Staphylococcus
DRDKEAIKTAPRI

SEQ ID NO: 1931952 - protein, 13 aa, Staphylococcus
DRDKEAVKHAPRI

SEQ ID NO: 1931953 - protein, 13 aa, Staphylococcus
DRDKEAVKNAPRI

SEQ ID NO: 1931954 - protein, 14 aa, Staphylococcus
DRDKEAVKNAPRIT

SEQ ID NO: 1931955 - protein, 13 aa, Staphylococcus
DRDKEAVKTAPRI

SEQ ID NO: 1931956 - protein, 9 aa, Staphylococcus
DRDKPEHLE

SEQ ID NO: 1931957 - protein, 9 aa, Staphylococcus
DRDKPEHLQ

SEQ ID NO: 1931958 - protein, 9 aa, Staphylococcus
DRDKQEHLD

SEQ ID NO: 1931959 - protein, 9 aa, Staphylococcus
DRDKSEHLD

SEQ ID NO: 1931960 - protein, 9 aa, Staphylococcus
DRDLTQLAT

SEQ ID NO: 1931961 - protein, 18 aa, Staphylococcus
DRDTLDVNGEHKKAEEID

SEQ ID NO: 1931962 - protein, 5 aa, Staphylococcus
DRDTS

SEQ ID NO: 1931963 - protein, 8 aa, Staphylococcus
DRDTSKLE

SEQ ID NO: 1931964 - protein, 16 aa, Staphylococcus
DRDTSKLEKVSAPFPR

SEQ ID NO: 1931965 - protein, 5 aa, Staphylococcus
DRDTT

SEQ ID NO: 1931966 - protein, 8 aa, Staphylococcus
DRDTTKLE

SEQ ID NO: 1931967 - protein, 10 aa, Staphylococcus
DREADGYITK

SEQ ID NO: 1931968 - protein, 6 aa, Staphylococcus
DREDET

SEQ ID NO: 1931969 - protein, 7 aa, Staphylococcus
DREDNLQ

SEQ ID NO: 1931970 - protein, 5 aa, Staphylococcus
DREDV

SEQ ID NO: 1931971 - protein, 15 aa, Staphylococcus
DREEKLGKKIRESQL

SEQ ID NO: 1931972 - protein, 7 aa, Staphylococcus
DREESPI

SEQ ID NO: 1931973 - protein, 7 aa, Staphylococcus
DREEVDI

SEQ ID NO: 1931974 - protein, 7 aa, Staphylococcus
DREEVDL

SEQ ID NO: 1931975 - protein, 4 aa, Staphylococcus
DREG

SEQ ID NO: 1931976 - protein, 8 aa, Staphylococcus
DREGKTSH

SEQ ID NO: 1931977 - protein, 11 aa, Staphylococcus
DREGLSDNQNI

SEQ ID NO: 1931978 - protein, 13 aa, Staphylococcus
DREGVEGSKDERT

SEQ ID NO: 1931979 - protein, 17 aa, Staphylococcus
DREHVDERHNLTKGRLQ

SEQ ID NO: 1931980 - protein, 5 aa, Staphylococcus
DREID

SEQ ID NO: 1931981 - protein, 5 aa, Staphylococcus
DREIN

SEQ ID NO: 1931982 - protein, 22 aa, Staphylococcus
DREKAKNKRGKIGVEHAKPEDI

SEQ ID NO: 1931983 - protein, 5 aa, Staphylococcus
DREKY

SEQ ID NO: 1931984 - protein, 7 aa, Staphylococcus
DRELQQK

SEQ ID NO: 1931985 - protein, 4 aa, Staphylococcus
DREN

SEQ ID NO: 1931986 - protein, 7 aa, Staphylococcus
DRENIDR

SEQ ID NO: 1931987 - protein, 10 aa, Staphylococcus
DRENKKGEKI

SEQ ID NO: 1931988 - protein, 6 aa, Staphylococcus
DRENPF

SEQ ID NO: 1931989 - protein, 11 aa, Staphylococcus
DRENPGPSTLK

SEQ ID NO: 1931990 - protein, 12 aa, Staphylococcus
DRENPGPSTLKQ

SEQ ID NO: 1931991 - protein, 12 aa, Staphylococcus
DRENPGPSTLKR

SEQ ID NO: 1931992 - protein, 8 aa, Staphylococcus
DRENPYDA

SEQ ID NO: 1931993 - protein, 13 aa, Staphylococcus
DREQHSDKQQDDH

SEQ ID NO: 1931994 - protein, 5 aa, Staphylococcus
DREQI

SEQ ID NO: 1931995 - protein, 5 aa, Staphylococcus
DREQV

SEQ ID NO: 1931996 - protein, 4 aa, Staphylococcus
DRER

SEQ ID NO: 1931997 - protein, 8 aa, Staphylococcus
DRFEENTL

SEQ ID NO: 1931998 - protein, 10 aa, Staphylococcus
DRFTNEDKEG

SEQ ID NO: 1931999 - protein, 4 aa, Staphylococcus
DRGE

SEQ ID NO: 1932000 - protein, 7 aa, Staphylococcus
DRGGHAK

SEQ ID NO: 1932001 - protein, 12 aa, Staphylococcus
DRGGYYESSGAL

SEQ ID NO: 1932002 - protein, 13 aa, Staphylococcus
DRGGYYESSGALK

SEQ ID NO: 1932003 - protein, 4 aa, Staphylococcus
DRGH

SEQ ID NO: 1932004 - protein, 5 aa, Staphylococcus
DRGIS

SEQ ID NO: 1932005 - protein, 7 aa, Staphylococcus
DRGISQE

SEQ ID NO: 1932006 - protein, 7 aa, Staphylococcus
DRGITQN

SEQ ID NO: 1932007 - protein, 7 aa, Staphylococcus
DRGLAGA

SEQ ID NO: 1932008 - protein, 6 aa, Staphylococcus
DRGNEF

SEQ ID NO: 1932009 - protein, 6 aa, Staphylococcus
DRGNGF

SEQ ID NO: 1932010 - protein, 8 aa, Staphylococcus
DRGPEPEK

SEQ ID NO: 1932011 - protein, 15 aa, Staphylococcus
DRGPGNGSGSNGHQE

SEQ ID NO: 1932012 - protein, 5 aa, Staphylococcus
DRGPV

SEQ ID NO: 1932013 - protein, 4 aa, Staphylococcus
DRGQ

SEQ ID NO: 1932014 - protein, 5 aa, Staphylococcus
DRGSF

SEQ ID NO: 1932015 - protein, 12 aa, Staphylococcus
DRGTNFMEPGTE

SEQ ID NO: 1932016 - protein, 19 aa, Staphylococcus
DRHDFNAAGENLAYGQQNS

SEQ ID NO: 1932017 - protein, 14 aa, Staphylococcus
DRHETTEKRTQDEI

SEQ ID NO: 1932018 - protein, 4 aa, Staphylococcus
DRHQ

SEQ ID NO: 1932019 - protein, 7 aa, Staphylococcus
DRHSKAN

SEQ ID NO: 1932020 - protein, 4 aa, Staphylococcus
DRHV

SEQ ID NO: 1932021 - protein, 5 aa, Staphylococcus
DRHYG

SEQ ID NO: 1932022 - protein, 7 aa, Staphylococcus
DRIDKNE

SEQ ID NO: 1932023 - protein, 6 aa, Staphylococcus
DRIDRN

SEQ ID NO: 1932024 - protein, 4 aa, Staphylococcus
DRIG

SEQ ID NO: 1932025 - protein, 6 aa, Staphylococcus
DRIGGV

SEQ ID NO: 1932026 - protein, 5 aa, Staphylococcus
DRIKN

SEQ ID NO: 1932027 - protein, 9 aa, Staphylococcus
DRINGSNIS

SEQ ID NO: 1932028 - protein, 4 aa, Staphylococcus
DRIP

SEQ ID NO: 1932029 - protein, 5 aa, Staphylococcus
DRISE

SEQ ID NO: 1932030 - protein, 11 aa, Staphylococcus
DRKDKNGKTRD

SEQ ID NO: 1932031 - protein, 11 aa, Staphylococcus
DRKDKNGNTRE

SEQ ID NO: 1932032 - protein, 11 aa, Staphylococcus
DRKDKNGNTRK

SEQ ID NO: 1932033 - protein, 9 aa, Staphylococcus
DRKDKNGQL

SEQ ID NO: 1932034 - protein, 9 aa, Staphylococcus
DRKDRAGVK

SEQ ID NO: 1932035 - protein, 8 aa, Staphylococcus
DRKGKTQV

SEQ ID NO: 1932036 - protein, 11 aa, Staphylococcus
DRKGKTQVETT

SEQ ID NO: 1932037 - protein, 7 aa, Staphylococcus
DRKGPNI

SEQ ID NO: 1932038 - protein, 4 aa, Staphylococcus
DRKI

SEQ ID NO: 1932039 - protein, 9 aa, Staphylococcus
DRKKSREKF

SEQ ID NO: 1932040 - protein, 5 aa, Staphylococcus
DRKLN

SEQ ID NO: 1932041 - protein, 7 aa, Staphylococcus
DRKNADR

SEQ ID NO: 1932042 - protein, 5 aa, Staphylococcus
DRKRP

SEQ ID NO: 1932043 - protein, 5 aa, Staphylococcus
DRKTN

SEQ ID NO: 1932044 - protein, 4 aa, Staphylococcus
DRKV

SEQ ID NO: 1932045 - protein, 8 aa, Staphylococcus
DRLANSEA

SEQ ID NO: 1932046 - protein, 13 aa, Staphylococcus
DRLASDPESFAPN

SEQ ID NO: 1932047 - protein, 13 aa, Staphylococcus
DRLASKPDAFAPN

SEQ ID NO: 1932048 - protein, 13 aa, Staphylococcus
DRLASNPAQFAPN

SEQ ID NO: 1932049 - protein, 13 aa, Staphylococcus
DRLASNPNEFAPN

SEQ ID NO: 1932050 - protein, 6 aa, Staphylococcus
DRLDEI

SEQ ID NO: 1932051 - protein, 5 aa, Staphylococcus
DRLDG

SEQ ID NO: 1932052 - protein, 16 aa, Staphylococcus
DRLDTNAYSLSGGQQQ

SEQ ID NO: 1932053 - protein, 9 aa, Staphylococcus
DRLEASTNI

SEQ ID NO: 1932054 - protein, 8 aa, Staphylococcus
DRLENSDA

SEQ ID NO: 1932055 - protein, 4 aa, Staphylococcus
DRLG

SEQ ID NO: 1932056 - protein, 7 aa, Staphylococcus
DRLGDMS

SEQ ID NO: 1932057 - protein, 8 aa, Staphylococcus
DRLGDMSR

SEQ ID NO: 1932058 - protein, 6 aa, Staphylococcus
DRLGGL

SEQ ID NO: 1932059 - protein, 9 aa, Staphylococcus
DRLGHGDIQ

SEQ ID NO: 1932060 - protein, 8 aa, Staphylococcus
DRLGNMSE

SEQ ID NO: 1932061 - protein, 4 aa, Staphylococcus
DRLL

SEQ ID NO: 1932062 - protein, 12 aa, Staphylococcus
DRLNEHNKREHK

SEQ ID NO: 1932063 - protein, 6 aa, Staphylococcus
DRLNKN

SEQ ID NO: 1932064 - protein, 6 aa, Staphylococcus
DRLQQL

SEQ ID NO: 1932065 - protein, 6 aa, Staphylococcus
DRLSEQ

SEQ ID NO: 1932066 - protein, 7 aa, Staphylococcus
DRLSEQD

SEQ ID NO: 1932067 - protein, 8 aa, Staphylococcus
DRLTEEDV

SEQ ID NO: 1932068 - protein, 13 aa, Staphylococcus
DRNDDIKIALGET

SEQ ID NO: 1932069 - protein, 14 aa, Staphylococcus
DRNDPAKLLPEEEE

SEQ ID NO: 1932070 - protein, 8 aa, Staphylococcus
DRNEDKIE

SEQ ID NO: 1932071 - protein, 5 aa, Staphylococcus
DRNEV

SEQ ID NO: 1932072 - protein, 5 aa, Staphylococcus
DRNFG

SEQ ID NO: 1932073 - protein, 5 aa, Staphylococcus
DRNGK

SEQ ID NO: 1932074 - protein, 12 aa, Staphylococcus
DRNGKPNKMNDD

SEQ ID NO: 1932075 - protein, 6 aa, Staphylococcus
DRNGRE

SEQ ID NO: 1932076 - protein, 6 aa, Staphylococcus
DRNGRQ

SEQ ID NO: 1932077 - protein, 5 aa, Staphylococcus
DRNID

SEQ ID NO: 1932078 - protein, 9 aa, Staphylococcus
DRNKPEHLE

SEQ ID NO: 1932079 - protein, 6 aa, Staphylococcus
DRNKRE

SEQ ID NO: 1932080 - protein, 18 aa, Staphylococcus
DRNMKTSDVYDIYHQLNA

SEQ ID NO: 1932081 - protein, 5 aa, Staphylococcus
DRNNC

SEQ ID NO: 1932082 - protein, 6 aa, Staphylococcus
DRNNSQ

SEQ ID NO: 1932083 - protein, 8 aa, Staphylococcus
DRNPENLP

SEQ ID NO: 1932084 - protein, 5 aa, Staphylococcus
DRNPL

SEQ ID NO: 1932085 - protein, 5 aa, Staphylococcus
DRNTK

SEQ ID NO: 1932086 - protein, 5 aa, Staphylococcus
DRNTS

SEQ ID NO: 1932087 - protein, 6 aa, Staphylococcus
DRNTSG

SEQ ID NO: 1932088 - protein, 11 aa, Staphylococcus
DRPADAPLKGY

SEQ ID NO: 1932089 - protein, 15 aa, Staphylococcus
DRPCEPEMVRRFLRW

SEQ ID NO: 1932090 - protein, 5 aa, Staphylococcus
DRPES

SEQ ID NO: 1932091 - protein, 8 aa, Staphylococcus
DRPGIVGR

SEQ ID NO: 1932092 - protein, 6 aa, Staphylococcus
DRPIDK

SEQ ID NO: 1932093 - protein, 17 aa, Staphylococcus
DRPLEAREDVDEKDLEK

SEQ ID NO: 1932094 - protein, 7 aa, Staphylococcus
DRPLPGH

SEQ ID NO: 1932095 - protein, 7 aa, Staphylococcus
DRPNMRK

SEQ ID NO: 1932096 - protein, 6 aa, Staphylococcus
DRPNPH

SEQ ID NO: 1932097 - protein, 9 aa, Staphylococcus
DRPSDTITA

SEQ ID NO: 1932098 - protein, 7 aa, Staphylococcus
DRPSNGM

SEQ ID NO: 1932099 - protein, 9 aa, Staphylococcus
DRPSTAKQI

SEQ ID NO: 1932100 - protein, 11 aa, Staphylococcus
DRPYADLTPEK

SEQ ID NO: 1932101 - protein, 6 aa, Staphylococcus
DRPYES

SEQ ID NO: 1932102 - protein, 9 aa, Staphylococcus
DRQERAGVK

SEQ ID NO: 1932103 - protein, 6 aa, Staphylococcus
DRQFES

SEQ ID NO: 1932104 - protein, 6 aa, Staphylococcus
DRQGKE

SEQ ID NO: 1932105 - protein, 6 aa, Staphylococcus
DRQIEG

SEQ ID NO: 1932106 - protein, 8 aa, Staphylococcus
DRQLSKQF

SEQ ID NO: 1932107 - protein, 8 aa, Staphylococcus
DRQRDDVD

SEQ ID NO: 1932108 - protein, 6 aa, Staphylococcus
DRQSYT

SEQ ID NO: 1932109 - protein, 4 aa, Staphylococcus
DRQT

SEQ ID NO: 1932110 - protein, 6 aa, Staphylococcus
DRQVGG

SEQ ID NO: 1932111 - protein, 12 aa, Staphylococcus
DRRAEIENNLEE

SEQ ID NO: 1932112 - protein, 5 aa, Staphylococcus
DRRDD

SEQ ID NO: 1932113 - protein, 6 aa, Staphylococcus
DRRDEV

SEQ ID NO: 1932114 - protein, 13 aa, Staphylococcus
DRRDEVKTSTKRR

SEQ ID NO: 1932115 - protein, 5 aa, Staphylococcus
DRRED

SEQ ID NO: 1932116 - protein, 5 aa, Staphylococcus
DRRGD

SEQ ID NO: 1932117 - protein, 5 aa, Staphylococcus
DRRGN

SEQ ID NO: 1932118 - protein, 6 aa, Staphylococcus
DRRGPY

SEQ ID NO: 1932119 - protein, 5 aa, Staphylococcus
DRRNA

SEQ ID NO: 1932120 - protein, 8 aa, Staphylococcus
DRRPDDAE

SEQ ID NO: 1932121 - protein, 10 aa, Staphylococcus
DRRPKDAKTY

SEQ ID NO: 1932122 - protein, 11 aa, Staphylococcus
DRRPNDAKPYH

SEQ ID NO: 1932123 - protein, 7 aa, Staphylococcus
DRSAVNQ

SEQ ID NO: 1932124 - protein, 4 aa, Staphylococcus
DRSD

SEQ ID NO: 1932125 - protein, 10 aa, Staphylococcus
DRSDKRRGRL

SEQ ID NO: 1932126 - protein, 12 aa, Staphylococcus
DRSDSNLSVANK

SEQ ID NO: 1932127 - protein, 7 aa, Staphylococcus
DRSLGEG

SEQ ID NO: 1932128 - protein, 11 aa, Staphylococcus
DRSMEEDEISK

SEQ ID NO: 1932129 - protein, 13 aa, Staphylococcus
DRSMETDGISKNS

SEQ ID NO: 1932130 - protein, 12 aa, Staphylococcus
DRTANSEEEMTQ

SEQ ID NO: 1932131 - protein, 6 aa, Staphylococcus
DRTATA

SEQ ID NO: 1932132 - protein, 11 aa, Staphylococcus
DRTDEAGNKRE

SEQ ID NO: 1932133 - protein, 4 aa, Staphylococcus
DRTE

SEQ ID NO: 1932134 - protein, 4 aa, Staphylococcus
DRTF

SEQ ID NO: 1932135 - protein, 5 aa, Staphylococcus
DRTKM

SEQ ID NO: 1932136 - protein, 10 aa, Staphylococcus
DRTNDAEDIA

SEQ ID NO: 1932137 - protein, 23 aa, Staphylococcus
DRTNKRKEIKRSGFKQRKEAVKK

SEQ ID NO: 1932138 - protein, 8 aa, Staphylococcus
DRTPYDQS

SEQ ID NO: 1932139 - protein, 6 aa, Staphylococcus
DRTREI

SEQ ID NO: 1932140 - protein, 8 aa, Staphylococcus
DRTSMATP

SEQ ID NO: 1932141 - protein, 8 aa, Staphylococcus
DRTSVGDK

SEQ ID NO: 1932142 - protein, 15 aa, Staphylococcus
DRTTSISGEISDTSY

SEQ ID NO: 1932143 - protein, 7 aa, Staphylococcus
DRVDKNE

SEQ ID NO: 1932144 - protein, 7 aa, Staphylococcus
DRVDRTR

SEQ ID NO: 1932145 - protein, 6 aa, Staphylococcus
DRVDYS

SEQ ID NO: 1932146 - protein, 4 aa, Staphylococcus
DRVE

SEQ ID NO: 1932147 - protein, 9 aa, Staphylococcus
DRVEELEKG

SEQ ID NO: 1932148 - protein, 7 aa, Staphylococcus
DRVEGDF

SEQ ID NO: 1932149 - protein, 5 aa, Staphylococcus
DRVEQ

SEQ ID NO: 1932150 - protein, 6 aa, Staphylococcus
DRVKGK

SEQ ID NO: 1932151 - protein, 6 aa, Staphylococcus
DRVNGD

SEQ ID NO: 1932152 - protein, 12 aa, Staphylococcus
DRVNKCGNQSSF

SEQ ID NO: 1932153 - protein, 9 aa, Staphylococcus
DRVSSGDLG

SEQ ID NO: 1932154 - protein, 5 aa, Staphylococcus
DRVTA

SEQ ID NO: 1932155 - protein, 12 aa, Staphylococcus
DRYGSDKPDTRF

SEQ ID NO: 1932156 - protein, 4 aa, Staphylococcus
DRYL

SEQ ID NO: 1932157 - protein, 11 aa, Staphylococcus
DRYRSKREQNQ

SEQ ID NO: 1932158 - protein, 12 aa, Staphylococcus
DRYSDERTEQTV

SEQ ID NO: 1932159 - protein, 26 aa, Staphylococcus
DRYSDERTEQTVRNRKRNKINMNYIG

SEQ ID NO: 1932160 - protein, 9 aa, Staphylococcus
DSAALSDDV

SEQ ID NO: 1932161 - protein, 8 aa, Staphylococcus
DSADADSN

SEQ ID NO: 1932162 - protein, 8 aa, Staphylococcus
DSADSERL

SEQ ID NO: 1932163 - protein, 11 aa, Staphylococcus
DSADVGTTKAR

SEQ ID NO: 1932164 - protein, 5 aa, Staphylococcus
DSAEG

SEQ ID NO: 1932165 - protein, 17 aa, Staphylococcus
DSAGGSTKEGRDSKTQA

SEQ ID NO: 1932166 - protein, 16 aa, Staphylococcus
DSAGGSTKEGRDSRTQ

SEQ ID NO: 1932167 - protein, 17 aa, Staphylococcus
DSAGGSTKSGRDSETQA

SEQ ID NO: 1932168 - protein, 16 aa, Staphylococcus
DSAGGSTKSGRDSRTQ

SEQ ID NO: 1932169 - protein, 17 aa, Staphylococcus
DSAGGSTKSGRDSSTQA

SEQ ID NO: 1932170 - protein, 9 aa, Staphylococcus
DSAKARGAE

SEQ ID NO: 1932171 - protein, 11 aa, Staphylococcus
DSAKEKSNEGI

SEQ ID NO: 1932172 - protein, 12 aa, Staphylococcus
DSAKEKSNEGTI

SEQ ID NO: 1932173 - protein, 11 aa, Staphylococcus
DSANGATGAMN

SEQ ID NO: 1932174 - protein, 9 aa, Staphylococcus
DSANKATRK

SEQ ID NO: 1932175 - protein, 8 aa, Staphylococcus
DSANKEDI

SEQ ID NO: 1932176 - protein, 14 aa, Staphylococcus
DSAPEGTQSEQVVS

SEQ ID NO: 1932177 - protein, 5 aa, Staphylococcus
DSAPL

SEQ ID NO: 1932178 - protein, 9 aa, Staphylococcus
DSAPWNNKR

SEQ ID NO: 1932179 - protein, 7 aa, Staphylococcus
DSAQKVA

SEQ ID NO: 1932180 - protein, 12 aa, Staphylococcus
DSASDLEGKDLS

SEQ ID NO: 1932181 - protein, 8 aa, Staphylococcus
DSASEQDV

SEQ ID NO: 1932182 - protein, 8 aa, Staphylococcus
DSASGETI

SEQ ID NO: 1932183 - protein, 8 aa, Staphylococcus
DSASGETL

SEQ ID NO: 1932184 - protein, 8 aa, Staphylococcus
DSASGKTI

SEQ ID NO: 1932185 - protein, 8 aa, Staphylococcus
DSASSQDV

SEQ ID NO: 1932186 - protein, 9 aa, Staphylococcus
DSATRTKYN

SEQ ID NO: 1932187 - protein, 4 aa, Staphylococcus
DSAV

SEQ ID NO: 1932188 - protein, 5 aa, Staphylococcus
DSAVE

SEQ ID NO: 1932189 - protein, 9 aa, Staphylococcus
DSDASQEQF

SEQ ID NO: 1932190 - protein, 9 aa, Staphylococcus
DSDDEGDRI

SEQ ID NO: 1932191 - protein, 4 aa, Staphylococcus
DSDE

SEQ ID NO: 1932192 - protein, 13 aa, Staphylococcus
DSDEEAQYLSTTQ

SEQ ID NO: 1932193 - protein, 6 aa, Staphylococcus
DSDEET

SEQ ID NO: 1932194 - protein, 6 aa, Staphylococcus
DSDEKD

SEQ ID NO: 1932195 - protein, 10 aa, Staphylococcus
DSDEQNTAAM

SEQ ID NO: 1932196 - protein, 7 aa, Staphylococcus
DSDHGGF

SEQ ID NO: 1932197 - protein, 15 aa, Staphylococcus
DSDIHNVSNDYDDMR

SEQ ID NO: 1932198 - protein, 11 aa, Staphylococcus
DSDKLVTRNGY

SEQ ID NO: 1932199 - protein, 5 aa, Staphylococcus
DSDLE

SEQ ID NO: 1932200 - protein, 7 aa, Staphylococcus
DSDLQGY

SEQ ID NO: 1932201 - protein, 10 aa, Staphylococcus
DSDNNSYPGE

SEQ ID NO: 1932202 - protein, 6 aa, Staphylococcus
DSDPER

SEQ ID NO: 1932203 - protein, 5 aa, Staphylococcus
DSDQM

SEQ ID NO: 1932204 - protein, 12 aa, Staphylococcus
DSDRPISSQDIS

SEQ ID NO: 1932205 - protein, 6 aa, Staphylococcus
DSDRPV

SEQ ID NO: 1932206 - protein, 4 aa, Staphylococcus
DSDS

SEQ ID NO: 1932207 - protein, 13 aa, Staphylococcus
DSDSAEDIHPNNR

SEQ ID NO: 1932208 - protein, 9 aa, Staphylococcus
DSDSGSQHT

SEQ ID NO: 1932209 - protein, 8 aa, Staphylococcus
DSDSNETI

SEQ ID NO: 1932210 - protein, 9 aa, Staphylococcus
DSDSSSPHS

SEQ ID NO: 1932211 - protein, 9 aa, Staphylococcus
DSDTEKTND

SEQ ID NO: 1932212 - protein, 6 aa, Staphylococcus
DSDTIT

SEQ ID NO: 1932213 - protein, 8 aa, Staphylococcus
DSDTNFDK

SEQ ID NO: 1932214 - protein, 5 aa, Staphylococcus
DSDVF

SEQ ID NO: 1932215 - protein, 7 aa, Staphylococcus
DSDVNQI

SEQ ID NO: 1932216 - protein, 6 aa, Staphylococcus
DSDVQQ

SEQ ID NO: 1932217 - protein, 7 aa, Staphylococcus
DSDVQQI

SEQ ID NO: 1932218 - protein, 15 aa, Staphylococcus
DSDYKKQEQETPGYQ

SEQ ID NO: 1932219 - protein, 15 aa, Staphylococcus
DSEAAMREERIEKTK

SEQ ID NO: 1932220 - protein, 8 aa, Staphylococcus
DSEATSPY

SEQ ID NO: 1932221 - protein, 5 aa, Staphylococcus
DSEDE

SEQ ID NO: 1932222 - protein, 7 aa, Staphylococcus
DSEDEAE

SEQ ID NO: 1932223 - protein, 8 aa, Staphylococcus
DSEDLTHD

SEQ ID NO: 1932224 - protein, 9 aa, Staphylococcus
DSEDNIRKA

SEQ ID NO: 1932225 - protein, 11 aa, Staphylococcus
DSEDSRAGRWS

SEQ ID NO: 1932226 - protein, 7 aa, Staphylococcus
DSEDVNV

SEQ ID NO: 1932227 - protein, 11 aa, Staphylococcus
DSEEHVQYTQK

SEQ ID NO: 1932228 - protein, 4 aa, Staphylococcus
DSEF

SEQ ID NO: 1932229 - protein, 12 aa, Staphylococcus
DSEFETLKKFRI

SEQ ID NO: 1932230 - protein, 15 aa, Staphylococcus
DSEFRYSGKPVPALQ

SEQ ID NO: 1932231 - protein, 4 aa, Staphylococcus
DSEG

SEQ ID NO: 1932232 - protein, 8 aa, Staphylococcus
DSEGNSYI

SEQ ID NO: 1932233 - protein, 5 aa, Staphylococcus
DSEGR

SEQ ID NO: 1932234 - protein, 6 aa, Staphylococcus
DSEGTP

SEQ ID NO: 1932235 - protein, 12 aa, Staphylococcus
DSEHKNKGPLSG

SEQ ID NO: 1932236 - protein, 4 aa, Staphylococcus
DSEI

SEQ ID NO: 1932237 - protein, 5 aa, Staphylococcus
DSEID

SEQ ID NO: 1932238 - protein, 6 aa, Staphylococcus
DSEIGD

SEQ ID NO: 1932239 - protein, 16 aa, Staphylococcus
DSEKLSTYQRQYSTAY

SEQ ID NO: 1932240 - protein, 8 aa, Staphylococcus
DSELNGSL

SEQ ID NO: 1932241 - protein, 7 aa, Staphylococcus
DSELPQA

SEQ ID NO: 1932242 - protein, 7 aa, Staphylococcus
DSELQGH

SEQ ID NO: 1932243 - protein, 29 aa, Staphylococcus
DSEMRRSNANFKHSEKNMQSYATRTKELT

SEQ ID NO: 1932244 - protein, 11 aa, Staphylococcus
DSENLVTRNGY

SEQ ID NO: 1932245 - protein, 7 aa, Staphylococcus
DSENRTL

SEQ ID NO: 1932246 - protein, 4 aa, Staphylococcus
DSEQ

SEQ ID NO: 1932247 - protein, 7 aa, Staphylococcus
DSEQAAQ

SEQ ID NO: 1932248 - protein, 6 aa, Staphylococcus
DSEQKD

SEQ ID NO: 1932249 - protein, 7 aa, Staphylococcus
DSEQRQI

SEQ ID NO: 1932250 - protein, 7 aa, Staphylococcus
DSEQTID

SEQ ID NO: 1932251 - protein, 9 aa, Staphylococcus
DSEQVTQEN

SEQ ID NO: 1932252 - protein, 4 aa, Staphylococcus
DSER

SEQ ID NO: 1932253 - protein, 15 aa, Staphylococcus
DSERNEYTKLLIETF

SEQ ID NO: 1932254 - protein, 15 aa, Staphylococcus
DSESEMRKERINKTK

SEQ ID NO: 1932255 - protein, 12 aa, Staphylococcus
DSESKDTSSTTH

SEQ ID NO: 1932256 - protein, 6 aa, Staphylococcus
DSESKL

SEQ ID NO: 1932257 - protein, 8 aa, Staphylococcus
DSESNETI

SEQ ID NO: 1932258 - protein, 6 aa, Staphylococcus
DSETES

SEQ ID NO: 1932259 - protein, 7 aa, Staphylococcus
DSETGHE

SEQ ID NO: 1932260 - protein, 8 aa, Staphylococcus
DSETGHES

SEQ ID NO: 1932261 - protein, 7 aa, Staphylococcus
DSETINS

SEQ ID NO: 1932262 - protein, 6 aa, Staphylococcus
DSETIR

SEQ ID NO: 1932263 - protein, 7 aa, Staphylococcus
DSETPVD

SEQ ID NO: 1932264 - protein, 15 aa, Staphylococcus
DSEVKGSIINLLNEL

SEQ ID NO: 1932265 - protein, 7 aa, Staphylococcus
DSEYTGG

SEQ ID NO: 1932266 - protein, 6 aa, Staphylococcus
DSFDEA

SEQ ID NO: 1932267 - protein, 5 aa, Staphylococcus
DSFDG

SEQ ID NO: 1932268 - protein, 6 aa, Staphylococcus
DSFDGG

SEQ ID NO: 1932269 - protein, 5 aa, Staphylococcus
DSFEE

SEQ ID NO: 1932270 - protein, 24 aa, Staphylococcus
DSFEEKYKELKQDPYADEEDQDEY

SEQ ID NO: 1932271 - protein, 5 aa, Staphylococcus
DSFEH

SEQ ID NO: 1932272 - protein, 12 aa, Staphylococcus
DSFEMPEGGYHG

SEQ ID NO: 1932273 - protein, 4 aa, Staphylococcus
DSFK

SEQ ID NO: 1932274 - protein, 8 aa, Staphylococcus
DSFKNTDT

SEQ ID NO: 1932275 - protein, 6 aa, Staphylococcus
DSFMSD

SEQ ID NO: 1932276 - protein, 7 aa, Staphylococcus
DSFNDSS

SEQ ID NO: 1932277 - protein, 14 aa, Staphylococcus
DSFNRGNVKNEKFK

SEQ ID NO: 1932278 - protein, 11 aa, Staphylococcus
DSFPSSQGQQG

SEQ ID NO: 1932279 - protein, 8 aa, Staphylococcus
DSFSPSEI

SEQ ID NO: 1932280 - protein, 6 aa, Staphylococcus
DSGADE

SEQ ID NO: 1932281 - protein, 9 aa, Staphylococcus
DSGAIGGNH

SEQ ID NO: 1932282 - protein, 9 aa, Staphylococcus
DSGAIGGSH

SEQ ID NO: 1932283 - protein, 6 aa, Staphylococcus
DSGAKE

SEQ ID NO: 1932284 - protein, 6 aa, Staphylococcus
DSGANE

SEQ ID NO: 1932285 - protein, 14 aa, Staphylococcus
DSGASYVTTSNRLL

SEQ ID NO: 1932286 - protein, 5 aa, Staphylococcus
DSGCT

SEQ ID NO: 1932287 - protein, 8 aa, Staphylococcus
DSGDNNVV

SEQ ID NO: 1932288 - protein, 9 aa, Staphylococcus
DSGDTETHR

SEQ ID NO: 1932289 - protein, 7 aa, Staphylococcus
DSGDVGI

SEQ ID NO: 1932290 - protein, 8 aa, Staphylococcus
DSGEIEDD

SEQ ID NO: 1932291 - protein, 8 aa, Staphylococcus
DSGELEAN

SEQ ID NO: 1932292 - protein, 16 aa, Staphylococcus
DSGENYVENASISTDE

SEQ ID NO: 1932293 - protein, 10 aa, Staphylococcus
DSGEQSATVL

SEQ ID NO: 1932294 - protein, 7 aa, Staphylococcus
DSGEYHE

SEQ ID NO: 1932295 - protein, 14 aa, Staphylococcus
DSGFNYRQQDNDFN

SEQ ID NO: 1932296 - protein, 9 aa, Staphylococcus
DSGGVTEYE

SEQ ID NO: 1932297 - protein, 8 aa, Staphylococcus
DSGKKDQL

SEQ ID NO: 1932298 - protein, 8 aa, Staphylococcus
DSGKRRSI

SEQ ID NO: 1932299 - protein, 4 aa, Staphylococcus
DSGL

SEQ ID NO: 1932300 - protein, 9 aa, Staphylococcus
DSGLPKRPF

SEQ ID NO: 1932301 - protein, 12 aa, Staphylococcus
DSGRIASSSYTA

SEQ ID NO: 1932302 - protein, 6 aa, Staphylococcus
DSGRYN

SEQ ID NO: 1932303 - protein, 10 aa, Staphylococcus
DSGTKKRGYA

SEQ ID NO: 1932304 - protein, 7 aa, Staphylococcus
DSGVKVE

SEQ ID NO: 1932305 - protein, 15 aa, Staphylococcus
DSGVSGKAAQKMAEK

SEQ ID NO: 1932306 - protein, 12 aa, Staphylococcus
DSGYKVGSNKHS

SEQ ID NO: 1932307 - protein, 4 aa, Staphylococcus
DSHE

SEQ ID NO: 1932308 - protein, 6 aa, Staphylococcus
DSHENV

SEQ ID NO: 1932309 - protein, 8 aa, Staphylococcus
DSHESKSS

SEQ ID NO: 1932310 - protein, 7 aa, Staphylococcus
DSHGADT

SEQ ID NO: 1932311 - protein, 8 aa, Staphylococcus
DSHNEHAT

SEQ ID NO: 1932312 - protein, 7 aa, Staphylococcus
DSHNYST

SEQ ID NO: 1932313 - protein, 41 aa, Staphylococcus
DSHPTQTNTSQSSANAQPQVTTESNDAQHQWTGDQSTIPVN

SEQ ID NO: 1932314 - protein, 15 aa, Staphylococcus
DSHRPNAKSKTKSQL

SEQ ID NO: 1932315 - protein, 8 aa, Staphylococcus
DSHSVETA

SEQ ID NO: 1932316 - protein, 6 aa, Staphylococcus
DSHTYS

SEQ ID NO: 1932317 - protein, 5 aa, Staphylococcus
DSHVS

SEQ ID NO: 1932318 - protein, 11 aa, Staphylococcus
DSIANDGYDNE

SEQ ID NO: 1932319 - protein, 11 aa, Staphylococcus
DSIANDGYNNE

SEQ ID NO: 1932320 - protein, 7 aa, Staphylococcus
DSIATNL

SEQ ID NO: 1932321 - protein, 5 aa, Staphylococcus
DSIDD

SEQ ID NO: 1932322 - protein, 10 aa, Staphylococcus
DSIDNIKNDA

SEQ ID NO: 1932323 - protein, 7 aa, Staphylococcus
DSIDSKS

SEQ ID NO: 1932324 - protein, 4 aa, Staphylococcus
DSIE

SEQ ID NO: 1932325 - protein, 5 aa, Staphylococcus
DSIER

SEQ ID NO: 1932326 - protein, 6 aa, Staphylococcus
DSIERL

SEQ ID NO: 1932327 - protein, 8 aa, Staphylococcus
DSIERTSR

SEQ ID NO: 1932328 - protein, 6 aa, Staphylococcus
DSIETG

SEQ ID NO: 1932329 - protein, 6 aa, Staphylococcus
DSIETS

SEQ ID NO: 1932330 - protein, 6 aa, Staphylococcus
DSIINT

SEQ ID NO: 1932331 - protein, 8 aa, Staphylococcus
DSIKKGVD

SEQ ID NO: 1932332 - protein, 10 aa, Staphylococcus
DSIKNKETQF

SEQ ID NO: 1932333 - protein, 14 aa, Staphylococcus
DSINDALEDKADGY

SEQ ID NO: 1932334 - protein, 8 aa, Staphylococcus
DSINQETD

SEQ ID NO: 1932335 - protein, 6 aa, Staphylococcus
DSIPDN

SEQ ID NO: 1932336 - protein, 6 aa, Staphylococcus
DSIQTR

SEQ ID NO: 1932337 - protein, 20 aa, Staphylococcus
DSISDGTVEISGNEINQLSN

SEQ ID NO: 1932338 - protein, 9 aa, Staphylococcus
DSISDSERN

SEQ ID NO: 1932339 - protein, 19 aa, Staphylococcus
DSISGGTVEVSGNEINQLK

SEQ ID NO: 1932340 - protein, 15 aa, Staphylococcus
DSISIEDNGRGMPTG

SEQ ID NO: 1932341 - protein, 6 aa, Staphylococcus
DSITQS

SEQ ID NO: 1932342 - protein, 5 aa, Staphylococcus
DSITS

SEQ ID NO: 1932343 - protein, 7 aa, Staphylococcus
DSITTQD

SEQ ID NO: 1932344 - protein, 7 aa, Staphylococcus
DSITTRN

SEQ ID NO: 1932345 - protein, 7 aa, Staphylococcus
DSIVNSR

SEQ ID NO: 1932346 - protein, 8 aa, Staphylococcus
DSKAETVD

SEQ ID NO: 1932347 - protein, 7 aa, Staphylococcus
DSKATLS

SEQ ID NO: 1932348 - protein, 9 aa, Staphylococcus
DSKDFGEHF

SEQ ID NO: 1932349 - protein, 10 aa, Staphylococcus
DSKDLDGELA

SEQ ID NO: 1932350 - protein, 5 aa, Staphylococcus
DSKDN

SEQ ID NO: 1932351 - protein, 8 aa, Staphylococcus
DSKEAENV

SEQ ID NO: 1932352 - protein, 8 aa, Staphylococcus
DSKEAIEK

SEQ ID NO: 1932353 - protein, 6 aa, Staphylococcus
DSKEDI

SEQ ID NO: 1932354 - protein, 8 aa, Staphylococcus
DSKEEVEQ

SEQ ID NO: 1932355 - protein, 8 aa, Staphylococcus
DSKEQYRK

SEQ ID NO: 1932356 - protein, 7 aa, Staphylococcus
DSKETMQ

SEQ ID NO: 1932357 - protein, 7 aa, Staphylococcus
DSKGECD

SEQ ID NO: 1932358 - protein, 8 aa, Staphylococcus
DSKGEYEI

SEQ ID NO: 1932359 - protein, 5 aa, Staphylococcus
DSKHH

SEQ ID NO: 1932360 - protein, 10 aa, Staphylococcus
DSKHPDFQQG

SEQ ID NO: 1932361 - protein, 17 aa, Staphylococcus
DSKHSQTLKQTGGIGTV

SEQ ID NO: 1932362 - protein, 6 aa, Staphylococcus
DSKIAP

SEQ ID NO: 1932363 - protein, 7 aa, Staphylococcus
DSKIAPT

SEQ ID NO: 1932364 - protein, 7 aa, Staphylococcus
DSKIESG

SEQ ID NO: 1932365 - protein, 12 aa, Staphylococcus
DSKKEKPEYEIN

SEQ ID NO: 1932366 - protein, 9 aa, Staphylococcus
DSKKVPAKQ

SEQ ID NO: 1932367 - protein, 9 aa, Staphylococcus
DSKKVSAKN

SEQ ID NO: 1932368 - protein, 10 aa, Staphylococcus
DSKKVSATKR

SEQ ID NO: 1932369 - protein, 13 aa, Staphylococcus
DSKKVSAVNRAQL

SEQ ID NO: 1932370 - protein, 11 aa, Staphylococcus
DSKKVTASKRQ

SEQ ID NO: 1932371 - protein, 13 aa, Staphylococcus
DSKLDRRNGIEKI

SEQ ID NO: 1932372 - protein, 12 aa, Staphylococcus
DSKLKDNPSLMN

SEQ ID NO: 1932373 - protein, 13 aa, Staphylococcus
DSKLTDESKAYQD

SEQ ID NO: 1932374 - protein, 11 aa, Staphylococcus
DSKLTGKRLSD

SEQ ID NO: 1932375 - protein, 12 aa, Staphylococcus
DSKLTTSDAATI

SEQ ID NO: 1932376 - protein, 10 aa, Staphylococcus
DSKNIESDAS

SEQ ID NO: 1932377 - protein, 10 aa, Staphylococcus
DSKNQPLKLG

SEQ ID NO: 1932378 - protein, 22 aa, Staphylococcus
DSKNQVHEDYNQSKKDLNDNEQ

SEQ ID NO: 1932379 - protein, 16 aa, Staphylococcus
DSKPLKGTRIEIEIPL

SEQ ID NO: 1932380 - protein, 4 aa, Staphylococcus
DSKQ

SEQ ID NO: 1932381 - protein, 8 aa, Staphylococcus
DSKQNEMI

SEQ ID NO: 1932382 - protein, 6 aa, Staphylococcus
DSKSDY

SEQ ID NO: 1932383 - protein, 10 aa, Staphylococcus
DSKSIEPFRD

SEQ ID NO: 1932384 - protein, 8 aa, Staphylococcus
DSKSPHFS

SEQ ID NO: 1932385 - protein, 11 aa, Staphylococcus
DSKSPNAFQGY

SEQ ID NO: 1932386 - protein, 15 aa, Staphylococcus
DSKTKALNEENGQSF

SEQ ID NO: 1932387 - protein, 6 aa, Staphylococcus
DSKTKG

SEQ ID NO: 1932388 - protein, 12 aa, Staphylococcus
DSKTLKHTLSNQ

SEQ ID NO: 1932389 - protein, 25 aa, Staphylococcus
DSKTPGHPEYRHTDGVEVTTGPLGQ

SEQ ID NO: 1932390 - protein, 7 aa, Staphylococcus
DSKVAPT

SEQ ID NO: 1932391 - protein, 14 aa, Staphylococcus
DSKVARKTGAQTEL

SEQ ID NO: 1932392 - protein, 7 aa, Staphylococcus
DSKVRGR

SEQ ID NO: 1932393 - protein, 11 aa, Staphylococcus
DSLATEAREKL

SEQ ID NO: 1932394 - protein, 14 aa, Staphylococcus
DSLATEAREKLSEV

SEQ ID NO: 1932395 - protein, 6 aa, Staphylococcus
DSLDEA

SEQ ID NO: 1932396 - protein, 6 aa, Staphylococcus
DSLDEN

SEQ ID NO: 1932397 - protein, 7 aa, Staphylococcus
DSLDETF

SEQ ID NO: 1932398 - protein, 9 aa, Staphylococcus
DSLDSAEQS

SEQ ID NO: 1932399 - protein, 4 aa, Staphylococcus
DSLE

SEQ ID NO: 1932400 - protein, 7 aa, Staphylococcus
DSLEEAR

SEQ ID NO: 1932401 - protein, 5 aa, Staphylococcus
DSLEK

SEQ ID NO: 1932402 - protein, 7 aa, Staphylococcus
DSLENRA

SEQ ID NO: 1932403 - protein, 7 aa, Staphylococcus
DSLENTD

SEQ ID NO: 1932404 - protein, 10 aa, Staphylococcus
DSLGDSKPDW

SEQ ID NO: 1932405 - protein, 6 aa, Staphylococcus
DSLKEE

SEQ ID NO: 1932406 - protein, 14 aa, Staphylococcus
DSLKESQEKNDVDL

SEQ ID NO: 1932407 - protein, 5 aa, Staphylococcus
DSLKG

SEQ ID NO: 1932408 - protein, 4 aa, Staphylococcus
DSLN

SEQ ID NO: 1932409 - protein, 6 aa, Staphylococcus
DSLNDV

SEQ ID NO: 1932410 - protein, 18 aa, Staphylococcus
DSLNEDKRIGPDPIGYNG

SEQ ID NO: 1932411 - protein, 21 aa, Staphylococcus
DSLNKGARQGKDPDEVSIGDL

SEQ ID NO: 1932412 - protein, 6 aa, Staphylococcus
DSLNQN

SEQ ID NO: 1932413 - protein, 10 aa, Staphylococcus
DSLPKNKNNY

SEQ ID NO: 1932414 - protein, 4 aa, Staphylococcus
DSLR

SEQ ID NO: 1932415 - protein, 8 aa, Staphylococcus
DSLRGSQN

SEQ ID NO: 1932416 - protein, 5 aa, Staphylococcus
DSLRT

SEQ ID NO: 1932417 - protein, 9 aa, Staphylococcus
DSLSDSTRL

SEQ ID NO: 1932418 - protein, 6 aa, Staphylococcus
DSLSKA

SEQ ID NO: 1932419 - protein, 7 aa, Staphylococcus
DSLTDPD

SEQ ID NO: 1932420 - protein, 6 aa, Staphylococcus
DSLTED

SEQ ID NO: 1932421 - protein, 8 aa, Staphylococcus
DSLTPEKR

SEQ ID NO: 1932422 - protein, 8 aa, Staphylococcus
DSNANESM

SEQ ID NO: 1932423 - protein, 6 aa, Staphylococcus
DSNANT

SEQ ID NO: 1932424 - protein, 11 aa, Staphylococcus
DSNDSRAGRWS

SEQ ID NO: 1932425 - protein, 7 aa, Staphylococcus
DSNDVKE

SEQ ID NO: 1932426 - protein, 4 aa, Staphylococcus
DSNE

SEQ ID NO: 1932427 - protein, 9 aa, Staphylococcus
DSNEKVNGI

SEQ ID NO: 1932428 - protein, 8 aa, Staphylococcus
DSNEPNIA

SEQ ID NO: 1932429 - protein, 5 aa, Staphylococcus
DSNER

SEQ ID NO: 1932430 - protein, 6 aa, Staphylococcus
DSNGLD

SEQ ID NO: 1932431 - protein, 7 aa, Staphylococcus
DSNIEEA

SEQ ID NO: 1932432 - protein, 13 aa, Staphylococcus
DSNIQSTLTDNAD

SEQ ID NO: 1932433 - protein, 8 aa, Staphylococcus
DSNKNYKK

SEQ ID NO: 1932434 - protein, 6 aa, Staphylococcus
DSNKYT

SEQ ID NO: 1932435 - protein, 5 aa, Staphylococcus
DSNLH

SEQ ID NO: 1932436 - protein, 21 aa, Staphylococcus
DSNLPKGSYRELTQEEIELVK

SEQ ID NO: 1932437 - protein, 7 aa, Staphylococcus
DSNNQNQ

SEQ ID NO: 1932438 - protein, 7 aa, Staphylococcus
DSNNRTL

SEQ ID NO: 1932439 - protein, 8 aa, Staphylococcus
DSNNTRKK

SEQ ID NO: 1932440 - protein, 7 aa, Staphylococcus
DSNNYSL

SEQ ID NO: 1932441 - protein, 8 aa, Staphylococcus
DSNQEAWT

SEQ ID NO: 1932442 - protein, 8 aa, Staphylococcus
DSNQNDGI

SEQ ID NO: 1932443 - protein, 6 aa, Staphylococcus
DSNQPT

SEQ ID NO: 1932444 - protein, 8 aa, Staphylococcus
DSNRQTAI

SEQ ID NO: 1932445 - protein, 8 aa, Staphylococcus
DSNRTSAI

SEQ ID NO: 1932446 - protein, 5 aa, Staphylococcus
DSNSS

SEQ ID NO: 1932447 - protein, 10 aa, Staphylococcus
DSNSSKEVNR

SEQ ID NO: 1932448 - protein, 5 aa, Staphylococcus
DSNTA

SEQ ID NO: 1932449 - protein, 10 aa, Staphylococcus
DSNTAQLQKD

SEQ ID NO: 1932450 - protein, 4 aa, Staphylococcus
DSNY

SEQ ID NO: 1932451 - protein, 5 aa, Staphylococcus
DSNYN

SEQ ID NO: 1932452 - protein, 6 aa, Staphylococcus
DSNYQG

SEQ ID NO: 1932453 - protein, 11 aa, Staphylococcus
DSNYSKEKLRT

SEQ ID NO: 1932454 - protein, 53 aa, Staphylococcus
DSPEENSSEINSNDDKQNASNAQKQNVKEETSKKDQHTTQLQNETQPKNNGRF

SEQ ID NO: 1932455 - protein, 8 aa, Staphylococcus
DSPEQLKR

SEQ ID NO: 1932456 - protein, 16 aa, Staphylococcus
DSPFRGQSSIHPGDLK

SEQ ID NO: 1932457 - protein, 15 aa, Staphylococcus
DSPGYNKFKTPHQTL

SEQ ID NO: 1932458 - protein, 25 aa, Staphylococcus
DSPGYQNFKTPHQSLYTGNSGTTTR

SEQ ID NO: 1932459 - protein, 5 aa, Staphylococcus
DSPIK

SEQ ID NO: 1932460 - protein, 5 aa, Staphylococcus
DSPKL

SEQ ID NO: 1932461 - protein, 9 aa, Staphylococcus
DSPKQHDTI

SEQ ID NO: 1932462 - protein, 9 aa, Staphylococcus
DSPKYGESV

SEQ ID NO: 1932463 - protein, 6 aa, Staphylococcus
DSPNDM

SEQ ID NO: 1932464 - protein, 15 aa, Staphylococcus
DSPQSVESLAEKQHT

SEQ ID NO: 1932465 - protein, 9 aa, Staphylococcus
DSPSDETIK

SEQ ID NO: 1932466 - protein, 7 aa, Staphylococcus
DSPSEAV

SEQ ID NO: 1932467 - protein, 9 aa, Staphylococcus
DSPSEETIK

SEQ ID NO: 1932468 - protein, 8 aa, Staphylococcus
DSPSIDQT

SEQ ID NO: 1932469 - protein, 19 aa, Staphylococcus
DSPSKSNELHNKQSDSQTK

SEQ ID NO: 1932470 - protein, 6 aa, Staphylococcus
DSPTLS

SEQ ID NO: 1932471 - protein, 4 aa, Staphylococcus
DSPY

SEQ ID NO: 1932472 - protein, 6 aa, Staphylococcus
DSPYAP

SEQ ID NO: 1932473 - protein, 9 aa, Staphylococcus
DSPYDHEGG

SEQ ID NO: 1932474 - protein, 7 aa, Staphylococcus
DSPYTLQ

SEQ ID NO: 1932475 - protein, 9 aa, Staphylococcus
DSQAAKFTD

SEQ ID NO: 1932476 - protein, 17 aa, Staphylococcus
DSQEINDKIKQDTTPQQ

SEQ ID NO: 1932477 - protein, 15 aa, Staphylococcus
DSQENKKIKTSETSG

SEQ ID NO: 1932478 - protein, 5 aa, Staphylococcus
DSQEV

SEQ ID NO: 1932479 - protein, 5 aa, Staphylococcus
DSQIT

SEQ ID NO: 1932480 - protein, 9 aa, Staphylococcus
DSQKDHDQV

SEQ ID NO: 1932481 - protein, 10 aa, Staphylococcus
DSQKPSNIKE

SEQ ID NO: 1932482 - protein, 9 aa, Staphylococcus
DSQKQPKQI

SEQ ID NO: 1932483 - protein, 6 aa, Staphylococcus
DSQMEQ

SEQ ID NO: 1932484 - protein, 4 aa, Staphylococcus
DSQN

SEQ ID NO: 1932485 - protein, 8 aa, Staphylococcus
DSQSEADM

SEQ ID NO: 1932486 - protein, 9 aa, Staphylococcus
DSQSLPYDD

SEQ ID NO: 1932487 - protein, 7 aa, Staphylococcus
DSQSYEG

SEQ ID NO: 1932488 - protein, 6 aa, Staphylococcus
DSQVTV

SEQ ID NO: 1932489 - protein, 7 aa, Staphylococcus
DSQWQSA

SEQ ID NO: 1932490 - protein, 5 aa, Staphylococcus
DSQYG

SEQ ID NO: 1932491 - protein, 5 aa, Staphylococcus
DSQYL

SEQ ID NO: 1932492 - protein, 8 aa, Staphylococcus
DSRAEMSG

SEQ ID NO: 1932493 - protein, 14 aa, Staphylococcus
DSRDFKDNTVRKLK

SEQ ID NO: 1932494 - protein, 8 aa, Staphylococcus
DSREEHDA

SEQ ID NO: 1932495 - protein, 5 aa, Staphylococcus
DSREG

SEQ ID NO: 1932496 - protein, 10 aa, Staphylococcus
DSREQFEQRT

SEQ ID NO: 1932497 - protein, 20 aa, Staphylococcus
DSRHADEANAIRRRRECEKC

SEQ ID NO: 1932498 - protein, 4 aa, Staphylococcus
DSRI

SEQ ID NO: 1932499 - protein, 7 aa, Staphylococcus
DSRIAPT

SEQ ID NO: 1932500 - protein, 7 aa, Staphylococcus
DSRISVN

SEQ ID NO: 1932501 - protein, 5 aa, Staphylococcus
DSRKI

SEQ ID NO: 1932502 - protein, 7 aa, Staphylococcus
DSRKLSP

SEQ ID NO: 1932503 - protein, 10 aa, Staphylococcus
DSRNGKQNII

SEQ ID NO: 1932504 - protein, 11 aa, Staphylococcus
DSRNGKQNVIE

SEQ ID NO: 1932505 - protein, 8 aa, Staphylococcus
DSRNGRQN

SEQ ID NO: 1932506 - protein, 11 aa, Staphylococcus
DSRNHNKKENM

SEQ ID NO: 1932507 - protein, 5 aa, Staphylococcus
DSRQF

SEQ ID NO: 1932508 - protein, 7 aa, Staphylococcus
DSRQQLN

SEQ ID NO: 1932509 - protein, 12 aa, Staphylococcus
DSRSCEVIKKSL

SEQ ID NO: 1932510 - protein, 7 aa, Staphylococcus
DSRSDAQ

SEQ ID NO: 1932511 - protein, 10 aa, Staphylococcus
DSSDDKLAQE

SEQ ID NO: 1932512 - protein, 15 aa, Staphylococcus
DSSDTRELKQQLSSS

SEQ ID NO: 1932513 - protein, 8 aa, Staphylococcus
DSSGASLE

SEQ ID NO: 1932514 - protein, 6 aa, Staphylococcus
DSSGQS

SEQ ID NO: 1932515 - protein, 12 aa, Staphylococcus
DSSHKPDEHYGE

SEQ ID NO: 1932516 - protein, 8 aa, Staphylococcus
DSSIGTGS

SEQ ID NO: 1932517 - protein, 6 aa, Staphylococcus
DSSIIK

SEQ ID NO: 1932518 - protein, 6 aa, Staphylococcus
DSSINV

SEQ ID NO: 1932519 - protein, 8 aa, Staphylococcus
DSSKFNTR

SEQ ID NO: 1932520 - protein, 11 aa, Staphylococcus
DSSKQVSDKDM

SEQ ID NO: 1932521 - protein, 11 aa, Staphylococcus
DSSKRDARASY

SEQ ID NO: 1932522 - protein, 6 aa, Staphylococcus
DSSKSL

SEQ ID NO: 1932523 - protein, 6 aa, Staphylococcus
DSSKYT

SEQ ID NO: 1932524 - protein, 6 aa, Staphylococcus
DSSNDI

SEQ ID NO: 1932525 - protein, 8 aa, Staphylococcus
DSSNGYDG

SEQ ID NO: 1932526 - protein, 5 aa, Staphylococcus
DSSNK

SEQ ID NO: 1932527 - protein, 6 aa, Staphylococcus
DSSNKD

SEQ ID NO: 1932528 - protein, 10 aa, Staphylococcus
DSSNKNTRDI

SEQ ID NO: 1932529 - protein, 10 aa, Staphylococcus
DSSNQDTKYV

SEQ ID NO: 1932530 - protein, 9 aa, Staphylococcus
DSSNQTTRK

SEQ ID NO: 1932531 - protein, 4 aa, Staphylococcus
DSSR

SEQ ID NO: 1932532 - protein, 9 aa, Staphylococcus
DSSRDELTN

SEQ ID NO: 1932533 - protein, 12 aa, Staphylococcus
DSSSDYETITKE

SEQ ID NO: 1932534 - protein, 9 aa, Staphylococcus
DSSSQQQEI

SEQ ID NO: 1932535 - protein, 15 aa, Staphylococcus
DSSTEVTSDEPFSAV

SEQ ID NO: 1932536 - protein, 6 aa, Staphylococcus
DSSTGE

SEQ ID NO: 1932537 - protein, 11 aa, Staphylococcus
DSSTKDEANKT

SEQ ID NO: 1932538 - protein, 4 aa, Staphylococcus
DSSV

SEQ ID NO: 1932539 - protein, 8 aa, Staphylococcus
DSSVGGKV

SEQ ID NO: 1932540 - protein, 17 aa, Staphylococcus
DSSVGGKVGINSENGKN

SEQ ID NO: 1932541 - protein, 17 aa, Staphylococcus
DSSVGGKVGINSKHGKN

SEQ ID NO: 1932542 - protein, 17 aa, Staphylococcus
DSSVGGKVGINSQHGKN

SEQ ID NO: 1932543 - protein, 17 aa, Staphylococcus
DSSVGGKVGINSSHGKN

SEQ ID NO: 1932544 - protein, 17 aa, Staphylococcus
DSSVGGKVGINTPQGKN

SEQ ID NO: 1932545 - protein, 13 aa, Staphylococcus
DSSVGNKTKVGPF

SEQ ID NO: 1932546 - protein, 6 aa, Staphylococcus
DSSVNP

SEQ ID NO: 1932547 - protein, 13 aa, Staphylococcus
DSSVTKLSDNALK

SEQ ID NO: 1932548 - protein, 5 aa, Staphylococcus
DSSYI

SEQ ID NO: 1932549 - protein, 7 aa, Staphylococcus
DSSYQEP

SEQ ID NO: 1932550 - protein, 4 aa, Staphylococcus
DSTA

SEQ ID NO: 1932551 - protein, 6 aa, Staphylococcus
DSTAEI

SEQ ID NO: 1932552 - protein, 10 aa, Staphylococcus
DSTATSQKPI

SEQ ID NO: 1932553 - protein, 21 aa, Staphylococcus
DSTDGIKRGDDVKDTGRPISV

SEQ ID NO: 1932554 - protein, 27 aa, Staphylococcus
DSTDGVKRGTEVRDSGDSISVPVGDAT

SEQ ID NO: 1932555 - protein, 8 aa, Staphylococcus
DSTDGVQR

SEQ ID NO: 1932556 - protein, 12 aa, Staphylococcus
DSTERPEGVEAG

SEQ ID NO: 1932557 - protein, 6 aa, Staphylococcus
DSTGDV

SEQ ID NO: 1932558 - protein, 6 aa, Staphylococcus
DSTGEI

SEQ ID NO: 1932559 - protein, 13 aa, Staphylococcus
DSTGIQNLATQPQ

SEQ ID NO: 1932560 - protein, 6 aa, Staphylococcus
DSTIKA

SEQ ID NO: 1932561 - protein, 6 aa, Staphylococcus
DSTIQS

SEQ ID NO: 1932562 - protein, 6 aa, Staphylococcus
DSTISQ

SEQ ID NO: 1932563 - protein, 5 aa, Staphylococcus
DSTIT

SEQ ID NO: 1932564 - protein, 5 aa, Staphylococcus
DSTKA

SEQ ID NO: 1932565 - protein, 11 aa, Staphylococcus
DSTNQKLQEQM

SEQ ID NO: 1932566 - protein, 33 aa, Staphylococcus
DSTPAGTDSEQVVSESIKSAKEKKYSKSNPYEA

SEQ ID NO: 1932567 - protein, 6 aa, Staphylococcus
DSTQYN

SEQ ID NO: 1932568 - protein, 56 aa, Staphylococcus
DSTRISDAAKNEAKSYITENYGSNYVSKRQAKGKQGDQDAHEAIRPTSAMRTPNEM

SEQ ID NO: 1932569 - protein, 15 aa, Staphylococcus
DSTRISDQAKSEAKN

SEQ ID NO: 1932570 - protein, 54 aa, Staphylococcus
DSTRISDQAQSEAKNYIQETYGNDYTSNRKSKGQGDQDAHEAIRPSSTLRTPNE

SEQ ID NO: 1932571 - protein, 16 aa, Staphylococcus
DSTRISDSAKSEAHNY

SEQ ID NO: 1932572 - protein, 54 aa, Staphylococcus
DSTRISQTAKDEAKQYIEDKYGKDYLSNRTAKGKQGDQDAHEAIRPTSTLRTPY

SEQ ID NO: 1932573 - protein, 55 aa, Staphylococcus
DSTRISQTAKDEAKSYIEEKYGTEYTSNRKTKGKQGDQDAHEAIRPTSTLRTPDE

SEQ ID NO: 1932574 - protein, 11 aa, Staphylococcus
DSTRQDHYELP

SEQ ID NO: 1932575 - protein, 6 aa, Staphylococcus
DSTSEI

SEQ ID NO: 1932576 - protein, 6 aa, Staphylococcus
DSTSNI

SEQ ID NO: 1932577 - protein, 9 aa, Staphylococcus
DSTSNVRSG

SEQ ID NO: 1932578 - protein, 8 aa, Staphylococcus
DSTSTNKI

SEQ ID NO: 1932579 - protein, 6 aa, Staphylococcus
DSTTES

SEQ ID NO: 1932580 - protein, 5 aa, Staphylococcus
DSTTI

SEQ ID NO: 1932581 - protein, 8 aa, Staphylococcus
DSTTNLER

SEQ ID NO: 1932582 - protein, 8 aa, Staphylococcus
DSTTYDSH

SEQ ID NO: 1932583 - protein, 6 aa, Staphylococcus
DSTVQS

SEQ ID NO: 1932584 - protein, 13 aa, Staphylococcus
DSTVRKRYKQGLR

SEQ ID NO: 1932585 - protein, 14 aa, Staphylococcus
DSTYFDSSTSPKQL

SEQ ID NO: 1932586 - protein, 6 aa, Staphylococcus
DSVDEY

SEQ ID NO: 1932587 - protein, 6 aa, Staphylococcus
DSVDKI

SEQ ID NO: 1932588 - protein, 20 aa, Staphylococcus
DSVEDLPPAELPDPDKRNTI

SEQ ID NO: 1932589 - protein, 7 aa, Staphylococcus
DSVEEAI

SEQ ID NO: 1932590 - protein, 6 aa, Staphylococcus
DSVESA

SEQ ID NO: 1932591 - protein, 4 aa, Staphylococcus
DSVK

SEQ ID NO: 1932592 - protein, 7 aa, Staphylococcus
DSVKPGG

SEQ ID NO: 1932593 - protein, 4 aa, Staphylococcus
DSVN

SEQ ID NO: 1932594 - protein, 7 aa, Staphylococcus
DSVNAQD

SEQ ID NO: 1932595 - protein, 9 aa, Staphylococcus
DSVNDEERK

SEQ ID NO: 1932596 - protein, 8 aa, Staphylococcus
DSVNEEER

SEQ ID NO: 1932597 - protein, 12 aa, Staphylococcus
DSVNGATAAVTA

SEQ ID NO: 1932598 - protein, 9 aa, Staphylococcus
DSVNNQERQ

SEQ ID NO: 1932599 - protein, 6 aa, Staphylococcus
DSVPKA

SEQ ID NO: 1932600 - protein, 8 aa, Staphylococcus
DSVQSRLE

SEQ ID NO: 1932601 - protein, 8 aa, Staphylococcus
DSVRNQGK

SEQ ID NO: 1932602 - protein, 8 aa, Staphylococcus
DSVSEEER

SEQ ID NO: 1932603 - protein, 10 aa, Staphylococcus
DSVSEHERQQ

SEQ ID NO: 1932604 - protein, 19 aa, Staphylococcus
DSVSGKKLKEKLENSREDA

SEQ ID NO: 1932605 - protein, 22 aa, Staphylococcus
DSVSQTRVRAKSADRLSSNGEK

SEQ ID NO: 1932606 - protein, 6 aa, Staphylococcus
DSVTGK

SEQ ID NO: 1932607 - protein, 7 aa, Staphylococcus
DSVTNES

SEQ ID NO: 1932608 - protein, 24 aa, Staphylococcus
DSVTTDHISPAGAIGKDTPAGQYL

SEQ ID NO: 1932609 - protein, 5 aa, Staphylococcus
DSWPD

SEQ ID NO: 1932610 - protein, 15 aa, Staphylococcus
DSWPDNIDTSYSRKE

SEQ ID NO: 1932611 - protein, 10 aa, Staphylococcus
DSYANPEALE

SEQ ID NO: 1932612 - protein, 10 aa, Staphylococcus
DSYANPRALE

SEQ ID NO: 1932613 - protein, 5 aa, Staphylococcus
DSYDG

SEQ ID NO: 1932614 - protein, 10 aa, Staphylococcus
DSYDSEDYKQ

SEQ ID NO: 1932615 - protein, 5 aa, Staphylococcus
DSYKE

SEQ ID NO: 1932616 - protein, 6 aa, Staphylococcus
DSYLRS

SEQ ID NO: 1932617 - protein, 9 aa, Staphylococcus
DSYRSEDLP

SEQ ID NO: 1932618 - protein, 9 aa, Staphylococcus
DSYRSEDLS

SEQ ID NO: 1932619 - protein, 5 aa, Staphylococcus
DSYSV

SEQ ID NO: 1932620 - protein, 7 aa, Staphylococcus
DSYSVGD

SEQ ID NO: 1932621 - protein, 6 aa, Staphylococcus
DSYSVS

SEQ ID NO: 1932622 - protein, 9 aa, Staphylococcus
DSYTKQLGG

SEQ ID NO: 1932623 - protein, 4 aa, Staphylococcus
DSYY

SEQ ID NO: 1932624 - protein, 16 aa, Staphylococcus
DTADEEGQKVNAKFST

SEQ ID NO: 1932625 - protein, 12 aa, Staphylococcus
DTAEAKDFDDRE

SEQ ID NO: 1932626 - protein, 12 aa, Staphylococcus
DTAGQKGTGKWT

SEQ ID NO: 1932627 - protein, 6 aa, Staphylococcus
DTAHAA

SEQ ID NO: 1932628 - protein, 8 aa, Staphylococcus
DTAKNIGA

SEQ ID NO: 1932629 - protein, 15 aa, Staphylococcus
DTAKQELVGKHGEKV

SEQ ID NO: 1932630 - protein, 12 aa, Staphylococcus
DTANAEVVGKHG

SEQ ID NO: 1932631 - protein, 21 aa, Staphylococcus
DTANEQAQTLSGKFSTSCGKI

SEQ ID NO: 1932632 - protein, 6 aa, Staphylococcus
DTANHE

SEQ ID NO: 1932633 - protein, 15 aa, Staphylococcus
DTANSEVVGKHGEKI

SEQ ID NO: 1932634 - protein, 22 aa, Staphylococcus
DTANTDAQTLSAKLSTNYGKIS

SEQ ID NO: 1932635 - protein, 13 aa, Staphylococcus
DTAPEGTQNEQIV

SEQ ID NO: 1932636 - protein, 14 aa, Staphylococcus
DTAPQTVEKVKNRE

SEQ ID NO: 1932637 - protein, 6 aa, Staphylococcus
DTAQQV

SEQ ID NO: 1932638 - protein, 4 aa, Staphylococcus
DTAR

SEQ ID NO: 1932639 - protein, 18 aa, Staphylococcus
DTARYGIESGGEPTQGAG

SEQ ID NO: 1932640 - protein, 18 aa, Staphylococcus
DTARYGLHSGGEPTQGAG

SEQ ID NO: 1932641 - protein, 18 aa, Staphylococcus
DTARYGLNSGGEPTQGAG

SEQ ID NO: 1932642 - protein, 18 aa, Staphylococcus
DTARYGLNTGGEPTQGAG

SEQ ID NO: 1932643 - protein, 18 aa, Staphylococcus
DTARYGLQSGGEPTQGAG

SEQ ID NO: 1932644 - protein, 6 aa, Staphylococcus
DTATDE

SEQ ID NO: 1932645 - protein, 5 aa, Staphylococcus
DTATK

SEQ ID NO: 1932646 - protein, 8 aa, Staphylococcus
DTATKRAV

SEQ ID NO: 1932647 - protein, 5 aa, Staphylococcus
DTATT

SEQ ID NO: 1932648 - protein, 13 aa, Staphylococcus
DTAVGIASSQGNF

SEQ ID NO: 1932649 - protein, 8 aa, Staphylococcus
DTCGNREQ

SEQ ID NO: 1932650 - protein, 5 aa, Staphylococcus
DTCPE

SEQ ID NO: 1932651 - protein, 5 aa, Staphylococcus
DTCPI

SEQ ID NO: 1932652 - protein, 6 aa, Staphylococcus
DTCPIS

SEQ ID NO: 1932653 - protein, 6 aa, Staphylococcus
DTDAHQ

SEQ ID NO: 1932654 - protein, 8 aa, Staphylococcus
DTDASTSI

SEQ ID NO: 1932655 - protein, 9 aa, Staphylococcus
DTDEDISKE

SEQ ID NO: 1932656 - protein, 8 aa, Staphylococcus
DTDEEAEY

SEQ ID NO: 1932657 - protein, 9 aa, Staphylococcus
DTDEGARRL

SEQ ID NO: 1932658 - protein, 10 aa, Staphylococcus
DTDEGTVNDM

SEQ ID NO: 1932659 - protein, 9 aa, Staphylococcus
DTDEQAKRE

SEQ ID NO: 1932660 - protein, 12 aa, Staphylococcus
DTDEQAQREFYE

SEQ ID NO: 1932661 - protein, 10 aa, Staphylococcus
DTDESETHSI

SEQ ID NO: 1932662 - protein, 6 aa, Staphylococcus
DTDGRM

SEQ ID NO: 1932663 - protein, 7 aa, Staphylococcus
DTDIKQD

SEQ ID NO: 1932664 - protein, 18 aa, Staphylococcus
DTDIPTEELTGENEGSDI

SEQ ID NO: 1932665 - protein, 17 aa, Staphylococcus
DTDKKRNLDDGESSQFS

SEQ ID NO: 1932666 - protein, 6 aa, Staphylococcus
DTDLSQ

SEQ ID NO: 1932667 - protein, 4 aa, Staphylococcus
DTDN

SEQ ID NO: 1932668 - protein, 15 aa, Staphylococcus
DTDNHRNIKIIGKIS

SEQ ID NO: 1932669 - protein, 13 aa, Staphylococcus
DTDQLTDNKAQYT

SEQ ID NO: 1932670 - protein, 6 aa, Staphylococcus
DTDRDD

SEQ ID NO: 1932671 - protein, 8 aa, Staphylococcus
DTDRDGPK

SEQ ID NO: 1932672 - protein, 9 aa, Staphylococcus
DTDRSGGFE

SEQ ID NO: 1932673 - protein, 8 aa, Staphylococcus
DTDSITPQ

SEQ ID NO: 1932674 - protein, 10 aa, Staphylococcus
DTDSKKPYEV

SEQ ID NO: 1932675 - protein, 17 aa, Staphylococcus
DTDSKRNLVDGESSQFD

SEQ ID NO: 1932676 - protein, 4 aa, Staphylococcus
DTDT

SEQ ID NO: 1932677 - protein, 7 aa, Staphylococcus
DTDTHAE

SEQ ID NO: 1932678 - protein, 7 aa, Staphylococcus
DTDTPIG

SEQ ID NO: 1932679 - protein, 4 aa, Staphylococcus
DTDV

SEQ ID NO: 1932680 - protein, 8 aa, Staphylococcus
DTDYKEPQ

SEQ ID NO: 1932681 - protein, 5 aa, Staphylococcus
DTEAL

SEQ ID NO: 1932682 - protein, 8 aa, Staphylococcus
DTEATAPY

SEQ ID NO: 1932683 - protein, 10 aa, Staphylococcus
DTEATHINEE

SEQ ID NO: 1932684 - protein, 9 aa, Staphylococcus
DTEDETEAV

SEQ ID NO: 1932685 - protein, 16 aa, Staphylococcus
DTEDIGEHFPKQNELE

SEQ ID NO: 1932686 - protein, 8 aa, Staphylococcus
DTEDNIRK

SEQ ID NO: 1932687 - protein, 4 aa, Staphylococcus
DTEE

SEQ ID NO: 1932688 - protein, 5 aa, Staphylococcus
DTEEE

SEQ ID NO: 1932689 - protein, 7 aa, Staphylococcus
DTEEEAQ

SEQ ID NO: 1932690 - protein, 9 aa, Staphylococcus
DTEERGRTM

SEQ ID NO: 1932691 - protein, 6 aa, Staphylococcus
DTEEVK

SEQ ID NO: 1932692 - protein, 4 aa, Staphylococcus
DTEF

SEQ ID NO: 1932693 - protein, 8 aa, Staphylococcus
DTEFGSGA

SEQ ID NO: 1932694 - protein, 12 aa, Staphylococcus
DTEGANEIKLGQ

SEQ ID NO: 1932695 - protein, 10 aa, Staphylococcus
DTEGIGSEKW

SEQ ID NO: 1932696 - protein, 12 aa, Staphylococcus
DTEGLPITKGNN

SEQ ID NO: 1932697 - protein, 11 aa, Staphylococcus
DTEGLPITQGN

SEQ ID NO: 1932698 - protein, 5 aa, Staphylococcus
DTEGQ

SEQ ID NO: 1932699 - protein, 13 aa, Staphylococcus
DTEGSDTVETNSE

SEQ ID NO: 1932700 - protein, 5 aa, Staphylococcus
DTEHD

SEQ ID NO: 1932701 - protein, 6 aa, Staphylococcus
DTEITD

SEQ ID NO: 1932702 - protein, 6 aa, Staphylococcus
DTEITG

SEQ ID NO: 1932703 - protein, 6 aa, Staphylococcus
DTEKAF

SEQ ID NO: 1932704 - protein, 8 aa, Staphylococcus
DTEKEATR

SEQ ID NO: 1932705 - protein, 22 aa, Staphylococcus
DTEKIEQDIERQEVKNNHEGAR

SEQ ID NO: 1932706 - protein, 6 aa, Staphylococcus
DTEKLK

SEQ ID NO: 1932707 - protein, 5 aa, Staphylococcus
DTEKQ

SEQ ID NO: 1932708 - protein, 5 aa, Staphylococcus
DTELA

SEQ ID NO: 1932709 - protein, 14 aa, Staphylococcus
DTEMDDEIEDPRED

SEQ ID NO: 1932710 - protein, 4 aa, Staphylococcus
DTEN

SEQ ID NO: 1932711 - protein, 5 aa, Staphylococcus
DTENA

SEQ ID NO: 1932712 - protein, 6 aa, Staphylococcus
DTENDG

SEQ ID NO: 1932713 - protein, 6 aa, Staphylococcus
DTENPE

SEQ ID NO: 1932714 - protein, 10 aa, Staphylococcus
DTENQSNTVT

SEQ ID NO: 1932715 - protein, 5 aa, Staphylococcus
DTENS

SEQ ID NO: 1932716 - protein, 15 aa, Staphylococcus
DTEPRPGSMGKGIPG

SEQ ID NO: 1932717 - protein, 9 aa, Staphylococcus
DTEQINDLS

SEQ ID NO: 1932718 - protein, 17 aa, Staphylococcus
DTEQRPGSMGKAIPGSR

SEQ ID NO: 1932719 - protein, 23 aa, Staphylococcus
DTEQVEKDIEKQEIKSENEATEI

SEQ ID NO: 1932720 - protein, 5 aa, Staphylococcus
DTERL

SEQ ID NO: 1932721 - protein, 10 aa, Staphylococcus
DTERNPQYSV

SEQ ID NO: 1932722 - protein, 25 aa, Staphylococcus
DTERYLKSEEQVRKIKQEQSENVRQ

SEQ ID NO: 1932723 - protein, 14 aa, Staphylococcus
DTESRGTESEQVIS

SEQ ID NO: 1932724 - protein, 16 aa, Staphylococcus
DTESRPGSMGKAIPGS

SEQ ID NO: 1932725 - protein, 10 aa, Staphylococcus
DTESTHINED

SEQ ID NO: 1932726 - protein, 12 aa, Staphylococcus
DTETELEVEPKG

SEQ ID NO: 1932727 - protein, 14 aa, Staphylococcus
DTETKIGKEIQEKY

SEQ ID NO: 1932728 - protein, 21 aa, Staphylococcus
DTETPSYESQIEELNESALSK

SEQ ID NO: 1932729 - protein, 20 aa, Staphylococcus
DTETPSYESQIEEMEGEALA

SEQ ID NO: 1932730 - protein, 21 aa, Staphylococcus
DTETPSYESQIEEMNGTPLAK

SEQ ID NO: 1932731 - protein, 20 aa, Staphylococcus
DTETPSYESQINELEDEALA

SEQ ID NO: 1932732 - protein, 6 aa, Staphylococcus
DTEVND

SEQ ID NO: 1932733 - protein, 17 aa, Staphylococcus
DTEYGKTYKPITIKIKY

SEQ ID NO: 1932734 - protein, 10 aa, Staphylococcus
DTFEKKEKDF

SEQ ID NO: 1932735 - protein, 5 aa, Staphylococcus
DTFER

SEQ ID NO: 1932736 - protein, 10 aa, Staphylococcus
DTFKEASEQL

SEQ ID NO: 1932737 - protein, 10 aa, Staphylococcus
DTFKQKEEQY

SEQ ID NO: 1932738 - protein, 5 aa, Staphylococcus
DTFNE

SEQ ID NO: 1932739 - protein, 18 aa, Staphylococcus
DTFNQRRGVSDEELGEQL

SEQ ID NO: 1932740 - protein, 4 aa, Staphylococcus
DTFQ

SEQ ID NO: 1932741 - protein, 8 aa, Staphylococcus
DTFSPSEV

SEQ ID NO: 1932742 - protein, 18 aa, Staphylococcus
DTFYNNDKTSPLPTQEDR

SEQ ID NO: 1932743 - protein, 5 aa, Staphylococcus
DTGAL

SEQ ID NO: 1932744 - protein, 8 aa, Staphylococcus
DTGASIDE

SEQ ID NO: 1932745 - protein, 10 aa, Staphylococcus
DTGDNNTVQI

SEQ ID NO: 1932746 - protein, 6 aa, Staphylococcus
DTGDTY

SEQ ID NO: 1932747 - protein, 52 aa, Staphylococcus
DTGEERDDIDSETEANHSYEEQSSSHKNDLSQSKINENTNDSSLQPKNNGRF

SEQ ID NO: 1932748 - protein, 6 aa, Staphylococcus
DTGGAL

SEQ ID NO: 1932749 - protein, 15 aa, Staphylococcus
DTGIGPQGKSYDVFG

SEQ ID NO: 1932750 - protein, 7 aa, Staphylococcus
DTGKAVE

SEQ ID NO: 1932751 - protein, 7 aa, Staphylococcus
DTGLSDN

SEQ ID NO: 1932752 - protein, 10 aa, Staphylococcus
DTGNNNEVQL

SEQ ID NO: 1932753 - protein, 8 aa, Staphylococcus
DTGNNTGA

SEQ ID NO: 1932754 - protein, 5 aa, Staphylococcus
DTGRN

SEQ ID NO: 1932755 - protein, 8 aa, Staphylococcus
DTGTQGKI

SEQ ID NO: 1932756 - protein, 7 aa, Staphylococcus
DTGVDDN

SEQ ID NO: 1932757 - protein, 8 aa, Staphylococcus
DTHAEEEI

SEQ ID NO: 1932758 - protein, 6 aa, Staphylococcus
DTHDET

SEQ ID NO: 1932759 - protein, 12 aa, Staphylococcus
DTHNAELNIFDH

SEQ ID NO: 1932760 - protein, 5 aa, Staphylococcus
DTHPE

SEQ ID NO: 1932761 - protein, 6 aa, Staphylococcus
DTHPHL

SEQ ID NO: 1932762 - protein, 8 aa, Staphylococcus
DTHPTADE

SEQ ID NO: 1932763 - protein, 110 aa, Staphylococcus
DTHQKDQKDVSEKKDSKKESKKDKSHKDTNENNQNAETEASIPTNQNYGTDYNNQTILPDGNTYDAQGTESNANTLDASVESNTEDNSGYAAQQEINAPGTEANSDPSVQ

SEQ ID NO: 1932764 - protein, 6 aa, Staphylococcus
DTHRES

SEQ ID NO: 1932765 - protein, 10 aa, Staphylococcus
DTHYPTDEED

SEQ ID NO: 1932766 - protein, 5 aa, Staphylococcus
DTIAS

SEQ ID NO: 1932767 - protein, 4 aa, Staphylococcus
DTIE

SEQ ID NO: 1932768 - protein, 15 aa, Staphylococcus
DTIEETDQKLQEANQ

SEQ ID NO: 1932769 - protein, 5 aa, Staphylococcus
DTIEN

SEQ ID NO: 1932770 - protein, 13 aa, Staphylococcus
DTIETNGSAINKE

SEQ ID NO: 1932771 - protein, 17 aa, Staphylococcus
DTIGKLSKSDLRKKRQK

SEQ ID NO: 1932772 - protein, 4 aa, Staphylococcus
DTIK

SEQ ID NO: 1932773 - protein, 11 aa, Staphylococcus
DTIKNNGYESN

SEQ ID NO: 1932774 - protein, 6 aa, Staphylococcus
DTIKPI

SEQ ID NO: 1932775 - protein, 6 aa, Staphylococcus
DTIKYS

SEQ ID NO: 1932776 - protein, 13 aa, Staphylococcus
DTILSKKAAKHVK

SEQ ID NO: 1932777 - protein, 9 aa, Staphylococcus
DTINADKAI

SEQ ID NO: 1932778 - protein, 25 aa, Staphylococcus
DTINNEIEPELYDSEGQLINKNKTS

SEQ ID NO: 1932779 - protein, 6 aa, Staphylococcus
DTIQTT

SEQ ID NO: 1932780 - protein, 26 aa, Staphylococcus
DTISGGSVEVDGNEINKLSNKKLANF

SEQ ID NO: 1932781 - protein, 14 aa, Staphylococcus
DTISPDSVMGSGSL

SEQ ID NO: 1932782 - protein, 6 aa, Staphylococcus
DTISSG

SEQ ID NO: 1932783 - protein, 5 aa, Staphylococcus
DTITI

SEQ ID NO: 1932784 - protein, 6 aa, Staphylococcus
DTITNE

SEQ ID NO: 1932785 - protein, 4 aa, Staphylococcus
DTKA

SEQ ID NO: 1932786 - protein, 10 aa, Staphylococcus
DTKDAKGNLQ

SEQ ID NO: 1932787 - protein, 10 aa, Staphylococcus
DTKDKRIATS

SEQ ID NO: 1932788 - protein, 8 aa, Staphylococcus
DTKDTEEI

SEQ ID NO: 1932789 - protein, 5 aa, Staphylococcus
DTKDV

SEQ ID NO: 1932790 - protein, 8 aa, Staphylococcus
DTKEENIS

SEQ ID NO: 1932791 - protein, 8 aa, Staphylococcus
DTKENERE

SEQ ID NO: 1932792 - protein, 5 aa, Staphylococcus
DTKGV

SEQ ID NO: 1932793 - protein, 8 aa, Staphylococcus
DTKGVVDQ

SEQ ID NO: 1932794 - protein, 8 aa, Staphylococcus
DTKIDGVE

SEQ ID NO: 1932795 - protein, 7 aa, Staphylococcus
DTKIESG

SEQ ID NO: 1932796 - protein, 10 aa, Staphylococcus
DTKISGKELR

SEQ ID NO: 1932797 - protein, 13 aa, Staphylococcus
DTKLPDDVDQTAK

SEQ ID NO: 1932798 - protein, 13 aa, Staphylococcus
DTKMEADIDETEK

SEQ ID NO: 1932799 - protein, 7 aa, Staphylococcus
DTKNEHY

SEQ ID NO: 1932800 - protein, 4 aa, Staphylococcus
DTKP

SEQ ID NO: 1932801 - protein, 8 aa, Staphylococcus
DTKPESVD

SEQ ID NO: 1932802 - protein, 36 aa, Staphylococcus
DTKPRPGSMGKAIPGSDTTVVDDEGRQVAPGVKGNI

SEQ ID NO: 1932803 - protein, 8 aa, Staphylococcus
DTKPTTFS

SEQ ID NO: 1932804 - protein, 5 aa, Staphylococcus
DTKQL

SEQ ID NO: 1932805 - protein, 9 aa, Staphylococcus
DTKQWDTRV

SEQ ID NO: 1932806 - protein, 10 aa, Staphylococcus
DTKSEALKRE

SEQ ID NO: 1932807 - protein, 6 aa, Staphylococcus
DTKTPY

SEQ ID NO: 1932808 - protein, 6 aa, Staphylococcus
DTKVDY

SEQ ID NO: 1932809 - protein, 8 aa, Staphylococcus
DTKYERKI

SEQ ID NO: 1932810 - protein, 5 aa, Staphylococcus
DTKYR

SEQ ID NO: 1932811 - protein, 18 aa, Staphylococcus
DTLARNNGIAYNDSERLK

SEQ ID NO: 1932812 - protein, 17 aa, Staphylococcus
DTLARNNGISFNDPERL

SEQ ID NO: 1932813 - protein, 17 aa, Staphylococcus
DTLASQKKLNSSEAKPL

SEQ ID NO: 1932814 - protein, 4 aa, Staphylococcus
DTLD

SEQ ID NO: 1932815 - protein, 6 aa, Staphylococcus
DTLEDG

SEQ ID NO: 1932816 - protein, 11 aa, Staphylococcus
DTLEESKDDLT

SEQ ID NO: 1932817 - protein, 18 aa, Staphylococcus
DTLERTPSFSVDRPDERT

SEQ ID NO: 1932818 - protein, 10 aa, Staphylococcus
DTLGNQGMGT

SEQ ID NO: 1932819 - protein, 16 aa, Staphylococcus
DTLLDSKQLGQTIADK

SEQ ID NO: 1932820 - protein, 10 aa, Staphylococcus
DTLNADKAIA

SEQ ID NO: 1932821 - protein, 11 aa, Staphylococcus
DTLNGKGPEDL

SEQ ID NO: 1932822 - protein, 11 aa, Staphylococcus
DTLNGQGPEDL

SEQ ID NO: 1932823 - protein, 6 aa, Staphylococcus
DTLPEA

SEQ ID NO: 1932824 - protein, 7 aa, Staphylococcus
DTLPGLE

SEQ ID NO: 1932825 - protein, 16 aa, Staphylococcus
DTLPSKDHPDYEDKVK

SEQ ID NO: 1932826 - protein, 8 aa, Staphylococcus
DTLPSPFE

SEQ ID NO: 1932827 - protein, 7 aa, Staphylococcus
DTLPTPF

SEQ ID NO: 1932828 - protein, 8 aa, Staphylococcus
DTLPTPFE

SEQ ID NO: 1932829 - protein, 13 aa, Staphylococcus
DTLQQLKSQTQYP

SEQ ID NO: 1932830 - protein, 9 aa, Staphylococcus
DTLSGGEVQ

SEQ ID NO: 1932831 - protein, 10 aa, Staphylococcus
DTLSGGTVEI

SEQ ID NO: 1932832 - protein, 6 aa, Staphylococcus
DTMNED

SEQ ID NO: 1932833 - protein, 4 aa, Staphylococcus
DTMP

SEQ ID NO: 1932834 - protein, 15 aa, Staphylococcus
DTMPNKGTTLSLKLP

SEQ ID NO: 1932835 - protein, 15 aa, Staphylococcus
DTMQAATKPGVTTRE

SEQ ID NO: 1932836 - protein, 17 aa, Staphylococcus
DTMQAETKPGVTTKELD

SEQ ID NO: 1932837 - protein, 17 aa, Staphylococcus
DTMRPKAPSPKPRAVKK

SEQ ID NO: 1932838 - protein, 7 aa, Staphylococcus
DTNAANQ

SEQ ID NO: 1932839 - protein, 12 aa, Staphylococcus
DTNAISTKEEIE

SEQ ID NO: 1932840 - protein, 14 aa, Staphylococcus
DTNAISTKEETQAI

SEQ ID NO: 1932841 - protein, 9 aa, Staphylococcus
DTNALPETL

SEQ ID NO: 1932842 - protein, 9 aa, Staphylococcus
DTNASSTSE

SEQ ID NO: 1932843 - protein, 6 aa, Staphylococcus
DTNAVG

SEQ ID NO: 1932844 - protein, 10 aa, Staphylococcus
DTNDDFGGSQ

SEQ ID NO: 1932845 - protein, 20 aa, Staphylococcus
DTNDIHTENGVQEKLSADER

SEQ ID NO: 1932846 - protein, 17 aa, Staphylococcus
DTNDISKSLNRGKHTTR

SEQ ID NO: 1932847 - protein, 7 aa, Staphylococcus
DTNEANL

SEQ ID NO: 1932848 - protein, 5 aa, Staphylococcus
DTNEI

SEQ ID NO: 1932849 - protein, 7 aa, Staphylococcus
DTNEIEE

SEQ ID NO: 1932850 - protein, 5 aa, Staphylococcus
DTNFD

SEQ ID NO: 1932851 - protein, 7 aa, Staphylococcus
DTNGKLD

SEQ ID NO: 1932852 - protein, 12 aa, Staphylococcus
DTNGLTKKQEAK

SEQ ID NO: 1932853 - protein, 7 aa, Staphylococcus
DTNGNKY

SEQ ID NO: 1932854 - protein, 4 aa, Staphylococcus
DTNI

SEQ ID NO: 1932855 - protein, 8 aa, Staphylococcus
DTNKEYDK

SEQ ID NO: 1932856 - protein, 18 aa, Staphylococcus
DTNKPLNKQIKEYTTGHY

SEQ ID NO: 1932857 - protein, 10 aa, Staphylococcus
DTNKTLNEGA

SEQ ID NO: 1932858 - protein, 8 aa, Staphylococcus
DTNNDDLK

SEQ ID NO: 1932859 - protein, 7 aa, Staphylococcus
DTNNDEA

SEQ ID NO: 1932860 - protein, 12 aa, Staphylococcus
DTNNDMKTATNA

SEQ ID NO: 1932861 - protein, 12 aa, Staphylococcus
DTNNDMKTKVNA

SEQ ID NO: 1932862 - protein, 6 aa, Staphylococcus
DTNNEQ

SEQ ID NO: 1932863 - protein, 7 aa, Staphylococcus
DTNNKEA

SEQ ID NO: 1932864 - protein, 13 aa, Staphylococcus
DTNNLTDNKAQYT

SEQ ID NO: 1932865 - protein, 10 aa, Staphylococcus
DTNNLTDSKA

SEQ ID NO: 1932866 - protein, 12 aa, Staphylococcus
DTNNLTDTKAQY

SEQ ID NO: 1932867 - protein, 5 aa, Staphylococcus
DTNPD

SEQ ID NO: 1932868 - protein, 5 aa, Staphylococcus
DTNPE

SEQ ID NO: 1932869 - protein, 6 aa, Staphylococcus
DTNPNV

SEQ ID NO: 1932870 - protein, 6 aa, Staphylococcus
DTNPTV

SEQ ID NO: 1932871 - protein, 15 aa, Staphylococcus
DTNQHTHSYNPTQAT

SEQ ID NO: 1932872 - protein, 6 aa, Staphylococcus
DTNRIQ

SEQ ID NO: 1932873 - protein, 8 aa, Staphylococcus
DTNRKEPD

SEQ ID NO: 1932874 - protein, 8 aa, Staphylococcus
DTNRKTAI

SEQ ID NO: 1932875 - protein, 10 aa, Staphylococcus
DTNSEKSYEP

SEQ ID NO: 1932876 - protein, 14 aa, Staphylococcus
DTNSGGPGKPRNTA

SEQ ID NO: 1932877 - protein, 5 aa, Staphylococcus
DTNSI

SEQ ID NO: 1932878 - protein, 7 aa, Staphylococcus
DTNSKDA

SEQ ID NO: 1932879 - protein, 6 aa, Staphylococcus
DTNTLT

SEQ ID NO: 1932880 - protein, 16 aa, Staphylococcus
DTNTTYGQQIKDDYGL

SEQ ID NO: 1932881 - protein, 4 aa, Staphylococcus
DTNV

SEQ ID NO: 1932882 - protein, 8 aa, Staphylococcus
DTPDLNPD

SEQ ID NO: 1932883 - protein, 6 aa, Staphylococcus
DTPDYE

SEQ ID NO: 1932884 - protein, 4 aa, Staphylococcus
DTPE

SEQ ID NO: 1932885 - protein, 9 aa, Staphylococcus
DTPEAFKED

SEQ ID NO: 1932886 - protein, 7 aa, Staphylococcus
DTPEHGK

SEQ ID NO: 1932887 - protein, 17 aa, Staphylococcus
DTPERGQENYSKATNFT

SEQ ID NO: 1932888 - protein, 6 aa, Staphylococcus
DTPETT

SEQ ID NO: 1932889 - protein, 5 aa, Staphylococcus
DTPFG

SEQ ID NO: 1932890 - protein, 6 aa, Staphylococcus
DTPFGS

SEQ ID NO: 1932891 - protein, 7 aa, Staphylococcus
DTPFTPK

SEQ ID NO: 1932892 - protein, 5 aa, Staphylococcus
DTPGF

SEQ ID NO: 1932893 - protein, 6 aa, Staphylococcus
DTPGLS

SEQ ID NO: 1932894 - protein, 16 aa, Staphylococcus
DTPGMSGQTSDSYLGG

SEQ ID NO: 1932895 - protein, 17 aa, Staphylococcus
DTPGMSGQVSDTAIGNG

SEQ ID NO: 1932896 - protein, 6 aa, Staphylococcus
DTPGVE

SEQ ID NO: 1932897 - protein, 7 aa, Staphylococcus
DTPISED

SEQ ID NO: 1932898 - protein, 9 aa, Staphylococcus
DTPKAPGQI

SEQ ID NO: 1932899 - protein, 10 aa, Staphylococcus
DTPKAPGQIQ

SEQ ID NO: 1932900 - protein, 5 aa, Staphylococcus
DTPKH

SEQ ID NO: 1932901 - protein, 10 aa, Staphylococcus
DTPKTRSSIR

SEQ ID NO: 1932902 - protein, 7 aa, Staphylococcus
DTPLAKR

SEQ ID NO: 1932903 - protein, 6 aa, Staphylococcus
DTPLGQ

SEQ ID NO: 1932904 - protein, 7 aa, Staphylococcus
DTPLNEA

SEQ ID NO: 1932905 - protein, 7 aa, Staphylococcus
DTPLSEN

SEQ ID NO: 1932906 - protein, 22 aa, Staphylococcus
DTPLSGDTDWGARKKLDPKDIA

SEQ ID NO: 1932907 - protein, 16 aa, Staphylococcus
DTPNVTMRNDPDGRNR

SEQ ID NO: 1932908 - protein, 5 aa, Staphylococcus
DTPQG

SEQ ID NO: 1932909 - protein, 5 aa, Staphylococcus
DTPQN

SEQ ID NO: 1932910 - protein, 10 aa, Staphylococcus
DTPRSQTKAD

SEQ ID NO: 1932911 - protein, 7 aa, Staphylococcus
DTPRTRK

SEQ ID NO: 1932912 - protein, 9 aa, Staphylococcus
DTPSALKQQ

SEQ ID NO: 1932913 - protein, 4 aa, Staphylococcus
DTPT

SEQ ID NO: 1932914 - protein, 9 aa, Staphylococcus
DTPTTSEQL

SEQ ID NO: 1932915 - protein, 15 aa, Staphylococcus
DTPVERPEIQETTAL

SEQ ID NO: 1932916 - protein, 6 aa, Staphylococcus
DTPVQK

SEQ ID NO: 1932917 - protein, 7 aa, Staphylococcus
DTPVTND

SEQ ID NO: 1932918 - protein, 14 aa, Staphylococcus
DTPVTQQLEQDGAE

SEQ ID NO: 1932919 - protein, 8 aa, Staphylococcus
DTPYPEDL

SEQ ID NO: 1932920 - protein, 6 aa, Staphylococcus
DTPYTF

SEQ ID NO: 1932921 - protein, 8 aa, Staphylococcus
DTQAFPTP

SEQ ID NO: 1932922 - protein, 33 aa, Staphylococcus
DTQAGASLYDTNSVDSAGITSEQVDKYKDNPGL

SEQ ID NO: 1932923 - protein, 22 aa, Staphylococcus
DTQAKSKGITCASAGNHAQGVA

SEQ ID NO: 1932924 - protein, 6 aa, Staphylococcus
DTQATE

SEQ ID NO: 1932925 - protein, 5 aa, Staphylococcus
DTQDQ

SEQ ID NO: 1932926 - protein, 8 aa, Staphylococcus
DTQDYKKH

SEQ ID NO: 1932927 - protein, 11 aa, Staphylococcus
DTQGKQLHKGE

SEQ ID NO: 1932928 - protein, 4 aa, Staphylococcus
DTQH

SEQ ID NO: 1932929 - protein, 6 aa, Staphylococcus
DTQHAQ

SEQ ID NO: 1932930 - protein, 5 aa, Staphylococcus
DTQIK

SEQ ID NO: 1932931 - protein, 9 aa, Staphylococcus
DTQKERGQM

SEQ ID NO: 1932932 - protein, 12 aa, Staphylococcus
DTQKNGSEKFKQ

SEQ ID NO: 1932933 - protein, 8 aa, Staphylococcus
DTQKRDYK

SEQ ID NO: 1932934 - protein, 7 aa, Staphylococcus
DTQLAET

SEQ ID NO: 1932935 - protein, 8 aa, Staphylococcus
DTQLENDA

SEQ ID NO: 1932936 - protein, 5 aa, Staphylococcus
DTQPR

SEQ ID NO: 1932937 - protein, 8 aa, Staphylococcus
DTQQEYAE

SEQ ID NO: 1932938 - protein, 8 aa, Staphylococcus
DTQQNGEM

SEQ ID NO: 1932939 - protein, 17 aa, Staphylococcus
DTQSDPNSQSTPSTDKQ

SEQ ID NO: 1932940 - protein, 17 aa, Staphylococcus
DTQSDPNSQTTPSTAKQ

SEQ ID NO: 1932941 - protein, 17 aa, Staphylococcus
DTQSDPNSSTTPSTTKQ

SEQ ID NO: 1932942 - protein, 8 aa, Staphylococcus
DTQSEYDT

SEQ ID NO: 1932943 - protein, 17 aa, Staphylococcus
DTQSNPESKSTPSTEKQ

SEQ ID NO: 1932944 - protein, 17 aa, Staphylococcus
DTQSNPESSTTPSTEKQ

SEQ ID NO: 1932945 - protein, 17 aa, Staphylococcus
DTQSNPESTTTPSTEKQ

SEQ ID NO: 1932946 - protein, 9 aa, Staphylococcus
DTQTEYGQD

SEQ ID NO: 1932947 - protein, 12 aa, Staphylococcus
DTQTGSLEVGKD

SEQ ID NO: 1932948 - protein, 4 aa, Staphylococcus
DTRA

SEQ ID NO: 1932949 - protein, 13 aa, Staphylococcus
DTRDFDSDKGGQL

SEQ ID NO: 1932950 - protein, 10 aa, Staphylococcus
DTRDSDRHGI

SEQ ID NO: 1932951 - protein, 15 aa, Staphylococcus
DTRDYETDKGGQLAQ

SEQ ID NO: 1932952 - protein, 4 aa, Staphylococcus
DTRE

SEQ ID NO: 1932953 - protein, 14 aa, Staphylococcus
DTRGERDRVKQRAN

SEQ ID NO: 1932954 - protein, 9 aa, Staphylococcus
DTRGTDRHG

SEQ ID NO: 1932955 - protein, 14 aa, Staphylococcus
DTRKADSSTSGTSF

SEQ ID NO: 1932956 - protein, 11 aa, Staphylococcus
DTRKPSNTKEL

SEQ ID NO: 1932957 - protein, 9 aa, Staphylococcus
DTRKTTPGL

SEQ ID NO: 1932958 - protein, 7 aa, Staphylococcus
DTRKVPT

SEQ ID NO: 1932959 - protein, 6 aa, Staphylococcus
DTRLND

SEQ ID NO: 1932960 - protein, 8 aa, Staphylococcus
DTRNTHPK

SEQ ID NO: 1932961 - protein, 13 aa, Staphylococcus
DTRNYETDKGGQL

SEQ ID NO: 1932962 - protein, 12 aa, Staphylococcus
DTRPDEPPTSGT

SEQ ID NO: 1932963 - protein, 11 aa, Staphylococcus
DTRPFLSTEES

SEQ ID NO: 1932964 - protein, 23 aa, Staphylococcus
DTRSDVPSKDDPTFEDKSAEAHK

SEQ ID NO: 1932965 - protein, 7 aa, Staphylococcus
DTRSNEI

SEQ ID NO: 1932966 - protein, 14 aa, Staphylococcus
DTRTPETDKGGNLA

SEQ ID NO: 1932967 - protein, 6 aa, Staphylococcus
DTRTPI

SEQ ID NO: 1932968 - protein, 9 aa, Staphylococcus
DTSALNSKL

SEQ ID NO: 1932969 - protein, 4 aa, Staphylococcus
DTSE

SEQ ID NO: 1932970 - protein, 8 aa, Staphylococcus
DTSEKAYL

SEQ ID NO: 1932971 - protein, 8 aa, Staphylococcus
DTSEPTAS

SEQ ID NO: 1932972 - protein, 14 aa, Staphylococcus
DTSETKDFDDRDDD

SEQ ID NO: 1932973 - protein, 14 aa, Staphylococcus
DTSETKEFSDREDS

SEQ ID NO: 1932974 - protein, 4 aa, Staphylococcus
DTSF

SEQ ID NO: 1932975 - protein, 7 aa, Staphylococcus
DTSFHAS

SEQ ID NO: 1932976 - protein, 5 aa, Staphylococcus
DTSFK

SEQ ID NO: 1932977 - protein, 14 aa, Staphylococcus
DTSHEMPADGYNGK

SEQ ID NO: 1932978 - protein, 15 aa, Staphylococcus
DTSHEMPADGYNGKD

SEQ ID NO: 1932979 - protein, 14 aa, Staphylococcus
DTSHEMPEDGYNGK

SEQ ID NO: 1932980 - protein, 14 aa, Staphylococcus
DTSHKMPEDGYNGK

SEQ ID NO: 1932981 - protein, 6 aa, Staphylococcus
DTSHQI

SEQ ID NO: 1932982 - protein, 10 aa, Staphylococcus
DTSHQTFKKE

SEQ ID NO: 1932983 - protein, 8 aa, Staphylococcus
DTSINDSS

SEQ ID NO: 1932984 - protein, 8 aa, Staphylococcus
DTSKPNDI

SEQ ID NO: 1932985 - protein, 12 aa, Staphylococcus
DTSKSMRKQSRA

SEQ ID NO: 1932986 - protein, 24 aa, Staphylococcus
DTSNKPKGLYESGQSDVLDHDDHK

SEQ ID NO: 1932987 - protein, 12 aa, Staphylococcus
DTSNKTKGLYDT

SEQ ID NO: 1932988 - protein, 8 aa, Staphylococcus
DTSNQDEH

SEQ ID NO: 1932989 - protein, 9 aa, Staphylococcus
DTSPDFNAS

SEQ ID NO: 1932990 - protein, 13 aa, Staphylococcus
DTSPDFNATNVNP

SEQ ID NO: 1932991 - protein, 7 aa, Staphylococcus
DTSPSSI

SEQ ID NO: 1932992 - protein, 9 aa, Staphylococcus
DTSRIKKDI

SEQ ID NO: 1932993 - protein, 5 aa, Staphylococcus
DTSRS

SEQ ID NO: 1932994 - protein, 10 aa, Staphylococcus
DTSRSELSAF

SEQ ID NO: 1932995 - protein, 7 aa, Staphylococcus
DTSTESE

SEQ ID NO: 1932996 - protein, 5 aa, Staphylococcus
DTSVL

SEQ ID NO: 1932997 - protein, 6 aa, Staphylococcus
DTSVNN

SEQ ID NO: 1932998 - protein, 10 aa, Staphylococcus
DTSYKTDEVK

SEQ ID NO: 1932999 - protein, 5 aa, Staphylococcus
DTSYP

SEQ ID NO: 1933000 - protein, 9 aa, Staphylococcus
DTSYPNKDA

SEQ ID NO: 1933001 - protein, 9 aa, Staphylococcus
DTSYPSKEA

SEQ ID NO: 1933002 - protein, 13 aa, Staphylococcus
DTTAGGGTDAGSI

SEQ ID NO: 1933003 - protein, 6 aa, Staphylococcus
DTTARY

SEQ ID NO: 1933004 - protein, 6 aa, Staphylococcus
DTTDEA

SEQ ID NO: 1933005 - protein, 8 aa, Staphylococcus
DTTDKNDF

SEQ ID NO: 1933006 - protein, 8 aa, Staphylococcus
DTTDTDEI

SEQ ID NO: 1933007 - protein, 8 aa, Staphylococcus
DTTELQPD

SEQ ID NO: 1933008 - protein, 9 aa, Staphylococcus
DTTEQRLEE

SEQ ID NO: 1933009 - protein, 6 aa, Staphylococcus
DTTERI

SEQ ID NO: 1933010 - protein, 13 aa, Staphylococcus
DTTETKEFADRDD

SEQ ID NO: 1933011 - protein, 13 aa, Staphylococcus
DTTETKEFQDRDD

SEQ ID NO: 1933012 - protein, 6 aa, Staphylococcus
DTTETN

SEQ ID NO: 1933013 - protein, 5 aa, Staphylococcus
DTTFN

SEQ ID NO: 1933014 - protein, 6 aa, Staphylococcus
DTTGWN

SEQ ID NO: 1933015 - protein, 17 aa, Staphylococcus
DTTHGKYDGEVVPTENG

SEQ ID NO: 1933016 - protein, 4 aa, Staphylococcus
DTTI

SEQ ID NO: 1933017 - protein, 7 aa, Staphylococcus
DTTIPAH

SEQ ID NO: 1933018 - protein, 8 aa, Staphylococcus
DTTKMDPR

SEQ ID NO: 1933019 - protein, 5 aa, Staphylococcus
DTTKN

SEQ ID NO: 1933020 - protein, 12 aa, Staphylococcus
DTTLKEAEQKVN

SEQ ID NO: 1933021 - protein, 12 aa, Staphylococcus
DTTLPSKSDEIL

SEQ ID NO: 1933022 - protein, 12 aa, Staphylococcus
DTTLPSNGDSIL

SEQ ID NO: 1933023 - protein, 9 aa, Staphylococcus
DTTLSSEGD

SEQ ID NO: 1933024 - protein, 9 aa, Staphylococcus
DTTNDMKTA

SEQ ID NO: 1933025 - protein, 9 aa, Staphylococcus
DTTNDNTGK

SEQ ID NO: 1933026 - protein, 11 aa, Staphylococcus
DTTNEAAQTLN

SEQ ID NO: 1933027 - protein, 9 aa, Staphylococcus
DTTNELAQT

SEQ ID NO: 1933028 - protein, 7 aa, Staphylococcus
DTTNEQA

SEQ ID NO: 1933029 - protein, 8 aa, Staphylococcus
DTTNQDEH

SEQ ID NO: 1933030 - protein, 17 aa, Staphylococcus
DTTNSNESKVNDNIAQT

SEQ ID NO: 1933031 - protein, 5 aa, Staphylococcus
DTTPL

SEQ ID NO: 1933032 - protein, 6 aa, Staphylococcus
DTTPLL

SEQ ID NO: 1933033 - protein, 6 aa, Staphylococcus
DTTQLN

SEQ ID NO: 1933034 - protein, 12 aa, Staphylococcus
DTTQMKPKELRK

SEQ ID NO: 1933035 - protein, 24 aa, Staphylococcus
DTTQTEVKKQPFRQGQQYPISQTN

SEQ ID NO: 1933036 - protein, 13 aa, Staphylococcus
DTTRHNQPDRKAQ

SEQ ID NO: 1933037 - protein, 6 aa, Staphylococcus
DTTRNK

SEQ ID NO: 1933038 - protein, 5 aa, Staphylococcus
DTTSE

SEQ ID NO: 1933039 - protein, 10 aa, Staphylococcus
DTTSKKGAHE

SEQ ID NO: 1933040 - protein, 11 aa, Staphylococcus
DTTSRKGAHEK

SEQ ID NO: 1933041 - protein, 6 aa, Staphylococcus
DTTSTF

SEQ ID NO: 1933042 - protein, 9 aa, Staphylococcus
DTTTDKPVS

SEQ ID NO: 1933043 - protein, 9 aa, Staphylococcus
DTTTNEPIA

SEQ ID NO: 1933044 - protein, 7 aa, Staphylococcus
DTTTNQS

SEQ ID NO: 1933045 - protein, 21 aa, Staphylococcus
DTTTPSYESQIEELDESALTK

SEQ ID NO: 1933046 - protein, 6 aa, Staphylococcus
DTTTQV

SEQ ID NO: 1933047 - protein, 11 aa, Staphylococcus
DTTVTHPTNPD

SEQ ID NO: 1933048 - protein, 9 aa, Staphylococcus
DTTYPGKDT

SEQ ID NO: 1933049 - protein, 8 aa, Staphylococcus
DTTYPSKE

SEQ ID NO: 1933050 - protein, 7 aa, Staphylococcus
DTTYTGG

SEQ ID NO: 1933051 - protein, 13 aa, Staphylococcus
DTVEKDSKTMKKF

SEQ ID NO: 1933052 - protein, 17 aa, Staphylococcus
DTVGDDLEVKASGGVRN

SEQ ID NO: 1933053 - protein, 10 aa, Staphylococcus
DTVGKPSDNV

SEQ ID NO: 1933054 - protein, 11 aa, Staphylococcus
DTVGKPSDNVK

SEQ ID NO: 1933055 - protein, 10 aa, Staphylococcus
DTVGKPSENV

SEQ ID NO: 1933056 - protein, 10 aa, Staphylococcus
DTVGKPSSNV

SEQ ID NO: 1933057 - protein, 4 aa, Staphylococcus
DTVK

SEQ ID NO: 1933058 - protein, 6 aa, Staphylococcus
DTVKPG

SEQ ID NO: 1933059 - protein, 6 aa, Staphylococcus
DTVKSK

SEQ ID NO: 1933060 - protein, 5 aa, Staphylococcus
DTVKV

SEQ ID NO: 1933061 - protein, 7 aa, Staphylococcus
DTVNITT

SEQ ID NO: 1933062 - protein, 6 aa, Staphylococcus
DTVPEN

SEQ ID NO: 1933063 - protein, 5 aa, Staphylococcus
DTVQS

SEQ ID NO: 1933064 - protein, 5 aa, Staphylococcus
DTVQY

SEQ ID NO: 1933065 - protein, 13 aa, Staphylococcus
DTVQYDNDKISQE

SEQ ID NO: 1933066 - protein, 12 aa, Staphylococcus
DTVQYKNKNISQ

SEQ ID NO: 1933067 - protein, 10 aa, Staphylococcus
DTVSDIQEGV

SEQ ID NO: 1933068 - protein, 7 aa, Staphylococcus
DTVSNDT

SEQ ID NO: 1933069 - protein, 6 aa, Staphylococcus
DTVSRD

SEQ ID NO: 1933070 - protein, 10 aa, Staphylococcus
DTVTEYDTQV

SEQ ID NO: 1933071 - protein, 6 aa, Staphylococcus
DTWADE

SEQ ID NO: 1933072 - protein, 4 aa, Staphylococcus
DTWG

SEQ ID NO: 1933073 - protein, 15 aa, Staphylococcus
DTWPDNIDTSYSRKE

SEQ ID NO: 1933074 - protein, 8 aa, Staphylococcus
DTYDERYE

SEQ ID NO: 1933075 - protein, 7 aa, Staphylococcus
DTYDTTV

SEQ ID NO: 1933076 - protein, 10 aa, Staphylococcus
DTYEAGSKMG

SEQ ID NO: 1933077 - protein, 6 aa, Staphylococcus
DTYENG

SEQ ID NO: 1933078 - protein, 7 aa, Staphylococcus
DTYHPNG

SEQ ID NO: 1933079 - protein, 14 aa, Staphylococcus
DTYHQEKQEHSDEI

SEQ ID NO: 1933080 - protein, 6 aa, Staphylococcus
DTYKAM

SEQ ID NO: 1933081 - protein, 7 aa, Staphylococcus
DTYNEEY

SEQ ID NO: 1933082 - protein, 5 aa, Staphylococcus
DTYNN

SEQ ID NO: 1933083 - protein, 5 aa, Staphylococcus
DTYNS

SEQ ID NO: 1933084 - protein, 7 aa, Staphylococcus
DTYQGQK

SEQ ID NO: 1933085 - protein, 6 aa, Staphylococcus
DTYQPR

SEQ ID NO: 1933086 - protein, 17 aa, Staphylococcus
DTYQPTEVLTGENEASE

SEQ ID NO: 1933087 - protein, 9 aa, Staphylococcus
DTYQQGDES

SEQ ID NO: 1933088 - protein, 9 aa, Staphylococcus
DTYQTTPQL

SEQ ID NO: 1933089 - protein, 10 aa, Staphylococcus
DTYTEDDQSY

SEQ ID NO: 1933090 - protein, 10 aa, Staphylococcus
DTYTKDNQSY

SEQ ID NO: 1933091 - protein, 9 aa, Staphylococcus
DTYTKGDHS

SEQ ID NO: 1933092 - protein, 14 aa, Staphylococcus
DTYTKTSDVTEKQL

SEQ ID NO: 1933093 - protein, 20 aa, Staphylococcus
DVAEATATTIRETEQVKTTA

SEQ ID NO: 1933094 - protein, 8 aa, Staphylococcus
DVAEEKKL

SEQ ID NO: 1933095 - protein, 7 aa, Staphylococcus
DVAKAEL

SEQ ID NO: 1933096 - protein, 5 aa, Staphylococcus
DVAKD

SEQ ID NO: 1933097 - protein, 7 aa, Staphylococcus
DVAKNDE

SEQ ID NO: 1933098 - protein, 9 aa, Staphylococcus
DVAKQETDL

SEQ ID NO: 1933099 - protein, 31 aa, Staphylococcus
DVAKRPPSSCTIGRSSGGITGTASRTMPSGE

SEQ ID NO: 1933100 - protein, 17 aa, Staphylococcus
DVAPPKQDEAQRESYLN

SEQ ID NO: 1933101 - protein, 15 aa, Staphylococcus
DVAPSYERGKNPFPK

SEQ ID NO: 1933102 - protein, 5 aa, Staphylococcus
DVAQT

SEQ ID NO: 1933103 - protein, 18 aa, Staphylococcus
DVASRKAVKKGSKGLDQI

SEQ ID NO: 1933104 - protein, 16 aa, Staphylococcus
DVDEKEEDAPQTLFVE

SEQ ID NO: 1933105 - protein, 9 aa, Staphylococcus
DVDEVSDEE

SEQ ID NO: 1933106 - protein, 4 aa, Staphylococcus
DVDG

SEQ ID NO: 1933107 - protein, 5 aa, Staphylococcus
DVDGA

SEQ ID NO: 1933108 - protein, 7 aa, Staphylococcus
DVDGETV

SEQ ID NO: 1933109 - protein, 7 aa, Staphylococcus
DVDGKKA

SEQ ID NO: 1933110 - protein, 7 aa, Staphylococcus
DVDKEKQ

SEQ ID NO: 1933111 - protein, 7 aa, Staphylococcus
DVDKNGL

SEQ ID NO: 1933112 - protein, 22 aa, Staphylococcus
DVDKRRAEFHPQGQRSSQTIQA

SEQ ID NO: 1933113 - protein, 17 aa, Staphylococcus
DVDKTEQEMLTTFKGGN

SEQ ID NO: 1933114 - protein, 6 aa, Staphylococcus
DVDNHT

SEQ ID NO: 1933115 - protein, 7 aa, Staphylococcus
DVDNHTE

SEQ ID NO: 1933116 - protein, 11 aa, Staphylococcus
DVDNVKPDPEP

SEQ ID NO: 1933117 - protein, 9 aa, Staphylococcus
DVDPEEQKT

SEQ ID NO: 1933118 - protein, 8 aa, Staphylococcus
DVDPETLK

SEQ ID NO: 1933119 - protein, 9 aa, Staphylococcus
DVDPPDEEA

SEQ ID NO: 1933120 - protein, 9 aa, Staphylococcus
DVDQPQEEL

SEQ ID NO: 1933121 - protein, 7 aa, Staphylococcus
DVDTGRI

SEQ ID NO: 1933122 - protein, 24 aa, Staphylococcus
DVDTKEKALAKVKPNNKKHNKTDE

SEQ ID NO: 1933123 - protein, 15 aa, Staphylococcus
DVEAGHAASVGRVDD

SEQ ID NO: 1933124 - protein, 10 aa, Staphylococcus
DVEAVKPDPE

SEQ ID NO: 1933125 - protein, 4 aa, Staphylococcus
DVEE

SEQ ID NO: 1933126 - protein, 17 aa, Staphylococcus
DVEEKEAESPATLFDEE

SEQ ID NO: 1933127 - protein, 16 aa, Staphylococcus
DVEEKEAKAPESLFDE

SEQ ID NO: 1933128 - protein, 16 aa, Staphylococcus
DVEENEDKSSQTLFDE

SEQ ID NO: 1933129 - protein, 18 aa, Staphylococcus
DVEETDAEEEAPKTLFDE

SEQ ID NO: 1933130 - protein, 8 aa, Staphylococcus
DVEGESVV

SEQ ID NO: 1933131 - protein, 7 aa, Staphylococcus
DVEGPFP

SEQ ID NO: 1933132 - protein, 5 aa, Staphylococcus
DVEGR

SEQ ID NO: 1933133 - protein, 26 aa, Staphylococcus
DVEGRSAKIEGKSDLQGAQVKATDLR

SEQ ID NO: 1933134 - protein, 6 aa, Staphylococcus
DVEHQH

SEQ ID NO: 1933135 - protein, 7 aa, Staphylococcus
DVEHSRS

SEQ ID NO: 1933136 - protein, 8 aa, Staphylococcus
DVEKAKAL

SEQ ID NO: 1933137 - protein, 11 aa, Staphylococcus
DVEKKEITSSR

SEQ ID NO: 1933138 - protein, 9 aa, Staphylococcus
DVEKNEQKI

SEQ ID NO: 1933139 - protein, 8 aa, Staphylococcus
DVEKRNNI

SEQ ID NO: 1933140 - protein, 14 aa, Staphylococcus
DVEKVKELTGAETG

SEQ ID NO: 1933141 - protein, 8 aa, Staphylococcus
DVENGEEA

SEQ ID NO: 1933142 - protein, 5 aa, Staphylococcus
DVENR

SEQ ID NO: 1933143 - protein, 4 aa, Staphylococcus
DVEP

SEQ ID NO: 1933144 - protein, 6 aa, Staphylococcus
DVEPDE

SEQ ID NO: 1933145 - protein, 9 aa, Staphylococcus
DVEPDVKET

SEQ ID NO: 1933146 - protein, 6 aa, Staphylococcus
DVEPED

SEQ ID NO: 1933147 - protein, 8 aa, Staphylococcus
DVEPEKRT

SEQ ID NO: 1933148 - protein, 6 aa, Staphylococcus
DVEPEQ

SEQ ID NO: 1933149 - protein, 8 aa, Staphylococcus
DVEPTDAQ

SEQ ID NO: 1933150 - protein, 5 aa, Staphylococcus
DVEQD

SEQ ID NO: 1933151 - protein, 5 aa, Staphylococcus
DVEQP

SEQ ID NO: 1933152 - protein, 6 aa, Staphylococcus
DVEQYK

SEQ ID NO: 1933153 - protein, 9 aa, Staphylococcus
DVERAEQEM

SEQ ID NO: 1933154 - protein, 12 aa, Staphylococcus
DVESEDYQRYYP

SEQ ID NO: 1933155 - protein, 5 aa, Staphylococcus
DVESQ

SEQ ID NO: 1933156 - protein, 24 aa, Staphylococcus
DVESYEGRRVQSIDNGFKKEGHKK

SEQ ID NO: 1933157 - protein, 7 aa, Staphylococcus
DVESYKG

SEQ ID NO: 1933158 - protein, 6 aa, Staphylococcus
DVETYR

SEQ ID NO: 1933159 - protein, 7 aa, Staphylococcus
DVEVDQG

SEQ ID NO: 1933160 - protein, 4 aa, Staphylococcus
DVEY

SEQ ID NO: 1933161 - protein, 7 aa, Staphylococcus
DVGGTAE

SEQ ID NO: 1933162 - protein, 17 aa, Staphylococcus
DVGNTVTRTEVDQQGKV

SEQ ID NO: 1933163 - protein, 12 aa, Staphylococcus
DVGSETLKSTLD

SEQ ID NO: 1933164 - protein, 6 aa, Staphylococcus
DVGSNV

SEQ ID NO: 1933165 - protein, 5 aa, Staphylococcus
DVGTG

SEQ ID NO: 1933166 - protein, 9 aa, Staphylococcus
DVGTGSGAI

SEQ ID NO: 1933167 - protein, 8 aa, Staphylococcus
DVGTGSGI

SEQ ID NO: 1933168 - protein, 7 aa, Staphylococcus
DVGTSTV

SEQ ID NO: 1933169 - protein, 24 aa, Staphylococcus
DVGYSEAKETIKNTFDSASTFGRK

SEQ ID NO: 1933170 - protein, 5 aa, Staphylococcus
DVHAQ

SEQ ID NO: 1933171 - protein, 6 aa, Staphylococcus
DVHDDD

SEQ ID NO: 1933172 - protein, 6 aa, Staphylococcus
DVHGSK

SEQ ID NO: 1933173 - protein, 5 aa, Staphylococcus
DVHQS

SEQ ID NO: 1933174 - protein, 7 aa, Staphylococcus
DVIDSGK

SEQ ID NO: 1933175 - protein, 14 aa, Staphylococcus
DVIEEGDSEYEKQT

SEQ ID NO: 1933176 - protein, 4 aa, Staphylococcus
DVIT

SEQ ID NO: 1933177 - protein, 7 aa, Staphylococcus
DVKDTDN

SEQ ID NO: 1933178 - protein, 9 aa, Staphylococcus
DVKEEIPSM

SEQ ID NO: 1933179 - protein, 8 aa, Staphylococcus
DVKGADLS

SEQ ID NO: 1933180 - protein, 8 aa, Staphylococcus
DVKHPGVK

SEQ ID NO: 1933181 - protein, 8 aa, Staphylococcus
DVKKQNDY

SEQ ID NO: 1933182 - protein, 4 aa, Staphylococcus
DVKM

SEQ ID NO: 1933183 - protein, 16 aa, Staphylococcus
DVKNSKKANIQSTSGF

SEQ ID NO: 1933184 - protein, 9 aa, Staphylococcus
DVKNTYGTG

SEQ ID NO: 1933185 - protein, 16 aa, Staphylococcus
DVKPPAQTEEQRESYL

SEQ ID NO: 1933186 - protein, 5 aa, Staphylococcus
DVKRQ

SEQ ID NO: 1933187 - protein, 14 aa, Staphylococcus
DVKRRGDMEEDPEF

SEQ ID NO: 1933188 - protein, 6 aa, Staphylococcus
DVKSNE

SEQ ID NO: 1933189 - protein, 7 aa, Staphylococcus
DVKSNNM

SEQ ID NO: 1933190 - protein, 8 aa, Staphylococcus
DVKTSKDL

SEQ ID NO: 1933191 - protein, 5 aa, Staphylococcus
DVKYQ

SEQ ID NO: 1933192 - protein, 6 aa, Staphylococcus
DVLPKE

SEQ ID NO: 1933193 - protein, 8 aa, Staphylococcus
DVLPNDAD

SEQ ID NO: 1933194 - protein, 6 aa, Staphylococcus
DVLPSD

SEQ ID NO: 1933195 - protein, 6 aa, Staphylococcus
DVNAEA

SEQ ID NO: 1933196 - protein, 36 aa, Staphylococcus
DVNDQLKKDEKNGDITEDDLRSQTDDVQKATDNSIK

SEQ ID NO: 1933197 - protein, 6 aa, Staphylococcus
DVNDTQ

SEQ ID NO: 1933198 - protein, 4 aa, Staphylococcus
DVNE

SEQ ID NO: 1933199 - protein, 6 aa, Staphylococcus
DVNGAQ

SEQ ID NO: 1933200 - protein, 7 aa, Staphylococcus
DVNPETL

SEQ ID NO: 1933201 - protein, 8 aa, Staphylococcus
DVNQKELE

SEQ ID NO: 1933202 - protein, 9 aa, Staphylococcus
DVNQKSLES

SEQ ID NO: 1933203 - protein, 6 aa, Staphylococcus
DVNQTE

SEQ ID NO: 1933204 - protein, 4 aa, Staphylococcus
DVNR

SEQ ID NO: 1933205 - protein, 11 aa, Staphylococcus
DVNRDRGGSLD

SEQ ID NO: 1933206 - protein, 6 aa, Staphylococcus
DVNSEA

SEQ ID NO: 1933207 - protein, 7 aa, Staphylococcus
DVNSESI

SEQ ID NO: 1933208 - protein, 8 aa, Staphylococcus
DVNTTNDS

SEQ ID NO: 1933209 - protein, 8 aa, Staphylococcus
DVPAEAEA

SEQ ID NO: 1933210 - protein, 7 aa, Staphylococcus
DVPDNAN

SEQ ID NO: 1933211 - protein, 8 aa, Staphylococcus
DVPDQPTF

SEQ ID NO: 1933212 - protein, 5 aa, Staphylococcus
DVPEE

SEQ ID NO: 1933213 - protein, 12 aa, Staphylococcus
DVPEGDSDEENI

SEQ ID NO: 1933214 - protein, 6 aa, Staphylococcus
DVPELN

SEQ ID NO: 1933215 - protein, 7 aa, Staphylococcus
DVPELND

SEQ ID NO: 1933216 - protein, 7 aa, Staphylococcus
DVPELTD

SEQ ID NO: 1933217 - protein, 11 aa, Staphylococcus
DVPGAQDNLQK

SEQ ID NO: 1933218 - protein, 7 aa, Staphylococcus
DVPGPFP

SEQ ID NO: 1933219 - protein, 10 aa, Staphylococcus
DVPKGASNKV

SEQ ID NO: 1933220 - protein, 16 aa, Staphylococcus
DVPKQAMPLKNETEVI

SEQ ID NO: 1933221 - protein, 7 aa, Staphylococcus
DVPKVKA

SEQ ID NO: 1933222 - protein, 7 aa, Staphylococcus
DVPNREG

SEQ ID NO: 1933223 - protein, 12 aa, Staphylococcus
DVPQAEVSNATT

SEQ ID NO: 1933224 - protein, 6 aa, Staphylococcus
DVPQDK

SEQ ID NO: 1933225 - protein, 12 aa, Staphylococcus
DVPQGADDTENV

SEQ ID NO: 1933226 - protein, 13 aa, Staphylococcus
DVPQGASDEENVE

SEQ ID NO: 1933227 - protein, 13 aa, Staphylococcus
DVPQGDSDEENVE

SEQ ID NO: 1933228 - protein, 22 aa, Staphylococcus
DVPQPKGKTATSPEEALENARE

SEQ ID NO: 1933229 - protein, 9 aa, Staphylococcus
DVPSELPDG

SEQ ID NO: 1933230 - protein, 12 aa, Staphylococcus
DVPSEQAETLKQ

SEQ ID NO: 1933231 - protein, 5 aa, Staphylococcus
DVPSM

SEQ ID NO: 1933232 - protein, 6 aa, Staphylococcus
DVPSSE

SEQ ID NO: 1933233 - protein, 5 aa, Staphylococcus
DVPVD

SEQ ID NO: 1933234 - protein, 10 aa, Staphylococcus
DVPYKSKNDG

SEQ ID NO: 1933235 - protein, 13 aa, Staphylococcus
DVPYTKEQGLGRN

SEQ ID NO: 1933236 - protein, 6 aa, Staphylococcus
DVQDAV

SEQ ID NO: 1933237 - protein, 7 aa, Staphylococcus
DVQDAVD

SEQ ID NO: 1933238 - protein, 8 aa, Staphylococcus
DVQDEEEL

SEQ ID NO: 1933239 - protein, 5 aa, Staphylococcus
DVQGS

SEQ ID NO: 1933240 - protein, 6 aa, Staphylococcus
DVQGSI

SEQ ID NO: 1933241 - protein, 5 aa, Staphylococcus
DVQKV

SEQ ID NO: 1933242 - protein, 8 aa, Staphylococcus
DVQNQSDE

SEQ ID NO: 1933243 - protein, 8 aa, Staphylococcus
DVQNQYDE

SEQ ID NO: 1933244 - protein, 12 aa, Staphylococcus
DVQPDIKKLGGA

SEQ ID NO: 1933245 - protein, 15 aa, Staphylococcus
DVQPPAESEEQREEY

SEQ ID NO: 1933246 - protein, 8 aa, Staphylococcus
DVQPVKES

SEQ ID NO: 1933247 - protein, 34 aa, Staphylococcus
DVQQTLQDRVNNGSYYKNEDQQVGSSIVDSENGG

SEQ ID NO: 1933248 - protein, 9 aa, Staphylococcus
DVQSAVQQS

SEQ ID NO: 1933249 - protein, 9 aa, Staphylococcus
DVQSGAITN

SEQ ID NO: 1933250 - protein, 6 aa, Staphylococcus
DVRAED

SEQ ID NO: 1933251 - protein, 6 aa, Staphylococcus
DVREKG

SEQ ID NO: 1933252 - protein, 13 aa, Staphylococcus
DVRENWDPEFGDR

SEQ ID NO: 1933253 - protein, 8 aa, Staphylococcus
DVRRTPKV

SEQ ID NO: 1933254 - protein, 9 aa, Staphylococcus
DVSDERSYE

SEQ ID NO: 1933255 - protein, 7 aa, Staphylococcus
DVSDREN

SEQ ID NO: 1933256 - protein, 6 aa, Staphylococcus
DVSEET

SEQ ID NO: 1933257 - protein, 9 aa, Staphylococcus
DVSESDKDV

SEQ ID NO: 1933258 - protein, 5 aa, Staphylococcus
DVSEY

SEQ ID NO: 1933259 - protein, 9 aa, Staphylococcus
DVSGEGSQV

SEQ ID NO: 1933260 - protein, 10 aa, Staphylococcus
DVSGGAGVEH

SEQ ID NO: 1933261 - protein, 18 aa, Staphylococcus
DVSGGAGVKHIKDDDTFG

SEQ ID NO: 1933262 - protein, 18 aa, Staphylococcus
DVSGGAKVEHIQDDDTFG

SEQ ID NO: 1933263 - protein, 9 aa, Staphylococcus
DVSGGANVE

SEQ ID NO: 1933264 - protein, 7 aa, Staphylococcus
DVSGPFP

SEQ ID NO: 1933265 - protein, 14 aa, Staphylococcus
DVSGSEAYKKRLQN

SEQ ID NO: 1933266 - protein, 7 aa, Staphylococcus
DVSKDVT

SEQ ID NO: 1933267 - protein, 7 aa, Staphylococcus
DVSKEAD

SEQ ID NO: 1933268 - protein, 8 aa, Staphylococcus
DVSKNVTT

SEQ ID NO: 1933269 - protein, 34 aa, Staphylococcus
DVSKRPSKKSKHDFTNSVTSESSFSNKPSNHSAI

SEQ ID NO: 1933270 - protein, 7 aa, Staphylococcus
DVSNEED

SEQ ID NO: 1933271 - protein, 8 aa, Staphylococcus
DVSNERIS

SEQ ID NO: 1933272 - protein, 8 aa, Staphylococcus
DVSNKNRT

SEQ ID NO: 1933273 - protein, 7 aa, Staphylococcus
DVSNRDE

SEQ ID NO: 1933274 - protein, 7 aa, Staphylococcus
DVSQNLT

SEQ ID NO: 1933275 - protein, 4 aa, Staphylococcus
DVSR

SEQ ID NO: 1933276 - protein, 10 aa, Staphylococcus
DVSRSKRKKV

SEQ ID NO: 1933277 - protein, 8 aa, Staphylococcus
DVSRTLQD

SEQ ID NO: 1933278 - protein, 12 aa, Staphylococcus
DVSSELNETTLS

SEQ ID NO: 1933279 - protein, 10 aa, Staphylococcus
DVSTDHEGEV

SEQ ID NO: 1933280 - protein, 17 aa, Staphylococcus
DVSTEEVTPENERRTVN

SEQ ID NO: 1933281 - protein, 10 aa, Staphylococcus
DVSTHHEGEV

SEQ ID NO: 1933282 - protein, 9 aa, Staphylococcus
DVSTSEELD

SEQ ID NO: 1933283 - protein, 8 aa, Staphylococcus
DVTAEEVN

SEQ ID NO: 1933284 - protein, 8 aa, Staphylococcus
DVTAEQVN

SEQ ID NO: 1933285 - protein, 4 aa, Staphylococcus
DVTD

SEQ ID NO: 1933286 - protein, 7 aa, Staphylococcus
DVTDDLA

SEQ ID NO: 1933287 - protein, 6 aa, Staphylococcus
DVTDDR

SEQ ID NO: 1933288 - protein, 8 aa, Staphylococcus
DVTDDRNK

SEQ ID NO: 1933289 - protein, 7 aa, Staphylococcus
DVTDQKY

SEQ ID NO: 1933290 - protein, 11 aa, Staphylococcus
DVTDTDAPTVA

SEQ ID NO: 1933291 - protein, 25 aa, Staphylococcus
DVTEEAKEIANTDGYKREIDGDQSF

SEQ ID NO: 1933292 - protein, 7 aa, Staphylococcus
DVTEGKD

SEQ ID NO: 1933293 - protein, 6 aa, Staphylococcus
DVTEPN

SEQ ID NO: 1933294 - protein, 5 aa, Staphylococcus
DVTGP

SEQ ID NO: 1933295 - protein, 10 aa, Staphylococcus
DVTGSVDEAA

SEQ ID NO: 1933296 - protein, 17 aa, Staphylococcus
DVTINQTEEININLINI

SEQ ID NO: 1933297 - protein, 11 aa, Staphylococcus
DVTKDNEGEVS

SEQ ID NO: 1933298 - protein, 8 aa, Staphylococcus
DVTKQREV

SEQ ID NO: 1933299 - protein, 5 aa, Staphylococcus
DVTMP

SEQ ID NO: 1933300 - protein, 17 aa, Staphylococcus
DVTQARDEVGKSIEAIQ

SEQ ID NO: 1933301 - protein, 5 aa, Staphylococcus
DVTQY

SEQ ID NO: 1933302 - protein, 5 aa, Staphylococcus
DVTRD

SEQ ID NO: 1933303 - protein, 15 aa, Staphylococcus
DVTRQNAIAKNIELF

SEQ ID NO: 1933304 - protein, 20 aa, Staphylococcus
DVTSGDITIEGKSITQAKGK

SEQ ID NO: 1933305 - protein, 26 aa, Staphylococcus
DVTSQDTSEWTRNTSQELVDSREPEN

SEQ ID NO: 1933306 - protein, 8 aa, Staphylococcus
DVTSTAGY

SEQ ID NO: 1933307 - protein, 21 aa, Staphylococcus
DVTSYDNEENGAARYLEEHFL

SEQ ID NO: 1933308 - protein, 10 aa, Staphylococcus
DVTTDHEGEV

SEQ ID NO: 1933309 - protein, 5 aa, Staphylococcus
DVTTH

SEQ ID NO: 1933310 - protein, 6 aa, Staphylococcus
DVTTSK

SEQ ID NO: 1933311 - protein, 8 aa, Staphylococcus
DVTTTTSK

SEQ ID NO: 1933312 - protein, 6 aa, Staphylococcus
DVTVEQ

SEQ ID NO: 1933313 - protein, 5 aa, Staphylococcus
DVVEP

SEQ ID NO: 1933314 - protein, 6 aa, Staphylococcus
DVVGQT

SEQ ID NO: 1933315 - protein, 9 aa, Staphylococcus
DVVKENPDV

SEQ ID NO: 1933316 - protein, 10 aa, Staphylococcus
DVVTEKSYAT

SEQ ID NO: 1933317 - protein, 5 aa, Staphylococcus
DVVTK

SEQ ID NO: 1933318 - protein, 13 aa, Staphylococcus
DVVTSVSQSLAQQ

SEQ ID NO: 1933319 - protein, 5 aa, Staphylococcus
DVYDD

SEQ ID NO: 1933320 - protein, 25 aa, Staphylococcus
DVYGNNKRKMKRGFERKKDAKFAES

SEQ ID NO: 1933321 - protein, 12 aa, Staphylococcus
DVYKESGQLSYV

SEQ ID NO: 1933322 - protein, 12 aa, Staphylococcus
DVYKNEGQLSYV

SEQ ID NO: 1933323 - protein, 12 aa, Staphylococcus
DVYKNSGQLSYV

SEQ ID NO: 1933324 - protein, 12 aa, Staphylococcus
DVYKTSGQLSYV

SEQ ID NO: 1933325 - protein, 12 aa, Staphylococcus
DVYKTTGQLSYV

SEQ ID NO: 1933326 - protein, 10 aa, Staphylococcus
DWEDKDGNHF

SEQ ID NO: 1933327 - protein, 11 aa, Staphylococcus
DWEDKDGNHVD

SEQ ID NO: 1933328 - protein, 6 aa, Staphylococcus
DWEGEE

SEQ ID NO: 1933329 - protein, 4 aa, Staphylococcus
DWEN

SEQ ID NO: 1933330 - protein, 5 aa, Staphylococcus
DWETM

SEQ ID NO: 1933331 - protein, 5 aa, Staphylococcus
DWGKR

SEQ ID NO: 1933332 - protein, 4 aa, Staphylococcus
DWKE

SEQ ID NO: 1933333 - protein, 6 aa, Staphylococcus
DWKGKK

SEQ ID NO: 1933334 - protein, 18 aa, Staphylococcus
DWNDKRRKGLNDKPVIAE

SEQ ID NO: 1933335 - protein, 24 aa, Staphylococcus
DWNDKRRKGLNDKPVIAEGKHTPI

SEQ ID NO: 1933336 - protein, 7 aa, Staphylococcus
DWNKEGW

SEQ ID NO: 1933337 - protein, 7 aa, Staphylococcus
DWNKTGW

SEQ ID NO: 1933338 - protein, 6 aa, Staphylococcus
DWPKAG

SEQ ID NO: 1933339 - protein, 7 aa, Staphylococcus
DWPKEGV

SEQ ID NO: 1933340 - protein, 8 aa, Staphylococcus
DWPKPGVN

SEQ ID NO: 1933341 - protein, 7 aa, Staphylococcus
DWQDEKE

SEQ ID NO: 1933342 - protein, 6 aa, Staphylococcus
DWSRSQ

SEQ ID NO: 1933343 - protein, 15 aa, Staphylococcus
DWTKGEVEAIPGKTM

SEQ ID NO: 1933344 - protein, 8 aa, Staphylococcus
DWTPQDSL

SEQ ID NO: 1933345 - protein, 9 aa, Staphylococcus
DYADESEKM

SEQ ID NO: 1933346 - protein, 18 aa, Staphylococcus
DYADSEPHSLSGGQKQRV

SEQ ID NO: 1933347 - protein, 6 aa, Staphylococcus
DYAEYG

SEQ ID NO: 1933348 - protein, 4 aa, Staphylococcus
DYAG

SEQ ID NO: 1933349 - protein, 5 aa, Staphylococcus
DYANS

SEQ ID NO: 1933350 - protein, 6 aa, Staphylococcus
DYANSL

SEQ ID NO: 1933351 - protein, 34 aa, Staphylococcus; identical to SEQ ID NO: 1756044

SEQ ID NO: 1933352 - protein, 33 aa, Staphylococcus
DYANYGDEATFGGGKSIRDGMAQNPNVTRDDRK

SEQ ID NO: 1933353 - protein, 33 aa, Staphylococcus
DYANYGEEATFGGGKSIRDGMAQNPNVTRDDRK

SEQ ID NO: 1933354 - protein, 22 aa, Staphylococcus
DYARITKEEYQDDKEDGIPEGH

SEQ ID NO: 1933355 - protein, 4 aa, Staphylococcus
DYAT

SEQ ID NO: 1933356 - protein, 34 aa, Staphylococcus
DYATYGDEAAFGGGKSIRDGMAQNPNVTRDDKQV

SEQ ID NO: 1933357 - protein, 7 aa, Staphylococcus
DYDATAF

SEQ ID NO: 1933358 - protein, 8 aa, Staphylococcus
DYDDEGQS

SEQ ID NO: 1933359 - protein, 7 aa, Staphylococcus
DYDEDAE

SEQ ID NO: 1933360 - protein, 8 aa, Staphylococcus
DYDEDAEK

SEQ ID NO: 1933361 - protein, 9 aa, Staphylococcus
DYDEKHEKA

SEQ ID NO: 1933362 - protein, 5 aa, Staphylococcus
DYDGV

SEQ ID NO: 1933363 - protein, 9 aa, Staphylococcus
DYDKEDIAD

SEQ ID NO: 1933364 - protein, 9 aa, Staphylococcus
DYDTEDGSC

SEQ ID NO: 1933365 - protein, 7 aa, Staphylococcus
DYDTGET

SEQ ID NO: 1933366 - protein, 5 aa, Staphylococcus
DYDTS

SEQ ID NO: 1933367 - protein, 6 aa, Staphylococcus
DYDTSL

SEQ ID NO: 1933368 - protein, 7 aa, Staphylococcus
DYDYPKQ

SEQ ID NO: 1933369 - protein, 6 aa, Staphylococcus
DYEADK

SEQ ID NO: 1933370 - protein, 15 aa, Staphylococcus
DYEEAVSETPFTKEK

SEQ ID NO: 1933371 - protein, 7 aa, Staphylococcus
DYEENEK

SEQ ID NO: 1933372 - protein, 7 aa, Staphylococcus
DYEENET

SEQ ID NO: 1933373 - protein, 7 aa, Staphylococcus
DYEESLN

SEQ ID NO: 1933374 - protein, 5 aa, Staphylococcus
DYEGE

SEQ ID NO: 1933375 - protein, 5 aa, Staphylococcus
DYEKE

SEQ ID NO: 1933376 - protein, 7 aa, Staphylococcus
DYEQEDN

SEQ ID NO: 1933377 - protein, 6 aa, Staphylococcus
DYEQGK

SEQ ID NO: 1933378 - protein, 10 aa, Staphylococcus
DYEQTKGSEI

SEQ ID NO: 1933379 - protein, 7 aa, Staphylococcus
DYERYGA

SEQ ID NO: 1933380 - protein, 9 aa, Staphylococcus
DYESEGKAL

SEQ ID NO: 1933381 - protein, 10 aa, Staphylococcus
DYESNKGNHY

SEQ ID NO: 1933382 - protein, 24 aa, Staphylococcus
DYETDKDGNVKPRLEDKDNHTIDA

SEQ ID NO: 1933383 - protein, 7 aa, Staphylococcus
DYETGAK

SEQ ID NO: 1933384 - protein, 8 aa, Staphylococcus
DYETGAQR

SEQ ID NO: 1933385 - protein, 9 aa, Staphylococcus
DYETNKSNH

SEQ ID NO: 1933386 - protein, 10 aa, Staphylococcus
DYETTEPLNN

SEQ ID NO: 1933387 - protein, 7 aa, Staphylococcus
DYETYGA

SEQ ID NO: 1933388 - protein, 14 aa, Staphylococcus
DYETYKKEKDKQLA

SEQ ID NO: 1933389 - protein, 9 aa, Staphylococcus
DYFSRSADD

SEQ ID NO: 1933390 - protein, 11 aa, Staphylococcus
DYFSRTPEDLK

SEQ ID NO: 1933391 - protein, 7 aa, Staphylococcus
DYGESDK

SEQ ID NO: 1933392 - protein, 4 aa, Staphylococcus
DYGF

SEQ ID NO: 1933393 - protein, 6 aa, Staphylococcus
DYGFSD

SEQ ID NO: 1933394 - protein, 4 aa, Staphylococcus
DYGG

SEQ ID NO: 1933395 - protein, 8 aa, Staphylococcus
DYGNAQRR

SEQ ID NO: 1933396 - protein, 12 aa, Staphylococcus
DYGNRVDRKNAR

SEQ ID NO: 1933397 - protein, 6 aa, Staphylococcus
DYGQKR

SEQ ID NO: 1933398 - protein, 4 aa, Staphylococcus
DYGS

SEQ ID NO: 1933399 - protein, 6 aa, Staphylococcus
DYGSNG

SEQ ID NO: 1933400 - protein, 6 aa, Staphylococcus
DYGSNI

SEQ ID NO: 1933401 - protein, 9 aa, Staphylococcus
DYGTQDEIK

SEQ ID NO: 1933402 - protein, 7 aa, Staphylococcus
DYGVPQA

SEQ ID NO: 1933403 - protein, 15 aa, Staphylococcus
DYHAKGYASGFEESD

SEQ ID NO: 1933404 - protein, 15 aa, Staphylococcus
DYHGEVTSPKTKAGI

SEQ ID NO: 1933405 - protein, 10 aa, Staphylococcus
DYIEKQSSKV

SEQ ID NO: 1933406 - protein, 10 aa, Staphylococcus
DYINKDTLKD

SEQ ID NO: 1933407 - protein, 12 aa, Staphylococcus
DYINNTKQSGYR

SEQ ID NO: 1933408 - protein, 12 aa, Staphylococcus
DYISNTKQSGYR

SEQ ID NO: 1933409 - protein, 12 aa, Staphylococcus
DYITSTHRGHGH

SEQ ID NO: 1933410 - protein, 5 aa, Staphylococcus
DYKAV

SEQ ID NO: 1933411 - protein, 5 aa, Staphylococcus
DYKFT

SEQ ID NO: 1933412 - protein, 7 aa, Staphylococcus
DYKGKKK

SEQ ID NO: 1933413 - protein, 17 aa, Staphylococcus
DYKGTTTYGFTGAGSDM

SEQ ID NO: 1933414 - protein, 5 aa, Staphylococcus
DYKIT

SEQ ID NO: 1933415 - protein, 10 aa, Staphylococcus
DYKKDDFAQT

SEQ ID NO: 1933416 - protein, 9 aa, Staphylococcus
DYKKGNEIS

SEQ ID NO: 1933417 - protein, 11 aa, Staphylococcus
DYKNEDKDDTV

SEQ ID NO: 1933418 - protein, 5 aa, Staphylococcus
DYKNG

SEQ ID NO: 1933419 - protein, 12 aa, Staphylococcus
DYKQTKEDISEV

SEQ ID NO: 1933420 - protein, 13 aa, Staphylococcus
DYKRPGLDKEMPP

SEQ ID NO: 1933421 - protein, 8 aa, Staphylococcus
DYKSDELA

SEQ ID NO: 1933422 - protein, 12 aa, Staphylococcus
DYKSGKQTLPQF

SEQ ID NO: 1933423 - protein, 7 aa, Staphylococcus
DYKSHAR

SEQ ID NO: 1933424 - protein, 11 aa, Staphylococcus
DYKSKKEEIAE

SEQ ID NO: 1933425 - protein, 6 aa, Staphylococcus
DYKSQV

SEQ ID NO: 1933426 - protein, 12 aa, Staphylococcus
DYKSRAKVTGHS

SEQ ID NO: 1933427 - protein, 6 aa, Staphylococcus
DYLQTE

SEQ ID NO: 1933428 - protein, 4 aa, Staphylococcus
DYNE

SEQ ID NO: 1933429 - protein, 5 aa, Staphylococcus
DYNEN

SEQ ID NO: 1933430 - protein, 7 aa, Staphylococcus
DYNEQSD

SEQ ID NO: 1933431 - protein, 13 aa, Staphylococcus
DYNGDNITGISSA

SEQ ID NO: 1933432 - protein, 11 aa, Staphylococcus
DYNGQSPTMTV

SEQ ID NO: 1933433 - protein, 5 aa, Staphylococcus
DYNNG

SEQ ID NO: 1933434 - protein, 12 aa, Staphylococcus
DYNNPKEAEEKG

SEQ ID NO: 1933435 - protein, 8 aa, Staphylococcus
DYNNSVES

SEQ ID NO: 1933436 - protein, 12 aa, Staphylococcus
DYNPETDRIPEN

SEQ ID NO: 1933437 - protein, 11 aa, Staphylococcus
DYNPGSSVTNN

SEQ ID NO: 1933438 - protein, 12 aa, Staphylococcus
DYPDGEKWAKGS

SEQ ID NO: 1933439 - protein, 12 aa, Staphylococcus
DYPDGSQYNRTK

SEQ ID NO: 1933440 - protein, 9 aa, Staphylococcus
DYPDNGPDI

SEQ ID NO: 1933441 - protein, 6 aa, Staphylococcus
DYPDPT

SEQ ID NO: 1933442 - protein, 4 aa, Staphylococcus
DYPE

SEQ ID NO: 1933443 - protein, 6 aa, Staphylococcus
DYPFND

SEQ ID NO: 1933444 - protein, 5 aa, Staphylococcus
DYPGI

SEQ ID NO: 1933445 - protein, 11 aa, Staphylococcus
DYPGIGPEHSY

SEQ ID NO: 1933446 - protein, 12 aa, Staphylococcus
DYPHGKVKDADV

SEQ ID NO: 1933447 - protein, 12 aa, Staphylococcus
DYPITPKNHGTE

SEQ ID NO: 1933448 - protein, 6 aa, Staphylococcus
DYPKAA

SEQ ID NO: 1933449 - protein, 7 aa, Staphylococcus
DYPKTAD

SEQ ID NO: 1933450 - protein, 5 aa, Staphylococcus
DYPME

SEQ ID NO: 1933451 - protein, 5 aa, Staphylococcus
DYPNR

SEQ ID NO: 1933452 - protein, 6 aa, Staphylococcus
DYPQYK

SEQ ID NO: 1933453 - protein, 12 aa, Staphylococcus
DYPSAKQAEAAE

SEQ ID NO: 1933454 - protein, 12 aa, Staphylococcus
DYPSAKQAQQAN

SEQ ID NO: 1933455 - protein, 11 aa, Staphylococcus
DYPSAKQVEAA

SEQ ID NO: 1933456 - protein, 10 aa, Staphylococcus
DYPSCGPDMP

SEQ ID NO: 1933457 - protein, 20 aa, Staphylococcus
DYPSCGPDMPEFEPRGCPRG

SEQ ID NO: 1933458 - protein, 9 aa, Staphylococcus
DYPSHKDNH

SEQ ID NO: 1933459 - protein, 6 aa, Staphylococcus
DYPTEV

SEQ ID NO: 1933460 - protein, 13 aa, Staphylococcus
DYPTGPSERQEQP

SEQ ID NO: 1933461 - protein, 6 aa, Staphylococcus
DYPYNN

SEQ ID NO: 1933462 - protein, 9 aa, Staphylococcus
DYQDKTQRL

SEQ ID NO: 1933463 - protein, 10 aa, Staphylococcus
DYQGGGRGSQ

SEQ ID NO: 1933464 - protein, 8 aa, Staphylococcus
DYQGQGIA

SEQ ID NO: 1933465 - protein, 6 aa, Staphylococcus
DYQKGH

SEQ ID NO: 1933466 - protein, 7 aa, Staphylococcus
DYQKGHD

SEQ ID NO: 1933467 - protein, 5 aa, Staphylococcus
DYQLN

SEQ ID NO: 1933468 - protein, 10 aa, Staphylococcus
DYQNKGVGRS

SEQ ID NO: 1933469 - protein, 9 aa, Staphylococcus
DYQNKKKEI

SEQ ID NO: 1933470 - protein, 8 aa, Staphylococcus
DYQRQTAD

SEQ ID NO: 1933471 - protein, 17 aa, Staphylococcus
DYQSEKDTATQALADDL

SEQ ID NO: 1933472 - protein, 22 aa, Staphylococcus
DYQSQERINKDDGTTESIALPK

SEQ ID NO: 1933473 - protein, 8 aa, Staphylococcus
DYQTDQNG

SEQ ID NO: 1933474 - protein, 7 aa, Staphylococcus
DYRGQGI

SEQ ID NO: 1933475 - protein, 16 aa, Staphylococcus
DYRHEDKSIDSYADDY

SEQ ID NO: 1933476 - protein, 12 aa, Staphylococcus
DYRHESKQIESY

SEQ ID NO: 1933477 - protein, 5 aa, Staphylococcus
DYRNT

SEQ ID NO: 1933478 - protein, 7 aa, Staphylococcus
DYRQGMQ

SEQ ID NO: 1933479 - protein, 7 aa, Staphylococcus
DYRRRGV

SEQ ID NO: 1933480 - protein, 4 aa, Staphylococcus
DYRS

SEQ ID NO: 1933481 - protein, 8 aa, Staphylococcus
DYRSKTDN

SEQ ID NO: 1933482 - protein, 5 aa, Staphylococcus
DYRSQ

SEQ ID NO: 1933483 - protein, 8 aa, Staphylococcus
DYSDKAAL

SEQ ID NO: 1933484 - protein, 7 aa, Staphylococcus
DYSGHGF

SEQ ID NO: 1933485 - protein, 4 aa, Staphylococcus
DYSH

SEQ ID NO: 1933486 - protein, 9 aa, Staphylococcus
DYSKDIGRN

SEQ ID NO: 1933487 - protein, 6 aa, Staphylococcus
DYSKEL

SEQ ID NO: 1933488 - protein, 9 aa, Staphylococcus
DYSKESEDE

SEQ ID NO: 1933489 - protein, 6 aa, Staphylococcus
DYSKPA

SEQ ID NO: 1933490 - protein, 7 aa, Staphylococcus
DYSPDKM

SEQ ID NO: 1933491 - protein, 17 aa, Staphylococcus
DYSPDSKLGLATGGTMT

SEQ ID NO: 1933492 - protein, 8 aa, Staphylococcus
DYSPKEIA

SEQ ID NO: 1933493 - protein, 14 aa, Staphylococcus
DYSQEEKTKRLNEI

SEQ ID NO: 1933494 - protein, 8 aa, Staphylococcus
DYTAKGNT

SEQ ID NO: 1933495 - protein, 12 aa, Staphylococcus
DYTEAGASIVNE

SEQ ID NO: 1933496 - protein, 15 aa, Staphylococcus
DYTELTDTAQQGDRE

SEQ ID NO: 1933497 - protein, 13 aa, Staphylococcus
DYTNEDINSKEQY

SEQ ID NO: 1933498 - protein, 21 aa, Staphylococcus
DYTNKSSFPSYQQPESNDYEL

SEQ ID NO: 1933499 - protein, 5 aa, Staphylococcus
DYTNS

SEQ ID NO: 1933500 - protein, 4 aa, Staphylococcus
DYTQ

SEQ ID NO: 1933501 - protein, 10 aa, Staphylococcus
DYTSKKKEII

SEQ ID NO: 1933502 - protein, 9 aa, Staphylococcus
DYTSSRGYE

SEQ ID NO: 1933503 - protein, 6 aa, Staphylococcus
DYTTNQ

SEQ ID NO: 1933504 - protein, 6 aa, Staphylococcus
DYVDNS

SEQ ID NO: 1933505 - protein, 12 aa, Staphylococcus
DYVESPKENGYR

SEQ ID NO: 1933506 - protein, 11 aa, Staphylococcus
DYVKSKSEKAY

SEQ ID NO: 1933507 - protein, 5 aa, Staphylococcus
DYVNN

SEQ ID NO: 1933508 - protein, 6 aa, Staphylococcus
DYVNNS

SEQ ID NO: 1933509 - protein, 4 aa, Staphylococcus
DYVS

SEQ ID NO: 1933510 - protein, 5 aa, Staphylococcus
DYWDK

SEQ ID NO: 1933511 - protein, 26 aa, Staphylococcus
DYYEAAREQLPDVGTKIETPDGKGTV

SEQ ID NO: 1933512 - protein, 12 aa, Staphylococcus
DYYEEARAQLPD

SEQ ID NO: 1933513 - protein, 26 aa, Staphylococcus
DYYEEARAQLPDVGDAIETPEGNGKV

SEQ ID NO: 1933514 - protein, 26 aa, Staphylococcus
DYYEEARAQLPDVGDEIHTPEGTGKV

SEQ ID NO: 1933515 - protein, 26 aa, Staphylococcus
DYYEEARAQLPDVGDSIETPDGNGQV

SEQ ID NO: 1933516 - protein, 9 aa, Staphylococcus
DYYGYSGEE

SEQ ID NO: 1933517 - protein, 15 aa, Staphylococcus
DYYYEGDGNRVPSTL

SEQ ID NO: 1933518 - protein, 18 aa, Staphylococcus
EAAAGLPEDVKEYFTARF

SEQ ID NO: 1933519 - protein, 18 aa, Staphylococcus
EAAAGLPEDVKEYFTARY

SEQ ID NO: 1933520 - protein, 5 aa, Staphylococcus
EAAAK

SEQ ID NO: 1933521 - protein, 6 aa, Staphylococcus
EAAASE

SEQ ID NO: 1933522 - protein, 11 aa, Staphylococcus
EAAASEHGDSA

SEQ ID NO: 1933523 - protein, 4 aa, Staphylococcus
EAAD

SEQ ID NO: 1933524 - protein, 7 aa, Staphylococcus
EAADKDY

SEQ ID NO: 1933525 - protein, 8 aa, Staphylococcus
EAADNVET

SEQ ID NO: 1933526 - protein, 8 aa, Staphylococcus
EAADPVSY

SEQ ID NO: 1933527 - protein, 21 aa, Staphylococcus
EAAEAISEAGLPASPGASTGK

SEQ ID NO: 1933528 - protein, 12 aa, Staphylococcus
EAAEKSLDNTPN

SEQ ID NO: 1933529 - protein, 8 aa, Staphylococcus
EAAENGKQ

SEQ ID NO: 1933530 - protein, 4 aa, Staphylococcus
EAAG

SEQ ID NO: 1933531 - protein, 11 aa, Staphylococcus
EAAGAKEGGVV

SEQ ID NO: 1933532 - protein, 11 aa, Staphylococcus
EAAGKGKLTDK

SEQ ID NO: 1933533 - protein, 11 aa, Staphylococcus
EAAGSKIEYSP

SEQ ID NO: 1933534 - protein, 9 aa, Staphylococcus
EAAGSTINY

SEQ ID NO: 1933535 - protein, 14 aa, Staphylococcus
EAAHSYNGRQTPRV

SEQ ID NO: 1933536 - protein, 4 aa, Staphylococcus
EAAI

SEQ ID NO: 1933537 - protein, 7 aa, Staphylococcus
EAAKAES

SEQ ID NO: 1933538 - protein, 9 aa, Staphylococcus
EAAKNESYD

SEQ ID NO: 1933539 - protein, 8 aa, Staphylococcus
EAAKNNGF

SEQ ID NO: 1933540 - protein, 9 aa, Staphylococcus
EAAKQDKSV

SEQ ID NO: 1933541 - protein, 16 aa, Staphylococcus
EAAKSSSEIVLEMLKS

SEQ ID NO: 1933542 - protein, 16 aa, Staphylococcus
EAAKSSSSIVESLIKV

SEQ ID NO: 1933543 - protein, 12 aa, Staphylococcus
EAALNDAAKALE

SEQ ID NO: 1933544 - protein, 8 aa, Staphylococcus
EAANELEN

SEQ ID NO: 1933545 - protein, 10 aa, Staphylococcus
EAANGDERAE

SEQ ID NO: 1933546 - protein, 12 aa, Staphylococcus
EAANGPTTPEAT

SEQ ID NO: 1933547 - protein, 8 aa, Staphylococcus
EAAPVNEF

SEQ ID NO: 1933548 - protein, 4 aa, Staphylococcus
EAAQ

SEQ ID NO: 1933549 - protein, 6 aa, Staphylococcus
EAAQDY

SEQ ID NO: 1933550 - protein, 5 aa, Staphylococcus
EAAQS

SEQ ID NO: 1933551 - protein, 7 aa, Staphylococcus
EAASEHD

SEQ ID NO: 1933552 - protein, 7 aa, Staphylococcus
EAASKHD

SEQ ID NO: 1933553 - protein, 8 aa, Staphylococcus
EAASPMSR

SEQ ID NO: 1933554 - protein, 7 aa, Staphylococcus
EACDNEG

SEQ ID NO: 1933555 - protein, 6 aa, Staphylococcus
EACEKS

SEQ ID NO: 1933556 - protein, 7 aa, Staphylococcus
EACKSSD

SEQ ID NO: 1933557 - protein, 10 aa, Staphylococcus
EACPGPSDSN

SEQ ID NO: 1933558 - protein, 10 aa, Staphylococcus
EACPGPTDSN

SEQ ID NO: 1933559 - protein, 4 aa, Staphylococcus
EACQ

SEQ ID NO: 1933560 - protein, 8 aa, Staphylococcus
EADAATGM

SEQ ID NO: 1933561 - protein, 8 aa, Staphylococcus
EADADAAL

SEQ ID NO: 1933562 - protein, 6 aa, Staphylococcus
EADALS

SEQ ID NO: 1933563 - protein, 7 aa, Staphylococcus
EADAQTY

SEQ ID NO: 1933564 - protein, 15 aa, Staphylococcus
EADASPNARTQGGQL

SEQ ID NO: 1933565 - protein, 7 aa, Staphylococcus
EADCKSA

SEQ ID NO: 1933566 - protein, 9 aa, Staphylococcus
EADDHYPGD

SEQ ID NO: 1933567 - protein, 8 aa, Staphylococcus
EADDKQSV

SEQ ID NO: 1933568 - protein, 11 aa, Staphylococcus
EADEFYPENPY

SEQ ID NO: 1933569 - protein, 17 aa, Staphylococcus
EADESYETSNKDSETVL

SEQ ID NO: 1933570 - protein, 7 aa, Staphylococcus
EADETLS

SEQ ID NO: 1933571 - protein, 19 aa, Staphylococcus
EADEVTGTATIKPSTLHGT

SEQ ID NO: 1933572 - protein, 9 aa, Staphylococcus
EADGHKGLR

SEQ ID NO: 1933573 - protein, 8 aa, Staphylococcus
EADGTHSD

SEQ ID NO: 1933574 - protein, 12 aa, Staphylococcus
EADHTSNDAQEF

SEQ ID NO: 1933575 - protein, 12 aa, Staphylococcus
EADHTSSDAQEF

SEQ ID NO: 1933576 - protein, 5 aa, Staphylococcus
EADID

SEQ ID NO: 1933577 - protein, 6 aa, Staphylococcus
EADIEN

SEQ ID NO: 1933578 - protein, 6 aa, Staphylococcus
EADKAR

SEQ ID NO: 1933579 - protein, 5 aa, Staphylococcus
EADKN

SEQ ID NO: 1933580 - protein, 4 aa, Staphylococcus
EADM

SEQ ID NO: 1933581 - protein, 10 aa, Staphylococcus
EADNATDYRD

SEQ ID NO: 1933582 - protein, 10 aa, Staphylococcus
EADNNAIDEE

SEQ ID NO: 1933583 - protein, 7 aa, Staphylococcus
EADPELD

SEQ ID NO: 1933584 - protein, 7 aa, Staphylococcus
EADPENE

SEQ ID NO: 1933585 - protein, 7 aa, Staphylococcus
EADPKAL

SEQ ID NO: 1933586 - protein, 25 aa, Staphylococcus
EADPNTQDKRMKRAGLGNPSAPGFE

SEQ ID NO: 1933587 - protein, 7 aa, Staphylococcus
EADPTPA

SEQ ID NO: 1933588 - protein, 5 aa, Staphylococcus
EADQV

SEQ ID NO: 1933589 - protein, 10 aa, Staphylococcus
EADRQNGITC

SEQ ID NO: 1933590 - protein, 9 aa, Staphylococcus
EADTDLGPS

SEQ ID NO: 1933591 - protein, 4 aa, Staphylococcus
EADV

SEQ ID NO: 1933592 - protein, 20 aa, Staphylococcus
EADYAEKLQSYPSVQGDNIQ

SEQ ID NO: 1933593 - protein, 5 aa, Staphylococcus
EADYD

SEQ ID NO: 1933594 - protein, 5 aa, Staphylococcus
EADYG

SEQ ID NO: 1933595 - protein, 8 aa, Staphylococcus
EADYRAKS

SEQ ID NO: 1933596 - protein, 8 aa, Staphylococcus
EAEAANAT

SEQ ID NO: 1933597 - protein, 14 aa, Staphylococcus
EAEAEKLKQHVNTE

SEQ ID NO: 1933598 - protein, 7 aa, Staphylococcus
EAEAEKT

SEQ ID NO: 1933599 - protein, 5 aa, Staphylococcus
EAEAI

SEQ ID NO: 1933600 - protein, 11 aa, Staphylococcus
EAEARNSQKRK

SEQ ID NO: 1933601 - protein, 21 aa, Staphylococcus
EAEAVPDEISPSEIEGRTDLR

SEQ ID NO: 1933602 - protein, 9 aa, Staphylococcus
EAEDFTNSQ

SEQ ID NO: 1933603 - protein, 10 aa, Staphylococcus
EAEDQSTVTV

SEQ ID NO: 1933604 - protein, 9 aa, Staphylococcus
EAEDSSDID

SEQ ID NO: 1933605 - protein, 5 aa, Staphylococcus
EAEDV

SEQ ID NO: 1933606 - protein, 19 aa, Staphylococcus
EAEDVPDEIEPSEIEGRHD

SEQ ID NO: 1933607 - protein, 20 aa, Staphylococcus
EAEDVPEEIEPSEIEGRRDL

SEQ ID NO: 1933608 - protein, 4 aa, Staphylococcus
EAEE

SEQ ID NO: 1933609 - protein, 6 aa, Staphylococcus
EAEEAI

SEQ ID NO: 1933610 - protein, 7 aa, Staphylococcus
EAEEAVN

SEQ ID NO: 1933611 - protein, 23 aa, Staphylococcus
EAEEGTPDEPSSDDSNEKRIADL

SEQ ID NO: 1933612 - protein, 7 aa, Staphylococcus
EAEEVSE

SEQ ID NO: 1933613 - protein, 7 aa, Staphylococcus
EAEGALN

SEQ ID NO: 1933614 - protein, 6 aa, Staphylococcus
EAEGHT

SEQ ID NO: 1933615 - protein, 6 aa, Staphylococcus
EAEGSN

SEQ ID NO: 1933616 - protein, 5 aa, Staphylococcus
EAEHQ

SEQ ID NO: 1933617 - protein, 6 aa, Staphylococcus
EAEIDG

SEQ ID NO: 1933618 - protein, 4 aa, Staphylococcus
EAEK

SEQ ID NO: 1933619 - protein, 24 aa, Staphylococcus
EAEKAGKIKPGDTIVEPTSGNTGI

SEQ ID NO: 1933620 - protein, 7 aa, Staphylococcus
EAEKQLG

SEQ ID NO: 1933621 - protein, 10 aa, Staphylococcus
EAEKRSGSQI

SEQ ID NO: 1933622 - protein, 11 aa, Staphylococcus
EAEKSLNNTPN

SEQ ID NO: 1933623 - protein, 5 aa, Staphylococcus
EAEKY

SEQ ID NO: 1933624 - protein, 7 aa, Staphylococcus
EAENEYP

SEQ ID NO: 1933625 - protein, 7 aa, Staphylococcus
EAENKAH

SEQ ID NO: 1933626 - protein, 10 aa, Staphylococcus
EAENKAQQQR

SEQ ID NO: 1933627 - protein, 11 aa, Staphylococcus
EAENSTDYREM

SEQ ID NO: 1933628 - protein, 8 aa, Staphylococcus
EAEPEHQD

SEQ ID NO: 1933629 - protein, 12 aa, Staphylococcus
EAEQLTNEIEQQ

SEQ ID NO: 1933630 - protein, 6 aa, Staphylococcus
EAEQSL

SEQ ID NO: 1933631 - protein, 6 aa, Staphylococcus
EAEQYV

SEQ ID NO: 1933632 - protein, 7 aa, Staphylococcus
EAEREGI

SEQ ID NO: 1933633 - protein, 12 aa, Staphylococcus
EAERNWLNQQKN

SEQ ID NO: 1933634 - protein, 12 aa, Staphylococcus
EAERNWLNQQQN

SEQ ID NO: 1933635 - protein, 13 aa, Staphylococcus
EAERSPNETYVPN

SEQ ID NO: 1933636 - protein, 12 aa, Staphylococcus
EAERTKHNNAQN

SEQ ID NO: 1933637 - protein, 11 aa, Staphylococcus
EAESEGSAEDM

SEQ ID NO: 1933638 - protein, 6 aa, Staphylococcus
EAESES

SEQ ID NO: 1933639 - protein, 9 aa, Staphylococcus
EAESTKRTL

SEQ ID NO: 1933640 - protein, 21 aa, Staphylococcus
EAESVPEEIKPEEIKGRRDLR

SEQ ID NO: 1933641 - protein, 5 aa, Staphylococcus
EAETG

SEQ ID NO: 1933642 - protein, 9 aa, Staphylococcus
EAETTATTI

SEQ ID NO: 1933643 - protein, 17 aa, Staphylococcus
EAEVNDAVEKSKQAQLE

SEQ ID NO: 1933644 - protein, 7 aa, Staphylococcus
EAEYKTP

SEQ ID NO: 1933645 - protein, 5 aa, Staphylococcus
EAFED

SEQ ID NO: 1933646 - protein, 5 aa, Staphylococcus
EAFEE

SEQ ID NO: 1933647 - protein, 6 aa, Staphylococcus
EAFEPG

SEQ ID NO: 1933648 - protein, 8 aa, Staphylococcus
EAFEQSGA

SEQ ID NO: 1933649 - protein, 20 aa, Staphylococcus
EAFGKNDPAEEMYPGGENER

SEQ ID NO: 1933650 - protein, 12 aa, Staphylococcus
EAFNNAKKELDD

SEQ ID NO: 1933651 - protein, 8 aa, Staphylococcus
EAFPNGEI

SEQ ID NO: 1933652 - protein, 7 aa, Staphylococcus
EAFSRKN

SEQ ID NO: 1933653 - protein, 4 aa, Staphylococcus
EAFT

SEQ ID NO: 1933654 - protein, 5 aa, Staphylococcus
EAFTE

SEQ ID NO: 1933655 - protein, 7 aa, Staphylococcus
EAFTNTD

SEQ ID NO: 1933656 - protein, 15 aa, Staphylococcus
EAGAAIDKEMTEMKD

SEQ ID NO: 1933657 - protein, 7 aa, Staphylococcus
EAGADFN

SEQ ID NO: 1933658 - protein, 6 aa, Staphylococcus
EAGADV

SEQ ID NO: 1933659 - protein, 5 aa, Staphylococcus
EAGAK

SEQ ID NO: 1933660 - protein, 4 aa, Staphylococcus
EAGD

SEQ ID NO: 1933661 - protein, 10 aa, Staphylococcus
EAGDFDSRKS

SEQ ID NO: 1933662 - protein, 5 aa, Staphylococcus
EAGEI

SEQ ID NO: 1933663 - protein, 15 aa, Staphylococcus
EAGEPLTPNRMNEEY

SEQ ID NO: 1933664 - protein, 7 aa, Staphylococcus
EAGESKT

SEQ ID NO: 1933665 - protein, 14 aa, Staphylococcus
EAGEVASALSRGQM

SEQ ID NO: 1933666 - protein, 8 aa, Staphylococcus
EAGGIGTV

SEQ ID NO: 1933667 - protein, 7 aa, Staphylococcus
EAGGKRI

SEQ ID NO: 1933668 - protein, 7 aa, Staphylococcus
EAGIPDQ

SEQ ID NO: 1933669 - protein, 5 aa, Staphylococcus
EAGKG

SEQ ID NO: 1933670 - protein, 9 aa, Staphylococcus
EAGKGYAAE

SEQ ID NO: 1933671 - protein, 10 aa, Staphylococcus
EAGKGYKAEE

SEQ ID NO: 1933672 - protein, 18 aa, Staphylococcus
EAGKLGGEKTSKEFDKDH

SEQ ID NO: 1933673 - protein, 9 aa, Staphylococcus
EAGKNYSAE

SEQ ID NO: 1933674 - protein, 19 aa, Staphylococcus
EAGLPEKVAESLQKELNKE

SEQ ID NO: 1933675 - protein, 14 aa, Staphylococcus
EAGMSKGETDKRAR

SEQ ID NO: 1933676 - protein, 7 aa, Staphylococcus
EAGQAAV

SEQ ID NO: 1933677 - protein, 12 aa, Staphylococcus
EAGQGASTSSYL

SEQ ID NO: 1933678 - protein, 7 aa, Staphylococcus
EAGQSAV

SEQ ID NO: 1933679 - protein, 7 aa, Staphylococcus
EAGQTAV

SEQ ID NO: 1933680 - protein, 7 aa, Staphylococcus
EAGQYTL

SEQ ID NO: 1933681 - protein, 6 aa, Staphylococcus
EAGRPD

SEQ ID NO: 1933682 - protein, 8 aa, Staphylococcus
EAGRSNKP

SEQ ID NO: 1933683 - protein, 8 aa, Staphylococcus
EAGSDLEN

SEQ ID NO: 1933684 - protein, 6 aa, Staphylococcus
EAGSTF

SEQ ID NO: 1933685 - protein, 15 aa, Staphylococcus
EAGTENLPGGYTSPA

SEQ ID NO: 1933686 - protein, 16 aa, Staphylococcus
EAGTNGLPGGYTSTER

SEQ ID NO: 1933687 - protein, 9 aa, Staphylococcus
EAGTNGPLE

SEQ ID NO: 1933688 - protein, 16 aa, Staphylococcus
EAGTVKGKKSGKFATS

SEQ ID NO: 1933689 - protein, 5 aa, Staphylococcus
EAGVD

SEQ ID NO: 1933690 - protein, 8 aa, Staphylococcus
EAGVDDEE

SEQ ID NO: 1933691 - protein, 13 aa, Staphylococcus
EAGVNKKEAVSNA

SEQ ID NO: 1933692 - protein, 8 aa, Staphylococcus
EAGVSEED

SEQ ID NO: 1933693 - protein, 8 aa, Staphylococcus
EAGVSEEE

SEQ ID NO: 1933694 - protein, 6 aa, Staphylococcus
EAGVSV

SEQ ID NO: 1933695 - protein, 17 aa, Staphylococcus
EAGYGADQFSQQAADKI

SEQ ID NO: 1933696 - protein, 22 aa, Staphylococcus
EAGYHKTNDVNGYRQEGFGPFD

SEQ ID NO: 1933697 - protein, 6 aa, Staphylococcus
EAGYKA

SEQ ID NO: 1933698 - protein, 14 aa, Staphylococcus
EAGYNKTPDVNGFR

SEQ ID NO: 1933699 - protein, 6 aa, Staphylococcus
EAGYPA

SEQ ID NO: 1933700 - protein, 6 aa, Staphylococcus
EAGYPQ

SEQ ID NO: 1933701 - protein, 12 aa, Staphylococcus
EAHAAEKPNPEV

SEQ ID NO: 1933702 - protein, 5 aa, Staphylococcus
EAHED

SEQ ID NO: 1933703 - protein, 9 aa, Staphylococcus
EAHGNGTYN

SEQ ID NO: 1933704 - protein, 10 aa, Staphylococcus
EAHKKLNQNV

SEQ ID NO: 1933705 - protein, 6 aa, Staphylococcus
EAHKRL

SEQ ID NO: 1933706 - protein, 6 aa, Staphylococcus
EAHQKP

SEQ ID NO: 1933707 - protein, 6 aa, Staphylococcus
EAHQNG

SEQ ID NO: 1933708 - protein, 10 aa, Staphylococcus
EAHREDGATW

SEQ ID NO: 1933709 - protein, 10 aa, Staphylococcus
EAIADKDVRE

SEQ ID NO: 1933710 - protein, 6 aa, Staphylococcus
EAIAQK

SEQ ID NO: 1933711 - protein, 10 aa, Staphylococcus
EAIDDEIKQD

SEQ ID NO: 1933712 - protein, 15 aa, Staphylococcus
EAIDETGINPVAQPE

SEQ ID NO: 1933713 - protein, 7 aa, Staphylococcus
EAIDNTQ

SEQ ID NO: 1933714 - protein, 13 aa, Staphylococcus
EAIDQSKATNMDE

SEQ ID NO: 1933715 - protein, 13 aa, Staphylococcus
EAIDQSTATSMDE

SEQ ID NO: 1933716 - protein, 5 aa, Staphylococcus
EAIDR

SEQ ID NO: 1933717 - protein, 6 aa, Staphylococcus
EAIEAA

SEQ ID NO: 1933718 - protein, 16 aa, Staphylococcus
EAIEETGIKPVDQPEI

SEQ ID NO: 1933719 - protein, 16 aa, Staphylococcus
EAIEETGIKPVDQPEV

SEQ ID NO: 1933720 - protein, 11 aa, Staphylococcus
EAIEGAEDNYE

SEQ ID NO: 1933721 - protein, 8 aa, Staphylococcus
EAIENEDI

SEQ ID NO: 1933722 - protein, 6 aa, Staphylococcus
EAIEQS

SEQ ID NO: 1933723 - protein, 6 aa, Staphylococcus
EAIEST

SEQ ID NO: 1933724 - protein, 11 aa, Staphylococcus
EAINPRTQTKI

SEQ ID NO: 1933725 - protein, 9 aa, Staphylococcus
EAINTVPSH

SEQ ID NO: 1933726 - protein, 6 aa, Staphylococcus
EAIQDN

SEQ ID NO: 1933727 - protein, 7 aa, Staphylococcus
EAIQSNG

SEQ ID NO: 1933728 - protein, 5 aa, Staphylococcus
EAIRN

SEQ ID NO: 1933729 - protein, 9 aa, Staphylococcus
EAIRNADEQ

SEQ ID NO: 1933730 - protein, 24 aa, Staphylococcus
EAKAANEEQPFANPRNAAAGSLRQ

SEQ ID NO: 1933731 - protein, 7 aa, Staphylococcus
EAKAAQS

SEQ ID NO: 1933732 - protein, 22 aa, Staphylococcus
EAKAIRQKDPKQYVKEAQTSMR

SEQ ID NO: 1933733 - protein, 12 aa, Staphylococcus
EAKDAGDDSNEA

SEQ ID NO: 1933734 - protein, 6 aa, Staphylococcus
EAKDDG

SEQ ID NO: 1933735 - protein, 7 aa, Staphylococcus
EAKDNNF

SEQ ID NO: 1933736 - protein, 5 aa, Staphylococcus
EAKDY

SEQ ID NO: 1933737 - protein, 12 aa, Staphylococcus
EAKEAGDASNEA

SEQ ID NO: 1933738 - protein, 7 aa, Staphylococcus
EAKEDVE

SEQ ID NO: 1933739 - protein, 12 aa, Staphylococcus
EAKEEGNDSNEA

SEQ ID NO: 1933740 - protein, 15 aa, Staphylococcus
EAKEGVKIQNESKTM

SEQ ID NO: 1933741 - protein, 12 aa, Staphylococcus
EAKENGDDSNEA

SEQ ID NO: 1933742 - protein, 7 aa, Staphylococcus
EAKEPMS

SEQ ID NO: 1933743 - protein, 6 aa, Staphylococcus
EAKEYG

SEQ ID NO: 1933744 - protein, 8 aa, Staphylococcus
EAKGNPIY

SEQ ID NO: 1933745 - protein, 14 aa, Staphylococcus
EAKHPKTRYAGGMG

SEQ ID NO: 1933746 - protein, 7 aa, Staphylococcus
EAKKAEL

SEQ ID NO: 1933747 - protein, 10 aa, Staphylococcus
EAKKAERIGE

SEQ ID NO: 1933748 - protein, 10 aa, Staphylococcus
EAKKAGNIGE

SEQ ID NO: 1933749 - protein, 11 aa, Staphylococcus
EAKKAQKLGEV

SEQ ID NO: 1933750 - protein, 10 aa, Staphylococcus
EAKKARQLGE

SEQ ID NO: 1933751 - protein, 13 aa, Staphylococcus
EAKKGLSKINPNT

SEQ ID NO: 1933752 - protein, 15 aa, Staphylococcus
EAKKPKVARIPKTNK

SEQ ID NO: 1933753 - protein, 8 aa, Staphylococcus
EAKKRKTE

SEQ ID NO: 1933754 - protein, 8 aa, Staphylococcus
EAKKRNSE

SEQ ID NO: 1933755 - protein, 5 aa, Staphylococcus
EAKLN

SEQ ID NO: 1933756 - protein, 6 aa, Staphylococcus
EAKMGT

SEQ ID NO: 1933757 - protein, 10 aa, Staphylococcus
EAKNADFKKA

SEQ ID NO: 1933758 - protein, 14 aa, Staphylococcus
EAKNLEKNSKIPTI

SEQ ID NO: 1933759 - protein, 6 aa, Staphylococcus
EAKNQK

SEQ ID NO: 1933760 - protein, 18 aa, Staphylococcus
EAKPAANEGGSQSGDSTI

SEQ ID NO: 1933761 - protein, 18 aa, Staphylococcus
EAKQITGQNITVDGGLTM

SEQ ID NO: 1933762 - protein, 8 aa, Staphylococcus
EAKQKAGY

SEQ ID NO: 1933763 - protein, 7 aa, Staphylococcus
EAKQYSL

SEQ ID NO: 1933764 - protein, 9 aa, Staphylococcus
EAKRAVEDG

SEQ ID NO: 1933765 - protein, 10 aa, Staphylococcus
EAKRGTETYE

SEQ ID NO: 1933766 - protein, 5 aa, Staphylococcus
EAKSM

SEQ ID NO: 1933767 - protein, 8 aa, Staphylococcus
EAKTKNPE

SEQ ID NO: 1933768 - protein, 10 aa, Staphylococcus
EAKTNQDTLF

SEQ ID NO: 1933769 - protein, 8 aa, Staphylococcus
EAKTTTRV

SEQ ID NO: 1933770 - protein, 9 aa, Staphylococcus
EAKTTTRVN

SEQ ID NO: 1933771 - protein, 12 aa, Staphylococcus
EAKYENEGYGKF

SEQ ID NO: 1933772 - protein, 10 aa, Staphylococcus
EALAPKDQTG

SEQ ID NO: 1933773 - protein, 4 aa, Staphylococcus
EALE

SEQ ID NO: 1933774 - protein, 6 aa, Staphylococcus
EALEAA

SEQ ID NO: 1933775 - protein, 7 aa, Staphylococcus
EALEDDD

SEQ ID NO: 1933776 - protein, 13 aa, Staphylococcus
EALENAEKKDELL

SEQ ID NO: 1933777 - protein, 5 aa, Staphylococcus
EALEQ

SEQ ID NO: 1933778 - protein, 4 aa, Staphylococcus
EALG

SEQ ID NO: 1933779 - protein, 13 aa, Staphylococcus
EALGYDTKTTNKG

SEQ ID NO: 1933780 - protein, 9 aa, Staphylococcus
EALKKNNSQ

SEQ ID NO: 1933781 - protein, 9 aa, Staphylococcus
EALKSNPLL

SEQ ID NO: 1933782 - protein, 15 aa, Staphylococcus
EALKSNPLLNSSWDG

SEQ ID NO: 1933783 - protein, 6 aa, Staphylococcus
EALNEE

SEQ ID NO: 1933784 - protein, 7 aa, Staphylococcus
EALNGSL

SEQ ID NO: 1933785 - protein, 6 aa, Staphylococcus
EALNKN

SEQ ID NO: 1933786 - protein, 6 aa, Staphylococcus
EALPEM

SEQ ID NO: 1933787 - protein, 6 aa, Staphylococcus
EALQPF

SEQ ID NO: 1933788 - protein, 5 aa, Staphylococcus
EALQT

SEQ ID NO: 1933789 - protein, 19 aa, Staphylococcus
EALRQESPKAFTTSGLTKE

SEQ ID NO: 1933790 - protein, 6 aa, Staphylococcus
EALSQE

SEQ ID NO: 1933791 - protein, 6 aa, Staphylococcus
EALSQN

SEQ ID NO: 1933792 - protein, 5 aa, Staphylococcus
EALTD

SEQ ID NO: 1933793 - protein, 9 aa, Staphylococcus
EALTEDDQT

SEQ ID NO: 1933794 - protein, 8 aa, Staphylococcus
EALTEPSL

SEQ ID NO: 1933795 - protein, 5 aa, Staphylococcus
EALTN

SEQ ID NO: 1933796 - protein, 9 aa, Staphylococcus
EALTSNNDD

SEQ ID NO: 1933797 - protein, 7 aa, Staphylococcus
EAMDQAE

SEQ ID NO: 1933798 - protein, 8 aa, Staphylococcus
EAMDRNEA

SEQ ID NO: 1933799 - protein, 4 aa, Staphylococcus
EAMG

SEQ ID NO: 1933800 - protein, 7 aa, Staphylococcus
EAMGQQG

SEQ ID NO: 1933801 - protein, 20 aa, Staphylococcus
EAMKKASNESFGYNEDEIVS

SEQ ID NO: 1933802 - protein, 7 aa, Staphylococcus
EAMKPDD

SEQ ID NO: 1933803 - protein, 15 aa, Staphylococcus
EAMKQASNESFGYNE

SEQ ID NO: 1933804 - protein, 11 aa, Staphylococcus
EANAAEKPNPE

SEQ ID NO: 1933805 - protein, 8 aa, Staphylococcus
EANATRTY

SEQ ID NO: 1933806 - protein, 12 aa, Staphylococcus
EANAVEKPNPEV

SEQ ID NO: 1933807 - protein, 4 aa, Staphylococcus
EAND

SEQ ID NO: 1933808 - protein, 5 aa, Staphylococcus
EANDF

SEQ ID NO: 1933809 - protein, 9 aa, Staphylococcus
EANDGNEAY

SEQ ID NO: 1933810 - protein, 8 aa, Staphylococcus
EANDGQTY

SEQ ID NO: 1933811 - protein, 9 aa, Staphylococcus
EANDNVESM

SEQ ID NO: 1933812 - protein, 43 aa, Staphylococcus
EANDSLKTDDELNSDIASTSHKTSHDAHNDVSHGNAHHQQRRR

SEQ ID NO: 1933813 - protein, 5 aa, Staphylococcus
EANED

SEQ ID NO: 1933814 - protein, 9 aa, Staphylococcus
EANEKANQN

SEQ ID NO: 1933815 - protein, 10 aa, Staphylococcus
EANERSGSRI

SEQ ID NO: 1933816 - protein, 26 aa, Staphylococcus
EANGGQILEDGKPLQFKNTKDAEQHG

SEQ ID NO: 1933817 - protein, 10 aa, Staphylococcus
EANGGSKLKD

SEQ ID NO: 1933818 - protein, 10 aa, Staphylococcus
EANGGSRLKD

SEQ ID NO: 1933819 - protein, 18 aa, Staphylococcus
EANGITGQNFTVDGGLTM

SEQ ID NO: 1933820 - protein, 20 aa, Staphylococcus
EANGVNPDNAEDWVGEDKGK

SEQ ID NO: 1933821 - protein, 20 aa, Staphylococcus
EANGVNPDNAEEWVGEDEGK

SEQ ID NO: 1933822 - protein, 20 aa, Staphylococcus
EANGVNPDNAEEWVGEDKGK

SEQ ID NO: 1933823 - protein, 19 aa, Staphylococcus
EANGVNPDNAKEWVGEEEG

SEQ ID NO: 1933824 - protein, 20 aa, Staphylococcus
EANGVNPDNAKEWVGEKEGK

SEQ ID NO: 1933825 - protein, 27 aa, Staphylococcus
EANIEDTKPNQPNHTDHLQKQSDEEAL

SEQ ID NO: 1933826 - protein, 18 aa, Staphylococcus
EANIQNAPGVKKANSELH

SEQ ID NO: 1933827 - protein, 18 aa, Staphylococcus
EANIQNAPGVRKANSELH

SEQ ID NO: 1933828 - protein, 6 aa, Staphylococcus
EANITT

SEQ ID NO: 1933829 - protein, 8 aa, Staphylococcus
EANKPNQK

SEQ ID NO: 1933830 - protein, 14 aa, Staphylococcus
EANNPYGDGNASNR

SEQ ID NO: 1933831 - protein, 18 aa, Staphylococcus
EANNQYQKALEKNKGNQS

SEQ ID NO: 1933832 - protein, 8 aa, Staphylococcus
EANPDELT

SEQ ID NO: 1933833 - protein, 8 aa, Staphylococcus
EANPETGE

SEQ ID NO: 1933834 - protein, 9 aa, Staphylococcus
EANPKEVEN

SEQ ID NO: 1933835 - protein, 8 aa, Staphylococcus
EANQRGAH

SEQ ID NO: 1933836 - protein, 8 aa, Staphylococcus
EANQSHSN

SEQ ID NO: 1933837 - protein, 7 aa, Staphylococcus
EANQSTT

SEQ ID NO: 1933838 - protein, 4 aa, Staphylococcus
EANR

SEQ ID NO: 1933839 - protein, 10 aa, Staphylococcus
EANREQHPIE

SEQ ID NO: 1933840 - protein, 7 aa, Staphylococcus
EANRVGD

SEQ ID NO: 1933841 - protein, 7 aa, Staphylococcus
EANSKDL

SEQ ID NO: 1933842 - protein, 17 aa, Staphylococcus
EANSNHLADTARKDGVV

SEQ ID NO: 1933843 - protein, 10 aa, Staphylococcus
EANSPVNQTD

SEQ ID NO: 1933844 - protein, 4 aa, Staphylococcus
EANT

SEQ ID NO: 1933845 - protein, 6 aa, Staphylococcus
EANTAP

SEQ ID NO: 1933846 - protein, 6 aa, Staphylococcus
EANTEI

SEQ ID NO: 1933847 - protein, 8 aa, Staphylococcus
EANTLTYG

SEQ ID NO: 1933848 - protein, 4 aa, Staphylococcus
EAPA

SEQ ID NO: 1933849 - protein, 6 aa, Staphylococcus
EAPAPQ

SEQ ID NO: 1933850 - protein, 5 aa, Staphylococcus
EAPDH

SEQ ID NO: 1933851 - protein, 4 aa, Staphylococcus
EAPF

SEQ ID NO: 1933852 - protein, 4 aa, Staphylococcus
EAPG

SEQ ID NO: 1933853 - protein, 6 aa, Staphylococcus
EAPHQG

SEQ ID NO: 1933854 - protein, 4 aa, Staphylococcus
EAPI

SEQ ID NO: 1933855 - protein, 14 aa, Staphylococcus
EAPISKQEATRGYG

SEQ ID NO: 1933856 - protein, 4 aa, Staphylococcus
EAPL

SEQ ID NO: 1933857 - protein, 18 aa, Staphylococcus
EAPPSQNKLNPYEISGQE

SEQ ID NO: 1933858 - protein, 8 aa, Staphylococcus
EAPPTQHK

SEQ ID NO: 1933859 - protein, 9 aa, Staphylococcus
EAPPTQHKL

SEQ ID NO: 1933860 - protein, 9 aa, Staphylococcus
EAPPTQNKL

SEQ ID NO: 1933861 - protein, 17 aa, Staphylococcus
EAPPTQNKLNPYEVSGQ

SEQ ID NO: 1933862 - protein, 17 aa, Staphylococcus
EAPPTQNKRNPYDISSD

SEQ ID NO: 1933863 - protein, 18 aa, Staphylococcus
EAPPVKDGRITKKTKMDA

SEQ ID NO: 1933864 - protein, 4 aa, Staphylococcus
EAPQ

SEQ ID NO: 1933865 - protein, 5 aa, Staphylococcus
EAPQS

SEQ ID NO: 1933866 - protein, 8 aa, Staphylococcus
EAPRENER

SEQ ID NO: 1933867 - protein, 13 aa, Staphylococcus
EAPSHMSGTQDNN

SEQ ID NO: 1933868 - protein, 7 aa, Staphylococcus
EAPTSGE

SEQ ID NO: 1933869 - protein, 9 aa, Staphylococcus
EAPTTPGKI

SEQ ID NO: 1933870 - protein, 9 aa, Staphylococcus
EAPTTPGTI

SEQ ID NO: 1933871 - protein, 10 aa, Staphylococcus
EAPTTPGTID

SEQ ID NO: 1933872 - protein, 9 aa, Staphylococcus
EAPTTSGKI

SEQ ID NO: 1933873 - protein, 6 aa, Staphylococcus
EAQAGD

SEQ ID NO: 1933874 - protein, 9 aa, Staphylococcus
EAQATHDEL

SEQ ID NO: 1933875 - protein, 10 aa, Staphylococcus
EAQDGSERKQ

SEQ ID NO: 1933876 - protein, 14 aa, Staphylococcus
EAQDHAKGSARSIE

SEQ ID NO: 1933877 - protein, 9 aa, Staphylococcus
EAQDKNNPL

SEQ ID NO: 1933878 - protein, 7 aa, Staphylococcus
EAQDNRK

SEQ ID NO: 1933879 - protein, 10 aa, Staphylococcus
EAQEGNQKKT

SEQ ID NO: 1933880 - protein, 8 aa, Staphylococcus
EAQETHDA

SEQ ID NO: 1933881 - protein, 5 aa, Staphylococcus
EAQGQ

SEQ ID NO: 1933882 - protein, 7 aa, Staphylococcus
EAQGSGH

SEQ ID NO: 1933883 - protein, 35 aa, Staphylococcus
EAQGYDYDDSKATETSVQTSKNVDVTNIGEGLNPM

SEQ ID NO: 1933884 - protein, 10 aa, Staphylococcus
EAQHKGYGTS

SEQ ID NO: 1933885 - protein, 6 aa, Staphylococcus
EAQIDD

SEQ ID NO: 1933886 - protein, 6 aa, Staphylococcus
EAQIDS

SEQ ID NO: 1933887 - protein, 6 aa, Staphylococcus
EAQIES

SEQ ID NO: 1933888 - protein, 10 aa, Staphylococcus
EAQKAQALGE

SEQ ID NO: 1933889 - protein, 8 aa, Staphylococcus
EAQKDGFK

SEQ ID NO: 1933890 - protein, 15 aa, Staphylococcus
EAQLKEDEEEQLESD

SEQ ID NO: 1933891 - protein, 6 aa, Staphylococcus
EAQMPT

SEQ ID NO: 1933892 - protein, 7 aa, Staphylococcus
EAQNEAD

SEQ ID NO: 1933893 - protein, 20 aa, Staphylococcus
EAQNHSMTELPNHEARYARA

SEQ ID NO: 1933894 - protein, 6 aa, Staphylococcus
EAQPEG

SEQ ID NO: 1933895 - protein, 12 aa, Staphylococcus
EAQPQKRGVYSG

SEQ ID NO: 1933896 - protein, 4 aa, Staphylococcus
EAQQ

SEQ ID NO: 1933897 - protein, 9 aa, Staphylococcus
EAQQDYSLP

SEQ ID NO: 1933898 - protein, 13 aa, Staphylococcus
EAQQTHDDLEKQY

SEQ ID NO: 1933899 - protein, 4 aa, Staphylococcus
EAQR

SEQ ID NO: 1933900 - protein, 7 aa, Staphylococcus
EAQRSLK

SEQ ID NO: 1933901 - protein, 8 aa, Staphylococcus
EAQSDAND

SEQ ID NO: 1933902 - protein, 9 aa, Staphylococcus
EAQSEGHTG

SEQ ID NO: 1933903 - protein, 10 aa, Staphylococcus
EAQSRKAITQ

SEQ ID NO: 1933904 - protein, 12 aa, Staphylococcus
EAQTGNHQPAVK

SEQ ID NO: 1933905 - protein, 5 aa, Staphylococcus
EAQTS

SEQ ID NO: 1933906 - protein, 9 aa, Staphylococcus
EAQYPDTGL

SEQ ID NO: 1933907 - protein, 10 aa, Staphylococcus
EAQYPETDVP

SEQ ID NO: 1933908 - protein, 9 aa, Staphylococcus
EAQYPETNL

SEQ ID NO: 1933909 - protein, 10 aa, Staphylococcus
EAQYPNEQAL

SEQ ID NO: 1933910 - protein, 17 aa, Staphylococcus
EARAGDIKHSYSDVTPL

SEQ ID NO: 1933911 - protein, 6 aa, Staphylococcus
EARDAG

SEQ ID NO: 1933912 - protein, 12 aa, Staphylococcus
EARDAGDDSNEA

SEQ ID NO: 1933913 - protein, 15 aa, Staphylococcus
EARDGKIKVTSKGKQ

SEQ ID NO: 1933914 - protein, 5 aa, Staphylococcus
EARED

SEQ ID NO: 1933915 - protein, 6 aa, Staphylococcus
EAREEY

SEQ ID NO: 1933916 - protein, 15 aa, Staphylococcus
EAREKYNLRDPKGGQ

SEQ ID NO: 1933917 - protein, 13 aa, Staphylococcus
EARERALNGEGST

SEQ ID NO: 1933918 - protein, 14 aa, Staphylococcus
EARERAVAGEGPTV

SEQ ID NO: 1933919 - protein, 11 aa, Staphylococcus
EARFGREPRAY

SEQ ID NO: 1933920 - protein, 14 aa, Staphylococcus
EARGDKFDREKAKQ

SEQ ID NO: 1933921 - protein, 5 aa, Staphylococcus
EARGF

SEQ ID NO: 1933922 - protein, 6 aa, Staphylococcus
EARGFS

SEQ ID NO: 1933923 - protein, 7 aa, Staphylococcus
EARGVDP

SEQ ID NO: 1933924 - protein, 5 aa, Staphylococcus
EARIQ

SEQ ID NO: 1933925 - protein, 6 aa, Staphylococcus
EARIQR

SEQ ID NO: 1933926 - protein, 10 aa, Staphylococcus
EARKAEAIGE

SEQ ID NO: 1933927 - protein, 9 aa, Staphylococcus
EARKANGAK

SEQ ID NO: 1933928 - protein, 7 aa, Staphylococcus
EARKRKT

SEQ ID NO: 1933929 - protein, 9 aa, Staphylococcus
EARKTHDDL

SEQ ID NO: 1933930 - protein, 41 aa, Staphylococcus
EARKTKENKSSSDTLNDNKSKDKDSKKDTKKKDKKKKNKKK

SEQ ID NO: 1933931 - protein, 9 aa, Staphylococcus
EARNHRKLG

SEQ ID NO: 1933932 - protein, 4 aa, Staphylococcus
EARQ

SEQ ID NO: 1933933 - protein, 11 aa, Staphylococcus
EARSARAYGSA

SEQ ID NO: 1933934 - protein, 11 aa, Staphylococcus
EARSHDNQSIE

SEQ ID NO: 1933935 - protein, 10 aa, Staphylococcus
EARSHNDQSI

SEQ ID NO: 1933936 - protein, 13 aa, Staphylococcus
EARSHNDQSIEKQ

SEQ ID NO: 1933937 - protein, 9 aa, Staphylococcus
EARSHSDTM

SEQ ID NO: 1933938 - protein, 9 aa, Staphylococcus
EARSHSKQK

SEQ ID NO: 1933939 - protein, 7 aa, Staphylococcus
EARTNGY

SEQ ID NO: 1933940 - protein, 20 aa, Staphylococcus
EARTTHDDLERQYQQYKNYE

SEQ ID NO: 1933941 - protein, 9 aa, Staphylococcus
EARTTSTIK

SEQ ID NO: 1933942 - protein, 9 aa, Staphylococcus
EASDKTNPL

SEQ ID NO: 1933943 - protein, 8 aa, Staphylococcus
EASDPLKQ

SEQ ID NO: 1933944 - protein, 8 aa, Staphylococcus
EASDYFNK

SEQ ID NO: 1933945 - protein, 10 aa, Staphylococcus
EASEEDSRGH

SEQ ID NO: 1933946 - protein, 7 aa, Staphylococcus
EASEKFG

SEQ ID NO: 1933947 - protein, 5 aa, Staphylococcus
EASEM

SEQ ID NO: 1933948 - protein, 15 aa, Staphylococcus
EASENHKKRVQSSTL

SEQ ID NO: 1933949 - protein, 14 aa, Staphylococcus
EASEQSASESQANL

SEQ ID NO: 1933950 - protein, 7 aa, Staphylococcus
EASESIE

SEQ ID NO: 1933951 - protein, 8 aa, Staphylococcus
EASETIDE

SEQ ID NO: 1933952 - protein, 9 aa, Staphylococcus
EASKAVESG

SEQ ID NO: 1933953 - protein, 8 aa, Staphylococcus
EASKDIAE

SEQ ID NO: 1933954 - protein, 8 aa, Staphylococcus
EASKKNSL

SEQ ID NO: 1933955 - protein, 6 aa, Staphylococcus
EASKLE

SEQ ID NO: 1933956 - protein, 8 aa, Staphylococcus
EASLDETY

SEQ ID NO: 1933957 - protein, 19 aa, Staphylococcus
EASLEKAFKEAKSEGEKYF

SEQ ID NO: 1933958 - protein, 16 aa, Staphylococcus
EASLGQALKNSGVPRE

SEQ ID NO: 1933959 - protein, 11 aa, Staphylococcus
EASLKEDEVEQ

SEQ ID NO: 1933960 - protein, 12 aa, Staphylococcus
EASLKEGEITQL

SEQ ID NO: 1933961 - protein, 5 aa, Staphylococcus
EASNA

SEQ ID NO: 1933962 - protein, 10 aa, Staphylococcus
EASNAVTSTI

SEQ ID NO: 1933963 - protein, 10 aa, Staphylococcus
EASNEITGTI

SEQ ID NO: 1933964 - protein, 11 aa, Staphylococcus
EASNEVEGSIH

SEQ ID NO: 1933965 - protein, 9 aa, Staphylococcus
EASNGKEAY

SEQ ID NO: 1933966 - protein, 15 aa, Staphylococcus
EASNNAVAKANLTAD

SEQ ID NO: 1933967 - protein, 4 aa, Staphylococcus
EASQ

SEQ ID NO: 1933968 - protein, 7 aa, Staphylococcus
EASQNND

SEQ ID NO: 1933969 - protein, 5 aa, Staphylococcus
EASRA

SEQ ID NO: 1933970 - protein, 8 aa, Staphylococcus
EASRNGKS

SEQ ID NO: 1933971 - protein, 12 aa, Staphylococcus
EASRQPSNFRKQ

SEQ ID NO: 1933972 - protein, 16 aa, Staphylococcus
EASSENSKLTGTEQEA

SEQ ID NO: 1933973 - protein, 6 aa, Staphylococcus
EASSMN

SEQ ID NO: 1933974 - protein, 7 aa, Staphylococcus
EASSYKS

SEQ ID NO: 1933975 - protein, 9 aa, Staphylococcus
EASTHPSNF

SEQ ID NO: 1933976 - protein, 12 aa, Staphylococcus
EASTHPSNFRKQ

SEQ ID NO: 1933977 - protein, 15 aa, Staphylococcus
EASTHPSNFRKQKTF

SEQ ID NO: 1933978 - protein, 12 aa, Staphylococcus
EASTHPSNFRNQ

SEQ ID NO: 1933979 - protein, 13 aa, Staphylococcus
EASTHPSNFRNQK

SEQ ID NO: 1933980 - protein, 12 aa, Staphylococcus
EASTHPSNFRQQ

SEQ ID NO: 1933981 - protein, 13 aa, Staphylococcus
EASTKDRKESDLR

SEQ ID NO: 1933982 - protein, 13 aa, Staphylococcus
EASTKNRKEGDLR

SEQ ID NO: 1933983 - protein, 13 aa, Staphylococcus
EASTKNRKENDLR

SEQ ID NO: 1933984 - protein, 10 aa, Staphylococcus
EASTLDDEID

SEQ ID NO: 1933985 - protein, 10 aa, Staphylococcus
EASVGKDTMT

SEQ ID NO: 1933986 - protein, 7 aa, Staphylococcus
EASVNRS

SEQ ID NO: 1933987 - protein, 7 aa, Staphylococcus
EASYTGK

SEQ ID NO: 1933988 - protein, 8 aa, Staphylococcus
EATANEFG

SEQ ID NO: 1933989 - protein, 6 aa, Staphylococcus
EATDFN

SEQ ID NO: 1933990 - protein, 11 aa, Staphylococcus
EATEKEDKETL

SEQ ID NO: 1933991 - protein, 11 aa, Staphylococcus
EATENKKAEDI

SEQ ID NO: 1933992 - protein, 11 aa, Staphylococcus
EATESDHGGYK

SEQ ID NO: 1933993 - protein, 13 aa, Staphylococcus
EATEYENMSIYDF

SEQ ID NO: 1933994 - protein, 5 aa, Staphylococcus
EATGE

SEQ ID NO: 1933995 - protein, 8 aa, Staphylococcus
EATGIPKE

SEQ ID NO: 1933996 - protein, 7 aa, Staphylococcus
EATGIPQ

SEQ ID NO: 1933997 - protein, 16 aa, Staphylococcus
EATGMKGRRETNTMPQ

SEQ ID NO: 1933998 - protein, 6 aa, Staphylococcus
EATGPH

SEQ ID NO: 1933999 - protein, 16 aa, Staphylococcus
EATGYDDSHSKYTPAW

SEQ ID NO: 1934000 - protein, 6 aa, Staphylococcus
EATHGD

SEQ ID NO: 1934001 - protein, 7 aa, Staphylococcus
EATHPTL

SEQ ID NO: 1934002 - protein, 9 aa, Staphylococcus
EATKDAKYP

SEQ ID NO: 1934003 - protein, 7 aa, Staphylococcus
EATKDAV

SEQ ID NO: 1934004 - protein, 15 aa, Staphylococcus
EATKIATIQQRNHFK

SEQ ID NO: 1934005 - protein, 9 aa, Staphylococcus
EATKNAAHP

SEQ ID NO: 1934006 - protein, 13 aa, Staphylococcus
EATKRKNIDIKGS

SEQ ID NO: 1934007 - protein, 8 aa, Staphylococcus
EATPEAKN

SEQ ID NO: 1934008 - protein, 18 aa, Staphylococcus
EATPEPSELEVETNDSDI

SEQ ID NO: 1934009 - protein, 8 aa, Staphylococcus
EATPIQKE

SEQ ID NO: 1934010 - protein, 6 aa, Staphylococcus
EATPLP

SEQ ID NO: 1934011 - protein, 9 aa, Staphylococcus
EATPYTEHS

SEQ ID NO: 1934012 - protein, 4 aa, Staphylococcus
EATQ

SEQ ID NO: 1934013 - protein, 9 aa, Staphylococcus
EATQEQKDK

SEQ ID NO: 1934014 - protein, 12 aa, Staphylococcus
EATRGNEQLAVL

SEQ ID NO: 1934015 - protein, 5 aa, Staphylococcus
EATRI

SEQ ID NO: 1934016 - protein, 9 aa, Staphylococcus
EATRKAKEL

SEQ ID NO: 1934017 - protein, 10 aa, Staphylococcus
EATRKATEEA

SEQ ID NO: 1934018 - protein, 5 aa, Staphylococcus
EATRL

SEQ ID NO: 1934019 - protein, 7 aa, Staphylococcus
EATRRAI

SEQ ID NO: 1934020 - protein, 16 aa, Staphylococcus
EATSYDDAESKYTPAW

SEQ ID NO: 1934021 - protein, 7 aa, Staphylococcus
EATTDTQ

SEQ ID NO: 1934022 - protein, 7 aa, Staphylococcus
EATTEEI

SEQ ID NO: 1934023 - protein, 10 aa, Staphylococcus
EATTERDEAE

SEQ ID NO: 1934024 - protein, 18 aa, Staphylococcus
EATTQNKPTHIQQKNNTR

SEQ ID NO: 1934025 - protein, 11 aa, Staphylococcus
EATTQSGALDE

SEQ ID NO: 1934026 - protein, 7 aa, Staphylococcus
EATVNNA

SEQ ID NO: 1934027 - protein, 6 aa, Staphylococcus
EATVRS

SEQ ID NO: 1934028 - protein, 7 aa, Staphylococcus
EATVTKD

SEQ ID NO: 1934029 - protein, 10 aa, Staphylococcus
EATVYENTQS

SEQ ID NO: 1934030 - protein, 12 aa, Staphylococcus
EATYHDADATAF

SEQ ID NO: 1934031 - protein, 9 aa, Staphylococcus
EAVAKANDK

SEQ ID NO: 1934032 - protein, 8 aa, Staphylococcus
EAVDPDDV

SEQ ID NO: 1934033 - protein, 5 aa, Staphylococcus
EAVEA

SEQ ID NO: 1934034 - protein, 9 aa, Staphylococcus
EAVEEGKIR

SEQ ID NO: 1934035 - protein, 6 aa, Staphylococcus
EAVGDD

SEQ ID NO: 1934036 - protein, 7 aa, Staphylococcus
EAVGDKA

SEQ ID NO: 1934037 - protein, 7 aa, Staphylococcus
EAVGEAT

SEQ ID NO: 1934038 - protein, 6 aa, Staphylococcus
EAVGQN

SEQ ID NO: 1934039 - protein, 6 aa, Staphylococcus
EAVHEQ

SEQ ID NO: 1934040 - protein, 6 aa, Staphylococcus
EAVKDG

SEQ ID NO: 1934041 - protein, 10 aa, Staphylococcus
EAVKDSQLDI

SEQ ID NO: 1934042 - protein, 12 aa, Staphylococcus
EAVKNKKVDAET

SEQ ID NO: 1934043 - protein, 4 aa, Staphylococcus
EAVM

SEQ ID NO: 1934044 - protein, 6 aa, Staphylococcus
EAVNDD

SEQ ID NO: 1934045 - protein, 10 aa, Staphylococcus
EAVNDKRTDH

SEQ ID NO: 1934046 - protein, 9 aa, Staphylococcus
EAVNDNKSQ

SEQ ID NO: 1934047 - protein, 6 aa, Staphylococcus
EAVPPV

SEQ ID NO: 1934048 - protein, 6 aa, Staphylococcus
EAVQDA

SEQ ID NO: 1934049 - protein, 11 aa, Staphylococcus
EAVQEAGKISE

SEQ ID NO: 1934050 - protein, 25 aa, Staphylococcus
EAVQSENKKLQALDADPQKDVEQRR

SEQ ID NO: 1934051 - protein, 14 aa, Staphylococcus
EAVREGNTGDVQLS

SEQ ID NO: 1934052 - protein, 4 aa, Staphylococcus
EAVT

SEQ ID NO: 1934053 - protein, 8 aa, Staphylococcus
EAVTEGVP

SEQ ID NO: 1934054 - protein, 8 aa, Staphylococcus
EAVTESVP

SEQ ID NO: 1934055 - protein, 5 aa, Staphylococcus
EAVTN

SEQ ID NO: 1934056 - protein, 5 aa, Staphylococcus
EAVTQ

SEQ ID NO: 1934057 - protein, 9 aa, Staphylococcus
EAYDNDTEL

SEQ ID NO: 1934058 - protein, 20 aa, Staphylococcus
EAYDTVQPKAMKSWETKTPF

SEQ ID NO: 1934059 - protein, 4 aa, Staphylococcus
EAYE

SEQ ID NO: 1934060 - protein, 5 aa, Staphylococcus
EAYEE

SEQ ID NO: 1934061 - protein, 13 aa, Staphylococcus
EAYEESGAVINES

SEQ ID NO: 1934062 - protein, 11 aa, Staphylococcus
EAYGNYSFGND

SEQ ID NO: 1934063 - protein, 9 aa, Staphylococcus
EAYKAYTET

SEQ ID NO: 1934064 - protein, 12 aa, Staphylococcus
EAYKKEKDRQDI

SEQ ID NO: 1934065 - protein, 6 aa, Staphylococcus
EAYKSN

SEQ ID NO: 1934066 - protein, 5 aa, Staphylococcus
EAYNK

SEQ ID NO: 1934067 - protein, 9 aa, Staphylococcus
EAYPQKNMK

SEQ ID NO: 1934068 - protein, 10 aa, Staphylococcus
EAYPQPNTLT

SEQ ID NO: 1934069 - protein, 14 aa, Staphylococcus
EAYPSIKARGGGYQ

SEQ ID NO: 1934070 - protein, 14 aa, Staphylococcus
EAYPSIKERGGGYQ

SEQ ID NO: 1934071 - protein, 8 aa, Staphylococcus
EAYQPNGT

SEQ ID NO: 1934072 - protein, 4 aa, Staphylococcus
EAYR

SEQ ID NO: 1934073 - protein, 10 aa, Staphylococcus
EAYSQQYPQL

SEQ ID NO: 1934074 - protein, 5 aa, Staphylococcus
EAYTI

SEQ ID NO: 1934075 - protein, 8 aa, Staphylococcus
EAYTPEGN

SEQ ID NO: 1934076 - protein, 20 aa, Staphylococcus
ECEKRDPKGLYAKARSGEIK

SEQ ID NO: 1934077 - protein, 20 aa, Staphylococcus
ECEKRDPKGLYEKARSGEIK

SEQ ID NO: 1934078 - protein, 12 aa, Staphylococcus
ECENCKNDEEQY

SEQ ID NO: 1934079 - protein, 10 aa, Staphylococcus
ECGNDNPETV

SEQ ID NO: 1934080 - protein, 18 aa, Staphylococcus
EDAAEKFKNSDNEQVDKV

SEQ ID NO: 1934081 - protein, 7 aa, Staphylococcus
EDAALQG

SEQ ID NO: 1934082 - protein, 6 aa, Staphylococcus
EDAAQR

SEQ ID NO: 1934083 - protein, 10 aa, Staphylococcus
EDADEHGIND

SEQ ID NO: 1934084 - protein, 7 aa, Staphylococcus
EDADGKN

SEQ ID NO: 1934085 - protein, 6 aa, Staphylococcus
EDADGL

SEQ ID NO: 1934086 - protein, 13 aa, Staphylococcus
EDADTPLHLMGVE

SEQ ID NO: 1934087 - protein, 13 aa, Staphylococcus
EDADVKTSQPPIG

SEQ ID NO: 1934088 - protein, 8 aa, Staphylococcus
EDAEAHDI

SEQ ID NO: 1934089 - protein, 10 aa, Staphylococcus
EDAEAHGISD

SEQ ID NO: 1934090 - protein, 6 aa, Staphylococcus
EDAEEA

SEQ ID NO: 1934091 - protein, 9 aa, Staphylococcus
EDAEEHDIK

SEQ ID NO: 1934092 - protein, 29 aa, Staphylococcus
EDAEITIGTKASSREEFEQQIKEGKFQEN

SEQ ID NO: 1934093 - protein, 8 aa, Staphylococcus
EDAELEPL

SEQ ID NO: 1934094 - protein, 5 aa, Staphylococcus
EDAEQ

SEQ ID NO: 1934095 - protein, 10 aa, Staphylococcus
EDAEQHGIND

SEQ ID NO: 1934096 - protein, 8 aa, Staphylococcus
EDAETIDA

SEQ ID NO: 1934097 - protein, 8 aa, Staphylococcus
EDAFGEKI

SEQ ID NO: 1934098 - protein, 19 aa, Staphylococcus
EDAGAGKTDEPVPDEHYGE

SEQ ID NO: 1934099 - protein, 21 aa, Staphylococcus
EDAGGKAIKAYADVSKEADVE

SEQ ID NO: 1934100 - protein, 12 aa, Staphylococcus
EDAGKLSHKDGY

SEQ ID NO: 1934101 - protein, 7 aa, Staphylococcus
EDAGKLY

SEQ ID NO: 1934102 - protein, 5 aa, Staphylococcus
EDAGQ

SEQ ID NO: 1934103 - protein, 5 aa, Staphylococcus
EDAGV

SEQ ID NO: 1934104 - protein, 8 aa, Staphylococcus
EDAHDIDE

SEQ ID NO: 1934105 - protein, 10 aa, Staphylococcus
EDAIKNGATE

SEQ ID NO: 1934106 - protein, 8 aa, Staphylococcus
EDAKADIK

SEQ ID NO: 1934107 - protein, 8 aa, Staphylococcus
EDAKANSL

SEQ ID NO: 1934108 - protein, 11 aa, Staphylococcus
EDAKAQADAGK

SEQ ID NO: 1934109 - protein, 20 aa, Staphylococcus
EDAKDKANQRVKAATKEADE

SEQ ID NO: 1934110 - protein, 10 aa, Staphylococcus
EDAKEHNIQD

SEQ ID NO: 1934111 - protein, 11 aa, Staphylococcus
EDAKEQAEKGH

SEQ ID NO: 1934112 - protein, 11 aa, Staphylococcus
EDAKQNAELNS

SEQ ID NO: 1934113 - protein, 6 aa, Staphylococcus
EDAKRY

SEQ ID NO: 1934114 - protein, 7 aa, Staphylococcus
EDALKGK

SEQ ID NO: 1934115 - protein, 8 aa, Staphylococcus
EDANDDIS

SEQ ID NO: 1934116 - protein, 10 aa, Staphylococcus
EDANGTKESV

SEQ ID NO: 1934117 - protein, 8 aa, Staphylococcus
EDANNRRM

SEQ ID NO: 1934118 - protein, 18 aa, Staphylococcus
EDAPAKLSDIAKAFASQN

SEQ ID NO: 1934119 - protein, 8 aa, Staphylococcus
EDAPHTSK

SEQ ID NO: 1934120 - protein, 6 aa, Staphylococcus
EDAQCG

SEQ ID NO: 1934121 - protein, 16 aa, Staphylococcus
EDAQLKEKPAEHEGAA

SEQ ID NO: 1934122 - protein, 4 aa, Staphylococcus
EDAR

SEQ ID NO: 1934123 - protein, 10 aa, Staphylococcus
EDARNVDNER

SEQ ID NO: 1934124 - protein, 9 aa, Staphylococcus
EDARPYAEA

SEQ ID NO: 1934125 - protein, 6 aa, Staphylococcus
EDASGL

SEQ ID NO: 1934126 - protein, 16 aa, Staphylococcus
EDASIKAAVEEAHKHD

SEQ ID NO: 1934127 - protein, 17 aa, Staphylococcus
EDASIKGAVEEAHKHGK

SEQ ID NO: 1934128 - protein, 18 aa, Staphylococcus
EDASIKGAVEEAHKNGKE

SEQ ID NO: 1934129 - protein, 18 aa, Staphylococcus
EDASIKSAIEEAHNNGKE

SEQ ID NO: 1934130 - protein, 5 aa, Staphylococcus
EDASL

SEQ ID NO: 1934131 - protein, 10 aa, Staphylococcus
EDASNTDNHY

SEQ ID NO: 1934132 - protein, 14 aa, Staphylococcus
EDASNTIKTRIFNL

SEQ ID NO: 1934133 - protein, 17 aa, Staphylococcus
EDASTKDVLEAKTKGLI

SEQ ID NO: 1934134 - protein, 6 aa, Staphylococcus
EDASYI

SEQ ID NO: 1934135 - protein, 8 aa, Staphylococcus
EDATEEDI

SEQ ID NO: 1934136 - protein, 10 aa, Staphylococcus
EDATRNTEKL

SEQ ID NO: 1934137 - protein, 6 aa, Staphylococcus
EDATWG

SEQ ID NO: 1934138 - protein, 9 aa, Staphylococcus
EDAVDPDDV

SEQ ID NO: 1934139 - protein, 8 aa, Staphylococcus
EDDAEDIN

SEQ ID NO: 1934140 - protein, 9 aa, Staphylococcus
EDDAKPDIR

SEQ ID NO: 1934141 - protein, 10 aa, Staphylococcus
EDDALTQDKL

SEQ ID NO: 1934142 - protein, 10 aa, Staphylococcus
EDDAPGNAIH

SEQ ID NO: 1934143 - protein, 18 aa, Staphylococcus
EDDDHDEHGHHHEATSYD

SEQ ID NO: 1934144 - protein, 19 aa, Staphylococcus
EDDDKTVNEKRADLLRKHI

SEQ ID NO: 1934145 - protein, 10 aa, Staphylococcus
EDDDNYFEQP

SEQ ID NO: 1934146 - protein, 9 aa, Staphylococcus
EDDDRAKHS

SEQ ID NO: 1934147 - protein, 17 aa, Staphylococcus
EDDEDDELDEEDEDEFE

SEQ ID NO: 1934148 - protein, 17 aa, Staphylococcus
EDDEDLDDEEEIDDEEK

SEQ ID NO: 1934149 - protein, 23 aa, Staphylococcus
EDDEDLDEEDEEEEEFEDEEETE

SEQ ID NO: 1934150 - protein, 5 aa, Staphylococcus
EDDEE

SEQ ID NO: 1934151 - protein, 8 aa, Staphylococcus
EDDEEDKN

SEQ ID NO: 1934152 - protein, 7 aa, Staphylococcus
EDDEIIP

SEQ ID NO: 1934153 - protein, 15 aa, Staphylococcus
EDDEIIPYTDSQETM

SEQ ID NO: 1934154 - protein, 78 aa, Staphylococcus
EDDELEAPPEENEQQERQQPKQQAQSQNQFTEQPRNVNSERPRSIQSVPKKQSTRLQQSSGERKYQMNNTTSKNNARN

SEQ ID NO: 1934155 - protein, 5 aa, Staphylococcus
EDDEM

SEQ ID NO: 1934156 - protein, 6 aa, Staphylococcus
EDDEQQ

SEQ ID NO: 1934157 - protein, 17 aa, Staphylococcus
EDDETMKQDLEQSVQDF

SEQ ID NO: 1934158 - protein, 4 aa, Staphylococcus
EDDF

SEQ ID NO: 1934159 - protein, 19 aa, Staphylococcus
EDDFDKPINDFSGGQKTRL

SEQ ID NO: 1934160 - protein, 19 aa, Staphylococcus
EDDFNKPINDFSGGQKTRL

SEQ ID NO: 1934161 - protein, 11 aa, Staphylococcus
EDDGLARSSRN

SEQ ID NO: 1934162 - protein, 8 aa, Staphylococcus
EDDHSEAM

SEQ ID NO: 1934163 - protein, 9 aa, Staphylococcus
EDDHSEAMN

SEQ ID NO: 1934164 - protein, 34 aa, Staphylococcus
EDDIDEDDDIPAETDDQETLNDPEDEEVEEEIND

SEQ ID NO: 1934165 - protein, 10 aa, Staphylococcus
EDDIDTAPKD

SEQ ID NO: 1934166 - protein, 12 aa, Staphylococcus
EDDIKDKMNTSR

SEQ ID NO: 1934167 - protein, 15 aa, Staphylococcus
EDDKTFEKRASTSAL

SEQ ID NO: 1934168 - protein, 4 aa, Staphylococcus
EDDL

SEQ ID NO: 1934169 - protein, 8 aa, Staphylococcus
EDDLDSSI

SEQ ID NO: 1934170 - protein, 33 aa, Staphylococcus
EDDLERDKTTDFGKAEHVSAEDGKEKAKAEPYV

SEQ ID NO: 1934171 - protein, 7 aa, Staphylococcus
EDDNGKL

SEQ ID NO: 1934172 - protein, 8 aa, Staphylococcus
EDDNGRYV

SEQ ID NO: 1934173 - protein, 9 aa, Staphylococcus
EDDNHNPNK

SEQ ID NO: 1934174 - protein, 7 aa, Staphylococcus
EDDNPVH

SEQ ID NO: 1934175 - protein, 11 aa, Staphylococcus
EDDPDAESPKL

SEQ ID NO: 1934176 - protein, 12 aa, Staphylococcus
EDDPDAESPKLS

SEQ ID NO: 1934177 - protein, 8 aa, Staphylococcus
EDDPDFEQ

SEQ ID NO: 1934178 - protein, 12 aa, Staphylococcus
EDDPEAESPKLS

SEQ ID NO: 1934179 - protein, 5 aa, Staphylococcus
EDDPI

SEQ ID NO: 1934180 - protein, 6 aa, Staphylococcus
EDDPKG

SEQ ID NO: 1934181 - protein, 5 aa, Staphylococcus
EDDQI

SEQ ID NO: 1934182 - protein, 4 aa, Staphylococcus
EDDR

SEQ ID NO: 1934183 - protein, 6 aa, Staphylococcus
EDDRVD

SEQ ID NO: 1934184 - protein, 11 aa, Staphylococcus
EDDSESESPKL

SEQ ID NO: 1934185 - protein, 5 aa, Staphylococcus
EDDSG

SEQ ID NO: 1934186 - protein, 8 aa, Staphylococcus
EDDSRGLA

SEQ ID NO: 1934187 - protein, 9 aa, Staphylococcus
EDDSTATEV

SEQ ID NO: 1934188 - protein, 17 aa, Staphylococcus
EDDTRKKRVGLSRTAYK

SEQ ID NO: 1934189 - protein, 6 aa, Staphylococcus
EDDTVI

SEQ ID NO: 1934190 - protein, 11 aa, Staphylococcus
EDDYNYDEKTK

SEQ ID NO: 1934191 - protein, 25 aa, Staphylococcus
EDDYNYDEKTKSVQLTDQGADKAER

SEQ ID NO: 1934192 - protein, 17 aa, Staphylococcus
EDEADDIEKAAEQAVED

SEQ ID NO: 1934193 - protein, 14 aa, Staphylococcus
EDEADVKTSQPSIG

SEQ ID NO: 1934194 - protein, 6 aa, Staphylococcus
EDEAEA

SEQ ID NO: 1934195 - protein, 9 aa, Staphylococcus
EDEDGNVIQ

SEQ ID NO: 1934196 - protein, 7 aa, Staphylococcus
EDEDIDN

SEQ ID NO: 1934197 - protein, 5 aa, Staphylococcus
EDEDN

SEQ ID NO: 1934198 - protein, 14 aa, Staphylococcus
EDEDRWNIVDSFKL

SEQ ID NO: 1934199 - protein, 6 aa, Staphylococcus
EDEDVN

SEQ ID NO: 1934200 - protein, 9 aa, Staphylococcus
EDEDVTERK

SEQ ID NO: 1934201 - protein, 7 aa, Staphylococcus
EDEEATV

SEQ ID NO: 1934202 - protein, 6 aa, Staphylococcus
EDEEEA

SEQ ID NO: 1934203 - protein, 7 aa, Staphylococcus
EDEEEAE

SEQ ID NO: 1934204 - protein, 12 aa, Staphylococcus
EDEEENSQYSEL

SEQ ID NO: 1934205 - protein, 20 aa, Staphylococcus
EDEEKAKAYKQARGKGGHVR

SEQ ID NO: 1934206 - protein, 17 aa, Staphylococcus
EDEEKAKQYKSARGMGG

SEQ ID NO: 1934207 - protein, 18 aa, Staphylococcus
EDEEKAKRYKQARGMGGH

SEQ ID NO: 1934208 - protein, 7 aa, Staphylococcus
EDEEKSL

SEQ ID NO: 1934209 - protein, 11 aa, Staphylococcus
EDEENPDNDEV

SEQ ID NO: 1934210 - protein, 9 aa, Staphylococcus
EDEERSKHS

SEQ ID NO: 1934211 - protein, 9 aa, Staphylococcus
EDEEYREDL

SEQ ID NO: 1934212 - protein, 6 aa, Staphylococcus
EDEFDQ

SEQ ID NO: 1934213 - protein, 5 aa, Staphylococcus
EDEFE

SEQ ID NO: 1934214 - protein, 5 aa, Staphylococcus
EDEFT

SEQ ID NO: 1934215 - protein, 4 aa, Staphylococcus
EDEG

SEQ ID NO: 1934216 - protein, 14 aa, Staphylococcus
EDEGIRKGTTADKL

SEQ ID NO: 1934217 - protein, 10 aa, Staphylococcus
EDEGKISTED

SEQ ID NO: 1934218 - protein, 4 aa, Staphylococcus
EDEH

SEQ ID NO: 1934219 - protein, 4 aa, Staphylococcus
EDEK

SEQ ID NO: 1934220 - protein, 10 aa, Staphylococcus
EDEKEINAQQ

SEQ ID NO: 1934221 - protein, 10 aa, Staphylococcus
EDEKEQGKRK

SEQ ID NO: 1934222 - protein, 20 aa, Staphylococcus
EDEKKAKLYKEARGKGGHVR

SEQ ID NO: 1934223 - protein, 18 aa, Staphylococcus
EDEKMGTYQYEINYKEIS

SEQ ID NO: 1934224 - protein, 4 aa, Staphylococcus
EDEL

SEQ ID NO: 1934225 - protein, 7 aa, Staphylococcus
EDELAAT

SEQ ID NO: 1934226 - protein, 11 aa, Staphylococcus
EDELESHKNDI

SEQ ID NO: 1934227 - protein, 35 aa, Staphylococcus
EDEMDDDDDIPAQTDDQETLDDDDNEPVEDEMNET

SEQ ID NO: 1934228 - protein, 7 aa, Staphylococcus
EDENADI

SEQ ID NO: 1934229 - protein, 8 aa, Staphylococcus
EDENATER

SEQ ID NO: 1934230 - protein, 6 aa, Staphylococcus
EDENDK

SEQ ID NO: 1934231 - protein, 8 aa, Staphylococcus
EDENDKLN

SEQ ID NO: 1934232 - protein, 7 aa, Staphylococcus
EDENEAI

SEQ ID NO: 1934233 - protein, 9 aa, Staphylococcus
EDENGEYQD

SEQ ID NO: 1934234 - protein, 20 aa, Staphylococcus
EDENKAKAYKEARGKGGHVR

SEQ ID NO: 1934235 - protein, 7 aa, Staphylococcus
EDENNRI

SEQ ID NO: 1934236 - protein, 9 aa, Staphylococcus
EDENNTQRV

SEQ ID NO: 1934237 - protein, 8 aa, Staphylococcus
EDENTTHR

SEQ ID NO: 1934238 - protein, 7 aa, Staphylococcus
EDENTTN

SEQ ID NO: 1934239 - protein, 5 aa, Staphylococcus
EDEPD

SEQ ID NO: 1934240 - protein, 7 aa, Staphylococcus
EDEPDID

SEQ ID NO: 1934241 - protein, 7 aa, Staphylococcus
EDEPDIE

SEQ ID NO: 1934242 - protein, 6 aa, Staphylococcus
EDEPIT

SEQ ID NO: 1934243 - protein, 5 aa, Staphylococcus
EDEPS

SEQ ID NO: 1934244 - protein, 4 aa, Staphylococcus
EDEQ

SEQ ID NO: 1934245 - protein, 13 aa, Staphylococcus
EDEQAYKDHGGPH

SEQ ID NO: 1934246 - protein, 6 aa, Staphylococcus
EDEQEA

SEQ ID NO: 1934247 - protein, 6 aa, Staphylococcus
EDEQEE

SEQ ID NO: 1934248 - protein, 7 aa, Staphylococcus
EDEQNAQ

SEQ ID NO: 1934249 - protein, 7 aa, Staphylococcus
EDEQRFE

SEQ ID NO: 1934250 - protein, 4 aa, Staphylococcus
EDER

SEQ ID NO: 1934251 - protein, 7 aa, Staphylococcus
EDEREEI

SEQ ID NO: 1934252 - protein, 16 aa, Staphylococcus
EDEREQQAILNAVELN

SEQ ID NO: 1934253 - protein, 16 aa, Staphylococcus
EDEREQQAIRNAIELN

SEQ ID NO: 1934254 - protein, 5 aa, Staphylococcus
EDERV

SEQ ID NO: 1934255 - protein, 4 aa, Staphylococcus
EDES

SEQ ID NO: 1934256 - protein, 6 aa, Staphylococcus
EDESSF

SEQ ID NO: 1934257 - protein, 8 aa, Staphylococcus
EDESTQTA

SEQ ID NO: 1934258 - protein, 7 aa, Staphylococcus
EDESVES

SEQ ID NO: 1934259 - protein, 4 aa, Staphylococcus
EDET

SEQ ID NO: 1934260 - protein, 6 aa, Staphylococcus
EDETEV

SEQ ID NO: 1934261 - protein, 9 aa, Staphylococcus
EDETNTQNH

SEQ ID NO: 1934262 - protein, 18 aa, Staphylococcus
EDETPVNEKRANVLREHI

SEQ ID NO: 1934263 - protein, 8 aa, Staphylococcus
EDETTSQD

SEQ ID NO: 1934264 - protein, 8 aa, Staphylococcus
EDETVGKK

SEQ ID NO: 1934265 - protein, 7 aa, Staphylococcus
EDETVQT

SEQ ID NO: 1934266 - protein, 23 aa, Staphylococcus
EDEVEKKYQEKKKIDEENNEIEK

SEQ ID NO: 1934267 - protein, 14 aa, Staphylococcus
EDEVNQLRKTNDIK

SEQ ID NO: 1934268 - protein, 12 aa, Staphylococcus
EDEVPEKTEGYE

SEQ ID NO: 1934269 - protein, 12 aa, Staphylococcus
EDEYHDNIKLNY

SEQ ID NO: 1934270 - protein, 6 aa, Staphylococcus
EDEYTA

SEQ ID NO: 1934271 - protein, 10 aa, Staphylococcus
EDFDDESLQA

SEQ ID NO: 1934272 - protein, 4 aa, Staphylococcus
EDFE

SEQ ID NO: 1934273 - protein, 7 aa, Staphylococcus
EDFEPGK

SEQ ID NO: 1934274 - protein, 4 aa, Staphylococcus
EDFH

SEQ ID NO: 1934275 - protein, 12 aa, Staphylococcus
EDFHSKSSNTPF

SEQ ID NO: 1934276 - protein, 8 aa, Staphylococcus
EDFNDDTK

SEQ ID NO: 1934277 - protein, 7 aa, Staphylococcus
EDFNGND

SEQ ID NO: 1934278 - protein, 42 aa, Staphylococcus
EDFQNNRQEMEKRQNKIQEINKKGAIPETTLSTSKQHAYNEV

SEQ ID NO: 1934279 - protein, 5 aa, Staphylococcus
EDFSE

SEQ ID NO: 1934280 - protein, 4 aa, Staphylococcus
EDFT

SEQ ID NO: 1934281 - protein, 14 aa, Staphylococcus
EDGAESDKVDVPTF

SEQ ID NO: 1934282 - protein, 9 aa, Staphylococcus
EDGATPNEI

SEQ ID NO: 1934283 - protein, 11 aa, Staphylococcus
EDGAVEEGDTV

SEQ ID NO: 1934284 - protein, 14 aa, Staphylococcus
EDGDFNDSEYTNKD

SEQ ID NO: 1934285 - protein, 13 aa, Staphylococcus
EDGDFNNNDLTNK

SEQ ID NO: 1934286 - protein, 8 aa, Staphylococcus
EDGDTEKL

SEQ ID NO: 1934287 - protein, 22 aa, Staphylococcus
EDGEEWQGHQKGTHQEAKRGRI

SEQ ID NO: 1934288 - protein, 97 aa, Staphylococcus
EDGEGDSVKDNDDKVPENDDDNPNKESKFTQSEVDSQISKAVETALSKRERKHQQELEKAKEEAKKEAESYAKLTEKEKKEKEYEKREKALAEKEKQ

SEQ ID NO: 1934289 - protein, 7 aa, Staphylococcus
EDGENEM

SEQ ID NO: 1934290 - protein, 6 aa, Staphylococcus
EDGENG

SEQ ID NO: 1934291 - protein, 7 aa, Staphylococcus
EDGEQAV

SEQ ID NO: 1934292 - protein, 10 aa, Staphylococcus
EDGESIGEHP

SEQ ID NO: 1934293 - protein, 8 aa, Staphylococcus
EDGETTVI

SEQ ID NO: 1934294 - protein, 4 aa, Staphylococcus
EDGF

SEQ ID NO: 1934295 - protein, 5 aa, Staphylococcus
EDGHL

SEQ ID NO: 1934296 - protein, 4 aa, Staphylococcus
EDGI

SEQ ID NO: 1934297 - protein, 8 aa, Staphylococcus
EDGIPTDV

SEQ ID NO: 1934298 - protein, 6 aa, Staphylococcus
EDGKIH

SEQ ID NO: 1934299 - protein, 11 aa, Staphylococcus
EDGKQTYRLDG

SEQ ID NO: 1934300 - protein, 9 aa, Staphylococcus
EDGKQVDSN

SEQ ID NO: 1934301 - protein, 10 aa, Staphylococcus
EDGLARSSRN

SEQ ID NO: 1934302 - protein, 13 aa, Staphylococcus
EDGLRFTENKPEI

SEQ ID NO: 1934303 - protein, 8 aa, Staphylococcus
EDGLTGEP

SEQ ID NO: 1934304 - protein, 6 aa, Staphylococcus
EDGLVS

SEQ ID NO: 1934305 - protein, 6 aa, Staphylococcus
EDGNQF

SEQ ID NO: 1934306 - protein, 20 aa, Staphylococcus
EDGNVDFDDNKYTENTRAAY

SEQ ID NO: 1934307 - protein, 24 aa, Staphylococcus
EDGQDGKTPSIEQQPVKDEKGNQV

SEQ ID NO: 1934308 - protein, 10 aa, Staphylococcus
EDGQEYEGEL

SEQ ID NO: 1934309 - protein, 9 aa, Staphylococcus
EDGQFDRTK

SEQ ID NO: 1934310 - protein, 5 aa, Staphylococcus
EDGQI

SEQ ID NO: 1934311 - protein, 11 aa, Staphylococcus
EDGQQYDGELD

SEQ ID NO: 1934312 - protein, 4 aa, Staphylococcus
EDGR

SEQ ID NO: 1934313 - protein, 11 aa, Staphylococcus
EDGRLKEGGTI

SEQ ID NO: 1934314 - protein, 4 aa, Staphylococcus
EDGS

SEQ ID NO: 1934315 - protein, 8 aa, Staphylococcus
EDGSDSAI

SEQ ID NO: 1934316 - protein, 10 aa, Staphylococcus
EDGSENPDFE

SEQ ID NO: 1934317 - protein, 20 aa, Staphylococcus
EDGSEWQGHQKGSYDESHRG

SEQ ID NO: 1934318 - protein, 5 aa, Staphylococcus
EDGSI

SEQ ID NO: 1934319 - protein, 8 aa, Staphylococcus
EDGSLDEE

SEQ ID NO: 1934320 - protein, 15 aa, Staphylococcus
EDGSLSEKDLKEQGV

SEQ ID NO: 1934321 - protein, 9 aa, Staphylococcus
EDGSMGTKG

SEQ ID NO: 1934322 - protein, 17 aa, Staphylococcus
EDGSVTAGNASSINDGA

SEQ ID NO: 1934323 - protein, 8 aa, Staphylococcus
EDGSYLTG

SEQ ID NO: 1934324 - protein, 14 aa, Staphylococcus
EDGSYSDEMKEVYY

SEQ ID NO: 1934325 - protein, 7 aa, Staphylococcus
EDGTDEP

SEQ ID NO: 1934326 - protein, 5 aa, Staphylococcus
EDGTI

SEQ ID NO: 1934327 - protein, 8 aa, Staphylococcus
EDGTPTDL

SEQ ID NO: 1934328 - protein, 18 aa, Staphylococcus
EDGTVTGGNASSINDGAS

SEQ ID NO: 1934329 - protein, 18 aa, Staphylococcus
EDGTVTGGNASSINDGSS

SEQ ID NO: 1934330 - protein, 10 aa, Staphylococcus
EDGTVTPSTA

SEQ ID NO: 1934331 - protein, 7 aa, Staphylococcus
EDGVTQP

SEQ ID NO: 1934332 - protein, 8 aa, Staphylococcus
EDGWGQKE

SEQ ID NO: 1934333 - protein, 13 aa, Staphylococcus
EDGWGQKETDVDR

SEQ ID NO: 1934334 - protein, 4 aa, Staphylococcus
EDGY

SEQ ID NO: 1934335 - protein, 5 aa, Staphylococcus
EDGYH

SEQ ID NO: 1934336 - protein, 12 aa, Staphylococcus
EDHASEQNGLGA

SEQ ID NO: 1934337 - protein, 7 aa, Staphylococcus
EDHDFDG

SEQ ID NO: 1934338 - protein, 9 aa, Staphylococcus
EDHEALSND

SEQ ID NO: 1934339 - protein, 7 aa, Staphylococcus
EDHEPIP

SEQ ID NO: 1934340 - protein, 6 aa, Staphylococcus
EDHGAE

SEQ ID NO: 1934341 - protein, 7 aa, Staphylococcus
EDHGAEA

SEQ ID NO: 1934342 - protein, 24 aa, Staphylococcus
EDHHNAQGKDKEEGKFKKLMKSLF

SEQ ID NO: 1934343 - protein, 5 aa, Staphylococcus
EDHNP

SEQ ID NO: 1934344 - protein, 6 aa, Staphylococcus
EDHPQH

SEQ ID NO: 1934345 - protein, 6 aa, Staphylococcus
EDHSDK

SEQ ID NO: 1934346 - protein, 6 aa, Staphylococcus
EDHSEG

SEQ ID NO: 1934347 - protein, 7 aa, Staphylococcus
EDHYPGD

SEQ ID NO: 1934348 - protein, 6 aa, Staphylococcus
EDIAEP

SEQ ID NO: 1934349 - protein, 9 aa, Staphylococcus
EDIAKGTKD

SEQ ID NO: 1934350 - protein, 8 aa, Staphylococcus
EDIDDEQY

SEQ ID NO: 1934351 - protein, 6 aa, Staphylococcus
EDIDET

SEQ ID NO: 1934352 - protein, 16 aa, Staphylococcus
EDIDGKKESKNDPELG

SEQ ID NO: 1934353 - protein, 14 aa, Staphylococcus
EDIDHSDATEDDHE

SEQ ID NO: 1934354 - protein, 13 aa, Staphylococcus
EDIDNADNEDNEE

SEQ ID NO: 1934355 - protein, 4 aa, Staphylococcus
EDIE

SEQ ID NO: 1934356 - protein, 5 aa, Staphylococcus
EDIEI

SEQ ID NO: 1934357 - protein, 5 aa, Staphylococcus
EDIEK

SEQ ID NO: 1934358 - protein, 14 aa, Staphylococcus
EDIENAPNNDEDDE

SEQ ID NO: 1934359 - protein, 12 aa, Staphylococcus
EDIENDSENNED

SEQ ID NO: 1934360 - protein, 13 aa, Staphylococcus
EDIEPLSKTNITE

SEQ ID NO: 1934361 - protein, 15 aa, Staphylococcus
EDIESADHEDDENDE

SEQ ID NO: 1934362 - protein, 13 aa, Staphylococcus
EDIESASDDDDDN

SEQ ID NO: 1934363 - protein, 5 aa, Staphylococcus
EDIET

SEQ ID NO: 1934364 - protein, 10 aa, Staphylococcus
EDIGNKTENI

SEQ ID NO: 1934365 - protein, 8 aa, Staphylococcus
EDIGRGDE

SEQ ID NO: 1934366 - protein, 23 aa, Staphylococcus
EDIGRNDPCPCGSGKKYKNCHGQ

SEQ ID NO: 1934367 - protein, 13 aa, Staphylococcus
EDIKEAKQAIEAK

SEQ ID NO: 1934368 - protein, 10 aa, Staphylococcus
EDIKGKDNED

SEQ ID NO: 1934369 - protein, 10 aa, Staphylococcus
EDIKQRKDGV

SEQ ID NO: 1934370 - protein, 25 aa, Staphylococcus
EDIKTQSSLNRPNDEKKGFFARLFN

SEQ ID NO: 1934371 - protein, 5 aa, Staphylococcus
EDINP

SEQ ID NO: 1934372 - protein, 8 aa, Staphylococcus
EDIPEDDY

SEQ ID NO: 1934373 - protein, 6 aa, Staphylococcus
EDIPFK

SEQ ID NO: 1934374 - protein, 13 aa, Staphylococcus
EDIQANHQITPDS

SEQ ID NO: 1934375 - protein, 7 aa, Staphylococcus
EDIRAEK

SEQ ID NO: 1934376 - protein, 5 aa, Staphylococcus
EDIRE

SEQ ID NO: 1934377 - protein, 11 aa, Staphylococcus
EDISDEEYRSK

SEQ ID NO: 1934378 - protein, 17 aa, Staphylococcus
EDISEDQKYSGDTLQND

SEQ ID NO: 1934379 - protein, 8 aa, Staphylococcus
EDISTPRD

SEQ ID NO: 1934380 - protein, 13 aa, Staphylococcus
EDITQSIKGTALD

SEQ ID NO: 1934381 - protein, 14 aa, Staphylococcus
EDKAAAFETNASEQ

SEQ ID NO: 1934382 - protein, 15 aa, Staphylococcus
EDKAAAFQSHAKNEI

SEQ ID NO: 1934383 - protein, 8 aa, Staphylococcus
EDKAENLA

SEQ ID NO: 1934384 - protein, 13 aa, Staphylococcus
EDKAPKYIVNGVE

SEQ ID NO: 1934385 - protein, 6 aa, Staphylococcus
EDKDAD

SEQ ID NO: 1934386 - protein, 7 aa, Staphylococcus
EDKDDFN

SEQ ID NO: 1934387 - protein, 9 aa, Staphylococcus
EDKDEMDEA

SEQ ID NO: 1934388 - protein, 19 aa, Staphylococcus
EDKDKVKDIVDEDGSDSAI

SEQ ID NO: 1934389 - protein, 14 aa, Staphylococcus
EDKDNATAIANLIA

SEQ ID NO: 1934390 - protein, 14 aa, Staphylococcus
EDKDNDALTLLCVF

SEQ ID NO: 1934391 - protein, 12 aa, Staphylococcus
EDKDTPIHLEGV

SEQ ID NO: 1934392 - protein, 6 aa, Staphylococcus
EDKEDL

SEQ ID NO: 1934393 - protein, 7 aa, Staphylococcus
EDKEGTT

SEQ ID NO: 1934394 - protein, 8 aa, Staphylococcus
EDKEKKEL

SEQ ID NO: 1934395 - protein, 6 aa, Staphylococcus
EDKELQ

SEQ ID NO: 1934396 - protein, 6 aa, Staphylococcus
EDKERR

SEQ ID NO: 1934397 - protein, 8 aa, Staphylococcus
EDKESQFE

SEQ ID NO: 1934398 - protein, 10 aa, Staphylococcus
EDKETNIQSY

SEQ ID NO: 1934399 - protein, 15 aa, Staphylococcus
EDKEYNTSKNDYSNI

SEQ ID NO: 1934400 - protein, 5 aa, Staphylococcus
EDKGE

SEQ ID NO: 1934401 - protein, 6 aa, Staphylococcus
EDKGNV

SEQ ID NO: 1934402 - protein, 22 aa, Staphylococcus
EDKGQASTVNLEPSESAQEDVH

SEQ ID NO: 1934403 - protein, 24 aa, Staphylococcus
EDKHDSTSAPVADNDFTSDIGKDI

SEQ ID NO: 1934404 - protein, 9 aa, Staphylococcus
EDKIAKGKI

SEQ ID NO: 1934405 - protein, 11 aa, Staphylococcus
EDKIAKGKVQK

SEQ ID NO: 1934406 - protein, 9 aa, Staphylococcus
EDKIPKGKV

SEQ ID NO: 1934407 - protein, 10 aa, Staphylococcus
EDKIPKGKVQ

SEQ ID NO: 1934408 - protein, 7 aa, Staphylococcus
EDKLEQL

SEQ ID NO: 1934409 - protein, 8 aa, Staphylococcus
EDKLNRIR

SEQ ID NO: 1934410 - protein, 4 aa, Staphylococcus
EDKN

SEQ ID NO: 1934411 - protein, 5 aa, Staphylococcus
EDKNS

SEQ ID NO: 1934412 - protein, 7 aa, Staphylococcus
EDKPETV

SEQ ID NO: 1934413 - protein, 6 aa, Staphylococcus
EDKPGI

SEQ ID NO: 1934414 - protein, 6 aa, Staphylococcus
EDKPGM

SEQ ID NO: 1934415 - protein, 5 aa, Staphylococcus
EDKPR

SEQ ID NO: 1934416 - protein, 7 aa, Staphylococcus
EDKQRVT

SEQ ID NO: 1934417 - protein, 15 aa, Staphylococcus
EDKRQEHIKQTKENP

SEQ ID NO: 1934418 - protein, 8 aa, Staphylococcus
EDKSADDI

SEQ ID NO: 1934419 - protein, 13 aa, Staphylococcus
EDKSNGTTSTIKT

SEQ ID NO: 1934420 - protein, 9 aa, Staphylococcus
EDKSYTPQE

SEQ ID NO: 1934421 - protein, 8 aa, Staphylococcus
EDKTDEAL

SEQ ID NO: 1934422 - protein, 5 aa, Staphylococcus
EDKTK

SEQ ID NO: 1934423 - protein, 23 aa, Staphylococcus
EDKVENQGGNTPMGRRGQPAELA

SEQ ID NO: 1934424 - protein, 8 aa, Staphylococcus
EDKVKGDV

SEQ ID NO: 1934425 - protein, 13 aa, Staphylococcus
EDKVPKKYVPEGI

SEQ ID NO: 1934426 - protein, 7 aa, Staphylococcus
EDKYAKA

SEQ ID NO: 1934427 - protein, 8 aa, Staphylococcus
EDLAEQKN

SEQ ID NO: 1934428 - protein, 4 aa, Staphylococcus
EDLD

SEQ ID NO: 1934429 - protein, 8 aa, Staphylococcus
EDLEKATK

SEQ ID NO: 1934430 - protein, 12 aa, Staphylococcus
EDLGADTPVNLN

SEQ ID NO: 1934431 - protein, 12 aa, Staphylococcus
EDLGKNKVEAYA

SEQ ID NO: 1934432 - protein, 20 aa, Staphylococcus
EDLKEGNQQKGYEITGFDSD

SEQ ID NO: 1934433 - protein, 13 aa, Staphylococcus
EDLKQGDQQRGYQ

SEQ ID NO: 1934434 - protein, 13 aa, Staphylococcus
EDLKQGNKERGYQ

SEQ ID NO: 1934435 - protein, 10 aa, Staphylococcus
EDLKSQLEQQ

SEQ ID NO: 1934436 - protein, 7 aa, Staphylococcus
EDLNESY

SEQ ID NO: 1934437 - protein, 12 aa, Staphylococcus
EDLNGKAEQLGH

SEQ ID NO: 1934438 - protein, 5 aa, Staphylococcus
EDLPQ

SEQ ID NO: 1934439 - protein, 11 aa, Staphylococcus
EDLQKSKLTES

SEQ ID NO: 1934440 - protein, 6 aa, Staphylococcus
EDLQRR

SEQ ID NO: 1934441 - protein, 5 aa, Staphylococcus
EDLRK

SEQ ID NO: 1934442 - protein, 7 aa, Staphylococcus
EDLSKEK

SEQ ID NO: 1934443 - protein, 9 aa, Staphylococcus
EDLSPSDGE

SEQ ID NO: 1934444 - protein, 5 aa, Staphylococcus
EDLSQ

SEQ ID NO: 1934445 - protein, 19 aa, Staphylococcus
EDLTKAKTRIAQAQSETDT

SEQ ID NO: 1934446 - protein, 4 aa, Staphylococcus
EDME

SEQ ID NO: 1934447 - protein, 7 aa, Staphylococcus
EDMKRQS

SEQ ID NO: 1934448 - protein, 4 aa, Staphylococcus
EDMP

SEQ ID NO: 1934449 - protein, 5 aa, Staphylococcus
EDMPK

SEQ ID NO: 1934450 - protein, 9 aa, Staphylococcus
EDMSSGEMK

SEQ ID NO: 1934451 - protein, 8 aa, Staphylococcus
EDMSTSIP

SEQ ID NO: 1934452 - protein, 5 aa, Staphylococcus
EDMTG

SEQ ID NO: 1934453 - protein, 12 aa, Staphylococcus
EDNASEQEGLGA

SEQ ID NO: 1934454 - protein, 12 aa, Staphylococcus
EDNASKNENLGA

SEQ ID NO: 1934455 - protein, 9 aa, Staphylococcus
EDNASKREW

SEQ ID NO: 1934456 - protein, 9 aa, Staphylococcus
EDNCQEEVN

SEQ ID NO: 1934457 - protein, 6 aa, Staphylococcus
EDNDAN

SEQ ID NO: 1934458 - protein, 9 aa, Staphylococcus
EDNDNGVAK

SEQ ID NO: 1934459 - protein, 19 aa, Staphylococcus
EDNDRQTLEQAYETFKAGE

SEQ ID NO: 1934460 - protein, 10 aa, Staphylococcus
EDNDSKLQEC

SEQ ID NO: 1934461 - protein, 7 aa, Staphylococcus
EDNDYGR

SEQ ID NO: 1934462 - protein, 4 aa, Staphylococcus
EDNE

SEQ ID NO: 1934463 - protein, 6 aa, Staphylococcus
EDNEKK

SEQ ID NO: 1934464 - protein, 14 aa, Staphylococcus
EDNEQLPADQGATQ

SEQ ID NO: 1934465 - protein, 14 aa, Staphylococcus
EDNEREHTSKSGGF

SEQ ID NO: 1934466 - protein, 12 aa, Staphylococcus
EDNETYSIKGYK

SEQ ID NO: 1934467 - protein, 10 aa, Staphylococcus
EDNFDDYESD

SEQ ID NO: 1934468 - protein, 16 aa, Staphylococcus
EDNGEIQSVDTGYDIE

SEQ ID NO: 1934469 - protein, 5 aa, Staphylococcus
EDNGK

SEQ ID NO: 1934470 - protein, 5 aa, Staphylococcus
EDNGV

SEQ ID NO: 1934471 - protein, 5 aa, Staphylococcus
EDNHA

SEQ ID NO: 1934472 - protein, 8 aa, Staphylococcus
EDNHYNRE

SEQ ID NO: 1934473 - protein, 7 aa, Staphylococcus
EDNKGSI

SEQ ID NO: 1934474 - protein, 7 aa, Staphylococcus
EDNKKKL

SEQ ID NO: 1934475 - protein, 8 aa, Staphylococcus
EDNKNGFK

SEQ ID NO: 1934476 - protein, 18 aa, Staphylococcus
EDNKTTYSHNKGLPETRE

SEQ ID NO: 1934477 - protein, 5 aa, Staphylococcus
EDNLG

SEQ ID NO: 1934478 - protein, 5 aa, Staphylococcus
EDNLQ

SEQ ID NO: 1934479 - protein, 7 aa, Staphylococcus
EDNPKFL

SEQ ID NO: 1934480 - protein, 9 aa, Staphylococcus
EDNPNGSHE

SEQ ID NO: 1934481 - protein, 7 aa, Staphylococcus
EDNPVQD

SEQ ID NO: 1934482 - protein, 6 aa, Staphylococcus
EDNQAR

SEQ ID NO: 1934483 - protein, 5 aa, Staphylococcus
EDNRV

SEQ ID NO: 1934484 - protein, 12 aa, Staphylococcus
EDNSKLPTNQNI

SEQ ID NO: 1934485 - protein, 12 aa, Staphylococcus
EDNSQLPTDQNI

SEQ ID NO: 1934486 - protein, 8 aa, Staphylococcus
EDNSVEAS

SEQ ID NO: 1934487 - protein, 10 aa, Staphylococcus
EDNTASGYTK

SEQ ID NO: 1934488 - protein, 6 aa, Staphylococcus
EDNTEW

SEQ ID NO: 1934489 - protein, 7 aa, Staphylococcus
EDNTGLS

SEQ ID NO: 1934490 - protein, 6 aa, Staphylococcus
EDNTLV

SEQ ID NO: 1934491 - protein, 11 aa, Staphylococcus
EDNTNTNPTVA

SEQ ID NO: 1934492 - protein, 10 aa, Staphylococcus
EDNVDQDAFT

SEQ ID NO: 1934493 - protein, 15 aa, Staphylococcus
EDNVVTSTKDMSEND

SEQ ID NO: 1934494 - protein, 9 aa, Staphylococcus
EDPAGKEWS

SEQ ID NO: 1934495 - protein, 11 aa, Staphylococcus
EDPDLKKNHPK

SEQ ID NO: 1934496 - protein, 7 aa, Staphylococcus
EDPDNPE

SEQ ID NO: 1934497 - protein, 8 aa, Staphylococcus
EDPEAYED

SEQ ID NO: 1934498 - protein, 7 aa, Staphylococcus
EDPEIKA

SEQ ID NO: 1934499 - protein, 19 aa, Staphylococcus
EDPEKAKIYKNARGKGGHM

SEQ ID NO: 1934500 - protein, 11 aa, Staphylococcus
EDPELNKATNL

SEQ ID NO: 1934501 - protein, 6 aa, Staphylococcus
EDPGYS

SEQ ID NO: 1934502 - protein, 5 aa, Staphylococcus
EDPHE

SEQ ID NO: 1934503 - protein, 12 aa, Staphylococcus
EDPKGAKTENYY

SEQ ID NO: 1934504 - protein, 7 aa, Staphylococcus
EDPKPKF

SEQ ID NO: 1934505 - protein, 7 aa, Staphylococcus
EDPNDGF

SEQ ID NO: 1934506 - protein, 8 aa, Staphylococcus
EDPNTSYK

SEQ ID NO: 1934507 - protein, 18 aa, Staphylococcus
EDPQFEGQTKTKLGNSEV

SEQ ID NO: 1934508 - protein, 4 aa, Staphylococcus
EDPR

SEQ ID NO: 1934509 - protein, 10 aa, Staphylococcus
EDPRQKENLE

SEQ ID NO: 1934510 - protein, 15 aa, Staphylococcus
EDPSQFQTDEAPKQL

SEQ ID NO: 1934511 - protein, 5 aa, Staphylococcus
EDPTA

SEQ ID NO: 1934512 - protein, 7 aa, Staphylococcus
EDPTDGL

SEQ ID NO: 1934513 - protein, 9 aa, Staphylococcus
EDPTDGLDE

SEQ ID NO: 1934514 - protein, 9 aa, Staphylococcus
EDPTDGLEE

SEQ ID NO: 1934515 - protein, 14 aa, Staphylococcus
EDPTLSVADKTRQR

SEQ ID NO: 1934516 - protein, 8 aa, Staphylococcus
EDPYDESP

SEQ ID NO: 1934517 - protein, 22 aa, Staphylococcus
EDQKAEIKELEEKYKSDEWTYR

SEQ ID NO: 1934518 - protein, 8 aa, Staphylococcus
EDQKKAAL

SEQ ID NO: 1934519 - protein, 12 aa, Staphylococcus
EDQNKDKGPLAG

SEQ ID NO: 1934520 - protein, 19 aa, Staphylococcus
EDQNNVNYAKSQQEALETA

SEQ ID NO: 1934521 - protein, 5 aa, Staphylococcus
EDQPH

SEQ ID NO: 1934522 - protein, 14 aa, Staphylococcus
EDQQVTVRDRDSME

SEQ ID NO: 1934523 - protein, 7 aa, Staphylococcus
EDQRINE

SEQ ID NO: 1934524 - protein, 6 aa, Staphylococcus
EDQSAH

SEQ ID NO: 1934525 - protein, 8 aa, Staphylococcus
EDQSDYMP

SEQ ID NO: 1934526 - protein, 8 aa, Staphylococcus
EDQSFEGQ

SEQ ID NO: 1934527 - protein, 5 aa, Staphylococcus
EDQSV

SEQ ID NO: 1934528 - protein, 4 aa, Staphylococcus
EDQT

SEQ ID NO: 1934529 - protein, 8 aa, Staphylococcus
EDQTIYDE

SEQ ID NO: 1934530 - protein, 11 aa, Staphylococcus
EDQVEANVEGI

SEQ ID NO: 1934531 - protein, 5 aa, Staphylococcus
EDQYG

SEQ ID NO: 1934532 - protein, 6 aa, Staphylococcus
EDQYNE

SEQ ID NO: 1934533 - protein, 11 aa, Staphylococcus
EDRDKGLAKTR

SEQ ID NO: 1934534 - protein, 7 aa, Staphylococcus
EDRDSNV

SEQ ID NO: 1934535 - protein, 10 aa, Staphylococcus
EDRDTNIKSY

SEQ ID NO: 1934536 - protein, 11 aa, Staphylococcus
EDRGESLGEHP

SEQ ID NO: 1934537 - protein, 13 aa, Staphylococcus
EDRGGYYESSGAL

SEQ ID NO: 1934538 - protein, 14 aa, Staphylococcus
EDRGGYYESSGALK

SEQ ID NO: 1934539 - protein, 13 aa, Staphylococcus
EDRGGYYETSGAL

SEQ ID NO: 1934540 - protein, 5 aa, Staphylococcus
EDRGY

SEQ ID NO: 1934541 - protein, 6 aa, Staphylococcus
EDRHKS

SEQ ID NO: 1934542 - protein, 7 aa, Staphylococcus
EDRLDED

SEQ ID NO: 1934543 - protein, 9 aa, Staphylococcus
EDRNSNVES

SEQ ID NO: 1934544 - protein, 9 aa, Staphylococcus
EDRNSSVES

SEQ ID NO: 1934545 - protein, 4 aa, Staphylococcus
EDRQ

SEQ ID NO: 1934546 - protein, 17 aa, Staphylococcus
EDRQSKTSEIYNIYHQV

SEQ ID NO: 1934547 - protein, 5 aa, Staphylococcus
EDRVA

SEQ ID NO: 1934548 - protein, 7 aa, Staphylococcus
EDRVSPK

SEQ ID NO: 1934549 - protein, 14 aa, Staphylococcus
EDSALDKEAYSRAT

SEQ ID NO: 1934550 - protein, 7 aa, Staphylococcus
EDSAYKA

SEQ ID NO: 1934551 - protein, 8 aa, Staphylococcus
EDSDGSYV

SEQ ID NO: 1934552 - protein, 20 aa, Staphylococcus
EDSDRQKLEQAYEQFKVGGN

SEQ ID NO: 1934553 - protein, 7 aa, Staphylococcus
EDSDSRH

SEQ ID NO: 1934554 - protein, 14 aa, Staphylococcus
EDSDVERGAPSSRQ

SEQ ID NO: 1934555 - protein, 14 aa, Staphylococcus
EDSEDFKKETSELS

SEQ ID NO: 1934556 - protein, 7 aa, Staphylococcus
EDSEEAN

SEQ ID NO: 1934557 - protein, 7 aa, Staphylococcus
EDSEEDL

SEQ ID NO: 1934558 - protein, 6 aa, Staphylococcus
EDSEKI

SEQ ID NO: 1934559 - protein, 14 aa, Staphylococcus
EDSELDKEAYDRAT

SEQ ID NO: 1934560 - protein, 7 aa, Staphylococcus
EDSENPE

SEQ ID NO: 1934561 - protein, 13 aa, Staphylococcus
EDSFKARANSNDL

SEQ ID NO: 1934562 - protein, 15 aa, Staphylococcus
EDSGQISSVNTGYEI

SEQ ID NO: 1934563 - protein, 8 aa, Staphylococcus
EDSGRGYR

SEQ ID NO: 1934564 - protein, 5 aa, Staphylococcus
EDSID

SEQ ID NO: 1934565 - protein, 5 aa, Staphylococcus
EDSIE

SEQ ID NO: 1934566 - protein, 12 aa, Staphylococcus
EDSIEAQLEKTP

SEQ ID NO: 1934567 - protein, 8 aa, Staphylococcus
EDSKAYYE

SEQ ID NO: 1934568 - protein, 9 aa, Staphylococcus
EDSKNTLIR

SEQ ID NO: 1934569 - protein, 15 aa, Staphylococcus
EDSLKEQNDDYAQRA

SEQ ID NO: 1934570 - protein, 5 aa, Staphylococcus
EDSNA

SEQ ID NO: 1934571 - protein, 8 aa, Staphylococcus
EDSNGRRM

SEQ ID NO: 1934572 - protein, 7 aa, Staphylococcus
EDSNLNQ

SEQ ID NO: 1934573 - protein, 9 aa, Staphylococcus
EDSNLNRDA

SEQ ID NO: 1934574 - protein, 8 aa, Staphylococcus
EDSPGNFT

SEQ ID NO: 1934575 - protein, 14 aa, Staphylococcus
EDSPHRLVELFKGN

SEQ ID NO: 1934576 - protein, 6 aa, Staphylococcus
EDSSDV

SEQ ID NO: 1934577 - protein, 7 aa, Staphylococcus
EDSSNFN

SEQ ID NO: 1934578 - protein, 9 aa, Staphylococcus
EDSSNFNSV

SEQ ID NO: 1934579 - protein, 19 aa, Staphylococcus
EDSSYTTGQVFGVTGGTQI

SEQ ID NO: 1934580 - protein, 7 aa, Staphylococcus
EDSTENR

SEQ ID NO: 1934581 - protein, 6 aa, Staphylococcus
EDSTLN

SEQ ID NO: 1934582 - protein, 11 aa, Staphylococcus
EDSVNSGRVKN

SEQ ID NO: 1934583 - protein, 4 aa, Staphylococcus
EDTD

SEQ ID NO: 1934584 - protein, 6 aa, Staphylococcus
EDTDKQ

SEQ ID NO: 1934585 - protein, 8 aa, Staphylococcus
EDTDQEIE

SEQ ID NO: 1934586 - protein, 17 aa, Staphylococcus
EDTDSKRNLEDGEASQF

SEQ ID NO: 1934587 - protein, 6 aa, Staphylococcus
EDTEGK

SEQ ID NO: 1934588 - protein, 6 aa, Staphylococcus
EDTEKL

SEQ ID NO: 1934589 - protein, 8 aa, Staphylococcus
EDTELTGN

SEQ ID NO: 1934590 - protein, 9 aa, Staphylococcus
EDTEQLSKD

SEQ ID NO: 1934591 - protein, 5 aa, Staphylococcus
EDTEV

SEQ ID NO: 1934592 - protein, 17 aa, Staphylococcus
EDTEVNRTTTRKALTAG

SEQ ID NO: 1934593 - protein, 4 aa, Staphylococcus
EDTF

SEQ ID NO: 1934594 - protein, 7 aa, Staphylococcus
EDTGQRI

SEQ ID NO: 1934595 - protein, 5 aa, Staphylococcus
EDTHR

SEQ ID NO: 1934596 - protein, 4 aa, Staphylococcus
EDTI

SEQ ID NO: 1934597 - protein, 5 aa, Staphylococcus
EDTIA

SEQ ID NO: 1934598 - protein, 5 aa, Staphylococcus
EDTIQ

SEQ ID NO: 1934599 - protein, 6 aa, Staphylococcus
EDTKEI

SEQ ID NO: 1934600 - protein, 12 aa, Staphylococcus
EDTKIGKKRHLE

SEQ ID NO: 1934601 - protein, 6 aa, Staphylococcus
EDTKRI

SEQ ID NO: 1934602 - protein, 4 aa, Staphylococcus
EDTL

SEQ ID NO: 1934603 - protein, 6 aa, Staphylococcus
EDTLES

SEQ ID NO: 1934604 - protein, 7 aa, Staphylococcus
EDTLKAS

SEQ ID NO: 1934605 - protein, 6 aa, Staphylococcus
EDTNED

SEQ ID NO: 1934606 - protein, 8 aa, Staphylococcus
EDTNSHEE

SEQ ID NO: 1934607 - protein, 13 aa, Staphylococcus
EDTNSISTKEEIQ

SEQ ID NO: 1934608 - protein, 15 aa, Staphylococcus
EDTNSVSTKEETQAV

SEQ ID NO: 1934609 - protein, 14 aa, Staphylococcus
EDTNVSEDFSDFKS

SEQ ID NO: 1934610 - protein, 7 aa, Staphylococcus
EDTPKSI

SEQ ID NO: 1934611 - protein, 4 aa, Staphylococcus
EDTQ

SEQ ID NO: 1934612 - protein, 11 aa, Staphylococcus
EDTSESKEFLD

SEQ ID NO: 1934613 - protein, 9 aa, Staphylococcus
EDTSQNAVN

SEQ ID NO: 1934614 - protein, 9 aa, Staphylococcus
EDTSQQAVN

SEQ ID NO: 1934615 - protein, 4 aa, Staphylococcus
EDTT

SEQ ID NO: 1934616 - protein, 8 aa, Staphylococcus
EDTVEVTQ

SEQ ID NO: 1934617 - protein, 8 aa, Staphylococcus
EDTVTMTD

SEQ ID NO: 1934618 - protein, 4 aa, Staphylococcus
EDTY

SEQ ID NO: 1934619 - protein, 9 aa, Staphylococcus
EDVASSPNF

SEQ ID NO: 1934620 - protein, 13 aa, Staphylococcus
EDVDDIKPNPDPY

SEQ ID NO: 1934621 - protein, 11 aa, Staphylococcus
EDVDEVKPAPD

SEQ ID NO: 1934622 - protein, 18 aa, Staphylococcus
EDVDPRETTGKYYSPKEF

SEQ ID NO: 1934623 - protein, 5 aa, Staphylococcus
EDVDR

SEQ ID NO: 1934624 - protein, 15 aa, Staphylococcus
EDVEATSESSNENEI

SEQ ID NO: 1934625 - protein, 6 aa, Staphylococcus
EDVGTK

SEQ ID NO: 1934626 - protein, 7 aa, Staphylococcus
EDVGTKA

SEQ ID NO: 1934627 - protein, 7 aa, Staphylococcus
EDVGTRS

SEQ ID NO: 1934628 - protein, 9 aa, Staphylococcus
EDVKKQNDY

SEQ ID NO: 1934629 - protein, 18 aa, Staphylococcus
EDVKKSKLLTKEKYEQRP

SEQ ID NO: 1934630 - protein, 9 aa, Staphylococcus
EDVKPQDTV

SEQ ID NO: 1934631 - protein, 9 aa, Staphylococcus
EDVNAPEAS

SEQ ID NO: 1934632 - protein, 5 aa, Staphylococcus
EDVQP

SEQ ID NO: 1934633 - protein, 6 aa, Staphylococcus
EDVQPH

SEQ ID NO: 1934634 - protein, 5 aa, Staphylococcus
EDVRN

SEQ ID NO: 1934635 - protein, 9 aa, Staphylococcus
EDVRSKGKA

SEQ ID NO: 1934636 - protein, 7 aa, Staphylococcus
EDVRYEN

SEQ ID NO: 1934637 - protein, 8 aa, Staphylococcus
EDVSGTIE

SEQ ID NO: 1934638 - protein, 6 aa, Staphylococcus
EDVSKT

SEQ ID NO: 1934639 - protein, 13 aa, Staphylococcus
EDVSNVKPDPEPY

SEQ ID NO: 1934640 - protein, 8 aa, Staphylococcus
EDVSSQAR

SEQ ID NO: 1934641 - protein, 19 aa, Staphylococcus
EDVTPKDFGRVGAQAAKQA

SEQ ID NO: 1934642 - protein, 9 aa, Staphylococcus
EDVTPQDFG

SEQ ID NO: 1934643 - protein, 19 aa, Staphylococcus
EDVTPSDFGRVGAQAAKQA

SEQ ID NO: 1934644 - protein, 7 aa, Staphylococcus
EDVTSGE

SEQ ID NO: 1934645 - protein, 4 aa, Staphylococcus
EDYA

SEQ ID NO: 1934646 - protein, 6 aa, Staphylococcus
EDYDIS

SEQ ID NO: 1934647 - protein, 11 aa, Staphylococcus
EDYDKEEFSRI

SEQ ID NO: 1934648 - protein, 13 aa, Staphylococcus
EDYDTADKNKAIQ

SEQ ID NO: 1934649 - protein, 26 aa, Staphylococcus
EDYEGHKLDTSTYTYKEPEQKSDGSW

SEQ ID NO: 1934650 - protein, 7 aa, Staphylococcus
EDYENGI

SEQ ID NO: 1934651 - protein, 6 aa, Staphylococcus
EDYERV

SEQ ID NO: 1934652 - protein, 14 aa, Staphylococcus
EDYFSREAADLKTD

SEQ ID NO: 1934653 - protein, 4 aa, Staphylococcus
EDYG

SEQ ID NO: 1934654 - protein, 4 aa, Staphylococcus
EDYK

SEQ ID NO: 1934655 - protein, 19 aa, Staphylococcus
EDYKTLKEQADFGKRMEPE

SEQ ID NO: 1934656 - protein, 4 aa, Staphylococcus
EDYN

SEQ ID NO: 1934657 - protein, 7 aa, Staphylococcus
EDYPEAK

SEQ ID NO: 1934658 - protein, 5 aa, Staphylococcus
EDYPH

SEQ ID NO: 1934659 - protein, 6 aa, Staphylococcus
EDYPNA

SEQ ID NO: 1934660 - protein, 6 aa, Staphylococcus
EDYPNV

SEQ ID NO: 1934661 - protein, 6 aa, Staphylococcus
EDYPNY

SEQ ID NO: 1934662 - protein, 8 aa, Staphylococcus
EDYPTQGV

SEQ ID NO: 1934663 - protein, 7 aa, Staphylococcus
EDYQQQT

SEQ ID NO: 1934664 - protein, 5 aa, Staphylococcus
EDYQS

SEQ ID NO: 1934665 - protein, 6 aa, Staphylococcus
EDYTFS

SEQ ID NO: 1934666 - protein, 8 aa, Staphylococcus
EEAAKAET

SEQ ID NO: 1934667 - protein, 11 aa, Staphylococcus
EEAANEVVGES

SEQ ID NO: 1934668 - protein, 14 aa, Staphylococcus
EEAAQLKQEHQTQS

SEQ ID NO: 1934669 - protein, 7 aa, Staphylococcus
EEADAQE

SEQ ID NO: 1934670 - protein, 9 aa, Staphylococcus
EEADDAMEE

SEQ ID NO: 1934671 - protein, 8 aa, Staphylococcus
EEADNGDI

SEQ ID NO: 1934672 - protein, 8 aa, Staphylococcus
EEAENISE

SEQ ID NO: 1934673 - protein, 14 aa, Staphylococcus
EEAEQLKTQSMVSH

SEQ ID NO: 1934674 - protein, 6 aa, Staphylococcus
EEAERY

SEQ ID NO: 1934675 - protein, 10 aa, Staphylococcus
EEAGEAPGTL

SEQ ID NO: 1934676 - protein, 8 aa, Staphylococcus
EEAGEIEG

SEQ ID NO: 1934677 - protein, 17 aa, Staphylococcus
EEAGEPLTATRMNDEYA

SEQ ID NO: 1934678 - protein, 13 aa, Staphylococcus
EEAGEPLTPTRMN

SEQ ID NO: 1934679 - protein, 16 aa, Staphylococcus
EEAGEPLTPTRMNEEY

SEQ ID NO: 1934680 - protein, 16 aa, Staphylococcus
EEAGEPLTSTRMNEEY

SEQ ID NO: 1934681 - protein, 5 aa, Staphylococcus
EEAGH

SEQ ID NO: 1934682 - protein, 10 aa, Staphylococcus
EEAGINATKD

SEQ ID NO: 1934683 - protein, 13 aa, Staphylococcus
EEAGLKGAKELDQ

SEQ ID NO: 1934684 - protein, 5 aa, Staphylococcus
EEAGQ

SEQ ID NO: 1934685 - protein, 7 aa, Staphylococcus
EEAHGNE

SEQ ID NO: 1934686 - protein, 5 aa, Staphylococcus
EEAHQ

SEQ ID NO: 1934687 - protein, 4 aa, Staphylococcus
EEAI

SEQ ID NO: 1934688 - protein, 18 aa, Staphylococcus
EEAINNGAEYITTSNQKL

SEQ ID NO: 1934689 - protein, 7 aa, Staphylococcus
EEAIQGA

SEQ ID NO: 1934690 - protein, 11 aa, Staphylococcus
EEAKAQSEQGK

SEQ ID NO: 1934691 - protein, 8 aa, Staphylococcus
EEAKASGA

SEQ ID NO: 1934692 - protein, 7 aa, Staphylococcus
EEAKEAV

SEQ ID NO: 1934693 - protein, 10 aa, Staphylococcus
EEAKEETGAN

SEQ ID NO: 1934694 - protein, 10 aa, Staphylococcus
EEAKENDQYT

SEQ ID NO: 1934695 - protein, 8 aa, Staphylococcus
EEAKHGEI

SEQ ID NO: 1934696 - protein, 12 aa, Staphylococcus
EEAKKSLDNTPN

SEQ ID NO: 1934697 - protein, 16 aa, Staphylococcus
EEAKNDVSKKLKNARG

SEQ ID NO: 1934698 - protein, 8 aa, Staphylococcus
EEAKRLEE

SEQ ID NO: 1934699 - protein, 11 aa, Staphylococcus
EEAKVQAENGD

SEQ ID NO: 1934700 - protein, 15 aa, Staphylococcus
EEALGKALKNSGVPR

SEQ ID NO: 1934701 - protein, 11 aa, Staphylococcus
EEALPEGGASL

SEQ ID NO: 1934702 - protein, 11 aa, Staphylococcus
EEAMPEEKGAL

SEQ ID NO: 1934703 - protein, 11 aa, Staphylococcus
EEANEAVERGA

SEQ ID NO: 1934704 - protein, 20 aa, Staphylococcus
EEANVSADTRVKDLTDDELG

SEQ ID NO: 1934705 - protein, 4 aa, Staphylococcus
EEAP

SEQ ID NO: 1934706 - protein, 8 aa, Staphylococcus
EEAPKDID

SEQ ID NO: 1934707 - protein, 13 aa, Staphylococcus
EEAPNDIDNWEQD

SEQ ID NO: 1934708 - protein, 23 aa, Staphylococcus
EEAPSPILSEEKRQEMGNAAVRA

SEQ ID NO: 1934709 - protein, 18 aa, Staphylococcus
EEAPSPILSEETRQEMGN

SEQ ID NO: 1934710 - protein, 9 aa, Staphylococcus
EEAPSPILT

SEQ ID NO: 1934711 - protein, 24 aa, Staphylococcus
EEAPSPILTEEKRQEMGNAAVRAA

SEQ ID NO: 1934712 - protein, 4 aa, Staphylococcus
EEAQ

SEQ ID NO: 1934713 - protein, 10 aa, Staphylococcus
EEAQDHQIQE

SEQ ID NO: 1934714 - protein, 10 aa, Staphylococcus
EEAQKETGAT

SEQ ID NO: 1934715 - protein, 7 aa, Staphylococcus
EEAQPAT

SEQ ID NO: 1934716 - protein, 8 aa, Staphylococcus
EEAQQKGV

SEQ ID NO: 1934717 - protein, 4 aa, Staphylococcus
EEAS

SEQ ID NO: 1934718 - protein, 14 aa, Staphylococcus
EEASEEIKTRIFNL

SEQ ID NO: 1934719 - protein, 14 aa, Staphylococcus
EEASHTIKTRIFNL

SEQ ID NO: 1934720 - protein, 11 aa, Staphylococcus
EEASLKEGEIE

SEQ ID NO: 1934721 - protein, 11 aa, Staphylococcus
EEASVAEGTIH

SEQ ID NO: 1934722 - protein, 57 aa, Staphylococcus
EEASYNDLDNDKNYETSEYNANYGSRTYDTQDDDSTRNLVDNSGKRHRRRRSSQMRE

SEQ ID NO: 1934723 - protein, 5 aa, Staphylococcus
EEATI

SEQ ID NO: 1934724 - protein, 8 aa, Staphylococcus
EEATTVTE

SEQ ID NO: 1934725 - protein, 8 aa, Staphylococcus
EEAVDPDD

SEQ ID NO: 1934726 - protein, 9 aa, Staphylococcus
EEAVDPDDV

SEQ ID NO: 1934727 - protein, 6 aa, Staphylococcus
EEAVGQ

SEQ ID NO: 1934728 - protein, 5 aa, Staphylococcus
EEAVK

SEQ ID NO: 1934729 - protein, 10 aa, Staphylococcus
EEAVQATKEG

SEQ ID NO: 1934730 - protein, 13 aa, Staphylococcus
EEAYQDEQGDSER

SEQ ID NO: 1934731 - protein, 14 aa, Staphylococcus
EEAYQDETGEDSER

SEQ ID NO: 1934732 - protein, 22 aa, Staphylococcus
EECENRDPKGLYKKARSGEIPE

SEQ ID NO: 1934733 - protein, 4 aa, Staphylococcus
EECG

SEQ ID NO: 1934734 - protein, 11 aa, Staphylococcus
EECNQQENTQK

SEQ ID NO: 1934735 - protein, 12 aa, Staphylococcus
EECTDKEKQEIK

SEQ ID NO: 1934736 - protein, 4 aa, Staphylococcus
EEDA

SEQ ID NO: 1934737 - protein, 11 aa, Staphylococcus
EEDAYKINDEY

SEQ ID NO: 1934738 - protein, 5 aa, Staphylococcus
EEDCR

SEQ ID NO: 1934739 - protein, 4 aa, Staphylococcus
EEDD

SEQ ID NO: 1934740 - protein, 23 aa, Staphylococcus
EEDDDDDIAEEEEEEFEDEEDFN

SEQ ID NO: 1934741 - protein, 23 aa, Staphylococcus
EEDDDDDIAEGEEEAFEDAEDFN

SEQ ID NO: 1934742 - protein, 7 aa, Staphylococcus
EEDDNLD

SEQ ID NO: 1934743 - protein, 5 aa, Staphylococcus
EEDDQ

SEQ ID NO: 1934744 - protein, 8 aa, Staphylococcus
EEDDTDMK

SEQ ID NO: 1934745 - protein, 7 aa, Staphylococcus
EEDEALD

SEQ ID NO: 1934746 - protein, 20 aa, Staphylococcus
EEDEDEDDDFDDEEEEEEYQ

SEQ ID NO: 1934747 - protein, 17 aa, Staphylococcus
EEDEEQYYNNERDAKQA

SEQ ID NO: 1934748 - protein, 6 aa, Staphylococcus
EEDEHN

SEQ ID NO: 1934749 - protein, 5 aa, Staphylococcus
EEDEL

SEQ ID NO: 1934750 - protein, 13 aa, Staphylococcus
EEDESKNAERRLQ

SEQ ID NO: 1934751 - protein, 56 aa, Staphylococcus
EEDEVADNQQQSKTKRAQAEPEAERPTQQDSYYEPTQQQQSSQQSNNHQYNERQRA

SEQ ID NO: 1934752 - protein, 4 aa, Staphylococcus
EEDF

SEQ ID NO: 1934753 - protein, 11 aa, Staphylococcus
EEDGESIGQHP

SEQ ID NO: 1934754 - protein, 16 aa, Staphylococcus
EEDGKTYEQRASTSAL

SEQ ID NO: 1934755 - protein, 11 aa, Staphylococcus
EEDGLAKSSRN

SEQ ID NO: 1934756 - protein, 5 aa, Staphylococcus
EEDHG

SEQ ID NO: 1934757 - protein, 13 aa, Staphylococcus
EEDIKDKMSTSRS

SEQ ID NO: 1934758 - protein, 16 aa, Staphylococcus
EEDIQQYKQNEKDAEQ

SEQ ID NO: 1934759 - protein, 7 aa, Staphylococcus
EEDITET

SEQ ID NO: 1934760 - protein, 13 aa, Staphylococcus
EEDKAVGQQRKNG

SEQ ID NO: 1934761 - protein, 17 aa, Staphylococcus
EEDKELEEDKEIDKEDV

SEQ ID NO: 1934762 - protein, 8 aa, Staphylococcus
EEDKNQLY

SEQ ID NO: 1934763 - protein, 11 aa, Staphylococcus
EEDKSNNNWGN

SEQ ID NO: 1934764 - protein, 13 aa, Staphylococcus
EEDNDWKETPTVT

SEQ ID NO: 1934765 - protein, 7 aa, Staphylococcus
EEDNIPK

SEQ ID NO: 1934766 - protein, 4 aa, Staphylococcus
EEDP

SEQ ID NO: 1934767 - protein, 8 aa, Staphylococcus
EEDPENEA

SEQ ID NO: 1934768 - protein, 6 aa, Staphylococcus
EEDPIL

SEQ ID NO: 1934769 - protein, 9 aa, Staphylococcus
EEDPIRGRE

SEQ ID NO: 1934770 - protein, 8 aa, Staphylococcus
EEDPTITE

SEQ ID NO: 1934771 - protein, 13 aa, Staphylococcus
EEDQASQTDGLGA

SEQ ID NO: 1934772 - protein, 6 aa, Staphylococcus
EEDQEA

SEQ ID NO: 1934773 - protein, 5 aa, Staphylococcus
EEDRN

SEQ ID NO: 1934774 - protein, 24 aa, Staphylococcus
EEDRNYARESIAKDKNINELETEI

SEQ ID NO: 1934775 - protein, 10 aa, Staphylococcus
EEDSAQYKNT

SEQ ID NO: 1934776 - protein, 7 aa, Staphylococcus
EEDSDTI

SEQ ID NO: 1934777 - protein, 18 aa, Staphylococcus
EEDTDSINTSSNTSINTK

SEQ ID NO: 1934778 - protein, 10 aa, Staphylococcus
EEDTPQPNPF

SEQ ID NO: 1934779 - protein, 5 aa, Staphylococcus
EEDTR

SEQ ID NO: 1934780 - protein, 6 aa, Staphylococcus
EEDTSK

SEQ ID NO: 1934781 - protein, 7 aa, Staphylococcus
EEDTTGT

SEQ ID NO: 1934782 - protein, 12 aa, Staphylococcus
EEDVKDIADAEG

SEQ ID NO: 1934783 - protein, 20 aa, Staphylococcus
EEDVTPKDFGRVGAQAAKQA

SEQ ID NO: 1934784 - protein, 4 aa, Staphylococcus
EEDY

SEQ ID NO: 1934785 - protein, 5 aa, Staphylococcus
EEDYN

SEQ ID NO: 1934786 - protein, 8 aa, Staphylococcus
EEDYTLNS

SEQ ID NO: 1934787 - protein, 16 aa, Staphylococcus
EEEADDIENTAEQAVE

SEQ ID NO: 1934788 - protein, 11 aa, Staphylococcus
EEEADPDAIER

SEQ ID NO: 1934789 - protein, 16 aa, Staphylococcus
EEEAKVTLTSQGATKI

SEQ ID NO: 1934790 - protein, 18 aa, Staphylococcus
EEEATEIEQAAEQAVEDS

SEQ ID NO: 1934791 - protein, 13 aa, Staphylococcus
EEEDFNDDPDDDK

SEQ ID NO: 1934792 - protein, 5 aa, Staphylococcus
EEEEE

SEQ ID NO: 1934793 - protein, 7 aa, Staphylococcus
EEEEPVD

SEQ ID NO: 1934794 - protein, 6 aa, Staphylococcus
EEEESI

SEQ ID NO: 1934795 - protein, 21 aa, Staphylococcus
EEEETQVKDGKAKKLTKKTFP

SEQ ID NO: 1934796 - protein, 21 aa, Staphylococcus
EEEETQVKDGKAKKQLKKTFP

SEQ ID NO: 1934797 - protein, 21 aa, Staphylococcus
EEEETQVKDGKAKKQVKKTFP

SEQ ID NO: 1934798 - protein, 16 aa, Staphylococcus
EEEETQVKDGKAKKVV

SEQ ID NO: 1934799 - protein, 21 aa, Staphylococcus
EEEETQVKDGKAKTLTKKTFP

SEQ ID NO: 1934800 - protein, 19 aa, Staphylococcus
EEEFDKPINDFSGGQKTRL

SEQ ID NO: 1934801 - protein, 7 aa, Staphylococcus
EEEFSPE

SEQ ID NO: 1934802 - protein, 4 aa, Staphylococcus
EEEG

SEQ ID NO: 1934803 - protein, 6 aa, Staphylococcus
EEEGSR

SEQ ID NO: 1934804 - protein, 13 aa, Staphylococcus
EEEGTMSQDDFNT

SEQ ID NO: 1934805 - protein, 6 aa, Staphylococcus
EEEIAE

SEQ ID NO: 1934806 - protein, 10 aa, Staphylococcus
EEEIDQVERR

SEQ ID NO: 1934807 - protein, 7 aa, Staphylococcus
EEEIEEP

SEQ ID NO: 1934808 - protein, 7 aa, Staphylococcus
EEEIKDQ

SEQ ID NO: 1934809 - protein, 4 aa, Staphylococcus
EEEK

SEQ ID NO: 1934810 - protein, 24 aa, Staphylococcus
EEEKEVNDAINSGASYVTTSNRKL

SEQ ID NO: 1934811 - protein, 4 aa, Staphylococcus
EEEL

SEQ ID NO: 1934812 - protein, 7 aa, Staphylococcus
EEELEDL

SEQ ID NO: 1934813 - protein, 5 aa, Staphylococcus
EEELH

SEQ ID NO: 1934814 - protein, 12 aa, Staphylococcus
EEELRQTSSHRF

SEQ ID NO: 1934815 - protein, 5 aa, Staphylococcus
EEELS

SEQ ID NO: 1934816 - protein, 7 aa, Staphylococcus
EEENYQN

SEQ ID NO: 1934817 - protein, 7 aa, Staphylococcus
EEEPNTI

SEQ ID NO: 1934818 - protein, 10 aa, Staphylococcus
EEEPPTNSPL

SEQ ID NO: 1934819 - protein, 9 aa, Staphylococcus
EEEPQNNVG

SEQ ID NO: 1934820 - protein, 7 aa, Staphylococcus
EEEQDKQ

SEQ ID NO: 1934821 - protein, 9 aa, Staphylococcus
EEEQDTQAI

SEQ ID NO: 1934822 - protein, 6 aa, Staphylococcus
EEEQTV

SEQ ID NO: 1934823 - protein, 4 aa, Staphylococcus
EEER

SEQ ID NO: 1934824 - protein, 6 aa, Staphylococcus
EEERET

SEQ ID NO: 1934825 - protein, 9 aa, Staphylococcus
EEERNSLTE

SEQ ID NO: 1934826 - protein, 7 aa, Staphylococcus
EEERNTN

SEQ ID NO: 1934827 - protein, 7 aa, Staphylococcus
EEERQEA

SEQ ID NO: 1934828 - protein, 15 aa, Staphylococcus
EEERVADDSDTPTFV

SEQ ID NO: 1934829 - protein, 5 aa, Staphylococcus
EEERY

SEQ ID NO: 1934830 - protein, 13 aa, Staphylococcus
EEESQIKEQQTSH

SEQ ID NO: 1934831 - protein, 7 aa, Staphylococcus
EEESSNY

SEQ ID NO: 1934832 - protein, 4 aa, Staphylococcus
EEET

SEQ ID NO: 1934833 - protein, 7 aa, Staphylococcus
EEETAEM

SEQ ID NO: 1934834 - protein, 7 aa, Staphylococcus
EEETPKY

SEQ ID NO: 1934835 - protein, 7 aa, Staphylococcus
EEETSRM

SEQ ID NO: 1934836 - protein, 80 aa, Staphylococcus
EEEVEAPEERETSQTRERAQERDVESRNENNVPSTQSQNNVNKQNAIKSVPQKSTTRKGATSEERNYRMNNNSKSNSRNV

SEQ ID NO: 1934837 - protein, 38 aa, Staphylococcus
EEEVESPAERQQRVTQNEENQNRNMQQQPIERTQNNQN

SEQ ID NO: 1934838 - protein, 13 aa, Staphylococcus
EEEVESPEERQRR

SEQ ID NO: 1934839 - protein, 73 aa, Staphylococcus
EEEVEVPEEREPERDRKPEREVESPKEPVQQPAASKTSAIKSVPQKSTSRYNTTSEERNYRMSNNSKSNTRNV

SEQ ID NO: 1934840 - protein, 57 aa, Staphylococcus
EEEVNSEENVETQKVDNSQDSAGNTDNSEVNEDHLQEDSQEEVQAEDVDPKDEKIQE

SEQ ID NO: 1934841 - protein, 12 aa, Staphylococcus
EEEYKENIRLNY

SEQ ID NO: 1934842 - protein, 12 aa, Staphylococcus
EEFADKAAARFG

SEQ ID NO: 1934843 - protein, 10 aa, Staphylococcus
EEFNGPAGRY

SEQ ID NO: 1934844 - protein, 5 aa, Staphylococcus
EEFSD

SEQ ID NO: 1934845 - protein, 8 aa, Staphylococcus
EEFSEEEY

SEQ ID NO: 1934846 - protein, 27 aa, Staphylococcus
EEFSPLKNKVGKDSVETATEDLKRMSL

SEQ ID NO: 1934847 - protein, 14 aa, Staphylococcus
EEFSPNGSKAPLTV

SEQ ID NO: 1934848 - protein, 5 aa, Staphylococcus
EEFSQ

SEQ ID NO: 1934849 - protein, 4 aa, Staphylococcus
EEFT

SEQ ID NO: 1934850 - protein, 10 aa, Staphylococcus
EEGAQSDDDD

SEQ ID NO: 1934851 - protein, 4 aa, Staphylococcus
EEGD

SEQ ID NO: 1934852 - protein, 10 aa, Staphylococcus
EEGDSIGEHP

SEQ ID NO: 1934853 - protein, 10 aa, Staphylococcus
EEGEAAEDNI

SEQ ID NO: 1934854 - protein, 21 aa, Staphylococcus
EEGEYEYPSEKWTENKPDDGM

SEQ ID NO: 1934855 - protein, 10 aa, Staphylococcus
EEGGITSPSA

SEQ ID NO: 1934856 - protein, 10 aa, Staphylococcus
EEGGLGADQY

SEQ ID NO: 1934857 - protein, 12 aa, Staphylococcus
EEGGSGSQRELG

SEQ ID NO: 1934858 - protein, 5 aa, Staphylococcus
EEGGV

SEQ ID NO: 1934859 - protein, 5 aa, Staphylococcus
EEGHG

SEQ ID NO: 1934860 - protein, 7 aa, Staphylococcus
EEGHGHD

SEQ ID NO: 1934861 - protein, 11 aa, Staphylococcus
EEGHGHNLKDT

SEQ ID NO: 1934862 - protein, 9 aa, Staphylococcus
EEGHMPQEV

SEQ ID NO: 1934863 - protein, 13 aa, Staphylococcus
EEGHRQAKDGEWN

SEQ ID NO: 1934864 - protein, 9 aa, Staphylococcus
EEGHRQAME

SEQ ID NO: 1934865 - protein, 14 aa, Staphylococcus
EEGHTGRMLAFIGR

SEQ ID NO: 1934866 - protein, 7 aa, Staphylococcus
EEGHTQA

SEQ ID NO: 1934867 - protein, 4 aa, Staphylococcus
EEGI

SEQ ID NO: 1934868 - protein, 6 aa, Staphylococcus
EEGIPE

SEQ ID NO: 1934869 - protein, 7 aa, Staphylococcus
EEGIPEE

SEQ ID NO: 1934870 - protein, 9 aa, Staphylococcus
EEGKALGAK

SEQ ID NO: 1934871 - protein, 8 aa, Staphylococcus
EEGKTLGA

SEQ ID NO: 1934872 - protein, 4 aa, Staphylococcus
EEGL

SEQ ID NO: 1934873 - protein, 18 aa, Staphylococcus
EEGLEDPLTGAISDDDTK

SEQ ID NO: 1934874 - protein, 7 aa, Staphylococcus
EEGLKPE

SEQ ID NO: 1934875 - protein, 18 aa, Staphylococcus
EEGLNKPIKNTDISRPGL

SEQ ID NO: 1934876 - protein, 8 aa, Staphylococcus
EEGLNQKL

SEQ ID NO: 1934877 - protein, 18 aa, Staphylococcus
EEGLNRPIKNTDISRPGL

SEQ ID NO: 1934878 - protein, 16 aa, Staphylococcus
EEGMNSTLDQLEKLLK

SEQ ID NO: 1934879 - protein, 5 aa, Staphylococcus
EEGNE

SEQ ID NO: 1934880 - protein, 7 aa, Staphylococcus
EEGNEEA

SEQ ID NO: 1934881 - protein, 7 aa, Staphylococcus
EEGNHLD

SEQ ID NO: 1934882 - protein, 5 aa, Staphylococcus
EEGNI

SEQ ID NO: 1934883 - protein, 19 aa, Staphylococcus
EEGNIKRAVKGEKIGTTIT

SEQ ID NO: 1934884 - protein, 11 aa, Staphylococcus
EEGNLKQRPIK

SEQ ID NO: 1934885 - protein, 5 aa, Staphylococcus
EEGNY

SEQ ID NO: 1934886 - protein, 7 aa, Staphylococcus
EEGNYKG

SEQ ID NO: 1934887 - protein, 11 aa, Staphylococcus
EEGNYSSITSD

SEQ ID NO: 1934888 - protein, 20 aa, Staphylococcus
EEGNYTASYGEVGSVDITVT

SEQ ID NO: 1934889 - protein, 5 aa, Staphylococcus
EEGPA

SEQ ID NO: 1934890 - protein, 4 aa, Staphylococcus
EEGQ

SEQ ID NO: 1934891 - protein, 5 aa, Staphylococcus
EEGQH

SEQ ID NO: 1934892 - protein, 5 aa, Staphylococcus
EEGQI

SEQ ID NO: 1934893 - protein, 5 aa, Staphylococcus
EEGQR

SEQ ID NO: 1934894 - protein, 9 aa, Staphylococcus
EEGRLPNRI

SEQ ID NO: 1934895 - protein, 20 aa, Staphylococcus
EEGRNRSSAIKQVASGRFGV

SEQ ID NO: 1934896 - protein, 5 aa, Staphylococcus
EEGSE

SEQ ID NO: 1934897 - protein, 5 aa, Staphylococcus
EEGSF

SEQ ID NO: 1934898 - protein, 12 aa, Staphylococcus
EEGSKGSQKELG

SEQ ID NO: 1934899 - protein, 8 aa, Staphylococcus
EEGSPQQI

SEQ ID NO: 1934900 - protein, 12 aa, Staphylococcus
EEGSSGSQKDLG

SEQ ID NO: 1934901 - protein, 5 aa, Staphylococcus
EEGSV

SEQ ID NO: 1934902 - protein, 5 aa, Staphylococcus
EEGSY

SEQ ID NO: 1934903 - protein, 7 aa, Staphylococcus
EEGTEVT

SEQ ID NO: 1934904 - protein, 7 aa, Staphylococcus
EEGTTGT

SEQ ID NO: 1934905 - protein, 7 aa, Staphylococcus
EEGTTQK

SEQ ID NO: 1934906 - protein, 20 aa, Staphylococcus
EEGTYTADYDRVGSVTVKVI

SEQ ID NO: 1934907 - protein, 6 aa, Staphylococcus
EEGVAT

SEQ ID NO: 1934908 - protein, 13 aa, Staphylococcus
EEGWGQKEKDVDR

SEQ ID NO: 1934909 - protein, 4 aa, Staphylococcus
EEHD

SEQ ID NO: 1934910 - protein, 5 aa, Staphylococcus
EEHDE

SEQ ID NO: 1934911 - protein, 9 aa, Staphylococcus
EEHDTTHHQ

SEQ ID NO: 1934912 - protein, 5 aa, Staphylococcus
EEHEE

SEQ ID NO: 1934913 - protein, 7 aa, Staphylococcus
EEHEGNN

SEQ ID NO: 1934914 - protein, 6 aa, Staphylococcus
EEHGAI

SEQ ID NO: 1934915 - protein, 7 aa, Staphylococcus
EEHLKSS

SEQ ID NO: 1934916 - protein, 16 aa, Staphylococcus
EEHNGGQPIYQYLFSV

SEQ ID NO: 1934917 - protein, 6 aa, Staphylococcus
EEHPNA

SEQ ID NO: 1934918 - protein, 9 aa, Staphylococcus
EEHQQNRNE

SEQ ID NO: 1934919 - protein, 8 aa, Staphylococcus
EEHQTGEQ

SEQ ID NO: 1934920 - protein, 5 aa, Staphylococcus
EEHRE

SEQ ID NO: 1934921 - protein, 5 aa, Staphylococcus
EEHSE

SEQ ID NO: 1934922 - protein, 4 aa, Staphylococcus
EEIA

SEQ ID NO: 1934923 - protein, 7 aa, Staphylococcus
EEIAEQS

SEQ ID NO: 1934924 - protein, 12 aa, Staphylococcus
EEIAGRPGSIVK

SEQ ID NO: 1934925 - protein, 8 aa, Staphylococcus
EEIANTKA

SEQ ID NO: 1934926 - protein, 5 aa, Staphylococcus
EEIDD

SEQ ID NO: 1934927 - protein, 19 aa, Staphylococcus
EEIDDDKKAEIAQQIQAQF

SEQ ID NO: 1934928 - protein, 8 aa, Staphylococcus
EEIDNDGT

SEQ ID NO: 1934929 - protein, 7 aa, Staphylococcus
EEIDQDN

SEQ ID NO: 1934930 - protein, 17 aa, Staphylococcus
EEIEEEKNRDGSATLEG

SEQ ID NO: 1934931 - protein, 6 aa, Staphylococcus
EEIEEV

SEQ ID NO: 1934932 - protein, 9 aa, Staphylococcus
EEIEPNLEA

SEQ ID NO: 1934933 - protein, 8 aa, Staphylococcus
EEIGGKHG

SEQ ID NO: 1934934 - protein, 13 aa, Staphylococcus
EEIGYGANASIPN

SEQ ID NO: 1934935 - protein, 13 aa, Staphylococcus
EEIGYGANASISD

SEQ ID NO: 1934936 - protein, 13 aa, Staphylococcus
EEIGYGANASISN

SEQ ID NO: 1934937 - protein, 15 aa, Staphylococcus
EEIGYGANASISPKI

SEQ ID NO: 1934938 - protein, 13 aa, Staphylococcus
EEIGYGANASLSE

SEQ ID NO: 1934939 - protein, 13 aa, Staphylococcus
EEIGYGANSSISE

SEQ ID NO: 1934940 - protein, 5 aa, Staphylococcus
EEIIT

SEQ ID NO: 1934941 - protein, 25 aa, Staphylococcus
EEIKAKTSAFQEKLQSEEDIKKQNK

SEQ ID NO: 1934942 - protein, 12 aa, Staphylococcus
EEIKETGSYTHT

SEQ ID NO: 1934943 - protein, 13 aa, Staphylococcus
EEIKNKTKQFQQE

SEQ ID NO: 1934944 - protein, 13 aa, Staphylococcus
EEINEVNPNPNMG

SEQ ID NO: 1934945 - protein, 20 aa, Staphylococcus
EEIPDDFQPEVATPEFRKQF

SEQ ID NO: 1934946 - protein, 7 aa, Staphylococcus
EEIPEDF

SEQ ID NO: 1934947 - protein, 8 aa, Staphylococcus
EEIPEDFQ

SEQ ID NO: 1934948 - protein, 21 aa, Staphylococcus
EEIPEDFQPQVATAELRKQYQ

SEQ ID NO: 1934949 - protein, 7 aa, Staphylococcus
EEIQEAH

SEQ ID NO: 1934950 - protein, 18 aa, Staphylococcus
EEIQEELKQDASLEDHGE

SEQ ID NO: 1934951 - protein, 5 aa, Staphylococcus
EEIQS

SEQ ID NO: 1934952 - protein, 4 aa, Staphylococcus
EEIR

SEQ ID NO: 1934953 - protein, 13 aa, Staphylococcus
EEIREKTKAFQKE

SEQ ID NO: 1934954 - protein, 13 aa, Staphylococcus
EEIRNKTKAFQER

SEQ ID NO: 1934955 - protein, 13 aa, Staphylococcus
EEIRNKTKKFQEE

SEQ ID NO: 1934956 - protein, 15 aa, Staphylococcus
EEIRNKTKKYQEELK

SEQ ID NO: 1934957 - protein, 26 aa, Staphylococcus
EEIRNKTKQFQEEAQAIEDVKKQNDY

SEQ ID NO: 1934958 - protein, 5 aa, Staphylococcus
EEISN

SEQ ID NO: 1934959 - protein, 10 aa, Staphylococcus
EEISNSPYFD

SEQ ID NO: 1934960 - protein, 14 aa, Staphylococcus
EEISPEKEQEVKEK

SEQ ID NO: 1934961 - protein, 5 aa, Staphylococcus
EEITE

SEQ ID NO: 1934962 - protein, 5 aa, Staphylococcus
EEITQ

SEQ ID NO: 1934963 - protein, 6 aa, Staphylococcus
EEKAEG

SEQ ID NO: 1934964 - protein, 15 aa, Staphylococcus
EEKAHNTSKNDYSNV

SEQ ID NO: 1934965 - protein, 19 aa, Staphylococcus
EEKANASDELEAADTSRED

SEQ ID NO: 1934966 - protein, 15 aa, Staphylococcus
EEKAYNTSKNDYNSI

SEQ ID NO: 1934967 - protein, 15 aa, Staphylococcus
EEKAYNTSKNDYSHI

SEQ ID NO: 1934968 - protein, 5 aa, Staphylococcus
EEKDI

SEQ ID NO: 1934969 - protein, 18 aa, Staphylococcus
EEKEENKKEKDQQKNDNC

SEQ ID NO: 1934970 - protein, 10 aa, Staphylococcus
EEKEEQQTLR

SEQ ID NO: 1934971 - protein, 24 aa, Staphylococcus
EEKEKNEEQPFANPRNAAAGSLRQ

SEQ ID NO: 1934972 - protein, 20 aa, Staphylococcus
EEKEREQRIATREEQELRRK

SEQ ID NO: 1934973 - protein, 5 aa, Staphylococcus
EEKEV

SEQ ID NO: 1934974 - protein, 15 aa, Staphylococcus
EEKEYNTSKNDYSEI

SEQ ID NO: 1934975 - protein, 15 aa, Staphylococcus
EEKEYNTSKNDYSSI

SEQ ID NO: 1934976 - protein, 12 aa, Staphylococcus
EEKFRSDDWTYR

SEQ ID NO: 1934977 - protein, 7 aa, Staphylococcus
EEKFSKQ

SEQ ID NO: 1934978 - protein, 20 aa, Staphylococcus
EEKFTKDTYQSINPANTTEV

SEQ ID NO: 1934979 - protein, 4 aa, Staphylococcus
EEKG

SEQ ID NO: 1934980 - protein, 19 aa, Staphylococcus
EEKGDNTISIKKNNDEHQY

SEQ ID NO: 1934981 - protein, 10 aa, Staphylococcus
EEKGEEPNTL

SEQ ID NO: 1934982 - protein, 8 aa, Staphylococcus
EEKGLAQR

SEQ ID NO: 1934983 - protein, 5 aa, Staphylococcus
EEKGY

SEQ ID NO: 1934984 - protein, 4 aa, Staphylococcus
EEKH

SEQ ID NO: 1934985 - protein, 10 aa, Staphylococcus
EEKHASKDDY

SEQ ID NO: 1934986 - protein, 5 aa, Staphylococcus
EEKHR

SEQ ID NO: 1934987 - protein, 4 aa, Staphylococcus
EEKI

SEQ ID NO: 1934988 - protein, 13 aa, Staphylococcus
EEKIKSLAEEKSL

SEQ ID NO: 1934989 - protein, 5 aa, Staphylococcus
EEKIP

SEQ ID NO: 1934990 - protein, 4 aa, Staphylococcus
EEKK

SEQ ID NO: 1934991 - protein, 21 aa, Staphylococcus
EEKKEKIEENKEKNQHKNDGC

SEQ ID NO: 1934992 - protein, 19 aa, Staphylococcus
EEKKEKNEKEQQDNNCCCN

SEQ ID NO: 1934993 - protein, 18 aa, Staphylococcus
EEKKEKNEKEQQDNNCCN

SEQ ID NO: 1934994 - protein, 6 aa, Staphylococcus
EEKKTV

SEQ ID NO: 1934995 - protein, 4 aa, Staphylococcus
EEKL

SEQ ID NO: 1934996 - protein, 10 aa, Staphylococcus
EEKLNKIRKE

SEQ ID NO: 1934997 - protein, 10 aa, Staphylococcus
EEKLNQQLAE

SEQ ID NO: 1934998 - protein, 7 aa, Staphylococcus
EEKLNRI

SEQ ID NO: 1934999 - protein, 6 aa, Staphylococcus
EEKLTQ

SEQ ID NO: 1935000 - protein, 4 aa, Staphylococcus
EEKM

SEQ ID NO: 1935001 - protein, 16 aa, Staphylococcus
EEKMGSYQYEINYKEL

SEQ ID NO: 1935002 - protein, 6 aa, Staphylococcus
EEKNGN

SEQ ID NO: 1935003 - protein, 12 aa, Staphylococcus
EEKNNDEIDPRQ

SEQ ID NO: 1935004 - protein, 11 aa, Staphylococcus
EEKNNDGIEPY

SEQ ID NO: 1935005 - protein, 10 aa, Staphylococcus
EEKNNDLVDA

SEQ ID NO: 1935006 - protein, 5 aa, Staphylococcus
EEKNQ

SEQ ID NO: 1935007 - protein, 8 aa, Staphylococcus
EEKPNPNT

SEQ ID NO: 1935008 - protein, 16 aa, Staphylococcus
EEKPSNEEIIKNNEIS

SEQ ID NO: 1935009 - protein, 4 aa, Staphylococcus
EEKQ

SEQ ID NO: 1935010 - protein, 5 aa, Staphylococcus
EEKQC

SEQ ID NO: 1935011 - protein, 7 aa, Staphylococcus
EEKQCPT

SEQ ID NO: 1935012 - protein, 10 aa, Staphylococcus
EEKQEQQALR

SEQ ID NO: 1935013 - protein, 7 aa, Staphylococcus
EEKQGNL

SEQ ID NO: 1935014 - protein, 9 aa, Staphylococcus
EEKQSYLNQ

SEQ ID NO: 1935015 - protein, 6 aa, Staphylococcus
EEKQTH

SEQ ID NO: 1935016 - protein, 5 aa, Staphylococcus
EEKRC

SEQ ID NO: 1935017 - protein, 6 aa, Staphylococcus
EEKRCP

SEQ ID NO: 1935018 - protein, 7 aa, Staphylococcus
EEKRCPT

SEQ ID NO: 1935019 - protein, 6 aa, Staphylococcus
EEKRDE

SEQ ID NO: 1935020 - protein, 8 aa, Staphylococcus
EEKRGDDL

SEQ ID NO: 1935021 - protein, 16 aa, Staphylococcus
EEKRQAHIQQTKSNPL

SEQ ID NO: 1935022 - protein, 17 aa, Staphylococcus
EEKRQEHIQQTKDNPLT

SEQ ID NO: 1935023 - protein, 16 aa, Staphylococcus
EEKRQEHIRQTNNNPL

SEQ ID NO: 1935024 - protein, 5 aa, Staphylococcus
EEKRT

SEQ ID NO: 1935025 - protein, 9 aa, Staphylococcus
EEKSDSDEL

SEQ ID NO: 1935026 - protein, 11 aa, Staphylococcus
EEKSGFTDADE

SEQ ID NO: 1935027 - protein, 8 aa, Staphylococcus
EEKSGYNS

SEQ ID NO: 1935028 - protein, 12 aa, Staphylococcus
EEKSNSEINAKE

SEQ ID NO: 1935029 - protein, 8 aa, Staphylococcus
EEKSNYNS

SEQ ID NO: 1935030 - protein, 21 aa, Staphylococcus
EEKTDKKDENNEKKENGNKNC

SEQ ID NO: 1935031 - protein, 11 aa, Staphylococcus
EEKTMAQTSKY

SEQ ID NO: 1935032 - protein, 9 aa, Staphylococcus
EEKTTTRVT

SEQ ID NO: 1935033 - protein, 8 aa, Staphylococcus
EEKTVTKG

SEQ ID NO: 1935034 - protein, 6 aa, Staphylococcus
EEKTYT

SEQ ID NO: 1935035 - protein, 11 aa, Staphylococcus
EEKVEDGNEYY

SEQ ID NO: 1935036 - protein, 23 aa, Staphylococcus
EEKVENQGGGTPMGRRGQPAELA

SEQ ID NO: 1935037 - protein, 18 aa, Staphylococcus
EEKVGEGIKAGLESTGLK

SEQ ID NO: 1935038 - protein, 13 aa, Staphylococcus
EEKVKTVSKSSED

SEQ ID NO: 1935039 - protein, 13 aa, Staphylococcus
EEKVNQKKSQNGD

SEQ ID NO: 1935040 - protein, 11 aa, Staphylococcus
EEKVSDDELKR

SEQ ID NO: 1935041 - protein, 9 aa, Staphylococcus
EELAGKEAT

SEQ ID NO: 1935042 - protein, 14 aa, Staphylococcus
EELDDALDRIRSVF

SEQ ID NO: 1935043 - protein, 7 aa, Staphylococcus
EELDDYD

SEQ ID NO: 1935044 - protein, 7 aa, Staphylococcus
EELDEGQ

SEQ ID NO: 1935045 - protein, 6 aa, Staphylococcus
EELDLT

SEQ ID NO: 1935046 - protein, 9 aa, Staphylococcus
EELDQVERR

SEQ ID NO: 1935047 - protein, 14 aa, Staphylococcus
EELDRFKNNSTKKL

SEQ ID NO: 1935048 - protein, 6 aa, Staphylococcus
EELDTT

SEQ ID NO: 1935049 - protein, 5 aa, Staphylococcus
EELEE

SEQ ID NO: 1935050 - protein, 5 aa, Staphylococcus
EELEK

SEQ ID NO: 1935051 - protein, 7 aa, Staphylococcus
EELEKYK

SEQ ID NO: 1935052 - protein, 12 aa, Staphylococcus
EELERKGQSYTY

SEQ ID NO: 1935053 - protein, 5 aa, Staphylococcus
EELGF

SEQ ID NO: 1935054 - protein, 6 aa, Staphylococcus
EELGFK

SEQ ID NO: 1935055 - protein, 5 aa, Staphylococcus
EELGH

SEQ ID NO: 1935056 - protein, 12 aa, Staphylococcus
EELGQALGKSSR

SEQ ID NO: 1935057 - protein, 7 aa, Staphylococcus
EELGQQG

SEQ ID NO: 1935058 - protein, 12 aa, Staphylococcus
EELHEKEDESHV

SEQ ID NO: 1935059 - protein, 4 aa, Staphylococcus
EELK

SEQ ID NO: 1935060 - protein, 6 aa, Staphylococcus
EELKEQ

SEQ ID NO: 1935061 - protein, 6 aa, Staphylococcus
EELKQG

SEQ ID NO: 1935062 - protein, 14 aa, Staphylococcus
EELKVKETNRIDTT

SEQ ID NO: 1935063 - protein, 4 aa, Staphylococcus
EELN

SEQ ID NO: 1935064 - protein, 13 aa, Staphylococcus
EELNKMGEKDPKL

SEQ ID NO: 1935065 - protein, 11 aa, Staphylococcus
EELNQDDTIES

SEQ ID NO: 1935066 - protein, 13 aa, Staphylococcus
EELNTTYETAEKI

SEQ ID NO: 1935067 - protein, 4 aa, Staphylococcus
EELP

SEQ ID NO: 1935068 - protein, 22 aa, Staphylococcus
EELPEDFQPQVATDEFKSQYQA

SEQ ID NO: 1935069 - protein, 8 aa, Staphylococcus
EELPNNAR

SEQ ID NO: 1935070 - protein, 10 aa, Staphylococcus
EELPQPLNEK

SEQ ID NO: 1935071 - protein, 5 aa, Staphylococcus
EELPS

SEQ ID NO: 1935072 - protein, 13 aa, Staphylococcus
EELPSTEEDNEEI

SEQ ID NO: 1935073 - protein, 4 aa, Staphylococcus
EELQ

SEQ ID NO: 1935074 - protein, 15 aa, Staphylococcus
EELQPGKIRNSNGPM

SEQ ID NO: 1935075 - protein, 19 aa, Staphylococcus
EELQRKKIKDTNVGKELQD

SEQ ID NO: 1935076 - protein, 16 aa, Staphylococcus
EELQRKKIRDTNDGYH

SEQ ID NO: 1935077 - protein, 15 aa, Staphylococcus
EELQRKKIRDTNVGK

SEQ ID NO: 1935078 - protein, 7 aa, Staphylococcus
EELQSEF

SEQ ID NO: 1935079 - protein, 4 aa, Staphylococcus
EELR

SEQ ID NO: 1935080 - protein, 22 aa, Staphylococcus
EELRQNDSNTNEKEQKEPKQKS

SEQ ID NO: 1935081 - protein, 5 aa, Staphylococcus
EELRS

SEQ ID NO: 1935082 - protein, 4 aa, Staphylococcus
EELS

SEQ ID NO: 1935083 - protein, 5 aa, Staphylococcus
EELSE

SEQ ID NO: 1935084 - protein, 16 aa, Staphylococcus
EELSEANLQDGEIDQL

SEQ ID NO: 1935085 - protein, 7 aa, Staphylococcus
EELSETG

SEQ ID NO: 1935086 - protein, 57 aa, Staphylococcus
EELSNEKEKQASLQSRVEQEKEKIAKLQEKRAELDESRKALEDAQTNNNLEKAAELQ

SEQ ID NO: 1935087 - protein, 57 aa, Staphylococcus
EELSNEKEKQASLQSRVEQEKEKIAKVQEKRAELDRSRQALEDAQTEGNLEKAAELQ

SEQ ID NO: 1935088 - protein, 55 aa, Staphylococcus
EELSNEKEKQASLQSRVEQEKEKIAKVQEKRAELDRSRQALEDAQTKGDLEKAAE

SEQ ID NO: 1935089 - protein, 57 aa, Staphylococcus
EELSNEKEKQASLQSRVEQEKEKIANVQEKRAELDRSRQALEDAQTEGNLEKAAELQ

SEQ ID NO: 1935090 - protein, 57 aa, Staphylococcus
EELSNEKEKQTSLQSRVEQEKEKIAKVQEKRAELDRSRQALEDAQTESNYEKAAELQ

SEQ ID NO: 1935091 - protein, 6 aa, Staphylococcus
EELTQY

SEQ ID NO: 1935092 - protein, 19 aa, Staphylococcus
EELTRKKIKDTNVGQELQS

SEQ ID NO: 1935093 - protein, 8 aa, Staphylococcus
EELYQKET

SEQ ID NO: 1935094 - protein, 19 aa, Staphylococcus
EEMEQAGSSQLYEKGYADD

SEQ ID NO: 1935095 - protein, 5 aa, Staphylococcus
EEMGE

SEQ ID NO: 1935096 - protein, 5 aa, Staphylococcus
EEMKQ

SEQ ID NO: 1935097 - protein, 21 aa, Staphylococcus
EEMPNDFQPQVATPQLRERYS

SEQ ID NO: 1935098 - protein, 23 aa, Staphylococcus
EEMQQQRDRARQARQNSQSMQVQ

SEQ ID NO: 1935099 - protein, 5 aa, Staphylococcus
EEMRE

SEQ ID NO: 1935100 - protein, 4 aa, Staphylococcus
EENA

SEQ ID NO: 1935101 - protein, 13 aa, Staphylococcus
EENADTKTSQPAI

SEQ ID NO: 1935102 - protein, 13 aa, Staphylococcus
EENADVKTSQPSI

SEQ ID NO: 1935103 - protein, 7 aa, Staphylococcus
EENAGDR

SEQ ID NO: 1935104 - protein, 5 aa, Staphylococcus
EENAN

SEQ ID NO: 1935105 - protein, 5 aa, Staphylococcus
EENAR

SEQ ID NO: 1935106 - protein, 6 aa, Staphylococcus
EENDTV

SEQ ID NO: 1935107 - protein, 12 aa, Staphylococcus
EENDWRDNPRVS

SEQ ID NO: 1935108 - protein, 6 aa, Staphylococcus
EENEAT

SEQ ID NO: 1935109 - protein, 6 aa, Staphylococcus
EENEHR

SEQ ID NO: 1935110 - protein, 7 aa, Staphylococcus
EENENGE

SEQ ID NO: 1935111 - protein, 8 aa, Staphylococcus
EENESERE

SEQ ID NO: 1935112 - protein, 8 aa, Staphylococcus
EENESNGV

SEQ ID NO: 1935113 - protein, 10 aa, Staphylococcus
EENEYKGEKQ

SEQ ID NO: 1935114 - protein, 7 aa, Staphylococcus
EENFKDA

SEQ ID NO: 1935115 - protein, 4 aa, Staphylococcus
EENG

SEQ ID NO: 1935116 - protein, 6 aa, Staphylococcus
EENGAL

SEQ ID NO: 1935117 - protein, 7 aa, Staphylococcus
EENGERP

SEQ ID NO: 1935118 - protein, 10 aa, Staphylococcus
EENGKSNFLP

SEQ ID NO: 1935119 - protein, 13 aa, Staphylococcus
EENGKTSFEPSDL

SEQ ID NO: 1935120 - protein, 17 aa, Staphylococcus
EENGSVAGKLTGGGRGG

SEQ ID NO: 1935121 - protein, 5 aa, Staphylococcus
EENGT

SEQ ID NO: 1935122 - protein, 12 aa, Staphylococcus
EENGTEHEGELD

SEQ ID NO: 1935123 - protein, 7 aa, Staphylococcus
EENHGNK

SEQ ID NO: 1935124 - protein, 16 aa, Staphylococcus
EENISKARNELNGTFN

SEQ ID NO: 1935125 - protein, 4 aa, Staphylococcus
EENK

SEQ ID NO: 1935126 - protein, 5 aa, Staphylococcus
EENKL

SEQ ID NO: 1935127 - protein, 4 aa, Staphylococcus
EENL

SEQ ID NO: 1935128 - protein, 4 aa, Staphylococcus
EENN

SEQ ID NO: 1935129 - protein, 8 aa, Staphylococcus
EENNGNRI

SEQ ID NO: 1935130 - protein, 15 aa, Staphylococcus
EENNKALRSKYGIDE

SEQ ID NO: 1935131 - protein, 22 aa, Staphylococcus
EENNTSVSTSPNSDDDYTQTQK

SEQ ID NO: 1935132 - protein, 11 aa, Staphylococcus
EENPDLPRPVG

SEQ ID NO: 1935133 - protein, 8 aa, Staphylococcus
EENPNAVE

SEQ ID NO: 1935134 - protein, 41 aa, Staphylococcus
EENPNSKKNKNKRTQIQQQVDSNERKLNETKNKIAEEGETL

SEQ ID NO: 1935135 - protein, 9 aa, Staphylococcus
EENQNVDEN

SEQ ID NO: 1935136 - protein, 5 aa, Staphylococcus
EENQT

SEQ ID NO: 1935137 - protein, 4 aa, Staphylococcus
EENR

SEQ ID NO: 1935138 - protein, 17 aa, Staphylococcus
EENRRLQEEVNQFRRRE

SEQ ID NO: 1935139 - protein, 17 aa, Staphylococcus
EENRRLQQEINQFKQSE

SEQ ID NO: 1935140 - protein, 5 aa, Staphylococcus
EENSA

SEQ ID NO: 1935141 - protein, 6 aa, Staphylococcus
EENSDI

SEQ ID NO: 1935142 - protein, 13 aa, Staphylococcus
EENSFNTNDETKV

SEQ ID NO: 1935143 - protein, 5 aa, Staphylococcus
EENSY

SEQ ID NO: 1935144 - protein, 13 aa, Staphylococcus
EENTGSPSTPRNV

SEQ ID NO: 1935145 - protein, 9 aa, Staphylococcus
EENTLTETQ

SEQ ID NO: 1935146 - protein, 9 aa, Staphylococcus
EENTSSTPK

SEQ ID NO: 1935147 - protein, 11 aa, Staphylococcus
EENTTQAGTEY

SEQ ID NO: 1935148 - protein, 6 aa, Staphylococcus
EENVQR

SEQ ID NO: 1935149 - protein, 23 aa, Staphylococcus
EEPELQQKYAQNSIESSKNFSKD

SEQ ID NO: 1935150 - protein, 6 aa, Staphylococcus
EEPINE

SEQ ID NO: 1935151 - protein, 8 aa, Staphylococcus
EEPKNQGA

SEQ ID NO: 1935152 - protein, 5 aa, Staphylococcus
EEPKY

SEQ ID NO: 1935153 - protein, 6 aa, Staphylococcus
EEPPIS

SEQ ID NO: 1935154 - protein, 4 aa, Staphylococcus
EEPQ

SEQ ID NO: 1935155 - protein, 7 aa, Staphylococcus
EEPQNQG

SEQ ID NO: 1935156 - protein, 8 aa, Staphylococcus
EEPQNQGA

SEQ ID NO: 1935157 - protein, 6 aa, Staphylococcus
EEPRHG

SEQ ID NO: 1935158 - protein, 9 aa, Staphylococcus
EEPSDDPQM

SEQ ID NO: 1935159 - protein, 5 aa, Staphylococcus
EEPTA

SEQ ID NO: 1935160 - protein, 10 aa, Staphylococcus
EEPTPIQTDS

SEQ ID NO: 1935161 - protein, 7 aa, Staphylococcus
EEPTSGE

SEQ ID NO: 1935162 - protein, 5 aa, Staphylococcus
EEPTT

SEQ ID NO: 1935163 - protein, 12 aa, Staphylococcus
EEPTVNITEEQR

SEQ ID NO: 1935164 - protein, 19 aa, Staphylococcus
EEQAGEKEIHPTDQRFIIK

SEQ ID NO: 1935165 - protein, 10 aa, Staphylococcus
EEQAGHPIEK

SEQ ID NO: 1935166 - protein, 13 aa, Staphylococcus
EEQAKNHKDNPFD

SEQ ID NO: 1935167 - protein, 12 aa, Staphylococcus
EEQAKNHPDNPF

SEQ ID NO: 1935168 - protein, 11 aa, Staphylococcus
EEQAKNHPHNP

SEQ ID NO: 1935169 - protein, 7 aa, Staphylococcus
EEQAKQL

SEQ ID NO: 1935170 - protein, 7 aa, Staphylococcus
EEQAQEQ

SEQ ID NO: 1935171 - protein, 9 aa, Staphylococcus
EEQEASPKY

SEQ ID NO: 1935172 - protein, 7 aa, Staphylococcus
EEQEQEM

SEQ ID NO: 1935173 - protein, 6 aa, Staphylococcus
EEQERE

SEQ ID NO: 1935174 - protein, 7 aa, Staphylococcus
EEQEREM

SEQ ID NO: 1935175 - protein, 10 aa, Staphylococcus
EEQGKVTTHS

SEQ ID NO: 1935176 - protein, 6 aa, Staphylococcus
EEQGLT

SEQ ID NO: 1935177 - protein, 13 aa, Staphylococcus
EEQGTMNEDDFKT

SEQ ID NO: 1935178 - protein, 13 aa, Staphylococcus
EEQGTMSKEDFET

SEQ ID NO: 1935179 - protein, 13 aa, Staphylococcus
EEQGTMSKEDFKT

SEQ ID NO: 1935180 - protein, 10 aa, Staphylococcus
EEQGTMSPED

SEQ ID NO: 1935181 - protein, 7 aa, Staphylococcus
EEQHGHQ

SEQ ID NO: 1935182 - protein, 4 aa, Staphylococcus
EEQI

SEQ ID NO: 1935183 - protein, 6 aa, Staphylococcus
EEQKEL

SEQ ID NO: 1935184 - protein, 9 aa, Staphylococcus
EEQKKAAEL

SEQ ID NO: 1935185 - protein, 7 aa, Staphylococcus
EEQKRYK

SEQ ID NO: 1935186 - protein, 19 aa, Staphylococcus
EEQLETAAERLATLANLYE

SEQ ID NO: 1935187 - protein, 7 aa, Staphylococcus
EEQNEFK

SEQ ID NO: 1935188 - protein, 5 aa, Staphylococcus
EEQNK

SEQ ID NO: 1935189 - protein, 4 aa, Staphylococcus
EEQP

SEQ ID NO: 1935190 - protein, 6 aa, Staphylococcus
EEQQDE

SEQ ID NO: 1935191 - protein, 8 aa, Staphylococcus
EEQQTKGH

SEQ ID NO: 1935192 - protein, 5 aa, Staphylococcus
EEQRI

SEQ ID NO: 1935193 - protein, 6 aa, Staphylococcus
EEQRLQ

SEQ ID NO: 1935194 - protein, 4 aa, Staphylococcus
EEQS

SEQ ID NO: 1935195 - protein, 12 aa, Staphylococcus
EEQSKPDGSFPT

SEQ ID NO: 1935196 - protein, 7 aa, Staphylococcus
EEQSSGH

SEQ ID NO: 1935197 - protein, 24 aa, Staphylococcus
EEQTNYSDMKASELKELAKERDIE

SEQ ID NO: 1935198 - protein, 6 aa, Staphylococcus
EEQVPT

SEQ ID NO: 1935199 - protein, 6 aa, Staphylococcus
EEQVQQ

SEQ ID NO: 1935200 - protein, 4 aa, Staphylococcus
EEQY

SEQ ID NO: 1935201 - protein, 6 aa, Staphylococcus
EEQYGR

SEQ ID NO: 1935202 - protein, 5 aa, Staphylococcus
EEQYR

SEQ ID NO: 1935203 - protein, 8 aa, Staphylococcus
EEQYSKNY

SEQ ID NO: 1935204 - protein, 11 aa, Staphylococcus
EERAEKEGYEG

SEQ ID NO: 1935205 - protein, 19 aa, Staphylococcus
EERAERRQKDNEQRGIESN

SEQ ID NO: 1935206 - protein, 21 aa, Staphylococcus
EERAERRQKENEENGIPSSLN

SEQ ID NO: 1935207 - protein, 21 aa, Staphylococcus
EERAERRQKENEQRGIPSTLS

SEQ ID NO: 1935208 - protein, 9 aa, Staphylococcus
EERAKAEGY

SEQ ID NO: 1935209 - protein, 6 aa, Staphylococcus
EERAKM

SEQ ID NO: 1935210 - protein, 10 aa, Staphylococcus
EERAKSEGYT

SEQ ID NO: 1935211 - protein, 10 aa, Staphylococcus
EERAKTQDYT

SEQ ID NO: 1935212 - protein, 19 aa, Staphylococcus
EERAPLKRNVDQEEVGKTA

SEQ ID NO: 1935213 - protein, 19 aa, Staphylococcus
EERAPLRRNVDQEEVGKTA

SEQ ID NO: 1935214 - protein, 7 aa, Staphylococcus
EERDNKY

SEQ ID NO: 1935215 - protein, 11 aa, Staphylococcus
EERDNKYPVYE

SEQ ID NO: 1935216 - protein, 23 aa, Staphylococcus
EERDNPNATELSKDEKDEQFEKD

SEQ ID NO: 1935217 - protein, 4 aa, Staphylococcus
EERE

SEQ ID NO: 1935218 - protein, 5 aa, Staphylococcus
EEREA

SEQ ID NO: 1935219 - protein, 5 aa, Staphylococcus
EEREH

SEQ ID NO: 1935220 - protein, 7 aa, Staphylococcus
EEREIKA

SEQ ID NO: 1935221 - protein, 8 aa, Staphylococcus
EEREIKGE

SEQ ID NO: 1935222 - protein, 5 aa, Staphylococcus
EEREN

SEQ ID NO: 1935223 - protein, 7 aa, Staphylococcus
EERENKY

SEQ ID NO: 1935224 - protein, 8 aa, Staphylococcus
EERENKYP

SEQ ID NO: 1935225 - protein, 7 aa, Staphylococcus
EERENQY

SEQ ID NO: 1935226 - protein, 8 aa, Staphylococcus
EERESGGT

SEQ ID NO: 1935227 - protein, 5 aa, Staphylococcus
EERGL

SEQ ID NO: 1935228 - protein, 7 aa, Staphylococcus
EERGNEA

SEQ ID NO: 1935229 - protein, 5 aa, Staphylococcus
EERGY

SEQ ID NO: 1935230 - protein, 8 aa, Staphylococcus
EERHKGSM

SEQ ID NO: 1935231 - protein, 4 aa, Staphylococcus
EERI

SEQ ID NO: 1935232 - protein, 6 aa, Staphylococcus
EERIEA

SEQ ID NO: 1935233 - protein, 7 aa, Staphylococcus
EERIQYP

SEQ ID NO: 1935234 - protein, 5 aa, Staphylococcus
EERIT

SEQ ID NO: 1935235 - protein, 12 aa, Staphylococcus
EERKKLSKRDGQ

SEQ ID NO: 1935236 - protein, 4 aa, Staphylococcus
EERL

SEQ ID NO: 1935237 - protein, 5 aa, Staphylococcus
EERLT

SEQ ID NO: 1935238 - protein, 4 aa, Staphylococcus
EERN

SEQ ID NO: 1935239 - protein, 6 aa, Staphylococcus
EERNGQ

SEQ ID NO: 1935240 - protein, 9 aa, Staphylococcus
EERQFPNNE

SEQ ID NO: 1935241 - protein, 8 aa, Staphylococcus
EERRGDAL

SEQ ID NO: 1935242 - protein, 7 aa, Staphylococcus
EERRGDD

SEQ ID NO: 1935243 - protein, 9 aa, Staphylococcus
EERRGDDLV

SEQ ID NO: 1935244 - protein, 10 aa, Staphylococcus
EERRKRAQAL

SEQ ID NO: 1935245 - protein, 19 aa, Staphylococcus
EERSDGRLFTGDEGSDCEI

SEQ ID NO: 1935246 - protein, 8 aa, Staphylococcus
EERSGRQA

SEQ ID NO: 1935247 - protein, 19 aa, Staphylococcus
EERSPLRRNVDQEEVGKTA

SEQ ID NO: 1935248 - protein, 6 aa, Staphylococcus
EERVAG

SEQ ID NO: 1935249 - protein, 7 aa, Staphylococcus
EERYIDK

SEQ ID NO: 1935250 - protein, 11 aa, Staphylococcus
EESAKKGEKNQ

SEQ ID NO: 1935251 - protein, 14 aa, Staphylococcus
EESANAIKTRIFNL

SEQ ID NO: 1935252 - protein, 14 aa, Staphylococcus
EESASLKAELPEME

SEQ ID NO: 1935253 - protein, 14 aa, Staphylococcus
EESASLKSAIPELE

SEQ ID NO: 1935254 - protein, 7 aa, Staphylococcus
EESDEGQ

SEQ ID NO: 1935255 - protein, 8 aa, Staphylococcus
EESDEKSI

SEQ ID NO: 1935256 - protein, 13 aa, Staphylococcus
EESDGTVKTSGIK

SEQ ID NO: 1935257 - protein, 8 aa, Staphylococcus
EESDINRS

SEQ ID NO: 1935258 - protein, 4 aa, Staphylococcus
EESE

SEQ ID NO: 1935259 - protein, 6 aa, Staphylococcus
EESEAL

SEQ ID NO: 1935260 - protein, 8 aa, Staphylococcus
EESEDKSI

SEQ ID NO: 1935261 - protein, 18 aa, Staphylococcus
EESEESFEDIAEDLIDFD

SEQ ID NO: 1935262 - protein, 6 aa, Staphylococcus
EESEFE

SEQ ID NO: 1935263 - protein, 7 aa, Staphylococcus
EESEFES

SEQ ID NO: 1935264 - protein, 13 aa, Staphylococcus
EESEHDKHRYLKQ

SEQ ID NO: 1935265 - protein, 19 aa, Staphylococcus
EESEIKAEDFASKGTNTPF

SEQ ID NO: 1935266 - protein, 6 aa, Staphylococcus
EESELE

SEQ ID NO: 1935267 - protein, 5 aa, Staphylococcus
EESER

SEQ ID NO: 1935268 - protein, 15 aa, Staphylococcus
EESEVAKEKDGTTVS

SEQ ID NO: 1935269 - protein, 6 aa, Staphylococcus
EESGIS

SEQ ID NO: 1935270 - protein, 8 aa, Staphylococcus
EESGKRFE

SEQ ID NO: 1935271 - protein, 13 aa, Staphylococcus
EESGLEGAKTLDQ

SEQ ID NO: 1935272 - protein, 14 aa, Staphylococcus
EESGLKGVKELDST

SEQ ID NO: 1935273 - protein, 6 aa, Staphylococcus
EESGLL

SEQ ID NO: 1935274 - protein, 10 aa, Staphylococcus
EESGRWSAYG

SEQ ID NO: 1935275 - protein, 5 aa, Staphylococcus
EESGV

SEQ ID NO: 1935276 - protein, 7 aa, Staphylococcus
EESIQEA

SEQ ID NO: 1935277 - protein, 7 aa, Staphylococcus
EESITRA

SEQ ID NO: 1935278 - protein, 7 aa, Staphylococcus
EESKENR

SEQ ID NO: 1935279 - protein, 9 aa, Staphylococcus
EESKGHLGY

SEQ ID NO: 1935280 - protein, 9 aa, Staphylococcus
EESKIPEIK

SEQ ID NO: 1935281 - protein, 6 aa, Staphylococcus
EESKPQ

SEQ ID NO: 1935282 - protein, 4 aa, Staphylococcus
EESL

SEQ ID NO: 1935283 - protein, 9 aa, Staphylococcus
EESLNQTKL

SEQ ID NO: 1935284 - protein, 21 aa, Staphylococcus
EESLNQTKLRADRLDEDSSNL

SEQ ID NO: 1935285 - protein, 21 aa, Staphylococcus
EESLSQTKLRAERLDEDSSEL

SEQ ID NO: 1935286 - protein, 7 aa, Staphylococcus
EESLTDD

SEQ ID NO: 1935287 - protein, 8 aa, Staphylococcus
EESNGFNT

SEQ ID NO: 1935288 - protein, 9 aa, Staphylococcus
EESNLTTAE

SEQ ID NO: 1935289 - protein, 32 aa, Staphylococcus
EESNLTTAELAAETDETLEDTDEVTTEDKDTE

SEQ ID NO: 1935290 - protein, 10 aa, Staphylococcus
EESNSKSQFH

SEQ ID NO: 1935291 - protein, 7 aa, Staphylococcus
EESPGAT

SEQ ID NO: 1935292 - protein, 5 aa, Staphylococcus
EESPN

SEQ ID NO: 1935293 - protein, 18 aa, Staphylococcus
EESPSPILSDEQREEMGN

SEQ ID NO: 1935294 - protein, 24 aa, Staphylococcus
EESPSPILTDEKRKEMGKAAIRAA

SEQ ID NO: 1935295 - protein, 7 aa, Staphylococcus
EESQPMT

SEQ ID NO: 1935296 - protein, 4 aa, Staphylococcus
EESR

SEQ ID NO: 1935297 - protein, 4 aa, Staphylococcus
EESS

SEQ ID NO: 1935298 - protein, 5 aa, Staphylococcus
EESSK

SEQ ID NO: 1935299 - protein, 13 aa, Staphylococcus
EESSLEDNKNHME

SEQ ID NO: 1935300 - protein, 8 aa, Staphylococcus
EESSNLKD

SEQ ID NO: 1935301 - protein, 14 aa, Staphylococcus
EESSSLKNELPEME

SEQ ID NO: 1935302 - protein, 6 aa, Staphylococcus
EESSVG

SEQ ID NO: 1935303 - protein, 19 aa, Staphylococcus
EESSYTTGQVYGVTGGTQL

SEQ ID NO: 1935304 - protein, 4 aa, Staphylococcus
EEST

SEQ ID NO: 1935305 - protein, 11 aa, Staphylococcus
EETAEKYGCTS

SEQ ID NO: 1935306 - protein, 13 aa, Staphylococcus
EETAYAQSLTDHP

SEQ ID NO: 1935307 - protein, 4 aa, Staphylococcus
EETC

SEQ ID NO: 1935308 - protein, 6 aa, Staphylococcus
EETDCN

SEQ ID NO: 1935309 - protein, 11 aa, Staphylococcus
EETDDDNTGTV

SEQ ID NO: 1935310 - protein, 5 aa, Staphylococcus
EETDE

SEQ ID NO: 1935311 - protein, 6 aa, Staphylococcus
EETEER

SEQ ID NO: 1935312 - protein, 7 aa, Staphylococcus
EETETYS

SEQ ID NO: 1935313 - protein, 4 aa, Staphylococcus
EETF

SEQ ID NO: 1935314 - protein, 7 aa, Staphylococcus
EETFERG

SEQ ID NO: 1935315 - protein, 5 aa, Staphylococcus
EETGA

SEQ ID NO: 1935316 - protein, 7 aa, Staphylococcus
EETGAQC

SEQ ID NO: 1935317 - protein, 6 aa, Staphylococcus
EETGAT

SEQ ID NO: 1935318 - protein, 17 aa, Staphylococcus
EETGISKTTLMAIAENT

SEQ ID NO: 1935319 - protein, 11 aa, Staphylococcus
EETGKEKFKTA

SEQ ID NO: 1935320 - protein, 16 aa, Staphylococcus
EETGMRGRRETNTMPQ

SEQ ID NO: 1935321 - protein, 22 aa, Staphylococcus
EETGSTFEENAKLKSEAAAKAL

SEQ ID NO: 1935322 - protein, 20 aa, Staphylococcus
EETGTTFDENAKLKSEAAAK

SEQ ID NO: 1935323 - protein, 7 aa, Staphylococcus
EETGYQK

SEQ ID NO: 1935324 - protein, 9 aa, Staphylococcus
EETGYQKPM

SEQ ID NO: 1935325 - protein, 7 aa, Staphylococcus
EETHQTD

SEQ ID NO: 1935326 - protein, 5 aa, Staphylococcus
EETIE

SEQ ID NO: 1935327 - protein, 9 aa, Staphylococcus
EETKDTDLP

SEQ ID NO: 1935328 - protein, 16 aa, Staphylococcus
EETLYKEDEKNATKEE

SEQ ID NO: 1935329 - protein, 7 aa, Staphylococcus
EETMTSR

SEQ ID NO: 1935330 - protein, 8 aa, Staphylococcus
EETNDNKL

SEQ ID NO: 1935331 - protein, 10 aa, Staphylococcus
EETNGDAVEI

SEQ ID NO: 1935332 - protein, 9 aa, Staphylococcus
EETNGETIN

SEQ ID NO: 1935333 - protein, 12 aa, Staphylococcus
EETNKVAKNQFE

SEQ ID NO: 1935334 - protein, 30 aa, Staphylococcus
EETNLTTTELSAEVDETSNEAQDASDNKEE

SEQ ID NO: 1935335 - protein, 7 aa, Staphylococcus
EETNNYE

SEQ ID NO: 1935336 - protein, 7 aa, Staphylococcus
EETNTSV

SEQ ID NO: 1935337 - protein, 8 aa, Staphylococcus
EETPATRS

SEQ ID NO: 1935338 - protein, 7 aa, Staphylococcus
EETPDKF

SEQ ID NO: 1935339 - protein, 12 aa, Staphylococcus
EETPSNQCPNCE

SEQ ID NO: 1935340 - protein, 9 aa, Staphylococcus
EETPVTEIS

SEQ ID NO: 1935341 - protein, 6 aa, Staphylococcus
EETQAQ

SEQ ID NO: 1935342 - protein, 7 aa, Staphylococcus
EETQFNG

SEQ ID NO: 1935343 - protein, 6 aa, Staphylococcus
EETQSK

SEQ ID NO: 1935344 - protein, 7 aa, Staphylococcus
EETSEGK

SEQ ID NO: 1935345 - protein, 6 aa, Staphylococcus
EETSPI

SEQ ID NO: 1935346 - protein, 13 aa, Staphylococcus
EETSYLQGTQPGI

SEQ ID NO: 1935347 - protein, 8 aa, Staphylococcus
EETTGIPK

SEQ ID NO: 1935348 - protein, 9 aa, Staphylococcus
EETTGIPKE

SEQ ID NO: 1935349 - protein, 8 aa, Staphylococcus
EETTGISK

SEQ ID NO: 1935350 - protein, 10 aa, Staphylococcus
EETVEEGVRK

SEQ ID NO: 1935351 - protein, 10 aa, Staphylococcus
EETVEQGVRK

SEQ ID NO: 1935352 - protein, 9 aa, Staphylococcus
EETVGKSIP

SEQ ID NO: 1935353 - protein, 19 aa, Staphylococcus
EETVNQTASDIKAHGGEAL

SEQ ID NO: 1935354 - protein, 9 aa, Staphylococcus
EETVTNAGK

SEQ ID NO: 1935355 - protein, 5 aa, Staphylococcus
EETYE

SEQ ID NO: 1935356 - protein, 8 aa, Staphylococcus
EETYPHST

SEQ ID NO: 1935357 - protein, 6 aa, Staphylococcus
EEVAKG

SEQ ID NO: 1935358 - protein, 11 aa, Staphylococcus
EEVDAKETTKI

SEQ ID NO: 1935359 - protein, 15 aa, Staphylococcus
EEVEDKTEAHFVNCL

SEQ ID NO: 1935360 - protein, 9 aa, Staphylococcus
EEVEKQGYY

SEQ ID NO: 1935361 - protein, 10 aa, Staphylococcus
EEVELAPEEH

SEQ ID NO: 1935362 - protein, 5 aa, Staphylococcus
EEVES

SEQ ID NO: 1935363 - protein, 10 aa, Staphylococcus
EEVESVEAGE

SEQ ID NO: 1935364 - protein, 18 aa, Staphylococcus
EEVGEAGTKRACEIGPKA

SEQ ID NO: 1935365 - protein, 18 aa, Staphylococcus
EEVGEAGTKRACEIGPQA

SEQ ID NO: 1935366 - protein, 18 aa, Staphylococcus
EEVGEAGTKRACEIGPRG

SEQ ID NO: 1935367 - protein, 19 aa, Staphylococcus
EEVGEAGTKRACEVGPKGD

SEQ ID NO: 1935368 - protein, 10 aa, Staphylococcus
EEVGSGAQQM

SEQ ID NO: 1935369 - protein, 5 aa, Staphylococcus
EEVHN

SEQ ID NO: 1935370 - protein, 6 aa, Staphylococcus
EEVKKG

SEQ ID NO: 1935371 - protein, 13 aa, Staphylococcus
EEVKTVGSLPSHD

SEQ ID NO: 1935372 - protein, 7 aa, Staphylococcus
EEVNDKL

SEQ ID NO: 1935373 - protein, 8 aa, Staphylococcus
EEVNEAYA

SEQ ID NO: 1935374 - protein, 7 aa, Staphylococcus
EEVNEKL

SEQ ID NO: 1935375 - protein, 9 aa, Staphylococcus
EEVNEQEEK

SEQ ID NO: 1935376 - protein, 13 aa, Staphylococcus
EEVNPEDEPDGEL

SEQ ID NO: 1935377 - protein, 5 aa, Staphylococcus
EEVPE

SEQ ID NO: 1935378 - protein, 6 aa, Staphylococcus
EEVPST

SEQ ID NO: 1935379 - protein, 4 aa, Staphylococcus
EEVQ

SEQ ID NO: 1935380 - protein, 4 aa, Staphylococcus
EEVS

SEQ ID NO: 1935381 - protein, 12 aa, Staphylococcus
EEVTANDVEGGN

SEQ ID NO: 1935382 - protein, 7 aa, Staphylococcus
EEVTGKN

SEQ ID NO: 1935383 - protein, 5 aa, Staphylococcus
EEVTH

SEQ ID NO: 1935384 - protein, 12 aa, Staphylococcus
EEVTKEKEEDMK

SEQ ID NO: 1935385 - protein, 60 aa, Staphylococcus
EEVVEEPEQYREKESQKPSQSRTPQATQSNSNFSANQSELRSVPNRRSSRNQNNEERNYR

SEQ ID NO: 1935386 - protein, 5 aa, Staphylococcus
EEWGS

SEQ ID NO: 1935387 - protein, 23 aa, Staphylococcus
EEWNQNEPEFPNYESGSNGPLDS

SEQ ID NO: 1935388 - protein, 8 aa, Staphylococcus
EEWTGSSG

SEQ ID NO: 1935389 - protein, 8 aa, Staphylococcus
EEYDEDMK

SEQ ID NO: 1935390 - protein, 11 aa, Staphylococcus
EEYDEDMKEEL

SEQ ID NO: 1935391 - protein, 4 aa, Staphylococcus
EEYE

SEQ ID NO: 1935392 - protein, 6 aa, Staphylococcus
EEYEDI

SEQ ID NO: 1935393 - protein, 14 aa, Staphylococcus
EEYEQLKSEHNDAL

SEQ ID NO: 1935394 - protein, 7 aa, Staphylococcus
EEYGPDL

SEQ ID NO: 1935395 - protein, 13 aa, Staphylococcus
EEYKEDGSVVIHL

SEQ ID NO: 1935396 - protein, 4 aa, Staphylococcus
EEYN

SEQ ID NO: 1935397 - protein, 6 aa, Staphylococcus
EEYNNG

SEQ ID NO: 1935398 - protein, 7 aa, Staphylococcus
EEYNQTN

SEQ ID NO: 1935399 - protein, 5 aa, Staphylococcus
EEYPD

SEQ ID NO: 1935400 - protein, 12 aa, Staphylococcus
EEYQKANQKHSI

SEQ ID NO: 1935401 - protein, 32 aa, Staphylococcus
EEYQKPLSELANKSVDDLEKIGDKAQQDQGFP

SEQ ID NO: 1935402 - protein, 7 aa, Staphylococcus
EEYQPTR

SEQ ID NO: 1935403 - protein, 4 aa, Staphylococcus
EEYS

SEQ ID NO: 1935404 - protein, 10 aa, Staphylococcus
EEYYDKKGDV

SEQ ID NO: 1935405 - protein, 7 aa, Staphylococcus
EFAEEAG

SEQ ID NO: 1935406 - protein, 45 aa, Staphylococcus
EFAEKEDNTAKDSNTDEQIEKTASEDDVQNDSSAVDDKEKEIQQL

SEQ ID NO: 1935407 - protein, 4 aa, Staphylococcus
EFAK

SEQ ID NO: 1935408 - protein, 5 aa, Staphylococcus
EFAKS

SEQ ID NO: 1935409 - protein, 8 aa, Staphylococcus
EFDHESQS

SEQ ID NO: 1935410 - protein, 16 aa, Staphylococcus
EFDNKEYRFDDRTVES

SEQ ID NO: 1935411 - protein, 12 aa, Staphylococcus
EFDPQGDQPEAI

SEQ ID NO: 1935412 - protein, 12 aa, Staphylococcus
EFDPQGDQPQAI

SEQ ID NO: 1935413 - protein, 8 aa, Staphylococcus
EFDPQKVS

SEQ ID NO: 1935414 - protein, 5 aa, Staphylococcus
EFDTQ

SEQ ID NO: 1935415 - protein, 13 aa, Staphylococcus
EFDTTKKISDSEF

SEQ ID NO: 1935416 - protein, 18 aa, Staphylococcus
EFEDNGDRLGWTEGSGKH

SEQ ID NO: 1935417 - protein, 9 aa, Staphylococcus
EFEEDPRED

SEQ ID NO: 1935418 - protein, 23 aa, Staphylococcus
EFEERRRGDNKIGTTKKGIGPAY

SEQ ID NO: 1935419 - protein, 7 aa, Staphylococcus
EFENGKS

SEQ ID NO: 1935420 - protein, 9 aa, Staphylococcus
EFEPESSQA

SEQ ID NO: 1935421 - protein, 9 aa, Staphylococcus
EFEPETSQA

SEQ ID NO: 1935422 - protein, 5 aa, Staphylococcus
EFEPH

SEQ ID NO: 1935423 - protein, 5 aa, Staphylococcus
EFEPK

SEQ ID NO: 1935424 - protein, 7 aa, Staphylococcus
EFEPQDV

SEQ ID NO: 1935425 - protein, 14 aa, Staphylococcus
EFEPQMEDQERTKL

SEQ ID NO: 1935426 - protein, 17 aa, Staphylococcus
EFEPTIESAAESRAPHR

SEQ ID NO: 1935427 - protein, 9 aa, Staphylococcus
EFERDGNDT

SEQ ID NO: 1935428 - protein, 9 aa, Staphylococcus
EFESATPYY

SEQ ID NO: 1935429 - protein, 5 aa, Staphylococcus
EFESE

SEQ ID NO: 1935430 - protein, 5 aa, Staphylococcus
EFETM

SEQ ID NO: 1935431 - protein, 5 aa, Staphylococcus
EFETT

SEQ ID NO: 1935432 - protein, 11 aa, Staphylococcus
EFEVPGDKSMT

SEQ ID NO: 1935433 - protein, 6 aa, Staphylococcus
EFEYND

SEQ ID NO: 1935434 - protein, 15 aa, Staphylococcus
EFGEEEKEVINGEQV

SEQ ID NO: 1935435 - protein, 5 aa, Staphylococcus
EFGGT

SEQ ID NO: 1935436 - protein, 14 aa, Staphylococcus
EFGKDGNEGEVPFK

SEQ ID NO: 1935437 - protein, 13 aa, Staphylococcus
EFGKSYLKEMGVE

SEQ ID NO: 1935438 - protein, 6 aa, Staphylococcus
EFGPDL

SEQ ID NO: 1935439 - protein, 17 aa, Staphylococcus
EFGPSGAAWHGDGEYAE

SEQ ID NO: 1935440 - protein, 10 aa, Staphylococcus
EFGSGEAGAV

SEQ ID NO: 1935441 - protein, 10 aa, Staphylococcus
EFGSPKLPHM

SEQ ID NO: 1935442 - protein, 11 aa, Staphylococcus
EFGTRGLYGSP

SEQ ID NO: 1935443 - protein, 11 aa, Staphylococcus
EFIQPPSRKNE

SEQ ID NO: 1935444 - protein, 13 aa, Staphylococcus
EFKDGTSTTMKTG

SEQ ID NO: 1935445 - protein, 10 aa, Staphylococcus
EFKDKEVRAK

SEQ ID NO: 1935446 - protein, 9 aa, Staphylococcus
EFKDQGKID

SEQ ID NO: 1935447 - protein, 8 aa, Staphylococcus
EFKEEGKI

SEQ ID NO: 1935448 - protein, 8 aa, Staphylococcus
EFKELSDD

SEQ ID NO: 1935449 - protein, 5 aa, Staphylococcus
EFKEN

SEQ ID NO: 1935450 - protein, 7 aa, Staphylococcus
EFKGNTV

SEQ ID NO: 1935451 - protein, 8 aa, Staphylococcus
EFKGTEAA

SEQ ID NO: 1935452 - protein, 6 aa, Staphylococcus
EFKKSG

SEQ ID NO: 1935453 - protein, 9 aa, Staphylococcus
EFKPKNLKN

SEQ ID NO: 1935454 - protein, 9 aa, Staphylococcus
EFKQSNGKY

SEQ ID NO: 1935455 - protein, 5 aa, Staphylococcus
EFKQT

SEQ ID NO: 1935456 - protein, 10 aa, Staphylococcus
EFKSEQPDYL

SEQ ID NO: 1935457 - protein, 8 aa, Staphylococcus
EFKSSKDN

SEQ ID NO: 1935458 - protein, 12 aa, Staphylococcus
EFKSTKPNLDNQ

SEQ ID NO: 1935459 - protein, 14 aa, Staphylococcus
EFKTQKPKLSQQVD

SEQ ID NO: 1935460 - protein, 9 aa, Staphylococcus
EFKYNDNAQ

SEQ ID NO: 1935461 - protein, 7 aa, Staphylococcus
EFKYNDT

SEQ ID NO: 1935462 - protein, 10 aa, Staphylococcus
EFKYSDNAKY

SEQ ID NO: 1935463 - protein, 7 aa, Staphylococcus
EFNETSV

SEQ ID NO: 1935464 - protein, 5 aa, Staphylococcus
EFNGD

SEQ ID NO: 1935465 - protein, 6 aa, Staphylococcus
EFNKDE

SEQ ID NO: 1935466 - protein, 6 aa, Staphylococcus
EFNNEN

SEQ ID NO: 1935467 - protein, 14 aa, Staphylococcus
EFNPEMSEETRTKL

SEQ ID NO: 1935468 - protein, 9 aa, Staphylococcus
EFNPSQLDA

SEQ ID NO: 1935469 - protein, 7 aa, Staphylococcus
EFNREDI

SEQ ID NO: 1935470 - protein, 8 aa, Staphylococcus
EFNREDVR

SEQ ID NO: 1935471 - protein, 8 aa, Staphylococcus
EFNRQNNN

SEQ ID NO: 1935472 - protein, 4 aa, Staphylococcus
EFNS

SEQ ID NO: 1935473 - protein, 6 aa, Staphylococcus
EFNSRG

SEQ ID NO: 1935474 - protein, 17 aa, Staphylococcus
EFNTKDKVLSDGADELS

SEQ ID NO: 1935475 - protein, 17 aa, Staphylococcus
EFNTKEKVLSDGSDELS

SEQ ID NO: 1935476 - protein, 17 aa, Staphylococcus
EFNTKEKVLSDGTDELS

SEQ ID NO: 1935477 - protein, 12 aa, Staphylococcus
EFNTNEKKNHSV

SEQ ID NO: 1935478 - protein, 12 aa, Staphylococcus
EFNTTPEWILYG

SEQ ID NO: 1935479 - protein, 15 aa, Staphylococcus
EFPGGKREEGETSME

SEQ ID NO: 1935480 - protein, 4 aa, Staphylococcus
EFPK

SEQ ID NO: 1935481 - protein, 4 aa, Staphylococcus
EFPN

SEQ ID NO: 1935482 - protein, 10 aa, Staphylococcus
EFPTQHENQY

SEQ ID NO: 1935483 - protein, 13 aa, Staphylococcus
EFPTRHDETFKTD

SEQ ID NO: 1935484 - protein, 10 aa, Staphylococcus
EFPTRHDETL

SEQ ID NO: 1935485 - protein, 10 aa, Staphylococcus
EFPTRHNEEL

SEQ ID NO: 1935486 - protein, 10 aa, Staphylococcus
EFQQASESFD

SEQ ID NO: 1935487 - protein, 12 aa, Staphylococcus
EFQQSADTIADA

SEQ ID NO: 1935488 - protein, 10 aa, Staphylococcus
EFQQSAETIA

SEQ ID NO: 1935489 - protein, 12 aa, Staphylococcus
EFQQSAETISDA

SEQ ID NO: 1935490 - protein, 12 aa, Staphylococcus
EFQQSSDTISGA

SEQ ID NO: 1935491 - protein, 7 aa, Staphylococcus
EFQYDDT

SEQ ID NO: 1935492 - protein, 6 aa, Staphylococcus
EFQYND

SEQ ID NO: 1935493 - protein, 11 aa, Staphylococcus
EFREKTSLEIE

SEQ ID NO: 1935494 - protein, 7 aa, Staphylococcus
EFRSQND

SEQ ID NO: 1935495 - protein, 7 aa, Staphylococcus
EFSDEDI

SEQ ID NO: 1935496 - protein, 11 aa, Staphylococcus
EFSEANAPHPR

SEQ ID NO: 1935497 - protein, 8 aa, Staphylococcus
EFSGEQQY

SEQ ID NO: 1935498 - protein, 7 aa, Staphylococcus
EFSGKGY

SEQ ID NO: 1935499 - protein, 4 aa, Staphylococcus
EFSN

SEQ ID NO: 1935500 - protein, 14 aa, Staphylococcus
EFSRTKNGLEPSEV

SEQ ID NO: 1935501 - protein, 5 aa, Staphylococcus
EFSRV

SEQ ID NO: 1935502 - protein, 5 aa, Staphylococcus
EFSSE

SEQ ID NO: 1935503 - protein, 7 aa, Staphylococcus
EFSSSID

SEQ ID NO: 1935504 - protein, 9 aa, Staphylococcus
EFSTQSPQF

SEQ ID NO: 1935505 - protein, 8 aa, Staphylococcus
EFSTTQQQ

SEQ ID NO: 1935506 - protein, 4 aa, Staphylococcus
EFTE

SEQ ID NO: 1935507 - protein, 5 aa, Staphylococcus
EFTGK

SEQ ID NO: 1935508 - protein, 11 aa, Staphylococcus
EFTGNKEQDKM

SEQ ID NO: 1935509 - protein, 11 aa, Staphylococcus
EFTKEDGIVQP

SEQ ID NO: 1935510 - protein, 5 aa, Staphylococcus
EFTKV

SEQ ID NO: 1935511 - protein, 7 aa, Staphylococcus
EFTQADY

SEQ ID NO: 1935512 - protein, 4 aa, Staphylococcus
EFTR

SEQ ID NO: 1935513 - protein, 8 aa, Staphylococcus
EFTSTNEG

SEQ ID NO: 1935514 - protein, 9 aa, Staphylococcus
EFTSTNEGA

SEQ ID NO: 1935515 - protein, 8 aa, Staphylococcus
EFTSTNQG

SEQ ID NO: 1935516 - protein, 5 aa, Staphylococcus
EFYGP

SEQ ID NO: 1935517 - protein, 12 aa, Staphylococcus
EGAADQYTRKDM

SEQ ID NO: 1935518 - protein, 9 aa, Staphylococcus
EGADGQRKI

SEQ ID NO: 1935519 - protein, 5 aa, Staphylococcus
EGADV

SEQ ID NO: 1935520 - protein, 14 aa, Staphylococcus
EGAEDDSEQGAQDL

SEQ ID NO: 1935521 - protein, 12 aa, Staphylococcus
EGAEDSESLARE

SEQ ID NO: 1935522 - protein, 9 aa, Staphylococcus
EGAERPGHF

SEQ ID NO: 1935523 - protein, 9 aa, Staphylococcus
EGAESDDDD

SEQ ID NO: 1935524 - protein, 23 aa, Staphylococcus
EGAEVEASVNHADRRDIKKNHSA

SEQ ID NO: 1935525 - protein, 5 aa, Staphylococcus
EGAFE

SEQ ID NO: 1935526 - protein, 16 aa, Staphylococcus
EGAGTQRLSEMKADDT

SEQ ID NO: 1935527 - protein, 4 aa, Staphylococcus
EGAI

SEQ ID NO: 1935528 - protein, 4 aa, Staphylococcus
EGAK

SEQ ID NO: 1935529 - protein, 7 aa, Staphylococcus
EGAKGKA

SEQ ID NO: 1935530 - protein, 4 aa, Staphylococcus
EGAL

SEQ ID NO: 1935531 - protein, 4 aa, Staphylococcus
EGAN

SEQ ID NO: 1935532 - protein, 4 aa, Staphylococcus
EGAQ

SEQ ID NO: 1935533 - protein, 7 aa, Staphylococcus
EGAQEYK

SEQ ID NO: 1935534 - protein, 5 aa, Staphylococcus
EGAQL

SEQ ID NO: 1935535 - protein, 9 aa, Staphylococcus
EGAQSDEDD

SEQ ID NO: 1935536 - protein, 8 aa, Staphylococcus
EGAQTDED

SEQ ID NO: 1935537 - protein, 10 aa, Staphylococcus
EGAREKAANG

SEQ ID NO: 1935538 - protein, 10 aa, Staphylococcus
EGAREKAENG

SEQ ID NO: 1935539 - protein, 9 aa, Staphylococcus
EGARNRGVP

SEQ ID NO: 1935540 - protein, 8 aa, Staphylococcus
EGASEGIG

SEQ ID NO: 1935541 - protein, 8 aa, Staphylococcus
EGASEGVG

SEQ ID NO: 1935542 - protein, 5 aa, Staphylococcus
EGASF

SEQ ID NO: 1935543 - protein, 10 aa, Staphylococcus
EGASPASHVT

SEQ ID NO: 1935544 - protein, 11 aa, Staphylococcus
EGASPASKVTD

SEQ ID NO: 1935545 - protein, 9 aa, Staphylococcus
EGASSSVKN

SEQ ID NO: 1935546 - protein, 6 aa, Staphylococcus
EGASTE

SEQ ID NO: 1935547 - protein, 22 aa, Staphylococcus
EGATVKDAQAAAYNNAEKIKSD

SEQ ID NO: 1935548 - protein, 9 aa, Staphylococcus
EGAVDDSYG

SEQ ID NO: 1935549 - protein, 7 aa, Staphylococcus
EGCPTES

SEQ ID NO: 1935550 - protein, 4 aa, Staphylococcus
EGDA

SEQ ID NO: 1935551 - protein, 10 aa, Staphylococcus
EGDAKNEQDI

SEQ ID NO: 1935552 - protein, 10 aa, Staphylococcus
EGDAKNLEDL

SEQ ID NO: 1935553 - protein, 13 aa, Staphylococcus
EGDAKNSKDLEQA

SEQ ID NO: 1935554 - protein, 14 aa, Staphylococcus
EGDATDKNAISKAL

SEQ ID NO: 1935555 - protein, 9 aa, Staphylococcus
EGDDAIPEG

SEQ ID NO: 1935556 - protein, 6 aa, Staphylococcus
EGDDNA

SEQ ID NO: 1935557 - protein, 7 aa, Staphylococcus
EGDDRTV

SEQ ID NO: 1935558 - protein, 5 aa, Staphylococcus
EGDDS

SEQ ID NO: 1935559 - protein, 14 aa, Staphylococcus
EGDERAYNYKAEHP

SEQ ID NO: 1935560 - protein, 6 aa, Staphylococcus
EGDERT

SEQ ID NO: 1935561 - protein, 7 aa, Staphylococcus
EGDERTL

SEQ ID NO: 1935562 - protein, 7 aa, Staphylococcus
EGDERTV

SEQ ID NO: 1935563 - protein, 5 aa, Staphylococcus
EGDES

SEQ ID NO: 1935564 - protein, 7 aa, Staphylococcus
EGDGIGG

SEQ ID NO: 1935565 - protein, 7 aa, Staphylococcus
EGDGVGG

SEQ ID NO: 1935566 - protein, 9 aa, Staphylococcus
EGDIKGVAQ

SEQ ID NO: 1935567 - protein, 7 aa, Staphylococcus
EGDINDL

SEQ ID NO: 1935568 - protein, 9 aa, Staphylococcus
EGDKDPNMP

SEQ ID NO: 1935569 - protein, 7 aa, Staphylococcus
EGDNYTD

SEQ ID NO: 1935570 - protein, 5 aa, Staphylococcus
EGDPC

SEQ ID NO: 1935571 - protein, 6 aa, Staphylococcus
EGDQLT

SEQ ID NO: 1935572 - protein, 5 aa, Staphylococcus
EGDQV

SEQ ID NO: 1935573 - protein, 9 aa, Staphylococcus
EGDQVQPQQ

SEQ ID NO: 1935574 - protein, 14 aa, Staphylococcus
EGDRGEQAANVVKM

SEQ ID NO: 1935575 - protein, 7 aa, Staphylococcus
EGDSETL

SEQ ID NO: 1935576 - protein, 9 aa, Staphylococcus
EGDSFESAF

SEQ ID NO: 1935577 - protein, 6 aa, Staphylococcus
EGDSGL

SEQ ID NO: 1935578 - protein, 5 aa, Staphylococcus
EGDST

SEQ ID NO: 1935579 - protein, 10 aa, Staphylococcus
EGDTPPNNVG

SEQ ID NO: 1935580 - protein, 9 aa, Staphylococcus
EGDTQDDNY

SEQ ID NO: 1935581 - protein, 9 aa, Staphylococcus
EGDTSFPIE

SEQ ID NO: 1935582 - protein, 5 aa, Staphylococcus
EGDVE

SEQ ID NO: 1935583 - protein, 4 aa, Staphylococcus
EGDY

SEQ ID NO: 1935584 - protein, 13 aa, Staphylococcus
EGDYPGDVTPSGY

SEQ ID NO: 1935585 - protein, 7 aa, Staphylococcus
EGEASVG

SEQ ID NO: 1935586 - protein, 11 aa, Staphylococcus
EGEDAFPQTHT

SEQ ID NO: 1935587 - protein, 10 aa, Staphylococcus
EGEDPSTEKP

SEQ ID NO: 1935588 - protein, 10 aa, Staphylococcus
EGEDTRVLDK

SEQ ID NO: 1935589 - protein, 5 aa, Staphylococcus
EGEEA

SEQ ID NO: 1935590 - protein, 10 aa, Staphylococcus
EGEEESDDDA

SEQ ID NO: 1935591 - protein, 6 aa, Staphylococcus
EGEERD

SEQ ID NO: 1935592 - protein, 7 aa, Staphylococcus
EGEERER

SEQ ID NO: 1935593 - protein, 9 aa, Staphylococcus
EGEERESAY

SEQ ID NO: 1935594 - protein, 5 aa, Staphylococcus
EGEES

SEQ ID NO: 1935595 - protein, 9 aa, Staphylococcus
EGEGDKSLT

SEQ ID NO: 1935596 - protein, 7 aa, Staphylococcus
EGEGPFE

SEQ ID NO: 1935597 - protein, 8 aa, Staphylococcus
EGEGRNAS

SEQ ID NO: 1935598 - protein, 5 aa, Staphylococcus
EGEHC

SEQ ID NO: 1935599 - protein, 4 aa, Staphylococcus
EGEI

SEQ ID NO: 1935600 - protein, 8 aa, Staphylococcus
EGEIEPQA

SEQ ID NO: 1935601 - protein, 19 aa, Staphylococcus
EGEISADATGKKPGRGAYV

SEQ ID NO: 1935602 - protein, 4 aa, Staphylococcus
EGEK

SEQ ID NO: 1935603 - protein, 9 aa, Staphylococcus
EGEKNLNLS

SEQ ID NO: 1935604 - protein, 8 aa, Staphylococcus
EGEKRDFR

SEQ ID NO: 1935605 - protein, 6 aa, Staphylococcus
EGEKSH

SEQ ID NO: 1935606 - protein, 9 aa, Staphylococcus
EGEKTLANN

SEQ ID NO: 1935607 - protein, 5 aa, Staphylococcus
EGELE

SEQ ID NO: 1935608 - protein, 5 aa, Staphylococcus
EGELR

SEQ ID NO: 1935609 - protein, 8 aa, Staphylococcus
EGELTDEE

SEQ ID NO: 1935610 - protein, 6 aa, Staphylococcus
EGEMDE

SEQ ID NO: 1935611 - protein, 5 aa, Staphylococcus
EGEMN

SEQ ID NO: 1935612 - protein, 25 aa, Staphylococcus
EGENSDVMSDNDTAREGDSSDDMTD

SEQ ID NO: 1935613 - protein, 24 aa, Staphylococcus
EGENSDVMSDNDTAREGDSTDDMT

SEQ ID NO: 1935614 - protein, 24 aa, Staphylococcus
EGENSEAVSDNDTAREGDASDDMT

SEQ ID NO: 1935615 - protein, 24 aa, Staphylococcus
EGENSEVIADNDTAREGDSTDDMT

SEQ ID NO: 1935616 - protein, 24 aa, Staphylococcus
EGENSEVISDNDTAREGDSTDDMT

SEQ ID NO: 1935617 - protein, 25 aa, Staphylococcus
EGENSEVMADNDTAREGDSSDDMTD

SEQ ID NO: 1935618 - protein, 50 aa, Staphylococcus
EGENSEVMGDNDNAREGDASDDMTDMQTKKGNGLTNNQIDDDEGGSVGHN

SEQ ID NO: 1935619 - protein, 6 aa, Staphylococcus
EGEPAV

SEQ ID NO: 1935620 - protein, 17 aa, Staphylococcus
EGEPIAEEYQANRQKKH

SEQ ID NO: 1935621 - protein, 8 aa, Staphylococcus
EGEQHKGR

SEQ ID NO: 1935622 - protein, 5 aa, Staphylococcus
EGEQI

SEQ ID NO: 1935623 - protein, 6 aa, Staphylococcus
EGEQQT

SEQ ID NO: 1935624 - protein, 13 aa, Staphylococcus
EGERGEQAANVVK

SEQ ID NO: 1935625 - protein, 16 aa, Staphylococcus
EGERGSGKICLNGAAS

SEQ ID NO: 1935626 - protein, 6 aa, Staphylococcus
EGERRE

SEQ ID NO: 1935627 - protein, 12 aa, Staphylococcus
EGESELLNPPHD

SEQ ID NO: 1935628 - protein, 7 aa, Staphylococcus
EGESLTA

SEQ ID NO: 1935629 - protein, 9 aa, Staphylococcus
EGESTDDDD

SEQ ID NO: 1935630 - protein, 6 aa, Staphylococcus
EGETAE

SEQ ID NO: 1935631 - protein, 8 aa, Staphylococcus
EGETEEQV

SEQ ID NO: 1935632 - protein, 9 aa, Staphylococcus
EGETENNIL

SEQ ID NO: 1935633 - protein, 5 aa, Staphylococcus
EGETF

SEQ ID NO: 1935634 - protein, 6 aa, Staphylococcus
EGETSI

SEQ ID NO: 1935635 - protein, 5 aa, Staphylococcus
EGETV

SEQ ID NO: 1935636 - protein, 7 aa, Staphylococcus
EGEYGNE

SEQ ID NO: 1935637 - protein, 8 aa, Staphylococcus
EGEYSDDD

SEQ ID NO: 1935638 - protein, 9 aa, Staphylococcus
EGEYVTPQD

SEQ ID NO: 1935639 - protein, 7 aa, Staphylococcus
EGFGPFD

SEQ ID NO: 1935640 - protein, 8 aa, Staphylococcus
EGFGPSGS

SEQ ID NO: 1935641 - protein, 12 aa, Staphylococcus
EGFKEKKAALPD

SEQ ID NO: 1935642 - protein, 12 aa, Staphylococcus
EGFKEKKEALPK

SEQ ID NO: 1935643 - protein, 5 aa, Staphylococcus
EGFNN

SEQ ID NO: 1935644 - protein, 12 aa, Staphylococcus
EGFQQKKAALPD

SEQ ID NO: 1935645 - protein, 6 aa, Staphylococcus
EGFSEE

SEQ ID NO: 1935646 - protein, 12 aa, Staphylococcus
EGFSGGEKKRNE

SEQ ID NO: 1935647 - protein, 6 aa, Staphylococcus
EGGDIS

SEQ ID NO: 1935648 - protein, 31 aa, Staphylococcus
EGGDVSKEAYTGDGPHINSGDLDGLNNEEAI

SEQ ID NO: 1935649 - protein, 4 aa, Staphylococcus
EGGE

SEQ ID NO: 1935650 - protein, 7 aa, Staphylococcus
EGGFSDK

SEQ ID NO: 1935651 - protein, 7 aa, Staphylococcus
EGGFSEK

SEQ ID NO: 1935652 - protein, 4 aa, Staphylococcus
EGGG

SEQ ID NO: 1935653 - protein, 9 aa, Staphylococcus
EGGGATLTD

SEQ ID NO: 1935654 - protein, 5 aa, Staphylococcus
EGGGK

SEQ ID NO: 1935655 - protein, 8 aa, Staphylococcus
EGGGYNLE

SEQ ID NO: 1935656 - protein, 17 aa, Staphylococcus
EGGIATYGKDPETKGEF

SEQ ID NO: 1935657 - protein, 8 aa, Staphylococcus
EGGKAEVY

SEQ ID NO: 1935658 - protein, 8 aa, Staphylococcus
EGGLDEDE

SEQ ID NO: 1935659 - protein, 12 aa, Staphylococcus
EGGLQECGNSQN

SEQ ID NO: 1935660 - protein, 8 aa, Staphylococcus
EGGLSDEE

SEQ ID NO: 1935661 - protein, 8 aa, Staphylococcus
EGGLSDKE

SEQ ID NO: 1935662 - protein, 7 aa, Staphylococcus
EGGLSEE

SEQ ID NO: 1935663 - protein, 12 aa, Staphylococcus
EGGLTEEESENY

SEQ ID NO: 1935664 - protein, 7 aa, Staphylococcus
EGGLTES

SEQ ID NO: 1935665 - protein, 5 aa, Staphylococcus
EGGMS

SEQ ID NO: 1935666 - protein, 6 aa, Staphylococcus
EGGMTN

SEQ ID NO: 1935667 - protein, 5 aa, Staphylococcus
EGGNG

SEQ ID NO: 1935668 - protein, 7 aa, Staphylococcus
EGGNKLT

SEQ ID NO: 1935669 - protein, 10 aa, Staphylococcus
EGGNSAQTIN

SEQ ID NO: 1935670 - protein, 9 aa, Staphylococcus
EGGPSKNYH

SEQ ID NO: 1935671 - protein, 10 aa, Staphylococcus
EGGPSKNYNL

SEQ ID NO: 1935672 - protein, 10 aa, Staphylococcus
EGGPSKNYNY

SEQ ID NO: 1935673 - protein, 7 aa, Staphylococcus
EGGQDNM

SEQ ID NO: 1935674 - protein, 4 aa, Staphylococcus
EGGR

SEQ ID NO: 1935675 - protein, 5 aa, Staphylococcus
EGGRH

SEQ ID NO: 1935676 - protein, 8 aa, Staphylococcus
EGGRNPAF

SEQ ID NO: 1935677 - protein, 15 aa, Staphylococcus
EGGRTVGSGVVTEIF

SEQ ID NO: 1935678 - protein, 15 aa, Staphylococcus
EGGRTVGSGVVTEIQ

SEQ ID NO: 1935679 - protein, 8 aa, Staphylococcus
EGGSLDND

SEQ ID NO: 1935680 - protein, 19 aa, Staphylococcus
EGGSQRKVDKIDKVEESEN

SEQ ID NO: 1935681 - protein, 10 aa, Staphylococcus
EGGSSAQTIN

SEQ ID NO: 1935682 - protein, 6 aa, Staphylococcus
EGGVEE

SEQ ID NO: 1935683 - protein, 7 aa, Staphylococcus
EGHAEGL

SEQ ID NO: 1935684 - protein, 8 aa, Staphylococcus
EGHAGQSL

SEQ ID NO: 1935685 - protein, 8 aa, Staphylococcus
EGHESEHN

SEQ ID NO: 1935686 - protein, 10 aa, Staphylococcus
EGHGHELKDE

SEQ ID NO: 1935687 - protein, 5 aa, Staphylococcus
EGHGM

SEQ ID NO: 1935688 - protein, 11 aa, Staphylococcus
EGHHQSEDGTW

SEQ ID NO: 1935689 - protein, 5 aa, Staphylococcus
EGHIY

SEQ ID NO: 1935690 - protein, 10 aa, Staphylococcus
EGHKDDGATW

SEQ ID NO: 1935691 - protein, 8 aa, Staphylococcus
EGHKYTDK

SEQ ID NO: 1935692 - protein, 13 aa, Staphylococcus
EGHPPITPVTDNK

SEQ ID NO: 1935693 - protein, 10 aa, Staphylococcus
EGHPTHPLSK

SEQ ID NO: 1935694 - protein, 11 aa, Staphylococcus
EGHPYGASGAN

SEQ ID NO: 1935695 - protein, 8 aa, Staphylococcus
EGHSTEEI

SEQ ID NO: 1935696 - protein, 12 aa, Staphylococcus
EGHTEISSREIG

SEQ ID NO: 1935697 - protein, 14 aa, Staphylococcus
EGHTSKWNEQNQTK

SEQ ID NO: 1935698 - protein, 10 aa, Staphylococcus
EGHTVSVEPH

SEQ ID NO: 1935699 - protein, 7 aa, Staphylococcus
EGHYTTD

SEQ ID NO: 1935700 - protein, 7 aa, Staphylococcus
EGHYTTN

SEQ ID NO: 1935701 - protein, 4 aa, Staphylococcus
EGIA

SEQ ID NO: 1935702 - protein, 4 aa, Staphylococcus
EGID

SEQ ID NO: 1935703 - protein, 23 aa, Staphylococcus
EGIDNGGTSISDYRHADGKTGKM

SEQ ID NO: 1935704 - protein, 7 aa, Staphylococcus
EGIDQLE

SEQ ID NO: 1935705 - protein, 4 aa, Staphylococcus
EGIE

SEQ ID NO: 1935706 - protein, 7 aa, Staphylococcus
EGIESKP

SEQ ID NO: 1935707 - protein, 10 aa, Staphylococcus
EGIGPKRKTT

SEQ ID NO: 1935708 - protein, 5 aa, Staphylococcus
EGIGS

SEQ ID NO: 1935709 - protein, 10 aa, Staphylococcus
EGIGSKRKTK

SEQ ID NO: 1935710 - protein, 5 aa, Staphylococcus
EGIIE

SEQ ID NO: 1935711 - protein, 14 aa, Staphylococcus
EGIKDPVSGTSNWT

SEQ ID NO: 1935712 - protein, 12 aa, Staphylococcus
EGIKNGNGEESI

SEQ ID NO: 1935713 - protein, 4 aa, Staphylococcus
EGIN

SEQ ID NO: 1935714 - protein, 5 aa, Staphylococcus
EGINC

SEQ ID NO: 1935715 - protein, 16 aa, Staphylococcus
EGINGTLSGTKEDTDQ

SEQ ID NO: 1935716 - protein, 17 aa, Staphylococcus
EGINGTLSGTKEDTDQY

SEQ ID NO: 1935717 - protein, 16 aa, Staphylococcus
EGINGTLSGTKEDTEN

SEQ ID NO: 1935718 - protein, 16 aa, Staphylococcus
EGINGTVSGTVEATDK

SEQ ID NO: 1935719 - protein, 5 aa, Staphylococcus
EGIQC

SEQ ID NO: 1935720 - protein, 5 aa, Staphylococcus
EGIQP

SEQ ID NO: 1935721 - protein, 7 aa, Staphylococcus
EGIQPYS

SEQ ID NO: 1935722 - protein, 12 aa, Staphylococcus
EGIRGNSNVEKL

SEQ ID NO: 1935723 - protein, 5 aa, Staphylococcus
EGIRP

SEQ ID NO: 1935724 - protein, 17 aa, Staphylococcus
EGISTTQIKKELYGKDA

SEQ ID NO: 1935725 - protein, 4 aa, Staphylococcus
EGIY

SEQ ID NO: 1935726 - protein, 4 aa, Staphylococcus
EGKA

SEQ ID NO: 1935727 - protein, 9 aa, Staphylococcus
EGKAEGLEI

SEQ ID NO: 1935728 - protein, 6 aa, Staphylococcus
EGKAHA

SEQ ID NO: 1935729 - protein, 6 aa, Staphylococcus
EGKANI

SEQ ID NO: 1935730 - protein, 9 aa, Staphylococcus
EGKATGLKI

SEQ ID NO: 1935731 - protein, 27 aa, Staphylococcus
EGKAYVGTTDTFYDNDKASPLVTQEDR

SEQ ID NO: 1935732 - protein, 27 aa, Staphylococcus
EGKAYVGTTDTFYDNDKTKPLTTQEDR

SEQ ID NO: 1935733 - protein, 28 aa, Staphylococcus
EGKAYVGTTDTFYDNNKTSPLANQEDRD

SEQ ID NO: 1935734 - protein, 28 aa, Staphylococcus
EGKAYVGTTDTFYNNEKTKPLTNQEDRD

SEQ ID NO: 1935735 - protein, 14 aa, Staphylococcus
EGKDATQALQDTTR

SEQ ID NO: 1935736 - protein, 8 aa, Staphylococcus
EGKDGEDE

SEQ ID NO: 1935737 - protein, 11 aa, Staphylococcus
EGKDPSEISRK

SEQ ID NO: 1935738 - protein, 18 aa, Staphylococcus
EGKDPSEISRKDEVWEGD

SEQ ID NO: 1935739 - protein, 18 aa, Staphylococcus
EGKDPSEISRKDEVWEGK

SEQ ID NO: 1935740 - protein, 8 aa, Staphylococcus
EGKDREAL

SEQ ID NO: 1935741 - protein, 6 aa, Staphylococcus
EGKDTY

SEQ ID NO: 1935742 - protein, 13 aa, Staphylococcus
EGKELPGVVAIAN

SEQ ID NO: 1935743 - protein, 5 aa, Staphylococcus
EGKEV

SEQ ID NO: 1935744 - protein, 14 aa, Staphylococcus
EGKEVSSEAKETIE

SEQ ID NO: 1935745 - protein, 12 aa, Staphylococcus
EGKFKPDEKYMS

SEQ ID NO: 1935746 - protein, 5 aa, Staphylococcus
EGKGA

SEQ ID NO: 1935747 - protein, 18 aa, Staphylococcus
EGKGFDNTKQMSDTSNGL

SEQ ID NO: 1935748 - protein, 6 aa, Staphylococcus
EGKGQY

SEQ ID NO: 1935749 - protein, 5 aa, Staphylococcus
EGKIA

SEQ ID NO: 1935750 - protein, 8 aa, Staphylococcus
EGKITERH

SEQ ID NO: 1935751 - protein, 10 aa, Staphylococcus
EGKKDPIGAM

SEQ ID NO: 1935752 - protein, 5 aa, Staphylococcus
EGKKT

SEQ ID NO: 1935753 - protein, 14 aa, Staphylococcus
EGKKVTDDNSGYAQ

SEQ ID NO: 1935754 - protein, 14 aa, Staphylococcus
EGKKVTEKSQNFNN

SEQ ID NO: 1935755 - protein, 5 aa, Staphylococcus
EGKLI

SEQ ID NO: 1935756 - protein, 14 aa, Staphylococcus
EGKMNDKAGKYEGM

SEQ ID NO: 1935757 - protein, 9 aa, Staphylococcus
EGKNAEQAL

SEQ ID NO: 1935758 - protein, 7 aa, Staphylococcus
EGKNEHL

SEQ ID NO: 1935759 - protein, 8 aa, Staphylococcus
EGKNETNI

SEQ ID NO: 1935760 - protein, 5 aa, Staphylococcus
EGKNI

SEQ ID NO: 1935761 - protein, 9 aa, Staphylococcus
EGKNNQRET

SEQ ID NO: 1935762 - protein, 11 aa, Staphylococcus
EGKNQQELEQI

SEQ ID NO: 1935763 - protein, 4 aa, Staphylococcus
EGKP

SEQ ID NO: 1935764 - protein, 7 aa, Staphylococcus
EGKPAVE

SEQ ID NO: 1935765 - protein, 4 aa, Staphylococcus
EGKQ

SEQ ID NO: 1935766 - protein, 8 aa, Staphylococcus
EGKQGSTY

SEQ ID NO: 1935767 - protein, 8 aa, Staphylococcus
EGKQHKES

SEQ ID NO: 1935768 - protein, 7 aa, Staphylococcus
EGKQLLT

SEQ ID NO: 1935769 - protein, 8 aa, Staphylococcus
EGKQSNHL

SEQ ID NO: 1935770 - protein, 6 aa, Staphylococcus
EGKRSN

SEQ ID NO: 1935771 - protein, 24 aa, Staphylococcus
EGKRYKKKGFKTKREATEAESIAR

SEQ ID NO: 1935772 - protein, 24 aa, Staphylococcus
EGKRYRKKGFRTKREANSAGLDKL

SEQ ID NO: 1935773 - protein, 7 aa, Staphylococcus
EGKSADE

SEQ ID NO: 1935774 - protein, 8 aa, Staphylococcus
EGKSISKI

SEQ ID NO: 1935775 - protein, 12 aa, Staphylococcus
EGKSVSSESKEI

SEQ ID NO: 1935776 - protein, 7 aa, Staphylococcus
EGKSYPR

SEQ ID NO: 1935777 - protein, 8 aa, Staphylococcus
EGKTEGTI

SEQ ID NO: 1935778 - protein, 8 aa, Staphylococcus
EGKTETPL

SEQ ID NO: 1935779 - protein, 5 aa, Staphylococcus
EGKTI

SEQ ID NO: 1935780 - protein, 13 aa, Staphylococcus
EGKTINSKTQDFQ

SEQ ID NO: 1935781 - protein, 13 aa, Staphylococcus
EGKTIYHTGDTGL

SEQ ID NO: 1935782 - protein, 8 aa, Staphylococcus
EGKTKEQI

SEQ ID NO: 1935783 - protein, 8 aa, Staphylococcus
EGKTKEQL

SEQ ID NO: 1935784 - protein, 10 aa, Staphylococcus
EGKTLGRLSS

SEQ ID NO: 1935785 - protein, 21 aa, Staphylococcus
EGKTPASLKKEFDSQRKRNIN

SEQ ID NO: 1935786 - protein, 21 aa, Staphylococcus
EGKTPSSLKKEFDSQRKRNIN

SEQ ID NO: 1935787 - protein, 6 aa, Staphylococcus
EGKTTQ

SEQ ID NO: 1935788 - protein, 11 aa, Staphylococcus
EGKTTRDLNGN

SEQ ID NO: 1935789 - protein, 13 aa, Staphylococcus
EGKTVNEKNQDFQ

SEQ ID NO: 1935790 - protein, 8 aa, Staphylococcus
EGKVTTTG

SEQ ID NO: 1935791 - protein, 4 aa, Staphylococcus
EGLA

SEQ ID NO: 1935792 - protein, 24 aa, Staphylococcus
EGLAKDEAEKLKEQLEEVGATVEL

SEQ ID NO: 1935793 - protein, 16 aa, Staphylococcus
EGLAKPAKLVQGDELN

SEQ ID NO: 1935794 - protein, 21 aa, Staphylococcus
EGLATEETPLDLDSSGDRKVT

SEQ ID NO: 1935795 - protein, 4 aa, Staphylococcus
EGLD

SEQ ID NO: 1935796 - protein, 9 aa, Staphylococcus
EGLDQSGYE

SEQ ID NO: 1935797 - protein, 4 aa, Staphylococcus
EGLE

SEQ ID NO: 1935798 - protein, 8 aa, Staphylococcus
EGLEAPKY

SEQ ID NO: 1935799 - protein, 10 aa, Staphylococcus
EGLEEQTARM

SEQ ID NO: 1935800 - protein, 7 aa, Staphylococcus
EGLEGWG

SEQ ID NO: 1935801 - protein, 11 aa, Staphylococcus
EGLEPNKTSQL

SEQ ID NO: 1935802 - protein, 8 aa, Staphylococcus
EGLGEKNG

SEQ ID NO: 1935803 - protein, 4 aa, Staphylococcus
EGLK

SEQ ID NO: 1935804 - protein, 8 aa, Staphylococcus
EGLKEVSE

SEQ ID NO: 1935805 - protein, 6 aa, Staphylococcus
EGLKQK

SEQ ID NO: 1935806 - protein, 4 aa, Staphylococcus
EGLN

SEQ ID NO: 1935807 - protein, 6 aa, Staphylococcus
EGLNAD

SEQ ID NO: 1935808 - protein, 14 aa, Staphylococcus
EGLNSEDKDENGNI

SEQ ID NO: 1935809 - protein, 8 aa, Staphylococcus
EGLPQSTI

SEQ ID NO: 1935810 - protein, 10 aa, Staphylococcus
EGLPSTNGTL

SEQ ID NO: 1935811 - protein, 20 aa, Staphylococcus
EGLQKKTRDELRKLEKNYDE

SEQ ID NO: 1935812 - protein, 8 aa, Staphylococcus
EGLRQEEA

SEQ ID NO: 1935813 - protein, 9 aa, Staphylococcus
EGLSNKEVA

SEQ ID NO: 1935814 - protein, 4 aa, Staphylococcus
EGLT

SEQ ID NO: 1935815 - protein, 9 aa, Staphylococcus
EGLTEADIG

SEQ ID NO: 1935816 - protein, 8 aa, Staphylococcus
EGLTEEDR

SEQ ID NO: 1935817 - protein, 9 aa, Staphylococcus
EGLTGRQKM

SEQ ID NO: 1935818 - protein, 5 aa, Staphylococcus
EGLTI

SEQ ID NO: 1935819 - protein, 7 aa, Staphylococcus
EGLTQTD

SEQ ID NO: 1935820 - protein, 4 aa, Staphylococcus
EGLV

SEQ ID NO: 1935821 - protein, 15 aa, Staphylococcus
EGMESTLDQLEGLLK

SEQ ID NO: 1935822 - protein, 6 aa, Staphylococcus
EGMGKG

SEQ ID NO: 1935823 - protein, 14 aa, Staphylococcus
EGMNPTAIAQDPFN

SEQ ID NO: 1935824 - protein, 16 aa, Staphylococcus
EGMNSTFDNLETLLET

SEQ ID NO: 1935825 - protein, 10 aa, Staphylococcus
EGMPTKDDFR

SEQ ID NO: 1935826 - protein, 5 aa, Staphylococcus
EGMQR

SEQ ID NO: 1935827 - protein, 18 aa, Staphylococcus
EGMSDTSSYPEVNENQKV

SEQ ID NO: 1935828 - protein, 11 aa, Staphylococcus
EGNAYNPDRSY

SEQ ID NO: 1935829 - protein, 8 aa, Staphylococcus
EGNDATCA

SEQ ID NO: 1935830 - protein, 8 aa, Staphylococcus
EGNDNTKL

SEQ ID NO: 1935831 - protein, 5 aa, Staphylococcus
EGNDS

SEQ ID NO: 1935832 - protein, 7 aa, Staphylococcus
EGNEEAF

SEQ ID NO: 1935833 - protein, 17 aa, Staphylococcus
EGNEKMSKSRGNVVNPD

SEQ ID NO: 1935834 - protein, 20 aa, Staphylococcus
EGNEMTSDEGIRANSSVEKL

SEQ ID NO: 1935835 - protein, 8 aa, Staphylococcus
EGNEPQFE

SEQ ID NO: 1935836 - protein, 8 aa, Staphylococcus
EGNETTKT

SEQ ID NO: 1935837 - protein, 8 aa, Staphylococcus
EGNEYTSK

SEQ ID NO: 1935838 - protein, 4 aa, Staphylococcus
EGNF

SEQ ID NO: 1935839 - protein, 6 aa, Staphylococcus
EGNFRK

SEQ ID NO: 1935840 - protein, 5 aa, Staphylococcus
EGNGA

SEQ ID NO: 1935841 - protein, 12 aa, Staphylococcus
EGNGPKPFTDNP

SEQ ID NO: 1935842 - protein, 6 aa, Staphylococcus
EGNGRH

SEQ ID NO: 1935843 - protein, 7 aa, Staphylococcus
EGNHDDW

SEQ ID NO: 1935844 - protein, 13 aa, Staphylococcus
EGNHDDWTSPPFE

SEQ ID NO: 1935845 - protein, 5 aa, Staphylococcus
EGNHF

SEQ ID NO: 1935846 - protein, 6 aa, Staphylococcus
EGNHPI

SEQ ID NO: 1935847 - protein, 8 aa, Staphylococcus
EGNHQDKY

SEQ ID NO: 1935848 - protein, 30 aa, Staphylococcus
EGNIEKGTTELAKSIADKGNYDYYTFNTIR

SEQ ID NO: 1935849 - protein, 7 aa, Staphylococcus
EGNIETE

SEQ ID NO: 1935850 - protein, 5 aa, Staphylococcus
EGNKV

SEQ ID NO: 1935851 - protein, 8 aa, Staphylococcus
EGNKVTGV

SEQ ID NO: 1935852 - protein, 13 aa, Staphylococcus
EGNNKYNYESSNF

SEQ ID NO: 1935853 - protein, 8 aa, Staphylococcus
EGNNNYGK

SEQ ID NO: 1935854 - protein, 6 aa, Staphylococcus
EGNPGD

SEQ ID NO: 1935855 - protein, 9 aa, Staphylococcus
EGNPLGRST

SEQ ID NO: 1935856 - protein, 14 aa, Staphylococcus
EGNQEWKETLNREQ

SEQ ID NO: 1935857 - protein, 9 aa, Staphylococcus
EGNQVNPSW

SEQ ID NO: 1935858 - protein, 4 aa, Staphylococcus
EGNR

SEQ ID NO: 1935859 - protein, 6 aa, Staphylococcus
EGNSAE

SEQ ID NO: 1935860 - protein, 10 aa, Staphylococcus
EGNSQDIEKQ

SEQ ID NO: 1935861 - protein, 7 aa, Staphylococcus
EGNTAEL

SEQ ID NO: 1935862 - protein, 6 aa, Staphylococcus
EGNTAR

SEQ ID NO: 1935863 - protein, 9 aa, Staphylococcus
EGNTQTGRA

SEQ ID NO: 1935864 - protein, 19 aa, Staphylococcus
EGNVDSVEKKVKKSHPKPL

SEQ ID NO: 1935865 - protein, 4 aa, Staphylococcus
EGNY

SEQ ID NO: 1935866 - protein, 6 aa, Staphylococcus
EGNYKE

SEQ ID NO: 1935867 - protein, 21 aa, Staphylococcus
EGPAYASAKEGVEANYANDLT

SEQ ID NO: 1935868 - protein, 6 aa, Staphylococcus
EGPGFT

SEQ ID NO: 1935869 - protein, 7 aa, Staphylococcus
EGPGFTV

SEQ ID NO: 1935870 - protein, 10 aa, Staphylococcus
EGPGLTKKIN

SEQ ID NO: 1935871 - protein, 13 aa, Staphylococcus
EGPGLTKKINKGI

SEQ ID NO: 1935872 - protein, 5 aa, Staphylococcus
EGPGV

SEQ ID NO: 1935873 - protein, 6 aa, Staphylococcus
EGPNGE

SEQ ID NO: 1935874 - protein, 14 aa, Staphylococcus
EGPNLSRKSETELD

SEQ ID NO: 1935875 - protein, 22 aa, Staphylococcus
EGPQFASAEEGVEANYAKDLTD

SEQ ID NO: 1935876 - protein, 9 aa, Staphylococcus
EGPQRPGHF

SEQ ID NO: 1935877 - protein, 16 aa, Staphylococcus
EGPRRGDGAGSVIIEL

SEQ ID NO: 1935878 - protein, 22 aa, Staphylococcus
EGPTFATAKEGVEANYAKDLTD

SEQ ID NO: 1935879 - protein, 22 aa, Staphylococcus
EGPTYASAKEGVEANYNNDVTD

SEQ ID NO: 1935880 - protein, 11 aa, Staphylococcus
EGQADGLHPNY

SEQ ID NO: 1935881 - protein, 6 aa, Staphylococcus
EGQAKD

SEQ ID NO: 1935882 - protein, 7 aa, Staphylococcus
EGQATQI

SEQ ID NO: 1935883 - protein, 13 aa, Staphylococcus
EGQDITEKALNTY

SEQ ID NO: 1935884 - protein, 7 aa, Staphylococcus
EGQDPVE

SEQ ID NO: 1935885 - protein, 9 aa, Staphylococcus
EGQDYTQEE

SEQ ID NO: 1935886 - protein, 5 aa, Staphylococcus
EGQEI

SEQ ID NO: 1935887 - protein, 7 aa, Staphylococcus
EGQEPVE

SEQ ID NO: 1935888 - protein, 8 aa, Staphylococcus
EGQERSVD

SEQ ID NO: 1935889 - protein, 4 aa, Staphylococcus
EGQI

SEQ ID NO: 1935890 - protein, 8 aa, Staphylococcus
EGQKEEDV

SEQ ID NO: 1935891 - protein, 7 aa, Staphylococcus
EGQKTAS

SEQ ID NO: 1935892 - protein, 4 aa, Staphylococcus
EGQM

SEQ ID NO: 1935893 - protein, 5 aa, Staphylococcus
EGQND

SEQ ID NO: 1935894 - protein, 13 aa, Staphylococcus
EGQNIKEAQAAAY

SEQ ID NO: 1935895 - protein, 4 aa, Staphylococcus
EGQP

SEQ ID NO: 1935896 - protein, 7 aa, Staphylococcus
EGQPAVE

SEQ ID NO: 1935897 - protein, 6 aa, Staphylococcus
EGQPLV

SEQ ID NO: 1935898 - protein, 7 aa, Staphylococcus
EGQPVNG

SEQ ID NO: 1935899 - protein, 39 aa, Staphylococcus
EGQQGISNDEVAAEQNIDLDESEETQKAESTEENTTVES

SEQ ID NO: 1935900 - protein, 39 aa, Staphylococcus
EGQQGVSNDEVAAEQNINLDEKEESQEAESTEENTTVES

SEQ ID NO: 1935901 - protein, 39 aa, Staphylococcus
EGQQGVSNEEVAAEQNIDLDESKEATEAETTEENTSVES

SEQ ID NO: 1935902 - protein, 20 aa, Staphylococcus
EGQQGVSNEEVAAEQNIDLN

SEQ ID NO: 1935903 - protein, 18 aa, Staphylococcus
EGQQGVSNEEVAAEQNIN

SEQ ID NO: 1935904 - protein, 39 aa, Staphylococcus
EGQQGVSNEEVAAEQNINLDEKEESEQAETTEENTSVES

SEQ ID NO: 1935905 - protein, 6 aa, Staphylococcus
EGQQIN

SEQ ID NO: 1935906 - protein, 10 aa, Staphylococcus
EGQQKLQSKP

SEQ ID NO: 1935907 - protein, 5 aa, Staphylococcus
EGQSI

SEQ ID NO: 1935908 - protein, 10 aa, Staphylococcus
EGQTGLNPPV

SEQ ID NO: 1935909 - protein, 11 aa, Staphylococcus
EGQTGVNPPVG

SEQ ID NO: 1935910 - protein, 13 aa, Staphylococcus
EGQTIQQAQHEAY

SEQ ID NO: 1935911 - protein, 17 aa, Staphylococcus
EGQTKSKLGTAEARSAV

SEQ ID NO: 1935912 - protein, 18 aa, Staphylococcus
EGQTKSKLGTPEARSAVD

SEQ ID NO: 1935913 - protein, 19 aa, Staphylococcus
EGQTKSKLGTSEARSAVDS

SEQ ID NO: 1935914 - protein, 18 aa, Staphylococcus
EGQTKSKLGTTEARSAVD

SEQ ID NO: 1935915 - protein, 8 aa, Staphylococcus
EGQTLDIP

SEQ ID NO: 1935916 - protein, 7 aa, Staphylococcus
EGQTLDV

SEQ ID NO: 1935917 - protein, 12 aa, Staphylococcus
EGQTLSDITSRA

SEQ ID NO: 1935918 - protein, 12 aa, Staphylococcus
EGQTNPPTLDSE

SEQ ID NO: 1935919 - protein, 11 aa, Staphylococcus
EGQTNPPTLNS

SEQ ID NO: 1935920 - protein, 18 aa, Staphylococcus
EGQTNPPTLNSETKYKKR

SEQ ID NO: 1935921 - protein, 5 aa, Staphylococcus
EGQTY

SEQ ID NO: 1935922 - protein, 15 aa, Staphylococcus
EGQTYKYDNDIENSI

SEQ ID NO: 1935923 - protein, 17 aa, Staphylococcus
EGQYQSNDRFPSKRQLS

SEQ ID NO: 1935924 - protein, 4 aa, Staphylococcus
EGRA

SEQ ID NO: 1935925 - protein, 12 aa, Staphylococcus
EGRAGKPRGAQE

SEQ ID NO: 1935926 - protein, 5 aa, Staphylococcus
EGRDL

SEQ ID NO: 1935927 - protein, 9 aa, Staphylococcus
EGREGQQQI

SEQ ID NO: 1935928 - protein, 6 aa, Staphylococcus
EGRGVA

SEQ ID NO: 1935929 - protein, 7 aa, Staphylococcus
EGRGVAK

SEQ ID NO: 1935930 - protein, 11 aa, Staphylococcus
EGRKHAENDPT

SEQ ID NO: 1935931 - protein, 14 aa, Staphylococcus
EGRKRSTQAAAGVE

SEQ ID NO: 1935932 - protein, 9 aa, Staphylococcus
EGRKTTDAL

SEQ ID NO: 1935933 - protein, 4 aa, Staphylococcus
EGRL

SEQ ID NO: 1935934 - protein, 7 aa, Staphylococcus
EGRLPQG

SEQ ID NO: 1935935 - protein, 14 aa, Staphylococcus
EGRLRSDEKVQGQF

SEQ ID NO: 1935936 - protein, 4 aa, Staphylococcus
EGRM

SEQ ID NO: 1935937 - protein, 9 aa, Staphylococcus
EGRNTDKAY

SEQ ID NO: 1935938 - protein, 7 aa, Staphylococcus
EGRPALC

SEQ ID NO: 1935939 - protein, 6 aa, Staphylococcus
EGRPEK

SEQ ID NO: 1935940 - protein, 11 aa, Staphylococcus
EGRPVSEADQK

SEQ ID NO: 1935941 - protein, 12 aa, Staphylococcus
EGRQASSKTVKA

SEQ ID NO: 1935942 - protein, 5 aa, Staphylococcus
EGRQK

SEQ ID NO: 1935943 - protein, 6 aa, Staphylococcus
EGRSYV

SEQ ID NO: 1935944 - protein, 11 aa, Staphylococcus
EGRTGSQRELG

SEQ ID NO: 1935945 - protein, 20 aa, Staphylococcus
EGRTRAAQDETHQAGSPSTD

SEQ ID NO: 1935946 - protein, 21 aa, Staphylococcus
EGRTRAAQDNTQQAGAPQTDF

SEQ ID NO: 1935947 - protein, 14 aa, Staphylococcus
EGRYSKETIRHPET

SEQ ID NO: 1935948 - protein, 15 aa, Staphylococcus
EGSDISEAKANAYEA

SEQ ID NO: 1935949 - protein, 5 aa, Staphylococcus
EGSEA

SEQ ID NO: 1935950 - protein, 5 aa, Staphylococcus
EGSEI

SEQ ID NO: 1935951 - protein, 10 aa, Staphylococcus
EGSEIKPSYK

SEQ ID NO: 1935952 - protein, 7 aa, Staphylococcus
EGSEQEL

SEQ ID NO: 1935953 - protein, 11 aa, Staphylococcus
EGSESNQTSPI

SEQ ID NO: 1935954 - protein, 13 aa, Staphylococcus
EGSGGLPVGTGGK

SEQ ID NO: 1935955 - protein, 4 aa, Staphylococcus
EGSK

SEQ ID NO: 1935956 - protein, 7 aa, Staphylococcus
EGSLSEG

SEQ ID NO: 1935957 - protein, 14 aa, Staphylococcus
EGSMKRYEALKKTE

SEQ ID NO: 1935958 - protein, 5 aa, Staphylococcus
EGSRI

SEQ ID NO: 1935959 - protein, 11 aa, Staphylococcus
EGSSLEDNKSH

SEQ ID NO: 1935960 - protein, 11 aa, Staphylococcus
EGSTDAEAAKD

SEQ ID NO: 1935961 - protein, 6 aa, Staphylococcus
EGSTIQ

SEQ ID NO: 1935962 - protein, 8 aa, Staphylococcus
EGSTITKN

SEQ ID NO: 1935963 - protein, 31 aa, Staphylococcus
EGSTYKLKGPNGEEVKLNQSEINDEDELQIG

SEQ ID NO: 1935964 - protein, 4 aa, Staphylococcus
EGSV

SEQ ID NO: 1935965 - protein, 8 aa, Staphylococcus
EGSYSEAD

SEQ ID NO: 1935966 - protein, 9 aa, Staphylococcus
EGTAEDAER

SEQ ID NO: 1935967 - protein, 10 aa, Staphylococcus
EGTAEDSERA

SEQ ID NO: 1935968 - protein, 6 aa, Staphylococcus
EGTAID

SEQ ID NO: 1935969 - protein, 7 aa, Staphylococcus
EGTAKSI

SEQ ID NO: 1935970 - protein, 5 aa, Staphylococcus
EGTDA

SEQ ID NO: 1935971 - protein, 5 aa, Staphylococcus
EGTDL

SEQ ID NO: 1935972 - protein, 6 aa, Staphylococcus
EGTDLT

SEQ ID NO: 1935973 - protein, 4 aa, Staphylococcus
EGTE

SEQ ID NO: 1935974 - protein, 5 aa, Staphylococcus
EGTEI

SEQ ID NO: 1935975 - protein, 7 aa, Staphylococcus
EGTELDG

SEQ ID NO: 1935976 - protein, 9 aa, Staphylococcus
EGTEPTVPR

SEQ ID NO: 1935977 - protein, 8 aa, Staphylococcus
EGTEREQL

SEQ ID NO: 1935978 - protein, 9 aa, Staphylococcus
EGTETTVPR

SEQ ID NO: 1935979 - protein, 4 aa, Staphylococcus
EGTH

SEQ ID NO: 1935980 - protein, 6 aa, Staphylococcus
EGTHYP

SEQ ID NO: 1935981 - protein, 12 aa, Staphylococcus
EGTICEDTASKY

SEQ ID NO: 1935982 - protein, 10 aa, Staphylococcus
EGTIKSEAYT

SEQ ID NO: 1935983 - protein, 10 aa, Staphylococcus
EGTKEDAEQA

SEQ ID NO: 1935984 - protein, 10 aa, Staphylococcus
EGTKEDTERA

SEQ ID NO: 1935985 - protein, 8 aa, Staphylococcus
EGTKEDVE

SEQ ID NO: 1935986 - protein, 5 aa, Staphylococcus
EGTKN

SEQ ID NO: 1935987 - protein, 8 aa, Staphylococcus
EGTKPIEF

SEQ ID NO: 1935988 - protein, 7 aa, Staphylococcus
EGTLHPD

SEQ ID NO: 1935989 - protein, 26 aa, Staphylococcus
EGTLHPDRITATGKTLRENNEDKEIL

SEQ ID NO: 1935990 - protein, 6 aa, Staphylococcus
EGTLVT

SEQ ID NO: 1935991 - protein, 4 aa, Staphylococcus
EGTM

SEQ ID NO: 1935992 - protein, 8 aa, Staphylococcus
EGTMRTSE

SEQ ID NO: 1935993 - protein, 4 aa, Staphylococcus
EGTP

SEQ ID NO: 1935994 - protein, 8 aa, Staphylococcus
EGTPGYEE

SEQ ID NO: 1935995 - protein, 8 aa, Staphylococcus
EGTPGYQQ

SEQ ID NO: 1935996 - protein, 5 aa, Staphylococcus
EGTPL

SEQ ID NO: 1935997 - protein, 9 aa, Staphylococcus
EGTRNGTLD

SEQ ID NO: 1935998 - protein, 11 aa, Staphylococcus
EGTSKKDDTVL

SEQ ID NO: 1935999 - protein, 7 aa, Staphylococcus
EGTSTKS

SEQ ID NO: 1936000 - protein, 11 aa, Staphylococcus
EGTTDESAAKD

SEQ ID NO: 1936001 - protein, 7 aa, Staphylococcus
EGTTEVS

SEQ ID NO: 1936002 - protein, 10 aa, Staphylococcus
EGTTGSQEAL

SEQ ID NO: 1936003 - protein, 14 aa, Staphylococcus
EGTTPHTITGRFSS

SEQ ID NO: 1936004 - protein, 7 aa, Staphylococcus
EGTTSDG

SEQ ID NO: 1936005 - protein, 5 aa, Staphylococcus
EGTVL

SEQ ID NO: 1936006 - protein, 6 aa, Staphylococcus
EGTVTA

SEQ ID NO: 1936007 - protein, 10 aa, Staphylococcus
EGTYYTPSYD

SEQ ID NO: 1936008 - protein, 24 aa, Staphylococcus
EGVAKEEAEKLKEQLEEVGATVEL

SEQ ID NO: 1936009 - protein, 4 aa, Staphylococcus
EGVE

SEQ ID NO: 1936010 - protein, 4 aa, Staphylococcus
EGVK

SEQ ID NO: 1936011 - protein, 10 aa, Staphylococcus
EGVKEESGEL

SEQ ID NO: 1936012 - protein, 15 aa, Staphylococcus
EGVNGMNDEEPSQKK

SEQ ID NO: 1936013 - protein, 10 aa, Staphylococcus
EGVQSSNADV

SEQ ID NO: 1936014 - protein, 6 aa, Staphylococcus
EGVQTA

SEQ ID NO: 1936015 - protein, 4 aa, Staphylococcus
EGVR

SEQ ID NO: 1936016 - protein, 10 aa, Staphylococcus
EGVSGSQEAL

SEQ ID NO: 1936017 - protein, 9 aa, Staphylococcus
EGVSQNAVT

SEQ ID NO: 1936018 - protein, 7 aa, Staphylococcus
EGYADAR

SEQ ID NO: 1936019 - protein, 7 aa, Staphylococcus
EGYATEG

SEQ ID NO: 1936020 - protein, 10 aa, Staphylococcus
EGYAYESGGD

SEQ ID NO: 1936021 - protein, 8 aa, Staphylococcus
EGYAYESH

SEQ ID NO: 1936022 - protein, 9 aa, Staphylococcus
EGYAYESNG

SEQ ID NO: 1936023 - protein, 10 aa, Staphylococcus
EGYDNLEQEL

SEQ ID NO: 1936024 - protein, 8 aa, Staphylococcus
EGYDSGHI

SEQ ID NO: 1936025 - protein, 14 aa, Staphylococcus
EGYDSGYVSKSKNL

SEQ ID NO: 1936026 - protein, 7 aa, Staphylococcus
EGYDTPN

SEQ ID NO: 1936027 - protein, 10 aa, Staphylococcus
EGYDTSDKQL

SEQ ID NO: 1936028 - protein, 4 aa, Staphylococcus
EGYE

SEQ ID NO: 1936029 - protein, 11 aa, Staphylococcus
EGYEKLEQELE

SEQ ID NO: 1936030 - protein, 6 aa, Staphylococcus
EGYEQL

SEQ ID NO: 1936031 - protein, 7 aa, Staphylococcus
EGYEQLE

SEQ ID NO: 1936032 - protein, 5 aa, Staphylococcus
EGYFE

SEQ ID NO: 1936033 - protein, 9 aa, Staphylococcus
EGYGPNEAA

SEQ ID NO: 1936034 - protein, 9 aa, Staphylococcus
EGYKKGLRK

SEQ ID NO: 1936035 - protein, 17 aa, Staphylococcus
EGYNQTQLAKKAGISRQ

SEQ ID NO: 1936036 - protein, 10 aa, Staphylococcus
EGYPATMNSP

SEQ ID NO: 1936037 - protein, 16 aa, Staphylococcus
EGYPATMNSPQLRNTV

SEQ ID NO: 1936038 - protein, 10 aa, Staphylococcus
EGYPPTFNDP

SEQ ID NO: 1936039 - protein, 20 aa, Staphylococcus
EGYPPTMNSPELRESVEQAL

SEQ ID NO: 1936040 - protein, 16 aa, Staphylococcus
EGYPPTMNSPKLRASV

SEQ ID NO: 1936041 - protein, 17 aa, Staphylococcus
EGYPPTMNSPKLREPVE

SEQ ID NO: 1936042 - protein, 12 aa, Staphylococcus
EGYPPTYNDPKL

SEQ ID NO: 1936043 - protein, 14 aa, Staphylococcus
EGYQGSVTQAARTN

SEQ ID NO: 1936044 - protein, 43 aa, Staphylococcus
EGYQSSNVSSNQNLVSTNTVNDESLQQVQTSASEETSKEISSP

SEQ ID NO: 1936045 - protein, 4 aa, Staphylococcus
EGYS

SEQ ID NO: 1936046 - protein, 6 aa, Staphylococcus
EGYSPE

SEQ ID NO: 1936047 - protein, 5 aa, Staphylococcus
EGYSQ

SEQ ID NO: 1936048 - protein, 8 aa, Staphylococcus
EGYSTGGS

SEQ ID NO: 1936049 - protein, 4 aa, Staphylococcus
EGYT

SEQ ID NO: 1936050 - protein, 4 aa, Staphylococcus
EGYY

SEQ ID NO: 1936051 - protein, 6 aa, Staphylococcus
EHAEEI

SEQ ID NO: 1936052 - protein, 8 aa, Staphylococcus
EHAELSER

SEQ ID NO: 1936053 - protein, 12 aa, Staphylococcus
EHAGDPSEREIT

SEQ ID NO: 1936054 - protein, 10 aa, Staphylococcus
EHAGFTSGTP

SEQ ID NO: 1936055 - protein, 11 aa, Staphylococcus
EHANVTPATIR

SEQ ID NO: 1936056 - protein, 5 aa, Staphylococcus
EHAQI

SEQ ID NO: 1936057 - protein, 6 aa, Staphylococcus
EHAQQP

SEQ ID NO: 1936058 - protein, 7 aa, Staphylococcus
EHAQVGR

SEQ ID NO: 1936059 - protein, 5 aa, Staphylococcus
EHASK

SEQ ID NO: 1936060 - protein, 10 aa, Staphylococcus
EHASYTAQPQ

SEQ ID NO: 1936061 - protein, 9 aa, Staphylococcus
EHASYTQHP

SEQ ID NO: 1936062 - protein, 7 aa, Staphylococcus
EHDAEKV

SEQ ID NO: 1936063 - protein, 4 aa, Staphylococcus
EHDE

SEQ ID NO: 1936064 - protein, 5 aa, Staphylococcus
EHDEL

SEQ ID NO: 1936065 - protein, 11 aa, Staphylococcus
EHDFDRTVNQE

SEQ ID NO: 1936066 - protein, 6 aa, Staphylococcus
EHDGSL

SEQ ID NO: 1936067 - protein, 50 aa, Staphylococcus
EHDKRDDESRNNDKQQTEVKRDTQQPVQSTQAENTNQQSQHNDETTHRDD

SEQ ID NO: 1936068 - protein, 15 aa, Staphylococcus
EHDPRMSNPTKPIGP

SEQ ID NO: 1936069 - protein, 5 aa, Staphylococcus
EHDVS

SEQ ID NO: 1936070 - protein, 14 aa, Staphylococcus
EHEAKRELSDQPEI

SEQ ID NO: 1936071 - protein, 7 aa, Staphylococcus
EHEDAEA

SEQ ID NO: 1936072 - protein, 10 aa, Staphylococcus
EHEDAEDTIN

SEQ ID NO: 1936073 - protein, 10 aa, Staphylococcus
EHEDAEETVN

SEQ ID NO: 1936074 - protein, 12 aa, Staphylococcus
EHEDEKASRFAN

SEQ ID NO: 1936075 - protein, 4 aa, Staphylococcus
EHEE

SEQ ID NO: 1936076 - protein, 12 aa, Staphylococcus
EHEERYKKADEF

SEQ ID NO: 1936077 - protein, 7 aa, Staphylococcus
EHEGTYS

SEQ ID NO: 1936078 - protein, 4 aa, Staphylococcus
EHEI

SEQ ID NO: 1936079 - protein, 9 aa, Staphylococcus
EHENDDGDL

SEQ ID NO: 1936080 - protein, 10 aa, Staphylococcus
EHENGDYGKQ

SEQ ID NO: 1936081 - protein, 7 aa, Staphylococcus
EHEQGKR

SEQ ID NO: 1936082 - protein, 9 aa, Staphylococcus
EHESEDGDL

SEQ ID NO: 1936083 - protein, 7 aa, Staphylococcus
EHESEEY

SEQ ID NO: 1936084 - protein, 6 aa, Staphylococcus
EHESHN

SEQ ID NO: 1936085 - protein, 6 aa, Staphylococcus
EHESHS

SEQ ID NO: 1936086 - protein, 7 aa, Staphylococcus
EHESNPI

SEQ ID NO: 1936087 - protein, 14 aa, Staphylococcus
EHESSYKQEDYPRY

SEQ ID NO: 1936088 - protein, 4 aa, Staphylococcus
EHET

SEQ ID NO: 1936089 - protein, 6 aa, Staphylococcus
EHETHP

SEQ ID NO: 1936090 - protein, 11 aa, Staphylococcus
EHETKAPDYFN

SEQ ID NO: 1936091 - protein, 14 aa, Staphylococcus
EHEYQDVSSTNENV

SEQ ID NO: 1936092 - protein, 13 aa, Staphylococcus
EHFTYDSNKKVNG

SEQ ID NO: 1936093 - protein, 22 aa, Staphylococcus
EHGAKTYDFGGTDNNPDKDSEH

SEQ ID NO: 1936094 - protein, 23 aa, Staphylococcus
EHGATSYDFGGTDNNPDKDSDHY

SEQ ID NO: 1936095 - protein, 22 aa, Staphylococcus
EHGATTYDFGGTDNNPDKDSEH

SEQ ID NO: 1936096 - protein, 9 aa, Staphylococcus
EHGEKAHSI

SEQ ID NO: 1936097 - protein, 6 aa, Staphylococcus
EHGELE

SEQ ID NO: 1936098 - protein, 13 aa, Staphylococcus
EHGEQVTSVEAKE

SEQ ID NO: 1936099 - protein, 13 aa, Staphylococcus
EHGEYDEVATSAA

SEQ ID NO: 1936100 - protein, 19 aa, Staphylococcus
EHGGENGAKEAGKQRLEGK

SEQ ID NO: 1936101 - protein, 18 aa, Staphylococcus
EHGGENGAKEAGRQRLEG

SEQ ID NO: 1936102 - protein, 5 aa, Staphylococcus
EHGHH

SEQ ID NO: 1936103 - protein, 20 aa, Staphylococcus
EHGRTKRKQAESELNELETE

SEQ ID NO: 1936104 - protein, 10 aa, Staphylococcus
EHGSKVATNE

SEQ ID NO: 1936105 - protein, 11 aa, Staphylococcus
EHGTKAHDIRK

SEQ ID NO: 1936106 - protein, 5 aa, Staphylococcus
EHGVG

SEQ ID NO: 1936107 - protein, 5 aa, Staphylococcus
EHHEE

SEQ ID NO: 1936108 - protein, 8 aa, Staphylococcus
EHHQTSGD

SEQ ID NO: 1936109 - protein, 9 aa, Staphylococcus
EHIEKAGLK

SEQ ID NO: 1936110 - protein, 22 aa, Staphylococcus
EHIGRNDPCPCGSGKKYKNCHG

SEQ ID NO: 1936111 - protein, 11 aa, Staphylococcus
EHIPPKTGADI

SEQ ID NO: 1936112 - protein, 7 aa, Staphylococcus
EHIQSAP

SEQ ID NO: 1936113 - protein, 4 aa, Staphylococcus
EHIS

SEQ ID NO: 1936114 - protein, 6 aa, Staphylococcus
EHKANS

SEQ ID NO: 1936115 - protein, 6 aa, Staphylococcus
EHKDKA

SEQ ID NO: 1936116 - protein, 19 aa, Staphylococcus
EHKDKDHDDYYEIKIRIYK

SEQ ID NO: 1936117 - protein, 4 aa, Staphylococcus
EHKE

SEQ ID NO: 1936118 - protein, 6 aa, Staphylococcus
EHKENN

SEQ ID NO: 1936119 - protein, 9 aa, Staphylococcus
EHKNPFESG

SEQ ID NO: 1936120 - protein, 15 aa, Staphylococcus
EHKQANRQIDKSQFE

SEQ ID NO: 1936121 - protein, 15 aa, Staphylococcus
EHKTRGANTTPETVS

SEQ ID NO: 1936122 - protein, 6 aa, Staphylococcus
EHKYPE

SEQ ID NO: 1936123 - protein, 10 aa, Staphylococcus
EHLDEGKKSV

SEQ ID NO: 1936124 - protein, 10 aa, Staphylococcus
EHLEKGKKSV

SEQ ID NO: 1936125 - protein, 10 aa, Staphylococcus
EHLGEGKKSI

SEQ ID NO: 1936126 - protein, 4 aa, Staphylococcus
EHLN

SEQ ID NO: 1936127 - protein, 4 aa, Staphylococcus
EHLP

SEQ ID NO: 1936128 - protein, 4 aa, Staphylococcus
EHLR

SEQ ID NO: 1936129 - protein, 32 aa, Staphylococcus
EHLSEHKDEYIDKGKEIAKDKFGDDKKDKKDD

SEQ ID NO: 1936130 - protein, 10 aa, Staphylococcus
EHLSESQGTT

SEQ ID NO: 1936131 - protein, 12 aa, Staphylococcus
EHLTTNQSKKIE

SEQ ID NO: 1936132 - protein, 10 aa, Staphylococcus
EHMSGGERQR

SEQ ID NO: 1936133 - protein, 7 aa, Staphylococcus
EHNDEAK

SEQ ID NO: 1936134 - protein, 4 aa, Staphylococcus
EHNE

SEQ ID NO: 1936135 - protein, 8 aa, Staphylococcus
EHNEAATT

SEQ ID NO: 1936136 - protein, 6 aa, Staphylococcus
EHNEEA

SEQ ID NO: 1936137 - protein, 20 aa, Staphylococcus
EHNEEGKPSEAAENRRQQME

SEQ ID NO: 1936138 - protein, 20 aa, Staphylococcus
EHNEEGKPSEAASNRQAQME

SEQ ID NO: 1936139 - protein, 26 aa, Staphylococcus
EHNEEGKTSEAADNRQQQMDKRMRKT

SEQ ID NO: 1936140 - protein, 26 aa, Staphylococcus
EHNEEGKTSEAATNRQQQMDKRMRKT

SEQ ID NO: 1936141 - protein, 5 aa, Staphylococcus
EHNHD

SEQ ID NO: 1936142 - protein, 26 aa, Staphylococcus
EHNQEGKPSEAADNRREQMEKRMSKT

SEQ ID NO: 1936143 - protein, 13 aa, Staphylococcus
EHNQQGKPSEAAM

SEQ ID NO: 1936144 - protein, 8 aa, Staphylococcus
EHNRENDL

SEQ ID NO: 1936145 - protein, 8 aa, Staphylococcus
EHNTEQLR

SEQ ID NO: 1936146 - protein, 9 aa, Staphylococcus
EHNYGTDNE

SEQ ID NO: 1936147 - protein, 7 aa, Staphylococcus
EHPDEVQ

SEQ ID NO: 1936148 - protein, 24 aa, Staphylococcus
EHPEFKTPDSPTVRVGGEAQSSFE

SEQ ID NO: 1936149 - protein, 13 aa, Staphylococcus
EHPEIKQDIDNKL

SEQ ID NO: 1936150 - protein, 9 aa, Staphylococcus
EHPENQINE

SEQ ID NO: 1936151 - protein, 12 aa, Staphylococcus
EHPLTPLPDSIE

SEQ ID NO: 1936152 - protein, 10 aa, Staphylococcus
EHPNMPSTVT

SEQ ID NO: 1936153 - protein, 9 aa, Staphylococcus
EHPPGPSKR

SEQ ID NO: 1936154 - protein, 10 aa, Staphylococcus
EHPPGPSKSI

SEQ ID NO: 1936155 - protein, 9 aa, Staphylococcus
EHPPGPSKT

SEQ ID NO: 1936156 - protein, 10 aa, Staphylococcus
EHPPGPSKTI

SEQ ID NO: 1936157 - protein, 9 aa, Staphylococcus
EHPPGPSKY

SEQ ID NO: 1936158 - protein, 23 aa, Staphylococcus
EHPRYGKQLKADTFEKEVPQTKD

SEQ ID NO: 1936159 - protein, 9 aa, Staphylococcus
EHPSNKQVT

SEQ ID NO: 1936160 - protein, 10 aa, Staphylococcus
EHQDAEDTVK

SEQ ID NO: 1936161 - protein, 10 aa, Staphylococcus
EHQDAKDTVR

SEQ ID NO: 1936162 - protein, 13 aa, Staphylococcus
EHQDEKASRFANE

SEQ ID NO: 1936163 - protein, 6 aa, Staphylococcus
EHQGHE

SEQ ID NO: 1936164 - protein, 8 aa, Staphylococcus
EHQKENAA

SEQ ID NO: 1936165 - protein, 6 aa, Staphylococcus
EHQKKL

SEQ ID NO: 1936166 - protein, 4 aa, Staphylococcus
EHQL

SEQ ID NO: 1936167 - protein, 5 aa, Staphylococcus
EHQPK

SEQ ID NO: 1936168 - protein, 13 aa, Staphylococcus
EHQSDIQKSFESD

SEQ ID NO: 1936169 - protein, 6 aa, Staphylococcus
EHQSQS

SEQ ID NO: 1936170 - protein, 5 aa, Staphylococcus
EHQTD

SEQ ID NO: 1936171 - protein, 6 aa, Staphylococcus
EHQTGM

SEQ ID NO: 1936172 - protein, 8 aa, Staphylococcus
EHQTLQNK

SEQ ID NO: 1936173 - protein, 6 aa, Staphylococcus
EHQTSI

SEQ ID NO: 1936174 - protein, 11 aa, Staphylococcus
EHQTTTTFESD

SEQ ID NO: 1936175 - protein, 19 aa, Staphylococcus
EHRDKDHDDYYEIKIKIYK

SEQ ID NO: 1936176 - protein, 6 aa, Staphylococcus
EHREKI

SEQ ID NO: 1936177 - protein, 13 aa, Staphylococcus
EHRERLRKKQALS

SEQ ID NO: 1936178 - protein, 14 aa, Staphylococcus
EHRERYRSKRRQNQ

SEQ ID NO: 1936179 - protein, 12 aa, Staphylococcus
EHRGRVGSGQVG

SEQ ID NO: 1936180 - protein, 5 aa, Staphylococcus
EHRKH

SEQ ID NO: 1936181 - protein, 8 aa, Staphylococcus
EHRKPQNF

SEQ ID NO: 1936182 - protein, 9 aa, Staphylococcus
EHRNAQNYA

SEQ ID NO: 1936183 - protein, 8 aa, Staphylococcus
EHRNPFES

SEQ ID NO: 1936184 - protein, 9 aa, Staphylococcus
EHRQAQNYA

SEQ ID NO: 1936185 - protein, 5 aa, Staphylococcus
EHSER

SEQ ID NO: 1936186 - protein, 8 aa, Staphylococcus
EHSGPQSL

SEQ ID NO: 1936187 - protein, 5 aa, Staphylococcus
EHSGV

SEQ ID NO: 1936188 - protein, 5 aa, Staphylococcus
EHSHQ

SEQ ID NO: 1936189 - protein, 5 aa, Staphylococcus
EHSKE

SEQ ID NO: 1936190 - protein, 6 aa, Staphylococcus
EHSNEE

SEQ ID NO: 1936191 - protein, 4 aa, Staphylococcus
EHSQ

SEQ ID NO: 1936192 - protein, 26 aa, Staphylococcus
EHSQEGKPSESAQNRQEQMDKRMRKT

SEQ ID NO: 1936193 - protein, 8 aa, Staphylococcus
EHSSQGRL

SEQ ID NO: 1936194 - protein, 13 aa, Staphylococcus
EHSVGHSERSGAV

SEQ ID NO: 1936195 - protein, 21 aa, Staphylococcus
EHTDEDIEETLRAADYAFSQM

SEQ ID NO: 1936196 - protein, 7 aa, Staphylococcus
EHTDNGV

SEQ ID NO: 1936197 - protein, 10 aa, Staphylococcus
EHTEEDIDET

SEQ ID NO: 1936198 - protein, 12 aa, Staphylococcus
EHTEEDIDKTIE

SEQ ID NO: 1936199 - protein, 21 aa, Staphylococcus
EHTEEDIDKTLEAADYAFSQM

SEQ ID NO: 1936200 - protein, 21 aa, Staphylococcus
EHTEEDIDQTLEAADYAFSQM

SEQ ID NO: 1936201 - protein, 21 aa, Staphylococcus
EHTEEDIDQTLKAADYAFSQM

SEQ ID NO: 1936202 - protein, 21 aa, Staphylococcus
EHTEEDIDSTLKAVDYAFSQM

SEQ ID NO: 1936203 - protein, 11 aa, Staphylococcus
EHTEYKDGQEV

SEQ ID NO: 1936204 - protein, 16 aa, Staphylococcus
EHTKEKFSDPETRAET

SEQ ID NO: 1936205 - protein, 16 aa, Staphylococcus
EHTKEKFSDPKTRAET

SEQ ID NO: 1936206 - protein, 16 aa, Staphylococcus
EHTKEKFSDPQTRAET

SEQ ID NO: 1936207 - protein, 10 aa, Staphylococcus
EHTQQNNNQM

SEQ ID NO: 1936208 - protein, 21 aa, Staphylococcus
EHTQSGKIARETMKQRYMKGA

SEQ ID NO: 1936209 - protein, 7 aa, Staphylococcus
EHTSGHI

SEQ ID NO: 1936210 - protein, 37 aa, Staphylococcus
EHVDQSQTQTSTQQQAQPAAKEETKKLTQQNPSKPVI

SEQ ID NO: 1936211 - protein, 5 aa, Staphylococcus
EHVTQ

SEQ ID NO: 1936212 - protein, 5 aa, Staphylococcus
EHYGA

SEQ ID NO: 1936213 - protein, 9 aa, Staphylococcus
EHYGAPNYK

SEQ ID NO: 1936214 - protein, 11 aa, Staphylococcus
EHYSEHTDKPF

SEQ ID NO: 1936215 - protein, 6 aa, Staphylococcus
EIAAEQ

SEQ ID NO: 1936216 - protein, 4 aa, Staphylococcus
EIAD

SEQ ID NO: 1936217 - protein, 16 aa, Staphylococcus
EIADGKVSPVIPQEFL

SEQ ID NO: 1936218 - protein, 24 aa, Staphylococcus
EIAEHTSNRERRAIEAERDTDELK

SEQ ID NO: 1936219 - protein, 25 aa, Staphylococcus
EIAEHTSQRERRAIDAERDTDELKK

SEQ ID NO: 1936220 - protein, 23 aa, Staphylococcus
EIAEKDGKDAANDAQQKAEKDGK

SEQ ID NO: 1936221 - protein, 7 aa, Staphylococcus
EIAEKDW

SEQ ID NO: 1936222 - protein, 9 aa, Staphylococcus
EIAEKTAHL

SEQ ID NO: 1936223 - protein, 6 aa, Staphylococcus
EIAEND

SEQ ID NO: 1936224 - protein, 6 aa, Staphylococcus
EIAENR

SEQ ID NO: 1936225 - protein, 14 aa, Staphylococcus
EIAKETEGVGTSGN

SEQ ID NO: 1936226 - protein, 6 aa, Staphylococcus
EIAKPD

SEQ ID NO: 1936227 - protein, 20 aa, Staphylococcus
EIANELDSEANSVDEYKENL

SEQ ID NO: 1936228 - protein, 15 aa, Staphylococcus
EIANKDISDFYAEKI

SEQ ID NO: 1936229 - protein, 7 aa, Staphylococcus
EIANKGT

SEQ ID NO: 1936230 - protein, 8 aa, Staphylococcus
EIANQQGN

SEQ ID NO: 1936231 - protein, 4 aa, Staphylococcus
EIAP

SEQ ID NO: 1936232 - protein, 6 aa, Staphylococcus
EIAPMP

SEQ ID NO: 1936233 - protein, 7 aa, Staphylococcus
EIAPNLE

SEQ ID NO: 1936234 - protein, 9 aa, Staphylococcus
EIAPNLEAG

SEQ ID NO: 1936235 - protein, 5 aa, Staphylococcus
EIARG

SEQ ID NO: 1936236 - protein, 4 aa, Staphylococcus
EIAS

SEQ ID NO: 1936237 - protein, 6 aa, Staphylococcus
EIASKS

SEQ ID NO: 1936238 - protein, 4 aa, Staphylococcus
EIAT

SEQ ID NO: 1936239 - protein, 10 aa, Staphylococcus
EIATEEGATY

SEQ ID NO: 1936240 - protein, 7 aa, Staphylococcus
EIATQEN

SEQ ID NO: 1936241 - protein, 19 aa, Staphylococcus
EIDDKGRVNASHRALLNKE

SEQ ID NO: 1936242 - protein, 11 aa, Staphylococcus
EIDDVKKQNDY

SEQ ID NO: 1936243 - protein, 11 aa, Staphylococcus
EIDEADKKDAE

SEQ ID NO: 1936244 - protein, 5 aa, Staphylococcus
EIDED

SEQ ID NO: 1936245 - protein, 6 aa, Staphylococcus
EIDESL

SEQ ID NO: 1936246 - protein, 5 aa, Staphylococcus
EIDGA

SEQ ID NO: 1936247 - protein, 17 aa, Staphylococcus
EIDKQGRVNASHKAINE

SEQ ID NO: 1936248 - protein, 15 aa, Staphylococcus
EIDKQGRVNASHKAL

SEQ ID NO: 1936249 - protein, 16 aa, Staphylococcus
EIDKQGRVNASHKVLV

SEQ ID NO: 1936250 - protein, 5 aa, Staphylococcus
EIDND

SEQ ID NO: 1936251 - protein, 10 aa, Staphylococcus
EIDNRDTKLE

SEQ ID NO: 1936252 - protein, 5 aa, Staphylococcus
EIDPD

SEQ ID NO: 1936253 - protein, 6 aa, Staphylococcus
EIDPLG

SEQ ID NO: 1936254 - protein, 6 aa, Staphylococcus
EIDPNQ

SEQ ID NO: 1936255 - protein, 9 aa, Staphylococcus
EIDQEKRKE

SEQ ID NO: 1936256 - protein, 15 aa, Staphylococcus
EIDSQTGHVSMGKDE

SEQ ID NO: 1936257 - protein, 20 aa, Staphylococcus
EIDTQSDPDSESTPSTEKQR

SEQ ID NO: 1936258 - protein, 5 aa, Staphylococcus
EIDTR

SEQ ID NO: 1936259 - protein, 6 aa, Staphylococcus
EIDVSS

SEQ ID NO: 1936260 - protein, 10 aa, Staphylococcus
EIEAEGDVAT

SEQ ID NO: 1936261 - protein, 11 aa, Staphylococcus
EIEAEGDVATG

SEQ ID NO: 1936262 - protein, 5 aa, Staphylococcus
EIEAG

SEQ ID NO: 1936263 - protein, 7 aa, Staphylococcus
EIEAHKG

SEQ ID NO: 1936264 - protein, 27 aa, Staphylococcus
EIEAPKKDAKSAPKQSIKKNSSIKVNT

SEQ ID NO: 1936265 - protein, 4 aa, Staphylococcus
EIED

SEQ ID NO: 1936266 - protein, 5 aa, Staphylococcus
EIEDA

SEQ ID NO: 1936267 - protein, 5 aa, Staphylococcus
EIEDD

SEQ ID NO: 1936268 - protein, 5 aa, Staphylococcus
EIEEA

SEQ ID NO: 1936269 - protein, 11 aa, Staphylococcus
EIEERGGGRQR

SEQ ID NO: 1936270 - protein, 6 aa, Staphylococcus
EIEESG

SEQ ID NO: 1936271 - protein, 6 aa, Staphylococcus
EIEFGP

SEQ ID NO: 1936272 - protein, 5 aa, Staphylococcus
EIEGD

SEQ ID NO: 1936273 - protein, 8 aa, Staphylococcus
EIEGFDKS

SEQ ID NO: 1936274 - protein, 5 aa, Staphylococcus
EIEGI

SEQ ID NO: 1936275 - protein, 13 aa, Staphylococcus
EIEGLEKKEFNNG

SEQ ID NO: 1936276 - protein, 5 aa, Staphylococcus
EIEGT

SEQ ID NO: 1936277 - protein, 6 aa, Staphylococcus
EIEGTG

SEQ ID NO: 1936278 - protein, 10 aa, Staphylococcus
EIEHSQQRYP

SEQ ID NO: 1936279 - protein, 4 aa, Staphylococcus
EIEK

SEQ ID NO: 1936280 - protein, 8 aa, Staphylococcus
EIEKEDNN

SEQ ID NO: 1936281 - protein, 11 aa, Staphylococcus
EIEKKGERYQE

SEQ ID NO: 1936282 - protein, 12 aa, Staphylococcus
EIEKNGDDASTK

SEQ ID NO: 1936283 - protein, 15 aa, Staphylococcus
EIEKQDSELTDEDLQ

SEQ ID NO: 1936284 - protein, 17 aa, Staphylococcus
EIEKQDSELTDEELEES

SEQ ID NO: 1936285 - protein, 17 aa, Staphylococcus
EIEKQDSELTDKDLQDA

SEQ ID NO: 1936286 - protein, 18 aa, Staphylococcus
EIEKQETELTDEELQESI

SEQ ID NO: 1936287 - protein, 6 aa, Staphylococcus
EIEKQG

SEQ ID NO: 1936288 - protein, 9 aa, Staphylococcus
EIEKSNNEA

SEQ ID NO: 1936289 - protein, 10 aa, Staphylococcus
EIEKSNNKQL

SEQ ID NO: 1936290 - protein, 8 aa, Staphylococcus
EIENDRES

SEQ ID NO: 1936291 - protein, 11 aa, Staphylococcus
EIENKDLPDGI

SEQ ID NO: 1936292 - protein, 5 aa, Staphylococcus
EIENN

SEQ ID NO: 1936293 - protein, 5 aa, Staphylococcus
EIENS

SEQ ID NO: 1936294 - protein, 6 aa, Staphylococcus
EIEPKT

SEQ ID NO: 1936295 - protein, 5 aa, Staphylococcus
EIEPN

SEQ ID NO: 1936296 - protein, 11 aa, Staphylococcus
EIEQKKPRSTF

SEQ ID NO: 1936297 - protein, 12 aa, Staphylococcus
EIERAAEQAVED

SEQ ID NO: 1936298 - protein, 9 aa, Staphylococcus
EIERDQLSD

SEQ ID NO: 1936299 - protein, 5 aa, Staphylococcus
EIESE

SEQ ID NO: 1936300 - protein, 13 aa, Staphylococcus
EIESHKKKSTIDS

SEQ ID NO: 1936301 - protein, 6 aa, Staphylococcus
EIESNL

SEQ ID NO: 1936302 - protein, 11 aa, Staphylococcus
EIETDDKDSNV

SEQ ID NO: 1936303 - protein, 12 aa, Staphylococcus
EIETKDPQSGEI

SEQ ID NO: 1936304 - protein, 8 aa, Staphylococcus
EIETNRDD

SEQ ID NO: 1936305 - protein, 10 aa, Staphylococcus
EIETRAKEQK

SEQ ID NO: 1936306 - protein, 11 aa, Staphylococcus
EIEVPGDKSMT

SEQ ID NO: 1936307 - protein, 5 aa, Staphylococcus
EIEYD

SEQ ID NO: 1936308 - protein, 12 aa, Staphylococcus
EIEYQDKRSPSI

SEQ ID NO: 1936309 - protein, 4 aa, Staphylococcus
EIFD

SEQ ID NO: 1936310 - protein, 5 aa, Staphylococcus
EIFTE

SEQ ID NO: 1936311 - protein, 4 aa, Staphylococcus
EIGD

SEQ ID NO: 1936312 - protein, 10 aa, Staphylococcus
EIGDAKDVAN

SEQ ID NO: 1936313 - protein, 8 aa, Staphylococcus
EIGDAQDI

SEQ ID NO: 1936314 - protein, 8 aa, Staphylococcus
EIGEAQDV

SEQ ID NO: 1936315 - protein, 6 aa, Staphylococcus
EIGEEG

SEQ ID NO: 1936316 - protein, 11 aa, Staphylococcus
EIGEEGSPEEL

SEQ ID NO: 1936317 - protein, 9 aa, Staphylococcus
EIGEGNKPE

SEQ ID NO: 1936318 - protein, 10 aa, Staphylococcus
EIGEKETEAL

SEQ ID NO: 1936319 - protein, 7 aa, Staphylococcus
EIGESTG

SEQ ID NO: 1936320 - protein, 5 aa, Staphylococcus
EIGGD

SEQ ID NO: 1936321 - protein, 5 aa, Staphylococcus
EIGHS

SEQ ID NO: 1936322 - protein, 14 aa, Staphylococcus
EIGKDISKEALESE

SEQ ID NO: 1936323 - protein, 8 aa, Staphylococcus
EIGKSPAQ

SEQ ID NO: 1936324 - protein, 12 aa, Staphylococcus
EIGKTTQASLSD

SEQ ID NO: 1936325 - protein, 19 aa, Staphylococcus
EIGPKTKKDKLRIVYETLF

SEQ ID NO: 1936326 - protein, 5 aa, Staphylococcus
EIGPR

SEQ ID NO: 1936327 - protein, 7 aa, Staphylococcus
EIGQESI

SEQ ID NO: 1936328 - protein, 6 aa, Staphylococcus
EIGQRQ

SEQ ID NO: 1936329 - protein, 8 aa, Staphylococcus
EIGRGGNV

SEQ ID NO: 1936330 - protein, 5 aa, Staphylococcus
EIGRK

SEQ ID NO: 1936331 - protein, 7 aa, Staphylococcus
EIGTPGT

SEQ ID NO: 1936332 - protein, 7 aa, Staphylococcus
EIGTPNY

SEQ ID NO: 1936333 - protein, 8 aa, Staphylococcus
EIGVDTPN

SEQ ID NO: 1936334 - protein, 12 aa, Staphylococcus
EIGYETDATLAR

SEQ ID NO: 1936335 - protein, 11 aa, Staphylococcus
EIHDGDVKKAK

SEQ ID NO: 1936336 - protein, 4 aa, Staphylococcus
EIHE

SEQ ID NO: 1936337 - protein, 16 aa, Staphylococcus
EIIEKAEQQLKAKYPR

SEQ ID NO: 1936338 - protein, 13 aa, Staphylococcus
EIIKGNSTPLPNM

SEQ ID NO: 1936339 - protein, 13 aa, Staphylococcus
EIIPNSKKIHASS

SEQ ID NO: 1936340 - protein, 4 aa, Staphylococcus
EIIR

SEQ ID NO: 1936341 - protein, 6 aa, Staphylococcus
EIKANL

SEQ ID NO: 1936342 - protein, 6 aa, Staphylococcus
EIKARA

SEQ ID NO: 1936343 - protein, 14 aa, Staphylococcus
EIKDAKKETKLDSI

SEQ ID NO: 1936344 - protein, 10 aa, Staphylococcus
EIKDLENEIE

SEQ ID NO: 1936345 - protein, 6 aa, Staphylococcus
EIKDND

SEQ ID NO: 1936346 - protein, 18 aa, Staphylococcus
EIKDTKEAIEKKEEYDQR

SEQ ID NO: 1936347 - protein, 6 aa, Staphylococcus
EIKDVG

SEQ ID NO: 1936348 - protein, 6 aa, Staphylococcus
EIKEGT

SEQ ID NO: 1936349 - protein, 8 aa, Staphylococcus
EIKEKYSE

SEQ ID NO: 1936350 - protein, 7 aa, Staphylococcus
EIKERDD

SEQ ID NO: 1936351 - protein, 6 aa, Staphylococcus
EIKERK

SEQ ID NO: 1936352 - protein, 6 aa, Staphylococcus
EIKESW

SEQ ID NO: 1936353 - protein, 5 aa, Staphylococcus
EIKFN

SEQ ID NO: 1936354 - protein, 9 aa, Staphylococcus
EIKGHDNRA

SEQ ID NO: 1936355 - protein, 21 aa, Staphylococcus
EIKGRKGKTINGTFIKEADLK

SEQ ID NO: 1936356 - protein, 5 aa, Staphylococcus
EIKKD

SEQ ID NO: 1936357 - protein, 9 aa, Staphylococcus
EIKKGDTVG

SEQ ID NO: 1936358 - protein, 5 aa, Staphylococcus
EIKKS

SEQ ID NO: 1936359 - protein, 19 aa, Staphylococcus
EIKKTSQAVRDGHTDDVQL

SEQ ID NO: 1936360 - protein, 4 aa, Staphylococcus
EIKN

SEQ ID NO: 1936361 - protein, 5 aa, Staphylococcus
EIKNG

SEQ ID NO: 1936362 - protein, 14 aa, Staphylococcus
EIKPDDTKENLEER

SEQ ID NO: 1936363 - protein, 5 aa, Staphylococcus
EIKPG

SEQ ID NO: 1936364 - protein, 7 aa, Staphylococcus
EIKPSEV

SEQ ID NO: 1936365 - protein, 9 aa, Staphylococcus
EIKSGFDPA

SEQ ID NO: 1936366 - protein, 12 aa, Staphylococcus
EIKSHRENGNGK

SEQ ID NO: 1936367 - protein, 6 aa, Staphylococcus
EIKSQG

SEQ ID NO: 1936368 - protein, 8 aa, Staphylococcus
EIKTGHPM

SEQ ID NO: 1936369 - protein, 10 aa, Staphylococcus
EIKTTTDEND

SEQ ID NO: 1936370 - protein, 10 aa, Staphylococcus
EIKYEQSQHA

SEQ ID NO: 1936371 - protein, 13 aa, Staphylococcus
EIKYTQSKEGTQA

SEQ ID NO: 1936372 - protein, 12 aa, Staphylococcus
EIKYTQSKNSIQ

SEQ ID NO: 1936373 - protein, 17 aa, Staphylococcus
EILSQKPAKAKKGTDIK

SEQ ID NO: 1936374 - protein, 6 aa, Staphylococcus
EINAES

SEQ ID NO: 1936375 - protein, 5 aa, Staphylococcus
EINDD

SEQ ID NO: 1936376 - protein, 9 aa, Staphylococcus
EINDETANR

SEQ ID NO: 1936377 - protein, 7 aa, Staphylococcus
EINDGEI

SEQ ID NO: 1936378 - protein, 12 aa, Staphylococcus
EINDNNQQAIDT

SEQ ID NO: 1936379 - protein, 9 aa, Staphylococcus
EINDSTADK

SEQ ID NO: 1936380 - protein, 25 aa, Staphylococcus
EINEAGRKPDLPFGGYKQSGIGREW

SEQ ID NO: 1936381 - protein, 25 aa, Staphylococcus
EINEAGRKPDLPFGGYKQSGLGREW

SEQ ID NO: 1936382 - protein, 16 aa, Staphylococcus
EINEHREKSNISTQPN

SEQ ID NO: 1936383 - protein, 6 aa, Staphylococcus
EINEND

SEQ ID NO: 1936384 - protein, 8 aa, Staphylococcus
EINENTQK

SEQ ID NO: 1936385 - protein, 9 aa, Staphylococcus
EINETDGVT

SEQ ID NO: 1936386 - protein, 10 aa, Staphylococcus
EINETEINAS

SEQ ID NO: 1936387 - protein, 10 aa, Staphylococcus
EINETSQQAI

SEQ ID NO: 1936388 - protein, 4 aa, Staphylococcus
EINF

SEQ ID NO: 1936389 - protein, 5 aa, Staphylococcus
EINGT

SEQ ID NO: 1936390 - protein, 6 aa, Staphylococcus
EINGTH

SEQ ID NO: 1936391 - protein, 8 aa, Staphylococcus
EINKNTKQ

SEQ ID NO: 1936392 - protein, 8 aa, Staphylococcus
EINKRAEH

SEQ ID NO: 1936393 - protein, 8 aa, Staphylococcus
EINKRANH

SEQ ID NO: 1936394 - protein, 8 aa, Staphylococcus
EINKRATH

SEQ ID NO: 1936395 - protein, 16 aa, Staphylococcus
EINNSTIRSNANIKQS

SEQ ID NO: 1936396 - protein, 4 aa, Staphylococcus
EINP

SEQ ID NO: 1936397 - protein, 5 aa, Staphylococcus
EINPD

SEQ ID NO: 1936398 - protein, 10 aa, Staphylococcus
EINPEKQNRH

SEQ ID NO: 1936399 - protein, 6 aa, Staphylococcus
EINPET

SEQ ID NO: 1936400 - protein, 13 aa, Staphylococcus
EINPETFNKEFKD

SEQ ID NO: 1936401 - protein, 6 aa, Staphylococcus
EINPGR

SEQ ID NO: 1936402 - protein, 4 aa, Staphylococcus
EINR

SEQ ID NO: 1936403 - protein, 10 aa, Staphylococcus
EINSDLEQTD

SEQ ID NO: 1936404 - protein, 13 aa, Staphylococcus
EINSPSGNADEAI

SEQ ID NO: 1936405 - protein, 12 aa, Staphylococcus
EINSPSGNAEKA

SEQ ID NO: 1936406 - protein, 12 aa, Staphylococcus
EINSPSGNATEA

SEQ ID NO: 1936407 - protein, 11 aa, Staphylococcus
EINTSAKTVYY

SEQ ID NO: 1936408 - protein, 13 aa, Staphylococcus
EINTSAKTVYYPD

SEQ ID NO: 1936409 - protein, 8 aa, Staphylococcus
EINTSPTF

SEQ ID NO: 1936410 - protein, 4 aa, Staphylococcus
EINV

SEQ ID NO: 1936411 - protein, 11 aa, Staphylococcus
EIPDGTNDTIS

SEQ ID NO: 1936412 - protein, 4 aa, Staphylococcus
EIPE

SEQ ID NO: 1936413 - protein, 7 aa, Staphylococcus
EIPEDFQ

SEQ ID NO: 1936414 - protein, 20 aa, Staphylococcus
EIPEDFQPQVATPRLRERYQ

SEQ ID NO: 1936415 - protein, 6 aa, Staphylococcus
EIPEKA

SEQ ID NO: 1936416 - protein, 8 aa, Staphylococcus
EIPESNEK

SEQ ID NO: 1936417 - protein, 4 aa, Staphylococcus
EIPG

SEQ ID NO: 1936418 - protein, 8 aa, Staphylococcus
EIPKDNVE

SEQ ID NO: 1936419 - protein, 7 aa, Staphylococcus
EIPKENV

SEQ ID NO: 1936420 - protein, 8 aa, Staphylococcus
EIPKENVQ

SEQ ID NO: 1936421 - protein, 8 aa, Staphylococcus
EIPKKPQI

SEQ ID NO: 1936422 - protein, 4 aa, Staphylococcus
EIPL

SEQ ID NO: 1936423 - protein, 7 aa, Staphylococcus
EIPNQKS

SEQ ID NO: 1936424 - protein, 6 aa, Staphylococcus
EIPPEK

SEQ ID NO: 1936425 - protein, 14 aa, Staphylococcus
EIPPEKQKADDLAE

SEQ ID NO: 1936426 - protein, 7 aa, Staphylococcus
EIPPEKV

SEQ ID NO: 1936427 - protein, 7 aa, Staphylococcus
EIPPENV

SEQ ID NO: 1936428 - protein, 13 aa, Staphylococcus
EIPQPNEPSTAET

SEQ ID NO: 1936429 - protein, 4 aa, Staphylococcus
EIPR

SEQ ID NO: 1936430 - protein, 13 aa, Staphylococcus
EIPSDQEAMDIGP

SEQ ID NO: 1936431 - protein, 11 aa, Staphylococcus
EIPSPSGDAYK

SEQ ID NO: 1936432 - protein, 12 aa, Staphylococcus
EIPSTNLKPYQQ

SEQ ID NO: 1936433 - protein, 4 aa, Staphylococcus
EIQA

SEQ ID NO: 1936434 - protein, 22 aa, Staphylococcus
EIQDGGQSKKEKLNTPSKPKFI

SEQ ID NO: 1936435 - protein, 5 aa, Staphylococcus
EIQEI

SEQ ID NO: 1936436 - protein, 16 aa, Staphylococcus
EIQEINKNYRDKDKVT

SEQ ID NO: 1936437 - protein, 5 aa, Staphylococcus
EIQLD

SEQ ID NO: 1936438 - protein, 11 aa, Staphylococcus
EIQNHKEHGNG

SEQ ID NO: 1936439 - protein, 8 aa, Staphylococcus
EIQNREEQ

SEQ ID NO: 1936440 - protein, 18 aa, Staphylococcus
EIQNSTSNDDESSNIKDS

SEQ ID NO: 1936441 - protein, 6 aa, Staphylococcus
EIQPKT

SEQ ID NO: 1936442 - protein, 7 aa, Staphylococcus
EIQQKYS

SEQ ID NO: 1936443 - protein, 6 aa, Staphylococcus
EIQTDH

SEQ ID NO: 1936444 - protein, 18 aa, Staphylococcus
EIQVDQNGKPNKMSEDDK

SEQ ID NO: 1936445 - protein, 8 aa, Staphylococcus
EIQVTEKE

SEQ ID NO: 1936446 - protein, 7 aa, Staphylococcus
EIREAEG

SEQ ID NO: 1936447 - protein, 12 aa, Staphylococcus
EIREGDEVKRTG

SEQ ID NO: 1936448 - protein, 6 aa, Staphylococcus
EIRETE

SEQ ID NO: 1936449 - protein, 5 aa, Staphylococcus
EIREY

SEQ ID NO: 1936450 - protein, 10 aa, Staphylococcus
EIRQKNRQID

SEQ ID NO: 1936451 - protein, 8 aa, Staphylococcus
EIRQTDGS

SEQ ID NO: 1936452 - protein, 7 aa, Staphylococcus
EIRQTEG

SEQ ID NO: 1936453 - protein, 8 aa, Staphylococcus
EIRQTKQV

SEQ ID NO: 1936454 - protein, 17 aa, Staphylococcus
EIRQTKQVGVGPQQREF

SEQ ID NO: 1936455 - protein, 5 aa, Staphylococcus
EISDE

SEQ ID NO: 1936456 - protein, 7 aa, Staphylococcus
EISDGLS

SEQ ID NO: 1936457 - protein, 12 aa, Staphylococcus
EISDLAASKPNL

SEQ ID NO: 1936458 - protein, 5 aa, Staphylococcus
EISDT

SEQ ID NO: 1936459 - protein, 10 aa, Staphylococcus
EISEENQQAI

SEQ ID NO: 1936460 - protein, 12 aa, Staphylococcus
EISEGDEVKRTG

SEQ ID NO: 1936461 - protein, 8 aa, Staphylococcus
EISEHSSP

SEQ ID NO: 1936462 - protein, 8 aa, Staphylococcus
EISEKGTK

SEQ ID NO: 1936463 - protein, 12 aa, Staphylococcus
EISENVVDLKDG

SEQ ID NO: 1936464 - protein, 8 aa, Staphylococcus
EISESKDN

SEQ ID NO: 1936465 - protein, 4 aa, Staphylococcus
EISI

SEQ ID NO: 1936466 - protein, 16 aa, Staphylococcus
EISINEQRANVIREHI

SEQ ID NO: 1936467 - protein, 5 aa, Staphylococcus
EISIR

SEQ ID NO: 1936468 - protein, 7 aa, Staphylococcus
EISKENV

SEQ ID NO: 1936469 - protein, 14 aa, Staphylococcus
EISKNTQSDVSLEA

SEQ ID NO: 1936470 - protein, 5 aa, Staphylococcus
EISKQ

SEQ ID NO: 1936471 - protein, 11 aa, Staphylococcus
EISNNEKRSKL

SEQ ID NO: 1936472 - protein, 21 aa, Staphylococcus
EISNNNKDFEQKIKNNEEKIN

SEQ ID NO: 1936473 - protein, 8 aa, Staphylococcus
EISPSGKG

SEQ ID NO: 1936474 - protein, 9 aa, Staphylococcus
EISQENQEA

SEQ ID NO: 1936475 - protein, 5 aa, Staphylococcus
EISQT

SEQ ID NO: 1936476 - protein, 5 aa, Staphylococcus
EISSC

SEQ ID NO: 1936477 - protein, 7 aa, Staphylococcus
EISSGYA

SEQ ID NO: 1936478 - protein, 14 aa, Staphylococcus
EISSYESPRDAWLY

SEQ ID NO: 1936479 - protein, 4 aa, Staphylococcus
EIST

SEQ ID NO: 1936480 - protein, 15 aa, Staphylococcus
EISTESKEDSTKNLE

SEQ ID NO: 1936481 - protein, 22 aa, Staphylococcus
EISTSSIEIPKDSIAHIKFLIS

SEQ ID NO: 1936482 - protein, 7 aa, Staphylococcus
EISTSSN

SEQ ID NO: 1936483 - protein, 6 aa, Staphylococcus
EISTST

SEQ ID NO: 1936484 - protein, 11 aa, Staphylococcus
EITDAVTEGVP

SEQ ID NO: 1936485 - protein, 12 aa, Staphylococcus
EITEGDEVRRTG

SEQ ID NO: 1936486 - protein, 10 aa, Staphylococcus
EITENSDLEG

SEQ ID NO: 1936487 - protein, 6 aa, Staphylococcus
EITERA

SEQ ID NO: 1936488 - protein, 5 aa, Staphylococcus
EITGA

SEQ ID NO: 1936489 - protein, 6 aa, Staphylococcus
EITGAN

SEQ ID NO: 1936490 - protein, 7 aa, Staphylococcus
EITGDKG

SEQ ID NO: 1936491 - protein, 11 aa, Staphylococcus
EITGSNAIHPG

SEQ ID NO: 1936492 - protein, 4 aa, Staphylococcus
EITH

SEQ ID NO: 1936493 - protein, 11 aa, Staphylococcus
EITKDAYGKTI

SEQ ID NO: 1936494 - protein, 17 aa, Staphylococcus
EITKDAYGKTIRAKTMG

SEQ ID NO: 1936495 - protein, 7 aa, Staphylococcus
EITKDPK

SEQ ID NO: 1936496 - protein, 7 aa, Staphylococcus
EITNRDN

SEQ ID NO: 1936497 - protein, 5 aa, Staphylococcus
EITNT

SEQ ID NO: 1936498 - protein, 10 aa, Staphylococcus
EITNTKQDLS

SEQ ID NO: 1936499 - protein, 8 aa, Staphylococcus
EITPISDA

SEQ ID NO: 1936500 - protein, 5 aa, Staphylococcus
EITPL

SEQ ID NO: 1936501 - protein, 7 aa, Staphylococcus
EITPQKV

SEQ ID NO: 1936502 - protein, 6 aa, Staphylococcus
EITTCD

SEQ ID NO: 1936503 - protein, 5 aa, Staphylococcus
EITYD

SEQ ID NO: 1936504 - protein, 4 aa, Staphylococcus
EIVA

SEQ ID NO: 1936505 - protein, 14 aa, Staphylococcus
EIVKGNSTPGMKTR

SEQ ID NO: 1936506 - protein, 12 aa, Staphylococcus
EIVKSGPKDSVI

SEQ ID NO: 1936507 - protein, 13 aa, Staphylococcus
EIVNDGKVGPITK

SEQ ID NO: 1936508 - protein, 21 aa, Staphylococcus
EIVNDPDKLRKYSKEQADLQK

SEQ ID NO: 1936509 - protein, 21 aa, Staphylococcus
EIVNDSDKLRKYSKEQADLQK

SEQ ID NO: 1936510 - protein, 5 aa, Staphylococcus
EIVTT

SEQ ID NO: 1936511 - protein, 6 aa, Staphylococcus
EIWEGK

SEQ ID NO: 1936512 - protein, 8 aa, Staphylococcus
EKAASIEE

SEQ ID NO: 1936513 - protein, 13 aa, Staphylococcus
EKADFKADETVSG

SEQ ID NO: 1936514 - protein, 11 aa, Staphylococcus
EKADPSLTYSK

SEQ ID NO: 1936515 - protein, 6 aa, Staphylococcus
EKADRY

SEQ ID NO: 1936516 - protein, 7 aa, Staphylococcus
EKAEFPE

SEQ ID NO: 1936517 - protein, 6 aa, Staphylococcus
EKAEKW

SEQ ID NO: 1936518 - protein, 8 aa, Staphylococcus
EKAELPEV

SEQ ID NO: 1936519 - protein, 14 aa, Staphylococcus
EKAEQLAEDKGPGT

SEQ ID NO: 1936520 - protein, 16 aa, Staphylococcus
EKAERQKRAEKALDDT

SEQ ID NO: 1936521 - protein, 10 aa, Staphylococcus
EKAESNPPHK

SEQ ID NO: 1936522 - protein, 5 aa, Staphylococcus
EKAFR

SEQ ID NO: 1936523 - protein, 7 aa, Staphylococcus
EKAFSKQ

SEQ ID NO: 1936524 - protein, 7 aa, Staphylococcus
EKAGGTA

SEQ ID NO: 1936525 - protein, 8 aa, Staphylococcus
EKAGINYT

SEQ ID NO: 1936526 - protein, 15 aa, Staphylococcus
EKAGIPSDALEPYGH

SEQ ID NO: 1936527 - protein, 17 aa, Staphylococcus
EKAGKQFKHNTGKSKRC

SEQ ID NO: 1936528 - protein, 6 aa, Staphylococcus
EKAGLN

SEQ ID NO: 1936529 - protein, 6 aa, Staphylococcus
EKAGQR

SEQ ID NO: 1936530 - protein, 6 aa, Staphylococcus
EKAGVD

SEQ ID NO: 1936531 - protein, 6 aa, Staphylococcus
EKAHGM

SEQ ID NO: 1936532 - protein, 8 aa, Staphylococcus
EKAKAEVD

SEQ ID NO: 1936533 - protein, 32 aa, Staphylococcus
EKAKEAEEKLKEQKEEKTNDTEQTKKDIDDAL

SEQ ID NO: 1936534 - protein, 32 aa, Staphylococcus
EKAKEAEEKLKEQNEEKTDDIEQTKKDVQDTL

SEQ ID NO: 1936535 - protein, 32 aa, Staphylococcus
EKAKEAEEKLKKEKESTEDSIEQTKKDVQDTL

SEQ ID NO: 1936536 - protein, 7 aa, Staphylococcus
EKAKELN

SEQ ID NO: 1936537 - protein, 20 aa, Staphylococcus
EKAKENGEASGRPPQTISSN

SEQ ID NO: 1936538 - protein, 8 aa, Staphylococcus
EKAKETQF

SEQ ID NO: 1936539 - protein, 13 aa, Staphylococcus
EKAKGSGEENYDE

SEQ ID NO: 1936540 - protein, 32 aa, Staphylococcus
EKAKKAEDKLKEEKESAKDNTEETKQNIQDTL

SEQ ID NO: 1936541 - protein, 7 aa, Staphylococcus
EKAKKYK

SEQ ID NO: 1936542 - protein, 6 aa, Staphylococcus
EKAKLD

SEQ ID NO: 1936543 - protein, 9 aa, Staphylococcus
EKAKNDEHF

SEQ ID NO: 1936544 - protein, 12 aa, Staphylococcus
EKAKNDEHSDRI

SEQ ID NO: 1936545 - protein, 7 aa, Staphylococcus
EKAKSGQ

SEQ ID NO: 1936546 - protein, 6 aa, Staphylococcus
EKAKSL

SEQ ID NO: 1936547 - protein, 8 aa, Staphylococcus
EKAKSNSL

SEQ ID NO: 1936548 - protein, 11 aa, Staphylococcus
EKAKTKQIEIP

SEQ ID NO: 1936549 - protein, 23 aa, Staphylococcus
EKAKTKQIEIPRNKIAKARHAVM

SEQ ID NO: 1936550 - protein, 8 aa, Staphylococcus
EKAKTVGA

SEQ ID NO: 1936551 - protein, 7 aa, Staphylococcus
EKALQQR

SEQ ID NO: 1936552 - protein, 11 aa, Staphylococcus
EKANEKETQKI

SEQ ID NO: 1936553 - protein, 9 aa, Staphylococcus
EKANEVDSK

SEQ ID NO: 1936554 - protein, 5 aa, Staphylococcus
EKANG

SEQ ID NO: 1936555 - protein, 8 aa, Staphylococcus
EKANPAAI

SEQ ID NO: 1936556 - protein, 13 aa, Staphylococcus
EKANTTLKEVGDS

SEQ ID NO: 1936557 - protein, 6 aa, Staphylococcus
EKAPDI

SEQ ID NO: 1936558 - protein, 10 aa, Staphylococcus
EKAPDVRKQY

SEQ ID NO: 1936559 - protein, 9 aa, Staphylococcus
EKAPQQDVT

SEQ ID NO: 1936560 - protein, 7 aa, Staphylococcus
EKAQQKE

SEQ ID NO: 1936561 - protein, 8 aa, Staphylococcus
EKAQQKEV

SEQ ID NO: 1936562 - protein, 7 aa, Staphylococcus
EKAQYLS

SEQ ID NO: 1936563 - protein, 19 aa, Staphylococcus
EKARRDREERERAEQASRT

SEQ ID NO: 1936564 - protein, 8 aa, Staphylococcus
EKARTNET

SEQ ID NO: 1936565 - protein, 8 aa, Staphylococcus
EKASDDAI

SEQ ID NO: 1936566 - protein, 14 aa, Staphylococcus
EKASEIDDKLDSEL

SEQ ID NO: 1936567 - protein, 8 aa, Staphylococcus
EKASESAG

SEQ ID NO: 1936568 - protein, 13 aa, Staphylococcus
EKASGRKTKRTEL

SEQ ID NO: 1936569 - protein, 8 aa, Staphylococcus
EKASKDFK

SEQ ID NO: 1936570 - protein, 8 aa, Staphylococcus
EKASNSAG

SEQ ID NO: 1936571 - protein, 15 aa, Staphylococcus
EKASPDSNQKRGGSL

SEQ ID NO: 1936572 - protein, 22 aa, Staphylococcus
EKASSDVSLATESDDAKKLKIT

SEQ ID NO: 1936573 - protein, 8 aa, Staphylococcus
EKASSTYI

SEQ ID NO: 1936574 - protein, 6 aa, Staphylococcus
EKATDI

SEQ ID NO: 1936575 - protein, 7 aa, Staphylococcus
EKATDLQ

SEQ ID NO: 1936576 - protein, 8 aa, Staphylococcus
EKATRVNR

SEQ ID NO: 1936577 - protein, 6 aa, Staphylococcus
EKATSI

SEQ ID NO: 1936578 - protein, 7 aa, Staphylococcus
EKATSID

SEQ ID NO: 1936579 - protein, 7 aa, Staphylococcus
EKATSVQ

SEQ ID NO: 1936580 - protein, 4 aa, Staphylococcus
EKAV

SEQ ID NO: 1936581 - protein, 7 aa, Staphylococcus
EKAYDNK

SEQ ID NO: 1936582 - protein, 21 aa, Staphylococcus
EKAYGSNKVAEIAKSAGETQL

SEQ ID NO: 1936583 - protein, 8 aa, Staphylococcus
EKAYNGEK

SEQ ID NO: 1936584 - protein, 9 aa, Staphylococcus
EKAYNGEKQ

SEQ ID NO: 1936585 - protein, 14 aa, Staphylococcus
EKAYYNANSPHQMG

SEQ ID NO: 1936586 - protein, 4 aa, Staphylococcus
EKDA

SEQ ID NO: 1936587 - protein, 10 aa, Staphylococcus
EKDAKSRSFN

SEQ ID NO: 1936588 - protein, 11 aa, Staphylococcus
EKDAKVSYEDR

SEQ ID NO: 1936589 - protein, 13 aa, Staphylococcus
EKDANENERAIKE

SEQ ID NO: 1936590 - protein, 15 aa, Staphylococcus
EKDANIPYNDRGYNF

SEQ ID NO: 1936591 - protein, 14 aa, Staphylococcus
EKDASAAEKTISEI

SEQ ID NO: 1936592 - protein, 14 aa, Staphylococcus
EKDASEAQKALTEI

SEQ ID NO: 1936593 - protein, 14 aa, Staphylococcus
EKDATNAQKDINEI

SEQ ID NO: 1936594 - protein, 8 aa, Staphylococcus
EKDDDKDL

SEQ ID NO: 1936595 - protein, 7 aa, Staphylococcus
EKDDTED

SEQ ID NO: 1936596 - protein, 15 aa, Staphylococcus
EKDDYIDGSAIQEGQ

SEQ ID NO: 1936597 - protein, 15 aa, Staphylococcus
EKDDYIDGSSVEPGQ

SEQ ID NO: 1936598 - protein, 14 aa, Staphylococcus
EKDDYIDGSTVKPG

SEQ ID NO: 1936599 - protein, 9 aa, Staphylococcus
EKDEEGKFT

SEQ ID NO: 1936600 - protein, 7 aa, Staphylococcus
EKDEEIG

SEQ ID NO: 1936601 - protein, 9 aa, Staphylococcus
EKDEPDLKE

SEQ ID NO: 1936602 - protein, 28 aa, Staphylococcus
EKDEQSESNNEERSHSKHVKTPSPSKDN

SEQ ID NO: 1936603 - protein, 10 aa, Staphylococcus
EKDEQSYQDS

SEQ ID NO: 1936604 - protein, 14 aa, Staphylococcus
EKDEYIDGSDVKPG

SEQ ID NO: 1936605 - protein, 14 aa, Staphylococcus
EKDEYIDGSEVEEG

SEQ ID NO: 1936606 - protein, 15 aa, Staphylococcus
EKDEYIDGSKVEAGQ

SEQ ID NO: 1936607 - protein, 13 aa, Staphylococcus
EKDEYSGEQEDEE

SEQ ID NO: 1936608 - protein, 6 aa, Staphylococcus
EKDFNS

SEQ ID NO: 1936609 - protein, 11 aa, Staphylococcus
EKDGLAKSSRN

SEQ ID NO: 1936610 - protein, 8 aa, Staphylococcus
EKDHLSAE

SEQ ID NO: 1936611 - protein, 24 aa, Staphylococcus
EKDHSDTDAKLNPNDLSAPPGVKI

SEQ ID NO: 1936612 - protein, 5 aa, Staphylococcus
EKDIP

SEQ ID NO: 1936613 - protein, 8 aa, Staphylococcus
EKDIPRNE

SEQ ID NO: 1936614 - protein, 9 aa, Staphylococcus
EKDKDYKEH

SEQ ID NO: 1936615 - protein, 9 aa, Staphylococcus
EKDKPIAPG

SEQ ID NO: 1936616 - protein, 9 aa, Staphylococcus
EKDKPQPQI

SEQ ID NO: 1936617 - protein, 9 aa, Staphylococcus
EKDKRNKYF

SEQ ID NO: 1936618 - protein, 7 aa, Staphylococcus
EKDKVDN

SEQ ID NO: 1936619 - protein, 6 aa, Staphylococcus
EKDKVG

SEQ ID NO: 1936620 - protein, 8 aa, Staphylococcus
EKDKVGQA

SEQ ID NO: 1936621 - protein, 6 aa, Staphylococcus
EKDLES

SEQ ID NO: 1936622 - protein, 6 aa, Staphylococcus
EKDLTQ

SEQ ID NO: 1936623 - protein, 6 aa, Staphylococcus
EKDMPP

SEQ ID NO: 1936624 - protein, 4 aa, Staphylococcus
EKDN

SEQ ID NO: 1936625 - protein, 16 aa, Staphylococcus
EKDNRLYGRGTSDMKS

SEQ ID NO: 1936626 - protein, 4 aa, Staphylococcus
EKDP

SEQ ID NO: 1936627 - protein, 9 aa, Staphylococcus
EKDPDDLDG

SEQ ID NO: 1936628 - protein, 5 aa, Staphylococcus
EKDPT

SEQ ID NO: 1936629 - protein, 10 aa, Staphylococcus
EKDQNQDTEV

SEQ ID NO: 1936630 - protein, 7 aa, Staphylococcus
EKDQSVV

SEQ ID NO: 1936631 - protein, 7 aa, Staphylococcus
EKDSDIK

SEQ ID NO: 1936632 - protein, 7 aa, Staphylococcus
EKDSGIK

SEQ ID NO: 1936633 - protein, 5 aa, Staphylococcus
EKDSK

SEQ ID NO: 1936634 - protein, 9 aa, Staphylococcus
EKDSRLSES

SEQ ID NO: 1936635 - protein, 8 aa, Staphylococcus
EKDSTNPV

SEQ ID NO: 1936636 - protein, 6 aa, Staphylococcus
EKDSWN

SEQ ID NO: 1936637 - protein, 8 aa, Staphylococcus
EKDTEDMA

SEQ ID NO: 1936638 - protein, 14 aa, Staphylococcus
EKDVVTTSRFPGTT

SEQ ID NO: 1936639 - protein, 5 aa, Staphylococcus
EKDYD

SEQ ID NO: 1936640 - protein, 5 aa, Staphylococcus
EKEAI

SEQ ID NO: 1936641 - protein, 13 aa, Staphylococcus
EKEATQDKTDYNI

SEQ ID NO: 1936642 - protein, 7 aa, Staphylococcus
EKEAYTK

SEQ ID NO: 1936643 - protein, 8 aa, Staphylococcus
EKEDCDKN

SEQ ID NO: 1936644 - protein, 7 aa, Staphylococcus
EKEDGKN

SEQ ID NO: 1936645 - protein, 14 aa, Staphylococcus
EKEDQTMSIEKNND

SEQ ID NO: 1936646 - protein, 6 aa, Staphylococcus
EKEDYN

SEQ ID NO: 1936647 - protein, 6 aa, Staphylococcus
EKEEAY

SEQ ID NO: 1936648 - protein, 5 aa, Staphylococcus
EKEEG

SEQ ID NO: 1936649 - protein, 5 aa, Staphylococcus
EKEEI

SEQ ID NO: 1936650 - protein, 14 aa, Staphylococcus
EKEEIENEIKEYDK

SEQ ID NO: 1936651 - protein, 13 aa, Staphylococcus
EKEFYNKAKQADF

SEQ ID NO: 1936652 - protein, 4 aa, Staphylococcus
EKEG

SEQ ID NO: 1936653 - protein, 9 aa, Staphylococcus
EKEGHKAQQ

SEQ ID NO: 1936654 - protein, 7 aa, Staphylococcus
EKEGRRY

SEQ ID NO: 1936655 - protein, 6 aa, Staphylococcus
EKEGYD

SEQ ID NO: 1936656 - protein, 6 aa, Staphylococcus
EKEHNM

SEQ ID NO: 1936657 - protein, 13 aa, Staphylococcus
EKEHSEHFNVENA

SEQ ID NO: 1936658 - protein, 13 aa, Staphylococcus
EKEHSTHFNVENA

SEQ ID NO: 1936659 - protein, 4 aa, Staphylococcus
EKEI

SEQ ID NO: 1936660 - protein, 7 aa, Staphylococcus
EKEIDQR

SEQ ID NO: 1936661 - protein, 5 aa, Staphylococcus
EKEIE

SEQ ID NO: 1936662 - protein, 7 aa, Staphylococcus
EKEIQGK

SEQ ID NO: 1936663 - protein, 13 aa, Staphylococcus
EKEISDIRSKLRQ

SEQ ID NO: 1936664 - protein, 6 aa, Staphylococcus
EKEISE

SEQ ID NO: 1936665 - protein, 15 aa, Staphylococcus
EKEITKRTATAHSSI

SEQ ID NO: 1936666 - protein, 17 aa, Staphylococcus
EKEKEAKEKVDKKAKEL

SEQ ID NO: 1936667 - protein, 7 aa, Staphylococcus
EKEKKSK

SEQ ID NO: 1936668 - protein, 6 aa, Staphylococcus
EKEKPD

SEQ ID NO: 1936669 - protein, 37 aa, Staphylococcus
EKEKTQQEEVKHKAETAYRDAEDLNQKINDRKTLTDE

SEQ ID NO: 1936670 - protein, 8 aa, Staphylococcus
EKEKVGEA

SEQ ID NO: 1936671 - protein, 4 aa, Staphylococcus
EKEL

SEQ ID NO: 1936672 - protein, 18 aa, Staphylococcus
EKELAKTGIRATSISPGL

SEQ ID NO: 1936673 - protein, 15 aa, Staphylococcus
EKELKNTIKSSNPIL

SEQ ID NO: 1936674 - protein, 6 aa, Staphylococcus
EKELTE

SEQ ID NO: 1936675 - protein, 7 aa, Staphylococcus
EKELTEY

SEQ ID NO: 1936676 - protein, 9 aa, Staphylococcus
EKENGEIAI

SEQ ID NO: 1936677 - protein, 9 aa, Staphylococcus
EKENIHEDA

SEQ ID NO: 1936678 - protein, 36 aa, Staphylococcus
EKENKSIVQKATKEAEASPYPDPSETYTFVYEEGGV

SEQ ID NO: 1936679 - protein, 10 aa, Staphylococcus
EKENNSNIQP

SEQ ID NO: 1936680 - protein, 5 aa, Staphylococcus
EKENV

SEQ ID NO: 1936681 - protein, 11 aa, Staphylococcus
EKEPREHTSEE

SEQ ID NO: 1936682 - protein, 8 aa, Staphylococcus
EKEQGEDL

SEQ ID NO: 1936683 - protein, 8 aa, Staphylococcus
EKESDDDM

SEQ ID NO: 1936684 - protein, 7 aa, Staphylococcus
EKETARM

SEQ ID NO: 1936685 - protein, 13 aa, Staphylococcus
EKETGASTATISR

SEQ ID NO: 1936686 - protein, 8 aa, Staphylococcus
EKETIENE

SEQ ID NO: 1936687 - protein, 8 aa, Staphylococcus
EKETIPPV

SEQ ID NO: 1936688 - protein, 4 aa, Staphylococcus
EKEW

SEQ ID NO: 1936689 - protein, 5 aa, Staphylococcus
EKEYE

SEQ ID NO: 1936690 - protein, 7 aa, Staphylococcus
EKEYENV

SEQ ID NO: 1936691 - protein, 8 aa, Staphylococcus
EKFEEYAP

SEQ ID NO: 1936692 - protein, 13 aa, Staphylococcus
EKFENEDWEQAAE

SEQ ID NO: 1936693 - protein, 7 aa, Staphylococcus
EKFEPDT

SEQ ID NO: 1936694 - protein, 4 aa, Staphylococcus
EKFG

SEQ ID NO: 1936695 - protein, 16 aa, Staphylococcus
EKFGEDVDELAVNGGF

SEQ ID NO: 1936696 - protein, 34 aa, Staphylococcus
EKFKDSDNEQVNKAKDKINEYTGGGDDDKKDKDD

SEQ ID NO: 1936697 - protein, 10 aa, Staphylococcus
EKFKKEKEIL

SEQ ID NO: 1936698 - protein, 35 aa, Staphylococcus
EKFKNSDNEQVNKAKDQINEYTGGEKHDNKDKKDD

SEQ ID NO: 1936699 - protein, 37 aa, Staphylococcus
EKFKNSDNEQVNKAKDTINEYTDTGKGDKDKKEDKDD

SEQ ID NO: 1936700 - protein, 7 aa, Staphylococcus
EKFNTYS

SEQ ID NO: 1936701 - protein, 4 aa, Staphylococcus
EKFP

SEQ ID NO: 1936702 - protein, 7 aa, Staphylococcus
EKFPGQT

SEQ ID NO: 1936703 - protein, 6 aa, Staphylococcus
EKFQGG

SEQ ID NO: 1936704 - protein, 9 aa, Staphylococcus
EKFQGNGYG

SEQ ID NO: 1936705 - protein, 9 aa, Staphylococcus
EKFSDSPGI

SEQ ID NO: 1936706 - protein, 10 aa, Staphylococcus
EKFSENPQFK

SEQ ID NO: 1936707 - protein, 5 aa, Staphylococcus
EKFSK

SEQ ID NO: 1936708 - protein, 7 aa, Staphylococcus
EKFTGQS

SEQ ID NO: 1936709 - protein, 4 aa, Staphylococcus
EKFW

SEQ ID NO: 1936710 - protein, 9 aa, Staphylococcus
EKGAARAQL

SEQ ID NO: 1936711 - protein, 9 aa, Staphylococcus
EKGADGYEM

SEQ ID NO: 1936712 - protein, 7 aa, Staphylococcus
EKGADVK

SEQ ID NO: 1936713 - protein, 10 aa, Staphylococcus
EKGAGEKKVN

SEQ ID NO: 1936714 - protein, 23 aa, Staphylococcus
EKGAHRHDTHSKNSTAKQLNTAG

SEQ ID NO: 1936715 - protein, 9 aa, Staphylococcus
EKGAPDPAD

SEQ ID NO: 1936716 - protein, 4 aa, Staphylococcus
EKGD

SEQ ID NO: 1936717 - protein, 7 aa, Staphylococcus
EKGDENF

SEQ ID NO: 1936718 - protein, 6 aa, Staphylococcus
EKGDKC

SEQ ID NO: 1936719 - protein, 7 aa, Staphylococcus
EKGEALA

SEQ ID NO: 1936720 - protein, 5 aa, Staphylococcus
EKGEE

SEQ ID NO: 1936721 - protein, 8 aa, Staphylococcus
EKGEPTLE

SEQ ID NO: 1936722 - protein, 6 aa, Staphylococcus
EKGERQ

SEQ ID NO: 1936723 - protein, 6 aa, Staphylococcus
EKGETM

SEQ ID NO: 1936724 - protein, 4 aa, Staphylococcus
EKGF

SEQ ID NO: 1936725 - protein, 8 aa, Staphylococcus
EKGFNEKE

SEQ ID NO: 1936726 - protein, 9 aa, Staphylococcus
EKGGKGGVD

SEQ ID NO: 1936727 - protein, 13 aa, Staphylococcus
EKGHDDASSYSHP

SEQ ID NO: 1936728 - protein, 11 aa, Staphylococcus
EKGHDDATSYA

SEQ ID NO: 1936729 - protein, 13 aa, Staphylococcus
EKGHDDETSYAHP

SEQ ID NO: 1936730 - protein, 5 aa, Staphylococcus
EKGHP

SEQ ID NO: 1936731 - protein, 5 aa, Staphylococcus
EKGIE

SEQ ID NO: 1936732 - protein, 8 aa, Staphylococcus
EKGKAIEI

SEQ ID NO: 1936733 - protein, 7 aa, Staphylococcus
EKGKDDL

SEQ ID NO: 1936734 - protein, 8 aa, Staphylococcus
EKGKEQDI

SEQ ID NO: 1936735 - protein, 10 aa, Staphylococcus
EKGKGASRKI

SEQ ID NO: 1936736 - protein, 11 aa, Staphylococcus
EKGKGKAKQVE

SEQ ID NO: 1936737 - protein, 11 aa, Staphylococcus
EKGKGKSKKVE

SEQ ID NO: 1936738 - protein, 12 aa, Staphylococcus
EKGKGKSKKVEY

SEQ ID NO: 1936739 - protein, 13 aa, Staphylococcus
EKGKGKSKKVEYA

SEQ ID NO: 1936740 - protein, 11 aa, Staphylococcus
EKGKGKSKQVE

SEQ ID NO: 1936741 - protein, 11 aa, Staphylococcus
EKGKGKTKKVE

SEQ ID NO: 1936742 - protein, 7 aa, Staphylococcus
EKGKNDL

SEQ ID NO: 1936743 - protein, 10 aa, Staphylococcus
EKGKNGEPGE

SEQ ID NO: 1936744 - protein, 7 aa, Staphylococcus
EKGKTDL

SEQ ID NO: 1936745 - protein, 7 aa, Staphylococcus
EKGKTEL

SEQ ID NO: 1936746 - protein, 6 aa, Staphylococcus
EKGKTG

SEQ ID NO: 1936747 - protein, 8 aa, Staphylococcus
EKGKYNAK

SEQ ID NO: 1936748 - protein, 10 aa, Staphylococcus
EKGKYTPKMS

SEQ ID NO: 1936749 - protein, 8 aa, Staphylococcus
EKGLDGSR

SEQ ID NO: 1936750 - protein, 7 aa, Staphylococcus
EKGLERA

SEQ ID NO: 1936751 - protein, 7 aa, Staphylococcus
EKGLGQS

SEQ ID NO: 1936752 - protein, 18 aa, Staphylococcus
EKGLHKPIKNTDISRPGL

SEQ ID NO: 1936753 - protein, 6 aa, Staphylococcus
EKGLPI

SEQ ID NO: 1936754 - protein, 13 aa, Staphylococcus
EKGLSVAKDMKEM

SEQ ID NO: 1936755 - protein, 12 aa, Staphylococcus
EKGLTDEPEGGL

SEQ ID NO: 1936756 - protein, 10 aa, Staphylococcus
EKGNDDETSF

SEQ ID NO: 1936757 - protein, 13 aa, Staphylococcus
EKGNGAKTGQDKV

SEQ ID NO: 1936758 - protein, 16 aa, Staphylococcus
EKGNGALIGDEKEDLA

SEQ ID NO: 1936759 - protein, 7 aa, Staphylococcus
EKGNNDL

SEQ ID NO: 1936760 - protein, 11 aa, Staphylococcus
EKGNSIENDAR

SEQ ID NO: 1936761 - protein, 5 aa, Staphylococcus
EKGNT

SEQ ID NO: 1936762 - protein, 13 aa, Staphylococcus
EKGNTGRMLAFIG

SEQ ID NO: 1936763 - protein, 9 aa, Staphylococcus
EKGNYSAIE

SEQ ID NO: 1936764 - protein, 7 aa, Staphylococcus
EKGPKYI

SEQ ID NO: 1936765 - protein, 17 aa, Staphylococcus
EKGPNALVGDEKEALAK

SEQ ID NO: 1936766 - protein, 7 aa, Staphylococcus
EKGPRRV

SEQ ID NO: 1936767 - protein, 13 aa, Staphylococcus
EKGPSSLIGEEKK

SEQ ID NO: 1936768 - protein, 11 aa, Staphylococcus
EKGPTSLDGVE

SEQ ID NO: 1936769 - protein, 4 aa, Staphylococcus
EKGQ

SEQ ID NO: 1936770 - protein, 7 aa, Staphylococcus
EKGQGIE

SEQ ID NO: 1936771 - protein, 9 aa, Staphylococcus
EKGQINPNM

SEQ ID NO: 1936772 - protein, 5 aa, Staphylococcus
EKGQP

SEQ ID NO: 1936773 - protein, 7 aa, Staphylococcus
EKGQSSQ

SEQ ID NO: 1936774 - protein, 6 aa, Staphylococcus
EKGQTG

SEQ ID NO: 1936775 - protein, 14 aa, Staphylococcus
EKGQTGRMLAFIGQ

SEQ ID NO: 1936776 - protein, 14 aa, Staphylococcus
EKGQTGRMLAFIGR

SEQ ID NO: 1936777 - protein, 7 aa, Staphylococcus
EKGQTIT

SEQ ID NO: 1936778 - protein, 5 aa, Staphylococcus
EKGQV

SEQ ID NO: 1936779 - protein, 5 aa, Staphylococcus
EKGRI

SEQ ID NO: 1936780 - protein, 10 aa, Staphylococcus
EKGSGTRVYQ

SEQ ID NO: 1936781 - protein, 7 aa, Staphylococcus
EKGSKYK

SEQ ID NO: 1936782 - protein, 9 aa, Staphylococcus
EKGSSLADA

SEQ ID NO: 1936783 - protein, 8 aa, Staphylococcus
EKGSSLTE

SEQ ID NO: 1936784 - protein, 10 aa, Staphylococcus
EKGSTKTSFE

SEQ ID NO: 1936785 - protein, 7 aa, Staphylococcus
EKGTEIT

SEQ ID NO: 1936786 - protein, 8 aa, Staphylococcus
EKGTEITS

SEQ ID NO: 1936787 - protein, 12 aa, Staphylococcus
EKGTITGRMVIK

SEQ ID NO: 1936788 - protein, 9 aa, Staphylococcus
EKGTPTTNI

SEQ ID NO: 1936789 - protein, 20 aa, Staphylococcus
EKGTTGEGVKSVTGYTGQDA

SEQ ID NO: 1936790 - protein, 6 aa, Staphylococcus
EKGTTM

SEQ ID NO: 1936791 - protein, 16 aa, Staphylococcus
EKGTVEKEGKAEGTTE

SEQ ID NO: 1936792 - protein, 17 aa, Staphylococcus
EKGTVEKEGKAEGTTEE

SEQ ID NO: 1936793 - protein, 16 aa, Staphylococcus
EKGTVEKEGKSEGTTE

SEQ ID NO: 1936794 - protein, 12 aa, Staphylococcus
EKGTVEKEGNTE

SEQ ID NO: 1936795 - protein, 17 aa, Staphylococcus
EKGTVQKEGKAEGSTEE

SEQ ID NO: 1936796 - protein, 16 aa, Staphylococcus
EKGTVQKEGKAEGTTE

SEQ ID NO: 1936797 - protein, 10 aa, Staphylococcus
EKGVKNVHGY

SEQ ID NO: 1936798 - protein, 13 aa, Staphylococcus
EKGVNSDSTTETF

SEQ ID NO: 1936799 - protein, 11 aa, Staphylococcus
EKGYASGFEES

SEQ ID NO: 1936800 - protein, 5 aa, Staphylococcus
EKGYD

SEQ ID NO: 1936801 - protein, 14 aa, Staphylococcus
EKGYDDKTSYAHQI

SEQ ID NO: 1936802 - protein, 6 aa, Staphylococcus
EKGYPT

SEQ ID NO: 1936803 - protein, 10 aa, Staphylococcus
EKHDNLEKQL

SEQ ID NO: 1936804 - protein, 7 aa, Staphylococcus
EKHDQPV

SEQ ID NO: 1936805 - protein, 15 aa, Staphylococcus
EKHEQKEEQRDGKFH

SEQ ID NO: 1936806 - protein, 17 aa, Staphylococcus
EKHGGAAKTSGAGGGDC

SEQ ID NO: 1936807 - protein, 8 aa, Staphylococcus
EKHHDSKA

SEQ ID NO: 1936808 - protein, 6 aa, Staphylococcus
EKHHKT

SEQ ID NO: 1936809 - protein, 12 aa, Staphylococcus
EKHNANGSNLES

SEQ ID NO: 1936810 - protein, 25 aa, Staphylococcus
EKHPEYKTADSPTVRVGGEAQSSFE

SEQ ID NO: 1936811 - protein, 6 aa, Staphylococcus
EKHQKP

SEQ ID NO: 1936812 - protein, 10 aa, Staphylococcus
EKHQLSNTTE

SEQ ID NO: 1936813 - protein, 10 aa, Staphylococcus
EKHQSSQNAY

SEQ ID NO: 1936814 - protein, 4 aa, Staphylococcus
EKHS

SEQ ID NO: 1936815 - protein, 6 aa, Staphylococcus
EKHTGY

SEQ ID NO: 1936816 - protein, 4 aa, Staphylococcus
EKID

SEQ ID NO: 1936817 - protein, 12 aa, Staphylococcus
EKIDDSVRRDPI

SEQ ID NO: 1936818 - protein, 13 aa, Staphylococcus
EKIDNGIKRGKKH

SEQ ID NO: 1936819 - protein, 22 aa, Staphylococcus
EKIDSSVRRDPIHRRQPNFDEL

SEQ ID NO: 1936820 - protein, 6 aa, Staphylococcus
EKIEAD

SEQ ID NO: 1936821 - protein, 9 aa, Staphylococcus
EKIEATLRG

SEQ ID NO: 1936822 - protein, 6 aa, Staphylococcus
EKIEER

SEQ ID NO: 1936823 - protein, 5 aa, Staphylococcus
EKIEH

SEQ ID NO: 1936824 - protein, 6 aa, Staphylococcus
EKIEPT

SEQ ID NO: 1936825 - protein, 6 aa, Staphylococcus
EKIERD

SEQ ID NO: 1936826 - protein, 12 aa, Staphylococcus
EKIERQSGQIED

SEQ ID NO: 1936827 - protein, 12 aa, Staphylococcus
EKIESGIKRGKK

SEQ ID NO: 1936828 - protein, 13 aa, Staphylococcus
EKIESGIKRGKKH

SEQ ID NO: 1936829 - protein, 8 aa, Staphylococcus
EKIETQDE

SEQ ID NO: 1936830 - protein, 6 aa, Staphylococcus
EKIFKS

SEQ ID NO: 1936831 - protein, 4 aa, Staphylococcus
EKIG

SEQ ID NO: 1936832 - protein, 20 aa, Staphylococcus
EKIGRKKYEQKKSHENEIEK

SEQ ID NO: 1936833 - protein, 8 aa, Staphylococcus
EKIGSVGS

SEQ ID NO: 1936834 - protein, 4 aa, Staphylococcus
EKIK

SEQ ID NO: 1936835 - protein, 5 aa, Staphylococcus
EKIKS

SEQ ID NO: 1936836 - protein, 7 aa, Staphylococcus
EKILSRS

SEQ ID NO: 1936837 - protein, 5 aa, Staphylococcus
EKINA

SEQ ID NO: 1936838 - protein, 12 aa, Staphylococcus
EKINKGENLEEQ

SEQ ID NO: 1936839 - protein, 8 aa, Staphylococcus
EKINNNKK

SEQ ID NO: 1936840 - protein, 9 aa, Staphylococcus
EKINNSEQR

SEQ ID NO: 1936841 - protein, 4 aa, Staphylococcus
EKIP

SEQ ID NO: 1936842 - protein, 4 aa, Staphylococcus
EKIQ

SEQ ID NO: 1936843 - protein, 5 aa, Staphylococcus
EKIQE

SEQ ID NO: 1936844 - protein, 10 aa, Staphylococcus
EKIRENTGYP

SEQ ID NO: 1936845 - protein, 13 aa, Staphylococcus
EKIRKQINEAQTS

SEQ ID NO: 1936846 - protein, 8 aa, Staphylococcus
EKISGSQI

SEQ ID NO: 1936847 - protein, 5 aa, Staphylococcus
EKISK

SEQ ID NO: 1936848 - protein, 12 aa, Staphylococcus
EKITGRGSNKEV

SEQ ID NO: 1936849 - protein, 10 aa, Staphylococcus
EKITNETSRN

SEQ ID NO: 1936850 - protein, 19 aa, Staphylococcus
EKITSEPATELPLAQRYFL

SEQ ID NO: 1936851 - protein, 7 aa, Staphylococcus
EKITTQG

SEQ ID NO: 1936852 - protein, 5 aa, Staphylococcus
EKKAL

SEQ ID NO: 1936853 - protein, 6 aa, Staphylococcus
EKKDEI

SEQ ID NO: 1936854 - protein, 10 aa, Staphylococcus
EKKDGARWEN

SEQ ID NO: 1936855 - protein, 11 aa, Staphylococcus
EKKDRTKQEAD

SEQ ID NO: 1936856 - protein, 8 aa, Staphylococcus
EKKEARRM

SEQ ID NO: 1936857 - protein, 5 aa, Staphylococcus
EKKEE

SEQ ID NO: 1936858 - protein, 8 aa, Staphylococcus
EKKEEREH

SEQ ID NO: 1936859 - protein, 5 aa, Staphylococcus
EKKEI

SEQ ID NO: 1936860 - protein, 9 aa, Staphylococcus
EKKENRSDF

SEQ ID NO: 1936861 - protein, 6 aa, Staphylococcus
EKKERF

SEQ ID NO: 1936862 - protein, 24 aa, Staphylococcus
EKKEVRKIAEEQDLATAKKKDSTG

SEQ ID NO: 1936863 - protein, 24 aa, Staphylococcus
EKKEVRRIAEEQDLATAKKKDSTG

SEQ ID NO: 1936864 - protein, 24 aa, Staphylococcus
EKKEVRRIAEEQGLATAKKKDSTG

SEQ ID NO: 1936865 - protein, 6 aa, Staphylococcus
EKKGDD

SEQ ID NO: 1936866 - protein, 8 aa, Staphylococcus
EKKGGYVS

SEQ ID NO: 1936867 - protein, 8 aa, Staphylococcus
EKKGNPIY

SEQ ID NO: 1936868 - protein, 6 aa, Staphylococcus
EKKGQI

SEQ ID NO: 1936869 - protein, 17 aa, Staphylococcus
EKKGYVTRTREIDDERN

SEQ ID NO: 1936870 - protein, 7 aa, Staphylococcus
EKKISGA

SEQ ID NO: 1936871 - protein, 9 aa, Staphylococcus
EKKKDAITK

SEQ ID NO: 1936872 - protein, 7 aa, Staphylococcus
EKKKEAI

SEQ ID NO: 1936873 - protein, 21 aa, Staphylococcus
EKKKKAQEKPAKTVSRTNRSA

SEQ ID NO: 1936874 - protein, 18 aa, Staphylococcus
EKKKPIKVPKISPQSKEE

SEQ ID NO: 1936875 - protein, 18 aa, Staphylococcus
EKKKSDKRAILNHESDLL

SEQ ID NO: 1936876 - protein, 14 aa, Staphylococcus
EKKLIKNGKNWMVI

SEQ ID NO: 1936877 - protein, 11 aa, Staphylococcus
EKKNGDKGKVE

SEQ ID NO: 1936878 - protein, 17 aa, Staphylococcus
EKKNKLRKNIHKDSIKS

SEQ ID NO: 1936879 - protein, 4 aa, Staphylococcus
EKKR

SEQ ID NO: 1936880 - protein, 17 aa, Staphylococcus
EKKRQDHIRQTKENPLT

SEQ ID NO: 1936881 - protein, 8 aa, Staphylococcus
EKKSREQI

SEQ ID NO: 1936882 - protein, 9 aa, Staphylococcus
EKKSREQIE

SEQ ID NO: 1936883 - protein, 7 aa, Staphylococcus
EKKSSEI

SEQ ID NO: 1936884 - protein, 7 aa, Staphylococcus
EKKTGYP

SEQ ID NO: 1936885 - protein, 7 aa, Staphylococcus
EKKTQMN

SEQ ID NO: 1936886 - protein, 44 aa, Staphylococcus
EKKVGNASQMSKKAFAKKVDQETQKIADKYKTTIYAPQKTFKPH

SEQ ID NO: 1936887 - protein, 14 aa, Staphylococcus
EKKYSDSKEQKENL

SEQ ID NO: 1936888 - protein, 18 aa, Staphylococcus
EKLAEKGALGNKTKQGFY

SEQ ID NO: 1936889 - protein, 10 aa, Staphylococcus
EKLAERSREL

SEQ ID NO: 1936890 - protein, 6 aa, Staphylococcus
EKLAKE

SEQ ID NO: 1936891 - protein, 6 aa, Staphylococcus
EKLANR

SEQ ID NO: 1936892 - protein, 20 aa, Staphylococcus
EKLAQSESLAISSSSRGNIE

SEQ ID NO: 1936893 - protein, 9 aa, Staphylococcus
EKLAQSSEL

SEQ ID NO: 1936894 - protein, 20 aa, Staphylococcus
EKLDDEVNKDGQKLDGINQE

SEQ ID NO: 1936895 - protein, 11 aa, Staphylococcus
EKLDDSVRRDP

SEQ ID NO: 1936896 - protein, 5 aa, Staphylococcus
EKLDF

SEQ ID NO: 1936897 - protein, 8 aa, Staphylococcus
EKLDPEAE

SEQ ID NO: 1936898 - protein, 8 aa, Staphylococcus
EKLDTHNQ

SEQ ID NO: 1936899 - protein, 17 aa, Staphylococcus
EKLDTSVKRDPIHREAP

SEQ ID NO: 1936900 - protein, 7 aa, Staphylococcus
EKLEECK

SEQ ID NO: 1936901 - protein, 7 aa, Staphylococcus
EKLEECQ

SEQ ID NO: 1936902 - protein, 12 aa, Staphylococcus
EKLEQAADDETT

SEQ ID NO: 1936903 - protein, 7 aa, Staphylococcus
EKLEQEQ

SEQ ID NO: 1936904 - protein, 7 aa, Staphylococcus
EKLKEPK

SEQ ID NO: 1936905 - protein, 14 aa, Staphylococcus
EKLKKEAKTEKGRV

SEQ ID NO: 1936906 - protein, 14 aa, Staphylococcus
EKLKQSENERLKRK

SEQ ID NO: 1936907 - protein, 7 aa, Staphylococcus
EKLKRGR

SEQ ID NO: 1936908 - protein, 7 aa, Staphylococcus
EKLLTEA

SEQ ID NO: 1936909 - protein, 16 aa, Staphylococcus
EKLLTEAQDALSTPDN

SEQ ID NO: 1936910 - protein, 16 aa, Staphylococcus
EKLLTQAQDALSTPEN

SEQ ID NO: 1936911 - protein, 7 aa, Staphylococcus
EKLNDKA

SEQ ID NO: 1936912 - protein, 7 aa, Staphylococcus
EKLNEKA

SEQ ID NO: 1936913 - protein, 12 aa, Staphylococcus
EKLNGDYSKSIP

SEQ ID NO: 1936914 - protein, 10 aa, Staphylococcus
EKLNNNDGYT

SEQ ID NO: 1936915 - protein, 10 aa, Staphylococcus
EKLNQQLAEE

SEQ ID NO: 1936916 - protein, 8 aa, Staphylococcus
EKLPEKRY

SEQ ID NO: 1936917 - protein, 9 aa, Staphylococcus
EKLPEKRYN

SEQ ID NO: 1936918 - protein, 8 aa, Staphylococcus
EKLPKKRF

SEQ ID NO: 1936919 - protein, 10 aa, Staphylococcus
EKLPKPPKAR

SEQ ID NO: 1936920 - protein, 7 aa, Staphylococcus
EKLPNEH

SEQ ID NO: 1936921 - protein, 19 aa, Staphylococcus
EKLPPKDAHNYEDKEKEVH

SEQ ID NO: 1936922 - protein, 7 aa, Staphylococcus
EKLPTIT

SEQ ID NO: 1936923 - protein, 7 aa, Staphylococcus
EKLPYRA

SEQ ID NO: 1936924 - protein, 4 aa, Staphylococcus
EKLQ

SEQ ID NO: 1936925 - protein, 12 aa, Staphylococcus
EKLQSAKSEKIQ

SEQ ID NO: 1936926 - protein, 10 aa, Staphylococcus
EKLQSELDRV

SEQ ID NO: 1936927 - protein, 5 aa, Staphylococcus
EKLSG

SEQ ID NO: 1936928 - protein, 13 aa, Staphylococcus
EKLSKQRSEEDER

SEQ ID NO: 1936929 - protein, 8 aa, Staphylococcus
EKLSNEQG

SEQ ID NO: 1936930 - protein, 13 aa, Staphylococcus
EKLSNPEGDFWKA

SEQ ID NO: 1936931 - protein, 13 aa, Staphylococcus
EKLTAQGESDAEA

SEQ ID NO: 1936932 - protein, 11 aa, Staphylococcus
EKLTEQDSDEL

SEQ ID NO: 1936933 - protein, 8 aa, Staphylococcus
EKLTGQTI

SEQ ID NO: 1936934 - protein, 14 aa, Staphylococcus
EKLTQDVEAPASGT

SEQ ID NO: 1936935 - protein, 9 aa, Staphylococcus
EKLTTTEHE

SEQ ID NO: 1936936 - protein, 10 aa, Staphylococcus
EKLVDKEEKR

SEQ ID NO: 1936937 - protein, 12 aa, Staphylococcus
EKLVNSKDDALM

SEQ ID NO: 1936938 - protein, 16 aa, Staphylococcus
EKMGADRDFTATEQKI

SEQ ID NO: 1936939 - protein, 4 aa, Staphylococcus
EKMN

SEQ ID NO: 1936940 - protein, 8 aa, Staphylococcus
EKMPRTQP

SEQ ID NO: 1936941 - protein, 9 aa, Staphylococcus
EKMSGKELR

SEQ ID NO: 1936942 - protein, 13 aa, Staphylococcus
EKMSNKALSDMRK

SEQ ID NO: 1936943 - protein, 5 aa, Staphylococcus
EKNAF

SEQ ID NO: 1936944 - protein, 11 aa, Staphylococcus
EKNAKRVDTQR

SEQ ID NO: 1936945 - protein, 19 aa, Staphylococcus
EKNAREKEAKRIKQLMQED

SEQ ID NO: 1936946 - protein, 10 aa, Staphylococcus
EKNAVKQSFT

SEQ ID NO: 1936947 - protein, 5 aa, Staphylococcus
EKNDA

SEQ ID NO: 1936948 - protein, 6 aa, Staphylococcus
EKNDED

SEQ ID NO: 1936949 - protein, 6 aa, Staphylococcus
EKNDTM

SEQ ID NO: 1936950 - protein, 7 aa, Staphylococcus
EKNEDFD

SEQ ID NO: 1936951 - protein, 6 aa, Staphylococcus
EKNEFE

SEQ ID NO: 1936952 - protein, 7 aa, Staphylococcus
EKNEGIE

SEQ ID NO: 1936953 - protein, 6 aa, Staphylococcus
EKNERI

SEQ ID NO: 1936954 - protein, 6 aa, Staphylococcus
EKNETL

SEQ ID NO: 1936955 - protein, 9 aa, Staphylococcus
EKNEYDADE

SEQ ID NO: 1936956 - protein, 20 aa, Staphylococcus
EKNEYTESSKPKKKKKDLQT

SEQ ID NO: 1936957 - protein, 6 aa, Staphylococcus
EKNGDQ

SEQ ID NO: 1936958 - protein, 9 aa, Staphylococcus
EKNGEGHRN

SEQ ID NO: 1936959 - protein, 15 aa, Staphylococcus
EKNGERTYSTRLTTE

SEQ ID NO: 1936960 - protein, 7 aa, Staphylococcus
EKNGESK

SEQ ID NO: 1936961 - protein, 14 aa, Staphylococcus
EKNGIYKSDDSVTD

SEQ ID NO: 1936962 - protein, 13 aa, Staphylococcus
EKNGIYKSDDTVE

SEQ ID NO: 1936963 - protein, 10 aa, Staphylococcus
EKNGKVTEIP

SEQ ID NO: 1936964 - protein, 5 aa, Staphylococcus
EKNGY

SEQ ID NO: 1936965 - protein, 12 aa, Staphylococcus
EKNHEIKPKKVF

SEQ ID NO: 1936966 - protein, 13 aa, Staphylococcus
EKNIGSERIKGYQ

SEQ ID NO: 1936967 - protein, 8 aa, Staphylococcus
EKNIPRSE

SEQ ID NO: 1936968 - protein, 7 aa, Staphylococcus
EKNIQKV

SEQ ID NO: 1936969 - protein, 4 aa, Staphylococcus
EKNK

SEQ ID NO: 1936970 - protein, 6 aa, Staphylococcus
EKNKFN

SEQ ID NO: 1936971 - protein, 9 aa, Staphylococcus
EKNKHNSQV

SEQ ID NO: 1936972 - protein, 9 aa, Staphylococcus
EKNKKQNQI

SEQ ID NO: 1936973 - protein, 19 aa, Staphylococcus
EKNKLESREEKRKEIYQSA

SEQ ID NO: 1936974 - protein, 10 aa, Staphylococcus
EKNKNESGFS

SEQ ID NO: 1936975 - protein, 7 aa, Staphylococcus
EKNKYRN

SEQ ID NO: 1936976 - protein, 7 aa, Staphylococcus
EKNLPGV

SEQ ID NO: 1936977 - protein, 4 aa, Staphylococcus
EKNN

SEQ ID NO: 1936978 - protein, 9 aa, Staphylococcus
EKNNDDIDP

SEQ ID NO: 1936979 - protein, 12 aa, Staphylococcus
EKNNDPYPDELK

SEQ ID NO: 1936980 - protein, 11 aa, Staphylococcus
EKNNDPYPNEL

SEQ ID NO: 1936981 - protein, 4 aa, Staphylococcus
EKNP

SEQ ID NO: 1936982 - protein, 7 aa, Staphylococcus
EKNPEAI

SEQ ID NO: 1936983 - protein, 9 aa, Staphylococcus
EKNPKGVQI

SEQ ID NO: 1936984 - protein, 15 aa, Staphylococcus
EKNQQIEKQNEVENY

SEQ ID NO: 1936985 - protein, 15 aa, Staphylococcus
EKNRNKIPFTAPSEG

SEQ ID NO: 1936986 - protein, 14 aa, Staphylococcus
EKNRNNVPFTAPAE

SEQ ID NO: 1936987 - protein, 7 aa, Staphylococcus
EKNRTDL

SEQ ID NO: 1936988 - protein, 10 aa, Staphylococcus
EKNSAKSYRE

SEQ ID NO: 1936989 - protein, 11 aa, Staphylococcus
EKNSKRVDEQR

SEQ ID NO: 1936990 - protein, 9 aa, Staphylococcus
EKNTEVRQQ

SEQ ID NO: 1936991 - protein, 4 aa, Staphylococcus
EKNV

SEQ ID NO: 1936992 - protein, 7 aa, Staphylococcus
EKNVPVK

SEQ ID NO: 1936993 - protein, 7 aa, Staphylococcus
EKNYADA

SEQ ID NO: 1936994 - protein, 8 aa, Staphylococcus
EKNYENYV

SEQ ID NO: 1936995 - protein, 7 aa, Staphylococcus
EKNYPDQ

SEQ ID NO: 1936996 - protein, 7 aa, Staphylococcus
EKNYPTA

SEQ ID NO: 1936997 - protein, 11 aa, Staphylococcus
EKPAQGTAPSN

SEQ ID NO: 1936998 - protein, 10 aa, Staphylococcus
EKPATSLDSK

SEQ ID NO: 1936999 - protein, 10 aa, Staphylococcus
EKPDNGSVTL

SEQ ID NO: 1937000 - protein, 8 aa, Staphylococcus
EKPEDSWQ

SEQ ID NO: 1937001 - protein, 7 aa, Staphylococcus
EKPELSN

SEQ ID NO: 1937002 - protein, 12 aa, Staphylococcus
EKPEQGTAPSNL

SEQ ID NO: 1937003 - protein, 7 aa, Staphylococcus
EKPFSQT

SEQ ID NO: 1937004 - protein, 6 aa, Staphylococcus
EKPGLF

SEQ ID NO: 1937005 - protein, 12 aa, Staphylococcus
EKPIDQRSSYGL

SEQ ID NO: 1937006 - protein, 11 aa, Staphylococcus
EKPIESNQVNI

SEQ ID NO: 1937007 - protein, 12 aa, Staphylococcus
EKPIGKRSSYGL

SEQ ID NO: 1937008 - protein, 12 aa, Staphylococcus
EKPIKKIQSSLD

SEQ ID NO: 1937009 - protein, 11 aa, Staphylococcus
EKPKEGTAPSN

SEQ ID NO: 1937010 - protein, 7 aa, Staphylococcus
EKPKEKV

SEQ ID NO: 1937011 - protein, 8 aa, Staphylococcus
EKPKTKSL

SEQ ID NO: 1937012 - protein, 4 aa, Staphylococcus
EKPL

SEQ ID NO: 1937013 - protein, 13 aa, Staphylococcus
EKPLESNGDNIDS

SEQ ID NO: 1937014 - protein, 14 aa, Staphylococcus
EKPNEVVKEGDEIE

SEQ ID NO: 1937015 - protein, 5 aa, Staphylococcus
EKPPI

SEQ ID NO: 1937016 - protein, 15 aa, Staphylococcus
EKPPIPGRTNSTAIE

SEQ ID NO: 1937017 - protein, 7 aa, Staphylococcus
EKPSDGH

SEQ ID NO: 1937018 - protein, 7 aa, Staphylococcus
EKPSPIF

SEQ ID NO: 1937019 - protein, 8 aa, Staphylococcus
EKPSTKFQ

SEQ ID NO: 1937020 - protein, 7 aa, Staphylococcus
EKPSTQF

SEQ ID NO: 1937021 - protein, 8 aa, Staphylococcus
EKPSVARD

SEQ ID NO: 1937022 - protein, 8 aa, Staphylococcus
EKPSYPPI

SEQ ID NO: 1937023 - protein, 6 aa, Staphylococcus
EKPTAR

SEQ ID NO: 1937024 - protein, 6 aa, Staphylococcus
EKPTTR

SEQ ID NO: 1937025 - protein, 7 aa, Staphylococcus
EKPTTRQ

SEQ ID NO: 1937026 - protein, 9 aa, Staphylococcus
EKPVITEST

SEQ ID NO: 1937027 - protein, 6 aa, Staphylococcus
EKPWNA

SEQ ID NO: 1937028 - protein, 9 aa, Staphylococcus
EKPYDKEGG

SEQ ID NO: 1937029 - protein, 6 aa, Staphylococcus
EKPYFE

SEQ ID NO: 1937030 - protein, 5 aa, Staphylococcus
EKPYQ

SEQ ID NO: 1937031 - protein, 7 aa, Staphylococcus
EKQAGDR

SEQ ID NO: 1937032 - protein, 28 aa, Staphylococcus
EKQAQQPKQKTTARKKSGLSYKEKREYE

SEQ ID NO: 1937033 - protein, 15 aa, Staphylococcus
EKQARRIGEARHEES

SEQ ID NO: 1937034 - protein, 30 aa, Staphylococcus
EKQATNTSKTQIKERKKTGLSYKEKREYES

SEQ ID NO: 1937035 - protein, 16 aa, Staphylococcus
EKQDKYKGFIVPKEWK

SEQ ID NO: 1937036 - protein, 14 aa, Staphylococcus
EKQDLNALKPKSLT

SEQ ID NO: 1937037 - protein, 4 aa, Staphylococcus
EKQE

SEQ ID NO: 1937038 - protein, 7 aa, Staphylococcus
EKQELKN

SEQ ID NO: 1937039 - protein, 6 aa, Staphylococcus
EKQENI

SEQ ID NO: 1937040 - protein, 10 aa, Staphylococcus
EKQEQPLPGL

SEQ ID NO: 1937041 - protein, 13 aa, Staphylococcus
EKQFESPDKQDRK

SEQ ID NO: 1937042 - protein, 22 aa, Staphylococcus
EKQFTNSGVSTGTASHETFEKS

SEQ ID NO: 1937043 - protein, 4 aa, Staphylococcus
EKQG

SEQ ID NO: 1937044 - protein, 6 aa, Staphylococcus
EKQGMT

SEQ ID NO: 1937045 - protein, 7 aa, Staphylococcus
EKQGRRY

SEQ ID NO: 1937046 - protein, 7 aa, Staphylococcus
EKQHQKS

SEQ ID NO: 1937047 - protein, 16 aa, Staphylococcus
EKQIDSYKRLKKVIQD

SEQ ID NO: 1937048 - protein, 10 aa, Staphylococcus
EKQIEDTADN

SEQ ID NO: 1937049 - protein, 6 aa, Staphylococcus
EKQIES

SEQ ID NO: 1937050 - protein, 7 aa, Staphylococcus
EKQIESL

SEQ ID NO: 1937051 - protein, 9 aa, Staphylococcus
EKQKETKAL

SEQ ID NO: 1937052 - protein, 7 aa, Staphylococcus
EKQKLQI

SEQ ID NO: 1937053 - protein, 5 aa, Staphylococcus
EKQKN

SEQ ID NO: 1937054 - protein, 17 aa, Staphylococcus
EKQLEKTRNGEIQDDYI

SEQ ID NO: 1937055 - protein, 9 aa, Staphylococcus
EKQLPQQNY

SEQ ID NO: 1937056 - protein, 14 aa, Staphylococcus
EKQLTESKQLQTEF

SEQ ID NO: 1937057 - protein, 7 aa, Staphylococcus
EKQMAKD

SEQ ID NO: 1937058 - protein, 8 aa, Staphylococcus
EKQNRHSL

SEQ ID NO: 1937059 - protein, 10 aa, Staphylococcus
EKQPDPEKVK

SEQ ID NO: 1937060 - protein, 7 aa, Staphylococcus
EKQPGIN

SEQ ID NO: 1937061 - protein, 7 aa, Staphylococcus
EKQPIFG

SEQ ID NO: 1937062 - protein, 24 aa, Staphylococcus
EKQPNQTTVTSTSVLPSKEAAQQA

SEQ ID NO: 1937063 - protein, 7 aa, Staphylococcus
EKQPPLK

SEQ ID NO: 1937064 - protein, 6 aa, Staphylococcus
EKQQFK

SEQ ID NO: 1937065 - protein, 10 aa, Staphylococcus
EKQQPEFKNK

SEQ ID NO: 1937066 - protein, 7 aa, Staphylococcus
EKQQYLQ

SEQ ID NO: 1937067 - protein, 7 aa, Staphylococcus
EKQRDDV

SEQ ID NO: 1937068 - protein, 56 aa, Staphylococcus; identical to SEQ ID NO: 1636298

SEQ ID NO: 1937069 - protein, 8 aa, Staphylococcus
EKQRPLPS

SEQ ID NO: 1937070 - protein, 53 aa, Staphylococcus
EKQRQNTNSNDTSSERASNELEQTTTSDDFNEETVQPVDSTYNKRNSNDDYFE

SEQ ID NO: 1937071 - protein, 7 aa, Staphylococcus
EKQSDSL

SEQ ID NO: 1937072 - protein, 5 aa, Staphylococcus
EKQSE

SEQ ID NO: 1937073 - protein, 12 aa, Staphylococcus
EKQSGKSVENRP

SEQ ID NO: 1937074 - protein, 8 aa, Staphylococcus
EKQSSELT

SEQ ID NO: 1937075 - protein, 4 aa, Staphylococcus
EKQT

SEQ ID NO: 1937076 - protein, 22 aa, Staphylococcus
EKQTAAEVTGYDKTKDLQHNYP

SEQ ID NO: 1937077 - protein, 14 aa, Staphylococcus
EKQVPAKALIFDKF

SEQ ID NO: 1937078 - protein, 14 aa, Staphylococcus
EKQVPAKQLIFEHF

SEQ ID NO: 1937079 - protein, 14 aa, Staphylococcus
EKQVPARDFIFKNF

SEQ ID NO: 1937080 - protein, 9 aa, Staphylococcus
EKQWEDSGK

SEQ ID NO: 1937081 - protein, 7 aa, Staphylococcus
EKQYDKN

SEQ ID NO: 1937082 - protein, 5 aa, Staphylococcus
EKQYN

SEQ ID NO: 1937083 - protein, 6 aa, Staphylococcus
EKQYPS

SEQ ID NO: 1937084 - protein, 21 aa, Staphylococcus
EKRADNQSNTYTEVKTSQPDF

SEQ ID NO: 1937085 - protein, 5 aa, Staphylococcus
EKRAK

SEQ ID NO: 1937086 - protein, 8 aa, Staphylococcus
EKRAQDAL

SEQ ID NO: 1937087 - protein, 10 aa, Staphylococcus
EKRAQELDDM

SEQ ID NO: 1937088 - protein, 10 aa, Staphylococcus
EKRAVEKSGL

SEQ ID NO: 1937089 - protein, 6 aa, Staphylococcus
EKRAVT

SEQ ID NO: 1937090 - protein, 4 aa, Staphylococcus
EKRC

SEQ ID NO: 1937091 - protein, 4 aa, Staphylococcus
EKRE

SEQ ID NO: 1937092 - protein, 20 aa, Staphylococcus
EKREDNQSNTYTEVRENQPQ

SEQ ID NO: 1937093 - protein, 23 aa, Staphylococcus
EKREIEEAVSNGASYVTTSDRSL

SEQ ID NO: 1937094 - protein, 7 aa, Staphylococcus
EKRFSKE

SEQ ID NO: 1937095 - protein, 13 aa, Staphylococcus
EKRKDNKSNTYTT

SEQ ID NO: 1937096 - protein, 4 aa, Staphylococcus
EKRL

SEQ ID NO: 1937097 - protein, 4 aa, Staphylococcus
EKRM

SEQ ID NO: 1937098 - protein, 6 aa, Staphylococcus
EKRNQQ

SEQ ID NO: 1937099 - protein, 8 aa, Staphylococcus
EKRNRDEI

SEQ ID NO: 1937100 - protein, 8 aa, Staphylococcus
EKRNRDNI

SEQ ID NO: 1937101 - protein, 34 aa, Staphylococcus
EKRNSEVTNDDLTTAHPSSNKDHYNTNDSEIREG

SEQ ID NO: 1937102 - protein, 4 aa, Staphylococcus
EKRP

SEQ ID NO: 1937103 - protein, 7 aa, Staphylococcus
EKRPVGY

SEQ ID NO: 1937104 - protein, 20 aa, Staphylococcus
EKRQDNQSNTYTTINDQQPQ

SEQ ID NO: 1937105 - protein, 9 aa, Staphylococcus
EKRQQIQDE

SEQ ID NO: 1937106 - protein, 8 aa, Staphylococcus
EKRQQIQN

SEQ ID NO: 1937107 - protein, 11 aa, Staphylococcus
EKRREPFENEN

SEQ ID NO: 1937108 - protein, 6 aa, Staphylococcus
EKRRPA

SEQ ID NO: 1937109 - protein, 6 aa, Staphylococcus
EKRRTL

SEQ ID NO: 1937110 - protein, 6 aa, Staphylococcus
EKRVSA

SEQ ID NO: 1937111 - protein, 7 aa, Staphylococcus
EKRYKGS

SEQ ID NO: 1937112 - protein, 7 aa, Staphylococcus
EKRYNDL

SEQ ID NO: 1937113 - protein, 10 aa, Staphylococcus
EKSDANNIPT

SEQ ID NO: 1937114 - protein, 12 aa, Staphylococcus
EKSDEQVKADNL

SEQ ID NO: 1937115 - protein, 9 aa, Staphylococcus
EKSDKGKEI

SEQ ID NO: 1937116 - protein, 6 aa, Staphylococcus
EKSDLA

SEQ ID NO: 1937117 - protein, 17 aa, Staphylococcus
EKSDQFNRKYKNNLSET

SEQ ID NO: 1937118 - protein, 8 aa, Staphylococcus
EKSEEQIK

SEQ ID NO: 1937119 - protein, 6 aa, Staphylococcus
EKSEIT

SEQ ID NO: 1937120 - protein, 6 aa, Staphylococcus
EKSELV

SEQ ID NO: 1937121 - protein, 7 aa, Staphylococcus
EKSESII

SEQ ID NO: 1937122 - protein, 6 aa, Staphylococcus
EKSEVR

SEQ ID NO: 1937123 - protein, 8 aa, Staphylococcus
EKSEVRRI

SEQ ID NO: 1937124 - protein, 7 aa, Staphylococcus
EKSGKRG

SEQ ID NO: 1937125 - protein, 6 aa, Staphylococcus
EKSGPR

SEQ ID NO: 1937126 - protein, 14 aa, Staphylococcus
EKSGYVETKPYKGV

SEQ ID NO: 1937127 - protein, 22 aa, Staphylococcus
EKSGYVETKPYKGVKLSKEGLT

SEQ ID NO: 1937128 - protein, 6 aa, Staphylococcus
EKSHNE

SEQ ID NO: 1937129 - protein, 21 aa, Staphylococcus
EKSHQEKHAQNIEQKKEVAQK

SEQ ID NO: 1937130 - protein, 20 aa, Staphylococcus
EKSHQEKHTENIDEKRAVAR

SEQ ID NO: 1937131 - protein, 7 aa, Staphylococcus
EKSHYLN

SEQ ID NO: 1937132 - protein, 7 aa, Staphylococcus
EKSIDTH

SEQ ID NO: 1937133 - protein, 6 aa, Staphylococcus
EKSIES

SEQ ID NO: 1937134 - protein, 8 aa, Staphylococcus
EKSKEQLK

SEQ ID NO: 1937135 - protein, 8 aa, Staphylococcus
EKSKQFSE

SEQ ID NO: 1937136 - protein, 10 aa, Staphylococcus
EKSKRGEAID

SEQ ID NO: 1937137 - protein, 15 aa, Staphylococcus
EKSKTGRMLAFIGQH

SEQ ID NO: 1937138 - protein, 11 aa, Staphylococcus
EKSKTKEIEIP

SEQ ID NO: 1937139 - protein, 11 aa, Staphylococcus
EKSKTKTIEIP

SEQ ID NO: 1937140 - protein, 6 aa, Staphylococcus
EKSLIP

SEQ ID NO: 1937141 - protein, 21 aa, Staphylococcus
EKSLKRTPSFSVNRPGEETGI

SEQ ID NO: 1937142 - protein, 7 aa, Staphylococcus
EKSLSNT

SEQ ID NO: 1937143 - protein, 10 aa, Staphylococcus
EKSMEIQNDL

SEQ ID NO: 1937144 - protein, 10 aa, Staphylococcus
EKSMQIQNDL

SEQ ID NO: 1937145 - protein, 20 aa, Staphylococcus
EKSQLESQLEQAQRSESIAH

SEQ ID NO: 1937146 - protein, 8 aa, Staphylococcus
EKSSGYNS

SEQ ID NO: 1937147 - protein, 8 aa, Staphylococcus
EKSTSTAV

SEQ ID NO: 1937148 - protein, 4 aa, Staphylococcus
EKSY

SEQ ID NO: 1937149 - protein, 8 aa, Staphylococcus
EKSYPGFK

SEQ ID NO: 1937150 - protein, 17 aa, Staphylococcus
EKSYSERLSMSNNGREV

SEQ ID NO: 1937151 - protein, 10 aa, Staphylococcus
EKTAEGEEYN

SEQ ID NO: 1937152 - protein, 10 aa, Staphylococcus
EKTAGKSLQT

SEQ ID NO: 1937153 - protein, 6 aa, Staphylococcus
EKTAQY

SEQ ID NO: 1937154 - protein, 5 aa, Staphylococcus
EKTAR

SEQ ID NO: 1937155 - protein, 10 aa, Staphylococcus
EKTDGNNTEN

SEQ ID NO: 1937156 - protein, 16 aa, Staphylococcus
EKTEFIPKERNAEVEE

SEQ ID NO: 1937157 - protein, 6 aa, Staphylococcus
EKTENP

SEQ ID NO: 1937158 - protein, 4 aa, Staphylococcus
EKTF

SEQ ID NO: 1937159 - protein, 11 aa, Staphylococcus
EKTFRAGEKVE

SEQ ID NO: 1937160 - protein, 12 aa, Staphylococcus
EKTFRAGEKVEP

SEQ ID NO: 1937161 - protein, 8 aa, Staphylococcus
EKTGKTMN

SEQ ID NO: 1937162 - protein, 16 aa, Staphylococcus
EKTIQRDVSQAKKQSD

SEQ ID NO: 1937163 - protein, 5 aa, Staphylococcus
EKTIR

SEQ ID NO: 1937164 - protein, 6 aa, Staphylococcus
EKTIRQ

SEQ ID NO: 1937165 - protein, 16 aa, Staphylococcus
EKTLPDNNSLATKSDN

SEQ ID NO: 1937166 - protein, 8 aa, Staphylococcus
EKTNAGGT

SEQ ID NO: 1937167 - protein, 6 aa, Staphylococcus
EKTNGD

SEQ ID NO: 1937168 - protein, 5 aa, Staphylococcus
EKTNK

SEQ ID NO: 1937169 - protein, 7 aa, Staphylococcus
EKTNRRI

SEQ ID NO: 1937170 - protein, 12 aa, Staphylococcus
EKTNSIQDTKDL

SEQ ID NO: 1937171 - protein, 10 aa, Staphylococcus
EKTPEPTRAD

SEQ ID NO: 1937172 - protein, 6 aa, Staphylococcus
EKTPQA

SEQ ID NO: 1937173 - protein, 9 aa, Staphylococcus
EKTRTTLED

SEQ ID NO: 1937174 - protein, 5 aa, Staphylococcus
EKTRY

SEQ ID NO: 1937175 - protein, 9 aa, Staphylococcus
EKTSDEAID

SEQ ID NO: 1937176 - protein, 20 aa, Staphylococcus
EKTSNPKHGVKTKETQAKVQ

SEQ ID NO: 1937177 - protein, 7 aa, Staphylococcus
EKTSPYE

SEQ ID NO: 1937178 - protein, 5 aa, Staphylococcus
EKTTH

SEQ ID NO: 1937179 - protein, 6 aa, Staphylococcus
EKTTPY

SEQ ID NO: 1937180 - protein, 12 aa, Staphylococcus
EKTTSDQETRDL

SEQ ID NO: 1937181 - protein, 7 aa, Staphylococcus
EKVAQGK

SEQ ID NO: 1937182 - protein, 9 aa, Staphylococcus
EKVAQQSDI

SEQ ID NO: 1937183 - protein, 10 aa, Staphylococcus
EKVDEKNGNI

SEQ ID NO: 1937184 - protein, 11 aa, Staphylococcus
EKVEDLSKDIK

SEQ ID NO: 1937185 - protein, 7 aa, Staphylococcus
EKVENGD

SEQ ID NO: 1937186 - protein, 11 aa, Staphylococcus
EKVESAEPGET

SEQ ID NO: 1937187 - protein, 6 aa, Staphylococcus
EKVETP

SEQ ID NO: 1937188 - protein, 7 aa, Staphylococcus
EKVGEYS

SEQ ID NO: 1937189 - protein, 6 aa, Staphylococcus
EKVGND

SEQ ID NO: 1937190 - protein, 7 aa, Staphylococcus
EKVGNDG

SEQ ID NO: 1937191 - protein, 7 aa, Staphylococcus
EKVHENN

SEQ ID NO: 1937192 - protein, 6 aa, Staphylococcus
EKVKDK

SEQ ID NO: 1937193 - protein, 11 aa, Staphylococcus
EKVKDKDLKKN

SEQ ID NO: 1937194 - protein, 18 aa, Staphylococcus
EKVKQSDELDTANTTRDD

SEQ ID NO: 1937195 - protein, 6 aa, Staphylococcus
EKVKSK

SEQ ID NO: 1937196 - protein, 4 aa, Staphylococcus
EKVN

SEQ ID NO: 1937197 - protein, 16 aa, Staphylococcus
EKVNGKKWSDAPTEEI

SEQ ID NO: 1937198 - protein, 5 aa, Staphylococcus
EKVNK

SEQ ID NO: 1937199 - protein, 7 aa, Staphylococcus
EKVNNGN

SEQ ID NO: 1937200 - protein, 5 aa, Staphylococcus
EKVNQ

SEQ ID NO: 1937201 - protein, 13 aa, Staphylococcus
EKVNQNEHLADNR

SEQ ID NO: 1937202 - protein, 6 aa, Staphylococcus
EKVNQT

SEQ ID NO: 1937203 - protein, 5 aa, Staphylococcus
EKVNS

SEQ ID NO: 1937204 - protein, 7 aa, Staphylococcus
EKVPESY

SEQ ID NO: 1937205 - protein, 12 aa, Staphylococcus
EKVPKDLSTNTD

SEQ ID NO: 1937206 - protein, 9 aa, Staphylococcus
EKVPSQDQL

SEQ ID NO: 1937207 - protein, 9 aa, Staphylococcus
EKVQKDDVS

SEQ ID NO: 1937208 - protein, 5 aa, Staphylococcus
EKVQP

SEQ ID NO: 1937209 - protein, 14 aa, Staphylococcus
EKVQSLADDKGLDI

SEQ ID NO: 1937210 - protein, 7 aa, Staphylococcus
EKVSGKK

SEQ ID NO: 1937211 - protein, 9 aa, Staphylococcus
EKVSKEEYK

SEQ ID NO: 1937212 - protein, 16 aa, Staphylococcus
EKVSKEMEPSYPEEWK

SEQ ID NO: 1937213 - protein, 11 aa, Staphylococcus
EKVSSDDFDKI

SEQ ID NO: 1937214 - protein, 13 aa, Staphylococcus
EKVSTKEETQSLG

SEQ ID NO: 1937215 - protein, 7 aa, Staphylococcus
EKVTSGA

SEQ ID NO: 1937216 - protein, 28 aa, Staphylococcus
EKVTSGYMGGTVENPTYEEVKKGETGHL

SEQ ID NO: 1937217 - protein, 14 aa, Staphylococcus
EKVVPGNTNLKEYQ

SEQ ID NO: 1937218 - protein, 6 aa, Staphylococcus
EKWPGT

SEQ ID NO: 1937219 - protein, 8 aa, Staphylococcus
EKWSETAK

SEQ ID NO: 1937220 - protein, 11 aa, Staphylococcus
EKYAEKGITPK

SEQ ID NO: 1937221 - protein, 6 aa, Staphylococcus
EKYAKG

SEQ ID NO: 1937222 - protein, 6 aa, Staphylococcus
EKYATP

SEQ ID NO: 1937223 - protein, 14 aa, Staphylococcus
EKYDDIKKNEGTHA

SEQ ID NO: 1937224 - protein, 6 aa, Staphylococcus
EKYDGC

SEQ ID NO: 1937225 - protein, 6 aa, Staphylococcus
EKYDTG

SEQ ID NO: 1937226 - protein, 4 aa, Staphylococcus
EKYE

SEQ ID NO: 1937227 - protein, 16 aa, Staphylococcus
EKYEDIKNNDNKHSLD

SEQ ID NO: 1937228 - protein, 5 aa, Staphylococcus
EKYEK

SEQ ID NO: 1937229 - protein, 29 aa, Staphylococcus
EKYEKTEADKKHQEKRNKEIEKKQTQIQE

SEQ ID NO: 1937230 - protein, 8 aa, Staphylococcus
EKYEKTPA

SEQ ID NO: 1937231 - protein, 4 aa, Staphylococcus
EKYG

SEQ ID NO: 1937232 - protein, 6 aa, Staphylococcus
EKYGEA

SEQ ID NO: 1937233 - protein, 17 aa, Staphylococcus
EKYGGAAKTSGAGGGDC

SEQ ID NO: 1937234 - protein, 11 aa, Staphylococcus
EKYGITPKTIN

SEQ ID NO: 1937235 - protein, 10 aa, Staphylococcus
EKYGKDEAKK

SEQ ID NO: 1937236 - protein, 6 aa, Staphylococcus
EKYHKP

SEQ ID NO: 1937237 - protein, 4 aa, Staphylococcus
EKYK

SEQ ID NO: 1937238 - protein, 8 aa, Staphylococcus
EKYKDDWK

SEQ ID NO: 1937239 - protein, 7 aa, Staphylococcus
EKYKDKV

SEQ ID NO: 1937240 - protein, 10 aa, Staphylococcus
EKYKDNPNFS

SEQ ID NO: 1937241 - protein, 17 aa, Staphylococcus
EKYKKELQDNDEQAQAF

SEQ ID NO: 1937242 - protein, 7 aa, Staphylococcus
EKYKTVP

SEQ ID NO: 1937243 - protein, 34 aa, Staphylococcus
EKYKYTEGKYRFSKENNIEYPKNEDVRYTSGNYT

SEQ ID NO: 1937244 - protein, 4 aa, Staphylococcus
EKYN

SEQ ID NO: 1937245 - protein, 13 aa, Staphylococcus
EKYNEKQKAGWSQ

SEQ ID NO: 1937246 - protein, 10 aa, Staphylococcus
EKYNFNNENA

SEQ ID NO: 1937247 - protein, 5 aa, Staphylococcus
EKYNG

SEQ ID NO: 1937248 - protein, 6 aa, Staphylococcus
EKYNNT

SEQ ID NO: 1937249 - protein, 7 aa, Staphylococcus
EKYPESY

SEQ ID NO: 1937250 - protein, 5 aa, Staphylococcus
EKYPG

SEQ ID NO: 1937251 - protein, 6 aa, Staphylococcus
EKYPHI

SEQ ID NO: 1937252 - protein, 7 aa, Staphylococcus
EKYPNLT

SEQ ID NO: 1937253 - protein, 5 aa, Staphylococcus
EKYPR

SEQ ID NO: 1937254 - protein, 5 aa, Staphylococcus
EKYQT

SEQ ID NO: 1937255 - protein, 6 aa, Staphylococcus
EKYRTI

SEQ ID NO: 1937256 - protein, 5 aa, Staphylococcus
EKYSN

SEQ ID NO: 1937257 - protein, 5 aa, Staphylococcus
EKYTE

SEQ ID NO: 1937258 - protein, 12 aa, Staphylococcus
EKYTYDKEKEAK

SEQ ID NO: 1937259 - protein, 25 aa, Staphylococcus
EKYTYDKEKEAQNVYGTTEEAHPGV

SEQ ID NO: 1937260 - protein, 25 aa, Staphylococcus
EKYTYDKKKEAQNVYGTTDEAHPGV

SEQ ID NO: 1937261 - protein, 12 aa, Staphylococcus
EKYTYDKKREAQ

SEQ ID NO: 1937262 - protein, 5 aa, Staphylococcus
ELAEE

SEQ ID NO: 1937263 - protein, 25 aa, Staphylococcus
ELAEHTSQRERRAIEAERDTDELKK

SEQ ID NO: 1937264 - protein, 13 aa, Staphylococcus
ELAEKQQGEVTEQ

SEQ ID NO: 1937265 - protein, 13 aa, Staphylococcus
ELAERRGVHEGGE

SEQ ID NO: 1937266 - protein, 7 aa, Staphylococcus
ELAESIE

SEQ ID NO: 1937267 - protein, 12 aa, Staphylococcus
ELAGGTPQQSAE

SEQ ID NO: 1937268 - protein, 39 aa, Staphylococcus
ELAKSRAESHLNNEEDNSDVNRAKRALERANNRIRVANL

SEQ ID NO: 1937269 - protein, 10 aa, Staphylococcus
ELAKTGIKTT

SEQ ID NO: 1937270 - protein, 6 aa, Staphylococcus
ELANGN

SEQ ID NO: 1937271 - protein, 13 aa, Staphylococcus
ELANKQQEEVTDQ

SEQ ID NO: 1937272 - protein, 10 aa, Staphylococcus
ELANNRDVTG

SEQ ID NO: 1937273 - protein, 11 aa, Staphylococcus
ELAQDRDIHEG

SEQ ID NO: 1937274 - protein, 18 aa, Staphylococcus
ELARRDSYQGKKFEHKVK

SEQ ID NO: 1937275 - protein, 12 aa, Staphylococcus
ELARTGIKSTSI

SEQ ID NO: 1937276 - protein, 7 aa, Staphylococcus
ELARTGV

SEQ ID NO: 1937277 - protein, 5 aa, Staphylococcus
ELASP

SEQ ID NO: 1937278 - protein, 8 aa, Staphylococcus
ELASQEGI

SEQ ID NO: 1937279 - protein, 15 aa, Staphylococcus
ELDAQTGHVSMGKNE

SEQ ID NO: 1937280 - protein, 9 aa, Staphylococcus
ELDDEKSTI

SEQ ID NO: 1937281 - protein, 10 aa, Staphylococcus
ELDDKNDEEI

SEQ ID NO: 1937282 - protein, 9 aa, Staphylococcus
ELDDSRQSH

SEQ ID NO: 1937283 - protein, 5 aa, Staphylococcus
ELDDT

SEQ ID NO: 1937284 - protein, 13 aa, Staphylococcus
ELDEALNRIRSVF

SEQ ID NO: 1937285 - protein, 10 aa, Staphylococcus
ELDESEADAF

SEQ ID NO: 1937286 - protein, 28 aa, Staphylococcus
ELDETSRKQSNTVKKTSAIDDSHDDMDQ

SEQ ID NO: 1937287 - protein, 18 aa, Staphylococcus
ELDETSRKSNTPSEPQRQ

SEQ ID NO: 1937288 - protein, 4 aa, Staphylococcus
ELDG

SEQ ID NO: 1937289 - protein, 17 aa, Staphylococcus
ELDKSVAQYKEDLTSQL

SEQ ID NO: 1937290 - protein, 13 aa, Staphylococcus
ELDKTVSNFSGGM

SEQ ID NO: 1937291 - protein, 4 aa, Staphylococcus
ELDN

SEQ ID NO: 1937292 - protein, 18 aa, Staphylococcus
ELDNEASDQFKDDLTNSA

SEQ ID NO: 1937293 - protein, 7 aa, Staphylococcus
ELDPANN

SEQ ID NO: 1937294 - protein, 12 aa, Staphylococcus
ELDQAKSTAAQP

SEQ ID NO: 1937295 - protein, 9 aa, Staphylococcus
ELDSEVQTT

SEQ ID NO: 1937296 - protein, 7 aa, Staphylococcus
ELDSQTG

SEQ ID NO: 1937297 - protein, 15 aa, Staphylococcus
ELDSQTGHVSLGKDE

SEQ ID NO: 1937298 - protein, 14 aa, Staphylococcus
ELDSQTGHVSMGKN

SEQ ID NO: 1937299 - protein, 5 aa, Staphylococcus
ELDTQ

SEQ ID NO: 1937300 - protein, 20 aa, Staphylococcus
ELEAEREAQIARGEMPRYGG

SEQ ID NO: 1937301 - protein, 21 aa, Staphylococcus
ELEAEREAQIARGEMPRYGGQ

SEQ ID NO: 1937302 - protein, 13 aa, Staphylococcus
ELEAKDYGEVTEQ

SEQ ID NO: 1937303 - protein, 11 aa, Staphylococcus
ELEDVAAENDV

SEQ ID NO: 1937304 - protein, 10 aa, Staphylococcus
ELEDVTAEND

SEQ ID NO: 1937305 - protein, 10 aa, Staphylococcus
ELEDVTTEND

SEQ ID NO: 1937306 - protein, 5 aa, Staphylococcus
ELEED

SEQ ID NO: 1937307 - protein, 16 aa, Staphylococcus
ELEEDHDIKNDSAFEQ

SEQ ID NO: 1937308 - protein, 16 aa, Staphylococcus
ELEEEHTIGNDSAFEQ

SEQ ID NO: 1937309 - protein, 20 aa, Staphylococcus
ELEEEREAQIARGEMPRYGG

SEQ ID NO: 1937310 - protein, 21 aa, Staphylococcus
ELEEEREAQIARGEMPRYGGQ

SEQ ID NO: 1937311 - protein, 5 aa, Staphylococcus
ELEEI

SEQ ID NO: 1937312 - protein, 6 aa, Staphylococcus
ELEEKG

SEQ ID NO: 1937313 - protein, 14 aa, Staphylococcus
ELEEKYRSDEWLYK

SEQ ID NO: 1937314 - protein, 5 aa, Staphylococcus
ELEEQ

SEQ ID NO: 1937315 - protein, 9 aa, Staphylococcus
ELEEQSKIQ

SEQ ID NO: 1937316 - protein, 9 aa, Staphylococcus
ELEERENKT

SEQ ID NO: 1937317 - protein, 7 aa, Staphylococcus
ELEESGA

SEQ ID NO: 1937318 - protein, 5 aa, Staphylococcus
ELEGA

SEQ ID NO: 1937319 - protein, 6 aa, Staphylococcus
ELEGEP

SEQ ID NO: 1937320 - protein, 13 aa, Staphylococcus
ELEGGSAGVAVSS

SEQ ID NO: 1937321 - protein, 8 aa, Staphylococcus
ELEHEKRR

SEQ ID NO: 1937322 - protein, 5 aa, Staphylococcus
ELEHP

SEQ ID NO: 1937323 - protein, 20 aa, Staphylococcus
ELEKEREDQIARGEMPRYGG

SEQ ID NO: 1937324 - protein, 10 aa, Staphylococcus
ELEKKDKDNY

SEQ ID NO: 1937325 - protein, 6 aa, Staphylococcus
ELEKLQ

SEQ ID NO: 1937326 - protein, 16 aa, Staphylococcus
ELENAGADATKVGIGP

SEQ ID NO: 1937327 - protein, 11 aa, Staphylococcus
ELENGKIKDDD

SEQ ID NO: 1937328 - protein, 9 aa, Staphylococcus
ELENGRIKD

SEQ ID NO: 1937329 - protein, 12 aa, Staphylococcus
ELENKNKEQKLE

SEQ ID NO: 1937330 - protein, 11 aa, Staphylococcus
ELENNDSPHHI

SEQ ID NO: 1937331 - protein, 9 aa, Staphylococcus
ELENQGAKF

SEQ ID NO: 1937332 - protein, 7 aa, Staphylococcus
ELEPEKN

SEQ ID NO: 1937333 - protein, 5 aa, Staphylococcus
ELEPK

SEQ ID NO: 1937334 - protein, 4 aa, Staphylococcus
ELEQ

SEQ ID NO: 1937335 - protein, 20 aa, Staphylococcus
ELEQEREEQITRGETPRYAG

SEQ ID NO: 1937336 - protein, 30 aa, Staphylococcus
ELEQQDTDQTKEDEPKKKPKKLKEADFDDD

SEQ ID NO: 1937337 - protein, 5 aa, Staphylococcus
ELEQS

SEQ ID NO: 1937338 - protein, 13 aa, Staphylococcus
ELEQTEPAEVTTA

SEQ ID NO: 1937339 - protein, 5 aa, Staphylococcus
ELERE

SEQ ID NO: 1937340 - protein, 6 aa, Staphylococcus
ELERKK

SEQ ID NO: 1937341 - protein, 7 aa, Staphylococcus
ELERKKA

SEQ ID NO: 1937342 - protein, 13 aa, Staphylococcus
ELERQNTTYKKTK

SEQ ID NO: 1937343 - protein, 11 aa, Staphylococcus
ELESATGQRLT

SEQ ID NO: 1937344 - protein, 7 aa, Staphylococcus
ELETHGQ

SEQ ID NO: 1937345 - protein, 9 aa, Staphylococcus
ELETKYGTD

SEQ ID NO: 1937346 - protein, 8 aa, Staphylococcus
ELETSERK

SEQ ID NO: 1937347 - protein, 4 aa, Staphylococcus
ELGA

SEQ ID NO: 1937348 - protein, 10 aa, Staphylococcus
ELGAEEQEVI

SEQ ID NO: 1937349 - protein, 7 aa, Staphylococcus
ELGAPLS

SEQ ID NO: 1937350 - protein, 8 aa, Staphylococcus
ELGAPLSV

SEQ ID NO: 1937351 - protein, 4 aa, Staphylococcus
ELGD

SEQ ID NO: 1937352 - protein, 7 aa, Staphylococcus
ELGEGGL

SEQ ID NO: 1937353 - protein, 7 aa, Staphylococcus
ELGEKSD

SEQ ID NO: 1937354 - protein, 10 aa, Staphylococcus
ELGENSQRMH

SEQ ID NO: 1937355 - protein, 11 aa, Staphylococcus
ELGENSRSMHE

SEQ ID NO: 1937356 - protein, 5 aa, Staphylococcus
ELGER

SEQ ID NO: 1937357 - protein, 5 aa, Staphylococcus
ELGET

SEQ ID NO: 1937358 - protein, 8 aa, Staphylococcus
ELGGDAKS

SEQ ID NO: 1937359 - protein, 8 aa, Staphylococcus
ELGGDPKS

SEQ ID NO: 1937360 - protein, 15 aa, Staphylococcus
ELGGGSIRISDGELQ

SEQ ID NO: 1937361 - protein, 11 aa, Staphylococcus
ELGGKTKIVDE

SEQ ID NO: 1937362 - protein, 12 aa, Staphylococcus
ELGGNTVDPSIR

SEQ ID NO: 1937363 - protein, 6 aa, Staphylococcus
ELGGRF

SEQ ID NO: 1937364 - protein, 14 aa, Staphylococcus
ELGGSVRTTTEENR

SEQ ID NO: 1937365 - protein, 6 aa, Staphylococcus
ELGHGA

SEQ ID NO: 1937366 - protein, 16 aa, Staphylococcus
ELGKLSKAQLRKKRQK

SEQ ID NO: 1937367 - protein, 9 aa, Staphylococcus
ELGKSEDVS

SEQ ID NO: 1937368 - protein, 4 aa, Staphylococcus
ELGL

SEQ ID NO: 1937369 - protein, 5 aa, Staphylococcus
ELGLQ

SEQ ID NO: 1937370 - protein, 5 aa, Staphylococcus
ELGPY

SEQ ID NO: 1937371 - protein, 5 aa, Staphylococcus
ELGQT

SEQ ID NO: 1937372 - protein, 8 aa, Staphylococcus
ELGSPLEV

SEQ ID NO: 1937373 - protein, 8 aa, Staphylococcus
ELGSPLSV

SEQ ID NO: 1937374 - protein, 6 aa, Staphylococcus
ELGSVN

SEQ ID NO: 1937375 - protein, 4 aa, Staphylococcus
ELGT

SEQ ID NO: 1937376 - protein, 6 aa, Staphylococcus
ELGTHG

SEQ ID NO: 1937377 - protein, 12 aa, Staphylococcus
ELGTKGLKEKLS

SEQ ID NO: 1937378 - protein, 4 aa, Staphylococcus
ELGY

SEQ ID NO: 1937379 - protein, 8 aa, Staphylococcus
ELHEGKKE

SEQ ID NO: 1937380 - protein, 11 aa, Staphylococcus
ELHEKEDESHV

SEQ ID NO: 1937381 - protein, 8 aa, Staphylococcus
ELIGKPPK

SEQ ID NO: 1937382 - protein, 8 aa, Staphylococcus
ELIGTPPK

SEQ ID NO: 1937383 - protein, 11 aa, Staphylococcus
ELINEAKKETD

SEQ ID NO: 1937384 - protein, 7 aa, Staphylococcus
ELKADNV

SEQ ID NO: 1937385 - protein, 7 aa, Staphylococcus
ELKADSV

SEQ ID NO: 1937386 - protein, 7 aa, Staphylococcus
ELKADTV

SEQ ID NO: 1937387 - protein, 12 aa, Staphylococcus
ELKAEADATNTA

SEQ ID NO: 1937388 - protein, 16 aa, Staphylococcus
ELKAKDKNLEGNDIRE

SEQ ID NO: 1937389 - protein, 12 aa, Staphylococcus
ELKANPEKNAVG

SEQ ID NO: 1937390 - protein, 5 aa, Staphylococcus
ELKDD

SEQ ID NO: 1937391 - protein, 8 aa, Staphylococcus
ELKDENKL

SEQ ID NO: 1937392 - protein, 10 aa, Staphylococcus
ELKDKGDYEA

SEQ ID NO: 1937393 - protein, 4 aa, Staphylococcus
ELKE

SEQ ID NO: 1937394 - protein, 7 aa, Staphylococcus
ELKEDEP

SEQ ID NO: 1937395 - protein, 6 aa, Staphylococcus
ELKEIR

SEQ ID NO: 1937396 - protein, 10 aa, Staphylococcus
ELKEKGDYKA

SEQ ID NO: 1937397 - protein, 13 aa, Staphylococcus
ELKEKKKRGIPHP

SEQ ID NO: 1937398 - protein, 6 aa, Staphylococcus
ELKEQQ

SEQ ID NO: 1937399 - protein, 7 aa, Staphylococcus
ELKEQQD

SEQ ID NO: 1937400 - protein, 5 aa, Staphylococcus
ELKGR

SEQ ID NO: 1937401 - protein, 4 aa, Staphylococcus
ELKK

SEQ ID NO: 1937402 - protein, 13 aa, Staphylococcus
ELKKAGVSTASGF

SEQ ID NO: 1937403 - protein, 17 aa, Staphylococcus
ELKKNENELKQLKQNES

SEQ ID NO: 1937404 - protein, 13 aa, Staphylococcus
ELKKTDRANTTVA

SEQ ID NO: 1937405 - protein, 8 aa, Staphylococcus
ELKNEGRM

SEQ ID NO: 1937406 - protein, 6 aa, Staphylococcus
ELKNEQ

SEQ ID NO: 1937407 - protein, 7 aa, Staphylococcus
ELKNNSS

SEQ ID NO: 1937408 - protein, 7 aa, Staphylococcus
ELKNRKS

SEQ ID NO: 1937409 - protein, 4 aa, Staphylococcus
ELKP

SEQ ID NO: 1937410 - protein, 10 aa, Staphylococcus
ELKPKELKER

SEQ ID NO: 1937411 - protein, 5 aa, Staphylococcus
ELKPM

SEQ ID NO: 1937412 - protein, 6 aa, Staphylococcus
ELKQNK

SEQ ID NO: 1937413 - protein, 12 aa, Staphylococcus
ELKQSIKASDGR

SEQ ID NO: 1937414 - protein, 7 aa, Staphylococcus
ELKRENP

SEQ ID NO: 1937415 - protein, 10 aa, Staphylococcus
ELKSEAQHNH

SEQ ID NO: 1937416 - protein, 18 aa, Staphylococcus
ELKSENPTYIIHEVTELN

SEQ ID NO: 1937417 - protein, 7 aa, Staphylococcus
ELKSPSH

SEQ ID NO: 1937418 - protein, 30 aa, Staphylococcus
ELKSQQAQKESSQAQVKQQLQKYKGTRQHI

SEQ ID NO: 1937419 - protein, 7 aa, Staphylococcus
ELKSQQE

SEQ ID NO: 1937420 - protein, 5 aa, Staphylococcus
ELKSR

SEQ ID NO: 1937421 - protein, 8 aa, Staphylococcus
ELKSTGKT

SEQ ID NO: 1937422 - protein, 13 aa, Staphylococcus
ELKVKETNRIDTT

SEQ ID NO: 1937423 - protein, 5 aa, Staphylococcus
ELLDP

SEQ ID NO: 1937424 - protein, 12 aa, Staphylococcus
ELMPGGVNSPVR

SEQ ID NO: 1937425 - protein, 5 aa, Staphylococcus
ELNDI

SEQ ID NO: 1937426 - protein, 6 aa, Staphylococcus
ELNDPL

SEQ ID NO: 1937427 - protein, 4 aa, Staphylococcus
ELNE

SEQ ID NO: 1937428 - protein, 6 aa, Staphylococcus
ELNEDE

SEQ ID NO: 1937429 - protein, 7 aa, Staphylococcus
ELNEEKE

SEQ ID NO: 1937430 - protein, 12 aa, Staphylococcus
ELNEEKEHLEQS

SEQ ID NO: 1937431 - protein, 14 aa, Staphylococcus
ELNEEKEQLEQTYE

SEQ ID NO: 1937432 - protein, 9 aa, Staphylococcus
ELNEKADQA

SEQ ID NO: 1937433 - protein, 11 aa, Staphylococcus
ELNEKADRELS

SEQ ID NO: 1937434 - protein, 7 aa, Staphylococcus
ELNENDD

SEQ ID NO: 1937435 - protein, 9 aa, Staphylococcus
ELNESDEDK

SEQ ID NO: 1937436 - protein, 10 aa, Staphylococcus
ELNESTEELK

SEQ ID NO: 1937437 - protein, 8 aa, Staphylococcus
ELNETEKP

SEQ ID NO: 1937438 - protein, 5 aa, Staphylococcus
ELNGN

SEQ ID NO: 1937439 - protein, 4 aa, Staphylococcus
ELNH

SEQ ID NO: 1937440 - protein, 5 aa, Staphylococcus
ELNHR

SEQ ID NO: 1937441 - protein, 4 aa, Staphylococcus
ELNK

SEQ ID NO: 1937442 - protein, 17 aa, Staphylococcus
ELNKEGKEAEVTDGINN

SEQ ID NO: 1937443 - protein, 14 aa, Staphylococcus
ELNPATARPYFGNP

SEQ ID NO: 1937444 - protein, 6 aa, Staphylococcus
ELNPRG

SEQ ID NO: 1937445 - protein, 9 aa, Staphylococcus
ELNPSEKDD

SEQ ID NO: 1937446 - protein, 15 aa, Staphylococcus
ELNQSDENITRGPDH

SEQ ID NO: 1937447 - protein, 5 aa, Staphylococcus
ELNQT

SEQ ID NO: 1937448 - protein, 6 aa, Staphylococcus
ELNRRG

SEQ ID NO: 1937449 - protein, 12 aa, Staphylococcus
ELNSAGAKNTTA

SEQ ID NO: 1937450 - protein, 11 aa, Staphylococcus
ELNSDETQANN

SEQ ID NO: 1937451 - protein, 8 aa, Staphylococcus
ELNSDTEL

SEQ ID NO: 1937452 - protein, 9 aa, Staphylococcus
ELNSGNRSM

SEQ ID NO: 1937453 - protein, 15 aa, Staphylococcus
ELNSKLNDTKASYNQ

SEQ ID NO: 1937454 - protein, 14 aa, Staphylococcus
ELNTNENKRQTIHE

SEQ ID NO: 1937455 - protein, 10 aa, Staphylococcus
ELNTPKSVEI

SEQ ID NO: 1937456 - protein, 5 aa, Staphylococcus
ELNTT

SEQ ID NO: 1937457 - protein, 11 aa, Staphylococcus
ELNTTYETAEK

SEQ ID NO: 1937458 - protein, 5 aa, Staphylococcus
ELNYQ

SEQ ID NO: 1937459 - protein, 7 aa, Staphylococcus
ELPAGSK

SEQ ID NO: 1937460 - protein, 10 aa, Staphylococcus
ELPDGTHDTI

SEQ ID NO: 1937461 - protein, 7 aa, Staphylococcus
ELPDNAR

SEQ ID NO: 1937462 - protein, 8 aa, Staphylococcus
ELPDSKLP

SEQ ID NO: 1937463 - protein, 4 aa, Staphylococcus
ELPE

SEQ ID NO: 1937464 - protein, 16 aa, Staphylococcus
ELPEDTGAFLIIHQGE

SEQ ID NO: 1937465 - protein, 16 aa, Staphylococcus
ELPEDTGSFLIIHQGE

SEQ ID NO: 1937466 - protein, 6 aa, Staphylococcus
ELPEGD

SEQ ID NO: 1937467 - protein, 16 aa, Staphylococcus
ELPEKRQKAYESGNQM

SEQ ID NO: 1937468 - protein, 5 aa, Staphylococcus
ELPES

SEQ ID NO: 1937469 - protein, 13 aa, Staphylococcus
ELPFSDKSSPEAI

SEQ ID NO: 1937470 - protein, 7 aa, Staphylococcus
ELPGYQK

SEQ ID NO: 1937471 - protein, 6 aa, Staphylococcus
ELPKGA

SEQ ID NO: 1937472 - protein, 7 aa, Staphylococcus
ELPKGAR

SEQ ID NO: 1937473 - protein, 12 aa, Staphylococcus
ELPKGGRRRGNV

SEQ ID NO: 1937474 - protein, 4 aa, Staphylococcus
ELPN

SEQ ID NO: 1937475 - protein, 11 aa, Staphylococcus
ELPPKAGRDNH

SEQ ID NO: 1937476 - protein, 7 aa, Staphylococcus
ELPPNLE

SEQ ID NO: 1937477 - protein, 5 aa, Staphylococcus
ELPQA

SEQ ID NO: 1937478 - protein, 16 aa, Staphylococcus
ELPQPSLTQSFSEKDI

SEQ ID NO: 1937479 - protein, 7 aa, Staphylococcus
ELPQSDK

SEQ ID NO: 1937480 - protein, 4 aa, Staphylococcus
ELPR

SEQ ID NO: 1937481 - protein, 20 aa, Staphylococcus
ELPRNEVTTVSTKSPYVSTG

SEQ ID NO: 1937482 - protein, 4 aa, Staphylococcus
ELPS

SEQ ID NO: 1937483 - protein, 10 aa, Staphylococcus
ELPSDTEVEA

SEQ ID NO: 1937484 - protein, 7 aa, Staphylococcus
ELPSGAS

SEQ ID NO: 1937485 - protein, 6 aa, Staphylococcus
ELPTGA

SEQ ID NO: 1937486 - protein, 7 aa, Staphylococcus
ELPTPEN

SEQ ID NO: 1937487 - protein, 12 aa, Staphylococcus
ELPTTEEEEEEI

SEQ ID NO: 1937488 - protein, 6 aa, Staphylococcus
ELPTTT

SEQ ID NO: 1937489 - protein, 13 aa, Staphylococcus
ELQAKQDKPVTDQ

SEQ ID NO: 1937490 - protein, 6 aa, Staphylococcus
ELQDEL

SEQ ID NO: 1937491 - protein, 8 aa, Staphylococcus
ELQENGKI

SEQ ID NO: 1937492 - protein, 5 aa, Staphylococcus
ELQEP

SEQ ID NO: 1937493 - protein, 19 aa, Staphylococcus
ELQESLESGQGEATTATVQ

SEQ ID NO: 1937494 - protein, 7 aa, Staphylococcus
ELQGEET

SEQ ID NO: 1937495 - protein, 9 aa, Staphylococcus
ELQGESTVD

SEQ ID NO: 1937496 - protein, 12 aa, Staphylococcus
ELQGIDRPNEVN

SEQ ID NO: 1937497 - protein, 5 aa, Staphylococcus
ELQKL

SEQ ID NO: 1937498 - protein, 6 aa, Staphylococcus
ELQKLR

SEQ ID NO: 1937499 - protein, 18 aa, Staphylococcus
ELQKLRDAETVTIDGEHA

SEQ ID NO: 1937500 - protein, 11 aa, Staphylococcus
ELQNGKIKDDD

SEQ ID NO: 1937501 - protein, 5 aa, Staphylococcus
ELQPF

SEQ ID NO: 1937502 - protein, 18 aa, Staphylococcus
ELQQKTSAFGQSTTVTPA

SEQ ID NO: 1937503 - protein, 12 aa, Staphylococcus
ELQQQTTIDDYL

SEQ ID NO: 1937504 - protein, 9 aa, Staphylococcus
ELQQSNPEV

SEQ ID NO: 1937505 - protein, 15 aa, Staphylococcus
ELQRKKIRDTNDGKV

SEQ ID NO: 1937506 - protein, 5 aa, Staphylococcus
ELQRQ

SEQ ID NO: 1937507 - protein, 10 aa, Staphylococcus
ELQSQNKTSN

SEQ ID NO: 1937508 - protein, 9 aa, Staphylococcus
ELQSSEDPI

SEQ ID NO: 1937509 - protein, 9 aa, Staphylococcus
ELQTRTRHK

SEQ ID NO: 1937510 - protein, 10 aa, Staphylococcus
ELRADKKVDG

SEQ ID NO: 1937511 - protein, 8 aa, Staphylococcus
ELRADKRV

SEQ ID NO: 1937512 - protein, 20 aa, Staphylococcus
ELRDGDKSRYGGKGVTKAVE

SEQ ID NO: 1937513 - protein, 14 aa, Staphylococcus
ELRDGDKSRYLGKG

SEQ ID NO: 1937514 - protein, 20 aa, Staphylococcus
ELRDGDKSRYLGKGVTKAVD

SEQ ID NO: 1937515 - protein, 7 aa, Staphylococcus
ELRDKGY

SEQ ID NO: 1937516 - protein, 4 aa, Staphylococcus
ELRE

SEQ ID NO: 1937517 - protein, 7 aa, Staphylococcus
ELRERKQ

SEQ ID NO: 1937518 - protein, 7 aa, Staphylococcus
ELRESRA

SEQ ID NO: 1937519 - protein, 8 aa, Staphylococcus
ELRESRED

SEQ ID NO: 1937520 - protein, 7 aa, Staphylococcus
ELRESRK

SEQ ID NO: 1937521 - protein, 8 aa, Staphylococcus
ELRESRTD

SEQ ID NO: 1937522 - protein, 19 aa, Staphylococcus
ELRETGLGGLAGTPTGEAI

SEQ ID NO: 1937523 - protein, 5 aa, Staphylococcus
ELRGP

SEQ ID NO: 1937524 - protein, 7 aa, Staphylococcus
ELRKAGA

SEQ ID NO: 1937525 - protein, 5 aa, Staphylococcus
ELRKG

SEQ ID NO: 1937526 - protein, 6 aa, Staphylococcus
ELRKQS

SEQ ID NO: 1937527 - protein, 15 aa, Staphylococcus
ELRPKQSKLGKVERA

SEQ ID NO: 1937528 - protein, 6 aa, Staphylococcus
ELRQGN

SEQ ID NO: 1937529 - protein, 6 aa, Staphylococcus
ELRSEN

SEQ ID NO: 1937530 - protein, 16 aa, Staphylococcus
ELRTEAQRRNIQETED

SEQ ID NO: 1937531 - protein, 13 aa, Staphylococcus
ELRTEPKLSLPTA

SEQ ID NO: 1937532 - protein, 4 aa, Staphylococcus
ELSA

SEQ ID NO: 1937533 - protein, 7 aa, Staphylococcus
ELSAADK

SEQ ID NO: 1937534 - protein, 10 aa, Staphylococcus
ELSADDQATL

SEQ ID NO: 1937535 - protein, 11 aa, Staphylococcus
ELSADGPIREP

SEQ ID NO: 1937536 - protein, 11 aa, Staphylococcus
ELSADGPIRPP

SEQ ID NO: 1937537 - protein, 10 aa, Staphylococcus
ELSAEDQETF

SEQ ID NO: 1937538 - protein, 9 aa, Staphylococcus
ELSAGNRSM

SEQ ID NO: 1937539 - protein, 12 aa, Staphylococcus
ELSDAEYETTKR

SEQ ID NO: 1937540 - protein, 19 aa, Staphylococcus
ELSDGKTKPAQLERTENEK

SEQ ID NO: 1937541 - protein, 9 aa, Staphylococcus
ELSDKEDTI

SEQ ID NO: 1937542 - protein, 7 aa, Staphylococcus
ELSDQED

SEQ ID NO: 1937543 - protein, 8 aa, Staphylococcus
ELSDSDTI

SEQ ID NO: 1937544 - protein, 9 aa, Staphylococcus
ELSDSEDTI

SEQ ID NO: 1937545 - protein, 7 aa, Staphylococcus
ELSDSQD

SEQ ID NO: 1937546 - protein, 10 aa, Staphylococcus
ELSEDDQATF

SEQ ID NO: 1937547 - protein, 9 aa, Staphylococcus
ELSEEDNID

SEQ ID NO: 1937548 - protein, 10 aa, Staphylococcus
ELSEEDQATF

SEQ ID NO: 1937549 - protein, 9 aa, Staphylococcus
ELSEGNRSM

SEQ ID NO: 1937550 - protein, 10 aa, Staphylococcus
ELSEGRRSEI

SEQ ID NO: 1937551 - protein, 9 aa, Staphylococcus
ELSEKVQDK

SEQ ID NO: 1937552 - protein, 6 aa, Staphylococcus
ELSEQQ

SEQ ID NO: 1937553 - protein, 6 aa, Staphylococcus
ELSGAM

SEQ ID NO: 1937554 - protein, 10 aa, Staphylococcus
ELSGANAIHP

SEQ ID NO: 1937555 - protein, 6 aa, Staphylococcus
ELSGGQ

SEQ ID NO: 1937556 - protein, 10 aa, Staphylococcus
ELSGGQKQRV

SEQ ID NO: 1937557 - protein, 9 aa, Staphylococcus
ELSGGQQKR

SEQ ID NO: 1937558 - protein, 10 aa, Staphylococcus
ELSGGQQQRV

SEQ ID NO: 1937559 - protein, 7 aa, Staphylococcus
ELSGRKE

SEQ ID NO: 1937560 - protein, 5 aa, Staphylococcus
ELSHH

SEQ ID NO: 1937561 - protein, 4 aa, Staphylococcus
ELSK

SEQ ID NO: 1937562 - protein, 9 aa, Staphylococcus
ELSKENELQ

SEQ ID NO: 1937563 - protein, 8 aa, Staphylococcus
ELSNDEPV

SEQ ID NO: 1937564 - protein, 6 aa, Staphylococcus
ELSNDI

SEQ ID NO: 1937565 - protein, 11 aa, Staphylococcus
ELSNHKNNLNK

SEQ ID NO: 1937566 - protein, 8 aa, Staphylococcus
ELSNQEVA

SEQ ID NO: 1937567 - protein, 4 aa, Staphylococcus
ELSP

SEQ ID NO: 1937568 - protein, 10 aa, Staphylococcus
ELSPEDQETF

SEQ ID NO: 1937569 - protein, 13 aa, Staphylococcus
ELSPFDDDKKSMD

SEQ ID NO: 1937570 - protein, 5 aa, Staphylococcus
ELSPQ

SEQ ID NO: 1937571 - protein, 5 aa, Staphylococcus
ELSPT

SEQ ID NO: 1937572 - protein, 13 aa, Staphylococcus
ELSQKNGLSISAT

SEQ ID NO: 1937573 - protein, 9 aa, Staphylococcus
ELSRGNRSM

SEQ ID NO: 1937574 - protein, 4 aa, Staphylococcus
ELSS

SEQ ID NO: 1937575 - protein, 7 aa, Staphylococcus
ELSSESD

SEQ ID NO: 1937576 - protein, 9 aa, Staphylococcus
ELSSGNRSM

SEQ ID NO: 1937577 - protein, 7 aa, Staphylococcus
ELSSGQT

SEQ ID NO: 1937578 - protein, 25 aa, Staphylococcus
ELSSQTVADATRIQYGGSVKPNNIK

SEQ ID NO: 1937579 - protein, 5 aa, Staphylococcus
ELSST

SEQ ID NO: 1937580 - protein, 8 aa, Staphylococcus
ELSTEDQL

SEQ ID NO: 1937581 - protein, 8 aa, Staphylococcus
ELSTETSN

SEQ ID NO: 1937582 - protein, 10 aa, Staphylococcus
ELSTFGPGGR

SEQ ID NO: 1937583 - protein, 4 aa, Staphylococcus
ELTD

SEQ ID NO: 1937584 - protein, 8 aa, Staphylococcus
ELTDDDYL

SEQ ID NO: 1937585 - protein, 9 aa, Staphylococcus
ELTDEDKIE

SEQ ID NO: 1937586 - protein, 5 aa, Staphylococcus
ELTED

SEQ ID NO: 1937587 - protein, 14 aa, Staphylococcus
ELTEEEIKGKDSED

SEQ ID NO: 1937588 - protein, 8 aa, Staphylococcus
ELTETYQQ

SEQ ID NO: 1937589 - protein, 9 aa, Staphylococcus
ELTGAKPGD

SEQ ID NO: 1937590 - protein, 11 aa, Staphylococcus
ELTGKKESDKI

SEQ ID NO: 1937591 - protein, 9 aa, Staphylococcus
ELTKNELEQ

SEQ ID NO: 1937592 - protein, 10 aa, Staphylococcus
ELTKQSDLAG

SEQ ID NO: 1937593 - protein, 4 aa, Staphylococcus
ELTN

SEQ ID NO: 1937594 - protein, 5 aa, Staphylococcus
ELTPI

SEQ ID NO: 1937595 - protein, 5 aa, Staphylococcus
ELTPT

SEQ ID NO: 1937596 - protein, 6 aa, Staphylococcus
ELTPYA

SEQ ID NO: 1937597 - protein, 8 aa, Staphylococcus
ELTQENDE

SEQ ID NO: 1937598 - protein, 22 aa, Staphylococcus
ELTSDQNKEKQEKQQTKKPRLI

SEQ ID NO: 1937599 - protein, 8 aa, Staphylococcus
ELTSEDKS

SEQ ID NO: 1937600 - protein, 7 aa, Staphylococcus
ELTTPEP

SEQ ID NO: 1937601 - protein, 8 aa, Staphylococcus
ELTTPTGA

SEQ ID NO: 1937602 - protein, 10 aa, Staphylococcus
ELTTPTGAAI

SEQ ID NO: 1937603 - protein, 13 aa, Staphylococcus
ELTTSQSKSLNDT

SEQ ID NO: 1937604 - protein, 11 aa, Staphylococcus
ELVKADEKDAV

SEQ ID NO: 1937605 - protein, 4 aa, Staphylococcus
ELYD

SEQ ID NO: 1937606 - protein, 4 aa, Staphylococcus
ELYQ

SEQ ID NO: 1937607 - protein, 13 aa, Staphylococcus
EMAGAKENDPFYK

SEQ ID NO: 1937608 - protein, 5 aa, Staphylococcus
EMASQ

SEQ ID NO: 1937609 - protein, 5 aa, Staphylococcus
EMATQ

SEQ ID NO: 1937610 - protein, 5 aa, Staphylococcus
EMDKA

SEQ ID NO: 1937611 - protein, 21 aa, Staphylococcus
EMDQQRTRAREARQSSQSMQI

SEQ ID NO: 1937612 - protein, 4 aa, Staphylococcus
EMED

SEQ ID NO: 1937613 - protein, 18 aa, Staphylococcus
EMEDEPVRAIKRKKDSSM

SEQ ID NO: 1937614 - protein, 4 aa, Staphylococcus
EMEH

SEQ ID NO: 1937615 - protein, 5 aa, Staphylococcus
EMENE

SEQ ID NO: 1937616 - protein, 8 aa, Staphylococcus
EMEPDEGS

SEQ ID NO: 1937617 - protein, 9 aa, Staphylococcus
EMEPDEGSV

SEQ ID NO: 1937618 - protein, 10 aa, Staphylococcus
EMEPDEGSYK

SEQ ID NO: 1937619 - protein, 9 aa, Staphylococcus
EMEPDEGTV

SEQ ID NO: 1937620 - protein, 6 aa, Staphylococcus
EMEPED

SEQ ID NO: 1937621 - protein, 5 aa, Staphylococcus
EMEPY

SEQ ID NO: 1937622 - protein, 26 aa, Staphylococcus
EMEQISEENDEDKYNQTHDSEARSDL

SEQ ID NO: 1937623 - protein, 5 aa, Staphylococcus
EMGKG

SEQ ID NO: 1937624 - protein, 8 aa, Staphylococcus
EMHGPELP

SEQ ID NO: 1937625 - protein, 8 aa, Staphylococcus
EMIDPQSA

SEQ ID NO: 1937626 - protein, 12 aa, Staphylococcus
EMIGTAPEEHIK

SEQ ID NO: 1937627 - protein, 6 aa, Staphylococcus
EMKDGE

SEQ ID NO: 1937628 - protein, 7 aa, Staphylococcus
EMKDTPN

SEQ ID NO: 1937629 - protein, 5 aa, Staphylococcus
EMKES

SEQ ID NO: 1937630 - protein, 10 aa, Staphylococcus
EMKKAAKDLD

SEQ ID NO: 1937631 - protein, 5 aa, Staphylococcus
EMKNR

SEQ ID NO: 1937632 - protein, 11 aa, Staphylococcus
EMMSEDERQRI

SEQ ID NO: 1937633 - protein, 7 aa, Staphylococcus
EMNGDTK

SEQ ID NO: 1937634 - protein, 5 aa, Staphylococcus
EMNGE

SEQ ID NO: 1937635 - protein, 8 aa, Staphylococcus
EMNRNGFE

SEQ ID NO: 1937636 - protein, 4 aa, Staphylococcus
EMPE

SEQ ID NO: 1937637 - protein, 11 aa, Staphylococcus
EMPKPDKTKID

SEQ ID NO: 1937638 - protein, 11 aa, Staphylococcus
EMPKPDKTKIN

SEQ ID NO: 1937639 - protein, 7 aa, Staphylococcus
EMPNTGK

SEQ ID NO: 1937640 - protein, 7 aa, Staphylococcus
EMPPAPY

SEQ ID NO: 1937641 - protein, 5 aa, Staphylococcus
EMQEH

SEQ ID NO: 1937642 - protein, 5 aa, Staphylococcus
EMQET

SEQ ID NO: 1937643 - protein, 6 aa, Staphylococcus
EMQPKK

SEQ ID NO: 1937644 - protein, 21 aa, Staphylococcus
EMQQQRDRARQARQNSQSMQV

SEQ ID NO: 1937645 - protein, 21 aa, Staphylococcus
EMQQQRDRARQARQSSQSMQI

SEQ ID NO: 1937646 - protein, 17 aa, Staphylococcus
EMQSATKPGITTKELDD

SEQ ID NO: 1937647 - protein, 12 aa, Staphylococcus
EMQTGEGKTLTA

SEQ ID NO: 1937648 - protein, 12 aa, Staphylococcus
EMRDKKGADVKE

SEQ ID NO: 1937649 - protein, 5 aa, Staphylococcus
EMRET

SEQ ID NO: 1937650 - protein, 10 aa, Staphylococcus
EMRGKDTYGN

SEQ ID NO: 1937651 - protein, 5 aa, Staphylococcus
EMRGP

SEQ ID NO: 1937652 - protein, 6 aa, Staphylococcus
EMRPKK

SEQ ID NO: 1937653 - protein, 6 aa, Staphylococcus
EMRPKN

SEQ ID NO: 1937654 - protein, 5 aa, Staphylococcus
EMRTD

SEQ ID NO: 1937655 - protein, 22 aa, Staphylococcus
EMSDDTEHGGMRTTSWTSYSTP

SEQ ID NO: 1937656 - protein, 4 aa, Staphylococcus
EMSE

SEQ ID NO: 1937657 - protein, 9 aa, Staphylococcus
EMSEPLGTH

SEQ ID NO: 1937658 - protein, 4 aa, Staphylococcus
EMSG

SEQ ID NO: 1937659 - protein, 9 aa, Staphylococcus
EMSGQTYQD

SEQ ID NO: 1937660 - protein, 7 aa, Staphylococcus
EMTEAQD

SEQ ID NO: 1937661 - protein, 4 aa, Staphylococcus
EMTG

SEQ ID NO: 1937662 - protein, 9 aa, Staphylococcus
EMTKYQEEK

SEQ ID NO: 1937663 - protein, 10 aa, Staphylococcus
EMYDTKPRGL

SEQ ID NO: 1937664 - protein, 11 aa, Staphylococcus
ENAAHGKGITE

SEQ ID NO: 1937665 - protein, 12 aa, Staphylococcus
ENAAHGKGLTEK

SEQ ID NO: 1937666 - protein, 39 aa, Staphylococcus
ENAANLRDKQSKLEKQYEDAKKEWQNAQGGSNTELSQED

SEQ ID NO: 1937667 - protein, 40 aa, Staphylococcus
ENAANLRDKQTKLEKQYEEANTNWKNTQNGDNTSLSEEDI

SEQ ID NO: 1937668 - protein, 8 aa, Staphylococcus
ENAASTVK

SEQ ID NO: 1937669 - protein, 6 aa, Staphylococcus
ENAAYG

SEQ ID NO: 1937670 - protein, 17 aa, Staphylococcus
ENADKRRQYRKGNEDMD

SEQ ID NO: 1937671 - protein, 4 aa, Staphylococcus
ENAE

SEQ ID NO: 1937672 - protein, 5 aa, Staphylococcus
ENAEK

SEQ ID NO: 1937673 - protein, 9 aa, Staphylococcus
ENAELEPLE

SEQ ID NO: 1937674 - protein, 13 aa, Staphylococcus
ENAESETDEEKLE

SEQ ID NO: 1937675 - protein, 5 aa, Staphylococcus
ENAFE

SEQ ID NO: 1937676 - protein, 4 aa, Staphylococcus
ENAG

SEQ ID NO: 1937677 - protein, 5 aa, Staphylococcus
ENAGF

SEQ ID NO: 1937678 - protein, 6 aa, Staphylococcus
ENAGGY

SEQ ID NO: 1937679 - protein, 13 aa, Staphylococcus
ENAIKKAEELDDL

SEQ ID NO: 1937680 - protein, 10 aa, Staphylococcus
ENAIKNGASE

SEQ ID NO: 1937681 - protein, 5 aa, Staphylococcus
ENAIS

SEQ ID NO: 1937682 - protein, 4 aa, Staphylococcus
ENAK

SEQ ID NO: 1937683 - protein, 9 aa, Staphylococcus
ENAKNAGFV

SEQ ID NO: 1937684 - protein, 11 aa, Staphylococcus
ENAKNVKQDNQ

SEQ ID NO: 1937685 - protein, 6 aa, Staphylococcus
ENAKSV

SEQ ID NO: 1937686 - protein, 5 aa, Staphylococcus
ENALD

SEQ ID NO: 1937687 - protein, 7 aa, Staphylococcus
ENANKLP

SEQ ID NO: 1937688 - protein, 23 aa, Staphylococcus
ENANYAKAQFKEAGLEVSNGTSF

SEQ ID NO: 1937689 - protein, 18 aa, Staphylococcus
ENAPGIGQSFPKISKNVD

SEQ ID NO: 1937690 - protein, 13 aa, Staphylococcus
ENAPLPNNKVESL

SEQ ID NO: 1937691 - protein, 4 aa, Staphylococcus
ENAQ

SEQ ID NO: 1937692 - protein, 7 aa, Staphylococcus
ENAQLAT

SEQ ID NO: 1937693 - protein, 11 aa, Staphylococcus
ENAQPYKEVAS

SEQ ID NO: 1937694 - protein, 8 aa, Staphylococcus
ENARLNEQ

SEQ ID NO: 1937695 - protein, 7 aa, Staphylococcus
ENARPYC

SEQ ID NO: 1937696 - protein, 6 aa, Staphylococcus
ENASKF

SEQ ID NO: 1937697 - protein, 14 aa, Staphylococcus
ENASNEIKSRIFNL

SEQ ID NO: 1937698 - protein, 15 aa, Staphylococcus
ENASVTLTSQGATKI

SEQ ID NO: 1937699 - protein, 10 aa, Staphylococcus
ENATFTPNTA

SEQ ID NO: 1937700 - protein, 12 aa, Staphylococcus
ENATPSQTSVNI

SEQ ID NO: 1937701 - protein, 4 aa, Staphylococcus
ENAV

SEQ ID NO: 1937702 - protein, 6 aa, Staphylococcus
ENAVAE

SEQ ID NO: 1937703 - protein, 8 aa, Staphylococcus
ENAYDNHT

SEQ ID NO: 1937704 - protein, 21 aa, Staphylococcus
ENAYEAKKQKNNMKTGQILSF

SEQ ID NO: 1937705 - protein, 12 aa, Staphylococcus
ENCGDPSERDVT

SEQ ID NO: 1937706 - protein, 10 aa, Staphylococcus
ENCSTKNENF

SEQ ID NO: 1937707 - protein, 12 aa, Staphylococcus
ENCTSEEKEEIK

SEQ ID NO: 1937708 - protein, 5 aa, Staphylococcus
ENDAD

SEQ ID NO: 1937709 - protein, 5 aa, Staphylococcus
ENDAE

SEQ ID NO: 1937710 - protein, 9 aa, Staphylococcus
ENDDDSEDL

SEQ ID NO: 1937711 - protein, 6 aa, Staphylococcus
ENDDKV

SEQ ID NO: 1937712 - protein, 6 aa, Staphylococcus
ENDDLK

SEQ ID NO: 1937713 - protein, 10 aa, Staphylococcus
ENDDTAKNAV

SEQ ID NO: 1937714 - protein, 9 aa, Staphylococcus
ENDDTCKEA

SEQ ID NO: 1937715 - protein, 11 aa, Staphylococcus
ENDDTLESPAV

SEQ ID NO: 1937716 - protein, 4 aa, Staphylococcus
ENDE

SEQ ID NO: 1937717 - protein, 5 aa, Staphylococcus
ENDEN

SEQ ID NO: 1937718 - protein, 18 aa, Staphylococcus
ENDENDVTIEEEARHASN

SEQ ID NO: 1937719 - protein, 10 aa, Staphylococcus
ENDEQAKETV

SEQ ID NO: 1937720 - protein, 18 aa, Staphylococcus
ENDERFAKTINNKRHDNL

SEQ ID NO: 1937721 - protein, 7 aa, Staphylococcus
ENDERVR

SEQ ID NO: 1937722 - protein, 6 aa, Staphylococcus
ENDETI

SEQ ID NO: 1937723 - protein, 11 aa, Staphylococcus
ENDEVTTKGST

SEQ ID NO: 1937724 - protein, 5 aa, Staphylococcus
ENDFD

SEQ ID NO: 1937725 - protein, 12 aa, Staphylococcus
ENDGALNKELKE

SEQ ID NO: 1937726 - protein, 10 aa, Staphylococcus
ENDGATGLDK

SEQ ID NO: 1937727 - protein, 9 aa, Staphylococcus
ENDGIRTPF

SEQ ID NO: 1937728 - protein, 4 aa, Staphylococcus
ENDI

SEQ ID NO: 1937729 - protein, 8 aa, Staphylococcus
ENDIDTEK

SEQ ID NO: 1937730 - protein, 9 aa, Staphylococcus
ENDIKGANH

SEQ ID NO: 1937731 - protein, 9 aa, Staphylococcus
ENDKGAIKS

SEQ ID NO: 1937732 - protein, 9 aa, Staphylococcus
ENDKNTKYF

SEQ ID NO: 1937733 - protein, 5 aa, Staphylococcus
ENDKP

SEQ ID NO: 1937734 - protein, 9 aa, Staphylococcus
ENDLNEAKT

SEQ ID NO: 1937735 - protein, 8 aa, Staphylococcus
ENDLSNSA

SEQ ID NO: 1937736 - protein, 16 aa, Staphylococcus
ENDNAKLTSDKLKAFG

SEQ ID NO: 1937737 - protein, 8 aa, Staphylococcus
ENDNEDVD

SEQ ID NO: 1937738 - protein, 8 aa, Staphylococcus
ENDNEVKQ

SEQ ID NO: 1937739 - protein, 8 aa, Staphylococcus
ENDNGSKM

SEQ ID NO: 1937740 - protein, 17 aa, Staphylococcus
ENDNHAEKLYQQLLKSM

SEQ ID NO: 1937741 - protein, 18 aa, Staphylococcus
ENDNKNNIPVVTPSPDYK

SEQ ID NO: 1937742 - protein, 6 aa, Staphylococcus
ENDNLK

SEQ ID NO: 1937743 - protein, 5 aa, Staphylococcus
ENDNQ

SEQ ID NO: 1937744 - protein, 4 aa, Staphylococcus
ENDP

SEQ ID NO: 1937745 - protein, 6 aa, Staphylococcus
ENDPDV

SEQ ID NO: 1937746 - protein, 5 aa, Staphylococcus
ENDPG

SEQ ID NO: 1937747 - protein, 6 aa, Staphylococcus
ENDPGI

SEQ ID NO: 1937748 - protein, 4 aa, Staphylococcus
ENDS

SEQ ID NO: 1937749 - protein, 42 aa, Staphylococcus
ENDSAAENTKQDQEDFKDPSETSIGDEAKTIVSEEEHDLNSD

SEQ ID NO: 1937750 - protein, 12 aa, Staphylococcus
ENDSVDLTDNTR

SEQ ID NO: 1937751 - protein, 6 aa, Staphylococcus
ENDSYT

SEQ ID NO: 1937752 - protein, 4 aa, Staphylococcus
ENDT

SEQ ID NO: 1937753 - protein, 24 aa, Staphylococcus
ENDVDDAQYRELSETDPKSKESLA

SEQ ID NO: 1937754 - protein, 6 aa, Staphylococcus
ENDVEV

SEQ ID NO: 1937755 - protein, 5 aa, Staphylococcus
ENDVK

SEQ ID NO: 1937756 - protein, 4 aa, Staphylococcus
ENDY

SEQ ID NO: 1937757 - protein, 5 aa, Staphylococcus
ENDYE

SEQ ID NO: 1937758 - protein, 11 aa, Staphylococcus
ENDYSQALSNY

SEQ ID NO: 1937759 - protein, 5 aa, Staphylococcus
ENDYT

SEQ ID NO: 1937760 - protein, 17 aa, Staphylococcus
ENEADALARDICDWIAT

SEQ ID NO: 1937761 - protein, 40 aa, Staphylococcus
ENEALKAEKALSQMRNETRSMLSESGVENFDDQIVDIIGK

SEQ ID NO: 1937762 - protein, 6 aa, Staphylococcus
ENEAQD

SEQ ID NO: 1937763 - protein, 7 aa, Staphylococcus
ENEAQDD

SEQ ID NO: 1937764 - protein, 9 aa, Staphylococcus
ENEDDIDIG

SEQ ID NO: 1937765 - protein, 12 aa, Staphylococcus
ENEDGSKIDPAM

SEQ ID NO: 1937766 - protein, 12 aa, Staphylococcus
ENEDGSKVDPAL

SEQ ID NO: 1937767 - protein, 10 aa, Staphylococcus
ENEDGTKINP

SEQ ID NO: 1937768 - protein, 5 aa, Staphylococcus
ENEDV

SEQ ID NO: 1937769 - protein, 6 aa, Staphylococcus
ENEDVN

SEQ ID NO: 1937770 - protein, 4 aa, Staphylococcus
ENEE

SEQ ID NO: 1937771 - protein, 17 aa, Staphylococcus
ENEEGVGKAIRESSIPR

SEQ ID NO: 1937772 - protein, 5 aa, Staphylococcus
ENEFG

SEQ ID NO: 1937773 - protein, 13 aa, Staphylococcus
ENEGAFDNDQAMK

SEQ ID NO: 1937774 - protein, 17 aa, Staphylococcus
ENEGEAEKIYREIGKSL

SEQ ID NO: 1937775 - protein, 14 aa, Staphylococcus
ENEGIKSNKTKVGD

SEQ ID NO: 1937776 - protein, 7 aa, Staphylococcus
ENEGKSL

SEQ ID NO: 1937777 - protein, 5 aa, Staphylococcus
ENEGN

SEQ ID NO: 1937778 - protein, 8 aa, Staphylococcus
ENEGPLHQ

SEQ ID NO: 1937779 - protein, 6 aa, Staphylococcus
ENEHQN

SEQ ID NO: 1937780 - protein, 6 aa, Staphylococcus
ENEHRD

SEQ ID NO: 1937781 - protein, 20 aa, Staphylococcus
ENEINDEQKQAIANQIKAQF

SEQ ID NO: 1937782 - protein, 18 aa, Staphylococcus
ENEINESGTYRHTTEELT

SEQ ID NO: 1937783 - protein, 5 aa, Staphylococcus
ENEIQ

SEQ ID NO: 1937784 - protein, 7 aa, Staphylococcus
ENEIQSK

SEQ ID NO: 1937785 - protein, 13 aa, Staphylococcus
ENEITITVSDQND

SEQ ID NO: 1937786 - protein, 6 aa, Staphylococcus
ENEKID

SEQ ID NO: 1937787 - protein, 9 aa, Staphylococcus
ENEKLSQQV

SEQ ID NO: 1937788 - protein, 10 aa, Staphylococcus
ENEKNYPDAI

SEQ ID NO: 1937789 - protein, 7 aa, Staphylococcus
ENELKDL

SEQ ID NO: 1937790 - protein, 9 aa, Staphylococcus
ENELKDSSL

SEQ ID NO: 1937791 - protein, 11 aa, Staphylococcus
ENELKQQHTEY

SEQ ID NO: 1937792 - protein, 5 aa, Staphylococcus
ENELS

SEQ ID NO: 1937793 - protein, 8 aa, Staphylococcus
ENEMNGEG

SEQ ID NO: 1937794 - protein, 7 aa, Staphylococcus
ENENETY

SEQ ID NO: 1937795 - protein, 5 aa, Staphylococcus
ENENF

SEQ ID NO: 1937796 - protein, 5 aa, Staphylococcus
ENENI

SEQ ID NO: 1937797 - protein, 8 aa, Staphylococcus
ENENKDLY

SEQ ID NO: 1937798 - protein, 6 aa, Staphylococcus
ENENLD

SEQ ID NO: 1937799 - protein, 8 aa, Staphylococcus
ENENQSEF

SEQ ID NO: 1937800 - protein, 8 aa, Staphylococcus
ENENVTDD

SEQ ID NO: 1937801 - protein, 7 aa, Staphylococcus
ENENYTD

SEQ ID NO: 1937802 - protein, 4 aa, Staphylococcus
ENEP

SEQ ID NO: 1937803 - protein, 10 aa, Staphylococcus
ENEPNKISKK

SEQ ID NO: 1937804 - protein, 7 aa, Staphylococcus
ENEPVPS

SEQ ID NO: 1937805 - protein, 16 aa, Staphylococcus
ENEQIEQKQQQKQKAL

SEQ ID NO: 1937806 - protein, 12 aa, Staphylococcus
ENEQKRNEKLEA

SEQ ID NO: 1937807 - protein, 7 aa, Staphylococcus
ENEQQKG

SEQ ID NO: 1937808 - protein, 7 aa, Staphylococcus
ENEQSYT

SEQ ID NO: 1937809 - protein, 5 aa, Staphylococcus
ENEQV

SEQ ID NO: 1937810 - protein, 4 aa, Staphylococcus
ENER

SEQ ID NO: 1937811 - protein, 10 aa, Staphylococcus
ENERKYLASQ

SEQ ID NO: 1937812 - protein, 5 aa, Staphylococcus
ENERL

SEQ ID NO: 1937813 - protein, 6 aa, Staphylococcus
ENERLS

SEQ ID NO: 1937814 - protein, 10 aa, Staphylococcus
ENERRSNKDM

SEQ ID NO: 1937815 - protein, 4 aa, Staphylococcus
ENES

SEQ ID NO: 1937816 - protein, 10 aa, Staphylococcus
ENESEQEAGG

SEQ ID NO: 1937817 - protein, 48 aa, Staphylococcus
ENESKGKSKSQAQATSNRFQNATKQPAKRAHSQRATATKQKQSATNWN

SEQ ID NO: 1937818 - protein, 6 aa, Staphylococcus
ENESLN

SEQ ID NO: 1937819 - protein, 5 aa, Staphylococcus
ENESN

SEQ ID NO: 1937820 - protein, 9 aa, Staphylococcus
ENESSEEAN

SEQ ID NO: 1937821 - protein, 5 aa, Staphylococcus
ENETG

SEQ ID NO: 1937822 - protein, 8 aa, Staphylococcus
ENETGRRR

SEQ ID NO: 1937823 - protein, 5 aa, Staphylococcus
ENETI

SEQ ID NO: 1937824 - protein, 5 aa, Staphylococcus
ENETY

SEQ ID NO: 1937825 - protein, 5 aa, Staphylococcus
ENEVI

SEQ ID NO: 1937826 - protein, 9 aa, Staphylococcus
ENEVSDPKE

SEQ ID NO: 1937827 - protein, 14 aa, Staphylococcus
ENEYEDNANPEFRQ

SEQ ID NO: 1937828 - protein, 14 aa, Staphylococcus
ENEYEDSSDPEFRR

SEQ ID NO: 1937829 - protein, 5 aa, Staphylococcus
ENFAK

SEQ ID NO: 1937830 - protein, 4 aa, Staphylococcus
ENFE

SEQ ID NO: 1937831 - protein, 18 aa, Staphylococcus
ENFEKNSCENAIETTTGN

SEQ ID NO: 1937832 - protein, 5 aa, Staphylococcus
ENFGE

SEQ ID NO: 1937833 - protein, 5 aa, Staphylococcus
ENFKD

SEQ ID NO: 1937834 - protein, 7 aa, Staphylococcus
ENFQKNN

SEQ ID NO: 1937835 - protein, 16 aa, Staphylococcus
ENFSTTRNIQGIFNIE

SEQ ID NO: 1937836 - protein, 4 aa, Staphylococcus
ENGA

SEQ ID NO: 1937837 - protein, 5 aa, Staphylococcus
ENGAA

SEQ ID NO: 1937838 - protein, 12 aa, Staphylococcus
ENGAAANEKGEM

SEQ ID NO: 1937839 - protein, 27 aa, Staphylococcus
ENGAESNEKGEMLEGGRRLSKDGKPIN

SEQ ID NO: 1937840 - protein, 8 aa, Staphylococcus
ENGAGLNP

SEQ ID NO: 1937841 - protein, 7 aa, Staphylococcus
ENGANTV

SEQ ID NO: 1937842 - protein, 9 aa, Staphylococcus
ENGATRIEG

SEQ ID NO: 1937843 - protein, 8 aa, Staphylococcus
ENGAYTTA

SEQ ID NO: 1937844 - protein, 7 aa, Staphylococcus
ENGDEAL

SEQ ID NO: 1937845 - protein, 16 aa, Staphylococcus
ENGDKRFRKVDASQNI

SEQ ID NO: 1937846 - protein, 15 aa, Staphylococcus
ENGDTIEDPAISDER

SEQ ID NO: 1937847 - protein, 5 aa, Staphylococcus
ENGDY

SEQ ID NO: 1937848 - protein, 8 aa, Staphylococcus
ENGDYEPT

SEQ ID NO: 1937849 - protein, 4 aa, Staphylococcus
ENGE

SEQ ID NO: 1937850 - protein, 8 aa, Staphylococcus
ENGEGSKY

SEQ ID NO: 1937851 - protein, 11 aa, Staphylococcus
ENGELATTGST

SEQ ID NO: 1937852 - protein, 6 aa, Staphylococcus
ENGELE

SEQ ID NO: 1937853 - protein, 6 aa, Staphylococcus
ENGELK

SEQ ID NO: 1937854 - protein, 8 aa, Staphylococcus
ENGEPFTG

SEQ ID NO: 1937855 - protein, 13 aa, Staphylococcus
ENGEPYLKATPQN

SEQ ID NO: 1937856 - protein, 9 aa, Staphylococcus
ENGESKPNI

SEQ ID NO: 1937857 - protein, 9 aa, Staphylococcus
ENGESLNEV

SEQ ID NO: 1937858 - protein, 8 aa, Staphylococcus
ENGESQVY

SEQ ID NO: 1937859 - protein, 7 aa, Staphylococcus
ENGEYPM

SEQ ID NO: 1937860 - protein, 4 aa, Staphylococcus
ENGF

SEQ ID NO: 1937861 - protein, 7 aa, Staphylococcus
ENGGITT

SEQ ID NO: 1937862 - protein, 9 aa, Staphylococcus
ENGGKALEQ

SEQ ID NO: 1937863 - protein, 21 aa, Staphylococcus
ENGGTSISSYRHADGKTGQMQ

SEQ ID NO: 1937864 - protein, 9 aa, Staphylococcus
ENGGVSEYE

SEQ ID NO: 1937865 - protein, 9 aa, Staphylococcus
ENGGVTEYE

SEQ ID NO: 1937866 - protein, 4 aa, Staphylococcus
ENGK

SEQ ID NO: 1937867 - protein, 9 aa, Staphylococcus
ENGKASQYI

SEQ ID NO: 1937868 - protein, 5 aa, Staphylococcus
ENGKD

SEQ ID NO: 1937869 - protein, 10 aa, Staphylococcus
ENGKEYEGEL

SEQ ID NO: 1937870 - protein, 7 aa, Staphylococcus
ENGKMEG

SEQ ID NO: 1937871 - protein, 10 aa, Staphylococcus
ENGKPQEVPQ

SEQ ID NO: 1937872 - protein, 16 aa, Staphylococcus
ENGKPTDVPGVYPETD

SEQ ID NO: 1937873 - protein, 9 aa, Staphylococcus
ENGKPTRIP

SEQ ID NO: 1937874 - protein, 5 aa, Staphylococcus
ENGKQ

SEQ ID NO: 1937875 - protein, 5 aa, Staphylococcus
ENGLE

SEQ ID NO: 1937876 - protein, 7 aa, Staphylococcus
ENGLKGT

SEQ ID NO: 1937877 - protein, 16 aa, Staphylococcus
ENGNNPNQKLVWQRVN

SEQ ID NO: 1937878 - protein, 5 aa, Staphylococcus
ENGNV

SEQ ID NO: 1937879 - protein, 7 aa, Staphylococcus
ENGNVDE

SEQ ID NO: 1937880 - protein, 6 aa, Staphylococcus
ENGNVN

SEQ ID NO: 1937881 - protein, 15 aa, Staphylococcus
ENGNVTKVDTTSLKN

SEQ ID NO: 1937882 - protein, 10 aa, Staphylococcus
ENGPHKGKTL

SEQ ID NO: 1937883 - protein, 17 aa, Staphylococcus
ENGQASKAISDLITKNN

SEQ ID NO: 1937884 - protein, 6 aa, Staphylococcus
ENGQRA

SEQ ID NO: 1937885 - protein, 6 aa, Staphylococcus
ENGQVE

SEQ ID NO: 1937886 - protein, 11 aa, Staphylococcus
ENGQVKEEGLK

SEQ ID NO: 1937887 - protein, 12 aa, Staphylococcus
ENGQVKEEGLKQ

SEQ ID NO: 1937888 - protein, 4 aa, Staphylococcus
ENGR

SEQ ID NO: 1937889 - protein, 5 aa, Staphylococcus
ENGRA

SEQ ID NO: 1937890 - protein, 11 aa, Staphylococcus
ENGRASTYHTD

SEQ ID NO: 1937891 - protein, 13 aa, Staphylococcus
ENGRKEIYKRTYK

SEQ ID NO: 1937892 - protein, 4 aa, Staphylococcus
ENGS

SEQ ID NO: 1937893 - protein, 6 aa, Staphylococcus
ENGSFT

SEQ ID NO: 1937894 - protein, 6 aa, Staphylococcus
ENGSHA

SEQ ID NO: 1937895 - protein, 5 aa, Staphylococcus
ENGSI

SEQ ID NO: 1937896 - protein, 7 aa, Staphylococcus
ENGSISN

SEQ ID NO: 1937897 - protein, 8 aa, Staphylococcus
ENGSSENE

SEQ ID NO: 1937898 - protein, 7 aa, Staphylococcus
ENGTAKE

SEQ ID NO: 1937899 - protein, 5 aa, Staphylococcus
ENGTI

SEQ ID NO: 1937900 - protein, 8 aa, Staphylococcus
ENGTLAAT

SEQ ID NO: 1937901 - protein, 8 aa, Staphylococcus
ENGTPANQ

SEQ ID NO: 1937902 - protein, 7 aa, Staphylococcus
ENGTPVQ

SEQ ID NO: 1937903 - protein, 18 aa, Staphylococcus
ENGTVTGGNASSINDGSS

SEQ ID NO: 1937904 - protein, 4 aa, Staphylococcus
ENGY

SEQ ID NO: 1937905 - protein, 9 aa, Staphylococcus
ENGYEGTTL

SEQ ID NO: 1937906 - protein, 11 aa, Staphylococcus
ENGYETSQSMQ

SEQ ID NO: 1937907 - protein, 11 aa, Staphylococcus
ENGYGKRTPVA

SEQ ID NO: 1937908 - protein, 12 aa, Staphylococcus
ENGYGKRTPVGE

SEQ ID NO: 1937909 - protein, 12 aa, Staphylococcus
ENGYGKRTPVSE

SEQ ID NO: 1937910 - protein, 7 aa, Staphylococcus
ENGYRSI

SEQ ID NO: 1937911 - protein, 31 aa, Staphylococcus
ENHADEAEIEIDDESIETTEIDAAEESKNTE

SEQ ID NO: 1937912 - protein, 5 aa, Staphylococcus
ENHAE

SEQ ID NO: 1937913 - protein, 11 aa, Staphylococcus
ENHDKYTRNRQ

SEQ ID NO: 1937914 - protein, 6 aa, Staphylococcus
ENHEET

SEQ ID NO: 1937915 - protein, 5 aa, Staphylococcus
ENHKI

SEQ ID NO: 1937916 - protein, 13 aa, Staphylococcus
ENHLSSDEHETRK

SEQ ID NO: 1937917 - protein, 4 aa, Staphylococcus
ENHM

SEQ ID NO: 1937918 - protein, 16 aa, Staphylococcus
ENHNGQQPIYQYLFAV

SEQ ID NO: 1937919 - protein, 6 aa, Staphylococcus
ENHPAD

SEQ ID NO: 1937920 - protein, 12 aa, Staphylococcus
ENHQANRQINTA

SEQ ID NO: 1937921 - protein, 7 aa, Staphylococcus
ENHQSFS

SEQ ID NO: 1937922 - protein, 7 aa, Staphylococcus
ENHSEGL

SEQ ID NO: 1937923 - protein, 13 aa, Staphylococcus
ENHSENLKQKRAH

SEQ ID NO: 1937924 - protein, 6 aa, Staphylococcus
ENHSLN

SEQ ID NO: 1937925 - protein, 7 aa, Staphylococcus
ENHTDEA

SEQ ID NO: 1937926 - protein, 15 aa, Staphylococcus
ENHTSENGLKMAILK

SEQ ID NO: 1937927 - protein, 5 aa, Staphylococcus
ENIAE

SEQ ID NO: 1937928 - protein, 11 aa, Staphylococcus
ENIAPEESADI

SEQ ID NO: 1937929 - protein, 6 aa, Staphylococcus
ENIAPQ

SEQ ID NO: 1937930 - protein, 11 aa, Staphylococcus
ENIAPTNSADI

SEQ ID NO: 1937931 - protein, 4 aa, Staphylococcus
ENID

SEQ ID NO: 1937932 - protein, 6 aa, Staphylococcus
ENIDEK

SEQ ID NO: 1937933 - protein, 6 aa, Staphylococcus
ENIDEN

SEQ ID NO: 1937934 - protein, 6 aa, Staphylococcus
ENIDEQ

SEQ ID NO: 1937935 - protein, 9 aa, Staphylococcus
ENIDPKRYE

SEQ ID NO: 1937936 - protein, 7 aa, Staphylococcus
ENIDTQS

SEQ ID NO: 1937937 - protein, 10 aa, Staphylococcus
ENIENHPIDN

SEQ ID NO: 1937938 - protein, 32 aa, Staphylococcus
ENIEREKTTDFGKAQHVSAEDGKEKVKPQPIV

SEQ ID NO: 1937939 - protein, 14 aa, Staphylococcus
ENIEREKTTDFGTA

SEQ ID NO: 1937940 - protein, 18 aa, Staphylococcus
ENIESEGFDKTSIDLPDN

SEQ ID NO: 1937941 - protein, 6 aa, Staphylococcus
ENIGEA

SEQ ID NO: 1937942 - protein, 6 aa, Staphylococcus
ENIGEK

SEQ ID NO: 1937943 - protein, 6 aa, Staphylococcus
ENIGEN

SEQ ID NO: 1937944 - protein, 6 aa, Staphylococcus
ENIGEQ

SEQ ID NO: 1937945 - protein, 6 aa, Staphylococcus
ENIGKP

SEQ ID NO: 1937946 - protein, 10 aa, Staphylococcus
ENIGTREADG

SEQ ID NO: 1937947 - protein, 21 aa, Staphylococcus
ENIKTNANVKPKADKTNPNHI

SEQ ID NO: 1937948 - protein, 8 aa, Staphylococcus
ENINSKGN

SEQ ID NO: 1937949 - protein, 5 aa, Staphylococcus
ENIPG

SEQ ID NO: 1937950 - protein, 8 aa, Staphylococcus
ENIPGRKQ

SEQ ID NO: 1937951 - protein, 7 aa, Staphylococcus
ENIPKDN

SEQ ID NO: 1937952 - protein, 25 aa, Staphylococcus
ENIQRADNKLEKNHVNNDNHSNYFN

SEQ ID NO: 1937953 - protein, 7 aa, Staphylococcus
ENITESI

SEQ ID NO: 1937954 - protein, 11 aa, Staphylococcus
ENITKSKNEDL

SEQ ID NO: 1937955 - protein, 18 aa, Staphylococcus
ENITPELSKQIPTKVTIV

SEQ ID NO: 1937956 - protein, 12 aa, Staphylococcus
ENKAKDNQREGI

SEQ ID NO: 1937957 - protein, 7 aa, Staphylococcus
ENKAPRV

SEQ ID NO: 1937958 - protein, 11 aa, Staphylococcus
ENKDAEGNQHL

SEQ ID NO: 1937959 - protein, 8 aa, Staphylococcus
ENKDASGY

SEQ ID NO: 1937960 - protein, 8 aa, Staphylococcus
ENKDDAGA

SEQ ID NO: 1937961 - protein, 5 aa, Staphylococcus
ENKDN

SEQ ID NO: 1937962 - protein, 5 aa, Staphylococcus
ENKDS

SEQ ID NO: 1937963 - protein, 7 aa, Staphylococcus
ENKDSNI

SEQ ID NO: 1937964 - protein, 11 aa, Staphylococcus
ENKDVEGQQHL

SEQ ID NO: 1937965 - protein, 13 aa, Staphylococcus
ENKEAQKIFDVEK

SEQ ID NO: 1937966 - protein, 10 aa, Staphylococcus
ENKEHGKELP

SEQ ID NO: 1937967 - protein, 5 aa, Staphylococcus
ENKEN

SEQ ID NO: 1937968 - protein, 8 aa, Staphylococcus
ENKEPIHD

SEQ ID NO: 1937969 - protein, 8 aa, Staphylococcus
ENKEPIHE

SEQ ID NO: 1937970 - protein, 6 aa, Staphylococcus
ENKEQI

SEQ ID NO: 1937971 - protein, 10 aa, Staphylococcus
ENKESINTQI

SEQ ID NO: 1937972 - protein, 8 aa, Staphylococcus
ENKGKSLG

SEQ ID NO: 1937973 - protein, 14 aa, Staphylococcus
ENKGKVSLTMIDPN

SEQ ID NO: 1937974 - protein, 8 aa, Staphylococcus
ENKKEGYY

SEQ ID NO: 1937975 - protein, 7 aa, Staphylococcus
ENKKNKY

SEQ ID NO: 1937976 - protein, 19 aa, Staphylococcus
ENKKSEVYTTLEGLKLTIN

SEQ ID NO: 1937977 - protein, 5 aa, Staphylococcus
ENKKY

SEQ ID NO: 1937978 - protein, 6 aa, Staphylococcus
ENKLPL

SEQ ID NO: 1937979 - protein, 8 aa, Staphylococcus
ENKNAETL

SEQ ID NO: 1937980 - protein, 13 aa, Staphylococcus
ENKNEAGRRISRE

SEQ ID NO: 1937981 - protein, 9 aa, Staphylococcus
ENKNEDSLE

SEQ ID NO: 1937982 - protein, 9 aa, Staphylococcus
ENKNGYLTE

SEQ ID NO: 1937983 - protein, 8 aa, Staphylococcus
ENKNNKKL

SEQ ID NO: 1937984 - protein, 8 aa, Staphylococcus
ENKPEESI

SEQ ID NO: 1937985 - protein, 10 aa, Staphylococcus
ENKPSVIKPN

SEQ ID NO: 1937986 - protein, 8 aa, Staphylococcus
ENKPTTKK

SEQ ID NO: 1937987 - protein, 4 aa, Staphylococcus
ENKQ

SEQ ID NO: 1937988 - protein, 8 aa, Staphylococcus
ENKQPEKI

SEQ ID NO: 1937989 - protein, 6 aa, Staphylococcus
ENKRED

SEQ ID NO: 1937990 - protein, 7 aa, Staphylococcus
ENKRKDI

SEQ ID NO: 1937991 - protein, 6 aa, Staphylococcus
ENKSIP

SEQ ID NO: 1937992 - protein, 6 aa, Staphylococcus
ENKTES

SEQ ID NO: 1937993 - protein, 10 aa, Staphylococcus
ENKTPRSDFK

SEQ ID NO: 1937994 - protein, 9 aa, Staphylococcus
ENKTYDMTR

SEQ ID NO: 1937995 - protein, 4 aa, Staphylococcus
ENKV

SEQ ID NO: 1937996 - protein, 8 aa, Staphylococcus
ENKYHPES

SEQ ID NO: 1937997 - protein, 6 aa, Staphylococcus
ENKYPS

SEQ ID NO: 1937998 - protein, 10 aa, Staphylococcus
ENKYTTDEVK

SEQ ID NO: 1937999 - protein, 12 aa, Staphylococcus
ENLDEEAREDAL

SEQ ID NO: 1938000 - protein, 6 aa, Staphylococcus
ENLEEC

SEQ ID NO: 1938001 - protein, 6 aa, Staphylococcus
ENLEQR

SEQ ID NO: 1938002 - protein, 5 aa, Staphylococcus
ENLER

SEQ ID NO: 1938003 - protein, 11 aa, Staphylococcus
ENLGQVASQTL

SEQ ID NO: 1938004 - protein, 7 aa, Staphylococcus
ENLGRIN

SEQ ID NO: 1938005 - protein, 5 aa, Staphylococcus
ENLGT

SEQ ID NO: 1938006 - protein, 6 aa, Staphylococcus
ENLKGS

SEQ ID NO: 1938007 - protein, 10 aa, Staphylococcus
ENLKNQSNDK

SEQ ID NO: 1938008 - protein, 5 aa, Staphylococcus
ENLKS

SEQ ID NO: 1938009 - protein, 6 aa, Staphylococcus
ENLKSE

SEQ ID NO: 1938010 - protein, 7 aa, Staphylococcus
ENLKSGE

SEQ ID NO: 1938011 - protein, 8 aa, Staphylococcus
ENLKSGEY

SEQ ID NO: 1938012 - protein, 4 aa, Staphylococcus
ENLN

SEQ ID NO: 1938013 - protein, 8 aa, Staphylococcus
ENLNDTQL

SEQ ID NO: 1938014 - protein, 11 aa, Staphylococcus
ENLPANKRKVN

SEQ ID NO: 1938015 - protein, 12 aa, Staphylococcus
ENLQNEGYDVSE

SEQ ID NO: 1938016 - protein, 13 aa, Staphylococcus
ENLRDKTNQPKIE

SEQ ID NO: 1938017 - protein, 5 aa, Staphylococcus
ENLSD

SEQ ID NO: 1938018 - protein, 6 aa, Staphylococcus
ENLSDS

SEQ ID NO: 1938019 - protein, 5 aa, Staphylococcus
ENLSP

SEQ ID NO: 1938020 - protein, 8 aa, Staphylococcus
ENLVNRDD

SEQ ID NO: 1938021 - protein, 13 aa, Staphylococcus
ENLYTSQPSISRD

SEQ ID NO: 1938022 - protein, 5 aa, Staphylococcus
ENMDG

SEQ ID NO: 1938023 - protein, 6 aa, Staphylococcus
ENMDGL

SEQ ID NO: 1938024 - protein, 12 aa, Staphylococcus
ENMKQNSAGVDV

SEQ ID NO: 1938025 - protein, 5 aa, Staphylococcus
ENMQS

SEQ ID NO: 1938026 - protein, 7 aa, Staphylococcus
ENMSKYA

SEQ ID NO: 1938027 - protein, 4 aa, Staphylococcus
ENND

SEQ ID NO: 1938028 - protein, 9 aa, Staphylococcus
ENNDECKAS

SEQ ID NO: 1938029 - protein, 8 aa, Staphylococcus
ENNDEDSI

SEQ ID NO: 1938030 - protein, 10 aa, Staphylococcus
ENNDEINAQQ

SEQ ID NO: 1938031 - protein, 10 aa, Staphylococcus
ENNDIESRFP

SEQ ID NO: 1938032 - protein, 12 aa, Staphylococcus
ENNDKEKITKSG

SEQ ID NO: 1938033 - protein, 10 aa, Staphylococcus
ENNDVKSYDV

SEQ ID NO: 1938034 - protein, 14 aa, Staphylococcus
ENNDVRRLISADID

SEQ ID NO: 1938035 - protein, 4 aa, Staphylococcus
ENNE

SEQ ID NO: 1938036 - protein, 7 aa, Staphylococcus
ENNEARD

SEQ ID NO: 1938037 - protein, 8 aa, Staphylococcus
ENNEGEYV

SEQ ID NO: 1938038 - protein, 8 aa, Staphylococcus
ENNEGQYV

SEQ ID NO: 1938039 - protein, 7 aa, Staphylococcus
ENNEITA

SEQ ID NO: 1938040 - protein, 13 aa, Staphylococcus
ENNELKSRIATQY

SEQ ID NO: 1938041 - protein, 8 aa, Staphylococcus
ENNEREKL

SEQ ID NO: 1938042 - protein, 5 aa, Staphylococcus
ENNGD

SEQ ID NO: 1938043 - protein, 16 aa, Staphylococcus
ENNGEHGAKEAGKMRL

SEQ ID NO: 1938044 - protein, 7 aa, Staphylococcus
ENNGGRA

SEQ ID NO: 1938045 - protein, 9 aa, Staphylococcus
ENNGQGHRD

SEQ ID NO: 1938046 - protein, 6 aa, Staphylococcus
ENNIRH

SEQ ID NO: 1938047 - protein, 16 aa, Staphylococcus
ENNITTEVSEKGTGMQ

SEQ ID NO: 1938048 - protein, 5 aa, Staphylococcus
ENNKA

SEQ ID NO: 1938049 - protein, 23 aa, Staphylococcus
ENNKETSFDTPQTANEMSSGKRY

SEQ ID NO: 1938050 - protein, 7 aa, Staphylococcus
ENNKKTY

SEQ ID NO: 1938051 - protein, 18 aa, Staphylococcus
ENNKMVPKRSEIKANISD

SEQ ID NO: 1938052 - protein, 9 aa, Staphylococcus
ENNKPDVQQ

SEQ ID NO: 1938053 - protein, 6 aa, Staphylococcus
ENNKTI

SEQ ID NO: 1938054 - protein, 7 aa, Staphylococcus
ENNKYDP

SEQ ID NO: 1938055 - protein, 8 aa, Staphylococcus
ENNKYDPS

SEQ ID NO: 1938056 - protein, 8 aa, Staphylococcus
ENNKYDPT

SEQ ID NO: 1938057 - protein, 10 aa, Staphylococcus
ENNKYSRSGL

SEQ ID NO: 1938058 - protein, 6 aa, Staphylococcus
ENNLNN

SEQ ID NO: 1938059 - protein, 8 aa, Staphylococcus
ENNLPSRK

SEQ ID NO: 1938060 - protein, 5 aa, Staphylococcus
ENNNE

SEQ ID NO: 1938061 - protein, 7 aa, Staphylococcus
ENNNQTK

SEQ ID NO: 1938062 - protein, 5 aa, Staphylococcus
ENNPE

SEQ ID NO: 1938063 - protein, 7 aa, Staphylococcus
ENNPEGK

SEQ ID NO: 1938064 - protein, 10 aa, Staphylococcus
ENNPKETSVG

SEQ ID NO: 1938065 - protein, 8 aa, Staphylococcus
ENNPKYLE

SEQ ID NO: 1938066 - protein, 4 aa, Staphylococcus
ENNQ

SEQ ID NO: 1938067 - protein, 8 aa, Staphylococcus
ENNQEPWT

SEQ ID NO: 1938068 - protein, 6 aa, Staphylococcus
ENNQFE

SEQ ID NO: 1938069 - protein, 12 aa, Staphylococcus
ENNQGQLNDEEA

SEQ ID NO: 1938070 - protein, 8 aa, Staphylococcus
ENNQPEEW

SEQ ID NO: 1938071 - protein, 5 aa, Staphylococcus
ENNRD

SEQ ID NO: 1938072 - protein, 8 aa, Staphylococcus
ENNRDNDL

SEQ ID NO: 1938073 - protein, 13 aa, Staphylococcus
ENNRTPIKGETIR

SEQ ID NO: 1938074 - protein, 7 aa, Staphylococcus
ENNSDSI

SEQ ID NO: 1938075 - protein, 6 aa, Staphylococcus
ENNSKK

SEQ ID NO: 1938076 - protein, 7 aa, Staphylococcus
ENNSPLS

SEQ ID NO: 1938077 - protein, 8 aa, Staphylococcus
ENNSVDNY

SEQ ID NO: 1938078 - protein, 8 aa, Staphylococcus
ENNTSTQV

SEQ ID NO: 1938079 - protein, 7 aa, Staphylococcus
ENNTTIQ

SEQ ID NO: 1938080 - protein, 6 aa, Staphylococcus
ENNVKN

SEQ ID NO: 1938081 - protein, 8 aa, Staphylococcus
ENNVKNGG

SEQ ID NO: 1938082 - protein, 9 aa, Staphylococcus
ENNVNANQI

SEQ ID NO: 1938083 - protein, 5 aa, Staphylococcus
ENNVP

SEQ ID NO: 1938084 - protein, 8 aa, Staphylococcus
ENNVQNGG

SEQ ID NO: 1938085 - protein, 15 aa, Staphylococcus
ENNYKDVAKKGVFYF

SEQ ID NO: 1938086 - protein, 8 aa, Staphylococcus
ENPDDEKP

SEQ ID NO: 1938087 - protein, 16 aa, Staphylococcus
ENPDDFKGQDADPNDV

SEQ ID NO: 1938088 - protein, 8 aa, Staphylococcus
ENPDFGEP

SEQ ID NO: 1938089 - protein, 9 aa, Staphylococcus
ENPDIDPEE

SEQ ID NO: 1938090 - protein, 13 aa, Staphylococcus
ENPDLSKEAISRP

SEQ ID NO: 1938091 - protein, 4 aa, Staphylococcus
ENPE

SEQ ID NO: 1938092 - protein, 5 aa, Staphylococcus
ENPED

SEQ ID NO: 1938093 - protein, 21 aa, Staphylococcus
ENPELDNEASSQFKDDMENSV

SEQ ID NO: 1938094 - protein, 10 aa, Staphylococcus
ENPELNATDM

SEQ ID NO: 1938095 - protein, 8 aa, Staphylococcus
ENPESFKK

SEQ ID NO: 1938096 - protein, 8 aa, Staphylococcus
ENPETSHT

SEQ ID NO: 1938097 - protein, 9 aa, Staphylococcus
ENPEYKGMG

SEQ ID NO: 1938098 - protein, 8 aa, Staphylococcus
ENPKKPDV

SEQ ID NO: 1938099 - protein, 16 aa, Staphylococcus
ENPKNERTKQFLQRVL

SEQ ID NO: 1938100 - protein, 6 aa, Staphylococcus
ENPNKE

SEQ ID NO: 1938101 - protein, 9 aa, Staphylococcus
ENPNMDADK

SEQ ID NO: 1938102 - protein, 6 aa, Staphylococcus
ENPQHE

SEQ ID NO: 1938103 - protein, 6 aa, Staphylococcus
ENPQHQ

SEQ ID NO: 1938104 - protein, 5 aa, Staphylococcus
ENPQN

SEQ ID NO: 1938105 - protein, 5 aa, Staphylococcus
ENPQT

SEQ ID NO: 1938106 - protein, 16 aa, Staphylococcus
ENPQTKGSIINLLNEL

SEQ ID NO: 1938107 - protein, 9 aa, Staphylococcus
ENPSQLEQQ

SEQ ID NO: 1938108 - protein, 5 aa, Staphylococcus
ENPSR

SEQ ID NO: 1938109 - protein, 9 aa, Staphylococcus
ENPSSIKDA

SEQ ID NO: 1938110 - protein, 5 aa, Staphylococcus
ENPTA

SEQ ID NO: 1938111 - protein, 6 aa, Staphylococcus
ENPTKV

SEQ ID NO: 1938112 - protein, 12 aa, Staphylococcus
ENPVESNETYDE

SEQ ID NO: 1938113 - protein, 9 aa, Staphylococcus
ENPVTEPDF

SEQ ID NO: 1938114 - protein, 4 aa, Staphylococcus
ENQA

SEQ ID NO: 1938115 - protein, 5 aa, Staphylococcus
ENQAA

SEQ ID NO: 1938116 - protein, 14 aa, Staphylococcus
ENQDGEVVTNETLK

SEQ ID NO: 1938117 - protein, 5 aa, Staphylococcus
ENQDT

SEQ ID NO: 1938118 - protein, 5 aa, Staphylococcus
ENQDV

SEQ ID NO: 1938119 - protein, 4 aa, Staphylococcus
ENQE

SEQ ID NO: 1938120 - protein, 5 aa, Staphylococcus
ENQEQ

SEQ ID NO: 1938121 - protein, 4 aa, Staphylococcus
ENQG

SEQ ID NO: 1938122 - protein, 11 aa, Staphylococcus
ENQGAAASRNV

SEQ ID NO: 1938123 - protein, 9 aa, Staphylococcus
ENQGGDASV

SEQ ID NO: 1938124 - protein, 8 aa, Staphylococcus
ENQGGDVS

SEQ ID NO: 1938125 - protein, 8 aa, Staphylococcus
ENQGHAHA

SEQ ID NO: 1938126 - protein, 12 aa, Staphylococcus
ENQGMIGKLVIK

SEQ ID NO: 1938127 - protein, 4 aa, Staphylococcus
ENQH

SEQ ID NO: 1938128 - protein, 4 aa, Staphylococcus
ENQI

SEQ ID NO: 1938129 - protein, 7 aa, Staphylococcus
ENQIPSS

SEQ ID NO: 1938130 - protein, 8 aa, Staphylococcus
ENQITSQT

SEQ ID NO: 1938131 - protein, 19 aa, Staphylococcus
ENQKQLNSTEKQQNNKRTM

SEQ ID NO: 1938132 - protein, 19 aa, Staphylococcus
ENQLEKSLKEAKSEGQKYF

SEQ ID NO: 1938133 - protein, 5 aa, Staphylococcus
ENQLN

SEQ ID NO: 1938134 - protein, 7 aa, Staphylococcus
ENQNGEW

SEQ ID NO: 1938135 - protein, 9 aa, Staphylococcus
ENQNGKRDD

SEQ ID NO: 1938136 - protein, 6 aa, Staphylococcus
ENQNGL

SEQ ID NO: 1938137 - protein, 5 aa, Staphylococcus
ENQPL

SEQ ID NO: 1938138 - protein, 6 aa, Staphylococcus
ENQPNV

SEQ ID NO: 1938139 - protein, 6 aa, Staphylococcus
ENQPPD

SEQ ID NO: 1938140 - protein, 7 aa, Staphylococcus
ENQQFEN

SEQ ID NO: 1938141 - protein, 7 aa, Staphylococcus
ENQQTAE

SEQ ID NO: 1938142 - protein, 8 aa, Staphylococcus
ENQSPTSI

SEQ ID NO: 1938143 - protein, 5 aa, Staphylococcus
ENQSY

SEQ ID NO: 1938144 - protein, 7 aa, Staphylococcus
ENQTADE

SEQ ID NO: 1938145 - protein, 7 aa, Staphylococcus
ENQTDEA

SEQ ID NO: 1938146 - protein, 12 aa, Staphylococcus
ENRDAKGQQHLP

SEQ ID NO: 1938147 - protein, 25 aa, Staphylococcus
ENRDTAKRQEKIKKKDDNLEKDRQQ

SEQ ID NO: 1938148 - protein, 9 aa, Staphylococcus
ENREEDDRY

SEQ ID NO: 1938149 - protein, 9 aa, Staphylococcus
ENREQGRRF

SEQ ID NO: 1938150 - protein, 7 aa, Staphylococcus
ENREREW

SEQ ID NO: 1938151 - protein, 9 aa, Staphylococcus
ENRGNNNVR

SEQ ID NO: 1938152 - protein, 7 aa, Staphylococcus
ENRHKRI

SEQ ID NO: 1938153 - protein, 9 aa, Staphylococcus
ENRHSSVES

SEQ ID NO: 1938154 - protein, 7 aa, Staphylococcus
ENRISKE

SEQ ID NO: 1938155 - protein, 7 aa, Staphylococcus
ENRKEEG

SEQ ID NO: 1938156 - protein, 8 aa, Staphylococcus
ENRKEEGL

SEQ ID NO: 1938157 - protein, 17 aa, Staphylococcus
ENRKKRIQSLSKGNQQK

SEQ ID NO: 1938158 - protein, 11 aa, Staphylococcus
ENRKPANTKQL

SEQ ID NO: 1938159 - protein, 15 aa, Staphylococcus
ENRNDETPESLNEKL

SEQ ID NO: 1938160 - protein, 8 aa, Staphylococcus
ENRNGKVG

SEQ ID NO: 1938161 - protein, 16 aa, Staphylococcus
ENRNNKLASVDKENVL

SEQ ID NO: 1938162 - protein, 12 aa, Staphylococcus
ENRNTLSQREIN

SEQ ID NO: 1938163 - protein, 16 aa, Staphylococcus
ENRNYTKESKERLART

SEQ ID NO: 1938164 - protein, 13 aa, Staphylococcus
ENRNYTKESTERL

SEQ ID NO: 1938165 - protein, 13 aa, Staphylococcus
ENRPQKPSRPRRG

SEQ ID NO: 1938166 - protein, 7 aa, Staphylococcus
ENSDEEL

SEQ ID NO: 1938167 - protein, 6 aa, Staphylococcus
ENSDET

SEQ ID NO: 1938168 - protein, 10 aa, Staphylococcus
ENSDGEYSDR

SEQ ID NO: 1938169 - protein, 7 aa, Staphylococcus
ENSEDHS

SEQ ID NO: 1938170 - protein, 5 aa, Staphylococcus
ENSEE

SEQ ID NO: 1938171 - protein, 10 aa, Staphylococcus
ENSHSTISTD

SEQ ID NO: 1938172 - protein, 6 aa, Staphylococcus
ENSIGN

SEQ ID NO: 1938173 - protein, 8 aa, Staphylococcus
ENSITAQS

SEQ ID NO: 1938174 - protein, 7 aa, Staphylococcus
ENSKDNH

SEQ ID NO: 1938175 - protein, 7 aa, Staphylococcus
ENSKNDG

SEQ ID NO: 1938176 - protein, 4 aa, Staphylococcus
ENSN

SEQ ID NO: 1938177 - protein, 13 aa, Staphylococcus
ENSNAISKSLSKQ

SEQ ID NO: 1938178 - protein, 31 aa, Staphylococcus
ENSNDTAYDLSDNKERRDAQHVEENGEEVEL

SEQ ID NO: 1938179 - protein, 10 aa, Staphylococcus
ENSNEIPENE

SEQ ID NO: 1938180 - protein, 10 aa, Staphylococcus
ENSNPMPPQT

SEQ ID NO: 1938181 - protein, 8 aa, Staphylococcus
ENSPASQV

SEQ ID NO: 1938182 - protein, 9 aa, Staphylococcus
ENSRPELSK

SEQ ID NO: 1938183 - protein, 21 aa, Staphylococcus
ENSRVDRQLRGRSGRQGDPGV

SEQ ID NO: 1938184 - protein, 22 aa, Staphylococcus
ENSRVDRQLRGRSGRQGDPGVS

SEQ ID NO: 1938185 - protein, 22 aa, Staphylococcus
ENSRVDRQLRGRSGRQGDPGYS

SEQ ID NO: 1938186 - protein, 4 aa, Staphylococcus
ENSS

SEQ ID NO: 1938187 - protein, 9 aa, Staphylococcus
ENSSGYSSY

SEQ ID NO: 1938188 - protein, 9 aa, Staphylococcus
ENSTKKSQE

SEQ ID NO: 1938189 - protein, 13 aa, Staphylococcus
ENTDLTQKQISRP

SEQ ID NO: 1938190 - protein, 7 aa, Staphylococcus
ENTDVTI

SEQ ID NO: 1938191 - protein, 4 aa, Staphylococcus
ENTE

SEQ ID NO: 1938192 - protein, 5 aa, Staphylococcus
ENTEE

SEQ ID NO: 1938193 - protein, 7 aa, Staphylococcus
ENTEEDL

SEQ ID NO: 1938194 - protein, 9 aa, Staphylococcus
ENTEKNKKN

SEQ ID NO: 1938195 - protein, 8 aa, Staphylococcus
ENTESKRI

SEQ ID NO: 1938196 - protein, 5 aa, Staphylococcus
ENTET

SEQ ID NO: 1938197 - protein, 10 aa, Staphylococcus
ENTETEQERI

SEQ ID NO: 1938198 - protein, 7 aa, Staphylococcus
ENTFKGS

SEQ ID NO: 1938199 - protein, 9 aa, Staphylococcus
ENTFNGQHT

SEQ ID NO: 1938200 - protein, 9 aa, Staphylococcus
ENTFTGKHT

SEQ ID NO: 1938201 - protein, 9 aa, Staphylococcus
ENTFTGTHT

SEQ ID NO: 1938202 - protein, 8 aa, Staphylococcus
ENTGHAHA

SEQ ID NO: 1938203 - protein, 10 aa, Staphylococcus
ENTGLSDDEL

SEQ ID NO: 1938204 - protein, 17 aa, Staphylococcus
ENTGSEDNVGKNNVPEV

SEQ ID NO: 1938205 - protein, 7 aa, Staphylococcus
ENTIENE

SEQ ID NO: 1938206 - protein, 7 aa, Staphylococcus
ENTIGEH

SEQ ID NO: 1938207 - protein, 5 aa, Staphylococcus
ENTIR

SEQ ID NO: 1938208 - protein, 21 aa, Staphylococcus
ENTISKKGKVAQSIEEKSKSI

SEQ ID NO: 1938209 - protein, 5 aa, Staphylococcus
ENTKE

SEQ ID NO: 1938210 - protein, 6 aa, Staphylococcus
ENTLKA

SEQ ID NO: 1938211 - protein, 7 aa, Staphylococcus
ENTLKAS

SEQ ID NO: 1938212 - protein, 8 aa, Staphylococcus
ENTLTDER

SEQ ID NO: 1938213 - protein, 9 aa, Staphylococcus
ENTLTDERV

SEQ ID NO: 1938214 - protein, 6 aa, Staphylococcus
ENTNDT

SEQ ID NO: 1938215 - protein, 5 aa, Staphylococcus
ENTNG

SEQ ID NO: 1938216 - protein, 6 aa, Staphylococcus
ENTNQL

SEQ ID NO: 1938217 - protein, 6 aa, Staphylococcus
ENTPIR

SEQ ID NO: 1938218 - protein, 8 aa, Staphylococcus
ENTPSTKT

SEQ ID NO: 1938219 - protein, 8 aa, Staphylococcus
ENTRGGAD

SEQ ID NO: 1938220 - protein, 5 aa, Staphylococcus
ENTSI

SEQ ID NO: 1938221 - protein, 11 aa, Staphylococcus
ENTSPRTEFNN

SEQ ID NO: 1938222 - protein, 14 aa, Staphylococcus
ENTTFDETTINNTT

SEQ ID NO: 1938223 - protein, 8 aa, Staphylococcus
ENTTSKKV

SEQ ID NO: 1938224 - protein, 43 aa, Staphylococcus
ENTTSNSTSNQSQNNQSSQQTLQSQSQSESGVTYNQGSTIPVK

SEQ ID NO: 1938225 - protein, 7 aa, Staphylococcus
ENTTSTK

SEQ ID NO: 1938226 - protein, 8 aa, Staphylococcus
ENTTSTKV

SEQ ID NO: 1938227 - protein, 8 aa, Staphylococcus
ENTTSTQV

SEQ ID NO: 1938228 - protein, 5 aa, Staphylococcus
ENTTY

SEQ ID NO: 1938229 - protein, 4 aa, Staphylococcus
ENTY

SEQ ID NO: 1938230 - protein, 5 aa, Staphylococcus
ENTYS

SEQ ID NO: 1938231 - protein, 18 aa, Staphylococcus
ENTYYEESGAFTGETSPV

SEQ ID NO: 1938232 - protein, 11 aa, Staphylococcus
ENVANAYETSI

SEQ ID NO: 1938233 - protein, 10 aa, Staphylococcus
ENVAQAYEQS

SEQ ID NO: 1938234 - protein, 10 aa, Staphylococcus
ENVAQAYETS

SEQ ID NO: 1938235 - protein, 5 aa, Staphylococcus
ENVDE

SEQ ID NO: 1938236 - protein, 8 aa, Staphylococcus
ENVDQNPY

SEQ ID NO: 1938237 - protein, 6 aa, Staphylococcus
ENVEND

SEQ ID NO: 1938238 - protein, 5 aa, Staphylococcus
ENVGQ

SEQ ID NO: 1938239 - protein, 4 aa, Staphylococcus
ENVH

SEQ ID NO: 1938240 - protein, 6 aa, Staphylococcus
ENVHDI

SEQ ID NO: 1938241 - protein, 6 aa, Staphylococcus
ENVHDV

SEQ ID NO: 1938242 - protein, 4 aa, Staphylococcus
ENVK

SEQ ID NO: 1938243 - protein, 13 aa, Staphylococcus
ENVKESESNQSIG

SEQ ID NO: 1938244 - protein, 13 aa, Staphylococcus
ENVKKGKEDNRET

SEQ ID NO: 1938245 - protein, 11 aa, Staphylococcus
ENVKNEKDAAV

SEQ ID NO: 1938246 - protein, 6 aa, Staphylococcus
ENVKPH

SEQ ID NO: 1938247 - protein, 20 aa, Staphylococcus
ENVKPHDKVKVTAKKESGEV

SEQ ID NO: 1938248 - protein, 11 aa, Staphylococcus
ENVKTKDEITY

SEQ ID NO: 1938249 - protein, 21 aa, Staphylococcus
ENVKTNANVKPKADKTNPSHI

SEQ ID NO: 1938250 - protein, 22 aa, Staphylococcus
ENVKTNVNVKPKADKTNPSHIG

SEQ ID NO: 1938251 - protein, 12 aa, Staphylococcus
ENVLSDGADELS

SEQ ID NO: 1938252 - protein, 9 aa, Staphylococcus
ENVNIKKEN

SEQ ID NO: 1938253 - protein, 8 aa, Staphylococcus
ENVPKDSK

SEQ ID NO: 1938254 - protein, 10 aa, Staphylococcus
ENVQDGSKDI

SEQ ID NO: 1938255 - protein, 10 aa, Staphylococcus
ENVQEGSKDV

SEQ ID NO: 1938256 - protein, 8 aa, Staphylococcus
ENVQTGRS

SEQ ID NO: 1938257 - protein, 9 aa, Staphylococcus
ENVSDKTGV

SEQ ID NO: 1938258 - protein, 6 aa, Staphylococcus
ENVSGK

SEQ ID NO: 1938259 - protein, 12 aa, Staphylococcus
ENVSKNDKNGTT

SEQ ID NO: 1938260 - protein, 10 aa, Staphylococcus
ENVSNSDLER

SEQ ID NO: 1938261 - protein, 6 aa, Staphylococcus
ENVSYG

SEQ ID NO: 1938262 - protein, 5 aa, Staphylococcus
ENVTR

SEQ ID NO: 1938263 - protein, 12 aa, Staphylococcus
ENWGQKERDVER

SEQ ID NO: 1938264 - protein, 9 aa, Staphylococcus
ENWSRPENE

SEQ ID NO: 1938265 - protein, 9 aa, Staphylococcus
ENWSRPEQE

SEQ ID NO: 1938266 - protein, 9 aa, Staphylococcus
ENWTRPENE

SEQ ID NO: 1938267 - protein, 7 aa, Staphylococcus
ENYANQQ

SEQ ID NO: 1938268 - protein, 7 aa, Staphylococcus
ENYDKEE

SEQ ID NO: 1938269 - protein, 10 aa, Staphylococcus
ENYDPTDKQL

SEQ ID NO: 1938270 - protein, 9 aa, Staphylococcus
ENYDPTNKQ

SEQ ID NO: 1938271 - protein, 11 aa, Staphylococcus
ENYEESTAQLK

SEQ ID NO: 1938272 - protein, 12 aa, Staphylococcus
ENYEESTSQLKE

SEQ ID NO: 1938273 - protein, 13 aa, Staphylococcus
ENYEESTSQLREE

SEQ ID NO: 1938274 - protein, 12 aa, Staphylococcus
ENYEESTSQLRQ

SEQ ID NO: 1938275 - protein, 11 aa, Staphylococcus
ENYEQNTANLK

SEQ ID NO: 1938276 - protein, 13 aa, Staphylococcus
ENYEQSSSQLREE

SEQ ID NO: 1938277 - protein, 13 aa, Staphylococcus
ENYEQSTSQLREE

SEQ ID NO: 1938278 - protein, 8 aa, Staphylococcus
ENYESEMS

SEQ ID NO: 1938279 - protein, 6 aa, Staphylococcus
ENYIDD

SEQ ID NO: 1938280 - protein, 9 aa, Staphylococcus
ENYKDIKQD

SEQ ID NO: 1938281 - protein, 7 aa, Staphylococcus
ENYKGQK

SEQ ID NO: 1938282 - protein, 5 aa, Staphylococcus
ENYKN

SEQ ID NO: 1938283 - protein, 12 aa, Staphylococcus
ENYKNLSHTATN

SEQ ID NO: 1938284 - protein, 5 aa, Staphylococcus
ENYNE

SEQ ID NO: 1938285 - protein, 7 aa, Staphylococcus
ENYNETK

SEQ ID NO: 1938286 - protein, 17 aa, Staphylococcus
ENYQNAKKQIYKNQTAD

SEQ ID NO: 1938287 - protein, 18 aa, Staphylococcus
ENYQNAKKQIYKNQTEND

SEQ ID NO: 1938288 - protein, 9 aa, Staphylococcus
ENYQNAKRR

SEQ ID NO: 1938289 - protein, 6 aa, Staphylococcus
ENYQPT

SEQ ID NO: 1938290 - protein, 6 aa, Staphylococcus
ENYSPQ

SEQ ID NO: 1938291 - protein, 14 aa, Staphylococcus
ENYTPAGQQITQAV

SEQ ID NO: 1938292 - protein, 6 aa, Staphylococcus
ENYTSE

SEQ ID NO: 1938293 - protein, 8 aa, Staphylococcus
ENYVNNDS

SEQ ID NO: 1938294 - protein, 14 aa, Staphylococcus
EPAENENGSAKPRL

SEQ ID NO: 1938295 - protein, 8 aa, Staphylococcus
EPAGAASM

SEQ ID NO: 1938296 - protein, 8 aa, Staphylococcus
EPAGASSM

SEQ ID NO: 1938297 - protein, 5 aa, Staphylococcus
EPALR

SEQ ID NO: 1938298 - protein, 5 aa, Staphylococcus
EPAQG

SEQ ID NO: 1938299 - protein, 5 aa, Staphylococcus
EPATD

SEQ ID NO: 1938300 - protein, 8 aa, Staphylococcus
EPATNSPL

SEQ ID NO: 1938301 - protein, 8 aa, Staphylococcus
EPAVSASR

SEQ ID NO: 1938302 - protein, 8 aa, Staphylococcus
EPDAAGPF

SEQ ID NO: 1938303 - protein, 4 aa, Staphylococcus
EPDD

SEQ ID NO: 1938304 - protein, 18 aa, Staphylococcus
EPDDYQETKNALAQSRHQ

SEQ ID NO: 1938305 - protein, 9 aa, Staphylococcus
EPDEHQSNF

SEQ ID NO: 1938306 - protein, 10 aa, Staphylococcus
EPDEKHSLEA

SEQ ID NO: 1938307 - protein, 10 aa, Staphylococcus
EPDENGEGGK

SEQ ID NO: 1938308 - protein, 5 aa, Staphylococcus
EPDEV

SEQ ID NO: 1938309 - protein, 5 aa, Staphylococcus
EPDFS

SEQ ID NO: 1938310 - protein, 22 aa, Staphylococcus
EPDHGSDVAGGLETIAEKKGDK

SEQ ID NO: 1938311 - protein, 6 aa, Staphylococcus
EPDKAY

SEQ ID NO: 1938312 - protein, 21 aa, Staphylococcus
EPDKYKNRKPDELSGGQRQRV

SEQ ID NO: 1938313 - protein, 5 aa, Staphylococcus
EPDLK

SEQ ID NO: 1938314 - protein, 8 aa, Staphylococcus
EPDNPLKQ

SEQ ID NO: 1938315 - protein, 19 aa, Staphylococcus
EPEASPVLSGGEPGPHKLQ

SEQ ID NO: 1938316 - protein, 7 aa, Staphylococcus
EPEAYPK

SEQ ID NO: 1938317 - protein, 10 aa, Staphylococcus
EPEDGHDIDA

SEQ ID NO: 1938318 - protein, 7 aa, Staphylococcus
EPEDGIE

SEQ ID NO: 1938319 - protein, 8 aa, Staphylococcus
EPEDLAKS

SEQ ID NO: 1938320 - protein, 18 aa, Staphylococcus
EPEDSPVLSGGEPGPHKL

SEQ ID NO: 1938321 - protein, 19 aa, Staphylococcus
EPEDSPVLSGGEPGPHKLQ

SEQ ID NO: 1938322 - protein, 18 aa, Staphylococcus
EPEDYQQTKEALAQSRHQ

SEQ ID NO: 1938323 - protein, 5 aa, Staphylococcus
EPEEG

SEQ ID NO: 1938324 - protein, 11 aa, Staphylococcus
EPEEHQHSPYK

SEQ ID NO: 1938325 - protein, 5 aa, Staphylococcus
EPEEI

SEQ ID NO: 1938326 - protein, 5 aa, Staphylococcus
EPEGA

SEQ ID NO: 1938327 - protein, 25 aa, Staphylococcus
EPEGSILSGGNAHSHDIEGIGSEKW

SEQ ID NO: 1938328 - protein, 7 aa, Staphylococcus
EPEHAQS

SEQ ID NO: 1938329 - protein, 6 aa, Staphylococcus
EPEHEQ

SEQ ID NO: 1938330 - protein, 21 aa, Staphylococcus
EPEHGSDVAGGLETTAKRDGD

SEQ ID NO: 1938331 - protein, 8 aa, Staphylococcus
EPELAPSK

SEQ ID NO: 1938332 - protein, 5 aa, Staphylococcus
EPEQL

SEQ ID NO: 1938333 - protein, 5 aa, Staphylococcus
EPEQY

SEQ ID NO: 1938334 - protein, 6 aa, Staphylococcus
EPERIS

SEQ ID NO: 1938335 - protein, 13 aa, Staphylococcus
EPESDDSNMTDER

SEQ ID NO: 1938336 - protein, 14 aa, Staphylococcus
EPESFAKDLSSILD

SEQ ID NO: 1938337 - protein, 21 aa, Staphylococcus
EPETYKNRKPDELSGGQQQRV

SEQ ID NO: 1938338 - protein, 13 aa, Staphylococcus
EPEVPQELIDLQR

SEQ ID NO: 1938339 - protein, 12 aa, Staphylococcus
EPEVPSELLDEQ

SEQ ID NO: 1938340 - protein, 9 aa, Staphylococcus
EPEVTPEQR

SEQ ID NO: 1938341 - protein, 4 aa, Staphylococcus
EPFD

SEQ ID NO: 1938342 - protein, 5 aa, Staphylococcus
EPFDD

SEQ ID NO: 1938343 - protein, 6 aa, Staphylococcus
EPFDEE

SEQ ID NO: 1938344 - protein, 5 aa, Staphylococcus
EPFDK

SEQ ID NO: 1938345 - protein, 4 aa, Staphylococcus
EPFE

SEQ ID NO: 1938346 - protein, 5 aa, Staphylococcus
EPFEP

SEQ ID NO: 1938347 - protein, 4 aa, Staphylococcus
EPFH

SEQ ID NO: 1938348 - protein, 4 aa, Staphylococcus
EPFQ

SEQ ID NO: 1938349 - protein, 15 aa, Staphylococcus
EPFYSKTSYKISEKQ

SEQ ID NO: 1938350 - protein, 5 aa, Staphylococcus
EPGDK

SEQ ID NO: 1938351 - protein, 6 aa, Staphylococcus
EPGEAD

SEQ ID NO: 1938352 - protein, 5 aa, Staphylococcus
EPGFA

SEQ ID NO: 1938353 - protein, 16 aa, Staphylococcus
EPGLSPRALKENYGIK

SEQ ID NO: 1938354 - protein, 9 aa, Staphylococcus
EPGQKAEDI

SEQ ID NO: 1938355 - protein, 10 aa, Staphylococcus
EPGRQTPGVE

SEQ ID NO: 1938356 - protein, 7 aa, Staphylococcus
EPGRSIV

SEQ ID NO: 1938357 - protein, 4 aa, Staphylococcus
EPGS

SEQ ID NO: 1938358 - protein, 5 aa, Staphylococcus
EPGSE

SEQ ID NO: 1938359 - protein, 12 aa, Staphylococcus
EPHDNNASASVT

SEQ ID NO: 1938360 - protein, 9 aa, Staphylococcus
EPHNTDAYG

SEQ ID NO: 1938361 - protein, 13 aa, Staphylococcus
EPHSLSGGQKQRV

SEQ ID NO: 1938362 - protein, 18 aa, Staphylococcus
EPIDTTDIPKDLKRNEKV

SEQ ID NO: 1938363 - protein, 4 aa, Staphylococcus
EPIE

SEQ ID NO: 1938364 - protein, 5 aa, Staphylococcus
EPIGE

SEQ ID NO: 1938365 - protein, 5 aa, Staphylococcus
EPIGG

SEQ ID NO: 1938366 - protein, 5 aa, Staphylococcus
EPIKE

SEQ ID NO: 1938367 - protein, 8 aa, Staphylococcus
EPINKDKL

SEQ ID NO: 1938368 - protein, 9 aa, Staphylococcus
EPIQGNNTN

SEQ ID NO: 1938369 - protein, 6 aa, Staphylococcus
EPISTD

SEQ ID NO: 1938370 - protein, 13 aa, Staphylococcus
EPIVPNNTDLANY

SEQ ID NO: 1938371 - protein, 8 aa, Staphylococcus
EPKDGRKL

SEQ ID NO: 1938372 - protein, 9 aa, Staphylococcus
EPKDKTLLK

SEQ ID NO: 1938373 - protein, 8 aa, Staphylococcus
EPKDNATA

SEQ ID NO: 1938374 - protein, 10 aa, Staphylococcus
EPKETESPLS

SEQ ID NO: 1938375 - protein, 12 aa, Staphylococcus
EPKETHQSRSDY

SEQ ID NO: 1938376 - protein, 10 aa, Staphylococcus
EPKGDSKPDW

SEQ ID NO: 1938377 - protein, 5 aa, Staphylococcus
EPKGV

SEQ ID NO: 1938378 - protein, 5 aa, Staphylococcus
EPKHF

SEQ ID NO: 1938379 - protein, 9 aa, Staphylococcus
EPKKEDLET

SEQ ID NO: 1938380 - protein, 8 aa, Staphylococcus
EPKKTIPT

SEQ ID NO: 1938381 - protein, 9 aa, Staphylococcus
EPKKTIPTT

SEQ ID NO: 1938382 - protein, 11 aa, Staphylococcus
EPKNGARPIKR

SEQ ID NO: 1938383 - protein, 66 aa, Staphylococcus
EPKNQNQRHGQEGNNNNFQNFGGQQSGQNTSSYQSNNNNNSSNNNQSDNPFANANGPIDISDDDLP

SEQ ID NO: 1938384 - protein, 67 aa, Staphylococcus
EPKNSQNGGGQRSQNNEFQDYGQGFGGQQSGQNTSYNNNSSRPNSNQSDNPFANANGPIDISDDDLP

SEQ ID NO: 1938385 - protein, 65 aa, Staphylococcus
EPKNSQQGGQRSQNNDFQDYGQGFGGQQSGQNTSYNNNNSSNSNQSDNPFANANGPIDISDDDLP

SEQ ID NO: 1938386 - protein, 5 aa, Staphylococcus
EPKPQ

SEQ ID NO: 1938387 - protein, 6 aa, Staphylococcus
EPKPQH

SEQ ID NO: 1938388 - protein, 21 aa, Staphylococcus
EPKQDTKSDKSVYEMFGIEDN

SEQ ID NO: 1938389 - protein, 4 aa, Staphylococcus
EPKR

SEQ ID NO: 1938390 - protein, 69 aa, Staphylococcus
EPKSQNQRHGGQQSGGGNQFQDYGQSYGGQQQGQNTSSYQNQNSSKSGQSDNPFANANGPIDISDDDLP

SEQ ID NO: 1938391 - protein, 8 aa, Staphylococcus
EPKTIGED

SEQ ID NO: 1938392 - protein, 11 aa, Staphylococcus
EPKTKNEYDPV

SEQ ID NO: 1938393 - protein, 5 aa, Staphylococcus
EPKTL

SEQ ID NO: 1938394 - protein, 10 aa, Staphylococcus
EPKTPESKQY

SEQ ID NO: 1938395 - protein, 22 aa, Staphylococcus
EPKTTSKSEQQFKDVYENLLNK

SEQ ID NO: 1938396 - protein, 6 aa, Staphylococcus
EPKVSQ

SEQ ID NO: 1938397 - protein, 5 aa, Staphylococcus
EPLEE

SEQ ID NO: 1938398 - protein, 5 aa, Staphylococcus
EPLES

SEQ ID NO: 1938399 - protein, 6 aa, Staphylococcus
EPLESE

SEQ ID NO: 1938400 - protein, 8 aa, Staphylococcus
EPLESEHP

SEQ ID NO: 1938401 - protein, 8 aa, Staphylococcus
EPLGGAHK

SEQ ID NO: 1938402 - protein, 17 aa, Staphylococcus
EPLGGAHKDIESQASTI

SEQ ID NO: 1938403 - protein, 17 aa, Staphylococcus
EPLGGAHKEMETQAQSI

SEQ ID NO: 1938404 - protein, 13 aa, Staphylococcus
EPLGGAHNNIEQQ

SEQ ID NO: 1938405 - protein, 8 aa, Staphylococcus
EPLGGAHR

SEQ ID NO: 1938406 - protein, 6 aa, Staphylococcus
EPLHKN

SEQ ID NO: 1938407 - protein, 4 aa, Staphylococcus
EPLK

SEQ ID NO: 1938408 - protein, 5 aa, Staphylococcus
EPLKG

SEQ ID NO: 1938409 - protein, 6 aa, Staphylococcus
EPLKPL

SEQ ID NO: 1938410 - protein, 5 aa, Staphylococcus
EPLLE

SEQ ID NO: 1938411 - protein, 4 aa, Staphylococcus
EPLN

SEQ ID NO: 1938412 - protein, 11 aa, Staphylococcus
EPLNEAPEKYV

SEQ ID NO: 1938413 - protein, 13 aa, Staphylococcus
EPLPEKLNNDGPY

SEQ ID NO: 1938414 - protein, 6 aa, Staphylococcus
EPLPKV

SEQ ID NO: 1938415 - protein, 8 aa, Staphylococcus
EPLPYTQD

SEQ ID NO: 1938416 - protein, 10 aa, Staphylococcus
EPLQPPTDDL

SEQ ID NO: 1938417 - protein, 8 aa, Staphylococcus
EPLQPSNE

SEQ ID NO: 1938418 - protein, 13 aa, Staphylococcus
EPLSDGSGEAKFA

SEQ ID NO: 1938419 - protein, 15 aa, Staphylococcus
EPLSDGSGNAKFAEG

SEQ ID NO: 1938420 - protein, 13 aa, Staphylococcus
EPLSDGSGNAQFA

SEQ ID NO: 1938421 - protein, 13 aa, Staphylococcus
EPLSDGSGPARFA

SEQ ID NO: 1938422 - protein, 8 aa, Staphylococcus
EPLTKEDR

SEQ ID NO: 1938423 - protein, 8 aa, Staphylococcus
EPLTSDNA

SEQ ID NO: 1938424 - protein, 7 aa, Staphylococcus
EPLTTKE

SEQ ID NO: 1938425 - protein, 22 aa, Staphylococcus
EPLTYDGAKTITTQDVKESNNP

SEQ ID NO: 1938426 - protein, 4 aa, Staphylococcus
EPMH

SEQ ID NO: 1938427 - protein, 16 aa, Staphylococcus
EPMTKAKRKNRDLISE

SEQ ID NO: 1938428 - protein, 6 aa, Staphylococcus
EPNAYQ

SEQ ID NO: 1938429 - protein, 8 aa, Staphylococcus
EPNEEKLT

SEQ ID NO: 1938430 - protein, 6 aa, Staphylococcus
EPNEIK

SEQ ID NO: 1938431 - protein, 6 aa, Staphylococcus
EPNEVE

SEQ ID NO: 1938432 - protein, 8 aa, Staphylococcus
EPNEVQQE

SEQ ID NO: 1938433 - protein, 6 aa, Staphylococcus
EPNFTE

SEQ ID NO: 1938434 - protein, 7 aa, Staphylococcus
EPNGPIL

SEQ ID NO: 1938435 - protein, 6 aa, Staphylococcus
EPNQST

SEQ ID NO: 1938436 - protein, 15 aa, Staphylococcus
EPNTEPIRGGTDGSQ

SEQ ID NO: 1938437 - protein, 10 aa, Staphylococcus
EPNTNYTQNY

SEQ ID NO: 1938438 - protein, 18 aa, Staphylococcus
EPNVAAKKIKSAVTDSDG

SEQ ID NO: 1938439 - protein, 6 aa, Staphylococcus
EPPDYL

SEQ ID NO: 1938440 - protein, 4 aa, Staphylococcus
EPPI

SEQ ID NO: 1938441 - protein, 8 aa, Staphylococcus
EPPIPGDL

SEQ ID NO: 1938442 - protein, 5 aa, Staphylococcus
EPPKD

SEQ ID NO: 1938443 - protein, 16 aa, Staphylococcus
EPPKNKVQRFFEYQAQ

SEQ ID NO: 1938444 - protein, 6 aa, Staphylococcus
EPPKNT

SEQ ID NO: 1938445 - protein, 5 aa, Staphylococcus
EPPKT

SEQ ID NO: 1938446 - protein, 7 aa, Staphylococcus
EPPLDSP

SEQ ID NO: 1938447 - protein, 9 aa, Staphylococcus
EPPNYQPDW

SEQ ID NO: 1938448 - protein, 6 aa, Staphylococcus
EPPQNT

SEQ ID NO: 1938449 - protein, 9 aa, Staphylococcus
EPQAGQGSI

SEQ ID NO: 1938450 - protein, 10 aa, Staphylococcus
EPQDDNRDGV

SEQ ID NO: 1938451 - protein, 6 aa, Staphylococcus
EPQHQH

SEQ ID NO: 1938452 - protein, 9 aa, Staphylococcus
EPQIKDGSI

SEQ ID NO: 1938453 - protein, 7 aa, Staphylococcus
EPQNNGS

SEQ ID NO: 1938454 - protein, 4 aa, Staphylococcus
EPQS

SEQ ID NO: 1938455 - protein, 7 aa, Staphylococcus
EPQSDEA

SEQ ID NO: 1938456 - protein, 4 aa, Staphylococcus
EPQT

SEQ ID NO: 1938457 - protein, 4 aa, Staphylococcus
EPQV

SEQ ID NO: 1938458 - protein, 10 aa, Staphylococcus
EPQVGEGSAP

SEQ ID NO: 1938459 - protein, 8 aa, Staphylococcus
EPQVKDAS

SEQ ID NO: 1938460 - protein, 9 aa, Staphylococcus
EPQVKEGSI

SEQ ID NO: 1938461 - protein, 10 aa, Staphylococcus
EPQVPDEAKG

SEQ ID NO: 1938462 - protein, 8 aa, Staphylococcus
EPQVREGS

SEQ ID NO: 1938463 - protein, 5 aa, Staphylococcus
EPQVT

SEQ ID NO: 1938464 - protein, 4 aa, Staphylococcus
EPRE

SEQ ID NO: 1938465 - protein, 14 aa, Staphylococcus
EPRYDTQHTHGTGC

SEQ ID NO: 1938466 - protein, 7 aa, Staphylococcus
EPSAQNM

SEQ ID NO: 1938467 - protein, 4 aa, Staphylococcus
EPSD

SEQ ID NO: 1938468 - protein, 21 aa, Staphylococcus
EPSDDGKDIKITKSSNLKETL

SEQ ID NO: 1938469 - protein, 8 aa, Staphylococcus
EPSDPMKE

SEQ ID NO: 1938470 - protein, 12 aa, Staphylococcus
EPSEGEFNYRKN

SEQ ID NO: 1938471 - protein, 6 aa, Staphylococcus
EPSESG

SEQ ID NO: 1938472 - protein, 6 aa, Staphylococcus
EPSETN

SEQ ID NO: 1938473 - protein, 4 aa, Staphylococcus
EPSH

SEQ ID NO: 1938474 - protein, 5 aa, Staphylococcus
EPSHL

SEQ ID NO: 1938475 - protein, 11 aa, Staphylococcus
EPSKRQAREDV

SEQ ID NO: 1938476 - protein, 4 aa, Staphylococcus
EPSL

SEQ ID NO: 1938477 - protein, 16 aa, Staphylococcus
EPSNETWHDEAERLQS

SEQ ID NO: 1938478 - protein, 10 aa, Staphylococcus
EPSNGLDPYG

SEQ ID NO: 1938479 - protein, 7 aa, Staphylococcus
EPSQDGI

SEQ ID NO: 1938480 - protein, 7 aa, Staphylococcus
EPSQHKT

SEQ ID NO: 1938481 - protein, 15 aa, Staphylococcus
EPSQTNLEGKTPDKY

SEQ ID NO: 1938482 - protein, 11 aa, Staphylococcus
EPSSGLDGQRM

SEQ ID NO: 1938483 - protein, 6 aa, Staphylococcus
EPSSNL

SEQ ID NO: 1938484 - protein, 7 aa, Staphylococcus
EPSSNLD

SEQ ID NO: 1938485 - protein, 6 aa, Staphylococcus
EPSYKD

SEQ ID NO: 1938486 - protein, 7 aa, Staphylococcus
EPSYRDD

SEQ ID NO: 1938487 - protein, 11 aa, Staphylococcus
EPTAGLDPEER

SEQ ID NO: 1938488 - protein, 12 aa, Staphylococcus
EPTAGLDPKSRH

SEQ ID NO: 1938489 - protein, 13 aa, Staphylococcus
EPTAGLDPKSRQQ

SEQ ID NO: 1938490 - protein, 8 aa, Staphylococcus
EPTDGPFE

SEQ ID NO: 1938491 - protein, 5 aa, Staphylococcus
EPTDV

SEQ ID NO: 1938492 - protein, 6 aa, Staphylococcus
EPTEFG

SEQ ID NO: 1938493 - protein, 18 aa, Staphylococcus
EPTEGQITINGKNIGDMN

SEQ ID NO: 1938494 - protein, 18 aa, Staphylococcus
EPTEGSIEMNGKDVRSMN

SEQ ID NO: 1938495 - protein, 21 aa, Staphylococcus
EPTEVQEFDEESERGAYGSTG

SEQ ID NO: 1938496 - protein, 13 aa, Staphylococcus
EPTGALDSETSKE

SEQ ID NO: 1938497 - protein, 13 aa, Staphylococcus
EPTGALDSKTSED

SEQ ID NO: 1938498 - protein, 13 aa, Staphylococcus
EPTGYLAGRDKRN

SEQ ID NO: 1938499 - protein, 6 aa, Staphylococcus
EPTINP

SEQ ID NO: 1938500 - protein, 15 aa, Staphylococcus
EPTKLKNPPSNWPRT

SEQ ID NO: 1938501 - protein, 4 aa, Staphylococcus
EPTL

SEQ ID NO: 1938502 - protein, 7 aa, Staphylococcus
EPTNSLD

SEQ ID NO: 1938503 - protein, 4 aa, Staphylococcus
EPTR

SEQ ID NO: 1938504 - protein, 6 aa, Staphylococcus
EPTREE

SEQ ID NO: 1938505 - protein, 7 aa, Staphylococcus
EPTSALD

SEQ ID NO: 1938506 - protein, 14 aa, Staphylococcus
EPTSALDQKNSQKV

SEQ ID NO: 1938507 - protein, 11 aa, Staphylococcus
EPTSALDVQNR

SEQ ID NO: 1938508 - protein, 8 aa, Staphylococcus
EPTSGIDA

SEQ ID NO: 1938509 - protein, 8 aa, Staphylococcus
EPTSGLDP

SEQ ID NO: 1938510 - protein, 6 aa, Staphylococcus
EPTSGS

SEQ ID NO: 1938511 - protein, 6 aa, Staphylococcus
EPTSGT

SEQ ID NO: 1938512 - protein, 6 aa, Staphylococcus
EPTTHL

SEQ ID NO: 1938513 - protein, 5 aa, Staphylococcus
EPTVE

SEQ ID NO: 1938514 - protein, 6 aa, Staphylococcus
EPTVNR

SEQ ID NO: 1938515 - protein, 12 aa, Staphylococcus
EPVDKTATMSEE

SEQ ID NO: 1938516 - protein, 5 aa, Staphylococcus
EPVEG

SEQ ID NO: 1938517 - protein, 12 aa, Staphylococcus
EPVEKALKEKFG

SEQ ID NO: 1938518 - protein, 9 aa, Staphylococcus
EPVGYTDQP

SEQ ID NO: 1938519 - protein, 5 aa, Staphylococcus
EPVIS

SEQ ID NO: 1938520 - protein, 4 aa, Staphylococcus
EPVN

SEQ ID NO: 1938521 - protein, 7 aa, Staphylococcus
EPVNNDI

SEQ ID NO: 1938522 - protein, 8 aa, Staphylococcus
EPVNSKYS

SEQ ID NO: 1938523 - protein, 4 aa, Staphylococcus
EPVP

SEQ ID NO: 1938524 - protein, 20 aa, Staphylococcus
EPVPPLPPVESFKGPKGRYQ

SEQ ID NO: 1938525 - protein, 17 aa, Staphylococcus
EPVSLETPIGEEDDSHL

SEQ ID NO: 1938526 - protein, 9 aa, Staphylococcus
EPVSMQPSL

SEQ ID NO: 1938527 - protein, 26 aa, Staphylococcus
EPVTGKSALPVNDSDLERRKERAEEL

SEQ ID NO: 1938528 - protein, 11 aa, Staphylococcus
EPWEPTSSDFY

SEQ ID NO: 1938529 - protein, 4 aa, Staphylococcus
EPYF

SEQ ID NO: 1938530 - protein, 10 aa, Staphylococcus
EPYPISGSHG

SEQ ID NO: 1938531 - protein, 11 aa, Staphylococcus
EPYPISGSHGL

SEQ ID NO: 1938532 - protein, 6 aa, Staphylococcus
EPYPNY

SEQ ID NO: 1938533 - protein, 7 aa, Staphylococcus
EPYRGQT

SEQ ID NO: 1938534 - protein, 6 aa, Staphylococcus
EPYTED

SEQ ID NO: 1938535 - protein, 8 aa, Staphylococcus
EPYTEDSS

SEQ ID NO: 1938536 - protein, 6 aa, Staphylococcus
EPYTEH

SEQ ID NO: 1938537 - protein, 18 aa, Staphylococcus
EQAAIQAKKDSENPTSLE

SEQ ID NO: 1938538 - protein, 9 aa, Staphylococcus
EQADDDKLR

SEQ ID NO: 1938539 - protein, 12 aa, Staphylococcus
EQADLTKKEAGL

SEQ ID NO: 1938540 - protein, 14 aa, Staphylococcus
EQADLTKKQAGSAV

SEQ ID NO: 1938541 - protein, 5 aa, Staphylococcus
EQADR

SEQ ID NO: 1938542 - protein, 8 aa, Staphylococcus
EQADSGSI

SEQ ID NO: 1938543 - protein, 6 aa, Staphylococcus
EQAELG

SEQ ID NO: 1938544 - protein, 12 aa, Staphylococcus
EQAELTKKEAGL

SEQ ID NO: 1938545 - protein, 10 aa, Staphylococcus
EQAEQTMEEK

SEQ ID NO: 1938546 - protein, 16 aa, Staphylococcus
EQAEVYKNNADRALKA

SEQ ID NO: 1938547 - protein, 7 aa, Staphylococcus
EQAGGTI

SEQ ID NO: 1938548 - protein, 7 aa, Staphylococcus
EQAGQRI

SEQ ID NO: 1938549 - protein, 5 aa, Staphylococcus
EQAGV

SEQ ID NO: 1938550 - protein, 7 aa, Staphylococcus
EQAKAQN

SEQ ID NO: 1938551 - protein, 20 aa, Staphylococcus
EQAKEKGEASGAPPKTISPN

SEQ ID NO: 1938552 - protein, 8 aa, Staphylococcus
EQAKHGDL

SEQ ID NO: 1938553 - protein, 10 aa, Staphylococcus
EQAKQNERSH

SEQ ID NO: 1938554 - protein, 6 aa, Staphylococcus
EQAKSL

SEQ ID NO: 1938555 - protein, 14 aa, Staphylococcus
EQALGKALNNSDIA

SEQ ID NO: 1938556 - protein, 12 aa, Staphylococcus
EQALRDSDEYKA

SEQ ID NO: 1938557 - protein, 13 aa, Staphylococcus
EQALRDSDEYKAI

SEQ ID NO: 1938558 - protein, 13 aa, Staphylococcus
EQALRESDEYQAI

SEQ ID NO: 1938559 - protein, 7 aa, Staphylococcus
EQANEVD

SEQ ID NO: 1938560 - protein, 8 aa, Staphylococcus
EQANKRQM

SEQ ID NO: 1938561 - protein, 11 aa, Staphylococcus
EQANSGHPGLP

SEQ ID NO: 1938562 - protein, 14 aa, Staphylococcus
EQAPKDIENWEQDE

SEQ ID NO: 1938563 - protein, 4 aa, Staphylococcus
EQAQ

SEQ ID NO: 1938564 - protein, 5 aa, Staphylococcus
EQAQE

SEQ ID NO: 1938565 - protein, 8 aa, Staphylococcus
EQAQPNQV

SEQ ID NO: 1938566 - protein, 7 aa, Staphylococcus
EQARGKI

SEQ ID NO: 1938567 - protein, 7 aa, Staphylococcus
EQARKGR

SEQ ID NO: 1938568 - protein, 11 aa, Staphylococcus
EQARNHKDNPF

SEQ ID NO: 1938569 - protein, 12 aa, Staphylococcus
EQARPTNKQTRQ

SEQ ID NO: 1938570 - protein, 7 aa, Staphylococcus
EQARQGR

SEQ ID NO: 1938571 - protein, 8 aa, Staphylococcus
EQASNSAG

SEQ ID NO: 1938572 - protein, 12 aa, Staphylococcus
EQATDAPNHGMR

SEQ ID NO: 1938573 - protein, 6 aa, Staphylococcus
EQATEG

SEQ ID NO: 1938574 - protein, 9 aa, Staphylococcus
EQATPQPID

SEQ ID NO: 1938575 - protein, 10 aa, Staphylococcus
EQAVDDDTAA

SEQ ID NO: 1938576 - protein, 10 aa, Staphylococcus
EQAYNGEKKI

SEQ ID NO: 1938577 - protein, 17 aa, Staphylococcus
EQCDTPENLYAKPQSEA

SEQ ID NO: 1938578 - protein, 4 aa, Staphylococcus
EQCE

SEQ ID NO: 1938579 - protein, 11 aa, Staphylococcus
EQCGSTHPEKL

SEQ ID NO: 1938580 - protein, 4 aa, Staphylococcus
EQCS

SEQ ID NO: 1938581 - protein, 9 aa, Staphylococcus
EQDAAEGLP

SEQ ID NO: 1938582 - protein, 6 aa, Staphylococcus
EQDASP

SEQ ID NO: 1938583 - protein, 12 aa, Staphylococcus
EQDDASYQESAQ

SEQ ID NO: 1938584 - protein, 8 aa, Staphylococcus
EQDDDHSE

SEQ ID NO: 1938585 - protein, 9 aa, Staphylococcus
EQDDNVGSM

SEQ ID NO: 1938586 - protein, 4 aa, Staphylococcus
EQDE

SEQ ID NO: 1938587 - protein, 15 aa, Staphylococcus
EQDETLTTLTGKNQY

SEQ ID NO: 1938588 - protein, 5 aa, Staphylococcus
EQDEY

SEQ ID NO: 1938589 - protein, 4 aa, Staphylococcus
EQDF

SEQ ID NO: 1938590 - protein, 17 aa, Staphylococcus
EQDGKLYGRGTSDMKGG

SEQ ID NO: 1938591 - protein, 8 aa, Staphylococcus
EQDGKVVN

SEQ ID NO: 1938592 - protein, 5 aa, Staphylococcus
EQDGV

SEQ ID NO: 1938593 - protein, 12 aa, Staphylococcus
EQDGYTVTKDSD

SEQ ID NO: 1938594 - protein, 5 aa, Staphylococcus
EQDHS

SEQ ID NO: 1938595 - protein, 5 aa, Staphylococcus
EQDIE

SEQ ID NO: 1938596 - protein, 9 aa, Staphylococcus
EQDIKGANH

SEQ ID NO: 1938597 - protein, 14 aa, Staphylococcus
EQDIQASIKGGTHI

SEQ ID NO: 1938598 - protein, 7 aa, Staphylococcus
EQDISKP

SEQ ID NO: 1938599 - protein, 7 aa, Staphylococcus
EQDKADF

SEQ ID NO: 1938600 - protein, 7 aa, Staphylococcus
EQDKETI

SEQ ID NO: 1938601 - protein, 5 aa, Staphylococcus
EQDLE

SEQ ID NO: 1938602 - protein, 7 aa, Staphylococcus
EQDLKGE

SEQ ID NO: 1938603 - protein, 10 aa, Staphylococcus
EQDPSGEARD

SEQ ID NO: 1938604 - protein, 7 aa, Staphylococcus
EQDRAIA

SEQ ID NO: 1938605 - protein, 10 aa, Staphylococcus
EQDRKDLTNY

SEQ ID NO: 1938606 - protein, 8 aa, Staphylococcus
EQDSIETA

SEQ ID NO: 1938607 - protein, 7 aa, Staphylococcus
EQDSKVK

SEQ ID NO: 1938608 - protein, 5 aa, Staphylococcus
EQDTL

SEQ ID NO: 1938609 - protein, 15 aa, Staphylococcus
EQDVKGQQHQDKASL

SEQ ID NO: 1938610 - protein, 9 aa, Staphylococcus
EQDYQPNQF

SEQ ID NO: 1938611 - protein, 19 aa, Staphylococcus
EQEANEKQENALSDYYSFK

SEQ ID NO: 1938612 - protein, 4 aa, Staphylococcus
EQED

SEQ ID NO: 1938613 - protein, 12 aa, Staphylococcus
EQEEAKVSYEDR

SEQ ID NO: 1938614 - protein, 17 aa, Staphylococcus
EQEEKRQLTPGQQEAYD

SEQ ID NO: 1938615 - protein, 4 aa, Staphylococcus
EQEF

SEQ ID NO: 1938616 - protein, 5 aa, Staphylococcus
EQEFD

SEQ ID NO: 1938617 - protein, 4 aa, Staphylococcus
EQEG

SEQ ID NO: 1938618 - protein, 13 aa, Staphylococcus
EQEGDMSEADAEA

SEQ ID NO: 1938619 - protein, 9 aa, Staphylococcus
EQEGGYDLT

SEQ ID NO: 1938620 - protein, 9 aa, Staphylococcus
EQEGITQDA

SEQ ID NO: 1938621 - protein, 9 aa, Staphylococcus
EQEGNESVS

SEQ ID NO: 1938622 - protein, 12 aa, Staphylococcus
EQEGSITDKRAD

SEQ ID NO: 1938623 - protein, 5 aa, Staphylococcus
EQEHK

SEQ ID NO: 1938624 - protein, 4 aa, Staphylococcus
EQEI

SEQ ID NO: 1938625 - protein, 6 aa, Staphylococcus
EQEIEG

SEQ ID NO: 1938626 - protein, 6 aa, Staphylococcus
EQEIES

SEQ ID NO: 1938627 - protein, 15 aa, Staphylococcus
EQEIETVKKEKDAAV

SEQ ID NO: 1938628 - protein, 7 aa, Staphylococcus
EQEINQP

SEQ ID NO: 1938629 - protein, 7 aa, Staphylococcus
EQEKAKK

SEQ ID NO: 1938630 - protein, 16 aa, Staphylococcus
EQEKSASVQSANGTDN

SEQ ID NO: 1938631 - protein, 7 aa, Staphylococcus
EQEKSYE

SEQ ID NO: 1938632 - protein, 6 aa, Staphylococcus
EQELPH

SEQ ID NO: 1938633 - protein, 16 aa, Staphylococcus
EQEMTQNMRKSNEIQE

SEQ ID NO: 1938634 - protein, 4 aa, Staphylococcus
EQEN

SEQ ID NO: 1938635 - protein, 6 aa, Staphylococcus
EQENID

SEQ ID NO: 1938636 - protein, 9 aa, Staphylococcus
EQENIEEEA

SEQ ID NO: 1938637 - protein, 9 aa, Staphylococcus
EQENKRTGI

SEQ ID NO: 1938638 - protein, 7 aa, Staphylococcus
EQENNDN

SEQ ID NO: 1938639 - protein, 9 aa, Staphylococcus
EQEPKLNKK

SEQ ID NO: 1938640 - protein, 8 aa, Staphylococcus
EQEPTEVG

SEQ ID NO: 1938641 - protein, 9 aa, Staphylococcus
EQEQINEDA

SEQ ID NO: 1938642 - protein, 16 aa, Staphylococcus
EQERNENKRRQAQGIQ

SEQ ID NO: 1938643 - protein, 16 aa, Staphylococcus
EQERNESKRRQAQGIK

SEQ ID NO: 1938644 - protein, 11 aa, Staphylococcus
EQERQEAPALQ

SEQ ID NO: 1938645 - protein, 9 aa, Staphylococcus
EQERQHDDY

SEQ ID NO: 1938646 - protein, 5 aa, Staphylococcus
EQESA

SEQ ID NO: 1938647 - protein, 8 aa, Staphylococcus
EQESEPLF

SEQ ID NO: 1938648 - protein, 6 aa, Staphylococcus
EQESLD

SEQ ID NO: 1938649 - protein, 7 aa, Staphylococcus
EQEVEGD

SEQ ID NO: 1938650 - protein, 7 aa, Staphylococcus
EQEYSKD

SEQ ID NO: 1938651 - protein, 19 aa, Staphylococcus
EQFENDEDEDEHYHDATDG

SEQ ID NO: 1938652 - protein, 8 aa, Staphylococcus
EQFGKEKA

SEQ ID NO: 1938653 - protein, 10 aa, Staphylococcus
EQFKNAESKL

SEQ ID NO: 1938654 - protein, 31 aa, Staphylococcus
EQFPAKDKRNSFTKGKLSNWENDKSEPIAKT

SEQ ID NO: 1938655 - protein, 11 aa, Staphylococcus
EQFPDRTYEPQ

SEQ ID NO: 1938656 - protein, 5 aa, Staphylococcus
EQFPT

SEQ ID NO: 1938657 - protein, 5 aa, Staphylococcus
EQGAD

SEQ ID NO: 1938658 - protein, 10 aa, Staphylococcus
EQGASHWTKE

SEQ ID NO: 1938659 - protein, 18 aa, Staphylococcus
EQGATHAAEGYARISGKT

SEQ ID NO: 1938660 - protein, 19 aa, Staphylococcus
EQGATHAAEGYARVSGNTG

SEQ ID NO: 1938661 - protein, 12 aa, Staphylococcus
EQGATNWTRDTY

SEQ ID NO: 1938662 - protein, 5 aa, Staphylococcus
EQGAV

SEQ ID NO: 1938663 - protein, 14 aa, Staphylococcus
EQGAYEIIRKLNEE

SEQ ID NO: 1938664 - protein, 4 aa, Staphylococcus
EQGE

SEQ ID NO: 1938665 - protein, 8 aa, Staphylococcus
EQGEEAAR

SEQ ID NO: 1938666 - protein, 4 aa, Staphylococcus
EQGF

SEQ ID NO: 1938667 - protein, 4 aa, Staphylococcus
EQGG

SEQ ID NO: 1938668 - protein, 7 aa, Staphylococcus
EQGGDVN

SEQ ID NO: 1938669 - protein, 10 aa, Staphylococcus
EQGGMDENQN

SEQ ID NO: 1938670 - protein, 8 aa, Staphylococcus
EQGGQTFE

SEQ ID NO: 1938671 - protein, 7 aa, Staphylococcus
EQGGTQW

SEQ ID NO: 1938672 - protein, 11 aa, Staphylococcus
EQGHEETFRNK

SEQ ID NO: 1938673 - protein, 8 aa, Staphylococcus
EQGHEQEA

SEQ ID NO: 1938674 - protein, 5 aa, Staphylococcus
EQGIK

SEQ ID NO: 1938675 - protein, 7 aa, Staphylococcus
EQGKDIT

SEQ ID NO: 1938676 - protein, 15 aa, Staphylococcus
EQGKTLAEAQGEIDK

SEQ ID NO: 1938677 - protein, 13 aa, Staphylococcus
EQGKTLAEAYGEI

SEQ ID NO: 1938678 - protein, 14 aa, Staphylococcus
EQGKTLAQAEGEID

SEQ ID NO: 1938679 - protein, 14 aa, Staphylococcus
EQGKTLASAKGEID

SEQ ID NO: 1938680 - protein, 11 aa, Staphylococcus
EQGLSQDEAEA

SEQ ID NO: 1938681 - protein, 7 aa, Staphylococcus
EQGNERF

SEQ ID NO: 1938682 - protein, 17 aa, Staphylococcus
EQGPADEIYKNPKHPYT

SEQ ID NO: 1938683 - protein, 6 aa, Staphylococcus
EQGPAH

SEQ ID NO: 1938684 - protein, 7 aa, Staphylococcus
EQGPRFK

SEQ ID NO: 1938685 - protein, 13 aa, Staphylococcus
EQGQEMTPNNKQQ

SEQ ID NO: 1938686 - protein, 6 aa, Staphylococcus
EQGQYL

SEQ ID NO: 1938687 - protein, 9 aa, Staphylococcus
EQGRTVDGY

SEQ ID NO: 1938688 - protein, 9 aa, Staphylococcus
EQGSKKWNK

SEQ ID NO: 1938689 - protein, 6 aa, Staphylococcus
EQGSPL

SEQ ID NO: 1938690 - protein, 11 aa, Staphylococcus
EQGSRARPGQG

SEQ ID NO: 1938691 - protein, 14 aa, Staphylococcus
EQGTIYNNGTPEPV

SEQ ID NO: 1938692 - protein, 5 aa, Staphylococcus
EQGTS

SEQ ID NO: 1938693 - protein, 18 aa, Staphylococcus
EQGTVTGGNASSINDGSS

SEQ ID NO: 1938694 - protein, 5 aa, Staphylococcus
EQGTY

SEQ ID NO: 1938695 - protein, 15 aa, Staphylococcus
EQGTYYATENESNIV

SEQ ID NO: 1938696 - protein, 4 aa, Staphylococcus
EQGV

SEQ ID NO: 1938697 - protein, 7 aa, Staphylococcus
EQGVQRG

SEQ ID NO: 1938698 - protein, 4 aa, Staphylococcus
EQGY

SEQ ID NO: 1938699 - protein, 11 aa, Staphylococcus
EQGYESTQSMQ

SEQ ID NO: 1938700 - protein, 13 aa, Staphylococcus
EQGYYDGDDAEEV

SEQ ID NO: 1938701 - protein, 6 aa, Staphylococcus
EQHAQD

SEQ ID NO: 1938702 - protein, 16 aa, Staphylococcus
EQHDGQQPVYQYLFSV

SEQ ID NO: 1938703 - protein, 16 aa, Staphylococcus
EQHEGGQPIYQYFFAV

SEQ ID NO: 1938704 - protein, 8 aa, Staphylococcus
EQHGQFTS

SEQ ID NO: 1938705 - protein, 5 aa, Staphylococcus
EQHGR

SEQ ID NO: 1938706 - protein, 11 aa, Staphylococcus
EQHIASEDNQV

SEQ ID NO: 1938707 - protein, 10 aa, Staphylococcus
EQHKTPLEAS

SEQ ID NO: 1938708 - protein, 4 aa, Staphylococcus
EQHM

SEQ ID NO: 1938709 - protein, 4 aa, Staphylococcus
EQHP

SEQ ID NO: 1938710 - protein, 9 aa, Staphylococcus
EQHRTNNPL

SEQ ID NO: 1938711 - protein, 9 aa, Staphylococcus
EQHTNNEVE

SEQ ID NO: 1938712 - protein, 5 aa, Staphylococcus
EQIDN

SEQ ID NO: 1938713 - protein, 5 aa, Staphylococcus
EQIDT

SEQ ID NO: 1938714 - protein, 16 aa, Staphylococcus
EQIDTPQAFRNQPKNK

SEQ ID NO: 1938715 - protein, 16 aa, Staphylococcus
EQIDTPQGFKDHPQTD

SEQ ID NO: 1938716 - protein, 12 aa, Staphylococcus
EQIEERRKLNIE

SEQ ID NO: 1938717 - protein, 5 aa, Staphylococcus
EQIEY

SEQ ID NO: 1938718 - protein, 4 aa, Staphylococcus
EQIG

SEQ ID NO: 1938719 - protein, 5 aa, Staphylococcus
EQIGD

SEQ ID NO: 1938720 - protein, 14 aa, Staphylococcus
EQIGDASWTITVQK

SEQ ID NO: 1938721 - protein, 5 aa, Staphylococcus
EQIGG

SEQ ID NO: 1938722 - protein, 14 aa, Staphylococcus
EQIKAGAQVATDHK

SEQ ID NO: 1938723 - protein, 13 aa, Staphylococcus
EQIKDGANVAREH

SEQ ID NO: 1938724 - protein, 4 aa, Staphylococcus
EQIN

SEQ ID NO: 1938725 - protein, 6 aa, Staphylococcus
EQINAK

SEQ ID NO: 1938726 - protein, 6 aa, Staphylococcus
EQINTN

SEQ ID NO: 1938727 - protein, 5 aa, Staphylococcus
EQIPD

SEQ ID NO: 1938728 - protein, 6 aa, Staphylococcus
EQIPES

SEQ ID NO: 1938729 - protein, 6 aa, Staphylococcus
EQISNK

SEQ ID NO: 1938730 - protein, 8 aa, Staphylococcus
EQISQKQY

SEQ ID NO: 1938731 - protein, 4 aa, Staphylococcus
EQIT

SEQ ID NO: 1938732 - protein, 5 aa, Staphylococcus
EQITA

SEQ ID NO: 1938733 - protein, 10 aa, Staphylococcus
EQKAKESGFS

SEQ ID NO: 1938734 - protein, 15 aa, Staphylococcus
EQKDASEAEQQIDEI

SEQ ID NO: 1938735 - protein, 6 aa, Staphylococcus
EQKDKI

SEQ ID NO: 1938736 - protein, 16 aa, Staphylococcus
EQKDKIKQLIDELEQY

SEQ ID NO: 1938737 - protein, 19 aa, Staphylococcus
EQKDRDHDDYYEIKIRIYK

SEQ ID NO: 1938738 - protein, 15 aa, Staphylococcus
EQKEHGHSIEEQERK

SEQ ID NO: 1938739 - protein, 6 aa, Staphylococcus
EQKEKI

SEQ ID NO: 1938740 - protein, 8 aa, Staphylococcus
EQKEQYLS

SEQ ID NO: 1938741 - protein, 14 aa, Staphylococcus
EQKGKVSLTMVNPN

SEQ ID NO: 1938742 - protein, 11 aa, Staphylococcus
EQKGYSGQQIA

SEQ ID NO: 1938743 - protein, 16 aa, Staphylococcus
EQKITLDRSESGLLPE

SEQ ID NO: 1938744 - protein, 4 aa, Staphylococcus
EQKK

SEQ ID NO: 1938745 - protein, 5 aa, Staphylococcus
EQKKE

SEQ ID NO: 1938746 - protein, 5 aa, Staphylococcus
EQKKI

SEQ ID NO: 1938747 - protein, 18 aa, Staphylococcus
EQKKSLVKDEATQKANEK

SEQ ID NO: 1938748 - protein, 8 aa, Staphylococcus
EQKLGESI

SEQ ID NO: 1938749 - protein, 15 aa, Staphylococcus
EQKLNDNKELESNLN

SEQ ID NO: 1938750 - protein, 9 aa, Staphylococcus
EQKNQKKNE

SEQ ID NO: 1938751 - protein, 11 aa, Staphylococcus
EQKNQKKQDIQ

SEQ ID NO: 1938752 - protein, 10 aa, Staphylococcus
EQKNQKTKEI

SEQ ID NO: 1938753 - protein, 8 aa, Staphylococcus
EQKNTTSS

SEQ ID NO: 1938754 - protein, 13 aa, Staphylococcus
EQKPAKAKKGTDI

SEQ ID NO: 1938755 - protein, 9 aa, Staphylococcus
EQKPSNQIM

SEQ ID NO: 1938756 - protein, 11 aa, Staphylococcus
EQKQQEKQKAL

SEQ ID NO: 1938757 - protein, 10 aa, Staphylococcus
EQKQQKTQQI

SEQ ID NO: 1938758 - protein, 9 aa, Staphylococcus
EQKQQQEYY

SEQ ID NO: 1938759 - protein, 11 aa, Staphylococcus
EQKQQQKQKAL

SEQ ID NO: 1938760 - protein, 12 aa, Staphylococcus
EQKSDSPEPQIV

SEQ ID NO: 1938761 - protein, 13 aa, Staphylococcus
EQKSGASTATISR

SEQ ID NO: 1938762 - protein, 10 aa, Staphylococcus
EQKSQKKQEI

SEQ ID NO: 1938763 - protein, 43 aa, Staphylococcus
EQKSTQSSQIRSQDNKDAYIAESQSAYLKDSENQAVKPAYEQT

SEQ ID NO: 1938764 - protein, 5 aa, Staphylococcus
EQKTN

SEQ ID NO: 1938765 - protein, 9 aa, Staphylococcus
EQLAKNAKK

SEQ ID NO: 1938766 - protein, 8 aa, Staphylococcus
EQLAKRAK

SEQ ID NO: 1938767 - protein, 14 aa, Staphylococcus
EQLEKGDSVQVEID

SEQ ID NO: 1938768 - protein, 11 aa, Staphylococcus
EQLEQQLKEEK

SEQ ID NO: 1938769 - protein, 14 aa, Staphylococcus
EQLGDASWTITVQK

SEQ ID NO: 1938770 - protein, 5 aa, Staphylococcus
EQLGT

SEQ ID NO: 1938771 - protein, 23 aa, Staphylococcus
EQLKQEPKANTEAAKRILKSIRQ

SEQ ID NO: 1938772 - protein, 14 aa, Staphylococcus
EQLKQGQDIVGNRT

SEQ ID NO: 1938773 - protein, 5 aa, Staphylococcus
EQLKR

SEQ ID NO: 1938774 - protein, 10 aa, Staphylococcus
EQLKSTEKFN

SEQ ID NO: 1938775 - protein, 13 aa, Staphylococcus
EQLMPGGVNSPVR

SEQ ID NO: 1938776 - protein, 8 aa, Staphylococcus
EQLNENGD

SEQ ID NO: 1938777 - protein, 9 aa, Staphylococcus
EQLNKDADR

SEQ ID NO: 1938778 - protein, 14 aa, Staphylococcus
EQLNSSDYKVTEEE

SEQ ID NO: 1938779 - protein, 8 aa, Staphylococcus
EQLNTTKT

SEQ ID NO: 1938780 - protein, 4 aa, Staphylococcus
EQLP

SEQ ID NO: 1938781 - protein, 14 aa, Staphylococcus
EQLQDKNYGEVTEQ

SEQ ID NO: 1938782 - protein, 11 aa, Staphylococcus
EQLQGQNRKDI

SEQ ID NO: 1938783 - protein, 5 aa, Staphylococcus
EQLQR

SEQ ID NO: 1938784 - protein, 5 aa, Staphylococcus
EQLRS

SEQ ID NO: 1938785 - protein, 6 aa, Staphylococcus
EQLSEE

SEQ ID NO: 1938786 - protein, 12 aa, Staphylococcus
EQLSKERRSVAQ

SEQ ID NO: 1938787 - protein, 6 aa, Staphylococcus
EQLSNE

SEQ ID NO: 1938788 - protein, 6 aa, Staphylococcus
EQLTQP

SEQ ID NO: 1938789 - protein, 7 aa, Staphylococcus
EQLTQPD

SEQ ID NO: 1938790 - protein, 14 aa, Staphylococcus
EQMDKDMMSKLENI

SEQ ID NO: 1938791 - protein, 4 aa, Staphylococcus
EQME

SEQ ID NO: 1938792 - protein, 4 aa, Staphylococcus
EQMG

SEQ ID NO: 1938793 - protein, 13 aa, Staphylococcus
EQMKGEALENTDN

SEQ ID NO: 1938794 - protein, 8 aa, Staphylococcus
EQMLSKGK

SEQ ID NO: 1938795 - protein, 13 aa, Staphylococcus
EQMNGEPLAKQDI

SEQ ID NO: 1938796 - protein, 6 aa, Staphylococcus
EQMPEL

SEQ ID NO: 1938797 - protein, 6 aa, Staphylococcus
EQMPNY

SEQ ID NO: 1938798 - protein, 7 aa, Staphylococcus
EQMPSYA

SEQ ID NO: 1938799 - protein, 5 aa, Staphylococcus
EQMSE

SEQ ID NO: 1938800 - protein, 7 aa, Staphylococcus
EQMSEED

SEQ ID NO: 1938801 - protein, 11 aa, Staphylococcus
EQMSEQAQNEI

SEQ ID NO: 1938802 - protein, 6 aa, Staphylococcus
EQMSQA

SEQ ID NO: 1938803 - protein, 8 aa, Staphylococcus
EQMTRKEA

SEQ ID NO: 1938804 - protein, 9 aa, Staphylococcus
EQNAKPIEL

SEQ ID NO: 1938805 - protein, 8 aa, Staphylococcus
EQNATPIE

SEQ ID NO: 1938806 - protein, 11 aa, Staphylococcus
EQNDKKPTNKV

SEQ ID NO: 1938807 - protein, 10 aa, Staphylococcus
EQNEGVQDGD

SEQ ID NO: 1938808 - protein, 8 aa, Staphylococcus
EQNEKERP

SEQ ID NO: 1938809 - protein, 13 aa, Staphylococcus
EQNEQNQQPSQKT

SEQ ID NO: 1938810 - protein, 17 aa, Staphylococcus
EQNETFKRRRDKFEAKL

SEQ ID NO: 1938811 - protein, 5 aa, Staphylococcus
EQNGQ

SEQ ID NO: 1938812 - protein, 11 aa, Staphylococcus
EQNGQTTVTST

SEQ ID NO: 1938813 - protein, 13 aa, Staphylococcus
EQNHAKGSARSIE

SEQ ID NO: 1938814 - protein, 5 aa, Staphylococcus
EQNHT

SEQ ID NO: 1938815 - protein, 4 aa, Staphylococcus
EQNI

SEQ ID NO: 1938816 - protein, 8 aa, Staphylococcus
EQNIPRNE

SEQ ID NO: 1938817 - protein, 8 aa, Staphylococcus
EQNIQTSI

SEQ ID NO: 1938818 - protein, 5 aa, Staphylococcus
EQNKK

SEQ ID NO: 1938819 - protein, 14 aa, Staphylococcus
EQNNKMIEVLKQFN

SEQ ID NO: 1938820 - protein, 6 aa, Staphylococcus
EQNNVE

SEQ ID NO: 1938821 - protein, 22 aa, Staphylococcus
EQNPTVEESNAVKSIKRDIEDN

SEQ ID NO: 1938822 - protein, 9 aa, Staphylococcus
EQNSDENGI

SEQ ID NO: 1938823 - protein, 13 aa, Staphylococcus
EQNSGSPAEPRNV

SEQ ID NO: 1938824 - protein, 9 aa, Staphylococcus
EQNSGYNSY

SEQ ID NO: 1938825 - protein, 6 aa, Staphylococcus
EQNVNS

SEQ ID NO: 1938826 - protein, 4 aa, Staphylococcus
EQPA

SEQ ID NO: 1938827 - protein, 5 aa, Staphylococcus
EQPAT

SEQ ID NO: 1938828 - protein, 6 aa, Staphylococcus
EQPATL

SEQ ID NO: 1938829 - protein, 6 aa, Staphylococcus
EQPDKF

SEQ ID NO: 1938830 - protein, 17 aa, Staphylococcus
EQPDKLAKEVKSEEGRV

SEQ ID NO: 1938831 - protein, 7 aa, Staphylococcus
EQPDSGE

SEQ ID NO: 1938832 - protein, 11 aa, Staphylococcus
EQPDSGTIEND

SEQ ID NO: 1938833 - protein, 4 aa, Staphylococcus
EQPE

SEQ ID NO: 1938834 - protein, 5 aa, Staphylococcus
EQPED

SEQ ID NO: 1938835 - protein, 7 aa, Staphylococcus
EQPEHRQ

SEQ ID NO: 1938836 - protein, 13 aa, Staphylococcus
EQPESTKDKTQLR

SEQ ID NO: 1938837 - protein, 5 aa, Staphylococcus
EQPGI

SEQ ID NO: 1938838 - protein, 12 aa, Staphylococcus
EQPGYSEQDPNE

SEQ ID NO: 1938839 - protein, 7 aa, Staphylococcus
EQPISKQ

SEQ ID NO: 1938840 - protein, 9 aa, Staphylococcus
EQPKNSHKT

SEQ ID NO: 1938841 - protein, 7 aa, Staphylococcus
EQPKSER

SEQ ID NO: 1938842 - protein, 9 aa, Staphylococcus
EQPLTEGLT

SEQ ID NO: 1938843 - protein, 9 aa, Staphylococcus
EQPNEETYR

SEQ ID NO: 1938844 - protein, 7 aa, Staphylococcus
EQPNSTF

SEQ ID NO: 1938845 - protein, 6 aa, Staphylococcus
EQPNVM

SEQ ID NO: 1938846 - protein, 4 aa, Staphylococcus
EQPQ

SEQ ID NO: 1938847 - protein, 13 aa, Staphylococcus
EQPQGDVVYSEAF

SEQ ID NO: 1938848 - protein, 5 aa, Staphylococcus
EQPQS

SEQ ID NO: 1938849 - protein, 13 aa, Staphylococcus
EQPSDMTGESLIK

SEQ ID NO: 1938850 - protein, 13 aa, Staphylococcus
EQPSDMTGESLIN

SEQ ID NO: 1938851 - protein, 14 aa, Staphylococcus
EQPSWNPKDFAPSI

SEQ ID NO: 1938852 - protein, 21 aa, Staphylococcus
EQPSWNPKDFSPSIYQPDDRL

SEQ ID NO: 1938853 - protein, 21 aa, Staphylococcus
EQPSWNPNDFSPSIYQEEDRL

SEQ ID NO: 1938854 - protein, 6 aa, Staphylococcus
EQPTDG

SEQ ID NO: 1938855 - protein, 7 aa, Staphylococcus
EQPTSGD

SEQ ID NO: 1938856 - protein, 9 aa, Staphylococcus
EQPTVKQGY

SEQ ID NO: 1938857 - protein, 20 aa, Staphylococcus
EQPTWDPTDFSPSIYQPEDR

SEQ ID NO: 1938858 - protein, 15 aa, Staphylococcus
EQPTWNPKDFSPSIY

SEQ ID NO: 1938859 - protein, 20 aa, Staphylococcus
EQPTWNPKDFSPSIYQPEDR

SEQ ID NO: 1938860 - protein, 7 aa, Staphylococcus
EQPVKAT

SEQ ID NO: 1938861 - protein, 5 aa, Staphylococcus
EQPWN

SEQ ID NO: 1938862 - protein, 14 aa, Staphylococcus
EQPWSNGNVGTNGV

SEQ ID NO: 1938863 - protein, 8 aa, Staphylococcus
EQQAGEKV

SEQ ID NO: 1938864 - protein, 9 aa, Staphylococcus
EQQEAEGIE

SEQ ID NO: 1938865 - protein, 6 aa, Staphylococcus
EQQEMN

SEQ ID NO: 1938866 - protein, 6 aa, Staphylococcus
EQQEVD

SEQ ID NO: 1938867 - protein, 5 aa, Staphylococcus
EQQGV

SEQ ID NO: 1938868 - protein, 7 aa, Staphylococcus
EQQHGHE

SEQ ID NO: 1938869 - protein, 9 aa, Staphylococcus
EQQKKAAEL

SEQ ID NO: 1938870 - protein, 17 aa, Staphylococcus
EQQKKEKEMKKKQKTIN

SEQ ID NO: 1938871 - protein, 7 aa, Staphylococcus
EQQKKQL

SEQ ID NO: 1938872 - protein, 16 aa, Staphylococcus
EQQLSKAKQTQTEYED

SEQ ID NO: 1938873 - protein, 7 aa, Staphylococcus
EQQPASI

SEQ ID NO: 1938874 - protein, 7 aa, Staphylococcus
EQQPASL

SEQ ID NO: 1938875 - protein, 5 aa, Staphylococcus
EQQPI

SEQ ID NO: 1938876 - protein, 5 aa, Staphylococcus
EQQPL

SEQ ID NO: 1938877 - protein, 5 aa, Staphylococcus
EQQQG

SEQ ID NO: 1938878 - protein, 9 aa, Staphylococcus
EQQQQKEHY

SEQ ID NO: 1938879 - protein, 7 aa, Staphylococcus
EQQQYAS

SEQ ID NO: 1938880 - protein, 4 aa, Staphylococcus
EQQR

SEQ ID NO: 1938881 - protein, 17 aa, Staphylococcus
EQQRNSINEMIEALQRS

SEQ ID NO: 1938882 - protein, 7 aa, Staphylococcus
EQQSESI

SEQ ID NO: 1938883 - protein, 9 aa, Staphylococcus
EQQSQNRLT

SEQ ID NO: 1938884 - protein, 8 aa, Staphylococcus
EQQTAEHQ

SEQ ID NO: 1938885 - protein, 12 aa, Staphylococcus
EQQTGNAEATAY

SEQ ID NO: 1938886 - protein, 13 aa, Staphylococcus
EQQTGNSEATPYR

SEQ ID NO: 1938887 - protein, 16 aa, Staphylococcus
EQQWNSNEKKITETQD

SEQ ID NO: 1938888 - protein, 5 aa, Staphylococcus
EQQYP

SEQ ID NO: 1938889 - protein, 10 aa, Staphylococcus
EQRAAELDKM

SEQ ID NO: 1938890 - protein, 21 aa, Staphylococcus
EQRANNKSTNKSDTVQSQRAN

SEQ ID NO: 1938891 - protein, 4 aa, Staphylococcus
EQRD

SEQ ID NO: 1938892 - protein, 7 aa, Staphylococcus
EQRDQYD

SEQ ID NO: 1938893 - protein, 8 aa, Staphylococcus
EQRDVGVT

SEQ ID NO: 1938894 - protein, 13 aa, Staphylococcus
EQREAEAKGGEQA

SEQ ID NO: 1938895 - protein, 5 aa, Staphylococcus
EQREK

SEQ ID NO: 1938896 - protein, 6 aa, Staphylococcus
EQREQF

SEQ ID NO: 1938897 - protein, 5 aa, Staphylococcus
EQRER

SEQ ID NO: 1938898 - protein, 10 aa, Staphylococcus
EQREREERIK

SEQ ID NO: 1938899 - protein, 4 aa, Staphylococcus
EQRG

SEQ ID NO: 1938900 - protein, 18 aa, Staphylococcus
EQRGLLDGDSEYNDNNRI

SEQ ID NO: 1938901 - protein, 17 aa, Staphylococcus
EQRGYLDGDKEYNDNNR

SEQ ID NO: 1938902 - protein, 4 aa, Staphylococcus
EQRK

SEQ ID NO: 1938903 - protein, 10 aa, Staphylococcus
EQRKEGIAES

SEQ ID NO: 1938904 - protein, 14 aa, Staphylococcus
EQRLGKPVDKITKG

SEQ ID NO: 1938905 - protein, 6 aa, Staphylococcus
EQRLPD

SEQ ID NO: 1938906 - protein, 10 aa, Staphylococcus
EQRNEKLEKD

SEQ ID NO: 1938907 - protein, 11 aa, Staphylococcus
EQRNEKLEKDI

SEQ ID NO: 1938908 - protein, 12 aa, Staphylococcus
EQRNGDDDLSQV

SEQ ID NO: 1938909 - protein, 8 aa, Staphylococcus
EQRNKEIT

SEQ ID NO: 1938910 - protein, 9 aa, Staphylococcus
EQRPNERRC

SEQ ID NO: 1938911 - protein, 8 aa, Staphylococcus
EQRPQTDV

SEQ ID NO: 1938912 - protein, 4 aa, Staphylococcus
EQRQ

SEQ ID NO: 1938913 - protein, 6 aa, Staphylococcus
EQRQKE

SEQ ID NO: 1938914 - protein, 6 aa, Staphylococcus
EQRQPE

SEQ ID NO: 1938915 - protein, 11 aa, Staphylococcus
EQRQTNQLETN

SEQ ID NO: 1938916 - protein, 4 aa, Staphylococcus
EQRR

SEQ ID NO: 1938917 - protein, 5 aa, Staphylococcus
EQRRQ

SEQ ID NO: 1938918 - protein, 10 aa, Staphylococcus
EQRTSNEVED

SEQ ID NO: 1938919 - protein, 8 aa, Staphylococcus
EQRVDSKF

SEQ ID NO: 1938920 - protein, 6 aa, Staphylococcus
EQRYKG

SEQ ID NO: 1938921 - protein, 5 aa, Staphylococcus
EQRYR

SEQ ID NO: 1938922 - protein, 11 aa, Staphylococcus
EQSAELAAKKG

SEQ ID NO: 1938923 - protein, 6 aa, Staphylococcus
EQSAEV

SEQ ID NO: 1938924 - protein, 5 aa, Staphylococcus
EQSAI

SEQ ID NO: 1938925 - protein, 11 aa, Staphylococcus
EQSAKSLRGAK

SEQ ID NO: 1938926 - protein, 8 aa, Staphylococcus
EQSATHWT

SEQ ID NO: 1938927 - protein, 7 aa, Staphylococcus
EQSATNW

SEQ ID NO: 1938928 - protein, 13 aa, Staphylococcus
EQSDDDFNTPVIK

SEQ ID NO: 1938929 - protein, 58 aa, Staphylococcus
EQSDFKPETDASFYSDDYNRNDSTQSNVQQESVESAESDMTNVPSEQNENHKQNVQEP

SEQ ID NO: 1938930 - protein, 6 aa, Staphylococcus
EQSDVE

SEQ ID NO: 1938931 - protein, 8 aa, Staphylococcus
EQSDYASG

SEQ ID NO: 1938932 - protein, 12 aa, Staphylococcus
EQSEPESELAET

SEQ ID NO: 1938933 - protein, 6 aa, Staphylococcus
EQSEQY

SEQ ID NO: 1938934 - protein, 8 aa, Staphylococcus
EQSESQVI

SEQ ID NO: 1938935 - protein, 6 aa, Staphylococcus
EQSFKD

SEQ ID NO: 1938936 - protein, 8 aa, Staphylococcus
EQSGAPTE

SEQ ID NO: 1938937 - protein, 7 aa, Staphylococcus
EQSGITN

SEQ ID NO: 1938938 - protein, 5 aa, Staphylococcus
EQSGV

SEQ ID NO: 1938939 - protein, 6 aa, Staphylococcus
EQSGVA

SEQ ID NO: 1938940 - protein, 11 aa, Staphylococcus
EQSGYSEQDPE

SEQ ID NO: 1938941 - protein, 5 aa, Staphylococcus
EQSIL

SEQ ID NO: 1938942 - protein, 7 aa, Staphylococcus
EQSITEH

SEQ ID NO: 1938943 - protein, 4 aa, Staphylococcus
EQSK

SEQ ID NO: 1938944 - protein, 6 aa, Staphylococcus
EQSKAQ

SEQ ID NO: 1938945 - protein, 8 aa, Staphylococcus
EQSKQRHK

SEQ ID NO: 1938946 - protein, 10 aa, Staphylococcus
EQSKVTKEKL

SEQ ID NO: 1938947 - protein, 15 aa, Staphylococcus
EQSLGQALKQTNVDR

SEQ ID NO: 1938948 - protein, 14 aa, Staphylococcus
EQSLKPGDKLPSNL

SEQ ID NO: 1938949 - protein, 6 aa, Staphylococcus
EQSNKI

SEQ ID NO: 1938950 - protein, 13 aa, Staphylococcus
EQSNNQTNNKNTM

SEQ ID NO: 1938951 - protein, 14 aa, Staphylococcus
EQSQNTSDNEEHSN

SEQ ID NO: 1938952 - protein, 8 aa, Staphylococcus
EQSRLQDD

SEQ ID NO: 1938953 - protein, 5 aa, Staphylococcus
EQSSG

SEQ ID NO: 1938954 - protein, 5 aa, Staphylococcus
EQSSL

SEQ ID NO: 1938955 - protein, 6 aa, Staphylococcus
EQSSLG

SEQ ID NO: 1938956 - protein, 12 aa, Staphylococcus
EQSTMNESKYCP

SEQ ID NO: 1938957 - protein, 10 aa, Staphylococcus
EQSTMNESRY

SEQ ID NO: 1938958 - protein, 13 aa, Staphylococcus
EQSTYQNMTIYDF

SEQ ID NO: 1938959 - protein, 8 aa, Staphylococcus
EQSVPTKL

SEQ ID NO: 1938960 - protein, 14 aa, Staphylococcus
EQSYEYKPKPYEKD

SEQ ID NO: 1938961 - protein, 16 aa, Staphylococcus
EQSYTENPKKGKAKRA

SEQ ID NO: 1938962 - protein, 9 aa, Staphylococcus
EQTATVNSF

SEQ ID NO: 1938963 - protein, 10 aa, Staphylococcus
EQTDDGVPNT

SEQ ID NO: 1938964 - protein, 7 aa, Staphylococcus
EQTDENY

SEQ ID NO: 1938965 - protein, 10 aa, Staphylococcus
EQTDVPESSD

SEQ ID NO: 1938966 - protein, 11 aa, Staphylococcus
EQTDVPESSEW

SEQ ID NO: 1938967 - protein, 9 aa, Staphylococcus
EQTEGRGRF

SEQ ID NO: 1938968 - protein, 5 aa, Staphylococcus
EQTEI

SEQ ID NO: 1938969 - protein, 7 aa, Staphylococcus
EQTENGM

SEQ ID NO: 1938970 - protein, 8 aa, Staphylococcus
EQTETRLE

SEQ ID NO: 1938971 - protein, 8 aa, Staphylococcus
EQTGPSSA

SEQ ID NO: 1938972 - protein, 8 aa, Staphylococcus
EQTGPSTA

SEQ ID NO: 1938973 - protein, 5 aa, Staphylococcus
EQTGQ

SEQ ID NO: 1938974 - protein, 9 aa, Staphylococcus
EQTGYQKPM

SEQ ID NO: 1938975 - protein, 12 aa, Staphylococcus
EQTINQVDERSY

SEQ ID NO: 1938976 - protein, 13 aa, Staphylococcus
EQTISSSDYRYDE

SEQ ID NO: 1938977 - protein, 12 aa, Staphylococcus
EQTKDVDNDKSL

SEQ ID NO: 1938978 - protein, 8 aa, Staphylococcus
EQTKGRGR

SEQ ID NO: 1938979 - protein, 6 aa, Staphylococcus
EQTKLT

SEQ ID NO: 1938980 - protein, 22 aa, Staphylococcus
EQTKQRYDFNESKDGHSITKDD

SEQ ID NO: 1938981 - protein, 7 aa, Staphylococcus
EQTLDKT

SEQ ID NO: 1938982 - protein, 7 aa, Staphylococcus
EQTNDRR

SEQ ID NO: 1938983 - protein, 5 aa, Staphylococcus
EQTNQ

SEQ ID NO: 1938984 - protein, 7 aa, Staphylococcus
EQTPSNK

SEQ ID NO: 1938985 - protein, 5 aa, Staphylococcus
EQTPV

SEQ ID NO: 1938986 - protein, 9 aa, Staphylococcus
EQTQTEPLL

SEQ ID NO: 1938987 - protein, 13 aa, Staphylococcus
EQTQTLTQQLLTI

SEQ ID NO: 1938988 - protein, 4 aa, Staphylococcus
EQTR

SEQ ID NO: 1938989 - protein, 10 aa, Staphylococcus
EQTRGQGYGT

SEQ ID NO: 1938990 - protein, 15 aa, Staphylococcus
EQTSESKEFSDRDDQ

SEQ ID NO: 1938991 - protein, 8 aa, Staphylococcus
EQTSYTLT

SEQ ID NO: 1938992 - protein, 7 aa, Staphylococcus
EQTTEQE

SEQ ID NO: 1938993 - protein, 11 aa, Staphylococcus
EQTTGEPPPKV

SEQ ID NO: 1938994 - protein, 9 aa, Staphylococcus
EQTTKGPQI

SEQ ID NO: 1938995 - protein, 7 aa, Staphylococcus
EQTVIPG

SEQ ID NO: 1938996 - protein, 4 aa, Staphylococcus
EQTY

SEQ ID NO: 1938997 - protein, 4 aa, Staphylococcus
EQVA

SEQ ID NO: 1938998 - protein, 7 aa, Staphylococcus
EQVAPTI

SEQ ID NO: 1938999 - protein, 58 aa, Staphylococcus
EQVEREKTTDFGKAQHVSAEDGKEKAKKQPIVKGEKIGRNDPCPCGSGKKYKNCHGKE

SEQ ID NO: 1939000 - protein, 8 aa, Staphylococcus
EQVETQDE

SEQ ID NO: 1939001 - protein, 4 aa, Staphylococcus
EQVG

SEQ ID NO: 1939002 - protein, 16 aa, Staphylococcus
EQVITSTQSLEKNDEI

SEQ ID NO: 1939003 - protein, 8 aa, Staphylococcus
EQVKKSDK

SEQ ID NO: 1939004 - protein, 11 aa, Staphylococcus
EQVKNEKDAAV

SEQ ID NO: 1939005 - protein, 4 aa, Staphylococcus
EQVQ

SEQ ID NO: 1939006 - protein, 12 aa, Staphylococcus
EQVRNNDERVEI

SEQ ID NO: 1939007 - protein, 7 aa, Staphylococcus
EQVSDGE

SEQ ID NO: 1939008 - protein, 15 aa, Staphylococcus
EQVSGKNYLQNNDQD

SEQ ID NO: 1939009 - protein, 5 aa, Staphylococcus
EQVSS

SEQ ID NO: 1939010 - protein, 12 aa, Staphylococcus
EQVVEKAQTVEK

SEQ ID NO: 1939011 - protein, 6 aa, Staphylococcus
EQWGSL

SEQ ID NO: 1939012 - protein, 6 aa, Staphylococcus
EQYAED

SEQ ID NO: 1939013 - protein, 7 aa, Staphylococcus
EQYAERQ

SEQ ID NO: 1939014 - protein, 4 aa, Staphylococcus
EQYD

SEQ ID NO: 1939015 - protein, 6 aa, Staphylococcus
EQYDED

SEQ ID NO: 1939016 - protein, 9 aa, Staphylococcus
EQYDKTPAQ

SEQ ID NO: 1939017 - protein, 4 aa, Staphylococcus
EQYE

SEQ ID NO: 1939018 - protein, 5 aa, Staphylococcus
EQYEE

SEQ ID NO: 1939019 - protein, 21 aa, Staphylococcus
EQYEVREEAAKRELEEETGYV

SEQ ID NO: 1939020 - protein, 4 aa, Staphylococcus
EQYG

SEQ ID NO: 1939021 - protein, 7 aa, Staphylococcus
EQYGEAE

SEQ ID NO: 1939022 - protein, 16 aa, Staphylococcus
EQYGSKVEISTSKNIG

SEQ ID NO: 1939023 - protein, 7 aa, Staphylococcus
EQYKSYE

SEQ ID NO: 1939024 - protein, 10 aa, Staphylococcus
EQYNEVNDKQ

SEQ ID NO: 1939025 - protein, 9 aa, Staphylococcus
EQYNKSEAF

SEQ ID NO: 1939026 - protein, 5 aa, Staphylococcus
EQYNL

SEQ ID NO: 1939027 - protein, 6 aa, Staphylococcus
EQYPGY

SEQ ID NO: 1939028 - protein, 6 aa, Staphylococcus
EQYQDE

SEQ ID NO: 1939029 - protein, 5 aa, Staphylococcus
EQYTL

SEQ ID NO: 1939030 - protein, 5 aa, Staphylococcus
EQYTN

SEQ ID NO: 1939031 - protein, 5 aa, Staphylococcus
EQYTT

SEQ ID NO: 1939032 - protein, 9 aa, Staphylococcus
EQYYEKKGT

SEQ ID NO: 1939033 - protein, 5 aa, Staphylococcus
EQYYG

SEQ ID NO: 1939034 - protein, 9 aa, Staphylococcus
ERAAAQNLK

SEQ ID NO: 1939035 - protein, 22 aa, Staphylococcus
ERAARKGRNPQTGKEIEIPASK

SEQ ID NO: 1939036 - protein, 5 aa, Staphylococcus
ERADN

SEQ ID NO: 1939037 - protein, 8 aa, Staphylococcus
ERAEEEME

SEQ ID NO: 1939038 - protein, 8 aa, Staphylococcus
ERAEHAPK

SEQ ID NO: 1939039 - protein, 4 aa, Staphylococcus
ERAG

SEQ ID NO: 1939040 - protein, 12 aa, Staphylococcus
ERAGQKADVEKI

SEQ ID NO: 1939041 - protein, 24 aa, Staphylococcus
ERAGQKADVEKIENSIQKRIDNGT

SEQ ID NO: 1939042 - protein, 24 aa, Staphylococcus
ERAGQKADVEKIKNGIQKRIDNGT

SEQ ID NO: 1939043 - protein, 5 aa, Staphylococcus
ERAKE

SEQ ID NO: 1939044 - protein, 50 aa, Staphylococcus
ERAKENKRKAMGEAERNNYKKNKNIRFSSAEPQRKTNNQHNTPVHENKEI

SEQ ID NO: 1939045 - protein, 12 aa, Staphylococcus
ERAKQLDTTRPL

SEQ ID NO: 1939046 - protein, 4 aa, Staphylococcus
ERAN

SEQ ID NO: 1939047 - protein, 18 aa, Staphylococcus
ERAPLKRNIDQEEVGKTA

SEQ ID NO: 1939048 - protein, 18 aa, Staphylococcus
ERAPLKRNVDQEEVGKTA

SEQ ID NO: 1939049 - protein, 7 aa, Staphylococcus
ERAPRYV

SEQ ID NO: 1939050 - protein, 4 aa, Staphylococcus
ERAT

SEQ ID NO: 1939051 - protein, 5 aa, Staphylococcus
ERATI

SEQ ID NO: 1939052 - protein, 15 aa, Staphylococcus
ERAVRRQKDNEERGI

SEQ ID NO: 1939053 - protein, 18 aa, Staphylococcus
ERDDSSHKEVDEHNSAYE

SEQ ID NO: 1939054 - protein, 20 aa, Staphylococcus
ERDEARKNKDFARADEIRDT

SEQ ID NO: 1939055 - protein, 8 aa, Staphylococcus
ERDEGTVS

SEQ ID NO: 1939056 - protein, 4 aa, Staphylococcus
ERDG

SEQ ID NO: 1939057 - protein, 12 aa, Staphylococcus
ERDGKTIKQSIK

SEQ ID NO: 1939058 - protein, 8 aa, Staphylococcus
ERDHEDIE

SEQ ID NO: 1939059 - protein, 5 aa, Staphylococcus
ERDIG

SEQ ID NO: 1939060 - protein, 9 aa, Staphylococcus
ERDKIENEY

SEQ ID NO: 1939061 - protein, 11 aa, Staphylococcus
ERDKKTKDYSK

SEQ ID NO: 1939062 - protein, 11 aa, Staphylococcus
ERDLTKTPEMG

SEQ ID NO: 1939063 - protein, 17 aa, Staphylococcus
ERDLTKTPEMGKQASRA

SEQ ID NO: 1939064 - protein, 25 aa, Staphylococcus
ERDNKQSNEPSKDEDDEKLKKDREQ

SEQ ID NO: 1939065 - protein, 6 aa, Staphylococcus
ERDPYA

SEQ ID NO: 1939066 - protein, 4 aa, Staphylococcus
ERDR

SEQ ID NO: 1939067 - protein, 11 aa, Staphylococcus
ERDRKVEKDYS

SEQ ID NO: 1939068 - protein, 8 aa, Staphylococcus
ERDTEAFR

SEQ ID NO: 1939069 - protein, 5 aa, Staphylococcus
ERDVT

SEQ ID NO: 1939070 - protein, 5 aa, Staphylococcus
ERDYE

SEQ ID NO: 1939071 - protein, 5 aa, Staphylococcus
ERDYY

SEQ ID NO: 1939072 - protein, 4 aa, Staphylococcus
EREA

SEQ ID NO: 1939073 - protein, 5 aa, Staphylococcus
EREAE

SEQ ID NO: 1939074 - protein, 5 aa, Staphylococcus
EREAG

SEQ ID NO: 1939075 - protein, 7 aa, Staphylococcus
EREDYNP

SEQ ID NO: 1939076 - protein, 4 aa, Staphylococcus
EREE

SEQ ID NO: 1939077 - protein, 9 aa, Staphylococcus
EREEYGYKG

SEQ ID NO: 1939078 - protein, 14 aa, Staphylococcus
EREGISRDEVRERM

SEQ ID NO: 1939079 - protein, 6 aa, Staphylococcus
EREGVR

SEQ ID NO: 1939080 - protein, 5 aa, Staphylococcus
EREGY

SEQ ID NO: 1939081 - protein, 4 aa, Staphylococcus
EREI

SEQ ID NO: 1939082 - protein, 5 aa, Staphylococcus
EREIG

SEQ ID NO: 1939083 - protein, 8 aa, Staphylococcus
EREIGPQG

SEQ ID NO: 1939084 - protein, 7 aa, Staphylococcus
EREIGSE

SEQ ID NO: 1939085 - protein, 6 aa, Staphylococcus
EREKAI

SEQ ID NO: 1939086 - protein, 4 aa, Staphylococcus
EREL

SEQ ID NO: 1939087 - protein, 8 aa, Staphylococcus
ERELEPGA

SEQ ID NO: 1939088 - protein, 9 aa, Staphylococcus
ERELGTPFK

SEQ ID NO: 1939089 - protein, 10 aa, Staphylococcus
EREMNAANDN

SEQ ID NO: 1939090 - protein, 7 aa, Staphylococcus
ERENGGT

SEQ ID NO: 1939091 - protein, 10 aa, Staphylococcus
ERENKKGDKV

SEQ ID NO: 1939092 - protein, 11 aa, Staphylococcus
EREQEQTKDNT

SEQ ID NO: 1939093 - protein, 7 aa, Staphylococcus
EREQGKI

SEQ ID NO: 1939094 - protein, 5 aa, Staphylococcus
EREQV

SEQ ID NO: 1939095 - protein, 9 aa, Staphylococcus
ERESTNQYQ

SEQ ID NO: 1939096 - protein, 27 aa, Staphylococcus
ERETEKDRDTEATVDGPVNSGGTLEST

SEQ ID NO: 1939097 - protein, 10 aa, Staphylococcus
ERETKKGEKI

SEQ ID NO: 1939098 - protein, 13 aa, Staphylococcus
ERETRRGKKLNHR

SEQ ID NO: 1939099 - protein, 4 aa, Staphylococcus
EREV

SEQ ID NO: 1939100 - protein, 4 aa, Staphylococcus
ERFD

SEQ ID NO: 1939101 - protein, 4 aa, Staphylococcus
ERFG

SEQ ID NO: 1939102 - protein, 6 aa, Staphylococcus
ERFGAP

SEQ ID NO: 1939103 - protein, 7 aa, Staphylococcus
ERFGEPK

SEQ ID NO: 1939104 - protein, 5 aa, Staphylococcus
ERFGK

SEQ ID NO: 1939105 - protein, 7 aa, Staphylococcus
ERFGKPK

SEQ ID NO: 1939106 - protein, 8 aa, Staphylococcus
ERFGQPKA

SEQ ID NO: 1939107 - protein, 6 aa, Staphylococcus
ERFKDS

SEQ ID NO: 1939108 - protein, 15 aa, Staphylococcus
ERFKSNYKTQSEYTY

SEQ ID NO: 1939109 - protein, 4 aa, Staphylococcus
ERFP

SEQ ID NO: 1939110 - protein, 10 aa, Staphylococcus
ERFTGDDQVG

SEQ ID NO: 1939111 - protein, 4 aa, Staphylococcus
ERGA

SEQ ID NO: 1939112 - protein, 10 aa, Staphylococcus
ERGENGPYYA

SEQ ID NO: 1939113 - protein, 8 aa, Staphylococcus
ERGEQGAY

SEQ ID NO: 1939114 - protein, 14 aa, Staphylococcus
ERGGASASGHGNSV

SEQ ID NO: 1939115 - protein, 9 aa, Staphylococcus
ERGGEKSKN

SEQ ID NO: 1939116 - protein, 5 aa, Staphylococcus
ERGIE

SEQ ID NO: 1939117 - protein, 4 aa, Staphylococcus
ERGK

SEQ ID NO: 1939118 - protein, 9 aa, Staphylococcus
ERGKHYGAT

SEQ ID NO: 1939119 - protein, 7 aa, Staphylococcus
ERGKYDD

SEQ ID NO: 1939120 - protein, 5 aa, Staphylococcus
ERGLT

SEQ ID NO: 1939121 - protein, 15 aa, Staphylococcus
ERGLTDEPEGGLRCR

SEQ ID NO: 1939122 - protein, 4 aa, Staphylococcus
ERGP

SEQ ID NO: 1939123 - protein, 7 aa, Staphylococcus
ERGPSRS

SEQ ID NO: 1939124 - protein, 11 aa, Staphylococcus
ERGQIKRGDTI

SEQ ID NO: 1939125 - protein, 10 aa, Staphylococcus
ERGQLPNNIS

SEQ ID NO: 1939126 - protein, 6 aa, Staphylococcus
ERGQQY

SEQ ID NO: 1939127 - protein, 10 aa, Staphylococcus
ERGSKLSPHY

SEQ ID NO: 1939128 - protein, 6 aa, Staphylococcus
ERGTEI

SEQ ID NO: 1939129 - protein, 5 aa, Staphylococcus
ERGTY

SEQ ID NO: 1939130 - protein, 19 aa, Staphylococcus
ERGVTVTNTPEVLTETTAE

SEQ ID NO: 1939131 - protein, 7 aa, Staphylococcus
ERGYNPV

SEQ ID NO: 1939132 - protein, 22 aa, Staphylococcus
ERGYQLSKTEYRGREATDFKED

SEQ ID NO: 1939133 - protein, 22 aa, Staphylococcus
ERGYQLSKTEYRGREATDFQEE

SEQ ID NO: 1939134 - protein, 7 aa, Staphylococcus
ERHDGEL

SEQ ID NO: 1939135 - protein, 12 aa, Staphylococcus
ERHEAASQTSFE

SEQ ID NO: 1939136 - protein, 10 aa, Staphylococcus
ERHEDSEVTS

SEQ ID NO: 1939137 - protein, 6 aa, Staphylococcus
ERHEDV

SEQ ID NO: 1939138 - protein, 12 aa, Staphylococcus
ERHEGNKHNGLG

SEQ ID NO: 1939139 - protein, 8 aa, Staphylococcus
ERHGKEAT

SEQ ID NO: 1939140 - protein, 8 aa, Staphylococcus
ERHKGSLP

SEQ ID NO: 1939141 - protein, 8 aa, Staphylococcus
ERHKGSMP

SEQ ID NO: 1939142 - protein, 10 aa, Staphylococcus
ERHKGSMPKE

SEQ ID NO: 1939143 - protein, 12 aa, Staphylococcus
ERHNLTKGRLQR

SEQ ID NO: 1939144 - protein, 4 aa, Staphylococcus
ERHS

SEQ ID NO: 1939145 - protein, 5 aa, Staphylococcus
ERHYP

SEQ ID NO: 1939146 - protein, 6 aa, Staphylococcus
ERIDRN

SEQ ID NO: 1939147 - protein, 7 aa, Staphylococcus
ERIEKAK

SEQ ID NO: 1939148 - protein, 8 aa, Staphylococcus
ERIEKAPN

SEQ ID NO: 1939149 - protein, 14 aa, Staphylococcus
ERIERNKQRQKESE

SEQ ID NO: 1939150 - protein, 4 aa, Staphylococcus
ERIG

SEQ ID NO: 1939151 - protein, 9 aa, Staphylococcus
ERIGDNAAN

SEQ ID NO: 1939152 - protein, 8 aa, Staphylococcus
ERIKSKPY

SEQ ID NO: 1939153 - protein, 8 aa, Staphylococcus
ERIKSLKN

SEQ ID NO: 1939154 - protein, 7 aa, Staphylococcus
ERINNTR

SEQ ID NO: 1939155 - protein, 13 aa, Staphylococcus
ERISSTNKGSVTS

SEQ ID NO: 1939156 - protein, 5 aa, Staphylococcus
ERKAT

SEQ ID NO: 1939157 - protein, 8 aa, Staphylococcus
ERKDKYRI

SEQ ID NO: 1939158 - protein, 4 aa, Staphylococcus
ERKE

SEQ ID NO: 1939159 - protein, 8 aa, Staphylococcus
ERKFPNNE

SEQ ID NO: 1939160 - protein, 9 aa, Staphylococcus
ERKGESYTY

SEQ ID NO: 1939161 - protein, 11 aa, Staphylococcus
ERKGKTQTDMA

SEQ ID NO: 1939162 - protein, 8 aa, Staphylococcus
ERKGKYQV

SEQ ID NO: 1939163 - protein, 25 aa, Staphylococcus
ERKGKYQVENKVSEKEKLQGKAKKE

SEQ ID NO: 1939164 - protein, 10 aa, Staphylococcus
ERKGQSYTYD

SEQ ID NO: 1939165 - protein, 16 aa, Staphylococcus
ERKGRDKKQVSVYAAA

SEQ ID NO: 1939166 - protein, 9 aa, Staphylococcus
ERKGTSYTF

SEQ ID NO: 1939167 - protein, 7 aa, Staphylococcus
ERKGVKQ

SEQ ID NO: 1939168 - protein, 23 aa, Staphylococcus
ERKKNQSATNARYEEEQDNLQQQ

SEQ ID NO: 1939169 - protein, 19 aa, Staphylococcus
ERKKNQSETNARFEEEQNN

SEQ ID NO: 1939170 - protein, 17 aa, Staphylococcus
ERKKNQSETNARYEEEL

SEQ ID NO: 1939171 - protein, 21 aa, Staphylococcus
ERKKNQSQTNARYEEEQSALE

SEQ ID NO: 1939172 - protein, 4 aa, Staphylococcus
ERKL

SEQ ID NO: 1939173 - protein, 13 aa, Staphylococcus
ERKNALKRPPVSN

SEQ ID NO: 1939174 - protein, 12 aa, Staphylococcus
ERKNEADGIAEY

SEQ ID NO: 1939175 - protein, 4 aa, Staphylococcus
ERKQ

SEQ ID NO: 1939176 - protein, 5 aa, Staphylococcus
ERKQA

SEQ ID NO: 1939177 - protein, 7 aa, Staphylococcus
ERKQEAI

SEQ ID NO: 1939178 - protein, 7 aa, Staphylococcus
ERKQKMA

SEQ ID NO: 1939179 - protein, 46 aa, Staphylococcus
ERKQNEVQNRPQSSEDERQEDLSATTLDKVENQNISQVNEDNESTL

SEQ ID NO: 1939180 - protein, 5 aa, Staphylococcus
ERKRD

SEQ ID NO: 1939181 - protein, 11 aa, Staphylococcus
ERKRDEKLAKT

SEQ ID NO: 1939182 - protein, 19 aa, Staphylococcus
ERKRGSGVSLTGSEAKKRE

SEQ ID NO: 1939183 - protein, 8 aa, Staphylococcus
ERKRGTAV

SEQ ID NO: 1939184 - protein, 11 aa, Staphylococcus
ERKRNEKLAKT

SEQ ID NO: 1939185 - protein, 20 aa, Staphylococcus
ERKRNQSETNARFEEEQESL

SEQ ID NO: 1939186 - protein, 10 aa, Staphylococcus
ERKRSEALAK

SEQ ID NO: 1939187 - protein, 7 aa, Staphylococcus
ERKSEVS

SEQ ID NO: 1939188 - protein, 8 aa, Staphylococcus
ERKTSAYQ

SEQ ID NO: 1939189 - protein, 17 aa, Staphylococcus
ERKYGQSYVDTHTGEIK

SEQ ID NO: 1939190 - protein, 11 aa, Staphylococcus
ERLAKYKQKSK

SEQ ID NO: 1939191 - protein, 16 aa, Staphylococcus
ERLAQTVTQDFSNATE

SEQ ID NO: 1939192 - protein, 4 aa, Staphylococcus
ERLE

SEQ ID NO: 1939193 - protein, 20 aa, Staphylococcus
ERLEGDISENVQTYTDTLSE

SEQ ID NO: 1939194 - protein, 6 aa, Staphylococcus
ERLEGE

SEQ ID NO: 1939195 - protein, 23 aa, Staphylococcus
ERLEKARSVGATHTFNSGNVDPV

SEQ ID NO: 1939196 - protein, 4 aa, Staphylococcus
ERLG

SEQ ID NO: 1939197 - protein, 6 aa, Staphylococcus
ERLGIP

SEQ ID NO: 1939198 - protein, 10 aa, Staphylococcus
ERLGIPKEKM

SEQ ID NO: 1939199 - protein, 11 aa, Staphylococcus
ERLKEDKKQLE

SEQ ID NO: 1939200 - protein, 13 aa, Staphylococcus
ERLKEDKKQLEKV

SEQ ID NO: 1939201 - protein, 10 aa, Staphylococcus
ERLKEEKKQL

SEQ ID NO: 1939202 - protein, 11 aa, Staphylococcus
ERLKEEKKQLE

SEQ ID NO: 1939203 - protein, 12 aa, Staphylococcus
ERLKQARQDYQN

SEQ ID NO: 1939204 - protein, 6 aa, Staphylococcus
ERLNDS

SEQ ID NO: 1939205 - protein, 7 aa, Staphylococcus
ERLNGNP

SEQ ID NO: 1939206 - protein, 14 aa, Staphylococcus
ERLNNSDVKLNNTQ

SEQ ID NO: 1939207 - protein, 18 aa, Staphylococcus
ERLNQSEELDMAPTSRDD

SEQ ID NO: 1939208 - protein, 11 aa, Staphylococcus
ERLNQSGYETN

SEQ ID NO: 1939209 - protein, 11 aa, Staphylococcus
ERLRSSRQLST

SEQ ID NO: 1939210 - protein, 4 aa, Staphylococcus
ERLS

SEQ ID NO: 1939211 - protein, 6 aa, Staphylococcus
ERLSER

SEQ ID NO: 1939212 - protein, 8 aa, Staphylococcus
ERLTDRQD

SEQ ID NO: 1939213 - protein, 6 aa, Staphylococcus
ERLTKA

SEQ ID NO: 1939214 - protein, 6 aa, Staphylococcus
ERMGDN

SEQ ID NO: 1939215 - protein, 11 aa, Staphylococcus
ERMNQNAAGLD

SEQ ID NO: 1939216 - protein, 6 aa, Staphylococcus
ERMQNA

SEQ ID NO: 1939217 - protein, 7 aa, Staphylococcus
ERMTSAE

SEQ ID NO: 1939218 - protein, 16 aa, Staphylococcus
ERNADKLEGTPISDSE

SEQ ID NO: 1939219 - protein, 8 aa, Staphylococcus
ERNAEERE

SEQ ID NO: 1939220 - protein, 5 aa, Staphylococcus
ERNAN

SEQ ID NO: 1939221 - protein, 4 aa, Staphylococcus
ERND

SEQ ID NO: 1939222 - protein, 9 aa, Staphylococcus
ERNDEDEPL

SEQ ID NO: 1939223 - protein, 16 aa, Staphylococcus
ERNEARKNKDFARADE

SEQ ID NO: 1939224 - protein, 20 aa, Staphylococcus
ERNEARKNKDFARADEIRDQ

SEQ ID NO: 1939225 - protein, 22 aa, Staphylococcus
ERNEARKNKDFARADEIRDTLK

SEQ ID NO: 1939226 - protein, 6 aa, Staphylococcus
ERNENM

SEQ ID NO: 1939227 - protein, 8 aa, Staphylococcus
ERNEPSWQ

SEQ ID NO: 1939228 - protein, 11 aa, Staphylococcus
ERNGKTNKITG

SEQ ID NO: 1939229 - protein, 8 aa, Staphylococcus
ERNITNEM

SEQ ID NO: 1939230 - protein, 5 aa, Staphylococcus
ERNKA

SEQ ID NO: 1939231 - protein, 16 aa, Staphylococcus
ERNKENLKNRPLSDTE

SEQ ID NO: 1939232 - protein, 7 aa, Staphylococcus
ERNKGLE

SEQ ID NO: 1939233 - protein, 12 aa, Staphylococcus
ERNKKAEKDYSK

SEQ ID NO: 1939234 - protein, 12 aa, Staphylococcus
ERNKKEEKDYSK

SEQ ID NO: 1939235 - protein, 7 aa, Staphylococcus
ERNNAQQ

SEQ ID NO: 1939236 - protein, 22 aa, Staphylococcus
ERNNARKDKDFARADEIRDQLK

SEQ ID NO: 1939237 - protein, 12 aa, Staphylococcus
ERNNDPYPNEIK

SEQ ID NO: 1939238 - protein, 12 aa, Staphylococcus
ERNNDPYPQELT

SEQ ID NO: 1939239 - protein, 14 aa, Staphylococcus
ERNPLQTSSYGTGQ

SEQ ID NO: 1939240 - protein, 12 aa, Staphylococcus
ERNRTDGSSLEV

SEQ ID NO: 1939241 - protein, 11 aa, Staphylococcus
ERNSKRVDEQR

SEQ ID NO: 1939242 - protein, 57 aa, Staphylococcus
ERNTDELSQDIYPQNEDLEDDSTNIQANVNATQPDGEIKQSKNDNNNITAKSEQTMI

SEQ ID NO: 1939243 - protein, 12 aa, Staphylococcus
ERNTKAEDEPAI

SEQ ID NO: 1939244 - protein, 4 aa, Staphylococcus
ERNY

SEQ ID NO: 1939245 - protein, 11 aa, Staphylococcus
ERNYKDDNNEQ

SEQ ID NO: 1939246 - protein, 11 aa, Staphylococcus
ERNYKDENNEI

SEQ ID NO: 1939247 - protein, 13 aa, Staphylococcus
ERNYKDENNEISS

SEQ ID NO: 1939248 - protein, 11 aa, Staphylococcus
ERNYKDQNNEI

SEQ ID NO: 1939249 - protein, 5 aa, Staphylococcus
ERNYY

SEQ ID NO: 1939250 - protein, 11 aa, Staphylococcus
ERPEIQETTAL

SEQ ID NO: 1939251 - protein, 7 aa, Staphylococcus
ERPELGN

SEQ ID NO: 1939252 - protein, 8 aa, Staphylococcus
ERPELGNQ

SEQ ID NO: 1939253 - protein, 11 aa, Staphylococcus
ERPERNENGNI

SEQ ID NO: 1939254 - protein, 6 aa, Staphylococcus
ERPGQT

SEQ ID NO: 1939255 - protein, 8 aa, Staphylococcus
ERPGVDGK

SEQ ID NO: 1939256 - protein, 7 aa, Staphylococcus
ERPIDDE

SEQ ID NO: 1939257 - protein, 12 aa, Staphylococcus
ERPKPLKSFDTN

SEQ ID NO: 1939258 - protein, 12 aa, Staphylococcus
ERPMAADNKTLG

SEQ ID NO: 1939259 - protein, 13 aa, Staphylococcus
ERPMASDNKTLGR

SEQ ID NO: 1939260 - protein, 8 aa, Staphylococcus
ERPQNDER

SEQ ID NO: 1939261 - protein, 5 aa, Staphylococcus
ERPTH

SEQ ID NO: 1939262 - protein, 5 aa, Staphylococcus
ERPYY

SEQ ID NO: 1939263 - protein, 4 aa, Staphylococcus
ERQA

SEQ ID NO: 1939264 - protein, 4 aa, Staphylococcus
ERQI

SEQ ID NO: 1939265 - protein, 9 aa, Staphylococcus
ERQKEEKAF

SEQ ID NO: 1939266 - protein, 17 aa, Staphylococcus
ERQLEKAKNGEIKDDYI

SEQ ID NO: 1939267 - protein, 17 aa, Staphylococcus
ERQMKTSEIYDIYHNIK

SEQ ID NO: 1939268 - protein, 28 aa, Staphylococcus
ERQNKNIKQDSKESKQNNEEANREKRQK

SEQ ID NO: 1939269 - protein, 5 aa, Staphylococcus
ERQNY

SEQ ID NO: 1939270 - protein, 6 aa, Staphylococcus
ERQQVY

SEQ ID NO: 1939271 - protein, 4 aa, Staphylococcus
ERQR

SEQ ID NO: 1939272 - protein, 5 aa, Staphylococcus
ERQRV

SEQ ID NO: 1939273 - protein, 4 aa, Staphylococcus
ERQS

SEQ ID NO: 1939274 - protein, 9 aa, Staphylococcus
ERQTLNKDL

SEQ ID NO: 1939275 - protein, 4 aa, Staphylococcus
ERQV

SEQ ID NO: 1939276 - protein, 13 aa, Staphylococcus
ERRAKQDGGSITI

SEQ ID NO: 1939277 - protein, 12 aa, Staphylococcus
ERRDDSDHATLS

SEQ ID NO: 1939278 - protein, 10 aa, Staphylococcus
ERRDGSYQQV

SEQ ID NO: 1939279 - protein, 11 aa, Staphylococcus
ERRERDHRKIG

SEQ ID NO: 1939280 - protein, 10 aa, Staphylococcus
ERRERDHRRI

SEQ ID NO: 1939281 - protein, 9 aa, Staphylococcus
ERRGQSYTY

SEQ ID NO: 1939282 - protein, 4 aa, Staphylococcus
ERRH

SEQ ID NO: 1939283 - protein, 14 aa, Staphylococcus
ERRKGKATEEQADE

SEQ ID NO: 1939284 - protein, 14 aa, Staphylococcus
ERRKGKATEEQAKE

SEQ ID NO: 1939285 - protein, 14 aa, Staphylococcus
ERRKGKATEEQAQE

SEQ ID NO: 1939286 - protein, 21 aa, Staphylococcus
ERRLKEKFGSKVDISTSKNIG

SEQ ID NO: 1939287 - protein, 10 aa, Staphylococcus
ERRLKERYGT

SEQ ID NO: 1939288 - protein, 6 aa, Staphylococcus
ERRNNK

SEQ ID NO: 1939289 - protein, 4 aa, Staphylococcus
ERRP

SEQ ID NO: 1939290 - protein, 10 aa, Staphylococcus
ERRPNDAETY

SEQ ID NO: 1939291 - protein, 16 aa, Staphylococcus
ERRQQNSNQDKTNSHY

SEQ ID NO: 1939292 - protein, 9 aa, Staphylococcus
ERRRDEKLA

SEQ ID NO: 1939293 - protein, 32 aa, Staphylococcus
ERRWSRDDQDTSDLAYEASKKAIEDAGIKPND

SEQ ID NO: 1939294 - protein, 11 aa, Staphylococcus
ERSAELAAQKG

SEQ ID NO: 1939295 - protein, 8 aa, Staphylococcus
ERSAKLAG

SEQ ID NO: 1939296 - protein, 10 aa, Staphylococcus
ERSAKLAGRR

SEQ ID NO: 1939297 - protein, 5 aa, Staphylococcus
ERSAV

SEQ ID NO: 1939298 - protein, 9 aa, Staphylococcus
ERSDGEPCN

SEQ ID NO: 1939299 - protein, 9 aa, Staphylococcus
ERSDSASWD

SEQ ID NO: 1939300 - protein, 4 aa, Staphylococcus
ERSE

SEQ ID NO: 1939301 - protein, 7 aa, Staphylococcus
ERSEERP

SEQ ID NO: 1939302 - protein, 41 aa, Staphylococcus
ERSELEQSDSTDNNNGNHIKQPDETKTYKKATSIKKGSKPF

SEQ ID NO: 1939303 - protein, 19 aa, Staphylococcus
ERSELPAEINEQLIVEYYS

SEQ ID NO: 1939304 - protein, 10 aa, Staphylococcus
ERSESGPYYA

SEQ ID NO: 1939305 - protein, 8 aa, Staphylococcus
ERSETDKR

SEQ ID NO: 1939306 - protein, 13 aa, Staphylococcus
ERSFDKDRLSEDI

SEQ ID NO: 1939307 - protein, 4 aa, Staphylococcus
ERSH

SEQ ID NO: 1939308 - protein, 7 aa, Staphylococcus
ERSHPNT

SEQ ID NO: 1939309 - protein, 10 aa, Staphylococcus
ERSKDNEGKS

SEQ ID NO: 1939310 - protein, 6 aa, Staphylococcus
ERSKYE

SEQ ID NO: 1939311 - protein, 4 aa, Staphylococcus
ERSN

SEQ ID NO: 1939312 - protein, 9 aa, Staphylococcus
ERSNHPKTE

SEQ ID NO: 1939313 - protein, 13 aa, Staphylococcus
ERSNSASKYQEQI

SEQ ID NO: 1939314 - protein, 6 aa, Staphylococcus
ERSPET

SEQ ID NO: 1939315 - protein, 12 aa, Staphylococcus
ERSTSNVKRQYP

SEQ ID NO: 1939316 - protein, 7 aa, Staphylococcus
ERSVETA

SEQ ID NO: 1939317 - protein, 4 aa, Staphylococcus
ERTA

SEQ ID NO: 1939318 - protein, 9 aa, Staphylococcus
ERTAKGGFN

SEQ ID NO: 1939319 - protein, 14 aa, Staphylococcus
ERTAMNTPIQGSAA

SEQ ID NO: 1939320 - protein, 10 aa, Staphylococcus
ERTATASELK

SEQ ID NO: 1939321 - protein, 9 aa, Staphylococcus
ERTDEDEPL

SEQ ID NO: 1939322 - protein, 15 aa, Staphylococcus
ERTDNDMTGSFESAE

SEQ ID NO: 1939323 - protein, 7 aa, Staphylococcus
ERTEAIG

SEQ ID NO: 1939324 - protein, 8 aa, Staphylococcus
ERTEGNKR

SEQ ID NO: 1939325 - protein, 5 aa, Staphylococcus
ERTEQ

SEQ ID NO: 1939326 - protein, 19 aa, Staphylococcus
ERTGQNIETIQKDTDRDNF

SEQ ID NO: 1939327 - protein, 19 aa, Staphylococcus
ERTGQSIEKIEQDTDRDNF

SEQ ID NO: 1939328 - protein, 19 aa, Staphylococcus
ERTGQSIEKIQKDTDRDNF

SEQ ID NO: 1939329 - protein, 19 aa, Staphylococcus
ERTGQSIEQIEKDTDRDNF

SEQ ID NO: 1939330 - protein, 19 aa, Staphylococcus
ERTGQSIEQIQKDTDRDNF

SEQ ID NO: 1939331 - protein, 12 aa, Staphylococcus
ERTKISREKDEN

SEQ ID NO: 1939332 - protein, 6 aa, Staphylococcus
ERTKKG

SEQ ID NO: 1939333 - protein, 8 aa, Staphylococcus
ERTKQGRY

SEQ ID NO: 1939334 - protein, 21 aa, Staphylococcus
ERTKTDRYQRKESSKSNSKLI

SEQ ID NO: 1939335 - protein, 21 aa, Staphylococcus
ERTKTDRYQRKQSGKSNSKLV

SEQ ID NO: 1939336 - protein, 11 aa, Staphylococcus
ERTKTGREQLE

SEQ ID NO: 1939337 - protein, 10 aa, Staphylococcus
ERTNAEIAQP

SEQ ID NO: 1939338 - protein, 10 aa, Staphylococcus
ERTNKEIAQP

SEQ ID NO: 1939339 - protein, 11 aa, Staphylococcus
ERTPRGRKATP

SEQ ID NO: 1939340 - protein, 21 aa, Staphylococcus
ERTPRGRKATPFAYEHFKKTK

SEQ ID NO: 1939341 - protein, 12 aa, Staphylococcus
ERTPRGRKATPY

SEQ ID NO: 1939342 - protein, 6 aa, Staphylococcus
ERTREV

SEQ ID NO: 1939343 - protein, 7 aa, Staphylococcus
ERTRQER

SEQ ID NO: 1939344 - protein, 7 aa, Staphylococcus
ERTSNKM

SEQ ID NO: 1939345 - protein, 10 aa, Staphylococcus
ERTTNMSGEI

SEQ ID NO: 1939346 - protein, 5 aa, Staphylococcus
ERTVG

SEQ ID NO: 1939347 - protein, 9 aa, Staphylococcus
ERVDGNDPI

SEQ ID NO: 1939348 - protein, 20 aa, Staphylococcus
ERVDTNGRVKYKNVEIKITY

SEQ ID NO: 1939349 - protein, 7 aa, Staphylococcus
ERVEDGK

SEQ ID NO: 1939350 - protein, 10 aa, Staphylococcus
ERVEKADAGD

SEQ ID NO: 1939351 - protein, 6 aa, Staphylococcus
ERVERN

SEQ ID NO: 1939352 - protein, 6 aa, Staphylococcus
ERVETE

SEQ ID NO: 1939353 - protein, 10 aa, Staphylococcus
ERVGHSDYKT

SEQ ID NO: 1939354 - protein, 8 aa, Staphylococcus
ERVGSQGE

SEQ ID NO: 1939355 - protein, 9 aa, Staphylococcus
ERVNNQPLP

SEQ ID NO: 1939356 - protein, 9 aa, Staphylococcus
ERVNQSKYR

SEQ ID NO: 1939357 - protein, 9 aa, Staphylococcus
ERVQKDKPV

SEQ ID NO: 1939358 - protein, 6 aa, Staphylococcus
ERWGPR

SEQ ID NO: 1939359 - protein, 5 aa, Staphylococcus
ERYAP

SEQ ID NO: 1939360 - protein, 4 aa, Staphylococcus
ERYD

SEQ ID NO: 1939361 - protein, 7 aa, Staphylococcus
ERYDGNP

SEQ ID NO: 1939362 - protein, 9 aa, Staphylococcus
ERYDRSSTI

SEQ ID NO: 1939363 - protein, 13 aa, Staphylococcus
ERYDTKHTHGTGC

SEQ ID NO: 1939364 - protein, 8 aa, Staphylococcus
ERYENGKY

SEQ ID NO: 1939365 - protein, 12 aa, Staphylococcus
ERYGDERKTEIQ

SEQ ID NO: 1939366 - protein, 8 aa, Staphylococcus
ERYGEEQS

SEQ ID NO: 1939367 - protein, 12 aa, Staphylococcus
ERYGSDKPDTRF

SEQ ID NO: 1939368 - protein, 7 aa, Staphylococcus
ERYNNGK

SEQ ID NO: 1939369 - protein, 6 aa, Staphylococcus
ERYPKA

SEQ ID NO: 1939370 - protein, 6 aa, Staphylococcus
ERYQAY

SEQ ID NO: 1939371 - protein, 8 aa, Staphylococcus
ERYQQQQH

SEQ ID NO: 1939372 - protein, 14 aa, Staphylococcus
ERYQSGNDDIKAKI

SEQ ID NO: 1939373 - protein, 10 aa, Staphylococcus
ERYRNKREQN

SEQ ID NO: 1939374 - protein, 11 aa, Staphylococcus
ERYRNQREQNQ

SEQ ID NO: 1939375 - protein, 12 aa, Staphylococcus
ERYRQKKGDIKQ

SEQ ID NO: 1939376 - protein, 11 aa, Staphylococcus
ERYRSKREQNQ

SEQ ID NO: 1939377 - protein, 10 aa, Staphylococcus
ERYSEAGSFR

SEQ ID NO: 1939378 - protein, 11 aa, Staphylococcus
ERYTERQGGYT

SEQ ID NO: 1939379 - protein, 8 aa, Staphylococcus
ESADKPSF

SEQ ID NO: 1939380 - protein, 6 aa, Staphylococcus
ESAEAG

SEQ ID NO: 1939381 - protein, 5 aa, Staphylococcus
ESAEG

SEQ ID NO: 1939382 - protein, 7 aa, Staphylococcus
ESAESTL

SEQ ID NO: 1939383 - protein, 10 aa, Staphylococcus
ESAIDNAKAA

SEQ ID NO: 1939384 - protein, 11 aa, Staphylococcus
ESAIDSAKAAA

SEQ ID NO: 1939385 - protein, 12 aa, Staphylococcus
ESAIDSAKASAV

SEQ ID NO: 1939386 - protein, 12 aa, Staphylococcus
ESAIDSGYVTEE

SEQ ID NO: 1939387 - protein, 11 aa, Staphylococcus
ESAINSGYVTE

SEQ ID NO: 1939388 - protein, 12 aa, Staphylococcus
ESAINSGYVTEE

SEQ ID NO: 1939389 - protein, 6 aa, Staphylococcus
ESAIPE

SEQ ID NO: 1939390 - protein, 12 aa, Staphylococcus
ESAIQSGHVTEE

SEQ ID NO: 1939391 - protein, 11 aa, Staphylococcus
ESAIQSGYVTE

SEQ ID NO: 1939392 - protein, 9 aa, Staphylococcus
ESAKARGAK

SEQ ID NO: 1939393 - protein, 9 aa, Staphylococcus
ESAKARGAQ

SEQ ID NO: 1939394 - protein, 11 aa, Staphylococcus
ESAKDKDKQQL

SEQ ID NO: 1939395 - protein, 11 aa, Staphylococcus
ESAKDNEESSL

SEQ ID NO: 1939396 - protein, 12 aa, Staphylococcus
ESAKSAKSFGMS

SEQ ID NO: 1939397 - protein, 19 aa, Staphylococcus
ESAKSGKLSYKITSNAGYS

SEQ ID NO: 1939398 - protein, 12 aa, Staphylococcus
ESAKTAKSFGMD

SEQ ID NO: 1939399 - protein, 7 aa, Staphylococcus
ESALQQE

SEQ ID NO: 1939400 - protein, 12 aa, Staphylococcus
ESALTERYQTTV

SEQ ID NO: 1939401 - protein, 5 aa, Staphylococcus
ESAMT

SEQ ID NO: 1939402 - protein, 10 aa, Staphylococcus
ESANKNTRDI

SEQ ID NO: 1939403 - protein, 11 aa, Staphylococcus
ESANKVENEFR

SEQ ID NO: 1939404 - protein, 17 aa, Staphylococcus
ESANQDHTHFKSRNKEL

SEQ ID NO: 1939405 - protein, 4 aa, Staphylococcus
ESAP

SEQ ID NO: 1939406 - protein, 8 aa, Staphylococcus
ESAPGNFS

SEQ ID NO: 1939407 - protein, 9 aa, Staphylococcus
ESAQARGAE

SEQ ID NO: 1939408 - protein, 9 aa, Staphylococcus
ESAQARGAN

SEQ ID NO: 1939409 - protein, 9 aa, Staphylococcus
ESAQARGAQ

SEQ ID NO: 1939410 - protein, 5 aa, Staphylococcus
ESAQM

SEQ ID NO: 1939411 - protein, 9 aa, Staphylococcus
ESAQTRGAQ

SEQ ID NO: 1939412 - protein, 6 aa, Staphylococcus
ESAQYN

SEQ ID NO: 1939413 - protein, 9 aa, Staphylococcus
ESARGEGGR

SEQ ID NO: 1939414 - protein, 6 aa, Staphylococcus
ESARPY

SEQ ID NO: 1939415 - protein, 12 aa, Staphylococcus
ESASEVKQVLDK

SEQ ID NO: 1939416 - protein, 8 aa, Staphylococcus
ESASNETI

SEQ ID NO: 1939417 - protein, 9 aa, Staphylococcus
ESASPPQTC

SEQ ID NO: 1939418 - protein, 5 aa, Staphylococcus
ESCGG

SEQ ID NO: 1939419 - protein, 8 aa, Staphylococcus
ESDAKEDI

SEQ ID NO: 1939420 - protein, 5 aa, Staphylococcus
ESDAN

SEQ ID NO: 1939421 - protein, 8 aa, Staphylococcus
ESDDFTKG

SEQ ID NO: 1939422 - protein, 5 aa, Staphylococcus
ESDDY

SEQ ID NO: 1939423 - protein, 4 aa, Staphylococcus
ESDE

SEQ ID NO: 1939424 - protein, 7 aa, Staphylococcus
ESDEDLL

SEQ ID NO: 1939425 - protein, 8 aa, Staphylococcus
ESDEEAEY

SEQ ID NO: 1939426 - protein, 17 aa, Staphylococcus
ESDEEREAGKANEVVGN

SEQ ID NO: 1939427 - protein, 17 aa, Staphylococcus
ESDEERESGKANEVVGN

SEQ ID NO: 1939428 - protein, 10 aa, Staphylococcus
ESDEGKEKIK

SEQ ID NO: 1939429 - protein, 6 aa, Staphylococcus
ESDELV

SEQ ID NO: 1939430 - protein, 6 aa, Staphylococcus
ESDENL

SEQ ID NO: 1939431 - protein, 7 aa, Staphylococcus
ESDEQMR

SEQ ID NO: 1939432 - protein, 14 aa, Staphylococcus
ESDERDTDSKSSGF

SEQ ID NO: 1939433 - protein, 14 aa, Staphylococcus
ESDEREHSTKSSGF

SEQ ID NO: 1939434 - protein, 7 aa, Staphylococcus
ESDERFA

SEQ ID NO: 1939435 - protein, 8 aa, Staphylococcus
ESDERVEP

SEQ ID NO: 1939436 - protein, 9 aa, Staphylococcus
ESDFKGVPN

SEQ ID NO: 1939437 - protein, 19 aa, Staphylococcus
ESDFNKPINDFSGGQKTRL

SEQ ID NO: 1939438 - protein, 8 aa, Staphylococcus
ESDGENLT

SEQ ID NO: 1939439 - protein, 7 aa, Staphylococcus
ESDGFEN

SEQ ID NO: 1939440 - protein, 6 aa, Staphylococcus
ESDGIL

SEQ ID NO: 1939441 - protein, 8 aa, Staphylococcus
ESDGLSAV

SEQ ID NO: 1939442 - protein, 9 aa, Staphylococcus
ESDGLSQLK

SEQ ID NO: 1939443 - protein, 9 aa, Staphylococcus
ESDGLSQVE

SEQ ID NO: 1939444 - protein, 7 aa, Staphylococcus
ESDHLSA

SEQ ID NO: 1939445 - protein, 8 aa, Staphylococcus
ESDHVTKD

SEQ ID NO: 1939446 - protein, 7 aa, Staphylococcus
ESDIDRS

SEQ ID NO: 1939447 - protein, 7 aa, Staphylococcus
ESDINRS

SEQ ID NO: 1939448 - protein, 4 aa, Staphylococcus
ESDK

SEQ ID NO: 1939449 - protein, 9 aa, Staphylococcus
ESDKPGPTI

SEQ ID NO: 1939450 - protein, 7 aa, Staphylococcus
ESDNDKI

SEQ ID NO: 1939451 - protein, 12 aa, Staphylococcus
ESDNDLDGYMFY

SEQ ID NO: 1939452 - protein, 22 aa, Staphylococcus
ESDNIGEQVKNGIKEKAKQGKL

SEQ ID NO: 1939453 - protein, 23 aa, Staphylococcus
ESDNIGEQVKNGLREKAKQGKLI

SEQ ID NO: 1939454 - protein, 6 aa, Staphylococcus
ESDQDV

SEQ ID NO: 1939455 - protein, 7 aa, Staphylococcus
ESDQQKV

SEQ ID NO: 1939456 - protein, 5 aa, Staphylococcus
ESDRD

SEQ ID NO: 1939457 - protein, 8 aa, Staphylococcus
ESDRVAQL

SEQ ID NO: 1939458 - protein, 8 aa, Staphylococcus
ESDTDKVA

SEQ ID NO: 1939459 - protein, 7 aa, Staphylococcus
ESDTPAI

SEQ ID NO: 1939460 - protein, 11 aa, Staphylococcus
ESDTSTGKALR

SEQ ID NO: 1939461 - protein, 8 aa, Staphylococcus
ESDYKGDY

SEQ ID NO: 1939462 - protein, 10 aa, Staphylococcus
ESDYPTDSEG

SEQ ID NO: 1939463 - protein, 9 aa, Staphylococcus
ESDYQSVET

SEQ ID NO: 1939464 - protein, 19 aa, Staphylococcus
ESEAGTVVTTTEKDFDTQD

SEQ ID NO: 1939465 - protein, 5 aa, Staphylococcus
ESEDV

SEQ ID NO: 1939466 - protein, 6 aa, Staphylococcus
ESEDVN

SEQ ID NO: 1939467 - protein, 5 aa, Staphylococcus
ESEET

SEQ ID NO: 1939468 - protein, 7 aa, Staphylococcus
ESEGERA

SEQ ID NO: 1939469 - protein, 10 aa, Staphylococcus
ESEGKQIHPT

SEQ ID NO: 1939470 - protein, 5 aa, Staphylococcus
ESEGN

SEQ ID NO: 1939471 - protein, 6 aa, Staphylococcus
ESEGPI

SEQ ID NO: 1939472 - protein, 14 aa, Staphylococcus
ESEGSVFQTTSDSE

SEQ ID NO: 1939473 - protein, 8 aa, Staphylococcus
ESEGTPTS

SEQ ID NO: 1939474 - protein, 19 aa, Staphylococcus
ESEIKTQLDESETTESDAI

SEQ ID NO: 1939475 - protein, 4 aa, Staphylococcus
ESEK

SEQ ID NO: 1939476 - protein, 5 aa, Staphylococcus
ESEKI

SEQ ID NO: 1939477 - protein, 10 aa, Staphylococcus
ESEKTVHDDA

SEQ ID NO: 1939478 - protein, 4 aa, Staphylococcus
ESEL

SEQ ID NO: 1939479 - protein, 12 aa, Staphylococcus
ESELDEVSEGRA

SEQ ID NO: 1939480 - protein, 5 aa, Staphylococcus
ESELE

SEQ ID NO: 1939481 - protein, 11 aa, Staphylococcus
ESELEKARHED

SEQ ID NO: 1939482 - protein, 5 aa, Staphylococcus
ESELS

SEQ ID NO: 1939483 - protein, 6 aa, Staphylococcus
ESENIV

SEQ ID NO: 1939484 - protein, 10 aa, Staphylococcus
ESEPATESPL

SEQ ID NO: 1939485 - protein, 4 aa, Staphylococcus
ESEQ

SEQ ID NO: 1939486 - protein, 7 aa, Staphylococcus
ESEQTPE

SEQ ID NO: 1939487 - protein, 9 aa, Staphylococcus
ESEQTTKSG

SEQ ID NO: 1939488 - protein, 4 aa, Staphylococcus
ESES

SEQ ID NO: 1939489 - protein, 5 aa, Staphylococcus
ESESE

SEQ ID NO: 1939490 - protein, 12 aa, Staphylococcus
ESESRNANYEKT

SEQ ID NO: 1939491 - protein, 8 aa, Staphylococcus
ESESTPTS

SEQ ID NO: 1939492 - protein, 9 aa, Staphylococcus
ESETSNEAN

SEQ ID NO: 1939493 - protein, 14 aa, Staphylococcus
ESEVAKEKDGTTVS

SEQ ID NO: 1939494 - protein, 15 aa, Staphylococcus
ESEVAMEKDGTSVSV

SEQ ID NO: 1939495 - protein, 15 aa, Staphylococcus
ESEVKQQTKQDKAQL

SEQ ID NO: 1939496 - protein, 15 aa, Staphylococcus
ESEVKSHHSQDKGEL

SEQ ID NO: 1939497 - protein, 15 aa, Staphylococcus
ESEVQDQHVQDKGQL

SEQ ID NO: 1939498 - protein, 9 aa, Staphylococcus
ESEYASPSM

SEQ ID NO: 1939499 - protein, 8 aa, Staphylococcus
ESFATADG

SEQ ID NO: 1939500 - protein, 10 aa, Staphylococcus
ESFATDQGQQ

SEQ ID NO: 1939501 - protein, 6 aa, Staphylococcus
ESFDQP

SEQ ID NO: 1939502 - protein, 4 aa, Staphylococcus
ESFE

SEQ ID NO: 1939503 - protein, 5 aa, Staphylococcus
ESFGA

SEQ ID NO: 1939504 - protein, 6 aa, Staphylococcus
ESFNTN

SEQ ID NO: 1939505 - protein, 4 aa, Staphylococcus
ESFP

SEQ ID NO: 1939506 - protein, 5 aa, Staphylococcus
ESFPE

SEQ ID NO: 1939507 - protein, 5 aa, Staphylococcus
ESFTR

SEQ ID NO: 1939508 - protein, 8 aa, Staphylococcus
ESFVDGEG

SEQ ID NO: 1939509 - protein, 5 aa, Staphylococcus
ESFYG

SEQ ID NO: 1939510 - protein, 10 aa, Staphylococcus
ESGAGKSHTA

SEQ ID NO: 1939511 - protein, 8 aa, Staphylococcus
ESGAGKTV

SEQ ID NO: 1939512 - protein, 7 aa, Staphylococcus
ESGARPV

SEQ ID NO: 1939513 - protein, 12 aa, Staphylococcus
ESGCGKSSAGRS

SEQ ID NO: 1939514 - protein, 8 aa, Staphylococcus
ESGDKPSF

SEQ ID NO: 1939515 - protein, 4 aa, Staphylococcus
ESGE

SEQ ID NO: 1939516 - protein, 13 aa, Staphylococcus
ESGEDIKVALGET

SEQ ID NO: 1939517 - protein, 7 aa, Staphylococcus
ESGEHKE

SEQ ID NO: 1939518 - protein, 5 aa, Staphylococcus
ESGEV

SEQ ID NO: 1939519 - protein, 9 aa, Staphylococcus
ESGGKTTEN

SEQ ID NO: 1939520 - protein, 5 aa, Staphylococcus
ESGIN

SEQ ID NO: 1939521 - protein, 11 aa, Staphylococcus
ESGKEKATYLP

SEQ ID NO: 1939522 - protein, 10 aa, Staphylococcus
ESGKSLGEHP

SEQ ID NO: 1939523 - protein, 9 aa, Staphylococcus
ESGKVTSCR

SEQ ID NO: 1939524 - protein, 10 aa, Staphylococcus
ESGLGGADGI

SEQ ID NO: 1939525 - protein, 7 aa, Staphylococcus
ESGMRKE

SEQ ID NO: 1939526 - protein, 19 aa, Staphylococcus
ESGNAESENTTTQDVYQSN

SEQ ID NO: 1939527 - protein, 13 aa, Staphylococcus
ESGNGTSNFASGR

SEQ ID NO: 1939528 - protein, 6 aa, Staphylococcus
ESGQAQ

SEQ ID NO: 1939529 - protein, 5 aa, Staphylococcus
ESGQR

SEQ ID NO: 1939530 - protein, 6 aa, Staphylococcus
ESGRPI

SEQ ID NO: 1939531 - protein, 9 aa, Staphylococcus
ESGRWSAYG

SEQ ID NO: 1939532 - protein, 8 aa, Staphylococcus
ESGSPTDI

SEQ ID NO: 1939533 - protein, 8 aa, Staphylococcus
ESGTGAGV

SEQ ID NO: 1939534 - protein, 9 aa, Staphylococcus
ESGTGAGVR

SEQ ID NO: 1939535 - protein, 7 aa, Staphylococcus
ESGTPTA

SEQ ID NO: 1939536 - protein, 8 aa, Staphylococcus
ESGWGQKE

SEQ ID NO: 1939537 - protein, 6 aa, Staphylococcus
ESGYRS

SEQ ID NO: 1939538 - protein, 12 aa, Staphylococcus
ESHAAEKPNPAV

SEQ ID NO: 1939539 - protein, 4 aa, Staphylococcus
ESHK

SEQ ID NO: 1939540 - protein, 6 aa, Staphylococcus
ESHNAY

SEQ ID NO: 1939541 - protein, 9 aa, Staphylococcus
ESHNSKPSL

SEQ ID NO: 1939542 - protein, 18 aa, Staphylococcus
ESHPDFKSKLKEGKSYPR

SEQ ID NO: 1939543 - protein, 11 aa, Staphylococcus
ESHPDMPSTVT

SEQ ID NO: 1939544 - protein, 8 aa, Staphylococcus
ESHPEKAT

SEQ ID NO: 1939545 - protein, 10 aa, Staphylococcus
ESHPKMPSTI

SEQ ID NO: 1939546 - protein, 12 aa, Staphylococcus
ESHPLQEEEHIQ

SEQ ID NO: 1939547 - protein, 13 aa, Staphylococcus
ESHPLQEEEQIQG

SEQ ID NO: 1939548 - protein, 10 aa, Staphylococcus
ESHPNMPKTV

SEQ ID NO: 1939549 - protein, 10 aa, Staphylococcus
ESHPNMPSTI

SEQ ID NO: 1939550 - protein, 11 aa, Staphylococcus
ESHPNMPSTVT

SEQ ID NO: 1939551 - protein, 4 aa, Staphylococcus
ESHQ

SEQ ID NO: 1939552 - protein, 9 aa, Staphylococcus
ESHSEEGQI

SEQ ID NO: 1939553 - protein, 7 aa, Staphylococcus
ESHSEGL

SEQ ID NO: 1939554 - protein, 40 aa, Staphylococcus
ESHSGSKRQTIQPKAKPTQKRGFSKRTTSSKKQVTSSDWK

SEQ ID NO: 1939555 - protein, 6 aa, Staphylococcus
ESHSKK

SEQ ID NO: 1939556 - protein, 4 aa, Staphylococcus
ESHT

SEQ ID NO: 1939557 - protein, 9 aa, Staphylococcus
ESHTGQPRD

SEQ ID NO: 1939558 - protein, 7 aa, Staphylococcus
ESIASNA

SEQ ID NO: 1939559 - protein, 19 aa, Staphylococcus
ESIDKDKGFGPYRQSERAD

SEQ ID NO: 1939560 - protein, 19 aa, Staphylococcus
ESIDKDKGHGPYRQSERAD

SEQ ID NO: 1939561 - protein, 20 aa, Staphylococcus
ESIDKDKGYGPYRQSERGDI

SEQ ID NO: 1939562 - protein, 10 aa, Staphylococcus
ESIDKGDYPE

SEQ ID NO: 1939563 - protein, 14 aa, Staphylococcus
ESIDSGTVETNNIS

SEQ ID NO: 1939564 - protein, 7 aa, Staphylococcus
ESIDSKE

SEQ ID NO: 1939565 - protein, 10 aa, Staphylococcus
ESIEKGDYPA

SEQ ID NO: 1939566 - protein, 4 aa, Staphylococcus
ESIG

SEQ ID NO: 1939567 - protein, 12 aa, Staphylococcus
ESIHTQSTKEIA

SEQ ID NO: 1939568 - protein, 4 aa, Staphylococcus
ESIK

SEQ ID NO: 1939569 - protein, 12 aa, Staphylococcus
ESIKSSPSSEKK

SEQ ID NO: 1939570 - protein, 4 aa, Staphylococcus
ESIN

SEQ ID NO: 1939571 - protein, 6 aa, Staphylococcus
ESINDV

SEQ ID NO: 1939572 - protein, 5 aa, Staphylococcus
ESIPE

SEQ ID NO: 1939573 - protein, 5 aa, Staphylococcus
ESIPG

SEQ ID NO: 1939574 - protein, 13 aa, Staphylococcus
ESIQQNIKMTLRK

SEQ ID NO: 1939575 - protein, 5 aa, Staphylococcus
ESIRP

SEQ ID NO: 1939576 - protein, 5 aa, Staphylococcus
ESISE

SEQ ID NO: 1939577 - protein, 8 aa, Staphylococcus
ESISEADL

SEQ ID NO: 1939578 - protein, 6 aa, Staphylococcus
ESISRA

SEQ ID NO: 1939579 - protein, 12 aa, Staphylococcus
ESISSDDFEKIE

SEQ ID NO: 1939580 - protein, 4 aa, Staphylococcus
ESIT

SEQ ID NO: 1939581 - protein, 23 aa, Staphylococcus
ESITDKDELKSKLEKELKDEPDI

SEQ ID NO: 1939582 - protein, 6 aa, Staphylococcus
ESITEL

SEQ ID NO: 1939583 - protein, 15 aa, Staphylococcus
ESITGRQIKDSTGEI

SEQ ID NO: 1939584 - protein, 7 aa, Staphylococcus
ESITNED

SEQ ID NO: 1939585 - protein, 7 aa, Staphylococcus
ESITNTD

SEQ ID NO: 1939586 - protein, 8 aa, Staphylococcus
ESITPYEG

SEQ ID NO: 1939587 - protein, 6 aa, Staphylococcus
ESIYDT

SEQ ID NO: 1939588 - protein, 7 aa, Staphylococcus
ESKATDF

SEQ ID NO: 1939589 - protein, 8 aa, Staphylococcus
ESKDNAQA

SEQ ID NO: 1939590 - protein, 8 aa, Staphylococcus
ESKDNYIP

SEQ ID NO: 1939591 - protein, 9 aa, Staphylococcus
ESKEGYDKD

SEQ ID NO: 1939592 - protein, 27 aa, Staphylococcus
ESKEIAQSNYDSIKAQAKAFGRNPNEV

SEQ ID NO: 1939593 - protein, 6 aa, Staphylococcus
ESKEIS

SEQ ID NO: 1939594 - protein, 9 aa, Staphylococcus
ESKETGKKE

SEQ ID NO: 1939595 - protein, 10 aa, Staphylococcus
ESKETGNKEY

SEQ ID NO: 1939596 - protein, 6 aa, Staphylococcus
ESKGDM

SEQ ID NO: 1939597 - protein, 8 aa, Staphylococcus
ESKGNPIY

SEQ ID NO: 1939598 - protein, 14 aa, Staphylococcus
ESKGQKVVSESKEL

SEQ ID NO: 1939599 - protein, 9 aa, Staphylococcus
ESKGWNAEK

SEQ ID NO: 1939600 - protein, 15 aa, Staphylococcus
ESKGYIRRDPTKPRA

SEQ ID NO: 1939601 - protein, 6 aa, Staphylococcus
ESKHPE

SEQ ID NO: 1939602 - protein, 19 aa, Staphylococcus
ESKIANRTINKEKFEQNLP

SEQ ID NO: 1939603 - protein, 10 aa, Staphylococcus
ESKIKKKDYQ

SEQ ID NO: 1939604 - protein, 13 aa, Staphylococcus
ESKIQEGKTVGES

SEQ ID NO: 1939605 - protein, 7 aa, Staphylococcus
ESKKEDF

SEQ ID NO: 1939606 - protein, 12 aa, Staphylococcus
ESKKHAKQEAEA

SEQ ID NO: 1939607 - protein, 14 aa, Staphylococcus
ESKKSSGGKFSTED

SEQ ID NO: 1939608 - protein, 4 aa, Staphylococcus
ESKL

SEQ ID NO: 1939609 - protein, 25 aa, Staphylococcus
ESKLQNPNLEKNDLDNNELINESTE

SEQ ID NO: 1939610 - protein, 7 aa, Staphylococcus
ESKMAKD

SEQ ID NO: 1939611 - protein, 14 aa, Staphylococcus
ESKMQSIHSAISDN

SEQ ID NO: 1939612 - protein, 4 aa, Staphylococcus
ESKN

SEQ ID NO: 1939613 - protein, 7 aa, Staphylococcus
ESKNDNI

SEQ ID NO: 1939614 - protein, 12 aa, Staphylococcus
ESKNKRDAKDNL

SEQ ID NO: 1939615 - protein, 6 aa, Staphylococcus
ESKNRD

SEQ ID NO: 1939616 - protein, 6 aa, Staphylococcus
ESKPGI

SEQ ID NO: 1939617 - protein, 8 aa, Staphylococcus
ESKPRRNQ

SEQ ID NO: 1939618 - protein, 10 aa, Staphylococcus
ESKPSVIKPN

SEQ ID NO: 1939619 - protein, 19 aa, Staphylococcus
ESKQLNIEASEINTDPFNY

SEQ ID NO: 1939620 - protein, 8 aa, Staphylococcus
ESKQSQIK

SEQ ID NO: 1939621 - protein, 8 aa, Staphylococcus
ESKQTPTS

SEQ ID NO: 1939622 - protein, 14 aa, Staphylococcus
ESKRYMEKAKEAGF

SEQ ID NO: 1939623 - protein, 14 aa, Staphylococcus
ESKSGGKSGDYQRK

SEQ ID NO: 1939624 - protein, 28 aa, Staphylococcus
ESKSKYKVEDKEKHTSQYEKSQDKAKKE

SEQ ID NO: 1939625 - protein, 8 aa, Staphylococcus
ESKSNDTM

SEQ ID NO: 1939626 - protein, 8 aa, Staphylococcus
ESKSNETM

SEQ ID NO: 1939627 - protein, 7 aa, Staphylococcus
ESKSQQE

SEQ ID NO: 1939628 - protein, 10 aa, Staphylococcus
ESKSSKIGDE

SEQ ID NO: 1939629 - protein, 15 aa, Staphylococcus
ESKSVNSKQVFPQDT

SEQ ID NO: 1939630 - protein, 8 aa, Staphylococcus
ESKSWDGI

SEQ ID NO: 1939631 - protein, 5 aa, Staphylococcus
ESKTI

SEQ ID NO: 1939632 - protein, 7 aa, Staphylococcus
ESKTYGE

SEQ ID NO: 1939633 - protein, 9 aa, Staphylococcus
ESKYGDTLE

SEQ ID NO: 1939634 - protein, 8 aa, Staphylococcus
ESLANTAQ

SEQ ID NO: 1939635 - protein, 4 aa, Staphylococcus
ESLD

SEQ ID NO: 1939636 - protein, 11 aa, Staphylococcus
ESLDSPESEPI

SEQ ID NO: 1939637 - protein, 17 aa, Staphylococcus
ESLDTDRLRNQLDMIQF

SEQ ID NO: 1939638 - protein, 6 aa, Staphylococcus
ESLDYE

SEQ ID NO: 1939639 - protein, 8 aa, Staphylococcus
ESLEEARE

SEQ ID NO: 1939640 - protein, 11 aa, Staphylococcus
ESLENTKSAVE

SEQ ID NO: 1939641 - protein, 7 aa, Staphylococcus
ESLEQQK

SEQ ID NO: 1939642 - protein, 6 aa, Staphylococcus
ESLETH

SEQ ID NO: 1939643 - protein, 6 aa, Staphylococcus
ESLETQ

SEQ ID NO: 1939644 - protein, 10 aa, Staphylococcus
ESLGGETNFD

SEQ ID NO: 1939645 - protein, 9 aa, Staphylococcus
ESLGGPNQL

SEQ ID NO: 1939646 - protein, 4 aa, Staphylococcus
ESLK

SEQ ID NO: 1939647 - protein, 14 aa, Staphylococcus
ESLKESQEKNDVDL

SEQ ID NO: 1939648 - protein, 14 aa, Staphylococcus
ESLKQSQEKNDVDL

SEQ ID NO: 1939649 - protein, 10 aa, Staphylococcus
ESLPEGARFD

SEQ ID NO: 1939650 - protein, 5 aa, Staphylococcus
ESLPG

SEQ ID NO: 1939651 - protein, 8 aa, Staphylococcus
ESLPIHSS

SEQ ID NO: 1939652 - protein, 10 aa, Staphylococcus
ESLPKDKSNY

SEQ ID NO: 1939653 - protein, 6 aa, Staphylococcus
ESLPNL

SEQ ID NO: 1939654 - protein, 11 aa, Staphylococcus
ESLRDEDLREE

SEQ ID NO: 1939655 - protein, 14 aa, Staphylococcus
ESLRHKEQSDEETF

SEQ ID NO: 1939656 - protein, 4 aa, Staphylococcus
ESLS

SEQ ID NO: 1939657 - protein, 5 aa, Staphylococcus
ESLSA

SEQ ID NO: 1939658 - protein, 10 aa, Staphylococcus
ESLSGTITPQ

SEQ ID NO: 1939659 - protein, 10 aa, Staphylococcus
ESLSGTVTPQ

SEQ ID NO: 1939660 - protein, 6 aa, Staphylococcus
ESLSNQ

SEQ ID NO: 1939661 - protein, 10 aa, Staphylococcus
ESLSTNNKTQ

SEQ ID NO: 1939662 - protein, 4 aa, Staphylococcus
ESLT

SEQ ID NO: 1939663 - protein, 7 aa, Staphylococcus
ESLTPTL

SEQ ID NO: 1939664 - protein, 5 aa, Staphylococcus
ESLTQ

SEQ ID NO: 1939665 - protein, 5 aa, Staphylococcus
ESLTT

SEQ ID NO: 1939666 - protein, 7 aa, Staphylococcus
ESLTTKN

SEQ ID NO: 1939667 - protein, 4 aa, Staphylococcus
ESLY

SEQ ID NO: 1939668 - protein, 4 aa, Staphylococcus
ESMD

SEQ ID NO: 1939669 - protein, 6 aa, Staphylococcus
ESMENR

SEQ ID NO: 1939670 - protein, 7 aa, Staphylococcus
ESMGAKG

SEQ ID NO: 1939671 - protein, 7 aa, Staphylococcus
ESMKTTV

SEQ ID NO: 1939672 - protein, 6 aa, Staphylococcus
ESMNGH

SEQ ID NO: 1939673 - protein, 10 aa, Staphylococcus
ESMNNDGITE

SEQ ID NO: 1939674 - protein, 14 aa, Staphylococcus
ESMSAREAAEAIQE

SEQ ID NO: 1939675 - protein, 11 aa, Staphylococcus
ESMSKSNAQEF

SEQ ID NO: 1939676 - protein, 8 aa, Staphylococcus
ESNAKGPF

SEQ ID NO: 1939677 - protein, 4 aa, Staphylococcus
ESND

SEQ ID NO: 1939678 - protein, 6 aa, Staphylococcus
ESNDEV

SEQ ID NO: 1939679 - protein, 7 aa, Staphylococcus
ESNDFKT

SEQ ID NO: 1939680 - protein, 12 aa, Staphylococcus
ESNDFSPLPEGE

SEQ ID NO: 1939681 - protein, 13 aa, Staphylococcus
ESNDKFPSKRQLS

SEQ ID NO: 1939682 - protein, 9 aa, Staphylococcus
ESNDKNPLR

SEQ ID NO: 1939683 - protein, 7 aa, Staphylococcus
ESNDMAD

SEQ ID NO: 1939684 - protein, 4 aa, Staphylococcus
ESNE

SEQ ID NO: 1939685 - protein, 8 aa, Staphylococcus
ESNEENEK

SEQ ID NO: 1939686 - protein, 8 aa, Staphylococcus
ESNELSSE

SEQ ID NO: 1939687 - protein, 9 aa, Staphylococcus
ESNEPIESL

SEQ ID NO: 1939688 - protein, 12 aa, Staphylococcus
ESNETWSPDNTI

SEQ ID NO: 1939689 - protein, 4 aa, Staphylococcus
ESNF

SEQ ID NO: 1939690 - protein, 5 aa, Staphylococcus
ESNGD

SEQ ID NO: 1939691 - protein, 12 aa, Staphylococcus
ESNGLSQVEDNT

SEQ ID NO: 1939692 - protein, 5 aa, Staphylococcus
ESNGN

SEQ ID NO: 1939693 - protein, 8 aa, Staphylococcus
ESNHYTDH

SEQ ID NO: 1939694 - protein, 15 aa, Staphylococcus
ESNIKALASDKGLEI

SEQ ID NO: 1939695 - protein, 6 aa, Staphylococcus
ESNKDV

SEQ ID NO: 1939696 - protein, 9 aa, Staphylococcus
ESNKEGPAI

SEQ ID NO: 1939697 - protein, 6 aa, Staphylococcus
ESNLDE

SEQ ID NO: 1939698 - protein, 5 aa, Staphylococcus
ESNLH

SEQ ID NO: 1939699 - protein, 9 aa, Staphylococcus
ESNLKKQEL

SEQ ID NO: 1939700 - protein, 7 aa, Staphylococcus
ESNLPGV

SEQ ID NO: 1939701 - protein, 10 aa, Staphylococcus
ESNMSRPLSQ

SEQ ID NO: 1939702 - protein, 16 aa, Staphylococcus
ESNNRPEHIDPNKSSK

SEQ ID NO: 1939703 - protein, 9 aa, Staphylococcus
ESNPNEALP

SEQ ID NO: 1939704 - protein, 4 aa, Staphylococcus
ESNQ

SEQ ID NO: 1939705 - protein, 6 aa, Staphylococcus
ESNQFN

SEQ ID NO: 1939706 - protein, 8 aa, Staphylococcus
ESNQHEVQ

SEQ ID NO: 1939707 - protein, 8 aa, Staphylococcus
ESNQLNKG

SEQ ID NO: 1939708 - protein, 6 aa, Staphylococcus
ESNQST

SEQ ID NO: 1939709 - protein, 6 aa, Staphylococcus
ESNRRN

SEQ ID NO: 1939710 - protein, 7 aa, Staphylococcus
ESNRTSR

SEQ ID NO: 1939711 - protein, 11 aa, Staphylococcus
ESNSEGNHKDF

SEQ ID NO: 1939712 - protein, 8 aa, Staphylococcus
ESNSNETM

SEQ ID NO: 1939713 - protein, 7 aa, Staphylococcus
ESNSQNL

SEQ ID NO: 1939714 - protein, 6 aa, Staphylococcus
ESNTHR

SEQ ID NO: 1939715 - protein, 8 aa, Staphylococcus
ESNVGAEQ

SEQ ID NO: 1939716 - protein, 16 aa, Staphylococcus
ESNYAEPLKNTTSISL

SEQ ID NO: 1939717 - protein, 10 aa, Staphylococcus
ESNYASNRGA

SEQ ID NO: 1939718 - protein, 5 aa, Staphylococcus
ESNYR

SEQ ID NO: 1939719 - protein, 4 aa, Staphylococcus
ESPE

SEQ ID NO: 1939720 - protein, 7 aa, Staphylococcus
ESPERVE

SEQ ID NO: 1939721 - protein, 9 aa, Staphylococcus
ESPHSDIPN

SEQ ID NO: 1939722 - protein, 11 aa, Staphylococcus
ESPIGGDHRPY

SEQ ID NO: 1939723 - protein, 12 aa, Staphylococcus
ESPIGGDNRPFS

SEQ ID NO: 1939724 - protein, 12 aa, Staphylococcus
ESPKFKNAESKL

SEQ ID NO: 1939725 - protein, 12 aa, Staphylococcus
ESPKFKNTESKL

SEQ ID NO: 1939726 - protein, 11 aa, Staphylococcus
ESPMNDNGYDI

SEQ ID NO: 1939727 - protein, 12 aa, Staphylococcus
ESPNDDNGYDIS

SEQ ID NO: 1939728 - protein, 17 aa, Staphylococcus
ESPNQPNECCDNDSDLS

SEQ ID NO: 1939729 - protein, 10 aa, Staphylococcus
ESPNYTNDEV

SEQ ID NO: 1939730 - protein, 7 aa, Staphylococcus
ESPPTYN

SEQ ID NO: 1939731 - protein, 5 aa, Staphylococcus
ESPQG

SEQ ID NO: 1939732 - protein, 6 aa, Staphylococcus
ESPSLE

SEQ ID NO: 1939733 - protein, 11 aa, Staphylococcus
ESPTFAQKVEE

SEQ ID NO: 1939734 - protein, 9 aa, Staphylococcus
ESPTTPGTI

SEQ ID NO: 1939735 - protein, 7 aa, Staphylococcus
ESPVTSN

SEQ ID NO: 1939736 - protein, 4 aa, Staphylococcus
ESPY

SEQ ID NO: 1939737 - protein, 8 aa, Staphylococcus
ESQAGENF

SEQ ID NO: 1939738 - protein, 8 aa, Staphylococcus
ESQDDTNQ

SEQ ID NO: 1939739 - protein, 5 aa, Staphylococcus
ESQDL

SEQ ID NO: 1939740 - protein, 17 aa, Staphylococcus
ESQDNPAAYKNTLGQEI

SEQ ID NO: 1939741 - protein, 19 aa, Staphylococcus
ESQEDDTKGIVDQIKAWVA

SEQ ID NO: 1939742 - protein, 7 aa, Staphylococcus
ESQEQVD

SEQ ID NO: 1939743 - protein, 6 aa, Staphylococcus
ESQGDK

SEQ ID NO: 1939744 - protein, 6 aa, Staphylococcus
ESQGDM

SEQ ID NO: 1939745 - protein, 12 aa, Staphylococcus
ESQGIGTSPKHF

SEQ ID NO: 1939746 - protein, 9 aa, Staphylococcus
ESQHASPSI

SEQ ID NO: 1939747 - protein, 9 aa, Staphylococcus
ESQHGKIEA

SEQ ID NO: 1939748 - protein, 4 aa, Staphylococcus
ESQI

SEQ ID NO: 1939749 - protein, 7 aa, Staphylococcus
ESQISED

SEQ ID NO: 1939750 - protein, 22 aa, Staphylococcus
ESQKLGAKFKQGLEKSRENFQE

SEQ ID NO: 1939751 - protein, 10 aa, Staphylococcus
ESQKRIEDGV

SEQ ID NO: 1939752 - protein, 6 aa, Staphylococcus
ESQKTV

SEQ ID NO: 1939753 - protein, 9 aa, Staphylococcus
ESQKTVLGH

SEQ ID NO: 1939754 - protein, 4 aa, Staphylococcus
ESQL

SEQ ID NO: 1939755 - protein, 8 aa, Staphylococcus
ESQLDKKE

SEQ ID NO: 1939756 - protein, 18 aa, Staphylococcus
ESQLKEKNDAHAKRSLQN

SEQ ID NO: 1939757 - protein, 5 aa, Staphylococcus
ESQMD

SEQ ID NO: 1939758 - protein, 7 aa, Staphylococcus
ESQNEKA

SEQ ID NO: 1939759 - protein, 7 aa, Staphylococcus
ESQNGTG

SEQ ID NO: 1939760 - protein, 7 aa, Staphylococcus
ESQNNIE

SEQ ID NO: 1939761 - protein, 15 aa, Staphylococcus
ESQQGRSYETKLTTN

SEQ ID NO: 1939762 - protein, 9 aa, Staphylococcus
ESQQRIEDG

SEQ ID NO: 1939763 - protein, 6 aa, Staphylococcus
ESQQYE

SEQ ID NO: 1939764 - protein, 16 aa, Staphylococcus
ESQRSEENQETVEITS

SEQ ID NO: 1939765 - protein, 7 aa, Staphylococcus
ESQSDHA

SEQ ID NO: 1939766 - protein, 12 aa, Staphylococcus
ESQSGNKSQKIQ

SEQ ID NO: 1939767 - protein, 11 aa, Staphylococcus
ESQSHSTLPYT

SEQ ID NO: 1939768 - protein, 8 aa, Staphylococcus
ESQSNETM

SEQ ID NO: 1939769 - protein, 10 aa, Staphylococcus
ESQSPYDEGR

SEQ ID NO: 1939770 - protein, 12 aa, Staphylococcus
ESQSYSSLPYKQ

SEQ ID NO: 1939771 - protein, 10 aa, Staphylococcus
ESQSYSTLPY

SEQ ID NO: 1939772 - protein, 11 aa, Staphylococcus
ESQSYSTLPYQ

SEQ ID NO: 1939773 - protein, 9 aa, Staphylococcus
ESQSYTKLP

SEQ ID NO: 1939774 - protein, 8 aa, Staphylococcus
ESQTDRLT

SEQ ID NO: 1939775 - protein, 8 aa, Staphylococcus
ESQTNRLT

SEQ ID NO: 1939776 - protein, 15 aa, Staphylococcus
ESQVKNQTTKDTGQL

SEQ ID NO: 1939777 - protein, 8 aa, Staphylococcus
ESQVNKDE

SEQ ID NO: 1939778 - protein, 7 aa, Staphylococcus
ESQWKES

SEQ ID NO: 1939779 - protein, 7 aa, Staphylococcus
ESRCTHY

SEQ ID NO: 1939780 - protein, 8 aa, Staphylococcus
ESREDRLT

SEQ ID NO: 1939781 - protein, 6 aa, Staphylococcus
ESRGFK

SEQ ID NO: 1939782 - protein, 6 aa, Staphylococcus
ESRGYD

SEQ ID NO: 1939783 - protein, 6 aa, Staphylococcus
ESRIEG

SEQ ID NO: 1939784 - protein, 7 aa, Staphylococcus
ESRKEEG

SEQ ID NO: 1939785 - protein, 8 aa, Staphylococcus
ESRKLSPE

SEQ ID NO: 1939786 - protein, 9 aa, Staphylococcus
ESRKLSPER

SEQ ID NO: 1939787 - protein, 8 aa, Staphylococcus
ESRKLSPQ

SEQ ID NO: 1939788 - protein, 5 aa, Staphylococcus
ESRKT

SEQ ID NO: 1939789 - protein, 12 aa, Staphylococcus
ESRNGQKRTRTM

SEQ ID NO: 1939790 - protein, 8 aa, Staphylococcus
ESRTDRLT

SEQ ID NO: 1939791 - protein, 8 aa, Staphylococcus
ESRTERLT

SEQ ID NO: 1939792 - protein, 6 aa, Staphylococcus
ESRTFE

SEQ ID NO: 1939793 - protein, 5 aa, Staphylococcus
ESRTI

SEQ ID NO: 1939794 - protein, 10 aa, Staphylococcus
ESRVDKRVET

SEQ ID NO: 1939795 - protein, 5 aa, Staphylococcus
ESRYK

SEQ ID NO: 1939796 - protein, 6 aa, Staphylococcus
ESSAAQ

SEQ ID NO: 1939797 - protein, 13 aa, Staphylococcus
ESSAPRAQESQDN

SEQ ID NO: 1939798 - protein, 10 aa, Staphylococcus
ESSDQSQLKG

SEQ ID NO: 1939799 - protein, 19 aa, Staphylococcus
ESSDRKQLEEAYAKYKAGE

SEQ ID NO: 1939800 - protein, 6 aa, Staphylococcus
ESSEER

SEQ ID NO: 1939801 - protein, 8 aa, Staphylococcus
ESSEFEDK

SEQ ID NO: 1939802 - protein, 5 aa, Staphylococcus
ESSEN

SEQ ID NO: 1939803 - protein, 4 aa, Staphylococcus
ESSF

SEQ ID NO: 1939804 - protein, 7 aa, Staphylococcus
ESSFNTA

SEQ ID NO: 1939805 - protein, 7 aa, Staphylococcus
ESSIYQE

SEQ ID NO: 1939806 - protein, 8 aa, Staphylococcus
ESSKEAEH

SEQ ID NO: 1939807 - protein, 9 aa, Staphylococcus
ESSKLENST

SEQ ID NO: 1939808 - protein, 17 aa, Staphylococcus
ESSKNDDELKISESQLR

SEQ ID NO: 1939809 - protein, 16 aa, Staphylococcus
ESSKRVAEQFKNKGYN

SEQ ID NO: 1939810 - protein, 10 aa, Staphylococcus
ESSKSDKLQI

SEQ ID NO: 1939811 - protein, 69 aa, Staphylococcus
ESSLENKEQSAVEKPFPENPYTANSNTESAYTESQNINNTNNNNTNNNNTNSNNSGSNGMSGNNINSMP

SEQ ID NO: 1939812 - protein, 20 aa, Staphylococcus
ESSNETEKSVEEKESNPIEK

SEQ ID NO: 1939813 - protein, 9 aa, Staphylococcus
ESSNGKPYD

SEQ ID NO: 1939814 - protein, 7 aa, Staphylococcus
ESSNPSI

SEQ ID NO: 1939815 - protein, 11 aa, Staphylococcus
ESSNQKMTENI

SEQ ID NO: 1939816 - protein, 7 aa, Staphylococcus
ESSPDSC

SEQ ID NO: 1939817 - protein, 6 aa, Staphylococcus
ESSPIT

SEQ ID NO: 1939818 - protein, 8 aa, Staphylococcus
ESSPQCNI

SEQ ID NO: 1939819 - protein, 6 aa, Staphylococcus
ESSQDR

SEQ ID NO: 1939820 - protein, 9 aa, Staphylococcus
ESSQHNRED

SEQ ID NO: 1939821 - protein, 29 aa, Staphylococcus
ESSRFKRSSNNSQSNDYRSHNNKSNSRMK

SEQ ID NO: 1939822 - protein, 12 aa, Staphylococcus
ESSRFNKSTLGS

SEQ ID NO: 1939823 - protein, 8 aa, Staphylococcus
ESSRKTPF

SEQ ID NO: 1939824 - protein, 8 aa, Staphylococcus
ESSTAGDS

SEQ ID NO: 1939825 - protein, 5 aa, Staphylococcus
ESSTI

SEQ ID NO: 1939826 - protein, 7 aa, Staphylococcus
ESSTQTL

SEQ ID NO: 1939827 - protein, 5 aa, Staphylococcus
ESSTV

SEQ ID NO: 1939828 - protein, 4 aa, Staphylococcus
ESSV

SEQ ID NO: 1939829 - protein, 8 aa, Staphylococcus
ESSYTYED

SEQ ID NO: 1939830 - protein, 7 aa, Staphylococcus
ESSYVNS

SEQ ID NO: 1939831 - protein, 7 aa, Staphylococcus
ESTAQHY

SEQ ID NO: 1939832 - protein, 17 aa, Staphylococcus
ESTASQIADDIVKWIFE

SEQ ID NO: 1939833 - protein, 4 aa, Staphylococcus
ESTC

SEQ ID NO: 1939834 - protein, 6 aa, Staphylococcus
ESTDGE

SEQ ID NO: 1939835 - protein, 7 aa, Staphylococcus
ESTDIEE

SEQ ID NO: 1939836 - protein, 6 aa, Staphylococcus
ESTDKV

SEQ ID NO: 1939837 - protein, 7 aa, Staphylococcus
ESTDYQD

SEQ ID NO: 1939838 - protein, 20 aa, Staphylococcus
ESTEAAMEETGDLKVPQEEG

SEQ ID NO: 1939839 - protein, 8 aa, Staphylococcus
ESTELDGE

SEQ ID NO: 1939840 - protein, 13 aa, Staphylococcus
ESTETAMEETGDL

SEQ ID NO: 1939841 - protein, 21 aa, Staphylococcus
ESTEVQPTHANGDIKRSEDIY

SEQ ID NO: 1939842 - protein, 4 aa, Staphylococcus
ESTG

SEQ ID NO: 1939843 - protein, 8 aa, Staphylococcus
ESTGPQNG

SEQ ID NO: 1939844 - protein, 7 aa, Staphylococcus
ESTHAQA

SEQ ID NO: 1939845 - protein, 21 aa, Staphylococcus
ESTIKANSRYFNDESEVPKQA

SEQ ID NO: 1939846 - protein, 6 aa, Staphylococcus
ESTINA

SEQ ID NO: 1939847 - protein, 7 aa, Staphylococcus
ESTIRAN

SEQ ID NO: 1939848 - protein, 10 aa, Staphylococcus
ESTISANSRY

SEQ ID NO: 1939849 - protein, 4 aa, Staphylococcus
ESTK

SEQ ID NO: 1939850 - protein, 11 aa, Staphylococcus
ESTKSGGEVTR

SEQ ID NO: 1939851 - protein, 6 aa, Staphylococcus
ESTKTQ

SEQ ID NO: 1939852 - protein, 4 aa, Staphylococcus
ESTM

SEQ ID NO: 1939853 - protein, 4 aa, Staphylococcus
ESTN

SEQ ID NO: 1939854 - protein, 5 aa, Staphylococcus
ESTNI

SEQ ID NO: 1939855 - protein, 12 aa, Staphylococcus
ESTNRAISLYKL

SEQ ID NO: 1939856 - protein, 4 aa, Staphylococcus
ESTQ

SEQ ID NO: 1939857 - protein, 7 aa, Staphylococcus
ESTRDEA

SEQ ID NO: 1939858 - protein, 8 aa, Staphylococcus
ESTRGGAD

SEQ ID NO: 1939859 - protein, 12 aa, Staphylococcus
ESTRPTKNEQME

SEQ ID NO: 1939860 - protein, 8 aa, Staphylococcus
ESTSEETL

SEQ ID NO: 1939861 - protein, 10 aa, Staphylococcus
ESTSFAEAVE

SEQ ID NO: 1939862 - protein, 8 aa, Staphylococcus
ESTSGETL

SEQ ID NO: 1939863 - protein, 11 aa, Staphylococcus
ESTSQKQVKGR

SEQ ID NO: 1939864 - protein, 11 aa, Staphylococcus
ESTTFAEKVEE

SEQ ID NO: 1939865 - protein, 4 aa, Staphylococcus
ESTY

SEQ ID NO: 1939866 - protein, 5 aa, Staphylococcus
ESTYE

SEQ ID NO: 1939867 - protein, 7 aa, Staphylococcus
ESTYNNI

SEQ ID NO: 1939868 - protein, 7 aa, Staphylococcus
ESTYPVE

SEQ ID NO: 1939869 - protein, 18 aa, Staphylococcus
ESVDKDKGYGPYRQSERA

SEQ ID NO: 1939870 - protein, 19 aa, Staphylococcus
ESVDKDKGYGPYRQSERAE

SEQ ID NO: 1939871 - protein, 6 aa, Staphylococcus
ESVEDM

SEQ ID NO: 1939872 - protein, 5 aa, Staphylococcus
ESVEK

SEQ ID NO: 1939873 - protein, 5 aa, Staphylococcus
ESVES

SEQ ID NO: 1939874 - protein, 9 aa, Staphylococcus
ESVGGTPSI

SEQ ID NO: 1939875 - protein, 6 aa, Staphylococcus
ESVGKD

SEQ ID NO: 1939876 - protein, 8 aa, Staphylococcus
ESVGTVSA

SEQ ID NO: 1939877 - protein, 11 aa, Staphylococcus
ESVKNKETEFA

SEQ ID NO: 1939878 - protein, 9 aa, Staphylococcus
ESVKNSMSQ

SEQ ID NO: 1939879 - protein, 10 aa, Staphylococcus
ESVKSRETKF

SEQ ID NO: 1939880 - protein, 12 aa, Staphylococcus
ESVNGQRICLYY

SEQ ID NO: 1939881 - protein, 18 aa, Staphylococcus
ESVNQGKKYGNIKPKPLN

SEQ ID NO: 1939882 - protein, 9 aa, Staphylococcus
ESVPSANAD

SEQ ID NO: 1939883 - protein, 34 aa, Staphylococcus
ESVQQALDEENEMNENQNKSKKSSSSNSKEQIKD

SEQ ID NO: 1939884 - protein, 8 aa, Staphylococcus
ESVQSDNE

SEQ ID NO: 1939885 - protein, 12 aa, Staphylococcus
ESVRKGKGLTDE

SEQ ID NO: 1939886 - protein, 7 aa, Staphylococcus
ESVSEAL

SEQ ID NO: 1939887 - protein, 5 aa, Staphylococcus
ESVSH

SEQ ID NO: 1939888 - protein, 7 aa, Staphylococcus
ESVSQGE

SEQ ID NO: 1939889 - protein, 7 aa, Staphylococcus
ESVSRAP

SEQ ID NO: 1939890 - protein, 14 aa, Staphylococcus
ESVTEGQGTLSDAV

SEQ ID NO: 1939891 - protein, 9 aa, Staphylococcus
ESWETKTPF

SEQ ID NO: 1939892 - protein, 12 aa, Staphylococcus
ESYADARGMLDN

SEQ ID NO: 1939893 - protein, 15 aa, Staphylococcus
ESYDSLSLTGGNAGV

SEQ ID NO: 1939894 - protein, 6 aa, Staphylococcus
ESYGGT

SEQ ID NO: 1939895 - protein, 8 aa, Staphylococcus
ESYKAQGV

SEQ ID NO: 1939896 - protein, 18 aa, Staphylococcus
ESYKNGKFHSYSAQEGTL

SEQ ID NO: 1939897 - protein, 15 aa, Staphylococcus
ESYKQSSDSKLAEIR

SEQ ID NO: 1939898 - protein, 11 aa, Staphylococcus
ESYKSGGKLKG

SEQ ID NO: 1939899 - protein, 10 aa, Staphylococcus
ESYKSTPELS

SEQ ID NO: 1939900 - protein, 4 aa, Staphylococcus
ESYL

SEQ ID NO: 1939901 - protein, 12 aa, Staphylococcus
ESYNSEETQANN

SEQ ID NO: 1939902 - protein, 4 aa, Staphylococcus
ESYR

SEQ ID NO: 1939903 - protein, 5 aa, Staphylococcus
ESYRE

SEQ ID NO: 1939904 - protein, 12 aa, Staphylococcus
ESYSQKKGDIQQ

SEQ ID NO: 1939905 - protein, 17 aa, Staphylococcus
ESYSTHTRSGLGGFEGR

SEQ ID NO: 1939906 - protein, 22 aa, Staphylococcus
ESYSTHTRSKIGGYKGRPLSKG

SEQ ID NO: 1939907 - protein, 14 aa, Staphylococcus
ETAAPLAPGENELE

SEQ ID NO: 1939908 - protein, 12 aa, Staphylococcus
ETADKVSEEKNY

SEQ ID NO: 1939909 - protein, 6 aa, Staphylococcus
ETADQY

SEQ ID NO: 1939910 - protein, 4 aa, Staphylococcus
ETAE

SEQ ID NO: 1939911 - protein, 17 aa, Staphylococcus
ETAGGKVLQRGTKHEGF

SEQ ID NO: 1939912 - protein, 7 aa, Staphylococcus
ETAGNQI

SEQ ID NO: 1939913 - protein, 5 aa, Staphylococcus
ETAGP

SEQ ID NO: 1939914 - protein, 6 aa, Staphylococcus
ETAHRR

SEQ ID NO: 1939915 - protein, 7 aa, Staphylococcus
ETAHTNH

SEQ ID NO: 1939916 - protein, 12 aa, Staphylococcus
ETAIDDNKNHAE

SEQ ID NO: 1939917 - protein, 4 aa, Staphylococcus
ETAK

SEQ ID NO: 1939918 - protein, 10 aa, Staphylococcus
ETAKRSGFVP

SEQ ID NO: 1939919 - protein, 13 aa, Staphylococcus
ETAKSQNIKATSY

SEQ ID NO: 1939920 - protein, 7 aa, Staphylococcus
ETAMKSG

SEQ ID NO: 1939921 - protein, 5 aa, Staphylococcus
ETANE

SEQ ID NO: 1939922 - protein, 31 aa, Staphylococcus
ETANGRKTKRPINPNTGSYAKSNDSSTWSDY

SEQ ID NO: 1939923 - protein, 6 aa, Staphylococcus
ETAQDR

SEQ ID NO: 1939924 - protein, 23 aa, Staphylococcus
ETAQQEHAKAVADNTKAVESNTA

SEQ ID NO: 1939925 - protein, 10 aa, Staphylococcus
ETASTELSQH

SEQ ID NO: 1939926 - protein, 8 aa, Staphylococcus
ETATEEEV

SEQ ID NO: 1939927 - protein, 8 aa, Staphylococcus
ETATGDVF

SEQ ID NO: 1939928 - protein, 20 aa, Staphylococcus
ETATSKIGKPSSVSVNTPAY

SEQ ID NO: 1939929 - protein, 4 aa, Staphylococcus
ETAV

SEQ ID NO: 1939930 - protein, 7 aa, Staphylococcus
ETAVTNG

SEQ ID NO: 1939931 - protein, 16 aa, Staphylococcus
ETCDGSGAKPGSKKKT

SEQ ID NO: 1939932 - protein, 12 aa, Staphylococcus
ETCGDPAEKKIT

SEQ ID NO: 1939933 - protein, 7 aa, Staphylococcus
ETDALSD

SEQ ID NO: 1939934 - protein, 4 aa, Staphylococcus
ETDD

SEQ ID NO: 1939935 - protein, 6 aa, Staphylococcus
ETDDDK

SEQ ID NO: 1939936 - protein, 10 aa, Staphylococcus
ETDDEGQTIH

SEQ ID NO: 1939937 - protein, 16 aa, Staphylococcus
ETDDELNEGDTFGSVE

SEQ ID NO: 1939938 - protein, 11 aa, Staphylococcus
ETDDGQTINPT

SEQ ID NO: 1939939 - protein, 12 aa, Staphylococcus
ETDDKLNGYMFY

SEQ ID NO: 1939940 - protein, 9 aa, Staphylococcus
ETDDNISKE

SEQ ID NO: 1939941 - protein, 13 aa, Staphylococcus
ETDDNVHYQTSGS

SEQ ID NO: 1939942 - protein, 7 aa, Staphylococcus
ETDDQEI

SEQ ID NO: 1939943 - protein, 11 aa, Staphylococcus
ETDDSSSYDDL

SEQ ID NO: 1939944 - protein, 5 aa, Staphylococcus
ETDDV

SEQ ID NO: 1939945 - protein, 10 aa, Staphylococcus
ETDEDAKKEF

SEQ ID NO: 1939946 - protein, 9 aa, Staphylococcus
ETDEDARRE

SEQ ID NO: 1939947 - protein, 16 aa, Staphylococcus
ETDEDLNEGDTFGSVE

SEQ ID NO: 1939948 - protein, 5 aa, Staphylococcus
ETDEE

SEQ ID NO: 1939949 - protein, 12 aa, Staphylococcus
ETDEEAKKLSTS

SEQ ID NO: 1939950 - protein, 18 aa, Staphylococcus
ETDEERENGKANDIVSNQ

SEQ ID NO: 1939951 - protein, 17 aa, Staphylococcus
ETDEERENGKANEIVSN

SEQ ID NO: 1939952 - protein, 31 aa, Staphylococcus
ETDEERENGKANEVVSNQVKEAVKGLSEDQL

SEQ ID NO: 1939953 - protein, 18 aa, Staphylococcus
ETDEERESGKANEVVGNQ

SEQ ID NO: 1939954 - protein, 9 aa, Staphylococcus
ETDEGSKYL

SEQ ID NO: 1939955 - protein, 9 aa, Staphylococcus
ETDEGSRRL

SEQ ID NO: 1939956 - protein, 6 aa, Staphylococcus
ETDELS

SEQ ID NO: 1939957 - protein, 10 aa, Staphylococcus
ETDEQPQHRA

SEQ ID NO: 1939958 - protein, 7 aa, Staphylococcus
ETDESPI

SEQ ID NO: 1939959 - protein, 11 aa, Staphylococcus
ETDESWDPNQT

SEQ ID NO: 1939960 - protein, 12 aa, Staphylococcus
ETDESWDPSNTI

SEQ ID NO: 1939961 - protein, 10 aa, Staphylococcus
ETDETSPLDL

SEQ ID NO: 1939962 - protein, 25 aa, Staphylococcus
ETDEVIPDKNAQPSSDSEDNGSEEE

SEQ ID NO: 1939963 - protein, 21 aa, Staphylococcus
ETDEVIPDKNASSDVTEESDE

SEQ ID NO: 1939964 - protein, 18 aa, Staphylococcus
ETDEVIPDKNASSEDSDE

SEQ ID NO: 1939965 - protein, 20 aa, Staphylococcus
ETDEVIPDKNATSDNEESDE

SEQ ID NO: 1939966 - protein, 21 aa, Staphylococcus
ETDEVIPDKNATSGESDESNE

SEQ ID NO: 1939967 - protein, 19 aa, Staphylococcus
ETDEVIPDRNAQSSDDSEE

SEQ ID NO: 1939968 - protein, 19 aa, Staphylococcus
ETDEVVPDKNASSEQSEDN

SEQ ID NO: 1939969 - protein, 6 aa, Staphylococcus
ETDGRM

SEQ ID NO: 1939970 - protein, 6 aa, Staphylococcus
ETDGVT

SEQ ID NO: 1939971 - protein, 7 aa, Staphylococcus
ETDHDTL

SEQ ID NO: 1939972 - protein, 11 aa, Staphylococcus
ETDHTSTDAQE

SEQ ID NO: 1939973 - protein, 7 aa, Staphylococcus
ETDKHDS

SEQ ID NO: 1939974 - protein, 5 aa, Staphylococcus
ETDKN

SEQ ID NO: 1939975 - protein, 6 aa, Staphylococcus
ETDKNS

SEQ ID NO: 1939976 - protein, 7 aa, Staphylococcus
ETDMDSN

SEQ ID NO: 1939977 - protein, 4 aa, Staphylococcus
ETDN

SEQ ID NO: 1939978 - protein, 6 aa, Staphylococcus
ETDNHQ

SEQ ID NO: 1939979 - protein, 7 aa, Staphylococcus
ETDPETM

SEQ ID NO: 1939980 - protein, 6 aa, Staphylococcus
ETDQDI

SEQ ID NO: 1939981 - protein, 5 aa, Staphylococcus
ETDQI

SEQ ID NO: 1939982 - protein, 7 aa, Staphylococcus
ETDQTSV

SEQ ID NO: 1939983 - protein, 4 aa, Staphylococcus
ETDR

SEQ ID NO: 1939984 - protein, 6 aa, Staphylococcus
ETDREK

SEQ ID NO: 1939985 - protein, 10 aa, Staphylococcus
ETDSGETYTG

SEQ ID NO: 1939986 - protein, 13 aa, Staphylococcus
ETDSLESNKSRMV

SEQ ID NO: 1939987 - protein, 4 aa, Staphylococcus
ETDT

SEQ ID NO: 1939988 - protein, 6 aa, Staphylococcus
ETDTAV

SEQ ID NO: 1939989 - protein, 6 aa, Staphylococcus
ETDTKL

SEQ ID NO: 1939990 - protein, 12 aa, Staphylococcus
ETDTPALPSNQA

SEQ ID NO: 1939991 - protein, 11 aa, Staphylococcus
ETDTSDHTGRT

SEQ ID NO: 1939992 - protein, 7 aa, Staphylococcus
ETDTSPI

SEQ ID NO: 1939993 - protein, 24 aa, Staphylococcus
ETDYEVTQKGEQFKGTEVSRKSVA

SEQ ID NO: 1939994 - protein, 23 aa, Staphylococcus
ETDYEVTSKDTQFRGTEVSRRSI

SEQ ID NO: 1939995 - protein, 5 aa, Staphylococcus
ETDYK

SEQ ID NO: 1939996 - protein, 22 aa, Staphylococcus
ETDYPDVAAEVGKSIQQGENER

SEQ ID NO: 1939997 - protein, 22 aa, Staphylococcus
ETDYPDVAQEVGKNIQKGEHDR

SEQ ID NO: 1939998 - protein, 6 aa, Staphylococcus
ETEAAD

SEQ ID NO: 1939999 - protein, 12 aa, Staphylococcus
ETEADLDGYMFY

SEQ ID NO: 1940000 - protein, 9 aa, Staphylococcus
ETEASISEP

SEQ ID NO: 1940001 - protein, 4 aa, Staphylococcus
ETED

SEQ ID NO: 1940002 - protein, 9 aa, Staphylococcus
ETEDADKAI

SEQ ID NO: 1940003 - protein, 28 aa, Staphylococcus
ETEDDESNNTEPPQSNNNSNIIDFNQYR

SEQ ID NO: 1940004 - protein, 16 aa, Staphylococcus
ETEDDIEESESFGSVE

SEQ ID NO: 1940005 - protein, 10 aa, Staphylococcus
ETEDEVPKQA

SEQ ID NO: 1940006 - protein, 12 aa, Staphylococcus
ETEDGSKIDPAL

SEQ ID NO: 1940007 - protein, 14 aa, Staphylococcus
ETEDGTVMEDGPER

SEQ ID NO: 1940008 - protein, 13 aa, Staphylococcus
ETEDKSVLKHPSS

SEQ ID NO: 1940009 - protein, 7 aa, Staphylococcus
ETEDNHS

SEQ ID NO: 1940010 - protein, 5 aa, Staphylococcus
ETEED

SEQ ID NO: 1940011 - protein, 7 aa, Staphylococcus
ETEEEFD

SEQ ID NO: 1940012 - protein, 18 aa, Staphylococcus
ETEEEFDKRIESYEDIEH

SEQ ID NO: 1940013 - protein, 18 aa, Staphylococcus
ETEEEFDKRIESYEDTDD

SEQ ID NO: 1940014 - protein, 18 aa, Staphylococcus
ETEEEFDKRIESYEDVDH

SEQ ID NO: 1940015 - protein, 18 aa, Staphylococcus
ETEEEFDKRIESYEDVEN

SEQ ID NO: 1940016 - protein, 18 aa, Staphylococcus
ETEEEFDKRIESYEEFDN

SEQ ID NO: 1940017 - protein, 18 aa, Staphylococcus
ETEEEFDKRIESYEEQDN

SEQ ID NO: 1940018 - protein, 7 aa, Staphylococcus
ETEEEQH

SEQ ID NO: 1940019 - protein, 5 aa, Staphylococcus
ETEEF

SEQ ID NO: 1940020 - protein, 6 aa, Staphylococcus
ETEEFE

SEQ ID NO: 1940021 - protein, 7 aa, Staphylococcus
ETEEQAQ

SEQ ID NO: 1940022 - protein, 9 aa, Staphylococcus
ETEERAGFV

SEQ ID NO: 1940023 - protein, 14 aa, Staphylococcus
ETEERTGFASKTDQ

SEQ ID NO: 1940024 - protein, 7 aa, Staphylococcus
ETEESPI

SEQ ID NO: 1940025 - protein, 20 aa, Staphylococcus
ETEEYEAGHIDGAQSYPLSS

SEQ ID NO: 1940026 - protein, 7 aa, Staphylococcus
ETEGKSV

SEQ ID NO: 1940027 - protein, 5 aa, Staphylococcus
ETEGN

SEQ ID NO: 1940028 - protein, 7 aa, Staphylococcus
ETEGPNV

SEQ ID NO: 1940029 - protein, 5 aa, Staphylococcus
ETEGT

SEQ ID NO: 1940030 - protein, 5 aa, Staphylococcus
ETEHK

SEQ ID NO: 1940031 - protein, 12 aa, Staphylococcus
ETEHNPKAYTHT

SEQ ID NO: 1940032 - protein, 4 aa, Staphylococcus
ETEI

SEQ ID NO: 1940033 - protein, 6 aa, Staphylococcus
ETEIES

SEQ ID NO: 1940034 - protein, 8 aa, Staphylococcus
ETEINETD

SEQ ID NO: 1940035 - protein, 6 aa, Staphylococcus
ETEIPN

SEQ ID NO: 1940036 - protein, 6 aa, Staphylococcus
ETEKIK

SEQ ID NO: 1940037 - protein, 5 aa, Staphylococcus
ETEKP

SEQ ID NO: 1940038 - protein, 24 aa, Staphylococcus
ETEKQNNINHNKKKKKQERNNQMR

SEQ ID NO: 1940039 - protein, 9 aa, Staphylococcus
ETELENEKN

SEQ ID NO: 1940040 - protein, 10 aa, Staphylococcus
ETENEINAQQ

SEQ ID NO: 1940041 - protein, 8 aa, Staphylococcus
ETENTPTS

SEQ ID NO: 1940042 - protein, 5 aa, Staphylococcus
ETENY

SEQ ID NO: 1940043 - protein, 4 aa, Staphylococcus
ETEP

SEQ ID NO: 1940044 - protein, 24 aa, Staphylococcus
ETEPGIKGDTATGATKSATVETGY

SEQ ID NO: 1940045 - protein, 9 aa, Staphylococcus
ETEPSDDIN

SEQ ID NO: 1940046 - protein, 9 aa, Staphylococcus
ETEPTNYST

SEQ ID NO: 1940047 - protein, 11 aa, Staphylococcus
ETEPVGYTNQP

SEQ ID NO: 1940048 - protein, 4 aa, Staphylococcus
ETEQ

SEQ ID NO: 1940049 - protein, 5 aa, Staphylococcus
ETEQD

SEQ ID NO: 1940050 - protein, 15 aa, Staphylococcus
ETEQETTNSNTLYTK

SEQ ID NO: 1940051 - protein, 16 aa, Staphylococcus
ETEQSHQLPSDSIEGF

SEQ ID NO: 1940052 - protein, 11 aa, Staphylococcus
ETESEIDAQQL

SEQ ID NO: 1940053 - protein, 8 aa, Staphylococcus
ETESGKPF

SEQ ID NO: 1940054 - protein, 14 aa, Staphylococcus
ETETERKERFARHQ

SEQ ID NO: 1940055 - protein, 10 aa, Staphylococcus
ETETKKERIQ

SEQ ID NO: 1940056 - protein, 6 aa, Staphylococcus
ETETPQ

SEQ ID NO: 1940057 - protein, 8 aa, Staphylococcus
ETETQQDE

SEQ ID NO: 1940058 - protein, 4 aa, Staphylococcus
ETEV

SEQ ID NO: 1940059 - protein, 34 aa, Staphylococcus
ETEVKEQTQENQDENSNDKTKQSKDTDKTFTQEE

SEQ ID NO: 1940060 - protein, 15 aa, Staphylococcus
ETEVQSHHQKDKGQL

SEQ ID NO: 1940061 - protein, 11 aa, Staphylococcus
ETEYEPTPEKE

SEQ ID NO: 1940062 - protein, 5 aa, Staphylococcus
ETEYG

SEQ ID NO: 1940063 - protein, 18 aa, Staphylococcus
ETFDTDASIDVAKNGDII

SEQ ID NO: 1940064 - protein, 18 aa, Staphylococcus
ETFDTDASVDIAKNGDIV

SEQ ID NO: 1940065 - protein, 4 aa, Staphylococcus
ETFE

SEQ ID NO: 1940066 - protein, 4 aa, Staphylococcus
ETFG

SEQ ID NO: 1940067 - protein, 16 aa, Staphylococcus
ETFGDEAITSDGEMNR

SEQ ID NO: 1940068 - protein, 6 aa, Staphylococcus
ETFKGQ

SEQ ID NO: 1940069 - protein, 11 aa, Staphylococcus
ETFKQNIDKND

SEQ ID NO: 1940070 - protein, 5 aa, Staphylococcus
ETFND

SEQ ID NO: 1940071 - protein, 14 aa, Staphylococcus
ETFNEEDEEDLAKS

SEQ ID NO: 1940072 - protein, 5 aa, Staphylococcus
ETFNG

SEQ ID NO: 1940073 - protein, 4 aa, Staphylococcus
ETFP

SEQ ID NO: 1940074 - protein, 4 aa, Staphylococcus
ETFQ

SEQ ID NO: 1940075 - protein, 12 aa, Staphylococcus
ETFQPEDVPHQD

SEQ ID NO: 1940076 - protein, 12 aa, Staphylococcus
ETFRRRRDTFEA

SEQ ID NO: 1940077 - protein, 5 aa, Staphylococcus
ETFTV

SEQ ID NO: 1940078 - protein, 7 aa, Staphylococcus
ETFVESN

SEQ ID NO: 1940079 - protein, 5 aa, Staphylococcus
ETGAI

SEQ ID NO: 1940080 - protein, 14 aa, Staphylococcus
ETGALPDADKFDSA

SEQ ID NO: 1940081 - protein, 8 aa, Staphylococcus
ETGAPTLR

SEQ ID NO: 1940082 - protein, 10 aa, Staphylococcus
ETGDIKDPYG

SEQ ID NO: 1940083 - protein, 18 aa, Staphylococcus
ETGDIKSRTRQHLNADTK

SEQ ID NO: 1940084 - protein, 6 aa, Staphylococcus
ETGDIQ

SEQ ID NO: 1940085 - protein, 4 aa, Staphylococcus
ETGE

SEQ ID NO: 1940086 - protein, 6 aa, Staphylococcus
ETGEAT

SEQ ID NO: 1940087 - protein, 19 aa, Staphylococcus
ETGEGQSTLAKGITDGQQR

SEQ ID NO: 1940088 - protein, 8 aa, Staphylococcus
ETGEHTVK

SEQ ID NO: 1940089 - protein, 8 aa, Staphylococcus
ETGEVKEQ

SEQ ID NO: 1940090 - protein, 8 aa, Staphylococcus
ETGGIPET

SEQ ID NO: 1940091 - protein, 7 aa, Staphylococcus
ETGGTIY

SEQ ID NO: 1940092 - protein, 4 aa, Staphylococcus
ETGI

SEQ ID NO: 1940093 - protein, 4 aa, Staphylococcus
ETGL

SEQ ID NO: 1940094 - protein, 4 aa, Staphylococcus
ETGN

SEQ ID NO: 1940095 - protein, 10 aa, Staphylococcus
ETGPITAGEL

SEQ ID NO: 1940096 - protein, 5 aa, Staphylococcus
ETGQR

SEQ ID NO: 1940097 - protein, 6 aa, Staphylococcus
ETGRTH

SEQ ID NO: 1940098 - protein, 6 aa, Staphylococcus
ETGSIT

SEQ ID NO: 1940099 - protein, 6 aa, Staphylococcus
ETGSRM

SEQ ID NO: 1940100 - protein, 4 aa, Staphylococcus
ETGT

SEQ ID NO: 1940101 - protein, 9 aa, Staphylococcus
ETGTIYSRP

SEQ ID NO: 1940102 - protein, 12 aa, Staphylococcus
ETGVELGERGEI

SEQ ID NO: 1940103 - protein, 13 aa, Staphylococcus
ETGVISETTESAV

SEQ ID NO: 1940104 - protein, 4 aa, Staphylococcus
ETGW

SEQ ID NO: 1940105 - protein, 5 aa, Staphylococcus
ETGYN

SEQ ID NO: 1940106 - protein, 12 aa, Staphylococcus
ETHAAEKPDPKV

SEQ ID NO: 1940107 - protein, 11 aa, Staphylococcus
ETHADKGPLSG

SEQ ID NO: 1940108 - protein, 12 aa, Staphylococcus
ETHAEEKPNPKV

SEQ ID NO: 1940109 - protein, 12 aa, Staphylococcus
ETHAEEKPSPKV

SEQ ID NO: 1940110 - protein, 15 aa, Staphylococcus
ETHDQPVEKLIIATT

SEQ ID NO: 1940111 - protein, 6 aa, Staphylococcus
ETHDTA

SEQ ID NO: 1940112 - protein, 13 aa, Staphylococcus
ETHDWSKEVGDTF

SEQ ID NO: 1940113 - protein, 5 aa, Staphylococcus
ETHEE

SEQ ID NO: 1940114 - protein, 10 aa, Staphylococcus
ETHGVNPRAI

SEQ ID NO: 1940115 - protein, 11 aa, Staphylococcus
ETHHSRAKTYK

SEQ ID NO: 1940116 - protein, 5 aa, Staphylococcus
ETHKR

SEQ ID NO: 1940117 - protein, 10 aa, Staphylococcus
ETHNADQADP

SEQ ID NO: 1940118 - protein, 5 aa, Staphylococcus
ETHNE

SEQ ID NO: 1940119 - protein, 4 aa, Staphylococcus
ETHP

SEQ ID NO: 1940120 - protein, 9 aa, Staphylococcus
ETHQGHGTD

SEQ ID NO: 1940121 - protein, 6 aa, Staphylococcus
ETHSKD

SEQ ID NO: 1940122 - protein, 11 aa, Staphylococcus
ETHVGNPLDGL

SEQ ID NO: 1940123 - protein, 5 aa, Staphylococcus
ETIDE

SEQ ID NO: 1940124 - protein, 6 aa, Staphylococcus
ETIDET

SEQ ID NO: 1940125 - protein, 12 aa, Staphylococcus
ETIDKDKAIATQ

SEQ ID NO: 1940126 - protein, 4 aa, Staphylococcus
ETIE

SEQ ID NO: 1940127 - protein, 7 aa, Staphylococcus
ETIEETT

SEQ ID NO: 1940128 - protein, 11 aa, Staphylococcus
ETIEPSHPGYD

SEQ ID NO: 1940129 - protein, 6 aa, Staphylococcus
ETIGET

SEQ ID NO: 1940130 - protein, 13 aa, Staphylococcus
ETIGGVTTQRRVT

SEQ ID NO: 1940131 - protein, 4 aa, Staphylococcus
ETIK

SEQ ID NO: 1940132 - protein, 5 aa, Staphylococcus
ETIKG

SEQ ID NO: 1940133 - protein, 7 aa, Staphylococcus
ETIKGSK

SEQ ID NO: 1940134 - protein, 13 aa, Staphylococcus
ETIKKSGGDSITV

SEQ ID NO: 1940135 - protein, 5 aa, Staphylococcus
ETIKS

SEQ ID NO: 1940136 - protein, 19 aa, Staphylococcus
ETIKSAKEKKYSKANPYQA

SEQ ID NO: 1940137 - protein, 25 aa, Staphylococcus
ETINDEKEPELYDKDGNLVNKEQTS

SEQ ID NO: 1940138 - protein, 10 aa, Staphylococcus
ETINEADEDK

SEQ ID NO: 1940139 - protein, 16 aa, Staphylococcus
ETINQSEKLVKKTTQN

SEQ ID NO: 1940140 - protein, 4 aa, Staphylococcus
ETIP

SEQ ID NO: 1940141 - protein, 14 aa, Staphylococcus
ETIPNSKLNTNLEE

SEQ ID NO: 1940142 - protein, 14 aa, Staphylococcus
ETIQNELADQDDIS

SEQ ID NO: 1940143 - protein, 5 aa, Staphylococcus
ETIQS

SEQ ID NO: 1940144 - protein, 8 aa, Staphylococcus
ETIQSDNP

SEQ ID NO: 1940145 - protein, 5 aa, Staphylococcus
ETIRS

SEQ ID NO: 1940146 - protein, 9 aa, Staphylococcus
ETISDLGKE

SEQ ID NO: 1940147 - protein, 7 aa, Staphylococcus
ETISSVK

SEQ ID NO: 1940148 - protein, 5 aa, Staphylococcus
ETITD

SEQ ID NO: 1940149 - protein, 5 aa, Staphylococcus
ETITS

SEQ ID NO: 1940150 - protein, 4 aa, Staphylococcus
ETKA

SEQ ID NO: 1940151 - protein, 11 aa, Staphylococcus
ETKANAVKAEG

SEQ ID NO: 1940152 - protein, 5 aa, Staphylococcus
ETKDA

SEQ ID NO: 1940153 - protein, 10 aa, Staphylococcus
ETKDKAQRVK

SEQ ID NO: 1940154 - protein, 12 aa, Staphylococcus
ETKDSPYLEGIK

SEQ ID NO: 1940155 - protein, 4 aa, Staphylococcus
ETKE

SEQ ID NO: 1940156 - protein, 19 aa, Staphylococcus
ETKEPFKATIERSDSCAVP

SEQ ID NO: 1940157 - protein, 4 aa, Staphylococcus
ETKG

SEQ ID NO: 1940158 - protein, 5 aa, Staphylococcus
ETKGA

SEQ ID NO: 1940159 - protein, 9 aa, Staphylococcus
ETKHDREVT

SEQ ID NO: 1940160 - protein, 5 aa, Staphylococcus
ETKHM

SEQ ID NO: 1940161 - protein, 6 aa, Staphylococcus
ETKHTS

SEQ ID NO: 1940162 - protein, 5 aa, Staphylococcus
ETKKH

SEQ ID NO: 1940163 - protein, 5 aa, Staphylococcus
ETKKL

SEQ ID NO: 1940164 - protein, 9 aa, Staphylococcus
ETKNPNTVP

SEQ ID NO: 1940165 - protein, 9 aa, Staphylococcus
ETKNTQDID

SEQ ID NO: 1940166 - protein, 5 aa, Staphylococcus
ETKPE

SEQ ID NO: 1940167 - protein, 8 aa, Staphylococcus
ETKPESVD

SEQ ID NO: 1940168 - protein, 7 aa, Staphylococcus
ETKQLTG

SEQ ID NO: 1940169 - protein, 4 aa, Staphylococcus
ETKR

SEQ ID NO: 1940170 - protein, 5 aa, Staphylococcus
ETKRL

SEQ ID NO: 1940171 - protein, 7 aa, Staphylococcus
ETKRYSS

SEQ ID NO: 1940172 - protein, 8 aa, Staphylococcus
ETKSDQEL

SEQ ID NO: 1940173 - protein, 10 aa, Staphylococcus
ETKSEALRRE

SEQ ID NO: 1940174 - protein, 10 aa, Staphylococcus
ETKSEAMKRE

SEQ ID NO: 1940175 - protein, 5 aa, Staphylococcus
ETKSL

SEQ ID NO: 1940176 - protein, 8 aa, Staphylococcus
ETKSNLKF

SEQ ID NO: 1940177 - protein, 10 aa, Staphylococcus
ETKTIEPFRD

SEQ ID NO: 1940178 - protein, 6 aa, Staphylococcus
ETKTLT

SEQ ID NO: 1940179 - protein, 12 aa, Staphylococcus
ETKTTVNSIEAK

SEQ ID NO: 1940180 - protein, 9 aa, Staphylococcus
ETKTYHKKP

SEQ ID NO: 1940181 - protein, 5 aa, Staphylococcus
ETKVY

SEQ ID NO: 1940182 - protein, 16 aa, Staphylococcus
ETKYQTKLPSTALTEE

SEQ ID NO: 1940183 - protein, 6 aa, Staphylococcus
ETLANQ

SEQ ID NO: 1940184 - protein, 14 aa, Staphylococcus
ETLDTGKTLEESYA

SEQ ID NO: 1940185 - protein, 5 aa, Staphylococcus
ETLED

SEQ ID NO: 1940186 - protein, 13 aa, Staphylococcus
ETLEEDKKVTRIH

SEQ ID NO: 1940187 - protein, 10 aa, Staphylococcus
ETLEEGKPVR

SEQ ID NO: 1940188 - protein, 5 aa, Staphylococcus
ETLEN

SEQ ID NO: 1940189 - protein, 10 aa, Staphylococcus
ETLEQAVKND

SEQ ID NO: 1940190 - protein, 13 aa, Staphylococcus
ETLEQIPQDEHDE

SEQ ID NO: 1940191 - protein, 5 aa, Staphylococcus
ETLKE

SEQ ID NO: 1940192 - protein, 11 aa, Staphylococcus
ETLKEGVKDAT

SEQ ID NO: 1940193 - protein, 11 aa, Staphylococcus
ETLKQGVKDAD

SEQ ID NO: 1940194 - protein, 11 aa, Staphylococcus
ETLKRGVKDAS

SEQ ID NO: 1940195 - protein, 10 aa, Staphylococcus
ETLLPDPLET

SEQ ID NO: 1940196 - protein, 6 aa, Staphylococcus
ETLNDN

SEQ ID NO: 1940197 - protein, 15 aa, Staphylococcus
ETLNEIGKEVNKTAA

SEQ ID NO: 1940198 - protein, 15 aa, Staphylococcus
ETLNQIGKEVNKSAA

SEQ ID NO: 1940199 - protein, 13 aa, Staphylococcus
ETLNQIPEEEHDE

SEQ ID NO: 1940200 - protein, 7 aa, Staphylococcus
ETLNSGE

SEQ ID NO: 1940201 - protein, 9 aa, Staphylococcus
ETLNSINDN

SEQ ID NO: 1940202 - protein, 8 aa, Staphylococcus
ETLPAESA

SEQ ID NO: 1940203 - protein, 10 aa, Staphylococcus
ETLPKDESNY

SEQ ID NO: 1940204 - protein, 9 aa, Staphylococcus
ETLPSESAK

SEQ ID NO: 1940205 - protein, 11 aa, Staphylococcus
ETLQGNGPEDL

SEQ ID NO: 1940206 - protein, 6 aa, Staphylococcus
ETLQPQ

SEQ ID NO: 1940207 - protein, 9 aa, Staphylococcus
ETLQQPTAH

SEQ ID NO: 1940208 - protein, 5 aa, Staphylococcus
ETLRG

SEQ ID NO: 1940209 - protein, 14 aa, Staphylococcus
ETLRPDDKKRASYS

SEQ ID NO: 1940210 - protein, 6 aa, Staphylococcus
ETLSEQ

SEQ ID NO: 1940211 - protein, 6 aa, Staphylococcus
ETLSGA

SEQ ID NO: 1940212 - protein, 8 aa, Staphylococcus
ETLSKNDE

SEQ ID NO: 1940213 - protein, 13 aa, Staphylococcus
ETLSPNKVEQVTR

SEQ ID NO: 1940214 - protein, 23 aa, Staphylococcus
ETLTDELKGNAYEQNEVDRIPSS

SEQ ID NO: 1940215 - protein, 10 aa, Staphylococcus
ETLTTRSGSD

SEQ ID NO: 1940216 - protein, 19 aa, Staphylococcus
ETLYKEDEKDSDKSDEKSK

SEQ ID NO: 1940217 - protein, 24 aa, Staphylococcus
ETLYKEDEKEAEKNANTETSEEDK

SEQ ID NO: 1940218 - protein, 19 aa, Staphylococcus
ETLYSEDEKKDKNDSEDET

SEQ ID NO: 1940219 - protein, 22 aa, Staphylococcus
ETLYSEDEKKERKKQEKQQKEN

SEQ ID NO: 1940220 - protein, 5 aa, Staphylococcus
ETMAK

SEQ ID NO: 1940221 - protein, 4 aa, Staphylococcus
ETME

SEQ ID NO: 1940222 - protein, 7 aa, Staphylococcus
ETMGNPK

SEQ ID NO: 1940223 - protein, 9 aa, Staphylococcus
ETMQQPTAH

SEQ ID NO: 1940224 - protein, 14 aa, Staphylococcus
ETMTTNVQSDKEKF

SEQ ID NO: 1940225 - protein, 11 aa, Staphylococcus
ETNAKKVEDQR

SEQ ID NO: 1940226 - protein, 11 aa, Staphylococcus
ETNANALKAEG

SEQ ID NO: 1940227 - protein, 9 aa, Staphylococcus
ETNARTAEM

SEQ ID NO: 1940228 - protein, 6 aa, Staphylococcus
ETNDAF

SEQ ID NO: 1940229 - protein, 17 aa, Staphylococcus
ETNDISKSLNRGKHTTR

SEQ ID NO: 1940230 - protein, 25 aa, Staphylococcus
ETNDSIPQDDSEATFASNISREDER

SEQ ID NO: 1940231 - protein, 4 aa, Staphylococcus
ETNE

SEQ ID NO: 1940232 - protein, 12 aa, Staphylococcus
ETNEELEDSPEF

SEQ ID NO: 1940233 - protein, 7 aa, Staphylococcus
ETNEGRL

SEQ ID NO: 1940234 - protein, 17 aa, Staphylococcus
ETNEQRESGKAEEVVSD

SEQ ID NO: 1940235 - protein, 13 aa, Staphylococcus
ETNESWDKSNTID

SEQ ID NO: 1940236 - protein, 4 aa, Staphylococcus
ETNH

SEQ ID NO: 1940237 - protein, 7 aa, Staphylococcus
ETNHSKP

SEQ ID NO: 1940238 - protein, 24 aa, Staphylococcus
ETNKDDIAKRQRKLESYKDKERLE

SEQ ID NO: 1940239 - protein, 6 aa, Staphylococcus
ETNKRL

SEQ ID NO: 1940240 - protein, 6 aa, Staphylococcus
ETNKTV

SEQ ID NO: 1940241 - protein, 19 aa, Staphylococcus
ETNNEVSYAESQKEALQTA

SEQ ID NO: 1940242 - protein, 6 aa, Staphylococcus
ETNPDG

SEQ ID NO: 1940243 - protein, 5 aa, Staphylococcus
ETNPL

SEQ ID NO: 1940244 - protein, 10 aa, Staphylococcus
ETNPNDGLET

SEQ ID NO: 1940245 - protein, 16 aa, Staphylococcus
ETNQEKFYNGTTGFQA

SEQ ID NO: 1940246 - protein, 5 aa, Staphylococcus
ETNRE

SEQ ID NO: 1940247 - protein, 11 aa, Staphylococcus
ETNRIETTSDE

SEQ ID NO: 1940248 - protein, 6 aa, Staphylococcus
ETNSSE

SEQ ID NO: 1940249 - protein, 16 aa, Staphylococcus
ETNTGHKVASAETEVE

SEQ ID NO: 1940250 - protein, 7 aa, Staphylococcus
ETNTLTS

SEQ ID NO: 1940251 - protein, 6 aa, Staphylococcus
ETNTPI

SEQ ID NO: 1940252 - protein, 7 aa, Staphylococcus
ETNTVTD

SEQ ID NO: 1940253 - protein, 7 aa, Staphylococcus
ETNYKGE

SEQ ID NO: 1940254 - protein, 6 aa, Staphylococcus
ETNYPQ

SEQ ID NO: 1940255 - protein, 40 aa, Staphylococcus
ETPAKSKRQTITSKSTTPSKRGFSKRTTSTKKQVSASDWK

SEQ ID NO: 1940256 - protein, 4 aa, Staphylococcus
ETPD

SEQ ID NO: 1940257 - protein, 5 aa, Staphylococcus
ETPDE

SEQ ID NO: 1940258 - protein, 7 aa, Staphylococcus
ETPDGQY

SEQ ID NO: 1940259 - protein, 7 aa, Staphylococcus
ETPDHTE

SEQ ID NO: 1940260 - protein, 5 aa, Staphylococcus
ETPDK

SEQ ID NO: 1940261 - protein, 8 aa, Staphylococcus
ETPDNAEG

SEQ ID NO: 1940262 - protein, 6 aa, Staphylococcus
ETPDNK

SEQ ID NO: 1940263 - protein, 8 aa, Staphylococcus
ETPDNTEG

SEQ ID NO: 1940264 - protein, 5 aa, Staphylococcus
ETPDR

SEQ ID NO: 1940265 - protein, 5 aa, Staphylococcus
ETPER

SEQ ID NO: 1940266 - protein, 5 aa, Staphylococcus
ETPET

SEQ ID NO: 1940267 - protein, 8 aa, Staphylococcus
ETPETAES

SEQ ID NO: 1940268 - protein, 5 aa, Staphylococcus
ETPGL

SEQ ID NO: 1940269 - protein, 5 aa, Staphylococcus
ETPGS

SEQ ID NO: 1940270 - protein, 4 aa, Staphylococcus
ETPK

SEQ ID NO: 1940271 - protein, 14 aa, Staphylococcus
ETPKTIKATGGFAK

SEQ ID NO: 1940272 - protein, 7 aa, Staphylococcus
ETPNIHT

SEQ ID NO: 1940273 - protein, 14 aa, Staphylococcus
ETPNKIKATGGFAK

SEQ ID NO: 1940274 - protein, 6 aa, Staphylococcus
ETPNSR

SEQ ID NO: 1940275 - protein, 4 aa, Staphylococcus
ETPQ

SEQ ID NO: 1940276 - protein, 7 aa, Staphylococcus
ETPQAVD

SEQ ID NO: 1940277 - protein, 5 aa, Staphylococcus
ETPQI

SEQ ID NO: 1940278 - protein, 40 aa, Staphylococcus
ETPSKQQRQTITPKTSTKQPKRGFSKRTTSSKKQVSASDW

SEQ ID NO: 1940279 - protein, 15 aa, Staphylococcus
ETPSKSDASAPVGPD

SEQ ID NO: 1940280 - protein, 7 aa, Staphylococcus
ETPSNGK

SEQ ID NO: 1940281 - protein, 5 aa, Staphylococcus
ETPSS

SEQ ID NO: 1940282 - protein, 7 aa, Staphylococcus
ETPSSNL

SEQ ID NO: 1940283 - protein, 14 aa, Staphylococcus
ETPSSYVVYRPKEI

SEQ ID NO: 1940284 - protein, 4 aa, Staphylococcus
ETPT

SEQ ID NO: 1940285 - protein, 14 aa, Staphylococcus
ETPTAIKATGGFAK

SEQ ID NO: 1940286 - protein, 6 aa, Staphylococcus
ETPTKG

SEQ ID NO: 1940287 - protein, 6 aa, Staphylococcus
ETPTNG

SEQ ID NO: 1940288 - protein, 5 aa, Staphylococcus
ETPTS

SEQ ID NO: 1940289 - protein, 7 aa, Staphylococcus
ETPTSGE

SEQ ID NO: 1940290 - protein, 10 aa, Staphylococcus
ETPTTPGTID

SEQ ID NO: 1940291 - protein, 4 aa, Staphylococcus
ETPV

SEQ ID NO: 1940292 - protein, 5 aa, Staphylococcus
ETPVT

SEQ ID NO: 1940293 - protein, 15 aa, Staphylococcus
ETPVTKTTAKRLSGK

SEQ ID NO: 1940294 - protein, 5 aa, Staphylococcus
ETPYR

SEQ ID NO: 1940295 - protein, 10 aa, Staphylococcus
ETQEQSESVK

SEQ ID NO: 1940296 - protein, 10 aa, Staphylococcus
ETQERRIEKT

SEQ ID NO: 1940297 - protein, 7 aa, Staphylococcus
ETQGNNG

SEQ ID NO: 1940298 - protein, 7 aa, Staphylococcus
ETQGSKF

SEQ ID NO: 1940299 - protein, 5 aa, Staphylococcus
ETQID

SEQ ID NO: 1940300 - protein, 9 aa, Staphylococcus
ETQIKETTA

SEQ ID NO: 1940301 - protein, 7 aa, Staphylococcus
ETQINEY

SEQ ID NO: 1940302 - protein, 5 aa, Staphylococcus
ETQKF

SEQ ID NO: 1940303 - protein, 8 aa, Staphylococcus
ETQKNGGV

SEQ ID NO: 1940304 - protein, 11 aa, Staphylococcus
ETQKVEKIGEA

SEQ ID NO: 1940305 - protein, 6 aa, Staphylococcus
ETQLKE

SEQ ID NO: 1940306 - protein, 7 aa, Staphylococcus
ETQLSKQ

SEQ ID NO: 1940307 - protein, 4 aa, Staphylococcus
ETQM

SEQ ID NO: 1940308 - protein, 9 aa, Staphylococcus
ETQNQNGQL

SEQ ID NO: 1940309 - protein, 6 aa, Staphylococcus
ETQPIF

SEQ ID NO: 1940310 - protein, 7 aa, Staphylococcus
ETQPKRI

SEQ ID NO: 1940311 - protein, 6 aa, Staphylococcus
ETQPRR

SEQ ID NO: 1940312 - protein, 6 aa, Staphylococcus
ETQRHM

SEQ ID NO: 1940313 - protein, 10 aa, Staphylococcus
ETQRSNENLD

SEQ ID NO: 1940314 - protein, 18 aa, Staphylococcus
ETQRSNNNLDGVSITSAS

SEQ ID NO: 1940315 - protein, 5 aa, Staphylococcus
ETQSI

SEQ ID NO: 1940316 - protein, 12 aa, Staphylococcus
ETQTEEEQNAGF

SEQ ID NO: 1940317 - protein, 9 aa, Staphylococcus
ETQVEDDFN

SEQ ID NO: 1940318 - protein, 4 aa, Staphylococcus
ETRA

SEQ ID NO: 1940319 - protein, 12 aa, Staphylococcus
ETRADVQSNSGT

SEQ ID NO: 1940320 - protein, 4 aa, Staphylococcus
ETRC

SEQ ID NO: 1940321 - protein, 7 aa, Staphylococcus
ETRDARH

SEQ ID NO: 1940322 - protein, 4 aa, Staphylococcus
ETRE

SEQ ID NO: 1940323 - protein, 6 aa, Staphylococcus
ETREEV

SEQ ID NO: 1940324 - protein, 7 aa, Staphylococcus
ETRGEEA

SEQ ID NO: 1940325 - protein, 17 aa, Staphylococcus
ETRGETLEQSVKDLNEG

SEQ ID NO: 1940326 - protein, 10 aa, Staphylococcus
ETRGQDKHGI

SEQ ID NO: 1940327 - protein, 10 aa, Staphylococcus
ETRGTNRHGI

SEQ ID NO: 1940328 - protein, 19 aa, Staphylococcus
ETRKNSLRDTYFNINQRGD

SEQ ID NO: 1940329 - protein, 17 aa, Staphylococcus
ETRKQTSKDLELNYYES

SEQ ID NO: 1940330 - protein, 8 aa, Staphylococcus
ETRKSTIL

SEQ ID NO: 1940331 - protein, 11 aa, Staphylococcus
ETRLGSEDYNF

SEQ ID NO: 1940332 - protein, 10 aa, Staphylococcus
ETRQNKIDEF

SEQ ID NO: 1940333 - protein, 6 aa, Staphylococcus
ETRQVA

SEQ ID NO: 1940334 - protein, 4 aa, Staphylococcus
ETRR

SEQ ID NO: 1940335 - protein, 26 aa, Staphylococcus
ETRSIKAQNPKGEVVNTVGSGDSTVA

SEQ ID NO: 1940336 - protein, 10 aa, Staphylococcus
ETRVDKRVET

SEQ ID NO: 1940337 - protein, 13 aa, Staphylococcus
ETRVGKGYIANDN

SEQ ID NO: 1940338 - protein, 12 aa, Staphylococcus
ETRYYANSDQKI

SEQ ID NO: 1940339 - protein, 5 aa, Staphylococcus
ETSAI

SEQ ID NO: 1940340 - protein, 8 aa, Staphylococcus
ETSDKEEV

SEQ ID NO: 1940341 - protein, 6 aa, Staphylococcus
ETSEPE

SEQ ID NO: 1940342 - protein, 63 aa, Staphylococcus
ETSETDNSTNTKNTDIETVKDSTDLNINGNDTLTVETSASASKNTSDKEVSHSVKSNAHTQAS

SEQ ID NO: 1940343 - protein, 8 aa, Staphylococcus
ETSEVDRR

SEQ ID NO: 1940344 - protein, 5 aa, Staphylococcus
ETSGY

SEQ ID NO: 1940345 - protein, 6 aa, Staphylococcus
ETSHAK

SEQ ID NO: 1940346 - protein, 11 aa, Staphylococcus
ETSHQQQTKMQ

SEQ ID NO: 1940347 - protein, 4 aa, Staphylococcus
ETSI

SEQ ID NO: 1940348 - protein, 8 aa, Staphylococcus
ETSIPEKS

SEQ ID NO: 1940349 - protein, 8 aa, Staphylococcus
ETSKQYYA

SEQ ID NO: 1940350 - protein, 9 aa, Staphylococcus
ETSKTTVTG

SEQ ID NO: 1940351 - protein, 13 aa, Staphylococcus
ETSLAAYEQQEYP

SEQ ID NO: 1940352 - protein, 6 aa, Staphylococcus
ETSLNG

SEQ ID NO: 1940353 - protein, 6 aa, Staphylococcus
ETSLQG

SEQ ID NO: 1940354 - protein, 8 aa, Staphylococcus
ETSNERLN

SEQ ID NO: 1940355 - protein, 4 aa, Staphylococcus
ETSP

SEQ ID NO: 1940356 - protein, 8 aa, Staphylococcus
ETSPATIT

SEQ ID NO: 1940357 - protein, 10 aa, Staphylococcus
ETSPLNTNLE

SEQ ID NO: 1940358 - protein, 9 aa, Staphylococcus
ETSQISKQG

SEQ ID NO: 1940359 - protein, 12 aa, Staphylococcus
ETSQQYNSAKQR

SEQ ID NO: 1940360 - protein, 6 aa, Staphylococcus
ETSQYI

SEQ ID NO: 1940361 - protein, 8 aa, Staphylococcus
ETSRKQKQ

SEQ ID NO: 1940362 - protein, 7 aa, Staphylococcus
ETSRSHG

SEQ ID NO: 1940363 - protein, 4 aa, Staphylococcus
ETST

SEQ ID NO: 1940364 - protein, 5 aa, Staphylococcus
ETSTE

SEQ ID NO: 1940365 - protein, 7 aa, Staphylococcus
ETSTKHL

SEQ ID NO: 1940366 - protein, 14 aa, Staphylococcus
ETSTSSVKKGESLY

SEQ ID NO: 1940367 - protein, 4 aa, Staphylococcus
ETTA

SEQ ID NO: 1940368 - protein, 13 aa, Staphylococcus
ETTAFSNEGDSTI

SEQ ID NO: 1940369 - protein, 5 aa, Staphylococcus
ETTAI

SEQ ID NO: 1940370 - protein, 10 aa, Staphylococcus
ETTAKYQPLS

SEQ ID NO: 1940371 - protein, 4 aa, Staphylococcus
ETTC

SEQ ID NO: 1940372 - protein, 5 aa, Staphylococcus
ETTCA

SEQ ID NO: 1940373 - protein, 8 aa, Staphylococcus
ETTDSHEH

SEQ ID NO: 1940374 - protein, 5 aa, Staphylococcus
ETTDY

SEQ ID NO: 1940375 - protein, 5 aa, Staphylococcus
ETTEE

SEQ ID NO: 1940376 - protein, 4 aa, Staphylococcus
ETTF

SEQ ID NO: 1940377 - protein, 8 aa, Staphylococcus
ETTGIPKE

SEQ ID NO: 1940378 - protein, 6 aa, Staphylococcus
ETTGLK

SEQ ID NO: 1940379 - protein, 10 aa, Staphylococcus
ETTGNQKDYD

SEQ ID NO: 1940380 - protein, 8 aa, Staphylococcus
ETTGNQLE

SEQ ID NO: 1940381 - protein, 9 aa, Staphylococcus
ETTGPEFSS

SEQ ID NO: 1940382 - protein, 10 aa, Staphylococcus
ETTGSEFSSN

SEQ ID NO: 1940383 - protein, 8 aa, Staphylococcus
ETTGSQFS

SEQ ID NO: 1940384 - protein, 9 aa, Staphylococcus
ETTGTEFSS

SEQ ID NO: 1940385 - protein, 5 aa, Staphylococcus
ETTIG

SEQ ID NO: 1940386 - protein, 8 aa, Staphylococcus
ETTKDTPL

SEQ ID NO: 1940387 - protein, 7 aa, Staphylococcus
ETTKNKD

SEQ ID NO: 1940388 - protein, 5 aa, Staphylococcus
ETTNH

SEQ ID NO: 1940389 - protein, 8 aa, Staphylococcus
ETTQHEAD

SEQ ID NO: 1940390 - protein, 10 aa, Staphylococcus
ETTQYFKPSQ

SEQ ID NO: 1940391 - protein, 7 aa, Staphylococcus
ETTRISA

SEQ ID NO: 1940392 - protein, 6 aa, Staphylococcus
ETTRKM

SEQ ID NO: 1940393 - protein, 4 aa, Staphylococcus
ETTS

SEQ ID NO: 1940394 - protein, 10 aa, Staphylococcus
ETTSAEHSEE

SEQ ID NO: 1940395 - protein, 8 aa, Staphylococcus
ETTSKDQI

SEQ ID NO: 1940396 - protein, 7 aa, Staphylococcus
ETTTGHI

SEQ ID NO: 1940397 - protein, 6 aa, Staphylococcus
ETTTQV

SEQ ID NO: 1940398 - protein, 7 aa, Staphylococcus
ETTVDTV

SEQ ID NO: 1940399 - protein, 5 aa, Staphylococcus
ETTVY

SEQ ID NO: 1940400 - protein, 6 aa, Staphylococcus
ETTYEQ

SEQ ID NO: 1940401 - protein, 19 aa, Staphylococcus
ETTYGASPYDKVRGHNGPV

SEQ ID NO: 1940402 - protein, 19 aa, Staphylococcus
ETTYGSAPYDKYRGHDGPI

SEQ ID NO: 1940403 - protein, 15 aa, Staphylococcus
ETTYNQIESEINDGR

SEQ ID NO: 1940404 - protein, 10 aa, Staphylococcus
ETTYPTDEEG

SEQ ID NO: 1940405 - protein, 8 aa, Staphylococcus
ETTYTPSN

SEQ ID NO: 1940406 - protein, 9 aa, Staphylococcus
ETVASSNAQ

SEQ ID NO: 1940407 - protein, 9 aa, Staphylococcus
ETVDGDDPI

SEQ ID NO: 1940408 - protein, 9 aa, Staphylococcus
ETVDGNDPI

SEQ ID NO: 1940409 - protein, 12 aa, Staphylococcus
ETVDQETINDSY

SEQ ID NO: 1940410 - protein, 9 aa, Staphylococcus
ETVDSTDAN

SEQ ID NO: 1940411 - protein, 9 aa, Staphylococcus
ETVEAGVRK

SEQ ID NO: 1940412 - protein, 13 aa, Staphylococcus
ETVESIYDASVNK

SEQ ID NO: 1940413 - protein, 17 aa, Staphylococcus
ETVGKNHKPNRKEPKQI

SEQ ID NO: 1940414 - protein, 17 aa, Staphylococcus
ETVGQNRKPNRKAPKQI

SEQ ID NO: 1940415 - protein, 5 aa, Staphylococcus
ETVGT

SEQ ID NO: 1940416 - protein, 8 aa, Staphylococcus
ETVKKYPN

SEQ ID NO: 1940417 - protein, 5 aa, Staphylococcus
ETVKP

SEQ ID NO: 1940418 - protein, 10 aa, Staphylococcus
ETVKSTGEDY

SEQ ID NO: 1940419 - protein, 9 aa, Staphylococcus
ETVNKEKGI

SEQ ID NO: 1940420 - protein, 16 aa, Staphylococcus
ETVNKSKGYYILKSQK

SEQ ID NO: 1940421 - protein, 9 aa, Staphylococcus
ETVPSSDAD

SEQ ID NO: 1940422 - protein, 9 aa, Staphylococcus
ETVQQPTAH

SEQ ID NO: 1940423 - protein, 5 aa, Staphylococcus
ETVRI

SEQ ID NO: 1940424 - protein, 6 aa, Staphylococcus
ETVRKY

SEQ ID NO: 1940425 - protein, 9 aa, Staphylococcus
ETVSPRDTV

SEQ ID NO: 1940426 - protein, 11 aa, Staphylococcus
ETVTASESAKI

SEQ ID NO: 1940427 - protein, 15 aa, Staphylococcus
ETVTKGENTTPETVT

SEQ ID NO: 1940428 - protein, 8 aa, Staphylococcus
ETVTNAGK

SEQ ID NO: 1940429 - protein, 10 aa, Staphylococcus
ETVTPTDHQE

SEQ ID NO: 1940430 - protein, 10 aa, Staphylococcus
ETVVESTQQI

SEQ ID NO: 1940431 - protein, 4 aa, Staphylococcus
ETWG

SEQ ID NO: 1940432 - protein, 8 aa, Staphylococcus
ETYDTKDF

SEQ ID NO: 1940433 - protein, 8 aa, Staphylococcus
ETYEHDAT

SEQ ID NO: 1940434 - protein, 6 aa, Staphylococcus
ETYENN

SEQ ID NO: 1940435 - protein, 5 aa, Staphylococcus
ETYGE

SEQ ID NO: 1940436 - protein, 5 aa, Staphylococcus
ETYGI

SEQ ID NO: 1940437 - protein, 5 aa, Staphylococcus
ETYGN

SEQ ID NO: 1940438 - protein, 5 aa, Staphylococcus
ETYGR

SEQ ID NO: 1940439 - protein, 7 aa, Staphylococcus
ETYHSSQ

SEQ ID NO: 1940440 - protein, 11 aa, Staphylococcus
ETYKKEQDKLA

SEQ ID NO: 1940441 - protein, 6 aa, Staphylococcus
ETYPGD

SEQ ID NO: 1940442 - protein, 6 aa, Staphylococcus
ETYPIK

SEQ ID NO: 1940443 - protein, 7 aa, Staphylococcus
ETYPNND

SEQ ID NO: 1940444 - protein, 5 aa, Staphylococcus
ETYPR

SEQ ID NO: 1940445 - protein, 12 aa, Staphylococcus
ETYQAITKDGET

SEQ ID NO: 1940446 - protein, 9 aa, Staphylococcus
ETYQQVNDR

SEQ ID NO: 1940447 - protein, 5 aa, Staphylococcus
ETYQT

SEQ ID NO: 1940448 - protein, 12 aa, Staphylococcus
ETYQTITKNGEE

SEQ ID NO: 1940449 - protein, 4 aa, Staphylococcus
ETYR

SEQ ID NO: 1940450 - protein, 13 aa, Staphylococcus
ETYSKQRSLREAV

SEQ ID NO: 1940451 - protein, 10 aa, Staphylococcus
ETYSPSKDPQ

SEQ ID NO: 1940452 - protein, 13 aa, Staphylococcus
ETYSTKSEALKRE

SEQ ID NO: 1940453 - protein, 15 aa, Staphylococcus
ETYTNNDKKSQIRVR

SEQ ID NO: 1940454 - protein, 5 aa, Staphylococcus
EVAAE

SEQ ID NO: 1940455 - protein, 7 aa, Staphylococcus
EVAAEQG

SEQ ID NO: 1940456 - protein, 6 aa, Staphylococcus
EVAARG

SEQ ID NO: 1940457 - protein, 11 aa, Staphylococcus
EVAARKARAAQ

SEQ ID NO: 1940458 - protein, 13 aa, Staphylococcus
EVADKKKSVSDRD

SEQ ID NO: 1940459 - protein, 4 aa, Staphylococcus
EVAE

SEQ ID NO: 1940460 - protein, 21 aa, Staphylococcus
EVAEAARKQGQQDVDAIYAFW

SEQ ID NO: 1940461 - protein, 6 aa, Staphylococcus
EVAEQA

SEQ ID NO: 1940462 - protein, 49 aa, Staphylococcus
EVAGKGSDVIRKEDVDNSQKPSQSNQNTQPNSQQETSKKSTANTPNKPV

SEQ ID NO: 1940463 - protein, 47 aa, Staphylococcus
EVAGKSNDVVRKEDIDQRQQQSSNKKAETAQRKAPETSSSSTPNKPV

SEQ ID NO: 1940464 - protein, 23 aa, Staphylococcus
EVAGSYSTHTRTKMGGHEGRALK

SEQ ID NO: 1940465 - protein, 21 aa, Staphylococcus
EVAKASKKDVDKAVEAATNAF

SEQ ID NO: 1940466 - protein, 10 aa, Staphylococcus
EVAKTSADGV

SEQ ID NO: 1940467 - protein, 12 aa, Staphylococcus
EVAPGAQGQLET

SEQ ID NO: 1940468 - protein, 6 aa, Staphylococcus
EVAPYK

SEQ ID NO: 1940469 - protein, 5 aa, Staphylococcus
EVAQN

SEQ ID NO: 1940470 - protein, 8 aa, Staphylococcus
EVAQNNNL

SEQ ID NO: 1940471 - protein, 11 aa, Staphylococcus
EVATNAGVTNV

SEQ ID NO: 1940472 - protein, 11 aa, Staphylococcus
EVATRAGVTNV

SEQ ID NO: 1940473 - protein, 4 aa, Staphylococcus
EVCR

SEQ ID NO: 1940474 - protein, 5 aa, Staphylococcus
EVDAQ

SEQ ID NO: 1940475 - protein, 6 aa, Staphylococcus
EVDEET

SEQ ID NO: 1940476 - protein, 18 aa, Staphylococcus
EVDEGARKIDVGDKDTNY

SEQ ID NO: 1940477 - protein, 8 aa, Staphylococcus
EVDESNIE

SEQ ID NO: 1940478 - protein, 8 aa, Staphylococcus
EVDGETVA

SEQ ID NO: 1940479 - protein, 9 aa, Staphylococcus
EVDKQRDTI

SEQ ID NO: 1940480 - protein, 6 aa, Staphylococcus
EVDNGY

SEQ ID NO: 1940481 - protein, 7 aa, Staphylococcus
EVDNQDA

SEQ ID NO: 1940482 - protein, 16 aa, Staphylococcus
EVDPDEIYNKTMRLTD

SEQ ID NO: 1940483 - protein, 6 aa, Staphylococcus
EVDPSS

SEQ ID NO: 1940484 - protein, 4 aa, Staphylococcus
EVDS

SEQ ID NO: 1940485 - protein, 7 aa, Staphylococcus
EVDSEGD

SEQ ID NO: 1940486 - protein, 11 aa, Staphylococcus
EVDSPNAKAAI

SEQ ID NO: 1940487 - protein, 4 aa, Staphylococcus
EVDT

SEQ ID NO: 1940488 - protein, 7 aa, Staphylococcus
EVEADRD

SEQ ID NO: 1940489 - protein, 49 aa, Staphylococcus
EVEAKNSDVVRKNDIDRKQQGGQSNQGSQAAKSEAPAKKQNQEPSKPVV

SEQ ID NO: 1940490 - protein, 7 aa, Staphylococcus
EVEDEAD

SEQ ID NO: 1940491 - protein, 20 aa, Staphylococcus
EVEDGDFDKVKEEIKERVQG

SEQ ID NO: 1940492 - protein, 9 aa, Staphylococcus
EVEEQPDSI

SEQ ID NO: 1940493 - protein, 14 aa, Staphylococcus
EVEETDDEVTEDLT

SEQ ID NO: 1940494 - protein, 6 aa, Staphylococcus
EVEGAE

SEQ ID NO: 1940495 - protein, 11 aa, Staphylococcus
EVEGAHDTLNE

SEQ ID NO: 1940496 - protein, 9 aa, Staphylococcus
EVEGAQETL

SEQ ID NO: 1940497 - protein, 10 aa, Staphylococcus
EVEGAQETLK

SEQ ID NO: 1940498 - protein, 10 aa, Staphylococcus
EVEGATDTLK

SEQ ID NO: 1940499 - protein, 5 aa, Staphylococcus
EVEGR

SEQ ID NO: 1940500 - protein, 16 aa, Staphylococcus
EVEGSHDDTLKQQIND

SEQ ID NO: 1940501 - protein, 5 aa, Staphylococcus
EVEGT

SEQ ID NO: 1940502 - protein, 9 aa, Staphylococcus
EVEGTPEKF

SEQ ID NO: 1940503 - protein, 8 aa, Staphylococcus
EVEKADKL

SEQ ID NO: 1940504 - protein, 20 aa, Staphylococcus
EVEKDGKKVEMKKTEDYEIP

SEQ ID NO: 1940505 - protein, 6 aa, Staphylococcus
EVENHT

SEQ ID NO: 1940506 - protein, 7 aa, Staphylococcus
EVENHTE

SEQ ID NO: 1940507 - protein, 6 aa, Staphylococcus
EVEPAS

SEQ ID NO: 1940508 - protein, 6 aa, Staphylococcus
EVEPQA

SEQ ID NO: 1940509 - protein, 10 aa, Staphylococcus
EVESNPDNVL

SEQ ID NO: 1940510 - protein, 7 aa, Staphylococcus
EVESQEK

SEQ ID NO: 1940511 - protein, 8 aa, Staphylococcus
EVETNNNN

SEQ ID NO: 1940512 - protein, 8 aa, Staphylococcus
EVETQRKN

SEQ ID NO: 1940513 - protein, 7 aa, Staphylococcus
EVETTTS

SEQ ID NO: 1940514 - protein, 28 aa, Staphylococcus
EVEVEKDGFRVNGQEVKSFSEPEPSKLP

SEQ ID NO: 1940515 - protein, 10 aa, Staphylococcus
EVFKRDGDDI

SEQ ID NO: 1940516 - protein, 8 aa, Staphylococcus
EVFNPNEK

SEQ ID NO: 1940517 - protein, 5 aa, Staphylococcus
EVGDD

SEQ ID NO: 1940518 - protein, 7 aa, Staphylococcus
EVGDKSI

SEQ ID NO: 1940519 - protein, 5 aa, Staphylococcus
EVGDY

SEQ ID NO: 1940520 - protein, 9 aa, Staphylococcus
EVGEDQAEH

SEQ ID NO: 1940521 - protein, 8 aa, Staphylococcus
EVGEHTSP

SEQ ID NO: 1940522 - protein, 9 aa, Staphylococcus
EVGEKQTAV

SEQ ID NO: 1940523 - protein, 9 aa, Staphylococcus
EVGETKNTL

SEQ ID NO: 1940524 - protein, 5 aa, Staphylococcus
EVGEY

SEQ ID NO: 1940525 - protein, 6 aa, Staphylococcus
EVGKGE

SEQ ID NO: 1940526 - protein, 11 aa, Staphylococcus
EVGNSGNTPEP

SEQ ID NO: 1940527 - protein, 8 aa, Staphylococcus
EVGPETQY

SEQ ID NO: 1940528 - protein, 7 aa, Staphylococcus
EVGQAKG

SEQ ID NO: 1940529 - protein, 7 aa, Staphylococcus
EVGQGDQ

SEQ ID NO: 1940530 - protein, 8 aa, Staphylococcus
EVGQPKGY

SEQ ID NO: 1940531 - protein, 4 aa, Staphylococcus
EVGR

SEQ ID NO: 1940532 - protein, 4 aa, Staphylococcus
EVGS

SEQ ID NO: 1940533 - protein, 6 aa, Staphylococcus
EVGSDT

SEQ ID NO: 1940534 - protein, 8 aa, Staphylococcus
EVGSNKDI

SEQ ID NO: 1940535 - protein, 6 aa, Staphylococcus
EVGSQG

SEQ ID NO: 1940536 - protein, 11 aa, Staphylococcus
EVGSTDKTGTV

SEQ ID NO: 1940537 - protein, 4 aa, Staphylococcus
EVGT

SEQ ID NO: 1940538 - protein, 7 aa, Staphylococcus
EVGTDKM

SEQ ID NO: 1940539 - protein, 12 aa, Staphylococcus
EVGTQPGISNAQ

SEQ ID NO: 1940540 - protein, 5 aa, Staphylococcus
EVGYK

SEQ ID NO: 1940541 - protein, 6 aa, Staphylococcus
EVGYKE

SEQ ID NO: 1940542 - protein, 5 aa, Staphylococcus
EVHAQ

SEQ ID NO: 1940543 - protein, 10 aa, Staphylococcus
EVHGESGMAG

SEQ ID NO: 1940544 - protein, 8 aa, Staphylococcus
EVIDSGEN

SEQ ID NO: 1940545 - protein, 7 aa, Staphylococcus
EVKDDKV

SEQ ID NO: 1940546 - protein, 13 aa, Staphylococcus
EVKDTTGAGDTFN

SEQ ID NO: 1940547 - protein, 11 aa, Staphylococcus
EVKDTTLATVG

SEQ ID NO: 1940548 - protein, 15 aa, Staphylococcus
EVKEDEIKGKDREDI

SEQ ID NO: 1940549 - protein, 9 aa, Staphylococcus
EVKEGELQD

SEQ ID NO: 1940550 - protein, 31 aa, Staphylococcus
EVKEQASNSYKNQQESSQDKQQGIRKGPNIK

SEQ ID NO: 1940551 - protein, 7 aa, Staphylococcus
EVKESDG

SEQ ID NO: 1940552 - protein, 9 aa, Staphylococcus
EVKESSEIY

SEQ ID NO: 1940553 - protein, 10 aa, Staphylococcus
EVKESSEVYA

SEQ ID NO: 1940554 - protein, 10 aa, Staphylococcus
EVKGEEQTID

SEQ ID NO: 1940555 - protein, 12 aa, Staphylococcus
EVKGVRTNIGTE

SEQ ID NO: 1940556 - protein, 4 aa, Staphylococcus
EVKK

SEQ ID NO: 1940557 - protein, 5 aa, Staphylococcus
EVKKG

SEQ ID NO: 1940558 - protein, 11 aa, Staphylococcus
EVKNDNAQGEY

SEQ ID NO: 1940559 - protein, 8 aa, Staphylococcus
EVKNEKQL

SEQ ID NO: 1940560 - protein, 8 aa, Staphylococcus
EVKNKEEI

SEQ ID NO: 1940561 - protein, 13 aa, Staphylococcus
EVKNNPELTSFSA

SEQ ID NO: 1940562 - protein, 9 aa, Staphylococcus
EVKNNTDKV

SEQ ID NO: 1940563 - protein, 8 aa, Staphylococcus
EVKNSTGK

SEQ ID NO: 1940564 - protein, 8 aa, Staphylococcus
EVKPGTNA

SEQ ID NO: 1940565 - protein, 9 aa, Staphylococcus
EVKPSSEVY

SEQ ID NO: 1940566 - protein, 9 aa, Staphylococcus
EVKQSGESI

SEQ ID NO: 1940567 - protein, 15 aa, Staphylococcus
EVKRRGDMEEDPSYK

SEQ ID NO: 1940568 - protein, 8 aa, Staphylococcus
EVKSNTEI

SEQ ID NO: 1940569 - protein, 10 aa, Staphylococcus
EVKSRSRGFE

SEQ ID NO: 1940570 - protein, 10 aa, Staphylococcus
EVKSSEEIDK

SEQ ID NO: 1940571 - protein, 8 aa, Staphylococcus
EVKTEGTI

SEQ ID NO: 1940572 - protein, 10 aa, Staphylococcus
EVKTKQTKFA

SEQ ID NO: 1940573 - protein, 6 aa, Staphylococcus
EVKTYE

SEQ ID NO: 1940574 - protein, 5 aa, Staphylococcus
EVLST

SEQ ID NO: 1940575 - protein, 8 aa, Staphylococcus
EVLTETTA

SEQ ID NO: 1940576 - protein, 16 aa, Staphylococcus
EVLTGSTRLKAGTSQK

SEQ ID NO: 1940577 - protein, 12 aa, Staphylococcus
EVMETPNGNGGV

SEQ ID NO: 1940578 - protein, 12 aa, Staphylococcus
EVNADGIGRDAS

SEQ ID NO: 1940579 - protein, 13 aa, Staphylococcus
EVNDGQTITYSSE

SEQ ID NO: 1940580 - protein, 5 aa, Staphylococcus
EVNEE

SEQ ID NO: 1940581 - protein, 6 aa, Staphylococcus
EVNEKM

SEQ ID NO: 1940582 - protein, 5 aa, Staphylococcus
EVNGI

SEQ ID NO: 1940583 - protein, 7 aa, Staphylococcus
EVNGSVS

SEQ ID NO: 1940584 - protein, 11 aa, Staphylococcus
EVNKEERHHGI

SEQ ID NO: 1940585 - protein, 5 aa, Staphylococcus
EVNNK

SEQ ID NO: 1940586 - protein, 4 aa, Staphylococcus
EVNP

SEQ ID NO: 1940587 - protein, 8 aa, Staphylococcus
EVNPDTLK

SEQ ID NO: 1940588 - protein, 7 aa, Staphylococcus
EVNPKKE

SEQ ID NO: 1940589 - protein, 7 aa, Staphylococcus
EVNQRRD

SEQ ID NO: 1940590 - protein, 4 aa, Staphylococcus
EVNS

SEQ ID NO: 1940591 - protein, 10 aa, Staphylococcus
EVNSLGDDVR

SEQ ID NO: 1940592 - protein, 4 aa, Staphylococcus
EVNT

SEQ ID NO: 1940593 - protein, 6 aa, Staphylococcus
EVNTKL

SEQ ID NO: 1940594 - protein, 7 aa, Staphylococcus
EVNTKMR

SEQ ID NO: 1940595 - protein, 6 aa, Staphylococcus
EVNTPL

SEQ ID NO: 1940596 - protein, 8 aa, Staphylococcus
EVNTPLSK

SEQ ID NO: 1940597 - protein, 5 aa, Staphylococcus
EVNTQ

SEQ ID NO: 1940598 - protein, 6 aa, Staphylococcus
EVNTQD

SEQ ID NO: 1940599 - protein, 7 aa, Staphylococcus
EVNTSSG

SEQ ID NO: 1940600 - protein, 9 aa, Staphylococcus
EVNTTDPDY

SEQ ID NO: 1940601 - protein, 9 aa, Staphylococcus
EVNTTDPNY

SEQ ID NO: 1940602 - protein, 8 aa, Staphylococcus
EVNTYATD

SEQ ID NO: 1940603 - protein, 19 aa, Staphylococcus
EVPAENEEVQSDAKDSQLT

SEQ ID NO: 1940604 - protein, 6 aa, Staphylococcus
EVPAGA

SEQ ID NO: 1940605 - protein, 12 aa, Staphylococcus
EVPDETVNKYHK

SEQ ID NO: 1940606 - protein, 6 aa, Staphylococcus
EVPDGK

SEQ ID NO: 1940607 - protein, 5 aa, Staphylococcus
EVPDS

SEQ ID NO: 1940608 - protein, 4 aa, Staphylococcus
EVPE

SEQ ID NO: 1940609 - protein, 5 aa, Staphylococcus
EVPED

SEQ ID NO: 1940610 - protein, 5 aa, Staphylococcus
EVPEE

SEQ ID NO: 1940611 - protein, 5 aa, Staphylococcus
EVPEG

SEQ ID NO: 1940612 - protein, 6 aa, Staphylococcus
EVPELD

SEQ ID NO: 1940613 - protein, 6 aa, Staphylococcus
EVPELT

SEQ ID NO: 1940614 - protein, 6 aa, Staphylococcus
EVPEPV

SEQ ID NO: 1940615 - protein, 5 aa, Staphylococcus
EVPES

SEQ ID NO: 1940616 - protein, 8 aa, Staphylococcus
EVPETLKD

SEQ ID NO: 1940617 - protein, 9 aa, Staphylococcus
EVPGDKSMT

SEQ ID NO: 1940618 - protein, 7 aa, Staphylococcus
EVPKPVN

SEQ ID NO: 1940619 - protein, 6 aa, Staphylococcus
EVPKTM

SEQ ID NO: 1940620 - protein, 13 aa, Staphylococcus
EVPNIDVGSKITI

SEQ ID NO: 1940621 - protein, 16 aa, Staphylococcus
EVPPKAKRKNKHLISE

SEQ ID NO: 1940622 - protein, 16 aa, Staphylococcus
EVPPKAPRKNKHLISK

SEQ ID NO: 1940623 - protein, 13 aa, Staphylococcus
EVPPLDKNKNHTL

SEQ ID NO: 1940624 - protein, 11 aa, Staphylococcus
EVPPNQCPNCE

SEQ ID NO: 1940625 - protein, 5 aa, Staphylococcus
EVPQE

SEQ ID NO: 1940626 - protein, 7 aa, Staphylococcus
EVPQNEK

SEQ ID NO: 1940627 - protein, 5 aa, Staphylococcus
EVPQQ

SEQ ID NO: 1940628 - protein, 7 aa, Staphylococcus
EVPRENK

SEQ ID NO: 1940629 - protein, 4 aa, Staphylococcus
EVQE

SEQ ID NO: 1940630 - protein, 6 aa, Staphylococcus
EVQEIE

SEQ ID NO: 1940631 - protein, 21 aa, Staphylococcus
EVQGNEDNKNLVEKNNQIHQS

SEQ ID NO: 1940632 - protein, 12 aa, Staphylococcus
EVQHNQNNSNLV

SEQ ID NO: 1940633 - protein, 9 aa, Staphylococcus
EVQKNDDNL

SEQ ID NO: 1940634 - protein, 8 aa, Staphylococcus
EVQNDKSV

SEQ ID NO: 1940635 - protein, 18 aa, Staphylococcus
EVQNTGKDISVPVGDETL

SEQ ID NO: 1940636 - protein, 6 aa, Staphylococcus
EVQPLK

SEQ ID NO: 1940637 - protein, 8 aa, Staphylococcus
EVQPTEAQ

SEQ ID NO: 1940638 - protein, 11 aa, Staphylococcus
EVQQGDQAPNF

SEQ ID NO: 1940639 - protein, 4 aa, Staphylococcus
EVQT

SEQ ID NO: 1940640 - protein, 6 aa, Staphylococcus
EVQTKS

SEQ ID NO: 1940641 - protein, 5 aa, Staphylococcus
EVQTQ

SEQ ID NO: 1940642 - protein, 9 aa, Staphylococcus
EVRAQGEDK

SEQ ID NO: 1940643 - protein, 4 aa, Staphylococcus
EVRD

SEQ ID NO: 1940644 - protein, 11 aa, Staphylococcus
EVREESPNVIP

SEQ ID NO: 1940645 - protein, 6 aa, Staphylococcus
EVREET

SEQ ID NO: 1940646 - protein, 13 aa, Staphylococcus
EVRGDLTQKAETH

SEQ ID NO: 1940647 - protein, 4 aa, Staphylococcus
EVRK

SEQ ID NO: 1940648 - protein, 14 aa, Staphylococcus
EVRKKLRDQYAEQK

SEQ ID NO: 1940649 - protein, 8 aa, Staphylococcus
EVRNQNSV

SEQ ID NO: 1940650 - protein, 9 aa, Staphylococcus
EVRPTENQI

SEQ ID NO: 1940651 - protein, 8 aa, Staphylococcus
EVRPTESQ

SEQ ID NO: 1940652 - protein, 5 aa, Staphylococcus
EVRQT

SEQ ID NO: 1940653 - protein, 13 aa, Staphylococcus
EVSAQDQSTTITV

SEQ ID NO: 1940654 - protein, 4 aa, Staphylococcus
EVSD

SEQ ID NO: 1940655 - protein, 9 aa, Staphylococcus
EVSDDEKTL

SEQ ID NO: 1940656 - protein, 6 aa, Staphylococcus
EVSDKA

SEQ ID NO: 1940657 - protein, 11 aa, Staphylococcus
EVSDPFGGSKS

SEQ ID NO: 1940658 - protein, 7 aa, Staphylococcus
EVSDTVD

SEQ ID NO: 1940659 - protein, 7 aa, Staphylococcus
EVSEALP

SEQ ID NO: 1940660 - protein, 12 aa, Staphylococcus
EVSEATKNYGED

SEQ ID NO: 1940661 - protein, 8 aa, Staphylococcus
EVSEEDRL

SEQ ID NO: 1940662 - protein, 9 aa, Staphylococcus
EVSEENPDE

SEQ ID NO: 1940663 - protein, 11 aa, Staphylococcus
EVSEEQAEQFG

SEQ ID NO: 1940664 - protein, 6 aa, Staphylococcus
EVSEEY

SEQ ID NO: 1940665 - protein, 14 aa, Staphylococcus
EVSEGQNIVYGLDD

SEQ ID NO: 1940666 - protein, 7 aa, Staphylococcus
EVSEGRG

SEQ ID NO: 1940667 - protein, 5 aa, Staphylococcus
EVSEI

SEQ ID NO: 1940668 - protein, 6 aa, Staphylococcus
EVSEKT

SEQ ID NO: 1940669 - protein, 7 aa, Staphylococcus
EVSENSV

SEQ ID NO: 1940670 - protein, 4 aa, Staphylococcus
EVSG

SEQ ID NO: 1940671 - protein, 10 aa, Staphylococcus
EVSGANAIHP

SEQ ID NO: 1940672 - protein, 20 aa, Staphylococcus
EVSGKKLKEKLENSKSDALM

SEQ ID NO: 1940673 - protein, 19 aa, Staphylococcus
EVSGKKLKENLENSKADAF

SEQ ID NO: 1940674 - protein, 8 aa, Staphylococcus
EVSGQPYV

SEQ ID NO: 1940675 - protein, 6 aa, Staphylococcus
EVSGYE

SEQ ID NO: 1940676 - protein, 8 aa, Staphylococcus
EVSHDYPD

SEQ ID NO: 1940677 - protein, 4 aa, Staphylococcus
EVSK

SEQ ID NO: 1940678 - protein, 8 aa, Staphylococcus
EVSKDLTE

SEQ ID NO: 1940679 - protein, 8 aa, Staphylococcus
EVSKDYEN

SEQ ID NO: 1940680 - protein, 4 aa, Staphylococcus
EVSN

SEQ ID NO: 1940681 - protein, 11 aa, Staphylococcus
EVSNAKEIRQT

SEQ ID NO: 1940682 - protein, 6 aa, Staphylococcus
EVSNAT

SEQ ID NO: 1940683 - protein, 11 aa, Staphylococcus
EVSNPKEIRQT

SEQ ID NO: 1940684 - protein, 7 aa, Staphylococcus
EVSPGTV

SEQ ID NO: 1940685 - protein, 14 aa, Staphylococcus
EVSQMSQKALANTR

SEQ ID NO: 1940686 - protein, 4 aa, Staphylococcus
EVSR

SEQ ID NO: 1940687 - protein, 7 aa, Staphylococcus
EVSRQRD

SEQ ID NO: 1940688 - protein, 9 aa, Staphylococcus
EVSRRGKVR

SEQ ID NO: 1940689 - protein, 6 aa, Staphylococcus
EVSSDF

SEQ ID NO: 1940690 - protein, 7 aa, Staphylococcus
EVSSGNT

SEQ ID NO: 1940691 - protein, 8 aa, Staphylococcus
EVSSGNTW

SEQ ID NO: 1940692 - protein, 5 aa, Staphylococcus
EVSTI

SEQ ID NO: 1940693 - protein, 26 aa, Staphylococcus
EVSYDKDEESVTVDATKELNEEAPYE

SEQ ID NO: 1940694 - protein, 5 aa, Staphylococcus
EVTAK

SEQ ID NO: 1940695 - protein, 8 aa, Staphylococcus
EVTATTTN

SEQ ID NO: 1940696 - protein, 5 aa, Staphylococcus
EVTEG

SEQ ID NO: 1940697 - protein, 13 aa, Staphylococcus
EVTEGQDVVYDFN

SEQ ID NO: 1940698 - protein, 9 aa, Staphylococcus
EVTETKGNY

SEQ ID NO: 1940699 - protein, 5 aa, Staphylococcus
EVTGE

SEQ ID NO: 1940700 - protein, 6 aa, Staphylococcus
EVTGIS

SEQ ID NO: 1940701 - protein, 8 aa, Staphylococcus
EVTHSKKG

SEQ ID NO: 1940702 - protein, 15 aa, Staphylococcus
EVTKADRQKQNGHKS

SEQ ID NO: 1940703 - protein, 14 aa, Staphylococcus
EVTKAQRQTRNGHQ

SEQ ID NO: 1940704 - protein, 15 aa, Staphylococcus
EVTKEERQKRNGHKS

SEQ ID NO: 1940705 - protein, 15 aa, Staphylococcus
EVTKGNHDKDMGRAA

SEQ ID NO: 1940706 - protein, 14 aa, Staphylococcus
EVTKNERQEKNGHK

SEQ ID NO: 1940707 - protein, 9 aa, Staphylococcus
EVTKRKEDG

SEQ ID NO: 1940708 - protein, 9 aa, Staphylococcus
EVTKRKESG

SEQ ID NO: 1940709 - protein, 6 aa, Staphylococcus
EVTKSL

SEQ ID NO: 1940710 - protein, 10 aa, Staphylococcus
EVTNTDAKKF

SEQ ID NO: 1940711 - protein, 11 aa, Staphylococcus
EVTNTDAKKFT

SEQ ID NO: 1940712 - protein, 8 aa, Staphylococcus
EVTPGTDA

SEQ ID NO: 1940713 - protein, 6 aa, Staphylococcus
EVTPPD

SEQ ID NO: 1940714 - protein, 7 aa, Staphylococcus
EVTPPDD

SEQ ID NO: 1940715 - protein, 7 aa, Staphylococcus
EVTPPDE

SEQ ID NO: 1940716 - protein, 4 aa, Staphylococcus
EVTQ

SEQ ID NO: 1940717 - protein, 11 aa, Staphylococcus
EVTQKQNEPEI

SEQ ID NO: 1940718 - protein, 4 aa, Staphylococcus
EVTR

SEQ ID NO: 1940719 - protein, 5 aa, Staphylococcus
EVTRE

SEQ ID NO: 1940720 - protein, 10 aa, Staphylococcus
EVTREQQDEF

SEQ ID NO: 1940721 - protein, 7 aa, Staphylococcus
EVTRPRG

SEQ ID NO: 1940722 - protein, 8 aa, Staphylococcus
EVTRVGRG

SEQ ID NO: 1940723 - protein, 4 aa, Staphylococcus
EVTS

SEQ ID NO: 1940724 - protein, 14 aa, Staphylococcus
EVTSGTQSPTSGKS

SEQ ID NO: 1940725 - protein, 8 aa, Staphylococcus
EVVETGKV

SEQ ID NO: 1940726 - protein, 12 aa, Staphylococcus
EVVGTQDGEGRL

SEQ ID NO: 1940727 - protein, 13 aa, Staphylococcus
EVVKGTSTPVPGM

SEQ ID NO: 1940728 - protein, 5 aa, Staphylococcus
EVVNE

SEQ ID NO: 1940729 - protein, 5 aa, Staphylococcus
EVYDD

SEQ ID NO: 1940730 - protein, 8 aa, Staphylococcus
EVYEESGA

SEQ ID NO: 1940731 - protein, 8 aa, Staphylococcus
EVYEQSGA

SEQ ID NO: 1940732 - protein, 7 aa, Staphylococcus
EVYETPA

SEQ ID NO: 1940733 - protein, 8 aa, Staphylococcus
EVYETPGA

SEQ ID NO: 1940734 - protein, 12 aa, Staphylococcus
EVYKNNADRALK

SEQ ID NO: 1940735 - protein, 20 aa, Staphylococcus
EVYQTGKPHDVFNDGDGLTE

SEQ ID NO: 1940736 - protein, 9 aa, Staphylococcus
EVYSPSTTQ

SEQ ID NO: 1940737 - protein, 5 aa, Staphylococcus
EWARA

SEQ ID NO: 1940738 - protein, 15 aa, Staphylococcus
EWATPNKIVAVLEEL

SEQ ID NO: 1940739 - protein, 11 aa, Staphylococcus
EWESSEGYPSA

SEQ ID NO: 1940740 - protein, 8 aa, Staphylococcus
EWESVGNQ

SEQ ID NO: 1940741 - protein, 7 aa, Staphylococcus
EWGQPLH

SEQ ID NO: 1940742 - protein, 12 aa, Staphylococcus
EWNSRKSALDGN

SEQ ID NO: 1940743 - protein, 4 aa, Staphylococcus
EWPD

SEQ ID NO: 1940744 - protein, 17 aa, Staphylococcus
EWQGHQRGSHDLATKGE

SEQ ID NO: 1940745 - protein, 4 aa, Staphylococcus
EWRK

SEQ ID NO: 1940746 - protein, 17 aa, Staphylococcus
EWRKNTGDGLSSGEKQT

SEQ ID NO: 1940747 - protein, 19 aa, Staphylococcus
EWRSDDVTREIDHALNIIQ

SEQ ID NO: 1940748 - protein, 10 aa, Staphylococcus
EWSKRQPNKP

SEQ ID NO: 1940749 - protein, 8 aa, Staphylococcus
EYADGDTF

SEQ ID NO: 1940750 - protein, 6 aa, Staphylococcus
EYADRQ

SEQ ID NO: 1940751 - protein, 9 aa, Staphylococcus
EYAEKEDSE

SEQ ID NO: 1940752 - protein, 7 aa, Staphylococcus
EYAENEK

SEQ ID NO: 1940753 - protein, 5 aa, Staphylococcus
EYAKQ

SEQ ID NO: 1940754 - protein, 8 aa, Staphylococcus
EYANTRGM

SEQ ID NO: 1940755 - protein, 16 aa, Staphylococcus
EYARKGETIERPKRQV

SEQ ID NO: 1940756 - protein, 12 aa, Staphylococcus
EYARKGETVERP

SEQ ID NO: 1940757 - protein, 16 aa, Staphylococcus
EYARNGETVERPERKV

SEQ ID NO: 1940758 - protein, 12 aa, Staphylococcus
EYARREDKSLSD

SEQ ID NO: 1940759 - protein, 12 aa, Staphylococcus
EYARREDKTLSD

SEQ ID NO: 1940760 - protein, 27 aa, Staphylococcus
EYASKTENYPHATLSTSGISLKSDRYN

SEQ ID NO: 1940761 - protein, 7 aa, Staphylococcus
EYASPTV

SEQ ID NO: 1940762 - protein, 6 aa, Staphylococcus
EYDAIQ

SEQ ID NO: 1940763 - protein, 8 aa, Staphylococcus
EYDAKTGQ

SEQ ID NO: 1940764 - protein, 6 aa, Staphylococcus
EYDATT

SEQ ID NO: 1940765 - protein, 8 aa, Staphylococcus
EYDDEEKF

SEQ ID NO: 1940766 - protein, 11 aa, Staphylococcus
EYDDEIKEDLE

SEQ ID NO: 1940767 - protein, 25 aa, Staphylococcus
EYDDTDKIFSNPADKQTEDYISGRF

SEQ ID NO: 1940768 - protein, 7 aa, Staphylococcus
EYDEDEI

SEQ ID NO: 1940769 - protein, 10 aa, Staphylococcus
EYDEENETGA

SEQ ID NO: 1940770 - protein, 10 aa, Staphylococcus
EYDENDKPYR

SEQ ID NO: 1940771 - protein, 4 aa, Staphylococcus
EYDF

SEQ ID NO: 1940772 - protein, 8 aa, Staphylococcus
EYDKDNQL

SEQ ID NO: 1940773 - protein, 5 aa, Staphylococcus
EYDMS

SEQ ID NO: 1940774 - protein, 6 aa, Staphylococcus
EYDNAE

SEQ ID NO: 1940775 - protein, 10 aa, Staphylococcus
EYDNASGSNH

SEQ ID NO: 1940776 - protein, 8 aa, Staphylococcus
EYDNKDAL

SEQ ID NO: 1940777 - protein, 14 aa, Staphylococcus
EYDPNREDRHELPP

SEQ ID NO: 1940778 - protein, 8 aa, Staphylococcus
EYDRQNSN

SEQ ID NO: 1940779 - protein, 16 aa, Staphylococcus
EYDTIKDKMRESGIGD

SEQ ID NO: 1940780 - protein, 16 aa, Staphylococcus
EYEAASTKKSKGELPV

SEQ ID NO: 1940781 - protein, 10 aa, Staphylococcus
EYEAGEKQNL

SEQ ID NO: 1940782 - protein, 10 aa, Staphylococcus
EYEDGESDLI

SEQ ID NO: 1940783 - protein, 18 aa, Staphylococcus
EYEEHSTNNSSANGSDFK

SEQ ID NO: 1940784 - protein, 12 aa, Staphylococcus
EYEEKRQEEELL

SEQ ID NO: 1940785 - protein, 7 aa, Staphylococcus
EYEENEN

SEQ ID NO: 1940786 - protein, 5 aa, Staphylococcus
EYEEV

SEQ ID NO: 1940787 - protein, 12 aa, Staphylococcus
EYEGTKDKDNYQ

SEQ ID NO: 1940788 - protein, 13 aa, Staphylococcus
EYEGTQSKETQQL

SEQ ID NO: 1940789 - protein, 4 aa, Staphylococcus
EYEK

SEQ ID NO: 1940790 - protein, 6 aa, Staphylococcus
EYEKEY

SEQ ID NO: 1940791 - protein, 14 aa, Staphylococcus
EYEKQSDHFNVEQA

SEQ ID NO: 1940792 - protein, 4 aa, Staphylococcus
EYEN

SEQ ID NO: 1940793 - protein, 11 aa, Staphylococcus
EYENESVVTEK

SEQ ID NO: 1940794 - protein, 8 aa, Staphylococcus
EYENRKDD

SEQ ID NO: 1940795 - protein, 8 aa, Staphylococcus
EYENRKED

SEQ ID NO: 1940796 - protein, 9 aa, Staphylococcus
EYEQQTEVP

SEQ ID NO: 1940797 - protein, 4 aa, Staphylococcus
EYES

SEQ ID NO: 1940798 - protein, 13 aa, Staphylococcus
EYESAKDKDTQQL

SEQ ID NO: 1940799 - protein, 13 aa, Staphylococcus
EYESAKDKETQQL

SEQ ID NO: 1940800 - protein, 8 aa, Staphylococcus
EYESAQDW

SEQ ID NO: 1940801 - protein, 6 aa, Staphylococcus
EYESER

SEQ ID NO: 1940802 - protein, 11 aa, Staphylococcus
EYESNQSENGK

SEQ ID NO: 1940803 - protein, 4 aa, Staphylococcus
EYET

SEQ ID NO: 1940804 - protein, 11 aa, Staphylococcus
EYETPTNLNSI

SEQ ID NO: 1940805 - protein, 11 aa, Staphylococcus
EYFGNTETPTG

SEQ ID NO: 1940806 - protein, 8 aa, Staphylococcus
EYFPTSEN

SEQ ID NO: 1940807 - protein, 7 aa, Staphylococcus
EYGDDGL

SEQ ID NO: 1940808 - protein, 5 aa, Staphylococcus
EYGEI

SEQ ID NO: 1940809 - protein, 6 aa, Staphylococcus
EYGESD

SEQ ID NO: 1940810 - protein, 4 aa, Staphylococcus
EYGN

SEQ ID NO: 1940811 - protein, 6 aa, Staphylococcus
EYGPDL

SEQ ID NO: 1940812 - protein, 5 aa, Staphylococcus
EYGPV

SEQ ID NO: 1940813 - protein, 8 aa, Staphylococcus
EYGQSQLQ

SEQ ID NO: 1940814 - protein, 5 aa, Staphylococcus
EYGTK

SEQ ID NO: 1940815 - protein, 8 aa, Staphylococcus
EYGTYETS

SEQ ID NO: 1940816 - protein, 11 aa, Staphylococcus
EYHEKKGSQLP

SEQ ID NO: 1940817 - protein, 6 aa, Staphylococcus
EYHGNE

SEQ ID NO: 1940818 - protein, 6 aa, Staphylococcus
EYHGNS

SEQ ID NO: 1940819 - protein, 8 aa, Staphylococcus
EYHNEDSA

SEQ ID NO: 1940820 - protein, 6 aa, Staphylococcus
EYHSTD

SEQ ID NO: 1940821 - protein, 8 aa, Staphylococcus
EYITSKNP

SEQ ID NO: 1940822 - protein, 10 aa, Staphylococcus
EYKAAGKLKG

SEQ ID NO: 1940823 - protein, 10 aa, Staphylococcus
EYKAAGKLQG

SEQ ID NO: 1940824 - protein, 10 aa, Staphylococcus
EYKAGGKLKG

SEQ ID NO: 1940825 - protein, 9 aa, Staphylococcus
EYKEGDTIQ

SEQ ID NO: 1940826 - protein, 13 aa, Staphylococcus
EYKEKAKTTGHSR

SEQ ID NO: 1940827 - protein, 9 aa, Staphylococcus
EYKGKTQYG

SEQ ID NO: 1940828 - protein, 12 aa, Staphylococcus
EYKKASGLTYDE

SEQ ID NO: 1940829 - protein, 5 aa, Staphylococcus
EYKKD

SEQ ID NO: 1940830 - protein, 11 aa, Staphylococcus
EYKNKKEELSD

SEQ ID NO: 1940831 - protein, 8 aa, Staphylococcus
EYKNRKQD

SEQ ID NO: 1940832 - protein, 13 aa, Staphylococcus
EYKQKKKEYHDST

SEQ ID NO: 1940833 - protein, 8 aa, Staphylococcus
EYKRHGQT

SEQ ID NO: 1940834 - protein, 5 aa, Staphylococcus
EYKRK

SEQ ID NO: 1940835 - protein, 5 aa, Staphylococcus
EYKTN

SEQ ID NO: 1940836 - protein, 6 aa, Staphylococcus
EYKYPT

SEQ ID NO: 1940837 - protein, 6 aa, Staphylococcus
EYLGTE

SEQ ID NO: 1940838 - protein, 5 aa, Staphylococcus
EYMKE

SEQ ID NO: 1940839 - protein, 8 aa, Staphylococcus
EYNDGEFK

SEQ ID NO: 1940840 - protein, 11 aa, Staphylococcus
EYNEKKGSQLP

SEQ ID NO: 1940841 - protein, 13 aa, Staphylococcus
EYNESSEHSVEKD

SEQ ID NO: 1940842 - protein, 19 aa, Staphylococcus
EYNGEQGAKEAGKQRLEGK

SEQ ID NO: 1940843 - protein, 4 aa, Staphylococcus
EYNL

SEQ ID NO: 1940844 - protein, 7 aa, Staphylococcus
EYNNDQV

SEQ ID NO: 1940845 - protein, 5 aa, Staphylococcus
EYNNI

SEQ ID NO: 1940846 - protein, 8 aa, Staphylococcus
EYNRQNNN

SEQ ID NO: 1940847 - protein, 8 aa, Staphylococcus
EYNSSNER

SEQ ID NO: 1940848 - protein, 10 aa, Staphylococcus
EYNVTQEQSH

SEQ ID NO: 1940849 - protein, 4 aa, Staphylococcus
EYPD

SEQ ID NO: 1940850 - protein, 6 aa, Staphylococcus
EYPDQG

SEQ ID NO: 1940851 - protein, 7 aa, Staphylococcus
EYPDSGE

SEQ ID NO: 1940852 - protein, 5 aa, Staphylococcus
EYPDV

SEQ ID NO: 1940853 - protein, 4 aa, Staphylococcus
EYPG

SEQ ID NO: 1940854 - protein, 6 aa, Staphylococcus
EYPREQ

SEQ ID NO: 1940855 - protein, 15 aa, Staphylococcus
EYPSDLKTTLENGPQ

SEQ ID NO: 1940856 - protein, 4 aa, Staphylococcus
EYPT

SEQ ID NO: 1940857 - protein, 13 aa, Staphylococcus
EYPTGPHERQESP

SEQ ID NO: 1940858 - protein, 11 aa, Staphylococcus
EYQAQHSSINE

SEQ ID NO: 1940859 - protein, 9 aa, Staphylococcus
EYQESDGSM

SEQ ID NO: 1940860 - protein, 6 aa, Staphylococcus
EYQLEA

SEQ ID NO: 1940861 - protein, 7 aa, Staphylococcus
EYQNPNV

SEQ ID NO: 1940862 - protein, 8 aa, Staphylococcus
EYQQTEDK

SEQ ID NO: 1940863 - protein, 5 aa, Staphylococcus
EYQSP

SEQ ID NO: 1940864 - protein, 8 aa, Staphylococcus
EYQSRSGS

SEQ ID NO: 1940865 - protein, 7 aa, Staphylococcus
EYQTDKR

SEQ ID NO: 1940866 - protein, 13 aa, Staphylococcus
EYQYNEVKKNFKD

SEQ ID NO: 1940867 - protein, 4 aa, Staphylococcus
EYRD

SEQ ID NO: 1940868 - protein, 20 aa, Staphylococcus
EYRDEASEAEIEATGAGDQG

SEQ ID NO: 1940869 - protein, 5 aa, Staphylococcus
EYRQH

SEQ ID NO: 1940870 - protein, 5 aa, Staphylococcus
EYSDA

SEQ ID NO: 1940871 - protein, 8 aa, Staphylococcus
EYSDASST

SEQ ID NO: 1940872 - protein, 8 aa, Staphylococcus
EYSDQTAV

SEQ ID NO: 1940873 - protein, 9 aa, Staphylococcus
EYSDSTQQL

SEQ ID NO: 1940874 - protein, 7 aa, Staphylococcus
EYSGQLD

SEQ ID NO: 1940875 - protein, 19 aa, Staphylococcus
EYSKIDDLPGQAKKSIQPN

SEQ ID NO: 1940876 - protein, 7 aa, Staphylococcus
EYSKSQV

SEQ ID NO: 1940877 - protein, 12 aa, Staphylococcus
EYSTKTVYPDKE

SEQ ID NO: 1940878 - protein, 5 aa, Staphylococcus
EYTDE

SEQ ID NO: 1940879 - protein, 9 aa, Staphylococcus
EYTDGQSEL

SEQ ID NO: 1940880 - protein, 16 aa, Staphylococcus
EYTDSNVKVDNDKDQI

SEQ ID NO: 1940881 - protein, 12 aa, Staphylococcus
EYTHPNKNQESN

SEQ ID NO: 1940882 - protein, 5 aa, Staphylococcus
EYTHS

SEQ ID NO: 1940883 - protein, 22 aa, Staphylococcus
EYTLSKDEINQMRKGKVTADAF

SEQ ID NO: 1940884 - protein, 9 aa, Staphylococcus
EYTPKDEAV

SEQ ID NO: 1940885 - protein, 6 aa, Staphylococcus
EYTPKL

SEQ ID NO: 1940886 - protein, 8 aa, Staphylococcus
EYTPKLKR

SEQ ID NO: 1940887 - protein, 4 aa, Staphylococcus
EYTR

SEQ ID NO: 1940888 - protein, 7 aa, Staphylococcus
EYTSPLI

SEQ ID NO: 1940889 - protein, 12 aa, Staphylococcus
EYTSREDATEAL

SEQ ID NO: 1940890 - protein, 8 aa, Staphylococcus
EYTTDKRH

SEQ ID NO: 1940891 - protein, 8 aa, Staphylococcus
EYTTENSD

SEQ ID NO: 1940892 - protein, 12 aa, Staphylococcus
EYTTQTIYPDRD

SEQ ID NO: 1940893 - protein, 4 aa, Staphylococcus
EYVH

SEQ ID NO: 1940894 - protein, 6 aa, Staphylococcus
EYVKEE

SEQ ID NO: 1940895 - protein, 6 aa, Staphylococcus
EYVPSL

SEQ ID NO: 1940896 - protein, 6 aa, Staphylococcus
EYVSKG

SEQ ID NO: 1940897 - protein, 4 aa, Staphylococcus
EYYA

SEQ ID NO: 1940898 - protein, 5 aa, Staphylococcus
EYYAP

SEQ ID NO: 1940899 - protein, 6 aa, Staphylococcus
EYYAPN

SEQ ID NO: 1940900 - protein, 7 aa, Staphylococcus
FADEEEA

SEQ ID NO: 1940901 - protein, 30 aa, Staphylococcus
FADGTGKQQGRGAYVSKDVKSVEDAQKNGV

SEQ ID NO: 1940902 - protein, 29 aa, Staphylococcus
FADGTGKQQGRGAYVSKDVQSVEAAQEKG

SEQ ID NO: 1940903 - protein, 5 aa, Staphylococcus
FAEAG

SEQ ID NO: 1940904 - protein, 4 aa, Staphylococcus
FAEE

SEQ ID NO: 1940905 - protein, 7 aa, Staphylococcus
FAEEGKP

SEQ ID NO: 1940906 - protein, 10 aa, Staphylococcus
FAEGKNNLFS

SEQ ID NO: 1940907 - protein, 6 aa, Staphylococcus
FAERTA

SEQ ID NO: 1940908 - protein, 7 aa, Staphylococcus
FAESKKP

SEQ ID NO: 1940909 - protein, 8 aa, Staphylococcus
FAGEKGGQ

SEQ ID NO: 1940910 - protein, 11 aa, Staphylococcus
FAGGRESANRI

SEQ ID NO: 1940911 - protein, 6 aa, Staphylococcus
FAGHNQ

SEQ ID NO: 1940912 - protein, 11 aa, Staphylococcus
FAGQEATIKTG

SEQ ID NO: 1940913 - protein, 12 aa, Staphylococcus
FAGQEATLKTGE

SEQ ID NO: 1940914 - protein, 10 aa, Staphylococcus
FAGREAALKT

SEQ ID NO: 1940915 - protein, 14 aa, Staphylococcus
FAGTEATLKSGQAL

SEQ ID NO: 1940916 - protein, 6 aa, Staphylococcus
FAKEEN

SEQ ID NO: 1940917 - protein, 8 aa, Staphylococcus
FAKEGKPV

SEQ ID NO: 1940918 - protein, 13 aa, Staphylococcus
FAKEHSPNSIEGT

SEQ ID NO: 1940919 - protein, 10 aa, Staphylococcus
FAKGSARSIE

SEQ ID NO: 1940920 - protein, 9 aa, Staphylococcus
FAKKTETNI

SEQ ID NO: 1940921 - protein, 12 aa, Staphylococcus
FAKLTGGKAAET

SEQ ID NO: 1940922 - protein, 6 aa, Staphylococcus
FAKNDN

SEQ ID NO: 1940923 - protein, 5 aa, Staphylococcus
FANEE

SEQ ID NO: 1940924 - protein, 12 aa, Staphylococcus
FANESYSDQSEH

SEQ ID NO: 1940925 - protein, 7 aa, Staphylococcus
FANGDTF

SEQ ID NO: 1940926 - protein, 7 aa, Staphylococcus
FANGENL

SEQ ID NO: 1940927 - protein, 4 aa, Staphylococcus
FANK

SEQ ID NO: 1940928 - protein, 4 aa, Staphylococcus
FANL

SEQ ID NO: 1940929 - protein, 17 aa, Staphylococcus
FANQSQQKAHQATINGK

SEQ ID NO: 1940930 - protein, 11 aa, Staphylococcus
FAPDGQDPSMI

SEQ ID NO: 1940931 - protein, 15 aa, Staphylococcus
FAPDNPKKGKATITG

SEQ ID NO: 1940932 - protein, 15 aa, Staphylococcus
FAPDNPKKGKKTITG

SEQ ID NO: 1940933 - protein, 7 aa, Staphylococcus
FAPDNQD

SEQ ID NO: 1940934 - protein, 8 aa, Staphylococcus
FAPGVSAN

SEQ ID NO: 1940935 - protein, 12 aa, Staphylococcus
FAPGVSAPAVNG

SEQ ID NO: 1940936 - protein, 9 aa, Staphylococcus
FAPGVSEPT

SEQ ID NO: 1940937 - protein, 10 aa, Staphylococcus
FAPGVSSPSV

SEQ ID NO: 1940938 - protein, 4 aa, Staphylococcus
FAPK

SEQ ID NO: 1940939 - protein, 5 aa, Staphylococcus
FAPKG

SEQ ID NO: 1940940 - protein, 15 aa, Staphylococcus
FAPNNPKLDKKTITG

SEQ ID NO: 1940941 - protein, 21 aa, Staphylococcus
FAPTDKAAENLKKENKTEESI

SEQ ID NO: 1940942 - protein, 18 aa, Staphylococcus
FAPTRTFKGHAADDKKTS

SEQ ID NO: 1940943 - protein, 20 aa, Staphylococcus
FAQDTNELERRRQAAESARL

SEQ ID NO: 1940944 - protein, 4 aa, Staphylococcus
FAQE

SEQ ID NO: 1940945 - protein, 4 aa, Staphylococcus
FAQG

SEQ ID NO: 1940946 - protein, 11 aa, Staphylococcus
FAQGGKPTTGL

SEQ ID NO: 1940947 - protein, 11 aa, Staphylococcus
FAQRRKTINNN

SEQ ID NO: 1940948 - protein, 9 aa, Staphylococcus
FASAQGKKV

SEQ ID NO: 1940949 - protein, 7 aa, Staphylococcus
FASEGKP

SEQ ID NO: 1940950 - protein, 8 aa, Staphylococcus
FASGFEES

SEQ ID NO: 1940951 - protein, 8 aa, Staphylococcus
FASGSSIR

SEQ ID NO: 1940952 - protein, 5 aa, Staphylococcus
FASGT

SEQ ID NO: 1940953 - protein, 20 aa, Staphylococcus
FASNKKELEDKAAQLTTGDV

SEQ ID NO: 1940954 - protein, 6 aa, Staphylococcus
FASPTV

SEQ ID NO: 1940955 - protein, 15 aa, Staphylococcus
FASTEEGNALTEQEQ

SEQ ID NO: 1940956 - protein, 15 aa, Staphylococcus
FASTEEGNKLTEDAQ

SEQ ID NO: 1940957 - protein, 7 aa, Staphylococcus
FATEGAA

SEQ ID NO: 1940958 - protein, 6 aa, Staphylococcus
FATEHG

SEQ ID NO: 1940959 - protein, 7 aa, Staphylococcus
FATEHGE

SEQ ID NO: 1940960 - protein, 14 aa, Staphylococcus
FATPDYDKIQSMKV

SEQ ID NO: 1940961 - protein, 7 aa, Staphylococcus
FATTDEW

SEQ ID NO: 1940962 - protein, 21 aa, Staphylococcus
FATTDKAKGALKQLADNEGYE

SEQ ID NO: 1940963 - protein, 21 aa, Staphylococcus
FATTDKAKGALKQLADNESYE

SEQ ID NO: 1940964 - protein, 20 aa, Staphylococcus
FATTDKEKGALKQLATNEGY

SEQ ID NO: 1940965 - protein, 9 aa, Staphylococcus
FATTKEWQR

SEQ ID NO: 1940966 - protein, 8 aa, Staphylococcus
FAVEDPGY

SEQ ID NO: 1940967 - protein, 7 aa, Staphylococcus
FAYDDSE

SEQ ID NO: 1940968 - protein, 4 aa, Staphylococcus
FDAD

SEQ ID NO: 1940969 - protein, 7 aa, Staphylococcus
FDADNQS

SEQ ID NO: 1940970 - protein, 8 aa, Staphylococcus
FDADNQSI

SEQ ID NO: 1940971 - protein, 5 aa, Staphylococcus
FDAKG

SEQ ID NO: 1940972 - protein, 9 aa, Staphylococcus
FDAPKTKEF

SEQ ID NO: 1940973 - protein, 6 aa, Staphylococcus
FDAPTL

SEQ ID NO: 1940974 - protein, 4 aa, Staphylococcus
FDAQ

SEQ ID NO: 1940975 - protein, 6 aa, Staphylococcus
FDAQPS

SEQ ID NO: 1940976 - protein, 12 aa, Staphylococcus
FDARQVAEYLTK

SEQ ID NO: 1940977 - protein, 10 aa, Staphylococcus
FDASGRRHTS

SEQ ID NO: 1940978 - protein, 7 aa, Staphylococcus
FDASKKG

SEQ ID NO: 1940979 - protein, 5 aa, Staphylococcus
FDASR

SEQ ID NO: 1940980 - protein, 11 aa, Staphylococcus
FDATGKDDQIE

SEQ ID NO: 1940981 - protein, 11 aa, Staphylococcus
FDATTQSGALQ

SEQ ID NO: 1940982 - protein, 8 aa, Staphylococcus
FDDEDNKI

SEQ ID NO: 1940983 - protein, 7 aa, Staphylococcus
FDDEPQL

SEQ ID NO: 1940984 - protein, 11 aa, Staphylococcus
FDDKDVTDDLS

SEQ ID NO: 1940985 - protein, 6 aa, Staphylococcus
FDDKND

SEQ ID NO: 1940986 - protein, 18 aa, Staphylococcus
FDDKNDLAQTLSQATNSE

SEQ ID NO: 1940987 - protein, 18 aa, Staphylococcus
FDDKNELANELSQATKSE

SEQ ID NO: 1940988 - protein, 18 aa, Staphylococcus
FDDKNELASTLSDATKSE

SEQ ID NO: 1940989 - protein, 18 aa, Staphylococcus
FDDKNELATTLGEATNSE

SEQ ID NO: 1940990 - protein, 8 aa, Staphylococcus
FDDKPHPL

SEQ ID NO: 1940991 - protein, 6 aa, Staphylococcus
FDDKSE

SEQ ID NO: 1940992 - protein, 25 aa, Staphylococcus
FDDNNSKKVTGVTYKKNGKEQTVKA

SEQ ID NO: 1940993 - protein, 13 aa, Staphylococcus
FDDNTNTENTRAA

SEQ ID NO: 1940994 - protein, 9 aa, Staphylococcus
FDDPSTSYK

SEQ ID NO: 1940995 - protein, 4 aa, Staphylococcus
FDDQ

SEQ ID NO: 1940996 - protein, 7 aa, Staphylococcus
FDDSTQT

SEQ ID NO: 1940997 - protein, 5 aa, Staphylococcus
FDEDI

SEQ ID NO: 1940998 - protein, 8 aa, Staphylococcus
FDEEGKNL

SEQ ID NO: 1940999 - protein, 7 aa, Staphylococcus
FDEGSTF

SEQ ID NO: 1941000 - protein, 4 aa, Staphylococcus
FDEI

SEQ ID NO: 1941001 - protein, 9 aa, Staphylococcus
FDEKKPAVI

SEQ ID NO: 1941002 - protein, 5 aa, Staphylococcus
FDEMP

SEQ ID NO: 1941003 - protein, 8 aa, Staphylococcus
FDENPTDK

SEQ ID NO: 1941004 - protein, 13 aa, Staphylococcus
FDENPTRSARDRH

SEQ ID NO: 1941005 - protein, 5 aa, Staphylococcus
FDEPK

SEQ ID NO: 1941006 - protein, 7 aa, Staphylococcus
FDEQEKE

SEQ ID NO: 1941007 - protein, 20 aa, Staphylococcus
FDEQQSLSPLKISNKEKSHI

SEQ ID NO: 1941008 - protein, 6 aa, Staphylococcus
FDEQTQ

SEQ ID NO: 1941009 - protein, 5 aa, Staphylococcus
FDESA

SEQ ID NO: 1941010 - protein, 8 aa, Staphylococcus
FDESYTKD

SEQ ID NO: 1941011 - protein, 10 aa, Staphylococcus
FDETQYNETK

SEQ ID NO: 1941012 - protein, 9 aa, Staphylococcus
FDGASDEDV

SEQ ID NO: 1941013 - protein, 6 aa, Staphylococcus
FDGDTE

SEQ ID NO: 1941014 - protein, 16 aa, Staphylococcus
FDGEKTGAYKVSDDEV

SEQ ID NO: 1941015 - protein, 11 aa, Staphylococcus
FDGGGSVPRED

SEQ ID NO: 1941016 - protein, 11 aa, Staphylococcus
FDGGIQDGTYE

SEQ ID NO: 1941017 - protein, 9 aa, Staphylococcus
FDGHPGNLA

SEQ ID NO: 1941018 - protein, 4 aa, Staphylococcus
FDGI

SEQ ID NO: 1941019 - protein, 6 aa, Staphylococcus
FDGKGQ

SEQ ID NO: 1941020 - protein, 14 aa, Staphylococcus
FDGTTDVESNASYL

SEQ ID NO: 1941021 - protein, 10 aa, Staphylococcus
FDKAKDDGFE

SEQ ID NO: 1941022 - protein, 7 aa, Staphylococcus
FDKASQT

SEQ ID NO: 1941023 - protein, 7 aa, Staphylococcus
FDKAYSD

SEQ ID NO: 1941024 - protein, 5 aa, Staphylococcus
FDKES

SEQ ID NO: 1941025 - protein, 8 aa, Staphylococcus
FDKETAKI

SEQ ID NO: 1941026 - protein, 7 aa, Staphylococcus
FDKEYTD

SEQ ID NO: 1941027 - protein, 11 aa, Staphylococcus
FDKKEREENID

SEQ ID NO: 1941028 - protein, 9 aa, Staphylococcus
FDKKNKRKA

SEQ ID NO: 1941029 - protein, 16 aa, Staphylococcus
FDKPENKTQMTPQEQV

SEQ ID NO: 1941030 - protein, 5 aa, Staphylococcus
FDKPG

SEQ ID NO: 1941031 - protein, 7 aa, Staphylococcus
FDKTPNL

SEQ ID NO: 1941032 - protein, 7 aa, Staphylococcus
FDMSDST

SEQ ID NO: 1941033 - protein, 7 aa, Staphylococcus
FDNAGRQ

SEQ ID NO: 1941034 - protein, 8 aa, Staphylococcus
FDNDTDYY

SEQ ID NO: 1941035 - protein, 5 aa, Staphylococcus
FDNEK

SEQ ID NO: 1941036 - protein, 6 aa, Staphylococcus
FDNGKA

SEQ ID NO: 1941037 - protein, 17 aa, Staphylococcus
FDNKEKFTANTQGHWQK

SEQ ID NO: 1941038 - protein, 10 aa, Staphylococcus
FDNKQQNNID

SEQ ID NO: 1941039 - protein, 5 aa, Staphylococcus
FDNPV

SEQ ID NO: 1941040 - protein, 5 aa, Staphylococcus
FDNQK

SEQ ID NO: 1941041 - protein, 7 aa, Staphylococcus
FDNSNGR

SEQ ID NO: 1941042 - protein, 11 aa, Staphylococcus
FDNYTSEDDLT

SEQ ID NO: 1941043 - protein, 14 aa, Staphylococcus
FDPDSAEDIHPNNR

SEQ ID NO: 1941044 - protein, 12 aa, Staphylococcus
FDPERKDRHHLP

SEQ ID NO: 1941045 - protein, 14 aa, Staphylococcus
FDPESADNIHPNNR

SEQ ID NO: 1941046 - protein, 6 aa, Staphylococcus
FDPMQT

SEQ ID NO: 1941047 - protein, 14 aa, Staphylococcus
FDPQSAKDIHPNNR

SEQ ID NO: 1941048 - protein, 11 aa, Staphylococcus
FDPSDDKARRV

SEQ ID NO: 1941049 - protein, 5 aa, Staphylococcus
FDPST

SEQ ID NO: 1941050 - protein, 4 aa, Staphylococcus
FDPT

SEQ ID NO: 1941051 - protein, 10 aa, Staphylococcus
FDPTDDGGQF

SEQ ID NO: 1941052 - protein, 11 aa, Staphylococcus
FDPTDDKGQFF

SEQ ID NO: 1941053 - protein, 11 aa, Staphylococcus
FDPTDNKGQFF

SEQ ID NO: 1941054 - protein, 15 aa, Staphylococcus
FDPVPLKKDKHTHHH

SEQ ID NO: 1941055 - protein, 6 aa, Staphylococcus
FDQAEN

SEQ ID NO: 1941056 - protein, 5 aa, Staphylococcus
FDQAQ

SEQ ID NO: 1941057 - protein, 4 aa, Staphylococcus
FDQE

SEQ ID NO: 1941058 - protein, 13 aa, Staphylococcus
FDQEGQQIKHLND

SEQ ID NO: 1941059 - protein, 4 aa, Staphylococcus
FDQF

SEQ ID NO: 1941060 - protein, 4 aa, Staphylococcus
FDQL

SEQ ID NO: 1941061 - protein, 5 aa, Staphylococcus
FDQLT

SEQ ID NO: 1941062 - protein, 5 aa, Staphylococcus
FDQQG

SEQ ID NO: 1941063 - protein, 8 aa, Staphylococcus
FDQRNGKK

SEQ ID NO: 1941064 - protein, 10 aa, Staphylococcus
FDQTELPGDY

SEQ ID NO: 1941065 - protein, 9 aa, Staphylococcus
FDQTNEAVT

SEQ ID NO: 1941066 - protein, 4 aa, Staphylococcus
FDQV

SEQ ID NO: 1941067 - protein, 5 aa, Staphylococcus
FDREA

SEQ ID NO: 1941068 - protein, 9 aa, Staphylococcus
FDREVQTEL

SEQ ID NO: 1941069 - protein, 7 aa, Staphylococcus
FDRQSGQ

SEQ ID NO: 1941070 - protein, 31 aa, Staphylococcus
FDRTASAEELKEEWDQYSKEELHEKEDEEAA

SEQ ID NO: 1941071 - protein, 26 aa, Staphylococcus
FDSDDSRAGRWSSFSKTECGLHVADK

SEQ ID NO: 1941072 - protein, 8 aa, Staphylococcus
FDSDGTPC

SEQ ID NO: 1941073 - protein, 25 aa, Staphylococcus
FDSDISNHSDSDIKGSVSKDPSRRV

SEQ ID NO: 1941074 - protein, 8 aa, Staphylococcus
FDSDYPAD

SEQ ID NO: 1941075 - protein, 6 aa, Staphylococcus
FDSEEE

SEQ ID NO: 1941076 - protein, 8 aa, Staphylococcus
FDSEEEAI

SEQ ID NO: 1941077 - protein, 14 aa, Staphylococcus
FDSEKKKARNAKES

SEQ ID NO: 1941078 - protein, 11 aa, Staphylococcus
FDSEKVSDVDA

SEQ ID NO: 1941079 - protein, 8 aa, Staphylococcus
FDSEQSIT

SEQ ID NO: 1941080 - protein, 11 aa, Staphylococcus
FDSESKATKAI

SEQ ID NO: 1941081 - protein, 12 aa, Staphylococcus
FDSINPANTSEL

SEQ ID NO: 1941082 - protein, 4 aa, Staphylococcus
FDSK

SEQ ID NO: 1941083 - protein, 9 aa, Staphylococcus
FDSKADYER

SEQ ID NO: 1941084 - protein, 8 aa, Staphylococcus
FDSKEDPN

SEQ ID NO: 1941085 - protein, 14 aa, Staphylococcus
FDSKKQEIAEKLNL

SEQ ID NO: 1941086 - protein, 10 aa, Staphylococcus
FDSKNKEHID

SEQ ID NO: 1941087 - protein, 8 aa, Staphylococcus
FDSKQDPE

SEQ ID NO: 1941088 - protein, 11 aa, Staphylococcus
FDSNEKKLKAL

SEQ ID NO: 1941089 - protein, 15 aa, Staphylococcus
FDSNEQVTDVEGEVN

SEQ ID NO: 1941090 - protein, 5 aa, Staphylococcus
FDSNQ

SEQ ID NO: 1941091 - protein, 5 aa, Staphylococcus
FDSPK

SEQ ID NO: 1941092 - protein, 21 aa, Staphylococcus
FDSSETITDVEGETSKFNNAI

SEQ ID NO: 1941093 - protein, 9 aa, Staphylococcus
FDSTSNVRA

SEQ ID NO: 1941094 - protein, 16 aa, Staphylococcus
FDTDTLEGIQSSNTDV

SEQ ID NO: 1941095 - protein, 11 aa, Staphylococcus
FDTEEEVPKQA

SEQ ID NO: 1941096 - protein, 7 aa, Staphylococcus
FDTETTL

SEQ ID NO: 1941097 - protein, 6 aa, Staphylococcus
FDTKEK

SEQ ID NO: 1941098 - protein, 8 aa, Staphylococcus
FDTKPRGL

SEQ ID NO: 1941099 - protein, 8 aa, Staphylococcus
FDTNFTTD

SEQ ID NO: 1941100 - protein, 4 aa, Staphylococcus
FDTP

SEQ ID NO: 1941101 - protein, 4 aa, Staphylococcus
FDTQ

SEQ ID NO: 1941102 - protein, 7 aa, Staphylococcus
FDTQTKL

SEQ ID NO: 1941103 - protein, 6 aa, Staphylococcus
FDTSNG

SEQ ID NO: 1941104 - protein, 40 aa, Staphylococcus
FDTSSNDRQNVNAQEATFTEESKDNNQQQEENQTTDKDID

SEQ ID NO: 1941105 - protein, 4 aa, Staphylococcus
FDTT

SEQ ID NO: 1941106 - protein, 4 aa, Staphylococcus
FDTV

SEQ ID NO: 1941107 - protein, 15 aa, Staphylococcus
FDYKGDGAYTSGQHP

SEQ ID NO: 1941108 - protein, 7 aa, Staphylococcus
FEAANGP

SEQ ID NO: 1941109 - protein, 10 aa, Staphylococcus
FEADDREQPN

SEQ ID NO: 1941110 - protein, 8 aa, Staphylococcus
FEAEGKAL

SEQ ID NO: 1941111 - protein, 33 aa, Staphylococcus
FEAENNKDETLDLEDTDSSTTNTYASQKQYKRE

SEQ ID NO: 1941112 - protein, 17 aa, Staphylococcus
FEAGDLPAPEGKKYAPA

SEQ ID NO: 1941113 - protein, 17 aa, Staphylococcus
FEAGDLPVPKGKQYAPA

SEQ ID NO: 1941114 - protein, 17 aa, Staphylococcus
FEAGDLPVPNGKTYAPA

SEQ ID NO: 1941115 - protein, 4 aa, Staphylococcus
FEAN

SEQ ID NO: 1941116 - protein, 18 aa, Staphylococcus
FEANENVSLKGEETTTGD

SEQ ID NO: 1941117 - protein, 11 aa, Staphylococcus
FEANPDELTNE

SEQ ID NO: 1941118 - protein, 6 aa, Staphylococcus
FEAPID

SEQ ID NO: 1941119 - protein, 4 aa, Staphylococcus
FEAR

SEQ ID NO: 1941120 - protein, 6 aa, Staphylococcus
FEARPD

SEQ ID NO: 1941121 - protein, 8 aa, Staphylococcus
FEASDVEN

SEQ ID NO: 1941122 - protein, 6 aa, Staphylococcus
FEATDD

SEQ ID NO: 1941123 - protein, 6 aa, Staphylococcus
FEATED

SEQ ID NO: 1941124 - protein, 12 aa, Staphylococcus
FEAYGSAYGHGV

SEQ ID NO: 1941125 - protein, 4 aa, Staphylococcus
FEDE

SEQ ID NO: 1941126 - protein, 6 aa, Staphylococcus
FEDEDL

SEQ ID NO: 1941127 - protein, 32 aa, Staphylococcus
FEDENEESVQGNQQQRRSHASDHSKRARHTNG

SEQ ID NO: 1941128 - protein, 7 aa, Staphylococcus
FEDENGP

SEQ ID NO: 1941129 - protein, 5 aa, Staphylococcus
FEDGF

SEQ ID NO: 1941130 - protein, 11 aa, Staphylococcus
FEDGKTVDEKM

SEQ ID NO: 1941131 - protein, 4 aa, Staphylococcus
FEDI

SEQ ID NO: 1941132 - protein, 18 aa, Staphylococcus
FEDKNDLAQSLSDATRSD

SEQ ID NO: 1941133 - protein, 60 aa, Staphylococcus
FEDKPATHARKQSNTGFGSSASNASGASSNDEGIGHAPRSNSSESSSESRTHTTKEDDIP

SEQ ID NO: 1941134 - protein, 60 aa, Staphylococcus
FEDKPSSQGRKASNTGFGSSATSSNTTKEDTFASNTTNASQSSDSASEGRAHTTNEDDIP

SEQ ID NO: 1941135 - protein, 61 aa, Staphylococcus
FEDKPSSQGRKASSTGFGSSVNSTSSTSSVGKEESMSSSATSSSSDSATERSHTTKDDDIP

SEQ ID NO: 1941136 - protein, 65 aa, Staphylococcus
FEDKPSSQGRKATSTGFGSSVNSSSSNQSHATPKEDSFATNTSTSSQSSEGVSERSHSTKDDDIP

SEQ ID NO: 1941137 - protein, 64 aa, Staphylococcus
FEDKPSTQGRKANTGFGSSAPSSSAPGTANTTKEEPSFKANHSSRNTEASAERTQTTKDDDIPS

SEQ ID NO: 1941138 - protein, 63 aa, Staphylococcus
FEDKPTSQGRKASSTGFGSSATSSPSTQSAPKEDSFTHSTSNSRPSDGLSERSHTTKDDDIPS

SEQ ID NO: 1941139 - protein, 63 aa, Staphylococcus
FEDKPTSQGRKASSTGFGTSATSSTSTQTSTPREESFSQSSSSSRSSESVSERSHTTKDDDIP

SEQ ID NO: 1941140 - protein, 6 aa, Staphylococcus
FEDKTK

SEQ ID NO: 1941141 - protein, 17 aa, Staphylococcus
FEDLDGKKESKNDPELG

SEQ ID NO: 1941142 - protein, 17 aa, Staphylococcus
FEDLDGKKESKNDSELG

SEQ ID NO: 1941143 - protein, 4 aa, Staphylococcus
FEDM

SEQ ID NO: 1941144 - protein, 7 aa, Staphylococcus
FEDNQSA

SEQ ID NO: 1941145 - protein, 15 aa, Staphylococcus
FEDQNEAIEKAGQAL

SEQ ID NO: 1941146 - protein, 8 aa, Staphylococcus
FEDSDKER

SEQ ID NO: 1941147 - protein, 14 aa, Staphylococcus
FEDSGAYTGETSPV

SEQ ID NO: 1941148 - protein, 9 aa, Staphylococcus
FEDSPGEHN

SEQ ID NO: 1941149 - protein, 9 aa, Staphylococcus
FEDTDDIEN

SEQ ID NO: 1941150 - protein, 17 aa, Staphylococcus
FEDVDGKKESKNDPELG

SEQ ID NO: 1941151 - protein, 5 aa, Staphylococcus
FEEAT

SEQ ID NO: 1941152 - protein, 7 aa, Staphylococcus
FEEDQSA

SEQ ID NO: 1941153 - protein, 5 aa, Staphylococcus
FEEEG

SEQ ID NO: 1941154 - protein, 6 aa, Staphylococcus
FEEESR

SEQ ID NO: 1941155 - protein, 6 aa, Staphylococcus
FEEGKG

SEQ ID NO: 1941156 - protein, 8 aa, Staphylococcus
FEEGSAVP

SEQ ID NO: 1941157 - protein, 9 aa, Staphylococcus
FEEGTSVKS

SEQ ID NO: 1941158 - protein, 11 aa, Staphylococcus
FEEKSDYLETR

SEQ ID NO: 1941159 - protein, 6 aa, Staphylococcus
FEEKTK

SEQ ID NO: 1941160 - protein, 6 aa, Staphylococcus
FEEKTN

SEQ ID NO: 1941161 - protein, 4 aa, Staphylococcus
FEEL

SEQ ID NO: 1941162 - protein, 18 aa, Staphylococcus
FEENENVSLKGEETKTGD

SEQ ID NO: 1941163 - protein, 6 aa, Staphylococcus
FEENKT

SEQ ID NO: 1941164 - protein, 12 aa, Staphylococcus
FEENPYNQPGRV

SEQ ID NO: 1941165 - protein, 7 aa, Staphylococcus
FEENQSA

SEQ ID NO: 1941166 - protein, 5 aa, Staphylococcus
FEEPA

SEQ ID NO: 1941167 - protein, 7 aa, Staphylococcus
FEEQTEI

SEQ ID NO: 1941168 - protein, 10 aa, Staphylococcus
FEEREDTLTE

SEQ ID NO: 1941169 - protein, 7 aa, Staphylococcus
FEERNQK

SEQ ID NO: 1941170 - protein, 8 aa, Staphylococcus
FEERQNQT

SEQ ID NO: 1941171 - protein, 10 aa, Staphylococcus
FEETSRKQKQ

SEQ ID NO: 1941172 - protein, 11 aa, Staphylococcus
FEGDASAKENI

SEQ ID NO: 1941173 - protein, 25 aa, Staphylococcus
FEGDEQKVKSPDDRNADKNATEEFR

SEQ ID NO: 1941174 - protein, 23 aa, Staphylococcus
FEGDEQKVKSPDDRNADKNATVE

SEQ ID NO: 1941175 - protein, 25 aa, Staphylococcus
FEGDEQKVKSPNDRNADKNATEDFK

SEQ ID NO: 1941176 - protein, 24 aa, Staphylococcus
FEGDEQKVKSPNDRNADKNATEEF

SEQ ID NO: 1941177 - protein, 10 aa, Staphylococcus
FEGEDTKIVD

SEQ ID NO: 1941178 - protein, 15 aa, Staphylococcus
FEGEHGAKRSAAEQV

SEQ ID NO: 1941179 - protein, 5 aa, Staphylococcus
FEGEM

SEQ ID NO: 1941180 - protein, 15 aa, Staphylococcus
FEGENGAKRSAEEQV

SEQ ID NO: 1941181 - protein, 10 aa, Staphylococcus
FEGESTWGDY

SEQ ID NO: 1941182 - protein, 11 aa, Staphylococcus
FEGHPDNVAPT

SEQ ID NO: 1941183 - protein, 12 aa, Staphylococcus
FEGHPDNVAPTI

SEQ ID NO: 1941184 - protein, 15 aa, Staphylococcus
FEGPEGAKRTSAEQV

SEQ ID NO: 1941185 - protein, 7 aa, Staphylococcus
FEGPGIS

SEQ ID NO: 1941186 - protein, 23 aa, Staphylococcus
FEGPSYASAKEGVEANYENDVTD

SEQ ID NO: 1941187 - protein, 8 aa, Staphylococcus
FEGPTGRY

SEQ ID NO: 1941188 - protein, 5 aa, Staphylococcus
FEGQT

SEQ ID NO: 1941189 - protein, 13 aa, Staphylococcus
FEGRDAWDNNDRP

SEQ ID NO: 1941190 - protein, 12 aa, Staphylococcus
FEGRQLQNGDEI

SEQ ID NO: 1941191 - protein, 7 aa, Staphylococcus
FEGRVTK

SEQ ID NO: 1941192 - protein, 9 aa, Staphylococcus
FEGTAGKQK

SEQ ID NO: 1941193 - protein, 6 aa, Staphylococcus
FEGTED

SEQ ID NO: 1941194 - protein, 8 aa, Staphylococcus
FEGTKKLD

SEQ ID NO: 1941195 - protein, 4 aa, Staphylococcus
FEIE

SEQ ID NO: 1941196 - protein, 5 aa, Staphylococcus
FEKAT

SEQ ID NO: 1941197 - protein, 9 aa, Staphylococcus
FEKATPSHE

SEQ ID NO: 1941198 - protein, 4 aa, Staphylococcus
FEKD

SEQ ID NO: 1941199 - protein, 17 aa, Staphylococcus
FEKDKKDLSHYQQTTRK

SEQ ID NO: 1941200 - protein, 11 aa, Staphylococcus
FEKEDGTEYAG

SEQ ID NO: 1941201 - protein, 9 aa, Staphylococcus
FEKETKEGH

SEQ ID NO: 1941202 - protein, 4 aa, Staphylococcus
FEKG

SEQ ID NO: 1941203 - protein, 7 aa, Staphylococcus
FEKGELN

SEQ ID NO: 1941204 - protein, 38 aa, Staphylococcus
FEKKQQQENHSQPVNSHEEDEKNDDKAYHSSQTHYEPT

SEQ ID NO: 1941205 - protein, 6 aa, Staphylococcus
FEKPSE

SEQ ID NO: 1941206 - protein, 8 aa, Staphylococcus
FEKPTEIQ

SEQ ID NO: 1941207 - protein, 8 aa, Staphylococcus
FEKSGYEV

SEQ ID NO: 1941208 - protein, 7 aa, Staphylococcus
FEMSGGQ

SEQ ID NO: 1941209 - protein, 4 aa, Staphylococcus
FENA

SEQ ID NO: 1941210 - protein, 10 aa, Staphylococcus
FENDADNNTV

SEQ ID NO: 1941211 - protein, 20 aa, Staphylococcus
FENDDKQTTIEYLKTIRNVL

SEQ ID NO: 1941212 - protein, 4 aa, Staphylococcus
FENE

SEQ ID NO: 1941213 - protein, 13 aa, Staphylococcus
FENESYSDQSEHT

SEQ ID NO: 1941214 - protein, 9 aa, Staphylococcus
FENETPLPT

SEQ ID NO: 1941215 - protein, 9 aa, Staphylococcus
FENETTPLP

SEQ ID NO: 1941216 - protein, 10 aa, Staphylococcus
FENGESELIP

SEQ ID NO: 1941217 - protein, 8 aa, Staphylococcus
FENGPDYD

SEQ ID NO: 1941218 - protein, 14 aa, Staphylococcus
FENKDAEGNPHAPG

SEQ ID NO: 1941219 - protein, 13 aa, Staphylococcus
FENKDSDGNQHLP

SEQ ID NO: 1941220 - protein, 13 aa, Staphylococcus
FENKDTDGNQHLP

SEQ ID NO: 1941221 - protein, 5 aa, Staphylococcus
FENKE

SEQ ID NO: 1941222 - protein, 6 aa, Staphylococcus
FENNPH

SEQ ID NO: 1941223 - protein, 8 aa, Staphylococcus
FENPANPE

SEQ ID NO: 1941224 - protein, 8 aa, Staphylococcus
FENRNNKQ

SEQ ID NO: 1941225 - protein, 50 aa, Staphylococcus
FENRTASNPPAEKPDEETDRVNENSDTQAFQTNEQTSENGSDASYQAGQR

SEQ ID NO: 1941226 - protein, 4 aa, Staphylococcus
FENT

SEQ ID NO: 1941227 - protein, 6 aa, Staphylococcus
FENTGQ

SEQ ID NO: 1941228 - protein, 13 aa, Staphylococcus
FENYTTSKKPDKK

SEQ ID NO: 1941229 - protein, 11 aa, Staphylococcus
FEPDAKRHAQY

SEQ ID NO: 1941230 - protein, 6 aa, Staphylococcus
FEPDKE

SEQ ID NO: 1941231 - protein, 7 aa, Staphylococcus
FEPDSEE

SEQ ID NO: 1941232 - protein, 14 aa, Staphylococcus
FEPEGEERNGNGFI

SEQ ID NO: 1941233 - protein, 8 aa, Staphylococcus
FEPEQNET

SEQ ID NO: 1941234 - protein, 4 aa, Staphylococcus
FEPG

SEQ ID NO: 1941235 - protein, 9 aa, Staphylococcus
FEPGDEKKV

SEQ ID NO: 1941236 - protein, 9 aa, Staphylococcus
FEPGDGPRH

SEQ ID NO: 1941237 - protein, 6 aa, Staphylococcus
FEPGDV

SEQ ID NO: 1941238 - protein, 9 aa, Staphylococcus
FEPKENGEA

SEQ ID NO: 1941239 - protein, 24 aa, Staphylococcus
FEPKQVDNTEEEAAKQVIVDRVAK

SEQ ID NO: 1941240 - protein, 16 aa, Staphylococcus
FEPNENVSLKGEETEI

SEQ ID NO: 1941241 - protein, 10 aa, Staphylococcus
FEPPRNDTEQ

SEQ ID NO: 1941242 - protein, 11 aa, Staphylococcus
FEPQGDQPEAI

SEQ ID NO: 1941243 - protein, 10 aa, Staphylococcus
FEPSPGDHDY

SEQ ID NO: 1941244 - protein, 14 aa, Staphylococcus
FEPSSRKNPERYKY

SEQ ID NO: 1941245 - protein, 8 aa, Staphylococcus
FEPTEGDF

SEQ ID NO: 1941246 - protein, 16 aa, Staphylococcus
FEPTIESAADSRAPHR

SEQ ID NO: 1941247 - protein, 16 aa, Staphylococcus
FEPTIESAAENRAPHR

SEQ ID NO: 1941248 - protein, 6 aa, Staphylococcus
FEPTQK

SEQ ID NO: 1941249 - protein, 4 aa, Staphylococcus
FEPY

SEQ ID NO: 1941250 - protein, 7 aa, Staphylococcus
FEQGKGD

SEQ ID NO: 1941251 - protein, 6 aa, Staphylococcus
FEQKTK

SEQ ID NO: 1941252 - protein, 5 aa, Staphylococcus
FEQNP

SEQ ID NO: 1941253 - protein, 8 aa, Staphylococcus
FEQPDDGD

SEQ ID NO: 1941254 - protein, 8 aa, Staphylococcus
FEQPNEGQ

SEQ ID NO: 1941255 - protein, 12 aa, Staphylococcus
FEQPSNIQFKAL

SEQ ID NO: 1941256 - protein, 5 aa, Staphylococcus
FEQPT

SEQ ID NO: 1941257 - protein, 7 aa, Staphylococcus
FEQRETI

SEQ ID NO: 1941258 - protein, 8 aa, Staphylococcus
FEQRNQKQ

SEQ ID NO: 1941259 - protein, 11 aa, Staphylococcus
FEQSTMNESRY

SEQ ID NO: 1941260 - protein, 7 aa, Staphylococcus
FEQTELP

SEQ ID NO: 1941261 - protein, 10 aa, Staphylococcus
FEQTELPGDY

SEQ ID NO: 1941262 - protein, 9 aa, Staphylococcus
FEREKAYGK

SEQ ID NO: 1941263 - protein, 6 aa, Staphylococcus
FERQSE

SEQ ID NO: 1941264 - protein, 16 aa, Staphylococcus
FERSATASELKSQWDE

SEQ ID NO: 1941265 - protein, 4 aa, Staphylococcus
FESD

SEQ ID NO: 1941266 - protein, 5 aa, Staphylococcus
FESDI

SEQ ID NO: 1941267 - protein, 12 aa, Staphylococcus
FESDQRIDYSQY

SEQ ID NO: 1941268 - protein, 11 aa, Staphylococcus
FESDSVDRTFN

SEQ ID NO: 1941269 - protein, 7 aa, Staphylococcus
FESDTDT

SEQ ID NO: 1941270 - protein, 8 aa, Staphylococcus
FESDTDTF

SEQ ID NO: 1941271 - protein, 4 aa, Staphylococcus
FESE

SEQ ID NO: 1941272 - protein, 7 aa, Staphylococcus
FESETDT

SEQ ID NO: 1941273 - protein, 6 aa, Staphylococcus
FESNGK

SEQ ID NO: 1941274 - protein, 16 aa, Staphylococcus
FESQREELVQNLKTLQ

SEQ ID NO: 1941275 - protein, 8 aa, Staphylococcus
FESSAAKF

SEQ ID NO: 1941276 - protein, 6 aa, Staphylococcus
FESTGT

SEQ ID NO: 1941277 - protein, 11 aa, Staphylococcus
FESTTKHTEID

SEQ ID NO: 1941278 - protein, 6 aa, Staphylococcus
FETDID

SEQ ID NO: 1941279 - protein, 8 aa, Staphylococcus
FETDTEIG

SEQ ID NO: 1941280 - protein, 13 aa, Staphylococcus
FETEDNPGAYRET

SEQ ID NO: 1941281 - protein, 8 aa, Staphylococcus
FETGEVNG

SEQ ID NO: 1941282 - protein, 9 aa, Staphylococcus
FETGRGSIQ

SEQ ID NO: 1941283 - protein, 13 aa, Staphylococcus
FETHEARDGKEAY

SEQ ID NO: 1941284 - protein, 13 aa, Staphylococcus
FETLEDGSTLATI

SEQ ID NO: 1941285 - protein, 19 aa, Staphylococcus
FETNPKYRAQINSGKSYPR

SEQ ID NO: 1941286 - protein, 8 aa, Staphylococcus
FETPDSGE

SEQ ID NO: 1941287 - protein, 9 aa, Staphylococcus
FETPKTKEF

SEQ ID NO: 1941288 - protein, 7 aa, Staphylococcus
FETPTNL

SEQ ID NO: 1941289 - protein, 4 aa, Staphylococcus
FETS

SEQ ID NO: 1941290 - protein, 22 aa, Staphylococcus
FETSQLSQGMKAKTKYKGTSIS

SEQ ID NO: 1941291 - protein, 9 aa, Staphylococcus
FETSTFKKG

SEQ ID NO: 1941292 - protein, 15 aa, Staphylococcus
FETSTSSVKKGESLY

SEQ ID NO: 1941293 - protein, 11 aa, Staphylococcus
FETTAQELGGE

SEQ ID NO: 1941294 - protein, 5 aa, Staphylococcus
FETTD

SEQ ID NO: 1941295 - protein, 15 aa, Staphylococcus
FETTIESAAEHRAPH

SEQ ID NO: 1941296 - protein, 16 aa, Staphylococcus
FETTIQSAAANRAPHR

SEQ ID NO: 1941297 - protein, 5 aa, Staphylococcus
FEVET

SEQ ID NO: 1941298 - protein, 5 aa, Staphylococcus
FEVGN

SEQ ID NO: 1941299 - protein, 4 aa, Staphylococcus
FEYH

SEQ ID NO: 1941300 - protein, 6 aa, Staphylococcus
FEYNDG

SEQ ID NO: 1941301 - protein, 4 aa, Staphylococcus
FEYS

SEQ ID NO: 1941302 - protein, 4 aa, Staphylococcus
FFDP

SEQ ID NO: 1941303 - protein, 13 aa, Staphylococcus
FFDPNGKDQLTED

SEQ ID NO: 1941304 - protein, 9 aa, Staphylococcus
FFDSKEDPN

SEQ ID NO: 1941305 - protein, 9 aa, Staphylococcus
FFQSKSDPK

SEQ ID NO: 1941306 - protein, 7 aa, Staphylococcus
FGAPHET

SEQ ID NO: 1941307 - protein, 15 aa, Staphylococcus
FGAPTSTDAAATEPT

SEQ ID NO: 1941308 - protein, 7 aa, Staphylococcus
FGASYQY

SEQ ID NO: 1941309 - protein, 12 aa, Staphylococcus
FGATKGLQEKYG

SEQ ID NO: 1941310 - protein, 16 aa, Staphylococcus
FGDDSSESLRQASAKT

SEQ ID NO: 1941311 - protein, 14 aa, Staphylococcus
FGDDSTEALRQKSA

SEQ ID NO: 1941312 - protein, 14 aa, Staphylococcus
FGDDSTEENRQASA

SEQ ID NO: 1941313 - protein, 15 aa, Staphylococcus
FGDEGEQNANKKGGK

SEQ ID NO: 1941314 - protein, 7 aa, Staphylococcus
FGDGASA

SEQ ID NO: 1941315 - protein, 5 aa, Staphylococcus
FGDHP

SEQ ID NO: 1941316 - protein, 4 aa, Staphylococcus
FGDQ

SEQ ID NO: 1941317 - protein, 9 aa, Staphylococcus
FGDQEKKEL

SEQ ID NO: 1941318 - protein, 12 aa, Staphylococcus
FGDVTGRTLGHE

SEQ ID NO: 1941319 - protein, 6 aa, Staphylococcus
FGEATK

SEQ ID NO: 1941320 - protein, 9 aa, Staphylococcus
FGEATRRAI

SEQ ID NO: 1941321 - protein, 9 aa, Staphylococcus
FGEDQRSQF

SEQ ID NO: 1941322 - protein, 9 aa, Staphylococcus
FGEDSDIAN

SEQ ID NO: 1941323 - protein, 8 aa, Staphylococcus
FGEDTDIA

SEQ ID NO: 1941324 - protein, 13 aa, Staphylococcus
FGEEEEDPYDDDT

SEQ ID NO: 1941325 - protein, 13 aa, Staphylococcus
FGEETEDPYDEDT

SEQ ID NO: 1941326 - protein, 7 aa, Staphylococcus
FGEGKGD

SEQ ID NO: 1941327 - protein, 10 aa, Staphylococcus
FGEGSAKTKV

SEQ ID NO: 1941328 - protein, 4 aa, Staphylococcus
FGEI

SEQ ID NO: 1941329 - protein, 4 aa, Staphylococcus
FGEK

SEQ ID NO: 1941330 - protein, 12 aa, Staphylococcus
FGELVEKAKAAL

SEQ ID NO: 1941331 - protein, 12 aa, Staphylococcus
FGELVSKAKDAL

SEQ ID NO: 1941332 - protein, 12 aa, Staphylococcus
FGELVSKAKEAL

SEQ ID NO: 1941333 - protein, 10 aa, Staphylococcus
FGENESETQV

SEQ ID NO: 1941334 - protein, 29 aa, Staphylococcus
FGENTAKAEKNIYNNSNSSETLKTKVNEL

SEQ ID NO: 1941335 - protein, 30 aa, Staphylococcus; identical to SEQ ID NO: 1778130

SEQ ID NO: 1941336 - protein, 10 aa, Staphylococcus
FGEPSKEARK

SEQ ID NO: 1941337 - protein, 10 aa, Staphylococcus
FGEQEEHHAR

SEQ ID NO: 1941338 - protein, 8 aa, Staphylococcus
FGEQGPKG

SEQ ID NO: 1941339 - protein, 10 aa, Staphylococcus
FGEQGQHALS

SEQ ID NO: 1941340 - protein, 18 aa, Staphylococcus
FGEQQEHHAREITPEEIE

SEQ ID NO: 1941341 - protein, 6 aa, Staphylococcus
FGESYT

SEQ ID NO: 1941342 - protein, 12 aa, Staphylococcus
FGGASEGNDYET

SEQ ID NO: 1941343 - protein, 13 aa, Staphylococcus
FGGATEGQDYESI

SEQ ID NO: 1941344 - protein, 17 aa, Staphylococcus
FGGDKTVISSGLETARE

SEQ ID NO: 1941345 - protein, 8 aa, Staphylococcus
FGGDPNNI

SEQ ID NO: 1941346 - protein, 8 aa, Staphylococcus
FGGDPNNV

SEQ ID NO: 1941347 - protein, 21 aa, Staphylococcus
FGGDPTGQKDSTKAFQDALGT

SEQ ID NO: 1941348 - protein, 14 aa, Staphylococcus
FGGENNEGEVPFKP

SEQ ID NO: 1941349 - protein, 10 aa, Staphylococcus
FGGGDNATVK

SEQ ID NO: 1941350 - protein, 8 aa, Staphylococcus
FGGGQRKR

SEQ ID NO: 1941351 - protein, 6 aa, Staphylococcus
FGGNPA

SEQ ID NO: 1941352 - protein, 16 aa, Staphylococcus
FGGQEPGTGEEATQNC

SEQ ID NO: 1941353 - protein, 8 aa, Staphylococcus
FGGQTAGN

SEQ ID NO: 1941354 - protein, 4 aa, Staphylococcus
FGGS

SEQ ID NO: 1941355 - protein, 6 aa, Staphylococcus
FGGSDG

SEQ ID NO: 1941356 - protein, 10 aa, Staphylococcus
FGGYDGKGQV

SEQ ID NO: 1941357 - protein, 12 aa, Staphylococcus
FGKDLKSAEDLN

SEQ ID NO: 1941358 - protein, 12 aa, Staphylococcus
FGKEEGVSEDTY

SEQ ID NO: 1941359 - protein, 11 aa, Staphylococcus
FGKEISKDENL

SEQ ID NO: 1941360 - protein, 10 aa, Staphylococcus
FGKKGEKIVE

SEQ ID NO: 1941361 - protein, 11 aa, Staphylococcus
FGKKGHESTHN

SEQ ID NO: 1941362 - protein, 13 aa, Staphylococcus
FGKKGNEGEVPFK

SEQ ID NO: 1941363 - protein, 5 aa, Staphylococcus
FGKNR

SEQ ID NO: 1941364 - protein, 9 aa, Staphylococcus
FGKNSDNTL

SEQ ID NO: 1941365 - protein, 17 aa, Staphylococcus
FGKPQKVITDRAPSTKV

SEQ ID NO: 1941366 - protein, 17 aa, Staphylococcus
FGKPQKVVTDQAPSTKV

SEQ ID NO: 1941367 - protein, 13 aa, Staphylococcus
FGKQNGQELEKDK

SEQ ID NO: 1941368 - protein, 12 aa, Staphylococcus
FGKSKQSEDTYK

SEQ ID NO: 1941369 - protein, 12 aa, Staphylococcus
FGKSYLKEMGVE

SEQ ID NO: 1941370 - protein, 8 aa, Staphylococcus
FGKTSDGK

SEQ ID NO: 1941371 - protein, 9 aa, Staphylococcus
FGLSESKAI

SEQ ID NO: 1941372 - protein, 15 aa, Staphylococcus
FGNETQLKEAINKNT

SEQ ID NO: 1941373 - protein, 10 aa, Staphylococcus
FGNGDAQTEV

SEQ ID NO: 1941374 - protein, 14 aa, Staphylococcus
FGNGERSTENRGAV

SEQ ID NO: 1941375 - protein, 10 aa, Staphylococcus
FGNGQSETPV

SEQ ID NO: 1941376 - protein, 12 aa, Staphylococcus
FGNHDTEGHLKR

SEQ ID NO: 1941377 - protein, 9 aa, Staphylococcus
FGNKGYAKK

SEQ ID NO: 1941378 - protein, 10 aa, Staphylococcus
FGNKSDIQKT

SEQ ID NO: 1941379 - protein, 24 aa, Staphylococcus
FGNNDEEDEEPPTEDIKTKRSEIR

SEQ ID NO: 1941380 - protein, 13 aa, Staphylococcus
FGNPDKNISPDTY

SEQ ID NO: 1941381 - protein, 8 aa, Staphylococcus
FGNPEKYN

SEQ ID NO: 1941382 - protein, 11 aa, Staphylococcus
FGNPSEDAQSI

SEQ ID NO: 1941383 - protein, 7 aa, Staphylococcus
FGNPSSI

SEQ ID NO: 1941384 - protein, 5 aa, Staphylococcus
FGNQS

SEQ ID NO: 1941385 - protein, 11 aa, Staphylococcus
FGNSGGNRRQY

SEQ ID NO: 1941386 - protein, 5 aa, Staphylococcus
FGNSQ

SEQ ID NO: 1941387 - protein, 14 aa, Staphylococcus
FGNTPIGKITTTQC

SEQ ID NO: 1941388 - protein, 9 aa, Staphylococcus
FGNTTTSVE

SEQ ID NO: 1941389 - protein, 6 aa, Staphylococcus
FGNTTW

SEQ ID NO: 1941390 - protein, 4 aa, Staphylococcus
FGPD

SEQ ID NO: 1941391 - protein, 12 aa, Staphylococcus
FGPDAKDIDKDL

SEQ ID NO: 1941392 - protein, 10 aa, Staphylococcus
FGPDTAEQND

SEQ ID NO: 1941393 - protein, 10 aa, Staphylococcus
FGPDTEEQST

SEQ ID NO: 1941394 - protein, 9 aa, Staphylococcus
FGPENQQDY

SEQ ID NO: 1941395 - protein, 15 aa, Staphylococcus
FGPEVEEIANTGGFN

SEQ ID NO: 1941396 - protein, 15 aa, Staphylococcus
FGPEVEHISDKGAFN

SEQ ID NO: 1941397 - protein, 16 aa, Staphylococcus
FGPGEKAAQIEGSKSF

SEQ ID NO: 1941398 - protein, 8 aa, Staphylococcus
FGPGNQQA

SEQ ID NO: 1941399 - protein, 7 aa, Staphylococcus
FGPNEDF

SEQ ID NO: 1941400 - protein, 15 aa, Staphylococcus
FGPNEDFDAYPRQID

SEQ ID NO: 1941401 - protein, 17 aa, Staphylococcus
FGPNEDFDAYPRQIDQD

SEQ ID NO: 1941402 - protein, 14 aa, Staphylococcus
FGPNEDLDSYPRDI

SEQ ID NO: 1941403 - protein, 15 aa, Staphylococcus
FGPNEDYDAYPRQID

SEQ ID NO: 1941404 - protein, 13 aa, Staphylococcus
FGPNKDAAQIEGS

SEQ ID NO: 1941405 - protein, 17 aa, Staphylococcus
FGPSGANWHGDDEYADI

SEQ ID NO: 1941406 - protein, 10 aa, Staphylococcus
FGQGEAKTQV

SEQ ID NO: 1941407 - protein, 4 aa, Staphylococcus
FGQH

SEQ ID NO: 1941408 - protein, 20 aa, Staphylococcus
FGQKQEHDAREMTSEEIEQT

SEQ ID NO: 1941409 - protein, 6 aa, Staphylococcus
FGQQSY

SEQ ID NO: 1941410 - protein, 6 aa, Staphylococcus
FGRAAS

SEQ ID NO: 1941411 - protein, 11 aa, Staphylococcus
FGRGLNATTAL

SEQ ID NO: 1941412 - protein, 13 aa, Staphylococcus
FGRLSKKDKDEIE

SEQ ID NO: 1941413 - protein, 22 aa, Staphylococcus
FGSDFKSAEKLNNQLRQSFKEE

SEQ ID NO: 1941414 - protein, 23 aa, Staphylococcus
FGSDLASAEKLNKQIRKSFKEEE

SEQ ID NO: 1941415 - protein, 6 aa, Staphylococcus
FGSDLG

SEQ ID NO: 1941416 - protein, 4 aa, Staphylococcus
FGSE

SEQ ID NO: 1941417 - protein, 9 aa, Staphylococcus
FGSESANIE

SEQ ID NO: 1941418 - protein, 10 aa, Staphylococcus
FGSESANIEE

SEQ ID NO: 1941419 - protein, 9 aa, Staphylococcus
FGSESGNMD

SEQ ID NO: 1941420 - protein, 10 aa, Staphylococcus
FGSETPDITR

SEQ ID NO: 1941421 - protein, 4 aa, Staphylococcus
FGSL

SEQ ID NO: 1941422 - protein, 5 aa, Staphylococcus
FGSLD

SEQ ID NO: 1941423 - protein, 4 aa, Staphylococcus
FGSN

SEQ ID NO: 1941424 - protein, 9 aa, Staphylococcus
FGSNNVDNC

SEQ ID NO: 1941425 - protein, 6 aa, Staphylococcus
FGSPKM

SEQ ID NO: 1941426 - protein, 23 aa, Staphylococcus
FGSPNKSGTNGVHGAPLGEDERK

SEQ ID NO: 1941427 - protein, 5 aa, Staphylococcus
FGSRT

SEQ ID NO: 1941428 - protein, 6 aa, Staphylococcus
FGSSDS

SEQ ID NO: 1941429 - protein, 9 aa, Staphylococcus
FGSSYPGKY

SEQ ID NO: 1941430 - protein, 4 aa, Staphylococcus
FGST

SEQ ID NO: 1941431 - protein, 10 aa, Staphylococcus
FGSTEYPDTT

SEQ ID NO: 1941432 - protein, 4 aa, Staphylococcus
FGTD

SEQ ID NO: 1941433 - protein, 7 aa, Staphylococcus
FGTEAQL

SEQ ID NO: 1941434 - protein, 10 aa, Staphylococcus
FGTGEAKTEV

SEQ ID NO: 1941435 - protein, 8 aa, Staphylococcus
FGTGKVSE

SEQ ID NO: 1941436 - protein, 17 aa, Staphylococcus
FGTGTKPSDWGNDEVPS

SEQ ID NO: 1941437 - protein, 10 aa, Staphylococcus
FGTPDAKAQE

SEQ ID NO: 1941438 - protein, 10 aa, Staphylococcus
FGTPENQAQE

SEQ ID NO: 1941439 - protein, 10 aa, Staphylococcus
FGTPSEEAQT

SEQ ID NO: 1941440 - protein, 8 aa, Staphylococcus
FGTPSKEA

SEQ ID NO: 1941441 - protein, 9 aa, Staphylococcus
FGTRGLYGS

SEQ ID NO: 1941442 - protein, 12 aa, Staphylococcus
FGTSEGTSEDTY

SEQ ID NO: 1941443 - protein, 9 aa, Staphylococcus
FGTSKSSIL

SEQ ID NO: 1941444 - protein, 11 aa, Staphylococcus
FGVDTTAREAY

SEQ ID NO: 1941445 - protein, 11 aa, Staphylococcus
FGVEGKSADDV

SEQ ID NO: 1941446 - protein, 11 aa, Staphylococcus
FGVEGKSADEI

SEQ ID NO: 1941447 - protein, 20 aa, Staphylococcus
FGVGTESGKIISTNKNFDEK

SEQ ID NO: 1941448 - protein, 4 aa, Staphylococcus
FGVP

SEQ ID NO: 1941449 - protein, 6 aa, Staphylococcus
FGYDSQ

SEQ ID NO: 1941450 - protein, 5 aa, Staphylococcus
FGYTK

SEQ ID NO: 1941451 - protein, 10 aa, Staphylococcus
FHEKADPSLA

SEQ ID NO: 1941452 - protein, 4 aa, Staphylococcus
FHEP

SEQ ID NO: 1941453 - protein, 6 aa, Staphylococcus
FHGEAE

SEQ ID NO: 1941454 - protein, 8 aa, Staphylococcus
FHNKNNSI

SEQ ID NO: 1941455 - protein, 6 aa, Staphylococcus
FHPGQK

SEQ ID NO: 1941456 - protein, 6 aa, Staphylococcus
FHPTET

SEQ ID NO: 1941457 - protein, 5 aa, Staphylococcus
FHQPQ

SEQ ID NO: 1941458 - protein, 5 aa, Staphylococcus
FHQTG

SEQ ID NO: 1941459 - protein, 11 aa, Staphylococcus
FHSDAGSKHVD

SEQ ID NO: 1941460 - protein, 6 aa, Staphylococcus
FIGSTD

SEQ ID NO: 1941461 - protein, 11 aa, Staphylococcus
FINREENNTGV

SEQ ID NO: 1941462 - protein, 5 aa, Staphylococcus
FIRGK

SEQ ID NO: 1941463 - protein, 5 aa, Staphylococcus
FISRT

SEQ ID NO: 1941464 - protein, 13 aa, Staphylococcus
FITSKSEKSYSKE

SEQ ID NO: 1941465 - protein, 12 aa, Staphylococcus
FKAAEKPGSAIQ

SEQ ID NO: 1941466 - protein, 12 aa, Staphylococcus
FKAAEKPGSEIQ

SEQ ID NO: 1941467 - protein, 11 aa, Staphylococcus
FKADDEKQPNI

SEQ ID NO: 1941468 - protein, 13 aa, Staphylococcus
FKADPDIDGTKSE

SEQ ID NO: 1941469 - protein, 13 aa, Staphylococcus
FKADPEVDGTKSE

SEQ ID NO: 1941470 - protein, 7 aa, Staphylococcus
FKAEQTE

SEQ ID NO: 1941471 - protein, 19 aa, Staphylococcus
FKAKEKNDIELGDFKHVNH

SEQ ID NO: 1941472 - protein, 13 aa, Staphylococcus
FKANPDVDGTHSE

SEQ ID NO: 1941473 - protein, 7 aa, Staphylococcus
FKANTEV

SEQ ID NO: 1941474 - protein, 6 aa, Staphylococcus
FKAQTD

SEQ ID NO: 1941475 - protein, 9 aa, Staphylococcus
FKASDVPSA

SEQ ID NO: 1941476 - protein, 12 aa, Staphylococcus
FKDDAKEVSQGY

SEQ ID NO: 1941477 - protein, 17 aa, Staphylococcus
FKDDAVESGYVTGEAPE

SEQ ID NO: 1941478 - protein, 12 aa, Staphylococcus
FKDEDPNGPHAK

SEQ ID NO: 1941479 - protein, 10 aa, Staphylococcus
FKDGGIPTSG

SEQ ID NO: 1941480 - protein, 10 aa, Staphylococcus
FKDGGVPATE

SEQ ID NO: 1941481 - protein, 10 aa, Staphylococcus
FKDGSYNEKL

SEQ ID NO: 1941482 - protein, 12 aa, Staphylococcus
FKDISKTKEGHK

SEQ ID NO: 1941483 - protein, 11 aa, Staphylococcus
FKDKESELTDL

SEQ ID NO: 1941484 - protein, 5 aa, Staphylococcus
FKDNG

SEQ ID NO: 1941485 - protein, 6 aa, Staphylococcus
FKDPQQ

SEQ ID NO: 1941486 - protein, 8 aa, Staphylococcus
FKDQDGPR

SEQ ID NO: 1941487 - protein, 4 aa, Staphylococcus
FKDS

SEQ ID NO: 1941488 - protein, 10 aa, Staphylococcus
FKDSKDNDID

SEQ ID NO: 1941489 - protein, 11 aa, Staphylococcus
FKDSNNDGIGD

SEQ ID NO: 1941490 - protein, 7 aa, Staphylococcus
FKDTDTK

SEQ ID NO: 1941491 - protein, 16 aa, Staphylococcus
FKDTDTTALKNSLKKE

SEQ ID NO: 1941492 - protein, 9 aa, Staphylococcus
FKDTETLSE

SEQ ID NO: 1941493 - protein, 6 aa, Staphylococcus
FKDTNT

SEQ ID NO: 1941494 - protein, 20 aa, Staphylococcus
FKEAHEGKSKTKSDDSPILG

SEQ ID NO: 1941495 - protein, 20 aa, Staphylococcus
FKEAHQRPKDSKSDEPSPVI

SEQ ID NO: 1941496 - protein, 12 aa, Staphylococcus
FKEAQSEGKKYF

SEQ ID NO: 1941497 - protein, 14 aa, Staphylococcus
FKEEDVRKKGIENL

SEQ ID NO: 1941498 - protein, 6 aa, Staphylococcus
FKEEEV

SEQ ID NO: 1941499 - protein, 9 aa, Staphylococcus
FKEGLSKDY

SEQ ID NO: 1941500 - protein, 7 aa, Staphylococcus
FKENGWD

SEQ ID NO: 1941501 - protein, 9 aa, Staphylococcus
FKEPKSEKV

SEQ ID NO: 1941502 - protein, 5 aa, Staphylococcus
FKEQE

SEQ ID NO: 1941503 - protein, 6 aa, Staphylococcus
FKERDA

SEQ ID NO: 1941504 - protein, 14 aa, Staphylococcus
FKESMSAKEASLAI

SEQ ID NO: 1941505 - protein, 16 aa, Staphylococcus
FKESMTAKEAATAIQN

SEQ ID NO: 1941506 - protein, 12 aa, Staphylococcus
FKESNKKVINQY

SEQ ID NO: 1941507 - protein, 9 aa, Staphylococcus
FKESTNKDI

SEQ ID NO: 1941508 - protein, 5 aa, Staphylococcus
FKETQ

SEQ ID NO: 1941509 - protein, 10 aa, Staphylococcus
FKETSRKQKQ

SEQ ID NO: 1941510 - protein, 5 aa, Staphylococcus
FKGAH

SEQ ID NO: 1941511 - protein, 25 aa, Staphylococcus
FKGAYKSFSKAKQVIKNANKQDQSQ

SEQ ID NO: 1941512 - protein, 6 aa, Staphylococcus
FKGDRL

SEQ ID NO: 1941513 - protein, 4 aa, Staphylococcus
FKGE

SEQ ID NO: 1941514 - protein, 20 aa, Staphylococcus
FKGEATVYQNTPEFKAKPGD

SEQ ID NO: 1941515 - protein, 6 aa, Staphylococcus
FKGERL

SEQ ID NO: 1941516 - protein, 12 aa, Staphylococcus
FKGESKNNQYTF

SEQ ID NO: 1941517 - protein, 11 aa, Staphylococcus
FKGKVDNDEVT

SEQ ID NO: 1941518 - protein, 9 aa, Staphylococcus
FKGLAKPGP

SEQ ID NO: 1941519 - protein, 10 aa, Staphylococcus
FKGNKNSKVD

SEQ ID NO: 1941520 - protein, 10 aa, Staphylococcus
FKGPAKPGPI

SEQ ID NO: 1941521 - protein, 9 aa, Staphylococcus
FKGPKEAIG

SEQ ID NO: 1941522 - protein, 9 aa, Staphylococcus
FKGPSQGRT

SEQ ID NO: 1941523 - protein, 7 aa, Staphylococcus
FKGQHTS

SEQ ID NO: 1941524 - protein, 5 aa, Staphylococcus
FKGQK

SEQ ID NO: 1941525 - protein, 5 aa, Staphylococcus
FKGSV

SEQ ID NO: 1941526 - protein, 8 aa, Staphylococcus
FKGTEAAV

SEQ ID NO: 1941527 - protein, 7 aa, Staphylococcus
FKGTKTK

SEQ ID NO: 1941528 - protein, 7 aa, Staphylococcus
FKGTQTK

SEQ ID NO: 1941529 - protein, 7 aa, Staphylococcus
FKHKSKE

SEQ ID NO: 1941530 - protein, 4 aa, Staphylococcus
FKHN

SEQ ID NO: 1941531 - protein, 42 aa, Staphylococcus
FKHNTSSDISDKQSQSNNDQLANEPASESLTVTDDNQSETNL

SEQ ID NO: 1941532 - protein, 7 aa, Staphylococcus
FKIDERK

SEQ ID NO: 1941533 - protein, 9 aa, Staphylococcus
FKKARQLPK

SEQ ID NO: 1941534 - protein, 7 aa, Staphylococcus
FKKDNQP

SEQ ID NO: 1941535 - protein, 95 aa, Staphylococcus
FKKEQNTDDKQNTQNNHQKSNNKQNQNNKGNQSNKDKQNNKGNHQKNNNQQKNQNKKNGQNNKGKQQNKNNKNNKNNKNNKQQNQAAEPKEMPSK

SEQ ID NO: 1941536 - protein, 8 aa, Staphylococcus
FKKNKGYE

SEQ ID NO: 1941537 - protein, 10 aa, Staphylococcus
FKKNKGYERS

SEQ ID NO: 1941538 - protein, 8 aa, Staphylococcus
FKKQGKID

SEQ ID NO: 1941539 - protein, 7 aa, Staphylococcus
FKKSPED

SEQ ID NO: 1941540 - protein, 11 aa, Staphylococcus
FKKTTKQFKEQ

SEQ ID NO: 1941541 - protein, 4 aa, Staphylococcus
FKKV

SEQ ID NO: 1941542 - protein, 11 aa, Staphylococcus
FKLTDKDSQLM

SEQ ID NO: 1941543 - protein, 21 aa, Staphylococcus
FKLTEKADVEKITTQLDGDQF

SEQ ID NO: 1941544 - protein, 8 aa, Staphylococcus
FKNAESKL

SEQ ID NO: 1941545 - protein, 7 aa, Staphylococcus
FKNASEA

SEQ ID NO: 1941546 - protein, 7 aa, Staphylococcus
FKNASEQ

SEQ ID NO: 1941547 - protein, 9 aa, Staphylococcus
FKNDYEASR

SEQ ID NO: 1941548 - protein, 4 aa, Staphylococcus
FKNE

SEQ ID NO: 1941549 - protein, 10 aa, Staphylococcus
FKNGGLPATG

SEQ ID NO: 1941550 - protein, 31 aa, Staphylococcus
FKNGGVPASGLVKSGKTKKTGTKVTFKPDPE

SEQ ID NO: 1941551 - protein, 9 aa, Staphylococcus
FKNGPDKDA

SEQ ID NO: 1941552 - protein, 5 aa, Staphylococcus
FKNKE

SEQ ID NO: 1941553 - protein, 11 aa, Staphylococcus
FKNNNNQTTIV

SEQ ID NO: 1941554 - protein, 11 aa, Staphylococcus
FKNNSDAPLEE

SEQ ID NO: 1941555 - protein, 5 aa, Staphylococcus
FKNPH

SEQ ID NO: 1941556 - protein, 10 aa, Staphylococcus
FKNPSSQRFK

SEQ ID NO: 1941557 - protein, 9 aa, Staphylococcus
FKNQNETGQ

SEQ ID NO: 1941558 - protein, 14 aa, Staphylococcus
FKNRDKALALYNKK

SEQ ID NO: 1941559 - protein, 15 aa, Staphylococcus
FKNREKAQNLVTKKY

SEQ ID NO: 1941560 - protein, 15 aa, Staphylococcus
FKNREKAQTLVNKKY

SEQ ID NO: 1941561 - protein, 4 aa, Staphylococcus
FKNS

SEQ ID NO: 1941562 - protein, 10 aa, Staphylococcus
FKNSEASTLP

SEQ ID NO: 1941563 - protein, 5 aa, Staphylococcus
FKNTS

SEQ ID NO: 1941564 - protein, 16 aa, Staphylococcus
FKNTTSVAIEPTAAEV

SEQ ID NO: 1941565 - protein, 8 aa, Staphylococcus
FKPAEPGN

SEQ ID NO: 1941566 - protein, 10 aa, Staphylococcus
FKPDMQELPS

SEQ ID NO: 1941567 - protein, 11 aa, Staphylococcus
FKPDMQELPSE

SEQ ID NO: 1941568 - protein, 4 aa, Staphylococcus
FKPE

SEQ ID NO: 1941569 - protein, 7 aa, Staphylococcus
FKPEDGI

SEQ ID NO: 1941570 - protein, 6 aa, Staphylococcus
FKPEEV

SEQ ID NO: 1941571 - protein, 5 aa, Staphylococcus
FKPEH

SEQ ID NO: 1941572 - protein, 10 aa, Staphylococcus
FKPEMQELPS

SEQ ID NO: 1941573 - protein, 12 aa, Staphylococcus
FKPESTHPRTDL

SEQ ID NO: 1941574 - protein, 5 aa, Staphylococcus
FKPEV

SEQ ID NO: 1941575 - protein, 6 aa, Staphylococcus
FKPFGQ

SEQ ID NO: 1941576 - protein, 4 aa, Staphylococcus
FKPG

SEQ ID NO: 1941577 - protein, 5 aa, Staphylococcus
FKPGE

SEQ ID NO: 1941578 - protein, 7 aa, Staphylococcus
FKPGQED

SEQ ID NO: 1941579 - protein, 7 aa, Staphylococcus
FKPGQKE

SEQ ID NO: 1941580 - protein, 6 aa, Staphylococcus
FKPGQY

SEQ ID NO: 1941581 - protein, 5 aa, Staphylococcus
FKPKD

SEQ ID NO: 1941582 - protein, 6 aa, Staphylococcus
FKPLGK

SEQ ID NO: 1941583 - protein, 5 aa, Staphylococcus
FKPNT

SEQ ID NO: 1941584 - protein, 5 aa, Staphylococcus
FKPQT

SEQ ID NO: 1941585 - protein, 12 aa, Staphylococcus
FKPSEDKSKDTY

SEQ ID NO: 1941586 - protein, 12 aa, Staphylococcus
FKPSEDKSKETY

SEQ ID NO: 1941587 - protein, 11 aa, Staphylococcus
FKPSEDTNKET

SEQ ID NO: 1941588 - protein, 6 aa, Staphylococcus
FKPSQY

SEQ ID NO: 1941589 - protein, 14 aa, Staphylococcus
FKPTDSDFEKIGGE

SEQ ID NO: 1941590 - protein, 17 aa, Staphylococcus
FKPTGSAQLNDDSIQNN

SEQ ID NO: 1941591 - protein, 4 aa, Staphylococcus
FKPY

SEQ ID NO: 1941592 - protein, 6 aa, Staphylococcus
FKPYTS

SEQ ID NO: 1941593 - protein, 14 aa, Staphylococcus
FKQAEKPTRNIKED

SEQ ID NO: 1941594 - protein, 8 aa, Staphylococcus
FKQASSED

SEQ ID NO: 1941595 - protein, 8 aa, Staphylococcus
FKQASSQH

SEQ ID NO: 1941596 - protein, 11 aa, Staphylococcus
FKQDGDKPGMF

SEQ ID NO: 1941597 - protein, 8 aa, Staphylococcus
FKQDNVQS

SEQ ID NO: 1941598 - protein, 8 aa, Staphylococcus
FKQEENTI

SEQ ID NO: 1941599 - protein, 7 aa, Staphylococcus
FKQEGKI

SEQ ID NO: 1941600 - protein, 18 aa, Staphylococcus
FKQEGVSGMNNEEPSQRD

SEQ ID NO: 1941601 - protein, 5 aa, Staphylococcus
FKQEV

SEQ ID NO: 1941602 - protein, 6 aa, Staphylococcus
FKQEVE

SEQ ID NO: 1941603 - protein, 6 aa, Staphylococcus
FKQGDF

SEQ ID NO: 1941604 - protein, 8 aa, Staphylococcus
FKQGSPQE

SEQ ID NO: 1941605 - protein, 8 aa, Staphylococcus
FKQKEDEF

SEQ ID NO: 1941606 - protein, 6 aa, Staphylococcus
FKQKTN

SEQ ID NO: 1941607 - protein, 8 aa, Staphylococcus
FKQTGGLH

SEQ ID NO: 1941608 - protein, 4 aa, Staphylococcus
FKRA

SEQ ID NO: 1941609 - protein, 7 aa, Staphylococcus
FKRHSSG

SEQ ID NO: 1941610 - protein, 6 aa, Staphylococcus
FKRTDM

SEQ ID NO: 1941611 - protein, 5 aa, Staphylococcus
FKSCN

SEQ ID NO: 1941612 - protein, 7 aa, Staphylococcus
FKSENDI

SEQ ID NO: 1941613 - protein, 5 aa, Staphylococcus
FKSGE

SEQ ID NO: 1941614 - protein, 11 aa, Staphylococcus
FKSGGHAQSNI

SEQ ID NO: 1941615 - protein, 12 aa, Staphylococcus
FKSGNSKAISLS

SEQ ID NO: 1941616 - protein, 9 aa, Staphylococcus
FKSKDNKKE

SEQ ID NO: 1941617 - protein, 10 aa, Staphylococcus
FKSKNGEQQA

SEQ ID NO: 1941618 - protein, 7 aa, Staphylococcus
FKSKQQD

SEQ ID NO: 1941619 - protein, 12 aa, Staphylococcus
FKSLSSDAELTK

SEQ ID NO: 1941620 - protein, 6 aa, Staphylococcus
FKSNRE

SEQ ID NO: 1941621 - protein, 6 aa, Staphylococcus
FKSNTE

SEQ ID NO: 1941622 - protein, 4 aa, Staphylococcus
FKSP

SEQ ID NO: 1941623 - protein, 11 aa, Staphylococcus
FKSPTDETISP

SEQ ID NO: 1941624 - protein, 4 aa, Staphylococcus
FKSQ

SEQ ID NO: 1941625 - protein, 8 aa, Staphylococcus
FKSQDDPK

SEQ ID NO: 1941626 - protein, 7 aa, Staphylococcus
FKSQQTE

SEQ ID NO: 1941627 - protein, 23 aa, Staphylococcus
FKSSAEVQGKFARQSGGRGQYGD

SEQ ID NO: 1941628 - protein, 40 aa, Staphylococcus
FKSSKNEENKKQNTQNNHQKQQNKKDNNQNKSNSKKKTIK

SEQ ID NO: 1941629 - protein, 10 aa, Staphylococcus
FKTEDEVTTI

SEQ ID NO: 1941630 - protein, 23 aa, Staphylococcus
FKTEKEQLHASPSSIRDYETQKE

SEQ ID NO: 1941631 - protein, 10 aa, Staphylococcus
FKTENNQDTI

SEQ ID NO: 1941632 - protein, 8 aa, Staphylococcus
FKTERLSS

SEQ ID NO: 1941633 - protein, 8 aa, Staphylococcus
FKTKELKK

SEQ ID NO: 1941634 - protein, 4 aa, Staphylococcus
FKTN

SEQ ID NO: 1941635 - protein, 12 aa, Staphylococcus
FKTNNNDSELKE

SEQ ID NO: 1941636 - protein, 11 aa, Staphylococcus
FKTNPHYKPSK

SEQ ID NO: 1941637 - protein, 10 aa, Staphylococcus
FKTNQERERV

SEQ ID NO: 1941638 - protein, 22 aa, Staphylococcus
FKTPAKVQGKFSRQSGGRGQYG

SEQ ID NO: 1941639 - protein, 11 aa, Staphylococcus
FKTPDNSSSKA

SEQ ID NO: 1941640 - protein, 11 aa, Staphylococcus
FKTPNQQSAKS

SEQ ID NO: 1941641 - protein, 8 aa, Staphylococcus
FKTSEVPS

SEQ ID NO: 1941642 - protein, 5 aa, Staphylococcus
FKTSK

SEQ ID NO: 1941643 - protein, 11 aa, Staphylococcus
FKTSSNPSIAS

SEQ ID NO: 1941644 - protein, 5 aa, Staphylococcus
FKTTQ

SEQ ID NO: 1941645 - protein, 5 aa, Staphylococcus
FKTTT

SEQ ID NO: 1941646 - protein, 9 aa, Staphylococcus
FKYEKDDSD

SEQ ID NO: 1941647 - protein, 6 aa, Staphylococcus
FLKNPS

SEQ ID NO: 1941648 - protein, 18 aa, Staphylococcus
FLNTTEKKITQEGLDNST

SEQ ID NO: 1941649 - protein, 7 aa, Staphylococcus
FLPGNGA

SEQ ID NO: 1941650 - protein, 9 aa, Staphylococcus
FLSGTDDYV

SEQ ID NO: 1941651 - protein, 8 aa, Staphylococcus
FLTEPDDE

SEQ ID NO: 1941652 - protein, 6 aa, Staphylococcus
FLTKRE

SEQ ID NO: 1941653 - protein, 4 aa, Staphylococcus
FLTP

SEQ ID NO: 1941654 - protein, 6 aa, Staphylococcus
FLTPNR

SEQ ID NO: 1941655 - protein, 9 aa, Staphylococcus
FMSDKDGDM

SEQ ID NO: 1941656 - protein, 10 aa, Staphylococcus
FNAEGNGTGI

SEQ ID NO: 1941657 - protein, 5 aa, Staphylococcus
FNAKG

SEQ ID NO: 1941658 - protein, 5 aa, Staphylococcus
FNAQS

SEQ ID NO: 1941659 - protein, 7 aa, Staphylococcus
FNASGEM

SEQ ID NO: 1941660 - protein, 12 aa, Staphylococcus
FNATKNLPNHVR

SEQ ID NO: 1941661 - protein, 7 aa, Staphylococcus
FNDATEL

SEQ ID NO: 1941662 - protein, 4 aa, Staphylococcus
FNDD

SEQ ID NO: 1941663 - protein, 9 aa, Staphylococcus
FNDEGSHTL

SEQ ID NO: 1941664 - protein, 7 aa, Staphylococcus
FNDEQIN

SEQ ID NO: 1941665 - protein, 6 aa, Staphylococcus
FNDKEL

SEQ ID NO: 1941666 - protein, 4 aa, Staphylococcus
FNDN

SEQ ID NO: 1941667 - protein, 8 aa, Staphylococcus
FNDNPNLE

SEQ ID NO: 1941668 - protein, 6 aa, Staphylococcus
FNDREN

SEQ ID NO: 1941669 - protein, 4 aa, Staphylococcus
FNEA

SEQ ID NO: 1941670 - protein, 8 aa, Staphylococcus
FNEDPETK

SEQ ID NO: 1941671 - protein, 12 aa, Staphylococcus
FNEDYGREKVQS

SEQ ID NO: 1941672 - protein, 8 aa, Staphylococcus
FNEEDQKW

SEQ ID NO: 1941673 - protein, 10 aa, Staphylococcus
FNEEDQKYVN

SEQ ID NO: 1941674 - protein, 17 aa, Staphylococcus
FNEENRAALDELVNKYN

SEQ ID NO: 1941675 - protein, 4 aa, Staphylococcus
FNEK

SEQ ID NO: 1941676 - protein, 7 aa, Staphylococcus
FNEKGEK

SEQ ID NO: 1941677 - protein, 9 aa, Staphylococcus
FNEKVEDNE

SEQ ID NO: 1941678 - protein, 11 aa, Staphylococcus
FNEPGTDINSA

SEQ ID NO: 1941679 - protein, 10 aa, Staphylococcus
FNEPGTDLHS

SEQ ID NO: 1941680 - protein, 11 aa, Staphylococcus
FNEPGTPFDSH

SEQ ID NO: 1941681 - protein, 12 aa, Staphylococcus
FNEPGTSFDSQT

SEQ ID NO: 1941682 - protein, 12 aa, Staphylococcus
FNEPGTSFESET

SEQ ID NO: 1941683 - protein, 14 aa, Staphylococcus
FNEPGTSKESETRV

SEQ ID NO: 1941684 - protein, 12 aa, Staphylococcus
FNEPGTSLESET

SEQ ID NO: 1941685 - protein, 4 aa, Staphylococcus
FNEQ

SEQ ID NO: 1941686 - protein, 7 aa, Staphylococcus
FNEQGEK

SEQ ID NO: 1941687 - protein, 7 aa, Staphylococcus
FNEQGQK

SEQ ID NO: 1941688 - protein, 7 aa, Staphylococcus
FNEQNND

SEQ ID NO: 1941689 - protein, 6 aa, Staphylococcus
FNEQSD

SEQ ID NO: 1941690 - protein, 15 aa, Staphylococcus
FNESTTRQTKAQHIS

SEQ ID NO: 1941691 - protein, 4 aa, Staphylococcus
FNET

SEQ ID NO: 1941692 - protein, 10 aa, Staphylococcus
FNETSRKQKQ

SEQ ID NO: 1941693 - protein, 12 aa, Staphylococcus
FNGAKENPNIKE

SEQ ID NO: 1941694 - protein, 5 aa, Staphylococcus
FNGDR

SEQ ID NO: 1941695 - protein, 11 aa, Staphylococcus
FNGESLEGKTV

SEQ ID NO: 1941696 - protein, 17 aa, Staphylococcus
FNGKGEHRYTFLDSFFE

SEQ ID NO: 1941697 - protein, 8 aa, Staphylococcus
FNGNASHQ

SEQ ID NO: 1941698 - protein, 12 aa, Staphylococcus
FNGNESLEISGN

SEQ ID NO: 1941699 - protein, 16 aa, Staphylococcus
FNGNGTQKYTFLEDHF

SEQ ID NO: 1941700 - protein, 8 aa, Staphylococcus
FNGNNELQ

SEQ ID NO: 1941701 - protein, 12 aa, Staphylococcus
FNGTKENPDIKE

SEQ ID NO: 1941702 - protein, 9 aa, Staphylococcus
FNGTKGSGA

SEQ ID NO: 1941703 - protein, 9 aa, Staphylococcus
FNGTKSDHK

SEQ ID NO: 1941704 - protein, 4 aa, Staphylococcus
FNHN

SEQ ID NO: 1941705 - protein, 5 aa, Staphylococcus
FNHST

SEQ ID NO: 1941706 - protein, 4 aa, Staphylococcus
FNIS

SEQ ID NO: 1941707 - protein, 8 aa, Staphylococcus
FNKADTLA

SEQ ID NO: 1941708 - protein, 4 aa, Staphylococcus
FNKE

SEQ ID NO: 1941709 - protein, 9 aa, Staphylococcus
FNKEAKEGK

SEQ ID NO: 1941710 - protein, 7 aa, Staphylococcus
FNKEEVS

SEQ ID NO: 1941711 - protein, 4 aa, Staphylococcus
FNKK

SEQ ID NO: 1941712 - protein, 9 aa, Staphylococcus
FNKKKGMEL

SEQ ID NO: 1941713 - protein, 20 aa, Staphylococcus
FNKKNGNSISLEAYSKGGSI

SEQ ID NO: 1941714 - protein, 8 aa, Staphylococcus
FNKKPGMV

SEQ ID NO: 1941715 - protein, 4 aa, Staphylococcus
FNKN

SEQ ID NO: 1941716 - protein, 6 aa, Staphylococcus
FNKPQR

SEQ ID NO: 1941717 - protein, 8 aa, Staphylococcus
FNKPTEIQ

SEQ ID NO: 1941718 - protein, 11 aa, Staphylococcus
FNLTKDEQDAY

SEQ ID NO: 1941719 - protein, 6 aa, Staphylococcus
FNNDNN

SEQ ID NO: 1941720 - protein, 9 aa, Staphylococcus
FNNDSTYTA

SEQ ID NO: 1941721 - protein, 8 aa, Staphylococcus
FNNEGEEK

SEQ ID NO: 1941722 - protein, 8 aa, Staphylococcus
FNNEGEES

SEQ ID NO: 1941723 - protein, 8 aa, Staphylococcus
FNNEGNEK

SEQ ID NO: 1941724 - protein, 7 aa, Staphylococcus
FNNEGQE

SEQ ID NO: 1941725 - protein, 6 aa, Staphylococcus
FNNEQR

SEQ ID NO: 1941726 - protein, 7 aa, Staphylococcus
FNNERKD

SEQ ID NO: 1941727 - protein, 8 aa, Staphylococcus
FNNGGSGG

SEQ ID NO: 1941728 - protein, 8 aa, Staphylococcus
FNNKPNSR

SEQ ID NO: 1941729 - protein, 4 aa, Staphylococcus
FNNN

SEQ ID NO: 1941730 - protein, 9 aa, Staphylococcus
FNNNNNTKM

SEQ ID NO: 1941731 - protein, 18 aa, Staphylococcus
FNNPEKASSLANQKLETE

SEQ ID NO: 1941732 - protein, 22 aa, Staphylococcus
FNNPQKSHELSQIKSDTEQKLE

SEQ ID NO: 1941733 - protein, 13 aa, Staphylococcus
FNNPTAQSLSQNV

SEQ ID NO: 1941734 - protein, 11 aa, Staphylococcus
FNNPTFTEAQN

SEQ ID NO: 1941735 - protein, 11 aa, Staphylococcus
FNNPTFTEEQN

SEQ ID NO: 1941736 - protein, 5 aa, Staphylococcus
FNNQE

SEQ ID NO: 1941737 - protein, 4 aa, Staphylococcus
FNNR

SEQ ID NO: 1941738 - protein, 19 aa, Staphylococcus
FNNVPKELENLTNGVENAE

SEQ ID NO: 1941739 - protein, 4 aa, Staphylococcus
FNNY

SEQ ID NO: 1941740 - protein, 9 aa, Staphylococcus
FNPEENKGK

SEQ ID NO: 1941741 - protein, 7 aa, Staphylococcus
FNPGQKE

SEQ ID NO: 1941742 - protein, 7 aa, Staphylococcus
FNPGSCV

SEQ ID NO: 1941743 - protein, 11 aa, Staphylococcus
FNPKDHTKSSK

SEQ ID NO: 1941744 - protein, 7 aa, Staphylococcus
FNPKQCK

SEQ ID NO: 1941745 - protein, 5 aa, Staphylococcus
FNPNH

SEQ ID NO: 1941746 - protein, 27 aa, Staphylococcus
FNPQNEKVANKYGKSYGTTDDKAVYNG

SEQ ID NO: 1941747 - protein, 8 aa, Staphylococcus
FNPQSKDF

SEQ ID NO: 1941748 - protein, 9 aa, Staphylococcus
FNPQSKDYF

SEQ ID NO: 1941749 - protein, 4 aa, Staphylococcus
FNPR

SEQ ID NO: 1941750 - protein, 19 aa, Staphylococcus
FNPSTYPPLSYTFDHIIIK

SEQ ID NO: 1941751 - protein, 5 aa, Staphylococcus
FNPTR

SEQ ID NO: 1941752 - protein, 7 aa, Staphylococcus
FNQDGSL

SEQ ID NO: 1941753 - protein, 6 aa, Staphylococcus
FNQDGT

SEQ ID NO: 1941754 - protein, 7 aa, Staphylococcus
FNQKGTD

SEQ ID NO: 1941755 - protein, 14 aa, Staphylococcus
FNQNDKVKVKKINI

SEQ ID NO: 1941756 - protein, 8 aa, Staphylococcus
FNQPTEIQ

SEQ ID NO: 1941757 - protein, 7 aa, Staphylococcus
FNQSEAE

SEQ ID NO: 1941758 - protein, 7 aa, Staphylococcus
FNQSEDE

SEQ ID NO: 1941759 - protein, 7 aa, Staphylococcus
FNQSQEE

SEQ ID NO: 1941760 - protein, 26 aa, Staphylococcus
FNQTSTCKEKSYPHSSELQKENLNND

SEQ ID NO: 1941761 - protein, 5 aa, Staphylococcus
FNRDD

SEQ ID NO: 1941762 - protein, 6 aa, Staphylococcus
FNREDM

SEQ ID NO: 1941763 - protein, 12 aa, Staphylococcus
FNRETKKLESFT

SEQ ID NO: 1941764 - protein, 7 aa, Staphylococcus
FNRQNNN

SEQ ID NO: 1941765 - protein, 10 aa, Staphylococcus
FNSDQEGLRN

SEQ ID NO: 1941766 - protein, 4 aa, Staphylococcus
FNSE

SEQ ID NO: 1941767 - protein, 8 aa, Staphylococcus
FNSEAQEG

SEQ ID NO: 1941768 - protein, 7 aa, Staphylococcus
FNSEQNI

SEQ ID NO: 1941769 - protein, 8 aa, Staphylococcus
FNSEQSIT

SEQ ID NO: 1941770 - protein, 9 aa, Staphylococcus
FNSKAQSHI

SEQ ID NO: 1941771 - protein, 5 aa, Staphylococcus
FNSKQ

SEQ ID NO: 1941772 - protein, 11 aa, Staphylococcus
FNSNADKEIEE

SEQ ID NO: 1941773 - protein, 8 aa, Staphylococcus
FNSNQTIS

SEQ ID NO: 1941774 - protein, 10 aa, Staphylococcus
FNSPNDQVTK

SEQ ID NO: 1941775 - protein, 6 aa, Staphylococcus
FNSPNG

SEQ ID NO: 1941776 - protein, 6 aa, Staphylococcus
FNSPTF

SEQ ID NO: 1941777 - protein, 6 aa, Staphylococcus
FNSQST

SEQ ID NO: 1941778 - protein, 7 aa, Staphylococcus
FNSREQT

SEQ ID NO: 1941779 - protein, 17 aa, Staphylococcus
FNSSNSKKYNFLDEYFE

SEQ ID NO: 1941780 - protein, 11 aa, Staphylococcus
FNTGESETPIT

SEQ ID NO: 1941781 - protein, 8 aa, Staphylococcus
FNTKEELA

SEQ ID NO: 1941782 - protein, 4 aa, Staphylococcus
FNTL

SEQ ID NO: 1941783 - protein, 6 aa, Staphylococcus
FNTPEA

SEQ ID NO: 1941784 - protein, 8 aa, Staphylococcus
FNTPSQIA

SEQ ID NO: 1941785 - protein, 8 aa, Staphylococcus
FNTPSQVA

SEQ ID NO: 1941786 - protein, 12 aa, Staphylococcus
FNTRDKNRFERK

SEQ ID NO: 1941787 - protein, 5 aa, Staphylococcus
FNTSE

SEQ ID NO: 1941788 - protein, 7 aa, Staphylococcus
FNTSPDE

SEQ ID NO: 1941789 - protein, 8 aa, Staphylococcus
FNTSPGEV

SEQ ID NO: 1941790 - protein, 13 aa, Staphylococcus
FNTSTDKSKKPYT

SEQ ID NO: 1941791 - protein, 7 aa, Staphylococcus
FNTSTNE

SEQ ID NO: 1941792 - protein, 9 aa, Staphylococcus
FNTTNSNGL

SEQ ID NO: 1941793 - protein, 14 aa, Staphylococcus
FNTTPEIKKYADEH

SEQ ID NO: 1941794 - protein, 11 aa, Staphylococcus
FNTYTSNNGRM

SEQ ID NO: 1941795 - protein, 4 aa, Staphylococcus
FNWD

SEQ ID NO: 1941796 - protein, 5 aa, Staphylococcus
FNYSG

SEQ ID NO: 1941797 - protein, 18 aa, Staphylococcus
FPAGAPFGGYKKSGIGRE

SEQ ID NO: 1941798 - protein, 5 aa, Staphylococcus
FPASK

SEQ ID NO: 1941799 - protein, 11 aa, Staphylococcus
FPASSAGSFKS

SEQ ID NO: 1941800 - protein, 11 aa, Staphylococcus
FPASSQGSFDS

SEQ ID NO: 1941801 - protein, 12 aa, Staphylococcus
FPAYSDKIETRR

SEQ ID NO: 1941802 - protein, 5 aa, Staphylococcus
FPAYY

SEQ ID NO: 1941803 - protein, 16 aa, Staphylococcus
FPDGQKVTTTADDQGH

SEQ ID NO: 1941804 - protein, 5 aa, Staphylococcus
FPDKQ

SEQ ID NO: 1941805 - protein, 5 aa, Staphylococcus
FPDRD

SEQ ID NO: 1941806 - protein, 5 aa, Staphylococcus
FPEDQ

SEQ ID NO: 1941807 - protein, 4 aa, Staphylococcus
FPEH

SEQ ID NO: 1941808 - protein, 5 aa, Staphylococcus
FPEKS

SEQ ID NO: 1941809 - protein, 6 aa, Staphylococcus
FPEQND

SEQ ID NO: 1941810 - protein, 16 aa, Staphylococcus
FPEQNDKMIDVLQQFK

SEQ ID NO: 1941811 - protein, 16 aa, Staphylococcus
FPEQNDKMIEVLQQFD

SEQ ID NO: 1941812 - protein, 7 aa, Staphylococcus
FPEQSAV

SEQ ID NO: 1941813 - protein, 5 aa, Staphylococcus
FPESE

SEQ ID NO: 1941814 - protein, 11 aa, Staphylococcus
FPEYKSEWTPK

SEQ ID NO: 1941815 - protein, 10 aa, Staphylococcus
FPGETDEEFQ

SEQ ID NO: 1941816 - protein, 18 aa, Staphylococcus
FPGGKREKGEASETAAAR

SEQ ID NO: 1941817 - protein, 5 aa, Staphylococcus
FPGPG

SEQ ID NO: 1941818 - protein, 15 aa, Staphylococcus
FPGSNKNGRRYSPFT

SEQ ID NO: 1941819 - protein, 15 aa, Staphylococcus
FPGSNKNNRRYSPFT

SEQ ID NO: 1941820 - protein, 4 aa, Staphylococcus
FPGT

SEQ ID NO: 1941821 - protein, 11 aa, Staphylococcus
FPGVGKASEKI

SEQ ID NO: 1941822 - protein, 11 aa, Staphylococcus
FPGVGKASEKV

SEQ ID NO: 1941823 - protein, 11 aa, Staphylococcus
FPGVGKASKKI

SEQ ID NO: 1941824 - protein, 13 aa, Staphylococcus
FPGVGKASKQKMH

SEQ ID NO: 1941825 - protein, 11 aa, Staphylococcus
FPGVGKATKEV

SEQ ID NO: 1941826 - protein, 10 aa, Staphylococcus
FPKDEKNNKI

SEQ ID NO: 1941827 - protein, 8 aa, Staphylococcus
FPKDNSDF

SEQ ID NO: 1941828 - protein, 8 aa, Staphylococcus
FPKEEKLA

SEQ ID NO: 1941829 - protein, 10 aa, Staphylococcus
FPKHEKTTDN

SEQ ID NO: 1941830 - protein, 22 aa, Staphylococcus
FPKKTGEKGDKALQIASSGPAF

SEQ ID NO: 1941831 - protein, 17 aa, Staphylococcus
FPKKTQFETKGESKSLA

SEQ ID NO: 1941832 - protein, 8 aa, Staphylococcus
FPKPGETL

SEQ ID NO: 1941833 - protein, 11 aa, Staphylococcus
FPKSRKEKNEV

SEQ ID NO: 1941834 - protein, 12 aa, Staphylococcus
FPKYGNNDSRVD

SEQ ID NO: 1941835 - protein, 6 aa, Staphylococcus
FPLDQS

SEQ ID NO: 1941836 - protein, 8 aa, Staphylococcus
FPLPNTNY

SEQ ID NO: 1941837 - protein, 4 aa, Staphylococcus
FPNE

SEQ ID NO: 1941838 - protein, 6 aa, Staphylococcus
FPNEGH

SEQ ID NO: 1941839 - protein, 6 aa, Staphylococcus
FPNIEE

SEQ ID NO: 1941840 - protein, 5 aa, Staphylococcus
FPNKR

SEQ ID NO: 1941841 - protein, 5 aa, Staphylococcus
FPNNY

SEQ ID NO: 1941842 - protein, 7 aa, Staphylococcus
FPNQETN

SEQ ID NO: 1941843 - protein, 13 aa, Staphylococcus
FPNYKSGTNGPIE

SEQ ID NO: 1941844 - protein, 13 aa, Staphylococcus
FPNYTSGTNGPLE

SEQ ID NO: 1941845 - protein, 6 aa, Staphylococcus
FPPDDP

SEQ ID NO: 1941846 - protein, 5 aa, Staphylococcus
FPPDE

SEQ ID NO: 1941847 - protein, 14 aa, Staphylococcus
FPPEDKEVFSSSRT

SEQ ID NO: 1941848 - protein, 9 aa, Staphylococcus
FPPEELEPE

SEQ ID NO: 1941849 - protein, 8 aa, Staphylococcus
FPPEHAKA

SEQ ID NO: 1941850 - protein, 9 aa, Staphylococcus
FPPENRDTF

SEQ ID NO: 1941851 - protein, 5 aa, Staphylococcus
FPPEY

SEQ ID NO: 1941852 - protein, 12 aa, Staphylococcus
FPPKDVEDGDVT

SEQ ID NO: 1941853 - protein, 4 aa, Staphylococcus
FPQD

SEQ ID NO: 1941854 - protein, 5 aa, Staphylococcus
FPQDT

SEQ ID NO: 1941855 - protein, 6 aa, Staphylococcus
FPQDTN

SEQ ID NO: 1941856 - protein, 5 aa, Staphylococcus
FPQEN

SEQ ID NO: 1941857 - protein, 7 aa, Staphylococcus
FPQNEET

SEQ ID NO: 1941858 - protein, 14 aa, Staphylococcus
FPQPQYKDDSSKMR

SEQ ID NO: 1941859 - protein, 8 aa, Staphylococcus
FPRDSLPE

SEQ ID NO: 1941860 - protein, 4 aa, Staphylococcus
FPSA

SEQ ID NO: 1941861 - protein, 11 aa, Staphylococcus
FPSAKQAEQAR

SEQ ID NO: 1941862 - protein, 11 aa, Staphylococcus
FPSAKQAQQAD

SEQ ID NO: 1941863 - protein, 11 aa, Staphylococcus
FPSDKKTKIEV

SEQ ID NO: 1941864 - protein, 15 aa, Staphylococcus
FPSETIQKEVDKASK

SEQ ID NO: 1941865 - protein, 4 aa, Staphylococcus
FPSQ

SEQ ID NO: 1941866 - protein, 4 aa, Staphylococcus
FPSY

SEQ ID NO: 1941867 - protein, 11 aa, Staphylococcus
FPTEKKGPTVL

SEQ ID NO: 1941868 - protein, 6 aa, Staphylococcus
FPTEQV

SEQ ID NO: 1941869 - protein, 10 aa, Staphylococcus
FPTESKGPSV

SEQ ID NO: 1941870 - protein, 10 aa, Staphylococcus
FPTETKGPSV

SEQ ID NO: 1941871 - protein, 9 aa, Staphylococcus
FPTPKGSKL

SEQ ID NO: 1941872 - protein, 10 aa, Staphylococcus
FPTPKGSKLV

SEQ ID NO: 1941873 - protein, 8 aa, Staphylococcus
FPTPPDIS

SEQ ID NO: 1941874 - protein, 8 aa, Staphylococcus
FPTPPSIS

SEQ ID NO: 1941875 - protein, 8 aa, Staphylococcus
FPTPTERD

SEQ ID NO: 1941876 - protein, 10 aa, Staphylococcus
FPTPTKDDYP

SEQ ID NO: 1941877 - protein, 5 aa, Staphylococcus
FPTSA

SEQ ID NO: 1941878 - protein, 5 aa, Staphylococcus
FPTSG

SEQ ID NO: 1941879 - protein, 8 aa, Staphylococcus
FPTSSMNY

SEQ ID NO: 1941880 - protein, 6 aa, Staphylococcus
FPTTGE

SEQ ID NO: 1941881 - protein, 5 aa, Staphylococcus
FPTTS

SEQ ID NO: 1941882 - protein, 12 aa, Staphylococcus
FPVPTSAKKFDD

SEQ ID NO: 1941883 - protein, 17 aa, Staphylococcus
FPYAANGRALSLDDTTG

SEQ ID NO: 1941884 - protein, 4 aa, Staphylococcus
FQAL

SEQ ID NO: 1941885 - protein, 6 aa, Staphylococcus
FQAQPG

SEQ ID NO: 1941886 - protein, 22 aa, Staphylococcus
FQASDSGETLDVTNPANGETLA

SEQ ID NO: 1941887 - protein, 9 aa, Staphylococcus
FQASGKQTL

SEQ ID NO: 1941888 - protein, 10 aa, Staphylococcus
FQDEQGDSER

SEQ ID NO: 1941889 - protein, 6 aa, Staphylococcus
FQDGEK

SEQ ID NO: 1941890 - protein, 5 aa, Staphylococcus
FQDNS

SEQ ID NO: 1941891 - protein, 4 aa, Staphylococcus
FQDQ

SEQ ID NO: 1941892 - protein, 4 aa, Staphylococcus
FQDT

SEQ ID NO: 1941893 - protein, 4 aa, Staphylococcus
FQDY

SEQ ID NO: 1941894 - protein, 4 aa, Staphylococcus
FQEN

SEQ ID NO: 1941895 - protein, 5 aa, Staphylococcus
FQENE

SEQ ID NO: 1941896 - protein, 7 aa, Staphylococcus
FQENQSA

SEQ ID NO: 1941897 - protein, 4 aa, Staphylococcus
FQER

SEQ ID NO: 1941898 - protein, 9 aa, Staphylococcus
FQESETPKY

SEQ ID NO: 1941899 - protein, 10 aa, Staphylococcus
FQETSRKQKQ

SEQ ID NO: 1941900 - protein, 4 aa, Staphylococcus
FQGP

SEQ ID NO: 1941901 - protein, 5 aa, Staphylococcus
FQGQK

SEQ ID NO: 1941902 - protein, 10 aa, Staphylococcus
FQKDGGSVEV

SEQ ID NO: 1941903 - protein, 8 aa, Staphylococcus
FQKRDDKK

SEQ ID NO: 1941904 - protein, 8 aa, Staphylococcus
FQKRDQSV

SEQ ID NO: 1941905 - protein, 8 aa, Staphylococcus
FQKRNDNK

SEQ ID NO: 1941906 - protein, 7 aa, Staphylococcus
FQMSGGQ

SEQ ID NO: 1941907 - protein, 11 aa, Staphylococcus
FQNEQNSDNER

SEQ ID NO: 1941908 - protein, 7 aa, Staphylococcus
FQNGDYT

SEQ ID NO: 1941909 - protein, 12 aa, Staphylococcus
FQNGRQRLEAEG

SEQ ID NO: 1941910 - protein, 4 aa, Staphylococcus
FQNN

SEQ ID NO: 1941911 - protein, 11 aa, Staphylococcus
FQNSRSSHEQD

SEQ ID NO: 1941912 - protein, 13 aa, Staphylococcus
FQNSVDQNTQTFD

SEQ ID NO: 1941913 - protein, 4 aa, Staphylococcus
FQPE

SEQ ID NO: 1941914 - protein, 14 aa, Staphylococcus
FQPKENLAEVIEKH

SEQ ID NO: 1941915 - protein, 5 aa, Staphylococcus
FQPKQ

SEQ ID NO: 1941916 - protein, 21 aa, Staphylococcus
FQPSESGETLTVTNPANGEEL

SEQ ID NO: 1941917 - protein, 6 aa, Staphylococcus
FQPSKE

SEQ ID NO: 1941918 - protein, 4 aa, Staphylococcus
FQPT

SEQ ID NO: 1941919 - protein, 5 aa, Staphylococcus
FQPTK

SEQ ID NO: 1941920 - protein, 12 aa, Staphylococcus
FQQGRTRLEEAG

SEQ ID NO: 1941921 - protein, 4 aa, Staphylococcus
FQQQ

SEQ ID NO: 1941922 - protein, 8 aa, Staphylococcus
FQQQPQSD

SEQ ID NO: 1941923 - protein, 11 aa, Staphylococcus
FQQSADTIESA

SEQ ID NO: 1941924 - protein, 11 aa, Staphylococcus
FQQSETGETIK

SEQ ID NO: 1941925 - protein, 5 aa, Staphylococcus
FQQTA

SEQ ID NO: 1941926 - protein, 8 aa, Staphylococcus
FQQTSDKH

SEQ ID NO: 1941927 - protein, 4 aa, Staphylococcus
FQSM

SEQ ID NO: 1941928 - protein, 21 aa, Staphylococcus
FQSSGSGETLTVTNPANGEDL

SEQ ID NO: 1941929 - protein, 14 aa, Staphylococcus
FQSTEPKSGGMFKK

SEQ ID NO: 1941930 - protein, 9 aa, Staphylococcus
FQSTRSTTY

SEQ ID NO: 1941931 - protein, 4 aa, Staphylococcus
FQTA

SEQ ID NO: 1941932 - protein, 11 aa, Staphylococcus
FQTEEQEPGIY

SEQ ID NO: 1941933 - protein, 11 aa, Staphylococcus
FQTNETTPITL

SEQ ID NO: 1941934 - protein, 13 aa, Staphylococcus
FQTNPAKENEPFS

SEQ ID NO: 1941935 - protein, 9 aa, Staphylococcus
FQTPNGELS

SEQ ID NO: 1941936 - protein, 9 aa, Staphylococcus
FQTSKNPKL

SEQ ID NO: 1941937 - protein, 6 aa, Staphylococcus
FRAEEV

SEQ ID NO: 1941938 - protein, 7 aa, Staphylococcus
FRASEVP

SEQ ID NO: 1941939 - protein, 12 aa, Staphylococcus
FRASQKAGKTHI

SEQ ID NO: 1941940 - protein, 11 aa, Staphylococcus
FRASQKAGLTE

SEQ ID NO: 1941941 - protein, 4 aa, Staphylococcus
FRDA

SEQ ID NO: 1941942 - protein, 8 aa, Staphylococcus
FRDEQRPR

SEQ ID NO: 1941943 - protein, 11 aa, Staphylococcus
FRETSKVKSKI

SEQ ID NO: 1941944 - protein, 13 aa, Staphylococcus
FRGREAWDDADRP

SEQ ID NO: 1941945 - protein, 5 aa, Staphylococcus
FRGTE

SEQ ID NO: 1941946 - protein, 6 aa, Staphylococcus
FRKGTT

SEQ ID NO: 1941947 - protein, 7 aa, Staphylococcus
FRKKEQE

SEQ ID NO: 1941948 - protein, 12 aa, Staphylococcus
FRKNPKSNEQLA

SEQ ID NO: 1941949 - protein, 6 aa, Staphylococcus
FRKPAS

SEQ ID NO: 1941950 - protein, 11 aa, Staphylococcus
FRKSPRNKDEL

SEQ ID NO: 1941951 - protein, 6 aa, Staphylococcus
FRNEIT

SEQ ID NO: 1941952 - protein, 5 aa, Staphylococcus
FRNEM

SEQ ID NO: 1941953 - protein, 15 aa, Staphylococcus
FRNKGSKVCSANSVR

SEQ ID NO: 1941954 - protein, 16 aa, Staphylococcus
FRNKGSKVCSANSVRA

SEQ ID NO: 1941955 - protein, 12 aa, Staphylococcus
FRNNQQQTLDNG

SEQ ID NO: 1941956 - protein, 8 aa, Staphylococcus
FRNSDEYP

SEQ ID NO: 1941957 - protein, 9 aa, Staphylococcus
FRNSGNDPA

SEQ ID NO: 1941958 - protein, 9 aa, Staphylococcus
FRNSGNKPE

SEQ ID NO: 1941959 - protein, 9 aa, Staphylococcus
FRNSGNNPS

SEQ ID NO: 1941960 - protein, 7 aa, Staphylococcus
FRNSNEY

SEQ ID NO: 1941961 - protein, 12 aa, Staphylococcus
FRNYDTKSHGTV

SEQ ID NO: 1941962 - protein, 24 aa, Staphylococcus
FRPDNEPEKERLSNINDKVKSDLD

SEQ ID NO: 1941963 - protein, 6 aa, Staphylococcus
FRPGLK

SEQ ID NO: 1941964 - protein, 11 aa, Staphylococcus
FRPGLKARDEF

SEQ ID NO: 1941965 - protein, 11 aa, Staphylococcus
FRPGLKARTEF

SEQ ID NO: 1941966 - protein, 7 aa, Staphylococcus
FRPGQEE

SEQ ID NO: 1941967 - protein, 9 aa, Staphylococcus
FRPKPNNVS

SEQ ID NO: 1941968 - protein, 8 aa, Staphylococcus
FRPPKDQF

SEQ ID NO: 1941969 - protein, 4 aa, Staphylococcus
FRPS

SEQ ID NO: 1941970 - protein, 12 aa, Staphylococcus
FRPSGDKSKETY

SEQ ID NO: 1941971 - protein, 6 aa, Staphylococcus
FRPSYQ

SEQ ID NO: 1941972 - protein, 9 aa, Staphylococcus
FRQKSKEKV

SEQ ID NO: 1941973 - protein, 88 aa, Staphylococcus
FRQQESNNNTKQNTQNNHQKQQNNNNNKNNNKQSNKGNANQKGNNNNKNNAKNNKNNKNNKNNKNNKNNKGNKNNKPAAEPKEMPSKI

SEQ ID NO: 1941974 - protein, 12 aa, Staphylococcus
FRQTKERPLNYS

SEQ ID NO: 1941975 - protein, 7 aa, Staphylococcus
FRSEGDY

SEQ ID NO: 1941976 - protein, 12 aa, Staphylococcus
FRSGGSKPAPVT

SEQ ID NO: 1941977 - protein, 12 aa, Staphylococcus
FRSGNTKAAPVT

SEQ ID NO: 1941978 - protein, 4 aa, Staphylococcus
FRSR

SEQ ID NO: 1941979 - protein, 7 aa, Staphylococcus
FRSRPEV

SEQ ID NO: 1941980 - protein, 10 aa, Staphylococcus
FRTGNEAVPE

SEQ ID NO: 1941981 - protein, 8 aa, Staphylococcus
FRTPTDEG

SEQ ID NO: 1941982 - protein, 74 aa, Staphylococcus
FRTQDNKRHRRRRNHANDDGIADSSYQSKGYQSRKKKDSNPYTTTSTHRQISPTSLGSSSTNNHKTSSNTQPRM

SEQ ID NO: 1941983 - protein, 11 aa, Staphylococcus
FRTSEVPSAVF

SEQ ID NO: 1941984 - protein, 7 aa, Staphylococcus
FRTSNEY

SEQ ID NO: 1941985 - protein, 9 aa, Staphylococcus
FSAPTNDDR

SEQ ID NO: 1941986 - protein, 5 aa, Staphylococcus
FSASA

SEQ ID NO: 1941987 - protein, 18 aa, Staphylococcus
FSASAADAIDAKGGAHEV

SEQ ID NO: 1941988 - protein, 12 aa, Staphylococcus
FSATTQSDALDE

SEQ ID NO: 1941989 - protein, 9 aa, Staphylococcus
FSDAEGEGF

SEQ ID NO: 1941990 - protein, 10 aa, Staphylococcus
FSDAGNAANL

SEQ ID NO: 1941991 - protein, 5 aa, Staphylococcus
FSDDN

SEQ ID NO: 1941992 - protein, 5 aa, Staphylococcus
FSDEG

SEQ ID NO: 1941993 - protein, 12 aa, Staphylococcus
FSDGDTTFAREM

SEQ ID NO: 1941994 - protein, 5 aa, Staphylococcus
FSDGK

SEQ ID NO: 1941995 - protein, 5 aa, Staphylococcus
FSDGQ

SEQ ID NO: 1941996 - protein, 6 aa, Staphylococcus
FSDKND

SEQ ID NO: 1941997 - protein, 6 aa, Staphylococcus
FSDRDD

SEQ ID NO: 1941998 - protein, 10 aa, Staphylococcus
FSDRKTLESL

SEQ ID NO: 1941999 - protein, 6 aa, Staphylococcus
FSDTHE

SEQ ID NO: 1942000 - protein, 6 aa, Staphylococcus
FSDTQN

SEQ ID NO: 1942001 - protein, 7 aa, Staphylococcus
FSEDEDQ

SEQ ID NO: 1942002 - protein, 4 aa, Staphylococcus
FSEE

SEQ ID NO: 1942003 - protein, 5 aa, Staphylococcus
FSEEA

SEQ ID NO: 1942004 - protein, 14 aa, Staphylococcus
FSEEALKTAETVRS

SEQ ID NO: 1942005 - protein, 9 aa, Staphylococcus
FSEELADKG

SEQ ID NO: 1942006 - protein, 8 aa, Staphylococcus
FSEELGAK

SEQ ID NO: 1942007 - protein, 8 aa, Staphylococcus
FSEETAIQ

SEQ ID NO: 1942008 - protein, 12 aa, Staphylococcus
FSEETKEMTDSN

SEQ ID NO: 1942009 - protein, 6 aa, Staphylococcus
FSEGQN

SEQ ID NO: 1942010 - protein, 17 aa, Staphylococcus
FSEGSYEVDGKDEVRKY

SEQ ID NO: 1942011 - protein, 4 aa, Staphylococcus
FSEI

SEQ ID NO: 1942012 - protein, 10 aa, Staphylococcus
FSEKGYTQDV

SEQ ID NO: 1942013 - protein, 7 aa, Staphylococcus
FSEPTEE

SEQ ID NO: 1942014 - protein, 9 aa, Staphylococcus
FSEQLGEQG

SEQ ID NO: 1942015 - protein, 13 aa, Staphylococcus
FSERTGKAFSSNE

SEQ ID NO: 1942016 - protein, 12 aa, Staphylococcus
FSERTGKIFSSD

SEQ ID NO: 1942017 - protein, 13 aa, Staphylococcus
FSERTGKSFSSDE

SEQ ID NO: 1942018 - protein, 6 aa, Staphylococcus
FSESQG

SEQ ID NO: 1942019 - protein, 12 aa, Staphylococcus
FSESTLTQLPPS

SEQ ID NO: 1942020 - protein, 8 aa, Staphylococcus
FSESVGKD

SEQ ID NO: 1942021 - protein, 9 aa, Staphylococcus
FSESVGKDI

SEQ ID NO: 1942022 - protein, 5 aa, Staphylococcus
FSETQ

SEQ ID NO: 1942023 - protein, 6 aa, Staphylococcus
FSETRQ

SEQ ID NO: 1942024 - protein, 4 aa, Staphylococcus
FSEV

SEQ ID NO: 1942025 - protein, 15 aa, Staphylococcus
FSEVEQKDLEERVKN

SEQ ID NO: 1942026 - protein, 8 aa, Staphylococcus
FSGEANNI

SEQ ID NO: 1942027 - protein, 25 aa, Staphylococcus
FSGGGKGKKGKRKQMENMMNGMNLP

SEQ ID NO: 1942028 - protein, 25 aa, Staphylococcus
FSGGGKGKKGKRSQMENMLKGMNLP

SEQ ID NO: 1942029 - protein, 10 aa, Staphylococcus
FSGGNNAGHT

SEQ ID NO: 1942030 - protein, 9 aa, Staphylococcus
FSGGQRQRV

SEQ ID NO: 1942031 - protein, 9 aa, Staphylococcus
FSGLDKQSV

SEQ ID NO: 1942032 - protein, 12 aa, Staphylococcus
FSGQEAIETLEK

SEQ ID NO: 1942033 - protein, 19 aa, Staphylococcus
FSGQTDAPINYDKLKVSHH

SEQ ID NO: 1942034 - protein, 5 aa, Staphylococcus
FSGQV

SEQ ID NO: 1942035 - protein, 11 aa, Staphylococcus
FSGQYGDKVST

SEQ ID NO: 1942036 - protein, 14 aa, Staphylococcus
FSGRKIEKCLMIAS

SEQ ID NO: 1942037 - protein, 13 aa, Staphylococcus
FSGSSPLVSGELG

SEQ ID NO: 1942038 - protein, 5 aa, Staphylococcus
FSGSY

SEQ ID NO: 1942039 - protein, 10 aa, Staphylococcus
FSGTGIKTSL

SEQ ID NO: 1942040 - protein, 8 aa, Staphylococcus
FSGTNDQN

SEQ ID NO: 1942041 - protein, 5 aa, Staphylococcus
FSGVT

SEQ ID NO: 1942042 - protein, 9 aa, Staphylococcus
FSHDGTTGM

SEQ ID NO: 1942043 - protein, 10 aa, Staphylococcus
FSHESGIHQD

SEQ ID NO: 1942044 - protein, 6 aa, Staphylococcus
FSIRGG

SEQ ID NO: 1942045 - protein, 10 aa, Staphylococcus
FSKDEEEDLG

SEQ ID NO: 1942046 - protein, 4 aa, Staphylococcus
FSKE

SEQ ID NO: 1942047 - protein, 8 aa, Staphylococcus
FSKEEQEK

SEQ ID NO: 1942048 - protein, 10 aa, Staphylococcus
FSKEKVGTFD

SEQ ID NO: 1942049 - protein, 7 aa, Staphylococcus
FSKGNED

SEQ ID NO: 1942050 - protein, 7 aa, Staphylococcus
FSKGQNV

SEQ ID NO: 1942051 - protein, 14 aa, Staphylococcus
FSKGSVDKTNNTAQ

SEQ ID NO: 1942052 - protein, 12 aa, Staphylococcus
FSKKSDKSKEKF

SEQ ID NO: 1942053 - protein, 6 aa, Staphylococcus
FSKNNI

SEQ ID NO: 1942054 - protein, 7 aa, Staphylococcus
FSKQKNN

SEQ ID NO: 1942055 - protein, 5 aa, Staphylococcus
FSKSA

SEQ ID NO: 1942056 - protein, 10 aa, Staphylococcus
FSKSQAKKRA

SEQ ID NO: 1942057 - protein, 11 aa, Staphylococcus
FSNASSYSKTF

SEQ ID NO: 1942058 - protein, 12 aa, Staphylococcus
FSNDPKKEIEKN

SEQ ID NO: 1942059 - protein, 11 aa, Staphylococcus
FSNEDKAQSEL

SEQ ID NO: 1942060 - protein, 17 aa, Staphylococcus
FSNETARGEKGFGSSGT

SEQ ID NO: 1942061 - protein, 24 aa, Staphylococcus
FSNGDDSSKARKNEKIGHQQWIIL

SEQ ID NO: 1942062 - protein, 9 aa, Staphylococcus
FSNIESKVG

SEQ ID NO: 1942063 - protein, 7 aa, Staphylococcus
FSNISDQ

SEQ ID NO: 1942064 - protein, 25 aa, Staphylococcus
FSNKDKSSVTTEEHWTNPNEKGFSV

SEQ ID NO: 1942065 - protein, 28 aa, Staphylococcus
FSNKDQSSITTEENWTNQDEPGLSAYEK

SEQ ID NO: 1942066 - protein, 9 aa, Staphylococcus
FSNKKEDES

SEQ ID NO: 1942067 - protein, 10 aa, Staphylococcus
FSNKTLEDPG

SEQ ID NO: 1942068 - protein, 12 aa, Staphylococcus
FSNNAKPASEGI

SEQ ID NO: 1942069 - protein, 12 aa, Staphylococcus
FSNNAKPATEGI

SEQ ID NO: 1942070 - protein, 11 aa, Staphylococcus
FSNNEKRRGDF

SEQ ID NO: 1942071 - protein, 13 aa, Staphylococcus
FSNNSKPASEGVK

SEQ ID NO: 1942072 - protein, 12 aa, Staphylococcus
FSNNSKPASQGV

SEQ ID NO: 1942073 - protein, 9 aa, Staphylococcus
FSNPHQKLS

SEQ ID NO: 1942074 - protein, 10 aa, Staphylococcus
FSNPNEKLSE

SEQ ID NO: 1942075 - protein, 6 aa, Staphylococcus
FSNQKE

SEQ ID NO: 1942076 - protein, 12 aa, Staphylococcus
FSNRNNNNWTKK

SEQ ID NO: 1942077 - protein, 5 aa, Staphylococcus
FSNTQ

SEQ ID NO: 1942078 - protein, 14 aa, Staphylococcus
FSNYGKLAPKKTAD

SEQ ID NO: 1942079 - protein, 4 aa, Staphylococcus
FSPA

SEQ ID NO: 1942080 - protein, 5 aa, Staphylococcus
FSPAF

SEQ ID NO: 1942081 - protein, 6 aa, Staphylococcus
FSPANK

SEQ ID NO: 1942082 - protein, 15 aa, Staphylococcus
FSPDHLRGDAEGRYG

SEQ ID NO: 1942083 - protein, 16 aa, Staphylococcus
FSPDHLRGDEEGRYGT

SEQ ID NO: 1942084 - protein, 15 aa, Staphylococcus
FSPETLTDNQSSTLP

SEQ ID NO: 1942085 - protein, 12 aa, Staphylococcus
FSPEYVAQYLTQ

SEQ ID NO: 1942086 - protein, 7 aa, Staphylococcus
FSPKDED

SEQ ID NO: 1942087 - protein, 10 aa, Staphylococcus
FSPNETGGGF

SEQ ID NO: 1942088 - protein, 10 aa, Staphylococcus
FSPNGSEIQT

SEQ ID NO: 1942089 - protein, 5 aa, Staphylococcus
FSPNL

SEQ ID NO: 1942090 - protein, 17 aa, Staphylococcus
FSPNTKEIKTGADDSVK

SEQ ID NO: 1942091 - protein, 17 aa, Staphylococcus
FSPQKKPAQLENEIEKL

SEQ ID NO: 1942092 - protein, 17 aa, Staphylococcus
FSPQKKPAQLHEAIEAL

SEQ ID NO: 1942093 - protein, 17 aa, Staphylococcus
FSPQKKPDQIASEIEKL

SEQ ID NO: 1942094 - protein, 17 aa, Staphylococcus
FSPQKKPSQLESEIEAL

SEQ ID NO: 1942095 - protein, 17 aa, Staphylococcus
FSPQKSPSQIESDIEDL

SEQ ID NO: 1942096 - protein, 9 aa, Staphylococcus
FSPQSGTVS

SEQ ID NO: 1942097 - protein, 5 aa, Staphylococcus
FSPSL

SEQ ID NO: 1942098 - protein, 9 aa, Staphylococcus
FSQDKGTVT

SEQ ID NO: 1942099 - protein, 12 aa, Staphylococcus
FSQHGGNRLGAN

SEQ ID NO: 1942100 - protein, 5 aa, Staphylococcus
FSQLT

SEQ ID NO: 1942101 - protein, 7 aa, Staphylococcus
FSQQKRK

SEQ ID NO: 1942102 - protein, 9 aa, Staphylococcus
FSQSDSEKN

SEQ ID NO: 1942103 - protein, 5 aa, Staphylococcus
FSQTE

SEQ ID NO: 1942104 - protein, 4 aa, Staphylococcus
FSQY

SEQ ID NO: 1942105 - protein, 7 aa, Staphylococcus
FSRDDAG

SEQ ID NO: 1942106 - protein, 11 aa, Staphylococcus
FSRDEASVQGA

SEQ ID NO: 1942107 - protein, 9 aa, Staphylococcus
FSRDQEEKR

SEQ ID NO: 1942108 - protein, 10 aa, Staphylococcus
FSREEASIQG

SEQ ID NO: 1942109 - protein, 6 aa, Staphylococcus
FSRGQN

SEQ ID NO: 1942110 - protein, 5 aa, Staphylococcus
FSRKK

SEQ ID NO: 1942111 - protein, 6 aa, Staphylococcus
FSRKTD

SEQ ID NO: 1942112 - protein, 11 aa, Staphylococcus
FSRSAQDLKRD

SEQ ID NO: 1942113 - protein, 5 aa, Staphylococcus
FSRSK

SEQ ID NO: 1942114 - protein, 11 aa, Staphylococcus
FSSASSYSKTF

SEQ ID NO: 1942115 - protein, 4 aa, Staphylococcus
FSSE

SEQ ID NO: 1942116 - protein, 7 aa, Staphylococcus
FSSEDGY

SEQ ID NO: 1942117 - protein, 10 aa, Staphylococcus
FSSEESEGTA

SEQ ID NO: 1942118 - protein, 4 aa, Staphylococcus
FSSG

SEQ ID NO: 1942119 - protein, 7 aa, Staphylococcus
FSSIERK

SEQ ID NO: 1942120 - protein, 13 aa, Staphylococcus
FSSLDDATRDEGI

SEQ ID NO: 1942121 - protein, 12 aa, Staphylococcus
FSSLDDSTKHES

SEQ ID NO: 1942122 - protein, 6 aa, Staphylococcus
FSSLGA

SEQ ID NO: 1942123 - protein, 8 aa, Staphylococcus
FSSNEIEQ

SEQ ID NO: 1942124 - protein, 11 aa, Staphylococcus
FSSQAADKIRE

SEQ ID NO: 1942125 - protein, 12 aa, Staphylococcus
FSSSEASKYDED

SEQ ID NO: 1942126 - protein, 9 aa, Staphylococcus
FSSSEKENW

SEQ ID NO: 1942127 - protein, 5 aa, Staphylococcus
FSSSS

SEQ ID NO: 1942128 - protein, 6 aa, Staphylococcus
FSSSSA

SEQ ID NO: 1942129 - protein, 7 aa, Staphylococcus
FSSSSSV

SEQ ID NO: 1942130 - protein, 5 aa, Staphylococcus
FSSYR

SEQ ID NO: 1942131 - protein, 4 aa, Staphylococcus
FSTA

SEQ ID NO: 1942132 - protein, 12 aa, Staphylococcus
FSTDTVKTAKEV

SEQ ID NO: 1942133 - protein, 7 aa, Staphylococcus
FSTEAEA

SEQ ID NO: 1942134 - protein, 6 aa, Staphylococcus
FSTGNH

SEQ ID NO: 1942135 - protein, 17 aa, Staphylococcus
FSTGSSIMPQKKNPDMA

SEQ ID NO: 1942136 - protein, 7 aa, Staphylococcus
FSTITNE

SEQ ID NO: 1942137 - protein, 11 aa, Staphylococcus
FSTKGNNRGLG

SEQ ID NO: 1942138 - protein, 4 aa, Staphylococcus
FSTM

SEQ ID NO: 1942139 - protein, 5 aa, Staphylococcus
FSTNE

SEQ ID NO: 1942140 - protein, 13 aa, Staphylococcus
FSTNKKKGYAKEK

SEQ ID NO: 1942141 - protein, 8 aa, Staphylococcus
FSTQSPQL

SEQ ID NO: 1942142 - protein, 18 aa, Staphylococcus
FSTSAAEAIDAKGGAHEV

SEQ ID NO: 1942143 - protein, 8 aa, Staphylococcus
FSTSPKDY

SEQ ID NO: 1942144 - protein, 6 aa, Staphylococcus
FSTTSL

SEQ ID NO: 1942145 - protein, 6 aa, Staphylococcus
FTADRT

SEQ ID NO: 1942146 - protein, 10 aa, Staphylococcus
FTAEENKAMK

SEQ ID NO: 1942147 - protein, 5 aa, Staphylococcus
FTAKD

SEQ ID NO: 1942148 - protein, 9 aa, Staphylococcus
FTASAGPGL

SEQ ID NO: 1942149 - protein, 9 aa, Staphylococcus
FTASSGPGL

SEQ ID NO: 1942150 - protein, 4 aa, Staphylococcus
FTDA

SEQ ID NO: 1942151 - protein, 4 aa, Staphylococcus
FTDD

SEQ ID NO: 1942152 - protein, 10 aa, Staphylococcus
FTDDAEDAGV

SEQ ID NO: 1942153 - protein, 7 aa, Staphylococcus
FTDDTPI

SEQ ID NO: 1942154 - protein, 8 aa, Staphylococcus
FTDETSKY

SEQ ID NO: 1942155 - protein, 6 aa, Staphylococcus
FTDNDK

SEQ ID NO: 1942156 - protein, 9 aa, Staphylococcus
FTDNKADIE

SEQ ID NO: 1942157 - protein, 8 aa, Staphylococcus
FTDNKDDI

SEQ ID NO: 1942158 - protein, 7 aa, Staphylococcus
FTDPDGH

SEQ ID NO: 1942159 - protein, 8 aa, Staphylococcus
FTDPDGHK

SEQ ID NO: 1942160 - protein, 6 aa, Staphylococcus
FTDREK

SEQ ID NO: 1942161 - protein, 6 aa, Staphylococcus
FTEDLG

SEQ ID NO: 1942162 - protein, 12 aa, Staphylococcus
FTEDNSKSIVSE

SEQ ID NO: 1942163 - protein, 7 aa, Staphylococcus
FTEEDQK

SEQ ID NO: 1942164 - protein, 7 aa, Staphylococcus
FTEGSSV

SEQ ID NO: 1942165 - protein, 10 aa, Staphylococcus
FTEITDDKKR

SEQ ID NO: 1942166 - protein, 10 aa, Staphylococcus
FTEKSRSFSE

SEQ ID NO: 1942167 - protein, 5 aa, Staphylococcus
FTEND

SEQ ID NO: 1942168 - protein, 12 aa, Staphylococcus
FTENDKQFPGKA

SEQ ID NO: 1942169 - protein, 8 aa, Staphylococcus
FTENGEQF

SEQ ID NO: 1942170 - protein, 11 aa, Staphylococcus
FTEQRLSKAAT

SEQ ID NO: 1942171 - protein, 6 aa, Staphylococcus
FTETTA

SEQ ID NO: 1942172 - protein, 13 aa, Staphylococcus
FTGEDPNAEPQTI

SEQ ID NO: 1942173 - protein, 25 aa, Staphylococcus
FTGGGKGKKAKRSQMENMLKGMNLP

SEQ ID NO: 1942174 - protein, 25 aa, Staphylococcus
FTGGGKGKKGKRSQMENMLKGMNLP

SEQ ID NO: 1942175 - protein, 25 aa, Staphylococcus
FTGGGKGKKGKRSQMQNMLKGMNLP

SEQ ID NO: 1942176 - protein, 12 aa, Staphylococcus
FTGGVAAMHLGY

SEQ ID NO: 1942177 - protein, 10 aa, Staphylococcus
FTGKETYKDG

SEQ ID NO: 1942178 - protein, 6 aa, Staphylococcus
FTGNGR

SEQ ID NO: 1942179 - protein, 26 aa, Staphylococcus
FTGNGRKGKKGKRSQMENMLKGMNLP

SEQ ID NO: 1942180 - protein, 10 aa, Staphylococcus
FTGNKERDKM

SEQ ID NO: 1942181 - protein, 7 aa, Staphylococcus
FTGPVGR

SEQ ID NO: 1942182 - protein, 9 aa, Staphylococcus
FTGQKGSYV

SEQ ID NO: 1942183 - protein, 11 aa, Staphylococcus
FTGSTAVGKSL

SEQ ID NO: 1942184 - protein, 17 aa, Staphylococcus
FTGTNGFENAGGMSQDM

SEQ ID NO: 1942185 - protein, 8 aa, Staphylococcus
FTGTSNGI

SEQ ID NO: 1942186 - protein, 5 aa, Staphylococcus
FTKAG

SEQ ID NO: 1942187 - protein, 11 aa, Staphylococcus
FTKDGDQSGLR

SEQ ID NO: 1942188 - protein, 9 aa, Staphylococcus
FTKDKTNSV

SEQ ID NO: 1942189 - protein, 10 aa, Staphylococcus
FTKEDDEALG

SEQ ID NO: 1942190 - protein, 11 aa, Staphylococcus
FTKEKSKAEMR

SEQ ID NO: 1942191 - protein, 8 aa, Staphylococcus
FTKGEHDL

SEQ ID NO: 1942192 - protein, 6 aa, Staphylococcus
FTKNPM

SEQ ID NO: 1942193 - protein, 13 aa, Staphylococcus
FTKSHSGNVPEEQ

SEQ ID NO: 1942194 - protein, 20 aa, Staphylococcus
FTKSPVENIKSANQDSDRHP

SEQ ID NO: 1942195 - protein, 5 aa, Staphylococcus
FTNAE

SEQ ID NO: 1942196 - protein, 7 aa, Staphylococcus
FTNAPKG

SEQ ID NO: 1942197 - protein, 8 aa, Staphylococcus
FTNDEENK

SEQ ID NO: 1942198 - protein, 9 aa, Staphylococcus
FTNKEELEK

SEQ ID NO: 1942199 - protein, 9 aa, Staphylococcus
FTNSDGARK

SEQ ID NO: 1942200 - protein, 5 aa, Staphylococcus
FTPEN

SEQ ID NO: 1942201 - protein, 5 aa, Staphylococcus
FTPES

SEQ ID NO: 1942202 - protein, 12 aa, Staphylococcus
FTPEYVAQYLTQ

SEQ ID NO: 1942203 - protein, 7 aa, Staphylococcus
FTPKNAG

SEQ ID NO: 1942204 - protein, 13 aa, Staphylococcus
FTPPSSHIGKGNH

SEQ ID NO: 1942205 - protein, 4 aa, Staphylococcus
FTPQ

SEQ ID NO: 1942206 - protein, 13 aa, Staphylococcus
FTPQMSEEDRTKL

SEQ ID NO: 1942207 - protein, 5 aa, Staphylococcus
FTPSG

SEQ ID NO: 1942208 - protein, 12 aa, Staphylococcus
FTQDNSQLDEQL

SEQ ID NO: 1942209 - protein, 5 aa, Staphylococcus
FTQEA

SEQ ID NO: 1942210 - protein, 10 aa, Staphylococcus
FTQGHGTADL

SEQ ID NO: 1942211 - protein, 9 aa, Staphylococcus
FTQKSAQKL

SEQ ID NO: 1942212 - protein, 4 aa, Staphylococcus
FTQP

SEQ ID NO: 1942213 - protein, 9 aa, Staphylococcus
FTQPPPRFT

SEQ ID NO: 1942214 - protein, 24 aa, Staphylococcus
FTRPNKEGQTKEDGVEFGSDEIEG

SEQ ID NO: 1942215 - protein, 6 aa, Staphylococcus
FTSANQ

SEQ ID NO: 1942216 - protein, 9 aa, Staphylococcus
FTSEGEGTG

SEQ ID NO: 1942217 - protein, 12 aa, Staphylococcus
FTSKQRIKKLLK

SEQ ID NO: 1942218 - protein, 9 aa, Staphylococcus
FTSKYNESY

SEQ ID NO: 1942219 - protein, 4 aa, Staphylococcus
FTSP

SEQ ID NO: 1942220 - protein, 6 aa, Staphylococcus
FTSPKK

SEQ ID NO: 1942221 - protein, 6 aa, Staphylococcus
FTTAGQ

SEQ ID NO: 1942222 - protein, 6 aa, Staphylococcus
FTTDEG

SEQ ID NO: 1942223 - protein, 20 aa, Staphylococcus
FTTEARDGRSTTYSTDVAKG

SEQ ID NO: 1942224 - protein, 21 aa, Staphylococcus
FTTEPEDGRSTTYSSDVAKGY

SEQ ID NO: 1942225 - protein, 5 aa, Staphylococcus
FTTES

SEQ ID NO: 1942226 - protein, 10 aa, Staphylococcus
FTTESGEKIE

SEQ ID NO: 1942227 - protein, 10 aa, Staphylococcus
FTTESGETIN

SEQ ID NO: 1942228 - protein, 10 aa, Staphylococcus
FTTESGETIQ

SEQ ID NO: 1942229 - protein, 11 aa, Staphylococcus
FTTGGLNRAAA

SEQ ID NO: 1942230 - protein, 5 aa, Staphylococcus
FTTGY

SEQ ID NO: 1942231 - protein, 14 aa, Staphylococcus
FTTSEQGKQRLEAA

SEQ ID NO: 1942232 - protein, 13 aa, Staphylococcus
FTTSERGKEKLER

SEQ ID NO: 1942233 - protein, 12 aa, Staphylococcus
FTTSQQGKAKLV

SEQ ID NO: 1942234 - protein, 11 aa, Staphylococcus
FTYDSNKKVNG

SEQ ID NO: 1942235 - protein, 4 aa, Staphylococcus
FVED

SEQ ID NO: 1942236 - protein, 4 aa, Staphylococcus
FVEN

SEQ ID NO: 1942237 - protein, 12 aa, Staphylococcus
FVGTSAGAQVGT

SEQ ID NO: 1942238 - protein, 6 aa, Staphylococcus
FVPEPG

SEQ ID NO: 1942239 - protein, 9 aa, Staphylococcus
FVPKNAYSS

SEQ ID NO: 1942240 - protein, 5 aa, Staphylococcus
FVPNK

SEQ ID NO: 1942241 - protein, 4 aa, Staphylococcus
FVPQ

SEQ ID NO: 1942242 - protein, 4 aa, Staphylococcus
FVPT

SEQ ID NO: 1942243 - protein, 5 aa, Staphylococcus
FVSDE

SEQ ID NO: 1942244 - protein, 6 aa, Staphylococcus
FVTEGK

SEQ ID NO: 1942245 - protein, 8 aa, Staphylococcus
FVTEGKND

SEQ ID NO: 1942246 - protein, 10 aa, Staphylococcus
FYATPRKPAV

SEQ ID NO: 1942247 - protein, 14 aa, Staphylococcus
FYDDGNAVSPSIKH

SEQ ID NO: 1942248 - protein, 21 aa, Staphylococcus
FYEKPSVRRKKKSEAARKRKF

SEQ ID NO: 1942249 - protein, 10 aa, Staphylococcus
FYSENPEHLK

SEQ ID NO: 1942250 - protein, 6 aa, Staphylococcus
FYSTDD

SEQ ID NO: 1942251 - protein, 5 aa, Staphylococcus
FYTEA

SEQ ID NO: 1942252 - protein, 18 aa, Staphylococcus
GAAALSGTTYPIDRHETK

SEQ ID NO: 1942253 - protein, 19 aa, Staphylococcus
GAAALSGTTYPIDRHETQS

SEQ ID NO: 1942254 - protein, 11 aa, Staphylococcus
GAAAPDIYDYD

SEQ ID NO: 1942255 - protein, 5 aa, Staphylococcus
GAADI

SEQ ID NO: 1942256 - protein, 10 aa, Staphylococcus
GAADIGDRQK

SEQ ID NO: 1942257 - protein, 8 aa, Staphylococcus
GAADMKSG

SEQ ID NO: 1942258 - protein, 10 aa, Staphylococcus
GAADNLESEA

SEQ ID NO: 1942259 - protein, 11 aa, Staphylococcus
GAADPKGGCSG

SEQ ID NO: 1942260 - protein, 6 aa, Staphylococcus
GAAGTD

SEQ ID NO: 1942261 - protein, 17 aa, Staphylococcus
GAAKAREELSSENLEDN

SEQ ID NO: 1942262 - protein, 18 aa, Staphylococcus
GAALANNELGKLSDAKKD

SEQ ID NO: 1942263 - protein, 19 aa, Staphylococcus
GAALANNELGKLSDEKKDA

SEQ ID NO: 1942264 - protein, 8 aa, Staphylococcus
GAANEGTF

SEQ ID NO: 1942265 - protein, 8 aa, Staphylococcus
GAANKSEV

SEQ ID NO: 1942266 - protein, 11 aa, Staphylococcus
GAANKTDPTKF

SEQ ID NO: 1942267 - protein, 10 aa, Staphylococcus
GAANKTDPTR

SEQ ID NO: 1942268 - protein, 9 aa, Staphylococcus
GAAPEDGDI

SEQ ID NO: 1942269 - protein, 9 aa, Staphylococcus
GAAPEDGEI

SEQ ID NO: 1942270 - protein, 5 aa, Staphylococcus
GAAPI

SEQ ID NO: 1942271 - protein, 9 aa, Staphylococcus
GAAPKDGKI

SEQ ID NO: 1942272 - protein, 13 aa, Staphylococcus
GAAPQDGKAYPHH

SEQ ID NO: 1942273 - protein, 10 aa, Staphylococcus
GAAPQQGHAY

SEQ ID NO: 1942274 - protein, 6 aa, Staphylococcus
GAAQGI

SEQ ID NO: 1942275 - protein, 10 aa, Staphylococcus
GAAQKPGETR

SEQ ID NO: 1942276 - protein, 5 aa, Staphylococcus
GACSS

SEQ ID NO: 1942277 - protein, 11 aa, Staphylococcus
GADAAKIVDTN

SEQ ID NO: 1942278 - protein, 9 aa, Staphylococcus
GADATNQEA

SEQ ID NO: 1942279 - protein, 7 aa, Staphylococcus
GADEFDS

SEQ ID NO: 1942280 - protein, 7 aa, Staphylococcus
GADEIDN

SEQ ID NO: 1942281 - protein, 7 aa, Staphylococcus
GADEIDS

SEQ ID NO: 1942282 - protein, 5 aa, Staphylococcus
GADEV

SEQ ID NO: 1942283 - protein, 8 aa, Staphylococcus
GADEVDPN

SEQ ID NO: 1942284 - protein, 11 aa, Staphylococcus
GADEVKETLGH

SEQ ID NO: 1942285 - protein, 9 aa, Staphylococcus
GADGAQLDD

SEQ ID NO: 1942286 - protein, 13 aa, Staphylococcus
GADGAQLDEDTSL

SEQ ID NO: 1942287 - protein, 10 aa, Staphylococcus
GADGGQLLPE

SEQ ID NO: 1942288 - protein, 15 aa, Staphylococcus
GADGGQLSTEPSNKL

SEQ ID NO: 1942289 - protein, 4 aa, Staphylococcus
GADI

SEQ ID NO: 1942290 - protein, 6 aa, Staphylococcus
GADIKK

SEQ ID NO: 1942291 - protein, 5 aa, Staphylococcus
GADLR

SEQ ID NO: 1942292 - protein, 8 aa, Staphylococcus
GADQWGNI

SEQ ID NO: 1942293 - protein, 4 aa, Staphylococcus
GADS

SEQ ID NO: 1942294 - protein, 13 aa, Staphylococcus
GADSVKETLGDTS

SEQ ID NO: 1942295 - protein, 15 aa, Staphylococcus
GADSYVEPAASASQK

SEQ ID NO: 1942296 - protein, 9 aa, Staphylococcus
GADTTIEPG

SEQ ID NO: 1942297 - protein, 7 aa, Staphylococcus
GADVGSD

SEQ ID NO: 1942298 - protein, 10 aa, Staphylococcus
GAEADEVTAI

SEQ ID NO: 1942299 - protein, 8 aa, Staphylococcus
GAEANEAA

SEQ ID NO: 1942300 - protein, 4 aa, Staphylococcus
GAEC

SEQ ID NO: 1942301 - protein, 9 aa, Staphylococcus
GAEDETINK

SEQ ID NO: 1942302 - protein, 8 aa, Staphylococcus
GAEDPSID

SEQ ID NO: 1942303 - protein, 13 aa, Staphylococcus
GAEDVKETLGNQS

SEQ ID NO: 1942304 - protein, 7 aa, Staphylococcus
GAEEAEV

SEQ ID NO: 1942305 - protein, 17 aa, Staphylococcus
GAEEKYKGHLADNAETL

SEQ ID NO: 1942306 - protein, 9 aa, Staphylococcus
GAEERDKEA

SEQ ID NO: 1942307 - protein, 13 aa, Staphylococcus
GAEGIRDKDTHDK

SEQ ID NO: 1942308 - protein, 19 aa, Staphylococcus
GAEGMSQESVDGRSNTFQA

SEQ ID NO: 1942309 - protein, 7 aa, Staphylococcus
GAEGTSF

SEQ ID NO: 1942310 - protein, 8 aa, Staphylococcus
GAEKDKEM

SEQ ID NO: 1942311 - protein, 4 aa, Staphylococcus
GAEL

SEQ ID NO: 1942312 - protein, 9 aa, Staphylococcus
GAENPGVDA

SEQ ID NO: 1942313 - protein, 8 aa, Staphylococcus
GAENPSMD

SEQ ID NO: 1942314 - protein, 7 aa, Staphylococcus
GAEQRQI

SEQ ID NO: 1942315 - protein, 14 aa, Staphylococcus
GAEQVKDTLGNQSL

SEQ ID NO: 1942316 - protein, 7 aa, Staphylococcus
GAERKNI

SEQ ID NO: 1942317 - protein, 25 aa, Staphylococcus
GAERVKDTLGDQSAYGFQEEQLGTA

SEQ ID NO: 1942318 - protein, 9 aa, Staphylococcus
GAESKKREL

SEQ ID NO: 1942319 - protein, 12 aa, Staphylococcus
GAESVKETLGDQ

SEQ ID NO: 1942320 - protein, 12 aa, Staphylococcus
GAESVKETLGNQ

SEQ ID NO: 1942321 - protein, 5 aa, Staphylococcus
GAETI

SEQ ID NO: 1942322 - protein, 5 aa, Staphylococcus
GAEVE

SEQ ID NO: 1942323 - protein, 5 aa, Staphylococcus
GAEVG

SEQ ID NO: 1942324 - protein, 4 aa, Staphylococcus
GAEY

SEQ ID NO: 1942325 - protein, 19 aa, Staphylococcus
GAEYKKIGVPGEQELGGRG

SEQ ID NO: 1942326 - protein, 6 aa, Staphylococcus
GAEYQY

SEQ ID NO: 1942327 - protein, 5 aa, Staphylococcus
GAFAD

SEQ ID NO: 1942328 - protein, 14 aa, Staphylococcus
GAFENNNPLPKPPI

SEQ ID NO: 1942329 - protein, 23 aa, Staphylococcus
GAFGDSTPKKDTPQNTIQQPTTM

SEQ ID NO: 1942330 - protein, 16 aa, Staphylococcus
GAFGDSTPKVNTPQVT

SEQ ID NO: 1942331 - protein, 16 aa, Staphylococcus
GAFGPSTPKVNTPQVT

SEQ ID NO: 1942332 - protein, 16 aa, Staphylococcus
GAFGSSTPKVNTPQVT

SEQ ID NO: 1942333 - protein, 11 aa, Staphylococcus
GAFNPPRALTE

SEQ ID NO: 1942334 - protein, 5 aa, Staphylococcus
GAFTG

SEQ ID NO: 1942335 - protein, 6 aa, Staphylococcus
GAFTPS

SEQ ID NO: 1942336 - protein, 8 aa, Staphylococcus
GAGAAQLG

SEQ ID NO: 1942337 - protein, 13 aa, Staphylococcus
GAGASAAAQHSQS

SEQ ID NO: 1942338 - protein, 21 aa, Staphylococcus
GAGDTTEKNKSVPVTPEEMAD

SEQ ID NO: 1942339 - protein, 13 aa, Staphylococcus
GAGDVSSHQLQAG

SEQ ID NO: 1942340 - protein, 13 aa, Staphylococcus
GAGGLPTGTGGKT

SEQ ID NO: 1942341 - protein, 12 aa, Staphylococcus
GAGGLPVGTGGK

SEQ ID NO: 1942342 - protein, 25 aa, Staphylococcus
GAGGNAPKGTTDDERFEGDLDQDKQ

SEQ ID NO: 1942343 - protein, 26 aa, Staphylococcus
GAGGNSPKGTTDDERFEGKLEQDGKT

SEQ ID NO: 1942344 - protein, 12 aa, Staphylococcus
GAGIKDALEKSA

SEQ ID NO: 1942345 - protein, 9 aa, Staphylococcus
GAGKDTDGQ

SEQ ID NO: 1942346 - protein, 9 aa, Staphylococcus
GAGKGTDGQ

SEQ ID NO: 1942347 - protein, 7 aa, Staphylococcus
GAGKNGF

SEQ ID NO: 1942348 - protein, 8 aa, Staphylococcus
GAGKSTTI

SEQ ID NO: 1942349 - protein, 8 aa, Staphylococcus
GAGKTSVI

SEQ ID NO: 1942350 - protein, 8 aa, Staphylococcus
GAGNSALD

SEQ ID NO: 1942351 - protein, 10 aa, Staphylococcus
GAGPGNPNLL

SEQ ID NO: 1942352 - protein, 7 aa, Staphylococcus
GAGQGQE

SEQ ID NO: 1942353 - protein, 6 aa, Staphylococcus
GAGREL

SEQ ID NO: 1942354 - protein, 6 aa, Staphylococcus
GAGSDM

SEQ ID NO: 1942355 - protein, 9 aa, Staphylococcus
GAGSGIGEA

SEQ ID NO: 1942356 - protein, 9 aa, Staphylococcus
GAGSGIGKS

SEQ ID NO: 1942357 - protein, 9 aa, Staphylococcus
GAGSGMGKA

SEQ ID NO: 1942358 - protein, 8 aa, Staphylococcus
GAGSSAYV

SEQ ID NO: 1942359 - protein, 16 aa, Staphylococcus
GAGSVNIDGEKTVVEK

SEQ ID NO: 1942360 - protein, 6 aa, Staphylococcus
GAGTGN

SEQ ID NO: 1942361 - protein, 7 aa, Staphylococcus
GAGTKNF

SEQ ID NO: 1942362 - protein, 16 aa, Staphylococcus
GAGTPLSEEEQQVADK

SEQ ID NO: 1942363 - protein, 12 aa, Staphylococcus
GAGTVEADNPSL

SEQ ID NO: 1942364 - protein, 5 aa, Staphylococcus
GAGVG

SEQ ID NO: 1942365 - protein, 5 aa, Staphylococcus
GAGYL

SEQ ID NO: 1942366 - protein, 6 aa, Staphylococcus
GAHAGK

SEQ ID NO: 1942367 - protein, 9 aa, Staphylococcus
GAHGGNAQI

SEQ ID NO: 1942368 - protein, 10 aa, Staphylococcus
GAHGKTSTTG

SEQ ID NO: 1942369 - protein, 20 aa, Staphylococcus
GAHGQAREITQDIEPDKYYP

SEQ ID NO: 1942370 - protein, 9 aa, Staphylococcus
GAHGSTSSL

SEQ ID NO: 1942371 - protein, 7 aa, Staphylococcus
GAHNNGK

SEQ ID NO: 1942372 - protein, 6 aa, Staphylococcus
GAHQTL

SEQ ID NO: 1942373 - protein, 8 aa, Staphylococcus
GAHSGGSH

SEQ ID NO: 1942374 - protein, 7 aa, Staphylococcus
GAHSKPR

SEQ ID NO: 1942375 - protein, 8 aa, Staphylococcus
GAHSTGAS

SEQ ID NO: 1942376 - protein, 6 aa, Staphylococcus
GAHTAE

SEQ ID NO: 1942377 - protein, 5 aa, Staphylococcus
GAIEE

SEQ ID NO: 1942378 - protein, 8 aa, Staphylococcus
GAIEKGEF

SEQ ID NO: 1942379 - protein, 9 aa, Staphylococcus
GAIERGTSE

SEQ ID NO: 1942380 - protein, 6 aa, Staphylococcus
GAIEYS

SEQ ID NO: 1942381 - protein, 5 aa, Staphylococcus
GAIKG

SEQ ID NO: 1942382 - protein, 7 aa, Staphylococcus
GAINENT

SEQ ID NO: 1942383 - protein, 7 aa, Staphylococcus
GAINSPQ

SEQ ID NO: 1942384 - protein, 13 aa, Staphylococcus
GAIQETEQKADDL

SEQ ID NO: 1942385 - protein, 16 aa, Staphylococcus
GAIREDDYVTEIWLPI

SEQ ID NO: 1942386 - protein, 5 aa, Staphylococcus
GAISD

SEQ ID NO: 1942387 - protein, 10 aa, Staphylococcus
GAISENVAYK

SEQ ID NO: 1942388 - protein, 7 aa, Staphylococcus
GAISGAI

SEQ ID NO: 1942389 - protein, 10 aa, Staphylococcus
GAISKSGVNH

SEQ ID NO: 1942390 - protein, 12 aa, Staphylococcus
GAITSEANDETI

SEQ ID NO: 1942391 - protein, 12 aa, Staphylococcus
GAITSGADAKTV

SEQ ID NO: 1942392 - protein, 12 aa, Staphylococcus
GAITSGASKETI

SEQ ID NO: 1942393 - protein, 12 aa, Staphylococcus
GAITSQADNETI

SEQ ID NO: 1942394 - protein, 6 aa, Staphylococcus
GAIYEG

SEQ ID NO: 1942395 - protein, 7 aa, Staphylococcus
GAIYEGR

SEQ ID NO: 1942396 - protein, 14 aa, Staphylococcus
GAIYENRPYGMNET

SEQ ID NO: 1942397 - protein, 6 aa, Staphylococcus
GAIYKK

SEQ ID NO: 1942398 - protein, 7 aa, Staphylococcus
GAIYKRD

SEQ ID NO: 1942399 - protein, 4 aa, Staphylococcus
GAKA

SEQ ID NO: 1942400 - protein, 8 aa, Staphylococcus
GAKANGKI

SEQ ID NO: 1942401 - protein, 8 aa, Staphylococcus
GAKAPKLV

SEQ ID NO: 1942402 - protein, 9 aa, Staphylococcus
GAKAPNLVT

SEQ ID NO: 1942403 - protein, 9 aa, Staphylococcus
GAKARIPNI

SEQ ID NO: 1942404 - protein, 13 aa, Staphylococcus
GAKARTTKQQARI

SEQ ID NO: 1942405 - protein, 8 aa, Staphylococcus
GAKDEVRS

SEQ ID NO: 1942406 - protein, 9 aa, Staphylococcus
GAKDKQGNF

SEQ ID NO: 1942407 - protein, 16 aa, Staphylococcus
GAKEEGTIGEDHRPET

SEQ ID NO: 1942408 - protein, 8 aa, Staphylococcus
GAKESLDL

SEQ ID NO: 1942409 - protein, 5 aa, Staphylococcus
GAKFD

SEQ ID NO: 1942410 - protein, 4 aa, Staphylococcus
GAKG

SEQ ID NO: 1942411 - protein, 9 aa, Staphylococcus
GAKGDEIEK

SEQ ID NO: 1942412 - protein, 7 aa, Staphylococcus
GAKGDKP

SEQ ID NO: 1942413 - protein, 10 aa, Staphylococcus
GAKGKRYALP

SEQ ID NO: 1942414 - protein, 10 aa, Staphylococcus
GAKGPNGATV

SEQ ID NO: 1942415 - protein, 11 aa, Staphylococcus
GAKGPSGSTVT

SEQ ID NO: 1942416 - protein, 8 aa, Staphylococcus
GAKGSRVE

SEQ ID NO: 1942417 - protein, 9 aa, Staphylococcus
GAKHAKDEV

SEQ ID NO: 1942418 - protein, 4 aa, Staphylococcus
GAKI

SEQ ID NO: 1942419 - protein, 8 aa, Staphylococcus
GAKKRAPK

SEQ ID NO: 1942420 - protein, 9 aa, Staphylococcus
GAKKRAPKL

SEQ ID NO: 1942421 - protein, 10 aa, Staphylococcus
GAKLETRNGY

SEQ ID NO: 1942422 - protein, 7 aa, Staphylococcus
GAKNGKS

SEQ ID NO: 1942423 - protein, 8 aa, Staphylococcus
GAKNGKSV

SEQ ID NO: 1942424 - protein, 13 aa, Staphylococcus
GAKPRKGKAYPHH

SEQ ID NO: 1942425 - protein, 8 aa, Staphylococcus
GAKPRVEA

SEQ ID NO: 1942426 - protein, 8 aa, Staphylococcus
GAKPTDTV

SEQ ID NO: 1942427 - protein, 8 aa, Staphylococcus
GAKRADQV

SEQ ID NO: 1942428 - protein, 8 aa, Staphylococcus
GAKRPNQV

SEQ ID NO: 1942429 - protein, 8 aa, Staphylococcus
GAKSLSNS

SEQ ID NO: 1942430 - protein, 10 aa, Staphylococcus
GALATSSGQA

SEQ ID NO: 1942431 - protein, 11 aa, Staphylococcus
GALATSSGQAA

SEQ ID NO: 1942432 - protein, 10 aa, Staphylococcus
GALDKPTDMN

SEQ ID NO: 1942433 - protein, 31 aa, Staphylococcus
GALDSADRTNKAALTGKNLQGALAKGRANLS

SEQ ID NO: 1942434 - protein, 10 aa, Staphylococcus
GALKSPTDMN

SEQ ID NO: 1942435 - protein, 9 aa, Staphylococcus
GALNKSKVE

SEQ ID NO: 1942436 - protein, 9 aa, Staphylococcus
GALSDPEGL

SEQ ID NO: 1942437 - protein, 13 aa, Staphylococcus
GALSQLTSSSIEG

SEQ ID NO: 1942438 - protein, 9 aa, Staphylococcus
GALSSAHGR

SEQ ID NO: 1942439 - protein, 11 aa, Staphylococcus
GALSVNGRSVT

SEQ ID NO: 1942440 - protein, 11 aa, Staphylococcus
GALTDRQSKSR

SEQ ID NO: 1942441 - protein, 12 aa, Staphylococcus
GALTSNASQQTV

SEQ ID NO: 1942442 - protein, 17 aa, Staphylococcus
GAMPQPVSSSSLITDEE

SEQ ID NO: 1942443 - protein, 4 aa, Staphylococcus
GAMT

SEQ ID NO: 1942444 - protein, 5 aa, Staphylococcus
GAMTP

SEQ ID NO: 1942445 - protein, 10 aa, Staphylococcus
GANAAADNQI

SEQ ID NO: 1942446 - protein, 17 aa, Staphylococcus
GANAAKAIVTDEDKKQI

SEQ ID NO: 1942447 - protein, 16 aa, Staphylococcus
GANAAKDIITDDDKKH

SEQ ID NO: 1942448 - protein, 16 aa, Staphylococcus
GANAAKDIITDDDKNH

SEQ ID NO: 1942449 - protein, 17 aa, Staphylococcus
GANAAKDIITDEDKKKI

SEQ ID NO: 1942450 - protein, 15 aa, Staphylococcus
GANAAKDIITEDDKK

SEQ ID NO: 1942451 - protein, 17 aa, Staphylococcus
GANAAKDIITNEDKKNI

SEQ ID NO: 1942452 - protein, 10 aa, Staphylococcus
GANAKDDATV

SEQ ID NO: 1942453 - protein, 11 aa, Staphylococcus
GANAKDQEAVT

SEQ ID NO: 1942454 - protein, 11 aa, Staphylococcus
GANAKNEQAVE

SEQ ID NO: 1942455 - protein, 7 aa, Staphylococcus
GANDEIR

SEQ ID NO: 1942456 - protein, 9 aa, Staphylococcus
GANDGATAL

SEQ ID NO: 1942457 - protein, 16 aa, Staphylococcus
GANETKSYLASGTSRL

SEQ ID NO: 1942458 - protein, 16 aa, Staphylococcus
GANETRSYLASGTSRI

SEQ ID NO: 1942459 - protein, 27 aa, Staphylococcus
GANETRSYLASGTSRLKVEKGQHVERG

SEQ ID NO: 1942460 - protein, 9 aa, Staphylococcus
GANGAGKTT

SEQ ID NO: 1942461 - protein, 19 aa, Staphylococcus
GANGATEIYGPQKGADAKM

SEQ ID NO: 1942462 - protein, 6 aa, Staphylococcus
GANGPL

SEQ ID NO: 1942463 - protein, 10 aa, Staphylococcus
GANGSGKSTL

SEQ ID NO: 1942464 - protein, 9 aa, Staphylococcus
GANGSGKTT

SEQ ID NO: 1942465 - protein, 9 aa, Staphylococcus
GANGSTSSL

SEQ ID NO: 1942466 - protein, 16 aa, Staphylococcus
GANKARKELSSENLEE

SEQ ID NO: 1942467 - protein, 16 aa, Staphylococcus
GANNHALDQGTAGLEN

SEQ ID NO: 1942468 - protein, 14 aa, Staphylococcus
GANNHSLDQGDEGV

SEQ ID NO: 1942469 - protein, 15 aa, Staphylococcus
GANNHSLDQGDQGIT

SEQ ID NO: 1942470 - protein, 10 aa, Staphylococcus
GANPTGSFKD

SEQ ID NO: 1942471 - protein, 11 aa, Staphylococcus
GANQNGYSEQL

SEQ ID NO: 1942472 - protein, 7 aa, Staphylococcus
GANQSLI

SEQ ID NO: 1942473 - protein, 8 aa, Staphylococcus
GANSKITY

SEQ ID NO: 1942474 - protein, 9 aa, Staphylococcus
GANSKITYG

SEQ ID NO: 1942475 - protein, 9 aa, Staphylococcus
GANSNVTYG

SEQ ID NO: 1942476 - protein, 9 aa, Staphylococcus
GANSSITYG

SEQ ID NO: 1942477 - protein, 10 aa, Staphylococcus
GANTSATKAF

SEQ ID NO: 1942478 - protein, 7 aa, Staphylococcus
GAPAEPV

SEQ ID NO: 1942479 - protein, 10 aa, Staphylococcus
GAPDKQNEEA

SEQ ID NO: 1942480 - protein, 6 aa, Staphylococcus
GAPEGV

SEQ ID NO: 1942481 - protein, 7 aa, Staphylococcus
GAPGFED

SEQ ID NO: 1942482 - protein, 8 aa, Staphylococcus
GAPGFEDE

SEQ ID NO: 1942483 - protein, 7 aa, Staphylococcus
GAPGFEE

SEQ ID NO: 1942484 - protein, 8 aa, Staphylococcus
GAPGFEEE

SEQ ID NO: 1942485 - protein, 7 aa, Staphylococcus
GAPGFEN

SEQ ID NO: 1942486 - protein, 9 aa, Staphylococcus
GAPGTGKSY

SEQ ID NO: 1942487 - protein, 10 aa, Staphylococcus
GAPGTGKTTV

SEQ ID NO: 1942488 - protein, 4 aa, Staphylococcus
GAPL

SEQ ID NO: 1942489 - protein, 10 aa, Staphylococcus
GAPLGEDERK

SEQ ID NO: 1942490 - protein, 11 aa, Staphylococcus
GAPLSPNEIQD

SEQ ID NO: 1942491 - protein, 5 aa, Staphylococcus
GAPLT

SEQ ID NO: 1942492 - protein, 9 aa, Staphylococcus
GAPLTPDEI

SEQ ID NO: 1942493 - protein, 10 aa, Staphylococcus
GAPLTPDEIQ

SEQ ID NO: 1942494 - protein, 9 aa, Staphylococcus
GAPMSPTEI

SEQ ID NO: 1942495 - protein, 9 aa, Staphylococcus
GAPMTPDEI

SEQ ID NO: 1942496 - protein, 10 aa, Staphylococcus
GAPMTPDEIK

SEQ ID NO: 1942497 - protein, 22 aa, Staphylococcus
GAPNKEGSHGVHGAPLGEDERK

SEQ ID NO: 1942498 - protein, 22 aa, Staphylococcus
GAPNVSGTNGVHGAPLGSDERK

SEQ ID NO: 1942499 - protein, 22 aa, Staphylococcus
GAPNVSGTNGVHGAPLGTDERK

SEQ ID NO: 1942500 - protein, 23 aa, Staphylococcus
GAPPGYIGHDDGGQLTEKVRRKP

SEQ ID NO: 1942501 - protein, 23 aa, Staphylococcus
GAPPGYVGHDEGGQLTEKVRRKP

SEQ ID NO: 1942502 - protein, 8 aa, Staphylococcus
GAPQAINQ

SEQ ID NO: 1942503 - protein, 6 aa, Staphylococcus
GAPQTL

SEQ ID NO: 1942504 - protein, 5 aa, Staphylococcus
GAPRE

SEQ ID NO: 1942505 - protein, 9 aa, Staphylococcus
GAPRENGAP

SEQ ID NO: 1942506 - protein, 6 aa, Staphylococcus
GAPRNT

SEQ ID NO: 1942507 - protein, 5 aa, Staphylococcus
GAPSE

SEQ ID NO: 1942508 - protein, 7 aa, Staphylococcus
GAPSEVT

SEQ ID NO: 1942509 - protein, 10 aa, Staphylococcus
GAPSKENEEA

SEQ ID NO: 1942510 - protein, 11 aa, Staphylococcus
GAPTQAVEQAG

SEQ ID NO: 1942511 - protein, 11 aa, Staphylococcus
GAPTRAVEDAG

SEQ ID NO: 1942512 - protein, 10 aa, Staphylococcus
GAPTRAVEEA

SEQ ID NO: 1942513 - protein, 12 aa, Staphylococcus
GAPTRAVEKAGK

SEQ ID NO: 1942514 - protein, 10 aa, Staphylococcus
GAPTRAVEQA

SEQ ID NO: 1942515 - protein, 7 aa, Staphylococcus
GAPTVEY

SEQ ID NO: 1942516 - protein, 9 aa, Staphylococcus
GAPVERTNV

SEQ ID NO: 1942517 - protein, 8 aa, Staphylococcus
GAPVGQRV

SEQ ID NO: 1942518 - protein, 6 aa, Staphylococcus
GAQAEA

SEQ ID NO: 1942519 - protein, 8 aa, Staphylococcus
GAQAEADQ

SEQ ID NO: 1942520 - protein, 21 aa, Staphylococcus
GAQALPELTPDGDVAAPSPIS

SEQ ID NO: 1942521 - protein, 21 aa, Staphylococcus
GAQALPELTPNGDVVAPSPLS

SEQ ID NO: 1942522 - protein, 14 aa, Staphylococcus
GAQALPNLTPQGDV

SEQ ID NO: 1942523 - protein, 8 aa, Staphylococcus
GAQDEATQ

SEQ ID NO: 1942524 - protein, 9 aa, Staphylococcus
GAQDEATQM

SEQ ID NO: 1942525 - protein, 8 aa, Staphylococcus
GAQDPSID

SEQ ID NO: 1942526 - protein, 12 aa, Staphylococcus
GAQEEAKSYAKK

SEQ ID NO: 1942527 - protein, 8 aa, Staphylococcus
GAQGGTYA

SEQ ID NO: 1942528 - protein, 9 aa, Staphylococcus
GAQGQLDTA

SEQ ID NO: 1942529 - protein, 7 aa, Staphylococcus
GAQKVGM

SEQ ID NO: 1942530 - protein, 5 aa, Staphylococcus
GAQLE

SEQ ID NO: 1942531 - protein, 8 aa, Staphylococcus
GAQLPSEH

SEQ ID NO: 1942532 - protein, 8 aa, Staphylococcus
GAQRPGHF

SEQ ID NO: 1942533 - protein, 4 aa, Staphylococcus
GAQS

SEQ ID NO: 1942534 - protein, 21 aa, Staphylococcus
GAQSLPNLTPGGDVAAPSPVD

SEQ ID NO: 1942535 - protein, 13 aa, Staphylococcus
GAQTERSKRNFPV

SEQ ID NO: 1942536 - protein, 5 aa, Staphylococcus
GAQTT

SEQ ID NO: 1942537 - protein, 4 aa, Staphylococcus
GAQV

SEQ ID NO: 1942538 - protein, 5 aa, Staphylococcus
GAQYQ

SEQ ID NO: 1942539 - protein, 8 aa, Staphylococcus
GARDGKSV

SEQ ID NO: 1942540 - protein, 8 aa, Staphylococcus
GARDGKTV

SEQ ID NO: 1942541 - protein, 8 aa, Staphylococcus
GARNEFDY

SEQ ID NO: 1942542 - protein, 5 aa, Staphylococcus
GARPM

SEQ ID NO: 1942543 - protein, 5 aa, Staphylococcus
GARSA

SEQ ID NO: 1942544 - protein, 10 aa, Staphylococcus
GARSGDAQVT

SEQ ID NO: 1942545 - protein, 5 aa, Staphylococcus
GASAA

SEQ ID NO: 1942546 - protein, 10 aa, Staphylococcus
GASALGKRPI

SEQ ID NO: 1942547 - protein, 5 aa, Staphylococcus
GASAS

SEQ ID NO: 1942548 - protein, 11 aa, Staphylococcus
GASDPKGGCSG

SEQ ID NO: 1942549 - protein, 9 aa, Staphylococcus
GASDSVIPD

SEQ ID NO: 1942550 - protein, 8 aa, Staphylococcus
GASEAIDT

SEQ ID NO: 1942551 - protein, 9 aa, Staphylococcus
GASEEKRNE

SEQ ID NO: 1942552 - protein, 7 aa, Staphylococcus
GASEGVG

SEQ ID NO: 1942553 - protein, 10 aa, Staphylococcus
GASGDEKEMS

SEQ ID NO: 1942554 - protein, 8 aa, Staphylococcus
GASGFGKY

SEQ ID NO: 1942555 - protein, 6 aa, Staphylococcus
GASGGV

SEQ ID NO: 1942556 - protein, 8 aa, Staphylococcus
GASGIGQY

SEQ ID NO: 1942557 - protein, 8 aa, Staphylococcus
GASGPSFD

SEQ ID NO: 1942558 - protein, 9 aa, Staphylococcus
GASGTGIQE

SEQ ID NO: 1942559 - protein, 6 aa, Staphylococcus
GASGYV

SEQ ID NO: 1942560 - protein, 7 aa, Staphylococcus
GASHETA

SEQ ID NO: 1942561 - protein, 4 aa, Staphylococcus
GASI

SEQ ID NO: 1942562 - protein, 12 aa, Staphylococcus
GASIAKNNAKRV

SEQ ID NO: 1942563 - protein, 24 aa, Staphylococcus
GASIEADTSTGTATIKPSKLQGAE

SEQ ID NO: 1942564 - protein, 8 aa, Staphylococcus
GASKAGQL

SEQ ID NO: 1942565 - protein, 10 aa, Staphylococcus
GASKKDDTVL

SEQ ID NO: 1942566 - protein, 8 aa, Staphylococcus
GASNDTIT

SEQ ID NO: 1942567 - protein, 12 aa, Staphylococcus
GASNEKLKKHGG

SEQ ID NO: 1942568 - protein, 8 aa, Staphylococcus
GASNVEQD

SEQ ID NO: 1942569 - protein, 15 aa, Staphylococcus
GASPAMSEAPEEAEA

SEQ ID NO: 1942570 - protein, 15 aa, Staphylococcus
GASPAMSEAPEEAED

SEQ ID NO: 1942571 - protein, 12 aa, Staphylococcus
GASPASSVSDYS

SEQ ID NO: 1942572 - protein, 11 aa, Staphylococcus
GASPASSVTDY

SEQ ID NO: 1942573 - protein, 13 aa, Staphylococcus
GASPKGQAYAAKY

SEQ ID NO: 1942574 - protein, 10 aa, Staphylococcus
GASPLEDTKT

SEQ ID NO: 1942575 - protein, 8 aa, Staphylococcus
GASPNDIE

SEQ ID NO: 1942576 - protein, 10 aa, Staphylococcus
GASPNGREKK

SEQ ID NO: 1942577 - protein, 5 aa, Staphylococcus
GASQL

SEQ ID NO: 1942578 - protein, 17 aa, Staphylococcus
GASRQRDPNAPRKGDDL

SEQ ID NO: 1942579 - protein, 18 aa, Staphylococcus
GASSGIGAATAKALEKQG

SEQ ID NO: 1942580 - protein, 19 aa, Staphylococcus
GASSGIGEATTKRLAEEGA

SEQ ID NO: 1942581 - protein, 8 aa, Staphylococcus
GASSGIGK

SEQ ID NO: 1942582 - protein, 9 aa, Staphylococcus
GASSGIGKE

SEQ ID NO: 1942583 - protein, 14 aa, Staphylococcus
GASSGVIDLLKMNM

SEQ ID NO: 1942584 - protein, 14 aa, Staphylococcus
GASSGVIDMLKVNM

SEQ ID NO: 1942585 - protein, 21 aa, Staphylococcus
GASTKEVKAFETKNAIENGAA

SEQ ID NO: 1942586 - protein, 7 aa, Staphylococcus
GASTNGV

SEQ ID NO: 1942587 - protein, 9 aa, Staphylococcus
GASTNSSYV

SEQ ID NO: 1942588 - protein, 22 aa, Staphylococcus
GASTTATKTFETEDAIKNGASE

SEQ ID NO: 1942589 - protein, 9 aa, Staphylococcus
GASTTETKI

SEQ ID NO: 1942590 - protein, 9 aa, Staphylococcus
GASTVDKSP

SEQ ID NO: 1942591 - protein, 6 aa, Staphylococcus
GASTYR

SEQ ID NO: 1942592 - protein, 14 aa, Staphylococcus
GASVYSASDVARAE

SEQ ID NO: 1942593 - protein, 14 aa, Staphylococcus
GASVYSASEIARNE

SEQ ID NO: 1942594 - protein, 14 aa, Staphylococcus
GASVYSASEIARSE

SEQ ID NO: 1942595 - protein, 7 aa, Staphylococcus
GASYFDN

SEQ ID NO: 1942596 - protein, 21 aa, Staphylococcus
GATANDTEQNNNGITQKPDPL

SEQ ID NO: 1942597 - protein, 7 aa, Staphylococcus
GATASNI

SEQ ID NO: 1942598 - protein, 16 aa, Staphylococcus
GATATFNSSDDDIDEQ

SEQ ID NO: 1942599 - protein, 5 aa, Staphylococcus
GATDA

SEQ ID NO: 1942600 - protein, 14 aa, Staphylococcus
GATDAFKEATKGRI

SEQ ID NO: 1942601 - protein, 11 aa, Staphylococcus
GATDPKGGCSG

SEQ ID NO: 1942602 - protein, 4 aa, Staphylococcus
GATE

SEQ ID NO: 1942603 - protein, 10 aa, Staphylococcus
GATEANNTAI

SEQ ID NO: 1942604 - protein, 6 aa, Staphylococcus
GATEAS

SEQ ID NO: 1942605 - protein, 7 aa, Staphylococcus
GATESNN

SEQ ID NO: 1942606 - protein, 8 aa, Staphylococcus
GATESNNM

SEQ ID NO: 1942607 - protein, 10 aa, Staphylococcus
GATESNNTAI

SEQ ID NO: 1942608 - protein, 11 aa, Staphylococcus
GATESNNTAIK

SEQ ID NO: 1942609 - protein, 7 aa, Staphylococcus
GATGGVG

SEQ ID NO: 1942610 - protein, 7 aa, Staphylococcus
GATGKIT

SEQ ID NO: 1942611 - protein, 10 aa, Staphylococcus
GATGSGKSVA

SEQ ID NO: 1942612 - protein, 7 aa, Staphylococcus
GATHGTP

SEQ ID NO: 1942613 - protein, 14 aa, Staphylococcus
GATHNGTQGSDKLG

SEQ ID NO: 1942614 - protein, 6 aa, Staphylococcus
GATIED

SEQ ID NO: 1942615 - protein, 8 aa, Staphylococcus
GATIEDAQ

SEQ ID NO: 1942616 - protein, 17 aa, Staphylococcus
GATITTTTSIQGYDPNP

SEQ ID NO: 1942617 - protein, 5 aa, Staphylococcus
GATKD

SEQ ID NO: 1942618 - protein, 9 aa, Staphylococcus
GATKPVKQA

SEQ ID NO: 1942619 - protein, 4 aa, Staphylococcus
GATL

SEQ ID NO: 1942620 - protein, 28 aa, Staphylococcus
GATLKTTSLNEPKLSEKQGRNTQEKREI

SEQ ID NO: 1942621 - protein, 4 aa, Staphylococcus
GATM

SEQ ID NO: 1942622 - protein, 7 aa, Staphylococcus
GATPLQA

SEQ ID NO: 1942623 - protein, 6 aa, Staphylococcus
GATPLS

SEQ ID NO: 1942624 - protein, 6 aa, Staphylococcus
GATPVI

SEQ ID NO: 1942625 - protein, 8 aa, Staphylococcus
GATRFSPL

SEQ ID NO: 1942626 - protein, 11 aa, Staphylococcus
GATRGLQEKYG

SEQ ID NO: 1942627 - protein, 9 aa, Staphylococcus
GATRVGASA

SEQ ID NO: 1942628 - protein, 5 aa, Staphylococcus
GATSD

SEQ ID NO: 1942629 - protein, 12 aa, Staphylococcus
GATTNKDNQNLK

SEQ ID NO: 1942630 - protein, 6 aa, Staphylococcus
GATTTD

SEQ ID NO: 1942631 - protein, 17 aa, Staphylococcus
GATTTINVKDEDVNQRI

SEQ ID NO: 1942632 - protein, 11 aa, Staphylococcus
GATVSSTLTSL

SEQ ID NO: 1942633 - protein, 8 aa, Staphylococcus
GATVTSQG

SEQ ID NO: 1942634 - protein, 4 aa, Staphylococcus
GATW

SEQ ID NO: 1942635 - protein, 4 aa, Staphylococcus
GATY

SEQ ID NO: 1942636 - protein, 5 aa, Staphylococcus
GATYQ

SEQ ID NO: 1942637 - protein, 9 aa, Staphylococcus
GAVAKRARA

SEQ ID NO: 1942638 - protein, 8 aa, Staphylococcus
GAVDPNAI

SEQ ID NO: 1942639 - protein, 9 aa, Staphylococcus
GAVDPNAIR

SEQ ID NO: 1942640 - protein, 7 aa, Staphylococcus
GAVDSTT

SEQ ID NO: 1942641 - protein, 6 aa, Staphylococcus
GAVEKV

SEQ ID NO: 1942642 - protein, 7 aa, Staphylococcus
GAVKPEY

SEQ ID NO: 1942643 - protein, 8 aa, Staphylococcus
GAVKSRGV

SEQ ID NO: 1942644 - protein, 4 aa, Staphylococcus
GAVT

SEQ ID NO: 1942645 - protein, 10 aa, Staphylococcus
GAVTERTKAI

SEQ ID NO: 1942646 - protein, 6 aa, Staphylococcus
GAVTPN

SEQ ID NO: 1942647 - protein, 7 aa, Staphylococcus
GAVTYQN

SEQ ID NO: 1942648 - protein, 14 aa, Staphylococcus
GAWKKKDDITENVE

SEQ ID NO: 1942649 - protein, 4 aa, Staphylococcus
GAWS

SEQ ID NO: 1942650 - protein, 7 aa, Staphylococcus
GAYGGEV

SEQ ID NO: 1942651 - protein, 5 aa, Staphylococcus
GAYGN

SEQ ID NO: 1942652 - protein, 4 aa, Staphylococcus
GAYI

SEQ ID NO: 1942653 - protein, 5 aa, Staphylococcus
GAYNN

SEQ ID NO: 1942654 - protein, 7 aa, Staphylococcus
GAYNNTL

SEQ ID NO: 1942655 - protein, 15 aa, Staphylococcus
GAYNNTLGSTLAGEV

SEQ ID NO: 1942656 - protein, 19 aa, Staphylococcus
GCEQSSAGHTMSELDQKRN

SEQ ID NO: 1942657 - protein, 19 aa, Staphylococcus
GCESSSQGQTMAELDQKRN

SEQ ID NO: 1942658 - protein, 12 aa, Staphylococcus
GCGDDGQTEYAG

SEQ ID NO: 1942659 - protein, 15 aa, Staphylococcus
GCGDPLGKIKKGDTV

SEQ ID NO: 1942660 - protein, 5 aa, Staphylococcus
GCGEC

SEQ ID NO: 1942661 - protein, 12 aa, Staphylococcus
GCGNDGNTEYAG

SEQ ID NO: 1942662 - protein, 9 aa, Staphylococcus
GCGSSREHA

SEQ ID NO: 1942663 - protein, 9 aa, Staphylococcus
GCNEQQPDE

SEQ ID NO: 1942664 - protein, 13 aa, Staphylococcus
GCNKRKDTKAIQR

SEQ ID NO: 1942665 - protein, 8 aa, Staphylococcus
GCQESPHK

SEQ ID NO: 1942666 - protein, 8 aa, Staphylococcus
GCRRQSPH

SEQ ID NO: 1942667 - protein, 7 aa, Staphylococcus
GCTAQAP

SEQ ID NO: 1942668 - protein, 6 aa, Staphylococcus
GCVNET

SEQ ID NO: 1942669 - protein, 7 aa, Staphylococcus
GDAAPLD

SEQ ID NO: 1942670 - protein, 9 aa, Staphylococcus
GDAAQLDSE

SEQ ID NO: 1942671 - protein, 8 aa, Staphylococcus
GDADTTQS

SEQ ID NO: 1942672 - protein, 16 aa, Staphylococcus
GDAEDEISRITTDGDT

SEQ ID NO: 1942673 - protein, 5 aa, Staphylococcus
GDAEE

SEQ ID NO: 1942674 - protein, 18 aa, Staphylococcus
GDAGGKLHTGRSRNDQVA

SEQ ID NO: 1942675 - protein, 18 aa, Staphylococcus
GDAGGRLHTGRSRNDQVA

SEQ ID NO: 1942676 - protein, 9 aa, Staphylococcus
GDAGRIKKG

SEQ ID NO: 1942677 - protein, 8 aa, Staphylococcus
GDAGRIKQ

SEQ ID NO: 1942678 - protein, 9 aa, Staphylococcus
GDAGRIKQG

SEQ ID NO: 1942679 - protein, 9 aa, Staphylococcus
GDAHVSEGD

SEQ ID NO: 1942680 - protein, 5 aa, Staphylococcus
GDAIA

SEQ ID NO: 1942681 - protein, 9 aa, Staphylococcus
GDAKERFKE

SEQ ID NO: 1942682 - protein, 11 aa, Staphylococcus
GDAKNQQDLEQ

SEQ ID NO: 1942683 - protein, 8 aa, Staphylococcus
GDAKSVSI

SEQ ID NO: 1942684 - protein, 13 aa, Staphylococcus
GDALDGKIGTLIK

SEQ ID NO: 1942685 - protein, 15 aa, Staphylococcus
GDANDYVGKGLSGGT

SEQ ID NO: 1942686 - protein, 8 aa, Staphylococcus
GDANRHEQ

SEQ ID NO: 1942687 - protein, 8 aa, Staphylococcus
GDAQEGSD

SEQ ID NO: 1942688 - protein, 6 aa, Staphylococcus
GDAQQV

SEQ ID NO: 1942689 - protein, 8 aa, Staphylococcus
GDARRGPS

SEQ ID NO: 1942690 - protein, 8 aa, Staphylococcus
GDARRGQS

SEQ ID NO: 1942691 - protein, 5 aa, Staphylococcus
GDARS

SEQ ID NO: 1942692 - protein, 5 aa, Staphylococcus
GDASN

SEQ ID NO: 1942693 - protein, 4 aa, Staphylococcus
GDAT

SEQ ID NO: 1942694 - protein, 8 aa, Staphylococcus
GDDAESMK

SEQ ID NO: 1942695 - protein, 7 aa, Staphylococcus
GDDAYGK

SEQ ID NO: 1942696 - protein, 6 aa, Staphylococcus
GDDDFG

SEQ ID NO: 1942697 - protein, 8 aa, Staphylococcus
GDDEAASA

SEQ ID NO: 1942698 - protein, 9 aa, Staphylococcus
GDDEHGWNK

SEQ ID NO: 1942699 - protein, 9 aa, Staphylococcus
GDDENNAQA

SEQ ID NO: 1942700 - protein, 10 aa, Staphylococcus
GDDENNPQAQ

SEQ ID NO: 1942701 - protein, 8 aa, Staphylococcus
GDDESGND

SEQ ID NO: 1942702 - protein, 9 aa, Staphylococcus
GDDGNYPNN

SEQ ID NO: 1942703 - protein, 8 aa, Staphylococcus
GDDGQTMQ

SEQ ID NO: 1942704 - protein, 9 aa, Staphylococcus
GDDGQTMQQ

SEQ ID NO: 1942705 - protein, 5 aa, Staphylococcus
GDDIE

SEQ ID NO: 1942706 - protein, 15 aa, Staphylococcus
GDDIGNGKVGDVTRK

SEQ ID NO: 1942707 - protein, 14 aa, Staphylococcus
GDDIKEVDTELNEV

SEQ ID NO: 1942708 - protein, 8 aa, Staphylococcus
GDDKTCRR

SEQ ID NO: 1942709 - protein, 6 aa, Staphylococcus
GDDLYS

SEQ ID NO: 1942710 - protein, 9 aa, Staphylococcus
GDDPRTKQS

SEQ ID NO: 1942711 - protein, 7 aa, Staphylococcus
GDDQKQK

SEQ ID NO: 1942712 - protein, 8 aa, Staphylococcus
GDDQLGEE

SEQ ID NO: 1942713 - protein, 9 aa, Staphylococcus
GDDRPEYRK

SEQ ID NO: 1942714 - protein, 13 aa, Staphylococcus
GDDSTEENRQASA

SEQ ID NO: 1942715 - protein, 13 aa, Staphylococcus
GDDTNELNRQASA

SEQ ID NO: 1942716 - protein, 7 aa, Staphylococcus
GDDTPLG

SEQ ID NO: 1942717 - protein, 13 aa, Staphylococcus
GDDTSEPLRKQSA

SEQ ID NO: 1942718 - protein, 29 aa, Staphylococcus
GDDVNEGDSIATISSEKLTQDIEAPATGT

SEQ ID NO: 1942719 - protein, 4 aa, Staphylococcus
GDEA

SEQ ID NO: 1942720 - protein, 5 aa, Staphylococcus
GDEDR

SEQ ID NO: 1942721 - protein, 6 aa, Staphylococcus
GDEDSL

SEQ ID NO: 1942722 - protein, 11 aa, Staphylococcus
GDEEQQLEANT

SEQ ID NO: 1942723 - protein, 4 aa, Staphylococcus
GDEG

SEQ ID NO: 1942724 - protein, 5 aa, Staphylococcus
GDEGG

SEQ ID NO: 1942725 - protein, 10 aa, Staphylococcus
GDEGLSQSPQ

SEQ ID NO: 1942726 - protein, 6 aa, Staphylococcus
GDEGTA

SEQ ID NO: 1942727 - protein, 7 aa, Staphylococcus
GDEIEED

SEQ ID NO: 1942728 - protein, 18 aa, Staphylococcus
GDEISKQLDSRHDKEISG

SEQ ID NO: 1942729 - protein, 5 aa, Staphylococcus
GDEIV

SEQ ID NO: 1942730 - protein, 4 aa, Staphylococcus
GDEK

SEQ ID NO: 1942731 - protein, 5 aa, Staphylococcus
GDEKI

SEQ ID NO: 1942732 - protein, 20 aa, Staphylococcus
GDEKKLGKKVGSDVENHKST

SEQ ID NO: 1942733 - protein, 8 aa, Staphylococcus
GDEKNGTD

SEQ ID NO: 1942734 - protein, 10 aa, Staphylococcus
GDELEPNEKG

SEQ ID NO: 1942735 - protein, 9 aa, Staphylococcus
GDELPTAGG

SEQ ID NO: 1942736 - protein, 8 aa, Staphylococcus
GDELSPYA

SEQ ID NO: 1942737 - protein, 6 aa, Staphylococcus
GDELTP

SEQ ID NO: 1942738 - protein, 31 aa, Staphylococcus
GDENDDAAPLDSDNKDKQSTSQQDAPPREQD

SEQ ID NO: 1942739 - protein, 9 aa, Staphylococcus
GDENGTISN

SEQ ID NO: 1942740 - protein, 11 aa, Staphylococcus
GDENGTISNIK

SEQ ID NO: 1942741 - protein, 16 aa, Staphylococcus
GDENGTISNIKNDKLT

SEQ ID NO: 1942742 - protein, 15 aa, Staphylococcus
GDENGTISNIKTDKL

SEQ ID NO: 1942743 - protein, 16 aa, Staphylococcus
GDENGTISNIKTDKLN

SEQ ID NO: 1942744 - protein, 11 aa, Staphylococcus
GDENGTISNIQ

SEQ ID NO: 1942745 - protein, 15 aa, Staphylococcus
GDENGTISNIQNDKL

SEQ ID NO: 1942746 - protein, 38 aa, Staphylococcus
GDEQEVIGSSGHSSVNSTEKHDTTQTEEENATTDAPHN

SEQ ID NO: 1942747 - protein, 9 aa, Staphylococcus
GDEQSIEQS

SEQ ID NO: 1942748 - protein, 8 aa, Staphylococcus
GDERAEEN

SEQ ID NO: 1942749 - protein, 7 aa, Staphylococcus
GDESFPI

SEQ ID NO: 1942750 - protein, 20 aa, Staphylococcus
GDESKLGKKVGSDIENHKST

SEQ ID NO: 1942751 - protein, 5 aa, Staphylococcus
GDESY

SEQ ID NO: 1942752 - protein, 10 aa, Staphylococcus
GDEVDSDWNQ

SEQ ID NO: 1942753 - protein, 9 aa, Staphylococcus
GDEVKTNQP

SEQ ID NO: 1942754 - protein, 6 aa, Staphylococcus
GDEVSV

SEQ ID NO: 1942755 - protein, 21 aa, Staphylococcus
GDEYGQDDPSEEMYPGGENER

SEQ ID NO: 1942756 - protein, 21 aa, Staphylococcus
GDEYGQNDPAEEMYPGGENER

SEQ ID NO: 1942757 - protein, 4 aa, Staphylococcus
GDFD

SEQ ID NO: 1942758 - protein, 10 aa, Staphylococcus
GDFETTAQGY

SEQ ID NO: 1942759 - protein, 12 aa, Staphylococcus
GDFETTENGYKC

SEQ ID NO: 1942760 - protein, 5 aa, Staphylococcus
GDFGE

SEQ ID NO: 1942761 - protein, 5 aa, Staphylococcus
GDFHP

SEQ ID NO: 1942762 - protein, 5 aa, Staphylococcus
GDFND

SEQ ID NO: 1942763 - protein, 6 aa, Staphylococcus
GDFNNP

SEQ ID NO: 1942764 - protein, 14 aa, Staphylococcus
GDFSEDAEDAGVQK

SEQ ID NO: 1942765 - protein, 10 aa, Staphylococcus
GDFSEDAEDV

SEQ ID NO: 1942766 - protein, 11 aa, Staphylococcus
GDFTKDSEDYG

SEQ ID NO: 1942767 - protein, 8 aa, Staphylococcus
GDFTPDSA

SEQ ID NO: 1942768 - protein, 13 aa, Staphylococcus
GDGAKPGTSKKTC

SEQ ID NO: 1942769 - protein, 7 aa, Staphylococcus
GDGDDKL

SEQ ID NO: 1942770 - protein, 13 aa, Staphylococcus
GDGDLKGSSVGHK

SEQ ID NO: 1942771 - protein, 14 aa, Staphylococcus
GDGDLKGSSVGSKN

SEQ ID NO: 1942772 - protein, 15 aa, Staphylococcus
GDGEGVGNPLSENPK

SEQ ID NO: 1942773 - protein, 8 aa, Staphylococcus
GDGEQTRD

SEQ ID NO: 1942774 - protein, 9 aa, Staphylococcus
GDGERDEPI

SEQ ID NO: 1942775 - protein, 9 aa, Staphylococcus
GDGERDKPV

SEQ ID NO: 1942776 - protein, 6 aa, Staphylococcus
GDGGTT

SEQ ID NO: 1942777 - protein, 9 aa, Staphylococcus
GDGHRDQPV

SEQ ID NO: 1942778 - protein, 6 aa, Staphylococcus
GDGKDN

SEQ ID NO: 1942779 - protein, 14 aa, Staphylococcus
GDGKDSEDEAEIRI

SEQ ID NO: 1942780 - protein, 48 aa, Staphylococcus
GDGKEISRQNIYNGEKGQDGKDGKDGVDGKSITAITERGTKDGKSGSY

SEQ ID NO: 1942781 - protein, 9 aa, Staphylococcus
GDGKERNNL

SEQ ID NO: 1942782 - protein, 7 aa, Staphylococcus
GDGKGNY

SEQ ID NO: 1942783 - protein, 5 aa, Staphylococcus
GDGKN

SEQ ID NO: 1942784 - protein, 6 aa, Staphylococcus
GDGKNN

SEQ ID NO: 1942785 - protein, 15 aa, Staphylococcus
GDGNKYDEQTTPRGY

SEQ ID NO: 1942786 - protein, 5 aa, Staphylococcus
GDGNL

SEQ ID NO: 1942787 - protein, 12 aa, Staphylococcus
GDGPAPYSTNPK

SEQ ID NO: 1942788 - protein, 7 aa, Staphylococcus
GDGPDEL

SEQ ID NO: 1942789 - protein, 8 aa, Staphylococcus
GDGQEKEH

SEQ ID NO: 1942790 - protein, 8 aa, Staphylococcus
GDGQERGH

SEQ ID NO: 1942791 - protein, 9 aa, Staphylococcus
GDGQLTVDD

SEQ ID NO: 1942792 - protein, 10 aa, Staphylococcus
GDGQQRNDLE

SEQ ID NO: 1942793 - protein, 9 aa, Staphylococcus
GDGQREQPV

SEQ ID NO: 1942794 - protein, 9 aa, Staphylococcus
GDGQRSEPV

SEQ ID NO: 1942795 - protein, 8 aa, Staphylococcus
GDGQSAQI

SEQ ID NO: 1942796 - protein, 7 aa, Staphylococcus
GDGRNNM

SEQ ID NO: 1942797 - protein, 8 aa, Staphylococcus
GDGRNNVA

SEQ ID NO: 1942798 - protein, 9 aa, Staphylococcus
GDGRRQDPV

SEQ ID NO: 1942799 - protein, 8 aa, Staphylococcus
GDGSERAD

SEQ ID NO: 1942800 - protein, 13 aa, Staphylococcus
GDGSRTTENRGNI

SEQ ID NO: 1942801 - protein, 19 aa, Staphylococcus
GDGSYRGAQRISEETKDIK

SEQ ID NO: 1942802 - protein, 19 aa, Staphylococcus
GDGSYRGAQRISEETTDIK

SEQ ID NO: 1942803 - protein, 8 aa, Staphylococcus
GDHAEHKA

SEQ ID NO: 1942804 - protein, 6 aa, Staphylococcus
GDHAGG

SEQ ID NO: 1942805 - protein, 4 aa, Staphylococcus
GDHE

SEQ ID NO: 1942806 - protein, 4 aa, Staphylococcus
GDHP

SEQ ID NO: 1942807 - protein, 6 aa, Staphylococcus
GDHSFV

SEQ ID NO: 1942808 - protein, 7 aa, Staphylococcus
GDHSGYA

SEQ ID NO: 1942809 - protein, 10 aa, Staphylococcus
GDHSHNKDNY

SEQ ID NO: 1942810 - protein, 8 aa, Staphylococcus
GDHTERAS

SEQ ID NO: 1942811 - protein, 7 aa, Staphylococcus
GDHVDEY

SEQ ID NO: 1942812 - protein, 8 aa, Staphylococcus
GDIAEVDK

SEQ ID NO: 1942813 - protein, 7 aa, Staphylococcus
GDIEDQT

SEQ ID NO: 1942814 - protein, 4 aa, Staphylococcus
GDIG

SEQ ID NO: 1942815 - protein, 6 aa, Staphylococcus
GDIGYK

SEQ ID NO: 1942816 - protein, 6 aa, Staphylococcus
GDIKTY

SEQ ID NO: 1942817 - protein, 4 aa, Staphylococcus
GDIP

SEQ ID NO: 1942818 - protein, 8 aa, Staphylococcus
GDIPAEDV

SEQ ID NO: 1942819 - protein, 11 aa, Staphylococcus
GDIPDRKTGHE

SEQ ID NO: 1942820 - protein, 11 aa, Staphylococcus
GDIPDRKTGLE

SEQ ID NO: 1942821 - protein, 11 aa, Staphylococcus
GDIPDRKTGME

SEQ ID NO: 1942822 - protein, 11 aa, Staphylococcus
GDIPDRQKGME

SEQ ID NO: 1942823 - protein, 5 aa, Staphylococcus
GDIPS

SEQ ID NO: 1942824 - protein, 4 aa, Staphylococcus
GDIQ

SEQ ID NO: 1942825 - protein, 6 aa, Staphylococcus
GDIQGE

SEQ ID NO: 1942826 - protein, 4 aa, Staphylococcus
GDIS

SEQ ID NO: 1942827 - protein, 6 aa, Staphylococcus
GDITEL

SEQ ID NO: 1942828 - protein, 19 aa, Staphylococcus
GDKAAEAEAAGADFVGEGE

SEQ ID NO: 1942829 - protein, 24 aa, Staphylococcus
GDKASEAEAAGADYVGESEYATKI

SEQ ID NO: 1942830 - protein, 10 aa, Staphylococcus
GDKDDSPLTH

SEQ ID NO: 1942831 - protein, 4 aa, Staphylococcus
GDKE

SEQ ID NO: 1942832 - protein, 12 aa, Staphylococcus
GDKEIKDALQKY

SEQ ID NO: 1942833 - protein, 6 aa, Staphylococcus
GDKELE

SEQ ID NO: 1942834 - protein, 8 aa, Staphylococcus
GDKEQLKN

SEQ ID NO: 1942835 - protein, 18 aa, Staphylococcus
GDKGTQYPNELSGGQKQR

SEQ ID NO: 1942836 - protein, 8 aa, Staphylococcus
GDKIEKGD

SEQ ID NO: 1942837 - protein, 15 aa, Staphylococcus
GDKIKETNDIADHEE

SEQ ID NO: 1942838 - protein, 14 aa, Staphylococcus
GDKIRKAQPNDEPI

SEQ ID NO: 1942839 - protein, 9 aa, Staphylococcus
GDKKEDGQA

SEQ ID NO: 1942840 - protein, 5 aa, Staphylococcus
GDKKG

SEQ ID NO: 1942841 - protein, 11 aa, Staphylococcus
GDKLSRTKGFD

SEQ ID NO: 1942842 - protein, 10 aa, Staphylococcus
GDKLSRTQGF

SEQ ID NO: 1942843 - protein, 4 aa, Staphylococcus
GDKP

SEQ ID NO: 1942844 - protein, 7 aa, Staphylococcus
GDKPGMV

SEQ ID NO: 1942845 - protein, 8 aa, Staphylococcus
GDKQYKNP

SEQ ID NO: 1942846 - protein, 5 aa, Staphylococcus
GDKRT

SEQ ID NO: 1942847 - protein, 6 aa, Staphylococcus
GDKTAQ

SEQ ID NO: 1942848 - protein, 7 aa, Staphylococcus
GDKTAVD

SEQ ID NO: 1942849 - protein, 10 aa, Staphylococcus
GDKTDDGKAL

SEQ ID NO: 1942850 - protein, 11 aa, Staphylococcus
GDKTDGALETR

SEQ ID NO: 1942851 - protein, 10 aa, Staphylococcus
GDKTKEGKDF

SEQ ID NO: 1942852 - protein, 9 aa, Staphylococcus
GDKVEEGES

SEQ ID NO: 1942853 - protein, 7 aa, Staphylococcus
GDKVKAN

SEQ ID NO: 1942854 - protein, 24 aa, Staphylococcus
GDKYPNEISGGQQQRTAAARASVH

SEQ ID NO: 1942855 - protein, 19 aa, Staphylococcus
GDKYPSELSGGQRQRTSAA

SEQ ID NO: 1942856 - protein, 6 aa, Staphylococcus
GDLEKR

SEQ ID NO: 1942857 - protein, 12 aa, Staphylococcus
GDLEKRESLNQN

SEQ ID NO: 1942858 - protein, 6 aa, Staphylococcus
GDLKPP

SEQ ID NO: 1942859 - protein, 4 aa, Staphylococcus
GDLP

SEQ ID NO: 1942860 - protein, 8 aa, Staphylococcus
GDLRREQN

SEQ ID NO: 1942861 - protein, 8 aa, Staphylococcus
GDLSGGEK

SEQ ID NO: 1942862 - protein, 11 aa, Staphylococcus
GDLSGGERTKV

SEQ ID NO: 1942863 - protein, 7 aa, Staphylococcus
GDLSKGT

SEQ ID NO: 1942864 - protein, 4 aa, Staphylococcus
GDLT

SEQ ID NO: 1942865 - protein, 4 aa, Staphylococcus
GDME

SEQ ID NO: 1942866 - protein, 6 aa, Staphylococcus
GDMKPP

SEQ ID NO: 1942867 - protein, 5 aa, Staphylococcus
GDMNS

SEQ ID NO: 1942868 - protein, 5 aa, Staphylococcus
GDMQM

SEQ ID NO: 1942869 - protein, 4 aa, Staphylococcus
GDMR

SEQ ID NO: 1942870 - protein, 20 aa, Staphylococcus
GDMRQGYEYSRSANPTRSAL

SEQ ID NO: 1942871 - protein, 9 aa, Staphylococcus
GDNAERKRG

SEQ ID NO: 1942872 - protein, 7 aa, Staphylococcus
GDNAETL

SEQ ID NO: 1942873 - protein, 8 aa, Staphylococcus
GDNATEPI

SEQ ID NO: 1942874 - protein, 6 aa, Staphylococcus
GDNDPV

SEQ ID NO: 1942875 - protein, 4 aa, Staphylococcus
GDNE

SEQ ID NO: 1942876 - protein, 7 aa, Staphylococcus
GDNETYH

SEQ ID NO: 1942877 - protein, 6 aa, Staphylococcus
GDNEVE

SEQ ID NO: 1942878 - protein, 12 aa, Staphylococcus
GDNFGKQIVKVS

SEQ ID NO: 1942879 - protein, 8 aa, Staphylococcus
GDNGIGKS

SEQ ID NO: 1942880 - protein, 17 aa, Staphylococcus
GDNGPGHQAAKEATEKA

SEQ ID NO: 1942881 - protein, 9 aa, Staphylococcus
GDNGTGKTT

SEQ ID NO: 1942882 - protein, 18 aa, Staphylococcus
GDNKARKVSSVSSGSVTL

SEQ ID NO: 1942883 - protein, 18 aa, Staphylococcus
GDNKARRVSSISSGSVTL

SEQ ID NO: 1942884 - protein, 18 aa, Staphylococcus
GDNKGRKVSSTSSGSVTV

SEQ ID NO: 1942885 - protein, 18 aa, Staphylococcus
GDNKGRRVSSTSSGSVTL

SEQ ID NO: 1942886 - protein, 17 aa, Staphylococcus
GDNKGRRVSSVSTGSVT

SEQ ID NO: 1942887 - protein, 7 aa, Staphylococcus
GDNLKSR

SEQ ID NO: 1942888 - protein, 6 aa, Staphylococcus
GDNNKQ

SEQ ID NO: 1942889 - protein, 6 aa, Staphylococcus
GDNNQA

SEQ ID NO: 1942890 - protein, 21 aa, Staphylococcus
GDNPAFRPKLRSDSNLSEQEQ

SEQ ID NO: 1942891 - protein, 6 aa, Staphylococcus
GDNPDR

SEQ ID NO: 1942892 - protein, 6 aa, Staphylococcus
GDNPER

SEQ ID NO: 1942893 - protein, 6 aa, Staphylococcus
GDNPQR

SEQ ID NO: 1942894 - protein, 7 aa, Staphylococcus
GDNPQRL

SEQ ID NO: 1942895 - protein, 14 aa, Staphylococcus
GDNPWQQSHEDTSY

SEQ ID NO: 1942896 - protein, 8 aa, Staphylococcus
GDNQEQQR

SEQ ID NO: 1942897 - protein, 7 aa, Staphylococcus
GDNRGER

SEQ ID NO: 1942898 - protein, 7 aa, Staphylococcus
GDNSQHM

SEQ ID NO: 1942899 - protein, 8 aa, Staphylococcus
GDNSQRMH

SEQ ID NO: 1942900 - protein, 4 aa, Staphylococcus
GDNV

SEQ ID NO: 1942901 - protein, 8 aa, Staphylococcus
GDNVEKGE

SEQ ID NO: 1942902 - protein, 16 aa, Staphylococcus
GDNVTDPENWSSREGL

SEQ ID NO: 1942903 - protein, 4 aa, Staphylococcus
GDNY

SEQ ID NO: 1942904 - protein, 14 aa, Staphylococcus
GDNYIEGKELNASE

SEQ ID NO: 1942905 - protein, 4 aa, Staphylococcus
GDPE

SEQ ID NO: 1942906 - protein, 5 aa, Staphylococcus
GDPFA

SEQ ID NO: 1942907 - protein, 20 aa, Staphylococcus
GDPFAEDTKMGAQTGPEQIE

SEQ ID NO: 1942908 - protein, 11 aa, Staphylococcus
GDPFDESTDYG

SEQ ID NO: 1942909 - protein, 6 aa, Staphylococcus
GDPFDK

SEQ ID NO: 1942910 - protein, 5 aa, Staphylococcus
GDPIK

SEQ ID NO: 1942911 - protein, 7 aa, Staphylococcus
GDPKRFK

SEQ ID NO: 1942912 - protein, 15 aa, Staphylococcus
GDPKYGPKKTLDIGG

SEQ ID NO: 1942913 - protein, 16 aa, Staphylococcus
GDPKYGPKKTLDIGGQ

SEQ ID NO: 1942914 - protein, 14 aa, Staphylococcus
GDPKYGPKKTMDIG

SEQ ID NO: 1942915 - protein, 13 aa, Staphylococcus
GDPKYGPKRTLDI

SEQ ID NO: 1942916 - protein, 11 aa, Staphylococcus
GDPLDENSDYG

SEQ ID NO: 1942917 - protein, 5 aa, Staphylococcus
GDPMT

SEQ ID NO: 1942918 - protein, 4 aa, Staphylococcus
GDPN

SEQ ID NO: 1942919 - protein, 13 aa, Staphylococcus
GDPNTEHSIDTAE

SEQ ID NO: 1942920 - protein, 6 aa, Staphylococcus
GDPQEN

SEQ ID NO: 1942921 - protein, 6 aa, Staphylococcus
GDPQVK

SEQ ID NO: 1942922 - protein, 13 aa, Staphylococcus
GDPRNEDTEVGPI

SEQ ID NO: 1942923 - protein, 10 aa, Staphylococcus
GDPRSTWGNL

SEQ ID NO: 1942924 - protein, 18 aa, Staphylococcus
GDPRSTWGNLEDNPVQDM

SEQ ID NO: 1942925 - protein, 8 aa, Staphylococcus
GDPSQTIT

SEQ ID NO: 1942926 - protein, 19 aa, Staphylococcus
GDPTDENVQMGSQTGEAQM

SEQ ID NO: 1942927 - protein, 6 aa, Staphylococcus
GDPVTK

SEQ ID NO: 1942928 - protein, 11 aa, Staphylococcus
GDPYDENTDYG

SEQ ID NO: 1942929 - protein, 6 aa, Staphylococcus
GDQAEG

SEQ ID NO: 1942930 - protein, 7 aa, Staphylococcus
GDQARKK

SEQ ID NO: 1942931 - protein, 6 aa, Staphylococcus
GDQGLK

SEQ ID NO: 1942932 - protein, 8 aa, Staphylococcus
GDQKKREM

SEQ ID NO: 1942933 - protein, 5 aa, Staphylococcus
GDQKL

SEQ ID NO: 1942934 - protein, 16 aa, Staphylococcus
GDQKLTVTVDGKGPIG

SEQ ID NO: 1942935 - protein, 6 aa, Staphylococcus
GDQLKE

SEQ ID NO: 1942936 - protein, 11 aa, Staphylococcus
GDQLKYKSDAI

SEQ ID NO: 1942937 - protein, 5 aa, Staphylococcus
GDQNH

SEQ ID NO: 1942938 - protein, 7 aa, Staphylococcus
GDQTPLG

SEQ ID NO: 1942939 - protein, 8 aa, Staphylococcus
GDQVTRKE

SEQ ID NO: 1942940 - protein, 4 aa, Staphylococcus
GDQY

SEQ ID NO: 1942941 - protein, 7 aa, Staphylococcus
GDRARKQ

SEQ ID NO: 1942942 - protein, 9 aa, Staphylococcus
GDRDPSRNP

SEQ ID NO: 1942943 - protein, 6 aa, Staphylococcus
GDREFA

SEQ ID NO: 1942944 - protein, 9 aa, Staphylococcus
GDRENPDLD

SEQ ID NO: 1942945 - protein, 11 aa, Staphylococcus
GDRFNTKPRGL

SEQ ID NO: 1942946 - protein, 12 aa, Staphylococcus
GDRGKNYPTKND

SEQ ID NO: 1942947 - protein, 9 aa, Staphylococcus
GDRGPDIET

SEQ ID NO: 1942948 - protein, 4 aa, Staphylococcus
GDRK

SEQ ID NO: 1942949 - protein, 8 aa, Staphylococcus
GDRLQNSE

SEQ ID NO: 1942950 - protein, 13 aa, Staphylococcus
GDRMGQGKENVKN

SEQ ID NO: 1942951 - protein, 18 aa, Staphylococcus
GDRNYISTKNKRNNPERV

SEQ ID NO: 1942952 - protein, 6 aa, Staphylococcus
GDRPIQ

SEQ ID NO: 1942953 - protein, 19 aa, Staphylococcus
GDRPSDVAREAQKVADKGF

SEQ ID NO: 1942954 - protein, 4 aa, Staphylococcus
GDRS

SEQ ID NO: 1942955 - protein, 10 aa, Staphylococcus
GDRSKGNNEL

SEQ ID NO: 1942956 - protein, 11 aa, Staphylococcus
GDRSRHTENRG

SEQ ID NO: 1942957 - protein, 7 aa, Staphylococcus
GDRSSSD

SEQ ID NO: 1942958 - protein, 12 aa, Staphylococcus
GDRYGWTEGSGK

SEQ ID NO: 1942959 - protein, 25 aa, Staphylococcus
GDSAGAQLSSQYTAIQTDKSLRDSM

SEQ ID NO: 1942960 - protein, 18 aa, Staphylococcus
GDSAGGSTKEGRDSKTQA

SEQ ID NO: 1942961 - protein, 17 aa, Staphylococcus
GDSAGGSTKLGRDSRTQ

SEQ ID NO: 1942962 - protein, 9 aa, Staphylococcus
GDSAGSLSE

SEQ ID NO: 1942963 - protein, 13 aa, Staphylococcus
GDSAITEEGEMDR

SEQ ID NO: 1942964 - protein, 8 aa, Staphylococcus
GDSAQASE

SEQ ID NO: 1942965 - protein, 9 aa, Staphylococcus
GDSAYKDED

SEQ ID NO: 1942966 - protein, 10 aa, Staphylococcus
GDSAYKDEDG

SEQ ID NO: 1942967 - protein, 9 aa, Staphylococcus
GDSAYQDED

SEQ ID NO: 1942968 - protein, 7 aa, Staphylococcus
GDSDNDR

SEQ ID NO: 1942969 - protein, 8 aa, Staphylococcus
GDSDNDRS

SEQ ID NO: 1942970 - protein, 8 aa, Staphylococcus
GDSEDYQD

SEQ ID NO: 1942971 - protein, 17 aa, Staphylococcus
GDSEELRYGENPQQSAR

SEQ ID NO: 1942972 - protein, 10 aa, Staphylococcus
GDSEEQPEAE

SEQ ID NO: 1942973 - protein, 8 aa, Staphylococcus
GDSEQAAQ

SEQ ID NO: 1942974 - protein, 8 aa, Staphylococcus
GDSEQASH

SEQ ID NO: 1942975 - protein, 8 aa, Staphylococcus
GDSEQASQ

SEQ ID NO: 1942976 - protein, 16 aa, Staphylococcus
GDSEQLRYGENPQQSA

SEQ ID NO: 1942977 - protein, 5 aa, Staphylococcus
GDSGK

SEQ ID NO: 1942978 - protein, 9 aa, Staphylococcus
GDSGNDETY

SEQ ID NO: 1942979 - protein, 4 aa, Staphylococcus
GDSI

SEQ ID NO: 1942980 - protein, 5 aa, Staphylococcus
GDSIK

SEQ ID NO: 1942981 - protein, 4 aa, Staphylococcus
GDSN

SEQ ID NO: 1942982 - protein, 10 aa, Staphylococcus
GDSPNDIQTA

SEQ ID NO: 1942983 - protein, 7 aa, Staphylococcus
GDSSNDI

SEQ ID NO: 1942984 - protein, 9 aa, Staphylococcus
GDSTSASEY

SEQ ID NO: 1942985 - protein, 4 aa, Staphylococcus
GDSV

SEQ ID NO: 1942986 - protein, 9 aa, Staphylococcus
GDSVDKGEA

SEQ ID NO: 1942987 - protein, 7 aa, Staphylococcus
GDSVKQV

SEQ ID NO: 1942988 - protein, 9 aa, Staphylococcus
GDSVTNYQK

SEQ ID NO: 1942989 - protein, 4 aa, Staphylococcus
GDTA

SEQ ID NO: 1942990 - protein, 9 aa, Staphylococcus
GDTADIEAM

SEQ ID NO: 1942991 - protein, 10 aa, Staphylococcus
GDTAKAESVG

SEQ ID NO: 1942992 - protein, 16 aa, Staphylococcus
GDTANAEVVGKHGEKV

SEQ ID NO: 1942993 - protein, 14 aa, Staphylococcus
GDTANDMQTGVNAQ

SEQ ID NO: 1942994 - protein, 7 aa, Staphylococcus
GDTANHE

SEQ ID NO: 1942995 - protein, 9 aa, Staphylococcus
GDTDDGSRF

SEQ ID NO: 1942996 - protein, 8 aa, Staphylococcus
GDTDDGTR

SEQ ID NO: 1942997 - protein, 19 aa, Staphylococcus
GDTDIDSAVKKEMGNQAGQ

SEQ ID NO: 1942998 - protein, 10 aa, Staphylococcus
GDTESRKQDV

SEQ ID NO: 1942999 - protein, 5 aa, Staphylococcus
GDTEV

SEQ ID NO: 1943000 - protein, 6 aa, Staphylococcus
GDTEVN

SEQ ID NO: 1943001 - protein, 9 aa, Staphylococcus
GDTFKYDND

SEQ ID NO: 1943002 - protein, 14 aa, Staphylococcus
GDTFKYDNDIENSI

SEQ ID NO: 1943003 - protein, 9 aa, Staphylococcus
GDTGRIKKG

SEQ ID NO: 1943004 - protein, 4 aa, Staphylococcus
GDTI

SEQ ID NO: 1943005 - protein, 13 aa, Staphylococcus
GDTNNDMKTKVNA

SEQ ID NO: 1943006 - protein, 4 aa, Staphylococcus
GDTP

SEQ ID NO: 1943007 - protein, 14 aa, Staphylococcus
GDTPEVPENTTLGH

SEQ ID NO: 1943008 - protein, 14 aa, Staphylococcus
GDTPEVPKNTTLGH

SEQ ID NO: 1943009 - protein, 9 aa, Staphylococcus
GDTPEVPQY

SEQ ID NO: 1943010 - protein, 14 aa, Staphylococcus
GDTPEVPSNTTLGH

SEQ ID NO: 1943011 - protein, 14 aa, Staphylococcus
GDTPEVTENTTLGH

SEQ ID NO: 1943012 - protein, 7 aa, Staphylococcus
GDTPIGR

SEQ ID NO: 1943013 - protein, 15 aa, Staphylococcus
GDTPPNHVSESEWKS

SEQ ID NO: 1943014 - protein, 8 aa, Staphylococcus
GDTPQEAL

SEQ ID NO: 1943015 - protein, 7 aa, Staphylococcus
GDTSDES

SEQ ID NO: 1943016 - protein, 11 aa, Staphylococcus
GDTSDNIPGIA

SEQ ID NO: 1943017 - protein, 17 aa, Staphylococcus
GDTSDNIPGVAGVGEKT

SEQ ID NO: 1943018 - protein, 18 aa, Staphylococcus
GDTSDNIPGVAGVGEKTA

SEQ ID NO: 1943019 - protein, 10 aa, Staphylococcus
GDTSIGKRPM

SEQ ID NO: 1943020 - protein, 6 aa, Staphylococcus
GDTSPY

SEQ ID NO: 1943021 - protein, 8 aa, Staphylococcus
GDTTLEDI

SEQ ID NO: 1943022 - protein, 18 aa, Staphylococcus
GDTTQSELAKSLGKSQSF

SEQ ID NO: 1943023 - protein, 18 aa, Staphylococcus
GDTTQSELAKSVGKSQSF

SEQ ID NO: 1943024 - protein, 18 aa, Staphylococcus
GDTTQSELAQSVGKSQSF

SEQ ID NO: 1943025 - protein, 11 aa, Staphylococcus
GDTTSQEDIDT

SEQ ID NO: 1943026 - protein, 4 aa, Staphylococcus
GDTV

SEQ ID NO: 1943027 - protein, 12 aa, Staphylococcus
GDTVEGDTPDEL

SEQ ID NO: 1943028 - protein, 7 aa, Staphylococcus
GDTVQVG

SEQ ID NO: 1943029 - protein, 9 aa, Staphylococcus
GDTYRYDND

SEQ ID NO: 1943030 - protein, 4 aa, Staphylococcus
GDVA

SEQ ID NO: 1943031 - protein, 11 aa, Staphylococcus
GDVDDIRESPA

SEQ ID NO: 1943032 - protein, 11 aa, Staphylococcus
GDVEEVTNETA

SEQ ID NO: 1943033 - protein, 7 aa, Staphylococcus
GDVEKTT

SEQ ID NO: 1943034 - protein, 6 aa, Staphylococcus
GDVKAS

SEQ ID NO: 1943035 - protein, 6 aa, Staphylococcus
GDVKGG

SEQ ID NO: 1943036 - protein, 29 aa, Staphylococcus
GDVQKEAYTGAGEHVNSGDLDGLNNEQAI

SEQ ID NO: 1943037 - protein, 5 aa, Staphylococcus
GDVQR

SEQ ID NO: 1943038 - protein, 7 aa, Staphylococcus
GDVREKG

SEQ ID NO: 1943039 - protein, 6 aa, Staphylococcus
GDVSSP

SEQ ID NO: 1943040 - protein, 6 aa, Staphylococcus
GDVTEL

SEQ ID NO: 1943041 - protein, 8 aa, Staphylococcus
GDVTSPEL

SEQ ID NO: 1943042 - protein, 15 aa, Staphylococcus
GDVTVDNSLNQRYEG

SEQ ID NO: 1943043 - protein, 8 aa, Staphylococcus
GDVVEQGE

SEQ ID NO: 1943044 - protein, 9 aa, Staphylococcus
GDVVKEGES

SEQ ID NO: 1943045 - protein, 7 aa, Staphylococcus
GDYHNKK

SEQ ID NO: 1943046 - protein, 13 aa, Staphylococcus
GDYIAPSSSTFKQ

SEQ ID NO: 1943047 - protein, 15 aa, Staphylococcus
GDYKGGRQKTPPELS

SEQ ID NO: 1943048 - protein, 4 aa, Staphylococcus
GDYL

SEQ ID NO: 1943049 - protein, 7 aa, Staphylococcus
GDYNPFG

SEQ ID NO: 1943050 - protein, 9 aa, Staphylococcus
GDYPGDITP

SEQ ID NO: 1943051 - protein, 12 aa, Staphylococcus
GDYPGDITPSGY

SEQ ID NO: 1943052 - protein, 31 aa, Staphylococcus
GDYRDESSEEELDESEDGEIESVEEEKDVTK

SEQ ID NO: 1943053 - protein, 11 aa, Staphylococcus
GDYSKKAQEDV

SEQ ID NO: 1943054 - protein, 12 aa, Staphylococcus
GDYSKKAQEDVL

SEQ ID NO: 1943055 - protein, 6 aa, Staphylococcus
GDYSQS

SEQ ID NO: 1943056 - protein, 7 aa, Staphylococcus
GDYTKRP

SEQ ID NO: 1943057 - protein, 9 aa, Staphylococcus
GEADEDKAI

SEQ ID NO: 1943058 - protein, 5 aa, Staphylococcus
GEAEP

SEQ ID NO: 1943059 - protein, 9 aa, Staphylococcus
GEAFEESGA

SEQ ID NO: 1943060 - protein, 8 aa, Staphylococcus
GEAFEQSG

SEQ ID NO: 1943061 - protein, 8 aa, Staphylococcus
GEAFTESG

SEQ ID NO: 1943062 - protein, 4 aa, Staphylococcus
GEAG

SEQ ID NO: 1943063 - protein, 5 aa, Staphylococcus
GEAGI

SEQ ID NO: 1943064 - protein, 19 aa, Staphylococcus
GEAGLNKQIKNTDISRPGL

SEQ ID NO: 1943065 - protein, 8 aa, Staphylococcus
GEAGSGKT

SEQ ID NO: 1943066 - protein, 9 aa, Staphylococcus
GEAHLTNPQ

SEQ ID NO: 1943067 - protein, 17 aa, Staphylococcus
GEAIDETGIKPVDQPEI

SEQ ID NO: 1943068 - protein, 16 aa, Staphylococcus
GEAIEETKINPVAQPE

SEQ ID NO: 1943069 - protein, 8 aa, Staphylococcus
GEAINNAK

SEQ ID NO: 1943070 - protein, 7 aa, Staphylococcus
GEAKEEF

SEQ ID NO: 1943071 - protein, 9 aa, Staphylococcus
GEAKSQQQW

SEQ ID NO: 1943072 - protein, 10 aa, Staphylococcus
GEALAGDDGF

SEQ ID NO: 1943073 - protein, 13 aa, Staphylococcus
GEANHAGTTPMGL

SEQ ID NO: 1943074 - protein, 13 aa, Staphylococcus
GEANNAADFDTVP

SEQ ID NO: 1943075 - protein, 6 aa, Staphylococcus
GEAPEF

SEQ ID NO: 1943076 - protein, 17 aa, Staphylococcus
GEAQALEDVEKIRSFWN

SEQ ID NO: 1943077 - protein, 6 aa, Staphylococcus
GEAQTG

SEQ ID NO: 1943078 - protein, 6 aa, Staphylococcus
GEARND

SEQ ID NO: 1943079 - protein, 12 aa, Staphylococcus
GEARSHNDKSLE

SEQ ID NO: 1943080 - protein, 7 aa, Staphylococcus
GEASADF

SEQ ID NO: 1943081 - protein, 8 aa, Staphylococcus
GEASISKD

SEQ ID NO: 1943082 - protein, 8 aa, Staphylococcus
GEASLQYK

SEQ ID NO: 1943083 - protein, 5 aa, Staphylococcus
GEASV

SEQ ID NO: 1943084 - protein, 17 aa, Staphylococcus
GEASYATSTSSNNINLE

SEQ ID NO: 1943085 - protein, 10 aa, Staphylococcus
GEASYSKHKR

SEQ ID NO: 1943086 - protein, 9 aa, Staphylococcus
GEASYSNHR

SEQ ID NO: 1943087 - protein, 8 aa, Staphylococcus
GEATQLPE

SEQ ID NO: 1943088 - protein, 7 aa, Staphylococcus
GEATRRA

SEQ ID NO: 1943089 - protein, 6 aa, Staphylococcus
GEATVY

SEQ ID NO: 1943090 - protein, 8 aa, Staphylococcus
GEATYSSR

SEQ ID NO: 1943091 - protein, 4 aa, Staphylococcus
GEAV

SEQ ID NO: 1943092 - protein, 14 aa, Staphylococcus
GEAVDSIYDASVNK

SEQ ID NO: 1943093 - protein, 13 aa, Staphylococcus
GEAVGEGKVGPIT

SEQ ID NO: 1943094 - protein, 14 aa, Staphylococcus
GEAVNDGKVGPITR

SEQ ID NO: 1943095 - protein, 10 aa, Staphylococcus
GEAVTSGEAD

SEQ ID NO: 1943096 - protein, 21 aa, Staphylococcus
GEAYGQNDPAEEMYPGGENER

SEQ ID NO: 1943097 - protein, 11 aa, Staphylococcus
GEDAESETTEA

SEQ ID NO: 1943098 - protein, 16 aa, Staphylococcus
GEDAGSKLAKAEKFGT

SEQ ID NO: 1943099 - protein, 16 aa, Staphylococcus
GEDAGSKLSKAEQFGT

SEQ ID NO: 1943100 - protein, 16 aa, Staphylococcus
GEDAGSKLTKAEKFGT

SEQ ID NO: 1943101 - protein, 17 aa, Staphylococcus
GEDAGSKLTKAEKLGTE

SEQ ID NO: 1943102 - protein, 17 aa, Staphylococcus
GEDAGSKLTKAQKFGTE

SEQ ID NO: 1943103 - protein, 10 aa, Staphylococcus
GEDAKTEDLE

SEQ ID NO: 1943104 - protein, 11 aa, Staphylococcus
GEDAQSDMTTQ

SEQ ID NO: 1943105 - protein, 6 aa, Staphylococcus
GEDDIK

SEQ ID NO: 1943106 - protein, 8 aa, Staphylococcus
GEDDKQTF

SEQ ID NO: 1943107 - protein, 8 aa, Staphylococcus
GEDDPQLS

SEQ ID NO: 1943108 - protein, 35 aa, Staphylococcus
GEDEADDDDDIPAVTDDQETLNDPEDEQVEDEINE

SEQ ID NO: 1943109 - protein, 38 aa, Staphylococcus
GEDEADDDDDIPAVTDDQETLNDPEDPEDDDVDEDLNE

SEQ ID NO: 1943110 - protein, 13 aa, Staphylococcus
GEDEIGDDDNEKV

SEQ ID NO: 1943111 - protein, 26 aa, Staphylococcus
GEDEIGDDENDKVKTIREYAAKEDSE

SEQ ID NO: 1943112 - protein, 15 aa, Staphylococcus
GEDEIGDEENDKVKA

SEQ ID NO: 1943113 - protein, 14 aa, Staphylococcus
GEDEIGDVENDKVT

SEQ ID NO: 1943114 - protein, 16 aa, Staphylococcus
GEDEINEADNEKVTTI

SEQ ID NO: 1943115 - protein, 8 aa, Staphylococcus
GEDELPDE

SEQ ID NO: 1943116 - protein, 13 aa, Staphylococcus
GEDENNPKAEITY

SEQ ID NO: 1943117 - protein, 9 aa, Staphylococcus
GEDENNPQA

SEQ ID NO: 1943118 - protein, 5 aa, Staphylococcus
GEDEP

SEQ ID NO: 1943119 - protein, 10 aa, Staphylococcus
GEDFDERIAP

SEQ ID NO: 1943120 - protein, 5 aa, Staphylococcus
GEDFE

SEQ ID NO: 1943121 - protein, 6 aa, Staphylococcus
GEDFEK

SEQ ID NO: 1943122 - protein, 6 aa, Staphylococcus
GEDFEQ

SEQ ID NO: 1943123 - protein, 21 aa, Staphylococcus
GEDFGKDDPEEEMYPGGENER

SEQ ID NO: 1943124 - protein, 20 aa, Staphylococcus
GEDFGQDDPAEEMYPGGENE

SEQ ID NO: 1943125 - protein, 6 aa, Staphylococcus
GEDFKE

SEQ ID NO: 1943126 - protein, 14 aa, Staphylococcus
GEDGAQLSTEPSNV

SEQ ID NO: 1943127 - protein, 11 aa, Staphylococcus
GEDGPGEPGTV

SEQ ID NO: 1943128 - protein, 10 aa, Staphylococcus
GEDGQHQLST

SEQ ID NO: 1943129 - protein, 10 aa, Staphylococcus
GEDGQNALSN

SEQ ID NO: 1943130 - protein, 5 aa, Staphylococcus
GEDGT

SEQ ID NO: 1943131 - protein, 6 aa, Staphylococcus
GEDHRS

SEQ ID NO: 1943132 - protein, 4 aa, Staphylococcus
GEDI

SEQ ID NO: 1943133 - protein, 4 aa, Staphylococcus
GEDK

SEQ ID NO: 1943134 - protein, 6 aa, Staphylococcus
GEDKAE

SEQ ID NO: 1943135 - protein, 8 aa, Staphylococcus
GEDKEIQS

SEQ ID NO: 1943136 - protein, 6 aa, Staphylococcus
GEDKRG

SEQ ID NO: 1943137 - protein, 9 aa, Staphylococcus
GEDLDEMTE

SEQ ID NO: 1943138 - protein, 5 aa, Staphylococcus
GEDLG

SEQ ID NO: 1943139 - protein, 9 aa, Staphylococcus
GEDNDYTGT

SEQ ID NO: 1943140 - protein, 6 aa, Staphylococcus
GEDNKK

SEQ ID NO: 1943141 - protein, 7 aa, Staphylococcus
GEDNPEH

SEQ ID NO: 1943142 - protein, 9 aa, Staphylococcus
GEDPTKEKP

SEQ ID NO: 1943143 - protein, 8 aa, Staphylococcus
GEDQQFEG

SEQ ID NO: 1943144 - protein, 9 aa, Staphylococcus
GEDQSYEGN

SEQ ID NO: 1943145 - protein, 4 aa, Staphylococcus
GEDS

SEQ ID NO: 1943146 - protein, 8 aa, Staphylococcus
GEDSAKDM

SEQ ID NO: 1943147 - protein, 4 aa, Staphylococcus
GEDT

SEQ ID NO: 1943148 - protein, 9 aa, Staphylococcus
GEDTAEQQA

SEQ ID NO: 1943149 - protein, 7 aa, Staphylococcus
GEDTAKD

SEQ ID NO: 1943150 - protein, 8 aa, Staphylococcus
GEDTDYSG

SEQ ID NO: 1943151 - protein, 7 aa, Staphylococcus
GEDTESF

SEQ ID NO: 1943152 - protein, 8 aa, Staphylococcus
GEDTLEDI

SEQ ID NO: 1943153 - protein, 6 aa, Staphylococcus
GEDTQA

SEQ ID NO: 1943154 - protein, 6 aa, Staphylococcus
GEDTVK

SEQ ID NO: 1943155 - protein, 5 aa, Staphylococcus
GEDTY

SEQ ID NO: 1943156 - protein, 15 aa, Staphylococcus
GEDVGNGNVGEVTRQ

SEQ ID NO: 1943157 - protein, 7 aa, Staphylococcus
GEDVSHD

SEQ ID NO: 1943158 - protein, 7 aa, Staphylococcus
GEDYEND

SEQ ID NO: 1943159 - protein, 6 aa, Staphylococcus
GEDYHN

SEQ ID NO: 1943160 - protein, 10 aa, Staphylococcus
GEDYKPNTFT

SEQ ID NO: 1943161 - protein, 6 aa, Staphylococcus
GEDYRN

SEQ ID NO: 1943162 - protein, 5 aa, Staphylococcus
GEEAP

SEQ ID NO: 1943163 - protein, 15 aa, Staphylococcus
GEEAPADIENWTQDE

SEQ ID NO: 1943164 - protein, 11 aa, Staphylococcus
GEEAVKSDSGL

SEQ ID NO: 1943165 - protein, 11 aa, Staphylococcus
GEEAVKSESGL

SEQ ID NO: 1943166 - protein, 6 aa, Staphylococcus
GEEAVS

SEQ ID NO: 1943167 - protein, 11 aa, Staphylococcus
GEEAVSSKSGL

SEQ ID NO: 1943168 - protein, 10 aa, Staphylococcus
GEEDDEMTLS

SEQ ID NO: 1943169 - protein, 5 aa, Staphylococcus
GEEEA

SEQ ID NO: 1943170 - protein, 35 aa, Staphylococcus
GEEEEEIDDQETAEADAEDDDEDLDDPQDEEEIND

SEQ ID NO: 1943171 - protein, 5 aa, Staphylococcus
GEEEP

SEQ ID NO: 1943172 - protein, 4 aa, Staphylococcus
GEEG

SEQ ID NO: 1943173 - protein, 55 aa, Staphylococcus
GEEGEDVGSDDDDSEETTQENKDNDTTSEDQQASSNEKQSDKKDTEKEAKPEQRD

SEQ ID NO: 1943174 - protein, 52 aa, Staphylococcus
GEEGESTQQQSKENNSKDETNEKAKESDADNGNTNQEDKVQQPSQEDASQEQ

SEQ ID NO: 1943175 - protein, 6 aa, Staphylococcus
GEEGHG

SEQ ID NO: 1943176 - protein, 8 aa, Staphylococcus
GEEGHGHN

SEQ ID NO: 1943177 - protein, 9 aa, Staphylococcus
GEEGKPSEI

SEQ ID NO: 1943178 - protein, 9 aa, Staphylococcus
GEEGLDRPI

SEQ ID NO: 1943179 - protein, 11 aa, Staphylococcus
GEEGPGVPGTV

SEQ ID NO: 1943180 - protein, 9 aa, Staphylococcus
GEEITEYPA

SEQ ID NO: 1943181 - protein, 10 aa, Staphylococcus
GEEITEYPAN

SEQ ID NO: 1943182 - protein, 11 aa, Staphylococcus
GEEITRAYNGK

SEQ ID NO: 1943183 - protein, 17 aa, Staphylococcus
GEEIVGEGAKAFQEQGY

SEQ ID NO: 1943184 - protein, 10 aa, Staphylococcus
GEEKDNSMIR

SEQ ID NO: 1943185 - protein, 8 aa, Staphylococcus
GEEKRKTS

SEQ ID NO: 1943186 - protein, 10 aa, Staphylococcus
GEEKSNSEVD

SEQ ID NO: 1943187 - protein, 9 aa, Staphylococcus
GEEKTKNMS

SEQ ID NO: 1943188 - protein, 16 aa, Staphylococcus
GEELSPTHADLMYDYY

SEQ ID NO: 1943189 - protein, 7 aa, Staphylococcus
GEELTKE

SEQ ID NO: 1943190 - protein, 39 aa, Staphylococcus
GEENETSHSSKTYSNEVERENERQNETQQRLTSQGTQRY

SEQ ID NO: 1943191 - protein, 6 aa, Staphylococcus
GEENKK

SEQ ID NO: 1943192 - protein, 16 aa, Staphylococcus
GEENRKSLLNLLSKAN

SEQ ID NO: 1943193 - protein, 6 aa, Staphylococcus
GEENTE

SEQ ID NO: 1943194 - protein, 11 aa, Staphylococcus
GEEPVKSESGL

SEQ ID NO: 1943195 - protein, 10 aa, Staphylococcus
GEEPVTSESG

SEQ ID NO: 1943196 - protein, 5 aa, Staphylococcus
GEEQI

SEQ ID NO: 1943197 - protein, 6 aa, Staphylococcus
GEEQRQ

SEQ ID NO: 1943198 - protein, 10 aa, Staphylococcus
GEEQSKKSAY

SEQ ID NO: 1943199 - protein, 22 aa, Staphylococcus
GEERNKPNMSAQAIGGAVGSNP

SEQ ID NO: 1943200 - protein, 7 aa, Staphylococcus
GEESDIR

SEQ ID NO: 1943201 - protein, 11 aa, Staphylococcus
GEESDQEVTEQ

SEQ ID NO: 1943202 - protein, 6 aa, Staphylococcus
GEESDY

SEQ ID NO: 1943203 - protein, 20 aa, Staphylococcus
GEESKLGKKIGSDIDNHKST

SEQ ID NO: 1943204 - protein, 6 aa, Staphylococcus
GEESKN

SEQ ID NO: 1943205 - protein, 5 aa, Staphylococcus
GEESQ

SEQ ID NO: 1943206 - protein, 11 aa, Staphylococcus
GEESRDEYQKR

SEQ ID NO: 1943207 - protein, 8 aa, Staphylococcus
GEETATGD

SEQ ID NO: 1943208 - protein, 15 aa, Staphylococcus
GEETDDDMARDHQES

SEQ ID NO: 1943209 - protein, 6 aa, Staphylococcus
GEETFE

SEQ ID NO: 1943210 - protein, 5 aa, Staphylococcus
GEETP

SEQ ID NO: 1943211 - protein, 7 aa, Staphylococcus
GEETTEP

SEQ ID NO: 1943212 - protein, 6 aa, Staphylococcus
GEETTT

SEQ ID NO: 1943213 - protein, 4 aa, Staphylococcus
GEEV

SEQ ID NO: 1943214 - protein, 6 aa, Staphylococcus
GEEVDA

SEQ ID NO: 1943215 - protein, 11 aa, Staphylococcus
GEEVDKADAEE

SEQ ID NO: 1943216 - protein, 5 aa, Staphylococcus
GEEVS

SEQ ID NO: 1943217 - protein, 9 aa, Staphylococcus
GEEVTSNGA

SEQ ID NO: 1943218 - protein, 9 aa, Staphylococcus
GEEVVNGNA

SEQ ID NO: 1943219 - protein, 7 aa, Staphylococcus
GEEYEPS

SEQ ID NO: 1943220 - protein, 19 aa, Staphylococcus
GEFKDSDKIGKEFYTDGPK

SEQ ID NO: 1943221 - protein, 11 aa, Staphylococcus
GEFKDSPQIGK

SEQ ID NO: 1943222 - protein, 19 aa, Staphylococcus
GEFKDSSKIGKEFYTDGPR

SEQ ID NO: 1943223 - protein, 11 aa, Staphylococcus
GEFKNAAQGDW

SEQ ID NO: 1943224 - protein, 19 aa, Staphylococcus
GEFKNSEKIGKEFYTDGPR

SEQ ID NO: 1943225 - protein, 7 aa, Staphylococcus
GEFNEGD

SEQ ID NO: 1943226 - protein, 11 aa, Staphylococcus
GEFQRNPDTDK

SEQ ID NO: 1943227 - protein, 18 aa, Staphylococcus
GEFRDSDKIGKEFYTDGP

SEQ ID NO: 1943228 - protein, 6 aa, Staphylococcus
GEFSEE

SEQ ID NO: 1943229 - protein, 4 aa, Staphylococcus
GEGA

SEQ ID NO: 1943230 - protein, 13 aa, Staphylococcus
GEGADALFKKAIH

SEQ ID NO: 1943231 - protein, 13 aa, Staphylococcus
GEGADAYYNQAIH

SEQ ID NO: 1943232 - protein, 13 aa, Staphylococcus
GEGADGYFGSAIH

SEQ ID NO: 1943233 - protein, 47 aa, Staphylococcus
GEGAEEAQYEAERNEAEQSKQQEKTSAETTVNENNASHDDTSDSGVE

SEQ ID NO: 1943234 - protein, 9 aa, Staphylococcus
GEGAEKNNL

SEQ ID NO: 1943235 - protein, 6 aa, Staphylococcus
GEGAFE

SEQ ID NO: 1943236 - protein, 19 aa, Staphylococcus
GEGAFENKHPLSTIESTTL

SEQ ID NO: 1943237 - protein, 8 aa, Staphylococcus
GEGAFENN

SEQ ID NO: 1943238 - protein, 8 aa, Staphylococcus
GEGAFENS

SEQ ID NO: 1943239 - protein, 17 aa, Staphylococcus
GEGAIQAAQSLTQDDSK

SEQ ID NO: 1943240 - protein, 9 aa, Staphylococcus
GEGAKGSTL

SEQ ID NO: 1943241 - protein, 18 aa, Staphylococcus
GEGASGKEAIAKAQELKP

SEQ ID NO: 1943242 - protein, 15 aa, Staphylococcus
GEGASGKEAIEKAHE

SEQ ID NO: 1943243 - protein, 8 aa, Staphylococcus
GEGDGIGG

SEQ ID NO: 1943244 - protein, 28 aa, Staphylococcus
GEGDKAFCSGGDQKKRGHGGYVGDDEIP

SEQ ID NO: 1943245 - protein, 27 aa, Staphylococcus
GEGDKAFCSGGDQKKRGHGGYVGEDEI

SEQ ID NO: 1943246 - protein, 28 aa, Staphylococcus
GEGDKAFCSGGDQKVRGHGGYVGDDQIP

SEQ ID NO: 1943247 - protein, 8 aa, Staphylococcus
GEGDSELS

SEQ ID NO: 1943248 - protein, 11 aa, Staphylococcus
GEGESGKDAIA

SEQ ID NO: 1943249 - protein, 4 aa, Staphylococcus
GEGF

SEQ ID NO: 1943250 - protein, 8 aa, Staphylococcus
GEGGERNA

SEQ ID NO: 1943251 - protein, 15 aa, Staphylococcus
GEGGHGSSPHTAKDA

SEQ ID NO: 1943252 - protein, 14 aa, Staphylococcus
GEGGHGSSPHTAND

SEQ ID NO: 1943253 - protein, 7 aa, Staphylococcus
GEGGQRQ

SEQ ID NO: 1943254 - protein, 9 aa, Staphylococcus
GEGGSGGAL

SEQ ID NO: 1943255 - protein, 10 aa, Staphylococcus
GEGGSGGALG

SEQ ID NO: 1943256 - protein, 4 aa, Staphylococcus
GEGH

SEQ ID NO: 1943257 - protein, 9 aa, Staphylococcus
GEGHTSKEI

SEQ ID NO: 1943258 - protein, 18 aa, Staphylococcus
GEGINEDVKEAVKNAVET

SEQ ID NO: 1943259 - protein, 4 aa, Staphylococcus
GEGK

SEQ ID NO: 1943260 - protein, 6 aa, Staphylococcus
GEGKDL

SEQ ID NO: 1943261 - protein, 9 aa, Staphylococcus
GEGKDLDEV

SEQ ID NO: 1943262 - protein, 9 aa, Staphylococcus
GEGKDLDTV

SEQ ID NO: 1943263 - protein, 7 aa, Staphylococcus
GEGKEKA

SEQ ID NO: 1943264 - protein, 78 aa, Staphylococcus
GEGKGSTSSSSESQNNDSNSENENTKTDSAETNYSTPRTSTEAQGSDTSSNDDSESINNKRVNATPSARRHARKNGID

SEQ ID NO: 1943265 - protein, 10 aa, Staphylococcus
GEGKIDAQTI

SEQ ID NO: 1943266 - protein, 11 aa, Staphylococcus
GEGKIDGQTIY

SEQ ID NO: 1943267 - protein, 17 aa, Staphylococcus
GEGKLDSQTIYGKTPIG

SEQ ID NO: 1943268 - protein, 17 aa, Staphylococcus
GEGKMDKQTIYGKTPIG

SEQ ID NO: 1943269 - protein, 11 aa, Staphylococcus
GEGKSGKEAIE

SEQ ID NO: 1943270 - protein, 22 aa, Staphylococcus
GEGLATEETPLDNHSDGDRKIT

SEQ ID NO: 1943271 - protein, 4 aa, Staphylococcus
GEGN

SEQ ID NO: 1943272 - protein, 7 aa, Staphylococcus
GEGNFDD

SEQ ID NO: 1943273 - protein, 11 aa, Staphylococcus
GEGNITVNDRD

SEQ ID NO: 1943274 - protein, 10 aa, Staphylococcus
GEGNITVNER

SEQ ID NO: 1943275 - protein, 12 aa, Staphylococcus
GEGNITVNGKDV

SEQ ID NO: 1943276 - protein, 11 aa, Staphylococcus
GEGNITVNGRD

SEQ ID NO: 1943277 - protein, 9 aa, Staphylococcus
GEGNPAKKF

SEQ ID NO: 1943278 - protein, 10 aa, Staphylococcus
GEGQEHQNLQ

SEQ ID NO: 1943279 - protein, 8 aa, Staphylococcus
GEGQLPDE

SEQ ID NO: 1943280 - protein, 6 aa, Staphylococcus
GEGQMI

SEQ ID NO: 1943281 - protein, 6 aa, Staphylococcus
GEGQYD

SEQ ID NO: 1943282 - protein, 7 aa, Staphylococcus
GEGREAL

SEQ ID NO: 1943283 - protein, 5 aa, Staphylococcus
GEGRV

SEQ ID NO: 1943284 - protein, 4 aa, Staphylococcus
GEGS

SEQ ID NO: 1943285 - protein, 75 aa, Staphylococcus
GEGSAEAKSAEASKSDGKAESKGESESETTTNTANEDTTRDHEQRQDEAEKADRSDEVKKHTQRVNATPSARRHA

SEQ ID NO: 1943286 - protein, 72 aa, Staphylococcus
GEGSGNASSGSSDNQTPQSNDETNKDDQQSKETSQPSNDTQSSDQSQDDSANNQRVKATPSARRHARANGVD

SEQ ID NO: 1943287 - protein, 68 aa, Staphylococcus
GEGSGNASSGSSNETPQKEESKDASESQDKSQQSQSSSDNKQDDQDSSNQRVNATPSARRHARENGVN

SEQ ID NO: 1943288 - protein, 67 aa, Staphylococcus
GEGSGNNTSEAPAKQEAPKQETETSTDDKSAQPAEATSNDTDDKSQDNNQRVNATPSARKYAREKGI

SEQ ID NO: 1943289 - protein, 6 aa, Staphylococcus
GEGSKI

SEQ ID NO: 1943290 - protein, 5 aa, Staphylococcus
GEGSV

SEQ ID NO: 1943291 - protein, 6 aa, Staphylococcus
GEGTFD

SEQ ID NO: 1943292 - protein, 7 aa, Staphylococcus
GEGTFDD

SEQ ID NO: 1943293 - protein, 5 aa, Staphylococcus
GEGTL

SEQ ID NO: 1943294 - protein, 6 aa, Staphylococcus
GEGTQH

SEQ ID NO: 1943295 - protein, 11 aa, Staphylococcus
GEGTSNQGDFH

SEQ ID NO: 1943296 - protein, 12 aa, Staphylococcus
GEGVNDEVKEAV

SEQ ID NO: 1943297 - protein, 18 aa, Staphylococcus
GEGVSEDVKASVKNAVET

SEQ ID NO: 1943298 - protein, 18 aa, Staphylococcus
GEGVSEEVKTSVKEAVET

SEQ ID NO: 1943299 - protein, 16 aa, Staphylococcus
GEGVTESIRTKDNMDG

SEQ ID NO: 1943300 - protein, 19 aa, Staphylococcus
GEGWYQEEGKPSQKLAPGS

SEQ ID NO: 1943301 - protein, 4 aa, Staphylococcus
GEGY

SEQ ID NO: 1943302 - protein, 5 aa, Staphylococcus
GEGYQ

SEQ ID NO: 1943303 - protein, 8 aa, Staphylococcus
GEHDESKA

SEQ ID NO: 1943304 - protein, 15 aa, Staphylococcus
GEHGGSCVTSGNAKS

SEQ ID NO: 1943305 - protein, 9 aa, Staphylococcus
GEHGQQTIN

SEQ ID NO: 1943306 - protein, 8 aa, Staphylococcus
GEHGQTAL

SEQ ID NO: 1943307 - protein, 5 aa, Staphylococcus
GEHPT

SEQ ID NO: 1943308 - protein, 9 aa, Staphylococcus
GEHQTTYKN

SEQ ID NO: 1943309 - protein, 12 aa, Staphylococcus
GEHQVKQDSTYP

SEQ ID NO: 1943310 - protein, 9 aa, Staphylococcus
GEHRNPFKS

SEQ ID NO: 1943311 - protein, 20 aa, Staphylococcus
GEHSDAYEATETIDATDKVV

SEQ ID NO: 1943312 - protein, 6 aa, Staphylococcus
GEHTNP

SEQ ID NO: 1943313 - protein, 4 aa, Staphylococcus
GEHV

SEQ ID NO: 1943314 - protein, 5 aa, Staphylococcus
GEHVA

SEQ ID NO: 1943315 - protein, 6 aa, Staphylococcus
GEIDED

SEQ ID NO: 1943316 - protein, 6 aa, Staphylococcus
GEIEGT

SEQ ID NO: 1943317 - protein, 12 aa, Staphylococcus
GEIEVPGDKSMT

SEQ ID NO: 1943318 - protein, 13 aa, Staphylococcus
GEIFNRDDSIKER

SEQ ID NO: 1943319 - protein, 4 aa, Staphylococcus
GEIG

SEQ ID NO: 1943320 - protein, 7 aa, Staphylococcus
GEIGKNT

SEQ ID NO: 1943321 - protein, 6 aa, Staphylococcus
GEIGSA

SEQ ID NO: 1943322 - protein, 23 aa, Staphylococcus
GEIKDRTGVMSKDGSFIKSEDIE

SEQ ID NO: 1943323 - protein, 19 aa, Staphylococcus
GEIKLDGENIHSHSTKEIA

SEQ ID NO: 1943324 - protein, 4 aa, Staphylococcus
GEIP

SEQ ID NO: 1943325 - protein, 5 aa, Staphylococcus
GEIPG

SEQ ID NO: 1943326 - protein, 5 aa, Staphylococcus
GEIPH

SEQ ID NO: 1943327 - protein, 6 aa, Staphylococcus
GEIPSH

SEQ ID NO: 1943328 - protein, 7 aa, Staphylococcus
GEIQPGT

SEQ ID NO: 1943329 - protein, 11 aa, Staphylococcus
GEISDKEFHQA

SEQ ID NO: 1943330 - protein, 13 aa, Staphylococcus
GEISPGPSVQTDE

SEQ ID NO: 1943331 - protein, 10 aa, Staphylococcus
GEISSDKNEI

SEQ ID NO: 1943332 - protein, 6 aa, Staphylococcus
GEISYD

SEQ ID NO: 1943333 - protein, 9 aa, Staphylococcus
GEITGNAGN

SEQ ID NO: 1943334 - protein, 6 aa, Staphylococcus
GEITHG

SEQ ID NO: 1943335 - protein, 12 aa, Staphylococcus
GEITVPGDKSMT

SEQ ID NO: 1943336 - protein, 14 aa, Staphylococcus
GEIVGGKSPDSGHE

SEQ ID NO: 1943337 - protein, 11 aa, Staphylococcus
GEKAVKSESGL

SEQ ID NO: 1943338 - protein, 6 aa, Staphylococcus
GEKDEK

SEQ ID NO: 1943339 - protein, 9 aa, Staphylococcus
GEKDRLQKQ

SEQ ID NO: 1943340 - protein, 6 aa, Staphylococcus
GEKESL

SEQ ID NO: 1943341 - protein, 6 aa, Staphylococcus
GEKETG

SEQ ID NO: 1943342 - protein, 7 aa, Staphylococcus
GEKETGV

SEQ ID NO: 1943343 - protein, 8 aa, Staphylococcus
GEKEYSTS

SEQ ID NO: 1943344 - protein, 6 aa, Staphylococcus
GEKFPK

SEQ ID NO: 1943345 - protein, 4 aa, Staphylococcus
GEKG

SEQ ID NO: 1943346 - protein, 8 aa, Staphylococcus
GEKGAKRA

SEQ ID NO: 1943347 - protein, 12 aa, Staphylococcus
GEKGLSREKIET

SEQ ID NO: 1943348 - protein, 13 aa, Staphylococcus
GEKGPKDLNQNTD

SEQ ID NO: 1943349 - protein, 10 aa, Staphylococcus
GEKGQEDLRQ

SEQ ID NO: 1943350 - protein, 18 aa, Staphylococcus
GEKHGGASKTSGAGGGDC

SEQ ID NO: 1943351 - protein, 15 aa, Staphylococcus
GEKIKDVKDIKDHEE

SEQ ID NO: 1943352 - protein, 6 aa, Staphylococcus
GEKIKR

SEQ ID NO: 1943353 - protein, 7 aa, Staphylococcus
GEKIPKG

SEQ ID NO: 1943354 - protein, 10 aa, Staphylococcus
GEKISGKELR

SEQ ID NO: 1943355 - protein, 18 aa, Staphylococcus
GEKITKQSVTANKKVLPN

SEQ ID NO: 1943356 - protein, 7 aa, Staphylococcus
GEKKADN

SEQ ID NO: 1943357 - protein, 18 aa, Staphylococcus
GEKKKKASEDDNTIKAEL

SEQ ID NO: 1943358 - protein, 18 aa, Staphylococcus
GEKKKKDTEEENTIKAEL

SEQ ID NO: 1943359 - protein, 5 aa, Staphylococcus
GEKKV

SEQ ID NO: 1943360 - protein, 10 aa, Staphylococcus
GEKPHQVDER

SEQ ID NO: 1943361 - protein, 8 aa, Staphylococcus
GEKPLMES

SEQ ID NO: 1943362 - protein, 10 aa, Staphylococcus
GEKPPKDLNH

SEQ ID NO: 1943363 - protein, 18 aa, Staphylococcus
GEKPQSSLKLKPEGTPFQ

SEQ ID NO: 1943364 - protein, 10 aa, Staphylococcus
GEKQLKQGFS

SEQ ID NO: 1943365 - protein, 11 aa, Staphylococcus
GEKQQLEAGTS

SEQ ID NO: 1943366 - protein, 11 aa, Staphylococcus
GEKQQLESGTS

SEQ ID NO: 1943367 - protein, 8 aa, Staphylococcus
GEKSLSNS

SEQ ID NO: 1943368 - protein, 8 aa, Staphylococcus
GEKTADYC

SEQ ID NO: 1943369 - protein, 7 aa, Staphylococcus
GEKTAQY

SEQ ID NO: 1943370 - protein, 8 aa, Staphylococcus
GEKTKDYC

SEQ ID NO: 1943371 - protein, 7 aa, Staphylococcus
GEKTSHT

SEQ ID NO: 1943372 - protein, 5 aa, Staphylococcus
GEKVP

SEQ ID NO: 1943373 - protein, 8 aa, Staphylococcus
GEKVQSLE

SEQ ID NO: 1943374 - protein, 8 aa, Staphylococcus
GEKVTRKE

SEQ ID NO: 1943375 - protein, 6 aa, Staphylococcus
GEKWSN

SEQ ID NO: 1943376 - protein, 8 aa, Staphylococcus
GEKYPVKP

SEQ ID NO: 1943377 - protein, 10 aa, Staphylococcus
GELATTGSTA

SEQ ID NO: 1943378 - protein, 8 aa, Staphylococcus
GELATTGY

SEQ ID NO: 1943379 - protein, 13 aa, Staphylococcus
GELDSTGKLPSNL

SEQ ID NO: 1943380 - protein, 7 aa, Staphylococcus
GELEEGG

SEQ ID NO: 1943381 - protein, 4 aa, Staphylococcus
GELG

SEQ ID NO: 1943382 - protein, 6 aa, Staphylococcus
GELHEG

SEQ ID NO: 1943383 - protein, 12 aa, Staphylococcus
GELKNKKGVNLP

SEQ ID NO: 1943384 - protein, 7 aa, Staphylococcus
GELKQED

SEQ ID NO: 1943385 - protein, 4 aa, Staphylococcus
GELP

SEQ ID NO: 1943386 - protein, 11 aa, Staphylococcus
GELPANKRKVN

SEQ ID NO: 1943387 - protein, 8 aa, Staphylococcus
GELSGAHG

SEQ ID NO: 1943388 - protein, 6 aa, Staphylococcus
GELTSH

SEQ ID NO: 1943389 - protein, 12 aa, Staphylococcus
GEMPNYNKDNYH

SEQ ID NO: 1943390 - protein, 5 aa, Staphylococcus
GEMQL

SEQ ID NO: 1943391 - protein, 7 aa, Staphylococcus
GEMTQAS

SEQ ID NO: 1943392 - protein, 10 aa, Staphylococcus
GENAGFTSGT

SEQ ID NO: 1943393 - protein, 15 aa, Staphylococcus
GENAPEDIENWTQDE

SEQ ID NO: 1943394 - protein, 5 aa, Staphylococcus
GENAS

SEQ ID NO: 1943395 - protein, 8 aa, Staphylococcus
GENDEQQR

SEQ ID NO: 1943396 - protein, 6 aa, Staphylococcus
GENDID

SEQ ID NO: 1943397 - protein, 6 aa, Staphylococcus
GENDVE

SEQ ID NO: 1943398 - protein, 6 aa, Staphylococcus
GENEPS

SEQ ID NO: 1943399 - protein, 16 aa, Staphylococcus
GENETRSYLASGTSRL

SEQ ID NO: 1943400 - protein, 10 aa, Staphylococcus
GENEVSDPKE

SEQ ID NO: 1943401 - protein, 10 aa, Staphylococcus
GENGAGKTSL

SEQ ID NO: 1943402 - protein, 11 aa, Staphylococcus
GENHKYGTSAD

SEQ ID NO: 1943403 - protein, 9 aa, Staphylococcus
GENHNARAS

SEQ ID NO: 1943404 - protein, 11 aa, Staphylococcus
GENISKPSVPE

SEQ ID NO: 1943405 - protein, 11 aa, Staphylococcus
GENITKPGVPE

SEQ ID NO: 1943406 - protein, 8 aa, Staphylococcus
GENKAPVE

SEQ ID NO: 1943407 - protein, 8 aa, Staphylococcus
GENKNQLS

SEQ ID NO: 1943408 - protein, 8 aa, Staphylococcus
GENLSSGY

SEQ ID NO: 1943409 - protein, 13 aa, Staphylococcus
GENNKQTHFSTGS

SEQ ID NO: 1943410 - protein, 7 aa, Staphylococcus
GENNSTI

SEQ ID NO: 1943411 - protein, 19 aa, Staphylococcus
GENPWQQNETPSPHSQFQD

SEQ ID NO: 1943412 - protein, 11 aa, Staphylococcus
GENRTRNLGNE

SEQ ID NO: 1943413 - protein, 8 aa, Staphylococcus
GENSAEMH

SEQ ID NO: 1943414 - protein, 9 aa, Staphylococcus
GENSQSMHE

SEQ ID NO: 1943415 - protein, 9 aa, Staphylococcus
GENSSPTKI

SEQ ID NO: 1943416 - protein, 7 aa, Staphylococcus
GENTDGH

SEQ ID NO: 1943417 - protein, 7 aa, Staphylococcus
GENTRAP

SEQ ID NO: 1943418 - protein, 15 aa, Staphylococcus
GEPADDENGAPKPRL

SEQ ID NO: 1943419 - protein, 17 aa, Staphylococcus
GEPADDEQGTPKPRLPY

SEQ ID NO: 1943420 - protein, 15 aa, Staphylococcus
GEPAEDEDGEPKPRL

SEQ ID NO: 1943421 - protein, 15 aa, Staphylococcus
GEPAEDENGSPKPRL

SEQ ID NO: 1943422 - protein, 10 aa, Staphylococcus
GEPARKLTKG

SEQ ID NO: 1943423 - protein, 8 aa, Staphylococcus
GEPDDTWE

SEQ ID NO: 1943424 - protein, 7 aa, Staphylococcus
GEPDPKM

SEQ ID NO: 1943425 - protein, 7 aa, Staphylococcus
GEPDPQL

SEQ ID NO: 1943426 - protein, 17 aa, Staphylococcus
GEPDRSQPEDKYLPNEL

SEQ ID NO: 1943427 - protein, 7 aa, Staphylococcus
GEPDSKM

SEQ ID NO: 1943428 - protein, 4 aa, Staphylococcus
GEPE

SEQ ID NO: 1943429 - protein, 6 aa, Staphylococcus
GEPEEV

SEQ ID NO: 1943430 - protein, 5 aa, Staphylococcus
GEPEG

SEQ ID NO: 1943431 - protein, 5 aa, Staphylococcus
GEPFD

SEQ ID NO: 1943432 - protein, 5 aa, Staphylococcus
GEPFS

SEQ ID NO: 1943433 - protein, 7 aa, Staphylococcus
GEPHERF

SEQ ID NO: 1943434 - protein, 6 aa, Staphylococcus
GEPIAE

SEQ ID NO: 1943435 - protein, 6 aa, Staphylococcus
GEPKGL

SEQ ID NO: 1943436 - protein, 5 aa, Staphylococcus
GEPKL

SEQ ID NO: 1943437 - protein, 20 aa, Staphylococcus
GEPKYDLEESKNRDTTYSAP

SEQ ID NO: 1943438 - protein, 14 aa, Staphylococcus
GEPKYYSSSAWGKE

SEQ ID NO: 1943439 - protein, 11 aa, Staphylococcus
GEPLSSPEDIE

SEQ ID NO: 1943440 - protein, 7 aa, Staphylococcus
GEPNPKM

SEQ ID NO: 1943441 - protein, 9 aa, Staphylococcus
GEPPHEGTQ

SEQ ID NO: 1943442 - protein, 10 aa, Staphylococcus
GEPPHQGTQK

SEQ ID NO: 1943443 - protein, 9 aa, Staphylococcus
GEPQAPGQI

SEQ ID NO: 1943444 - protein, 8 aa, Staphylococcus
GEPRERFE

SEQ ID NO: 1943445 - protein, 7 aa, Staphylococcus
GEPRVTE

SEQ ID NO: 1943446 - protein, 9 aa, Staphylococcus
GEPSAFNYS

SEQ ID NO: 1943447 - protein, 9 aa, Staphylococcus
GEPSAYNYA

SEQ ID NO: 1943448 - protein, 10 aa, Staphylococcus
GEPSAYNYDQ

SEQ ID NO: 1943449 - protein, 7 aa, Staphylococcus
GEPTDNG

SEQ ID NO: 1943450 - protein, 29 aa, Staphylococcus
GEPVAKGQGRTKKESEQKAAEKAYNDMKK

SEQ ID NO: 1943451 - protein, 7 aa, Staphylococcus
GEPVSDK

SEQ ID NO: 1943452 - protein, 14 aa, Staphylococcus
GEQDAQASIKAGTH

SEQ ID NO: 1943453 - protein, 10 aa, Staphylococcus
GEQDAQASIR

SEQ ID NO: 1943454 - protein, 8 aa, Staphylococcus
GEQEKKEL

SEQ ID NO: 1943455 - protein, 7 aa, Staphylococcus
GEQEKRE

SEQ ID NO: 1943456 - protein, 15 aa, Staphylococcus
GEQFEGFRKSTEGYY

SEQ ID NO: 1943457 - protein, 14 aa, Staphylococcus
GEQFEGGQAEGYDL

SEQ ID NO: 1943458 - protein, 13 aa, Staphylococcus
GEQFEGGQAESYD

SEQ ID NO: 1943459 - protein, 9 aa, Staphylococcus
GEQGPPEQL

SEQ ID NO: 1943460 - protein, 5 aa, Staphylococcus
GEQGV

SEQ ID NO: 1943461 - protein, 25 aa, Staphylococcus
GEQIEEEDLKKAQEQAQAIEKDENI

SEQ ID NO: 1943462 - protein, 5 aa, Staphylococcus
GEQIP

SEQ ID NO: 1943463 - protein, 11 aa, Staphylococcus
GEQITQDYQNK

SEQ ID NO: 1943464 - protein, 4 aa, Staphylococcus
GEQK

SEQ ID NO: 1943465 - protein, 6 aa, Staphylococcus
GEQLEG

SEQ ID NO: 1943466 - protein, 9 aa, Staphylococcus
GEQLPSEND

SEQ ID NO: 1943467 - protein, 7 aa, Staphylococcus
GEQLSGR

SEQ ID NO: 1943468 - protein, 11 aa, Staphylococcus
GEQLTKDYKDK

SEQ ID NO: 1943469 - protein, 5 aa, Staphylococcus
GEQPN

SEQ ID NO: 1943470 - protein, 6 aa, Staphylococcus
GEQQGF

SEQ ID NO: 1943471 - protein, 7 aa, Staphylococcus
GEQQRES

SEQ ID NO: 1943472 - protein, 11 aa, Staphylococcus
GEQQSKKSPYD

SEQ ID NO: 1943473 - protein, 6 aa, Staphylococcus
GEQSDY

SEQ ID NO: 1943474 - protein, 24 aa, Staphylococcus
GEQVGSYVSKDRKTIEQIDEFINN

SEQ ID NO: 1943475 - protein, 10 aa, Staphylococcus
GEQVTSGNAD

SEQ ID NO: 1943476 - protein, 4 aa, Staphylococcus
GERC

SEQ ID NO: 1943477 - protein, 5 aa, Staphylococcus
GERDG

SEQ ID NO: 1943478 - protein, 5 aa, Staphylococcus
GERDL

SEQ ID NO: 1943479 - protein, 7 aa, Staphylococcus
GEREQDL

SEQ ID NO: 1943480 - protein, 8 aa, Staphylococcus
GEREQSVD

SEQ ID NO: 1943481 - protein, 16 aa, Staphylococcus
GERETRRGKKLADQDR

SEQ ID NO: 1943482 - protein, 16 aa, Staphylococcus
GERETRRGKKLANQDR

SEQ ID NO: 1943483 - protein, 19 aa, Staphylococcus
GERETRRGKKLEDGDQIDI

SEQ ID NO: 1943484 - protein, 4 aa, Staphylococcus
GERF

SEQ ID NO: 1943485 - protein, 5 aa, Staphylococcus
GERGL

SEQ ID NO: 1943486 - protein, 12 aa, Staphylococcus
GERITSLESKEV

SEQ ID NO: 1943487 - protein, 5 aa, Staphylococcus
GERLN

SEQ ID NO: 1943488 - protein, 15 aa, Staphylococcus
GERLNAEVGTKAYGS

SEQ ID NO: 1943489 - protein, 15 aa, Staphylococcus
GERLNATVGTKAYGS

SEQ ID NO: 1943490 - protein, 8 aa, Staphylococcus
GERLNGNP

SEQ ID NO: 1943491 - protein, 9 aa, Staphylococcus
GERLSDDVK

SEQ ID NO: 1943492 - protein, 10 aa, Staphylococcus
GERMGQGKEN

SEQ ID NO: 1943493 - protein, 5 aa, Staphylococcus
GERPF

SEQ ID NO: 1943494 - protein, 13 aa, Staphylococcus
GERPVMYKAIEGY

SEQ ID NO: 1943495 - protein, 5 aa, Staphylococcus
GERQP

SEQ ID NO: 1943496 - protein, 8 aa, Staphylococcus
GERQQSVD

SEQ ID NO: 1943497 - protein, 19 aa, Staphylococcus
GERQQSVDYELSNDDKIDN

SEQ ID NO: 1943498 - protein, 5 aa, Staphylococcus
GERQY

SEQ ID NO: 1943499 - protein, 5 aa, Staphylococcus
GERSV

SEQ ID NO: 1943500 - protein, 5 aa, Staphylococcus
GERTN

SEQ ID NO: 1943501 - protein, 12 aa, Staphylococcus
GERTPHGDSQIR

SEQ ID NO: 1943502 - protein, 8 aa, Staphylococcus
GERTREGN

SEQ ID NO: 1943503 - protein, 10 aa, Staphylococcus
GERVYPNKPI

SEQ ID NO: 1943504 - protein, 11 aa, Staphylococcus
GERYQYTASSH

SEQ ID NO: 1943505 - protein, 15 aa, Staphylococcus
GESADSLGLDGREEI

SEQ ID NO: 1943506 - protein, 12 aa, Staphylococcus
GESAGRLTETGA

SEQ ID NO: 1943507 - protein, 10 aa, Staphylococcus
GESAGSLSPY

SEQ ID NO: 1943508 - protein, 8 aa, Staphylococcus
GESAGTLA

SEQ ID NO: 1943509 - protein, 13 aa, Staphylococcus
GESARYATEQRIE

SEQ ID NO: 1943510 - protein, 6 aa, Staphylococcus
GESDED

SEQ ID NO: 1943511 - protein, 53 aa, Staphylococcus
GESDEGLRNDSSHLNNHPTHNRVQEEQEANVAQESDSHKGANEPDDTQKTGVD

SEQ ID NO: 1943512 - protein, 16 aa, Staphylococcus
GESDSLNQRYQDYDKK

SEQ ID NO: 1943513 - protein, 8 aa, Staphylococcus
GESEARDY

SEQ ID NO: 1943514 - protein, 21 aa, Staphylococcus
GESEGKDYKGIYPSSANYTTD

SEQ ID NO: 1943515 - protein, 7 aa, Staphylococcus
GESEPSL

SEQ ID NO: 1943516 - protein, 4 aa, Staphylococcus
GESF

SEQ ID NO: 1943517 - protein, 7 aa, Staphylococcus
GESFEPG

SEQ ID NO: 1943518 - protein, 5 aa, Staphylococcus
GESFK

SEQ ID NO: 1943519 - protein, 9 aa, Staphylococcus
GESGAGKTT

SEQ ID NO: 1943520 - protein, 9 aa, Staphylococcus
GESGCGKST

SEQ ID NO: 1943521 - protein, 10 aa, Staphylococcus
GESGSGKSIT

SEQ ID NO: 1943522 - protein, 10 aa, Staphylococcus
GESGSGKSLT

SEQ ID NO: 1943523 - protein, 11 aa, Staphylococcus
GESGSGKSLTA

SEQ ID NO: 1943524 - protein, 10 aa, Staphylococcus
GESGSGKSTL

SEQ ID NO: 1943525 - protein, 11 aa, Staphylococcus
GESGSGKSTLS

SEQ ID NO: 1943526 - protein, 10 aa, Staphylococcus
GESGSGKSVV

SEQ ID NO: 1943527 - protein, 9 aa, Staphylococcus
GESGSGKTT

SEQ ID NO: 1943528 - protein, 10 aa, Staphylococcus
GESGSGKTTL

SEQ ID NO: 1943529 - protein, 4 aa, Staphylococcus
GESH

SEQ ID NO: 1943530 - protein, 7 aa, Staphylococcus
GESHQLT

SEQ ID NO: 1943531 - protein, 13 aa, Staphylococcus
GESIEESIVIPVK

SEQ ID NO: 1943532 - protein, 9 aa, Staphylococcus
GESKNEVEE

SEQ ID NO: 1943533 - protein, 6 aa, Staphylococcus
GESKYG

SEQ ID NO: 1943534 - protein, 6 aa, Staphylococcus
GESNDL

SEQ ID NO: 1943535 - protein, 6 aa, Staphylococcus
GESNED

SEQ ID NO: 1943536 - protein, 4 aa, Staphylococcus
GESR

SEQ ID NO: 1943537 - protein, 8 aa, Staphylococcus
GESRIDKE

SEQ ID NO: 1943538 - protein, 6 aa, Staphylococcus
GESRVE

SEQ ID NO: 1943539 - protein, 47 aa, Staphylococcus
GESSDTQLAQPSDKSVESDIANSEHQAHQQDDASVTEEANKHETGDE

SEQ ID NO: 1943540 - protein, 7 aa, Staphylococcus
GESSERY

SEQ ID NO: 1943541 - protein, 8 aa, Staphylococcus
GESSLEAG

SEQ ID NO: 1943542 - protein, 19 aa, Staphylococcus
GESSYTTGQVYGVTGGKQI

SEQ ID NO: 1943543 - protein, 10 aa, Staphylococcus
GESTEDIENT

SEQ ID NO: 1943544 - protein, 19 aa, Staphylococcus
GESTGYDYSRTKNPTRSAF

SEQ ID NO: 1943545 - protein, 8 aa, Staphylococcus
GESTLEDI

SEQ ID NO: 1943546 - protein, 9 aa, Staphylococcus
GESTTPSIK

SEQ ID NO: 1943547 - protein, 10 aa, Staphylococcus
GESTTPSITK

SEQ ID NO: 1943548 - protein, 6 aa, Staphylococcus
GESTYE

SEQ ID NO: 1943549 - protein, 13 aa, Staphylococcus
GESVAEKVGVDPG

SEQ ID NO: 1943550 - protein, 8 aa, Staphylococcus
GESVSISQ

SEQ ID NO: 1943551 - protein, 8 aa, Staphylococcus
GESVSYGS

SEQ ID NO: 1943552 - protein, 14 aa, Staphylococcus
GESVSYGSTFTATE

SEQ ID NO: 1943553 - protein, 5 aa, Staphylococcus
GESYR

SEQ ID NO: 1943554 - protein, 11 aa, Staphylococcus
GETAAGLYPEE

SEQ ID NO: 1943555 - protein, 20 aa, Staphylococcus
GETADTKAMKNTVLQQLQRR

SEQ ID NO: 1943556 - protein, 6 aa, Staphylococcus
GETDED

SEQ ID NO: 1943557 - protein, 23 aa, Staphylococcus
GETDEDDDATQDAIVEPDNVGAD

SEQ ID NO: 1943558 - protein, 9 aa, Staphylococcus
GETDESEVR

SEQ ID NO: 1943559 - protein, 7 aa, Staphylococcus
GETEEQV

SEQ ID NO: 1943560 - protein, 8 aa, Staphylococcus
GETEEQVR

SEQ ID NO: 1943561 - protein, 10 aa, Staphylococcus
GETEHNGTEI

SEQ ID NO: 1943562 - protein, 8 aa, Staphylococcus
GETEKDGI

SEQ ID NO: 1943563 - protein, 10 aa, Staphylococcus
GETENEVESR

SEQ ID NO: 1943564 - protein, 11 aa, Staphylococcus
GETEPEDAENW

SEQ ID NO: 1943565 - protein, 6 aa, Staphylococcus
GETEPS

SEQ ID NO: 1943566 - protein, 5 aa, Staphylococcus
GETFP

SEQ ID NO: 1943567 - protein, 6 aa, Staphylococcus
GETGAS

SEQ ID NO: 1943568 - protein, 6 aa, Staphylococcus
GETHQL

SEQ ID NO: 1943569 - protein, 4 aa, Staphylococcus
GETI

SEQ ID NO: 1943570 - protein, 5 aa, Staphylococcus
GETIE

SEQ ID NO: 1943571 - protein, 6 aa, Staphylococcus
GETKGM

SEQ ID NO: 1943572 - protein, 11 aa, Staphylococcus
GETKSDDIPAD

SEQ ID NO: 1943573 - protein, 11 aa, Staphylococcus
GETKSDDIPAE

SEQ ID NO: 1943574 - protein, 11 aa, Staphylococcus
GETKSDDIPAN

SEQ ID NO: 1943575 - protein, 7 aa, Staphylococcus
GETKYSL

SEQ ID NO: 1943576 - protein, 4 aa, Staphylococcus
GETL

SEQ ID NO: 1943577 - protein, 8 aa, Staphylococcus
GETNESLP

SEQ ID NO: 1943578 - protein, 14 aa, Staphylococcus
GETPPNNVSHSEWT

SEQ ID NO: 1943579 - protein, 7 aa, Staphylococcus
GETQECN

SEQ ID NO: 1943580 - protein, 5 aa, Staphylococcus
GETQV

SEQ ID NO: 1943581 - protein, 13 aa, Staphylococcus
GETREGKYAGQER

SEQ ID NO: 1943582 - protein, 5 aa, Staphylococcus
GETSE

SEQ ID NO: 1943583 - protein, 13 aa, Staphylococcus
GETSHSGSTPMPM

SEQ ID NO: 1943584 - protein, 6 aa, Staphylococcus
GETTDY

SEQ ID NO: 1943585 - protein, 7 aa, Staphylococcus
GETTQLS

SEQ ID NO: 1943586 - protein, 5 aa, Staphylococcus
GETTR

SEQ ID NO: 1943587 - protein, 13 aa, Staphylococcus
GETVETDEDISKE

SEQ ID NO: 1943588 - protein, 17 aa, Staphylococcus
GETVQSLSGDDNGNVTK

SEQ ID NO: 1943589 - protein, 24 aa, Staphylococcus
GETVRKSDLSEFGNVSTKSIQRDV

SEQ ID NO: 1943590 - protein, 5 aa, Staphylococcus
GETVS

SEQ ID NO: 1943591 - protein, 10 aa, Staphylococcus
GETVTPHDHQ

SEQ ID NO: 1943592 - protein, 5 aa, Staphylococcus
GETYQ

SEQ ID NO: 1943593 - protein, 18 aa, Staphylococcus
GETYSNADKKSQIKVRKQ

SEQ ID NO: 1943594 - protein, 4 aa, Staphylococcus
GEVE

SEQ ID NO: 1943595 - protein, 6 aa, Staphylococcus
GEVEET

SEQ ID NO: 1943596 - protein, 6 aa, Staphylococcus
GEVEGT

SEQ ID NO: 1943597 - protein, 6 aa, Staphylococcus
GEVEHA

SEQ ID NO: 1943598 - protein, 4 aa, Staphylococcus
GEVG

SEQ ID NO: 1943599 - protein, 6 aa, Staphylococcus
GEVGYS

SEQ ID NO: 1943600 - protein, 8 aa, Staphylococcus
GEVISPDD

SEQ ID NO: 1943601 - protein, 10 aa, Staphylococcus
GEVPERTEDY

SEQ ID NO: 1943602 - protein, 10 aa, Staphylococcus
GEVPNHPETF

SEQ ID NO: 1943603 - protein, 4 aa, Staphylococcus
GEVQ

SEQ ID NO: 1943604 - protein, 5 aa, Staphylococcus
GEVQG

SEQ ID NO: 1943605 - protein, 8 aa, Staphylococcus
GEVSENGM

SEQ ID NO: 1943606 - protein, 6 aa, Staphylococcus
GEVSND

SEQ ID NO: 1943607 - protein, 6 aa, Staphylococcus
GEVSNE

SEQ ID NO: 1943608 - protein, 15 aa, Staphylococcus
GEVTSGTQSPSSGKS

SEQ ID NO: 1943609 - protein, 21 aa, Staphylococcus
GEVTTNPIAGTIRRGTTPEID

SEQ ID NO: 1943610 - protein, 10 aa, Staphylococcus
GEVVERPGSV

SEQ ID NO: 1943611 - protein, 9 aa, Staphylococcus
GEVYDKDAR

SEQ ID NO: 1943612 - protein, 11 aa, Staphylococcus
GEYAPSNNDAI

SEQ ID NO: 1943613 - protein, 9 aa, Staphylococcus
GEYAPSTTE

SEQ ID NO: 1943614 - protein, 4 aa, Staphylococcus
GEYD

SEQ ID NO: 1943615 - protein, 4 aa, Staphylococcus
GEYE

SEQ ID NO: 1943616 - protein, 5 aa, Staphylococcus
GEYEV

SEQ ID NO: 1943617 - protein, 5 aa, Staphylococcus
GEYFD

SEQ ID NO: 1943618 - protein, 7 aa, Staphylococcus
GEYGDVE

SEQ ID NO: 1943619 - protein, 5 aa, Staphylococcus
GEYGP

SEQ ID NO: 1943620 - protein, 7 aa, Staphylococcus
GEYGPDL

SEQ ID NO: 1943621 - protein, 8 aa, Staphylococcus
GEYGPDLE

SEQ ID NO: 1943622 - protein, 12 aa, Staphylococcus
GEYKDLREQSAK

SEQ ID NO: 1943623 - protein, 13 aa, Staphylococcus
GEYKDLRKQSAEE

SEQ ID NO: 1943624 - protein, 13 aa, Staphylococcus
GEYKDLRQQSAEE

SEQ ID NO: 1943625 - protein, 4 aa, Staphylococcus
GEYQ

SEQ ID NO: 1943626 - protein, 9 aa, Staphylococcus
GEYQPEAHN

SEQ ID NO: 1943627 - protein, 10 aa, Staphylococcus
GEYQPEAHNY

SEQ ID NO: 1943628 - protein, 8 aa, Staphylococcus
GEYQPHAH

SEQ ID NO: 1943629 - protein, 14 aa, Staphylococcus
GEYSGNAWQGKKEN

SEQ ID NO: 1943630 - protein, 6 aa, Staphylococcus
GEYSMT

SEQ ID NO: 1943631 - protein, 5 aa, Staphylococcus
GFAEK

SEQ ID NO: 1943632 - protein, 8 aa, Staphylococcus
GFAHRDPG

SEQ ID NO: 1943633 - protein, 7 aa, Staphylococcus
GFAKNDN

SEQ ID NO: 1943634 - protein, 9 aa, Staphylococcus
GFASSQGNF

SEQ ID NO: 1943635 - protein, 4 aa, Staphylococcus
GFDE

SEQ ID NO: 1943636 - protein, 9 aa, Staphylococcus
GFDETTEMG

SEQ ID NO: 1943637 - protein, 5 aa, Staphylococcus
GFDKA

SEQ ID NO: 1943638 - protein, 5 aa, Staphylococcus
GFDKE

SEQ ID NO: 1943639 - protein, 7 aa, Staphylococcus
GFDKEYS

SEQ ID NO: 1943640 - protein, 8 aa, Staphylococcus
GFDKKYAD

SEQ ID NO: 1943641 - protein, 9 aa, Staphylococcus
GFDKSYSDK

SEQ ID NO: 1943642 - protein, 8 aa, Staphylococcus
GFDNEEEA

SEQ ID NO: 1943643 - protein, 4 aa, Staphylococcus
GFDP

SEQ ID NO: 1943644 - protein, 13 aa, Staphylococcus
GFDPVPLKKDKHR

SEQ ID NO: 1943645 - protein, 19 aa, Staphylococcus
GFDPVPLKKTKHKKDKNIN

SEQ ID NO: 1943646 - protein, 5 aa, Staphylococcus
GFDQQ

SEQ ID NO: 1943647 - protein, 8 aa, Staphylococcus
GFEDEADA

SEQ ID NO: 1943648 - protein, 12 aa, Staphylococcus
GFEIQTENETYN

SEQ ID NO: 1943649 - protein, 10 aa, Staphylococcus
GFEKPTPTHE

SEQ ID NO: 1943650 - protein, 5 aa, Staphylococcus
GFENN

SEQ ID NO: 1943651 - protein, 30 aa, Staphylococcus
GFENQADSLTYNKGEYKNSQMSSGDQRVDT

SEQ ID NO: 1943652 - protein, 6 aa, Staphylococcus
GFEPKR

SEQ ID NO: 1943653 - protein, 6 aa, Staphylococcus
GFGAGY

SEQ ID NO: 1943654 - protein, 14 aa, Staphylococcus
GFGGADDGQDYESI

SEQ ID NO: 1943655 - protein, 13 aa, Staphylococcus
GFGGGSEGHDYET

SEQ ID NO: 1943656 - protein, 12 aa, Staphylococcus
GFGGPRGGGRDR

SEQ ID NO: 1943657 - protein, 11 aa, Staphylococcus
GFGGRHGGRDR

SEQ ID NO: 1943658 - protein, 13 aa, Staphylococcus
GFGNNEEDQREGI

SEQ ID NO: 1943659 - protein, 10 aa, Staphylococcus
GFGNTATSID

SEQ ID NO: 1943660 - protein, 6 aa, Staphylococcus
GFGPNG

SEQ ID NO: 1943661 - protein, 7 aa, Staphylococcus
GFGPSGS

SEQ ID NO: 1943662 - protein, 8 aa, Staphylococcus
GFGSSKTY

SEQ ID NO: 1943663 - protein, 5 aa, Staphylococcus
GFHAR

SEQ ID NO: 1943664 - protein, 5 aa, Staphylococcus
GFHEP

SEQ ID NO: 1943665 - protein, 6 aa, Staphylococcus
GFISKG

SEQ ID NO: 1943666 - protein, 10 aa, Staphylococcus
GFKDGSYEKK

SEQ ID NO: 1943667 - protein, 7 aa, Staphylococcus
GFKEGLS

SEQ ID NO: 1943668 - protein, 10 aa, Staphylococcus
GFKEGLSKDY

SEQ ID NO: 1943669 - protein, 19 aa, Staphylococcus
GFKQGLQDYGGTPKEVLEN

SEQ ID NO: 1943670 - protein, 6 aa, Staphylococcus
GFKSGE

SEQ ID NO: 1943671 - protein, 5 aa, Staphylococcus
GFKSS

SEQ ID NO: 1943672 - protein, 4 aa, Staphylococcus
GFKT

SEQ ID NO: 1943673 - protein, 6 aa, Staphylococcus
GFKTEG

SEQ ID NO: 1943674 - protein, 8 aa, Staphylococcus
GFLPGNGA

SEQ ID NO: 1943675 - protein, 9 aa, Staphylococcus
GFNDEIDEG

SEQ ID NO: 1943676 - protein, 13 aa, Staphylococcus
GFNEKKIKELYSS

SEQ ID NO: 1943677 - protein, 10 aa, Staphylococcus
GFNIGEPDDA

SEQ ID NO: 1943678 - protein, 11 aa, Staphylococcus
GFNKDKKSIAD

SEQ ID NO: 1943679 - protein, 6 aa, Staphylococcus
GFNKPN

SEQ ID NO: 1943680 - protein, 5 aa, Staphylococcus
GFNNG

SEQ ID NO: 1943681 - protein, 13 aa, Staphylococcus
GFNPQSQPKGTGL

SEQ ID NO: 1943682 - protein, 20 aa, Staphylococcus
GFNSKKKQFTNLNSPQKRGV

SEQ ID NO: 1943683 - protein, 11 aa, Staphylococcus
GFNTGESETPI

SEQ ID NO: 1943684 - protein, 13 aa, Staphylococcus
GFPASSEGSFKSV

SEQ ID NO: 1943685 - protein, 4 aa, Staphylococcus
GFPD

SEQ ID NO: 1943686 - protein, 9 aa, Staphylococcus
GFPDSTLNY

SEQ ID NO: 1943687 - protein, 5 aa, Staphylococcus
GFPDT

SEQ ID NO: 1943688 - protein, 5 aa, Staphylococcus
GFPKE

SEQ ID NO: 1943689 - protein, 23 aa, Staphylococcus
GFPNVEKRPKPIYETSPIPQIPR

SEQ ID NO: 1943690 - protein, 4 aa, Staphylococcus
GFQK

SEQ ID NO: 1943691 - protein, 6 aa, Staphylococcus
GFQYTS

SEQ ID NO: 1943692 - protein, 11 aa, Staphylococcus
GFRGEASLQYK

SEQ ID NO: 1943693 - protein, 6 aa, Staphylococcus
GFSAQE

SEQ ID NO: 1943694 - protein, 8 aa, Staphylococcus
GFSDEAEA

SEQ ID NO: 1943695 - protein, 12 aa, Staphylococcus
GFSGAKRDRPEL

SEQ ID NO: 1943696 - protein, 11 aa, Staphylococcus
GFSGRVTKKDI

SEQ ID NO: 1943697 - protein, 30 aa, Staphylococcus
GFSNKDKSSITTERNWTDEHEPGLSAYEKS

SEQ ID NO: 1943698 - protein, 9 aa, Staphylococcus
GFSNSASYT

SEQ ID NO: 1943699 - protein, 7 aa, Staphylococcus
GFSNSSL

SEQ ID NO: 1943700 - protein, 17 aa, Staphylococcus
GFSPDHLRGDAEGRYGT

SEQ ID NO: 1943701 - protein, 17 aa, Staphylococcus
GFSPDNLRGDAEGRYGT

SEQ ID NO: 1943702 - protein, 11 aa, Staphylococcus
GFSPEDRQENI

SEQ ID NO: 1943703 - protein, 11 aa, Staphylococcus
GFSPEDRTENI

SEQ ID NO: 1943704 - protein, 9 aa, Staphylococcus
GFSSHTNFT

SEQ ID NO: 1943705 - protein, 8 aa, Staphylococcus
GFSSSKTY

SEQ ID NO: 1943706 - protein, 8 aa, Staphylococcus
GFTDEEKV

SEQ ID NO: 1943707 - protein, 10 aa, Staphylococcus
GFTDEKSEID

SEQ ID NO: 1943708 - protein, 5 aa, Staphylococcus
GFTDN

SEQ ID NO: 1943709 - protein, 11 aa, Staphylococcus
GFTDNKEEIES

SEQ ID NO: 1943710 - protein, 9 aa, Staphylococcus
GFTDNRDDI

SEQ ID NO: 1943711 - protein, 5 aa, Staphylococcus
GFTDS

SEQ ID NO: 1943712 - protein, 20 aa, Staphylococcus
GFTDSISSAFSSGNNVTQGV

SEQ ID NO: 1943713 - protein, 5 aa, Staphylococcus
GFTGE

SEQ ID NO: 1943714 - protein, 7 aa, Staphylococcus
GFTGTSG

SEQ ID NO: 1943715 - protein, 13 aa, Staphylococcus
GFTRTSVNMSKLP

SEQ ID NO: 1943716 - protein, 9 aa, Staphylococcus
GFTSPSMEH

SEQ ID NO: 1943717 - protein, 8 aa, Staphylococcus
GFTTNPSL

SEQ ID NO: 1943718 - protein, 16 aa, Staphylococcus
GFTTSENGKNKLESAN

SEQ ID NO: 1943719 - protein, 5 aa, Staphylococcus
GFTVG

SEQ ID NO: 1943720 - protein, 8 aa, Staphylococcus
GFYKNKAK

SEQ ID NO: 1943721 - protein, 10 aa, Staphylococcus
GFYNNKAKAI

SEQ ID NO: 1943722 - protein, 6 aa, Staphylococcus
GFYSAN

SEQ ID NO: 1943723 - protein, 12 aa, Staphylococcus
GFYSEGPAAEVE

SEQ ID NO: 1943724 - protein, 9 aa, Staphylococcus
GGADNACGA

SEQ ID NO: 1943725 - protein, 4 aa, Staphylococcus
GGAE

SEQ ID NO: 1943726 - protein, 7 aa, Staphylococcus
GGAEGYG

SEQ ID NO: 1943727 - protein, 4 aa, Staphylococcus
GGAK

SEQ ID NO: 1943728 - protein, 5 aa, Staphylococcus
GGAKD

SEQ ID NO: 1943729 - protein, 4 aa, Staphylococcus
GGAN

SEQ ID NO: 1943730 - protein, 9 aa, Staphylococcus
GGANGIGKG

SEQ ID NO: 1943731 - protein, 7 aa, Staphylococcus
GGAQGIG

SEQ ID NO: 1943732 - protein, 17 aa, Staphylococcus
GGAQRDPNVPRKGDDLQ

SEQ ID NO: 1943733 - protein, 5 aa, Staphylococcus
GGAQS

SEQ ID NO: 1943734 - protein, 22 aa, Staphylococcus
GGAQSLPNLTPGGDVAGPSPIS

SEQ ID NO: 1943735 - protein, 22 aa, Staphylococcus
GGAQSLPNLTPNGDVVAPSPIS

SEQ ID NO: 1943736 - protein, 10 aa, Staphylococcus
GGARSNSTFQ

SEQ ID NO: 1943737 - protein, 7 aa, Staphylococcus
GGASGIG

SEQ ID NO: 1943738 - protein, 9 aa, Staphylococcus
GGASKGEAI

SEQ ID NO: 1943739 - protein, 8 aa, Staphylococcus
GGASKGIA

SEQ ID NO: 1943740 - protein, 10 aa, Staphylococcus
GGASKGIANE

SEQ ID NO: 1943741 - protein, 9 aa, Staphylococcus
GGASKGIAT

SEQ ID NO: 1943742 - protein, 9 aa, Staphylococcus
GGASKGLAA

SEQ ID NO: 1943743 - protein, 9 aa, Staphylococcus
GGASKGLAN

SEQ ID NO: 1943744 - protein, 8 aa, Staphylococcus
GGATGGGY

SEQ ID NO: 1943745 - protein, 8 aa, Staphylococcus
GGATLNQN

SEQ ID NO: 1943746 - protein, 15 aa, Staphylococcus
GGATLNSHRNQEPIL

SEQ ID NO: 1943747 - protein, 14 aa, Staphylococcus
GGATLNSNRNNEQI

SEQ ID NO: 1943748 - protein, 7 aa, Staphylococcus
GGATPSI

SEQ ID NO: 1943749 - protein, 8 aa, Staphylococcus
GGATSTPT

SEQ ID NO: 1943750 - protein, 10 aa, Staphylococcus
GGAVAKRAKA

SEQ ID NO: 1943751 - protein, 10 aa, Staphylococcus
GGAVAKRARA

SEQ ID NO: 1943752 - protein, 8 aa, Staphylococcus
GGAYPTLK

SEQ ID NO: 1943753 - protein, 19 aa, Staphylococcus
GGCFSGKDPTKVDRSAAYA

SEQ ID NO: 1943754 - protein, 8 aa, Staphylococcus
GGDFETGL

SEQ ID NO: 1943755 - protein, 8 aa, Staphylococcus
GGDGDGYA

SEQ ID NO: 1943756 - protein, 4 aa, Staphylococcus
GGDH

SEQ ID NO: 1943757 - protein, 13 aa, Staphylococcus
GGDIQKEAYTGVG

SEQ ID NO: 1943758 - protein, 6 aa, Staphylococcus
GGDITR

SEQ ID NO: 1943759 - protein, 7 aa, Staphylococcus
GGDKDTL

SEQ ID NO: 1943760 - protein, 23 aa, Staphylococcus
GGDMSKEAYTGDGPHINSGELNG

SEQ ID NO: 1943761 - protein, 9 aa, Staphylococcus
GGDNLAATF

SEQ ID NO: 1943762 - protein, 6 aa, Staphylococcus
GGDNRI

SEQ ID NO: 1943763 - protein, 5 aa, Staphylococcus
GGDNT

SEQ ID NO: 1943764 - protein, 7 aa, Staphylococcus
GGDPDNV

SEQ ID NO: 1943765 - protein, 5 aa, Staphylococcus
GGDPI

SEQ ID NO: 1943766 - protein, 18 aa, Staphylococcus
GGDPTATGMGGESIYGEP

SEQ ID NO: 1943767 - protein, 18 aa, Staphylococcus
GGDPTATGMGGESIYGGP

SEQ ID NO: 1943768 - protein, 18 aa, Staphylococcus
GGDPTATGMGGESIYGGS

SEQ ID NO: 1943769 - protein, 19 aa, Staphylococcus
GGDPTATGMGGESIYGGSF

SEQ ID NO: 1943770 - protein, 9 aa, Staphylococcus
GGDSAIGRA

SEQ ID NO: 1943771 - protein, 9 aa, Staphylococcus
GGDSGETLH

SEQ ID NO: 1943772 - protein, 9 aa, Staphylococcus
GGDSGIGRA

SEQ ID NO: 1943773 - protein, 6 aa, Staphylococcus
GGDSIK

SEQ ID NO: 1943774 - protein, 19 aa, Staphylococcus
GGDTKAIERDEATAATTAY

SEQ ID NO: 1943775 - protein, 23 aa, Staphylococcus
GGDVQKEAYTGNGPHVNSGELNG

SEQ ID NO: 1943776 - protein, 7 aa, Staphylococcus
GGDYKEN

SEQ ID NO: 1943777 - protein, 7 aa, Staphylococcus
GGEAQLP

SEQ ID NO: 1943778 - protein, 6 aa, Staphylococcus
GGEAQR

SEQ ID NO: 1943779 - protein, 9 aa, Staphylococcus
GGEARQAVQ

SEQ ID NO: 1943780 - protein, 7 aa, Staphylococcus
GGEEAVT

SEQ ID NO: 1943781 - protein, 7 aa, Staphylococcus
GGEEKNR

SEQ ID NO: 1943782 - protein, 8 aa, Staphylococcus
GGEFRGGD

SEQ ID NO: 1943783 - protein, 6 aa, Staphylococcus
GGEGGM

SEQ ID NO: 1943784 - protein, 5 aa, Staphylococcus
GGEGN

SEQ ID NO: 1943785 - protein, 6 aa, Staphylococcus
GGEIGD

SEQ ID NO: 1943786 - protein, 5 aa, Staphylococcus
GGEII

SEQ ID NO: 1943787 - protein, 17 aa, Staphylococcus
GGEIPLDPNSTQNDELN

SEQ ID NO: 1943788 - protein, 8 aa, Staphylococcus
GGEKINPA

SEQ ID NO: 1943789 - protein, 9 aa, Staphylococcus
GGEKINPAL

SEQ ID NO: 1943790 - protein, 10 aa, Staphylococcus
GGEKKNPALE

SEQ ID NO: 1943791 - protein, 16 aa, Staphylococcus
GGEKTVISSGLETARE

SEQ ID NO: 1943792 - protein, 9 aa, Staphylococcus
GGEKVNPAL

SEQ ID NO: 1943793 - protein, 7 aa, Staphylococcus
GGELSNQ

SEQ ID NO: 1943794 - protein, 9 aa, Staphylococcus
GGENSTINM

SEQ ID NO: 1943795 - protein, 9 aa, Staphylococcus
GGENSTITM

SEQ ID NO: 1943796 - protein, 7 aa, Staphylococcus
GGENTTI

SEQ ID NO: 1943797 - protein, 14 aa, Staphylococcus
GGEQETKRRAGTEN

SEQ ID NO: 1943798 - protein, 8 aa, Staphylococcus
GGEQFNTH

SEQ ID NO: 1943799 - protein, 12 aa, Staphylococcus
GGEQFNTVPEEA

SEQ ID NO: 1943800 - protein, 8 aa, Staphylococcus
GGERVNPA

SEQ ID NO: 1943801 - protein, 11 aa, Staphylococcus
GGESKSEVESR

SEQ ID NO: 1943802 - protein, 12 aa, Staphylococcus
GGETNPESRYVS

SEQ ID NO: 1943803 - protein, 6 aa, Staphylococcus
GGETQL

SEQ ID NO: 1943804 - protein, 4 aa, Staphylococcus
GGFE

SEQ ID NO: 1943805 - protein, 9 aa, Staphylococcus
GGFEGGMSN

SEQ ID NO: 1943806 - protein, 10 aa, Staphylococcus
GGFEGGMSNG

SEQ ID NO: 1943807 - protein, 6 aa, Staphylococcus
GGFGAN

SEQ ID NO: 1943808 - protein, 10 aa, Staphylococcus
GGFKDGSFEK

SEQ ID NO: 1943809 - protein, 11 aa, Staphylococcus
GGFKDGSFESK

SEQ ID NO: 1943810 - protein, 11 aa, Staphylococcus
GGFKDGSYERK

SEQ ID NO: 1943811 - protein, 5 aa, Staphylococcus
GGFKN

SEQ ID NO: 1943812 - protein, 4 aa, Staphylococcus
GGFP

SEQ ID NO: 1943813 - protein, 5 aa, Staphylococcus
GGFRN

SEQ ID NO: 1943814 - protein, 6 aa, Staphylococcus
GGFSRK

SEQ ID NO: 1943815 - protein, 4 aa, Staphylococcus
GGFT

SEQ ID NO: 1943816 - protein, 7 aa, Staphylococcus
GGGAAKN

SEQ ID NO: 1943817 - protein, 6 aa, Staphylococcus
GGGAKS

SEQ ID NO: 1943818 - protein, 5 aa, Staphylococcus
GGGDH

SEQ ID NO: 1943819 - protein, 9 aa, Staphylococcus
GGGDIPRNT

SEQ ID NO: 1943820 - protein, 9 aa, Staphylococcus
GGGDNACGA

SEQ ID NO: 1943821 - protein, 37 aa, Staphylococcus
GGGFANSYRTTYAKANAAITSTRKSIDSNKALHGNAN

SEQ ID NO: 1943822 - protein, 9 aa, Staphylococcus
GGGFTGQAQ

SEQ ID NO: 1943823 - protein, 5 aa, Staphylococcus
GGGGA

SEQ ID NO: 1943824 - protein, 6 aa, Staphylococcus
GGGGIP

SEQ ID NO: 1943825 - protein, 8 aa, Staphylococcus
GGGIIENS

SEQ ID NO: 1943826 - protein, 9 aa, Staphylococcus
GGGKKAVDN

SEQ ID NO: 1943827 - protein, 10 aa, Staphylococcus
GGGLNKDNLP

SEQ ID NO: 1943828 - protein, 12 aa, Staphylococcus
GGGLQACGNSQN

SEQ ID NO: 1943829 - protein, 10 aa, Staphylococcus
GGGLSRTDEK

SEQ ID NO: 1943830 - protein, 4 aa, Staphylococcus
GGGM

SEQ ID NO: 1943831 - protein, 13 aa, Staphylococcus
GGGMGNAALFERW

SEQ ID NO: 1943832 - protein, 5 aa, Staphylococcus
GGGQA

SEQ ID NO: 1943833 - protein, 6 aa, Staphylococcus
GGGQAE

SEQ ID NO: 1943834 - protein, 10 aa, Staphylococcus
GGGQAELQLT

SEQ ID NO: 1943835 - protein, 9 aa, Staphylococcus
GGGQAELRL

SEQ ID NO: 1943836 - protein, 11 aa, Staphylococcus
GGGQEFGVRSG

SEQ ID NO: 1943837 - protein, 7 aa, Staphylococcus
GGGRGGS

SEQ ID NO: 1943838 - protein, 4 aa, Staphylococcus
GGGS

SEQ ID NO: 1943839 - protein, 6 aa, Staphylococcus
GGGSIP

SEQ ID NO: 1943840 - protein, 8 aa, Staphylococcus
GGGSNSIG

SEQ ID NO: 1943841 - protein, 7 aa, Staphylococcus
GGGTPTA

SEQ ID NO: 1943842 - protein, 9 aa, Staphylococcus
GGGTPTALS

SEQ ID NO: 1943843 - protein, 5 aa, Staphylococcus
GGGYA

SEQ ID NO: 1943844 - protein, 15 aa, Staphylococcus
GGGYTVSAARTERRI

SEQ ID NO: 1943845 - protein, 10 aa, Staphylococcus
GGHAEDLETA

SEQ ID NO: 1943846 - protein, 5 aa, Staphylococcus
GGHAP

SEQ ID NO: 1943847 - protein, 5 aa, Staphylococcus
GGHDN

SEQ ID NO: 1943848 - protein, 11 aa, Staphylococcus
GGHFTTDDGYD

SEQ ID NO: 1943849 - protein, 8 aa, Staphylococcus
GGHGTSMG

SEQ ID NO: 1943850 - protein, 9 aa, Staphylococcus
GGHKAGEIA

SEQ ID NO: 1943851 - protein, 10 aa, Staphylococcus
GGHKAGEVAS

SEQ ID NO: 1943852 - protein, 4 aa, Staphylococcus
GGHN

SEQ ID NO: 1943853 - protein, 8 aa, Staphylococcus
GGHQAGEI

SEQ ID NO: 1943854 - protein, 8 aa, Staphylococcus
GGHRAGEI

SEQ ID NO: 1943855 - protein, 4 aa, Staphylococcus
GGHS

SEQ ID NO: 1943856 - protein, 10 aa, Staphylococcus
GGHSEDPNIA

SEQ ID NO: 1943857 - protein, 50 aa, Staphylococcus
GGHSHDDSKEEAAEQQETKQQAATVSEEGTESASGDAPQTPTQDEEIDEN

SEQ ID NO: 1943858 - protein, 5 aa, Staphylococcus
GGHSN

SEQ ID NO: 1943859 - protein, 15 aa, Staphylococcus
GGHTNNKIRVSTTPV

SEQ ID NO: 1943860 - protein, 15 aa, Staphylococcus
GGHVTGPKDPNIQKI

SEQ ID NO: 1943861 - protein, 15 aa, Staphylococcus
GGHVTGPKDPNIQQI

SEQ ID NO: 1943862 - protein, 16 aa, Staphylococcus
GGIATYGKDPETKGEL

SEQ ID NO: 1943863 - protein, 12 aa, Staphylococcus
GGIDPRRRGETL

SEQ ID NO: 1943864 - protein, 7 aa, Staphylococcus
GGIDSPV

SEQ ID NO: 1943865 - protein, 4 aa, Staphylococcus
GGIE

SEQ ID NO: 1943866 - protein, 9 aa, Staphylococcus
GGIEPATSE

SEQ ID NO: 1943867 - protein, 7 aa, Staphylococcus
GGIESHG

SEQ ID NO: 1943868 - protein, 4 aa, Staphylococcus
GGIG

SEQ ID NO: 1943869 - protein, 5 aa, Staphylococcus
GGIIE

SEQ ID NO: 1943870 - protein, 7 aa, Staphylococcus
GGIIENK

SEQ ID NO: 1943871 - protein, 7 aa, Staphylococcus
GGIKTGK

SEQ ID NO: 1943872 - protein, 6 aa, Staphylococcus
GGINDQ

SEQ ID NO: 1943873 - protein, 10 aa, Staphylococcus
GGINDSTSKY

SEQ ID NO: 1943874 - protein, 5 aa, Staphylococcus
GGINE

SEQ ID NO: 1943875 - protein, 6 aa, Staphylococcus
GGINNE

SEQ ID NO: 1943876 - protein, 8 aa, Staphylococcus
GGINNNTV

SEQ ID NO: 1943877 - protein, 10 aa, Staphylococcus
GGINTPETAL

SEQ ID NO: 1943878 - protein, 5 aa, Staphylococcus
GGIPD

SEQ ID NO: 1943879 - protein, 5 aa, Staphylococcus
GGIPI

SEQ ID NO: 1943880 - protein, 12 aa, Staphylococcus
GGIRSESERPLT

SEQ ID NO: 1943881 - protein, 13 aa, Staphylococcus
GGIRSKEDLERLE

SEQ ID NO: 1943882 - protein, 8 aa, Staphylococcus
GGIRTHGD

SEQ ID NO: 1943883 - protein, 9 aa, Staphylococcus
GGISSTDDI

SEQ ID NO: 1943884 - protein, 6 aa, Staphylococcus
GGISTI

SEQ ID NO: 1943885 - protein, 4 aa, Staphylococcus
GGIT

SEQ ID NO: 1943886 - protein, 8 aa, Staphylococcus
GGITKMDG

SEQ ID NO: 1943887 - protein, 12 aa, Staphylococcus
GGIYTNEDRYTP

SEQ ID NO: 1943888 - protein, 7 aa, Staphylococcus
GGKAANI

SEQ ID NO: 1943889 - protein, 8 aa, Staphylococcus
GGKAANII

SEQ ID NO: 1943890 - protein, 9 aa, Staphylococcus
GGKAAYPST

SEQ ID NO: 1943891 - protein, 7 aa, Staphylococcus
GGKAELD

SEQ ID NO: 1943892 - protein, 8 aa, Staphylococcus
GGKAIEEG

SEQ ID NO: 1943893 - protein, 7 aa, Staphylococcus
GGKAQLA

SEQ ID NO: 1943894 - protein, 19 aa, Staphylococcus
GGKASGRGVVSTASYEARQ

SEQ ID NO: 1943895 - protein, 19 aa, Staphylococcus
GGKASSRGVVSTASYEARK

SEQ ID NO: 1943896 - protein, 8 aa, Staphylococcus
GGKEAAQR

SEQ ID NO: 1943897 - protein, 8 aa, Staphylococcus
GGKEEAAH

SEQ ID NO: 1943898 - protein, 9 aa, Staphylococcus
GGKEGAERI

SEQ ID NO: 1943899 - protein, 4 aa, Staphylococcus
GGKF

SEQ ID NO: 1943900 - protein, 12 aa, Staphylococcus
GGKFGKVLITLQ

SEQ ID NO: 1943901 - protein, 9 aa, Staphylococcus
GGKFNKGDI

SEQ ID NO: 1943902 - protein, 9 aa, Staphylococcus
GGKFSESAI

SEQ ID NO: 1943903 - protein, 8 aa, Staphylococcus
GGKGANLA

SEQ ID NO: 1943904 - protein, 22 aa, Staphylococcus
GGKGGGRPDMAQGGGTQPENIT

SEQ ID NO: 1943905 - protein, 23 aa, Staphylococcus
GGKGGGRPDMAQGGGTQPENITE

SEQ ID NO: 1943906 - protein, 8 aa, Staphylococcus
GGKGGIDL

SEQ ID NO: 1943907 - protein, 6 aa, Staphylococcus
GGKGQM

SEQ ID NO: 1943908 - protein, 11 aa, Staphylococcus
GGKGQVGKVRT

SEQ ID NO: 1943909 - protein, 7 aa, Staphylococcus
GGKGRRA

SEQ ID NO: 1943910 - protein, 10 aa, Staphylococcus
GGKGSQSAVN

SEQ ID NO: 1943911 - protein, 9 aa, Staphylococcus
GGKIDEGET

SEQ ID NO: 1943912 - protein, 15 aa, Staphylococcus
GGKITQVSYETPSKL

SEQ ID NO: 1943913 - protein, 10 aa, Staphylococcus
GGKKGLGKTV

SEQ ID NO: 1943914 - protein, 20 aa, Staphylococcus
GGKLDISDEDLRTLDAAKDL

SEQ ID NO: 1943915 - protein, 15 aa, Staphylococcus
GGKLTQVSYETPSRL

SEQ ID NO: 1943916 - protein, 11 aa, Staphylococcus
GGKLYNSSKYN

SEQ ID NO: 1943917 - protein, 10 aa, Staphylococcus
GGKNGLTKSV

SEQ ID NO: 1943918 - protein, 9 aa, Staphylococcus
GGKNSAVDA

SEQ ID NO: 1943919 - protein, 9 aa, Staphylococcus
GGKPEASGH

SEQ ID NO: 1943920 - protein, 15 aa, Staphylococcus
GGKPLAEAKGEVAYA

SEQ ID NO: 1943921 - protein, 14 aa, Staphylococcus
GGKQFNSVPDEASI

SEQ ID NO: 1943922 - protein, 8 aa, Staphylococcus
GGKQPTDI

SEQ ID NO: 1943923 - protein, 9 aa, Staphylococcus
GGKQRTDKR

SEQ ID NO: 1943924 - protein, 15 aa, Staphylococcus
GGKRTDKYGEEISGQ

SEQ ID NO: 1943925 - protein, 9 aa, Staphylococcus
GGKSKGEAI

SEQ ID NO: 1943926 - protein, 9 aa, Staphylococcus
GGKSKGQAI

SEQ ID NO: 1943927 - protein, 10 aa, Staphylococcus
GGKSPDSGHE

SEQ ID NO: 1943928 - protein, 9 aa, Staphylococcus
GGKTDYGVN

SEQ ID NO: 1943929 - protein, 18 aa, Staphylococcus
GGKTGTAQVADPDNGGYV

SEQ ID NO: 1943930 - protein, 22 aa, Staphylococcus
GGKTIKMSNEEVEVSKPVSKDN

SEQ ID NO: 1943931 - protein, 22 aa, Staphylococcus
GGKTINAKTEEIEVSKSVTKDH

SEQ ID NO: 1943932 - protein, 9 aa, Staphylococcus
GGKTINMTT

SEQ ID NO: 1943933 - protein, 17 aa, Staphylococcus
GGKTKKEKVHITYQTLF

SEQ ID NO: 1943934 - protein, 12 aa, Staphylococcus
GGKVEEGEQSIQ

SEQ ID NO: 1943935 - protein, 14 aa, Staphylococcus
GGKVNHNETMNETA

SEQ ID NO: 1943936 - protein, 21 aa, Staphylococcus
GGKVPDSMKSSQNNSLPSNTM

SEQ ID NO: 1943937 - protein, 36 aa, Staphylococcus
GGKVPNSMKSSHNTNVASSNTMVTDDEIGNGDSIFD

SEQ ID NO: 1943938 - protein, 5 aa, Staphylococcus
GGKYI

SEQ ID NO: 1943939 - protein, 18 aa, Staphylococcus
GGKYTEEEIDFGESVGRE

SEQ ID NO: 1943940 - protein, 13 aa, Staphylococcus
GGLEDKSGTGEIK

SEQ ID NO: 1943941 - protein, 8 aa, Staphylococcus
GGLEGGGI

SEQ ID NO: 1943942 - protein, 7 aa, Staphylococcus
GGLGADQ

SEQ ID NO: 1943943 - protein, 7 aa, Staphylococcus
GGLGKGI

SEQ ID NO: 1943944 - protein, 5 aa, Staphylococcus
GGLHN

SEQ ID NO: 1943945 - protein, 5 aa, Staphylococcus
GGLNK

SEQ ID NO: 1943946 - protein, 6 aa, Staphylococcus
GGLNPY

SEQ ID NO: 1943947 - protein, 8 aa, Staphylococcus
GGLPESVP

SEQ ID NO: 1943948 - protein, 13 aa, Staphylococcus
GGLPNKEPKIQEQ

SEQ ID NO: 1943949 - protein, 14 aa, Staphylococcus
GGLPNKEPKIQEQW

SEQ ID NO: 1943950 - protein, 13 aa, Staphylococcus
GGLPNKEPQIQEK

SEQ ID NO: 1943951 - protein, 13 aa, Staphylococcus
GGLPNKEPQIQEQ

SEQ ID NO: 1943952 - protein, 10 aa, Staphylococcus
GGLPVGTGGK

SEQ ID NO: 1943953 - protein, 4 aa, Staphylococcus
GGLQ

SEQ ID NO: 1943954 - protein, 7 aa, Staphylococcus
GGLRTPL

SEQ ID NO: 1943955 - protein, 4 aa, Staphylococcus
GGLS

SEQ ID NO: 1943956 - protein, 10 aa, Staphylococcus
GGLSEATPAF

SEQ ID NO: 1943957 - protein, 9 aa, Staphylococcus
GGLSGPAIK

SEQ ID NO: 1943958 - protein, 5 aa, Staphylococcus
GGLYG

SEQ ID NO: 1943959 - protein, 6 aa, Staphylococcus
GGMAGT

SEQ ID NO: 1943960 - protein, 11 aa, Staphylococcus
GGMDEASLSGD

SEQ ID NO: 1943961 - protein, 4 aa, Staphylococcus
GGME

SEQ ID NO: 1943962 - protein, 4 aa, Staphylococcus
GGMK

SEQ ID NO: 1943963 - protein, 15 aa, Staphylococcus
GGMNEWGDEGTVIDS

SEQ ID NO: 1943964 - protein, 4 aa, Staphylococcus
GGMS

SEQ ID NO: 1943965 - protein, 7 aa, Staphylococcus
GGMTNAS

SEQ ID NO: 1943966 - protein, 6 aa, Staphylococcus
GGMTQA

SEQ ID NO: 1943967 - protein, 9 aa, Staphylococcus
GGMTSPANA

SEQ ID NO: 1943968 - protein, 6 aa, Staphylococcus
GGNAKF

SEQ ID NO: 1943969 - protein, 8 aa, Staphylococcus
GGNAKSLA

SEQ ID NO: 1943970 - protein, 9 aa, Staphylococcus
GGNGAGKTT

SEQ ID NO: 1943971 - protein, 6 aa, Staphylococcus
GGNGGM

SEQ ID NO: 1943972 - protein, 13 aa, Staphylococcus
GGNHVTSQNPEVN

SEQ ID NO: 1943973 - protein, 14 aa, Staphylococcus
GGNHVTSQNPEVNY

SEQ ID NO: 1943974 - protein, 4 aa, Staphylococcus
GGNI

SEQ ID NO: 1943975 - protein, 10 aa, Staphylococcus
GGNIEAGTTE

SEQ ID NO: 1943976 - protein, 21 aa, Staphylococcus
GGNIEQGTTEATKALAEKGNY

SEQ ID NO: 1943977 - protein, 8 aa, Staphylococcus
GGNLQSTS

SEQ ID NO: 1943978 - protein, 6 aa, Staphylococcus
GGNNNG

SEQ ID NO: 1943979 - protein, 6 aa, Staphylococcus
GGNPAK

SEQ ID NO: 1943980 - protein, 15 aa, Staphylococcus
GGNQVNSVPDMATTD

SEQ ID NO: 1943981 - protein, 6 aa, Staphylococcus
GGNRNG

SEQ ID NO: 1943982 - protein, 7 aa, Staphylococcus
GGNSNNI

SEQ ID NO: 1943983 - protein, 6 aa, Staphylococcus
GGNTHH

SEQ ID NO: 1943984 - protein, 8 aa, Staphylococcus
GGNTNIDG

SEQ ID NO: 1943985 - protein, 20 aa, Staphylococcus
GGNTNYQDTIRRNKALAQSG

SEQ ID NO: 1943986 - protein, 20 aa, Staphylococcus
GGNTNYQDTIRRNKTLAESG

SEQ ID NO: 1943987 - protein, 6 aa, Staphylococcus
GGNTSR

SEQ ID NO: 1943988 - protein, 6 aa, Staphylococcus
GGNTTS

SEQ ID NO: 1943989 - protein, 10 aa, Staphylococcus
GGNTVDPSIR

SEQ ID NO: 1943990 - protein, 6 aa, Staphylococcus
GGNVDL

SEQ ID NO: 1943991 - protein, 31 aa, Staphylococcus
GGNVQEEAYTGEGAHINSGELDGLDNKEAIS

SEQ ID NO: 1943992 - protein, 10 aa, Staphylococcus
GGNVSGAGTD

SEQ ID NO: 1943993 - protein, 12 aa, Staphylococcus
GGNVSGAGTDTI

SEQ ID NO: 1943994 - protein, 6 aa, Staphylococcus
GGNYEN

SEQ ID NO: 1943995 - protein, 10 aa, Staphylococcus
GGPASGSAAV

SEQ ID NO: 1943996 - protein, 9 aa, Staphylococcus
GGPASGTAA

SEQ ID NO: 1943997 - protein, 7 aa, Staphylococcus
GGPEQLD

SEQ ID NO: 1943998 - protein, 19 aa, Staphylococcus
GGPEQLPSLKSHANDPAYE

SEQ ID NO: 1943999 - protein, 9 aa, Staphylococcus
GGPGKPEGL

SEQ ID NO: 1944000 - protein, 10 aa, Staphylococcus
GGPGKPEGLD

SEQ ID NO: 1944001 - protein, 10 aa, Staphylococcus
GGPGKPEGLE

SEQ ID NO: 1944002 - protein, 11 aa, Staphylococcus
GGPGKPEGLNT

SEQ ID NO: 1944003 - protein, 4 aa, Staphylococcus
GGPI

SEQ ID NO: 1944004 - protein, 5 aa, Staphylococcus
GGPIR

SEQ ID NO: 1944005 - protein, 15 aa, Staphylococcus
GGPKWNDHPKRPEAG

SEQ ID NO: 1944006 - protein, 15 aa, Staphylococcus
GGPKWNDPNNRPEQG

SEQ ID NO: 1944007 - protein, 15 aa, Staphylococcus
GGPKWSNPKNRPEHG

SEQ ID NO: 1944008 - protein, 15 aa, Staphylococcus
GGPKWTDPKVRPEQG

SEQ ID NO: 1944009 - protein, 15 aa, Staphylococcus
GGPQWTDPNNRPEQG

SEQ ID NO: 1944010 - protein, 4 aa, Staphylococcus
GGPS

SEQ ID NO: 1944011 - protein, 9 aa, Staphylococcus
GGPSSRTQR

SEQ ID NO: 1944012 - protein, 12 aa, Staphylococcus
GGPTNGVPREDG

SEQ ID NO: 1944013 - protein, 4 aa, Staphylococcus
GGPV

SEQ ID NO: 1944014 - protein, 6 aa, Staphylococcus
GGQAHI

SEQ ID NO: 1944015 - protein, 11 aa, Staphylococcus
GGQDEAAYEES

SEQ ID NO: 1944016 - protein, 10 aa, Staphylococcus
GGQEYGIRSG

SEQ ID NO: 1944017 - protein, 11 aa, Staphylococcus
GGQEYGVRSGT

SEQ ID NO: 1944018 - protein, 12 aa, Staphylococcus
GGQEYGVRSGTV

SEQ ID NO: 1944019 - protein, 13 aa, Staphylococcus
GGQGIATAVSYYK

SEQ ID NO: 1944020 - protein, 14 aa, Staphylococcus
GGQGIATVVSHYEE

SEQ ID NO: 1944021 - protein, 11 aa, Staphylococcus
GGQGIGTNPDE

SEQ ID NO: 1944022 - protein, 8 aa, Staphylococcus
GGQGKLKG

SEQ ID NO: 1944023 - protein, 17 aa, Staphylococcus
GGQGTRLGYKGPKGSFE

SEQ ID NO: 1944024 - protein, 17 aa, Staphylococcus
GGQGTRLGYQGPKGSFE

SEQ ID NO: 1944025 - protein, 11 aa, Staphylococcus
GGQIENGETIR

SEQ ID NO: 1944026 - protein, 14 aa, Staphylococcus
GGQITSKSYAKNDK

SEQ ID NO: 1944027 - protein, 6 aa, Staphylococcus
GGQKQR

SEQ ID NO: 1944028 - protein, 7 aa, Staphylococcus
GGQMAKT

SEQ ID NO: 1944029 - protein, 7 aa, Staphylococcus
GGQPNTM

SEQ ID NO: 1944030 - protein, 5 aa, Staphylococcus
GGQRG

SEQ ID NO: 1944031 - protein, 9 aa, Staphylococcus
GGQSAERKR

SEQ ID NO: 1944032 - protein, 13 aa, Staphylococcus
GGQVADEGTIGND

SEQ ID NO: 1944033 - protein, 14 aa, Staphylococcus
GGQVADHGTVGNDN

SEQ ID NO: 1944034 - protein, 10 aa, Staphylococcus
GGQVADKGIV

SEQ ID NO: 1944035 - protein, 13 aa, Staphylococcus
GGQVADKGTVGND

SEQ ID NO: 1944036 - protein, 14 aa, Staphylococcus
GGQVADKGTVGNEN

SEQ ID NO: 1944037 - protein, 14 aa, Staphylococcus
GGQVADQGTISNEN

SEQ ID NO: 1944038 - protein, 14 aa, Staphylococcus
GGQVADQGTVSNEN

SEQ ID NO: 1944039 - protein, 9 aa, Staphylococcus
GGQVNDTAG

SEQ ID NO: 1944040 - protein, 4 aa, Staphylococcus
GGQY

SEQ ID NO: 1944041 - protein, 8 aa, Staphylococcus
GGRDAAER

SEQ ID NO: 1944042 - protein, 6 aa, Staphylococcus
GGRDSS

SEQ ID NO: 1944043 - protein, 11 aa, Staphylococcus
GGREAAQRIKQ

SEQ ID NO: 1944044 - protein, 8 aa, Staphylococcus
GGREASER

SEQ ID NO: 1944045 - protein, 5 aa, Staphylococcus
GGREV

SEQ ID NO: 1944046 - protein, 12 aa, Staphylococcus
GGRGPQQDISAY

SEQ ID NO: 1944047 - protein, 7 aa, Staphylococcus
GGRGQER

SEQ ID NO: 1944048 - protein, 7 aa, Staphylococcus
GGRGRRA

SEQ ID NO: 1944049 - protein, 7 aa, Staphylococcus
GGRIGRA

SEQ ID NO: 1944050 - protein, 5 aa, Staphylococcus
GGRIT

SEQ ID NO: 1944051 - protein, 7 aa, Staphylococcus
GGRLPGD

SEQ ID NO: 1944052 - protein, 8 aa, Staphylococcus
GGRLPGGV

SEQ ID NO: 1944053 - protein, 5 aa, Staphylococcus
GGRLT

SEQ ID NO: 1944054 - protein, 11 aa, Staphylococcus
GGRNDEFEGER

SEQ ID NO: 1944055 - protein, 5 aa, Staphylococcus
GGRNF

SEQ ID NO: 1944056 - protein, 5 aa, Staphylococcus
GGRNY

SEQ ID NO: 1944057 - protein, 18 aa, Staphylococcus
GGRQQRDPNAPRKGDDLQ

SEQ ID NO: 1944058 - protein, 6 aa, Staphylococcus
GGRSAQ

SEQ ID NO: 1944059 - protein, 17 aa, Staphylococcus
GGRTKKDKIHINYRTLF

SEQ ID NO: 1944060 - protein, 17 aa, Staphylococcus
GGRTKKDKLHITYQTLF

SEQ ID NO: 1944061 - protein, 17 aa, Staphylococcus
GGRTKKDKYYITYQTLF

SEQ ID NO: 1944062 - protein, 5 aa, Staphylococcus
GGRTT

SEQ ID NO: 1944063 - protein, 11 aa, Staphylococcus
GGRVGTQIQQA

SEQ ID NO: 1944064 - protein, 9 aa, Staphylococcus
GGRVSKTKG

SEQ ID NO: 1944065 - protein, 9 aa, Staphylococcus
GGSAGSVLG

SEQ ID NO: 1944066 - protein, 7 aa, Staphylococcus
GGSAPDI

SEQ ID NO: 1944067 - protein, 10 aa, Staphylococcus
GGSARNTARI

SEQ ID NO: 1944068 - protein, 10 aa, Staphylococcus
GGSDGTIGTS

SEQ ID NO: 1944069 - protein, 11 aa, Staphylococcus
GGSEGRDRSTA

SEQ ID NO: 1944070 - protein, 8 aa, Staphylococcus
GGSFKAET

SEQ ID NO: 1944071 - protein, 5 aa, Staphylococcus
GGSGE

SEQ ID NO: 1944072 - protein, 8 aa, Staphylococcus
GGSGHEPA

SEQ ID NO: 1944073 - protein, 8 aa, Staphylococcus
GGSGHEPG

SEQ ID NO: 1944074 - protein, 9 aa, Staphylococcus
GGSIDTYRQ

SEQ ID NO: 1944075 - protein, 16 aa, Staphylococcus
GGSKATTEAIEGAEDN

SEQ ID NO: 1944076 - protein, 7 aa, Staphylococcus
GGSLAGS

SEQ ID NO: 1944077 - protein, 8 aa, Staphylococcus
GGSLAGSL

SEQ ID NO: 1944078 - protein, 6 aa, Staphylococcus
GGSLYE

SEQ ID NO: 1944079 - protein, 8 aa, Staphylococcus
GGSMGKFT

SEQ ID NO: 1944080 - protein, 7 aa, Staphylococcus
GGSNGLD

SEQ ID NO: 1944081 - protein, 11 aa, Staphylococcus
GGSQGRDRATA

SEQ ID NO: 1944082 - protein, 8 aa, Staphylococcus
GGSREHEM

SEQ ID NO: 1944083 - protein, 18 aa, Staphylococcus
GGSRQRDPNAPRKGDDLQ

SEQ ID NO: 1944084 - protein, 7 aa, Staphylococcus
GGSSGIG

SEQ ID NO: 1944085 - protein, 9 aa, Staphylococcus
GGSSGIGKA

SEQ ID NO: 1944086 - protein, 9 aa, Staphylococcus
GGSTETSYF

SEQ ID NO: 1944087 - protein, 9 aa, Staphylococcus
GGSTGGGLT

SEQ ID NO: 1944088 - protein, 5 aa, Staphylococcus
GGSTN

SEQ ID NO: 1944089 - protein, 10 aa, Staphylococcus
GGSTRQSIEE

SEQ ID NO: 1944090 - protein, 5 aa, Staphylococcus
GGSVA

SEQ ID NO: 1944091 - protein, 20 aa, Staphylococcus
GGSVGAQAGGKVEASARGIE

SEQ ID NO: 1944092 - protein, 11 aa, Staphylococcus
GGSVNNPETSS

SEQ ID NO: 1944093 - protein, 12 aa, Staphylococcus
GGSVNNPETSSY

SEQ ID NO: 1944094 - protein, 7 aa, Staphylococcus
GGTAGYV

SEQ ID NO: 1944095 - protein, 6 aa, Staphylococcus
GGTANE

SEQ ID NO: 1944096 - protein, 7 aa, Staphylococcus
GGTANKY

SEQ ID NO: 1944097 - protein, 11 aa, Staphylococcus
GGTDDGGIGTS

SEQ ID NO: 1944098 - protein, 9 aa, Staphylococcus
GGTEEADGQ

SEQ ID NO: 1944099 - protein, 11 aa, Staphylococcus
GGTEMSTDEQI

SEQ ID NO: 1944100 - protein, 20 aa, Staphylococcus
GGTEMTTEEKIASGLNDSNV

SEQ ID NO: 1944101 - protein, 5 aa, Staphylococcus
GGTFG

SEQ ID NO: 1944102 - protein, 4 aa, Staphylococcus
GGTI

SEQ ID NO: 1944103 - protein, 5 aa, Staphylococcus
GGTIV

SEQ ID NO: 1944104 - protein, 4 aa, Staphylococcus
GGTL

SEQ ID NO: 1944105 - protein, 9 aa, Staphylococcus
GGTLASNND

SEQ ID NO: 1944106 - protein, 11 aa, Staphylococcus
GGTNGKGSTVS

SEQ ID NO: 1944107 - protein, 7 aa, Staphylococcus
GGTNWND

SEQ ID NO: 1944108 - protein, 9 aa, Staphylococcus
GGTPESSIR

SEQ ID NO: 1944109 - protein, 9 aa, Staphylococcus
GGTPESSLR

SEQ ID NO: 1944110 - protein, 5 aa, Staphylococcus
GGTPL

SEQ ID NO: 1944111 - protein, 8 aa, Staphylococcus
GGTPTALS

SEQ ID NO: 1944112 - protein, 11 aa, Staphylococcus
GGTPTALSTQQ

SEQ ID NO: 1944113 - protein, 6 aa, Staphylococcus
GGTQFE

SEQ ID NO: 1944114 - protein, 7 aa, Staphylococcus
GGTQTNQ

SEQ ID NO: 1944115 - protein, 9 aa, Staphylococcus
GGTRGFKAG

SEQ ID NO: 1944116 - protein, 10 aa, Staphylococcus
GGTRGYSQGH

SEQ ID NO: 1944117 - protein, 10 aa, Staphylococcus
GGTRPKSTKW

SEQ ID NO: 1944118 - protein, 11 aa, Staphylococcus
GGTSDKEDRYI

SEQ ID NO: 1944119 - protein, 7 aa, Staphylococcus
GGTSGLG

SEQ ID NO: 1944120 - protein, 7 aa, Staphylococcus
GGTSNEF

SEQ ID NO: 1944121 - protein, 8 aa, Staphylococcus
GGTSNRYR

SEQ ID NO: 1944122 - protein, 22 aa, Staphylococcus
GGTTFESAKAGVEANYDKDLTD

SEQ ID NO: 1944123 - protein, 5 aa, Staphylococcus
GGTTK

SEQ ID NO: 1944124 - protein, 9 aa, Staphylococcus
GGTTTGRIP

SEQ ID NO: 1944125 - protein, 5 aa, Staphylococcus
GGTVA

SEQ ID NO: 1944126 - protein, 6 aa, Staphylococcus
GGTVGD

SEQ ID NO: 1944127 - protein, 9 aa, Staphylococcus
GGTVQEEVG

SEQ ID NO: 1944128 - protein, 6 aa, Staphylococcus
GGVDPS

SEQ ID NO: 1944129 - protein, 7 aa, Staphylococcus
GGVEETQ

SEQ ID NO: 1944130 - protein, 4 aa, Staphylococcus
GGVF

SEQ ID NO: 1944131 - protein, 4 aa, Staphylococcus
GGVG

SEQ ID NO: 1944132 - protein, 5 aa, Staphylococcus
GGVGI

SEQ ID NO: 1944133 - protein, 5 aa, Staphylococcus
GGVGL

SEQ ID NO: 1944134 - protein, 12 aa, Staphylococcus
GGVHKGAEETMD

SEQ ID NO: 1944135 - protein, 9 aa, Staphylococcus
GGVIGDGNK

SEQ ID NO: 1944136 - protein, 4 aa, Staphylococcus
GGVP

SEQ ID NO: 1944137 - protein, 6 aa, Staphylococcus
GGVPSI

SEQ ID NO: 1944138 - protein, 7 aa, Staphylococcus
GGVRNPL

SEQ ID NO: 1944139 - protein, 4 aa, Staphylococcus
GGVS

SEQ ID NO: 1944140 - protein, 8 aa, Staphylococcus
GGVSEETR

SEQ ID NO: 1944141 - protein, 8 aa, Staphylococcus
GGVTDPDQ

SEQ ID NO: 1944142 - protein, 8 aa, Staphylococcus
GGVTNPDQ

SEQ ID NO: 1944143 - protein, 18 aa, Staphylococcus
GGVTQSKLPYKSSIENYA

SEQ ID NO: 1944144 - protein, 9 aa, Staphylococcus
GGVTTTAYG

SEQ ID NO: 1944145 - protein, 14 aa, Staphylococcus
GGVYPEKESEGTLT

SEQ ID NO: 1944146 - protein, 12 aa, Staphylococcus
GGVYTNDDRYTP

SEQ ID NO: 1944147 - protein, 7 aa, Staphylococcus
GGWPEEI

SEQ ID NO: 1944148 - protein, 13 aa, Staphylococcus
GGYATKEADGTIE

SEQ ID NO: 1944149 - protein, 13 aa, Staphylococcus
GGYATNKENGEIE

SEQ ID NO: 1944150 - protein, 5 aa, Staphylococcus
GGYDA

SEQ ID NO: 1944151 - protein, 8 aa, Staphylococcus
GGYDGKGQ

SEQ ID NO: 1944152 - protein, 4 aa, Staphylococcus
GGYE

SEQ ID NO: 1944153 - protein, 13 aa, Staphylococcus
GGYEGRKLQAGDA

SEQ ID NO: 1944154 - protein, 14 aa, Staphylococcus
GGYKNQSRDVPQSE

SEQ ID NO: 1944155 - protein, 13 aa, Staphylococcus
GGYKTSKRGGLRI

SEQ ID NO: 1944156 - protein, 8 aa, Staphylococcus
GGYLDGDR

SEQ ID NO: 1944157 - protein, 9 aa, Staphylococcus
GGYNGSVSG

SEQ ID NO: 1944158 - protein, 4 aa, Staphylococcus
GGYP

SEQ ID NO: 1944159 - protein, 11 aa, Staphylococcus
GGYSRDEANKI

SEQ ID NO: 1944160 - protein, 16 aa, Staphylococcus
GGYSRDEANKLLKDND

SEQ ID NO: 1944161 - protein, 11 aa, Staphylococcus
GGYSREHANEV

SEQ ID NO: 1944162 - protein, 12 aa, Staphylococcus
GGYTDQQTYNEA

SEQ ID NO: 1944163 - protein, 7 aa, Staphylococcus
GHAAGIP

SEQ ID NO: 1944164 - protein, 27 aa, Staphylococcus
GHAGAQGGFGSQGFGGGDFGGFSGGGF

SEQ ID NO: 1944165 - protein, 12 aa, Staphylococcus
GHAGQSLGAFAP

SEQ ID NO: 1944166 - protein, 4 aa, Staphylococcus
GHAP

SEQ ID NO: 1944167 - protein, 11 aa, Staphylococcus
GHAPYKQNKSG

SEQ ID NO: 1944168 - protein, 6 aa, Staphylococcus
GHAQGT

SEQ ID NO: 1944169 - protein, 10 aa, Staphylococcus
GHAYNPDNAY

SEQ ID NO: 1944170 - protein, 4 aa, Staphylococcus
GHDA

SEQ ID NO: 1944171 - protein, 4 aa, Staphylococcus
GHDD

SEQ ID NO: 1944172 - protein, 40 aa, Staphylococcus
GHDDDDASSKEEEPAKEEAKTEETPAASTSQDEKVDENRR

SEQ ID NO: 1944173 - protein, 45 aa, Staphylococcus
GHDDDSSAKEEPAKEEAKAETEEAPAASASQDEEVDENRKIKAMP

SEQ ID NO: 1944174 - protein, 8 aa, Staphylococcus
GHDERDHE

SEQ ID NO: 1944175 - protein, 9 aa, Staphylococcus
GHDERDHEF

SEQ ID NO: 1944176 - protein, 8 aa, Staphylococcus
GHDIDDNV

SEQ ID NO: 1944177 - protein, 5 aa, Staphylococcus
GHDNP

SEQ ID NO: 1944178 - protein, 11 aa, Staphylococcus
GHDRYGKTYEG

SEQ ID NO: 1944179 - protein, 5 aa, Staphylococcus
GHDVS

SEQ ID NO: 1944180 - protein, 30 aa, Staphylococcus
GHECDSDSNAKIDSDTLDDTKKDVDDKKKE

SEQ ID NO: 1944181 - protein, 10 aa, Staphylococcus
GHEERDKEAQ

SEQ ID NO: 1944182 - protein, 6 aa, Staphylococcus
GHEGVS

SEQ ID NO: 1944183 - protein, 11 aa, Staphylococcus
GHEHKSKKKAI

SEQ ID NO: 1944184 - protein, 5 aa, Staphylococcus
GHEIG

SEQ ID NO: 1944185 - protein, 5 aa, Staphylococcus
GHENI

SEQ ID NO: 1944186 - protein, 4 aa, Staphylococcus
GHES

SEQ ID NO: 1944187 - protein, 20 aa, Staphylococcus
GHETFDTDASVDTAKNGDIV

SEQ ID NO: 1944188 - protein, 19 aa, Staphylococcus
GHETFDTDASVDTARNGDI

SEQ ID NO: 1944189 - protein, 6 aa, Staphylococcus
GHGAED

SEQ ID NO: 1944190 - protein, 10 aa, Staphylococcus
GHGDDGITTH

SEQ ID NO: 1944191 - protein, 4 aa, Staphylococcus
GHGG

SEQ ID NO: 1944192 - protein, 12 aa, Staphylococcus
GHGGDSGSIDDL

SEQ ID NO: 1944193 - protein, 11 aa, Staphylococcus
GHGGDSGSIED

SEQ ID NO: 1944194 - protein, 12 aa, Staphylococcus
GHGGDSGSSDDL

SEQ ID NO: 1944195 - protein, 9 aa, Staphylococcus
GHGKDETSM

SEQ ID NO: 1944196 - protein, 24 aa, Staphylococcus
GHGKSLSRLGGGIGTRGPGETKLE

SEQ ID NO: 1944197 - protein, 28 aa, Staphylococcus
GHGKSLSRLGGGIGTRGPGETKLETDRR

SEQ ID NO: 1944198 - protein, 10 aa, Staphylococcus
GHGKSSRPDV

SEQ ID NO: 1944199 - protein, 12 aa, Staphylococcus
GHGKSSRSESYD

SEQ ID NO: 1944200 - protein, 10 aa, Staphylococcus
GHGKSTHPMS

SEQ ID NO: 1944201 - protein, 12 aa, Staphylococcus
GHGKSTKKNSFN

SEQ ID NO: 1944202 - protein, 4 aa, Staphylococcus
GHGL

SEQ ID NO: 1944203 - protein, 10 aa, Staphylococcus
GHGPEKDKIQ

SEQ ID NO: 1944204 - protein, 5 aa, Staphylococcus
GHGPI

SEQ ID NO: 1944205 - protein, 16 aa, Staphylococcus
GHGQEQAGTLRYTPRA

SEQ ID NO: 1944206 - protein, 5 aa, Staphylococcus
GHGQI

SEQ ID NO: 1944207 - protein, 6 aa, Staphylococcus
GHGRAR

SEQ ID NO: 1944208 - protein, 4 aa, Staphylococcus
GHGS

SEQ ID NO: 1944209 - protein, 12 aa, Staphylococcus
GHGSESHNNPYH

SEQ ID NO: 1944210 - protein, 13 aa, Staphylococcus
GHGSETNNNPYHA

SEQ ID NO: 1944211 - protein, 12 aa, Staphylococcus
GHGVGSSLHEAP

SEQ ID NO: 1944212 - protein, 4 aa, Staphylococcus
GHHE

SEQ ID NO: 1944213 - protein, 6 aa, Staphylococcus
GHHGEE

SEQ ID NO: 1944214 - protein, 7 aa, Staphylococcus
GHHNLNG

SEQ ID NO: 1944215 - protein, 4 aa, Staphylococcus
GHHP

SEQ ID NO: 1944216 - protein, 9 aa, Staphylococcus
GHIPSGEWG

SEQ ID NO: 1944217 - protein, 4 aa, Staphylococcus
GHIR

SEQ ID NO: 1944218 - protein, 4 aa, Staphylococcus
GHIS

SEQ ID NO: 1944219 - protein, 4 aa, Staphylococcus
GHIV

SEQ ID NO: 1944220 - protein, 10 aa, Staphylococcus
GHKAEQPELE

SEQ ID NO: 1944221 - protein, 11 aa, Staphylococcus
GHKAIEQRTSF

SEQ ID NO: 1944222 - protein, 8 aa, Staphylococcus
GHKATAKQ

SEQ ID NO: 1944223 - protein, 5 aa, Staphylococcus
GHKDA

SEQ ID NO: 1944224 - protein, 9 aa, Staphylococcus
GHKLPQSYA

SEQ ID NO: 1944225 - protein, 9 aa, Staphylococcus
GHKNGTIGN

SEQ ID NO: 1944226 - protein, 9 aa, Staphylococcus
GHKYTNKRR

SEQ ID NO: 1944227 - protein, 5 aa, Staphylococcus
GHLDG

SEQ ID NO: 1944228 - protein, 10 aa, Staphylococcus
GHLGDSADTL

SEQ ID NO: 1944229 - protein, 10 aa, Staphylococcus
GHLQKANNEL

SEQ ID NO: 1944230 - protein, 12 aa, Staphylococcus
GHLTDTKGRQVD

SEQ ID NO: 1944231 - protein, 10 aa, Staphylococcus
GHLTHGSPVN

SEQ ID NO: 1944232 - protein, 12 aa, Staphylococcus
GHLTTDEQETRK

SEQ ID NO: 1944233 - protein, 6 aa, Staphylococcus
GHNDPI

SEQ ID NO: 1944234 - protein, 4 aa, Staphylococcus
GHNE

SEQ ID NO: 1944235 - protein, 13 aa, Staphylococcus
GHNEWTETVNREE

SEQ ID NO: 1944236 - protein, 6 aa, Staphylococcus
GHNGEG

SEQ ID NO: 1944237 - protein, 6 aa, Staphylococcus
GHNGIY

SEQ ID NO: 1944238 - protein, 9 aa, Staphylococcus
GHNGSGAEL

SEQ ID NO: 1944239 - protein, 9 aa, Staphylococcus
GHNGSGKSI

SEQ ID NO: 1944240 - protein, 10 aa, Staphylococcus
GHNGSGKSTF

SEQ ID NO: 1944241 - protein, 11 aa, Staphylococcus
GHNGSGKSTVT

SEQ ID NO: 1944242 - protein, 5 aa, Staphylococcus
GHNNM

SEQ ID NO: 1944243 - protein, 15 aa, Staphylococcus
GHNSKTKKSDKSRRV

SEQ ID NO: 1944244 - protein, 10 aa, Staphylococcus
GHNTSSKHQE

SEQ ID NO: 1944245 - protein, 8 aa, Staphylococcus
GHPAVQPR

SEQ ID NO: 1944246 - protein, 6 aa, Staphylococcus
GHPEFQ

SEQ ID NO: 1944247 - protein, 11 aa, Staphylococcus
GHPEGKIESET

SEQ ID NO: 1944248 - protein, 6 aa, Staphylococcus
GHPQGE

SEQ ID NO: 1944249 - protein, 11 aa, Staphylococcus
GHPRVAETTTA

SEQ ID NO: 1944250 - protein, 11 aa, Staphylococcus
GHPRVAETTTV

SEQ ID NO: 1944251 - protein, 9 aa, Staphylococcus
GHPTNDKTW

SEQ ID NO: 1944252 - protein, 6 aa, Staphylococcus
GHPTVG

SEQ ID NO: 1944253 - protein, 6 aa, Staphylococcus
GHPVGT

SEQ ID NO: 1944254 - protein, 5 aa, Staphylococcus
GHQPA

SEQ ID NO: 1944255 - protein, 4 aa, Staphylococcus
GHQT

SEQ ID NO: 1944256 - protein, 4 aa, Staphylococcus
GHRS

SEQ ID NO: 1944257 - protein, 18 aa, Staphylococcus
GHRSQEDPEFNEQYKEEM

SEQ ID NO: 1944258 - protein, 10 aa, Staphylococcus
GHRSQKDENF

SEQ ID NO: 1944259 - protein, 6 aa, Staphylococcus
GHRSSY

SEQ ID NO: 1944260 - protein, 17 aa, Staphylococcus
GHRTSAEGAPLKRGAST

SEQ ID NO: 1944261 - protein, 17 aa, Staphylococcus
GHRTSTEGAPLKRGAST

SEQ ID NO: 1944262 - protein, 7 aa, Staphylococcus
GHSDESD

SEQ ID NO: 1944263 - protein, 11 aa, Staphylococcus
GHSDSAENYIG

SEQ ID NO: 1944264 - protein, 9 aa, Staphylococcus
GHSERSGAV

SEQ ID NO: 1944265 - protein, 12 aa, Staphylococcus
GHSFDKAKEDGF

SEQ ID NO: 1944266 - protein, 6 aa, Staphylococcus
GHSGAT

SEQ ID NO: 1944267 - protein, 6 aa, Staphylococcus
GHSGTT

SEQ ID NO: 1944268 - protein, 7 aa, Staphylococcus
GHSLGGR

SEQ ID NO: 1944269 - protein, 5 aa, Staphylococcus
GHSNG

SEQ ID NO: 1944270 - protein, 10 aa, Staphylococcus
GHSNPATTQS

SEQ ID NO: 1944271 - protein, 6 aa, Staphylococcus
GHSPGS

SEQ ID NO: 1944272 - protein, 10 aa, Staphylococcus
GHSQLPSEGL

SEQ ID NO: 1944273 - protein, 6 aa, Staphylococcus
GHSTQQ

SEQ ID NO: 1944274 - protein, 5 aa, Staphylococcus
GHSYG

SEQ ID NO: 1944275 - protein, 10 aa, Staphylococcus
GHTDENEQYI

SEQ ID NO: 1944276 - protein, 6 aa, Staphylococcus
GHTEAA

SEQ ID NO: 1944277 - protein, 8 aa, Staphylococcus
GHTEADAS

SEQ ID NO: 1944278 - protein, 8 aa, Staphylococcus
GHTFTEND

SEQ ID NO: 1944279 - protein, 5 aa, Staphylococcus
GHTGF

SEQ ID NO: 1944280 - protein, 5 aa, Staphylococcus
GHTGS

SEQ ID NO: 1944281 - protein, 10 aa, Staphylococcus
GHTGTLDPEV

SEQ ID NO: 1944282 - protein, 4 aa, Staphylococcus
GHTL

SEQ ID NO: 1944283 - protein, 4 aa, Staphylococcus
GHTR

SEQ ID NO: 1944284 - protein, 8 aa, Staphylococcus
GHTTTITK

SEQ ID NO: 1944285 - protein, 7 aa, Staphylococcus
GHVGQIP

SEQ ID NO: 1944286 - protein, 8 aa, Staphylococcus
GHVPRPKA

SEQ ID NO: 1944287 - protein, 12 aa, Staphylococcus
GHYAGAKDLGRA

SEQ ID NO: 1944288 - protein, 12 aa, Staphylococcus
GHYAGAKELGRA

SEQ ID NO: 1944289 - protein, 16 aa, Staphylococcus
GHYDGEIEGFGFGIKL

SEQ ID NO: 1944290 - protein, 12 aa, Staphylococcus
GHYTERGEDLGY

SEQ ID NO: 1944291 - protein, 13 aa, Staphylococcus
GHYTERGKEQGFS

SEQ ID NO: 1944292 - protein, 17 aa, Staphylococcus
GIADDGDSTNLTSPLRE

SEQ ID NO: 1944293 - protein, 13 aa, Staphylococcus
GIADDKDKNNLEH

SEQ ID NO: 1944294 - protein, 31 aa, Staphylococcus
GIADDNNVDNLDSETRKNVGSYQSVGHRQTP

SEQ ID NO: 1944295 - protein, 6 aa, Staphylococcus
GIADSF

SEQ ID NO: 1944296 - protein, 5 aa, Staphylococcus
GIAEP

SEQ ID NO: 1944297 - protein, 9 aa, Staphylococcus
GIAGDQQAA

SEQ ID NO: 1944298 - protein, 9 aa, Staphylococcus
GIAGHEKNV

SEQ ID NO: 1944299 - protein, 15 aa, Staphylococcus
GIAKAAKKADRIAAE

SEQ ID NO: 1944300 - protein, 21 aa, Staphylococcus
GIANADDPVAAAKACKDAIEG

SEQ ID NO: 1944301 - protein, 10 aa, Staphylococcus
GIANKELTPE

SEQ ID NO: 1944302 - protein, 4 aa, Staphylococcus
GIAP

SEQ ID NO: 1944303 - protein, 8 aa, Staphylococcus
GIARPAAS

SEQ ID NO: 1944304 - protein, 8 aa, Staphylococcus
GIARPAAT

SEQ ID NO: 1944305 - protein, 15 aa, Staphylococcus
GIASSKRQAREDVNN

SEQ ID NO: 1944306 - protein, 6 aa, Staphylococcus
GIATEG

SEQ ID NO: 1944307 - protein, 8 aa, Staphylococcus
GIATEGAE

SEQ ID NO: 1944308 - protein, 8 aa, Staphylococcus
GIATEGAK

SEQ ID NO: 1944309 - protein, 23 aa, Staphylococcus
GIATQAKVEAKLNEQGISRHDIG

SEQ ID NO: 1944310 - protein, 23 aa, Staphylococcus
GIATQAKVEAKLNEQGLSRHDLG

SEQ ID NO: 1944311 - protein, 15 aa, Staphylococcus
GIATSKRQAREDVNN

SEQ ID NO: 1944312 - protein, 11 aa, Staphylococcus
GIDAKEEKYRN

SEQ ID NO: 1944313 - protein, 6 aa, Staphylococcus
GIDDAA

SEQ ID NO: 1944314 - protein, 6 aa, Staphylococcus
GIDDAT

SEQ ID NO: 1944315 - protein, 31 aa, Staphylococcus
GIDDSEVKASRIRKSVGTERTFSTDINDDEA

SEQ ID NO: 1944316 - protein, 9 aa, Staphylococcus
GIDDVPQSQ

SEQ ID NO: 1944317 - protein, 5 aa, Staphylococcus
GIDES

SEQ ID NO: 1944318 - protein, 5 aa, Staphylococcus
GIDGN

SEQ ID NO: 1944319 - protein, 11 aa, Staphylococcus
GIDGNTDADGL

SEQ ID NO: 1944320 - protein, 7 aa, Staphylococcus
GIDKASN

SEQ ID NO: 1944321 - protein, 14 aa, Staphylococcus
GIDKDDVTERDIDQ

SEQ ID NO: 1944322 - protein, 9 aa, Staphylococcus
GIDKGTGIK

SEQ ID NO: 1944323 - protein, 8 aa, Staphylococcus
GIDNDKNK

SEQ ID NO: 1944324 - protein, 13 aa, Staphylococcus
GIDNGAANLITGK

SEQ ID NO: 1944325 - protein, 13 aa, Staphylococcus
GIDPKTIPVDDKD

SEQ ID NO: 1944326 - protein, 14 aa, Staphylococcus
GIDPNDSTSAPVDD

SEQ ID NO: 1944327 - protein, 11 aa, Staphylococcus
GIDPRRRGETL

SEQ ID NO: 1944328 - protein, 5 aa, Staphylococcus
GIDQN

SEQ ID NO: 1944329 - protein, 5 aa, Staphylococcus
GIDQS

SEQ ID NO: 1944330 - protein, 17 aa, Staphylococcus
GIDQSKIREKSKINNPA

SEQ ID NO: 1944331 - protein, 8 aa, Staphylococcus
GIDQSKLR

SEQ ID NO: 1944332 - protein, 18 aa, Staphylococcus
GIDQSKLREKYNVTNPSI

SEQ ID NO: 1944333 - protein, 18 aa, Staphylococcus
GIDQSKMREKYKVNNPSI

SEQ ID NO: 1944334 - protein, 18 aa, Staphylococcus
GIDQSKVREKYKVTNPSI

SEQ ID NO: 1944335 - protein, 8 aa, Staphylococcus
GIDQSRVR

SEQ ID NO: 1944336 - protein, 14 aa, Staphylococcus
GIDQTKGSIKVGKD

SEQ ID NO: 1944337 - protein, 13 aa, Staphylococcus
GIDRVNSKTISEA

SEQ ID NO: 1944338 - protein, 8 aa, Staphylococcus
GIDSDKST

SEQ ID NO: 1944339 - protein, 9 aa, Staphylococcus
GIDSENSEW

SEQ ID NO: 1944340 - protein, 8 aa, Staphylococcus
GIDSETAL

SEQ ID NO: 1944341 - protein, 6 aa, Staphylococcus
GIDTRH

SEQ ID NO: 1944342 - protein, 14 aa, Staphylococcus
GIDYDSANPPLYDS

SEQ ID NO: 1944343 - protein, 14 aa, Staphylococcus
GIDYQYEEGPGQHD

SEQ ID NO: 1944344 - protein, 15 aa, Staphylococcus
GIEDRGQYYDSTGAL

SEQ ID NO: 1944345 - protein, 7 aa, Staphylococcus
GIEEDKQ

SEQ ID NO: 1944346 - protein, 11 aa, Staphylococcus
GIEEETTGHHI

SEQ ID NO: 1944347 - protein, 11 aa, Staphylococcus
GIEESSANQRV

SEQ ID NO: 1944348 - protein, 6 aa, Staphylococcus
GIEETQ

SEQ ID NO: 1944349 - protein, 8 aa, Staphylococcus
GIEGEELK

SEQ ID NO: 1944350 - protein, 10 aa, Staphylococcus
GIEGKSADDI

SEQ ID NO: 1944351 - protein, 10 aa, Staphylococcus
GIEGKSADDV

SEQ ID NO: 1944352 - protein, 5 aa, Staphylococcus
GIEGN

SEQ ID NO: 1944353 - protein, 6 aa, Staphylococcus
GIEGRL

SEQ ID NO: 1944354 - protein, 7 aa, Staphylococcus
GIEIEED

SEQ ID NO: 1944355 - protein, 5 aa, Staphylococcus
GIEKA

SEQ ID NO: 1944356 - protein, 6 aa, Staphylococcus
GIEKAN

SEQ ID NO: 1944357 - protein, 9 aa, Staphylococcus
GIEKDKEKF

SEQ ID NO: 1944358 - protein, 11 aa, Staphylococcus
GIENYSDEINH

SEQ ID NO: 1944359 - protein, 9 aa, Staphylococcus
GIEPGRSIV

SEQ ID NO: 1944360 - protein, 6 aa, Staphylococcus
GIEPNK

SEQ ID NO: 1944361 - protein, 6 aa, Staphylococcus
GIEPNQ

SEQ ID NO: 1944362 - protein, 7 aa, Staphylococcus
GIEPNQA

SEQ ID NO: 1944363 - protein, 6 aa, Staphylococcus
GIESGQ

SEQ ID NO: 1944364 - protein, 5 aa, Staphylococcus
GIETA

SEQ ID NO: 1944365 - protein, 12 aa, Staphylococcus
GIETNGSKDPMK

SEQ ID NO: 1944366 - protein, 12 aa, Staphylococcus
GIFSSDNGGKSW

SEQ ID NO: 1944367 - protein, 9 aa, Staphylococcus
GIGAKRKTK

SEQ ID NO: 1944368 - protein, 5 aa, Staphylococcus
GIGAP

SEQ ID NO: 1944369 - protein, 19 aa, Staphylococcus
GIGEGPDAKAFDDEGSHTL

SEQ ID NO: 1944370 - protein, 7 aa, Staphylococcus
GIGESKV

SEQ ID NO: 1944371 - protein, 12 aa, Staphylococcus
GIGGKRSAGYGR

SEQ ID NO: 1944372 - protein, 8 aa, Staphylococcus
GIGKKTAR

SEQ ID NO: 1944373 - protein, 14 aa, Staphylococcus
GIGKPEALKGNYEG

SEQ ID NO: 1944374 - protein, 5 aa, Staphylococcus
GIGNY

SEQ ID NO: 1944375 - protein, 6 aa, Staphylococcus
GIGPEI

SEQ ID NO: 1944376 - protein, 5 aa, Staphylococcus
GIGPK

SEQ ID NO: 1944377 - protein, 9 aa, Staphylococcus
GIGPKTAQR

SEQ ID NO: 1944378 - protein, 5 aa, Staphylococcus
GIGRP

SEQ ID NO: 1944379 - protein, 7 aa, Staphylococcus
GIGRTDL

SEQ ID NO: 1944380 - protein, 4 aa, Staphylococcus
GIGS

SEQ ID NO: 1944381 - protein, 5 aa, Staphylococcus
GIGSD

SEQ ID NO: 1944382 - protein, 9 aa, Staphylococcus
GIGSPKDAC

SEQ ID NO: 1944383 - protein, 6 aa, Staphylococcus
GIGTSQ

SEQ ID NO: 1944384 - protein, 8 aa, Staphylococcus
GIGYAPNN

SEQ ID NO: 1944385 - protein, 5 aa, Staphylococcus
GIGYE

SEQ ID NO: 1944386 - protein, 8 aa, Staphylococcus
GIHNKEDV

SEQ ID NO: 1944387 - protein, 8 aa, Staphylococcus
GIHNQSDV

SEQ ID NO: 1944388 - protein, 7 aa, Staphylococcus
GIHSQQE

SEQ ID NO: 1944389 - protein, 6 aa, Staphylococcus
GIHSRE

SEQ ID NO: 1944390 - protein, 5 aa, Staphylococcus
GIHST

SEQ ID NO: 1944391 - protein, 7 aa, Staphylococcus
GIIGDGK

SEQ ID NO: 1944392 - protein, 5 aa, Staphylococcus
GIKAN

SEQ ID NO: 1944393 - protein, 9 aa, Staphylococcus
GIKATHKDG

SEQ ID NO: 1944394 - protein, 5 aa, Staphylococcus
GIKDQ

SEQ ID NO: 1944395 - protein, 17 aa, Staphylococcus
GIKEAKSGTTLAGKNVN

SEQ ID NO: 1944396 - protein, 22 aa, Staphylococcus
GIKGEVKVKSHSDFTDTRFQPG

SEQ ID NO: 1944397 - protein, 11 aa, Staphylococcus
GIKGNTKEAVR

SEQ ID NO: 1944398 - protein, 10 aa, Staphylococcus
GIKKEDVESA

SEQ ID NO: 1944399 - protein, 6 aa, Staphylococcus
GIKNPS

SEQ ID NO: 1944400 - protein, 7 aa, Staphylococcus
GIKQKNM

SEQ ID NO: 1944401 - protein, 7 aa, Staphylococcus
GIKQKPL

SEQ ID NO: 1944402 - protein, 6 aa, Staphylococcus
GIKQKQ

SEQ ID NO: 1944403 - protein, 7 aa, Staphylococcus
GIKQKQL

SEQ ID NO: 1944404 - protein, 6 aa, Staphylococcus
GIKQPS

SEQ ID NO: 1944405 - protein, 9 aa, Staphylococcus
GIKRVTQHD

SEQ ID NO: 1944406 - protein, 10 aa, Staphylococcus
GIKSKNGEWK

SEQ ID NO: 1944407 - protein, 13 aa, Staphylococcus
GIKSRGKAEIGDK

SEQ ID NO: 1944408 - protein, 12 aa, Staphylococcus
GIKTTKNIYDST

SEQ ID NO: 1944409 - protein, 14 aa, Staphylococcus
GILSQSSPVATQIP

SEQ ID NO: 1944410 - protein, 5 aa, Staphylococcus
GINDD

SEQ ID NO: 1944411 - protein, 5 aa, Staphylococcus
GINDN

SEQ ID NO: 1944412 - protein, 9 aa, Staphylococcus
GINEGKRHQ

SEQ ID NO: 1944413 - protein, 7 aa, Staphylococcus
GINEKQP

SEQ ID NO: 1944414 - protein, 5 aa, Staphylococcus
GINEP

SEQ ID NO: 1944415 - protein, 8 aa, Staphylococcus
GINEPATE

SEQ ID NO: 1944416 - protein, 6 aa, Staphylococcus
GINEVT

SEQ ID NO: 1944417 - protein, 4 aa, Staphylococcus
GING

SEQ ID NO: 1944418 - protein, 15 aa, Staphylococcus
GINGEKRIEVDENKE

SEQ ID NO: 1944419 - protein, 7 aa, Staphylococcus
GINHAKA

SEQ ID NO: 1944420 - protein, 9 aa, Staphylococcus
GINHSKSNA

SEQ ID NO: 1944421 - protein, 9 aa, Staphylococcus
GINHSKSNQ

SEQ ID NO: 1944422 - protein, 4 aa, Staphylococcus
GINK

SEQ ID NO: 1944423 - protein, 9 aa, Staphylococcus
GINKDTDEG

SEQ ID NO: 1944424 - protein, 22 aa, Staphylococcus
GINNGGTSISDYRHADGKTGEM

SEQ ID NO: 1944425 - protein, 10 aa, Staphylococcus
GINNPSNTTI

SEQ ID NO: 1944426 - protein, 9 aa, Staphylococcus
GINNSQSNE

SEQ ID NO: 1944427 - protein, 6 aa, Staphylococcus
GINPDS

SEQ ID NO: 1944428 - protein, 6 aa, Staphylococcus
GINPED

SEQ ID NO: 1944429 - protein, 7 aa, Staphylococcus
GINPEKA

SEQ ID NO: 1944430 - protein, 10 aa, Staphylococcus
GINPGSGNHD

SEQ ID NO: 1944431 - protein, 4 aa, Staphylococcus
GINR

SEQ ID NO: 1944432 - protein, 5 aa, Staphylococcus
GINRS

SEQ ID NO: 1944433 - protein, 9 aa, Staphylococcus
GINSQHGKN

SEQ ID NO: 1944434 - protein, 7 aa, Staphylococcus
GINSVES

SEQ ID NO: 1944435 - protein, 14 aa, Staphylococcus
GINTDGDALKTQTN

SEQ ID NO: 1944436 - protein, 4 aa, Staphylococcus
GINV

SEQ ID NO: 1944437 - protein, 4 aa, Staphylococcus
GINY

SEQ ID NO: 1944438 - protein, 4 aa, Staphylococcus
GIPD

SEQ ID NO: 1944439 - protein, 12 aa, Staphylococcus
GIPDERTAAELG

SEQ ID NO: 1944440 - protein, 7 aa, Staphylococcus
GIPDESK

SEQ ID NO: 1944441 - protein, 12 aa, Staphylococcus
GIPDESKYKEVE

SEQ ID NO: 1944442 - protein, 5 aa, Staphylococcus
GIPED

SEQ ID NO: 1944443 - protein, 6 aa, Staphylococcus
GIPGPI

SEQ ID NO: 1944444 - protein, 5 aa, Staphylococcus
GIPKD

SEQ ID NO: 1944445 - protein, 9 aa, Staphylococcus
GIPKDTKIG

SEQ ID NO: 1944446 - protein, 5 aa, Staphylococcus
GIPKG

SEQ ID NO: 1944447 - protein, 5 aa, Staphylococcus
GIPKK

SEQ ID NO: 1944448 - protein, 6 aa, Staphylococcus
GIPKKN

SEQ ID NO: 1944449 - protein, 5 aa, Staphylococcus
GIPKN

SEQ ID NO: 1944450 - protein, 5 aa, Staphylococcus
GIPLS

SEQ ID NO: 1944451 - protein, 5 aa, Staphylococcus
GIPNS

SEQ ID NO: 1944452 - protein, 4 aa, Staphylococcus
GIPP

SEQ ID NO: 1944453 - protein, 6 aa, Staphylococcus
GIPRTG

SEQ ID NO: 1944454 - protein, 7 aa, Staphylococcus
GIPRTGY

SEQ ID NO: 1944455 - protein, 7 aa, Staphylococcus
GIPSGKN

SEQ ID NO: 1944456 - protein, 5 aa, Staphylococcus
GIPTI

SEQ ID NO: 1944457 - protein, 4 aa, Staphylococcus
GIQE

SEQ ID NO: 1944458 - protein, 6 aa, Staphylococcus
GIQGHE

SEQ ID NO: 1944459 - protein, 5 aa, Staphylococcus
GIQGY

SEQ ID NO: 1944460 - protein, 10 aa, Staphylococcus
GIQKRIDNGT

SEQ ID NO: 1944461 - protein, 9 aa, Staphylococcus
GIQKSTDIE

SEQ ID NO: 1944462 - protein, 6 aa, Staphylococcus
GIQNED

SEQ ID NO: 1944463 - protein, 6 aa, Staphylococcus
GIQPND

SEQ ID NO: 1944464 - protein, 5 aa, Staphylococcus
GIQQP

SEQ ID NO: 1944465 - protein, 4 aa, Staphylococcus
GIQR

SEQ ID NO: 1944466 - protein, 19 aa, Staphylococcus
GIQSGKLDDPQGWRVVVPR

SEQ ID NO: 1944467 - protein, 9 aa, Staphylococcus
GIQSSNADV

SEQ ID NO: 1944468 - protein, 6 aa, Staphylococcus
GIQTDV

SEQ ID NO: 1944469 - protein, 9 aa, Staphylococcus
GIRANSKAD

SEQ ID NO: 1944470 - protein, 4 aa, Staphylococcus
GIRE

SEQ ID NO: 1944471 - protein, 7 aa, Staphylococcus
GIRETED

SEQ ID NO: 1944472 - protein, 8 aa, Staphylococcus
GIRPDKIA

SEQ ID NO: 1944473 - protein, 26 aa, Staphylococcus
GIRPEGAAQNDQKRITTPEQAKQLGS

SEQ ID NO: 1944474 - protein, 11 aa, Staphylococcus
GIRSESERPLT

SEQ ID NO: 1944475 - protein, 6 aa, Staphylococcus
GIRTPL

SEQ ID NO: 1944476 - protein, 6 aa, Staphylococcus
GISAPV

SEQ ID NO: 1944477 - protein, 13 aa, Staphylococcus
GISASADKVPGTR

SEQ ID NO: 1944478 - protein, 5 aa, Staphylococcus
GISER

SEQ ID NO: 1944479 - protein, 15 aa, Staphylococcus
GISGDSKKKHQNFSD

SEQ ID NO: 1944480 - protein, 7 aa, Staphylococcus
GISGDVK

SEQ ID NO: 1944481 - protein, 6 aa, Staphylococcus
GISGGF

SEQ ID NO: 1944482 - protein, 13 aa, Staphylococcus
GISGGFKKPADLT

SEQ ID NO: 1944483 - protein, 14 aa, Staphylococcus
GISGMNNKEPSQKD

SEQ ID NO: 1944484 - protein, 13 aa, Staphylococcus
GISGNTGASTGPY

SEQ ID NO: 1944485 - protein, 11 aa, Staphylococcus
GISGVDTRSIT

SEQ ID NO: 1944486 - protein, 12 aa, Staphylococcus
GISGVDTRSITR

SEQ ID NO: 1944487 - protein, 13 aa, Staphylococcus
GISGVDTRSITRK

SEQ ID NO: 1944488 - protein, 6 aa, Staphylococcus
GISIPE

SEQ ID NO: 1944489 - protein, 8 aa, Staphylococcus
GISKARGI

SEQ ID NO: 1944490 - protein, 8 aa, Staphylococcus
GISKEDAN

SEQ ID NO: 1944491 - protein, 13 aa, Staphylococcus
GISKENENDLPGY

SEQ ID NO: 1944492 - protein, 7 aa, Staphylococcus
GISMGTD

SEQ ID NO: 1944493 - protein, 7 aa, Staphylococcus
GISMTED

SEQ ID NO: 1944494 - protein, 11 aa, Staphylococcus
GISNAKEAYER

SEQ ID NO: 1944495 - protein, 5 aa, Staphylococcus
GISNT

SEQ ID NO: 1944496 - protein, 7 aa, Staphylococcus
GISPQRY

SEQ ID NO: 1944497 - protein, 7 aa, Staphylococcus
GISSGAA

SEQ ID NO: 1944498 - protein, 8 aa, Staphylococcus
GISSQGDR

SEQ ID NO: 1944499 - protein, 8 aa, Staphylococcus
GISSQGET

SEQ ID NO: 1944500 - protein, 8 aa, Staphylococcus
GISSQKDT

SEQ ID NO: 1944501 - protein, 16 aa, Staphylococcus
GISSSKRQAREDVNNG

SEQ ID NO: 1944502 - protein, 6 aa, Staphylococcus
GITAPG

SEQ ID NO: 1944503 - protein, 11 aa, Staphylococcus
GITEDDNVGTM

SEQ ID NO: 1944504 - protein, 5 aa, Staphylococcus
GITGA

SEQ ID NO: 1944505 - protein, 8 aa, Staphylococcus
GITGPNGL

SEQ ID NO: 1944506 - protein, 4 aa, Staphylococcus
GITI

SEQ ID NO: 1944507 - protein, 15 aa, Staphylococcus
GITLTNTRGIQSKQL

SEQ ID NO: 1944508 - protein, 8 aa, Staphylococcus
GITNEREK

SEQ ID NO: 1944509 - protein, 18 aa, Staphylococcus
GITPGQIRTKNQSHQYQS

SEQ ID NO: 1944510 - protein, 14 aa, Staphylococcus
GITPKPQPGNPKPR

SEQ ID NO: 1944511 - protein, 14 aa, Staphylococcus
GITPKPQPGNPQPR

SEQ ID NO: 1944512 - protein, 17 aa, Staphylococcus
GITPTLADTNKGKGSVI

SEQ ID NO: 1944513 - protein, 11 aa, Staphylococcus
GITQNKNNRDI

SEQ ID NO: 1944514 - protein, 7 aa, Staphylococcus
GITRKKA

SEQ ID NO: 1944515 - protein, 9 aa, Staphylococcus
GITRKQAKQ

SEQ ID NO: 1944516 - protein, 4 aa, Staphylococcus
GITS

SEQ ID NO: 1944517 - protein, 10 aa, Staphylococcus
GITTDLNNHQ

SEQ ID NO: 1944518 - protein, 5 aa, Staphylococcus
GITTL

SEQ ID NO: 1944519 - protein, 23 aa, Staphylococcus
GITTPDLGGKASTEDIFNQILQQ

SEQ ID NO: 1944520 - protein, 11 aa, Staphylococcus
GITTTNAADVR

SEQ ID NO: 1944521 - protein, 5 aa, Staphylococcus
GIVKR

SEQ ID NO: 1944522 - protein, 4 aa, Staphylococcus
GIVS

SEQ ID NO: 1944523 - protein, 7 aa, Staphylococcus
GIYEPTE

SEQ ID NO: 1944524 - protein, 5 aa, Staphylococcus
GIYHP

SEQ ID NO: 1944525 - protein, 10 aa, Staphylococcus
GIYTEDPTRD

SEQ ID NO: 1944526 - protein, 12 aa, Staphylococcus
GKAAEKEWREND

SEQ ID NO: 1944527 - protein, 13 aa, Staphylococcus
GKAAHGSRPWEGE

SEQ ID NO: 1944528 - protein, 8 aa, Staphylococcus
GKAAKTYE

SEQ ID NO: 1944529 - protein, 7 aa, Staphylococcus
GKAAKYV

SEQ ID NO: 1944530 - protein, 18 aa, Staphylococcus
GKAANGETLNGDEKEKIE

SEQ ID NO: 1944531 - protein, 7 aa, Staphylococcus
GKAANII

SEQ ID NO: 1944532 - protein, 7 aa, Staphylococcus
GKAATVK

SEQ ID NO: 1944533 - protein, 10 aa, Staphylococcus
GKADKKGYRK

SEQ ID NO: 1944534 - protein, 11 aa, Staphylococcus
GKADVGAPPMS

SEQ ID NO: 1944535 - protein, 11 aa, Staphylococcus
GKAEIGAPPMS

SEQ ID NO: 1944536 - protein, 8 aa, Staphylococcus
GKAEQEIE

SEQ ID NO: 1944537 - protein, 18 aa, Staphylococcus
GKAFEQYKKTGGQVYDHI

SEQ ID NO: 1944538 - protein, 18 aa, Staphylococcus
GKAFPGQPSVAHDSDIEG

SEQ ID NO: 1944539 - protein, 7 aa, Staphylococcus
GKAGGEI

SEQ ID NO: 1944540 - protein, 16 aa, Staphylococcus
GKAGIGYKDNVNGKGR

SEQ ID NO: 1944541 - protein, 8 aa, Staphylococcus
GKAGNPDI

SEQ ID NO: 1944542 - protein, 7 aa, Staphylococcus
GKAISKI

SEQ ID NO: 1944543 - protein, 7 aa, Staphylococcus
GKALGGG

SEQ ID NO: 1944544 - protein, 7 aa, Staphylococcus
GKANVDE

SEQ ID NO: 1944545 - protein, 9 aa, Staphylococcus
GKAPGGFPL

SEQ ID NO: 1944546 - protein, 9 aa, Staphylococcus
GKAPGGYPK

SEQ ID NO: 1944547 - protein, 11 aa, Staphylococcus
GKAPVGAPPMS

SEQ ID NO: 1944548 - protein, 7 aa, Staphylococcus
GKARDSI

SEQ ID NO: 1944549 - protein, 9 aa, Staphylococcus
GKASGRGVV

SEQ ID NO: 1944550 - protein, 9 aa, Staphylococcus
GKASKGSLV

SEQ ID NO: 1944551 - protein, 9 aa, Staphylococcus
GKASNRGVV

SEQ ID NO: 1944552 - protein, 9 aa, Staphylococcus
GKASTRGVV

SEQ ID NO: 1944553 - protein, 11 aa, Staphylococcus
GKASVGAPPMS

SEQ ID NO: 1944554 - protein, 7 aa, Staphylococcus
GKATDEE

SEQ ID NO: 1944555 - protein, 7 aa, Staphylococcus
GKATYDD

SEQ ID NO: 1944556 - protein, 6 aa, Staphylococcus
GKAVES

SEQ ID NO: 1944557 - protein, 12 aa, Staphylococcus
GKCGSKLKLKMY

SEQ ID NO: 1944558 - protein, 4 aa, Staphylococcus
GKCV

SEQ ID NO: 1944559 - protein, 7 aa, Staphylococcus
GKDAERI

SEQ ID NO: 1944560 - protein, 7 aa, Staphylococcus
GKDAGEL

SEQ ID NO: 1944561 - protein, 13 aa, Staphylococcus
GKDAGFDSIRDQD

SEQ ID NO: 1944562 - protein, 11 aa, Staphylococcus
GKDAHKVSERL

SEQ ID NO: 1944563 - protein, 6 aa, Staphylococcus
GKDASD

SEQ ID NO: 1944564 - protein, 11 aa, Staphylococcus
GKDATQAVTDE

SEQ ID NO: 1944565 - protein, 6 aa, Staphylococcus
GKDATY

SEQ ID NO: 1944566 - protein, 14 aa, Staphylococcus
GKDDEDAKKSLDVN

SEQ ID NO: 1944567 - protein, 10 aa, Staphylococcus
GKDEEGAREL

SEQ ID NO: 1944568 - protein, 8 aa, Staphylococcus
GKDELPDE

SEQ ID NO: 1944569 - protein, 6 aa, Staphylococcus
GKDESL

SEQ ID NO: 1944570 - protein, 5 aa, Staphylococcus
GKDEV

SEQ ID NO: 1944571 - protein, 4 aa, Staphylococcus
GKDF

SEQ ID NO: 1944572 - protein, 7 aa, Staphylococcus
GKDFDKK

SEQ ID NO: 1944573 - protein, 14 aa, Staphylococcus
GKDFGEENVVGPND

SEQ ID NO: 1944574 - protein, 9 aa, Staphylococcus
GKDGAEDKL

SEQ ID NO: 1944575 - protein, 9 aa, Staphylococcus
GKDGAEEKL

SEQ ID NO: 1944576 - protein, 13 aa, Staphylococcus
GKDGGKKLADELN

SEQ ID NO: 1944577 - protein, 14 aa, Staphylococcus
GKDGKKKGIKLDKE

SEQ ID NO: 1944578 - protein, 10 aa, Staphylococcus
GKDGQKKDPM

SEQ ID NO: 1944579 - protein, 9 aa, Staphylococcus
GKDGQTVEK

SEQ ID NO: 1944580 - protein, 14 aa, Staphylococcus
GKDGSLTGFGGTID

SEQ ID NO: 1944581 - protein, 12 aa, Staphylococcus
GKDHNDKGAIKD

SEQ ID NO: 1944582 - protein, 12 aa, Staphylococcus
GKDHNDKSSIKD

SEQ ID NO: 1944583 - protein, 9 aa, Staphylococcus
GKDHSPKRN

SEQ ID NO: 1944584 - protein, 9 aa, Staphylococcus
GKDHSSKRD

SEQ ID NO: 1944585 - protein, 5 aa, Staphylococcus
GKDIK

SEQ ID NO: 1944586 - protein, 12 aa, Staphylococcus
GKDIPAEARETI

SEQ ID NO: 1944587 - protein, 8 aa, Staphylococcus
GKDIRIDT

SEQ ID NO: 1944588 - protein, 8 aa, Staphylococcus
GKDKAERV

SEQ ID NO: 1944589 - protein, 19 aa, Staphylococcus
GKDKGKTGVVQSTEPKKDR

SEQ ID NO: 1944590 - protein, 8 aa, Staphylococcus
GKDKNHQL

SEQ ID NO: 1944591 - protein, 8 aa, Staphylococcus
GKDKPISR

SEQ ID NO: 1944592 - protein, 9 aa, Staphylococcus
GKDKRKSTI

SEQ ID NO: 1944593 - protein, 4 aa, Staphylococcus
GKDL

SEQ ID NO: 1944594 - protein, 8 aa, Staphylococcus
GKDLYSKS

SEQ ID NO: 1944595 - protein, 7 aa, Staphylococcus
GKDMSPN

SEQ ID NO: 1944596 - protein, 7 aa, Staphylococcus
GKDNETV

SEQ ID NO: 1944597 - protein, 9 aa, Staphylococcus
GKDNGKLEA

SEQ ID NO: 1944598 - protein, 9 aa, Staphylococcus
GKDNQEALG

SEQ ID NO: 1944599 - protein, 8 aa, Staphylococcus
GKDPKAPK

SEQ ID NO: 1944600 - protein, 19 aa, Staphylococcus
GKDPRTGKPLLVTYNLLEK

SEQ ID NO: 1944601 - protein, 12 aa, Staphylococcus
GKDRGHNPKKVT

SEQ ID NO: 1944602 - protein, 9 aa, Staphylococcus
GKDRSSKRD

SEQ ID NO: 1944603 - protein, 4 aa, Staphylococcus
GKDS

SEQ ID NO: 1944604 - protein, 7 aa, Staphylococcus
GKDSMGN

SEQ ID NO: 1944605 - protein, 9 aa, Staphylococcus
GKDSTEEDI

SEQ ID NO: 1944606 - protein, 9 aa, Staphylococcus
GKDTLEDIA

SEQ ID NO: 1944607 - protein, 7 aa, Staphylococcus
GKDTTTL

SEQ ID NO: 1944608 - protein, 8 aa, Staphylococcus
GKDVDDPT

SEQ ID NO: 1944609 - protein, 11 aa, Staphylococcus
GKDVKTLKKGD

SEQ ID NO: 1944610 - protein, 24 aa, Staphylococcus
GKDVTDYKEGDKVYGRPSKGKMGT

SEQ ID NO: 1944611 - protein, 12 aa, Staphylococcus
GKDVTKYKKGDR

SEQ ID NO: 1944612 - protein, 10 aa, Staphylococcus
GKDVTRFKKG

SEQ ID NO: 1944613 - protein, 9 aa, Staphylococcus
GKDYNGKQS

SEQ ID NO: 1944614 - protein, 7 aa, Staphylococcus
GKDYPKQ

SEQ ID NO: 1944615 - protein, 5 aa, Staphylococcus
GKDYQ

SEQ ID NO: 1944616 - protein, 35 aa, Staphylococcus
GKDYVSQRKAAAGKQGDQDAHEAIRPTKTLRTPAE

SEQ ID NO: 1944617 - protein, 7 aa, Staphylococcus
GKEAAQL

SEQ ID NO: 1944618 - protein, 11 aa, Staphylococcus
GKEAEQQRKQK

SEQ ID NO: 1944619 - protein, 14 aa, Staphylococcus
GKEAHVTDYTNASR

SEQ ID NO: 1944620 - protein, 6 aa, Staphylococcus
GKEALS

SEQ ID NO: 1944621 - protein, 13 aa, Staphylococcus
GKEANEKETKKIQ

SEQ ID NO: 1944622 - protein, 8 aa, Staphylococcus
GKEASGND

SEQ ID NO: 1944623 - protein, 8 aa, Staphylococcus
GKEATQNI

SEQ ID NO: 1944624 - protein, 11 aa, Staphylococcus
GKEAVKSDSGL

SEQ ID NO: 1944625 - protein, 7 aa, Staphylococcus
GKEAVRE

SEQ ID NO: 1944626 - protein, 4 aa, Staphylococcus
GKED

SEQ ID NO: 1944627 - protein, 5 aa, Staphylococcus
GKEDL

SEQ ID NO: 1944628 - protein, 18 aa, Staphylococcus
GKEELDNNPFQDALKNLK

SEQ ID NO: 1944629 - protein, 7 aa, Staphylococcus
GKEEQFK

SEQ ID NO: 1944630 - protein, 17 aa, Staphylococcus
GKEEQFKGHLGDSAKTL

SEQ ID NO: 1944631 - protein, 12 aa, Staphylococcus
GKEGNEGEVPFK

SEQ ID NO: 1944632 - protein, 8 aa, Staphylococcus
GKEGNWRD

SEQ ID NO: 1944633 - protein, 5 aa, Staphylococcus
GKEHG

SEQ ID NO: 1944634 - protein, 7 aa, Staphylococcus
GKEIEDE

SEQ ID NO: 1944635 - protein, 7 aa, Staphylococcus
GKEIEDK

SEQ ID NO: 1944636 - protein, 9 aa, Staphylococcus
GKEIQNPDM

SEQ ID NO: 1944637 - protein, 10 aa, Staphylococcus
GKEITTQPNA

SEQ ID NO: 1944638 - protein, 4 aa, Staphylococcus
GKEK

SEQ ID NO: 1944639 - protein, 8 aa, Staphylococcus
GKEKNGVH

SEQ ID NO: 1944640 - protein, 8 aa, Staphylococcus
GKEKPVPS

SEQ ID NO: 1944641 - protein, 8 aa, Staphylococcus
GKEKTKHM

SEQ ID NO: 1944642 - protein, 9 aa, Staphylococcus
GKEKTKSMP

SEQ ID NO: 1944643 - protein, 9 aa, Staphylococcus
GKEKTSAMD

SEQ ID NO: 1944644 - protein, 9 aa, Staphylococcus
GKEKTSSLN

SEQ ID NO: 1944645 - protein, 7 aa, Staphylococcus
GKELESN

SEQ ID NO: 1944646 - protein, 7 aa, Staphylococcus
GKELGVG

SEQ ID NO: 1944647 - protein, 9 aa, Staphylococcus
GKELKQAIK

SEQ ID NO: 1944648 - protein, 12 aa, Staphylococcus
GKELPGIQSISD

SEQ ID NO: 1944649 - protein, 6 aa, Staphylococcus
GKEMNE

SEQ ID NO: 1944650 - protein, 9 aa, Staphylococcus
GKENEQKLE

SEQ ID NO: 1944651 - protein, 5 aa, Staphylococcus
GKENF

SEQ ID NO: 1944652 - protein, 10 aa, Staphylococcus
GKENGVTKEE

SEQ ID NO: 1944653 - protein, 12 aa, Staphylococcus
GKENQTSIQPDY

SEQ ID NO: 1944654 - protein, 6 aa, Staphylococcus
GKEPIQ

SEQ ID NO: 1944655 - protein, 9 aa, Staphylococcus
GKEPLDNTA

SEQ ID NO: 1944656 - protein, 15 aa, Staphylococcus
GKEPLDNTSIHPESY

SEQ ID NO: 1944657 - protein, 16 aa, Staphylococcus
GKEPLDNTSIHPESYQ

SEQ ID NO: 1944658 - protein, 11 aa, Staphylococcus
GKEPPGTPPMT

SEQ ID NO: 1944659 - protein, 6 aa, Staphylococcus
GKEQSI

SEQ ID NO: 1944660 - protein, 6 aa, Staphylococcus
GKEQVD

SEQ ID NO: 1944661 - protein, 17 aa, Staphylococcus
GKERKSIAQIDEFLAQY

SEQ ID NO: 1944662 - protein, 17 aa, Staphylococcus
GKERKSIEQIDEFLSKY

SEQ ID NO: 1944663 - protein, 17 aa, Staphylococcus
GKERKSIEQIDSFLSQY

SEQ ID NO: 1944664 - protein, 6 aa, Staphylococcus
GKESEE

SEQ ID NO: 1944665 - protein, 15 aa, Staphylococcus
GKESESREKVASEIE

SEQ ID NO: 1944666 - protein, 7 aa, Staphylococcus
GKETDKV

SEQ ID NO: 1944667 - protein, 11 aa, Staphylococcus
GKEVKTLKKGD

SEQ ID NO: 1944668 - protein, 14 aa, Staphylococcus
GKEVPSDAKTTIEN

SEQ ID NO: 1944669 - protein, 14 aa, Staphylococcus
GKEVTQQQAEKTFG

SEQ ID NO: 1944670 - protein, 19 aa, Staphylococcus
GKEYGKQKAYVRDVDIDDL

SEQ ID NO: 1944671 - protein, 9 aa, Staphylococcus
GKEYSTQKV

SEQ ID NO: 1944672 - protein, 6 aa, Staphylococcus
GKEYTP

SEQ ID NO: 1944673 - protein, 19 aa, Staphylococcus
GKFDNEDIQTKAIEASETN

SEQ ID NO: 1944674 - protein, 9 aa, Staphylococcus
GKFDSSGHY

SEQ ID NO: 1944675 - protein, 5 aa, Staphylococcus
GKFED

SEQ ID NO: 1944676 - protein, 10 aa, Staphylococcus
GKFKDSVHTG

SEQ ID NO: 1944677 - protein, 8 aa, Staphylococcus
GKFNHGDK

SEQ ID NO: 1944678 - protein, 9 aa, Staphylococcus
GKFNHGDKA

SEQ ID NO: 1944679 - protein, 16 aa, Staphylococcus
GKFNHGDKAKAHIQAG

SEQ ID NO: 1944680 - protein, 7 aa, Staphylococcus
GKFNKDD

SEQ ID NO: 1944681 - protein, 7 aa, Staphylococcus
GKFNKDN

SEQ ID NO: 1944682 - protein, 9 aa, Staphylococcus
GKFNKENAN

SEQ ID NO: 1944683 - protein, 15 aa, Staphylococcus
GKGAHAAKPEQGKDP

SEQ ID NO: 1944684 - protein, 18 aa, Staphylococcus
GKGAHAAKPEQGNDPTVA

SEQ ID NO: 1944685 - protein, 9 aa, Staphylococcus
GKGAKQDPD

SEQ ID NO: 1944686 - protein, 10 aa, Staphylococcus
GKGAQEAHES

SEQ ID NO: 1944687 - protein, 22 aa, Staphylococcus
GKGAYSNDPGAVANGYNERDFN

SEQ ID NO: 1944688 - protein, 4 aa, Staphylococcus
GKGC

SEQ ID NO: 1944689 - protein, 6 aa, Staphylococcus
GKGDAL

SEQ ID NO: 1944690 - protein, 10 aa, Staphylococcus
GKGDFQVSER

SEQ ID NO: 1944691 - protein, 15 aa, Staphylococcus
GKGDGVATPKFSPEG

SEQ ID NO: 1944692 - protein, 7 aa, Staphylococcus
GKGDNIN

SEQ ID NO: 1944693 - protein, 9 aa, Staphylococcus
GKGDTETKV

SEQ ID NO: 1944694 - protein, 7 aa, Staphylococcus
GKGEEKL

SEQ ID NO: 1944695 - protein, 15 aa, Staphylococcus
GKGFDPNLKPQGTGL

SEQ ID NO: 1944696 - protein, 5 aa, Staphylococcus
GKGGF

SEQ ID NO: 1944697 - protein, 12 aa, Staphylococcus
GKGGGRKLADEL

SEQ ID NO: 1944698 - protein, 13 aa, Staphylococcus
GKGGGRKLADELN

SEQ ID NO: 1944699 - protein, 15 aa, Staphylococcus
GKGGHAAKPEESNDP

SEQ ID NO: 1944700 - protein, 13 aa, Staphylococcus
GKGGKKLKEIGKR

SEQ ID NO: 1944701 - protein, 18 aa, Staphylococcus
GKGGKKLKEVGKRARQDI

SEQ ID NO: 1944702 - protein, 17 aa, Staphylococcus
GKGGKKLKEVGKRARRD

SEQ ID NO: 1944703 - protein, 7 aa, Staphylococcus
GKGGTKI

SEQ ID NO: 1944704 - protein, 5 aa, Staphylococcus
GKGHM

SEQ ID NO: 1944705 - protein, 6 aa, Staphylococcus
GKGHMN

SEQ ID NO: 1944706 - protein, 7 aa, Staphylococcus
GKGHMSG

SEQ ID NO: 1944707 - protein, 14 aa, Staphylococcus
GKGIKAALEKSASY

SEQ ID NO: 1944708 - protein, 11 aa, Staphylococcus
GKGIREALEQS

SEQ ID NO: 1944709 - protein, 8 aa, Staphylococcus
GKGKAGVL

SEQ ID NO: 1944710 - protein, 11 aa, Staphylococcus
GKGKRQPNEVP

SEQ ID NO: 1944711 - protein, 9 aa, Staphylococcus
GKGKVGRVR

SEQ ID NO: 1944712 - protein, 7 aa, Staphylococcus
GKGKYNL

SEQ ID NO: 1944713 - protein, 4 aa, Staphylococcus
GKGL

SEQ ID NO: 1944714 - protein, 36 aa, Staphylococcus
GKGLATEETPLDYNATGDRKVTVDGVEGLEKETARI

SEQ ID NO: 1944715 - protein, 7 aa, Staphylococcus
GKGLTDD

SEQ ID NO: 1944716 - protein, 7 aa, Staphylococcus
GKGPGKY

SEQ ID NO: 1944717 - protein, 7 aa, Staphylococcus
GKGQTKI

SEQ ID NO: 1944718 - protein, 8 aa, Staphylococcus
GKGRPGVL

SEQ ID NO: 1944719 - protein, 7 aa, Staphylococcus
GKGRSGF

SEQ ID NO: 1944720 - protein, 9 aa, Staphylococcus
GKGSAHEPQ

SEQ ID NO: 1944721 - protein, 8 aa, Staphylococcus
GKGSENPP

SEQ ID NO: 1944722 - protein, 9 aa, Staphylococcus
GKGSESGNA

SEQ ID NO: 1944723 - protein, 7 aa, Staphylococcus
GKGSKER

SEQ ID NO: 1944724 - protein, 9 aa, Staphylococcus
GKGSKHGPR

SEQ ID NO: 1944725 - protein, 7 aa, Staphylococcus
GKGSKIY

SEQ ID NO: 1944726 - protein, 11 aa, Staphylococcus
GKGSLSGQGKA

SEQ ID NO: 1944727 - protein, 8 aa, Staphylococcus
GKGSTHPP

SEQ ID NO: 1944728 - protein, 14 aa, Staphylococcus
GKGTFVKEQDQSIL

SEQ ID NO: 1944729 - protein, 8 aa, Staphylococcus
GKGTHITD

SEQ ID NO: 1944730 - protein, 14 aa, Staphylococcus
GKGTYVKEQDNSIL

SEQ ID NO: 1944731 - protein, 10 aa, Staphylococcus
GKGYKHKDSE

SEQ ID NO: 1944732 - protein, 8 aa, Staphylococcus
GKGYQHKD

SEQ ID NO: 1944733 - protein, 14 aa, Staphylococcus
GKGYQHKDNDFKEL

SEQ ID NO: 1944734 - protein, 7 aa, Staphylococcus
GKHDTIG

SEQ ID NO: 1944735 - protein, 9 aa, Staphylococcus
GKHGEKATV

SEQ ID NO: 1944736 - protein, 7 aa, Staphylococcus
GKHGEKV

SEQ ID NO: 1944737 - protein, 8 aa, Staphylococcus
GKHGEKVT

SEQ ID NO: 1944738 - protein, 13 aa, Staphylococcus
GKHGGYQANQHTA

SEQ ID NO: 1944739 - protein, 16 aa, Staphylococcus
GKHQAYQKSEEEISQL

SEQ ID NO: 1944740 - protein, 4 aa, Staphylococcus
GKHR

SEQ ID NO: 1944741 - protein, 6 aa, Staphylococcus
GKIAAI

SEQ ID NO: 1944742 - protein, 10 aa, Staphylococcus
GKIADTPNEA

SEQ ID NO: 1944743 - protein, 10 aa, Staphylococcus
GKIADTTEEA

SEQ ID NO: 1944744 - protein, 9 aa, Staphylococcus
GKIAGLGGY

SEQ ID NO: 1944745 - protein, 7 aa, Staphylococcus
GKIARRA

SEQ ID NO: 1944746 - protein, 18 aa, Staphylococcus
GKIAYDSQRKTDEPRGGE

SEQ ID NO: 1944747 - protein, 19 aa, Staphylococcus
GKIAYDSQTKNDEPRGGEY

SEQ ID NO: 1944748 - protein, 9 aa, Staphylococcus
GKIDEGESY

SEQ ID NO: 1944749 - protein, 6 aa, Staphylococcus
GKIDKD

SEQ ID NO: 1944750 - protein, 16 aa, Staphylococcus
GKIDSKKLKEINTEKC

SEQ ID NO: 1944751 - protein, 19 aa, Staphylococcus
GKIDTDKKTITFKEDSESL

SEQ ID NO: 1944752 - protein, 6 aa, Staphylococcus
GKIDYG

SEQ ID NO: 1944753 - protein, 8 aa, Staphylococcus
GKIEETAK

SEQ ID NO: 1944754 - protein, 10 aa, Staphylococcus
GKIEGLHPGR

SEQ ID NO: 1944755 - protein, 12 aa, Staphylococcus
GKIEKGESEEAA

SEQ ID NO: 1944756 - protein, 12 aa, Staphylococcus
GKIEQGESDVDA

SEQ ID NO: 1944757 - protein, 7 aa, Staphylococcus
GKIETTI

SEQ ID NO: 1944758 - protein, 7 aa, Staphylococcus
GKIGAHG

SEQ ID NO: 1944759 - protein, 8 aa, Staphylococcus
GKIGGEDD

SEQ ID NO: 1944760 - protein, 14 aa, Staphylococcus
GKIGRKSREDKNNW

SEQ ID NO: 1944761 - protein, 12 aa, Staphylococcus
GKIGTKPSYQAM

SEQ ID NO: 1944762 - protein, 13 aa, Staphylococcus
GKIGTKTSYQTMQ

SEQ ID NO: 1944763 - protein, 7 aa, Staphylococcus
GKIGTKV

SEQ ID NO: 1944764 - protein, 4 aa, Staphylococcus
GKIH

SEQ ID NO: 1944765 - protein, 19 aa, Staphylococcus
GKIHPHEKVRTKKRAFKSL

SEQ ID NO: 1944766 - protein, 10 aa, Staphylococcus
GKIKDSVHTG

SEQ ID NO: 1944767 - protein, 8 aa, Staphylococcus
GKIKGIAQ

SEQ ID NO: 1944768 - protein, 8 aa, Staphylococcus
GKIKPAVN

SEQ ID NO: 1944769 - protein, 12 aa, Staphylococcus
GKIKSKTSIAEG

SEQ ID NO: 1944770 - protein, 7 aa, Staphylococcus
GKIKTEV

SEQ ID NO: 1944771 - protein, 13 aa, Staphylococcus
GKIKTKTSVADGF

SEQ ID NO: 1944772 - protein, 13 aa, Staphylococcus
GKIKTQVSVEEGF

SEQ ID NO: 1944773 - protein, 12 aa, Staphylococcus
GKINKDNKGDID

SEQ ID NO: 1944774 - protein, 14 aa, Staphylococcus
GKIPEEKVLKYKQY

SEQ ID NO: 1944775 - protein, 18 aa, Staphylococcus
GKIPGGFKKEKDVQEMTQ

SEQ ID NO: 1944776 - protein, 20 aa, Staphylococcus
GKIPGGFKKREGRPADEATL

SEQ ID NO: 1944777 - protein, 20 aa, Staphylococcus
GKIPGGFKKREGRPSDEATL

SEQ ID NO: 1944778 - protein, 17 aa, Staphylococcus
GKIPPKKPRHTESFISE

SEQ ID NO: 1944779 - protein, 8 aa, Staphylococcus
GKIREISS

SEQ ID NO: 1944780 - protein, 4 aa, Staphylococcus
GKIS

SEQ ID NO: 1944781 - protein, 12 aa, Staphylococcus
GKISGRDDEEEV

SEQ ID NO: 1944782 - protein, 7 aa, Staphylococcus
GKITRNA

SEQ ID NO: 1944783 - protein, 6 aa, Staphylococcus
GKIVNT

SEQ ID NO: 1944784 - protein, 7 aa, Staphylococcus
GKIVTKD

SEQ ID NO: 1944785 - protein, 5 aa, Staphylococcus
GKKAL

SEQ ID NO: 1944786 - protein, 6 aa, Staphylococcus
GKKALD

SEQ ID NO: 1944787 - protein, 7 aa, Staphylococcus
GKKALDS

SEQ ID NO: 1944788 - protein, 10 aa, Staphylococcus
GKKATGVTFK

SEQ ID NO: 1944789 - protein, 15 aa, Staphylococcus
GKKDDINSGGKQMPS

SEQ ID NO: 1944790 - protein, 16 aa, Staphylococcus
GKKDDVNSGGKQMPAH

SEQ ID NO: 1944791 - protein, 9 aa, Staphylococcus
GKKDPIGAM

SEQ ID NO: 1944792 - protein, 15 aa, Staphylococcus
GKKEDINSGGKQMPS

SEQ ID NO: 1944793 - protein, 6 aa, Staphylococcus
GKKEGY

SEQ ID NO: 1944794 - protein, 8 aa, Staphylococcus
GKKEISIR

SEQ ID NO: 1944795 - protein, 22 aa, Staphylococcus
GKKEYAGKPITKDTAKKVRTEL

SEQ ID NO: 1944796 - protein, 5 aa, Staphylococcus
GKKFS

SEQ ID NO: 1944797 - protein, 7 aa, Staphylococcus
GKKGAAE

SEQ ID NO: 1944798 - protein, 6 aa, Staphylococcus
GKKGAL

SEQ ID NO: 1944799 - protein, 16 aa, Staphylococcus
GKKGDLASRRQAAKTL

SEQ ID NO: 1944800 - protein, 10 aa, Staphylococcus
GKKGYSAENV

SEQ ID NO: 1944801 - protein, 5 aa, Staphylococcus
GKKIA

SEQ ID NO: 1944802 - protein, 27 aa, Staphylococcus
GKKIHDKRQALKDKAMKRDVDRAIKAR

SEQ ID NO: 1944803 - protein, 27 aa, Staphylococcus
GKKIHDKRQALKDKAMKRDVDRAIKDR

SEQ ID NO: 1944804 - protein, 19 aa, Staphylococcus
GKKKQYTHASYGPYKRPNR

SEQ ID NO: 1944805 - protein, 27 aa, Staphylococcus
GKKKYDKRQALKEKAVKRDMDRAVKAR

SEQ ID NO: 1944806 - protein, 4 aa, Staphylococcus
GKKL

SEQ ID NO: 1944807 - protein, 7 aa, Staphylococcus
GKKLMSQ

SEQ ID NO: 1944808 - protein, 23 aa, Staphylococcus
GKKLTSKDTKNYSPVKPKDLTYS

SEQ ID NO: 1944809 - protein, 7 aa, Staphylococcus
GKKMGTH

SEQ ID NO: 1944810 - protein, 8 aa, Staphylococcus
GKKPLDPE

SEQ ID NO: 1944811 - protein, 8 aa, Staphylococcus
GKKPLEPQ

SEQ ID NO: 1944812 - protein, 10 aa, Staphylococcus
GKKQKEPYLN

SEQ ID NO: 1944813 - protein, 4 aa, Staphylococcus
GKKR

SEQ ID NO: 1944814 - protein, 6 aa, Staphylococcus
GKKREN

SEQ ID NO: 1944815 - protein, 9 aa, Staphylococcus
GKKRHVPED

SEQ ID NO: 1944816 - protein, 8 aa, Staphylococcus
GKKRMPTA

SEQ ID NO: 1944817 - protein, 7 aa, Staphylococcus
GKKRMPV

SEQ ID NO: 1944818 - protein, 9 aa, Staphylococcus
GKKRNDKRK

SEQ ID NO: 1944819 - protein, 9 aa, Staphylococcus
GKKRTKKMS

SEQ ID NO: 1944820 - protein, 7 aa, Staphylococcus
GKKSHQT

SEQ ID NO: 1944821 - protein, 8 aa, Staphylococcus
GKKSHQTF

SEQ ID NO: 1944822 - protein, 16 aa, Staphylococcus
GKKTGGLFDGETPGGI

SEQ ID NO: 1944823 - protein, 33 aa, Staphylococcus
GKKTGNTPDGRKAGEPFAPGANPMHGRDEHGAL

SEQ ID NO: 1944824 - protein, 37 aa, Staphylococcus; identical to SEQ ID NO: 1602155

SEQ ID NO: 1944825 - protein, 38 aa, Staphylococcus; identical to SEQ ID NO: 1637407

SEQ ID NO: 1944826 - protein, 8 aa, Staphylococcus
GKKTTFQE

SEQ ID NO: 1944827 - protein, 7 aa, Staphylococcus
GKKTYSD

SEQ ID NO: 1944828 - protein, 5 aa, Staphylococcus
GKKVQ

SEQ ID NO: 1944829 - protein, 4 aa, Staphylococcus
GKLD

SEQ ID NO: 1944830 - protein, 5 aa, Staphylococcus
GKLDE

SEQ ID NO: 1944831 - protein, 9 aa, Staphylococcus
GKLDIPEED

SEQ ID NO: 1944832 - protein, 8 aa, Staphylococcus
GKLDITDE

SEQ ID NO: 1944833 - protein, 19 aa, Staphylococcus
GKLDITDEDYATLDAAKDL

SEQ ID NO: 1944834 - protein, 25 aa, Staphylococcus
GKLEEDEEREEAAKRELEEETGYKA

SEQ ID NO: 1944835 - protein, 7 aa, Staphylococcus
GKLEEEK

SEQ ID NO: 1944836 - protein, 25 aa, Staphylococcus
GKLEGSYIGKERKSIDQIDAFLAKY

SEQ ID NO: 1944837 - protein, 23 aa, Staphylococcus
GKLEKGEARLSAAKRELEEETGY

SEQ ID NO: 1944838 - protein, 13 aa, Staphylococcus
GKLELKSGSKWSK

SEQ ID NO: 1944839 - protein, 11 aa, Staphylococcus
GKLELKSGSRW

SEQ ID NO: 1944840 - protein, 23 aa, Staphylococcus
GKLEQGEQLESAAKRELSEETGY

SEQ ID NO: 1944841 - protein, 16 aa, Staphylococcus
GKLGGYQIKDAQSKIS

SEQ ID NO: 1944842 - protein, 16 aa, Staphylococcus
GKLGGYQLQETPNSYE

SEQ ID NO: 1944843 - protein, 14 aa, Staphylococcus
GKLHGRGAADMKSG

SEQ ID NO: 1944844 - protein, 6 aa, Staphylococcus
GKLHTV

SEQ ID NO: 1944845 - protein, 4 aa, Staphylococcus
GKLK

SEQ ID NO: 1944846 - protein, 8 aa, Staphylococcus
GKLKQRPL

SEQ ID NO: 1944847 - protein, 9 aa, Staphylococcus
GKLNDKPYS

SEQ ID NO: 1944848 - protein, 29 aa, Staphylococcus
GKLPENYKDELPKFSSDHNAATRADSGEI

SEQ ID NO: 1944849 - protein, 7 aa, Staphylococcus
GKLPKDV

SEQ ID NO: 1944850 - protein, 8 aa, Staphylococcus
GKLPKGKK

SEQ ID NO: 1944851 - protein, 29 aa, Staphylococcus
GKLPKNYRDELPRFDSDHNAATRADSGEV

SEQ ID NO: 1944852 - protein, 8 aa, Staphylococcus
GKLPQGKK

SEQ ID NO: 1944853 - protein, 29 aa, Staphylococcus
GKLPQNYEKELPKFDADHNAASRADSGEV

SEQ ID NO: 1944854 - protein, 14 aa, Staphylococcus
GKLPQNYEKELPKY

SEQ ID NO: 1944855 - protein, 12 aa, Staphylococcus
GKLPSNYKEKLP

SEQ ID NO: 1944856 - protein, 7 aa, Staphylococcus
GKLPTGV

SEQ ID NO: 1944857 - protein, 8 aa, Staphylococcus
GKLQPGVY

SEQ ID NO: 1944858 - protein, 9 aa, Staphylococcus
GKLSDAKAN

SEQ ID NO: 1944859 - protein, 8 aa, Staphylococcus
GKLSGAHG

SEQ ID NO: 1944860 - protein, 9 aa, Staphylococcus
GKLSQNKKG

SEQ ID NO: 1944861 - protein, 16 aa, Staphylococcus
GKLYQRKDDNPETVSN

SEQ ID NO: 1944862 - protein, 4 aa, Staphylococcus
GKMI

SEQ ID NO: 1944863 - protein, 5 aa, Staphylococcus
GKMKG

SEQ ID NO: 1944864 - protein, 8 aa, Staphylococcus
GKMPDDPS

SEQ ID NO: 1944865 - protein, 5 aa, Staphylococcus
GKMTK

SEQ ID NO: 1944866 - protein, 10 aa, Staphylococcus
GKNAETGKYE

SEQ ID NO: 1944867 - protein, 9 aa, Staphylococcus
GKNAGQNPD

SEQ ID NO: 1944868 - protein, 11 aa, Staphylococcus
GKNAPSRDEIE

SEQ ID NO: 1944869 - protein, 8 aa, Staphylococcus
GKNARGIN

SEQ ID NO: 1944870 - protein, 13 aa, Staphylococcus
GKNDEIKTSTKRR

SEQ ID NO: 1944871 - protein, 9 aa, Staphylococcus
GKNFGQGMS

SEQ ID NO: 1944872 - protein, 10 aa, Staphylococcus
GKNGAGKTTL

SEQ ID NO: 1944873 - protein, 9 aa, Staphylococcus
GKNGASIYT

SEQ ID NO: 1944874 - protein, 11 aa, Staphylococcus
GKNGKIEPGLA

SEQ ID NO: 1944875 - protein, 9 aa, Staphylococcus
GKNGSGKST

SEQ ID NO: 1944876 - protein, 9 aa, Staphylococcus
GKNGSGKSV

SEQ ID NO: 1944877 - protein, 9 aa, Staphylococcus
GKNGSGKTT

SEQ ID NO: 1944878 - protein, 10 aa, Staphylococcus
GKNGSGKTTL

SEQ ID NO: 1944879 - protein, 10 aa, Staphylococcus
GKNGTGKTSL

SEQ ID NO: 1944880 - protein, 9 aa, Staphylococcus
GKNGTGKTT

SEQ ID NO: 1944881 - protein, 9 aa, Staphylococcus
GKNGVNKTV

SEQ ID NO: 1944882 - protein, 5 aa, Staphylococcus
GKNID

SEQ ID NO: 1944883 - protein, 6 aa, Staphylococcus
GKNIHA

SEQ ID NO: 1944884 - protein, 7 aa, Staphylococcus
GKNIHTT

SEQ ID NO: 1944885 - protein, 5 aa, Staphylococcus
GKNIS

SEQ ID NO: 1944886 - protein, 15 aa, Staphylococcus
GKNKDDRTQTGTVSK

SEQ ID NO: 1944887 - protein, 8 aa, Staphylococcus
GKNKEERV

SEQ ID NO: 1944888 - protein, 12 aa, Staphylococcus
GKNKPTYTPHVD

SEQ ID NO: 1944889 - protein, 11 aa, Staphylococcus
GKNKQEVSEDV

SEQ ID NO: 1944890 - protein, 16 aa, Staphylococcus
GKNKSDLSVDKLKAYG

SEQ ID NO: 1944891 - protein, 8 aa, Staphylococcus
GKNKVGSR

SEQ ID NO: 1944892 - protein, 7 aa, Staphylococcus
GKNKVNS

SEQ ID NO: 1944893 - protein, 10 aa, Staphylococcus
GKNNETSSAK

SEQ ID NO: 1944894 - protein, 8 aa, Staphylococcus
GKNNPNSF

SEQ ID NO: 1944895 - protein, 9 aa, Staphylococcus
GKNNTKETS

SEQ ID NO: 1944896 - protein, 14 aa, Staphylococcus
GKNPKYNFERDEKF

SEQ ID NO: 1944897 - protein, 10 aa, Staphylococcus
GKNPQTGKYE

SEQ ID NO: 1944898 - protein, 27 aa, Staphylococcus
GKNQSIPQDDSKATFASNISRADERVD

SEQ ID NO: 1944899 - protein, 9 aa, Staphylococcus
GKNQTPHYV

SEQ ID NO: 1944900 - protein, 10 aa, Staphylococcus
GKNRPGTNSI

SEQ ID NO: 1944901 - protein, 11 aa, Staphylococcus
GKNRRADRRAI

SEQ ID NO: 1944902 - protein, 9 aa, Staphylococcus
GKNSEQDPD

SEQ ID NO: 1944903 - protein, 9 aa, Staphylococcus
GKNSGQNPD

SEQ ID NO: 1944904 - protein, 9 aa, Staphylococcus
GKNSTEADI

SEQ ID NO: 1944905 - protein, 9 aa, Staphylococcus
GKNVGEPLD

SEQ ID NO: 1944906 - protein, 4 aa, Staphylococcus
GKNY

SEQ ID NO: 1944907 - protein, 9 aa, Staphylococcus
GKNYKQGNI

SEQ ID NO: 1944908 - protein, 9 aa, Staphylococcus
GKNYRDSPK

SEQ ID NO: 1944909 - protein, 17 aa, Staphylococcus
GKNYSKEALATKAINGK

SEQ ID NO: 1944910 - protein, 4 aa, Staphylococcus
GKPC

SEQ ID NO: 1944911 - protein, 5 aa, Staphylococcus
GKPCK

SEQ ID NO: 1944912 - protein, 10 aa, Staphylococcus
GKPEKKGYRK

SEQ ID NO: 1944913 - protein, 6 aa, Staphylococcus
GKPELV

SEQ ID NO: 1944914 - protein, 7 aa, Staphylococcus
GKPEPIF

SEQ ID NO: 1944915 - protein, 6 aa, Staphylococcus
GKPFSE

SEQ ID NO: 1944916 - protein, 7 aa, Staphylococcus
GKPFSQE

SEQ ID NO: 1944917 - protein, 6 aa, Staphylococcus
GKPFTQ

SEQ ID NO: 1944918 - protein, 6 aa, Staphylococcus
GKPGLV

SEQ ID NO: 1944919 - protein, 14 aa, Staphylococcus
GKPGLVTKDDVKEG

SEQ ID NO: 1944920 - protein, 4 aa, Staphylococcus
GKPI

SEQ ID NO: 1944921 - protein, 5 aa, Staphylococcus
GKPIA

SEQ ID NO: 1944922 - protein, 4 aa, Staphylococcus
GKPK

SEQ ID NO: 1944923 - protein, 7 aa, Staphylococcus
GKPKAQL

SEQ ID NO: 1944924 - protein, 9 aa, Staphylococcus
GKPKEGETV

SEQ ID NO: 1944925 - protein, 20 aa, Staphylococcus
GKPKSDEQSHALGATVDGGL

SEQ ID NO: 1944926 - protein, 18 aa, Staphylococcus
GKPLNNAEISPINGNLEG

SEQ ID NO: 1944927 - protein, 8 aa, Staphylococcus
GKPLPNRK

SEQ ID NO: 1944928 - protein, 10 aa, Staphylococcus
GKPNKKGYRK

SEQ ID NO: 1944929 - protein, 5 aa, Staphylococcus
GKPNV

SEQ ID NO: 1944930 - protein, 13 aa, Staphylococcus
GKPPREKSEIPAK

SEQ ID NO: 1944931 - protein, 10 aa, Staphylococcus
GKPPSDVNLP

SEQ ID NO: 1944932 - protein, 16 aa, Staphylococcus
GKPQKIVTDQAPSTKV

SEQ ID NO: 1944933 - protein, 16 aa, Staphylococcus
GKPQKVITDQAPSTKV

SEQ ID NO: 1944934 - protein, 16 aa, Staphylococcus
GKPQKVVTDQAPSTKV

SEQ ID NO: 1944935 - protein, 9 aa, Staphylococcus
GKPSGIDAQ

SEQ ID NO: 1944936 - protein, 9 aa, Staphylococcus
GKPSKAEME

SEQ ID NO: 1944937 - protein, 19 aa, Staphylococcus
GKPTEIKGSFSSGTAERGW

SEQ ID NO: 1944938 - protein, 10 aa, Staphylococcus
GKPVAESRAF

SEQ ID NO: 1944939 - protein, 5 aa, Staphylococcus
GKPVD

SEQ ID NO: 1944940 - protein, 5 aa, Staphylococcus
GKPVH

SEQ ID NO: 1944941 - protein, 5 aa, Staphylococcus
GKPYA

SEQ ID NO: 1944942 - protein, 8 aa, Staphylococcus
GKQAENIA

SEQ ID NO: 1944943 - protein, 7 aa, Staphylococcus
GKQANLK

SEQ ID NO: 1944944 - protein, 12 aa, Staphylococcus
GKQEPGNGQEAM

SEQ ID NO: 1944945 - protein, 5 aa, Staphylococcus
GKQGL

SEQ ID NO: 1944946 - protein, 6 aa, Staphylococcus
GKQGLQ

SEQ ID NO: 1944947 - protein, 6 aa, Staphylococcus
GKQGNA

SEQ ID NO: 1944948 - protein, 7 aa, Staphylococcus
GKQGNAV

SEQ ID NO: 1944949 - protein, 7 aa, Staphylococcus
GKQGTIL

SEQ ID NO: 1944950 - protein, 7 aa, Staphylococcus
GKQNHPY

SEQ ID NO: 1944951 - protein, 6 aa, Staphylococcus
GKQPDM

SEQ ID NO: 1944952 - protein, 9 aa, Staphylococcus
GKQPTSTTI

SEQ ID NO: 1944953 - protein, 16 aa, Staphylococcus
GKQQRRVGGVGTGGGM

SEQ ID NO: 1944954 - protein, 31 aa, Staphylococcus
GKQSGTTINDNYTGGTNGGSFEMSSSNDAFK

SEQ ID NO: 1944955 - protein, 4 aa, Staphylococcus
GKQT

SEQ ID NO: 1944956 - protein, 5 aa, Staphylococcus
GKQTE

SEQ ID NO: 1944957 - protein, 20 aa, Staphylococcus
GKQTEILEQGPTISKEEGAN

SEQ ID NO: 1944958 - protein, 5 aa, Staphylococcus
GKQTP

SEQ ID NO: 1944959 - protein, 6 aa, Staphylococcus
GKQTRD

SEQ ID NO: 1944960 - protein, 7 aa, Staphylococcus
GKQTVEQ

SEQ ID NO: 1944961 - protein, 7 aa, Staphylococcus
GKQTVKN

SEQ ID NO: 1944962 - protein, 7 aa, Staphylococcus
GKQTVKQ

SEQ ID NO: 1944963 - protein, 8 aa, Staphylococcus
GKQTVKSL

SEQ ID NO: 1944964 - protein, 12 aa, Staphylococcus
GKQYHADKNHPF

SEQ ID NO: 1944965 - protein, 5 aa, Staphylococcus
GKQYT

SEQ ID NO: 1944966 - protein, 4 aa, Staphylococcus
GKRD

SEQ ID NO: 1944967 - protein, 17 aa, Staphylococcus
GKRDDINSGGKQMPSHY

SEQ ID NO: 1944968 - protein, 7 aa, Staphylococcus
GKRDTVA

SEQ ID NO: 1944969 - protein, 4 aa, Staphylococcus
GKRF

SEQ ID NO: 1944970 - protein, 18 aa, Staphylococcus
GKRIDNIKESEYNKMRGK

SEQ ID NO: 1944971 - protein, 6 aa, Staphylococcus
GKRIGK

SEQ ID NO: 1944972 - protein, 8 aa, Staphylococcus
GKRKTKDM

SEQ ID NO: 1944973 - protein, 5 aa, Staphylococcus
GKRLE

SEQ ID NO: 1944974 - protein, 8 aa, Staphylococcus
GKRLYEDN

SEQ ID NO: 1944975 - protein, 8 aa, Staphylococcus
GKRLYSDN

SEQ ID NO: 1944976 - protein, 8 aa, Staphylococcus
GKRMYDDN

SEQ ID NO: 1944977 - protein, 5 aa, Staphylococcus
GKRPA

SEQ ID NO: 1944978 - protein, 6 aa, Staphylococcus
GKRREL

SEQ ID NO: 1944979 - protein, 10 aa, Staphylococcus
GKRSQQASQM

SEQ ID NO: 1944980 - protein, 6 aa, Staphylococcus
GKRSVA

SEQ ID NO: 1944981 - protein, 7 aa, Staphylococcus
GKSAGEA

SEQ ID NO: 1944982 - protein, 15 aa, Staphylococcus
GKSAHGSRPWEGDNA

SEQ ID NO: 1944983 - protein, 6 aa, Staphylococcus
GKSANI

SEQ ID NO: 1944984 - protein, 9 aa, Staphylococcus
GKSAYNSAK

SEQ ID NO: 1944985 - protein, 7 aa, Staphylococcus
GKSDDFN

SEQ ID NO: 1944986 - protein, 9 aa, Staphylococcus
GKSDKKKVQ

SEQ ID NO: 1944987 - protein, 9 aa, Staphylococcus
GKSDKKRVK

SEQ ID NO: 1944988 - protein, 5 aa, Staphylococcus
GKSEA

SEQ ID NO: 1944989 - protein, 4 aa, Staphylococcus
GKSF

SEQ ID NO: 1944990 - protein, 15 aa, Staphylococcus
GKSFKYTSEGPQGLL

SEQ ID NO: 1944991 - protein, 10 aa, Staphylococcus
GKSGAEEKLK

SEQ ID NO: 1944992 - protein, 7 aa, Staphylococcus
GKSGLGV

SEQ ID NO: 1944993 - protein, 15 aa, Staphylococcus
GKSGTGKTTLATREN

SEQ ID NO: 1944994 - protein, 5 aa, Staphylococcus
GKSGV

SEQ ID NO: 1944995 - protein, 5 aa, Staphylococcus
GKSHI

SEQ ID NO: 1944996 - protein, 8 aa, Staphylococcus
GKSINDLD

SEQ ID NO: 1944997 - protein, 8 aa, Staphylococcus
GKSKADAI

SEQ ID NO: 1944998 - protein, 9 aa, Staphylococcus
GKSKDDAIA

SEQ ID NO: 1944999 - protein, 35 aa, Staphylococcus
GKSKDDASKNEFSKVPNVEGQSIDKAKDSLNAKSL

SEQ ID NO: 1945000 - protein, 8 aa, Staphylococcus
GKSKVNKL

SEQ ID NO: 1945001 - protein, 6 aa, Staphylococcus
GKSLSE

SEQ ID NO: 1945002 - protein, 10 aa, Staphylococcus
GKSLSQLTSQ

SEQ ID NO: 1945003 - protein, 9 aa, Staphylococcus
GKSLSTDVK

SEQ ID NO: 1945004 - protein, 8 aa, Staphylococcus
GKSLSTEI

SEQ ID NO: 1945005 - protein, 7 aa, Staphylococcus
GKSNGIE

SEQ ID NO: 1945006 - protein, 56 aa, Staphylococcus
GKSNKNDSTQNKDEPEYHENYDDHTTDQNSEEEHHDGHDKSDKEESKFKKLMKSLF

SEQ ID NO: 1945007 - protein, 6 aa, Staphylococcus
GKSRPY

SEQ ID NO: 1945008 - protein, 34 aa, Staphylococcus
GKSSDSASKADYSKVPNVEGQETQKAEDSMNAQS

SEQ ID NO: 1945009 - protein, 9 aa, Staphylococcus
GKSSKDTQF

SEQ ID NO: 1945010 - protein, 10 aa, Staphylococcus
GKSSTEADIA

SEQ ID NO: 1945011 - protein, 8 aa, Staphylococcus
GKSSYKNV

SEQ ID NO: 1945012 - protein, 8 aa, Staphylococcus
GKSSYKRA

SEQ ID NO: 1945013 - protein, 7 aa, Staphylococcus
GKSTAAK

SEQ ID NO: 1945014 - protein, 7 aa, Staphylococcus
GKSTIGE

SEQ ID NO: 1945015 - protein, 8 aa, Staphylococcus
GKSTNGMF

SEQ ID NO: 1945016 - protein, 14 aa, Staphylococcus
GKSTNGMFDGEATG

SEQ ID NO: 1945017 - protein, 17 aa, Staphylococcus
GKSTNGMFDGEATGGIA

SEQ ID NO: 1945018 - protein, 8 aa, Staphylococcus
GKSTNQLL

SEQ ID NO: 1945019 - protein, 7 aa, Staphylococcus
GKSVSKK

SEQ ID NO: 1945020 - protein, 12 aa, Staphylococcus
GKSYKKNTQSAL

SEQ ID NO: 1945021 - protein, 5 aa, Staphylococcus
GKSYM

SEQ ID NO: 1945022 - protein, 5 aa, Staphylococcus
GKSYV

SEQ ID NO: 1945023 - protein, 6 aa, Staphylococcus
GKSYVD

SEQ ID NO: 1945024 - protein, 18 aa, Staphylococcus
GKTAERLNKLQKSAKTVT

SEQ ID NO: 1945025 - protein, 18 aa, Staphylococcus
GKTAERLSKLQKSGSTVT

SEQ ID NO: 1945026 - protein, 13 aa, Staphylococcus
GKTAHASKPNQGI

SEQ ID NO: 1945027 - protein, 15 aa, Staphylococcus
GKTAHASTPNKGVSA

SEQ ID NO: 1945028 - protein, 19 aa, Staphylococcus
GKTAKNTINQRGSQVADEA

SEQ ID NO: 1945029 - protein, 15 aa, Staphylococcus
GKTATNIEKFTSQGS

SEQ ID NO: 1945030 - protein, 9 aa, Staphylococcus
GKTDKKRVQ

SEQ ID NO: 1945031 - protein, 6 aa, Staphylococcus
GKTDYN

SEQ ID NO: 1945032 - protein, 18 aa, Staphylococcus
GKTEDSIQSYEHNKRPHY

SEQ ID NO: 1945033 - protein, 30 aa, Staphylococcus
GKTEEMKARRNKVSDQIAEKKRNKEDADDV

SEQ ID NO: 1945034 - protein, 30 aa, Staphylococcus
GKTEEMKARRNKVSEEIAEKKRNKENADDV

SEQ ID NO: 1945035 - protein, 9 aa, Staphylococcus
GKTEGAMDA

SEQ ID NO: 1945036 - protein, 8 aa, Staphylococcus
GKTENEKL

SEQ ID NO: 1945037 - protein, 7 aa, Staphylococcus
GKTENGD

SEQ ID NO: 1945038 - protein, 4 aa, Staphylococcus
GKTG

SEQ ID NO: 1945039 - protein, 8 aa, Staphylococcus
GKTGRTTG

SEQ ID NO: 1945040 - protein, 8 aa, Staphylococcus
GKTGSGKS

SEQ ID NO: 1945041 - protein, 6 aa, Staphylococcus
GKTHDG

SEQ ID NO: 1945042 - protein, 5 aa, Staphylococcus
GKTIY

SEQ ID NO: 1945043 - protein, 6 aa, Staphylococcus
GKTKEE

SEQ ID NO: 1945044 - protein, 24 aa, Staphylococcus
GKTLEVDTSEIENAPLPNNKVESL

SEQ ID NO: 1945045 - protein, 15 aa, Staphylococcus
GKTNPTEAAPGTIRG

SEQ ID NO: 1945046 - protein, 9 aa, Staphylococcus
GKTNYDELT

SEQ ID NO: 1945047 - protein, 10 aa, Staphylococcus
GKTPASSTHK

SEQ ID NO: 1945048 - protein, 8 aa, Staphylococcus
GKTPIVAG

SEQ ID NO: 1945049 - protein, 10 aa, Staphylococcus
GKTPQSSYKK

SEQ ID NO: 1945050 - protein, 10 aa, Staphylococcus
GKTPRSSHKK

SEQ ID NO: 1945051 - protein, 10 aa, Staphylococcus
GKTPRSSHRK

SEQ ID NO: 1945052 - protein, 7 aa, Staphylococcus
GKTQDGK

SEQ ID NO: 1945053 - protein, 8 aa, Staphylococcus
GKTQGEDA

SEQ ID NO: 1945054 - protein, 8 aa, Staphylococcus
GKTSFDTD

SEQ ID NO: 1945055 - protein, 7 aa, Staphylococcus
GKTTDEL

SEQ ID NO: 1945056 - protein, 6 aa, Staphylococcus
GKTTFR

SEQ ID NO: 1945057 - protein, 17 aa, Staphylococcus
GKTTGGMFDGEASGNIA

SEQ ID NO: 1945058 - protein, 8 aa, Staphylococcus
GKTTGTDA

SEQ ID NO: 1945059 - protein, 7 aa, Staphylococcus
GKTTTTL

SEQ ID NO: 1945060 - protein, 5 aa, Staphylococcus
GKTVL

SEQ ID NO: 1945061 - protein, 21 aa, Staphylococcus
GKTVSEAKSNAYKKADGIDSE

SEQ ID NO: 1945062 - protein, 11 aa, Staphylococcus
GKTVTSAEAGE

SEQ ID NO: 1945063 - protein, 4 aa, Staphylococcus
GKTY

SEQ ID NO: 1945064 - protein, 8 aa, Staphylococcus
GKTYPKSQ

SEQ ID NO: 1945065 - protein, 14 aa, Staphylococcus
GKTYSNSKENFQNM

SEQ ID NO: 1945066 - protein, 17 aa, Staphylococcus
GKTYTEKDKKSQIEVRK

SEQ ID NO: 1945067 - protein, 9 aa, Staphylococcus
GKVATKRAS

SEQ ID NO: 1945068 - protein, 6 aa, Staphylococcus
GKVDMT

SEQ ID NO: 1945069 - protein, 8 aa, Staphylococcus
GKVDREKY

SEQ ID NO: 1945070 - protein, 12 aa, Staphylococcus
GKVERANQREYG

SEQ ID NO: 1945071 - protein, 9 aa, Staphylococcus
GKVEYRAEK

SEQ ID NO: 1945072 - protein, 7 aa, Staphylococcus
GKVGAHG

SEQ ID NO: 1945073 - protein, 17 aa, Staphylococcus
GKVGKDNENLMIRRKER

SEQ ID NO: 1945074 - protein, 10 aa, Staphylococcus
GKVKKSTEVE

SEQ ID NO: 1945075 - protein, 8 aa, Staphylococcus
GKVKSGES

SEQ ID NO: 1945076 - protein, 7 aa, Staphylococcus
GKVLGKE

SEQ ID NO: 1945077 - protein, 10 aa, Staphylococcus
GKVLGTGEKI

SEQ ID NO: 1945078 - protein, 5 aa, Staphylococcus
GKVNN

SEQ ID NO: 1945079 - protein, 14 aa, Staphylococcus
GKVNPSGKLAETFP

SEQ ID NO: 1945080 - protein, 9 aa, Staphylococcus
GKVPHDRAD

SEQ ID NO: 1945081 - protein, 16 aa, Staphylococcus
GKVPQSMKNEHTSHSN

SEQ ID NO: 1945082 - protein, 16 aa, Staphylococcus
GKVPQTMKHQTKSSNM

SEQ ID NO: 1945083 - protein, 6 aa, Staphylococcus
GKVPRQ

SEQ ID NO: 1945084 - protein, 6 aa, Staphylococcus
GKVRNP

SEQ ID NO: 1945085 - protein, 10 aa, Staphylococcus
GKVRSSEQSL

SEQ ID NO: 1945086 - protein, 5 aa, Staphylococcus
GKVSD

SEQ ID NO: 1945087 - protein, 12 aa, Staphylococcus
GKVSDKKAKLHP

SEQ ID NO: 1945088 - protein, 20 aa, Staphylococcus
GKVSGVSSSNTSTNTSLTAN

SEQ ID NO: 1945089 - protein, 36 aa, Staphylococcus
GKVSHSNSTSNTSTPPGNSNKMVTDDELGNGDSIFD

SEQ ID NO: 1945090 - protein, 8 aa, Staphylococcus
GKVSKDAR

SEQ ID NO: 1945091 - protein, 8 aa, Staphylococcus
GKVTERTY

SEQ ID NO: 1945092 - protein, 11 aa, Staphylococcus
GKVTGAGTDTI

SEQ ID NO: 1945093 - protein, 6 aa, Staphylococcus
GKVTGQ

SEQ ID NO: 1945094 - protein, 9 aa, Staphylococcus
GKVTNEGVA

SEQ ID NO: 1945095 - protein, 7 aa, Staphylococcus
GKVTVDS

SEQ ID NO: 1945096 - protein, 16 aa, Staphylococcus
GKVVESNEELEDSPEF

SEQ ID NO: 1945097 - protein, 13 aa, Staphylococcus
GKVVPKVKTRDLE

SEQ ID NO: 1945098 - protein, 11 aa, Staphylococcus
GKWNRAKQEIN

SEQ ID NO: 1945099 - protein, 12 aa, Staphylococcus
GKWNRSKQEING

SEQ ID NO: 1945100 - protein, 7 aa, Staphylococcus
GKWSSEV

SEQ ID NO: 1945101 - protein, 19 aa, Staphylococcus
GKYDEDQTFDDHRATRRDF

SEQ ID NO: 1945102 - protein, 19 aa, Staphylococcus
GKYDEDTTFDDHRATRRDF

SEQ ID NO: 1945103 - protein, 19 aa, Staphylococcus
GKYEENQTFDDHRAPRRDF

SEQ ID NO: 1945104 - protein, 20 aa, Staphylococcus
GKYEENQTFNDHRATRRDFQ

SEQ ID NO: 1945105 - protein, 5 aa, Staphylococcus
GKYEG

SEQ ID NO: 1945106 - protein, 11 aa, Staphylococcus
GKYEGTENDIE

SEQ ID NO: 1945107 - protein, 19 aa, Staphylococcus
GKYELEKGEATRLPFDIET

SEQ ID NO: 1945108 - protein, 7 aa, Staphylococcus
GKYGEEV

SEQ ID NO: 1945109 - protein, 17 aa, Staphylococcus
GKYGGYQANESTATANL

SEQ ID NO: 1945110 - protein, 5 aa, Staphylococcus
GKYGN

SEQ ID NO: 1945111 - protein, 14 aa, Staphylococcus
GKYGYHNRTNKDNW

SEQ ID NO: 1945112 - protein, 38 aa, Staphylococcus
GKYHKDGETKEVSADKYNQLADKANKIYDKDSQVPHVD

SEQ ID NO: 1945113 - protein, 7 aa, Staphylococcus
GKYNASQ

SEQ ID NO: 1945114 - protein, 12 aa, Staphylococcus
GKYNENSTFDDI

SEQ ID NO: 1945115 - protein, 6 aa, Staphylococcus
GKYNEQ

SEQ ID NO: 1945116 - protein, 6 aa, Staphylococcus
GKYNPS

SEQ ID NO: 1945117 - protein, 7 aa, Staphylococcus
GKYNSQK

SEQ ID NO: 1945118 - protein, 6 aa, Staphylococcus
GKYTDT

SEQ ID NO: 1945119 - protein, 7 aa, Staphylococcus
GKYTEDM

SEQ ID NO: 1945120 - protein, 8 aa, Staphylococcus
GKYTKGAT

SEQ ID NO: 1945121 - protein, 7 aa, Staphylococcus
GKYYTPS

SEQ ID NO: 1945122 - protein, 6 aa, Staphylococcus
GLAAGK

SEQ ID NO: 1945123 - protein, 8 aa, Staphylococcus
GLAEEADG

SEQ ID NO: 1945124 - protein, 9 aa, Staphylococcus
GLAGSEAAY

SEQ ID NO: 1945125 - protein, 9 aa, Staphylococcus
GLAQEQDVT

SEQ ID NO: 1945126 - protein, 4 aa, Staphylococcus
GLAS

SEQ ID NO: 1945127 - protein, 5 aa, Staphylococcus
GLASF

SEQ ID NO: 1945128 - protein, 7 aa, Staphylococcus
GLDAPQY

SEQ ID NO: 1945129 - protein, 9 aa, Staphylococcus
GLDDAGYQN

SEQ ID NO: 1945130 - protein, 17 aa, Staphylococcus
GLDDSKKVSAANRQKLS

SEQ ID NO: 1945131 - protein, 6 aa, Staphylococcus
GLDEAG

SEQ ID NO: 1945132 - protein, 9 aa, Staphylococcus
GLDEQKDGV

SEQ ID NO: 1945133 - protein, 4 aa, Staphylococcus
GLDG

SEQ ID NO: 1945134 - protein, 9 aa, Staphylococcus
GLDKKTESN

SEQ ID NO: 1945135 - protein, 4 aa, Staphylococcus
GLDN

SEQ ID NO: 1945136 - protein, 6 aa, Staphylococcus
GLDPDK

SEQ ID NO: 1945137 - protein, 10 aa, Staphylococcus
GLDPEKRFNV

SEQ ID NO: 1945138 - protein, 7 aa, Staphylococcus
GLDPEQY

SEQ ID NO: 1945139 - protein, 6 aa, Staphylococcus
GLDTGE

SEQ ID NO: 1945140 - protein, 10 aa, Staphylococcus
GLDTHQADDG

SEQ ID NO: 1945141 - protein, 11 aa, Staphylococcus
GLDYQNKKDEI

SEQ ID NO: 1945142 - protein, 6 aa, Staphylococcus
GLEAPQ

SEQ ID NO: 1945143 - protein, 8 aa, Staphylococcus
GLEATGLE

SEQ ID NO: 1945144 - protein, 20 aa, Staphylococcus
GLEDKGDSYPSQLSGGQKQR

SEQ ID NO: 1945145 - protein, 12 aa, Staphylococcus
GLEDPKTGKRPY

SEQ ID NO: 1945146 - protein, 21 aa, Staphylococcus
GLEEKANAYPSQLSGGQKQRV

SEQ ID NO: 1945147 - protein, 5 aa, Staphylococcus
GLEHT

SEQ ID NO: 1945148 - protein, 8 aa, Staphylococcus
GLENNKYH

SEQ ID NO: 1945149 - protein, 7 aa, Staphylococcus
GLEPDKA

SEQ ID NO: 1945150 - protein, 6 aa, Staphylococcus
GLEPGK

SEQ ID NO: 1945151 - protein, 7 aa, Staphylococcus
GLEPGKD

SEQ ID NO: 1945152 - protein, 9 aa, Staphylococcus
GLEPGPKYQ

SEQ ID NO: 1945153 - protein, 18 aa, Staphylococcus
GLEPGPKYQDVKNNETFE

SEQ ID NO: 1945154 - protein, 10 aa, Staphylococcus
GLEPGPKYQE

SEQ ID NO: 1945155 - protein, 17 aa, Staphylococcus
GLEPGPKYQEVKDNDTF

SEQ ID NO: 1945156 - protein, 17 aa, Staphylococcus
GLEPGPKYQEVKTNDTF

SEQ ID NO: 1945157 - protein, 8 aa, Staphylococcus
GLEPGSYF

SEQ ID NO: 1945158 - protein, 6 aa, Staphylococcus
GLEPIN

SEQ ID NO: 1945159 - protein, 7 aa, Staphylococcus
GLEPPKE

SEQ ID NO: 1945160 - protein, 5 aa, Staphylococcus
GLEPT

SEQ ID NO: 1945161 - protein, 7 aa, Staphylococcus
GLEPTEV

SEQ ID NO: 1945162 - protein, 8 aa, Staphylococcus
GLEQERDV

SEQ ID NO: 1945163 - protein, 5 aa, Staphylococcus
GLESR

SEQ ID NO: 1945164 - protein, 9 aa, Staphylococcus
GLESVKHSQ

SEQ ID NO: 1945165 - protein, 15 aa, Staphylococcus
GLETEETSSEENVES

SEQ ID NO: 1945166 - protein, 10 aa, Staphylococcus
GLEVKDDENV

SEQ ID NO: 1945167 - protein, 14 aa, Staphylococcus
GLGDKARYATEARI

SEQ ID NO: 1945168 - protein, 10 aa, Staphylococcus
GLGDSARYAN

SEQ ID NO: 1945169 - protein, 15 aa, Staphylococcus
GLGDSARYATDARIK

SEQ ID NO: 1945170 - protein, 14 aa, Staphylococcus
GLGDSARYATETRI

SEQ ID NO: 1945171 - protein, 15 aa, Staphylococcus
GLGDSARYATGQRIQ

SEQ ID NO: 1945172 - protein, 5 aa, Staphylococcus
GLGEG

SEQ ID NO: 1945173 - protein, 6 aa, Staphylococcus
GLGEMN

SEQ ID NO: 1945174 - protein, 5 aa, Staphylococcus
GLGES

SEQ ID NO: 1945175 - protein, 6 aa, Staphylococcus
GLGGGI

SEQ ID NO: 1945176 - protein, 6 aa, Staphylococcus
GLGKDR

SEQ ID NO: 1945177 - protein, 5 aa, Staphylococcus
GLGKN

SEQ ID NO: 1945178 - protein, 9 aa, Staphylococcus
GLGKTVTAA

SEQ ID NO: 1945179 - protein, 11 aa, Staphylococcus
GLGPTKDDLTK

SEQ ID NO: 1945180 - protein, 13 aa, Staphylococcus
GLGPTKDDLTKQT

SEQ ID NO: 1945181 - protein, 5 aa, Staphylococcus
GLGRT

SEQ ID NO: 1945182 - protein, 9 aa, Staphylococcus
GLGSEQAGA

SEQ ID NO: 1945183 - protein, 26 aa, Staphylococcus
GLGSGATLKGNSLKSSSIAITDNSTI

SEQ ID NO: 1945184 - protein, 6 aa, Staphylococcus
GLGSKK

SEQ ID NO: 1945185 - protein, 5 aa, Staphylococcus
GLGTT

SEQ ID NO: 1945186 - protein, 14 aa, Staphylococcus
GLGYETAKELKNKG

SEQ ID NO: 1945187 - protein, 21 aa, Staphylococcus
GLGYKDQFDEERKTVDDDARI

SEQ ID NO: 1945188 - protein, 4 aa, Staphylococcus
GLHG

SEQ ID NO: 1945189 - protein, 6 aa, Staphylococcus
GLHPED

SEQ ID NO: 1945190 - protein, 7 aa, Staphylococcus
GLHPEDI

SEQ ID NO: 1945191 - protein, 7 aa, Staphylococcus
GLHPGRT

SEQ ID NO: 1945192 - protein, 13 aa, Staphylococcus
GLKANINKTLTPH

SEQ ID NO: 1945193 - protein, 7 aa, Staphylococcus
GLKAPQY

SEQ ID NO: 1945194 - protein, 12 aa, Staphylococcus
GLKAQGEAYLEG

SEQ ID NO: 1945195 - protein, 8 aa, Staphylococcus
GLKDAMEN

SEQ ID NO: 1945196 - protein, 8 aa, Staphylococcus
GLKDAMES

SEQ ID NO: 1945197 - protein, 11 aa, Staphylococcus
GLKDDQGTGQI

SEQ ID NO: 1945198 - protein, 17 aa, Staphylococcus
GLKEESSEEQSVNTETN

SEQ ID NO: 1945199 - protein, 6 aa, Staphylococcus
GLKEGD

SEQ ID NO: 1945200 - protein, 4 aa, Staphylococcus
GLKG

SEQ ID NO: 1945201 - protein, 14 aa, Staphylococcus
GLKGDKAQPELEEY

SEQ ID NO: 1945202 - protein, 10 aa, Staphylococcus
GLKGVKNPSE

SEQ ID NO: 1945203 - protein, 6 aa, Staphylococcus
GLKKGD

SEQ ID NO: 1945204 - protein, 8 aa, Staphylococcus
GLKNNAYH

SEQ ID NO: 1945205 - protein, 19 aa, Staphylococcus
GLKPAANGTLRGGTPAENL

SEQ ID NO: 1945206 - protein, 9 aa, Staphylococcus
GLKRNDEGI

SEQ ID NO: 1945207 - protein, 4 aa, Staphylococcus
GLKS

SEQ ID NO: 1945208 - protein, 8 aa, Staphylococcus
GLKSQGAQ

SEQ ID NO: 1945209 - protein, 10 aa, Staphylococcus
GLKTALTEAG

SEQ ID NO: 1945210 - protein, 9 aa, Staphylococcus
GLKTGEEKD

SEQ ID NO: 1945211 - protein, 8 aa, Staphylococcus
GLKYTDKR

SEQ ID NO: 1945212 - protein, 9 aa, Staphylococcus
GLKYTDKRK

SEQ ID NO: 1945213 - protein, 9 aa, Staphylococcus
GLKYTDKRN

SEQ ID NO: 1945214 - protein, 6 aa, Staphylococcus
GLLNDP

SEQ ID NO: 1945215 - protein, 10 aa, Staphylococcus
GLNAGEGRVL

SEQ ID NO: 1945216 - protein, 10 aa, Staphylococcus
GLNAIEAETS

SEQ ID NO: 1945217 - protein, 7 aa, Staphylococcus
GLNATES

SEQ ID NO: 1945218 - protein, 13 aa, Staphylococcus
GLNENRGKYNSAL

SEQ ID NO: 1945219 - protein, 10 aa, Staphylococcus
GLNERGISTD

SEQ ID NO: 1945220 - protein, 10 aa, Staphylococcus
GLNERGISTN

SEQ ID NO: 1945221 - protein, 5 aa, Staphylococcus
GLNGK

SEQ ID NO: 1945222 - protein, 13 aa, Staphylococcus
GLNKDAAREEFGE

SEQ ID NO: 1945223 - protein, 14 aa, Staphylococcus
GLNKDDAREKWGEE

SEQ ID NO: 1945224 - protein, 14 aa, Staphylococcus
GLNKDDARKEFGEE

SEQ ID NO: 1945225 - protein, 15 aa, Staphylococcus
GLNKDDARKEFGEEQ

SEQ ID NO: 1945226 - protein, 14 aa, Staphylococcus
GLNKDDARKKFGED

SEQ ID NO: 1945227 - protein, 14 aa, Staphylococcus
GLNKDDARQQFGEE

SEQ ID NO: 1945228 - protein, 14 aa, Staphylococcus
GLNKDEARKEFGEE

SEQ ID NO: 1945229 - protein, 6 aa, Staphylococcus
GLNNGA

SEQ ID NO: 1945230 - protein, 8 aa, Staphylococcus
GLNNGANA

SEQ ID NO: 1945231 - protein, 8 aa, Staphylococcus
GLNNGPHA

SEQ ID NO: 1945232 - protein, 9 aa, Staphylococcus
GLNNTAAKT

SEQ ID NO: 1945233 - protein, 12 aa, Staphylococcus
GLNPDPVKQEDI

SEQ ID NO: 1945234 - protein, 8 aa, Staphylococcus
GLNPKTTK

SEQ ID NO: 1945235 - protein, 10 aa, Staphylococcus
GLNQNIPSRY

SEQ ID NO: 1945236 - protein, 7 aa, Staphylococcus
GLNQPNN

SEQ ID NO: 1945237 - protein, 8 aa, Staphylococcus
GLNRTEAL

SEQ ID NO: 1945238 - protein, 11 aa, Staphylococcus
GLPATEARNKK

SEQ ID NO: 1945239 - protein, 6 aa, Staphylococcus
GLPEGT

SEQ ID NO: 1945240 - protein, 7 aa, Staphylococcus
GLPGQQI

SEQ ID NO: 1945241 - protein, 5 aa, Staphylococcus
GLPKE

SEQ ID NO: 1945242 - protein, 6 aa, Staphylococcus
GLPKHG

SEQ ID NO: 1945243 - protein, 12 aa, Staphylococcus
GLPMGGYGGRQD

SEQ ID NO: 1945244 - protein, 4 aa, Staphylococcus
GLPN

SEQ ID NO: 1945245 - protein, 10 aa, Staphylococcus
GLPNDSKIGN

SEQ ID NO: 1945246 - protein, 6 aa, Staphylococcus
GLPNEL

SEQ ID NO: 1945247 - protein, 9 aa, Staphylococcus
GLPNTTPAM

SEQ ID NO: 1945248 - protein, 12 aa, Staphylococcus
GLPPGQMGNSEV

SEQ ID NO: 1945249 - protein, 11 aa, Staphylococcus
GLPPKKNIDKT

SEQ ID NO: 1945250 - protein, 4 aa, Staphylococcus
GLPQ

SEQ ID NO: 1945251 - protein, 6 aa, Staphylococcus
GLPQIS

SEQ ID NO: 1945252 - protein, 7 aa, Staphylococcus
GLPQQQD

SEQ ID NO: 1945253 - protein, 6 aa, Staphylococcus
GLPSTL

SEQ ID NO: 1945254 - protein, 12 aa, Staphylococcus
GLPTERNARKLD

SEQ ID NO: 1945255 - protein, 7 aa, Staphylococcus
GLPTSEY

SEQ ID NO: 1945256 - protein, 7 aa, Staphylococcus
GLPTSTI

SEQ ID NO: 1945257 - protein, 10 aa, Staphylococcus
GLQECGNSQN

SEQ ID NO: 1945258 - protein, 10 aa, Staphylococcus
GLQEDAADDV

SEQ ID NO: 1945259 - protein, 5 aa, Staphylococcus
GLQEG

SEQ ID NO: 1945260 - protein, 5 aa, Staphylococcus
GLQKQ

SEQ ID NO: 1945261 - protein, 10 aa, Staphylococcus
GLQKSTDVEE

SEQ ID NO: 1945262 - protein, 18 aa, Staphylococcus
GLQNKNKYKVEELSGGMK

SEQ ID NO: 1945263 - protein, 4 aa, Staphylococcus
GLQP

SEQ ID NO: 1945264 - protein, 5 aa, Staphylococcus
GLQPG

SEQ ID NO: 1945265 - protein, 5 aa, Staphylococcus
GLQSE

SEQ ID NO: 1945266 - protein, 7 aa, Staphylococcus
GLQSEQS

SEQ ID NO: 1945267 - protein, 6 aa, Staphylococcus
GLQVPN

SEQ ID NO: 1945268 - protein, 4 aa, Staphylococcus
GLRE

SEQ ID NO: 1945269 - protein, 5 aa, Staphylococcus
GLREG

SEQ ID NO: 1945270 - protein, 5 aa, Staphylococcus
GLREV

SEQ ID NO: 1945271 - protein, 10 aa, Staphylococcus
GLRHDNKSQW

SEQ ID NO: 1945272 - protein, 10 aa, Staphylococcus
GLRKSDNKDY

SEQ ID NO: 1945273 - protein, 16 aa, Staphylococcus
GLRRGKDDILNEQYKA

SEQ ID NO: 1945274 - protein, 4 aa, Staphylococcus
GLRS

SEQ ID NO: 1945275 - protein, 5 aa, Staphylococcus
GLRSG

SEQ ID NO: 1945276 - protein, 14 aa, Staphylococcus
GLRSGNKYAPFPEE

SEQ ID NO: 1945277 - protein, 5 aa, Staphylococcus
GLRTA

SEQ ID NO: 1945278 - protein, 6 aa, Staphylococcus
GLRTAL

SEQ ID NO: 1945279 - protein, 7 aa, Staphylococcus
GLRTHGD

SEQ ID NO: 1945280 - protein, 6 aa, Staphylococcus
GLRTPL

SEQ ID NO: 1945281 - protein, 7 aa, Staphylococcus
GLRTPLD

SEQ ID NO: 1945282 - protein, 10 aa, Staphylococcus
GLSAEDSQNM

SEQ ID NO: 1945283 - protein, 15 aa, Staphylococcus
GLSAGSTGSAAVDPR

SEQ ID NO: 1945284 - protein, 16 aa, Staphylococcus
GLSAKSTEAAKRGLPN

SEQ ID NO: 1945285 - protein, 9 aa, Staphylococcus
GLSDCDGNA

SEQ ID NO: 1945286 - protein, 10 aa, Staphylococcus
GLSDNTIGAY

SEQ ID NO: 1945287 - protein, 8 aa, Staphylococcus
GLSDTFED

SEQ ID NO: 1945288 - protein, 4 aa, Staphylococcus
GLSE

SEQ ID NO: 1945289 - protein, 6 aa, Staphylococcus
GLSEDQ

SEQ ID NO: 1945290 - protein, 11 aa, Staphylococcus
GLSEERLSKST

SEQ ID NO: 1945291 - protein, 9 aa, Staphylococcus
GLSEKTMTN

SEQ ID NO: 1945292 - protein, 10 aa, Staphylococcus
GLSENTIGAY

SEQ ID NO: 1945293 - protein, 4 aa, Staphylococcus
GLSG

SEQ ID NO: 1945294 - protein, 9 aa, Staphylococcus
GLSGEELKT

SEQ ID NO: 1945295 - protein, 16 aa, Staphylococcus
GLSGKEAKEDLEQHGA

SEQ ID NO: 1945296 - protein, 11 aa, Staphylococcus
GLSGKKLDSEI

SEQ ID NO: 1945297 - protein, 10 aa, Staphylococcus
GLSGKSARLE

SEQ ID NO: 1945298 - protein, 10 aa, Staphylococcus
GLSGTYNTAV

SEQ ID NO: 1945299 - protein, 13 aa, Staphylococcus
GLSGTYNTAYQAS

SEQ ID NO: 1945300 - protein, 18 aa, Staphylococcus
GLSGTYQTAYQASQMTDS

SEQ ID NO: 1945301 - protein, 7 aa, Staphylococcus
GLSNEED

SEQ ID NO: 1945302 - protein, 8 aa, Staphylococcus
GLSNPNKI

SEQ ID NO: 1945303 - protein, 4 aa, Staphylococcus
GLSP

SEQ ID NO: 1945304 - protein, 9 aa, Staphylococcus
GLSPNTIGA

SEQ ID NO: 1945305 - protein, 13 aa, Staphylococcus
GLSPSSVKTLEKN

SEQ ID NO: 1945306 - protein, 9 aa, Staphylococcus
GLSPTGQPL

SEQ ID NO: 1945307 - protein, 5 aa, Staphylococcus
GLSQA

SEQ ID NO: 1945308 - protein, 5 aa, Staphylococcus
GLSRD

SEQ ID NO: 1945309 - protein, 10 aa, Staphylococcus
GLSRELSTTD

SEQ ID NO: 1945310 - protein, 9 aa, Staphylococcus
GLSRENAAE

SEQ ID NO: 1945311 - protein, 8 aa, Staphylococcus
GLSSRDIQ

SEQ ID NO: 1945312 - protein, 10 aa, Staphylococcus
GLSSSKTQNM

SEQ ID NO: 1945313 - protein, 10 aa, Staphylococcus
GLSTGEKYDE

SEQ ID NO: 1945314 - protein, 6 aa, Staphylococcus
GLSTTN

SEQ ID NO: 1945315 - protein, 6 aa, Staphylococcus
GLSVTG

SEQ ID NO: 1945316 - protein, 4 aa, Staphylococcus
GLSY

SEQ ID NO: 1945317 - protein, 6 aa, Staphylococcus
GLSYSS

SEQ ID NO: 1945318 - protein, 7 aa, Staphylococcus
GLTDKGS

SEQ ID NO: 1945319 - protein, 11 aa, Staphylococcus
GLTDNEGHAQF

SEQ ID NO: 1945320 - protein, 10 aa, Staphylococcus
GLTDNEGNSI

SEQ ID NO: 1945321 - protein, 10 aa, Staphylococcus
GLTDVDGNSI

SEQ ID NO: 1945322 - protein, 5 aa, Staphylococcus
GLTDY

SEQ ID NO: 1945323 - protein, 10 aa, Staphylococcus
GLTEERLTQA

SEQ ID NO: 1945324 - protein, 8 aa, Staphylococcus
GLTGDELK

SEQ ID NO: 1945325 - protein, 6 aa, Staphylococcus
GLTGKK

SEQ ID NO: 1945326 - protein, 8 aa, Staphylococcus
GLTGSGFE

SEQ ID NO: 1945327 - protein, 11 aa, Staphylococcus
GLTKDRYNRMK

SEQ ID NO: 1945328 - protein, 7 aa, Staphylococcus
GLTKPAE

SEQ ID NO: 1945329 - protein, 6 aa, Staphylococcus
GLTNEH

SEQ ID NO: 1945330 - protein, 6 aa, Staphylococcus
GLTPIK

SEQ ID NO: 1945331 - protein, 12 aa, Staphylococcus
GLTQEEAVNEQL

SEQ ID NO: 1945332 - protein, 8 aa, Staphylococcus
GLTQPGKT

SEQ ID NO: 1945333 - protein, 5 aa, Staphylococcus
GLTST

SEQ ID NO: 1945334 - protein, 10 aa, Staphylococcus
GLTTPDEKEA

SEQ ID NO: 1945335 - protein, 11 aa, Staphylococcus
GLTTPDEKEAL

SEQ ID NO: 1945336 - protein, 5 aa, Staphylococcus
GLTTS

SEQ ID NO: 1945337 - protein, 10 aa, Staphylococcus
GLTVKDDENV

SEQ ID NO: 1945338 - protein, 6 aa, Staphylococcus
GLTVPN

SEQ ID NO: 1945339 - protein, 22 aa, Staphylococcus
GLVERTKTDRYQRKQGKSLGSK

SEQ ID NO: 1945340 - protein, 13 aa, Staphylococcus
GLVGGYYKDYFKE

SEQ ID NO: 1945341 - protein, 12 aa, Staphylococcus
GLVQANKSLKRM

SEQ ID NO: 1945342 - protein, 14 aa, Staphylococcus
GLYTRGPKSMVISF

SEQ ID NO: 1945343 - protein, 5 aa, Staphylococcus
GMADG

SEQ ID NO: 1945344 - protein, 15 aa, Staphylococcus
GMAGAQKAARDYELQ

SEQ ID NO: 1945345 - protein, 11 aa, Staphylococcus
GMATDKDGKMY

SEQ ID NO: 1945346 - protein, 9 aa, Staphylococcus
GMDDNEKNW

SEQ ID NO: 1945347 - protein, 8 aa, Staphylococcus
GMDENDWE

SEQ ID NO: 1945348 - protein, 13 aa, Staphylococcus
GMDENEKQQNINS

SEQ ID NO: 1945349 - protein, 7 aa, Staphylococcus
GMDPSIG

SEQ ID NO: 1945350 - protein, 7 aa, Staphylococcus
GMDPSLG

SEQ ID NO: 1945351 - protein, 7 aa, Staphylococcus
GMDTGEI

SEQ ID NO: 1945352 - protein, 6 aa, Staphylococcus
GMEGHK

SEQ ID NO: 1945353 - protein, 7 aa, Staphylococcus
GMEITEE

SEQ ID NO: 1945354 - protein, 11 aa, Staphylococcus
GMEITEEGKSV

SEQ ID NO: 1945355 - protein, 4 aa, Staphylococcus
GMER

SEQ ID NO: 1945356 - protein, 23 aa, Staphylococcus
GMGQKGDQDIEHGQNKTLNHSED

SEQ ID NO: 1945357 - protein, 5 aa, Staphylococcus
GMGTL

SEQ ID NO: 1945358 - protein, 16 aa, Staphylococcus
GMGYTGSKDLKALREE

SEQ ID NO: 1945359 - protein, 4 aa, Staphylococcus
GMIK

SEQ ID NO: 1945360 - protein, 14 aa, Staphylococcus
GMIKKSSVSQFKTT

SEQ ID NO: 1945361 - protein, 39 aa, Staphylococcus
GMKKESKIGSSFGGKKPAKRGPSRRVSRNAAVSSSDWKV

SEQ ID NO: 1945362 - protein, 5 aa, Staphylococcus
GMKQG

SEQ ID NO: 1945363 - protein, 18 aa, Staphylococcus
GMLSQSSPVGTQIPHTAG

SEQ ID NO: 1945364 - protein, 6 aa, Staphylococcus
GMNDTK

SEQ ID NO: 1945365 - protein, 4 aa, Staphylococcus
GMNE

SEQ ID NO: 1945366 - protein, 14 aa, Staphylococcus
GMNEWGTAGTEINS

SEQ ID NO: 1945367 - protein, 14 aa, Staphylococcus
GMNEWGTEGLEINN

SEQ ID NO: 1945368 - protein, 6 aa, Staphylococcus
GMNSTL

SEQ ID NO: 1945369 - protein, 8 aa, Staphylococcus
GMPDSEEI

SEQ ID NO: 1945370 - protein, 10 aa, Staphylococcus
GMPKQKDIQT

SEQ ID NO: 1945371 - protein, 9 aa, Staphylococcus
GMPPTGGLG

SEQ ID NO: 1945372 - protein, 6 aa, Staphylococcus
GMPTEI

SEQ ID NO: 1945373 - protein, 10 aa, Staphylococcus
GMPTETYGDY

SEQ ID NO: 1945374 - protein, 7 aa, Staphylococcus
GMQDNLK

SEQ ID NO: 1945375 - protein, 5 aa, Staphylococcus
GMQSE

SEQ ID NO: 1945376 - protein, 6 aa, Staphylococcus
GMQSEM

SEQ ID NO: 1945377 - protein, 7 aa, Staphylococcus
GMQSTQN

SEQ ID NO: 1945378 - protein, 6 aa, Staphylococcus
GMREEI

SEQ ID NO: 1945379 - protein, 14 aa, Staphylococcus
GMRKKGKVYENTEK

SEQ ID NO: 1945380 - protein, 22 aa, Staphylococcus
GMRSELTQNDFESLESADSVND

SEQ ID NO: 1945381 - protein, 7 aa, Staphylococcus
GMSAADG

SEQ ID NO: 1945382 - protein, 6 aa, Staphylococcus
GMSAAS

SEQ ID NO: 1945383 - protein, 13 aa, Staphylococcus
GMSAASKVVKKDG

SEQ ID NO: 1945384 - protein, 8 aa, Staphylococcus
GMSASDGF

SEQ ID NO: 1945385 - protein, 4 aa, Staphylococcus
GMSE

SEQ ID NO: 1945386 - protein, 6 aa, Staphylococcus
GMSEAG

SEQ ID NO: 1945387 - protein, 14 aa, Staphylococcus
GMSGQTSETALGNG

SEQ ID NO: 1945388 - protein, 8 aa, Staphylococcus
GMSKGEAI

SEQ ID NO: 1945389 - protein, 9 aa, Staphylococcus
GMSKSDIKK

SEQ ID NO: 1945390 - protein, 9 aa, Staphylococcus
GMSKSEIKE

SEQ ID NO: 1945391 - protein, 4 aa, Staphylococcus
GMSN

SEQ ID NO: 1945392 - protein, 14 aa, Staphylococcus
GMSPEEFEKHTLQS

SEQ ID NO: 1945393 - protein, 17 aa, Staphylococcus
GMSQETLSKNVNVSRQT

SEQ ID NO: 1945394 - protein, 12 aa, Staphylococcus
GMSSKAYGSRSG

SEQ ID NO: 1945395 - protein, 5 aa, Staphylococcus
GMSTA

SEQ ID NO: 1945396 - protein, 6 aa, Staphylococcus
GMSTAG

SEQ ID NO: 1945397 - protein, 10 aa, Staphylococcus
GMSTTVTDGG

SEQ ID NO: 1945398 - protein, 5 aa, Staphylococcus
GMSVP

SEQ ID NO: 1945399 - protein, 6 aa, Staphylococcus
GMTAPQ

SEQ ID NO: 1945400 - protein, 11 aa, Staphylococcus
GMTEREVKAEL

SEQ ID NO: 1945401 - protein, 9 aa, Staphylococcus
GMTESDNHT

SEQ ID NO: 1945402 - protein, 13 aa, Staphylococcus
GMTGDEAREAGYS

SEQ ID NO: 1945403 - protein, 12 aa, Staphylococcus
GMTGTGKQGEKE

SEQ ID NO: 1945404 - protein, 13 aa, Staphylococcus
GMTHGNKNTYPQI

SEQ ID NO: 1945405 - protein, 8 aa, Staphylococcus
GMTKGEAL

SEQ ID NO: 1945406 - protein, 9 aa, Staphylococcus
GMTSANPLD

SEQ ID NO: 1945407 - protein, 13 aa, Staphylococcus
GMTSANPLDFPGY

SEQ ID NO: 1945408 - protein, 27 aa, Staphylococcus
GMTSANPLDFPSYEEKIQKDQQKTGLN

SEQ ID NO: 1945409 - protein, 11 aa, Staphylococcus
GMTTQQADALA

SEQ ID NO: 1945410 - protein, 12 aa, Staphylococcus
GMVKTNNSEVTK

SEQ ID NO: 1945411 - protein, 10 aa, Staphylococcus
GNAAKKHEEN

SEQ ID NO: 1945412 - protein, 4 aa, Staphylococcus
GNAD

SEQ ID NO: 1945413 - protein, 9 aa, Staphylococcus
GNADDIANR

SEQ ID NO: 1945414 - protein, 12 aa, Staphylococcus
GNADKGITAPHH

SEQ ID NO: 1945415 - protein, 5 aa, Staphylococcus
GNAGI

SEQ ID NO: 1945416 - protein, 8 aa, Staphylococcus
GNAGPETL

SEQ ID NO: 1945417 - protein, 5 aa, Staphylococcus
GNAGY

SEQ ID NO: 1945418 - protein, 14 aa, Staphylococcus
GNAGYLTDTEPGSL

SEQ ID NO: 1945419 - protein, 4 aa, Staphylococcus
GNAK

SEQ ID NO: 1945420 - protein, 9 aa, Staphylococcus
GNAKEGNIT

SEQ ID NO: 1945421 - protein, 14 aa, Staphylococcus
GNAKLTKKQIKNYG

SEQ ID NO: 1945422 - protein, 8 aa, Staphylococcus
GNAKTHER

SEQ ID NO: 1945423 - protein, 9 aa, Staphylococcus
GNANDQVKA

SEQ ID NO: 1945424 - protein, 10 aa, Staphylococcus
GNANENESKI

SEQ ID NO: 1945425 - protein, 17 aa, Staphylococcus
GNAPFDYARSGNPNRQL

SEQ ID NO: 1945426 - protein, 12 aa, Staphylococcus
GNAQTEPKGEDY

SEQ ID NO: 1945427 - protein, 4 aa, Staphylococcus
GNAS

SEQ ID NO: 1945428 - protein, 9 aa, Staphylococcus
GNASDELKN

SEQ ID NO: 1945429 - protein, 12 aa, Staphylococcus
GNASEELKESAD

SEQ ID NO: 1945430 - protein, 9 aa, Staphylococcus
GNASEELKK

SEQ ID NO: 1945431 - protein, 6 aa, Staphylococcus
GNASQS

SEQ ID NO: 1945432 - protein, 32 aa, Staphylococcus
GNATDDLKAISDEVTLDNNANGIPHALKQLLN

SEQ ID NO: 1945433 - protein, 5 aa, Staphylococcus
GNATN

SEQ ID NO: 1945434 - protein, 8 aa, Staphylococcus
GNAVPEPF

SEQ ID NO: 1945435 - protein, 7 aa, Staphylococcus
GNAVSGW

SEQ ID NO: 1945436 - protein, 17 aa, Staphylococcus
GNCPFTSSKAQGGYEHY

SEQ ID NO: 1945437 - protein, 4 aa, Staphylococcus
GNDA

SEQ ID NO: 1945438 - protein, 6 aa, Staphylococcus
GNDAMS

SEQ ID NO: 1945439 - protein, 7 aa, Staphylococcus
GNDAVGE

SEQ ID NO: 1945440 - protein, 8 aa, Staphylococcus
GNDDAFYQ

SEQ ID NO: 1945441 - protein, 6 aa, Staphylococcus
GNDDTL

SEQ ID NO: 1945442 - protein, 18 aa, Staphylococcus
GNDDVASSKDIDDRRGIA

SEQ ID NO: 1945443 - protein, 8 aa, Staphylococcus
GNDGEQHR

SEQ ID NO: 1945444 - protein, 6 aa, Staphylococcus
GNDGPA

SEQ ID NO: 1945445 - protein, 8 aa, Staphylococcus
GNDGPAIE

SEQ ID NO: 1945446 - protein, 5 aa, Staphylococcus
GNDHS

SEQ ID NO: 1945447 - protein, 4 aa, Staphylococcus
GNDK

SEQ ID NO: 1945448 - protein, 10 aa, Staphylococcus
GNDKCDLDEQ

SEQ ID NO: 1945449 - protein, 6 aa, Staphylococcus
GNDLEE

SEQ ID NO: 1945450 - protein, 9 aa, Staphylococcus
GNDLGEAEK

SEQ ID NO: 1945451 - protein, 7 aa, Staphylococcus
GNDPIEN

SEQ ID NO: 1945452 - protein, 7 aa, Staphylococcus
GNDPIKN

SEQ ID NO: 1945453 - protein, 7 aa, Staphylococcus
GNDPITN

SEQ ID NO: 1945454 - protein, 15 aa, Staphylococcus
GNDQDPIQTERSEQL

SEQ ID NO: 1945455 - protein, 6 aa, Staphylococcus
GNDQPY

SEQ ID NO: 1945456 - protein, 9 aa, Staphylococcus
GNDQSSKRD

SEQ ID NO: 1945457 - protein, 4 aa, Staphylococcus
GNDR

SEQ ID NO: 1945458 - protein, 7 aa, Staphylococcus
GNDSNDI

SEQ ID NO: 1945459 - protein, 6 aa, Staphylococcus
GNDSVR

SEQ ID NO: 1945460 - protein, 6 aa, Staphylococcus
GNDTAM

SEQ ID NO: 1945461 - protein, 14 aa, Staphylococcus
GNEAINDDGEMNRQ

SEQ ID NO: 1945462 - protein, 9 aa, Staphylococcus
GNEAPSHSV

SEQ ID NO: 1945463 - protein, 12 aa, Staphylococcus
GNEDKGITAPHH

SEQ ID NO: 1945464 - protein, 8 aa, Staphylococcus
GNEDQSKL

SEQ ID NO: 1945465 - protein, 7 aa, Staphylococcus
GNEDTIT

SEQ ID NO: 1945466 - protein, 6 aa, Staphylococcus
GNEEDT

SEQ ID NO: 1945467 - protein, 7 aa, Staphylococcus
GNEEQLA

SEQ ID NO: 1945468 - protein, 16 aa, Staphylococcus
GNEFHENSPRLIVKIT

SEQ ID NO: 1945469 - protein, 13 aa, Staphylococcus
GNEGAHQPNPIQR

SEQ ID NO: 1945470 - protein, 7 aa, Staphylococcus
GNEGEPQ

SEQ ID NO: 1945471 - protein, 5 aa, Staphylococcus
GNEGI

SEQ ID NO: 1945472 - protein, 15 aa, Staphylococcus
GNEGKTKPNETQQQY

SEQ ID NO: 1945473 - protein, 5 aa, Staphylococcus
GNEID

SEQ ID NO: 1945474 - protein, 19 aa, Staphylococcus
GNEIGEVTSGTQAPSSGKS

SEQ ID NO: 1945475 - protein, 7 aa, Staphylococcus
GNEIRSL

SEQ ID NO: 1945476 - protein, 8 aa, Staphylococcus
GNEKSGEK

SEQ ID NO: 1945477 - protein, 6 aa, Staphylococcus
GNEKVA

SEQ ID NO: 1945478 - protein, 6 aa, Staphylococcus
GNENEN

SEQ ID NO: 1945479 - protein, 6 aa, Staphylococcus
GNENKK

SEQ ID NO: 1945480 - protein, 6 aa, Staphylococcus
GNEPIS

SEQ ID NO: 1945481 - protein, 6 aa, Staphylococcus
GNEPLA

SEQ ID NO: 1945482 - protein, 7 aa, Staphylococcus
GNEPLIS

SEQ ID NO: 1945483 - protein, 6 aa, Staphylococcus
GNEQQL

SEQ ID NO: 1945484 - protein, 7 aa, Staphylococcus
GNEQQTT

SEQ ID NO: 1945485 - protein, 13 aa, Staphylococcus
GNEQSHQDDSFSD

SEQ ID NO: 1945486 - protein, 13 aa, Staphylococcus
GNERDDRTHTGTI

SEQ ID NO: 1945487 - protein, 6 aa, Staphylococcus
GNESAF

SEQ ID NO: 1945488 - protein, 6 aa, Staphylococcus
GNESGF

SEQ ID NO: 1945489 - protein, 18 aa, Staphylococcus
GNESGTSGLPGGYTSAER

SEQ ID NO: 1945490 - protein, 12 aa, Staphylococcus
GNESINDALKSY

SEQ ID NO: 1945491 - protein, 11 aa, Staphylococcus
GNESNKKSPYD

SEQ ID NO: 1945492 - protein, 6 aa, Staphylococcus
GNETAM

SEQ ID NO: 1945493 - protein, 16 aa, Staphylococcus
GNETAMETSRRVAKEE

SEQ ID NO: 1945494 - protein, 5 aa, Staphylococcus
GNETK

SEQ ID NO: 1945495 - protein, 8 aa, Staphylococcus
GNETYKDG

SEQ ID NO: 1945496 - protein, 11 aa, Staphylococcus
GNEVSSYERNG

SEQ ID NO: 1945497 - protein, 6 aa, Staphylococcus
GNEYSN

SEQ ID NO: 1945498 - protein, 5 aa, Staphylococcus
GNFDT

SEQ ID NO: 1945499 - protein, 5 aa, Staphylococcus
GNFEE

SEQ ID NO: 1945500 - protein, 7 aa, Staphylococcus
GNFERTR

SEQ ID NO: 1945501 - protein, 12 aa, Staphylococcus
GNFGPKSKEEVN

SEQ ID NO: 1945502 - protein, 9 aa, Staphylococcus
GNFKAETQN

SEQ ID NO: 1945503 - protein, 9 aa, Staphylococcus
GNFKAETQT

SEQ ID NO: 1945504 - protein, 14 aa, Staphylococcus
GNFNENHEREEIQS

SEQ ID NO: 1945505 - protein, 14 aa, Staphylococcus
GNFNENYGREEVQS

SEQ ID NO: 1945506 - protein, 11 aa, Staphylococcus
GNFSDDAEDAG

SEQ ID NO: 1945507 - protein, 4 aa, Staphylococcus
GNGA

SEQ ID NO: 1945508 - protein, 12 aa, Staphylococcus
GNGAPSNLEGER

SEQ ID NO: 1945509 - protein, 12 aa, Staphylococcus
GNGAPSNLEGQK

SEQ ID NO: 1945510 - protein, 5 aa, Staphylococcus
GNGAT

SEQ ID NO: 1945511 - protein, 7 aa, Staphylococcus
GNGEDIE

SEQ ID NO: 1945512 - protein, 13 aa, Staphylococcus
GNGERSTQNRGAV

SEQ ID NO: 1945513 - protein, 12 aa, Staphylococcus
GNGFDDDTEMGP

SEQ ID NO: 1945514 - protein, 12 aa, Staphylococcus
GNGFDQDTEMGP

SEQ ID NO: 1945515 - protein, 12 aa, Staphylococcus
GNGFDSDTEMGP

SEQ ID NO: 1945516 - protein, 5 aa, Staphylococcus
GNGFS

SEQ ID NO: 1945517 - protein, 17 aa, Staphylococcus
GNGGLKSSQIVATDRDN

SEQ ID NO: 1945518 - protein, 9 aa, Staphylococcus
GNGGNVARK

SEQ ID NO: 1945519 - protein, 8 aa, Staphylococcus
GNGGTEVT

SEQ ID NO: 1945520 - protein, 9 aa, Staphylococcus
GNGGTEVTK

SEQ ID NO: 1945521 - protein, 8 aa, Staphylococcus
GNGHRDQP

SEQ ID NO: 1945522 - protein, 4 aa, Staphylococcus
GNGI

SEQ ID NO: 1945523 - protein, 28 aa, Staphylococcus
GNGKDSILTRKSGKIPADYTSKEKLPHQ

SEQ ID NO: 1945524 - protein, 5 aa, Staphylococcus
GNGKN

SEQ ID NO: 1945525 - protein, 10 aa, Staphylococcus
GNGLSSKEIA

SEQ ID NO: 1945526 - protein, 9 aa, Staphylococcus
GNGLVPDAE

SEQ ID NO: 1945527 - protein, 7 aa, Staphylococcus
GNGMDED

SEQ ID NO: 1945528 - protein, 13 aa, Staphylococcus
GNGPMSSYQDKGI

SEQ ID NO: 1945529 - protein, 7 aa, Staphylococcus
GNGPQVG

SEQ ID NO: 1945530 - protein, 8 aa, Staphylococcus
GNGQGDEL

SEQ ID NO: 1945531 - protein, 5 aa, Staphylococcus
GNGRR

SEQ ID NO: 1945532 - protein, 6 aa, Staphylococcus
GNGRVG

SEQ ID NO: 1945533 - protein, 8 aa, Staphylococcus
GNGSEFVA

SEQ ID NO: 1945534 - protein, 6 aa, Staphylococcus
GNGSEI

SEQ ID NO: 1945535 - protein, 10 aa, Staphylococcus
GNGSGRFTKA

SEQ ID NO: 1945536 - protein, 11 aa, Staphylococcus
GNGSGRFTKAH

SEQ ID NO: 1945537 - protein, 9 aa, Staphylococcus
GNGSLDKKL

SEQ ID NO: 1945538 - protein, 7 aa, Staphylococcus
GNGTAQI

SEQ ID NO: 1945539 - protein, 8 aa, Staphylococcus
GNHDGSYN

SEQ ID NO: 1945540 - protein, 4 aa, Staphylococcus
GNHF

SEQ ID NO: 1945541 - protein, 6 aa, Staphylococcus
GNHGLD

SEQ ID NO: 1945542 - protein, 6 aa, Staphylococcus
GNHITS

SEQ ID NO: 1945543 - protein, 8 aa, Staphylococcus
GNHNPETV

SEQ ID NO: 1945544 - protein, 44 aa, Staphylococcus
GNHSDDSSSEEPKEEAAKEESASSQESQPAANTQDAEVDENRTI

SEQ ID NO: 1945545 - protein, 4 aa, Staphylococcus
GNHT

SEQ ID NO: 1945546 - protein, 6 aa, Staphylococcus
GNIEKY

SEQ ID NO: 1945547 - protein, 6 aa, Staphylococcus
GNIENG

SEQ ID NO: 1945548 - protein, 50 aa, Staphylococcus
GNIKETVGNATDNKNLEQEGKEDKTSGKAKEVVDNAKEKANDVIDKFKGD

SEQ ID NO: 1945549 - protein, 10 aa, Staphylococcus
GNIPNDQSNM

SEQ ID NO: 1945550 - protein, 8 aa, Staphylococcus
GNIPTSNY

SEQ ID NO: 1945551 - protein, 4 aa, Staphylococcus
GNIQ

SEQ ID NO: 1945552 - protein, 8 aa, Staphylococcus
GNISSSAK

SEQ ID NO: 1945553 - protein, 9 aa, Staphylococcus
GNKATGVTF

SEQ ID NO: 1945554 - protein, 20 aa, Staphylococcus
GNKATGVTFKRNGKNHTVNA

SEQ ID NO: 1945555 - protein, 13 aa, Staphylococcus
GNKDRTTENRGQI

SEQ ID NO: 1945556 - protein, 5 aa, Staphylococcus
GNKEE

SEQ ID NO: 1945557 - protein, 5 aa, Staphylococcus
GNKET

SEQ ID NO: 1945558 - protein, 4 aa, Staphylococcus
GNKI

SEQ ID NO: 1945559 - protein, 14 aa, Staphylococcus
GNKKRVSFKQQPAY

SEQ ID NO: 1945560 - protein, 5 aa, Staphylococcus
GNKKV

SEQ ID NO: 1945561 - protein, 8 aa, Staphylococcus
GNKLNNRV

SEQ ID NO: 1945562 - protein, 4 aa, Staphylococcus
GNKQ

SEQ ID NO: 1945563 - protein, 6 aa, Staphylococcus
GNKQHV

SEQ ID NO: 1945564 - protein, 14 aa, Staphylococcus
GNKSITSASGSSDL

SEQ ID NO: 1945565 - protein, 14 aa, Staphylococcus
GNKSITSHSGSTDV

SEQ ID NO: 1945566 - protein, 14 aa, Staphylococcus
GNKSVTSSSGSTDL

SEQ ID NO: 1945567 - protein, 7 aa, Staphylococcus
GNKVHPN

SEQ ID NO: 1945568 - protein, 8 aa, Staphylococcus
GNKVTEIT

SEQ ID NO: 1945569 - protein, 18 aa, Staphylococcus
GNKYPSEISGGQQQRTAA

SEQ ID NO: 1945570 - protein, 22 aa, Staphylococcus
GNLADVDGRIQSRSYENKEGQR

SEQ ID NO: 1945571 - protein, 4 aa, Staphylococcus
GNLD

SEQ ID NO: 1945572 - protein, 10 aa, Staphylococcus
GNLDETEAEA

SEQ ID NO: 1945573 - protein, 7 aa, Staphylococcus
GNLKEQS

SEQ ID NO: 1945574 - protein, 4 aa, Staphylococcus
GNLP

SEQ ID NO: 1945575 - protein, 7 aa, Staphylococcus
GNLPKGV

SEQ ID NO: 1945576 - protein, 10 aa, Staphylococcus
GNLQKANDEL

SEQ ID NO: 1945577 - protein, 14 aa, Staphylococcus
GNMSQTNETRSITN

SEQ ID NO: 1945578 - protein, 4 aa, Staphylococcus
GNMT

SEQ ID NO: 1945579 - protein, 6 aa, Staphylococcus
GNMVPK

SEQ ID NO: 1945580 - protein, 4 aa, Staphylococcus
GNNA

SEQ ID NO: 1945581 - protein, 6 aa, Staphylococcus
GNNDEH

SEQ ID NO: 1945582 - protein, 9 aa, Staphylococcus
GNNDEHLKS

SEQ ID NO: 1945583 - protein, 8 aa, Staphylococcus
GNNDENIQ

SEQ ID NO: 1945584 - protein, 6 aa, Staphylococcus
GNNDIN

SEQ ID NO: 1945585 - protein, 7 aa, Staphylococcus
GNNDINR

SEQ ID NO: 1945586 - protein, 4 aa, Staphylococcus
GNNE

SEQ ID NO: 1945587 - protein, 6 aa, Staphylococcus
GNNEGD

SEQ ID NO: 1945588 - protein, 6 aa, Staphylococcus
GNNEPN

SEQ ID NO: 1945589 - protein, 10 aa, Staphylococcus
GNNEVSDPKE

SEQ ID NO: 1945590 - protein, 14 aa, Staphylococcus
GNNGSIDNDPAAAM

SEQ ID NO: 1945591 - protein, 8 aa, Staphylococcus
GNNGVGKS

SEQ ID NO: 1945592 - protein, 7 aa, Staphylococcus
GNNIDIR

SEQ ID NO: 1945593 - protein, 7 aa, Staphylococcus
GNNITRK

SEQ ID NO: 1945594 - protein, 8 aa, Staphylococcus
GNNKENYK

SEQ ID NO: 1945595 - protein, 19 aa, Staphylococcus
GNNKLTDKQKRNSGVTQES

SEQ ID NO: 1945596 - protein, 9 aa, Staphylococcus
GNNKSTTWT

SEQ ID NO: 1945597 - protein, 10 aa, Staphylococcus
GNNKTKREIQ

SEQ ID NO: 1945598 - protein, 7 aa, Staphylococcus
GNNLEEI

SEQ ID NO: 1945599 - protein, 6 aa, Staphylococcus
GNNLNQ

SEQ ID NO: 1945600 - protein, 6 aa, Staphylococcus
GNNNTA

SEQ ID NO: 1945601 - protein, 7 aa, Staphylococcus
GNNNYGK

SEQ ID NO: 1945602 - protein, 6 aa, Staphylococcus
GNNPIY

SEQ ID NO: 1945603 - protein, 7 aa, Staphylococcus
GNNPVEN

SEQ ID NO: 1945604 - protein, 14 aa, Staphylococcus
GNNQWDDKYPTPEH

SEQ ID NO: 1945605 - protein, 7 aa, Staphylococcus
GNNSEDR

SEQ ID NO: 1945606 - protein, 11 aa, Staphylococcus
GNNSEKAEADV

SEQ ID NO: 1945607 - protein, 4 aa, Staphylococcus
GNNT

SEQ ID NO: 1945608 - protein, 7 aa, Staphylococcus
GNNTAVD

SEQ ID NO: 1945609 - protein, 7 aa, Staphylococcus
GNNTNTL

SEQ ID NO: 1945610 - protein, 12 aa, Staphylococcus
GNNVNKPEDSLR

SEQ ID NO: 1945611 - protein, 7 aa, Staphylococcus
GNPASWD

SEQ ID NO: 1945612 - protein, 27 aa, Staphylococcus
GNPASWDKATNALEESNGYIDSVTDEE

SEQ ID NO: 1945613 - protein, 19 aa, Staphylococcus
GNPASWEKATNALNESNGL

SEQ ID NO: 1945614 - protein, 8 aa, Staphylococcus
GNPASWKK

SEQ ID NO: 1945615 - protein, 7 aa, Staphylococcus
GNPASWQ

SEQ ID NO: 1945616 - protein, 17 aa, Staphylococcus
GNPASWTKATAALNESH

SEQ ID NO: 1945617 - protein, 19 aa, Staphylococcus
GNPASWTKATNALDESNGL

SEQ ID NO: 1945618 - protein, 12 aa, Staphylococcus
GNPDKGITAPHH

SEQ ID NO: 1945619 - protein, 6 aa, Staphylococcus
GNPEEN

SEQ ID NO: 1945620 - protein, 7 aa, Staphylococcus
GNPEEYS

SEQ ID NO: 1945621 - protein, 9 aa, Staphylococcus
GNPEGNVED

SEQ ID NO: 1945622 - protein, 15 aa, Staphylococcus
GNPEKETTHPHHSPN

SEQ ID NO: 1945623 - protein, 10 aa, Staphylococcus
GNPEYKGAAT

SEQ ID NO: 1945624 - protein, 6 aa, Staphylococcus
GNPGES

SEQ ID NO: 1945625 - protein, 8 aa, Staphylococcus
GNPGESAS

SEQ ID NO: 1945626 - protein, 9 aa, Staphylococcus
GNPGISLSP

SEQ ID NO: 1945627 - protein, 7 aa, Staphylococcus
GNPGPAS

SEQ ID NO: 1945628 - protein, 7 aa, Staphylococcus
GNPGRST

SEQ ID NO: 1945629 - protein, 10 aa, Staphylococcus
GNPGTGVTND

SEQ ID NO: 1945630 - protein, 10 aa, Staphylococcus
GNPIGTLTES

SEQ ID NO: 1945631 - protein, 7 aa, Staphylococcus
GNPKDEL

SEQ ID NO: 1945632 - protein, 7 aa, Staphylococcus
GNPKEEL

SEQ ID NO: 1945633 - protein, 8 aa, Staphylococcus
GNPKIETG

SEQ ID NO: 1945634 - protein, 9 aa, Staphylococcus
GNPKIETGD

SEQ ID NO: 1945635 - protein, 9 aa, Staphylococcus
GNPKIKTGN

SEQ ID NO: 1945636 - protein, 9 aa, Staphylococcus
GNPKIQTGN

SEQ ID NO: 1945637 - protein, 8 aa, Staphylococcus
GNPKLTKS

SEQ ID NO: 1945638 - protein, 9 aa, Staphylococcus
GNPKVETGD

SEQ ID NO: 1945639 - protein, 6 aa, Staphylococcus
GNPLDY

SEQ ID NO: 1945640 - protein, 17 aa, Staphylococcus
GNPNKYIATPSSKSEFK

SEQ ID NO: 1945641 - protein, 4 aa, Staphylococcus
GNPP

SEQ ID NO: 1945642 - protein, 4 aa, Staphylococcus
GNPQ

SEQ ID NO: 1945643 - protein, 5 aa, Staphylococcus
GNPQN

SEQ ID NO: 1945644 - protein, 5 aa, Staphylococcus
GNPRR

SEQ ID NO: 1945645 - protein, 5 aa, Staphylococcus
GNPSL

SEQ ID NO: 1945646 - protein, 5 aa, Staphylococcus
GNPSM

SEQ ID NO: 1945647 - protein, 24 aa, Staphylococcus
GNPSSIHSMGRDARKYLDDARRTI

SEQ ID NO: 1945648 - protein, 4 aa, Staphylococcus
GNPT

SEQ ID NO: 1945649 - protein, 7 aa, Staphylococcus
GNPVATL

SEQ ID NO: 1945650 - protein, 8 aa, Staphylococcus
GNPVGTLK

SEQ ID NO: 1945651 - protein, 8 aa, Staphylococcus
GNPVGTMK

SEQ ID NO: 1945652 - protein, 5 aa, Staphylococcus
GNPYV

SEQ ID NO: 1945653 - protein, 8 aa, Staphylococcus
GNQAEKIA

SEQ ID NO: 1945654 - protein, 12 aa, Staphylococcus
GNQDKNITAPHH

SEQ ID NO: 1945655 - protein, 9 aa, Staphylococcus
GNQEGSTYD

SEQ ID NO: 1945656 - protein, 9 aa, Staphylococcus
GNQEKPDLE

SEQ ID NO: 1945657 - protein, 13 aa, Staphylococcus
GNQEYQSDLTGTV

SEQ ID NO: 1945658 - protein, 4 aa, Staphylococcus
GNQF

SEQ ID NO: 1945659 - protein, 15 aa, Staphylococcus
GNQFKPKEIKWRDER

SEQ ID NO: 1945660 - protein, 50 aa, Staphylococcus
GNQGGGPHYYPNNKGVYQSQPEYKKPAFPVDGDGYEYNQRQDDDNYFEQP

SEQ ID NO: 1945661 - protein, 7 aa, Staphylococcus
GNQGQHP

SEQ ID NO: 1945662 - protein, 19 aa, Staphylococcus
GNQIGEITSGTQSPLTGKS

SEQ ID NO: 1945663 - protein, 19 aa, Staphylococcus
GNQIGEVTSGTKSPSSDKS

SEQ ID NO: 1945664 - protein, 5 aa, Staphylococcus
GNQKL

SEQ ID NO: 1945665 - protein, 8 aa, Staphylococcus
GNQKQTTY

SEQ ID NO: 1945666 - protein, 8 aa, Staphylococcus
GNQMPEGV

SEQ ID NO: 1945667 - protein, 4 aa, Staphylococcus
GNQN

SEQ ID NO: 1945668 - protein, 9 aa, Staphylococcus
GNQNNKYDF

SEQ ID NO: 1945669 - protein, 8 aa, Staphylococcus
GNQNNKYE

SEQ ID NO: 1945670 - protein, 12 aa, Staphylococcus
GNQQSHEDDSFQ

SEQ ID NO: 1945671 - protein, 13 aa, Staphylococcus
GNQRDDRTHTGTF

SEQ ID NO: 1945672 - protein, 6 aa, Staphylococcus
GNQTEI

SEQ ID NO: 1945673 - protein, 12 aa, Staphylococcus
GNQTISEALSSF

SEQ ID NO: 1945674 - protein, 14 aa, Staphylococcus
GNQVNSVPDTATAE

SEQ ID NO: 1945675 - protein, 5 aa, Staphylococcus
GNQYA

SEQ ID NO: 1945676 - protein, 7 aa, Staphylococcus
GNRARED

SEQ ID NO: 1945677 - protein, 5 aa, Staphylococcus
GNRDQ

SEQ ID NO: 1945678 - protein, 7 aa, Staphylococcus
GNRIPKE

SEQ ID NO: 1945679 - protein, 27 aa, Staphylococcus
GNRLTDDGNVTWDPSKKHIKEGVKGSL

SEQ ID NO: 1945680 - protein, 28 aa, Staphylococcus
GNRLTEDGNITWDPSKKHIKEGVKGSLQ

SEQ ID NO: 1945681 - protein, 8 aa, Staphylococcus
GNRMPEGV

SEQ ID NO: 1945682 - protein, 4 aa, Staphylococcus
GNRR

SEQ ID NO: 1945683 - protein, 5 aa, Staphylococcus
GNRSI

SEQ ID NO: 1945684 - protein, 10 aa, Staphylococcus
GNRSVLSDSN

SEQ ID NO: 1945685 - protein, 13 aa, Staphylococcus
GNRSVLSDSNLKG

SEQ ID NO: 1945686 - protein, 7 aa, Staphylococcus
GNRYDVG

SEQ ID NO: 1945687 - protein, 17 aa, Staphylococcus
GNSDFNKIDGGKTDSNL

SEQ ID NO: 1945688 - protein, 16 aa, Staphylococcus
GNSEEAINKIKAYLNE

SEQ ID NO: 1945689 - protein, 10 aa, Staphylococcus
GNSEEDREYI

SEQ ID NO: 1945690 - protein, 8 aa, Staphylococcus
GNSEEEVR

SEQ ID NO: 1945691 - protein, 6 aa, Staphylococcus
GNSEHT

SEQ ID NO: 1945692 - protein, 7 aa, Staphylococcus
GNSEKEL

SEQ ID NO: 1945693 - protein, 6 aa, Staphylococcus
GNSGHT

SEQ ID NO: 1945694 - protein, 6 aa, Staphylococcus
GNSGPL

SEQ ID NO: 1945695 - protein, 4 aa, Staphylococcus
GNSH

SEQ ID NO: 1945696 - protein, 8 aa, Staphylococcus
GNSLPEDT

SEQ ID NO: 1945697 - protein, 4 aa, Staphylococcus
GNSN

SEQ ID NO: 1945698 - protein, 9 aa, Staphylococcus
GNSNQPKMQ

SEQ ID NO: 1945699 - protein, 6 aa, Staphylococcus
GNSQHT

SEQ ID NO: 1945700 - protein, 15 aa, Staphylococcus
GNSQYQNTNTQIASE

SEQ ID NO: 1945701 - protein, 10 aa, Staphylococcus
GNSTATTEKE

SEQ ID NO: 1945702 - protein, 7 aa, Staphylococcus
GNSTHTI

SEQ ID NO: 1945703 - protein, 31 aa, Staphylococcus
GNSTKQAIKRYEDGIPAEQCGGTSEYNNGNG

SEQ ID NO: 1945704 - protein, 24 aa, Staphylococcus
GNSYDTKKFSKNKIKNSDGTTQNF

SEQ ID NO: 1945705 - protein, 7 aa, Staphylococcus
GNTATIG

SEQ ID NO: 1945706 - protein, 7 aa, Staphylococcus
GNTDGVE

SEQ ID NO: 1945707 - protein, 6 aa, Staphylococcus
GNTGAT

SEQ ID NO: 1945708 - protein, 5 aa, Staphylococcus
GNTHH

SEQ ID NO: 1945709 - protein, 18 aa, Staphylococcus
GNTIKAQSTRANTKLLPN

SEQ ID NO: 1945710 - protein, 6 aa, Staphylococcus
GNTNDR

SEQ ID NO: 1945711 - protein, 13 aa, Staphylococcus
GNTPDENGKLKGD

SEQ ID NO: 1945712 - protein, 17 aa, Staphylococcus
GNTPDENGKLKGDIEYD

SEQ ID NO: 1945713 - protein, 16 aa, Staphylococcus
GNTPDENGKLKGDVDY

SEQ ID NO: 1945714 - protein, 17 aa, Staphylococcus
GNTPDENGKLKGDVEYE

SEQ ID NO: 1945715 - protein, 18 aa, Staphylococcus
GNTPDENGKLKGDVEYED

SEQ ID NO: 1945716 - protein, 5 aa, Staphylococcus
GNTQV

SEQ ID NO: 1945717 - protein, 25 aa, Staphylococcus
GNTTANAKSNFKNTWNTTKDRFGDI

SEQ ID NO: 1945718 - protein, 7 aa, Staphylococcus
GNTTIDP

SEQ ID NO: 1945719 - protein, 18 aa, Staphylococcus
GNTTQSELAKSLGKSQSF

SEQ ID NO: 1945720 - protein, 16 aa, Staphylococcus
GNTTSDDFLSKNQKGM

SEQ ID NO: 1945721 - protein, 6 aa, Staphylococcus
GNVEPA

SEQ ID NO: 1945722 - protein, 10 aa, Staphylococcus
GNVKDKITGN

SEQ ID NO: 1945723 - protein, 5 aa, Staphylococcus
GNVKE

SEQ ID NO: 1945724 - protein, 11 aa, Staphylococcus
GNVKETAGNVM

SEQ ID NO: 1945725 - protein, 43 aa, Staphylococcus
GNVKETVGNVTDNKDLEKEGKEDKASGKVKETIDNVKDKAKDF

SEQ ID NO: 1945726 - protein, 48 aa, Staphylococcus
GNVKETVGNVTDNKELENEGKEDKTSGKAKEFVENAKDKANEVIDKFK

SEQ ID NO: 1945727 - protein, 10 aa, Staphylococcus
GNVLGTGEKI

SEQ ID NO: 1945728 - protein, 4 aa, Staphylococcus
GNVN

SEQ ID NO: 1945729 - protein, 6 aa, Staphylococcus
GNVNEL

SEQ ID NO: 1945730 - protein, 9 aa, Staphylococcus
GNVPTSIKD

SEQ ID NO: 1945731 - protein, 8 aa, Staphylococcus
GNVQTGRS

SEQ ID NO: 1945732 - protein, 8 aa, Staphylococcus
GNVRGKGL

SEQ ID NO: 1945733 - protein, 8 aa, Staphylococcus
GNVSEDLP

SEQ ID NO: 1945734 - protein, 9 aa, Staphylococcus
GNVSEGGTA

SEQ ID NO: 1945735 - protein, 11 aa, Staphylococcus
GNVTNAVNAPK

SEQ ID NO: 1945736 - protein, 6 aa, Staphylococcus
GNWTPT

SEQ ID NO: 1945737 - protein, 7 aa, Staphylococcus
GNYAPDL

SEQ ID NO: 1945738 - protein, 7 aa, Staphylococcus
GNYDNTV

SEQ ID NO: 1945739 - protein, 5 aa, Staphylococcus
GNYEE

SEQ ID NO: 1945740 - protein, 7 aa, Staphylococcus
GNYGSNI

SEQ ID NO: 1945741 - protein, 5 aa, Staphylococcus
GNYHP

SEQ ID NO: 1945742 - protein, 7 aa, Staphylococcus
GNYLPSG

SEQ ID NO: 1945743 - protein, 4 aa, Staphylococcus
GNYP

SEQ ID NO: 1945744 - protein, 7 aa, Staphylococcus
GNYPEIT

SEQ ID NO: 1945745 - protein, 7 aa, Staphylococcus
GNYPEVT

SEQ ID NO: 1945746 - protein, 6 aa, Staphylococcus
GNYPKN

SEQ ID NO: 1945747 - protein, 11 aa, Staphylococcus
GNYQPAMEPEE

SEQ ID NO: 1945748 - protein, 9 aa, Staphylococcus
GNYRENFKD

SEQ ID NO: 1945749 - protein, 7 aa, Staphylococcus
GNYSDVT

SEQ ID NO: 1945750 - protein, 7 aa, Staphylococcus
GNYSTEE

SEQ ID NO: 1945751 - protein, 5 aa, Staphylococcus
GNYSY

SEQ ID NO: 1945752 - protein, 4 aa, Staphylococcus
GNYT

SEQ ID NO: 1945753 - protein, 4 aa, Staphylococcus
GPAA

SEQ ID NO: 1945754 - protein, 6 aa, Staphylococcus
GPAGMT

SEQ ID NO: 1945755 - protein, 4 aa, Staphylococcus
GPAI

SEQ ID NO: 1945756 - protein, 8 aa, Staphylococcus
GPANKQAY

SEQ ID NO: 1945757 - protein, 8 aa, Staphylococcus
GPANQQSY

SEQ ID NO: 1945758 - protein, 9 aa, Staphylococcus
GPASEATEE

SEQ ID NO: 1945759 - protein, 5 aa, Staphylococcus
GPASQ

SEQ ID NO: 1945760 - protein, 5 aa, Staphylococcus
GPATI

SEQ ID NO: 1945761 - protein, 19 aa, Staphylococcus
GPATINKDNYKGPKGPTGS

SEQ ID NO: 1945762 - protein, 19 aa, Staphylococcus
GPATINKHTHKGPKGPTGY

SEQ ID NO: 1945763 - protein, 19 aa, Staphylococcus
GPATINKPSHKGPKGPTGY

SEQ ID NO: 1945764 - protein, 19 aa, Staphylococcus
GPATINKSTFKGPKGPTGY

SEQ ID NO: 1945765 - protein, 11 aa, Staphylococcus
GPATSNSYEIN

SEQ ID NO: 1945766 - protein, 13 aa, Staphylococcus
GPATSNSYEINDD

SEQ ID NO: 1945767 - protein, 13 aa, Staphylococcus
GPATSNSYEINDE

SEQ ID NO: 1945768 - protein, 12 aa, Staphylococcus
GPATSSTYEIND

SEQ ID NO: 1945769 - protein, 14 aa, Staphylococcus
GPATSTSYEINDDI

SEQ ID NO: 1945770 - protein, 28 aa, Staphylococcus
GPATTNKTSYKGPKGPTGSMITTVLNWL

SEQ ID NO: 1945771 - protein, 19 aa, Staphylococcus
GPATTNRNNFNGPKGPTGY

SEQ ID NO: 1945772 - protein, 17 aa, Staphylococcus
GPAVDAQKHAAKVYNAD

SEQ ID NO: 1945773 - protein, 8 aa, Staphylococcus
GPDEANQK

SEQ ID NO: 1945774 - protein, 6 aa, Staphylococcus
GPDGAG

SEQ ID NO: 1945775 - protein, 13 aa, Staphylococcus
GPDRDFEPTDQRI

SEQ ID NO: 1945776 - protein, 13 aa, Staphylococcus
GPDRDFTPTEQRI

SEQ ID NO: 1945777 - protein, 13 aa, Staphylococcus
GPDRDQTNLLEQL

SEQ ID NO: 1945778 - protein, 13 aa, Staphylococcus
GPDREQTNLLEQL

SEQ ID NO: 1945779 - protein, 13 aa, Staphylococcus
GPDRNQTNLLKSL

SEQ ID NO: 1945780 - protein, 14 aa, Staphylococcus
GPDRTQTNMLKPLW

SEQ ID NO: 1945781 - protein, 16 aa, Staphylococcus
GPDSPDSLIKLFQSAD

SEQ ID NO: 1945782 - protein, 6 aa, Staphylococcus
GPDTTL

SEQ ID NO: 1945783 - protein, 4 aa, Staphylococcus
GPDV

SEQ ID NO: 1945784 - protein, 6 aa, Staphylococcus
GPEAVE

SEQ ID NO: 1945785 - protein, 7 aa, Staphylococcus
GPEESKL

SEQ ID NO: 1945786 - protein, 21 aa, Staphylococcus
GPEGGDGGGTIVATGTPEDIA

SEQ ID NO: 1945787 - protein, 30 aa, Staphylococcus
GPEGGDGGGTIVATGTPEEIAEAPDSYTGK

SEQ ID NO: 1945788 - protein, 30 aa, Staphylococcus
GPEGGDGGGTIVATGTPEEISNVDASYTGQ

SEQ ID NO: 1945789 - protein, 21 aa, Staphylococcus
GPEGGDGGGTLVATGTPEEIA

SEQ ID NO: 1945790 - protein, 21 aa, Staphylococcus
GPEGGDGGGTVVATGTPEQIA

SEQ ID NO: 1945791 - protein, 21 aa, Staphylococcus
GPEGGEGGGTIVATGTPEDIA

SEQ ID NO: 1945792 - protein, 30 aa, Staphylococcus
GPEGGEGGGTIVGTGTPEEIAENKDSYTGT

SEQ ID NO: 1945793 - protein, 8 aa, Staphylococcus
GPEKQQGY

SEQ ID NO: 1945794 - protein, 18 aa, Staphylococcus
GPEMKSTGEVMGKDATME

SEQ ID NO: 1945795 - protein, 18 aa, Staphylococcus
GPEMKSTGEVMGKDQTLE

SEQ ID NO: 1945796 - protein, 10 aa, Staphylococcus
GPENDTGQRL

SEQ ID NO: 1945797 - protein, 8 aa, Staphylococcus
GPEPNDED

SEQ ID NO: 1945798 - protein, 4 aa, Staphylococcus
GPEQ

SEQ ID NO: 1945799 - protein, 6 aa, Staphylococcus
GPEQTA

SEQ ID NO: 1945800 - protein, 9 aa, Staphylococcus
GPERSEELV

SEQ ID NO: 1945801 - protein, 14 aa, Staphylococcus
GPESDIPAPDVYTN

SEQ ID NO: 1945802 - protein, 4 aa, Staphylococcus
GPFD

SEQ ID NO: 1945803 - protein, 7 aa, Staphylococcus
GPFDGQD

SEQ ID NO: 1945804 - protein, 15 aa, Staphylococcus
GPFEAAKKNVSDNQL

SEQ ID NO: 1945805 - protein, 11 aa, Staphylococcus
GPFKAAKQNVR

SEQ ID NO: 1945806 - protein, 5 aa, Staphylococcus
GPFKS

SEQ ID NO: 1945807 - protein, 6 aa, Staphylococcus
GPFPSA

SEQ ID NO: 1945808 - protein, 10 aa, Staphylococcus
GPGAGEHGGE

SEQ ID NO: 1945809 - protein, 21 aa, Staphylococcus
GPGAGEHGGEIVASGTPKQVM

SEQ ID NO: 1945810 - protein, 21 aa, Staphylococcus
GPGAGNHGGEIVSSGTPAKVM

SEQ ID NO: 1945811 - protein, 42 aa, Staphylococcus
GPGAGNHGGEIVSSGTPDKVMKDKKSLTGQYLSGQKRIDVPE

SEQ ID NO: 1945812 - protein, 32 aa, Staphylococcus
GPGAGNHGGEIVSSGTPKKVMKDKKSLTGQYL

SEQ ID NO: 1945813 - protein, 6 aa, Staphylococcus
GPGDEV

SEQ ID NO: 1945814 - protein, 18 aa, Staphylococcus
GPGDTQSESYVTEIWMPI

SEQ ID NO: 1945815 - protein, 4 aa, Staphylococcus
GPGG

SEQ ID NO: 1945816 - protein, 9 aa, Staphylococcus
GPGLTKSMN

SEQ ID NO: 1945817 - protein, 8 aa, Staphylococcus
GPGLTQKL

SEQ ID NO: 1945818 - protein, 8 aa, Staphylococcus
GPGPGLDG

SEQ ID NO: 1945819 - protein, 37 aa, Staphylococcus
GPGPGLDGGKVQFSGTPKNFIDSSETLTSKHLKRYIN

SEQ ID NO: 1945820 - protein, 12 aa, Staphylococcus
GPGQAAAQIEGS

SEQ ID NO: 1945821 - protein, 4 aa, Staphylococcus
GPGR

SEQ ID NO: 1945822 - protein, 10 aa, Staphylococcus
GPGRGSSAGS

SEQ ID NO: 1945823 - protein, 13 aa, Staphylococcus
GPGSGKDGGKITF

SEQ ID NO: 1945824 - protein, 13 aa, Staphylococcus
GPGSGKNGGEITF

SEQ ID NO: 1945825 - protein, 17 aa, Staphylococcus
GPGVVDQETLKKRVKDA

SEQ ID NO: 1945826 - protein, 5 aa, Staphylococcus
GPHKG

SEQ ID NO: 1945827 - protein, 12 aa, Staphylococcus
GPHNDAKDQKTY

SEQ ID NO: 1945828 - protein, 14 aa, Staphylococcus
GPHQKVDKEREIGA

SEQ ID NO: 1945829 - protein, 14 aa, Staphylococcus
GPHQKVEKEREIGA

SEQ ID NO: 1945830 - protein, 6 aa, Staphylococcus
GPHQTG

SEQ ID NO: 1945831 - protein, 4 aa, Staphylococcus
GPHR

SEQ ID NO: 1945832 - protein, 5 aa, Staphylococcus
GPHRD

SEQ ID NO: 1945833 - protein, 13 aa, Staphylococcus
GPHRKEEKERDIG

SEQ ID NO: 1945834 - protein, 13 aa, Staphylococcus
GPHRKEEKEREIG

SEQ ID NO: 1945835 - protein, 12 aa, Staphylococcus
GPHRKEEKEREL

SEQ ID NO: 1945836 - protein, 7 aa, Staphylococcus
GPHVTTP

SEQ ID NO: 1945837 - protein, 13 aa, Staphylococcus
GPIDEVKTNHGNK

SEQ ID NO: 1945838 - protein, 6 aa, Staphylococcus
GPIDGS

SEQ ID NO: 1945839 - protein, 6 aa, Staphylococcus
GPIDTP

SEQ ID NO: 1945840 - protein, 19 aa, Staphylococcus
GPIDVNTPANLRQTGYEQT

SEQ ID NO: 1945841 - protein, 4 aa, Staphylococcus
GPIE

SEQ ID NO: 1945842 - protein, 17 aa, Staphylococcus
GPILEPDTKYDSHGVYS

SEQ ID NO: 1945843 - protein, 18 aa, Staphylococcus
GPIPTSSFTPEESPDPGF

SEQ ID NO: 1945844 - protein, 5 aa, Staphylococcus
GPIQQ

SEQ ID NO: 1945845 - protein, 6 aa, Staphylococcus
GPIRPD

SEQ ID NO: 1945846 - protein, 6 aa, Staphylococcus
GPIRTP

SEQ ID NO: 1945847 - protein, 6 aa, Staphylococcus
GPKDDI

SEQ ID NO: 1945848 - protein, 8 aa, Staphylococcus
GPKDTLNT

SEQ ID NO: 1945849 - protein, 4 aa, Staphylococcus
GPKE

SEQ ID NO: 1945850 - protein, 7 aa, Staphylococcus
GPKETLN

SEQ ID NO: 1945851 - protein, 9 aa, Staphylococcus
GPKGAPGMP

SEQ ID NO: 1945852 - protein, 10 aa, Staphylococcus
GPKGKNMESR

SEQ ID NO: 1945853 - protein, 7 aa, Staphylococcus
GPKQTGI

SEQ ID NO: 1945854 - protein, 4 aa, Staphylococcus
GPLG

SEQ ID NO: 1945855 - protein, 4 aa, Staphylococcus
GPLK

SEQ ID NO: 1945856 - protein, 5 aa, Staphylococcus
GPLKE

SEQ ID NO: 1945857 - protein, 18 aa, Staphylococcus
GPLKSKTINRVRNSSARE

SEQ ID NO: 1945858 - protein, 13 aa, Staphylococcus
GPLNASRSEQGQP

SEQ ID NO: 1945859 - protein, 13 aa, Staphylococcus
GPLQNEEGTGKID

SEQ ID NO: 1945860 - protein, 4 aa, Staphylococcus
GPLS

SEQ ID NO: 1945861 - protein, 6 aa, Staphylococcus
GPLSKL

SEQ ID NO: 1945862 - protein, 25 aa, Staphylococcus
GPLSTPSSPQGKPVSMQAGASKQGV

SEQ ID NO: 1945863 - protein, 14 aa, Staphylococcus
GPLTKEKATQLKDY

SEQ ID NO: 1945864 - protein, 5 aa, Staphylococcus
GPLTN

SEQ ID NO: 1945865 - protein, 8 aa, Staphylococcus
GPLTTDKL

SEQ ID NO: 1945866 - protein, 6 aa, Staphylococcus
GPLTTE

SEQ ID NO: 1945867 - protein, 8 aa, Staphylococcus
GPLTTEGL

SEQ ID NO: 1945868 - protein, 11 aa, Staphylococcus
GPLTTPIGGGI

SEQ ID NO: 1945869 - protein, 15 aa, Staphylococcus
GPLTTPSSPQGKPIA

SEQ ID NO: 1945870 - protein, 4 aa, Staphylococcus
GPMG

SEQ ID NO: 1945871 - protein, 5 aa, Staphylococcus
GPMGG

SEQ ID NO: 1945872 - protein, 14 aa, Staphylococcus
GPMKAGLSSEGKAL

SEQ ID NO: 1945873 - protein, 10 aa, Staphylococcus
GPNAGKDGGE

SEQ ID NO: 1945874 - protein, 8 aa, Staphylococcus
GPNATDVV

SEQ ID NO: 1945875 - protein, 6 aa, Staphylococcus
GPNDDI

SEQ ID NO: 1945876 - protein, 12 aa, Staphylococcus
GPNEAAAQIEGS

SEQ ID NO: 1945877 - protein, 19 aa, Staphylococcus
GPNEETKETEDEVPPTTAR

SEQ ID NO: 1945878 - protein, 10 aa, Staphylococcus
GPNGAGKSSF

SEQ ID NO: 1945879 - protein, 10 aa, Staphylococcus
GPNGAGKSTT

SEQ ID NO: 1945880 - protein, 8 aa, Staphylococcus
GPNGCGKS

SEQ ID NO: 1945881 - protein, 8 aa, Staphylococcus
GPNGSGKS

SEQ ID NO: 1945882 - protein, 11 aa, Staphylococcus
GPNGTGKSTLS

SEQ ID NO: 1945883 - protein, 9 aa, Staphylococcus
GPNIGGGRV

SEQ ID NO: 1945884 - protein, 5 aa, Staphylococcus
GPNIK

SEQ ID NO: 1945885 - protein, 10 aa, Staphylococcus
GPNKDIPAPD

SEQ ID NO: 1945886 - protein, 11 aa, Staphylococcus
GPNKDIPAPDV

SEQ ID NO: 1945887 - protein, 16 aa, Staphylococcus
GPNKEAAQIEGSKSFA

SEQ ID NO: 1945888 - protein, 7 aa, Staphylococcus
GPNKNLD

SEQ ID NO: 1945889 - protein, 12 aa, Staphylococcus
GPNQDAAQIEGS

SEQ ID NO: 1945890 - protein, 14 aa, Staphylococcus
GPNSDAAQIEGSKA

SEQ ID NO: 1945891 - protein, 10 aa, Staphylococcus
GPPTANGLPH

SEQ ID NO: 1945892 - protein, 5 aa, Staphylococcus
GPQAI

SEQ ID NO: 1945893 - protein, 6 aa, Staphylococcus
GPQAIE

SEQ ID NO: 1945894 - protein, 7 aa, Staphylococcus
GPQEDEI

SEQ ID NO: 1945895 - protein, 8 aa, Staphylococcus
GPQGVGKS

SEQ ID NO: 1945896 - protein, 6 aa, Staphylococcus
GPQITS

SEQ ID NO: 1945897 - protein, 9 aa, Staphylococcus
GPQKGATAK

SEQ ID NO: 1945898 - protein, 6 aa, Staphylococcus
GPQQVQ

SEQ ID NO: 1945899 - protein, 15 aa, Staphylococcus
GPQYDSFSDESHEGL

SEQ ID NO: 1945900 - protein, 4 aa, Staphylococcus
GPRA

SEQ ID NO: 1945901 - protein, 8 aa, Staphylococcus
GPRAKEVQ

SEQ ID NO: 1945902 - protein, 8 aa, Staphylococcus
GPRAKPVQ

SEQ ID NO: 1945903 - protein, 5 aa, Staphylococcus
GPRIT

SEQ ID NO: 1945904 - protein, 17 aa, Staphylococcus
GPRSTLRDEMGTQLKSS

SEQ ID NO: 1945905 - protein, 10 aa, Staphylococcus
GPSDDPNMKP

SEQ ID NO: 1945906 - protein, 7 aa, Staphylococcus
GPSDKSH

SEQ ID NO: 1945907 - protein, 7 aa, Staphylococcus
GPSEDAF

SEQ ID NO: 1945908 - protein, 10 aa, Staphylococcus
GPSETPGFSS

SEQ ID NO: 1945909 - protein, 10 aa, Staphylococcus
GPSGCGKTTT

SEQ ID NO: 1945910 - protein, 9 aa, Staphylococcus
GPSGGGKST

SEQ ID NO: 1945911 - protein, 10 aa, Staphylococcus
GPSGSGKSTF

SEQ ID NO: 1945912 - protein, 10 aa, Staphylococcus
GPSGSGKTTA

SEQ ID NO: 1945913 - protein, 10 aa, Staphylococcus
GPSGSGKTTL

SEQ ID NO: 1945914 - protein, 10 aa, Staphylococcus
GPSGVGKGTV

SEQ ID NO: 1945915 - protein, 9 aa, Staphylococcus
GPSIERPGD

SEQ ID NO: 1945916 - protein, 8 aa, Staphylococcus
GPSKKTME

SEQ ID NO: 1945917 - protein, 7 aa, Staphylococcus
GPSNRNY

SEQ ID NO: 1945918 - protein, 7 aa, Staphylococcus
GPSPAAL

SEQ ID NO: 1945919 - protein, 5 aa, Staphylococcus
GPSQE

SEQ ID NO: 1945920 - protein, 6 aa, Staphylococcus
GPSQEL

SEQ ID NO: 1945921 - protein, 12 aa, Staphylococcus
GPSSGAQGGEIT

SEQ ID NO: 1945922 - protein, 13 aa, Staphylococcus
GPSSGDQGGEITF

SEQ ID NO: 1945923 - protein, 6 aa, Staphylococcus
GPSTEL

SEQ ID NO: 1945924 - protein, 11 aa, Staphylococcus
GPSTSTTYEIN

SEQ ID NO: 1945925 - protein, 12 aa, Staphylococcus
GPSVPPKESADI

SEQ ID NO: 1945926 - protein, 14 aa, Staphylococcus
GPTAIATSTEDVVA

SEQ ID NO: 1945927 - protein, 13 aa, Staphylococcus
GPTAIATTTDDVV

SEQ ID NO: 1945928 - protein, 13 aa, Staphylococcus
GPTAVATSTEDVV

SEQ ID NO: 1945929 - protein, 11 aa, Staphylococcus
GPTCHTGSQSC

SEQ ID NO: 1945930 - protein, 6 aa, Staphylococcus
GPTEST

SEQ ID NO: 1945931 - protein, 31 aa, Staphylococcus
GPTFSTTVKSNTKSAVQQTGHKQAAKVTAAE

SEQ ID NO: 1945932 - protein, 18 aa, Staphylococcus
GPTGSQMGKKESAKDTAR

SEQ ID NO: 1945933 - protein, 9 aa, Staphylococcus
GPTPPDKDH

SEQ ID NO: 1945934 - protein, 9 aa, Staphylococcus
GPTPRSYGY

SEQ ID NO: 1945935 - protein, 7 aa, Staphylococcus
GPTPVPD

SEQ ID NO: 1945936 - protein, 8 aa, Staphylococcus
GPTPVPDE

SEQ ID NO: 1945937 - protein, 7 aa, Staphylococcus
GPTPVPE

SEQ ID NO: 1945938 - protein, 8 aa, Staphylococcus
GPTPVPKE

SEQ ID NO: 1945939 - protein, 9 aa, Staphylococcus
GPTPVPKEI

SEQ ID NO: 1945940 - protein, 8 aa, Staphylococcus
GPTPVPNS

SEQ ID NO: 1945941 - protein, 9 aa, Staphylococcus
GPTTPTPAF

SEQ ID NO: 1945942 - protein, 8 aa, Staphylococcus
GPTTPTTA

SEQ ID NO: 1945943 - protein, 13 aa, Staphylococcus
GPTVNARKDKKEA

SEQ ID NO: 1945944 - protein, 4 aa, Staphylococcus
GPTY

SEQ ID NO: 1945945 - protein, 11 aa, Staphylococcus
GPVENEDKSKL

SEQ ID NO: 1945946 - protein, 4 aa, Staphylococcus
GPVI

SEQ ID NO: 1945947 - protein, 8 aa, Staphylococcus
GPVPELPP

SEQ ID NO: 1945948 - protein, 14 aa, Staphylococcus
GPVTNFDEANKSDL

SEQ ID NO: 1945949 - protein, 13 aa, Staphylococcus
GPVTNFEEANQSD

SEQ ID NO: 1945950 - protein, 13 aa, Staphylococcus
GPVTNFEQANKSD

SEQ ID NO: 1945951 - protein, 14 aa, Staphylococcus
GPVTNFEQANSSDL

SEQ ID NO: 1945952 - protein, 11 aa, Staphylococcus
GPVTRKMKQPG

SEQ ID NO: 1945953 - protein, 5 aa, Staphylococcus
GPVYG

SEQ ID NO: 1945954 - protein, 7 aa, Staphylococcus
GPYAERK

SEQ ID NO: 1945955 - protein, 11 aa, Staphylococcus
GPYPTEDELDP

SEQ ID NO: 1945956 - protein, 13 aa, Staphylococcus
GPYPTENEVDPDL

SEQ ID NO: 1945957 - protein, 4 aa, Staphylococcus
GQAD

SEQ ID NO: 1945958 - protein, 11 aa, Staphylococcus
GQAEGEYDRPH

SEQ ID NO: 1945959 - protein, 12 aa, Staphylococcus
GQAGGRAEITPE

SEQ ID NO: 1945960 - protein, 7 aa, Staphylococcus
GQAGGRF

SEQ ID NO: 1945961 - protein, 5 aa, Staphylococcus
GQAIS

SEQ ID NO: 1945962 - protein, 9 aa, Staphylococcus
GQAKISGNA

SEQ ID NO: 1945963 - protein, 7 aa, Staphylococcus
GQALPQA

SEQ ID NO: 1945964 - protein, 7 aa, Staphylococcus
GQAPYES

SEQ ID NO: 1945965 - protein, 7 aa, Staphylococcus
GQAQHTQ

SEQ ID NO: 1945966 - protein, 12 aa, Staphylococcus
GQAQLNERSNGE

SEQ ID NO: 1945967 - protein, 7 aa, Staphylococcus
GQARQSC

SEQ ID NO: 1945968 - protein, 10 aa, Staphylococcus
GQATGTEKNI

SEQ ID NO: 1945969 - protein, 10 aa, Staphylococcus
GQDDPSYRES

SEQ ID NO: 1945970 - protein, 6 aa, Staphylococcus
GQDDVS

SEQ ID NO: 1945971 - protein, 8 aa, Staphylococcus
GQDENYEE

SEQ ID NO: 1945972 - protein, 13 aa, Staphylococcus
GQDETDYSHPTEE

SEQ ID NO: 1945973 - protein, 17 aa, Staphylococcus
GQDGEQIGVKSKQEALE

SEQ ID NO: 1945974 - protein, 6 aa, Staphylococcus
GQDHAV

SEQ ID NO: 1945975 - protein, 9 aa, Staphylococcus
GQDHSSKRD

SEQ ID NO: 1945976 - protein, 9 aa, Staphylococcus
GQDKEATQA

SEQ ID NO: 1945977 - protein, 13 aa, Staphylococcus
GQDKEATQKARDY

SEQ ID NO: 1945978 - protein, 11 aa, Staphylococcus
GQDKEATQRAR

SEQ ID NO: 1945979 - protein, 7 aa, Staphylococcus
GQDKQVG

SEQ ID NO: 1945980 - protein, 6 aa, Staphylococcus
GQDLPQ

SEQ ID NO: 1945981 - protein, 16 aa, Staphylococcus
GQDQQRVGGVGTGGGM

SEQ ID NO: 1945982 - protein, 14 aa, Staphylococcus
GQDSTDTKRSREEL

SEQ ID NO: 1945983 - protein, 11 aa, Staphylococcus
GQDSTEKDVEA

SEQ ID NO: 1945984 - protein, 7 aa, Staphylococcus
GQDTDIA

SEQ ID NO: 1945985 - protein, 7 aa, Staphylococcus
GQDTVRR

SEQ ID NO: 1945986 - protein, 4 aa, Staphylococcus
GQDV

SEQ ID NO: 1945987 - protein, 8 aa, Staphylococcus
GQDYPKPL

SEQ ID NO: 1945988 - protein, 6 aa, Staphylococcus
GQEAAQ

SEQ ID NO: 1945989 - protein, 13 aa, Staphylococcus
GQEAIDDNGEMNR

SEQ ID NO: 1945990 - protein, 7 aa, Staphylococcus
GQEATQI

SEQ ID NO: 1945991 - protein, 11 aa, Staphylococcus
GQEDDDTMARD

SEQ ID NO: 1945992 - protein, 11 aa, Staphylococcus
GQEGQRKIENQ

SEQ ID NO: 1945993 - protein, 4 aa, Staphylococcus
GQEH

SEQ ID NO: 1945994 - protein, 5 aa, Staphylococcus
GQEHE

SEQ ID NO: 1945995 - protein, 5 aa, Staphylococcus
GQEIA

SEQ ID NO: 1945996 - protein, 6 aa, Staphylococcus
GQEIAV

SEQ ID NO: 1945997 - protein, 9 aa, Staphylococcus
GQEKAKKSL

SEQ ID NO: 1945998 - protein, 7 aa, Staphylococcus
GQEKDDF

SEQ ID NO: 1945999 - protein, 4 aa, Staphylococcus
GQEL

SEQ ID NO: 1946000 - protein, 33 aa, Staphylococcus
GQELKRQSAQPSGRAVRSKRGGSWVSRLRDTLK

SEQ ID NO: 1946001 - protein, 4 aa, Staphylococcus
GQEN

SEQ ID NO: 1946002 - protein, 7 aa, Staphylococcus
GQEPQQL

SEQ ID NO: 1946003 - protein, 9 aa, Staphylococcus
GQERGWPEF

SEQ ID NO: 1946004 - protein, 15 aa, Staphylococcus
GQESDDDMARDHQEA

SEQ ID NO: 1946005 - protein, 9 aa, Staphylococcus
GQESNPTTW

SEQ ID NO: 1946006 - protein, 4 aa, Staphylococcus
GQET

SEQ ID NO: 1946007 - protein, 21 aa, Staphylococcus
GQETYSQDAGVSDDFIGEFIK

SEQ ID NO: 1946008 - protein, 12 aa, Staphylococcus
GQEVDSASHSRA

SEQ ID NO: 1946009 - protein, 9 aa, Staphylococcus
GQEYNSTTY

SEQ ID NO: 1946010 - protein, 7 aa, Staphylococcus
GQFAKGS

SEQ ID NO: 1946011 - protein, 12 aa, Staphylococcus
GQFSSTPIPSQA

SEQ ID NO: 1946012 - protein, 5 aa, Staphylococcus
GQFTD

SEQ ID NO: 1946013 - protein, 23 aa, Staphylococcus
GQGAMTTAIEGAEDSASLGEQDL

SEQ ID NO: 1946014 - protein, 7 aa, Staphylococcus
GQGAYSK

SEQ ID NO: 1946015 - protein, 4 aa, Staphylococcus
GQGC

SEQ ID NO: 1946016 - protein, 15 aa, Staphylococcus
GQGFDPNSQPQGTGL

SEQ ID NO: 1946017 - protein, 15 aa, Staphylococcus
GQGFDPSSKPRGSGL

SEQ ID NO: 1946018 - protein, 9 aa, Staphylococcus
GQGGEKDKI

SEQ ID NO: 1946019 - protein, 14 aa, Staphylococcus
GQGGHGSSPHAAND

SEQ ID NO: 1946020 - protein, 10 aa, Staphylococcus
GQGKSKKEAI

SEQ ID NO: 1946021 - protein, 7 aa, Staphylococcus
GQGPHQI

SEQ ID NO: 1946022 - protein, 9 aa, Staphylococcus
GQGQEATQI

SEQ ID NO: 1946023 - protein, 7 aa, Staphylococcus
GQGQEQV

SEQ ID NO: 1946024 - protein, 12 aa, Staphylococcus
GQGTGDRPEIDR

SEQ ID NO: 1946025 - protein, 16 aa, Staphylococcus
GQGTRLGYDGPKGSFE

SEQ ID NO: 1946026 - protein, 17 aa, Staphylococcus
GQGTRLGYKGPKGSFEI

SEQ ID NO: 1946027 - protein, 16 aa, Staphylococcus
GQGTRLGYSGPKGSFE

SEQ ID NO: 1946028 - protein, 8 aa, Staphylococcus
GQHEFKTG

SEQ ID NO: 1946029 - protein, 7 aa, Staphylococcus
GQHETQS

SEQ ID NO: 1946030 - protein, 5 aa, Staphylococcus
GQHFE

SEQ ID NO: 1946031 - protein, 7 aa, Staphylococcus
GQHFKDK

SEQ ID NO: 1946032 - protein, 5 aa, Staphylococcus
GQHPI

SEQ ID NO: 1946033 - protein, 4 aa, Staphylococcus
GQHQ

SEQ ID NO: 1946034 - protein, 5 aa, Staphylococcus
GQHQR

SEQ ID NO: 1946035 - protein, 19 aa, Staphylococcus
GQHSNKLDIEGKELTHDSR

SEQ ID NO: 1946036 - protein, 5 aa, Staphylococcus
GQHSS

SEQ ID NO: 1946037 - protein, 6 aa, Staphylococcus
GQHTKA

SEQ ID NO: 1946038 - protein, 8 aa, Staphylococcus
GQHYSSSK

SEQ ID NO: 1946039 - protein, 9 aa, Staphylococcus
GQIDPKRDV

SEQ ID NO: 1946040 - protein, 11 aa, Staphylococcus
GQIGAGTVKPP

SEQ ID NO: 1946041 - protein, 13 aa, Staphylococcus
GQIGTKASYQTIQ

SEQ ID NO: 1946042 - protein, 7 aa, Staphylococcus
GQIKDPR

SEQ ID NO: 1946043 - protein, 10 aa, Staphylococcus
GQIKEPTDMN

SEQ ID NO: 1946044 - protein, 9 aa, Staphylococcus
GQIPQTHAE

SEQ ID NO: 1946045 - protein, 10 aa, Staphylococcus
GQIPSTHKEL

SEQ ID NO: 1946046 - protein, 11 aa, Staphylococcus
GQIQEDDEVEG

SEQ ID NO: 1946047 - protein, 7 aa, Staphylococcus
GQIQGVA

SEQ ID NO: 1946048 - protein, 5 aa, Staphylococcus
GQITM

SEQ ID NO: 1946049 - protein, 9 aa, Staphylococcus
GQITQNREQ

SEQ ID NO: 1946050 - protein, 10 aa, Staphylococcus
GQITQNREQV

SEQ ID NO: 1946051 - protein, 4 aa, Staphylococcus
GQIY

SEQ ID NO: 1946052 - protein, 16 aa, Staphylococcus
GQKAYDETGEWLPSET

SEQ ID NO: 1946053 - protein, 10 aa, Staphylococcus
GQKAYDNTGE

SEQ ID NO: 1946054 - protein, 24 aa, Staphylococcus
GQKFSGKITNYDDEIDNESREDSI

SEQ ID NO: 1946055 - protein, 8 aa, Staphylococcus
GQKGAKRA

SEQ ID NO: 1946056 - protein, 22 aa, Staphylococcus
GQKGTDLTYQDKEKLEKKNLPG

SEQ ID NO: 1946057 - protein, 16 aa, Staphylococcus
GQKGTDLTYQEKEKIE

SEQ ID NO: 1946058 - protein, 10 aa, Staphylococcus
GQKGTNLTYQ

SEQ ID NO: 1946059 - protein, 16 aa, Staphylococcus
GQKGTNLTYQDKEKIE

SEQ ID NO: 1946060 - protein, 17 aa, Staphylococcus
GQKGTNLTYQDKQKLEK

SEQ ID NO: 1946061 - protein, 17 aa, Staphylococcus
GQKGTNLTYQQKEKIEK

SEQ ID NO: 1946062 - protein, 8 aa, Staphylococcus
GQKHQGTK

SEQ ID NO: 1946063 - protein, 9 aa, Staphylococcus
GQKIEPVEK

SEQ ID NO: 1946064 - protein, 8 aa, Staphylococcus
GQKKAIDA

SEQ ID NO: 1946065 - protein, 10 aa, Staphylococcus
GQKKDDEVTH

SEQ ID NO: 1946066 - protein, 15 aa, Staphylococcus
GQKKNDFNTPVIRLN

SEQ ID NO: 1946067 - protein, 8 aa, Staphylococcus
GQKKRSRN

SEQ ID NO: 1946068 - protein, 6 aa, Staphylococcus
GQKLPE

SEQ ID NO: 1946069 - protein, 9 aa, Staphylococcus
GQKNNNDVT

SEQ ID NO: 1946070 - protein, 8 aa, Staphylococcus
GQKNPDRV

SEQ ID NO: 1946071 - protein, 4 aa, Staphylococcus
GQKP

SEQ ID NO: 1946072 - protein, 7 aa, Staphylococcus
GQKQAHL

SEQ ID NO: 1946073 - protein, 8 aa, Staphylococcus
GQKRNDKI

SEQ ID NO: 1946074 - protein, 7 aa, Staphylococcus
GQKSGNE

SEQ ID NO: 1946075 - protein, 7 aa, Staphylococcus
GQKTDEG

SEQ ID NO: 1946076 - protein, 10 aa, Staphylococcus
GQKTGNTITH

SEQ ID NO: 1946077 - protein, 12 aa, Staphylococcus
GQKYTKLSDYEE

SEQ ID NO: 1946078 - protein, 6 aa, Staphylococcus
GQLAPT

SEQ ID NO: 1946079 - protein, 6 aa, Staphylococcus
GQLDHP

SEQ ID NO: 1946080 - protein, 8 aa, Staphylococcus
GQLDNPGK

SEQ ID NO: 1946081 - protein, 6 aa, Staphylococcus
GQLDYD

SEQ ID NO: 1946082 - protein, 7 aa, Staphylococcus
GQLEDEK

SEQ ID NO: 1946083 - protein, 7 aa, Staphylococcus
GQLEHPG

SEQ ID NO: 1946084 - protein, 11 aa, Staphylococcus
GQLELKSGNRW

SEQ ID NO: 1946085 - protein, 8 aa, Staphylococcus
GQLENPEN

SEQ ID NO: 1946086 - protein, 8 aa, Staphylococcus
GQLENPSN

SEQ ID NO: 1946087 - protein, 14 aa, Staphylococcus
GQLETVKNKYNKMS

SEQ ID NO: 1946088 - protein, 4 aa, Staphylococcus
GQLK

SEQ ID NO: 1946089 - protein, 14 aa, Staphylococcus
GQLPENVTKEQAKD

SEQ ID NO: 1946090 - protein, 7 aa, Staphylococcus
GQLPKGV

SEQ ID NO: 1946091 - protein, 9 aa, Staphylococcus
GQLSEEDVR

SEQ ID NO: 1946092 - protein, 6 aa, Staphylococcus
GQLSGS

SEQ ID NO: 1946093 - protein, 7 aa, Staphylococcus
GQLTNDM

SEQ ID NO: 1946094 - protein, 10 aa, Staphylococcus
GQLTTSDESL

SEQ ID NO: 1946095 - protein, 6 aa, Staphylococcus
GQMAKT

SEQ ID NO: 1946096 - protein, 9 aa, Staphylococcus
GQMDNHSAE

SEQ ID NO: 1946097 - protein, 6 aa, Staphylococcus
GQMNRV

SEQ ID NO: 1946098 - protein, 9 aa, Staphylococcus
GQNAGNNSD

SEQ ID NO: 1946099 - protein, 4 aa, Staphylococcus
GQND

SEQ ID NO: 1946100 - protein, 10 aa, Staphylococcus
GQNDGVNDGD

SEQ ID NO: 1946101 - protein, 9 aa, Staphylococcus
GQNEGVQDG

SEQ ID NO: 1946102 - protein, 10 aa, Staphylococcus
GQNGTGKTSL

SEQ ID NO: 1946103 - protein, 11 aa, Staphylococcus
GQNKKDARQLV

SEQ ID NO: 1946104 - protein, 8 aa, Staphylococcus
GQNKNQIQ

SEQ ID NO: 1946105 - protein, 24 aa, Staphylococcus
GQNKVKDTKAIQKALNKAKNGEHT

SEQ ID NO: 1946106 - protein, 4 aa, Staphylococcus
GQNL

SEQ ID NO: 1946107 - protein, 8 aa, Staphylococcus
GQNLGAVD

SEQ ID NO: 1946108 - protein, 6 aa, Staphylococcus
GQNLPK

SEQ ID NO: 1946109 - protein, 10 aa, Staphylococcus
GQNLPVETEL

SEQ ID NO: 1946110 - protein, 5 aa, Staphylococcus
GQNLY

SEQ ID NO: 1946111 - protein, 10 aa, Staphylococcus
GQNSAIENIE

SEQ ID NO: 1946112 - protein, 5 aa, Staphylococcus
GQNYD

SEQ ID NO: 1946113 - protein, 6 aa, Staphylococcus
GQNYDY

SEQ ID NO: 1946114 - protein, 7 aa, Staphylococcus
GQNYRSS

SEQ ID NO: 1946115 - protein, 14 aa, Staphylococcus
GQPADIAQKAKDGI

SEQ ID NO: 1946116 - protein, 7 aa, Staphylococcus
GQPARID

SEQ ID NO: 1946117 - protein, 14 aa, Staphylococcus
GQPATTLSGGEAQR

SEQ ID NO: 1946118 - protein, 15 aa, Staphylococcus
GQPATTLSGGEAQRV

SEQ ID NO: 1946119 - protein, 6 aa, Staphylococcus
GQPAVQ

SEQ ID NO: 1946120 - protein, 5 aa, Staphylococcus
GQPDF

SEQ ID NO: 1946121 - protein, 5 aa, Staphylococcus
GQPDH

SEQ ID NO: 1946122 - protein, 6 aa, Staphylococcus
GQPDPK

SEQ ID NO: 1946123 - protein, 14 aa, Staphylococcus
GQPENHYSHSGPIG

SEQ ID NO: 1946124 - protein, 14 aa, Staphylococcus
GQPGLVTKDDVKEG

SEQ ID NO: 1946125 - protein, 8 aa, Staphylococcus
GQPISDHT

SEQ ID NO: 1946126 - protein, 7 aa, Staphylococcus
GQPITEM

SEQ ID NO: 1946127 - protein, 9 aa, Staphylococcus
GQPKAGETV

SEQ ID NO: 1946128 - protein, 9 aa, Staphylococcus
GQPKEGDTV

SEQ ID NO: 1946129 - protein, 9 aa, Staphylococcus
GQPKEGETV

SEQ ID NO: 1946130 - protein, 5 aa, Staphylococcus
GQPLF

SEQ ID NO: 1946131 - protein, 7 aa, Staphylococcus
GQPLGNA

SEQ ID NO: 1946132 - protein, 10 aa, Staphylococcus
GQPPESYAHS

SEQ ID NO: 1946133 - protein, 8 aa, Staphylococcus
GQPQEGET

SEQ ID NO: 1946134 - protein, 8 aa, Staphylococcus
GQPQSGET

SEQ ID NO: 1946135 - protein, 9 aa, Staphylococcus
GQPQSGETV

SEQ ID NO: 1946136 - protein, 13 aa, Staphylococcus
GQPSDMTGESLIK

SEQ ID NO: 1946137 - protein, 4 aa, Staphylococcus
GQPV

SEQ ID NO: 1946138 - protein, 4 aa, Staphylococcus
GQPY

SEQ ID NO: 1946139 - protein, 5 aa, Staphylococcus
GQQAL

SEQ ID NO: 1946140 - protein, 6 aa, Staphylococcus
GQQAMT

SEQ ID NO: 1946141 - protein, 14 aa, Staphylococcus
GQQDDVSKAHGTAL

SEQ ID NO: 1946142 - protein, 19 aa, Staphylococcus
GQQEPHEAREMTSDEIEQT

SEQ ID NO: 1946143 - protein, 5 aa, Staphylococcus
GQQGV

SEQ ID NO: 1946144 - protein, 19 aa, Staphylococcus
GQQHEHDAREITPKEIEQT

SEQ ID NO: 1946145 - protein, 4 aa, Staphylococcus
GQQI

SEQ ID NO: 1946146 - protein, 4 aa, Staphylococcus
GQQK

SEQ ID NO: 1946147 - protein, 5 aa, Staphylococcus
GQQLR

SEQ ID NO: 1946148 - protein, 11 aa, Staphylococcus
GQQLTKDYQGK

SEQ ID NO: 1946149 - protein, 10 aa, Staphylococcus
GQQNKKNSAY

SEQ ID NO: 1946150 - protein, 7 aa, Staphylococcus
GQQQPID

SEQ ID NO: 1946151 - protein, 16 aa, Staphylococcus
GQQQQRVGGIGTGGGM

SEQ ID NO: 1946152 - protein, 9 aa, Staphylococcus
GQQQSIDKV

SEQ ID NO: 1946153 - protein, 5 aa, Staphylococcus
GQQSH

SEQ ID NO: 1946154 - protein, 10 aa, Staphylococcus
GQQSYQGKNH

SEQ ID NO: 1946155 - protein, 9 aa, Staphylococcus
GQQTANSIR

SEQ ID NO: 1946156 - protein, 6 aa, Staphylococcus
GQQVAD

SEQ ID NO: 1946157 - protein, 12 aa, Staphylococcus
GQQYKKKKSSLK

SEQ ID NO: 1946158 - protein, 5 aa, Staphylococcus
GQQYT

SEQ ID NO: 1946159 - protein, 4 aa, Staphylococcus
GQRA

SEQ ID NO: 1946160 - protein, 16 aa, Staphylococcus
GQRANDFNTPVIINKK

SEQ ID NO: 1946161 - protein, 9 aa, Staphylococcus
GQRANLTTE

SEQ ID NO: 1946162 - protein, 5 aa, Staphylococcus
GQRGY

SEQ ID NO: 1946163 - protein, 5 aa, Staphylococcus
GQRIA

SEQ ID NO: 1946164 - protein, 7 aa, Staphylococcus
GQRINAG

SEQ ID NO: 1946165 - protein, 12 aa, Staphylococcus
GQRKHKQYSDGI

SEQ ID NO: 1946166 - protein, 6 aa, Staphylococcus
GQRQPR

SEQ ID NO: 1946167 - protein, 9 aa, Staphylococcus
GQRTDITAD

SEQ ID NO: 1946168 - protein, 9 aa, Staphylococcus
GQRTDITAE

SEQ ID NO: 1946169 - protein, 9 aa, Staphylococcus
GQRTDITSE

SEQ ID NO: 1946170 - protein, 10 aa, Staphylococcus
GQRTDLTSEQ

SEQ ID NO: 1946171 - protein, 14 aa, Staphylococcus
GQRYDRSASAAELK

SEQ ID NO: 1946172 - protein, 8 aa, Staphylococcus
GQRYNRET

SEQ ID NO: 1946173 - protein, 13 aa, Staphylococcus
GQSANTDRPGEHL

SEQ ID NO: 1946174 - protein, 9 aa, Staphylococcus
GQSDENEMR

SEQ ID NO: 1946175 - protein, 6 aa, Staphylococcus
GQSEFE

SEQ ID NO: 1946176 - protein, 7 aa, Staphylococcus
GQSEKNM

SEQ ID NO: 1946177 - protein, 4 aa, Staphylococcus
GQSG

SEQ ID NO: 1946178 - protein, 7 aa, Staphylococcus
GQSGYDI

SEQ ID NO: 1946179 - protein, 5 aa, Staphylococcus
GQSKD

SEQ ID NO: 1946180 - protein, 12 aa, Staphylococcus
GQSLGKEERVNV

SEQ ID NO: 1946181 - protein, 5 aa, Staphylococcus
GQSLN

SEQ ID NO: 1946182 - protein, 8 aa, Staphylococcus
GQSLSKER

SEQ ID NO: 1946183 - protein, 4 aa, Staphylococcus
GQSM

SEQ ID NO: 1946184 - protein, 6 aa, Staphylococcus
GQSNHT

SEQ ID NO: 1946185 - protein, 8 aa, Staphylococcus
GQSNPERV

SEQ ID NO: 1946186 - protein, 9 aa, Staphylococcus
GQSPELGKI

SEQ ID NO: 1946187 - protein, 5 aa, Staphylococcus
GQSPR

SEQ ID NO: 1946188 - protein, 8 aa, Staphylococcus
GQSPRLAE

SEQ ID NO: 1946189 - protein, 8 aa, Staphylococcus
GQSPTLSK

SEQ ID NO: 1946190 - protein, 9 aa, Staphylococcus
GQSQELSRI

SEQ ID NO: 1946191 - protein, 7 aa, Staphylococcus
GQSQKYN

SEQ ID NO: 1946192 - protein, 11 aa, Staphylococcus
GQSQTGTGKSH

SEQ ID NO: 1946193 - protein, 10 aa, Staphylococcus
GQSQTGTGKT

SEQ ID NO: 1946194 - protein, 13 aa, Staphylococcus
GQSREMKQKQRYS

SEQ ID NO: 1946195 - protein, 7 aa, Staphylococcus
GQSSIKN

SEQ ID NO: 1946196 - protein, 7 aa, Staphylococcus
GQSSKSL

SEQ ID NO: 1946197 - protein, 7 aa, Staphylococcus
GQSSSAI

SEQ ID NO: 1946198 - protein, 7 aa, Staphylococcus
GQSTIKS

SEQ ID NO: 1946199 - protein, 9 aa, Staphylococcus
GQSVARGEV

SEQ ID NO: 1946200 - protein, 8 aa, Staphylococcus
GQSVSPES

SEQ ID NO: 1946201 - protein, 15 aa, Staphylococcus
GQSYPLEGVEEPSEV

SEQ ID NO: 1946202 - protein, 5 aa, Staphylococcus
GQSYS

SEQ ID NO: 1946203 - protein, 6 aa, Staphylococcus
GQTAAT

SEQ ID NO: 1946204 - protein, 10 aa, Staphylococcus
GQTAEKQINA

SEQ ID NO: 1946205 - protein, 13 aa, Staphylococcus
GQTANDFNTPVIR

SEQ ID NO: 1946206 - protein, 25 aa, Staphylococcus
GQTAYHKNGLNNNDPHTTPKEQGGF

SEQ ID NO: 1946207 - protein, 7 aa, Staphylococcus
GQTDDID

SEQ ID NO: 1946208 - protein, 9 aa, Staphylococcus
GQTDENEMR

SEQ ID NO: 1946209 - protein, 18 aa, Staphylococcus
GQTDSTALGTKAFQETDI

SEQ ID NO: 1946210 - protein, 11 aa, Staphylococcus
GQTEDGDGNRG

SEQ ID NO: 1946211 - protein, 7 aa, Staphylococcus
GQTEEGT

SEQ ID NO: 1946212 - protein, 7 aa, Staphylococcus
GQTEEQV

SEQ ID NO: 1946213 - protein, 14 aa, Staphylococcus
GQTEKNTKQAVEQA

SEQ ID NO: 1946214 - protein, 6 aa, Staphylococcus
GQTETG

SEQ ID NO: 1946215 - protein, 9 aa, Staphylococcus
GQTGINPPV

SEQ ID NO: 1946216 - protein, 12 aa, Staphylococcus
GQTGNLTPADKK

SEQ ID NO: 1946217 - protein, 4 aa, Staphylococcus
GQTH

SEQ ID NO: 1946218 - protein, 13 aa, Staphylococcus
GQTIERGNKLDEG

SEQ ID NO: 1946219 - protein, 18 aa, Staphylococcus
GQTKEEALAKKKRLDAQL

SEQ ID NO: 1946220 - protein, 6 aa, Staphylococcus
GQTKVD

SEQ ID NO: 1946221 - protein, 7 aa, Staphylococcus
GQTLGRL

SEQ ID NO: 1946222 - protein, 5 aa, Staphylococcus
GQTLN

SEQ ID NO: 1946223 - protein, 6 aa, Staphylococcus
GQTLPD

SEQ ID NO: 1946224 - protein, 7 aa, Staphylococcus
GQTLSDI

SEQ ID NO: 1946225 - protein, 8 aa, Staphylococcus
GQTLSEIT

SEQ ID NO: 1946226 - protein, 9 aa, Staphylococcus
GQTNDSLLG

SEQ ID NO: 1946227 - protein, 9 aa, Staphylococcus
GQTNSSLLG

SEQ ID NO: 1946228 - protein, 7 aa, Staphylococcus
GQTNSTL

SEQ ID NO: 1946229 - protein, 8 aa, Staphylococcus
GQTNSTLL

SEQ ID NO: 1946230 - protein, 4 aa, Staphylococcus
GQTP

SEQ ID NO: 1946231 - protein, 14 aa, Staphylococcus
GQTPRLATNRKASK

SEQ ID NO: 1946232 - protein, 16 aa, Staphylococcus
GQTPVAKALTICQMLE

SEQ ID NO: 1946233 - protein, 8 aa, Staphylococcus
GQTPVEET

SEQ ID NO: 1946234 - protein, 6 aa, Staphylococcus
GQTQRF

SEQ ID NO: 1946235 - protein, 7 aa, Staphylococcus
GQTQTDF

SEQ ID NO: 1946236 - protein, 14 aa, Staphylococcus
GQTQYNQQSQMASD

SEQ ID NO: 1946237 - protein, 7 aa, Staphylococcus
GQTSIKS

SEQ ID NO: 1946238 - protein, 6 aa, Staphylococcus
GQTTIK

SEQ ID NO: 1946239 - protein, 18 aa, Staphylococcus
GQTTQSELAQSLGKSQSF

SEQ ID NO: 1946240 - protein, 4 aa, Staphylococcus
GQTV

SEQ ID NO: 1946241 - protein, 6 aa, Staphylococcus
GQVAER

SEQ ID NO: 1946242 - protein, 12 aa, Staphylococcus
GQVANNDDPSDI

SEQ ID NO: 1946243 - protein, 9 aa, Staphylococcus
GQVEENDNI

SEQ ID NO: 1946244 - protein, 7 aa, Staphylococcus
GQVHEGA

SEQ ID NO: 1946245 - protein, 10 aa, Staphylococcus
GQVKEEGLKQ

SEQ ID NO: 1946246 - protein, 10 aa, Staphylococcus
GQVPGQPSNM

SEQ ID NO: 1946247 - protein, 18 aa, Staphylococcus
GQVSIDTGAKGPNGSTVT

SEQ ID NO: 1946248 - protein, 12 aa, Staphylococcus
GQVSNQKLEELN

SEQ ID NO: 1946249 - protein, 6 aa, Staphylococcus
GQVTES

SEQ ID NO: 1946250 - protein, 21 aa, Staphylococcus
GQVTKRDPETINPKIKTGQVE

SEQ ID NO: 1946251 - protein, 10 aa, Staphylococcus
GQVTQNREQV

SEQ ID NO: 1946252 - protein, 6 aa, Staphylococcus
GQYAPD

SEQ ID NO: 1946253 - protein, 10 aa, Staphylococcus
GQYGANKQHT

SEQ ID NO: 1946254 - protein, 12 aa, Staphylococcus
GQYGDVEKVEAA

SEQ ID NO: 1946255 - protein, 10 aa, Staphylococcus
GQYGEGTIND

SEQ ID NO: 1946256 - protein, 32 aa, Staphylococcus
GQYGEGYIDNKPVKAYRDEDRVANDSNTPTFV

SEQ ID NO: 1946257 - protein, 7 aa, Staphylococcus
GQYGGNI

SEQ ID NO: 1946258 - protein, 10 aa, Staphylococcus
GQYGGNLTGT

SEQ ID NO: 1946259 - protein, 32 aa, Staphylococcus
GQYGKGTIEGKEVKSYREEDRVAEDSNTPTFV

SEQ ID NO: 1946260 - protein, 14 aa, Staphylococcus
GQYGRKNGNGSGKI

SEQ ID NO: 1946261 - protein, 7 aa, Staphylococcus
GQYGTNI

SEQ ID NO: 1946262 - protein, 6 aa, Staphylococcus
GQYIPN

SEQ ID NO: 1946263 - protein, 13 aa, Staphylococcus
GQYKSGDRFPSKR

SEQ ID NO: 1946264 - protein, 16 aa, Staphylococcus
GQYQAQDKFPSKRQLS

SEQ ID NO: 1946265 - protein, 13 aa, Staphylococcus
GQYQSGDKFPSKR

SEQ ID NO: 1946266 - protein, 8 aa, Staphylococcus
GQYRDKPM

SEQ ID NO: 1946267 - protein, 6 aa, Staphylococcus
GQYSEI

SEQ ID NO: 1946268 - protein, 10 aa, Staphylococcus
GQYSGDENNQ

SEQ ID NO: 1946269 - protein, 22 aa, Staphylococcus
GQYSQSKVYEYKSKDGQRSNTY

SEQ ID NO: 1946270 - protein, 17 aa, Staphylococcus
GQYTTVDDEQLNPYLDG

SEQ ID NO: 1946271 - protein, 7 aa, Staphylococcus
GRAADTP

SEQ ID NO: 1946272 - protein, 4 aa, Staphylococcus
GRAE

SEQ ID NO: 1946273 - protein, 8 aa, Staphylococcus
GRAEITDS

SEQ ID NO: 1946274 - protein, 14 aa, Staphylococcus
GRAEYPSASDDEAM

SEQ ID NO: 1946275 - protein, 11 aa, Staphylococcus
GRAGRDGAYSQ

SEQ ID NO: 1946276 - protein, 12 aa, Staphylococcus
GRAGRDGEASQA

SEQ ID NO: 1946277 - protein, 12 aa, Staphylococcus
GRAGRDGGQSQA

SEQ ID NO: 1946278 - protein, 13 aa, Staphylococcus
GRAGRDGKPSQAI

SEQ ID NO: 1946279 - protein, 13 aa, Staphylococcus
GRAGRDGKQSQAI

SEQ ID NO: 1946280 - protein, 11 aa, Staphylococcus
GRAGRDNLQSQ

SEQ ID NO: 1946281 - protein, 12 aa, Staphylococcus
GRAGRDQQPSQA

SEQ ID NO: 1946282 - protein, 10 aa, Staphylococcus
GRAPKEKQSI

SEQ ID NO: 1946283 - protein, 10 aa, Staphylococcus
GRAPKEKQSV

SEQ ID NO: 1946284 - protein, 10 aa, Staphylococcus
GRAPKEQQSV

SEQ ID NO: 1946285 - protein, 9 aa, Staphylococcus
GRATPLTYA

SEQ ID NO: 1946286 - protein, 5 aa, Staphylococcus
GRAVA

SEQ ID NO: 1946287 - protein, 6 aa, Staphylococcus
GRAVAD

SEQ ID NO: 1946288 - protein, 17 aa, Staphylococcus
GRAVAKSVDQYLKQKVL

SEQ ID NO: 1946289 - protein, 6 aa, Staphylococcus
GRAVAQ

SEQ ID NO: 1946290 - protein, 6 aa, Staphylococcus
GRAVAR

SEQ ID NO: 1946291 - protein, 10 aa, Staphylococcus
GRDARADING

SEQ ID NO: 1946292 - protein, 10 aa, Staphylococcus
GRDDTERVKT

SEQ ID NO: 1946293 - protein, 9 aa, Staphylococcus
GRDEDNQKA

SEQ ID NO: 1946294 - protein, 5 aa, Staphylococcus
GRDEG

SEQ ID NO: 1946295 - protein, 5 aa, Staphylococcus
GRDFD

SEQ ID NO: 1946296 - protein, 14 aa, Staphylococcus
GRDFGEENIVGPND

SEQ ID NO: 1946297 - protein, 7 aa, Staphylococcus
GRDGYEH

SEQ ID NO: 1946298 - protein, 8 aa, Staphylococcus
GRDITDDI

SEQ ID NO: 1946299 - protein, 23 aa, Staphylococcus
GRDITDDVAQGLNTSYDTAEKIK

SEQ ID NO: 1946300 - protein, 9 aa, Staphylococcus
GRDKKYTLE

SEQ ID NO: 1946301 - protein, 9 aa, Staphylococcus
GRDKQTYAG

SEQ ID NO: 1946302 - protein, 7 aa, Staphylococcus
GRDKSQM

SEQ ID NO: 1946303 - protein, 5 aa, Staphylococcus
GRDKV

SEQ ID NO: 1946304 - protein, 5 aa, Staphylococcus
GRDLP

SEQ ID NO: 1946305 - protein, 5 aa, Staphylococcus
GRDQG

SEQ ID NO: 1946306 - protein, 10 aa, Staphylococcus
GREGAKTPSQ

SEQ ID NO: 1946307 - protein, 10 aa, Staphylococcus
GREGEKTPSQ

SEQ ID NO: 1946308 - protein, 8 aa, Staphylococcus
GREGRNIR

SEQ ID NO: 1946309 - protein, 19 aa, Staphylococcus
GREHAYPSELSGGQKQRVG

SEQ ID NO: 1946310 - protein, 4 aa, Staphylococcus
GREI

SEQ ID NO: 1946311 - protein, 9 aa, Staphylococcus
GREKDGDWQ

SEQ ID NO: 1946312 - protein, 11 aa, Staphylococcus
GREKDQNGTAW

SEQ ID NO: 1946313 - protein, 8 aa, Staphylococcus
GREKGKYR

SEQ ID NO: 1946314 - protein, 5 aa, Staphylococcus
GRELT

SEQ ID NO: 1946315 - protein, 18 aa, Staphylococcus
GRENAYPSELSGGQKQRV

SEQ ID NO: 1946316 - protein, 11 aa, Staphylococcus
GRENKRGEQTS

SEQ ID NO: 1946317 - protein, 12 aa, Staphylococcus
GRENVEQAYENS

SEQ ID NO: 1946318 - protein, 6 aa, Staphylococcus
GREPLL

SEQ ID NO: 1946319 - protein, 8 aa, Staphylococcus
GREPLTSE

SEQ ID NO: 1946320 - protein, 5 aa, Staphylococcus
GREQT

SEQ ID NO: 1946321 - protein, 7 aa, Staphylococcus
GREQTER

SEQ ID NO: 1946322 - protein, 7 aa, Staphylococcus
GRESGSE

SEQ ID NO: 1946323 - protein, 13 aa, Staphylococcus
GRESRFSETPISE

SEQ ID NO: 1946324 - protein, 6 aa, Staphylococcus
GRETPL

SEQ ID NO: 1946325 - protein, 7 aa, Staphylococcus
GRETSLT

SEQ ID NO: 1946326 - protein, 6 aa, Staphylococcus
GRFAAP

SEQ ID NO: 1946327 - protein, 4 aa, Staphylococcus
GRFN

SEQ ID NO: 1946328 - protein, 10 aa, Staphylococcus
GRFSDTSRDG

SEQ ID NO: 1946329 - protein, 9 aa, Staphylococcus
GRFSDTSRE

SEQ ID NO: 1946330 - protein, 9 aa, Staphylococcus
GRFSETSRD

SEQ ID NO: 1946331 - protein, 8 aa, Staphylococcus
GRFSGGSH

SEQ ID NO: 1946332 - protein, 5 aa, Staphylococcus
GRFSN

SEQ ID NO: 1946333 - protein, 6 aa, Staphylococcus
GRFSPE

SEQ ID NO: 1946334 - protein, 10 aa, Staphylococcus
GRGAADMKSG

SEQ ID NO: 1946335 - protein, 20 aa, Staphylococcus
GRGDFKGKTEGEVKSIEKHS

SEQ ID NO: 1946336 - protein, 6 aa, Staphylococcus
GRGFPG

SEQ ID NO: 1946337 - protein, 12 aa, Staphylococcus
GRGGHSSMPEKA

SEQ ID NO: 1946338 - protein, 6 aa, Staphylococcus
GRGPII

SEQ ID NO: 1946339 - protein, 8 aa, Staphylococcus
GRGPSDKE

SEQ ID NO: 1946340 - protein, 12 aa, Staphylococcus
GRGPSDKEVDHI

SEQ ID NO: 1946341 - protein, 12 aa, Staphylococcus
GRGPSDKEVEHI

SEQ ID NO: 1946342 - protein, 9 aa, Staphylococcus
GRGPSNKEV

SEQ ID NO: 1946343 - protein, 4 aa, Staphylococcus
GRGR

SEQ ID NO: 1946344 - protein, 9 aa, Staphylococcus
GRGRNRRKI

SEQ ID NO: 1946345 - protein, 20 aa, Staphylococcus
GRGTESDEKIQKRVSEARKE

SEQ ID NO: 1946346 - protein, 20 aa, Staphylococcus
GRGTESDEKIQSRVAEARKE

SEQ ID NO: 1946347 - protein, 20 aa, Staphylococcus
GRGTESDEKIQSRVKEARKE

SEQ ID NO: 1946348 - protein, 20 aa, Staphylococcus
GRGTESSEKIQSRVHEARKE

SEQ ID NO: 1946349 - protein, 20 aa, Staphylococcus
GRGTETDEKIQSRVNEARKE

SEQ ID NO: 1946350 - protein, 5 aa, Staphylococcus
GRGTF

SEQ ID NO: 1946351 - protein, 8 aa, Staphylococcus
GRGTSTFD

SEQ ID NO: 1946352 - protein, 7 aa, Staphylococcus
GRGVQAK

SEQ ID NO: 1946353 - protein, 6 aa, Staphylococcus
GRGYKL

SEQ ID NO: 1946354 - protein, 5 aa, Staphylococcus
GRHAG

SEQ ID NO: 1946355 - protein, 9 aa, Staphylococcus
GRHGGYEIQ

SEQ ID NO: 1946356 - protein, 7 aa, Staphylococcus
GRHKTSR

SEQ ID NO: 1946357 - protein, 7 aa, Staphylococcus
GRHPSFR

SEQ ID NO: 1946358 - protein, 4 aa, Staphylococcus
GRHT

SEQ ID NO: 1946359 - protein, 10 aa, Staphylococcus
GRIADTPEDA

SEQ ID NO: 1946360 - protein, 4 aa, Staphylococcus
GRIG

SEQ ID NO: 1946361 - protein, 8 aa, Staphylococcus
GRIGGRRN

SEQ ID NO: 1946362 - protein, 5 aa, Staphylococcus
GRIHP

SEQ ID NO: 1946363 - protein, 7 aa, Staphylococcus
GRIKGAA

SEQ ID NO: 1946364 - protein, 5 aa, Staphylococcus
GRIKK

SEQ ID NO: 1946365 - protein, 9 aa, Staphylococcus
GRIPETHKE

SEQ ID NO: 1946366 - protein, 8 aa, Staphylococcus
GRIPNTDL

SEQ ID NO: 1946367 - protein, 12 aa, Staphylococcus
GRIQDGEKIKYT

SEQ ID NO: 1946368 - protein, 12 aa, Staphylococcus
GRIQSGEDIKYT

SEQ ID NO: 1946369 - protein, 7 aa, Staphylococcus
GRIRQRP

SEQ ID NO: 1946370 - protein, 14 aa, Staphylococcus
GRITEYKGNYSNYV

SEQ ID NO: 1946371 - protein, 11 aa, Staphylococcus
GRITGAGTDTI

SEQ ID NO: 1946372 - protein, 4 aa, Staphylococcus
GRIV

SEQ ID NO: 1946373 - protein, 4 aa, Staphylococcus
GRKA

SEQ ID NO: 1946374 - protein, 9 aa, Staphylococcus
GRKAKMSEL

SEQ ID NO: 1946375 - protein, 11 aa, Staphylococcus
GRKDDKGELAE

SEQ ID NO: 1946376 - protein, 11 aa, Staphylococcus
GRKDGKPGLDI

SEQ ID NO: 1946377 - protein, 5 aa, Staphylococcus
GRKDT

SEQ ID NO: 1946378 - protein, 6 aa, Staphylococcus
GRKEEH

SEQ ID NO: 1946379 - protein, 15 aa, Staphylococcus
GRKEHQLTPEEQETF

SEQ ID NO: 1946380 - protein, 15 aa, Staphylococcus
GRKEHQLTQEERDTF

SEQ ID NO: 1946381 - protein, 13 aa, Staphylococcus
GRKFTDEKEINDH

SEQ ID NO: 1946382 - protein, 4 aa, Staphylococcus
GRKG

SEQ ID NO: 1946383 - protein, 7 aa, Staphylococcus
GRKGCSS

SEQ ID NO: 1946384 - protein, 7 aa, Staphylococcus
GRKGFSS

SEQ ID NO: 1946385 - protein, 12 aa, Staphylococcus
GRKGGEGNSKYE

SEQ ID NO: 1946386 - protein, 10 aa, Staphylococcus
GRKGGKQGLD

SEQ ID NO: 1946387 - protein, 10 aa, Staphylococcus
GRKGGNQGLE

SEQ ID NO: 1946388 - protein, 8 aa, Staphylococcus
GRKGYEHD

SEQ ID NO: 1946389 - protein, 8 aa, Staphylococcus
GRKIEEPN

SEQ ID NO: 1946390 - protein, 8 aa, Staphylococcus
GRKIEEPT

SEQ ID NO: 1946391 - protein, 10 aa, Staphylococcus
GRKKLEAQNI

SEQ ID NO: 1946392 - protein, 10 aa, Staphylococcus
GRKNGNQGLE

SEQ ID NO: 1946393 - protein, 10 aa, Staphylococcus
GRKNGNQGLT

SEQ ID NO: 1946394 - protein, 13 aa, Staphylococcus
GRKNVADAYQTSL

SEQ ID NO: 1946395 - protein, 12 aa, Staphylococcus
GRKNVETAYETS

SEQ ID NO: 1946396 - protein, 4 aa, Staphylococcus
GRKP

SEQ ID NO: 1946397 - protein, 8 aa, Staphylococcus
GRKPFIED

SEQ ID NO: 1946398 - protein, 11 aa, Staphylococcus
GRKPNTDDIGL

SEQ ID NO: 1946399 - protein, 14 aa, Staphylococcus
GRKPNTDGLGLENT

SEQ ID NO: 1946400 - protein, 13 aa, Staphylococcus
GRKPNTEDIGLNN

SEQ ID NO: 1946401 - protein, 8 aa, Staphylococcus
GRKPNTQV

SEQ ID NO: 1946402 - protein, 23 aa, Staphylococcus
GRKPNTSDIGLQNTKVKTTQSGH

SEQ ID NO: 1946403 - protein, 13 aa, Staphylococcus
GRKPQDIVEILNN

SEQ ID NO: 1946404 - protein, 4 aa, Staphylococcus
GRKQ

SEQ ID NO: 1946405 - protein, 13 aa, Staphylococcus
GRKRSTQAAAGVE

SEQ ID NO: 1946406 - protein, 14 aa, Staphylococcus
GRKRSTQAAAGVES

SEQ ID NO: 1946407 - protein, 9 aa, Staphylococcus
GRKSGKQGL

SEQ ID NO: 1946408 - protein, 22 aa, Staphylococcus
GRKTIDADDPLYTTRVQDGKHP

SEQ ID NO: 1946409 - protein, 12 aa, Staphylococcus
GRKTVEADDPLY

SEQ ID NO: 1946410 - protein, 6 aa, Staphylococcus
GRLEDA

SEQ ID NO: 1946411 - protein, 5 aa, Staphylococcus
GRLNP

SEQ ID NO: 1946412 - protein, 6 aa, Staphylococcus
GRLPEA

SEQ ID NO: 1946413 - protein, 7 aa, Staphylococcus
GRLPGGI

SEQ ID NO: 1946414 - protein, 7 aa, Staphylococcus
GRLPGGV

SEQ ID NO: 1946415 - protein, 7 aa, Staphylococcus
GRLPQGK

SEQ ID NO: 1946416 - protein, 6 aa, Staphylococcus
GRLQDA

SEQ ID NO: 1946417 - protein, 7 aa, Staphylococcus
GRLQNKS

SEQ ID NO: 1946418 - protein, 11 aa, Staphylococcus
GRLRSEDHYSK

SEQ ID NO: 1946419 - protein, 4 aa, Staphylococcus
GRLS

SEQ ID NO: 1946420 - protein, 11 aa, Staphylococcus
GRLSAEDKEEI

SEQ ID NO: 1946421 - protein, 18 aa, Staphylococcus
GRLSAKEVLGNKKALTEF

SEQ ID NO: 1946422 - protein, 11 aa, Staphylococcus
GRLSDEDKKEI

SEQ ID NO: 1946423 - protein, 8 aa, Staphylococcus
GRLSPEKG

SEQ ID NO: 1946424 - protein, 12 aa, Staphylococcus
GRLTDSKGREVD

SEQ ID NO: 1946425 - protein, 18 aa, Staphylococcus
GRLTETGAKLVDPNGELQ

SEQ ID NO: 1946426 - protein, 6 aa, Staphylococcus
GRMNET

SEQ ID NO: 1946427 - protein, 6 aa, Staphylococcus
GRMSTQ

SEQ ID NO: 1946428 - protein, 10 aa, Staphylococcus
GRNAEFEGER

SEQ ID NO: 1946429 - protein, 7 aa, Staphylococcus
GRNGHKK

SEQ ID NO: 1946430 - protein, 6 aa, Staphylococcus
GRNGKS

SEQ ID NO: 1946431 - protein, 6 aa, Staphylococcus
GRNGLH

SEQ ID NO: 1946432 - protein, 25 aa, Staphylococcus
GRNLPAQLRETGLGGLAGTPTGEAI

SEQ ID NO: 1946433 - protein, 25 aa, Staphylococcus
GRNLPASLRETGLGGLAGTPTGEEI

SEQ ID NO: 1946434 - protein, 25 aa, Staphylococcus
GRNLPASLRETGLGGLAGTSTGEAI

SEQ ID NO: 1946435 - protein, 8 aa, Staphylococcus
GRNNEGGD

SEQ ID NO: 1946436 - protein, 11 aa, Staphylococcus
GRNNVAQAYET

SEQ ID NO: 1946437 - protein, 11 aa, Staphylococcus
GRNPENSPDFG

SEQ ID NO: 1946438 - protein, 8 aa, Staphylococcus
GRNPKYNF

SEQ ID NO: 1946439 - protein, 15 aa, Staphylococcus
GRNPKYNFERDEKFE

SEQ ID NO: 1946440 - protein, 14 aa, Staphylococcus
GRNPKYNFEREEKF

SEQ ID NO: 1946441 - protein, 7 aa, Staphylococcus
GRNRDTT

SEQ ID NO: 1946442 - protein, 8 aa, Staphylococcus
GRNTDKLN

SEQ ID NO: 1946443 - protein, 8 aa, Staphylococcus
GRNTEGGQ

SEQ ID NO: 1946444 - protein, 10 aa, Staphylococcus
GRNTQNKEYK

SEQ ID NO: 1946445 - protein, 5 aa, Staphylococcus
GRPAC

SEQ ID NO: 1946446 - protein, 5 aa, Staphylococcus
GRPAL

SEQ ID NO: 1946447 - protein, 6 aa, Staphylococcus
GRPFSQ

SEQ ID NO: 1946448 - protein, 6 aa, Staphylococcus
GRPFTQ

SEQ ID NO: 1946449 - protein, 5 aa, Staphylococcus
GRPFY

SEQ ID NO: 1946450 - protein, 14 aa, Staphylococcus
GRPGLVTKEDVKEG

SEQ ID NO: 1946451 - protein, 7 aa, Staphylococcus
GRPITER

SEQ ID NO: 1946452 - protein, 4 aa, Staphylococcus
GRPL

SEQ ID NO: 1946453 - protein, 5 aa, Staphylococcus
GRPLS

SEQ ID NO: 1946454 - protein, 4 aa, Staphylococcus
GRPN

SEQ ID NO: 1946455 - protein, 8 aa, Staphylococcus
GRPQEGET

SEQ ID NO: 1946456 - protein, 11 aa, Staphylococcus
GRPSTYAPTLD

SEQ ID NO: 1946457 - protein, 9 aa, Staphylococcus
GRPTSGMSV

SEQ ID NO: 1946458 - protein, 7 aa, Staphylococcus
GRPYATN

SEQ ID NO: 1946459 - protein, 6 aa, Staphylococcus
GRQGYE

SEQ ID NO: 1946460 - protein, 7 aa, Staphylococcus
GRQGYEH

SEQ ID NO: 1946461 - protein, 4 aa, Staphylococcus
GRQH

SEQ ID NO: 1946462 - protein, 8 aa, Staphylococcus
GRQPGLRE

SEQ ID NO: 1946463 - protein, 10 aa, Staphylococcus
GRQTKDDKID

SEQ ID NO: 1946464 - protein, 9 aa, Staphylococcus
GRQTKEDDI

SEQ ID NO: 1946465 - protein, 10 aa, Staphylococcus
GRQTKEDDID

SEQ ID NO: 1946466 - protein, 9 aa, Staphylococcus
GRQTKEDEI

SEQ ID NO: 1946467 - protein, 10 aa, Staphylococcus
GRQTKEDEID

SEQ ID NO: 1946468 - protein, 7 aa, Staphylococcus
GRRGVSS

SEQ ID NO: 1946469 - protein, 7 aa, Staphylococcus
GRRGYEH

SEQ ID NO: 1946470 - protein, 7 aa, Staphylococcus
GRRMSAS

SEQ ID NO: 1946471 - protein, 7 aa, Staphylococcus
GRRPNLQ

SEQ ID NO: 1946472 - protein, 10 aa, Staphylococcus
GRRPNTDELG

SEQ ID NO: 1946473 - protein, 4 aa, Staphylococcus
GRRT

SEQ ID NO: 1946474 - protein, 8 aa, Staphylococcus
GRSATDAI

SEQ ID NO: 1946475 - protein, 8 aa, Staphylococcus
GRSDVDKN

SEQ ID NO: 1946476 - protein, 5 aa, Staphylococcus
GRSDY

SEQ ID NO: 1946477 - protein, 39 aa, Staphylococcus
GRSEEGGLHSDIQDNTETHESKEEQEEHQQRKHRLSSKE

SEQ ID NO: 1946478 - protein, 6 aa, Staphylococcus
GRSEEH

SEQ ID NO: 1946479 - protein, 7 aa, Staphylococcus
GRSEGAK

SEQ ID NO: 1946480 - protein, 8 aa, Staphylococcus
GRSEGAKV

SEQ ID NO: 1946481 - protein, 8 aa, Staphylococcus
GRSEGASV

SEQ ID NO: 1946482 - protein, 8 aa, Staphylococcus
GRSGQGVG

SEQ ID NO: 1946483 - protein, 6 aa, Staphylococcus
GRSHQC

SEQ ID NO: 1946484 - protein, 8 aa, Staphylococcus
GRSKSYPN

SEQ ID NO: 1946485 - protein, 4 aa, Staphylococcus
GRSN

SEQ ID NO: 1946486 - protein, 9 aa, Staphylococcus
GRSNVGKST

SEQ ID NO: 1946487 - protein, 11 aa, Staphylococcus
GRSPRYEYNRN

SEQ ID NO: 1946488 - protein, 9 aa, Staphylococcus
GRSPSFKNV

SEQ ID NO: 1946489 - protein, 8 aa, Staphylococcus
GRSPSFKQ

SEQ ID NO: 1946490 - protein, 12 aa, Staphylococcus
GRSQGKNPTYYN

SEQ ID NO: 1946491 - protein, 8 aa, Staphylococcus
GRSQPEYR

SEQ ID NO: 1946492 - protein, 9 aa, Staphylococcus
GRSQPEYRR

SEQ ID NO: 1946493 - protein, 7 aa, Staphylococcus
GRSSETP

SEQ ID NO: 1946494 - protein, 8 aa, Staphylococcus
GRSTRNSL

SEQ ID NO: 1946495 - protein, 9 aa, Staphylococcus
GRSTRSPLG

SEQ ID NO: 1946496 - protein, 8 aa, Staphylococcus
GRSTRSSL

SEQ ID NO: 1946497 - protein, 9 aa, Staphylococcus
GRSTRSSLG

SEQ ID NO: 1946498 - protein, 8 aa, Staphylococcus
GRSTRSTL

SEQ ID NO: 1946499 - protein, 7 aa, Staphylococcus
GRSYQDI

SEQ ID NO: 1946500 - protein, 16 aa, Staphylococcus
GRTATNIEKYTSQGSL

SEQ ID NO: 1946501 - protein, 7 aa, Staphylococcus
GRTATQT

SEQ ID NO: 1946502 - protein, 8 aa, Staphylococcus
GRTDDEPV

SEQ ID NO: 1946503 - protein, 6 aa, Staphylococcus
GRTEDG

SEQ ID NO: 1946504 - protein, 5 aa, Staphylococcus
GRTEE

SEQ ID NO: 1946505 - protein, 6 aa, Staphylococcus
GRTEEI

SEQ ID NO: 1946506 - protein, 5 aa, Staphylococcus
GRTET

SEQ ID NO: 1946507 - protein, 5 aa, Staphylococcus
GRTFD

SEQ ID NO: 1946508 - protein, 8 aa, Staphylococcus
GRTFTADK

SEQ ID NO: 1946509 - protein, 11 aa, Staphylococcus
GRTGRAGKKGI

SEQ ID NO: 1946510 - protein, 11 aa, Staphylococcus
GRTGRAGKKGV

SEQ ID NO: 1946511 - protein, 9 aa, Staphylococcus
GRTGRGNYK

SEQ ID NO: 1946512 - protein, 9 aa, Staphylococcus
GRTGRGQYK

SEQ ID NO: 1946513 - protein, 11 aa, Staphylococcus
GRTGRGQYKGE

SEQ ID NO: 1946514 - protein, 11 aa, Staphylococcus
GRTGRKIQDTK

SEQ ID NO: 1946515 - protein, 10 aa, Staphylococcus
GRTLQAGDTI

SEQ ID NO: 1946516 - protein, 7 aa, Staphylococcus
GRTNEGE

SEQ ID NO: 1946517 - protein, 11 aa, Staphylococcus
GRTPNTQDIGL

SEQ ID NO: 1946518 - protein, 9 aa, Staphylococcus
GRTRDVRDK

SEQ ID NO: 1946519 - protein, 7 aa, Staphylococcus
GRTSPVP

SEQ ID NO: 1946520 - protein, 5 aa, Staphylococcus
GRTTI

SEQ ID NO: 1946521 - protein, 19 aa, Staphylococcus
GRTYNNQEPKYLNSPETPI

SEQ ID NO: 1946522 - protein, 5 aa, Staphylococcus
GRVDP

SEQ ID NO: 1946523 - protein, 6 aa, Staphylococcus
GRVDPI

SEQ ID NO: 1946524 - protein, 9 aa, Staphylococcus
GRVEKINDN

SEQ ID NO: 1946525 - protein, 5 aa, Staphylococcus
GRVGA

SEQ ID NO: 1946526 - protein, 12 aa, Staphylococcus
GRVGDKVEEEEI

SEQ ID NO: 1946527 - protein, 9 aa, Staphylococcus
GRVGRSEHQ

SEQ ID NO: 1946528 - protein, 10 aa, Staphylococcus
GRVKDTEDYK

SEQ ID NO: 1946529 - protein, 7 aa, Staphylococcus
GRVPNTD

SEQ ID NO: 1946530 - protein, 12 aa, Staphylococcus
GRVQSGEKFKYT

SEQ ID NO: 1946531 - protein, 12 aa, Staphylococcus
GRVQSGEKIKYT

SEQ ID NO: 1946532 - protein, 8 aa, Staphylococcus
GRVSAGNL

SEQ ID NO: 1946533 - protein, 12 aa, Staphylococcus
GRVSGMNAGIYQ

SEQ ID NO: 1946534 - protein, 11 aa, Staphylococcus
GRWAKQRKLPR

SEQ ID NO: 1946535 - protein, 11 aa, Staphylococcus
GRWAKQRKMPR

SEQ ID NO: 1946536 - protein, 4 aa, Staphylococcus
GRYE

SEQ ID NO: 1946537 - protein, 8 aa, Staphylococcus
GRYGGRIS

SEQ ID NO: 1946538 - protein, 8 aa, Staphylococcus
GRYKTNKK

SEQ ID NO: 1946539 - protein, 5 aa, Staphylococcus
GRYNS

SEQ ID NO: 1946540 - protein, 11 aa, Staphylococcus
GRYRRKERQTF

SEQ ID NO: 1946541 - protein, 9 aa, Staphylococcus
GRYSGRIEA

SEQ ID NO: 1946542 - protein, 14 aa, Staphylococcus
GRYSKETIRNPETD

SEQ ID NO: 1946543 - protein, 14 aa, Staphylococcus
GRYSKETVRHPETD

SEQ ID NO: 1946544 - protein, 10 aa, Staphylococcus
GSAARGNVTP

SEQ ID NO: 1946545 - protein, 7 aa, Staphylococcus
GSAAVNA

SEQ ID NO: 1946546 - protein, 13 aa, Staphylococcus
GSACTAGSTTPSH

SEQ ID NO: 1946547 - protein, 5 aa, Staphylococcus
GSADE

SEQ ID NO: 1946548 - protein, 23 aa, Staphylococcus
GSADVMKKTNSVPAGRYGQPEEI

SEQ ID NO: 1946549 - protein, 20 aa, Staphylococcus
GSAESDAFKGKISNESPMAK

SEQ ID NO: 1946550 - protein, 10 aa, Staphylococcus
GSAGALDDSL

SEQ ID NO: 1946551 - protein, 9 aa, Staphylococcus
GSAGALDES

SEQ ID NO: 1946552 - protein, 6 aa, Staphylococcus
GSAGIK

SEQ ID NO: 1946553 - protein, 12 aa, Staphylococcus
GSAGRGNVTPAA

SEQ ID NO: 1946554 - protein, 6 aa, Staphylococcus
GSAKEE

SEQ ID NO: 1946555 - protein, 7 aa, Staphylococcus
GSAKNVE

SEQ ID NO: 1946556 - protein, 5 aa, Staphylococcus
GSALI

SEQ ID NO: 1946557 - protein, 9 aa, Staphylococcus
GSALSANQI

SEQ ID NO: 1946558 - protein, 4 aa, Staphylococcus
GSAN

SEQ ID NO: 1946559 - protein, 16 aa, Staphylococcus
GSANNQLKDENKHSQM

SEQ ID NO: 1946560 - protein, 8 aa, Staphylococcus
GSANYNSL

SEQ ID NO: 1946561 - protein, 16 aa, Staphylococcus
GSAPDIAGKNIANPTG

SEQ ID NO: 1946562 - protein, 15 aa, Staphylococcus
GSAPDIAGQDKANPF

SEQ ID NO: 1946563 - protein, 10 aa, Staphylococcus
GSAPDIANQD

SEQ ID NO: 1946564 - protein, 15 aa, Staphylococcus
GSAPDIANQDKANPF

SEQ ID NO: 1946565 - protein, 10 aa, Staphylococcus
GSAPDIANQN

SEQ ID NO: 1946566 - protein, 13 aa, Staphylococcus
GSAPDIANQNIAN

SEQ ID NO: 1946567 - protein, 15 aa, Staphylococcus
GSAPGQDLRYSTEKV

SEQ ID NO: 1946568 - protein, 13 aa, Staphylococcus
GSAQTEDIASDSL

SEQ ID NO: 1946569 - protein, 5 aa, Staphylococcus
GSATG

SEQ ID NO: 1946570 - protein, 10 aa, Staphylococcus
GSATNDAGAG

SEQ ID NO: 1946571 - protein, 10 aa, Staphylococcus
GSATNDGGAG

SEQ ID NO: 1946572 - protein, 10 aa, Staphylococcus
GSATNDGGSG

SEQ ID NO: 1946573 - protein, 11 aa, Staphylococcus
GSATNDGGSGM

SEQ ID NO: 1946574 - protein, 10 aa, Staphylococcus
GSATNDGGTG

SEQ ID NO: 1946575 - protein, 12 aa, Staphylococcus
GSAVTAYKKGDR

SEQ ID NO: 1946576 - protein, 7 aa, Staphylococcus
GSAYYAP

SEQ ID NO: 1946577 - protein, 14 aa, Staphylococcus
GSDASAALRSGADV

SEQ ID NO: 1946578 - protein, 6 aa, Staphylococcus
GSDASN

SEQ ID NO: 1946579 - protein, 5 aa, Staphylococcus
GSDDL

SEQ ID NO: 1946580 - protein, 11 aa, Staphylococcus
GSDDLTDSETE

SEQ ID NO: 1946581 - protein, 5 aa, Staphylococcus
GSDDS

SEQ ID NO: 1946582 - protein, 9 aa, Staphylococcus
GSDDTIDPR

SEQ ID NO: 1946583 - protein, 5 aa, Staphylococcus
GSDEL

SEQ ID NO: 1946584 - protein, 6 aa, Staphylococcus
GSDEQG

SEQ ID NO: 1946585 - protein, 8 aa, Staphylococcus
GSDGEQHR

SEQ ID NO: 1946586 - protein, 8 aa, Staphylococcus
GSDGGFAE

SEQ ID NO: 1946587 - protein, 8 aa, Staphylococcus
GSDGNGGK

SEQ ID NO: 1946588 - protein, 8 aa, Staphylococcus
GSDGVLDT

SEQ ID NO: 1946589 - protein, 8 aa, Staphylococcus
GSDHTKIE

SEQ ID NO: 1946590 - protein, 7 aa, Staphylococcus
GSDIQET

SEQ ID NO: 1946591 - protein, 8 aa, Staphylococcus
GSDKDTLH

SEQ ID NO: 1946592 - protein, 4 aa, Staphylococcus
GSDM

SEQ ID NO: 1946593 - protein, 8 aa, Staphylococcus
GSDMEPRE

SEQ ID NO: 1946594 - protein, 4 aa, Staphylococcus
GSDN

SEQ ID NO: 1946595 - protein, 7 aa, Staphylococcus
GSDRAHA

SEQ ID NO: 1946596 - protein, 13 aa, Staphylococcus
GSDREQALATEEL

SEQ ID NO: 1946597 - protein, 13 aa, Staphylococcus
GSDREQSLATKQL

SEQ ID NO: 1946598 - protein, 10 aa, Staphylococcus
GSDSLASAER

SEQ ID NO: 1946599 - protein, 10 aa, Staphylococcus
GSDSVESAKR

SEQ ID NO: 1946600 - protein, 10 aa, Staphylococcus
GSDSVESANK

SEQ ID NO: 1946601 - protein, 10 aa, Staphylococcus
GSDSVESAQR

SEQ ID NO: 1946602 - protein, 12 aa, Staphylococcus
GSDTGGSIRQPA

SEQ ID NO: 1946603 - protein, 11 aa, Staphylococcus
GSDVNNPTESL

SEQ ID NO: 1946604 - protein, 6 aa, Staphylococcus
GSDVTG

SEQ ID NO: 1946605 - protein, 7 aa, Staphylococcus
GSDYSSA

SEQ ID NO: 1946606 - protein, 5 aa, Staphylococcus
GSEAD

SEQ ID NO: 1946607 - protein, 12 aa, Staphylococcus
GSEARLASGALA

SEQ ID NO: 1946608 - protein, 13 aa, Staphylococcus
GSEARLASGALAG

SEQ ID NO: 1946609 - protein, 13 aa, Staphylococcus
GSEARLASGSLAG

SEQ ID NO: 1946610 - protein, 9 aa, Staphylococcus
GSEDFDEDT

SEQ ID NO: 1946611 - protein, 8 aa, Staphylococcus
GSEDPEYD

SEQ ID NO: 1946612 - protein, 7 aa, Staphylococcus
GSEENNV

SEQ ID NO: 1946613 - protein, 8 aa, Staphylococcus
GSEETVKA

SEQ ID NO: 1946614 - protein, 8 aa, Staphylococcus
GSEETVKE

SEQ ID NO: 1946615 - protein, 8 aa, Staphylococcus
GSEHEQNA

SEQ ID NO: 1946616 - protein, 8 aa, Staphylococcus
GSEHEQSA

SEQ ID NO: 1946617 - protein, 7 aa, Staphylococcus
GSEHGNI

SEQ ID NO: 1946618 - protein, 4 aa, Staphylococcus
GSEI

SEQ ID NO: 1946619 - protein, 6 aa, Staphylococcus
GSEIGD

SEQ ID NO: 1946620 - protein, 8 aa, Staphylococcus
GSEISERL

SEQ ID NO: 1946621 - protein, 9 aa, Staphylococcus
GSEKEISIR

SEQ ID NO: 1946622 - protein, 10 aa, Staphylococcus
GSEKKTSAII

SEQ ID NO: 1946623 - protein, 5 aa, Staphylococcus
GSEKP

SEQ ID NO: 1946624 - protein, 10 aa, Staphylococcus
GSEKQPDDLE

SEQ ID NO: 1946625 - protein, 5 aa, Staphylococcus
GSELP

SEQ ID NO: 1946626 - protein, 4 aa, Staphylococcus
GSEN

SEQ ID NO: 1946627 - protein, 9 aa, Staphylococcus
GSENATVND

SEQ ID NO: 1946628 - protein, 12 aa, Staphylococcus
GSENSAQFAADE

SEQ ID NO: 1946629 - protein, 15 aa, Staphylococcus
GSEPIEDALENFYKK

SEQ ID NO: 1946630 - protein, 14 aa, Staphylococcus
GSEPLDNTAIHPES

SEQ ID NO: 1946631 - protein, 4 aa, Staphylococcus
GSEQ

SEQ ID NO: 1946632 - protein, 10 aa, Staphylococcus
GSERKPDDLE

SEQ ID NO: 1946633 - protein, 7 aa, Staphylococcus
GSERTIQ

SEQ ID NO: 1946634 - protein, 6 aa, Staphylococcus
GSESAY

SEQ ID NO: 1946635 - protein, 8 aa, Staphylococcus
GSESGSIQ

SEQ ID NO: 1946636 - protein, 6 aa, Staphylococcus
GSETAI

SEQ ID NO: 1946637 - protein, 10 aa, Staphylococcus
GSETGNAQGV

SEQ ID NO: 1946638 - protein, 9 aa, Staphylococcus
GSETGNAQS

SEQ ID NO: 1946639 - protein, 6 aa, Staphylococcus
GSETLT

SEQ ID NO: 1946640 - protein, 14 aa, Staphylococcus
GSEVEHIAEKGAFN

SEQ ID NO: 1946641 - protein, 8 aa, Staphylococcus
GSEVQVGE

SEQ ID NO: 1946642 - protein, 16 aa, Staphylococcus
GSEVTVDNPAQMPERD

SEQ ID NO: 1946643 - protein, 17 aa, Staphylococcus
GSEVTVDNPAQMPERDK

SEQ ID NO: 1946644 - protein, 16 aa, Staphylococcus
GSEYDGYDMMRHDLFC

SEQ ID NO: 1946645 - protein, 5 aa, Staphylococcus
GSEYT

SEQ ID NO: 1946646 - protein, 6 aa, Staphylococcus
GSFDAG

SEQ ID NO: 1946647 - protein, 7 aa, Staphylococcus
GSFDGGA

SEQ ID NO: 1946648 - protein, 6 aa, Staphylococcus
GSFKKK

SEQ ID NO: 1946649 - protein, 4 aa, Staphylococcus
GSFN

SEQ ID NO: 1946650 - protein, 5 aa, Staphylococcus
GSFNF

SEQ ID NO: 1946651 - protein, 10 aa, Staphylococcus
GSFNPSSDLQ

SEQ ID NO: 1946652 - protein, 17 aa, Staphylococcus
GSFPQTKEVRKKRADWK

SEQ ID NO: 1946653 - protein, 10 aa, Staphylococcus
GSFPQTQEVR

SEQ ID NO: 1946654 - protein, 6 aa, Staphylococcus
GSFSDK

SEQ ID NO: 1946655 - protein, 4 aa, Staphylococcus
GSFT

SEQ ID NO: 1946656 - protein, 4 aa, Staphylococcus
GSGA

SEQ ID NO: 1946657 - protein, 10 aa, Staphylococcus
GSGATGSKIM

SEQ ID NO: 1946658 - protein, 7 aa, Staphylococcus
GSGEERA

SEQ ID NO: 1946659 - protein, 8 aa, Staphylococcus
GSGEERAE

SEQ ID NO: 1946660 - protein, 8 aa, Staphylococcus
GSGGGIGF

SEQ ID NO: 1946661 - protein, 5 aa, Staphylococcus
GSGGI

SEQ ID NO: 1946662 - protein, 5 aa, Staphylococcus
GSGGL

SEQ ID NO: 1946663 - protein, 6 aa, Staphylococcus
GSGGLG

SEQ ID NO: 1946664 - protein, 10 aa, Staphylococcus
GSGGNTGDDK

SEQ ID NO: 1946665 - protein, 15 aa, Staphylococcus
GSGGNYALSAGRALK

SEQ ID NO: 1946666 - protein, 23 aa, Staphylococcus
GSGGNYALSAGRALKRNATHLSA

SEQ ID NO: 1946667 - protein, 11 aa, Staphylococcus
GSGGSTGADKT

SEQ ID NO: 1946668 - protein, 13 aa, Staphylococcus
GSGGSTGADKTIS

SEQ ID NO: 1946669 - protein, 11 aa, Staphylococcus
GSGGSTGDDKT

SEQ ID NO: 1946670 - protein, 8 aa, Staphylococcus
GSGGTFTG

SEQ ID NO: 1946671 - protein, 18 aa, Staphylococcus
GSGGTFTGTAEGLAERKA

SEQ ID NO: 1946672 - protein, 17 aa, Staphylococcus
GSGIGYEEYAKSKGSDV

SEQ ID NO: 1946673 - protein, 7 aa, Staphylococcus
GSGKGDF

SEQ ID NO: 1946674 - protein, 6 aa, Staphylococcus
GSGKPV

SEQ ID NO: 1946675 - protein, 10 aa, Staphylococcus
GSGKSTFAKQ

SEQ ID NO: 1946676 - protein, 7 aa, Staphylococcus
GSGKTTF

SEQ ID NO: 1946677 - protein, 8 aa, Staphylococcus
GSGKTTIA

SEQ ID NO: 1946678 - protein, 7 aa, Staphylococcus
GSGKTTL

SEQ ID NO: 1946679 - protein, 4 aa, Staphylococcus
GSGL

SEQ ID NO: 1946680 - protein, 18 aa, Staphylococcus
GSGLAKGYLNQPEQTQQS

SEQ ID NO: 1946681 - protein, 10 aa, Staphylococcus
GSGLSAQDSW

SEQ ID NO: 1946682 - protein, 13 aa, Staphylococcus
GSGNKRTQSVTSG

SEQ ID NO: 1946683 - protein, 10 aa, Staphylococcus
GSGNRNWGQN

SEQ ID NO: 1946684 - protein, 10 aa, Staphylococcus
GSGPAGLAAA

SEQ ID NO: 1946685 - protein, 10 aa, Staphylococcus
GSGPAGLSAA

SEQ ID NO: 1946686 - protein, 18 aa, Staphylococcus
GSGPAGLTAADELNAKGY

SEQ ID NO: 1946687 - protein, 13 aa, Staphylococcus
GSGPAGLTAAEEL

SEQ ID NO: 1946688 - protein, 8 aa, Staphylococcus
GSGPTGAK

SEQ ID NO: 1946689 - protein, 4 aa, Staphylococcus
GSGR

SEQ ID NO: 1946690 - protein, 10 aa, Staphylococcus
GSGRTGSKIM

SEQ ID NO: 1946691 - protein, 8 aa, Staphylococcus
GSGSGIGK

SEQ ID NO: 1946692 - protein, 7 aa, Staphylococcus
GSGSKRA

SEQ ID NO: 1946693 - protein, 8 aa, Staphylococcus
GSGSKRAE

SEQ ID NO: 1946694 - protein, 5 aa, Staphylococcus
GSGSL

SEQ ID NO: 1946695 - protein, 6 aa, Staphylococcus
GSGSPV

SEQ ID NO: 1946696 - protein, 18 aa, Staphylococcus
GSGSRASDNRQQEVSEIS

SEQ ID NO: 1946697 - protein, 19 aa, Staphylococcus
GSGSRLSDNRQQEVSEISR

SEQ ID NO: 1946698 - protein, 5 aa, Staphylococcus
GSGST

SEQ ID NO: 1946699 - protein, 6 aa, Staphylococcus
GSGSTA

SEQ ID NO: 1946700 - protein, 15 aa, Staphylococcus
GSGSTGGDSGSKGLS

SEQ ID NO: 1946701 - protein, 15 aa, Staphylococcus
GSGSTGGESGGKGLS

SEQ ID NO: 1946702 - protein, 7 aa, Staphylococcus
GSGSVGE

SEQ ID NO: 1946703 - protein, 9 aa, Staphylococcus
GSGTQIGED

SEQ ID NO: 1946704 - protein, 9 aa, Staphylococcus
GSGTTLKES

SEQ ID NO: 1946705 - protein, 20 aa, Staphylococcus
GSGVATLGLPDSPGVPEGIA

SEQ ID NO: 1946706 - protein, 5 aa, Staphylococcus
GSGVG

SEQ ID NO: 1946707 - protein, 5 aa, Staphylococcus
GSHAE

SEQ ID NO: 1946708 - protein, 5 aa, Staphylococcus
GSHAG

SEQ ID NO: 1946709 - protein, 6 aa, Staphylococcus
GSHAGR

SEQ ID NO: 1946710 - protein, 6 aa, Staphylococcus
GSHASR

SEQ ID NO: 1946711 - protein, 10 aa, Staphylococcus
GSHASRNNKY

SEQ ID NO: 1946712 - protein, 4 aa, Staphylococcus
GSHD

SEQ ID NO: 1946713 - protein, 7 aa, Staphylococcus
GSHDDMA

SEQ ID NO: 1946714 - protein, 5 aa, Staphylococcus
GSHDG

SEQ ID NO: 1946715 - protein, 4 aa, Staphylococcus
GSHG

SEQ ID NO: 1946716 - protein, 4 aa, Staphylococcus
GSHL

SEQ ID NO: 1946717 - protein, 5 aa, Staphylococcus
GSHLP

SEQ ID NO: 1946718 - protein, 7 aa, Staphylococcus
GSHMQPR

SEQ ID NO: 1946719 - protein, 8 aa, Staphylococcus
GSHPLPSI

SEQ ID NO: 1946720 - protein, 52 aa, Staphylococcus
GSHSDDSSKQEEKQEEAPAEKESTSSSQSQEASTASTQEAEVDENKTVKAMP

SEQ ID NO: 1946721 - protein, 4 aa, Staphylococcus
GSIA

SEQ ID NO: 1946722 - protein, 8 aa, Staphylococcus
GSIDASTE

SEQ ID NO: 1946723 - protein, 7 aa, Staphylococcus
GSIDEGK

SEQ ID NO: 1946724 - protein, 18 aa, Staphylococcus
GSIDTDSVLNTDKPIAPG

SEQ ID NO: 1946725 - protein, 4 aa, Staphylococcus
GSIE

SEQ ID NO: 1946726 - protein, 7 aa, Staphylococcus
GSIEKGK

SEQ ID NO: 1946727 - protein, 7 aa, Staphylococcus
GSIEMGK

SEQ ID NO: 1946728 - protein, 7 aa, Staphylococcus
GSIEPGK

SEQ ID NO: 1946729 - protein, 8 aa, Staphylococcus
GSIESYDD

SEQ ID NO: 1946730 - protein, 7 aa, Staphylococcus
GSIGNGQ

SEQ ID NO: 1946731 - protein, 15 aa, Staphylococcus
GSIIESGTTDGEGKI

SEQ ID NO: 1946732 - protein, 9 aa, Staphylococcus
GSIISQNGQ

SEQ ID NO: 1946733 - protein, 9 aa, Staphylococcus
GSIKEISSQ

SEQ ID NO: 1946734 - protein, 14 aa, Staphylococcus
GSILNGGESHPHDI

SEQ ID NO: 1946735 - protein, 7 aa, Staphylococcus
GSIREIS

SEQ ID NO: 1946736 - protein, 11 aa, Staphylococcus
GSISEEAHQTL

SEQ ID NO: 1946737 - protein, 11 aa, Staphylococcus
GSISTEAHSTL

SEQ ID NO: 1946738 - protein, 6 aa, Staphylococcus
GSITEI

SEQ ID NO: 1946739 - protein, 9 aa, Staphylococcus
GSITPKESV

SEQ ID NO: 1946740 - protein, 8 aa, Staphylococcus
GSITVDGT

SEQ ID NO: 1946741 - protein, 4 aa, Staphylococcus
GSIV

SEQ ID NO: 1946742 - protein, 5 aa, Staphylococcus
GSIVD

SEQ ID NO: 1946743 - protein, 10 aa, Staphylococcus
GSIVQNDDGI

SEQ ID NO: 1946744 - protein, 4 aa, Staphylococcus
GSKA

SEQ ID NO: 1946745 - protein, 9 aa, Staphylococcus
GSKAGATAV

SEQ ID NO: 1946746 - protein, 10 aa, Staphylococcus
GSKALKSLRS

SEQ ID NO: 1946747 - protein, 23 aa, Staphylococcus
GSKAMTEAVEGAEDNEEQGKDDL

SEQ ID NO: 1946748 - protein, 8 aa, Staphylococcus
GSKANELL

SEQ ID NO: 1946749 - protein, 9 aa, Staphylococcus
GSKDATSHA

SEQ ID NO: 1946750 - protein, 10 aa, Staphylococcus
GSKDYKGAAT

SEQ ID NO: 1946751 - protein, 7 aa, Staphylococcus
GSKEDAL

SEQ ID NO: 1946752 - protein, 7 aa, Staphylococcus
GSKEEVV

SEQ ID NO: 1946753 - protein, 5 aa, Staphylococcus
GSKEG

SEQ ID NO: 1946754 - protein, 7 aa, Staphylococcus
GSKEGIT

SEQ ID NO: 1946755 - protein, 8 aa, Staphylococcus
GSKEMEYE

SEQ ID NO: 1946756 - protein, 8 aa, Staphylococcus
GSKEQQAY

SEQ ID NO: 1946757 - protein, 7 aa, Staphylococcus
GSKESTL

SEQ ID NO: 1946758 - protein, 7 aa, Staphylococcus
GSKGARV

SEQ ID NO: 1946759 - protein, 10 aa, Staphylococcus
GSKGNLNTRK

SEQ ID NO: 1946760 - protein, 5 aa, Staphylococcus
GSKGV

SEQ ID NO: 1946761 - protein, 5 aa, Staphylococcus
GSKHA

SEQ ID NO: 1946762 - protein, 8 aa, Staphylococcus
GSKITVEY

SEQ ID NO: 1946763 - protein, 36 aa, Staphylococcus
GSKKDETKSAQYSKVPNVTGQSTDKAKESLKSEDLQ

SEQ ID NO: 1946764 - protein, 8 aa, Staphylococcus
GSKKIEND

SEQ ID NO: 1946765 - protein, 5 aa, Staphylococcus
GSKKP

SEQ ID NO: 1946766 - protein, 5 aa, Staphylococcus
GSKKV

SEQ ID NO: 1946767 - protein, 6 aa, Staphylococcus
GSKKVE

SEQ ID NO: 1946768 - protein, 9 aa, Staphylococcus
GSKLNEGRL

SEQ ID NO: 1946769 - protein, 12 aa, Staphylococcus
GSKNKKDAKDNL

SEQ ID NO: 1946770 - protein, 9 aa, Staphylococcus
GSKNKSEVN

SEQ ID NO: 1946771 - protein, 9 aa, Staphylococcus
GSKNVGTSI

SEQ ID NO: 1946772 - protein, 7 aa, Staphylococcus
GSKPPHV

SEQ ID NO: 1946773 - protein, 9 aa, Staphylococcus
GSKQKEHGV

SEQ ID NO: 1946774 - protein, 9 aa, Staphylococcus
GSKQKEYGV

SEQ ID NO: 1946775 - protein, 11 aa, Staphylococcus
GSKQKKEGVRT

SEQ ID NO: 1946776 - protein, 21 aa, Staphylococcus
GSKRKDTKDSLFEDKKSEQKI

SEQ ID NO: 1946777 - protein, 4 aa, Staphylococcus
GSKS

SEQ ID NO: 1946778 - protein, 6 aa, Staphylococcus
GSKTVG

SEQ ID NO: 1946779 - protein, 9 aa, Staphylococcus
GSKVNGKIE

SEQ ID NO: 1946780 - protein, 17 aa, Staphylococcus
GSKVTVDNPAQMPERDR

SEQ ID NO: 1946781 - protein, 9 aa, Staphylococcus
GSKYPYNNT

SEQ ID NO: 1946782 - protein, 4 aa, Staphylococcus
GSLD

SEQ ID NO: 1946783 - protein, 5 aa, Staphylococcus
GSLDE

SEQ ID NO: 1946784 - protein, 8 aa, Staphylococcus
GSLDGSGE

SEQ ID NO: 1946785 - protein, 8 aa, Staphylococcus
GSLDRQAK

SEQ ID NO: 1946786 - protein, 8 aa, Staphylococcus
GSLGEQYE

SEQ ID NO: 1946787 - protein, 14 aa, Staphylococcus
GSLKDTLKEMQQDL

SEQ ID NO: 1946788 - protein, 10 aa, Staphylococcus
GSLPKGLETS

SEQ ID NO: 1946789 - protein, 10 aa, Staphylococcus
GSLPKGLNQD

SEQ ID NO: 1946790 - protein, 10 aa, Staphylococcus
GSLPKGLNTN

SEQ ID NO: 1946791 - protein, 6 aa, Staphylococcus
GSLPTQ

SEQ ID NO: 1946792 - protein, 14 aa, Staphylococcus
GSLSNTSGEIEKHG

SEQ ID NO: 1946793 - protein, 14 aa, Staphylococcus
GSLSPSSGEIERHG

SEQ ID NO: 1946794 - protein, 14 aa, Staphylococcus
GSLSPSSGNIDRHG

SEQ ID NO: 1946795 - protein, 14 aa, Staphylococcus
GSLSPTSGDIERHG

SEQ ID NO: 1946796 - protein, 5 aa, Staphylococcus
GSLVD

SEQ ID NO: 1946797 - protein, 6 aa, Staphylococcus
GSLYTG

SEQ ID NO: 1946798 - protein, 9 aa, Staphylococcus
GSMGKSSTR

SEQ ID NO: 1946799 - protein, 10 aa, Staphylococcus
GSMGKSSTRM

SEQ ID NO: 1946800 - protein, 6 aa, Staphylococcus
GSMPKE

SEQ ID NO: 1946801 - protein, 18 aa, Staphylococcus
GSMRAGKSVYAESASTVK

SEQ ID NO: 1946802 - protein, 7 aa, Staphylococcus
GSMSATE

SEQ ID NO: 1946803 - protein, 9 aa, Staphylococcus
GSMSGQECA

SEQ ID NO: 1946804 - protein, 12 aa, Staphylococcus
GSMSTSGKDELE

SEQ ID NO: 1946805 - protein, 8 aa, Staphylococcus
GSMTDTTG

SEQ ID NO: 1946806 - protein, 7 aa, Staphylococcus
GSNANQI

SEQ ID NO: 1946807 - protein, 10 aa, Staphylococcus
GSNAQSSMSQ

SEQ ID NO: 1946808 - protein, 14 aa, Staphylococcus
GSNGFENAGGMTEK

SEQ ID NO: 1946809 - protein, 9 aa, Staphylococcus
GSNGTGKTT

SEQ ID NO: 1946810 - protein, 4 aa, Staphylococcus
GSNK

SEQ ID NO: 1946811 - protein, 14 aa, Staphylococcus
GSNKNSELTSTYPH

SEQ ID NO: 1946812 - protein, 8 aa, Staphylococcus
GSNMEPRE

SEQ ID NO: 1946813 - protein, 8 aa, Staphylococcus
GSNMQPRE

SEQ ID NO: 1946814 - protein, 4 aa, Staphylococcus
GSNN

SEQ ID NO: 1946815 - protein, 17 aa, Staphylococcus
GSNQPNRLYPKKPNDEY

SEQ ID NO: 1946816 - protein, 9 aa, Staphylococcus
GSNQPNTVS

SEQ ID NO: 1946817 - protein, 5 aa, Staphylococcus
GSNRP

SEQ ID NO: 1946818 - protein, 7 aa, Staphylococcus
GSNSTDL

SEQ ID NO: 1946819 - protein, 6 aa, Staphylococcus
GSPDEV

SEQ ID NO: 1946820 - protein, 23 aa, Staphylococcus
GSPEMGTKNAQTNKSNNTPTLDS

SEQ ID NO: 1946821 - protein, 23 aa, Staphylococcus
GSPEMNTKNATANKSNNTPTLDG

SEQ ID NO: 1946822 - protein, 23 aa, Staphylococcus
GSPEMSNKNAQANKSNNTPTLDG

SEQ ID NO: 1946823 - protein, 23 aa, Staphylococcus
GSPEMSNKNAQANKSNNTPTLDS

SEQ ID NO: 1946824 - protein, 23 aa, Staphylococcus
GSPEMSNKNAQATKSNNTPTLDG

SEQ ID NO: 1946825 - protein, 23 aa, Staphylococcus
GSPEMSNKNATANKSNNTPTLDG

SEQ ID NO: 1946826 - protein, 9 aa, Staphylococcus
GSPEYKGAA

SEQ ID NO: 1946827 - protein, 8 aa, Staphylococcus
GSPGFSSE

SEQ ID NO: 1946828 - protein, 5 aa, Staphylococcus
GSPIR

SEQ ID NO: 1946829 - protein, 13 aa, Staphylococcus
GSPISKTKASQVE

SEQ ID NO: 1946830 - protein, 22 aa, Staphylococcus
GSPNKAGSNGVHGAPLGEDERK

SEQ ID NO: 1946831 - protein, 12 aa, Staphylococcus
GSPNQHGSNEEY

SEQ ID NO: 1946832 - protein, 9 aa, Staphylococcus
GSPSSRTQR

SEQ ID NO: 1946833 - protein, 10 aa, Staphylococcus
GSPSSRTQRL

SEQ ID NO: 1946834 - protein, 4 aa, Staphylococcus
GSPT

SEQ ID NO: 1946835 - protein, 7 aa, Staphylococcus
GSPTDNM

SEQ ID NO: 1946836 - protein, 10 aa, Staphylococcus
GSPTRNATEA

SEQ ID NO: 1946837 - protein, 5 aa, Staphylococcus
GSPYK

SEQ ID NO: 1946838 - protein, 18 aa, Staphylococcus
GSPYKNLKKTYDKEKHEM

SEQ ID NO: 1946839 - protein, 4 aa, Staphylococcus
GSQD

SEQ ID NO: 1946840 - protein, 7 aa, Staphylococcus
GSQDAVK

SEQ ID NO: 1946841 - protein, 14 aa, Staphylococcus
GSQDEAIEKAGRAL

SEQ ID NO: 1946842 - protein, 6 aa, Staphylococcus
GSQEAE

SEQ ID NO: 1946843 - protein, 17 aa, Staphylococcus
GSQGHAHAQNLKDNGYD

SEQ ID NO: 1946844 - protein, 8 aa, Staphylococcus
GSQIIDNT

SEQ ID NO: 1946845 - protein, 7 aa, Staphylococcus
GSQKVGM

SEQ ID NO: 1946846 - protein, 6 aa, Staphylococcus
GSQLPY

SEQ ID NO: 1946847 - protein, 23 aa, Staphylococcus
GSQNEAIEKAGQALVDSGAVTEN

SEQ ID NO: 1946848 - protein, 10 aa, Staphylococcus
GSQQYKGAAT

SEQ ID NO: 1946849 - protein, 5 aa, Staphylococcus
GSQRP

SEQ ID NO: 1946850 - protein, 11 aa, Staphylococcus
GSQSANNPYAA

SEQ ID NO: 1946851 - protein, 8 aa, Staphylococcus
GSQSGDYQ

SEQ ID NO: 1946852 - protein, 10 aa, Staphylococcus
GSQSYKGAAT

SEQ ID NO: 1946853 - protein, 10 aa, Staphylococcus
GSQVNLTPKE

SEQ ID NO: 1946854 - protein, 7 aa, Staphylococcus
GSRAEEL

SEQ ID NO: 1946855 - protein, 8 aa, Staphylococcus
GSRATGTR

SEQ ID NO: 1946856 - protein, 10 aa, Staphylococcus
GSRATGTRIY

SEQ ID NO: 1946857 - protein, 4 aa, Staphylococcus
GSRE

SEQ ID NO: 1946858 - protein, 13 aa, Staphylococcus
GSRETRRGKKLTH

SEQ ID NO: 1946859 - protein, 15 aa, Staphylococcus
GSRGMKLEEVVDALI

SEQ ID NO: 1946860 - protein, 14 aa, Staphylococcus
GSRGMKLEEVVEAL

SEQ ID NO: 1946861 - protein, 5 aa, Staphylococcus
GSRGS

SEQ ID NO: 1946862 - protein, 4 aa, Staphylococcus
GSRI

SEQ ID NO: 1946863 - protein, 9 aa, Staphylococcus
GSRIPDNNT

SEQ ID NO: 1946864 - protein, 4 aa, Staphylococcus
GSRK

SEQ ID NO: 1946865 - protein, 5 aa, Staphylococcus
GSRKE

SEQ ID NO: 1946866 - protein, 16 aa, Staphylococcus
GSRMSDNRQQEVSEIS

SEQ ID NO: 1946867 - protein, 4 aa, Staphylococcus
GSRP

SEQ ID NO: 1946868 - protein, 7 aa, Staphylococcus
GSRPQTL

SEQ ID NO: 1946869 - protein, 6 aa, Staphylococcus
GSRPTE

SEQ ID NO: 1946870 - protein, 13 aa, Staphylococcus
GSRPYSKLGEHEI

SEQ ID NO: 1946871 - protein, 16 aa, Staphylococcus
GSRQRDPNAPRKGDDL

SEQ ID NO: 1946872 - protein, 11 aa, Staphylococcus
GSRSVKHQAEA

SEQ ID NO: 1946873 - protein, 12 aa, Staphylococcus
GSRSVKKEAEAL

SEQ ID NO: 1946874 - protein, 11 aa, Staphylococcus
GSRTVKHEAEA

SEQ ID NO: 1946875 - protein, 7 aa, Staphylococcus
GSRTVKI

SEQ ID NO: 1946876 - protein, 12 aa, Staphylococcus
GSRTVKKEAEAL

SEQ ID NO: 1946877 - protein, 13 aa, Staphylococcus
GSRTVKKEAESLG

SEQ ID NO: 1946878 - protein, 13 aa, Staphylococcus
GSRTVKKEAESMG

SEQ ID NO: 1946879 - protein, 5 aa, Staphylococcus
GSRVG

SEQ ID NO: 1946880 - protein, 4 aa, Staphylococcus
GSSD

SEQ ID NO: 1946881 - protein, 5 aa, Staphylococcus
GSSDH

SEQ ID NO: 1946882 - protein, 10 aa, Staphylococcus
GSSEYKGTAT

SEQ ID NO: 1946883 - protein, 7 aa, Staphylococcus
GSSFDKC

SEQ ID NO: 1946884 - protein, 5 aa, Staphylococcus
GSSFS

SEQ ID NO: 1946885 - protein, 8 aa, Staphylococcus
GSSFTDIG

SEQ ID NO: 1946886 - protein, 7 aa, Staphylococcus
GSSIAKS

SEQ ID NO: 1946887 - protein, 17 aa, Staphylococcus
GSSKKDDSVLAGYTSKN

SEQ ID NO: 1946888 - protein, 9 aa, Staphylococcus
GSSKKDDTV

SEQ ID NO: 1946889 - protein, 10 aa, Staphylococcus
GSSKKDNEVL

SEQ ID NO: 1946890 - protein, 5 aa, Staphylococcus
GSSKL

SEQ ID NO: 1946891 - protein, 4 aa, Staphylococcus
GSSL

SEQ ID NO: 1946892 - protein, 6 aa, Staphylococcus
GSSNNN

SEQ ID NO: 1946893 - protein, 8 aa, Staphylococcus
GSSNSAFS

SEQ ID NO: 1946894 - protein, 8 aa, Staphylococcus
GSSNVPSI

SEQ ID NO: 1946895 - protein, 6 aa, Staphylococcus
GSSPES

SEQ ID NO: 1946896 - protein, 7 aa, Staphylococcus
GSSPESF

SEQ ID NO: 1946897 - protein, 7 aa, Staphylococcus
GSSPRNS

SEQ ID NO: 1946898 - protein, 10 aa, Staphylococcus
GSSRSGAQDF

SEQ ID NO: 1946899 - protein, 4 aa, Staphylococcus
GSSS

SEQ ID NO: 1946900 - protein, 9 aa, Staphylococcus
GSSSGKDTL

SEQ ID NO: 1946901 - protein, 9 aa, Staphylococcus
GSSSTDFNT

SEQ ID NO: 1946902 - protein, 8 aa, Staphylococcus
GSSSYDAP

SEQ ID NO: 1946903 - protein, 5 aa, Staphylococcus
GSSTI

SEQ ID NO: 1946904 - protein, 5 aa, Staphylococcus
GSSTL

SEQ ID NO: 1946905 - protein, 6 aa, Staphylococcus
GSSTSQ

SEQ ID NO: 1946906 - protein, 5 aa, Staphylococcus
GSSTY

SEQ ID NO: 1946907 - protein, 13 aa, Staphylococcus
GSSVEYNQLIVNV

SEQ ID NO: 1946908 - protein, 6 aa, Staphylococcus
GSSYTY

SEQ ID NO: 1946909 - protein, 7 aa, Staphylococcus
GSSYTYG

SEQ ID NO: 1946910 - protein, 8 aa, Staphylococcus
GSTDTGAK

SEQ ID NO: 1946911 - protein, 10 aa, Staphylococcus
GSTEEGAVDS

SEQ ID NO: 1946912 - protein, 5 aa, Staphylococcus
GSTEH

SEQ ID NO: 1946913 - protein, 7 aa, Staphylococcus
GSTFGKT

SEQ ID NO: 1946914 - protein, 16 aa, Staphylococcus
GSTGISAGYATDIPPH

SEQ ID NO: 1946915 - protein, 10 aa, Staphylococcus
GSTGRGNVTP

SEQ ID NO: 1946916 - protein, 5 aa, Staphylococcus
GSTIN

SEQ ID NO: 1946917 - protein, 8 aa, Staphylococcus
GSTIPRED

SEQ ID NO: 1946918 - protein, 5 aa, Staphylococcus
GSTIT

SEQ ID NO: 1946919 - protein, 12 aa, Staphylococcus
GSTITDDIPEDS

SEQ ID NO: 1946920 - protein, 12 aa, Staphylococcus
GSTITDDIPNES

SEQ ID NO: 1946921 - protein, 13 aa, Staphylococcus
GSTITDDVPNDSL

SEQ ID NO: 1946922 - protein, 12 aa, Staphylococcus
GSTITDNVPEDS

SEQ ID NO: 1946923 - protein, 4 aa, Staphylococcus
GSTK

SEQ ID NO: 1946924 - protein, 8 aa, Staphylococcus
GSTLSNEL

SEQ ID NO: 1946925 - protein, 9 aa, Staphylococcus
GSTLSREAD

SEQ ID NO: 1946926 - protein, 5 aa, Staphylococcus
GSTNF

SEQ ID NO: 1946927 - protein, 15 aa, Staphylococcus
GSTNPSEAAPGSIRG

SEQ ID NO: 1946928 - protein, 15 aa, Staphylococcus
GSTNPSEAAPGTIRG

SEQ ID NO: 1946929 - protein, 8 aa, Staphylococcus
GSTNPSNL

SEQ ID NO: 1946930 - protein, 11 aa, Staphylococcus
GSTRLKSGTAQ

SEQ ID NO: 1946931 - protein, 11 aa, Staphylococcus
GSTSDSIQSFE

SEQ ID NO: 1946932 - protein, 7 aa, Staphylococcus
GSTSEKG

SEQ ID NO: 1946933 - protein, 5 aa, Staphylococcus
GSTSH

SEQ ID NO: 1946934 - protein, 7 aa, Staphylococcus
GSTSTDF

SEQ ID NO: 1946935 - protein, 10 aa, Staphylococcus
GSTSTDFKSN

SEQ ID NO: 1946936 - protein, 8 aa, Staphylococcus
GSTSTTIK

SEQ ID NO: 1946937 - protein, 5 aa, Staphylococcus
GSTSV

SEQ ID NO: 1946938 - protein, 8 aa, Staphylococcus
GSTSYERP

SEQ ID NO: 1946939 - protein, 5 aa, Staphylococcus
GSTTL

SEQ ID NO: 1946940 - protein, 9 aa, Staphylococcus
GSTTSNNIT

SEQ ID NO: 1946941 - protein, 4 aa, Staphylococcus
GSTV

SEQ ID NO: 1946942 - protein, 12 aa, Staphylococcus
GSTVTQGYTDKH

SEQ ID NO: 1946943 - protein, 12 aa, Staphylococcus
GSVDRSMQKILN

SEQ ID NO: 1946944 - protein, 4 aa, Staphylococcus
GSVE

SEQ ID NO: 1946945 - protein, 5 aa, Staphylococcus
GSVED

SEQ ID NO: 1946946 - protein, 5 aa, Staphylococcus
GSVEE

SEQ ID NO: 1946947 - protein, 8 aa, Staphylococcus
GSVFQNPR

SEQ ID NO: 1946948 - protein, 13 aa, Staphylococcus
GSVGIANNQTGLY

SEQ ID NO: 1946949 - protein, 14 aa, Staphylococcus
GSVGITGKVAEETL

SEQ ID NO: 1946950 - protein, 8 aa, Staphylococcus
GSVGLNNG

SEQ ID NO: 1946951 - protein, 5 aa, Staphylococcus
GSVGS

SEQ ID NO: 1946952 - protein, 20 aa, Staphylococcus
GSVLKPDSQYDNYGIKGGST

SEQ ID NO: 1946953 - protein, 13 aa, Staphylococcus
GSVLNGGKAHAHD

SEQ ID NO: 1946954 - protein, 13 aa, Staphylococcus
GSVNITGKEAESL

SEQ ID NO: 1946955 - protein, 12 aa, Staphylococcus
GSVNNRQNGQRN

SEQ ID NO: 1946956 - protein, 6 aa, Staphylococcus
GSVPQS

SEQ ID NO: 1946957 - protein, 12 aa, Staphylococcus
GSVSNAKSNEVY

SEQ ID NO: 1946958 - protein, 11 aa, Staphylococcus
GSVSPQTKEKL

SEQ ID NO: 1946959 - protein, 21 aa, Staphylococcus
GSVTKRDPETVNPKIKTGQVE

SEQ ID NO: 1946960 - protein, 8 aa, Staphylococcus
GSYDEGYE

SEQ ID NO: 1946961 - protein, 13 aa, Staphylococcus
GSYDERADQVAEK

SEQ ID NO: 1946962 - protein, 14 aa, Staphylococcus
GSYDKRADEEAEKY

SEQ ID NO: 1946963 - protein, 14 aa, Staphylococcus
GSYDNRAQEEADKY

SEQ ID NO: 1946964 - protein, 8 aa, Staphylococcus
GSYEDCSD

SEQ ID NO: 1946965 - protein, 9 aa, Staphylococcus
GSYGTGKSH

SEQ ID NO: 1946966 - protein, 7 aa, Staphylococcus
GSYNDQG

SEQ ID NO: 1946967 - protein, 9 aa, Staphylococcus
GSYNPQTQI

SEQ ID NO: 1946968 - protein, 13 aa, Staphylococcus
GSYNQRAKEEADK

SEQ ID NO: 1946969 - protein, 15 aa, Staphylococcus
GSYNTRAQKEADKYG

SEQ ID NO: 1946970 - protein, 8 aa, Staphylococcus
GSYQPSMK

SEQ ID NO: 1946971 - protein, 8 aa, Staphylococcus
GSYSNGKQ

SEQ ID NO: 1946972 - protein, 7 aa, Staphylococcus
GSYTDEN

SEQ ID NO: 1946973 - protein, 13 aa, Staphylococcus
GSYVTEGKITRNA

SEQ ID NO: 1946974 - protein, 4 aa, Staphylococcus
GTAC

SEQ ID NO: 1946975 - protein, 7 aa, Staphylococcus
GTAELDG

SEQ ID NO: 1946976 - protein, 9 aa, Staphylococcus
GTAGEHMEG

SEQ ID NO: 1946977 - protein, 11 aa, Staphylococcus
GTAHREHASNV

SEQ ID NO: 1946978 - protein, 5 aa, Staphylococcus
GTAKS

SEQ ID NO: 1946979 - protein, 11 aa, Staphylococcus
GTAKVTKEEMD

SEQ ID NO: 1946980 - protein, 6 aa, Staphylococcus
GTAPHQ

SEQ ID NO: 1946981 - protein, 5 aa, Staphylococcus
GTAPI

SEQ ID NO: 1946982 - protein, 5 aa, Staphylococcus
GTARG

SEQ ID NO: 1946983 - protein, 10 aa, Staphylococcus
GTASKGSFPQ

SEQ ID NO: 1946984 - protein, 6 aa, Staphylococcus
GTASKI

SEQ ID NO: 1946985 - protein, 5 aa, Staphylococcus
GTASV

SEQ ID NO: 1946986 - protein, 12 aa, Staphylococcus
GTAVSEDATQRV

SEQ ID NO: 1946987 - protein, 11 aa, Staphylococcus
GTAVSEEQTQL

SEQ ID NO: 1946988 - protein, 11 aa, Staphylococcus
GTAVSNNETQV

SEQ ID NO: 1946989 - protein, 4 aa, Staphylococcus
GTCM

SEQ ID NO: 1946990 - protein, 7 aa, Staphylococcus
GTCMTSE

SEQ ID NO: 1946991 - protein, 7 aa, Staphylococcus
GTCPSST

SEQ ID NO: 1946992 - protein, 5 aa, Staphylococcus
GTDGK

SEQ ID NO: 1946993 - protein, 4 aa, Staphylococcus
GTDI

SEQ ID NO: 1946994 - protein, 4 aa, Staphylococcus
GTDN

SEQ ID NO: 1946995 - protein, 4 aa, Staphylococcus
GTDQ

SEQ ID NO: 1946996 - protein, 6 aa, Staphylococcus
GTDRSC

SEQ ID NO: 1946997 - protein, 9 aa, Staphylococcus
GTDRYSRKI

SEQ ID NO: 1946998 - protein, 4 aa, Staphylococcus
GTDS

SEQ ID NO: 1946999 - protein, 10 aa, Staphylococcus
GTDSRESFPQ

SEQ ID NO: 1947000 - protein, 19 aa, Staphylococcus
GTDSRPEDRDEATAATTAY

SEQ ID NO: 1947001 - protein, 8 aa, Staphylococcus
GTDTLEET

SEQ ID NO: 1947002 - protein, 5 aa, Staphylococcus
GTDTR

SEQ ID NO: 1947003 - protein, 6 aa, Staphylococcus
GTDTYS

SEQ ID NO: 1947004 - protein, 9 aa, Staphylococcus
GTDVNKPII

SEQ ID NO: 1947005 - protein, 13 aa, Staphylococcus
GTEAAKGNTLTKK

SEQ ID NO: 1947006 - protein, 14 aa, Staphylococcus
GTEAAKGNTLTKKS

SEQ ID NO: 1947007 - protein, 24 aa, Staphylococcus
GTEADTFEYSEEAVEKAAGNNNEL

SEQ ID NO: 1947008 - protein, 7 aa, Staphylococcus
GTEDKTY

SEQ ID NO: 1947009 - protein, 8 aa, Staphylococcus
GTEDKTYL

SEQ ID NO: 1947010 - protein, 12 aa, Staphylococcus
GTEDNPGAYTNT

SEQ ID NO: 1947011 - protein, 13 aa, Staphylococcus
GTEDQDKASTFGL

SEQ ID NO: 1947012 - protein, 10 aa, Staphylococcus
GTEESPGETE

SEQ ID NO: 1947013 - protein, 12 aa, Staphylococcus
GTEHDPQNYEEQ

SEQ ID NO: 1947014 - protein, 4 aa, Staphylococcus
GTEI

SEQ ID NO: 1947015 - protein, 10 aa, Staphylococcus
GTEIKQGNDT

SEQ ID NO: 1947016 - protein, 5 aa, Staphylococcus
GTELG

SEQ ID NO: 1947017 - protein, 7 aa, Staphylococcus
GTENADD

SEQ ID NO: 1947018 - protein, 7 aa, Staphylococcus
GTENAED

SEQ ID NO: 1947019 - protein, 5 aa, Staphylococcus
GTENI

SEQ ID NO: 1947020 - protein, 5 aa, Staphylococcus
GTENP

SEQ ID NO: 1947021 - protein, 4 aa, Staphylococcus
GTEP

SEQ ID NO: 1947022 - protein, 14 aa, Staphylococcus
GTEPAKGNALTKKT

SEQ ID NO: 1947023 - protein, 14 aa, Staphylococcus
GTEPAKGNTLTKKS

SEQ ID NO: 1947024 - protein, 8 aa, Staphylococcus
GTEPDSET

SEQ ID NO: 1947025 - protein, 13 aa, Staphylococcus
GTEPKEPADIGTD

SEQ ID NO: 1947026 - protein, 13 aa, Staphylococcus
GTEPKKGNSLTKE

SEQ ID NO: 1947027 - protein, 17 aa, Staphylococcus
GTEPLDNTSIHPESYQA

SEQ ID NO: 1947028 - protein, 7 aa, Staphylococcus
GTEPNSA

SEQ ID NO: 1947029 - protein, 4 aa, Staphylococcus
GTEQ

SEQ ID NO: 1947030 - protein, 5 aa, Staphylococcus
GTEQI

SEQ ID NO: 1947031 - protein, 7 aa, Staphylococcus
GTEQRQI

SEQ ID NO: 1947032 - protein, 6 aa, Staphylococcus
GTERHW

SEQ ID NO: 1947033 - protein, 11 aa, Staphylococcus
GTERVDNENTY

SEQ ID NO: 1947034 - protein, 14 aa, Staphylococcus
GTESATRADSGDVI

SEQ ID NO: 1947035 - protein, 13 aa, Staphylococcus
GTETGNAEEIAET

SEQ ID NO: 1947036 - protein, 7 aa, Staphylococcus
GTETLPK

SEQ ID NO: 1947037 - protein, 4 aa, Staphylococcus
GTEV

SEQ ID NO: 1947038 - protein, 10 aa, Staphylococcus
GTEVKRGDDT

SEQ ID NO: 1947039 - protein, 12 aa, Staphylococcus
GTEVSKGDVAPN

SEQ ID NO: 1947040 - protein, 16 aa, Staphylococcus
GTEVTVDNPAQMPERD

SEQ ID NO: 1947041 - protein, 4 aa, Staphylococcus
GTEW

SEQ ID NO: 1947042 - protein, 4 aa, Staphylococcus
GTFN

SEQ ID NO: 1947043 - protein, 4 aa, Staphylococcus
GTFR

SEQ ID NO: 1947044 - protein, 7 aa, Staphylococcus
GTFSKQN

SEQ ID NO: 1947045 - protein, 5 aa, Staphylococcus
GTFSQ

SEQ ID NO: 1947046 - protein, 12 aa, Staphylococcus
GTFVKEQDNSIL

SEQ ID NO: 1947047 - protein, 7 aa, Staphylococcus
GTGAGSD

SEQ ID NO: 1947048 - protein, 8 aa, Staphylococcus
GTGDHPTT

SEQ ID NO: 1947049 - protein, 9 aa, Staphylococcus
GTGDQKINL

SEQ ID NO: 1947050 - protein, 11 aa, Staphylococcus
GTGEDIHPSTL

SEQ ID NO: 1947051 - protein, 9 aa, Staphylococcus
GTGEEIEEP

SEQ ID NO: 1947052 - protein, 13 aa, Staphylococcus
GTGGGEKLAEELQ

SEQ ID NO: 1947053 - protein, 12 aa, Staphylococcus
GTGHDGNTEYAG

SEQ ID NO: 1947054 - protein, 7 aa, Staphylococcus
GTGHVDA

SEQ ID NO: 1947055 - protein, 9 aa, Staphylococcus
GTGHVDATD

SEQ ID NO: 1947056 - protein, 9 aa, Staphylococcus
GTGIDEESA

SEQ ID NO: 1947057 - protein, 6 aa, Staphylococcus
GTGKSH

SEQ ID NO: 1947058 - protein, 9 aa, Staphylococcus
GTGKSTIGE

SEQ ID NO: 1947059 - protein, 8 aa, Staphylococcus
GTGKSTVS

SEQ ID NO: 1947060 - protein, 25 aa, Staphylococcus
GTGKTTLSAAADRKLIGDDEHGWNK

SEQ ID NO: 1947061 - protein, 15 aa, Staphylococcus
GTGKTTLSADPTRKL

SEQ ID NO: 1947062 - protein, 15 aa, Staphylococcus
GTGKTTLSATPNRKL

SEQ ID NO: 1947063 - protein, 9 aa, Staphylococcus
GTGKVPESK

SEQ ID NO: 1947064 - protein, 8 aa, Staphylococcus
GTGKVSEA

SEQ ID NO: 1947065 - protein, 10 aa, Staphylococcus
GTGKVSESEL

SEQ ID NO: 1947066 - protein, 8 aa, Staphylococcus
GTGLGIPQ

SEQ ID NO: 1947067 - protein, 7 aa, Staphylococcus
GTGMGLP

SEQ ID NO: 1947068 - protein, 9 aa, Staphylococcus
GTGMGLPGS

SEQ ID NO: 1947069 - protein, 4 aa, Staphylococcus
GTGN

SEQ ID NO: 1947070 - protein, 12 aa, Staphylococcus
GTGNDGNTDYAG

SEQ ID NO: 1947071 - protein, 11 aa, Staphylococcus
GTGQTYTNGIK

SEQ ID NO: 1947072 - protein, 8 aa, Staphylococcus
GTGQYPKW

SEQ ID NO: 1947073 - protein, 9 aa, Staphylococcus
GTGQYPKYK

SEQ ID NO: 1947074 - protein, 8 aa, Staphylococcus
GTGSGNIP

SEQ ID NO: 1947075 - protein, 10 aa, Staphylococcus
GTGSLDKKLT

SEQ ID NO: 1947076 - protein, 7 aa, Staphylococcus
GTGSLTA

SEQ ID NO: 1947077 - protein, 8 aa, Staphylococcus
GTGSNDAI

SEQ ID NO: 1947078 - protein, 10 aa, Staphylococcus
GTGSYRKPSY

SEQ ID NO: 1947079 - protein, 9 aa, Staphylococcus
GTGTALETS

SEQ ID NO: 1947080 - protein, 8 aa, Staphylococcus
GTGTFTYN

SEQ ID NO: 1947081 - protein, 5 aa, Staphylococcus
GTGTL

SEQ ID NO: 1947082 - protein, 15 aa, Staphylococcus
GTGTNATKKSLEASL

SEQ ID NO: 1947083 - protein, 10 aa, Staphylococcus
GTGTNLESSR

SEQ ID NO: 1947084 - protein, 22 aa, Staphylococcus
GTGTNNTAKSIQASQRAKALGA

SEQ ID NO: 1947085 - protein, 15 aa, Staphylococcus
GTGTNNTEKSIQASV

SEQ ID NO: 1947086 - protein, 22 aa, Staphylococcus
GTGTNNTQKSIEASKRAKEIGA

SEQ ID NO: 1947087 - protein, 15 aa, Staphylococcus
GTGTNNTQKSIQASV

SEQ ID NO: 1947088 - protein, 10 aa, Staphylococcus
GTGTQSNLSA

SEQ ID NO: 1947089 - protein, 7 aa, Staphylococcus
GTGTQTN

SEQ ID NO: 1947090 - protein, 6 aa, Staphylococcus
GTGTSI

SEQ ID NO: 1947091 - protein, 5 aa, Staphylococcus
GTGTT

SEQ ID NO: 1947092 - protein, 5 aa, Staphylococcus
GTGVI

SEQ ID NO: 1947093 - protein, 5 aa, Staphylococcus
GTGVL

SEQ ID NO: 1947094 - protein, 18 aa, Staphylococcus
GTGVVKASKRLKQPLPQR

SEQ ID NO: 1947095 - protein, 6 aa, Staphylococcus
GTHAGK

SEQ ID NO: 1947096 - protein, 6 aa, Staphylococcus
GTHAGR

SEQ ID NO: 1947097 - protein, 6 aa, Staphylococcus
GTHQDG

SEQ ID NO: 1947098 - protein, 6 aa, Staphylococcus
GTIAAT

SEQ ID NO: 1947099 - protein, 4 aa, Staphylococcus
GTID

SEQ ID NO: 1947100 - protein, 10 aa, Staphylococcus
GTIDDPIDET

SEQ ID NO: 1947101 - protein, 9 aa, Staphylococcus
GTIDDPLDE

SEQ ID NO: 1947102 - protein, 5 aa, Staphylococcus
GTIEA

SEQ ID NO: 1947103 - protein, 8 aa, Staphylococcus
GTIEETED

SEQ ID NO: 1947104 - protein, 8 aa, Staphylococcus
GTIEGELN

SEQ ID NO: 1947105 - protein, 5 aa, Staphylococcus
GTIEN

SEQ ID NO: 1947106 - protein, 18 aa, Staphylococcus
GTIENGEISPFGAVVINV

SEQ ID NO: 1947107 - protein, 4 aa, Staphylococcus
GTIN

SEQ ID NO: 1947108 - protein, 8 aa, Staphylococcus
GTIPQQTA

SEQ ID NO: 1947109 - protein, 14 aa, Staphylococcus
GTIQRGTTPDEDLA

SEQ ID NO: 1947110 - protein, 6 aa, Staphylococcus
GTIREI

SEQ ID NO: 1947111 - protein, 4 aa, Staphylococcus
GTIS

SEQ ID NO: 1947112 - protein, 5 aa, Staphylococcus
GTITD

SEQ ID NO: 1947113 - protein, 7 aa, Staphylococcus
GTITSEK

SEQ ID NO: 1947114 - protein, 6 aa, Staphylococcus
GTIYSR

SEQ ID NO: 1947115 - protein, 6 aa, Staphylococcus
GTKEHV

SEQ ID NO: 1947116 - protein, 6 aa, Staphylococcus
GTKFKE

SEQ ID NO: 1947117 - protein, 8 aa, Staphylococcus
GTKGIGAS

SEQ ID NO: 1947118 - protein, 8 aa, Staphylococcus
GTKGKRFA

SEQ ID NO: 1947119 - protein, 12 aa, Staphylococcus
GTKISKAASNIQ

SEQ ID NO: 1947120 - protein, 5 aa, Staphylococcus
GTKKV

SEQ ID NO: 1947121 - protein, 5 aa, Staphylococcus
GTKLY

SEQ ID NO: 1947122 - protein, 8 aa, Staphylococcus
GTKNDGAD

SEQ ID NO: 1947123 - protein, 8 aa, Staphylococcus
GTKPIQFE

SEQ ID NO: 1947124 - protein, 8 aa, Staphylococcus
GTKQKQFG

SEQ ID NO: 1947125 - protein, 4 aa, Staphylococcus
GTKR

SEQ ID NO: 1947126 - protein, 10 aa, Staphylococcus
GTKRVDNAHS

SEQ ID NO: 1947127 - protein, 10 aa, Staphylococcus
GTKSEALKRE

SEQ ID NO: 1947128 - protein, 14 aa, Staphylococcus
GTKTETSDRTVDVP

SEQ ID NO: 1947129 - protein, 6 aa, Staphylococcus
GTKTLE

SEQ ID NO: 1947130 - protein, 5 aa, Staphylococcus
GTKVK

SEQ ID NO: 1947131 - protein, 12 aa, Staphylococcus
GTKVKSSDTVEV

SEQ ID NO: 1947132 - protein, 22 aa, Staphylococcus
GTKVREKLRNGEALPTKFSRPE

SEQ ID NO: 1947133 - protein, 22 aa, Staphylococcus
GTKVREKLRNGESLPKEFSRPE

SEQ ID NO: 1947134 - protein, 8 aa, Staphylococcus
GTKVTRKE

SEQ ID NO: 1947135 - protein, 10 aa, Staphylococcus
GTLDQETLET

SEQ ID NO: 1947136 - protein, 9 aa, Staphylococcus
GTLDSNYEQ

SEQ ID NO: 1947137 - protein, 5 aa, Staphylococcus
GTLED

SEQ ID NO: 1947138 - protein, 19 aa, Staphylococcus
GTLKGSTTSDKKKARKYQD

SEQ ID NO: 1947139 - protein, 4 aa, Staphylococcus
GTLN

SEQ ID NO: 1947140 - protein, 5 aa, Staphylococcus
GTLNE

SEQ ID NO: 1947141 - protein, 23 aa, Staphylococcus
GTLNYSKNQSYQQGMCQITFKKN

SEQ ID NO: 1947142 - protein, 7 aa, Staphylococcus
GTLPYEK

SEQ ID NO: 1947143 - protein, 10 aa, Staphylococcus
GTLSGNPLAM

SEQ ID NO: 1947144 - protein, 5 aa, Staphylococcus
GTLSH

SEQ ID NO: 1947145 - protein, 8 aa, Staphylococcus
GTLTGKDF

SEQ ID NO: 1947146 - protein, 6 aa, Staphylococcus
GTMDYP

SEQ ID NO: 1947147 - protein, 11 aa, Staphylococcus
GTMGQRWEEGK

SEQ ID NO: 1947148 - protein, 5 aa, Staphylococcus
GTMGS

SEQ ID NO: 1947149 - protein, 17 aa, Staphylococcus
GTMNGENVLNTAEQLMT

SEQ ID NO: 1947150 - protein, 7 aa, Staphylococcus
GTNAGGI

SEQ ID NO: 1947151 - protein, 4 aa, Staphylococcus
GTND

SEQ ID NO: 1947152 - protein, 11 aa, Staphylococcus
GTNDIPREKPY

SEQ ID NO: 1947153 - protein, 7 aa, Staphylococcus
GTNDMGK

SEQ ID NO: 1947154 - protein, 25 aa, Staphylococcus
GTNDRIAQDDDKATFASNISREDER

SEQ ID NO: 1947155 - protein, 11 aa, Staphylococcus
GTNEDSVYEET

SEQ ID NO: 1947156 - protein, 8 aa, Staphylococcus
GTNEESIY

SEQ ID NO: 1947157 - protein, 10 aa, Staphylococcus
GTNGIKPKHQ

SEQ ID NO: 1947158 - protein, 11 aa, Staphylococcus
GTNGKTTTSSL

SEQ ID NO: 1947159 - protein, 6 aa, Staphylococcus
GTNGRQ

SEQ ID NO: 1947160 - protein, 7 aa, Staphylococcus
GTNGTGD

SEQ ID NO: 1947161 - protein, 16 aa, Staphylococcus
GTNGYLADYGDAGSLA

SEQ ID NO: 1947162 - protein, 4 aa, Staphylococcus
GTNK

SEQ ID NO: 1947163 - protein, 10 aa, Staphylococcus
GTNKESVKTM

SEQ ID NO: 1947164 - protein, 19 aa, Staphylococcus
GTNKTNKYYNDSKATNTLA

SEQ ID NO: 1947165 - protein, 4 aa, Staphylococcus
GTNL

SEQ ID NO: 1947166 - protein, 15 aa, Staphylococcus
GTNLIGQSQTGTGKS

SEQ ID NO: 1947167 - protein, 4 aa, Staphylococcus
GTNN

SEQ ID NO: 1947168 - protein, 11 aa, Staphylococcus
GTNNKGKLGAN

SEQ ID NO: 1947169 - protein, 9 aa, Staphylococcus
GTNQYETLS

SEQ ID NO: 1947170 - protein, 7 aa, Staphylococcus
GTNRSVG

SEQ ID NO: 1947171 - protein, 11 aa, Staphylococcus
GTNTLASDIPA

SEQ ID NO: 1947172 - protein, 4 aa, Staphylococcus
GTNV

SEQ ID NO: 1947173 - protein, 13 aa, Staphylococcus
GTNVERGKEILND

SEQ ID NO: 1947174 - protein, 13 aa, Staphylococcus
GTNVEYDQALIQI

SEQ ID NO: 1947175 - protein, 13 aa, Staphylococcus
GTNVEYDQVLVKV

SEQ ID NO: 1947176 - protein, 12 aa, Staphylococcus
GTNVKRGKEILN

SEQ ID NO: 1947177 - protein, 12 aa, Staphylococcus
GTPAKPVSDIKN

SEQ ID NO: 1947178 - protein, 14 aa, Staphylococcus
GTPAVTTRGFDTDA

SEQ ID NO: 1947179 - protein, 8 aa, Staphylococcus
GTPEQSGH

SEQ ID NO: 1947180 - protein, 5 aa, Staphylococcus
GTPFE

SEQ ID NO: 1947181 - protein, 7 aa, Staphylococcus
GTPFEHR

SEQ ID NO: 1947182 - protein, 10 aa, Staphylococcus
GTPGDSVQYK

SEQ ID NO: 1947183 - protein, 5 aa, Staphylococcus
GTPIE

SEQ ID NO: 1947184 - protein, 6 aa, Staphylococcus
GTPIND

SEQ ID NO: 1947185 - protein, 17 aa, Staphylococcus
GTPIRLTGQDSERGTFS

SEQ ID NO: 1947186 - protein, 6 aa, Staphylococcus
GTPKQR

SEQ ID NO: 1947187 - protein, 11 aa, Staphylococcus
GTPLPQQEAYN

SEQ ID NO: 1947188 - protein, 4 aa, Staphylococcus
GTPN

SEQ ID NO: 1947189 - protein, 11 aa, Staphylococcus
GTPNDESEIED

SEQ ID NO: 1947190 - protein, 7 aa, Staphylococcus
GTPNELK

SEQ ID NO: 1947191 - protein, 6 aa, Staphylococcus
GTPNVG

SEQ ID NO: 1947192 - protein, 9 aa, Staphylococcus
GTPQAPGQI

SEQ ID NO: 1947193 - protein, 9 aa, Staphylococcus
GTPQAVKPS

SEQ ID NO: 1947194 - protein, 6 aa, Staphylococcus
GTPQEI

SEQ ID NO: 1947195 - protein, 5 aa, Staphylococcus
GTPQH

SEQ ID NO: 1947196 - protein, 18 aa, Staphylococcus
GTPRFEENASLDGRATAD

SEQ ID NO: 1947197 - protein, 18 aa, Staphylococcus
GTPRFEENASQDGRATAD

SEQ ID NO: 1947198 - protein, 18 aa, Staphylococcus
GTPRFEENQSQDGRSTAD

SEQ ID NO: 1947199 - protein, 13 aa, Staphylococcus
GTPSKKDKEDDYY

SEQ ID NO: 1947200 - protein, 7 aa, Staphylococcus
GTPTFES

SEQ ID NO: 1947201 - protein, 12 aa, Staphylococcus
GTPVASTDKNTQ

SEQ ID NO: 1947202 - protein, 8 aa, Staphylococcus
GTPYPDDL

SEQ ID NO: 1947203 - protein, 12 aa, Staphylococcus
GTQDGVKIINKS

SEQ ID NO: 1947204 - protein, 6 aa, Staphylococcus
GTQDRT

SEQ ID NO: 1947205 - protein, 5 aa, Staphylococcus
GTQGK

SEQ ID NO: 1947206 - protein, 10 aa, Staphylococcus
GTQIADPKRR

SEQ ID NO: 1947207 - protein, 5 aa, Staphylococcus
GTQIS

SEQ ID NO: 1947208 - protein, 8 aa, Staphylococcus
GTQISQEH

SEQ ID NO: 1947209 - protein, 5 aa, Staphylococcus
GTQKQ

SEQ ID NO: 1947210 - protein, 4 aa, Staphylococcus
GTQL

SEQ ID NO: 1947211 - protein, 5 aa, Staphylococcus
GTQLD

SEQ ID NO: 1947212 - protein, 10 aa, Staphylococcus
GTQLDLTKTE

SEQ ID NO: 1947213 - protein, 5 aa, Staphylococcus
GTQLS

SEQ ID NO: 1947214 - protein, 14 aa, Staphylococcus
GTQLSVPQAPFGGI

SEQ ID NO: 1947215 - protein, 4 aa, Staphylococcus
GTQM

SEQ ID NO: 1947216 - protein, 8 aa, Staphylococcus
GTQPSYST

SEQ ID NO: 1947217 - protein, 7 aa, Staphylococcus
GTQRAGL

SEQ ID NO: 1947218 - protein, 8 aa, Staphylococcus
GTQSDDAI

SEQ ID NO: 1947219 - protein, 8 aa, Staphylococcus
GTQSKISG

SEQ ID NO: 1947220 - protein, 13 aa, Staphylococcus
GTQVEHAGREGLG

SEQ ID NO: 1947221 - protein, 4 aa, Staphylococcus
GTRE

SEQ ID NO: 1947222 - protein, 8 aa, Staphylococcus
GTRGFHAG

SEQ ID NO: 1947223 - protein, 9 aa, Staphylococcus
GTRGFKQGH

SEQ ID NO: 1947224 - protein, 4 aa, Staphylococcus
GTRL

SEQ ID NO: 1947225 - protein, 7 aa, Staphylococcus
GTRQYTK

SEQ ID NO: 1947226 - protein, 5 aa, Staphylococcus
GTRTE

SEQ ID NO: 1947227 - protein, 7 aa, Staphylococcus
GTRYNRE

SEQ ID NO: 1947228 - protein, 6 aa, Staphylococcus
GTRYRP

SEQ ID NO: 1947229 - protein, 6 aa, Staphylococcus
GTSAGS

SEQ ID NO: 1947230 - protein, 9 aa, Staphylococcus
GTSAGSQVG

SEQ ID NO: 1947231 - protein, 10 aa, Staphylococcus
GTSAGSQVGA

SEQ ID NO: 1947232 - protein, 15 aa, Staphylococcus
GTSAGSQVGATLSSP

SEQ ID NO: 1947233 - protein, 24 aa, Staphylococcus
GTSAGYVGYDDNSNTLTEKVRRNP

SEQ ID NO: 1947234 - protein, 8 aa, Staphylococcus
GTSAYSRT

SEQ ID NO: 1947235 - protein, 10 aa, Staphylococcus
GTSEVQETAV

SEQ ID NO: 1947236 - protein, 5 aa, Staphylococcus
GTSFN

SEQ ID NO: 1947237 - protein, 8 aa, Staphylococcus
GTSGCSEA

SEQ ID NO: 1947238 - protein, 6 aa, Staphylococcus
GTSGLG

SEQ ID NO: 1947239 - protein, 10 aa, Staphylococcus
GTSGSLNRHA

SEQ ID NO: 1947240 - protein, 4 aa, Staphylococcus
GTSI

SEQ ID NO: 1947241 - protein, 10 aa, Staphylococcus
GTSIDDESAI

SEQ ID NO: 1947242 - protein, 11 aa, Staphylococcus
GTSIDDESAVE

SEQ ID NO: 1947243 - protein, 6 aa, Staphylococcus
GTSIEN

SEQ ID NO: 1947244 - protein, 5 aa, Staphylococcus
GTSIN

SEQ ID NO: 1947245 - protein, 8 aa, Staphylococcus
GTSIPGRD

SEQ ID NO: 1947246 - protein, 9 aa, Staphylococcus
GTSKKDETV

SEQ ID NO: 1947247 - protein, 10 aa, Staphylococcus
GTSKTPEGKD

SEQ ID NO: 1947248 - protein, 4 aa, Staphylococcus
GTSL

SEQ ID NO: 1947249 - protein, 5 aa, Staphylococcus
GTSLS

SEQ ID NO: 1947250 - protein, 7 aa, Staphylococcus
GTSLTNY

SEQ ID NO: 1947251 - protein, 14 aa, Staphylococcus
GTSNAKLNGNSIDS

SEQ ID NO: 1947252 - protein, 17 aa, Staphylococcus
GTSPEYNETKNDYSSVD

SEQ ID NO: 1947253 - protein, 12 aa, Staphylococcus
GTSQESSDPSTI

SEQ ID NO: 1947254 - protein, 5 aa, Staphylococcus
GTSQQ

SEQ ID NO: 1947255 - protein, 7 aa, Staphylococcus
GTSQQAV

SEQ ID NO: 1947256 - protein, 4 aa, Staphylococcus
GTSS

SEQ ID NO: 1947257 - protein, 12 aa, Staphylococcus
GTSSRPGANAEY

SEQ ID NO: 1947258 - protein, 8 aa, Staphylococcus
GTSTANKI

SEQ ID NO: 1947259 - protein, 8 aa, Staphylococcus
GTSTAQKI

SEQ ID NO: 1947260 - protein, 8 aa, Staphylococcus
GTSTIPDL

SEQ ID NO: 1947261 - protein, 13 aa, Staphylococcus
GTSTTTEDQTGDI

SEQ ID NO: 1947262 - protein, 17 aa, Staphylococcus
GTTAENPTLSDEEKDEV

SEQ ID NO: 1947263 - protein, 16 aa, Staphylococcus
GTTAESPTLNDEEKEH

SEQ ID NO: 1947264 - protein, 16 aa, Staphylococcus
GTTAESPTLTDNEKAQ

SEQ ID NO: 1947265 - protein, 17 aa, Staphylococcus
GTTAESPTLTDQEKEQV

SEQ ID NO: 1947266 - protein, 17 aa, Staphylococcus
GTTAESPTLTEEEKEQV

SEQ ID NO: 1947267 - protein, 17 aa, Staphylococcus
GTTAESPTLTEEEKETV

SEQ ID NO: 1947268 - protein, 5 aa, Staphylococcus
GTTDE

SEQ ID NO: 1947269 - protein, 10 aa, Staphylococcus
GTTDEAAAKD

SEQ ID NO: 1947270 - protein, 7 aa, Staphylococcus
GTTDGKD

SEQ ID NO: 1947271 - protein, 10 aa, Staphylococcus
GTTEEQHPGV

SEQ ID NO: 1947272 - protein, 7 aa, Staphylococcus
GTTEKAQ

SEQ ID NO: 1947273 - protein, 4 aa, Staphylococcus
GTTG

SEQ ID NO: 1947274 - protein, 8 aa, Staphylococcus
GTTGMPKG

SEQ ID NO: 1947275 - protein, 4 aa, Staphylococcus
GTTI

SEQ ID NO: 1947276 - protein, 6 aa, Staphylococcus
GTTIDR

SEQ ID NO: 1947277 - protein, 6 aa, Staphylococcus
GTTIGR

SEQ ID NO: 1947278 - protein, 9 aa, Staphylococcus
GTTKEEGNI

SEQ ID NO: 1947279 - protein, 6 aa, Staphylococcus
GTTKYD

SEQ ID NO: 1947280 - protein, 16 aa, Staphylococcus
GTTLTHPQNKDYMDTN

SEQ ID NO: 1947281 - protein, 16 aa, Staphylococcus
GTTMYGGTSDSPVTQS

SEQ ID NO: 1947282 - protein, 16 aa, Staphylococcus
GTTNKHHPNEDNVRTY

SEQ ID NO: 1947283 - protein, 7 aa, Staphylococcus
GTTPSDF

SEQ ID NO: 1947284 - protein, 12 aa, Staphylococcus
GTTQGGGTDAGS

SEQ ID NO: 1947285 - protein, 10 aa, Staphylococcus
GTTRGIKGKN

SEQ ID NO: 1947286 - protein, 5 aa, Staphylococcus
GTTSM

SEQ ID NO: 1947287 - protein, 8 aa, Staphylococcus
GTTSTRTL

SEQ ID NO: 1947288 - protein, 29 aa, Staphylococcus
GTTTANKIAEEANVSPETRVKDLTDDELG

SEQ ID NO: 1947289 - protein, 5 aa, Staphylococcus
GTTVA

SEQ ID NO: 1947290 - protein, 12 aa, Staphylococcus
GTTVGDKATEYE

SEQ ID NO: 1947291 - protein, 10 aa, Staphylococcus
GTTVSRASLH

SEQ ID NO: 1947292 - protein, 4 aa, Staphylococcus
GTVD

SEQ ID NO: 1947293 - protein, 7 aa, Staphylococcus
GTVDYGA

SEQ ID NO: 1947294 - protein, 6 aa, Staphylococcus
GTVEKA

SEQ ID NO: 1947295 - protein, 9 aa, Staphylococcus
GTVKTFTGY

SEQ ID NO: 1947296 - protein, 6 aa, Staphylococcus
GTVQGE

SEQ ID NO: 1947297 - protein, 5 aa, Staphylococcus
GTVTD

SEQ ID NO: 1947298 - protein, 21 aa, Staphylococcus
GTVTKRDPDTVNSKIKTGQVE

SEQ ID NO: 1947299 - protein, 6 aa, Staphylococcus
GTVTPQ

SEQ ID NO: 1947300 - protein, 4 aa, Staphylococcus
GTVV

SEQ ID NO: 1947301 - protein, 5 aa, Staphylococcus
GTVVE

SEQ ID NO: 1947302 - protein, 5 aa, Staphylococcus
GTYAQ

SEQ ID NO: 1947303 - protein, 6 aa, Staphylococcus
GTYDKY

SEQ ID NO: 1947304 - protein, 7 aa, Staphylococcus
GTYGPDL

SEQ ID NO: 1947305 - protein, 7 aa, Staphylococcus
GTYKGKE

SEQ ID NO: 1947306 - protein, 8 aa, Staphylococcus
GTYKGKEV

SEQ ID NO: 1947307 - protein, 9 aa, Staphylococcus
GTYKGKEVS

SEQ ID NO: 1947308 - protein, 8 aa, Staphylococcus
GTYNGKEV

SEQ ID NO: 1947309 - protein, 11 aa, Staphylococcus
GTYNPNNVNAA

SEQ ID NO: 1947310 - protein, 9 aa, Staphylococcus
GTYPGSSAR

SEQ ID NO: 1947311 - protein, 26 aa, Staphylococcus
GTYQDIQTAESGSALEVDKPKNKKAI

SEQ ID NO: 1947312 - protein, 6 aa, Staphylococcus
GTYSEA

SEQ ID NO: 1947313 - protein, 5 aa, Staphylococcus
GTYTH

SEQ ID NO: 1947314 - protein, 15 aa, Staphylococcus
GVAKDDLKEENVQAV

SEQ ID NO: 1947315 - protein, 14 aa, Staphylococcus
GVAKDNLKEENVDA

SEQ ID NO: 1947316 - protein, 15 aa, Staphylococcus
GVAKDNLKEENVEAV

SEQ ID NO: 1947317 - protein, 9 aa, Staphylococcus
GVANEELTP

SEQ ID NO: 1947318 - protein, 13 aa, Staphylococcus
GVANNKEILPNTK

SEQ ID NO: 1947319 - protein, 10 aa, Staphylococcus
GVAPSNDKQG

SEQ ID NO: 1947320 - protein, 8 aa, Staphylococcus
GVARPAAS

SEQ ID NO: 1947321 - protein, 10 aa, Staphylococcus
GVASNKGLRA

SEQ ID NO: 1947322 - protein, 4 aa, Staphylococcus
GVDA

SEQ ID NO: 1947323 - protein, 13 aa, Staphylococcus
GVDANDSTSAPVE

SEQ ID NO: 1947324 - protein, 19 aa, Staphylococcus
GVDDKQAIYTEHNDTSKHL

SEQ ID NO: 1947325 - protein, 11 aa, Staphylococcus
GVDDSKKLNDQ

SEQ ID NO: 1947326 - protein, 11 aa, Staphylococcus
GVDDSKKLTDA

SEQ ID NO: 1947327 - protein, 12 aa, Staphylococcus
GVDDSKKLTDDK

SEQ ID NO: 1947328 - protein, 11 aa, Staphylococcus
GVDDSKKLTDT

SEQ ID NO: 1947329 - protein, 25 aa, Staphylococcus
GVDENDSTSAPVEDADYTSDIGKDI

SEQ ID NO: 1947330 - protein, 10 aa, Staphylococcus
GVDGGIGTSF

SEQ ID NO: 1947331 - protein, 14 aa, Staphylococcus
GVDKEKDQVLPGTP

SEQ ID NO: 1947332 - protein, 11 aa, Staphylococcus
GVDMKSPEPIE

SEQ ID NO: 1947333 - protein, 12 aa, Staphylococcus
GVDMTSPKPIEQ

SEQ ID NO: 1947334 - protein, 4 aa, Staphylococcus
GVDP

SEQ ID NO: 1947335 - protein, 6 aa, Staphylococcus
GVDPEE

SEQ ID NO: 1947336 - protein, 8 aa, Staphylococcus
GVDPEIKT

SEQ ID NO: 1947337 - protein, 6 aa, Staphylococcus
GVDPES

SEQ ID NO: 1947338 - protein, 9 aa, Staphylococcus
GVDPSIKTF

SEQ ID NO: 1947339 - protein, 8 aa, Staphylococcus
GVDQGKRG

SEQ ID NO: 1947340 - protein, 6 aa, Staphylococcus
GVDQNK

SEQ ID NO: 1947341 - protein, 6 aa, Staphylococcus
GVDQTR

SEQ ID NO: 1947342 - protein, 14 aa, Staphylococcus
GVDRNDSTSAPVED

SEQ ID NO: 1947343 - protein, 8 aa, Staphylococcus
GVDRSAKR

SEQ ID NO: 1947344 - protein, 4 aa, Staphylococcus
GVDS

SEQ ID NO: 1947345 - protein, 8 aa, Staphylococcus
GVDSDNGI

SEQ ID NO: 1947346 - protein, 4 aa, Staphylococcus
GVDT

SEQ ID NO: 1947347 - protein, 5 aa, Staphylococcus
GVDTD

SEQ ID NO: 1947348 - protein, 8 aa, Staphylococcus
GVDTRSIT

SEQ ID NO: 1947349 - protein, 9 aa, Staphylococcus
GVDTRSITR

SEQ ID NO: 1947350 - protein, 7 aa, Staphylococcus
GVDTTTI

SEQ ID NO: 1947351 - protein, 14 aa, Staphylococcus
GVDYDSANPPLYDS

SEQ ID NO: 1947352 - protein, 13 aa, Staphylococcus
GVEATEQVKKDLP

SEQ ID NO: 1947353 - protein, 5 aa, Staphylococcus
GVEDG

SEQ ID NO: 1947354 - protein, 9 aa, Staphylococcus
GVEEAIQGA

SEQ ID NO: 1947355 - protein, 18 aa, Staphylococcus
GVEEQADEVQKVKRSENG

SEQ ID NO: 1947356 - protein, 5 aa, Staphylococcus
GVEER

SEQ ID NO: 1947357 - protein, 9 aa, Staphylococcus
GVEGYTPDH

SEQ ID NO: 1947358 - protein, 10 aa, Staphylococcus
GVEGYTPDHG

SEQ ID NO: 1947359 - protein, 11 aa, Staphylococcus
GVEGYTSDRGL

SEQ ID NO: 1947360 - protein, 5 aa, Staphylococcus
GVEIT

SEQ ID NO: 1947361 - protein, 19 aa, Staphylococcus
GVELNKGRIGAKEGPNAIK

SEQ ID NO: 1947362 - protein, 19 aa, Staphylococcus
GVELNKGRVGAKEGPNKIK

SEQ ID NO: 1947363 - protein, 19 aa, Staphylococcus
GVELNNGRVGAQEGPDAVR

SEQ ID NO: 1947364 - protein, 13 aa, Staphylococcus
GVELRKTGRLGDL

SEQ ID NO: 1947365 - protein, 5 aa, Staphylococcus
GVEPG

SEQ ID NO: 1947366 - protein, 13 aa, Staphylococcus
GVEPNEINTQIAN

SEQ ID NO: 1947367 - protein, 6 aa, Staphylococcus
GVEQSK

SEQ ID NO: 1947368 - protein, 4 aa, Staphylococcus
GVER

SEQ ID NO: 1947369 - protein, 10 aa, Staphylococcus
GVESTSRAPW

SEQ ID NO: 1947370 - protein, 6 aa, Staphylococcus
GVETPN

SEQ ID NO: 1947371 - protein, 17 aa, Staphylococcus
GVFDGSKPIEFDDNREW

SEQ ID NO: 1947372 - protein, 4 aa, Staphylococcus
GVFS

SEQ ID NO: 1947373 - protein, 10 aa, Staphylococcus
GVFTEEGGPF

SEQ ID NO: 1947374 - protein, 10 aa, Staphylococcus
GVGAAATGLR

SEQ ID NO: 1947375 - protein, 8 aa, Staphylococcus
GVGAADIP

SEQ ID NO: 1947376 - protein, 21 aa, Staphylococcus
GVGANSEQLSAMNHDSLIKEF

SEQ ID NO: 1947377 - protein, 10 aa, Staphylococcus
GVGASGIGQY

SEQ ID NO: 1947378 - protein, 6 aa, Staphylococcus
GVGEKT

SEQ ID NO: 1947379 - protein, 6 aa, Staphylococcus
GVGENF

SEQ ID NO: 1947380 - protein, 7 aa, Staphylococcus
GVGHETN

SEQ ID NO: 1947381 - protein, 4 aa, Staphylococcus
GVGI

SEQ ID NO: 1947382 - protein, 9 aa, Staphylococcus
GVGKSTLTK

SEQ ID NO: 1947383 - protein, 7 aa, Staphylococcus
GVGKTTV

SEQ ID NO: 1947384 - protein, 7 aa, Staphylococcus
GVGNDSL

SEQ ID NO: 1947385 - protein, 5 aa, Staphylococcus
GVGNE

SEQ ID NO: 1947386 - protein, 9 aa, Staphylococcus
GVGPQQREM

SEQ ID NO: 1947387 - protein, 13 aa, Staphylococcus
GVGQYNNGEIDKE

SEQ ID NO: 1947388 - protein, 5 aa, Staphylococcus
GVGSD

SEQ ID NO: 1947389 - protein, 5 aa, Staphylococcus
GVGSN

SEQ ID NO: 1947390 - protein, 4 aa, Staphylococcus
GVGT

SEQ ID NO: 1947391 - protein, 15 aa, Staphylococcus
GVGTEIAEGKETRVF

SEQ ID NO: 1947392 - protein, 5 aa, Staphylococcus
GVGTT

SEQ ID NO: 1947393 - protein, 6 aa, Staphylococcus
GVGVQE

SEQ ID NO: 1947394 - protein, 8 aa, Staphylococcus
GVGVQTAG

SEQ ID NO: 1947395 - protein, 11 aa, Staphylococcus
GVHPNKNGGYA

SEQ ID NO: 1947396 - protein, 7 aa, Staphylococcus
GVIDETN

SEQ ID NO: 1947397 - protein, 7 aa, Staphylococcus
GVIGDGN

SEQ ID NO: 1947398 - protein, 24 aa, Staphylococcus
GVINTADELNGYNEDRAKENIEGI

SEQ ID NO: 1947399 - protein, 4 aa, Staphylococcus
GVIP

SEQ ID NO: 1947400 - protein, 8 aa, Staphylococcus
GVIPGGAL

SEQ ID NO: 1947401 - protein, 9 aa, Staphylococcus
GVKAGKRHQ

SEQ ID NO: 1947402 - protein, 6 aa, Staphylococcus
GVKEPL

SEQ ID NO: 1947403 - protein, 4 aa, Staphylococcus
GVKG

SEQ ID NO: 1947404 - protein, 4 aa, Staphylococcus
GVKK

SEQ ID NO: 1947405 - protein, 7 aa, Staphylococcus
GVKKENI

SEQ ID NO: 1947406 - protein, 6 aa, Staphylococcus
GVKNGG

SEQ ID NO: 1947407 - protein, 10 aa, Staphylococcus
GVKPQTASEH

SEQ ID NO: 1947408 - protein, 5 aa, Staphylococcus
GVKQG

SEQ ID NO: 1947409 - protein, 8 aa, Staphylococcus
GVKSGVVA

SEQ ID NO: 1947410 - protein, 6 aa, Staphylococcus
GVKTGS

SEQ ID NO: 1947411 - protein, 12 aa, Staphylococcus
GVLERTGHTEAA

SEQ ID NO: 1947412 - protein, 15 aa, Staphylococcus
GVLSPGDKLPSQREI

SEQ ID NO: 1947413 - protein, 12 aa, Staphylococcus
GVLSRRGHTEAS

SEQ ID NO: 1947414 - protein, 25 aa, Staphylococcus
GVLSTKAVAGTIPRTQDAEKDEKNV

SEQ ID NO: 1947415 - protein, 9 aa, Staphylococcus
GVNEGKRHQ

SEQ ID NO: 1947416 - protein, 16 aa, Staphylococcus
GVNEPKTKSKNNPKHF

SEQ ID NO: 1947417 - protein, 8 aa, Staphylococcus
GVNGNFGE

SEQ ID NO: 1947418 - protein, 5 aa, Staphylococcus
GVNIG

SEQ ID NO: 1947419 - protein, 15 aa, Staphylococcus
GVNKPNTDGDKPAWF

SEQ ID NO: 1947420 - protein, 9 aa, Staphylococcus
GVNNGKRHQ

SEQ ID NO: 1947421 - protein, 7 aa, Staphylococcus
GVNPEEL

SEQ ID NO: 1947422 - protein, 9 aa, Staphylococcus
GVNPSSDGE

SEQ ID NO: 1947423 - protein, 5 aa, Staphylococcus
GVNQE

SEQ ID NO: 1947424 - protein, 5 aa, Staphylococcus
GVNVP

SEQ ID NO: 1947425 - protein, 9 aa, Staphylococcus
GVPDTTPAM

SEQ ID NO: 1947426 - protein, 9 aa, Staphylococcus
GVPEGTAIE

SEQ ID NO: 1947427 - protein, 5 aa, Staphylococcus
GVPES

SEQ ID NO: 1947428 - protein, 16 aa, Staphylococcus
GVPGGQMANTEDVENF

SEQ ID NO: 1947429 - protein, 6 aa, Staphylococcus
GVPGIS

SEQ ID NO: 1947430 - protein, 7 aa, Staphylococcus
GVPGISE

SEQ ID NO: 1947431 - protein, 13 aa, Staphylococcus
GVPGRHNDDSPTI

SEQ ID NO: 1947432 - protein, 6 aa, Staphylococcus
GVPLTE

SEQ ID NO: 1947433 - protein, 16 aa, Staphylococcus
GVPNHENSHPHQSATK

SEQ ID NO: 1947434 - protein, 9 aa, Staphylococcus
GVPNTTPAM

SEQ ID NO: 1947435 - protein, 16 aa, Staphylococcus
GVPNYENSHPHQSATG

SEQ ID NO: 1947436 - protein, 9 aa, Staphylococcus
GVPQGTDAI

SEQ ID NO: 1947437 - protein, 7 aa, Staphylococcus
GVPRPGT

SEQ ID NO: 1947438 - protein, 5 aa, Staphylococcus
GVPSD

SEQ ID NO: 1947439 - protein, 11 aa, Staphylococcus
GVPSGKAKQKA

SEQ ID NO: 1947440 - protein, 5 aa, Staphylococcus
GVPSN

SEQ ID NO: 1947441 - protein, 6 aa, Staphylococcus
GVPSTA

SEQ ID NO: 1947442 - protein, 13 aa, Staphylococcus
GVPVGSGKTGQEI

SEQ ID NO: 1947443 - protein, 4 aa, Staphylococcus
GVQF

SEQ ID NO: 1947444 - protein, 5 aa, Staphylococcus
GVQFP

SEQ ID NO: 1947445 - protein, 6 aa, Staphylococcus
GVQFPN

SEQ ID NO: 1947446 - protein, 11 aa, Staphylococcus
GVQKDADEVED

SEQ ID NO: 1947447 - protein, 10 aa, Staphylococcus
GVQKDAEEVE

SEQ ID NO: 1947448 - protein, 4 aa, Staphylococcus
GVQM

SEQ ID NO: 1947449 - protein, 10 aa, Staphylococcus
GVQPGSGNFE

SEQ ID NO: 1947450 - protein, 4 aa, Staphylococcus
GVQR

SEQ ID NO: 1947451 - protein, 7 aa, Staphylococcus
GVQSGDR

SEQ ID NO: 1947452 - protein, 9 aa, Staphylococcus
GVQTSNADV

SEQ ID NO: 1947453 - protein, 5 aa, Staphylococcus
GVRGA

SEQ ID NO: 1947454 - protein, 16 aa, Staphylococcus
GVRGFKDTTKTEASYR

SEQ ID NO: 1947455 - protein, 11 aa, Staphylococcus
GVRGSTKQAVE

SEQ ID NO: 1947456 - protein, 7 aa, Staphylococcus
GVRPGEK

SEQ ID NO: 1947457 - protein, 13 aa, Staphylococcus
GVRVTAPDTLQPV

SEQ ID NO: 1947458 - protein, 4 aa, Staphylococcus
GVSC

SEQ ID NO: 1947459 - protein, 8 aa, Staphylococcus
GVSDDELQ

SEQ ID NO: 1947460 - protein, 6 aa, Staphylococcus
GVSDED

SEQ ID NO: 1947461 - protein, 17 aa, Staphylococcus
GVSDENAGAMEFDPYYK

SEQ ID NO: 1947462 - protein, 17 aa, Staphylococcus
GVSDENAGAMEFDPYYQ

SEQ ID NO: 1947463 - protein, 11 aa, Staphylococcus
GVSDPEKKRKI

SEQ ID NO: 1947464 - protein, 8 aa, Staphylococcus
GVSDRSVH

SEQ ID NO: 1947465 - protein, 11 aa, Staphylococcus
GVSEGGRNSSL

SEQ ID NO: 1947466 - protein, 11 aa, Staphylococcus
GVSERGGHPVY

SEQ ID NO: 1947467 - protein, 12 aa, Staphylococcus
GVSFSGETPHDV

SEQ ID NO: 1947468 - protein, 27 aa, Staphylococcus
GVSGGEVGALTGPSIMPGGQKEAYDKV

SEQ ID NO: 1947469 - protein, 11 aa, Staphylococcus
GVSGNMQAKPL

SEQ ID NO: 1947470 - protein, 10 aa, Staphylococcus
GVSGSGKSTL

SEQ ID NO: 1947471 - protein, 12 aa, Staphylococcus
GVSGSNGTALSE

SEQ ID NO: 1947472 - protein, 9 aa, Staphylococcus
GVSKEQVGA

SEQ ID NO: 1947473 - protein, 10 aa, Staphylococcus
GVSKGKGFQG

SEQ ID NO: 1947474 - protein, 11 aa, Staphylococcus
GVSKGKGFQGN

SEQ ID NO: 1947475 - protein, 11 aa, Staphylococcus
GVSKGNAVTDL

SEQ ID NO: 1947476 - protein, 23 aa, Staphylococcus
GVSKGTEKALKSYNKLSKQSTLK

SEQ ID NO: 1947477 - protein, 10 aa, Staphylococcus
GVSKSTVSRY

SEQ ID NO: 1947478 - protein, 7 aa, Staphylococcus
GVSNQTL

SEQ ID NO: 1947479 - protein, 10 aa, Staphylococcus
GVSNSGKSWL

SEQ ID NO: 1947480 - protein, 7 aa, Staphylococcus
GVSPGTV

SEQ ID NO: 1947481 - protein, 19 aa, Staphylococcus
GVSPSELGGDGKLKRQTKD

SEQ ID NO: 1947482 - protein, 34 aa, Staphylococcus
GVSPSELGGDGKLKRQTKEISMDGGNWDKYKNEK

SEQ ID NO: 1947483 - protein, 12 aa, Staphylococcus
GVSQVNRSKREI

SEQ ID NO: 1947484 - protein, 5 aa, Staphylococcus
GVSRP

SEQ ID NO: 1947485 - protein, 11 aa, Staphylococcus
GVSTRPGHTEV

SEQ ID NO: 1947486 - protein, 10 aa, Staphylococcus
GVSTRPGYQE

SEQ ID NO: 1947487 - protein, 5 aa, Staphylococcus
GVSVG

SEQ ID NO: 1947488 - protein, 7 aa, Staphylococcus
GVSYTED

SEQ ID NO: 1947489 - protein, 7 aa, Staphylococcus
GVTADDS

SEQ ID NO: 1947490 - protein, 18 aa, Staphylococcus
GVTAIGGETIEKDGAAPL

SEQ ID NO: 1947491 - protein, 8 aa, Staphylococcus
GVTDDELR

SEQ ID NO: 1947492 - protein, 12 aa, Staphylococcus
GVTEENKNCYKD

SEQ ID NO: 1947493 - protein, 8 aa, Staphylococcus
GVTEGSTN

SEQ ID NO: 1947494 - protein, 5 aa, Staphylococcus
GVTEK

SEQ ID NO: 1947495 - protein, 11 aa, Staphylococcus
GVTETQQRRIA

SEQ ID NO: 1947496 - protein, 14 aa, Staphylococcus
GVTGTIQKVNGGWY

SEQ ID NO: 1947497 - protein, 6 aa, Staphylococcus
GVTKDV

SEQ ID NO: 1947498 - protein, 8 aa, Staphylococcus
GVTNNEKI

SEQ ID NO: 1947499 - protein, 5 aa, Staphylococcus
GVTQE

SEQ ID NO: 1947500 - protein, 10 aa, Staphylococcus
GVTSASAAVA

SEQ ID NO: 1947501 - protein, 6 aa, Staphylococcus
GVTSHP

SEQ ID NO: 1947502 - protein, 6 aa, Staphylococcus
GVTSSQ

SEQ ID NO: 1947503 - protein, 10 aa, Staphylococcus
GVTTDLNNHQ

SEQ ID NO: 1947504 - protein, 12 aa, Staphylococcus
GVTYKEGDITPV

SEQ ID NO: 1947505 - protein, 5 aa, Staphylococcus
GVVDS

SEQ ID NO: 1947506 - protein, 7 aa, Staphylococcus
GVVDSKH

SEQ ID NO: 1947507 - protein, 9 aa, Staphylococcus
GVVDSTRGE

SEQ ID NO: 1947508 - protein, 9 aa, Staphylococcus
GVVENGDTV

SEQ ID NO: 1947509 - protein, 13 aa, Staphylococcus
GVVGSNGNTAPVN

SEQ ID NO: 1947510 - protein, 11 aa, Staphylococcus
GVVPSTPDQFG

SEQ ID NO: 1947511 - protein, 4 aa, Staphylococcus
GVYD

SEQ ID NO: 1947512 - protein, 12 aa, Staphylococcus
GVYDEEDLEYRG

SEQ ID NO: 1947513 - protein, 5 aa, Staphylococcus
GVYDN

SEQ ID NO: 1947514 - protein, 5 aa, Staphylococcus
GVYGQ

SEQ ID NO: 1947515 - protein, 11 aa, Staphylococcus
GVYSGSAFDHN

SEQ ID NO: 1947516 - protein, 6 aa, Staphylococcus
GWEEDA

SEQ ID NO: 1947517 - protein, 11 aa, Staphylococcus
GWGPDYPDPTT

SEQ ID NO: 1947518 - protein, 8 aa, Staphylococcus
GWPKPGVS

SEQ ID NO: 1947519 - protein, 4 aa, Staphylococcus
GWPN

SEQ ID NO: 1947520 - protein, 4 aa, Staphylococcus
GWPQ

SEQ ID NO: 1947521 - protein, 12 aa, Staphylococcus
GWQSEGHTGTPW

SEQ ID NO: 1947522 - protein, 4 aa, Staphylococcus
GWTT

SEQ ID NO: 1947523 - protein, 5 aa, Staphylococcus
GWVTG

SEQ ID NO: 1947524 - protein, 5 aa, Staphylococcus
GYADT

SEQ ID NO: 1947525 - protein, 6 aa, Staphylococcus
GYAERS

SEQ ID NO: 1947526 - protein, 10 aa, Staphylococcus
GYAIDDEENE

SEQ ID NO: 1947527 - protein, 6 aa, Staphylococcus
GYAQRA

SEQ ID NO: 1947528 - protein, 9 aa, Staphylococcus
GYASGFEES

SEQ ID NO: 1947529 - protein, 4 aa, Staphylococcus
GYAV

SEQ ID NO: 1947530 - protein, 8 aa, Staphylococcus
GYAYESGG

SEQ ID NO: 1947531 - protein, 8 aa, Staphylococcus
GYAYESNG

SEQ ID NO: 1947532 - protein, 6 aa, Staphylococcus
GYDAGR

SEQ ID NO: 1947533 - protein, 5 aa, Staphylococcus
GYDFS

SEQ ID NO: 1947534 - protein, 8 aa, Staphylococcus
GYDIEPKA

SEQ ID NO: 1947535 - protein, 17 aa, Staphylococcus
GYDISSGIETDNHKDLN

SEQ ID NO: 1947536 - protein, 10 aa, Staphylococcus
GYDKDEQNYE

SEQ ID NO: 1947537 - protein, 15 aa, Staphylococcus
GYDKPENKAQLTPKQ

SEQ ID NO: 1947538 - protein, 17 aa, Staphylococcus
GYDKPENKAQMTPQEQV

SEQ ID NO: 1947539 - protein, 6 aa, Staphylococcus
GYDKYN

SEQ ID NO: 1947540 - protein, 4 aa, Staphylococcus
GYDR

SEQ ID NO: 1947541 - protein, 6 aa, Staphylococcus
GYDTVS

SEQ ID NO: 1947542 - protein, 14 aa, Staphylococcus
GYEDKGDPSEREIT

SEQ ID NO: 1947543 - protein, 17 aa, Staphylococcus
GYEDRNINGMSGGQKQR

SEQ ID NO: 1947544 - protein, 4 aa, Staphylococcus
GYEG

SEQ ID NO: 1947545 - protein, 10 aa, Staphylococcus
GYEGQQKISQ

SEQ ID NO: 1947546 - protein, 5 aa, Staphylococcus
GYEIE

SEQ ID NO: 1947547 - protein, 4 aa, Staphylococcus
GYEK

SEQ ID NO: 1947548 - protein, 9 aa, Staphylococcus
GYEKPDPKA

SEQ ID NO: 1947549 - protein, 11 aa, Staphylococcus
GYENPVPSEEM

SEQ ID NO: 1947550 - protein, 7 aa, Staphylococcus
GYEPADK

SEQ ID NO: 1947551 - protein, 7 aa, Staphylococcus
GYEPKSI

SEQ ID NO: 1947552 - protein, 12 aa, Staphylococcus
GYEPTDDLKEDI

SEQ ID NO: 1947553 - protein, 4 aa, Staphylococcus
GYEQ

SEQ ID NO: 1947554 - protein, 5 aa, Staphylococcus
GYEQG

SEQ ID NO: 1947555 - protein, 7 aa, Staphylococcus
GYEQRNI

SEQ ID NO: 1947556 - protein, 17 aa, Staphylococcus
GYEQRQIEGMSGGQKQR

SEQ ID NO: 1947557 - protein, 18 aa, Staphylococcus
GYEQRSINDMSGGQKQRV

SEQ ID NO: 1947558 - protein, 10 aa, Staphylococcus
GYESDESNYE

SEQ ID NO: 1947559 - protein, 17 aa, Staphylococcus
GYESRTIEGISGGQKQR

SEQ ID NO: 1947560 - protein, 10 aa, Staphylococcus
GYESTKEQFK

SEQ ID NO: 1947561 - protein, 10 aa, Staphylococcus
GYETTDYQTE

SEQ ID NO: 1947562 - protein, 6 aa, Staphylococcus
GYFGSK

SEQ ID NO: 1947563 - protein, 14 aa, Staphylococcus
GYFPNKNAQQLRGS

SEQ ID NO: 1947564 - protein, 5 aa, Staphylococcus
GYGAE

SEQ ID NO: 1947565 - protein, 10 aa, Staphylococcus
GYGAGSKDFD

SEQ ID NO: 1947566 - protein, 11 aa, Staphylococcus
GYGDEYAPGDS

SEQ ID NO: 1947567 - protein, 10 aa, Staphylococcus
GYGEDAMDAS

SEQ ID NO: 1947568 - protein, 11 aa, Staphylococcus
GYGEDAMDASM

SEQ ID NO: 1947569 - protein, 13 aa, Staphylococcus
GYGEDAMDASYDG

SEQ ID NO: 1947570 - protein, 14 aa, Staphylococcus
GYGEDAMDASYDGL

SEQ ID NO: 1947571 - protein, 8 aa, Staphylococcus
GYGEVNQK

SEQ ID NO: 1947572 - protein, 4 aa, Staphylococcus
GYGL

SEQ ID NO: 1947573 - protein, 4 aa, Staphylococcus
GYGN

SEQ ID NO: 1947574 - protein, 5 aa, Staphylococcus
GYGNE

SEQ ID NO: 1947575 - protein, 6 aa, Staphylococcus
GYGNEF

SEQ ID NO: 1947576 - protein, 11 aa, Staphylococcus
GYGNFSDEEGF

SEQ ID NO: 1947577 - protein, 14 aa, Staphylococcus
GYGNNDDDKKEGIH

SEQ ID NO: 1947578 - protein, 13 aa, Staphylococcus
GYGNNDDDKQEGI

SEQ ID NO: 1947579 - protein, 12 aa, Staphylococcus
GYGPTENTTFTT

SEQ ID NO: 1947580 - protein, 4 aa, Staphylococcus
GYGQ

SEQ ID NO: 1947581 - protein, 12 aa, Staphylococcus
GYGRIANTPEDA

SEQ ID NO: 1947582 - protein, 5 aa, Staphylococcus
GYGSK

SEQ ID NO: 1947583 - protein, 14 aa, Staphylococcus
GYGSPNKSGTHGVH

SEQ ID NO: 1947584 - protein, 9 aa, Staphylococcus
GYGSTGDAY

SEQ ID NO: 1947585 - protein, 6 aa, Staphylococcus
GYHGDT

SEQ ID NO: 1947586 - protein, 8 aa, Staphylococcus
GYHKNAPN

SEQ ID NO: 1947587 - protein, 10 aa, Staphylococcus
GYHKTEYYDD

SEQ ID NO: 1947588 - protein, 27 aa, Staphylococcus
GYHTPENPTDHNDNTPINTSSTSQLNG

SEQ ID NO: 1947589 - protein, 10 aa, Staphylococcus
GYIADTPGFS

SEQ ID NO: 1947590 - protein, 8 aa, Staphylococcus
GYIDPGAQ

SEQ ID NO: 1947591 - protein, 10 aa, Staphylococcus
GYIGDQQLTE

SEQ ID NO: 1947592 - protein, 6 aa, Staphylococcus
GYIGKN

SEQ ID NO: 1947593 - protein, 4 aa, Staphylococcus
GYIK

SEQ ID NO: 1947594 - protein, 8 aa, Staphylococcus
GYKASDDL

SEQ ID NO: 1947595 - protein, 10 aa, Staphylococcus
GYKEKMRKAE

SEQ ID NO: 1947596 - protein, 6 aa, Staphylococcus
GYKESN

SEQ ID NO: 1947597 - protein, 6 aa, Staphylococcus
GYKPSD

SEQ ID NO: 1947598 - protein, 8 aa, Staphylococcus
GYKPSDDL

SEQ ID NO: 1947599 - protein, 11 aa, Staphylococcus
GYKQGVQPYSE

SEQ ID NO: 1947600 - protein, 12 aa, Staphylococcus
GYKSKAINKARI

SEQ ID NO: 1947601 - protein, 10 aa, Staphylococcus
GYKSSGIGRE

SEQ ID NO: 1947602 - protein, 12 aa, Staphylococcus
GYKTPKELISGD

SEQ ID NO: 1947603 - protein, 7 aa, Staphylococcus
GYLDGDR

SEQ ID NO: 1947604 - protein, 12 aa, Staphylococcus
GYNADKRDAYAA

SEQ ID NO: 1947605 - protein, 8 aa, Staphylococcus
GYNDNKAT

SEQ ID NO: 1947606 - protein, 16 aa, Staphylococcus
GYNKESAEAKNIKTKS

SEQ ID NO: 1947607 - protein, 11 aa, Staphylococcus
GYNKSQAKKRA

SEQ ID NO: 1947608 - protein, 4 aa, Staphylococcus
GYNM

SEQ ID NO: 1947609 - protein, 5 aa, Staphylococcus
GYNMS

SEQ ID NO: 1947610 - protein, 23 aa, Staphylococcus
GYNNEGESTSQHAGIKWYNMVKE

SEQ ID NO: 1947611 - protein, 5 aa, Staphylococcus
GYNPD

SEQ ID NO: 1947612 - protein, 11 aa, Staphylococcus
GYNSEISEAQF

SEQ ID NO: 1947613 - protein, 11 aa, Staphylococcus
GYNSGNTNYKD

SEQ ID NO: 1947614 - protein, 9 aa, Staphylococcus
GYNSKEMKQ

SEQ ID NO: 1947615 - protein, 10 aa, Staphylococcus
GYNTYGDLQR

SEQ ID NO: 1947616 - protein, 6 aa, Staphylococcus
GYPGQP

SEQ ID NO: 1947617 - protein, 5 aa, Staphylococcus
GYPMP

SEQ ID NO: 1947618 - protein, 6 aa, Staphylococcus
GYPPDL

SEQ ID NO: 1947619 - protein, 8 aa, Staphylococcus
GYPPSVRE

SEQ ID NO: 1947620 - protein, 9 aa, Staphylococcus
GYPSHSSDK

SEQ ID NO: 1947621 - protein, 6 aa, Staphylococcus
GYPSLS

SEQ ID NO: 1947622 - protein, 54 aa, Staphylococcus
GYQAFQDKAEAEKAQTAPTKNEKEATDSAITETAQETTAPPSLKSRRKKVNYSG

SEQ ID NO: 1947623 - protein, 9 aa, Staphylococcus
GYQESNGSM

SEQ ID NO: 1947624 - protein, 4 aa, Staphylococcus
GYQH

SEQ ID NO: 1947625 - protein, 5 aa, Staphylococcus
GYQKP

SEQ ID NO: 1947626 - protein, 5 aa, Staphylococcus
GYQND

SEQ ID NO: 1947627 - protein, 5 aa, Staphylococcus
GYQPE

SEQ ID NO: 1947628 - protein, 6 aa, Staphylococcus
GYRALS

SEQ ID NO: 1947629 - protein, 4 aa, Staphylococcus
GYRD

SEQ ID NO: 1947630 - protein, 6 aa, Staphylococcus
GYRGNS

SEQ ID NO: 1947631 - protein, 8 aa, Staphylococcus
GYRHTHDS

SEQ ID NO: 1947632 - protein, 6 aa, Staphylococcus
GYRKGL

SEQ ID NO: 1947633 - protein, 8 aa, Staphylococcus
GYRKSDGK

SEQ ID NO: 1947634 - protein, 4 aa, Staphylococcus
GYRS

SEQ ID NO: 1947635 - protein, 6 aa, Staphylococcus
GYRSID

SEQ ID NO: 1947636 - protein, 16 aa, Staphylococcus
GYRTGSMNEVIDTHHT

SEQ ID NO: 1947637 - protein, 9 aa, Staphylococcus
GYSDDKEDL

SEQ ID NO: 1947638 - protein, 7 aa, Staphylococcus
GYSDSTT

SEQ ID NO: 1947639 - protein, 13 aa, Staphylococcus
GYSGGHVENPTYE

SEQ ID NO: 1947640 - protein, 5 aa, Staphylococcus
GYSGY

SEQ ID NO: 1947641 - protein, 5 aa, Staphylococcus
GYSKE

SEQ ID NO: 1947642 - protein, 12 aa, Staphylococcus
GYSKTKANERAK

SEQ ID NO: 1947643 - protein, 4 aa, Staphylococcus
GYSN

SEQ ID NO: 1947644 - protein, 5 aa, Staphylococcus
GYSNE

SEQ ID NO: 1947645 - protein, 8 aa, Staphylococcus
GYSNEYDL

SEQ ID NO: 1947646 - protein, 12 aa, Staphylococcus
GYSNEYTPKAAR

SEQ ID NO: 1947647 - protein, 8 aa, Staphylococcus
GYSPKLKR

SEQ ID NO: 1947648 - protein, 4 aa, Staphylococcus
GYSS

SEQ ID NO: 1947649 - protein, 7 aa, Staphylococcus
GYSSDIT

SEQ ID NO: 1947650 - protein, 13 aa, Staphylococcus
GYSSTGKPSTANI

SEQ ID NO: 1947651 - protein, 6 aa, Staphylococcus
GYSTGG

SEQ ID NO: 1947652 - protein, 10 aa, Staphylococcus
GYSTNPKGGV

SEQ ID NO: 1947653 - protein, 8 aa, Staphylococcus
GYSYPNEY

SEQ ID NO: 1947654 - protein, 7 aa, Staphylococcus
GYTAREG

SEQ ID NO: 1947655 - protein, 7 aa, Staphylococcus
GYTDDEA

SEQ ID NO: 1947656 - protein, 14 aa, Staphylococcus
GYTEAQAKEEGLAV

SEQ ID NO: 1947657 - protein, 13 aa, Staphylococcus
GYTEAQAKEEGLD

SEQ ID NO: 1947658 - protein, 14 aa, Staphylococcus
GYTEAQAKEEGLDY

SEQ ID NO: 1947659 - protein, 14 aa, Staphylococcus
GYTEAQAKEEGLEY

SEQ ID NO: 1947660 - protein, 17 aa, Staphylococcus
GYTEEDVRRALNENKGS

SEQ ID NO: 1947661 - protein, 17 aa, Staphylococcus
GYTEEDVRRALSMDKEN

SEQ ID NO: 1947662 - protein, 18 aa, Staphylococcus
GYTEEDVRSALSDEEGSE

SEQ ID NO: 1947663 - protein, 9 aa, Staphylococcus
GYTEQKLSK

SEQ ID NO: 1947664 - protein, 17 aa, Staphylococcus
GYTESDVREALSMEKES

SEQ ID NO: 1947665 - protein, 4 aa, Staphylococcus
GYTG

SEQ ID NO: 1947666 - protein, 7 aa, Staphylococcus
GYTGDDE

SEQ ID NO: 1947667 - protein, 6 aa, Staphylococcus
GYTGRD

SEQ ID NO: 1947668 - protein, 8 aa, Staphylococcus
GYTKEDIN

SEQ ID NO: 1947669 - protein, 14 aa, Staphylococcus
GYTNDGISTSEHGG

SEQ ID NO: 1947670 - protein, 10 aa, Staphylococcus
GYTNTDSYDK

SEQ ID NO: 1947671 - protein, 8 aa, Staphylococcus
GYTPSEQK

SEQ ID NO: 1947672 - protein, 9 aa, Staphylococcus
GYTPTEDIN

SEQ ID NO: 1947673 - protein, 22 aa, Staphylococcus
GYTQDRQPGIEADMNPKPVAEL

SEQ ID NO: 1947674 - protein, 21 aa, Staphylococcus
GYTQDRQPGIQKDMNPQPITE

SEQ ID NO: 1947675 - protein, 19 aa, Staphylococcus
GYTQEKQPGSEKDMDPRPI

SEQ ID NO: 1947676 - protein, 21 aa, Staphylococcus
GYTQNRQPGTERDMDPRPISE

SEQ ID NO: 1947677 - protein, 20 aa, Staphylococcus
GYTQSNQPGIEADMTPKPIA

SEQ ID NO: 1947678 - protein, 10 aa, Staphylococcus
GYTRAKYGYD

SEQ ID NO: 1947679 - protein, 6 aa, Staphylococcus
GYTRNG

SEQ ID NO: 1947680 - protein, 4 aa, Staphylococcus
GYTT

SEQ ID NO: 1947681 - protein, 4 aa, Staphylococcus
GYVG

SEQ ID NO: 1947682 - protein, 4 aa, Staphylococcus
GYVS

SEQ ID NO: 1947683 - protein, 11 aa, Staphylococcus
GYVTNKGVAES

SEQ ID NO: 1947684 - protein, 4 aa, Staphylococcus
GYYE

SEQ ID NO: 1947685 - protein, 6 aa, Staphylococcus
GYYGTT

SEQ ID NO: 1947686 - protein, 5 aa, Staphylococcus
GYYPG

SEQ ID NO: 1947687 - protein, 5 aa, Staphylococcus
GYYSE

SEQ ID NO: 1947688 - protein, 12 aa, Staphylococcus
GYYTQEYQGDTL

SEQ ID NO: 1947689 - protein, 12 aa, Staphylococcus
HAAEAIVKRFFL

SEQ ID NO: 1947690 - protein, 5 aa, Staphylococcus
HAAKV

SEQ ID NO: 1947691 - protein, 4 aa, Staphylococcus
HAAL

SEQ ID NO: 1947692 - protein, 9 aa, Staphylococcus
HAALRNPKM

SEQ ID NO: 1947693 - protein, 14 aa, Staphylococcus
HAAQGITKEEVSRN

SEQ ID NO: 1947694 - protein, 17 aa, Staphylococcus
HAAQGWQSEGNTGTPWL

SEQ ID NO: 1947695 - protein, 5 aa, Staphylococcus
HAAQT

SEQ ID NO: 1947696 - protein, 5 aa, Staphylococcus
HACGA

SEQ ID NO: 1947697 - protein, 5 aa, Staphylococcus
HACGE

SEQ ID NO: 1947698 - protein, 8 aa, Staphylococcus
HADDPAYE

SEQ ID NO: 1947699 - protein, 5 aa, Staphylococcus
HADDY

SEQ ID NO: 1947700 - protein, 11 aa, Staphylococcus
HADEDSLDASY

SEQ ID NO: 1947701 - protein, 27 aa, Staphylococcus
HADEQVNEAAKERQRIGDEKLEAAKNE

SEQ ID NO: 1947702 - protein, 22 aa, Staphylococcus
HADEQVNEAAKERQRQGEEQLS

SEQ ID NO: 1947703 - protein, 12 aa, Staphylococcus
HADERESRFANE

SEQ ID NO: 1947704 - protein, 14 aa, Staphylococcus
HADKLNGDPLTDKE

SEQ ID NO: 1947705 - protein, 10 aa, Staphylococcus
HADKQDQGKW

SEQ ID NO: 1947706 - protein, 7 aa, Staphylococcus
HADSEDG

SEQ ID NO: 1947707 - protein, 12 aa, Staphylococcus
HADSGVGFNAAT

SEQ ID NO: 1947708 - protein, 9 aa, Staphylococcus
HADSPDPEC

SEQ ID NO: 1947709 - protein, 12 aa, Staphylococcus
HAEDEDESRTME

SEQ ID NO: 1947710 - protein, 7 aa, Staphylococcus
HAEDGPR

SEQ ID NO: 1947711 - protein, 5 aa, Staphylococcus
HAEDI

SEQ ID NO: 1947712 - protein, 5 aa, Staphylococcus
HAEDL

SEQ ID NO: 1947713 - protein, 5 aa, Staphylococcus
HAEDV

SEQ ID NO: 1947714 - protein, 13 aa, Staphylococcus
HAEPGIGYNAATD

SEQ ID NO: 1947715 - protein, 6 aa, Staphylococcus
HAESED

SEQ ID NO: 1947716 - protein, 7 aa, Staphylococcus
HAETEED

SEQ ID NO: 1947717 - protein, 6 aa, Staphylococcus
HAETID

SEQ ID NO: 1947718 - protein, 5 aa, Staphylococcus
HAETL

SEQ ID NO: 1947719 - protein, 11 aa, Staphylococcus
HAFEQSEDEIN

SEQ ID NO: 1947720 - protein, 19 aa, Staphylococcus
HAFKSKKNIVKENAKKYDR

SEQ ID NO: 1947721 - protein, 4 aa, Staphylococcus
HAGD

SEQ ID NO: 1947722 - protein, 8 aa, Staphylococcus
HAGFTTGE

SEQ ID NO: 1947723 - protein, 4 aa, Staphylococcus
HAGK

SEQ ID NO: 1947724 - protein, 8 aa, Staphylococcus
HAGKQRKT

SEQ ID NO: 1947725 - protein, 14 aa, Staphylococcus
HAGQEIDDFSKSRA

SEQ ID NO: 1947726 - protein, 10 aa, Staphylococcus
HAGQKADVEK

SEQ ID NO: 1947727 - protein, 9 aa, Staphylococcus
HAGQQGDID

SEQ ID NO: 1947728 - protein, 10 aa, Staphylococcus
HAGSKEGTAA

SEQ ID NO: 1947729 - protein, 7 aa, Staphylococcus
HAGVGDY

SEQ ID NO: 1947730 - protein, 11 aa, Staphylococcus
HAGVGDYYGTY

SEQ ID NO: 1947731 - protein, 12 aa, Staphylococcus
HAGVGDYYGTYD

SEQ ID NO: 1947732 - protein, 9 aa, Staphylococcus
HAGYQRQPK

SEQ ID NO: 1947733 - protein, 12 aa, Staphylococcus
HAHEPNQEAVET

SEQ ID NO: 1947734 - protein, 8 aa, Staphylococcus
HAHGPNPS

SEQ ID NO: 1947735 - protein, 10 aa, Staphylococcus
HAHQPNQDTV

SEQ ID NO: 1947736 - protein, 54 aa, Staphylococcus
HAIADNSNKEDTKRSSQLDSSITIENESTIESSSNTSNNNERTPNYSKRDNTVN

SEQ ID NO: 1947737 - protein, 11 aa, Staphylococcus
HAIKNDSAFEQ

SEQ ID NO: 1947738 - protein, 4 aa, Staphylococcus
HAIS

SEQ ID NO: 1947739 - protein, 16 aa, Staphylococcus
HAKDKAYDGKFSESFS

SEQ ID NO: 1947740 - protein, 6 aa, Staphylococcus
HAKEAD

SEQ ID NO: 1947741 - protein, 11 aa, Staphylococcus
HAKEKTAQNDG

SEQ ID NO: 1947742 - protein, 11 aa, Staphylococcus
HAKEKTKNNTG

SEQ ID NO: 1947743 - protein, 12 aa, Staphylococcus
HAKETNLTSPEG

SEQ ID NO: 1947744 - protein, 10 aa, Staphylococcus
HAKKSNGAEV

SEQ ID NO: 1947745 - protein, 15 aa, Staphylococcus
HAKNPEGHDVLVWAP

SEQ ID NO: 1947746 - protein, 9 aa, Staphylococcus
HAKPSGQHH

SEQ ID NO: 1947747 - protein, 6 aa, Staphylococcus
HAKQNS

SEQ ID NO: 1947748 - protein, 7 aa, Staphylococcus
HANDNAY

SEQ ID NO: 1947749 - protein, 4 aa, Staphylococcus
HANG

SEQ ID NO: 1947750 - protein, 12 aa, Staphylococcus
HANHPKEGGSYH

SEQ ID NO: 1947751 - protein, 8 aa, Staphylococcus
HANQGEYG

SEQ ID NO: 1947752 - protein, 4 aa, Staphylococcus
HANS

SEQ ID NO: 1947753 - protein, 6 aa, Staphylococcus
HANSED

SEQ ID NO: 1947754 - protein, 9 aa, Staphylococcus
HANSGTVED

SEQ ID NO: 1947755 - protein, 4 aa, Staphylococcus
HANT

SEQ ID NO: 1947756 - protein, 9 aa, Staphylococcus
HANTPDPEC

SEQ ID NO: 1947757 - protein, 9 aa, Staphylococcus
HAPESLPDE

SEQ ID NO: 1947758 - protein, 16 aa, Staphylococcus
HAPHAAEEKDQPMTKA

SEQ ID NO: 1947759 - protein, 16 aa, Staphylococcus
HAPHAAEEKNQPMTKA

SEQ ID NO: 1947760 - protein, 15 aa, Staphylococcus
HAPHAKEEKAQPMTK

SEQ ID NO: 1947761 - protein, 16 aa, Staphylococcus
HAPHAKEEKDQPMTQA

SEQ ID NO: 1947762 - protein, 15 aa, Staphylococcus
HAPHAKEEKEQPMTK

SEQ ID NO: 1947763 - protein, 4 aa, Staphylococcus
HAPI

SEQ ID NO: 1947764 - protein, 6 aa, Staphylococcus
HAPLDS

SEQ ID NO: 1947765 - protein, 7 aa, Staphylococcus
HAPLSSQ

SEQ ID NO: 1947766 - protein, 8 aa, Staphylococcus
HAPSKNPK

SEQ ID NO: 1947767 - protein, 14 aa, Staphylococcus
HAPSNMSGKQSNNI

SEQ ID NO: 1947768 - protein, 4 aa, Staphylococcus
HAPT

SEQ ID NO: 1947769 - protein, 8 aa, Staphylococcus
HAPTSLSD

SEQ ID NO: 1947770 - protein, 9 aa, Staphylococcus
HAPYTPNTK

SEQ ID NO: 1947771 - protein, 26 aa, Staphylococcus
HAQARQQGKHHKGPRRFTEEARTKFE

SEQ ID NO: 1947772 - protein, 19 aa, Staphylococcus
HAQASELTTEDNEDKQEYE

SEQ ID NO: 1947773 - protein, 7 aa, Staphylococcus
HAQGDKC

SEQ ID NO: 1947774 - protein, 9 aa, Staphylococcus
HAQGETDAN

SEQ ID NO: 1947775 - protein, 12 aa, Staphylococcus
HAQGSQGYGGEN

SEQ ID NO: 1947776 - protein, 9 aa, Staphylococcus
HAQNKSDNK

SEQ ID NO: 1947777 - protein, 12 aa, Staphylococcus
HAQQAKTQSDAE

SEQ ID NO: 1947778 - protein, 10 aa, Staphylococcus
HAQQSGESFA

SEQ ID NO: 1947779 - protein, 21 aa, Staphylococcus
HAQSTTSVDLANRSRALTEEN

SEQ ID NO: 1947780 - protein, 7 aa, Staphylococcus
HARGDAN

SEQ ID NO: 1947781 - protein, 11 aa, Staphylococcus
HARNPYGDGNA

SEQ ID NO: 1947782 - protein, 12 aa, Staphylococcus
HARQTKEDIEVS

SEQ ID NO: 1947783 - protein, 24 aa, Staphylococcus
HASAQFRKSGGRTKGPAAFTEEDV

SEQ ID NO: 1947784 - protein, 8 aa, Staphylococcus
HASDEAAY

SEQ ID NO: 1947785 - protein, 7 aa, Staphylococcus
HASGANV

SEQ ID NO: 1947786 - protein, 7 aa, Staphylococcus
HASGEKC

SEQ ID NO: 1947787 - protein, 10 aa, Staphylococcus
HASLKNDYEV

SEQ ID NO: 1947788 - protein, 4 aa, Staphylococcus
HASN

SEQ ID NO: 1947789 - protein, 6 aa, Staphylococcus
HASPSA

SEQ ID NO: 1947790 - protein, 8 aa, Staphylococcus
HASQLSAK

SEQ ID NO: 1947791 - protein, 9 aa, Staphylococcus
HASQLSAKE

SEQ ID NO: 1947792 - protein, 12 aa, Staphylococcus
HASRSNNNPYHA

SEQ ID NO: 1947793 - protein, 8 aa, Staphylococcus
HASYTEHP

SEQ ID NO: 1947794 - protein, 10 aa, Staphylococcus
HATARDSGAA

SEQ ID NO: 1947795 - protein, 8 aa, Staphylococcus
HATARKND

SEQ ID NO: 1947796 - protein, 9 aa, Staphylococcus
HATARKNNL

SEQ ID NO: 1947797 - protein, 8 aa, Staphylococcus
HATDEAAN

SEQ ID NO: 1947798 - protein, 7 aa, Staphylococcus
HATDTEA

SEQ ID NO: 1947799 - protein, 5 aa, Staphylococcus
HATFT

SEQ ID NO: 1947800 - protein, 9 aa, Staphylococcus
HATNNGKIK

SEQ ID NO: 1947801 - protein, 5 aa, Staphylococcus
HATSS

SEQ ID NO: 1947802 - protein, 8 aa, Staphylococcus
HATTSAAA

SEQ ID NO: 1947803 - protein, 9 aa, Staphylococcus
HATTSTGIS

SEQ ID NO: 1947804 - protein, 9 aa, Staphylococcus
HAVGPTKGG

SEQ ID NO: 1947805 - protein, 9 aa, Staphylococcus
HAYGSDKSF

SEQ ID NO: 1947806 - protein, 4 aa, Staphylococcus
HAYP

SEQ ID NO: 1947807 - protein, 7 aa, Staphylococcus
HAYPESY

SEQ ID NO: 1947808 - protein, 11 aa, Staphylococcus
HCTEQEKREIK

SEQ ID NO: 1947809 - protein, 8 aa, Staphylococcus
HDAEPTAS

SEQ ID NO: 1947810 - protein, 12 aa, Staphylococcus
HDAGQSDDVRDT

SEQ ID NO: 1947811 - protein, 11 aa, Staphylococcus
HDAGYKVKDDF

SEQ ID NO: 1947812 - protein, 8 aa, Staphylococcus
HDAGYNIK

SEQ ID NO: 1947813 - protein, 10 aa, Staphylococcus
HDAGYNVKED

SEQ ID NO: 1947814 - protein, 11 aa, Staphylococcus
HDALDAKTEGM

SEQ ID NO: 1947815 - protein, 5 aa, Staphylococcus
HDANS

SEQ ID NO: 1947816 - protein, 14 aa, Staphylococcus
HDASGKAKETKRRF

SEQ ID NO: 1947817 - protein, 9 aa, Staphylococcus
HDATEKYDK

SEQ ID NO: 1947818 - protein, 9 aa, Staphylococcus
HDATKPYKD

SEQ ID NO: 1947819 - protein, 14 aa, Staphylococcus
HDDFGYGSTDTGNV

SEQ ID NO: 1947820 - protein, 4 aa, Staphylococcus
HDDG

SEQ ID NO: 1947821 - protein, 6 aa, Staphylococcus
HDDGDA

SEQ ID NO: 1947822 - protein, 4 aa, Staphylococcus
HDDL

SEQ ID NO: 1947823 - protein, 6 aa, Staphylococcus
HDDLAQ

SEQ ID NO: 1947824 - protein, 9 aa, Staphylococcus
HDDTKPYEK

SEQ ID NO: 1947825 - protein, 4 aa, Staphylococcus
HDDY

SEQ ID NO: 1947826 - protein, 8 aa, Staphylococcus
HDEAQAVG

SEQ ID NO: 1947827 - protein, 6 aa, Staphylococcus
HDEAQH

SEQ ID NO: 1947828 - protein, 7 aa, Staphylococcus
HDEAQRE

SEQ ID NO: 1947829 - protein, 12 aa, Staphylococcus
HDEDDEDNIETE

SEQ ID NO: 1947830 - protein, 5 aa, Staphylococcus
HDEEK

SEQ ID NO: 1947831 - protein, 4 aa, Staphylococcus
HDEG

SEQ ID NO: 1947832 - protein, 29 aa, Staphylococcus
HDEGLKAANELLDKTNANPVITTGHPDFS

SEQ ID NO: 1947833 - protein, 7 aa, Staphylococcus
HDEHPNK

SEQ ID NO: 1947834 - protein, 8 aa, Staphylococcus
HDEKEYVS

SEQ ID NO: 1947835 - protein, 22 aa, Staphylococcus
HDELDGSETVVSGASCTTNSLA

SEQ ID NO: 1947836 - protein, 6 aa, Staphylococcus
HDEPEE

SEQ ID NO: 1947837 - protein, 4 aa, Staphylococcus
HDEQ

SEQ ID NO: 1947838 - protein, 9 aa, Staphylococcus
HDEQGDNER

SEQ ID NO: 1947839 - protein, 5 aa, Staphylococcus
HDEQQ

SEQ ID NO: 1947840 - protein, 9 aa, Staphylococcus
HDEQSNDAR

SEQ ID NO: 1947841 - protein, 4 aa, Staphylococcus
HDER

SEQ ID NO: 1947842 - protein, 7 aa, Staphylococcus
HDERDHE

SEQ ID NO: 1947843 - protein, 7 aa, Staphylococcus
HDERDYE

SEQ ID NO: 1947844 - protein, 7 aa, Staphylococcus
HDERYTK

SEQ ID NO: 1947845 - protein, 4 aa, Staphylococcus
HDET

SEQ ID NO: 1947846 - protein, 5 aa, Staphylococcus
HDETI

SEQ ID NO: 1947847 - protein, 5 aa, Staphylococcus
HDEVD

SEQ ID NO: 1947848 - protein, 7 aa, Staphylococcus
HDEYART

SEQ ID NO: 1947849 - protein, 4 aa, Staphylococcus
HDFE

SEQ ID NO: 1947850 - protein, 7 aa, Staphylococcus
HDGAARG

SEQ ID NO: 1947851 - protein, 14 aa, Staphylococcus
HDGCATGGTCNCSL

SEQ ID NO: 1947852 - protein, 11 aa, Staphylococcus
HDGEITENAGN

SEQ ID NO: 1947853 - protein, 11 aa, Staphylococcus
HDGEITGNAGN

SEQ ID NO: 1947854 - protein, 8 aa, Staphylococcus
HDGKETEL

SEQ ID NO: 1947855 - protein, 7 aa, Staphylococcus
HDGQAAA

SEQ ID NO: 1947856 - protein, 5 aa, Staphylococcus
HDGSI

SEQ ID NO: 1947857 - protein, 6 aa, Staphylococcus
HDHETD

SEQ ID NO: 1947858 - protein, 6 aa, Staphylococcus
HDIQSA

SEQ ID NO: 1947859 - protein, 35 aa, Staphylococcus
HDKIDKNDKMDNPDMQKPDSLAEPIQTKDEEVSYE

SEQ ID NO: 1947860 - protein, 20 aa, Staphylococcus
HDKIDKSDKMDNPDMEKPES

SEQ ID NO: 1947861 - protein, 32 aa, Staphylococcus
HDKIDKSDKMDNPDMEKPESLQQPLKSDDKEF

SEQ ID NO: 1947862 - protein, 7 aa, Staphylococcus
HDKRSPS

SEQ ID NO: 1947863 - protein, 13 aa, Staphylococcus
HDKSPAVRRTAGD

SEQ ID NO: 1947864 - protein, 7 aa, Staphylococcus
HDKTPDA

SEQ ID NO: 1947865 - protein, 7 aa, Staphylococcus
HDKTQTL

SEQ ID NO: 1947866 - protein, 10 aa, Staphylococcus
HDLASRDSVT

SEQ ID NO: 1947867 - protein, 4 aa, Staphylococcus
HDLD

SEQ ID NO: 1947868 - protein, 38 aa, Staphylococcus
HDLKRGTSKHKTERQHREVEQYKRDTEYYKNRKDEEVR

SEQ ID NO: 1947869 - protein, 7 aa, Staphylococcus
HDLPTDE

SEQ ID NO: 1947870 - protein, 6 aa, Staphylococcus
HDLTEE

SEQ ID NO: 1947871 - protein, 8 aa, Staphylococcus
HDNEENYE

SEQ ID NO: 1947872 - protein, 16 aa, Staphylococcus
HDNEIDMQDNEEEDVV

SEQ ID NO: 1947873 - protein, 10 aa, Staphylococcus
HDNLTTTECP

SEQ ID NO: 1947874 - protein, 5 aa, Staphylococcus
HDNPR

SEQ ID NO: 1947875 - protein, 5 aa, Staphylococcus
HDNSI

SEQ ID NO: 1947876 - protein, 9 aa, Staphylococcus
HDPEGDFGR

SEQ ID NO: 1947877 - protein, 9 aa, Staphylococcus
HDPEKNKGK

SEQ ID NO: 1947878 - protein, 8 aa, Staphylococcus
HDPETNEK

SEQ ID NO: 1947879 - protein, 14 aa, Staphylococcus
HDPKANCKATAQQI

SEQ ID NO: 1947880 - protein, 6 aa, Staphylococcus
HDPLRP

SEQ ID NO: 1947881 - protein, 14 aa, Staphylococcus
HDPLSANITSEWPD

SEQ ID NO: 1947882 - protein, 7 aa, Staphylococcus
HDPLSAS

SEQ ID NO: 1947883 - protein, 14 aa, Staphylococcus
HDPLSSKISSNWPN

SEQ ID NO: 1947884 - protein, 14 aa, Staphylococcus
HDPLSTKISSNWPK

SEQ ID NO: 1947885 - protein, 7 aa, Staphylococcus
HDPLTTR

SEQ ID NO: 1947886 - protein, 7 aa, Staphylococcus
HDPYPHQ

SEQ ID NO: 1947887 - protein, 8 aa, Staphylococcus
HDQETGEK

SEQ ID NO: 1947888 - protein, 6 aa, Staphylococcus
HDQGAN

SEQ ID NO: 1947889 - protein, 10 aa, Staphylococcus
HDQHTATRFG

SEQ ID NO: 1947890 - protein, 5 aa, Staphylococcus
HDQKA

SEQ ID NO: 1947891 - protein, 14 aa, Staphylococcus
HDQPRRVSTWGDDE

SEQ ID NO: 1947892 - protein, 13 aa, Staphylococcus
HDQPRRVSTWGND

SEQ ID NO: 1947893 - protein, 14 aa, Staphylococcus
HDQPRRVSTWGNDT

SEQ ID NO: 1947894 - protein, 6 aa, Staphylococcus
HDRDAQ

SEQ ID NO: 1947895 - protein, 14 aa, Staphylococcus
HDSDGIVAALEKIL

SEQ ID NO: 1947896 - protein, 4 aa, Staphylococcus
HDSE

SEQ ID NO: 1947897 - protein, 12 aa, Staphylococcus
HDSEGKVVEQKR

SEQ ID NO: 1947898 - protein, 6 aa, Staphylococcus
HDSGNL

SEQ ID NO: 1947899 - protein, 7 aa, Staphylococcus
HDSHPQN

SEQ ID NO: 1947900 - protein, 5 aa, Staphylococcus
HDSIG

SEQ ID NO: 1947901 - protein, 4 aa, Staphylococcus
HDSL

SEQ ID NO: 1947902 - protein, 8 aa, Staphylococcus
HDSNPKNV

SEQ ID NO: 1947903 - protein, 5 aa, Staphylococcus
HDSNQ

SEQ ID NO: 1947904 - protein, 11 aa, Staphylococcus
HDSNSSVEDNV

SEQ ID NO: 1947905 - protein, 7 aa, Staphylococcus
HDTDPLQ

SEQ ID NO: 1947906 - protein, 10 aa, Staphylococcus
HDTLEKTEQH

SEQ ID NO: 1947907 - protein, 12 aa, Staphylococcus
HDTNGKAKEIKR

SEQ ID NO: 1947908 - protein, 12 aa, Staphylococcus
HDTNHASSNYDE

SEQ ID NO: 1947909 - protein, 4 aa, Staphylococcus
HDTP

SEQ ID NO: 1947910 - protein, 6 aa, Staphylococcus
HDTSRP

SEQ ID NO: 1947911 - protein, 20 aa, Staphylococcus
HDTSYENKIDEYPSSQGKKG

SEQ ID NO: 1947912 - protein, 17 aa, Staphylococcus
HDTTKQVSSLSGGQQKR

SEQ ID NO: 1947913 - protein, 5 aa, Staphylococcus
HDTTT

SEQ ID NO: 1947914 - protein, 11 aa, Staphylococcus
HDTVGKPSDNV

SEQ ID NO: 1947915 - protein, 11 aa, Staphylococcus
HDVDRGRDDVD

SEQ ID NO: 1947916 - protein, 5 aa, Staphylococcus
HDVEN

SEQ ID NO: 1947917 - protein, 13 aa, Staphylococcus
HDVETQAQSIKRT

SEQ ID NO: 1947918 - protein, 9 aa, Staphylococcus
HDVNQKELE

SEQ ID NO: 1947919 - protein, 10 aa, Staphylococcus
HDVNQKSLEG

SEQ ID NO: 1947920 - protein, 5 aa, Staphylococcus
HDVPT

SEQ ID NO: 1947921 - protein, 11 aa, Staphylococcus
HDVQGGSTITQ

SEQ ID NO: 1947922 - protein, 5 aa, Staphylococcus
HDVRE

SEQ ID NO: 1947923 - protein, 6 aa, Staphylococcus
HDYENG

SEQ ID NO: 1947924 - protein, 14 aa, Staphylococcus
HDYRPQIKNNFIVN

SEQ ID NO: 1947925 - protein, 8 aa, Staphylococcus
HDYRTNQE

SEQ ID NO: 1947926 - protein, 4 aa, Staphylococcus
HEAH

SEQ ID NO: 1947927 - protein, 13 aa, Staphylococcus
HEAKKYGLNGDDT

SEQ ID NO: 1947928 - protein, 13 aa, Staphylococcus
HEAKRDKVYQPTI

SEQ ID NO: 1947929 - protein, 21 aa, Staphylococcus
HEAKRNKTNQPKIERAEIDEP

SEQ ID NO: 1947930 - protein, 4 aa, Staphylococcus
HEAL

SEQ ID NO: 1947931 - protein, 5 aa, Staphylococcus
HEARI

SEQ ID NO: 1947932 - protein, 8 aa, Staphylococcus
HEASSPYN

SEQ ID NO: 1947933 - protein, 13 aa, Staphylococcus
HEATYKQEDYPRY

SEQ ID NO: 1947934 - protein, 5 aa, Staphylococcus
HEAYE

SEQ ID NO: 1947935 - protein, 9 aa, Staphylococcus
HEDAPAPSI

SEQ ID NO: 1947936 - protein, 8 aa, Staphylococcus
HEDGNTRV

SEQ ID NO: 1947937 - protein, 20 aa, Staphylococcus
HEDGSVDFDDNRYTENTRAA

SEQ ID NO: 1947938 - protein, 5 aa, Staphylococcus
HEDIE

SEQ ID NO: 1947939 - protein, 13 aa, Staphylococcus
HEDISDNTKYEDE

SEQ ID NO: 1947940 - protein, 13 aa, Staphylococcus
HEDKEMKGYGPSK

SEQ ID NO: 1947941 - protein, 7 aa, Staphylococcus
HEDLTKQ

SEQ ID NO: 1947942 - protein, 10 aa, Staphylococcus
HEDNQADATV

SEQ ID NO: 1947943 - protein, 8 aa, Staphylococcus
HEDPETLN

SEQ ID NO: 1947944 - protein, 17 aa, Staphylococcus
HEDRKVNKAFRHIGHSH

SEQ ID NO: 1947945 - protein, 5 aa, Staphylococcus
HEDTG

SEQ ID NO: 1947946 - protein, 21 aa, Staphylococcus
HEDTINDDAKKEIAEQIQAQF

SEQ ID NO: 1947947 - protein, 7 aa, Staphylococcus
HEDTQYS

SEQ ID NO: 1947948 - protein, 8 aa, Staphylococcus
HEDYEERG

SEQ ID NO: 1947949 - protein, 14 aa, Staphylococcus
HEEALKKKAELDQR

SEQ ID NO: 1947950 - protein, 9 aa, Staphylococcus
HEEARTNHV

SEQ ID NO: 1947951 - protein, 9 aa, Staphylococcus
HEEDDEDNI

SEQ ID NO: 1947952 - protein, 31 aa, Staphylococcus
HEEDDEENIETEYERKFSDKGSRIYRMEAKF

SEQ ID NO: 1947953 - protein, 5 aa, Staphylococcus
HEEDL

SEQ ID NO: 1947954 - protein, 10 aa, Staphylococcus
HEEDNEDNVL

SEQ ID NO: 1947955 - protein, 6 aa, Staphylococcus
HEEENA

SEQ ID NO: 1947956 - protein, 8 aa, Staphylococcus
HEEGPSMG

SEQ ID NO: 1947957 - protein, 8 aa, Staphylococcus
HEEGSTQA

SEQ ID NO: 1947958 - protein, 6 aa, Staphylococcus
HEEHEI

SEQ ID NO: 1947959 - protein, 7 aa, Staphylococcus
HEEQEYP

SEQ ID NO: 1947960 - protein, 6 aa, Staphylococcus
HEEQQT

SEQ ID NO: 1947961 - protein, 8 aa, Staphylococcus
HEESGQLA

SEQ ID NO: 1947962 - protein, 10 aa, Staphylococcus
HEESGQLPLK

SEQ ID NO: 1947963 - protein, 7 aa, Staphylococcus
HEESLQV

SEQ ID NO: 1947964 - protein, 15 aa, Staphylococcus
HEESPGETVELDGKR

SEQ ID NO: 1947965 - protein, 19 aa, Staphylococcus
HEESPGETVELDGKRYKEY

SEQ ID NO: 1947966 - protein, 15 aa, Staphylococcus
HEESPGETVELEGKR

SEQ ID NO: 1947967 - protein, 15 aa, Staphylococcus
HEESPGKTVELEGKK

SEQ ID NO: 1947968 - protein, 5 aa, Staphylococcus
HEETS

SEQ ID NO: 1947969 - protein, 6 aa, Staphylococcus
HEGDDI

SEQ ID NO: 1947970 - protein, 5 aa, Staphylococcus
HEGEQ

SEQ ID NO: 1947971 - protein, 7 aa, Staphylococcus
HEGEYGK

SEQ ID NO: 1947972 - protein, 8 aa, Staphylococcus
HEGEYGKT

SEQ ID NO: 1947973 - protein, 14 aa, Staphylococcus
HEGEYTYGQQLPSE

SEQ ID NO: 1947974 - protein, 6 aa, Staphylococcus
HEGGDI

SEQ ID NO: 1947975 - protein, 7 aa, Staphylococcus
HEGGDIS

SEQ ID NO: 1947976 - protein, 5 aa, Staphylococcus
HEGGQ

SEQ ID NO: 1947977 - protein, 7 aa, Staphylococcus
HEGGYKA

SEQ ID NO: 1947978 - protein, 4 aa, Staphylococcus
HEGI

SEQ ID NO: 1947979 - protein, 14 aa, Staphylococcus
HEGKEYPSAAIGTG

SEQ ID NO: 1947980 - protein, 11 aa, Staphylococcus
HEGKRSEELGI

SEQ ID NO: 1947981 - protein, 6 aa, Staphylococcus
HEGPSY

SEQ ID NO: 1947982 - protein, 8 aa, Staphylococcus
HEGQFRKN

SEQ ID NO: 1947983 - protein, 10 aa, Staphylococcus
HEGQRSEALG

SEQ ID NO: 1947984 - protein, 19 aa, Staphylococcus
HEGRQKRQAAEKELSGLEN

SEQ ID NO: 1947985 - protein, 9 aa, Staphylococcus
HEGRRPKGD

SEQ ID NO: 1947986 - protein, 10 aa, Staphylococcus
HEGTDQFNTH

SEQ ID NO: 1947987 - protein, 5 aa, Staphylococcus
HEGTE

SEQ ID NO: 1947988 - protein, 8 aa, Staphylococcus
HEGTGAGH

SEQ ID NO: 1947989 - protein, 9 aa, Staphylococcus
HEGTGAGND

SEQ ID NO: 1947990 - protein, 21 aa, Staphylococcus
HEGTTEDLPIKTKNIKKKTIN

SEQ ID NO: 1947991 - protein, 4 aa, Staphylococcus
HEGV

SEQ ID NO: 1947992 - protein, 12 aa, Staphylococcus
HEGYTDTDDSKF

SEQ ID NO: 1947993 - protein, 34 aa, Staphylococcus
HEHEHDHEHEGHEAHEEHDEHEGHDHEEGSKDPH

SEQ ID NO: 1947994 - protein, 12 aa, Staphylococcus
HEHHTPETEEYG

SEQ ID NO: 1947995 - protein, 7 aa, Staphylococcus
HEHNEIT

SEQ ID NO: 1947996 - protein, 10 aa, Staphylococcus
HEHNKEQQTD

SEQ ID NO: 1947997 - protein, 10 aa, Staphylococcus
HEHNKEQQTE

SEQ ID NO: 1947998 - protein, 11 aa, Staphylococcus
HEHNKEQQTEP

SEQ ID NO: 1947999 - protein, 10 aa, Staphylococcus
HEHNKSQQTE

SEQ ID NO: 1948000 - protein, 19 aa, Staphylococcus
HEHTVREDDRLELLEIVGG

SEQ ID NO: 1948001 - protein, 4 aa, Staphylococcus
HEIN

SEQ ID NO: 1948002 - protein, 8 aa, Staphylococcus
HEIPRDGE

SEQ ID NO: 1948003 - protein, 31 aa, Staphylococcus
HEKARRDREERERAKQASRTIINDDRDHGLE

SEQ ID NO: 1948004 - protein, 12 aa, Staphylococcus
HEKAVQNSAISN

SEQ ID NO: 1948005 - protein, 13 aa, Staphylococcus
HEKEIKDLSSKVR

SEQ ID NO: 1948006 - protein, 4 aa, Staphylococcus
HEKL

SEQ ID NO: 1948007 - protein, 6 aa, Staphylococcus
HEKNGV

SEQ ID NO: 1948008 - protein, 7 aa, Staphylococcus
HEKNGVT

SEQ ID NO: 1948009 - protein, 14 aa, Staphylococcus
HEKPPIPGRTNSTA

SEQ ID NO: 1948010 - protein, 8 aa, Staphylococcus
HEKYTGPD

SEQ ID NO: 1948011 - protein, 4 aa, Staphylococcus
HELD

SEQ ID NO: 1948012 - protein, 8 aa, Staphylococcus
HELDEESY

SEQ ID NO: 1948013 - protein, 7 aa, Staphylococcus
HELDPEA

SEQ ID NO: 1948014 - protein, 5 aa, Staphylococcus
HELDY

SEQ ID NO: 1948015 - protein, 6 aa, Staphylococcus
HELGEA

SEQ ID NO: 1948016 - protein, 23 aa, Staphylococcus
HELGGRRRPSQTVGRTLNSGWQN

SEQ ID NO: 1948017 - protein, 11 aa, Staphylococcus
HELPGDTTFSS

SEQ ID NO: 1948018 - protein, 4 aa, Staphylococcus
HELQ

SEQ ID NO: 1948019 - protein, 4 aa, Staphylococcus
HELS

SEQ ID NO: 1948020 - protein, 12 aa, Staphylococcus
HELSGDSTFSSI

SEQ ID NO: 1948021 - protein, 11 aa, Staphylococcus
HELSKKTKIDI

SEQ ID NO: 1948022 - protein, 4 aa, Staphylococcus
HEMR

SEQ ID NO: 1948023 - protein, 5 aa, Staphylococcus
HENAE

SEQ ID NO: 1948024 - protein, 8 aa, Staphylococcus
HENDDGDL

SEQ ID NO: 1948025 - protein, 21 aa, Staphylococcus
HENEISDEQKKDIAEQIKAQF

SEQ ID NO: 1948026 - protein, 8 aa, Staphylococcus
HENEYGKT

SEQ ID NO: 1948027 - protein, 9 aa, Staphylococcus
HENKAQAPF

SEQ ID NO: 1948028 - protein, 8 aa, Staphylococcus
HENNQAHA

SEQ ID NO: 1948029 - protein, 6 aa, Staphylococcus
HENNQV

SEQ ID NO: 1948030 - protein, 9 aa, Staphylococcus
HENPNKEKP

SEQ ID NO: 1948031 - protein, 9 aa, Staphylococcus
HENPNNEKP

SEQ ID NO: 1948032 - protein, 9 aa, Staphylococcus
HENPNNESR

SEQ ID NO: 1948033 - protein, 13 aa, Staphylococcus
HENQRDKEAQPQI

SEQ ID NO: 1948034 - protein, 10 aa, Staphylococcus
HENRNIESKM

SEQ ID NO: 1948035 - protein, 24 aa, Staphylococcus
HENRRHKTNQPSIQRGAIKEPNEV

SEQ ID NO: 1948036 - protein, 4 aa, Staphylococcus
HENS

SEQ ID NO: 1948037 - protein, 11 aa, Staphylococcus
HENSPLDNQYG

SEQ ID NO: 1948038 - protein, 4 aa, Staphylococcus
HENY

SEQ ID NO: 1948039 - protein, 9 aa, Staphylococcus
HENYNENDK

SEQ ID NO: 1948040 - protein, 6 aa, Staphylococcus
HEPEDI

SEQ ID NO: 1948041 - protein, 33 aa, Staphylococcus
HEPENIGAGKSNLPGNPVERESVKKLSNKRYNT

SEQ ID NO: 1948042 - protein, 6 aa, Staphylococcus
HEPGLN

SEQ ID NO: 1948043 - protein, 4 aa, Staphylococcus
HEPI

SEQ ID NO: 1948044 - protein, 4 aa, Staphylococcus
HEPK

SEQ ID NO: 1948045 - protein, 9 aa, Staphylococcus
HEPKSQADH

SEQ ID NO: 1948046 - protein, 4 aa, Staphylococcus
HEPM

SEQ ID NO: 1948047 - protein, 12 aa, Staphylococcus
HEPNDYEKSFFI

SEQ ID NO: 1948048 - protein, 10 aa, Staphylococcus
HEQAENYGHS

SEQ ID NO: 1948049 - protein, 8 aa, Staphylococcus
HEQDRDKQ

SEQ ID NO: 1948050 - protein, 8 aa, Staphylococcus
HEQENNVV

SEQ ID NO: 1948051 - protein, 6 aa, Staphylococcus
HEQHPN

SEQ ID NO: 1948052 - protein, 6 aa, Staphylococcus
HEQNGV

SEQ ID NO: 1948053 - protein, 6 aa, Staphylococcus
HEQRND

SEQ ID NO: 1948054 - protein, 9 aa, Staphylococcus
HERKEKMTE

SEQ ID NO: 1948055 - protein, 9 aa, Staphylococcus
HERKNKMAE

SEQ ID NO: 1948056 - protein, 10 aa, Staphylococcus
HERQIKEQGI

SEQ ID NO: 1948057 - protein, 10 aa, Staphylococcus
HESADETVTI

SEQ ID NO: 1948058 - protein, 5 aa, Staphylococcus
HESDN

SEQ ID NO: 1948059 - protein, 5 aa, Staphylococcus
HESEL

SEQ ID NO: 1948060 - protein, 7 aa, Staphylococcus
HESIDQS

SEQ ID NO: 1948061 - protein, 6 aa, Staphylococcus
HESLEK

SEQ ID NO: 1948062 - protein, 7 aa, Staphylococcus
HESPSEY

SEQ ID NO: 1948063 - protein, 10 aa, Staphylococcus
HESPSEYTRE

SEQ ID NO: 1948064 - protein, 13 aa, Staphylococcus
HESQITLKSSKQL

SEQ ID NO: 1948065 - protein, 10 aa, Staphylococcus
HESSQSQATV

SEQ ID NO: 1948066 - protein, 9 aa, Staphylococcus
HESTDRPKS

SEQ ID NO: 1948067 - protein, 10 aa, Staphylococcus
HESVSKQPNE

SEQ ID NO: 1948068 - protein, 12 aa, Staphylococcus
HETAKKAMEDKK

SEQ ID NO: 1948069 - protein, 8 aa, Staphylococcus
HETANQEA

SEQ ID NO: 1948070 - protein, 4 aa, Staphylococcus
HETD

SEQ ID NO: 1948071 - protein, 4 aa, Staphylococcus
HETG

SEQ ID NO: 1948072 - protein, 6 aa, Staphylococcus
HETGKE

SEQ ID NO: 1948073 - protein, 6 aa, Staphylococcus
HETGSE

SEQ ID NO: 1948074 - protein, 20 aa, Staphylococcus
HETLKSYSAEAVYHDFMNMF

SEQ ID NO: 1948075 - protein, 6 aa, Staphylococcus
HETNRH

SEQ ID NO: 1948076 - protein, 11 aa, Staphylococcus
HETQNSTDDNI

SEQ ID NO: 1948077 - protein, 10 aa, Staphylococcus
HETTAPPYFN

SEQ ID NO: 1948078 - protein, 8 aa, Staphylococcus
HETTPPAY

SEQ ID NO: 1948079 - protein, 4 aa, Staphylococcus
HETV

SEQ ID NO: 1948080 - protein, 4 aa, Staphylococcus
HETY

SEQ ID NO: 1948081 - protein, 9 aa, Staphylococcus
HETYQQERG

SEQ ID NO: 1948082 - protein, 10 aa, Staphylococcus
HEVDESNDAI

SEQ ID NO: 1948083 - protein, 10 aa, Staphylococcus
HEVKGQSFSN

SEQ ID NO: 1948084 - protein, 7 aa, Staphylococcus
HEVPEAK

SEQ ID NO: 1948085 - protein, 8 aa, Staphylococcus
HEVPTDSI

SEQ ID NO: 1948086 - protein, 7 aa, Staphylococcus
HEVSEEN

SEQ ID NO: 1948087 - protein, 8 aa, Staphylococcus
HEVSEENI

SEQ ID NO: 1948088 - protein, 20 aa, Staphylococcus
HEYAPSSIKDLQNNSINKID

SEQ ID NO: 1948089 - protein, 4 aa, Staphylococcus
HEYE

SEQ ID NO: 1948090 - protein, 15 aa, Staphylococcus
HEYQDVSSANENPLE

SEQ ID NO: 1948091 - protein, 13 aa, Staphylococcus
HEYQDVSSTNDNV

SEQ ID NO: 1948092 - protein, 13 aa, Staphylococcus
HEYQDVSSTNSNL

SEQ ID NO: 1948093 - protein, 14 aa, Staphylococcus
HEYQDVSSTNTNEF

SEQ ID NO: 1948094 - protein, 13 aa, Staphylococcus
HEYQDVSSTNTNL

SEQ ID NO: 1948095 - protein, 14 aa, Staphylococcus
HEYSDDEDDENENY

SEQ ID NO: 1948096 - protein, 9 aa, Staphylococcus
HFDEEGKAL

SEQ ID NO: 1948097 - protein, 26 aa, Staphylococcus
HFDEKERKEAMKEKAQDFVEQGSRVY

SEQ ID NO: 1948098 - protein, 6 aa, Staphylococcus
HFDGTP

SEQ ID NO: 1948099 - protein, 5 aa, Staphylococcus
HFDKE

SEQ ID NO: 1948100 - protein, 8 aa, Staphylococcus
HFDPSESD

SEQ ID NO: 1948101 - protein, 8 aa, Staphylococcus
HFEDDTNT

SEQ ID NO: 1948102 - protein, 5 aa, Staphylococcus
HFGGS

SEQ ID NO: 1948103 - protein, 11 aa, Staphylococcus
HFGSENPLSIA

SEQ ID NO: 1948104 - protein, 11 aa, Staphylococcus
HFKEEKRQTIK

SEQ ID NO: 1948105 - protein, 4 aa, Staphylococcus
HFKN

SEQ ID NO: 1948106 - protein, 16 aa, Staphylococcus
HFKNRDKALALIEKKY

SEQ ID NO: 1948107 - protein, 6 aa, Staphylococcus
HFKPEE

SEQ ID NO: 1948108 - protein, 14 aa, Staphylococcus
HFKPGDRVAVEPGV

SEQ ID NO: 1948109 - protein, 5 aa, Staphylococcus
HFNDS

SEQ ID NO: 1948110 - protein, 13 aa, Staphylococcus
HFNENYEREKVQS

SEQ ID NO: 1948111 - protein, 7 aa, Staphylococcus
HFNPSQG

SEQ ID NO: 1948112 - protein, 13 aa, Staphylococcus
HFQEEETDTNESI

SEQ ID NO: 1948113 - protein, 8 aa, Staphylococcus
HFQPSNSD

SEQ ID NO: 1948114 - protein, 6 aa, Staphylococcus
HFSSDK

SEQ ID NO: 1948115 - protein, 11 aa, Staphylococcus
HFSTKEKLQSL

SEQ ID NO: 1948116 - protein, 9 aa, Staphylococcus
HFTNQDANE

SEQ ID NO: 1948117 - protein, 5 aa, Staphylococcus
HFYPS

SEQ ID NO: 1948118 - protein, 9 aa, Staphylococcus
HGAEGLPED

SEQ ID NO: 1948119 - protein, 11 aa, Staphylococcus
HGAEGLSEDTI

SEQ ID NO: 1948120 - protein, 5 aa, Staphylococcus
HGAIA

SEQ ID NO: 1948121 - protein, 9 aa, Staphylococcus
HGAQDEATY

SEQ ID NO: 1948122 - protein, 6 aa, Staphylococcus
HGATKD

SEQ ID NO: 1948123 - protein, 15 aa, Staphylococcus
HGAVAGKLTGGGRGG

SEQ ID NO: 1948124 - protein, 5 aa, Staphylococcus
HGCPW

SEQ ID NO: 1948125 - protein, 7 aa, Staphylococcus
HGDANEG

SEQ ID NO: 1948126 - protein, 5 aa, Staphylococcus
HGDAV

SEQ ID NO: 1948127 - protein, 7 aa, Staphylococcus
HGDDEPM

SEQ ID NO: 1948128 - protein, 19 aa, Staphylococcus
HGDPQFEGQTKTKLGNSEV

SEQ ID NO: 1948129 - protein, 10 aa, Staphylococcus
HGDQAEHKAR

SEQ ID NO: 1948130 - protein, 5 aa, Staphylococcus
HGDSC

SEQ ID NO: 1948131 - protein, 14 aa, Staphylococcus
HGDSGLATLTGSDG

SEQ ID NO: 1948132 - protein, 7 aa, Staphylococcus
HGDVEPT

SEQ ID NO: 1948133 - protein, 17 aa, Staphylococcus
HGDYTTVDDEQLNPYLN

SEQ ID NO: 1948134 - protein, 11 aa, Staphylococcus
HGEGDPPDNAV

SEQ ID NO: 1948135 - protein, 7 aa, Staphylococcus
HGEGQYD

SEQ ID NO: 1948136 - protein, 18 aa, Staphylococcus
HGEGRDELEQDIVEFFTQ

SEQ ID NO: 1948137 - protein, 18 aa, Staphylococcus
HGEGSDKVETQIAEFFMT

SEQ ID NO: 1948138 - protein, 4 aa, Staphylococcus
HGEK

SEQ ID NO: 1948139 - protein, 19 aa, Staphylococcus
HGEKKKKETEEDNTIKAEL

SEQ ID NO: 1948140 - protein, 5 aa, Staphylococcus
HGENA

SEQ ID NO: 1948141 - protein, 7 aa, Staphylococcus
HGENEPY

SEQ ID NO: 1948142 - protein, 18 aa, Staphylococcus
HGEPGIEKTTIRSSEETV

SEQ ID NO: 1948143 - protein, 17 aa, Staphylococcus
HGEPGIEKTTIRTAKET

SEQ ID NO: 1948144 - protein, 5 aa, Staphylococcus
HGEPI

SEQ ID NO: 1948145 - protein, 6 aa, Staphylococcus
HGEQKF

SEQ ID NO: 1948146 - protein, 15 aa, Staphylococcus
HGEQKISYVNTILKV

SEQ ID NO: 1948147 - protein, 13 aa, Staphylococcus
HGERITTLESKEV

SEQ ID NO: 1948148 - protein, 7 aa, Staphylococcus
HGESKFR

SEQ ID NO: 1948149 - protein, 8 aa, Staphylococcus
HGESVNMP

SEQ ID NO: 1948150 - protein, 7 aa, Staphylococcus
HGETGVD

SEQ ID NO: 1948151 - protein, 4 aa, Staphylococcus
HGEY

SEQ ID NO: 1948152 - protein, 8 aa, Staphylococcus
HGEYTDED

SEQ ID NO: 1948153 - protein, 5 aa, Staphylococcus
HGFSD

SEQ ID NO: 1948154 - protein, 8 aa, Staphylococcus
HGGAATNI

SEQ ID NO: 1948155 - protein, 8 aa, Staphylococcus
HGGARSNS

SEQ ID NO: 1948156 - protein, 10 aa, Staphylococcus
HGGARSNSAF

SEQ ID NO: 1948157 - protein, 11 aa, Staphylococcus
HGGGIEPATTE

SEQ ID NO: 1948158 - protein, 7 aa, Staphylococcus
HGGGISE

SEQ ID NO: 1948159 - protein, 8 aa, Staphylococcus
HGGPNGID

SEQ ID NO: 1948160 - protein, 9 aa, Staphylococcus
HGGPSDTNL

SEQ ID NO: 1948161 - protein, 10 aa, Staphylococcus
HGGREEIGKV

SEQ ID NO: 1948162 - protein, 32 aa, Staphylococcus
HGGRGGRGNSRFATPRNPAPDFSENGEPGEEL

SEQ ID NO: 1948163 - protein, 9 aa, Staphylococcus
HGGSKGLDK

SEQ ID NO: 1948164 - protein, 12 aa, Staphylococcus
HGGSKSVANQES

SEQ ID NO: 1948165 - protein, 8 aa, Staphylococcus
HGGSNGCD

SEQ ID NO: 1948166 - protein, 12 aa, Staphylococcus
HGGTKSNANQES

SEQ ID NO: 1948167 - protein, 13 aa, Staphylococcus
HGGTTPANRENIP

SEQ ID NO: 1948168 - protein, 9 aa, Staphylococcus
HGHARGPMA

SEQ ID NO: 1948169 - protein, 9 aa, Staphylococcus
HGHASRGYE

SEQ ID NO: 1948170 - protein, 15 aa, Staphylococcus
HGHDKDDITLQSSNV

SEQ ID NO: 1948171 - protein, 14 aa, Staphylococcus
HGHELSSDETFSSI

SEQ ID NO: 1948172 - protein, 4 aa, Staphylococcus
HGHG

SEQ ID NO: 1948173 - protein, 5 aa, Staphylococcus
HGHGE

SEQ ID NO: 1948174 - protein, 5 aa, Staphylococcus
HGHGK

SEQ ID NO: 1948175 - protein, 7 aa, Staphylococcus
HGHQGED

SEQ ID NO: 1948176 - protein, 7 aa, Staphylococcus
HGHSQGV

SEQ ID NO: 1948177 - protein, 7 aa, Staphylococcus
HGHSSGV

SEQ ID NO: 1948178 - protein, 11 aa, Staphylococcus
HGHTTTLTHRG

SEQ ID NO: 1948179 - protein, 10 aa, Staphylococcus
HGIPDDAKIG

SEQ ID NO: 1948180 - protein, 4 aa, Staphylococcus
HGKD

SEQ ID NO: 1948181 - protein, 6 aa, Staphylococcus
HGKESF

SEQ ID NO: 1948182 - protein, 23 aa, Staphylococcus
HGKGAYSNDPGAVANGYNERDFN

SEQ ID NO: 1948183 - protein, 10 aa, Staphylococcus
HGKGTENKNV

SEQ ID NO: 1948184 - protein, 9 aa, Staphylococcus
HGKGTENKV

SEQ ID NO: 1948185 - protein, 10 aa, Staphylococcus
HGKGTETKNV

SEQ ID NO: 1948186 - protein, 12 aa, Staphylococcus
HGKKPSPEEVQD

SEQ ID NO: 1948187 - protein, 12 aa, Staphylococcus
HGKKPTDEELQD

SEQ ID NO: 1948188 - protein, 11 aa, Staphylococcus
HGKKPTEAELQ

SEQ ID NO: 1948189 - protein, 12 aa, Staphylococcus
HGKPSGIDTQTI

SEQ ID NO: 1948190 - protein, 12 aa, Staphylococcus
HGKRPSDAELQD

SEQ ID NO: 1948191 - protein, 12 aa, Staphylococcus
HGKRPTDEELQD

SEQ ID NO: 1948192 - protein, 5 aa, Staphylococcus
HGKSA

SEQ ID NO: 1948193 - protein, 5 aa, Staphylococcus
HGKTI

SEQ ID NO: 1948194 - protein, 19 aa, Staphylococcus
HGKTKKTGTKVTFKPDPEI

SEQ ID NO: 1948195 - protein, 18 aa, Staphylococcus
HGKTNVEVASASAGLTAG

SEQ ID NO: 1948196 - protein, 6 aa, Staphylococcus
HGLGYG

SEQ ID NO: 1948197 - protein, 6 aa, Staphylococcus
HGLNDS

SEQ ID NO: 1948198 - protein, 11 aa, Staphylococcus
HGLQYDSDSEW

SEQ ID NO: 1948199 - protein, 5 aa, Staphylococcus
HGLTE

SEQ ID NO: 1948200 - protein, 6 aa, Staphylococcus
HGMDPS

SEQ ID NO: 1948201 - protein, 9 aa, Staphylococcus
HGMDPSLGV

SEQ ID NO: 1948202 - protein, 5 aa, Staphylococcus
HGNAF

SEQ ID NO: 1948203 - protein, 15 aa, Staphylococcus
HGNDPIAEGTDHTRE

SEQ ID NO: 1948204 - protein, 14 aa, Staphylococcus
HGNDPIAPGTDHTR

SEQ ID NO: 1948205 - protein, 15 aa, Staphylococcus
HGNDPIAPGTDHTRE

SEQ ID NO: 1948206 - protein, 15 aa, Staphylococcus
HGNDPTADGTDHTRE

SEQ ID NO: 1948207 - protein, 15 aa, Staphylococcus
HGNDPTAEGTDHTRE

SEQ ID NO: 1948208 - protein, 8 aa, Staphylococcus
HGNDYESL

SEQ ID NO: 1948209 - protein, 8 aa, Staphylococcus
HGNERSKI

SEQ ID NO: 1948210 - protein, 5 aa, Staphylococcus
HGNNF

SEQ ID NO: 1948211 - protein, 19 aa, Staphylococcus
HGNPQFEGQTKTKLGNSEV

SEQ ID NO: 1948212 - protein, 8 aa, Staphylococcus
HGNRSDID

SEQ ID NO: 1948213 - protein, 5 aa, Staphylococcus
HGNSI

SEQ ID NO: 1948214 - protein, 4 aa, Staphylococcus
HGNT

SEQ ID NO: 1948215 - protein, 10 aa, Staphylococcus
HGNTATYPQV

SEQ ID NO: 1948216 - protein, 9 aa, Staphylococcus
HGNTQTYPQ

SEQ ID NO: 1948217 - protein, 7 aa, Staphylococcus
HGNTQVD

SEQ ID NO: 1948218 - protein, 7 aa, Staphylococcus
HGPEQER

SEQ ID NO: 1948219 - protein, 9 aa, Staphylococcus
HGPKAGLSD

SEQ ID NO: 1948220 - protein, 12 aa, Staphylococcus
HGPLKSKTINRV

SEQ ID NO: 1948221 - protein, 17 aa, Staphylococcus
HGPRNKPETGRFAQEAG

SEQ ID NO: 1948222 - protein, 17 aa, Staphylococcus
HGPSQGKTYKDDNGRKV

SEQ ID NO: 1948223 - protein, 8 aa, Staphylococcus
HGPSQGRT

SEQ ID NO: 1948224 - protein, 16 aa, Staphylococcus
HGPSQGRTVQSDNGRE

SEQ ID NO: 1948225 - protein, 18 aa, Staphylococcus
HGPYTTVDDEQLNPFLDG

SEQ ID NO: 1948226 - protein, 17 aa, Staphylococcus
HGPYTTVEDEQLNPYLH

SEQ ID NO: 1948227 - protein, 5 aa, Staphylococcus
HGQAP

SEQ ID NO: 1948228 - protein, 9 aa, Staphylococcus
HGQDQTGTL

SEQ ID NO: 1948229 - protein, 8 aa, Staphylococcus
HGQEHSGT

SEQ ID NO: 1948230 - protein, 5 aa, Staphylococcus
HGQEQ

SEQ ID NO: 1948231 - protein, 6 aa, Staphylococcus
HGQEQM

SEQ ID NO: 1948232 - protein, 4 aa, Staphylococcus
HGQL

SEQ ID NO: 1948233 - protein, 6 aa, Staphylococcus
HGQLPN

SEQ ID NO: 1948234 - protein, 10 aa, Staphylococcus
HGQPDGYTSH

SEQ ID NO: 1948235 - protein, 6 aa, Staphylococcus
HGQRQT

SEQ ID NO: 1948236 - protein, 7 aa, Staphylococcus
HGQSGIE

SEQ ID NO: 1948237 - protein, 6 aa, Staphylococcus
HGQTGI

SEQ ID NO: 1948238 - protein, 7 aa, Staphylococcus
HGQTGVE

SEQ ID NO: 1948239 - protein, 12 aa, Staphylococcus
HGRDKAQKASFK

SEQ ID NO: 1948240 - protein, 7 aa, Staphylococcus
HGREPLV

SEQ ID NO: 1948241 - protein, 6 aa, Staphylococcus
HGRIEP

SEQ ID NO: 1948242 - protein, 12 aa, Staphylococcus
HGRNYDPNSEMS

SEQ ID NO: 1948243 - protein, 10 aa, Staphylococcus
HGRPKEKNEF

SEQ ID NO: 1948244 - protein, 8 aa, Staphylococcus
HGRSSETP

SEQ ID NO: 1948245 - protein, 6 aa, Staphylococcus
HGRTIQ

SEQ ID NO: 1948246 - protein, 7 aa, Staphylococcus
HGRTVQQ

SEQ ID NO: 1948247 - protein, 11 aa, Staphylococcus
HGSAPDIANQN

SEQ ID NO: 1948248 - protein, 5 aa, Staphylococcus
HGSDY

SEQ ID NO: 1948249 - protein, 7 aa, Staphylococcus
HGSDYNL

SEQ ID NO: 1948250 - protein, 12 aa, Staphylococcus
HGSESHNNPYHS

SEQ ID NO: 1948251 - protein, 5 aa, Staphylococcus
HGSEV

SEQ ID NO: 1948252 - protein, 6 aa, Staphylococcus
HGSFED

SEQ ID NO: 1948253 - protein, 12 aa, Staphylococcus
HGSHEEHKGRID

SEQ ID NO: 1948254 - protein, 4 aa, Staphylococcus
HGSK

SEQ ID NO: 1948255 - protein, 5 aa, Staphylococcus
HGSKP

SEQ ID NO: 1948256 - protein, 6 aa, Staphylococcus
HGSNNN

SEQ ID NO: 1948257 - protein, 10 aa, Staphylococcus
HGSRTSSSEE

SEQ ID NO: 1948258 - protein, 8 aa, Staphylococcus
HGSTYGSL

SEQ ID NO: 1948259 - protein, 4 aa, Staphylococcus
HGSV

SEQ ID NO: 1948260 - protein, 11 aa, Staphylococcus
HGSVSNNNPYH

SEQ ID NO: 1948261 - protein, 12 aa, Staphylococcus
HGTASFATSSGM

SEQ ID NO: 1948262 - protein, 10 aa, Staphylococcus
HGTDKNEAPI

SEQ ID NO: 1948263 - protein, 7 aa, Staphylococcus
HGTEDAV

SEQ ID NO: 1948264 - protein, 7 aa, Staphylococcus
HGTGKTQ

SEQ ID NO: 1948265 - protein, 7 aa, Staphylococcus
HGTGTPI

SEQ ID NO: 1948266 - protein, 14 aa, Staphylococcus
HGTNVEYDQVLVKL

SEQ ID NO: 1948267 - protein, 14 aa, Staphylococcus
HGTNVEYDQVLVTL

SEQ ID NO: 1948268 - protein, 13 aa, Staphylococcus
HGVASDKKIEEGD

SEQ ID NO: 1948269 - protein, 12 aa, Staphylococcus
HGVASDKRIEKG

SEQ ID NO: 1948270 - protein, 11 aa, Staphylococcus
HGVKADKDYLN

SEQ ID NO: 1948271 - protein, 4 aa, Staphylococcus
HGVN

SEQ ID NO: 1948272 - protein, 4 aa, Staphylococcus
HGVQ

SEQ ID NO: 1948273 - protein, 4 aa, Staphylococcus
HGVS

SEQ ID NO: 1948274 - protein, 4 aa, Staphylococcus
HGVT

SEQ ID NO: 1948275 - protein, 4 aa, Staphylococcus
HGYD

SEQ ID NO: 1948276 - protein, 10 aa, Staphylococcus
HGYDTNPIGG

SEQ ID NO: 1948277 - protein, 11 aa, Staphylococcus
HGYDTNPIGGF

SEQ ID NO: 1948278 - protein, 16 aa, Staphylococcus
HGYDTNPIGGFESDQI

SEQ ID NO: 1948279 - protein, 14 aa, Staphylococcus
HGYEIESKRGGGGY

SEQ ID NO: 1948280 - protein, 14 aa, Staphylococcus
HGYGNNDEDAKEGI

SEQ ID NO: 1948281 - protein, 10 aa, Staphylococcus
HGYSDKPQHI

SEQ ID NO: 1948282 - protein, 8 aa, Staphylococcus
HGYSDKPR

SEQ ID NO: 1948283 - protein, 9 aa, Staphylococcus
HGYSDKPRN

SEQ ID NO: 1948284 - protein, 10 aa, Staphylococcus
HGYSDKPRQI

SEQ ID NO: 1948285 - protein, 11 aa, Staphylococcus
HHAKGSARSIE

SEQ ID NO: 1948286 - protein, 4 aa, Staphylococcus
HHDD

SEQ ID NO: 1948287 - protein, 10 aa, Staphylococcus
HHEPNRTQRK

SEQ ID NO: 1948288 - protein, 11 aa, Staphylococcus
HHERTANRDGL

SEQ ID NO: 1948289 - protein, 10 aa, Staphylococcus
HHETDIADNA

SEQ ID NO: 1948290 - protein, 4 aa, Staphylococcus
HHFE

SEQ ID NO: 1948291 - protein, 5 aa, Staphylococcus
HHGNE

SEQ ID NO: 1948292 - protein, 11 aa, Staphylococcus
HHGSKTSSSEK

SEQ ID NO: 1948293 - protein, 10 aa, Staphylococcus
HHHEPNPDTV

SEQ ID NO: 1948294 - protein, 5 aa, Staphylococcus
HHKGQ

SEQ ID NO: 1948295 - protein, 9 aa, Staphylococcus
HHKNPIGEA

SEQ ID NO: 1948296 - protein, 9 aa, Staphylococcus
HHLSTPSLD

SEQ ID NO: 1948297 - protein, 6 aa, Staphylococcus
HHNEGG

SEQ ID NO: 1948298 - protein, 15 aa, Staphylococcus
HHNQRNDQWGGNAEN

SEQ ID NO: 1948299 - protein, 10 aa, Staphylococcus
HHNSDDKSMI

SEQ ID NO: 1948300 - protein, 6 aa, Staphylococcus
HHPLPQ

SEQ ID NO: 1948301 - protein, 4 aa, Staphylococcus
HHQD

SEQ ID NO: 1948302 - protein, 4 aa, Staphylococcus
HHQH

SEQ ID NO: 1948303 - protein, 4 aa, Staphylococcus
HHQT

SEQ ID NO: 1948304 - protein, 7 aa, Staphylococcus
HHQTSNQ

SEQ ID NO: 1948305 - protein, 11 aa, Staphylococcus
HHREKNEDAGG

SEQ ID NO: 1948306 - protein, 20 aa, Staphylococcus
HHRGATSYHPKMITSCTLSN

SEQ ID NO: 1948307 - protein, 5 aa, Staphylococcus
HHRKA

SEQ ID NO: 1948308 - protein, 11 aa, Staphylococcus
HHRSDYAVSDP

SEQ ID NO: 1948309 - protein, 5 aa, Staphylococcus
HHRTA

SEQ ID NO: 1948310 - protein, 7 aa, Staphylococcus
HHSEDYP

SEQ ID NO: 1948311 - protein, 8 aa, Staphylococcus
HHSKESIR

SEQ ID NO: 1948312 - protein, 7 aa, Staphylococcus
HHSPQNS

SEQ ID NO: 1948313 - protein, 6 aa, Staphylococcus
HHTQSA

SEQ ID NO: 1948314 - protein, 8 aa, Staphylococcus
HHTTTQSL

SEQ ID NO: 1948315 - protein, 17 aa, Staphylococcus
HIAENEYQSVDKDIQTE

SEQ ID NO: 1948316 - protein, 16 aa, Staphylococcus
HIANNRGTKVHVKKAD

SEQ ID NO: 1948317 - protein, 7 aa, Staphylococcus
HIDKSTG

SEQ ID NO: 1948318 - protein, 8 aa, Staphylococcus
HIDPKRDV

SEQ ID NO: 1948319 - protein, 10 aa, Staphylococcus
HIDSEQESRE

SEQ ID NO: 1948320 - protein, 9 aa, Staphylococcus
HIDSKTKDK

SEQ ID NO: 1948321 - protein, 7 aa, Staphylococcus
HIDSQQE

SEQ ID NO: 1948322 - protein, 6 aa, Staphylococcus
HIEDKN

SEQ ID NO: 1948323 - protein, 6 aa, Staphylococcus
HIEGQE

SEQ ID NO: 1948324 - protein, 16 aa, Staphylococcus
HIENPSEIISEGDEIE

SEQ ID NO: 1948325 - protein, 4 aa, Staphylococcus
HIEP

SEQ ID NO: 1948326 - protein, 5 aa, Staphylococcus
HIEYD

SEQ ID NO: 1948327 - protein, 20 aa, Staphylococcus
HIGGGTGASEGAKATTVTPG

SEQ ID NO: 1948328 - protein, 20 aa, Staphylococcus
HIGGGTGASEGTKATTVTPG

SEQ ID NO: 1948329 - protein, 9 aa, Staphylococcus
HIGGNPKTL

SEQ ID NO: 1948330 - protein, 7 aa, Staphylococcus
HIGPQNK

SEQ ID NO: 1948331 - protein, 21 aa, Staphylococcus
HIGRNDPCPCGSGKKYKNCCG

SEQ ID NO: 1948332 - protein, 13 aa, Staphylococcus
HIGSPSEALEPGQ

SEQ ID NO: 1948333 - protein, 14 aa, Staphylococcus
HIGTPGEVLEPGQQ

SEQ ID NO: 1948334 - protein, 15 aa, Staphylococcus
HIGTPSEVLEPNQEV

SEQ ID NO: 1948335 - protein, 10 aa, Staphylococcus
HIHGESGMDG

SEQ ID NO: 1948336 - protein, 6 aa, Staphylococcus
HIKVGS

SEQ ID NO: 1948337 - protein, 5 aa, Staphylococcus
HINAG

SEQ ID NO: 1948338 - protein, 4 aa, Staphylococcus
HINP

SEQ ID NO: 1948339 - protein, 4 aa, Staphylococcus
HIPD

SEQ ID NO: 1948340 - protein, 6 aa, Staphylococcus
HIPEEY

SEQ ID NO: 1948341 - protein, 5 aa, Staphylococcus
HIPSE

SEQ ID NO: 1948342 - protein, 6 aa, Staphylococcus
HIQATQ

SEQ ID NO: 1948343 - protein, 16 aa, Staphylococcus
HIQTSDERILPGGTGY

SEQ ID NO: 1948344 - protein, 16 aa, Staphylococcus
HIQTSDERILPNGTGY

SEQ ID NO: 1948345 - protein, 16 aa, Staphylococcus
HIQTSDNRILPSGTGY

SEQ ID NO: 1948346 - protein, 5 aa, Staphylococcus
HIREI

SEQ ID NO: 1948347 - protein, 6 aa, Staphylococcus
HIRKNN

SEQ ID NO: 1948348 - protein, 11 aa, Staphylococcus
HISDKDMKQDI

SEQ ID NO: 1948349 - protein, 5 aa, Staphylococcus
HISDT

SEQ ID NO: 1948350 - protein, 5 aa, Staphylococcus
HISGK

SEQ ID NO: 1948351 - protein, 11 aa, Staphylococcus
HISSEARDTIE

SEQ ID NO: 1948352 - protein, 10 aa, Staphylococcus
HISTGGGASL

SEQ ID NO: 1948353 - protein, 4 aa, Staphylococcus
HITD

SEQ ID NO: 1948354 - protein, 13 aa, Staphylococcus
HITGPEDPNIQKI

SEQ ID NO: 1948355 - protein, 18 aa, Staphylococcus
HITKDDTFDSINPANTSE

SEQ ID NO: 1948356 - protein, 19 aa, Staphylococcus
HITKDDTFDSINPANTSEL

SEQ ID NO: 1948357 - protein, 18 aa, Staphylococcus
HITQHQKDQSANPKLNDE

SEQ ID NO: 1948358 - protein, 23 aa, Staphylococcus
HITSEPSTLSMQQDDRQENEDQT

SEQ ID NO: 1948359 - protein, 6 aa, Staphylococcus
HKADQR

SEQ ID NO: 1948360 - protein, 4 aa, Staphylococcus
HKAN

SEQ ID NO: 1948361 - protein, 8 aa, Staphylococcus
HKANYSKA

SEQ ID NO: 1948362 - protein, 10 aa, Staphylococcus
HKARHATKAI

SEQ ID NO: 1948363 - protein, 11 aa, Staphylococcus
HKASTSNKGYI

SEQ ID NO: 1948364 - protein, 11 aa, Staphylococcus
HKATYTPHVDS

SEQ ID NO: 1948365 - protein, 6 aa, Staphylococcus
HKDDQL

SEQ ID NO: 1948366 - protein, 5 aa, Staphylococcus
HKDEI

SEQ ID NO: 1948367 - protein, 8 aa, Staphylococcus
HKDEIANN

SEQ ID NO: 1948368 - protein, 8 aa, Staphylococcus
HKDEIKAK

SEQ ID NO: 1948369 - protein, 8 aa, Staphylococcus
HKDEIKGK

SEQ ID NO: 1948370 - protein, 9 aa, Staphylococcus
HKDEIQNND

SEQ ID NO: 1948371 - protein, 11 aa, Staphylococcus
HKDEKESRFAN

SEQ ID NO: 1948372 - protein, 8 aa, Staphylococcus
HKDELKDT

SEQ ID NO: 1948373 - protein, 7 aa, Staphylococcus
HKDGIDE

SEQ ID NO: 1948374 - protein, 8 aa, Staphylococcus
HKDGKRGT

SEQ ID NO: 1948375 - protein, 5 aa, Staphylococcus
HKDIN

SEQ ID NO: 1948376 - protein, 20 aa, Staphylococcus
HKDINQSLSNEDAYKRARPS

SEQ ID NO: 1948377 - protein, 8 aa, Staphylococcus
HKDKAKSI

SEQ ID NO: 1948378 - protein, 8 aa, Staphylococcus
HKDKDYAT

SEQ ID NO: 1948379 - protein, 8 aa, Staphylococcus
HKDKNVSK

SEQ ID NO: 1948380 - protein, 22 aa, Staphylococcus
HKDLDGSETVVSGASCTTNSLA

SEQ ID NO: 1948381 - protein, 7 aa, Staphylococcus
HKDNGAQ

SEQ ID NO: 1948382 - protein, 8 aa, Staphylococcus
HKDPVAEA

SEQ ID NO: 1948383 - protein, 4 aa, Staphylococcus
HKDR

SEQ ID NO: 1948384 - protein, 6 aa, Staphylococcus
HKDRSI

SEQ ID NO: 1948385 - protein, 5 aa, Staphylococcus
HKDSY

SEQ ID NO: 1948386 - protein, 6 aa, Staphylococcus
HKDSYA

SEQ ID NO: 1948387 - protein, 6 aa, Staphylococcus
HKDYKT

SEQ ID NO: 1948388 - protein, 8 aa, Staphylococcus
HKEAEERF

SEQ ID NO: 1948389 - protein, 5 aa, Staphylococcus
HKEAQ

SEQ ID NO: 1948390 - protein, 6 aa, Staphylococcus
HKEEEY

SEQ ID NO: 1948391 - protein, 6 aa, Staphylococcus
HKEEVT

SEQ ID NO: 1948392 - protein, 6 aa, Staphylococcus
HKEEYM

SEQ ID NO: 1948393 - protein, 7 aa, Staphylococcus
HKEGANT

SEQ ID NO: 1948394 - protein, 5 aa, Staphylococcus
HKEGL

SEQ ID NO: 1948395 - protein, 7 aa, Staphylococcus
HKEKTGA

SEQ ID NO: 1948396 - protein, 10 aa, Staphylococcus
HKEKTQHADI

SEQ ID NO: 1948397 - protein, 8 aa, Staphylococcus
HKELSRQQ

SEQ ID NO: 1948398 - protein, 5 aa, Staphylococcus
HKEQH

SEQ ID NO: 1948399 - protein, 6 aa, Staphylococcus
HKEQQS

SEQ ID NO: 1948400 - protein, 8 aa, Staphylococcus
HKESVDSL

SEQ ID NO: 1948401 - protein, 6 aa, Staphylococcus
HKETIE

SEQ ID NO: 1948402 - protein, 9 aa, Staphylococcus
HKFGGPKGA

SEQ ID NO: 1948403 - protein, 9 aa, Staphylococcus
HKFGGPKGI

SEQ ID NO: 1948404 - protein, 10 aa, Staphylococcus
HKFPKDEKNK

SEQ ID NO: 1948405 - protein, 16 aa, Staphylococcus
HKGDSKLGVVVHAEHY

SEQ ID NO: 1948406 - protein, 7 aa, Staphylococcus
HKGEAIS

SEQ ID NO: 1948407 - protein, 10 aa, Staphylococcus
HKGGYTKAVS

SEQ ID NO: 1948408 - protein, 12 aa, Staphylococcus
HKGHKLNASPNR

SEQ ID NO: 1948409 - protein, 6 aa, Staphylococcus
HKGKDY

SEQ ID NO: 1948410 - protein, 10 aa, Staphylococcus
HKGKRSEELG

SEQ ID NO: 1948411 - protein, 11 aa, Staphylococcus
HKGKRSEELGI

SEQ ID NO: 1948412 - protein, 11 aa, Staphylococcus
HKGLSSDDINE

SEQ ID NO: 1948413 - protein, 5 aa, Staphylococcus
HKGNS

SEQ ID NO: 1948414 - protein, 12 aa, Staphylococcus
HKGQIPGVKKAS

SEQ ID NO: 1948415 - protein, 13 aa, Staphylococcus
HKGQKQAVYENTD

SEQ ID NO: 1948416 - protein, 7 aa, Staphylococcus
HKGSSKV

SEQ ID NO: 1948417 - protein, 9 aa, Staphylococcus
HKGTGAGSD

SEQ ID NO: 1948418 - protein, 7 aa, Staphylococcus
HKGVDID

SEQ ID NO: 1948419 - protein, 17 aa, Staphylococcus
HKGYDISSGIETNECKD

SEQ ID NO: 1948420 - protein, 7 aa, Staphylococcus
HKGYGTS

SEQ ID NO: 1948421 - protein, 8 aa, Staphylococcus
HKHKPEIE

SEQ ID NO: 1948422 - protein, 9 aa, Staphylococcus
HKHNPVAQA

SEQ ID NO: 1948423 - protein, 8 aa, Staphylococcus
HKHPADYN

SEQ ID NO: 1948424 - protein, 9 aa, Staphylococcus
HKINNDDRG

SEQ ID NO: 1948425 - protein, 5 aa, Staphylococcus
HKIPE

SEQ ID NO: 1948426 - protein, 4 aa, Staphylococcus
HKKA

SEQ ID NO: 1948427 - protein, 7 aa, Staphylococcus
HKKEKGV

SEQ ID NO: 1948428 - protein, 13 aa, Staphylococcus
HKKEQGQKVREIF

SEQ ID NO: 1948429 - protein, 4 aa, Staphylococcus
HKKG

SEQ ID NO: 1948430 - protein, 8 aa, Staphylococcus
HKKKGQAV

SEQ ID NO: 1948431 - protein, 8 aa, Staphylococcus
HKKKGQTI

SEQ ID NO: 1948432 - protein, 13 aa, Staphylococcus
HKKLTSVDKENVL

SEQ ID NO: 1948433 - protein, 7 aa, Staphylococcus
HKKNEIE

SEQ ID NO: 1948434 - protein, 26 aa, Staphylococcus
HKKQTPNHSEETEVQKPTIRKGPNIK

SEQ ID NO: 1948435 - protein, 24 aa, Staphylococcus
HKKRRGKQNKPQTDSGDQSLAQDR

SEQ ID NO: 1948436 - protein, 6 aa, Staphylococcus
HKKSAR

SEQ ID NO: 1948437 - protein, 25 aa, Staphylococcus
HKKSKNGEADKPPFQKTLRQYTVVE

SEQ ID NO: 1948438 - protein, 6 aa, Staphylococcus
HKKSQP

SEQ ID NO: 1948439 - protein, 6 aa, Staphylococcus
HKKTAR

SEQ ID NO: 1948440 - protein, 5 aa, Staphylococcus
HKKTY

SEQ ID NO: 1948441 - protein, 6 aa, Staphylococcus
HKKYEQ

SEQ ID NO: 1948442 - protein, 7 aa, Staphylococcus
HKLTPRR

SEQ ID NO: 1948443 - protein, 20 aa, Staphylococcus
HKMSKSIDSYKVDNKAIDEL

SEQ ID NO: 1948444 - protein, 5 aa, Staphylococcus
HKNAA

SEQ ID NO: 1948445 - protein, 14 aa, Staphylococcus
HKNAYDKQQKEIKA

SEQ ID NO: 1948446 - protein, 8 aa, Staphylococcus
HKNEPRYD

SEQ ID NO: 1948447 - protein, 4 aa, Staphylococcus
HKNG

SEQ ID NO: 1948448 - protein, 7 aa, Staphylococcus
HKNKNHT

SEQ ID NO: 1948449 - protein, 9 aa, Staphylococcus
HKNNKTNNK

SEQ ID NO: 1948450 - protein, 7 aa, Staphylococcus
HKNNLSK

SEQ ID NO: 1948451 - protein, 9 aa, Staphylococcus
HKNNPRAIR

SEQ ID NO: 1948452 - protein, 7 aa, Staphylococcus
HKNQELN

SEQ ID NO: 1948453 - protein, 8 aa, Staphylococcus
HKNRDDNN

SEQ ID NO: 1948454 - protein, 9 aa, Staphylococcus
HKNTTTGIS

SEQ ID NO: 1948455 - protein, 16 aa, Staphylococcus
HKNTTTGISANERTLT

SEQ ID NO: 1948456 - protein, 13 aa, Staphylococcus
HKNYNGPKGATGY

SEQ ID NO: 1948457 - protein, 10 aa, Staphylococcus
HKPDAFPTDI

SEQ ID NO: 1948458 - protein, 4 aa, Staphylococcus
HKPE

SEQ ID NO: 1948459 - protein, 9 aa, Staphylococcus
HKPETTFGN

SEQ ID NO: 1948460 - protein, 4 aa, Staphylococcus
HKPH

SEQ ID NO: 1948461 - protein, 5 aa, Staphylococcus
HKPLP

SEQ ID NO: 1948462 - protein, 7 aa, Staphylococcus
HKPMKAQ

SEQ ID NO: 1948463 - protein, 7 aa, Staphylococcus
HKPNLDP

SEQ ID NO: 1948464 - protein, 4 aa, Staphylococcus
HKPQ

SEQ ID NO: 1948465 - protein, 12 aa, Staphylococcus
HKPSGAKPGFVT

SEQ ID NO: 1948466 - protein, 4 aa, Staphylococcus
HKQE

SEQ ID NO: 1948467 - protein, 13 aa, Staphylococcus
HKQGPLSEGTVSE

SEQ ID NO: 1948468 - protein, 13 aa, Staphylococcus
HKQGPLSEGTVSG

SEQ ID NO: 1948469 - protein, 9 aa, Staphylococcus
HKQKDDDKQ

SEQ ID NO: 1948470 - protein, 8 aa, Staphylococcus
HKQNPAAV

SEQ ID NO: 1948471 - protein, 16 aa, Staphylococcus
HKRAFDGDKGPNTGGM

SEQ ID NO: 1948472 - protein, 8 aa, Staphylococcus
HKRATVKQ

SEQ ID NO: 1948473 - protein, 16 aa, Staphylococcus
HKRAYDNDKGPNTGGM

SEQ ID NO: 1948474 - protein, 16 aa, Staphylococcus
HKRAYDYDKGPNTGGM

SEQ ID NO: 1948475 - protein, 14 aa, Staphylococcus
HKRELAYTRYSWPK

SEQ ID NO: 1948476 - protein, 7 aa, Staphylococcus
HKRPDDQ

SEQ ID NO: 1948477 - protein, 7 aa, Staphylococcus
HKRPEDQ

SEQ ID NO: 1948478 - protein, 6 aa, Staphylococcus
HKRSQI

SEQ ID NO: 1948479 - protein, 7 aa, Staphylococcus
HKRSSHL

SEQ ID NO: 1948480 - protein, 8 aa, Staphylococcus
HKRSTEIQ

SEQ ID NO: 1948481 - protein, 8 aa, Staphylococcus
HKSGKPTV

SEQ ID NO: 1948482 - protein, 8 aa, Staphylococcus
HKSHNKKN

SEQ ID NO: 1948483 - protein, 4 aa, Staphylococcus
HKSQ

SEQ ID NO: 1948484 - protein, 8 aa, Staphylococcus
HKSRRVFN

SEQ ID NO: 1948485 - protein, 6 aa, Staphylococcus
HKSSDQ

SEQ ID NO: 1948486 - protein, 14 aa, Staphylococcus
HKSSFKSQLDESNQ

SEQ ID NO: 1948487 - protein, 8 aa, Staphylococcus
HKSTKKFK

SEQ ID NO: 1948488 - protein, 7 aa, Staphylococcus
HKSTTHT

SEQ ID NO: 1948489 - protein, 6 aa, Staphylococcus
HKTAED

SEQ ID NO: 1948490 - protein, 10 aa, Staphylococcus
HKTDSSPRYV

SEQ ID NO: 1948491 - protein, 7 aa, Staphylococcus
HKTEQLP

SEQ ID NO: 1948492 - protein, 5 aa, Staphylococcus
HKTKT

SEQ ID NO: 1948493 - protein, 4 aa, Staphylococcus
HKTL

SEQ ID NO: 1948494 - protein, 6 aa, Staphylococcus
HKTPSA

SEQ ID NO: 1948495 - protein, 6 aa, Staphylococcus
HKTRPS

SEQ ID NO: 1948496 - protein, 5 aa, Staphylococcus
HKTSV

SEQ ID NO: 1948497 - protein, 6 aa, Staphylococcus
HKTSVD

SEQ ID NO: 1948498 - protein, 6 aa, Staphylococcus
HKTTAL

SEQ ID NO: 1948499 - protein, 6 aa, Staphylococcus
HKTTDQ

SEQ ID NO: 1948500 - protein, 7 aa, Staphylococcus
HKTTSNA

SEQ ID NO: 1948501 - protein, 7 aa, Staphylococcus
HKTVTAV

SEQ ID NO: 1948502 - protein, 10 aa, Staphylococcus
HKTYRDSEHT

SEQ ID NO: 1948503 - protein, 11 aa, Staphylococcus
HKVDEGSYQPS

SEQ ID NO: 1948504 - protein, 17 aa, Staphylococcus
HKVGEGIAEGLASTGLK

SEQ ID NO: 1948505 - protein, 4 aa, Staphylococcus
HKVN

SEQ ID NO: 1948506 - protein, 6 aa, Staphylococcus
HKVNEA

SEQ ID NO: 1948507 - protein, 5 aa, Staphylococcus
HKVPR

SEQ ID NO: 1948508 - protein, 10 aa, Staphylococcus
HKVRTRSESF

SEQ ID NO: 1948509 - protein, 9 aa, Staphylococcus
HKWADTRAM

SEQ ID NO: 1948510 - protein, 6 aa, Staphylococcus
HKYPQA

SEQ ID NO: 1948511 - protein, 4 aa, Staphylococcus
HLAD

SEQ ID NO: 1948512 - protein, 7 aa, Staphylococcus
HLDDKSS

SEQ ID NO: 1948513 - protein, 6 aa, Staphylococcus
HLDGET

SEQ ID NO: 1948514 - protein, 12 aa, Staphylococcus
HLDKEIKNKRLQ

SEQ ID NO: 1948515 - protein, 16 aa, Staphylococcus
HLDKEKYEAQPPFIWG

SEQ ID NO: 1948516 - protein, 8 aa, Staphylococcus
HLDPDKPT

SEQ ID NO: 1948517 - protein, 13 aa, Staphylococcus
HLENKNSQQQQSS

SEQ ID NO: 1948518 - protein, 4 aa, Staphylococcus
HLEP

SEQ ID NO: 1948519 - protein, 7 aa, Staphylococcus
HLERKKG

SEQ ID NO: 1948520 - protein, 11 aa, Staphylococcus
HLERKKGSISY

SEQ ID NO: 1948521 - protein, 5 aa, Staphylococcus
HLEYK

SEQ ID NO: 1948522 - protein, 21 aa, Staphylococcus
HLGESTGYDYTRTKNPTRSAF

SEQ ID NO: 1948523 - protein, 5 aa, Staphylococcus
HLGET

SEQ ID NO: 1948524 - protein, 22 aa, Staphylococcus
HLGQSTGYDYTRTKNPTRSSFE

SEQ ID NO: 1948525 - protein, 5 aa, Staphylococcus
HLNQQ

SEQ ID NO: 1948526 - protein, 5 aa, Staphylococcus
HLPAK

SEQ ID NO: 1948527 - protein, 6 aa, Staphylococcus
HLPEGN

SEQ ID NO: 1948528 - protein, 19 aa, Staphylococcus
HLPEGPKYYPDDQISDHPE

SEQ ID NO: 1948529 - protein, 14 aa, Staphylococcus
HLQEKQGVKGTTFT

SEQ ID NO: 1948530 - protein, 10 aa, Staphylococcus
HLQQASSGGA

SEQ ID NO: 1948531 - protein, 11 aa, Staphylococcus
HLQQQSDEEAL

SEQ ID NO: 1948532 - protein, 4 aa, Staphylococcus
HLSD

SEQ ID NO: 1948533 - protein, 18 aa, Staphylococcus
HLSDTSAVDSLTYTSDEI

SEQ ID NO: 1948534 - protein, 19 aa, Staphylococcus
HLSEEQRKQFEAEGRKPSI

SEQ ID NO: 1948535 - protein, 7 aa, Staphylococcus
HLSERER

SEQ ID NO: 1948536 - protein, 9 aa, Staphylococcus
HLSGGERQR

SEQ ID NO: 1948537 - protein, 8 aa, Staphylococcus
HLSGSTYS

SEQ ID NO: 1948538 - protein, 8 aa, Staphylococcus
HLSPKTQA

SEQ ID NO: 1948539 - protein, 5 aa, Staphylococcus
HLSPV

SEQ ID NO: 1948540 - protein, 5 aa, Staphylococcus
HLTDG

SEQ ID NO: 1948541 - protein, 11 aa, Staphylococcus
HLTDSKGRNVD

SEQ ID NO: 1948542 - protein, 11 aa, Staphylococcus
HLTDTKGRTVD

SEQ ID NO: 1948543 - protein, 19 aa, Staphylococcus
HLTEEERQQFEAEGRKPSI

SEQ ID NO: 1948544 - protein, 18 aa, Staphylococcus
HLTEEQRQQFEAEGRKPA

SEQ ID NO: 1948545 - protein, 18 aa, Staphylococcus
HLTEEQRQQFEAEGRQPA

SEQ ID NO: 1948546 - protein, 7 aa, Staphylococcus
HLTEPGD

SEQ ID NO: 1948547 - protein, 11 aa, Staphylococcus
HLTHGSPVNFS

SEQ ID NO: 1948548 - protein, 10 aa, Staphylococcus
HLTSDQQRAF

SEQ ID NO: 1948549 - protein, 8 aa, Staphylococcus
HMAEDEKS

SEQ ID NO: 1948550 - protein, 5 aa, Staphylococcus
HMDGE

SEQ ID NO: 1948551 - protein, 9 aa, Staphylococcus
HMEAGKKSV

SEQ ID NO: 1948552 - protein, 5 aa, Staphylococcus
HMGGT

SEQ ID NO: 1948553 - protein, 4 aa, Staphylococcus
HMGS

SEQ ID NO: 1948554 - protein, 14 aa, Staphylococcus
HMKTSEVYDIYHEV

SEQ ID NO: 1948555 - protein, 6 aa, Staphylococcus
HMNDAE

SEQ ID NO: 1948556 - protein, 5 aa, Staphylococcus
HMPQE

SEQ ID NO: 1948557 - protein, 11 aa, Staphylococcus
HMRRGGKRSEV

SEQ ID NO: 1948558 - protein, 11 aa, Staphylococcus
HMSVNPEAAGM

SEQ ID NO: 1948559 - protein, 11 aa, Staphylococcus
HNAEEVKKRPH

SEQ ID NO: 1948560 - protein, 10 aa, Staphylococcus
HNAEPEKAEE

SEQ ID NO: 1948561 - protein, 14 aa, Staphylococcus
HNAEPEKTEEIKAA

SEQ ID NO: 1948562 - protein, 25 aa, Staphylococcus
HNAEPEKTEEIKAASIAEAKELAKT

SEQ ID NO: 1948563 - protein, 9 aa, Staphylococcus
HNAKHTKYS

SEQ ID NO: 1948564 - protein, 6 aa, Staphylococcus
HNAKTG

SEQ ID NO: 1948565 - protein, 10 aa, Staphylococcus
HNAQETKDLG

SEQ ID NO: 1948566 - protein, 7 aa, Staphylococcus
HNASGEA

SEQ ID NO: 1948567 - protein, 6 aa, Staphylococcus
HNDAAI

SEQ ID NO: 1948568 - protein, 13 aa, Staphylococcus
HNDEEIATGVSSD

SEQ ID NO: 1948569 - protein, 7 aa, Staphylococcus
HNDGITE

SEQ ID NO: 1948570 - protein, 22 aa, Staphylococcus
HNDLDGSETVVSGASCTTNSLA

SEQ ID NO: 1948571 - protein, 8 aa, Staphylococcus
HNDNTKAY

SEQ ID NO: 1948572 - protein, 36 aa, Staphylococcus
HNDNTSQEKQQTKATTATRNTTSKTESLQPSSIPVN

SEQ ID NO: 1948573 - protein, 8 aa, Staphylococcus
HNDPDTLN

SEQ ID NO: 1948574 - protein, 4 aa, Staphylococcus
HNDQ

SEQ ID NO: 1948575 - protein, 6 aa, Staphylococcus
HNDTDH

SEQ ID NO: 1948576 - protein, 9 aa, Staphylococcus
HNDTSDITI

SEQ ID NO: 1948577 - protein, 6 aa, Staphylococcus
HNDVET

SEQ ID NO: 1948578 - protein, 8 aa, Staphylococcus
HNDYPNQQ

SEQ ID NO: 1948579 - protein, 9 aa, Staphylococcus
HNEAATKIL

SEQ ID NO: 1948580 - protein, 8 aa, Staphylococcus
HNEADGKR

SEQ ID NO: 1948581 - protein, 5 aa, Staphylococcus
HNEDN

SEQ ID NO: 1948582 - protein, 34 aa, Staphylococcus
HNEELTADQQVKSSINDNQTTTRETFNDNENNKV

SEQ ID NO: 1948583 - protein, 11 aa, Staphylococcus
HNEIKPGGAAL

SEQ ID NO: 1948584 - protein, 11 aa, Staphylococcus
HNEMDEPSITN

SEQ ID NO: 1948585 - protein, 14 aa, Staphylococcus
HNEMDEPSITNPLP

SEQ ID NO: 1948586 - protein, 4 aa, Staphylococcus
HNEP

SEQ ID NO: 1948587 - protein, 4 aa, Staphylococcus
HNEQ

SEQ ID NO: 1948588 - protein, 4 aa, Staphylococcus
HNET

SEQ ID NO: 1948589 - protein, 7 aa, Staphylococcus
HNETSVK

SEQ ID NO: 1948590 - protein, 6 aa, Staphylococcus
HNETTV

SEQ ID NO: 1948591 - protein, 13 aa, Staphylococcus
HNEVEKEARDKAA

SEQ ID NO: 1948592 - protein, 13 aa, Staphylococcus
HNEVEKEARDKAS

SEQ ID NO: 1948593 - protein, 13 aa, Staphylococcus
HNEVEQEARDKAA

SEQ ID NO: 1948594 - protein, 11 aa, Staphylococcus
HNFPKEETNVQ

SEQ ID NO: 1948595 - protein, 13 aa, Staphylococcus
HNGASRADSGEVI

SEQ ID NO: 1948596 - protein, 4 aa, Staphylococcus
HNGE

SEQ ID NO: 1948597 - protein, 6 aa, Staphylococcus
HNGEKF

SEQ ID NO: 1948598 - protein, 7 aa, Staphylococcus
HNGELTE

SEQ ID NO: 1948599 - protein, 4 aa, Staphylococcus
HNGG

SEQ ID NO: 1948600 - protein, 25 aa, Staphylococcus
HNGGEEIESSTLEDGTVVRRFQIEI

SEQ ID NO: 1948601 - protein, 6 aa, Staphylococcus
HNGKET

SEQ ID NO: 1948602 - protein, 6 aa, Staphylococcus
HNGLKS

SEQ ID NO: 1948603 - protein, 9 aa, Staphylococcus
HNGSGKSTL

SEQ ID NO: 1948604 - protein, 5 aa, Staphylococcus
HNGSI

SEQ ID NO: 1948605 - protein, 9 aa, Staphylococcus
HNHNQYTSY

SEQ ID NO: 1948606 - protein, 7 aa, Staphylococcus
HNIPRDK

SEQ ID NO: 1948607 - protein, 9 aa, Staphylococcus
HNKANDATV

SEQ ID NO: 1948608 - protein, 9 aa, Staphylococcus
HNKEISKVK

SEQ ID NO: 1948609 - protein, 5 aa, Staphylococcus
HNKEL

SEQ ID NO: 1948610 - protein, 6 aa, Staphylococcus
HNKEQM

SEQ ID NO: 1948611 - protein, 7 aa, Staphylococcus
HNKGELT

SEQ ID NO: 1948612 - protein, 9 aa, Staphylococcus
HNKKTRDQM

SEQ ID NO: 1948613 - protein, 14 aa, Staphylococcus
HNLGKGAKYTKARR

SEQ ID NO: 1948614 - protein, 5 aa, Staphylococcus
HNLST

SEQ ID NO: 1948615 - protein, 13 aa, Staphylococcus
HNLYKEKDEFHIE

SEQ ID NO: 1948616 - protein, 6 aa, Staphylococcus
HNMDKN

SEQ ID NO: 1948617 - protein, 20 aa, Staphylococcus
HNMPNNYDKPLKVERVSFNE

SEQ ID NO: 1948618 - protein, 7 aa, Staphylococcus
HNNDNVE

SEQ ID NO: 1948619 - protein, 10 aa, Staphylococcus
HNNDVSNSEQ

SEQ ID NO: 1948620 - protein, 8 aa, Staphylococcus
HNNEAEQS

SEQ ID NO: 1948621 - protein, 12 aa, Staphylococcus
HNNGQGAKYTKI

SEQ ID NO: 1948622 - protein, 8 aa, Staphylococcus
HNNGSGTL

SEQ ID NO: 1948623 - protein, 9 aa, Staphylococcus
HNNPNSEIP

SEQ ID NO: 1948624 - protein, 7 aa, Staphylococcus
HNNQNYP

SEQ ID NO: 1948625 - protein, 20 aa, Staphylococcus
HNNVQGASDMGSMPDQFPGY

SEQ ID NO: 1948626 - protein, 4 aa, Staphylococcus
HNPD

SEQ ID NO: 1948627 - protein, 6 aa, Staphylococcus
HNPDHN

SEQ ID NO: 1948628 - protein, 5 aa, Staphylococcus
HNPDI

SEQ ID NO: 1948629 - protein, 6 aa, Staphylococcus
HNPDQL

SEQ ID NO: 1948630 - protein, 4 aa, Staphylococcus
HNPE

SEQ ID NO: 1948631 - protein, 8 aa, Staphylococcus
HNPETLET

SEQ ID NO: 1948632 - protein, 7 aa, Staphylococcus
HNPKDYN

SEQ ID NO: 1948633 - protein, 9 aa, Staphylococcus
HNPNRDGHG

SEQ ID NO: 1948634 - protein, 8 aa, Staphylococcus
HNPPMEDA

SEQ ID NO: 1948635 - protein, 9 aa, Staphylococcus
HNPPMEDAA

SEQ ID NO: 1948636 - protein, 7 aa, Staphylococcus
HNPPMQD

SEQ ID NO: 1948637 - protein, 7 aa, Staphylococcus
HNPSGRV

SEQ ID NO: 1948638 - protein, 5 aa, Staphylococcus
HNPSK

SEQ ID NO: 1948639 - protein, 8 aa, Staphylococcus
HNPTGVQY

SEQ ID NO: 1948640 - protein, 6 aa, Staphylococcus
HNPTQD

SEQ ID NO: 1948641 - protein, 7 aa, Staphylococcus
HNPVPDN

SEQ ID NO: 1948642 - protein, 4 aa, Staphylococcus
HNQD

SEQ ID NO: 1948643 - protein, 4 aa, Staphylococcus
HNQE

SEQ ID NO: 1948644 - protein, 7 aa, Staphylococcus
HNQLSTD

SEQ ID NO: 1948645 - protein, 7 aa, Staphylococcus
HNQLTSE

SEQ ID NO: 1948646 - protein, 16 aa, Staphylococcus
HNQPDHVYSPSTSKSL

SEQ ID NO: 1948647 - protein, 5 aa, Staphylococcus
HNQQI

SEQ ID NO: 1948648 - protein, 9 aa, Staphylococcus
HNQQSSYTR

SEQ ID NO: 1948649 - protein, 11 aa, Staphylococcus
HNRKTQGKTQA

SEQ ID NO: 1948650 - protein, 6 aa, Staphylococcus
HNSEKI

SEQ ID NO: 1948651 - protein, 10 aa, Staphylococcus
HNSERKPKGL

SEQ ID NO: 1948652 - protein, 9 aa, Staphylococcus
HNTDPISGQ

SEQ ID NO: 1948653 - protein, 8 aa, Staphylococcus
HNTEITGN

SEQ ID NO: 1948654 - protein, 11 aa, Staphylococcus
HNTERKPKGLW

SEQ ID NO: 1948655 - protein, 6 aa, Staphylococcus
HNTKEF

SEQ ID NO: 1948656 - protein, 4 aa, Staphylococcus
HNTN

SEQ ID NO: 1948657 - protein, 10 aa, Staphylococcus
HNTNDGRFAE

SEQ ID NO: 1948658 - protein, 18 aa, Staphylococcus
HNTRRTRQHKDDHLTNEV

SEQ ID NO: 1948659 - protein, 14 aa, Staphylococcus
HNTSNDDGTISESE

SEQ ID NO: 1948660 - protein, 7 aa, Staphylococcus
HNTTTIE

SEQ ID NO: 1948661 - protein, 10 aa, Staphylococcus
HNVAQSGRYT

SEQ ID NO: 1948662 - protein, 6 aa, Staphylococcus
HNVDPT

SEQ ID NO: 1948663 - protein, 13 aa, Staphylococcus
HNVKETVKRAYRQ

SEQ ID NO: 1948664 - protein, 10 aa, Staphylococcus
HNVPGADDYT

SEQ ID NO: 1948665 - protein, 12 aa, Staphylococcus
HNVPGADTHTHS

SEQ ID NO: 1948666 - protein, 8 aa, Staphylococcus
HNVSNNKK

SEQ ID NO: 1948667 - protein, 6 aa, Staphylococcus
HNYDNG

SEQ ID NO: 1948668 - protein, 4 aa, Staphylococcus
HNYE

SEQ ID NO: 1948669 - protein, 18 aa, Staphylococcus
HNYKTAREQALSNNHIPE

SEQ ID NO: 1948670 - protein, 18 aa, Staphylococcus
HNYKTARERALSNNHIPE

SEQ ID NO: 1948671 - protein, 7 aa, Staphylococcus
HNYKTEK

SEQ ID NO: 1948672 - protein, 6 aa, Staphylococcus
HNYTET

SEQ ID NO: 1948673 - protein, 5 aa, Staphylococcus
HPAGR

SEQ ID NO: 1948674 - protein, 5 aa, Staphylococcus
HPAKQ

SEQ ID NO: 1948675 - protein, 4 aa, Staphylococcus
HPAN

SEQ ID NO: 1948676 - protein, 4 aa, Staphylococcus
HPAV

SEQ ID NO: 1948677 - protein, 4 aa, Staphylococcus
HPDA

SEQ ID NO: 1948678 - protein, 6 aa, Staphylococcus
HPDEDH

SEQ ID NO: 1948679 - protein, 6 aa, Staphylococcus
HPDEIP

SEQ ID NO: 1948680 - protein, 5 aa, Staphylococcus
HPDET

SEQ ID NO: 1948681 - protein, 9 aa, Staphylococcus
HPDHEATAD

SEQ ID NO: 1948682 - protein, 4 aa, Staphylococcus
HPDK

SEQ ID NO: 1948683 - protein, 14 aa, Staphylococcus
HPDKPKEIKPKKVF

SEQ ID NO: 1948684 - protein, 6 aa, Staphylococcus
HPDKPV

SEQ ID NO: 1948685 - protein, 5 aa, Staphylococcus
HPDKR

SEQ ID NO: 1948686 - protein, 6 aa, Staphylococcus
HPDPAV

SEQ ID NO: 1948687 - protein, 5 aa, Staphylococcus
HPDSP

SEQ ID NO: 1948688 - protein, 5 aa, Staphylococcus
HPDTQ

SEQ ID NO: 1948689 - protein, 5 aa, Staphylococcus
HPEAG

SEQ ID NO: 1948690 - protein, 9 aa, Staphylococcus
HPEAKNKNS

SEQ ID NO: 1948691 - protein, 8 aa, Staphylococcus
HPEAKNRN

SEQ ID NO: 1948692 - protein, 9 aa, Staphylococcus
HPEAKNRNS

SEQ ID NO: 1948693 - protein, 8 aa, Staphylococcus
HPEAQHQN

SEQ ID NO: 1948694 - protein, 6 aa, Staphylococcus
HPEAYQ

SEQ ID NO: 1948695 - protein, 4 aa, Staphylococcus
HPED

SEQ ID NO: 1948696 - protein, 5 aa, Staphylococcus
HPEFQ

SEQ ID NO: 1948697 - protein, 9 aa, Staphylococcus
HPEFRSQYE

SEQ ID NO: 1948698 - protein, 8 aa, Staphylococcus
HPEGGYYK

SEQ ID NO: 1948699 - protein, 8 aa, Staphylococcus
HPEGGYYR

SEQ ID NO: 1948700 - protein, 4 aa, Staphylococcus
HPEK

SEQ ID NO: 1948701 - protein, 7 aa, Staphylococcus
HPEKTTP

SEQ ID NO: 1948702 - protein, 6 aa, Staphylococcus
HPENEL

SEQ ID NO: 1948703 - protein, 6 aa, Staphylococcus
HPEQYQ

SEQ ID NO: 1948704 - protein, 4 aa, Staphylococcus
HPET

SEQ ID NO: 1948705 - protein, 5 aa, Staphylococcus
HPETG

SEQ ID NO: 1948706 - protein, 5 aa, Staphylococcus
HPEYT

SEQ ID NO: 1948707 - protein, 6 aa, Staphylococcus
HPFAQQ

SEQ ID NO: 1948708 - protein, 4 aa, Staphylococcus
HPFS

SEQ ID NO: 1948709 - protein, 16 aa, Staphylococcus
HPGKKGGKSSAPREVS

SEQ ID NO: 1948710 - protein, 25 aa, Staphylococcus
HPGKQSPKSLSKQPVAPSAIPLSGG

SEQ ID NO: 1948711 - protein, 9 aa, Staphylococcus
HPGSLGPIH

SEQ ID NO: 1948712 - protein, 5 aa, Staphylococcus
HPGTY

SEQ ID NO: 1948713 - protein, 11 aa, Staphylococcus
HPHADSEKQKT

SEQ ID NO: 1948714 - protein, 4 aa, Staphylococcus
HPHG

SEQ ID NO: 1948715 - protein, 4 aa, Staphylococcus
HPHN

SEQ ID NO: 1948716 - protein, 8 aa, Staphylococcus
HPHSRKEF

SEQ ID NO: 1948717 - protein, 10 aa, Staphylococcus
HPIADTSHVE

SEQ ID NO: 1948718 - protein, 12 aa, Staphylococcus
HPIGKKKLKDLS

SEQ ID NO: 1948719 - protein, 6 aa, Staphylococcus
HPIQNE

SEQ ID NO: 1948720 - protein, 7 aa, Staphylococcus
HPITTPS

SEQ ID NO: 1948721 - protein, 6 aa, Staphylococcus
HPKAGE

SEQ ID NO: 1948722 - protein, 8 aa, Staphylococcus
HPKDDYTK

SEQ ID NO: 1948723 - protein, 8 aa, Staphylococcus
HPKDKQSL

SEQ ID NO: 1948724 - protein, 4 aa, Staphylococcus
HPKH

SEQ ID NO: 1948725 - protein, 12 aa, Staphylococcus
HPKINGKGHGEG

SEQ ID NO: 1948726 - protein, 12 aa, Staphylococcus
HPKKDEEAYQKR

SEQ ID NO: 1948727 - protein, 10 aa, Staphylococcus
HPKKDHEAYE

SEQ ID NO: 1948728 - protein, 14 aa, Staphylococcus
HPKKDKDAYEQRNA

SEQ ID NO: 1948729 - protein, 13 aa, Staphylococcus
HPKKDKEAYEQRN

SEQ ID NO: 1948730 - protein, 5 aa, Staphylococcus
HPKLK

SEQ ID NO: 1948731 - protein, 12 aa, Staphylococcus
HPKNKGGSGAQR

SEQ ID NO: 1948732 - protein, 14 aa, Staphylococcus
HPKQGDLHHPGETE

SEQ ID NO: 1948733 - protein, 13 aa, Staphylococcus
HPKQGDLHHPKAT

SEQ ID NO: 1948734 - protein, 14 aa, Staphylococcus
HPKQGDLHNPGQTE

SEQ ID NO: 1948735 - protein, 14 aa, Staphylococcus
HPKQGDLHNPNEST

SEQ ID NO: 1948736 - protein, 14 aa, Staphylococcus
HPKQGDLHNPNETK

SEQ ID NO: 1948737 - protein, 5 aa, Staphylococcus
HPKQY

SEQ ID NO: 1948738 - protein, 11 aa, Staphylococcus
HPKSDDFKTTH

SEQ ID NO: 1948739 - protein, 8 aa, Staphylococcus
HPKSDEFK

SEQ ID NO: 1948740 - protein, 16 aa, Staphylococcus
HPKTDELKRFLNVINE

SEQ ID NO: 1948741 - protein, 16 aa, Staphylococcus
HPKTEELRRFLNVINE

SEQ ID NO: 1948742 - protein, 10 aa, Staphylococcus
HPKTEKDYDL

SEQ ID NO: 1948743 - protein, 9 aa, Staphylococcus
HPKTKTAKN

SEQ ID NO: 1948744 - protein, 22 aa, Staphylococcus
HPKYGKQLKADTFEKELPQTKD

SEQ ID NO: 1948745 - protein, 4 aa, Staphylococcus
HPLA

SEQ ID NO: 1948746 - protein, 5 aa, Staphylococcus
HPLAQ

SEQ ID NO: 1948747 - protein, 11 aa, Staphylococcus
HPLASKTDISL

SEQ ID NO: 1948748 - protein, 5 aa, Staphylococcus
HPLDT

SEQ ID NO: 1948749 - protein, 13 aa, Staphylococcus
HPLPKSDNNYKHI

SEQ ID NO: 1948750 - protein, 4 aa, Staphylococcus
HPLQ

SEQ ID NO: 1948751 - protein, 8 aa, Staphylococcus
HPLSQRTK

SEQ ID NO: 1948752 - protein, 6 aa, Staphylococcus
HPNDDY

SEQ ID NO: 1948753 - protein, 13 aa, Staphylococcus
HPNEFKKDNVRQD

SEQ ID NO: 1948754 - protein, 11 aa, Staphylococcus
HPNEPKPAIKA

SEQ ID NO: 1948755 - protein, 5 aa, Staphylococcus
HPNET

SEQ ID NO: 1948756 - protein, 11 aa, Staphylococcus
HPNETRESLAA

SEQ ID NO: 1948757 - protein, 5 aa, Staphylococcus
HPNGI

SEQ ID NO: 1948758 - protein, 4 aa, Staphylococcus
HPNK

SEQ ID NO: 1948759 - protein, 5 aa, Staphylococcus
HPNNH

SEQ ID NO: 1948760 - protein, 6 aa, Staphylococcus
HPNNKD

SEQ ID NO: 1948761 - protein, 6 aa, Staphylococcus
HPNPAV

SEQ ID NO: 1948762 - protein, 16 aa, Staphylococcus
HPNPSVALSDSGQQMD

SEQ ID NO: 1948763 - protein, 4 aa, Staphylococcus
HPNR

SEQ ID NO: 1948764 - protein, 9 aa, Staphylococcus
HPNSNKEQF

SEQ ID NO: 1948765 - protein, 5 aa, Staphylococcus
HPNSQ

SEQ ID NO: 1948766 - protein, 12 aa, Staphylococcus
HPPKGDAFAARS

SEQ ID NO: 1948767 - protein, 13 aa, Staphylococcus
HPPKGDAFAGRSQ

SEQ ID NO: 1948768 - protein, 4 aa, Staphylococcus
HPPQ

SEQ ID NO: 1948769 - protein, 6 aa, Staphylococcus
HPPVDQ

SEQ ID NO: 1948770 - protein, 12 aa, Staphylococcus
HPPVNKKEDAEK

SEQ ID NO: 1948771 - protein, 13 aa, Staphylococcus
HPPVSKTKEAENT

SEQ ID NO: 1948772 - protein, 5 aa, Staphylococcus
HPQAG

SEQ ID NO: 1948773 - protein, 4 aa, Staphylococcus
HPQG

SEQ ID NO: 1948774 - protein, 7 aa, Staphylococcus
HPQGKQD

SEQ ID NO: 1948775 - protein, 5 aa, Staphylococcus
HPQNN

SEQ ID NO: 1948776 - protein, 4 aa, Staphylococcus
HPQP

SEQ ID NO: 1948777 - protein, 4 aa, Staphylococcus
HPQS

SEQ ID NO: 1948778 - protein, 9 aa, Staphylococcus
HPQTETTKN

SEQ ID NO: 1948779 - protein, 6 aa, Staphylococcus
HPRAEL

SEQ ID NO: 1948780 - protein, 11 aa, Staphylococcus
HPRKELSAYAP

SEQ ID NO: 1948781 - protein, 4 aa, Staphylococcus
HPRS

SEQ ID NO: 1948782 - protein, 5 aa, Staphylococcus
HPRSW

SEQ ID NO: 1948783 - protein, 8 aa, Staphylococcus
HPRTDEKG

SEQ ID NO: 1948784 - protein, 8 aa, Staphylococcus
HPRTKEEV

SEQ ID NO: 1948785 - protein, 9 aa, Staphylococcus
HPRVAETTT

SEQ ID NO: 1948786 - protein, 13 aa, Staphylococcus
HPRYGKQLEAETF

SEQ ID NO: 1948787 - protein, 22 aa, Staphylococcus
HPRYGKQLKAETFEKELPQTKD

SEQ ID NO: 1948788 - protein, 14 aa, Staphylococcus
HPRYQAGGSSKVNA

SEQ ID NO: 1948789 - protein, 9 aa, Staphylococcus
HPSETKMSS

SEQ ID NO: 1948790 - protein, 8 aa, Staphylococcus
HPSETTIK

SEQ ID NO: 1948791 - protein, 4 aa, Staphylococcus
HPSF

SEQ ID NO: 1948792 - protein, 25 aa, Staphylococcus
HPSFKSGKKRKSGFKTKAEATNAAQ

SEQ ID NO: 1948793 - protein, 20 aa, Staphylococcus
HPSGDTTPSLEDIKTTDRLR

SEQ ID NO: 1948794 - protein, 15 aa, Staphylococcus
HPSGDVTPSEEDINT

SEQ ID NO: 1948795 - protein, 15 aa, Staphylococcus
HPSGDVTPSSEDIAT

SEQ ID NO: 1948796 - protein, 4 aa, Staphylococcus
HPSH

SEQ ID NO: 1948797 - protein, 7 aa, Staphylococcus
HPSHPGY

SEQ ID NO: 1948798 - protein, 7 aa, Staphylococcus
HPSIKSK

SEQ ID NO: 1948799 - protein, 13 aa, Staphylococcus
HPSKNKESYDQRD

SEQ ID NO: 1948800 - protein, 8 aa, Staphylococcus
HPSQPVSI

SEQ ID NO: 1948801 - protein, 5 aa, Staphylococcus
HPSSQ

SEQ ID NO: 1948802 - protein, 11 aa, Staphylococcus
HPSSRTDRGVH

SEQ ID NO: 1948803 - protein, 6 aa, Staphylococcus
HPSTYD

SEQ ID NO: 1948804 - protein, 6 aa, Staphylococcus
HPTADD

SEQ ID NO: 1948805 - protein, 6 aa, Staphylococcus
HPTDLS

SEQ ID NO: 1948806 - protein, 6 aa, Staphylococcus
HPTETL

SEQ ID NO: 1948807 - protein, 11 aa, Staphylococcus
HPTGSKPLKEL

SEQ ID NO: 1948808 - protein, 5 aa, Staphylococcus
HPTGY

SEQ ID NO: 1948809 - protein, 8 aa, Staphylococcus
HPTHPLSK

SEQ ID NO: 1948810 - protein, 5 aa, Staphylococcus
HPTIA

SEQ ID NO: 1948811 - protein, 10 aa, Staphylococcus
HPTLRAEAQD

SEQ ID NO: 1948812 - protein, 24 aa, Staphylococcus
HPTLRAKAEDVSLPLSDEDKNTLK

SEQ ID NO: 1948813 - protein, 9 aa, Staphylococcus
HPTLREKAK

SEQ ID NO: 1948814 - protein, 24 aa, Staphylococcus
HPTLREKAKDVNLPLSEEDKNTLR

SEQ ID NO: 1948815 - protein, 22 aa, Staphylococcus
HPTLREKAKDVTLPLSEEDRNT

SEQ ID NO: 1948816 - protein, 12 aa, Staphylococcus
HPTLREKAKEVE

SEQ ID NO: 1948817 - protein, 10 aa, Staphylococcus
HPTLREKAQE

SEQ ID NO: 1948818 - protein, 5 aa, Staphylococcus
HPTNH

SEQ ID NO: 1948819 - protein, 10 aa, Staphylococcus
HPTNSKPLKE

SEQ ID NO: 1948820 - protein, 13 aa, Staphylococcus
HPTPALGGYPKAE

SEQ ID NO: 1948821 - protein, 16 aa, Staphylococcus
HPTPALGGYPKKEAVD

SEQ ID NO: 1948822 - protein, 13 aa, Staphylococcus
HPTPALGGYPKNE

SEQ ID NO: 1948823 - protein, 6 aa, Staphylococcus
HPTPEA

SEQ ID NO: 1948824 - protein, 6 aa, Staphylococcus
HPTQTN

SEQ ID NO: 1948825 - protein, 5 aa, Staphylococcus
HPTRY

SEQ ID NO: 1948826 - protein, 11 aa, Staphylococcus
HPTTGGVSASF

SEQ ID NO: 1948827 - protein, 6 aa, Staphylococcus
HPTTNI

SEQ ID NO: 1948828 - protein, 12 aa, Staphylococcus
HPVDEGSFQPSR

SEQ ID NO: 1948829 - protein, 8 aa, Staphylococcus
HPYDKQGG

SEQ ID NO: 1948830 - protein, 5 aa, Staphylococcus
HPYET

SEQ ID NO: 1948831 - protein, 6 aa, Staphylococcus
HPYKRG

SEQ ID NO: 1948832 - protein, 4 aa, Staphylococcus
HPYN

SEQ ID NO: 1948833 - protein, 6 aa, Staphylococcus
HPYPDP

SEQ ID NO: 1948834 - protein, 13 aa, Staphylococcus
HPYTKQLVALYES

SEQ ID NO: 1948835 - protein, 4 aa, Staphylococcus
HQAE

SEQ ID NO: 1948836 - protein, 8 aa, Staphylococcus
HQAGETDF

SEQ ID NO: 1948837 - protein, 8 aa, Staphylococcus
HQAGQTDF

SEQ ID NO: 1948838 - protein, 7 aa, Staphylococcus
HQASMSS

SEQ ID NO: 1948839 - protein, 5 aa, Staphylococcus
HQAST

SEQ ID NO: 1948840 - protein, 4 aa, Staphylococcus
HQAT

SEQ ID NO: 1948841 - protein, 5 aa, Staphylococcus
HQDDQ

SEQ ID NO: 1948842 - protein, 4 aa, Staphylococcus
HQDE

SEQ ID NO: 1948843 - protein, 9 aa, Staphylococcus
HQDEINNND

SEQ ID NO: 1948844 - protein, 4 aa, Staphylococcus
HQDI

SEQ ID NO: 1948845 - protein, 4 aa, Staphylococcus
HQDL

SEQ ID NO: 1948846 - protein, 12 aa, Staphylococcus
HQDMNEQRSISD

SEQ ID NO: 1948847 - protein, 11 aa, Staphylococcus
HQDNANTEAQD

SEQ ID NO: 1948848 - protein, 9 aa, Staphylococcus
HQDQSESEM

SEQ ID NO: 1948849 - protein, 4 aa, Staphylococcus
HQDY

SEQ ID NO: 1948850 - protein, 10 aa, Staphylococcus
HQEDKSKREF

SEQ ID NO: 1948851 - protein, 12 aa, Staphylococcus
HQEDKSTEAQDK

SEQ ID NO: 1948852 - protein, 12 aa, Staphylococcus
HQEDQNSGAQDK

SEQ ID NO: 1948853 - protein, 6 aa, Staphylococcus
HQEEDF

SEQ ID NO: 1948854 - protein, 22 aa, Staphylococcus
HQELDGSETVVSGASCTTNSLA

SEQ ID NO: 1948855 - protein, 11 aa, Staphylococcus
HQEMSENNKQQ

SEQ ID NO: 1948856 - protein, 12 aa, Staphylococcus
HQENENSQAQDK

SEQ ID NO: 1948857 - protein, 10 aa, Staphylococcus
HQENKQSGIA

SEQ ID NO: 1948858 - protein, 10 aa, Staphylococcus
HQEQQQGTAA

SEQ ID NO: 1948859 - protein, 14 aa, Staphylococcus
HQERVGGIGTGGGM

SEQ ID NO: 1948860 - protein, 6 aa, Staphylococcus
HQETTD

SEQ ID NO: 1948861 - protein, 6 aa, Staphylococcus
HQFPTG

SEQ ID NO: 1948862 - protein, 12 aa, Staphylococcus
HQGEIAAEPKNI

SEQ ID NO: 1948863 - protein, 6 aa, Staphylococcus
HQGEPI

SEQ ID NO: 1948864 - protein, 18 aa, Staphylococcus
HQGGDSSIVDDPDKLPHA

SEQ ID NO: 1948865 - protein, 8 aa, Staphylococcus
HQGGGRGK

SEQ ID NO: 1948866 - protein, 8 aa, Staphylococcus
HQGGLGTI

SEQ ID NO: 1948867 - protein, 9 aa, Staphylococcus
HQGHPGNLA

SEQ ID NO: 1948868 - protein, 7 aa, Staphylococcus
HQGIGST

SEQ ID NO: 1948869 - protein, 6 aa, Staphylococcus
HQGKPI

SEQ ID NO: 1948870 - protein, 8 aa, Staphylococcus
HQGQFRKN

SEQ ID NO: 1948871 - protein, 5 aa, Staphylococcus
HQGQP

SEQ ID NO: 1948872 - protein, 5 aa, Staphylococcus
HQGRD

SEQ ID NO: 1948873 - protein, 5 aa, Staphylococcus
HQGRL

SEQ ID NO: 1948874 - protein, 9 aa, Staphylococcus
HQHEAPNYE

SEQ ID NO: 1948875 - protein, 9 aa, Staphylococcus
HQHEAPNYK

SEQ ID NO: 1948876 - protein, 9 aa, Staphylococcus
HQHNKNPKR

SEQ ID NO: 1948877 - protein, 9 aa, Staphylococcus
HQHQKEAHK

SEQ ID NO: 1948878 - protein, 10 aa, Staphylococcus
HQHQKEAHKV

SEQ ID NO: 1948879 - protein, 12 aa, Staphylococcus
HQIAQSGRYTYQ

SEQ ID NO: 1948880 - protein, 5 aa, Staphylococcus
HQIDG

SEQ ID NO: 1948881 - protein, 7 aa, Staphylococcus
HQIPADV

SEQ ID NO: 1948882 - protein, 10 aa, Staphylococcus
HQISNSNEID

SEQ ID NO: 1948883 - protein, 6 aa, Staphylococcus
HQITPD

SEQ ID NO: 1948884 - protein, 15 aa, Staphylococcus
HQKAYEATNAGKYNE

SEQ ID NO: 1948885 - protein, 6 aa, Staphylococcus
HQKDKL

SEQ ID NO: 1948886 - protein, 4 aa, Staphylococcus
HQKG

SEQ ID NO: 1948887 - protein, 7 aa, Staphylococcus
HQKGSES

SEQ ID NO: 1948888 - protein, 13 aa, Staphylococcus
HQKPTQFNPEGGI

SEQ ID NO: 1948889 - protein, 14 aa, Staphylococcus
HQKPTQFNPEGGIL

SEQ ID NO: 1948890 - protein, 7 aa, Staphylococcus
HQKQDSN

SEQ ID NO: 1948891 - protein, 6 aa, Staphylococcus
HQKQSD

SEQ ID NO: 1948892 - protein, 22 aa, Staphylococcus
HQKTLGGGAQYDYARSGNPNRA

SEQ ID NO: 1948893 - protein, 7 aa, Staphylococcus
HQKTSDL

SEQ ID NO: 1948894 - protein, 8 aa, Staphylococcus
HQLDTESY

SEQ ID NO: 1948895 - protein, 19 aa, Staphylococcus
HQLKSPDEIKKELNNNKKD

SEQ ID NO: 1948896 - protein, 11 aa, Staphylococcus
HQLNEKLAKSE

SEQ ID NO: 1948897 - protein, 6 aa, Staphylococcus
HQLNEL

SEQ ID NO: 1948898 - protein, 7 aa, Staphylococcus
HQLPDAV

SEQ ID NO: 1948899 - protein, 8 aa, Staphylococcus
HQLPDSDR

SEQ ID NO: 1948900 - protein, 12 aa, Staphylococcus
HQLPSDVEEQVE

SEQ ID NO: 1948901 - protein, 10 aa, Staphylococcus
HQLPSEVEEQ

SEQ ID NO: 1948902 - protein, 9 aa, Staphylococcus
HQLQGSQQP

SEQ ID NO: 1948903 - protein, 11 aa, Staphylococcus
HQLTREKAAEI

SEQ ID NO: 1948904 - protein, 4 aa, Staphylococcus
HQMA

SEQ ID NO: 1948905 - protein, 6 aa, Staphylococcus
HQNDAN

SEQ ID NO: 1948906 - protein, 12 aa, Staphylococcus
HQNDENTDAQDK

SEQ ID NO: 1948907 - protein, 9 aa, Staphylococcus
HQNERPDYE

SEQ ID NO: 1948908 - protein, 14 aa, Staphylococcus
HQNKKVKSLSGGMK

SEQ ID NO: 1948909 - protein, 9 aa, Staphylococcus
HQNKTIATK

SEQ ID NO: 1948910 - protein, 7 aa, Staphylococcus
HQPDAEN

SEQ ID NO: 1948911 - protein, 16 aa, Staphylococcus
HQPDKVKDYIEQLEEL

SEQ ID NO: 1948912 - protein, 9 aa, Staphylococcus
HQPEGYTSH

SEQ ID NO: 1948913 - protein, 10 aa, Staphylococcus
HQPRAVTSEK

SEQ ID NO: 1948914 - protein, 8 aa, Staphylococcus
HQPRPQTD

SEQ ID NO: 1948915 - protein, 7 aa, Staphylococcus
HQPSNER

SEQ ID NO: 1948916 - protein, 9 aa, Staphylococcus
HQPVGRRSL

SEQ ID NO: 1948917 - protein, 4 aa, Staphylococcus
HQQA

SEQ ID NO: 1948918 - protein, 7 aa, Staphylococcus
HQQGQDI

SEQ ID NO: 1948919 - protein, 5 aa, Staphylococcus
HQQGT

SEQ ID NO: 1948920 - protein, 6 aa, Staphylococcus
HQQLGG

SEQ ID NO: 1948921 - protein, 6 aa, Staphylococcus
HQQLHD

SEQ ID NO: 1948922 - protein, 14 aa, Staphylococcus
HQQNQEKPSYDTKQ

SEQ ID NO: 1948923 - protein, 4 aa, Staphylococcus
HQQQ

SEQ ID NO: 1948924 - protein, 10 aa, Staphylococcus
HQQQKDLQTL

SEQ ID NO: 1948925 - protein, 5 aa, Staphylococcus
HQQQT

SEQ ID NO: 1948926 - protein, 4 aa, Staphylococcus
HQQV

SEQ ID NO: 1948927 - protein, 6 aa, Staphylococcus
HQQYTG

SEQ ID NO: 1948928 - protein, 6 aa, Staphylococcus
HQRDND

SEQ ID NO: 1948929 - protein, 4 aa, Staphylococcus
HQRL

SEQ ID NO: 1948930 - protein, 5 aa, Staphylococcus
HQRLT

SEQ ID NO: 1948931 - protein, 9 aa, Staphylococcus
HQRNGKKYQ

SEQ ID NO: 1948932 - protein, 9 aa, Staphylococcus
HQRNGKKYS

SEQ ID NO: 1948933 - protein, 9 aa, Staphylococcus
HQRNGKSYG

SEQ ID NO: 1948934 - protein, 4 aa, Staphylococcus
HQRP

SEQ ID NO: 1948935 - protein, 7 aa, Staphylococcus
HQRPEDQ

SEQ ID NO: 1948936 - protein, 15 aa, Staphylococcus
HQSASLPDDQKFERD

SEQ ID NO: 1948937 - protein, 5 aa, Staphylococcus
HQSDI

SEQ ID NO: 1948938 - protein, 7 aa, Staphylococcus
HQSDNSN

SEQ ID NO: 1948939 - protein, 5 aa, Staphylococcus
HQSEL

SEQ ID NO: 1948940 - protein, 6 aa, Staphylococcus
HQSELT

SEQ ID NO: 1948941 - protein, 7 aa, Staphylococcus
HQSHATY

SEQ ID NO: 1948942 - protein, 4 aa, Staphylococcus
HQSI

SEQ ID NO: 1948943 - protein, 4 aa, Staphylococcus
HQSK

SEQ ID NO: 1948944 - protein, 7 aa, Staphylococcus
HQSNAQS

SEQ ID NO: 1948945 - protein, 9 aa, Staphylococcus
HQSQASGHT

SEQ ID NO: 1948946 - protein, 9 aa, Staphylococcus
HQSSGAAER

SEQ ID NO: 1948947 - protein, 7 aa, Staphylococcus
HQSTSDL

SEQ ID NO: 1948948 - protein, 10 aa, Staphylococcus
HQTDEPTIEQ

SEQ ID NO: 1948949 - protein, 5 aa, Staphylococcus
HQTDK

SEQ ID NO: 1948950 - protein, 6 aa, Staphylococcus
HQTEKL

SEQ ID NO: 1948951 - protein, 7 aa, Staphylococcus
HQTESPR

SEQ ID NO: 1948952 - protein, 10 aa, Staphylococcus
HQTETPSVEQ

SEQ ID NO: 1948953 - protein, 4 aa, Staphylococcus
HQTG

SEQ ID NO: 1948954 - protein, 10 aa, Staphylococcus
HQTGPEGKEI

SEQ ID NO: 1948955 - protein, 5 aa, Staphylococcus
HQTIT

SEQ ID NO: 1948956 - protein, 7 aa, Staphylococcus
HQTNPNS

SEQ ID NO: 1948957 - protein, 7 aa, Staphylococcus
HQTPDKK

SEQ ID NO: 1948958 - protein, 7 aa, Staphylococcus
HQTRRKC

SEQ ID NO: 1948959 - protein, 5 aa, Staphylococcus
HQTSI

SEQ ID NO: 1948960 - protein, 6 aa, Staphylococcus
HQTTHE

SEQ ID NO: 1948961 - protein, 7 aa, Staphylococcus
HQTTNET

SEQ ID NO: 1948962 - protein, 6 aa, Staphylococcus
HQTTNN

SEQ ID NO: 1948963 - protein, 6 aa, Staphylococcus
HQTTQE

SEQ ID NO: 1948964 - protein, 5 aa, Staphylococcus
HQTTY

SEQ ID NO: 1948965 - protein, 20 aa, Staphylococcus
HQTYVSSSNEKKGFLARLFN

SEQ ID NO: 1948966 - protein, 8 aa, Staphylococcus
HQVAEASG

SEQ ID NO: 1948967 - protein, 11 aa, Staphylococcus
HQVAQSGRYTY

SEQ ID NO: 1948968 - protein, 9 aa, Staphylococcus
HQVDQSSVQ

SEQ ID NO: 1948969 - protein, 8 aa, Staphylococcus
HQVNPGGA

SEQ ID NO: 1948970 - protein, 4 aa, Staphylococcus
HQVR

SEQ ID NO: 1948971 - protein, 21 aa, Staphylococcus
HQYGEKKKKDTEEENTIKAEL

SEQ ID NO: 1948972 - protein, 5 aa, Staphylococcus
HQYRM

SEQ ID NO: 1948973 - protein, 11 aa, Staphylococcus
HRADEDAATTA

SEQ ID NO: 1948974 - protein, 20 aa, Staphylococcus
HRAPSNDESGVLQVIERYLQ

SEQ ID NO: 1948975 - protein, 8 aa, Staphylococcus
HRAQKDES

SEQ ID NO: 1948976 - protein, 6 aa, Staphylococcus
HRAQTS

SEQ ID NO: 1948977 - protein, 6 aa, Staphylococcus
HRDAPG

SEQ ID NO: 1948978 - protein, 5 aa, Staphylococcus
HRDEA

SEQ ID NO: 1948979 - protein, 5 aa, Staphylococcus
HRDED

SEQ ID NO: 1948980 - protein, 11 aa, Staphylococcus
HRDEDKGYPRS

SEQ ID NO: 1948981 - protein, 6 aa, Staphylococcus
HRDGGQ

SEQ ID NO: 1948982 - protein, 5 aa, Staphylococcus
HRDHN

SEQ ID NO: 1948983 - protein, 18 aa, Staphylococcus
HRDKDHEDYYEIKIKLYK

SEQ ID NO: 1948984 - protein, 5 aa, Staphylococcus
HRDNY

SEQ ID NO: 1948985 - protein, 4 aa, Staphylococcus
HRDT

SEQ ID NO: 1948986 - protein, 11 aa, Staphylococcus
HRDTSKEEALK

SEQ ID NO: 1948987 - protein, 10 aa, Staphylococcus
HREDYAVSDP

SEQ ID NO: 1948988 - protein, 5 aa, Staphylococcus
HREIS

SEQ ID NO: 1948989 - protein, 4 aa, Staphylococcus
HREK

SEQ ID NO: 1948990 - protein, 6 aa, Staphylococcus
HREQFE

SEQ ID NO: 1948991 - protein, 14 aa, Staphylococcus
HREQKVQRLDQEGY

SEQ ID NO: 1948992 - protein, 9 aa, Staphylococcus
HREQQPIET

SEQ ID NO: 1948993 - protein, 5 aa, Staphylococcus
HRESI

SEQ ID NO: 1948994 - protein, 6 aa, Staphylococcus
HRESVE

SEQ ID NO: 1948995 - protein, 26 aa, Staphylococcus
HRGANHPVKDLKTGKIALTSQNHGYA

SEQ ID NO: 1948996 - protein, 27 aa, Staphylococcus
HRGANHPVKDLRTGKVDITSQNHGYAI

SEQ ID NO: 1948997 - protein, 4 aa, Staphylococcus
HRGG

SEQ ID NO: 1948998 - protein, 16 aa, Staphylococcus
HRGGVGADGITGDGAG

SEQ ID NO: 1948999 - protein, 7 aa, Staphylococcus
HRGHGKD

SEQ ID NO: 1949000 - protein, 12 aa, Staphylococcus
HRGHGKDIDEVE

SEQ ID NO: 1949001 - protein, 18 aa, Staphylococcus
HRGHGKEIDEKERGHYDS

SEQ ID NO: 1949002 - protein, 10 aa, Staphylococcus
HRGHGKEITI

SEQ ID NO: 1949003 - protein, 15 aa, Staphylococcus
HRGHGKNIDENERGH

SEQ ID NO: 1949004 - protein, 8 aa, Staphylococcus
HRGKGIAS

SEQ ID NO: 1949005 - protein, 10 aa, Staphylococcus
HRGPKETAVK

SEQ ID NO: 1949006 - protein, 7 aa, Staphylococcus
HRGQEGA

SEQ ID NO: 1949007 - protein, 15 aa, Staphylococcus
HRGRKYKSYKGNVGK

SEQ ID NO: 1949008 - protein, 4 aa, Staphylococcus
HRGS

SEQ ID NO: 1949009 - protein, 4 aa, Staphylococcus
HRIA

SEQ ID NO: 1949010 - protein, 9 aa, Staphylococcus
HRIKDKQKL

SEQ ID NO: 1949011 - protein, 4 aa, Staphylococcus
HRIS

SEQ ID NO: 1949012 - protein, 9 aa, Staphylococcus
HRISDKAYN

SEQ ID NO: 1949013 - protein, 4 aa, Staphylococcus
HRIT

SEQ ID NO: 1949014 - protein, 8 aa, Staphylococcus
HRITDGEL

SEQ ID NO: 1949015 - protein, 5 aa, Staphylococcus
HRITT

SEQ ID NO: 1949016 - protein, 9 aa, Staphylococcus
HRKDAKVKS

SEQ ID NO: 1949017 - protein, 8 aa, Staphylococcus
HRKGAQEK

SEQ ID NO: 1949018 - protein, 7 aa, Staphylococcus
HRKGSYE

SEQ ID NO: 1949019 - protein, 7 aa, Staphylococcus
HRKGTHE

SEQ ID NO: 1949020 - protein, 6 aa, Staphylococcus
HRKNPT

SEQ ID NO: 1949021 - protein, 10 aa, Staphylococcus
HRKTDNKIET

SEQ ID NO: 1949022 - protein, 4 aa, Staphylococcus
HRLP

SEQ ID NO: 1949023 - protein, 11 aa, Staphylococcus
HRMSAPDYPGF

SEQ ID NO: 1949024 - protein, 6 aa, Staphylococcus
HRMSSS

SEQ ID NO: 1949025 - protein, 5 aa, Staphylococcus
HRNGE

SEQ ID NO: 1949026 - protein, 7 aa, Staphylococcus
HRNNKKV

SEQ ID NO: 1949027 - protein, 17 aa, Staphylococcus
HRNTPNAWRKNPYTDIP

SEQ ID NO: 1949028 - protein, 18 aa, Staphylococcus
HRNTQIKENNELEEYTNA

SEQ ID NO: 1949029 - protein, 5 aa, Staphylococcus
HRPKQ

SEQ ID NO: 1949030 - protein, 4 aa, Staphylococcus
HRPL

SEQ ID NO: 1949031 - protein, 8 aa, Staphylococcus
HRPNQTTP

SEQ ID NO: 1949032 - protein, 9 aa, Staphylococcus
HRPPMPNTD

SEQ ID NO: 1949033 - protein, 8 aa, Staphylococcus
HRPQYVDK

SEQ ID NO: 1949034 - protein, 6 aa, Staphylococcus
HRPTSY

SEQ ID NO: 1949035 - protein, 11 aa, Staphylococcus
HRPVTSDKDST

SEQ ID NO: 1949036 - protein, 12 aa, Staphylococcus
HRQAGRVVIDFN

SEQ ID NO: 1949037 - protein, 11 aa, Staphylococcus
HRQLKKPERLT

SEQ ID NO: 1949038 - protein, 6 aa, Staphylococcus
HRQNYK

SEQ ID NO: 1949039 - protein, 6 aa, Staphylococcus
HRQTIK

SEQ ID NO: 1949040 - protein, 11 aa, Staphylococcus
HRRDKDGYAQA

SEQ ID NO: 1949041 - protein, 11 aa, Staphylococcus
HRRDKEGYAQA

SEQ ID NO: 1949042 - protein, 10 aa, Staphylococcus
HRRDKPGYAQ

SEQ ID NO: 1949043 - protein, 11 aa, Staphylococcus
HRRDQGLEHTR

SEQ ID NO: 1949044 - protein, 6 aa, Staphylococcus
HRRPSD

SEQ ID NO: 1949045 - protein, 77 aa, Staphylococcus
HRRQPRPPARRALPRAQHPREPAPRRAGLPGPASPTSTAASSTAPPPPGSSPTTSGTRSWPPAGSGGPRSPRPYSAP

SEQ ID NO: 1949046 - protein, 9 aa, Staphylococcus
HRRQSPKEV

SEQ ID NO: 1949047 - protein, 9 aa, Staphylococcus
HRRQSSDEV

SEQ ID NO: 1949048 - protein, 8 aa, Staphylococcus
HRSAAASY

SEQ ID NO: 1949049 - protein, 8 aa, Staphylococcus
HRSAADTY

SEQ ID NO: 1949050 - protein, 7 aa, Staphylococcus
HRSAENG

SEQ ID NO: 1949051 - protein, 8 aa, Staphylococcus
HRSELNTE

SEQ ID NO: 1949052 - protein, 10 aa, Staphylococcus
HRSENPDEEV

SEQ ID NO: 1949053 - protein, 6 aa, Staphylococcus
HRSKGY

SEQ ID NO: 1949054 - protein, 8 aa, Staphylococcus
HRSNPDLE

SEQ ID NO: 1949055 - protein, 16 aa, Staphylococcus
HRTEKGWQGFPSDGKL

SEQ ID NO: 1949056 - protein, 5 aa, Staphylococcus
HRTEQ

SEQ ID NO: 1949057 - protein, 11 aa, Staphylococcus
HRTKTEKANDL

SEQ ID NO: 1949058 - protein, 6 aa, Staphylococcus
HRTKTG

SEQ ID NO: 1949059 - protein, 10 aa, Staphylococcus
HRTNEETGNV

SEQ ID NO: 1949060 - protein, 6 aa, Staphylococcus
HRTSPH

SEQ ID NO: 1949061 - protein, 5 aa, Staphylococcus
HRVKD

SEQ ID NO: 1949062 - protein, 7 aa, Staphylococcus
HRVSSSK

SEQ ID NO: 1949063 - protein, 4 aa, Staphylococcus
HRVT

SEQ ID NO: 1949064 - protein, 5 aa, Staphylococcus
HRVTD

SEQ ID NO: 1949065 - protein, 11 aa, Staphylococcus
HRYSAKAWDNR

SEQ ID NO: 1949066 - protein, 5 aa, Staphylococcus
HSAKQ

SEQ ID NO: 1949067 - protein, 4 aa, Staphylococcus
HSAN

SEQ ID NO: 1949068 - protein, 7 aa, Staphylococcus
HSANTAV

SEQ ID NO: 1949069 - protein, 11 aa, Staphylococcus
HSAPGDGETLE

SEQ ID NO: 1949070 - protein, 5 aa, Staphylococcus
HSAPK

SEQ ID NO: 1949071 - protein, 5 aa, Staphylococcus
HSASR

SEQ ID NO: 1949072 - protein, 10 aa, Staphylococcus
HSATDERQNL

SEQ ID NO: 1949073 - protein, 10 aa, Staphylococcus
HSDDVSTNDP

SEQ ID NO: 1949074 - protein, 17 aa, Staphylococcus
HSDEEASGLYHTLIKSI

SEQ ID NO: 1949075 - protein, 8 aa, Staphylococcus
HSDEKDEV

SEQ ID NO: 1949076 - protein, 8 aa, Staphylococcus
HSDENELR

SEQ ID NO: 1949077 - protein, 7 aa, Staphylococcus
HSDHRTT

SEQ ID NO: 1949078 - protein, 4 aa, Staphylococcus
HSDI

SEQ ID NO: 1949079 - protein, 17 aa, Staphylococcus
HSDRENQLSQINTMIHV

SEQ ID NO: 1949080 - protein, 9 aa, Staphylococcus
HSDRKEENT

SEQ ID NO: 1949081 - protein, 8 aa, Staphylococcus
HSDRQDEN

SEQ ID NO: 1949082 - protein, 7 aa, Staphylococcus
HSDRQEE

SEQ ID NO: 1949083 - protein, 8 aa, Staphylococcus
HSDRQEEN

SEQ ID NO: 1949084 - protein, 14 aa, Staphylococcus
HSDRSVAGIGPAAS

SEQ ID NO: 1949085 - protein, 18 aa, Staphylococcus
HSDRTNEQTIRTFIDYLR

SEQ ID NO: 1949086 - protein, 16 aa, Staphylococcus
HSDSDFSDDIKQRATS

SEQ ID NO: 1949087 - protein, 6 aa, Staphylococcus
HSDSKN

SEQ ID NO: 1949088 - protein, 16 aa, Staphylococcus
HSDSPLTANKKAQQFE

SEQ ID NO: 1949089 - protein, 14 aa, Staphylococcus
HSDSRQRVMSLFKS

SEQ ID NO: 1949090 - protein, 21 aa, Staphylococcus
HSDYSGVQVQRDVSKKYGESI

SEQ ID NO: 1949091 - protein, 10 aa, Staphylococcus
HSEEQFNSQD

SEQ ID NO: 1949092 - protein, 7 aa, Staphylococcus
HSEFSGD

SEQ ID NO: 1949093 - protein, 5 aa, Staphylococcus
HSEGL

SEQ ID NO: 1949094 - protein, 7 aa, Staphylococcus
HSEHEET

SEQ ID NO: 1949095 - protein, 5 aa, Staphylococcus
HSEHK

SEQ ID NO: 1949096 - protein, 9 aa, Staphylococcus
HSEHSGEDF

SEQ ID NO: 1949097 - protein, 4 aa, Staphylococcus
HSEI

SEQ ID NO: 1949098 - protein, 8 aa, Staphylococcus
HSEIESDE

SEQ ID NO: 1949099 - protein, 4 aa, Staphylococcus
HSEK

SEQ ID NO: 1949100 - protein, 9 aa, Staphylococcus
HSEKDNESL

SEQ ID NO: 1949101 - protein, 6 aa, Staphylococcus
HSENDG

SEQ ID NO: 1949102 - protein, 13 aa, Staphylococcus
HSENVAKVSRRDL

SEQ ID NO: 1949103 - protein, 7 aa, Staphylococcus
HSEQEYP

SEQ ID NO: 1949104 - protein, 10 aa, Staphylococcus
HSEQQSNGQF

SEQ ID NO: 1949105 - protein, 7 aa, Staphylococcus
HSERTGA

SEQ ID NO: 1949106 - protein, 7 aa, Staphylococcus
HSESEDE

SEQ ID NO: 1949107 - protein, 5 aa, Staphylococcus
HSESI

SEQ ID NO: 1949108 - protein, 13 aa, Staphylococcus
HSEVEQEARDKAA

SEQ ID NO: 1949109 - protein, 10 aa, Staphylococcus
HSFGKSAQDF

SEQ ID NO: 1949110 - protein, 5 aa, Staphylococcus
HSGFP

SEQ ID NO: 1949111 - protein, 7 aa, Staphylococcus
HSGGYEI

SEQ ID NO: 1949112 - protein, 4 aa, Staphylococcus
HSGI

SEQ ID NO: 1949113 - protein, 4 aa, Staphylococcus
HSGK

SEQ ID NO: 1949114 - protein, 8 aa, Staphylococcus
HSGKTKDA

SEQ ID NO: 1949115 - protein, 8 aa, Staphylococcus
HSGLNNPK

SEQ ID NO: 1949116 - protein, 8 aa, Staphylococcus
HSGSEEFN

SEQ ID NO: 1949117 - protein, 7 aa, Staphylococcus
HSGTIQN

SEQ ID NO: 1949118 - protein, 4 aa, Staphylococcus
HSGV

SEQ ID NO: 1949119 - protein, 7 aa, Staphylococcus
HSGVTTD

SEQ ID NO: 1949120 - protein, 5 aa, Staphylococcus
HSGYA

SEQ ID NO: 1949121 - protein, 9 aa, Staphylococcus
HSHETNAAY

SEQ ID NO: 1949122 - protein, 12 aa, Staphylococcus
HSHGKRLEKGQF

SEQ ID NO: 1949123 - protein, 12 aa, Staphylococcus
HSHGKSLKRGQF

SEQ ID NO: 1949124 - protein, 4 aa, Staphylococcus
HSHP

SEQ ID NO: 1949125 - protein, 6 aa, Staphylococcus
HSHPEI

SEQ ID NO: 1949126 - protein, 4 aa, Staphylococcus
HSIE

SEQ ID NO: 1949127 - protein, 4 aa, Staphylococcus
HSIG

SEQ ID NO: 1949128 - protein, 6 aa, Staphylococcus
HSIGGE

SEQ ID NO: 1949129 - protein, 17 aa, Staphylococcus
HSIGRDARKYLDESRRT

SEQ ID NO: 1949130 - protein, 17 aa, Staphylococcus
HSIGRDARKYLDQSRRK

SEQ ID NO: 1949131 - protein, 6 aa, Staphylococcus
HSIPDS

SEQ ID NO: 1949132 - protein, 7 aa, Staphylococcus
HSIQDPD

SEQ ID NO: 1949133 - protein, 7 aa, Staphylococcus
HSISSSK

SEQ ID NO: 1949134 - protein, 10 aa, Staphylococcus
HSKEAASQQN

SEQ ID NO: 1949135 - protein, 5 aa, Staphylococcus
HSKEG

SEQ ID NO: 1949136 - protein, 6 aa, Staphylococcus
HSKNDV

SEQ ID NO: 1949137 - protein, 8 aa, Staphylococcus
HSKNEALQ

SEQ ID NO: 1949138 - protein, 9 aa, Staphylococcus
HSKNTEEME

SEQ ID NO: 1949139 - protein, 9 aa, Staphylococcus
HSKSFRKAV

SEQ ID NO: 1949140 - protein, 6 aa, Staphylococcus
HSKTHI

SEQ ID NO: 1949141 - protein, 7 aa, Staphylococcus
HSKTKDK

SEQ ID NO: 1949142 - protein, 8 aa, Staphylococcus
HSLEGAKA

SEQ ID NO: 1949143 - protein, 4 aa, Staphylococcus
HSLG

SEQ ID NO: 1949144 - protein, 5 aa, Staphylococcus
HSLGQ

SEQ ID NO: 1949145 - protein, 13 aa, Staphylococcus
HSLKPGDKLPSNL

SEQ ID NO: 1949146 - protein, 11 aa, Staphylococcus
HSLSGGQKQRV

SEQ ID NO: 1949147 - protein, 27 aa, Staphylococcus
HSLTGQYLSGKKRIEVPEARRDITDRK

SEQ ID NO: 1949148 - protein, 11 aa, Staphylococcus
HSNAVRNSAIS

SEQ ID NO: 1949149 - protein, 4 aa, Staphylococcus
HSND

SEQ ID NO: 1949150 - protein, 5 aa, Staphylococcus
HSNDF

SEQ ID NO: 1949151 - protein, 15 aa, Staphylococcus
HSNDQSIEAFESKDD

SEQ ID NO: 1949152 - protein, 12 aa, Staphylococcus
HSNEADKAAAQA

SEQ ID NO: 1949153 - protein, 8 aa, Staphylococcus
HSNGDDIL

SEQ ID NO: 1949154 - protein, 18 aa, Staphylococcus
HSNGKSKILNGQYAGQTL

SEQ ID NO: 1949155 - protein, 6 aa, Staphylococcus
HSNHEN

SEQ ID NO: 1949156 - protein, 12 aa, Staphylococcus
HSNHSTTQIASE

SEQ ID NO: 1949157 - protein, 41 aa, Staphylococcus
HSNHTHPTNDTQHNDNQSQKTTIVTTNNENKKDIKPDSERK

SEQ ID NO: 1949158 - protein, 4 aa, Staphylococcus
HSNK

SEQ ID NO: 1949159 - protein, 8 aa, Staphylococcus
HSNKTRHI

SEQ ID NO: 1949160 - protein, 8 aa, Staphylococcus
HSNKTSLE

SEQ ID NO: 1949161 - protein, 8 aa, Staphylococcus
HSNKTTLE

SEQ ID NO: 1949162 - protein, 17 aa, Staphylococcus
HSNNDEGYDVLIWEPET

SEQ ID NO: 1949163 - protein, 6 aa, Staphylococcus
HSNNKA

SEQ ID NO: 1949164 - protein, 16 aa, Staphylococcus
HSNNQRHTNETEKVLT

SEQ ID NO: 1949165 - protein, 14 aa, Staphylococcus
HSNNQRHTNETEQI

SEQ ID NO: 1949166 - protein, 5 aa, Staphylococcus
HSNNV

SEQ ID NO: 1949167 - protein, 9 aa, Staphylococcus
HSNQPTDDF

SEQ ID NO: 1949168 - protein, 18 aa, Staphylococcus
HSNQSRHITSLSGGETFQ

SEQ ID NO: 1949169 - protein, 15 aa, Staphylococcus
HSNSHIPEVVNFKVE

SEQ ID NO: 1949170 - protein, 7 aa, Staphylococcus
HSNTNED

SEQ ID NO: 1949171 - protein, 7 aa, Staphylococcus
HSNTSIE

SEQ ID NO: 1949172 - protein, 14 aa, Staphylococcus
HSNYSSTHENYDPY

SEQ ID NO: 1949173 - protein, 12 aa, Staphylococcus
HSPFEENIETTK

SEQ ID NO: 1949174 - protein, 5 aa, Staphylococcus
HSPFN

SEQ ID NO: 1949175 - protein, 8 aa, Staphylococcus
HSPGPGVG

SEQ ID NO: 1949176 - protein, 5 aa, Staphylococcus
HSPMT

SEQ ID NO: 1949177 - protein, 6 aa, Staphylococcus
HSPNIS

SEQ ID NO: 1949178 - protein, 7 aa, Staphylococcus
HSPPTRN

SEQ ID NO: 1949179 - protein, 4 aa, Staphylococcus
HSPQ

SEQ ID NO: 1949180 - protein, 9 aa, Staphylococcus
HSPRYEYNR

SEQ ID NO: 1949181 - protein, 13 aa, Staphylococcus
HSPSYYSEGSEYP

SEQ ID NO: 1949182 - protein, 5 aa, Staphylococcus
HSQGS

SEQ ID NO: 1949183 - protein, 22 aa, Staphylococcus
HSQLNGPSLDMTSNNRHNDQSY

SEQ ID NO: 1949184 - protein, 12 aa, Staphylococcus
HSQLSKQDIKED

SEQ ID NO: 1949185 - protein, 6 aa, Staphylococcus
HSQPDS

SEQ ID NO: 1949186 - protein, 5 aa, Staphylococcus
HSQPL

SEQ ID NO: 1949187 - protein, 10 aa, Staphylococcus
HSQQQEDGQF

SEQ ID NO: 1949188 - protein, 5 aa, Staphylococcus
HSQQS

SEQ ID NO: 1949189 - protein, 4 aa, Staphylococcus
HSQR

SEQ ID NO: 1949190 - protein, 32 aa, Staphylococcus
HSQRASSLHAEKVENNNQLKTTIHKNAGANLG

SEQ ID NO: 1949191 - protein, 4 aa, Staphylococcus
HSQT

SEQ ID NO: 1949192 - protein, 6 aa, Staphylococcus
HSQTGV

SEQ ID NO: 1949193 - protein, 8 aa, Staphylococcus
HSREKAEK

SEQ ID NO: 1949194 - protein, 5 aa, Staphylococcus
HSRFP

SEQ ID NO: 1949195 - protein, 7 aa, Staphylococcus
HSRGDAN

SEQ ID NO: 1949196 - protein, 9 aa, Staphylococcus
HSRKINKNE

SEQ ID NO: 1949197 - protein, 11 aa, Staphylococcus
HSRKSGKVPSN

SEQ ID NO: 1949198 - protein, 7 aa, Staphylococcus
HSRQEKG

SEQ ID NO: 1949199 - protein, 17 aa, Staphylococcus
HSRSQRAEALKGRIDEV

SEQ ID NO: 1949200 - protein, 6 aa, Staphylococcus
HSRSSK

SEQ ID NO: 1949201 - protein, 28 aa, Staphylococcus
HSRSTEKDKDSVETMDGSISAGGSLESE

SEQ ID NO: 1949202 - protein, 9 aa, Staphylococcus
HSSDETQQF

SEQ ID NO: 1949203 - protein, 11 aa, Staphylococcus
HSSDSIDSKQL

SEQ ID NO: 1949204 - protein, 8 aa, Staphylococcus
HSSEQVED

SEQ ID NO: 1949205 - protein, 9 aa, Staphylococcus
HSSIEEVST

SEQ ID NO: 1949206 - protein, 10 aa, Staphylococcus
HSSITDERET

SEQ ID NO: 1949207 - protein, 4 aa, Staphylococcus
HSSK

SEQ ID NO: 1949208 - protein, 4 aa, Staphylococcus
HSSL

SEQ ID NO: 1949209 - protein, 8 aa, Staphylococcus
HSSQQQEI

SEQ ID NO: 1949210 - protein, 4 aa, Staphylococcus
HSSR

SEQ ID NO: 1949211 - protein, 8 aa, Staphylococcus
HSSRETVR

SEQ ID NO: 1949212 - protein, 7 aa, Staphylococcus
HSSSDTE

SEQ ID NO: 1949213 - protein, 12 aa, Staphylococcus
HSSSGRAPSEQG

SEQ ID NO: 1949214 - protein, 6 aa, Staphylococcus
HSSSSD

SEQ ID NO: 1949215 - protein, 5 aa, Staphylococcus
HSSST

SEQ ID NO: 1949216 - protein, 5 aa, Staphylococcus
HSTEA

SEQ ID NO: 1949217 - protein, 8 aa, Staphylococcus
HSTENPFN

SEQ ID NO: 1949218 - protein, 8 aa, Staphylococcus
HSTERAHT

SEQ ID NO: 1949219 - protein, 9 aa, Staphylococcus
HSTKEGRVT

SEQ ID NO: 1949220 - protein, 11 aa, Staphylococcus
HSTLTDEQAIP

SEQ ID NO: 1949221 - protein, 13 aa, Staphylococcus
HSTQNDFNTPVIR

SEQ ID NO: 1949222 - protein, 9 aa, Staphylococcus
HSTSQRIKQ

SEQ ID NO: 1949223 - protein, 8 aa, Staphylococcus
HSTTKNNQ

SEQ ID NO: 1949224 - protein, 14 aa, Staphylococcus
HSTTREGKYAGQER

SEQ ID NO: 1949225 - protein, 4 aa, Staphylococcus
HSVE

SEQ ID NO: 1949226 - protein, 18 aa, Staphylococcus
HSVSTNDDFFESGGDSLK

SEQ ID NO: 1949227 - protein, 7 aa, Staphylococcus
HSVTGNV

SEQ ID NO: 1949228 - protein, 5 aa, Staphylococcus
HSYPI

SEQ ID NO: 1949229 - protein, 6 aa, Staphylococcus
HSYPNS

SEQ ID NO: 1949230 - protein, 13 aa, Staphylococcus
HSYPTGTHERQDH

SEQ ID NO: 1949231 - protein, 11 aa, Staphylococcus
HTANGGHRLEG

SEQ ID NO: 1949232 - protein, 5 aa, Staphylococcus
HTATA

SEQ ID NO: 1949233 - protein, 5 aa, Staphylococcus
HTATE

SEQ ID NO: 1949234 - protein, 16 aa, Staphylococcus
HTATVKGPKGELSRTF

SEQ ID NO: 1949235 - protein, 14 aa, Staphylococcus
HTDDEAKLNEAKER

SEQ ID NO: 1949236 - protein, 10 aa, Staphylococcus
HTDEDGNSTH

SEQ ID NO: 1949237 - protein, 6 aa, Staphylococcus
HTDHKT

SEQ ID NO: 1949238 - protein, 6 aa, Staphylococcus
HTDLQQ

SEQ ID NO: 1949239 - protein, 12 aa, Staphylococcus
HTDNKGDSPFDR

SEQ ID NO: 1949240 - protein, 9 aa, Staphylococcus
HTDNRTKQI

SEQ ID NO: 1949241 - protein, 20 aa, Staphylococcus
HTDPFNQDTDGDGKNDGDEV

SEQ ID NO: 1949242 - protein, 8 aa, Staphylococcus
HTDTKKDR

SEQ ID NO: 1949243 - protein, 10 aa, Staphylococcus
HTDTSDPSGV

SEQ ID NO: 1949244 - protein, 6 aa, Staphylococcus
HTDYNG

SEQ ID NO: 1949245 - protein, 7 aa, Staphylococcus
HTDYNGG

SEQ ID NO: 1949246 - protein, 10 aa, Staphylococcus
HTEAASSLQS

SEQ ID NO: 1949247 - protein, 6 aa, Staphylococcus
HTEEHK

SEQ ID NO: 1949248 - protein, 14 aa, Staphylococcus
HTEITNSKIGSNVT

SEQ ID NO: 1949249 - protein, 10 aa, Staphylococcus
HTEKEDNEDF

SEQ ID NO: 1949250 - protein, 15 aa, Staphylococcus
HTEKKFSDPKTRAET

SEQ ID NO: 1949251 - protein, 4 aa, Staphylococcus
HTEP

SEQ ID NO: 1949252 - protein, 9 aa, Staphylococcus
HTEPKEVEG

SEQ ID NO: 1949253 - protein, 6 aa, Staphylococcus
HTEQNQ

SEQ ID NO: 1949254 - protein, 7 aa, Staphylococcus
HTEQYDK

SEQ ID NO: 1949255 - protein, 4 aa, Staphylococcus
HTER

SEQ ID NO: 1949256 - protein, 10 aa, Staphylococcus
HTETGRKLAR

SEQ ID NO: 1949257 - protein, 6 aa, Staphylococcus
HTEYGN

SEQ ID NO: 1949258 - protein, 4 aa, Staphylococcus
HTFE

SEQ ID NO: 1949259 - protein, 4 aa, Staphylococcus
HTFN

SEQ ID NO: 1949260 - protein, 16 aa, Staphylococcus
HTGDANDYVGKGLSGG

SEQ ID NO: 1949261 - protein, 9 aa, Staphylococcus
HTGDKSQSD

SEQ ID NO: 1949262 - protein, 5 aa, Staphylococcus
HTGET

SEQ ID NO: 1949263 - protein, 9 aa, Staphylococcus
HTGGNKTFI

SEQ ID NO: 1949264 - protein, 6 aa, Staphylococcus
HTGTKE

SEQ ID NO: 1949265 - protein, 15 aa, Staphylococcus
HTGVPDELGGQGIGK

SEQ ID NO: 1949266 - protein, 14 aa, Staphylococcus
HTGVSDELGGQGLG

SEQ ID NO: 1949267 - protein, 7 aa, Staphylococcus
HTHASNA

SEQ ID NO: 1949268 - protein, 7 aa, Staphylococcus
HTHPDDI

SEQ ID NO: 1949269 - protein, 17 aa, Staphylococcus
HTIADGTEVAIPGDKTF

SEQ ID NO: 1949270 - protein, 6 aa, Staphylococcus
HTIENT

SEQ ID NO: 1949271 - protein, 11 aa, Staphylococcus
HTIETSNEAER

SEQ ID NO: 1949272 - protein, 13 aa, Staphylococcus
HTIHDGARHQTIH

SEQ ID NO: 1949273 - protein, 6 aa, Staphylococcus
HTINAS

SEQ ID NO: 1949274 - protein, 7 aa, Staphylococcus
HTIPSDL

SEQ ID NO: 1949275 - protein, 4 aa, Staphylococcus
HTKA

SEQ ID NO: 1949276 - protein, 6 aa, Staphylococcus
HTKDKD

SEQ ID NO: 1949277 - protein, 6 aa, Staphylococcus
HTKEEL

SEQ ID NO: 1949278 - protein, 4 aa, Staphylococcus
HTKF

SEQ ID NO: 1949279 - protein, 6 aa, Staphylococcus
HTKKKD

SEQ ID NO: 1949280 - protein, 4 aa, Staphylococcus
HTKM

SEQ ID NO: 1949281 - protein, 5 aa, Staphylococcus
HTKQG

SEQ ID NO: 1949282 - protein, 10 aa, Staphylococcus
HTLTDATNLE

SEQ ID NO: 1949283 - protein, 6 aa, Staphylococcus
HTLTSG

SEQ ID NO: 1949284 - protein, 26 aa, Staphylococcus
HTMAGDDPTKYRTSDEDSEWEKKDPL

SEQ ID NO: 1949285 - protein, 7 aa, Staphylococcus
HTNASRD

SEQ ID NO: 1949286 - protein, 9 aa, Staphylococcus
HTNEPAYGT

SEQ ID NO: 1949287 - protein, 7 aa, Staphylococcus
HTNESPR

SEQ ID NO: 1949288 - protein, 6 aa, Staphylococcus
HTNGEE

SEQ ID NO: 1949289 - protein, 7 aa, Staphylococcus
HTNGHGK

SEQ ID NO: 1949290 - protein, 7 aa, Staphylococcus
HTNHPKE

SEQ ID NO: 1949291 - protein, 10 aa, Staphylococcus
HTNKKGNVLN

SEQ ID NO: 1949292 - protein, 11 aa, Staphylococcus
HTNKLKDIEQS

SEQ ID NO: 1949293 - protein, 10 aa, Staphylococcus
HTNQKGNVLN

SEQ ID NO: 1949294 - protein, 7 aa, Staphylococcus
HTNQPER

SEQ ID NO: 1949295 - protein, 7 aa, Staphylococcus
HTNYNNN

SEQ ID NO: 1949296 - protein, 4 aa, Staphylococcus
HTPD

SEQ ID NO: 1949297 - protein, 16 aa, Staphylococcus
HTPEGIEARQTVPAPA

SEQ ID NO: 1949298 - protein, 12 aa, Staphylococcus
HTPEIGKGRGPV

SEQ ID NO: 1949299 - protein, 12 aa, Staphylococcus
HTPEIGQGRGPV

SEQ ID NO: 1949300 - protein, 22 aa, Staphylococcus
HTPEKFPQMSSKIKKENEDLET

SEQ ID NO: 1949301 - protein, 4 aa, Staphylococcus
HTPL

SEQ ID NO: 1949302 - protein, 5 aa, Staphylococcus
HTPSQ

SEQ ID NO: 1949303 - protein, 7 aa, Staphylococcus
HTPSQDA

SEQ ID NO: 1949304 - protein, 8 aa, Staphylococcus
HTPSQDKF

SEQ ID NO: 1949305 - protein, 19 aa, Staphylococcus
HTPSQDKFTISRDDDGAYV

SEQ ID NO: 1949306 - protein, 18 aa, Staphylococcus
HTPSQDKFTITRDDDAAY

SEQ ID NO: 1949307 - protein, 19 aa, Staphylococcus
HTPSQDKFTITRDDDGAYV

SEQ ID NO: 1949308 - protein, 9 aa, Staphylococcus
HTPSQDTFT

SEQ ID NO: 1949309 - protein, 18 aa, Staphylococcus
HTPSQDTFTITRDDDAAY

SEQ ID NO: 1949310 - protein, 6 aa, Staphylococcus
HTPSQM

SEQ ID NO: 1949311 - protein, 8 aa, Staphylococcus
HTPTKQEF

SEQ ID NO: 1949312 - protein, 16 aa, Staphylococcus
HTPVKEIDGEDPIKAD

SEQ ID NO: 1949313 - protein, 4 aa, Staphylococcus
HTPY

SEQ ID NO: 1949314 - protein, 14 aa, Staphylococcus
HTQAQGLTEETNDD

SEQ ID NO: 1949315 - protein, 6 aa, Staphylococcus
HTQEGT

SEQ ID NO: 1949316 - protein, 4 aa, Staphylococcus
HTQT

SEQ ID NO: 1949317 - protein, 7 aa, Staphylococcus
HTRSAET

SEQ ID NO: 1949318 - protein, 9 aa, Staphylococcus
HTRSTKARQ

SEQ ID NO: 1949319 - protein, 7 aa, Staphylococcus
HTRYSQQ

SEQ ID NO: 1949320 - protein, 13 aa, Staphylococcus
HTSANKKKVPAGS

SEQ ID NO: 1949321 - protein, 6 aa, Staphylococcus
HTSAVE

SEQ ID NO: 1949322 - protein, 8 aa, Staphylococcus
HTSGMAEG

SEQ ID NO: 1949323 - protein, 4 aa, Staphylococcus
HTSI

SEQ ID NO: 1949324 - protein, 14 aa, Staphylococcus
HTSISKRASDIKAQ

SEQ ID NO: 1949325 - protein, 10 aa, Staphylococcus
HTSKEKKFIP

SEQ ID NO: 1949326 - protein, 10 aa, Staphylococcus
HTSKELDDTP

SEQ ID NO: 1949327 - protein, 9 aa, Staphylococcus
HTSLEPTKH

SEQ ID NO: 1949328 - protein, 10 aa, Staphylococcus
HTSLEPTKHI

SEQ ID NO: 1949329 - protein, 10 aa, Staphylococcus
HTSNKKKLVT

SEQ ID NO: 1949330 - protein, 18 aa, Staphylococcus
HTSPVQARTLEKRNGQGP

SEQ ID NO: 1949331 - protein, 18 aa, Staphylococcus
HTSPVQARTMEQRNGQGP

SEQ ID NO: 1949332 - protein, 12 aa, Staphylococcus
HTSQKKKRVPAG

SEQ ID NO: 1949333 - protein, 10 aa, Staphylococcus
HTSRPDAPEH

SEQ ID NO: 1949334 - protein, 11 aa, Staphylococcus
HTSSGRSPSEL

SEQ ID NO: 1949335 - protein, 11 aa, Staphylococcus
HTSTGRKLAEE

SEQ ID NO: 1949336 - protein, 4 aa, Staphylococcus
HTSY

SEQ ID NO: 1949337 - protein, 9 aa, Staphylococcus
HTSYSHNKG

SEQ ID NO: 1949338 - protein, 6 aa, Staphylococcus
HTTAAT

SEQ ID NO: 1949339 - protein, 23 aa, Staphylococcus
HTTDTQADRLTAETKPTERSGSE

SEQ ID NO: 1949340 - protein, 15 aa, Staphylococcus
HTTDTYTGAVTTPIY

SEQ ID NO: 1949341 - protein, 21 aa, Staphylococcus
HTTEDRTTTQVKELENDDRID

SEQ ID NO: 1949342 - protein, 7 aa, Staphylococcus
HTTEEKM

SEQ ID NO: 1949343 - protein, 7 aa, Staphylococcus
HTTEERM

SEQ ID NO: 1949344 - protein, 11 aa, Staphylococcus
HTTGRKEMTKT

SEQ ID NO: 1949345 - protein, 7 aa, Staphylococcus
HTTKATD

SEQ ID NO: 1949346 - protein, 4 aa, Staphylococcus
HTTL

SEQ ID NO: 1949347 - protein, 7 aa, Staphylococcus
HTTSERI

SEQ ID NO: 1949348 - protein, 13 aa, Staphylococcus
HTVEVNGESIETE

SEQ ID NO: 1949349 - protein, 10 aa, Staphylococcus
HTVTQSSEYG

SEQ ID NO: 1949350 - protein, 13 aa, Staphylococcus
HTYAAQNNMAPPI

SEQ ID NO: 1949351 - protein, 5 aa, Staphylococcus
HTYED

SEQ ID NO: 1949352 - protein, 8 aa, Staphylococcus
HTYEPSQR

SEQ ID NO: 1949353 - protein, 4 aa, Staphylococcus
HTYK

SEQ ID NO: 1949354 - protein, 5 aa, Staphylococcus
HTYNE

SEQ ID NO: 1949355 - protein, 12 aa, Staphylococcus
HVAGSEARQFIY

SEQ ID NO: 1949356 - protein, 11 aa, Staphylococcus
HVAPSNDKQGV

SEQ ID NO: 1949357 - protein, 4 aa, Staphylococcus
HVDA

SEQ ID NO: 1949358 - protein, 4 aa, Staphylococcus
HVDG

SEQ ID NO: 1949359 - protein, 8 aa, Staphylococcus
HVDGNDPI

SEQ ID NO: 1949360 - protein, 9 aa, Staphylococcus
HVDKPEDVV

SEQ ID NO: 1949361 - protein, 4 aa, Staphylococcus
HVER

SEQ ID NO: 1949362 - protein, 12 aa, Staphylococcus
HVESGVKHKDEK

SEQ ID NO: 1949363 - protein, 8 aa, Staphylococcus
HVESPEQV

SEQ ID NO: 1949364 - protein, 10 aa, Staphylococcus
HVGAGSEAGI

SEQ ID NO: 1949365 - protein, 11 aa, Staphylococcus
HVGQDDEAVDD

SEQ ID NO: 1949366 - protein, 9 aa, Staphylococcus
HVKDSEAET

SEQ ID NO: 1949367 - protein, 8 aa, Staphylococcus
HVKSDACV

SEQ ID NO: 1949368 - protein, 10 aa, Staphylococcus
HVKSEIEGKD

SEQ ID NO: 1949369 - protein, 8 aa, Staphylococcus
HVKSPEDV

SEQ ID NO: 1949370 - protein, 8 aa, Staphylococcus
HVNREGQY

SEQ ID NO: 1949371 - protein, 11 aa, Staphylococcus
HVPEENEIDNY

SEQ ID NO: 1949372 - protein, 12 aa, Staphylococcus
HVPKKDGSASRL

SEQ ID NO: 1949373 - protein, 4 aa, Staphylococcus
HVPP

SEQ ID NO: 1949374 - protein, 8 aa, Staphylococcus
HVPRPKAL

SEQ ID NO: 1949375 - protein, 11 aa, Staphylococcus
HVPRPPAMKET

SEQ ID NO: 1949376 - protein, 6 aa, Staphylococcus
HVPRPQ

SEQ ID NO: 1949377 - protein, 6 aa, Staphylococcus
HVQSPE

SEQ ID NO: 1949378 - protein, 8 aa, Staphylococcus
HVQSPEDV

SEQ ID NO: 1949379 - protein, 8 aa, Staphylococcus
HVSAEEAE

SEQ ID NO: 1949380 - protein, 8 aa, Staphylococcus
HVSDQDKN

SEQ ID NO: 1949381 - protein, 18 aa, Staphylococcus
HVSEQTGSVQLSERASGE

SEQ ID NO: 1949382 - protein, 4 aa, Staphylococcus
HVSV

SEQ ID NO: 1949383 - protein, 5 aa, Staphylococcus
HVSVE

SEQ ID NO: 1949384 - protein, 13 aa, Staphylococcus
HVTAQDDIATGDY

SEQ ID NO: 1949385 - protein, 8 aa, Staphylococcus
HVTNSDKL

SEQ ID NO: 1949386 - protein, 12 aa, Staphylococcus
HVTSPKSIQTAS

SEQ ID NO: 1949387 - protein, 10 aa, Staphylococcus
HVTTHDDPTY

SEQ ID NO: 1949388 - protein, 10 aa, Staphylococcus
HVTTNGELQP

SEQ ID NO: 1949389 - protein, 5 aa, Staphylococcus
HWGGQ

SEQ ID NO: 1949390 - protein, 9 aa, Staphylococcus
HWTSPNKAI

SEQ ID NO: 1949391 - protein, 9 aa, Staphylococcus
HYAEHTDKP

SEQ ID NO: 1949392 - protein, 4 aa, Staphylococcus
HYAP

SEQ ID NO: 1949393 - protein, 6 aa, Staphylococcus
HYAPEK

SEQ ID NO: 1949394 - protein, 7 aa, Staphylococcus
HYAPESQ

SEQ ID NO: 1949395 - protein, 13 aa, Staphylococcus
HYAPSQKEALQTA

SEQ ID NO: 1949396 - protein, 12 aa, Staphylococcus
HYATNQENRVDK

SEQ ID NO: 1949397 - protein, 7 aa, Staphylococcus
HYDAKDD

SEQ ID NO: 1949398 - protein, 4 aa, Staphylococcus
HYDG

SEQ ID NO: 1949399 - protein, 29 aa, Staphylococcus
HYDGDNPAFKPKKRPDKKVGLSKHEEAQI

SEQ ID NO: 1949400 - protein, 18 aa, Staphylococcus
HYDNQTQINLEETKQTSD

SEQ ID NO: 1949401 - protein, 4 aa, Staphylococcus
HYEE

SEQ ID NO: 1949402 - protein, 5 aa, Staphylococcus
HYENT

SEQ ID NO: 1949403 - protein, 17 aa, Staphylococcus
HYESARAAALSNNHIPE

SEQ ID NO: 1949404 - protein, 5 aa, Staphylococcus
HYGEK

SEQ ID NO: 1949405 - protein, 8 aa, Staphylococcus
HYGGTGQS

SEQ ID NO: 1949406 - protein, 7 aa, Staphylococcus
HYGNETR

SEQ ID NO: 1949407 - protein, 26 aa, Staphylococcus
HYGNPSSIHSVGRDARKYLDQSRQKV

SEQ ID NO: 1949408 - protein, 26 aa, Staphylococcus
HYGNPSSIHSVGRDARRYLDESRRNV

SEQ ID NO: 1949409 - protein, 6 aa, Staphylococcus
HYHSEN

SEQ ID NO: 1949410 - protein, 10 aa, Staphylococcus
HYKDTNEFAN

SEQ ID NO: 1949411 - protein, 10 aa, Staphylococcus
HYKGGKLQAE

SEQ ID NO: 1949412 - protein, 4 aa, Staphylococcus
HYKP

SEQ ID NO: 1949413 - protein, 17 aa, Staphylococcus
HYKSARQRALSNNHIPE

SEQ ID NO: 1949414 - protein, 21 aa, Staphylococcus
HYNGENPAFKPKKRPDKPVGL

SEQ ID NO: 1949415 - protein, 16 aa, Staphylococcus
HYNPNNEITKSRNTLD

SEQ ID NO: 1949416 - protein, 16 aa, Staphylococcus
HYNSARERALSNNHIP

SEQ ID NO: 1949417 - protein, 5 aa, Staphylococcus
HYPDA

SEQ ID NO: 1949418 - protein, 6 aa, Staphylococcus
HYPDTS

SEQ ID NO: 1949419 - protein, 7 aa, Staphylococcus
HYPDTSR

SEQ ID NO: 1949420 - protein, 5 aa, Staphylococcus
HYPKS

SEQ ID NO: 1949421 - protein, 4 aa, Staphylococcus
HYPN

SEQ ID NO: 1949422 - protein, 6 aa, Staphylococcus
HYPNQQ

SEQ ID NO: 1949423 - protein, 5 aa, Staphylococcus
HYPSN

SEQ ID NO: 1949424 - protein, 12 aa, Staphylococcus
HYPSVQGDNVQY

SEQ ID NO: 1949425 - protein, 12 aa, Staphylococcus
HYQKTYDENEYK

SEQ ID NO: 1949426 - protein, 15 aa, Staphylococcus
HYQPEDRKKLEPKDI

SEQ ID NO: 1949427 - protein, 7 aa, Staphylococcus
HYQQTVT

SEQ ID NO: 1949428 - protein, 11 aa, Staphylococcus
HYQQTYTENEY

SEQ ID NO: 1949429 - protein, 9 aa, Staphylococcus
HYQRTFDET

SEQ ID NO: 1949430 - protein, 8 aa, Staphylococcus
HYQRTYEE

SEQ ID NO: 1949431 - protein, 6 aa, Staphylococcus
HYQTSQ

SEQ ID NO: 1949432 - protein, 7 aa, Staphylococcus
HYRQPTY

SEQ ID NO: 1949433 - protein, 5 aa, Staphylococcus
HYRRG

SEQ ID NO: 1949434 - protein, 6 aa, Staphylococcus
HYSDEQ

SEQ ID NO: 1949435 - protein, 21 aa, Staphylococcus
HYSDNKDKVEATQKATKPKFI

SEQ ID NO: 1949436 - protein, 9 aa, Staphylococcus
HYSDTNAFA

SEQ ID NO: 1949437 - protein, 9 aa, Staphylococcus
HYSEAGSFR

SEQ ID NO: 1949438 - protein, 15 aa, Staphylococcus
HYSEGELQELLDTIK

SEQ ID NO: 1949439 - protein, 7 aa, Staphylococcus
HYSPDTP

SEQ ID NO: 1949440 - protein, 8 aa, Staphylococcus
HYSPDTPL

SEQ ID NO: 1949441 - protein, 6 aa, Staphylococcus
HYTEPW

SEQ ID NO: 1949442 - protein, 11 aa, Staphylococcus
HYTTTKQSKLK

SEQ ID NO: 1949443 - protein, 19 aa, Staphylococcus
HYYDGGSYSMENPDVSEAD

SEQ ID NO: 1949444 - protein, 15 aa, Staphylococcus
HYYGSGSKTTQSVTA

SEQ ID NO: 1949445 - protein, 12 aa, Staphylococcus
HYYTSKSQTAYT

SEQ ID NO: 1949446 - protein, 15 aa, Staphylococcus
IAAGKKGTDLPGQIA

SEQ ID NO: 1949447 - protein, 13 aa, Staphylococcus
IAAIDGGKSIDTS

SEQ ID NO: 1949448 - protein, 8 aa, Staphylococcus
IAAPAYAG

SEQ ID NO: 1949449 - protein, 16 aa, Staphylococcus
IAAPSANLSGRPSPTK

SEQ ID NO: 1949450 - protein, 4 aa, Staphylococcus
IADD

SEQ ID NO: 1949451 - protein, 11 aa, Staphylococcus
IADDGNKENII

SEQ ID NO: 1949452 - protein, 11 aa, Staphylococcus
IADDSDVDGTL

SEQ ID NO: 1949453 - protein, 4 aa, Staphylococcus
IADE

SEQ ID NO: 1949454 - protein, 8 aa, Staphylococcus
IADENGGN

SEQ ID NO: 1949455 - protein, 7 aa, Staphylococcus
IADGANV

SEQ ID NO: 1949456 - protein, 15 aa, Staphylococcus
IADGKIEPVIPEEYL

SEQ ID NO: 1949457 - protein, 6 aa, Staphylococcus
IADIGS

SEQ ID NO: 1949458 - protein, 11 aa, Staphylococcus
IADKDSDYALT

SEQ ID NO: 1949459 - protein, 11 aa, Staphylococcus
IADKKKNVSDH

SEQ ID NO: 1949460 - protein, 7 aa, Staphylococcus
IADNEGL

SEQ ID NO: 1949461 - protein, 15 aa, Staphylococcus
IADNKDTKVVEHQKD

SEQ ID NO: 1949462 - protein, 7 aa, Staphylococcus
IADRPKS

SEQ ID NO: 1949463 - protein, 6 aa, Staphylococcus
IADSKE

SEQ ID NO: 1949464 - protein, 12 aa, Staphylococcus
IADSPSTPYAAI

SEQ ID NO: 1949465 - protein, 6 aa, Staphylococcus
IADTAG

SEQ ID NO: 1949466 - protein, 5 aa, Staphylococcus
IADTE

SEQ ID NO: 1949467 - protein, 13 aa, Staphylococcus
IADYTSPREDWLY

SEQ ID NO: 1949468 - protein, 8 aa, Staphylococcus
IAEAHQTS

SEQ ID NO: 1949469 - protein, 5 aa, Staphylococcus
IAEDK

SEQ ID NO: 1949470 - protein, 6 aa, Staphylococcus
IAEDQI

SEQ ID NO: 1949471 - protein, 4 aa, Staphylococcus
IAEE

SEQ ID NO: 1949472 - protein, 5 aa, Staphylococcus
IAEEN

SEQ ID NO: 1949473 - protein, 11 aa, Staphylococcus
IAEENIQSMPP

SEQ ID NO: 1949474 - protein, 7 aa, Staphylococcus
IAEENKL

SEQ ID NO: 1949475 - protein, 7 aa, Staphylococcus
IAEENNL

SEQ ID NO: 1949476 - protein, 7 aa, Staphylococcus
IAEENSL

SEQ ID NO: 1949477 - protein, 6 aa, Staphylococcus
IAEENV

SEQ ID NO: 1949478 - protein, 7 aa, Staphylococcus
IAEEQTI

SEQ ID NO: 1949479 - protein, 10 aa, Staphylococcus
IAEESAKSAL

SEQ ID NO: 1949480 - protein, 11 aa, Staphylococcus
IAEGESVTSGQ

SEQ ID NO: 1949481 - protein, 27 aa, Staphylococcus
IAEGQGKTKKESEQKAAERAYKQMKTK

SEQ ID NO: 1949482 - protein, 6 aa, Staphylococcus
IAEIDD

SEQ ID NO: 1949483 - protein, 6 aa, Staphylococcus
IAEIDS

SEQ ID NO: 1949484 - protein, 23 aa, Staphylococcus
IAEKRGEAKMSSQAVGGAVGSNP

SEQ ID NO: 1949485 - protein, 14 aa, Staphylococcus
IAENADHVKGPGSF

SEQ ID NO: 1949486 - protein, 4 aa, Staphylococcus
IAEP

SEQ ID NO: 1949487 - protein, 7 aa, Staphylococcus
IAEPAGA

SEQ ID NO: 1949488 - protein, 7 aa, Staphylococcus
IAEPGDT

SEQ ID NO: 1949489 - protein, 6 aa, Staphylococcus
IAEPQS

SEQ ID NO: 1949490 - protein, 10 aa, Staphylococcus
IAEQGSPDEM

SEQ ID NO: 1949491 - protein, 5 aa, Staphylococcus
IAERN

SEQ ID NO: 1949492 - protein, 6 aa, Staphylococcus
IAESQG

SEQ ID NO: 1949493 - protein, 7 aa, Staphylococcus
IAESSHQ

SEQ ID NO: 1949494 - protein, 5 aa, Staphylococcus
IAESV

SEQ ID NO: 1949495 - protein, 6 aa, Staphylococcus
IAETAH

SEQ ID NO: 1949496 - protein, 6 aa, Staphylococcus
IAETDH

SEQ ID NO: 1949497 - protein, 12 aa, Staphylococcus
IAEVGAGDYKGD

SEQ ID NO: 1949498 - protein, 12 aa, Staphylococcus
IAGASKNSNHPM

SEQ ID NO: 1949499 - protein, 8 aa, Staphylococcus
IAGDQQAA

SEQ ID NO: 1949500 - protein, 7 aa, Staphylococcus
IAGGDEK

SEQ ID NO: 1949501 - protein, 10 aa, Staphylococcus
IAGGDKKVNY

SEQ ID NO: 1949502 - protein, 9 aa, Staphylococcus
IAGGEEKNR

SEQ ID NO: 1949503 - protein, 5 aa, Staphylococcus
IAGMK

SEQ ID NO: 1949504 - protein, 9 aa, Staphylococcus
IAGNGASDI

SEQ ID NO: 1949505 - protein, 9 aa, Staphylococcus
IAGNGSDEL

SEQ ID NO: 1949506 - protein, 7 aa, Staphylococcus
IAGQGTI

SEQ ID NO: 1949507 - protein, 7 aa, Staphylococcus
IAGQGTL

SEQ ID NO: 1949508 - protein, 5 aa, Staphylococcus
IAGQP

SEQ ID NO: 1949509 - protein, 5 aa, Staphylococcus
IAGQS

SEQ ID NO: 1949510 - protein, 4 aa, Staphylococcus
IAGS

SEQ ID NO: 1949511 - protein, 7 aa, Staphylococcus
IAGSGSA

SEQ ID NO: 1949512 - protein, 7 aa, Staphylococcus
IAGSINN

SEQ ID NO: 1949513 - protein, 19 aa, Staphylococcus
IAGTIRRGRTPEEDQNNAH

SEQ ID NO: 1949514 - protein, 10 aa, Staphylococcus
IAGTSGRQLY

SEQ ID NO: 1949515 - protein, 9 aa, Staphylococcus
IAGYSRNKV

SEQ ID NO: 1949516 - protein, 5 aa, Staphylococcus
IAHEG

SEQ ID NO: 1949517 - protein, 4 aa, Staphylococcus
IAHQ

SEQ ID NO: 1949518 - protein, 18 aa, Staphylococcus
IAHTKGEIAMQDKEKFEG

SEQ ID NO: 1949519 - protein, 13 aa, Staphylococcus
IAKAAKKSDRIAA

SEQ ID NO: 1949520 - protein, 11 aa, Staphylococcus
IAKAISGSTAY

SEQ ID NO: 1949521 - protein, 9 aa, Staphylococcus
IAKATGTSL

SEQ ID NO: 1949522 - protein, 4 aa, Staphylococcus
IAKD

SEQ ID NO: 1949523 - protein, 10 aa, Staphylococcus
IAKDGEGATK

SEQ ID NO: 1949524 - protein, 10 aa, Staphylococcus
IAKDGYDTEL

SEQ ID NO: 1949525 - protein, 13 aa, Staphylococcus
IAKDNLKEENVDA

SEQ ID NO: 1949526 - protein, 6 aa, Staphylococcus
IAKDQG

SEQ ID NO: 1949527 - protein, 10 aa, Staphylococcus
IAKDSDESIQ

SEQ ID NO: 1949528 - protein, 10 aa, Staphylococcus
IAKDSQYDME

SEQ ID NO: 1949529 - protein, 6 aa, Staphylococcus
IAKDTR

SEQ ID NO: 1949530 - protein, 5 aa, Staphylococcus
IAKEY

SEQ ID NO: 1949531 - protein, 15 aa, Staphylococcus
IAKGDTSADITTPES

SEQ ID NO: 1949532 - protein, 8 aa, Staphylococcus
IAKGKQSH

SEQ ID NO: 1949533 - protein, 28 aa, Staphylococcus
IAKGQGRTKKESEQKAAESAYHKLRDEN

SEQ ID NO: 1949534 - protein, 13 aa, Staphylococcus
IAKGQGVGRESVV

SEQ ID NO: 1949535 - protein, 31 aa, Staphylococcus
IAKGQGVGRGSTTGKTVISKTASDLEGKDLS

SEQ ID NO: 1949536 - protein, 12 aa, Staphylococcus
IAKGQGVGRGSV

SEQ ID NO: 1949537 - protein, 13 aa, Staphylococcus
IAKGQGVGRGSVV

SEQ ID NO: 1949538 - protein, 12 aa, Staphylococcus
IAKGSFSDGTNY

SEQ ID NO: 1949539 - protein, 12 aa, Staphylococcus
IAKKSGEEIKSN

SEQ ID NO: 1949540 - protein, 8 aa, Staphylococcus
IAKNKPDA

SEQ ID NO: 1949541 - protein, 7 aa, Staphylococcus
IAKPGSV

SEQ ID NO: 1949542 - protein, 17 aa, Staphylococcus
IAKPQKPTAQRATRSNV

SEQ ID NO: 1949543 - protein, 4 aa, Staphylococcus
IAKQ

SEQ ID NO: 1949544 - protein, 10 aa, Staphylococcus
IAKQDDTDRS

SEQ ID NO: 1949545 - protein, 23 aa, Staphylococcus
IAKQLGKSHMSAQAVGGAVGRSP

SEQ ID NO: 1949546 - protein, 8 aa, Staphylococcus
IAKQQKTI

SEQ ID NO: 1949547 - protein, 5 aa, Staphylococcus
IAKTG

SEQ ID NO: 1949548 - protein, 14 aa, Staphylococcus
IAKTGAYITQEEAD

SEQ ID NO: 1949549 - protein, 15 aa, Staphylococcus
IAKTGAYITQEEADE

SEQ ID NO: 1949550 - protein, 10 aa, Staphylococcus
IAKTGSSIFT

SEQ ID NO: 1949551 - protein, 7 aa, Staphylococcus
IAKTGTV

SEQ ID NO: 1949552 - protein, 15 aa, Staphylococcus
IAKTGTYITQEEADE

SEQ ID NO: 1949553 - protein, 5 aa, Staphylococcus
IAKTS

SEQ ID NO: 1949554 - protein, 4 aa, Staphylococcus
IALT

SEQ ID NO: 1949555 - protein, 21 aa, Staphylococcus
IANADDPKAAAKQCRDIIDGN

SEQ ID NO: 1949556 - protein, 20 aa, Staphylococcus
IANADDPVEAAKQCRAAIEG

SEQ ID NO: 1949557 - protein, 20 aa, Staphylococcus
IANADDPVEAAKQCREAIEG

SEQ ID NO: 1949558 - protein, 20 aa, Staphylococcus
IANADDPVVAAKQCRDAIEG

SEQ ID NO: 1949559 - protein, 20 aa, Staphylococcus
IANAEDPVEVAKQCRDAIEG

SEQ ID NO: 1949560 - protein, 18 aa, Staphylococcus
IANELDSDANSVDEYKEN

SEQ ID NO: 1949561 - protein, 6 aa, Staphylococcus
IANEQN

SEQ ID NO: 1949562 - protein, 9 aa, Staphylococcus
IANETGHTR

SEQ ID NO: 1949563 - protein, 6 aa, Staphylococcus
IANEVP

SEQ ID NO: 1949564 - protein, 7 aa, Staphylococcus
IANGTEH

SEQ ID NO: 1949565 - protein, 7 aa, Staphylococcus
IANGTKQ

SEQ ID NO: 1949566 - protein, 10 aa, Staphylococcus
IANKAVSTAF

SEQ ID NO: 1949567 - protein, 15 aa, Staphylococcus
IANKQITTLQKNAKA

SEQ ID NO: 1949568 - protein, 16 aa, Staphylococcus
IANKQITTLQKNAKEF

SEQ ID NO: 1949569 - protein, 15 aa, Staphylococcus
IANKQITTLQRNAND

SEQ ID NO: 1949570 - protein, 6 aa, Staphylococcus
IANNNK

SEQ ID NO: 1949571 - protein, 10 aa, Staphylococcus
IANNPPSLEV

SEQ ID NO: 1949572 - protein, 18 aa, Staphylococcus
IANPTYEQVKSGTTGHYE

SEQ ID NO: 1949573 - protein, 6 aa, Staphylococcus
IANSAE

SEQ ID NO: 1949574 - protein, 13 aa, Staphylococcus
IANSDQKALGKRT

SEQ ID NO: 1949575 - protein, 13 aa, Staphylococcus
IANSGYTSRRKAE

SEQ ID NO: 1949576 - protein, 9 aa, Staphylococcus
IANYNGTDF

SEQ ID NO: 1949577 - protein, 41 aa, Staphylococcus
IAPEETDTKLTNMNTSISQNGKDIQQRATKEELNSSKKTLS

SEQ ID NO: 1949578 - protein, 6 aa, Staphylococcus
IAPEVG

SEQ ID NO: 1949579 - protein, 10 aa, Staphylococcus
IAPGANINYD

SEQ ID NO: 1949580 - protein, 8 aa, Staphylococcus
IAPGDYEK

SEQ ID NO: 1949581 - protein, 6 aa, Staphylococcus
IAPKGA

SEQ ID NO: 1949582 - protein, 13 aa, Staphylococcus
IAPKSNETPPVKD

SEQ ID NO: 1949583 - protein, 7 aa, Staphylococcus
IAPNDDY

SEQ ID NO: 1949584 - protein, 23 aa, Staphylococcus
IAPPDATAEQREADLADRKYQGL

SEQ ID NO: 1949585 - protein, 7 aa, Staphylococcus
IAPRTMD

SEQ ID NO: 1949586 - protein, 6 aa, Staphylococcus
IAPSPE

SEQ ID NO: 1949587 - protein, 9 aa, Staphylococcus
IAPSPQHMD

SEQ ID NO: 1949588 - protein, 6 aa, Staphylococcus
IAPSTA

SEQ ID NO: 1949589 - protein, 4 aa, Staphylococcus
IAPT

SEQ ID NO: 1949590 - protein, 4 aa, Staphylococcus
IAQA

SEQ ID NO: 1949591 - protein, 4 aa, Staphylococcus
IAQD

SEQ ID NO: 1949592 - protein, 10 aa, Staphylococcus
IAQDESPREI

SEQ ID NO: 1949593 - protein, 6 aa, Staphylococcus
IAQEQN

SEQ ID NO: 1949594 - protein, 9 aa, Staphylococcus
IAQGAPQEV

SEQ ID NO: 1949595 - protein, 10 aa, Staphylococcus
IAQKDKDYAT

SEQ ID NO: 1949596 - protein, 6 aa, Staphylococcus
IAQKTA

SEQ ID NO: 1949597 - protein, 8 aa, Staphylococcus
IAQMSTKD

SEQ ID NO: 1949598 - protein, 12 aa, Staphylococcus
IAQRGKVELNEK

SEQ ID NO: 1949599 - protein, 7 aa, Staphylococcus
IAQRTAK

SEQ ID NO: 1949600 - protein, 9 aa, Staphylococcus
IAQSDIDKQ

SEQ ID NO: 1949601 - protein, 4 aa, Staphylococcus
IAQT

SEQ ID NO: 1949602 - protein, 6 aa, Staphylococcus
IAQTPF

SEQ ID NO: 1949603 - protein, 6 aa, Staphylococcus
IAQYDT

SEQ ID NO: 1949604 - protein, 8 aa, Staphylococcus
IARDNESI

SEQ ID NO: 1949605 - protein, 13 aa, Staphylococcus
IAREQNGKFGTVS

SEQ ID NO: 1949606 - protein, 10 aa, Staphylococcus
IARGASIQTG

SEQ ID NO: 1949607 - protein, 11 aa, Staphylococcus
IARGQGVGRGS

SEQ ID NO: 1949608 - protein, 11 aa, Staphylococcus
IARNDKDYATT

SEQ ID NO: 1949609 - protein, 8 aa, Staphylococcus
IARNNSKD

SEQ ID NO: 1949610 - protein, 6 aa, Staphylococcus
IARNQG

SEQ ID NO: 1949611 - protein, 5 aa, Staphylococcus
IARQE

SEQ ID NO: 1949612 - protein, 5 aa, Staphylococcus
IARQT

SEQ ID NO: 1949613 - protein, 6 aa, Staphylococcus
IARQTP

SEQ ID NO: 1949614 - protein, 5 aa, Staphylococcus
IARSG

SEQ ID NO: 1949615 - protein, 6 aa, Staphylococcus
IARTGY

SEQ ID NO: 1949616 - protein, 9 aa, Staphylococcus
IARTSELQF

SEQ ID NO: 1949617 - protein, 4 aa, Staphylococcus
IASD

SEQ ID NO: 1949618 - protein, 8 aa, Staphylococcus
IASDDDVI

SEQ ID NO: 1949619 - protein, 4 aa, Staphylococcus
IASE

SEQ ID NO: 1949620 - protein, 20 aa, Staphylococcus
IASFGKGKSLSKKDISKEGH

SEQ ID NO: 1949621 - protein, 5 aa, Staphylococcus
IASGD

SEQ ID NO: 1949622 - protein, 9 aa, Staphylococcus
IASGEAETS

SEQ ID NO: 1949623 - protein, 9 aa, Staphylococcus
IASGEAETT

SEQ ID NO: 1949624 - protein, 10 aa, Staphylococcus
IASGESETTL

SEQ ID NO: 1949625 - protein, 13 aa, Staphylococcus
IASGHKYKYKVKL

SEQ ID NO: 1949626 - protein, 15 aa, Staphylococcus
IASGKISPVVPEEFQ

SEQ ID NO: 1949627 - protein, 15 aa, Staphylococcus
IASGKITPVVSDEFT

SEQ ID NO: 1949628 - protein, 7 aa, Staphylococcus
IASGVDR

SEQ ID NO: 1949629 - protein, 10 aa, Staphylococcus
IASHRQHGNG

SEQ ID NO: 1949630 - protein, 7 aa, Staphylococcus
IASKKKS

SEQ ID NO: 1949631 - protein, 14 aa, Staphylococcus
IASKTIVDKFFKQD

SEQ ID NO: 1949632 - protein, 7 aa, Staphylococcus
IASMTNA

SEQ ID NO: 1949633 - protein, 9 aa, Staphylococcus
IASNQESEK

SEQ ID NO: 1949634 - protein, 7 aa, Staphylococcus
IASQGNK

SEQ ID NO: 1949635 - protein, 15 aa, Staphylococcus
IASRKAVEKGSTALE

SEQ ID NO: 1949636 - protein, 17 aa, Staphylococcus
IASRQAVEKGTKGLERV

SEQ ID NO: 1949637 - protein, 17 aa, Staphylococcus
IASSGYTSRRKAETLIT

SEQ ID NO: 1949638 - protein, 13 aa, Staphylococcus
IASSQIVDRLIKT

SEQ ID NO: 1949639 - protein, 8 aa, Staphylococcus
IASTSEPL

SEQ ID NO: 1949640 - protein, 9 aa, Staphylococcus
IASTTKDTR

SEQ ID NO: 1949641 - protein, 10 aa, Staphylococcus
IATADGQISM

SEQ ID NO: 1949642 - protein, 5 aa, Staphylococcus
IATDD

SEQ ID NO: 1949643 - protein, 6 aa, Staphylococcus
IATDDE

SEQ ID NO: 1949644 - protein, 11 aa, Staphylococcus
IATDDKGINYV

SEQ ID NO: 1949645 - protein, 6 aa, Staphylococcus
IATDEE

SEQ ID NO: 1949646 - protein, 7 aa, Staphylococcus
IATEGAE

SEQ ID NO: 1949647 - protein, 7 aa, Staphylococcus
IATFSGT

SEQ ID NO: 1949648 - protein, 12 aa, Staphylococcus
IATGDSSEVLGN

SEQ ID NO: 1949649 - protein, 9 aa, Staphylococcus
IATGETEEV

SEQ ID NO: 1949650 - protein, 7 aa, Staphylococcus
IATGVQP

SEQ ID NO: 1949651 - protein, 14 aa, Staphylococcus
IATHDSDYAKLEDG

SEQ ID NO: 1949652 - protein, 24 aa, Staphylococcus
IATKGSHVIKDNGDVVQNNQPDYL

SEQ ID NO: 1949653 - protein, 23 aa, Staphylococcus
IATKGSHYFDEDDNVQQNNDPEF

SEQ ID NO: 1949654 - protein, 8 aa, Staphylococcus
IATNKPEA

SEQ ID NO: 1949655 - protein, 15 aa, Staphylococcus
IATNTPSVLTETTAE

SEQ ID NO: 1949656 - protein, 5 aa, Staphylococcus
IATPD

SEQ ID NO: 1949657 - protein, 21 aa, Staphylococcus
IATQAKVDAKLKEQGISRHDI

SEQ ID NO: 1949658 - protein, 22 aa, Staphylococcus
IATQAKVDAKLKEQGISRHDIG

SEQ ID NO: 1949659 - protein, 21 aa, Staphylococcus
IATQAKVEAKLNEQGISRHEL

SEQ ID NO: 1949660 - protein, 7 aa, Staphylococcus
IATQEGI

SEQ ID NO: 1949661 - protein, 8 aa, Staphylococcus
IATREADG

SEQ ID NO: 1949662 - protein, 8 aa, Staphylococcus
IATREEDG

SEQ ID NO: 1949663 - protein, 8 aa, Staphylococcus
IATRETDG

SEQ ID NO: 1949664 - protein, 14 aa, Staphylococcus
IATSKRQAREDVNN

SEQ ID NO: 1949665 - protein, 7 aa, Staphylococcus
IATTEEV

SEQ ID NO: 1949666 - protein, 8 aa, Staphylococcus
IATTEEVD

SEQ ID NO: 1949667 - protein, 8 aa, Staphylococcus
IATTGSHR

SEQ ID NO: 1949668 - protein, 15 aa, Staphylococcus
IATYGKDSETKGEYW

SEQ ID NO: 1949669 - protein, 5 aa, Staphylococcus
IAVGD

SEQ ID NO: 1949670 - protein, 5 aa, Staphylococcus
IAVGK

SEQ ID NO: 1949671 - protein, 11 aa, Staphylococcus
IAYKPKDCDLK

SEQ ID NO: 1949672 - protein, 6 aa, Staphylococcus
IAYPGR

SEQ ID NO: 1949673 - protein, 4 aa, Staphylococcus
ICAE

SEQ ID NO: 1949674 - protein, 12 aa, Staphylococcus
IDAAKKAGDTIG

SEQ ID NO: 1949675 - protein, 11 aa, Staphylococcus
IDAANDTNAGL

SEQ ID NO: 1949676 - protein, 16 aa, Staphylococcus
IDADGVHVGQDDKEVK

SEQ ID NO: 1949677 - protein, 4 aa, Staphylococcus
IDAE

SEQ ID NO: 1949678 - protein, 8 aa, Staphylococcus
IDAEGDQF

SEQ ID NO: 1949679 - protein, 9 aa, Staphylococcus
IDAETAKTN

SEQ ID NO: 1949680 - protein, 8 aa, Staphylococcus
IDAGSHLP

SEQ ID NO: 1949681 - protein, 9 aa, Staphylococcus
IDAKPDEVV

SEQ ID NO: 1949682 - protein, 4 aa, Staphylococcus
IDAQ

SEQ ID NO: 1949683 - protein, 6 aa, Staphylococcus
IDAQAP

SEQ ID NO: 1949684 - protein, 4 aa, Staphylococcus
IDAR

SEQ ID NO: 1949685 - protein, 8 aa, Staphylococcus
IDATNDNS

SEQ ID NO: 1949686 - protein, 12 aa, Staphylococcus
IDDALERIKKVF

SEQ ID NO: 1949687 - protein, 7 aa, Staphylococcus
IDDDKEQ

SEQ ID NO: 1949688 - protein, 5 aa, Staphylococcus
IDDEK

SEQ ID NO: 1949689 - protein, 9 aa, Staphylococcus
IDDETTANI

SEQ ID NO: 1949690 - protein, 13 aa, Staphylococcus
IDDFSEKKPRTRI

SEQ ID NO: 1949691 - protein, 15 aa, Staphylococcus
IDDGGQFQDRGSQYR

SEQ ID NO: 1949692 - protein, 10 aa, Staphylococcus
IDDGPKNEES

SEQ ID NO: 1949693 - protein, 4 aa, Staphylococcus
IDDK

SEQ ID NO: 1949694 - protein, 5 aa, Staphylococcus
IDDMK

SEQ ID NO: 1949695 - protein, 16 aa, Staphylococcus
IDDNELDSIKEEVKKR

SEQ ID NO: 1949696 - protein, 6 aa, Staphylococcus
IDDNEV

SEQ ID NO: 1949697 - protein, 8 aa, Staphylococcus
IDDNVANS

SEQ ID NO: 1949698 - protein, 7 aa, Staphylococcus
IDDPETF

SEQ ID NO: 1949699 - protein, 5 aa, Staphylococcus
IDDPT

SEQ ID NO: 1949700 - protein, 4 aa, Staphylococcus
IDDQ

SEQ ID NO: 1949701 - protein, 7 aa, Staphylococcus
IDDQGNL

SEQ ID NO: 1949702 - protein, 6 aa, Staphylococcus
IDDQGP

SEQ ID NO: 1949703 - protein, 33 aa, Staphylococcus
IDDQTPGNAIHTEEAEDVTNDESDDNANDDRID

SEQ ID NO: 1949704 - protein, 9 aa, Staphylococcus
IDDRNEKMG

SEQ ID NO: 1949705 - protein, 5 aa, Staphylococcus
IDDSD

SEQ ID NO: 1949706 - protein, 6 aa, Staphylococcus
IDDSKG

SEQ ID NO: 1949707 - protein, 6 aa, Staphylococcus
IDDSVY

SEQ ID NO: 1949708 - protein, 16 aa, Staphylococcus
IDDTEKDMLKRFEGRD

SEQ ID NO: 1949709 - protein, 7 aa, Staphylococcus
IDDTLDQ

SEQ ID NO: 1949710 - protein, 7 aa, Staphylococcus
IDDTNGA

SEQ ID NO: 1949711 - protein, 14 aa, Staphylococcus
IDDTTKQFVGNKEE

SEQ ID NO: 1949712 - protein, 10 aa, Staphylococcus
IDDVKKQNDY

SEQ ID NO: 1949713 - protein, 7 aa, Staphylococcus
IDEANHE

SEQ ID NO: 1949714 - protein, 6 aa, Staphylococcus
IDEAYT

SEQ ID NO: 1949715 - protein, 4 aa, Staphylococcus
IDED

SEQ ID NO: 1949716 - protein, 8 aa, Staphylococcus
IDEDKLNK

SEQ ID NO: 1949717 - protein, 5 aa, Staphylococcus
IDEEG

SEQ ID NO: 1949718 - protein, 7 aa, Staphylococcus
IDEEGKL

SEQ ID NO: 1949719 - protein, 7 aa, Staphylococcus
IDEEKQE

SEQ ID NO: 1949720 - protein, 10 aa, Staphylococcus
IDEENESGAY

SEQ ID NO: 1949721 - protein, 21 aa, Staphylococcus
IDEENKARQESHSDYLASGST

SEQ ID NO: 1949722 - protein, 9 aa, Staphylococcus
IDEENNELG

SEQ ID NO: 1949723 - protein, 21 aa, Staphylococcus
IDEENRKRQSNEEEYLASGSN

SEQ ID NO: 1949724 - protein, 11 aa, Staphylococcus
IDEEQNPQKLQ

SEQ ID NO: 1949725 - protein, 11 aa, Staphylococcus
IDEESKSDYEI

SEQ ID NO: 1949726 - protein, 11 aa, Staphylococcus
IDEESQKDNRP

SEQ ID NO: 1949727 - protein, 7 aa, Staphylococcus
IDEGHNA

SEQ ID NO: 1949728 - protein, 7 aa, Staphylococcus
IDEGVKD

SEQ ID NO: 1949729 - protein, 9 aa, Staphylococcus
IDEGVKGSD

SEQ ID NO: 1949730 - protein, 4 aa, Staphylococcus
IDEL

SEQ ID NO: 1949731 - protein, 9 aa, Staphylococcus
IDELGEPDV

SEQ ID NO: 1949732 - protein, 8 aa, Staphylococcus
IDENDLNK

SEQ ID NO: 1949733 - protein, 9 aa, Staphylococcus
IDENERGHY

SEQ ID NO: 1949734 - protein, 15 aa, Staphylococcus
IDENQIRNKLDMLQF

SEQ ID NO: 1949735 - protein, 39 aa, Staphylococcus
IDENSANESEIIKSSSQFSHEDQQKIDKLSKQIKPMDND

SEQ ID NO: 1949736 - protein, 4 aa, Staphylococcus
IDEP

SEQ ID NO: 1949737 - protein, 11 aa, Staphylococcus
IDEPKISQGYY

SEQ ID NO: 1949738 - protein, 8 aa, Staphylococcus
IDEPQTNF

SEQ ID NO: 1949739 - protein, 10 aa, Staphylococcus
IDEPTITAKG

SEQ ID NO: 1949740 - protein, 7 aa, Staphylococcus
IDEPVGE

SEQ ID NO: 1949741 - protein, 7 aa, Staphylococcus
IDEQPYC

SEQ ID NO: 1949742 - protein, 11 aa, Staphylococcus
IDEQSKTVGAV

SEQ ID NO: 1949743 - protein, 8 aa, Staphylococcus
IDESGSLN

SEQ ID NO: 1949744 - protein, 23 aa, Staphylococcus
IDESKSGMVPRSRLNDKNAEIEE

SEQ ID NO: 1949745 - protein, 8 aa, Staphylococcus
IDETDNDG

SEQ ID NO: 1949746 - protein, 9 aa, Staphylococcus
IDETTQQFV

SEQ ID NO: 1949747 - protein, 14 aa, Staphylococcus
IDETTQQYVGNKTE

SEQ ID NO: 1949748 - protein, 8 aa, Staphylococcus
IDEVRENN

SEQ ID NO: 1949749 - protein, 9 aa, Staphylococcus
IDEYENPER

SEQ ID NO: 1949750 - protein, 4 aa, Staphylococcus
IDFD

SEQ ID NO: 1949751 - protein, 9 aa, Staphylococcus
IDFDKQNGQ

SEQ ID NO: 1949752 - protein, 6 aa, Staphylococcus
IDGATL

SEQ ID NO: 1949753 - protein, 10 aa, Staphylococcus
IDGDINDLST

SEQ ID NO: 1949754 - protein, 13 aa, Staphylococcus
IDGDMEKSFQSAE

SEQ ID NO: 1949755 - protein, 11 aa, Staphylococcus
IDGDRSLADSH

SEQ ID NO: 1949756 - protein, 8 aa, Staphylococcus
IDGDSLNK

SEQ ID NO: 1949757 - protein, 7 aa, Staphylococcus
IDGDTVE

SEQ ID NO: 1949758 - protein, 10 aa, Staphylococcus
IDGEDEQFKS

SEQ ID NO: 1949759 - protein, 7 aa, Staphylococcus
IDGENIG

SEQ ID NO: 1949760 - protein, 5 aa, Staphylococcus
IDGES

SEQ ID NO: 1949761 - protein, 14 aa, Staphylococcus
IDGFTKDTKGYNYS

SEQ ID NO: 1949762 - protein, 11 aa, Staphylococcus
IDGGALKTTTN

SEQ ID NO: 1949763 - protein, 6 aa, Staphylococcus
IDGITD

SEQ ID NO: 1949764 - protein, 11 aa, Staphylococcus
IDGKSDGKETI

SEQ ID NO: 1949765 - protein, 10 aa, Staphylococcus
IDGKSYTPQE

SEQ ID NO: 1949766 - protein, 7 aa, Staphylococcus
IDGLSRD

SEQ ID NO: 1949767 - protein, 5 aa, Staphylococcus
IDGNE

SEQ ID NO: 1949768 - protein, 9 aa, Staphylococcus
IDGPHKPPD

SEQ ID NO: 1949769 - protein, 7 aa, Staphylococcus
IDGQQDH

SEQ ID NO: 1949770 - protein, 8 aa, Staphylococcus
IDGRGGAQ

SEQ ID NO: 1949771 - protein, 10 aa, Staphylococcus
IDGSGDIEKV

SEQ ID NO: 1949772 - protein, 9 aa, Staphylococcus
IDGSIQKEG

SEQ ID NO: 1949773 - protein, 6 aa, Staphylococcus
IDGSPY

SEQ ID NO: 1949774 - protein, 7 aa, Staphylococcus
IDGSPYK

SEQ ID NO: 1949775 - protein, 6 aa, Staphylococcus
IDGSTI

SEQ ID NO: 1949776 - protein, 6 aa, Staphylococcus
IDGSTL

SEQ ID NO: 1949777 - protein, 18 aa, Staphylococcus
IDGTKVDKHSTGGVGDTT

SEQ ID NO: 1949778 - protein, 10 aa, Staphylococcus
IDGTSGEKAD

SEQ ID NO: 1949779 - protein, 12 aa, Staphylococcus
IDGTTNLVKQGK

SEQ ID NO: 1949780 - protein, 17 aa, Staphylococcus
IDGTTVTIGGTAKGSGM

SEQ ID NO: 1949781 - protein, 7 aa, Staphylococcus
IDGVSSK

SEQ ID NO: 1949782 - protein, 8 aa, Staphylococcus
IDHDGTEF

SEQ ID NO: 1949783 - protein, 8 aa, Staphylococcus
IDHDKGEV

SEQ ID NO: 1949784 - protein, 9 aa, Staphylococcus
IDHGDQQDG

SEQ ID NO: 1949785 - protein, 6 aa, Staphylococcus
IDHNAQ

SEQ ID NO: 1949786 - protein, 4 aa, Staphylococcus
IDHQ

SEQ ID NO: 1949787 - protein, 30 aa, Staphylococcus
IDHSEVKATRVRKSVGTERTFSTDVNDDEE

SEQ ID NO: 1949788 - protein, 4 aa, Staphylococcus
IDID

SEQ ID NO: 1949789 - protein, 9 aa, Staphylococcus
IDIPQTANQ

SEQ ID NO: 1949790 - protein, 12 aa, Staphylococcus
IDITKNEGYTYE

SEQ ID NO: 1949791 - protein, 9 aa, Staphylococcus
IDKAELDQK

SEQ ID NO: 1949792 - protein, 9 aa, Staphylococcus
IDKAELDQT

SEQ ID NO: 1949793 - protein, 7 aa, Staphylococcus
IDKANGE

SEQ ID NO: 1949794 - protein, 8 aa, Staphylococcus
IDKANGEV

SEQ ID NO: 1949795 - protein, 5 aa, Staphylococcus
IDKAT

SEQ ID NO: 1949796 - protein, 10 aa, Staphylococcus
IDKDAKGINH

SEQ ID NO: 1949797 - protein, 12 aa, Staphylococcus
IDKDGEAHPLTQ

SEQ ID NO: 1949798 - protein, 12 aa, Staphylococcus
IDKDGNTHPLTQ

SEQ ID NO: 1949799 - protein, 18 aa, Staphylococcus
IDKDGPTGTFIDSNGSMP

SEQ ID NO: 1949800 - protein, 9 aa, Staphylococcus
IDKDKGEVK

SEQ ID NO: 1949801 - protein, 6 aa, Staphylococcus
IDKEPY

SEQ ID NO: 1949802 - protein, 13 aa, Staphylococcus
IDKEQFEDLTKQF

SEQ ID NO: 1949803 - protein, 17 aa, Staphylococcus
IDKESAIEKGLESDIAG

SEQ ID NO: 1949804 - protein, 19 aa, Staphylococcus
IDKESPVEKSFSEYEGSLE

SEQ ID NO: 1949805 - protein, 6 aa, Staphylococcus
IDKHTT

SEQ ID NO: 1949806 - protein, 11 aa, Staphylococcus
IDKKNDYLETA

SEQ ID NO: 1949807 - protein, 9 aa, Staphylococcus
IDKNELDQT

SEQ ID NO: 1949808 - protein, 18 aa, Staphylococcus
IDKNGPTGKFIGVDGEMP

SEQ ID NO: 1949809 - protein, 18 aa, Staphylococcus
IDKNGPTGTFIDGNGTMP

SEQ ID NO: 1949810 - protein, 9 aa, Staphylococcus
IDKNKRHAL

SEQ ID NO: 1949811 - protein, 8 aa, Staphylococcus
IDKPGSDI

SEQ ID NO: 1949812 - protein, 11 aa, Staphylococcus
IDKPTANPDRV

SEQ ID NO: 1949813 - protein, 11 aa, Staphylococcus
IDKPTSNPDRV

SEQ ID NO: 1949814 - protein, 9 aa, Staphylococcus
IDKQEMKQR

SEQ ID NO: 1949815 - protein, 17 aa, Staphylococcus
IDKQGRVNASHKALDEN

SEQ ID NO: 1949816 - protein, 16 aa, Staphylococcus
IDKQGRVNASHKALLD

SEQ ID NO: 1949817 - protein, 15 aa, Staphylococcus
IDKQGRVNASHKVLD

SEQ ID NO: 1949818 - protein, 22 aa, Staphylococcus
IDKRHKEEEKVQEKNKKARLSE

SEQ ID NO: 1949819 - protein, 30 aa, Staphylococcus
IDKRRKEEEKARQENEKQRIKDMKKSNKHM

SEQ ID NO: 1949820 - protein, 11 aa, Staphylococcus
IDKSDKRRGRL

SEQ ID NO: 1949821 - protein, 9 aa, Staphylococcus
IDKTELDQT

SEQ ID NO: 1949822 - protein, 8 aa, Staphylococcus
IDKTKGEV

SEQ ID NO: 1949823 - protein, 8 aa, Staphylococcus
IDKTTTQY

SEQ ID NO: 1949824 - protein, 6 aa, Staphylococcus
IDLDGK

SEQ ID NO: 1949825 - protein, 5 aa, Staphylococcus
IDLND

SEQ ID NO: 1949826 - protein, 18 aa, Staphylococcus
IDLPEKPHLGVPADEEVN

SEQ ID NO: 1949827 - protein, 9 aa, Staphylococcus
IDMPSLSED

SEQ ID NO: 1949828 - protein, 7 aa, Staphylococcus
IDMTSPG

SEQ ID NO: 1949829 - protein, 28 aa, Staphylococcus
IDNDQQQNSNVKESKDQKGKASDSQKGT

SEQ ID NO: 1949830 - protein, 6 aa, Staphylococcus
IDNDRY

SEQ ID NO: 1949831 - protein, 12 aa, Staphylococcus
IDNDSNTSNASM

SEQ ID NO: 1949832 - protein, 4 aa, Staphylococcus
IDNE

SEQ ID NO: 1949833 - protein, 5 aa, Staphylococcus
IDNEE

SEQ ID NO: 1949834 - protein, 5 aa, Staphylococcus
IDNEI

SEQ ID NO: 1949835 - protein, 21 aa, Staphylococcus
IDNENKARQSNATDYLESGST

SEQ ID NO: 1949836 - protein, 9 aa, Staphylococcus
IDNGEIGEI

SEQ ID NO: 1949837 - protein, 8 aa, Staphylococcus
IDNGKGVT

SEQ ID NO: 1949838 - protein, 5 aa, Staphylococcus
IDNLS

SEQ ID NO: 1949839 - protein, 4 aa, Staphylococcus
IDNN

SEQ ID NO: 1949840 - protein, 7 aa, Staphylococcus
IDNNEKW

SEQ ID NO: 1949841 - protein, 6 aa, Staphylococcus
IDNNGG

SEQ ID NO: 1949842 - protein, 6 aa, Staphylococcus
IDNPGA

SEQ ID NO: 1949843 - protein, 8 aa, Staphylococcus
IDNPLTES

SEQ ID NO: 1949844 - protein, 7 aa, Staphylococcus
IDNPNEV

SEQ ID NO: 1949845 - protein, 14 aa, Staphylococcus
IDNPSDAVKVGDEI

SEQ ID NO: 1949846 - protein, 10 aa, Staphylococcus
IDNQKKDFKR
